United States Patent 7,341,835 (METHODS OF ANALYSIS OF ALTERNATIVE SPLICING IN MOUSE) - sequence listing, part 20

SEQ ID NO: 758487 - DNA, 25 bp, Mus musculus
tatggtggccatgagaaagctgtcg

SEQ ID NO: 758488 - DNA, 25 bp, Mus musculus
tatggtggcccacaatcctggagtc

SEQ ID NO: 758489 - DNA, 25 bp, Mus musculus
tatggtggcccagaatcctggagtc

SEQ ID NO: 758490 - DNA, 25 bp, Mus musculus
tatggtggcccgcagtattctcaac

SEQ ID NO: 758491 - DNA, 25 bp, Mus musculus
tatggtggcccggagtattctcaac

SEQ ID NO: 758492 - DNA, 25 bp, Mus musculus
tatggtgggctccattgacaatgac

SEQ ID NO: 758493 - DNA, 25 bp, Mus musculus
tatggtgggctcgattgacaatgac

SEQ ID NO: 758494 - DNA, 25 bp, Mus musculus
tatggtgggtcaacagcagccagct

SEQ ID NO: 758495 - DNA, 25 bp, Mus musculus
tatggtgggtcatcagcagccagct

SEQ ID NO: 758496 - DNA, 25 bp, Mus musculus
tatggtgggtctcttgttatgatac

SEQ ID NO: 758497 - DNA, 25 bp, Mus musculus
tatggtgggtctgttgttatgatac

SEQ ID NO: 758498 - DNA, 25 bp, Mus musculus
tatggtggtgatcagaactatagtg

SEQ ID NO: 758499 - DNA, 25 bp, Mus musculus
tatggtggtgatgagaactatagtg

SEQ ID NO: 758500 - DNA, 25 bp, Mus musculus
tatggtggttaaagctggctgccct

SEQ ID NO: 758501 - DNA, 25 bp, Mus musculus
tatggtggttaatgctggctgccct

SEQ ID NO: 758502 - DNA, 25 bp, Mus musculus
tatggtgtaactcgatcccgctcgg

SEQ ID NO: 758503 - DNA, 25 bp, Mus musculus
tatggtgtaactggatcccgctcgg

SEQ ID NO: 758504 - DNA, 25 bp, Mus musculus
tatggtgtccacatcactttaaggg

SEQ ID NO: 758505 - DNA, 25 bp, Mus musculus
tatggtgtccacttcactttaaggg

SEQ ID NO: 758506 - DNA, 25 bp, Mus musculus
tatggtgtccgaaactggagactcc

SEQ ID NO: 758507 - DNA, 25 bp, Mus musculus
tatggtgtccgatactggagactcc

SEQ ID NO: 758508 - DNA, 25 bp, Mus musculus
tatggtgtgaaccaagcccaggtgc

SEQ ID NO: 758509 - DNA, 25 bp, Mus musculus
tatggtgtgaacgaagcccaggtgc

SEQ ID NO: 758510 - DNA, 25 bp, Mus musculus
tatggtgtgcagagatgtgtctgct

SEQ ID NO: 758511 - DNA, 25 bp, Mus musculus
tatggtgtgcagtgatgtgtctgct

SEQ ID NO: 758512 - DNA, 25 bp, Mus musculus
tatggtgtgggtccaggtttctttt

SEQ ID NO: 758513 - DNA, 25 bp, Mus musculus
tatggtgtgggtgcaggtttctttt

SEQ ID NO: 758514 - DNA, 25 bp, Mus musculus
tatggtgtggtaaaggcctacacca

SEQ ID NO: 758515 - DNA, 25 bp, Mus musculus
tatggtgtggtataggcctacacca

SEQ ID NO: 758516 - DNA, 25 bp, Mus musculus
tatggtgtggtgaccacatatgata

SEQ ID NO: 758517 - DNA, 25 bp, Mus musculus
tatggtgtggtgtccacatatgata

SEQ ID NO: 758518 - DNA, 25 bp, Mus musculus
tatggttacaacactcagtatgatg

SEQ ID NO: 758519 - DNA, 25 bp, Mus musculus
tatggttacaactctcagtatgatg

SEQ ID NO: 758520 - DNA, 25 bp, Mus musculus
tatggttagcatatacgcactacat

SEQ ID NO: 758521 - DNA, 25 bp, Mus musculus
tatggttagcatttacgcactacat

SEQ ID NO: 758522 - DNA, 25 bp, Mus musculus
tatggttcatgtagaacggttcaca

SEQ ID NO: 758523 - DNA, 25 bp, Mus musculus
tatggttcatgttgaacggttcaca

SEQ ID NO: 758524 - DNA, 25 bp, Mus musculus
tatggttctgaccagctcgtggtgc

SEQ ID NO: 758525 - DNA, 25 bp, Mus musculus
tatggttctgacgagctcgtggtgc

SEQ ID NO: 758526 - DNA, 25 bp, Mus musculus
tatggttctgttcgcataccctcgt

SEQ ID NO: 758527 - DNA, 25 bp, Mus musculus
tatggttctgttggcataccctcgt

SEQ ID NO: 758528 - DNA, 25 bp, Mus musculus
tatggttgatagagtggtcagcctt

SEQ ID NO: 758529 - DNA, 25 bp, Mus musculus
tatggttgatagtgtggtcagcctt

SEQ ID NO: 758530 - DNA, 25 bp, Mus musculus
tatggttgctacctggtcagcgtgc

SEQ ID NO: 758531 - DNA, 25 bp, Mus musculus
tatggttgctacgtggtcagcgtgc

SEQ ID NO: 758532 - DNA, 25 bp, Mus musculus
tatggttgtctaatcggtaatctcc

SEQ ID NO: 758533 - DNA, 25 bp, Mus musculus
tatggttgtctattcggtaatctcc

SEQ ID NO: 758534 - DNA, 25 bp, Mus musculus
tatggtttcccaaaaggagcctctg

SEQ ID NO: 758535 - DNA, 25 bp, Mus musculus
tatggtttcccataaggagcctctg

SEQ ID NO: 758536 - DNA, 25 bp, Mus musculus
tatggtttcctcacggccatgttca

SEQ ID NO: 758537 - DNA, 25 bp, Mus musculus
tatggtttcctctcggccatgttca

SEQ ID NO: 758538 - DNA, 25 bp, Mus musculus
tatggttttatgcatgggaccccag

SEQ ID NO: 758539 - DNA, 25 bp, Mus musculus
tatggttttatggatgggaccccag

SEQ ID NO: 758540 - DNA, 25 bp, Mus musculus
tatggttttgttcactttgacagtc

SEQ ID NO: 758541 - DNA, 25 bp, Mus musculus
tatggttttgttgactttgacagtc

SEQ ID NO: 758542 - DNA, 25 bp, Mus musculus
tatggtttttgcacacagaatggat

SEQ ID NO: 758543 - DNA, 25 bp, Mus musculus
tatggtttttgctcacagaatggat

SEQ ID NO: 758544 - DNA, 25 bp, Mus musculus
tatgtaaaggatattccagccaccc

SEQ ID NO: 758545 - DNA, 25 bp, Mus musculus
tatgtaaaggattttccagccaccc

SEQ ID NO: 758546 - DNA, 25 bp, Mus musculus
tatgtaaatggacagactatcactt

SEQ ID NO: 758547 - DNA, 25 bp, Mus musculus
tatgtaaatggagagactatcactt

SEQ ID NO: 758548 - DNA, 25 bp, Mus musculus
tatgtaatctacacatccatgctgt

SEQ ID NO: 758549 - DNA, 25 bp, Mus musculus
tatgtaatctactcatccatgctgt

SEQ ID NO: 758550 - DNA, 25 bp, Mus musculus
tatgtacaaaaaagccaggaactgg

SEQ ID NO: 758551 - DNA, 25 bp, Mus musculus
tatgtacaaaaatgccaggaactgg

SEQ ID NO: 758552 - DNA, 25 bp, Mus musculus
tatgtacaacctcagatgcgctgcg

SEQ ID NO: 758553 - DNA, 25 bp, Mus musculus
tatgtacaacctgagatgcgctgcg

SEQ ID NO: 758554 - DNA, 25 bp, Mus musculus
tatgtacaacttcacccacttggat

SEQ ID NO: 758555 - DNA, 25 bp, Mus musculus
tatgtacaacttgacccacttggat

SEQ ID NO: 758556 - DNA, 25 bp, Mus musculus
tatgtacaccagcaacgcaaaggca

SEQ ID NO: 758557 - DNA, 25 bp, Mus musculus
tatgtacaccaggaacgcaaaggca

SEQ ID NO: 758558 - DNA, 25 bp, Mus musculus
tatgtacatacaaccctaggctgat

SEQ ID NO: 758559 - DNA, 25 bp, Mus musculus
tatgtacatacatccctaggctgat

SEQ ID NO: 758560 - DNA, 25 bp, Mus musculus
tatgtacatctacctggtccaccag

SEQ ID NO: 758561 - DNA, 25 bp, Mus musculus
tatgtacatctagctggtccaccag

SEQ ID NO: 758562 - DNA, 25 bp, Mus musculus
tatgtacatgagacactgactgtgt

SEQ ID NO: 758563 - DNA, 25 bp, Mus musculus
tatgtacatgagtcactgactgtgt

SEQ ID NO: 758564 - DNA, 25 bp, Mus musculus
tatgtacccatgcaaggtgcatcaa

SEQ ID NO: 758565 - DNA, 25 bp, Mus musculus
tatgtacccatggaaggtgcatcaa

SEQ ID NO: 758566 - DNA, 25 bp, Mus musculus
tatgtacccctgacctacaacaaag

SEQ ID NO: 758567 - DNA, 25 bp, Mus musculus
tatgtacccctgtcctacaacaaag

SEQ ID NO: 758568 - DNA, 25 bp, Mus musculus
tatgtaccctataatatcctgacac

SEQ ID NO: 758569 - DNA, 25 bp, Mus musculus
tatgtaccctattatatcctgacac

SEQ ID NO: 758570 - DNA, 25 bp, Mus musculus
tatgtacctatgctgagaatcgtgc

SEQ ID NO: 758571 - DNA, 25 bp, Mus musculus
tatgtacctatggtgagaatcgtgc

SEQ ID NO: 758572 - DNA, 25 bp, Mus musculus
tatgtacgaggtcacccttaagagc

SEQ ID NO: 758573 - DNA, 25 bp, Mus musculus
tatgtacgaggtgacccttaagagc

SEQ ID NO: 758574 - DNA, 25 bp, Mus musculus
tatgtactaccgaggatctgctgca

SEQ ID NO: 758575 - DNA, 25 bp, Mus musculus
tatgtactaccgtggatctgctgca

SEQ ID NO: 758576 - DNA, 25 bp, Mus musculus
tatgtactgactcaagctcggatgg

SEQ ID NO: 758577 - DNA, 25 bp, Mus musculus
tatgtactgactgaagctcggatgg

SEQ ID NO: 758578 - DNA, 25 bp, Mus musculus
tatgtactgcatcctgtttgtcgca

SEQ ID NO: 758579 - DNA, 25 bp, Mus musculus
tatgtactgcatgctgtttgtcgca

SEQ ID NO: 758580 - DNA, 25 bp, Mus musculus
tatgtagacagtccactgaagccac

SEQ ID NO: 758581 - DNA, 25 bp, Mus musculus
tatgtagacagtgcactgaagccac

SEQ ID NO: 758582 - DNA, 25 bp, Mus musculus
tatgtagaggccacaaatgccattg

SEQ ID NO: 758583 - DNA, 25 bp, Mus musculus
tatgtagaggcctcaaatgccattg

SEQ ID NO: 758584 - DNA, 25 bp, Mus musculus
tatgtagagttccttcctcctagga

SEQ ID NO: 758585 - DNA, 25 bp, Mus musculus
tatgtagagttcgttcctcctagga

SEQ ID NO: 758586 - DNA, 25 bp, Mus musculus
tatgtagagttgcatgttacagtca

SEQ ID NO: 758587 - DNA, 25 bp, Mus musculus
tatgtagagttggatgttacagtca

SEQ ID NO: 758588 - DNA, 25 bp, Mus musculus
tatgtagctgatcagattgtgagca

SEQ ID NO: 758589 - DNA, 25 bp, Mus musculus
tatgtagctgatgagattgtgagca

SEQ ID NO: 758590 - DNA, 25 bp, Mus musculus
tatgtaggatttagtatgaagtttg

SEQ ID NO: 758591 - DNA, 25 bp, Mus musculus
tatgtaggattttgtatgaagtttg

SEQ ID NO: 758592 - DNA, 25 bp, Mus musculus
tatgtagggcaaaatgagccagagc

SEQ ID NO: 758593 - DNA, 25 bp, Mus musculus
tatgtagggcaatatgagccagagc

SEQ ID NO: 758594 - DNA, 25 bp, Mus musculus
tatgtagtcagtcagccgctgggcc

SEQ ID NO: 758595 - DNA, 25 bp, Mus musculus
tatgtagtcagtgagccgctgggcc

SEQ ID NO: 758596 - DNA, 25 bp, Mus musculus
tatgtagttaggctgtgctacagcc

SEQ ID NO: 758597 - DNA, 25 bp, Mus musculus
tatgtagttagggtgtgctacagcc

SEQ ID NO: 758598 - DNA, 25 bp, Mus musculus
tatgtataacaacgtgaatagtgtc

SEQ ID NO: 758599 - DNA, 25 bp, Mus musculus
tatgtataacaaggtgaatagtgtc

SEQ ID NO: 758600 - DNA, 25 bp, Mus musculus
tatgtatagcttcaacaaaactcag

SEQ ID NO: 758601 - DNA, 25 bp, Mus musculus
tatgtatagcttgaacaaaactcag

SEQ ID NO: 758602 - DNA, 25 bp, Mus musculus
tatgtatatgagaatctactgcatg

SEQ ID NO: 758603 - DNA, 25 bp, Mus musculus
tatgtatatgagtatctactgcatg

SEQ ID NO: 758604 - DNA, 25 bp, Mus musculus
tatgtatctgtaccagaggagaacc

SEQ ID NO: 758605 - DNA, 25 bp, Mus musculus
tatgtatctgtagcagaggagaacc

SEQ ID NO: 758606 - DNA, 25 bp, Mus musculus
tatgtatgaaacactatggaaatcc

SEQ ID NO: 758607 - DNA, 25 bp, Mus musculus
tatgtatgaaactctatggaaatcc

SEQ ID NO: 758608 - DNA, 25 bp, Mus musculus
tatgtatgaaccatttgctgctcga

SEQ ID NO: 758609 - DNA, 25 bp, Mus musculus
tatgtatgaaccttttgctgctcga

SEQ ID NO: 758610 - DNA, 25 bp, Mus musculus
tatgtatgccaacgagaccgtaggc

SEQ ID NO: 758611 - DNA, 25 bp, Mus musculus
tatgtatgccaaggagaccgtaggc

SEQ ID NO: 758612 - DNA, 25 bp, Mus musculus
tatgtatggcccacaggtctcgttc

SEQ ID NO: 758613 - DNA, 25 bp, Mus musculus
tatgtatggccctcaggtctcgttc

SEQ ID NO: 758614 - DNA, 25 bp, Mus musculus
tatgtatggccgcagctcccaggcc

SEQ ID NO: 758615 - DNA, 25 bp, Mus musculus
tatgtatggccggagctcccaggcc

SEQ ID NO: 758616 - DNA, 25 bp, Mus musculus
tatgtatgggctctatgagtacctc

SEQ ID NO: 758617 - DNA, 25 bp, Mus musculus
tatgtatgggctgtatgagtacctc

SEQ ID NO: 758618 - DNA, 25 bp, Mus musculus
tatgtattacccaagaagcccaaaa

SEQ ID NO: 758619 - DNA, 25 bp, Mus musculus
tatgtattaccctagaagcccaaaa

SEQ ID NO: 758620 - DNA, 25 bp, Mus musculus
tatgtattcgaacttagctgtgcag

SEQ ID NO: 758621 - DNA, 25 bp, Mus musculus
tatgtattcgaagttagctgtgcag

SEQ ID NO: 758622 - DNA, 25 bp, Mus musculus
tatgtatttccgatttgcccagaag

SEQ ID NO: 758623 - DNA, 25 bp, Mus musculus
tatgtatttccgttttgcccagaag

SEQ ID NO: 758624 - DNA, 25 bp, Mus musculus
tatgtcaaatgcaagaagtgcacgg

SEQ ID NO: 758625 - DNA, 25 bp, Mus musculus
tatgtcaaatgctagaagtgcacgg

SEQ ID NO: 758626 - DNA, 25 bp, Mus musculus
tatgtcaacggcaagaaagtcactg

SEQ ID NO: 758627 - DNA, 25 bp, Mus musculus
tatgtcaacggctagaaagtcactg

SEQ ID NO: 758628 - DNA, 25 bp, Mus musculus
tatgtcaagtcacaaggccaagtgc

SEQ ID NO: 758629 - DNA, 25 bp, Mus musculus
tatgtcaagtcagaaggccaagtgc

SEQ ID NO: 758630 - DNA, 25 bp, Mus musculus
tatgtcaatcaaaatgctaagtggt

SEQ ID NO: 758631 - DNA, 25 bp, Mus musculus
tatgtcaatcaatatgctaagtggt

SEQ ID NO: 758632 - DNA, 25 bp, Mus musculus
tatgtcaatgcccatatggtctgcc

SEQ ID NO: 758633 - DNA, 25 bp, Mus musculus
tatgtcaatgccgatatggtctgcc

SEQ ID NO: 758634 - DNA, 25 bp, Mus musculus
tatgtcaatgggactgatcaggaag

SEQ ID NO: 758635 - DNA, 25 bp, Mus musculus
tatgtcaatgggtctgatcaggaag

SEQ ID NO: 758636 - DNA, 25 bp, Mus musculus
tatgtcaattctacatcagaagaga

SEQ ID NO: 758637 - DNA, 25 bp, Mus musculus
tatgtcaattcttcatcagaagaga

SEQ ID NO: 758638 - DNA, 25 bp, Mus musculus
tatgtcacaagaagccgaatcagcc

SEQ ID NO: 758639 - DNA, 25 bp, Mus musculus
tatgtcacaagatgccgaatcagcc

SEQ ID NO: 758640 - DNA, 25 bp, Mus musculus
tatgtcaccagtagtttctgaacac

SEQ ID NO: 758641 - DNA, 25 bp, Mus musculus
tatgtcaccagttgtttctgaacac

SEQ ID NO: 758642 - DNA, 25 bp, Mus musculus
tatgtcaccgaacagatcaggaacc

SEQ ID NO: 758643 - DNA, 25 bp, Mus musculus
tatgtcaccgaagagatcaggaacc

SEQ ID NO: 758644 - DNA, 25 bp, Mus musculus
tatgtcaccgttcaaaagaactggt

SEQ ID NO: 758645 - DNA, 25 bp, Mus musculus
tatgtcaccgttgaaaagaactggt

SEQ ID NO: 758646 - DNA, 25 bp, Mus musculus
tatgtcacgctacacaaaggctgct

SEQ ID NO: 758647 - DNA, 25 bp, Mus musculus
tatgtcacgctagacaaaggctgct

SEQ ID NO: 758648 - DNA, 25 bp, Mus musculus
tatgtcactcacataggaggcggag

SEQ ID NO: 758649 - DNA, 25 bp, Mus musculus
tatgtcactcacttaggaggcggag

SEQ ID NO: 758650 - DNA, 25 bp, Mus musculus
tatgtcactcagcacatcagcagcc

SEQ ID NO: 758651 - DNA, 25 bp, Mus musculus
tatgtcactcaggacatcagcagcc

SEQ ID NO: 758652 - DNA, 25 bp, Mus musculus
tatgtcagaagccagatcatttccc

SEQ ID NO: 758653 - DNA, 25 bp, Mus musculus
tatgtcagaagcgagatcatttccc

SEQ ID NO: 758654 - DNA, 25 bp, Mus musculus
tatgtcagcacacacttacagagca

SEQ ID NO: 758655 - DNA, 25 bp, Mus musculus
tatgtcagcacagacttacagagca

SEQ ID NO: 758656 - DNA, 25 bp, Mus musculus
tatgtcagggtcaggtttcttggga

SEQ ID NO: 758657 - DNA, 25 bp, Mus musculus
tatgtcagggtctggtttcttggga

SEQ ID NO: 758658 - DNA, 25 bp, Mus musculus
tatgtcagtacaaggacaagcaccc

SEQ ID NO: 758659 - DNA, 25 bp, Mus musculus
tatgtcagtacatggacaagcaccc

SEQ ID NO: 758660 - DNA, 25 bp, Mus musculus
tatgtcagtagcacagaggcgatgt

SEQ ID NO: 758661 - DNA, 25 bp, Mus musculus
tatgtcagtagctcagaggcgatgt

SEQ ID NO: 758662 - DNA, 25 bp, Mus musculus
tatgtcagtagtcgaccttcccaac

SEQ ID NO: 758663 - DNA, 25 bp, Mus musculus
tatgtcagtagtggaccttcccaac

SEQ ID NO: 758664 - DNA, 25 bp, Mus musculus
tatgtcagtgagctccgcttcgccc

SEQ ID NO: 758665 - DNA, 25 bp, Mus musculus
tatgtcagtgaggtccgcttcgccc

SEQ ID NO: 758666 - DNA, 25 bp, Mus musculus
tatgtcatcagtctggtgttccggc

SEQ ID NO: 758667 - DNA, 25 bp, Mus musculus
tatgtcatcagtgtggtgttccggc

SEQ ID NO: 758668 - DNA, 25 bp, Mus musculus
tatgtcatccagcttaccgatggca

SEQ ID NO: 758669 - DNA, 25 bp, Mus musculus
tatgtcatccaggttaccgatggca

SEQ ID NO: 758670 - DNA, 25 bp, Mus musculus
tatgtcatcctaaagactgtgcagc

SEQ ID NO: 758671 - DNA, 25 bp, Mus musculus
tatgtcatcctatagactgtgcagc

SEQ ID NO: 758672 - DNA, 25 bp, Mus musculus
tatgtcatggatcaaagaaggagag

SEQ ID NO: 758673 - DNA, 25 bp, Mus musculus
tatgtcatggatgaaagaaggagag

SEQ ID NO: 758674 - DNA, 25 bp, Mus musculus
tatgtcatggccatcacgctggacg

SEQ ID NO: 758675 - DNA, 25 bp, Mus musculus
tatgtcatggccttcacgctggacg

SEQ ID NO: 758676 - DNA, 25 bp, Mus musculus
tatgtcattgaaaaccaggcggccg

SEQ ID NO: 758677 - DNA, 25 bp, Mus musculus
tatgtcattgaataccaggcggccg

SEQ ID NO: 758678 - DNA, 25 bp, Mus musculus
tatgtcattttacctccattgaagt

SEQ ID NO: 758679 - DNA, 25 bp, Mus musculus
tatgtcattttagctccattgaagt

SEQ ID NO: 758680 - DNA, 25 bp, Mus musculus
tatgtccaaaacagtcaaagtaggc

SEQ ID NO: 758681 - DNA, 25 bp, Mus musculus
tatgtccaaaactgtcaaagtaggc

SEQ ID NO: 758682 - DNA, 25 bp, Mus musculus
tatgtccaagggaatcctagatgat

SEQ ID NO: 758683 - DNA, 25 bp, Mus musculus
tatgtccaagggtatcctagatgat

SEQ ID NO: 758684 - DNA, 25 bp, Mus musculus
tatgtccaccctctgcggcgaggga

SEQ ID NO: 758685 - DNA, 25 bp, Mus musculus
tatgtccaccctgtgcggcgaggga

SEQ ID NO: 758686 - DNA, 25 bp, Mus musculus
tatgtccagtcgctcatggctgagc

SEQ ID NO: 758687 - DNA, 25 bp, Mus musculus
tatgtccagtcggtcatggctgagc

SEQ ID NO: 758688 - DNA, 25 bp, Mus musculus
tatgtccatcgactggttgcaagca

SEQ ID NO: 758689 - DNA, 25 bp, Mus musculus
tatgtccatcgagtggttgcaagca

SEQ ID NO: 758690 - DNA, 25 bp, Mus musculus
tatgtcccagctctcatatttggac

SEQ ID NO: 758691 - DNA, 25 bp, Mus musculus
tatgtcccagctgtcatatttggac

SEQ ID NO: 758692 - DNA, 25 bp, Mus musculus
tatgtcccatggcatcctggaagga

SEQ ID NO: 758693 - DNA, 25 bp, Mus musculus
tatgtcccatgggatcctggaagga

SEQ ID NO: 758694 - DNA, 25 bp, Mus musculus
tatgtccccagaattgtgtttgtag

SEQ ID NO: 758695 - DNA, 25 bp, Mus musculus
tatgtccccagatttgtgtttgtag

SEQ ID NO: 758696 - DNA, 25 bp, Mus musculus
tatgtcccctagagaaaaactgtca

SEQ ID NO: 758697 - DNA, 25 bp, Mus musculus
tatgtcccctagtgaaaaactgtca

SEQ ID NO: 758698 - DNA, 25 bp, Mus musculus
tatgtcccctgaccagagcacaagg

SEQ ID NO: 758699 - DNA, 25 bp, Mus musculus
tatgtcccctgagcagagcacaagg

SEQ ID NO: 758700 - DNA, 25 bp, Mus musculus
tatgtcccttgtcaatggctgggaa

SEQ ID NO: 758701 - DNA, 25 bp, Mus musculus
tatgtcccttgtgaatggctgggaa

SEQ ID NO: 758702 - DNA, 25 bp, Mus musculus
tatgtccgaatcctggcttcatgga

SEQ ID NO: 758703 - DNA, 25 bp, Mus musculus
tatgtccgaatcgtggcttcatgga

SEQ ID NO: 758704 - DNA, 25 bp, Mus musculus
tatgtccgcatgaacttctttggtc

SEQ ID NO: 758705 - DNA, 25 bp, Mus musculus
tatgtccgcatgtacttctttggtc

SEQ ID NO: 758706 - DNA, 25 bp, Mus musculus
tatgtccgttgtcagatggaaggat

SEQ ID NO: 758707 - DNA, 25 bp, Mus musculus
tatgtccgttgtgagatggaaggat

SEQ ID NO: 758708 - DNA, 25 bp, Mus musculus
tatgtcctcaacacctgcgggcagg

SEQ ID NO: 758709 - DNA, 25 bp, Mus musculus
tatgtcctcaactcctgcgggcagg

SEQ ID NO: 758710 - DNA, 25 bp, Mus musculus
tatgtcctcaagaacctgcggagac

SEQ ID NO: 758711 - DNA, 25 bp, Mus musculus
tatgtcctcaagtacctgcggagac

SEQ ID NO: 758712 - DNA, 25 bp, Mus musculus
tatgtcctcagaccaattggtaccg

SEQ ID NO: 758713 - DNA, 25 bp, Mus musculus
tatgtcctcagagcaattggtaccg

SEQ ID NO: 758714 - DNA, 25 bp, Mus musculus
tatgtcctcggtctactaaggccca

SEQ ID NO: 758715 - DNA, 25 bp, Mus musculus
tatgtcctcggtgtactaaggccca

SEQ ID NO: 758716 - DNA, 25 bp, Mus musculus
tatgtcctcgtccacgagttgccca

SEQ ID NO: 758717 - DNA, 25 bp, Mus musculus
tatgtcctcgtcgacgagttgccca

SEQ ID NO: 758718 - DNA, 25 bp, Mus musculus
tatgtcctgaagcacaggttttctg

SEQ ID NO: 758719 - DNA, 25 bp, Mus musculus
tatgtcctgaaggacaggttttctg

SEQ ID NO: 758720 - DNA, 25 bp, Mus musculus
tatgtcctgggactccgttaccatg

SEQ ID NO: 758721 - DNA, 25 bp, Mus musculus
tatgtcctgggagtccgttaccatg

SEQ ID NO: 758722 - DNA, 25 bp, Mus musculus
tatgtccttcggagttacctggtgg

SEQ ID NO: 758723 - DNA, 25 bp, Mus musculus
tatgtccttcggtgttacctggtgg

SEQ ID NO: 758724 - DNA, 25 bp, Mus musculus
tatgtcctttctctatattctgacg

SEQ ID NO: 758725 - DNA, 25 bp, Mus musculus
tatgtcctttctgtatattctgacg

SEQ ID NO: 758726 - DNA, 25 bp, Mus musculus
tatgtcctttgtccccacctgggat

SEQ ID NO: 758727 - DNA, 25 bp, Mus musculus
tatgtcctttgtgcccacctgggat

SEQ ID NO: 758728 - DNA, 25 bp, Mus musculus
tatgtcgacacacctgtgcgccatg

SEQ ID NO: 758729 - DNA, 25 bp, Mus musculus
tatgtcgacacagctgtgcgccatg

SEQ ID NO: 758730 - DNA, 25 bp, Mus musculus
tatgtcgccctgacgagagagtttg

SEQ ID NO: 758731 - DNA, 25 bp, Mus musculus
tatgtcgccctgtcgagagagtttg

SEQ ID NO: 758732 - DNA, 25 bp, Mus musculus
tatgtcgctgccctgtgcggaaaag

SEQ ID NO: 758733 - DNA, 25 bp, Mus musculus
tatgtcgctgccgtgtgcggaaaag

SEQ ID NO: 758734 - DNA, 25 bp, Mus musculus
tatgtcggcctcagacgagctggat

SEQ ID NO: 758735 - DNA, 25 bp, Mus musculus
tatgtcggcctctgacgagctggat

SEQ ID NO: 758736 - DNA, 25 bp, Mus musculus
tatgtcggctatatgcacaaacgga

SEQ ID NO: 758737 - DNA, 25 bp, Mus musculus
tatgtcggctatttgcacaaacgga

SEQ ID NO: 758738 - DNA, 25 bp, Mus musculus
tatgtcgttcaacgagctagaggca

SEQ ID NO: 758739 - DNA, 25 bp, Mus musculus
tatgtcgttcaaggagctagaggca

SEQ ID NO: 758740 - DNA, 25 bp, Mus musculus
tatgtctaatgtaaaagggagctgc

SEQ ID NO: 758741 - DNA, 25 bp, Mus musculus
tatgtctaatgttaaagggagctgc

SEQ ID NO: 758742 - DNA, 25 bp, Mus musculus
tatgtctaatttcgttcttctgggt

SEQ ID NO: 758743 - DNA, 25 bp, Mus musculus
tatgtctaatttggttcttctgggt

SEQ ID NO: 758744 - DNA, 25 bp, Mus musculus
tatgtctacaagagaggattagcct

SEQ ID NO: 758745 - DNA, 25 bp, Mus musculus
tatgtctacaagtgaggattagcct

SEQ ID NO: 758746 - DNA, 25 bp, Mus musculus
tatgtctacagcatgggccagttcc

SEQ ID NO: 758747 - DNA, 25 bp, Mus musculus
tatgtctacagcttgggccagttcc

SEQ ID NO: 758748 - DNA, 25 bp, Mus musculus
tatgtctatacccagagccgaattc

SEQ ID NO: 758749 - DNA, 25 bp, Mus musculus
tatgtctataccgagagccgaattc

SEQ ID NO: 758750 - DNA, 25 bp, Mus musculus
tatgtctctactacgggccttggac

SEQ ID NO: 758751 - DNA, 25 bp, Mus musculus
tatgtctctacttcgggccttggac

SEQ ID NO: 758752 - DNA, 25 bp, Mus musculus
tatgtctcttctcccactgtaggag

SEQ ID NO: 758753 - DNA, 25 bp, Mus musculus
tatgtctcttctgccactgtaggag

SEQ ID NO: 758754 - DNA, 25 bp, Mus musculus
tatgtctgcaaacatgggcagagcc

SEQ ID NO: 758755 - DNA, 25 bp, Mus musculus
tatgtctgcaaagatgggcagagcc

SEQ ID NO: 758756 - DNA, 25 bp, Mus musculus
tatgtctggaggctaccaactcctc

SEQ ID NO: 758757 - DNA, 25 bp, Mus musculus
tatgtctggagggtaccaactcctc

SEQ ID NO: 758758 - DNA, 25 bp, Mus musculus
tatgtctgtactcgagaatcaccac

SEQ ID NO: 758759 - DNA, 25 bp, Mus musculus
tatgtctgtactggagaatcaccac

SEQ ID NO: 758760 - DNA, 25 bp, Mus musculus
tatgtctgtctgatccgctaattcc

SEQ ID NO: 758761 - DNA, 25 bp, Mus musculus
tatgtctgtctgctttaccatgtta

SEQ ID NO: 758762 - DNA, 25 bp, Mus musculus
tatgtctgtctggtttaccatgtta

SEQ ID NO: 758763 - DNA, 25 bp, Mus musculus
tatgtctgtctgttccgctaattcc

SEQ ID NO: 758764 - DNA, 25 bp, Mus musculus
tatgtcttcaaaatgagtccacgag

SEQ ID NO: 758765 - DNA, 25 bp, Mus musculus
tatgtcttcaaattgagtccacgag

SEQ ID NO: 758766 - DNA, 25 bp, Mus musculus
tatgtcttcagaaacgcaatcacag

SEQ ID NO: 758767 - DNA, 25 bp, Mus musculus
tatgtcttcagatacgcaatcacag

SEQ ID NO: 758768 - DNA, 25 bp, Mus musculus
tatgtcttctcgcaatacaacaggt

SEQ ID NO: 758769 - DNA, 25 bp, Mus musculus
tatgtcttctcggaatacaacaggt

SEQ ID NO: 758770 - DNA, 25 bp, Mus musculus
tatgtctttgacaactggcttcagg

SEQ ID NO: 758771 - DNA, 25 bp, Mus musculus
tatgtctttgactactggcttcagg

SEQ ID NO: 758772 - DNA, 25 bp, Mus musculus
tatgtgaaaacgactgagaaacttg

SEQ ID NO: 758773 - DNA, 25 bp, Mus musculus
tatgtgaaaacgtctgagaaacttg

SEQ ID NO: 758774 - DNA, 25 bp, Mus musculus
tatgtgaaccgtcgccgtcgcgcac

SEQ ID NO: 758775 - DNA, 25 bp, Mus musculus
tatgtgaaccgtggccgtcgcgcac

SEQ ID NO: 758776 - DNA, 25 bp, Mus musculus
tatgtgaatcagacctttgcccctt

SEQ ID NO: 758777 - DNA, 25 bp, Mus musculus
tatgtgaatcagtcctttgcccctt

SEQ ID NO: 758778 - DNA, 25 bp, Mus musculus
tatgtgaatcccacagtgacttagc

SEQ ID NO: 758779 - DNA, 25 bp, Mus musculus
tatgtgaatccctcagtgacttagc

SEQ ID NO: 758780 - DNA, 25 bp, Mus musculus
tatgtgaatgttatggcggtggcca

SEQ ID NO: 758781 - DNA, 25 bp, Mus musculus
tatgtgaatgttttggcggtggcca

SEQ ID NO: 758782 - DNA, 25 bp, Mus musculus
tatgtgacacagctgatatttggag

SEQ ID NO: 758783 - DNA, 25 bp, Mus musculus
tatgtgacacaggtgatatttggag

SEQ ID NO: 758784 - DNA, 25 bp, Mus musculus
tatgtgaccagcactagtgtcaacc

SEQ ID NO: 758785 - DNA, 25 bp, Mus musculus
tatgtgaccagctctagtgtcaacc

SEQ ID NO: 758786 - DNA, 25 bp, Mus musculus
tatgtgaccaggaacaagactgcag

SEQ ID NO: 758787 - DNA, 25 bp, Mus musculus
tatgtgaccaggtacaagactgcag

SEQ ID NO: 758788 - DNA, 25 bp, Mus musculus
tatgtgacctgtacttagagcaaga

SEQ ID NO: 758789 - DNA, 25 bp, Mus musculus
tatgtgacctgttcttagagcaaga

SEQ ID NO: 758790 - DNA, 25 bp, Mus musculus
tatgtgaccttcctgggatacagtg

SEQ ID NO: 758791 - DNA, 25 bp, Mus musculus
tatgtgaccttcgtgggatacagtg

SEQ ID NO: 758792 - DNA, 25 bp, Mus musculus
tatgtgagcaaactattcctggaag

SEQ ID NO: 758793 - DNA, 25 bp, Mus musculus
tatgtgagcaaagtattcctggaag

SEQ ID NO: 758794 - DNA, 25 bp, Mus musculus
tatgtgagcacaagagcttctaacc

SEQ ID NO: 758795 - DNA, 25 bp, Mus musculus
tatgtgagcacatgagcttctaacc

SEQ ID NO: 758796 - DNA, 25 bp, Mus musculus
tatgtgagctggactagcttgcttt

SEQ ID NO: 758797 - DNA, 25 bp, Mus musculus
tatgtgagctggtctagcttgcttt

SEQ ID NO: 758798 - DNA, 25 bp, Mus musculus
tatgtgaggagtcaccaagcctgtc

SEQ ID NO: 758799 - DNA, 25 bp, Mus musculus
tatgtgaggagtgaccaagcctgtc

SEQ ID NO: 758800 - DNA, 25 bp, Mus musculus
tatgtgagggccctccccaggtgct

SEQ ID NO: 758801 - DNA, 25 bp, Mus musculus
tatgtgagggccgtccccaggtgct

SEQ ID NO: 758802 - DNA, 25 bp, Mus musculus
tatgtgagtagcaccactggaggcc

SEQ ID NO: 758803 - DNA, 25 bp, Mus musculus
tatgtgagtagctccactggaggcc

SEQ ID NO: 758804 - DNA, 25 bp, Mus musculus
tatgtgagtgctatagacaacgctc

SEQ ID NO: 758805 - DNA, 25 bp, Mus musculus
tatgtgagtgctttagacaacgctc

SEQ ID NO: 758806 - DNA, 25 bp, Mus musculus
tatgtgatcagtattgagggcattg

SEQ ID NO: 758807 - DNA, 25 bp, Mus musculus
tatgtgatcagttttgagggcattg

SEQ ID NO: 758808 - DNA, 25 bp, Mus musculus
tatgtgatctggcaaaaagcaaacc

SEQ ID NO: 758809 - DNA, 25 bp, Mus musculus
tatgtgatctgggaaaaagcaaacc

SEQ ID NO: 758810 - DNA, 25 bp, Mus musculus
tatgtgatgaaacaccctgagacca

SEQ ID NO: 758811 - DNA, 25 bp, Mus musculus
tatgtgatgaaagaccctgagacca

SEQ ID NO: 758812 - DNA, 25 bp, Mus musculus
tatgtgatgggaatgggcaatgaaa

SEQ ID NO: 758813 - DNA, 25 bp, Mus musculus
tatgtgatgggattgggcaatgaaa

SEQ ID NO: 758814 - DNA, 25 bp, Mus musculus
tatgtgattaccactttcctgacac

SEQ ID NO: 758815 - DNA, 25 bp, Mus musculus
tatgtgattacctctttcctgacac

SEQ ID NO: 758816 - DNA, 25 bp, Mus musculus
tatgtgcaaagacgtgaacgacttc

SEQ ID NO: 758817 - DNA, 25 bp, Mus musculus
tatgtgcaaagaggtgaacgacttc

SEQ ID NO: 758818 - DNA, 25 bp, Mus musculus
tatgtgcaacttaccttcagagccc

SEQ ID NO: 758819 - DNA, 25 bp, Mus musculus
tatgtgcaactttccttcagagccc

SEQ ID NO: 758820 - DNA, 25 bp, Mus musculus
tatgtgcaccatcttcaaaaacagg

SEQ ID NO: 758821 - DNA, 25 bp, Mus musculus
tatgtgcaccatgttcaaaaacagg

SEQ ID NO: 758822 - DNA, 25 bp, Mus musculus
tatgtgcacccacacgccatagttg

SEQ ID NO: 758823 - DNA, 25 bp, Mus musculus
tatgtgcacccagacgccatagttg

SEQ ID NO: 758824 - DNA, 25 bp, Mus musculus
tatgtgcaccgcctcataaagggag

SEQ ID NO: 758825 - DNA, 25 bp, Mus musculus
tatgtgcaccgcgtcataaagggag

SEQ ID NO: 758826 - DNA, 25 bp, Mus musculus
tatgtgcacttcaattcaggagcca

SEQ ID NO: 758827 - DNA, 25 bp, Mus musculus
tatgtgcacttctattcaggagcca

SEQ ID NO: 758828 - DNA, 25 bp, Mus musculus
tatgtgcacttgatctatggctggc

SEQ ID NO: 758829 - DNA, 25 bp, Mus musculus
tatgtgcacttgttctatggctggc

SEQ ID NO: 758830 - DNA, 25 bp, Mus musculus
tatgtgcaggacaggattcgggccc

SEQ ID NO: 758831 - DNA, 25 bp, Mus musculus
tatgtgcaggaccttaccttggacc

SEQ ID NO: 758832 - DNA, 25 bp, Mus musculus
tatgtgcaggacgttaccttggacc

SEQ ID NO: 758833 - DNA, 25 bp, Mus musculus
tatgtgcaggactggattcgggccc

SEQ ID NO: 758834 - DNA, 25 bp, Mus musculus
tatgtgcaggagattgtgagaccag

SEQ ID NO: 758835 - DNA, 25 bp, Mus musculus
tatgtgcaggagtttgtgagaccag

SEQ ID NO: 758836 - DNA, 25 bp, Mus musculus
tatgtgccaataatctatgtccctg

SEQ ID NO: 758837 - DNA, 25 bp, Mus musculus
tatgtgccaatattctatgtccctg

SEQ ID NO: 758838 - DNA, 25 bp, Mus musculus
tatgtgccacttaaggacatcgtgg

SEQ ID NO: 758839 - DNA, 25 bp, Mus musculus
tatgtgccactttaggacatcgtgg

SEQ ID NO: 758840 - DNA, 25 bp, Mus musculus
tatgtgccaggtaagcctttctaac

SEQ ID NO: 758841 - DNA, 25 bp, Mus musculus
tatgtgccaggttagcctttctaac

SEQ ID NO: 758842 - DNA, 25 bp, Mus musculus
tatgtgccataaacgtgtggtcaga

SEQ ID NO: 758843 - DNA, 25 bp, Mus musculus
tatgtgccataatcgtgtggtcaga

SEQ ID NO: 758844 - DNA, 25 bp, Mus musculus
tatgtgcccctgctactgttctaag

SEQ ID NO: 758845 - DNA, 25 bp, Mus musculus
tatgtgcccctggtactgttctaag

SEQ ID NO: 758846 - DNA, 25 bp, Mus musculus
tatgtgcccgagaacagctctggac

SEQ ID NO: 758847 - DNA, 25 bp, Mus musculus
tatgtgcccgagtacagctctggac

SEQ ID NO: 758848 - DNA, 25 bp, Mus musculus
tatgtgcccgggactgacctgagtc

SEQ ID NO: 758849 - DNA, 25 bp, Mus musculus
tatgtgcccgggtctgacctgagtc

SEQ ID NO: 758850 - DNA, 25 bp, Mus musculus
tatgtgccggacagtcctggcttat

SEQ ID NO: 758851 - DNA, 25 bp, Mus musculus
tatgtgccggactgtcctggcttat

SEQ ID NO: 758852 - DNA, 25 bp, Mus musculus
tatgtgcctcccactgctaatttgg

SEQ ID NO: 758853 - DNA, 25 bp, Mus musculus
tatgtgcctccctctgctaatttgg

SEQ ID NO: 758854 - DNA, 25 bp, Mus musculus
tatgtgcctgctcatgacctgactg

SEQ ID NO: 758855 - DNA, 25 bp, Mus musculus
tatgtgcctgctgatgacctgactg

SEQ ID NO: 758856 - DNA, 25 bp, Mus musculus
tatgtgcgccagctcattggcatgg

SEQ ID NO: 758857 - DNA, 25 bp, Mus musculus
tatgtgcgccaggtcattggcatgg

SEQ ID NO: 758858 - DNA, 25 bp, Mus musculus
tatgtgcgctcccagaagctaagga

SEQ ID NO: 758859 - DNA, 25 bp, Mus musculus
tatgtgcgctccgagaagctaagga

SEQ ID NO: 758860 - DNA, 25 bp, Mus musculus
tatgtgcggaccagcattatggaca

SEQ ID NO: 758861 - DNA, 25 bp, Mus musculus
tatgtgcggacctgcattatggaca

SEQ ID NO: 758862 - DNA, 25 bp, Mus musculus
tatgtgcgtcttacgttgcaaagat

SEQ ID NO: 758863 - DNA, 25 bp, Mus musculus
tatgtgcgtcttatgaaatatggtg

SEQ ID NO: 758864 - DNA, 25 bp, Mus musculus
tatgtgcgtctttcgttgcaaagat

SEQ ID NO: 758865 - DNA, 25 bp, Mus musculus
tatgtgcgtcttttgaaatatggtg

SEQ ID NO: 758866 - DNA, 25 bp, Mus musculus
tatgtgcgtttgctagactttctag

SEQ ID NO: 758867 - DNA, 25 bp, Mus musculus
tatgtgcgtttggtagactttctag

SEQ ID NO: 758868 - DNA, 25 bp, Mus musculus
tatgtgctcattcgaaccggcacca

SEQ ID NO: 758869 - DNA, 25 bp, Mus musculus
tatgtgctcattggaaccggcacca

SEQ ID NO: 758870 - DNA, 25 bp, Mus musculus
tatgtgctcctcagcaatgacaatg

SEQ ID NO: 758871 - DNA, 25 bp, Mus musculus
tatgtgctcctctgcaatgacaatg

SEQ ID NO: 758872 - DNA, 25 bp, Mus musculus
tatgtgctctttaacctcgttagga

SEQ ID NO: 758873 - DNA, 25 bp, Mus musculus
tatgtgctcttttacctcgttagga

SEQ ID NO: 758874 - DNA, 25 bp, Mus musculus
tatgtgctgacacccttggctgcgc

SEQ ID NO: 758875 - DNA, 25 bp, Mus musculus
tatgtgctgacagccttggctgcgc

SEQ ID NO: 758876 - DNA, 25 bp, Mus musculus
tatgtgctgactagcaggctcacgt

SEQ ID NO: 758877 - DNA, 25 bp, Mus musculus
tatgtgctgacttgcaggctcacgt

SEQ ID NO: 758878 - DNA, 25 bp, Mus musculus
tatgtgctgggaagttacgggtatt

SEQ ID NO: 758879 - DNA, 25 bp, Mus musculus
tatgtgctgggatgttacgggtatt

SEQ ID NO: 758880 - DNA, 25 bp, Mus musculus
tatgtgctggtgcagtacgcagcca

SEQ ID NO: 758881 - DNA, 25 bp, Mus musculus
tatgtgctggtggagtacgcagcca

SEQ ID NO: 758882 - DNA, 25 bp, Mus musculus
tatgtgcttccacactgagcctggg

SEQ ID NO: 758883 - DNA, 25 bp, Mus musculus
tatgtgcttccacaggtgagggttc

SEQ ID NO: 758884 - DNA, 25 bp, Mus musculus
tatgtgcttccagactgagcctggg

SEQ ID NO: 758885 - DNA, 25 bp, Mus musculus
tatgtgcttccagaggtgagggttc

SEQ ID NO: 758886 - DNA, 25 bp, Mus musculus
tatgtgcttgtcatttttggaggcc

SEQ ID NO: 758887 - DNA, 25 bp, Mus musculus
tatgtgcttgtcttttttggaggcc

SEQ ID NO: 758888 - DNA, 25 bp, Mus musculus
tatgtggaaaaaagtgccaagcttc

SEQ ID NO: 758889 - DNA, 25 bp, Mus musculus
tatgtggaaaaatgtgccaagcttc

SEQ ID NO: 758890 - DNA, 25 bp, Mus musculus
tatgtggaaagacatactggaaacc

SEQ ID NO: 758891 - DNA, 25 bp, Mus musculus
tatgtggaaagagatactggaaacc

SEQ ID NO: 758892 - DNA, 25 bp, Mus musculus
tatgtggaccaacctgggctctaat

SEQ ID NO: 758893 - DNA, 25 bp, Mus musculus
tatgtggaccaagctgggctctaat

SEQ ID NO: 758894 - DNA, 25 bp, Mus musculus
tatgtggacgcacgcgccgagacca

SEQ ID NO: 758895 - DNA, 25 bp, Mus musculus
tatgtggacgcaggcgccgagacca

SEQ ID NO: 758896 - DNA, 25 bp, Mus musculus
tatgtggacgtcatgccttgaagac

SEQ ID NO: 758897 - DNA, 25 bp, Mus musculus
tatgtggacgtcttgccttgaagac

SEQ ID NO: 758898 - DNA, 25 bp, Mus musculus
tatgtggactttcagtctgctgaag

SEQ ID NO: 758899 - DNA, 25 bp, Mus musculus
tatgtggactttgagtctgctgaag

SEQ ID NO: 758900 - DNA, 25 bp, Mus musculus
tatgtggagtatcaaaacgagtccc

SEQ ID NO: 758901 - DNA, 25 bp, Mus musculus
tatgtggagtatgaaaacgagtccc

SEQ ID NO: 758902 - DNA, 25 bp, Mus musculus
tatgtggagtcccatgttagcaggc

SEQ ID NO: 758903 - DNA, 25 bp, Mus musculus
tatgtggagtccgatgttagcaggc

SEQ ID NO: 758904 - DNA, 25 bp, Mus musculus
tatgtggagtgtatcactggaccca

SEQ ID NO: 758905 - DNA, 25 bp, Mus musculus
tatgtggagtgtttcactggaccca

SEQ ID NO: 758906 - DNA, 25 bp, Mus musculus
tatgtggatacacgctcagcagctc

SEQ ID NO: 758907 - DNA, 25 bp, Mus musculus
tatgtggatacaggctcagcagctc

SEQ ID NO: 758908 - DNA, 25 bp, Mus musculus
tatgtggcactgaaacgaactgggc

SEQ ID NO: 758909 - DNA, 25 bp, Mus musculus
tatgtggcactgctcttctcaaagg

SEQ ID NO: 758910 - DNA, 25 bp, Mus musculus
tatgtggcactggtcttctcaaagg

SEQ ID NO: 758911 - DNA, 25 bp, Mus musculus
tatgtggcactgtaacgaactgggc

SEQ ID NO: 758912 - DNA, 25 bp, Mus musculus
tatgtggccaccagcctaagagaga

SEQ ID NO: 758913 - DNA, 25 bp, Mus musculus
tatgtggccacctgcctaagagaga

SEQ ID NO: 758914 - DNA, 25 bp, Mus musculus
tatgtggcccttcacaactgcgtgg

SEQ ID NO: 758915 - DNA, 25 bp, Mus musculus
tatgtggcccttgacaactgcgtgg

SEQ ID NO: 758916 - DNA, 25 bp, Mus musculus
tatgtggcctcacccgtgggtgtca

SEQ ID NO: 758917 - DNA, 25 bp, Mus musculus
tatgtggcctcagccgtgggtgtca

SEQ ID NO: 758918 - DNA, 25 bp, Mus musculus
tatgtggcctgtacataccagagag

SEQ ID NO: 758919 - DNA, 25 bp, Mus musculus
tatgtggcctgttcataccagagag

SEQ ID NO: 758920 - DNA, 25 bp, Mus musculus
tatgtggccttcctccgtggcttct

SEQ ID NO: 758921 - DNA, 25 bp, Mus musculus
tatgtggccttcgtccgtggcttct

SEQ ID NO: 758922 - DNA, 25 bp, Mus musculus
tatgtggctactcgctggtaccgtg

SEQ ID NO: 758923 - DNA, 25 bp, Mus musculus
tatgtggctactggctggtaccgtg

SEQ ID NO: 758924 - DNA, 25 bp, Mus musculus
tatgtggctggtccctttgacctgt

SEQ ID NO: 758925 - DNA, 25 bp, Mus musculus
tatgtggctggtgcctttgacctgt

SEQ ID NO: 758926 - DNA, 25 bp, Mus musculus
tatgtggcttggatggtccctggca

SEQ ID NO: 758927 - DNA, 25 bp, Mus musculus
tatgtggcttggttggtccctggca

SEQ ID NO: 758928 - DNA, 25 bp, Mus musculus
tatgtgggaaaaccaccgaggctgc

SEQ ID NO: 758929 - DNA, 25 bp, Mus musculus
tatgtgggaaaagcaccgaggctgc

SEQ ID NO: 758930 - DNA, 25 bp, Mus musculus
tatgtgggcaccatgattggctatg

SEQ ID NO: 758931 - DNA, 25 bp, Mus musculus
tatgtgggcaccttgattggctatg

SEQ ID NO: 758932 - DNA, 25 bp, Mus musculus
tatgtgggcagcaaggactacgtgc

SEQ ID NO: 758933 - DNA, 25 bp, Mus musculus
tatgtgggcagctaggactacgtgc

SEQ ID NO: 758934 - DNA, 25 bp, Mus musculus
tatgtgggcatgatgacaggattca

SEQ ID NO: 758935 - DNA, 25 bp, Mus musculus
tatgtgggcatgttgacaggattca

SEQ ID NO: 758936 - DNA, 25 bp, Mus musculus
tatgtgggctatacccgagtgtctg

SEQ ID NO: 758937 - DNA, 25 bp, Mus musculus
tatgtgggctattcccgagtgtctg

SEQ ID NO: 758938 - DNA, 25 bp, Mus musculus
tatgtgggtcatactcaaggctgca

SEQ ID NO: 758939 - DNA, 25 bp, Mus musculus
tatgtgggtcattctcaaggctgca

SEQ ID NO: 758940 - DNA, 25 bp, Mus musculus
tatgtggtagtcctctctcaggcac

SEQ ID NO: 758941 - DNA, 25 bp, Mus musculus
tatgtggtagtcgtctctcaggcac

SEQ ID NO: 758942 - DNA, 25 bp, Mus musculus
tatgtggtccaaaggcagcatatgt

SEQ ID NO: 758943 - DNA, 25 bp, Mus musculus
tatgtggtccaatggcagcatatgt

SEQ ID NO: 758944 - DNA, 25 bp, Mus musculus
tatgtggtccacaccaactatgacg

SEQ ID NO: 758945 - DNA, 25 bp, Mus musculus
tatgtggtccactccaactatgacg

SEQ ID NO: 758946 - DNA, 25 bp, Mus musculus
tatgtggtccagaagatgatcgatg

SEQ ID NO: 758947 - DNA, 25 bp, Mus musculus
tatgtggtccagctgttttaattga

SEQ ID NO: 758948 - DNA, 25 bp, Mus musculus
tatgtggtccaggtgttttaattga

SEQ ID NO: 758949 - DNA, 25 bp, Mus musculus
tatgtggtccagtagatgatcgatg

SEQ ID NO: 758950 - DNA, 25 bp, Mus musculus
tatgtggtggccagcatgcggatca

SEQ ID NO: 758951 - DNA, 25 bp, Mus musculus
tatgtggtggcctgcatgcggatca

SEQ ID NO: 758952 - DNA, 25 bp, Mus musculus
tatgtggttcaccaactgtgtagac

SEQ ID NO: 758953 - DNA, 25 bp, Mus musculus
tatgtggttcacgaactgtgtagac

SEQ ID NO: 758954 - DNA, 25 bp, Mus musculus
tatgtggttcgaattctaagagaag

SEQ ID NO: 758955 - DNA, 25 bp, Mus musculus
tatgtggttcgatttctaagagaag

SEQ ID NO: 758956 - DNA, 25 bp, Mus musculus
tatgtgtacaaacctgtcatggatc

SEQ ID NO: 758957 - DNA, 25 bp, Mus musculus
tatgtgtacaaagctgtcatggatc

SEQ ID NO: 758958 - DNA, 25 bp, Mus musculus
tatgtgtacactcctgagctcttcc

SEQ ID NO: 758959 - DNA, 25 bp, Mus musculus
tatgtgtacactgctgagctcttcc

SEQ ID NO: 758960 - DNA, 25 bp, Mus musculus
tatgtgtacgcacgctgcagctgca

SEQ ID NO: 758961 - DNA, 25 bp, Mus musculus
tatgtgtacgcaggctgcagctgca

SEQ ID NO: 758962 - DNA, 25 bp, Mus musculus
tatgtgtacgctcaagagcccaaca

SEQ ID NO: 758963 - DNA, 25 bp, Mus musculus
tatgtgtacgctgaagagcccaaca

SEQ ID NO: 758964 - DNA, 25 bp, Mus musculus
tatgtgtatcagagagacacggtgt

SEQ ID NO: 758965 - DNA, 25 bp, Mus musculus
tatgtgtatcagtgagacacggtgt

SEQ ID NO: 758966 - DNA, 25 bp, Mus musculus
tatgtgtatgagatgagagacaagc

SEQ ID NO: 758967 - DNA, 25 bp, Mus musculus
tatgtgtatgagttgagagacaagc

SEQ ID NO: 758968 - DNA, 25 bp, Mus musculus
tatgtgtcaatgaccggctgcggga

SEQ ID NO: 758969 - DNA, 25 bp, Mus musculus
tatgtgtcaatgagaggcactattt

SEQ ID NO: 758970 - DNA, 25 bp, Mus musculus
tatgtgtcaatgtccggctgcggga

SEQ ID NO: 758971 - DNA, 25 bp, Mus musculus
tatgtgtcaatgtgaggcactattt

SEQ ID NO: 758972 - DNA, 25 bp, Mus musculus
tatgtgtcacaaagatgtctacccg

SEQ ID NO: 758973 - DNA, 25 bp, Mus musculus
tatgtgtcacaatgatgtctacccg

SEQ ID NO: 758974 - DNA, 25 bp, Mus musculus
tatgtgtcacacctgagtaccactg

SEQ ID NO: 758975 - DNA, 25 bp, Mus musculus
tatgtgtcacacgtgagtaccactg

SEQ ID NO: 758976 - DNA, 25 bp, Mus musculus
tatgtgtcatcaagggctgcttctg

SEQ ID NO: 758977 - DNA, 25 bp, Mus musculus
tatgtgtcatcatgggctgcttctg

SEQ ID NO: 758978 - DNA, 25 bp, Mus musculus
tatgtgtcccggaaccacgtaaagg

SEQ ID NO: 758979 - DNA, 25 bp, Mus musculus
tatgtgtcccggtaccacgtaaagg

SEQ ID NO: 758980 - DNA, 25 bp, Mus musculus
tatgtgtccggaaagagaccagatt

SEQ ID NO: 758981 - DNA, 25 bp, Mus musculus
tatgtgtccggatagagaccagatt

SEQ ID NO: 758982 - DNA, 25 bp, Mus musculus
tatgtgtcctgcagagcacaccagc

SEQ ID NO: 758983 - DNA, 25 bp, Mus musculus
tatgtgtcctgctgagcacaccagc

SEQ ID NO: 758984 - DNA, 25 bp, Mus musculus
tatgtgtcctttctcgacgagccgc

SEQ ID NO: 758985 - DNA, 25 bp, Mus musculus
tatgtgtcctttgtcgacgagccgc

SEQ ID NO: 758986 - DNA, 25 bp, Mus musculus
tatgtgtcgcagaatccgttctgag

SEQ ID NO: 758987 - DNA, 25 bp, Mus musculus
tatgtgtcgcagtatccgttctgag

SEQ ID NO: 758988 - DNA, 25 bp, Mus musculus
tatgtgtcggagaaccggtttgttc

SEQ ID NO: 758989 - DNA, 25 bp, Mus musculus
tatgtgtcggagtaccggtttgttc

SEQ ID NO: 758990 - DNA, 25 bp, Mus musculus
tatgtgtctgccaacagagtcctgt

SEQ ID NO: 758991 - DNA, 25 bp, Mus musculus
tatgtgtctgcctacagagtcctgt

SEQ ID NO: 758992 - DNA, 25 bp, Mus musculus
tatgtgtgctgacaaccagacctgg

SEQ ID NO: 758993 - DNA, 25 bp, Mus musculus
tatgtgtgctgagaaccagacctgg

SEQ ID NO: 758994 - DNA, 25 bp, Mus musculus
tatgtgtggaagacaaccgcattcc

SEQ ID NO: 758995 - DNA, 25 bp, Mus musculus
tatgtgtggaagtcaaccgcattcc

SEQ ID NO: 758996 - DNA, 25 bp, Mus musculus
tatgtgtgtgctaaaaacaggcttc

SEQ ID NO: 758997 - DNA, 25 bp, Mus musculus
tatgtgtgtgcttaaaacaggcttc

SEQ ID NO: 758998 - DNA, 25 bp, Mus musculus
tatgtgttatgtagtgggcagtgta

SEQ ID NO: 758999 - DNA, 25 bp, Mus musculus
tatgtgttatgttgtgggcagtgta

SEQ ID NO: 759000 - DNA, 25 bp, Mus musculus
tatgtgttctctaaggacttgcctg

SEQ ID NO: 759001 - DNA, 25 bp, Mus musculus
tatgtgttctcttaggacttgcctg

SEQ ID NO: 759002 - DNA, 25 bp, Mus musculus
tatgtgttgtgcatgcctcgcacac

SEQ ID NO: 759003 - DNA, 25 bp, Mus musculus
tatgtgttgtgcttgcctcgcacac

SEQ ID NO: 759004 - DNA, 25 bp, Mus musculus
tatgtgtttcctcatcggccaaagg

SEQ ID NO: 759005 - DNA, 25 bp, Mus musculus
tatgtgtttcctgatcggccaaagg

SEQ ID NO: 759006 - DNA, 25 bp, Mus musculus
tatgtgtttgatcgcacaaatcccc

SEQ ID NO: 759007 - DNA, 25 bp, Mus musculus
tatgtgtttgatggcacaaatcccc

SEQ ID NO: 759008 - DNA, 25 bp, Mus musculus
tatgttaagactagctgccccaaac

SEQ ID NO: 759009 - DNA, 25 bp, Mus musculus
tatgttaagacttgctgccccaaac

SEQ ID NO: 759010 - DNA, 25 bp, Mus musculus
tatgttagagatccacttcagcccc

SEQ ID NO: 759011 - DNA, 25 bp, Mus musculus
tatgttagagatgcacttcagcccc

SEQ ID NO: 759012 - DNA, 25 bp, Mus musculus
tatgttagccaaagtggattcttcc

SEQ ID NO: 759013 - DNA, 25 bp, Mus musculus
tatgttagccaatgtggattcttcc

SEQ ID NO: 759014 - DNA, 25 bp, Mus musculus
tatgttagccccaatgaacttagag

SEQ ID NO: 759015 - DNA, 25 bp, Mus musculus
tatgttagcccctatgaacttagag

SEQ ID NO: 759016 - DNA, 25 bp, Mus musculus
tatgttagccctcttcgaaaccaag

SEQ ID NO: 759017 - DNA, 25 bp, Mus musculus
tatgttagccctgttcgaaaccaag

SEQ ID NO: 759018 - DNA, 25 bp, Mus musculus
tatgttagctatcggatatcacgag

SEQ ID NO: 759019 - DNA, 25 bp, Mus musculus
tatgttagctatgggatatcacgag

SEQ ID NO: 759020 - DNA, 25 bp, Mus musculus
tatgttatggtgctgtagtttggtc

SEQ ID NO: 759021 - DNA, 25 bp, Mus musculus
tatgttatggtggtgtagtttggtc

SEQ ID NO: 759022 - DNA, 25 bp, Mus musculus
tatgttatttcccacaagaaagaag

SEQ ID NO: 759023 - DNA, 25 bp, Mus musculus
tatgttatttccgacaagaaagaag

SEQ ID NO: 759024 - DNA, 25 bp, Mus musculus
tatgttcagaaccaatagaggcaca

SEQ ID NO: 759025 - DNA, 25 bp, Mus musculus
tatgttcagaacgaatagaggcaca

SEQ ID NO: 759026 - DNA, 25 bp, Mus musculus
tatgttcagcatcttctgggccctc

SEQ ID NO: 759027 - DNA, 25 bp, Mus musculus
tatgttcagcatgttctgggccctc

SEQ ID NO: 759028 - DNA, 25 bp, Mus musculus
tatgttcatgcaaaacacgttaaca

SEQ ID NO: 759029 - DNA, 25 bp, Mus musculus
tatgttcatgcataacacgttaaca

SEQ ID NO: 759030 - DNA, 25 bp, Mus musculus
tatgttccaagtcctgaccaaccac

SEQ ID NO: 759031 - DNA, 25 bp, Mus musculus
tatgttccaagtgctgaccaaccac

SEQ ID NO: 759032 - DNA, 25 bp, Mus musculus
tatgttccagagaaaggaactgtgg

SEQ ID NO: 759033 - DNA, 25 bp, Mus musculus
tatgttccagagtaaggaactgtgg

SEQ ID NO: 759034 - DNA, 25 bp, Mus musculus
tatgttcccttcactcaggcttgct

SEQ ID NO: 759035 - DNA, 25 bp, Mus musculus
tatgttcccttctctcaggcttgct

SEQ ID NO: 759036 - DNA, 25 bp, Mus musculus
tatgttcctctcaactgtttccacc

SEQ ID NO: 759037 - DNA, 25 bp, Mus musculus
tatgttcctctctactgtttccacc

SEQ ID NO: 759038 - DNA, 25 bp, Mus musculus
tatgttcgacaacgtgcagttcagc

SEQ ID NO: 759039 - DNA, 25 bp, Mus musculus
tatgttcgacaaggtgcagttcagc

SEQ ID NO: 759040 - DNA, 25 bp, Mus musculus
tatgttcgctatagggacctccgca

SEQ ID NO: 759041 - DNA, 25 bp, Mus musculus
tatgttcgctattgggacctccgca

SEQ ID NO: 759042 - DNA, 25 bp, Mus musculus
tatgttcgcttcctgaatgagaggc

SEQ ID NO: 759043 - DNA, 25 bp, Mus musculus
tatgttcgcttcgtgaatgagaggc

SEQ ID NO: 759044 - DNA, 25 bp, Mus musculus
tatgttcgtgaacacatatggccac

SEQ ID NO: 759045 - DNA, 25 bp, Mus musculus
tatgttcgtgaagacatatggccac

SEQ ID NO: 759046 - DNA, 25 bp, Mus musculus
tatgttctaccaaatcacatgatgc

SEQ ID NO: 759047 - DNA, 25 bp, Mus musculus
tatgttctaccatatcacatgatgc

SEQ ID NO: 759048 - DNA, 25 bp, Mus musculus
tatgttctccagaaacgatttcagc

SEQ ID NO: 759049 - DNA, 25 bp, Mus musculus
tatgttctccagtaacgatttcagc

SEQ ID NO: 759050 - DNA, 25 bp, Mus musculus
tatgttctggtcatgactgacagcg

SEQ ID NO: 759051 - DNA, 25 bp, Mus musculus
tatgttctggtcttgactgacagcg

SEQ ID NO: 759052 - DNA, 25 bp, Mus musculus
tatgttgacaaaacctacctaggca

SEQ ID NO: 759053 - DNA, 25 bp, Mus musculus
tatgttgacaaatcctacctaggca

SEQ ID NO: 759054 - DNA, 25 bp, Mus musculus
tatgttgacacaaaaggatgtaaat

SEQ ID NO: 759055 - DNA, 25 bp, Mus musculus
tatgttgacacataaggatgtaaat

SEQ ID NO: 759056 - DNA, 25 bp, Mus musculus
tatgttgagtctcaaaatgtcacca

SEQ ID NO: 759057 - DNA, 25 bp, Mus musculus
tatgttgagtctgaaaatgtcacca

SEQ ID NO: 759058 - DNA, 25 bp, Mus musculus
tatgttgccactatactgagatacg

SEQ ID NO: 759059 - DNA, 25 bp, Mus musculus
tatgttgccactttactgagatacg

SEQ ID NO: 759060 - DNA, 25 bp, Mus musculus
tatgttgcctatcttgccaaagacc

SEQ ID NO: 759061 - DNA, 25 bp, Mus musculus
tatgttgcctatgttgccaaagacc

SEQ ID NO: 759062 - DNA, 25 bp, Mus musculus
tatgttgcctggaacagcccagaag

SEQ ID NO: 759063 - DNA, 25 bp, Mus musculus
tatgttgcctggtacagcccagaag

SEQ ID NO: 759064 - DNA, 25 bp, Mus musculus
tatgttgggattccccgggatcaga

SEQ ID NO: 759065 - DNA, 25 bp, Mus musculus
tatgttgggattgcccgggatcaga

SEQ ID NO: 759066 - DNA, 25 bp, Mus musculus
tatgttggtgggacactcagcccca

SEQ ID NO: 759067 - DNA, 25 bp, Mus musculus
tatgttggtgggtcactcagcccca

SEQ ID NO: 759068 - DNA, 25 bp, Mus musculus
tatgttgtaggcagatgaagaatgt

SEQ ID NO: 759069 - DNA, 25 bp, Mus musculus
tatgttgtaggctgatgaagaatgt

SEQ ID NO: 759070 - DNA, 25 bp, Mus musculus
tatgttgtctctccctacaggagca

SEQ ID NO: 759071 - DNA, 25 bp, Mus musculus
tatgttgtctctgcctacaggagca

SEQ ID NO: 759072 - DNA, 25 bp, Mus musculus
tatgtttaggatccttcatgcctcc

SEQ ID NO: 759073 - DNA, 25 bp, Mus musculus
tatgtttaggatgcttcatgcctcc

SEQ ID NO: 759074 - DNA, 25 bp, Mus musculus
tatgtttagtctacttaaccctgag

SEQ ID NO: 759075 - DNA, 25 bp, Mus musculus
tatgtttagtcttcttaaccctgag

SEQ ID NO: 759076 - DNA, 25 bp, Mus musculus
tatgtttccatcacaccgtctgtcg

SEQ ID NO: 759077 - DNA, 25 bp, Mus musculus
tatgtttccatctcaccgtctgtcg

SEQ ID NO: 759078 - DNA, 25 bp, Mus musculus
tatgtttcctatccctcgggtgatg

SEQ ID NO: 759079 - DNA, 25 bp, Mus musculus
tatgtttcctatgcctcgggtgatg

SEQ ID NO: 759080 - DNA, 25 bp, Mus musculus
tatgtttctctaagacgtttcctgg

SEQ ID NO: 759081 - DNA, 25 bp, Mus musculus
tatgtttctctatgacgtttcctgg

SEQ ID NO: 759082 - DNA, 25 bp, Mus musculus
tatgtttgagtacctggcaccgcca

SEQ ID NO: 759083 - DNA, 25 bp, Mus musculus
tatgtttgagtagctggcaccgcca

SEQ ID NO: 759084 - DNA, 25 bp, Mus musculus
tatgtttgccatacttgcagagagg

SEQ ID NO: 759085 - DNA, 25 bp, Mus musculus
tatgtttgccattcttgcagagagg

SEQ ID NO: 759086 - DNA, 25 bp, Mus musculus
tatgtttgcggtaggatagcattga

SEQ ID NO: 759087 - DNA, 25 bp, Mus musculus
tatgtttgcggttggatagcattga

SEQ ID NO: 759088 - DNA, 25 bp, Mus musculus
tatgtttgctttccagcaaatgaca

SEQ ID NO: 759089 - DNA, 25 bp, Mus musculus
tatgtttgctttgcagcaaatgaca

SEQ ID NO: 759090 - DNA, 25 bp, Mus musculus
tatgtttggcgaatggcaccttttc

SEQ ID NO: 759091 - DNA, 25 bp, Mus musculus
tatgtttggcgattggcaccttttc

SEQ ID NO: 759092 - DNA, 25 bp, Mus musculus
tatgttttagggaatcctgtggcga

SEQ ID NO: 759093 - DNA, 25 bp, Mus musculus
tatgttttagggtatcctgtggcga

SEQ ID NO: 759094 - DNA, 25 bp, Mus musculus
tatgttttccctcgagcgtcccaca

SEQ ID NO: 759095 - DNA, 25 bp, Mus musculus
tatgttttccctggagcgtcccaca

SEQ ID NO: 759096 - DNA, 25 bp, Mus musculus
tatgttttggagacacacaagctaa

SEQ ID NO: 759097 - DNA, 25 bp, Mus musculus
tatgttttggagtcacacaagctaa

SEQ ID NO: 759098 - DNA, 25 bp, Mus musculus
tatgttttggctactcgggaacagc

SEQ ID NO: 759099 - DNA, 25 bp, Mus musculus
tatgttttggcttctcgggaacagc

SEQ ID NO: 759100 - DNA, 25 bp, Mus musculus
tatgttttgggaacccaaatagtgc

SEQ ID NO: 759101 - DNA, 25 bp, Mus musculus
tatgttttgggatcccaaatagtgc

SEQ ID NO: 759102 - DNA, 25 bp, Mus musculus
tatgtttttgagctccctggtgacc

SEQ ID NO: 759103 - DNA, 25 bp, Mus musculus
tatgtttttgaggtccctggtgacc

SEQ ID NO: 759104 - DNA, 25 bp, Mus musculus
tattaaaaagtgcttgcacaggccc

SEQ ID NO: 759105 - DNA, 25 bp, Mus musculus
tattaaaaagtggttgcacaggccc

SEQ ID NO: 759106 - DNA, 25 bp, Mus musculus
tattaaagaggtctgtgcccattgc

SEQ ID NO: 759107 - DNA, 25 bp, Mus musculus
tattaaagaggtgtgtgcccattgc

SEQ ID NO: 759108 - DNA, 25 bp, Mus musculus
tattaaagctgcagttacaaccgga

SEQ ID NO: 759109 - DNA, 25 bp, Mus musculus
tattaaagctgctgttacaaccgga

SEQ ID NO: 759110 - DNA, 25 bp, Mus musculus
tattaaagtgtacatgccaaagctg

SEQ ID NO: 759111 - DNA, 25 bp, Mus musculus
tattaaagtgtagatgccaaagctg

SEQ ID NO: 759112 - DNA, 25 bp, Mus musculus
tattaaatagctctacagaagcagg

SEQ ID NO: 759113 - DNA, 25 bp, Mus musculus
tattaaatagctgtacagaagcagg

SEQ ID NO: 759114 - DNA, 25 bp, Mus musculus
tattaaatggatcaagccaagacag

SEQ ID NO: 759115 - DNA, 25 bp, Mus musculus
tattaaatggatgaagccaagacag

SEQ ID NO: 759116 - DNA, 25 bp, Mus musculus
tattaaattctaagctgaagatcca

SEQ ID NO: 759117 - DNA, 25 bp, Mus musculus
tattaaattctatgctgaagatcca

SEQ ID NO: 759118 - DNA, 25 bp, Mus musculus
tattaacactaactatccagatatt

SEQ ID NO: 759119 - DNA, 25 bp, Mus musculus
tattaacactaagtatccagatatt

SEQ ID NO: 759120 - DNA, 25 bp, Mus musculus
tattaacagaaaaggcaaccagtca

SEQ ID NO: 759121 - DNA, 25 bp, Mus musculus
tattaacagaaatggcaaccagtca

SEQ ID NO: 759122 - DNA, 25 bp, Mus musculus
tattaacagcggaagaggttcatgc

SEQ ID NO: 759123 - DNA, 25 bp, Mus musculus
tattaacagcggtagaggttcatgc

SEQ ID NO: 759124 - DNA, 25 bp, Mus musculus
tattaaccaacaattctcagacacc

SEQ ID NO: 759125 - DNA, 25 bp, Mus musculus
tattaaccaacatttctcagacacc

SEQ ID NO: 759126 - DNA, 25 bp, Mus musculus
tattaaccagaacgatggaatggtc

SEQ ID NO: 759127 - DNA, 25 bp, Mus musculus
tattaaccagaaggatggaatggtc

SEQ ID NO: 759128 - DNA, 25 bp, Mus musculus
tattaaccagaccatatgtttgcgg

SEQ ID NO: 759129 - DNA, 25 bp, Mus musculus
tattaaccagacgatatgtttgcgg

SEQ ID NO: 759130 - DNA, 25 bp, Mus musculus
tattaactcccaccctggcactggg

SEQ ID NO: 759131 - DNA, 25 bp, Mus musculus
tattaactcccagcctggcactggg

SEQ ID NO: 759132 - DNA, 25 bp, Mus musculus
tattaactgcacagctggagagcat

SEQ ID NO: 759133 - DNA, 25 bp, Mus musculus
tattaactgcactgctggagagcat

SEQ ID NO: 759134 - DNA, 25 bp, Mus musculus
tattaacttcccaaagaggaggagg

SEQ ID NO: 759135 - DNA, 25 bp, Mus musculus
tattaacttccctaagaggaggagg

SEQ ID NO: 759136 - DNA, 25 bp, Mus musculus
tattaagacatcactcaggaactcc

SEQ ID NO: 759137 - DNA, 25 bp, Mus musculus
tattaagacatctctcaggaactcc

SEQ ID NO: 759138 - DNA, 25 bp, Mus musculus
tattaagatcggcaaccaagcggag

SEQ ID NO: 759139 - DNA, 25 bp, Mus musculus
tattaagatcgggaaccaagcggag

SEQ ID NO: 759140 - DNA, 25 bp, Mus musculus
tattaagcacctacgatgtgccggg

SEQ ID NO: 759141 - DNA, 25 bp, Mus musculus
tattaagcaccttcgatgtgccggg

SEQ ID NO: 759142 - DNA, 25 bp, Mus musculus
tattaagcagggatcggcgacggaa

SEQ ID NO: 759143 - DNA, 25 bp, Mus musculus
tattaagcagggttcggcgacggaa

SEQ ID NO: 759144 - DNA, 25 bp, Mus musculus
tattaaggaaacactgagtaagacc

SEQ ID NO: 759145 - DNA, 25 bp, Mus musculus
tattaaggaaactctgagtaagacc

SEQ ID NO: 759146 - DNA, 25 bp, Mus musculus
tattaaggactgacgcgaccatgtg

SEQ ID NO: 759147 - DNA, 25 bp, Mus musculus
tattaaggactgtcgcgaccatgtg

SEQ ID NO: 759148 - DNA, 25 bp, Mus musculus
tattaaggagcacctcttgcccttt

SEQ ID NO: 759149 - DNA, 25 bp, Mus musculus
tattaaggagcagctcttgcccttt

SEQ ID NO: 759150 - DNA, 25 bp, Mus musculus
tattaagtattccttggtggaccag

SEQ ID NO: 759151 - DNA, 25 bp, Mus musculus
tattaagtattcgttggtggaccag

SEQ ID NO: 759152 - DNA, 25 bp, Mus musculus
tattaagtcgcgcatactgggacgg

SEQ ID NO: 759153 - DNA, 25 bp, Mus musculus
tattaagtcgcggatactgggacgg

SEQ ID NO: 759154 - DNA, 25 bp, Mus musculus
tattaagtgcaaagcggctgtccta

SEQ ID NO: 759155 - DNA, 25 bp, Mus musculus
tattaagtgcaatgcggctgtccta

SEQ ID NO: 759156 - DNA, 25 bp, Mus musculus
tattaagtggagatctgccctccca

SEQ ID NO: 759157 - DNA, 25 bp, Mus musculus
tattaagtggagttctgccctccca

SEQ ID NO: 759158 - DNA, 25 bp, Mus musculus
tattaagtgtccagggacgaggtcc

SEQ ID NO: 759159 - DNA, 25 bp, Mus musculus
tattaagtgtcctgggacgaggtcc

SEQ ID NO: 759160 - DNA, 25 bp, Mus musculus
tattaatcctgaagtaagaagaaag

SEQ ID NO: 759161 - DNA, 25 bp, Mus musculus
tattaatcctgatgtaagaagaaag

SEQ ID NO: 759162 - DNA, 25 bp, Mus musculus
tattaatgaagcatagaaaacctag

SEQ ID NO: 759163 - DNA, 25 bp, Mus musculus
tattaatgaagcttagaaaacctag

SEQ ID NO: 759164 - DNA, 25 bp, Mus musculus
tattaatgagctcaagtcggaaatc

SEQ ID NO: 759165 - DNA, 25 bp, Mus musculus
tattaatgagctgaagtcggaaatc

SEQ ID NO: 759166 - DNA, 25 bp, Mus musculus
tattaatgagtgagagaccgggcag

SEQ ID NO: 759167 - DNA, 25 bp, Mus musculus
tattaatgagtgtgagaccgggcag

SEQ ID NO: 759168 - DNA, 25 bp, Mus musculus
tattaatgtgctatccgtttgcaag

SEQ ID NO: 759169 - DNA, 25 bp, Mus musculus
tattaatgtgctttccgtttgcaag

SEQ ID NO: 759170 - DNA, 25 bp, Mus musculus
tattacaacaacacgtacggagcgc

SEQ ID NO: 759171 - DNA, 25 bp, Mus musculus
tattacaacaactcgtacggagcgc

SEQ ID NO: 759172 - DNA, 25 bp, Mus musculus
tattacaagctgcatgtcctgacct

SEQ ID NO: 759173 - DNA, 25 bp, Mus musculus
tattacaagctggatgtcctgacct

SEQ ID NO: 759174 - DNA, 25 bp, Mus musculus
tattacaatctcaggataaaaccaa

SEQ ID NO: 759175 - DNA, 25 bp, Mus musculus
tattacaatctctggataaaaccaa

SEQ ID NO: 759176 - DNA, 25 bp, Mus musculus
tattacacagataggcaggcagggt

SEQ ID NO: 759177 - DNA, 25 bp, Mus musculus
tattacacagattggcaggcagggt

SEQ ID NO: 759178 - DNA, 25 bp, Mus musculus
tattacacagtaaatgcatgggtgg

SEQ ID NO: 759179 - DNA, 25 bp, Mus musculus
tattacacagtatatgcatgggtgg

SEQ ID NO: 759180 - DNA, 25 bp, Mus musculus
tattacaccagacccattgaatata

SEQ ID NO: 759181 - DNA, 25 bp, Mus musculus
tattacaccagagccattgaatata

SEQ ID NO: 759182 - DNA, 25 bp, Mus musculus
tattacaccgggattggtgctggtg

SEQ ID NO: 759183 - DNA, 25 bp, Mus musculus
tattacaccgggtttggtgctggtg

SEQ ID NO: 759184 - DNA, 25 bp, Mus musculus
tattacacgcctaaccagttagcac

SEQ ID NO: 759185 - DNA, 25 bp, Mus musculus
tattacacgccttaccagttagcac

SEQ ID NO: 759186 - DNA, 25 bp, Mus musculus
tattacacggagaatggtggaggcc

SEQ ID NO: 759187 - DNA, 25 bp, Mus musculus
tattacacggagtatggtggaggcc

SEQ ID NO: 759188 - DNA, 25 bp, Mus musculus
tattacactgacctagaggccttcg

SEQ ID NO: 759189 - DNA, 25 bp, Mus musculus
tattacactgacgtagaggccttcg

SEQ ID NO: 759190 - DNA, 25 bp, Mus musculus
tattacactttcatgtcctctagac

SEQ ID NO: 759191 - DNA, 25 bp, Mus musculus
tattacactttcttgtcctctagac

SEQ ID NO: 759192 - DNA, 25 bp, Mus musculus
tattacagtttgcacaatatgggaa

SEQ ID NO: 759193 - DNA, 25 bp, Mus musculus
tattacagtttggacaatatgggaa

SEQ ID NO: 759194 - DNA, 25 bp, Mus musculus
tattacatagagatggaacggaccc

SEQ ID NO: 759195 - DNA, 25 bp, Mus musculus
tattacatagagttggaacggaccc

SEQ ID NO: 759196 - DNA, 25 bp, Mus musculus
tattacatttaaagaggaagatcct

SEQ ID NO: 759197 - DNA, 25 bp, Mus musculus
tattacatttaatgaggaagatcct

SEQ ID NO: 759198 - DNA, 25 bp, Mus musculus
tattaccacacccacggagacagtt

SEQ ID NO: 759199 - DNA, 25 bp, Mus musculus
tattaccacaccgacggagacagtt

SEQ ID NO: 759200 - DNA, 25 bp, Mus musculus
tattaccacctgctcgagcaagtgg

SEQ ID NO: 759201 - DNA, 25 bp, Mus musculus
tattaccacctggtcgagcaagtgg

SEQ ID NO: 759202 - DNA, 25 bp, Mus musculus
tattaccagcagaggagtctggagg

SEQ ID NO: 759203 - DNA, 25 bp, Mus musculus
tattaccagcagtggagtctggagg

SEQ ID NO: 759204 - DNA, 25 bp, Mus musculus
tattaccaggatatacaacattggc

SEQ ID NO: 759205 - DNA, 25 bp, Mus musculus
tattaccaggatttacaacattggc

SEQ ID NO: 759206 - DNA, 25 bp, Mus musculus
tattaccagttgatgatcacccgga

SEQ ID NO: 759207 - DNA, 25 bp, Mus musculus
tattaccagttgttgatcacccgga

SEQ ID NO: 759208 - DNA, 25 bp, Mus musculus
tattaccatcagagcaaaagtgact

SEQ ID NO: 759209 - DNA, 25 bp, Mus musculus
tattaccatcagcttgctacttgga

SEQ ID NO: 759210 - DNA, 25 bp, Mus musculus
tattaccatcaggttgctacttgga

SEQ ID NO: 759211 - DNA, 25 bp, Mus musculus
tattaccatcagtgcaaaagtgact

SEQ ID NO: 759212 - DNA, 25 bp, Mus musculus
tattaccatggacgagtacttcatg

SEQ ID NO: 759213 - DNA, 25 bp, Mus musculus
tattaccatggaggagtacttcatg

SEQ ID NO: 759214 - DNA, 25 bp, Mus musculus
tattacccatccaagaacaggctgc

SEQ ID NO: 759215 - DNA, 25 bp, Mus musculus
tattacccatcctagaacaggctgc

SEQ ID NO: 759216 - DNA, 25 bp, Mus musculus
tattaccgcctcctgttagttggca

SEQ ID NO: 759217 - DNA, 25 bp, Mus musculus
tattaccgcctcgtgttagttggca

SEQ ID NO: 759218 - DNA, 25 bp, Mus musculus
tattacctctagatgaaattgggca

SEQ ID NO: 759219 - DNA, 25 bp, Mus musculus
tattacctctagttgaaattgggca

SEQ ID NO: 759220 - DNA, 25 bp, Mus musculus
tattacctgactcatggctgggcgg

SEQ ID NO: 759221 - DNA, 25 bp, Mus musculus
tattacctgactgatggctgggcgg

SEQ ID NO: 759222 - DNA, 25 bp, Mus musculus
tattacctggaacctctgctttgcc

SEQ ID NO: 759223 - DNA, 25 bp, Mus musculus
tattacctggaagctctgctttgcc

SEQ ID NO: 759224 - DNA, 25 bp, Mus musculus
tattacctggacaactcattgaagc

SEQ ID NO: 759225 - DNA, 25 bp, Mus musculus
tattacctggactactcattgaagc

SEQ ID NO: 759226 - DNA, 25 bp, Mus musculus
tattacctggcaccattcatcacag

SEQ ID NO: 759227 - DNA, 25 bp, Mus musculus
tattacctggcagcattcatcacag

SEQ ID NO: 759228 - DNA, 25 bp, Mus musculus
tattacctgtccctgggcaacaggc

SEQ ID NO: 759229 - DNA, 25 bp, Mus musculus
tattacctgtccgtgggcaacaggc

SEQ ID NO: 759230 - DNA, 25 bp, Mus musculus
tattaccttccaaatgatgatggag

SEQ ID NO: 759231 - DNA, 25 bp, Mus musculus
tattaccttccatatgatgatggag

SEQ ID NO: 759232 - DNA, 25 bp, Mus musculus
tattacgagaatcagcttggaaaga

SEQ ID NO: 759233 - DNA, 25 bp, Mus musculus
tattacgagaatgagcttggaaaga

SEQ ID NO: 759234 - DNA, 25 bp, Mus musculus
tattacgagactcgctccatcagac

SEQ ID NO: 759235 - DNA, 25 bp, Mus musculus
tattacgagactggctccatcagac

SEQ ID NO: 759236 - DNA, 25 bp, Mus musculus
tattacggcttcaacaataaccgac

SEQ ID NO: 759237 - DNA, 25 bp, Mus musculus
tattacggcttctacaataaccgac

SEQ ID NO: 759238 - DNA, 25 bp, Mus musculus
tattacgggccccagtgtcagtatg

SEQ ID NO: 759239 - DNA, 25 bp, Mus musculus
tattacgggcccgagtgtcagtatg

SEQ ID NO: 759240 - DNA, 25 bp, Mus musculus
tattactacaccaggaaaaggacac

SEQ ID NO: 759241 - DNA, 25 bp, Mus musculus
tattactacacctggaaaaggacac

SEQ ID NO: 759242 - DNA, 25 bp, Mus musculus
tattactacattccatggcctcatc

SEQ ID NO: 759243 - DNA, 25 bp, Mus musculus
tattactacattgcatggcctcatc

SEQ ID NO: 759244 - DNA, 25 bp, Mus musculus
tattactacctgacggtgaaggccc

SEQ ID NO: 759245 - DNA, 25 bp, Mus musculus
tattactacctgtcggtgaaggccc

SEQ ID NO: 759246 - DNA, 25 bp, Mus musculus
tattactcaacacgaatcttcaagg

SEQ ID NO: 759247 - DNA, 25 bp, Mus musculus
tattactcaacaggaatcttcaagg

SEQ ID NO: 759248 - DNA, 25 bp, Mus musculus
tattactcctggagcgagtccggcg

SEQ ID NO: 759249 - DNA, 25 bp, Mus musculus
tattactcctggtgcgagtccggcg

SEQ ID NO: 759250 - DNA, 25 bp, Mus musculus
tattactctaggaatgaccgagacc

SEQ ID NO: 759251 - DNA, 25 bp, Mus musculus
tattactctaggtatgaccgagacc

SEQ ID NO: 759252 - DNA, 25 bp, Mus musculus
tattactgaaaacctcttcccggca

SEQ ID NO: 759253 - DNA, 25 bp, Mus musculus
tattactgaaaagctcttcccggca

SEQ ID NO: 759254 - DNA, 25 bp, Mus musculus
tattactgaagtatatcactggttc

SEQ ID NO: 759255 - DNA, 25 bp, Mus musculus
tattactgaagtttatcactggttc

SEQ ID NO: 759256 - DNA, 25 bp, Mus musculus
tattactgcgggatctcaggagcca

SEQ ID NO: 759257 - DNA, 25 bp, Mus musculus
tattactgcgggttctcaggagcca

SEQ ID NO: 759258 - DNA, 25 bp, Mus musculus
tattactgctgtcttcttctgtgtg

SEQ ID NO: 759259 - DNA, 25 bp, Mus musculus
tattactgctgtgttcttctgtgtg

SEQ ID NO: 759260 - DNA, 25 bp, Mus musculus
tattactggccaagttttgataaag

SEQ ID NO: 759261 - DNA, 25 bp, Mus musculus
tattactggccatgttttgataaag

SEQ ID NO: 759262 - DNA, 25 bp, Mus musculus
tattacttggccagtggattttgtc

SEQ ID NO: 759263 - DNA, 25 bp, Mus musculus
tattacttggcctgtggattttgtc

SEQ ID NO: 759264 - DNA, 25 bp, Mus musculus
tattagaaagaaccccagttcccag

SEQ ID NO: 759265 - DNA, 25 bp, Mus musculus
tattagaaagaagcccagttcccag

SEQ ID NO: 759266 - DNA, 25 bp, Mus musculus
tattagaacactcacagatgatatg

SEQ ID NO: 759267 - DNA, 25 bp, Mus musculus
tattagaacactgacagatgatatg

SEQ ID NO: 759268 - DNA, 25 bp, Mus musculus
tattagaagcataaaaagtcagagt

SEQ ID NO: 759269 - DNA, 25 bp, Mus musculus
tattagaagcattaaaagtcagagt

SEQ ID NO: 759270 - DNA, 25 bp, Mus musculus
tattagaatgctaggtagcgctcca

SEQ ID NO: 759271 - DNA, 25 bp, Mus musculus
tattagaatgcttggtagcgctcca

SEQ ID NO: 759272 - DNA, 25 bp, Mus musculus
tattagacatgtacgttcttggagc

SEQ ID NO: 759273 - DNA, 25 bp, Mus musculus
tattagacatgttcgttcttggagc

SEQ ID NO: 759274 - DNA, 25 bp, Mus musculus
tattagactgggagtgtaactcggt

SEQ ID NO: 759275 - DNA, 25 bp, Mus musculus
tattagactgggtgtgtaactcggt

SEQ ID NO: 759276 - DNA, 25 bp, Mus musculus
tattagacttaaagactactgctgc

SEQ ID NO: 759277 - DNA, 25 bp, Mus musculus
tattagacttaatgactactgctgc

SEQ ID NO: 759278 - DNA, 25 bp, Mus musculus
tattagatagcaaagcatccttcct

SEQ ID NO: 759279 - DNA, 25 bp, Mus musculus
tattagatagcatagcatccttcct

SEQ ID NO: 759280 - DNA, 25 bp, Mus musculus
tattagatctggaagctgagcttag

SEQ ID NO: 759281 - DNA, 25 bp, Mus musculus
tattagatctggtagctgagcttag

SEQ ID NO: 759282 - DNA, 25 bp, Mus musculus
tattagcagaaccaccattgtctag

SEQ ID NO: 759283 - DNA, 25 bp, Mus musculus
tattagcagaacgaccattgtctag

SEQ ID NO: 759284 - DNA, 25 bp, Mus musculus
tattagcagctactcatgtggaagc

SEQ ID NO: 759285 - DNA, 25 bp, Mus musculus
tattagcagctagtcatgtggaagc

SEQ ID NO: 759286 - DNA, 25 bp, Mus musculus
tattagccaaagctaccagtggctc

SEQ ID NO: 759287 - DNA, 25 bp, Mus musculus
tattagccaaaggtaccagtggctc

SEQ ID NO: 759288 - DNA, 25 bp, Mus musculus
tattagccgtgactcagatggaatg

SEQ ID NO: 759289 - DNA, 25 bp, Mus musculus
tattagccgtgagtcagatggaatg

SEQ ID NO: 759290 - DNA, 25 bp, Mus musculus
tattagcctctaactttctgaaagg

SEQ ID NO: 759291 - DNA, 25 bp, Mus musculus
tattagcctctatctttctgaaagg

SEQ ID NO: 759292 - DNA, 25 bp, Mus musculus
tattagcgttacagcagattgcgga

SEQ ID NO: 759293 - DNA, 25 bp, Mus musculus
tattagcgttactgcagattgcgga

SEQ ID NO: 759294 - DNA, 25 bp, Mus musculus
tattagctgttcatactatgaaaag

SEQ ID NO: 759295 - DNA, 25 bp, Mus musculus
tattagctgttcttactatgaaaag

SEQ ID NO: 759296 - DNA, 25 bp, Mus musculus
tattaggataaacactgactgacag

SEQ ID NO: 759297 - DNA, 25 bp, Mus musculus
tattaggataaagactgactgacag

SEQ ID NO: 759298 - DNA, 25 bp, Mus musculus
tattaggctctcagccctattcgtg

SEQ ID NO: 759299 - DNA, 25 bp, Mus musculus
tattaggctctctgccctattcgtg

SEQ ID NO: 759300 - DNA, 25 bp, Mus musculus
tattagggtagaactgcggactagc

SEQ ID NO: 759301 - DNA, 25 bp, Mus musculus
tattagggtagatctgcggactagc

SEQ ID NO: 759302 - DNA, 25 bp, Mus musculus
tattaggtaggtcagcaagagaccc

SEQ ID NO: 759303 - DNA, 25 bp, Mus musculus
tattaggtaggtgagcaagagaccc

SEQ ID NO: 759304 - DNA, 25 bp, Mus musculus
tattagtactttaaagaagagagca

SEQ ID NO: 759305 - DNA, 25 bp, Mus musculus
tattagtacttttaagaagagagca

SEQ ID NO: 759306 - DNA, 25 bp, Mus musculus
tattagtcaattacagagagaaggg

SEQ ID NO: 759307 - DNA, 25 bp, Mus musculus
tattagtcaatttcagagagaaggg

SEQ ID NO: 759308 - DNA, 25 bp, Mus musculus
tattagtcatttcgcagaagcatgt

SEQ ID NO: 759309 - DNA, 25 bp, Mus musculus
tattagtcatttggcagaagcatgt

SEQ ID NO: 759310 - DNA, 25 bp, Mus musculus
tattagtcgataccaatgacgtgat

SEQ ID NO: 759311 - DNA, 25 bp, Mus musculus
tattagtcgatagcaatgacgtgat

SEQ ID NO: 759312 - DNA, 25 bp, Mus musculus
tattagtgataactctatttcttgg

SEQ ID NO: 759313 - DNA, 25 bp, Mus musculus
tattagtgataagtctatttcttgg

SEQ ID NO: 759314 - DNA, 25 bp, Mus musculus
tattagtggctaacgtcttgcctgc

SEQ ID NO: 759315 - DNA, 25 bp, Mus musculus
tattagtggctatcgtcttgcctgc

SEQ ID NO: 759316 - DNA, 25 bp, Mus musculus
tattagtggcttcgaggttctcaga

SEQ ID NO: 759317 - DNA, 25 bp, Mus musculus
tattagtggcttggaggttctcaga

SEQ ID NO: 759318 - DNA, 25 bp, Mus musculus
tattataagattagttcaagaacac

SEQ ID NO: 759319 - DNA, 25 bp, Mus musculus
tattataagatttgttcaagaacac

SEQ ID NO: 759320 - DNA, 25 bp, Mus musculus
tattatacacacagtttgagtggcc

SEQ ID NO: 759321 - DNA, 25 bp, Mus musculus
tattatacacactgtttgagtggcc

SEQ ID NO: 759322 - DNA, 25 bp, Mus musculus
tattatacatcgctctaccagggcc

SEQ ID NO: 759323 - DNA, 25 bp, Mus musculus
tattatacatcggtctaccagggcc

SEQ ID NO: 759324 - DNA, 25 bp, Mus musculus
tattatacatgacaggttgcccctt

SEQ ID NO: 759325 - DNA, 25 bp, Mus musculus
tattatacatgagaggttgcccctt

SEQ ID NO: 759326 - DNA, 25 bp, Mus musculus
tattataccaagctccaaagaccct

SEQ ID NO: 759327 - DNA, 25 bp, Mus musculus
tattataccaaggtccaaagaccct

SEQ ID NO: 759328 - DNA, 25 bp, Mus musculus
tattatactcgcacttaaaaatgcc

SEQ ID NO: 759329 - DNA, 25 bp, Mus musculus
tattatactcgctcttaaaaatgcc

SEQ ID NO: 759330 - DNA, 25 bp, Mus musculus
tattatatctatctgaccttcctgg

SEQ ID NO: 759331 - DNA, 25 bp, Mus musculus
tattatatctatgtgaccttcctgg

SEQ ID NO: 759332 - DNA, 25 bp, Mus musculus
tattatatgtatatatgcgggtggc

SEQ ID NO: 759333 - DNA, 25 bp, Mus musculus
tattatatgtatttatgcgggtggc

SEQ ID NO: 759334 - DNA, 25 bp, Mus musculus
tattatcaagaaattggaagagcat

SEQ ID NO: 759335 - DNA, 25 bp, Mus musculus
tattatcaagaatttggaagagcat

SEQ ID NO: 759336 - DNA, 25 bp, Mus musculus
tattatcaggagaacagatcagtgg

SEQ ID NO: 759337 - DNA, 25 bp, Mus musculus
tattatcaggagtacagatcagtgg

SEQ ID NO: 759338 - DNA, 25 bp, Mus musculus
tattatccaggaaaccagaccctcc

SEQ ID NO: 759339 - DNA, 25 bp, Mus musculus
tattatccaggataccagaccctcc

SEQ ID NO: 759340 - DNA, 25 bp, Mus musculus
tattatccagttcgtcccatctatc

SEQ ID NO: 759341 - DNA, 25 bp, Mus musculus
tattatccagttggtcccatctatc

SEQ ID NO: 759342 - DNA, 25 bp, Mus musculus
tattatccatggaacattacttccc

SEQ ID NO: 759343 - DNA, 25 bp, Mus musculus
tattatccatggtacattacttccc

SEQ ID NO: 759344 - DNA, 25 bp, Mus musculus
tattatcccctaaatggagtgctca

SEQ ID NO: 759345 - DNA, 25 bp, Mus musculus
tattatcccctatatggagtgctca

SEQ ID NO: 759346 - DNA, 25 bp, Mus musculus
tattatcctgttactcaacaagaag

SEQ ID NO: 759347 - DNA, 25 bp, Mus musculus
tattatcctgtttctcaacaagaag

SEQ ID NO: 759348 - DNA, 25 bp, Mus musculus
tattatctacgtcagactccccaga

SEQ ID NO: 759349 - DNA, 25 bp, Mus musculus
tattatctacgtgagactccccaga

SEQ ID NO: 759350 - DNA, 25 bp, Mus musculus
tattatctcggtcttcagccgctgg

SEQ ID NO: 759351 - DNA, 25 bp, Mus musculus
tattatctcggtgttcagccgctgg

SEQ ID NO: 759352 - DNA, 25 bp, Mus musculus
tattatgagaaacgcatcatgcaga

SEQ ID NO: 759353 - DNA, 25 bp, Mus musculus
tattatgagaaaggcatcatgcaga

SEQ ID NO: 759354 - DNA, 25 bp, Mus musculus
tattatgagggaagctgaggaattc

SEQ ID NO: 759355 - DNA, 25 bp, Mus musculus
tattatgagggatgctgaggaattc

SEQ ID NO: 759356 - DNA, 25 bp, Mus musculus
tattatgatttacgaatgcagctgg

SEQ ID NO: 759357 - DNA, 25 bp, Mus musculus
tattatgatttaggaatgcagctgg

SEQ ID NO: 759358 - DNA, 25 bp, Mus musculus
tattatgcatgcacttaaaaatgcc

SEQ ID NO: 759359 - DNA, 25 bp, Mus musculus
tattatgcatgctcttaaaaatgcc

SEQ ID NO: 759360 - DNA, 25 bp, Mus musculus
tattatgcctgtcctcccttgggac

SEQ ID NO: 759361 - DNA, 25 bp, Mus musculus
tattatgcctgtgctcccttgggac

SEQ ID NO: 759362 - DNA, 25 bp, Mus musculus
tattatgctcaacttcagaacctca

SEQ ID NO: 759363 - DNA, 25 bp, Mus musculus
tattatgctcaagttcagaacctca

SEQ ID NO: 759364 - DNA, 25 bp, Mus musculus
tattatggaggaatgatctatacgg

SEQ ID NO: 759365 - DNA, 25 bp, Mus musculus
tattatggaggattgatctatacgg

SEQ ID NO: 759366 - DNA, 25 bp, Mus musculus
tattatggattaagaaaagaatggc

SEQ ID NO: 759367 - DNA, 25 bp, Mus musculus
tattatggattatgaaaagaatggc

SEQ ID NO: 759368 - DNA, 25 bp, Mus musculus
tattatggattcctacaacaaacag

SEQ ID NO: 759369 - DNA, 25 bp, Mus musculus
tattatggattcgtacaacaaacag

SEQ ID NO: 759370 - DNA, 25 bp, Mus musculus
tattatggctctccatgggatgctg

SEQ ID NO: 759371 - DNA, 25 bp, Mus musculus
tattatggctctgcatgggatgctg

SEQ ID NO: 759372 - DNA, 25 bp, Mus musculus
tattatgggcatccggagcctgagc

SEQ ID NO: 759373 - DNA, 25 bp, Mus musculus
tattatgggcatgcggagcctgagc

SEQ ID NO: 759374 - DNA, 25 bp, Mus musculus
tattatgtccttcaagcgaatgctg

SEQ ID NO: 759375 - DNA, 25 bp, Mus musculus
tattatgtccttgaagcgaatgctg

SEQ ID NO: 759376 - DNA, 25 bp, Mus musculus
tattatgtctcccagcgtgggtacc

SEQ ID NO: 759377 - DNA, 25 bp, Mus musculus
tattatgtctccgagcgtgggtacc

SEQ ID NO: 759378 - DNA, 25 bp, Mus musculus
tattattaaggaaacactgagtaag

SEQ ID NO: 759379 - DNA, 25 bp, Mus musculus
tattattaaggatacactgagtaag

SEQ ID NO: 759380 - DNA, 25 bp, Mus musculus
tattattacagtatgcacaatatgg

SEQ ID NO: 759381 - DNA, 25 bp, Mus musculus
tattattacagtttgcacaatatgg

SEQ ID NO: 759382 - DNA, 25 bp, Mus musculus
tattattagtgcagctcctccaggg

SEQ ID NO: 759383 - DNA, 25 bp, Mus musculus
tattattagtgctgctcctccaggg

SEQ ID NO: 759384 - DNA, 25 bp, Mus musculus
tattattatctactacagtgaagca

SEQ ID NO: 759385 - DNA, 25 bp, Mus musculus
tattattatctagtacagtgaagca

SEQ ID NO: 759386 - DNA, 25 bp, Mus musculus
tattattattctaagattgctgggc

SEQ ID NO: 759387 - DNA, 25 bp, Mus musculus
tattattattcttagattgctgggc

SEQ ID NO: 759388 - DNA, 25 bp, Mus musculus
tattattcgtccaatctgatggcga

SEQ ID NO: 759389 - DNA, 25 bp, Mus musculus
tattattcgtcctatctgatggcga

SEQ ID NO: 759390 - DNA, 25 bp, Mus musculus
tattattcttccaggtgattttcga

SEQ ID NO: 759391 - DNA, 25 bp, Mus musculus
tattattcttcctggtgattttcga

SEQ ID NO: 759392 - DNA, 25 bp, Mus musculus
tattattgataacaccaacctgcac

SEQ ID NO: 759393 - DNA, 25 bp, Mus musculus
tattattgataagaccaacctgcac

SEQ ID NO: 759394 - DNA, 25 bp, Mus musculus
tattattgtagcagaatactttcgc

SEQ ID NO: 759395 - DNA, 25 bp, Mus musculus
tattattgtagctgaatactttcgc

SEQ ID NO: 759396 - DNA, 25 bp, Mus musculus
tattatttcatcctgatgactggca

SEQ ID NO: 759397 - DNA, 25 bp, Mus musculus
tattatttcatcgtgatgactggca

SEQ ID NO: 759398 - DNA, 25 bp, Mus musculus
tattatttcttacgcaatgtggctg

SEQ ID NO: 759399 - DNA, 25 bp, Mus musculus
tattatttcttacgttcaccagtgg

SEQ ID NO: 759400 - DNA, 25 bp, Mus musculus
tattatttcttaggcaatgtggctg

SEQ ID NO: 759401 - DNA, 25 bp, Mus musculus
tattatttcttaggttcaccagtgg

SEQ ID NO: 759402 - DNA, 25 bp, Mus musculus
tattatttggagaatgagagtctcc

SEQ ID NO: 759403 - DNA, 25 bp, Mus musculus
tattatttggagtatgagagtctcc

SEQ ID NO: 759404 - DNA, 25 bp, Mus musculus
tattatttggccacaggtgcaaggc

SEQ ID NO: 759405 - DNA, 25 bp, Mus musculus
tattatttggcctcaggtgcaaggc

SEQ ID NO: 759406 - DNA, 25 bp, Mus musculus
tattcaaagttgaaaatcccgagtt

SEQ ID NO: 759407 - DNA, 25 bp, Mus musculus
tattcaaagttgtaaatcccgagtt

SEQ ID NO: 759408 - DNA, 25 bp, Mus musculus
tattcaacaccacctccagtcagat

SEQ ID NO: 759409 - DNA, 25 bp, Mus musculus
tattcaacaccagctccagtcagat

SEQ ID NO: 759410 - DNA, 25 bp, Mus musculus
tattcaacagaacataagggcagac

SEQ ID NO: 759411 - DNA, 25 bp, Mus musculus
tattcaacagaagataagggcagac

SEQ ID NO: 759412 - DNA, 25 bp, Mus musculus
tattcaaccaacaacccgtctgagc

SEQ ID NO: 759413 - DNA, 25 bp, Mus musculus
tattcaaccaactacccgtctgagc

SEQ ID NO: 759414 - DNA, 25 bp, Mus musculus
tattcaaccagcatcttcgagtcgg

SEQ ID NO: 759415 - DNA, 25 bp, Mus musculus
tattcaaccagcttcttcgagtcgg

SEQ ID NO: 759416 - DNA, 25 bp, Mus musculus
tattcaacgaaacgcccatcaatcc

SEQ ID NO: 759417 - DNA, 25 bp, Mus musculus
tattcaacgaaaggcccatcaatcc

SEQ ID NO: 759418 - DNA, 25 bp, Mus musculus
tattcaactcagagacaccatccag

SEQ ID NO: 759419 - DNA, 25 bp, Mus musculus
tattcaactcagtgacaccatccag

SEQ ID NO: 759420 - DNA, 25 bp, Mus musculus
tattcaagagcaaatgaccaagagc

SEQ ID NO: 759421 - DNA, 25 bp, Mus musculus
tattcaagagcatatgaccaagagc

SEQ ID NO: 759422 - DNA, 25 bp, Mus musculus
tattcaagatcgcaatcatggaggg

SEQ ID NO: 759423 - DNA, 25 bp, Mus musculus
tattcaagatcggaatcatggaggg

SEQ ID NO: 759424 - DNA, 25 bp, Mus musculus
tattcaagatttcaactggcagcga

SEQ ID NO: 759425 - DNA, 25 bp, Mus musculus
tattcaagatttgaactggcagcga

SEQ ID NO: 759426 - DNA, 25 bp, Mus musculus
tattcaaggtcgaggaaggtcagac

SEQ ID NO: 759427 - DNA, 25 bp, Mus musculus
tattcaaggtcgtggaaggtcagac

SEQ ID NO: 759428 - DNA, 25 bp, Mus musculus
tattcaaggtgtcgttagaaaagcc

SEQ ID NO: 759429 - DNA, 25 bp, Mus musculus
tattcaaggtgtctgatgatgaata

SEQ ID NO: 759430 - DNA, 25 bp, Mus musculus
tattcaaggtgtggttagaaaagcc

SEQ ID NO: 759431 - DNA, 25 bp, Mus musculus
tattcaaggtgtgtgatgatgaata

SEQ ID NO: 759432 - DNA, 25 bp, Mus musculus
tattcaagtcaaaaaacatgcgtgt

SEQ ID NO: 759433 - DNA, 25 bp, Mus musculus
tattcaagtcaataaacatgcgtgt

SEQ ID NO: 759434 - DNA, 25 bp, Mus musculus
tattcaagtcacaagtgcccagaag

SEQ ID NO: 759435 - DNA, 25 bp, Mus musculus
tattcaagtcactagtgcccagaag

SEQ ID NO: 759436 - DNA, 25 bp, Mus musculus
tattcaagtgatccccaaggcaaag

SEQ ID NO: 759437 - DNA, 25 bp, Mus musculus
tattcaagtgatgcccaaggcaaag

SEQ ID NO: 759438 - DNA, 25 bp, Mus musculus
tattcaagtgcacagccgcatgtat

SEQ ID NO: 759439 - DNA, 25 bp, Mus musculus
tattcaagtgcagagccgcatgtat

SEQ ID NO: 759440 - DNA, 25 bp, Mus musculus
tattcaagtggaagtggccccagcc

SEQ ID NO: 759441 - DNA, 25 bp, Mus musculus
tattcaagtggatgtggccccagcc

SEQ ID NO: 759442 - DNA, 25 bp, Mus musculus
tattcaagttacatctgattggcga

SEQ ID NO: 759443 - DNA, 25 bp, Mus musculus
tattcaagttacttctgattggcga

SEQ ID NO: 759444 - DNA, 25 bp, Mus musculus
tattcaagttcccaggaatcttgtt

SEQ ID NO: 759445 - DNA, 25 bp, Mus musculus
tattcaagttccgaggaatcttgtt

SEQ ID NO: 759446 - DNA, 25 bp, Mus musculus
tattcaatacctagataaaggacct

SEQ ID NO: 759447 - DNA, 25 bp, Mus musculus
tattcaataccttgataaaggacct

SEQ ID NO: 759448 - DNA, 25 bp, Mus musculus
tattcaatcataacctctgggctgg

SEQ ID NO: 759449 - DNA, 25 bp, Mus musculus
tattcaatcatatcctctgggctgg

SEQ ID NO: 759450 - DNA, 25 bp, Mus musculus
tattcaatgactatacagccacgct

SEQ ID NO: 759451 - DNA, 25 bp, Mus musculus
tattcaatgactatgcggccaccct

SEQ ID NO: 759452 - DNA, 25 bp, Mus musculus
tattcaatgactttacagccacgct

SEQ ID NO: 759453 - DNA, 25 bp, Mus musculus
tattcaatgactttgcggccaccct

SEQ ID NO: 759454 - DNA, 25 bp, Mus musculus
tattcaattgatcgtcatactgacc

SEQ ID NO: 759455 - DNA, 25 bp, Mus musculus
tattcaattgatggtcatactgacc

SEQ ID NO: 759456 - DNA, 25 bp, Mus musculus
tattcacaagcacttgggtcctaag

SEQ ID NO: 759457 - DNA, 25 bp, Mus musculus
tattcacaagcagttgggtcctaag

SEQ ID NO: 759458 - DNA, 25 bp, Mus musculus
tattcacacccgagcctatgtgggc

SEQ ID NO: 759459 - DNA, 25 bp, Mus musculus
tattcacacccgtgcctatgtgggc

SEQ ID NO: 759460 - DNA, 25 bp, Mus musculus
tattcacacctgaagaacgtaaagg

SEQ ID NO: 759461 - DNA, 25 bp, Mus musculus
tattcacacctgtagaacgtaaagg

SEQ ID NO: 759462 - DNA, 25 bp, Mus musculus
tattcacaccttctttgatcaccag

SEQ ID NO: 759463 - DNA, 25 bp, Mus musculus
tattcacaccttgtttgatcaccag

SEQ ID NO: 759464 - DNA, 25 bp, Mus musculus
tattcacagagcaattactgagcct

SEQ ID NO: 759465 - DNA, 25 bp, Mus musculus
tattcacagagctattactgagcct

SEQ ID NO: 759466 - DNA, 25 bp, Mus musculus
tattcacagcccaggtaagtccaag

SEQ ID NO: 759467 - DNA, 25 bp, Mus musculus
tattcacagccctggtaagtccaag

SEQ ID NO: 759468 - DNA, 25 bp, Mus musculus
tattcacatcagacacagtgggctc

SEQ ID NO: 759469 - DNA, 25 bp, Mus musculus
tattcacatcagtcacagtgggctc

SEQ ID NO: 759470 - DNA, 25 bp, Mus musculus
tattcacatgggacaaataggctgc

SEQ ID NO: 759471 - DNA, 25 bp, Mus musculus
tattcacatgggtcaaataggctgc

SEQ ID NO: 759472 - DNA, 25 bp, Mus musculus
tattcaccagccagttatgagtcag

SEQ ID NO: 759473 - DNA, 25 bp, Mus musculus
tattcaccagcctgttatgagtcag

SEQ ID NO: 759474 - DNA, 25 bp, Mus musculus
tattcaccgaatccctcgtgggcgg

SEQ ID NO: 759475 - DNA, 25 bp, Mus musculus
tattcaccgaatgcctcgtgggcgg

SEQ ID NO: 759476 - DNA, 25 bp, Mus musculus
tattcaccgcctctacgaggagtgg

SEQ ID NO: 759477 - DNA, 25 bp, Mus musculus
tattcaccgcctgtacgaggagtgg

SEQ ID NO: 759478 - DNA, 25 bp, Mus musculus
tattcacgatcgctatgaccaccag

SEQ ID NO: 759479 - DNA, 25 bp, Mus musculus
tattcacgatcggtatgaccaccag

SEQ ID NO: 759480 - DNA, 25 bp, Mus musculus
tattcacgatggatttccgatatcc

SEQ ID NO: 759481 - DNA, 25 bp, Mus musculus
tattcacgatggttttccgatatcc

SEQ ID NO: 759482 - DNA, 25 bp, Mus musculus
tattcacgggaccaaagcatgactg

SEQ ID NO: 759483 - DNA, 25 bp, Mus musculus
tattcacgggacgaaagcatgactg

SEQ ID NO: 759484 - DNA, 25 bp, Mus musculus
tattcactgtacagccccgaggcac

SEQ ID NO: 759485 - DNA, 25 bp, Mus musculus
tattcactgtacagctttgagtacc

SEQ ID NO: 759486 - DNA, 25 bp, Mus musculus
tattcactgtactgccccgaggcac

SEQ ID NO: 759487 - DNA, 25 bp, Mus musculus
tattcactgtactgctttgagtacc

SEQ ID NO: 759488 - DNA, 25 bp, Mus musculus
tattcagaacaccaacagtctctct

SEQ ID NO: 759489 - DNA, 25 bp, Mus musculus
tattcagaacacgaacagtctctct

SEQ ID NO: 759490 - DNA, 25 bp, Mus musculus
tattcagaagatcacgtggccacct

SEQ ID NO: 759491 - DNA, 25 bp, Mus musculus
tattcagaagatgacgtggccacct

SEQ ID NO: 759492 - DNA, 25 bp, Mus musculus
tattcagaatgtaatcctggtgttc

SEQ ID NO: 759493 - DNA, 25 bp, Mus musculus
tattcagaatgttatcctggtgttc

SEQ ID NO: 759494 - DNA, 25 bp, Mus musculus
tattcagacccaacatggagttaca

SEQ ID NO: 759495 - DNA, 25 bp, Mus musculus
tattcagacccatcatggagttaca

SEQ ID NO: 759496 - DNA, 25 bp, Mus musculus
tattcagagctcagccgtgggcacg

SEQ ID NO: 759497 - DNA, 25 bp, Mus musculus
tattcagagctctgccgtgggcacg

SEQ ID NO: 759498 - DNA, 25 bp, Mus musculus
tattcagagtgaacttcatcgggac

SEQ ID NO: 759499 - DNA, 25 bp, Mus musculus
tattcagagtgatcttcatcgggac

SEQ ID NO: 759500 - DNA, 25 bp, Mus musculus
tattcagatgccagtcaactggccg

SEQ ID NO: 759501 - DNA, 25 bp, Mus musculus
tattcagatgcctgtcaactggccg

SEQ ID NO: 759502 - DNA, 25 bp, Mus musculus
tattcagcacaaagattggcaagca

SEQ ID NO: 759503 - DNA, 25 bp, Mus musculus
tattcagcacaatgattggcaagca

SEQ ID NO: 759504 - DNA, 25 bp, Mus musculus
tattcagcctcacctagttcaagga

SEQ ID NO: 759505 - DNA, 25 bp, Mus musculus
tattcagcctcagctagttcaagga

SEQ ID NO: 759506 - DNA, 25 bp, Mus musculus
tattcagctatcaggcagttgtgcc

SEQ ID NO: 759507 - DNA, 25 bp, Mus musculus
tattcagctatctggcagttgtgcc

SEQ ID NO: 759508 - DNA, 25 bp, Mus musculus
tattcagctcgcacttcagcttgcc

SEQ ID NO: 759509 - DNA, 25 bp, Mus musculus
tattcagctcgctcttcagcttgcc

SEQ ID NO: 759510 - DNA, 25 bp, Mus musculus
tattcaggaaataaggctggcccca

SEQ ID NO: 759511 - DNA, 25 bp, Mus musculus
tattcaggaaattaggctggcccca

SEQ ID NO: 759512 - DNA, 25 bp, Mus musculus
tattcaggagacaatgcctgcagct

SEQ ID NO: 759513 - DNA, 25 bp, Mus musculus
tattcaggagactatgcctgcagct

SEQ ID NO: 759514 - DNA, 25 bp, Mus musculus
tattcaggagagaaggtatatcccc

SEQ ID NO: 759515 - DNA, 25 bp, Mus musculus
tattcaggagagtaggtatatcccc

SEQ ID NO: 759516 - DNA, 25 bp, Mus musculus
tattcaggcattctgtggagttctg

SEQ ID NO: 759517 - DNA, 25 bp, Mus musculus
tattcaggcattgtgtggagttctg

SEQ ID NO: 759518 - DNA, 25 bp, Mus musculus
tattcaggccacagcttggagaacc

SEQ ID NO: 759519 - DNA, 25 bp, Mus musculus
tattcaggccactgcttggagaacc

SEQ ID NO: 759520 - DNA, 25 bp, Mus musculus
tattcagtcaaacaaggttggcacg

SEQ ID NO: 759521 - DNA, 25 bp, Mus musculus
tattcagtcaaagaaggttggcacg

SEQ ID NO: 759522 - DNA, 25 bp, Mus musculus
tattcagtcagaacggaccctgtaa

SEQ ID NO: 759523 - DNA, 25 bp, Mus musculus
tattcagtcagatcggaccctgtaa

SEQ ID NO: 759524 - DNA, 25 bp, Mus musculus
tattcagtctgcaaagaagtttgtg

SEQ ID NO: 759525 - DNA, 25 bp, Mus musculus
tattcagtctgctaagaagtttgtg

SEQ ID NO: 759526 - DNA, 25 bp, Mus musculus
tattcagtgcatagctttaagccag

SEQ ID NO: 759527 - DNA, 25 bp, Mus musculus
tattcagtgcattgctttaagccag

SEQ ID NO: 759528 - DNA, 25 bp, Mus musculus
tattcagtgggtaggttatagggcc

SEQ ID NO: 759529 - DNA, 25 bp, Mus musculus
tattcagtgggttggttatagggcc

SEQ ID NO: 759530 - DNA, 25 bp, Mus musculus
tattcagttcacaacctcacctggc

SEQ ID NO: 759531 - DNA, 25 bp, Mus musculus
tattcagttcactacctcacctggc

SEQ ID NO: 759532 - DNA, 25 bp, Mus musculus
tattcagttgatctttgagcgtgcc

SEQ ID NO: 759533 - DNA, 25 bp, Mus musculus
tattcagttgatgtttgagcgtgcc

SEQ ID NO: 759534 - DNA, 25 bp, Mus musculus
tattcagtttcccttcccaatgtaa

SEQ ID NO: 759535 - DNA, 25 bp, Mus musculus
tattcagtttccgttcccaatgtaa

SEQ ID NO: 759536 - DNA, 25 bp, Mus musculus
tattcataaaaaagtgactgacccg

SEQ ID NO: 759537 - DNA, 25 bp, Mus musculus
tattcataaaaatgtgactgacccg

SEQ ID NO: 759538 - DNA, 25 bp, Mus musculus
tattcataagtaatagactgccaga

SEQ ID NO: 759539 - DNA, 25 bp, Mus musculus
tattcataagtattagactgccaga

SEQ ID NO: 759540 - DNA, 25 bp, Mus musculus
tattcatcacaaaccatcagtctgg

SEQ ID NO: 759541 - DNA, 25 bp, Mus musculus
tattcatcacaatccatcagtctgg

SEQ ID NO: 759542 - DNA, 25 bp, Mus musculus
tattcatcatcaccgccaatgaagc

SEQ ID NO: 759543 - DNA, 25 bp, Mus musculus
tattcatcatcagcgccaatgaagc

SEQ ID NO: 759544 - DNA, 25 bp, Mus musculus
tattcatcggcgaacgctatgtgaa

SEQ ID NO: 759545 - DNA, 25 bp, Mus musculus
tattcatcggcgtacgctatgtgaa

SEQ ID NO: 759546 - DNA, 25 bp, Mus musculus
tattcatgaaaacttcgggatcgtg

SEQ ID NO: 759547 - DNA, 25 bp, Mus musculus
tattcatgaaaagttcgggatcgtg

SEQ ID NO: 759548 - DNA, 25 bp, Mus musculus
tattcatgatcacacggactcccac

SEQ ID NO: 759549 - DNA, 25 bp, Mus musculus
tattcatgatcagacggactcccac

SEQ ID NO: 759550 - DNA, 25 bp, Mus musculus
tattcatgattcctacaaaccctcc

SEQ ID NO: 759551 - DNA, 25 bp, Mus musculus
tattcatgattcgtacaaaccctcc

SEQ ID NO: 759552 - DNA, 25 bp, Mus musculus
tattcatgccccagaagagcgtggg

SEQ ID NO: 759553 - DNA, 25 bp, Mus musculus
tattcatgcccctgaagagcgtggg

SEQ ID NO: 759554 - DNA, 25 bp, Mus musculus
tattcatggccacggttataccaca

SEQ ID NO: 759555 - DNA, 25 bp, Mus musculus
tattcatggccagggttataccaca

SEQ ID NO: 759556 - DNA, 25 bp, Mus musculus
tattcatggtttctacacggacccc

SEQ ID NO: 759557 - DNA, 25 bp, Mus musculus
tattcatggtttgtacacggacccc

SEQ ID NO: 759558 - DNA, 25 bp, Mus musculus
tattcatgtgggaaatcaagtagtg

SEQ ID NO: 759559 - DNA, 25 bp, Mus musculus
tattcatgtgggtaatcaagtagtg

SEQ ID NO: 759560 - DNA, 25 bp, Mus musculus
tattcattactcaaagttcaagtcg

SEQ ID NO: 759561 - DNA, 25 bp, Mus musculus
tattcattactctaagttcaagtcg

SEQ ID NO: 759562 - DNA, 25 bp, Mus musculus
tattcattgacaaacagcaaagaag

SEQ ID NO: 759563 - DNA, 25 bp, Mus musculus
tattcattgacatacagcaaagaag

SEQ ID NO: 759564 - DNA, 25 bp, Mus musculus
tattcattgtggaagagtgtcctga

SEQ ID NO: 759565 - DNA, 25 bp, Mus musculus
tattcattgtggtagagtgtcctga

SEQ ID NO: 759566 - DNA, 25 bp, Mus musculus
tattccaaaatcaaaccatggaggt

SEQ ID NO: 759567 - DNA, 25 bp, Mus musculus
tattccaaaatctaaccatggaggt

SEQ ID NO: 759568 - DNA, 25 bp, Mus musculus
tattccaaagtgcaaggtcctcaga

SEQ ID NO: 759569 - DNA, 25 bp, Mus musculus
tattccaaagtggaaggtcctcaga

SEQ ID NO: 759570 - DNA, 25 bp, Mus musculus
tattccaacaggcaccattctggcc

SEQ ID NO: 759571 - DNA, 25 bp, Mus musculus
tattccaacagggaccattctggcc

SEQ ID NO: 759572 - DNA, 25 bp, Mus musculus
tattccaagagcaggccgacaagtg

SEQ ID NO: 759573 - DNA, 25 bp, Mus musculus
tattccaagagctggccgacaagtg

SEQ ID NO: 759574 - DNA, 25 bp, Mus musculus
tattccaataacagtaccacctcca

SEQ ID NO: 759575 - DNA, 25 bp, Mus musculus
tattccaataactgtaccacctcca

SEQ ID NO: 759576 - DNA, 25 bp, Mus musculus
tattccaatctccatgacatcatgt

SEQ ID NO: 759577 - DNA, 25 bp, Mus musculus
tattccaatctcgatgacatcatgt

SEQ ID NO: 759578 - DNA, 25 bp, Mus musculus
tattccaattctacagacagttttc

SEQ ID NO: 759579 - DNA, 25 bp, Mus musculus
tattccaattcttcagacagttttc

SEQ ID NO: 759580 - DNA, 25 bp, Mus musculus
tattccacaaagcatgactattcac

SEQ ID NO: 759581 - DNA, 25 bp, Mus musculus
tattccacaaaggatgactattcac

SEQ ID NO: 759582 - DNA, 25 bp, Mus musculus
tattccacagctcaatgcaggagca

SEQ ID NO: 759583 - DNA, 25 bp, Mus musculus
tattccacagctgaatgcaggagca

SEQ ID NO: 759584 - DNA, 25 bp, Mus musculus
tattccaccgaactgaagaagctgt

SEQ ID NO: 759585 - DNA, 25 bp, Mus musculus
tattccaccgaagtgaagaagctgt

SEQ ID NO: 759586 - DNA, 25 bp, Mus musculus
tattccacgactagttcagctgctt

SEQ ID NO: 759587 - DNA, 25 bp, Mus musculus
tattccacgacttgttcagctgctt

SEQ ID NO: 759588 - DNA, 25 bp, Mus musculus
tattccacttgtcaggaaacaacct

SEQ ID NO: 759589 - DNA, 25 bp, Mus musculus
tattccacttgtgaggaaacaacct

SEQ ID NO: 759590 - DNA, 25 bp, Mus musculus
tattccagaagcattcactgagggc

SEQ ID NO: 759591 - DNA, 25 bp, Mus musculus
tattccagaagctttcactgagggc

SEQ ID NO: 759592 - DNA, 25 bp, Mus musculus
tattccagagacagccccggcggac

SEQ ID NO: 759593 - DNA, 25 bp, Mus musculus
tattccagagactgccccggcggac

SEQ ID NO: 759594 - DNA, 25 bp, Mus musculus
tattccagatctccaatgtcacagg

SEQ ID NO: 759595 - DNA, 25 bp, Mus musculus
tattccagatctgcaatgtcacagg

SEQ ID NO: 759596 - DNA, 25 bp, Mus musculus
tattccaggcaaacagtgtgagagc

SEQ ID NO: 759597 - DNA, 25 bp, Mus musculus
tattccaggcaactatcgctgcacc

SEQ ID NO: 759598 - DNA, 25 bp, Mus musculus
tattccaggcaagtatcgctgcacc

SEQ ID NO: 759599 - DNA, 25 bp, Mus musculus
tattccaggcaatcagtgtgagagc

SEQ ID NO: 759600 - DNA, 25 bp, Mus musculus
tattccaggtgtatatagagagcta

SEQ ID NO: 759601 - DNA, 25 bp, Mus musculus
tattccaggtgtttatagagagcta

SEQ ID NO: 759602 - DNA, 25 bp, Mus musculus
tattccagtaagagctgctggcaac

SEQ ID NO: 759603 - DNA, 25 bp, Mus musculus
tattccagtaagtgctgctggcaac

SEQ ID NO: 759604 - DNA, 25 bp, Mus musculus
tattccagtgacaataaacttgaac

SEQ ID NO: 759605 - DNA, 25 bp, Mus musculus
tattccagtgactataaacttgaac

SEQ ID NO: 759606 - DNA, 25 bp, Mus musculus
tattccatagaacatagcagtccac

SEQ ID NO: 759607 - DNA, 25 bp, Mus musculus
tattccatagaagatagcagtccac

SEQ ID NO: 759608 - DNA, 25 bp, Mus musculus
tattccatagcaattggaagacgcc

SEQ ID NO: 759609 - DNA, 25 bp, Mus musculus
tattccatagcatttggaagacgcc

SEQ ID NO: 759610 - DNA, 25 bp, Mus musculus
tattccatcgccatcggcatctgag

SEQ ID NO: 759611 - DNA, 25 bp, Mus musculus
tattccatcgccttcggcatctgag

SEQ ID NO: 759612 - DNA, 25 bp, Mus musculus
tattccatgagtacaactaagccag

SEQ ID NO: 759613 - DNA, 25 bp, Mus musculus
tattccatgagttcaactaagccag

SEQ ID NO: 759614 - DNA, 25 bp, Mus musculus
tattccatgattcctctctgccttg

SEQ ID NO: 759615 - DNA, 25 bp, Mus musculus
tattccatgattgctctctgccttg

SEQ ID NO: 759616 - DNA, 25 bp, Mus musculus
tattccatgcaaaggagcggcagct

SEQ ID NO: 759617 - DNA, 25 bp, Mus musculus
tattccatgcaatggagcggcagct

SEQ ID NO: 759618 - DNA, 25 bp, Mus musculus
tattccatgcttcatgccatcagaa

SEQ ID NO: 759619 - DNA, 25 bp, Mus musculus
tattccatgcttgatgccatcagaa

SEQ ID NO: 759620 - DNA, 25 bp, Mus musculus
tattccatgtggagaaaaatggccg

SEQ ID NO: 759621 - DNA, 25 bp, Mus musculus
tattccatgtggtgaaaaatggccg

SEQ ID NO: 759622 - DNA, 25 bp, Mus musculus
tattcccaaagcaaaccagttcttc

SEQ ID NO: 759623 - DNA, 25 bp, Mus musculus
tattcccaaagctaaccagttcttc

SEQ ID NO: 759624 - DNA, 25 bp, Mus musculus
tattcccacatgacgtgcgctaccg

SEQ ID NO: 759625 - DNA, 25 bp, Mus musculus
tattcccacatgtcgtgcgctaccg

SEQ ID NO: 759626 - DNA, 25 bp, Mus musculus
tattcccagaagaatgaatcgacag

SEQ ID NO: 759627 - DNA, 25 bp, Mus musculus
tattcccagaagtatgaatcgacag

SEQ ID NO: 759628 - DNA, 25 bp, Mus musculus
tattccctacttaaggagcaaccca

SEQ ID NO: 759629 - DNA, 25 bp, Mus musculus
tattccctactttaggagcaaccca

SEQ ID NO: 759630 - DNA, 25 bp, Mus musculus
tattccctcataaaagtctcaccct

SEQ ID NO: 759631 - DNA, 25 bp, Mus musculus
tattccctcatataagtctcaccct

SEQ ID NO: 759632 - DNA, 25 bp, Mus musculus
tattccctctggctcttatgtagtg

SEQ ID NO: 759633 - DNA, 25 bp, Mus musculus
tattccctctgggtcttatgtagtg

SEQ ID NO: 759634 - DNA, 25 bp, Mus musculus
tattcccttaccaggtgctaaccat

SEQ ID NO: 759635 - DNA, 25 bp, Mus musculus
tattcccttacctggtgctaaccat

SEQ ID NO: 759636 - DNA, 25 bp, Mus musculus
tattccgaactcagcgcattgacct

SEQ ID NO: 759637 - DNA, 25 bp, Mus musculus
tattccgaactctgcgcattgacct

SEQ ID NO: 759638 - DNA, 25 bp, Mus musculus
tattccgaaggaaccttaggagccc

SEQ ID NO: 759639 - DNA, 25 bp, Mus musculus
tattccgaaggatccttaggagccc

SEQ ID NO: 759640 - DNA, 25 bp, Mus musculus
tattccgaatgtctgaggacaagcc

SEQ ID NO: 759641 - DNA, 25 bp, Mus musculus
tattccgaatgtgtgaggacaagcc

SEQ ID NO: 759642 - DNA, 25 bp, Mus musculus
tattccgatggaagacgattgacgc

SEQ ID NO: 759643 - DNA, 25 bp, Mus musculus
tattccgatggatgacgattgacgc

SEQ ID NO: 759644 - DNA, 25 bp, Mus musculus
tattccggaattacgatgctcccga

SEQ ID NO: 759645 - DNA, 25 bp, Mus musculus
tattccggaatttcgatgctcccga

SEQ ID NO: 759646 - DNA, 25 bp, Mus musculus
tattccggagagcagagaaactgcg

SEQ ID NO: 759647 - DNA, 25 bp, Mus musculus
tattccggagaggagagaaactgcg

SEQ ID NO: 759648 - DNA, 25 bp, Mus musculus
tattccgggatacaaggctctacag

SEQ ID NO: 759649 - DNA, 25 bp, Mus musculus
tattccgggatagaaggctctacag

SEQ ID NO: 759650 - DNA, 25 bp, Mus musculus
tattccgtacaccaagaaggaaaca

SEQ ID NO: 759651 - DNA, 25 bp, Mus musculus
tattccgtacacgaagaaggaaaca

SEQ ID NO: 759652 - DNA, 25 bp, Mus musculus
tattccgtgggaacctacaacagtt

SEQ ID NO: 759653 - DNA, 25 bp, Mus musculus
tattccgtgggatcctacaacagtt

SEQ ID NO: 759654 - DNA, 25 bp, Mus musculus
tattccgtgtgcagcggaagcccca

SEQ ID NO: 759655 - DNA, 25 bp, Mus musculus
tattccgtgtgctgcggaagcccca

SEQ ID NO: 759656 - DNA, 25 bp, Mus musculus
tattcctaaagtacaacatgtcatc

SEQ ID NO: 759657 - DNA, 25 bp, Mus musculus
tattcctaaagttcaacatgtcatc

SEQ ID NO: 759658 - DNA, 25 bp, Mus musculus
tattcctaaggcaagatgggcatat

SEQ ID NO: 759659 - DNA, 25 bp, Mus musculus
tattcctaaggctagatgggcatat

SEQ ID NO: 759660 - DNA, 25 bp, Mus musculus
tattcctagcaacccgagaaggcag

SEQ ID NO: 759661 - DNA, 25 bp, Mus musculus
tattcctagcaagccgagaaggcag

SEQ ID NO: 759662 - DNA, 25 bp, Mus musculus
tattcctcagtgaataagcctggcc

SEQ ID NO: 759663 - DNA, 25 bp, Mus musculus
tattcctcagtgtataagcctggcc

SEQ ID NO: 759664 - DNA, 25 bp, Mus musculus
tattcctcatggaaaagcagctgcc

SEQ ID NO: 759665 - DNA, 25 bp, Mus musculus
tattcctcatggtaaagcagctgcc

SEQ ID NO: 759666 - DNA, 25 bp, Mus musculus
tattcctcgcctctctgcgtctgtg

SEQ ID NO: 759667 - DNA, 25 bp, Mus musculus
tattcctcgcctgtctgcgtctgtg

SEQ ID NO: 759668 - DNA, 25 bp, Mus musculus
tattcctctatgagatgctctgcct

SEQ ID NO: 759669 - DNA, 25 bp, Mus musculus
tattcctctatgtgatgctctgcct

SEQ ID NO: 759670 - DNA, 25 bp, Mus musculus
tattcctgaccgaccagcaggcgtt

SEQ ID NO: 759671 - DNA, 25 bp, Mus musculus
tattcctgaccgtccagcaggcgtt

SEQ ID NO: 759672 - DNA, 25 bp, Mus musculus
tattcctgacttcctacggccactg

SEQ ID NO: 759673 - DNA, 25 bp, Mus musculus
tattcctgacttgctacggccactg

SEQ ID NO: 759674 - DNA, 25 bp, Mus musculus
tattcctgagccagacggttgtaag

SEQ ID NO: 759675 - DNA, 25 bp, Mus musculus
tattcctgagcctgacggttgtaag

SEQ ID NO: 759676 - DNA, 25 bp, Mus musculus
tattcctgatctaccacaggagtgg

SEQ ID NO: 759677 - DNA, 25 bp, Mus musculus
tattcctgatcttccacaggagtgg

SEQ ID NO: 759678 - DNA, 25 bp, Mus musculus
tattcctgcacaaataacaaaaccc

SEQ ID NO: 759679 - DNA, 25 bp, Mus musculus
tattcctgcacatataacaaaaccc

SEQ ID NO: 759680 - DNA, 25 bp, Mus musculus
tattcctgccgtcggatggccaagc

SEQ ID NO: 759681 - DNA, 25 bp, Mus musculus
tattcctgccgtgggatggccaagc

SEQ ID NO: 759682 - DNA, 25 bp, Mus musculus
tattcctgcgcgatgagaagagtct

SEQ ID NO: 759683 - DNA, 25 bp, Mus musculus
tattcctgcgcgttgagaagagtct

SEQ ID NO: 759684 - DNA, 25 bp, Mus musculus
tattcctgctgtaggaggccactgg

SEQ ID NO: 759685 - DNA, 25 bp, Mus musculus
tattcctgctgtcagggcacttctc

SEQ ID NO: 759686 - DNA, 25 bp, Mus musculus
tattcctgctgtgagggcacttctc

SEQ ID NO: 759687 - DNA, 25 bp, Mus musculus
tattcctgctgttggaggccactgg

SEQ ID NO: 759688 - DNA, 25 bp, Mus musculus
tattcctggagcaatccccaaaaaa

SEQ ID NO: 759689 - DNA, 25 bp, Mus musculus
tattcctggagctatccccaaaaaa

SEQ ID NO: 759690 - DNA, 25 bp, Mus musculus
tattcctggcctagtgaacgctgct

SEQ ID NO: 759691 - DNA, 25 bp, Mus musculus
tattcctggccttgtgaacgctgct

SEQ ID NO: 759692 - DNA, 25 bp, Mus musculus
tattcctggcttaagtcatttttgt

SEQ ID NO: 759693 - DNA, 25 bp, Mus musculus
tattcctggctttagtcatttttgt

SEQ ID NO: 759694 - DNA, 25 bp, Mus musculus
tattcctgggatcaccttgcagagg

SEQ ID NO: 759695 - DNA, 25 bp, Mus musculus
tattcctgggatgaccttgcagagg

SEQ ID NO: 759696 - DNA, 25 bp, Mus musculus
tattcctgggtcactggccgctgag

SEQ ID NO: 759697 - DNA, 25 bp, Mus musculus
tattcctgggtctctggccgctgag

SEQ ID NO: 759698 - DNA, 25 bp, Mus musculus
tattcctgggtgatcaatggcgaga

SEQ ID NO: 759699 - DNA, 25 bp, Mus musculus
tattcctgggtgttcaatggcgaga

SEQ ID NO: 759700 - DNA, 25 bp, Mus musculus
tattcctgttatatatgaacggcat

SEQ ID NO: 759701 - DNA, 25 bp, Mus musculus
tattcctgttatttatgaacggcat

SEQ ID NO: 759702 - DNA, 25 bp, Mus musculus
tattccttaaggaggtacacaggga

SEQ ID NO: 759703 - DNA, 25 bp, Mus musculus
tattccttaaggtggtacacaggga

SEQ ID NO: 759704 - DNA, 25 bp, Mus musculus
tattccttacccaaagaagacacca

SEQ ID NO: 759705 - DNA, 25 bp, Mus musculus
tattccttaccctaagaagacacca

SEQ ID NO: 759706 - DNA, 25 bp, Mus musculus
tattccttcaaaagcctggaagcag

SEQ ID NO: 759707 - DNA, 25 bp, Mus musculus
tattccttcaaatgcctggaagcag

SEQ ID NO: 759708 - DNA, 25 bp, Mus musculus
tattccttcaccaggcaaaaactaa

SEQ ID NO: 759709 - DNA, 25 bp, Mus musculus
tattccttcacctggcaaaaactaa

SEQ ID NO: 759710 - DNA, 25 bp, Mus musculus
tattccttctgtacagcctgctgca

SEQ ID NO: 759711 - DNA, 25 bp, Mus musculus
tattccttctgttcagcctgctgca

SEQ ID NO: 759712 - DNA, 25 bp, Mus musculus
tattccttggaaagttcgctagagc

SEQ ID NO: 759713 - DNA, 25 bp, Mus musculus
tattccttggaatgttcgctagagc

SEQ ID NO: 759714 - DNA, 25 bp, Mus musculus
tattccttggtgcaccagacaagtg

SEQ ID NO: 759715 - DNA, 25 bp, Mus musculus
tattccttggtggaccagacaagtg

SEQ ID NO: 759716 - DNA, 25 bp, Mus musculus
tattccttttcacaatagccttgaa

SEQ ID NO: 759717 - DNA, 25 bp, Mus musculus
tattccttttcagaatagccttgaa

SEQ ID NO: 759718 - DNA, 25 bp, Mus musculus
tattcgaaacatagtaccaaccgga

SEQ ID NO: 759719 - DNA, 25 bp, Mus musculus
tattcgaaacattgtaccaaccgga

SEQ ID NO: 759720 - DNA, 25 bp, Mus musculus
tattcgaatactaggaccggactcc

SEQ ID NO: 759721 - DNA, 25 bp, Mus musculus
tattcgaatacttggaccggactcc

SEQ ID NO: 759722 - DNA, 25 bp, Mus musculus
tattcgagagggaccctgacaagag

SEQ ID NO: 759723 - DNA, 25 bp, Mus musculus
tattcgagagggtccctgacaagag

SEQ ID NO: 759724 - DNA, 25 bp, Mus musculus
tattcgagatgacctgcacacagaa

SEQ ID NO: 759725 - DNA, 25 bp, Mus musculus
tattcgagatgagctgcacacagaa

SEQ ID NO: 759726 - DNA, 25 bp, Mus musculus
tattcgaggtgcacttcgggctggt

SEQ ID NO: 759727 - DNA, 25 bp, Mus musculus
tattcgaggtgctcttcgggctggt

SEQ ID NO: 759728 - DNA, 25 bp, Mus musculus
tattcgatcggtagagaaaattgag

SEQ ID NO: 759729 - DNA, 25 bp, Mus musculus
tattcgatcggttgagaaaattgag

SEQ ID NO: 759730 - DNA, 25 bp, Mus musculus
tattcgatgacgctcaactgcagat

SEQ ID NO: 759731 - DNA, 25 bp, Mus musculus
tattcgatgacggtcaactgcagat

SEQ ID NO: 759732 - DNA, 25 bp, Mus musculus
tattcgatggaacagtcattagctc

SEQ ID NO: 759733 - DNA, 25 bp, Mus musculus
tattcgatggaagagtcattagctc

SEQ ID NO: 759734 - DNA, 25 bp, Mus musculus
tattcgcagggaacgcatcaggatg

SEQ ID NO: 759735 - DNA, 25 bp, Mus musculus
tattcgcagggatcgcatcaggatg

SEQ ID NO: 759736 - DNA, 25 bp, Mus musculus
tattcgcgatccaacttcaacaact

SEQ ID NO: 759737 - DNA, 25 bp, Mus musculus
tattcgcgatcctacttcaacaact

SEQ ID NO: 759738 - DNA, 25 bp, Mus musculus
tattcgcgctgcaattgcctccgcg

SEQ ID NO: 759739 - DNA, 25 bp, Mus musculus
tattcgcgctgctattgcctccgcg

SEQ ID NO: 759740 - DNA, 25 bp, Mus musculus
tattcgctggagcaatgcctcgagt

SEQ ID NO: 759741 - DNA, 25 bp, Mus musculus
tattcgctggaggaatgcctcgagt

SEQ ID NO: 759742 - DNA, 25 bp, Mus musculus
tattcgctgtctctgagacacaggc

SEQ ID NO: 759743 - DNA, 25 bp, Mus musculus
tattcgctgtctgtgagacacaggc

SEQ ID NO: 759744 - DNA, 25 bp, Mus musculus
tattcgcttctgagctcggaacggg

SEQ ID NO: 759745 - DNA, 25 bp, Mus musculus
tattcgcttctgtgctcggaacggg

SEQ ID NO: 759746 - DNA, 25 bp, Mus musculus
tattcggaagctataaaggatgctc

SEQ ID NO: 759747 - DNA, 25 bp, Mus musculus
tattcggaagctttaaaggatgctc

SEQ ID NO: 759748 - DNA, 25 bp, Mus musculus
tattcggacgaacttgatgcttatg

SEQ ID NO: 759749 - DNA, 25 bp, Mus musculus
tattcggacgaagttgatgcttatg

SEQ ID NO: 759750 - DNA, 25 bp, Mus musculus
tattcggagtcactttacacaagct

SEQ ID NO: 759751 - DNA, 25 bp, Mus musculus
tattcggagtcagtttacacaagct

SEQ ID NO: 759752 - DNA, 25 bp, Mus musculus
tattcggcagagactcagcccgatg

SEQ ID NO: 759753 - DNA, 25 bp, Mus musculus
tattcggcagagtctcagcccgatg

SEQ ID NO: 759754 - DNA, 25 bp, Mus musculus
tattcggctgaacctggtgtacgac

SEQ ID NO: 759755 - DNA, 25 bp, Mus musculus
tattcggctgaagctggtgtacgac

SEQ ID NO: 759756 - DNA, 25 bp, Mus musculus
tattcggctgacagtgagcccctga

SEQ ID NO: 759757 - DNA, 25 bp, Mus musculus
tattcggctgactgtgagcccctga

SEQ ID NO: 759758 - DNA, 25 bp, Mus musculus
tattcgggagccacagaagtatcct

SEQ ID NO: 759759 - DNA, 25 bp, Mus musculus
tattcgggagcctcagaagtatcct

SEQ ID NO: 759760 - DNA, 25 bp, Mus musculus
tattcgggcttaccctgcagccgga

SEQ ID NO: 759761 - DNA, 25 bp, Mus musculus
tattcgggcttagcctgcagccgga

SEQ ID NO: 759762 - DNA, 25 bp, Mus musculus
tattcgtagctcagctttcagagcg

SEQ ID NO: 759763 - DNA, 25 bp, Mus musculus
tattcgtagctctgctttcagagcg

SEQ ID NO: 759764 - DNA, 25 bp, Mus musculus
tattcgtccaaacaacactgctagt

SEQ ID NO: 759765 - DNA, 25 bp, Mus musculus
tattcgtccaaagaacactgctagt

SEQ ID NO: 759766 - DNA, 25 bp, Mus musculus
tattcgtggtttcctgaggtccgag

SEQ ID NO: 759767 - DNA, 25 bp, Mus musculus
tattcgtggtttgctgaggtccgag

SEQ ID NO: 759768 - DNA, 25 bp, Mus musculus
tattcgtgtcctcttctgctaatca

SEQ ID NO: 759769 - DNA, 25 bp, Mus musculus
tattcgtgtcctgttctgctaatca

SEQ ID NO: 759770 - DNA, 25 bp, Mus musculus
tattcgtttgacaaagccaagcagt

SEQ ID NO: 759771 - DNA, 25 bp, Mus musculus
tattcgtttgactaagccaagcagt

SEQ ID NO: 759772 - DNA, 25 bp, Mus musculus
tattctaaacaaagtgcttagggtt

SEQ ID NO: 759773 - DNA, 25 bp, Mus musculus
tattctaaacaatgtgcttagggtt

SEQ ID NO: 759774 - DNA, 25 bp, Mus musculus
tattctaaacatatcaccctacgcc

SEQ ID NO: 759775 - DNA, 25 bp, Mus musculus
tattctaaacatttcaccctacgcc

SEQ ID NO: 759776 - DNA, 25 bp, Mus musculus
tattctaaaccacatcactcagacc

SEQ ID NO: 759777 - DNA, 25 bp, Mus musculus
tattctaaaccagatcactcagacc

SEQ ID NO: 759778 - DNA, 25 bp, Mus musculus
tattctaaagatcgcctgtatgctg

SEQ ID NO: 759779 - DNA, 25 bp, Mus musculus
tattctaaagatggcctgtatgctg

SEQ ID NO: 759780 - DNA, 25 bp, Mus musculus
tattctaagtacaacacaccggtcc

SEQ ID NO: 759781 - DNA, 25 bp, Mus musculus
tattctaagtactacacaccggtcc

SEQ ID NO: 759782 - DNA, 25 bp, Mus musculus
tattctacaagaaaaattaggaagc

SEQ ID NO: 759783 - DNA, 25 bp, Mus musculus
tattctacaagataaattaggaagc

SEQ ID NO: 759784 - DNA, 25 bp, Mus musculus
tattctacacgtcaacagcaagggc

SEQ ID NO: 759785 - DNA, 25 bp, Mus musculus
tattctacacgtgaacagcaagggc

SEQ ID NO: 759786 - DNA, 25 bp, Mus musculus
tattctacatggacattgcacgggc

SEQ ID NO: 759787 - DNA, 25 bp, Mus musculus
tattctacatggtcattgcacgggc

SEQ ID NO: 759788 - DNA, 25 bp, Mus musculus
tattctacttaaaataagaagagca

SEQ ID NO: 759789 - DNA, 25 bp, Mus musculus
tattctacttaatataagaagagca

SEQ ID NO: 759790 - DNA, 25 bp, Mus musculus
tattctacttttagagatgtctcct

SEQ ID NO: 759791 - DNA, 25 bp, Mus musculus
tattctactttttgagatgtctcct

SEQ ID NO: 759792 - DNA, 25 bp, Mus musculus
tattctagaagtcgacgtatatccc

SEQ ID NO: 759793 - DNA, 25 bp, Mus musculus
tattctagaagtggacgtatatccc

SEQ ID NO: 759794 - DNA, 25 bp, Mus musculus
tattctagactcagttgagttgaca

SEQ ID NO: 759795 - DNA, 25 bp, Mus musculus
tattctagactctgttgagttgaca

SEQ ID NO: 759796 - DNA, 25 bp, Mus musculus
tattctagagcacccgccggaaaat

SEQ ID NO: 759797 - DNA, 25 bp, Mus musculus
tattctagagcagccgccggaaaat

SEQ ID NO: 759798 - DNA, 25 bp, Mus musculus
tattctagccaacggataccagacc

SEQ ID NO: 759799 - DNA, 25 bp, Mus musculus
tattctagccaagggataccagacc

SEQ ID NO: 759800 - DNA, 25 bp, Mus musculus
tattctatctggctccggtcacgag

SEQ ID NO: 759801 - DNA, 25 bp, Mus musculus
tattctatctgggtccggtcacgag

SEQ ID NO: 759802 - DNA, 25 bp, Mus musculus
tattctcaacaacaagctcattagc

SEQ ID NO: 759803 - DNA, 25 bp, Mus musculus
tattctcaacaagaagctcattagc

SEQ ID NO: 759804 - DNA, 25 bp, Mus musculus
tattctcaatctacatcagtgttct

SEQ ID NO: 759805 - DNA, 25 bp, Mus musculus
tattctcaatcttcatcagtgttct

SEQ ID NO: 759806 - DNA, 25 bp, Mus musculus
tattctcacactacctaaaaatagg

SEQ ID NO: 759807 - DNA, 25 bp, Mus musculus
tattctcacacttcctaaaaatagg

SEQ ID NO: 759808 - DNA, 25 bp, Mus musculus
tattctcagagtaggttggtgggca

SEQ ID NO: 759809 - DNA, 25 bp, Mus musculus
tattctcagagttggttggtgggca

SEQ ID NO: 759810 - DNA, 25 bp, Mus musculus
tattctcaggagagtgaagacatcc

SEQ ID NO: 759811 - DNA, 25 bp, Mus musculus
tattctcaggagtgtgaagacatcc

SEQ ID NO: 759812 - DNA, 25 bp, Mus musculus
tattctcattccaggcagagatcct

SEQ ID NO: 759813 - DNA, 25 bp, Mus musculus
tattctcattcctggcagagatcct

SEQ ID NO: 759814 - DNA, 25 bp, Mus musculus
tattctccacggacattagtgttcc

SEQ ID NO: 759815 - DNA, 25 bp, Mus musculus
tattctccacggtcattagtgttcc

SEQ ID NO: 759816 - DNA, 25 bp, Mus musculus
tattctccgaggcttggtctcacac

SEQ ID NO: 759817 - DNA, 25 bp, Mus musculus
tattctccgagggttggtctcacac

SEQ ID NO: 759818 - DNA, 25 bp, Mus musculus
tattctccgagtcacagctgaagac

SEQ ID NO: 759819 - DNA, 25 bp, Mus musculus
tattctccgagtgacagctgaagac

SEQ ID NO: 759820 - DNA, 25 bp, Mus musculus
tattctccggacattagcaccatga

SEQ ID NO: 759821 - DNA, 25 bp, Mus musculus
tattctccggactttagcaccatga

SEQ ID NO: 759822 - DNA, 25 bp, Mus musculus
tattctcgagagaagatctctgtta

SEQ ID NO: 759823 - DNA, 25 bp, Mus musculus
tattctcgagagtagatctctgtta

SEQ ID NO: 759824 - DNA, 25 bp, Mus musculus
tattctctaaagcatgtattccaaa

SEQ ID NO: 759825 - DNA, 25 bp, Mus musculus
tattctctaaaggatgtattccaaa

SEQ ID NO: 759826 - DNA, 25 bp, Mus musculus
tattctctaactagtgggacctctg

SEQ ID NO: 759827 - DNA, 25 bp, Mus musculus
tattctctaacttgtgggacctctg

SEQ ID NO: 759828 - DNA, 25 bp, Mus musculus
tattctctctatctgtgtcccgagg

SEQ ID NO: 759829 - DNA, 25 bp, Mus musculus
tattctctctatgtgtgtcccgagg

SEQ ID NO: 759830 - DNA, 25 bp, Mus musculus
tattctctgaaaccaaatgaccaga

SEQ ID NO: 759831 - DNA, 25 bp, Mus musculus
tattctctgaaagcaaatgaccaga

SEQ ID NO: 759832 - DNA, 25 bp, Mus musculus
tattctctgaccacaggcagcatgg

SEQ ID NO: 759833 - DNA, 25 bp, Mus musculus
tattctctgacctcaggcagcatgg

SEQ ID NO: 759834 - DNA, 25 bp, Mus musculus
tattctctgtcaccaaagcctatcg

SEQ ID NO: 759835 - DNA, 25 bp, Mus musculus
tattctctgtcagcaaagcctatcg

SEQ ID NO: 759836 - DNA, 25 bp, Mus musculus
tattctcttgggaacctccactctg

SEQ ID NO: 759837 - DNA, 25 bp, Mus musculus
tattctcttgggtacctccactctg

SEQ ID NO: 759838 - DNA, 25 bp, Mus musculus
tattctgaaagactctacactcaca

SEQ ID NO: 759839 - DNA, 25 bp, Mus musculus
tattctgaaagagtctacactcaca

SEQ ID NO: 759840 - DNA, 25 bp, Mus musculus
tattctgacggacaaaggaggcact

SEQ ID NO: 759841 - DNA, 25 bp, Mus musculus
tattctgacggagaaaggaggcact

SEQ ID NO: 759842 - DNA, 25 bp, Mus musculus
tattctgagggtatctccggatttg

SEQ ID NO: 759843 - DNA, 25 bp, Mus musculus
tattctgagggtttctccggatttg

SEQ ID NO: 759844 - DNA, 25 bp, Mus musculus
tattctgagtacattgaactattaa

SEQ ID NO: 759845 - DNA, 25 bp, Mus musculus
tattctgagtactttgaactattaa

SEQ ID NO: 759846 - DNA, 25 bp, Mus musculus
tattctgcaagtctgatcgaaacag

SEQ ID NO: 759847 - DNA, 25 bp, Mus musculus
tattctgcaagtgtgatcgaaacag

SEQ ID NO: 759848 - DNA, 25 bp, Mus musculus
tattctgcactaatgacaacgaggc

SEQ ID NO: 759849 - DNA, 25 bp, Mus musculus
tattctgcactattgacaacgaggc

SEQ ID NO: 759850 - DNA, 25 bp, Mus musculus
tattctgccaggacgggattcccaa

SEQ ID NO: 759851 - DNA, 25 bp, Mus musculus
tattctgccaggtcgggattcccaa

SEQ ID NO: 759852 - DNA, 25 bp, Mus musculus
tattctgctagaaatttacccctac

SEQ ID NO: 759853 - DNA, 25 bp, Mus musculus
tattctgctagatatttacccctac

SEQ ID NO: 759854 - DNA, 25 bp, Mus musculus
tattctgctatacgagacgacggac

SEQ ID NO: 759855 - DNA, 25 bp, Mus musculus
tattctgctataggagacgacggac

SEQ ID NO: 759856 - DNA, 25 bp, Mus musculus
tattctgctattcgcattggcttgg

SEQ ID NO: 759857 - DNA, 25 bp, Mus musculus
tattctgctattggcattggcttgg

SEQ ID NO: 759858 - DNA, 25 bp, Mus musculus
tattctgctggcatacttgggtgtc

SEQ ID NO: 759859 - DNA, 25 bp, Mus musculus
tattctgctggcttacttgggtgtc

SEQ ID NO: 759860 - DNA, 25 bp, Mus musculus
tattctggagaaacagcttatggac

SEQ ID NO: 759861 - DNA, 25 bp, Mus musculus
tattctggagaatcagcttatggac

SEQ ID NO: 759862 - DNA, 25 bp, Mus musculus
tattctggagtgcatgctgaacaca

SEQ ID NO: 759863 - DNA, 25 bp, Mus musculus
tattctggagtggatgctgaacaca

SEQ ID NO: 759864 - DNA, 25 bp, Mus musculus
tattctggcattaactctgcccttt

SEQ ID NO: 759865 - DNA, 25 bp, Mus musculus
tattctggcatttactctgcccttt

SEQ ID NO: 759866 - DNA, 25 bp, Mus musculus
tattctggctacaaatggagctctc

SEQ ID NO: 759867 - DNA, 25 bp, Mus musculus
tattctggctactaatggagctctc

SEQ ID NO: 759868 - DNA, 25 bp, Mus musculus
tattctggctgcagctcgcggcttc

SEQ ID NO: 759869 - DNA, 25 bp, Mus musculus
tattctggctgctgctcgcggcttc

SEQ ID NO: 759870 - DNA, 25 bp, Mus musculus
tattctggctgtagtgaaaaatggg

SEQ ID NO: 759871 - DNA, 25 bp, Mus musculus
tattctggctgttgtgaaaaatggg

SEQ ID NO: 759872 - DNA, 25 bp, Mus musculus
tattctgggaaccttgggccgccag

SEQ ID NO: 759873 - DNA, 25 bp, Mus musculus
tattctgggaacgttgggccgccag

SEQ ID NO: 759874 - DNA, 25 bp, Mus musculus
tattctgggcaacacagatccgcaa

SEQ ID NO: 759875 - DNA, 25 bp, Mus musculus
tattctgggcaagacagatccgcaa

SEQ ID NO: 759876 - DNA, 25 bp, Mus musculus
tattctgggcatcctcgttccttgg

SEQ ID NO: 759877 - DNA, 25 bp, Mus musculus
tattctgggcatgctcgttccttgg

SEQ ID NO: 759878 - DNA, 25 bp, Mus musculus
tattctggtcaaagtatccctcggg

SEQ ID NO: 759879 - DNA, 25 bp, Mus musculus
tattctggtcaatgtatccctcggg

SEQ ID NO: 759880 - DNA, 25 bp, Mus musculus
tattctgtggaacgacgtgtatctc

SEQ ID NO: 759881 - DNA, 25 bp, Mus musculus
tattctgtggaaggacgtgtatctc

SEQ ID NO: 759882 - DNA, 25 bp, Mus musculus
tattctgtggagcactaccaggagc

SEQ ID NO: 759883 - DNA, 25 bp, Mus musculus
tattctgtggaggactaccaggagc

SEQ ID NO: 759884 - DNA, 25 bp, Mus musculus
tattctgtggctacatcctctggac

SEQ ID NO: 759885 - DNA, 25 bp, Mus musculus
tattctgtggcttcatcctctggac

SEQ ID NO: 759886 - DNA, 25 bp, Mus musculus
tattctgttccacatttgccctcag

SEQ ID NO: 759887 - DNA, 25 bp, Mus musculus
tattctgttccagatttgccctcag

SEQ ID NO: 759888 - DNA, 25 bp, Mus musculus
tattctgttgcacgtagtctggctg

SEQ ID NO: 759889 - DNA, 25 bp, Mus musculus
tattctgttgcaggtagtctggctg

SEQ ID NO: 759890 - DNA, 25 bp, Mus musculus
tattcttatgaaataccccaaagtg

SEQ ID NO: 759891 - DNA, 25 bp, Mus musculus
tattcttatgaattaccccaaagtg

SEQ ID NO: 759892 - DNA, 25 bp, Mus musculus
tattcttatttcacagtcttgtcac

SEQ ID NO: 759893 - DNA, 25 bp, Mus musculus
tattcttatttctcagtcttgtcac

SEQ ID NO: 759894 - DNA, 25 bp, Mus musculus
tattcttcaagcctaatggaaacca

SEQ ID NO: 759895 - DNA, 25 bp, Mus musculus
tattcttcaagcgtaatggaaacca

SEQ ID NO: 759896 - DNA, 25 bp, Mus musculus
tattcttcacataaagcaaaacgtc

SEQ ID NO: 759897 - DNA, 25 bp, Mus musculus
tattcttcacattaagcaaaacgtc

SEQ ID NO: 759898 - DNA, 25 bp, Mus musculus
tattcttccagccagaagtcgtgtt

SEQ ID NO: 759899 - DNA, 25 bp, Mus musculus
tattcttccagcgagaagtcgtgtt

SEQ ID NO: 759900 - DNA, 25 bp, Mus musculus
tattcttccaggagattttcgatat

SEQ ID NO: 759901 - DNA, 25 bp, Mus musculus
tattcttccaggtgattttcgatat

SEQ ID NO: 759902 - DNA, 25 bp, Mus musculus
tattcttctgcacggagcgatgatg

SEQ ID NO: 759903 - DNA, 25 bp, Mus musculus
tattcttctgcagggagcgatgatg

SEQ ID NO: 759904 - DNA, 25 bp, Mus musculus
tattcttgccacagcagttcaggaa

SEQ ID NO: 759905 - DNA, 25 bp, Mus musculus
tattcttgccactgcagttcaggaa

SEQ ID NO: 759906 - DNA, 25 bp, Mus musculus
tattcttgctaactcttcattacag

SEQ ID NO: 759907 - DNA, 25 bp, Mus musculus
tattcttgctaagtcttcattacag

SEQ ID NO: 759908 - DNA, 25 bp, Mus musculus
tattctttacctagcatctgtctca

SEQ ID NO: 759909 - DNA, 25 bp, Mus musculus
tattctttaccttgcatctgtctca

SEQ ID NO: 759910 - DNA, 25 bp, Mus musculus
tattctttagatcctaagtgcgagt

SEQ ID NO: 759911 - DNA, 25 bp, Mus musculus
tattctttagatgctaagtgcgagt

SEQ ID NO: 759912 - DNA, 25 bp, Mus musculus
tattctttgcagactcagcaacagc

SEQ ID NO: 759913 - DNA, 25 bp, Mus musculus
tattctttgcagtctcagcaacagc

SEQ ID NO: 759914 - DNA, 25 bp, Mus musculus
tattcttttagcagatggctcctcc

SEQ ID NO: 759915 - DNA, 25 bp, Mus musculus
tattcttttagctgatggctcctcc

SEQ ID NO: 759916 - DNA, 25 bp, Mus musculus
tattgaaaaaatcaatgggatgctt

SEQ ID NO: 759917 - DNA, 25 bp, Mus musculus
tattgaaaaaatgaatgggatgctt

SEQ ID NO: 759918 - DNA, 25 bp, Mus musculus
tattgaaaacatctacagtgctacc

SEQ ID NO: 759919 - DNA, 25 bp, Mus musculus
tattgaaaacatgtacagtgctacc

SEQ ID NO: 759920 - DNA, 25 bp, Mus musculus
tattgaaaatccacgcaggacctat

SEQ ID NO: 759921 - DNA, 25 bp, Mus musculus
tattgaaaatcctcgcaggacctat

SEQ ID NO: 759922 - DNA, 25 bp, Mus musculus
tattgaaagatgcaatgaagtcctg

SEQ ID NO: 759923 - DNA, 25 bp, Mus musculus
tattgaaagatggaatgaagtcctg

SEQ ID NO: 759924 - DNA, 25 bp, Mus musculus
tattgaaagccgagtcttcccttcc

SEQ ID NO: 759925 - DNA, 25 bp, Mus musculus
tattgaaagccgtgtcttcccttcc

SEQ ID NO: 759926 - DNA, 25 bp, Mus musculus
tattgaaagtggctcgctatgctgc

SEQ ID NO: 759927 - DNA, 25 bp, Mus musculus
tattgaaagtgggtcgctatgctgc

SEQ ID NO: 759928 - DNA, 25 bp, Mus musculus
tattgaacaaagaaccaagggtggc

SEQ ID NO: 759929 - DNA, 25 bp, Mus musculus
tattgaacaaagtaccaagggtggc

SEQ ID NO: 759930 - DNA, 25 bp, Mus musculus
tattgaacactcagattacagagcc

SEQ ID NO: 759931 - DNA, 25 bp, Mus musculus
tattgaacactctgattacagagcc

SEQ ID NO: 759932 - DNA, 25 bp, Mus musculus
tattgaacccaaacagaaaagtcca

SEQ ID NO: 759933 - DNA, 25 bp, Mus musculus
tattgaacccaatcagaaaagtcca

SEQ ID NO: 759934 - DNA, 25 bp, Mus musculus
tattgaacctgcaacataatgagct

SEQ ID NO: 759935 - DNA, 25 bp, Mus musculus
tattgaacctgctacataatgagct

SEQ ID NO: 759936 - DNA, 25 bp, Mus musculus
tattgaaccttacaactgaatcacc

SEQ ID NO: 759937 - DNA, 25 bp, Mus musculus
tattgaaccttagaactgaatcacc

SEQ ID NO: 759938 - DNA, 25 bp, Mus musculus
tattgaactcttcacgaaggcattc

SEQ ID NO: 759939 - DNA, 25 bp, Mus musculus
tattgaactcttgacgaaggcattc

SEQ ID NO: 759940 - DNA, 25 bp, Mus musculus
tattgaaggagtcgttctcagagac

SEQ ID NO: 759941 - DNA, 25 bp, Mus musculus
tattgaaggagtggttctcagagac

SEQ ID NO: 759942 - DNA, 25 bp, Mus musculus
tattgaaggccgaagatgctggtac

SEQ ID NO: 759943 - DNA, 25 bp, Mus musculus
tattgaaggccgtagatgctggtac

SEQ ID NO: 759944 - DNA, 25 bp, Mus musculus
tattgaaggtccctggctccattgc

SEQ ID NO: 759945 - DNA, 25 bp, Mus musculus
tattgaaggtccgtggctccattgc

SEQ ID NO: 759946 - DNA, 25 bp, Mus musculus
tattgaagttctcactctcaagaaa

SEQ ID NO: 759947 - DNA, 25 bp, Mus musculus
tattgaagttctgactctcaagaaa

SEQ ID NO: 759948 - DNA, 25 bp, Mus musculus
tattgaagttgaacctgttctcacc

SEQ ID NO: 759949 - DNA, 25 bp, Mus musculus
tattgaagttgatcctgttctcacc

SEQ ID NO: 759950 - DNA, 25 bp, Mus musculus
tattgaatccccaaactaccctggg

SEQ ID NO: 759951 - DNA, 25 bp, Mus musculus
tattgaatcccctaactaccctggg

SEQ ID NO: 759952 - DNA, 25 bp, Mus musculus
tattgaattgtgcatctggtgcccc

SEQ ID NO: 759953 - DNA, 25 bp, Mus musculus
tattgaattgtggatctggtgcccc

SEQ ID NO: 759954 - DNA, 25 bp, Mus musculus
tattgacaacgacgcctatccagac

SEQ ID NO: 759955 - DNA, 25 bp, Mus musculus
tattgacaacgaggcctatccagac

SEQ ID NO: 759956 - DNA, 25 bp, Mus musculus
tattgacaagttcgattcacaaggc

SEQ ID NO: 759957 - DNA, 25 bp, Mus musculus
tattgacaagttggattcacaaggc

SEQ ID NO: 759958 - DNA, 25 bp, Mus musculus
tattgacatcctagttgggacccca

SEQ ID NO: 759959 - DNA, 25 bp, Mus musculus
tattgacatccttgttgggacccca

SEQ ID NO: 759960 - DNA, 25 bp, Mus musculus
tattgacatggcacccttgcaggca

SEQ ID NO: 759961 - DNA, 25 bp, Mus musculus
tattgacatggctcccttgcaggca

SEQ ID NO: 759962 - DNA, 25 bp, Mus musculus
tattgacattttcgtctcaacgctc

SEQ ID NO: 759963 - DNA, 25 bp, Mus musculus
tattgacattttggtctcaacgctc

SEQ ID NO: 759964 - DNA, 25 bp, Mus musculus
tattgacccatcaggcaattcccca

SEQ ID NO: 759965 - DNA, 25 bp, Mus musculus
tattgacccatctggcaattcccca

SEQ ID NO: 759966 - DNA, 25 bp, Mus musculus
tattgaccctgcctgggaatctcca

SEQ ID NO: 759967 - DNA, 25 bp, Mus musculus
tattgaccctgcgtgggaatctcca

SEQ ID NO: 759968 - DNA, 25 bp, Mus musculus
tattgaccgataaaagcgctggaag

SEQ ID NO: 759969 - DNA, 25 bp, Mus musculus
tattgaccgatataagcgctggaag

SEQ ID NO: 759970 - DNA, 25 bp, Mus musculus
tattgacctaccctggaagtatgcc

SEQ ID NO: 759971 - DNA, 25 bp, Mus musculus
tattgacctaccgtggaagtatgcc

SEQ ID NO: 759972 - DNA, 25 bp, Mus musculus
tattgactagacaggcccttggata

SEQ ID NO: 759973 - DNA, 25 bp, Mus musculus
tattgactagactggcccttggata

SEQ ID NO: 759974 - DNA, 25 bp, Mus musculus
tattgactggatagacaatggagaa

SEQ ID NO: 759975 - DNA, 25 bp, Mus musculus
tattgactggattgacaatggagaa

SEQ ID NO: 759976 - DNA, 25 bp, Mus musculus
tattgactgggcacctaagagcgac

SEQ ID NO: 759977 - DNA, 25 bp, Mus musculus
tattgactgggctcctaagagcgac

SEQ ID NO: 759978 - DNA, 25 bp, Mus musculus
tattgactttgactacagcagttac

SEQ ID NO: 759979 - DNA, 25 bp, Mus musculus
tattgactttgagtacagcagttac

SEQ ID NO: 759980 - DNA, 25 bp, Mus musculus
tattgagaagctaacccacgattat

SEQ ID NO: 759981 - DNA, 25 bp, Mus musculus
tattgagaagcttacccacgattat

SEQ ID NO: 759982 - DNA, 25 bp, Mus musculus
tattgagacagcctagggtacacag

SEQ ID NO: 759983 - DNA, 25 bp, Mus musculus
tattgagacagcgtagggtacacag

SEQ ID NO: 759984 - DNA, 25 bp, Mus musculus
tattgagactcacactggaagcatt

SEQ ID NO: 759985 - DNA, 25 bp, Mus musculus
tattgagactcagactggaagcatt

SEQ ID NO: 759986 - DNA, 25 bp, Mus musculus
tattgagagagtatccatgacacgc

SEQ ID NO: 759987 - DNA, 25 bp, Mus musculus
tattgagagagtttccatgacacgc

SEQ ID NO: 759988 - DNA, 25 bp, Mus musculus
tattgagatcaaccgccagaccaag

SEQ ID NO: 759989 - DNA, 25 bp, Mus musculus
tattgagatcaagcgccagaccaag

SEQ ID NO: 759990 - DNA, 25 bp, Mus musculus
tattgagatggtaatggccacagat

SEQ ID NO: 759991 - DNA, 25 bp, Mus musculus
tattgagatggttatggccacagat

SEQ ID NO: 759992 - DNA, 25 bp, Mus musculus
tattgagattaacttgaacgacagg

SEQ ID NO: 759993 - DNA, 25 bp, Mus musculus
tattgagattaagttgaacgacagg

SEQ ID NO: 759994 - DNA, 25 bp, Mus musculus
tattgagattagaagacaacagcct

SEQ ID NO: 759995 - DNA, 25 bp, Mus musculus
tattgagattagtagacaacagcct

SEQ ID NO: 759996 - DNA, 25 bp, Mus musculus
tattgagcaccgcaatgaaacagag

SEQ ID NO: 759997 - DNA, 25 bp, Mus musculus
tattgagcaccggaatgaaacagag

SEQ ID NO: 759998 - DNA, 25 bp, Mus musculus
tattgagcctaaccactggcccctg

SEQ ID NO: 759999 - DNA, 25 bp, Mus musculus
tattgagcctaagcactggcccctg

SEQ ID NO: 760000 - DNA, 25 bp, Mus musculus
tattgagcctcgcagactggattct

SEQ ID NO: 760001 - DNA, 25 bp, Mus musculus
tattgagcctcggagactggattct

SEQ ID NO: 760002 - DNA, 25 bp, Mus musculus
tattgagccttacttggaacaagcc

SEQ ID NO: 760003 - DNA, 25 bp, Mus musculus
tattgagccttagttggaacaagcc

SEQ ID NO: 760004 - DNA, 25 bp, Mus musculus
tattgagccttcagccgatgttgga

SEQ ID NO: 760005 - DNA, 25 bp, Mus musculus
tattgagccttctgccgatgttgga

SEQ ID NO: 760006 - DNA, 25 bp, Mus musculus
tattgagcttcccatggatacaaaa

SEQ ID NO: 760007 - DNA, 25 bp, Mus musculus
tattgagcttccgatggatacaaaa

SEQ ID NO: 760008 - DNA, 25 bp, Mus musculus
tattgaggaaaacagtgaagtcttt

SEQ ID NO: 760009 - DNA, 25 bp, Mus musculus
tattgaggaaaagagtgaagtcttt

SEQ ID NO: 760010 - DNA, 25 bp, Mus musculus
tattgaggactgagtaaatccgctc

SEQ ID NO: 760011 - DNA, 25 bp, Mus musculus
tattgaggactgtgtaaatccgctc

SEQ ID NO: 760012 - DNA, 25 bp, Mus musculus
tattgaggccccagtttgctatcat

SEQ ID NO: 760013 - DNA, 25 bp, Mus musculus
tattgaggccccatgtcctgcctgg

SEQ ID NO: 760014 - DNA, 25 bp, Mus musculus
tattgaggcccctgtttgctatcat

SEQ ID NO: 760015 - DNA, 25 bp, Mus musculus
tattgaggccccttgtcctgcctgg

SEQ ID NO: 760016 - DNA, 25 bp, Mus musculus
tattgagtcagcacaagtttgcaag

SEQ ID NO: 760017 - DNA, 25 bp, Mus musculus
tattgagtcagctcaagtttgcaag

SEQ ID NO: 760018 - DNA, 25 bp, Mus musculus
tattgagtcgcgaacagaagggcgc

SEQ ID NO: 760019 - DNA, 25 bp, Mus musculus
tattgagtcgcgtacagaagggcgc

SEQ ID NO: 760020 - DNA, 25 bp, Mus musculus
tattgagttgacatgtgaccagcga

SEQ ID NO: 760021 - DNA, 25 bp, Mus musculus
tattgagttgacttgtgaccagcga

SEQ ID NO: 760022 - DNA, 25 bp, Mus musculus
tattgagttgcacccagtcttagtc

SEQ ID NO: 760023 - DNA, 25 bp, Mus musculus
tattgagttgcagccagtcttagtc

SEQ ID NO: 760024 - DNA, 25 bp, Mus musculus
tattgataaaaaagcgtgttccttc

SEQ ID NO: 760025 - DNA, 25 bp, Mus musculus
tattgataaaaatgcgtgttccttc

SEQ ID NO: 760026 - DNA, 25 bp, Mus musculus
tattgataacaccaacctgcacgcc

SEQ ID NO: 760027 - DNA, 25 bp, Mus musculus
tattgataacacgaacctgcacgcc

SEQ ID NO: 760028 - DNA, 25 bp, Mus musculus
tattgataatgaagtgaaacttgac

SEQ ID NO: 760029 - DNA, 25 bp, Mus musculus
tattgataatgatgtgaaacttgac

SEQ ID NO: 760030 - DNA, 25 bp, Mus musculus
tattgataccacacttgcagcatgg

SEQ ID NO: 760031 - DNA, 25 bp, Mus musculus
tattgataccactcttgcagcatgg

SEQ ID NO: 760032 - DNA, 25 bp, Mus musculus
tattgatagcagaggcggacaacct

SEQ ID NO: 760033 - DNA, 25 bp, Mus musculus
tattgatagcagtggcggacaacct

SEQ ID NO: 760034 - DNA, 25 bp, Mus musculus
tattgatatactacctagcgggctg

SEQ ID NO: 760035 - DNA, 25 bp, Mus musculus
tattgatatacttcctagcgggctg

SEQ ID NO: 760036 - DNA, 25 bp, Mus musculus
tattgatcagctccccatggtctta

SEQ ID NO: 760037 - DNA, 25 bp, Mus musculus
tattgatcagctgcccatggtctta

SEQ ID NO: 760038 - DNA, 25 bp, Mus musculus
tattgatccagtcggaagaatccaa

SEQ ID NO: 760039 - DNA, 25 bp, Mus musculus
tattgatccagtgggaagaatccaa

SEQ ID NO: 760040 - DNA, 25 bp, Mus musculus
tattgatcgagaagagaacatccca

SEQ ID NO: 760041 - DNA, 25 bp, Mus musculus
tattgatcgagatgagaacatccca

SEQ ID NO: 760042 - DNA, 25 bp, Mus musculus
tattgatcgctaccgctctgtccag

SEQ ID NO: 760043 - DNA, 25 bp, Mus musculus
tattgatcgctagcgctctgtccag

SEQ ID NO: 760044 - DNA, 25 bp, Mus musculus
tattgatctgcaagcactgactggg

SEQ ID NO: 760045 - DNA, 25 bp, Mus musculus
tattgatctgcatgcactgactggg

SEQ ID NO: 760046 - DNA, 25 bp, Mus musculus
tattgatgaaaaaagatactctgac

SEQ ID NO: 760047 - DNA, 25 bp, Mus musculus
tattgatgaaaatagatactctgac

SEQ ID NO: 760048 - DNA, 25 bp, Mus musculus
tattgatgaatgacgctatggttac

SEQ ID NO: 760049 - DNA, 25 bp, Mus musculus
tattgatgaatgagcgactggaaga

SEQ ID NO: 760050 - DNA, 25 bp, Mus musculus
tattgatgaatgtcgctatggttac

SEQ ID NO: 760051 - DNA, 25 bp, Mus musculus
tattgatgaatgtgcgactggaaga

SEQ ID NO: 760052 - DNA, 25 bp, Mus musculus
tattgatgaccaagaacgtggactc

SEQ ID NO: 760053 - DNA, 25 bp, Mus musculus
tattgatgaccatgaacgtggactc

SEQ ID NO: 760054 - DNA, 25 bp, Mus musculus
tattgatgagtgagaggaccgtgaa

SEQ ID NO: 760055 - DNA, 25 bp, Mus musculus
tattgatgagtgtgaggaccgtgaa

SEQ ID NO: 760056 - DNA, 25 bp, Mus musculus
tattgatgcaggactgtttttcttc

SEQ ID NO: 760057 - DNA, 25 bp, Mus musculus
tattgatgcaggtctgtttttcttc

SEQ ID NO: 760058 - DNA, 25 bp, Mus musculus
tattgatggcgacggacaagtcaac

SEQ ID NO: 760059 - DNA, 25 bp, Mus musculus
tattgatggcgagggacaagtcaac

SEQ ID NO: 760060 - DNA, 25 bp, Mus musculus
tattgatgggaaccctcgtgtacct

SEQ ID NO: 760061 - DNA, 25 bp, Mus musculus
tattgatgggaagcctcgtgtacct

SEQ ID NO: 760062 - DNA, 25 bp, Mus musculus
tattgattacccatattcaccacct

SEQ ID NO: 760063 - DNA, 25 bp, Mus musculus
tattgattacccttattcaccacct

SEQ ID NO: 760064 - DNA, 25 bp, Mus musculus
tattgattagcactgccgtcacctc

SEQ ID NO: 760065 - DNA, 25 bp, Mus musculus
tattgattagcagtgccgtcacctc

SEQ ID NO: 760066 - DNA, 25 bp, Mus musculus
tattgcaaaaggcaatgtggtctgg

SEQ ID NO: 760067 - DNA, 25 bp, Mus musculus
tattgcaaaagggaatgtggtctgg

SEQ ID NO: 760068 - DNA, 25 bp, Mus musculus
tattgcaagtggcaagacgacatgc

SEQ ID NO: 760069 - DNA, 25 bp, Mus musculus
tattgcaagtgggaagacgacatgc

SEQ ID NO: 760070 - DNA, 25 bp, Mus musculus
tattgcaattcaacattgctgcctg

SEQ ID NO: 760071 - DNA, 25 bp, Mus musculus
tattgcaattcatcattgctgcctg

SEQ ID NO: 760072 - DNA, 25 bp, Mus musculus
tattgcaccaaaaatgagccctggc

SEQ ID NO: 760073 - DNA, 25 bp, Mus musculus
tattgcaccaaatatgagccctggc

SEQ ID NO: 760074 - DNA, 25 bp, Mus musculus
tattgcactggtcgtgtagatcgtg

SEQ ID NO: 760075 - DNA, 25 bp, Mus musculus
tattgcactggtggtgtagatcgtg

SEQ ID NO: 760076 - DNA, 25 bp, Mus musculus
tattgcagagttagcaagatctctg

SEQ ID NO: 760077 - DNA, 25 bp, Mus musculus
tattgcagagtttgcaagatctctg

SEQ ID NO: 760078 - DNA, 25 bp, Mus musculus
tattgcagccaacgataagctgtgg

SEQ ID NO: 760079 - DNA, 25 bp, Mus musculus
tattgcagccaaggataagctgtgg

SEQ ID NO: 760080 - DNA, 25 bp, Mus musculus
tattgcaggcaacgctactacttgc

SEQ ID NO: 760081 - DNA, 25 bp, Mus musculus
tattgcaggcaaggctactacttgc

SEQ ID NO: 760082 - DNA, 25 bp, Mus musculus
tattgcagttatatgggcttactgg

SEQ ID NO: 760083 - DNA, 25 bp, Mus musculus
tattgcagttatttgggcttactgg

SEQ ID NO: 760084 - DNA, 25 bp, Mus musculus
tattgcatcaggactcataggacct

SEQ ID NO: 760085 - DNA, 25 bp, Mus musculus
tattgcatcaggtctcataggacct

SEQ ID NO: 760086 - DNA, 25 bp, Mus musculus
tattgcatctgtatctgagcaccag

SEQ ID NO: 760087 - DNA, 25 bp, Mus musculus
tattgcatctgtttctgagcaccag

SEQ ID NO: 760088 - DNA, 25 bp, Mus musculus
tattgcatgaaacctgatcaacact

SEQ ID NO: 760089 - DNA, 25 bp, Mus musculus
tattgcatgaaagctgatcaacact

SEQ ID NO: 760090 - DNA, 25 bp, Mus musculus
tattgcatgaagatcccattgaagg

SEQ ID NO: 760091 - DNA, 25 bp, Mus musculus
tattgcatgaagttcccattgaagg

SEQ ID NO: 760092 - DNA, 25 bp, Mus musculus
tattgcattggtcacctctggagtt

SEQ ID NO: 760093 - DNA, 25 bp, Mus musculus
tattgcattggtgacctctggagtt

SEQ ID NO: 760094 - DNA, 25 bp, Mus musculus
tattgccaaacaatacaacatgagc

SEQ ID NO: 760095 - DNA, 25 bp, Mus musculus
tattgccaaacattacaacatgagc

SEQ ID NO: 760096 - DNA, 25 bp, Mus musculus
tattgccacaaaccgaatgatcact

SEQ ID NO: 760097 - DNA, 25 bp, Mus musculus
tattgccacaaagcgaatgatcact

SEQ ID NO: 760098 - DNA, 25 bp, Mus musculus
tattgccacagaagtagagaaactg

SEQ ID NO: 760099 - DNA, 25 bp, Mus musculus
tattgccacagatgtagagaaactg

SEQ ID NO: 760100 - DNA, 25 bp, Mus musculus
tattgccaccaaaaacggattgttc

SEQ ID NO: 760101 - DNA, 25 bp, Mus musculus
tattgccaccaataacggattgttc

SEQ ID NO: 760102 - DNA, 25 bp, Mus musculus
tattgccataaactccatgtggtcc

SEQ ID NO: 760103 - DNA, 25 bp, Mus musculus
tattgccataaagtccatgtggtcc

SEQ ID NO: 760104 - DNA, 25 bp, Mus musculus
tattgccatcaactgggccggtggt

SEQ ID NO: 760105 - DNA, 25 bp, Mus musculus
tattgccatcaagtgggccggtggt

SEQ ID NO: 760106 - DNA, 25 bp, Mus musculus
tattgccatcacctcttcctgggta

SEQ ID NO: 760107 - DNA, 25 bp, Mus musculus
tattgccatcacgtcttcctgggta

SEQ ID NO: 760108 - DNA, 25 bp, Mus musculus
tattgccatggacctcatgggcaca

SEQ ID NO: 760109 - DNA, 25 bp, Mus musculus
tattgccatggagctcatgggcaca

SEQ ID NO: 760110 - DNA, 25 bp, Mus musculus
tattgcccctccagtttgggtccca

SEQ ID NO: 760111 - DNA, 25 bp, Mus musculus
tattgcccctcctgtttgggtccca

SEQ ID NO: 760112 - DNA, 25 bp, Mus musculus
tattgccgatctctacttcagattc

SEQ ID NO: 760113 - DNA, 25 bp, Mus musculus
tattgccgatctgtacttcagattc

SEQ ID NO: 760114 - DNA, 25 bp, Mus musculus
tattgccgttcgattctccacagtc

SEQ ID NO: 760115 - DNA, 25 bp, Mus musculus
tattgccgttcgtttctccacagtc

SEQ ID NO: 760116 - DNA, 25 bp, Mus musculus
tattgccgttttcgacagagaatcg

SEQ ID NO: 760117 - DNA, 25 bp, Mus musculus
tattgccgttttggacagagaatcg

SEQ ID NO: 760118 - DNA, 25 bp, Mus musculus
tattgcctagaaatgcgggaagagc

SEQ ID NO: 760119 - DNA, 25 bp, Mus musculus
tattgcctagaattgcgggaagagc

SEQ ID NO: 760120 - DNA, 25 bp, Mus musculus
tattgcctcctaagtgcaagggcca

SEQ ID NO: 760121 - DNA, 25 bp, Mus musculus
tattgcctcctatgtgcaagggcca

SEQ ID NO: 760122 - DNA, 25 bp, Mus musculus
tattgcctgctgaaggacacttagc

SEQ ID NO: 760123 - DNA, 25 bp, Mus musculus
tattgcctgctgtaggacacttagc

SEQ ID NO: 760124 - DNA, 25 bp, Mus musculus
tattgcctgtagcaagaagaagggc

SEQ ID NO: 760125 - DNA, 25 bp, Mus musculus
tattgcctgtaggaagaagaagggc

SEQ ID NO: 760126 - DNA, 25 bp, Mus musculus
tattgcctgttcagcttgctttggc

SEQ ID NO: 760127 - DNA, 25 bp, Mus musculus
tattgcctgttctgcttgctttggc

SEQ ID NO: 760128 - DNA, 25 bp, Mus musculus
tattgccttcgaatattgcacgtca

SEQ ID NO: 760129 - DNA, 25 bp, Mus musculus
tattgccttcgattattgcacgtca

SEQ ID NO: 760130 - DNA, 25 bp, Mus musculus
tattgcgagactaaattaacgaagc

SEQ ID NO: 760131 - DNA, 25 bp, Mus musculus
tattgcgagacttaattaacgaagc

SEQ ID NO: 760132 - DNA, 25 bp, Mus musculus
tattgcgctataccctggcggacga

SEQ ID NO: 760133 - DNA, 25 bp, Mus musculus
tattgcgctatagcctggcggacga

SEQ ID NO: 760134 - DNA, 25 bp, Mus musculus
tattgctaattgaggctggcgtggc

SEQ ID NO: 760135 - DNA, 25 bp, Mus musculus
tattgctaattgtggctggcgtggc

SEQ ID NO: 760136 - DNA, 25 bp, Mus musculus
tattgctaccctcgctccctgaggg

SEQ ID NO: 760137 - DNA, 25 bp, Mus musculus
tattgctaccctggctccctgaggg

SEQ ID NO: 760138 - DNA, 25 bp, Mus musculus
tattgctagcctccctgctctaagg

SEQ ID NO: 760139 - DNA, 25 bp, Mus musculus
tattgctagcctgcctgctctaagg

SEQ ID NO: 760140 - DNA, 25 bp, Mus musculus
tattgctaggtaaggatctccttac

SEQ ID NO: 760141 - DNA, 25 bp, Mus musculus
tattgctaggtatggatctccttac

SEQ ID NO: 760142 - DNA, 25 bp, Mus musculus
tattgctattggagcaccacaagaa

SEQ ID NO: 760143 - DNA, 25 bp, Mus musculus
tattgctattggtgcaccacaagaa

SEQ ID NO: 760144 - DNA, 25 bp, Mus musculus
tattgctcaagcagtcctcagtcga

SEQ ID NO: 760145 - DNA, 25 bp, Mus musculus
tattgctcaagctgtcctcagtcga

SEQ ID NO: 760146 - DNA, 25 bp, Mus musculus
tattgctcatggaccccatgatgga

SEQ ID NO: 760147 - DNA, 25 bp, Mus musculus
tattgctcatggtccccatgatgga

SEQ ID NO: 760148 - DNA, 25 bp, Mus musculus
tattgctccaaaccacagagtaggc

SEQ ID NO: 760149 - DNA, 25 bp, Mus musculus
tattgctccaaagcacagagtaggc

SEQ ID NO: 760150 - DNA, 25 bp, Mus musculus
tattgctcggctcaattggaaacgc

SEQ ID NO: 760151 - DNA, 25 bp, Mus musculus
tattgctcggctgaattggaaacgc

SEQ ID NO: 760152 - DNA, 25 bp, Mus musculus
tattgctgagcacatcctggctaca

SEQ ID NO: 760153 - DNA, 25 bp, Mus musculus
tattgctgagcagatcctggctaca

SEQ ID NO: 760154 - DNA, 25 bp, Mus musculus
tattgctgagttcggcatctatcca

SEQ ID NO: 760155 - DNA, 25 bp, Mus musculus
tattgctgagttgggcatctatcca

SEQ ID NO: 760156 - DNA, 25 bp, Mus musculus
tattgctgccgaaggaggaaagaat

SEQ ID NO: 760157 - DNA, 25 bp, Mus musculus
tattgctgccgatggaggaaagaat

SEQ ID NO: 760158 - DNA, 25 bp, Mus musculus
tattgctgtcaaatccaagctgctc

SEQ ID NO: 760159 - DNA, 25 bp, Mus musculus
tattgctgtcaattccaagctgctc

SEQ ID NO: 760160 - DNA, 25 bp, Mus musculus
tattgctgtgacagagctgaagacc

SEQ ID NO: 760161 - DNA, 25 bp, Mus musculus
tattgctgtgactgagctgaagacc

SEQ ID NO: 760162 - DNA, 25 bp, Mus musculus
tattgcttaacacaaatggttccca

SEQ ID NO: 760163 - DNA, 25 bp, Mus musculus
tattgcttaacagaaatggttccca

SEQ ID NO: 760164 - DNA, 25 bp, Mus musculus
tattgcttcctgcacaccgacagca

SEQ ID NO: 760165 - DNA, 25 bp, Mus musculus
tattgcttcctggacaccgacagca

SEQ ID NO: 760166 - DNA, 25 bp, Mus musculus
tattgcttctgtcgctggatcgttc

SEQ ID NO: 760167 - DNA, 25 bp, Mus musculus
tattgcttctgtggctggatcgttc

SEQ ID NO: 760168 - DNA, 25 bp, Mus musculus
tattgcttgaccatgagtgaatcca

SEQ ID NO: 760169 - DNA, 25 bp, Mus musculus
tattgcttgaccttgagtgaatcca

SEQ ID NO: 760170 - DNA, 25 bp, Mus musculus
tattggaaacatccttcagatagat

SEQ ID NO: 760171 - DNA, 25 bp, Mus musculus
tattggaaacatgcttcagatagat

SEQ ID NO: 760172 - DNA, 25 bp, Mus musculus
tattggaaagagcacccctattgcc

SEQ ID NO: 760173 - DNA, 25 bp, Mus musculus
tattggaaagaggacccctattgcc

SEQ ID NO: 760174 - DNA, 25 bp, Mus musculus
tattggaaaggccataatatttctg

SEQ ID NO: 760175 - DNA, 25 bp, Mus musculus
tattggaaaggcgataatatttctg

SEQ ID NO: 760176 - DNA, 25 bp, Mus musculus
tattggaacacaaccgcaagaagcg

SEQ ID NO: 760177 - DNA, 25 bp, Mus musculus
tattggaacacatccgcaagaagcg

SEQ ID NO: 760178 - DNA, 25 bp, Mus musculus
tattggaagactcggaagactccgt

SEQ ID NO: 760179 - DNA, 25 bp, Mus musculus
tattggaagactgggaagactccgt

SEQ ID NO: 760180 - DNA, 25 bp, Mus musculus
tattggaagattacaggaacaaccg

SEQ ID NO: 760181 - DNA, 25 bp, Mus musculus
tattggaagatttcaggaacaaccg

SEQ ID NO: 760182 - DNA, 25 bp, Mus musculus
tattggaagcaaatgcagtggttgc

SEQ ID NO: 760183 - DNA, 25 bp, Mus musculus
tattggaagcaattgcagtggttgc

SEQ ID NO: 760184 - DNA, 25 bp, Mus musculus
tattggaatactcatgtctagcaag

SEQ ID NO: 760185 - DNA, 25 bp, Mus musculus
tattggaatactgatgtctagcaag

SEQ ID NO: 760186 - DNA, 25 bp, Mus musculus
tattggacacttcgccccaaacata

SEQ ID NO: 760187 - DNA, 25 bp, Mus musculus
tattggacacttggccccaaacata

SEQ ID NO: 760188 - DNA, 25 bp, Mus musculus
tattggacggtcaggaaacactgga

SEQ ID NO: 760189 - DNA, 25 bp, Mus musculus
tattggacggtctggaaacactgga

SEQ ID NO: 760190 - DNA, 25 bp, Mus musculus
tattggagagacctggccatgacct

SEQ ID NO: 760191 - DNA, 25 bp, Mus musculus
tattggagagacgtggccatgacct

SEQ ID NO: 760192 - DNA, 25 bp, Mus musculus
tattggagatgtccttcaggtctac

SEQ ID NO: 760193 - DNA, 25 bp, Mus musculus
tattggagatgtgcttcaggtctac

SEQ ID NO: 760194 - DNA, 25 bp, Mus musculus
tattggagcagaccatgtgcagagc

SEQ ID NO: 760195 - DNA, 25 bp, Mus musculus
tattggagcagagcatgtgcagagc

SEQ ID NO: 760196 - DNA, 25 bp, Mus musculus
tattggagcatgattacggatgacg

SEQ ID NO: 760197 - DNA, 25 bp, Mus musculus
tattggagcatgtttacggatgacg

SEQ ID NO: 760198 - DNA, 25 bp, Mus musculus
tattggagctcaacagggtagccgg

SEQ ID NO: 760199 - DNA, 25 bp, Mus musculus
tattggagctcatcagggtagccgg

SEQ ID NO: 760200 - DNA, 25 bp, Mus musculus
tattggagtgctcttatgccacagc

SEQ ID NO: 760201 - DNA, 25 bp, Mus musculus
tattggagtgctgttatgccacagc

SEQ ID NO: 760202 - DNA, 25 bp, Mus musculus
tattggatcttgctacacagagtct

SEQ ID NO: 760203 - DNA, 25 bp, Mus musculus
tattggatcttggtacacagagtct

SEQ ID NO: 760204 - DNA, 25 bp, Mus musculus
tattggatgattctttggtgtctct

SEQ ID NO: 760205 - DNA, 25 bp, Mus musculus
tattggatgattgtttggtgtctct

SEQ ID NO: 760206 - DNA, 25 bp, Mus musculus
tattggcaactaccggctccttaag

SEQ ID NO: 760207 - DNA, 25 bp, Mus musculus
tattggcaactagcggctccttaag

SEQ ID NO: 760208 - DNA, 25 bp, Mus musculus
tattggcaattgctggagaagattt

SEQ ID NO: 760209 - DNA, 25 bp, Mus musculus
tattggcaattggtggagaagattt

SEQ ID NO: 760210 - DNA, 25 bp, Mus musculus
tattggcagccaaggaatgtgtcca

SEQ ID NO: 760211 - DNA, 25 bp, Mus musculus
tattggcagccatggaatgtgtcca

SEQ ID NO: 760212 - DNA, 25 bp, Mus musculus
tattggcatcgacaaggaccgtact

SEQ ID NO: 760213 - DNA, 25 bp, Mus musculus
tattggcatcgagaaggaccgtact

SEQ ID NO: 760214 - DNA, 25 bp, Mus musculus
tattggcatcggcttcacggatcgg

SEQ ID NO: 760215 - DNA, 25 bp, Mus musculus
tattggcatcgggttcacggatcgg

SEQ ID NO: 760216 - DNA, 25 bp, Mus musculus
tattggcatctaagtcagggtgcaa

SEQ ID NO: 760217 - DNA, 25 bp, Mus musculus
tattggcatctatgtcagggtgcaa

SEQ ID NO: 760218 - DNA, 25 bp, Mus musculus
tattggcatctcatccacataccag

SEQ ID NO: 760219 - DNA, 25 bp, Mus musculus
tattggcatctcttccacataccag

SEQ ID NO: 760220 - DNA, 25 bp, Mus musculus
tattggcatgatcgagtgacaggaa

SEQ ID NO: 760221 - DNA, 25 bp, Mus musculus
tattggcatgatggagtgacaggaa

SEQ ID NO: 760222 - DNA, 25 bp, Mus musculus
tattggcattaccactataacctcc

SEQ ID NO: 760223 - DNA, 25 bp, Mus musculus
tattggcattacgactataacctcc

SEQ ID NO: 760224 - DNA, 25 bp, Mus musculus
tattggcattggcttggcatctaat

SEQ ID NO: 760225 - DNA, 25 bp, Mus musculus
tattggcattgggttggcatctaat

SEQ ID NO: 760226 - DNA, 25 bp, Mus musculus
tattggccacaacaggcaggtgagc

SEQ ID NO: 760227 - DNA, 25 bp, Mus musculus
tattggccacaagaggcaggtgagc

SEQ ID NO: 760228 - DNA, 25 bp, Mus musculus
tattggccacccaggaaacttcgtc

SEQ ID NO: 760229 - DNA, 25 bp, Mus musculus
tattggccaccctggaaacttcgtc

SEQ ID NO: 760230 - DNA, 25 bp, Mus musculus
tattggccagctcagaactcaggtg

SEQ ID NO: 760231 - DNA, 25 bp, Mus musculus
tattggccagctgagaactcaggtg

SEQ ID NO: 760232 - DNA, 25 bp, Mus musculus
tattggccaggaatcaagcacagct

SEQ ID NO: 760233 - DNA, 25 bp, Mus musculus
tattggccaggattcaagcacagct

SEQ ID NO: 760234 - DNA, 25 bp, Mus musculus
tattggcccagactatcagcaagat

SEQ ID NO: 760235 - DNA, 25 bp, Mus musculus
tattggcccagagtatcagcaagat

SEQ ID NO: 760236 - DNA, 25 bp, Mus musculus
tattggcccagcattgtaccgttac

SEQ ID NO: 760237 - DNA, 25 bp, Mus musculus
tattggcccagctttgtaccgttac

SEQ ID NO: 760238 - DNA, 25 bp, Mus musculus
tattggccctgaatgtggcctatca

SEQ ID NO: 760239 - DNA, 25 bp, Mus musculus
tattggccctgattgtggcctatca

SEQ ID NO: 760240 - DNA, 25 bp, Mus musculus
tattggccctgtatgtccctggacc

SEQ ID NO: 760241 - DNA, 25 bp, Mus musculus
tattggccctgtttgtccctggacc

SEQ ID NO: 760242 - DNA, 25 bp, Mus musculus
tattggccgtggcattgccttacag

SEQ ID NO: 760243 - DNA, 25 bp, Mus musculus
tattggccgtgggattgccttacag

SEQ ID NO: 760244 - DNA, 25 bp, Mus musculus
tattggcctagcaactgtgggcaac

SEQ ID NO: 760245 - DNA, 25 bp, Mus musculus
tattggcctagctactgtgggcaac

SEQ ID NO: 760246 - DNA, 25 bp, Mus musculus
tattggcgcaccagaaagtcgttcc

SEQ ID NO: 760247 - DNA, 25 bp, Mus musculus
tattggcgcacctgaaagtcgttcc

SEQ ID NO: 760248 - DNA, 25 bp, Mus musculus
tattggcgcatacactggagctaag

SEQ ID NO: 760249 - DNA, 25 bp, Mus musculus
tattggcgcatagactggagctaag

SEQ ID NO: 760250 - DNA, 25 bp, Mus musculus
tattggcgtcagataatactcttca

SEQ ID NO: 760251 - DNA, 25 bp, Mus musculus
tattggcgtcagttaatactcttca

SEQ ID NO: 760252 - DNA, 25 bp, Mus musculus
tattggctacaacgaacggcctcag

SEQ ID NO: 760253 - DNA, 25 bp, Mus musculus
tattggctacaaggaacggcctcag

SEQ ID NO: 760254 - DNA, 25 bp, Mus musculus
tattggctcaaactcacattcgagc

SEQ ID NO: 760255 - DNA, 25 bp, Mus musculus
tattggctcaaagtcacattcgagc

SEQ ID NO: 760256 - DNA, 25 bp, Mus musculus
tattggctcaggatccctagggccc

SEQ ID NO: 760257 - DNA, 25 bp, Mus musculus
tattggctcaggttccctagggccc

SEQ ID NO: 760258 - DNA, 25 bp, Mus musculus
tattggctcctgacactactttggg

SEQ ID NO: 760259 - DNA, 25 bp, Mus musculus
tattggctcctgtcactactttggg

SEQ ID NO: 760260 - DNA, 25 bp, Mus musculus
tattggctcgcacagagtgtcctgg

SEQ ID NO: 760261 - DNA, 25 bp, Mus musculus
tattggctcgcagagagtgtcctgg

SEQ ID NO: 760262 - DNA, 25 bp, Mus musculus
tattggctggatcccgcaaaaaccc

SEQ ID NO: 760263 - DNA, 25 bp, Mus musculus
tattggctggatgccgcaaaaaccc

SEQ ID NO: 760264 - DNA, 25 bp, Mus musculus
tattggctgtggcagaaatgatcgt

SEQ ID NO: 760265 - DNA, 25 bp, Mus musculus
tattggctgtgggagaaatgatcgt

SEQ ID NO: 760266 - DNA, 25 bp, Mus musculus
tattggcttgacactgctctgaccc

SEQ ID NO: 760267 - DNA, 25 bp, Mus musculus
tattggcttgactctgctctgaccc

SEQ ID NO: 760268 - DNA, 25 bp, Mus musculus
tattggcttggactgccgacaggca

SEQ ID NO: 760269 - DNA, 25 bp, Mus musculus
tattggcttggagtgccgacaggca

SEQ ID NO: 760270 - DNA, 25 bp, Mus musculus
tattgggaaggtcccagctactgca

SEQ ID NO: 760271 - DNA, 25 bp, Mus musculus
tattgggaaggtgccagctactgca

SEQ ID NO: 760272 - DNA, 25 bp, Mus musculus
tattgggaataaagacaaaaagccc

SEQ ID NO: 760273 - DNA, 25 bp, Mus musculus
tattgggaataatgacaaaaagccc

SEQ ID NO: 760274 - DNA, 25 bp, Mus musculus
tattgggacactcaatctgcaggca

SEQ ID NO: 760275 - DNA, 25 bp, Mus musculus
tattgggacactgaatctgcaggca

SEQ ID NO: 760276 - DNA, 25 bp, Mus musculus
tattgggagctcatgcactcctggc

SEQ ID NO: 760277 - DNA, 25 bp, Mus musculus
tattgggagctcttgcactcctggc

SEQ ID NO: 760278 - DNA, 25 bp, Mus musculus
tattgggattccacttctggccagc

SEQ ID NO: 760279 - DNA, 25 bp, Mus musculus
tattgggattcctcttctggccagc

SEQ ID NO: 760280 - DNA, 25 bp, Mus musculus
tattgggattctccatgttctttgg

SEQ ID NO: 760281 - DNA, 25 bp, Mus musculus
tattgggattctgcatgttctttgg

SEQ ID NO: 760282 - DNA, 25 bp, Mus musculus
tattgggccaatcaaaatatgcaag

SEQ ID NO: 760283 - DNA, 25 bp, Mus musculus
tattgggccaatgaaaatatgcaag

SEQ ID NO: 760284 - DNA, 25 bp, Mus musculus
tattgggcccaaatgactgtttgcc

SEQ ID NO: 760285 - DNA, 25 bp, Mus musculus
tattgggcccaattgactgtttgcc

SEQ ID NO: 760286 - DNA, 25 bp, Mus musculus
tattgggcctctccgcaatcgttcc

SEQ ID NO: 760287 - DNA, 25 bp, Mus musculus
tattgggcctctgcgcaatcgttcc

SEQ ID NO: 760288 - DNA, 25 bp, Mus musculus
tattgggctcctatagctcagcatg

SEQ ID NO: 760289 - DNA, 25 bp, Mus musculus
tattgggctcctttagctcagcatg

SEQ ID NO: 760290 - DNA, 25 bp, Mus musculus
tattgggtaccgcttgacaactgta

SEQ ID NO: 760291 - DNA, 25 bp, Mus musculus
tattgggtaccggttgacaactgta

SEQ ID NO: 760292 - DNA, 25 bp, Mus musculus
tattgggtatctcgaccggtcctct

SEQ ID NO: 760293 - DNA, 25 bp, Mus musculus
tattgggtatctggaccggtcctct

SEQ ID NO: 760294 - DNA, 25 bp, Mus musculus
tattgggtcagcagacagagactgg

SEQ ID NO: 760295 - DNA, 25 bp, Mus musculus
tattgggtcagctgacagagactgg

SEQ ID NO: 760296 - DNA, 25 bp, Mus musculus
tattgggtgaggatgacagtgacac

SEQ ID NO: 760297 - DNA, 25 bp, Mus musculus
tattgggtgaggttgacagtgacac

SEQ ID NO: 760298 - DNA, 25 bp, Mus musculus
tattgggttcacacgctttcctagg

SEQ ID NO: 760299 - DNA, 25 bp, Mus musculus
tattgggttcactcgctttcctagg

SEQ ID NO: 760300 - DNA, 25 bp, Mus musculus
tattggtaaccaacccttcgaggcc

SEQ ID NO: 760301 - DNA, 25 bp, Mus musculus
tattggtaaccatcccttcgaggcc

SEQ ID NO: 760302 - DNA, 25 bp, Mus musculus
tattggtacagaaggagcactatgg

SEQ ID NO: 760303 - DNA, 25 bp, Mus musculus
tattggtacagatggagcactatgg

SEQ ID NO: 760304 - DNA, 25 bp, Mus musculus
tattggtagaacacagaatcgccag

SEQ ID NO: 760305 - DNA, 25 bp, Mus musculus
tattggtagaactcagaatcgccag

SEQ ID NO: 760306 - DNA, 25 bp, Mus musculus
tattggtagtttcagacagctcacg

SEQ ID NO: 760307 - DNA, 25 bp, Mus musculus
tattggtagtttgagacagctcacg

SEQ ID NO: 760308 - DNA, 25 bp, Mus musculus
tattggtattgcagccgctggagag

SEQ ID NO: 760309 - DNA, 25 bp, Mus musculus
tattggtattgctgccgctggagag

SEQ ID NO: 760310 - DNA, 25 bp, Mus musculus
tattggtccggtaactgtctctgaa

SEQ ID NO: 760311 - DNA, 25 bp, Mus musculus
tattggtccggttactgtctctgaa

SEQ ID NO: 760312 - DNA, 25 bp, Mus musculus
tattggtcctcgaactacttggtgc

SEQ ID NO: 760313 - DNA, 25 bp, Mus musculus
tattggtcctcgtactacttggtgc

SEQ ID NO: 760314 - DNA, 25 bp, Mus musculus
tattggtcttccacatctagaatat

SEQ ID NO: 760315 - DNA, 25 bp, Mus musculus
tattggtcttcctcatctagaatat

SEQ ID NO: 760316 - DNA, 25 bp, Mus musculus
tattggtgaagcaaaccagtctgcg

SEQ ID NO: 760317 - DNA, 25 bp, Mus musculus
tattggtgaagctaaccagtctgcg

SEQ ID NO: 760318 - DNA, 25 bp, Mus musculus
tattggtgactaccatggcggcgcc

SEQ ID NO: 760319 - DNA, 25 bp, Mus musculus
tattggtgactagcatggcggcgcc

SEQ ID NO: 760320 - DNA, 25 bp, Mus musculus
tattggtgagcaagagcggaatgaa

SEQ ID NO: 760321 - DNA, 25 bp, Mus musculus
tattggtgagcatgagcggaatgaa

SEQ ID NO: 760322 - DNA, 25 bp, Mus musculus
tattggtgcaccacaagaagacgac

SEQ ID NO: 760323 - DNA, 25 bp, Mus musculus
tattggtgcacctcaagaagacgac

SEQ ID NO: 760324 - DNA, 25 bp, Mus musculus
tattggtgcagcaagaacgaaaacg

SEQ ID NO: 760325 - DNA, 25 bp, Mus musculus
tattggtgcagctagaacgaaaacg

SEQ ID NO: 760326 - DNA, 25 bp, Mus musculus
tattggtgctctcgcccctctgagc

SEQ ID NO: 760327 - DNA, 25 bp, Mus musculus
tattggtgctctggcccctctgagc

SEQ ID NO: 760328 - DNA, 25 bp, Mus musculus
tattggtggagaagatctctcaact

SEQ ID NO: 760329 - DNA, 25 bp, Mus musculus
tattggtggagatgatctctcaact

SEQ ID NO: 760330 - DNA, 25 bp, Mus musculus
tattggtttggtacgtcagcctgga

SEQ ID NO: 760331 - DNA, 25 bp, Mus musculus
tattggtttggttcgtcagcctgga

SEQ ID NO: 760332 - DNA, 25 bp, Mus musculus
tattgtaaatagacacatgacaggc

SEQ ID NO: 760333 - DNA, 25 bp, Mus musculus
tattgtaaatagtcacatgacaggc

SEQ ID NO: 760334 - DNA, 25 bp, Mus musculus
tattgtaaatatagactctctcagc

SEQ ID NO: 760335 - DNA, 25 bp, Mus musculus
tattgtaaatattgactctctcagc

SEQ ID NO: 760336 - DNA, 25 bp, Mus musculus
tattgtaacgttatgtcagacatgg

SEQ ID NO: 760337 - DNA, 25 bp, Mus musculus
tattgtaacgttttgtcagacatgg

SEQ ID NO: 760338 - DNA, 25 bp, Mus musculus
tattgtaagagcaaaaccccttgtc

SEQ ID NO: 760339 - DNA, 25 bp, Mus musculus
tattgtaagagctaaaccccttgtc

SEQ ID NO: 760340 - DNA, 25 bp, Mus musculus
tattgtaagcggctccaggtgctgt

SEQ ID NO: 760341 - DNA, 25 bp, Mus musculus
tattgtaagcgggtccaggtgctgt

SEQ ID NO: 760342 - DNA, 25 bp, Mus musculus
tattgtaccccaaacaagccaagcc

SEQ ID NO: 760343 - DNA, 25 bp, Mus musculus
tattgtaccccatacaagccaagcc

SEQ ID NO: 760344 - DNA, 25 bp, Mus musculus
tattgtacggaaaagtcactgtatc

SEQ ID NO: 760345 - DNA, 25 bp, Mus musculus
tattgtacggaatagtcactgtatc

SEQ ID NO: 760346 - DNA, 25 bp, Mus musculus
tattgtagaattatgtcatcctgaa

SEQ ID NO: 760347 - DNA, 25 bp, Mus musculus
tattgtagaattttgtcatcctgaa

SEQ ID NO: 760348 - DNA, 25 bp, Mus musculus
tattgtagagggattatcttgtccc

SEQ ID NO: 760349 - DNA, 25 bp, Mus musculus
tattgtagagggtttatcttgtccc

SEQ ID NO: 760350 - DNA, 25 bp, Mus musculus
tattgtagctgtatatagcacgtgt

SEQ ID NO: 760351 - DNA, 25 bp, Mus musculus
tattgtagctgtttatagcacgtgt

SEQ ID NO: 760352 - DNA, 25 bp, Mus musculus
tattgtaggcaaaattttacacctc

SEQ ID NO: 760353 - DNA, 25 bp, Mus musculus
tattgtaggcaatattttacacctc

SEQ ID NO: 760354 - DNA, 25 bp, Mus musculus
tattgtcaaactcataggcgtgtgc

SEQ ID NO: 760355 - DNA, 25 bp, Mus musculus
tattgtcaaactgataggcgtgtgc

SEQ ID NO: 760356 - DNA, 25 bp, Mus musculus
tattgtcagctcatcaaacagacca

SEQ ID NO: 760357 - DNA, 25 bp, Mus musculus
tattgtcagctcttcaaacagacca

SEQ ID NO: 760358 - DNA, 25 bp, Mus musculus
tattgtcattgcaagcgctgttggc

SEQ ID NO: 760359 - DNA, 25 bp, Mus musculus
tattgtcattgctagcgctgttggc

SEQ ID NO: 760360 - DNA, 25 bp, Mus musculus
tattgtccagatccgggacaccaca

SEQ ID NO: 760361 - DNA, 25 bp, Mus musculus
tattgtccagatgcgggacaccaca

SEQ ID NO: 760362 - DNA, 25 bp, Mus musculus
tattgtcccagcagcttagaaaaca

SEQ ID NO: 760363 - DNA, 25 bp, Mus musculus
tattgtcccagctgcttagaaaaca

SEQ ID NO: 760364 - DNA, 25 bp, Mus musculus
tattgtccccagctcttcaggaacc

SEQ ID NO: 760365 - DNA, 25 bp, Mus musculus
tattgtccccaggtcttcaggaacc

SEQ ID NO: 760366 - DNA, 25 bp, Mus musculus
tattgtccccatagtccaagaacct

SEQ ID NO: 760367 - DNA, 25 bp, Mus musculus
tattgtccccattgtccaagaacct

SEQ ID NO: 760368 - DNA, 25 bp, Mus musculus
tattgtcctagacttgaggtgaaca

SEQ ID NO: 760369 - DNA, 25 bp, Mus musculus
tattgtcctagagttgaggtgaaca

SEQ ID NO: 760370 - DNA, 25 bp, Mus musculus
tattgtcctgctaagtacagattgc

SEQ ID NO: 760371 - DNA, 25 bp, Mus musculus
tattgtcctgcttagtacagattgc

SEQ ID NO: 760372 - DNA, 25 bp, Mus musculus
tattgtccttttagcccacaatgac

SEQ ID NO: 760373 - DNA, 25 bp, Mus musculus
tattgtcctttttgcccacaatgac

SEQ ID NO: 760374 - DNA, 25 bp, Mus musculus
tattgtcgaatgctagaagaaggct

SEQ ID NO: 760375 - DNA, 25 bp, Mus musculus
tattgtcgaatggtagaagaaggct

SEQ ID NO: 760376 - DNA, 25 bp, Mus musculus
tattgtctcaatctgcccttacgag

SEQ ID NO: 760377 - DNA, 25 bp, Mus musculus
tattgtctcaatgtgcccttacgag

SEQ ID NO: 760378 - DNA, 25 bp, Mus musculus
tattgtctccgaagcttctagagag

SEQ ID NO: 760379 - DNA, 25 bp, Mus musculus
tattgtctccgatgcttctagagag

SEQ ID NO: 760380 - DNA, 25 bp, Mus musculus
tattgtctctggaactcgatacaag

SEQ ID NO: 760381 - DNA, 25 bp, Mus musculus
tattgtctctggtactcgatacaag

SEQ ID NO: 760382 - DNA, 25 bp, Mus musculus
tattgtctgaaaaacgtggccagca

SEQ ID NO: 760383 - DNA, 25 bp, Mus musculus
tattgtctgaaatacgtggccagca

SEQ ID NO: 760384 - DNA, 25 bp, Mus musculus
tattgtcttcagaggaccccgtcgg

SEQ ID NO: 760385 - DNA, 25 bp, Mus musculus
tattgtcttcagtggaccccgtcgg

SEQ ID NO: 760386 - DNA, 25 bp, Mus musculus
tattgtgaaacaccctctgacccag

SEQ ID NO: 760387 - DNA, 25 bp, Mus musculus
tattgtgaaacagcctctgacccag

SEQ ID NO: 760388 - DNA, 25 bp, Mus musculus
tattgtgaccccaggtacaggagac

SEQ ID NO: 760389 - DNA, 25 bp, Mus musculus
tattgtgacccctggtacaggagac

SEQ ID NO: 760390 - DNA, 25 bp, Mus musculus
tattgtgatctccatgttcatctgc

SEQ ID NO: 760391 - DNA, 25 bp, Mus musculus
tattgtgatctcgatgttcatctgc

SEQ ID NO: 760392 - DNA, 25 bp, Mus musculus
tattgtgcttttctgcgcttcggcc

SEQ ID NO: 760393 - DNA, 25 bp, Mus musculus
tattgtgcttttgtgcgcttcggcc

SEQ ID NO: 760394 - DNA, 25 bp, Mus musculus
tattgtggacacagggacatctctt

SEQ ID NO: 760395 - DNA, 25 bp, Mus musculus
tattgtggacactgggacatctctt

SEQ ID NO: 760396 - DNA, 25 bp, Mus musculus
tattgtggatagagccctgggaccc

SEQ ID NO: 760397 - DNA, 25 bp, Mus musculus
tattgtggatagtgccctgggaccc

SEQ ID NO: 760398 - DNA, 25 bp, Mus musculus
tattgtggatatagcctctcgtttc

SEQ ID NO: 760399 - DNA, 25 bp, Mus musculus
tattgtggatattgcctctcgtttc

SEQ ID NO: 760400 - DNA, 25 bp, Mus musculus
tattgtggatgtcctgaagtacagc

SEQ ID NO: 760401 - DNA, 25 bp, Mus musculus
tattgtggatgtgctgaagtacagc

SEQ ID NO: 760402 - DNA, 25 bp, Mus musculus
tattgtggctacacagccgtgcgaa

SEQ ID NO: 760403 - DNA, 25 bp, Mus musculus
tattgtggctactcagccgtgcgaa

SEQ ID NO: 760404 - DNA, 25 bp, Mus musculus
tattgtggtaacagatggagagcgc

SEQ ID NO: 760405 - DNA, 25 bp, Mus musculus
tattgtggtaactgatggagagcgc

SEQ ID NO: 760406 - DNA, 25 bp, Mus musculus
tattgtggtagtcatcgccagtgtg

SEQ ID NO: 760407 - DNA, 25 bp, Mus musculus
tattgtggtagtgatcgccagtgtg

SEQ ID NO: 760408 - DNA, 25 bp, Mus musculus
tattgtggtctgctacaactgcttc

SEQ ID NO: 760409 - DNA, 25 bp, Mus musculus
tattgtggtctggtacaactgcttc

SEQ ID NO: 760410 - DNA, 25 bp, Mus musculus
tattgtggtcttccatgccaaggag

SEQ ID NO: 760411 - DNA, 25 bp, Mus musculus
tattgtggtcttgcatgccaaggag

SEQ ID NO: 760412 - DNA, 25 bp, Mus musculus
tattgtgtctccatctctgggagga

SEQ ID NO: 760413 - DNA, 25 bp, Mus musculus
tattgtgtctccttctctgggagga

SEQ ID NO: 760414 - DNA, 25 bp, Mus musculus
tattgtgtggagagctctgaaccac

SEQ ID NO: 760415 - DNA, 25 bp, Mus musculus
tattgtgtggagtgctctgaaccac

SEQ ID NO: 760416 - DNA, 25 bp, Mus musculus
tattgtgtgttcctctcccctaagc

SEQ ID NO: 760417 - DNA, 25 bp, Mus musculus
tattgtgtgttcgtctcccctaagc

SEQ ID NO: 760418 - DNA, 25 bp, Mus musculus
tattgttacagcacagctggttggt

SEQ ID NO: 760419 - DNA, 25 bp, Mus musculus
tattgttacagctcagctggttggt

SEQ ID NO: 760420 - DNA, 25 bp, Mus musculus
tattgttagaacacagagggtagct

SEQ ID NO: 760421 - DNA, 25 bp, Mus musculus
tattgttagaactcagagggtagct

SEQ ID NO: 760422 - DNA, 25 bp, Mus musculus
tattgttcagggagtcacacttgga

SEQ ID NO: 760423 - DNA, 25 bp, Mus musculus
tattgttcagggtgtcacacttgga

SEQ ID NO: 760424 - DNA, 25 bp, Mus musculus
tattgttccaagactttagctgtgg

SEQ ID NO: 760425 - DNA, 25 bp, Mus musculus
tattgttccaagtctttagctgtgg

SEQ ID NO: 760426 - DNA, 25 bp, Mus musculus
tattgttcctcaaggttacagcttc

SEQ ID NO: 760427 - DNA, 25 bp, Mus musculus
tattgttcctcatggttacagcttc

SEQ ID NO: 760428 - DNA, 25 bp, Mus musculus
tattgttcggcacgtgccattggga

SEQ ID NO: 760429 - DNA, 25 bp, Mus musculus
tattgttcggcaggtgccattggga

SEQ ID NO: 760430 - DNA, 25 bp, Mus musculus
tattgttgacatccacgcagctgca

SEQ ID NO: 760431 - DNA, 25 bp, Mus musculus
tattgttgacatgcacgcagctgca

SEQ ID NO: 760432 - DNA, 25 bp, Mus musculus
tattgttgctccagacacagtgatc

SEQ ID NO: 760433 - DNA, 25 bp, Mus musculus
tattgttgctcctgacacagtgatc

SEQ ID NO: 760434 - DNA, 25 bp, Mus musculus
tattgtttggtaaccacttggagca

SEQ ID NO: 760435 - DNA, 25 bp, Mus musculus
tattgtttggtatccacttggagca

SEQ ID NO: 760436 - DNA, 25 bp, Mus musculus
tatttaaaactgacaggtcctgacc

SEQ ID NO: 760437 - DNA, 25 bp, Mus musculus
tatttaaaactgtcaggtcctgacc

SEQ ID NO: 760438 - DNA, 25 bp, Mus musculus
tatttaaagacacttaccaaggacg

SEQ ID NO: 760439 - DNA, 25 bp, Mus musculus
tatttaaagacagttaccaaggacg

SEQ ID NO: 760440 - DNA, 25 bp, Mus musculus
tatttaaagaggacaagagtcccct

SEQ ID NO: 760441 - DNA, 25 bp, Mus musculus
tatttaaagaggtcaagagtcccct

SEQ ID NO: 760442 - DNA, 25 bp, Mus musculus
tatttaaagcgaccgggcagaggca

SEQ ID NO: 760443 - DNA, 25 bp, Mus musculus
tatttaaagcgagcgggcagaggca

SEQ ID NO: 760444 - DNA, 25 bp, Mus musculus
tatttaaatggaaacacctcacaga

SEQ ID NO: 760445 - DNA, 25 bp, Mus musculus
tatttaaatggatacacctcacaga

SEQ ID NO: 760446 - DNA, 25 bp, Mus musculus
tatttaacaactatggctggaaggg

SEQ ID NO: 760447 - DNA, 25 bp, Mus musculus
tatttaacaactttggctggaaggg

SEQ ID NO: 760448 - DNA, 25 bp, Mus musculus
tatttaagcacaccacagttcggtg

SEQ ID NO: 760449 - DNA, 25 bp, Mus musculus
tatttaagcacagcacagttcggtg

SEQ ID NO: 760450 - DNA, 25 bp, Mus musculus
tatttaagccgacattcctgataga

SEQ ID NO: 760451 - DNA, 25 bp, Mus musculus
tatttaagccgagattcctgataga

SEQ ID NO: 760452 - DNA, 25 bp, Mus musculus
tatttaagctggctccggagaaagt

SEQ ID NO: 760453 - DNA, 25 bp, Mus musculus
tatttaagctgggtccggagaaagt

SEQ ID NO: 760454 - DNA, 25 bp, Mus musculus
tatttaagtttgaagaacaacaacg

SEQ ID NO: 760455 - DNA, 25 bp, Mus musculus
tatttaagtttgtagaacaacaacg

SEQ ID NO: 760456 - DNA, 25 bp, Mus musculus
tatttaatcctactaatgtgcagcc

SEQ ID NO: 760457 - DNA, 25 bp, Mus musculus
tatttaatcctagtaatgtgcagcc

SEQ ID NO: 760458 - DNA, 25 bp, Mus musculus
tatttaatgagcctctgagcttcct

SEQ ID NO: 760459 - DNA, 25 bp, Mus musculus
tatttaatgagcgtctgagcttcct

SEQ ID NO: 760460 - DNA, 25 bp, Mus musculus
tatttacaagtgaaggcaatttcca

SEQ ID NO: 760461 - DNA, 25 bp, Mus musculus
tatttacaagtgtaggcaatttcca

SEQ ID NO: 760462 - DNA, 25 bp, Mus musculus
tatttacaatgacgaggcagaccct

SEQ ID NO: 760463 - DNA, 25 bp, Mus musculus
tatttacaatgaggaggcagaccct

SEQ ID NO: 760464 - DNA, 25 bp, Mus musculus
tatttacactccatgtgcatcatcc

SEQ ID NO: 760465 - DNA, 25 bp, Mus musculus
tatttacactccttgtgcatcatcc

SEQ ID NO: 760466 - DNA, 25 bp, Mus musculus
tatttacagaggaaatggcagtctc

SEQ ID NO: 760467 - DNA, 25 bp, Mus musculus
tatttacagaggtaatggcagtctc

SEQ ID NO: 760468 - DNA, 25 bp, Mus musculus
tatttacagattcgatctaccagca

SEQ ID NO: 760469 - DNA, 25 bp, Mus musculus
tatttacagattggatctaccagca

SEQ ID NO: 760470 - DNA, 25 bp, Mus musculus
tatttacataaaccagaggcgagcc

SEQ ID NO: 760471 - DNA, 25 bp, Mus musculus
tatttacataaagcagaggcgagcc

SEQ ID NO: 760472 - DNA, 25 bp, Mus musculus
tatttacatgagaaacacatccttc

SEQ ID NO: 760473 - DNA, 25 bp, Mus musculus
tatttacatgagtaacacatccttc

SEQ ID NO: 760474 - DNA, 25 bp, Mus musculus
tatttacctaagcagacctgcctca

SEQ ID NO: 760475 - DNA, 25 bp, Mus musculus
tatttacctaaggagacctgcctca

SEQ ID NO: 760476 - DNA, 25 bp, Mus musculus
tatttacctcagagtgtgaagatca

SEQ ID NO: 760477 - DNA, 25 bp, Mus musculus
tatttacctcagtgtgtgaagatca

SEQ ID NO: 760478 - DNA, 25 bp, Mus musculus
tatttacgctgacgacccatccgtc

SEQ ID NO: 760479 - DNA, 25 bp, Mus musculus
tatttacgctgaggacccatccgtc

SEQ ID NO: 760480 - DNA, 25 bp, Mus musculus
tatttacgtcgaactcctttgatgt

SEQ ID NO: 760481 - DNA, 25 bp, Mus musculus
tatttacgtcgatctcctttgatgt

SEQ ID NO: 760482 - DNA, 25 bp, Mus musculus
tatttactaccaaggtctggacacg

SEQ ID NO: 760483 - DNA, 25 bp, Mus musculus
tatttactaccatggtctggacacg

SEQ ID NO: 760484 - DNA, 25 bp, Mus musculus
tatttactttatcctcagggaagga

SEQ ID NO: 760485 - DNA, 25 bp, Mus musculus
tatttactttatgctcagggaagga

SEQ ID NO: 760486 - DNA, 25 bp, Mus musculus
tatttagacacgactttctgtgacc

SEQ ID NO: 760487 - DNA, 25 bp, Mus musculus
tatttagacacgtctttctgtgacc

SEQ ID NO: 760488 - DNA, 25 bp, Mus musculus
tatttagagaaaccaaacaagtggc

SEQ ID NO: 760489 - DNA, 25 bp, Mus musculus
tatttagagaaagcaaacaagtggc

SEQ ID NO: 760490 - DNA, 25 bp, Mus musculus
tatttagagcgcagcgcctgactgg

SEQ ID NO: 760491 - DNA, 25 bp, Mus musculus
tatttagagcgctgcgcctgactgg

SEQ ID NO: 760492 - DNA, 25 bp, Mus musculus
tatttagatgctaatcagattgaag

SEQ ID NO: 760493 - DNA, 25 bp, Mus musculus
tatttagatgcttatcagattgaag

SEQ ID NO: 760494 - DNA, 25 bp, Mus musculus
tatttagcattgatgaaaacgaact

SEQ ID NO: 760495 - DNA, 25 bp, Mus musculus
tatttagcattgttgaaaacgaact

SEQ ID NO: 760496 - DNA, 25 bp, Mus musculus
tatttagctgtccttgtgatgtcac

SEQ ID NO: 760497 - DNA, 25 bp, Mus musculus
tatttagctgtcgttgtgatgtcac

SEQ ID NO: 760498 - DNA, 25 bp, Mus musculus
tatttaggagatcaaaaacctggcc

SEQ ID NO: 760499 - DNA, 25 bp, Mus musculus
tatttaggagatgaaaaacctggcc

SEQ ID NO: 760500 - DNA, 25 bp, Mus musculus
tatttaggcattacaaggatagcct

SEQ ID NO: 760501 - DNA, 25 bp, Mus musculus
tatttaggcatttcaaggatagcct

SEQ ID NO: 760502 - DNA, 25 bp, Mus musculus
tatttaggtgatccatccgcctggg

SEQ ID NO: 760503 - DNA, 25 bp, Mus musculus
tatttaggtgatgcatccgcctggg

SEQ ID NO: 760504 - DNA, 25 bp, Mus musculus
tatttagtgtttagccagaatctct

SEQ ID NO: 760505 - DNA, 25 bp, Mus musculus
tatttagtgttttgccagaatctct

SEQ ID NO: 760506 - DNA, 25 bp, Mus musculus
tatttataaacacagcaaaggaaga

SEQ ID NO: 760507 - DNA, 25 bp, Mus musculus
tatttataaacagagcaaaggaaga

SEQ ID NO: 760508 - DNA, 25 bp, Mus musculus
tatttataaagtacacccaaggcgc

SEQ ID NO: 760509 - DNA, 25 bp, Mus musculus
tatttataaagttcacccaaggcgc

SEQ ID NO: 760510 - DNA, 25 bp, Mus musculus
tatttatcaacaacgactggcacga

SEQ ID NO: 760511 - DNA, 25 bp, Mus musculus
tatttatcaacatcgactggcacga

SEQ ID NO: 760512 - DNA, 25 bp, Mus musculus
tatttatcaagtattcaacacctcc

SEQ ID NO: 760513 - DNA, 25 bp, Mus musculus
tatttatcaagttttcaacacctcc

SEQ ID NO: 760514 - DNA, 25 bp, Mus musculus
tatttatcacagaggatcgaaagcc

SEQ ID NO: 760515 - DNA, 25 bp, Mus musculus
tatttatcacagtggatcgaaagcc

SEQ ID NO: 760516 - DNA, 25 bp, Mus musculus
tatttatcacctcttgaagagaagc

SEQ ID NO: 760517 - DNA, 25 bp, Mus musculus
tatttatcacctgttgaagagaagc

SEQ ID NO: 760518 - DNA, 25 bp, Mus musculus
tatttatcagcacgtggctgactgc

SEQ ID NO: 760519 - DNA, 25 bp, Mus musculus
tatttatcagcaggtggctgactgc

SEQ ID NO: 760520 - DNA, 25 bp, Mus musculus
tatttatcttggctcttctctgcag

SEQ ID NO: 760521 - DNA, 25 bp, Mus musculus
tatttatcttgggtcttctctgcag

SEQ ID NO: 760522 - DNA, 25 bp, Mus musculus
tatttatgaagacaagctcgaggcc

SEQ ID NO: 760523 - DNA, 25 bp, Mus musculus
tatttatgaagagaagctcgaggcc

SEQ ID NO: 760524 - DNA, 25 bp, Mus musculus
tatttatgacggactccagcagggc

SEQ ID NO: 760525 - DNA, 25 bp, Mus musculus
tatttatgacggtctccagcagggc

SEQ ID NO: 760526 - DNA, 25 bp, Mus musculus
tatttatggacacactgccagtggg

SEQ ID NO: 760527 - DNA, 25 bp, Mus musculus
tatttatggacagactgccagtggg

SEQ ID NO: 760528 - DNA, 25 bp, Mus musculus
tatttatggagcaaatccaaggagg

SEQ ID NO: 760529 - DNA, 25 bp, Mus musculus
tatttatggagctaatccaaggagg

SEQ ID NO: 760530 - DNA, 25 bp, Mus musculus
tatttatggaggaaactggcttagc

SEQ ID NO: 760531 - DNA, 25 bp, Mus musculus
tatttatggaggtaactggcttagc

SEQ ID NO: 760532 - DNA, 25 bp, Mus musculus
tatttatgtgaaacagtcctttgcc

SEQ ID NO: 760533 - DNA, 25 bp, Mus musculus
tatttatgtgaatcagtcctttgcc

SEQ ID NO: 760534 - DNA, 25 bp, Mus musculus
tatttattaaagaacagagaagtca

SEQ ID NO: 760535 - DNA, 25 bp, Mus musculus
tatttattaaagtacagagaagtca

SEQ ID NO: 760536 - DNA, 25 bp, Mus musculus
tatttattaactcaccaccatggcc

SEQ ID NO: 760537 - DNA, 25 bp, Mus musculus
tatttattaactgaccaccatggcc

SEQ ID NO: 760538 - DNA, 25 bp, Mus musculus
tatttattacaccagagccattgaa

SEQ ID NO: 760539 - DNA, 25 bp, Mus musculus
tatttattacacgagagccattgaa

SEQ ID NO: 760540 - DNA, 25 bp, Mus musculus
tatttattcaccaacctaagcgagg

SEQ ID NO: 760541 - DNA, 25 bp, Mus musculus
tatttattcacctacctaagcgagg

SEQ ID NO: 760542 - DNA, 25 bp, Mus musculus
tatttattgaatacttctacaagcc

SEQ ID NO: 760543 - DNA, 25 bp, Mus musculus
tatttattgaattcttctacaagcc

SEQ ID NO: 760544 - DNA, 25 bp, Mus musculus
tatttattgctgcttttcctgggac

SEQ ID NO: 760545 - DNA, 25 bp, Mus musculus
tatttattgctggttttcctgggac

SEQ ID NO: 760546 - DNA, 25 bp, Mus musculus
tatttattgtgacaggaaataagga

SEQ ID NO: 760547 - DNA, 25 bp, Mus musculus
tatttattgtgagaggaaataagga

SEQ ID NO: 760548 - DNA, 25 bp, Mus musculus
tatttcaaaagtatctctgtgacca

SEQ ID NO: 760549 - DNA, 25 bp, Mus musculus
tatttcaaaagtttctctgtgacca

SEQ ID NO: 760550 - DNA, 25 bp, Mus musculus
tatttcaaagaacgccctggagcgg

SEQ ID NO: 760551 - DNA, 25 bp, Mus musculus
tatttcaaagaaggccctggagcgg

SEQ ID NO: 760552 - DNA, 25 bp, Mus musculus
tatttcaacaagatccacacatgta

SEQ ID NO: 760553 - DNA, 25 bp, Mus musculus
tatttcaacaagttccacacatgta

SEQ ID NO: 760554 - DNA, 25 bp, Mus musculus
tatttcaacagtcgctctatgggct

SEQ ID NO: 760555 - DNA, 25 bp, Mus musculus
tatttcaacagtggctctatgggct

SEQ ID NO: 760556 - DNA, 25 bp, Mus musculus
tatttcaacattccagtgataatcc

SEQ ID NO: 760557 - DNA, 25 bp, Mus musculus
tatttcaacattgcagtgataatcc

SEQ ID NO: 760558 - DNA, 25 bp, Mus musculus
tatttcaagaagcagaagcggctta

SEQ ID NO: 760559 - DNA, 25 bp, Mus musculus
tatttcaagaaggagaagcggctta

SEQ ID NO: 760560 - DNA, 25 bp, Mus musculus
tatttcaaggaaacaaagattatca

SEQ ID NO: 760561 - DNA, 25 bp, Mus musculus
tatttcaaggaatcaaagattatca

SEQ ID NO: 760562 - DNA, 25 bp, Mus musculus
tatttcacaaacaggaccagctgag

SEQ ID NO: 760563 - DNA, 25 bp, Mus musculus
tatttcacaaactggaccagctgag

SEQ ID NO: 760564 - DNA, 25 bp, Mus musculus
tatttcacacaaaatgcggattgtt

SEQ ID NO: 760565 - DNA, 25 bp, Mus musculus
tatttcacacaatatgcggattgtt

SEQ ID NO: 760566 - DNA, 25 bp, Mus musculus
tatttcacagctaaagcaaaagctt

SEQ ID NO: 760567 - DNA, 25 bp, Mus musculus
tatttcacagcttaagcaaaagctt

SEQ ID NO: 760568 - DNA, 25 bp, Mus musculus
tatttcacctcaaaggccttggagt

SEQ ID NO: 760569 - DNA, 25 bp, Mus musculus
tatttcacctcataggccttggagt

SEQ ID NO: 760570 - DNA, 25 bp, Mus musculus
tatttcagacaccatatacccgagg

SEQ ID NO: 760571 - DNA, 25 bp, Mus musculus
tatttcagacacgatatacccgagg

SEQ ID NO: 760572 - DNA, 25 bp, Mus musculus
tatttcagactgagggtcccaggga

SEQ ID NO: 760573 - DNA, 25 bp, Mus musculus
tatttcagactgtgggtcccaggga

SEQ ID NO: 760574 - DNA, 25 bp, Mus musculus
tatttcagctgcagcgaggactgtc

SEQ ID NO: 760575 - DNA, 25 bp, Mus musculus
tatttcagctgctgcgaggactgtc

SEQ ID NO: 760576 - DNA, 25 bp, Mus musculus
tatttcaggccaaacatcgtggtgt

SEQ ID NO: 760577 - DNA, 25 bp, Mus musculus
tatttcaggccatacatcgtggtgt

SEQ ID NO: 760578 - DNA, 25 bp, Mus musculus
tatttcaggcggaatcttgggcata

SEQ ID NO: 760579 - DNA, 25 bp, Mus musculus
tatttcaggcggtatcttgggcata

SEQ ID NO: 760580 - DNA, 25 bp, Mus musculus
tatttcagtagcaaccctagacgga

SEQ ID NO: 760581 - DNA, 25 bp, Mus musculus
tatttcagtagctaccctagacgga

SEQ ID NO: 760582 - DNA, 25 bp, Mus musculus
tatttcagtgacatggtcctgtggg

SEQ ID NO: 760583 - DNA, 25 bp, Mus musculus
tatttcagtgacttggtcctgtggg

SEQ ID NO: 760584 - DNA, 25 bp, Mus musculus
tatttcagtgctactctcctcccag

SEQ ID NO: 760585 - DNA, 25 bp, Mus musculus
tatttcagtgcttctctcctcccag

SEQ ID NO: 760586 - DNA, 25 bp, Mus musculus
tatttcatccggaagcctccaagtg

SEQ ID NO: 760587 - DNA, 25 bp, Mus musculus
tatttcatccggtagcctccaagtg

SEQ ID NO: 760588 - DNA, 25 bp, Mus musculus
tatttcatctggagccaggcgtgtg

SEQ ID NO: 760589 - DNA, 25 bp, Mus musculus
tatttcatctggtgccaggcgtgtg

SEQ ID NO: 760590 - DNA, 25 bp, Mus musculus
tatttcattgccctggtctttgagg

SEQ ID NO: 760591 - DNA, 25 bp, Mus musculus
tatttcattgccgtggtctttgagg

SEQ ID NO: 760592 - DNA, 25 bp, Mus musculus
tatttccaacagctctttccctaat

SEQ ID NO: 760593 - DNA, 25 bp, Mus musculus
tatttccaacaggtctttccctaat

SEQ ID NO: 760594 - DNA, 25 bp, Mus musculus
tatttccaagaactagggcgggagc

SEQ ID NO: 760595 - DNA, 25 bp, Mus musculus
tatttccaagaagtagggcgggagc

SEQ ID NO: 760596 - DNA, 25 bp, Mus musculus
tatttccaaggtagaatgattccct

SEQ ID NO: 760597 - DNA, 25 bp, Mus musculus
tatttccaaggttgaatgattccct

SEQ ID NO: 760598 - DNA, 25 bp, Mus musculus
tatttccacacgatcagacagtcta

SEQ ID NO: 760599 - DNA, 25 bp, Mus musculus
tatttccacacgttcagacagtcta

SEQ ID NO: 760600 - DNA, 25 bp, Mus musculus
tatttccagctgattgtgatctgct

SEQ ID NO: 760601 - DNA, 25 bp, Mus musculus
tatttccagctgtttgtgatctgct

SEQ ID NO: 760602 - DNA, 25 bp, Mus musculus
tatttccaggcaatcggaggacgcc

SEQ ID NO: 760603 - DNA, 25 bp, Mus musculus
tatttccaggcattcggaggacgcc

SEQ ID NO: 760604 - DNA, 25 bp, Mus musculus
tatttccagtgtcaaggacatgagc

SEQ ID NO: 760605 - DNA, 25 bp, Mus musculus
tatttccagtgtgaaggacatgagc

SEQ ID NO: 760606 - DNA, 25 bp, Mus musculus
tatttccatgttcggcacaggctca

SEQ ID NO: 760607 - DNA, 25 bp, Mus musculus
tatttccatgttgggcacaggctca

SEQ ID NO: 760608 - DNA, 25 bp, Mus musculus
tatttcccacaacaaagaagttcca

SEQ ID NO: 760609 - DNA, 25 bp, Mus musculus
tatttcccacaagaaagaagttcca

SEQ ID NO: 760610 - DNA, 25 bp, Mus musculus
tatttcccagagatcattgaacgag

SEQ ID NO: 760611 - DNA, 25 bp, Mus musculus
tatttcccagagttcattgaacgag

SEQ ID NO: 760612 - DNA, 25 bp, Mus musculus
tatttcccatccacgtttgctcaga

SEQ ID NO: 760613 - DNA, 25 bp, Mus musculus
tatttcccatcctcgtttgctcaga

SEQ ID NO: 760614 - DNA, 25 bp, Mus musculus
tatttccccagcaccgcagtgggag

SEQ ID NO: 760615 - DNA, 25 bp, Mus musculus
tatttccccagctccgcagtgggag

SEQ ID NO: 760616 - DNA, 25 bp, Mus musculus
tatttccctgctaactgccctgtgt

SEQ ID NO: 760617 - DNA, 25 bp, Mus musculus
tatttccctgcttactgccctgtgt

SEQ ID NO: 760618 - DNA, 25 bp, Mus musculus
tatttccgagagacacaatcatcat

SEQ ID NO: 760619 - DNA, 25 bp, Mus musculus
tatttccgagagtcacaatcatcat

SEQ ID NO: 760620 - DNA, 25 bp, Mus musculus
tatttcctcaagacagatctgccca

SEQ ID NO: 760621 - DNA, 25 bp, Mus musculus
tatttcctcaagtcagatctgccca

SEQ ID NO: 760622 - DNA, 25 bp, Mus musculus
tatttcctgcagctcaagtttgacc

SEQ ID NO: 760623 - DNA, 25 bp, Mus musculus
tatttcctgcaggtcaagtttgacc

SEQ ID NO: 760624 - DNA, 25 bp, Mus musculus
tatttcctgggtatcaaggtaccag

SEQ ID NO: 760625 - DNA, 25 bp, Mus musculus
tatttcctgggtttcaaggtaccag

SEQ ID NO: 760626 - DNA, 25 bp, Mus musculus
tatttccttgccagtactccaaagg

SEQ ID NO: 760627 - DNA, 25 bp, Mus musculus
tatttccttgcctgtactccaaagg

SEQ ID NO: 760628 - DNA, 25 bp, Mus musculus
tatttcgaaccccacttcactgggc

SEQ ID NO: 760629 - DNA, 25 bp, Mus musculus
tatttcgaacccgacttcactgggc

SEQ ID NO: 760630 - DNA, 25 bp, Mus musculus
tatttcgacagacgtgcagaggcca

SEQ ID NO: 760631 - DNA, 25 bp, Mus musculus
tatttcgacagaggtgcagaggcca

SEQ ID NO: 760632 - DNA, 25 bp, Mus musculus
tatttcgatgttacccatgaacact

SEQ ID NO: 760633 - DNA, 25 bp, Mus musculus
tatttcgatgtttcccatgaacact

SEQ ID NO: 760634 - DNA, 25 bp, Mus musculus
tatttcgcctgccttggtacccggt

SEQ ID NO: 760635 - DNA, 25 bp, Mus musculus
tatttcgcctgcgttggtacccggt

SEQ ID NO: 760636 - DNA, 25 bp, Mus musculus
tatttcggcgaaacttgaacgtgac

SEQ ID NO: 760637 - DNA, 25 bp, Mus musculus
tatttcggcgaatcttgaacgtgac

SEQ ID NO: 760638 - DNA, 25 bp, Mus musculus
tatttcgttcgcagtgtgaagcaca

SEQ ID NO: 760639 - DNA, 25 bp, Mus musculus
tatttcgttcgctgtgtgaagcaca

SEQ ID NO: 760640 - DNA, 25 bp, Mus musculus
tatttctaatgcctccaggtagggc

SEQ ID NO: 760641 - DNA, 25 bp, Mus musculus
tatttctaatgcgtccaggtagggc

SEQ ID NO: 760642 - DNA, 25 bp, Mus musculus
tatttctacactatggtggagagcc

SEQ ID NO: 760643 - DNA, 25 bp, Mus musculus
tatttctacactttggtggagagcc

SEQ ID NO: 760644 - DNA, 25 bp, Mus musculus
tatttctacgacaatgactgcggag

SEQ ID NO: 760645 - DNA, 25 bp, Mus musculus
tatttctacgactatgactgcggag

SEQ ID NO: 760646 - DNA, 25 bp, Mus musculus
tatttctagagcagagtctcagagc

SEQ ID NO: 760647 - DNA, 25 bp, Mus musculus
tatttctagagctgagtctcagagc

SEQ ID NO: 760648 - DNA, 25 bp, Mus musculus
tatttctatactctccagggtgaag

SEQ ID NO: 760649 - DNA, 25 bp, Mus musculus
tatttctatactgtccagggtgaag

SEQ ID NO: 760650 - DNA, 25 bp, Mus musculus
tatttctcacagaattaagactgga

SEQ ID NO: 760651 - DNA, 25 bp, Mus musculus
tatttctcacagtattaagactgga

SEQ ID NO: 760652 - DNA, 25 bp, Mus musculus
tatttctcagagattgatggaaaca

SEQ ID NO: 760653 - DNA, 25 bp, Mus musculus
tatttctcagagtttgatggaaaca

SEQ ID NO: 760654 - DNA, 25 bp, Mus musculus
tatttctccattcatgttggctgca

SEQ ID NO: 760655 - DNA, 25 bp, Mus musculus
tatttctccattgatgttggctgca

SEQ ID NO: 760656 - DNA, 25 bp, Mus musculus
tatttctcggtgcagaagcttggga

SEQ ID NO: 760657 - DNA, 25 bp, Mus musculus
tatttctcggtggagaagcttggga

SEQ ID NO: 760658 - DNA, 25 bp, Mus musculus
tatttctctgctcctcttttggccc

SEQ ID NO: 760659 - DNA, 25 bp, Mus musculus
tatttctctgctgctcttttggccc

SEQ ID NO: 760660 - DNA, 25 bp, Mus musculus
tatttctgaacaagtccacagccgc

SEQ ID NO: 760661 - DNA, 25 bp, Mus musculus
tatttctgaacatgtccacagccgc

SEQ ID NO: 760662 - DNA, 25 bp, Mus musculus
tatttctgacagagcagcctttgga

SEQ ID NO: 760663 - DNA, 25 bp, Mus musculus
tatttctgacagtgcagcctttgga

SEQ ID NO: 760664 - DNA, 25 bp, Mus musculus
tatttctgatccctgaggtgcctgc

SEQ ID NO: 760665 - DNA, 25 bp, Mus musculus
tatttctgatccgtgaggtgcctgc

SEQ ID NO: 760666 - DNA, 25 bp, Mus musculus
tatttctgggtgatcacactggtgc

SEQ ID NO: 760667 - DNA, 25 bp, Mus musculus
tatttctgggtgttcacactggtgc

SEQ ID NO: 760668 - DNA, 25 bp, Mus musculus
tatttctggtggctgatattccctg

SEQ ID NO: 760669 - DNA, 25 bp, Mus musculus
tatttctggtgggtgatattccctg

SEQ ID NO: 760670 - DNA, 25 bp, Mus musculus
tatttctgtcgtagccgagctggct

SEQ ID NO: 760671 - DNA, 25 bp, Mus musculus
tatttctgtcgttgccgagctggct

SEQ ID NO: 760672 - DNA, 25 bp, Mus musculus
tatttcttactgagccgagaagccg

SEQ ID NO: 760673 - DNA, 25 bp, Mus musculus
tatttcttactgtgccgagaagccg

SEQ ID NO: 760674 - DNA, 25 bp, Mus musculus
tatttcttaggcaatgtggctggag

SEQ ID NO: 760675 - DNA, 25 bp, Mus musculus
tatttcttaggctatgtggctggag

SEQ ID NO: 760676 - DNA, 25 bp, Mus musculus
tatttcttggtcagctggactacac

SEQ ID NO: 760677 - DNA, 25 bp, Mus musculus
tatttcttggtctgctggactacac

SEQ ID NO: 760678 - DNA, 25 bp, Mus musculus
tatttcttgttgctcacgtctcctg

SEQ ID NO: 760679 - DNA, 25 bp, Mus musculus
tatttcttgttggtcacgtctcctg

SEQ ID NO: 760680 - DNA, 25 bp, Mus musculus
tatttgaagattcaggcgttatccg

SEQ ID NO: 760681 - DNA, 25 bp, Mus musculus
tatttgaagattgaggcgttatccg

SEQ ID NO: 760682 - DNA, 25 bp, Mus musculus
tatttgaatatcatcagttgccacc

SEQ ID NO: 760683 - DNA, 25 bp, Mus musculus
tatttgaatatcttcagttgccacc

SEQ ID NO: 760684 - DNA, 25 bp, Mus musculus
tatttgaatgctaagggaatggcct

SEQ ID NO: 760685 - DNA, 25 bp, Mus musculus
tatttgaatgcttagggaatggcct

SEQ ID NO: 760686 - DNA, 25 bp, Mus musculus
tatttgacacgcagcgacccgcctg

SEQ ID NO: 760687 - DNA, 25 bp, Mus musculus
tatttgacacgctgcgacccgcctg

SEQ ID NO: 760688 - DNA, 25 bp, Mus musculus
tatttgaccagtcagaaccgagatg

SEQ ID NO: 760689 - DNA, 25 bp, Mus musculus
tatttgaccagtcggcccagtcgta

SEQ ID NO: 760690 - DNA, 25 bp, Mus musculus
tatttgaccagtgagaaccgagatg

SEQ ID NO: 760691 - DNA, 25 bp, Mus musculus
tatttgaccagtgggcccagtcgta

SEQ ID NO: 760692 - DNA, 25 bp, Mus musculus
tatttgaccgccagggcatgatcta

SEQ ID NO: 760693 - DNA, 25 bp, Mus musculus
tatttgaccgcctgggcatgatcta

SEQ ID NO: 760694 - DNA, 25 bp, Mus musculus
tatttgacctcacccgccgatttga

SEQ ID NO: 760695 - DNA, 25 bp, Mus musculus
tatttgacctcagccgccgatttga

SEQ ID NO: 760696 - DNA, 25 bp, Mus musculus
tatttgacggatctactctaccttc

SEQ ID NO: 760697 - DNA, 25 bp, Mus musculus
tatttgacggatgtactctaccttc

SEQ ID NO: 760698 - DNA, 25 bp, Mus musculus
tatttgactattaggttgcacatgg

SEQ ID NO: 760699 - DNA, 25 bp, Mus musculus
tatttgactatttggttgcacatgg

SEQ ID NO: 760700 - DNA, 25 bp, Mus musculus
tatttgagatcgatccgcacctgca

SEQ ID NO: 760701 - DNA, 25 bp, Mus musculus
tatttgagatcgttccgcacctgca

SEQ ID NO: 760702 - DNA, 25 bp, Mus musculus
tatttgagccctccttcagtgccga

SEQ ID NO: 760703 - DNA, 25 bp, Mus musculus
tatttgagccctgcttcagtgccga

SEQ ID NO: 760704 - DNA, 25 bp, Mus musculus
tatttgagcgcaagcgcaaagcgct

SEQ ID NO: 760705 - DNA, 25 bp, Mus musculus
tatttgagcgcatgcgcaaagcgct

SEQ ID NO: 760706 - DNA, 25 bp, Mus musculus
tatttgagcttaacaaacggctaca

SEQ ID NO: 760707 - DNA, 25 bp, Mus musculus
tatttgagcttatcaaacggctaca

SEQ ID NO: 760708 - DNA, 25 bp, Mus musculus
tatttgaggacccacttttctccag

SEQ ID NO: 760709 - DNA, 25 bp, Mus musculus
tatttgaggaccgacttttctccag

SEQ ID NO: 760710 - DNA, 25 bp, Mus musculus
tatttgagttggaatccagctcttt

SEQ ID NO: 760711 - DNA, 25 bp, Mus musculus
tatttgagttggtatccagctcttt

SEQ ID NO: 760712 - DNA, 25 bp, Mus musculus
tatttgatagtcagggcagtggaga

SEQ ID NO: 760713 - DNA, 25 bp, Mus musculus
tatttgatagtctgggcagtggaga

SEQ ID NO: 760714 - DNA, 25 bp, Mus musculus
tatttgatccttcagcaaccctgga

SEQ ID NO: 760715 - DNA, 25 bp, Mus musculus
tatttgatccttgagcaaccctgga

SEQ ID NO: 760716 - DNA, 25 bp, Mus musculus
tatttgatcgggactctacagggcc

SEQ ID NO: 760717 - DNA, 25 bp, Mus musculus
tatttgatcgggtctctacagggcc

SEQ ID NO: 760718 - DNA, 25 bp, Mus musculus
tatttgatgccacaaaaacgaccct

SEQ ID NO: 760719 - DNA, 25 bp, Mus musculus
tatttgatgccagaaaaacgaccct

SEQ ID NO: 760720 - DNA, 25 bp, Mus musculus
tatttgatttagacttggagaccga

SEQ ID NO: 760721 - DNA, 25 bp, Mus musculus
tatttgatttagtcttggagaccga

SEQ ID NO: 760722 - DNA, 25 bp, Mus musculus
tatttgatttcacctttagcccaga

SEQ ID NO: 760723 - DNA, 25 bp, Mus musculus
tatttgatttcagctttagcccaga

SEQ ID NO: 760724 - DNA, 25 bp, Mus musculus
tatttgcaatagctgactgctccag

SEQ ID NO: 760725 - DNA, 25 bp, Mus musculus
tatttgcaataggtgactgctccag

SEQ ID NO: 760726 - DNA, 25 bp, Mus musculus
tatttgcacaaacggagtggtgcga

SEQ ID NO: 760727 - DNA, 25 bp, Mus musculus
tatttgcacaaagggagtggtgcga

SEQ ID NO: 760728 - DNA, 25 bp, Mus musculus
tatttgcacaggctctggagaaccg

SEQ ID NO: 760729 - DNA, 25 bp, Mus musculus
tatttgcacagggtctggagaaccg

SEQ ID NO: 760730 - DNA, 25 bp, Mus musculus
tatttgcatgcaaagaacatcatcc

SEQ ID NO: 760731 - DNA, 25 bp, Mus musculus
tatttgcatgcatagaacatcatcc

SEQ ID NO: 760732 - DNA, 25 bp, Mus musculus
tatttgccaatgcaggaggagcccc

SEQ ID NO: 760733 - DNA, 25 bp, Mus musculus
tatttgccaatggaggaggagcccc

SEQ ID NO: 760734 - DNA, 25 bp, Mus musculus
tatttgccaggaaaatcagccaagg

SEQ ID NO: 760735 - DNA, 25 bp, Mus musculus
tatttgccaggataatcagccaagg

SEQ ID NO: 760736 - DNA, 25 bp, Mus musculus
tatttgccagtaaagcagtggtgaa

SEQ ID NO: 760737 - DNA, 25 bp, Mus musculus
tatttgccagtatagcagtggtgaa

SEQ ID NO: 760738 - DNA, 25 bp, Mus musculus
tatttgccccaaagtggactctaaa

SEQ ID NO: 760739 - DNA, 25 bp, Mus musculus
tatttgccccaatgtggactctaaa

SEQ ID NO: 760740 - DNA, 25 bp, Mus musculus
tatttgcccggcagctgatgcaggt

SEQ ID NO: 760741 - DNA, 25 bp, Mus musculus
tatttgcccggctgctgatgcaggt

SEQ ID NO: 760742 - DNA, 25 bp, Mus musculus
tatttgccctctcggagtctggaga

SEQ ID NO: 760743 - DNA, 25 bp, Mus musculus
tatttgccctctgggagtctggaga

SEQ ID NO: 760744 - DNA, 25 bp, Mus musculus
tatttgcccttccatgacctgaaaa

SEQ ID NO: 760745 - DNA, 25 bp, Mus musculus
tatttgcccttcgatgacctgaaaa

SEQ ID NO: 760746 - DNA, 25 bp, Mus musculus
tatttgccgctgactcaggctccaa

SEQ ID NO: 760747 - DNA, 25 bp, Mus musculus
tatttgccgctgtctcaggctccaa

SEQ ID NO: 760748 - DNA, 25 bp, Mus musculus
tatttgcctgtgagtattcataaca

SEQ ID NO: 760749 - DNA, 25 bp, Mus musculus
tatttgcctgtgtgtattcataaca

SEQ ID NO: 760750 - DNA, 25 bp, Mus musculus
tatttgcgctatctgcggcgcctag

SEQ ID NO: 760751 - DNA, 25 bp, Mus musculus
tatttgcgctatgtgcggcgcctag

SEQ ID NO: 760752 - DNA, 25 bp, Mus musculus
tatttgcggaaaactttgggccaag

SEQ ID NO: 760753 - DNA, 25 bp, Mus musculus
tatttgcggaaatctttgggccaag

SEQ ID NO: 760754 - DNA, 25 bp, Mus musculus
tatttgcggaggaataaattgcgtg

SEQ ID NO: 760755 - DNA, 25 bp, Mus musculus
tatttgcggaggtataaattgcgtg

SEQ ID NO: 760756 - DNA, 25 bp, Mus musculus
tatttgctaggtcggtttggtagac

SEQ ID NO: 760757 - DNA, 25 bp, Mus musculus
tatttgctaggtgggtttggtagac

SEQ ID NO: 760758 - DNA, 25 bp, Mus musculus
tatttgctatgcctgaatcatactc

SEQ ID NO: 760759 - DNA, 25 bp, Mus musculus
tatttgctatgcgtgaatcatactc

SEQ ID NO: 760760 - DNA, 25 bp, Mus musculus
tatttgctgcttcaggattccctac

SEQ ID NO: 760761 - DNA, 25 bp, Mus musculus
tatttgctgcttgaggattccctac

SEQ ID NO: 760762 - DNA, 25 bp, Mus musculus
tatttgctggccacattgccaattc

SEQ ID NO: 760763 - DNA, 25 bp, Mus musculus
tatttgctggcctcattgccaattc

SEQ ID NO: 760764 - DNA, 25 bp, Mus musculus
tatttgctgtccagtgaaagaagcc

SEQ ID NO: 760765 - DNA, 25 bp, Mus musculus
tatttgctgtcctgtgaaagaagcc

SEQ ID NO: 760766 - DNA, 25 bp, Mus musculus
tatttggaacttcagttctggagag

SEQ ID NO: 760767 - DNA, 25 bp, Mus musculus
tatttggaacttgagttctggagag

SEQ ID NO: 760768 - DNA, 25 bp, Mus musculus
tatttggaatcgaagtgtcaggctg

SEQ ID NO: 760769 - DNA, 25 bp, Mus musculus
tatttggaatcgtagtgtcaggctg

SEQ ID NO: 760770 - DNA, 25 bp, Mus musculus
tatttggacgaaagctgtacgtgct

SEQ ID NO: 760771 - DNA, 25 bp, Mus musculus
tatttggacgaatgctgtacgtgct

SEQ ID NO: 760772 - DNA, 25 bp, Mus musculus
tatttggagaatcagagtctcctgt

SEQ ID NO: 760773 - DNA, 25 bp, Mus musculus
tatttggagaatgagagtctcctgt

SEQ ID NO: 760774 - DNA, 25 bp, Mus musculus
tatttggagagcagcaacattccca

SEQ ID NO: 760775 - DNA, 25 bp, Mus musculus
tatttggagagctgcaacattccca

SEQ ID NO: 760776 - DNA, 25 bp, Mus musculus
tatttggagcagaggaaatgcctgg

SEQ ID NO: 760777 - DNA, 25 bp, Mus musculus
tatttggagcagtggaaatgcctgg

SEQ ID NO: 760778 - DNA, 25 bp, Mus musculus
tatttggagcccaaggctgtcccga

SEQ ID NO: 760779 - DNA, 25 bp, Mus musculus
tatttggagccctaggctgtcccga

SEQ ID NO: 760780 - DNA, 25 bp, Mus musculus
tatttggcatgaccccagggtgtcc

SEQ ID NO: 760781 - DNA, 25 bp, Mus musculus
tatttggcatgagcccagggtgtcc

SEQ ID NO: 760782 - DNA, 25 bp, Mus musculus
tatttggccagacgtagaagtcaat

SEQ ID NO: 760783 - DNA, 25 bp, Mus musculus
tatttggccagaggtagaagtcaat

SEQ ID NO: 760784 - DNA, 25 bp, Mus musculus
tatttggcgacaatgagaagcccct

SEQ ID NO: 760785 - DNA, 25 bp, Mus musculus
tatttggcgacattgagaagcccct

SEQ ID NO: 760786 - DNA, 25 bp, Mus musculus
tatttggctcccaagattgaagatg

SEQ ID NO: 760787 - DNA, 25 bp, Mus musculus
tatttggctccctagattgaagatg

SEQ ID NO: 760788 - DNA, 25 bp, Mus musculus
tatttggctgagcataaacttgaac

SEQ ID NO: 760789 - DNA, 25 bp, Mus musculus
tatttggctgaggataaacttgaac

SEQ ID NO: 760790 - DNA, 25 bp, Mus musculus
tatttggcttggatacaggcacaga

SEQ ID NO: 760791 - DNA, 25 bp, Mus musculus
tatttggcttggttacaggcacaga

SEQ ID NO: 760792 - DNA, 25 bp, Mus musculus
tatttgggaaaacggccgcatgatc

SEQ ID NO: 760793 - DNA, 25 bp, Mus musculus
tatttgggaaaagggccgcatgatc

SEQ ID NO: 760794 - DNA, 25 bp, Mus musculus
tatttgggaataccggtgcttgcag

SEQ ID NO: 760795 - DNA, 25 bp, Mus musculus
tatttgggaatagcggtgcttgcag

SEQ ID NO: 760796 - DNA, 25 bp, Mus musculus
tatttgggaccaagatacacagttc

SEQ ID NO: 760797 - DNA, 25 bp, Mus musculus
tatttgggaccatgatacacagttc

SEQ ID NO: 760798 - DNA, 25 bp, Mus musculus
tatttgggcaatacataccttgcat

SEQ ID NO: 760799 - DNA, 25 bp, Mus musculus
tatttgggcaattcataccttgcat

SEQ ID NO: 760800 - DNA, 25 bp, Mus musculus
tatttgggcaggaagcccactgtgg

SEQ ID NO: 760801 - DNA, 25 bp, Mus musculus
tatttgggcaggtagcccactgtgg

SEQ ID NO: 760802 - DNA, 25 bp, Mus musculus
tatttgggccaaataaaccgaatct

SEQ ID NO: 760803 - DNA, 25 bp, Mus musculus
tatttgggccaattaaaccgaatct

SEQ ID NO: 760804 - DNA, 25 bp, Mus musculus
tatttgggcgttctcggcaacgagc

SEQ ID NO: 760805 - DNA, 25 bp, Mus musculus
tatttgggcgttgtcggcaacgagc

SEQ ID NO: 760806 - DNA, 25 bp, Mus musculus
tatttgggctgaagcaggagaaaat

SEQ ID NO: 760807 - DNA, 25 bp, Mus musculus
tatttgggctgatgcaggagaaaat

SEQ ID NO: 760808 - DNA, 25 bp, Mus musculus
tatttgggtatccacaaacaaaggg

SEQ ID NO: 760809 - DNA, 25 bp, Mus musculus
tatttgggtatcgacaaacaaaggg

SEQ ID NO: 760810 - DNA, 25 bp, Mus musculus
tatttggtaaagatgtctgccgcac

SEQ ID NO: 760811 - DNA, 25 bp, Mus musculus
tatttggtaaagttgtctgccgcac

SEQ ID NO: 760812 - DNA, 25 bp, Mus musculus
tatttggtactacagcattccacca

SEQ ID NO: 760813 - DNA, 25 bp, Mus musculus
tatttggtactagagcattccacca

SEQ ID NO: 760814 - DNA, 25 bp, Mus musculus
tatttggtcctcctagctgaacatc

SEQ ID NO: 760815 - DNA, 25 bp, Mus musculus
tatttggtcctcgtagctgaacatc

SEQ ID NO: 760816 - DNA, 25 bp, Mus musculus
tatttggtgaagcaagtcagtcagt

SEQ ID NO: 760817 - DNA, 25 bp, Mus musculus
tatttggtgaaggaagtcagtcagt

SEQ ID NO: 760818 - DNA, 25 bp, Mus musculus
tatttggtgcgacactaaactggat

SEQ ID NO: 760819 - DNA, 25 bp, Mus musculus
tatttggtgcgagactaaactggat

SEQ ID NO: 760820 - DNA, 25 bp, Mus musculus
tatttggttagtcccaccataccat

SEQ ID NO: 760821 - DNA, 25 bp, Mus musculus
tatttggttagtgccaccataccat

SEQ ID NO: 760822 - DNA, 25 bp, Mus musculus
tatttggttattatcaagttcacac

SEQ ID NO: 760823 - DNA, 25 bp, Mus musculus
tatttggttattttcaagttcacac

SEQ ID NO: 760824 - DNA, 25 bp, Mus musculus
tatttggttcccactgctacttggt

SEQ ID NO: 760825 - DNA, 25 bp, Mus musculus
tatttggttccctctgctacttggt

SEQ ID NO: 760826 - DNA, 25 bp, Mus musculus
tatttggttgttatctccaggctga

SEQ ID NO: 760827 - DNA, 25 bp, Mus musculus
tatttggttgttttctccaggctga

SEQ ID NO: 760828 - DNA, 25 bp, Mus musculus
tatttgtaacagcagaaagctatgg

SEQ ID NO: 760829 - DNA, 25 bp, Mus musculus
tatttgtaacaggagaaagctatgg

SEQ ID NO: 760830 - DNA, 25 bp, Mus musculus
tatttgtaccttcagctcctcaaag

SEQ ID NO: 760831 - DNA, 25 bp, Mus musculus
tatttgtaccttgagctcctcaaag

SEQ ID NO: 760832 - DNA, 25 bp, Mus musculus
tatttgtaggccctgcacagaaaaa

SEQ ID NO: 760833 - DNA, 25 bp, Mus musculus
tatttgtaggccgtgcacagaaaaa

SEQ ID NO: 760834 - DNA, 25 bp, Mus musculus
tatttgtatacacgaaagtatctgg

SEQ ID NO: 760835 - DNA, 25 bp, Mus musculus
tatttgtatacaggaaagtatctgg

SEQ ID NO: 760836 - DNA, 25 bp, Mus musculus
tatttgtcgcttatttcccctgcag

SEQ ID NO: 760837 - DNA, 25 bp, Mus musculus
tatttgtcgcttttttcccctgcag

SEQ ID NO: 760838 - DNA, 25 bp, Mus musculus
tatttgtctaaccttcctgctgtgg

SEQ ID NO: 760839 - DNA, 25 bp, Mus musculus
tatttgtctaacgttcctgctgtgg

SEQ ID NO: 760840 - DNA, 25 bp, Mus musculus
tatttgtgcgcaatctgctgctagc

SEQ ID NO: 760841 - DNA, 25 bp, Mus musculus
tatttgtgcgcattctgctgctagc

SEQ ID NO: 760842 - DNA, 25 bp, Mus musculus
tatttgtgctggaccatcgtgagta

SEQ ID NO: 760843 - DNA, 25 bp, Mus musculus
tatttgtgctggtccatcgtgagta

SEQ ID NO: 760844 - DNA, 25 bp, Mus musculus
tatttgtggttgacagcaatgatcg

SEQ ID NO: 760845 - DNA, 25 bp, Mus musculus
tatttgtggttgtcagcaatgatcg

SEQ ID NO: 760846 - DNA, 25 bp, Mus musculus
tatttgttaagtccagtgacagtgc

SEQ ID NO: 760847 - DNA, 25 bp, Mus musculus
tatttgttaagtgcagtgacagtgc

SEQ ID NO: 760848 - DNA, 25 bp, Mus musculus
tatttgttagagactaaagctgaca

SEQ ID NO: 760849 - DNA, 25 bp, Mus musculus
tatttgttagagtctaaagctgaca

SEQ ID NO: 760850 - DNA, 25 bp, Mus musculus
tatttgttcatcagtcacaggccct

SEQ ID NO: 760851 - DNA, 25 bp, Mus musculus
tatttgttcatctgtcacaggccct

SEQ ID NO: 760852 - DNA, 25 bp, Mus musculus
tatttgtttatgcacaacagtggct

SEQ ID NO: 760853 - DNA, 25 bp, Mus musculus
tatttgtttatggacaacagtggct

SEQ ID NO: 760854 - DNA, 25 bp, Mus musculus
tattttaaacctccagacataaggg

SEQ ID NO: 760855 - DNA, 25 bp, Mus musculus
tattttaaacctgcagacataaggg

SEQ ID NO: 760856 - DNA, 25 bp, Mus musculus
tattttaacagtcgttctggccgct

SEQ ID NO: 760857 - DNA, 25 bp, Mus musculus
tattttaacagtggttctggccgct

SEQ ID NO: 760858 - DNA, 25 bp, Mus musculus
tattttaagactaagttgctggccc

SEQ ID NO: 760859 - DNA, 25 bp, Mus musculus
tattttaagacttagttgctggccc

SEQ ID NO: 760860 - DNA, 25 bp, Mus musculus
tattttaaggaacattgaatgccgc

SEQ ID NO: 760861 - DNA, 25 bp, Mus musculus
tattttaaggaagattgaatgccgc

SEQ ID NO: 760862 - DNA, 25 bp, Mus musculus
tattttaataatatgccagaaccca

SEQ ID NO: 760863 - DNA, 25 bp, Mus musculus
tattttaataatttgccagaaccca

SEQ ID NO: 760864 - DNA, 25 bp, Mus musculus
tattttaccaaacgataaagtccag

SEQ ID NO: 760865 - DNA, 25 bp, Mus musculus
tattttaccaaaggataaagtccag

SEQ ID NO: 760866 - DNA, 25 bp, Mus musculus
tattttagctgccttattgggagag

SEQ ID NO: 760867 - DNA, 25 bp, Mus musculus
tattttagctgcgttattgggagag

SEQ ID NO: 760868 - DNA, 25 bp, Mus musculus
tattttaggtcactcagagcttcaa

SEQ ID NO: 760869 - DNA, 25 bp, Mus musculus
tattttaggtcagtcagagcttcaa

SEQ ID NO: 760870 - DNA, 25 bp, Mus musculus
tattttatgcatcgcgtatgtcgcg

SEQ ID NO: 760871 - DNA, 25 bp, Mus musculus
tattttatgcatggcgtatgtcgcg

SEQ ID NO: 760872 - DNA, 25 bp, Mus musculus
tattttcaatagatccattgatgcc

SEQ ID NO: 760873 - DNA, 25 bp, Mus musculus
tattttcaatagttccattgatgcc

SEQ ID NO: 760874 - DNA, 25 bp, Mus musculus
tattttcagaagatacagctccgtc

SEQ ID NO: 760875 - DNA, 25 bp, Mus musculus
tattttcagaagttacagctccgtc

SEQ ID NO: 760876 - DNA, 25 bp, Mus musculus
tattttcatagacgaattggatgcc

SEQ ID NO: 760877 - DNA, 25 bp, Mus musculus
tattttcatagaggaattggatgcc

SEQ ID NO: 760878 - DNA, 25 bp, Mus musculus
tattttccctgcacactggctactg

SEQ ID NO: 760879 - DNA, 25 bp, Mus musculus
tattttccctgctcactggctactg

SEQ ID NO: 760880 - DNA, 25 bp, Mus musculus
tattttcctaggaactctagccagg

SEQ ID NO: 760881 - DNA, 25 bp, Mus musculus
tattttcctaggtactctagccagg

SEQ ID NO: 760882 - DNA, 25 bp, Mus musculus
tattttcctgtaagaagggctggcg

SEQ ID NO: 760883 - DNA, 25 bp, Mus musculus
tattttcctgtatgaagggctggcg

SEQ ID NO: 760884 - DNA, 25 bp, Mus musculus
tattttcctgttagggagcggcctg

SEQ ID NO: 760885 - DNA, 25 bp, Mus musculus
tattttcctgtttgggagcggcctg

SEQ ID NO: 760886 - DNA, 25 bp, Mus musculus
tattttccttcacggattgggagat

SEQ ID NO: 760887 - DNA, 25 bp, Mus musculus
tattttccttcagggattgggagat

SEQ ID NO: 760888 - DNA, 25 bp, Mus musculus
tattttcgggacacatcacaatcca

SEQ ID NO: 760889 - DNA, 25 bp, Mus musculus
tattttcgggactcatcacaatcca

SEQ ID NO: 760890 - DNA, 25 bp, Mus musculus
tattttcgtctacctgtttccgatc

SEQ ID NO: 760891 - DNA, 25 bp, Mus musculus
tattttcgtctagctgtttccgatc

SEQ ID NO: 760892 - DNA, 25 bp, Mus musculus
tattttcgtgacagccttccagggc

SEQ ID NO: 760893 - DNA, 25 bp, Mus musculus
tattttcgtgactgccttccagggc

SEQ ID NO: 760894 - DNA, 25 bp, Mus musculus
tattttctcaaactcacagctagta

SEQ ID NO: 760895 - DNA, 25 bp, Mus musculus
tattttctcaaagtcacagctagta

SEQ ID NO: 760896 - DNA, 25 bp, Mus musculus
tattttctccaaaatgatcgactga

SEQ ID NO: 760897 - DNA, 25 bp, Mus musculus
tattttctccaatatgatcgactga

SEQ ID NO: 760898 - DNA, 25 bp, Mus musculus
tattttctgctgctaaagatggaaa

SEQ ID NO: 760899 - DNA, 25 bp, Mus musculus
tattttctgctggtaaagatggaaa

SEQ ID NO: 760900 - DNA, 25 bp, Mus musculus
tattttctgcttcaggagaaacgga

SEQ ID NO: 760901 - DNA, 25 bp, Mus musculus
tattttctgcttgaggagaaacgga

SEQ ID NO: 760902 - DNA, 25 bp, Mus musculus
tattttctggtccattgaaaggaat

SEQ ID NO: 760903 - DNA, 25 bp, Mus musculus
tattttctggtcgattgaaaggaat

SEQ ID NO: 760904 - DNA, 25 bp, Mus musculus
tattttcttcaaagccagagatgat

SEQ ID NO: 760905 - DNA, 25 bp, Mus musculus
tattttcttcaatgccagagatgat

SEQ ID NO: 760906 - DNA, 25 bp, Mus musculus
tattttgaagtccactttccaatga

SEQ ID NO: 760907 - DNA, 25 bp, Mus musculus
tattttgaagtcgactttccaatga

SEQ ID NO: 760908 - DNA, 25 bp, Mus musculus
tattttgacaggaggccagggaaac

SEQ ID NO: 760909 - DNA, 25 bp, Mus musculus
tattttgacaggtggccagggaaac

SEQ ID NO: 760910 - DNA, 25 bp, Mus musculus
tattttgagaagacgtggcttagcc

SEQ ID NO: 760911 - DNA, 25 bp, Mus musculus
tattttgagaagtcgtggcttagcc

SEQ ID NO: 760912 - DNA, 25 bp, Mus musculus
tattttgagctcattcctgatcaga

SEQ ID NO: 760913 - DNA, 25 bp, Mus musculus
tattttgagctctttcctgatcaga

SEQ ID NO: 760914 - DNA, 25 bp, Mus musculus
tattttgagggccagacctccttcc

SEQ ID NO: 760915 - DNA, 25 bp, Mus musculus
tattttgagggcgagacctccttcc

SEQ ID NO: 760916 - DNA, 25 bp, Mus musculus
tattttgagtacacagatggcacct

SEQ ID NO: 760917 - DNA, 25 bp, Mus musculus
tattttgagtactcagatggcacct

SEQ ID NO: 760918 - DNA, 25 bp, Mus musculus
tattttgatgccaaggaacgggcag

SEQ ID NO: 760919 - DNA, 25 bp, Mus musculus
tattttgatgcctaggaacgggcag

SEQ ID NO: 760920 - DNA, 25 bp, Mus musculus
tattttgattttcaccgagagatcc

SEQ ID NO: 760921 - DNA, 25 bp, Mus musculus
tattttgattttgaccgagagatcc

SEQ ID NO: 760922 - DNA, 25 bp, Mus musculus
tattttgcacgaaagcaagatgctg

SEQ ID NO: 760923 - DNA, 25 bp, Mus musculus
tattttgcacgatagcaagatgctg

SEQ ID NO: 760924 - DNA, 25 bp, Mus musculus
tattttgccggcattgtaggcggag

SEQ ID NO: 760925 - DNA, 25 bp, Mus musculus
tattttgccggctttgtaggcggag

SEQ ID NO: 760926 - DNA, 25 bp, Mus musculus
tattttgccgggagggcagacaaaa

SEQ ID NO: 760927 - DNA, 25 bp, Mus musculus
tattttgccgggtgggcagacaaaa

SEQ ID NO: 760928 - DNA, 25 bp, Mus musculus
tattttgcgctcaatctgccctacg

SEQ ID NO: 760929 - DNA, 25 bp, Mus musculus
tattttgcgctctatctgccctacg

SEQ ID NO: 760930 - DNA, 25 bp, Mus musculus
tattttgctcttcgagaagtcattc

SEQ ID NO: 760931 - DNA, 25 bp, Mus musculus
tattttgctcttggagaagtcattc

SEQ ID NO: 760932 - DNA, 25 bp, Mus musculus
tattttgctgttcaaggagcctgag

SEQ ID NO: 760933 - DNA, 25 bp, Mus musculus
tattttgctgttgaaggagcctgag

SEQ ID NO: 760934 - DNA, 25 bp, Mus musculus
tattttggaagaagtcagttctaca

SEQ ID NO: 760935 - DNA, 25 bp, Mus musculus
tattttggaagatgtcagttctaca

SEQ ID NO: 760936 - DNA, 25 bp, Mus musculus
tattttggcaggctgccaccctaac

SEQ ID NO: 760937 - DNA, 25 bp, Mus musculus
tattttggcagggtgccaccctaac

SEQ ID NO: 760938 - DNA, 25 bp, Mus musculus
tattttggcattcaacattgtgaac

SEQ ID NO: 760939 - DNA, 25 bp, Mus musculus
tattttggcattgaacattgtgaac

SEQ ID NO: 760940 - DNA, 25 bp, Mus musculus
tattttggcgcacataaggaaaggg

SEQ ID NO: 760941 - DNA, 25 bp, Mus musculus
tattttggcgcagataaggaaaggg

SEQ ID NO: 760942 - DNA, 25 bp, Mus musculus
tattttggctccaggcactgcagga

SEQ ID NO: 760943 - DNA, 25 bp, Mus musculus
tattttggctcctggcactgcagga

SEQ ID NO: 760944 - DNA, 25 bp, Mus musculus
tattttgggatgaagattgtccgag

SEQ ID NO: 760945 - DNA, 25 bp, Mus musculus
tattttgggatgtagattgtccgag

SEQ ID NO: 760946 - DNA, 25 bp, Mus musculus
tattttgggtatctgctgtaccgaa

SEQ ID NO: 760947 - DNA, 25 bp, Mus musculus
tattttgggtatgtgctgtaccgaa

SEQ ID NO: 760948 - DNA, 25 bp, Mus musculus
tattttgggtcgagcactagcctcg

SEQ ID NO: 760949 - DNA, 25 bp, Mus musculus
tattttgggtcgtgcactagcctcg

SEQ ID NO: 760950 - DNA, 25 bp, Mus musculus
tattttggtgaacgccatttatacc

SEQ ID NO: 760951 - DNA, 25 bp, Mus musculus
tattttggtgaaggccatttatacc

SEQ ID NO: 760952 - DNA, 25 bp, Mus musculus
tattttgtcctgacaactccatccc

SEQ ID NO: 760953 - DNA, 25 bp, Mus musculus
tattttgtcctgtcaactccatccc

SEQ ID NO: 760954 - DNA, 25 bp, Mus musculus
tattttgtgaacatgatagacccac

SEQ ID NO: 760955 - DNA, 25 bp, Mus musculus
tattttgtgaacttgatagacccac

SEQ ID NO: 760956 - DNA, 25 bp, Mus musculus
tattttgtgaatacagtggccccag

SEQ ID NO: 760957 - DNA, 25 bp, Mus musculus
tattttgtgaattcagtggccccag

SEQ ID NO: 760958 - DNA, 25 bp, Mus musculus
tattttgttgctccggcggaacgct

SEQ ID NO: 760959 - DNA, 25 bp, Mus musculus
tattttgttgctgcggcggaacgct

SEQ ID NO: 760960 - DNA, 25 bp, Mus musculus
tatttttaaagacggagacgatgga

SEQ ID NO: 760961 - DNA, 25 bp, Mus musculus
tatttttaaagagggagacgatgga

SEQ ID NO: 760962 - DNA, 25 bp, Mus musculus
tatttttaaaggagcaacttcgcaa

SEQ ID NO: 760963 - DNA, 25 bp, Mus musculus
tatttttaaaggtgcaacttcgcaa

SEQ ID NO: 760964 - DNA, 25 bp, Mus musculus
tatttttaaggcatccaacatgttc

SEQ ID NO: 760965 - DNA, 25 bp, Mus musculus
tatttttaaggcttccaacatgttc

SEQ ID NO: 760966 - DNA, 25 bp, Mus musculus
tatttttaccgtcccaaatgtgaga

SEQ ID NO: 760967 - DNA, 25 bp, Mus musculus
tatttttaccgtgccaaatgtgaga

SEQ ID NO: 760968 - DNA, 25 bp, Mus musculus
tatttttactcacacctcagcaacc

SEQ ID NO: 760969 - DNA, 25 bp, Mus musculus
tatttttactcagacctcagcaacc

SEQ ID NO: 760970 - DNA, 25 bp, Mus musculus
tatttttctccacgccaccgggaca

SEQ ID NO: 760971 - DNA, 25 bp, Mus musculus
tatttttctccaggccaccgggaca

SEQ ID NO: 760972 - DNA, 25 bp, Mus musculus
tatttttgccaacatgtcgcggtaa

SEQ ID NO: 760973 - DNA, 25 bp, Mus musculus
tatttttgccaagatgtcgcggtaa

SEQ ID NO: 760974 - DNA, 25 bp, Mus musculus
tatttttggccgctactcttcacaa

SEQ ID NO: 760975 - DNA, 25 bp, Mus musculus
tatttttggccggtactcttcacaa

SEQ ID NO: 760976 - DNA, 25 bp, Mus musculus
tatttttgggttcagcagctcgtca

SEQ ID NO: 760977 - DNA, 25 bp, Mus musculus
tatttttgggttgagcagctcgtca

SEQ ID NO: 760978 - DNA, 25 bp, Mus musculus
tatttttgtgccagatacattccgc

SEQ ID NO: 760979 - DNA, 25 bp, Mus musculus
tatttttgtgcctgatacattccgc

SEQ ID NO: 760980 - DNA, 25 bp, Mus musculus
tattttttacatcaagagcgataac

SEQ ID NO: 760981 - DNA, 25 bp, Mus musculus
tattttttacatgaagagcgataac

SEQ ID NO: 760982 - DNA, 25 bp, Mus musculus
tattttttgagcaaggtgccacaag

SEQ ID NO: 760983 - DNA, 25 bp, Mus musculus
tattttttgagctaggtgccacaag

SEQ ID NO: 760984 - DNA, 25 bp, Mus musculus
tattttttggtacttttgcagggca

SEQ ID NO: 760985 - DNA, 25 bp, Mus musculus
tattttttggtagttttgcagggca

SEQ ID NO: 760986 - DNA, 25 bp, Mus musculus
tcaaaaaagcgtagggctgcactgt

SEQ ID NO: 760987 - DNA, 25 bp, Mus musculus
tcaaaaaagcgttgggctgcactgt

SEQ ID NO: 760988 - DNA, 25 bp, Mus musculus
tcaaaaacaagcagccggaggagca

SEQ ID NO: 760989 - DNA, 25 bp, Mus musculus
tcaaaaacaagctgccggaggagca

SEQ ID NO: 760990 - DNA, 25 bp, Mus musculus
tcaaaaacaatgaacttggaggata

SEQ ID NO: 760991 - DNA, 25 bp, Mus musculus
tcaaaaacaatgtacttggaggata

SEQ ID NO: 760992 - DNA, 25 bp, Mus musculus
tcaaaaacacgcactcggtccaagt

SEQ ID NO: 760993 - DNA, 25 bp, Mus musculus
tcaaaaacacgctctcggtccaagt

SEQ ID NO: 760994 - DNA, 25 bp, Mus musculus
tcaaaaacgtatcctggaagaagaa

SEQ ID NO: 760995 - DNA, 25 bp, Mus musculus
tcaaaaacgtatgctggaagaagaa

SEQ ID NO: 760996 - DNA, 25 bp, Mus musculus
tcaaaaactaccacccaaagatcag

SEQ ID NO: 760997 - DNA, 25 bp, Mus musculus
tcaaaaactacctcccaaagatcag

SEQ ID NO: 760998 - DNA, 25 bp, Mus musculus
tcaaaaagatgtctgggactgtctc

SEQ ID NO: 760999 - DNA, 25 bp, Mus musculus
tcaaaaagatgtgtgggactgtctc

SEQ ID NO: 761000 - DNA, 25 bp, Mus musculus
tcaaaaagattgaagccgcacattg

SEQ ID NO: 761001 - DNA, 25 bp, Mus musculus
tcaaaaagattgtagccgcacattg

SEQ ID NO: 761002 - DNA, 25 bp, Mus musculus
tcaaaaagcataaaaggggcgtggt

SEQ ID NO: 761003 - DNA, 25 bp, Mus musculus
tcaaaaagcatataaggggcgtggt

SEQ ID NO: 761004 - DNA, 25 bp, Mus musculus
tcaaaaagctgaacctccgaaatgc

SEQ ID NO: 761005 - DNA, 25 bp, Mus musculus
tcaaaaagctgatcctccgaaatgc

SEQ ID NO: 761006 - DNA, 25 bp, Mus musculus
tcaaaaaggacgactatactgcccg

SEQ ID NO: 761007 - DNA, 25 bp, Mus musculus
tcaaaaaggacgtctatactgcccg

SEQ ID NO: 761008 - DNA, 25 bp, Mus musculus
tcaaaaagtgcaatgggcgggctct

SEQ ID NO: 761009 - DNA, 25 bp, Mus musculus
tcaaaaagtgcattgggcgggctct

SEQ ID NO: 761010 - DNA, 25 bp, Mus musculus
tcaaaaatatttatgtcttacaaga

SEQ ID NO: 761011 - DNA, 25 bp, Mus musculus
tcaaaaatatttttgtcttacaaga

SEQ ID NO: 761012 - DNA, 25 bp, Mus musculus
tcaaaaatccaaattcccaaacagg

SEQ ID NO: 761013 - DNA, 25 bp, Mus musculus
tcaaaaatccaatttcccaaacagg

SEQ ID NO: 761014 - DNA, 25 bp, Mus musculus
tcaaaaatctcgagctggtggatga

SEQ ID NO: 761015 - DNA, 25 bp, Mus musculus
tcaaaaatctcgtgctggtggatga

SEQ ID NO: 761016 - DNA, 25 bp, Mus musculus
tcaaaaatctggcatccaaaagcgg

SEQ ID NO: 761017 - DNA, 25 bp, Mus musculus
tcaaaaatctgggatccaaaagcgg

SEQ ID NO: 761018 - DNA, 25 bp, Mus musculus
tcaaaaatgctcaggtctcctccac

SEQ ID NO: 761019 - DNA, 25 bp, Mus musculus
tcaaaaatgctctggtctcctccac

SEQ ID NO: 761020 - DNA, 25 bp, Mus musculus
tcaaaacataccagcttccagatac

SEQ ID NO: 761021 - DNA, 25 bp, Mus musculus
tcaaaacatacctgcttccagatac

SEQ ID NO: 761022 - DNA, 25 bp, Mus musculus
tcaaaacattgaaggaaagcttagg

SEQ ID NO: 761023 - DNA, 25 bp, Mus musculus
tcaaaacattgatggaaagcttagg

SEQ ID NO: 761024 - DNA, 25 bp, Mus musculus
tcaaaacgacagaatgacgagagcc

SEQ ID NO: 761025 - DNA, 25 bp, Mus musculus
tcaaaacgacagtatgacgagagcc

SEQ ID NO: 761026 - DNA, 25 bp, Mus musculus
tcaaaacgcaggatttggatccggg

SEQ ID NO: 761027 - DNA, 25 bp, Mus musculus
tcaaaacgcaggttttggatccggg

SEQ ID NO: 761028 - DNA, 25 bp, Mus musculus
tcaaaactacagacgttggtccccg

SEQ ID NO: 761029 - DNA, 25 bp, Mus musculus
tcaaaactacagtcgttggtccccg

SEQ ID NO: 761030 - DNA, 25 bp, Mus musculus
tcaaaactatatcaacatcctgcgg

SEQ ID NO: 761031 - DNA, 25 bp, Mus musculus
tcaaaactatatgaacatcctgcgg

SEQ ID NO: 761032 - DNA, 25 bp, Mus musculus
tcaaaactgcatccatacattgggt

SEQ ID NO: 761033 - DNA, 25 bp, Mus musculus
tcaaaactgcatgcatacattgggt

SEQ ID NO: 761034 - DNA, 25 bp, Mus musculus
tcaaaactgggcaggtaggtctcca

SEQ ID NO: 761035 - DNA, 25 bp, Mus musculus
tcaaaactgggctggtaggtctcca

SEQ ID NO: 761036 - DNA, 25 bp, Mus musculus
tcaaaagacccaagctcttcctggt

SEQ ID NO: 761037 - DNA, 25 bp, Mus musculus
tcaaaagacccatgctcttcctggt

SEQ ID NO: 761038 - DNA, 25 bp, Mus musculus
tcaaaagacggtagcatgactctgg

SEQ ID NO: 761039 - DNA, 25 bp, Mus musculus
tcaaaagacggttgcatgactctgg

SEQ ID NO: 761040 - DNA, 25 bp, Mus musculus
tcaaaagagcccacggtggagacag

SEQ ID NO: 761041 - DNA, 25 bp, Mus musculus
tcaaaagagccctcggtggagacag

SEQ ID NO: 761042 - DNA, 25 bp, Mus musculus
tcaaaagagcttcgttgaggacggt

SEQ ID NO: 761043 - DNA, 25 bp, Mus musculus
tcaaaagagcttggttgaggacggt

SEQ ID NO: 761044 - DNA, 25 bp, Mus musculus
tcaaaagagggtcctgaaccaccag

SEQ ID NO: 761045 - DNA, 25 bp, Mus musculus
tcaaaagagggtgctgaaccaccag

SEQ ID NO: 761046 - DNA, 25 bp, Mus musculus
tcaaaagcaatgaggaagggattca

SEQ ID NO: 761047 - DNA, 25 bp, Mus musculus
tcaaaagcaatgtggaagggattca

SEQ ID NO: 761048 - DNA, 25 bp, Mus musculus
tcaaaagcatacagtggtggccagc

SEQ ID NO: 761049 - DNA, 25 bp, Mus musculus
tcaaaagcatactgtggtggccagc

SEQ ID NO: 761050 - DNA, 25 bp, Mus musculus
tcaaaagcatgtaacggagtctggt

SEQ ID NO: 761051 - DNA, 25 bp, Mus musculus
tcaaaagcatgttacggagtctggt

SEQ ID NO: 761052 - DNA, 25 bp, Mus musculus
tcaaaagccaccaccccaagaaagg

SEQ ID NO: 761053 - DNA, 25 bp, Mus musculus
tcaaaagccacctccccaagaaagg

SEQ ID NO: 761054 - DNA, 25 bp, Mus musculus
tcaaaagccctgctactgggttagg

SEQ ID NO: 761055 - DNA, 25 bp, Mus musculus
tcaaaagccctggtactgggttagg

SEQ ID NO: 761056 - DNA, 25 bp, Mus musculus
tcaaaagcgactctgcagtgattgg

SEQ ID NO: 761057 - DNA, 25 bp, Mus musculus
tcaaaagcgactgtgcagtgattgg

SEQ ID NO: 761058 - DNA, 25 bp, Mus musculus
tcaaaagcgtttagagtgccttatg

SEQ ID NO: 761059 - DNA, 25 bp, Mus musculus
tcaaaagcgttttgagtgccttatg

SEQ ID NO: 761060 - DNA, 25 bp, Mus musculus
tcaaaagctccccaaatcaccaaga

SEQ ID NO: 761061 - DNA, 25 bp, Mus musculus
tcaaaagctcccgaaatcaccaaga

SEQ ID NO: 761062 - DNA, 25 bp, Mus musculus
tcaaaagcttcgacttccactttgg

SEQ ID NO: 761063 - DNA, 25 bp, Mus musculus
tcaaaagcttcgtcttccactttgg

SEQ ID NO: 761064 - DNA, 25 bp, Mus musculus
tcaaaaggcaaacctctatagtggg

SEQ ID NO: 761065 - DNA, 25 bp, Mus musculus
tcaaaaggcaaagctctatagtggg

SEQ ID NO: 761066 - DNA, 25 bp, Mus musculus
tcaaaaggcaagcatggtccagagc

SEQ ID NO: 761067 - DNA, 25 bp, Mus musculus
tcaaaaggcaaggatggtccagagc

SEQ ID NO: 761068 - DNA, 25 bp, Mus musculus
tcaaaagggatgaggcctgggactt

SEQ ID NO: 761069 - DNA, 25 bp, Mus musculus
tcaaaagggatgtggcctgggactt

SEQ ID NO: 761070 - DNA, 25 bp, Mus musculus
tcaaaaggtagtcgcacaagagcag

SEQ ID NO: 761071 - DNA, 25 bp, Mus musculus
tcaaaaggtagtggcacaagagcag

SEQ ID NO: 761072 - DNA, 25 bp, Mus musculus
tcaaaagtatctctgtgaccaagat

SEQ ID NO: 761073 - DNA, 25 bp, Mus musculus
tcaaaagtatctgtgtgaccaagat

SEQ ID NO: 761074 - DNA, 25 bp, Mus musculus
tcaaaagtccccacatcaaatacat

SEQ ID NO: 761075 - DNA, 25 bp, Mus musculus
tcaaaagtcccctcatcaaatacat

SEQ ID NO: 761076 - DNA, 25 bp, Mus musculus
tcaaaagttgaaagctgtcagcagg

SEQ ID NO: 761077 - DNA, 25 bp, Mus musculus
tcaaaagttgaatgctgtcagcagg

SEQ ID NO: 761078 - DNA, 25 bp, Mus musculus
tcaaaagtttcaagaaggagctggc

SEQ ID NO: 761079 - DNA, 25 bp, Mus musculus
tcaaaagtttcatgaaggagctggc

SEQ ID NO: 761080 - DNA, 25 bp, Mus musculus
tcaaaatacggtatgaagcagaagc

SEQ ID NO: 761081 - DNA, 25 bp, Mus musculus
tcaaaatacggtttgaagcagaagc

SEQ ID NO: 761082 - DNA, 25 bp, Mus musculus
tcaaaatattggacaagtgactgtt

SEQ ID NO: 761083 - DNA, 25 bp, Mus musculus
tcaaaatattggtcaagtgactgtt

SEQ ID NO: 761084 - DNA, 25 bp, Mus musculus
tcaaaatcgaataatacagcagccc

SEQ ID NO: 761085 - DNA, 25 bp, Mus musculus
tcaaaatcgaattatacagcagccc

SEQ ID NO: 761086 - DNA, 25 bp, Mus musculus
tcaaaatctggaagtcccgatcgtg

SEQ ID NO: 761087 - DNA, 25 bp, Mus musculus
tcaaaatctggatgtcccgatcgtg

SEQ ID NO: 761088 - DNA, 25 bp, Mus musculus
tcaaaatcttgtctggctcccagca

SEQ ID NO: 761089 - DNA, 25 bp, Mus musculus
tcaaaatcttgtgtggctcccagca

SEQ ID NO: 761090 - DNA, 25 bp, Mus musculus
tcaaaatgaacactccctcgcaaag

SEQ ID NO: 761091 - DNA, 25 bp, Mus musculus
tcaaaatgaacagtccctcgcaaag

SEQ ID NO: 761092 - DNA, 25 bp, Mus musculus
tcaaaatgattgaggatcctgtgga

SEQ ID NO: 761093 - DNA, 25 bp, Mus musculus
tcaaaatgattgtggatcctgtgga

SEQ ID NO: 761094 - DNA, 25 bp, Mus musculus
tcaaaatggtcaagacacaatgaca

SEQ ID NO: 761095 - DNA, 25 bp, Mus musculus
tcaaaatggtcatgacacaatgaca

SEQ ID NO: 761096 - DNA, 25 bp, Mus musculus
tcaaaatggttaccgcagcacacag

SEQ ID NO: 761097 - DNA, 25 bp, Mus musculus
tcaaaatggttagcgcagcacacag

SEQ ID NO: 761098 - DNA, 25 bp, Mus musculus
tcaaaatgtcagctctaaggtggga

SEQ ID NO: 761099 - DNA, 25 bp, Mus musculus
tcaaaatgtcaggtctaaggtggga

SEQ ID NO: 761100 - DNA, 25 bp, Mus musculus
tcaaaatgtggacatcttagaatta

SEQ ID NO: 761101 - DNA, 25 bp, Mus musculus
tcaaaatgtggagatcttagaatta

SEQ ID NO: 761102 - DNA, 25 bp, Mus musculus
tcaaaatgtgtcagtaacagaagct

SEQ ID NO: 761103 - DNA, 25 bp, Mus musculus
tcaaaatgtgtctgtaacagaagct

SEQ ID NO: 761104 - DNA, 25 bp, Mus musculus
tcaaaatgttggagcgcttttgccg

SEQ ID NO: 761105 - DNA, 25 bp, Mus musculus
tcaaaatgttggtgcgcttttgccg

SEQ ID NO: 761106 - DNA, 25 bp, Mus musculus
tcaaaattagaacatcgttaccaga

SEQ ID NO: 761107 - DNA, 25 bp, Mus musculus
tcaaaattagaagatcgttaccaga

SEQ ID NO: 761108 - DNA, 25 bp, Mus musculus
tcaaaattgcctcaatggcccctgg

SEQ ID NO: 761109 - DNA, 25 bp, Mus musculus
tcaaaattgcctgaatggcccctgg

SEQ ID NO: 761110 - DNA, 25 bp, Mus musculus
tcaaaattggaacagagtggaagct

SEQ ID NO: 761111 - DNA, 25 bp, Mus musculus
tcaaaattggaagagagtggaagct

SEQ ID NO: 761112 - DNA, 25 bp, Mus musculus
tcaaaattgtcgaaaatgggacaca

SEQ ID NO: 761113 - DNA, 25 bp, Mus musculus
tcaaaattgtcgtaaatgggacaca

SEQ ID NO: 761114 - DNA, 25 bp, Mus musculus
tcaaacaaagaccaatcaaacttgg

SEQ ID NO: 761115 - DNA, 25 bp, Mus musculus
tcaaacaaagacgaatcaaacttgg

SEQ ID NO: 761116 - DNA, 25 bp, Mus musculus
tcaaacaacatcaatcggataactg

SEQ ID NO: 761117 - DNA, 25 bp, Mus musculus
tcaaacaacatctatcggataactg

SEQ ID NO: 761118 - DNA, 25 bp, Mus musculus
tcaaacaagaaaacatcaaaaagtt

SEQ ID NO: 761119 - DNA, 25 bp, Mus musculus
tcaaacaagaaatcatcaaaaagtt

SEQ ID NO: 761120 - DNA, 25 bp, Mus musculus
tcaaacacaactcgaaaaatgggat

SEQ ID NO: 761121 - DNA, 25 bp, Mus musculus
tcaaacacaactggaaaaatgggat

SEQ ID NO: 761122 - DNA, 25 bp, Mus musculus
tcaaacacagatagagggtgaaact

SEQ ID NO: 761123 - DNA, 25 bp, Mus musculus
tcaaacacagattgagggtgaaact

SEQ ID NO: 761124 - DNA, 25 bp, Mus musculus
tcaaacacgacaatatcatcgccat

SEQ ID NO: 761125 - DNA, 25 bp, Mus musculus
tcaaacacgacattatcatcgccat

SEQ ID NO: 761126 - DNA, 25 bp, Mus musculus
tcaaacacgtccatgcattcatcca

SEQ ID NO: 761127 - DNA, 25 bp, Mus musculus
tcaaacacgtccttgcattcatcca

SEQ ID NO: 761128 - DNA, 25 bp, Mus musculus
tcaaacacgtggaacccaatgaggt

SEQ ID NO: 761129 - DNA, 25 bp, Mus musculus
tcaaacacgtggtacccaatgaggt

SEQ ID NO: 761130 - DNA, 25 bp, Mus musculus
tcaaacagaaacacggcatgaatct

SEQ ID NO: 761131 - DNA, 25 bp, Mus musculus
tcaaacagaaactcggcatgaatct

SEQ ID NO: 761132 - DNA, 25 bp, Mus musculus
tcaaacagacaacggggaacacggc

SEQ ID NO: 761133 - DNA, 25 bp, Mus musculus
tcaaacagacaagggggaacacggc

SEQ ID NO: 761134 - DNA, 25 bp, Mus musculus
tcaaacagatgaagtgagtgttccc

SEQ ID NO: 761135 - DNA, 25 bp, Mus musculus
tcaaacagatgatgtgagtgttccc

SEQ ID NO: 761136 - DNA, 25 bp, Mus musculus
tcaaacaggagcattgctaccctgg

SEQ ID NO: 761137 - DNA, 25 bp, Mus musculus
tcaaacaggagctttgctaccctgg

SEQ ID NO: 761138 - DNA, 25 bp, Mus musculus
tcaaacagtgctcattcttcatgca

SEQ ID NO: 761139 - DNA, 25 bp, Mus musculus
tcaaacagtgctgattcttcatgca

SEQ ID NO: 761140 - DNA, 25 bp, Mus musculus
tcaaacatccagctgggagacctca

SEQ ID NO: 761141 - DNA, 25 bp, Mus musculus
tcaaacatccaggtgggagacctca

SEQ ID NO: 761142 - DNA, 25 bp, Mus musculus
tcaaacatggagaacataaaatttt

SEQ ID NO: 761143 - DNA, 25 bp, Mus musculus
tcaaacatggagtacataaaatttt

SEQ ID NO: 761144 - DNA, 25 bp, Mus musculus
tcaaacattatcaagaagaaggaca

SEQ ID NO: 761145 - DNA, 25 bp, Mus musculus
tcaaacattatctagaagaaggaca

SEQ ID NO: 761146 - DNA, 25 bp, Mus musculus
tcaaacattgttaagaaacggagga

SEQ ID NO: 761147 - DNA, 25 bp, Mus musculus
tcaaacattgtttagaaacggagga

SEQ ID NO: 761148 - DNA, 25 bp, Mus musculus
tcaaaccaatgacttcaagaacctg

SEQ ID NO: 761149 - DNA, 25 bp, Mus musculus
tcaaaccaatgagttcaagaacctg

SEQ ID NO: 761150 - DNA, 25 bp, Mus musculus
tcaaaccacatacgaagacatccaa

SEQ ID NO: 761151 - DNA, 25 bp, Mus musculus
tcaaaccacataggaagacatccaa

SEQ ID NO: 761152 - DNA, 25 bp, Mus musculus
tcaaaccacgaactaagctttcacg

SEQ ID NO: 761153 - DNA, 25 bp, Mus musculus
tcaaaccacgaagtaagctttcacg

SEQ ID NO: 761154 - DNA, 25 bp, Mus musculus
tcaaaccactagatgactgccagaa

SEQ ID NO: 761155 - DNA, 25 bp, Mus musculus
tcaaaccactagttgactgccagaa

SEQ ID NO: 761156 - DNA, 25 bp, Mus musculus
tcaaaccagaaaacggaagcccaag

SEQ ID NO: 761157 - DNA, 25 bp, Mus musculus
tcaaaccagaaatcggaagcccaag

SEQ ID NO: 761158 - DNA, 25 bp, Mus musculus
tcaaaccatcatataccccatggag

SEQ ID NO: 761159 - DNA, 25 bp, Mus musculus
tcaaaccatcatttaccccatggag

SEQ ID NO: 761160 - DNA, 25 bp, Mus musculus
tcaaacccaaaccaaggagcaacgg

SEQ ID NO: 761161 - DNA, 25 bp, Mus musculus
tcaaacccaaacgaaggagcaacgg

SEQ ID NO: 761162 - DNA, 25 bp, Mus musculus
tcaaacccatcacgaaggatgctgt

SEQ ID NO: 761163 - DNA, 25 bp, Mus musculus
tcaaacccatcaggaaggatgctgt

SEQ ID NO: 761164 - DNA, 25 bp, Mus musculus
tcaaaccccagacacctggaagagc

SEQ ID NO: 761165 - DNA, 25 bp, Mus musculus
tcaaaccccagagacctggaagagc

SEQ ID NO: 761166 - DNA, 25 bp, Mus musculus
tcaaaccctgaaactcagaatctgg

SEQ ID NO: 761167 - DNA, 25 bp, Mus musculus
tcaaaccctgaatctcagaatctgg

SEQ ID NO: 761168 - DNA, 25 bp, Mus musculus
tcaaaccgagaaatgctcatagccc

SEQ ID NO: 761169 - DNA, 25 bp, Mus musculus
tcaaaccgagaattgctcatagccc

SEQ ID NO: 761170 - DNA, 25 bp, Mus musculus
tcaaaccggtgaacttggaagctct

SEQ ID NO: 761171 - DNA, 25 bp, Mus musculus
tcaaaccggtgatcttggaagctct

SEQ ID NO: 761172 - DNA, 25 bp, Mus musculus
tcaaaccgtacaagaaaaagtcgtg

SEQ ID NO: 761173 - DNA, 25 bp, Mus musculus
tcaaaccgtacatgaaaaagtcgtg

SEQ ID NO: 761174 - DNA, 25 bp, Mus musculus
tcaaaccgtgagcaatttcctgtgt

SEQ ID NO: 761175 - DNA, 25 bp, Mus musculus
tcaaaccgtgaggaatttcctgtgt

SEQ ID NO: 761176 - DNA, 25 bp, Mus musculus
tcaaaccgtgtcagctacgccgcaa

SEQ ID NO: 761177 - DNA, 25 bp, Mus musculus
tcaaaccgtgtctgctacgccgcaa

SEQ ID NO: 761178 - DNA, 25 bp, Mus musculus
tcaaacctacagactgcacattgct

SEQ ID NO: 761179 - DNA, 25 bp, Mus musculus
tcaaacctacagtctgcacattgct

SEQ ID NO: 761180 - DNA, 25 bp, Mus musculus
tcaaacctactgacgcgattctctc

SEQ ID NO: 761181 - DNA, 25 bp, Mus musculus
tcaaacctactgtcgcgattctctc

SEQ ID NO: 761182 - DNA, 25 bp, Mus musculus
tcaaacctggagacctcatcttcgc

SEQ ID NO: 761183 - DNA, 25 bp, Mus musculus
tcaaacctggagtcctcatcttcgc

SEQ ID NO: 761184 - DNA, 25 bp, Mus musculus
tcaaacctttgtcggccaggaatgt

SEQ ID NO: 761185 - DNA, 25 bp, Mus musculus
tcaaacctttgtgggccaggaatgt

SEQ ID NO: 761186 - DNA, 25 bp, Mus musculus
tcaaacgcattgacctggctggcct

SEQ ID NO: 761187 - DNA, 25 bp, Mus musculus
tcaaacgcattgtcctggctggcct

SEQ ID NO: 761188 - DNA, 25 bp, Mus musculus
tcaaacgccagacccagtggaagaa

SEQ ID NO: 761189 - DNA, 25 bp, Mus musculus
tcaaacgccagagccagtggaagaa

SEQ ID NO: 761190 - DNA, 25 bp, Mus musculus
tcaaacgcggctactcggcccattt

SEQ ID NO: 761191 - DNA, 25 bp, Mus musculus
tcaaacgcggcttctcggcccattt

SEQ ID NO: 761192 - DNA, 25 bp, Mus musculus
tcaaacggtttgagaagcggaagga

SEQ ID NO: 761193 - DNA, 25 bp, Mus musculus
tcaaacggtttgtgaagcggaagga

SEQ ID NO: 761194 - DNA, 25 bp, Mus musculus
tcaaacgtgaaacaaggtacctaag

SEQ ID NO: 761195 - DNA, 25 bp, Mus musculus
tcaaacgtgaaagaaggtacctaag

SEQ ID NO: 761196 - DNA, 25 bp, Mus musculus
tcaaactacttacgtggcagaagtc

SEQ ID NO: 761197 - DNA, 25 bp, Mus musculus
tcaaactacttaggtggcagaagtc

SEQ ID NO: 761198 - DNA, 25 bp, Mus musculus
tcaaactatgttcggcaaggacccc

SEQ ID NO: 761199 - DNA, 25 bp, Mus musculus
tcaaactatgttgggcaaggacccc

SEQ ID NO: 761200 - DNA, 25 bp, Mus musculus
tcaaactcaaggaccaggtgctgtt

SEQ ID NO: 761201 - DNA, 25 bp, Mus musculus
tcaaactcaaggtccaggtgctgtt

SEQ ID NO: 761202 - DNA, 25 bp, Mus musculus
tcaaactccaggagctgtgatcact

SEQ ID NO: 761203 - DNA, 25 bp, Mus musculus
tcaaactccaggtgctgtgatcact

SEQ ID NO: 761204 - DNA, 25 bp, Mus musculus
tcaaactcgtgaccctgtgcctagg

SEQ ID NO: 761205 - DNA, 25 bp, Mus musculus
tcaaactcgtgagcctgtgcctagg

SEQ ID NO: 761206 - DNA, 25 bp, Mus musculus
tcaaactgcagaacaaggtgttcca

SEQ ID NO: 761207 - DNA, 25 bp, Mus musculus
tcaaactgcagatcaaggtgttcca

SEQ ID NO: 761208 - DNA, 25 bp, Mus musculus
tcaaactggaaaccggagttgtcaa

SEQ ID NO: 761209 - DNA, 25 bp, Mus musculus
tcaaactggaaagcggagttgtcaa

SEQ ID NO: 761210 - DNA, 25 bp, Mus musculus
tcaaactggactctgcagtttacaa

SEQ ID NO: 761211 - DNA, 25 bp, Mus musculus
tcaaactggactgtgcagtttacaa

SEQ ID NO: 761212 - DNA, 25 bp, Mus musculus
tcaaactggtgtaaacagagccagc

SEQ ID NO: 761213 - DNA, 25 bp, Mus musculus
tcaaactggtgttaacagagccagc

SEQ ID NO: 761214 - DNA, 25 bp, Mus musculus
tcaaacttcctaatgaggatggcct

SEQ ID NO: 761215 - DNA, 25 bp, Mus musculus
tcaaacttcctattgaggatggcct

SEQ ID NO: 761216 - DNA, 25 bp, Mus musculus
tcaaacttcgccatgggacgtttcc

SEQ ID NO: 761217 - DNA, 25 bp, Mus musculus
tcaaacttcgccttgggacgtttcc

SEQ ID NO: 761218 - DNA, 25 bp, Mus musculus
tcaaacttggttcgttagtctccac

SEQ ID NO: 761219 - DNA, 25 bp, Mus musculus
tcaaacttggttggttagtctccac

SEQ ID NO: 761220 - DNA, 25 bp, Mus musculus
tcaaagaaatgtatacccacctgga

SEQ ID NO: 761221 - DNA, 25 bp, Mus musculus
tcaaagaaatgtttacccacctgga

SEQ ID NO: 761222 - DNA, 25 bp, Mus musculus
tcaaagaacaacaagactggagatg

SEQ ID NO: 761223 - DNA, 25 bp, Mus musculus
tcaaagaacaactagactggagatg

SEQ ID NO: 761224 - DNA, 25 bp, Mus musculus
tcaaagaacagaagaggaagtacaa

SEQ ID NO: 761225 - DNA, 25 bp, Mus musculus
tcaaagaacagatgaggaagtacaa

SEQ ID NO: 761226 - DNA, 25 bp, Mus musculus
tcaaagaacgggagagacgtctcaa

SEQ ID NO: 761227 - DNA, 25 bp, Mus musculus
tcaaagaacgggtgagacgtctcaa

SEQ ID NO: 761228 - DNA, 25 bp, Mus musculus
tcaaagaacttaacgcacgaggaga

SEQ ID NO: 761229 - DNA, 25 bp, Mus musculus
tcaaagaacttatcgcacgaggaga

SEQ ID NO: 761230 - DNA, 25 bp, Mus musculus
tcaaagaagaatagctaaagtgctg

SEQ ID NO: 761231 - DNA, 25 bp, Mus musculus
tcaaagaagaattgctaaagtgctg

SEQ ID NO: 761232 - DNA, 25 bp, Mus musculus
tcaaagaaggttcgcacgtacaaga

SEQ ID NO: 761233 - DNA, 25 bp, Mus musculus
tcaaagaaggttggcacgtacaaga

SEQ ID NO: 761234 - DNA, 25 bp, Mus musculus
tcaaagaagtcaaggaagtcacgag

SEQ ID NO: 761235 - DNA, 25 bp, Mus musculus
tcaaagaagtcatggaagtcacgag

SEQ ID NO: 761236 - DNA, 25 bp, Mus musculus
tcaaagacaaacaggaagaaacgaa

SEQ ID NO: 761237 - DNA, 25 bp, Mus musculus
tcaaagacaaactggaagaaacgaa

SEQ ID NO: 761238 - DNA, 25 bp, Mus musculus
tcaaagacaacaactacctgcccta

SEQ ID NO: 761239 - DNA, 25 bp, Mus musculus
tcaaagacaacatctacctgcccta

SEQ ID NO: 761240 - DNA, 25 bp, Mus musculus
tcaaagacaagcctacggtggagag

SEQ ID NO: 761241 - DNA, 25 bp, Mus musculus
tcaaagacaagcgtacggtggagag

SEQ ID NO: 761242 - DNA, 25 bp, Mus musculus
tcaaagacagaaccctggaagagtc

SEQ ID NO: 761243 - DNA, 25 bp, Mus musculus
tcaaagacagaagcctggaagagtc

SEQ ID NO: 761244 - DNA, 25 bp, Mus musculus
tcaaagacatgcatgcacgagagag

SEQ ID NO: 761245 - DNA, 25 bp, Mus musculus
tcaaagacatgcttgcacgagagag

SEQ ID NO: 761246 - DNA, 25 bp, Mus musculus
tcaaagaccaaacaccacagagcca

SEQ ID NO: 761247 - DNA, 25 bp, Mus musculus
tcaaagaccaaagaccacagagcca

SEQ ID NO: 761248 - DNA, 25 bp, Mus musculus
tcaaagaccaagaactttgaagacc

SEQ ID NO: 761249 - DNA, 25 bp, Mus musculus
tcaaagaccaagtactttgaagacc

SEQ ID NO: 761250 - DNA, 25 bp, Mus musculus
tcaaagaccagcaagaaggagcccg

SEQ ID NO: 761251 - DNA, 25 bp, Mus musculus
tcaaagaccagctagaaggagcccg

SEQ ID NO: 761252 - DNA, 25 bp, Mus musculus
tcaaagaccatcagcaaagtggccg

SEQ ID NO: 761253 - DNA, 25 bp, Mus musculus
tcaaagaccatctgcaaagtggccg

SEQ ID NO: 761254 - DNA, 25 bp, Mus musculus
tcaaagaccccaagtaggcggccca

SEQ ID NO: 761255 - DNA, 25 bp, Mus musculus
tcaaagaccccatgtaggcggccca

SEQ ID NO: 761256 - DNA, 25 bp, Mus musculus
tcaaagacctctacagcctaaagcc

SEQ ID NO: 761257 - DNA, 25 bp, Mus musculus
tcaaagacctcttcagcctaaagcc

SEQ ID NO: 761258 - DNA, 25 bp, Mus musculus
tcaaagacttccagcatgacgcctg

SEQ ID NO: 761259 - DNA, 25 bp, Mus musculus
tcaaagacttcctgcatgacgcctg

SEQ ID NO: 761260 - DNA, 25 bp, Mus musculus
tcaaagagaagcaattagacctgct

SEQ ID NO: 761261 - DNA, 25 bp, Mus musculus
tcaaagagaagctattagacctgct

SEQ ID NO: 761262 - DNA, 25 bp, Mus musculus
tcaaagagacagatactccccgtag

SEQ ID NO: 761263 - DNA, 25 bp, Mus musculus
tcaaagagacagttactccccgtag

SEQ ID NO: 761264 - DNA, 25 bp, Mus musculus
tcaaagagagcgaagtcaaggccct

SEQ ID NO: 761265 - DNA, 25 bp, Mus musculus
tcaaagagagcgtagtcaaggccct

SEQ ID NO: 761266 - DNA, 25 bp, Mus musculus
tcaaagagatagagactctcgcgcc

SEQ ID NO: 761267 - DNA, 25 bp, Mus musculus
tcaaagagatagctgtgactgtgaa

SEQ ID NO: 761268 - DNA, 25 bp, Mus musculus
tcaaagagataggtgtgactgtgaa

SEQ ID NO: 761269 - DNA, 25 bp, Mus musculus
tcaaagagatagtgactctcgcgcc

SEQ ID NO: 761270 - DNA, 25 bp, Mus musculus
tcaaagagcgcaaccagtgggtagg

SEQ ID NO: 761271 - DNA, 25 bp, Mus musculus
tcaaagagcgcatccagtgggtagg

SEQ ID NO: 761272 - DNA, 25 bp, Mus musculus
tcaaagagctccaggcgctcaacac

SEQ ID NO: 761273 - DNA, 25 bp, Mus musculus
tcaaagagctcctggcgctcaacac

SEQ ID NO: 761274 - DNA, 25 bp, Mus musculus
tcaaagaggaaaactctaaacgttt

SEQ ID NO: 761275 - DNA, 25 bp, Mus musculus
tcaaagaggaaatctctaaacgttt

SEQ ID NO: 761276 - DNA, 25 bp, Mus musculus
tcaaagaggagcactgcatcttccg

SEQ ID NO: 761277 - DNA, 25 bp, Mus musculus
tcaaagaggagctctgcatcttccg

SEQ ID NO: 761278 - DNA, 25 bp, Mus musculus
tcaaagagggctactccttccagcc

SEQ ID NO: 761279 - DNA, 25 bp, Mus musculus
tcaaagagggcttctccttccagcc

SEQ ID NO: 761280 - DNA, 25 bp, Mus musculus
tcaaagaggtggcaacttcggtcca

SEQ ID NO: 761281 - DNA, 25 bp, Mus musculus
tcaaagaggtgggaacttcggtcca

SEQ ID NO: 761282 - DNA, 25 bp, Mus musculus
tcaaagaggttgacgaggatggaac

SEQ ID NO: 761283 - DNA, 25 bp, Mus musculus
tcaaagaggttgtcgaggatggaac

SEQ ID NO: 761284 - DNA, 25 bp, Mus musculus
tcaaagatataactagaaaactcag

SEQ ID NO: 761285 - DNA, 25 bp, Mus musculus
tcaaagatataagtagaaaactcag

SEQ ID NO: 761286 - DNA, 25 bp, Mus musculus
tcaaagatcaaacaaggtgactaca

SEQ ID NO: 761287 - DNA, 25 bp, Mus musculus
tcaaagatcaaagaaggtgactaca

SEQ ID NO: 761288 - DNA, 25 bp, Mus musculus
tcaaagatgagcacaatgaggagag

SEQ ID NO: 761289 - DNA, 25 bp, Mus musculus
tcaaagatgagctcaatgaggagag

SEQ ID NO: 761290 - DNA, 25 bp, Mus musculus
tcaaagatggtcctgccgctcagga

SEQ ID NO: 761291 - DNA, 25 bp, Mus musculus
tcaaagatggtcgtgccgctcagga

SEQ ID NO: 761292 - DNA, 25 bp, Mus musculus
tcaaagatgtccacgaagactccct

SEQ ID NO: 761293 - DNA, 25 bp, Mus musculus
tcaaagatgtcctcgaagactccct

SEQ ID NO: 761294 - DNA, 25 bp, Mus musculus
tcaaagatgtggcacggaagcctcc

SEQ ID NO: 761295 - DNA, 25 bp, Mus musculus
tcaaagatgtgggacggaagcctcc

SEQ ID NO: 761296 - DNA, 25 bp, Mus musculus
tcaaagcaaaagagtgatcccgaag

SEQ ID NO: 761297 - DNA, 25 bp, Mus musculus
tcaaagcaaaagtgtgatcccgaag

SEQ ID NO: 761298 - DNA, 25 bp, Mus musculus
tcaaagcaaatgaaggaatcacggt

SEQ ID NO: 761299 - DNA, 25 bp, Mus musculus
tcaaagcaaatgtaggaatcacggt

SEQ ID NO: 761300 - DNA, 25 bp, Mus musculus
tcaaagcaacccatcagcacttcgg

SEQ ID NO: 761301 - DNA, 25 bp, Mus musculus
tcaaagcaacccttcagcacttcgg

SEQ ID NO: 761302 - DNA, 25 bp, Mus musculus
tcaaagcaagtacgcaagcgccagc

SEQ ID NO: 761303 - DNA, 25 bp, Mus musculus
tcaaagcaagtaggcaagcgccagc

SEQ ID NO: 761304 - DNA, 25 bp, Mus musculus
tcaaagcagagcatctgaatagccc

SEQ ID NO: 761305 - DNA, 25 bp, Mus musculus
tcaaagcagagcttctgaatagccc

SEQ ID NO: 761306 - DNA, 25 bp, Mus musculus
tcaaagcaggagacgtgagcagagc

SEQ ID NO: 761307 - DNA, 25 bp, Mus musculus
tcaaagcaggagtcgtgagcagagc

SEQ ID NO: 761308 - DNA, 25 bp, Mus musculus
tcaaagcaggccagactgaccaggt

SEQ ID NO: 761309 - DNA, 25 bp, Mus musculus
tcaaagcaggcctgactgaccaggt

SEQ ID NO: 761310 - DNA, 25 bp, Mus musculus
tcaaagcagggacgatgccagtcac

SEQ ID NO: 761311 - DNA, 25 bp, Mus musculus
tcaaagcagggaggatgccagtcac

SEQ ID NO: 761312 - DNA, 25 bp, Mus musculus
tcaaagccatccaaaaagaccgtgg

SEQ ID NO: 761313 - DNA, 25 bp, Mus musculus
tcaaagccatcctaaaagaccgtgg

SEQ ID NO: 761314 - DNA, 25 bp, Mus musculus
tcaaagcccaacacgttgaaacatc

SEQ ID NO: 761315 - DNA, 25 bp, Mus musculus
tcaaagcccaactcgttgaaacatc

SEQ ID NO: 761316 - DNA, 25 bp, Mus musculus
tcaaagcccaagctccaagaggcct

SEQ ID NO: 761317 - DNA, 25 bp, Mus musculus
tcaaagcccaaggtccaagaggcct

SEQ ID NO: 761318 - DNA, 25 bp, Mus musculus
tcaaagccctcgagtgcgcgggacc

SEQ ID NO: 761319 - DNA, 25 bp, Mus musculus
tcaaagccctcgtgtgcgcgggacc

SEQ ID NO: 761320 - DNA, 25 bp, Mus musculus
tcaaagccctctcctacaagaacgg

SEQ ID NO: 761321 - DNA, 25 bp, Mus musculus
tcaaagccctctgctacaagaacgg

SEQ ID NO: 761322 - DNA, 25 bp, Mus musculus
tcaaagccctggcacttggagcctc

SEQ ID NO: 761323 - DNA, 25 bp, Mus musculus
tcaaagccctgggacttggagcctc

SEQ ID NO: 761324 - DNA, 25 bp, Mus musculus
tcaaagccggcaagaaatccaggag

SEQ ID NO: 761325 - DNA, 25 bp, Mus musculus
tcaaagccggcatgaaatccaggag

SEQ ID NO: 761326 - DNA, 25 bp, Mus musculus
tcaaagcctctcacatctaggccaa

SEQ ID NO: 761327 - DNA, 25 bp, Mus musculus
tcaaagcctctctcatctaggccaa

SEQ ID NO: 761328 - DNA, 25 bp, Mus musculus
tcaaagcctgcgcaattaaaaggag

SEQ ID NO: 761329 - DNA, 25 bp, Mus musculus
tcaaagcctgcggaattaaaaggag

SEQ ID NO: 761330 - DNA, 25 bp, Mus musculus
tcaaagccttagagtggcgctacac

SEQ ID NO: 761331 - DNA, 25 bp, Mus musculus
tcaaagccttagtgtggcgctacac

SEQ ID NO: 761332 - DNA, 25 bp, Mus musculus
tcaaagcgagtgacatcctcagaaa

SEQ ID NO: 761333 - DNA, 25 bp, Mus musculus
tcaaagcgagtgtcatcctcagaaa

SEQ ID NO: 761334 - DNA, 25 bp, Mus musculus
tcaaagcgggcacattcagcctgtc

SEQ ID NO: 761335 - DNA, 25 bp, Mus musculus
tcaaagcgggcagattcagcctgtc

SEQ ID NO: 761336 - DNA, 25 bp, Mus musculus
tcaaagcgtggtaggtgagtgctcc

SEQ ID NO: 761337 - DNA, 25 bp, Mus musculus
tcaaagcgtggttggtgagtgctcc

SEQ ID NO: 761338 - DNA, 25 bp, Mus musculus
tcaaagctagatcctcggatccagc

SEQ ID NO: 761339 - DNA, 25 bp, Mus musculus
tcaaagctagatgctcggatccagc

SEQ ID NO: 761340 - DNA, 25 bp, Mus musculus
tcaaagctagctaggtggcactccg

SEQ ID NO: 761341 - DNA, 25 bp, Mus musculus
tcaaagctagcttggtggcactccg

SEQ ID NO: 761342 - DNA, 25 bp, Mus musculus
tcaaagctcagcctcaaaccctgtg

SEQ ID NO: 761343 - DNA, 25 bp, Mus musculus
tcaaagctcagcgtcaaaccctgtg

SEQ ID NO: 761344 - DNA, 25 bp, Mus musculus
tcaaagctcgaaacctcaaagccat

SEQ ID NO: 761345 - DNA, 25 bp, Mus musculus
tcaaagctcgaatcctcaaagccat

SEQ ID NO: 761346 - DNA, 25 bp, Mus musculus
tcaaagctcgagacagggagatgga

SEQ ID NO: 761347 - DNA, 25 bp, Mus musculus
tcaaagctcgagtcagggagatgga

SEQ ID NO: 761348 - DNA, 25 bp, Mus musculus
tcaaagctgcaaaagaagcccggtc

SEQ ID NO: 761349 - DNA, 25 bp, Mus musculus
tcaaagctgcaatagaagcccggtc

SEQ ID NO: 761350 - DNA, 25 bp, Mus musculus
tcaaagctgtgtactcaggcttcta

SEQ ID NO: 761351 - DNA, 25 bp, Mus musculus
tcaaagctgtgttctcaggcttcta

SEQ ID NO: 761352 - DNA, 25 bp, Mus musculus
tcaaagctgttgagtacgtgagcct

SEQ ID NO: 761353 - DNA, 25 bp, Mus musculus
tcaaagctgttgtgtacgtgagcct

SEQ ID NO: 761354 - DNA, 25 bp, Mus musculus
tcaaaggaaagcaaggcagactgct

SEQ ID NO: 761355 - DNA, 25 bp, Mus musculus
tcaaaggaaagctaggcagactgct

SEQ ID NO: 761356 - DNA, 25 bp, Mus musculus
tcaaaggaaagtactttcacagccg

SEQ ID NO: 761357 - DNA, 25 bp, Mus musculus
tcaaaggaaagttctttcacagccg

SEQ ID NO: 761358 - DNA, 25 bp, Mus musculus
tcaaaggaagataccaacagaaaca

SEQ ID NO: 761359 - DNA, 25 bp, Mus musculus
tcaaaggaagattccaacagaaaca

SEQ ID NO: 761360 - DNA, 25 bp, Mus musculus
tcaaaggacaccaagatgtggaagc

SEQ ID NO: 761361 - DNA, 25 bp, Mus musculus
tcaaaggacacctagatgtggaagc

SEQ ID NO: 761362 - DNA, 25 bp, Mus musculus
tcaaaggacatgactgaggagtcac

SEQ ID NO: 761363 - DNA, 25 bp, Mus musculus
tcaaaggacatgtctgaggagtcac

SEQ ID NO: 761364 - DNA, 25 bp, Mus musculus
tcaaaggagcccacgccaggcgggc

SEQ ID NO: 761365 - DNA, 25 bp, Mus musculus
tcaaaggagccctcgccaggcgggc

SEQ ID NO: 761366 - DNA, 25 bp, Mus musculus
tcaaaggagtggacctcgatgcacc

SEQ ID NO: 761367 - DNA, 25 bp, Mus musculus
tcaaaggagtggtcctcgatgcacc

SEQ ID NO: 761368 - DNA, 25 bp, Mus musculus
tcaaaggatcccaagcactgtcagg

SEQ ID NO: 761369 - DNA, 25 bp, Mus musculus
tcaaaggatccctagcactgtcagg

SEQ ID NO: 761370 - DNA, 25 bp, Mus musculus
tcaaaggcgtctacagccacacagt

SEQ ID NO: 761371 - DNA, 25 bp, Mus musculus
tcaaaggcgtcttcagccacacagt

SEQ ID NO: 761372 - DNA, 25 bp, Mus musculus
tcaaaggctcctagagcgcagagcg

SEQ ID NO: 761373 - DNA, 25 bp, Mus musculus
tcaaaggctccttgagcgcagagcg

SEQ ID NO: 761374 - DNA, 25 bp, Mus musculus
tcaaaggctctgaagacactccaac

SEQ ID NO: 761375 - DNA, 25 bp, Mus musculus
tcaaaggctctgtagacactccaac

SEQ ID NO: 761376 - DNA, 25 bp, Mus musculus
tcaaaggctgctcggattccatcca

SEQ ID NO: 761377 - DNA, 25 bp, Mus musculus
tcaaaggctgctgggattccatcca

SEQ ID NO: 761378 - DNA, 25 bp, Mus musculus
tcaaaggcttgccacctcgcctggg

SEQ ID NO: 761379 - DNA, 25 bp, Mus musculus
tcaaaggcttgcgacctcgcctggg

SEQ ID NO: 761380 - DNA, 25 bp, Mus musculus
tcaaagggccgcagccccgagggaa

SEQ ID NO: 761381 - DNA, 25 bp, Mus musculus
tcaaagggccgctgccccgagggaa

SEQ ID NO: 761382 - DNA, 25 bp, Mus musculus
tcaaagggctaaatgacaggccaca

SEQ ID NO: 761383 - DNA, 25 bp, Mus musculus
tcaaagggctaattgacaggccaca

SEQ ID NO: 761384 - DNA, 25 bp, Mus musculus
tcaaagggtgaactcatggagtctg

SEQ ID NO: 761385 - DNA, 25 bp, Mus musculus
tcaaagggtgaagtcatggagtctg

SEQ ID NO: 761386 - DNA, 25 bp, Mus musculus
tcaaagggttcacgacatggtcaca

SEQ ID NO: 761387 - DNA, 25 bp, Mus musculus
tcaaagggttcaggacatggtcaca

SEQ ID NO: 761388 - DNA, 25 bp, Mus musculus
tcaaaggtcactatgaggcaaagca

SEQ ID NO: 761389 - DNA, 25 bp, Mus musculus
tcaaaggtcactttgaggcaaagca

SEQ ID NO: 761390 - DNA, 25 bp, Mus musculus
tcaaaggtgcaacggactttctcac

SEQ ID NO: 761391 - DNA, 25 bp, Mus musculus
tcaaaggtgcaagggactttctcac

SEQ ID NO: 761392 - DNA, 25 bp, Mus musculus
tcaaagtaagacctaaaaggcgcag

SEQ ID NO: 761393 - DNA, 25 bp, Mus musculus
tcaaagtaagacgtaaaaggcgcag

SEQ ID NO: 761394 - DNA, 25 bp, Mus musculus
tcaaagtaggtaaagaagattcatc

SEQ ID NO: 761395 - DNA, 25 bp, Mus musculus
tcaaagtaggtatagaagattcatc

SEQ ID NO: 761396 - DNA, 25 bp, Mus musculus
tcaaagtccacaataacagaacaga

SEQ ID NO: 761397 - DNA, 25 bp, Mus musculus
tcaaagtccacattaacagaacaga

SEQ ID NO: 761398 - DNA, 25 bp, Mus musculus
tcaaagtccctgatgattggaacag

SEQ ID NO: 761399 - DNA, 25 bp, Mus musculus
tcaaagtccctgttgattggaacag

SEQ ID NO: 761400 - DNA, 25 bp, Mus musculus
tcaaagtcgcccaccaagaaaaaga

SEQ ID NO: 761401 - DNA, 25 bp, Mus musculus
tcaaagtcgccctccaagaaaaaga

SEQ ID NO: 761402 - DNA, 25 bp, Mus musculus
tcaaagtctgataccagggaaatcc

SEQ ID NO: 761403 - DNA, 25 bp, Mus musculus
tcaaagtctgattccagggaaatcc

SEQ ID NO: 761404 - DNA, 25 bp, Mus musculus
tcaaagtctggcaatcagcaagctg

SEQ ID NO: 761405 - DNA, 25 bp, Mus musculus
tcaaagtctggctatcagcaagctg

SEQ ID NO: 761406 - DNA, 25 bp, Mus musculus
tcaaagtcttccaccgggatggtca

SEQ ID NO: 761407 - DNA, 25 bp, Mus musculus
tcaaagtcttcctccgggatggtca

SEQ ID NO: 761408 - DNA, 25 bp, Mus musculus
tcaaagtgaacaaaaccctgccgta

SEQ ID NO: 761409 - DNA, 25 bp, Mus musculus
tcaaagtgaacataaccctgccgta

SEQ ID NO: 761410 - DNA, 25 bp, Mus musculus
tcaaagtgattgatgttggccggag

SEQ ID NO: 761411 - DNA, 25 bp, Mus musculus
tcaaagtgattgttgttggccggag

SEQ ID NO: 761412 - DNA, 25 bp, Mus musculus
tcaaagtgccagcagtaagacccac

SEQ ID NO: 761413 - DNA, 25 bp, Mus musculus
tcaaagtgccaggagtaagacccac

SEQ ID NO: 761414 - DNA, 25 bp, Mus musculus
tcaaagtgcgccagctcatcagctg

SEQ ID NO: 761415 - DNA, 25 bp, Mus musculus
tcaaagtgcgcctgctcatcagctg

SEQ ID NO: 761416 - DNA, 25 bp, Mus musculus
tcaaagtgctggagcaggatcgact

SEQ ID NO: 761417 - DNA, 25 bp, Mus musculus
tcaaagtgctggtgcaggatcgact

SEQ ID NO: 761418 - DNA, 25 bp, Mus musculus
tcaaagtggccacacacgagaagga

SEQ ID NO: 761419 - DNA, 25 bp, Mus musculus
tcaaagtggccagacacgagaagga

SEQ ID NO: 761420 - DNA, 25 bp, Mus musculus
tcaaagtgggatctcagacgactct

SEQ ID NO: 761421 - DNA, 25 bp, Mus musculus
tcaaagtgggatgtcagacgactct

SEQ ID NO: 761422 - DNA, 25 bp, Mus musculus
tcaaagtgggcaactttccggcttc

SEQ ID NO: 761423 - DNA, 25 bp, Mus musculus
tcaaagtgggcatctttccggcttc

SEQ ID NO: 761424 - DNA, 25 bp, Mus musculus
tcaaagtggtcaccagctccctctg

SEQ ID NO: 761425 - DNA, 25 bp, Mus musculus
tcaaagtggtcagcagctccctctg

SEQ ID NO: 761426 - DNA, 25 bp, Mus musculus
tcaaagttacagacattctggccca

SEQ ID NO: 761427 - DNA, 25 bp, Mus musculus
tcaaagttacagtcattctggccca

SEQ ID NO: 761428 - DNA, 25 bp, Mus musculus
tcaaagttagaacccaagacccctg

SEQ ID NO: 761429 - DNA, 25 bp, Mus musculus
tcaaagttagaagccaagacccctg

SEQ ID NO: 761430 - DNA, 25 bp, Mus musculus
tcaaagttatgacactttgccccat

SEQ ID NO: 761431 - DNA, 25 bp, Mus musculus
tcaaagttatgagactttgccccat

SEQ ID NO: 761432 - DNA, 25 bp, Mus musculus
tcaaagttgcagcacaaagctcgcc

SEQ ID NO: 761433 - DNA, 25 bp, Mus musculus
tcaaagttgcaggacaaagctcgcc

SEQ ID NO: 761434 - DNA, 25 bp, Mus musculus
tcaaataagataacccaagtggcct

SEQ ID NO: 761435 - DNA, 25 bp, Mus musculus
tcaaataagatatcccaagtggcct

SEQ ID NO: 761436 - DNA, 25 bp, Mus musculus
tcaaatacagcaccattggactggc

SEQ ID NO: 761437 - DNA, 25 bp, Mus musculus
tcaaatacagcagcattggactggc

SEQ ID NO: 761438 - DNA, 25 bp, Mus musculus
tcaaataccccaatggtgtgaaccc

SEQ ID NO: 761439 - DNA, 25 bp, Mus musculus
tcaaataccccattggtgtgaaccc

SEQ ID NO: 761440 - DNA, 25 bp, Mus musculus
tcaaatacgcagacattgagtcccc

SEQ ID NO: 761441 - DNA, 25 bp, Mus musculus
tcaaatacgcagtcattgagtcccc

SEQ ID NO: 761442 - DNA, 25 bp, Mus musculus
tcaaatataacaaagatggcagtgt

SEQ ID NO: 761443 - DNA, 25 bp, Mus musculus
tcaaatataacatagatggcagtgt

SEQ ID NO: 761444 - DNA, 25 bp, Mus musculus
tcaaatatatatccctggatgtggc

SEQ ID NO: 761445 - DNA, 25 bp, Mus musculus
tcaaatatatatgcctggatgtggc

SEQ ID NO: 761446 - DNA, 25 bp, Mus musculus
tcaaatatgaagctccccaaaccac

SEQ ID NO: 761447 - DNA, 25 bp, Mus musculus
tcaaatatgaaggtccccaaaccac

SEQ ID NO: 761448 - DNA, 25 bp, Mus musculus
tcaaatatggctaatctgacttgtt

SEQ ID NO: 761449 - DNA, 25 bp, Mus musculus
tcaaatatggcttatctgacttgtt

SEQ ID NO: 761450 - DNA, 25 bp, Mus musculus
tcaaatcagaacagccagccggtgg

SEQ ID NO: 761451 - DNA, 25 bp, Mus musculus
tcaaatcagaactgccagccggtgg

SEQ ID NO: 761452 - DNA, 25 bp, Mus musculus
tcaaatcagggcagtgctggaggcc

SEQ ID NO: 761453 - DNA, 25 bp, Mus musculus
tcaaatcagggctgtgctggaggcc

SEQ ID NO: 761454 - DNA, 25 bp, Mus musculus
tcaaatcagtcactacaaatgccag

SEQ ID NO: 761455 - DNA, 25 bp, Mus musculus
tcaaatcagtcagtacaaatgccag

SEQ ID NO: 761456 - DNA, 25 bp, Mus musculus
tcaaatccaactcaacaagaagtgt

SEQ ID NO: 761457 - DNA, 25 bp, Mus musculus
tcaaatccaactgaacaagaagtgt

SEQ ID NO: 761458 - DNA, 25 bp, Mus musculus
tcaaatccagtgaccggctagacga

SEQ ID NO: 761459 - DNA, 25 bp, Mus musculus
tcaaatccagtgtccggctagacga

SEQ ID NO: 761460 - DNA, 25 bp, Mus musculus
tcaaatccccgacttcggatgacat

SEQ ID NO: 761461 - DNA, 25 bp, Mus musculus
tcaaatccccgagttcggatgacat

SEQ ID NO: 761462 - DNA, 25 bp, Mus musculus
tcaaatccgtcgaagcagcacaaca

SEQ ID NO: 761463 - DNA, 25 bp, Mus musculus
tcaaatccgtcgtagcagcacaaca

SEQ ID NO: 761464 - DNA, 25 bp, Mus musculus
tcaaatctctcactccatgcacaga

SEQ ID NO: 761465 - DNA, 25 bp, Mus musculus
tcaaatctctcagtccatgcacaga

SEQ ID NO: 761466 - DNA, 25 bp, Mus musculus
tcaaatctgagaatctgaggcacag

SEQ ID NO: 761467 - DNA, 25 bp, Mus musculus
tcaaatctgagattctgaggcacag

SEQ ID NO: 761468 - DNA, 25 bp, Mus musculus
tcaaatgaaatcacaaccgcatccc

SEQ ID NO: 761469 - DNA, 25 bp, Mus musculus
tcaaatgaaatctcaaccgcatccc

SEQ ID NO: 761470 - DNA, 25 bp, Mus musculus
tcaaatgcagggacaacagtgcagc

SEQ ID NO: 761471 - DNA, 25 bp, Mus musculus
tcaaatgcagggtcaacagtgcagc

SEQ ID NO: 761472 - DNA, 25 bp, Mus musculus
tcaaatgcgggcagcccatccgtct

SEQ ID NO: 761473 - DNA, 25 bp, Mus musculus
tcaaatgcgggctgcccatccgtct

SEQ ID NO: 761474 - DNA, 25 bp, Mus musculus
tcaaatggtccaaacttctaaaagg

SEQ ID NO: 761475 - DNA, 25 bp, Mus musculus
tcaaatggtccatacttctaaaagg

SEQ ID NO: 761476 - DNA, 25 bp, Mus musculus
tcaaatgtcctgatcattggagagt

SEQ ID NO: 761477 - DNA, 25 bp, Mus musculus
tcaaatgtcctgttcattggagagt

SEQ ID NO: 761478 - DNA, 25 bp, Mus musculus
tcaaatgtgagaattctgaaggccc

SEQ ID NO: 761479 - DNA, 25 bp, Mus musculus
tcaaatgtgagatttctgaaggccc

SEQ ID NO: 761480 - DNA, 25 bp, Mus musculus
tcaaatgtggcaatgaggaggcgct

SEQ ID NO: 761481 - DNA, 25 bp, Mus musculus
tcaaatgtggcattgaggaggcgct

SEQ ID NO: 761482 - DNA, 25 bp, Mus musculus
tcaaatgtgtagaaagcggccagcc

SEQ ID NO: 761483 - DNA, 25 bp, Mus musculus
tcaaatgtgtagtaagcggccagcc

SEQ ID NO: 761484 - DNA, 25 bp, Mus musculus
tcaaattaccccagacaaacagatg

SEQ ID NO: 761485 - DNA, 25 bp, Mus musculus
tcaaattacccctgacaaacagatg

SEQ ID NO: 761486 - DNA, 25 bp, Mus musculus
tcaaattatctcatctccctggacc

SEQ ID NO: 761487 - DNA, 25 bp, Mus musculus
tcaaattatctcttctccctggacc

SEQ ID NO: 761488 - DNA, 25 bp, Mus musculus
tcaaattcagatatggctcctaggg

SEQ ID NO: 761489 - DNA, 25 bp, Mus musculus
tcaaattcagatttggctcctaggg

SEQ ID NO: 761490 - DNA, 25 bp, Mus musculus
tcaaattctggaagcctatgaaaat

SEQ ID NO: 761491 - DNA, 25 bp, Mus musculus
tcaaattctggatgcctatgaaaat

SEQ ID NO: 761492 - DNA, 25 bp, Mus musculus
tcaaattctttccaaagtccaggct

SEQ ID NO: 761493 - DNA, 25 bp, Mus musculus
tcaaattctttcgaaagtccaggct

SEQ ID NO: 761494 - DNA, 25 bp, Mus musculus
tcaaattgaatacgcagtgcctccg

SEQ ID NO: 761495 - DNA, 25 bp, Mus musculus
tcaaattgaataggcagtgcctccg

SEQ ID NO: 761496 - DNA, 25 bp, Mus musculus
tcaaattgaccccaactgatataaa

SEQ ID NO: 761497 - DNA, 25 bp, Mus musculus
tcaaattgacccgaactgatataaa

SEQ ID NO: 761498 - DNA, 25 bp, Mus musculus
tcaaattgccaacctgcaagagctg

SEQ ID NO: 761499 - DNA, 25 bp, Mus musculus
tcaaattgccaagctgcaagagctg

SEQ ID NO: 761500 - DNA, 25 bp, Mus musculus
tcaaattggatgaaggctgggtacc

SEQ ID NO: 761501 - DNA, 25 bp, Mus musculus
tcaaattggatgtaggctgggtacc

SEQ ID NO: 761502 - DNA, 25 bp, Mus musculus
tcaaattgttgcaggagggccttcg

SEQ ID NO: 761503 - DNA, 25 bp, Mus musculus
tcaaattgttgctggagggccttcg

SEQ ID NO: 761504 - DNA, 25 bp, Mus musculus
tcaacaaaacggaccatagccggag

SEQ ID NO: 761505 - DNA, 25 bp, Mus musculus
tcaacaaaacggtccatagccggag

SEQ ID NO: 761506 - DNA, 25 bp, Mus musculus
tcaacaaaagcacggagttcaactt

SEQ ID NO: 761507 - DNA, 25 bp, Mus musculus
tcaacaaaagcagggagttcaactt

SEQ ID NO: 761508 - DNA, 25 bp, Mus musculus
tcaacaaacacgaggacggctacgc

SEQ ID NO: 761509 - DNA, 25 bp, Mus musculus
tcaacaaacacgtggacggctacgc

SEQ ID NO: 761510 - DNA, 25 bp, Mus musculus
tcaacaaaccggatgagcgtggctt

SEQ ID NO: 761511 - DNA, 25 bp, Mus musculus
tcaacaaaccggttgagcgtggctt

SEQ ID NO: 761512 - DNA, 25 bp, Mus musculus
tcaacaaataagaaacctcgaaaat

SEQ ID NO: 761513 - DNA, 25 bp, Mus musculus
tcaacaaataagtaacctcgaaaat

SEQ ID NO: 761514 - DNA, 25 bp, Mus musculus
tcaacaaatacactagcaagtctga

SEQ ID NO: 761515 - DNA, 25 bp, Mus musculus
tcaacaaatacagtagcaagtctga

SEQ ID NO: 761516 - DNA, 25 bp, Mus musculus
tcaacaaataccagtacctgctgac

SEQ ID NO: 761517 - DNA, 25 bp, Mus musculus
tcaacaaatacctgtacctgctgac

SEQ ID NO: 761518 - DNA, 25 bp, Mus musculus
tcaacaacagcaaggttaccgggat

SEQ ID NO: 761519 - DNA, 25 bp, Mus musculus
tcaacaacagcatggttaccgggat

SEQ ID NO: 761520 - DNA, 25 bp, Mus musculus
tcaacaaccaggagctaaatgagct

SEQ ID NO: 761521 - DNA, 25 bp, Mus musculus
tcaacaaccaggtgctaaatgagct

SEQ ID NO: 761522 - DNA, 25 bp, Mus musculus
tcaacaacctgaacctggctttact

SEQ ID NO: 761523 - DNA, 25 bp, Mus musculus
tcaacaacctgatcctggctttact

SEQ ID NO: 761524 - DNA, 25 bp, Mus musculus
tcaacaactaccctgctgagctgat

SEQ ID NO: 761525 - DNA, 25 bp, Mus musculus
tcaacaactaccgtgctgagctgat

SEQ ID NO: 761526 - DNA, 25 bp, Mus musculus
tcaacaactctgagttcaatggcaa

SEQ ID NO: 761527 - DNA, 25 bp, Mus musculus
tcaacaactctgtgttcaatggcaa

SEQ ID NO: 761528 - DNA, 25 bp, Mus musculus
tcaacaactggtctgagaacgcgga

SEQ ID NO: 761529 - DNA, 25 bp, Mus musculus
tcaacaactggtgtgagaacgcgga

SEQ ID NO: 761530 - DNA, 25 bp, Mus musculus
tcaacaagaagaatgcgctcatccg

SEQ ID NO: 761531 - DNA, 25 bp, Mus musculus
tcaacaagaagattgcgctcatccg

SEQ ID NO: 761532 - DNA, 25 bp, Mus musculus
tcaacaagaaggagaggcgccggtt

SEQ ID NO: 761533 - DNA, 25 bp, Mus musculus
tcaacaagaaggtgaggcgccggtt

SEQ ID NO: 761534 - DNA, 25 bp, Mus musculus
tcaacaagatccacacatgtaccaa

SEQ ID NO: 761535 - DNA, 25 bp, Mus musculus
tcaacaagatcctcacatgtaccaa

SEQ ID NO: 761536 - DNA, 25 bp, Mus musculus
tcaacaagatgactctggagcagga

SEQ ID NO: 761537 - DNA, 25 bp, Mus musculus
tcaacaagatgagtctggagcagga

SEQ ID NO: 761538 - DNA, 25 bp, Mus musculus
tcaacaagcaagaatgtggctggct

SEQ ID NO: 761539 - DNA, 25 bp, Mus musculus
tcaacaagcaagtatgtggctggct

SEQ ID NO: 761540 - DNA, 25 bp, Mus musculus
tcaacaagcatgcattttctggagg

SEQ ID NO: 761541 - DNA, 25 bp, Mus musculus
tcaacaagcatggattttctggagg

SEQ ID NO: 761542 - DNA, 25 bp, Mus musculus
tcaacaaggaggacccggactggtg

SEQ ID NO: 761543 - DNA, 25 bp, Mus musculus
tcaacaaggaggtcccggactggtg

SEQ ID NO: 761544 - DNA, 25 bp, Mus musculus
tcaacaaggataccagggtgtccct

SEQ ID NO: 761545 - DNA, 25 bp, Mus musculus
tcaacaaggatagcagggtgtccct

SEQ ID NO: 761546 - DNA, 25 bp, Mus musculus
tcaacaaggcacagcgggtcttaca

SEQ ID NO: 761547 - DNA, 25 bp, Mus musculus
tcaacaaggcactgcgggtcttaca

SEQ ID NO: 761548 - DNA, 25 bp, Mus musculus
tcaacaagtcccaggatgcccaact

SEQ ID NO: 761549 - DNA, 25 bp, Mus musculus
tcaacaagtccctggatgcccaact

SEQ ID NO: 761550 - DNA, 25 bp, Mus musculus
tcaacaagtcttagaccaccctggg

SEQ ID NO: 761551 - DNA, 25 bp, Mus musculus
tcaacaagtctttgaccaccctggg

SEQ ID NO: 761552 - DNA, 25 bp, Mus musculus
tcaacaagttgaagaagacacccct

SEQ ID NO: 761553 - DNA, 25 bp, Mus musculus
tcaacaagttgatgaagacacccct

SEQ ID NO: 761554 - DNA, 25 bp, Mus musculus
tcaacaataggaccaaaacacccgt

SEQ ID NO: 761555 - DNA, 25 bp, Mus musculus
tcaacaataggagcaaaacacccgt

SEQ ID NO: 761556 - DNA, 25 bp, Mus musculus
tcaacaatccctccagtaagtgcta

SEQ ID NO: 761557 - DNA, 25 bp, Mus musculus
tcaacaatccctgcagtaagtgcta

SEQ ID NO: 761558 - DNA, 25 bp, Mus musculus
tcaacaatttatccaacaatgagta

SEQ ID NO: 761559 - DNA, 25 bp, Mus musculus
tcaacaatttatgcaacaatgagta

SEQ ID NO: 761560 - DNA, 25 bp, Mus musculus
tcaacacaaaatatttggagatggg

SEQ ID NO: 761561 - DNA, 25 bp, Mus musculus
tcaacacaaaatttttggagatggg

SEQ ID NO: 761562 - DNA, 25 bp, Mus musculus
tcaacacaaagtcgctaggcttaaa

SEQ ID NO: 761563 - DNA, 25 bp, Mus musculus
tcaacacaaagtggctaggcttaaa

SEQ ID NO: 761564 - DNA, 25 bp, Mus musculus
tcaacacaacagacattctacgaac

SEQ ID NO: 761565 - DNA, 25 bp, Mus musculus
tcaacacaacagtcattctacgaac

SEQ ID NO: 761566 - DNA, 25 bp, Mus musculus
tcaacacaactcctatcaatgctgc

SEQ ID NO: 761567 - DNA, 25 bp, Mus musculus
tcaacacaactcgtatcaatgctgc

SEQ ID NO: 761568 - DNA, 25 bp, Mus musculus
tcaacacaagagaagaacggactct

SEQ ID NO: 761569 - DNA, 25 bp, Mus musculus
tcaacacaagagtagaacggactct

SEQ ID NO: 761570 - DNA, 25 bp, Mus musculus
tcaacacaaggaaaggctctggctt

SEQ ID NO: 761571 - DNA, 25 bp, Mus musculus
tcaacacaaggataggctctggctt

SEQ ID NO: 761572 - DNA, 25 bp, Mus musculus
tcaacacacatcagggaaggcccca

SEQ ID NO: 761573 - DNA, 25 bp, Mus musculus
tcaacacacatctgggaaggcccca

SEQ ID NO: 761574 - DNA, 25 bp, Mus musculus
tcaacacagatgacccttagacggc

SEQ ID NO: 761575 - DNA, 25 bp, Mus musculus
tcaacacagatgtcccttagacggc

SEQ ID NO: 761576 - DNA, 25 bp, Mus musculus
tcaacaccagctccagatgtcaagg

SEQ ID NO: 761577 - DNA, 25 bp, Mus musculus
tcaacaccagctgcagatgtcaagg

SEQ ID NO: 761578 - DNA, 25 bp, Mus musculus
tcaacaccgtgcagcacgctcggga

SEQ ID NO: 761579 - DNA, 25 bp, Mus musculus
tcaacaccgtgctgcacgctcggga

SEQ ID NO: 761580 - DNA, 25 bp, Mus musculus
tcaacaccgtgtcgaccttgggctg

SEQ ID NO: 761581 - DNA, 25 bp, Mus musculus
tcaacaccgtgtggaccttgggctg

SEQ ID NO: 761582 - DNA, 25 bp, Mus musculus
tcaacacctaagacaaagcagtctc

SEQ ID NO: 761583 - DNA, 25 bp, Mus musculus
tcaacacctaagtcaaagcagtctc

SEQ ID NO: 761584 - DNA, 25 bp, Mus musculus
tcaacacgagtgagtgaaccagccg

SEQ ID NO: 761585 - DNA, 25 bp, Mus musculus
tcaacacgagtgtgtgaaccagccg

SEQ ID NO: 761586 - DNA, 25 bp, Mus musculus
tcaacacgcattcggcgggccggta

SEQ ID NO: 761587 - DNA, 25 bp, Mus musculus
tcaacacgcattgggcgggccggta

SEQ ID NO: 761588 - DNA, 25 bp, Mus musculus
tcaacactgacgaggcccagatgta

SEQ ID NO: 761589 - DNA, 25 bp, Mus musculus
tcaacactgacgtggcccagatgta

SEQ ID NO: 761590 - DNA, 25 bp, Mus musculus
tcaacactgagactgctaaagccaa

SEQ ID NO: 761591 - DNA, 25 bp, Mus musculus
tcaacactgagagtgctaaagccaa

SEQ ID NO: 761592 - DNA, 25 bp, Mus musculus
tcaacacttgccacggtcaggaaac

SEQ ID NO: 761593 - DNA, 25 bp, Mus musculus
tcaacacttgcctcggtcaggaaac

SEQ ID NO: 761594 - DNA, 25 bp, Mus musculus
tcaacacttttcagcagaacgtgca

SEQ ID NO: 761595 - DNA, 25 bp, Mus musculus
tcaacacttttctgcagaacgtgca

SEQ ID NO: 761596 - DNA, 25 bp, Mus musculus
tcaacagaaagaatcaatccctagc

SEQ ID NO: 761597 - DNA, 25 bp, Mus musculus
tcaacagaaagattcaatccctagc

SEQ ID NO: 761598 - DNA, 25 bp, Mus musculus
tcaacagaacataagggcagactgc

SEQ ID NO: 761599 - DNA, 25 bp, Mus musculus
tcaacagaacattagggcagactgc

SEQ ID NO: 761600 - DNA, 25 bp, Mus musculus
tcaacagaaggtccgcgtgctgctc

SEQ ID NO: 761601 - DNA, 25 bp, Mus musculus
tcaacagaaggtgcgcgtgctgctc

SEQ ID NO: 761602 - DNA, 25 bp, Mus musculus
tcaacagaatgtatggagttcagct

SEQ ID NO: 761603 - DNA, 25 bp, Mus musculus
tcaacagaatgtttggagttcagct

SEQ ID NO: 761604 - DNA, 25 bp, Mus musculus
tcaacagacaacatttttctcccca

SEQ ID NO: 761605 - DNA, 25 bp, Mus musculus
tcaacagacaacttttttctcccca

SEQ ID NO: 761606 - DNA, 25 bp, Mus musculus
tcaacagacagacggaacaacaaag

SEQ ID NO: 761607 - DNA, 25 bp, Mus musculus
tcaacagacagagggaacaacaaag

SEQ ID NO: 761608 - DNA, 25 bp, Mus musculus
tcaacagacaggctcgacagagtgt

SEQ ID NO: 761609 - DNA, 25 bp, Mus musculus
tcaacagacagggtcgacagagtgt

SEQ ID NO: 761610 - DNA, 25 bp, Mus musculus
tcaacagacagtcttcatcgggact

SEQ ID NO: 761611 - DNA, 25 bp, Mus musculus
tcaacagacagtgttcatcgggact

SEQ ID NO: 761612 - DNA, 25 bp, Mus musculus
tcaacagactggagcgagaggacta

SEQ ID NO: 761613 - DNA, 25 bp, Mus musculus
tcaacagactggtgcgagaggacta

SEQ ID NO: 761614 - DNA, 25 bp, Mus musculus
tcaacagagcttccgagcactaggt

SEQ ID NO: 761615 - DNA, 25 bp, Mus musculus
tcaacagagcttgcgagcactaggt

SEQ ID NO: 761616 - DNA, 25 bp, Mus musculus
tcaacagagtaacctctggagggtc

SEQ ID NO: 761617 - DNA, 25 bp, Mus musculus
tcaacagagtaagctctggagggtc

SEQ ID NO: 761618 - DNA, 25 bp, Mus musculus
tcaacagatagacgcagagatgatc

SEQ ID NO: 761619 - DNA, 25 bp, Mus musculus
tcaacagatagaggcagagatgatc

SEQ ID NO: 761620 - DNA, 25 bp, Mus musculus
tcaacagcaatgcatacgagggtgt

SEQ ID NO: 761621 - DNA, 25 bp, Mus musculus
tcaacagcaatggatacgagggtgt

SEQ ID NO: 761622 - DNA, 25 bp, Mus musculus
tcaacagcaccaagtatgaagtggc

SEQ ID NO: 761623 - DNA, 25 bp, Mus musculus
tcaacagcaccatgtatgaagtggc

SEQ ID NO: 761624 - DNA, 25 bp, Mus musculus
tcaacagcacttaccgttcagtcag

SEQ ID NO: 761625 - DNA, 25 bp, Mus musculus
tcaacagcactttccgttcagtcag

SEQ ID NO: 761626 - DNA, 25 bp, Mus musculus
tcaacagccactagacttctggaag

SEQ ID NO: 761627 - DNA, 25 bp, Mus musculus
tcaacagccacttgacttctggaag

SEQ ID NO: 761628 - DNA, 25 bp, Mus musculus
tcaacagcctctaccctgatgtcaa

SEQ ID NO: 761629 - DNA, 25 bp, Mus musculus
tcaacagcctcttccctgatgtcaa

SEQ ID NO: 761630 - DNA, 25 bp, Mus musculus
tcaacagcggacaccccgatgctag

SEQ ID NO: 761631 - DNA, 25 bp, Mus musculus
tcaacagcggactccccgatgctag

SEQ ID NO: 761632 - DNA, 25 bp, Mus musculus
tcaacagctacccacgcttcagtga

SEQ ID NO: 761633 - DNA, 25 bp, Mus musculus
tcaacagctaccgacgcttcagtga

SEQ ID NO: 761634 - DNA, 25 bp, Mus musculus
tcaacagctccaccgaaaggacgtc

SEQ ID NO: 761635 - DNA, 25 bp, Mus musculus
tcaacagctccagcgaaaggacgtc

SEQ ID NO: 761636 - DNA, 25 bp, Mus musculus
tcaacagctctacaaggcttggccc

SEQ ID NO: 761637 - DNA, 25 bp, Mus musculus
tcaacagctctagaaggcttggccc

SEQ ID NO: 761638 - DNA, 25 bp, Mus musculus
tcaacagctctcaatggaataagga

SEQ ID NO: 761639 - DNA, 25 bp, Mus musculus
tcaacagctctcaggcctgcattgc

SEQ ID NO: 761640 - DNA, 25 bp, Mus musculus
tcaacagctctctatggaataagga

SEQ ID NO: 761641 - DNA, 25 bp, Mus musculus
tcaacagctctctggcctgcattgc

SEQ ID NO: 761642 - DNA, 25 bp, Mus musculus
tcaacaggaatcatcaaggacgcgg

SEQ ID NO: 761643 - DNA, 25 bp, Mus musculus
tcaacaggaatcttcaaggacgcgg

SEQ ID NO: 761644 - DNA, 25 bp, Mus musculus
tcaacaggatggaggtctacactca

SEQ ID NO: 761645 - DNA, 25 bp, Mus musculus
tcaacaggatggtggtctacactca

SEQ ID NO: 761646 - DNA, 25 bp, Mus musculus
tcaacagggaatacacccacagcca

SEQ ID NO: 761647 - DNA, 25 bp, Mus musculus
tcaacagggaattcacccacagcca

SEQ ID NO: 761648 - DNA, 25 bp, Mus musculus
tcaacagggatcaaaacatactgtg

SEQ ID NO: 761649 - DNA, 25 bp, Mus musculus
tcaacagggatctaaacatactgtg

SEQ ID NO: 761650 - DNA, 25 bp, Mus musculus
tcaacagggcctcaatggaaggaag

SEQ ID NO: 761651 - DNA, 25 bp, Mus musculus
tcaacagggcctgaatggaaggaag

SEQ ID NO: 761652 - DNA, 25 bp, Mus musculus
tcaacaggttccaacaattgtaaag

SEQ ID NO: 761653 - DNA, 25 bp, Mus musculus
tcaacaggttcctacaattgtaaag

SEQ ID NO: 761654 - DNA, 25 bp, Mus musculus
tcaacagtatagaggctctgctcag

SEQ ID NO: 761655 - DNA, 25 bp, Mus musculus
tcaacagtatagtggctctgctcag

SEQ ID NO: 761656 - DNA, 25 bp, Mus musculus
tcaacagtcttcaaaaacagatgtc

SEQ ID NO: 761657 - DNA, 25 bp, Mus musculus
tcaacagtcttctaaaacagatgtc

SEQ ID NO: 761658 - DNA, 25 bp, Mus musculus
tcaacagtgctaaccggaagcgcct

SEQ ID NO: 761659 - DNA, 25 bp, Mus musculus
tcaacagtgctatccggaagcgcct

SEQ ID NO: 761660 - DNA, 25 bp, Mus musculus
tcaacagttatcagacccaagcaca

SEQ ID NO: 761661 - DNA, 25 bp, Mus musculus
tcaacagttatctgacccaagcaca

SEQ ID NO: 761662 - DNA, 25 bp, Mus musculus
tcaacatcaaacagaacaacaagca

SEQ ID NO: 761663 - DNA, 25 bp, Mus musculus
tcaacatcaaactgaacaacaagca

SEQ ID NO: 761664 - DNA, 25 bp, Mus musculus
tcaacatcaccaaaggcgaccctat

SEQ ID NO: 761665 - DNA, 25 bp, Mus musculus
tcaacatcaccataggcgaccctat

SEQ ID NO: 761666 - DNA, 25 bp, Mus musculus
tcaacatcagtcagtcaggaacaca

SEQ ID NO: 761667 - DNA, 25 bp, Mus musculus
tcaacatcagtctgtcaggaacaca

SEQ ID NO: 761668 - DNA, 25 bp, Mus musculus
tcaacatccccacctggaactggaa

SEQ ID NO: 761669 - DNA, 25 bp, Mus musculus
tcaacatccccagctggaactggaa

SEQ ID NO: 761670 - DNA, 25 bp, Mus musculus
tcaacatcctggctctggtgtaccg

SEQ ID NO: 761671 - DNA, 25 bp, Mus musculus
tcaacatcctgggtctggtgtaccg

SEQ ID NO: 761672 - DNA, 25 bp, Mus musculus
tcaacatcgatgatcttttcccgca

SEQ ID NO: 761673 - DNA, 25 bp, Mus musculus
tcaacatcgatgttcttttcccgca

SEQ ID NO: 761674 - DNA, 25 bp, Mus musculus
tcaacatctaggactgggcagagct

SEQ ID NO: 761675 - DNA, 25 bp, Mus musculus
tcaacatctaggtctgggcagagct

SEQ ID NO: 761676 - DNA, 25 bp, Mus musculus
tcaacatctccaaggaggcccgaag

SEQ ID NO: 761677 - DNA, 25 bp, Mus musculus
tcaacatctccatggaggcccgaag

SEQ ID NO: 761678 - DNA, 25 bp, Mus musculus
tcaacatgacacactacatcaagca

SEQ ID NO: 761679 - DNA, 25 bp, Mus musculus
tcaacatgacactctacatcaagca

SEQ ID NO: 761680 - DNA, 25 bp, Mus musculus
tcaacatgctgacacacatgcaccg

SEQ ID NO: 761681 - DNA, 25 bp, Mus musculus
tcaacatgctgagacacatgcaccg

SEQ ID NO: 761682 - DNA, 25 bp, Mus musculus
tcaacatggacgaccggtttgggca

SEQ ID NO: 761683 - DNA, 25 bp, Mus musculus
tcaacatggacgtccggtttgggca

SEQ ID NO: 761684 - DNA, 25 bp, Mus musculus
tcaacatggattcactgagtgcccg

SEQ ID NO: 761685 - DNA, 25 bp, Mus musculus
tcaacatggattgactgagtgcccg

SEQ ID NO: 761686 - DNA, 25 bp, Mus musculus
tcaacatgtacacgaggatggtgct

SEQ ID NO: 761687 - DNA, 25 bp, Mus musculus
tcaacatgtacaggaggatggtgct

SEQ ID NO: 761688 - DNA, 25 bp, Mus musculus
tcaacatgtaccagacctcacgcgt

SEQ ID NO: 761689 - DNA, 25 bp, Mus musculus
tcaacatgtacctgacctcacgcgt

SEQ ID NO: 761690 - DNA, 25 bp, Mus musculus
tcaacatgtcaaataagtgaaaagt

SEQ ID NO: 761691 - DNA, 25 bp, Mus musculus
tcaacatgtcaattaagtgaaaagt

SEQ ID NO: 761692 - DNA, 25 bp, Mus musculus
tcaacatgttccatctccgaggccg

SEQ ID NO: 761693 - DNA, 25 bp, Mus musculus
tcaacatgttccttctccgaggccg

SEQ ID NO: 761694 - DNA, 25 bp, Mus musculus
tcaacatgtttgaccacccgattcc

SEQ ID NO: 761695 - DNA, 25 bp, Mus musculus
tcaacatgtttgtccacccgattcc

SEQ ID NO: 761696 - DNA, 25 bp, Mus musculus
tcaacattgaacacttcaacagttc

SEQ ID NO: 761697 - DNA, 25 bp, Mus musculus
tcaacattgaactcttcaacagttc

SEQ ID NO: 761698 - DNA, 25 bp, Mus musculus
tcaacattgatcacctccacgtggg

SEQ ID NO: 761699 - DNA, 25 bp, Mus musculus
tcaacattgatctcctccacgtggg

SEQ ID NO: 761700 - DNA, 25 bp, Mus musculus
tcaacatttccaacaagaaccttag

SEQ ID NO: 761701 - DNA, 25 bp, Mus musculus
tcaacatttccatcaagaaccttag

SEQ ID NO: 761702 - DNA, 25 bp, Mus musculus
tcaacatttccgagaaattcctggg

SEQ ID NO: 761703 - DNA, 25 bp, Mus musculus
tcaacatttccgtgaaattcctggg

SEQ ID NO: 761704 - DNA, 25 bp, Mus musculus
tcaaccaaatcccagttcaactcag

SEQ ID NO: 761705 - DNA, 25 bp, Mus musculus
tcaaccaaatccgagttcaactcag

SEQ ID NO: 761706 - DNA, 25 bp, Mus musculus
tcaaccaactttctgtgcctttggg

SEQ ID NO: 761707 - DNA, 25 bp, Mus musculus
tcaaccaactttgtgtgcctttggg

SEQ ID NO: 761708 - DNA, 25 bp, Mus musculus
tcaaccaagaacatagatctgagct

SEQ ID NO: 761709 - DNA, 25 bp, Mus musculus
tcaaccaagaacttagatctgagct

SEQ ID NO: 761710 - DNA, 25 bp, Mus musculus
tcaaccaaggccctgtatgaccgaa

SEQ ID NO: 761711 - DNA, 25 bp, Mus musculus
tcaaccaaggccgtgtatgaccgaa

SEQ ID NO: 761712 - DNA, 25 bp, Mus musculus
tcaaccaagggtcgactggcctctg

SEQ ID NO: 761713 - DNA, 25 bp, Mus musculus
tcaaccaagggtggactggcctctg

SEQ ID NO: 761714 - DNA, 25 bp, Mus musculus
tcaaccaatcaccagccctgaaggg

SEQ ID NO: 761715 - DNA, 25 bp, Mus musculus
tcaaccaatcacgagccctgaaggg

SEQ ID NO: 761716 - DNA, 25 bp, Mus musculus
tcaaccaatggactgcaagcatagt

SEQ ID NO: 761717 - DNA, 25 bp, Mus musculus
tcaaccaatggagtgcaagcatagt

SEQ ID NO: 761718 - DNA, 25 bp, Mus musculus
tcaaccacaactacgagatcgactt

SEQ ID NO: 761719 - DNA, 25 bp, Mus musculus
tcaaccacaactactctcagcagtg

SEQ ID NO: 761720 - DNA, 25 bp, Mus musculus
tcaaccacaacttcgagatcgactt

SEQ ID NO: 761721 - DNA, 25 bp, Mus musculus
tcaaccacaacttctctcagcagtg

SEQ ID NO: 761722 - DNA, 25 bp, Mus musculus
tcaaccacacagagctgtgtgcaga

SEQ ID NO: 761723 - DNA, 25 bp, Mus musculus
tcaaccacacagtgctgtgtgcaga

SEQ ID NO: 761724 - DNA, 25 bp, Mus musculus
tcaaccacagagagaagtgtcaggc

SEQ ID NO: 761725 - DNA, 25 bp, Mus musculus
tcaaccacagagtgaagtgtcaggc

SEQ ID NO: 761726 - DNA, 25 bp, Mus musculus
tcaaccactccacttatactcagaa

SEQ ID NO: 761727 - DNA, 25 bp, Mus musculus
tcaaccactccagttatactcagaa

SEQ ID NO: 761728 - DNA, 25 bp, Mus musculus
tcaaccactgtgagggtaagccgcc

SEQ ID NO: 761729 - DNA, 25 bp, Mus musculus
tcaaccactgtgtgggtaagccgcc

SEQ ID NO: 761730 - DNA, 25 bp, Mus musculus
tcaaccagaagcaagagcgcctggg

SEQ ID NO: 761731 - DNA, 25 bp, Mus musculus
tcaaccagaagctagagcgcctggg

SEQ ID NO: 761732 - DNA, 25 bp, Mus musculus
tcaaccagatctacgaggagggcga

SEQ ID NO: 761733 - DNA, 25 bp, Mus musculus
tcaaccagatcttcgaggagggcga

SEQ ID NO: 761734 - DNA, 25 bp, Mus musculus
tcaaccagatgtcgactgcctagaa

SEQ ID NO: 761735 - DNA, 25 bp, Mus musculus
tcaaccagatgtggactgcctagaa

SEQ ID NO: 761736 - DNA, 25 bp, Mus musculus
tcaaccaggaagagggatccattgc

SEQ ID NO: 761737 - DNA, 25 bp, Mus musculus
tcaaccaggaagtgggatccattgc

SEQ ID NO: 761738 - DNA, 25 bp, Mus musculus
tcaaccaggacacctttgccgactt

SEQ ID NO: 761739 - DNA, 25 bp, Mus musculus
tcaaccaggacagctttgccgactt

SEQ ID NO: 761740 - DNA, 25 bp, Mus musculus
tcaaccaggaggagacgtttgacga

SEQ ID NO: 761741 - DNA, 25 bp, Mus musculus
tcaaccaggaggtgacgtttgacga

SEQ ID NO: 761742 - DNA, 25 bp, Mus musculus
tcaaccagggtccttatggccaagt

SEQ ID NO: 761743 - DNA, 25 bp, Mus musculus
tcaaccagggtcgttatggccaagt

SEQ ID NO: 761744 - DNA, 25 bp, Mus musculus
tcaaccagggttacctacaggccaa

SEQ ID NO: 761745 - DNA, 25 bp, Mus musculus
tcaaccagggtttcctacaggccaa

SEQ ID NO: 761746 - DNA, 25 bp, Mus musculus
tcaaccagtacacggaagaccagat

SEQ ID NO: 761747 - DNA, 25 bp, Mus musculus
tcaaccagtacagggaagaccagat

SEQ ID NO: 761748 - DNA, 25 bp, Mus musculus
tcaaccatccttagaacttgaccaa

SEQ ID NO: 761749 - DNA, 25 bp, Mus musculus
tcaaccatcctttgaacttgaccaa

SEQ ID NO: 761750 - DNA, 25 bp, Mus musculus
tcaaccatggttcctcagtcacaag

SEQ ID NO: 761751 - DNA, 25 bp, Mus musculus
tcaaccatggttgctcagtcacaag

SEQ ID NO: 761752 - DNA, 25 bp, Mus musculus
tcaaccatgtttatcacttgtggcc

SEQ ID NO: 761753 - DNA, 25 bp, Mus musculus
tcaaccatgtttttcacttgtggcc

SEQ ID NO: 761754 - DNA, 25 bp, Mus musculus
tcaacccaaattatgaggtagcaga

SEQ ID NO: 761755 - DNA, 25 bp, Mus musculus
tcaacccaaattttgaggtagcaga

SEQ ID NO: 761756 - DNA, 25 bp, Mus musculus
tcaacccaaggtacagaagaacaga

SEQ ID NO: 761757 - DNA, 25 bp, Mus musculus
tcaacccaaggttcagaagaacaga

SEQ ID NO: 761758 - DNA, 25 bp, Mus musculus
tcaacccacaatcaaatggagactc

SEQ ID NO: 761759 - DNA, 25 bp, Mus musculus
tcaacccacaatgaaatggagactc

SEQ ID NO: 761760 - DNA, 25 bp, Mus musculus
tcaacccagaggagcgcagttgcag

SEQ ID NO: 761761 - DNA, 25 bp, Mus musculus
tcaacccagaggtgcgcagttgcag

SEQ ID NO: 761762 - DNA, 25 bp, Mus musculus
tcaacccagggcaatccgaatgagg

SEQ ID NO: 761763 - DNA, 25 bp, Mus musculus
tcaacccagggctatccgaatgagg

SEQ ID NO: 761764 - DNA, 25 bp, Mus musculus
tcaacccaggtgagagctaagccag

SEQ ID NO: 761765 - DNA, 25 bp, Mus musculus
tcaacccaggtgtgagctaagccag

SEQ ID NO: 761766 - DNA, 25 bp, Mus musculus
tcaacccagtcaaggcccagggtct

SEQ ID NO: 761767 - DNA, 25 bp, Mus musculus
tcaacccagtcatggcccagggtct

SEQ ID NO: 761768 - DNA, 25 bp, Mus musculus
tcaacccatactacatccaggaggc

SEQ ID NO: 761769 - DNA, 25 bp, Mus musculus
tcaacccatacttcatccaggaggc

SEQ ID NO: 761770 - DNA, 25 bp, Mus musculus
tcaaccccagtgaatcctccgttag

SEQ ID NO: 761771 - DNA, 25 bp, Mus musculus
tcaaccccagtgtatcctccgttag

SEQ ID NO: 761772 - DNA, 25 bp, Mus musculus
tcaaccccgagaaggtgctacctaa

SEQ ID NO: 761773 - DNA, 25 bp, Mus musculus
tcaaccccgagatggtgctacctaa

SEQ ID NO: 761774 - DNA, 25 bp, Mus musculus
tcaaccccggtgaggtggccaggat

SEQ ID NO: 761775 - DNA, 25 bp, Mus musculus
tcaaccccggtgtggtggccaggat

SEQ ID NO: 761776 - DNA, 25 bp, Mus musculus
tcaaccccttgaagatcttaaaaag

SEQ ID NO: 761777 - DNA, 25 bp, Mus musculus
tcaaccccttgatgatcttaaaaag

SEQ ID NO: 761778 - DNA, 25 bp, Mus musculus
tcaaccctaaagaagtgctggtgcg

SEQ ID NO: 761779 - DNA, 25 bp, Mus musculus
tcaaccctaaagtagtgctggtgcg

SEQ ID NO: 761780 - DNA, 25 bp, Mus musculus
tcaaccctcaaaagcgttttgagtg

SEQ ID NO: 761781 - DNA, 25 bp, Mus musculus
tcaaccctcaaatgcgttttgagtg

SEQ ID NO: 761782 - DNA, 25 bp, Mus musculus
tcaacccttctacagttctccagag

SEQ ID NO: 761783 - DNA, 25 bp, Mus musculus
tcaacccttctagagttctccagag

SEQ ID NO: 761784 - DNA, 25 bp, Mus musculus
tcaaccgacgcacggctgctgagaa

SEQ ID NO: 761785 - DNA, 25 bp, Mus musculus
tcaaccgacgcagggctgctgagaa

SEQ ID NO: 761786 - DNA, 25 bp, Mus musculus
tcaaccgcacacaggcggaggagat

SEQ ID NO: 761787 - DNA, 25 bp, Mus musculus
tcaaccgcacactggcggaggagat

SEQ ID NO: 761788 - DNA, 25 bp, Mus musculus
tcaaccgcctccaggagctcataga

SEQ ID NO: 761789 - DNA, 25 bp, Mus musculus
tcaaccgcctcctggagctcataga

SEQ ID NO: 761790 - DNA, 25 bp, Mus musculus
tcaaccgcctgcagaagggacagaa

SEQ ID NO: 761791 - DNA, 25 bp, Mus musculus
tcaaccgcctgctgaagggacagaa

SEQ ID NO: 761792 - DNA, 25 bp, Mus musculus
tcaaccgctgcaatgcagatgttgt

SEQ ID NO: 761793 - DNA, 25 bp, Mus musculus
tcaaccgctgcattgcagatgttgt

SEQ ID NO: 761794 - DNA, 25 bp, Mus musculus
tcaaccggaaacacatggaatatcc

SEQ ID NO: 761795 - DNA, 25 bp, Mus musculus
tcaaccggaaactcatggaatatcc

SEQ ID NO: 761796 - DNA, 25 bp, Mus musculus
tcaaccggaactactgggagaagaa

SEQ ID NO: 761797 - DNA, 25 bp, Mus musculus
tcaaccggaacttctgggagaagaa

SEQ ID NO: 761798 - DNA, 25 bp, Mus musculus
tcaaccgtggttctcgtgttttggg

SEQ ID NO: 761799 - DNA, 25 bp, Mus musculus
tcaaccgtggttgtcgtgttttggg

SEQ ID NO: 761800 - DNA, 25 bp, Mus musculus
tcaacctaacgtcgaactgtccatc

SEQ ID NO: 761801 - DNA, 25 bp, Mus musculus
tcaacctaacgtggaactgtccatc

SEQ ID NO: 761802 - DNA, 25 bp, Mus musculus
tcaacctatgttctatgaagaactg

SEQ ID NO: 761803 - DNA, 25 bp, Mus musculus
tcaacctatgttgtatgaagaactg

SEQ ID NO: 761804 - DNA, 25 bp, Mus musculus
tcaacctcaagaagtggagtttctc

SEQ ID NO: 761805 - DNA, 25 bp, Mus musculus
tcaacctcaagatgtggagtttctc

SEQ ID NO: 761806 - DNA, 25 bp, Mus musculus
tcaacctccggaatctgccgtggtt

SEQ ID NO: 761807 - DNA, 25 bp, Mus musculus
tcaacctccggattctgccgtggtt

SEQ ID NO: 761808 - DNA, 25 bp, Mus musculus
tcaacctctactatccccgggatgg

SEQ ID NO: 761809 - DNA, 25 bp, Mus musculus
tcaacctctactttccccgggatgg

SEQ ID NO: 761810 - DNA, 25 bp, Mus musculus
tcaacctctccactgcgcaggtgga

SEQ ID NO: 761811 - DNA, 25 bp, Mus musculus
tcaacctctccagtgcgcaggtgga

SEQ ID NO: 761812 - DNA, 25 bp, Mus musculus
tcaacctctgacctgatgcattttg

SEQ ID NO: 761813 - DNA, 25 bp, Mus musculus
tcaacctctgacgtgatgcattttg

SEQ ID NO: 761814 - DNA, 25 bp, Mus musculus
tcaacctgaattctcctaacaaagg

SEQ ID NO: 761815 - DNA, 25 bp, Mus musculus
tcaacctgaattgtcctaacaaagg

SEQ ID NO: 761816 - DNA, 25 bp, Mus musculus
tcaacctgacacacattgaatccag

SEQ ID NO: 761817 - DNA, 25 bp, Mus musculus
tcaacctgacactcattgaatccag

SEQ ID NO: 761818 - DNA, 25 bp, Mus musculus
tcaacctgcctgaagctggctgtgg

SEQ ID NO: 761819 - DNA, 25 bp, Mus musculus
tcaacctgcctgtagctggctgtgg

SEQ ID NO: 761820 - DNA, 25 bp, Mus musculus
tcaacctgctgtcgctacaggagct

SEQ ID NO: 761821 - DNA, 25 bp, Mus musculus
tcaacctgctgtggctacaggagct

SEQ ID NO: 761822 - DNA, 25 bp, Mus musculus
tcaacctggatgaaaatgtgcgcac

SEQ ID NO: 761823 - DNA, 25 bp, Mus musculus
tcaacctggatgagaacaggatcct

SEQ ID NO: 761824 - DNA, 25 bp, Mus musculus
tcaacctggatgtaaatgtgcgcac

SEQ ID NO: 761825 - DNA, 25 bp, Mus musculus
tcaacctggatgtgaacaggatcct

SEQ ID NO: 761826 - DNA, 25 bp, Mus musculus
tcaacctggcgtagctatggcaaca

SEQ ID NO: 761827 - DNA, 25 bp, Mus musculus
tcaacctggcgttgctatggcaaca

SEQ ID NO: 761828 - DNA, 25 bp, Mus musculus
tcaacctggcttacttgtacggcgc

SEQ ID NO: 761829 - DNA, 25 bp, Mus musculus
tcaacctggctttcttgtacggcgc

SEQ ID NO: 761830 - DNA, 25 bp, Mus musculus
tcaacctgtccacacgttgtcgtga

SEQ ID NO: 761831 - DNA, 25 bp, Mus musculus
tcaacctgtccagacgttgtcgtga

SEQ ID NO: 761832 - DNA, 25 bp, Mus musculus
tcaaccttagctactgcctcaatgc

SEQ ID NO: 761833 - DNA, 25 bp, Mus musculus
tcaaccttagcttctgcctcaatgc

SEQ ID NO: 761834 - DNA, 25 bp, Mus musculus
tcaaccttaggaaacggcgtgactc

SEQ ID NO: 761835 - DNA, 25 bp, Mus musculus
tcaaccttaggatacggcgtgactc

SEQ ID NO: 761836 - DNA, 25 bp, Mus musculus
tcaaccttcgtcagcgccatctagg

SEQ ID NO: 761837 - DNA, 25 bp, Mus musculus
tcaaccttcgtctgcgccatctagg

SEQ ID NO: 761838 - DNA, 25 bp, Mus musculus
tcaaccttgccaccagagagctgga

SEQ ID NO: 761839 - DNA, 25 bp, Mus musculus
tcaaccttgccagcagagagctgga

SEQ ID NO: 761840 - DNA, 25 bp, Mus musculus
tcaacgaaggccacatgaagtggga

SEQ ID NO: 761841 - DNA, 25 bp, Mus musculus
tcaacgaaggcctcatgaagtggga

SEQ ID NO: 761842 - DNA, 25 bp, Mus musculus
tcaacgaatgccaggtcaataatgg

SEQ ID NO: 761843 - DNA, 25 bp, Mus musculus
tcaacgaatgcctggtcaataatgg

SEQ ID NO: 761844 - DNA, 25 bp, Mus musculus
tcaacgaatgctccgagggtacccc

SEQ ID NO: 761845 - DNA, 25 bp, Mus musculus
tcaacgaatgctgcgagggtacccc

SEQ ID NO: 761846 - DNA, 25 bp, Mus musculus
tcaacgacggagcagacctgccgga

SEQ ID NO: 761847 - DNA, 25 bp, Mus musculus
tcaacgacggaggagacctgccgga

SEQ ID NO: 761848 - DNA, 25 bp, Mus musculus
tcaacgactatgaggccaatgaccc

SEQ ID NO: 761849 - DNA, 25 bp, Mus musculus
tcaacgactatgtggccaatgaccc

SEQ ID NO: 761850 - DNA, 25 bp, Mus musculus
tcaacgactgcgagtgcgatgggct

SEQ ID NO: 761851 - DNA, 25 bp, Mus musculus
tcaacgactgcgtgtgcgatgggct

SEQ ID NO: 761852 - DNA, 25 bp, Mus musculus
tcaacgagaagcaactgcataccct

SEQ ID NO: 761853 - DNA, 25 bp, Mus musculus
tcaacgagaagctactgcataccct

SEQ ID NO: 761854 - DNA, 25 bp, Mus musculus
tcaacgagaccaacaagatcttcga

SEQ ID NO: 761855 - DNA, 25 bp, Mus musculus
tcaacgagaccacgtgtcagtacga

SEQ ID NO: 761856 - DNA, 25 bp, Mus musculus
tcaacgagaccaggtgtcagtacga

SEQ ID NO: 761857 - DNA, 25 bp, Mus musculus
tcaacgagaccatcaagatcttcga

SEQ ID NO: 761858 - DNA, 25 bp, Mus musculus
tcaacgagagctatcaagatgttag

SEQ ID NO: 761859 - DNA, 25 bp, Mus musculus
tcaacgagagctttcaagatgttag

SEQ ID NO: 761860 - DNA, 25 bp, Mus musculus
tcaacgagcactcgcgacaggtgta

SEQ ID NO: 761861 - DNA, 25 bp, Mus musculus
tcaacgagcactggcgacaggtgta

SEQ ID NO: 761862 - DNA, 25 bp, Mus musculus
tcaacgaggcagacatcaagctgag

SEQ ID NO: 761863 - DNA, 25 bp, Mus musculus
tcaacgaggcagtcatcaagctgag

SEQ ID NO: 761864 - DNA, 25 bp, Mus musculus
tcaacgagggaccagtcttctaccc

SEQ ID NO: 761865 - DNA, 25 bp, Mus musculus
tcaacgagggacgagtcttctaccc

SEQ ID NO: 761866 - DNA, 25 bp, Mus musculus
tcaacgagtatgcatatgcagcaga

SEQ ID NO: 761867 - DNA, 25 bp, Mus musculus
tcaacgagtatggatatgcagcaga

SEQ ID NO: 761868 - DNA, 25 bp, Mus musculus
tcaacgagtgcaacagtaacccctg

SEQ ID NO: 761869 - DNA, 25 bp, Mus musculus
tcaacgagtgcatcagtaacccctg

SEQ ID NO: 761870 - DNA, 25 bp, Mus musculus
tcaacgatggcgcagagtcggccat

SEQ ID NO: 761871 - DNA, 25 bp, Mus musculus
tcaacgatggcggagagtcggccat

SEQ ID NO: 761872 - DNA, 25 bp, Mus musculus
tcaacgcaaagacaggcaaactgga

SEQ ID NO: 761873 - DNA, 25 bp, Mus musculus
tcaacgcaaagagaggcaaactgga

SEQ ID NO: 761874 - DNA, 25 bp, Mus musculus
tcaacgccaactatgacgttcagag

SEQ ID NO: 761875 - DNA, 25 bp, Mus musculus
tcaacgccaactttgacgttcagag

SEQ ID NO: 761876 - DNA, 25 bp, Mus musculus
tcaacgccatgtacagctcagaaga

SEQ ID NO: 761877 - DNA, 25 bp, Mus musculus
tcaacgccatgttcagctcagaaga

SEQ ID NO: 761878 - DNA, 25 bp, Mus musculus
tcaacgcccaccagtggtcagagac

SEQ ID NO: 761879 - DNA, 25 bp, Mus musculus
tcaacgcccacctgtggtcagagac

SEQ ID NO: 761880 - DNA, 25 bp, Mus musculus
tcaacgccctcaagggcgagcacat

SEQ ID NO: 761881 - DNA, 25 bp, Mus musculus
tcaacgccctcatgggcgagcacat

SEQ ID NO: 761882 - DNA, 25 bp, Mus musculus
tcaacgccgcgcaggacctgctggg

SEQ ID NO: 761883 - DNA, 25 bp, Mus musculus
tcaacgccgcgctggacctgctggg

SEQ ID NO: 761884 - DNA, 25 bp, Mus musculus
tcaacgcgtaatcaattccggaggt

SEQ ID NO: 761885 - DNA, 25 bp, Mus musculus
tcaacgcgtaatgaattccggaggt

SEQ ID NO: 761886 - DNA, 25 bp, Mus musculus
tcaacgctacatagccaacctaggg

SEQ ID NO: 761887 - DNA, 25 bp, Mus musculus
tcaacgctacattgccaacctaggg

SEQ ID NO: 761888 - DNA, 25 bp, Mus musculus
tcaacgctcaataaaactacacttc

SEQ ID NO: 761889 - DNA, 25 bp, Mus musculus
tcaacgctcaattaaactacacttc

SEQ ID NO: 761890 - DNA, 25 bp, Mus musculus
tcaacgctgacacaccagggtgtgc

SEQ ID NO: 761891 - DNA, 25 bp, Mus musculus
tcaacgctgacagaccagggtgtgc

SEQ ID NO: 761892 - DNA, 25 bp, Mus musculus
tcaacgctgcctcgctggatgggca

SEQ ID NO: 761893 - DNA, 25 bp, Mus musculus
tcaacgctgcctggctggatgggca

SEQ ID NO: 761894 - DNA, 25 bp, Mus musculus
tcaacgcttcgaagacaacctggcc

SEQ ID NO: 761895 - DNA, 25 bp, Mus musculus
tcaacgcttcgatgacaacctggcc

SEQ ID NO: 761896 - DNA, 25 bp, Mus musculus
tcaacggaaaaaagcgaagctgtaa

SEQ ID NO: 761897 - DNA, 25 bp, Mus musculus
tcaacggaaaaatgcgaagctgtaa

SEQ ID NO: 761898 - DNA, 25 bp, Mus musculus
tcaacggagaccacagtgagagcga

SEQ ID NO: 761899 - DNA, 25 bp, Mus musculus
tcaacggagacctcagtgagagcga

SEQ ID NO: 761900 - DNA, 25 bp, Mus musculus
tcaacggcagaaaaatcagattagt

SEQ ID NO: 761901 - DNA, 25 bp, Mus musculus
tcaacggcagaataatcagattagt

SEQ ID NO: 761902 - DNA, 25 bp, Mus musculus
tcaacggcattgacctgaccaacct

SEQ ID NO: 761903 - DNA, 25 bp, Mus musculus
tcaacggcattgtcctgaccaacct

SEQ ID NO: 761904 - DNA, 25 bp, Mus musculus
tcaacggcctgccaaggatcttgga

SEQ ID NO: 761905 - DNA, 25 bp, Mus musculus
tcaacggcctgcgaaggatcttgga

SEQ ID NO: 761906 - DNA, 25 bp, Mus musculus
tcaacggcgtagatctcaacaagtc

SEQ ID NO: 761907 - DNA, 25 bp, Mus musculus
tcaacggcgtagttctcaacaagtc

SEQ ID NO: 761908 - DNA, 25 bp, Mus musculus
tcaacggcgtcaacgtagagggcga

SEQ ID NO: 761909 - DNA, 25 bp, Mus musculus
tcaacggcgtcatcgtagagggcga

SEQ ID NO: 761910 - DNA, 25 bp, Mus musculus
tcaacggctgttcaatgagggccag

SEQ ID NO: 761911 - DNA, 25 bp, Mus musculus
tcaacggctgttgaatgagggccag

SEQ ID NO: 761912 - DNA, 25 bp, Mus musculus
tcaacgggacaaagacagtaagcct

SEQ ID NO: 761913 - DNA, 25 bp, Mus musculus
tcaacgggacaatgacagtaagcct

SEQ ID NO: 761914 - DNA, 25 bp, Mus musculus
tcaacggtatagaagagcgcatgtc

SEQ ID NO: 761915 - DNA, 25 bp, Mus musculus
tcaacggtatagtagagcgcatgtc

SEQ ID NO: 761916 - DNA, 25 bp, Mus musculus
tcaacggtcagcagcccaaccttga

SEQ ID NO: 761917 - DNA, 25 bp, Mus musculus
tcaacggtcagctgcccaaccttga

SEQ ID NO: 761918 - DNA, 25 bp, Mus musculus
tcaacggtgaaaactgtgcgggctg

SEQ ID NO: 761919 - DNA, 25 bp, Mus musculus
tcaacggtgaaatctgtgcgggctg

SEQ ID NO: 761920 - DNA, 25 bp, Mus musculus
tcaacggttccaagtttatttagct

SEQ ID NO: 761921 - DNA, 25 bp, Mus musculus
tcaacggttccatgtttatttagct

SEQ ID NO: 761922 - DNA, 25 bp, Mus musculus
tcaacgtatcctccttctggaccaa

SEQ ID NO: 761923 - DNA, 25 bp, Mus musculus
tcaacgtatcctgcttctggaccaa

SEQ ID NO: 761924 - DNA, 25 bp, Mus musculus
tcaacgtcacagcaggacatgggaa

SEQ ID NO: 761925 - DNA, 25 bp, Mus musculus
tcaacgtcacaggaggacatgggaa

SEQ ID NO: 761926 - DNA, 25 bp, Mus musculus
tcaacgtcatcaaggccgacttcaa

SEQ ID NO: 761927 - DNA, 25 bp, Mus musculus
tcaacgtcatcatggccgacttcaa

SEQ ID NO: 761928 - DNA, 25 bp, Mus musculus
tcaacgtcgatgcattcaagagatt

SEQ ID NO: 761929 - DNA, 25 bp, Mus musculus
tcaacgtcgatggattcaagagatt

SEQ ID NO: 761930 - DNA, 25 bp, Mus musculus
tcaacgtcggccatttcgaccagta

SEQ ID NO: 761931 - DNA, 25 bp, Mus musculus
tcaacgtcggccttttcgaccagta

SEQ ID NO: 761932 - DNA, 25 bp, Mus musculus
tcaacgtgcctgacattggcggcca

SEQ ID NO: 761933 - DNA, 25 bp, Mus musculus
tcaacgtgcctgtcattggcggcca

SEQ ID NO: 761934 - DNA, 25 bp, Mus musculus
tcaacgtggaacactcaaccaaggg

SEQ ID NO: 761935 - DNA, 25 bp, Mus musculus
tcaacgtggaactctcaaccaaggg

SEQ ID NO: 761936 - DNA, 25 bp, Mus musculus
tcaacgtggagaatgtctttcttca

SEQ ID NO: 761937 - DNA, 25 bp, Mus musculus
tcaacgtggagattgtctttcttca

SEQ ID NO: 761938 - DNA, 25 bp, Mus musculus
tcaacgtgggctacctagaggcact

SEQ ID NO: 761939 - DNA, 25 bp, Mus musculus
tcaacgtgggcttcctagaggcact

SEQ ID NO: 761940 - DNA, 25 bp, Mus musculus
tcaacgtgtcttacctgtccacggg

SEQ ID NO: 761941 - DNA, 25 bp, Mus musculus
tcaacgtgtctttcctgtccacggg

SEQ ID NO: 761942 - DNA, 25 bp, Mus musculus
tcaacgtgtggtactctgtcaatgg

SEQ ID NO: 761943 - DNA, 25 bp, Mus musculus
tcaacgtgtggttctctgtcaatgg

SEQ ID NO: 761944 - DNA, 25 bp, Mus musculus
tcaacgttgaaacaaggaccattgc

SEQ ID NO: 761945 - DNA, 25 bp, Mus musculus
tcaacgttgaaagaaggaccattgc

SEQ ID NO: 761946 - DNA, 25 bp, Mus musculus
tcaacgtttggacatgttgtctaag

SEQ ID NO: 761947 - DNA, 25 bp, Mus musculus
tcaacgtttggagatgttgtctaag

SEQ ID NO: 761948 - DNA, 25 bp, Mus musculus
tcaacgtttggtacgacccggctga

SEQ ID NO: 761949 - DNA, 25 bp, Mus musculus
tcaacgtttggttcgacccggctga

SEQ ID NO: 761950 - DNA, 25 bp, Mus musculus
tcaactaaacaaaccaatgcatcgt

SEQ ID NO: 761951 - DNA, 25 bp, Mus musculus
tcaactaaacaatccaatgcatcgt

SEQ ID NO: 761952 - DNA, 25 bp, Mus musculus
tcaactaaagttccgtcctccttaa

SEQ ID NO: 761953 - DNA, 25 bp, Mus musculus
tcaactaaagttgcgtcctccttaa

SEQ ID NO: 761954 - DNA, 25 bp, Mus musculus
tcaactacccatcgagaagcgaagt

SEQ ID NO: 761955 - DNA, 25 bp, Mus musculus
tcaactacccatggagaagcgaagt

SEQ ID NO: 761956 - DNA, 25 bp, Mus musculus
tcaactagagataaaaataccagaa

SEQ ID NO: 761957 - DNA, 25 bp, Mus musculus
tcaactagagattaaaataccagaa

SEQ ID NO: 761958 - DNA, 25 bp, Mus musculus
tcaactagttgtatctccagcccca

SEQ ID NO: 761959 - DNA, 25 bp, Mus musculus
tcaactagttgtttctccagcccca

SEQ ID NO: 761960 - DNA, 25 bp, Mus musculus
tcaactcaatgaaaccagaaaaact

SEQ ID NO: 761961 - DNA, 25 bp, Mus musculus
tcaactcaatgataccagaaaaact

SEQ ID NO: 761962 - DNA, 25 bp, Mus musculus
tcaactcaccaaagtgccccgagtg

SEQ ID NO: 761963 - DNA, 25 bp, Mus musculus
tcaactcaccaatgtgccccgagtg

SEQ ID NO: 761964 - DNA, 25 bp, Mus musculus
tcaactcagtagctgtagctgctcg

SEQ ID NO: 761965 - DNA, 25 bp, Mus musculus
tcaactcagtaggtgtagctgctcg

SEQ ID NO: 761966 - DNA, 25 bp, Mus musculus
tcaactccactaatggagagctgaa

SEQ ID NO: 761967 - DNA, 25 bp, Mus musculus
tcaactccactattggagagctgaa

SEQ ID NO: 761968 - DNA, 25 bp, Mus musculus
tcaactccccaacatcctttaggaa

SEQ ID NO: 761969 - DNA, 25 bp, Mus musculus
tcaactccccaagatcctttaggaa

SEQ ID NO: 761970 - DNA, 25 bp, Mus musculus
tcaactccctcaacggcattggcat

SEQ ID NO: 761971 - DNA, 25 bp, Mus musculus
tcaactccctcatcggcattggcat

SEQ ID NO: 761972 - DNA, 25 bp, Mus musculus
tcaactccgcagcttagctgggacc

SEQ ID NO: 761973 - DNA, 25 bp, Mus musculus
tcaactccgcaggttagctgggacc

SEQ ID NO: 761974 - DNA, 25 bp, Mus musculus
tcaactccgtggcttcaccttggga

SEQ ID NO: 761975 - DNA, 25 bp, Mus musculus
tcaactccgtgggttcaccttggga

SEQ ID NO: 761976 - DNA, 25 bp, Mus musculus
tcaactcctaaaagagctgacgggt

SEQ ID NO: 761977 - DNA, 25 bp, Mus musculus
tcaactcctaaatgagctgacgggt

SEQ ID NO: 761978 - DNA, 25 bp, Mus musculus
tcaactcctgtcagctgactcaaaa

SEQ ID NO: 761979 - DNA, 25 bp, Mus musculus
tcaactcctgtctgctgactcaaaa

SEQ ID NO: 761980 - DNA, 25 bp, Mus musculus
tcaactctatccctccagatgaggt

SEQ ID NO: 761981 - DNA, 25 bp, Mus musculus
tcaactctatccgtccagatgaggt

SEQ ID NO: 761982 - DNA, 25 bp, Mus musculus
tcaactctatttcgtactacagcat

SEQ ID NO: 761983 - DNA, 25 bp, Mus musculus
tcaactctatttggtactacagcat

SEQ ID NO: 761984 - DNA, 25 bp, Mus musculus
tcaactctcttaccgggagatggag

SEQ ID NO: 761985 - DNA, 25 bp, Mus musculus
tcaactctcttagcgggagatggag

SEQ ID NO: 761986 - DNA, 25 bp, Mus musculus
tcaactctgacgaggtggagcagat

SEQ ID NO: 761987 - DNA, 25 bp, Mus musculus
tcaactctgacgtggtggagcagat

SEQ ID NO: 761988 - DNA, 25 bp, Mus musculus
tcaactctgatcagagaccacgaat

SEQ ID NO: 761989 - DNA, 25 bp, Mus musculus
tcaactctgatctgagaccacgaat

SEQ ID NO: 761990 - DNA, 25 bp, Mus musculus
tcaactctgcagcataaatacatgg

SEQ ID NO: 761991 - DNA, 25 bp, Mus musculus
tcaactctgcaggataaatacatgg

SEQ ID NO: 761992 - DNA, 25 bp, Mus musculus
tcaactctggttctgccatgaaccc

SEQ ID NO: 761993 - DNA, 25 bp, Mus musculus
tcaactctggttgtgccatgaaccc

SEQ ID NO: 761994 - DNA, 25 bp, Mus musculus
tcaactcttccacaacaggcactgg

SEQ ID NO: 761995 - DNA, 25 bp, Mus musculus
tcaactcttccagaacaggcactgg

SEQ ID NO: 761996 - DNA, 25 bp, Mus musculus
tcaactcttgaaaataggtatcttc

SEQ ID NO: 761997 - DNA, 25 bp, Mus musculus
tcaactcttgaatataggtatcttc

SEQ ID NO: 761998 - DNA, 25 bp, Mus musculus
tcaactgaaggaataagtcagccct

SEQ ID NO: 761999 - DNA, 25 bp, Mus musculus
tcaactgaaggattaagtcagccct

SEQ ID NO: 762000 - DNA, 25 bp, Mus musculus
tcaactgcagcaaaaaacactaagg

SEQ ID NO: 762001 - DNA, 25 bp, Mus musculus
tcaactgcagcataaaacactaagg

SEQ ID NO: 762002 - DNA, 25 bp, Mus musculus
tcaactgccggcacaatacagctgg

SEQ ID NO: 762003 - DNA, 25 bp, Mus musculus
tcaactgccggctcaatacagctgg

SEQ ID NO: 762004 - DNA, 25 bp, Mus musculus
tcaactgcctagctgaaggccacgc

SEQ ID NO: 762005 - DNA, 25 bp, Mus musculus
tcaactgcctaggtgaaggccacgc

SEQ ID NO: 762006 - DNA, 25 bp, Mus musculus
tcaactgcctgcagggcctattcct

SEQ ID NO: 762007 - DNA, 25 bp, Mus musculus
tcaactgcctgctgggcctattcct

SEQ ID NO: 762008 - DNA, 25 bp, Mus musculus
tcaactgctccaaaacgggttacag

SEQ ID NO: 762009 - DNA, 25 bp, Mus musculus
tcaactgctccataacgggttacag

SEQ ID NO: 762010 - DNA, 25 bp, Mus musculus
tcaactgctgctactcagccttgct

SEQ ID NO: 762011 - DNA, 25 bp, Mus musculus
tcaactgctgcttctcagccttgct

SEQ ID NO: 762012 - DNA, 25 bp, Mus musculus
tcaactggtcttcgtggccgctgga

SEQ ID NO: 762013 - DNA, 25 bp, Mus musculus
tcaactggtcttggtggccgctgga

SEQ ID NO: 762014 - DNA, 25 bp, Mus musculus
tcaactgtcccgatggtgaatacca

SEQ ID NO: 762015 - DNA, 25 bp, Mus musculus
tcaactgtcccgttggtgaatacca

SEQ ID NO: 762016 - DNA, 25 bp, Mus musculus
tcaactgtcgcaagctggtgaagcc

SEQ ID NO: 762017 - DNA, 25 bp, Mus musculus
tcaactgtcgcatgctggtgaagcc

SEQ ID NO: 762018 - DNA, 25 bp, Mus musculus
tcaactgtcgctacattgagcagcg

SEQ ID NO: 762019 - DNA, 25 bp, Mus musculus
tcaactgtcgcttcattgagcagcg

SEQ ID NO: 762020 - DNA, 25 bp, Mus musculus
tcaactgtctcgagggaagccacga

SEQ ID NO: 762021 - DNA, 25 bp, Mus musculus
tcaactgtctcgtgggaagccacga

SEQ ID NO: 762022 - DNA, 25 bp, Mus musculus
tcaactgttctgagggaagagagct

SEQ ID NO: 762023 - DNA, 25 bp, Mus musculus
tcaactgttctgtgggaagagagct

SEQ ID NO: 762024 - DNA, 25 bp, Mus musculus
tcaacttacctcaccgtcacaagat

SEQ ID NO: 762025 - DNA, 25 bp, Mus musculus
tcaacttacctctccgtcacaagat

SEQ ID NO: 762026 - DNA, 25 bp, Mus musculus
tcaacttactgaccacacaaatgtg

SEQ ID NO: 762027 - DNA, 25 bp, Mus musculus
tcaacttactgagcacacaaatgtg

SEQ ID NO: 762028 - DNA, 25 bp, Mus musculus
tcaacttaggctcaacaacagccaa

SEQ ID NO: 762029 - DNA, 25 bp, Mus musculus
tcaacttaggctgaacaacagccaa

SEQ ID NO: 762030 - DNA, 25 bp, Mus musculus
tcaacttcaaaaagtttctcggaga

SEQ ID NO: 762031 - DNA, 25 bp, Mus musculus
tcaacttcaaaatgtttctcggaga

SEQ ID NO: 762032 - DNA, 25 bp, Mus musculus
tcaacttcacaactggacagattgg

SEQ ID NO: 762033 - DNA, 25 bp, Mus musculus
tcaacttcacaagtggacagattgg

SEQ ID NO: 762034 - DNA, 25 bp, Mus musculus
tcaacttcatgaatgacagtaccaa

SEQ ID NO: 762035 - DNA, 25 bp, Mus musculus
tcaacttcatgattgacagtaccaa

SEQ ID NO: 762036 - DNA, 25 bp, Mus musculus
tcaacttcccttcataatgaaccag

SEQ ID NO: 762037 - DNA, 25 bp, Mus musculus
tcaacttcccttgataatgaaccag

SEQ ID NO: 762038 - DNA, 25 bp, Mus musculus
tcaacttctagaaggtgtccaccaa

SEQ ID NO: 762039 - DNA, 25 bp, Mus musculus
tcaacttctagatggtgtccaccaa

SEQ ID NO: 762040 - DNA, 25 bp, Mus musculus
tcaacttgaagaagaaggcaacttc

SEQ ID NO: 762041 - DNA, 25 bp, Mus musculus
tcaacttgaagatgaaggcaacttc

SEQ ID NO: 762042 - DNA, 25 bp, Mus musculus
tcaacttgcaaccagagaataggag

SEQ ID NO: 762043 - DNA, 25 bp, Mus musculus
tcaacttgcaacgagagaataggag

SEQ ID NO: 762044 - DNA, 25 bp, Mus musculus
tcaacttggcggcaaggaacctcgg

SEQ ID NO: 762045 - DNA, 25 bp, Mus musculus
tcaacttggcgggaaggaacctcgg

SEQ ID NO: 762046 - DNA, 25 bp, Mus musculus
tcaacttgggctactcgggcaagtt

SEQ ID NO: 762047 - DNA, 25 bp, Mus musculus
tcaacttgggcttctcgggcaagtt

SEQ ID NO: 762048 - DNA, 25 bp, Mus musculus
tcaacttgggttatggattcggagt

SEQ ID NO: 762049 - DNA, 25 bp, Mus musculus
tcaacttgggttttggattcggagt

SEQ ID NO: 762050 - DNA, 25 bp, Mus musculus
tcaacttggtatcttgaaggagagc

SEQ ID NO: 762051 - DNA, 25 bp, Mus musculus
tcaacttggtatgttgaaggagagc

SEQ ID NO: 762052 - DNA, 25 bp, Mus musculus
tcaactttaactctgggatgctgct

SEQ ID NO: 762053 - DNA, 25 bp, Mus musculus
tcaactttaactgtgggatgctgct

SEQ ID NO: 762054 - DNA, 25 bp, Mus musculus
tcaactttacagaggacgagcacag

SEQ ID NO: 762055 - DNA, 25 bp, Mus musculus
tcaactttacagtggacgagcacag

SEQ ID NO: 762056 - DNA, 25 bp, Mus musculus
tcaactttgatgaagagaagcggcg

SEQ ID NO: 762057 - DNA, 25 bp, Mus musculus
tcaactttgatgtagagaagcggcg

SEQ ID NO: 762058 - DNA, 25 bp, Mus musculus
tcaactttgtccagaatgactgcag

SEQ ID NO: 762059 - DNA, 25 bp, Mus musculus
tcaactttgtcctgaatgactgcag

SEQ ID NO: 762060 - DNA, 25 bp, Mus musculus
tcaacttttctgaagctctcctaaa

SEQ ID NO: 762061 - DNA, 25 bp, Mus musculus
tcaacttttctgtagctctcctaaa

SEQ ID NO: 762062 - DNA, 25 bp, Mus musculus
tcaacttttttaaccagtgttcagg

SEQ ID NO: 762063 - DNA, 25 bp, Mus musculus
tcaacttttttatccagtgttcagg

SEQ ID NO: 762064 - DNA, 25 bp, Mus musculus
tcaagaaaaaggagaggaagttgga

SEQ ID NO: 762065 - DNA, 25 bp, Mus musculus
tcaagaaaaaggtgaggaagttgga

SEQ ID NO: 762066 - DNA, 25 bp, Mus musculus
tcaagaaaaagtaaccacagccaag

SEQ ID NO: 762067 - DNA, 25 bp, Mus musculus
tcaagaaaaagttaccacagccaag

SEQ ID NO: 762068 - DNA, 25 bp, Mus musculus
tcaagaaaacaactctccatgtggc

SEQ ID NO: 762069 - DNA, 25 bp, Mus musculus
tcaagaaaacaagtctccatgtggc

SEQ ID NO: 762070 - DNA, 25 bp, Mus musculus
tcaagaaaaccaatgtcttcaatgc

SEQ ID NO: 762071 - DNA, 25 bp, Mus musculus
tcaagaaaaccattgtcttcaatgc

SEQ ID NO: 762072 - DNA, 25 bp, Mus musculus
tcaagaaaagggagccaggacctca

SEQ ID NO: 762073 - DNA, 25 bp, Mus musculus
tcaagaaaagggtgccaggacctca

SEQ ID NO: 762074 - DNA, 25 bp, Mus musculus
tcaagaaaatcaaagtcgtcttcac

SEQ ID NO: 762075 - DNA, 25 bp, Mus musculus
tcaagaaaatcatagtcgtcttcac

SEQ ID NO: 762076 - DNA, 25 bp, Mus musculus
tcaagaaaatgtaccagttgggact

SEQ ID NO: 762077 - DNA, 25 bp, Mus musculus
tcaagaaaatgttccagttgggact

SEQ ID NO: 762078 - DNA, 25 bp, Mus musculus
tcaagaaacagaaataacgacaaag

SEQ ID NO: 762079 - DNA, 25 bp, Mus musculus
tcaagaaacagatataacgacaaag

SEQ ID NO: 762080 - DNA, 25 bp, Mus musculus
tcaagaaactaaacacagccaagca

SEQ ID NO: 762081 - DNA, 25 bp, Mus musculus
tcaagaaactaatcacagccaagca

SEQ ID NO: 762082 - DNA, 25 bp, Mus musculus
tcaagaaactgaatggagctccaca

SEQ ID NO: 762083 - DNA, 25 bp, Mus musculus
tcaagaaactgattggagctccaca

SEQ ID NO: 762084 - DNA, 25 bp, Mus musculus
tcaagaaagaggagatgaactaccg

SEQ ID NO: 762085 - DNA, 25 bp, Mus musculus
tcaagaaagaggtgatgaactaccg

SEQ ID NO: 762086 - DNA, 25 bp, Mus musculus
tcaagaaagcagcatggaccatagt

SEQ ID NO: 762087 - DNA, 25 bp, Mus musculus
tcaagaaagcaggatggaccatagt

SEQ ID NO: 762088 - DNA, 25 bp, Mus musculus
tcaagaaaggcgaggactttgtcaa

SEQ ID NO: 762089 - DNA, 25 bp, Mus musculus
tcaagaaaggcgtggactttgtcaa

SEQ ID NO: 762090 - DNA, 25 bp, Mus musculus
tcaagaaatgaacgctccaggaagc

SEQ ID NO: 762091 - DNA, 25 bp, Mus musculus
tcaagaaatgaaggctccaggaagc

SEQ ID NO: 762092 - DNA, 25 bp, Mus musculus
tcaagaaattgaagagtgcgaatgc

SEQ ID NO: 762093 - DNA, 25 bp, Mus musculus
tcaagaaattgatgagtgcgaatgc

SEQ ID NO: 762094 - DNA, 25 bp, Mus musculus
tcaagaacaagccacgcattaatga

SEQ ID NO: 762095 - DNA, 25 bp, Mus musculus
tcaagaacaagcgacgcattaatga

SEQ ID NO: 762096 - DNA, 25 bp, Mus musculus
tcaagaacactgagcacgtcctggc

SEQ ID NO: 762097 - DNA, 25 bp, Mus musculus
tcaagaacactgtgcacgtcctggc

SEQ ID NO: 762098 - DNA, 25 bp, Mus musculus
tcaagaacaggtaagagactctaaa

SEQ ID NO: 762099 - DNA, 25 bp, Mus musculus
tcaagaacaggttagagactctaaa

SEQ ID NO: 762100 - DNA, 25 bp, Mus musculus
tcaagaacattcaacagtgggaggt

SEQ ID NO: 762101 - DNA, 25 bp, Mus musculus
tcaagaacattctacagtgggaggt

SEQ ID NO: 762102 - DNA, 25 bp, Mus musculus
tcaagaacatttagaacagcatccg

SEQ ID NO: 762103 - DNA, 25 bp, Mus musculus
tcaagaacattttgaacagcatccg

SEQ ID NO: 762104 - DNA, 25 bp, Mus musculus
tcaagaaccattagtagcagtggtg

SEQ ID NO: 762105 - DNA, 25 bp, Mus musculus
tcaagaaccatttgtagcagtggtg

SEQ ID NO: 762106 - DNA, 25 bp, Mus musculus
tcaagaaccctgataccgtcctctg

SEQ ID NO: 762107 - DNA, 25 bp, Mus musculus
tcaagaaccctgttaccgtcctctg

SEQ ID NO: 762108 - DNA, 25 bp, Mus musculus
tcaagaacctttaactgcttccatg

SEQ ID NO: 762109 - DNA, 25 bp, Mus musculus
tcaagaaccttttactgcttccatg

SEQ ID NO: 762110 - DNA, 25 bp, Mus musculus
tcaagaacgccactggtgcacaggt

SEQ ID NO: 762111 - DNA, 25 bp, Mus musculus
tcaagaacgccagtggtgcacaggt

SEQ ID NO: 762112 - DNA, 25 bp, Mus musculus
tcaagaactattatccacagaccag

SEQ ID NO: 762113 - DNA, 25 bp, Mus musculus
tcaagaactattttccacagaccag

SEQ ID NO: 762114 - DNA, 25 bp, Mus musculus
tcaagaactggacgagtggtacaca

SEQ ID NO: 762115 - DNA, 25 bp, Mus musculus
tcaagaactggaggagtggtacaca

SEQ ID NO: 762116 - DNA, 25 bp, Mus musculus
tcaagaagagccagggacgggcctg

SEQ ID NO: 762117 - DNA, 25 bp, Mus musculus
tcaagaagagcctgggacgggcctg

SEQ ID NO: 762118 - DNA, 25 bp, Mus musculus
tcaagaagagtaaagtgccatgcgg

SEQ ID NO: 762119 - DNA, 25 bp, Mus musculus
tcaagaagagtacctgcgagtcctt

SEQ ID NO: 762120 - DNA, 25 bp, Mus musculus
tcaagaagagtagctgcgagtcctt

SEQ ID NO: 762121 - DNA, 25 bp, Mus musculus
tcaagaagagtatagtgccatgcgg

SEQ ID NO: 762122 - DNA, 25 bp, Mus musculus
tcaagaagatcaatatgggacagaa

SEQ ID NO: 762123 - DNA, 25 bp, Mus musculus
tcaagaagatcattatgggacagaa

SEQ ID NO: 762124 - DNA, 25 bp, Mus musculus
tcaagaagattacggtggtgccgtc

SEQ ID NO: 762125 - DNA, 25 bp, Mus musculus
tcaagaagattagggtggtgccgtc

SEQ ID NO: 762126 - DNA, 25 bp, Mus musculus
tcaagaagcacgctgtgtacaaccc

SEQ ID NO: 762127 - DNA, 25 bp, Mus musculus
tcaagaagcacggtgtgtacaaccc

SEQ ID NO: 762128 - DNA, 25 bp, Mus musculus
tcaagaagcagaagcggcttatccc

SEQ ID NO: 762129 - DNA, 25 bp, Mus musculus
tcaagaagcagatgcggcttatccc

SEQ ID NO: 762130 - DNA, 25 bp, Mus musculus
tcaagaagctacatacccaaataca

SEQ ID NO: 762131 - DNA, 25 bp, Mus musculus
tcaagaagctacttacccaaataca

SEQ ID NO: 762132 - DNA, 25 bp, Mus musculus
tcaagaagctatcggagccttccag

SEQ ID NO: 762133 - DNA, 25 bp, Mus musculus
tcaagaagctatgggagccttccag

SEQ ID NO: 762134 - DNA, 25 bp, Mus musculus
tcaagaaggataagcgacacatggc

SEQ ID NO: 762135 - DNA, 25 bp, Mus musculus
tcaagaaggatatgcgacacatggc

SEQ ID NO: 762136 - DNA, 25 bp, Mus musculus
tcaagaagtacaaggagaacaggtc

SEQ ID NO: 762137 - DNA, 25 bp, Mus musculus
tcaagaagtacatggagaacaggtc

SEQ ID NO: 762138 - DNA, 25 bp, Mus musculus
tcaagaagtccaattgcagacttcc

SEQ ID NO: 762139 - DNA, 25 bp, Mus musculus
tcaagaagtccatttgcagacttcc

SEQ ID NO: 762140 - DNA, 25 bp, Mus musculus
tcaagaagttctaaaatacctgcgc

SEQ ID NO: 762141 - DNA, 25 bp, Mus musculus
tcaagaagttcttaaatacctgcgc

SEQ ID NO: 762142 - DNA, 25 bp, Mus musculus
tcaagaatgaagagggcagacgtct

SEQ ID NO: 762143 - DNA, 25 bp, Mus musculus
tcaagaatgaagtgggcagacgtct

SEQ ID NO: 762144 - DNA, 25 bp, Mus musculus
tcaagaatgacgcaactgcccaggc

SEQ ID NO: 762145 - DNA, 25 bp, Mus musculus
tcaagaatgacggaactgcccaggc

SEQ ID NO: 762146 - DNA, 25 bp, Mus musculus
tcaagaatgccgaccctgaggaact

SEQ ID NO: 762147 - DNA, 25 bp, Mus musculus
tcaagaatgccgtccctgaggaact

SEQ ID NO: 762148 - DNA, 25 bp, Mus musculus
tcaagaatggagacgtgacctgcgt

SEQ ID NO: 762149 - DNA, 25 bp, Mus musculus
tcaagaatggagtcgtgacctgcgt

SEQ ID NO: 762150 - DNA, 25 bp, Mus musculus
tcaagacacaaacaaaaccatccag

SEQ ID NO: 762151 - DNA, 25 bp, Mus musculus
tcaagacacaaagaaaaccatccag

SEQ ID NO: 762152 - DNA, 25 bp, Mus musculus
tcaagacactgtagggagcacagcc

SEQ ID NO: 762153 - DNA, 25 bp, Mus musculus
tcaagacactgttgggagcacagcc

SEQ ID NO: 762154 - DNA, 25 bp, Mus musculus
tcaagacagttcctagacatgtggg

SEQ ID NO: 762155 - DNA, 25 bp, Mus musculus
tcaagacagttcgtagacatgtggg

SEQ ID NO: 762156 - DNA, 25 bp, Mus musculus
tcaagacatggactgtgtgccctgc

SEQ ID NO: 762157 - DNA, 25 bp, Mus musculus
tcaagacatggagtgtgtgccctgc

SEQ ID NO: 762158 - DNA, 25 bp, Mus musculus
tcaagacatgtgagtagcttcttcc

SEQ ID NO: 762159 - DNA, 25 bp, Mus musculus
tcaagacatgtgtgtagcttcttcc

SEQ ID NO: 762160 - DNA, 25 bp, Mus musculus
tcaagaccaactcagctgtccggac

SEQ ID NO: 762161 - DNA, 25 bp, Mus musculus
tcaagaccaactgagctgtccggac

SEQ ID NO: 762162 - DNA, 25 bp, Mus musculus
tcaagaccaatgcaagagtgaatgg

SEQ ID NO: 762163 - DNA, 25 bp, Mus musculus
tcaagaccaatggaagagtgaatgg

SEQ ID NO: 762164 - DNA, 25 bp, Mus musculus
tcaagaccaccgacctgcagtgggt

SEQ ID NO: 762165 - DNA, 25 bp, Mus musculus
tcaagaccaccgtcctgcagtgggt

SEQ ID NO: 762166 - DNA, 25 bp, Mus musculus
tcaagaccagcaacttccgatgagc

SEQ ID NO: 762167 - DNA, 25 bp, Mus musculus
tcaagaccagcatcttccgatgagc

SEQ ID NO: 762168 - DNA, 25 bp, Mus musculus
tcaagaccagcgatgacatagagag

SEQ ID NO: 762169 - DNA, 25 bp, Mus musculus
tcaagaccagcgttgacatagagag

SEQ ID NO: 762170 - DNA, 25 bp, Mus musculus
tcaagaccagctacctccgccaagt

SEQ ID NO: 762171 - DNA, 25 bp, Mus musculus
tcaagaccagcttcctccgccaagt

SEQ ID NO: 762172 - DNA, 25 bp, Mus musculus
tcaagacccagaatcaagcaataaa

SEQ ID NO: 762173 - DNA, 25 bp, Mus musculus
tcaagacccagattcaagcaataaa

SEQ ID NO: 762174 - DNA, 25 bp, Mus musculus
tcaagaccgcctatggcatgaagga

SEQ ID NO: 762175 - DNA, 25 bp, Mus musculus
tcaagaccgcctttggcatgaagga

SEQ ID NO: 762176 - DNA, 25 bp, Mus musculus
tcaagaccggtgagctgaagtcact

SEQ ID NO: 762177 - DNA, 25 bp, Mus musculus
tcaagaccggtgtgctgaagtcact

SEQ ID NO: 762178 - DNA, 25 bp, Mus musculus
tcaagaccttgactccgctataatg

SEQ ID NO: 762179 - DNA, 25 bp, Mus musculus
tcaagaccttgagtccgctataatg

SEQ ID NO: 762180 - DNA, 25 bp, Mus musculus
tcaagacgcctcaggagttcaatcc

SEQ ID NO: 762181 - DNA, 25 bp, Mus musculus
tcaagacgcctctggagttcaatcc

SEQ ID NO: 762182 - DNA, 25 bp, Mus musculus
tcaagacggaagagcaaacagtact

SEQ ID NO: 762183 - DNA, 25 bp, Mus musculus
tcaagacggaagtgcaaacagtact

SEQ ID NO: 762184 - DNA, 25 bp, Mus musculus
tcaagacggcagagtaatggaccaa

SEQ ID NO: 762185 - DNA, 25 bp, Mus musculus
tcaagacggcagtgtaatggaccaa

SEQ ID NO: 762186 - DNA, 25 bp, Mus musculus
tcaagacggtagagagagcctttct

SEQ ID NO: 762187 - DNA, 25 bp, Mus musculus
tcaagacggtagtgagagcctttct

SEQ ID NO: 762188 - DNA, 25 bp, Mus musculus
tcaagactacaacctgcgaattaag

SEQ ID NO: 762189 - DNA, 25 bp, Mus musculus
tcaagactacaagctgcgaattaag

SEQ ID NO: 762190 - DNA, 25 bp, Mus musculus
tcaagactagaccagcgttcccagg

SEQ ID NO: 762191 - DNA, 25 bp, Mus musculus
tcaagactagacgagcgttcccagg

SEQ ID NO: 762192 - DNA, 25 bp, Mus musculus
tcaagactatttctacctcaaccag

SEQ ID NO: 762193 - DNA, 25 bp, Mus musculus
tcaagactatttgtacctcaaccag

SEQ ID NO: 762194 - DNA, 25 bp, Mus musculus
tcaagactcaccagaacaagaaggg

SEQ ID NO: 762195 - DNA, 25 bp, Mus musculus
tcaagactcaccatactgatgggac

SEQ ID NO: 762196 - DNA, 25 bp, Mus musculus
tcaagactcacctgaacaagaaggg

SEQ ID NO: 762197 - DNA, 25 bp, Mus musculus
tcaagactcaccttactgatgggac

SEQ ID NO: 762198 - DNA, 25 bp, Mus musculus
tcaagactcactcagagccaaggcc

SEQ ID NO: 762199 - DNA, 25 bp, Mus musculus
tcaagactcactgagagccaaggcc

SEQ ID NO: 762200 - DNA, 25 bp, Mus musculus
tcaagactggcaagacagcgagtgg

SEQ ID NO: 762201 - DNA, 25 bp, Mus musculus
tcaagactggcatgacagcgagtgg

SEQ ID NO: 762202 - DNA, 25 bp, Mus musculus
tcaagactgggtatgaggtcaaatc

SEQ ID NO: 762203 - DNA, 25 bp, Mus musculus
tcaagactgggtttgaggtcaaatc

SEQ ID NO: 762204 - DNA, 25 bp, Mus musculus
tcaagactgtgaatccctctcgggt

SEQ ID NO: 762205 - DNA, 25 bp, Mus musculus
tcaagactgtgattccctctcgggt

SEQ ID NO: 762206 - DNA, 25 bp, Mus musculus
tcaagacttctactccaaaaaggaa

SEQ ID NO: 762207 - DNA, 25 bp, Mus musculus
tcaagacttctagtccaaaaaggaa

SEQ ID NO: 762208 - DNA, 25 bp, Mus musculus
tcaagactttggaggacaaatggcc

SEQ ID NO: 762209 - DNA, 25 bp, Mus musculus
tcaagactttggtggacaaatggcc

SEQ ID NO: 762210 - DNA, 25 bp, Mus musculus
tcaagagaatctcaaggctgcatct

SEQ ID NO: 762211 - DNA, 25 bp, Mus musculus
tcaagagaatctgaaggctgcatct

SEQ ID NO: 762212 - DNA, 25 bp, Mus musculus
tcaagagacagaagcaacaacgggc

SEQ ID NO: 762213 - DNA, 25 bp, Mus musculus
tcaagagacagatgcaacaacgggc

SEQ ID NO: 762214 - DNA, 25 bp, Mus musculus
tcaagagacctaagccaaacagttc

SEQ ID NO: 762215 - DNA, 25 bp, Mus musculus
tcaagagacctatgccaaacagttc

SEQ ID NO: 762216 - DNA, 25 bp, Mus musculus
tcaagagagcgaatagcaccgacta

SEQ ID NO: 762217 - DNA, 25 bp, Mus musculus
tcaagagagcgattagcaccgacta

SEQ ID NO: 762218 - DNA, 25 bp, Mus musculus
tcaagagagtgaagcagatgctgct

SEQ ID NO: 762219 - DNA, 25 bp, Mus musculus
tcaagagagtgatgcagatgctgct

SEQ ID NO: 762220 - DNA, 25 bp, Mus musculus
tcaagagataccaccagtcaggcca

SEQ ID NO: 762221 - DNA, 25 bp, Mus musculus
tcaagagatacctccagtcaggcca

SEQ ID NO: 762222 - DNA, 25 bp, Mus musculus
tcaagagatctgcttaccccagtct

SEQ ID NO: 762223 - DNA, 25 bp, Mus musculus
tcaagagatctggttaccccagtct

SEQ ID NO: 762224 - DNA, 25 bp, Mus musculus
tcaagagatgatcaccatgaaacta

SEQ ID NO: 762225 - DNA, 25 bp, Mus musculus
tcaagagatgatgaccatgaaacta

SEQ ID NO: 762226 - DNA, 25 bp, Mus musculus
tcaagagcaaatcaccaagagccat

SEQ ID NO: 762227 - DNA, 25 bp, Mus musculus
tcaagagcaaatgaccaagagccat

SEQ ID NO: 762228 - DNA, 25 bp, Mus musculus
tcaagagcagtgaccagtgaaggga

SEQ ID NO: 762229 - DNA, 25 bp, Mus musculus
tcaagagcagtgtccagtgaaggga

SEQ ID NO: 762230 - DNA, 25 bp, Mus musculus
tcaagagccctacagaacctgccat

SEQ ID NO: 762231 - DNA, 25 bp, Mus musculus
tcaagagccctagagaacctgccat

SEQ ID NO: 762232 - DNA, 25 bp, Mus musculus
tcaagagcctcaaaggactgccatg

SEQ ID NO: 762233 - DNA, 25 bp, Mus musculus
tcaagagcctcataggactgccatg

SEQ ID NO: 762234 - DNA, 25 bp, Mus musculus
tcaagagctgggattgtaagccctc

SEQ ID NO: 762235 - DNA, 25 bp, Mus musculus
tcaagagctgggtttgtaagccctc

SEQ ID NO: 762236 - DNA, 25 bp, Mus musculus
tcaagagcttctctcggaggacgcc

SEQ ID NO: 762237 - DNA, 25 bp, Mus musculus
tcaagagcttctgtcggaggacgcc

SEQ ID NO: 762238 - DNA, 25 bp, Mus musculus
tcaagaggaaccaggagccaaatgt

SEQ ID NO: 762239 - DNA, 25 bp, Mus musculus
tcaagaggaacctggagccaaatgt

SEQ ID NO: 762240 - DNA, 25 bp, Mus musculus
tcaagaggaagcacgttgccttgtg

SEQ ID NO: 762241 - DNA, 25 bp, Mus musculus
tcaagaggaagctcgttgccttgtg

SEQ ID NO: 762242 - DNA, 25 bp, Mus musculus
tcaagaggacggactttttgtttgt

SEQ ID NO: 762243 - DNA, 25 bp, Mus musculus
tcaagaggacggtctttttgtttgt

SEQ ID NO: 762244 - DNA, 25 bp, Mus musculus
tcaagaggagatcttgggcagcacc

SEQ ID NO: 762245 - DNA, 25 bp, Mus musculus
tcaagaggagatgttgggcagcacc

SEQ ID NO: 762246 - DNA, 25 bp, Mus musculus
tcaagaggaggccaatctctatgct

SEQ ID NO: 762247 - DNA, 25 bp, Mus musculus
tcaagaggaggcgaatctctatgct

SEQ ID NO: 762248 - DNA, 25 bp, Mus musculus
tcaagaggatgtatcctggacagat

SEQ ID NO: 762249 - DNA, 25 bp, Mus musculus
tcaagaggatgtttcctggacagat

SEQ ID NO: 762250 - DNA, 25 bp, Mus musculus
tcaagaggcacaccccactgagcaa

SEQ ID NO: 762251 - DNA, 25 bp, Mus musculus
tcaagaggcacagcccactgagcaa

SEQ ID NO: 762252 - DNA, 25 bp, Mus musculus
tcaagaggcaggaattgaagctgcc

SEQ ID NO: 762253 - DNA, 25 bp, Mus musculus
tcaagaggcaggtattgaagctgcc

SEQ ID NO: 762254 - DNA, 25 bp, Mus musculus
tcaagaggcctgagggcatgcatcg

SEQ ID NO: 762255 - DNA, 25 bp, Mus musculus
tcaagaggcctgtgggcatgcatcg

SEQ ID NO: 762256 - DNA, 25 bp, Mus musculus
tcaagaggcgcaatggtggccctgt

SEQ ID NO: 762257 - DNA, 25 bp, Mus musculus
tcaagaggcgcattggtggccctgt

SEQ ID NO: 762258 - DNA, 25 bp, Mus musculus
tcaagagggactatgaaagtaattt

SEQ ID NO: 762259 - DNA, 25 bp, Mus musculus
tcaagagggactttgaaagtaattt

SEQ ID NO: 762260 - DNA, 25 bp, Mus musculus
tcaagagggtttcggtttattctct

SEQ ID NO: 762261 - DNA, 25 bp, Mus musculus
tcaagagggtttgggtttattctct

SEQ ID NO: 762262 - DNA, 25 bp, Mus musculus
tcaagaggtctgagcctacctgtgc

SEQ ID NO: 762263 - DNA, 25 bp, Mus musculus
tcaagaggtctgtgcctacctgtgc

SEQ ID NO: 762264 - DNA, 25 bp, Mus musculus
tcaagagtgaccaggtgggacgcct

SEQ ID NO: 762265 - DNA, 25 bp, Mus musculus
tcaagagtgacctggtgggacgcct

SEQ ID NO: 762266 - DNA, 25 bp, Mus musculus
tcaagagtgccaaatgccgcgtcac

SEQ ID NO: 762267 - DNA, 25 bp, Mus musculus
tcaagagtgccatatgccgcgtcac

SEQ ID NO: 762268 - DNA, 25 bp, Mus musculus
tcaagagtggacattgtgggatcgc

SEQ ID NO: 762269 - DNA, 25 bp, Mus musculus
tcaagagtggactttgtgggatcgc

SEQ ID NO: 762270 - DNA, 25 bp, Mus musculus
tcaagagtgtagagaatgcgcctct

SEQ ID NO: 762271 - DNA, 25 bp, Mus musculus
tcaagagtgtagtgaatgcgcctct

SEQ ID NO: 762272 - DNA, 25 bp, Mus musculus
tcaagagtgtgaaactgcgtggtcc

SEQ ID NO: 762273 - DNA, 25 bp, Mus musculus
tcaagagtgtgatactgcgtggtcc

SEQ ID NO: 762274 - DNA, 25 bp, Mus musculus
tcaagagttcccacaatctggcagt

SEQ ID NO: 762275 - DNA, 25 bp, Mus musculus
tcaagagttccctcaatctggcagt

SEQ ID NO: 762276 - DNA, 25 bp, Mus musculus
tcaagataacggacttcgggctgtg

SEQ ID NO: 762277 - DNA, 25 bp, Mus musculus
tcaagataacggtcttcgggctgtg

SEQ ID NO: 762278 - DNA, 25 bp, Mus musculus
tcaagataagcaatgaaaatggagc

SEQ ID NO: 762279 - DNA, 25 bp, Mus musculus
tcaagataagcattgaaaatggagc

SEQ ID NO: 762280 - DNA, 25 bp, Mus musculus
tcaagataataaagacggttactcc

SEQ ID NO: 762281 - DNA, 25 bp, Mus musculus
tcaagataataatgacggttactcc

SEQ ID NO: 762282 - DNA, 25 bp, Mus musculus
tcaagatcaagaatgaagtggattc

SEQ ID NO: 762283 - DNA, 25 bp, Mus musculus
tcaagatcaagattgaagtggattc

SEQ ID NO: 762284 - DNA, 25 bp, Mus musculus
tcaagatccactaccggacatgaga

SEQ ID NO: 762285 - DNA, 25 bp, Mus musculus
tcaagatccacttccggacatgaga

SEQ ID NO: 762286 - DNA, 25 bp, Mus musculus
tcaagatcccaaatgagggccacat

SEQ ID NO: 762287 - DNA, 25 bp, Mus musculus
tcaagatcccaattgagggccacat

SEQ ID NO: 762288 - DNA, 25 bp, Mus musculus
tcaagatccgtgacatggactcagg

SEQ ID NO: 762289 - DNA, 25 bp, Mus musculus
tcaagatccgtgtcatggactcagg

SEQ ID NO: 762290 - DNA, 25 bp, Mus musculus
tcaagatcgcaaacatggagggtga

SEQ ID NO: 762291 - DNA, 25 bp, Mus musculus
tcaagatcgcaatcatggagggtga

SEQ ID NO: 762292 - DNA, 25 bp, Mus musculus
tcaagatcgtagcatagtgctcaag

SEQ ID NO: 762293 - DNA, 25 bp, Mus musculus
tcaagatcgtaggatagtgctcaag

SEQ ID NO: 762294 - DNA, 25 bp, Mus musculus
tcaagatctcaacccacctgaagat

SEQ ID NO: 762295 - DNA, 25 bp, Mus musculus
tcaagatctcaagccacctgaagat

SEQ ID NO: 762296 - DNA, 25 bp, Mus musculus
tcaagatctgctcacctgataagat

SEQ ID NO: 762297 - DNA, 25 bp, Mus musculus
tcaagatctgctgacctgataagat

SEQ ID NO: 762298 - DNA, 25 bp, Mus musculus
tcaagatctggaagcagcctgtgac

SEQ ID NO: 762299 - DNA, 25 bp, Mus musculus
tcaagatctggatgcagcctgtgac

SEQ ID NO: 762300 - DNA, 25 bp, Mus musculus
tcaagatgaagacaggagcaagccc

SEQ ID NO: 762301 - DNA, 25 bp, Mus musculus
tcaagatgaagagaggagcaagccc

SEQ ID NO: 762302 - DNA, 25 bp, Mus musculus
tcaagatgccagcacccaagtggat

SEQ ID NO: 762303 - DNA, 25 bp, Mus musculus
tcaagatgccaggacccaagtggat

SEQ ID NO: 762304 - DNA, 25 bp, Mus musculus
tcaagatgcggtcgccactgaactc

SEQ ID NO: 762305 - DNA, 25 bp, Mus musculus
tcaagatgcggtggccactgaactc

SEQ ID NO: 762306 - DNA, 25 bp, Mus musculus
tcaagatgctgtaccatgccaggtg

SEQ ID NO: 762307 - DNA, 25 bp, Mus musculus
tcaagatgctgttccatgccaggtg

SEQ ID NO: 762308 - DNA, 25 bp, Mus musculus
tcaagatggagtcctgcaagactgg

SEQ ID NO: 762309 - DNA, 25 bp, Mus musculus
tcaagatggagtgctgcaagactgg

SEQ ID NO: 762310 - DNA, 25 bp, Mus musculus
tcaagatggcggataatctcccttc

SEQ ID NO: 762311 - DNA, 25 bp, Mus musculus
tcaagatggcggttaatctcccttc

SEQ ID NO: 762312 - DNA, 25 bp, Mus musculus
tcaagatgggctatgagtttggcaa

SEQ ID NO: 762313 - DNA, 25 bp, Mus musculus
tcaagatgggctttgagtttggcaa

SEQ ID NO: 762314 - DNA, 25 bp, Mus musculus
tcaagatgtaggcaccctggtcact

SEQ ID NO: 762315 - DNA, 25 bp, Mus musculus
tcaagatgtagggaccctggtcact

SEQ ID NO: 762316 - DNA, 25 bp, Mus musculus
tcaagatgtcaacacgagccatgtc

SEQ ID NO: 762317 - DNA, 25 bp, Mus musculus
tcaagatgtcaagacgagccatgtc

SEQ ID NO: 762318 - DNA, 25 bp, Mus musculus
tcaagatgttccacaacctcctgtc

SEQ ID NO: 762319 - DNA, 25 bp, Mus musculus
tcaagatgttcctcaacctcctgtc

SEQ ID NO: 762320 - DNA, 25 bp, Mus musculus
tcaagatgtttaaggcctacaaagg

SEQ ID NO: 762321 - DNA, 25 bp, Mus musculus
tcaagatgtttatggcctacaaagg

SEQ ID NO: 762322 - DNA, 25 bp, Mus musculus
tcaagattatagaacccagaagaac

SEQ ID NO: 762323 - DNA, 25 bp, Mus musculus
tcaagattatagtacccagaagaac

SEQ ID NO: 762324 - DNA, 25 bp, Mus musculus
tcaagattgcagaaacccgaaaccc

SEQ ID NO: 762325 - DNA, 25 bp, Mus musculus
tcaagattgcagtaacccgaaaccc

SEQ ID NO: 762326 - DNA, 25 bp, Mus musculus
tcaagattgccaaatgccagatact

SEQ ID NO: 762327 - DNA, 25 bp, Mus musculus
tcaagattgccatatgccagatact

SEQ ID NO: 762328 - DNA, 25 bp, Mus musculus
tcaagattgtcaactacactgtacg

SEQ ID NO: 762329 - DNA, 25 bp, Mus musculus
tcaagattgtcatctacactgtacg

SEQ ID NO: 762330 - DNA, 25 bp, Mus musculus
tcaagcaaagccaacaacatgctgg

SEQ ID NO: 762331 - DNA, 25 bp, Mus musculus
tcaagcaaagcctacaacatgctgg

SEQ ID NO: 762332 - DNA, 25 bp, Mus musculus
tcaagcaacagcagtattcagacct

SEQ ID NO: 762333 - DNA, 25 bp, Mus musculus
tcaagcaacagctgtattcagacct

SEQ ID NO: 762334 - DNA, 25 bp, Mus musculus
tcaagcaactgactatccgtcgagg

SEQ ID NO: 762335 - DNA, 25 bp, Mus musculus
tcaagcaactgagtatccgtcgagg

SEQ ID NO: 762336 - DNA, 25 bp, Mus musculus
tcaagcaagttcatttgcgggaggg

SEQ ID NO: 762337 - DNA, 25 bp, Mus musculus
tcaagcaagttcttttgcgggaggg

SEQ ID NO: 762338 - DNA, 25 bp, Mus musculus
tcaagcacaaagcaaaaacagtctg

SEQ ID NO: 762339 - DNA, 25 bp, Mus musculus
tcaagcacaaaggaaaaacagtctg

SEQ ID NO: 762340 - DNA, 25 bp, Mus musculus
tcaagcacacccaggtaacctgtga

SEQ ID NO: 762341 - DNA, 25 bp, Mus musculus
tcaagcacaccctggtaacctgtga

SEQ ID NO: 762342 - DNA, 25 bp, Mus musculus
tcaagcacatgcagattcgagtgaa

SEQ ID NO: 762343 - DNA, 25 bp, Mus musculus
tcaagcacatgctgattcgagtgaa

SEQ ID NO: 762344 - DNA, 25 bp, Mus musculus
tcaagcacgagaacctgcagagcca

SEQ ID NO: 762345 - DNA, 25 bp, Mus musculus
tcaagcacgagatcctgcagagcca

SEQ ID NO: 762346 - DNA, 25 bp, Mus musculus
tcaagcacttgcactggaagggaga

SEQ ID NO: 762347 - DNA, 25 bp, Mus musculus
tcaagcacttgctctggaagggaga

SEQ ID NO: 762348 - DNA, 25 bp, Mus musculus
tcaagcagaactcgagtcatgctgc

SEQ ID NO: 762349 - DNA, 25 bp, Mus musculus
tcaagcagaactggagtcatgctgc

SEQ ID NO: 762350 - DNA, 25 bp, Mus musculus
tcaagcagcaaactttgatccttct

SEQ ID NO: 762351 - DNA, 25 bp, Mus musculus
tcaagcagcaaagtttgatccttct

SEQ ID NO: 762352 - DNA, 25 bp, Mus musculus
tcaagcagcaacatgggaagacagt

SEQ ID NO: 762353 - DNA, 25 bp, Mus musculus
tcaagcagcaacttgggaagacagt

SEQ ID NO: 762354 - DNA, 25 bp, Mus musculus
tcaagcagcaccattgtccggacag

SEQ ID NO: 762355 - DNA, 25 bp, Mus musculus
tcaagcagcacctttgtccggacag

SEQ ID NO: 762356 - DNA, 25 bp, Mus musculus
tcaagcaggaagcaccagtgttggc

SEQ ID NO: 762357 - DNA, 25 bp, Mus musculus
tcaagcaggaaggaccagtgttggc

SEQ ID NO: 762358 - DNA, 25 bp, Mus musculus
tcaagcaggaggcagatgcatctcg

SEQ ID NO: 762359 - DNA, 25 bp, Mus musculus
tcaagcaggagggagatgcatctcg

SEQ ID NO: 762360 - DNA, 25 bp, Mus musculus
tcaagcagggctattgggaagagtt

SEQ ID NO: 762361 - DNA, 25 bp, Mus musculus
tcaagcagggcttttgggaagagtt

SEQ ID NO: 762362 - DNA, 25 bp, Mus musculus
tcaagcaggtgactacggagagcca

SEQ ID NO: 762363 - DNA, 25 bp, Mus musculus
tcaagcaggtgagtacggagagcca

SEQ ID NO: 762364 - DNA, 25 bp, Mus musculus
tcaagcaggtttccatgagagtcgt

SEQ ID NO: 762365 - DNA, 25 bp, Mus musculus
tcaagcaggtttgcatgagagtcgt

SEQ ID NO: 762366 - DNA, 25 bp, Mus musculus
tcaagcagtcctcagtcgagaaaag

SEQ ID NO: 762367 - DNA, 25 bp, Mus musculus
tcaagcagtcctgagtcgagaaaag

SEQ ID NO: 762368 - DNA, 25 bp, Mus musculus
tcaagcatccagctacaaatgttct

SEQ ID NO: 762369 - DNA, 25 bp, Mus musculus
tcaagcatccaggtacaaatgttct

SEQ ID NO: 762370 - DNA, 25 bp, Mus musculus
tcaagcatgcatacaagtggagggc

SEQ ID NO: 762371 - DNA, 25 bp, Mus musculus
tcaagcatgcattcaagtggagggc

SEQ ID NO: 762372 - DNA, 25 bp, Mus musculus
tcaagcattagtcacaaagccaagg

SEQ ID NO: 762373 - DNA, 25 bp, Mus musculus
tcaagcattagtgacaaagccaagg

SEQ ID NO: 762374 - DNA, 25 bp, Mus musculus
tcaagccacctgaagattttgaggc

SEQ ID NO: 762375 - DNA, 25 bp, Mus musculus
tcaagccacctgtagattttgaggc

SEQ ID NO: 762376 - DNA, 25 bp, Mus musculus
tcaagccactgtcgacatcaaggac

SEQ ID NO: 762377 - DNA, 25 bp, Mus musculus
tcaagccactgtggacatcaaggac

SEQ ID NO: 762378 - DNA, 25 bp, Mus musculus
tcaagccagactatcaaccctgtgg

SEQ ID NO: 762379 - DNA, 25 bp, Mus musculus
tcaagccagactttcaaccctgtgg

SEQ ID NO: 762380 - DNA, 25 bp, Mus musculus
tcaagccagggaacttcaaggtcca

SEQ ID NO: 762381 - DNA, 25 bp, Mus musculus
tcaagccagggaagctaagacctaa

SEQ ID NO: 762382 - DNA, 25 bp, Mus musculus
tcaagccagggatcttcaaggtcca

SEQ ID NO: 762383 - DNA, 25 bp, Mus musculus
tcaagccagggatgctaagacctaa

SEQ ID NO: 762384 - DNA, 25 bp, Mus musculus
tcaagccaggtgcagggtgggaatc

SEQ ID NO: 762385 - DNA, 25 bp, Mus musculus
tcaagccaggtggagggtgggaatc

SEQ ID NO: 762386 - DNA, 25 bp, Mus musculus
tcaagccagtggacgaaaaagagga

SEQ ID NO: 762387 - DNA, 25 bp, Mus musculus
tcaagccagtggtcgaaaaagagga

SEQ ID NO: 762388 - DNA, 25 bp, Mus musculus
tcaagcccaaggaaaagataggcat

SEQ ID NO: 762389 - DNA, 25 bp, Mus musculus
tcaagcccaaggtaaagataggcat

SEQ ID NO: 762390 - DNA, 25 bp, Mus musculus
tcaagcccaggaagcctagcctggc

SEQ ID NO: 762391 - DNA, 25 bp, Mus musculus
tcaagcccaggatgcctagcctggc

SEQ ID NO: 762392 - DNA, 25 bp, Mus musculus
tcaagcccgtggcaatcagacggct

SEQ ID NO: 762393 - DNA, 25 bp, Mus musculus
tcaagcccgtgggaatcagacggct

SEQ ID NO: 762394 - DNA, 25 bp, Mus musculus
tcaagccgagccacgggacggctgc

SEQ ID NO: 762395 - DNA, 25 bp, Mus musculus
tcaagccgagcctcgggacggctgc

SEQ ID NO: 762396 - DNA, 25 bp, Mus musculus
tcaagccgcaggagcaaccttggat

SEQ ID NO: 762397 - DNA, 25 bp, Mus musculus
tcaagccgcaggtgcaaccttggat

SEQ ID NO: 762398 - DNA, 25 bp, Mus musculus
tcaagccggacaatctactgttggc

SEQ ID NO: 762399 - DNA, 25 bp, Mus musculus
tcaagccggacattctactgttggc

SEQ ID NO: 762400 - DNA, 25 bp, Mus musculus
tcaagccgtgccatagcaaatcccg

SEQ ID NO: 762401 - DNA, 25 bp, Mus musculus
tcaagccgtgccttagcaaatcccg

SEQ ID NO: 762402 - DNA, 25 bp, Mus musculus
tcaagcctgaatcacgagtgaatgg

SEQ ID NO: 762403 - DNA, 25 bp, Mus musculus
tcaagcctgaatgacgagtgaatgg

SEQ ID NO: 762404 - DNA, 25 bp, Mus musculus
tcaagcctgcttagacagagctgca

SEQ ID NO: 762405 - DNA, 25 bp, Mus musculus
tcaagcctgctttgacagagctgca

SEQ ID NO: 762406 - DNA, 25 bp, Mus musculus
tcaagcctgtgtatgagcgcttcca

SEQ ID NO: 762407 - DNA, 25 bp, Mus musculus
tcaagcctgtgtttgagcgcttcca

SEQ ID NO: 762408 - DNA, 25 bp, Mus musculus
tcaagccttctcacagaacggatct

SEQ ID NO: 762409 - DNA, 25 bp, Mus musculus
tcaagccttctctcagaacggatct

SEQ ID NO: 762410 - DNA, 25 bp, Mus musculus
tcaagcctttcgcatatcagcagcc

SEQ ID NO: 762411 - DNA, 25 bp, Mus musculus
tcaagcctttcggatatcagcagcc

SEQ ID NO: 762412 - DNA, 25 bp, Mus musculus
tcaagcgacggtcacagtccatcta

SEQ ID NO: 762413 - DNA, 25 bp, Mus musculus
tcaagcgacggtgacagtccatcta

SEQ ID NO: 762414 - DNA, 25 bp, Mus musculus
tcaagcgactctacatagacaaatc

SEQ ID NO: 762415 - DNA, 25 bp, Mus musculus
tcaagcgactcttcatagacaaatc

SEQ ID NO: 762416 - DNA, 25 bp, Mus musculus
tcaagcgccagtatgtggaatacgc

SEQ ID NO: 762417 - DNA, 25 bp, Mus musculus
tcaagcgccagtttgtggaatacgc

SEQ ID NO: 762418 - DNA, 25 bp, Mus musculus
tcaagcgccgcacggtattaagcag

SEQ ID NO: 762419 - DNA, 25 bp, Mus musculus
tcaagcgccgcagggtattaagcag

SEQ ID NO: 762420 - DNA, 25 bp, Mus musculus
tcaagcgccgttatgccattggctc

SEQ ID NO: 762421 - DNA, 25 bp, Mus musculus
tcaagcgccgttttgccattggctc

SEQ ID NO: 762422 - DNA, 25 bp, Mus musculus
tcaagcgcgtctacttgctgcggtc

SEQ ID NO: 762423 - DNA, 25 bp, Mus musculus
tcaagcgcgtcttcttgctgcggtc

SEQ ID NO: 762424 - DNA, 25 bp, Mus musculus
tcaagcggaagtcgcagtgacaacg

SEQ ID NO: 762425 - DNA, 25 bp, Mus musculus
tcaagcggaagtggcagtgacaacg

SEQ ID NO: 762426 - DNA, 25 bp, Mus musculus
tcaagcggagccagggctttgtctc

SEQ ID NO: 762427 - DNA, 25 bp, Mus musculus
tcaagcggagcctgggctttgtctc

SEQ ID NO: 762428 - DNA, 25 bp, Mus musculus
tcaagcggctctcataaagatctgg

SEQ ID NO: 762429 - DNA, 25 bp, Mus musculus
tcaagcggctctgataaagatctgg

SEQ ID NO: 762430 - DNA, 25 bp, Mus musculus
tcaagcggttttcagaacacgagcc

SEQ ID NO: 762431 - DNA, 25 bp, Mus musculus
tcaagcggttttgagaacacgagcc

SEQ ID NO: 762432 - DNA, 25 bp, Mus musculus
tcaagcgtctgacctattccaggtg

SEQ ID NO: 762433 - DNA, 25 bp, Mus musculus
tcaagcgtctgagctattccaggtg

SEQ ID NO: 762434 - DNA, 25 bp, Mus musculus
tcaagctacagaaagtaagtggtct

SEQ ID NO: 762435 - DNA, 25 bp, Mus musculus
tcaagctacagatagtaagtggtct

SEQ ID NO: 762436 - DNA, 25 bp, Mus musculus
tcaagctaccagataagccggccag

SEQ ID NO: 762437 - DNA, 25 bp, Mus musculus
tcaagctaccagttaagccggccag

SEQ ID NO: 762438 - DNA, 25 bp, Mus musculus
tcaagctcacaaactctgacccaat

SEQ ID NO: 762439 - DNA, 25 bp, Mus musculus
tcaagctcacaatctctgacccaat

SEQ ID NO: 762440 - DNA, 25 bp, Mus musculus
tcaagctcagagcaatcttcctacc

SEQ ID NO: 762441 - DNA, 25 bp, Mus musculus
tcaagctcagaggaatcttcctacc

SEQ ID NO: 762442 - DNA, 25 bp, Mus musculus
tcaagctcatgcaggtatggtacag

SEQ ID NO: 762443 - DNA, 25 bp, Mus musculus
tcaagctcatgctggtatggtacag

SEQ ID NO: 762444 - DNA, 25 bp, Mus musculus
tcaagctcccacagagtgacagggc

SEQ ID NO: 762445 - DNA, 25 bp, Mus musculus
tcaagctcccactgagtgacagggc

SEQ ID NO: 762446 - DNA, 25 bp, Mus musculus
tcaagctcccttcggagtcagcgtc

SEQ ID NO: 762447 - DNA, 25 bp, Mus musculus
tcaagctcccttgggagtcagcgtc

SEQ ID NO: 762448 - DNA, 25 bp, Mus musculus
tcaagctcgataaggtgaccttgca

SEQ ID NO: 762449 - DNA, 25 bp, Mus musculus
tcaagctcgatatggtgaccttgca

SEQ ID NO: 762450 - DNA, 25 bp, Mus musculus
tcaagctctgtgctctcaccatgat

SEQ ID NO: 762451 - DNA, 25 bp, Mus musculus
tcaagctctgtggtctcaccatgat

SEQ ID NO: 762452 - DNA, 25 bp, Mus musculus
tcaagctcttgcattagaatctcgg

SEQ ID NO: 762453 - DNA, 25 bp, Mus musculus
tcaagctcttgctttagaatctcgg

SEQ ID NO: 762454 - DNA, 25 bp, Mus musculus
tcaagctgaagacgaacatggtttc

SEQ ID NO: 762455 - DNA, 25 bp, Mus musculus
tcaagctgaagaggaacatggtttc

SEQ ID NO: 762456 - DNA, 25 bp, Mus musculus
tcaagctgcacacatataaacaaag

SEQ ID NO: 762457 - DNA, 25 bp, Mus musculus
tcaagctgcacagatataaacaaag

SEQ ID NO: 762458 - DNA, 25 bp, Mus musculus
tcaagctgcagtcaagctggagcat

SEQ ID NO: 762459 - DNA, 25 bp, Mus musculus
tcaagctgcagtgaagctggagcat

SEQ ID NO: 762460 - DNA, 25 bp, Mus musculus
tcaagctgctccctaacagtattag

SEQ ID NO: 762461 - DNA, 25 bp, Mus musculus
tcaagctgctccgtaacagtattag

SEQ ID NO: 762462 - DNA, 25 bp, Mus musculus
tcaagctgtactcgccgaaggagcc

SEQ ID NO: 762463 - DNA, 25 bp, Mus musculus
tcaagctgtactggccgaaggagcc

SEQ ID NO: 762464 - DNA, 25 bp, Mus musculus
tcaagctgtcttctggatgagtacc

SEQ ID NO: 762465 - DNA, 25 bp, Mus musculus
tcaagctgtcttgtggatgagtacc

SEQ ID NO: 762466 - DNA, 25 bp, Mus musculus
tcaagcttagggacagcgtcccaag

SEQ ID NO: 762467 - DNA, 25 bp, Mus musculus
tcaagcttagggtcagcgtcccaag

SEQ ID NO: 762468 - DNA, 25 bp, Mus musculus
tcaagcttggcaagtggtgttctcc

SEQ ID NO: 762469 - DNA, 25 bp, Mus musculus
tcaagcttggcatgtggtgttctcc

SEQ ID NO: 762470 - DNA, 25 bp, Mus musculus
tcaagctttccaaggttaccaggtt

SEQ ID NO: 762471 - DNA, 25 bp, Mus musculus
tcaagctttccatggttaccaggtt

SEQ ID NO: 762472 - DNA, 25 bp, Mus musculus
tcaagctttgctagttcctgcatta

SEQ ID NO: 762473 - DNA, 25 bp, Mus musculus
tcaagctttgcttgttcctgcatta

SEQ ID NO: 762474 - DNA, 25 bp, Mus musculus
tcaaggaaatggagcgggtcttaaa

SEQ ID NO: 762475 - DNA, 25 bp, Mus musculus
tcaaggaaatggtgcgggtcttaaa

SEQ ID NO: 762476 - DNA, 25 bp, Mus musculus
tcaaggaaccagagcctggaactcc

SEQ ID NO: 762477 - DNA, 25 bp, Mus musculus
tcaaggaaccagtgcctggaactcc

SEQ ID NO: 762478 - DNA, 25 bp, Mus musculus
tcaaggaagtgtcgagcgaagatat

SEQ ID NO: 762479 - DNA, 25 bp, Mus musculus
tcaaggaagtgtggagcgaagatat

SEQ ID NO: 762480 - DNA, 25 bp, Mus musculus
tcaaggaatgccctgctctagctgt

SEQ ID NO: 762481 - DNA, 25 bp, Mus musculus
tcaaggaatgccgtgctctagctgt

SEQ ID NO: 762482 - DNA, 25 bp, Mus musculus
tcaaggaattccagggcgagcagcg

SEQ ID NO: 762483 - DNA, 25 bp, Mus musculus
tcaaggaattcctgggcgagcagcg

SEQ ID NO: 762484 - DNA, 25 bp, Mus musculus
tcaaggacaaccctaccttgggtga

SEQ ID NO: 762485 - DNA, 25 bp, Mus musculus
tcaaggacaaccgtaccttgggtga

SEQ ID NO: 762486 - DNA, 25 bp, Mus musculus
tcaaggacacctacctgaggactta

SEQ ID NO: 762487 - DNA, 25 bp, Mus musculus
tcaaggacaccttcctgaggactta

SEQ ID NO: 762488 - DNA, 25 bp, Mus musculus
tcaaggacagcgagctctactccag

SEQ ID NO: 762489 - DNA, 25 bp, Mus musculus
tcaaggacagcgaggccctccagga

SEQ ID NO: 762490 - DNA, 25 bp, Mus musculus
tcaaggacagcgtgctctactccag

SEQ ID NO: 762491 - DNA, 25 bp, Mus musculus
tcaaggacagcgtggccctccagga

SEQ ID NO: 762492 - DNA, 25 bp, Mus musculus
tcaaggacatcacccatttgcaggg

SEQ ID NO: 762493 - DNA, 25 bp, Mus musculus
tcaaggacatcagccatttgcaggg

SEQ ID NO: 762494 - DNA, 25 bp, Mus musculus
tcaaggaccattctgctagatgccc

SEQ ID NO: 762495 - DNA, 25 bp, Mus musculus
tcaaggaccattgtgctagatgccc

SEQ ID NO: 762496 - DNA, 25 bp, Mus musculus
tcaaggaccccaagcggctctactg

SEQ ID NO: 762497 - DNA, 25 bp, Mus musculus
tcaaggaccccatgcggctctactg

SEQ ID NO: 762498 - DNA, 25 bp, Mus musculus
tcaaggacctccaccctgtcactgt

SEQ ID NO: 762499 - DNA, 25 bp, Mus musculus
tcaaggacctcctccctgtcactgt

SEQ ID NO: 762500 - DNA, 25 bp, Mus musculus
tcaaggacctcgaggctcttctcaa

SEQ ID NO: 762501 - DNA, 25 bp, Mus musculus
tcaaggacctcgtggctcttctcaa

SEQ ID NO: 762502 - DNA, 25 bp, Mus musculus
tcaaggacgatgatagcgctcagcc

SEQ ID NO: 762503 - DNA, 25 bp, Mus musculus
tcaaggacgatgttagcgctcagcc

SEQ ID NO: 762504 - DNA, 25 bp, Mus musculus
tcaaggacgcggctgtccaggaacc

SEQ ID NO: 762505 - DNA, 25 bp, Mus musculus
tcaaggacgcgggtgtccaggaacc

SEQ ID NO: 762506 - DNA, 25 bp, Mus musculus
tcaaggactacaatggccagatcaa

SEQ ID NO: 762507 - DNA, 25 bp, Mus musculus
tcaaggactacattggccagatcaa

SEQ ID NO: 762508 - DNA, 25 bp, Mus musculus
tcaaggactagtactgacttatagg

SEQ ID NO: 762509 - DNA, 25 bp, Mus musculus
tcaaggactagttctgacttatagg

SEQ ID NO: 762510 - DNA, 25 bp, Mus musculus
tcaaggactggtccaactggacttt

SEQ ID NO: 762511 - DNA, 25 bp, Mus musculus
tcaaggactggtgcaactggacttt

SEQ ID NO: 762512 - DNA, 25 bp, Mus musculus
tcaaggactgtaccgaggctataaa

SEQ ID NO: 762513 - DNA, 25 bp, Mus musculus
tcaaggactgtagcgaggctataaa

SEQ ID NO: 762514 - DNA, 25 bp, Mus musculus
tcaaggacttcacccaggaaaagtc

SEQ ID NO: 762515 - DNA, 25 bp, Mus musculus
tcaaggacttcagccaggaaaagtc

SEQ ID NO: 762516 - DNA, 25 bp, Mus musculus
tcaaggagactgacatcaagcatct

SEQ ID NO: 762517 - DNA, 25 bp, Mus musculus
tcaaggagactgtcatcaagcatct

SEQ ID NO: 762518 - DNA, 25 bp, Mus musculus
tcaaggagacttcgggacgcccgca

SEQ ID NO: 762519 - DNA, 25 bp, Mus musculus
tcaaggagacttggggacgcccgca

SEQ ID NO: 762520 - DNA, 25 bp, Mus musculus
tcaaggagatccaggcgcgggtagc

SEQ ID NO: 762521 - DNA, 25 bp, Mus musculus
tcaaggagatcctggcgcgggtagc

SEQ ID NO: 762522 - DNA, 25 bp, Mus musculus
tcaaggagatctccccggctgggaa

SEQ ID NO: 762523 - DNA, 25 bp, Mus musculus
tcaaggagatctgcccggctgggaa

SEQ ID NO: 762524 - DNA, 25 bp, Mus musculus
tcaaggagattaacagggaagagtc

SEQ ID NO: 762525 - DNA, 25 bp, Mus musculus
tcaaggagattatcagggaagagtc

SEQ ID NO: 762526 - DNA, 25 bp, Mus musculus
tcaaggagcacaccagtgaccagcc

SEQ ID NO: 762527 - DNA, 25 bp, Mus musculus
tcaaggagcacagcagtgaccagcc

SEQ ID NO: 762528 - DNA, 25 bp, Mus musculus
tcaaggagcgtgaggaagaaaaaga

SEQ ID NO: 762529 - DNA, 25 bp, Mus musculus
tcaaggagcgtgtggaagaaaaaga

SEQ ID NO: 762530 - DNA, 25 bp, Mus musculus
tcaaggagcttaatttccaggtccg

SEQ ID NO: 762531 - DNA, 25 bp, Mus musculus
tcaaggagcttattttccaggtccg

SEQ ID NO: 762532 - DNA, 25 bp, Mus musculus
tcaaggaggaagactgctcggctcg

SEQ ID NO: 762533 - DNA, 25 bp, Mus musculus
tcaaggaggaagtctgctcggctcg

SEQ ID NO: 762534 - DNA, 25 bp, Mus musculus
tcaaggaggacaagctcttcaggcc

SEQ ID NO: 762535 - DNA, 25 bp, Mus musculus
tcaaggaggacatgctcttcaggcc

SEQ ID NO: 762536 - DNA, 25 bp, Mus musculus
tcaaggaggtggcaaataaaagctg

SEQ ID NO: 762537 - DNA, 25 bp, Mus musculus
tcaaggaggtgggaaataaaagctg

SEQ ID NO: 762538 - DNA, 25 bp, Mus musculus
tcaaggagtggtatgtgtaccccgg

SEQ ID NO: 762539 - DNA, 25 bp, Mus musculus
tcaaggagtggtttgtgtaccccgg

SEQ ID NO: 762540 - DNA, 25 bp, Mus musculus
tcaaggagttccagagacagtaccg

SEQ ID NO: 762541 - DNA, 25 bp, Mus musculus
tcaaggagttcctgagacagtaccg

SEQ ID NO: 762542 - DNA, 25 bp, Mus musculus
tcaaggatagaaaggtgaacagcaa

SEQ ID NO: 762543 - DNA, 25 bp, Mus musculus
tcaaggatagaatggtgaacagcaa

SEQ ID NO: 762544 - DNA, 25 bp, Mus musculus
tcaaggatctaaatcagcagcatgt

SEQ ID NO: 762545 - DNA, 25 bp, Mus musculus
tcaaggatctaattcagcagcatgt

SEQ ID NO: 762546 - DNA, 25 bp, Mus musculus
tcaaggatgatgctttactgcaaac

SEQ ID NO: 762547 - DNA, 25 bp, Mus musculus
tcaaggatgatggtttactgcaaac

SEQ ID NO: 762548 - DNA, 25 bp, Mus musculus
tcaaggatgctcatgctaagcaggg

SEQ ID NO: 762549 - DNA, 25 bp, Mus musculus
tcaaggatgctcttgctaagcaggg

SEQ ID NO: 762550 - DNA, 25 bp, Mus musculus
tcaaggatgtccagttgaggcccaa

SEQ ID NO: 762551 - DNA, 25 bp, Mus musculus
tcaaggatgtcctgttgaggcccaa

SEQ ID NO: 762552 - DNA, 25 bp, Mus musculus
tcaaggcaaacaagtgaggcaggag

SEQ ID NO: 762553 - DNA, 25 bp, Mus musculus
tcaaggcaaacatgtgaggcaggag

SEQ ID NO: 762554 - DNA, 25 bp, Mus musculus
tcaaggcaaggtccacaacccattc

SEQ ID NO: 762555 - DNA, 25 bp, Mus musculus
tcaaggcaaggtgcacaacccattc

SEQ ID NO: 762556 - DNA, 25 bp, Mus musculus
tcaaggcaatcacggctgtaacgga

SEQ ID NO: 762557 - DNA, 25 bp, Mus musculus
tcaaggcaatcagggctgtaacgga

SEQ ID NO: 762558 - DNA, 25 bp, Mus musculus
tcaaggcaatcgatacaaactttgc

SEQ ID NO: 762559 - DNA, 25 bp, Mus musculus
tcaaggcaatcgttacaaactttgc

SEQ ID NO: 762560 - DNA, 25 bp, Mus musculus
tcaaggcacaaacagcttgtcaggg

SEQ ID NO: 762561 - DNA, 25 bp, Mus musculus
tcaaggcacaaagagcttgtcaggg

SEQ ID NO: 762562 - DNA, 25 bp, Mus musculus
tcaaggcaggaaagggactcacgat

SEQ ID NO: 762563 - DNA, 25 bp, Mus musculus
tcaaggcaggaatgggactcacgat

SEQ ID NO: 762564 - DNA, 25 bp, Mus musculus
tcaaggcagtgaaaagaagaaaagg

SEQ ID NO: 762565 - DNA, 25 bp, Mus musculus
tcaaggcagtgataagaagaaaagg

SEQ ID NO: 762566 - DNA, 25 bp, Mus musculus
tcaaggcattacctcaccaagtgag

SEQ ID NO: 762567 - DNA, 25 bp, Mus musculus
tcaaggcattacgtcaccaagtgag

SEQ ID NO: 762568 - DNA, 25 bp, Mus musculus
tcaaggccacctacaactatgaaaa

SEQ ID NO: 762569 - DNA, 25 bp, Mus musculus
tcaaggccaccttcaactatgaaaa

SEQ ID NO: 762570 - DNA, 25 bp, Mus musculus
tcaaggccagaaacctgtgccttaa

SEQ ID NO: 762571 - DNA, 25 bp, Mus musculus
tcaaggccagaatcctgtgccttaa

SEQ ID NO: 762572 - DNA, 25 bp, Mus musculus
tcaaggccagatccaaagagcagcc

SEQ ID NO: 762573 - DNA, 25 bp, Mus musculus
tcaaggccagatgcaaagagcagcc

SEQ ID NO: 762574 - DNA, 25 bp, Mus musculus
tcaaggccctcacgaccattgtcta

SEQ ID NO: 762575 - DNA, 25 bp, Mus musculus
tcaaggccctcaggaccattgtcta

SEQ ID NO: 762576 - DNA, 25 bp, Mus musculus
tcaaggcctcgtctggccgtgcgct

SEQ ID NO: 762577 - DNA, 25 bp, Mus musculus
tcaaggcctcgtgtggccgtgcgct

SEQ ID NO: 762578 - DNA, 25 bp, Mus musculus
tcaaggcctgacagaacggcctcag

SEQ ID NO: 762579 - DNA, 25 bp, Mus musculus
tcaaggcctgactgaacggcctcag

SEQ ID NO: 762580 - DNA, 25 bp, Mus musculus
tcaaggcctggactaaggactctct

SEQ ID NO: 762581 - DNA, 25 bp, Mus musculus
tcaaggcctggagtaaggactctct

SEQ ID NO: 762582 - DNA, 25 bp, Mus musculus
tcaaggcctggcaagtcccgctctt

SEQ ID NO: 762583 - DNA, 25 bp, Mus musculus
tcaaggcctggctagtcccgctctt

SEQ ID NO: 762584 - DNA, 25 bp, Mus musculus
tcaaggcggagaaggagattttaaa

SEQ ID NO: 762585 - DNA, 25 bp, Mus musculus
tcaaggcggagatggagattttaaa

SEQ ID NO: 762586 - DNA, 25 bp, Mus musculus
tcaaggcggataagaaggcagctca

SEQ ID NO: 762587 - DNA, 25 bp, Mus musculus
tcaaggcggatatgaaggcagctca

SEQ ID NO: 762588 - DNA, 25 bp, Mus musculus
tcaaggcggcctacgaggccgagct

SEQ ID NO: 762589 - DNA, 25 bp, Mus musculus
tcaaggcggccttcgaggccgagct

SEQ ID NO: 762590 - DNA, 25 bp, Mus musculus
tcaaggcgggaaatattttgctaaa

SEQ ID NO: 762591 - DNA, 25 bp, Mus musculus
tcaaggcgggaattattttgctaaa

SEQ ID NO: 762592 - DNA, 25 bp, Mus musculus
tcaaggctgctgaccagggacctca

SEQ ID NO: 762593 - DNA, 25 bp, Mus musculus
tcaaggctgctgtccagggacctca

SEQ ID NO: 762594 - DNA, 25 bp, Mus musculus
tcaaggctggttaattggactgatg

SEQ ID NO: 762595 - DNA, 25 bp, Mus musculus
tcaaggctggtttattggactgatg

SEQ ID NO: 762596 - DNA, 25 bp, Mus musculus
tcaaggcttggtatctcgtcagaca

SEQ ID NO: 762597 - DNA, 25 bp, Mus musculus
tcaaggcttggtttctcgtcagaca

SEQ ID NO: 762598 - DNA, 25 bp, Mus musculus
tcaagggaaaccacacagagactgc

SEQ ID NO: 762599 - DNA, 25 bp, Mus musculus
tcaagggaaacctcacagagactgc

SEQ ID NO: 762600 - DNA, 25 bp, Mus musculus
tcaagggacagaattgggaagagca

SEQ ID NO: 762601 - DNA, 25 bp, Mus musculus
tcaagggacagaatttagggctagt

SEQ ID NO: 762602 - DNA, 25 bp, Mus musculus
tcaagggacagatttgggaagagca

SEQ ID NO: 762603 - DNA, 25 bp, Mus musculus
tcaagggacagattttagggctagt

SEQ ID NO: 762604 - DNA, 25 bp, Mus musculus
tcaagggagaggaccaggcaacttc

SEQ ID NO: 762605 - DNA, 25 bp, Mus musculus
tcaagggagaggtccaggcaacttc

SEQ ID NO: 762606 - DNA, 25 bp, Mus musculus
tcaagggaggagacgtttgaagacc

SEQ ID NO: 762607 - DNA, 25 bp, Mus musculus
tcaagggaggagtcgtttgaagacc

SEQ ID NO: 762608 - DNA, 25 bp, Mus musculus
tcaagggcaagaaaggtgttttgtt

SEQ ID NO: 762609 - DNA, 25 bp, Mus musculus
tcaagggcaagataggtgttttgtt

SEQ ID NO: 762610 - DNA, 25 bp, Mus musculus
tcaagggcaagtcagaggccaaaat

SEQ ID NO: 762611 - DNA, 25 bp, Mus musculus
tcaagggcaagtgagaggccaaaat

SEQ ID NO: 762612 - DNA, 25 bp, Mus musculus
tcaagggcagagcaagattgccaac

SEQ ID NO: 762613 - DNA, 25 bp, Mus musculus
tcaagggcagaggaagattgccaac

SEQ ID NO: 762614 - DNA, 25 bp, Mus musculus
tcaagggcagctaggtaggaagctt

SEQ ID NO: 762615 - DNA, 25 bp, Mus musculus
tcaagggcagcttggtaggaagctt

SEQ ID NO: 762616 - DNA, 25 bp, Mus musculus
tcaagggcatgaatcaggatggtct

SEQ ID NO: 762617 - DNA, 25 bp, Mus musculus
tcaagggcatgattcaggatggtct

SEQ ID NO: 762618 - DNA, 25 bp, Mus musculus
tcaagggccatcctgagtgaacgag

SEQ ID NO: 762619 - DNA, 25 bp, Mus musculus
tcaagggccatcgtgagtgaacgag

SEQ ID NO: 762620 - DNA, 25 bp, Mus musculus
tcaagggccctaccctcaaggaggc

SEQ ID NO: 762621 - DNA, 25 bp, Mus musculus
tcaagggccctagcctcaaggaggc

SEQ ID NO: 762622 - DNA, 25 bp, Mus musculus
tcaagggcctccaagggaatcccat

SEQ ID NO: 762623 - DNA, 25 bp, Mus musculus
tcaagggcctcctagggaatcccat

SEQ ID NO: 762624 - DNA, 25 bp, Mus musculus
tcaagggctgcgatgtgtgaaatct

SEQ ID NO: 762625 - DNA, 25 bp, Mus musculus
tcaagggctgcgttgtgtgaaatct

SEQ ID NO: 762626 - DNA, 25 bp, Mus musculus
tcaagggctggaaccggatgcagaa

SEQ ID NO: 762627 - DNA, 25 bp, Mus musculus
tcaagggctggatccggatgcagaa

SEQ ID NO: 762628 - DNA, 25 bp, Mus musculus
tcaaggggctgtccatgcacacggt

SEQ ID NO: 762629 - DNA, 25 bp, Mus musculus
tcaaggggctgtgcatgcacacggt

SEQ ID NO: 762630 - DNA, 25 bp, Mus musculus
tcaaggggggctataagttctttgc

SEQ ID NO: 762631 - DNA, 25 bp, Mus musculus
tcaaggggggctttaagttctttgc

SEQ ID NO: 762632 - DNA, 25 bp, Mus musculus
tcaagggtcccgcaggcctctagca

SEQ ID NO: 762633 - DNA, 25 bp, Mus musculus
tcaagggtcccggaggcctctagca

SEQ ID NO: 762634 - DNA, 25 bp, Mus musculus
tcaagggttctcagcttctacaggg

SEQ ID NO: 762635 - DNA, 25 bp, Mus musculus
tcaagggttctctgcttctacaggg

SEQ ID NO: 762636 - DNA, 25 bp, Mus musculus
tcaaggtaaaaacgcagagggagcc

SEQ ID NO: 762637 - DNA, 25 bp, Mus musculus
tcaaggtaaaaaggcagagggagcc

SEQ ID NO: 762638 - DNA, 25 bp, Mus musculus
tcaaggtaagaacgtggcctgagtc

SEQ ID NO: 762639 - DNA, 25 bp, Mus musculus
tcaaggtaagaaggtggcctgagtc

SEQ ID NO: 762640 - DNA, 25 bp, Mus musculus
tcaaggtacatcacgcagttcagca

SEQ ID NO: 762641 - DNA, 25 bp, Mus musculus
tcaaggtacatctcgcagttcagca

SEQ ID NO: 762642 - DNA, 25 bp, Mus musculus
tcaaggtaccgaccgcgcctttctt

SEQ ID NO: 762643 - DNA, 25 bp, Mus musculus
tcaaggtaccgagcgcgcctttctt

SEQ ID NO: 762644 - DNA, 25 bp, Mus musculus
tcaaggtagctgagaatggtcaaca

SEQ ID NO: 762645 - DNA, 25 bp, Mus musculus
tcaaggtagctgtgaatggtcaaca

SEQ ID NO: 762646 - DNA, 25 bp, Mus musculus
tcaaggtagtgaagttctcctacat

SEQ ID NO: 762647 - DNA, 25 bp, Mus musculus
tcaaggtagtgatgttctcctacat

SEQ ID NO: 762648 - DNA, 25 bp, Mus musculus
tcaaggtcaagacggtctaccgaca

SEQ ID NO: 762649 - DNA, 25 bp, Mus musculus
tcaaggtcaagagggtctaccgaca

SEQ ID NO: 762650 - DNA, 25 bp, Mus musculus
tcaaggtcagtcataacggcagtgt

SEQ ID NO: 762651 - DNA, 25 bp, Mus musculus
tcaaggtcagtcttaacggcagtgt

SEQ ID NO: 762652 - DNA, 25 bp, Mus musculus
tcaaggtcatatcagcgcacaggcc

SEQ ID NO: 762653 - DNA, 25 bp, Mus musculus
tcaaggtcatatgagcgcacaggcc

SEQ ID NO: 762654 - DNA, 25 bp, Mus musculus
tcaaggtccaagatgccaatcccgc

SEQ ID NO: 762655 - DNA, 25 bp, Mus musculus
tcaaggtccaagttgccaatcccgc

SEQ ID NO: 762656 - DNA, 25 bp, Mus musculus
tcaaggtcgcccagcttctagtcaa

SEQ ID NO: 762657 - DNA, 25 bp, Mus musculus
tcaaggtcgccctgcttctagtcaa

SEQ ID NO: 762658 - DNA, 25 bp, Mus musculus
tcaaggtcgtccaatgggtccacac

SEQ ID NO: 762659 - DNA, 25 bp, Mus musculus
tcaaggtcgtcctatgggtccacac

SEQ ID NO: 762660 - DNA, 25 bp, Mus musculus
tcaaggtctgagatgtgaaaagaat

SEQ ID NO: 762661 - DNA, 25 bp, Mus musculus
tcaaggtctgagttgtgaaaagaat

SEQ ID NO: 762662 - DNA, 25 bp, Mus musculus
tcaaggtctgtaccaccatgctctg

SEQ ID NO: 762663 - DNA, 25 bp, Mus musculus
tcaaggtctgtagcaccatgctctg

SEQ ID NO: 762664 - DNA, 25 bp, Mus musculus
tcaaggtgaacaccaagcagcgcta

SEQ ID NO: 762665 - DNA, 25 bp, Mus musculus
tcaaggtgaacagcaagcagcgcta

SEQ ID NO: 762666 - DNA, 25 bp, Mus musculus
tcaaggtgaacgcatccgctagtag

SEQ ID NO: 762667 - DNA, 25 bp, Mus musculus
tcaaggtgaacggatccgctagtag

SEQ ID NO: 762668 - DNA, 25 bp, Mus musculus
tcaaggtgaactataccttcaaccg

SEQ ID NO: 762669 - DNA, 25 bp, Mus musculus
tcaaggtgaactttaccttcaaccg

SEQ ID NO: 762670 - DNA, 25 bp, Mus musculus
tcaaggtggagacttgttgtctctg

SEQ ID NO: 762671 - DNA, 25 bp, Mus musculus
tcaaggtggagagttgttgtctctg

SEQ ID NO: 762672 - DNA, 25 bp, Mus musculus
tcaaggtggcctagactgtcaagct

SEQ ID NO: 762673 - DNA, 25 bp, Mus musculus
tcaaggtggccttgactgtcaagct

SEQ ID NO: 762674 - DNA, 25 bp, Mus musculus
tcaaggtgggagacattgccaccgg

SEQ ID NO: 762675 - DNA, 25 bp, Mus musculus
tcaaggtgggagtcattgccaccgg

SEQ ID NO: 762676 - DNA, 25 bp, Mus musculus
tcaaggtgggccctcagtatccagt

SEQ ID NO: 762677 - DNA, 25 bp, Mus musculus
tcaaggtgggccgtcagtatccagt

SEQ ID NO: 762678 - DNA, 25 bp, Mus musculus
tcaaggtggtggaattcaaggaaaa

SEQ ID NO: 762679 - DNA, 25 bp, Mus musculus
tcaaggtggtggtattcaaggaaaa

SEQ ID NO: 762680 - DNA, 25 bp, Mus musculus
tcaaggtgtgctcttcctctgggca

SEQ ID NO: 762681 - DNA, 25 bp, Mus musculus
tcaaggtgtgctgttcctctgggca

SEQ ID NO: 762682 - DNA, 25 bp, Mus musculus
tcaaggtgttgtcagaagtttaact

SEQ ID NO: 762683 - DNA, 25 bp, Mus musculus
tcaaggtgttgtgagaagtttaact

SEQ ID NO: 762684 - DNA, 25 bp, Mus musculus
tcaaggttaagaatgcaaatgccta

SEQ ID NO: 762685 - DNA, 25 bp, Mus musculus
tcaaggttaagattgcaaatgccta

SEQ ID NO: 762686 - DNA, 25 bp, Mus musculus
tcaaggttaagcagagtctctccag

SEQ ID NO: 762687 - DNA, 25 bp, Mus musculus
tcaaggttaagctgagtctctccag

SEQ ID NO: 762688 - DNA, 25 bp, Mus musculus
tcaaggttacatcccagtggaagga

SEQ ID NO: 762689 - DNA, 25 bp, Mus musculus
tcaaggttacatgccagtggaagga

SEQ ID NO: 762690 - DNA, 25 bp, Mus musculus
tcaaggttcctaccagatgttcttc

SEQ ID NO: 762691 - DNA, 25 bp, Mus musculus
tcaaggttcctagcagatgttcttc

SEQ ID NO: 762692 - DNA, 25 bp, Mus musculus
tcaaggttcgggacctggatgacag

SEQ ID NO: 762693 - DNA, 25 bp, Mus musculus
tcaaggttcgggtcctggatgacag

SEQ ID NO: 762694 - DNA, 25 bp, Mus musculus
tcaaggttcttcagtgtcataagcc

SEQ ID NO: 762695 - DNA, 25 bp, Mus musculus
tcaaggttcttctgtgtcataagcc

SEQ ID NO: 762696 - DNA, 25 bp, Mus musculus
tcaagtaacctcatggagcagttca

SEQ ID NO: 762697 - DNA, 25 bp, Mus musculus
tcaagtaacctcttggagcagttca

SEQ ID NO: 762698 - DNA, 25 bp, Mus musculus
tcaagtaaggcaagtctacacacca

SEQ ID NO: 762699 - DNA, 25 bp, Mus musculus
tcaagtaaggcatgtctacacacca

SEQ ID NO: 762700 - DNA, 25 bp, Mus musculus
tcaagtaagtggaacattgaggaca

SEQ ID NO: 762701 - DNA, 25 bp, Mus musculus
tcaagtaagtggtacattgaggaca

SEQ ID NO: 762702 - DNA, 25 bp, Mus musculus
tcaagtacacacacaaccagctttt

SEQ ID NO: 762703 - DNA, 25 bp, Mus musculus
tcaagtacacactcaaccagctttt

SEQ ID NO: 762704 - DNA, 25 bp, Mus musculus
tcaagtacatctagggccagcgcct

SEQ ID NO: 762705 - DNA, 25 bp, Mus musculus
tcaagtacatcttgggccagcgcct

SEQ ID NO: 762706 - DNA, 25 bp, Mus musculus
tcaagtacatgccaatttgaaggta

SEQ ID NO: 762707 - DNA, 25 bp, Mus musculus
tcaagtacatgcgaatttgaaggta

SEQ ID NO: 762708 - DNA, 25 bp, Mus musculus
tcaagtaccccgagtggaagcagaa

SEQ ID NO: 762709 - DNA, 25 bp, Mus musculus
tcaagtaccccgtgtggaagcagaa

SEQ ID NO: 762710 - DNA, 25 bp, Mus musculus
tcaagtacccgcagaactgtgcaga

SEQ ID NO: 762711 - DNA, 25 bp, Mus musculus
tcaagtacccgctgaactgtgcaga

SEQ ID NO: 762712 - DNA, 25 bp, Mus musculus
tcaagtactcataccagacccacga

SEQ ID NO: 762713 - DNA, 25 bp, Mus musculus
tcaagtactcattccagacccacga

SEQ ID NO: 762714 - DNA, 25 bp, Mus musculus
tcaagtactgcactcatagtatttc

SEQ ID NO: 762715 - DNA, 25 bp, Mus musculus
tcaagtactgcagtcatagtatttc

SEQ ID NO: 762716 - DNA, 25 bp, Mus musculus
tcaagtacttccagcaaggcatggg

SEQ ID NO: 762717 - DNA, 25 bp, Mus musculus
tcaagtacttcctgcaaggcatggg

SEQ ID NO: 762718 - DNA, 25 bp, Mus musculus
tcaagtagcagtcaccggacaaggc

SEQ ID NO: 762719 - DNA, 25 bp, Mus musculus
tcaagtagcagtgaccggacaaggc

SEQ ID NO: 762720 - DNA, 25 bp, Mus musculus
tcaagtagccaaagatttcaaagat

SEQ ID NO: 762721 - DNA, 25 bp, Mus musculus
tcaagtagccaatgatttcaaagat

SEQ ID NO: 762722 - DNA, 25 bp, Mus musculus
tcaagtagccttcccattgcagtac

SEQ ID NO: 762723 - DNA, 25 bp, Mus musculus
tcaagtagccttgccattgcagtac

SEQ ID NO: 762724 - DNA, 25 bp, Mus musculus
tcaagtagctatctcctagggaaac

SEQ ID NO: 762725 - DNA, 25 bp, Mus musculus
tcaagtagctatgtcctagggaaac

SEQ ID NO: 762726 - DNA, 25 bp, Mus musculus
tcaagtatcagcaccgccccaagag

SEQ ID NO: 762727 - DNA, 25 bp, Mus musculus
tcaagtatcagctccgccccaagag

SEQ ID NO: 762728 - DNA, 25 bp, Mus musculus
tcaagtatgccaaagacacgcgcta

SEQ ID NO: 762729 - DNA, 25 bp, Mus musculus
tcaagtatgccatagacacgcgcta

SEQ ID NO: 762730 - DNA, 25 bp, Mus musculus
tcaagtatgtgacccggtgtggcac

SEQ ID NO: 762731 - DNA, 25 bp, Mus musculus
tcaagtatgtgagccggtgtggcac

SEQ ID NO: 762732 - DNA, 25 bp, Mus musculus
tcaagtcaaaaaacatgcgtgtgct

SEQ ID NO: 762733 - DNA, 25 bp, Mus musculus
tcaagtcaaaaatcatgcgtgtgct

SEQ ID NO: 762734 - DNA, 25 bp, Mus musculus
tcaagtcaacttagtccgttcccat

SEQ ID NO: 762735 - DNA, 25 bp, Mus musculus
tcaagtcaactttgtccgttcccat

SEQ ID NO: 762736 - DNA, 25 bp, Mus musculus
tcaagtcaatggaacacgcaagggt

SEQ ID NO: 762737 - DNA, 25 bp, Mus musculus
tcaagtcaatggtacacgcaagggt

SEQ ID NO: 762738 - DNA, 25 bp, Mus musculus
tcaagtcacactatgccttccgcat

SEQ ID NO: 762739 - DNA, 25 bp, Mus musculus
tcaagtcacactttgccttccgcat

SEQ ID NO: 762740 - DNA, 25 bp, Mus musculus
tcaagtcaggtgcttcaggtcaggt

SEQ ID NO: 762741 - DNA, 25 bp, Mus musculus
tcaagtcaggtggttcaggtcaggt

SEQ ID NO: 762742 - DNA, 25 bp, Mus musculus
tcaagtcatgtgcagttttgcaaac

SEQ ID NO: 762743 - DNA, 25 bp, Mus musculus
tcaagtcatgtggagttttgcaaac

SEQ ID NO: 762744 - DNA, 25 bp, Mus musculus
tcaagtcattctcctggtcattctt

SEQ ID NO: 762745 - DNA, 25 bp, Mus musculus
tcaagtcattctgctggtcattctt

SEQ ID NO: 762746 - DNA, 25 bp, Mus musculus
tcaagtccaaacagagcaacacaga

SEQ ID NO: 762747 - DNA, 25 bp, Mus musculus
tcaagtccaaactgagcaacacaga

SEQ ID NO: 762748 - DNA, 25 bp, Mus musculus
tcaagtccatcaactcccgaaccag

SEQ ID NO: 762749 - DNA, 25 bp, Mus musculus
tcaagtccatcatctcccgaaccag

SEQ ID NO: 762750 - DNA, 25 bp, Mus musculus
tcaagtccatggaccaggacttcgg

SEQ ID NO: 762751 - DNA, 25 bp, Mus musculus
tcaagtccatggtccaggacttcgg

SEQ ID NO: 762752 - DNA, 25 bp, Mus musculus
tcaagtccccttcgcactgcaggtg

SEQ ID NO: 762753 - DNA, 25 bp, Mus musculus
tcaagtccccttggcactgcaggtg

SEQ ID NO: 762754 - DNA, 25 bp, Mus musculus
tcaagtccctaacgagcaggctcag

SEQ ID NO: 762755 - DNA, 25 bp, Mus musculus
tcaagtccctaaggagcaggctcag

SEQ ID NO: 762756 - DNA, 25 bp, Mus musculus
tcaagtccgggacaatctttgacaa

SEQ ID NO: 762757 - DNA, 25 bp, Mus musculus
tcaagtccgggagaatctttgacaa

SEQ ID NO: 762758 - DNA, 25 bp, Mus musculus
tcaagtcctactctttgtggtgggt

SEQ ID NO: 762759 - DNA, 25 bp, Mus musculus
tcaagtcctactgtttgtggtgggt

SEQ ID NO: 762760 - DNA, 25 bp, Mus musculus
tcaagtcctccacaacttcggcgta

SEQ ID NO: 762761 - DNA, 25 bp, Mus musculus
tcaagtcctccagaacttcggcgta

SEQ ID NO: 762762 - DNA, 25 bp, Mus musculus
tcaagtcctttaccgcctgaagaag

SEQ ID NO: 762763 - DNA, 25 bp, Mus musculus
tcaagtcctttagcgcctgaagaag

SEQ ID NO: 762764 - DNA, 25 bp, Mus musculus
tcaagtcctttcagtgagtctacca

SEQ ID NO: 762765 - DNA, 25 bp, Mus musculus
tcaagtcctttctgtgagtctacca

SEQ ID NO: 762766 - DNA, 25 bp, Mus musculus
tcaagtcgaatcatactggtaaaat

SEQ ID NO: 762767 - DNA, 25 bp, Mus musculus
tcaagtcgaatcttactggtaaaat

SEQ ID NO: 762768 - DNA, 25 bp, Mus musculus
tcaagtcgatgcagctggcaggacc

SEQ ID NO: 762769 - DNA, 25 bp, Mus musculus
tcaagtcgatgctgctggcaggacc

SEQ ID NO: 762770 - DNA, 25 bp, Mus musculus
tcaagtcgcaacaaggagttgacag

SEQ ID NO: 762771 - DNA, 25 bp, Mus musculus
tcaagtcgcaactaggagttgacag

SEQ ID NO: 762772 - DNA, 25 bp, Mus musculus
tcaagtctacaactctaagagtcga

SEQ ID NO: 762773 - DNA, 25 bp, Mus musculus
tcaagtctacaagtctaagagtcga

SEQ ID NO: 762774 - DNA, 25 bp, Mus musculus
tcaagtctcaacagaactgccttct

SEQ ID NO: 762775 - DNA, 25 bp, Mus musculus
tcaagtctcaactgaactgccttct

SEQ ID NO: 762776 - DNA, 25 bp, Mus musculus
tcaagtctcttgaggctcaggcgga

SEQ ID NO: 762777 - DNA, 25 bp, Mus musculus
tcaagtctcttgtggctcaggcgga

SEQ ID NO: 762778 - DNA, 25 bp, Mus musculus
tcaagtctgggacgacgcggtgtaa

SEQ ID NO: 762779 - DNA, 25 bp, Mus musculus
tcaagtctgggaggacgcggtgtaa

SEQ ID NO: 762780 - DNA, 25 bp, Mus musculus
tcaagtctgtgtacaagggcagcat

SEQ ID NO: 762781 - DNA, 25 bp, Mus musculus
tcaagtctgtgttcaagggcagcat

SEQ ID NO: 762782 - DNA, 25 bp, Mus musculus
tcaagtcttgccagaaagtgccgct

SEQ ID NO: 762783 - DNA, 25 bp, Mus musculus
tcaagtcttgcctgaaagtgccgct

SEQ ID NO: 762784 - DNA, 25 bp, Mus musculus
tcaagtcttgtacgctggcccggga

SEQ ID NO: 762785 - DNA, 25 bp, Mus musculus
tcaagtcttgtaggctggcccggga

SEQ ID NO: 762786 - DNA, 25 bp, Mus musculus
tcaagtgaactcagaccacctgcct

SEQ ID NO: 762787 - DNA, 25 bp, Mus musculus
tcaagtgaactctgaccacctgcct

SEQ ID NO: 762788 - DNA, 25 bp, Mus musculus
tcaagtgaagatcagaaaacgatac

SEQ ID NO: 762789 - DNA, 25 bp, Mus musculus
tcaagtgaagatgagaaaacgatac

SEQ ID NO: 762790 - DNA, 25 bp, Mus musculus
tcaagtgacttcatgtgatgtcagc

SEQ ID NO: 762791 - DNA, 25 bp, Mus musculus
tcaagtgacttcttgtgatgtcagc

SEQ ID NO: 762792 - DNA, 25 bp, Mus musculus
tcaagtgcaagcagaactactaaga

SEQ ID NO: 762793 - DNA, 25 bp, Mus musculus
tcaagtgcaagctgaactactaaga

SEQ ID NO: 762794 - DNA, 25 bp, Mus musculus
tcaagtgcacttcgaacaatgcccc

SEQ ID NO: 762795 - DNA, 25 bp, Mus musculus
tcaagtgcacttggaacaatgcccc

SEQ ID NO: 762796 - DNA, 25 bp, Mus musculus
tcaagtgcatcaagaatgacgcaac

SEQ ID NO: 762797 - DNA, 25 bp, Mus musculus
tcaagtgcatcatgaatgacgcaac

SEQ ID NO: 762798 - DNA, 25 bp, Mus musculus
tcaagtgcctgacacaactggttgc

SEQ ID NO: 762799 - DNA, 25 bp, Mus musculus
tcaagtgcctgagacaactggttgc

SEQ ID NO: 762800 - DNA, 25 bp, Mus musculus
tcaagtgcgcggagtgcagccagta

SEQ ID NO: 762801 - DNA, 25 bp, Mus musculus
tcaagtgcgcggtgtgcagccagta

SEQ ID NO: 762802 - DNA, 25 bp, Mus musculus
tcaagtgcggaaaagctgtggcacc

SEQ ID NO: 762803 - DNA, 25 bp, Mus musculus
tcaagtgcggaatagctgtggcacc

SEQ ID NO: 762804 - DNA, 25 bp, Mus musculus
tcaagtgctccaacctcgaagtagg

SEQ ID NO: 762805 - DNA, 25 bp, Mus musculus
tcaagtgctccatcctcgaagtagg

SEQ ID NO: 762806 - DNA, 25 bp, Mus musculus
tcaagtggaacgctgagtcgtgcct

SEQ ID NO: 762807 - DNA, 25 bp, Mus musculus
tcaagtggaacggtgagtcgtgcct

SEQ ID NO: 762808 - DNA, 25 bp, Mus musculus
tcaagtggagctacatgaataagcc

SEQ ID NO: 762809 - DNA, 25 bp, Mus musculus
tcaagtggagcttcatgaataagcc

SEQ ID NO: 762810 - DNA, 25 bp, Mus musculus
tcaagtggatggacaccaccgcttg

SEQ ID NO: 762811 - DNA, 25 bp, Mus musculus
tcaagtggatggtcaccaccgcttg

SEQ ID NO: 762812 - DNA, 25 bp, Mus musculus
tcaagtggcaggacttcaagtggct

SEQ ID NO: 762813 - DNA, 25 bp, Mus musculus
tcaagtggcaggtcttcaagtggct

SEQ ID NO: 762814 - DNA, 25 bp, Mus musculus
tcaagtggcccacctctacatgatc

SEQ ID NO: 762815 - DNA, 25 bp, Mus musculus
tcaagtggcccagctctacatgatc

SEQ ID NO: 762816 - DNA, 25 bp, Mus musculus
tcaagtggccgaactgaagaattca

SEQ ID NO: 762817 - DNA, 25 bp, Mus musculus
tcaagtggccgatctgaagaattca

SEQ ID NO: 762818 - DNA, 25 bp, Mus musculus
tcaagtggctgaagtacatcgtcta

SEQ ID NO: 762819 - DNA, 25 bp, Mus musculus
tcaagtggctgaatgcgcagcaggt

SEQ ID NO: 762820 - DNA, 25 bp, Mus musculus
tcaagtggctgaatggactcaaaag

SEQ ID NO: 762821 - DNA, 25 bp, Mus musculus
tcaagtggctgatgtacatcgtcta

SEQ ID NO: 762822 - DNA, 25 bp, Mus musculus
tcaagtggctgattgcgcagcaggt

SEQ ID NO: 762823 - DNA, 25 bp, Mus musculus
tcaagtggctgattggactcaaaag

SEQ ID NO: 762824 - DNA, 25 bp, Mus musculus
tcaagtggctgtaccagcgagatcc

SEQ ID NO: 762825 - DNA, 25 bp, Mus musculus
tcaagtggctgttccagcgagatcc

SEQ ID NO: 762826 - DNA, 25 bp, Mus musculus
tcaagtggttctaggaggatgagaa

SEQ ID NO: 762827 - DNA, 25 bp, Mus musculus
tcaagtggttcttggaggatgagaa

SEQ ID NO: 762828 - DNA, 25 bp, Mus musculus
tcaagtgtaatgctgatgcaaaccc

SEQ ID NO: 762829 - DNA, 25 bp, Mus musculus
tcaagtgtaatggtgatgcaaaccc

SEQ ID NO: 762830 - DNA, 25 bp, Mus musculus
tcaagtgtcaagactaaagctgctg

SEQ ID NO: 762831 - DNA, 25 bp, Mus musculus
tcaagtgtcaagtctaaagctgctg

SEQ ID NO: 762832 - DNA, 25 bp, Mus musculus
tcaagtgtcctacctgccgtaagga

SEQ ID NO: 762833 - DNA, 25 bp, Mus musculus
tcaagtgtcctagctgccgtaagga

SEQ ID NO: 762834 - DNA, 25 bp, Mus musculus
tcaagtgtggagcttcataaggtca

SEQ ID NO: 762835 - DNA, 25 bp, Mus musculus
tcaagtgtggaggttcataaggtca

SEQ ID NO: 762836 - DNA, 25 bp, Mus musculus
tcaagttacttcagattggcgattc

SEQ ID NO: 762837 - DNA, 25 bp, Mus musculus
tcaagttacttctgattggcgattc

SEQ ID NO: 762838 - DNA, 25 bp, Mus musculus
tcaagttcaccaaggatctgccgct

SEQ ID NO: 762839 - DNA, 25 bp, Mus musculus
tcaagttcaccatggatctgccgct

SEQ ID NO: 762840 - DNA, 25 bp, Mus musculus
tcaagttcccctattatgtgggagc

SEQ ID NO: 762841 - DNA, 25 bp, Mus musculus
tcaagttccccttttatgtgggagc

SEQ ID NO: 762842 - DNA, 25 bp, Mus musculus
tcaagttcctgaaagaggcagggcg

SEQ ID NO: 762843 - DNA, 25 bp, Mus musculus
tcaagttcctgatagaggcagggcg

SEQ ID NO: 762844 - DNA, 25 bp, Mus musculus
tcaagttctaatactcaaagggcag

SEQ ID NO: 762845 - DNA, 25 bp, Mus musculus
tcaagttctaattctcaaagggcag

SEQ ID NO: 762846 - DNA, 25 bp, Mus musculus
tcaagttctccaagaatgagacctg

SEQ ID NO: 762847 - DNA, 25 bp, Mus musculus
tcaagttctccatgaatgagacctg

SEQ ID NO: 762848 - DNA, 25 bp, Mus musculus
tcaagttctcggcaaagcagcaggc

SEQ ID NO: 762849 - DNA, 25 bp, Mus musculus
tcaagttctcgggaaagcagcaggc

SEQ ID NO: 762850 - DNA, 25 bp, Mus musculus
tcaagttctgataatgctatgtaca

SEQ ID NO: 762851 - DNA, 25 bp, Mus musculus
tcaagttctgattatgctatgtaca

SEQ ID NO: 762852 - DNA, 25 bp, Mus musculus
tcaagttcttccacgagaatgagct

SEQ ID NO: 762853 - DNA, 25 bp, Mus musculus
tcaagttcttcctcgagaatgagct

SEQ ID NO: 762854 - DNA, 25 bp, Mus musculus
tcaagttgaaccagtgggaagatgg

SEQ ID NO: 762855 - DNA, 25 bp, Mus musculus
tcaagttgaacctgtgggaagatgg

SEQ ID NO: 762856 - DNA, 25 bp, Mus musculus
tcaagttgaactaccaccatttgtt

SEQ ID NO: 762857 - DNA, 25 bp, Mus musculus
tcaagttgaacttccaccatttgtt

SEQ ID NO: 762858 - DNA, 25 bp, Mus musculus
tcaagttgcattagaaaaagcagaa

SEQ ID NO: 762859 - DNA, 25 bp, Mus musculus
tcaagttgcatttgaaaaagcagaa

SEQ ID NO: 762860 - DNA, 25 bp, Mus musculus
tcaagttggcgacacattccaagtt

SEQ ID NO: 762861 - DNA, 25 bp, Mus musculus
tcaagttggcgagacattccaagtt

SEQ ID NO: 762862 - DNA, 25 bp, Mus musculus
tcaagttgggaaatctcctccagaa

SEQ ID NO: 762863 - DNA, 25 bp, Mus musculus
tcaagttgggaattctcctccagaa

SEQ ID NO: 762864 - DNA, 25 bp, Mus musculus
tcaagttgtccccttctctgtggtg

SEQ ID NO: 762865 - DNA, 25 bp, Mus musculus
tcaagttgtcccgttctctgtggtg

SEQ ID NO: 762866 - DNA, 25 bp, Mus musculus
tcaagtttaccccaggctcagctgg

SEQ ID NO: 762867 - DNA, 25 bp, Mus musculus
tcaagtttacccgaggctcagctgg

SEQ ID NO: 762868 - DNA, 25 bp, Mus musculus
tcaagtttcacgctgaccgaacaag

SEQ ID NO: 762869 - DNA, 25 bp, Mus musculus
tcaagtttcacggtgaccgaacaag

SEQ ID NO: 762870 - DNA, 25 bp, Mus musculus
tcaagtttgggaagcattgccacaa

SEQ ID NO: 762871 - DNA, 25 bp, Mus musculus
tcaagtttgggatgcattgccacaa

SEQ ID NO: 762872 - DNA, 25 bp, Mus musculus
tcaagtttgtggacctggcagaccc

SEQ ID NO: 762873 - DNA, 25 bp, Mus musculus
tcaagtttgtggtcctggcagaccc

SEQ ID NO: 762874 - DNA, 25 bp, Mus musculus
tcaagttttggcattgaaagaatgc

SEQ ID NO: 762875 - DNA, 25 bp, Mus musculus
tcaagttttggctttgaaagaatgc

SEQ ID NO: 762876 - DNA, 25 bp, Mus musculus
tcaagttttgggagatcaccgcagg

SEQ ID NO: 762877 - DNA, 25 bp, Mus musculus
tcaagttttgggtgatcaccgcagg

SEQ ID NO: 762878 - DNA, 25 bp, Mus musculus
tcaataaacttaagatggaagactc

SEQ ID NO: 762879 - DNA, 25 bp, Mus musculus
tcaataaacttatgatggaagactc

SEQ ID NO: 762880 - DNA, 25 bp, Mus musculus
tcaataaagagacagtgcccttcgt

SEQ ID NO: 762881 - DNA, 25 bp, Mus musculus
tcaataaagagagagtgcccttcgt

SEQ ID NO: 762882 - DNA, 25 bp, Mus musculus
tcaataaatgaaaaggtgccgcagc

SEQ ID NO: 762883 - DNA, 25 bp, Mus musculus
tcaataaatgaataggtgccgcagc

SEQ ID NO: 762884 - DNA, 25 bp, Mus musculus
tcaataacttcaagggtctgggtca

SEQ ID NO: 762885 - DNA, 25 bp, Mus musculus
tcaataacttcatgggtctgggtca

SEQ ID NO: 762886 - DNA, 25 bp, Mus musculus
tcaataacttggagaaaacaggcca

SEQ ID NO: 762887 - DNA, 25 bp, Mus musculus
tcaataacttggtgaaaacaggcca

SEQ ID NO: 762888 - DNA, 25 bp, Mus musculus
tcaataaggaaccaaaatggctttt

SEQ ID NO: 762889 - DNA, 25 bp, Mus musculus
tcaataaggaacgaaaatggctttt

SEQ ID NO: 762890 - DNA, 25 bp, Mus musculus
tcaataataaatagccaagaaaagc

SEQ ID NO: 762891 - DNA, 25 bp, Mus musculus
tcaataataaattgccaagaaaagc

SEQ ID NO: 762892 - DNA, 25 bp, Mus musculus
tcaataattccaactatgaagaagg

SEQ ID NO: 762893 - DNA, 25 bp, Mus musculus
tcaataattccatctatgaagaagg

SEQ ID NO: 762894 - DNA, 25 bp, Mus musculus
tcaatacatcacaattactttaggg

SEQ ID NO: 762895 - DNA, 25 bp, Mus musculus
tcaatacatcactattactttaggg

SEQ ID NO: 762896 - DNA, 25 bp, Mus musculus
tcaataccaggaacgacgacctcca

SEQ ID NO: 762897 - DNA, 25 bp, Mus musculus
tcaataccaggatcgacgacctcca

SEQ ID NO: 762898 - DNA, 25 bp, Mus musculus
tcaataccgaaacggaagcggcaag

SEQ ID NO: 762899 - DNA, 25 bp, Mus musculus
tcaataccgaaagggaagcggcaag

SEQ ID NO: 762900 - DNA, 25 bp, Mus musculus
tcaataccttgaaaaaggacctgtg

SEQ ID NO: 762901 - DNA, 25 bp, Mus musculus
tcaataccttgataaaggacctgtg

SEQ ID NO: 762902 - DNA, 25 bp, Mus musculus
tcaatagaatgcatcgacttccgaa

SEQ ID NO: 762903 - DNA, 25 bp, Mus musculus
tcaatagaatgcttcgacttccgaa

SEQ ID NO: 762904 - DNA, 25 bp, Mus musculus
tcaatagagacaaggcgggagacca

SEQ ID NO: 762905 - DNA, 25 bp, Mus musculus
tcaatagagacatggcgggagacca

SEQ ID NO: 762906 - DNA, 25 bp, Mus musculus
tcaatagagttacagcttaaaaagt

SEQ ID NO: 762907 - DNA, 25 bp, Mus musculus
tcaatagagttagagcttaaaaagt

SEQ ID NO: 762908 - DNA, 25 bp, Mus musculus
tcaatagatcttcataatccacagg

SEQ ID NO: 762909 - DNA, 25 bp, Mus musculus
tcaatagatcttgataatccacagg

SEQ ID NO: 762910 - DNA, 25 bp, Mus musculus
tcaatagctcggaggtagaggtctt

SEQ ID NO: 762911 - DNA, 25 bp, Mus musculus
tcaatagctcggtggtagaggtctt

SEQ ID NO: 762912 - DNA, 25 bp, Mus musculus
tcaatagggccacagaccgattggt

SEQ ID NO: 762913 - DNA, 25 bp, Mus musculus
tcaatagggccagagaccgattggt

SEQ ID NO: 762914 - DNA, 25 bp, Mus musculus
tcaatagtatcaagaagctctccac

SEQ ID NO: 762915 - DNA, 25 bp, Mus musculus
tcaatagtatcatgaagctctccac

SEQ ID NO: 762916 - DNA, 25 bp, Mus musculus
tcaatagtcaggagcacttgctgcc

SEQ ID NO: 762917 - DNA, 25 bp, Mus musculus
tcaatagtcaggtgcacttgctgcc

SEQ ID NO: 762918 - DNA, 25 bp, Mus musculus
tcaatagtctgaagctggatctggg

SEQ ID NO: 762919 - DNA, 25 bp, Mus musculus
tcaatagtctgatgctggatctggg

SEQ ID NO: 762920 - DNA, 25 bp, Mus musculus
tcaatatactttcctatgtataccc

SEQ ID NO: 762921 - DNA, 25 bp, Mus musculus
tcaatatactttgctatgtataccc

SEQ ID NO: 762922 - DNA, 25 bp, Mus musculus
tcaatatcacacaatgcagactggc

SEQ ID NO: 762923 - DNA, 25 bp, Mus musculus
tcaatatcacactatgcagactggc

SEQ ID NO: 762924 - DNA, 25 bp, Mus musculus
tcaatatccacgagctggcagagcg

SEQ ID NO: 762925 - DNA, 25 bp, Mus musculus
tcaatatccacgtgctggcagagcg

SEQ ID NO: 762926 - DNA, 25 bp, Mus musculus
tcaatatccctcacctggtactggg

SEQ ID NO: 762927 - DNA, 25 bp, Mus musculus
tcaatatccctctcctggtactggg

SEQ ID NO: 762928 - DNA, 25 bp, Mus musculus
tcaatatctacaaacagcagttggg

SEQ ID NO: 762929 - DNA, 25 bp, Mus musculus
tcaatatctacatacagcagttggg

SEQ ID NO: 762930 - DNA, 25 bp, Mus musculus
tcaatattggatatgcaacggcagt

SEQ ID NO: 762931 - DNA, 25 bp, Mus musculus
tcaatattggatttgcaacggcagt

SEQ ID NO: 762932 - DNA, 25 bp, Mus musculus
tcaatcaaaattagccactgctttg

SEQ ID NO: 762933 - DNA, 25 bp, Mus musculus
tcaatcaaaatttgccactgctttg

SEQ ID NO: 762934 - DNA, 25 bp, Mus musculus
tcaatcaagaccctgaacaagaaga

SEQ ID NO: 762935 - DNA, 25 bp, Mus musculus
tcaatcaagaccgtgaacaagaaga

SEQ ID NO: 762936 - DNA, 25 bp, Mus musculus
tcaatcaagcagcaggacaagtgtc

SEQ ID NO: 762937 - DNA, 25 bp, Mus musculus
tcaatcaagcaggaggacaagtgtc

SEQ ID NO: 762938 - DNA, 25 bp, Mus musculus
tcaatcaatatgctaagtggtggat

SEQ ID NO: 762939 - DNA, 25 bp, Mus musculus
tcaatcaatatggtaagtggtggat

SEQ ID NO: 762940 - DNA, 25 bp, Mus musculus
tcaatcacaacgacttaggaggctg

SEQ ID NO: 762941 - DNA, 25 bp, Mus musculus
tcaatcacaacgcagaacatcggtg

SEQ ID NO: 762942 - DNA, 25 bp, Mus musculus
tcaatcacaacggagaacatcggtg

SEQ ID NO: 762943 - DNA, 25 bp, Mus musculus
tcaatcacaacgtcttaggaggctg

SEQ ID NO: 762944 - DNA, 25 bp, Mus musculus
tcaatcagacggcaggctacagtga

SEQ ID NO: 762945 - DNA, 25 bp, Mus musculus
tcaatcagacgggaggctacagtga

SEQ ID NO: 762946 - DNA, 25 bp, Mus musculus
tcaatcagctacaagccctgcagac

SEQ ID NO: 762947 - DNA, 25 bp, Mus musculus
tcaatcagctactagccctgcagac

SEQ ID NO: 762948 - DNA, 25 bp, Mus musculus
tcaatcagtgagctcatccaagtcc

SEQ ID NO: 762949 - DNA, 25 bp, Mus musculus
tcaatcagtgaggtcatccaagtcc

SEQ ID NO: 762950 - DNA, 25 bp, Mus musculus
tcaatcatattcctggtcggcgtgg

SEQ ID NO: 762951 - DNA, 25 bp, Mus musculus
tcaatcatattcgtggtcggcgtgg

SEQ ID NO: 762952 - DNA, 25 bp, Mus musculus
tcaatccacatgatcttgccagagt

SEQ ID NO: 762953 - DNA, 25 bp, Mus musculus
tcaatccacatgttcttgccagagt

SEQ ID NO: 762954 - DNA, 25 bp, Mus musculus
tcaatccaggagagtgaaaacttat

SEQ ID NO: 762955 - DNA, 25 bp, Mus musculus
tcaatccaggagtgtgaaaacttat

SEQ ID NO: 762956 - DNA, 25 bp, Mus musculus
tcaatccatagaagtcttggacagg

SEQ ID NO: 762957 - DNA, 25 bp, Mus musculus
tcaatccatagatgtcttggacagg

SEQ ID NO: 762958 - DNA, 25 bp, Mus musculus
tcaatccatcgcaaacgtatgccag

SEQ ID NO: 762959 - DNA, 25 bp, Mus musculus
tcaatccatcgctaacgtatgccag

SEQ ID NO: 762960 - DNA, 25 bp, Mus musculus
tcaatcccagaaatcacgcagcggg

SEQ ID NO: 762961 - DNA, 25 bp, Mus musculus
tcaatcccagaattcacgcagcggg

SEQ ID NO: 762962 - DNA, 25 bp, Mus musculus
tcaatcccgaaaacgaaagcgcagc

SEQ ID NO: 762963 - DNA, 25 bp, Mus musculus
tcaatcccgaaatcgaaagcgcagc

SEQ ID NO: 762964 - DNA, 25 bp, Mus musculus
tcaatccgtcctaggcttccagcag

SEQ ID NO: 762965 - DNA, 25 bp, Mus musculus
tcaatccgtccttggcttccagcag

SEQ ID NO: 762966 - DNA, 25 bp, Mus musculus
tcaatcgaagatcacgtctgccagc

SEQ ID NO: 762967 - DNA, 25 bp, Mus musculus
tcaatcgaagatgacgtctgccagc

SEQ ID NO: 762968 - DNA, 25 bp, Mus musculus
tcaatcggcccaccaaaaagaatgc

SEQ ID NO: 762969 - DNA, 25 bp, Mus musculus
tcaatcggcccagcaaaaagaatgc

SEQ ID NO: 762970 - DNA, 25 bp, Mus musculus
tcaatctagatgagtttgagtctca

SEQ ID NO: 762971 - DNA, 25 bp, Mus musculus
tcaatctagatgtgtttgagtctca

SEQ ID NO: 762972 - DNA, 25 bp, Mus musculus
tcaatctaggtaccagcaaacagca

SEQ ID NO: 762973 - DNA, 25 bp, Mus musculus
tcaatctaggtagcagcaaacagca

SEQ ID NO: 762974 - DNA, 25 bp, Mus musculus
tcaatctcagcaatcgaggacatgg

SEQ ID NO: 762975 - DNA, 25 bp, Mus musculus
tcaatctcagcattcgaggacatgg

SEQ ID NO: 762976 - DNA, 25 bp, Mus musculus
tcaatctcatcccactgaggacagc

SEQ ID NO: 762977 - DNA, 25 bp, Mus musculus
tcaatctcatccgactgaggacagc

SEQ ID NO: 762978 - DNA, 25 bp, Mus musculus
tcaatctcatggctgtaaaagtggg

SEQ ID NO: 762979 - DNA, 25 bp, Mus musculus
tcaatctcatgggtgtaaaagtggg

SEQ ID NO: 762980 - DNA, 25 bp, Mus musculus
tcaatctcctagagacagtgttctt

SEQ ID NO: 762981 - DNA, 25 bp, Mus musculus
tcaatctcctagtgacagtgttctt

SEQ ID NO: 762982 - DNA, 25 bp, Mus musculus
tcaatctcctgtaccttggctatcc

SEQ ID NO: 762983 - DNA, 25 bp, Mus musculus
tcaatctcctgttccttggctatcc

SEQ ID NO: 762984 - DNA, 25 bp, Mus musculus
tcaatctcctttcggactgctcaga

SEQ ID NO: 762985 - DNA, 25 bp, Mus musculus
tcaatctcctttgggactgctcaga

SEQ ID NO: 762986 - DNA, 25 bp, Mus musculus
tcaatctcggatcaagggagatact

SEQ ID NO: 762987 - DNA, 25 bp, Mus musculus
tcaatctcggatgaagggagatact

SEQ ID NO: 762988 - DNA, 25 bp, Mus musculus
tcaatctctttgaggtgacccaggg

SEQ ID NO: 762989 - DNA, 25 bp, Mus musculus
tcaatctctttgtggtgacccaggg

SEQ ID NO: 762990 - DNA, 25 bp, Mus musculus
tcaatctgcgctagccccgtatctt

SEQ ID NO: 762991 - DNA, 25 bp, Mus musculus
tcaatctgcgcttgccccgtatctt

SEQ ID NO: 762992 - DNA, 25 bp, Mus musculus
tcaatctggtgacagatggtctgcc

SEQ ID NO: 762993 - DNA, 25 bp, Mus musculus
tcaatctggtgagagatggtctgcc

SEQ ID NO: 762994 - DNA, 25 bp, Mus musculus
tcaatcttgtaacaataaaccgggt

SEQ ID NO: 762995 - DNA, 25 bp, Mus musculus
tcaatcttgtaagaataaaccgggt

SEQ ID NO: 762996 - DNA, 25 bp, Mus musculus
tcaatctttatgcacttctacatgg

SEQ ID NO: 762997 - DNA, 25 bp, Mus musculus
tcaatctttatggacttctacatgg

SEQ ID NO: 762998 - DNA, 25 bp, Mus musculus
tcaatgaaaaccacccagaatccat

SEQ ID NO: 762999 - DNA, 25 bp, Mus musculus
tcaatgaaaacctcccagaatccat

SEQ ID NO: 763000 - DNA, 25 bp, Mus musculus
tcaatgaacgagacaactgccagta

SEQ ID NO: 763001 - DNA, 25 bp, Mus musculus
tcaatgaacgagtcaactgccagta

SEQ ID NO: 763002 - DNA, 25 bp, Mus musculus
tcaatgaagtctacatctccctgct

SEQ ID NO: 763003 - DNA, 25 bp, Mus musculus
tcaatgaagtcttcatctccctgct

SEQ ID NO: 763004 - DNA, 25 bp, Mus musculus
tcaatgaatgtgagcaccgaaacca

SEQ ID NO: 763005 - DNA, 25 bp, Mus musculus
tcaatgaatgtgtgcaccgaaacca

SEQ ID NO: 763006 - DNA, 25 bp, Mus musculus
tcaatgaccggcagcgggagcagct

SEQ ID NO: 763007 - DNA, 25 bp, Mus musculus
tcaatgaccggctgcgggagcagct

SEQ ID NO: 763008 - DNA, 25 bp, Mus musculus
tcaatgacctcaagcaactcacagc

SEQ ID NO: 763009 - DNA, 25 bp, Mus musculus
tcaatgacctcatgcaactcacagc

SEQ ID NO: 763010 - DNA, 25 bp, Mus musculus
tcaatgacctccagaaacaggtggg

SEQ ID NO: 763011 - DNA, 25 bp, Mus musculus
tcaatgacctcctgaaacaggtggg

SEQ ID NO: 763012 - DNA, 25 bp, Mus musculus
tcaatgacgaccaggataaagccta

SEQ ID NO: 763013 - DNA, 25 bp, Mus musculus
tcaatgacgacctggataaagccta

SEQ ID NO: 763014 - DNA, 25 bp, Mus musculus
tcaatgacgactactcacaggtggc

SEQ ID NO: 763015 - DNA, 25 bp, Mus musculus
tcaatgacgacttctcacaggtggc

SEQ ID NO: 763016 - DNA, 25 bp, Mus musculus
tcaatgactcagacgatggcgacgt

SEQ ID NO: 763017 - DNA, 25 bp, Mus musculus
tcaatgactcagtcgatggcgacgt

SEQ ID NO: 763018 - DNA, 25 bp, Mus musculus
tcaatgactggactaaggagaaaca

SEQ ID NO: 763019 - DNA, 25 bp, Mus musculus
tcaatgactggagtaaggagaaaca

SEQ ID NO: 763020 - DNA, 25 bp, Mus musculus
tcaatgagatgtatcgagaggtgga

SEQ ID NO: 763021 - DNA, 25 bp, Mus musculus
tcaatgagatgtttcgagaggtgga

SEQ ID NO: 763022 - DNA, 25 bp, Mus musculus
tcaatgagcgctatgaaaatgtcca

SEQ ID NO: 763023 - DNA, 25 bp, Mus musculus
tcaatgagcgctttgaaaatgtcca

SEQ ID NO: 763024 - DNA, 25 bp, Mus musculus
tcaatgagctgcacaaattcagtcc

SEQ ID NO: 763025 - DNA, 25 bp, Mus musculus
tcaatgagctgctcaaattcagtcc

SEQ ID NO: 763026 - DNA, 25 bp, Mus musculus
tcaatgagtccccacagatggcctg

SEQ ID NO: 763027 - DNA, 25 bp, Mus musculus
tcaatgagtcccgacagatggcctg

SEQ ID NO: 763028 - DNA, 25 bp, Mus musculus
tcaatgagtcctaattaagcactag

SEQ ID NO: 763029 - DNA, 25 bp, Mus musculus
tcaatgagtccttattaagcactag

SEQ ID NO: 763030 - DNA, 25 bp, Mus musculus
tcaatgagtgcacctctaatccctg

SEQ ID NO: 763031 - DNA, 25 bp, Mus musculus
tcaatgagtgcagctctaatccctg

SEQ ID NO: 763032 - DNA, 25 bp, Mus musculus
tcaatgagtgtgcagtcacgagcag

SEQ ID NO: 763033 - DNA, 25 bp, Mus musculus
tcaatgagtgtggagtcacgagcag

SEQ ID NO: 763034 - DNA, 25 bp, Mus musculus
tcaatgagttgtacagtcttctgcg

SEQ ID NO: 763035 - DNA, 25 bp, Mus musculus
tcaatgagttgttcagtcttctgcg

SEQ ID NO: 763036 - DNA, 25 bp, Mus musculus
tcaatgatctgcacaacttcaatga

SEQ ID NO: 763037 - DNA, 25 bp, Mus musculus
tcaatgatctgctcaacttcaatga

SEQ ID NO: 763038 - DNA, 25 bp, Mus musculus
tcaatgatgcccagcgacaagcaac

SEQ ID NO: 763039 - DNA, 25 bp, Mus musculus
tcaatgatgccctgcgacaagcaac

SEQ ID NO: 763040 - DNA, 25 bp, Mus musculus
tcaatgatggtgcatccaaccaatg

SEQ ID NO: 763041 - DNA, 25 bp, Mus musculus
tcaatgatggtggatccaaccaatg

SEQ ID NO: 763042 - DNA, 25 bp, Mus musculus
tcaatgcaagacacaaacttggctg

SEQ ID NO: 763043 - DNA, 25 bp, Mus musculus
tcaatgcaagactcaaacttggctg

SEQ ID NO: 763044 - DNA, 25 bp, Mus musculus
tcaatgcactagacaactcggaaaa

SEQ ID NO: 763045 - DNA, 25 bp, Mus musculus
tcaatgcactagtcaactcggaaaa

SEQ ID NO: 763046 - DNA, 25 bp, Mus musculus
tcaatgcagaggaagatcagccgct

SEQ ID NO: 763047 - DNA, 25 bp, Mus musculus
tcaatgcagaggtagatcagccgct

SEQ ID NO: 763048 - DNA, 25 bp, Mus musculus
tcaatgcataagcttatggataagt

SEQ ID NO: 763049 - DNA, 25 bp, Mus musculus
tcaatgcataaggttatggataagt

SEQ ID NO: 763050 - DNA, 25 bp, Mus musculus
tcaatgcatgaacaccttagggtgg

SEQ ID NO: 763051 - DNA, 25 bp, Mus musculus
tcaatgcatgaagaccttagggtgg

SEQ ID NO: 763052 - DNA, 25 bp, Mus musculus
tcaatgcattcgacacggaccacaa

SEQ ID NO: 763053 - DNA, 25 bp, Mus musculus
tcaatgcattcgtcacggaccacaa

SEQ ID NO: 763054 - DNA, 25 bp, Mus musculus
tcaatgccacccaggcagaaagcaa

SEQ ID NO: 763055 - DNA, 25 bp, Mus musculus
tcaatgccaccctggcagaaagcaa

SEQ ID NO: 763056 - DNA, 25 bp, Mus musculus
tcaatgccagtgacgtgctgtcagc

SEQ ID NO: 763057 - DNA, 25 bp, Mus musculus
tcaatgccagtgtcgtgctgtcagc

SEQ ID NO: 763058 - DNA, 25 bp, Mus musculus
tcaatgccagttcggtctgcagaac

SEQ ID NO: 763059 - DNA, 25 bp, Mus musculus
tcaatgccagttgggtctgcagaac

SEQ ID NO: 763060 - DNA, 25 bp, Mus musculus
tcaatgcccgcaagtagacagtggt

SEQ ID NO: 763061 - DNA, 25 bp, Mus musculus
tcaatgcccgcatgtagacagtggt

SEQ ID NO: 763062 - DNA, 25 bp, Mus musculus
tcaatgccctgcagaagtgcacatg

SEQ ID NO: 763063 - DNA, 25 bp, Mus musculus
tcaatgccctgctgaagtgcacatg

SEQ ID NO: 763064 - DNA, 25 bp, Mus musculus
tcaatgcctactatctgcccaacaa

SEQ ID NO: 763065 - DNA, 25 bp, Mus musculus
tcaatgcctactttctgcccaacaa

SEQ ID NO: 763066 - DNA, 25 bp, Mus musculus
tcaatgcctctgcaaaacatgtccc

SEQ ID NO: 763067 - DNA, 25 bp, Mus musculus
tcaatgcctctggaaaacatgtccc

SEQ ID NO: 763068 - DNA, 25 bp, Mus musculus
tcaatgctaggacacagggcaggta

SEQ ID NO: 763069 - DNA, 25 bp, Mus musculus
tcaatgctaggagacagggcaggta

SEQ ID NO: 763070 - DNA, 25 bp, Mus musculus
tcaatgctcgccagggcatttctac

SEQ ID NO: 763071 - DNA, 25 bp, Mus musculus
tcaatgctcgcctgggcatttctac

SEQ ID NO: 763072 - DNA, 25 bp, Mus musculus
tcaatgctgccaatgtcaccgacca

SEQ ID NO: 763073 - DNA, 25 bp, Mus musculus
tcaatgctgccattgtcaccgacca

SEQ ID NO: 763074 - DNA, 25 bp, Mus musculus
tcaatgctgggcacctatttgtcca

SEQ ID NO: 763075 - DNA, 25 bp, Mus musculus
tcaatgctgggctcctatttgtcca

SEQ ID NO: 763076 - DNA, 25 bp, Mus musculus
tcaatgctgtcccaccaagacttgt

SEQ ID NO: 763077 - DNA, 25 bp, Mus musculus
tcaatgctgtccgaccaagacttgt

SEQ ID NO: 763078 - DNA, 25 bp, Mus musculus
tcaatgctgtggacctgctgatcct

SEQ ID NO: 763079 - DNA, 25 bp, Mus musculus
tcaatgctgtggtcctgctgatcct

SEQ ID NO: 763080 - DNA, 25 bp, Mus musculus
tcaatgcttaagaacccagatagtc

SEQ ID NO: 763081 - DNA, 25 bp, Mus musculus
tcaatgcttaagtacccagatagtc

SEQ ID NO: 763082 - DNA, 25 bp, Mus musculus
tcaatggaatctatgagcagctggg

SEQ ID NO: 763083 - DNA, 25 bp, Mus musculus
tcaatggaatctttgagcagctggg

SEQ ID NO: 763084 - DNA, 25 bp, Mus musculus
tcaatggaattaatacactaggaga

SEQ ID NO: 763085 - DNA, 25 bp, Mus musculus
tcaatggaattattacactaggaga

SEQ ID NO: 763086 - DNA, 25 bp, Mus musculus
tcaatggacataccacaaagcaaga

SEQ ID NO: 763087 - DNA, 25 bp, Mus musculus
tcaatggacatagcacaaagcaaga

SEQ ID NO: 763088 - DNA, 25 bp, Mus musculus
tcaatggacttcacaacccagatcc

SEQ ID NO: 763089 - DNA, 25 bp, Mus musculus
tcaatggacttctcaacccagatcc

SEQ ID NO: 763090 - DNA, 25 bp, Mus musculus
tcaatggagatcatccagaagttcc

SEQ ID NO: 763091 - DNA, 25 bp, Mus musculus
tcaatggagatcttccagaagttcc

SEQ ID NO: 763092 - DNA, 25 bp, Mus musculus
tcaatggagcacatacagggagctt

SEQ ID NO: 763093 - DNA, 25 bp, Mus musculus
tcaatggagcacttacagggagctt

SEQ ID NO: 763094 - DNA, 25 bp, Mus musculus
tcaatggagcccagtgcaaggccgt

SEQ ID NO: 763095 - DNA, 25 bp, Mus musculus
tcaatggagccctgtgcaaggccgt

SEQ ID NO: 763096 - DNA, 25 bp, Mus musculus
tcaatggaggctccttcttcccgga

SEQ ID NO: 763097 - DNA, 25 bp, Mus musculus
tcaatggaggctgcttcttcccgga

SEQ ID NO: 763098 - DNA, 25 bp, Mus musculus
tcaatggattctcgacttcaaagga

SEQ ID NO: 763099 - DNA, 25 bp, Mus musculus
tcaatggattctggacttcaaagga

SEQ ID NO: 763100 - DNA, 25 bp, Mus musculus
tcaatggcaagcaggcgctgtctaa

SEQ ID NO: 763101 - DNA, 25 bp, Mus musculus
tcaatggcaagctggcgctgtctaa

SEQ ID NO: 763102 - DNA, 25 bp, Mus musculus
tcaatggcaaggagccatcccgtgg

SEQ ID NO: 763103 - DNA, 25 bp, Mus musculus
tcaatggcaaggtgccatcccgtgg

SEQ ID NO: 763104 - DNA, 25 bp, Mus musculus
tcaatggcagctccttagagccctg

SEQ ID NO: 763105 - DNA, 25 bp, Mus musculus
tcaatggcagctgcttagagccctg

SEQ ID NO: 763106 - DNA, 25 bp, Mus musculus
tcaatggcatggacgtgaatggcaa

SEQ ID NO: 763107 - DNA, 25 bp, Mus musculus
tcaatggcatggtcgtgaatggcaa

SEQ ID NO: 763108 - DNA, 25 bp, Mus musculus
tcaatggccctaattaccacaaggg

SEQ ID NO: 763109 - DNA, 25 bp, Mus musculus
tcaatggccctatttaccacaaggg

SEQ ID NO: 763110 - DNA, 25 bp, Mus musculus
tcaatgggacagacgatgagagaac

SEQ ID NO: 763111 - DNA, 25 bp, Mus musculus
tcaatgggacagtcgatgagagaac

SEQ ID NO: 763112 - DNA, 25 bp, Mus musculus
tcaatgggagaaataaggatgcaag

SEQ ID NO: 763113 - DNA, 25 bp, Mus musculus
tcaatgggagaattaaggatgcaag

SEQ ID NO: 763114 - DNA, 25 bp, Mus musculus
tcaatgggcccccaagagagctgcg

SEQ ID NO: 763115 - DNA, 25 bp, Mus musculus
tcaatgggccccgaagagagctgcg

SEQ ID NO: 763116 - DNA, 25 bp, Mus musculus
tcaatgtacctaagcttgggcaaga

SEQ ID NO: 763117 - DNA, 25 bp, Mus musculus
tcaatgtacctatgcttgggcaaga

SEQ ID NO: 763118 - DNA, 25 bp, Mus musculus
tcaatgtacctccacccagagggct

SEQ ID NO: 763119 - DNA, 25 bp, Mus musculus
tcaatgtacctcgacccagagggct

SEQ ID NO: 763120 - DNA, 25 bp, Mus musculus
tcaatgtatctaaagggctctagaa

SEQ ID NO: 763121 - DNA, 25 bp, Mus musculus
tcaatgtatctatagggctctagaa

SEQ ID NO: 763122 - DNA, 25 bp, Mus musculus
tcaatgtattccatcgccttcggca

SEQ ID NO: 763123 - DNA, 25 bp, Mus musculus
tcaatgtattccttcgccttcggca

SEQ ID NO: 763124 - DNA, 25 bp, Mus musculus
tcaatgtcaaccagaggcgggagcc

SEQ ID NO: 763125 - DNA, 25 bp, Mus musculus
tcaatgtcaacctgaggcgggagcc

SEQ ID NO: 763126 - DNA, 25 bp, Mus musculus
tcaatgtcactgagaatgaatgtca

SEQ ID NO: 763127 - DNA, 25 bp, Mus musculus
tcaatgtcactgtgaatgaatgtca

SEQ ID NO: 763128 - DNA, 25 bp, Mus musculus
tcaatgtcattgacccagaggacca

SEQ ID NO: 763129 - DNA, 25 bp, Mus musculus
tcaatgtcattgtcccagaggacca

SEQ ID NO: 763130 - DNA, 25 bp, Mus musculus
tcaatgtctccacggcaacggaaga

SEQ ID NO: 763131 - DNA, 25 bp, Mus musculus
tcaatgtctccagggcaacggaaga

SEQ ID NO: 763132 - DNA, 25 bp, Mus musculus
tcaatgtctttgactggctaggccg

SEQ ID NO: 763133 - DNA, 25 bp, Mus musculus
tcaatgtctttgtctggctaggccg

SEQ ID NO: 763134 - DNA, 25 bp, Mus musculus
tcaatgtgaccacagcagtatcaga

SEQ ID NO: 763135 - DNA, 25 bp, Mus musculus
tcaatgtgaccagagcagtatcaga

SEQ ID NO: 763136 - DNA, 25 bp, Mus musculus
tcaatgtgactgaggactacattag

SEQ ID NO: 763137 - DNA, 25 bp, Mus musculus
tcaatgtgactgtggactacattag

SEQ ID NO: 763138 - DNA, 25 bp, Mus musculus
tcaatgtgccctaacgagatggcat

SEQ ID NO: 763139 - DNA, 25 bp, Mus musculus
tcaatgtgcccttacgagatggcat

SEQ ID NO: 763140 - DNA, 25 bp, Mus musculus
tcaatgtgcggaatggaatgagctt

SEQ ID NO: 763141 - DNA, 25 bp, Mus musculus
tcaatgtgcggattggaatgagctt

SEQ ID NO: 763142 - DNA, 25 bp, Mus musculus
tcaatgtgctgacccctgttcactc

SEQ ID NO: 763143 - DNA, 25 bp, Mus musculus
tcaatgtgctgagccctgttcactc

SEQ ID NO: 763144 - DNA, 25 bp, Mus musculus
tcaatgtggagactgttgaatacaa

SEQ ID NO: 763145 - DNA, 25 bp, Mus musculus
tcaatgtggagagtgttgaatacaa

SEQ ID NO: 763146 - DNA, 25 bp, Mus musculus
tcaatgtgttccatgcccattcggg

SEQ ID NO: 763147 - DNA, 25 bp, Mus musculus
tcaatgtgttccttgcccattcggg

SEQ ID NO: 763148 - DNA, 25 bp, Mus musculus
tcaatgttgcatatggagttgaaaa

SEQ ID NO: 763149 - DNA, 25 bp, Mus musculus
tcaatgttgcatttggagttgaaaa

SEQ ID NO: 763150 - DNA, 25 bp, Mus musculus
tcaattaaacacagcattgtgttgc

SEQ ID NO: 763151 - DNA, 25 bp, Mus musculus
tcaattaaacactgcattgtgttgc

SEQ ID NO: 763152 - DNA, 25 bp, Mus musculus
tcaattaagaaacatcagggagata

SEQ ID NO: 763153 - DNA, 25 bp, Mus musculus
tcaattaagaaagatcagggagata

SEQ ID NO: 763154 - DNA, 25 bp, Mus musculus
tcaattaccatgctcggcattacca

SEQ ID NO: 763155 - DNA, 25 bp, Mus musculus
tcaattaccatggtcggcattacca

SEQ ID NO: 763156 - DNA, 25 bp, Mus musculus
tcaattaccgctaccacctgggttg

SEQ ID NO: 763157 - DNA, 25 bp, Mus musculus
tcaattaccgcttccacctgggttg

SEQ ID NO: 763158 - DNA, 25 bp, Mus musculus
tcaattagttctcgtgtccctgcct

SEQ ID NO: 763159 - DNA, 25 bp, Mus musculus
tcaattagttctggtgtccctgcct

SEQ ID NO: 763160 - DNA, 25 bp, Mus musculus
tcaattatacaccagggcatctgga

SEQ ID NO: 763161 - DNA, 25 bp, Mus musculus
tcaattatacacgagggcatctgga

SEQ ID NO: 763162 - DNA, 25 bp, Mus musculus
tcaattcacccaagaaccctgtgag

SEQ ID NO: 763163 - DNA, 25 bp, Mus musculus
tcaattcacccatgaaccctgtgag

SEQ ID NO: 763164 - DNA, 25 bp, Mus musculus
tcaattcaggatctaaccaggaggg

SEQ ID NO: 763165 - DNA, 25 bp, Mus musculus
tcaattcaggatgtaaccaggaggg

SEQ ID NO: 763166 - DNA, 25 bp, Mus musculus
tcaattcatccaacagcctgggcgt

SEQ ID NO: 763167 - DNA, 25 bp, Mus musculus
tcaattcatccatcagcctgggcgt

SEQ ID NO: 763168 - DNA, 25 bp, Mus musculus
tcaattccgtgcatgcactgtcagc

SEQ ID NO: 763169 - DNA, 25 bp, Mus musculus
tcaattccgtgcttgcactgtcagc

SEQ ID NO: 763170 - DNA, 25 bp, Mus musculus
tcaattcgctcacaaagaataccat

SEQ ID NO: 763171 - DNA, 25 bp, Mus musculus
tcaattcgctcagaaagaataccat

SEQ ID NO: 763172 - DNA, 25 bp, Mus musculus
tcaattctcagccacagaacggcct

SEQ ID NO: 763173 - DNA, 25 bp, Mus musculus
tcaattctcagcgacagaacggcct

SEQ ID NO: 763174 - DNA, 25 bp, Mus musculus
tcaattctggaaaggcaccacctgg

SEQ ID NO: 763175 - DNA, 25 bp, Mus musculus
tcaattctggaatggcaccacctgg

SEQ ID NO: 763176 - DNA, 25 bp, Mus musculus
tcaattctgtggctgcatagtgggc

SEQ ID NO: 763177 - DNA, 25 bp, Mus musculus
tcaattctgtgggtgcatagtgggc

SEQ ID NO: 763178 - DNA, 25 bp, Mus musculus
tcaattgagtccaaaggcagtgaag

SEQ ID NO: 763179 - DNA, 25 bp, Mus musculus
tcaattgagtcctaaggcagtgaag

SEQ ID NO: 763180 - DNA, 25 bp, Mus musculus
tcaattggataaatccagtagcggt

SEQ ID NO: 763181 - DNA, 25 bp, Mus musculus
tcaattggataattccagtagcggt

SEQ ID NO: 763182 - DNA, 25 bp, Mus musculus
tcaattggatgaaaacacaataggc

SEQ ID NO: 763183 - DNA, 25 bp, Mus musculus
tcaattggatgataacacaataggc

SEQ ID NO: 763184 - DNA, 25 bp, Mus musculus
tcaattgggacgcttgccagaccct

SEQ ID NO: 763185 - DNA, 25 bp, Mus musculus
tcaattgggacggttgccagaccct

SEQ ID NO: 763186 - DNA, 25 bp, Mus musculus
tcaattgggatgatctcttggcccg

SEQ ID NO: 763187 - DNA, 25 bp, Mus musculus
tcaattgggatgttctcttggcccg

SEQ ID NO: 763188 - DNA, 25 bp, Mus musculus
tcaattggtacgaagccaaccagct

SEQ ID NO: 763189 - DNA, 25 bp, Mus musculus
tcaattggtacgtagccaaccagct

SEQ ID NO: 763190 - DNA, 25 bp, Mus musculus
tcaattggtcccatggatgggctac

SEQ ID NO: 763191 - DNA, 25 bp, Mus musculus
tcaattggtcccttggatgggctac

SEQ ID NO: 763192 - DNA, 25 bp, Mus musculus
tcaattggttgacgccgcgctctct

SEQ ID NO: 763193 - DNA, 25 bp, Mus musculus
tcaattggttgaggccgcgctctct

SEQ ID NO: 763194 - DNA, 25 bp, Mus musculus
tcaatttaacgaatacactagcaag

SEQ ID NO: 763195 - DNA, 25 bp, Mus musculus
tcaatttaacgattacactagcaag

SEQ ID NO: 763196 - DNA, 25 bp, Mus musculus
tcaatttccctgacatcctgaccag

SEQ ID NO: 763197 - DNA, 25 bp, Mus musculus
tcaatttccctgtcatcctgaccag

SEQ ID NO: 763198 - DNA, 25 bp, Mus musculus
tcaatttgcgagaatgccaagcgct

SEQ ID NO: 763199 - DNA, 25 bp, Mus musculus
tcaatttgcgagtatgccaagcgct

SEQ ID NO: 763200 - DNA, 25 bp, Mus musculus
tcaattttgcttcaggcccgctact

SEQ ID NO: 763201 - DNA, 25 bp, Mus musculus
tcaattttgcttgaggcccgctact

SEQ ID NO: 763202 - DNA, 25 bp, Mus musculus
tcaattttggtaccgcgcacagaca

SEQ ID NO: 763203 - DNA, 25 bp, Mus musculus
tcaattttggtagcgcgcacagaca

SEQ ID NO: 763204 - DNA, 25 bp, Mus musculus
tcacaaaaagaaaagatagcctgcc

SEQ ID NO: 763205 - DNA, 25 bp, Mus musculus
tcacaaaaagaatagatagcctgcc

SEQ ID NO: 763206 - DNA, 25 bp, Mus musculus
tcacaaacaataatgatccagtggg

SEQ ID NO: 763207 - DNA, 25 bp, Mus musculus
tcacaaacaatattgatccagtggg

SEQ ID NO: 763208 - DNA, 25 bp, Mus musculus
tcacaaactcctaggcctgggtctc

SEQ ID NO: 763209 - DNA, 25 bp, Mus musculus
tcacaaactccttggcctgggtctc

SEQ ID NO: 763210 - DNA, 25 bp, Mus musculus
tcacaaagaagaacattttagagca

SEQ ID NO: 763211 - DNA, 25 bp, Mus musculus
tcacaaagaagatcattttagagca

SEQ ID NO: 763212 - DNA, 25 bp, Mus musculus
tcacaaagaataccaaggctccttg

SEQ ID NO: 763213 - DNA, 25 bp, Mus musculus
tcacaaagaatagcaaggctccttg

SEQ ID NO: 763214 - DNA, 25 bp, Mus musculus
tcacaaagccagcactctacacatg

SEQ ID NO: 763215 - DNA, 25 bp, Mus musculus
tcacaaagccaggactctacacatg

SEQ ID NO: 763216 - DNA, 25 bp, Mus musculus
tcacaaagccctaaggctcttccgg

SEQ ID NO: 763217 - DNA, 25 bp, Mus musculus
tcacaaagcccttaggctcttccgg

SEQ ID NO: 763218 - DNA, 25 bp, Mus musculus
tcacaaagccgcatccatgtgtgct

SEQ ID NO: 763219 - DNA, 25 bp, Mus musculus
tcacaaagccgcttccatgtgtgct

SEQ ID NO: 763220 - DNA, 25 bp, Mus musculus
tcacaaagcgacctttatgggaccc

SEQ ID NO: 763221 - DNA, 25 bp, Mus musculus
tcacaaagcgacgtttatgggaccc

SEQ ID NO: 763222 - DNA, 25 bp, Mus musculus
tcacaaagctgacacacaactaggg

SEQ ID NO: 763223 - DNA, 25 bp, Mus musculus
tcacaaagctgagacacaactaggg

SEQ ID NO: 763224 - DNA, 25 bp, Mus musculus
tcacaaagtggaacattcatgcaga

SEQ ID NO: 763225 - DNA, 25 bp, Mus musculus
tcacaaagtggatcattcatgcaga

SEQ ID NO: 763226 - DNA, 25 bp, Mus musculus
tcacaaagtttgagagtggaaaacg

SEQ ID NO: 763227 - DNA, 25 bp, Mus musculus
tcacaaagtttgtgagtggaaaacg

SEQ ID NO: 763228 - DNA, 25 bp, Mus musculus
tcacaaataaagacctaacagcggt

SEQ ID NO: 763229 - DNA, 25 bp, Mus musculus
tcacaaataaagtcctaacagcggt

SEQ ID NO: 763230 - DNA, 25 bp, Mus musculus
tcacaaataggacagctctacgtgg

SEQ ID NO: 763231 - DNA, 25 bp, Mus musculus
tcacaaataggagagctctacgtgg

SEQ ID NO: 763232 - DNA, 25 bp, Mus musculus
tcacaaatagggatacccctgaaac

SEQ ID NO: 763233 - DNA, 25 bp, Mus musculus
tcacaaatagggttacccctgaaac

SEQ ID NO: 763234 - DNA, 25 bp, Mus musculus
tcacaaatgaagaatccttcaacgc

SEQ ID NO: 763235 - DNA, 25 bp, Mus musculus
tcacaaatgaagtatccttcaacgc

SEQ ID NO: 763236 - DNA, 25 bp, Mus musculus
tcacaaattcctcatctgggacacc

SEQ ID NO: 763237 - DNA, 25 bp, Mus musculus
tcacaaattcctgatctgggacacc

SEQ ID NO: 763238 - DNA, 25 bp, Mus musculus
tcacaaattttacattcaaccttgg

SEQ ID NO: 763239 - DNA, 25 bp, Mus musculus
tcacaaattttagattcaaccttgg

SEQ ID NO: 763240 - DNA, 25 bp, Mus musculus
tcacaacaaccaagcacttaaaaag

SEQ ID NO: 763241 - DNA, 25 bp, Mus musculus
tcacaacaaccatgcacttaaaaag

SEQ ID NO: 763242 - DNA, 25 bp, Mus musculus
tcacaacacattcgagcacttgcgc

SEQ ID NO: 763243 - DNA, 25 bp, Mus musculus
tcacaacacattggagcacttgcgc

SEQ ID NO: 763244 - DNA, 25 bp, Mus musculus
tcacaacagaatactttgatcctct

SEQ ID NO: 763245 - DNA, 25 bp, Mus musculus
tcacaacagaattctttgatcctct

SEQ ID NO: 763246 - DNA, 25 bp, Mus musculus
tcacaacagatcacaacagctccag

SEQ ID NO: 763247 - DNA, 25 bp, Mus musculus
tcacaacagatctcaacagctccag

SEQ ID NO: 763248 - DNA, 25 bp, Mus musculus
tcacaaccacggagtcccgaaagca

SEQ ID NO: 763249 - DNA, 25 bp, Mus musculus
tcacaaccacggtgtcccgaaagca

SEQ ID NO: 763250 - DNA, 25 bp, Mus musculus
tcacaaccctgcataccagataatg

SEQ ID NO: 763251 - DNA, 25 bp, Mus musculus
tcacaaccctgcttaccagataatg

SEQ ID NO: 763252 - DNA, 25 bp, Mus musculus
tcacaaccgaagacatcaaagcagc

SEQ ID NO: 763253 - DNA, 25 bp, Mus musculus
tcacaaccgaagtcatcaaagcagc

SEQ ID NO: 763254 - DNA, 25 bp, Mus musculus
tcacaacctttcactccatgacatg

SEQ ID NO: 763255 - DNA, 25 bp, Mus musculus
tcacaacctttctctccatgacatg

SEQ ID NO: 763256 - DNA, 25 bp, Mus musculus
tcacaacgcgaaccctgcttgagtg

SEQ ID NO: 763257 - DNA, 25 bp, Mus musculus
tcacaacgcgaagcctgcttgagtg

SEQ ID NO: 763258 - DNA, 25 bp, Mus musculus
tcacaacgtgaaccccgaatgtctg

SEQ ID NO: 763259 - DNA, 25 bp, Mus musculus
tcacaacgtgaagcccgaatgtctg

SEQ ID NO: 763260 - DNA, 25 bp, Mus musculus
tcacaactcttgaaccaacaggagg

SEQ ID NO: 763261 - DNA, 25 bp, Mus musculus
tcacaactcttgtaccaacaggagg

SEQ ID NO: 763262 - DNA, 25 bp, Mus musculus
tcacaactgcacctgatcaagtgga

SEQ ID NO: 763263 - DNA, 25 bp, Mus musculus
tcacaactgcacgtgatcaagtgga

SEQ ID NO: 763264 - DNA, 25 bp, Mus musculus
tcacaactgctaactcgtggagcct

SEQ ID NO: 763265 - DNA, 25 bp, Mus musculus
tcacaactgctatctcgtggagcct

SEQ ID NO: 763266 - DNA, 25 bp, Mus musculus
tcacaactgggaagaagttggccct

SEQ ID NO: 763267 - DNA, 25 bp, Mus musculus
tcacaactgggatgaagttggccct

SEQ ID NO: 763268 - DNA, 25 bp, Mus musculus
tcacaactgtggattaggcaaagct

SEQ ID NO: 763269 - DNA, 25 bp, Mus musculus
tcacaactgtggtttaggcaaagct

SEQ ID NO: 763270 - DNA, 25 bp, Mus musculus
tcacaactttggagggagggcctga

SEQ ID NO: 763271 - DNA, 25 bp, Mus musculus
tcacaactttggtgggagggcctga

SEQ ID NO: 763272 - DNA, 25 bp, Mus musculus
tcacaagaagaacacagcagccttg

SEQ ID NO: 763273 - DNA, 25 bp, Mus musculus
tcacaagaagaagacagcagccttg

SEQ ID NO: 763274 - DNA, 25 bp, Mus musculus
tcacaagacaggagatcccgggcta

SEQ ID NO: 763275 - DNA, 25 bp, Mus musculus
tcacaagacaggtgatcccgggcta

SEQ ID NO: 763276 - DNA, 25 bp, Mus musculus
tcacaagactgtcaagccctaggcg

SEQ ID NO: 763277 - DNA, 25 bp, Mus musculus
tcacaagactgtgaagccctaggcg

SEQ ID NO: 763278 - DNA, 25 bp, Mus musculus
tcacaagaggatcaccagaggcacc

SEQ ID NO: 763279 - DNA, 25 bp, Mus musculus
tcacaagaggatgaccagaggcacc

SEQ ID NO: 763280 - DNA, 25 bp, Mus musculus
tcacaagagtacagctacgagcagt

SEQ ID NO: 763281 - DNA, 25 bp, Mus musculus
tcacaagagtactgctacgagcagt

SEQ ID NO: 763282 - DNA, 25 bp, Mus musculus
tcacaagagtctagtctacctctgg

SEQ ID NO: 763283 - DNA, 25 bp, Mus musculus
tcacaagagtcttgtctacctctgg

SEQ ID NO: 763284 - DNA, 25 bp, Mus musculus
tcacaagatgaacggcatcaaccgg

SEQ ID NO: 763285 - DNA, 25 bp, Mus musculus
tcacaagatgaagggcatcaaccgg

SEQ ID NO: 763286 - DNA, 25 bp, Mus musculus
tcacaagcagccagtcggcagccta

SEQ ID NO: 763287 - DNA, 25 bp, Mus musculus
tcacaagcagccagtgtccccggga

SEQ ID NO: 763288 - DNA, 25 bp, Mus musculus
tcacaagcagcctgtcggcagccta

SEQ ID NO: 763289 - DNA, 25 bp, Mus musculus
tcacaagcagcctgtgtccccggga

SEQ ID NO: 763290 - DNA, 25 bp, Mus musculus
tcacaagctgcaccgatgagaacag

SEQ ID NO: 763291 - DNA, 25 bp, Mus musculus
tcacaagctgcagcgatgagaacag

SEQ ID NO: 763292 - DNA, 25 bp, Mus musculus
tcacaagctggtcgaaggctgcctt

SEQ ID NO: 763293 - DNA, 25 bp, Mus musculus
tcacaagctggtggaaggctgcctt

SEQ ID NO: 763294 - DNA, 25 bp, Mus musculus
tcacaaggatgacagtgaattagac

SEQ ID NO: 763295 - DNA, 25 bp, Mus musculus
tcacaaggatgagagtgaattagac

SEQ ID NO: 763296 - DNA, 25 bp, Mus musculus
tcacaaggatgtcgaacagtctaag

SEQ ID NO: 763297 - DNA, 25 bp, Mus musculus
tcacaaggatgtggaacagtctaag

SEQ ID NO: 763298 - DNA, 25 bp, Mus musculus
tcacaaggctcaacaagatggtggc

SEQ ID NO: 763299 - DNA, 25 bp, Mus musculus
tcacaaggctcatcaagatggtggc

SEQ ID NO: 763300 - DNA, 25 bp, Mus musculus
tcacaaggctgaattgacaagggct

SEQ ID NO: 763301 - DNA, 25 bp, Mus musculus
tcacaaggctgatttgacaagggct

SEQ ID NO: 763302 - DNA, 25 bp, Mus musculus
tcacaagggccaaagattgatttgt

SEQ ID NO: 763303 - DNA, 25 bp, Mus musculus
tcacaagggccatagattgatttgt

SEQ ID NO: 763304 - DNA, 25 bp, Mus musculus
tcacaagggtgacatctgtcccatg

SEQ ID NO: 763305 - DNA, 25 bp, Mus musculus
tcacaagggtgagatctgtcccatg

SEQ ID NO: 763306 - DNA, 25 bp, Mus musculus
tcacaaggtgaaccccattgccctg

SEQ ID NO: 763307 - DNA, 25 bp, Mus musculus
tcacaaggtgaagcccattgccctg

SEQ ID NO: 763308 - DNA, 25 bp, Mus musculus
tcacaagtaaccaccagagagctcc

SEQ ID NO: 763309 - DNA, 25 bp, Mus musculus
tcacaagtaacctccagagagctcc

SEQ ID NO: 763310 - DNA, 25 bp, Mus musculus
tcacaagtgaagaggccgagagacg

SEQ ID NO: 763311 - DNA, 25 bp, Mus musculus
tcacaagtgaagtggccgagagacg

SEQ ID NO: 763312 - DNA, 25 bp, Mus musculus
tcacaatccatcagtctggccagac

SEQ ID NO: 763313 - DNA, 25 bp, Mus musculus
tcacaatccatctgtctggccagac

SEQ ID NO: 763314 - DNA, 25 bp, Mus musculus
tcacaatcctaactttatctataga

SEQ ID NO: 763315 - DNA, 25 bp, Mus musculus
tcacaatcctaagtttatctataga

SEQ ID NO: 763316 - DNA, 25 bp, Mus musculus
tcacaatgacagaaccggagacact

SEQ ID NO: 763317 - DNA, 25 bp, Mus musculus
tcacaatgacagtaccggagacact

SEQ ID NO: 763318 - DNA, 25 bp, Mus musculus
tcacaatgacatcctttcaagaagt

SEQ ID NO: 763319 - DNA, 25 bp, Mus musculus
tcacaatgacatgctttcaagaagt

SEQ ID NO: 763320 - DNA, 25 bp, Mus musculus
tcacaatgcggccacagatgccttg

SEQ ID NO: 763321 - DNA, 25 bp, Mus musculus
tcacaatgcggcgacagatgccttg

SEQ ID NO: 763322 - DNA, 25 bp, Mus musculus
tcacaatgcggtcgtgcacgaactg

SEQ ID NO: 763323 - DNA, 25 bp, Mus musculus
tcacaatgcggtggtgcacgaactg

SEQ ID NO: 763324 - DNA, 25 bp, Mus musculus
tcacaatggacaaacacctgaaact

SEQ ID NO: 763325 - DNA, 25 bp, Mus musculus
tcacaatggacatacacctgaaact

SEQ ID NO: 763326 - DNA, 25 bp, Mus musculus
tcacaatgtagactctgatgacctg

SEQ ID NO: 763327 - DNA, 25 bp, Mus musculus
tcacaatgtagagtctgatgacctg

SEQ ID NO: 763328 - DNA, 25 bp, Mus musculus
tcacaatgtgaacgcgatggtactg

SEQ ID NO: 763329 - DNA, 25 bp, Mus musculus
tcacaatgtgaaggcgatggtactg

SEQ ID NO: 763330 - DNA, 25 bp, Mus musculus
tcacaattacttacaacagctaccc

SEQ ID NO: 763331 - DNA, 25 bp, Mus musculus
tcacaattactttcaacagctaccc

SEQ ID NO: 763332 - DNA, 25 bp, Mus musculus
tcacaattgtgaccactgtaggctt

SEQ ID NO: 763333 - DNA, 25 bp, Mus musculus
tcacaattgtgagcactgtaggctt

SEQ ID NO: 763334 - DNA, 25 bp, Mus musculus
tcacaatttgagagcagtgctgcca

SEQ ID NO: 763335 - DNA, 25 bp, Mus musculus
tcacaatttgagtgcagtgctgcca

SEQ ID NO: 763336 - DNA, 25 bp, Mus musculus
tcacacaacaatagggtatacccag

SEQ ID NO: 763337 - DNA, 25 bp, Mus musculus
tcacacaacaattgggtatacccag

SEQ ID NO: 763338 - DNA, 25 bp, Mus musculus
tcacacaacgaactagaaaagcaca

SEQ ID NO: 763339 - DNA, 25 bp, Mus musculus
tcacacaacgaagtagaaaagcaca

SEQ ID NO: 763340 - DNA, 25 bp, Mus musculus
tcacacaagggccagatgacaccat

SEQ ID NO: 763341 - DNA, 25 bp, Mus musculus
tcacacaagggcgagatgacaccat

SEQ ID NO: 763342 - DNA, 25 bp, Mus musculus
tcacacacactccagcaattgagct

SEQ ID NO: 763343 - DNA, 25 bp, Mus musculus
tcacacacactcgagcaattgagct

SEQ ID NO: 763344 - DNA, 25 bp, Mus musculus
tcacacacacttacttcaatccaga

SEQ ID NO: 763345 - DNA, 25 bp, Mus musculus
tcacacacactttcttcaatccaga

SEQ ID NO: 763346 - DNA, 25 bp, Mus musculus
tcacacactctgcaggtagccgagg

SEQ ID NO: 763347 - DNA, 25 bp, Mus musculus
tcacacactctggaggtagccgagg

SEQ ID NO: 763348 - DNA, 25 bp, Mus musculus
tcacacagaactcctgcgaggacct

SEQ ID NO: 763349 - DNA, 25 bp, Mus musculus
tcacacagaactgctgcgaggacct

SEQ ID NO: 763350 - DNA, 25 bp, Mus musculus
tcacacagacccaagaagaagaacg

SEQ ID NO: 763351 - DNA, 25 bp, Mus musculus
tcacacagaccctagaagaagaacg

SEQ ID NO: 763352 - DNA, 25 bp, Mus musculus
tcacacagactgagcattacctcct

SEQ ID NO: 763353 - DNA, 25 bp, Mus musculus
tcacacagactgtgcattacctcct

SEQ ID NO: 763354 - DNA, 25 bp, Mus musculus
tcacacagagacattgtacatagct

SEQ ID NO: 763355 - DNA, 25 bp, Mus musculus
tcacacagagactttgtacatagct

SEQ ID NO: 763356 - DNA, 25 bp, Mus musculus
tcacacagagcaccatctctaggtt

SEQ ID NO: 763357 - DNA, 25 bp, Mus musculus
tcacacagagcagcatctctaggtt

SEQ ID NO: 763358 - DNA, 25 bp, Mus musculus
tcacacagagcccatgggtggtaag

SEQ ID NO: 763359 - DNA, 25 bp, Mus musculus
tcacacagagccgatgggtggtaag

SEQ ID NO: 763360 - DNA, 25 bp, Mus musculus
tcacacagagctaaaggctacgtcc

SEQ ID NO: 763361 - DNA, 25 bp, Mus musculus
tcacacagagcttaaggctacgtcc

SEQ ID NO: 763362 - DNA, 25 bp, Mus musculus
tcacacagcatgcatttacgcacga

SEQ ID NO: 763363 - DNA, 25 bp, Mus musculus
tcacacagcatggatttacgcacga

SEQ ID NO: 763364 - DNA, 25 bp, Mus musculus
tcacacagcattatgtcagtagctc

SEQ ID NO: 763365 - DNA, 25 bp, Mus musculus
tcacacagcattttgtcagtagctc

SEQ ID NO: 763366 - DNA, 25 bp, Mus musculus
tcacacagcctacaggtaagctcgg

SEQ ID NO: 763367 - DNA, 25 bp, Mus musculus
tcacacagcctagaggtaagctcgg

SEQ ID NO: 763368 - DNA, 25 bp, Mus musculus
tcacacagtattcacactgtaccat

SEQ ID NO: 763369 - DNA, 25 bp, Mus musculus
tcacacagtattgacactgtaccat

SEQ ID NO: 763370 - DNA, 25 bp, Mus musculus
tcacacatctaacaagggccagcac

SEQ ID NO: 763371 - DNA, 25 bp, Mus musculus
tcacacatctaagaagggccagcac

SEQ ID NO: 763372 - DNA, 25 bp, Mus musculus
tcacacatcttgagcgagaaggcat

SEQ ID NO: 763373 - DNA, 25 bp, Mus musculus
tcacacatcttgtgcgagaaggcat

SEQ ID NO: 763374 - DNA, 25 bp, Mus musculus
tcacacattgtgaacccaggaaaag

SEQ ID NO: 763375 - DNA, 25 bp, Mus musculus
tcacacattgtgtacccaggaaaag

SEQ ID NO: 763376 - DNA, 25 bp, Mus musculus
tcacaccacagaaatccctagaaga

SEQ ID NO: 763377 - DNA, 25 bp, Mus musculus
tcacaccacagatatccctagaaga

SEQ ID NO: 763378 - DNA, 25 bp, Mus musculus
tcacaccaccagaagccagtcaatg

SEQ ID NO: 763379 - DNA, 25 bp, Mus musculus
tcacaccaccagtagccagtcaatg

SEQ ID NO: 763380 - DNA, 25 bp, Mus musculus
tcacaccagaagatgggaagcagaa

SEQ ID NO: 763381 - DNA, 25 bp, Mus musculus
tcacaccagaagttgggaagcagaa

SEQ ID NO: 763382 - DNA, 25 bp, Mus musculus
tcacaccagaggctctggagctggc

SEQ ID NO: 763383 - DNA, 25 bp, Mus musculus
tcacaccagagggtctggagctggc

SEQ ID NO: 763384 - DNA, 25 bp, Mus musculus
tcacaccagagtaagcaggaggcaa

SEQ ID NO: 763385 - DNA, 25 bp, Mus musculus
tcacaccagagttagcaggaggcaa

SEQ ID NO: 763386 - DNA, 25 bp, Mus musculus
tcacaccagccaagatctgtgccgg

SEQ ID NO: 763387 - DNA, 25 bp, Mus musculus
tcacaccagccaagccttattgctg

SEQ ID NO: 763388 - DNA, 25 bp, Mus musculus
tcacaccagccatgatctgtgccgg

SEQ ID NO: 763389 - DNA, 25 bp, Mus musculus
tcacaccagccatgccttattgctg

SEQ ID NO: 763390 - DNA, 25 bp, Mus musculus
tcacaccagggcattatgcgatggt

SEQ ID NO: 763391 - DNA, 25 bp, Mus musculus
tcacaccagggctttatgcgatggt

SEQ ID NO: 763392 - DNA, 25 bp, Mus musculus
tcacacccgcaacgtcactggagga

SEQ ID NO: 763393 - DNA, 25 bp, Mus musculus
tcacacccgcaaggtcactggagga

SEQ ID NO: 763394 - DNA, 25 bp, Mus musculus
tcacacccttatctacagctactgg

SEQ ID NO: 763395 - DNA, 25 bp, Mus musculus
tcacacccttatgtacagctactgg

SEQ ID NO: 763396 - DNA, 25 bp, Mus musculus
tcacaccggagcctttagtttgggc

SEQ ID NO: 763397 - DNA, 25 bp, Mus musculus
tcacaccggagcgtttagtttgggc

SEQ ID NO: 763398 - DNA, 25 bp, Mus musculus
tcacacctattaatgaccttcctgg

SEQ ID NO: 763399 - DNA, 25 bp, Mus musculus
tcacacctattattgaccttcctgg

SEQ ID NO: 763400 - DNA, 25 bp, Mus musculus
tcacacctctggacatcatgcttgg

SEQ ID NO: 763401 - DNA, 25 bp, Mus musculus
tcacacctctggtcatcatgcttgg

SEQ ID NO: 763402 - DNA, 25 bp, Mus musculus
tcacacctgaagaacgtaaaggagg

SEQ ID NO: 763403 - DNA, 25 bp, Mus musculus
tcacacctgaagtacgtaaaggagg

SEQ ID NO: 763404 - DNA, 25 bp, Mus musculus
tcacacctggctaccattatgatgt

SEQ ID NO: 763405 - DNA, 25 bp, Mus musculus
tcacacctggcttccattatgatgt

SEQ ID NO: 763406 - DNA, 25 bp, Mus musculus
tcacaccttctgctaggaggcagaa

SEQ ID NO: 763407 - DNA, 25 bp, Mus musculus
tcacaccttctggtaggaggcagaa

SEQ ID NO: 763408 - DNA, 25 bp, Mus musculus
tcacaccttcttagatcaccaggat

SEQ ID NO: 763409 - DNA, 25 bp, Mus musculus
tcacaccttctttgatcaccaggat

SEQ ID NO: 763410 - DNA, 25 bp, Mus musculus
tcacacgatacaccaagaagacctc

SEQ ID NO: 763411 - DNA, 25 bp, Mus musculus
tcacacgatacagcaagaagacctc

SEQ ID NO: 763412 - DNA, 25 bp, Mus musculus
tcacacgatcctctttgcacagaag

SEQ ID NO: 763413 - DNA, 25 bp, Mus musculus
tcacacgatcctgtttgcacagaag

SEQ ID NO: 763414 - DNA, 25 bp, Mus musculus
tcacacgatgatactcattcacgca

SEQ ID NO: 763415 - DNA, 25 bp, Mus musculus
tcacacgatgattctcattcacgca

SEQ ID NO: 763416 - DNA, 25 bp, Mus musculus
tcacacgctgcactggatgtacggc

SEQ ID NO: 763417 - DNA, 25 bp, Mus musculus
tcacacgctgcagtggatgtacggc

SEQ ID NO: 763418 - DNA, 25 bp, Mus musculus
tcacacggaagcctctgaaagtctt

SEQ ID NO: 763419 - DNA, 25 bp, Mus musculus
tcacacggaagcgtctgaaagtctt

SEQ ID NO: 763420 - DNA, 25 bp, Mus musculus
tcacacgggaacaaaaggatgtcct

SEQ ID NO: 763421 - DNA, 25 bp, Mus musculus
tcacacgggaactaaaggatgtcct

SEQ ID NO: 763422 - DNA, 25 bp, Mus musculus
tcacacgtgcatctgtgatgcaggg

SEQ ID NO: 763423 - DNA, 25 bp, Mus musculus
tcacacgtgcatgtgtgatgcaggg

SEQ ID NO: 763424 - DNA, 25 bp, Mus musculus
tcacacgttatgacctgatcagccg

SEQ ID NO: 763425 - DNA, 25 bp, Mus musculus
tcacacgttatgtcctgatcagccg

SEQ ID NO: 763426 - DNA, 25 bp, Mus musculus
tcacactaaagacagagaaggtggc

SEQ ID NO: 763427 - DNA, 25 bp, Mus musculus
tcacactaaagagagagaaggtggc

SEQ ID NO: 763428 - DNA, 25 bp, Mus musculus
tcacactacctaaaaataggcagat

SEQ ID NO: 763429 - DNA, 25 bp, Mus musculus
tcacactacctataaataggcagat

SEQ ID NO: 763430 - DNA, 25 bp, Mus musculus
tcacactacgatcagctgctagctg

SEQ ID NO: 763431 - DNA, 25 bp, Mus musculus
tcacactacgatgagctgctagctg

SEQ ID NO: 763432 - DNA, 25 bp, Mus musculus
tcacactatgccatccgcatctttg

SEQ ID NO: 763433 - DNA, 25 bp, Mus musculus
tcacactatgccttccgcatctttg

SEQ ID NO: 763434 - DNA, 25 bp, Mus musculus
tcacactatttccagcatgcccgag

SEQ ID NO: 763435 - DNA, 25 bp, Mus musculus
tcacactatttcgagcatgcccgag

SEQ ID NO: 763436 - DNA, 25 bp, Mus musculus
tcacactcagaaacaaggaagaagg

SEQ ID NO: 763437 - DNA, 25 bp, Mus musculus
tcacactcagaatcaaggaagaagg

SEQ ID NO: 763438 - DNA, 25 bp, Mus musculus
tcacactgaagcaactagcgtgtgt

SEQ ID NO: 763439 - DNA, 25 bp, Mus musculus
tcacactgaagctactagcgtgtgt

SEQ ID NO: 763440 - DNA, 25 bp, Mus musculus
tcacactgaggacacaacaaggatc

SEQ ID NO: 763441 - DNA, 25 bp, Mus musculus
tcacactgaggagacaacaaggatc

SEQ ID NO: 763442 - DNA, 25 bp, Mus musculus
tcacactgatgacaagtaagaagac

SEQ ID NO: 763443 - DNA, 25 bp, Mus musculus
tcacactgatgagaagtaagaagac

SEQ ID NO: 763444 - DNA, 25 bp, Mus musculus
tcacactgcgttacctgctgcaaca

SEQ ID NO: 763445 - DNA, 25 bp, Mus musculus
tcacactgcgtttcctgctgcaaca

SEQ ID NO: 763446 - DNA, 25 bp, Mus musculus
tcacactggagcaaggaggcaagaa

SEQ ID NO: 763447 - DNA, 25 bp, Mus musculus
tcacactggagctaggaggcaagaa

SEQ ID NO: 763448 - DNA, 25 bp, Mus musculus
tcacactggatgctctgctggagat

SEQ ID NO: 763449 - DNA, 25 bp, Mus musculus
tcacactggatggtctgctggagat

SEQ ID NO: 763450 - DNA, 25 bp, Mus musculus
tcacactggctgcactgtcagtagg

SEQ ID NO: 763451 - DNA, 25 bp, Mus musculus
tcacactggctggactgtcagtagg

SEQ ID NO: 763452 - DNA, 25 bp, Mus musculus
tcacactggtggctgttattgaaag

SEQ ID NO: 763453 - DNA, 25 bp, Mus musculus
tcacactggtgggtgttattgaaag

SEQ ID NO: 763454 - DNA, 25 bp, Mus musculus
tcacacttccaccagcaagtagctg

SEQ ID NO: 763455 - DNA, 25 bp, Mus musculus
tcacacttccacgagcaagtagctg

SEQ ID NO: 763456 - DNA, 25 bp, Mus musculus
tcacagaaaccaccctcatttcggg

SEQ ID NO: 763457 - DNA, 25 bp, Mus musculus
tcacagaaaccagcctcatttcggg

SEQ ID NO: 763458 - DNA, 25 bp, Mus musculus
tcacagaacatgcatcagcctgggc

SEQ ID NO: 763459 - DNA, 25 bp, Mus musculus
tcacagaacatggatcagcctgggc

SEQ ID NO: 763460 - DNA, 25 bp, Mus musculus
tcacagaagccaagtataccaacct

SEQ ID NO: 763461 - DNA, 25 bp, Mus musculus
tcacagaagccatgtataccaacct

SEQ ID NO: 763462 - DNA, 25 bp, Mus musculus
tcacagaaggacaccacgttcacca

SEQ ID NO: 763463 - DNA, 25 bp, Mus musculus
tcacagaaggactccacgttcacca

SEQ ID NO: 763464 - DNA, 25 bp, Mus musculus
tcacagaaggttccggaggacactg

SEQ ID NO: 763465 - DNA, 25 bp, Mus musculus
tcacagaaggttgcggaggacactg

SEQ ID NO: 763466 - DNA, 25 bp, Mus musculus
tcacagaatttaagtgggcagcaaa

SEQ ID NO: 763467 - DNA, 25 bp, Mus musculus
tcacagaatttatgtgggcagcaaa

SEQ ID NO: 763468 - DNA, 25 bp, Mus musculus
tcacagacagacataatcgggagct

SEQ ID NO: 763469 - DNA, 25 bp, Mus musculus
tcacagacagacttaatcgggagct

SEQ ID NO: 763470 - DNA, 25 bp, Mus musculus
tcacagacagcgactctacacaagg

SEQ ID NO: 763471 - DNA, 25 bp, Mus musculus
tcacagacagcgtctctacacaagg

SEQ ID NO: 763472 - DNA, 25 bp, Mus musculus
tcacagacccagcaaaaatcaagcg

SEQ ID NO: 763473 - DNA, 25 bp, Mus musculus
tcacagacccaggaaaaatcaagcg

SEQ ID NO: 763474 - DNA, 25 bp, Mus musculus
tcacagacgaggcagaaggcgtgag

SEQ ID NO: 763475 - DNA, 25 bp, Mus musculus
tcacagacgagggagaaggcgtgag

SEQ ID NO: 763476 - DNA, 25 bp, Mus musculus
tcacagacggggaataggaacctaa

SEQ ID NO: 763477 - DNA, 25 bp, Mus musculus
tcacagacggggtataggaacctaa

SEQ ID NO: 763478 - DNA, 25 bp, Mus musculus
tcacagactatgacatactttgagt

SEQ ID NO: 763479 - DNA, 25 bp, Mus musculus
tcacagactatgtcatactttgagt

SEQ ID NO: 763480 - DNA, 25 bp, Mus musculus
tcacagactcctatgttcaactgtt

SEQ ID NO: 763481 - DNA, 25 bp, Mus musculus
tcacagactcctccgtagtggcact

SEQ ID NO: 763482 - DNA, 25 bp, Mus musculus
tcacagactcctgcgtagtggcact

SEQ ID NO: 763483 - DNA, 25 bp, Mus musculus
tcacagactcctttgttcaactgtt

SEQ ID NO: 763484 - DNA, 25 bp, Mus musculus
tcacagagaacacgagagtacaacc

SEQ ID NO: 763485 - DNA, 25 bp, Mus musculus
tcacagagaacaggagagtacaacc

SEQ ID NO: 763486 - DNA, 25 bp, Mus musculus
tcacagagacccacattcaagcagt

SEQ ID NO: 763487 - DNA, 25 bp, Mus musculus
tcacagagaccctcattcaagcagt

SEQ ID NO: 763488 - DNA, 25 bp, Mus musculus
tcacagagagagctacccatgagga

SEQ ID NO: 763489 - DNA, 25 bp, Mus musculus
tcacagagagaggtacccatgagga

SEQ ID NO: 763490 - DNA, 25 bp, Mus musculus
tcacagagagttaccactagtccag

SEQ ID NO: 763491 - DNA, 25 bp, Mus musculus
tcacagagagtttccactagtccag

SEQ ID NO: 763492 - DNA, 25 bp, Mus musculus
tcacagagatccagactaagacaac

SEQ ID NO: 763493 - DNA, 25 bp, Mus musculus
tcacagagatcctgactaagacaac

SEQ ID NO: 763494 - DNA, 25 bp, Mus musculus
tcacagagattcatgagtatgccca

SEQ ID NO: 763495 - DNA, 25 bp, Mus musculus
tcacagagattcttgagtatgccca

SEQ ID NO: 763496 - DNA, 25 bp, Mus musculus
tcacagagcacgagtctttcacagc

SEQ ID NO: 763497 - DNA, 25 bp, Mus musculus
tcacagagcacgtgtctttcacagc

SEQ ID NO: 763498 - DNA, 25 bp, Mus musculus
tcacagagccctacacaagactcat

SEQ ID NO: 763499 - DNA, 25 bp, Mus musculus
tcacagagcccttcacaagactcat

SEQ ID NO: 763500 - DNA, 25 bp, Mus musculus
tcacagaggcgaagcactatcacgc

SEQ ID NO: 763501 - DNA, 25 bp, Mus musculus
tcacagaggcgatgcactatcacgc

SEQ ID NO: 763502 - DNA, 25 bp, Mus musculus
tcacagagggcgagccggcacagcc

SEQ ID NO: 763503 - DNA, 25 bp, Mus musculus
tcacagagggcgtgccggcacagcc

SEQ ID NO: 763504 - DNA, 25 bp, Mus musculus
tcacagaggtggcaacaaggcccct

SEQ ID NO: 763505 - DNA, 25 bp, Mus musculus
tcacagaggtgggaacaaggcccct

SEQ ID NO: 763506 - DNA, 25 bp, Mus musculus
tcacagagtgtgctacgttcattct

SEQ ID NO: 763507 - DNA, 25 bp, Mus musculus
tcacagagtgtggtacgttcattct

SEQ ID NO: 763508 - DNA, 25 bp, Mus musculus
tcacagataaacaccttgcgagact

SEQ ID NO: 763509 - DNA, 25 bp, Mus musculus
tcacagataaactccttgcgagact

SEQ ID NO: 763510 - DNA, 25 bp, Mus musculus
tcacagatagaaatcagctgccagg

SEQ ID NO: 763511 - DNA, 25 bp, Mus musculus
tcacagatagaattcagctgccagg

SEQ ID NO: 763512 - DNA, 25 bp, Mus musculus
tcacagatctctaagcacaagtcag

SEQ ID NO: 763513 - DNA, 25 bp, Mus musculus
tcacagatctcttagcacaagtcag

SEQ ID NO: 763514 - DNA, 25 bp, Mus musculus
tcacagatctttcggagaaatgacg

SEQ ID NO: 763515 - DNA, 25 bp, Mus musculus
tcacagatctttgggagaaatgacg

SEQ ID NO: 763516 - DNA, 25 bp, Mus musculus
tcacagatgatcagcaagaatccct

SEQ ID NO: 763517 - DNA, 25 bp, Mus musculus
tcacagatgatctgcaagaatccct

SEQ ID NO: 763518 - DNA, 25 bp, Mus musculus
tcacagatgcacagacccagagatc

SEQ ID NO: 763519 - DNA, 25 bp, Mus musculus
tcacagatgcactgacccagagatc

SEQ ID NO: 763520 - DNA, 25 bp, Mus musculus
tcacagatgggaaatcccaagattt

SEQ ID NO: 763521 - DNA, 25 bp, Mus musculus
tcacagatgggatatcccaagattt

SEQ ID NO: 763522 - DNA, 25 bp, Mus musculus
tcacagatgtgaccttccaaggatg

SEQ ID NO: 763523 - DNA, 25 bp, Mus musculus
tcacagatgtgagcttccaaggatg

SEQ ID NO: 763524 - DNA, 25 bp, Mus musculus
tcacagatttcaagccaggctactg

SEQ ID NO: 763525 - DNA, 25 bp, Mus musculus
tcacagatttcatgccaggctactg

SEQ ID NO: 763526 - DNA, 25 bp, Mus musculus
tcacagcaagatcaacactctggcc

SEQ ID NO: 763527 - DNA, 25 bp, Mus musculus
tcacagcaagatgaacactctggcc

SEQ ID NO: 763528 - DNA, 25 bp, Mus musculus
tcacagcaagcaaaccaagaagcat

SEQ ID NO: 763529 - DNA, 25 bp, Mus musculus
tcacagcaagcataccaagaagcat

SEQ ID NO: 763530 - DNA, 25 bp, Mus musculus
tcacagcaccgaaaccaagtctgtg

SEQ ID NO: 763531 - DNA, 25 bp, Mus musculus
tcacagcaccgataccaagtctgtg

SEQ ID NO: 763532 - DNA, 25 bp, Mus musculus
tcacagcagagaacgacaatgtcct

SEQ ID NO: 763533 - DNA, 25 bp, Mus musculus
tcacagcagagatcgacaatgtcct

SEQ ID NO: 763534 - DNA, 25 bp, Mus musculus
tcacagcagagtatgaggtggagat

SEQ ID NO: 763535 - DNA, 25 bp, Mus musculus
tcacagcagagtttgaggtggagat

SEQ ID NO: 763536 - DNA, 25 bp, Mus musculus
tcacagcagcagagttcaccaaaaa

SEQ ID NO: 763537 - DNA, 25 bp, Mus musculus
tcacagcagcagtgttcaccaaaaa

SEQ ID NO: 763538 - DNA, 25 bp, Mus musculus
tcacagcaggttaacacaggcggct

SEQ ID NO: 763539 - DNA, 25 bp, Mus musculus
tcacagcaggtttacacaggcggct

SEQ ID NO: 763540 - DNA, 25 bp, Mus musculus
tcacagcatggtctatacacagagc

SEQ ID NO: 763541 - DNA, 25 bp, Mus musculus
tcacagcatggtgtatacacagagc

SEQ ID NO: 763542 - DNA, 25 bp, Mus musculus
tcacagccaaccagcgatttcttct

SEQ ID NO: 763543 - DNA, 25 bp, Mus musculus
tcacagccaacctgcgatttcttct

SEQ ID NO: 763544 - DNA, 25 bp, Mus musculus
tcacagccaccaaatactgactatg

SEQ ID NO: 763545 - DNA, 25 bp, Mus musculus
tcacagccaccatatactgactatg

SEQ ID NO: 763546 - DNA, 25 bp, Mus musculus
tcacagccatcgagatggctgaagg

SEQ ID NO: 763547 - DNA, 25 bp, Mus musculus
tcacagccatcgtgatggctgaagg

SEQ ID NO: 763548 - DNA, 25 bp, Mus musculus
tcacagccgagaatgcaggcagccg

SEQ ID NO: 763549 - DNA, 25 bp, Mus musculus
tcacagccgagattgcaggcagccg

SEQ ID NO: 763550 - DNA, 25 bp, Mus musculus
tcacagcctgtgagaaattctccaa

SEQ ID NO: 763551 - DNA, 25 bp, Mus musculus
tcacagcctgtgtgaaattctccaa

SEQ ID NO: 763552 - DNA, 25 bp, Mus musculus
tcacagccttgaccggaaccaagat

SEQ ID NO: 763553 - DNA, 25 bp, Mus musculus
tcacagccttgagcggaaccaagat

SEQ ID NO: 763554 - DNA, 25 bp, Mus musculus
tcacagcgatttcaaagagctttgt

SEQ ID NO: 763555 - DNA, 25 bp, Mus musculus
tcacagcgatttgaaagagctttgt

SEQ ID NO: 763556 - DNA, 25 bp, Mus musculus
tcacagcgggaacactgccctggct

SEQ ID NO: 763557 - DNA, 25 bp, Mus musculus
tcacagcgggaagactgccctggct

SEQ ID NO: 763558 - DNA, 25 bp, Mus musculus
tcacagctacacaggatactgttgg

SEQ ID NO: 763559 - DNA, 25 bp, Mus musculus
tcacagctacactggatactgttgg

SEQ ID NO: 763560 - DNA, 25 bp, Mus musculus
tcacagctattgcactcggagggaa

SEQ ID NO: 763561 - DNA, 25 bp, Mus musculus
tcacagctattggactcggagggaa

SEQ ID NO: 763562 - DNA, 25 bp, Mus musculus
tcacagctcagtaaagaggctgagg

SEQ ID NO: 763563 - DNA, 25 bp, Mus musculus
tcacagctcagttaagaggctgagg

SEQ ID NO: 763564 - DNA, 25 bp, Mus musculus
tcacagctccagagatgaccacaga

SEQ ID NO: 763565 - DNA, 25 bp, Mus musculus
tcacagctccagtgatgaccacaga

SEQ ID NO: 763566 - DNA, 25 bp, Mus musculus
tcacagctcgttcgttggtaaaggc

SEQ ID NO: 763567 - DNA, 25 bp, Mus musculus
tcacagctcgttggttggtaaaggc

SEQ ID NO: 763568 - DNA, 25 bp, Mus musculus
tcacagctgaagcatgcacacaggg

SEQ ID NO: 763569 - DNA, 25 bp, Mus musculus
tcacagctgaaggatgcacacaggg

SEQ ID NO: 763570 - DNA, 25 bp, Mus musculus
tcacagctgcatcgtaagacgtctc

SEQ ID NO: 763571 - DNA, 25 bp, Mus musculus
tcacagctgcatggtaagacgtctc

SEQ ID NO: 763572 - DNA, 25 bp, Mus musculus
tcacagctgcggagtgaactgtctg

SEQ ID NO: 763573 - DNA, 25 bp, Mus musculus
tcacagctgcggtgtgaactgtctg

SEQ ID NO: 763574 - DNA, 25 bp, Mus musculus
tcacagctgtttcgtaaggaggagt

SEQ ID NO: 763575 - DNA, 25 bp, Mus musculus
tcacagctgtttggtaaggaggagt

SEQ ID NO: 763576 - DNA, 25 bp, Mus musculus
tcacagcttgttcggtaaacagcga

SEQ ID NO: 763577 - DNA, 25 bp, Mus musculus
tcacagcttgttgggtaaacagcga

SEQ ID NO: 763578 - DNA, 25 bp, Mus musculus
tcacaggaacctatgatggcaatga

SEQ ID NO: 763579 - DNA, 25 bp, Mus musculus
tcacaggaacctttgatggcaatga

SEQ ID NO: 763580 - DNA, 25 bp, Mus musculus
tcacaggaagagaccaaagtataat

SEQ ID NO: 763581 - DNA, 25 bp, Mus musculus
tcacaggaagagtccaaagtataat

SEQ ID NO: 763582 - DNA, 25 bp, Mus musculus
tcacaggaagatctgggtatctcag

SEQ ID NO: 763583 - DNA, 25 bp, Mus musculus
tcacaggaagatgtgggtatctcag

SEQ ID NO: 763584 - DNA, 25 bp, Mus musculus
tcacaggaggagatgctgccctcag

SEQ ID NO: 763585 - DNA, 25 bp, Mus musculus
tcacaggaggagttgctgccctcag

SEQ ID NO: 763586 - DNA, 25 bp, Mus musculus
tcacaggagtttctggttcccaatg

SEQ ID NO: 763587 - DNA, 25 bp, Mus musculus
tcacaggagtttgtggttcccaatg

SEQ ID NO: 763588 - DNA, 25 bp, Mus musculus
tcacaggatcccaggatgacctggt

SEQ ID NO: 763589 - DNA, 25 bp, Mus musculus
tcacaggatccctggatgacctggt

SEQ ID NO: 763590 - DNA, 25 bp, Mus musculus
tcacaggcgggtacaactccaagaa

SEQ ID NO: 763591 - DNA, 25 bp, Mus musculus
tcacaggcgggttcaactccaagaa

SEQ ID NO: 763592 - DNA, 25 bp, Mus musculus
tcacaggcgttgaaaagactcatgc

SEQ ID NO: 763593 - DNA, 25 bp, Mus musculus
tcacaggcgttgtaaagactcatgc

SEQ ID NO: 763594 - DNA, 25 bp, Mus musculus
tcacaggctcctaccccatgaggaa

SEQ ID NO: 763595 - DNA, 25 bp, Mus musculus
tcacaggctccttccccatgaggaa

SEQ ID NO: 763596 - DNA, 25 bp, Mus musculus
tcacaggcttcccagaagtctaagg

SEQ ID NO: 763597 - DNA, 25 bp, Mus musculus
tcacaggcttccgagaagtctaagg

SEQ ID NO: 763598 - DNA, 25 bp, Mus musculus
tcacagggaaatcggagaaaccctt

SEQ ID NO: 763599 - DNA, 25 bp, Mus musculus
tcacagggaaatgggagaaaccctt

SEQ ID NO: 763600 - DNA, 25 bp, Mus musculus
tcacagggactacaggctgaaccag

SEQ ID NO: 763601 - DNA, 25 bp, Mus musculus
tcacagggactagaggctgaaccag

SEQ ID NO: 763602 - DNA, 25 bp, Mus musculus
tcacagggccagagggcccatcatc

SEQ ID NO: 763603 - DNA, 25 bp, Mus musculus
tcacagggccagtgggcccatcatc

SEQ ID NO: 763604 - DNA, 25 bp, Mus musculus
tcacagggctcacaaattccactgg

SEQ ID NO: 763605 - DNA, 25 bp, Mus musculus
tcacagggctcagaaattccactgg

SEQ ID NO: 763606 - DNA, 25 bp, Mus musculus
tcacaggtcagcaggatccgaggaa

SEQ ID NO: 763607 - DNA, 25 bp, Mus musculus
tcacaggtcagcatcgacagctcga

SEQ ID NO: 763608 - DNA, 25 bp, Mus musculus
tcacaggtcagctggatccgaggaa

SEQ ID NO: 763609 - DNA, 25 bp, Mus musculus
tcacaggtcagcttcgacagctcga

SEQ ID NO: 763610 - DNA, 25 bp, Mus musculus
tcacaggtctgaccaaagctgagct

SEQ ID NO: 763611 - DNA, 25 bp, Mus musculus
tcacaggtctgagcaaagctgagct

SEQ ID NO: 763612 - DNA, 25 bp, Mus musculus
tcacaggtgcgcctcggctgctgca

SEQ ID NO: 763613 - DNA, 25 bp, Mus musculus
tcacaggtgcgcgtcggctgctgca

SEQ ID NO: 763614 - DNA, 25 bp, Mus musculus
tcacaggttccacgagtcatgtcaa

SEQ ID NO: 763615 - DNA, 25 bp, Mus musculus
tcacaggttccaggagtcatgtcaa

SEQ ID NO: 763616 - DNA, 25 bp, Mus musculus
tcacagtagcccaactagaagacaa

SEQ ID NO: 763617 - DNA, 25 bp, Mus musculus
tcacagtagccctactagaagacaa

SEQ ID NO: 763618 - DNA, 25 bp, Mus musculus
tcacagtatcctcgccacagcctga

SEQ ID NO: 763619 - DNA, 25 bp, Mus musculus
tcacagtatcctggccacagcctga

SEQ ID NO: 763620 - DNA, 25 bp, Mus musculus
tcacagtcaagtactaccctcctga

SEQ ID NO: 763621 - DNA, 25 bp, Mus musculus
tcacagtcaagttctaccctcctga

SEQ ID NO: 763622 - DNA, 25 bp, Mus musculus
tcacagtcagtcaagcacagggcta

SEQ ID NO: 763623 - DNA, 25 bp, Mus musculus
tcacagtcagtctagcacagggcta

SEQ ID NO: 763624 - DNA, 25 bp, Mus musculus
tcacagtcctagagaaagtcccggt

SEQ ID NO: 763625 - DNA, 25 bp, Mus musculus
tcacagtcctagtgaaagtcccggt

SEQ ID NO: 763626 - DNA, 25 bp, Mus musculus
tcacagtcggtcagtccaacctgtt

SEQ ID NO: 763627 - DNA, 25 bp, Mus musculus
tcacagtcggtctgtccaacctgtt

SEQ ID NO: 763628 - DNA, 25 bp, Mus musculus
tcacagtcgtccagtaagaagagct

SEQ ID NO: 763629 - DNA, 25 bp, Mus musculus
tcacagtcgtcctgtaagaagagct

SEQ ID NO: 763630 - DNA, 25 bp, Mus musculus
tcacagtctttcagccttgcagaga

SEQ ID NO: 763631 - DNA, 25 bp, Mus musculus
tcacagtctttctgccttgcagaga

SEQ ID NO: 763632 - DNA, 25 bp, Mus musculus
tcacagtgaaacatctagaagacat

SEQ ID NO: 763633 - DNA, 25 bp, Mus musculus
tcacagtgaaacttctagaagacat

SEQ ID NO: 763634 - DNA, 25 bp, Mus musculus
tcacagtgaggcacgcgacatgagg

SEQ ID NO: 763635 - DNA, 25 bp, Mus musculus
tcacagtgaggctcgcgacatgagg

SEQ ID NO: 763636 - DNA, 25 bp, Mus musculus
tcacagtggctcctgcttgtcttcc

SEQ ID NO: 763637 - DNA, 25 bp, Mus musculus
tcacagtggctcgtgcttgtcttcc

SEQ ID NO: 763638 - DNA, 25 bp, Mus musculus
tcacagtgtaccctctggaggagag

SEQ ID NO: 763639 - DNA, 25 bp, Mus musculus
tcacagtgtaccgtctggaggagag

SEQ ID NO: 763640 - DNA, 25 bp, Mus musculus
tcacagtgtccgagaagtggcgaga

SEQ ID NO: 763641 - DNA, 25 bp, Mus musculus
tcacagtgtccgtgaagtggcgaga

SEQ ID NO: 763642 - DNA, 25 bp, Mus musculus
tcacagttgtgtatgacgacagcac

SEQ ID NO: 763643 - DNA, 25 bp, Mus musculus
tcacagttgtgtttgacgacagcac

SEQ ID NO: 763644 - DNA, 25 bp, Mus musculus
tcacataaacctcgtggagatagat

SEQ ID NO: 763645 - DNA, 25 bp, Mus musculus
tcacataaacctggtggagatagat

SEQ ID NO: 763646 - DNA, 25 bp, Mus musculus
tcacataggctaagggcacaaatca

SEQ ID NO: 763647 - DNA, 25 bp, Mus musculus
tcacataggctatgggcacaaatca

SEQ ID NO: 763648 - DNA, 25 bp, Mus musculus
tcacatatcgacagccggagctgga

SEQ ID NO: 763649 - DNA, 25 bp, Mus musculus
tcacatatcgactgccggagctgga

SEQ ID NO: 763650 - DNA, 25 bp, Mus musculus
tcacatatggccaagcttttggtct

SEQ ID NO: 763651 - DNA, 25 bp, Mus musculus
tcacatatggcctagcttttggtct

SEQ ID NO: 763652 - DNA, 25 bp, Mus musculus
tcacatatgtagagattggagatgg

SEQ ID NO: 763653 - DNA, 25 bp, Mus musculus
tcacatatgtagtgattggagatgg

SEQ ID NO: 763654 - DNA, 25 bp, Mus musculus
tcacatattcctactcacgaaacca

SEQ ID NO: 763655 - DNA, 25 bp, Mus musculus
tcacatattccttctcacgaaacca

SEQ ID NO: 763656 - DNA, 25 bp, Mus musculus
tcacatcaaagcagggtgcatcttg

SEQ ID NO: 763657 - DNA, 25 bp, Mus musculus
tcacatcaaagctgggtgcatcttg

SEQ ID NO: 763658 - DNA, 25 bp, Mus musculus
tcacatcaaggacgtatctggcact

SEQ ID NO: 763659 - DNA, 25 bp, Mus musculus
tcacatcaaggaggtatctggcact

SEQ ID NO: 763660 - DNA, 25 bp, Mus musculus
tcacatcaaggcctgacagaacggc

SEQ ID NO: 763661 - DNA, 25 bp, Mus musculus
tcacatcaaggcgtgacagaacggc

SEQ ID NO: 763662 - DNA, 25 bp, Mus musculus
tcacatcaagttctcaacagaagct

SEQ ID NO: 763663 - DNA, 25 bp, Mus musculus
tcacatcaagttgtcaacagaagct

SEQ ID NO: 763664 - DNA, 25 bp, Mus musculus
tcacatcagacacagtgggctctat

SEQ ID NO: 763665 - DNA, 25 bp, Mus musculus
tcacatcagacagagtgggctctat

SEQ ID NO: 763666 - DNA, 25 bp, Mus musculus
tcacatcaggttccatgttgggccg

SEQ ID NO: 763667 - DNA, 25 bp, Mus musculus
tcacatcaggttgcatgttgggccg

SEQ ID NO: 763668 - DNA, 25 bp, Mus musculus
tcacatcagtgtcccacagtgcaag

SEQ ID NO: 763669 - DNA, 25 bp, Mus musculus
tcacatcagtgtgccacagtgcaag

SEQ ID NO: 763670 - DNA, 25 bp, Mus musculus
tcacatcatggaattggatgcacag

SEQ ID NO: 763671 - DNA, 25 bp, Mus musculus
tcacatcatggatttggatgcacag

SEQ ID NO: 763672 - DNA, 25 bp, Mus musculus
tcacatcgtcctaacagactttggg

SEQ ID NO: 763673 - DNA, 25 bp, Mus musculus
tcacatcgtccttacagactttggg

SEQ ID NO: 763674 - DNA, 25 bp, Mus musculus
tcacatctagaacgtgtaggagcca

SEQ ID NO: 763675 - DNA, 25 bp, Mus musculus
tcacatctagaaggtgtaggagcca

SEQ ID NO: 763676 - DNA, 25 bp, Mus musculus
tcacatctagatcgctgtcataaag

SEQ ID NO: 763677 - DNA, 25 bp, Mus musculus
tcacatctagatggctgtcataaag

SEQ ID NO: 763678 - DNA, 25 bp, Mus musculus
tcacatctaggccaaagccccatgt

SEQ ID NO: 763679 - DNA, 25 bp, Mus musculus
tcacatctaggcgaaagccccatgt

SEQ ID NO: 763680 - DNA, 25 bp, Mus musculus
tcacatctcccacgaggagtttcag

SEQ ID NO: 763681 - DNA, 25 bp, Mus musculus
tcacatctcccaggaggagtttcag

SEQ ID NO: 763682 - DNA, 25 bp, Mus musculus
tcacatctcctcagggagggggccg

SEQ ID NO: 763683 - DNA, 25 bp, Mus musculus
tcacatctcctctgggagggggccg

SEQ ID NO: 763684 - DNA, 25 bp, Mus musculus
tcacatctctgcagtgaatgggcag

SEQ ID NO: 763685 - DNA, 25 bp, Mus musculus
tcacatctctgctgtgaatgggcag

SEQ ID NO: 763686 - DNA, 25 bp, Mus musculus
tcacatctgcgacttcatcaggaag

SEQ ID NO: 763687 - DNA, 25 bp, Mus musculus
tcacatctgcgagttcatcaggaag

SEQ ID NO: 763688 - DNA, 25 bp, Mus musculus
tcacatcttcagcatttacacccag

SEQ ID NO: 763689 - DNA, 25 bp, Mus musculus
tcacatcttcaggatttacacccag

SEQ ID NO: 763690 - DNA, 25 bp, Mus musculus
tcacatcttcatccagctagctcgg

SEQ ID NO: 763691 - DNA, 25 bp, Mus musculus
tcacatcttcatgcagctagctcgg

SEQ ID NO: 763692 - DNA, 25 bp, Mus musculus
tcacatgaaaggattaagggctcct

SEQ ID NO: 763693 - DNA, 25 bp, Mus musculus
tcacatgaaaggtttaagggctcct

SEQ ID NO: 763694 - DNA, 25 bp, Mus musculus
tcacatgaacgaccagaaccgagag

SEQ ID NO: 763695 - DNA, 25 bp, Mus musculus
tcacatgaacgagcagaaccgagag

SEQ ID NO: 763696 - DNA, 25 bp, Mus musculus
tcacatgacaacacagagcctcggt

SEQ ID NO: 763697 - DNA, 25 bp, Mus musculus
tcacatgacaactcagagcctcggt

SEQ ID NO: 763698 - DNA, 25 bp, Mus musculus
tcacatgacaggctaagagcttagc

SEQ ID NO: 763699 - DNA, 25 bp, Mus musculus
tcacatgacagggtaagagcttagc

SEQ ID NO: 763700 - DNA, 25 bp, Mus musculus
tcacatgactggctgtgctacctgg

SEQ ID NO: 763701 - DNA, 25 bp, Mus musculus
tcacatgactgggtgtgctacctgg

SEQ ID NO: 763702 - DNA, 25 bp, Mus musculus
tcacatgataaacaacaaaccggcc

SEQ ID NO: 763703 - DNA, 25 bp, Mus musculus
tcacatgataaagaacaaaccggcc

SEQ ID NO: 763704 - DNA, 25 bp, Mus musculus
tcacatgatgctaaagatagctgag

SEQ ID NO: 763705 - DNA, 25 bp, Mus musculus
tcacatgatgcttaagatagctgag

SEQ ID NO: 763706 - DNA, 25 bp, Mus musculus
tcacatgccaatcgctggagacatg

SEQ ID NO: 763707 - DNA, 25 bp, Mus musculus
tcacatgccaatggctggagacatg

SEQ ID NO: 763708 - DNA, 25 bp, Mus musculus
tcacatgcttgccaacggttgggac

SEQ ID NO: 763709 - DNA, 25 bp, Mus musculus
tcacatgcttgcgaacggttgggac

SEQ ID NO: 763710 - DNA, 25 bp, Mus musculus
tcacatggaacgatgctatgctaag

SEQ ID NO: 763711 - DNA, 25 bp, Mus musculus
tcacatggaacgttgctatgctaag

SEQ ID NO: 763712 - DNA, 25 bp, Mus musculus
tcacatggaagacctaccaagagga

SEQ ID NO: 763713 - DNA, 25 bp, Mus musculus
tcacatggaagagctaccaagagga

SEQ ID NO: 763714 - DNA, 25 bp, Mus musculus
tcacatggaggtacgtccagggtgc

SEQ ID NO: 763715 - DNA, 25 bp, Mus musculus
tcacatggaggttcgtccagggtgc

SEQ ID NO: 763716 - DNA, 25 bp, Mus musculus
tcacatggctgtattgtctattcag

SEQ ID NO: 763717 - DNA, 25 bp, Mus musculus
tcacatggctgttttgtctattcag

SEQ ID NO: 763718 - DNA, 25 bp, Mus musculus
tcacatgggccaagaggcaacgagg

SEQ ID NO: 763719 - DNA, 25 bp, Mus musculus
tcacatgggccatgaggcaacgagg

SEQ ID NO: 763720 - DNA, 25 bp, Mus musculus
tcacatgtcaaacagcaatgcacgt

SEQ ID NO: 763721 - DNA, 25 bp, Mus musculus
tcacatgtcaaagagcaatgcacgt

SEQ ID NO: 763722 - DNA, 25 bp, Mus musculus
tcacatgtctgcagggaaggagcta

SEQ ID NO: 763723 - DNA, 25 bp, Mus musculus
tcacatgtctgctgggaaggagcta

SEQ ID NO: 763724 - DNA, 25 bp, Mus musculus
tcacattaacaacccaagaagagtt

SEQ ID NO: 763725 - DNA, 25 bp, Mus musculus
tcacattaacaagccaagaagagtt

SEQ ID NO: 763726 - DNA, 25 bp, Mus musculus
tcacattactggatgctaaggagct

SEQ ID NO: 763727 - DNA, 25 bp, Mus musculus
tcacattactggttgctaaggagct

SEQ ID NO: 763728 - DNA, 25 bp, Mus musculus
tcacattattgtcccagctgcttag

SEQ ID NO: 763729 - DNA, 25 bp, Mus musculus
tcacattattgtgccagctgcttag

SEQ ID NO: 763730 - DNA, 25 bp, Mus musculus
tcacattcctatcagcagcagcttc

SEQ ID NO: 763731 - DNA, 25 bp, Mus musculus
tcacattcctatgagcagcagcttc

SEQ ID NO: 763732 - DNA, 25 bp, Mus musculus
tcacattgaactagcagggcagacc

SEQ ID NO: 763733 - DNA, 25 bp, Mus musculus
tcacattgaacttgcagggcagacc

SEQ ID NO: 763734 - DNA, 25 bp, Mus musculus
tcacattgaggacaacaggtaccgc

SEQ ID NO: 763735 - DNA, 25 bp, Mus musculus
tcacattgaggagaacaggtaccgc

SEQ ID NO: 763736 - DNA, 25 bp, Mus musculus
tcacattgcagacctgcgcgtggca

SEQ ID NO: 763737 - DNA, 25 bp, Mus musculus
tcacattgcagagctgcgcgtggca

SEQ ID NO: 763738 - DNA, 25 bp, Mus musculus
tcacatttgcctataatcagatgaa

SEQ ID NO: 763739 - DNA, 25 bp, Mus musculus
tcacatttgcctttaatcagatgaa

SEQ ID NO: 763740 - DNA, 25 bp, Mus musculus
tcaccaaaaattagatcatcatagt

SEQ ID NO: 763741 - DNA, 25 bp, Mus musculus
tcaccaaaaatttgatcatcatagt

SEQ ID NO: 763742 - DNA, 25 bp, Mus musculus
tcaccaaaacataataaacgactgc

SEQ ID NO: 763743 - DNA, 25 bp, Mus musculus
tcaccaaaacattataaacgactgc

SEQ ID NO: 763744 - DNA, 25 bp, Mus musculus
tcaccaaaagatctggcagtgtatg

SEQ ID NO: 763745 - DNA, 25 bp, Mus musculus
tcaccaaaagatgtggcagtgtatg

SEQ ID NO: 763746 - DNA, 25 bp, Mus musculus
tcaccaaaagttagatgatgtagcc

SEQ ID NO: 763747 - DNA, 25 bp, Mus musculus
tcaccaaaagtttgatgatgtagcc

SEQ ID NO: 763748 - DNA, 25 bp, Mus musculus
tcaccaaacaaactgccctactata

SEQ ID NO: 763749 - DNA, 25 bp, Mus musculus
tcaccaaacaaagtgccctactata

SEQ ID NO: 763750 - DNA, 25 bp, Mus musculus
tcaccaaagagtaactatgaacttt

SEQ ID NO: 763751 - DNA, 25 bp, Mus musculus
tcaccaaagagttactatgaacttt

SEQ ID NO: 763752 - DNA, 25 bp, Mus musculus
tcaccaaagcagacatcgaacaact

SEQ ID NO: 763753 - DNA, 25 bp, Mus musculus
tcaccaaagcagtcatcgaacaact

SEQ ID NO: 763754 - DNA, 25 bp, Mus musculus
tcaccaaaggcaatccagcttcagg

SEQ ID NO: 763755 - DNA, 25 bp, Mus musculus
tcaccaaaggcattccagcttcagg

SEQ ID NO: 763756 - DNA, 25 bp, Mus musculus
tcaccaaagtggaatcaaccctctc

SEQ ID NO: 763757 - DNA, 25 bp, Mus musculus
tcaccaaagtggtatcaaccctctc

SEQ ID NO: 763758 - DNA, 25 bp, Mus musculus
tcaccaaataccctgtgctcatcaa

SEQ ID NO: 763759 - DNA, 25 bp, Mus musculus
tcaccaaataccgtgtgctcatcaa

SEQ ID NO: 763760 - DNA, 25 bp, Mus musculus
tcaccaacaaccacaagtctcttga

SEQ ID NO: 763761 - DNA, 25 bp, Mus musculus
tcaccaacaacctcaagtctcttga

SEQ ID NO: 763762 - DNA, 25 bp, Mus musculus
tcaccaacacgtacagtgctttgcc

SEQ ID NO: 763763 - DNA, 25 bp, Mus musculus
tcaccaacacgttcagtgctttgcc

SEQ ID NO: 763764 - DNA, 25 bp, Mus musculus
tcaccaacactaataaacagcaatc

SEQ ID NO: 763765 - DNA, 25 bp, Mus musculus
tcaccaacactattaaacagcaatc

SEQ ID NO: 763766 - DNA, 25 bp, Mus musculus
tcaccaacagtcagctcaagccaga

SEQ ID NO: 763767 - DNA, 25 bp, Mus musculus
tcaccaacagtctgctcaagccaga

SEQ ID NO: 763768 - DNA, 25 bp, Mus musculus
tcaccaaccagtcctcttttgacaa

SEQ ID NO: 763769 - DNA, 25 bp, Mus musculus
tcaccaaccagtgctcttttgacaa

SEQ ID NO: 763770 - DNA, 25 bp, Mus musculus
tcaccaaccctgaagatgcctgcag

SEQ ID NO: 763771 - DNA, 25 bp, Mus musculus
tcaccaaccctgtagatgcctgcag

SEQ ID NO: 763772 - DNA, 25 bp, Mus musculus
tcaccaacctaaccgaggagctggg

SEQ ID NO: 763773 - DNA, 25 bp, Mus musculus
tcaccaacctaagcgaggagctggg

SEQ ID NO: 763774 - DNA, 25 bp, Mus musculus
tcaccaacttaccattgatccaggg

SEQ ID NO: 763775 - DNA, 25 bp, Mus musculus
tcaccaacttacgattgatccaggg

SEQ ID NO: 763776 - DNA, 25 bp, Mus musculus
tcaccaagaactaaagtgaggacag

SEQ ID NO: 763777 - DNA, 25 bp, Mus musculus
tcaccaagaacttaagtgaggacag

SEQ ID NO: 763778 - DNA, 25 bp, Mus musculus
tcaccaagaagcatcagtatgagat

SEQ ID NO: 763779 - DNA, 25 bp, Mus musculus
tcaccaagaagcttcagtatgagat

SEQ ID NO: 763780 - DNA, 25 bp, Mus musculus
tcaccaagagcccagtaagagaatc

SEQ ID NO: 763781 - DNA, 25 bp, Mus musculus
tcaccaagagccgagtaagagaatc

SEQ ID NO: 763782 - DNA, 25 bp, Mus musculus
tcaccaagagtaccggttgtcatct

SEQ ID NO: 763783 - DNA, 25 bp, Mus musculus
tcaccaagagtagcggttgtcatct

SEQ ID NO: 763784 - DNA, 25 bp, Mus musculus
tcaccaagattgacatgtgtcctgc

SEQ ID NO: 763785 - DNA, 25 bp, Mus musculus
tcaccaagattgtcatgtgtcctgc

SEQ ID NO: 763786 - DNA, 25 bp, Mus musculus
tcaccaagcaagcatgggaggccaa

SEQ ID NO: 763787 - DNA, 25 bp, Mus musculus
tcaccaagcaaggatgggaggccaa

SEQ ID NO: 763788 - DNA, 25 bp, Mus musculus
tcaccaagccagaaggagtctacga

SEQ ID NO: 763789 - DNA, 25 bp, Mus musculus
tcaccaagccagtaggagtctacga

SEQ ID NO: 763790 - DNA, 25 bp, Mus musculus
tcaccaaggaacaagtgctgcagcg

SEQ ID NO: 763791 - DNA, 25 bp, Mus musculus
tcaccaaggaactagtgctgcagcg

SEQ ID NO: 763792 - DNA, 25 bp, Mus musculus
tcaccaaggaagagctgatccaggc

SEQ ID NO: 763793 - DNA, 25 bp, Mus musculus
tcaccaaggaagtgctgatccaggc

SEQ ID NO: 763794 - DNA, 25 bp, Mus musculus
tcaccaagggacctaaccacatggg

SEQ ID NO: 763795 - DNA, 25 bp, Mus musculus
tcaccaagggacgtaaccacatggg

SEQ ID NO: 763796 - DNA, 25 bp, Mus musculus
tcaccaagggccagcctttgtcacg

SEQ ID NO: 763797 - DNA, 25 bp, Mus musculus
tcaccaagggcctgcctttgtcacg

SEQ ID NO: 763798 - DNA, 25 bp, Mus musculus
tcaccaaggtgtctggagctcagga

SEQ ID NO: 763799 - DNA, 25 bp, Mus musculus
tcaccaaggtgtgtggagctcagga

SEQ ID NO: 763800 - DNA, 25 bp, Mus musculus
tcaccaagtgtcacttcgttggcct

SEQ ID NO: 763801 - DNA, 25 bp, Mus musculus
tcaccaagtgtctcttcgttggcct

SEQ ID NO: 763802 - DNA, 25 bp, Mus musculus
tcaccaatattaaggagtcacgcca

SEQ ID NO: 763803 - DNA, 25 bp, Mus musculus
tcaccaatattatggagtcacgcca

SEQ ID NO: 763804 - DNA, 25 bp, Mus musculus
tcaccaatgatgaggcctatgcaga

SEQ ID NO: 763805 - DNA, 25 bp, Mus musculus
tcaccaatgatgtggcctatgcaga

SEQ ID NO: 763806 - DNA, 25 bp, Mus musculus
tcaccaatgtgcaggagcctcctgg

SEQ ID NO: 763807 - DNA, 25 bp, Mus musculus
tcaccaatgtgctggagcctcctgg

SEQ ID NO: 763808 - DNA, 25 bp, Mus musculus
tcaccaattgtgcactaggccgaat

SEQ ID NO: 763809 - DNA, 25 bp, Mus musculus
tcaccaattgtggactaggccgaat

SEQ ID NO: 763810 - DNA, 25 bp, Mus musculus
tcaccacaatggagagcaacctgaa

SEQ ID NO: 763811 - DNA, 25 bp, Mus musculus
tcaccacaatggtgagcaacctgaa

SEQ ID NO: 763812 - DNA, 25 bp, Mus musculus
tcaccacacagcagaaactggctgg

SEQ ID NO: 763813 - DNA, 25 bp, Mus musculus
tcaccacacagctgaaactggctgg

SEQ ID NO: 763814 - DNA, 25 bp, Mus musculus
tcaccacacaggaaaccatgtgcga

SEQ ID NO: 763815 - DNA, 25 bp, Mus musculus
tcaccacacaggtaaccatgtgcga

SEQ ID NO: 763816 - DNA, 25 bp, Mus musculus
tcaccacactgaaagccagagagac

SEQ ID NO: 763817 - DNA, 25 bp, Mus musculus
tcaccacactgatagccagagagac

SEQ ID NO: 763818 - DNA, 25 bp, Mus musculus
tcaccacagctgactgcttcacggt

SEQ ID NO: 763819 - DNA, 25 bp, Mus musculus
tcaccacagctgtctgcttcacggt

SEQ ID NO: 763820 - DNA, 25 bp, Mus musculus
tcaccacaggttacagccgcatgag

SEQ ID NO: 763821 - DNA, 25 bp, Mus musculus
tcaccacaggtttcagccgcatgag

SEQ ID NO: 763822 - DNA, 25 bp, Mus musculus
tcaccacagtatctaaaaagagccc

SEQ ID NO: 763823 - DNA, 25 bp, Mus musculus
tcaccacagtatgtaaaaagagccc

SEQ ID NO: 763824 - DNA, 25 bp, Mus musculus
tcaccacagtctctgggaggctcgg

SEQ ID NO: 763825 - DNA, 25 bp, Mus musculus
tcaccacagtctgtgggaggctcgg

SEQ ID NO: 763826 - DNA, 25 bp, Mus musculus
tcaccacagtgacaacccaaggctt

SEQ ID NO: 763827 - DNA, 25 bp, Mus musculus
tcaccacagtgagaacccaaggctt

SEQ ID NO: 763828 - DNA, 25 bp, Mus musculus
tcaccaccaccaaaggtcagtaagt

SEQ ID NO: 763829 - DNA, 25 bp, Mus musculus
tcaccaccaccataggtcagtaagt

SEQ ID NO: 763830 - DNA, 25 bp, Mus musculus
tcaccaccccaaaaaacttagacag

SEQ ID NO: 763831 - DNA, 25 bp, Mus musculus
tcaccaccccaataaacttagacag

SEQ ID NO: 763832 - DNA, 25 bp, Mus musculus
tcaccacccgctctggaaaggtctt

SEQ ID NO: 763833 - DNA, 25 bp, Mus musculus
tcaccacccgctgtggaaaggtctt

SEQ ID NO: 763834 - DNA, 25 bp, Mus musculus
tcaccaccgtgacgtggcaggagaa

SEQ ID NO: 763835 - DNA, 25 bp, Mus musculus
tcaccaccgtgaggtggcaggagaa

SEQ ID NO: 763836 - DNA, 25 bp, Mus musculus
tcaccactccgacccaagtgggaag

SEQ ID NO: 763837 - DNA, 25 bp, Mus musculus
tcaccactccgagccaagtgggaag

SEQ ID NO: 763838 - DNA, 25 bp, Mus musculus
tcaccactgagacagggttcacagc

SEQ ID NO: 763839 - DNA, 25 bp, Mus musculus
tcaccactgagagagggttcacagc

SEQ ID NO: 763840 - DNA, 25 bp, Mus musculus
tcaccactgccaaggtcatcttgtg

SEQ ID NO: 763841 - DNA, 25 bp, Mus musculus
tcaccactgccatggtcatcttgtg

SEQ ID NO: 763842 - DNA, 25 bp, Mus musculus
tcaccagactgcagactaggcatct

SEQ ID NO: 763843 - DNA, 25 bp, Mus musculus
tcaccagactgctgactaggcatct

SEQ ID NO: 763844 - DNA, 25 bp, Mus musculus
tcaccagactgtcgacttcgtcagc

SEQ ID NO: 763845 - DNA, 25 bp, Mus musculus
tcaccagactgtggacttcgtcagc

SEQ ID NO: 763846 - DNA, 25 bp, Mus musculus
tcaccagagagaataaacgacgacg

SEQ ID NO: 763847 - DNA, 25 bp, Mus musculus
tcaccagagagattaaacgacgacg

SEQ ID NO: 763848 - DNA, 25 bp, Mus musculus
tcaccagagagcagtgggtccccag

SEQ ID NO: 763849 - DNA, 25 bp, Mus musculus
tcaccagagagctgtgggtccccag

SEQ ID NO: 763850 - DNA, 25 bp, Mus musculus
tcaccagagatacagaaagacagct

SEQ ID NO: 763851 - DNA, 25 bp, Mus musculus
tcaccagagatagagaaagacagct

SEQ ID NO: 763852 - DNA, 25 bp, Mus musculus
tcaccagagcatcatgttgctggcc

SEQ ID NO: 763853 - DNA, 25 bp, Mus musculus
tcaccagagcatgatgttgctggcc

SEQ ID NO: 763854 - DNA, 25 bp, Mus musculus
tcaccagaggacctttgttttggag

SEQ ID NO: 763855 - DNA, 25 bp, Mus musculus
tcaccagaggacgtttgttttggag

SEQ ID NO: 763856 - DNA, 25 bp, Mus musculus
tcaccagaggttacgaggagttcaa

SEQ ID NO: 763857 - DNA, 25 bp, Mus musculus
tcaccagaggtttcgaggagttcaa

SEQ ID NO: 763858 - DNA, 25 bp, Mus musculus
tcaccagataaacaagcggcagcgc

SEQ ID NO: 763859 - DNA, 25 bp, Mus musculus
tcaccagataaagaagcggcagcgc

SEQ ID NO: 763860 - DNA, 25 bp, Mus musculus
tcaccagatcgaagcagtgctcctg

SEQ ID NO: 763861 - DNA, 25 bp, Mus musculus
tcaccagatcgatgcagtgctcctg

SEQ ID NO: 763862 - DNA, 25 bp, Mus musculus
tcaccagatgcaatactctcaacag

SEQ ID NO: 763863 - DNA, 25 bp, Mus musculus
tcaccagatgcattactctcaacag

SEQ ID NO: 763864 - DNA, 25 bp, Mus musculus
tcaccagcaaaactaaggagtctat

SEQ ID NO: 763865 - DNA, 25 bp, Mus musculus
tcaccagcaaaagtaaggagtctat

SEQ ID NO: 763866 - DNA, 25 bp, Mus musculus
tcaccagcaacccagtaagcttggt

SEQ ID NO: 763867 - DNA, 25 bp, Mus musculus
tcaccagcaaccgagtaagcttggt

SEQ ID NO: 763868 - DNA, 25 bp, Mus musculus
tcaccagccaacatcatcaagccag

SEQ ID NO: 763869 - DNA, 25 bp, Mus musculus
tcaccagccaacttcatcaagccag

SEQ ID NO: 763870 - DNA, 25 bp, Mus musculus
tcaccagccaccaagtataacattc

SEQ ID NO: 763871 - DNA, 25 bp, Mus musculus
tcaccagccacctagtataacattc

SEQ ID NO: 763872 - DNA, 25 bp, Mus musculus
tcaccagccagactgtgaacgtggt

SEQ ID NO: 763873 - DNA, 25 bp, Mus musculus
tcaccagccagagtgtgaacgtggt

SEQ ID NO: 763874 - DNA, 25 bp, Mus musculus
tcaccagccatgaccctatgaggca

SEQ ID NO: 763875 - DNA, 25 bp, Mus musculus
tcaccagccatgtccctatgaggca

SEQ ID NO: 763876 - DNA, 25 bp, Mus musculus
tcaccagcgataagcagctttctac

SEQ ID NO: 763877 - DNA, 25 bp, Mus musculus
tcaccagcgatatgcagctttctac

SEQ ID NO: 763878 - DNA, 25 bp, Mus musculus
tcaccagcgggtcaaatacaccaag

SEQ ID NO: 763879 - DNA, 25 bp, Mus musculus
tcaccagcgggtgaaatacaccaag

SEQ ID NO: 763880 - DNA, 25 bp, Mus musculus
tcaccagctggcattaactcggagc

SEQ ID NO: 763881 - DNA, 25 bp, Mus musculus
tcaccagctggctttaactcggagc

SEQ ID NO: 763882 - DNA, 25 bp, Mus musculus
tcaccaggaactcgagaaattgccc

SEQ ID NO: 763883 - DNA, 25 bp, Mus musculus
tcaccaggaactggagaaattgccc

SEQ ID NO: 763884 - DNA, 25 bp, Mus musculus
tcaccaggacctaatgaaaggtatc

SEQ ID NO: 763885 - DNA, 25 bp, Mus musculus
tcaccaggaccttatgaaaggtatc

SEQ ID NO: 763886 - DNA, 25 bp, Mus musculus
tcaccaggactgacacgttcccagg

SEQ ID NO: 763887 - DNA, 25 bp, Mus musculus
tcaccaggactgtcacgttcccagg

SEQ ID NO: 763888 - DNA, 25 bp, Mus musculus
tcaccaggctggctacctgaatttt

SEQ ID NO: 763889 - DNA, 25 bp, Mus musculus
tcaccaggctgggtacctgaatttt

SEQ ID NO: 763890 - DNA, 25 bp, Mus musculus
tcaccagggagaatgtggcgctgaa

SEQ ID NO: 763891 - DNA, 25 bp, Mus musculus
tcaccagggagattgtggcgctgaa

SEQ ID NO: 763892 - DNA, 25 bp, Mus musculus
tcaccaggttcccaagactcgagaa

SEQ ID NO: 763893 - DNA, 25 bp, Mus musculus
tcaccaggttccgaagactcgagaa

SEQ ID NO: 763894 - DNA, 25 bp, Mus musculus
tcaccagtaaggactacagtgctgt

SEQ ID NO: 763895 - DNA, 25 bp, Mus musculus
tcaccagtaaggtctacagtgctgt

SEQ ID NO: 763896 - DNA, 25 bp, Mus musculus
tcaccagtcacgaacgggaccagtc

SEQ ID NO: 763897 - DNA, 25 bp, Mus musculus
tcaccagtcacgtacgggaccagtc

SEQ ID NO: 763898 - DNA, 25 bp, Mus musculus
tcaccagtgggaagcagcagatgac

SEQ ID NO: 763899 - DNA, 25 bp, Mus musculus
tcaccagtgggatgcagcagatgac

SEQ ID NO: 763900 - DNA, 25 bp, Mus musculus
tcaccagttgttactgaacacagaa

SEQ ID NO: 763901 - DNA, 25 bp, Mus musculus
tcaccagttgtttctgaacacagaa

SEQ ID NO: 763902 - DNA, 25 bp, Mus musculus
tcaccagttttgcaggcagcgacga

SEQ ID NO: 763903 - DNA, 25 bp, Mus musculus
tcaccagttttggaggcagcgacga

SEQ ID NO: 763904 - DNA, 25 bp, Mus musculus
tcaccatacataaaaagccgccaag

SEQ ID NO: 763905 - DNA, 25 bp, Mus musculus
tcaccatacatataaagccgccaag

SEQ ID NO: 763906 - DNA, 25 bp, Mus musculus
tcaccatatatgcaaaaatcagaat

SEQ ID NO: 763907 - DNA, 25 bp, Mus musculus
tcaccatatatggaaaaatcagaat

SEQ ID NO: 763908 - DNA, 25 bp, Mus musculus
tcaccatcaaggcaggtccttttaa

SEQ ID NO: 763909 - DNA, 25 bp, Mus musculus
tcaccatcaagggaggtccttttaa

SEQ ID NO: 763910 - DNA, 25 bp, Mus musculus
tcaccatccaggagctgctagacag

SEQ ID NO: 763911 - DNA, 25 bp, Mus musculus
tcaccatccaggtgctgctagacag

SEQ ID NO: 763912 - DNA, 25 bp, Mus musculus
tcaccatccatacgtgagctccagt

SEQ ID NO: 763913 - DNA, 25 bp, Mus musculus
tcaccatccataggtgagctccagt

SEQ ID NO: 763914 - DNA, 25 bp, Mus musculus
tcaccatcctggcactatttgatgc

SEQ ID NO: 763915 - DNA, 25 bp, Mus musculus
tcaccatcctgggactatttgatgc

SEQ ID NO: 763916 - DNA, 25 bp, Mus musculus
tcaccatcgtagactcaccgtagct

SEQ ID NO: 763917 - DNA, 25 bp, Mus musculus
tcaccatcgtagtctcaccgtagct

SEQ ID NO: 763918 - DNA, 25 bp, Mus musculus
tcaccatctcctatgtgtacactgc

SEQ ID NO: 763919 - DNA, 25 bp, Mus musculus
tcaccatctcctttgtgtacactgc

SEQ ID NO: 763920 - DNA, 25 bp, Mus musculus
tcaccatctgctatcctgaatacac

SEQ ID NO: 763921 - DNA, 25 bp, Mus musculus
tcaccatctgctttcctgaatacac

SEQ ID NO: 763922 - DNA, 25 bp, Mus musculus
tcaccatgaacccagactagctgtg

SEQ ID NO: 763923 - DNA, 25 bp, Mus musculus
tcaccatgaaccgagactagctgtg

SEQ ID NO: 763924 - DNA, 25 bp, Mus musculus
tcaccatgacgcaggcccgagtctg

SEQ ID NO: 763925 - DNA, 25 bp, Mus musculus
tcaccatgacgctggcccgagtctg

SEQ ID NO: 763926 - DNA, 25 bp, Mus musculus
tcaccatgaggtacaaggagacccg

SEQ ID NO: 763927 - DNA, 25 bp, Mus musculus
tcaccatgaggttcaaggagacccg

SEQ ID NO: 763928 - DNA, 25 bp, Mus musculus
tcaccatgagtgatgtatgtgggta

SEQ ID NO: 763929 - DNA, 25 bp, Mus musculus
tcaccatgagtgttgtatgtgggta

SEQ ID NO: 763930 - DNA, 25 bp, Mus musculus
tcaccatgccgaagctcagagtgct

SEQ ID NO: 763931 - DNA, 25 bp, Mus musculus
tcaccatgccgatgctcagagtgct

SEQ ID NO: 763932 - DNA, 25 bp, Mus musculus
tcaccatgcctgaatcctgggtgcc

SEQ ID NO: 763933 - DNA, 25 bp, Mus musculus
tcaccatgcctgtatcctgggtgcc

SEQ ID NO: 763934 - DNA, 25 bp, Mus musculus
tcaccatggaccaggagacagcact

SEQ ID NO: 763935 - DNA, 25 bp, Mus musculus
tcaccatggacctggagacagcact

SEQ ID NO: 763936 - DNA, 25 bp, Mus musculus
tcaccatggaggctgggaactactg

SEQ ID NO: 763937 - DNA, 25 bp, Mus musculus
tcaccatggagggtgggaactactg

SEQ ID NO: 763938 - DNA, 25 bp, Mus musculus
tcaccatggagtagtcaccgctgca

SEQ ID NO: 763939 - DNA, 25 bp, Mus musculus
tcaccatggagttgtcaccgctgca

SEQ ID NO: 763940 - DNA, 25 bp, Mus musculus
tcaccatggcaacgcagtgtacttg

SEQ ID NO: 763941 - DNA, 25 bp, Mus musculus
tcaccatggcaaggcagtgtacttg

SEQ ID NO: 763942 - DNA, 25 bp, Mus musculus
tcaccatgggacatctgctctgtca

SEQ ID NO: 763943 - DNA, 25 bp, Mus musculus
tcaccatgggacttctgctctgtca

SEQ ID NO: 763944 - DNA, 25 bp, Mus musculus
tcaccatgttccagtgctccgggtc

SEQ ID NO: 763945 - DNA, 25 bp, Mus musculus
tcaccatgttcctgtgctccgggtc

SEQ ID NO: 763946 - DNA, 25 bp, Mus musculus
tcaccattgccaaattgatcactca

SEQ ID NO: 763947 - DNA, 25 bp, Mus musculus
tcaccattgccaagcaggccaactg

SEQ ID NO: 763948 - DNA, 25 bp, Mus musculus
tcaccattgccatattgatcactca

SEQ ID NO: 763949 - DNA, 25 bp, Mus musculus
tcaccattgccatgcaggccaactg

SEQ ID NO: 763950 - DNA, 25 bp, Mus musculus
tcacccaagagcagagagacacagt

SEQ ID NO: 763951 - DNA, 25 bp, Mus musculus
tcacccaagagctgagagacacagt

SEQ ID NO: 763952 - DNA, 25 bp, Mus musculus
tcacccaagcgcaagatgaggagac

SEQ ID NO: 763953 - DNA, 25 bp, Mus musculus
tcacccaagcgctagatgaggagac

SEQ ID NO: 763954 - DNA, 25 bp, Mus musculus
tcacccaatcggagacgtagaggcg

SEQ ID NO: 763955 - DNA, 25 bp, Mus musculus
tcacccaatcggtgacgtagaggcg

SEQ ID NO: 763956 - DNA, 25 bp, Mus musculus
tcacccactcggaccgggtggtctt

SEQ ID NO: 763957 - DNA, 25 bp, Mus musculus
tcacccactcggtccgggtggtctt

SEQ ID NO: 763958 - DNA, 25 bp, Mus musculus
tcacccactttcagacaggtgtgtg

SEQ ID NO: 763959 - DNA, 25 bp, Mus musculus
tcacccactttctgacaggtgtgtg

SEQ ID NO: 763960 - DNA, 25 bp, Mus musculus
tcacccagaaagctgcccgacagag

SEQ ID NO: 763961 - DNA, 25 bp, Mus musculus
tcacccagaaaggtgcccgacagag

SEQ ID NO: 763962 - DNA, 25 bp, Mus musculus
tcacccagaggacatttaagctcga

SEQ ID NO: 763963 - DNA, 25 bp, Mus musculus
tcacccagaggagatttaagctcga

SEQ ID NO: 763964 - DNA, 25 bp, Mus musculus
tcacccatgagcacagccacagtga

SEQ ID NO: 763965 - DNA, 25 bp, Mus musculus
tcacccatgagctcagccacagtga

SEQ ID NO: 763966 - DNA, 25 bp, Mus musculus
tcacccatgatgctaggacttgctt

SEQ ID NO: 763967 - DNA, 25 bp, Mus musculus
tcacccatgatggtaggacttgctt

SEQ ID NO: 763968 - DNA, 25 bp, Mus musculus
tcacccatgtgaccctggacaagga

SEQ ID NO: 763969 - DNA, 25 bp, Mus musculus
tcacccatgtgagcctggacaagga

SEQ ID NO: 763970 - DNA, 25 bp, Mus musculus
tcacccatttggcaggaggtggaca

SEQ ID NO: 763971 - DNA, 25 bp, Mus musculus
tcacccatttgggaggaggtggaca

SEQ ID NO: 763972 - DNA, 25 bp, Mus musculus
tcaccccagcctaagaaggaaaatg

SEQ ID NO: 763973 - DNA, 25 bp, Mus musculus
tcaccccagccttagaaggaaaatg

SEQ ID NO: 763974 - DNA, 25 bp, Mus musculus
tcaccccagcttccttgcagaagga

SEQ ID NO: 763975 - DNA, 25 bp, Mus musculus
tcaccccagcttgcttgcagaagga

SEQ ID NO: 763976 - DNA, 25 bp, Mus musculus
tcaccccatgaaaggcctgagagcc

SEQ ID NO: 763977 - DNA, 25 bp, Mus musculus
tcaccccatgaatggcctgagagcc

SEQ ID NO: 763978 - DNA, 25 bp, Mus musculus
tcaccccggaacctggccatggaag

SEQ ID NO: 763979 - DNA, 25 bp, Mus musculus
tcaccccggaacgtggccatggaag

SEQ ID NO: 763980 - DNA, 25 bp, Mus musculus
tcaccccgtgtgattgccagacaag

SEQ ID NO: 763981 - DNA, 25 bp, Mus musculus
tcaccccgtgtgtttgccagacaag

SEQ ID NO: 763982 - DNA, 25 bp, Mus musculus
tcacccctccataggagagctggct

SEQ ID NO: 763983 - DNA, 25 bp, Mus musculus
tcacccctccattggagagctggct

SEQ ID NO: 763984 - DNA, 25 bp, Mus musculus
tcacccctctttcgtttggctaggt

SEQ ID NO: 763985 - DNA, 25 bp, Mus musculus
tcacccctctttggtttggctaggt

SEQ ID NO: 763986 - DNA, 25 bp, Mus musculus
tcacccctgcttaaacttcgcggat

SEQ ID NO: 763987 - DNA, 25 bp, Mus musculus
tcacccctgctttaacttcgcggat

SEQ ID NO: 763988 - DNA, 25 bp, Mus musculus
tcacccctggctctttatcgaggag

SEQ ID NO: 763989 - DNA, 25 bp, Mus musculus
tcacccctggctgtttatcgaggag

SEQ ID NO: 763990 - DNA, 25 bp, Mus musculus
tcacccctgtgcctgtcgtagaaag

SEQ ID NO: 763991 - DNA, 25 bp, Mus musculus
tcacccctgtgcgtgtcgtagaaag

SEQ ID NO: 763992 - DNA, 25 bp, Mus musculus
tcacccgagagaatccatgagaatg

SEQ ID NO: 763993 - DNA, 25 bp, Mus musculus
tcacccgagagattccatgagaatg

SEQ ID NO: 763994 - DNA, 25 bp, Mus musculus
tcacccgagataataagcagttaga

SEQ ID NO: 763995 - DNA, 25 bp, Mus musculus
tcacccgagatattaagcagttaga

SEQ ID NO: 763996 - DNA, 25 bp, Mus musculus
tcacccgcaggactctggaccgttg

SEQ ID NO: 763997 - DNA, 25 bp, Mus musculus
tcacccgcaggagtctggaccgttg

SEQ ID NO: 763998 - DNA, 25 bp, Mus musculus
tcacccgctccaaggcagaggagct

SEQ ID NO: 763999 - DNA, 25 bp, Mus musculus
tcacccgctccatggcagaggagct

SEQ ID NO: 764000 - DNA, 25 bp, Mus musculus
tcacccgctgtgagaggaatgcaca

SEQ ID NO: 764001 - DNA, 25 bp, Mus musculus
tcacccgctgtgtgaggaatgcaca

SEQ ID NO: 764002 - DNA, 25 bp, Mus musculus
tcacccggaatgaaaacaaacggcg

SEQ ID NO: 764003 - DNA, 25 bp, Mus musculus
tcacccggaatgtaaacaaacggcg

SEQ ID NO: 764004 - DNA, 25 bp, Mus musculus
tcacccgggaagaattctccaagat

SEQ ID NO: 764005 - DNA, 25 bp, Mus musculus
tcacccgggaagtattctccaagat

SEQ ID NO: 764006 - DNA, 25 bp, Mus musculus
tcacccggtctcaagagggaggttt

SEQ ID NO: 764007 - DNA, 25 bp, Mus musculus
tcacccggtctctagagggaggttt

SEQ ID NO: 764008 - DNA, 25 bp, Mus musculus
tcaccctacatgaccaaggaactac

SEQ ID NO: 764009 - DNA, 25 bp, Mus musculus
tcaccctacatgtccaaggaactac

SEQ ID NO: 764010 - DNA, 25 bp, Mus musculus
tcaccctcaaaaatcagttacacag

SEQ ID NO: 764011 - DNA, 25 bp, Mus musculus
tcaccctcaaaattcagttacacag

SEQ ID NO: 764012 - DNA, 25 bp, Mus musculus
tcaccctcggagaaaatgtagatgt

SEQ ID NO: 764013 - DNA, 25 bp, Mus musculus
tcaccctcggagtaaatgtagatgt

SEQ ID NO: 764014 - DNA, 25 bp, Mus musculus
tcaccctgagtgatgcctcaaaagc

SEQ ID NO: 764015 - DNA, 25 bp, Mus musculus
tcaccctgagtgttgcctcaaaagc

SEQ ID NO: 764016 - DNA, 25 bp, Mus musculus
tcaccctgatagaaaggactggagg

SEQ ID NO: 764017 - DNA, 25 bp, Mus musculus
tcaccctgatagtaaggactggagg

SEQ ID NO: 764018 - DNA, 25 bp, Mus musculus
tcaccctgcggaagctgatgcacgg

SEQ ID NO: 764019 - DNA, 25 bp, Mus musculus
tcaccctgcggatgctgatgcacgg

SEQ ID NO: 764020 - DNA, 25 bp, Mus musculus
tcaccctgctgtatcaaaaaactgc

SEQ ID NO: 764021 - DNA, 25 bp, Mus musculus
tcaccctgctgtttcaaaaaactgc

SEQ ID NO: 764022 - DNA, 25 bp, Mus musculus
tcaccctgggtcattgtcatagctg

SEQ ID NO: 764023 - DNA, 25 bp, Mus musculus
tcaccctgggtctttgtcatagctg

SEQ ID NO: 764024 - DNA, 25 bp, Mus musculus
tcaccctgggttcagattgctgccc

SEQ ID NO: 764025 - DNA, 25 bp, Mus musculus
tcaccctgggttgagattgctgccc

SEQ ID NO: 764026 - DNA, 25 bp, Mus musculus
tcaccctgtagacgtacttgtgccg

SEQ ID NO: 764027 - DNA, 25 bp, Mus musculus
tcaccctgtagaggtacttgtgccg

SEQ ID NO: 764028 - DNA, 25 bp, Mus musculus
tcaccctgtatgagttctggcagga

SEQ ID NO: 764029 - DNA, 25 bp, Mus musculus
tcaccctgtatgtgttctggcagga

SEQ ID NO: 764030 - DNA, 25 bp, Mus musculus
tcaccctgtggtagaaagcctccga

SEQ ID NO: 764031 - DNA, 25 bp, Mus musculus
tcaccctgtggttgaaagcctccga

SEQ ID NO: 764032 - DNA, 25 bp, Mus musculus
tcacccttctggcactatttgatgc

SEQ ID NO: 764033 - DNA, 25 bp, Mus musculus
tcacccttctgggactatttgatgc

SEQ ID NO: 764034 - DNA, 25 bp, Mus musculus
tcacccttgcttctggaggattggc

SEQ ID NO: 764035 - DNA, 25 bp, Mus musculus
tcacccttgcttgtggaggattggc

SEQ ID NO: 764036 - DNA, 25 bp, Mus musculus
tcacccttgggtacagagtcttgga

SEQ ID NO: 764037 - DNA, 25 bp, Mus musculus
tcacccttgggttcagagtcttgga

SEQ ID NO: 764038 - DNA, 25 bp, Mus musculus
tcacccttggtgcttgttcccttag

SEQ ID NO: 764039 - DNA, 25 bp, Mus musculus
tcacccttggtggttgttcccttag

SEQ ID NO: 764040 - DNA, 25 bp, Mus musculus
tcacccttgtttagcccctattaag

SEQ ID NO: 764041 - DNA, 25 bp, Mus musculus
tcacccttgttttgcccctattaag

SEQ ID NO: 764042 - DNA, 25 bp, Mus musculus
tcaccgaatagacgaacgtagccag

SEQ ID NO: 764043 - DNA, 25 bp, Mus musculus
tcaccgaatagaggaacgtagccag

SEQ ID NO: 764044 - DNA, 25 bp, Mus musculus
tcaccgaattcccagaagccgggag

SEQ ID NO: 764045 - DNA, 25 bp, Mus musculus
tcaccgaattccgagaagccgggag

SEQ ID NO: 764046 - DNA, 25 bp, Mus musculus
tcaccgacgtaaagagatgaccacc

SEQ ID NO: 764047 - DNA, 25 bp, Mus musculus
tcaccgacgtaatgagatgaccacc

SEQ ID NO: 764048 - DNA, 25 bp, Mus musculus
tcaccgactatgagacaaagaacat

SEQ ID NO: 764049 - DNA, 25 bp, Mus musculus
tcaccgactatgtgacaaagaacat

SEQ ID NO: 764050 - DNA, 25 bp, Mus musculus
tcaccgagacttcgcggccaggaat

SEQ ID NO: 764051 - DNA, 25 bp, Mus musculus
tcaccgagacttggcggccaggaat

SEQ ID NO: 764052 - DNA, 25 bp, Mus musculus
tcaccgagatgaatggacgcattgt

SEQ ID NO: 764053 - DNA, 25 bp, Mus musculus
tcaccgagatgattggacgcattgt

SEQ ID NO: 764054 - DNA, 25 bp, Mus musculus
tcaccgagcaaacttttggcaccgc

SEQ ID NO: 764055 - DNA, 25 bp, Mus musculus
tcaccgagcaaagttttggcaccgc

SEQ ID NO: 764056 - DNA, 25 bp, Mus musculus
tcaccgagcagaagatggaaaggag

SEQ ID NO: 764057 - DNA, 25 bp, Mus musculus
tcaccgagcagatgatggaaaggag

SEQ ID NO: 764058 - DNA, 25 bp, Mus musculus
tcaccgaggagtcgcgcgatctcca

SEQ ID NO: 764059 - DNA, 25 bp, Mus musculus
tcaccgaggagtggcgcgatctcca

SEQ ID NO: 764060 - DNA, 25 bp, Mus musculus
tcaccgagtatgagcgtgcccagta

SEQ ID NO: 764061 - DNA, 25 bp, Mus musculus
tcaccgagtatgtgcgtgcccagta

SEQ ID NO: 764062 - DNA, 25 bp, Mus musculus
tcaccgcagagtctccctgagagat

SEQ ID NO: 764063 - DNA, 25 bp, Mus musculus
tcaccgcagagtgtccctgagagat

SEQ ID NO: 764064 - DNA, 25 bp, Mus musculus
tcaccgcagatgatggacggcaggt

SEQ ID NO: 764065 - DNA, 25 bp, Mus musculus
tcaccgcagatgttggacggcaggt

SEQ ID NO: 764066 - DNA, 25 bp, Mus musculus
tcaccgcaggaaaaaagtgtcccaa

SEQ ID NO: 764067 - DNA, 25 bp, Mus musculus
tcaccgcaggaataaagtgtcccaa

SEQ ID NO: 764068 - DNA, 25 bp, Mus musculus
tcaccgctggcgagacctggcatgg

SEQ ID NO: 764069 - DNA, 25 bp, Mus musculus
tcaccgctggcgtgacctggcatgg

SEQ ID NO: 764070 - DNA, 25 bp, Mus musculus
tcaccggacacaatcctacagaagg

SEQ ID NO: 764071 - DNA, 25 bp, Mus musculus
tcaccggacacattcctacagaagg

SEQ ID NO: 764072 - DNA, 25 bp, Mus musculus
tcaccggacaggaagcgcctcgaag

SEQ ID NO: 764073 - DNA, 25 bp, Mus musculus
tcaccggacaggtagcgcctcgaag

SEQ ID NO: 764074 - DNA, 25 bp, Mus musculus
tcaccggcacatcaatggctatgga

SEQ ID NO: 764075 - DNA, 25 bp, Mus musculus
tcaccggcacatgaatggctatgga

SEQ ID NO: 764076 - DNA, 25 bp, Mus musculus
tcaccggcgccccatgtgagaaaga

SEQ ID NO: 764077 - DNA, 25 bp, Mus musculus
tcaccggcgcccgatgtgagaaaga

SEQ ID NO: 764078 - DNA, 25 bp, Mus musculus
tcaccggctgcacagagtctaggga

SEQ ID NO: 764079 - DNA, 25 bp, Mus musculus
tcaccggctgcagagagtctaggga

SEQ ID NO: 764080 - DNA, 25 bp, Mus musculus
tcaccgggactcagccccaatgtat

SEQ ID NO: 764081 - DNA, 25 bp, Mus musculus
tcaccgggactctgccccaatgtat

SEQ ID NO: 764082 - DNA, 25 bp, Mus musculus
tcaccgggaggcctttcctgagacc

SEQ ID NO: 764083 - DNA, 25 bp, Mus musculus
tcaccgggaggcgtttcctgagacc

SEQ ID NO: 764084 - DNA, 25 bp, Mus musculus
tcaccgtaggtgaactctgggcctt

SEQ ID NO: 764085 - DNA, 25 bp, Mus musculus
tcaccgtaggtgtactctgggcctt

SEQ ID NO: 764086 - DNA, 25 bp, Mus musculus
tcaccgtatcgtcgaggcctttcgg

SEQ ID NO: 764087 - DNA, 25 bp, Mus musculus
tcaccgtatcgtggaggcctttcgg

SEQ ID NO: 764088 - DNA, 25 bp, Mus musculus
tcaccgtcaacaaagccctgaacag

SEQ ID NO: 764089 - DNA, 25 bp, Mus musculus
tcaccgtcaacatagccctgaacag

SEQ ID NO: 764090 - DNA, 25 bp, Mus musculus
tcaccgtcagccatagcgtcactat

SEQ ID NO: 764091 - DNA, 25 bp, Mus musculus
tcaccgtcagccttagcgtcactat

SEQ ID NO: 764092 - DNA, 25 bp, Mus musculus
tcaccgtcaggacaagtgtaacctt

SEQ ID NO: 764093 - DNA, 25 bp, Mus musculus
tcaccgtcaggagaagtgtaacctt

SEQ ID NO: 764094 - DNA, 25 bp, Mus musculus
tcaccgtccccacacggaagtgttt

SEQ ID NO: 764095 - DNA, 25 bp, Mus musculus
tcaccgtccccagacggaagtgttt

SEQ ID NO: 764096 - DNA, 25 bp, Mus musculus
tcaccgtgatggctgtcatcagtgg

SEQ ID NO: 764097 - DNA, 25 bp, Mus musculus
tcaccgtgatgggtgtcatcagtgg

SEQ ID NO: 764098 - DNA, 25 bp, Mus musculus
tcaccgtgatttcaaactttccagt

SEQ ID NO: 764099 - DNA, 25 bp, Mus musculus
tcaccgtgatttgaaactttccagt

SEQ ID NO: 764100 - DNA, 25 bp, Mus musculus
tcaccgtgcgagacaccatgtctga

SEQ ID NO: 764101 - DNA, 25 bp, Mus musculus
tcaccgtgcgagtcaccatgtctga

SEQ ID NO: 764102 - DNA, 25 bp, Mus musculus
tcaccgtgcgccagaacctgaggaa

SEQ ID NO: 764103 - DNA, 25 bp, Mus musculus
tcaccgtgcgcctgaacctgaggaa

SEQ ID NO: 764104 - DNA, 25 bp, Mus musculus
tcaccgtgctagcttcaaaggctgc

SEQ ID NO: 764105 - DNA, 25 bp, Mus musculus
tcaccgtgctaggttcaaaggctgc

SEQ ID NO: 764106 - DNA, 25 bp, Mus musculus
tcaccgtgctgaatgggaagccctt

SEQ ID NO: 764107 - DNA, 25 bp, Mus musculus
tcaccgtgctgattgggaagccctt

SEQ ID NO: 764108 - DNA, 25 bp, Mus musculus
tcaccgtggaggaaggaaagtctgt

SEQ ID NO: 764109 - DNA, 25 bp, Mus musculus
tcaccgtggaggtaggaaagtctgt

SEQ ID NO: 764110 - DNA, 25 bp, Mus musculus
tcaccgtggagtaacaagtatgacc

SEQ ID NO: 764111 - DNA, 25 bp, Mus musculus
tcaccgtggagttacaagtatgacc

SEQ ID NO: 764112 - DNA, 25 bp, Mus musculus
tcaccgttacacagtgcgggccaag

SEQ ID NO: 764113 - DNA, 25 bp, Mus musculus
tcaccgttacactgtgcgggccaag

SEQ ID NO: 764114 - DNA, 25 bp, Mus musculus
tcacctaaaagtcggaaagcaaata

SEQ ID NO: 764115 - DNA, 25 bp, Mus musculus
tcacctaaaagtgggaaagcaaata

SEQ ID NO: 764116 - DNA, 25 bp, Mus musculus
tcacctaacttcatcctgtcatgcg

SEQ ID NO: 764117 - DNA, 25 bp, Mus musculus
tcacctaacttcttcctgtcatgcg

SEQ ID NO: 764118 - DNA, 25 bp, Mus musculus
tcacctacaacaactggtgatcgtt

SEQ ID NO: 764119 - DNA, 25 bp, Mus musculus
tcacctacaacatctggtgatcgtt

SEQ ID NO: 764120 - DNA, 25 bp, Mus musculus
tcacctacaagaagagagccacagg

SEQ ID NO: 764121 - DNA, 25 bp, Mus musculus
tcacctacaagatgagagccacagg

SEQ ID NO: 764122 - DNA, 25 bp, Mus musculus
tcacctacgatgaggtccaaacacg

SEQ ID NO: 764123 - DNA, 25 bp, Mus musculus
tcacctacgatgtggtccaaacacg

SEQ ID NO: 764124 - DNA, 25 bp, Mus musculus
tcacctacggtgaggggaagctact

SEQ ID NO: 764125 - DNA, 25 bp, Mus musculus
tcacctacggtgtggggaagctact

SEQ ID NO: 764126 - DNA, 25 bp, Mus musculus
tcacctaggcctctgggacaggaca

SEQ ID NO: 764127 - DNA, 25 bp, Mus musculus
tcacctaggcctgtgggacaggaca

SEQ ID NO: 764128 - DNA, 25 bp, Mus musculus
tcacctagggcaacagaagcaaggg

SEQ ID NO: 764129 - DNA, 25 bp, Mus musculus
tcacctagggcatcagaagcaaggg

SEQ ID NO: 764130 - DNA, 25 bp, Mus musculus
tcacctagtggcagtaccagctcag

SEQ ID NO: 764131 - DNA, 25 bp, Mus musculus
tcacctagtggctgtaccagctcag

SEQ ID NO: 764132 - DNA, 25 bp, Mus musculus
tcacctatgagacgcgggaactgtc

SEQ ID NO: 764133 - DNA, 25 bp, Mus musculus
tcacctatgagaggcgggaactgtc

SEQ ID NO: 764134 - DNA, 25 bp, Mus musculus
tcacctatgatgctaagtcaccacc

SEQ ID NO: 764135 - DNA, 25 bp, Mus musculus
tcacctatgatggtaagtcaccacc

SEQ ID NO: 764136 - DNA, 25 bp, Mus musculus
tcacctatgttcaccagaaacgatt

SEQ ID NO: 764137 - DNA, 25 bp, Mus musculus
tcacctatgttctccagaaacgatt

SEQ ID NO: 764138 - DNA, 25 bp, Mus musculus
tcacctattcccactgtgctggacg

SEQ ID NO: 764139 - DNA, 25 bp, Mus musculus
tcacctattccctctgtgctggacg

SEQ ID NO: 764140 - DNA, 25 bp, Mus musculus
tcacctcaaataagtttggctgcag

SEQ ID NO: 764141 - DNA, 25 bp, Mus musculus
tcacctcaaatatgtttggctgcag

SEQ ID NO: 764142 - DNA, 25 bp, Mus musculus
tcacctcaaccacaaaactcagttt

SEQ ID NO: 764143 - DNA, 25 bp, Mus musculus
tcacctcaaccagaaaactcagttt

SEQ ID NO: 764144 - DNA, 25 bp, Mus musculus
tcacctcagaaaagaatttatgcgt

SEQ ID NO: 764145 - DNA, 25 bp, Mus musculus
tcacctcagaaatgaatttatgcgt

SEQ ID NO: 764146 - DNA, 25 bp, Mus musculus
tcacctcagaatagtgctgcctaag

SEQ ID NO: 764147 - DNA, 25 bp, Mus musculus
tcacctcagaattgtgctgcctaag

SEQ ID NO: 764148 - DNA, 25 bp, Mus musculus
tcacctcagcacagcattcgttaaa

SEQ ID NO: 764149 - DNA, 25 bp, Mus musculus
tcacctcagcactgcattcgttaaa

SEQ ID NO: 764150 - DNA, 25 bp, Mus musculus
tcacctcagccaaggtcaaatatgg

SEQ ID NO: 764151 - DNA, 25 bp, Mus musculus
tcacctcagccatggtcaaatatgg

SEQ ID NO: 764152 - DNA, 25 bp, Mus musculus
tcacctcagggaacagggatcaggt

SEQ ID NO: 764153 - DNA, 25 bp, Mus musculus
tcacctcagggatcagggatcaggt

SEQ ID NO: 764154 - DNA, 25 bp, Mus musculus
tcacctcattgaatattacctggca

SEQ ID NO: 764155 - DNA, 25 bp, Mus musculus
tcacctcattgattattacctggca

SEQ ID NO: 764156 - DNA, 25 bp, Mus musculus
tcacctccacggaacttagagaaaa

SEQ ID NO: 764157 - DNA, 25 bp, Mus musculus
tcacctccacggtacttagagaaaa

SEQ ID NO: 764158 - DNA, 25 bp, Mus musculus
tcacctccacgtcggctggtatcag

SEQ ID NO: 764159 - DNA, 25 bp, Mus musculus
tcacctccacgtgggctggtatcag

SEQ ID NO: 764160 - DNA, 25 bp, Mus musculus
tcacctccggtcacaagtgtcatgg

SEQ ID NO: 764161 - DNA, 25 bp, Mus musculus
tcacctccggtcatatcatgcagct

SEQ ID NO: 764162 - DNA, 25 bp, Mus musculus
tcacctccggtctcaagtgtcatgg

SEQ ID NO: 764163 - DNA, 25 bp, Mus musculus
tcacctccggtcttatcatgcagct

SEQ ID NO: 764164 - DNA, 25 bp, Mus musculus
tcacctcgtgcaagggcgtgctcct

SEQ ID NO: 764165 - DNA, 25 bp, Mus musculus
tcacctcgtgcatgggcgtgctcct

SEQ ID NO: 764166 - DNA, 25 bp, Mus musculus
tcacctctacagacattgccgacgt

SEQ ID NO: 764167 - DNA, 25 bp, Mus musculus
tcacctctacagtcattgccgacgt

SEQ ID NO: 764168 - DNA, 25 bp, Mus musculus
tcacctctagatcacatcacgctga

SEQ ID NO: 764169 - DNA, 25 bp, Mus musculus
tcacctctagatgacatcacgctga

SEQ ID NO: 764170 - DNA, 25 bp, Mus musculus
tcacctctagctcgtccgacgggtt

SEQ ID NO: 764171 - DNA, 25 bp, Mus musculus
tcacctctagctggtccgacgggtt

SEQ ID NO: 764172 - DNA, 25 bp, Mus musculus
tcacctctgagaattgggacagtct

SEQ ID NO: 764173 - DNA, 25 bp, Mus musculus
tcacctctgagatttgggacagtct

SEQ ID NO: 764174 - DNA, 25 bp, Mus musculus
tcacctctgaggagtaatggactgt

SEQ ID NO: 764175 - DNA, 25 bp, Mus musculus
tcacctctgaggtgtaatggactgt

SEQ ID NO: 764176 - DNA, 25 bp, Mus musculus
tcacctctgatgaggagtacctgag

SEQ ID NO: 764177 - DNA, 25 bp, Mus musculus
tcacctctgatgtggagtacctgag

SEQ ID NO: 764178 - DNA, 25 bp, Mus musculus
tcacctctggagatctgctggccat

SEQ ID NO: 764179 - DNA, 25 bp, Mus musculus
tcacctctggagttctgctggccat

SEQ ID NO: 764180 - DNA, 25 bp, Mus musculus
tcacctctggccaaaagacatcagg

SEQ ID NO: 764181 - DNA, 25 bp, Mus musculus
tcacctctggcctaaagacatcagg

SEQ ID NO: 764182 - DNA, 25 bp, Mus musculus
tcacctctgggacttcacattggct

SEQ ID NO: 764183 - DNA, 25 bp, Mus musculus
tcacctctgggagttcacattggct

SEQ ID NO: 764184 - DNA, 25 bp, Mus musculus
tcacctctgggcaatggacgctttc

SEQ ID NO: 764185 - DNA, 25 bp, Mus musculus
tcacctctgggctatggacgctttc

SEQ ID NO: 764186 - DNA, 25 bp, Mus musculus
tcacctctgtgcacgaggacgacag

SEQ ID NO: 764187 - DNA, 25 bp, Mus musculus
tcacctctgtgctcgaggacgacag

SEQ ID NO: 764188 - DNA, 25 bp, Mus musculus
tcacctcttgccagatctcttacag

SEQ ID NO: 764189 - DNA, 25 bp, Mus musculus
tcacctcttgcctgatctcttacag

SEQ ID NO: 764190 - DNA, 25 bp, Mus musculus
tcacctgaagaacgcaatgcagact

SEQ ID NO: 764191 - DNA, 25 bp, Mus musculus
tcacctgaagaaggcaatgcagact

SEQ ID NO: 764192 - DNA, 25 bp, Mus musculus
tcacctgaattgatgccagcatatc

SEQ ID NO: 764193 - DNA, 25 bp, Mus musculus
tcacctgaattgttgccagcatatc

SEQ ID NO: 764194 - DNA, 25 bp, Mus musculus
tcacctgagagcctgctcgtgccag

SEQ ID NO: 764195 - DNA, 25 bp, Mus musculus
tcacctgagagcgtgctcgtgccag

SEQ ID NO: 764196 - DNA, 25 bp, Mus musculus
tcacctgatatgaaaaaggagcaag

SEQ ID NO: 764197 - DNA, 25 bp, Mus musculus
tcacctgatatgtaaaaggagcaag

SEQ ID NO: 764198 - DNA, 25 bp, Mus musculus
tcacctgatgcaagaacacatgggc

SEQ ID NO: 764199 - DNA, 25 bp, Mus musculus
tcacctgatgcatgaacacatgggc

SEQ ID NO: 764200 - DNA, 25 bp, Mus musculus
tcacctgcagtaccagccaaaaagg

SEQ ID NO: 764201 - DNA, 25 bp, Mus musculus
tcacctgcagtagcagccaaaaagg

SEQ ID NO: 764202 - DNA, 25 bp, Mus musculus
tcacctgcccaaagcagtacaagcg

SEQ ID NO: 764203 - DNA, 25 bp, Mus musculus
tcacctgcccaatgcagtacaagcg

SEQ ID NO: 764204 - DNA, 25 bp, Mus musculus
tcacctgcccagagcttcagggaca

SEQ ID NO: 764205 - DNA, 25 bp, Mus musculus
tcacctgcccagtgcttcagggaca

SEQ ID NO: 764206 - DNA, 25 bp, Mus musculus
tcacctgcgcccaggcacaggatgt

SEQ ID NO: 764207 - DNA, 25 bp, Mus musculus
tcacctgcgccctggcacaggatgt

SEQ ID NO: 764208 - DNA, 25 bp, Mus musculus
tcacctgctggtcgaatcctgggtc

SEQ ID NO: 764209 - DNA, 25 bp, Mus musculus
tcacctgctggtggaatcctgggtc

SEQ ID NO: 764210 - DNA, 25 bp, Mus musculus
tcacctggagcacaatcgggttaag

SEQ ID NO: 764211 - DNA, 25 bp, Mus musculus
tcacctggagcagaatcgggttaag

SEQ ID NO: 764212 - DNA, 25 bp, Mus musculus
tcacctggcagaagatcgaacagat

SEQ ID NO: 764213 - DNA, 25 bp, Mus musculus
tcacctggcagatgatcgaacagat

SEQ ID NO: 764214 - DNA, 25 bp, Mus musculus
tcacctggccgacggagttctctct

SEQ ID NO: 764215 - DNA, 25 bp, Mus musculus
tcacctggccgagggagttctctct

SEQ ID NO: 764216 - DNA, 25 bp, Mus musculus
tcacctggctttagagaaattcaca

SEQ ID NO: 764217 - DNA, 25 bp, Mus musculus
tcacctggcttttgagaaattcaca

SEQ ID NO: 764218 - DNA, 25 bp, Mus musculus
tcacctgggcaacgatgacttcgca

SEQ ID NO: 764219 - DNA, 25 bp, Mus musculus
tcacctgggcaaggatgacttcgca

SEQ ID NO: 764220 - DNA, 25 bp, Mus musculus
tcacctgtaaagaccacacctgcat

SEQ ID NO: 764221 - DNA, 25 bp, Mus musculus
tcacctgtaaagtccacacctgcat

SEQ ID NO: 764222 - DNA, 25 bp, Mus musculus
tcacctgtacttagtggcacaagaa

SEQ ID NO: 764223 - DNA, 25 bp, Mus musculus
tcacctgtactttgtggcacaagaa

SEQ ID NO: 764224 - DNA, 25 bp, Mus musculus
tcacctgtagctagtctgaaaacca

SEQ ID NO: 764225 - DNA, 25 bp, Mus musculus
tcacctgtagcttgtctgaaaacca

SEQ ID NO: 764226 - DNA, 25 bp, Mus musculus
tcacctgtcaagaggagcacccagg

SEQ ID NO: 764227 - DNA, 25 bp, Mus musculus
tcacctgtcaagtggagcacccagg

SEQ ID NO: 764228 - DNA, 25 bp, Mus musculus
tcacctgtcgccataagtatcttaa

SEQ ID NO: 764229 - DNA, 25 bp, Mus musculus
tcacctgtcgccttaagtatcttaa

SEQ ID NO: 764230 - DNA, 25 bp, Mus musculus
tcacctgtctccatgatttctttgg

SEQ ID NO: 764231 - DNA, 25 bp, Mus musculus
tcacctgtctccttgatttctttgg

SEQ ID NO: 764232 - DNA, 25 bp, Mus musculus
tcacctgtgcaacccatatatgtcc

SEQ ID NO: 764233 - DNA, 25 bp, Mus musculus
tcacctgtgcaagccatatatgtcc

SEQ ID NO: 764234 - DNA, 25 bp, Mus musculus
tcacctgtgcacatatgacaataag

SEQ ID NO: 764235 - DNA, 25 bp, Mus musculus
tcacctgtgcacttatgacaataag

SEQ ID NO: 764236 - DNA, 25 bp, Mus musculus
tcacctgtttataggcattgcagct

SEQ ID NO: 764237 - DNA, 25 bp, Mus musculus
tcacctgtttattggcattgcagct

SEQ ID NO: 764238 - DNA, 25 bp, Mus musculus
tcaccttaggaacaatgatcggctt

SEQ ID NO: 764239 - DNA, 25 bp, Mus musculus
tcaccttaggaagaatgatcggctt

SEQ ID NO: 764240 - DNA, 25 bp, Mus musculus
tcaccttatttgaggtggtgaagct

SEQ ID NO: 764241 - DNA, 25 bp, Mus musculus
tcaccttatttgtggtggtgaagct

SEQ ID NO: 764242 - DNA, 25 bp, Mus musculus
tcaccttcaaccaagtgaaaggcat

SEQ ID NO: 764243 - DNA, 25 bp, Mus musculus
tcaccttcaacctagtgaaaggcat

SEQ ID NO: 764244 - DNA, 25 bp, Mus musculus
tcaccttcaactagggcttctcggg

SEQ ID NO: 764245 - DNA, 25 bp, Mus musculus
tcaccttcaacttgggcttctcggg

SEQ ID NO: 764246 - DNA, 25 bp, Mus musculus
tcaccttcaaggacttacacttcaa

SEQ ID NO: 764247 - DNA, 25 bp, Mus musculus
tcaccttcaaggtcttacacttcaa

SEQ ID NO: 764248 - DNA, 25 bp, Mus musculus
tcaccttcagaaactagttccgagt

SEQ ID NO: 764249 - DNA, 25 bp, Mus musculus
tcaccttcagaatctagttccgagt

SEQ ID NO: 764250 - DNA, 25 bp, Mus musculus
tcaccttcagtgacttcaatgcaga

SEQ ID NO: 764251 - DNA, 25 bp, Mus musculus
tcaccttcagtgtcttcaatgcaga

SEQ ID NO: 764252 - DNA, 25 bp, Mus musculus
tcaccttcatctcctacgtggtgtc

SEQ ID NO: 764253 - DNA, 25 bp, Mus musculus
tcaccttcatctgctacgtggtgtc

SEQ ID NO: 764254 - DNA, 25 bp, Mus musculus
tcaccttccaaaaagtacttggcaa

SEQ ID NO: 764255 - DNA, 25 bp, Mus musculus
tcaccttccaaatagtacttggcaa

SEQ ID NO: 764256 - DNA, 25 bp, Mus musculus
tcaccttccgggagacagtcctgca

SEQ ID NO: 764257 - DNA, 25 bp, Mus musculus
tcaccttccgggtgacagtcctgca

SEQ ID NO: 764258 - DNA, 25 bp, Mus musculus
tcaccttcgatgatgcccagcagga

SEQ ID NO: 764259 - DNA, 25 bp, Mus musculus
tcaccttcgatgttgcccagcagga

SEQ ID NO: 764260 - DNA, 25 bp, Mus musculus
tcaccttctacacaaaggaaccttt

SEQ ID NO: 764261 - DNA, 25 bp, Mus musculus
tcaccttctacagaaaggaaccttt

SEQ ID NO: 764262 - DNA, 25 bp, Mus musculus
tcaccttctgatcgctggacgctgg

SEQ ID NO: 764263 - DNA, 25 bp, Mus musculus
tcaccttctgatggctggacgctgg

SEQ ID NO: 764264 - DNA, 25 bp, Mus musculus
tcaccttgaagaacttcacaggaga

SEQ ID NO: 764265 - DNA, 25 bp, Mus musculus
tcaccttgaagatcttcacaggaga

SEQ ID NO: 764266 - DNA, 25 bp, Mus musculus
tcaccttggaggatgtagcaagaat

SEQ ID NO: 764267 - DNA, 25 bp, Mus musculus
tcaccttggaggttgtagcaagaat

SEQ ID NO: 764268 - DNA, 25 bp, Mus musculus
tcaccttggatgatgggctgctcat

SEQ ID NO: 764269 - DNA, 25 bp, Mus musculus
tcaccttggatgttgggctgctcat

SEQ ID NO: 764270 - DNA, 25 bp, Mus musculus
tcaccttggtcaacctgctgcagct

SEQ ID NO: 764271 - DNA, 25 bp, Mus musculus
tcaccttggtcatcctgctgcagct

SEQ ID NO: 764272 - DNA, 25 bp, Mus musculus
tcaccttgttcaaccagttccagtg

SEQ ID NO: 764273 - DNA, 25 bp, Mus musculus
tcaccttgttcatccagttccagtg

SEQ ID NO: 764274 - DNA, 25 bp, Mus musculus
tcacctttctcccaaggcggacgtg

SEQ ID NO: 764275 - DNA, 25 bp, Mus musculus
tcacctttctccgaaggcggacgtg

SEQ ID NO: 764276 - DNA, 25 bp, Mus musculus
tcacctttcttgactttggcccctt

SEQ ID NO: 764277 - DNA, 25 bp, Mus musculus
tcacctttcttgcaaataggaggca

SEQ ID NO: 764278 - DNA, 25 bp, Mus musculus
tcacctttcttggaaataggaggca

SEQ ID NO: 764279 - DNA, 25 bp, Mus musculus
tcacctttcttgtctttggcccctt

SEQ ID NO: 764280 - DNA, 25 bp, Mus musculus
tcacctttgatgctatgcgccatgc

SEQ ID NO: 764281 - DNA, 25 bp, Mus musculus
tcacctttgatggtatgcgccatgc

SEQ ID NO: 764282 - DNA, 25 bp, Mus musculus
tcaccttttccactgggaagccaca

SEQ ID NO: 764283 - DNA, 25 bp, Mus musculus
tcaccttttccagtgggaagccaca

SEQ ID NO: 764284 - DNA, 25 bp, Mus musculus
tcacgaaacaatcaatcagaaaagc

SEQ ID NO: 764285 - DNA, 25 bp, Mus musculus
tcacgaaacaatgaatcagaaaagc

SEQ ID NO: 764286 - DNA, 25 bp, Mus musculus
tcacgaagagcacgtacccctagga

SEQ ID NO: 764287 - DNA, 25 bp, Mus musculus
tcacgaagagcaggtacccctagga

SEQ ID NO: 764288 - DNA, 25 bp, Mus musculus
tcacgaagatcacattgctttgctc

SEQ ID NO: 764289 - DNA, 25 bp, Mus musculus
tcacgaagatcagattgctttgctc

SEQ ID NO: 764290 - DNA, 25 bp, Mus musculus
tcacgaagggcaatatcccagctac

SEQ ID NO: 764291 - DNA, 25 bp, Mus musculus
tcacgaagggcattatcccagctac

SEQ ID NO: 764292 - DNA, 25 bp, Mus musculus
tcacgaaggtcgatcatctgccgca

SEQ ID NO: 764293 - DNA, 25 bp, Mus musculus
tcacgaaggtcgttcatctgccgca

SEQ ID NO: 764294 - DNA, 25 bp, Mus musculus
tcacgaagtggaaacagaatcagct

SEQ ID NO: 764295 - DNA, 25 bp, Mus musculus
tcacgaagtggatacagaatcagct

SEQ ID NO: 764296 - DNA, 25 bp, Mus musculus
tcacgaatcagcaggaggtccctgt

SEQ ID NO: 764297 - DNA, 25 bp, Mus musculus
tcacgaatcagctggaggtccctgt

SEQ ID NO: 764298 - DNA, 25 bp, Mus musculus
tcacgacaacagcttctacatccaa

SEQ ID NO: 764299 - DNA, 25 bp, Mus musculus
tcacgacaacaggttctacatccaa

SEQ ID NO: 764300 - DNA, 25 bp, Mus musculus
tcacgacatcatccacactaaggaa

SEQ ID NO: 764301 - DNA, 25 bp, Mus musculus
tcacgacatcatgcacactaaggaa

SEQ ID NO: 764302 - DNA, 25 bp, Mus musculus
tcacgaccagtaaattctgagggtt

SEQ ID NO: 764303 - DNA, 25 bp, Mus musculus
tcacgaccagtatattctgagggtt

SEQ ID NO: 764304 - DNA, 25 bp, Mus musculus
tcacgagaagtcaagatgacaacat

SEQ ID NO: 764305 - DNA, 25 bp, Mus musculus
tcacgagaagtctagatgacaacat

SEQ ID NO: 764306 - DNA, 25 bp, Mus musculus
tcacgagcgttgacaattgctgccc

SEQ ID NO: 764307 - DNA, 25 bp, Mus musculus
tcacgagcgttgtcaattgctgccc

SEQ ID NO: 764308 - DNA, 25 bp, Mus musculus
tcacgaggatccaggaaatgtatct

SEQ ID NO: 764309 - DNA, 25 bp, Mus musculus
tcacgaggatcctggaaatgtatct

SEQ ID NO: 764310 - DNA, 25 bp, Mus musculus
tcacgaggctagacatgtctatgct

SEQ ID NO: 764311 - DNA, 25 bp, Mus musculus
tcacgaggctagtcatgtctatgct

SEQ ID NO: 764312 - DNA, 25 bp, Mus musculus
tcacgatggtgacttcgagtacaac

SEQ ID NO: 764313 - DNA, 25 bp, Mus musculus
tcacgatggtgagttcgagtacaac

SEQ ID NO: 764314 - DNA, 25 bp, Mus musculus
tcacgatgtctgaccggaaggcagt

SEQ ID NO: 764315 - DNA, 25 bp, Mus musculus
tcacgatgtctgtccggaaggcagt

SEQ ID NO: 764316 - DNA, 25 bp, Mus musculus
tcacgcacacgcagagtgccgtggt

SEQ ID NO: 764317 - DNA, 25 bp, Mus musculus
tcacgcacacgctgagtgccgtggt

SEQ ID NO: 764318 - DNA, 25 bp, Mus musculus
tcacgcacagaacagccacggaaat

SEQ ID NO: 764319 - DNA, 25 bp, Mus musculus
tcacgcacagaagagccacggaaat

SEQ ID NO: 764320 - DNA, 25 bp, Mus musculus
tcacgcagggtgacttaggcctcat

SEQ ID NO: 764321 - DNA, 25 bp, Mus musculus
tcacgcagggtgtcttaggcctcat

SEQ ID NO: 764322 - DNA, 25 bp, Mus musculus
tcacgcatctatctggccctgggat

SEQ ID NO: 764323 - DNA, 25 bp, Mus musculus
tcacgcatctatgtggccctgggat

SEQ ID NO: 764324 - DNA, 25 bp, Mus musculus
tcacgcatgcgcagctcttctgcgg

SEQ ID NO: 764325 - DNA, 25 bp, Mus musculus
tcacgcatgcgctgctcttctgcgg

SEQ ID NO: 764326 - DNA, 25 bp, Mus musculus
tcacgccagaacactaagaaagact

SEQ ID NO: 764327 - DNA, 25 bp, Mus musculus
tcacgccagaactctaagaaagact

SEQ ID NO: 764328 - DNA, 25 bp, Mus musculus
tcacgccagaggcaatgctgactgc

SEQ ID NO: 764329 - DNA, 25 bp, Mus musculus
tcacgccagagggaatgctgactgc

SEQ ID NO: 764330 - DNA, 25 bp, Mus musculus
tcacgccgagcacatggtccgggat

SEQ ID NO: 764331 - DNA, 25 bp, Mus musculus
tcacgccgagcagatggtccgggat

SEQ ID NO: 764332 - DNA, 25 bp, Mus musculus
tcacgccgctcgaagactgctttat

SEQ ID NO: 764333 - DNA, 25 bp, Mus musculus
tcacgccgctcgtagactgctttat

SEQ ID NO: 764334 - DNA, 25 bp, Mus musculus
tcacgcctcctgctgcagtcctgaa

SEQ ID NO: 764335 - DNA, 25 bp, Mus musculus
tcacgcctcctggtgcagtcctgaa

SEQ ID NO: 764336 - DNA, 25 bp, Mus musculus
tcacgcctgcttcgacagaattgag

SEQ ID NO: 764337 - DNA, 25 bp, Mus musculus
tcacgcctgcttggacagaattgag

SEQ ID NO: 764338 - DNA, 25 bp, Mus musculus
tcacgcgggacgcaagaacttgccc

SEQ ID NO: 764339 - DNA, 25 bp, Mus musculus
tcacgcgggacggaagaacttgccc

SEQ ID NO: 764340 - DNA, 25 bp, Mus musculus
tcacgcgggcttcagtcaagaactt

SEQ ID NO: 764341 - DNA, 25 bp, Mus musculus
tcacgcgggcttgagtcaagaactt

SEQ ID NO: 764342 - DNA, 25 bp, Mus musculus
tcacgcgggtgcagctgcatgtact

SEQ ID NO: 764343 - DNA, 25 bp, Mus musculus
tcacgcgggtgctgctgcatgtact

SEQ ID NO: 764344 - DNA, 25 bp, Mus musculus
tcacgctagtgaccccgaataatta

SEQ ID NO: 764345 - DNA, 25 bp, Mus musculus
tcacgctagtgagcccgaataatta

SEQ ID NO: 764346 - DNA, 25 bp, Mus musculus
tcacgctccattcgcaacctgtttg

SEQ ID NO: 764347 - DNA, 25 bp, Mus musculus
tcacgctccattggcaacctgtttg

SEQ ID NO: 764348 - DNA, 25 bp, Mus musculus
tcacgctccctactgcagtgatgga

SEQ ID NO: 764349 - DNA, 25 bp, Mus musculus
tcacgctccctagtgcagtgatgga

SEQ ID NO: 764350 - DNA, 25 bp, Mus musculus
tcacgctgacctccgaggcagaaag

SEQ ID NO: 764351 - DNA, 25 bp, Mus musculus
tcacgctgacctgcgaggcagaaag

SEQ ID NO: 764352 - DNA, 25 bp, Mus musculus
tcacgctggctaagctcgactctgg

SEQ ID NO: 764353 - DNA, 25 bp, Mus musculus
tcacgctggctatgctcgactctgg

SEQ ID NO: 764354 - DNA, 25 bp, Mus musculus
tcacgctgggttacgatgccatccg

SEQ ID NO: 764355 - DNA, 25 bp, Mus musculus
tcacgctgggtttcgatgccatccg

SEQ ID NO: 764356 - DNA, 25 bp, Mus musculus
tcacgctgtgcaactcggtgctgct

SEQ ID NO: 764357 - DNA, 25 bp, Mus musculus
tcacgctgtgcatctcggtgctgct

SEQ ID NO: 764358 - DNA, 25 bp, Mus musculus
tcacgcttatctcgagcaaaaccca

SEQ ID NO: 764359 - DNA, 25 bp, Mus musculus
tcacgcttatctggagcaaaaccca

SEQ ID NO: 764360 - DNA, 25 bp, Mus musculus
tcacggaagagtctaccaagaatcc

SEQ ID NO: 764361 - DNA, 25 bp, Mus musculus
tcacggaagagtgtaccaagaatcc

SEQ ID NO: 764362 - DNA, 25 bp, Mus musculus
tcacggaagcctctgtgggatcctg

SEQ ID NO: 764363 - DNA, 25 bp, Mus musculus
tcacggaagcctgtgtgggatcctg

SEQ ID NO: 764364 - DNA, 25 bp, Mus musculus
tcacggaagtgacgactgatacctt

SEQ ID NO: 764365 - DNA, 25 bp, Mus musculus
tcacggaagtgaggactgatacctt

SEQ ID NO: 764366 - DNA, 25 bp, Mus musculus
tcacggacatgaccgagaagattgt

SEQ ID NO: 764367 - DNA, 25 bp, Mus musculus
tcacggacatgagcgagaagattgt

SEQ ID NO: 764368 - DNA, 25 bp, Mus musculus
tcacggacttagcaaacactgccag

SEQ ID NO: 764369 - DNA, 25 bp, Mus musculus
tcacggacttaggaaacactgccag

SEQ ID NO: 764370 - DNA, 25 bp, Mus musculus
tcacggactttgagccatatgctac

SEQ ID NO: 764371 - DNA, 25 bp, Mus musculus
tcacggactttgtgccatatgctac

SEQ ID NO: 764372 - DNA, 25 bp, Mus musculus
tcacggagacgtagggaccgaagcc

SEQ ID NO: 764373 - DNA, 25 bp, Mus musculus
tcacggagacgttgggaccgaagcc

SEQ ID NO: 764374 - DNA, 25 bp, Mus musculus
tcacggagcagtaccaggtgttgct

SEQ ID NO: 764375 - DNA, 25 bp, Mus musculus
tcacggagcagttccaggtgttgct

SEQ ID NO: 764376 - DNA, 25 bp, Mus musculus
tcacggaggcacagaagcaaggcct

SEQ ID NO: 764377 - DNA, 25 bp, Mus musculus
tcacggaggcactgaagcaaggcct

SEQ ID NO: 764378 - DNA, 25 bp, Mus musculus
tcacggaggtctagggaaggcgaaa

SEQ ID NO: 764379 - DNA, 25 bp, Mus musculus
tcacggaggtcttgggaaggcgaaa

SEQ ID NO: 764380 - DNA, 25 bp, Mus musculus
tcacggatatgaatgccacccttgc

SEQ ID NO: 764381 - DNA, 25 bp, Mus musculus
tcacggatatgattgccacccttgc

SEQ ID NO: 764382 - DNA, 25 bp, Mus musculus
tcacggatcgccaacagtgacgaag

SEQ ID NO: 764383 - DNA, 25 bp, Mus musculus
tcacggatcgcctacagtgacgaag

SEQ ID NO: 764384 - DNA, 25 bp, Mus musculus
tcacggatgattcacatccagacca

SEQ ID NO: 764385 - DNA, 25 bp, Mus musculus
tcacggatgattgacatccagacca

SEQ ID NO: 764386 - DNA, 25 bp, Mus musculus
tcacggatggttcctgacagactgc

SEQ ID NO: 764387 - DNA, 25 bp, Mus musculus
tcacggatggttgctgacagactgc

SEQ ID NO: 764388 - DNA, 25 bp, Mus musculus
tcacggatgtcactgagacgacaat

SEQ ID NO: 764389 - DNA, 25 bp, Mus musculus
tcacggatgtcagtgagacgacaat

SEQ ID NO: 764390 - DNA, 25 bp, Mus musculus
tcacggcagagtcgtggaaagcagc

SEQ ID NO: 764391 - DNA, 25 bp, Mus musculus
tcacggcagagtggtggaaagcagc

SEQ ID NO: 764392 - DNA, 25 bp, Mus musculus
tcacggcagtgacaatacgggaaac

SEQ ID NO: 764393 - DNA, 25 bp, Mus musculus
tcacggcagtgagaatacgggaaac

SEQ ID NO: 764394 - DNA, 25 bp, Mus musculus
tcacggcatttgcactgaaagccag

SEQ ID NO: 764395 - DNA, 25 bp, Mus musculus
tcacggcatttggactgaaagccag

SEQ ID NO: 764396 - DNA, 25 bp, Mus musculus
tcacggccatccaatatggtaacgg

SEQ ID NO: 764397 - DNA, 25 bp, Mus musculus
tcacggccatcctatatggtaacgg

SEQ ID NO: 764398 - DNA, 25 bp, Mus musculus
tcacggcctggtcgcatcattgcag

SEQ ID NO: 764399 - DNA, 25 bp, Mus musculus
tcacggcctggtggcatcattgcag

SEQ ID NO: 764400 - DNA, 25 bp, Mus musculus
tcacggctactaagttcggcctcgg

SEQ ID NO: 764401 - DNA, 25 bp, Mus musculus
tcacggctactatgttcggcctcgg

SEQ ID NO: 764402 - DNA, 25 bp, Mus musculus
tcacggctagcaaagtcacgtggta

SEQ ID NO: 764403 - DNA, 25 bp, Mus musculus
tcacggctagcatagtcacgtggta

SEQ ID NO: 764404 - DNA, 25 bp, Mus musculus
tcacggctatctacaggagctctct

SEQ ID NO: 764405 - DNA, 25 bp, Mus musculus
tcacggctatcttcaggagctctct

SEQ ID NO: 764406 - DNA, 25 bp, Mus musculus
tcacggctctcaactgtgagaccgg

SEQ ID NO: 764407 - DNA, 25 bp, Mus musculus
tcacggctctcatctgtgagaccgg

SEQ ID NO: 764408 - DNA, 25 bp, Mus musculus
tcacggctgcatattgaagcacttc

SEQ ID NO: 764409 - DNA, 25 bp, Mus musculus
tcacggctgcattttgaagcacttc

SEQ ID NO: 764410 - DNA, 25 bp, Mus musculus
tcacggctggccaggactgttgttc

SEQ ID NO: 764411 - DNA, 25 bp, Mus musculus
tcacggctggcctggactgttgttc

SEQ ID NO: 764412 - DNA, 25 bp, Mus musculus
tcacggcttcagatgatggctacat

SEQ ID NO: 764413 - DNA, 25 bp, Mus musculus
tcacggcttcagttgatggctacat

SEQ ID NO: 764414 - DNA, 25 bp, Mus musculus
tcacggcttcgtcgtactcaaggag

SEQ ID NO: 764415 - DNA, 25 bp, Mus musculus
tcacggcttcgtggtactcaaggag

SEQ ID NO: 764416 - DNA, 25 bp, Mus musculus
tcacgggaactcaccggaagactag

SEQ ID NO: 764417 - DNA, 25 bp, Mus musculus
tcacgggaactctccggaagactag

SEQ ID NO: 764418 - DNA, 25 bp, Mus musculus
tcacgggaagacagagattgtaccc

SEQ ID NO: 764419 - DNA, 25 bp, Mus musculus
tcacgggaagactgagattgtaccc

SEQ ID NO: 764420 - DNA, 25 bp, Mus musculus
tcacgggaatagcagtagagctctc

SEQ ID NO: 764421 - DNA, 25 bp, Mus musculus
tcacgggaataggagtagagctctc

SEQ ID NO: 764422 - DNA, 25 bp, Mus musculus
tcacgggacaccctgagttctggcg

SEQ ID NO: 764423 - DNA, 25 bp, Mus musculus
tcacgggacaccgtgagttctggcg

SEQ ID NO: 764424 - DNA, 25 bp, Mus musculus
tcacgggagaaaatggaacggcgtt

SEQ ID NO: 764425 - DNA, 25 bp, Mus musculus
tcacgggagaaattggaacggcgtt

SEQ ID NO: 764426 - DNA, 25 bp, Mus musculus
tcacgggcactcaggatgccaaccg

SEQ ID NO: 764427 - DNA, 25 bp, Mus musculus
tcacgggcactctggatgccaaccg

SEQ ID NO: 764428 - DNA, 25 bp, Mus musculus
tcacgggcatcaacgtgggtgtctg

SEQ ID NO: 764429 - DNA, 25 bp, Mus musculus
tcacgggcatcatcgtgggtgtctg

SEQ ID NO: 764430 - DNA, 25 bp, Mus musculus
tcacgggctcgactagtggacaaac

SEQ ID NO: 764431 - DNA, 25 bp, Mus musculus
tcacgggctcgagtagtggacaaac

SEQ ID NO: 764432 - DNA, 25 bp, Mus musculus
tcacgggtcacactgaaacatctag

SEQ ID NO: 764433 - DNA, 25 bp, Mus musculus
tcacgggtcacagtgaaacatctag

SEQ ID NO: 764434 - DNA, 25 bp, Mus musculus
tcacgggtctacctgtgtgcctcag

SEQ ID NO: 764435 - DNA, 25 bp, Mus musculus
tcacgggtctacgtgtgtgcctcag

SEQ ID NO: 764436 - DNA, 25 bp, Mus musculus
tcacgggtgacaagaaggaattcgc

SEQ ID NO: 764437 - DNA, 25 bp, Mus musculus
tcacgggtgacatgaaggaattcgc

SEQ ID NO: 764438 - DNA, 25 bp, Mus musculus
tcacgggtgtgtcgaagtatatcac

SEQ ID NO: 764439 - DNA, 25 bp, Mus musculus
tcacgggtgtgtggaagtatatcac

SEQ ID NO: 764440 - DNA, 25 bp, Mus musculus
tcacgggttggacccattaaactta

SEQ ID NO: 764441 - DNA, 25 bp, Mus musculus
tcacgggttggagccattaaactta

SEQ ID NO: 764442 - DNA, 25 bp, Mus musculus
tcacggtaaacaagcggatgtggaa

SEQ ID NO: 764443 - DNA, 25 bp, Mus musculus
tcacggtaaacatgcggatgtggaa

SEQ ID NO: 764444 - DNA, 25 bp, Mus musculus
tcacggtaaccaaccccaagaggat

SEQ ID NO: 764445 - DNA, 25 bp, Mus musculus
tcacggtaaccatccccaagaggat

SEQ ID NO: 764446 - DNA, 25 bp, Mus musculus
tcacggtgaagacgcctaaagagaa

SEQ ID NO: 764447 - DNA, 25 bp, Mus musculus
tcacggtgaagaggcctaaagagaa

SEQ ID NO: 764448 - DNA, 25 bp, Mus musculus
tcacggtgaagtctaaagtaaccag

SEQ ID NO: 764449 - DNA, 25 bp, Mus musculus
tcacggtgaagtgtaaagtaaccag

SEQ ID NO: 764450 - DNA, 25 bp, Mus musculus
tcacggtgagtcctacttgcctgac

SEQ ID NO: 764451 - DNA, 25 bp, Mus musculus
tcacggtgagtcgtacttgcctgac

SEQ ID NO: 764452 - DNA, 25 bp, Mus musculus
tcacggtgtgccaccctacagtact

SEQ ID NO: 764453 - DNA, 25 bp, Mus musculus
tcacggtgtgcctccctacagtact

SEQ ID NO: 764454 - DNA, 25 bp, Mus musculus
tcacgtaaaactaggaacccaacat

SEQ ID NO: 764455 - DNA, 25 bp, Mus musculus
tcacgtaaaacttggaacccaacat

SEQ ID NO: 764456 - DNA, 25 bp, Mus musculus
tcacgtagtcaactattatggcagc

SEQ ID NO: 764457 - DNA, 25 bp, Mus musculus
tcacgtagtcaagtattatggcagc

SEQ ID NO: 764458 - DNA, 25 bp, Mus musculus
tcacgtatctaaccagccatgacta

SEQ ID NO: 764459 - DNA, 25 bp, Mus musculus
tcacgtatctaagcagccatgacta

SEQ ID NO: 764460 - DNA, 25 bp, Mus musculus
tcacgtatgcagagagcgccgctgg

SEQ ID NO: 764461 - DNA, 25 bp, Mus musculus
tcacgtatgcagtgagcgccgctgg

SEQ ID NO: 764462 - DNA, 25 bp, Mus musculus
tcacgtatttacacttgaatccaaa

SEQ ID NO: 764463 - DNA, 25 bp, Mus musculus
tcacgtatttactcttgaatccaaa

SEQ ID NO: 764464 - DNA, 25 bp, Mus musculus
tcacgtcacctcagaatctctcagg

SEQ ID NO: 764465 - DNA, 25 bp, Mus musculus
tcacgtcacctctgaatctctcagg

SEQ ID NO: 764466 - DNA, 25 bp, Mus musculus
tcacgtcactataggagacatcaaa

SEQ ID NO: 764467 - DNA, 25 bp, Mus musculus
tcacgtcactattggagacatcaaa

SEQ ID NO: 764468 - DNA, 25 bp, Mus musculus
tcacgtcagtggcaaatatgcacga

SEQ ID NO: 764469 - DNA, 25 bp, Mus musculus
tcacgtcagtgggaaatatgcacga

SEQ ID NO: 764470 - DNA, 25 bp, Mus musculus
tcacgtcatgagattgccaatgctg

SEQ ID NO: 764471 - DNA, 25 bp, Mus musculus
tcacgtcatgagtttgccaatgctg

SEQ ID NO: 764472 - DNA, 25 bp, Mus musculus
tcacgtccactcagaaagctaccta

SEQ ID NO: 764473 - DNA, 25 bp, Mus musculus
tcacgtccactctgaaagctaccta

SEQ ID NO: 764474 - DNA, 25 bp, Mus musculus
tcacgtcctttgagggtgctgccct

SEQ ID NO: 764475 - DNA, 25 bp, Mus musculus
tcacgtcctttgtgggtgctgccct

SEQ ID NO: 764476 - DNA, 25 bp, Mus musculus
tcacgtcggcctacatcaggaaccg

SEQ ID NO: 764477 - DNA, 25 bp, Mus musculus
tcacgtcggccttcatcaggaaccg

SEQ ID NO: 764478 - DNA, 25 bp, Mus musculus
tcacgtctaataaggactccgtggg

SEQ ID NO: 764479 - DNA, 25 bp, Mus musculus
tcacgtctaatatggactccgtggg

SEQ ID NO: 764480 - DNA, 25 bp, Mus musculus
tcacgtctattcaaaacaggaaggc

SEQ ID NO: 764481 - DNA, 25 bp, Mus musculus
tcacgtctattctaaacaggaaggc

SEQ ID NO: 764482 - DNA, 25 bp, Mus musculus
tcacgtgacacgcaagtgactccga

SEQ ID NO: 764483 - DNA, 25 bp, Mus musculus
tcacgtgacacggaagtgactccga

SEQ ID NO: 764484 - DNA, 25 bp, Mus musculus
tcacgtgatcaccacagtttcccag

SEQ ID NO: 764485 - DNA, 25 bp, Mus musculus
tcacgtgatcacgacagtttcccag

SEQ ID NO: 764486 - DNA, 25 bp, Mus musculus
tcacgtgccccgcacgttggtgagc

SEQ ID NO: 764487 - DNA, 25 bp, Mus musculus
tcacgtgccccggacgttggtgagc

SEQ ID NO: 764488 - DNA, 25 bp, Mus musculus
tcacgtgctcggacttggaaggcct

SEQ ID NO: 764489 - DNA, 25 bp, Mus musculus
tcacgtgctcggtcttggaaggcct

SEQ ID NO: 764490 - DNA, 25 bp, Mus musculus
tcacgtggaaaaatagcattacagc

SEQ ID NO: 764491 - DNA, 25 bp, Mus musculus
tcacgtggaaaattagcattacagc

SEQ ID NO: 764492 - DNA, 25 bp, Mus musculus
tcacgtggacaacagcaacccctga

SEQ ID NO: 764493 - DNA, 25 bp, Mus musculus
tcacgtggacaagagcaacccctga

SEQ ID NO: 764494 - DNA, 25 bp, Mus musculus
tcacgtgtccccactgagactctag

SEQ ID NO: 764495 - DNA, 25 bp, Mus musculus
tcacgtgtcccctctgagactctag

SEQ ID NO: 764496 - DNA, 25 bp, Mus musculus
tcacgtgtgtcgctaagtaaaatgc

SEQ ID NO: 764497 - DNA, 25 bp, Mus musculus
tcacgtgtgtcggtaagtaaaatgc

SEQ ID NO: 764498 - DNA, 25 bp, Mus musculus
tcacgttgaagtctcacctcctgtt

SEQ ID NO: 764499 - DNA, 25 bp, Mus musculus
tcacgttgaagtgtcacctcctgtt

SEQ ID NO: 764500 - DNA, 25 bp, Mus musculus
tcacgttgagcgacaagacccagtc

SEQ ID NO: 764501 - DNA, 25 bp, Mus musculus
tcacgttgagcgtcaagacccagtc

SEQ ID NO: 764502 - DNA, 25 bp, Mus musculus
tcacgttgaggacacctttgacagt

SEQ ID NO: 764503 - DNA, 25 bp, Mus musculus
tcacgttgaggagacctttgacagt

SEQ ID NO: 764504 - DNA, 25 bp, Mus musculus
tcacgttgttgcagagtggatccag

SEQ ID NO: 764505 - DNA, 25 bp, Mus musculus
tcacgttgttgctgagtggatccag

SEQ ID NO: 764506 - DNA, 25 bp, Mus musculus
tcactaaaagagatccagggatctg

SEQ ID NO: 764507 - DNA, 25 bp, Mus musculus
tcactaaaagagttccagggatctg

SEQ ID NO: 764508 - DNA, 25 bp, Mus musculus
tcactaacagcccttgccgagagat

SEQ ID NO: 764509 - DNA, 25 bp, Mus musculus
tcactaacagccgttgccgagagat

SEQ ID NO: 764510 - DNA, 25 bp, Mus musculus
tcactaaccagcacagtgcctggcg

SEQ ID NO: 764511 - DNA, 25 bp, Mus musculus
tcactaaccagctcagtgcctggcg

SEQ ID NO: 764512 - DNA, 25 bp, Mus musculus
tcactaacgcaacagcagacagcag

SEQ ID NO: 764513 - DNA, 25 bp, Mus musculus
tcactaacgcaagagcagacagcag

SEQ ID NO: 764514 - DNA, 25 bp, Mus musculus
tcactaagattgagattacggacac

SEQ ID NO: 764515 - DNA, 25 bp, Mus musculus
tcactaagattgtgattacggacac

SEQ ID NO: 764516 - DNA, 25 bp, Mus musculus
tcactaaggaaaaaaggatgactcc

SEQ ID NO: 764517 - DNA, 25 bp, Mus musculus
tcactaaggaaataaggatgactcc

SEQ ID NO: 764518 - DNA, 25 bp, Mus musculus
tcactaagtgaacaggagctggccg

SEQ ID NO: 764519 - DNA, 25 bp, Mus musculus
tcactaagtgaagaggagctggccg

SEQ ID NO: 764520 - DNA, 25 bp, Mus musculus
tcactaatccagctggcttgttttg

SEQ ID NO: 764521 - DNA, 25 bp, Mus musculus
tcactaatccaggtggcttgttttg

SEQ ID NO: 764522 - DNA, 25 bp, Mus musculus
tcactacaacttccacaagattttg

SEQ ID NO: 764523 - DNA, 25 bp, Mus musculus
tcactacaacttgcacaagattttg

SEQ ID NO: 764524 - DNA, 25 bp, Mus musculus
tcactacaagttcgctctaggtcaa

SEQ ID NO: 764525 - DNA, 25 bp, Mus musculus
tcactacaagttggctctaggtcaa

SEQ ID NO: 764526 - DNA, 25 bp, Mus musculus
tcactacactcaaccatcctttgaa

SEQ ID NO: 764527 - DNA, 25 bp, Mus musculus
tcactacactcatccatcctttgaa

SEQ ID NO: 764528 - DNA, 25 bp, Mus musculus
tcactacagaacagaacagcgccac

SEQ ID NO: 764529 - DNA, 25 bp, Mus musculus
tcactacagaactgaacagcgccac

SEQ ID NO: 764530 - DNA, 25 bp, Mus musculus
tcactacagaccagattgtgcagag

SEQ ID NO: 764531 - DNA, 25 bp, Mus musculus
tcactacagacctgattgtgcagag

SEQ ID NO: 764532 - DNA, 25 bp, Mus musculus
tcactacatgtcagtgtaacagagc

SEQ ID NO: 764533 - DNA, 25 bp, Mus musculus
tcactacatgtctgtgtaacagagc

SEQ ID NO: 764534 - DNA, 25 bp, Mus musculus
tcactaccacgcagttggttccagc

SEQ ID NO: 764535 - DNA, 25 bp, Mus musculus
tcactaccacgctgttggttccagc

SEQ ID NO: 764536 - DNA, 25 bp, Mus musculus
tcactaccacgtcggctcagctgga

SEQ ID NO: 764537 - DNA, 25 bp, Mus musculus
tcactaccacgtgggctcagctgga

SEQ ID NO: 764538 - DNA, 25 bp, Mus musculus
tcactactgcatagcacacctcagg

SEQ ID NO: 764539 - DNA, 25 bp, Mus musculus
tcactactgcattgcacacctcagg

SEQ ID NO: 764540 - DNA, 25 bp, Mus musculus
tcactactgcgtcgtgtccaactac

SEQ ID NO: 764541 - DNA, 25 bp, Mus musculus
tcactactgcgtggtgtccaactac

SEQ ID NO: 764542 - DNA, 25 bp, Mus musculus
tcactactggaactcctgacccagg

SEQ ID NO: 764543 - DNA, 25 bp, Mus musculus
tcactactggaagtcctgacccagg

SEQ ID NO: 764544 - DNA, 25 bp, Mus musculus
tcactactgttcctgcgttcccgga

SEQ ID NO: 764545 - DNA, 25 bp, Mus musculus
tcactactgttcgtgcgttcccgga

SEQ ID NO: 764546 - DNA, 25 bp, Mus musculus
tcactagagtagcaaaaagcccagt

SEQ ID NO: 764547 - DNA, 25 bp, Mus musculus
tcactagagtaggaaaaagcccagt

SEQ ID NO: 764548 - DNA, 25 bp, Mus musculus
tcactagcttatcgagcccaggcag

SEQ ID NO: 764549 - DNA, 25 bp, Mus musculus
tcactagcttatggagcccaggcag

SEQ ID NO: 764550 - DNA, 25 bp, Mus musculus
tcactagggccgcagctcagtgaga

SEQ ID NO: 764551 - DNA, 25 bp, Mus musculus
tcactagggccggagctcagtgaga

SEQ ID NO: 764552 - DNA, 25 bp, Mus musculus
tcactataggagacatcaaaacagg

SEQ ID NO: 764553 - DNA, 25 bp, Mus musculus
tcactataggagtcatcaaaacagg

SEQ ID NO: 764554 - DNA, 25 bp, Mus musculus
tcactatcaagcccctggacaggaa

SEQ ID NO: 764555 - DNA, 25 bp, Mus musculus
tcactatcaagcgcctggacaggaa

SEQ ID NO: 764556 - DNA, 25 bp, Mus musculus
tcactatcatcacagcgggctaacg

SEQ ID NO: 764557 - DNA, 25 bp, Mus musculus
tcactatcatcagagcgggctaacg

SEQ ID NO: 764558 - DNA, 25 bp, Mus musculus
tcactatgaggcaaagcaaggtgga

SEQ ID NO: 764559 - DNA, 25 bp, Mus musculus
tcactatgaggctaagcaaggtgga

SEQ ID NO: 764560 - DNA, 25 bp, Mus musculus
tcactatgcaggaaggtaacttcct

SEQ ID NO: 764561 - DNA, 25 bp, Mus musculus
tcactatgcaggtaggtaacttcct

SEQ ID NO: 764562 - DNA, 25 bp, Mus musculus
tcactatgccagaggatgattattg

SEQ ID NO: 764563 - DNA, 25 bp, Mus musculus
tcactatgccagtggatgattattg

SEQ ID NO: 764564 - DNA, 25 bp, Mus musculus
tcactatggaagatgaaggcaattc

SEQ ID NO: 764565 - DNA, 25 bp, Mus musculus
tcactatggaagttgaaggcaattc

SEQ ID NO: 764566 - DNA, 25 bp, Mus musculus
tcactatggactacaagcaccggca

SEQ ID NO: 764567 - DNA, 25 bp, Mus musculus
tcactatggacttcaagcaccggca

SEQ ID NO: 764568 - DNA, 25 bp, Mus musculus
tcactatggagccttgattggcctc

SEQ ID NO: 764569 - DNA, 25 bp, Mus musculus
tcactatggagcgttgattggcctc

SEQ ID NO: 764570 - DNA, 25 bp, Mus musculus
tcactatggatgctgtgagcacagc

SEQ ID NO: 764571 - DNA, 25 bp, Mus musculus
tcactatggatggtgtgagcacagc

SEQ ID NO: 764572 - DNA, 25 bp, Mus musculus
tcactatgtctgacgggtgtaccac

SEQ ID NO: 764573 - DNA, 25 bp, Mus musculus
tcactatgtctgtcgggtgtaccac

SEQ ID NO: 764574 - DNA, 25 bp, Mus musculus
tcactatgtggaccaagctgggctc

SEQ ID NO: 764575 - DNA, 25 bp, Mus musculus
tcactatgtggagcaagctgggctc

SEQ ID NO: 764576 - DNA, 25 bp, Mus musculus
tcactattgactacagcacaggctt

SEQ ID NO: 764577 - DNA, 25 bp, Mus musculus
tcactattgacttcagcacaggctt

SEQ ID NO: 764578 - DNA, 25 bp, Mus musculus
tcactattgctacgtatggatctcc

SEQ ID NO: 764579 - DNA, 25 bp, Mus musculus
tcactattgctaggtatggatctcc

SEQ ID NO: 764580 - DNA, 25 bp, Mus musculus
tcactatttggaactgttcagaaaa

SEQ ID NO: 764581 - DNA, 25 bp, Mus musculus
tcactatttggatctgttcagaaaa

SEQ ID NO: 764582 - DNA, 25 bp, Mus musculus
tcactcaaagagcaagttggtgccc

SEQ ID NO: 764583 - DNA, 25 bp, Mus musculus
tcactcaaagaggaagttggtgccc

SEQ ID NO: 764584 - DNA, 25 bp, Mus musculus
tcactcaatgatacggaaacaagga

SEQ ID NO: 764585 - DNA, 25 bp, Mus musculus
tcactcaatgattcggaaacaagga

SEQ ID NO: 764586 - DNA, 25 bp, Mus musculus
tcactcaatggactggttccacaga

SEQ ID NO: 764587 - DNA, 25 bp, Mus musculus
tcactcaatggagtggttccacaga

SEQ ID NO: 764588 - DNA, 25 bp, Mus musculus
tcactcagaagtcgaccatggtagg

SEQ ID NO: 764589 - DNA, 25 bp, Mus musculus
tcactcagaagtggaccatggtagg

SEQ ID NO: 764590 - DNA, 25 bp, Mus musculus
tcactcaggagtcgaagcctttgta

SEQ ID NO: 764591 - DNA, 25 bp, Mus musculus
tcactcaggagtggaagcctttgta

SEQ ID NO: 764592 - DNA, 25 bp, Mus musculus
tcactcatcggaccgagttgtggcc

SEQ ID NO: 764593 - DNA, 25 bp, Mus musculus
tcactcatcggagcgagttgtggcc

SEQ ID NO: 764594 - DNA, 25 bp, Mus musculus
tcactcatctgccaaagtgtgagag

SEQ ID NO: 764595 - DNA, 25 bp, Mus musculus
tcactcatctgcgaaagtgtgagag

SEQ ID NO: 764596 - DNA, 25 bp, Mus musculus
tcactcatgcaaacaaaagcgactc

SEQ ID NO: 764597 - DNA, 25 bp, Mus musculus
tcactcatgcaatcaaaagcgactc

SEQ ID NO: 764598 - DNA, 25 bp, Mus musculus
tcactcattatgatatcctgacccc

SEQ ID NO: 764599 - DNA, 25 bp, Mus musculus
tcactcattatgttatcctgacccc

SEQ ID NO: 764600 - DNA, 25 bp, Mus musculus
tcactcattcttcatgggcattcga

SEQ ID NO: 764601 - DNA, 25 bp, Mus musculus
tcactcattcttgatgggcattcga

SEQ ID NO: 764602 - DNA, 25 bp, Mus musculus
tcactccaggagacttgagggacct

SEQ ID NO: 764603 - DNA, 25 bp, Mus musculus
tcactccaggagtcttgagggacct

SEQ ID NO: 764604 - DNA, 25 bp, Mus musculus
tcactccatgcacagaaaagatccg

SEQ ID NO: 764605 - DNA, 25 bp, Mus musculus
tcactccatgcagagaaaagatccg

SEQ ID NO: 764606 - DNA, 25 bp, Mus musculus
tcactccatggaagaagtgacagct

SEQ ID NO: 764607 - DNA, 25 bp, Mus musculus
tcactccatggacctttagtggtaa

SEQ ID NO: 764608 - DNA, 25 bp, Mus musculus
tcactccatggagctttagtggtaa

SEQ ID NO: 764609 - DNA, 25 bp, Mus musculus
tcactccatggatgaagtgacagct

SEQ ID NO: 764610 - DNA, 25 bp, Mus musculus
tcactcccagacaacgtgagcggtg

SEQ ID NO: 764611 - DNA, 25 bp, Mus musculus
tcactcccagactacgtgagcggtg

SEQ ID NO: 764612 - DNA, 25 bp, Mus musculus
tcactcccgaccagtacctgaagat

SEQ ID NO: 764613 - DNA, 25 bp, Mus musculus
tcactcccgacctgtacctgaagat

SEQ ID NO: 764614 - DNA, 25 bp, Mus musculus
tcactcccgattctgagggaatcat

SEQ ID NO: 764615 - DNA, 25 bp, Mus musculus
tcactcccgattgtgagggaatcat

SEQ ID NO: 764616 - DNA, 25 bp, Mus musculus
tcactcccgggcagtatgccatggt

SEQ ID NO: 764617 - DNA, 25 bp, Mus musculus
tcactcccgggctgtatgccatggt

SEQ ID NO: 764618 - DNA, 25 bp, Mus musculus
tcactccctcggcatgctggaagct

SEQ ID NO: 764619 - DNA, 25 bp, Mus musculus
tcactccctcgggatgctggaagct

SEQ ID NO: 764620 - DNA, 25 bp, Mus musculus
tcactcctggcgaccctgggactgg

SEQ ID NO: 764621 - DNA, 25 bp, Mus musculus
tcactcctggcgtccctgggactgg

SEQ ID NO: 764622 - DNA, 25 bp, Mus musculus
tcactccttccgcaagcaagctaag

SEQ ID NO: 764623 - DNA, 25 bp, Mus musculus
tcactccttccggaagcaagctaag

SEQ ID NO: 764624 - DNA, 25 bp, Mus musculus
tcactccttggtccttaatgatagt

SEQ ID NO: 764625 - DNA, 25 bp, Mus musculus
tcactccttggtgcttaatgatagt

SEQ ID NO: 764626 - DNA, 25 bp, Mus musculus
tcactcgaagctaccgcagtgtggg

SEQ ID NO: 764627 - DNA, 25 bp, Mus musculus
tcactcgaagcttccgcagtgtggg

SEQ ID NO: 764628 - DNA, 25 bp, Mus musculus
tcactcgcctgccacttaagcggag

SEQ ID NO: 764629 - DNA, 25 bp, Mus musculus
tcactcgcctgcgacttaagcggag

SEQ ID NO: 764630 - DNA, 25 bp, Mus musculus
tcactcgctttcctaggcgcggaca

SEQ ID NO: 764631 - DNA, 25 bp, Mus musculus
tcactcgctttcgtaggcgcggaca

SEQ ID NO: 764632 - DNA, 25 bp, Mus musculus
tcactcggagaccaaatcctggagg

SEQ ID NO: 764633 - DNA, 25 bp, Mus musculus
tcactcggagacgaaatcctggagg

SEQ ID NO: 764634 - DNA, 25 bp, Mus musculus
tcactcggagctagagtcccgggct

SEQ ID NO: 764635 - DNA, 25 bp, Mus musculus
tcactcggagcttgagtcccgggct

SEQ ID NO: 764636 - DNA, 25 bp, Mus musculus
tcactcggatgcagggtcccagggc

SEQ ID NO: 764637 - DNA, 25 bp, Mus musculus
tcactcggatgctgggtcccagggc

SEQ ID NO: 764638 - DNA, 25 bp, Mus musculus
tcactcggccagaacattttgactt

SEQ ID NO: 764639 - DNA, 25 bp, Mus musculus
tcactcggccagtacattttgactt

SEQ ID NO: 764640 - DNA, 25 bp, Mus musculus
tcactcggccccagtggagggagcc

SEQ ID NO: 764641 - DNA, 25 bp, Mus musculus
tcactcggcccctgtggagggagcc

SEQ ID NO: 764642 - DNA, 25 bp, Mus musculus
tcactcgggtgtcaagccgtaccag

SEQ ID NO: 764643 - DNA, 25 bp, Mus musculus
tcactcgggtgtgaagccgtaccag

SEQ ID NO: 764644 - DNA, 25 bp, Mus musculus
tcactctcaacaagggtgaggcctt

SEQ ID NO: 764645 - DNA, 25 bp, Mus musculus
tcactctcaacatgggtgaggcctt

SEQ ID NO: 764646 - DNA, 25 bp, Mus musculus
tcactctcaagcacatctgagtaag

SEQ ID NO: 764647 - DNA, 25 bp, Mus musculus
tcactctcaagctcatctgagtaag

SEQ ID NO: 764648 - DNA, 25 bp, Mus musculus
tcactctcactgagtctaccagcag

SEQ ID NO: 764649 - DNA, 25 bp, Mus musculus
tcactctcactgtgtctaccagcag

SEQ ID NO: 764650 - DNA, 25 bp, Mus musculus
tcactctcagcacctgtctctcaca

SEQ ID NO: 764651 - DNA, 25 bp, Mus musculus
tcactctcagcagctgtctctcaca

SEQ ID NO: 764652 - DNA, 25 bp, Mus musculus
tcactctccggacgtcgcagaggct

SEQ ID NO: 764653 - DNA, 25 bp, Mus musculus
tcactctccggaggtcgcagaggct

SEQ ID NO: 764654 - DNA, 25 bp, Mus musculus
tcactctgacagaactagaaaccca

SEQ ID NO: 764655 - DNA, 25 bp, Mus musculus
tcactctgacagtactagaaaccca

SEQ ID NO: 764656 - DNA, 25 bp, Mus musculus
tcactctgagaaagcgcacactggg

SEQ ID NO: 764657 - DNA, 25 bp, Mus musculus
tcactctgagaatgcgcacactggg

SEQ ID NO: 764658 - DNA, 25 bp, Mus musculus
tcactctgccatccagaaaagagcg

SEQ ID NO: 764659 - DNA, 25 bp, Mus musculus
tcactctgccatgcagaaaagagcg

SEQ ID NO: 764660 - DNA, 25 bp, Mus musculus
tcactctgctggaattattcatcgg

SEQ ID NO: 764661 - DNA, 25 bp, Mus musculus
tcactctgctggtattattcatcgg

SEQ ID NO: 764662 - DNA, 25 bp, Mus musculus
tcactctgcttgatccagtctccaa

SEQ ID NO: 764663 - DNA, 25 bp, Mus musculus
tcactctgcttgttccagtctccaa

SEQ ID NO: 764664 - DNA, 25 bp, Mus musculus
tcactctggaaccatggacgacaga

SEQ ID NO: 764665 - DNA, 25 bp, Mus musculus
tcactctggaacgatggacgacaga

SEQ ID NO: 764666 - DNA, 25 bp, Mus musculus
tcactctggctcaacctggcgtggg

SEQ ID NO: 764667 - DNA, 25 bp, Mus musculus
tcactctggctctacctggcgtggg

SEQ ID NO: 764668 - DNA, 25 bp, Mus musculus
tcactctgggaactgatctttgtct

SEQ ID NO: 764669 - DNA, 25 bp, Mus musculus
tcactctgggaagtgatctttgtct

SEQ ID NO: 764670 - DNA, 25 bp, Mus musculus
tcactctgggagaactagggccacc

SEQ ID NO: 764671 - DNA, 25 bp, Mus musculus
tcactctgggagtactagggccacc

SEQ ID NO: 764672 - DNA, 25 bp, Mus musculus
tcactctgtggacacaccttatggc

SEQ ID NO: 764673 - DNA, 25 bp, Mus musculus
tcactctgtggagacaccttatggc

SEQ ID NO: 764674 - DNA, 25 bp, Mus musculus
tcactcttcgccaagggcttgcaga

SEQ ID NO: 764675 - DNA, 25 bp, Mus musculus
tcactcttcgcctagggcttgcaga

SEQ ID NO: 764676 - DNA, 25 bp, Mus musculus
tcactctttggacgtcgaccttgac

SEQ ID NO: 764677 - DNA, 25 bp, Mus musculus
tcactctttggaggtcgaccttgac

SEQ ID NO: 764678 - DNA, 25 bp, Mus musculus
tcactgaaaagcacgtgcaagcggc

SEQ ID NO: 764679 - DNA, 25 bp, Mus musculus
tcactgaaaagctcgtgcaagcggc

SEQ ID NO: 764680 - DNA, 25 bp, Mus musculus
tcactgacaaaactgcaaacgatca

SEQ ID NO: 764681 - DNA, 25 bp, Mus musculus
tcactgacaaaagtgcaaacgatca

SEQ ID NO: 764682 - DNA, 25 bp, Mus musculus
tcactgacacacaactcgaccagtt

SEQ ID NO: 764683 - DNA, 25 bp, Mus musculus
tcactgacacactactcgaccagtt

SEQ ID NO: 764684 - DNA, 25 bp, Mus musculus
tcactgacaggtaaaatagagagct

SEQ ID NO: 764685 - DNA, 25 bp, Mus musculus
tcactgacaggtccgactcaaagag

SEQ ID NO: 764686 - DNA, 25 bp, Mus musculus
tcactgacaggtgcgactcaaagag

SEQ ID NO: 764687 - DNA, 25 bp, Mus musculus
tcactgacaggttaaatagagagct

SEQ ID NO: 764688 - DNA, 25 bp, Mus musculus
tcactgacatttcacttcgttgctg

SEQ ID NO: 764689 - DNA, 25 bp, Mus musculus
tcactgacatttgacttcgttgctg

SEQ ID NO: 764690 - DNA, 25 bp, Mus musculus
tcactgaccatgcttgaggacaatg

SEQ ID NO: 764691 - DNA, 25 bp, Mus musculus
tcactgaccatggttgaggacaatg

SEQ ID NO: 764692 - DNA, 25 bp, Mus musculus
tcactgaccctccagatgtggccag

SEQ ID NO: 764693 - DNA, 25 bp, Mus musculus
tcactgaccctcgagatgtggccag

SEQ ID NO: 764694 - DNA, 25 bp, Mus musculus
tcactgacctcgaggacctcatgtc

SEQ ID NO: 764695 - DNA, 25 bp, Mus musculus
tcactgacctcgtggacctcatgtc

SEQ ID NO: 764696 - DNA, 25 bp, Mus musculus
tcactgactacacgccgtgtcgtgt

SEQ ID NO: 764697 - DNA, 25 bp, Mus musculus
tcactgactacaggccgtgtcgtgt

SEQ ID NO: 764698 - DNA, 25 bp, Mus musculus
tcactgagaatgaatgtcagaacta

SEQ ID NO: 764699 - DNA, 25 bp, Mus musculus
tcactgagaatgacctcctggtgcg

SEQ ID NO: 764700 - DNA, 25 bp, Mus musculus
tcactgagaatgtatgtcagaacta

SEQ ID NO: 764701 - DNA, 25 bp, Mus musculus
tcactgagaatgtcctcctggtgcg

SEQ ID NO: 764702 - DNA, 25 bp, Mus musculus
tcactgagacctatttgaccgagag

SEQ ID NO: 764703 - DNA, 25 bp, Mus musculus
tcactgagacctttttgaccgagag

SEQ ID NO: 764704 - DNA, 25 bp, Mus musculus
tcactgagcaggcagctgagctgtc

SEQ ID NO: 764705 - DNA, 25 bp, Mus musculus
tcactgagcagggagctgagctgtc

SEQ ID NO: 764706 - DNA, 25 bp, Mus musculus
tcactgagctacagatggtggcgct

SEQ ID NO: 764707 - DNA, 25 bp, Mus musculus
tcactgagctactgatggtggcgct

SEQ ID NO: 764708 - DNA, 25 bp, Mus musculus
tcactgagggataagaacgagtcct

SEQ ID NO: 764709 - DNA, 25 bp, Mus musculus
tcactgagggattagaacgagtcct

SEQ ID NO: 764710 - DNA, 25 bp, Mus musculus
tcactgagggcacctattcctgtct

SEQ ID NO: 764711 - DNA, 25 bp, Mus musculus
tcactgagggcagctattcctgtct

SEQ ID NO: 764712 - DNA, 25 bp, Mus musculus
tcactgatagctaccagtaaggcct

SEQ ID NO: 764713 - DNA, 25 bp, Mus musculus
tcactgatagcttccagtaaggcct

SEQ ID NO: 764714 - DNA, 25 bp, Mus musculus
tcactgatcaccacatctgtgagat

SEQ ID NO: 764715 - DNA, 25 bp, Mus musculus
tcactgatcacctcatctgtgagat

SEQ ID NO: 764716 - DNA, 25 bp, Mus musculus
tcactgatgaagctggtatccgatc

SEQ ID NO: 764717 - DNA, 25 bp, Mus musculus
tcactgatgaaggtggtatccgatc

SEQ ID NO: 764718 - DNA, 25 bp, Mus musculus
tcactgatgctaatcagcagtgtgt

SEQ ID NO: 764719 - DNA, 25 bp, Mus musculus
tcactgatgctattcagcagtgtgt

SEQ ID NO: 764720 - DNA, 25 bp, Mus musculus
tcactgatgctgacatccgggagcg

SEQ ID NO: 764721 - DNA, 25 bp, Mus musculus
tcactgatgctgtcatccgggagcg

SEQ ID NO: 764722 - DNA, 25 bp, Mus musculus
tcactgatgggacacttcgggagca

SEQ ID NO: 764723 - DNA, 25 bp, Mus musculus
tcactgatgggagacttcgggagca

SEQ ID NO: 764724 - DNA, 25 bp, Mus musculus
tcactgatgggcctaggtgacatga

SEQ ID NO: 764725 - DNA, 25 bp, Mus musculus
tcactgatgggcgtaggtgacatga

SEQ ID NO: 764726 - DNA, 25 bp, Mus musculus
tcactgattgggaaggcaggcacca

SEQ ID NO: 764727 - DNA, 25 bp, Mus musculus
tcactgattgggtaggcaggcacca

SEQ ID NO: 764728 - DNA, 25 bp, Mus musculus
tcactgcaaatgagcatgcctgggt

SEQ ID NO: 764729 - DNA, 25 bp, Mus musculus
tcactgcaaatgtgcatgcctgggt

SEQ ID NO: 764730 - DNA, 25 bp, Mus musculus
tcactgcaagacatcagtctgaggc

SEQ ID NO: 764731 - DNA, 25 bp, Mus musculus
tcactgcaagacttcagtctgaggc

SEQ ID NO: 764732 - DNA, 25 bp, Mus musculus
tcactgcaaggacccggtggcttcg

SEQ ID NO: 764733 - DNA, 25 bp, Mus musculus
tcactgcaaggagccggtggcttcg

SEQ ID NO: 764734 - DNA, 25 bp, Mus musculus
tcactgcaccaacactgggtacaag

SEQ ID NO: 764735 - DNA, 25 bp, Mus musculus
tcactgcaccaagactgggtacaag

SEQ ID NO: 764736 - DNA, 25 bp, Mus musculus
tcactgcagaagaatttatcctagc

SEQ ID NO: 764737 - DNA, 25 bp, Mus musculus
tcactgcagaagtatttatcctagc

SEQ ID NO: 764738 - DNA, 25 bp, Mus musculus
tcactgcagagaaccggaagaaaac

SEQ ID NO: 764739 - DNA, 25 bp, Mus musculus
tcactgcagagatccggaagaaaac

SEQ ID NO: 764740 - DNA, 25 bp, Mus musculus
tcactgcagcaacaacggtactgtc

SEQ ID NO: 764741 - DNA, 25 bp, Mus musculus
tcactgcagcaacccggctcttggg

SEQ ID NO: 764742 - DNA, 25 bp, Mus musculus
tcactgcagcaagaacggtactgtc

SEQ ID NO: 764743 - DNA, 25 bp, Mus musculus
tcactgcagcaagccggctcttggg

SEQ ID NO: 764744 - DNA, 25 bp, Mus musculus
tcactgcagcgaatatccaacctat

SEQ ID NO: 764745 - DNA, 25 bp, Mus musculus
tcactgcagcgattatccaacctat

SEQ ID NO: 764746 - DNA, 25 bp, Mus musculus
tcactgcaggaaaatggtgcacaga

SEQ ID NO: 764747 - DNA, 25 bp, Mus musculus
tcactgcaggaatatggtgcacaga

SEQ ID NO: 764748 - DNA, 25 bp, Mus musculus
tcactgcaggcacgtgtcacacttg

SEQ ID NO: 764749 - DNA, 25 bp, Mus musculus
tcactgcaggcaggtgtcacacttg

SEQ ID NO: 764750 - DNA, 25 bp, Mus musculus
tcactgcaggtaagggtttcttccg

SEQ ID NO: 764751 - DNA, 25 bp, Mus musculus
tcactgcaggtatgggtttcttccg

SEQ ID NO: 764752 - DNA, 25 bp, Mus musculus
tcactgcattggctcttctgcactg

SEQ ID NO: 764753 - DNA, 25 bp, Mus musculus
tcactgcattgggtcttctgcactg

SEQ ID NO: 764754 - DNA, 25 bp, Mus musculus
tcactgccaatcagtatgagatggt

SEQ ID NO: 764755 - DNA, 25 bp, Mus musculus
tcactgccaatctgtatgagatggt

SEQ ID NO: 764756 - DNA, 25 bp, Mus musculus
tcactgccagcgctgccagaagcag

SEQ ID NO: 764757 - DNA, 25 bp, Mus musculus
tcactgccagcggtgccagaagcag

SEQ ID NO: 764758 - DNA, 25 bp, Mus musculus
tcactgccagtgactctatcatggg

SEQ ID NO: 764759 - DNA, 25 bp, Mus musculus
tcactgccagtgtctctatcatggg

SEQ ID NO: 764760 - DNA, 25 bp, Mus musculus
tcactgccatccataagcactacag

SEQ ID NO: 764761 - DNA, 25 bp, Mus musculus
tcactgccatccttaagcactacag

SEQ ID NO: 764762 - DNA, 25 bp, Mus musculus
tcactgccatctcttgcaggccaag

SEQ ID NO: 764763 - DNA, 25 bp, Mus musculus
tcactgccatctgttgcaggccaag

SEQ ID NO: 764764 - DNA, 25 bp, Mus musculus
tcactgcccaaaacttaggcaaact

SEQ ID NO: 764765 - DNA, 25 bp, Mus musculus
tcactgcccaaatcttaggcaaact

SEQ ID NO: 764766 - DNA, 25 bp, Mus musculus
tcactgcccaggaagcacggctggg

SEQ ID NO: 764767 - DNA, 25 bp, Mus musculus
tcactgcccaggtagcacggctggg

SEQ ID NO: 764768 - DNA, 25 bp, Mus musculus
tcactgccgcccaggtgaaggtgga

SEQ ID NO: 764769 - DNA, 25 bp, Mus musculus
tcactgccgccctggtgaaggtgga

SEQ ID NO: 764770 - DNA, 25 bp, Mus musculus
tcactgcctatccagcacatggctt

SEQ ID NO: 764771 - DNA, 25 bp, Mus musculus
tcactgcctatcgagcacatggctt

SEQ ID NO: 764772 - DNA, 25 bp, Mus musculus
tcactgcctgatactcagctgatgg

SEQ ID NO: 764773 - DNA, 25 bp, Mus musculus
tcactgcctgattctcagctgatgg

SEQ ID NO: 764774 - DNA, 25 bp, Mus musculus
tcactgcctgtgaaacccttacaac

SEQ ID NO: 764775 - DNA, 25 bp, Mus musculus
tcactgcctgtgtaacccttacaac

SEQ ID NO: 764776 - DNA, 25 bp, Mus musculus
tcactgccttacattgtgctcatca

SEQ ID NO: 764777 - DNA, 25 bp, Mus musculus
tcactgccttactttgtgctcatca

SEQ ID NO: 764778 - DNA, 25 bp, Mus musculus
tcactgcgcatcatggatttgaggg

SEQ ID NO: 764779 - DNA, 25 bp, Mus musculus
tcactgcgcatcttggatttgaggg

SEQ ID NO: 764780 - DNA, 25 bp, Mus musculus
tcactgcgctcgatctgatttggga

SEQ ID NO: 764781 - DNA, 25 bp, Mus musculus
tcactgcgctcgttctgatttggga

SEQ ID NO: 764782 - DNA, 25 bp, Mus musculus
tcactgctaacaagttgtacctgga

SEQ ID NO: 764783 - DNA, 25 bp, Mus musculus
tcactgctaacatgttgtacctgga

SEQ ID NO: 764784 - DNA, 25 bp, Mus musculus
tcactgctacaccagagacaacggg

SEQ ID NO: 764785 - DNA, 25 bp, Mus musculus
tcactgctacacgagagacaacggg

SEQ ID NO: 764786 - DNA, 25 bp, Mus musculus
tcactgctgcccatcatacgttcag

SEQ ID NO: 764787 - DNA, 25 bp, Mus musculus
tcactgctgcccttcatacgttcag

SEQ ID NO: 764788 - DNA, 25 bp, Mus musculus
tcactgctgcttaggcaggtgcctc

SEQ ID NO: 764789 - DNA, 25 bp, Mus musculus
tcactgctgctttggcaggtgcctc

SEQ ID NO: 764790 - DNA, 25 bp, Mus musculus
tcactgctgtgacgatccaggtcct

SEQ ID NO: 764791 - DNA, 25 bp, Mus musculus
tcactgctgtgaggatccaggtcct

SEQ ID NO: 764792 - DNA, 25 bp, Mus musculus
tcactgctgtgcacccctggactga

SEQ ID NO: 764793 - DNA, 25 bp, Mus musculus
tcactgctgtgctcccctggactga

SEQ ID NO: 764794 - DNA, 25 bp, Mus musculus
tcactgcttacacgaatggcctttt

SEQ ID NO: 764795 - DNA, 25 bp, Mus musculus
tcactgcttacaggaatggcctttt

SEQ ID NO: 764796 - DNA, 25 bp, Mus musculus
tcactgcttcagactgactgccgca

SEQ ID NO: 764797 - DNA, 25 bp, Mus musculus
tcactgcttcagtctgactgccgca

SEQ ID NO: 764798 - DNA, 25 bp, Mus musculus
tcactgcttctcagggatgccggct

SEQ ID NO: 764799 - DNA, 25 bp, Mus musculus
tcactgcttctctgggatgccggct

SEQ ID NO: 764800 - DNA, 25 bp, Mus musculus
tcactgcttcttacatccctgatgc

SEQ ID NO: 764801 - DNA, 25 bp, Mus musculus
tcactgcttctttcatccctgatgc

SEQ ID NO: 764802 - DNA, 25 bp, Mus musculus
tcactggacactagcaccatgagag

SEQ ID NO: 764803 - DNA, 25 bp, Mus musculus
tcactggacacttgcaccatgagag

SEQ ID NO: 764804 - DNA, 25 bp, Mus musculus
tcactggacgatactcaaaccggct

SEQ ID NO: 764805 - DNA, 25 bp, Mus musculus
tcactggacgattctcaaaccggct

SEQ ID NO: 764806 - DNA, 25 bp, Mus musculus
tcactggagctcatgcagtacctcc

SEQ ID NO: 764807 - DNA, 25 bp, Mus musculus
tcactggagctcttgcagtacctcc

SEQ ID NO: 764808 - DNA, 25 bp, Mus musculus
tcactggatcctatgctcagaagta

SEQ ID NO: 764809 - DNA, 25 bp, Mus musculus
tcactggatcctttgctcagaagta

SEQ ID NO: 764810 - DNA, 25 bp, Mus musculus
tcactggcaattacgcttctcatcg

SEQ ID NO: 764811 - DNA, 25 bp, Mus musculus
tcactggcaatttcgcttctcatcg

SEQ ID NO: 764812 - DNA, 25 bp, Mus musculus
tcactggcatagatggagacaaagg

SEQ ID NO: 764813 - DNA, 25 bp, Mus musculus
tcactggcatagttggagacaaagg

SEQ ID NO: 764814 - DNA, 25 bp, Mus musculus
tcactggctcaacgaaaaatgtcct

SEQ ID NO: 764815 - DNA, 25 bp, Mus musculus
tcactggctcaaggaaaaatgtcct

SEQ ID NO: 764816 - DNA, 25 bp, Mus musculus
tcactggctctacgctgtaaagcag

SEQ ID NO: 764817 - DNA, 25 bp, Mus musculus
tcactggctctaggctgtaaagcag

SEQ ID NO: 764818 - DNA, 25 bp, Mus musculus
tcactggctgccctaaggccaagac

SEQ ID NO: 764819 - DNA, 25 bp, Mus musculus
tcactggctgccgtaaggccaagac

SEQ ID NO: 764820 - DNA, 25 bp, Mus musculus
tcactggctttcatgagaaggcgga

SEQ ID NO: 764821 - DNA, 25 bp, Mus musculus
tcactggctttcttgagaaggcgga

SEQ ID NO: 764822 - DNA, 25 bp, Mus musculus
tcactgggaagcaataacaagtaca

SEQ ID NO: 764823 - DNA, 25 bp, Mus musculus
tcactgggaagctataacaagtaca

SEQ ID NO: 764824 - DNA, 25 bp, Mus musculus
tcactgggacctcggctttaccacg

SEQ ID NO: 764825 - DNA, 25 bp, Mus musculus
tcactgggacctgggctttaccacg

SEQ ID NO: 764826 - DNA, 25 bp, Mus musculus
tcactgggacggaagcaagcttatc

SEQ ID NO: 764827 - DNA, 25 bp, Mus musculus
tcactgggacggtagcaagcttatc

SEQ ID NO: 764828 - DNA, 25 bp, Mus musculus
tcactgggcaagatgagttcagccg

SEQ ID NO: 764829 - DNA, 25 bp, Mus musculus
tcactgggcaagttgagttcagccg

SEQ ID NO: 764830 - DNA, 25 bp, Mus musculus
tcactgggcacacaggctgaactgc

SEQ ID NO: 764831 - DNA, 25 bp, Mus musculus
tcactgggcacagaggctgaactgc

SEQ ID NO: 764832 - DNA, 25 bp, Mus musculus
tcactgggcactccgggattttgct

SEQ ID NO: 764833 - DNA, 25 bp, Mus musculus
tcactgggcactgcgggattttgct

SEQ ID NO: 764834 - DNA, 25 bp, Mus musculus
tcactgggcctgcaggtcaaaagcc

SEQ ID NO: 764835 - DNA, 25 bp, Mus musculus
tcactgggcctggaggtcaaaagcc

SEQ ID NO: 764836 - DNA, 25 bp, Mus musculus
tcactgggtaggaacaaaactgggc

SEQ ID NO: 764837 - DNA, 25 bp, Mus musculus
tcactgggtaggtacaaaactgggc

SEQ ID NO: 764838 - DNA, 25 bp, Mus musculus
tcactgggtcagagctggccactct

SEQ ID NO: 764839 - DNA, 25 bp, Mus musculus
tcactgggtcagtgctggccactct

SEQ ID NO: 764840 - DNA, 25 bp, Mus musculus
tcactgggtctgctgatgttaggac

SEQ ID NO: 764841 - DNA, 25 bp, Mus musculus
tcactgggtctggtgatgttaggac

SEQ ID NO: 764842 - DNA, 25 bp, Mus musculus
tcactgggtgccaaggagctgtgca

SEQ ID NO: 764843 - DNA, 25 bp, Mus musculus
tcactgggtgcctaggagctgtgca

SEQ ID NO: 764844 - DNA, 25 bp, Mus musculus
tcactgggtgtaccgtacactttgt

SEQ ID NO: 764845 - DNA, 25 bp, Mus musculus
tcactgggtgtagcgtacactttgt

SEQ ID NO: 764846 - DNA, 25 bp, Mus musculus
tcactggtaattagctgtaggactt

SEQ ID NO: 764847 - DNA, 25 bp, Mus musculus
tcactggtaatttgctgtaggactt

SEQ ID NO: 764848 - DNA, 25 bp, Mus musculus
tcactggtcctgagggccatgtgct

SEQ ID NO: 764849 - DNA, 25 bp, Mus musculus
tcactggtcctgtgggccatgtgct

SEQ ID NO: 764850 - DNA, 25 bp, Mus musculus
tcactggtgacccaaaacatccagt

SEQ ID NO: 764851 - DNA, 25 bp, Mus musculus
tcactggtgaccgaaaacatccagt

SEQ ID NO: 764852 - DNA, 25 bp, Mus musculus
tcactggtggtcatccgactggagc

SEQ ID NO: 764853 - DNA, 25 bp, Mus musculus
tcactggtggtcttccgactggagc

SEQ ID NO: 764854 - DNA, 25 bp, Mus musculus
tcactgtaacgaaggcatggccagc

SEQ ID NO: 764855 - DNA, 25 bp, Mus musculus
tcactgtaacgatggcatggccagc

SEQ ID NO: 764856 - DNA, 25 bp, Mus musculus
tcactgtaagggacctgagaagacg

SEQ ID NO: 764857 - DNA, 25 bp, Mus musculus
tcactgtaagggtcctgagaagacg

SEQ ID NO: 764858 - DNA, 25 bp, Mus musculus
tcactgtaatgaccctagaaggtct

SEQ ID NO: 764859 - DNA, 25 bp, Mus musculus
tcactgtaatgagcctagaaggtct

SEQ ID NO: 764860 - DNA, 25 bp, Mus musculus
tcactgtacagtcccaagggagagg

SEQ ID NO: 764861 - DNA, 25 bp, Mus musculus
tcactgtacagtgccaagggagagg

SEQ ID NO: 764862 - DNA, 25 bp, Mus musculus
tcactgtacggaacaggagagggtc

SEQ ID NO: 764863 - DNA, 25 bp, Mus musculus
tcactgtacggatcaggagagggtc

SEQ ID NO: 764864 - DNA, 25 bp, Mus musculus
tcactgtatggcacatagattgcaa

SEQ ID NO: 764865 - DNA, 25 bp, Mus musculus
tcactgtatggctcatagattgcaa

SEQ ID NO: 764866 - DNA, 25 bp, Mus musculus
tcactgtcactgacagtctccttgg

SEQ ID NO: 764867 - DNA, 25 bp, Mus musculus
tcactgtcactgtcagtctccttgg

SEQ ID NO: 764868 - DNA, 25 bp, Mus musculus
tcactgtcaggcaatatccgaaacg

SEQ ID NO: 764869 - DNA, 25 bp, Mus musculus
tcactgtcaggctatatccgaaacg

SEQ ID NO: 764870 - DNA, 25 bp, Mus musculus
tcactgtcagtaattagcaaacatc

SEQ ID NO: 764871 - DNA, 25 bp, Mus musculus
tcactgtcagtatttagcaaacatc

SEQ ID NO: 764872 - DNA, 25 bp, Mus musculus
tcactgtcattaaacaagctgtaca

SEQ ID NO: 764873 - DNA, 25 bp, Mus musculus
tcactgtcattatacaagctgtaca

SEQ ID NO: 764874 - DNA, 25 bp, Mus musculus
tcactgtccccaaacacactggaga

SEQ ID NO: 764875 - DNA, 25 bp, Mus musculus
tcactgtccccatacacactggaga

SEQ ID NO: 764876 - DNA, 25 bp, Mus musculus
tcactgtcccgtacctgaaagatgt

SEQ ID NO: 764877 - DNA, 25 bp, Mus musculus
tcactgtcccgttcctgaaagatgt

SEQ ID NO: 764878 - DNA, 25 bp, Mus musculus
tcactgtcgatcagaaaaccttcca

SEQ ID NO: 764879 - DNA, 25 bp, Mus musculus
tcactgtcgatctgaaaaccttcca

SEQ ID NO: 764880 - DNA, 25 bp, Mus musculus
tcactgtctgaaaagcattaaaagc

SEQ ID NO: 764881 - DNA, 25 bp, Mus musculus
tcactgtctgaatagcattaaaagc

SEQ ID NO: 764882 - DNA, 25 bp, Mus musculus
tcactgtctggtattttgatgccaa

SEQ ID NO: 764883 - DNA, 25 bp, Mus musculus
tcactgtctggttttttgatgccaa

SEQ ID NO: 764884 - DNA, 25 bp, Mus musculus
tcactgtgaagtaggacctccgaga

SEQ ID NO: 764885 - DNA, 25 bp, Mus musculus
tcactgtgaagttggacctccgaga

SEQ ID NO: 764886 - DNA, 25 bp, Mus musculus
tcactgtgacagagtagtatccttg

SEQ ID NO: 764887 - DNA, 25 bp, Mus musculus
tcactgtgacagtgtagtatccttg

SEQ ID NO: 764888 - DNA, 25 bp, Mus musculus
tcactgtgatgaacgagaatgagcg

SEQ ID NO: 764889 - DNA, 25 bp, Mus musculus
tcactgtgatgatcgagaatgagcg

SEQ ID NO: 764890 - DNA, 25 bp, Mus musculus
tcactgtgatgtacagactctgcct

SEQ ID NO: 764891 - DNA, 25 bp, Mus musculus
tcactgtgatgttcagactctgcct

SEQ ID NO: 764892 - DNA, 25 bp, Mus musculus
tcactgtgcaaaactaacatcatgg

SEQ ID NO: 764893 - DNA, 25 bp, Mus musculus
tcactgtgcaaatctaacatcatgg

SEQ ID NO: 764894 - DNA, 25 bp, Mus musculus
tcactgtgccagaacatgatgccag

SEQ ID NO: 764895 - DNA, 25 bp, Mus musculus
tcactgtgccagtacatgatgccag

SEQ ID NO: 764896 - DNA, 25 bp, Mus musculus
tcactgtgccttctccttaggactc

SEQ ID NO: 764897 - DNA, 25 bp, Mus musculus
tcactgtgccttgtccttaggactc

SEQ ID NO: 764898 - DNA, 25 bp, Mus musculus
tcactgtggaggaaggccagaggtt

SEQ ID NO: 764899 - DNA, 25 bp, Mus musculus
tcactgtggaggtaggccagaggtt

SEQ ID NO: 764900 - DNA, 25 bp, Mus musculus
tcactgtggataaggtcatggacgt

SEQ ID NO: 764901 - DNA, 25 bp, Mus musculus
tcactgtggatatggtcatggacgt

SEQ ID NO: 764902 - DNA, 25 bp, Mus musculus
tcactgtgggaacggttctgtgcta

SEQ ID NO: 764903 - DNA, 25 bp, Mus musculus
tcactgtgggaagggttctgtgcta

SEQ ID NO: 764904 - DNA, 25 bp, Mus musculus
tcactgtggttgcaagtggagattt

SEQ ID NO: 764905 - DNA, 25 bp, Mus musculus
tcactgtggttggaagtggagattt

SEQ ID NO: 764906 - DNA, 25 bp, Mus musculus
tcactgtgtaaactgcattcgtaac

SEQ ID NO: 764907 - DNA, 25 bp, Mus musculus
tcactgtgtaaagtgcattcgtaac

SEQ ID NO: 764908 - DNA, 25 bp, Mus musculus
tcactgtgtcaaacatcaggaagca

SEQ ID NO: 764909 - DNA, 25 bp, Mus musculus
tcactgtgtcaatcatcaggaagca

SEQ ID NO: 764910 - DNA, 25 bp, Mus musculus
tcactgtgtctaccagcagccttaa

SEQ ID NO: 764911 - DNA, 25 bp, Mus musculus
tcactgtgtctagcagcagccttaa

SEQ ID NO: 764912 - DNA, 25 bp, Mus musculus
tcactgtgtctcaggatgagggtgt

SEQ ID NO: 764913 - DNA, 25 bp, Mus musculus
tcactgtgtctctggatgagggtgt

SEQ ID NO: 764914 - DNA, 25 bp, Mus musculus
tcactgttacagaataagctggctc

SEQ ID NO: 764915 - DNA, 25 bp, Mus musculus
tcactgttacagtataagctggctc

SEQ ID NO: 764916 - DNA, 25 bp, Mus musculus
tcactgttaccaacttggcactctg

SEQ ID NO: 764917 - DNA, 25 bp, Mus musculus
tcactgttaccatcttggcactctg

SEQ ID NO: 764918 - DNA, 25 bp, Mus musculus
tcactgttgcatcagccctgtctgc

SEQ ID NO: 764919 - DNA, 25 bp, Mus musculus
tcactgttgcatgagccctgtctgc

SEQ ID NO: 764920 - DNA, 25 bp, Mus musculus
tcactgttgggcacgttggctaagg

SEQ ID NO: 764921 - DNA, 25 bp, Mus musculus
tcactgttgggctcgttggctaagg

SEQ ID NO: 764922 - DNA, 25 bp, Mus musculus
tcacttaacagtcttagcctataac

SEQ ID NO: 764923 - DNA, 25 bp, Mus musculus
tcacttaacagtgttagcctataac

SEQ ID NO: 764924 - DNA, 25 bp, Mus musculus
tcacttacgttaatggatccttact

SEQ ID NO: 764925 - DNA, 25 bp, Mus musculus
tcacttacgttattggatccttact

SEQ ID NO: 764926 - DNA, 25 bp, Mus musculus
tcacttatgaacacaaaaactggag

SEQ ID NO: 764927 - DNA, 25 bp, Mus musculus
tcacttatgaactcaaaaactggag

SEQ ID NO: 764928 - DNA, 25 bp, Mus musculus
tcacttatggacattgacacgctca

SEQ ID NO: 764929 - DNA, 25 bp, Mus musculus
tcacttatggactttgacacgctca

SEQ ID NO: 764930 - DNA, 25 bp, Mus musculus
tcacttcaataacgaatacgggacc

SEQ ID NO: 764931 - DNA, 25 bp, Mus musculus
tcacttcaataaggaatacgggacc

SEQ ID NO: 764932 - DNA, 25 bp, Mus musculus
tcacttcacctcagatggaagcagc

SEQ ID NO: 764933 - DNA, 25 bp, Mus musculus
tcacttcacctctgatggaagcagc

SEQ ID NO: 764934 - DNA, 25 bp, Mus musculus
tcacttcacttcatgatcctctacg

SEQ ID NO: 764935 - DNA, 25 bp, Mus musculus
tcacttcacttcttgatcctctacg

SEQ ID NO: 764936 - DNA, 25 bp, Mus musculus
tcacttcaggtaacaatgcagcaag

SEQ ID NO: 764937 - DNA, 25 bp, Mus musculus
tcacttcaggtatcaatgcagcaag

SEQ ID NO: 764938 - DNA, 25 bp, Mus musculus
tcacttcatcttcgctgacaacggc

SEQ ID NO: 764939 - DNA, 25 bp, Mus musculus
tcacttcatcttggctgacaacggc

SEQ ID NO: 764940 - DNA, 25 bp, Mus musculus
tcacttccaagacacgtggctcgca

SEQ ID NO: 764941 - DNA, 25 bp, Mus musculus
tcacttccaagagacgtggctcgca

SEQ ID NO: 764942 - DNA, 25 bp, Mus musculus
tcacttccaatgcaggtcaggatag

SEQ ID NO: 764943 - DNA, 25 bp, Mus musculus
tcacttccaatggaggtcaggatag

SEQ ID NO: 764944 - DNA, 25 bp, Mus musculus
tcacttccatgaagaactctctgag

SEQ ID NO: 764945 - DNA, 25 bp, Mus musculus
tcacttccatgatgaactctctgag

SEQ ID NO: 764946 - DNA, 25 bp, Mus musculus
tcacttcctggaaacaagactcggc

SEQ ID NO: 764947 - DNA, 25 bp, Mus musculus
tcacttcctggaagcagggcagtac

SEQ ID NO: 764948 - DNA, 25 bp, Mus musculus
tcacttcctggatacaagactcggc

SEQ ID NO: 764949 - DNA, 25 bp, Mus musculus
tcacttcctggatgcagggcagtac

SEQ ID NO: 764950 - DNA, 25 bp, Mus musculus
tcacttctaacacacctgactgctg

SEQ ID NO: 764951 - DNA, 25 bp, Mus musculus
tcacttctaacagacctgactgctg

SEQ ID NO: 764952 - DNA, 25 bp, Mus musculus
tcacttctacagacagggcctggag

SEQ ID NO: 764953 - DNA, 25 bp, Mus musculus
tcacttctacagtcagggcctggag

SEQ ID NO: 764954 - DNA, 25 bp, Mus musculus
tcacttctattgaaagagcaacagc

SEQ ID NO: 764955 - DNA, 25 bp, Mus musculus
tcacttctattgtaagagcaacagc

SEQ ID NO: 764956 - DNA, 25 bp, Mus musculus
tcacttctcggacaatgaggcagac

SEQ ID NO: 764957 - DNA, 25 bp, Mus musculus
tcacttctcggagaatgaggcagac

SEQ ID NO: 764958 - DNA, 25 bp, Mus musculus
tcacttctgaggagatgagtacctc

SEQ ID NO: 764959 - DNA, 25 bp, Mus musculus
tcacttctgaggtgatgagtacctc

SEQ ID NO: 764960 - DNA, 25 bp, Mus musculus
tcacttctgatgataataagctcag

SEQ ID NO: 764961 - DNA, 25 bp, Mus musculus
tcacttctgatgttaataagctcag

SEQ ID NO: 764962 - DNA, 25 bp, Mus musculus
tcacttctggacaatatgatcggtg

SEQ ID NO: 764963 - DNA, 25 bp, Mus musculus
tcacttctggactatatgatcggtg

SEQ ID NO: 764964 - DNA, 25 bp, Mus musculus
tcacttgaggaaaggaaacttcttg

SEQ ID NO: 764965 - DNA, 25 bp, Mus musculus
tcacttgaggaatggaaacttcttg

SEQ ID NO: 764966 - DNA, 25 bp, Mus musculus
tcacttgaggtcctgattgcagatc

SEQ ID NO: 764967 - DNA, 25 bp, Mus musculus
tcacttgaggtcgtgattgcagatc

SEQ ID NO: 764968 - DNA, 25 bp, Mus musculus
tcacttgcagcactacgggctgcga

SEQ ID NO: 764969 - DNA, 25 bp, Mus musculus
tcacttgcagcagtacgggctgcga

SEQ ID NO: 764970 - DNA, 25 bp, Mus musculus
tcacttgcgtggctagacttcagaa

SEQ ID NO: 764971 - DNA, 25 bp, Mus musculus
tcacttgcgtgggtagacttcagaa

SEQ ID NO: 764972 - DNA, 25 bp, Mus musculus
tcacttggaaatcgtggcccctaac

SEQ ID NO: 764973 - DNA, 25 bp, Mus musculus
tcacttggaaatggtggcccctaac

SEQ ID NO: 764974 - DNA, 25 bp, Mus musculus
tcacttggagaacggctgccatcca

SEQ ID NO: 764975 - DNA, 25 bp, Mus musculus
tcacttggagaagggctgccatcca

SEQ ID NO: 764976 - DNA, 25 bp, Mus musculus
tcacttggccagagcagactggatt

SEQ ID NO: 764977 - DNA, 25 bp, Mus musculus
tcacttggccagtgcagactggatt

SEQ ID NO: 764978 - DNA, 25 bp, Mus musculus
tcacttggctgacgcgctgcaccag

SEQ ID NO: 764979 - DNA, 25 bp, Mus musculus
tcacttggctgaggcgctgcaccag

SEQ ID NO: 764980 - DNA, 25 bp, Mus musculus
tcacttggttcactggaacaccaaa

SEQ ID NO: 764981 - DNA, 25 bp, Mus musculus
tcacttggttcagtggaacaccaaa

SEQ ID NO: 764982 - DNA, 25 bp, Mus musculus
tcacttgtcaccatcgggatgaggg

SEQ ID NO: 764983 - DNA, 25 bp, Mus musculus
tcacttgtcaccttcgggatgaggg

SEQ ID NO: 764984 - DNA, 25 bp, Mus musculus
tcacttgtggcccaaatgaggccat

SEQ ID NO: 764985 - DNA, 25 bp, Mus musculus
tcacttgtggccgaaatgaggccat

SEQ ID NO: 764986 - DNA, 25 bp, Mus musculus
tcacttgtttggatactgtatctaa

SEQ ID NO: 764987 - DNA, 25 bp, Mus musculus
tcacttgtttggttactgtatctaa

SEQ ID NO: 764988 - DNA, 25 bp, Mus musculus
tcactttcatcaccagttttggagg

SEQ ID NO: 764989 - DNA, 25 bp, Mus musculus
tcactttcatcagcagttttggagg

SEQ ID NO: 764990 - DNA, 25 bp, Mus musculus
tcactttcccttctgagaaaaagcc

SEQ ID NO: 764991 - DNA, 25 bp, Mus musculus
tcactttcccttgtgagaaaaagcc

SEQ ID NO: 764992 - DNA, 25 bp, Mus musculus
tcactttgtgccctgtagcctaaac

SEQ ID NO: 764993 - DNA, 25 bp, Mus musculus
tcactttgtgccgtgtagcctaaac

SEQ ID NO: 764994 - DNA, 25 bp, Mus musculus
tcactttgtggtagtccactgcaca

SEQ ID NO: 764995 - DNA, 25 bp, Mus musculus
tcactttgtggttgtccactgcaca

SEQ ID NO: 764996 - DNA, 25 bp, Mus musculus
tcacttttctccaccgaagtgaggg

SEQ ID NO: 764997 - DNA, 25 bp, Mus musculus
tcacttttctcctccgaagtgaggg

SEQ ID NO: 764998 - DNA, 25 bp, Mus musculus
tcagaaaaactaagtacaaaatggc

SEQ ID NO: 764999 - DNA, 25 bp, Mus musculus
tcagaaaaactatgtacaaaatggc

SEQ ID NO: 765000 - DNA, 25 bp, Mus musculus
tcagaaaacattaaattacagcaag

SEQ ID NO: 765001 - DNA, 25 bp, Mus musculus
tcagaaaacatttaattacagcaag

SEQ ID NO: 765002 - DNA, 25 bp, Mus musculus
tcagaaaactcgagtacaggcaggc

SEQ ID NO: 765003 - DNA, 25 bp, Mus musculus
tcagaaaactcgtgtacaggcaggc

SEQ ID NO: 765004 - DNA, 25 bp, Mus musculus
tcagaaaactgcaagatgccagcag

SEQ ID NO: 765005 - DNA, 25 bp, Mus musculus
tcagaaaactgctagatgccagcag

SEQ ID NO: 765006 - DNA, 25 bp, Mus musculus
tcagaaaagctcagttcgtatcaag

SEQ ID NO: 765007 - DNA, 25 bp, Mus musculus
tcagaaaagctctgttcgtatcaag

SEQ ID NO: 765008 - DNA, 25 bp, Mus musculus
tcagaaaaggctcacacagagcagt

SEQ ID NO: 765009 - DNA, 25 bp, Mus musculus
tcagaaaaggctgacacagagcagt

SEQ ID NO: 765010 - DNA, 25 bp, Mus musculus
tcagaaacacacagagatgatcaca

SEQ ID NO: 765011 - DNA, 25 bp, Mus musculus
tcagaaacacactgagatgatcaca

SEQ ID NO: 765012 - DNA, 25 bp, Mus musculus
tcagaaacacctcgtgagagactgc

SEQ ID NO: 765013 - DNA, 25 bp, Mus musculus
tcagaaacacctctgtcagctgcag

SEQ ID NO: 765014 - DNA, 25 bp, Mus musculus
tcagaaacacctggtgagagactgc

SEQ ID NO: 765015 - DNA, 25 bp, Mus musculus
tcagaaacacctgtgtcagctgcag

SEQ ID NO: 765016 - DNA, 25 bp, Mus musculus
tcagaaacagcactctgtgattacc

SEQ ID NO: 765017 - DNA, 25 bp, Mus musculus
tcagaaacagcagtctgtgattacc

SEQ ID NO: 765018 - DNA, 25 bp, Mus musculus
tcagaaacatcgagacctttgcaat

SEQ ID NO: 765019 - DNA, 25 bp, Mus musculus
tcagaaacatcgtgacctttgcaat

SEQ ID NO: 765020 - DNA, 25 bp, Mus musculus
tcagaaaccaaacgtcaagcaatgg

SEQ ID NO: 765021 - DNA, 25 bp, Mus musculus
tcagaaaccaaaggtcaagcaatgg

SEQ ID NO: 765022 - DNA, 25 bp, Mus musculus
tcagaaacccagaggagatgtgttc

SEQ ID NO: 765023 - DNA, 25 bp, Mus musculus
tcagaaacccagtggagatgtgttc

SEQ ID NO: 765024 - DNA, 25 bp, Mus musculus
tcagaaacccctctgcttggagcag

SEQ ID NO: 765025 - DNA, 25 bp, Mus musculus
tcagaaacccctgtgcttggagcag

SEQ ID NO: 765026 - DNA, 25 bp, Mus musculus
tcagaaaccttgctgaacgctcagc

SEQ ID NO: 765027 - DNA, 25 bp, Mus musculus
tcagaaaccttggtgaacgctcagc

SEQ ID NO: 765028 - DNA, 25 bp, Mus musculus
tcagaaacttacctggaagcccact

SEQ ID NO: 765029 - DNA, 25 bp, Mus musculus
tcagaaacttacgtggaagcccact

SEQ ID NO: 765030 - DNA, 25 bp, Mus musculus
tcagaaacttcaaagtgccagggcg

SEQ ID NO: 765031 - DNA, 25 bp, Mus musculus
tcagaaacttcatagtgccagggcg

SEQ ID NO: 765032 - DNA, 25 bp, Mus musculus
tcagaaagagacaacacatatgagg

SEQ ID NO: 765033 - DNA, 25 bp, Mus musculus
tcagaaagagactacacatatgagg

SEQ ID NO: 765034 - DNA, 25 bp, Mus musculus
tcagaaagcagcaagtatcggacag

SEQ ID NO: 765035 - DNA, 25 bp, Mus musculus
tcagaaagcagctagtatcggacag

SEQ ID NO: 765036 - DNA, 25 bp, Mus musculus
tcagaaagcatcctagggagggacc

SEQ ID NO: 765037 - DNA, 25 bp, Mus musculus
tcagaaagcatcgtagggagggacc

SEQ ID NO: 765038 - DNA, 25 bp, Mus musculus
tcagaaagccggacttggcacctgg

SEQ ID NO: 765039 - DNA, 25 bp, Mus musculus
tcagaaagccggtcttggcacctgg

SEQ ID NO: 765040 - DNA, 25 bp, Mus musculus
tcagaaagcgccattggctacttca

SEQ ID NO: 765041 - DNA, 25 bp, Mus musculus
tcagaaagcgcctttggctacttca

SEQ ID NO: 765042 - DNA, 25 bp, Mus musculus
tcagaaagctgaaggttgaaataaa

SEQ ID NO: 765043 - DNA, 25 bp, Mus musculus
tcagaaagctgatggttgaaataaa

SEQ ID NO: 765044 - DNA, 25 bp, Mus musculus
tcagaaagctgtaggatcagtgcga

SEQ ID NO: 765045 - DNA, 25 bp, Mus musculus
tcagaaagctgttggatcagtgcga

SEQ ID NO: 765046 - DNA, 25 bp, Mus musculus
tcagaaaggacaagaatacccaccc

SEQ ID NO: 765047 - DNA, 25 bp, Mus musculus
tcagaaaggacatgaatacccaccc

SEQ ID NO: 765048 - DNA, 25 bp, Mus musculus
tcagaaaggcagctccctcatcgag

SEQ ID NO: 765049 - DNA, 25 bp, Mus musculus
tcagaaaggcaggtccctcatcgag

SEQ ID NO: 765050 - DNA, 25 bp, Mus musculus
tcagaaagggctaaactaggtctcc

SEQ ID NO: 765051 - DNA, 25 bp, Mus musculus
tcagaaagggcttaactaggtctcc

SEQ ID NO: 765052 - DNA, 25 bp, Mus musculus
tcagaaagttcgaggtgtggacatc

SEQ ID NO: 765053 - DNA, 25 bp, Mus musculus
tcagaaagttcgtggtgtggacatc

SEQ ID NO: 765054 - DNA, 25 bp, Mus musculus
tcagaaatacccagacttacaacaa

SEQ ID NO: 765055 - DNA, 25 bp, Mus musculus
tcagaaataccctgacttacaacaa

SEQ ID NO: 765056 - DNA, 25 bp, Mus musculus
tcagaaatacctaccagcctgtggc

SEQ ID NO: 765057 - DNA, 25 bp, Mus musculus
tcagaaataccttccagcctgtggc

SEQ ID NO: 765058 - DNA, 25 bp, Mus musculus
tcagaaatacgacgcgatgcagtgc

SEQ ID NO: 765059 - DNA, 25 bp, Mus musculus
tcagaaatacgaggcgatgcagtgc

SEQ ID NO: 765060 - DNA, 25 bp, Mus musculus
tcagaaatactacagctcgtcccaa

SEQ ID NO: 765061 - DNA, 25 bp, Mus musculus
tcagaaatactagagctcgtcccaa

SEQ ID NO: 765062 - DNA, 25 bp, Mus musculus
tcagaaatcctgagacatgccatct

SEQ ID NO: 765063 - DNA, 25 bp, Mus musculus
tcagaaatcctgtgacatgccatct

SEQ ID NO: 765064 - DNA, 25 bp, Mus musculus
tcagaaatgagtagcacatccctgc

SEQ ID NO: 765065 - DNA, 25 bp, Mus musculus
tcagaaatgagttgcacatccctgc

SEQ ID NO: 765066 - DNA, 25 bp, Mus musculus
tcagaaattgcacccctacgatcag

SEQ ID NO: 765067 - DNA, 25 bp, Mus musculus
tcagaaattgcagccctacgatcag

SEQ ID NO: 765068 - DNA, 25 bp, Mus musculus
tcagaacaactgagcacgcgtgatc

SEQ ID NO: 765069 - DNA, 25 bp, Mus musculus
tcagaacaactgtgcacgcgtgatc

SEQ ID NO: 765070 - DNA, 25 bp, Mus musculus
tcagaacaaggaaaagatttccacc

SEQ ID NO: 765071 - DNA, 25 bp, Mus musculus
tcagaacaaggataagatttccacc

SEQ ID NO: 765072 - DNA, 25 bp, Mus musculus
tcagaacagagtctttgcccatctc

SEQ ID NO: 765073 - DNA, 25 bp, Mus musculus
tcagaacagagtgtttgcccatctc

SEQ ID NO: 765074 - DNA, 25 bp, Mus musculus
tcagaaccaaatcacagaggcacac

SEQ ID NO: 765075 - DNA, 25 bp, Mus musculus
tcagaaccaaatgacagaggcacac

SEQ ID NO: 765076 - DNA, 25 bp, Mus musculus
tcagaaccaattcggccacacgtaa

SEQ ID NO: 765077 - DNA, 25 bp, Mus musculus
tcagaaccaattgggccacacgtaa

SEQ ID NO: 765078 - DNA, 25 bp, Mus musculus
tcagaaccagagcaagtcatcccat

SEQ ID NO: 765079 - DNA, 25 bp, Mus musculus
tcagaaccagaggaagtcatcccat

SEQ ID NO: 765080 - DNA, 25 bp, Mus musculus
tcagaaccagttcccctgactctgg

SEQ ID NO: 765081 - DNA, 25 bp, Mus musculus
tcagaaccagttgccctgactctgg

SEQ ID NO: 765082 - DNA, 25 bp, Mus musculus
tcagaacccgtaagtggcagctctc

SEQ ID NO: 765083 - DNA, 25 bp, Mus musculus
tcagaacccgtatgtggcagctctc

SEQ ID NO: 765084 - DNA, 25 bp, Mus musculus
tcagaaccgttacgatgggcaggta

SEQ ID NO: 765085 - DNA, 25 bp, Mus musculus
tcagaaccgttaggatgggcaggta

SEQ ID NO: 765086 - DNA, 25 bp, Mus musculus
tcagaacctgaaccggcggcagcat

SEQ ID NO: 765087 - DNA, 25 bp, Mus musculus
tcagaacctgaagcggcggcagcat

SEQ ID NO: 765088 - DNA, 25 bp, Mus musculus
tcagaacgaatccacaaatgaacag

SEQ ID NO: 765089 - DNA, 25 bp, Mus musculus
tcagaacgaatcgacaaatgaacag

SEQ ID NO: 765090 - DNA, 25 bp, Mus musculus
tcagaacgcacgagctaacagcagc

SEQ ID NO: 765091 - DNA, 25 bp, Mus musculus
tcagaacgcacgtgctaacagcagc

SEQ ID NO: 765092 - DNA, 25 bp, Mus musculus
tcagaacggtctatctctacccatg

SEQ ID NO: 765093 - DNA, 25 bp, Mus musculus
tcagaacggtctttctctacccatg

SEQ ID NO: 765094 - DNA, 25 bp, Mus musculus
tcagaactacctagtgtaatacagc

SEQ ID NO: 765095 - DNA, 25 bp, Mus musculus
tcagaactaccttgtgtaatacagc

SEQ ID NO: 765096 - DNA, 25 bp, Mus musculus
tcagaactagtgagaaggttgagca

SEQ ID NO: 765097 - DNA, 25 bp, Mus musculus
tcagaactagtgtgaaggttgagca

SEQ ID NO: 765098 - DNA, 25 bp, Mus musculus
tcagaactatagaggctatggcggc

SEQ ID NO: 765099 - DNA, 25 bp, Mus musculus
tcagaactatagtggctatggcggc

SEQ ID NO: 765100 - DNA, 25 bp, Mus musculus
tcagaactcagtcaaaacacggcca

SEQ ID NO: 765101 - DNA, 25 bp, Mus musculus
tcagaactcagtgaaaacacggcca

SEQ ID NO: 765102 - DNA, 25 bp, Mus musculus
tcagaactccaaaccgaggctctca

SEQ ID NO: 765103 - DNA, 25 bp, Mus musculus
tcagaactccaatccgaggctctca

SEQ ID NO: 765104 - DNA, 25 bp, Mus musculus
tcagaactcgcaaagggttgacact

SEQ ID NO: 765105 - DNA, 25 bp, Mus musculus
tcagaactcgcatagggttgacact

SEQ ID NO: 765106 - DNA, 25 bp, Mus musculus
tcagaactctagaaggtaaggcagg

SEQ ID NO: 765107 - DNA, 25 bp, Mus musculus
tcagaactctagtaggtaaggcagg

SEQ ID NO: 765108 - DNA, 25 bp, Mus musculus
tcagaactgcagaaaatgcttctaa

SEQ ID NO: 765109 - DNA, 25 bp, Mus musculus
tcagaactgcagtaaatgcttctaa

SEQ ID NO: 765110 - DNA, 25 bp, Mus musculus
tcagaactgccacccggtggttttg

SEQ ID NO: 765111 - DNA, 25 bp, Mus musculus
tcagaactgccagccggtggttttg

SEQ ID NO: 765112 - DNA, 25 bp, Mus musculus
tcagaactgtgtaactgttaagcag

SEQ ID NO: 765113 - DNA, 25 bp, Mus musculus
tcagaactgtgttactgttaagcag

SEQ ID NO: 765114 - DNA, 25 bp, Mus musculus
tcagaacttagacaagccctcgacc

SEQ ID NO: 765115 - DNA, 25 bp, Mus musculus
tcagaacttagagaagccctcgacc

SEQ ID NO: 765116 - DNA, 25 bp, Mus musculus
tcagaagaaactaggtccactgagt

SEQ ID NO: 765117 - DNA, 25 bp, Mus musculus
tcagaagaaacttggtccactgagt

SEQ ID NO: 765118 - DNA, 25 bp, Mus musculus
tcagaagaaggacacattgtgcaac

SEQ ID NO: 765119 - DNA, 25 bp, Mus musculus
tcagaagaaggagacattgtgcaac

SEQ ID NO: 765120 - DNA, 25 bp, Mus musculus
tcagaagacagacagtaggaggatt

SEQ ID NO: 765121 - DNA, 25 bp, Mus musculus
tcagaagacagagagtaggaggatt

SEQ ID NO: 765122 - DNA, 25 bp, Mus musculus
tcagaagacagtcgatgggccatca

SEQ ID NO: 765123 - DNA, 25 bp, Mus musculus
tcagaagacagtggatgggccatca

SEQ ID NO: 765124 - DNA, 25 bp, Mus musculus
tcagaagacataactacctgaagac

SEQ ID NO: 765125 - DNA, 25 bp, Mus musculus
tcagaagacatatctacctgaagac

SEQ ID NO: 765126 - DNA, 25 bp, Mus musculus
tcagaagaccagctgtccctattga

SEQ ID NO: 765127 - DNA, 25 bp, Mus musculus
tcagaagaccaggtgtccctattga

SEQ ID NO: 765128 - DNA, 25 bp, Mus musculus
tcagaagacctcagtgtgttctacc

SEQ ID NO: 765129 - DNA, 25 bp, Mus musculus
tcagaagacctctgtgtgttctacc

SEQ ID NO: 765130 - DNA, 25 bp, Mus musculus
tcagaagacgttcctgtttgcaggc

SEQ ID NO: 765131 - DNA, 25 bp, Mus musculus
tcagaagacgttgctgtttgcaggc

SEQ ID NO: 765132 - DNA, 25 bp, Mus musculus
tcagaagactttccgaacagagcgt

SEQ ID NO: 765133 - DNA, 25 bp, Mus musculus
tcagaagactttgcgaacagagcgt

SEQ ID NO: 765134 - DNA, 25 bp, Mus musculus
tcagaagagtgtctgctgcacttga

SEQ ID NO: 765135 - DNA, 25 bp, Mus musculus
tcagaagagtgtgtgctgcacttga

SEQ ID NO: 765136 - DNA, 25 bp, Mus musculus
tcagaagatcatctggatgccccag

SEQ ID NO: 765137 - DNA, 25 bp, Mus musculus
tcagaagatcatgtggatgccccag

SEQ ID NO: 765138 - DNA, 25 bp, Mus musculus
tcagaagatccacctattgacacac

SEQ ID NO: 765139 - DNA, 25 bp, Mus musculus
tcagaagatccagctattgacacac

SEQ ID NO: 765140 - DNA, 25 bp, Mus musculus
tcagaagatttgcttctgatccaaa

SEQ ID NO: 765141 - DNA, 25 bp, Mus musculus
tcagaagatttggttctgatccaaa

SEQ ID NO: 765142 - DNA, 25 bp, Mus musculus
tcagaagcagcaaggtcagagggcc

SEQ ID NO: 765143 - DNA, 25 bp, Mus musculus
tcagaagcagcatggtcagagggcc

SEQ ID NO: 765144 - DNA, 25 bp, Mus musculus
tcagaagccaacacaggcacagtgg

SEQ ID NO: 765145 - DNA, 25 bp, Mus musculus
tcagaagccaactcaggcacagtgg

SEQ ID NO: 765146 - DNA, 25 bp, Mus musculus
tcagaagccgagcaactatgaacgg

SEQ ID NO: 765147 - DNA, 25 bp, Mus musculus
tcagaagccgaggaactatgaacgg

SEQ ID NO: 765148 - DNA, 25 bp, Mus musculus
tcagaagcctgtagacagtggtgct

SEQ ID NO: 765149 - DNA, 25 bp, Mus musculus
tcagaagcctgttgacagtggtgct

SEQ ID NO: 765150 - DNA, 25 bp, Mus musculus
tcagaagcgctgaaaggaggcagcc

SEQ ID NO: 765151 - DNA, 25 bp, Mus musculus
tcagaagcgctgtaaggaggcagcc

SEQ ID NO: 765152 - DNA, 25 bp, Mus musculus
tcagaagcggctagtaaaggggact

SEQ ID NO: 765153 - DNA, 25 bp, Mus musculus
tcagaagcggctcagaaacgttccc

SEQ ID NO: 765154 - DNA, 25 bp, Mus musculus
tcagaagcggctgagaaacgttccc

SEQ ID NO: 765155 - DNA, 25 bp, Mus musculus
tcagaagcggcttgtaaaggggact

SEQ ID NO: 765156 - DNA, 25 bp, Mus musculus
tcagaagctaatcgcaaattcctct

SEQ ID NO: 765157 - DNA, 25 bp, Mus musculus
tcagaagctaatggcaaattcctct

SEQ ID NO: 765158 - DNA, 25 bp, Mus musculus
tcagaagcttagatgggaccacagt

SEQ ID NO: 765159 - DNA, 25 bp, Mus musculus
tcagaagcttagttgggaccacagt

SEQ ID NO: 765160 - DNA, 25 bp, Mus musculus
tcagaagcttttatgatggagcaag

SEQ ID NO: 765161 - DNA, 25 bp, Mus musculus
tcagaagcttttttgatggagcaag

SEQ ID NO: 765162 - DNA, 25 bp, Mus musculus
tcagaaggagaaccgctaagcatcc

SEQ ID NO: 765163 - DNA, 25 bp, Mus musculus
tcagaaggagaagcgctaagcatcc

SEQ ID NO: 765164 - DNA, 25 bp, Mus musculus
tcagaaggaggaagacttgggccca

SEQ ID NO: 765165 - DNA, 25 bp, Mus musculus
tcagaaggaggatgacttgggccca

SEQ ID NO: 765166 - DNA, 25 bp, Mus musculus
tcagaaggccaactgcagacgctgt

SEQ ID NO: 765167 - DNA, 25 bp, Mus musculus
tcagaaggccaagtgcagacgctgt

SEQ ID NO: 765168 - DNA, 25 bp, Mus musculus
tcagaaggcctcctgcgtgtcttct

SEQ ID NO: 765169 - DNA, 25 bp, Mus musculus
tcagaaggcctcgtgcgtgtcttct

SEQ ID NO: 765170 - DNA, 25 bp, Mus musculus
tcagaaggctgtagttcaccccaat

SEQ ID NO: 765171 - DNA, 25 bp, Mus musculus
tcagaaggctgttgttcaccccaat

SEQ ID NO: 765172 - DNA, 25 bp, Mus musculus
tcagaagggtccacatacaataaag

SEQ ID NO: 765173 - DNA, 25 bp, Mus musculus
tcagaagggtcctcatacaataaag

SEQ ID NO: 765174 - DNA, 25 bp, Mus musculus
tcagaagggttgcttccccaagtct

SEQ ID NO: 765175 - DNA, 25 bp, Mus musculus
tcagaagggttggttccccaagtct

SEQ ID NO: 765176 - DNA, 25 bp, Mus musculus
tcagaaggtactccctctggctggc

SEQ ID NO: 765177 - DNA, 25 bp, Mus musculus
tcagaaggtactgcctctggctggc

SEQ ID NO: 765178 - DNA, 25 bp, Mus musculus
tcagaaggttctacctgaaaaacgt

SEQ ID NO: 765179 - DNA, 25 bp, Mus musculus
tcagaaggttcttcctgaaaaacgt

SEQ ID NO: 765180 - DNA, 25 bp, Mus musculus
tcagaagtaccaataacctgaagaa

SEQ ID NO: 765181 - DNA, 25 bp, Mus musculus
tcagaagtaccattaacctgaagaa

SEQ ID NO: 765182 - DNA, 25 bp, Mus musculus
tcagaagtactccatggacaacact

SEQ ID NO: 765183 - DNA, 25 bp, Mus musculus
tcagaagtactcgatggacaacact

SEQ ID NO: 765184 - DNA, 25 bp, Mus musculus
tcagaagtactgcagtgggccagca

SEQ ID NO: 765185 - DNA, 25 bp, Mus musculus
tcagaagtactggagtgggccagca

SEQ ID NO: 765186 - DNA, 25 bp, Mus musculus
tcagaagtatccatcccgaaaacaa

SEQ ID NO: 765187 - DNA, 25 bp, Mus musculus
tcagaagtatccttcccgaaaacaa

SEQ ID NO: 765188 - DNA, 25 bp, Mus musculus
tcagaagtatgaccagagagccacc

SEQ ID NO: 765189 - DNA, 25 bp, Mus musculus
tcagaagtatgagcagagagccacc

SEQ ID NO: 765190 - DNA, 25 bp, Mus musculus
tcagaagtattcatgctgccccgaa

SEQ ID NO: 765191 - DNA, 25 bp, Mus musculus
tcagaagtattcttgctgccccgaa

SEQ ID NO: 765192 - DNA, 25 bp, Mus musculus
tcagaagtcttgcactgcaactgca

SEQ ID NO: 765193 - DNA, 25 bp, Mus musculus
tcagaagtcttggactgcaactgca

SEQ ID NO: 765194 - DNA, 25 bp, Mus musculus
tcagaagtgaggacatttgtgctgg

SEQ ID NO: 765195 - DNA, 25 bp, Mus musculus
tcagaagtgaggtcatttgtgctgg

SEQ ID NO: 765196 - DNA, 25 bp, Mus musculus
tcagaagtggatcgattgcagtcag

SEQ ID NO: 765197 - DNA, 25 bp, Mus musculus
tcagaagtggatggattgcagtcag

SEQ ID NO: 765198 - DNA, 25 bp, Mus musculus
tcagaagttggacatacacaagtgg

SEQ ID NO: 765199 - DNA, 25 bp, Mus musculus
tcagaagttggagatacacaagtgg

SEQ ID NO: 765200 - DNA, 25 bp, Mus musculus
tcagaataaactcggcagtgggccc

SEQ ID NO: 765201 - DNA, 25 bp, Mus musculus
tcagaataaactgggcagtgggccc

SEQ ID NO: 765202 - DNA, 25 bp, Mus musculus
tcagaataactcatggagcctgtgc

SEQ ID NO: 765203 - DNA, 25 bp, Mus musculus
tcagaataactcttggagcctgtgc

SEQ ID NO: 765204 - DNA, 25 bp, Mus musculus
tcagaatacacacggaatccagatg

SEQ ID NO: 765205 - DNA, 25 bp, Mus musculus
tcagaatacacagggaatccagatg

SEQ ID NO: 765206 - DNA, 25 bp, Mus musculus
tcagaatagtgcagcctaaggacct

SEQ ID NO: 765207 - DNA, 25 bp, Mus musculus
tcagaatagtgctgcctaaggacct

SEQ ID NO: 765208 - DNA, 25 bp, Mus musculus
tcagaatccagaaacgaaacagatt

SEQ ID NO: 765209 - DNA, 25 bp, Mus musculus
tcagaatccagatacgaaacagatt

SEQ ID NO: 765210 - DNA, 25 bp, Mus musculus
tcagaatcctgcaaacctggaggag

SEQ ID NO: 765211 - DNA, 25 bp, Mus musculus
tcagaatcctgctaacctggaggag

SEQ ID NO: 765212 - DNA, 25 bp, Mus musculus
tcagaatctaccaacaggcgttccc

SEQ ID NO: 765213 - DNA, 25 bp, Mus musculus
tcagaatctacctacaggcgttccc

SEQ ID NO: 765214 - DNA, 25 bp, Mus musculus
tcagaatctcgacagtgcaggagaa

SEQ ID NO: 765215 - DNA, 25 bp, Mus musculus
tcagaatctcgagagtgcaggagaa

SEQ ID NO: 765216 - DNA, 25 bp, Mus musculus
tcagaatctgaacaaggcaaactac

SEQ ID NO: 765217 - DNA, 25 bp, Mus musculus
tcagaatctgaagaaggcaaactac

SEQ ID NO: 765218 - DNA, 25 bp, Mus musculus
tcagaatctgtaccaccttcccaag

SEQ ID NO: 765219 - DNA, 25 bp, Mus musculus
tcagaatctgtagcaccttcccaag

SEQ ID NO: 765220 - DNA, 25 bp, Mus musculus
tcagaatcttttccgcacacaaatc

SEQ ID NO: 765221 - DNA, 25 bp, Mus musculus
tcagaatcttttgcgcacacaaatc

SEQ ID NO: 765222 - DNA, 25 bp, Mus musculus
tcagaatgatataaacttgtccgaa

SEQ ID NO: 765223 - DNA, 25 bp, Mus musculus
tcagaatgatattaacttgtccgaa

SEQ ID NO: 765224 - DNA, 25 bp, Mus musculus
tcagaatgcacactctggaagccaa

SEQ ID NO: 765225 - DNA, 25 bp, Mus musculus
tcagaatgcacagtctggaagccaa

SEQ ID NO: 765226 - DNA, 25 bp, Mus musculus
tcagaatggagacgacctgctaggc

SEQ ID NO: 765227 - DNA, 25 bp, Mus musculus
tcagaatggagaggacctgctaggc

SEQ ID NO: 765228 - DNA, 25 bp, Mus musculus
tcagaatggagtcgccccggctcct

SEQ ID NO: 765229 - DNA, 25 bp, Mus musculus
tcagaatggagtggccccggctcct

SEQ ID NO: 765230 - DNA, 25 bp, Mus musculus
tcagaatgggccacatcctttctcc

SEQ ID NO: 765231 - DNA, 25 bp, Mus musculus
tcagaatgggcctcatcctttctcc

SEQ ID NO: 765232 - DNA, 25 bp, Mus musculus
tcagaatgggtgacttgtgtccgct

SEQ ID NO: 765233 - DNA, 25 bp, Mus musculus
tcagaatgggtgtcttgtgtccgct

SEQ ID NO: 765234 - DNA, 25 bp, Mus musculus
tcagaatggtttccaagtctgtcca

SEQ ID NO: 765235 - DNA, 25 bp, Mus musculus
tcagaatggtttgcaagtctgtcca

SEQ ID NO: 765236 - DNA, 25 bp, Mus musculus
tcagaatgtcccagaacatggcaga

SEQ ID NO: 765237 - DNA, 25 bp, Mus musculus
tcagaatgtccctgaacatggcaga

SEQ ID NO: 765238 - DNA, 25 bp, Mus musculus
tcagaattcagacacaaactctccc

SEQ ID NO: 765239 - DNA, 25 bp, Mus musculus
tcagaattcagagacaaactctccc

SEQ ID NO: 765240 - DNA, 25 bp, Mus musculus
tcagaattctagaccccaggagcag

SEQ ID NO: 765241 - DNA, 25 bp, Mus musculus
tcagaattctagtccccaggagcag

SEQ ID NO: 765242 - DNA, 25 bp, Mus musculus
tcagaattctgcaggcgaggaaagc

SEQ ID NO: 765243 - DNA, 25 bp, Mus musculus
tcagaattctgctggcgaggaaagc

SEQ ID NO: 765244 - DNA, 25 bp, Mus musculus
tcagaatttaggacacccgtattgg

SEQ ID NO: 765245 - DNA, 25 bp, Mus musculus
tcagaatttaggtcacccgtattgg

SEQ ID NO: 765246 - DNA, 25 bp, Mus musculus
tcagaatttcgacaggcagtttgag

SEQ ID NO: 765247 - DNA, 25 bp, Mus musculus
tcagaatttcgagaggcagtttgag

SEQ ID NO: 765248 - DNA, 25 bp, Mus musculus
tcagaattttccaggttagtatcag

SEQ ID NO: 765249 - DNA, 25 bp, Mus musculus
tcagaattttcctggttagtatcag

SEQ ID NO: 765250 - DNA, 25 bp, Mus musculus
tcagacaaagggaggacgccagcat

SEQ ID NO: 765251 - DNA, 25 bp, Mus musculus
tcagacaaagggtggacgccagcat

SEQ ID NO: 765252 - DNA, 25 bp, Mus musculus
tcagacaaatgtagacactcaccct

SEQ ID NO: 765253 - DNA, 25 bp, Mus musculus
tcagacaaatgttgacactcaccct

SEQ ID NO: 765254 - DNA, 25 bp, Mus musculus
tcagacaaccgtaggatctgccaaa

SEQ ID NO: 765255 - DNA, 25 bp, Mus musculus
tcagacaaccgttggatctgccaaa

SEQ ID NO: 765256 - DNA, 25 bp, Mus musculus
tcagacaagaagctgtctgagaccc

SEQ ID NO: 765257 - DNA, 25 bp, Mus musculus
tcagacaagaaggtgtctgagaccc

SEQ ID NO: 765258 - DNA, 25 bp, Mus musculus
tcagacaagatgaaccattgaaaca

SEQ ID NO: 765259 - DNA, 25 bp, Mus musculus
tcagacaagatgtaccattgaaaca

SEQ ID NO: 765260 - DNA, 25 bp, Mus musculus
tcagacaagcccacaaggtgagacc

SEQ ID NO: 765261 - DNA, 25 bp, Mus musculus
tcagacaagccctcaaggtgagacc

SEQ ID NO: 765262 - DNA, 25 bp, Mus musculus
tcagacaagctgatggtgcacctgg

SEQ ID NO: 765263 - DNA, 25 bp, Mus musculus
tcagacaagctgttggtgcacctgg

SEQ ID NO: 765264 - DNA, 25 bp, Mus musculus
tcagacaatgagcttcagcaagcat

SEQ ID NO: 765265 - DNA, 25 bp, Mus musculus
tcagacaatgaggttcagcaagcat

SEQ ID NO: 765266 - DNA, 25 bp, Mus musculus
tcagacacagcacttacttatacag

SEQ ID NO: 765267 - DNA, 25 bp, Mus musculus
tcagacacagcagttacttatacag

SEQ ID NO: 765268 - DNA, 25 bp, Mus musculus
tcagacacatgacatggaagcagtg

SEQ ID NO: 765269 - DNA, 25 bp, Mus musculus
tcagacacatgagatggaagcagtg

SEQ ID NO: 765270 - DNA, 25 bp, Mus musculus
tcagacaccaatcctgagtcctcag

SEQ ID NO: 765271 - DNA, 25 bp, Mus musculus
tcagacaccaatgctgagtcctcag

SEQ ID NO: 765272 - DNA, 25 bp, Mus musculus
tcagacaccagccattcagactcgg

SEQ ID NO: 765273 - DNA, 25 bp, Mus musculus
tcagacaccagcgattcagactcgg

SEQ ID NO: 765274 - DNA, 25 bp, Mus musculus
tcagacaccgagaagaaagggacct

SEQ ID NO: 765275 - DNA, 25 bp, Mus musculus
tcagacaccgagtagaaagggacct

SEQ ID NO: 765276 - DNA, 25 bp, Mus musculus
tcagacacggctctcaacgctgcaa

SEQ ID NO: 765277 - DNA, 25 bp, Mus musculus
tcagacacggctgtcaacgctgcaa

SEQ ID NO: 765278 - DNA, 25 bp, Mus musculus
tcagacactggtaagttggaggtgt

SEQ ID NO: 765279 - DNA, 25 bp, Mus musculus
tcagacactggtatagagaggcatc

SEQ ID NO: 765280 - DNA, 25 bp, Mus musculus
tcagacactggttagttggaggtgt

SEQ ID NO: 765281 - DNA, 25 bp, Mus musculus
tcagacactggtttagagaggcatc

SEQ ID NO: 765282 - DNA, 25 bp, Mus musculus
tcagacagacgtcaaaatgacatgt

SEQ ID NO: 765283 - DNA, 25 bp, Mus musculus
tcagacagacgtgaaaatgacatgt

SEQ ID NO: 765284 - DNA, 25 bp, Mus musculus
tcagacagcagaaaacctcatcttt

SEQ ID NO: 765285 - DNA, 25 bp, Mus musculus
tcagacagcagataacctcatcttt

SEQ ID NO: 765286 - DNA, 25 bp, Mus musculus
tcagacagcgacaactacacagacg

SEQ ID NO: 765287 - DNA, 25 bp, Mus musculus
tcagacagcgactactacacagacg

SEQ ID NO: 765288 - DNA, 25 bp, Mus musculus
tcagacaggagccatcacaccttgc

SEQ ID NO: 765289 - DNA, 25 bp, Mus musculus
tcagacaggagcgatcacaccttgc

SEQ ID NO: 765290 - DNA, 25 bp, Mus musculus
tcagacaggcctcggcacggctgca

SEQ ID NO: 765291 - DNA, 25 bp, Mus musculus
tcagacaggcctgggcacggctgca

SEQ ID NO: 765292 - DNA, 25 bp, Mus musculus
tcagacagggcccagcagtacagga

SEQ ID NO: 765293 - DNA, 25 bp, Mus musculus
tcagacagggccgagcagtacagga

SEQ ID NO: 765294 - DNA, 25 bp, Mus musculus
tcagacagtgctcttccagggagct

SEQ ID NO: 765295 - DNA, 25 bp, Mus musculus
tcagacagtgctgttccagggagct

SEQ ID NO: 765296 - DNA, 25 bp, Mus musculus
tcagacagtggcaagtgagagcgac

SEQ ID NO: 765297 - DNA, 25 bp, Mus musculus
tcagacagtggctagtgagagcgac

SEQ ID NO: 765298 - DNA, 25 bp, Mus musculus
tcagacagtgggacctaccagtgct

SEQ ID NO: 765299 - DNA, 25 bp, Mus musculus
tcagacagtgggtcctaccagtgct

SEQ ID NO: 765300 - DNA, 25 bp, Mus musculus
tcagacatcagacacgacacaatgc

SEQ ID NO: 765301 - DNA, 25 bp, Mus musculus
tcagacatcagagacgacacaatgc

SEQ ID NO: 765302 - DNA, 25 bp, Mus musculus
tcagacatcatcctgacagatgaca

SEQ ID NO: 765303 - DNA, 25 bp, Mus musculus
tcagacatcatcgtgacagatgaca

SEQ ID NO: 765304 - DNA, 25 bp, Mus musculus
tcagacatgaatcgatgggcacagg

SEQ ID NO: 765305 - DNA, 25 bp, Mus musculus
tcagacatgaatggatgggcacagg

SEQ ID NO: 765306 - DNA, 25 bp, Mus musculus
tcagacatgatgacacacctggtga

SEQ ID NO: 765307 - DNA, 25 bp, Mus musculus
tcagacatgatgtcacacctggtga

SEQ ID NO: 765308 - DNA, 25 bp, Mus musculus
tcagacattgacagggatgggacca

SEQ ID NO: 765309 - DNA, 25 bp, Mus musculus
tcagacattgactgggatgggacca

SEQ ID NO: 765310 - DNA, 25 bp, Mus musculus
tcagaccaaagactagttaatggag

SEQ ID NO: 765311 - DNA, 25 bp, Mus musculus
tcagaccaaagagtagttaatggag

SEQ ID NO: 765312 - DNA, 25 bp, Mus musculus
tcagaccacaggaagtgcggacgcg

SEQ ID NO: 765313 - DNA, 25 bp, Mus musculus
tcagaccacaggtagtgcggacgcg

SEQ ID NO: 765314 - DNA, 25 bp, Mus musculus
tcagaccacctaaggtgagagccac

SEQ ID NO: 765315 - DNA, 25 bp, Mus musculus
tcagaccacctatggtgagagccac

SEQ ID NO: 765316 - DNA, 25 bp, Mus musculus
tcagaccataccagcattagaagaa

SEQ ID NO: 765317 - DNA, 25 bp, Mus musculus
tcagaccatacctgcattagaagaa

SEQ ID NO: 765318 - DNA, 25 bp, Mus musculus
tcagaccatagtctgacccctgggt

SEQ ID NO: 765319 - DNA, 25 bp, Mus musculus
tcagaccatagtgtgacccctgggt

SEQ ID NO: 765320 - DNA, 25 bp, Mus musculus
tcagaccatgccattgtcaccagga

SEQ ID NO: 765321 - DNA, 25 bp, Mus musculus
tcagaccatgcctttgtcaccagga

SEQ ID NO: 765322 - DNA, 25 bp, Mus musculus
tcagacccagtcatctgcaccgtgg

SEQ ID NO: 765323 - DNA, 25 bp, Mus musculus
tcagacccagtcttctgcaccgtgg

SEQ ID NO: 765324 - DNA, 25 bp, Mus musculus
tcagacccatggatcgagatggtgt

SEQ ID NO: 765325 - DNA, 25 bp, Mus musculus
tcagacccatggttcgagatggtgt

SEQ ID NO: 765326 - DNA, 25 bp, Mus musculus
tcagaccccaggatgctttcaggcc

SEQ ID NO: 765327 - DNA, 25 bp, Mus musculus
tcagaccccaggttgctttcaggcc

SEQ ID NO: 765328 - DNA, 25 bp, Mus musculus
tcagacccctacagagcttgaaggg

SEQ ID NO: 765329 - DNA, 25 bp, Mus musculus
tcagacccctactgagcttgaaggg

SEQ ID NO: 765330 - DNA, 25 bp, Mus musculus
tcagacccgaaaaggaatcagtgcc

SEQ ID NO: 765331 - DNA, 25 bp, Mus musculus
tcagacccgaaatggaatcagtgcc

SEQ ID NO: 765332 - DNA, 25 bp, Mus musculus
tcagacccggagatgttgttcacgc

SEQ ID NO: 765333 - DNA, 25 bp, Mus musculus
tcagacccggagttgttgttcacgc

SEQ ID NO: 765334 - DNA, 25 bp, Mus musculus
tcagaccctccaaatattcctggct

SEQ ID NO: 765335 - DNA, 25 bp, Mus musculus
tcagaccctccatatattcctggct

SEQ ID NO: 765336 - DNA, 25 bp, Mus musculus
tcagacccttatctcaaagtcttcc

SEQ ID NO: 765337 - DNA, 25 bp, Mus musculus
tcagacccttatgtcaaagtcttcc

SEQ ID NO: 765338 - DNA, 25 bp, Mus musculus
tcagacccttgcacaccatggagga

SEQ ID NO: 765339 - DNA, 25 bp, Mus musculus
tcagacccttgctcaccatggagga

SEQ ID NO: 765340 - DNA, 25 bp, Mus musculus
tcagaccgagaaagtcctacggacc

SEQ ID NO: 765341 - DNA, 25 bp, Mus musculus
tcagaccgagaatgtcctacggacc

SEQ ID NO: 765342 - DNA, 25 bp, Mus musculus
tcagaccgatagagaacaggacccg

SEQ ID NO: 765343 - DNA, 25 bp, Mus musculus
tcagaccgatagtgaacaggacccg

SEQ ID NO: 765344 - DNA, 25 bp, Mus musculus
tcagacctccgaactaggacttcct

SEQ ID NO: 765345 - DNA, 25 bp, Mus musculus
tcagacctccgatctaggacttcct

SEQ ID NO: 765346 - DNA, 25 bp, Mus musculus
tcagacctggagaatacgggaacgt

SEQ ID NO: 765347 - DNA, 25 bp, Mus musculus
tcagacctggagtatacgggaacgt

SEQ ID NO: 765348 - DNA, 25 bp, Mus musculus
tcagacctggatccatgtttctgtg

SEQ ID NO: 765349 - DNA, 25 bp, Mus musculus
tcagacctggatgcatgtttctgtg

SEQ ID NO: 765350 - DNA, 25 bp, Mus musculus
tcagaccttatcatccagagcaacg

SEQ ID NO: 765351 - DNA, 25 bp, Mus musculus
tcagaccttatcttccagagcaacg

SEQ ID NO: 765352 - DNA, 25 bp, Mus musculus
tcagacctttctaccactggcagat

SEQ ID NO: 765353 - DNA, 25 bp, Mus musculus
tcagacctttcttccactggcagat

SEQ ID NO: 765354 - DNA, 25 bp, Mus musculus
tcagaccttttaatgcgttgaagac

SEQ ID NO: 765355 - DNA, 25 bp, Mus musculus
tcagaccttttattgcgttgaagac

SEQ ID NO: 765356 - DNA, 25 bp, Mus musculus
tcagacgaagatcggaattctcagc

SEQ ID NO: 765357 - DNA, 25 bp, Mus musculus
tcagacgaagatgggaattctcagc

SEQ ID NO: 765358 - DNA, 25 bp, Mus musculus
tcagacgaccctagcgaaggttgcg

SEQ ID NO: 765359 - DNA, 25 bp, Mus musculus
tcagacgacccttgcgaaggttgcg

SEQ ID NO: 765360 - DNA, 25 bp, Mus musculus
tcagacgactctctaaaacagttgg

SEQ ID NO: 765361 - DNA, 25 bp, Mus musculus
tcagacgactctgtaaaacagttgg

SEQ ID NO: 765362 - DNA, 25 bp, Mus musculus
tcagacgagcggaaatgtaactacg

SEQ ID NO: 765363 - DNA, 25 bp, Mus musculus
tcagacgagcggtaatgtaactacg

SEQ ID NO: 765364 - DNA, 25 bp, Mus musculus
tcagacgatgccacatgcaggctgt

SEQ ID NO: 765365 - DNA, 25 bp, Mus musculus
tcagacgatgcctcatgcaggctgt

SEQ ID NO: 765366 - DNA, 25 bp, Mus musculus
tcagacgccacacggcttgatgcca

SEQ ID NO: 765367 - DNA, 25 bp, Mus musculus
tcagacgccacagggcttgatgcca

SEQ ID NO: 765368 - DNA, 25 bp, Mus musculus
tcagacgccgcgagtcgtccttgac

SEQ ID NO: 765369 - DNA, 25 bp, Mus musculus
tcagacgccgcgtgtcgtccttgac

SEQ ID NO: 765370 - DNA, 25 bp, Mus musculus
tcagacgcgccaccattgttttgtc

SEQ ID NO: 765371 - DNA, 25 bp, Mus musculus
tcagacgcgccagcattgttttgtc

SEQ ID NO: 765372 - DNA, 25 bp, Mus musculus
tcagacgctcgacggcgagttcatc

SEQ ID NO: 765373 - DNA, 25 bp, Mus musculus
tcagacgctcgagggcgagttcatc

SEQ ID NO: 765374 - DNA, 25 bp, Mus musculus
tcagacgctgcaccccatataggaa

SEQ ID NO: 765375 - DNA, 25 bp, Mus musculus
tcagacgctgcagcccatataggaa

SEQ ID NO: 765376 - DNA, 25 bp, Mus musculus
tcagacggcggtacccgcgacggac

SEQ ID NO: 765377 - DNA, 25 bp, Mus musculus
tcagacggcggttcccgcgacggac

SEQ ID NO: 765378 - DNA, 25 bp, Mus musculus
tcagacgtgataaggccgtggctcc

SEQ ID NO: 765379 - DNA, 25 bp, Mus musculus
tcagacgtgatatggccgtggctcc

SEQ ID NO: 765380 - DNA, 25 bp, Mus musculus
tcagacgtgccgcttcagggaatgc

SEQ ID NO: 765381 - DNA, 25 bp, Mus musculus
tcagacgtgccggttcagggaatgc

SEQ ID NO: 765382 - DNA, 25 bp, Mus musculus
tcagacgtgctgattcagagtagtc

SEQ ID NO: 765383 - DNA, 25 bp, Mus musculus
tcagacgtgctgtttcagagtagtc

SEQ ID NO: 765384 - DNA, 25 bp, Mus musculus
tcagacgtggataaagataacccgg

SEQ ID NO: 765385 - DNA, 25 bp, Mus musculus
tcagacgtggattaagataacccgg

SEQ ID NO: 765386 - DNA, 25 bp, Mus musculus
tcagactactaaagagcctcagctt

SEQ ID NO: 765387 - DNA, 25 bp, Mus musculus
tcagactactaatgagcctcagctt

SEQ ID NO: 765388 - DNA, 25 bp, Mus musculus
tcagactactcgcacagcgtacgga

SEQ ID NO: 765389 - DNA, 25 bp, Mus musculus
tcagactactcggacagcgtacgga

SEQ ID NO: 765390 - DNA, 25 bp, Mus musculus
tcagactactggcagcggacgctgt

SEQ ID NO: 765391 - DNA, 25 bp, Mus musculus
tcagactactgggagcggacgctgt

SEQ ID NO: 765392 - DNA, 25 bp, Mus musculus
tcagactagccactcttggaggaag

SEQ ID NO: 765393 - DNA, 25 bp, Mus musculus
tcagactagccagtcttggaggaag

SEQ ID NO: 765394 - DNA, 25 bp, Mus musculus
tcagactatcacaggactggagccc

SEQ ID NO: 765395 - DNA, 25 bp, Mus musculus
tcagactatcactggactggagccc

SEQ ID NO: 765396 - DNA, 25 bp, Mus musculus
tcagactgagaaaacccatagttaa

SEQ ID NO: 765397 - DNA, 25 bp, Mus musculus
tcagactgagaatacccatagttaa

SEQ ID NO: 765398 - DNA, 25 bp, Mus musculus
tcagactggaagacagagaggtgca

SEQ ID NO: 765399 - DNA, 25 bp, Mus musculus
tcagactggaagtcagagaggtgca

SEQ ID NO: 765400 - DNA, 25 bp, Mus musculus
tcagactggcaaaaggagaagcttc

SEQ ID NO: 765401 - DNA, 25 bp, Mus musculus
tcagactggcaataggagaagcttc

SEQ ID NO: 765402 - DNA, 25 bp, Mus musculus
tcagactggcatcatatttaccctg

SEQ ID NO: 765403 - DNA, 25 bp, Mus musculus
tcagactggcatcggagacagaagc

SEQ ID NO: 765404 - DNA, 25 bp, Mus musculus
tcagactggcatgatatttaccctg

SEQ ID NO: 765405 - DNA, 25 bp, Mus musculus
tcagactggcatgggagacagaagc

SEQ ID NO: 765406 - DNA, 25 bp, Mus musculus
tcagactggccgattcatatagaaa

SEQ ID NO: 765407 - DNA, 25 bp, Mus musculus
tcagactggccgtttcatatagaaa

SEQ ID NO: 765408 - DNA, 25 bp, Mus musculus
tcagactgggcaacgtgttccatgc

SEQ ID NO: 765409 - DNA, 25 bp, Mus musculus
tcagactgggcatcgtgttccatgc

SEQ ID NO: 765410 - DNA, 25 bp, Mus musculus
tcagactgggtcaggccctcaactt

SEQ ID NO: 765411 - DNA, 25 bp, Mus musculus
tcagactgggtctggccctcaactt

SEQ ID NO: 765412 - DNA, 25 bp, Mus musculus
tcagactgtgagctggaggaaccct

SEQ ID NO: 765413 - DNA, 25 bp, Mus musculus
tcagactgtgaggtggaggaaccct

SEQ ID NO: 765414 - DNA, 25 bp, Mus musculus
tcagactgtggactgcacggtcacc

SEQ ID NO: 765415 - DNA, 25 bp, Mus musculus
tcagactgtggagtgcacggtcacc

SEQ ID NO: 765416 - DNA, 25 bp, Mus musculus
tcagacttagggaccgaggatggat

SEQ ID NO: 765417 - DNA, 25 bp, Mus musculus
tcagacttagggtccgaggatggat

SEQ ID NO: 765418 - DNA, 25 bp, Mus musculus
tcagacttctggagccttttcccct

SEQ ID NO: 765419 - DNA, 25 bp, Mus musculus
tcagacttctggtgccttttcccct

SEQ ID NO: 765420 - DNA, 25 bp, Mus musculus
tcagacttctgtagggctattggat

SEQ ID NO: 765421 - DNA, 25 bp, Mus musculus
tcagacttctgttgggctattggat

SEQ ID NO: 765422 - DNA, 25 bp, Mus musculus
tcagacttgagcatttaaacctaac

SEQ ID NO: 765423 - DNA, 25 bp, Mus musculus
tcagacttgagcttttaaacctaac

SEQ ID NO: 765424 - DNA, 25 bp, Mus musculus
tcagacttggacactatgtgcaatg

SEQ ID NO: 765425 - DNA, 25 bp, Mus musculus
tcagacttggactctatgtgcaatg

SEQ ID NO: 765426 - DNA, 25 bp, Mus musculus
tcagactttcacaacgataaattca

SEQ ID NO: 765427 - DNA, 25 bp, Mus musculus
tcagactttcactacgataaattca

SEQ ID NO: 765428 - DNA, 25 bp, Mus musculus
tcagagaaatgcctccccaaaggtc

SEQ ID NO: 765429 - DNA, 25 bp, Mus musculus
tcagagaaatgcgtccccaaaggtc

SEQ ID NO: 765430 - DNA, 25 bp, Mus musculus
tcagagaacacaccttgaagagcag

SEQ ID NO: 765431 - DNA, 25 bp, Mus musculus
tcagagaacacagcttgaagagcag

SEQ ID NO: 765432 - DNA, 25 bp, Mus musculus
tcagagaacccaacagatgtggagg

SEQ ID NO: 765433 - DNA, 25 bp, Mus musculus
tcagagaacccatcagatgtggagg

SEQ ID NO: 765434 - DNA, 25 bp, Mus musculus
tcagagaagaacactatggcaccag

SEQ ID NO: 765435 - DNA, 25 bp, Mus musculus
tcagagaagaactctatggcaccag

SEQ ID NO: 765436 - DNA, 25 bp, Mus musculus
tcagagaagccaatgatgaccgctt

SEQ ID NO: 765437 - DNA, 25 bp, Mus musculus
tcagagaagccattgatgaccgctt

SEQ ID NO: 765438 - DNA, 25 bp, Mus musculus
tcagagacaagcagtaacaagtaag

SEQ ID NO: 765439 - DNA, 25 bp, Mus musculus
tcagagacaagctgtaacaagtaag

SEQ ID NO: 765440 - DNA, 25 bp, Mus musculus
tcagagacaccaaccagacagaact

SEQ ID NO: 765441 - DNA, 25 bp, Mus musculus
tcagagacaccatccagacagaact

SEQ ID NO: 765442 - DNA, 25 bp, Mus musculus
tcagagacagttaaagtacaaccaa

SEQ ID NO: 765443 - DNA, 25 bp, Mus musculus
tcagagacagtttaagtacaaccaa

SEQ ID NO: 765444 - DNA, 25 bp, Mus musculus
tcagagacatttccagatttcatag

SEQ ID NO: 765445 - DNA, 25 bp, Mus musculus
tcagagacatttgcagatttcatag

SEQ ID NO: 765446 - DNA, 25 bp, Mus musculus
tcagagaccaaaagctcggagctct

SEQ ID NO: 765447 - DNA, 25 bp, Mus musculus
tcagagaccaaatgctcggagctct

SEQ ID NO: 765448 - DNA, 25 bp, Mus musculus
tcagagacccagctgctcaaaggca

SEQ ID NO: 765449 - DNA, 25 bp, Mus musculus
tcagagacccaggtgctcaaaggca

SEQ ID NO: 765450 - DNA, 25 bp, Mus musculus
tcagagacccatccctggtgcagag

SEQ ID NO: 765451 - DNA, 25 bp, Mus musculus
tcagagacccatgcctggtgcagag

SEQ ID NO: 765452 - DNA, 25 bp, Mus musculus
tcagagacccctcttgaaaggaaaa

SEQ ID NO: 765453 - DNA, 25 bp, Mus musculus
tcagagacccctgttgaaaggaaaa

SEQ ID NO: 765454 - DNA, 25 bp, Mus musculus
tcagagacgctgaccttcaagaggc

SEQ ID NO: 765455 - DNA, 25 bp, Mus musculus
tcagagacgctgtccttcaagaggc

SEQ ID NO: 765456 - DNA, 25 bp, Mus musculus
tcagagacggtaccttggcacctgc

SEQ ID NO: 765457 - DNA, 25 bp, Mus musculus
tcagagacggtagcttggcacctgc

SEQ ID NO: 765458 - DNA, 25 bp, Mus musculus
tcagagactatgcttgtggtccaca

SEQ ID NO: 765459 - DNA, 25 bp, Mus musculus
tcagagactatggttgtggtccaca

SEQ ID NO: 765460 - DNA, 25 bp, Mus musculus
tcagagactcccacctggttgctgt

SEQ ID NO: 765461 - DNA, 25 bp, Mus musculus
tcagagactccctcctggttgctgt

SEQ ID NO: 765462 - DNA, 25 bp, Mus musculus
tcagagactctaaatgtgaataccc

SEQ ID NO: 765463 - DNA, 25 bp, Mus musculus
tcagagactctatatgtgaataccc

SEQ ID NO: 765464 - DNA, 25 bp, Mus musculus
tcagagactgtgcagccaatcatgg

SEQ ID NO: 765465 - DNA, 25 bp, Mus musculus
tcagagactgtggagccaatcatgg

SEQ ID NO: 765466 - DNA, 25 bp, Mus musculus
tcagagagactcatggaggtgcaga

SEQ ID NO: 765467 - DNA, 25 bp, Mus musculus
tcagagagactcttggaggtgcaga

SEQ ID NO: 765468 - DNA, 25 bp, Mus musculus
tcagagagcagccactttgccagtg

SEQ ID NO: 765469 - DNA, 25 bp, Mus musculus
tcagagagcagcgactttgccagtg

SEQ ID NO: 765470 - DNA, 25 bp, Mus musculus
tcagagagccggctggagaggcagc

SEQ ID NO: 765471 - DNA, 25 bp, Mus musculus
tcagagagccgggtggagaggcagc

SEQ ID NO: 765472 - DNA, 25 bp, Mus musculus
tcagagagcctaagagcatcacctc

SEQ ID NO: 765473 - DNA, 25 bp, Mus musculus
tcagagagcctatgagcatcacctc

SEQ ID NO: 765474 - DNA, 25 bp, Mus musculus
tcagagagcggaagggctctttccc

SEQ ID NO: 765475 - DNA, 25 bp, Mus musculus
tcagagagcggatgggctctttccc

SEQ ID NO: 765476 - DNA, 25 bp, Mus musculus
tcagagagcgttccgttcatcaagc

SEQ ID NO: 765477 - DNA, 25 bp, Mus musculus
tcagagagcgttgcgttcatcaagc

SEQ ID NO: 765478 - DNA, 25 bp, Mus musculus
tcagagagctgaagaaaccatggca

SEQ ID NO: 765479 - DNA, 25 bp, Mus musculus
tcagagagctgatgaaaccatggca

SEQ ID NO: 765480 - DNA, 25 bp, Mus musculus
tcagagagcttgcagaccgacccag

SEQ ID NO: 765481 - DNA, 25 bp, Mus musculus
tcagagagcttggagaccgacccag

SEQ ID NO: 765482 - DNA, 25 bp, Mus musculus
tcagagagggagacacgcacccgga

SEQ ID NO: 765483 - DNA, 25 bp, Mus musculus
tcagagagggagatctcgacgcaat

SEQ ID NO: 765484 - DNA, 25 bp, Mus musculus
tcagagagggagtcacgcacccgga

SEQ ID NO: 765485 - DNA, 25 bp, Mus musculus
tcagagagggagttctcgacgcaat

SEQ ID NO: 765486 - DNA, 25 bp, Mus musculus
tcagagaggtcacatggcttgctcg

SEQ ID NO: 765487 - DNA, 25 bp, Mus musculus
tcagagaggtcagatggcttgctcg

SEQ ID NO: 765488 - DNA, 25 bp, Mus musculus
tcagagaggttaagctattttctca

SEQ ID NO: 765489 - DNA, 25 bp, Mus musculus
tcagagaggttatgctattttctca

SEQ ID NO: 765490 - DNA, 25 bp, Mus musculus
tcagagagtgcacaaggagcacagt

SEQ ID NO: 765491 - DNA, 25 bp, Mus musculus
tcagagagtgcagaaggagcacagt

SEQ ID NO: 765492 - DNA, 25 bp, Mus musculus
tcagagagtggcaggtatatacctc

SEQ ID NO: 765493 - DNA, 25 bp, Mus musculus
tcagagagtggctggtatatacctc

SEQ ID NO: 765494 - DNA, 25 bp, Mus musculus
tcagagagttccagggacaaacggc

SEQ ID NO: 765495 - DNA, 25 bp, Mus musculus
tcagagagttcctgggacaaacggc

SEQ ID NO: 765496 - DNA, 25 bp, Mus musculus
tcagagatcaccctgctggagacag

SEQ ID NO: 765497 - DNA, 25 bp, Mus musculus
tcagagatcaccgtgctggagacag

SEQ ID NO: 765498 - DNA, 25 bp, Mus musculus
tcagagatccgcaaccgaaagcaac

SEQ ID NO: 765499 - DNA, 25 bp, Mus musculus
tcagagatccgctaccgaaagcaac

SEQ ID NO: 765500 - DNA, 25 bp, Mus musculus
tcagagatctacagtaaggtgtgct

SEQ ID NO: 765501 - DNA, 25 bp, Mus musculus
tcagagatctactgtaaggtgtgct

SEQ ID NO: 765502 - DNA, 25 bp, Mus musculus
tcagagatctccctggcagtggaac

SEQ ID NO: 765503 - DNA, 25 bp, Mus musculus
tcagagatctccgtggcagtggaac

SEQ ID NO: 765504 - DNA, 25 bp, Mus musculus
tcagagatgacaaggagcttcggca

SEQ ID NO: 765505 - DNA, 25 bp, Mus musculus
tcagagatgacatggagcttcggca

SEQ ID NO: 765506 - DNA, 25 bp, Mus musculus
tcagagatgaccatctcaacctgct

SEQ ID NO: 765507 - DNA, 25 bp, Mus musculus
tcagagatgaccttctcaacctgct

SEQ ID NO: 765508 - DNA, 25 bp, Mus musculus
tcagagatgcagaggcattacgtca

SEQ ID NO: 765509 - DNA, 25 bp, Mus musculus
tcagagatgcagtggcattacgtca

SEQ ID NO: 765510 - DNA, 25 bp, Mus musculus
tcagagatgcatcagtggatgacac

SEQ ID NO: 765511 - DNA, 25 bp, Mus musculus
tcagagatgcatgagtggatgacac

SEQ ID NO: 765512 - DNA, 25 bp, Mus musculus
tcagagattactatgtgcacttcaa

SEQ ID NO: 765513 - DNA, 25 bp, Mus musculus
tcagagattactttgtgcacttcaa

SEQ ID NO: 765514 - DNA, 25 bp, Mus musculus
tcagagattggtacactcaccatag

SEQ ID NO: 765515 - DNA, 25 bp, Mus musculus
tcagagattggttcactcaccatag

SEQ ID NO: 765516 - DNA, 25 bp, Mus musculus
tcagagcaacggacgaacaaataag

SEQ ID NO: 765517 - DNA, 25 bp, Mus musculus
tcagagcaacggtcgaacaaataag

SEQ ID NO: 765518 - DNA, 25 bp, Mus musculus
tcagagcaagggatgacctcatcac

SEQ ID NO: 765519 - DNA, 25 bp, Mus musculus
tcagagcaagggttgacctcatcac

SEQ ID NO: 765520 - DNA, 25 bp, Mus musculus
tcagagcagacaaagaaacctccca

SEQ ID NO: 765521 - DNA, 25 bp, Mus musculus
tcagagcagacatagaaacctccca

SEQ ID NO: 765522 - DNA, 25 bp, Mus musculus
tcagagcagagaaagattataatcc

SEQ ID NO: 765523 - DNA, 25 bp, Mus musculus
tcagagcagagaacgaggtgctgac

SEQ ID NO: 765524 - DNA, 25 bp, Mus musculus
tcagagcagagatagattataatcc

SEQ ID NO: 765525 - DNA, 25 bp, Mus musculus
tcagagcagagatcgaggtgctgac

SEQ ID NO: 765526 - DNA, 25 bp, Mus musculus
tcagagcagatccatcgattgctgc

SEQ ID NO: 765527 - DNA, 25 bp, Mus musculus
tcagagcagatcgatcgattgctgc

SEQ ID NO: 765528 - DNA, 25 bp, Mus musculus
tcagagcaggacaacccatctacca

SEQ ID NO: 765529 - DNA, 25 bp, Mus musculus
tcagagcaggactacccatctacca

SEQ ID NO: 765530 - DNA, 25 bp, Mus musculus
tcagagcaggcaagatgctgcctcc

SEQ ID NO: 765531 - DNA, 25 bp, Mus musculus
tcagagcaggcatgatgctgcctcc

SEQ ID NO: 765532 - DNA, 25 bp, Mus musculus
tcagagcagtagagtcttcacagca

SEQ ID NO: 765533 - DNA, 25 bp, Mus musculus
tcagagcagtagtgtcttcacagca

SEQ ID NO: 765534 - DNA, 25 bp, Mus musculus
tcagagcagtatcacagcctacttc

SEQ ID NO: 765535 - DNA, 25 bp, Mus musculus
tcagagcagtatgacagcctacttc

SEQ ID NO: 765536 - DNA, 25 bp, Mus musculus
tcagagcattgcacccaaaactacc

SEQ ID NO: 765537 - DNA, 25 bp, Mus musculus
tcagagcattgctcccaaaactacc

SEQ ID NO: 765538 - DNA, 25 bp, Mus musculus
tcagagccaagacatctggaagaca

SEQ ID NO: 765539 - DNA, 25 bp, Mus musculus
tcagagccaagagatctggaagaca

SEQ ID NO: 765540 - DNA, 25 bp, Mus musculus
tcagagccagtactatgataccaca

SEQ ID NO: 765541 - DNA, 25 bp, Mus musculus
tcagagccagtagtatgataccaca

SEQ ID NO: 765542 - DNA, 25 bp, Mus musculus
tcagagcccgagaacagtctacctg

SEQ ID NO: 765543 - DNA, 25 bp, Mus musculus
tcagagcccgagtacagtctacctg

SEQ ID NO: 765544 - DNA, 25 bp, Mus musculus
tcagagccctatccactggtgagaa

SEQ ID NO: 765545 - DNA, 25 bp, Mus musculus
tcagagccctatgcactggtgagaa

SEQ ID NO: 765546 - DNA, 25 bp, Mus musculus
tcagagcccttgacttggagaatct

SEQ ID NO: 765547 - DNA, 25 bp, Mus musculus
tcagagcccttgtcttggagaatct

SEQ ID NO: 765548 - DNA, 25 bp, Mus musculus
tcagagccgaaaccataagcgaaga

SEQ ID NO: 765549 - DNA, 25 bp, Mus musculus
tcagagccgaaagcataagcgaaga

SEQ ID NO: 765550 - DNA, 25 bp, Mus musculus
tcagagccgcttcgccaaggaagtg

SEQ ID NO: 765551 - DNA, 25 bp, Mus musculus
tcagagccgcttggccaaggaagtg

SEQ ID NO: 765552 - DNA, 25 bp, Mus musculus
tcagagcctgaaagtatccgtaagt

SEQ ID NO: 765553 - DNA, 25 bp, Mus musculus
tcagagcctgaatgtatccgtaagt

SEQ ID NO: 765554 - DNA, 25 bp, Mus musculus
tcagagccttccaaagccatggtgg

SEQ ID NO: 765555 - DNA, 25 bp, Mus musculus
tcagagccttcctaagccatggtgg

SEQ ID NO: 765556 - DNA, 25 bp, Mus musculus
tcagagcgaacaatcagaagtatcc

SEQ ID NO: 765557 - DNA, 25 bp, Mus musculus
tcagagcgaacattcagaagtatcc

SEQ ID NO: 765558 - DNA, 25 bp, Mus musculus
tcagagcgaggcctgtttcaaggcc

SEQ ID NO: 765559 - DNA, 25 bp, Mus musculus
tcagagcgaggcgtgtttcaaggcc

SEQ ID NO: 765560 - DNA, 25 bp, Mus musculus
tcagagcgttttccataatggtgcc

SEQ ID NO: 765561 - DNA, 25 bp, Mus musculus
tcagagcgttttgcataatggtgcc

SEQ ID NO: 765562 - DNA, 25 bp, Mus musculus
tcagagctactcacccctagaagtg

SEQ ID NO: 765563 - DNA, 25 bp, Mus musculus
tcagagctactctcccctagaagtg

SEQ ID NO: 765564 - DNA, 25 bp, Mus musculus
tcagagctatcgacattggcccgag

SEQ ID NO: 765565 - DNA, 25 bp, Mus musculus
tcagagctatcgtcattggcccgag

SEQ ID NO: 765566 - DNA, 25 bp, Mus musculus
tcagagctcagcacttcagactcac

SEQ ID NO: 765567 - DNA, 25 bp, Mus musculus
tcagagctcagctcttcagactcac

SEQ ID NO: 765568 - DNA, 25 bp, Mus musculus
tcagagctccagatctacgagtccc

SEQ ID NO: 765569 - DNA, 25 bp, Mus musculus
tcagagctccagttctacgagtccc

SEQ ID NO: 765570 - DNA, 25 bp, Mus musculus
tcagagctctgactctaagtcggag

SEQ ID NO: 765571 - DNA, 25 bp, Mus musculus
tcagagctctgagtctaagtcggag

SEQ ID NO: 765572 - DNA, 25 bp, Mus musculus
tcagagctctttcgccttaaaatga

SEQ ID NO: 765573 - DNA, 25 bp, Mus musculus
tcagagctctttggccttaaaatga

SEQ ID NO: 765574 - DNA, 25 bp, Mus musculus
tcagagctgaagataagagagcagg

SEQ ID NO: 765575 - DNA, 25 bp, Mus musculus
tcagagctgaagttaagagagcagg

SEQ ID NO: 765576 - DNA, 25 bp, Mus musculus
tcagagctgagacccctgagaaact

SEQ ID NO: 765577 - DNA, 25 bp, Mus musculus
tcagagctgagagccctgagaaact

SEQ ID NO: 765578 - DNA, 25 bp, Mus musculus
tcagagctgcccacaagaggagggc

SEQ ID NO: 765579 - DNA, 25 bp, Mus musculus
tcagagctgccctcaagaggagggc

SEQ ID NO: 765580 - DNA, 25 bp, Mus musculus
tcagagctgctaagtcgctgtggcc

SEQ ID NO: 765581 - DNA, 25 bp, Mus musculus
tcagagctgctatgtcgctgtggcc

SEQ ID NO: 765582 - DNA, 25 bp, Mus musculus
tcagagctggctaatggcagatgtg

SEQ ID NO: 765583 - DNA, 25 bp, Mus musculus
tcagagctggctacagcaagaagga

SEQ ID NO: 765584 - DNA, 25 bp, Mus musculus
tcagagctggcttatggcagatgtg

SEQ ID NO: 765585 - DNA, 25 bp, Mus musculus
tcagagctggcttcagcaagaagga

SEQ ID NO: 765586 - DNA, 25 bp, Mus musculus
tcagagcttcccatccgaacgtgga

SEQ ID NO: 765587 - DNA, 25 bp, Mus musculus
tcagagcttcccttccgaacgtgga

SEQ ID NO: 765588 - DNA, 25 bp, Mus musculus
tcagaggaaccaaggtgcacttcag

SEQ ID NO: 765589 - DNA, 25 bp, Mus musculus
tcagaggaaccatggtgcacttcag

SEQ ID NO: 765590 - DNA, 25 bp, Mus musculus
tcagaggaacccactggtctgcggt

SEQ ID NO: 765591 - DNA, 25 bp, Mus musculus
tcagaggaaccctctggtctgcggt

SEQ ID NO: 765592 - DNA, 25 bp, Mus musculus
tcagaggacatgatgcctgtcggcc

SEQ ID NO: 765593 - DNA, 25 bp, Mus musculus
tcagaggacatgttgcctgtcggcc

SEQ ID NO: 765594 - DNA, 25 bp, Mus musculus
tcagaggaccaaacctgtgggcgtg

SEQ ID NO: 765595 - DNA, 25 bp, Mus musculus
tcagaggaccaatcctgtgggcgtg

SEQ ID NO: 765596 - DNA, 25 bp, Mus musculus
tcagaggacctcactgagagggcaa

SEQ ID NO: 765597 - DNA, 25 bp, Mus musculus
tcagaggacctctctgagagggcaa

SEQ ID NO: 765598 - DNA, 25 bp, Mus musculus
tcagaggagaatcaggaaaatacag

SEQ ID NO: 765599 - DNA, 25 bp, Mus musculus
tcagaggagaatgaggaaaatacag

SEQ ID NO: 765600 - DNA, 25 bp, Mus musculus
tcagaggagagaacagaaacaagag

SEQ ID NO: 765601 - DNA, 25 bp, Mus musculus
tcagaggagagatcagaaacaagag

SEQ ID NO: 765602 - DNA, 25 bp, Mus musculus
tcagaggagcagatgtgcagccaag

SEQ ID NO: 765603 - DNA, 25 bp, Mus musculus
tcagaggagcagttgtgcagccaag

SEQ ID NO: 765604 - DNA, 25 bp, Mus musculus
tcagaggagcccatgccggagtctg

SEQ ID NO: 765605 - DNA, 25 bp, Mus musculus
tcagaggagcccttgccggagtctg

SEQ ID NO: 765606 - DNA, 25 bp, Mus musculus
tcagaggaggatacagatgagtgcc

SEQ ID NO: 765607 - DNA, 25 bp, Mus musculus
tcagaggaggattcagatgagtgcc

SEQ ID NO: 765608 - DNA, 25 bp, Mus musculus
tcagaggagtgcatgaacgcaatca

SEQ ID NO: 765609 - DNA, 25 bp, Mus musculus
tcagaggagtgcttgaacgcaatca

SEQ ID NO: 765610 - DNA, 25 bp, Mus musculus
tcagaggatagcctttcggtggcca

SEQ ID NO: 765611 - DNA, 25 bp, Mus musculus
tcagaggatagcgtttcggtggcca

SEQ ID NO: 765612 - DNA, 25 bp, Mus musculus
tcagaggatcccctgtaacgggtgc

SEQ ID NO: 765613 - DNA, 25 bp, Mus musculus
tcagaggatcccgtgtaacgggtgc

SEQ ID NO: 765614 - DNA, 25 bp, Mus musculus
tcagaggatgttctatctttacaag

SEQ ID NO: 765615 - DNA, 25 bp, Mus musculus
tcagaggatgttgtatctttacaag

SEQ ID NO: 765616 - DNA, 25 bp, Mus musculus
tcagaggcacctactaagtcggagg

SEQ ID NO: 765617 - DNA, 25 bp, Mus musculus
tcagaggcaccttctaagtcggagg

SEQ ID NO: 765618 - DNA, 25 bp, Mus musculus
tcagaggcagaacatttatacagat

SEQ ID NO: 765619 - DNA, 25 bp, Mus musculus
tcagaggcagaagatttatacagat

SEQ ID NO: 765620 - DNA, 25 bp, Mus musculus
tcagaggcagacatgtcatcgagtg

SEQ ID NO: 765621 - DNA, 25 bp, Mus musculus
tcagaggcagacttgtcatcgagtg

SEQ ID NO: 765622 - DNA, 25 bp, Mus musculus
tcagaggcagcaaactgggctgcag

SEQ ID NO: 765623 - DNA, 25 bp, Mus musculus
tcagaggcagcaaggtgagcagctt

SEQ ID NO: 765624 - DNA, 25 bp, Mus musculus
tcagaggcagcatactgggctgcag

SEQ ID NO: 765625 - DNA, 25 bp, Mus musculus
tcagaggcagcatggtgagcagctt

SEQ ID NO: 765626 - DNA, 25 bp, Mus musculus
tcagaggcatagcatgtggacacac

SEQ ID NO: 765627 - DNA, 25 bp, Mus musculus
tcagaggcataggatgtggacacac

SEQ ID NO: 765628 - DNA, 25 bp, Mus musculus
tcagaggcatcactaagccctctgc

SEQ ID NO: 765629 - DNA, 25 bp, Mus musculus
tcagaggcatcagtaagccctctgc

SEQ ID NO: 765630 - DNA, 25 bp, Mus musculus
tcagaggccatcacagctgatgtca

SEQ ID NO: 765631 - DNA, 25 bp, Mus musculus
tcagaggccatctcagctgatgtca

SEQ ID NO: 765632 - DNA, 25 bp, Mus musculus
tcagaggccctgctgtgtcccttta

SEQ ID NO: 765633 - DNA, 25 bp, Mus musculus
tcagaggccctggtgtgtcccttta

SEQ ID NO: 765634 - DNA, 25 bp, Mus musculus
tcagaggctcccaggacaactcgag

SEQ ID NO: 765635 - DNA, 25 bp, Mus musculus
tcagaggctccctggacaactcgag

SEQ ID NO: 765636 - DNA, 25 bp, Mus musculus
tcagaggctcctaaaagatatgttc

SEQ ID NO: 765637 - DNA, 25 bp, Mus musculus
tcagaggctccttaaagatatgttc

SEQ ID NO: 765638 - DNA, 25 bp, Mus musculus
tcagaggcttgcaaggccctcctgg

SEQ ID NO: 765639 - DNA, 25 bp, Mus musculus
tcagaggcttgctaggccctcctgg

SEQ ID NO: 765640 - DNA, 25 bp, Mus musculus
tcagagggaacaagaacccatctct

SEQ ID NO: 765641 - DNA, 25 bp, Mus musculus
tcagagggaacatgaacccatctct

SEQ ID NO: 765642 - DNA, 25 bp, Mus musculus
tcagagggcacacacgactgccaca

SEQ ID NO: 765643 - DNA, 25 bp, Mus musculus
tcagagggcacagacgactgccaca

SEQ ID NO: 765644 - DNA, 25 bp, Mus musculus
tcagagggctgaatgaggtgcatcc

SEQ ID NO: 765645 - DNA, 25 bp, Mus musculus
tcagagggctgattgaggtgcatcc

SEQ ID NO: 765646 - DNA, 25 bp, Mus musculus
tcagagggtgacaaagtttctaacc

SEQ ID NO: 765647 - DNA, 25 bp, Mus musculus
tcagagggtgactaagtttctaacc

SEQ ID NO: 765648 - DNA, 25 bp, Mus musculus
tcagaggtcattcctggcgttcaga

SEQ ID NO: 765649 - DNA, 25 bp, Mus musculus
tcagaggtcattgctggcgttcaga

SEQ ID NO: 765650 - DNA, 25 bp, Mus musculus
tcagaggtgggcagtgtcttcccac

SEQ ID NO: 765651 - DNA, 25 bp, Mus musculus
tcagaggtgggctgtgtcttcccac

SEQ ID NO: 765652 - DNA, 25 bp, Mus musculus
tcagaggttcagaacaaaatctacc

SEQ ID NO: 765653 - DNA, 25 bp, Mus musculus
tcagaggttcagtacaaaatctacc

SEQ ID NO: 765654 - DNA, 25 bp, Mus musculus
tcagaggttgagaaggccagtccct

SEQ ID NO: 765655 - DNA, 25 bp, Mus musculus
tcagaggttgagtaggccagtccct

SEQ ID NO: 765656 - DNA, 25 bp, Mus musculus
tcagagtaaaaacggccctcaggga

SEQ ID NO: 765657 - DNA, 25 bp, Mus musculus
tcagagtaaaaagggccctcaggga

SEQ ID NO: 765658 - DNA, 25 bp, Mus musculus
tcagagtaaaggcatctcctccagc

SEQ ID NO: 765659 - DNA, 25 bp, Mus musculus
tcagagtaaagggatctcctccagc

SEQ ID NO: 765660 - DNA, 25 bp, Mus musculus
tcagagtaactaaggactgcacctt

SEQ ID NO: 765661 - DNA, 25 bp, Mus musculus
tcagagtaactatggactgcacctt

SEQ ID NO: 765662 - DNA, 25 bp, Mus musculus
tcagagtaatgcagaatgcgtgcct

SEQ ID NO: 765663 - DNA, 25 bp, Mus musculus
tcagagtaatgctgaatgcgtgcct

SEQ ID NO: 765664 - DNA, 25 bp, Mus musculus
tcagagtatctacctcctcagaagc

SEQ ID NO: 765665 - DNA, 25 bp, Mus musculus
tcagagtatctagctcctcagaagc

SEQ ID NO: 765666 - DNA, 25 bp, Mus musculus
tcagagtcacctcatgtcaacctgg

SEQ ID NO: 765667 - DNA, 25 bp, Mus musculus
tcagagtcacctgatgtcaacctgg

SEQ ID NO: 765668 - DNA, 25 bp, Mus musculus
tcagagtcagctatggtgccaggca

SEQ ID NO: 765669 - DNA, 25 bp, Mus musculus
tcagagtcagctttggtgccaggca

SEQ ID NO: 765670 - DNA, 25 bp, Mus musculus
tcagagtccacacctcagaactacg

SEQ ID NO: 765671 - DNA, 25 bp, Mus musculus
tcagagtccacagctcagaactacg

SEQ ID NO: 765672 - DNA, 25 bp, Mus musculus
tcagagtcctgcaattcacaggcag

SEQ ID NO: 765673 - DNA, 25 bp, Mus musculus
tcagagtcctgctattcacaggcag

SEQ ID NO: 765674 - DNA, 25 bp, Mus musculus
tcagagtctggacctggaaactacc

SEQ ID NO: 765675 - DNA, 25 bp, Mus musculus
tcagagtctggagctggaaactacc

SEQ ID NO: 765676 - DNA, 25 bp, Mus musculus
tcagagtcttggaaaagcagaagcc

SEQ ID NO: 765677 - DNA, 25 bp, Mus musculus
tcagagtcttggtaaagcagaagcc

SEQ ID NO: 765678 - DNA, 25 bp, Mus musculus
tcagagtgaactacatcgggacagg

SEQ ID NO: 765679 - DNA, 25 bp, Mus musculus
tcagagtgaacttcatcgggacagg

SEQ ID NO: 765680 - DNA, 25 bp, Mus musculus
tcagagtgaagaagctcgcgcttgg

SEQ ID NO: 765681 - DNA, 25 bp, Mus musculus
tcagagtgaagatgctcgcgcttgg

SEQ ID NO: 765682 - DNA, 25 bp, Mus musculus
tcagagtgacctacagagggcagca

SEQ ID NO: 765683 - DNA, 25 bp, Mus musculus
tcagagtgaccttcagagggcagca

SEQ ID NO: 765684 - DNA, 25 bp, Mus musculus
tcagagtgatggactcaagagcaga

SEQ ID NO: 765685 - DNA, 25 bp, Mus musculus
tcagagtgatggtctcaagagcaga

SEQ ID NO: 765686 - DNA, 25 bp, Mus musculus
tcagagtgtagacaaggacgtcctt

SEQ ID NO: 765687 - DNA, 25 bp, Mus musculus
tcagagtgtagagaaggacgtcctt

SEQ ID NO: 765688 - DNA, 25 bp, Mus musculus
tcagagtgtgaacaccagccagggt

SEQ ID NO: 765689 - DNA, 25 bp, Mus musculus
tcagagtgtgaagaccagccagggt

SEQ ID NO: 765690 - DNA, 25 bp, Mus musculus
tcagagttagatcccgctggaccct

SEQ ID NO: 765691 - DNA, 25 bp, Mus musculus
tcagagttagatgccgctggaccct

SEQ ID NO: 765692 - DNA, 25 bp, Mus musculus
tcagagttcaagcatctcaacccaa

SEQ ID NO: 765693 - DNA, 25 bp, Mus musculus
tcagagttcaaggatctcaacccaa

SEQ ID NO: 765694 - DNA, 25 bp, Mus musculus
tcagagttctggactggcattcccc

SEQ ID NO: 765695 - DNA, 25 bp, Mus musculus
tcagagttctggtctggcattcccc

SEQ ID NO: 765696 - DNA, 25 bp, Mus musculus
tcagagttgtcgctgcaacatgcag

SEQ ID NO: 765697 - DNA, 25 bp, Mus musculus
tcagagttgtcggtgcaacatgcag

SEQ ID NO: 765698 - DNA, 25 bp, Mus musculus
tcagagtttcatccaagatgtgggc

SEQ ID NO: 765699 - DNA, 25 bp, Mus musculus
tcagagtttcatgcaagatgtgggc

SEQ ID NO: 765700 - DNA, 25 bp, Mus musculus
tcagagtttcgacacttggcgccgg

SEQ ID NO: 765701 - DNA, 25 bp, Mus musculus
tcagagtttcgagacttggcgccgg

SEQ ID NO: 765702 - DNA, 25 bp, Mus musculus
tcagagtttcttccgggctctggcc

SEQ ID NO: 765703 - DNA, 25 bp, Mus musculus
tcagagtttcttgcgggctctggcc

SEQ ID NO: 765704 - DNA, 25 bp, Mus musculus
tcagagtttgtaattccaagtgtgt

SEQ ID NO: 765705 - DNA, 25 bp, Mus musculus
tcagagtttgtatttccaagtgtgt

SEQ ID NO: 765706 - DNA, 25 bp, Mus musculus
tcagataaacacctgcaagaaggcc

SEQ ID NO: 765707 - DNA, 25 bp, Mus musculus
tcagataaacacgtgcaagaaggcc

SEQ ID NO: 765708 - DNA, 25 bp, Mus musculus
tcagataaattgacagcagccagtt

SEQ ID NO: 765709 - DNA, 25 bp, Mus musculus
tcagataaattgtcagcagccagtt

SEQ ID NO: 765710 - DNA, 25 bp, Mus musculus
tcagataactctattgaacactcag

SEQ ID NO: 765711 - DNA, 25 bp, Mus musculus
tcagataactcttttgaacactcag

SEQ ID NO: 765712 - DNA, 25 bp, Mus musculus
tcagataactggcatcaaacatatg

SEQ ID NO: 765713 - DNA, 25 bp, Mus musculus
tcagataactgggatcaaacatatg

SEQ ID NO: 765714 - DNA, 25 bp, Mus musculus
tcagataacttgacccagggctatg

SEQ ID NO: 765715 - DNA, 25 bp, Mus musculus
tcagataacttgtcccagggctatg

SEQ ID NO: 765716 - DNA, 25 bp, Mus musculus
tcagataagaagacagcagcagcag

SEQ ID NO: 765717 - DNA, 25 bp, Mus musculus
tcagataagaagtcagcagcagcag

SEQ ID NO: 765718 - DNA, 25 bp, Mus musculus
tcagataatccactctccgtggcgg

SEQ ID NO: 765719 - DNA, 25 bp, Mus musculus
tcagataatccagtctccgtggcgg

SEQ ID NO: 765720 - DNA, 25 bp, Mus musculus
tcagatacacctacctacgagagca

SEQ ID NO: 765721 - DNA, 25 bp, Mus musculus
tcagatacaccttcctacgagagca

SEQ ID NO: 765722 - DNA, 25 bp, Mus musculus
tcagatacagggaagccttactact

SEQ ID NO: 765723 - DNA, 25 bp, Mus musculus
tcagatacagggtagccttactact

SEQ ID NO: 765724 - DNA, 25 bp, Mus musculus
tcagatacggcaagaaccgcgggct

SEQ ID NO: 765725 - DNA, 25 bp, Mus musculus
tcagatacggcatgaaccgcgggct

SEQ ID NO: 765726 - DNA, 25 bp, Mus musculus
tcagatacttcactctcaaaacaag

SEQ ID NO: 765727 - DNA, 25 bp, Mus musculus
tcagatacttcagtctcaaaacaag

SEQ ID NO: 765728 - DNA, 25 bp, Mus musculus
tcagatagactcatgtggcatctca

SEQ ID NO: 765729 - DNA, 25 bp, Mus musculus
tcagatagactcttgtggcatctca

SEQ ID NO: 765730 - DNA, 25 bp, Mus musculus
tcagatagagaccaaccggaacaca

SEQ ID NO: 765731 - DNA, 25 bp, Mus musculus
tcagatagagacgaaccggaacaca

SEQ ID NO: 765732 - DNA, 25 bp, Mus musculus
tcagatagattgaggagagagagct

SEQ ID NO: 765733 - DNA, 25 bp, Mus musculus
tcagatagattgtggagagagagct

SEQ ID NO: 765734 - DNA, 25 bp, Mus musculus
tcagatagcagtcagcctatgctgc

SEQ ID NO: 765735 - DNA, 25 bp, Mus musculus
tcagatagcagtgagcctatgctgc

SEQ ID NO: 765736 - DNA, 25 bp, Mus musculus
tcagatagttaccagttctggagac

SEQ ID NO: 765737 - DNA, 25 bp, Mus musculus
tcagatagttacgagttctggagac

SEQ ID NO: 765738 - DNA, 25 bp, Mus musculus
tcagatatacacattgacaatggat

SEQ ID NO: 765739 - DNA, 25 bp, Mus musculus
tcagatatacactttgacaatggat

SEQ ID NO: 765740 - DNA, 25 bp, Mus musculus
tcagatattttaaaggttgacacaa

SEQ ID NO: 765741 - DNA, 25 bp, Mus musculus
tcagatattttataggttgacacaa

SEQ ID NO: 765742 - DNA, 25 bp, Mus musculus
tcagatcacagaagcggtaacgagc

SEQ ID NO: 765743 - DNA, 25 bp, Mus musculus
tcagatcacagatgcggtaacgagc

SEQ ID NO: 765744 - DNA, 25 bp, Mus musculus
tcagatcacgctctacatgctagtg

SEQ ID NO: 765745 - DNA, 25 bp, Mus musculus
tcagatcacgctgtacatgctagtg

SEQ ID NO: 765746 - DNA, 25 bp, Mus musculus
tcagatcagcagagtttccaatgtg

SEQ ID NO: 765747 - DNA, 25 bp, Mus musculus
tcagatcagcagtgtttccaatgtg

SEQ ID NO: 765748 - DNA, 25 bp, Mus musculus
tcagatcaggatccccaaaattgga

SEQ ID NO: 765749 - DNA, 25 bp, Mus musculus
tcagatcaggatgcccaaaattgga

SEQ ID NO: 765750 - DNA, 25 bp, Mus musculus
tcagatcagtccatccctcgagaca

SEQ ID NO: 765751 - DNA, 25 bp, Mus musculus
tcagatcagtccttccctcgagaca

SEQ ID NO: 765752 - DNA, 25 bp, Mus musculus
tcagatcatgatcgcaagggcgatg

SEQ ID NO: 765753 - DNA, 25 bp, Mus musculus
tcagatcatgatggcaagggcgatg

SEQ ID NO: 765754 - DNA, 25 bp, Mus musculus
tcagatccagctatcctgtacaatg

SEQ ID NO: 765755 - DNA, 25 bp, Mus musculus
tcagatccagctttcctgtacaatg

SEQ ID NO: 765756 - DNA, 25 bp, Mus musculus
tcagatccgtgcatacagacatcaa

SEQ ID NO: 765757 - DNA, 25 bp, Mus musculus
tcagatccgtgcttacagacatcaa

SEQ ID NO: 765758 - DNA, 25 bp, Mus musculus
tcagatcctcctcaagctggacagg

SEQ ID NO: 765759 - DNA, 25 bp, Mus musculus
tcagatcctcctgaagctggacagg

SEQ ID NO: 765760 - DNA, 25 bp, Mus musculus
tcagatcctcgactggaggccaccg

SEQ ID NO: 765761 - DNA, 25 bp, Mus musculus
tcagatcctcgagtggaggccaccg

SEQ ID NO: 765762 - DNA, 25 bp, Mus musculus
tcagatcgaaaacatagctcagcgg

SEQ ID NO: 765763 - DNA, 25 bp, Mus musculus
tcagatcgaaaagatagctcagcgg

SEQ ID NO: 765764 - DNA, 25 bp, Mus musculus
tcagatcgacaaagtcaaggtgtgg

SEQ ID NO: 765765 - DNA, 25 bp, Mus musculus
tcagatcgacaatgtcaaggtgtgg

SEQ ID NO: 765766 - DNA, 25 bp, Mus musculus
tcagatcgccctagggaaataagag

SEQ ID NO: 765767 - DNA, 25 bp, Mus musculus
tcagatcgcccttgggaaataagag

SEQ ID NO: 765768 - DNA, 25 bp, Mus musculus
tcagatcgctcgcattcagagcgag

SEQ ID NO: 765769 - DNA, 25 bp, Mus musculus
tcagatcgctcggattcagagcgag

SEQ ID NO: 765770 - DNA, 25 bp, Mus musculus
tcagatcggaccctgtaaaagctgt

SEQ ID NO: 765771 - DNA, 25 bp, Mus musculus
tcagatcggaccgtgtaaaagctgt

SEQ ID NO: 765772 - DNA, 25 bp, Mus musculus
tcagatcggcctacaggacgctggc

SEQ ID NO: 765773 - DNA, 25 bp, Mus musculus
tcagatcggccttcaggacgctggc

SEQ ID NO: 765774 - DNA, 25 bp, Mus musculus
tcagatcgggttatgagaccgccca

SEQ ID NO: 765775 - DNA, 25 bp, Mus musculus
tcagatcgggttttgagaccgccca

SEQ ID NO: 765776 - DNA, 25 bp, Mus musculus
tcagatctaccgctcactgctggcg

SEQ ID NO: 765777 - DNA, 25 bp, Mus musculus
tcagatctaccggtcactgctggcg

SEQ ID NO: 765778 - DNA, 25 bp, Mus musculus
tcagatctacgtccatcccaagtgc

SEQ ID NO: 765779 - DNA, 25 bp, Mus musculus
tcagatctacgtgcatcccaagtgc

SEQ ID NO: 765780 - DNA, 25 bp, Mus musculus
tcagatctgaaactcaacggacccc

SEQ ID NO: 765781 - DNA, 25 bp, Mus musculus
tcagatctgaaagtcaacggacccc

SEQ ID NO: 765782 - DNA, 25 bp, Mus musculus
tcagatctgctgaccagagcaaggg

SEQ ID NO: 765783 - DNA, 25 bp, Mus musculus
tcagatctgctgtccagagcaaggg

SEQ ID NO: 765784 - DNA, 25 bp, Mus musculus
tcagatctgggaaagcagcccagga

SEQ ID NO: 765785 - DNA, 25 bp, Mus musculus
tcagatctgggatagcagcccagga

SEQ ID NO: 765786 - DNA, 25 bp, Mus musculus
tcagatctggtcctgcgttgcggcc

SEQ ID NO: 765787 - DNA, 25 bp, Mus musculus
tcagatctggtcgtgcgttgcggcc

SEQ ID NO: 765788 - DNA, 25 bp, Mus musculus
tcagatctgtacagagagtgagaag

SEQ ID NO: 765789 - DNA, 25 bp, Mus musculus
tcagatctgtactgagagtgagaag

SEQ ID NO: 765790 - DNA, 25 bp, Mus musculus
tcagatctgtggcaagtcctcatgg

SEQ ID NO: 765791 - DNA, 25 bp, Mus musculus
tcagatctgtgggaagtcctcatgg

SEQ ID NO: 765792 - DNA, 25 bp, Mus musculus
tcagatgaaacccaaatccatacca

SEQ ID NO: 765793 - DNA, 25 bp, Mus musculus
tcagatgaaaccgaaatccatacca

SEQ ID NO: 765794 - DNA, 25 bp, Mus musculus
tcagatgaccctagggatgataaca

SEQ ID NO: 765795 - DNA, 25 bp, Mus musculus
tcagatgacccttgggatgataaca

SEQ ID NO: 765796 - DNA, 25 bp, Mus musculus
tcagatgacggcaaaagcaaaatca

SEQ ID NO: 765797 - DNA, 25 bp, Mus musculus
tcagatgacggctaaagcaaaatca

SEQ ID NO: 765798 - DNA, 25 bp, Mus musculus
tcagatgagaatcatgccaagatcc

SEQ ID NO: 765799 - DNA, 25 bp, Mus musculus
tcagatgagaatgatgccaagatcc

SEQ ID NO: 765800 - DNA, 25 bp, Mus musculus
tcagatgaggacctaaagaaggcct

SEQ ID NO: 765801 - DNA, 25 bp, Mus musculus
tcagatgaggacgtaaagaaggcct

SEQ ID NO: 765802 - DNA, 25 bp, Mus musculus
tcagatgaggagcacaatacgagcc

SEQ ID NO: 765803 - DNA, 25 bp, Mus musculus
tcagatgaggaggacaatacgagcc

SEQ ID NO: 765804 - DNA, 25 bp, Mus musculus
tcagatgaggccagcgcagaagtga

SEQ ID NO: 765805 - DNA, 25 bp, Mus musculus
tcagatgaggcctgcgcagaagtga

SEQ ID NO: 765806 - DNA, 25 bp, Mus musculus
tcagatgagttgacaaggcaccggc

SEQ ID NO: 765807 - DNA, 25 bp, Mus musculus
tcagatgagttgtcaaggcaccggc

SEQ ID NO: 765808 - DNA, 25 bp, Mus musculus
tcagatgatggcaacatcaagatct

SEQ ID NO: 765809 - DNA, 25 bp, Mus musculus
tcagatgatggctacatcaagatct

SEQ ID NO: 765810 - DNA, 25 bp, Mus musculus
tcagatgatgttccatgcgcactgg

SEQ ID NO: 765811 - DNA, 25 bp, Mus musculus
tcagatgatgttgcatgcgcactgg

SEQ ID NO: 765812 - DNA, 25 bp, Mus musculus
tcagatgcacgaccgttgttatggg

SEQ ID NO: 765813 - DNA, 25 bp, Mus musculus
tcagatgcacgagcgttgttatggg

SEQ ID NO: 765814 - DNA, 25 bp, Mus musculus
tcagatgcactgacagttgacccca

SEQ ID NO: 765815 - DNA, 25 bp, Mus musculus
tcagatgcactgtcagttgacccca

SEQ ID NO: 765816 - DNA, 25 bp, Mus musculus
tcagatgcagagagagcattcggtg

SEQ ID NO: 765817 - DNA, 25 bp, Mus musculus
tcagatgcagagcacgcgttccctc

SEQ ID NO: 765818 - DNA, 25 bp, Mus musculus
tcagatgcagaggacgcgttccctc

SEQ ID NO: 765819 - DNA, 25 bp, Mus musculus
tcagatgcagagtgagcattcggtg

SEQ ID NO: 765820 - DNA, 25 bp, Mus musculus
tcagatgcctcgcagcgacgtcatc

SEQ ID NO: 765821 - DNA, 25 bp, Mus musculus
tcagatgcctcggagcgacgtcatc

SEQ ID NO: 765822 - DNA, 25 bp, Mus musculus
tcagatgcctggaagaaagaccgaa

SEQ ID NO: 765823 - DNA, 25 bp, Mus musculus
tcagatgcctggtagaaagaccgaa

SEQ ID NO: 765824 - DNA, 25 bp, Mus musculus
tcagatgctaccacggttcagtacc

SEQ ID NO: 765825 - DNA, 25 bp, Mus musculus
tcagatgctacctcggttcagtacc

SEQ ID NO: 765826 - DNA, 25 bp, Mus musculus
tcagatgctgtaaacaccagcagcc

SEQ ID NO: 765827 - DNA, 25 bp, Mus musculus
tcagatgctgtatacaccagcagcc

SEQ ID NO: 765828 - DNA, 25 bp, Mus musculus
tcagatggaaagcaccgcttacagt

SEQ ID NO: 765829 - DNA, 25 bp, Mus musculus
tcagatggaaaggaccgcttacagt

SEQ ID NO: 765830 - DNA, 25 bp, Mus musculus
tcagatggagttagatcatgaaaga

SEQ ID NO: 765831 - DNA, 25 bp, Mus musculus
tcagatggagtttgatcatgaaaga

SEQ ID NO: 765832 - DNA, 25 bp, Mus musculus
tcagatggatgaaggcaaccagtgt

SEQ ID NO: 765833 - DNA, 25 bp, Mus musculus
tcagatggatgatggcaaccagtgt

SEQ ID NO: 765834 - DNA, 25 bp, Mus musculus
tcagatggcaatcgcaggacgtcag

SEQ ID NO: 765835 - DNA, 25 bp, Mus musculus
tcagatggcaatggcaggacgtcag

SEQ ID NO: 765836 - DNA, 25 bp, Mus musculus
tcagatggccccagataattcccag

SEQ ID NO: 765837 - DNA, 25 bp, Mus musculus
tcagatggcccctgataattcccag

SEQ ID NO: 765838 - DNA, 25 bp, Mus musculus
tcagatggctatctggcccacttgg

SEQ ID NO: 765839 - DNA, 25 bp, Mus musculus
tcagatggctatgtggcccacttgg

SEQ ID NO: 765840 - DNA, 25 bp, Mus musculus
tcagatggctcacatgtttcccaca

SEQ ID NO: 765841 - DNA, 25 bp, Mus musculus
tcagatggctcacgcaggtcaacca

SEQ ID NO: 765842 - DNA, 25 bp, Mus musculus
tcagatggctcagatgtttcccaca

SEQ ID NO: 765843 - DNA, 25 bp, Mus musculus
tcagatggctcaggcaggtcaacca

SEQ ID NO: 765844 - DNA, 25 bp, Mus musculus
tcagatggctgcagatcattacaga

SEQ ID NO: 765845 - DNA, 25 bp, Mus musculus
tcagatggctgctgatcattacaga

SEQ ID NO: 765846 - DNA, 25 bp, Mus musculus
tcagatggtccaagtggagtgctaa

SEQ ID NO: 765847 - DNA, 25 bp, Mus musculus
tcagatggtccatgtggagtgctaa

SEQ ID NO: 765848 - DNA, 25 bp, Mus musculus
tcagatggtcggaaatgcccacacc

SEQ ID NO: 765849 - DNA, 25 bp, Mus musculus
tcagatggtcggtaatgcccacacc

SEQ ID NO: 765850 - DNA, 25 bp, Mus musculus
tcagatggtctcaggcctaaggatg

SEQ ID NO: 765851 - DNA, 25 bp, Mus musculus
tcagatggtctctggcctaaggatg

SEQ ID NO: 765852 - DNA, 25 bp, Mus musculus
tcagatgtaccaacgctgggtccca

SEQ ID NO: 765853 - DNA, 25 bp, Mus musculus
tcagatgtaccatcgctgggtccca

SEQ ID NO: 765854 - DNA, 25 bp, Mus musculus
tcagatgtccaacttgatgaatcaa

SEQ ID NO: 765855 - DNA, 25 bp, Mus musculus
tcagatgtccaagttgatgaatcaa

SEQ ID NO: 765856 - DNA, 25 bp, Mus musculus
tcagatgtcctacaagcctgcagta

SEQ ID NO: 765857 - DNA, 25 bp, Mus musculus
tcagatgtcctagaagcctgcagta

SEQ ID NO: 765858 - DNA, 25 bp, Mus musculus
tcagattaaaaacaagaccctgaat

SEQ ID NO: 765859 - DNA, 25 bp, Mus musculus
tcagattaaaaagaagaccctgaat

SEQ ID NO: 765860 - DNA, 25 bp, Mus musculus
tcagattagtcacccaggatgggaa

SEQ ID NO: 765861 - DNA, 25 bp, Mus musculus
tcagattagtcagccaggatgggaa

SEQ ID NO: 765862 - DNA, 25 bp, Mus musculus
tcagattagtctacaccacagccac

SEQ ID NO: 765863 - DNA, 25 bp, Mus musculus
tcagattagtcttcaccacagccac

SEQ ID NO: 765864 - DNA, 25 bp, Mus musculus
tcagattagttgaagacaagccagg

SEQ ID NO: 765865 - DNA, 25 bp, Mus musculus
tcagattagttgtagacaagccagg

SEQ ID NO: 765866 - DNA, 25 bp, Mus musculus
tcagattcaggacgagacttgccag

SEQ ID NO: 765867 - DNA, 25 bp, Mus musculus
tcagattcaggaggagacttgccag

SEQ ID NO: 765868 - DNA, 25 bp, Mus musculus
tcagattccagcacctcgtcgtcat

SEQ ID NO: 765869 - DNA, 25 bp, Mus musculus
tcagattccagctcctcgtcgtcat

SEQ ID NO: 765870 - DNA, 25 bp, Mus musculus
tcagattcccaaccaacaagagctc

SEQ ID NO: 765871 - DNA, 25 bp, Mus musculus
tcagattcccaagcaacaagagctc

SEQ ID NO: 765872 - DNA, 25 bp, Mus musculus
tcagattctcggagataattttcca

SEQ ID NO: 765873 - DNA, 25 bp, Mus musculus
tcagattctcggtgataattttcca

SEQ ID NO: 765874 - DNA, 25 bp, Mus musculus
tcagattctgcacgaccatttgcag

SEQ ID NO: 765875 - DNA, 25 bp, Mus musculus
tcagattctgcaggaccatttgcag

SEQ ID NO: 765876 - DNA, 25 bp, Mus musculus
tcagattctggcactgagaagtggc

SEQ ID NO: 765877 - DNA, 25 bp, Mus musculus
tcagattctggctctgagaagtggc

SEQ ID NO: 765878 - DNA, 25 bp, Mus musculus
tcagattcttatctgaatcccacag

SEQ ID NO: 765879 - DNA, 25 bp, Mus musculus
tcagattcttatgtgaatcccacag

SEQ ID NO: 765880 - DNA, 25 bp, Mus musculus
tcagattgagcaatactccatggat

SEQ ID NO: 765881 - DNA, 25 bp, Mus musculus
tcagattgagcattactccatggat

SEQ ID NO: 765882 - DNA, 25 bp, Mus musculus
tcagattgatggagttaccgaagac

SEQ ID NO: 765883 - DNA, 25 bp, Mus musculus
tcagattgatggtgttaccgaagac

SEQ ID NO: 765884 - DNA, 25 bp, Mus musculus
tcagattggcctcacacgagagagt

SEQ ID NO: 765885 - DNA, 25 bp, Mus musculus
tcagattggcctgacacgagagagt

SEQ ID NO: 765886 - DNA, 25 bp, Mus musculus
tcagatttccgacttcttgtttcag

SEQ ID NO: 765887 - DNA, 25 bp, Mus musculus
tcagatttccgagttcttgtttcag

SEQ ID NO: 765888 - DNA, 25 bp, Mus musculus
tcagatttgtgacgagcacgcggca

SEQ ID NO: 765889 - DNA, 25 bp, Mus musculus
tcagatttgtgaggagcacgcggca

SEQ ID NO: 765890 - DNA, 25 bp, Mus musculus
tcagattttgctctctgcagcagtg

SEQ ID NO: 765891 - DNA, 25 bp, Mus musculus
tcagattttgctgtctgcagcagtg

SEQ ID NO: 765892 - DNA, 25 bp, Mus musculus
tcagattttggcacttccaaggagc

SEQ ID NO: 765893 - DNA, 25 bp, Mus musculus
tcagattttggctcttccaaggagc

SEQ ID NO: 765894 - DNA, 25 bp, Mus musculus
tcagcaaacatcattcgcgttggag

SEQ ID NO: 765895 - DNA, 25 bp, Mus musculus
tcagcaaacatctttcgcgttggag

SEQ ID NO: 765896 - DNA, 25 bp, Mus musculus
tcagcaaacatgcaccattggcagc

SEQ ID NO: 765897 - DNA, 25 bp, Mus musculus
tcagcaaacatggaccattggcagc

SEQ ID NO: 765898 - DNA, 25 bp, Mus musculus
tcagcaaagagaatctgacgattag

SEQ ID NO: 765899 - DNA, 25 bp, Mus musculus
tcagcaaagagattctgacgattag

SEQ ID NO: 765900 - DNA, 25 bp, Mus musculus
tcagcaaaggagatcggctgggaaa

SEQ ID NO: 765901 - DNA, 25 bp, Mus musculus
tcagcaaaggagttcggctgggaaa

SEQ ID NO: 765902 - DNA, 25 bp, Mus musculus
tcagcaaaggccagatcatcaacgt

SEQ ID NO: 765903 - DNA, 25 bp, Mus musculus
tcagcaaaggcctgatcatcaacgt

SEQ ID NO: 765904 - DNA, 25 bp, Mus musculus
tcagcaacaaacagaagaaactcct

SEQ ID NO: 765905 - DNA, 25 bp, Mus musculus
tcagcaacaaactgaagaaactcct

SEQ ID NO: 765906 - DNA, 25 bp, Mus musculus
tcagcaacaaatatttagcgatgtc

SEQ ID NO: 765907 - DNA, 25 bp, Mus musculus
tcagcaacaaatttttagcgatgtc

SEQ ID NO: 765908 - DNA, 25 bp, Mus musculus
tcagcaacaagacaatagtgggctg

SEQ ID NO: 765909 - DNA, 25 bp, Mus musculus
tcagcaacaagagaatagtgggctg

SEQ ID NO: 765910 - DNA, 25 bp, Mus musculus
tcagcaacccttctgagaaggtctt

SEQ ID NO: 765911 - DNA, 25 bp, Mus musculus
tcagcaacccttgtgagaaggtctt

SEQ ID NO: 765912 - DNA, 25 bp, Mus musculus
tcagcaaccgctcgaagctggccag

SEQ ID NO: 765913 - DNA, 25 bp, Mus musculus
tcagcaaccgctggaagctggccag

SEQ ID NO: 765914 - DNA, 25 bp, Mus musculus
tcagcaacctccaaggtgaggatct

SEQ ID NO: 765915 - DNA, 25 bp, Mus musculus
tcagcaacctcctaggtgaggatct

SEQ ID NO: 765916 - DNA, 25 bp, Mus musculus
tcagcaacggtgcacatccaggtgg

SEQ ID NO: 765917 - DNA, 25 bp, Mus musculus
tcagcaacggtggacatccaggtgg

SEQ ID NO: 765918 - DNA, 25 bp, Mus musculus
tcagcaactacactcgagggagcgg

SEQ ID NO: 765919 - DNA, 25 bp, Mus musculus
tcagcaactacagtcgagggagcgg

SEQ ID NO: 765920 - DNA, 25 bp, Mus musculus
tcagcaactcttacccgaagatctt

SEQ ID NO: 765921 - DNA, 25 bp, Mus musculus
tcagcaactctttcccgaagatctt

SEQ ID NO: 765922 - DNA, 25 bp, Mus musculus
tcagcaactgaaagaggccagcgtg

SEQ ID NO: 765923 - DNA, 25 bp, Mus musculus
tcagcaactgaatgaggccagcgtg

SEQ ID NO: 765924 - DNA, 25 bp, Mus musculus
tcagcaactgcacaagatcctctct

SEQ ID NO: 765925 - DNA, 25 bp, Mus musculus
tcagcaactgcagaagatcctctct

SEQ ID NO: 765926 - DNA, 25 bp, Mus musculus
tcagcaactgccacatttgctcaag

SEQ ID NO: 765927 - DNA, 25 bp, Mus musculus
tcagcaactgcctcatttgctcaag

SEQ ID NO: 765928 - DNA, 25 bp, Mus musculus
tcagcaacttcaatcccactacatg

SEQ ID NO: 765929 - DNA, 25 bp, Mus musculus
tcagcaacttcattcccactacatg

SEQ ID NO: 765930 - DNA, 25 bp, Mus musculus
tcagcaagacgccaggcgcgcttgc

SEQ ID NO: 765931 - DNA, 25 bp, Mus musculus
tcagcaagacgcgaggcgcgcttgc

SEQ ID NO: 765932 - DNA, 25 bp, Mus musculus
tcagcaagaggaaagcaacatcggg

SEQ ID NO: 765933 - DNA, 25 bp, Mus musculus
tcagcaagaggatagcaacatcggg

SEQ ID NO: 765934 - DNA, 25 bp, Mus musculus
tcagcaagagggaaagacttgtgtt

SEQ ID NO: 765935 - DNA, 25 bp, Mus musculus
tcagcaagagggtaagacttgtgtt

SEQ ID NO: 765936 - DNA, 25 bp, Mus musculus
tcagcaagagtgacgtgaagtcact

SEQ ID NO: 765937 - DNA, 25 bp, Mus musculus
tcagcaagagtgtcgtgaagtcact

SEQ ID NO: 765938 - DNA, 25 bp, Mus musculus
tcagcaagatctcgacagagagctt

SEQ ID NO: 765939 - DNA, 25 bp, Mus musculus
tcagcaagatctggacagagagctt

SEQ ID NO: 765940 - DNA, 25 bp, Mus musculus
tcagcaagatgtcgagatggcaatt

SEQ ID NO: 765941 - DNA, 25 bp, Mus musculus
tcagcaagatgtggagatggcaatt

SEQ ID NO: 765942 - DNA, 25 bp, Mus musculus
tcagcaagcaaaagccagggacacc

SEQ ID NO: 765943 - DNA, 25 bp, Mus musculus
tcagcaagcaaacatgtcggaagat

SEQ ID NO: 765944 - DNA, 25 bp, Mus musculus
tcagcaagcaaagatgtcggaagat

SEQ ID NO: 765945 - DNA, 25 bp, Mus musculus
tcagcaagcaaatgccagggacacc

SEQ ID NO: 765946 - DNA, 25 bp, Mus musculus
tcagcaagcaagcacgggcgcttct

SEQ ID NO: 765947 - DNA, 25 bp, Mus musculus
tcagcaagcaaggacgggcgcttct

SEQ ID NO: 765948 - DNA, 25 bp, Mus musculus
tcagcaagcaccaataccgccgtat

SEQ ID NO: 765949 - DNA, 25 bp, Mus musculus
tcagcaagcacctataccgccgtat

SEQ ID NO: 765950 - DNA, 25 bp, Mus musculus
tcagcaagcactatcgctgctccag

SEQ ID NO: 765951 - DNA, 25 bp, Mus musculus
tcagcaagcactttcgctgctccag

SEQ ID NO: 765952 - DNA, 25 bp, Mus musculus
tcagcaagcattcaagattcagccg

SEQ ID NO: 765953 - DNA, 25 bp, Mus musculus
tcagcaagcattgaagattcagccg

SEQ ID NO: 765954 - DNA, 25 bp, Mus musculus
tcagcaagcccgataagcatgaagc

SEQ ID NO: 765955 - DNA, 25 bp, Mus musculus
tcagcaagcccgttaagcatgaagc

SEQ ID NO: 765956 - DNA, 25 bp, Mus musculus
tcagcaagccctacagcctctttga

SEQ ID NO: 765957 - DNA, 25 bp, Mus musculus
tcagcaagcccttcagcctctttga

SEQ ID NO: 765958 - DNA, 25 bp, Mus musculus
tcagcaagcgctcgcggcaaattga

SEQ ID NO: 765959 - DNA, 25 bp, Mus musculus
tcagcaagcgctggcggcaaattga

SEQ ID NO: 765960 - DNA, 25 bp, Mus musculus
tcagcaagcggcaccgggccttggt

SEQ ID NO: 765961 - DNA, 25 bp, Mus musculus
tcagcaagcggctccgggccttggt

SEQ ID NO: 765962 - DNA, 25 bp, Mus musculus
tcagcaagctatcagaaggaaaagg

SEQ ID NO: 765963 - DNA, 25 bp, Mus musculus
tcagcaagctatgagaaggaaaagg

SEQ ID NO: 765964 - DNA, 25 bp, Mus musculus
tcagcaagctgtcatggatgatgat

SEQ ID NO: 765965 - DNA, 25 bp, Mus musculus
tcagcaagctgtgatggatgatgat

SEQ ID NO: 765966 - DNA, 25 bp, Mus musculus
tcagcaaggcaaaacagcaaataag

SEQ ID NO: 765967 - DNA, 25 bp, Mus musculus
tcagcaaggcaaagcagcaaccaag

SEQ ID NO: 765968 - DNA, 25 bp, Mus musculus
tcagcaaggcaatacagcaaataag

SEQ ID NO: 765969 - DNA, 25 bp, Mus musculus
tcagcaaggcaatgcagcaaccaag

SEQ ID NO: 765970 - DNA, 25 bp, Mus musculus
tcagcaaggtgaacgtaatagaacc

SEQ ID NO: 765971 - DNA, 25 bp, Mus musculus
tcagcaaggtgatcgtaatagaacc

SEQ ID NO: 765972 - DNA, 25 bp, Mus musculus
tcagcaaggtttccacgagtgcagc

SEQ ID NO: 765973 - DNA, 25 bp, Mus musculus
tcagcaaggtttgcacgagtgcagc

SEQ ID NO: 765974 - DNA, 25 bp, Mus musculus
tcagcaagtaaactgagggtatggc

SEQ ID NO: 765975 - DNA, 25 bp, Mus musculus
tcagcaagtaaagtgagggtatggc

SEQ ID NO: 765976 - DNA, 25 bp, Mus musculus
tcagcaagttttcgagcaaagacag

SEQ ID NO: 765977 - DNA, 25 bp, Mus musculus
tcagcaagttttggagcaaagacag

SEQ ID NO: 765978 - DNA, 25 bp, Mus musculus
tcagcaatacccagatcattagcaa

SEQ ID NO: 765979 - DNA, 25 bp, Mus musculus
tcagcaataccctgatcattagcaa

SEQ ID NO: 765980 - DNA, 25 bp, Mus musculus
tcagcaatgcttaccatgagttagc

SEQ ID NO: 765981 - DNA, 25 bp, Mus musculus
tcagcaatgctttccatgagttagc

SEQ ID NO: 765982 - DNA, 25 bp, Mus musculus
tcagcaatgggcagagggactttgc

SEQ ID NO: 765983 - DNA, 25 bp, Mus musculus
tcagcaatgggctgagggactttgc

SEQ ID NO: 765984 - DNA, 25 bp, Mus musculus
tcagcaatgtctagccgactgtggg

SEQ ID NO: 765985 - DNA, 25 bp, Mus musculus
tcagcaatgtcttgccgactgtggg

SEQ ID NO: 765986 - DNA, 25 bp, Mus musculus
tcagcaatgtgtcttccacgggcag

SEQ ID NO: 765987 - DNA, 25 bp, Mus musculus
tcagcaatgtgtgttccacgggcag

SEQ ID NO: 765988 - DNA, 25 bp, Mus musculus
tcagcaattcccagtagacccaaga

SEQ ID NO: 765989 - DNA, 25 bp, Mus musculus
tcagcaattccctgtagacccaaga

SEQ ID NO: 765990 - DNA, 25 bp, Mus musculus
tcagcacaagcaccaaggtgaggaa

SEQ ID NO: 765991 - DNA, 25 bp, Mus musculus
tcagcacaagcagcaaggtgaggaa

SEQ ID NO: 765992 - DNA, 25 bp, Mus musculus
tcagcacaagctaggctttagtctt

SEQ ID NO: 765993 - DNA, 25 bp, Mus musculus
tcagcacaagcttggctttagtctt

SEQ ID NO: 765994 - DNA, 25 bp, Mus musculus
tcagcacaccagctaggaaggagga

SEQ ID NO: 765995 - DNA, 25 bp, Mus musculus
tcagcacaccaggtaggaaggagga

SEQ ID NO: 765996 - DNA, 25 bp, Mus musculus
tcagcacaccgtctaagaatgctgg

SEQ ID NO: 765997 - DNA, 25 bp, Mus musculus
tcagcacaccgtgtaagaatgctgg

SEQ ID NO: 765998 - DNA, 25 bp, Mus musculus
tcagcacacgatcgaaacgtacagg

SEQ ID NO: 765999 - DNA, 25 bp, Mus musculus
tcagcacacgatggaaacgtacagg

SEQ ID NO: 766000 - DNA, 25 bp, Mus musculus
tcagcacactgaacggcttgagact

SEQ ID NO: 766001 - DNA, 25 bp, Mus musculus
tcagcacactgatcggcttgagact

SEQ ID NO: 766002 - DNA, 25 bp, Mus musculus
tcagcacagacactggcgagcatct

SEQ ID NO: 766003 - DNA, 25 bp, Mus musculus
tcagcacagacagtggcgagcatct

SEQ ID NO: 766004 - DNA, 25 bp, Mus musculus
tcagcacagaggctactgaagtcag

SEQ ID NO: 766005 - DNA, 25 bp, Mus musculus
tcagcacagagggtactgaagtcag

SEQ ID NO: 766006 - DNA, 25 bp, Mus musculus
tcagcacagcttcgactggtgacgg

SEQ ID NO: 766007 - DNA, 25 bp, Mus musculus
tcagcacagcttggactggtgacgg

SEQ ID NO: 766008 - DNA, 25 bp, Mus musculus
tcagcacaggctacatctgctttga

SEQ ID NO: 766009 - DNA, 25 bp, Mus musculus
tcagcacaggcttcatctgctttga

SEQ ID NO: 766010 - DNA, 25 bp, Mus musculus
tcagcacagttcctgaggtggcctt

SEQ ID NO: 766011 - DNA, 25 bp, Mus musculus
tcagcacagttcgtgaggtggcctt

SEQ ID NO: 766012 - DNA, 25 bp, Mus musculus
tcagcacatattagaggatgaccct

SEQ ID NO: 766013 - DNA, 25 bp, Mus musculus
tcagcacatatttgaggatgaccct

SEQ ID NO: 766014 - DNA, 25 bp, Mus musculus
tcagcacattggagaagctttgggt

SEQ ID NO: 766015 - DNA, 25 bp, Mus musculus
tcagcacattggtgaagctttgggt

SEQ ID NO: 766016 - DNA, 25 bp, Mus musculus
tcagcaccacaaatccactctaggt

SEQ ID NO: 766017 - DNA, 25 bp, Mus musculus
tcagcaccacaattccactctaggt

SEQ ID NO: 766018 - DNA, 25 bp, Mus musculus
tcagcaccagggagcttgttagttc

SEQ ID NO: 766019 - DNA, 25 bp, Mus musculus
tcagcaccagggtgcttgttagttc

SEQ ID NO: 766020 - DNA, 25 bp, Mus musculus
tcagcaccagtgctcatggagaaaa

SEQ ID NO: 766021 - DNA, 25 bp, Mus musculus
tcagcaccagtggtcatggagaaaa

SEQ ID NO: 766022 - DNA, 25 bp, Mus musculus
tcagcacccgcaacgagaatcagaa

SEQ ID NO: 766023 - DNA, 25 bp, Mus musculus
tcagcacccgcatcgagaatcagaa

SEQ ID NO: 766024 - DNA, 25 bp, Mus musculus
tcagcaccgaaaaggagatcctgcc

SEQ ID NO: 766025 - DNA, 25 bp, Mus musculus
tcagcaccgaaatggagatcctgcc

SEQ ID NO: 766026 - DNA, 25 bp, Mus musculus
tcagcacctcggcatgacgaaatgc

SEQ ID NO: 766027 - DNA, 25 bp, Mus musculus
tcagcacctcgggatgacgaaatgc

SEQ ID NO: 766028 - DNA, 25 bp, Mus musculus
tcagcacctgctattaggacatcac

SEQ ID NO: 766029 - DNA, 25 bp, Mus musculus
tcagcacctgcttttaggacatcac

SEQ ID NO: 766030 - DNA, 25 bp, Mus musculus
tcagcacctgtgcaggaagtacggt

SEQ ID NO: 766031 - DNA, 25 bp, Mus musculus
tcagcacctgtggaggaagtacggt

SEQ ID NO: 766032 - DNA, 25 bp, Mus musculus
tcagcacgcatgcatgttgcttaga

SEQ ID NO: 766033 - DNA, 25 bp, Mus musculus
tcagcacgcatggatgttgcttaga

SEQ ID NO: 766034 - DNA, 25 bp, Mus musculus
tcagcacgctaacagccgctgtcaa

SEQ ID NO: 766035 - DNA, 25 bp, Mus musculus
tcagcacgctaagagccgctgtcaa

SEQ ID NO: 766036 - DNA, 25 bp, Mus musculus
tcagcacgctggaggcactctacat

SEQ ID NO: 766037 - DNA, 25 bp, Mus musculus
tcagcacgctggtggcactctacat

SEQ ID NO: 766038 - DNA, 25 bp, Mus musculus
tcagcacgggcaagttctgctcatc

SEQ ID NO: 766039 - DNA, 25 bp, Mus musculus
tcagcacgggcatgttctgctcatc

SEQ ID NO: 766040 - DNA, 25 bp, Mus musculus
tcagcacgggcgaagatggatgtct

SEQ ID NO: 766041 - DNA, 25 bp, Mus musculus
tcagcacgggcgtagatggatgtct

SEQ ID NO: 766042 - DNA, 25 bp, Mus musculus
tcagcacgggttcatgatgctcctg

SEQ ID NO: 766043 - DNA, 25 bp, Mus musculus
tcagcacgggttgatgatgctcctg

SEQ ID NO: 766044 - DNA, 25 bp, Mus musculus
tcagcactcctgagaagatacagca

SEQ ID NO: 766045 - DNA, 25 bp, Mus musculus
tcagcactcctgtgaagatacagca

SEQ ID NO: 766046 - DNA, 25 bp, Mus musculus
tcagcactgggcactgtacttgggt

SEQ ID NO: 766047 - DNA, 25 bp, Mus musculus
tcagcactgggctctgtacttgggt

SEQ ID NO: 766048 - DNA, 25 bp, Mus musculus
tcagcacttgcgaggagtccctgga

SEQ ID NO: 766049 - DNA, 25 bp, Mus musculus
tcagcacttgcgtggagtccctgga

SEQ ID NO: 766050 - DNA, 25 bp, Mus musculus
tcagcagaaaatatgcatcagttat

SEQ ID NO: 766051 - DNA, 25 bp, Mus musculus
tcagcagaaaatttgcatcagttat

SEQ ID NO: 766052 - DNA, 25 bp, Mus musculus
tcagcagaagtaaaagcccggattc

SEQ ID NO: 766053 - DNA, 25 bp, Mus musculus
tcagcagaagtataagcccggattc

SEQ ID NO: 766054 - DNA, 25 bp, Mus musculus
tcagcagaatgaagaccaaacccat

SEQ ID NO: 766055 - DNA, 25 bp, Mus musculus
tcagcagaatgatgaccaaacccat

SEQ ID NO: 766056 - DNA, 25 bp, Mus musculus
tcagcagacgccagacaagccatct

SEQ ID NO: 766057 - DNA, 25 bp, Mus musculus
tcagcagacgcctgacaagccatct

SEQ ID NO: 766058 - DNA, 25 bp, Mus musculus
tcagcagagcatcatacgggagctc

SEQ ID NO: 766059 - DNA, 25 bp, Mus musculus
tcagcagagcatgatacgggagctc

SEQ ID NO: 766060 - DNA, 25 bp, Mus musculus
tcagcagagggcatggtttcccact

SEQ ID NO: 766061 - DNA, 25 bp, Mus musculus
tcagcagagggcttggtttcccact

SEQ ID NO: 766062 - DNA, 25 bp, Mus musculus
tcagcagaggttcgctgtgatcctg

SEQ ID NO: 766063 - DNA, 25 bp, Mus musculus
tcagcagaggttggctgtgatcctg

SEQ ID NO: 766064 - DNA, 25 bp, Mus musculus
tcagcagagtggaaccagcagacag

SEQ ID NO: 766065 - DNA, 25 bp, Mus musculus
tcagcagagtggtaccagcagacag

SEQ ID NO: 766066 - DNA, 25 bp, Mus musculus
tcagcagatacaactatctgagtct

SEQ ID NO: 766067 - DNA, 25 bp, Mus musculus
tcagcagatacatctatctgagtct

SEQ ID NO: 766068 - DNA, 25 bp, Mus musculus
tcagcagataccagaacaaccaaat

SEQ ID NO: 766069 - DNA, 25 bp, Mus musculus
tcagcagatacctgaacaaccaaat

SEQ ID NO: 766070 - DNA, 25 bp, Mus musculus
tcagcagatctgagagcgctaccct

SEQ ID NO: 766071 - DNA, 25 bp, Mus musculus
tcagcagatctgtgagcgctaccct

SEQ ID NO: 766072 - DNA, 25 bp, Mus musculus
tcagcagcactgacgcgggcttgtt

SEQ ID NO: 766073 - DNA, 25 bp, Mus musculus
tcagcagcactgtcgcgggcttgtt

SEQ ID NO: 766074 - DNA, 25 bp, Mus musculus
tcagcagcagtaactgagacctgtt

SEQ ID NO: 766075 - DNA, 25 bp, Mus musculus
tcagcagcagtatctgagacctgtt

SEQ ID NO: 766076 - DNA, 25 bp, Mus musculus
tcagcagcatgacaactcagggccc

SEQ ID NO: 766077 - DNA, 25 bp, Mus musculus
tcagcagcatgagaactcagggccc

SEQ ID NO: 766078 - DNA, 25 bp, Mus musculus
tcagcagccaaccaccctgtgtttg

SEQ ID NO: 766079 - DNA, 25 bp, Mus musculus
tcagcagccaacgaccctgtgtttg

SEQ ID NO: 766080 - DNA, 25 bp, Mus musculus
tcagcagcccctacagtgcgtggca

SEQ ID NO: 766081 - DNA, 25 bp, Mus musculus
tcagcagccccttcagtgcgtggca

SEQ ID NO: 766082 - DNA, 25 bp, Mus musculus
tcagcagcctccacaaagagaagga

SEQ ID NO: 766083 - DNA, 25 bp, Mus musculus
tcagcagcctcctcaaagagaagga

SEQ ID NO: 766084 - DNA, 25 bp, Mus musculus
tcagcagcgtttaccagatctttgc

SEQ ID NO: 766085 - DNA, 25 bp, Mus musculus
tcagcagcgttttccagatctttgc

SEQ ID NO: 766086 - DNA, 25 bp, Mus musculus
tcagcagctcagaggattcggacac

SEQ ID NO: 766087 - DNA, 25 bp, Mus musculus
tcagcagctcagtggattcggacac

SEQ ID NO: 766088 - DNA, 25 bp, Mus musculus
tcagcagctctaccctacctgatga

SEQ ID NO: 766089 - DNA, 25 bp, Mus musculus
tcagcagctctagcctacctgatga

SEQ ID NO: 766090 - DNA, 25 bp, Mus musculus
tcagcagctgaaataccactctccg

SEQ ID NO: 766091 - DNA, 25 bp, Mus musculus
tcagcagctgaattaccactctccg

SEQ ID NO: 766092 - DNA, 25 bp, Mus musculus
tcagcagctgctcggaattccctgt

SEQ ID NO: 766093 - DNA, 25 bp, Mus musculus
tcagcagctgctgggaattccctgt

SEQ ID NO: 766094 - DNA, 25 bp, Mus musculus
tcagcagcttaactgggactcactc

SEQ ID NO: 766095 - DNA, 25 bp, Mus musculus
tcagcagcttaagtgggactcactc

SEQ ID NO: 766096 - DNA, 25 bp, Mus musculus
tcagcagctttcacaaggcatgtgg

SEQ ID NO: 766097 - DNA, 25 bp, Mus musculus
tcagcagctttctcaaggcatgtgg

SEQ ID NO: 766098 - DNA, 25 bp, Mus musculus
tcagcaggaaacctacttaagaagc

SEQ ID NO: 766099 - DNA, 25 bp, Mus musculus
tcagcaggaaacgtacttaagaagc

SEQ ID NO: 766100 - DNA, 25 bp, Mus musculus
tcagcaggacgaagagatacgcttg

SEQ ID NO: 766101 - DNA, 25 bp, Mus musculus
tcagcaggacgatgagatacgcttg

SEQ ID NO: 766102 - DNA, 25 bp, Mus musculus
tcagcaggacgcagcgcacaacatg

SEQ ID NO: 766103 - DNA, 25 bp, Mus musculus
tcagcaggacgctgcgcacaacatg

SEQ ID NO: 766104 - DNA, 25 bp, Mus musculus
tcagcaggattcagggattcaacat

SEQ ID NO: 766105 - DNA, 25 bp, Mus musculus
tcagcaggattctgggattcaacat

SEQ ID NO: 766106 - DNA, 25 bp, Mus musculus
tcagcaggcgcacacaaaggcggct

SEQ ID NO: 766107 - DNA, 25 bp, Mus musculus
tcagcaggcgcagacaaaggcggct

SEQ ID NO: 766108 - DNA, 25 bp, Mus musculus
tcagcaggctatcaggaatgtccag

SEQ ID NO: 766109 - DNA, 25 bp, Mus musculus
tcagcaggctatgaggaatgtccag

SEQ ID NO: 766110 - DNA, 25 bp, Mus musculus
tcagcagggccgacttaaagggaat

SEQ ID NO: 766111 - DNA, 25 bp, Mus musculus
tcagcagggccgtcttaaagggaat

SEQ ID NO: 766112 - DNA, 25 bp, Mus musculus
tcagcagggtggatactggacacat

SEQ ID NO: 766113 - DNA, 25 bp, Mus musculus
tcagcagggtggttactggacacat

SEQ ID NO: 766114 - DNA, 25 bp, Mus musculus
tcagcaggtaaaagaggagctgccc

SEQ ID NO: 766115 - DNA, 25 bp, Mus musculus
tcagcaggtaaatgaggagctgccc

SEQ ID NO: 766116 - DNA, 25 bp, Mus musculus
tcagcaggttgcagtgcagtcaggc

SEQ ID NO: 766117 - DNA, 25 bp, Mus musculus
tcagcaggttgctgtgcagtcaggc

SEQ ID NO: 766118 - DNA, 25 bp, Mus musculus
tcagcagtaggcattcagagagacc

SEQ ID NO: 766119 - DNA, 25 bp, Mus musculus
tcagcagtaggctttcagagagacc

SEQ ID NO: 766120 - DNA, 25 bp, Mus musculus
tcagcagtatgcacatcctaatgcc

SEQ ID NO: 766121 - DNA, 25 bp, Mus musculus
tcagcagtatgctcatcctaatgcc

SEQ ID NO: 766122 - DNA, 25 bp, Mus musculus
tcagcagtcaagaacctcatggcct

SEQ ID NO: 766123 - DNA, 25 bp, Mus musculus
tcagcagtcaagtacctcatggcct

SEQ ID NO: 766124 - DNA, 25 bp, Mus musculus
tcagcagtcagcacagatctccaaa

SEQ ID NO: 766125 - DNA, 25 bp, Mus musculus
tcagcagtcagctcagatctccaaa

SEQ ID NO: 766126 - DNA, 25 bp, Mus musculus
tcagcagtgcacatgctgttgagat

SEQ ID NO: 766127 - DNA, 25 bp, Mus musculus
tcagcagtgcacttgctgttgagat

SEQ ID NO: 766128 - DNA, 25 bp, Mus musculus
tcagcagtgcccatcggagttcgag

SEQ ID NO: 766129 - DNA, 25 bp, Mus musculus
tcagcagtgcccttcggagttcgag

SEQ ID NO: 766130 - DNA, 25 bp, Mus musculus
tcagcagtggtgatgctcattccca

SEQ ID NO: 766131 - DNA, 25 bp, Mus musculus
tcagcagtggtgttgctcattccca

SEQ ID NO: 766132 - DNA, 25 bp, Mus musculus
tcagcagtgtcaaggaccgcaagaa

SEQ ID NO: 766133 - DNA, 25 bp, Mus musculus
tcagcagtgtcatggaccgcaagaa

SEQ ID NO: 766134 - DNA, 25 bp, Mus musculus
tcagcagttgacagctgcccagcag

SEQ ID NO: 766135 - DNA, 25 bp, Mus musculus
tcagcagttgactgctgcccagcag

SEQ ID NO: 766136 - DNA, 25 bp, Mus musculus
tcagcagtttgaaggagcccctgtg

SEQ ID NO: 766137 - DNA, 25 bp, Mus musculus
tcagcagtttgatggagcccctgtg

SEQ ID NO: 766138 - DNA, 25 bp, Mus musculus
tcagcagtttggctatcagcgccgg

SEQ ID NO: 766139 - DNA, 25 bp, Mus musculus
tcagcagtttgggtatcagcgccgg

SEQ ID NO: 766140 - DNA, 25 bp, Mus musculus
tcagcataagcaaggacacagctgt

SEQ ID NO: 766141 - DNA, 25 bp, Mus musculus
tcagcataagcatggacacagctgt

SEQ ID NO: 766142 - DNA, 25 bp, Mus musculus
tcagcatacagaagaatcagagctt

SEQ ID NO: 766143 - DNA, 25 bp, Mus musculus
tcagcatacagatgaatcagagctt

SEQ ID NO: 766144 - DNA, 25 bp, Mus musculus
tcagcatagctgagataaactcttc

SEQ ID NO: 766145 - DNA, 25 bp, Mus musculus
tcagcatagctgtgataaactcttc

SEQ ID NO: 766146 - DNA, 25 bp, Mus musculus
tcagcatcagatatacacattgaca

SEQ ID NO: 766147 - DNA, 25 bp, Mus musculus
tcagcatcagatttacacattgaca

SEQ ID NO: 766148 - DNA, 25 bp, Mus musculus
tcagcatccgagcttcgtgcgaggc

SEQ ID NO: 766149 - DNA, 25 bp, Mus musculus
tcagcatccgaggttcgtgcgaggc

SEQ ID NO: 766150 - DNA, 25 bp, Mus musculus
tcagcatccgggagctggatccctt

SEQ ID NO: 766151 - DNA, 25 bp, Mus musculus
tcagcatccgggtgctggatccctt

SEQ ID NO: 766152 - DNA, 25 bp, Mus musculus
tcagcatcgaatctttgaacccacg

SEQ ID NO: 766153 - DNA, 25 bp, Mus musculus
tcagcatcgaatgtttgaacccacg

SEQ ID NO: 766154 - DNA, 25 bp, Mus musculus
tcagcatcgtatcccagttcggaca

SEQ ID NO: 766155 - DNA, 25 bp, Mus musculus
tcagcatcgtatgccagttcggaca

SEQ ID NO: 766156 - DNA, 25 bp, Mus musculus
tcagcatctcagcttgaccaagcgc

SEQ ID NO: 766157 - DNA, 25 bp, Mus musculus
tcagcatctcaggttgaccaagcgc

SEQ ID NO: 766158 - DNA, 25 bp, Mus musculus
tcagcatctgctacgcaagctaggg

SEQ ID NO: 766159 - DNA, 25 bp, Mus musculus
tcagcatctgcttcgcaagctaggg

SEQ ID NO: 766160 - DNA, 25 bp, Mus musculus
tcagcatcttggaacaagagtgagg

SEQ ID NO: 766161 - DNA, 25 bp, Mus musculus
tcagcatcttggacaacgggctgcg

SEQ ID NO: 766162 - DNA, 25 bp, Mus musculus
tcagcatcttggtacaagagtgagg

SEQ ID NO: 766163 - DNA, 25 bp, Mus musculus
tcagcatcttggtcaacgggctgcg

SEQ ID NO: 766164 - DNA, 25 bp, Mus musculus
tcagcatgactgatatagacctcac

SEQ ID NO: 766165 - DNA, 25 bp, Mus musculus
tcagcatgactgttatagacctcac

SEQ ID NO: 766166 - DNA, 25 bp, Mus musculus
tcagcatgacttacatatgggcttt

SEQ ID NO: 766167 - DNA, 25 bp, Mus musculus
tcagcatgactttcatatgggcttt

SEQ ID NO: 766168 - DNA, 25 bp, Mus musculus
tcagcatgagaacattgaattggtt

SEQ ID NO: 766169 - DNA, 25 bp, Mus musculus
tcagcatgagaagattgaattggtt

SEQ ID NO: 766170 - DNA, 25 bp, Mus musculus
tcagcatgatccaggaatccgactg

SEQ ID NO: 766171 - DNA, 25 bp, Mus musculus
tcagcatgatcctggaatccgactg

SEQ ID NO: 766172 - DNA, 25 bp, Mus musculus
tcagcatgatggacttggagttgcc

SEQ ID NO: 766173 - DNA, 25 bp, Mus musculus
tcagcatgatggtcttggagttgcc

SEQ ID NO: 766174 - DNA, 25 bp, Mus musculus
tcagcatgcagtcgtttagagaatg

SEQ ID NO: 766175 - DNA, 25 bp, Mus musculus
tcagcatgcagtggtttagagaatg

SEQ ID NO: 766176 - DNA, 25 bp, Mus musculus
tcagcatgcatactttcttataggg

SEQ ID NO: 766177 - DNA, 25 bp, Mus musculus
tcagcatgcatagtttcttataggg

SEQ ID NO: 766178 - DNA, 25 bp, Mus musculus
tcagcatgccccaggactcgatgct

SEQ ID NO: 766179 - DNA, 25 bp, Mus musculus
tcagcatgcccctggactcgatgct

SEQ ID NO: 766180 - DNA, 25 bp, Mus musculus
tcagcatgctcgctgggaagactcc

SEQ ID NO: 766181 - DNA, 25 bp, Mus musculus
tcagcatgctcggtgggaagactcc

SEQ ID NO: 766182 - DNA, 25 bp, Mus musculus
tcagcatggaagatgtaaagaggaa

SEQ ID NO: 766183 - DNA, 25 bp, Mus musculus
tcagcatggaagttgtaaagaggaa

SEQ ID NO: 766184 - DNA, 25 bp, Mus musculus
tcagcatggacaccaaccagatcca

SEQ ID NO: 766185 - DNA, 25 bp, Mus musculus
tcagcatggacagcaaccagatcca

SEQ ID NO: 766186 - DNA, 25 bp, Mus musculus
tcagcatggccaaggacggcctgga

SEQ ID NO: 766187 - DNA, 25 bp, Mus musculus
tcagcatggccatggacggcctgga

SEQ ID NO: 766188 - DNA, 25 bp, Mus musculus
tcagcatggcgcagcacacggttct

SEQ ID NO: 766189 - DNA, 25 bp, Mus musculus
tcagcatggcgctgcacacggttct

SEQ ID NO: 766190 - DNA, 25 bp, Mus musculus
tcagcatggcttcctaatgcaactg

SEQ ID NO: 766191 - DNA, 25 bp, Mus musculus
tcagcatggcttgctaatgcaactg

SEQ ID NO: 766192 - DNA, 25 bp, Mus musculus
tcagcatgtcttcttagtggagtcc

SEQ ID NO: 766193 - DNA, 25 bp, Mus musculus
tcagcatgtcttgttagtggagtcc

SEQ ID NO: 766194 - DNA, 25 bp, Mus musculus
tcagcatgttcacaagctcaacaag

SEQ ID NO: 766195 - DNA, 25 bp, Mus musculus
tcagcatgttcagaagctcaacaag

SEQ ID NO: 766196 - DNA, 25 bp, Mus musculus
tcagcattagctcccgaaatgggcg

SEQ ID NO: 766197 - DNA, 25 bp, Mus musculus
tcagcattagctgccgaaatgggcg

SEQ ID NO: 766198 - DNA, 25 bp, Mus musculus
tcagcattcgcgctgtggacagtgg

SEQ ID NO: 766199 - DNA, 25 bp, Mus musculus
tcagcattcgcggtgtggacagtgg

SEQ ID NO: 766200 - DNA, 25 bp, Mus musculus
tcagcattcttgagctggcagcttg

SEQ ID NO: 766201 - DNA, 25 bp, Mus musculus
tcagcattcttgtgctggcagcttg

SEQ ID NO: 766202 - DNA, 25 bp, Mus musculus
tcagcatttggaataacagatgacc

SEQ ID NO: 766203 - DNA, 25 bp, Mus musculus
tcagcatttggattaacagatgacc

SEQ ID NO: 766204 - DNA, 25 bp, Mus musculus
tcagccaaaggcatgacagctcagg

SEQ ID NO: 766205 - DNA, 25 bp, Mus musculus
tcagccaaaggcttgacagctcagg

SEQ ID NO: 766206 - DNA, 25 bp, Mus musculus
tcagccaacctcctgaaatgggcag

SEQ ID NO: 766207 - DNA, 25 bp, Mus musculus
tcagccaacctcgtgaaatgggcag

SEQ ID NO: 766208 - DNA, 25 bp, Mus musculus
tcagccaactggaggaaccaccgac

SEQ ID NO: 766209 - DNA, 25 bp, Mus musculus
tcagccaactggtggaaccaccgac

SEQ ID NO: 766210 - DNA, 25 bp, Mus musculus
tcagccaagcggatgtggaaggtct

SEQ ID NO: 766211 - DNA, 25 bp, Mus musculus
tcagccaagcggttgtggaaggtct

SEQ ID NO: 766212 - DNA, 25 bp, Mus musculus
tcagccaagggtatttgcctgttct

SEQ ID NO: 766213 - DNA, 25 bp, Mus musculus
tcagccaagggtttttgcctgttct

SEQ ID NO: 766214 - DNA, 25 bp, Mus musculus
tcagccaatcagcatgaagagaccg

SEQ ID NO: 766215 - DNA, 25 bp, Mus musculus
tcagccaatcaggatgaagagaccg

SEQ ID NO: 766216 - DNA, 25 bp, Mus musculus
tcagccaatgggagtaagtttcact

SEQ ID NO: 766217 - DNA, 25 bp, Mus musculus
tcagccaatgggtgtaagtttcact

SEQ ID NO: 766218 - DNA, 25 bp, Mus musculus
tcagccaattgacaagtctgctgtc

SEQ ID NO: 766219 - DNA, 25 bp, Mus musculus
tcagccaattgagaagtctgctgtc

SEQ ID NO: 766220 - DNA, 25 bp, Mus musculus
tcagccacacagagcctgccgtgag

SEQ ID NO: 766221 - DNA, 25 bp, Mus musculus
tcagccacacagtgcctgccgtgag

SEQ ID NO: 766222 - DNA, 25 bp, Mus musculus
tcagccacaggacactacaatacgt

SEQ ID NO: 766223 - DNA, 25 bp, Mus musculus
tcagccacaggagactacaatacgt

SEQ ID NO: 766224 - DNA, 25 bp, Mus musculus
tcagccacccaaagactggaacatg

SEQ ID NO: 766225 - DNA, 25 bp, Mus musculus
tcagccacccaatgactggaacatg

SEQ ID NO: 766226 - DNA, 25 bp, Mus musculus
tcagccactacactgtggccaagca

SEQ ID NO: 766227 - DNA, 25 bp, Mus musculus
tcagccactacagtgtggccaagca

SEQ ID NO: 766228 - DNA, 25 bp, Mus musculus
tcagccagaagaataaagtatggtt

SEQ ID NO: 766229 - DNA, 25 bp, Mus musculus
tcagccagaagattaaagtatggtt

SEQ ID NO: 766230 - DNA, 25 bp, Mus musculus
tcagccagagctcagtactgggaaa

SEQ ID NO: 766231 - DNA, 25 bp, Mus musculus
tcagccagagctgagtactgggaaa

SEQ ID NO: 766232 - DNA, 25 bp, Mus musculus
tcagccagatgacgaccagtattgt

SEQ ID NO: 766233 - DNA, 25 bp, Mus musculus
tcagccagatgaggaccagtattgt

SEQ ID NO: 766234 - DNA, 25 bp, Mus musculus
tcagccagatgtagtccgggcgctg

SEQ ID NO: 766235 - DNA, 25 bp, Mus musculus
tcagccagatgttgtccgggcgctg

SEQ ID NO: 766236 - DNA, 25 bp, Mus musculus
tcagccagcgtcaggtcctgacaac

SEQ ID NO: 766237 - DNA, 25 bp, Mus musculus
tcagccagcgtctggtcctgacaac

SEQ ID NO: 766238 - DNA, 25 bp, Mus musculus
tcagccagctcaaggtgtccagtcc

SEQ ID NO: 766239 - DNA, 25 bp, Mus musculus
tcagccagctcatggtgtccagtcc

SEQ ID NO: 766240 - DNA, 25 bp, Mus musculus
tcagccagctgtaccagaatcaaga

SEQ ID NO: 766241 - DNA, 25 bp, Mus musculus
tcagccagctgttccagaatcaaga

SEQ ID NO: 766242 - DNA, 25 bp, Mus musculus
tcagccaggaacagtggcggagact

SEQ ID NO: 766243 - DNA, 25 bp, Mus musculus
tcagccaggaactgtggcggagact

SEQ ID NO: 766244 - DNA, 25 bp, Mus musculus
tcagccaggaatcatgggtaaccaa

SEQ ID NO: 766245 - DNA, 25 bp, Mus musculus
tcagccaggaatgatgggtaaccaa

SEQ ID NO: 766246 - DNA, 25 bp, Mus musculus
tcagccaggacaaggtatcatattg

SEQ ID NO: 766247 - DNA, 25 bp, Mus musculus
tcagccaggacatggtatcatattg

SEQ ID NO: 766248 - DNA, 25 bp, Mus musculus
tcagccaggagaatggtcaaaaagc

SEQ ID NO: 766249 - DNA, 25 bp, Mus musculus
tcagccaggagattggtcaaaaagc

SEQ ID NO: 766250 - DNA, 25 bp, Mus musculus
tcagccaggaggaagttcactgtca

SEQ ID NO: 766251 - DNA, 25 bp, Mus musculus
tcagccaggaggtagttcactgtca

SEQ ID NO: 766252 - DNA, 25 bp, Mus musculus
tcagccagggctactgcttcaacat

SEQ ID NO: 766253 - DNA, 25 bp, Mus musculus
tcagccagggcttctgcttcaacat

SEQ ID NO: 766254 - DNA, 25 bp, Mus musculus
tcagccaggttcagcagttgatggg

SEQ ID NO: 766255 - DNA, 25 bp, Mus musculus
tcagccaggttctgcagttgatggg

SEQ ID NO: 766256 - DNA, 25 bp, Mus musculus
tcagccagtctgattgttaccaaag

SEQ ID NO: 766257 - DNA, 25 bp, Mus musculus
tcagccagtctgtttgttaccaaag

SEQ ID NO: 766258 - DNA, 25 bp, Mus musculus
tcagccagtgacactctattcaggg

SEQ ID NO: 766259 - DNA, 25 bp, Mus musculus
tcagccagtgactctctattcaggg

SEQ ID NO: 766260 - DNA, 25 bp, Mus musculus
tcagccatattgcacctctgaaggc

SEQ ID NO: 766261 - DNA, 25 bp, Mus musculus
tcagccatattggacctctgaaggc

SEQ ID NO: 766262 - DNA, 25 bp, Mus musculus
tcagccatcaatcactagcacatga

SEQ ID NO: 766263 - DNA, 25 bp, Mus musculus
tcagccatcaatgactagcacatga

SEQ ID NO: 766264 - DNA, 25 bp, Mus musculus
tcagccatgaggacgttcctgacca

SEQ ID NO: 766265 - DNA, 25 bp, Mus musculus
tcagccatgaggtcgttcctgacca

SEQ ID NO: 766266 - DNA, 25 bp, Mus musculus
tcagccatgcaacgagcctacttgc

SEQ ID NO: 766267 - DNA, 25 bp, Mus musculus
tcagccatgcaaggagcctacttgc

SEQ ID NO: 766268 - DNA, 25 bp, Mus musculus
tcagccatggttctgcagaggatct

SEQ ID NO: 766269 - DNA, 25 bp, Mus musculus
tcagccatggttgtgcagaggatct

SEQ ID NO: 766270 - DNA, 25 bp, Mus musculus
tcagccattggactccctgtgtgtc

SEQ ID NO: 766271 - DNA, 25 bp, Mus musculus
tcagccattggagtccctgtgtgtc

SEQ ID NO: 766272 - DNA, 25 bp, Mus musculus
tcagcccaaagtagtagcacttagt

SEQ ID NO: 766273 - DNA, 25 bp, Mus musculus
tcagcccaaagttgtagcacttagt

SEQ ID NO: 766274 - DNA, 25 bp, Mus musculus
tcagcccaacagaggaacgggcagg

SEQ ID NO: 766275 - DNA, 25 bp, Mus musculus
tcagcccaacagtggaacgggcagg

SEQ ID NO: 766276 - DNA, 25 bp, Mus musculus
tcagcccaactcagggccaaatagg

SEQ ID NO: 766277 - DNA, 25 bp, Mus musculus
tcagcccaactctgggccaaatagg

SEQ ID NO: 766278 - DNA, 25 bp, Mus musculus
tcagcccaagtccatcaaagaggaa

SEQ ID NO: 766279 - DNA, 25 bp, Mus musculus
tcagcccaagtcgatcaaagaggaa

SEQ ID NO: 766280 - DNA, 25 bp, Mus musculus
tcagcccaatgaaaggcaggttcga

SEQ ID NO: 766281 - DNA, 25 bp, Mus musculus
tcagcccaatgataggcaggttcga

SEQ ID NO: 766282 - DNA, 25 bp, Mus musculus
tcagcccacatgctaccactggatt

SEQ ID NO: 766283 - DNA, 25 bp, Mus musculus
tcagcccacatggtaccactggatt

SEQ ID NO: 766284 - DNA, 25 bp, Mus musculus
tcagcccaggacaattgggccaaac

SEQ ID NO: 766285 - DNA, 25 bp, Mus musculus
tcagcccaggactattgggccaaac

SEQ ID NO: 766286 - DNA, 25 bp, Mus musculus
tcagcccagtggaccttggagcctg

SEQ ID NO: 766287 - DNA, 25 bp, Mus musculus
tcagcccagtggtccttggagcctg

SEQ ID NO: 766288 - DNA, 25 bp, Mus musculus
tcagcccattcgctggagccactgg

SEQ ID NO: 766289 - DNA, 25 bp, Mus musculus
tcagcccattcggtggagccactgg

SEQ ID NO: 766290 - DNA, 25 bp, Mus musculus
tcagccccacaaattgagaatgagc

SEQ ID NO: 766291 - DNA, 25 bp, Mus musculus
tcagccccacaatttgagaatgagc

SEQ ID NO: 766292 - DNA, 25 bp, Mus musculus
tcagccccacccattaaaggcggag

SEQ ID NO: 766293 - DNA, 25 bp, Mus musculus
tcagccccaccctttaaaggcggag

SEQ ID NO: 766294 - DNA, 25 bp, Mus musculus
tcagccccagctcgactcgccaggc

SEQ ID NO: 766295 - DNA, 25 bp, Mus musculus
tcagccccagctggactcgccaggc

SEQ ID NO: 766296 - DNA, 25 bp, Mus musculus
tcagccccatctacggtcctagtaa

SEQ ID NO: 766297 - DNA, 25 bp, Mus musculus
tcagccccatcttcggtcctagtaa

SEQ ID NO: 766298 - DNA, 25 bp, Mus musculus
tcagccccgctgaaatgaagaggac

SEQ ID NO: 766299 - DNA, 25 bp, Mus musculus
tcagccccgctgtaatgaagaggac

SEQ ID NO: 766300 - DNA, 25 bp, Mus musculus
tcagcccgagatatcttggaccaga

SEQ ID NO: 766301 - DNA, 25 bp, Mus musculus
tcagcccgagatttcttggaccaga

SEQ ID NO: 766302 - DNA, 25 bp, Mus musculus
tcagcccgatgtctcagaggcctgt

SEQ ID NO: 766303 - DNA, 25 bp, Mus musculus
tcagcccgatgtgtcagaggcctgt

SEQ ID NO: 766304 - DNA, 25 bp, Mus musculus
tcagcccgcccgagtatcaggatgt

SEQ ID NO: 766305 - DNA, 25 bp, Mus musculus
tcagcccgcccgtgtatcaggatgt

SEQ ID NO: 766306 - DNA, 25 bp, Mus musculus
tcagcccgtaagaggaaagcaggcc

SEQ ID NO: 766307 - DNA, 25 bp, Mus musculus
tcagcccgtaagtggaaagcaggcc

SEQ ID NO: 766308 - DNA, 25 bp, Mus musculus
tcagccctgacgcttcagttcatgt

SEQ ID NO: 766309 - DNA, 25 bp, Mus musculus
tcagccctgacggttcagttcatgt

SEQ ID NO: 766310 - DNA, 25 bp, Mus musculus
tcagccctgatgcacctcggagcag

SEQ ID NO: 766311 - DNA, 25 bp, Mus musculus
tcagccctgatggacctcggagcag

SEQ ID NO: 766312 - DNA, 25 bp, Mus musculus
tcagccctggagcacagcgtccagt

SEQ ID NO: 766313 - DNA, 25 bp, Mus musculus
tcagccctggaggacagcgtccagt

SEQ ID NO: 766314 - DNA, 25 bp, Mus musculus
tcagccctggtgattcagtcgtaca

SEQ ID NO: 766315 - DNA, 25 bp, Mus musculus
tcagccctggtgtttcagtcgtaca

SEQ ID NO: 766316 - DNA, 25 bp, Mus musculus
tcagccctgtgaagatggtggaccg

SEQ ID NO: 766317 - DNA, 25 bp, Mus musculus
tcagccctgtgatgatggtggaccg

SEQ ID NO: 766318 - DNA, 25 bp, Mus musculus
tcagccctgtgtcccaatatgccag

SEQ ID NO: 766319 - DNA, 25 bp, Mus musculus
tcagccctgtgtgccaatatgccag

SEQ ID NO: 766320 - DNA, 25 bp, Mus musculus
tcagccgaaactacaaggagtccag

SEQ ID NO: 766321 - DNA, 25 bp, Mus musculus
tcagccgaaacttcaaggagtccag

SEQ ID NO: 766322 - DNA, 25 bp, Mus musculus
tcagccgaaagtccagaaatgagtg

SEQ ID NO: 766323 - DNA, 25 bp, Mus musculus
tcagccgaaagtgcagaaatgagtg

SEQ ID NO: 766324 - DNA, 25 bp, Mus musculus
tcagccgaaggtatgcatttccagc

SEQ ID NO: 766325 - DNA, 25 bp, Mus musculus
tcagccgaaggtttgcatttccagc

SEQ ID NO: 766326 - DNA, 25 bp, Mus musculus
tcagccgactcaacctctagcaggt

SEQ ID NO: 766327 - DNA, 25 bp, Mus musculus
tcagccgactcatcctctagcaggt

SEQ ID NO: 766328 - DNA, 25 bp, Mus musculus
tcagccgagaggagtccggcatcaa

SEQ ID NO: 766329 - DNA, 25 bp, Mus musculus
tcagccgagaggtgtccggcatcaa

SEQ ID NO: 766330 - DNA, 25 bp, Mus musculus
tcagccgagtgaatgaaaggacctt

SEQ ID NO: 766331 - DNA, 25 bp, Mus musculus
tcagccgagtgattgaaaggacctt

SEQ ID NO: 766332 - DNA, 25 bp, Mus musculus
tcagccgagtgtagttgaggagcct

SEQ ID NO: 766333 - DNA, 25 bp, Mus musculus
tcagccgagtgttgttgaggagcct

SEQ ID NO: 766334 - DNA, 25 bp, Mus musculus
tcagccgattccaggaagaccccag

SEQ ID NO: 766335 - DNA, 25 bp, Mus musculus
tcagccgattcctggaagaccccag

SEQ ID NO: 766336 - DNA, 25 bp, Mus musculus
tcagccgcaacgacgtcatcggcaa

SEQ ID NO: 766337 - DNA, 25 bp, Mus musculus
tcagccgcaacgtcgtcatcggcaa

SEQ ID NO: 766338 - DNA, 25 bp, Mus musculus
tcagccgcatgactgaacggcagct

SEQ ID NO: 766339 - DNA, 25 bp, Mus musculus
tcagccgcatgagtgaacggcagct

SEQ ID NO: 766340 - DNA, 25 bp, Mus musculus
tcagccgcttgcaccgagtggcaca

SEQ ID NO: 766341 - DNA, 25 bp, Mus musculus
tcagccgcttgctccgagtggcaca

SEQ ID NO: 766342 - DNA, 25 bp, Mus musculus
tcagccgctttacgtgtcccgtgtg

SEQ ID NO: 766343 - DNA, 25 bp, Mus musculus
tcagccgctttaggtgtcccgtgtg

SEQ ID NO: 766344 - DNA, 25 bp, Mus musculus
tcagccggaaacaggtgaggccatt

SEQ ID NO: 766345 - DNA, 25 bp, Mus musculus
tcagccggaaactggtgaggccatt

SEQ ID NO: 766346 - DNA, 25 bp, Mus musculus
tcagccggaacgaccagtaaatagc

SEQ ID NO: 766347 - DNA, 25 bp, Mus musculus
tcagccggaacgtccagtaaatagc

SEQ ID NO: 766348 - DNA, 25 bp, Mus musculus
tcagccggaccgcaactatgtgatc

SEQ ID NO: 766349 - DNA, 25 bp, Mus musculus
tcagccggaccggaactatgtgatc

SEQ ID NO: 766350 - DNA, 25 bp, Mus musculus
tcagccgggcacaggaaagggtgga

SEQ ID NO: 766351 - DNA, 25 bp, Mus musculus
tcagccgggcactggaaagggtgga

SEQ ID NO: 766352 - DNA, 25 bp, Mus musculus
tcagccgggcgcaacgttcgtgaga

SEQ ID NO: 766353 - DNA, 25 bp, Mus musculus
tcagccgggcgctacgttcgtgaga

SEQ ID NO: 766354 - DNA, 25 bp, Mus musculus
tcagccggtcaacaatgaccagtgc

SEQ ID NO: 766355 - DNA, 25 bp, Mus musculus
tcagccggtcaagaatgaccagtgc

SEQ ID NO: 766356 - DNA, 25 bp, Mus musculus
tcagccgtacaacatctacgaggtc

SEQ ID NO: 766357 - DNA, 25 bp, Mus musculus
tcagccgtacaagatctacgaggtc

SEQ ID NO: 766358 - DNA, 25 bp, Mus musculus
tcagccgtacatactgcagcatcct

SEQ ID NO: 766359 - DNA, 25 bp, Mus musculus
tcagccgtacattctgcagcatcct

SEQ ID NO: 766360 - DNA, 25 bp, Mus musculus
tcagccgtagcccttccgttaggca

SEQ ID NO: 766361 - DNA, 25 bp, Mus musculus
tcagccgtagccgttccgttaggca

SEQ ID NO: 766362 - DNA, 25 bp, Mus musculus
tcagccgtgccaagagaagatgggc

SEQ ID NO: 766363 - DNA, 25 bp, Mus musculus
tcagccgtgccatgagaagatgggc

SEQ ID NO: 766364 - DNA, 25 bp, Mus musculus
tcagccgtgtccatcagagataatg

SEQ ID NO: 766365 - DNA, 25 bp, Mus musculus
tcagccgtgtccttcagagataatg

SEQ ID NO: 766366 - DNA, 25 bp, Mus musculus
tcagccgtgtttcagcactttgcct

SEQ ID NO: 766367 - DNA, 25 bp, Mus musculus
tcagccgtgtttgagcactttgcct

SEQ ID NO: 766368 - DNA, 25 bp, Mus musculus
tcagccgttacgagagcactcgacg

SEQ ID NO: 766369 - DNA, 25 bp, Mus musculus
tcagccgttacgtgagcactcgacg

SEQ ID NO: 766370 - DNA, 25 bp, Mus musculus
tcagcctagacaagaacctccgttt

SEQ ID NO: 766371 - DNA, 25 bp, Mus musculus
tcagcctagacatgaacctccgttt

SEQ ID NO: 766372 - DNA, 25 bp, Mus musculus
tcagcctagcagaaaaaccgaccag

SEQ ID NO: 766373 - DNA, 25 bp, Mus musculus
tcagcctagcagtaaaaccgaccag

SEQ ID NO: 766374 - DNA, 25 bp, Mus musculus
tcagcctagctaagaatagccagcc

SEQ ID NO: 766375 - DNA, 25 bp, Mus musculus
tcagcctagctatgaatagccagcc

SEQ ID NO: 766376 - DNA, 25 bp, Mus musculus
tcagcctaggtcaaaacctcagaca

SEQ ID NO: 766377 - DNA, 25 bp, Mus musculus
tcagcctaggtctaaacctcagaca

SEQ ID NO: 766378 - DNA, 25 bp, Mus musculus
tcagcctatgctcctccgagtggtt

SEQ ID NO: 766379 - DNA, 25 bp, Mus musculus
tcagcctatgctgctccgagtggtt

SEQ ID NO: 766380 - DNA, 25 bp, Mus musculus
tcagcctcaactcgtcttggtggcc

SEQ ID NO: 766381 - DNA, 25 bp, Mus musculus
tcagcctcaactggtcttggtggcc

SEQ ID NO: 766382 - DNA, 25 bp, Mus musculus
tcagcctcagagatcacgtattaag

SEQ ID NO: 766383 - DNA, 25 bp, Mus musculus
tcagcctcagagttcacgtattaag

SEQ ID NO: 766384 - DNA, 25 bp, Mus musculus
tcagcctcaggaatcaggagttcat

SEQ ID NO: 766385 - DNA, 25 bp, Mus musculus
tcagcctcaggattcaggagttcat

SEQ ID NO: 766386 - DNA, 25 bp, Mus musculus
tcagcctcattaccaggaaaaggtc

SEQ ID NO: 766387 - DNA, 25 bp, Mus musculus
tcagcctcattagcaggaaaaggtc

SEQ ID NO: 766388 - DNA, 25 bp, Mus musculus
tcagcctctacgagttggacagcag

SEQ ID NO: 766389 - DNA, 25 bp, Mus musculus
tcagcctctacgtgttggacagcag

SEQ ID NO: 766390 - DNA, 25 bp, Mus musculus
tcagcctctcagcagatgtggcagg

SEQ ID NO: 766391 - DNA, 25 bp, Mus musculus
tcagcctctcaggagatgtggcagg

SEQ ID NO: 766392 - DNA, 25 bp, Mus musculus
tcagcctcttctctcagctctgtaa

SEQ ID NO: 766393 - DNA, 25 bp, Mus musculus
tcagcctcttctgtcagctctgtaa

SEQ ID NO: 766394 - DNA, 25 bp, Mus musculus
tcagcctgaagaagttctgccggaa

SEQ ID NO: 766395 - DNA, 25 bp, Mus musculus
tcagcctgaagatgttctgccggaa

SEQ ID NO: 766396 - DNA, 25 bp, Mus musculus
tcagcctgaggtcttctgcaaccag

SEQ ID NO: 766397 - DNA, 25 bp, Mus musculus
tcagcctgaggtgttctgcaaccag

SEQ ID NO: 766398 - DNA, 25 bp, Mus musculus
tcagcctgagttcgttgcgcaaaaa

SEQ ID NO: 766399 - DNA, 25 bp, Mus musculus
tcagcctgagttggttgcgcaaaaa

SEQ ID NO: 766400 - DNA, 25 bp, Mus musculus
tcagcctgatgacgccggccactat

SEQ ID NO: 766401 - DNA, 25 bp, Mus musculus
tcagcctgatgaggccggccactat

SEQ ID NO: 766402 - DNA, 25 bp, Mus musculus
tcagcctgatgtcggccgtacatct

SEQ ID NO: 766403 - DNA, 25 bp, Mus musculus
tcagcctgatgtgggccgtacatct

SEQ ID NO: 766404 - DNA, 25 bp, Mus musculus
tcagcctgcctacgaaacgcaagga

SEQ ID NO: 766405 - DNA, 25 bp, Mus musculus
tcagcctgcctaggaaacgcaagga

SEQ ID NO: 766406 - DNA, 25 bp, Mus musculus
tcagcctgccttagtgtaaccccaa

SEQ ID NO: 766407 - DNA, 25 bp, Mus musculus
tcagcctgcctttgtgtaaccccaa

SEQ ID NO: 766408 - DNA, 25 bp, Mus musculus
tcagcctggacaacatcagcaagcg

SEQ ID NO: 766409 - DNA, 25 bp, Mus musculus
tcagcctggacatcatcagcaagcg

SEQ ID NO: 766410 - DNA, 25 bp, Mus musculus
tcagcctggaccatcgctgccgaat

SEQ ID NO: 766411 - DNA, 25 bp, Mus musculus
tcagcctggaccttcgctgccgaat

SEQ ID NO: 766412 - DNA, 25 bp, Mus musculus
tcagcctgggatatttcggttccat

SEQ ID NO: 766413 - DNA, 25 bp, Mus musculus
tcagcctgggatttttcggttccat

SEQ ID NO: 766414 - DNA, 25 bp, Mus musculus
tcagcctgggcaaatgctggtccga

SEQ ID NO: 766415 - DNA, 25 bp, Mus musculus
tcagcctgggcatatgctggtccga

SEQ ID NO: 766416 - DNA, 25 bp, Mus musculus
tcagcctgggcgctctgaagatgca

SEQ ID NO: 766417 - DNA, 25 bp, Mus musculus
tcagcctgggcggtctgaagatgca

SEQ ID NO: 766418 - DNA, 25 bp, Mus musculus
tcagcctgggctcagacacggctgt

SEQ ID NO: 766419 - DNA, 25 bp, Mus musculus
tcagcctgggctgagacacggctgt

SEQ ID NO: 766420 - DNA, 25 bp, Mus musculus
tcagcctgtatcaatattttcgacc

SEQ ID NO: 766421 - DNA, 25 bp, Mus musculus
tcagcctgtatctatattttcgacc

SEQ ID NO: 766422 - DNA, 25 bp, Mus musculus
tcagcctgtcctccggaatcgacaa

SEQ ID NO: 766423 - DNA, 25 bp, Mus musculus
tcagcctgtcctgcggaatcgacaa

SEQ ID NO: 766424 - DNA, 25 bp, Mus musculus
tcagcctgtcgcctgcaaatcagga

SEQ ID NO: 766425 - DNA, 25 bp, Mus musculus
tcagcctgtcgcgtgcaaatcagga

SEQ ID NO: 766426 - DNA, 25 bp, Mus musculus
tcagcctgtggtcctgatgccaact

SEQ ID NO: 766427 - DNA, 25 bp, Mus musculus
tcagcctgtggtgctgatgccaact

SEQ ID NO: 766428 - DNA, 25 bp, Mus musculus
tcagcctgttctaacgaggaggaga

SEQ ID NO: 766429 - DNA, 25 bp, Mus musculus
tcagcctgttcttacgaggaggaga

SEQ ID NO: 766430 - DNA, 25 bp, Mus musculus
tcagccttagcgacactatcgtcct

SEQ ID NO: 766431 - DNA, 25 bp, Mus musculus
tcagccttagcgtcactatcgtcct

SEQ ID NO: 766432 - DNA, 25 bp, Mus musculus
tcagccttcactagtccacggaaca

SEQ ID NO: 766433 - DNA, 25 bp, Mus musculus
tcagccttcacttgtccacggaaca

SEQ ID NO: 766434 - DNA, 25 bp, Mus musculus
tcagccttccgaacattcactactt

SEQ ID NO: 766435 - DNA, 25 bp, Mus musculus
tcagccttccgatcattcactactt

SEQ ID NO: 766436 - DNA, 25 bp, Mus musculus
tcagccttcctgactccatggacga

SEQ ID NO: 766437 - DNA, 25 bp, Mus musculus
tcagccttcctgtctccatggacga

SEQ ID NO: 766438 - DNA, 25 bp, Mus musculus
tcagccttcgccatcatggagagcc

SEQ ID NO: 766439 - DNA, 25 bp, Mus musculus
tcagccttcgccttcatggagagcc

SEQ ID NO: 766440 - DNA, 25 bp, Mus musculus
tcagccttgcagagagatggacaga

SEQ ID NO: 766441 - DNA, 25 bp, Mus musculus
tcagccttgcagtgagatggacaga

SEQ ID NO: 766442 - DNA, 25 bp, Mus musculus
tcagccttggctatctaggggtcaa

SEQ ID NO: 766443 - DNA, 25 bp, Mus musculus
tcagccttggctttctaggggtcaa

SEQ ID NO: 766444 - DNA, 25 bp, Mus musculus
tcagccttgtgtatagagaatataa

SEQ ID NO: 766445 - DNA, 25 bp, Mus musculus
tcagccttgtgtttagagaatataa

SEQ ID NO: 766446 - DNA, 25 bp, Mus musculus
tcagcctttgagcagatcaccctgg

SEQ ID NO: 766447 - DNA, 25 bp, Mus musculus
tcagcctttgaggagatcaccctgg

SEQ ID NO: 766448 - DNA, 25 bp, Mus musculus
tcagcctttggtcatcctccaggac

SEQ ID NO: 766449 - DNA, 25 bp, Mus musculus
tcagcctttggtgatcctccaggac

SEQ ID NO: 766450 - DNA, 25 bp, Mus musculus
tcagcctttgtcacgggccgctggg

SEQ ID NO: 766451 - DNA, 25 bp, Mus musculus
tcagcctttgtctcgggccgctggg

SEQ ID NO: 766452 - DNA, 25 bp, Mus musculus
tcagcgaccacgagctggtgcatcc

SEQ ID NO: 766453 - DNA, 25 bp, Mus musculus
tcagcgaccacgtgctggtgcatcc

SEQ ID NO: 766454 - DNA, 25 bp, Mus musculus
tcagcgacgtgcagggccgctgtac

SEQ ID NO: 766455 - DNA, 25 bp, Mus musculus
tcagcgacgtgctgggccgctgtac

SEQ ID NO: 766456 - DNA, 25 bp, Mus musculus
tcagcgactatgaagactccgtgct

SEQ ID NO: 766457 - DNA, 25 bp, Mus musculus
tcagcgactatgtagactccgtgct

SEQ ID NO: 766458 - DNA, 25 bp, Mus musculus
tcagcgactccaatttgatgtttca

SEQ ID NO: 766459 - DNA, 25 bp, Mus musculus
tcagcgactccattttgatgtttca

SEQ ID NO: 766460 - DNA, 25 bp, Mus musculus
tcagcgactccgatcgtgacaccgg

SEQ ID NO: 766461 - DNA, 25 bp, Mus musculus
tcagcgactccgttcgtgacaccgg

SEQ ID NO: 766462 - DNA, 25 bp, Mus musculus
tcagcgacttgtacaaaactgtctt

SEQ ID NO: 766463 - DNA, 25 bp, Mus musculus
tcagcgacttgttcaaaactgtctt

SEQ ID NO: 766464 - DNA, 25 bp, Mus musculus
tcagcgagagtacctgcgagaagcc

SEQ ID NO: 766465 - DNA, 25 bp, Mus musculus
tcagcgagagtagctgcgagaagcc

SEQ ID NO: 766466 - DNA, 25 bp, Mus musculus
tcagcgagcacacgagaggaaaaat

SEQ ID NO: 766467 - DNA, 25 bp, Mus musculus
tcagcgagcacaggagaggaaaaat

SEQ ID NO: 766468 - DNA, 25 bp, Mus musculus
tcagcgagcagcaggccaagtccct

SEQ ID NO: 766469 - DNA, 25 bp, Mus musculus
tcagcgagcagctggccaagtccct

SEQ ID NO: 766470 - DNA, 25 bp, Mus musculus
tcagcgaggtgactcttgattcccc

SEQ ID NO: 766471 - DNA, 25 bp, Mus musculus
tcagcgaggtgagtcttgattcccc

SEQ ID NO: 766472 - DNA, 25 bp, Mus musculus
tcagcgagtgctactacaccatggc

SEQ ID NO: 766473 - DNA, 25 bp, Mus musculus
tcagcgagtgcttctacaccatggc

SEQ ID NO: 766474 - DNA, 25 bp, Mus musculus
tcagcgagtttgcactccagagcga

SEQ ID NO: 766475 - DNA, 25 bp, Mus musculus
tcagcgagtttggactccagagcga

SEQ ID NO: 766476 - DNA, 25 bp, Mus musculus
tcagcgataatgacattcggaagta

SEQ ID NO: 766477 - DNA, 25 bp, Mus musculus
tcagcgataatgtcattcggaagta

SEQ ID NO: 766478 - DNA, 25 bp, Mus musculus
tcagcgcaaaggagaatggtgagca

SEQ ID NO: 766479 - DNA, 25 bp, Mus musculus
tcagcgcaaaggtgaatggtgagca

SEQ ID NO: 766480 - DNA, 25 bp, Mus musculus
tcagcgcactagctgtgccctgctg

SEQ ID NO: 766481 - DNA, 25 bp, Mus musculus
tcagcgcactaggtgtgccctgctg

SEQ ID NO: 766482 - DNA, 25 bp, Mus musculus
tcagcgcagcaacgacatggtgtgt

SEQ ID NO: 766483 - DNA, 25 bp, Mus musculus
tcagcgcagcaaggacatggtgtgt

SEQ ID NO: 766484 - DNA, 25 bp, Mus musculus
tcagcgcatcttacgcatcatgtgt

SEQ ID NO: 766485 - DNA, 25 bp, Mus musculus
tcagcgcatctttcgcatcatgtgt

SEQ ID NO: 766486 - DNA, 25 bp, Mus musculus
tcagcgcattgacctctaccagcag

SEQ ID NO: 766487 - DNA, 25 bp, Mus musculus
tcagcgcattgagctctaccagcag

SEQ ID NO: 766488 - DNA, 25 bp, Mus musculus
tcagcgccaaaaagcctaaaaagag

SEQ ID NO: 766489 - DNA, 25 bp, Mus musculus
tcagcgccaaaatgcctaaaaagag

SEQ ID NO: 766490 - DNA, 25 bp, Mus musculus
tcagcgccagggaccagaaagccca

SEQ ID NO: 766491 - DNA, 25 bp, Mus musculus
tcagcgccagggtccagaaagccca

SEQ ID NO: 766492 - DNA, 25 bp, Mus musculus
tcagcgccggcaagatgaagttcac

SEQ ID NO: 766493 - DNA, 25 bp, Mus musculus
tcagcgccggcatgatgaagttcac

SEQ ID NO: 766494 - DNA, 25 bp, Mus musculus
tcagcgcctacaagtacccaacagg

SEQ ID NO: 766495 - DNA, 25 bp, Mus musculus
tcagcgcctacatgtacccaacagg

SEQ ID NO: 766496 - DNA, 25 bp, Mus musculus
tcagcgcctcctacaaagaacaatg

SEQ ID NO: 766497 - DNA, 25 bp, Mus musculus
tcagcgcctccttcaaagaacaatg

SEQ ID NO: 766498 - DNA, 25 bp, Mus musculus
tcagcgcctctcaggatggaaaact

SEQ ID NO: 766499 - DNA, 25 bp, Mus musculus
tcagcgcctctctggatggaaaact

SEQ ID NO: 766500 - DNA, 25 bp, Mus musculus
tcagcgcctctgatgctgcgacagt

SEQ ID NO: 766501 - DNA, 25 bp, Mus musculus
tcagcgcctctgttgctgcgacagt

SEQ ID NO: 766502 - DNA, 25 bp, Mus musculus
tcagcgctagatactacgtcttcat

SEQ ID NO: 766503 - DNA, 25 bp, Mus musculus
tcagcgctagattctacgtcttcat

SEQ ID NO: 766504 - DNA, 25 bp, Mus musculus
tcagcgctggaccaactgtcctctg

SEQ ID NO: 766505 - DNA, 25 bp, Mus musculus
tcagcgctggacgaactgtcctctg

SEQ ID NO: 766506 - DNA, 25 bp, Mus musculus
tcagcgctggtcaaatacaaagcag

SEQ ID NO: 766507 - DNA, 25 bp, Mus musculus
tcagcgctggtctaatacaaagcag

SEQ ID NO: 766508 - DNA, 25 bp, Mus musculus
tcagcgcttgctctccgtgttgtct

SEQ ID NO: 766509 - DNA, 25 bp, Mus musculus
tcagcgcttgctgtccgtgttgtct

SEQ ID NO: 766510 - DNA, 25 bp, Mus musculus
tcagcggaaagtcatctgcatcccc

SEQ ID NO: 766511 - DNA, 25 bp, Mus musculus
tcagcggaaagtgatctgcatcccc

SEQ ID NO: 766512 - DNA, 25 bp, Mus musculus
tcagcggaaccacgagggtcatgaa

SEQ ID NO: 766513 - DNA, 25 bp, Mus musculus
tcagcggaaccaggagggtcatgaa

SEQ ID NO: 766514 - DNA, 25 bp, Mus musculus
tcagcggaagatagtcatgcacaag

SEQ ID NO: 766515 - DNA, 25 bp, Mus musculus
tcagcggaagattgtcatgcacaag

SEQ ID NO: 766516 - DNA, 25 bp, Mus musculus
tcagcggacagtacctttagatgcc

SEQ ID NO: 766517 - DNA, 25 bp, Mus musculus
tcagcggacagttcctttagatgcc

SEQ ID NO: 766518 - DNA, 25 bp, Mus musculus
tcagcggagcgtcttcaggatgctt

SEQ ID NO: 766519 - DNA, 25 bp, Mus musculus
tcagcggagcgtgttcaggatgctt

SEQ ID NO: 766520 - DNA, 25 bp, Mus musculus
tcagcggaggcgcaaacttgacact

SEQ ID NO: 766521 - DNA, 25 bp, Mus musculus
tcagcggaggcggaaacttgacact

SEQ ID NO: 766522 - DNA, 25 bp, Mus musculus
tcagcggatcaccaaataccctgtg

SEQ ID NO: 766523 - DNA, 25 bp, Mus musculus
tcagcggatcacgaaataccctgtg

SEQ ID NO: 766524 - DNA, 25 bp, Mus musculus
tcagcggatgggatcaagccttgcc

SEQ ID NO: 766525 - DNA, 25 bp, Mus musculus
tcagcggatgggttcaagccttgcc

SEQ ID NO: 766526 - DNA, 25 bp, Mus musculus
tcagcggatgtactggccttcattc

SEQ ID NO: 766527 - DNA, 25 bp, Mus musculus
tcagcggatgtagtggccttcattc

SEQ ID NO: 766528 - DNA, 25 bp, Mus musculus
tcagcggattcgcttcacactgcca

SEQ ID NO: 766529 - DNA, 25 bp, Mus musculus
tcagcggattcggttcacactgcca

SEQ ID NO: 766530 - DNA, 25 bp, Mus musculus
tcagcggcaaccacctgaaggaagt

SEQ ID NO: 766531 - DNA, 25 bp, Mus musculus
tcagcggcaacctcctgaaggaagt

SEQ ID NO: 766532 - DNA, 25 bp, Mus musculus
tcagcggccggcagagccagctgag

SEQ ID NO: 766533 - DNA, 25 bp, Mus musculus
tcagcggccggctgagccagctgag

SEQ ID NO: 766534 - DNA, 25 bp, Mus musculus
tcagcggccggtacattattcttct

SEQ ID NO: 766535 - DNA, 25 bp, Mus musculus
tcagcggccggttcattattcttct

SEQ ID NO: 766536 - DNA, 25 bp, Mus musculus
tcagcggctaaacgcgcttgcggcc

SEQ ID NO: 766537 - DNA, 25 bp, Mus musculus
tcagcggctaaaggcgcttgcggcc

SEQ ID NO: 766538 - DNA, 25 bp, Mus musculus
tcagcggctactaggctatcctcgt

SEQ ID NO: 766539 - DNA, 25 bp, Mus musculus
tcagcggctacttggctatcctcgt

SEQ ID NO: 766540 - DNA, 25 bp, Mus musculus
tcagcggctatgaccaggtgctcca

SEQ ID NO: 766541 - DNA, 25 bp, Mus musculus
tcagcggctatgtccaggtgctcca

SEQ ID NO: 766542 - DNA, 25 bp, Mus musculus
tcagcggctggtcgagttcatgaca

SEQ ID NO: 766543 - DNA, 25 bp, Mus musculus
tcagcggctggtggagttcatgaca

SEQ ID NO: 766544 - DNA, 25 bp, Mus musculus
tcagcgggaagtcaagacgaagctc

SEQ ID NO: 766545 - DNA, 25 bp, Mus musculus
tcagcgggaagtgaagacgaagctc

SEQ ID NO: 766546 - DNA, 25 bp, Mus musculus
tcagcgggactgagaaacttccaaa

SEQ ID NO: 766547 - DNA, 25 bp, Mus musculus
tcagcgggactgtgaaacttccaaa

SEQ ID NO: 766548 - DNA, 25 bp, Mus musculus
tcagcgggcaccacaatttccagat

SEQ ID NO: 766549 - DNA, 25 bp, Mus musculus
tcagcgggcacctcaatttccagat

SEQ ID NO: 766550 - DNA, 25 bp, Mus musculus
tcagcgggtcccacggggagaaatt

SEQ ID NO: 766551 - DNA, 25 bp, Mus musculus
tcagcgggtccctcggggagaaatt

SEQ ID NO: 766552 - DNA, 25 bp, Mus musculus
tcagcggtatcaatttattatggct

SEQ ID NO: 766553 - DNA, 25 bp, Mus musculus
tcagcggtatcattttattatggct

SEQ ID NO: 766554 - DNA, 25 bp, Mus musculus
tcagcggtgctgatttccttatcat

SEQ ID NO: 766555 - DNA, 25 bp, Mus musculus
tcagcggtgctgttttccttatcat

SEQ ID NO: 766556 - DNA, 25 bp, Mus musculus
tcagcggtgtctcccgttcaaacac

SEQ ID NO: 766557 - DNA, 25 bp, Mus musculus
tcagcggtgtctgccgttcaaacac

SEQ ID NO: 766558 - DNA, 25 bp, Mus musculus
tcagcgtaagtgagagcgctcccag

SEQ ID NO: 766559 - DNA, 25 bp, Mus musculus
tcagcgtaagtgtgagcgctcccag

SEQ ID NO: 766560 - DNA, 25 bp, Mus musculus
tcagcgtaccttcagtgacatggcc

SEQ ID NO: 766561 - DNA, 25 bp, Mus musculus
tcagcgtaccttgagtgacatggcc

SEQ ID NO: 766562 - DNA, 25 bp, Mus musculus
tcagcgtagaggagcagaaatggcc

SEQ ID NO: 766563 - DNA, 25 bp, Mus musculus
tcagcgtagaggtgcagaaatggcc

SEQ ID NO: 766564 - DNA, 25 bp, Mus musculus
tcagcgtaggatcggcaactgcgtc

SEQ ID NO: 766565 - DNA, 25 bp, Mus musculus
tcagcgtaggatgggcaactgcgtc

SEQ ID NO: 766566 - DNA, 25 bp, Mus musculus
tcagcgtatcttagagcactgcacg

SEQ ID NO: 766567 - DNA, 25 bp, Mus musculus
tcagcgtatctttgagcactgcacg

SEQ ID NO: 766568 - DNA, 25 bp, Mus musculus
tcagcgtcagttcagttgctcacag

SEQ ID NO: 766569 - DNA, 25 bp, Mus musculus
tcagcgtcagttgagttgctcacag

SEQ ID NO: 766570 - DNA, 25 bp, Mus musculus
tcagcgtccactcaaaaggttctgg

SEQ ID NO: 766571 - DNA, 25 bp, Mus musculus
tcagcgtccactgaaaaggttctgg

SEQ ID NO: 766572 - DNA, 25 bp, Mus musculus
tcagcgtcccaaatgtctatgagaa

SEQ ID NO: 766573 - DNA, 25 bp, Mus musculus
tcagcgtcccaacgagaccagttct

SEQ ID NO: 766574 - DNA, 25 bp, Mus musculus
tcagcgtcccaaggagaccagttct

SEQ ID NO: 766575 - DNA, 25 bp, Mus musculus
tcagcgtcccaattgtctatgagaa

SEQ ID NO: 766576 - DNA, 25 bp, Mus musculus
tcagcgtccccaaaggatgagcagg

SEQ ID NO: 766577 - DNA, 25 bp, Mus musculus
tcagcgtccccataggatgagcagg

SEQ ID NO: 766578 - DNA, 25 bp, Mus musculus
tcagcgtcctataactccaagtcag

SEQ ID NO: 766579 - DNA, 25 bp, Mus musculus
tcagcgtcctattactccaagtcag

SEQ ID NO: 766580 - DNA, 25 bp, Mus musculus
tcagcgtcctgtcatttctcggatc

SEQ ID NO: 766581 - DNA, 25 bp, Mus musculus
tcagcgtcctgtgatttctcggatc

SEQ ID NO: 766582 - DNA, 25 bp, Mus musculus
tcagcgtctcgaactctctgagaac

SEQ ID NO: 766583 - DNA, 25 bp, Mus musculus
tcagcgtctcgatctctctgagaac

SEQ ID NO: 766584 - DNA, 25 bp, Mus musculus
tcagcgtctttaattgtggcccaac

SEQ ID NO: 766585 - DNA, 25 bp, Mus musculus
tcagcgtctttatttgtggcccaac

SEQ ID NO: 766586 - DNA, 25 bp, Mus musculus
tcagcgtgaaggagatgagagacat

SEQ ID NO: 766587 - DNA, 25 bp, Mus musculus
tcagcgtgaaggtgatgagagacat

SEQ ID NO: 766588 - DNA, 25 bp, Mus musculus
tcagcgtgactgaggaagaattctg

SEQ ID NO: 766589 - DNA, 25 bp, Mus musculus
tcagcgtgactgtggaagaattctg

SEQ ID NO: 766590 - DNA, 25 bp, Mus musculus
tcagcgtgatatcgaagagagtcac

SEQ ID NO: 766591 - DNA, 25 bp, Mus musculus
tcagcgtgatatggaagagagtcac

SEQ ID NO: 766592 - DNA, 25 bp, Mus musculus
tcagcgtgcaccaaaagtgggacta

SEQ ID NO: 766593 - DNA, 25 bp, Mus musculus
tcagcgtgcacctaaagtgggacta

SEQ ID NO: 766594 - DNA, 25 bp, Mus musculus
tcagcgtgctgtcccattggacgac

SEQ ID NO: 766595 - DNA, 25 bp, Mus musculus
tcagcgtgctgtgccattggacgac

SEQ ID NO: 766596 - DNA, 25 bp, Mus musculus
tcagcgtggagtcggataaagacca

SEQ ID NO: 766597 - DNA, 25 bp, Mus musculus
tcagcgtggagtgggataaagacca

SEQ ID NO: 766598 - DNA, 25 bp, Mus musculus
tcagcgtggctcacggtgctgccag

SEQ ID NO: 766599 - DNA, 25 bp, Mus musculus
tcagcgtggctctcggtgctgccag

SEQ ID NO: 766600 - DNA, 25 bp, Mus musculus
tcagctaacaaaagcacttgtggaa

SEQ ID NO: 766601 - DNA, 25 bp, Mus musculus
tcagctaacaaatgcacttgtggaa

SEQ ID NO: 766602 - DNA, 25 bp, Mus musculus
tcagctaacctcctctggaccagga

SEQ ID NO: 766603 - DNA, 25 bp, Mus musculus
tcagctaacctcgtctggaccagga

SEQ ID NO: 766604 - DNA, 25 bp, Mus musculus
tcagctacacagacctcgtgggctt

SEQ ID NO: 766605 - DNA, 25 bp, Mus musculus
tcagctacacagtcctcgtgggctt

SEQ ID NO: 766606 - DNA, 25 bp, Mus musculus
tcagctacagccagacaggatgcag

SEQ ID NO: 766607 - DNA, 25 bp, Mus musculus
tcagctacagcctgacaggatgcag

SEQ ID NO: 766608 - DNA, 25 bp, Mus musculus
tcagctaccggcaacccagtgggaa

SEQ ID NO: 766609 - DNA, 25 bp, Mus musculus
tcagctaccggctacccagtgggaa

SEQ ID NO: 766610 - DNA, 25 bp, Mus musculus
tcagctacggctccagcagaacatg

SEQ ID NO: 766611 - DNA, 25 bp, Mus musculus
tcagctacggctgcagcagaacatg

SEQ ID NO: 766612 - DNA, 25 bp, Mus musculus
tcagctacggggaggtcttcttcct

SEQ ID NO: 766613 - DNA, 25 bp, Mus musculus
tcagctacggggtggtcttcttcct

SEQ ID NO: 766614 - DNA, 25 bp, Mus musculus
tcagctacgtggacatgagcacagc

SEQ ID NO: 766615 - DNA, 25 bp, Mus musculus
tcagctacgtggtcatgagcacagc

SEQ ID NO: 766616 - DNA, 25 bp, Mus musculus
tcagctactccgagagagtgacggc

SEQ ID NO: 766617 - DNA, 25 bp, Mus musculus
tcagctactccgtgagagtgacggc

SEQ ID NO: 766618 - DNA, 25 bp, Mus musculus
tcagctacttagcaagttggccagc

SEQ ID NO: 766619 - DNA, 25 bp, Mus musculus
tcagctacttaggaagttggccagc

SEQ ID NO: 766620 - DNA, 25 bp, Mus musculus
tcagctagaaagcatcaccgaaggg

SEQ ID NO: 766621 - DNA, 25 bp, Mus musculus
tcagctagaaaggatcaccgaaggg

SEQ ID NO: 766622 - DNA, 25 bp, Mus musculus
tcagctagacaaaagatctgtgccc

SEQ ID NO: 766623 - DNA, 25 bp, Mus musculus
tcagctagacaatagatctgtgccc

SEQ ID NO: 766624 - DNA, 25 bp, Mus musculus
tcagctagcaatctgtaggtcttca

SEQ ID NO: 766625 - DNA, 25 bp, Mus musculus
tcagctagcaatgtgtaggtcttca

SEQ ID NO: 766626 - DNA, 25 bp, Mus musculus
tcagctagcagtcgcaggtgatcca

SEQ ID NO: 766627 - DNA, 25 bp, Mus musculus
tcagctagcagtggcaggtgatcca

SEQ ID NO: 766628 - DNA, 25 bp, Mus musculus
tcagctagtaagagccgcctgcaga

SEQ ID NO: 766629 - DNA, 25 bp, Mus musculus
tcagctagtaagtgccgcctgcaga

SEQ ID NO: 766630 - DNA, 25 bp, Mus musculus
tcagctagtccgctacagagaagtc

SEQ ID NO: 766631 - DNA, 25 bp, Mus musculus
tcagctagtccggtacagagaagtc

SEQ ID NO: 766632 - DNA, 25 bp, Mus musculus
tcagctataagacagctagacaatc

SEQ ID NO: 766633 - DNA, 25 bp, Mus musculus
tcagctataagagagctagacaatc

SEQ ID NO: 766634 - DNA, 25 bp, Mus musculus
tcagctatctgcctggtccattcag

SEQ ID NO: 766635 - DNA, 25 bp, Mus musculus
tcagctatctgcgtggtccattcag

SEQ ID NO: 766636 - DNA, 25 bp, Mus musculus
tcagctattgagaagctaacccacg

SEQ ID NO: 766637 - DNA, 25 bp, Mus musculus
tcagctattgagtagctaacccacg

SEQ ID NO: 766638 - DNA, 25 bp, Mus musculus
tcagctatttccaaagtcgctggga

SEQ ID NO: 766639 - DNA, 25 bp, Mus musculus
tcagctatttccatgatagtcacag

SEQ ID NO: 766640 - DNA, 25 bp, Mus musculus
tcagctatttcctaagtcgctggga

SEQ ID NO: 766641 - DNA, 25 bp, Mus musculus
tcagctatttccttgatagtcacag

SEQ ID NO: 766642 - DNA, 25 bp, Mus musculus
tcagctcaactgctgacccaaaggc

SEQ ID NO: 766643 - DNA, 25 bp, Mus musculus
tcagctcaactggtgacccaaaggc

SEQ ID NO: 766644 - DNA, 25 bp, Mus musculus
tcagctcaagtgctgtgtccagagg

SEQ ID NO: 766645 - DNA, 25 bp, Mus musculus
tcagctcaagtggtgtgtccagagg

SEQ ID NO: 766646 - DNA, 25 bp, Mus musculus
tcagctcaccaaagaaattaatcaa

SEQ ID NO: 766647 - DNA, 25 bp, Mus musculus
tcagctcaccaatgaaattaatcaa

SEQ ID NO: 766648 - DNA, 25 bp, Mus musculus
tcagctcagaaacttgggacttcct

SEQ ID NO: 766649 - DNA, 25 bp, Mus musculus
tcagctcagaaagttgggacttcct

SEQ ID NO: 766650 - DNA, 25 bp, Mus musculus
tcagctcagatcaccaaagccctgg

SEQ ID NO: 766651 - DNA, 25 bp, Mus musculus
tcagctcagatctccaaagccctgg

SEQ ID NO: 766652 - DNA, 25 bp, Mus musculus
tcagctcagcctcgagtaagcagag

SEQ ID NO: 766653 - DNA, 25 bp, Mus musculus
tcagctcagcctggagtaagcagag

SEQ ID NO: 766654 - DNA, 25 bp, Mus musculus
tcagctcataccacctttgggaaag

SEQ ID NO: 766655 - DNA, 25 bp, Mus musculus
tcagctcatacctcctttgggaaag

SEQ ID NO: 766656 - DNA, 25 bp, Mus musculus
tcagctcatgagatcccacgtggac

SEQ ID NO: 766657 - DNA, 25 bp, Mus musculus
tcagctcatgagttcccacgtggac

SEQ ID NO: 766658 - DNA, 25 bp, Mus musculus
tcagctccactgatgccaaactttg

SEQ ID NO: 766659 - DNA, 25 bp, Mus musculus
tcagctccactgttgccaaactttg

SEQ ID NO: 766660 - DNA, 25 bp, Mus musculus
tcagctccagagatcgtctttgaac

SEQ ID NO: 766661 - DNA, 25 bp, Mus musculus
tcagctccagagctatacaagtcag

SEQ ID NO: 766662 - DNA, 25 bp, Mus musculus
tcagctccagaggtatacaagtcag

SEQ ID NO: 766663 - DNA, 25 bp, Mus musculus
tcagctccagagttcgtctttgaac

SEQ ID NO: 766664 - DNA, 25 bp, Mus musculus
tcagctccagatcagctgagcttgg

SEQ ID NO: 766665 - DNA, 25 bp, Mus musculus
tcagctccagatgagctgagcttgg

SEQ ID NO: 766666 - DNA, 25 bp, Mus musculus
tcagctccattgatgaattttgccg

SEQ ID NO: 766667 - DNA, 25 bp, Mus musculus
tcagctccattgttgaattttgccg

SEQ ID NO: 766668 - DNA, 25 bp, Mus musculus
tcagctccccacaaaaacagaagca

SEQ ID NO: 766669 - DNA, 25 bp, Mus musculus
tcagctccccactaaaacagaagca

SEQ ID NO: 766670 - DNA, 25 bp, Mus musculus
tcagctcccgacagtttgtagggtc

SEQ ID NO: 766671 - DNA, 25 bp, Mus musculus
tcagctcccgactgtttgtagggtc

SEQ ID NO: 766672 - DNA, 25 bp, Mus musculus
tcagctcccggacctcagcgcgaag

SEQ ID NO: 766673 - DNA, 25 bp, Mus musculus
tcagctcccggagctcagcgcgaag

SEQ ID NO: 766674 - DNA, 25 bp, Mus musculus
tcagctccgaaacagggagcgactg

SEQ ID NO: 766675 - DNA, 25 bp, Mus musculus
tcagctccgaaagagggagcgactg

SEQ ID NO: 766676 - DNA, 25 bp, Mus musculus
tcagctccgaataacgtatagaaaa

SEQ ID NO: 766677 - DNA, 25 bp, Mus musculus
tcagctccgaattacgtatagaaaa

SEQ ID NO: 766678 - DNA, 25 bp, Mus musculus
tcagctccgccaaggatggtgttgg

SEQ ID NO: 766679 - DNA, 25 bp, Mus musculus
tcagctccgccatggatggtgttgg

SEQ ID NO: 766680 - DNA, 25 bp, Mus musculus
tcagctcctaagatggtaccactca

SEQ ID NO: 766681 - DNA, 25 bp, Mus musculus
tcagctcctaagttggtaccactca

SEQ ID NO: 766682 - DNA, 25 bp, Mus musculus
tcagctccttagctttgagaggcag

SEQ ID NO: 766683 - DNA, 25 bp, Mus musculus
tcagctccttaggtttgagaggcag

SEQ ID NO: 766684 - DNA, 25 bp, Mus musculus
tcagctcgaggaacgaggattaccc

SEQ ID NO: 766685 - DNA, 25 bp, Mus musculus
tcagctcgaggatcgaggattaccc

SEQ ID NO: 766686 - DNA, 25 bp, Mus musculus
tcagctcgattgctccaaattggag

SEQ ID NO: 766687 - DNA, 25 bp, Mus musculus
tcagctcgattggtccaaattggag

SEQ ID NO: 766688 - DNA, 25 bp, Mus musculus
tcagctcgctgcacatgcagacaga

SEQ ID NO: 766689 - DNA, 25 bp, Mus musculus
tcagctcgctgctcatgcagacaga

SEQ ID NO: 766690 - DNA, 25 bp, Mus musculus
tcagctcggcccacttcgttagcgg

SEQ ID NO: 766691 - DNA, 25 bp, Mus musculus
tcagctcggccctcttcgttagcgg

SEQ ID NO: 766692 - DNA, 25 bp, Mus musculus
tcagctcggctcactaatggcagct

SEQ ID NO: 766693 - DNA, 25 bp, Mus musculus
tcagctcggctctctaatggcagct

SEQ ID NO: 766694 - DNA, 25 bp, Mus musculus
tcagctctactcagactctgatgac

SEQ ID NO: 766695 - DNA, 25 bp, Mus musculus
tcagctctactctgactctgatgac

SEQ ID NO: 766696 - DNA, 25 bp, Mus musculus
tcagctctcaacacctaagtcaaag

SEQ ID NO: 766697 - DNA, 25 bp, Mus musculus
tcagctctcaactcctaagtcaaag

SEQ ID NO: 766698 - DNA, 25 bp, Mus musculus
tcagctctgacaaggcccactgaag

SEQ ID NO: 766699 - DNA, 25 bp, Mus musculus
tcagctctgacatggcccactgaag

SEQ ID NO: 766700 - DNA, 25 bp, Mus musculus
tcagctctgactagaaggacctgct

SEQ ID NO: 766701 - DNA, 25 bp, Mus musculus
tcagctctgactaggacgggcatcc

SEQ ID NO: 766702 - DNA, 25 bp, Mus musculus
tcagctctgacttgaaggacctgct

SEQ ID NO: 766703 - DNA, 25 bp, Mus musculus
tcagctctgacttggacgggcatcc

SEQ ID NO: 766704 - DNA, 25 bp, Mus musculus
tcagctctgagtcaaacatttaaca

SEQ ID NO: 766705 - DNA, 25 bp, Mus musculus
tcagctctgagtgaaacatttaaca

SEQ ID NO: 766706 - DNA, 25 bp, Mus musculus
tcagctctgggtcctggttactgtc

SEQ ID NO: 766707 - DNA, 25 bp, Mus musculus
tcagctctgggtgctggttactgtc

SEQ ID NO: 766708 - DNA, 25 bp, Mus musculus
tcagctgaaaatcggcagtgccctc

SEQ ID NO: 766709 - DNA, 25 bp, Mus musculus
tcagctgaaaatgggcagtgccctc

SEQ ID NO: 766710 - DNA, 25 bp, Mus musculus
tcagctgaaacaattgttgctacag

SEQ ID NO: 766711 - DNA, 25 bp, Mus musculus
tcagctgaaacatttgttgctacag

SEQ ID NO: 766712 - DNA, 25 bp, Mus musculus
tcagctgaacatctgccagcaggga

SEQ ID NO: 766713 - DNA, 25 bp, Mus musculus
tcagctgaacatgtgccagcaggga

SEQ ID NO: 766714 - DNA, 25 bp, Mus musculus
tcagctgaattaccatgtgagtaga

SEQ ID NO: 766715 - DNA, 25 bp, Mus musculus
tcagctgaattagcatgtgagtaga

SEQ ID NO: 766716 - DNA, 25 bp, Mus musculus
tcagctgaccagacatgtaaaatct

SEQ ID NO: 766717 - DNA, 25 bp, Mus musculus
tcagctgaccagtcatgtaaaatct

SEQ ID NO: 766718 - DNA, 25 bp, Mus musculus
tcagctgagcaacacaaacctctac

SEQ ID NO: 766719 - DNA, 25 bp, Mus musculus
tcagctgagcaagacaaacctctac

SEQ ID NO: 766720 - DNA, 25 bp, Mus musculus
tcagctgaggatccttgcagcttcc

SEQ ID NO: 766721 - DNA, 25 bp, Mus musculus
tcagctgaggatgcttgcagcttcc

SEQ ID NO: 766722 - DNA, 25 bp, Mus musculus
tcagctgatgaaatgttcaactttc

SEQ ID NO: 766723 - DNA, 25 bp, Mus musculus
tcagctgatgaattgttcaactttc

SEQ ID NO: 766724 - DNA, 25 bp, Mus musculus
tcagctgatgagagaacctccaggg

SEQ ID NO: 766725 - DNA, 25 bp, Mus musculus
tcagctgatgagtgaacctccaggg

SEQ ID NO: 766726 - DNA, 25 bp, Mus musculus
tcagctgatgctcaaggtgcacaag

SEQ ID NO: 766727 - DNA, 25 bp, Mus musculus
tcagctgatgctgaaggtgcacaag

SEQ ID NO: 766728 - DNA, 25 bp, Mus musculus
tcagctgcaaagaggaaccagagat

SEQ ID NO: 766729 - DNA, 25 bp, Mus musculus
tcagctgcaaagtggaaccagagat

SEQ ID NO: 766730 - DNA, 25 bp, Mus musculus
tcagctgcaagcagggaccaaaccc

SEQ ID NO: 766731 - DNA, 25 bp, Mus musculus
tcagctgcaagctgggaccaaaccc

SEQ ID NO: 766732 - DNA, 25 bp, Mus musculus
tcagctgcacaaaggccagtcctac

SEQ ID NO: 766733 - DNA, 25 bp, Mus musculus
tcagctgcacaatggccagtcctac

SEQ ID NO: 766734 - DNA, 25 bp, Mus musculus
tcagctgcacagcactccaatgcag

SEQ ID NO: 766735 - DNA, 25 bp, Mus musculus
tcagctgcacaggactccaatgcag

SEQ ID NO: 766736 - DNA, 25 bp, Mus musculus
tcagctgcataacggtctggacttc

SEQ ID NO: 766737 - DNA, 25 bp, Mus musculus
tcagctgcataagggtctggacttc

SEQ ID NO: 766738 - DNA, 25 bp, Mus musculus
tcagctgccaaaacgtcgtctcctg

SEQ ID NO: 766739 - DNA, 25 bp, Mus musculus
tcagctgccaaatcgtcgtctcctg

SEQ ID NO: 766740 - DNA, 25 bp, Mus musculus
tcagctgccctaactggaggccttc

SEQ ID NO: 766741 - DNA, 25 bp, Mus musculus
tcagctgccctatctggaggccttc

SEQ ID NO: 766742 - DNA, 25 bp, Mus musculus
tcagctgccctgagtttgccacggt

SEQ ID NO: 766743 - DNA, 25 bp, Mus musculus
tcagctgccctgtgtttgccacggt

SEQ ID NO: 766744 - DNA, 25 bp, Mus musculus
tcagctgcctgtatataactaccag

SEQ ID NO: 766745 - DNA, 25 bp, Mus musculus
tcagctgcctgtcttaacctgcatc

SEQ ID NO: 766746 - DNA, 25 bp, Mus musculus
tcagctgcctgtgttaacctgcatc

SEQ ID NO: 766747 - DNA, 25 bp, Mus musculus
tcagctgcctgtttataactaccag

SEQ ID NO: 766748 - DNA, 25 bp, Mus musculus
tcagctgcggagcatggagtcatcc

SEQ ID NO: 766749 - DNA, 25 bp, Mus musculus
tcagctgcggaggatggagtcatcc

SEQ ID NO: 766750 - DNA, 25 bp, Mus musculus
tcagctgcggctcctaaggaccgag

SEQ ID NO: 766751 - DNA, 25 bp, Mus musculus
tcagctgcggctgctaaggaccgag

SEQ ID NO: 766752 - DNA, 25 bp, Mus musculus
tcagctgctaaccagagtctgcggg

SEQ ID NO: 766753 - DNA, 25 bp, Mus musculus
tcagctgctaacgagagtctgcggg

SEQ ID NO: 766754 - DNA, 25 bp, Mus musculus
tcagctgctctaacgaatgcatggg

SEQ ID NO: 766755 - DNA, 25 bp, Mus musculus
tcagctgctctatcgaatgcatggg

SEQ ID NO: 766756 - DNA, 25 bp, Mus musculus
tcagctgctctcaggcgcctctgag

SEQ ID NO: 766757 - DNA, 25 bp, Mus musculus
tcagctgctctctggcgcctctgag

SEQ ID NO: 766758 - DNA, 25 bp, Mus musculus
tcagctgctggaagaagggaaaaca

SEQ ID NO: 766759 - DNA, 25 bp, Mus musculus
tcagctgctggatgaagggaaaaca

SEQ ID NO: 766760 - DNA, 25 bp, Mus musculus
tcagctgcttcacccagctcattga

SEQ ID NO: 766761 - DNA, 25 bp, Mus musculus
tcagctgcttcagccagctcattga

SEQ ID NO: 766762 - DNA, 25 bp, Mus musculus
tcagctgcttctatttagtggccct

SEQ ID NO: 766763 - DNA, 25 bp, Mus musculus
tcagctgcttctttttagtggccct

SEQ ID NO: 766764 - DNA, 25 bp, Mus musculus
tcagctgcttgtacgagcacatcag

SEQ ID NO: 766765 - DNA, 25 bp, Mus musculus
tcagctgcttgttcgagcacatcag

SEQ ID NO: 766766 - DNA, 25 bp, Mus musculus
tcagctggacaacgtgttcgtggcc

SEQ ID NO: 766767 - DNA, 25 bp, Mus musculus
tcagctggacaaggtgttcgtggcc

SEQ ID NO: 766768 - DNA, 25 bp, Mus musculus
tcagctggacagcacggttggacgg

SEQ ID NO: 766769 - DNA, 25 bp, Mus musculus
tcagctggacaggacggttggacgg

SEQ ID NO: 766770 - DNA, 25 bp, Mus musculus
tcagctggacggagcagtcatggct

SEQ ID NO: 766771 - DNA, 25 bp, Mus musculus
tcagctggacggtgcagtcatggct

SEQ ID NO: 766772 - DNA, 25 bp, Mus musculus
tcagctggaggtccctgttttgaaa

SEQ ID NO: 766773 - DNA, 25 bp, Mus musculus
tcagctggaggtgcctgttttgaaa

SEQ ID NO: 766774 - DNA, 25 bp, Mus musculus
tcagctggatcaacgagctgctgga

SEQ ID NO: 766775 - DNA, 25 bp, Mus musculus
tcagctggatcatcgagctgctgga

SEQ ID NO: 766776 - DNA, 25 bp, Mus musculus
tcagctggattgaaaacggaaatgc

SEQ ID NO: 766777 - DNA, 25 bp, Mus musculus
tcagctggattgtaaacggaaatgc

SEQ ID NO: 766778 - DNA, 25 bp, Mus musculus
tcagctggctacctccatgtgaaca

SEQ ID NO: 766779 - DNA, 25 bp, Mus musculus
tcagctggctacgtccatgtgaaca

SEQ ID NO: 766780 - DNA, 25 bp, Mus musculus
tcagctgggctcagccagtcacgtg

SEQ ID NO: 766781 - DNA, 25 bp, Mus musculus
tcagctgggctctgccagtcacgtg

SEQ ID NO: 766782 - DNA, 25 bp, Mus musculus
tcagctgggcttagccctacccagg

SEQ ID NO: 766783 - DNA, 25 bp, Mus musculus
tcagctgggctttgccctacccagg

SEQ ID NO: 766784 - DNA, 25 bp, Mus musculus
tcagctgggtctcttagcagagctt

SEQ ID NO: 766785 - DNA, 25 bp, Mus musculus
tcagctgggtctgttagcagagctt

SEQ ID NO: 766786 - DNA, 25 bp, Mus musculus
tcagctggtcctaggagagtccgtc

SEQ ID NO: 766787 - DNA, 25 bp, Mus musculus
tcagctggtccttggagagtccgtc

SEQ ID NO: 766788 - DNA, 25 bp, Mus musculus
tcagctgtaagaacatagaacttcc

SEQ ID NO: 766789 - DNA, 25 bp, Mus musculus
tcagctgtaagactgaccgatcagt

SEQ ID NO: 766790 - DNA, 25 bp, Mus musculus
tcagctgtaagagtgaccgatcagt

SEQ ID NO: 766791 - DNA, 25 bp, Mus musculus
tcagctgtaagatcatagaacttcc

SEQ ID NO: 766792 - DNA, 25 bp, Mus musculus
tcagctgtatgacgtctggctccag

SEQ ID NO: 766793 - DNA, 25 bp, Mus musculus
tcagctgtatgaggtctggctccag

SEQ ID NO: 766794 - DNA, 25 bp, Mus musculus
tcagctgtccaaaaacattacccgg

SEQ ID NO: 766795 - DNA, 25 bp, Mus musculus
tcagctgtccaaagagtgaagttcg

SEQ ID NO: 766796 - DNA, 25 bp, Mus musculus
tcagctgtccaataacattacccgg

SEQ ID NO: 766797 - DNA, 25 bp, Mus musculus
tcagctgtccaatgagtgaagttcg

SEQ ID NO: 766798 - DNA, 25 bp, Mus musculus
tcagctgtccctcgtgaccagcagg

SEQ ID NO: 766799 - DNA, 25 bp, Mus musculus
tcagctgtccctggtgaccagcagg

SEQ ID NO: 766800 - DNA, 25 bp, Mus musculus
tcagctgtcctgaaatgggagagcg

SEQ ID NO: 766801 - DNA, 25 bp, Mus musculus
tcagctgtcctgtaatgggagagcg

SEQ ID NO: 766802 - DNA, 25 bp, Mus musculus
tcagctgtctccagggaggccagca

SEQ ID NO: 766803 - DNA, 25 bp, Mus musculus
tcagctgtctcctgggaggccagca

SEQ ID NO: 766804 - DNA, 25 bp, Mus musculus
tcagctgtgaatactgtgagcagcg

SEQ ID NO: 766805 - DNA, 25 bp, Mus musculus
tcagctgtgaattctgtgagcagcg

SEQ ID NO: 766806 - DNA, 25 bp, Mus musculus
tcagctgtgattcagggacctcccg

SEQ ID NO: 766807 - DNA, 25 bp, Mus musculus
tcagctgtgattgagggacctcccg

SEQ ID NO: 766808 - DNA, 25 bp, Mus musculus
tcagctgtgccacccggagtatatc

SEQ ID NO: 766809 - DNA, 25 bp, Mus musculus
tcagctgtgccagccggagtatatc

SEQ ID NO: 766810 - DNA, 25 bp, Mus musculus
tcagctgtggcgcataagcacgaat

SEQ ID NO: 766811 - DNA, 25 bp, Mus musculus
tcagctgtggcggataagcacgaat

SEQ ID NO: 766812 - DNA, 25 bp, Mus musculus
tcagctgtgtgaatgctctgaggct

SEQ ID NO: 766813 - DNA, 25 bp, Mus musculus
tcagctgtgtgattgctctgaggct

SEQ ID NO: 766814 - DNA, 25 bp, Mus musculus
tcagctgtgtgcaccgcaggatgcg

SEQ ID NO: 766815 - DNA, 25 bp, Mus musculus
tcagctgtgtgcagccagttacccc

SEQ ID NO: 766816 - DNA, 25 bp, Mus musculus
tcagctgtgtgctccgcaggatgcg

SEQ ID NO: 766817 - DNA, 25 bp, Mus musculus
tcagctgtgtgctgccagttacccc

SEQ ID NO: 766818 - DNA, 25 bp, Mus musculus
tcagctgtttatagacaagttggat

SEQ ID NO: 766819 - DNA, 25 bp, Mus musculus
tcagctgtttattgacaagttggat

SEQ ID NO: 766820 - DNA, 25 bp, Mus musculus
tcagctgtttctatgggaatacggg

SEQ ID NO: 766821 - DNA, 25 bp, Mus musculus
tcagctgtttctttgggaatacggg

SEQ ID NO: 766822 - DNA, 25 bp, Mus musculus
tcagcttaaattatctccgagtttt

SEQ ID NO: 766823 - DNA, 25 bp, Mus musculus
tcagcttaaattttctccgagtttt

SEQ ID NO: 766824 - DNA, 25 bp, Mus musculus
tcagcttatggacaaccgcatggtg

SEQ ID NO: 766825 - DNA, 25 bp, Mus musculus
tcagcttatggagaaccgcatggtg

SEQ ID NO: 766826 - DNA, 25 bp, Mus musculus
tcagcttattgaccagccagggttt

SEQ ID NO: 766827 - DNA, 25 bp, Mus musculus
tcagcttattgagcagccagggttt

SEQ ID NO: 766828 - DNA, 25 bp, Mus musculus
tcagcttcattcagagctgcctggc

SEQ ID NO: 766829 - DNA, 25 bp, Mus musculus
tcagcttcattctgagctgcctggc

SEQ ID NO: 766830 - DNA, 25 bp, Mus musculus
tcagcttccaggagcctcacttcta

SEQ ID NO: 766831 - DNA, 25 bp, Mus musculus
tcagcttccaggtgcctcacttcta

SEQ ID NO: 766832 - DNA, 25 bp, Mus musculus
tcagcttcctctagggcatgaccgg

SEQ ID NO: 766833 - DNA, 25 bp, Mus musculus
tcagcttcctcttgggcatgaccgg

SEQ ID NO: 766834 - DNA, 25 bp, Mus musculus
tcagcttcgagaacccctttgagca

SEQ ID NO: 766835 - DNA, 25 bp, Mus musculus
tcagcttcgagatcccctttgagca

SEQ ID NO: 766836 - DNA, 25 bp, Mus musculus
tcagcttctccaaggagtctacgcc

SEQ ID NO: 766837 - DNA, 25 bp, Mus musculus
tcagcttctccatggagtctacgcc

SEQ ID NO: 766838 - DNA, 25 bp, Mus musculus
tcagcttctctcagcctgtgagtcc

SEQ ID NO: 766839 - DNA, 25 bp, Mus musculus
tcagcttctctctgcctgtgagtcc

SEQ ID NO: 766840 - DNA, 25 bp, Mus musculus
tcagcttctgccaatctcactgtgc

SEQ ID NO: 766841 - DNA, 25 bp, Mus musculus
tcagcttctgcctatctcactgtgc

SEQ ID NO: 766842 - DNA, 25 bp, Mus musculus
tcagcttctggaatgagccacagcc

SEQ ID NO: 766843 - DNA, 25 bp, Mus musculus
tcagcttctggattgagccacagcc

SEQ ID NO: 766844 - DNA, 25 bp, Mus musculus
tcagcttctgtcacagtgccggcgg

SEQ ID NO: 766845 - DNA, 25 bp, Mus musculus
tcagcttctgtctcagtgccggcgg

SEQ ID NO: 766846 - DNA, 25 bp, Mus musculus
tcagcttgaccaagcgcctctacta

SEQ ID NO: 766847 - DNA, 25 bp, Mus musculus
tcagcttgaccatgcgcctctacta

SEQ ID NO: 766848 - DNA, 25 bp, Mus musculus
tcagcttgactactcttctggacaa

SEQ ID NO: 766849 - DNA, 25 bp, Mus musculus
tcagcttgactagtcttctggacaa

SEQ ID NO: 766850 - DNA, 25 bp, Mus musculus
tcagcttgcctactacagacttcat

SEQ ID NO: 766851 - DNA, 25 bp, Mus musculus
tcagcttgcctagtacagacttcat

SEQ ID NO: 766852 - DNA, 25 bp, Mus musculus
tcagcttgctacatggacttattgt

SEQ ID NO: 766853 - DNA, 25 bp, Mus musculus
tcagcttgctacttggacttattgt

SEQ ID NO: 766854 - DNA, 25 bp, Mus musculus
tcagcttggattctcttgggccccg

SEQ ID NO: 766855 - DNA, 25 bp, Mus musculus
tcagcttggattgtcttgggccccg

SEQ ID NO: 766856 - DNA, 25 bp, Mus musculus
tcagcttgggcaaatgtgtgcctgt

SEQ ID NO: 766857 - DNA, 25 bp, Mus musculus
tcagcttgggcatatgtgtgcctgt

SEQ ID NO: 766858 - DNA, 25 bp, Mus musculus
tcagcttgtagccttttctgctgct

SEQ ID NO: 766859 - DNA, 25 bp, Mus musculus
tcagcttgtagcgttttctgctgct

SEQ ID NO: 766860 - DNA, 25 bp, Mus musculus
tcagcttgtcatctgtctattccca

SEQ ID NO: 766861 - DNA, 25 bp, Mus musculus
tcagcttgtcatgtgtctattccca

SEQ ID NO: 766862 - DNA, 25 bp, Mus musculus
tcagcttgtctgactcctaggaaag

SEQ ID NO: 766863 - DNA, 25 bp, Mus musculus
tcagcttgtctgtctcctaggaaag

SEQ ID NO: 766864 - DNA, 25 bp, Mus musculus
tcagcttgttagagttgggactgct

SEQ ID NO: 766865 - DNA, 25 bp, Mus musculus
tcagcttgttagtgttgggactgct

SEQ ID NO: 766866 - DNA, 25 bp, Mus musculus
tcagctttaaagagcaggagctcaa

SEQ ID NO: 766867 - DNA, 25 bp, Mus musculus
tcagctttaaagtgcaggagctcaa

SEQ ID NO: 766868 - DNA, 25 bp, Mus musculus
tcagctttaggaaatataagggtgt

SEQ ID NO: 766869 - DNA, 25 bp, Mus musculus
tcagctttaggatatataagggtgt

SEQ ID NO: 766870 - DNA, 25 bp, Mus musculus
tcagctttcaaaatccttctcagga

SEQ ID NO: 766871 - DNA, 25 bp, Mus musculus
tcagctttcaaattccttctcagga

SEQ ID NO: 766872 - DNA, 25 bp, Mus musculus
tcagctttccttcactccttgggag

SEQ ID NO: 766873 - DNA, 25 bp, Mus musculus
tcagctttccttgactccttgggag

SEQ ID NO: 766874 - DNA, 25 bp, Mus musculus
tcagctttcgccagcgtccggtatt

SEQ ID NO: 766875 - DNA, 25 bp, Mus musculus
tcagctttcgcctgcgtccggtatt

SEQ ID NO: 766876 - DNA, 25 bp, Mus musculus
tcagctttgccacggtcacattatg

SEQ ID NO: 766877 - DNA, 25 bp, Mus musculus
tcagctttgccagggtcacattatg

SEQ ID NO: 766878 - DNA, 25 bp, Mus musculus
tcagctttgtgaactcatcaacaag

SEQ ID NO: 766879 - DNA, 25 bp, Mus musculus
tcagctttgtgatctcatcaacaag

SEQ ID NO: 766880 - DNA, 25 bp, Mus musculus
tcagcttttctgcataagcaccatg

SEQ ID NO: 766881 - DNA, 25 bp, Mus musculus
tcagcttttctggataagcaccatg

SEQ ID NO: 766882 - DNA, 25 bp, Mus musculus
tcaggaaacaagctcggcagctgga

SEQ ID NO: 766883 - DNA, 25 bp, Mus musculus
tcaggaaacaaggtcggcagctgga

SEQ ID NO: 766884 - DNA, 25 bp, Mus musculus
tcaggaaacaccaaactcacgcgca

SEQ ID NO: 766885 - DNA, 25 bp, Mus musculus
tcaggaaacacctaactcacgcgca

SEQ ID NO: 766886 - DNA, 25 bp, Mus musculus
tcaggaaacactcgaatgcgaagtg

SEQ ID NO: 766887 - DNA, 25 bp, Mus musculus
tcaggaaacactggaatgcgaagtg

SEQ ID NO: 766888 - DNA, 25 bp, Mus musculus
tcaggaaaccaaagtcccagtggcc

SEQ ID NO: 766889 - DNA, 25 bp, Mus musculus
tcaggaaaccaatgtcccagtggcc

SEQ ID NO: 766890 - DNA, 25 bp, Mus musculus
tcaggaaagggcacccagtgcgaga

SEQ ID NO: 766891 - DNA, 25 bp, Mus musculus
tcaggaaagggctcccagtgcgaga

SEQ ID NO: 766892 - DNA, 25 bp, Mus musculus
tcaggaaattagcacaggcacccgg

SEQ ID NO: 766893 - DNA, 25 bp, Mus musculus
tcaggaaattaggacaggcacccgg

SEQ ID NO: 766894 - DNA, 25 bp, Mus musculus
tcaggaacaaacacagccaggcaga

SEQ ID NO: 766895 - DNA, 25 bp, Mus musculus
tcaggaacaaactcagccaggcaga

SEQ ID NO: 766896 - DNA, 25 bp, Mus musculus
tcaggaacagctcgagaatggccct

SEQ ID NO: 766897 - DNA, 25 bp, Mus musculus
tcaggaacagctggagaatggccct

SEQ ID NO: 766898 - DNA, 25 bp, Mus musculus
tcaggaacgccaccgagaacgagaa

SEQ ID NO: 766899 - DNA, 25 bp, Mus musculus
tcaggaacgccagcgagaacgagaa

SEQ ID NO: 766900 - DNA, 25 bp, Mus musculus
tcaggaactatacctcgcccacaag

SEQ ID NO: 766901 - DNA, 25 bp, Mus musculus
tcaggaactatagctcgcccacaag

SEQ ID NO: 766902 - DNA, 25 bp, Mus musculus
tcaggaactccacagttataacatt

SEQ ID NO: 766903 - DNA, 25 bp, Mus musculus
tcaggaactccagagttataacatt

SEQ ID NO: 766904 - DNA, 25 bp, Mus musculus
tcaggaactgctaaaatctcctttg

SEQ ID NO: 766905 - DNA, 25 bp, Mus musculus
tcaggaactgcttaaatctcctttg

SEQ ID NO: 766906 - DNA, 25 bp, Mus musculus
tcaggaactggtccaggcctggagc

SEQ ID NO: 766907 - DNA, 25 bp, Mus musculus
tcaggaactggtgcaggcctggagc

SEQ ID NO: 766908 - DNA, 25 bp, Mus musculus
tcaggaacttcccaagaggagctgc

SEQ ID NO: 766909 - DNA, 25 bp, Mus musculus
tcaggaacttccgaagaggagctgc

SEQ ID NO: 766910 - DNA, 25 bp, Mus musculus
tcaggaagaatccagagattcaggc

SEQ ID NO: 766911 - DNA, 25 bp, Mus musculus
tcaggaagaatcgagagattcaggc

SEQ ID NO: 766912 - DNA, 25 bp, Mus musculus
tcaggaagacttcatgaaagcagtc

SEQ ID NO: 766913 - DNA, 25 bp, Mus musculus
tcaggaagacttgatgaaagcagtc

SEQ ID NO: 766914 - DNA, 25 bp, Mus musculus
tcaggaagagatagcttgatttttc

SEQ ID NO: 766915 - DNA, 25 bp, Mus musculus
tcaggaagagattgcttgatttttc

SEQ ID NO: 766916 - DNA, 25 bp, Mus musculus
tcaggaagatgccatttattggacg

SEQ ID NO: 766917 - DNA, 25 bp, Mus musculus
tcaggaagatgcgatttattggacg

SEQ ID NO: 766918 - DNA, 25 bp, Mus musculus
tcaggaagattaccacggtcacaac

SEQ ID NO: 766919 - DNA, 25 bp, Mus musculus
tcaggaagattagcacggtcacaac

SEQ ID NO: 766920 - DNA, 25 bp, Mus musculus
tcaggaagcagtagcctccaccagg

SEQ ID NO: 766921 - DNA, 25 bp, Mus musculus
tcaggaagcagttgcctccaccagg

SEQ ID NO: 766922 - DNA, 25 bp, Mus musculus
tcaggaagccgtccaatcgttgtgg

SEQ ID NO: 766923 - DNA, 25 bp, Mus musculus
tcaggaagccgtgcaatcgttgtgg

SEQ ID NO: 766924 - DNA, 25 bp, Mus musculus
tcaggaagcctcagctctcttatgg

SEQ ID NO: 766925 - DNA, 25 bp, Mus musculus
tcaggaagcctctgctctcttatgg

SEQ ID NO: 766926 - DNA, 25 bp, Mus musculus
tcaggaagctcaagtgctccacagg

SEQ ID NO: 766927 - DNA, 25 bp, Mus musculus
tcaggaagctcatgtgctccacagg

SEQ ID NO: 766928 - DNA, 25 bp, Mus musculus
tcaggaagctggaaatgagagtaag

SEQ ID NO: 766929 - DNA, 25 bp, Mus musculus
tcaggaagctggtaatgagagtaag

SEQ ID NO: 766930 - DNA, 25 bp, Mus musculus
tcaggaagtcctctccaatggctgt

SEQ ID NO: 766931 - DNA, 25 bp, Mus musculus
tcaggaagtcctgtccaatggctgt

SEQ ID NO: 766932 - DNA, 25 bp, Mus musculus
tcaggaagttcccagggcacctgcg

SEQ ID NO: 766933 - DNA, 25 bp, Mus musculus
tcaggaagttccgagggcacctgcg

SEQ ID NO: 766934 - DNA, 25 bp, Mus musculus
tcaggaagttttcctgttcgagtca

SEQ ID NO: 766935 - DNA, 25 bp, Mus musculus
tcaggaagttttgctgttcgagtca

SEQ ID NO: 766936 - DNA, 25 bp, Mus musculus
tcaggaatacgacgtggtgagcaca

SEQ ID NO: 766937 - DNA, 25 bp, Mus musculus
tcaggaatacgaggtggtgagcaca

SEQ ID NO: 766938 - DNA, 25 bp, Mus musculus
tcaggaatagacctctgacagtgtc

SEQ ID NO: 766939 - DNA, 25 bp, Mus musculus
tcaggaatagacgtctgacagtgtc

SEQ ID NO: 766940 - DNA, 25 bp, Mus musculus
tcaggaatctcacggcctcctaggg

SEQ ID NO: 766941 - DNA, 25 bp, Mus musculus
tcaggaatctcagggcctcctaggg

SEQ ID NO: 766942 - DNA, 25 bp, Mus musculus
tcaggaatgactccccgtgtggtac

SEQ ID NO: 766943 - DNA, 25 bp, Mus musculus
tcaggaatgactgcccgtgtggtac

SEQ ID NO: 766944 - DNA, 25 bp, Mus musculus
tcaggaatgagcatgtggagccccg

SEQ ID NO: 766945 - DNA, 25 bp, Mus musculus
tcaggaatgagcttgtggagccccg

SEQ ID NO: 766946 - DNA, 25 bp, Mus musculus
tcaggaatggtacctcccactaaca

SEQ ID NO: 766947 - DNA, 25 bp, Mus musculus
tcaggaatggtagctcccactaaca

SEQ ID NO: 766948 - DNA, 25 bp, Mus musculus
tcaggaattgcgcagcctcttcgag

SEQ ID NO: 766949 - DNA, 25 bp, Mus musculus
tcaggaattgcggagcctcttcgag

SEQ ID NO: 766950 - DNA, 25 bp, Mus musculus
tcaggaatttctccatgagctgaaa

SEQ ID NO: 766951 - DNA, 25 bp, Mus musculus
tcaggaatttctgcatgagctgaaa

SEQ ID NO: 766952 - DNA, 25 bp, Mus musculus
tcaggacaagtgaaacctttaagct

SEQ ID NO: 766953 - DNA, 25 bp, Mus musculus
tcaggacaagtgtaacctttaagct

SEQ ID NO: 766954 - DNA, 25 bp, Mus musculus
tcaggacacacaaaagcccagagag

SEQ ID NO: 766955 - DNA, 25 bp, Mus musculus
tcaggacacacataagcccagagag

SEQ ID NO: 766956 - DNA, 25 bp, Mus musculus
tcaggacacccaccaagatcaagga

SEQ ID NO: 766957 - DNA, 25 bp, Mus musculus
tcaggacacccagcaagatcaagga

SEQ ID NO: 766958 - DNA, 25 bp, Mus musculus
tcaggacacctaaccctctttcaag

SEQ ID NO: 766959 - DNA, 25 bp, Mus musculus
tcaggacacctatccctctttcaag

SEQ ID NO: 766960 - DNA, 25 bp, Mus musculus
tcaggacacggaagcgcaagtcaga

SEQ ID NO: 766961 - DNA, 25 bp, Mus musculus
tcaggacacggatgcgcaagtcaga

SEQ ID NO: 766962 - DNA, 25 bp, Mus musculus
tcaggacactgtcatatgttcgcgt

SEQ ID NO: 766963 - DNA, 25 bp, Mus musculus
tcaggacactgtgatatgttcgcgt

SEQ ID NO: 766964 - DNA, 25 bp, Mus musculus
tcaggacagactcaggaggattcct

SEQ ID NO: 766965 - DNA, 25 bp, Mus musculus
tcaggacagactgaggaggattcct

SEQ ID NO: 766966 - DNA, 25 bp, Mus musculus
tcaggacagcagctaactggcatac

SEQ ID NO: 766967 - DNA, 25 bp, Mus musculus
tcaggacagcaggtaactggcatac

SEQ ID NO: 766968 - DNA, 25 bp, Mus musculus
tcaggacagcgaaactctggaatgg

SEQ ID NO: 766969 - DNA, 25 bp, Mus musculus
tcaggacagcgatactctggaatgg

SEQ ID NO: 766970 - DNA, 25 bp, Mus musculus
tcaggacagtcacagaagccaatga

SEQ ID NO: 766971 - DNA, 25 bp, Mus musculus
tcaggacagtcagagaagccaatga

SEQ ID NO: 766972 - DNA, 25 bp, Mus musculus
tcaggacagttgaatgagtacacgg

SEQ ID NO: 766973 - DNA, 25 bp, Mus musculus
tcaggacagttgtatgagtacacgg

SEQ ID NO: 766974 - DNA, 25 bp, Mus musculus
tcaggacatggacgtgccggatgca

SEQ ID NO: 766975 - DNA, 25 bp, Mus musculus
tcaggacatggaggtgccggatgca

SEQ ID NO: 766976 - DNA, 25 bp, Mus musculus
tcaggaccatcacaggagaactttg

SEQ ID NO: 766977 - DNA, 25 bp, Mus musculus
tcaggaccatcagaggagaactttg

SEQ ID NO: 766978 - DNA, 25 bp, Mus musculus
tcaggaccccgaacgatatatgcaa

SEQ ID NO: 766979 - DNA, 25 bp, Mus musculus
tcaggaccccgatcgatatatgcaa

SEQ ID NO: 766980 - DNA, 25 bp, Mus musculus
tcaggaccgtgacactggaaagtca

SEQ ID NO: 766981 - DNA, 25 bp, Mus musculus
tcaggaccgtgagactggaaagtca

SEQ ID NO: 766982 - DNA, 25 bp, Mus musculus
tcaggaccgtttcgaggtcaacatc

SEQ ID NO: 766983 - DNA, 25 bp, Mus musculus
tcaggaccgtttggaggtcaacatc

SEQ ID NO: 766984 - DNA, 25 bp, Mus musculus
tcaggacctgagctgtttgtagcct

SEQ ID NO: 766985 - DNA, 25 bp, Mus musculus
tcaggacctgaggtgtttgtagcct

SEQ ID NO: 766986 - DNA, 25 bp, Mus musculus
tcaggaccttcgagtgctcaatgct

SEQ ID NO: 766987 - DNA, 25 bp, Mus musculus
tcaggaccttcgtgtgctcaatgct

SEQ ID NO: 766988 - DNA, 25 bp, Mus musculus
tcaggaccttgacacagacgacttt

SEQ ID NO: 766989 - DNA, 25 bp, Mus musculus
tcaggaccttgagacagacgacttt

SEQ ID NO: 766990 - DNA, 25 bp, Mus musculus
tcaggacgaagccatcaagatattc

SEQ ID NO: 766991 - DNA, 25 bp, Mus musculus
tcaggacgaagcgatcaagatattc

SEQ ID NO: 766992 - DNA, 25 bp, Mus musculus
tcaggacgacaaacaccaggagttg

SEQ ID NO: 766993 - DNA, 25 bp, Mus musculus
tcaggacgacaatcaccaggagttg

SEQ ID NO: 766994 - DNA, 25 bp, Mus musculus
tcaggacgagcacttgcatgcaggc

SEQ ID NO: 766995 - DNA, 25 bp, Mus musculus
tcaggacgagcagttgcatgcaggc

SEQ ID NO: 766996 - DNA, 25 bp, Mus musculus
tcaggacgaggaaccaaaaacagag

SEQ ID NO: 766997 - DNA, 25 bp, Mus musculus
tcaggacgaggatccaaaaacagag

SEQ ID NO: 766998 - DNA, 25 bp, Mus musculus
tcaggacgaggcagaagaagacgtt

SEQ ID NO: 766999 - DNA, 25 bp, Mus musculus
tcaggacgaggctgaagaagacgtt

SEQ ID NO: 767000 - DNA, 25 bp, Mus musculus
tcaggacgcgtacaccttacgctgc

SEQ ID NO: 767001 - DNA, 25 bp, Mus musculus
tcaggacgcgtagaccttacgctgc

SEQ ID NO: 767002 - DNA, 25 bp, Mus musculus
tcaggacgctggctactaccagtgc

SEQ ID NO: 767003 - DNA, 25 bp, Mus musculus
tcaggacgctgggtactaccagtgc

SEQ ID NO: 767004 - DNA, 25 bp, Mus musculus
tcaggacgggagaaaggattcgcat

SEQ ID NO: 767005 - DNA, 25 bp, Mus musculus
tcaggacgggagtaaggattcgcat

SEQ ID NO: 767006 - DNA, 25 bp, Mus musculus
tcaggacggtacctgctctctgacc

SEQ ID NO: 767007 - DNA, 25 bp, Mus musculus
tcaggacggtacgtgctctctgacc

SEQ ID NO: 767008 - DNA, 25 bp, Mus musculus
tcaggacggtgaagtctgtaggcat

SEQ ID NO: 767009 - DNA, 25 bp, Mus musculus
tcaggacggtgatgtctgtaggcat

SEQ ID NO: 767010 - DNA, 25 bp, Mus musculus
tcaggactgaccagtgttgctgcac

SEQ ID NO: 767011 - DNA, 25 bp, Mus musculus
tcaggactgacctgtgttgctgcac

SEQ ID NO: 767012 - DNA, 25 bp, Mus musculus
tcaggactgatgaccatctggaccc

SEQ ID NO: 767013 - DNA, 25 bp, Mus musculus
tcaggactgatgtccatctggaccc

SEQ ID NO: 767014 - DNA, 25 bp, Mus musculus
tcaggactgctacctggtgaccaag

SEQ ID NO: 767015 - DNA, 25 bp, Mus musculus
tcaggactgctagctggtgaccaag

SEQ ID NO: 767016 - DNA, 25 bp, Mus musculus
tcaggactgctgaactggagaccat

SEQ ID NO: 767017 - DNA, 25 bp, Mus musculus
tcaggactgctgtactggagaccat

SEQ ID NO: 767018 - DNA, 25 bp, Mus musculus
tcaggactggatctccgcggcccga

SEQ ID NO: 767019 - DNA, 25 bp, Mus musculus
tcaggactggatgtccgcggcccga

SEQ ID NO: 767020 - DNA, 25 bp, Mus musculus
tcaggactgtggaagacgtaccgac

SEQ ID NO: 767021 - DNA, 25 bp, Mus musculus
tcaggactgtggtagacgtaccgac

SEQ ID NO: 767022 - DNA, 25 bp, Mus musculus
tcaggacttactagatgctgagaga

SEQ ID NO: 767023 - DNA, 25 bp, Mus musculus
tcaggacttactcttcaccgaaaag

SEQ ID NO: 767024 - DNA, 25 bp, Mus musculus
tcaggacttactgttcaccgaaaag

SEQ ID NO: 767025 - DNA, 25 bp, Mus musculus
tcaggacttacttgatgctgagaga

SEQ ID NO: 767026 - DNA, 25 bp, Mus musculus
tcaggactttgacaatacagcaatc

SEQ ID NO: 767027 - DNA, 25 bp, Mus musculus
tcaggactttgagaatacagcaatc

SEQ ID NO: 767028 - DNA, 25 bp, Mus musculus
tcaggagaaagaagctgttttgcgc

SEQ ID NO: 767029 - DNA, 25 bp, Mus musculus
tcaggagaaagatgctgttttgcgc

SEQ ID NO: 767030 - DNA, 25 bp, Mus musculus
tcaggagaaagtctgtagctgccac

SEQ ID NO: 767031 - DNA, 25 bp, Mus musculus
tcaggagaaagtgtgtagctgccac

SEQ ID NO: 767032 - DNA, 25 bp, Mus musculus
tcaggagaacttcggcatccttctg

SEQ ID NO: 767033 - DNA, 25 bp, Mus musculus
tcaggagaacttgggcatccttctg

SEQ ID NO: 767034 - DNA, 25 bp, Mus musculus
tcaggagacaatcagtagcatcagg

SEQ ID NO: 767035 - DNA, 25 bp, Mus musculus
tcaggagacaatgagtagcatcagg

SEQ ID NO: 767036 - DNA, 25 bp, Mus musculus
tcaggagacagcaggaactgcagat

SEQ ID NO: 767037 - DNA, 25 bp, Mus musculus
tcaggagacagctggaactgcagat

SEQ ID NO: 767038 - DNA, 25 bp, Mus musculus
tcaggagacgttcatccagatagct

SEQ ID NO: 767039 - DNA, 25 bp, Mus musculus
tcaggagacgttgatccagatagct

SEQ ID NO: 767040 - DNA, 25 bp, Mus musculus
tcaggagactaaagcggcgctgcaa

SEQ ID NO: 767041 - DNA, 25 bp, Mus musculus
tcaggagactaatgcggcgctgcaa

SEQ ID NO: 767042 - DNA, 25 bp, Mus musculus
tcaggagactagaccccttctgacc

SEQ ID NO: 767043 - DNA, 25 bp, Mus musculus
tcaggagactagtccccttctgacc

SEQ ID NO: 767044 - DNA, 25 bp, Mus musculus
tcaggagagccgagcaggaccattt

SEQ ID NO: 767045 - DNA, 25 bp, Mus musculus
tcaggagagccgtgcaggaccattt

SEQ ID NO: 767046 - DNA, 25 bp, Mus musculus
tcaggagagtggctgtgacccatcc

SEQ ID NO: 767047 - DNA, 25 bp, Mus musculus
tcaggagagtgggtgtgacccatcc

SEQ ID NO: 767048 - DNA, 25 bp, Mus musculus
tcaggagatggcattgatgctgtca

SEQ ID NO: 767049 - DNA, 25 bp, Mus musculus
tcaggagatggctttgatgctgtca

SEQ ID NO: 767050 - DNA, 25 bp, Mus musculus
tcaggagcaaccagtcaatgaaggc

SEQ ID NO: 767051 - DNA, 25 bp, Mus musculus
tcaggagcaacctgtcaatgaaggc

SEQ ID NO: 767052 - DNA, 25 bp, Mus musculus
tcaggagcaaggagccacagaacat

SEQ ID NO: 767053 - DNA, 25 bp, Mus musculus
tcaggagcaaggtgccacagaacat

SEQ ID NO: 767054 - DNA, 25 bp, Mus musculus
tcaggagcacatctcctacatcggg

SEQ ID NO: 767055 - DNA, 25 bp, Mus musculus
tcaggagcacatgtcctacatcggg

SEQ ID NO: 767056 - DNA, 25 bp, Mus musculus
tcaggagcagcaagccttgaagcac

SEQ ID NO: 767057 - DNA, 25 bp, Mus musculus
tcaggagcagcatgccttgaagcac

SEQ ID NO: 767058 - DNA, 25 bp, Mus musculus
tcaggagcaggaagacccagagttg

SEQ ID NO: 767059 - DNA, 25 bp, Mus musculus
tcaggagcaggatgacccagagttg

SEQ ID NO: 767060 - DNA, 25 bp, Mus musculus
tcaggagcagtgaggtgtggagccc

SEQ ID NO: 767061 - DNA, 25 bp, Mus musculus
tcaggagcagtgtggtgtggagccc

SEQ ID NO: 767062 - DNA, 25 bp, Mus musculus
tcaggagccaaactgaaaacattct

SEQ ID NO: 767063 - DNA, 25 bp, Mus musculus
tcaggagccaaagtgaaaacattct

SEQ ID NO: 767064 - DNA, 25 bp, Mus musculus
tcaggagccactcgagtccttgagt

SEQ ID NO: 767065 - DNA, 25 bp, Mus musculus
tcaggagccactctagcctcaggaa

SEQ ID NO: 767066 - DNA, 25 bp, Mus musculus
tcaggagccactggagtccttgagt

SEQ ID NO: 767067 - DNA, 25 bp, Mus musculus
tcaggagccactgtagcctcaggaa

SEQ ID NO: 767068 - DNA, 25 bp, Mus musculus
tcaggagccagtcaaagctgaccca

SEQ ID NO: 767069 - DNA, 25 bp, Mus musculus
tcaggagccagtgaaagctgaccca

SEQ ID NO: 767070 - DNA, 25 bp, Mus musculus
tcaggagcccagagacactgagcag

SEQ ID NO: 767071 - DNA, 25 bp, Mus musculus
tcaggagcccagtgacactgagcag

SEQ ID NO: 767072 - DNA, 25 bp, Mus musculus
tcaggagccgcgcagcgttcgctct

SEQ ID NO: 767073 - DNA, 25 bp, Mus musculus
tcaggagccgcggagcgttcgctct

SEQ ID NO: 767074 - DNA, 25 bp, Mus musculus
tcaggagcggagacacctggacttc

SEQ ID NO: 767075 - DNA, 25 bp, Mus musculus
tcaggagcggagtcacctggacttc

SEQ ID NO: 767076 - DNA, 25 bp, Mus musculus
tcaggagctccaatcaggaaaggtg

SEQ ID NO: 767077 - DNA, 25 bp, Mus musculus
tcaggagctccattcaggaaaggtg

SEQ ID NO: 767078 - DNA, 25 bp, Mus musculus
tcaggagctgtacaatagcgggctc

SEQ ID NO: 767079 - DNA, 25 bp, Mus musculus
tcaggagctgtagaatagcgggctc

SEQ ID NO: 767080 - DNA, 25 bp, Mus musculus
tcaggaggaaacatccatggtgaat

SEQ ID NO: 767081 - DNA, 25 bp, Mus musculus
tcaggaggaaacttccatggtgaat

SEQ ID NO: 767082 - DNA, 25 bp, Mus musculus
tcaggaggagtacgctctgctcaca

SEQ ID NO: 767083 - DNA, 25 bp, Mus musculus
tcaggaggagtaggctctgctcaca

SEQ ID NO: 767084 - DNA, 25 bp, Mus musculus
tcaggaggatgaagtagcacatact

SEQ ID NO: 767085 - DNA, 25 bp, Mus musculus
tcaggaggatgatgtagcacatact

SEQ ID NO: 767086 - DNA, 25 bp, Mus musculus
tcaggaggcaaacatctgttttaca

SEQ ID NO: 767087 - DNA, 25 bp, Mus musculus
tcaggaggcaaagatctgttttaca

SEQ ID NO: 767088 - DNA, 25 bp, Mus musculus
tcaggaggcatgaaacttgtgaact

SEQ ID NO: 767089 - DNA, 25 bp, Mus musculus
tcaggaggcatgtaacttgtgaact

SEQ ID NO: 767090 - DNA, 25 bp, Mus musculus
tcaggaggctgcagctccatctggg

SEQ ID NO: 767091 - DNA, 25 bp, Mus musculus
tcaggaggctgctgctccatctggg

SEQ ID NO: 767092 - DNA, 25 bp, Mus musculus
tcaggaggtattcaaccagttcagg

SEQ ID NO: 767093 - DNA, 25 bp, Mus musculus
tcaggaggtattgaaccagttcagg

SEQ ID NO: 767094 - DNA, 25 bp, Mus musculus
tcaggaggtcaacatcatccacagc

SEQ ID NO: 767095 - DNA, 25 bp, Mus musculus
tcaggaggtcaagatcatccacagc

SEQ ID NO: 767096 - DNA, 25 bp, Mus musculus
tcaggaggttgtatcttgcagcccc

SEQ ID NO: 767097 - DNA, 25 bp, Mus musculus
tcaggaggttgtttcttgcagcccc

SEQ ID NO: 767098 - DNA, 25 bp, Mus musculus
tcaggagtgcggatcccgcgaagac

SEQ ID NO: 767099 - DNA, 25 bp, Mus musculus
tcaggagtgcggttcccgcgaagac

SEQ ID NO: 767100 - DNA, 25 bp, Mus musculus
tcaggataacccagtgaccttagcc

SEQ ID NO: 767101 - DNA, 25 bp, Mus musculus
tcaggataaccctgtgaccttagcc

SEQ ID NO: 767102 - DNA, 25 bp, Mus musculus
tcaggatacagcctacaacaccaag

SEQ ID NO: 767103 - DNA, 25 bp, Mus musculus
tcaggatacagcgtacaacaccaag

SEQ ID NO: 767104 - DNA, 25 bp, Mus musculus
tcaggataggctcggacagctttca

SEQ ID NO: 767105 - DNA, 25 bp, Mus musculus
tcaggataggctgggacagctttca

SEQ ID NO: 767106 - DNA, 25 bp, Mus musculus
tcaggatatcctctgggaagaggtc

SEQ ID NO: 767107 - DNA, 25 bp, Mus musculus
tcaggatatcctgtgggaagaggtc

SEQ ID NO: 767108 - DNA, 25 bp, Mus musculus
tcaggatcaatcaatgacagtggcc

SEQ ID NO: 767109 - DNA, 25 bp, Mus musculus
tcaggatcaatctatgacagtggcc

SEQ ID NO: 767110 - DNA, 25 bp, Mus musculus
tcaggatccaaaagttgctgccttc

SEQ ID NO: 767111 - DNA, 25 bp, Mus musculus
tcaggatccaaatgttgctgccttc

SEQ ID NO: 767112 - DNA, 25 bp, Mus musculus
tcaggatcctgacttaaggcagttt

SEQ ID NO: 767113 - DNA, 25 bp, Mus musculus
tcaggatcctgagttaaggcagttt

SEQ ID NO: 767114 - DNA, 25 bp, Mus musculus
tcaggatcctgcagcactcagcttc

SEQ ID NO: 767115 - DNA, 25 bp, Mus musculus
tcaggatcctgctgcactcagcttc

SEQ ID NO: 767116 - DNA, 25 bp, Mus musculus
tcaggatctgcaacgtgaccaaaga

SEQ ID NO: 767117 - DNA, 25 bp, Mus musculus
tcaggatctgcatcgtgaccaaaga

SEQ ID NO: 767118 - DNA, 25 bp, Mus musculus
tcaggatcttatagaccgaggatgg

SEQ ID NO: 767119 - DNA, 25 bp, Mus musculus
tcaggatcttattgaccgaggatgg

SEQ ID NO: 767120 - DNA, 25 bp, Mus musculus
tcaggatgagctagctgcctcgttt

SEQ ID NO: 767121 - DNA, 25 bp, Mus musculus
tcaggatgagcttgctgcctcgttt

SEQ ID NO: 767122 - DNA, 25 bp, Mus musculus
tcaggatgaggcatatgaccggcgt

SEQ ID NO: 767123 - DNA, 25 bp, Mus musculus
tcaggatgaggcttatgaccggcgt

SEQ ID NO: 767124 - DNA, 25 bp, Mus musculus
tcaggatgattgaagagcgtcccac

SEQ ID NO: 767125 - DNA, 25 bp, Mus musculus
tcaggatgattgtagagcgtcccac

SEQ ID NO: 767126 - DNA, 25 bp, Mus musculus
tcaggatgcactatcaggctccagc

SEQ ID NO: 767127 - DNA, 25 bp, Mus musculus
tcaggatgcactttcaggctccagc

SEQ ID NO: 767128 - DNA, 25 bp, Mus musculus
tcaggatgccaccaacgctaaagct

SEQ ID NO: 767129 - DNA, 25 bp, Mus musculus
tcaggatgccacgaacgctaaagct

SEQ ID NO: 767130 - DNA, 25 bp, Mus musculus
tcaggatgcctaccggggagaattt

SEQ ID NO: 767131 - DNA, 25 bp, Mus musculus
tcaggatgcctagcggggagaattt

SEQ ID NO: 767132 - DNA, 25 bp, Mus musculus
tcaggatgctaaaccaatcctcatc

SEQ ID NO: 767133 - DNA, 25 bp, Mus musculus
tcaggatgctaatccaatcctcatc

SEQ ID NO: 767134 - DNA, 25 bp, Mus musculus
tcaggatggcctaaagatcttcagt

SEQ ID NO: 767135 - DNA, 25 bp, Mus musculus
tcaggatggcctctatcataagtgg

SEQ ID NO: 767136 - DNA, 25 bp, Mus musculus
tcaggatggcctgtatcataagtgg

SEQ ID NO: 767137 - DNA, 25 bp, Mus musculus
tcaggatggccttaagatcttcagt

SEQ ID NO: 767138 - DNA, 25 bp, Mus musculus
tcaggatggctgaattctgcggtca

SEQ ID NO: 767139 - DNA, 25 bp, Mus musculus
tcaggatggctgtattctgcggtca

SEQ ID NO: 767140 - DNA, 25 bp, Mus musculus
tcaggatgtcatcagcaccatcggg

SEQ ID NO: 767141 - DNA, 25 bp, Mus musculus
tcaggatgtcatgagcaccatcggg

SEQ ID NO: 767142 - DNA, 25 bp, Mus musculus
tcaggatgtccaagagccacatcag

SEQ ID NO: 767143 - DNA, 25 bp, Mus musculus
tcaggatgtccatgagccacatcag

SEQ ID NO: 767144 - DNA, 25 bp, Mus musculus
tcaggatgtcctaccaaggcaagaa

SEQ ID NO: 767145 - DNA, 25 bp, Mus musculus
tcaggatgtccttccaaggcaagaa

SEQ ID NO: 767146 - DNA, 25 bp, Mus musculus
tcaggatgttggaccagacaaggga

SEQ ID NO: 767147 - DNA, 25 bp, Mus musculus
tcaggatgttggtccagacaaggga

SEQ ID NO: 767148 - DNA, 25 bp, Mus musculus
tcaggattcctcaaacacatttggc

SEQ ID NO: 767149 - DNA, 25 bp, Mus musculus
tcaggattcctctaacacatttggc

SEQ ID NO: 767150 - DNA, 25 bp, Mus musculus
tcaggattggccaagatgacttacc

SEQ ID NO: 767151 - DNA, 25 bp, Mus musculus
tcaggattggcctagatgacttacc

SEQ ID NO: 767152 - DNA, 25 bp, Mus musculus
tcaggatttgagagcccatcacggg

SEQ ID NO: 767153 - DNA, 25 bp, Mus musculus
tcaggatttgagtgcccatcacggg

SEQ ID NO: 767154 - DNA, 25 bp, Mus musculus
tcaggatttggcaatatcaacagtg

SEQ ID NO: 767155 - DNA, 25 bp, Mus musculus
tcaggatttggctatatcaacagtg

SEQ ID NO: 767156 - DNA, 25 bp, Mus musculus
tcaggcaaaaggatggtagaactag

SEQ ID NO: 767157 - DNA, 25 bp, Mus musculus
tcaggcaaaaggttggtagaactag

SEQ ID NO: 767158 - DNA, 25 bp, Mus musculus
tcaggcaacccaaacttacggacta

SEQ ID NO: 767159 - DNA, 25 bp, Mus musculus
tcaggcaacccatacttacggacta

SEQ ID NO: 767160 - DNA, 25 bp, Mus musculus
tcaggcaactataagtacatagccc

SEQ ID NO: 767161 - DNA, 25 bp, Mus musculus
tcaggcaactattagtacatagccc

SEQ ID NO: 767162 - DNA, 25 bp, Mus musculus
tcaggcaacttcagccaagtggact

SEQ ID NO: 767163 - DNA, 25 bp, Mus musculus
tcaggcaacttctgccaagtggact

SEQ ID NO: 767164 - DNA, 25 bp, Mus musculus
tcaggcaagagaattgttatccaaa

SEQ ID NO: 767165 - DNA, 25 bp, Mus musculus
tcaggcaagagatttgttatccaaa

SEQ ID NO: 767166 - DNA, 25 bp, Mus musculus
tcaggcaagcccagaagttccgaca

SEQ ID NO: 767167 - DNA, 25 bp, Mus musculus
tcaggcaagccctgaagttccgaca

SEQ ID NO: 767168 - DNA, 25 bp, Mus musculus
tcaggcaatgtgactgaaggagaca

SEQ ID NO: 767169 - DNA, 25 bp, Mus musculus
tcaggcaatgtgtctgaaggagaca

SEQ ID NO: 767170 - DNA, 25 bp, Mus musculus
tcaggcacatgcatcagctcttctc

SEQ ID NO: 767171 - DNA, 25 bp, Mus musculus
tcaggcacatgcttcagctcttctc

SEQ ID NO: 767172 - DNA, 25 bp, Mus musculus
tcaggcaccttgcagagcaacttct

SEQ ID NO: 767173 - DNA, 25 bp, Mus musculus
tcaggcaccttggagagcaacttct

SEQ ID NO: 767174 - DNA, 25 bp, Mus musculus
tcaggcacgagaattacgatgaggc

SEQ ID NO: 767175 - DNA, 25 bp, Mus musculus
tcaggcacgagatttacgatgaggc

SEQ ID NO: 767176 - DNA, 25 bp, Mus musculus
tcaggcactctcatcggttcatggg

SEQ ID NO: 767177 - DNA, 25 bp, Mus musculus
tcaggcactctcttcggttcatggg

SEQ ID NO: 767178 - DNA, 25 bp, Mus musculus
tcaggcagaatcacacataaccctt

SEQ ID NO: 767179 - DNA, 25 bp, Mus musculus
tcaggcagaatctcacataaccctt

SEQ ID NO: 767180 - DNA, 25 bp, Mus musculus
tcaggcagatgaagccgtgaatgct

SEQ ID NO: 767181 - DNA, 25 bp, Mus musculus
tcaggcagatgatgccgtgaatgct

SEQ ID NO: 767182 - DNA, 25 bp, Mus musculus
tcaggcagatgtacaaccgctgggc

SEQ ID NO: 767183 - DNA, 25 bp, Mus musculus
tcaggcagatgttcaaccgctgggc

SEQ ID NO: 767184 - DNA, 25 bp, Mus musculus
tcaggcagcagtagagtgacatgag

SEQ ID NO: 767185 - DNA, 25 bp, Mus musculus
tcaggcagcagttgagtgacatgag

SEQ ID NO: 767186 - DNA, 25 bp, Mus musculus
tcaggcagccggcttttaatcccag

SEQ ID NO: 767187 - DNA, 25 bp, Mus musculus
tcaggcagccgggttttaatcccag

SEQ ID NO: 767188 - DNA, 25 bp, Mus musculus
tcaggcagcctgactgtggttgtac

SEQ ID NO: 767189 - DNA, 25 bp, Mus musculus
tcaggcagcctgtctgtggttgtac

SEQ ID NO: 767190 - DNA, 25 bp, Mus musculus
tcaggcagcgctatggttctctttc

SEQ ID NO: 767191 - DNA, 25 bp, Mus musculus
tcaggcagcgctttggttctctttc

SEQ ID NO: 767192 - DNA, 25 bp, Mus musculus
tcaggcagcgggaggaaggttgtca

SEQ ID NO: 767193 - DNA, 25 bp, Mus musculus
tcaggcagcgggtggaaggttgtca

SEQ ID NO: 767194 - DNA, 25 bp, Mus musculus
tcaggcagcttcataccgtgctcag

SEQ ID NO: 767195 - DNA, 25 bp, Mus musculus
tcaggcagcttcttaccgtgctcag

SEQ ID NO: 767196 - DNA, 25 bp, Mus musculus
tcaggcagctttcagattcggcaag

SEQ ID NO: 767197 - DNA, 25 bp, Mus musculus
tcaggcagctttgagattcggcaag

SEQ ID NO: 767198 - DNA, 25 bp, Mus musculus
tcaggcaggaccctttgacataaag

SEQ ID NO: 767199 - DNA, 25 bp, Mus musculus
tcaggcaggaccgtttgacataaag

SEQ ID NO: 767200 - DNA, 25 bp, Mus musculus
tcaggcagtctcattccgaataggt

SEQ ID NO: 767201 - DNA, 25 bp, Mus musculus
tcaggcagtctctttccgaataggt

SEQ ID NO: 767202 - DNA, 25 bp, Mus musculus
tcaggcagtgctatgtcaaattttc

SEQ ID NO: 767203 - DNA, 25 bp, Mus musculus
tcaggcagtgctttgtcaaattttc

SEQ ID NO: 767204 - DNA, 25 bp, Mus musculus
tcaggcatcaaaatagctctctggg

SEQ ID NO: 767205 - DNA, 25 bp, Mus musculus
tcaggcatcaaattagctctctggg

SEQ ID NO: 767206 - DNA, 25 bp, Mus musculus
tcaggcatcggcctgaagccctgga

SEQ ID NO: 767207 - DNA, 25 bp, Mus musculus
tcaggcatcggcgtgaagccctgga

SEQ ID NO: 767208 - DNA, 25 bp, Mus musculus
tcaggcatgggaaaaacagcagtgt

SEQ ID NO: 767209 - DNA, 25 bp, Mus musculus
tcaggcatgggataaacagcagtgt

SEQ ID NO: 767210 - DNA, 25 bp, Mus musculus
tcaggccaaacaacgtggtgtcagg

SEQ ID NO: 767211 - DNA, 25 bp, Mus musculus
tcaggccaaacatcgtggtgtcagg

SEQ ID NO: 767212 - DNA, 25 bp, Mus musculus
tcaggccaaactagatgagtgggaa

SEQ ID NO: 767213 - DNA, 25 bp, Mus musculus
tcaggccaaacttgatgagtgggaa

SEQ ID NO: 767214 - DNA, 25 bp, Mus musculus
tcaggccagaatccactatgggcag

SEQ ID NO: 767215 - DNA, 25 bp, Mus musculus
tcaggccagaatgcactatgggcag

SEQ ID NO: 767216 - DNA, 25 bp, Mus musculus
tcaggccagagcatgaggatcggat

SEQ ID NO: 767217 - DNA, 25 bp, Mus musculus
tcaggccagagcttgaggatcggat

SEQ ID NO: 767218 - DNA, 25 bp, Mus musculus
tcaggccagcagaacaccttcaagg

SEQ ID NO: 767219 - DNA, 25 bp, Mus musculus
tcaggccagcagtacaccttcaagg

SEQ ID NO: 767220 - DNA, 25 bp, Mus musculus
tcaggccagcgacttggacgcttct

SEQ ID NO: 767221 - DNA, 25 bp, Mus musculus
tcaggccagcgagttggacgcttct

SEQ ID NO: 767222 - DNA, 25 bp, Mus musculus
tcaggccaggaaaaacatgactgtc

SEQ ID NO: 767223 - DNA, 25 bp, Mus musculus
tcaggccaggaataacatgactgtc

SEQ ID NO: 767224 - DNA, 25 bp, Mus musculus
tcaggccagggacttaacttcagca

SEQ ID NO: 767225 - DNA, 25 bp, Mus musculus
tcaggccagggagttaacttcagca

SEQ ID NO: 767226 - DNA, 25 bp, Mus musculus
tcaggcccctccacagcagtatggt

SEQ ID NO: 767227 - DNA, 25 bp, Mus musculus
tcaggcccctcctcagcagtatggt

SEQ ID NO: 767228 - DNA, 25 bp, Mus musculus
tcaggcccgctacttcaattgggac

SEQ ID NO: 767229 - DNA, 25 bp, Mus musculus
tcaggcccgctagttcaattgggac

SEQ ID NO: 767230 - DNA, 25 bp, Mus musculus
tcaggcccgctgctggatcgtgtct

SEQ ID NO: 767231 - DNA, 25 bp, Mus musculus
tcaggcccgctggtggatcgtgtct

SEQ ID NO: 767232 - DNA, 25 bp, Mus musculus
tcaggcccgcttatccagagagagg

SEQ ID NO: 767233 - DNA, 25 bp, Mus musculus
tcaggcccgcttttccagagagagg

SEQ ID NO: 767234 - DNA, 25 bp, Mus musculus
tcaggccctaggagaaggacagtcc

SEQ ID NO: 767235 - DNA, 25 bp, Mus musculus
tcaggccctaggtgaaggacagtcc

SEQ ID NO: 767236 - DNA, 25 bp, Mus musculus
tcaggccgcctacaccgcaagattg

SEQ ID NO: 767237 - DNA, 25 bp, Mus musculus
tcaggccgcctagaccgcaagattg

SEQ ID NO: 767238 - DNA, 25 bp, Mus musculus
tcaggccgccttataactcagagat

SEQ ID NO: 767239 - DNA, 25 bp, Mus musculus
tcaggccgccttttaactcagagat

SEQ ID NO: 767240 - DNA, 25 bp, Mus musculus
tcaggccgtcaaactggacttgggt

SEQ ID NO: 767241 - DNA, 25 bp, Mus musculus
tcaggccgtcaatctggacttgggt

SEQ ID NO: 767242 - DNA, 25 bp, Mus musculus
tcaggcctaaggatgcttctgtcct

SEQ ID NO: 767243 - DNA, 25 bp, Mus musculus
tcaggcctaaggttgcttctgtcct

SEQ ID NO: 767244 - DNA, 25 bp, Mus musculus
tcaggcctcacgcaatgtcagcaat

SEQ ID NO: 767245 - DNA, 25 bp, Mus musculus
tcaggcctcacggaatgtcagcaat

SEQ ID NO: 767246 - DNA, 25 bp, Mus musculus
tcaggcctcagaactgcaaaattaa

SEQ ID NO: 767247 - DNA, 25 bp, Mus musculus
tcaggcctcagatctgcaaaattaa

SEQ ID NO: 767248 - DNA, 25 bp, Mus musculus
tcaggcctcccacaagatgccagtg

SEQ ID NO: 767249 - DNA, 25 bp, Mus musculus
tcaggcctcccagaagatgccagtg

SEQ ID NO: 767250 - DNA, 25 bp, Mus musculus
tcaggcctgccgattcatgaaatgc

SEQ ID NO: 767251 - DNA, 25 bp, Mus musculus
tcaggcctgccgtttcatgaaatgc

SEQ ID NO: 767252 - DNA, 25 bp, Mus musculus
tcaggccttctgagtcacgggaaga

SEQ ID NO: 767253 - DNA, 25 bp, Mus musculus
tcaggccttctgtgtcacgggaaga

SEQ ID NO: 767254 - DNA, 25 bp, Mus musculus
tcaggcctttgacttgggagataca

SEQ ID NO: 767255 - DNA, 25 bp, Mus musculus
tcaggcctttgagttgggagataca

SEQ ID NO: 767256 - DNA, 25 bp, Mus musculus
tcaggcgaagctcagtcacgaaacc

SEQ ID NO: 767257 - DNA, 25 bp, Mus musculus
tcaggcgaagctgagtcacgaaacc

SEQ ID NO: 767258 - DNA, 25 bp, Mus musculus
tcaggcgaataccactgtgtatatc

SEQ ID NO: 767259 - DNA, 25 bp, Mus musculus
tcaggcgaatacgactgtgtatatc

SEQ ID NO: 767260 - DNA, 25 bp, Mus musculus
tcaggcgaggatcgcaagcctctgc

SEQ ID NO: 767261 - DNA, 25 bp, Mus musculus
tcaggcgaggatggcaagcctctgc

SEQ ID NO: 767262 - DNA, 25 bp, Mus musculus
tcaggcgcacttcttcgagcatcca

SEQ ID NO: 767263 - DNA, 25 bp, Mus musculus
tcaggcgcacttgttcgagcatcca

SEQ ID NO: 767264 - DNA, 25 bp, Mus musculus
tcaggcgcagaactcgaggttaacc

SEQ ID NO: 767265 - DNA, 25 bp, Mus musculus
tcaggcgcagaagtcgaggttaacc

SEQ ID NO: 767266 - DNA, 25 bp, Mus musculus
tcaggcgcagatccacagcgatatc

SEQ ID NO: 767267 - DNA, 25 bp, Mus musculus
tcaggcgcagatgcacagcgatatc

SEQ ID NO: 767268 - DNA, 25 bp, Mus musculus
tcaggcgcccttcggagtgggaacg

SEQ ID NO: 767269 - DNA, 25 bp, Mus musculus
tcaggcgcccttgggagtgggaacg

SEQ ID NO: 767270 - DNA, 25 bp, Mus musculus
tcaggcgtggacctggcacccaaag

SEQ ID NO: 767271 - DNA, 25 bp, Mus musculus
tcaggcgtggacgtggcacccaaag

SEQ ID NO: 767272 - DNA, 25 bp, Mus musculus
tcaggcgttcgccagtcacacacag

SEQ ID NO: 767273 - DNA, 25 bp, Mus musculus
tcaggcgttcgcgagtcacacacag

SEQ ID NO: 767274 - DNA, 25 bp, Mus musculus
tcaggctaagccatcctcccaggag

SEQ ID NO: 767275 - DNA, 25 bp, Mus musculus
tcaggctaagccttcctcccaggag

SEQ ID NO: 767276 - DNA, 25 bp, Mus musculus
tcaggctaataacaagtgaagtcgg

SEQ ID NO: 767277 - DNA, 25 bp, Mus musculus
tcaggctaataagaagtgaagtcgg

SEQ ID NO: 767278 - DNA, 25 bp, Mus musculus
tcaggctaccaccatacccattgtg

SEQ ID NO: 767279 - DNA, 25 bp, Mus musculus
tcaggctaccacgatacccattgtg

SEQ ID NO: 767280 - DNA, 25 bp, Mus musculus
tcaggctacctgagcgaccagtgga

SEQ ID NO: 767281 - DNA, 25 bp, Mus musculus
tcaggctacctgtgcgaccagtgga

SEQ ID NO: 767282 - DNA, 25 bp, Mus musculus
tcaggctactggaggcacgtggcca

SEQ ID NO: 767283 - DNA, 25 bp, Mus musculus
tcaggctactggtggcacgtggcca

SEQ ID NO: 767284 - DNA, 25 bp, Mus musculus
tcaggctatcataacctgcgttcaa

SEQ ID NO: 767285 - DNA, 25 bp, Mus musculus
tcaggctatcattacctgcgttcaa

SEQ ID NO: 767286 - DNA, 25 bp, Mus musculus
tcaggctcagtgaaggcaagttcca

SEQ ID NO: 767287 - DNA, 25 bp, Mus musculus
tcaggctcagtgtaggcaagttcca

SEQ ID NO: 767288 - DNA, 25 bp, Mus musculus
tcaggctccactctgggcaagctag

SEQ ID NO: 767289 - DNA, 25 bp, Mus musculus
tcaggctccactctgtcgttctggt

SEQ ID NO: 767290 - DNA, 25 bp, Mus musculus
tcaggctccactgtgggcaagctag

SEQ ID NO: 767291 - DNA, 25 bp, Mus musculus
tcaggctccactgtgtcgttctggt

SEQ ID NO: 767292 - DNA, 25 bp, Mus musculus
tcaggctctactaggagcagctcaa

SEQ ID NO: 767293 - DNA, 25 bp, Mus musculus
tcaggctctacttggagcagctcaa

SEQ ID NO: 767294 - DNA, 25 bp, Mus musculus
tcaggctctgaccatactgtgacgt

SEQ ID NO: 767295 - DNA, 25 bp, Mus musculus
tcaggctctgacgatactgtgacgt

SEQ ID NO: 767296 - DNA, 25 bp, Mus musculus
tcaggctcttgacttacagattcgg

SEQ ID NO: 767297 - DNA, 25 bp, Mus musculus
tcaggctcttgagttacagattcgg

SEQ ID NO: 767298 - DNA, 25 bp, Mus musculus
tcaggctgactcatagaaagggtag

SEQ ID NO: 767299 - DNA, 25 bp, Mus musculus
tcaggctgactcttagaaagggtag

SEQ ID NO: 767300 - DNA, 25 bp, Mus musculus
tcaggctgccacctaaacttcagag

SEQ ID NO: 767301 - DNA, 25 bp, Mus musculus
tcaggctgccacgtaaacttcagag

SEQ ID NO: 767302 - DNA, 25 bp, Mus musculus
tcaggctgccccatttctgtgtgct

SEQ ID NO: 767303 - DNA, 25 bp, Mus musculus
tcaggctgccccttttctgtgtgct

SEQ ID NO: 767304 - DNA, 25 bp, Mus musculus
tcaggctgcctcctggcttggtcgc

SEQ ID NO: 767305 - DNA, 25 bp, Mus musculus
tcaggctgcctcgtggcttggtcgc

SEQ ID NO: 767306 - DNA, 25 bp, Mus musculus
tcaggctgcttaaggacgacctcaa

SEQ ID NO: 767307 - DNA, 25 bp, Mus musculus
tcaggctgcttatggacgacctcaa

SEQ ID NO: 767308 - DNA, 25 bp, Mus musculus
tcaggctgctttcgtgttgtacatc

SEQ ID NO: 767309 - DNA, 25 bp, Mus musculus
tcaggctgctttggtgttgtacatc

SEQ ID NO: 767310 - DNA, 25 bp, Mus musculus
tcaggctggaaacgaaactctgagt

SEQ ID NO: 767311 - DNA, 25 bp, Mus musculus
tcaggctggaaaggaaactctgagt

SEQ ID NO: 767312 - DNA, 25 bp, Mus musculus
tcaggctggctgagatgggctccct

SEQ ID NO: 767313 - DNA, 25 bp, Mus musculus
tcaggctggctgtgatgggctccct

SEQ ID NO: 767314 - DNA, 25 bp, Mus musculus
tcaggctggcttctcattttcaagg

SEQ ID NO: 767315 - DNA, 25 bp, Mus musculus
tcaggctggcttgtcattttcaagg

SEQ ID NO: 767316 - DNA, 25 bp, Mus musculus
tcaggctggggaccggatcttcttc

SEQ ID NO: 767317 - DNA, 25 bp, Mus musculus
tcaggctggggagcggatcttcttc

SEQ ID NO: 767318 - DNA, 25 bp, Mus musculus
tcaggctggtccaaagctggaggca

SEQ ID NO: 767319 - DNA, 25 bp, Mus musculus
tcaggctggtcctaagctggaggca

SEQ ID NO: 767320 - DNA, 25 bp, Mus musculus
tcaggctgtaaacgctcggtcccca

SEQ ID NO: 767321 - DNA, 25 bp, Mus musculus
tcaggctgtaaaggctcggtcccca

SEQ ID NO: 767322 - DNA, 25 bp, Mus musculus
tcaggctgtcgcagaagtggagcct

SEQ ID NO: 767323 - DNA, 25 bp, Mus musculus
tcaggctgtcgctgaagtggagcct

SEQ ID NO: 767324 - DNA, 25 bp, Mus musculus
tcaggctgtcgtacgagcatcaggt

SEQ ID NO: 767325 - DNA, 25 bp, Mus musculus
tcaggctgtcgttcgagcatcaggt

SEQ ID NO: 767326 - DNA, 25 bp, Mus musculus
tcaggcttcaagattgaaggacata

SEQ ID NO: 767327 - DNA, 25 bp, Mus musculus
tcaggcttcaagtttgaaggacata

SEQ ID NO: 767328 - DNA, 25 bp, Mus musculus
tcaggcttgcagaccccattcattg

SEQ ID NO: 767329 - DNA, 25 bp, Mus musculus
tcaggcttgcagtccccattcattg

SEQ ID NO: 767330 - DNA, 25 bp, Mus musculus
tcaggcttggccagctagtggatgc

SEQ ID NO: 767331 - DNA, 25 bp, Mus musculus
tcaggcttggcctgctagtggatgc

SEQ ID NO: 767332 - DNA, 25 bp, Mus musculus
tcaggcttgtgtcttcggcagtgct

SEQ ID NO: 767333 - DNA, 25 bp, Mus musculus
tcaggcttgtgtgttcggcagtgct

SEQ ID NO: 767334 - DNA, 25 bp, Mus musculus
tcaggctttgcacaaatggaccacg

SEQ ID NO: 767335 - DNA, 25 bp, Mus musculus
tcaggctttgcagaaatggaccacg

SEQ ID NO: 767336 - DNA, 25 bp, Mus musculus
tcagggaaacaacagacacgtggct

SEQ ID NO: 767337 - DNA, 25 bp, Mus musculus
tcagggaaacaagagacacgtggct

SEQ ID NO: 767338 - DNA, 25 bp, Mus musculus
tcagggaaacccatagtggcaccca

SEQ ID NO: 767339 - DNA, 25 bp, Mus musculus
tcagggaaacccttagtggcaccca

SEQ ID NO: 767340 - DNA, 25 bp, Mus musculus
tcagggaacttgactgtagtcgcag

SEQ ID NO: 767341 - DNA, 25 bp, Mus musculus
tcagggaacttgtctgtagtcgcag

SEQ ID NO: 767342 - DNA, 25 bp, Mus musculus
tcagggaagtatcacagcgggatcc

SEQ ID NO: 767343 - DNA, 25 bp, Mus musculus
tcagggaagtatgacagcgggatcc

SEQ ID NO: 767344 - DNA, 25 bp, Mus musculus
tcagggaatagaacctgttttggaa

SEQ ID NO: 767345 - DNA, 25 bp, Mus musculus
tcagggaatagatcctgttttggaa

SEQ ID NO: 767346 - DNA, 25 bp, Mus musculus
tcagggaatgcaacatgggaaacct

SEQ ID NO: 767347 - DNA, 25 bp, Mus musculus
tcagggaatgcatcatgggaaacct

SEQ ID NO: 767348 - DNA, 25 bp, Mus musculus
tcagggacaagcaagcacctacaga

SEQ ID NO: 767349 - DNA, 25 bp, Mus musculus
tcagggacaagctagcacctacaga

SEQ ID NO: 767350 - DNA, 25 bp, Mus musculus
tcagggacacgtcgacagactgagc

SEQ ID NO: 767351 - DNA, 25 bp, Mus musculus
tcagggacacgtggacagactgagc

SEQ ID NO: 767352 - DNA, 25 bp, Mus musculus
tcagggacagtcctgctggcccagt

SEQ ID NO: 767353 - DNA, 25 bp, Mus musculus
tcagggacagtcgtgctggcccagt

SEQ ID NO: 767354 - DNA, 25 bp, Mus musculus
tcagggaccaagaatcttcactgcc

SEQ ID NO: 767355 - DNA, 25 bp, Mus musculus
tcagggaccaagtatcttcactgcc

SEQ ID NO: 767356 - DNA, 25 bp, Mus musculus
tcagggaccaggacattcacagaca

SEQ ID NO: 767357 - DNA, 25 bp, Mus musculus
tcagggaccaggtcattcacagaca

SEQ ID NO: 767358 - DNA, 25 bp, Mus musculus
tcagggacccagagtccagcttgga

SEQ ID NO: 767359 - DNA, 25 bp, Mus musculus
tcagggacccagtgtccagcttgga

SEQ ID NO: 767360 - DNA, 25 bp, Mus musculus
tcagggacctagcaagcctgttcgg

SEQ ID NO: 767361 - DNA, 25 bp, Mus musculus
tcagggacctaggaagcctgttcgg

SEQ ID NO: 767362 - DNA, 25 bp, Mus musculus
tcagggacctttcgcagacctgtgg

SEQ ID NO: 767363 - DNA, 25 bp, Mus musculus
tcagggacctttggcagacctgtgg

SEQ ID NO: 767364 - DNA, 25 bp, Mus musculus
tcagggactctactccgaatcagta

SEQ ID NO: 767365 - DNA, 25 bp, Mus musculus
tcagggactctagtccgaatcagta

SEQ ID NO: 767366 - DNA, 25 bp, Mus musculus
tcagggactgcactggctaagactg

SEQ ID NO: 767367 - DNA, 25 bp, Mus musculus
tcagggactgcagtggctaagactg

SEQ ID NO: 767368 - DNA, 25 bp, Mus musculus
tcagggagagctagacagtggtccc

SEQ ID NO: 767369 - DNA, 25 bp, Mus musculus
tcagggagagcttgacagtggtccc

SEQ ID NO: 767370 - DNA, 25 bp, Mus musculus
tcagggagataaattcaactcagtg

SEQ ID NO: 767371 - DNA, 25 bp, Mus musculus
tcagggagataatttcaactcagtg

SEQ ID NO: 767372 - DNA, 25 bp, Mus musculus
tcagggagatcaaaagacgaactag

SEQ ID NO: 767373 - DNA, 25 bp, Mus musculus
tcagggagatcataagacgaactag

SEQ ID NO: 767374 - DNA, 25 bp, Mus musculus
tcagggagcccaatactgtcagcag

SEQ ID NO: 767375 - DNA, 25 bp, Mus musculus
tcagggagcccattactgtcagcag

SEQ ID NO: 767376 - DNA, 25 bp, Mus musculus
tcagggagctgcaatggctatactg

SEQ ID NO: 767377 - DNA, 25 bp, Mus musculus
tcagggagctgctatggctatactg

SEQ ID NO: 767378 - DNA, 25 bp, Mus musculus
tcagggaggaaacctcatccattcc

SEQ ID NO: 767379 - DNA, 25 bp, Mus musculus
tcagggaggaaagctcatccattcc

SEQ ID NO: 767380 - DNA, 25 bp, Mus musculus
tcagggagtcacacttggagcagaa

SEQ ID NO: 767381 - DNA, 25 bp, Mus musculus
tcagggagtcactcttggagcagaa

SEQ ID NO: 767382 - DNA, 25 bp, Mus musculus
tcagggatccctaatgggcatgttt

SEQ ID NO: 767383 - DNA, 25 bp, Mus musculus
tcagggatcccttatgggcatgttt

SEQ ID NO: 767384 - DNA, 25 bp, Mus musculus
tcagggatcctaacatcagggagag

SEQ ID NO: 767385 - DNA, 25 bp, Mus musculus
tcagggatcctatcatcagggagag

SEQ ID NO: 767386 - DNA, 25 bp, Mus musculus
tcagggatcttgaaggttcgagcgc

SEQ ID NO: 767387 - DNA, 25 bp, Mus musculus
tcagggatcttgtaggttcgagcgc

SEQ ID NO: 767388 - DNA, 25 bp, Mus musculus
tcagggatgggcacaaacttatgct

SEQ ID NO: 767389 - DNA, 25 bp, Mus musculus
tcagggatgggctcaaacttatgct

SEQ ID NO: 767390 - DNA, 25 bp, Mus musculus
tcagggatgtcaacaatgtattcca

SEQ ID NO: 767391 - DNA, 25 bp, Mus musculus
tcagggatgtcatcaatgtattcca

SEQ ID NO: 767392 - DNA, 25 bp, Mus musculus
tcagggatttgaagagagccgccca

SEQ ID NO: 767393 - DNA, 25 bp, Mus musculus
tcagggatttgatgagagccgccca

SEQ ID NO: 767394 - DNA, 25 bp, Mus musculus
tcagggcaaaatagaatcttccgct

SEQ ID NO: 767395 - DNA, 25 bp, Mus musculus
tcagggcaaaattgaatcttccgct

SEQ ID NO: 767396 - DNA, 25 bp, Mus musculus
tcagggcaagaacagtccgcgactc

SEQ ID NO: 767397 - DNA, 25 bp, Mus musculus
tcagggcaagaagagtccgcgactc

SEQ ID NO: 767398 - DNA, 25 bp, Mus musculus
tcagggcaagctcaccaaactggct

SEQ ID NO: 767399 - DNA, 25 bp, Mus musculus
tcagggcaagctgaccaaactggct

SEQ ID NO: 767400 - DNA, 25 bp, Mus musculus
tcagggcaatgacgtcacatccatc

SEQ ID NO: 767401 - DNA, 25 bp, Mus musculus
tcagggcaatgaggtcacatccatc

SEQ ID NO: 767402 - DNA, 25 bp, Mus musculus
tcagggcacaaaccaagagggtgtc

SEQ ID NO: 767403 - DNA, 25 bp, Mus musculus
tcagggcacaaagcaagagggtgtc

SEQ ID NO: 767404 - DNA, 25 bp, Mus musculus
tcagggcaccaacgcggctctagca

SEQ ID NO: 767405 - DNA, 25 bp, Mus musculus
tcagggcaccaaggcggctctagca

SEQ ID NO: 767406 - DNA, 25 bp, Mus musculus
tcagggcagctccagtatattccag

SEQ ID NO: 767407 - DNA, 25 bp, Mus musculus
tcagggcagctcgagtatattccag

SEQ ID NO: 767408 - DNA, 25 bp, Mus musculus
tcagggcagtgactttcacagcagg

SEQ ID NO: 767409 - DNA, 25 bp, Mus musculus
tcagggcagtgagtttcacagcagg

SEQ ID NO: 767410 - DNA, 25 bp, Mus musculus
tcagggcagtgcatcctgggacact

SEQ ID NO: 767411 - DNA, 25 bp, Mus musculus
tcagggcagtgcttcctgggacact

SEQ ID NO: 767412 - DNA, 25 bp, Mus musculus
tcagggcagttcctacagatgaagc

SEQ ID NO: 767413 - DNA, 25 bp, Mus musculus
tcagggcagttcgtacagatgaagc

SEQ ID NO: 767414 - DNA, 25 bp, Mus musculus
tcagggcatcgcaggacagtgctgg

SEQ ID NO: 767415 - DNA, 25 bp, Mus musculus
tcagggcatcgctggacagtgctgg

SEQ ID NO: 767416 - DNA, 25 bp, Mus musculus
tcagggccaactccgaattcttcgg

SEQ ID NO: 767417 - DNA, 25 bp, Mus musculus
tcagggccaactgcgaattcttcgg

SEQ ID NO: 767418 - DNA, 25 bp, Mus musculus
tcagggccctccatcgaggacggca

SEQ ID NO: 767419 - DNA, 25 bp, Mus musculus
tcagggccctccttcgaggacggca

SEQ ID NO: 767420 - DNA, 25 bp, Mus musculus
tcagggccctgcatatctccacagg

SEQ ID NO: 767421 - DNA, 25 bp, Mus musculus
tcagggccctgcttatctccacagg

SEQ ID NO: 767422 - DNA, 25 bp, Mus musculus
tcagggccctgtctcaatggtggct

SEQ ID NO: 767423 - DNA, 25 bp, Mus musculus
tcagggccctgtgtcaatggtggct

SEQ ID NO: 767424 - DNA, 25 bp, Mus musculus
tcagggccgtccaggacagttcgtc

SEQ ID NO: 767425 - DNA, 25 bp, Mus musculus
tcagggccgtcctggacagttcgtc

SEQ ID NO: 767426 - DNA, 25 bp, Mus musculus
tcagggcctctgagtgaaggctgtc

SEQ ID NO: 767427 - DNA, 25 bp, Mus musculus
tcagggcctctgtgtgaaggctgtc

SEQ ID NO: 767428 - DNA, 25 bp, Mus musculus
tcagggcgaacacgacaattatgag

SEQ ID NO: 767429 - DNA, 25 bp, Mus musculus
tcagggcgaacaggacaattatgag

SEQ ID NO: 767430 - DNA, 25 bp, Mus musculus
tcagggcgccgtctggctgttccta

SEQ ID NO: 767431 - DNA, 25 bp, Mus musculus
tcagggcgccgtgtggctgttccta

SEQ ID NO: 767432 - DNA, 25 bp, Mus musculus
tcagggcgtgaaagtctacgaggac

SEQ ID NO: 767433 - DNA, 25 bp, Mus musculus
tcagggcgtgaatgtctacgaggac

SEQ ID NO: 767434 - DNA, 25 bp, Mus musculus
tcagggcgtgctactgagctatggc

SEQ ID NO: 767435 - DNA, 25 bp, Mus musculus
tcagggcgtgcttctgagctatggc

SEQ ID NO: 767436 - DNA, 25 bp, Mus musculus
tcagggctacctcgcttctagacag

SEQ ID NO: 767437 - DNA, 25 bp, Mus musculus
tcagggctacctggcttctagacag

SEQ ID NO: 767438 - DNA, 25 bp, Mus musculus
tcagggctacggagcagaggtatcc

SEQ ID NO: 767439 - DNA, 25 bp, Mus musculus
tcagggctacggtgcagaggtatcc

SEQ ID NO: 767440 - DNA, 25 bp, Mus musculus
tcagggctcaacagtttcaacctga

SEQ ID NO: 767441 - DNA, 25 bp, Mus musculus
tcagggctcaactgtttcaacctga

SEQ ID NO: 767442 - DNA, 25 bp, Mus musculus
tcagggctctcacgcctcacggaat

SEQ ID NO: 767443 - DNA, 25 bp, Mus musculus
tcagggctctcaggcctcacggaat

SEQ ID NO: 767444 - DNA, 25 bp, Mus musculus
tcagggctgaataggcggatgaaca

SEQ ID NO: 767445 - DNA, 25 bp, Mus musculus
tcagggctgaattggcggatgaaca

SEQ ID NO: 767446 - DNA, 25 bp, Mus musculus
tcagggctgtctcgctttctgttgg

SEQ ID NO: 767447 - DNA, 25 bp, Mus musculus
tcagggctgtctggctttctgttgg

SEQ ID NO: 767448 - DNA, 25 bp, Mus musculus
tcagggcttaccacttaggagggct

SEQ ID NO: 767449 - DNA, 25 bp, Mus musculus
tcagggcttacctcttaggagggct

SEQ ID NO: 767450 - DNA, 25 bp, Mus musculus
tcagggcttccaccgttcgttcaag

SEQ ID NO: 767451 - DNA, 25 bp, Mus musculus
tcagggcttccagcgttcgttcaag

SEQ ID NO: 767452 - DNA, 25 bp, Mus musculus
tcagggcttgctaactaccagggca

SEQ ID NO: 767453 - DNA, 25 bp, Mus musculus
tcagggcttgctacatttccaggtg

SEQ ID NO: 767454 - DNA, 25 bp, Mus musculus
tcagggcttgcttactaccagggca

SEQ ID NO: 767455 - DNA, 25 bp, Mus musculus
tcagggcttgcttcatttccaggtg

SEQ ID NO: 767456 - DNA, 25 bp, Mus musculus
tcaggggaccggcatgaatttcaga

SEQ ID NO: 767457 - DNA, 25 bp, Mus musculus
tcaggggaccgggatgaatttcaga

SEQ ID NO: 767458 - DNA, 25 bp, Mus musculus
tcagggtacacaagcattcttggag

SEQ ID NO: 767459 - DNA, 25 bp, Mus musculus
tcagggtacacatgcattcttggag

SEQ ID NO: 767460 - DNA, 25 bp, Mus musculus
tcagggtacaggctgacttcagctc

SEQ ID NO: 767461 - DNA, 25 bp, Mus musculus
tcagggtacagggtgacttcagctc

SEQ ID NO: 767462 - DNA, 25 bp, Mus musculus
tcagggtaccaacagacttccatct

SEQ ID NO: 767463 - DNA, 25 bp, Mus musculus
tcagggtaccaagagacttccatct

SEQ ID NO: 767464 - DNA, 25 bp, Mus musculus
tcagggtaccacaacggagttcacg

SEQ ID NO: 767465 - DNA, 25 bp, Mus musculus
tcagggtaccactacggagttcacg

SEQ ID NO: 767466 - DNA, 25 bp, Mus musculus
tcagggtagatgaattggacccaga

SEQ ID NO: 767467 - DNA, 25 bp, Mus musculus
tcagggtagatgtattggacccaga

SEQ ID NO: 767468 - DNA, 25 bp, Mus musculus
tcagggtagattaaagggctctgcc

SEQ ID NO: 767469 - DNA, 25 bp, Mus musculus
tcagggtagatttaagggctctgcc

SEQ ID NO: 767470 - DNA, 25 bp, Mus musculus
tcagggtagccgcatctacaacagc

SEQ ID NO: 767471 - DNA, 25 bp, Mus musculus
tcagggtagccggatctacaacagc

SEQ ID NO: 767472 - DNA, 25 bp, Mus musculus
tcagggtaggtgactcaagccaaat

SEQ ID NO: 767473 - DNA, 25 bp, Mus musculus
tcagggtaggtgtctcaagccaaat

SEQ ID NO: 767474 - DNA, 25 bp, Mus musculus
tcagggtatgaacaaaaggactttg

SEQ ID NO: 767475 - DNA, 25 bp, Mus musculus
tcagggtatgaagaaaaggactttg

SEQ ID NO: 767476 - DNA, 25 bp, Mus musculus
tcagggtattcacctgctgcactcc

SEQ ID NO: 767477 - DNA, 25 bp, Mus musculus
tcagggtattcagctgctgcactcc

SEQ ID NO: 767478 - DNA, 25 bp, Mus musculus
tcagggtcactaacgggcctcgcag

SEQ ID NO: 767479 - DNA, 25 bp, Mus musculus
tcagggtcactatcgggcctcgcag

SEQ ID NO: 767480 - DNA, 25 bp, Mus musculus
tcagggtcagctctctaaagcaggg

SEQ ID NO: 767481 - DNA, 25 bp, Mus musculus
tcagggtcagctgtctaaagcaggg

SEQ ID NO: 767482 - DNA, 25 bp, Mus musculus
tcagggtcctacagaaggaactggg

SEQ ID NO: 767483 - DNA, 25 bp, Mus musculus
tcagggtcctactgaaggaactggg

SEQ ID NO: 767484 - DNA, 25 bp, Mus musculus
tcagggtcctgacctttgccctgga

SEQ ID NO: 767485 - DNA, 25 bp, Mus musculus
tcagggtcctgagctttgccctgga

SEQ ID NO: 767486 - DNA, 25 bp, Mus musculus
tcagggtcgccactgtgagcaaagc

SEQ ID NO: 767487 - DNA, 25 bp, Mus musculus
tcagggtcgccagtgtgagcaaagc

SEQ ID NO: 767488 - DNA, 25 bp, Mus musculus
tcagggtctcaacatctacagtggg

SEQ ID NO: 767489 - DNA, 25 bp, Mus musculus
tcagggtctcaagatctacagtggg

SEQ ID NO: 767490 - DNA, 25 bp, Mus musculus
tcagggtctgagaggcatcactggc

SEQ ID NO: 767491 - DNA, 25 bp, Mus musculus
tcagggtctgagtggcatcactggc

SEQ ID NO: 767492 - DNA, 25 bp, Mus musculus
tcagggtgcaggagtgctcttgcaa

SEQ ID NO: 767493 - DNA, 25 bp, Mus musculus
tcagggtgcaggtgtgctcttgcaa

SEQ ID NO: 767494 - DNA, 25 bp, Mus musculus
tcagggtgctcacgataagctctat

SEQ ID NO: 767495 - DNA, 25 bp, Mus musculus
tcagggtgctcaggataagctctat

SEQ ID NO: 767496 - DNA, 25 bp, Mus musculus
tcagggtgggatagctcagaatgat

SEQ ID NO: 767497 - DNA, 25 bp, Mus musculus
tcagggtgggattgctcagaatgat

SEQ ID NO: 767498 - DNA, 25 bp, Mus musculus
tcagggtggtgtagatgtcctcaag

SEQ ID NO: 767499 - DNA, 25 bp, Mus musculus
tcagggtggtgttgatgtcctcaag

SEQ ID NO: 767500 - DNA, 25 bp, Mus musculus
tcagggttcagcagcatcaacacag

SEQ ID NO: 767501 - DNA, 25 bp, Mus musculus
tcagggttcagctgcatcaacacag

SEQ ID NO: 767502 - DNA, 25 bp, Mus musculus
tcagggttcctaagaacagcgtaca

SEQ ID NO: 767503 - DNA, 25 bp, Mus musculus
tcagggttcctatgaacagcgtaca

SEQ ID NO: 767504 - DNA, 25 bp, Mus musculus
tcaggtaacaatccagcaagctcag

SEQ ID NO: 767505 - DNA, 25 bp, Mus musculus
tcaggtaacaatgcagcaagctcag

SEQ ID NO: 767506 - DNA, 25 bp, Mus musculus
tcaggtaaccagcagattgtaggac

SEQ ID NO: 767507 - DNA, 25 bp, Mus musculus
tcaggtaaccaggagattgtaggac

SEQ ID NO: 767508 - DNA, 25 bp, Mus musculus
tcaggtaatgccaaacggcctcagg

SEQ ID NO: 767509 - DNA, 25 bp, Mus musculus
tcaggtaatgcctaacggcctcagg

SEQ ID NO: 767510 - DNA, 25 bp, Mus musculus
tcaggtacagagatgctccacagta

SEQ ID NO: 767511 - DNA, 25 bp, Mus musculus
tcaggtacagagttgctccacagta

SEQ ID NO: 767512 - DNA, 25 bp, Mus musculus
tcaggtaccaaccactatgtgcaac

SEQ ID NO: 767513 - DNA, 25 bp, Mus musculus
tcaggtaccaacgactatgtgcaac

SEQ ID NO: 767514 - DNA, 25 bp, Mus musculus
tcaggtacccatcgattcttcagga

SEQ ID NO: 767515 - DNA, 25 bp, Mus musculus
tcaggtacccatggattcttcagga

SEQ ID NO: 767516 - DNA, 25 bp, Mus musculus
tcaggtactcgcctcggcacagagg

SEQ ID NO: 767517 - DNA, 25 bp, Mus musculus
tcaggtactcgcgtcggcacagagg

SEQ ID NO: 767518 - DNA, 25 bp, Mus musculus
tcaggtataacacagtcacactccc

SEQ ID NO: 767519 - DNA, 25 bp, Mus musculus
tcaggtataacagagtcacactccc

SEQ ID NO: 767520 - DNA, 25 bp, Mus musculus
tcaggtatcctgcttggcaccaggg

SEQ ID NO: 767521 - DNA, 25 bp, Mus musculus
tcaggtatcctggttggcaccaggg

SEQ ID NO: 767522 - DNA, 25 bp, Mus musculus
tcaggtatggaaaagtaagcatgta

SEQ ID NO: 767523 - DNA, 25 bp, Mus musculus
tcaggtatggaatagtaagcatgta

SEQ ID NO: 767524 - DNA, 25 bp, Mus musculus
tcaggtcaaagtaccgaaaaagatt

SEQ ID NO: 767525 - DNA, 25 bp, Mus musculus
tcaggtcaaagttccgaaaaagatt

SEQ ID NO: 767526 - DNA, 25 bp, Mus musculus
tcaggtcaaattcggatcaatggct

SEQ ID NO: 767527 - DNA, 25 bp, Mus musculus
tcaggtcaaattgggatcaatggct

SEQ ID NO: 767528 - DNA, 25 bp, Mus musculus
tcaggtcaacttcatggcttcacag

SEQ ID NO: 767529 - DNA, 25 bp, Mus musculus
tcaggtcaacttgatggcttcacag

SEQ ID NO: 767530 - DNA, 25 bp, Mus musculus
tcaggtcaccaccaactctgaaggc

SEQ ID NO: 767531 - DNA, 25 bp, Mus musculus
tcaggtcaccacgaactctgaaggc

SEQ ID NO: 767532 - DNA, 25 bp, Mus musculus
tcaggtcacggaatgagagcaaagg

SEQ ID NO: 767533 - DNA, 25 bp, Mus musculus
tcaggtcacggattgagagcaaagg

SEQ ID NO: 767534 - DNA, 25 bp, Mus musculus
tcaggtcagacaactcaggaaggca

SEQ ID NO: 767535 - DNA, 25 bp, Mus musculus
tcaggtcagacatctcaggaaggca

SEQ ID NO: 767536 - DNA, 25 bp, Mus musculus
tcaggtcagagtatcttccgggctc

SEQ ID NO: 767537 - DNA, 25 bp, Mus musculus
tcaggtcagagtttcttccgggctc

SEQ ID NO: 767538 - DNA, 25 bp, Mus musculus
tcaggtcatcacaggatatcagctg

SEQ ID NO: 767539 - DNA, 25 bp, Mus musculus
tcaggtcatcactggatatcagctg

SEQ ID NO: 767540 - DNA, 25 bp, Mus musculus
tcaggtccaatccatatgccagaaa

SEQ ID NO: 767541 - DNA, 25 bp, Mus musculus
tcaggtccaatcgatatgccagaaa

SEQ ID NO: 767542 - DNA, 25 bp, Mus musculus
tcaggtccctgacagcgcgggcact

SEQ ID NO: 767543 - DNA, 25 bp, Mus musculus
tcaggtccctgagagcgcgggcact

SEQ ID NO: 767544 - DNA, 25 bp, Mus musculus
tcaggtccctgcagtcagcgaagtt

SEQ ID NO: 767545 - DNA, 25 bp, Mus musculus
tcaggtccctgctgtcagcgaagtt

SEQ ID NO: 767546 - DNA, 25 bp, Mus musculus
tcaggtccggctaccggtttcgtcg

SEQ ID NO: 767547 - DNA, 25 bp, Mus musculus
tcaggtccggcttccggtttcgtcg

SEQ ID NO: 767548 - DNA, 25 bp, Mus musculus
tcaggtcctagcctcctagctgggt

SEQ ID NO: 767549 - DNA, 25 bp, Mus musculus
tcaggtcctagcgtcctagctgggt

SEQ ID NO: 767550 - DNA, 25 bp, Mus musculus
tcaggtctatagcaaaggcccctct

SEQ ID NO: 767551 - DNA, 25 bp, Mus musculus
tcaggtctataggaaaggcccctct

SEQ ID NO: 767552 - DNA, 25 bp, Mus musculus
tcaggtctgaacagctgctctagtg

SEQ ID NO: 767553 - DNA, 25 bp, Mus musculus
tcaggtctgaactgctgctctagtg

SEQ ID NO: 767554 - DNA, 25 bp, Mus musculus
tcaggtctgatacagataaaaacct

SEQ ID NO: 767555 - DNA, 25 bp, Mus musculus
tcaggtctgatagagataaaaacct

SEQ ID NO: 767556 - DNA, 25 bp, Mus musculus
tcaggtgaacagaatcgtggctcag

SEQ ID NO: 767557 - DNA, 25 bp, Mus musculus
tcaggtgaacagtatcgtggctcag

SEQ ID NO: 767558 - DNA, 25 bp, Mus musculus
tcaggtgacattatggttcccaggc

SEQ ID NO: 767559 - DNA, 25 bp, Mus musculus
tcaggtgacattttggttcccaggc

SEQ ID NO: 767560 - DNA, 25 bp, Mus musculus
tcaggtgattcacatggagctggac

SEQ ID NO: 767561 - DNA, 25 bp, Mus musculus
tcaggtgattcagatggagctggac

SEQ ID NO: 767562 - DNA, 25 bp, Mus musculus
tcaggtgcacttagtcacagaggtc

SEQ ID NO: 767563 - DNA, 25 bp, Mus musculus
tcaggtgcactttgtcacagaggtc

SEQ ID NO: 767564 - DNA, 25 bp, Mus musculus
tcaggtgccagcaaaccaagggtgg

SEQ ID NO: 767565 - DNA, 25 bp, Mus musculus
tcaggtgccagctaaccaagggtgg

SEQ ID NO: 767566 - DNA, 25 bp, Mus musculus
tcaggtgcctcaacttttccagtgc

SEQ ID NO: 767567 - DNA, 25 bp, Mus musculus
tcaggtgcctcatcttttccagtgc

SEQ ID NO: 767568 - DNA, 25 bp, Mus musculus
tcaggtgcctctcgctgactgcgtg

SEQ ID NO: 767569 - DNA, 25 bp, Mus musculus
tcaggtgcctctggctgactgcgtg

SEQ ID NO: 767570 - DNA, 25 bp, Mus musculus
tcaggtgctcaaaatgcagaacacg

SEQ ID NO: 767571 - DNA, 25 bp, Mus musculus
tcaggtgctcaatatgcagaacacg

SEQ ID NO: 767572 - DNA, 25 bp, Mus musculus
tcaggtgctcgaagcctggattcca

SEQ ID NO: 767573 - DNA, 25 bp, Mus musculus
tcaggtgctcgatgcctggattcca

SEQ ID NO: 767574 - DNA, 25 bp, Mus musculus
tcaggtggaaaacccatagtgcctc

SEQ ID NO: 767575 - DNA, 25 bp, Mus musculus
tcaggtggaaaagccatagtgcctc

SEQ ID NO: 767576 - DNA, 25 bp, Mus musculus
tcaggtggaaagagtcaacctccaa

SEQ ID NO: 767577 - DNA, 25 bp, Mus musculus
tcaggtggaaagtgtcaacctccaa

SEQ ID NO: 767578 - DNA, 25 bp, Mus musculus
tcaggtggaattcaggctgcctcag

SEQ ID NO: 767579 - DNA, 25 bp, Mus musculus
tcaggtggaattgaggctgcctcag

SEQ ID NO: 767580 - DNA, 25 bp, Mus musculus
tcaggtggcatgcttggctcagacc

SEQ ID NO: 767581 - DNA, 25 bp, Mus musculus
tcaggtggcatggttggctcagacc

SEQ ID NO: 767582 - DNA, 25 bp, Mus musculus
tcaggtggccgcagaggtgcaattc

SEQ ID NO: 767583 - DNA, 25 bp, Mus musculus
tcaggtggccgctgaggtgcaattc

SEQ ID NO: 767584 - DNA, 25 bp, Mus musculus
tcaggtggcctacgacctgctgcca

SEQ ID NO: 767585 - DNA, 25 bp, Mus musculus
tcaggtggcctaggacctgctgcca

SEQ ID NO: 767586 - DNA, 25 bp, Mus musculus
tcaggtggctgcctaggtatcaagt

SEQ ID NO: 767587 - DNA, 25 bp, Mus musculus
tcaggtggctgcgtaggtatcaagt

SEQ ID NO: 767588 - DNA, 25 bp, Mus musculus
tcaggtgggctgatagaggtctatc

SEQ ID NO: 767589 - DNA, 25 bp, Mus musculus
tcaggtgggctgttagaggtctatc

SEQ ID NO: 767590 - DNA, 25 bp, Mus musculus
tcaggtgtagaaaggaaaaactgtt

SEQ ID NO: 767591 - DNA, 25 bp, Mus musculus
tcaggtgtagaatggaaaaactgtt

SEQ ID NO: 767592 - DNA, 25 bp, Mus musculus
tcaggtgtatctaactggtgcacaa

SEQ ID NO: 767593 - DNA, 25 bp, Mus musculus
tcaggtgtatcttactggtgcacaa

SEQ ID NO: 767594 - DNA, 25 bp, Mus musculus
tcaggtgtatgtcgctacagcctct

SEQ ID NO: 767595 - DNA, 25 bp, Mus musculus
tcaggtgtatgtggctacagcctct

SEQ ID NO: 767596 - DNA, 25 bp, Mus musculus
tcaggtgtcagaccccaaagagcct

SEQ ID NO: 767597 - DNA, 25 bp, Mus musculus
tcaggtgtcagagcccaaagagcct

SEQ ID NO: 767598 - DNA, 25 bp, Mus musculus
tcaggtgttgagagaactcaccttg

SEQ ID NO: 767599 - DNA, 25 bp, Mus musculus
tcaggtgttgagtgaactcaccttg

SEQ ID NO: 767600 - DNA, 25 bp, Mus musculus
tcaggtgtttccagctctcggtagc

SEQ ID NO: 767601 - DNA, 25 bp, Mus musculus
tcaggtgtttcctgctctcggtagc

SEQ ID NO: 767602 - DNA, 25 bp, Mus musculus
tcaggttaaagcatcctgggaagcc

SEQ ID NO: 767603 - DNA, 25 bp, Mus musculus
tcaggttaaagcttcctgggaagcc

SEQ ID NO: 767604 - DNA, 25 bp, Mus musculus
tcaggttaagggaccctgaggtgac

SEQ ID NO: 767605 - DNA, 25 bp, Mus musculus
tcaggttaagggtccctgaggtgac

SEQ ID NO: 767606 - DNA, 25 bp, Mus musculus
tcaggttactggctatggccccaaa

SEQ ID NO: 767607 - DNA, 25 bp, Mus musculus
tcaggttactgggtatggccccaaa

SEQ ID NO: 767608 - DNA, 25 bp, Mus musculus
tcaggttacttcatggcagctatcc

SEQ ID NO: 767609 - DNA, 25 bp, Mus musculus
tcaggttacttcttggcagctatcc

SEQ ID NO: 767610 - DNA, 25 bp, Mus musculus
tcaggttatgggacagacgctatca

SEQ ID NO: 767611 - DNA, 25 bp, Mus musculus
tcaggttatgggtcagacgctatca

SEQ ID NO: 767612 - DNA, 25 bp, Mus musculus
tcaggttcagacaccacttcaggtg

SEQ ID NO: 767613 - DNA, 25 bp, Mus musculus
tcaggttcagactccacttcaggtg

SEQ ID NO: 767614 - DNA, 25 bp, Mus musculus
tcaggttccaatcctgagcagatgc

SEQ ID NO: 767615 - DNA, 25 bp, Mus musculus
tcaggttccaatgctgagcagatgc

SEQ ID NO: 767616 - DNA, 25 bp, Mus musculus
tcaggttccatgatgggccgaacag

SEQ ID NO: 767617 - DNA, 25 bp, Mus musculus
tcaggttccatgttgggccgaacag

SEQ ID NO: 767618 - DNA, 25 bp, Mus musculus
tcaggttccgctcctgatgcccaag

SEQ ID NO: 767619 - DNA, 25 bp, Mus musculus
tcaggttccgctgctgatgcccaag

SEQ ID NO: 767620 - DNA, 25 bp, Mus musculus
tcaggttctgacagcttaagagaag

SEQ ID NO: 767621 - DNA, 25 bp, Mus musculus
tcaggttctgactgcttaagagaag

SEQ ID NO: 767622 - DNA, 25 bp, Mus musculus
tcaggttgcaacattatacctactg

SEQ ID NO: 767623 - DNA, 25 bp, Mus musculus
tcaggttgcaactttatacctactg

SEQ ID NO: 767624 - DNA, 25 bp, Mus musculus
tcaggttggactcagtcactggcct

SEQ ID NO: 767625 - DNA, 25 bp, Mus musculus
tcaggttggactgagtcactggcct

SEQ ID NO: 767626 - DNA, 25 bp, Mus musculus
tcaggttggagtacaacagatgctc

SEQ ID NO: 767627 - DNA, 25 bp, Mus musculus
tcaggttggagttcaacagatgctc

SEQ ID NO: 767628 - DNA, 25 bp, Mus musculus
tcaggttgtagcaccgtcagacatg

SEQ ID NO: 767629 - DNA, 25 bp, Mus musculus
tcaggttgtagctccgtcagacatg

SEQ ID NO: 767630 - DNA, 25 bp, Mus musculus
tcaggtttcgagagaagatcgacaa

SEQ ID NO: 767631 - DNA, 25 bp, Mus musculus
tcaggtttcgagtgaagatcgacaa

SEQ ID NO: 767632 - DNA, 25 bp, Mus musculus
tcaggtttctgcctccaggaaggtc

SEQ ID NO: 767633 - DNA, 25 bp, Mus musculus
tcaggtttctgcgtccaggaaggtc

SEQ ID NO: 767634 - DNA, 25 bp, Mus musculus
tcaggtttgccgctcagcacagaag

SEQ ID NO: 767635 - DNA, 25 bp, Mus musculus
tcaggtttgccggtcagcacagaag

SEQ ID NO: 767636 - DNA, 25 bp, Mus musculus
tcagtaaaagagcttcttgtgctcc

SEQ ID NO: 767637 - DNA, 25 bp, Mus musculus
tcagtaaaagaggttcttgtgctcc

SEQ ID NO: 767638 - DNA, 25 bp, Mus musculus
tcagtaaactggacttgcacactat

SEQ ID NO: 767639 - DNA, 25 bp, Mus musculus
tcagtaaactggtcttgcacactat

SEQ ID NO: 767640 - DNA, 25 bp, Mus musculus
tcagtaaatgacacgaagaggagct

SEQ ID NO: 767641 - DNA, 25 bp, Mus musculus
tcagtaaatgactcgaagaggagct

SEQ ID NO: 767642 - DNA, 25 bp, Mus musculus
tcagtaacaaaccactttcctcagc

SEQ ID NO: 767643 - DNA, 25 bp, Mus musculus
tcagtaacaaacgactttcctcagc

SEQ ID NO: 767644 - DNA, 25 bp, Mus musculus
tcagtaacatatcggctcgagtggg

SEQ ID NO: 767645 - DNA, 25 bp, Mus musculus
tcagtaacatatgggctcgagtggg

SEQ ID NO: 767646 - DNA, 25 bp, Mus musculus
tcagtaaccacacacggcctgtcat

SEQ ID NO: 767647 - DNA, 25 bp, Mus musculus
tcagtaaccacagacggcctgtcat

SEQ ID NO: 767648 - DNA, 25 bp, Mus musculus
tcagtaacctggctgccgagcgtgg

SEQ ID NO: 767649 - DNA, 25 bp, Mus musculus
tcagtaacctgggtgccgagcgtgg

SEQ ID NO: 767650 - DNA, 25 bp, Mus musculus
tcagtaacggaacagaagttcacga

SEQ ID NO: 767651 - DNA, 25 bp, Mus musculus
tcagtaacggaagagaagttcacga

SEQ ID NO: 767652 - DNA, 25 bp, Mus musculus
tcagtaagagtgaccttggccggaa

SEQ ID NO: 767653 - DNA, 25 bp, Mus musculus
tcagtaagagtgtccttggccggaa

SEQ ID NO: 767654 - DNA, 25 bp, Mus musculus
tcagtaagtactctccagctctcct

SEQ ID NO: 767655 - DNA, 25 bp, Mus musculus
tcagtaagtactgtccagctctcct

SEQ ID NO: 767656 - DNA, 25 bp, Mus musculus
tcagtaagtttcaaccaaagctggg

SEQ ID NO: 767657 - DNA, 25 bp, Mus musculus
tcagtaagtttctaccaaagctggg

SEQ ID NO: 767658 - DNA, 25 bp, Mus musculus
tcagtaatacccaggacttggtgct

SEQ ID NO: 767659 - DNA, 25 bp, Mus musculus
tcagtaataccctggacttggtgct

SEQ ID NO: 767660 - DNA, 25 bp, Mus musculus
tcagtaatgatgaagaccccaagac

SEQ ID NO: 767661 - DNA, 25 bp, Mus musculus
tcagtaatgatgtagaccccaagac

SEQ ID NO: 767662 - DNA, 25 bp, Mus musculus
tcagtacaaggtagctgaccccatc

SEQ ID NO: 767663 - DNA, 25 bp, Mus musculus
tcagtacaaggttgctgaccccatc

SEQ ID NO: 767664 - DNA, 25 bp, Mus musculus
tcagtacaatggctctgagctgtca

SEQ ID NO: 767665 - DNA, 25 bp, Mus musculus
tcagtacaatgggtctgagctgtca

SEQ ID NO: 767666 - DNA, 25 bp, Mus musculus
tcagtacacaacaggccgtggctcc

SEQ ID NO: 767667 - DNA, 25 bp, Mus musculus
tcagtacacaactggccgtggctcc

SEQ ID NO: 767668 - DNA, 25 bp, Mus musculus
tcagtacaccaccatcgggcggatg

SEQ ID NO: 767669 - DNA, 25 bp, Mus musculus
tcagtacaccacgatcgggcggatg

SEQ ID NO: 767670 - DNA, 25 bp, Mus musculus
tcagtacactccctgtgcttgagcg

SEQ ID NO: 767671 - DNA, 25 bp, Mus musculus
tcagtacactccgtgtgcttgagcg

SEQ ID NO: 767672 - DNA, 25 bp, Mus musculus
tcagtacagcttaagtggtttgtcc

SEQ ID NO: 767673 - DNA, 25 bp, Mus musculus
tcagtacagctttagtggtttgtcc

SEQ ID NO: 767674 - DNA, 25 bp, Mus musculus
tcagtacaggctaccctgtcatcgt

SEQ ID NO: 767675 - DNA, 25 bp, Mus musculus
tcagtacaggcttccctgtcatcgt

SEQ ID NO: 767676 - DNA, 25 bp, Mus musculus
tcagtacagtgccttgtagtggaca

SEQ ID NO: 767677 - DNA, 25 bp, Mus musculus
tcagtacagtgcgttgtagtggaca

SEQ ID NO: 767678 - DNA, 25 bp, Mus musculus
tcagtacagttcatgcactgccaga

SEQ ID NO: 767679 - DNA, 25 bp, Mus musculus
tcagtacagttcttgcactgccaga

SEQ ID NO: 767680 - DNA, 25 bp, Mus musculus
tcagtacatggacaagcaccctgga

SEQ ID NO: 767681 - DNA, 25 bp, Mus musculus
tcagtacatggagaagcaccctgga

SEQ ID NO: 767682 - DNA, 25 bp, Mus musculus
tcagtaccaggaagtgcagtcgcgg

SEQ ID NO: 767683 - DNA, 25 bp, Mus musculus
tcagtaccaggactctcttccgtca

SEQ ID NO: 767684 - DNA, 25 bp, Mus musculus
tcagtaccaggagtctcttccgtca

SEQ ID NO: 767685 - DNA, 25 bp, Mus musculus
tcagtaccaggatgtgcagtcgcgg

SEQ ID NO: 767686 - DNA, 25 bp, Mus musculus
tcagtacccgctcagtcagataggt

SEQ ID NO: 767687 - DNA, 25 bp, Mus musculus
tcagtacccgctgagtcagataggt

SEQ ID NO: 767688 - DNA, 25 bp, Mus musculus
tcagtacccgtaattgagatccgtg

SEQ ID NO: 767689 - DNA, 25 bp, Mus musculus
tcagtacccgtatttgagatccgtg

SEQ ID NO: 767690 - DNA, 25 bp, Mus musculus
tcagtaccgcctcgagaagcagagt

SEQ ID NO: 767691 - DNA, 25 bp, Mus musculus
tcagtaccgcctggagaagcagagt

SEQ ID NO: 767692 - DNA, 25 bp, Mus musculus
tcagtacctcatcccggagtccgta

SEQ ID NO: 767693 - DNA, 25 bp, Mus musculus
tcagtacctcatgccggagtccgta

SEQ ID NO: 767694 - DNA, 25 bp, Mus musculus
tcagtacctggtctacacgagcagc

SEQ ID NO: 767695 - DNA, 25 bp, Mus musculus
tcagtacctggtgtacacgagcagc

SEQ ID NO: 767696 - DNA, 25 bp, Mus musculus
tcagtacctgtccaaaatggtgccc

SEQ ID NO: 767697 - DNA, 25 bp, Mus musculus
tcagtacctgtcgaaaatggtgccc

SEQ ID NO: 767698 - DNA, 25 bp, Mus musculus
tcagtacgtggacagcttcacccag

SEQ ID NO: 767699 - DNA, 25 bp, Mus musculus
tcagtacgtggagagcttcacccag

SEQ ID NO: 767700 - DNA, 25 bp, Mus musculus
tcagtactaaaacccgattctgatc

SEQ ID NO: 767701 - DNA, 25 bp, Mus musculus
tcagtactaaaagccgattctgatc

SEQ ID NO: 767702 - DNA, 25 bp, Mus musculus
tcagtactacaaagggtcctatcct

SEQ ID NO: 767703 - DNA, 25 bp, Mus musculus
tcagtactacaatgggtcctatcct

SEQ ID NO: 767704 - DNA, 25 bp, Mus musculus
tcagtactatgactgggtgcccgtt

SEQ ID NO: 767705 - DNA, 25 bp, Mus musculus
tcagtactatgagtgggtgcccgtt

SEQ ID NO: 767706 - DNA, 25 bp, Mus musculus
tcagtactcaggctccacagacggg

SEQ ID NO: 767707 - DNA, 25 bp, Mus musculus
tcagtactcagggtccacagacggg

SEQ ID NO: 767708 - DNA, 25 bp, Mus musculus
tcagtactcggtacgggccggacca

SEQ ID NO: 767709 - DNA, 25 bp, Mus musculus
tcagtactcggttcgggccggacca

SEQ ID NO: 767710 - DNA, 25 bp, Mus musculus
tcagtactgcctccgaggagatcaa

SEQ ID NO: 767711 - DNA, 25 bp, Mus musculus
tcagtactgcctgcgaggagatcaa

SEQ ID NO: 767712 - DNA, 25 bp, Mus musculus
tcagtacttccgaggcccgctttgt

SEQ ID NO: 767713 - DNA, 25 bp, Mus musculus
tcagtacttccgtggcccgctttgt

SEQ ID NO: 767714 - DNA, 25 bp, Mus musculus
tcagtagaagatcccgatgagcctc

SEQ ID NO: 767715 - DNA, 25 bp, Mus musculus
tcagtagaagatgccgatgagcctc

SEQ ID NO: 767716 - DNA, 25 bp, Mus musculus
tcagtagagagccacttacggctct

SEQ ID NO: 767717 - DNA, 25 bp, Mus musculus
tcagtagagagcgacttacggctct

SEQ ID NO: 767718 - DNA, 25 bp, Mus musculus
tcagtagagggcactccgatgcatg

SEQ ID NO: 767719 - DNA, 25 bp, Mus musculus
tcagtagagggctctccgatgcatg

SEQ ID NO: 767720 - DNA, 25 bp, Mus musculus
tcagtagatcagagacagtgccctt

SEQ ID NO: 767721 - DNA, 25 bp, Mus musculus
tcagtagatcagtgacagtgccctt

SEQ ID NO: 767722 - DNA, 25 bp, Mus musculus
tcagtagatgctaggagagaacccc

SEQ ID NO: 767723 - DNA, 25 bp, Mus musculus
tcagtagatgcttggagagaacccc

SEQ ID NO: 767724 - DNA, 25 bp, Mus musculus
tcagtagccaaactgcttgggcagg

SEQ ID NO: 767725 - DNA, 25 bp, Mus musculus
tcagtagccaaagtgcttgggcagg

SEQ ID NO: 767726 - DNA, 25 bp, Mus musculus
tcagtagctcagaggcgatgtggac

SEQ ID NO: 767727 - DNA, 25 bp, Mus musculus
tcagtagctcagtggcgatgtggac

SEQ ID NO: 767728 - DNA, 25 bp, Mus musculus
tcagtaggagccaggtgagacagac

SEQ ID NO: 767729 - DNA, 25 bp, Mus musculus
tcagtaggagcctggtgagacagac

SEQ ID NO: 767730 - DNA, 25 bp, Mus musculus
tcagtagggctaacacattgctgtt

SEQ ID NO: 767731 - DNA, 25 bp, Mus musculus
tcagtagggctatcacattgctgtt

SEQ ID NO: 767732 - DNA, 25 bp, Mus musculus
tcagtagtcctgagtaaagagccca

SEQ ID NO: 767733 - DNA, 25 bp, Mus musculus
tcagtagtcctgtgtaaagagccca

SEQ ID NO: 767734 - DNA, 25 bp, Mus musculus
tcagtagtgactagatacaaaacaa

SEQ ID NO: 767735 - DNA, 25 bp, Mus musculus
tcagtagtgacttgatacaaaacaa

SEQ ID NO: 767736 - DNA, 25 bp, Mus musculus
tcagtagttaagagaaccagggccc

SEQ ID NO: 767737 - DNA, 25 bp, Mus musculus
tcagtagttaagtgaaccagggccc

SEQ ID NO: 767738 - DNA, 25 bp, Mus musculus
tcagtagttcacatgatgacacaat

SEQ ID NO: 767739 - DNA, 25 bp, Mus musculus
tcagtagttcacttgatgacacaat

SEQ ID NO: 767740 - DNA, 25 bp, Mus musculus
tcagtataatcaacagcaggcccct

SEQ ID NO: 767741 - DNA, 25 bp, Mus musculus
tcagtataatcatcagcaggcccct

SEQ ID NO: 767742 - DNA, 25 bp, Mus musculus
tcagtatagactaagccttgaggca

SEQ ID NO: 767743 - DNA, 25 bp, Mus musculus
tcagtatagacttagccttgaggca

SEQ ID NO: 767744 - DNA, 25 bp, Mus musculus
tcagtatatccgacagaagcacggg

SEQ ID NO: 767745 - DNA, 25 bp, Mus musculus
tcagtatatccgtcagaagcacggg

SEQ ID NO: 767746 - DNA, 25 bp, Mus musculus
tcagtatatgatcaagctatggaac

SEQ ID NO: 767747 - DNA, 25 bp, Mus musculus
tcagtatatgatgaagctatggaac

SEQ ID NO: 767748 - DNA, 25 bp, Mus musculus
tcagtatatgccaagacctgggctg

SEQ ID NO: 767749 - DNA, 25 bp, Mus musculus
tcagtatatgcctagacctgggctg

SEQ ID NO: 767750 - DNA, 25 bp, Mus musculus
tcagtatcaaggacatagtccagga

SEQ ID NO: 767751 - DNA, 25 bp, Mus musculus
tcagtatcaaggtcatagtccagga

SEQ ID NO: 767752 - DNA, 25 bp, Mus musculus
tcagtatcagatacgacacagcagc

SEQ ID NO: 767753 - DNA, 25 bp, Mus musculus
tcagtatcagattcgacacagcagc

SEQ ID NO: 767754 - DNA, 25 bp, Mus musculus
tcagtatccacacataaacggcagt

SEQ ID NO: 767755 - DNA, 25 bp, Mus musculus
tcagtatccacagataaacggcagt

SEQ ID NO: 767756 - DNA, 25 bp, Mus musculus
tcagtatccatcatagccatgggcc

SEQ ID NO: 767757 - DNA, 25 bp, Mus musculus
tcagtatccatcttagccatgggcc

SEQ ID NO: 767758 - DNA, 25 bp, Mus musculus
tcagtatccatgaggggccgcgtgc

SEQ ID NO: 767759 - DNA, 25 bp, Mus musculus
tcagtatccatgtggggccgcgtgc

SEQ ID NO: 767760 - DNA, 25 bp, Mus musculus
tcagtatcccctatccagctgtggg

SEQ ID NO: 767761 - DNA, 25 bp, Mus musculus
tcagtatcccctttccagctgtggg

SEQ ID NO: 767762 - DNA, 25 bp, Mus musculus
tcagtatcgagacaggcttccggcc

SEQ ID NO: 767763 - DNA, 25 bp, Mus musculus
tcagtatcgagagaggcttccggcc

SEQ ID NO: 767764 - DNA, 25 bp, Mus musculus
tcagtatgcctgagatgcatcgtgg

SEQ ID NO: 767765 - DNA, 25 bp, Mus musculus
tcagtatgcctgtgatgcatcgtgg

SEQ ID NO: 767766 - DNA, 25 bp, Mus musculus
tcagtatggagaatcagcccggcag

SEQ ID NO: 767767 - DNA, 25 bp, Mus musculus
tcagtatggagattcagcccggcag

SEQ ID NO: 767768 - DNA, 25 bp, Mus musculus
tcagtatggagcagtgacccctgca

SEQ ID NO: 767769 - DNA, 25 bp, Mus musculus
tcagtatggagctgtgacccctgca

SEQ ID NO: 767770 - DNA, 25 bp, Mus musculus
tcagtatgtactcctgtcatcagca

SEQ ID NO: 767771 - DNA, 25 bp, Mus musculus
tcagtatgtactgctgtcatcagca

SEQ ID NO: 767772 - DNA, 25 bp, Mus musculus
tcagtatgtgataaatggagaagta

SEQ ID NO: 767773 - DNA, 25 bp, Mus musculus
tcagtatgtgattaatggagaagta

SEQ ID NO: 767774 - DNA, 25 bp, Mus musculus
tcagtatgtggacgctgcctggtat

SEQ ID NO: 767775 - DNA, 25 bp, Mus musculus
tcagtatgtggaggctgcctggtat

SEQ ID NO: 767776 - DNA, 25 bp, Mus musculus
tcagtattagctacgttagctgcct

SEQ ID NO: 767777 - DNA, 25 bp, Mus musculus
tcagtattagcttcgttagctgcct

SEQ ID NO: 767778 - DNA, 25 bp, Mus musculus
tcagtattttcaagacccatttgtc

SEQ ID NO: 767779 - DNA, 25 bp, Mus musculus
tcagtattttcatgacccatttgtc

SEQ ID NO: 767780 - DNA, 25 bp, Mus musculus
tcagtcaaagagaactgatcctttg

SEQ ID NO: 767781 - DNA, 25 bp, Mus musculus
tcagtcaaagagtactgatcctttg

SEQ ID NO: 767782 - DNA, 25 bp, Mus musculus
tcagtcaagtacagtgtcgtataga

SEQ ID NO: 767783 - DNA, 25 bp, Mus musculus
tcagtcaagtactgtgtcgtataga

SEQ ID NO: 767784 - DNA, 25 bp, Mus musculus
tcagtcaatcagaaagctgccctgg

SEQ ID NO: 767785 - DNA, 25 bp, Mus musculus
tcagtcaatcagtaagctgccctgg

SEQ ID NO: 767786 - DNA, 25 bp, Mus musculus
tcagtcacaactaagtcattgtgtg

SEQ ID NO: 767787 - DNA, 25 bp, Mus musculus
tcagtcacaacttagtcattgtgtg

SEQ ID NO: 767788 - DNA, 25 bp, Mus musculus
tcagtcacaaggctcatcaagatgg

SEQ ID NO: 767789 - DNA, 25 bp, Mus musculus
tcagtcacaagggtcatcaagatgg

SEQ ID NO: 767790 - DNA, 25 bp, Mus musculus
tcagtcacagagctggcaacaaggc

SEQ ID NO: 767791 - DNA, 25 bp, Mus musculus
tcagtcacagaggtggcaacaaggc

SEQ ID NO: 767792 - DNA, 25 bp, Mus musculus
tcagtcacatccacattgtgcccat

SEQ ID NO: 767793 - DNA, 25 bp, Mus musculus
tcagtcacatcctcattgtgcccat

SEQ ID NO: 767794 - DNA, 25 bp, Mus musculus
tcagtcaccaaacaataccgcctga

SEQ ID NO: 767795 - DNA, 25 bp, Mus musculus
tcagtcaccaaagaataccgcctga

SEQ ID NO: 767796 - DNA, 25 bp, Mus musculus
tcagtcacgttgacacaaccagcgt

SEQ ID NO: 767797 - DNA, 25 bp, Mus musculus
tcagtcacgttgtcacaaccagcgt

SEQ ID NO: 767798 - DNA, 25 bp, Mus musculus
tcagtcactgagaccacagacaaag

SEQ ID NO: 767799 - DNA, 25 bp, Mus musculus
tcagtcactgagtccacagacaaag

SEQ ID NO: 767800 - DNA, 25 bp, Mus musculus
tcagtcagaaacacttcatcttagg

SEQ ID NO: 767801 - DNA, 25 bp, Mus musculus
tcagtcagaaactcttcatcttagg

SEQ ID NO: 767802 - DNA, 25 bp, Mus musculus
tcagtcagatcgcaccctgtaaaag

SEQ ID NO: 767803 - DNA, 25 bp, Mus musculus
tcagtcagatcggaccctgtaaaag

SEQ ID NO: 767804 - DNA, 25 bp, Mus musculus
tcagtcagcaagacgcgcaagggcg

SEQ ID NO: 767805 - DNA, 25 bp, Mus musculus
tcagtcagcaagtcgcgcaagggcg

SEQ ID NO: 767806 - DNA, 25 bp, Mus musculus
tcagtcagcgggattcctaggaagc

SEQ ID NO: 767807 - DNA, 25 bp, Mus musculus
tcagtcagcgggtttcctaggaagc

SEQ ID NO: 767808 - DNA, 25 bp, Mus musculus
tcagtcagctaaatcatagtcctgg

SEQ ID NO: 767809 - DNA, 25 bp, Mus musculus
tcagtcagctaattcatagtcctgg

SEQ ID NO: 767810 - DNA, 25 bp, Mus musculus
tcagtcaggaacagctaaaatctcc

SEQ ID NO: 767811 - DNA, 25 bp, Mus musculus
tcagtcaggaactgctaaaatctcc

SEQ ID NO: 767812 - DNA, 25 bp, Mus musculus
tcagtcaggagtccaaccccggagt

SEQ ID NO: 767813 - DNA, 25 bp, Mus musculus
tcagtcaggagtgcaaccccggagt

SEQ ID NO: 767814 - DNA, 25 bp, Mus musculus
tcagtcaggctgaagggagccagct

SEQ ID NO: 767815 - DNA, 25 bp, Mus musculus
tcagtcaggctgtagggagccagct

SEQ ID NO: 767816 - DNA, 25 bp, Mus musculus
tcagtcaggtacaggcaggagttat

SEQ ID NO: 767817 - DNA, 25 bp, Mus musculus
tcagtcaggtactggcaggagttat

SEQ ID NO: 767818 - DNA, 25 bp, Mus musculus
tcagtcatcaatcatccctctgatg

SEQ ID NO: 767819 - DNA, 25 bp, Mus musculus
tcagtcatcaatgatccctctgatg

SEQ ID NO: 767820 - DNA, 25 bp, Mus musculus
tcagtcatcgagcaggaaatcatct

SEQ ID NO: 767821 - DNA, 25 bp, Mus musculus
tcagtcatcgaggaggaaatcatct

SEQ ID NO: 767822 - DNA, 25 bp, Mus musculus
tcagtcatcgtgacattctgtggca

SEQ ID NO: 767823 - DNA, 25 bp, Mus musculus
tcagtcatcgtgtcattctgtggca

SEQ ID NO: 767824 - DNA, 25 bp, Mus musculus
tcagtcattccacatgaaaagatgc

SEQ ID NO: 767825 - DNA, 25 bp, Mus musculus
tcagtcattccagatgaaaagatgc

SEQ ID NO: 767826 - DNA, 25 bp, Mus musculus
tcagtcattgctctcaccatccagg

SEQ ID NO: 767827 - DNA, 25 bp, Mus musculus
tcagtcattgctgtcaccatccagg

SEQ ID NO: 767828 - DNA, 25 bp, Mus musculus
tcagtccaaggtccctgagtcttcc

SEQ ID NO: 767829 - DNA, 25 bp, Mus musculus
tcagtccaaggtgcctgagtcttcc

SEQ ID NO: 767830 - DNA, 25 bp, Mus musculus
tcagtccaatcaattcagctgtgga

SEQ ID NO: 767831 - DNA, 25 bp, Mus musculus
tcagtccaatcatttcagctgtgga

SEQ ID NO: 767832 - DNA, 25 bp, Mus musculus
tcagtccaccgtctcctgtgtgagc

SEQ ID NO: 767833 - DNA, 25 bp, Mus musculus
tcagtccaccgtgtcctgtgtgagc

SEQ ID NO: 767834 - DNA, 25 bp, Mus musculus
tcagtccagagcagcaagaattcag

SEQ ID NO: 767835 - DNA, 25 bp, Mus musculus
tcagtccagagctgcaagaattcag

SEQ ID NO: 767836 - DNA, 25 bp, Mus musculus
tcagtccagcttcttggccaggcca

SEQ ID NO: 767837 - DNA, 25 bp, Mus musculus
tcagtccagcttgttggccaggcca

SEQ ID NO: 767838 - DNA, 25 bp, Mus musculus
tcagtccatcatacacgccaaaagg

SEQ ID NO: 767839 - DNA, 25 bp, Mus musculus
tcagtccatcattcacgccaaaagg

SEQ ID NO: 767840 - DNA, 25 bp, Mus musculus
tcagtccatgtgaatctcacggtgg

SEQ ID NO: 767841 - DNA, 25 bp, Mus musculus
tcagtccatgtgtatctcacggtgg

SEQ ID NO: 767842 - DNA, 25 bp, Mus musculus
tcagtcccaacaaccgaaatgccat

SEQ ID NO: 767843 - DNA, 25 bp, Mus musculus
tcagtcccaacatccgaaatgccat

SEQ ID NO: 767844 - DNA, 25 bp, Mus musculus
tcagtcccagagacatccgagtgtg

SEQ ID NO: 767845 - DNA, 25 bp, Mus musculus
tcagtcccagagtcatccgagtgtg

SEQ ID NO: 767846 - DNA, 25 bp, Mus musculus
tcagtcccaggtctagaacgttctc

SEQ ID NO: 767847 - DNA, 25 bp, Mus musculus
tcagtcccaggtgtagaacgttctc

SEQ ID NO: 767848 - DNA, 25 bp, Mus musculus
tcagtccccaccaggagttccaggg

SEQ ID NO: 767849 - DNA, 25 bp, Mus musculus
tcagtccccacctggagttccaggg

SEQ ID NO: 767850 - DNA, 25 bp, Mus musculus
tcagtcccctgtatctcaccaaagg

SEQ ID NO: 767851 - DNA, 25 bp, Mus musculus
tcagtcccctgtttctcaccaaagg

SEQ ID NO: 767852 - DNA, 25 bp, Mus musculus
tcagtccctagtatagccccaaatc

SEQ ID NO: 767853 - DNA, 25 bp, Mus musculus
tcagtccctagtttagccccaaatc

SEQ ID NO: 767854 - DNA, 25 bp, Mus musculus
tcagtccctgctctcaagggagaaa

SEQ ID NO: 767855 - DNA, 25 bp, Mus musculus
tcagtccctgctgtcaagggagaaa

SEQ ID NO: 767856 - DNA, 25 bp, Mus musculus
tcagtccgaccgctggtttcgaaga

SEQ ID NO: 767857 - DNA, 25 bp, Mus musculus
tcagtccgaccggtggtttcgaaga

SEQ ID NO: 767858 - DNA, 25 bp, Mus musculus
tcagtccgctagaagcacactccag

SEQ ID NO: 767859 - DNA, 25 bp, Mus musculus
tcagtccgctagtagcacactccag

SEQ ID NO: 767860 - DNA, 25 bp, Mus musculus
tcagtccggtcacagaactcaagaa

SEQ ID NO: 767861 - DNA, 25 bp, Mus musculus
tcagtccggtcagagaactcaagaa

SEQ ID NO: 767862 - DNA, 25 bp, Mus musculus
tcagtccgtccgactggcaggacct

SEQ ID NO: 767863 - DNA, 25 bp, Mus musculus
tcagtccgtccgtctggcaggacct

SEQ ID NO: 767864 - DNA, 25 bp, Mus musculus
tcagtccgtcggaccgcgtggagca

SEQ ID NO: 767865 - DNA, 25 bp, Mus musculus
tcagtccgtcggtccgcgtggagca

SEQ ID NO: 767866 - DNA, 25 bp, Mus musculus
tcagtccgttggattggattatcac

SEQ ID NO: 767867 - DNA, 25 bp, Mus musculus
tcagtccgttggtttggattatcac

SEQ ID NO: 767868 - DNA, 25 bp, Mus musculus
tcagtcctcaggaattggctggacc

SEQ ID NO: 767869 - DNA, 25 bp, Mus musculus
tcagtcctcaggtattggctggacc

SEQ ID NO: 767870 - DNA, 25 bp, Mus musculus
tcagtcctctgacgtaataggctcc

SEQ ID NO: 767871 - DNA, 25 bp, Mus musculus
tcagtcctctgaggtaataggctcc

SEQ ID NO: 767872 - DNA, 25 bp, Mus musculus
tcagtcctctgtcaactgactgttt

SEQ ID NO: 767873 - DNA, 25 bp, Mus musculus
tcagtcctctgtgaactgactgttt

SEQ ID NO: 767874 - DNA, 25 bp, Mus musculus
tcagtcctgagacgtgtcggatgct

SEQ ID NO: 767875 - DNA, 25 bp, Mus musculus
tcagtcctgagaggtgtcggatgct

SEQ ID NO: 767876 - DNA, 25 bp, Mus musculus
tcagtcgacttcagcaggcaatcgc

SEQ ID NO: 767877 - DNA, 25 bp, Mus musculus
tcagtcgacttctgcaggcaatcgc

SEQ ID NO: 767878 - DNA, 25 bp, Mus musculus
tcagtcgagctgaccagttccctct

SEQ ID NO: 767879 - DNA, 25 bp, Mus musculus
tcagtcgagctgtccagttccctct

SEQ ID NO: 767880 - DNA, 25 bp, Mus musculus
tcagtcgccagacttctgtgatccc

SEQ ID NO: 767881 - DNA, 25 bp, Mus musculus
tcagtcgccagagttctgtgatccc

SEQ ID NO: 767882 - DNA, 25 bp, Mus musculus
tcagtcggattcatgacaacttgct

SEQ ID NO: 767883 - DNA, 25 bp, Mus musculus
tcagtcggattcttgacaacttgct

SEQ ID NO: 767884 - DNA, 25 bp, Mus musculus
tcagtcggcttcaagacaacatggc

SEQ ID NO: 767885 - DNA, 25 bp, Mus musculus
tcagtcggcttctagacaacatggc

SEQ ID NO: 767886 - DNA, 25 bp, Mus musculus
tcagtctaacttcactggctagaaa

SEQ ID NO: 767887 - DNA, 25 bp, Mus musculus
tcagtctaacttgactggctagaaa

SEQ ID NO: 767888 - DNA, 25 bp, Mus musculus
tcagtctacttcctgaggtggatgt

SEQ ID NO: 767889 - DNA, 25 bp, Mus musculus
tcagtctacttcgtgaggtggatgt

SEQ ID NO: 767890 - DNA, 25 bp, Mus musculus
tcagtctcacagaggccaagtgctg

SEQ ID NO: 767891 - DNA, 25 bp, Mus musculus
tcagtctcacagtggccaagtgctg

SEQ ID NO: 767892 - DNA, 25 bp, Mus musculus
tcagtctcgactcgacaacgtgatg

SEQ ID NO: 767893 - DNA, 25 bp, Mus musculus
tcagtctcgactggacaacgtgatg

SEQ ID NO: 767894 - DNA, 25 bp, Mus musculus
tcagtctcgagacgaaaggtgtcca

SEQ ID NO: 767895 - DNA, 25 bp, Mus musculus
tcagtctcgagaggaaaggtgtcca

SEQ ID NO: 767896 - DNA, 25 bp, Mus musculus
tcagtctcgcaccatggtttccggg

SEQ ID NO: 767897 - DNA, 25 bp, Mus musculus
tcagtctcgcacgatggtttccggg

SEQ ID NO: 767898 - DNA, 25 bp, Mus musculus
tcagtctcggatagatctaatgaag

SEQ ID NO: 767899 - DNA, 25 bp, Mus musculus
tcagtctcggattgatctaatgaag

SEQ ID NO: 767900 - DNA, 25 bp, Mus musculus
tcagtctgatatcagcatgtgaact

SEQ ID NO: 767901 - DNA, 25 bp, Mus musculus
tcagtctgatatgagcatgtgaact

SEQ ID NO: 767902 - DNA, 25 bp, Mus musculus
tcagtctgcaaacaagtttgtggag

SEQ ID NO: 767903 - DNA, 25 bp, Mus musculus
tcagtctgcaaagaagtttgtggag

SEQ ID NO: 767904 - DNA, 25 bp, Mus musculus
tcagtctgcactcagccatctatgc

SEQ ID NO: 767905 - DNA, 25 bp, Mus musculus
tcagtctgcactgagccatctatgc

SEQ ID NO: 767906 - DNA, 25 bp, Mus musculus
tcagtctggacaactggagcgtctg

SEQ ID NO: 767907 - DNA, 25 bp, Mus musculus
tcagtctggacatctggagcgtctg

SEQ ID NO: 767908 - DNA, 25 bp, Mus musculus
tcagtctggagaactccggctcaga

SEQ ID NO: 767909 - DNA, 25 bp, Mus musculus
tcagtctggagatctccggctcaga

SEQ ID NO: 767910 - DNA, 25 bp, Mus musculus
tcagtctgtcaacttgaacctgtgg

SEQ ID NO: 767911 - DNA, 25 bp, Mus musculus
tcagtctgtcaagttgaacctgtgg

SEQ ID NO: 767912 - DNA, 25 bp, Mus musculus
tcagtctgtctccagctatctggca

SEQ ID NO: 767913 - DNA, 25 bp, Mus musculus
tcagtctgtctcgagctatctggca

SEQ ID NO: 767914 - DNA, 25 bp, Mus musculus
tcagtcttctgcaacagtgacaaga

SEQ ID NO: 767915 - DNA, 25 bp, Mus musculus
tcagtcttctgctacagtgacaaga

SEQ ID NO: 767916 - DNA, 25 bp, Mus musculus
tcagtcttgtcactggtaatgtgct

SEQ ID NO: 767917 - DNA, 25 bp, Mus musculus
tcagtcttgtcagtggtaatgtgct

SEQ ID NO: 767918 - DNA, 25 bp, Mus musculus
tcagtcttttgcctcagacgctagc

SEQ ID NO: 767919 - DNA, 25 bp, Mus musculus
tcagtcttttgcgtcagacgctagc

SEQ ID NO: 767920 - DNA, 25 bp, Mus musculus
tcagtgaaaacacggccaagatctt

SEQ ID NO: 767921 - DNA, 25 bp, Mus musculus
tcagtgaaaacagggccaagatctt

SEQ ID NO: 767922 - DNA, 25 bp, Mus musculus
tcagtgaaaggcatctgcacatgct

SEQ ID NO: 767923 - DNA, 25 bp, Mus musculus
tcagtgaaaggcttctgcacatgct

SEQ ID NO: 767924 - DNA, 25 bp, Mus musculus
tcagtgaaaggtaacaatgacaaac

SEQ ID NO: 767925 - DNA, 25 bp, Mus musculus
tcagtgaaaggttacaatgacaaac

SEQ ID NO: 767926 - DNA, 25 bp, Mus musculus
tcagtgaaagtgctcgtgcgctgcc

SEQ ID NO: 767927 - DNA, 25 bp, Mus musculus
tcagtgaaagtggtcgtgcgctgcc

SEQ ID NO: 767928 - DNA, 25 bp, Mus musculus
tcagtgaaatggacacagaacaaaa

SEQ ID NO: 767929 - DNA, 25 bp, Mus musculus
tcagtgaaatggtcacagaacaaaa

SEQ ID NO: 767930 - DNA, 25 bp, Mus musculus
tcagtgaacactcggatgacacctg

SEQ ID NO: 767931 - DNA, 25 bp, Mus musculus
tcagtgaacactgggatgacacctg

SEQ ID NO: 767932 - DNA, 25 bp, Mus musculus
tcagtgaacctgaaataaaactggc

SEQ ID NO: 767933 - DNA, 25 bp, Mus musculus
tcagtgaacctgtaataaaactggc

SEQ ID NO: 767934 - DNA, 25 bp, Mus musculus
tcagtgaacgagcagcatccattgc

SEQ ID NO: 767935 - DNA, 25 bp, Mus musculus
tcagtgaacgaggagcatccattgc

SEQ ID NO: 767936 - DNA, 25 bp, Mus musculus
tcagtgaagaagcagcttgacgaga

SEQ ID NO: 767937 - DNA, 25 bp, Mus musculus
tcagtgaagaaggagcttgacgaga

SEQ ID NO: 767938 - DNA, 25 bp, Mus musculus
tcagtgaagaccatgagctccatct

SEQ ID NO: 767939 - DNA, 25 bp, Mus musculus
tcagtgaagaccttgagctccatct

SEQ ID NO: 767940 - DNA, 25 bp, Mus musculus
tcagtgaagccaagaactactttgc

SEQ ID NO: 767941 - DNA, 25 bp, Mus musculus
tcagtgaagccatgaactactttgc

SEQ ID NO: 767942 - DNA, 25 bp, Mus musculus
tcagtgaattagcagagcttgggaa

SEQ ID NO: 767943 - DNA, 25 bp, Mus musculus
tcagtgaattaggagagcttgggaa

SEQ ID NO: 767944 - DNA, 25 bp, Mus musculus
tcagtgacaatgaccgaagcctgct

SEQ ID NO: 767945 - DNA, 25 bp, Mus musculus
tcagtgacaatgtccgaagcctgct

SEQ ID NO: 767946 - DNA, 25 bp, Mus musculus
tcagtgaccacacagagatcaccaa

SEQ ID NO: 767947 - DNA, 25 bp, Mus musculus
tcagtgaccacagagagatcaccaa

SEQ ID NO: 767948 - DNA, 25 bp, Mus musculus
tcagtgaccattacccagtggaggt

SEQ ID NO: 767949 - DNA, 25 bp, Mus musculus
tcagtgaccatttcccagtggaggt

SEQ ID NO: 767950 - DNA, 25 bp, Mus musculus
tcagtgacccgcagttattttcatg

SEQ ID NO: 767951 - DNA, 25 bp, Mus musculus
tcagtgacccgctgttattttcatg

SEQ ID NO: 767952 - DNA, 25 bp, Mus musculus
tcagtgacccgtcgttggagagtca

SEQ ID NO: 767953 - DNA, 25 bp, Mus musculus
tcagtgacccgtggttggagagtca

SEQ ID NO: 767954 - DNA, 25 bp, Mus musculus
tcagtgacctaactacaaaagccag

SEQ ID NO: 767955 - DNA, 25 bp, Mus musculus
tcagtgacctaagtacaaaagccag

SEQ ID NO: 767956 - DNA, 25 bp, Mus musculus
tcagtgaccttcagatagactcatg

SEQ ID NO: 767957 - DNA, 25 bp, Mus musculus
tcagtgaccttctgatagactcatg

SEQ ID NO: 767958 - DNA, 25 bp, Mus musculus
tcagtgacctttccagtgtgcagct

SEQ ID NO: 767959 - DNA, 25 bp, Mus musculus
tcagtgacctttgcagtgtgcagct

SEQ ID NO: 767960 - DNA, 25 bp, Mus musculus
tcagtgacgaggagaagacccttcg

SEQ ID NO: 767961 - DNA, 25 bp, Mus musculus
tcagtgacgaggtgaagacccttcg

SEQ ID NO: 767962 - DNA, 25 bp, Mus musculus
tcagtgactaagcttctggagaaga

SEQ ID NO: 767963 - DNA, 25 bp, Mus musculus
tcagtgactaaggttctggagaaga

SEQ ID NO: 767964 - DNA, 25 bp, Mus musculus
tcagtgactcaaagacgggaaaccc

SEQ ID NO: 767965 - DNA, 25 bp, Mus musculus
tcagtgactcaatgacgggaaaccc

SEQ ID NO: 767966 - DNA, 25 bp, Mus musculus
tcagtgactggcatggcactcccaa

SEQ ID NO: 767967 - DNA, 25 bp, Mus musculus
tcagtgactggcttggcactcccaa

SEQ ID NO: 767968 - DNA, 25 bp, Mus musculus
tcagtgacttcgaggtgcggcaact

SEQ ID NO: 767969 - DNA, 25 bp, Mus musculus
tcagtgacttcgtggtgcggcaact

SEQ ID NO: 767970 - DNA, 25 bp, Mus musculus
tcagtgagaacgagtacgacgccag

SEQ ID NO: 767971 - DNA, 25 bp, Mus musculus
tcagtgagaacgtgtacgacgccag

SEQ ID NO: 767972 - DNA, 25 bp, Mus musculus
tcagtgagaatcacgatgcagggcc

SEQ ID NO: 767973 - DNA, 25 bp, Mus musculus
tcagtgagaatctcgatgcagggcc

SEQ ID NO: 767974 - DNA, 25 bp, Mus musculus
tcagtgagagccagaggaagctccg

SEQ ID NO: 767975 - DNA, 25 bp, Mus musculus
tcagtgagagcctgaggaagctccg

SEQ ID NO: 767976 - DNA, 25 bp, Mus musculus
tcagtgagatatatgcaagtatagc

SEQ ID NO: 767977 - DNA, 25 bp, Mus musculus
tcagtgagatatttgcaagtatagc

SEQ ID NO: 767978 - DNA, 25 bp, Mus musculus
tcagtgagatctagataacaagtac

SEQ ID NO: 767979 - DNA, 25 bp, Mus musculus
tcagtgagatcttgataacaagtac

SEQ ID NO: 767980 - DNA, 25 bp, Mus musculus
tcagtgagccgcagggccgcaaaag

SEQ ID NO: 767981 - DNA, 25 bp, Mus musculus
tcagtgagccgctgggccgcaaaag

SEQ ID NO: 767982 - DNA, 25 bp, Mus musculus
tcagtgagcggaatcagggccacac

SEQ ID NO: 767983 - DNA, 25 bp, Mus musculus
tcagtgagcggattcagggccacac

SEQ ID NO: 767984 - DNA, 25 bp, Mus musculus
tcagtgagctccaaagaatgaagat

SEQ ID NO: 767985 - DNA, 25 bp, Mus musculus
tcagtgagctcctaagaatgaagat

SEQ ID NO: 767986 - DNA, 25 bp, Mus musculus
tcagtgagctgaagcggcctcccct

SEQ ID NO: 767987 - DNA, 25 bp, Mus musculus
tcagtgagctgaataaccataccct

SEQ ID NO: 767988 - DNA, 25 bp, Mus musculus
tcagtgagctgatgcggcctcccct

SEQ ID NO: 767989 - DNA, 25 bp, Mus musculus
tcagtgagctgattaaccataccct

SEQ ID NO: 767990 - DNA, 25 bp, Mus musculus
tcagtgaggaaacctcgagagactt

SEQ ID NO: 767991 - DNA, 25 bp, Mus musculus
tcagtgaggaaagctcgagagactt

SEQ ID NO: 767992 - DNA, 25 bp, Mus musculus
tcagtgaggaacaggtacgcagctt

SEQ ID NO: 767993 - DNA, 25 bp, Mus musculus
tcagtgaggaactggtacgcagctt

SEQ ID NO: 767994 - DNA, 25 bp, Mus musculus
tcagtgaggaggacacagtcccttt

SEQ ID NO: 767995 - DNA, 25 bp, Mus musculus
tcagtgaggaggtcacagtcccttt

SEQ ID NO: 767996 - DNA, 25 bp, Mus musculus
tcagtgagtagacacctcttctttc

SEQ ID NO: 767997 - DNA, 25 bp, Mus musculus
tcagtgagtagagacctcttctttc

SEQ ID NO: 767998 - DNA, 25 bp, Mus musculus
tcagtgagtatcagagctgggtgcc

SEQ ID NO: 767999 - DNA, 25 bp, Mus musculus
tcagtgagtatctgagctgggtgcc

SEQ ID NO: 768000 - DNA, 25 bp, Mus musculus
tcagtgatacaacaaccaatttggc

SEQ ID NO: 768001 - DNA, 25 bp, Mus musculus
tcagtgatacaagaaccaatttggc

SEQ ID NO: 768002 - DNA, 25 bp, Mus musculus
tcagtgatgatgcttttattggtct

SEQ ID NO: 768003 - DNA, 25 bp, Mus musculus
tcagtgatgatggttttattggtct

SEQ ID NO: 768004 - DNA, 25 bp, Mus musculus
tcagtgattctaaagcacagctggc

SEQ ID NO: 768005 - DNA, 25 bp, Mus musculus
tcagtgattctatagcacagctggc

SEQ ID NO: 768006 - DNA, 25 bp, Mus musculus
tcagtgattgctaatagttaggcca

SEQ ID NO: 768007 - DNA, 25 bp, Mus musculus
tcagtgattgcttatagttaggcca

SEQ ID NO: 768008 - DNA, 25 bp, Mus musculus
tcagtgattttaaaacaccagtggg

SEQ ID NO: 768009 - DNA, 25 bp, Mus musculus
tcagtgattttataacaccagtggg

SEQ ID NO: 768010 - DNA, 25 bp, Mus musculus
tcagtgcaactgagaaagcaaggcc

SEQ ID NO: 768011 - DNA, 25 bp, Mus musculus
tcagtgcaactgtgaaagcaaggcc

SEQ ID NO: 768012 - DNA, 25 bp, Mus musculus
tcagtgcaagctctatcaatactac

SEQ ID NO: 768013 - DNA, 25 bp, Mus musculus
tcagtgcaagctgtatcaatactac

SEQ ID NO: 768014 - DNA, 25 bp, Mus musculus
tcagtgcaatggctgcagcaagtcc

SEQ ID NO: 768015 - DNA, 25 bp, Mus musculus
tcagtgcaatgggtgcagcaagtcc

SEQ ID NO: 768016 - DNA, 25 bp, Mus musculus
tcagtgcacagaagcctctcttgaa

SEQ ID NO: 768017 - DNA, 25 bp, Mus musculus
tcagtgcacagatgcctctcttgaa

SEQ ID NO: 768018 - DNA, 25 bp, Mus musculus
tcagtgcacagtcggatataagcaa

SEQ ID NO: 768019 - DNA, 25 bp, Mus musculus
tcagtgcacagtgggatataagcaa

SEQ ID NO: 768020 - DNA, 25 bp, Mus musculus
tcagtgcactaacaggctgggattg

SEQ ID NO: 768021 - DNA, 25 bp, Mus musculus
tcagtgcactaagaggctgggattg

SEQ ID NO: 768022 - DNA, 25 bp, Mus musculus
tcagtgcagagcacttgcctaaggc

SEQ ID NO: 768023 - DNA, 25 bp, Mus musculus
tcagtgcagagctcttgcctaaggc

SEQ ID NO: 768024 - DNA, 25 bp, Mus musculus
tcagtgcagaggactccagtgccga

SEQ ID NO: 768025 - DNA, 25 bp, Mus musculus
tcagtgcagaggtctccagtgccga

SEQ ID NO: 768026 - DNA, 25 bp, Mus musculus
tcagtgcaggttagcaccatcccat

SEQ ID NO: 768027 - DNA, 25 bp, Mus musculus
tcagtgcaggtttgcaccatcccat

SEQ ID NO: 768028 - DNA, 25 bp, Mus musculus
tcagtgcatacaacactcggctctt

SEQ ID NO: 768029 - DNA, 25 bp, Mus musculus
tcagtgcatacatcactcggctctt

SEQ ID NO: 768030 - DNA, 25 bp, Mus musculus
tcagtgcatctcaccagtcaagagg

SEQ ID NO: 768031 - DNA, 25 bp, Mus musculus
tcagtgcatctctccagtcaagagg

SEQ ID NO: 768032 - DNA, 25 bp, Mus musculus
tcagtgcatggcaagtacgcagcaa

SEQ ID NO: 768033 - DNA, 25 bp, Mus musculus
tcagtgcatggctagtacgcagcaa

SEQ ID NO: 768034 - DNA, 25 bp, Mus musculus
tcagtgcatttgaacccctatggtc

SEQ ID NO: 768035 - DNA, 25 bp, Mus musculus
tcagtgcatttgtacccctatggtc

SEQ ID NO: 768036 - DNA, 25 bp, Mus musculus
tcagtgccaatacatggagagatgc

SEQ ID NO: 768037 - DNA, 25 bp, Mus musculus
tcagtgccaatagatggagagatgc

SEQ ID NO: 768038 - DNA, 25 bp, Mus musculus
tcagtgccctgaagcctctcgggag

SEQ ID NO: 768039 - DNA, 25 bp, Mus musculus
tcagtgccctgatgcctctcgggag

SEQ ID NO: 768040 - DNA, 25 bp, Mus musculus
tcagtgcctgtgaccgaggagagcc

SEQ ID NO: 768041 - DNA, 25 bp, Mus musculus
tcagtgcctgtgtccgaggagagcc

SEQ ID NO: 768042 - DNA, 25 bp, Mus musculus
tcagtgccttagatgcccatgtggg

SEQ ID NO: 768043 - DNA, 25 bp, Mus musculus
tcagtgccttagttgcccatgtggg

SEQ ID NO: 768044 - DNA, 25 bp, Mus musculus
tcagtgccttggaacgcagggtgct

SEQ ID NO: 768045 - DNA, 25 bp, Mus musculus
tcagtgccttggtacgcagggtgct

SEQ ID NO: 768046 - DNA, 25 bp, Mus musculus
tcagtgcgagaaccaggaactcgag

SEQ ID NO: 768047 - DNA, 25 bp, Mus musculus
tcagtgcgagaagcaggaactcgag

SEQ ID NO: 768048 - DNA, 25 bp, Mus musculus
tcagtgcgcagacgccaatgtgtcc

SEQ ID NO: 768049 - DNA, 25 bp, Mus musculus
tcagtgcgcagaggccaatgtgtcc

SEQ ID NO: 768050 - DNA, 25 bp, Mus musculus
tcagtgcggatactcagtcatgaag

SEQ ID NO: 768051 - DNA, 25 bp, Mus musculus
tcagtgcggatagtcagtcatgaag

SEQ ID NO: 768052 - DNA, 25 bp, Mus musculus
tcagtgcggcctccaaaaggcccta

SEQ ID NO: 768053 - DNA, 25 bp, Mus musculus
tcagtgcggcctgcaaaaggcccta

SEQ ID NO: 768054 - DNA, 25 bp, Mus musculus
tcagtgctaaaacccagcagaaatg

SEQ ID NO: 768055 - DNA, 25 bp, Mus musculus
tcagtgctaaaagccagcagaaatg

SEQ ID NO: 768056 - DNA, 25 bp, Mus musculus
tcagtgctacagaagaatatggtgc

SEQ ID NO: 768057 - DNA, 25 bp, Mus musculus
tcagtgctacagtagaatatggtgc

SEQ ID NO: 768058 - DNA, 25 bp, Mus musculus
tcagtgctacgacgtgaccaccttt

SEQ ID NO: 768059 - DNA, 25 bp, Mus musculus
tcagtgctacgaggtgaccaccttt

SEQ ID NO: 768060 - DNA, 25 bp, Mus musculus
tcagtgctactgagagcggacatgc

SEQ ID NO: 768061 - DNA, 25 bp, Mus musculus
tcagtgctactgtgagcggacatgc

SEQ ID NO: 768062 - DNA, 25 bp, Mus musculus
tcagtgctatgtctcttccgggtgc

SEQ ID NO: 768063 - DNA, 25 bp, Mus musculus
tcagtgctatgtgtcttccgggtgc

SEQ ID NO: 768064 - DNA, 25 bp, Mus musculus
tcagtgctcgatacagaccttatca

SEQ ID NO: 768065 - DNA, 25 bp, Mus musculus
tcagtgctcgattcagaccttatca

SEQ ID NO: 768066 - DNA, 25 bp, Mus musculus
tcagtgctgaatagctgctgcctgc

SEQ ID NO: 768067 - DNA, 25 bp, Mus musculus
tcagtgctgaattgctgctgcctgc

SEQ ID NO: 768068 - DNA, 25 bp, Mus musculus
tcagtgctgacaatgctgatcaatt

SEQ ID NO: 768069 - DNA, 25 bp, Mus musculus
tcagtgctgacattgctgatcaatt

SEQ ID NO: 768070 - DNA, 25 bp, Mus musculus
tcagtgctgatgcttgcacgggatc

SEQ ID NO: 768071 - DNA, 25 bp, Mus musculus
tcagtgctgatggttgcacgggatc

SEQ ID NO: 768072 - DNA, 25 bp, Mus musculus
tcagtgctgctaacagaagatgtct

SEQ ID NO: 768073 - DNA, 25 bp, Mus musculus
tcagtgctgctatcagaagatgtct

SEQ ID NO: 768074 - DNA, 25 bp, Mus musculus
tcagtgctggagcaccctgtccatg

SEQ ID NO: 768075 - DNA, 25 bp, Mus musculus
tcagtgctggaggaccctgtccatg

SEQ ID NO: 768076 - DNA, 25 bp, Mus musculus
tcagtgctggtcaaaggctgccaac

SEQ ID NO: 768077 - DNA, 25 bp, Mus musculus
tcagtgctggtctaaggctgccaac

SEQ ID NO: 768078 - DNA, 25 bp, Mus musculus
tcagtgcttcgtcagcttctttgat

SEQ ID NO: 768079 - DNA, 25 bp, Mus musculus
tcagtgcttcgtgagcttctttgat

SEQ ID NO: 768080 - DNA, 25 bp, Mus musculus
tcagtggaataaagtagagaacctc

SEQ ID NO: 768081 - DNA, 25 bp, Mus musculus
tcagtggaataatgtagagaacctc

SEQ ID NO: 768082 - DNA, 25 bp, Mus musculus
tcagtggaatttctataaggaagtg

SEQ ID NO: 768083 - DNA, 25 bp, Mus musculus
tcagtggaatttgtataaggaagtg

SEQ ID NO: 768084 - DNA, 25 bp, Mus musculus
tcagtggacacccaaagcagagagc

SEQ ID NO: 768085 - DNA, 25 bp, Mus musculus
tcagtggacaccgaaagcagagagc

SEQ ID NO: 768086 - DNA, 25 bp, Mus musculus
tcagtggacccactatgatagtagt

SEQ ID NO: 768087 - DNA, 25 bp, Mus musculus
tcagtggacccagtatgatagtagt

SEQ ID NO: 768088 - DNA, 25 bp, Mus musculus
tcagtggacctgactcattaggcag

SEQ ID NO: 768089 - DNA, 25 bp, Mus musculus
tcagtggacctgtctcattaggcag

SEQ ID NO: 768090 - DNA, 25 bp, Mus musculus
tcagtggacgaaagcgcacgagctg

SEQ ID NO: 768091 - DNA, 25 bp, Mus musculus
tcagtggacgaatgcgcacgagctg

SEQ ID NO: 768092 - DNA, 25 bp, Mus musculus
tcagtggagcaaccccttggctcgc

SEQ ID NO: 768093 - DNA, 25 bp, Mus musculus
tcagtggagcaagcccttggctcgc

SEQ ID NO: 768094 - DNA, 25 bp, Mus musculus
tcagtggaggacatgcaaactgagg

SEQ ID NO: 768095 - DNA, 25 bp, Mus musculus
tcagtggaggacttgcaaactgagg

SEQ ID NO: 768096 - DNA, 25 bp, Mus musculus
tcagtggaggttctatctggattgc

SEQ ID NO: 768097 - DNA, 25 bp, Mus musculus
tcagtggaggttgtatctggattgc

SEQ ID NO: 768098 - DNA, 25 bp, Mus musculus
tcagtggagtcaccgtctgtgccat

SEQ ID NO: 768099 - DNA, 25 bp, Mus musculus
tcagtggagtcagcgtctgtgccat

SEQ ID NO: 768100 - DNA, 25 bp, Mus musculus
tcagtggagttcagatggctcaggc

SEQ ID NO: 768101 - DNA, 25 bp, Mus musculus
tcagtggagttctgatggctcaggc

SEQ ID NO: 768102 - DNA, 25 bp, Mus musculus
tcagtggatagcagttgcgggctta

SEQ ID NO: 768103 - DNA, 25 bp, Mus musculus
tcagtggatagctgttgcgggctta

SEQ ID NO: 768104 - DNA, 25 bp, Mus musculus
tcagtggatctgacgacaccaaaag

SEQ ID NO: 768105 - DNA, 25 bp, Mus musculus
tcagtggatctgtcgacaccaaaag

SEQ ID NO: 768106 - DNA, 25 bp, Mus musculus
tcagtggatggactaaacaagcttc

SEQ ID NO: 768107 - DNA, 25 bp, Mus musculus
tcagtggatggagtaaacaagcttc

SEQ ID NO: 768108 - DNA, 25 bp, Mus musculus
tcagtggcaagactttgctagccag

SEQ ID NO: 768109 - DNA, 25 bp, Mus musculus
tcagtggcaagagtttgctagccag

SEQ ID NO: 768110 - DNA, 25 bp, Mus musculus
tcagtggcactgctgtggcccacaa

SEQ ID NO: 768111 - DNA, 25 bp, Mus musculus
tcagtggcactggtgtggcccacaa

SEQ ID NO: 768112 - DNA, 25 bp, Mus musculus
tcagtggcccacactcaaggagaag

SEQ ID NO: 768113 - DNA, 25 bp, Mus musculus
tcagtggcccactctcaaggagaag

SEQ ID NO: 768114 - DNA, 25 bp, Mus musculus
tcagtggcccagacttaccgttcag

SEQ ID NO: 768115 - DNA, 25 bp, Mus musculus
tcagtggcccagtcttaccgttcag

SEQ ID NO: 768116 - DNA, 25 bp, Mus musculus
tcagtggcccggacttttcggttgc

SEQ ID NO: 768117 - DNA, 25 bp, Mus musculus
tcagtggcccggtcttttcggttgc

SEQ ID NO: 768118 - DNA, 25 bp, Mus musculus
tcagtggcctgcaagttattccaaa

SEQ ID NO: 768119 - DNA, 25 bp, Mus musculus
tcagtggcctgctagttattccaaa

SEQ ID NO: 768120 - DNA, 25 bp, Mus musculus
tcagtggccttcacatgctcctgct

SEQ ID NO: 768121 - DNA, 25 bp, Mus musculus
tcagtggccttctcatgctcctgct

SEQ ID NO: 768122 - DNA, 25 bp, Mus musculus
tcagtggctgtaatctaccgagaca

SEQ ID NO: 768123 - DNA, 25 bp, Mus musculus
tcagtggctgtattctaccgagaca

SEQ ID NO: 768124 - DNA, 25 bp, Mus musculus
tcagtgggaaccaggctaccatcca

SEQ ID NO: 768125 - DNA, 25 bp, Mus musculus
tcagtgggaacctggctaccatcca

SEQ ID NO: 768126 - DNA, 25 bp, Mus musculus
tcagtgggaactacaagaaaggaga

SEQ ID NO: 768127 - DNA, 25 bp, Mus musculus
tcagtgggaacttcaagaaaggaga

SEQ ID NO: 768128 - DNA, 25 bp, Mus musculus
tcagtgggaagtctggccctgatcc

SEQ ID NO: 768129 - DNA, 25 bp, Mus musculus
tcagtgggaagtgtggccctgatcc

SEQ ID NO: 768130 - DNA, 25 bp, Mus musculus
tcagtgggacatcgcttgtcttctg

SEQ ID NO: 768131 - DNA, 25 bp, Mus musculus
tcagtgggacatggcttgtcttctg

SEQ ID NO: 768132 - DNA, 25 bp, Mus musculus
tcagtgggactgcatgagcacagcc

SEQ ID NO: 768133 - DNA, 25 bp, Mus musculus
tcagtgggactggatgagcacagcc

SEQ ID NO: 768134 - DNA, 25 bp, Mus musculus
tcagtgggagaacctttaagccacg

SEQ ID NO: 768135 - DNA, 25 bp, Mus musculus
tcagtgggagaagctttaagccacg

SEQ ID NO: 768136 - DNA, 25 bp, Mus musculus
tcagtgggatcacatatgccgccag

SEQ ID NO: 768137 - DNA, 25 bp, Mus musculus
tcagtgggatcagatatgccgccag

SEQ ID NO: 768138 - DNA, 25 bp, Mus musculus
tcagtgggccacatccacaagcgag

SEQ ID NO: 768139 - DNA, 25 bp, Mus musculus
tcagtgggccacttccacaagcgag

SEQ ID NO: 768140 - DNA, 25 bp, Mus musculus
tcagtgggcctcaccttggcgcttt

SEQ ID NO: 768141 - DNA, 25 bp, Mus musculus
tcagtgggcctctccttggcgcttt

SEQ ID NO: 768142 - DNA, 25 bp, Mus musculus
tcagtgggctctaccttgaaaagac

SEQ ID NO: 768143 - DNA, 25 bp, Mus musculus
tcagtgggctcttccttgaaaagac

SEQ ID NO: 768144 - DNA, 25 bp, Mus musculus
tcagtgggtatgactgccagcgcca

SEQ ID NO: 768145 - DNA, 25 bp, Mus musculus
tcagtgggtatgtctgccagcgcca

SEQ ID NO: 768146 - DNA, 25 bp, Mus musculus
tcagtggtctatctctcgacccctg

SEQ ID NO: 768147 - DNA, 25 bp, Mus musculus
tcagtggtctatgtctcgacccctg

SEQ ID NO: 768148 - DNA, 25 bp, Mus musculus
tcagtggtctccaggaattccccag

SEQ ID NO: 768149 - DNA, 25 bp, Mus musculus
tcagtggtctcctggaattccccag

SEQ ID NO: 768150 - DNA, 25 bp, Mus musculus
tcagtggtctgaccagtatccttcc

SEQ ID NO: 768151 - DNA, 25 bp, Mus musculus
tcagtggtctgagcagtatccttcc

SEQ ID NO: 768152 - DNA, 25 bp, Mus musculus
tcagtggtgagtacatcggagcctt

SEQ ID NO: 768153 - DNA, 25 bp, Mus musculus
tcagtggtgagttcatcggagcctt

SEQ ID NO: 768154 - DNA, 25 bp, Mus musculus
tcagtggtggctcggtcctttgatc

SEQ ID NO: 768155 - DNA, 25 bp, Mus musculus
tcagtggtggctgggtcctttgatc

SEQ ID NO: 768156 - DNA, 25 bp, Mus musculus
tcagtggtgtacagaggtcatggcc

SEQ ID NO: 768157 - DNA, 25 bp, Mus musculus
tcagtggtgtactgaggtcatggcc

SEQ ID NO: 768158 - DNA, 25 bp, Mus musculus
tcagtggtgtccatgcagaacctca

SEQ ID NO: 768159 - DNA, 25 bp, Mus musculus
tcagtggtgtccttgcagaacctca

SEQ ID NO: 768160 - DNA, 25 bp, Mus musculus
tcagtggtgtcgagaataatgggaa

SEQ ID NO: 768161 - DNA, 25 bp, Mus musculus
tcagtggtgtcgtgaataatgggaa

SEQ ID NO: 768162 - DNA, 25 bp, Mus musculus
tcagtggtgttcaaccagaccccgg

SEQ ID NO: 768163 - DNA, 25 bp, Mus musculus
tcagtggtgttctaccagaccccgg

SEQ ID NO: 768164 - DNA, 25 bp, Mus musculus
tcagtggttaccctgccactcagtc

SEQ ID NO: 768165 - DNA, 25 bp, Mus musculus
tcagtggttaccgtgccactcagtc

SEQ ID NO: 768166 - DNA, 25 bp, Mus musculus
tcagtggttccacgatgcatcgcgt

SEQ ID NO: 768167 - DNA, 25 bp, Mus musculus
tcagtggttccaggatgcatcgcgt

SEQ ID NO: 768168 - DNA, 25 bp, Mus musculus
tcagtggttcgccagcacgaagagt

SEQ ID NO: 768169 - DNA, 25 bp, Mus musculus
tcagtggttcgcgagcacgaagagt

SEQ ID NO: 768170 - DNA, 25 bp, Mus musculus
tcagtgtagaaacagaaccttgtta

SEQ ID NO: 768171 - DNA, 25 bp, Mus musculus
tcagtgtagaaagagaaccttgtta

SEQ ID NO: 768172 - DNA, 25 bp, Mus musculus
tcagtgtatcagatcgccatggtgc

SEQ ID NO: 768173 - DNA, 25 bp, Mus musculus
tcagtgtatcagttcgccatggtgc

SEQ ID NO: 768174 - DNA, 25 bp, Mus musculus
tcagtgtcacaaccgttgacctgaa

SEQ ID NO: 768175 - DNA, 25 bp, Mus musculus
tcagtgtcacaagcgttgacctgaa

SEQ ID NO: 768176 - DNA, 25 bp, Mus musculus
tcagtgtcacctcaccgactgtttg

SEQ ID NO: 768177 - DNA, 25 bp, Mus musculus
tcagtgtcacctgaccgactgtttg

SEQ ID NO: 768178 - DNA, 25 bp, Mus musculus
tcagtgtcactgcacgttgccgaat

SEQ ID NO: 768179 - DNA, 25 bp, Mus musculus
tcagtgtcactggacgttgccgaat

SEQ ID NO: 768180 - DNA, 25 bp, Mus musculus
tcagtgtcatgtccgaggtggctca

SEQ ID NO: 768181 - DNA, 25 bp, Mus musculus
tcagtgtcatgtgcgaggtggctca

SEQ ID NO: 768182 - DNA, 25 bp, Mus musculus
tcagtgtcattccaggttacccggg

SEQ ID NO: 768183 - DNA, 25 bp, Mus musculus
tcagtgtcattcgaggttacccggg

SEQ ID NO: 768184 - DNA, 25 bp, Mus musculus
tcagtgtcccctagcttccgcagga

SEQ ID NO: 768185 - DNA, 25 bp, Mus musculus
tcagtgtccccttgcttccgcagga

SEQ ID NO: 768186 - DNA, 25 bp, Mus musculus
tcagtgtccgtcctgcaaaaccatc

SEQ ID NO: 768187 - DNA, 25 bp, Mus musculus
tcagtgtccgtcgtgcaaaaccatc

SEQ ID NO: 768188 - DNA, 25 bp, Mus musculus
tcagtgtcctggcttaagaaccaca

SEQ ID NO: 768189 - DNA, 25 bp, Mus musculus
tcagtgtcctgggttaagaaccaca

SEQ ID NO: 768190 - DNA, 25 bp, Mus musculus
tcagtgtctttaagacccatctgtc

SEQ ID NO: 768191 - DNA, 25 bp, Mus musculus
tcagtgtctttatgacccatctgtc

SEQ ID NO: 768192 - DNA, 25 bp, Mus musculus
tcagtgtgacgacctttgcacttac

SEQ ID NO: 768193 - DNA, 25 bp, Mus musculus
tcagtgtgacgagctttgcacttac

SEQ ID NO: 768194 - DNA, 25 bp, Mus musculus
tcagtgtgactgagctagtaagagt

SEQ ID NO: 768195 - DNA, 25 bp, Mus musculus
tcagtgtgactgtgctagtaagagt

SEQ ID NO: 768196 - DNA, 25 bp, Mus musculus
tcagtgtgatatatatatgcatgca

SEQ ID NO: 768197 - DNA, 25 bp, Mus musculus
tcagtgtgatatttatatgcatgca

SEQ ID NO: 768198 - DNA, 25 bp, Mus musculus
tcagtgtgggcacctcgtgccaaag

SEQ ID NO: 768199 - DNA, 25 bp, Mus musculus
tcagtgtgggcagctcgtgccaaag

SEQ ID NO: 768200 - DNA, 25 bp, Mus musculus
tcagtgttccacaagcttcaggtca

SEQ ID NO: 768201 - DNA, 25 bp, Mus musculus
tcagtgttccactagcttcaggtca

SEQ ID NO: 768202 - DNA, 25 bp, Mus musculus
tcagtgttccatcttccgactaggg

SEQ ID NO: 768203 - DNA, 25 bp, Mus musculus
tcagtgttccatgttccgactaggg

SEQ ID NO: 768204 - DNA, 25 bp, Mus musculus
tcagtgttcccgagtggcctggccg

SEQ ID NO: 768205 - DNA, 25 bp, Mus musculus
tcagtgttcccgtgtggcctggccg

SEQ ID NO: 768206 - DNA, 25 bp, Mus musculus
tcagtgttctctacagccccttgaa

SEQ ID NO: 768207 - DNA, 25 bp, Mus musculus
tcagtgttctcttcagccccttgaa

SEQ ID NO: 768208 - DNA, 25 bp, Mus musculus
tcagtgttgacaaagcctttgggca

SEQ ID NO: 768209 - DNA, 25 bp, Mus musculus
tcagtgttgacatagcctttgggca

SEQ ID NO: 768210 - DNA, 25 bp, Mus musculus
tcagtgttggacacatccaatggct

SEQ ID NO: 768211 - DNA, 25 bp, Mus musculus
tcagtgttggactcatccaatggct

SEQ ID NO: 768212 - DNA, 25 bp, Mus musculus
tcagtgttgtaacgccttgatagag

SEQ ID NO: 768213 - DNA, 25 bp, Mus musculus
tcagtgttgtaaggccttgatagag

SEQ ID NO: 768214 - DNA, 25 bp, Mus musculus
tcagtgttgttgctagagaggaagc

SEQ ID NO: 768215 - DNA, 25 bp, Mus musculus
tcagtgttgttggtagagaggaagc

SEQ ID NO: 768216 - DNA, 25 bp, Mus musculus
tcagtgttttccatcctgttagaat

SEQ ID NO: 768217 - DNA, 25 bp, Mus musculus
tcagtgttttccttcctgttagaat

SEQ ID NO: 768218 - DNA, 25 bp, Mus musculus
tcagttaaaaaacccttggagccat

SEQ ID NO: 768219 - DNA, 25 bp, Mus musculus
tcagttaaaaaagccttggagccat

SEQ ID NO: 768220 - DNA, 25 bp, Mus musculus
tcagttaaagctcccctggagccgg

SEQ ID NO: 768221 - DNA, 25 bp, Mus musculus
tcagttaaagctgccctggagccgg

SEQ ID NO: 768222 - DNA, 25 bp, Mus musculus
tcagttaacaacctatcgagggagg

SEQ ID NO: 768223 - DNA, 25 bp, Mus musculus
tcagttaacaacgtatcgagggagg

SEQ ID NO: 768224 - DNA, 25 bp, Mus musculus
tcagttaaggtgacacaccagggtg

SEQ ID NO: 768225 - DNA, 25 bp, Mus musculus
tcagttaaggtgtcacaccagggtg

SEQ ID NO: 768226 - DNA, 25 bp, Mus musculus
tcagttacactgcttggcccatgag

SEQ ID NO: 768227 - DNA, 25 bp, Mus musculus
tcagttacactggttggcccatgag

SEQ ID NO: 768228 - DNA, 25 bp, Mus musculus
tcagttaccttgacgatgtcccatt

SEQ ID NO: 768229 - DNA, 25 bp, Mus musculus
tcagttaccttgtcgatgtcccatt

SEQ ID NO: 768230 - DNA, 25 bp, Mus musculus
tcagttagcaggacaaagatgcatt

SEQ ID NO: 768231 - DNA, 25 bp, Mus musculus
tcagttagcaggtcaaagatgcatt

SEQ ID NO: 768232 - DNA, 25 bp, Mus musculus
tcagttagtgcaccgaaagggctta

SEQ ID NO: 768233 - DNA, 25 bp, Mus musculus
tcagttagtgcagcgaaagggctta

SEQ ID NO: 768234 - DNA, 25 bp, Mus musculus
tcagttatggtcatgccccagctgg

SEQ ID NO: 768235 - DNA, 25 bp, Mus musculus
tcagttatggtcttgccccagctgg

SEQ ID NO: 768236 - DNA, 25 bp, Mus musculus
tcagttcaccttagagtagcagaac

SEQ ID NO: 768237 - DNA, 25 bp, Mus musculus
tcagttcacctttgagtagcagaac

SEQ ID NO: 768238 - DNA, 25 bp, Mus musculus
tcagttcacgatatcccgccgtggg

SEQ ID NO: 768239 - DNA, 25 bp, Mus musculus
tcagttcacgatttcccgccgtggg

SEQ ID NO: 768240 - DNA, 25 bp, Mus musculus
tcagttcacgccatacagctgggta

SEQ ID NO: 768241 - DNA, 25 bp, Mus musculus
tcagttcacgccttacagctgggta

SEQ ID NO: 768242 - DNA, 25 bp, Mus musculus
tcagttcactgtcggagtcaagccc

SEQ ID NO: 768243 - DNA, 25 bp, Mus musculus
tcagttcactgtgggagtcaagccc

SEQ ID NO: 768244 - DNA, 25 bp, Mus musculus
tcagttcagacacttccacagagcc

SEQ ID NO: 768245 - DNA, 25 bp, Mus musculus
tcagttcagacagttccacagagcc

SEQ ID NO: 768246 - DNA, 25 bp, Mus musculus
tcagttcagatgcatccgcagcaag

SEQ ID NO: 768247 - DNA, 25 bp, Mus musculus
tcagttcagatggatccgcagcaag

SEQ ID NO: 768248 - DNA, 25 bp, Mus musculus
tcagttcaggaacctgagccacaat

SEQ ID NO: 768249 - DNA, 25 bp, Mus musculus
tcagttcaggaagctgagccacaat

SEQ ID NO: 768250 - DNA, 25 bp, Mus musculus
tcagttcattgaagagctcatggag

SEQ ID NO: 768251 - DNA, 25 bp, Mus musculus
tcagttcattgatgagctcatggag

SEQ ID NO: 768252 - DNA, 25 bp, Mus musculus
tcagttccaaatagagaaggctgca

SEQ ID NO: 768253 - DNA, 25 bp, Mus musculus
tcagttccaaattgagaaggctgca

SEQ ID NO: 768254 - DNA, 25 bp, Mus musculus
tcagttccacacacgtcaacctaag

SEQ ID NO: 768255 - DNA, 25 bp, Mus musculus
tcagttccacactcgtcaacctaag

SEQ ID NO: 768256 - DNA, 25 bp, Mus musculus
tcagttccagcgacttcgctatatc

SEQ ID NO: 768257 - DNA, 25 bp, Mus musculus
tcagttccagcgtcttcgctatatc

SEQ ID NO: 768258 - DNA, 25 bp, Mus musculus
tcagttccagctataggaggaggga

SEQ ID NO: 768259 - DNA, 25 bp, Mus musculus
tcagttccagctttaggaggaggga

SEQ ID NO: 768260 - DNA, 25 bp, Mus musculus
tcagttccatgacatcctcatccga

SEQ ID NO: 768261 - DNA, 25 bp, Mus musculus
tcagttccatgagatcctcatccga

SEQ ID NO: 768262 - DNA, 25 bp, Mus musculus
tcagttcccatgaaagtgcagcaca

SEQ ID NO: 768263 - DNA, 25 bp, Mus musculus
tcagttcccatgtaagtgcagcaca

SEQ ID NO: 768264 - DNA, 25 bp, Mus musculus
tcagttccccacagacgatgagtcg

SEQ ID NO: 768265 - DNA, 25 bp, Mus musculus
tcagttccccactgacgatgagtcg

SEQ ID NO: 768266 - DNA, 25 bp, Mus musculus
tcagttccgcaaatgtactgcaaat

SEQ ID NO: 768267 - DNA, 25 bp, Mus musculus
tcagttccgcaattgtactgcaaat

SEQ ID NO: 768268 - DNA, 25 bp, Mus musculus
tcagttccgggaagacactgctttt

SEQ ID NO: 768269 - DNA, 25 bp, Mus musculus
tcagttccgggatgacactgctttt

SEQ ID NO: 768270 - DNA, 25 bp, Mus musculus
tcagttcgggtcagttaagctccgc

SEQ ID NO: 768271 - DNA, 25 bp, Mus musculus
tcagttcgggtctgttaagctccgc

SEQ ID NO: 768272 - DNA, 25 bp, Mus musculus
tcagttctaacgcagaagactcgga

SEQ ID NO: 768273 - DNA, 25 bp, Mus musculus
tcagttctaacggagaagactcgga

SEQ ID NO: 768274 - DNA, 25 bp, Mus musculus
tcagttctaagacctggcagccagc

SEQ ID NO: 768275 - DNA, 25 bp, Mus musculus
tcagttctaagagctggcagccagc

SEQ ID NO: 768276 - DNA, 25 bp, Mus musculus
tcagttctacatatctcgacagtgg

SEQ ID NO: 768277 - DNA, 25 bp, Mus musculus
tcagttctacatttctcgacagtgg

SEQ ID NO: 768278 - DNA, 25 bp, Mus musculus
tcagttctaccaaaagaccatatgc

SEQ ID NO: 768279 - DNA, 25 bp, Mus musculus
tcagttctaccataagaccatatgc

SEQ ID NO: 768280 - DNA, 25 bp, Mus musculus
tcagttctactgaacgatggtggga

SEQ ID NO: 768281 - DNA, 25 bp, Mus musculus
tcagttctactgtacgatggtggga

SEQ ID NO: 768282 - DNA, 25 bp, Mus musculus
tcagttctagtgacctcggctcggg

SEQ ID NO: 768283 - DNA, 25 bp, Mus musculus
tcagttctagtgtcctcggctcggg

SEQ ID NO: 768284 - DNA, 25 bp, Mus musculus
tcagttctatgcagcacaccaggga

SEQ ID NO: 768285 - DNA, 25 bp, Mus musculus
tcagttctatgctgcacaccaggga

SEQ ID NO: 768286 - DNA, 25 bp, Mus musculus
tcagttctcacgagacatggatctg

SEQ ID NO: 768287 - DNA, 25 bp, Mus musculus
tcagttctcacgtgacatggatctg

SEQ ID NO: 768288 - DNA, 25 bp, Mus musculus
tcagttctcagtacagaaagtcact

SEQ ID NO: 768289 - DNA, 25 bp, Mus musculus
tcagttctcagttcagaaagtcact

SEQ ID NO: 768290 - DNA, 25 bp, Mus musculus
tcagttctcccacagggcggtgaga

SEQ ID NO: 768291 - DNA, 25 bp, Mus musculus
tcagttctcccagagggcggtgaga

SEQ ID NO: 768292 - DNA, 25 bp, Mus musculus
tcagttctcctgctaagcattgcct

SEQ ID NO: 768293 - DNA, 25 bp, Mus musculus
tcagttctcctggtaagcattgcct

SEQ ID NO: 768294 - DNA, 25 bp, Mus musculus
tcagttctcttaaatcacagcccag

SEQ ID NO: 768295 - DNA, 25 bp, Mus musculus
tcagttctcttatatcacagcccag

SEQ ID NO: 768296 - DNA, 25 bp, Mus musculus
tcagttctgacaccagggatggacc

SEQ ID NO: 768297 - DNA, 25 bp, Mus musculus
tcagttctgacagcagggatggacc

SEQ ID NO: 768298 - DNA, 25 bp, Mus musculus
tcagttctgccaacggaatcacagt

SEQ ID NO: 768299 - DNA, 25 bp, Mus musculus
tcagttctgccatcggaatcacagt

SEQ ID NO: 768300 - DNA, 25 bp, Mus musculus
tcagttctgcccagtgataagttcc

SEQ ID NO: 768301 - DNA, 25 bp, Mus musculus
tcagttctgccctgtgataagttcc

SEQ ID NO: 768302 - DNA, 25 bp, Mus musculus
tcagttctgcctccgtagtaaagat

SEQ ID NO: 768303 - DNA, 25 bp, Mus musculus
tcagttctgcctgcgtagtaaagat

SEQ ID NO: 768304 - DNA, 25 bp, Mus musculus
tcagttctggagactattttttcca

SEQ ID NO: 768305 - DNA, 25 bp, Mus musculus
tcagttctggagtctattttttcca

SEQ ID NO: 768306 - DNA, 25 bp, Mus musculus
tcagttctgtcccatgccattccag

SEQ ID NO: 768307 - DNA, 25 bp, Mus musculus
tcagttctgtccgatgccattccag

SEQ ID NO: 768308 - DNA, 25 bp, Mus musculus
tcagttcttcaaaggccctaattac

SEQ ID NO: 768309 - DNA, 25 bp, Mus musculus
tcagttcttcaatggccctaattac

SEQ ID NO: 768310 - DNA, 25 bp, Mus musculus
tcagttcttccacaagaaatcgcag

SEQ ID NO: 768311 - DNA, 25 bp, Mus musculus
tcagttcttccagaagaaatcgcag

SEQ ID NO: 768312 - DNA, 25 bp, Mus musculus
tcagttcttctgcagctaagttccc

SEQ ID NO: 768313 - DNA, 25 bp, Mus musculus
tcagttcttctggagctaagttccc

SEQ ID NO: 768314 - DNA, 25 bp, Mus musculus
tcagttcttggtcgcattagagacg

SEQ ID NO: 768315 - DNA, 25 bp, Mus musculus
tcagttcttggtggcattagagacg

SEQ ID NO: 768316 - DNA, 25 bp, Mus musculus
tcagttgaaaaaaggcgacactttc

SEQ ID NO: 768317 - DNA, 25 bp, Mus musculus
tcagttgaaaaatggcgacactttc

SEQ ID NO: 768318 - DNA, 25 bp, Mus musculus
tcagttgacaatagctggcccatgc

SEQ ID NO: 768319 - DNA, 25 bp, Mus musculus
tcagttgacaattgctggcccatgc

SEQ ID NO: 768320 - DNA, 25 bp, Mus musculus
tcagttgaccccatctatcgagaca

SEQ ID NO: 768321 - DNA, 25 bp, Mus musculus
tcagttgaccccttctatcgagaca

SEQ ID NO: 768322 - DNA, 25 bp, Mus musculus
tcagttgcacccagcaagagggagt

SEQ ID NO: 768323 - DNA, 25 bp, Mus musculus
tcagttgcaccctgcaagagggagt

SEQ ID NO: 768324 - DNA, 25 bp, Mus musculus
tcagttgcagcaccatgtggctcaa

SEQ ID NO: 768325 - DNA, 25 bp, Mus musculus
tcagttgcagcagcatgtggctcaa

SEQ ID NO: 768326 - DNA, 25 bp, Mus musculus
tcagttgcaggcagcctatcaccag

SEQ ID NO: 768327 - DNA, 25 bp, Mus musculus
tcagttgcaggctgcctatcaccag

SEQ ID NO: 768328 - DNA, 25 bp, Mus musculus
tcagttgcctgactcgcttggacca

SEQ ID NO: 768329 - DNA, 25 bp, Mus musculus
tcagttgcctgagtcgcttggacca

SEQ ID NO: 768330 - DNA, 25 bp, Mus musculus
tcagttggcaggagccatggcgtac

SEQ ID NO: 768331 - DNA, 25 bp, Mus musculus
tcagttggcaggtgccatggcgtac

SEQ ID NO: 768332 - DNA, 25 bp, Mus musculus
tcagttggcatcctgttcagttgaa

SEQ ID NO: 768333 - DNA, 25 bp, Mus musculus
tcagttggcatcgtgttcagttgaa

SEQ ID NO: 768334 - DNA, 25 bp, Mus musculus
tcagttgggaagatcagggaaacca

SEQ ID NO: 768335 - DNA, 25 bp, Mus musculus
tcagttgggaagttcagggaaacca

SEQ ID NO: 768336 - DNA, 25 bp, Mus musculus
tcagttgggaggctagtgtctacca

SEQ ID NO: 768337 - DNA, 25 bp, Mus musculus
tcagttgggagggtagtgtctacca

SEQ ID NO: 768338 - DNA, 25 bp, Mus musculus
tcagttggttacattaaacggcagg

SEQ ID NO: 768339 - DNA, 25 bp, Mus musculus
tcagttggttactttaaacggcagg

SEQ ID NO: 768340 - DNA, 25 bp, Mus musculus
tcagttgtgacacccggagctgctg

SEQ ID NO: 768341 - DNA, 25 bp, Mus musculus
tcagttgtgacagccggagctgctg

SEQ ID NO: 768342 - DNA, 25 bp, Mus musculus
tcagttgtttagctgtgcagccagc

SEQ ID NO: 768343 - DNA, 25 bp, Mus musculus
tcagttgtttaggtgtgcagccagc

SEQ ID NO: 768344 - DNA, 25 bp, Mus musculus
tcagtttaatgtcccgatatccccg

SEQ ID NO: 768345 - DNA, 25 bp, Mus musculus
tcagtttaatgtgccgatatccccg

SEQ ID NO: 768346 - DNA, 25 bp, Mus musculus
tcagtttaccctcatctggcacagg

SEQ ID NO: 768347 - DNA, 25 bp, Mus musculus
tcagtttaccctgatctggcacagg

SEQ ID NO: 768348 - DNA, 25 bp, Mus musculus
tcagtttcccaacttccaaaatcaa

SEQ ID NO: 768349 - DNA, 25 bp, Mus musculus
tcagtttcccaagttccaaaatcaa

SEQ ID NO: 768350 - DNA, 25 bp, Mus musculus
tcagtttcccttcccaatgtaattt

SEQ ID NO: 768351 - DNA, 25 bp, Mus musculus
tcagtttcccttgccaatgtaattt

SEQ ID NO: 768352 - DNA, 25 bp, Mus musculus
tcagtttctataaaagtgttggaga

SEQ ID NO: 768353 - DNA, 25 bp, Mus musculus
tcagtttctatataagtgttggaga

SEQ ID NO: 768354 - DNA, 25 bp, Mus musculus
tcagtttgaagaccatattaaggcc

SEQ ID NO: 768355 - DNA, 25 bp, Mus musculus
tcagtttgaagagcatattaaggcc

SEQ ID NO: 768356 - DNA, 25 bp, Mus musculus
tcagtttgacgaccaaacctaaaac

SEQ ID NO: 768357 - DNA, 25 bp, Mus musculus
tcagtttgacgagcaaacctaaaac

SEQ ID NO: 768358 - DNA, 25 bp, Mus musculus
tcagtttgatagaatcaagaccctt

SEQ ID NO: 768359 - DNA, 25 bp, Mus musculus
tcagtttgatagtatcaagaccctt

SEQ ID NO: 768360 - DNA, 25 bp, Mus musculus
tcagtttggattaagggatgaggct

SEQ ID NO: 768361 - DNA, 25 bp, Mus musculus
tcagtttggatttagggatgaggct

SEQ ID NO: 768362 - DNA, 25 bp, Mus musculus
tcagtttggcctcagagtgcaccac

SEQ ID NO: 768363 - DNA, 25 bp, Mus musculus
tcagtttggcctgagagtgcaccac

SEQ ID NO: 768364 - DNA, 25 bp, Mus musculus
tcagtttgtgagagcagggttctct

SEQ ID NO: 768365 - DNA, 25 bp, Mus musculus
tcagtttgtgagtgcagggttctct

SEQ ID NO: 768366 - DNA, 25 bp, Mus musculus
tcagttttgataccggcaggcagca

SEQ ID NO: 768367 - DNA, 25 bp, Mus musculus
tcagttttgatagcggcaggcagca

SEQ ID NO: 768368 - DNA, 25 bp, Mus musculus
tcagttttgcgaagagaagagtagg

SEQ ID NO: 768369 - DNA, 25 bp, Mus musculus
tcagttttgcgatgagaagagtagg

SEQ ID NO: 768370 - DNA, 25 bp, Mus musculus
tcagtttttagtacaccctgggtct

SEQ ID NO: 768371 - DNA, 25 bp, Mus musculus
tcagtttttagttcaccctgggtct

SEQ ID NO: 768372 - DNA, 25 bp, Mus musculus
tcagtttttatgaatgaaccaagac

SEQ ID NO: 768373 - DNA, 25 bp, Mus musculus
tcagtttttatgtatgaaccaagac

SEQ ID NO: 768374 - DNA, 25 bp, Mus musculus
tcagtttttctcagctcagatgaag

SEQ ID NO: 768375 - DNA, 25 bp, Mus musculus
tcagtttttctctgctcagatgaag

SEQ ID NO: 768376 - DNA, 25 bp, Mus musculus
tcataaactcataatcagtggattc

SEQ ID NO: 768377 - DNA, 25 bp, Mus musculus
tcataaactcattatcagtggattc

SEQ ID NO: 768378 - DNA, 25 bp, Mus musculus
tcataaagataacagtggagctcca

SEQ ID NO: 768379 - DNA, 25 bp, Mus musculus
tcataaagataagagtggagctcca

SEQ ID NO: 768380 - DNA, 25 bp, Mus musculus
tcataaagtttcaagcatgttcccc

SEQ ID NO: 768381 - DNA, 25 bp, Mus musculus
tcataaagtttctagcatgttcccc

SEQ ID NO: 768382 - DNA, 25 bp, Mus musculus
tcataaatagtcaactcttgtctct

SEQ ID NO: 768383 - DNA, 25 bp, Mus musculus
tcataaatagtctactcttgtctct

SEQ ID NO: 768384 - DNA, 25 bp, Mus musculus
tcataacaaaggacagcatcctctc

SEQ ID NO: 768385 - DNA, 25 bp, Mus musculus
tcataacaaaggtcagcatcctctc

SEQ ID NO: 768386 - DNA, 25 bp, Mus musculus
tcataacagcgtcatggaggctgga

SEQ ID NO: 768387 - DNA, 25 bp, Mus musculus
tcataacagcgtgatggaggctgga

SEQ ID NO: 768388 - DNA, 25 bp, Mus musculus
tcataaccaataagtagcaggctgc

SEQ ID NO: 768389 - DNA, 25 bp, Mus musculus
tcataaccaatatgtagcaggctgc

SEQ ID NO: 768390 - DNA, 25 bp, Mus musculus
tcataactctagactcgggatcctc

SEQ ID NO: 768391 - DNA, 25 bp, Mus musculus
tcataactctagtctcgggatcctc

SEQ ID NO: 768392 - DNA, 25 bp, Mus musculus
tcataacttccacgtattgaaaggg

SEQ ID NO: 768393 - DNA, 25 bp, Mus musculus
tcataacttccaggtattgaaaggg

SEQ ID NO: 768394 - DNA, 25 bp, Mus musculus
tcataagcagcgatcgggatctcct

SEQ ID NO: 768395 - DNA, 25 bp, Mus musculus
tcataagcagcgttcgggatctcct

SEQ ID NO: 768396 - DNA, 25 bp, Mus musculus
tcataagccaggagctagaggctcc

SEQ ID NO: 768397 - DNA, 25 bp, Mus musculus
tcataagccaggtgctagaggctcc

SEQ ID NO: 768398 - DNA, 25 bp, Mus musculus
tcataagctttgacaagagggctgc

SEQ ID NO: 768399 - DNA, 25 bp, Mus musculus
tcataagctttgtcaagagggctgc

SEQ ID NO: 768400 - DNA, 25 bp, Mus musculus
tcataaggagaaaacagcgtctggc

SEQ ID NO: 768401 - DNA, 25 bp, Mus musculus
tcataaggagaatacagcgtctggc

SEQ ID NO: 768402 - DNA, 25 bp, Mus musculus
tcataagtcaggccagagtggtgct

SEQ ID NO: 768403 - DNA, 25 bp, Mus musculus
tcataagtcagggcagagtggtgct

SEQ ID NO: 768404 - DNA, 25 bp, Mus musculus
tcataagtggcacatgctgctcgcc

SEQ ID NO: 768405 - DNA, 25 bp, Mus musculus
tcataagtggcagatgctgctcgcc

SEQ ID NO: 768406 - DNA, 25 bp, Mus musculus
tcataagttcttcttgggataacaa

SEQ ID NO: 768407 - DNA, 25 bp, Mus musculus
tcataagttcttgttgggataacaa

SEQ ID NO: 768408 - DNA, 25 bp, Mus musculus
tcataatacgaacacaaccacctgg

SEQ ID NO: 768409 - DNA, 25 bp, Mus musculus
tcataatacgaagacaaccacctgg

SEQ ID NO: 768410 - DNA, 25 bp, Mus musculus
tcataatccacaacccagaacctga

SEQ ID NO: 768411 - DNA, 25 bp, Mus musculus
tcataatccacatcccagaacctga

SEQ ID NO: 768412 - DNA, 25 bp, Mus musculus
tcataatgaaagcttcaggtgggct

SEQ ID NO: 768413 - DNA, 25 bp, Mus musculus
tcataatgaaaggttcaggtgggct

SEQ ID NO: 768414 - DNA, 25 bp, Mus musculus
tcataatgtgagaaagagagaatgc

SEQ ID NO: 768415 - DNA, 25 bp, Mus musculus
tcataatgtgagacggttcccagta

SEQ ID NO: 768416 - DNA, 25 bp, Mus musculus
tcataatgtgagtaagagagaatgc

SEQ ID NO: 768417 - DNA, 25 bp, Mus musculus
tcataatgtgagtcggttcccagta

SEQ ID NO: 768418 - DNA, 25 bp, Mus musculus
tcataattgggacggatgagaccct

SEQ ID NO: 768419 - DNA, 25 bp, Mus musculus
tcataattgggagggatgagaccct

SEQ ID NO: 768420 - DNA, 25 bp, Mus musculus
tcatacacacggaagcatttcttgc

SEQ ID NO: 768421 - DNA, 25 bp, Mus musculus
tcatacacacggtagcatttcttgc

SEQ ID NO: 768422 - DNA, 25 bp, Mus musculus
tcatacacagctccaattttgacca

SEQ ID NO: 768423 - DNA, 25 bp, Mus musculus
tcatacacagctgcaattttgacca

SEQ ID NO: 768424 - DNA, 25 bp, Mus musculus
tcatacagaactacgtgcgggttca

SEQ ID NO: 768425 - DNA, 25 bp, Mus musculus
tcatacagaacttcgtgcgggttca

SEQ ID NO: 768426 - DNA, 25 bp, Mus musculus
tcatacagactcaaacccagcaggt

SEQ ID NO: 768427 - DNA, 25 bp, Mus musculus
tcatacagactctaacccagcaggt

SEQ ID NO: 768428 - DNA, 25 bp, Mus musculus
tcatacagcaaaagctagagagagc

SEQ ID NO: 768429 - DNA, 25 bp, Mus musculus
tcatacagcaaatgctagagagagc

SEQ ID NO: 768430 - DNA, 25 bp, Mus musculus
tcatacagcatgatggccggaacca

SEQ ID NO: 768431 - DNA, 25 bp, Mus musculus
tcatacagcatgttggccggaacca

SEQ ID NO: 768432 - DNA, 25 bp, Mus musculus
tcatacatacaacatgcatgtcaaa

SEQ ID NO: 768433 - DNA, 25 bp, Mus musculus
tcatacatacaagatgcatgtcaaa

SEQ ID NO: 768434 - DNA, 25 bp, Mus musculus
tcatacatgctgagctcatccctga

SEQ ID NO: 768435 - DNA, 25 bp, Mus musculus
tcatacatgctgtgctcatccctga

SEQ ID NO: 768436 - DNA, 25 bp, Mus musculus
tcatacattcgcatctcagacacca

SEQ ID NO: 768437 - DNA, 25 bp, Mus musculus
tcatacattcgcttctcagacacca

SEQ ID NO: 768438 - DNA, 25 bp, Mus musculus
tcataccaaagtataaaggccctgg

SEQ ID NO: 768439 - DNA, 25 bp, Mus musculus
tcataccaaagtttaaaggccctgg

SEQ ID NO: 768440 - DNA, 25 bp, Mus musculus
tcataccaagttcacgagaggacat

SEQ ID NO: 768441 - DNA, 25 bp, Mus musculus
tcataccaagttgacgagaggacat

SEQ ID NO: 768442 - DNA, 25 bp, Mus musculus
tcataccataggagtggaatttggc

SEQ ID NO: 768443 - DNA, 25 bp, Mus musculus
tcataccataggtgtggaatttggc

SEQ ID NO: 768444 - DNA, 25 bp, Mus musculus
tcataccggtgaccatggaggtgcc

SEQ ID NO: 768445 - DNA, 25 bp, Mus musculus
tcataccggtgagcatggaggtgcc

SEQ ID NO: 768446 - DNA, 25 bp, Mus musculus
tcatacctacagcaaacatgtcaag

SEQ ID NO: 768447 - DNA, 25 bp, Mus musculus
tcatacctacaggaaacatgtcaag

SEQ ID NO: 768448 - DNA, 25 bp, Mus musculus
tcatacctccttagggaaagcgaca

SEQ ID NO: 768449 - DNA, 25 bp, Mus musculus
tcatacctcctttgggaaagcgaca

SEQ ID NO: 768450 - DNA, 25 bp, Mus musculus
tcatacggcagaagcccgggccgaa

SEQ ID NO: 768451 - DNA, 25 bp, Mus musculus
tcatacggcagatgcccgggccgaa

SEQ ID NO: 768452 - DNA, 25 bp, Mus musculus
tcatacgtgcagctggcctttccct

SEQ ID NO: 768453 - DNA, 25 bp, Mus musculus
tcatacgtgcaggtggcctttccct

SEQ ID NO: 768454 - DNA, 25 bp, Mus musculus
tcatactagaccaagacggagacat

SEQ ID NO: 768455 - DNA, 25 bp, Mus musculus
tcatactagacctagacggagacat

SEQ ID NO: 768456 - DNA, 25 bp, Mus musculus
tcatactagcccaggtggcatgggt

SEQ ID NO: 768457 - DNA, 25 bp, Mus musculus
tcatactagccctggtggcatgggt

SEQ ID NO: 768458 - DNA, 25 bp, Mus musculus
tcatactcaccacctttgcacagag

SEQ ID NO: 768459 - DNA, 25 bp, Mus musculus
tcatactcaccagctttgcacagag

SEQ ID NO: 768460 - DNA, 25 bp, Mus musculus
tcatactcagttatagataaagaag

SEQ ID NO: 768461 - DNA, 25 bp, Mus musculus
tcatactcagttttagataaagaag

SEQ ID NO: 768462 - DNA, 25 bp, Mus musculus
tcatactccaagaacgatctttcca

SEQ ID NO: 768463 - DNA, 25 bp, Mus musculus
tcatactccaagtacgatctttcca

SEQ ID NO: 768464 - DNA, 25 bp, Mus musculus
tcatactgcatgatggtctccgccg

SEQ ID NO: 768465 - DNA, 25 bp, Mus musculus
tcatactgcatgttggtctccgccg

SEQ ID NO: 768466 - DNA, 25 bp, Mus musculus
tcatactggcaaatggttccccact

SEQ ID NO: 768467 - DNA, 25 bp, Mus musculus
tcatactggcaattggttccccact

SEQ ID NO: 768468 - DNA, 25 bp, Mus musculus
tcatactgggctccacagggggcat

SEQ ID NO: 768469 - DNA, 25 bp, Mus musculus
tcatactgggctgcacagggggcat

SEQ ID NO: 768470 - DNA, 25 bp, Mus musculus
tcatacttacttagagaccagaata

SEQ ID NO: 768471 - DNA, 25 bp, Mus musculus
tcatacttactttgagaccagaata

SEQ ID NO: 768472 - DNA, 25 bp, Mus musculus
tcatagaagagcatcgtaagctact

SEQ ID NO: 768473 - DNA, 25 bp, Mus musculus
tcatagaagagcttcgtaagctact

SEQ ID NO: 768474 - DNA, 25 bp, Mus musculus
tcatagactgccaggaaggctccct

SEQ ID NO: 768475 - DNA, 25 bp, Mus musculus
tcatagactgcctggaaggctccct

SEQ ID NO: 768476 - DNA, 25 bp, Mus musculus
tcatagagacaaagttctttgacga

SEQ ID NO: 768477 - DNA, 25 bp, Mus musculus
tcatagagacaatgttctttgacga

SEQ ID NO: 768478 - DNA, 25 bp, Mus musculus
tcatagagattgcagcctgtcactc

SEQ ID NO: 768479 - DNA, 25 bp, Mus musculus
tcatagagattggagcctgtcactc

SEQ ID NO: 768480 - DNA, 25 bp, Mus musculus
tcatagagggaacactcatatacac

SEQ ID NO: 768481 - DNA, 25 bp, Mus musculus
tcatagagggaagactcatatacac

SEQ ID NO: 768482 - DNA, 25 bp, Mus musculus
tcatagagggccagaggcgcttagc

SEQ ID NO: 768483 - DNA, 25 bp, Mus musculus
tcatagagggcctgaggcgcttagc

SEQ ID NO: 768484 - DNA, 25 bp, Mus musculus
tcatagcaaagacctcctggagaag

SEQ ID NO: 768485 - DNA, 25 bp, Mus musculus
tcatagcaaagagctcctggagaag

SEQ ID NO: 768486 - DNA, 25 bp, Mus musculus
tcatagcaggaacttactgtgagat

SEQ ID NO: 768487 - DNA, 25 bp, Mus musculus
tcatagcaggaagttactgtgagat

SEQ ID NO: 768488 - DNA, 25 bp, Mus musculus
tcatagcatctcctctcggagtggc

SEQ ID NO: 768489 - DNA, 25 bp, Mus musculus
tcatagcatctcgtctcggagtggc

SEQ ID NO: 768490 - DNA, 25 bp, Mus musculus
tcatagccgtgcacaacaacctggt

SEQ ID NO: 768491 - DNA, 25 bp, Mus musculus
tcatagccgtgctcaacaacctggt

SEQ ID NO: 768492 - DNA, 25 bp, Mus musculus
tcatagcgctataccacctgctggc

SEQ ID NO: 768493 - DNA, 25 bp, Mus musculus
tcatagcgctattccacctgctggc

SEQ ID NO: 768494 - DNA, 25 bp, Mus musculus
tcatagctaggtctaagtgcacact

SEQ ID NO: 768495 - DNA, 25 bp, Mus musculus
tcatagctaggtgtaagtgcacact

SEQ ID NO: 768496 - DNA, 25 bp, Mus musculus
tcatagctgcctccacagagaagaa

SEQ ID NO: 768497 - DNA, 25 bp, Mus musculus
tcatagctgcctgcacagagaagaa

SEQ ID NO: 768498 - DNA, 25 bp, Mus musculus
tcatagctgtgacgtataaccgcga

SEQ ID NO: 768499 - DNA, 25 bp, Mus musculus
tcatagctgtgaggtataaccgcga

SEQ ID NO: 768500 - DNA, 25 bp, Mus musculus
tcataggaaagtaagacggtggtta

SEQ ID NO: 768501 - DNA, 25 bp, Mus musculus
tcataggaaagttagacggtggtta

SEQ ID NO: 768502 - DNA, 25 bp, Mus musculus
tcataggaccgaagagtcgcgctcc

SEQ ID NO: 768503 - DNA, 25 bp, Mus musculus
tcataggaccgatgagtcgcgctcc

SEQ ID NO: 768504 - DNA, 25 bp, Mus musculus
tcataggagacacgtcagaagagct

SEQ ID NO: 768505 - DNA, 25 bp, Mus musculus
tcataggagacaggtcagaagagct

SEQ ID NO: 768506 - DNA, 25 bp, Mus musculus
tcataggcaccgagaccccagagtc

SEQ ID NO: 768507 - DNA, 25 bp, Mus musculus
tcataggcaccgtgaccccagagtc

SEQ ID NO: 768508 - DNA, 25 bp, Mus musculus
tcataggccgagcagcatttggtga

SEQ ID NO: 768509 - DNA, 25 bp, Mus musculus
tcataggccgaggagcatttggtga

SEQ ID NO: 768510 - DNA, 25 bp, Mus musculus
tcataggcctggcagagctcgtctg

SEQ ID NO: 768511 - DNA, 25 bp, Mus musculus
tcataggcctgggagagctcgtctg

SEQ ID NO: 768512 - DNA, 25 bp, Mus musculus
tcataggctcaaagtacaagaaggt

SEQ ID NO: 768513 - DNA, 25 bp, Mus musculus
tcataggctcaatgtacaagaaggt

SEQ ID NO: 768514 - DNA, 25 bp, Mus musculus
tcataggctgcaccgaagtaacaag

SEQ ID NO: 768515 - DNA, 25 bp, Mus musculus
tcataggctgcagcgaagtaacaag

SEQ ID NO: 768516 - DNA, 25 bp, Mus musculus
tcataggctgtcaccagcacttgga

SEQ ID NO: 768517 - DNA, 25 bp, Mus musculus
tcataggctgtctccagcacttgga

SEQ ID NO: 768518 - DNA, 25 bp, Mus musculus
tcatagggaaacctgtaaggttagg

SEQ ID NO: 768519 - DNA, 25 bp, Mus musculus
tcatagggaaacgtgtaaggttagg

SEQ ID NO: 768520 - DNA, 25 bp, Mus musculus
tcatagggacacctgcagttgccag

SEQ ID NO: 768521 - DNA, 25 bp, Mus musculus
tcatagggacacgtgcagttgccag

SEQ ID NO: 768522 - DNA, 25 bp, Mus musculus
tcatagggctatcgtccccagcact

SEQ ID NO: 768523 - DNA, 25 bp, Mus musculus
tcatagggctatggtccccagcact

SEQ ID NO: 768524 - DNA, 25 bp, Mus musculus
tcatagtagaaaagcagttagcagt

SEQ ID NO: 768525 - DNA, 25 bp, Mus musculus
tcatagtagaaatgcagttagcagt

SEQ ID NO: 768526 - DNA, 25 bp, Mus musculus
tcatagtctaggagtgaagcaagca

SEQ ID NO: 768527 - DNA, 25 bp, Mus musculus
tcatagtctaggtgtgaagcaagca

SEQ ID NO: 768528 - DNA, 25 bp, Mus musculus
tcatagtctccaagatcggcctcgg

SEQ ID NO: 768529 - DNA, 25 bp, Mus musculus
tcatagtctccatgatcggcctcgg

SEQ ID NO: 768530 - DNA, 25 bp, Mus musculus
tcatagtgaaatagaacggcggcga

SEQ ID NO: 768531 - DNA, 25 bp, Mus musculus
tcatagtgaaattgaacggcggcga

SEQ ID NO: 768532 - DNA, 25 bp, Mus musculus
tcatagtgcctgaggtccgccggcc

SEQ ID NO: 768533 - DNA, 25 bp, Mus musculus
tcatagtgcctgtggtccgccggcc

SEQ ID NO: 768534 - DNA, 25 bp, Mus musculus
tcatagtgttgcacatagaccccaa

SEQ ID NO: 768535 - DNA, 25 bp, Mus musculus
tcatagtgttgctcatagaccccaa

SEQ ID NO: 768536 - DNA, 25 bp, Mus musculus
tcatataaaggcaaagaggtcccag

SEQ ID NO: 768537 - DNA, 25 bp, Mus musculus
tcatataaaggctaagaggtcccag

SEQ ID NO: 768538 - DNA, 25 bp, Mus musculus
tcatataagatcaacactgtggtgt

SEQ ID NO: 768539 - DNA, 25 bp, Mus musculus
tcatataagatctacactgtggtgt

SEQ ID NO: 768540 - DNA, 25 bp, Mus musculus
tcatatactgttactgcaatggtga

SEQ ID NO: 768541 - DNA, 25 bp, Mus musculus
tcatatactgtttctgcaatggtga

SEQ ID NO: 768542 - DNA, 25 bp, Mus musculus
tcatatcaataaccatttagacagt

SEQ ID NO: 768543 - DNA, 25 bp, Mus musculus
tcatatcaataagcatttagacagt

SEQ ID NO: 768544 - DNA, 25 bp, Mus musculus
tcatatcactggaggcgggttgctg

SEQ ID NO: 768545 - DNA, 25 bp, Mus musculus
tcatatcactggtggcgggttgctg

SEQ ID NO: 768546 - DNA, 25 bp, Mus musculus
tcatatcctgggaccagcttccagc

SEQ ID NO: 768547 - DNA, 25 bp, Mus musculus
tcatatcctgggtccagcttccagc

SEQ ID NO: 768548 - DNA, 25 bp, Mus musculus
tcatatcgccaactacctgggaagc

SEQ ID NO: 768549 - DNA, 25 bp, Mus musculus
tcatatcgccaagtacctgggaagc

SEQ ID NO: 768550 - DNA, 25 bp, Mus musculus
tcatatcgttaactctgagcctgag

SEQ ID NO: 768551 - DNA, 25 bp, Mus musculus
tcatatcgttaagtctgagcctgag

SEQ ID NO: 768552 - DNA, 25 bp, Mus musculus
tcatatctcactcctagctggtgca

SEQ ID NO: 768553 - DNA, 25 bp, Mus musculus
tcatatctcactgctagctggtgca

SEQ ID NO: 768554 - DNA, 25 bp, Mus musculus
tcatatctgggtaagcatcaaagaa

SEQ ID NO: 768555 - DNA, 25 bp, Mus musculus
tcatatctgggttagcatcaaagaa

SEQ ID NO: 768556 - DNA, 25 bp, Mus musculus
tcatatgagcagctaaagaacgagc

SEQ ID NO: 768557 - DNA, 25 bp, Mus musculus
tcatatgagcaggtaaagaacgagc

SEQ ID NO: 768558 - DNA, 25 bp, Mus musculus
tcatatgatcagatgttaaagcaag

SEQ ID NO: 768559 - DNA, 25 bp, Mus musculus
tcatatgatcagttgttaaagcaag

SEQ ID NO: 768560 - DNA, 25 bp, Mus musculus
tcatatggagggaatgtaacctcaa

SEQ ID NO: 768561 - DNA, 25 bp, Mus musculus
tcatatggagggtatgtaacctcaa

SEQ ID NO: 768562 - DNA, 25 bp, Mus musculus
tcatatggttcaactagtctgtgct

SEQ ID NO: 768563 - DNA, 25 bp, Mus musculus
tcatatggttcatctagtctgtgct

SEQ ID NO: 768564 - DNA, 25 bp, Mus musculus
tcatattatatcaagagacgccctg

SEQ ID NO: 768565 - DNA, 25 bp, Mus musculus
tcatattatatctagagacgccctg

SEQ ID NO: 768566 - DNA, 25 bp, Mus musculus
tcatattcgcctctgggacttggaa

SEQ ID NO: 768567 - DNA, 25 bp, Mus musculus
tcatattcgcctgtgggacttggaa

SEQ ID NO: 768568 - DNA, 25 bp, Mus musculus
tcatatttgacgcatgtactctacc

SEQ ID NO: 768569 - DNA, 25 bp, Mus musculus
tcatatttgacggatgtactctacc

SEQ ID NO: 768570 - DNA, 25 bp, Mus musculus
tcatcaaacatccaggtgctgtggg

SEQ ID NO: 768571 - DNA, 25 bp, Mus musculus
tcatcaaacatcgaggtgctgtggg

SEQ ID NO: 768572 - DNA, 25 bp, Mus musculus
tcatcaaactccaggcgcctcttgg

SEQ ID NO: 768573 - DNA, 25 bp, Mus musculus
tcatcaaactcctggcgcctcttgg

SEQ ID NO: 768574 - DNA, 25 bp, Mus musculus
tcatcaaactctacccaaaacaagg

SEQ ID NO: 768575 - DNA, 25 bp, Mus musculus
tcatcaaactcttcccaaaacaagg

SEQ ID NO: 768576 - DNA, 25 bp, Mus musculus
tcatcaaagacccaaacgacatttc

SEQ ID NO: 768577 - DNA, 25 bp, Mus musculus
tcatcaaagaccgaaacgacatttc

SEQ ID NO: 768578 - DNA, 25 bp, Mus musculus
tcatcaaagctccaaacctcaaagc

SEQ ID NO: 768579 - DNA, 25 bp, Mus musculus
tcatcaaagctcgaaacctcaaagc

SEQ ID NO: 768580 - DNA, 25 bp, Mus musculus
tcatcaacaaggactacgccgactt

SEQ ID NO: 768581 - DNA, 25 bp, Mus musculus
tcatcaacaaggtctacgccgactt

SEQ ID NO: 768582 - DNA, 25 bp, Mus musculus
tcatcaacaatgagatccctgattg

SEQ ID NO: 768583 - DNA, 25 bp, Mus musculus
tcatcaacaatgtgatccctgattg

SEQ ID NO: 768584 - DNA, 25 bp, Mus musculus
tcatcaacacaacaatacaggaggc

SEQ ID NO: 768585 - DNA, 25 bp, Mus musculus
tcatcaacacaagaatacaggaggc

SEQ ID NO: 768586 - DNA, 25 bp, Mus musculus
tcatcaacacctcggctctttggta

SEQ ID NO: 768587 - DNA, 25 bp, Mus musculus
tcatcaacacctgggctctttggta

SEQ ID NO: 768588 - DNA, 25 bp, Mus musculus
tcatcaacagagagattgctcgggc

SEQ ID NO: 768589 - DNA, 25 bp, Mus musculus
tcatcaacagagtgattgctcgggc

SEQ ID NO: 768590 - DNA, 25 bp, Mus musculus
tcatcaaccgtaagtgcttgtttct

SEQ ID NO: 768591 - DNA, 25 bp, Mus musculus
tcatcaaccgtatgtgcttgtttct

SEQ ID NO: 768592 - DNA, 25 bp, Mus musculus
tcatcaaccgtgaggctgaaccagc

SEQ ID NO: 768593 - DNA, 25 bp, Mus musculus
tcatcaaccgtgtggctgaaccagc

SEQ ID NO: 768594 - DNA, 25 bp, Mus musculus
tcatcaaccttcagggagcgtgcac

SEQ ID NO: 768595 - DNA, 25 bp, Mus musculus
tcatcaaccttctgggagcgtgcac

SEQ ID NO: 768596 - DNA, 25 bp, Mus musculus
tcatcaacgcagaaggcgggcagtc

SEQ ID NO: 768597 - DNA, 25 bp, Mus musculus
tcatcaacgcagtaggcgggcagtc

SEQ ID NO: 768598 - DNA, 25 bp, Mus musculus
tcatcaacggagacgacatgtttgt

SEQ ID NO: 768599 - DNA, 25 bp, Mus musculus
tcatcaacggagtcgacatgtttgt

SEQ ID NO: 768600 - DNA, 25 bp, Mus musculus
tcatcaactctcacttcaatgagct

SEQ ID NO: 768601 - DNA, 25 bp, Mus musculus
tcatcaactctctcttcaatgagct

SEQ ID NO: 768602 - DNA, 25 bp, Mus musculus
tcatcaactgttctcatttttctgc

SEQ ID NO: 768603 - DNA, 25 bp, Mus musculus
tcatcaactgttgtcatttttctgc

SEQ ID NO: 768604 - DNA, 25 bp, Mus musculus
tcatcaagaagaccgagtccgacgc

SEQ ID NO: 768605 - DNA, 25 bp, Mus musculus
tcatcaagaagagcgagtccgacgc

SEQ ID NO: 768606 - DNA, 25 bp, Mus musculus
tcatcaagacggacatcaagctggc

SEQ ID NO: 768607 - DNA, 25 bp, Mus musculus
tcatcaagacggtcatcaagctggc

SEQ ID NO: 768608 - DNA, 25 bp, Mus musculus
tcatcaagagccacaaaggactgcc

SEQ ID NO: 768609 - DNA, 25 bp, Mus musculus
tcatcaagagcctcaaaggactgcc

SEQ ID NO: 768610 - DNA, 25 bp, Mus musculus
tcatcaagatgaagggataccccag

SEQ ID NO: 768611 - DNA, 25 bp, Mus musculus
tcatcaagatgatgggataccccag

SEQ ID NO: 768612 - DNA, 25 bp, Mus musculus
tcatcaagcaaacggactaccacca

SEQ ID NO: 768613 - DNA, 25 bp, Mus musculus
tcatcaagcaaagggactaccacca

SEQ ID NO: 768614 - DNA, 25 bp, Mus musculus
tcatcaagccgacagggcgtcaaag

SEQ ID NO: 768615 - DNA, 25 bp, Mus musculus
tcatcaagccgagagggcgtcaaag

SEQ ID NO: 768616 - DNA, 25 bp, Mus musculus
tcatcaagcctcctttgcgtcactt

SEQ ID NO: 768617 - DNA, 25 bp, Mus musculus
tcatcaagcctcgtttgcgtcactt

SEQ ID NO: 768618 - DNA, 25 bp, Mus musculus
tcatcaaggctgaaatacaggcagt

SEQ ID NO: 768619 - DNA, 25 bp, Mus musculus
tcatcaaggctgtaatacaggcagt

SEQ ID NO: 768620 - DNA, 25 bp, Mus musculus
tcatcaagtacacaggctacgggaa

SEQ ID NO: 768621 - DNA, 25 bp, Mus musculus
tcatcaagtacagaggctacgggaa

SEQ ID NO: 768622 - DNA, 25 bp, Mus musculus
tcatcaagtatgaggctgcagagct

SEQ ID NO: 768623 - DNA, 25 bp, Mus musculus
tcatcaagtatgtggctgcagagct

SEQ ID NO: 768624 - DNA, 25 bp, Mus musculus
tcatcaagtctgcagagaccccgca

SEQ ID NO: 768625 - DNA, 25 bp, Mus musculus
tcatcaagtctggagagaccccgca

SEQ ID NO: 768626 - DNA, 25 bp, Mus musculus
tcatcaagtgccagcactctgtggg

SEQ ID NO: 768627 - DNA, 25 bp, Mus musculus
tcatcaagtgcctgcactctgtggg

SEQ ID NO: 768628 - DNA, 25 bp, Mus musculus
tcatcaagttaaccaccctctctgg

SEQ ID NO: 768629 - DNA, 25 bp, Mus musculus
tcatcaagttaagcaccctctctgg

SEQ ID NO: 768630 - DNA, 25 bp, Mus musculus
tcatcaataaccaaaacaaaacaga

SEQ ID NO: 768631 - DNA, 25 bp, Mus musculus
tcatcaataacctaaacaaaacaga

SEQ ID NO: 768632 - DNA, 25 bp, Mus musculus
tcatcaatgacgacctggataaagc

SEQ ID NO: 768633 - DNA, 25 bp, Mus musculus
tcatcaatgacgtcctggataaagc

SEQ ID NO: 768634 - DNA, 25 bp, Mus musculus
tcatcaatgagaacaagccccagtc

SEQ ID NO: 768635 - DNA, 25 bp, Mus musculus
tcatcaatgagatcaagccccagtc

SEQ ID NO: 768636 - DNA, 25 bp, Mus musculus
tcatcaatggcaccaagccacggct

SEQ ID NO: 768637 - DNA, 25 bp, Mus musculus
tcatcaatggcagcaagccacggct

SEQ ID NO: 768638 - DNA, 25 bp, Mus musculus
tcatcaattagacttccccaaagta

SEQ ID NO: 768639 - DNA, 25 bp, Mus musculus
tcatcaattagagttccccaaagta

SEQ ID NO: 768640 - DNA, 25 bp, Mus musculus
tcatcaattccaagccagatgaaag

SEQ ID NO: 768641 - DNA, 25 bp, Mus musculus
tcatcaattccatgccagatgaaag

SEQ ID NO: 768642 - DNA, 25 bp, Mus musculus
tcatcacaaaaaatgaggcagattt

SEQ ID NO: 768643 - DNA, 25 bp, Mus musculus
tcatcacaaaaattgaggcagattt

SEQ ID NO: 768644 - DNA, 25 bp, Mus musculus
tcatcacaactgaaccccagagttc

SEQ ID NO: 768645 - DNA, 25 bp, Mus musculus
tcatcacaactgtaccccagagttc

SEQ ID NO: 768646 - DNA, 25 bp, Mus musculus
tcatcacaatccatcagtctggcca

SEQ ID NO: 768647 - DNA, 25 bp, Mus musculus
tcatcacaatccttcagtctggcca

SEQ ID NO: 768648 - DNA, 25 bp, Mus musculus
tcatcacacgatacaccaagaagac

SEQ ID NO: 768649 - DNA, 25 bp, Mus musculus
tcatcacacgattcaccaagaagac

SEQ ID NO: 768650 - DNA, 25 bp, Mus musculus
tcatcacagaatagccctgaagcaa

SEQ ID NO: 768651 - DNA, 25 bp, Mus musculus
tcatcacagaattgccctgaagcaa

SEQ ID NO: 768652 - DNA, 25 bp, Mus musculus
tcatcacagattctcgagtccagtg

SEQ ID NO: 768653 - DNA, 25 bp, Mus musculus
tcatcacagattgtcgagtccagtg

SEQ ID NO: 768654 - DNA, 25 bp, Mus musculus
tcatcacagcaacagaacagtcatg

SEQ ID NO: 768655 - DNA, 25 bp, Mus musculus
tcatcacagcaagagaacagtcatg

SEQ ID NO: 768656 - DNA, 25 bp, Mus musculus
tcatcacagccaaccgggtgctgca

SEQ ID NO: 768657 - DNA, 25 bp, Mus musculus
tcatcacagccatccgggtgctgca

SEQ ID NO: 768658 - DNA, 25 bp, Mus musculus
tcatcacagcgcaaactgccaaagg

SEQ ID NO: 768659 - DNA, 25 bp, Mus musculus
tcatcacagcgctaactgccaaagg

SEQ ID NO: 768660 - DNA, 25 bp, Mus musculus
tcatcacagctacagaggatcgaat

SEQ ID NO: 768661 - DNA, 25 bp, Mus musculus
tcatcacagctagagaggatcgaat

SEQ ID NO: 768662 - DNA, 25 bp, Mus musculus
tcatcacagtacagtagcccgtctt

SEQ ID NO: 768663 - DNA, 25 bp, Mus musculus
tcatcacagtactgtagcccgtctt

SEQ ID NO: 768664 - DNA, 25 bp, Mus musculus
tcatcacatccaagaccgaggtcat

SEQ ID NO: 768665 - DNA, 25 bp, Mus musculus
tcatcacatccatgaccgaggtcat

SEQ ID NO: 768666 - DNA, 25 bp, Mus musculus
tcatcaccaacgagactgggcagcc

SEQ ID NO: 768667 - DNA, 25 bp, Mus musculus
tcatcaccaacgtgactgggcagcc

SEQ ID NO: 768668 - DNA, 25 bp, Mus musculus
tcatcaccacaacccggaagttctt

SEQ ID NO: 768669 - DNA, 25 bp, Mus musculus
tcatcaccacaagccggaagttctt

SEQ ID NO: 768670 - DNA, 25 bp, Mus musculus
tcatcaccaccgaggcctacatagg

SEQ ID NO: 768671 - DNA, 25 bp, Mus musculus
tcatcaccaccgtggcctacatagg

SEQ ID NO: 768672 - DNA, 25 bp, Mus musculus
tcatcaccacgcctcttgaaactgt

SEQ ID NO: 768673 - DNA, 25 bp, Mus musculus
tcatcaccacgcgtcttgaaactgt

SEQ ID NO: 768674 - DNA, 25 bp, Mus musculus
tcatcaccagcacagatatcttggg

SEQ ID NO: 768675 - DNA, 25 bp, Mus musculus
tcatcaccagcagagatatcttggg

SEQ ID NO: 768676 - DNA, 25 bp, Mus musculus
tcatcacccaccacttcaagtgtaa

SEQ ID NO: 768677 - DNA, 25 bp, Mus musculus
tcatcacccacctcttcaagtgtaa

SEQ ID NO: 768678 - DNA, 25 bp, Mus musculus
tcatcaccccatctcctgaggtggt

SEQ ID NO: 768679 - DNA, 25 bp, Mus musculus
tcatcaccccatgtcctgaggtggt

SEQ ID NO: 768680 - DNA, 25 bp, Mus musculus
tcatcacccgcaagtcactgatcga

SEQ ID NO: 768681 - DNA, 25 bp, Mus musculus
tcatcacccgcatgtcactgatcga

SEQ ID NO: 768682 - DNA, 25 bp, Mus musculus
tcatcaccgaggagtccaaggtgcc

SEQ ID NO: 768683 - DNA, 25 bp, Mus musculus
tcatcaccgaggtgtccaaggtgcc

SEQ ID NO: 768684 - DNA, 25 bp, Mus musculus
tcatcaccgcatcgacgggagtaat

SEQ ID NO: 768685 - DNA, 25 bp, Mus musculus
tcatcaccgcatggacgggagtaat

SEQ ID NO: 768686 - DNA, 25 bp, Mus musculus
tcatcaccgtgccaatagttctgct

SEQ ID NO: 768687 - DNA, 25 bp, Mus musculus
tcatcaccgtgcgaatagttctgct

SEQ ID NO: 768688 - DNA, 25 bp, Mus musculus
tcatcacctcatacatgatttccag

SEQ ID NO: 768689 - DNA, 25 bp, Mus musculus
tcatcacctcattcatgatttccag

SEQ ID NO: 768690 - DNA, 25 bp, Mus musculus
tcatcacgaatccaggttccagctc

SEQ ID NO: 768691 - DNA, 25 bp, Mus musculus
tcatcacgaatcgaggttccagctc

SEQ ID NO: 768692 - DNA, 25 bp, Mus musculus
tcatcacgaggcagaagctattgtc

SEQ ID NO: 768693 - DNA, 25 bp, Mus musculus
tcatcacgaggctgaagctattgtc

SEQ ID NO: 768694 - DNA, 25 bp, Mus musculus
tcatcacgccctaggaggttaatca

SEQ ID NO: 768695 - DNA, 25 bp, Mus musculus
tcatcacgcccttggaggttaatca

SEQ ID NO: 768696 - DNA, 25 bp, Mus musculus
tcatcacggaatactgccgatacgg

SEQ ID NO: 768697 - DNA, 25 bp, Mus musculus
tcatcacggaattctgccgatacgg

SEQ ID NO: 768698 - DNA, 25 bp, Mus musculus
tcatcacggagccagttagaagaca

SEQ ID NO: 768699 - DNA, 25 bp, Mus musculus
tcatcacggagcgagttagaagaca

SEQ ID NO: 768700 - DNA, 25 bp, Mus musculus
tcatcacgggaaatatcattctcac

SEQ ID NO: 768701 - DNA, 25 bp, Mus musculus
tcatcacgggaattatcattctcac

SEQ ID NO: 768702 - DNA, 25 bp, Mus musculus
tcatcacgggagaaaatggaacggc

SEQ ID NO: 768703 - DNA, 25 bp, Mus musculus
tcatcacgggagtaaatggaacggc

SEQ ID NO: 768704 - DNA, 25 bp, Mus musculus
tcatcacgtagaatcgaggctaatc

SEQ ID NO: 768705 - DNA, 25 bp, Mus musculus
tcatcacgtagattcgaggctaatc

SEQ ID NO: 768706 - DNA, 25 bp, Mus musculus
tcatcactacagaactgaacagcgc

SEQ ID NO: 768707 - DNA, 25 bp, Mus musculus
tcatcactacagtactgaacagcgc

SEQ ID NO: 768708 - DNA, 25 bp, Mus musculus
tcatcactcttgcagccaaacgaga

SEQ ID NO: 768709 - DNA, 25 bp, Mus musculus
tcatcactcttggagccaaacgaga

SEQ ID NO: 768710 - DNA, 25 bp, Mus musculus
tcatcactgaccctgcgtatttcat

SEQ ID NO: 768711 - DNA, 25 bp, Mus musculus
tcatcactgaccgtgcgtatttcat

SEQ ID NO: 768712 - DNA, 25 bp, Mus musculus
tcatcactgcagcatgggtacagcc

SEQ ID NO: 768713 - DNA, 25 bp, Mus musculus
tcatcactgcaggatgggtacagcc

SEQ ID NO: 768714 - DNA, 25 bp, Mus musculus
tcatcactgcctatcgagcacatgg

SEQ ID NO: 768715 - DNA, 25 bp, Mus musculus
tcatcactgcctttcgagcacatgg

SEQ ID NO: 768716 - DNA, 25 bp, Mus musculus
tcatcactgggtaggcaagactcag

SEQ ID NO: 768717 - DNA, 25 bp, Mus musculus
tcatcactgggttggcaagactcag

SEQ ID NO: 768718 - DNA, 25 bp, Mus musculus
tcatcactggtgagtccggtgggac

SEQ ID NO: 768719 - DNA, 25 bp, Mus musculus
tcatcactggtgtgtccggtgggac

SEQ ID NO: 768720 - DNA, 25 bp, Mus musculus
tcatcactgtcaaggacaaagacaa

SEQ ID NO: 768721 - DNA, 25 bp, Mus musculus
tcatcactgtcatggacaaagacaa

SEQ ID NO: 768722 - DNA, 25 bp, Mus musculus
tcatcacttggacgaatgcccacac

SEQ ID NO: 768723 - DNA, 25 bp, Mus musculus
tcatcacttggaggaatgcccacac

SEQ ID NO: 768724 - DNA, 25 bp, Mus musculus
tcatcactttcgatgacgtccctgg

SEQ ID NO: 768725 - DNA, 25 bp, Mus musculus
tcatcactttcgttgacgtccctgg

SEQ ID NO: 768726 - DNA, 25 bp, Mus musculus
tcatcagagccaagtccacactagg

SEQ ID NO: 768727 - DNA, 25 bp, Mus musculus
tcatcagagccatgtccacactagg

SEQ ID NO: 768728 - DNA, 25 bp, Mus musculus
tcatcagagctgcaaatggaccaaa

SEQ ID NO: 768729 - DNA, 25 bp, Mus musculus
tcatcagagctggaaatggaccaaa

SEQ ID NO: 768730 - DNA, 25 bp, Mus musculus
tcatcagaggcaatgagagcacggg

SEQ ID NO: 768731 - DNA, 25 bp, Mus musculus
tcatcagaggcattgagagcacggg

SEQ ID NO: 768732 - DNA, 25 bp, Mus musculus
tcatcagaggtcataccctgcctgg

SEQ ID NO: 768733 - DNA, 25 bp, Mus musculus
tcatcagaggtcttaccctgcctgg

SEQ ID NO: 768734 - DNA, 25 bp, Mus musculus
tcatcagattgccttgtctcacagc

SEQ ID NO: 768735 - DNA, 25 bp, Mus musculus
tcatcagattgcgttgtctcacagc

SEQ ID NO: 768736 - DNA, 25 bp, Mus musculus
tcatcagcagatcgcggatccagac

SEQ ID NO: 768737 - DNA, 25 bp, Mus musculus
tcatcagcagatggcggatccagac

SEQ ID NO: 768738 - DNA, 25 bp, Mus musculus
tcatcagcattgaaaggatcttact

SEQ ID NO: 768739 - DNA, 25 bp, Mus musculus
tcatcagcattgtaaggatcttact

SEQ ID NO: 768740 - DNA, 25 bp, Mus musculus
tcatcagccggaactggcatggtgt

SEQ ID NO: 768741 - DNA, 25 bp, Mus musculus
tcatcagccggatctggcatggtgt

SEQ ID NO: 768742 - DNA, 25 bp, Mus musculus
tcatcagcgtgtaagcattccccaa

SEQ ID NO: 768743 - DNA, 25 bp, Mus musculus
tcatcagcgtgttagcattccccaa

SEQ ID NO: 768744 - DNA, 25 bp, Mus musculus
tcatcagctctgagttgggccaggc

SEQ ID NO: 768745 - DNA, 25 bp, Mus musculus
tcatcagctctgtgttgggccaggc

SEQ ID NO: 768746 - DNA, 25 bp, Mus musculus
tcatcagctgagcattacagagtct

SEQ ID NO: 768747 - DNA, 25 bp, Mus musculus
tcatcagctgaggattacagagtct

SEQ ID NO: 768748 - DNA, 25 bp, Mus musculus
tcatcagctttgacttgaagagcat

SEQ ID NO: 768749 - DNA, 25 bp, Mus musculus
tcatcagctttgtcttgaagagcat

SEQ ID NO: 768750 - DNA, 25 bp, Mus musculus
tcatcaggaactagggcttcttggg

SEQ ID NO: 768751 - DNA, 25 bp, Mus musculus
tcatcaggaacttgggcttcttggg

SEQ ID NO: 768752 - DNA, 25 bp, Mus musculus
tcatcaggaagtcacttaatgccgg

SEQ ID NO: 768753 - DNA, 25 bp, Mus musculus
tcatcaggaagtgacttaatgccgg

SEQ ID NO: 768754 - DNA, 25 bp, Mus musculus
tcatcaggagatcgtggcacatact

SEQ ID NO: 768755 - DNA, 25 bp, Mus musculus
tcatcaggagatggtggcacatact

SEQ ID NO: 768756 - DNA, 25 bp, Mus musculus
tcatcaggatcaatgagaaaacccc

SEQ ID NO: 768757 - DNA, 25 bp, Mus musculus
tcatcaggatcattgagaaaacccc

SEQ ID NO: 768758 - DNA, 25 bp, Mus musculus
tcatcaggcatgacgcatatccctc

SEQ ID NO: 768759 - DNA, 25 bp, Mus musculus
tcatcaggcatgtcgcatatccctc

SEQ ID NO: 768760 - DNA, 25 bp, Mus musculus
tcatcagggatacctgtcagccagg

SEQ ID NO: 768761 - DNA, 25 bp, Mus musculus
tcatcagggatagctgtcagccagg

SEQ ID NO: 768762 - DNA, 25 bp, Mus musculus
tcatcagggctgagtcccaaaagtg

SEQ ID NO: 768763 - DNA, 25 bp, Mus musculus
tcatcagggctgtgtcccaaaagtg

SEQ ID NO: 768764 - DNA, 25 bp, Mus musculus
tcatcaggtcatcagagacttctac

SEQ ID NO: 768765 - DNA, 25 bp, Mus musculus
tcatcaggtcatgagagacttctac

SEQ ID NO: 768766 - DNA, 25 bp, Mus musculus
tcatcaggtgggacaccgggacata

SEQ ID NO: 768767 - DNA, 25 bp, Mus musculus
tcatcaggtgggtcaccgggacata

SEQ ID NO: 768768 - DNA, 25 bp, Mus musculus
tcatcaggttccagaaagagaggaa

SEQ ID NO: 768769 - DNA, 25 bp, Mus musculus
tcatcaggttcctgaaagagaggaa

SEQ ID NO: 768770 - DNA, 25 bp, Mus musculus
tcatcagtccctcctttctgtagga

SEQ ID NO: 768771 - DNA, 25 bp, Mus musculus
tcatcagtccctgctttctgtagga

SEQ ID NO: 768772 - DNA, 25 bp, Mus musculus
tcatcagtgggcctctccttggcgc

SEQ ID NO: 768773 - DNA, 25 bp, Mus musculus
tcatcagtgggcgtctccttggcgc

SEQ ID NO: 768774 - DNA, 25 bp, Mus musculus
tcatcagtggtgagttcatcggagc

SEQ ID NO: 768775 - DNA, 25 bp, Mus musculus
tcatcagtggtgtgttcatcggagc

SEQ ID NO: 768776 - DNA, 25 bp, Mus musculus
tcatcagtgtagagtgccgagagct

SEQ ID NO: 768777 - DNA, 25 bp, Mus musculus
tcatcagtgtagtgtgccgagagct

SEQ ID NO: 768778 - DNA, 25 bp, Mus musculus
tcatcagtgtgacactgacatcatc

SEQ ID NO: 768779 - DNA, 25 bp, Mus musculus
tcatcagtgtgagactgacatcatc

SEQ ID NO: 768780 - DNA, 25 bp, Mus musculus
tcatcataccggcttcctggccata

SEQ ID NO: 768781 - DNA, 25 bp, Mus musculus
tcatcataccgggttcctggccata

SEQ ID NO: 768782 - DNA, 25 bp, Mus musculus
tcatcatagttgaggtatttgtctg

SEQ ID NO: 768783 - DNA, 25 bp, Mus musculus
tcatcatagttgtggtatttgtctg

SEQ ID NO: 768784 - DNA, 25 bp, Mus musculus
tcatcatcagcaagacactgcatga

SEQ ID NO: 768785 - DNA, 25 bp, Mus musculus
tcatcatcagcatgacactgcatga

SEQ ID NO: 768786 - DNA, 25 bp, Mus musculus
tcatcatcagcgagttagcattccc

SEQ ID NO: 768787 - DNA, 25 bp, Mus musculus
tcatcatcagcgtgttagcattccc

SEQ ID NO: 768788 - DNA, 25 bp, Mus musculus
tcatcatccaggagttggagaagca

SEQ ID NO: 768789 - DNA, 25 bp, Mus musculus
tcatcatccaggtgttggagaagca

SEQ ID NO: 768790 - DNA, 25 bp, Mus musculus
tcatcatccagtcgaatggcccgga

SEQ ID NO: 768791 - DNA, 25 bp, Mus musculus
tcatcatccagtggaatggcccgga

SEQ ID NO: 768792 - DNA, 25 bp, Mus musculus
tcatcatccccaatccaaactgtga

SEQ ID NO: 768793 - DNA, 25 bp, Mus musculus
tcatcatccccattccaaactgtga

SEQ ID NO: 768794 - DNA, 25 bp, Mus musculus
tcatcatcctccctcttgggagaat

SEQ ID NO: 768795 - DNA, 25 bp, Mus musculus
tcatcatcctccgtcttgggagaat

SEQ ID NO: 768796 - DNA, 25 bp, Mus musculus
tcatcatcgagaccgacctggaacg

SEQ ID NO: 768797 - DNA, 25 bp, Mus musculus
tcatcatcgagagcgacctggaacg

SEQ ID NO: 768798 - DNA, 25 bp, Mus musculus
tcatcatcgatgctttcaaaggaca

SEQ ID NO: 768799 - DNA, 25 bp, Mus musculus
tcatcatcgatggtttcaaaggaca

SEQ ID NO: 768800 - DNA, 25 bp, Mus musculus
tcatcatcgcccaggctggagttgg

SEQ ID NO: 768801 - DNA, 25 bp, Mus musculus
tcatcatcgccctggctggagttgg

SEQ ID NO: 768802 - DNA, 25 bp, Mus musculus
tcatcatcgtgcagcgtcaggacaa

SEQ ID NO: 768803 - DNA, 25 bp, Mus musculus
tcatcatcgtgctgcgtcaggacaa

SEQ ID NO: 768804 - DNA, 25 bp, Mus musculus
tcatcatctctgaagacatctctgt

SEQ ID NO: 768805 - DNA, 25 bp, Mus musculus
tcatcatctctgtagacatctctgt

SEQ ID NO: 768806 - DNA, 25 bp, Mus musculus
tcatcatctgcactacctgtcagac

SEQ ID NO: 768807 - DNA, 25 bp, Mus musculus
tcatcatctgcagtacctgtcagac

SEQ ID NO: 768808 - DNA, 25 bp, Mus musculus
tcatcatctgttactccatcacgga

SEQ ID NO: 768809 - DNA, 25 bp, Mus musculus
tcatcatctgtttctccatcacgga

SEQ ID NO: 768810 - DNA, 25 bp, Mus musculus
tcatcatcttgcactggcggacgct

SEQ ID NO: 768811 - DNA, 25 bp, Mus musculus
tcatcatcttgctctggcggacgct

SEQ ID NO: 768812 - DNA, 25 bp, Mus musculus
tcatcatgacttccaatgtagccag

SEQ ID NO: 768813 - DNA, 25 bp, Mus musculus
tcatcatgacttgcaatgtagccag

SEQ ID NO: 768814 - DNA, 25 bp, Mus musculus
tcatcatgagaaaaagagagccacg

SEQ ID NO: 768815 - DNA, 25 bp, Mus musculus
tcatcatgagaataagagagccacg

SEQ ID NO: 768816 - DNA, 25 bp, Mus musculus
tcatcatgatggaagacctgcctgg

SEQ ID NO: 768817 - DNA, 25 bp, Mus musculus
tcatcatgatggtagacctgcctgg

SEQ ID NO: 768818 - DNA, 25 bp, Mus musculus
tcatcatgcactacactgttaattc

SEQ ID NO: 768819 - DNA, 25 bp, Mus musculus
tcatcatgcacttcactgttaattc

SEQ ID NO: 768820 - DNA, 25 bp, Mus musculus
tcatcatgccctacccggagacaga

SEQ ID NO: 768821 - DNA, 25 bp, Mus musculus
tcatcatgcccttcccggagacaga

SEQ ID NO: 768822 - DNA, 25 bp, Mus musculus
tcatcatgcctgcactatttcacga

SEQ ID NO: 768823 - DNA, 25 bp, Mus musculus
tcatcatgcctggactatttcacga

SEQ ID NO: 768824 - DNA, 25 bp, Mus musculus
tcatcatggcaaaaccagctggtgg

SEQ ID NO: 768825 - DNA, 25 bp, Mus musculus
tcatcatggcaaatgtcatcagcaa

SEQ ID NO: 768826 - DNA, 25 bp, Mus musculus
tcatcatggcaataccagctggtgg

SEQ ID NO: 768827 - DNA, 25 bp, Mus musculus
tcatcatggcaattgtcatcagcaa

SEQ ID NO: 768828 - DNA, 25 bp, Mus musculus
tcatcatgggctccaacatcggaac

SEQ ID NO: 768829 - DNA, 25 bp, Mus musculus
tcatcatgggctctagggcagtgtc

SEQ ID NO: 768830 - DNA, 25 bp, Mus musculus
tcatcatgggctgcaacatcggaac

SEQ ID NO: 768831 - DNA, 25 bp, Mus musculus
tcatcatgggctgtagggcagtgtc

SEQ ID NO: 768832 - DNA, 25 bp, Mus musculus
tcatcatggtaaaggaactcagcac

SEQ ID NO: 768833 - DNA, 25 bp, Mus musculus
tcatcatggtaatggaactcagcac

SEQ ID NO: 768834 - DNA, 25 bp, Mus musculus
tcatcattcggacaccaaccgtggg

SEQ ID NO: 768835 - DNA, 25 bp, Mus musculus
tcatcattcggagaccaaccgtggg

SEQ ID NO: 768836 - DNA, 25 bp, Mus musculus
tcatcattctgtacgaagggctcct

SEQ ID NO: 768837 - DNA, 25 bp, Mus musculus
tcatcattctgttcgaagggctcct

SEQ ID NO: 768838 - DNA, 25 bp, Mus musculus
tcatcattggtgagacggtgctggt

SEQ ID NO: 768839 - DNA, 25 bp, Mus musculus
tcatcattggtgtgacggtgctggt

SEQ ID NO: 768840 - DNA, 25 bp, Mus musculus
tcatcatttcttccaagccctaagg

SEQ ID NO: 768841 - DNA, 25 bp, Mus musculus
tcatcatttcttgcaagccctaagg

SEQ ID NO: 768842 - DNA, 25 bp, Mus musculus
tcatccaaaagcatctcaagacgat

SEQ ID NO: 768843 - DNA, 25 bp, Mus musculus
tcatccaaaagcttctcaagacgat

SEQ ID NO: 768844 - DNA, 25 bp, Mus musculus
tcatccaaaatacaggaagcatgcg

SEQ ID NO: 768845 - DNA, 25 bp, Mus musculus
tcatccaaaatagaggaagcatgcg

SEQ ID NO: 768846 - DNA, 25 bp, Mus musculus
tcatccaaatacacagctggccggg

SEQ ID NO: 768847 - DNA, 25 bp, Mus musculus
tcatccaaatactcagctggccggg

SEQ ID NO: 768848 - DNA, 25 bp, Mus musculus
tcatccaacagcctgggcgtcagtg

SEQ ID NO: 768849 - DNA, 25 bp, Mus musculus
tcatccaacagcgtgggcgtcagtg

SEQ ID NO: 768850 - DNA, 25 bp, Mus musculus
tcatccaacatcagttattagtggc

SEQ ID NO: 768851 - DNA, 25 bp, Mus musculus
tcatccaacatctgttattagtggc

SEQ ID NO: 768852 - DNA, 25 bp, Mus musculus
tcatccaagaagcttctgaacctgt

SEQ ID NO: 768853 - DNA, 25 bp, Mus musculus
tcatccaagaaggttctgaacctgt

SEQ ID NO: 768854 - DNA, 25 bp, Mus musculus
tcatccaagcggaccgccagatgct

SEQ ID NO: 768855 - DNA, 25 bp, Mus musculus
tcatccaagcggtccgccagatgct

SEQ ID NO: 768856 - DNA, 25 bp, Mus musculus
tcatccacactaaggaaaccctgac

SEQ ID NO: 768857 - DNA, 25 bp, Mus musculus
tcatccacactatggaaaccctgac

SEQ ID NO: 768858 - DNA, 25 bp, Mus musculus
tcatccacataccagatcctgtttg

SEQ ID NO: 768859 - DNA, 25 bp, Mus musculus
tcatccacatacgagatcctgtttg

SEQ ID NO: 768860 - DNA, 25 bp, Mus musculus
tcatccacatgaacctgtttgtatc

SEQ ID NO: 768861 - DNA, 25 bp, Mus musculus
tcatccacatgatcctgtttgtatc

SEQ ID NO: 768862 - DNA, 25 bp, Mus musculus
tcatccaccaccaggtccggatggg

SEQ ID NO: 768863 - DNA, 25 bp, Mus musculus
tcatccaccacctggtccggatggg

SEQ ID NO: 768864 - DNA, 25 bp, Mus musculus
tcatccacgcctagggcggcatggc

SEQ ID NO: 768865 - DNA, 25 bp, Mus musculus
tcatccacgccttgggcggcatggc

SEQ ID NO: 768866 - DNA, 25 bp, Mus musculus
tcatccacgctgacctgtttcaaat

SEQ ID NO: 768867 - DNA, 25 bp, Mus musculus
tcatccacgctgtcctgtttcaaat

SEQ ID NO: 768868 - DNA, 25 bp, Mus musculus
tcatccactagtacttgtgaggtcc

SEQ ID NO: 768869 - DNA, 25 bp, Mus musculus
tcatccactagttcttgtgaggtcc

SEQ ID NO: 768870 - DNA, 25 bp, Mus musculus
tcatccactctcaagcggaaggcgc

SEQ ID NO: 768871 - DNA, 25 bp, Mus musculus
tcatccactctctagcggaaggcgc

SEQ ID NO: 768872 - DNA, 25 bp, Mus musculus
tcatccagaaacatccttggaagaa

SEQ ID NO: 768873 - DNA, 25 bp, Mus musculus
tcatccagaaacttccttggaagaa

SEQ ID NO: 768874 - DNA, 25 bp, Mus musculus
tcatccagcagaagacggacgaggc

SEQ ID NO: 768875 - DNA, 25 bp, Mus musculus
tcatccagcagaatgcctcagaggc

SEQ ID NO: 768876 - DNA, 25 bp, Mus musculus
tcatccagcagacttggaacaggac

SEQ ID NO: 768877 - DNA, 25 bp, Mus musculus
tcatccagcagagttggaacaggac

SEQ ID NO: 768878 - DNA, 25 bp, Mus musculus
tcatccagcagatgacggacgaggc

SEQ ID NO: 768879 - DNA, 25 bp, Mus musculus
tcatccagcagattgcctcagaggc

SEQ ID NO: 768880 - DNA, 25 bp, Mus musculus
tcatccagcccacctttacctgcag

SEQ ID NO: 768881 - DNA, 25 bp, Mus musculus
tcatccagcccagctttacctgcag

SEQ ID NO: 768882 - DNA, 25 bp, Mus musculus
tcatccagccttatggcgaatggtt

SEQ ID NO: 768883 - DNA, 25 bp, Mus musculus
tcatccagccttttggcgaatggtt

SEQ ID NO: 768884 - DNA, 25 bp, Mus musculus
tcatccagctgaagcagcggaggcg

SEQ ID NO: 768885 - DNA, 25 bp, Mus musculus
tcatccagctgatgcagcggaggcg

SEQ ID NO: 768886 - DNA, 25 bp, Mus musculus
tcatccaggagcacctagtgtcagc

SEQ ID NO: 768887 - DNA, 25 bp, Mus musculus
tcatccaggagctcctagtgtcagc

SEQ ID NO: 768888 - DNA, 25 bp, Mus musculus
tcatccaggattatcaagcttccgt

SEQ ID NO: 768889 - DNA, 25 bp, Mus musculus
tcatccaggattttcaagcttccgt

SEQ ID NO: 768890 - DNA, 25 bp, Mus musculus
tcatccaggctgacgacagcaattc

SEQ ID NO: 768891 - DNA, 25 bp, Mus musculus
tcatccaggctgtcgacagcaattc

SEQ ID NO: 768892 - DNA, 25 bp, Mus musculus
tcatccagggcaaactggaccagcg

SEQ ID NO: 768893 - DNA, 25 bp, Mus musculus
tcatccagggcatactggaccagcg

SEQ ID NO: 768894 - DNA, 25 bp, Mus musculus
tcatccaggttaccgatggcaacca

SEQ ID NO: 768895 - DNA, 25 bp, Mus musculus
tcatccaggttagcgatggcaacca

SEQ ID NO: 768896 - DNA, 25 bp, Mus musculus
tcatccatccggaaaggcatggtga

SEQ ID NO: 768897 - DNA, 25 bp, Mus musculus
tcatccatccggtaaggcatggtga

SEQ ID NO: 768898 - DNA, 25 bp, Mus musculus
tcatccatgaagaccacgtccagat

SEQ ID NO: 768899 - DNA, 25 bp, Mus musculus
tcatccatgaagtccacgtccagat

SEQ ID NO: 768900 - DNA, 25 bp, Mus musculus
tcatccatgagtaatcatacgaagg

SEQ ID NO: 768901 - DNA, 25 bp, Mus musculus
tcatccatgagttatcatacgaagg

SEQ ID NO: 768902 - DNA, 25 bp, Mus musculus
tcatccatgcctacctagggctgga

SEQ ID NO: 768903 - DNA, 25 bp, Mus musculus
tcatccatgccttcctagggctgga

SEQ ID NO: 768904 - DNA, 25 bp, Mus musculus
tcatccatgctgaacaggcaacagg

SEQ ID NO: 768905 - DNA, 25 bp, Mus musculus
tcatccatgctgtacaggcaacagg

SEQ ID NO: 768906 - DNA, 25 bp, Mus musculus
tcatccatgggtacttagcgctgtc

SEQ ID NO: 768907 - DNA, 25 bp, Mus musculus
tcatccatgggttcttagcgctgtc

SEQ ID NO: 768908 - DNA, 25 bp, Mus musculus
tcatccatgtgcagacgctaaccca

SEQ ID NO: 768909 - DNA, 25 bp, Mus musculus
tcatccatgtgctgacgctaaccca

SEQ ID NO: 768910 - DNA, 25 bp, Mus musculus
tcatccattagaccggtaatcaaga

SEQ ID NO: 768911 - DNA, 25 bp, Mus musculus
tcatccattagagcggtaatcaaga

SEQ ID NO: 768912 - DNA, 25 bp, Mus musculus
tcatcccaagtgaggctgaataagg

SEQ ID NO: 768913 - DNA, 25 bp, Mus musculus
tcatcccaagtgtggctgaataagg

SEQ ID NO: 768914 - DNA, 25 bp, Mus musculus
tcatcccagactcctctatggagag

SEQ ID NO: 768915 - DNA, 25 bp, Mus musculus
tcatcccagactgctctatggagag

SEQ ID NO: 768916 - DNA, 25 bp, Mus musculus
tcatcccagtctcagggtggaggca

SEQ ID NO: 768917 - DNA, 25 bp, Mus musculus
tcatcccagtctgagggtggaggca

SEQ ID NO: 768918 - DNA, 25 bp, Mus musculus
tcatcccatcaaatcttctaaagcc

SEQ ID NO: 768919 - DNA, 25 bp, Mus musculus
tcatcccatcaattcttctaaagcc

SEQ ID NO: 768920 - DNA, 25 bp, Mus musculus
tcatccccaacgatgagtggctgga

SEQ ID NO: 768921 - DNA, 25 bp, Mus musculus
tcatccccaacgttgagtggctgga

SEQ ID NO: 768922 - DNA, 25 bp, Mus musculus
tcatccccaaggacttagccatgtc

SEQ ID NO: 768923 - DNA, 25 bp, Mus musculus
tcatccccaaggtcttagccatgtc

SEQ ID NO: 768924 - DNA, 25 bp, Mus musculus
tcatccccactgctctggttgctgg

SEQ ID NO: 768925 - DNA, 25 bp, Mus musculus
tcatccccactggtctggttgctgg

SEQ ID NO: 768926 - DNA, 25 bp, Mus musculus
tcatccccagagaggtgaggccctg

SEQ ID NO: 768927 - DNA, 25 bp, Mus musculus
tcatccccagagtggtgaggccctg

SEQ ID NO: 768928 - DNA, 25 bp, Mus musculus
tcatccccagtgaccaagactttga

SEQ ID NO: 768929 - DNA, 25 bp, Mus musculus
tcatccccagtgtccaagactttga

SEQ ID NO: 768930 - DNA, 25 bp, Mus musculus
tcatccccatagaggtggagcagac

SEQ ID NO: 768931 - DNA, 25 bp, Mus musculus
tcatccccatagtggtggagcagac

SEQ ID NO: 768932 - DNA, 25 bp, Mus musculus
tcatcccctattacattgccctggt

SEQ ID NO: 768933 - DNA, 25 bp, Mus musculus
tcatcccctatttcattgccctggt

SEQ ID NO: 768934 - DNA, 25 bp, Mus musculus
tcatcccctgacctatgaaggtggt

SEQ ID NO: 768935 - DNA, 25 bp, Mus musculus
tcatcccctgacgtatgaaggtggt

SEQ ID NO: 768936 - DNA, 25 bp, Mus musculus
tcatccccttacatgaaaggctgga

SEQ ID NO: 768937 - DNA, 25 bp, Mus musculus
tcatccccttacttgaaaggctgga

SEQ ID NO: 768938 - DNA, 25 bp, Mus musculus
tcatcccgcatgctggtttctttgc

SEQ ID NO: 768939 - DNA, 25 bp, Mus musculus
tcatcccgcatggtggtttctttgc

SEQ ID NO: 768940 - DNA, 25 bp, Mus musculus
tcatcccggaggctggcgagccaaa

SEQ ID NO: 768941 - DNA, 25 bp, Mus musculus
tcatcccggagggtggcgagccaaa

SEQ ID NO: 768942 - DNA, 25 bp, Mus musculus
tcatcccggagtccgtagacctgga

SEQ ID NO: 768943 - DNA, 25 bp, Mus musculus
tcatcccggagtgcgtagacctgga

SEQ ID NO: 768944 - DNA, 25 bp, Mus musculus
tcatcccgggacagttccaggagta

SEQ ID NO: 768945 - DNA, 25 bp, Mus musculus
tcatcccgggactgttccaggagta

SEQ ID NO: 768946 - DNA, 25 bp, Mus musculus
tcatcccgtgaaccgaatgcgcagc

SEQ ID NO: 768947 - DNA, 25 bp, Mus musculus
tcatcccgtgaagcgaatgcgcagc

SEQ ID NO: 768948 - DNA, 25 bp, Mus musculus
tcatccctgacaaagtgccatcagg

SEQ ID NO: 768949 - DNA, 25 bp, Mus musculus
tcatccctgacatagtgccatcagg

SEQ ID NO: 768950 - DNA, 25 bp, Mus musculus
tcatcccttagcagtggagggacag

SEQ ID NO: 768951 - DNA, 25 bp, Mus musculus
tcatcccttagctgtggagggacag

SEQ ID NO: 768952 - DNA, 25 bp, Mus musculus
tcatccgaaaatatgacaggcaagg

SEQ ID NO: 768953 - DNA, 25 bp, Mus musculus
tcatccgaaaatttgacaggcaagg

SEQ ID NO: 768954 - DNA, 25 bp, Mus musculus
tcatccgatcctcccctgagagagg

SEQ ID NO: 768955 - DNA, 25 bp, Mus musculus
tcatccgatcctgccctgagagagg

SEQ ID NO: 768956 - DNA, 25 bp, Mus musculus
tcatccgccatgacgtgcagcctga

SEQ ID NO: 768957 - DNA, 25 bp, Mus musculus
tcatccgccatgtcgtgcagcctga

SEQ ID NO: 768958 - DNA, 25 bp, Mus musculus
tcatccgcctgtagatgacccgcag

SEQ ID NO: 768959 - DNA, 25 bp, Mus musculus
tcatccgcctgttgatgacccgcag

SEQ ID NO: 768960 - DNA, 25 bp, Mus musculus
tcatccgctatcagctaaaccagga

SEQ ID NO: 768961 - DNA, 25 bp, Mus musculus
tcatccgctatctgctaaaccagga

SEQ ID NO: 768962 - DNA, 25 bp, Mus musculus
tcatccggaggcaggaccagctgca

SEQ ID NO: 768963 - DNA, 25 bp, Mus musculus
tcatccggaggctggaccagctgca

SEQ ID NO: 768964 - DNA, 25 bp, Mus musculus
tcatccgggctgaaggtgaacggca

SEQ ID NO: 768965 - DNA, 25 bp, Mus musculus
tcatccgggctgtaggtgaacggca

SEQ ID NO: 768966 - DNA, 25 bp, Mus musculus
tcatcctaaattcacaaagggccag

SEQ ID NO: 768967 - DNA, 25 bp, Mus musculus
tcatcctaaattgacaaagggccag

SEQ ID NO: 768968 - DNA, 25 bp, Mus musculus
tcatcctagcgaagtcctggcagga

SEQ ID NO: 768969 - DNA, 25 bp, Mus musculus
tcatcctagcgatgtcctggcagga

SEQ ID NO: 768970 - DNA, 25 bp, Mus musculus
tcatcctagtggctgtccgtcactc

SEQ ID NO: 768971 - DNA, 25 bp, Mus musculus
tcatcctagtgggtgtccgtcactc

SEQ ID NO: 768972 - DNA, 25 bp, Mus musculus
tcatcctcaaccaggaacagcagat

SEQ ID NO: 768973 - DNA, 25 bp, Mus musculus
tcatcctcaacctggaacagcagat

SEQ ID NO: 768974 - DNA, 25 bp, Mus musculus
tcatcctcacttaccatgcagggaa

SEQ ID NO: 768975 - DNA, 25 bp, Mus musculus
tcatcctcactttccatgcagggaa

SEQ ID NO: 768976 - DNA, 25 bp, Mus musculus
tcatcctcagatatgccatccagga

SEQ ID NO: 768977 - DNA, 25 bp, Mus musculus
tcatcctcagatttgccatccagga

SEQ ID NO: 768978 - DNA, 25 bp, Mus musculus
tcatcctcagcaacctcaggagaaa

SEQ ID NO: 768979 - DNA, 25 bp, Mus musculus
tcatcctcagcatcctcaggagaaa

SEQ ID NO: 768980 - DNA, 25 bp, Mus musculus
tcatcctcaggaagggcgccataaa

SEQ ID NO: 768981 - DNA, 25 bp, Mus musculus
tcatcctcaggatgggcgccataaa

SEQ ID NO: 768982 - DNA, 25 bp, Mus musculus
tcatcctcagtaatacatggcatgg

SEQ ID NO: 768983 - DNA, 25 bp, Mus musculus
tcatcctcagtattacatggcatgg

SEQ ID NO: 768984 - DNA, 25 bp, Mus musculus
tcatcctcatcaagctgtggcagaa

SEQ ID NO: 768985 - DNA, 25 bp, Mus musculus
tcatcctcatcatgctgtggcagaa

SEQ ID NO: 768986 - DNA, 25 bp, Mus musculus
tcatcctcatccagggttagaagct

SEQ ID NO: 768987 - DNA, 25 bp, Mus musculus
tcatcctcatcctgggttagaagct

SEQ ID NO: 768988 - DNA, 25 bp, Mus musculus
tcatcctcattcaagtgtgtgcttg

SEQ ID NO: 768989 - DNA, 25 bp, Mus musculus
tcatcctcattctagtgtgtgcttg

SEQ ID NO: 768990 - DNA, 25 bp, Mus musculus
tcatcctcatttccatccttgtcgg

SEQ ID NO: 768991 - DNA, 25 bp, Mus musculus
tcatcctcatttgcatccttgtcgg

SEQ ID NO: 768992 - DNA, 25 bp, Mus musculus
tcatcctccttgacgtgaccctgat

SEQ ID NO: 768993 - DNA, 25 bp, Mus musculus
tcatcctccttgtcgtgaccctgat

SEQ ID NO: 768994 - DNA, 25 bp, Mus musculus
tcatcctctccacctgggaaggagg

SEQ ID NO: 768995 - DNA, 25 bp, Mus musculus
tcatcctctccagctgggaaggagg

SEQ ID NO: 768996 - DNA, 25 bp, Mus musculus
tcatcctctggacgaacgtgagctc

SEQ ID NO: 768997 - DNA, 25 bp, Mus musculus
tcatcctctggaggaacgtgagctc

SEQ ID NO: 768998 - DNA, 25 bp, Mus musculus
tcatcctctggtacgtattgtttgg

SEQ ID NO: 768999 - DNA, 25 bp, Mus musculus
tcatcctctggttcgtattgtttgg

SEQ ID NO: 769000 - DNA, 25 bp, Mus musculus
tcatcctgaaacaacccagctaatg

SEQ ID NO: 769001 - DNA, 25 bp, Mus musculus
tcatcctgaaactacccagctaatg

SEQ ID NO: 769002 - DNA, 25 bp, Mus musculus
tcatcctgaaggagaaggactgtcc

SEQ ID NO: 769003 - DNA, 25 bp, Mus musculus
tcatcctgaaggtgaaggactgtcc

SEQ ID NO: 769004 - DNA, 25 bp, Mus musculus
tcatcctgacccaggtgaatgcacc

SEQ ID NO: 769005 - DNA, 25 bp, Mus musculus
tcatcctgaccctggtgaatgcacc

SEQ ID NO: 769006 - DNA, 25 bp, Mus musculus
tcatcctgactgactgcacacacga

SEQ ID NO: 769007 - DNA, 25 bp, Mus musculus
tcatcctgactgtctgcacacacga

SEQ ID NO: 769008 - DNA, 25 bp, Mus musculus
tcatcctgcccaactgtgagaacga

SEQ ID NO: 769009 - DNA, 25 bp, Mus musculus
tcatcctgcccatctgtgagaacga

SEQ ID NO: 769010 - DNA, 25 bp, Mus musculus
tcatcctgccttacaacctatgcag

SEQ ID NO: 769011 - DNA, 25 bp, Mus musculus
tcatcctgcctttcaacctatgcag

SEQ ID NO: 769012 - DNA, 25 bp, Mus musculus
tcatcctgcttcatgtacttcactg

SEQ ID NO: 769013 - DNA, 25 bp, Mus musculus
tcatcctgcttcttgtacttcactg

SEQ ID NO: 769014 - DNA, 25 bp, Mus musculus
tcatcctggtgacaaggaagaacct

SEQ ID NO: 769015 - DNA, 25 bp, Mus musculus
tcatcctggtgagaaggaagaacct

SEQ ID NO: 769016 - DNA, 25 bp, Mus musculus
tcatcctggtggcaactcagcatcc

SEQ ID NO: 769017 - DNA, 25 bp, Mus musculus
tcatcctggtgggaactcagcatcc

SEQ ID NO: 769018 - DNA, 25 bp, Mus musculus
tcatcctggttaaagagtgggcctg

SEQ ID NO: 769019 - DNA, 25 bp, Mus musculus
tcatcctggttatagagtgggcctg

SEQ ID NO: 769020 - DNA, 25 bp, Mus musculus
tcatccttcagaactgctgtccaga

SEQ ID NO: 769021 - DNA, 25 bp, Mus musculus
tcatccttcagatctgctgtccaga

SEQ ID NO: 769022 - DNA, 25 bp, Mus musculus
tcatccttctggagcaggacctcca

SEQ ID NO: 769023 - DNA, 25 bp, Mus musculus
tcatccttctggtgcaggacctcca

SEQ ID NO: 769024 - DNA, 25 bp, Mus musculus
tcatccttgaaccttcatgtctagg

SEQ ID NO: 769025 - DNA, 25 bp, Mus musculus
tcatccttgaacgttcatgtctagg

SEQ ID NO: 769026 - DNA, 25 bp, Mus musculus
tcatccttggaacccgcactgaggg

SEQ ID NO: 769027 - DNA, 25 bp, Mus musculus
tcatccttggaagccgcactgaggg

SEQ ID NO: 769028 - DNA, 25 bp, Mus musculus
tcatccttggtgattgcaactggac

SEQ ID NO: 769029 - DNA, 25 bp, Mus musculus
tcatccttggtgcttagtgctgcag

SEQ ID NO: 769030 - DNA, 25 bp, Mus musculus
tcatccttggtggttagtgctgcag

SEQ ID NO: 769031 - DNA, 25 bp, Mus musculus
tcatccttggtgtttgcaactggac

SEQ ID NO: 769032 - DNA, 25 bp, Mus musculus
tcatccttgtccatgttcgcacagg

SEQ ID NO: 769033 - DNA, 25 bp, Mus musculus
tcatccttgtccttgttcgcacagg

SEQ ID NO: 769034 - DNA, 25 bp, Mus musculus
tcatccttgtctagaattcctgcag

SEQ ID NO: 769035 - DNA, 25 bp, Mus musculus
tcatccttgtcttgaattcctgcag

SEQ ID NO: 769036 - DNA, 25 bp, Mus musculus
tcatcctttcgaatgctgactggtc

SEQ ID NO: 769037 - DNA, 25 bp, Mus musculus
tcatcctttcgattgctgactggtc

SEQ ID NO: 769038 - DNA, 25 bp, Mus musculus
tcatcctttgcgattgggctaacag

SEQ ID NO: 769039 - DNA, 25 bp, Mus musculus
tcatcctttgcgtttgggctaacag

SEQ ID NO: 769040 - DNA, 25 bp, Mus musculus
tcatcgaacttaccctcaaagaaga

SEQ ID NO: 769041 - DNA, 25 bp, Mus musculus
tcatcgaacttagcctcaaagaaga

SEQ ID NO: 769042 - DNA, 25 bp, Mus musculus
tcatcgaagacaatgagctgaacat

SEQ ID NO: 769043 - DNA, 25 bp, Mus musculus
tcatcgaagacattgagctgaacat

SEQ ID NO: 769044 - DNA, 25 bp, Mus musculus
tcatcgaagctcaagatatggcagg

SEQ ID NO: 769045 - DNA, 25 bp, Mus musculus
tcatcgaagctctagatatggcagg

SEQ ID NO: 769046 - DNA, 25 bp, Mus musculus
tcatcgacagcacataccagcagtg

SEQ ID NO: 769047 - DNA, 25 bp, Mus musculus
tcatcgacagcagataccagcagtg

SEQ ID NO: 769048 - DNA, 25 bp, Mus musculus
tcatcgacagtacacacactgagca

SEQ ID NO: 769049 - DNA, 25 bp, Mus musculus
tcatcgacagtagacacactgagca

SEQ ID NO: 769050 - DNA, 25 bp, Mus musculus
tcatcgacgggaaaagccggttcct

SEQ ID NO: 769051 - DNA, 25 bp, Mus musculus
tcatcgacgggataagccggttcct

SEQ ID NO: 769052 - DNA, 25 bp, Mus musculus
tcatcgagaaggaaaaggtgccata

SEQ ID NO: 769053 - DNA, 25 bp, Mus musculus
tcatcgagaaggtaaaggtgccata

SEQ ID NO: 769054 - DNA, 25 bp, Mus musculus
tcatcgagacaaccaccattaagcc

SEQ ID NO: 769055 - DNA, 25 bp, Mus musculus
tcatcgagacaagcaccattaagcc

SEQ ID NO: 769056 - DNA, 25 bp, Mus musculus
tcatcgagagcgacctggaacgtgc

SEQ ID NO: 769057 - DNA, 25 bp, Mus musculus
tcatcgagagcgtcctggaacgtgc

SEQ ID NO: 769058 - DNA, 25 bp, Mus musculus
tcatcgagatccagagtgcgtgggc

SEQ ID NO: 769059 - DNA, 25 bp, Mus musculus
tcatcgagatcctgagtgcgtgggc

SEQ ID NO: 769060 - DNA, 25 bp, Mus musculus
tcatcgagcctgagtacctccacag

SEQ ID NO: 769061 - DNA, 25 bp, Mus musculus
tcatcgagcctgtgtacctccacag

SEQ ID NO: 769062 - DNA, 25 bp, Mus musculus
tcatcgaggaccagcctgtcctaaa

SEQ ID NO: 769063 - DNA, 25 bp, Mus musculus
tcatcgaggacctgcctgtcctaaa

SEQ ID NO: 769064 - DNA, 25 bp, Mus musculus
tcatcgagtcggactgtgacgaccc

SEQ ID NO: 769065 - DNA, 25 bp, Mus musculus
tcatcgagtcggtctgtgacgaccc

SEQ ID NO: 769066 - DNA, 25 bp, Mus musculus
tcatcgagtgtcaaggtaatggcaa

SEQ ID NO: 769067 - DNA, 25 bp, Mus musculus
tcatcgagtgtctaggtaatggcaa

SEQ ID NO: 769068 - DNA, 25 bp, Mus musculus
tcatcgatcagtcgatctgcgctca

SEQ ID NO: 769069 - DNA, 25 bp, Mus musculus
tcatcgatcagtggatctgcgctca

SEQ ID NO: 769070 - DNA, 25 bp, Mus musculus
tcatcgatgaggaaacagaggtgca

SEQ ID NO: 769071 - DNA, 25 bp, Mus musculus
tcatcgatgaggctggccactgcat

SEQ ID NO: 769072 - DNA, 25 bp, Mus musculus
tcatcgatgagggtggccactgcat

SEQ ID NO: 769073 - DNA, 25 bp, Mus musculus
tcatcgatgaggtaacagaggtgca

SEQ ID NO: 769074 - DNA, 25 bp, Mus musculus
tcatcgattataacctccacggcaa

SEQ ID NO: 769075 - DNA, 25 bp, Mus musculus
tcatcgattatatcctccacggcaa

SEQ ID NO: 769076 - DNA, 25 bp, Mus musculus
tcatcgcagacacccatcagaactt

SEQ ID NO: 769077 - DNA, 25 bp, Mus musculus
tcatcgcagacagccatcagaactt

SEQ ID NO: 769078 - DNA, 25 bp, Mus musculus
tcatcgcaggccacgagagcggaga

SEQ ID NO: 769079 - DNA, 25 bp, Mus musculus
tcatcgcaggccagccgggcttgtg

SEQ ID NO: 769080 - DNA, 25 bp, Mus musculus
tcatcgcaggcctcgagagcggaga

SEQ ID NO: 769081 - DNA, 25 bp, Mus musculus
tcatcgcaggcctgccgggcttgtg

SEQ ID NO: 769082 - DNA, 25 bp, Mus musculus
tcatcgccagagatggaaggctcct

SEQ ID NO: 769083 - DNA, 25 bp, Mus musculus
tcatcgccagagttggaaggctcct

SEQ ID NO: 769084 - DNA, 25 bp, Mus musculus
tcatcgccatcgagaaggcctcggg

SEQ ID NO: 769085 - DNA, 25 bp, Mus musculus
tcatcgccatcgatgctggcctggt

SEQ ID NO: 769086 - DNA, 25 bp, Mus musculus
tcatcgccatcgtgaaggcctcggg

SEQ ID NO: 769087 - DNA, 25 bp, Mus musculus
tcatcgccatcgttgctggcctggt

SEQ ID NO: 769088 - DNA, 25 bp, Mus musculus
tcatcgcctctgatttgtcccatag

SEQ ID NO: 769089 - DNA, 25 bp, Mus musculus
tcatcgcctctgttttgtcccatag

SEQ ID NO: 769090 - DNA, 25 bp, Mus musculus
tcatcgcctggcattgactcatagc

SEQ ID NO: 769091 - DNA, 25 bp, Mus musculus
tcatcgcctggctttgactcatagc

SEQ ID NO: 769092 - DNA, 25 bp, Mus musculus
tcatcgctatgacgaaattccccag

SEQ ID NO: 769093 - DNA, 25 bp, Mus musculus
tcatcgctatgaggaaattccccag

SEQ ID NO: 769094 - DNA, 25 bp, Mus musculus
tcatcgctctctagggcatcaccat

SEQ ID NO: 769095 - DNA, 25 bp, Mus musculus
tcatcgctctcttgggcatcaccat

SEQ ID NO: 769096 - DNA, 25 bp, Mus musculus
tcatcgctgcgcagagcgcttacga

SEQ ID NO: 769097 - DNA, 25 bp, Mus musculus
tcatcgctgcgctgagcgcttacga

SEQ ID NO: 769098 - DNA, 25 bp, Mus musculus
tcatcgctggatccctggtgcttga

SEQ ID NO: 769099 - DNA, 25 bp, Mus musculus
tcatcgctggatgcctggtgcttga

SEQ ID NO: 769100 - DNA, 25 bp, Mus musculus
tcatcgcttaggaaaccaatcccga

SEQ ID NO: 769101 - DNA, 25 bp, Mus musculus
tcatcgcttaggtaaccaatcccga

SEQ ID NO: 769102 - DNA, 25 bp, Mus musculus
tcatcggacaggaactgagcacact

SEQ ID NO: 769103 - DNA, 25 bp, Mus musculus
tcatcggacaggtactgagcacact

SEQ ID NO: 769104 - DNA, 25 bp, Mus musculus
tcatcggagatgatattaaccggcg

SEQ ID NO: 769105 - DNA, 25 bp, Mus musculus
tcatcggagatgttattaaccggcg

SEQ ID NO: 769106 - DNA, 25 bp, Mus musculus
tcatcggagggcacaggtttctgcg

SEQ ID NO: 769107 - DNA, 25 bp, Mus musculus
tcatcggagggctcaggtttctgcg

SEQ ID NO: 769108 - DNA, 25 bp, Mus musculus
tcatcggcacatccagtcagaacgt

SEQ ID NO: 769109 - DNA, 25 bp, Mus musculus
tcatcggcacatgcagtcagaacgt

SEQ ID NO: 769110 - DNA, 25 bp, Mus musculus
tcatcggccggtacccgtgaaaaca

SEQ ID NO: 769111 - DNA, 25 bp, Mus musculus
tcatcggccggttcccgtgaaaaca

SEQ ID NO: 769112 - DNA, 25 bp, Mus musculus
tcatcggcctctctatctggttgcc

SEQ ID NO: 769113 - DNA, 25 bp, Mus musculus
tcatcggcctctgtatctggttgcc

SEQ ID NO: 769114 - DNA, 25 bp, Mus musculus
tcatcggctgctcctggtatggtga

SEQ ID NO: 769115 - DNA, 25 bp, Mus musculus
tcatcggctgctgctggtatggtga

SEQ ID NO: 769116 - DNA, 25 bp, Mus musculus
tcatcgggaaccacttcctacggga

SEQ ID NO: 769117 - DNA, 25 bp, Mus musculus
tcatcgggaacctcttcctacggga

SEQ ID NO: 769118 - DNA, 25 bp, Mus musculus
tcatcggtggcgagaacaagcactc

SEQ ID NO: 769119 - DNA, 25 bp, Mus musculus
tcatcggtggcgtgaacaagcactc

SEQ ID NO: 769120 - DNA, 25 bp, Mus musculus
tcatcgtacctaagcctcctggagc

SEQ ID NO: 769121 - DNA, 25 bp, Mus musculus
tcatcgtacctatgcctcctggagc

SEQ ID NO: 769122 - DNA, 25 bp, Mus musculus
tcatcgtagcctagccggaggaggt

SEQ ID NO: 769123 - DNA, 25 bp, Mus musculus
tcatcgtagccttgccggaggaggt

SEQ ID NO: 769124 - DNA, 25 bp, Mus musculus
tcatcgtagggaacactcatgggca

SEQ ID NO: 769125 - DNA, 25 bp, Mus musculus
tcatcgtagggatcactcatgggca

SEQ ID NO: 769126 - DNA, 25 bp, Mus musculus
tcatcgtcaggacaggagaacaccg

SEQ ID NO: 769127 - DNA, 25 bp, Mus musculus
tcatcgtcaggagaggagaacaccg

SEQ ID NO: 769128 - DNA, 25 bp, Mus musculus
tcatcgtcatcaccataaagttgag

SEQ ID NO: 769129 - DNA, 25 bp, Mus musculus
tcatcgtcatcagcataaagttgag

SEQ ID NO: 769130 - DNA, 25 bp, Mus musculus
tcatcgtcggctcgagatgcagccc

SEQ ID NO: 769131 - DNA, 25 bp, Mus musculus
tcatcgtcggctggagatgcagccc

SEQ ID NO: 769132 - DNA, 25 bp, Mus musculus
tcatcgtcttccattactaccaggc

SEQ ID NO: 769133 - DNA, 25 bp, Mus musculus
tcatcgtcttcctttactaccaggc

SEQ ID NO: 769134 - DNA, 25 bp, Mus musculus
tcatcgtgagaacatgaaacaggcg

SEQ ID NO: 769135 - DNA, 25 bp, Mus musculus
tcatcgtgagaagatgaaacaggcg

SEQ ID NO: 769136 - DNA, 25 bp, Mus musculus
tcatcgtgcatgagatctgtggatg

SEQ ID NO: 769137 - DNA, 25 bp, Mus musculus
tcatcgtgcatgtgatctgtggatg

SEQ ID NO: 769138 - DNA, 25 bp, Mus musculus
tcatcgtgcgtgaggtgcccctgct

SEQ ID NO: 769139 - DNA, 25 bp, Mus musculus
tcatcgtgcgtgtggtgcccctgct

SEQ ID NO: 769140 - DNA, 25 bp, Mus musculus
tcatcgtggactcggatgtgcacca

SEQ ID NO: 769141 - DNA, 25 bp, Mus musculus
tcatcgtggactgggatgtgcacca

SEQ ID NO: 769142 - DNA, 25 bp, Mus musculus
tcatcgtgggcaagctctggattga

SEQ ID NO: 769143 - DNA, 25 bp, Mus musculus
tcatcgtgggcatgctctggattga

SEQ ID NO: 769144 - DNA, 25 bp, Mus musculus
tcatcgtggtgaagtatgacccgca

SEQ ID NO: 769145 - DNA, 25 bp, Mus musculus
tcatcgtggtgatgtatgacccgca

SEQ ID NO: 769146 - DNA, 25 bp, Mus musculus
tcatcgtggtggagggcttgtacat

SEQ ID NO: 769147 - DNA, 25 bp, Mus musculus
tcatcgtggtggtgggcttgtacat

SEQ ID NO: 769148 - DNA, 25 bp, Mus musculus
tcatcgtggttgatggagccatcct

SEQ ID NO: 769149 - DNA, 25 bp, Mus musculus
tcatcgtggttgttggagccatcct

SEQ ID NO: 769150 - DNA, 25 bp, Mus musculus
tcatcgttaaagcaacaaatggacc

SEQ ID NO: 769151 - DNA, 25 bp, Mus musculus
tcatcgttaaaggaacaaatggacc

SEQ ID NO: 769152 - DNA, 25 bp, Mus musculus
tcatcgttactcaggaaaccagaga

SEQ ID NO: 769153 - DNA, 25 bp, Mus musculus
tcatcgttactctggaaaccagaga

SEQ ID NO: 769154 - DNA, 25 bp, Mus musculus
tcatcgttacttctgcctggacaag

SEQ ID NO: 769155 - DNA, 25 bp, Mus musculus
tcatcgttacttgtgcctggacaag

SEQ ID NO: 769156 - DNA, 25 bp, Mus musculus
tcatcgttcaggcagaaattgggca

SEQ ID NO: 769157 - DNA, 25 bp, Mus musculus
tcatcgttcagggagaaattgggca

SEQ ID NO: 769158 - DNA, 25 bp, Mus musculus
tcatctaaaacccaagccaagcgct

SEQ ID NO: 769159 - DNA, 25 bp, Mus musculus
tcatctaaaaccgaagccaagcgct

SEQ ID NO: 769160 - DNA, 25 bp, Mus musculus
tcatctaaatccaagcgtgtcgtca

SEQ ID NO: 769161 - DNA, 25 bp, Mus musculus
tcatctaaatcctagcgtgtcgtca

SEQ ID NO: 769162 - DNA, 25 bp, Mus musculus
tcatctaacatgaaggagccctggg

SEQ ID NO: 769163 - DNA, 25 bp, Mus musculus
tcatctaacatgtaggagccctggg

SEQ ID NO: 769164 - DNA, 25 bp, Mus musculus
tcatctaaggaacgagacaagaaac

SEQ ID NO: 769165 - DNA, 25 bp, Mus musculus
tcatctaaggaaggagacaagaaac

SEQ ID NO: 769166 - DNA, 25 bp, Mus musculus
tcatctacatcacctgtgcatcgga

SEQ ID NO: 769167 - DNA, 25 bp, Mus musculus
tcatctacatcagctgtgcatcgga

SEQ ID NO: 769168 - DNA, 25 bp, Mus musculus
tcatctacctccatcgaattgctgg

SEQ ID NO: 769169 - DNA, 25 bp, Mus musculus
tcatctacctccttcgaattgctgg

SEQ ID NO: 769170 - DNA, 25 bp, Mus musculus
tcatctacggccatgccctctggta

SEQ ID NO: 769171 - DNA, 25 bp, Mus musculus
tcatctacggccttgccctctggta

SEQ ID NO: 769172 - DNA, 25 bp, Mus musculus
tcatctacgggaagggattccagac

SEQ ID NO: 769173 - DNA, 25 bp, Mus musculus
tcatctacgggatgggattccagac

SEQ ID NO: 769174 - DNA, 25 bp, Mus musculus
tcatctacgggtagacggtggtact

SEQ ID NO: 769175 - DNA, 25 bp, Mus musculus
tcatctacgggttgacggtggtact

SEQ ID NO: 769176 - DNA, 25 bp, Mus musculus
tcatctactactccctgaaggagtc

SEQ ID NO: 769177 - DNA, 25 bp, Mus musculus
tcatctactactgcctgaaggagtc

SEQ ID NO: 769178 - DNA, 25 bp, Mus musculus
tcatctagagctcacagacgacact

SEQ ID NO: 769179 - DNA, 25 bp, Mus musculus
tcatctagagctgacagacgacact

SEQ ID NO: 769180 - DNA, 25 bp, Mus musculus
tcatctagtagcagttcccctgaac

SEQ ID NO: 769181 - DNA, 25 bp, Mus musculus
tcatctagtagctgttcccctgaac

SEQ ID NO: 769182 - DNA, 25 bp, Mus musculus
tcatctatgaccactttgaacacgt

SEQ ID NO: 769183 - DNA, 25 bp, Mus musculus
tcatctatgacctctttgaacacgt

SEQ ID NO: 769184 - DNA, 25 bp, Mus musculus
tcatctatgggaacgtgctgcagtc

SEQ ID NO: 769185 - DNA, 25 bp, Mus musculus
tcatctatgggatcgtgctgcagtc

SEQ ID NO: 769186 - DNA, 25 bp, Mus musculus
tcatctcaaaatctctcatcaccag

SEQ ID NO: 769187 - DNA, 25 bp, Mus musculus
tcatctcaaaatgtctcatcaccag

SEQ ID NO: 769188 - DNA, 25 bp, Mus musculus
tcatctcaccccacgtggtagcagg

SEQ ID NO: 769189 - DNA, 25 bp, Mus musculus
tcatctcaccccagagaagaaccga

SEQ ID NO: 769190 - DNA, 25 bp, Mus musculus
tcatctcacccctcgtggtagcagg

SEQ ID NO: 769191 - DNA, 25 bp, Mus musculus
tcatctcacccctgagaagaaccga

SEQ ID NO: 769192 - DNA, 25 bp, Mus musculus
tcatctcactatcggcacagcagct

SEQ ID NO: 769193 - DNA, 25 bp, Mus musculus
tcatctcactatgggcacagcagct

SEQ ID NO: 769194 - DNA, 25 bp, Mus musculus
tcatctcatcaaaggaaggcttaag

SEQ ID NO: 769195 - DNA, 25 bp, Mus musculus
tcatctcatcaatggaaggcttaag

SEQ ID NO: 769196 - DNA, 25 bp, Mus musculus
tcatctcattcacttaaagtgtgag

SEQ ID NO: 769197 - DNA, 25 bp, Mus musculus
tcatctcattcagttaaagtgtgag

SEQ ID NO: 769198 - DNA, 25 bp, Mus musculus
tcatctccaagaagcagtaccccag

SEQ ID NO: 769199 - DNA, 25 bp, Mus musculus
tcatctccaagatgcagtaccccag

SEQ ID NO: 769200 - DNA, 25 bp, Mus musculus
tcatctccatcaacaacaaaatggt

SEQ ID NO: 769201 - DNA, 25 bp, Mus musculus
tcatctccatcaagggtcctgagct

SEQ ID NO: 769202 - DNA, 25 bp, Mus musculus
tcatctccatcatcaacaaaatggt

SEQ ID NO: 769203 - DNA, 25 bp, Mus musculus
tcatctccatcatgggtcctgagct

SEQ ID NO: 769204 - DNA, 25 bp, Mus musculus
tcatctccatgcagtgccgggagct

SEQ ID NO: 769205 - DNA, 25 bp, Mus musculus
tcatctccatgctgtgccgggagct

SEQ ID NO: 769206 - DNA, 25 bp, Mus musculus
tcatctcccgacacaacattgaagg

SEQ ID NO: 769207 - DNA, 25 bp, Mus musculus
tcatctcccgactcaacattgaagg

SEQ ID NO: 769208 - DNA, 25 bp, Mus musculus
tcatctccgaacctgagcaacggtg

SEQ ID NO: 769209 - DNA, 25 bp, Mus musculus
tcatctccgaacgtgagcaacggtg

SEQ ID NO: 769210 - DNA, 25 bp, Mus musculus
tcatctccggctctgtctgccagga

SEQ ID NO: 769211 - DNA, 25 bp, Mus musculus
tcatctccggctgtgtctgccagga

SEQ ID NO: 769212 - DNA, 25 bp, Mus musculus
tcatctccgggaagtgtgcttgccg

SEQ ID NO: 769213 - DNA, 25 bp, Mus musculus
tcatctccgggatgtgtgcttgccg

SEQ ID NO: 769214 - DNA, 25 bp, Mus musculus
tcatctcctccaagacgatgatgga

SEQ ID NO: 769215 - DNA, 25 bp, Mus musculus
tcatctcctccatgacgatgatgga

SEQ ID NO: 769216 - DNA, 25 bp, Mus musculus
tcatctcgatttcactgcaactcca

SEQ ID NO: 769217 - DNA, 25 bp, Mus musculus
tcatctcgatttgactgcaactcca

SEQ ID NO: 769218 - DNA, 25 bp, Mus musculus
tcatctcggagaaccaaaggcggac

SEQ ID NO: 769219 - DNA, 25 bp, Mus musculus
tcatctcggagatccaaaggcggac

SEQ ID NO: 769220 - DNA, 25 bp, Mus musculus
tcatctcgtttaacctagtgagaca

SEQ ID NO: 769221 - DNA, 25 bp, Mus musculus
tcatctcgtttatcctagtgagaca

SEQ ID NO: 769222 - DNA, 25 bp, Mus musculus
tcatctctaccaaggctggctagcc

SEQ ID NO: 769223 - DNA, 25 bp, Mus musculus
tcatctctaccaccagatgcgtagg

SEQ ID NO: 769224 - DNA, 25 bp, Mus musculus
tcatctctaccagcagatgcgtagg

SEQ ID NO: 769225 - DNA, 25 bp, Mus musculus
tcatctctaccatggctggctagcc

SEQ ID NO: 769226 - DNA, 25 bp, Mus musculus
tcatctctacgtctacattgagtcc

SEQ ID NO: 769227 - DNA, 25 bp, Mus musculus
tcatctctacgtgtacattgagtcc

SEQ ID NO: 769228 - DNA, 25 bp, Mus musculus
tcatctctcttgcagcatggccatg

SEQ ID NO: 769229 - DNA, 25 bp, Mus musculus
tcatctctcttggagcatggccatg

SEQ ID NO: 769230 - DNA, 25 bp, Mus musculus
tcatctctgccaagagccataacct

SEQ ID NO: 769231 - DNA, 25 bp, Mus musculus
tcatctctgccatgagccataacct

SEQ ID NO: 769232 - DNA, 25 bp, Mus musculus
tcatctctggaacaacaatttggat

SEQ ID NO: 769233 - DNA, 25 bp, Mus musculus
tcatctctggaagaacaatttggat

SEQ ID NO: 769234 - DNA, 25 bp, Mus musculus
tcatctctgggtaccctcagggcta

SEQ ID NO: 769235 - DNA, 25 bp, Mus musculus
tcatctctgggttccctcagggcta

SEQ ID NO: 769236 - DNA, 25 bp, Mus musculus
tcatctctggtgagcttagctacaa

SEQ ID NO: 769237 - DNA, 25 bp, Mus musculus
tcatctctggtgtgcttagctacaa

SEQ ID NO: 769238 - DNA, 25 bp, Mus musculus
tcatctctgtttctctcaaggcgtg

SEQ ID NO: 769239 - DNA, 25 bp, Mus musculus
tcatctctgtttgtctcaaggcgtg

SEQ ID NO: 769240 - DNA, 25 bp, Mus musculus
tcatctcttaggaaattgctggctt

SEQ ID NO: 769241 - DNA, 25 bp, Mus musculus
tcatctcttaggtaattgctggctt

SEQ ID NO: 769242 - DNA, 25 bp, Mus musculus
tcatctgaagaacgctgttgctgag

SEQ ID NO: 769243 - DNA, 25 bp, Mus musculus
tcatctgaagaaggctgttgctgag

SEQ ID NO: 769244 - DNA, 25 bp, Mus musculus
tcatctgactcacacactggtgatg

SEQ ID NO: 769245 - DNA, 25 bp, Mus musculus
tcatctgactcagacactggtgatg

SEQ ID NO: 769246 - DNA, 25 bp, Mus musculus
tcatctgcaattcccaatattccag

SEQ ID NO: 769247 - DNA, 25 bp, Mus musculus
tcatctgcaattgccaatattccag

SEQ ID NO: 769248 - DNA, 25 bp, Mus musculus
tcatctgcacctagtacacgaccgt

SEQ ID NO: 769249 - DNA, 25 bp, Mus musculus
tcatctgcaccttgtacacgaccgt

SEQ ID NO: 769250 - DNA, 25 bp, Mus musculus
tcatctgcacttccttacatgctgc

SEQ ID NO: 769251 - DNA, 25 bp, Mus musculus
tcatctgcacttgcttacatgctgc

SEQ ID NO: 769252 - DNA, 25 bp, Mus musculus
tcatctgcagcaacctgagcacagc

SEQ ID NO: 769253 - DNA, 25 bp, Mus musculus
tcatctgcagcatcctgagcacagc

SEQ ID NO: 769254 - DNA, 25 bp, Mus musculus
tcatctgcagggatactgggtgata

SEQ ID NO: 769255 - DNA, 25 bp, Mus musculus
tcatctgcagggttactgggtgata

SEQ ID NO: 769256 - DNA, 25 bp, Mus musculus
tcatctgcccacattacgaggacga

SEQ ID NO: 769257 - DNA, 25 bp, Mus musculus
tcatctgcccactttacgaggacga

SEQ ID NO: 769258 - DNA, 25 bp, Mus musculus
tcatctgcctttcatagtaaagaaa

SEQ ID NO: 769259 - DNA, 25 bp, Mus musculus
tcatctgcctttgatagtaaagaaa

SEQ ID NO: 769260 - DNA, 25 bp, Mus musculus
tcatctgcgcataggctccgactgg

SEQ ID NO: 769261 - DNA, 25 bp, Mus musculus
tcatctgcgcattggctccgactgg

SEQ ID NO: 769262 - DNA, 25 bp, Mus musculus
tcatctgcggaacggtgcgtgtcct

SEQ ID NO: 769263 - DNA, 25 bp, Mus musculus
tcatctgcggaagggtgcgtgtcct

SEQ ID NO: 769264 - DNA, 25 bp, Mus musculus
tcatctgctacgaggtgtcctccgc

SEQ ID NO: 769265 - DNA, 25 bp, Mus musculus
tcatctgctacgtggtgtcctccgc

SEQ ID NO: 769266 - DNA, 25 bp, Mus musculus
tcatctgctgaacgatgctctcagc

SEQ ID NO: 769267 - DNA, 25 bp, Mus musculus
tcatctgctgaaggatgctctcagc

SEQ ID NO: 769268 - DNA, 25 bp, Mus musculus
tcatctgctggtccgggatgtaaag

SEQ ID NO: 769269 - DNA, 25 bp, Mus musculus
tcatctgctggtgcgggatgtaaag

SEQ ID NO: 769270 - DNA, 25 bp, Mus musculus
tcatctggaccactcggcgggatgt

SEQ ID NO: 769271 - DNA, 25 bp, Mus musculus
tcatctggaccagtcggcgggatgt

SEQ ID NO: 769272 - DNA, 25 bp, Mus musculus
tcatctggacctctggatagacagt

SEQ ID NO: 769273 - DNA, 25 bp, Mus musculus
tcatctggacctgtggatagacagt

SEQ ID NO: 769274 - DNA, 25 bp, Mus musculus
tcatctggcagtcaggagatcctgt

SEQ ID NO: 769275 - DNA, 25 bp, Mus musculus
tcatctggcagtgaggagatcctgt

SEQ ID NO: 769276 - DNA, 25 bp, Mus musculus
tcatctggcggcagaaactaagact

SEQ ID NO: 769277 - DNA, 25 bp, Mus musculus
tcatctggcggctgaaactaagact

SEQ ID NO: 769278 - DNA, 25 bp, Mus musculus
tcatctggctggaaagtcgtctact

SEQ ID NO: 769279 - DNA, 25 bp, Mus musculus
tcatctggctggtaagtcgtctact

SEQ ID NO: 769280 - DNA, 25 bp, Mus musculus
tcatctgggagaacgaggtgccaaa

SEQ ID NO: 769281 - DNA, 25 bp, Mus musculus
tcatctgggagatcgaggtgccaaa

SEQ ID NO: 769282 - DNA, 25 bp, Mus musculus
tcatctggtatgcacaacaagcgaa

SEQ ID NO: 769283 - DNA, 25 bp, Mus musculus
tcatctggtatggacaacaagcgaa

SEQ ID NO: 769284 - DNA, 25 bp, Mus musculus
tcatctggtgagcaatgaggacccc

SEQ ID NO: 769285 - DNA, 25 bp, Mus musculus
tcatctggtgaggaatgaggacccc

SEQ ID NO: 769286 - DNA, 25 bp, Mus musculus
tcatctgtagcaaaactaggatcag

SEQ ID NO: 769287 - DNA, 25 bp, Mus musculus
tcatctgtagcataactaggatcag

SEQ ID NO: 769288 - DNA, 25 bp, Mus musculus
tcatctgtcaaaaatgggagcccat

SEQ ID NO: 769289 - DNA, 25 bp, Mus musculus
tcatctgtcaaatatgggagcccat

SEQ ID NO: 769290 - DNA, 25 bp, Mus musculus
tcatctgtccgcacacaggtgtcac

SEQ ID NO: 769291 - DNA, 25 bp, Mus musculus
tcatctgtccgctcacaggtgtcac

SEQ ID NO: 769292 - DNA, 25 bp, Mus musculus
tcatctgtcggcacttcgcccttta

SEQ ID NO: 769293 - DNA, 25 bp, Mus musculus
tcatctgtcggctcttcgcccttta

SEQ ID NO: 769294 - DNA, 25 bp, Mus musculus
tcatctgtggcaatacttctgtggc

SEQ ID NO: 769295 - DNA, 25 bp, Mus musculus
tcatctgtggcattacttctgtggc

SEQ ID NO: 769296 - DNA, 25 bp, Mus musculus
tcatctgtttgtcctattttaacaa

SEQ ID NO: 769297 - DNA, 25 bp, Mus musculus
tcatctgtttgtgctattttaacaa

SEQ ID NO: 769298 - DNA, 25 bp, Mus musculus
tcatcttagaagctccccacttaga

SEQ ID NO: 769299 - DNA, 25 bp, Mus musculus
tcatcttagaaggtccccacttaga

SEQ ID NO: 769300 - DNA, 25 bp, Mus musculus
tcatcttagaggatagcaggcatct

SEQ ID NO: 769301 - DNA, 25 bp, Mus musculus
tcatcttagaggttagcaggcatct

SEQ ID NO: 769302 - DNA, 25 bp, Mus musculus
tcatcttagcaacgagagggctgcg

SEQ ID NO: 769303 - DNA, 25 bp, Mus musculus
tcatcttagcaaggagagggctgcg

SEQ ID NO: 769304 - DNA, 25 bp, Mus musculus
tcatcttcacaacgtcacgaggaac

SEQ ID NO: 769305 - DNA, 25 bp, Mus musculus
tcatcttcacaaggtcacgaggaac

SEQ ID NO: 769306 - DNA, 25 bp, Mus musculus
tcatcttcagtgagtgccagcccag

SEQ ID NO: 769307 - DNA, 25 bp, Mus musculus
tcatcttcagtgtgtgccagcccag

SEQ ID NO: 769308 - DNA, 25 bp, Mus musculus
tcatcttcatggaaggccgtgggta

SEQ ID NO: 769309 - DNA, 25 bp, Mus musculus
tcatcttcatggtaggccgtgggta

SEQ ID NO: 769310 - DNA, 25 bp, Mus musculus
tcatcttccgtcactggcagaacgc

SEQ ID NO: 769311 - DNA, 25 bp, Mus musculus
tcatcttccgtctctggcagaacgc

SEQ ID NO: 769312 - DNA, 25 bp, Mus musculus
tcatcttcgctcctcgactggacaa

SEQ ID NO: 769313 - DNA, 25 bp, Mus musculus
tcatcttcgctcgtcgactggacaa

SEQ ID NO: 769314 - DNA, 25 bp, Mus musculus
tcatcttcggaacgctggcactcag

SEQ ID NO: 769315 - DNA, 25 bp, Mus musculus
tcatcttcggaaggctggcactcag

SEQ ID NO: 769316 - DNA, 25 bp, Mus musculus
tcatcttcggctaccaagacagctc

SEQ ID NO: 769317 - DNA, 25 bp, Mus musculus
tcatcttcggcttccaagacagctc

SEQ ID NO: 769318 - DNA, 25 bp, Mus musculus
tcatcttctaccagatgggccttgg

SEQ ID NO: 769319 - DNA, 25 bp, Mus musculus
tcatcttctacctgatgggccttgg

SEQ ID NO: 769320 - DNA, 25 bp, Mus musculus
tcatcttctctcactaccaggaagc

SEQ ID NO: 769321 - DNA, 25 bp, Mus musculus
tcatcttctctctctaccaggaagc

SEQ ID NO: 769322 - DNA, 25 bp, Mus musculus
tcatcttctgaacgcaaggaagtct

SEQ ID NO: 769323 - DNA, 25 bp, Mus musculus
tcatcttctgaaggcaaggaagtct

SEQ ID NO: 769324 - DNA, 25 bp, Mus musculus
tcatcttctgcacggcagatactgg

SEQ ID NO: 769325 - DNA, 25 bp, Mus musculus
tcatcttctgcagggcagatactgg

SEQ ID NO: 769326 - DNA, 25 bp, Mus musculus
tcatcttctgctccgagtgccatta

SEQ ID NO: 769327 - DNA, 25 bp, Mus musculus
tcatcttctgctgcgagtgccatta

SEQ ID NO: 769328 - DNA, 25 bp, Mus musculus
tcatcttcttggatgtcagcaggga

SEQ ID NO: 769329 - DNA, 25 bp, Mus musculus
tcatcttcttggttgtcagcaggga

SEQ ID NO: 769330 - DNA, 25 bp, Mus musculus
tcatcttgagctcccatgtaccttg

SEQ ID NO: 769331 - DNA, 25 bp, Mus musculus
tcatcttgagctgccatgtaccttg

SEQ ID NO: 769332 - DNA, 25 bp, Mus musculus
tcatcttgaggtcgccaatatggga

SEQ ID NO: 769333 - DNA, 25 bp, Mus musculus
tcatcttgaggtggccaatatggga

SEQ ID NO: 769334 - DNA, 25 bp, Mus musculus
tcatcttgccgacaaagatcctact

SEQ ID NO: 769335 - DNA, 25 bp, Mus musculus
tcatcttgccgagaaagatcctact

SEQ ID NO: 769336 - DNA, 25 bp, Mus musculus
tcatcttgccggaaattcagaagcc

SEQ ID NO: 769337 - DNA, 25 bp, Mus musculus
tcatcttgccggtaattcagaagcc

SEQ ID NO: 769338 - DNA, 25 bp, Mus musculus
tcatcttgctcacagctggacaagt

SEQ ID NO: 769339 - DNA, 25 bp, Mus musculus
tcatcttgctcagagctggacaagt

SEQ ID NO: 769340 - DNA, 25 bp, Mus musculus
tcatcttggctgaagttccacaggg

SEQ ID NO: 769341 - DNA, 25 bp, Mus musculus
tcatcttggctgtagttccacaggg

SEQ ID NO: 769342 - DNA, 25 bp, Mus musculus
tcatctttaaagaagtacggagtgg

SEQ ID NO: 769343 - DNA, 25 bp, Mus musculus
tcatctttaaagtagtacggagtgg

SEQ ID NO: 769344 - DNA, 25 bp, Mus musculus
tcatctttgaacagggaacttcctg

SEQ ID NO: 769345 - DNA, 25 bp, Mus musculus
tcatctttgaactgggaacttcctg

SEQ ID NO: 769346 - DNA, 25 bp, Mus musculus
tcatctttgcggatactctcacact

SEQ ID NO: 769347 - DNA, 25 bp, Mus musculus
tcatctttgcggttactctcacact

SEQ ID NO: 769348 - DNA, 25 bp, Mus musculus
tcatctttggtgacgagaattctcc

SEQ ID NO: 769349 - DNA, 25 bp, Mus musculus
tcatctttggtgtcgagaattctcc

SEQ ID NO: 769350 - DNA, 25 bp, Mus musculus
tcatctttttcacctctaggaatga

SEQ ID NO: 769351 - DNA, 25 bp, Mus musculus
tcatctttttcagctctaggaatga

SEQ ID NO: 769352 - DNA, 25 bp, Mus musculus
tcatgaaaaaccagtcctgcctcct

SEQ ID NO: 769353 - DNA, 25 bp, Mus musculus
tcatgaaaaacctgtcctgcctcct

SEQ ID NO: 769354 - DNA, 25 bp, Mus musculus
tcatgaaacgcaccaagctaggccc

SEQ ID NO: 769355 - DNA, 25 bp, Mus musculus
tcatgaaacgcagcaagctaggccc

SEQ ID NO: 769356 - DNA, 25 bp, Mus musculus
tcatgaaagggaatccatctgccgc

SEQ ID NO: 769357 - DNA, 25 bp, Mus musculus
tcatgaaagggattccatctgccgc

SEQ ID NO: 769358 - DNA, 25 bp, Mus musculus
tcatgaaagtccactctttgatttc

SEQ ID NO: 769359 - DNA, 25 bp, Mus musculus
tcatgaaagtcctctctttgatttc

SEQ ID NO: 769360 - DNA, 25 bp, Mus musculus
tcatgaaagtgaacttcttaaggca

SEQ ID NO: 769361 - DNA, 25 bp, Mus musculus
tcatgaaagtgatcttcttaaggca

SEQ ID NO: 769362 - DNA, 25 bp, Mus musculus
tcatgaacacatcagctagcaacag

SEQ ID NO: 769363 - DNA, 25 bp, Mus musculus
tcatgaacacatgagctagcaacag

SEQ ID NO: 769364 - DNA, 25 bp, Mus musculus
tcatgaacacccagccacaattttt

SEQ ID NO: 769365 - DNA, 25 bp, Mus musculus
tcatgaacaccctgccacaattttt

SEQ ID NO: 769366 - DNA, 25 bp, Mus musculus
tcatgaaccacaatgcagtagcggt

SEQ ID NO: 769367 - DNA, 25 bp, Mus musculus
tcatgaaccacattgcagtagcggt

SEQ ID NO: 769368 - DNA, 25 bp, Mus musculus
tcatgaaccctcacatccgtgtagg

SEQ ID NO: 769369 - DNA, 25 bp, Mus musculus
tcatgaaccctctcatccgtgtagg

SEQ ID NO: 769370 - DNA, 25 bp, Mus musculus
tcatgaaccggacaacctgcaatct

SEQ ID NO: 769371 - DNA, 25 bp, Mus musculus
tcatgaaccggagaacctgcaatct

SEQ ID NO: 769372 - DNA, 25 bp, Mus musculus
tcatgaacgagcatcgcctgagcca

SEQ ID NO: 769373 - DNA, 25 bp, Mus musculus
tcatgaacgagcttcgcctgagcca

SEQ ID NO: 769374 - DNA, 25 bp, Mus musculus
tcatgaacggcaaggacgagatgca

SEQ ID NO: 769375 - DNA, 25 bp, Mus musculus
tcatgaacggcatggacgagatgca

SEQ ID NO: 769376 - DNA, 25 bp, Mus musculus
tcatgaactcttcggacatgtgccc

SEQ ID NO: 769377 - DNA, 25 bp, Mus musculus
tcatgaactcttgggacatgtgccc

SEQ ID NO: 769378 - DNA, 25 bp, Mus musculus
tcatgaagaataacacagccaaacg

SEQ ID NO: 769379 - DNA, 25 bp, Mus musculus
tcatgaagaatatcacagccaaacg

SEQ ID NO: 769380 - DNA, 25 bp, Mus musculus
tcatgaagacctatatgacccctgg

SEQ ID NO: 769381 - DNA, 25 bp, Mus musculus
tcatgaagacctttatgacccctgg

SEQ ID NO: 769382 - DNA, 25 bp, Mus musculus
tcatgaagagctctcccgaggtgtc

SEQ ID NO: 769383 - DNA, 25 bp, Mus musculus
tcatgaagagctgtcccgaggtgtc

SEQ ID NO: 769384 - DNA, 25 bp, Mus musculus
tcatgaagatcgaaactcctgcgcc

SEQ ID NO: 769385 - DNA, 25 bp, Mus musculus
tcatgaagatcgtaactcctgcgcc

SEQ ID NO: 769386 - DNA, 25 bp, Mus musculus
tcatgaagcagacagggtacctgac

SEQ ID NO: 769387 - DNA, 25 bp, Mus musculus
tcatgaagcagagagggtacctgac

SEQ ID NO: 769388 - DNA, 25 bp, Mus musculus
tcatgaagcctgaatggaagctaca

SEQ ID NO: 769389 - DNA, 25 bp, Mus musculus
tcatgaagcctgtatggaagctaca

SEQ ID NO: 769390 - DNA, 25 bp, Mus musculus
tcatgaagcttgagcgtcctttctg

SEQ ID NO: 769391 - DNA, 25 bp, Mus musculus
tcatgaagcttgtgcgtcctttctg

SEQ ID NO: 769392 - DNA, 25 bp, Mus musculus
tcatgaaggacacgtggatcaatgc

SEQ ID NO: 769393 - DNA, 25 bp, Mus musculus
tcatgaaggacaggtggatcaatgc

SEQ ID NO: 769394 - DNA, 25 bp, Mus musculus
tcatgaaggagcattgcgcaaacgt

SEQ ID NO: 769395 - DNA, 25 bp, Mus musculus
tcatgaaggagctttgcgcaaacgt

SEQ ID NO: 769396 - DNA, 25 bp, Mus musculus
tcatgaaggtcacggtgaagacgcc

SEQ ID NO: 769397 - DNA, 25 bp, Mus musculus
tcatgaaggtcagggtgaagacgcc

SEQ ID NO: 769398 - DNA, 25 bp, Mus musculus
tcatgaagtgggagaaccggcacga

SEQ ID NO: 769399 - DNA, 25 bp, Mus musculus
tcatgaagtgggtgaaccggcacga

SEQ ID NO: 769400 - DNA, 25 bp, Mus musculus
tcatgaatgacactaccaacgtggc

SEQ ID NO: 769401 - DNA, 25 bp, Mus musculus
tcatgaatgacagtaccaacgtggc

SEQ ID NO: 769402 - DNA, 25 bp, Mus musculus
tcatgaatgcttcagctgatgaaat

SEQ ID NO: 769403 - DNA, 25 bp, Mus musculus
tcatgaatgcttgagctgatgaaat

SEQ ID NO: 769404 - DNA, 25 bp, Mus musculus
tcatgaatggcaaagatgtcgtggc

SEQ ID NO: 769405 - DNA, 25 bp, Mus musculus
tcatgaatggcaacaaggccagtga

SEQ ID NO: 769406 - DNA, 25 bp, Mus musculus
tcatgaatggcatagatgtcgtggc

SEQ ID NO: 769407 - DNA, 25 bp, Mus musculus
tcatgaatggcatcaaggccagtga

SEQ ID NO: 769408 - DNA, 25 bp, Mus musculus
tcatgaatgggtctcaggatagccc

SEQ ID NO: 769409 - DNA, 25 bp, Mus musculus
tcatgaatgggtgtcaggatagccc

SEQ ID NO: 769410 - DNA, 25 bp, Mus musculus
tcatgaatgtagacatgaatgcagc

SEQ ID NO: 769411 - DNA, 25 bp, Mus musculus
tcatgaatgtagtcatgaatgcagc

SEQ ID NO: 769412 - DNA, 25 bp, Mus musculus
tcatgaatttgaaaacggtgtggaa

SEQ ID NO: 769413 - DNA, 25 bp, Mus musculus
tcatgaatttgataacggtgtggaa

SEQ ID NO: 769414 - DNA, 25 bp, Mus musculus
tcatgacaatgaacagccgcaggga

SEQ ID NO: 769415 - DNA, 25 bp, Mus musculus
tcatgacaatgatcagccgcaggga

SEQ ID NO: 769416 - DNA, 25 bp, Mus musculus
tcatgacagagaaaagatacagcgg

SEQ ID NO: 769417 - DNA, 25 bp, Mus musculus
tcatgacagagataagatacagcgg

SEQ ID NO: 769418 - DNA, 25 bp, Mus musculus
tcatgacagatcaatactacctcag

SEQ ID NO: 769419 - DNA, 25 bp, Mus musculus
tcatgacagatctatactacctcag

SEQ ID NO: 769420 - DNA, 25 bp, Mus musculus
tcatgacagtaccttctactgccta

SEQ ID NO: 769421 - DNA, 25 bp, Mus musculus
tcatgacagtacgttctactgccta

SEQ ID NO: 769422 - DNA, 25 bp, Mus musculus
tcatgacagtcgagtacttcggtcc

SEQ ID NO: 769423 - DNA, 25 bp, Mus musculus
tcatgacagtcgtgtacttcggtcc

SEQ ID NO: 769424 - DNA, 25 bp, Mus musculus
tcatgaccaaaaccgtgccttgtgg

SEQ ID NO: 769425 - DNA, 25 bp, Mus musculus
tcatgaccaaaagcgtgccttgtgg

SEQ ID NO: 769426 - DNA, 25 bp, Mus musculus
tcatgaccccagagcccaagtgttt

SEQ ID NO: 769427 - DNA, 25 bp, Mus musculus
tcatgaccccagtgcccaagtgttt

SEQ ID NO: 769428 - DNA, 25 bp, Mus musculus
tcatgacccgccacgggaggctctg

SEQ ID NO: 769429 - DNA, 25 bp, Mus musculus
tcatgacccgcctcgggaggctctg

SEQ ID NO: 769430 - DNA, 25 bp, Mus musculus
tcatgacccttgcacagcaggacgt

SEQ ID NO: 769431 - DNA, 25 bp, Mus musculus
tcatgacccttggacagcaggacgt

SEQ ID NO: 769432 - DNA, 25 bp, Mus musculus
tcatgacctcagcatggatggcctg

SEQ ID NO: 769433 - DNA, 25 bp, Mus musculus
tcatgacctcaggatggatggcctg

SEQ ID NO: 769434 - DNA, 25 bp, Mus musculus
tcatgacctctcagacagtccatac

SEQ ID NO: 769435 - DNA, 25 bp, Mus musculus
tcatgacctctctgacagtccatac

SEQ ID NO: 769436 - DNA, 25 bp, Mus musculus
tcatgacctggacctactgagaaag

SEQ ID NO: 769437 - DNA, 25 bp, Mus musculus
tcatgacctggagctactgagaaag

SEQ ID NO: 769438 - DNA, 25 bp, Mus musculus
tcatgacgaacaatttctatgcagc

SEQ ID NO: 769439 - DNA, 25 bp, Mus musculus
tcatgacgaacattttctatgcagc

SEQ ID NO: 769440 - DNA, 25 bp, Mus musculus
tcatgacgatttcgctgttactaaa

SEQ ID NO: 769441 - DNA, 25 bp, Mus musculus
tcatgacgatttggctgttactaaa

SEQ ID NO: 769442 - DNA, 25 bp, Mus musculus
tcatgacgctggctctcagtgagaa

SEQ ID NO: 769443 - DNA, 25 bp, Mus musculus
tcatgacgctgggtctcagtgagaa

SEQ ID NO: 769444 - DNA, 25 bp, Mus musculus
tcatgacgggaaaaccaagcactct

SEQ ID NO: 769445 - DNA, 25 bp, Mus musculus
tcatgacgggaataccaagcactct

SEQ ID NO: 769446 - DNA, 25 bp, Mus musculus
tcatgacgtgcaccgatgacttccg

SEQ ID NO: 769447 - DNA, 25 bp, Mus musculus
tcatgacgtgcagcgatgacttccg

SEQ ID NO: 769448 - DNA, 25 bp, Mus musculus
tcatgactccgtcatgtggaccctg

SEQ ID NO: 769449 - DNA, 25 bp, Mus musculus
tcatgactccgtgatgtggaccctg

SEQ ID NO: 769450 - DNA, 25 bp, Mus musculus
tcatgactccttagggcaacagctg

SEQ ID NO: 769451 - DNA, 25 bp, Mus musculus
tcatgactcctttgggcaacagctg

SEQ ID NO: 769452 - DNA, 25 bp, Mus musculus
tcatgactctggatctttcagcaaa

SEQ ID NO: 769453 - DNA, 25 bp, Mus musculus
tcatgactctggttctttcagcaaa

SEQ ID NO: 769454 - DNA, 25 bp, Mus musculus
tcatgactgacaacgggctccggga

SEQ ID NO: 769455 - DNA, 25 bp, Mus musculus
tcatgactgacatcgggctccggga

SEQ ID NO: 769456 - DNA, 25 bp, Mus musculus
tcatgactgagaacggaaaccgcct

SEQ ID NO: 769457 - DNA, 25 bp, Mus musculus
tcatgactgagatcggaaaccgcct

SEQ ID NO: 769458 - DNA, 25 bp, Mus musculus
tcatgactgtgaccctgagcctctg

SEQ ID NO: 769459 - DNA, 25 bp, Mus musculus
tcatgactgtgagcctgagcctctg

SEQ ID NO: 769460 - DNA, 25 bp, Mus musculus
tcatgacttacaacgtggagccgct

SEQ ID NO: 769461 - DNA, 25 bp, Mus musculus
tcatgacttacatcgtggagccgct

SEQ ID NO: 769462 - DNA, 25 bp, Mus musculus
tcatgacttccaatgtagccagtga

SEQ ID NO: 769463 - DNA, 25 bp, Mus musculus
tcatgacttccattgtagccagtga

SEQ ID NO: 769464 - DNA, 25 bp, Mus musculus
tcatgagaataacagagccacggac

SEQ ID NO: 769465 - DNA, 25 bp, Mus musculus
tcatgagaataagagagccacggac

SEQ ID NO: 769466 - DNA, 25 bp, Mus musculus
tcatgagacctgatgggccaagtcc

SEQ ID NO: 769467 - DNA, 25 bp, Mus musculus
tcatgagacctgttgggccaagtcc

SEQ ID NO: 769468 - DNA, 25 bp, Mus musculus
tcatgagacgcaatagtgtcacccc

SEQ ID NO: 769469 - DNA, 25 bp, Mus musculus
tcatgagacgcattagtgtcacccc

SEQ ID NO: 769470 - DNA, 25 bp, Mus musculus
tcatgagatgcgctgtttgcctagg

SEQ ID NO: 769471 - DNA, 25 bp, Mus musculus
tcatgagatgcggtgtttgcctagg

SEQ ID NO: 769472 - DNA, 25 bp, Mus musculus
tcatgagcaaataggctggtgagtc

SEQ ID NO: 769473 - DNA, 25 bp, Mus musculus
tcatgagcaaattggctggtgagtc

SEQ ID NO: 769474 - DNA, 25 bp, Mus musculus
tcatgagcagccaccaggagggacg

SEQ ID NO: 769475 - DNA, 25 bp, Mus musculus
tcatgagcagcctccaggagggacg

SEQ ID NO: 769476 - DNA, 25 bp, Mus musculus
tcatgagcccgcactgccacaggtt

SEQ ID NO: 769477 - DNA, 25 bp, Mus musculus
tcatgagcccgctctgccacaggtt

SEQ ID NO: 769478 - DNA, 25 bp, Mus musculus
tcatgagccctcattttgaagaaat

SEQ ID NO: 769479 - DNA, 25 bp, Mus musculus
tcatgagccctctttttgaagaaat

SEQ ID NO: 769480 - DNA, 25 bp, Mus musculus
tcatgagccggcagaacgtgggcta

SEQ ID NO: 769481 - DNA, 25 bp, Mus musculus
tcatgagccggctgaacgtgggcta

SEQ ID NO: 769482 - DNA, 25 bp, Mus musculus
tcatgagccgtcagaaggtgcagct

SEQ ID NO: 769483 - DNA, 25 bp, Mus musculus
tcatgagccgtctgaaggtgcagct

SEQ ID NO: 769484 - DNA, 25 bp, Mus musculus
tcatgagccgttacctgaggagccc

SEQ ID NO: 769485 - DNA, 25 bp, Mus musculus
tcatgagccgtttcctgaggagccc

SEQ ID NO: 769486 - DNA, 25 bp, Mus musculus
tcatgagcctccagggcccctctgt

SEQ ID NO: 769487 - DNA, 25 bp, Mus musculus
tcatgagcctcctgggcccctctgt

SEQ ID NO: 769488 - DNA, 25 bp, Mus musculus
tcatgagcggaactgtgagcccatt

SEQ ID NO: 769489 - DNA, 25 bp, Mus musculus
tcatgagcggaagtgtgagcccatt

SEQ ID NO: 769490 - DNA, 25 bp, Mus musculus
tcatgagcttgtatggcgggaagcc

SEQ ID NO: 769491 - DNA, 25 bp, Mus musculus
tcatgagcttgtttggcgggaagcc

SEQ ID NO: 769492 - DNA, 25 bp, Mus musculus
tcatgaggcagtccaagggtgacct

SEQ ID NO: 769493 - DNA, 25 bp, Mus musculus
tcatgaggcagtgcaagggtgacct

SEQ ID NO: 769494 - DNA, 25 bp, Mus musculus
tcatgagggagacgaccaggtctct

SEQ ID NO: 769495 - DNA, 25 bp, Mus musculus
tcatgagggagaggaccaggtctct

SEQ ID NO: 769496 - DNA, 25 bp, Mus musculus
tcatgagggagcatgatgtcagcta

SEQ ID NO: 769497 - DNA, 25 bp, Mus musculus
tcatgagggagcttgatgtcagcta

SEQ ID NO: 769498 - DNA, 25 bp, Mus musculus
tcatgagggctaagctggacgcaca

SEQ ID NO: 769499 - DNA, 25 bp, Mus musculus
tcatgagggctatgctggacgcaca

SEQ ID NO: 769500 - DNA, 25 bp, Mus musculus
tcatgagggtaacgccaagcaggct

SEQ ID NO: 769501 - DNA, 25 bp, Mus musculus
tcatgagggtaaggccaagcaggct

SEQ ID NO: 769502 - DNA, 25 bp, Mus musculus
tcatgagggtgcaatcactcacacc

SEQ ID NO: 769503 - DNA, 25 bp, Mus musculus
tcatgagggtgcaggactcctacgg

SEQ ID NO: 769504 - DNA, 25 bp, Mus musculus
tcatgagggtgctatcactcacacc

SEQ ID NO: 769505 - DNA, 25 bp, Mus musculus
tcatgagggtgctggactcctacgg

SEQ ID NO: 769506 - DNA, 25 bp, Mus musculus
tcatgagtccgaaggcaatgtacca

SEQ ID NO: 769507 - DNA, 25 bp, Mus musculus
tcatgagtccgatggcaatgtacca

SEQ ID NO: 769508 - DNA, 25 bp, Mus musculus
tcatgagtggaacccatgctgctgg

SEQ ID NO: 769509 - DNA, 25 bp, Mus musculus
tcatgagtggaagccatgctgctgg

SEQ ID NO: 769510 - DNA, 25 bp, Mus musculus
tcatgatcagtgcagacatggccca

SEQ ID NO: 769511 - DNA, 25 bp, Mus musculus
tcatgatcagtggagacatggccca

SEQ ID NO: 769512 - DNA, 25 bp, Mus musculus
tcatgatccaccagccctctggagg

SEQ ID NO: 769513 - DNA, 25 bp, Mus musculus
tcatgatccacctgccctctggagg

SEQ ID NO: 769514 - DNA, 25 bp, Mus musculus
tcatgatcctctagccttcgttcca

SEQ ID NO: 769515 - DNA, 25 bp, Mus musculus
tcatgatcctcttgccttcgttcca

SEQ ID NO: 769516 - DNA, 25 bp, Mus musculus
tcatgatcctgaaatgtgccatggc

SEQ ID NO: 769517 - DNA, 25 bp, Mus musculus
tcatgatcctgatatgtgccatggc

SEQ ID NO: 769518 - DNA, 25 bp, Mus musculus
tcatgatctcaacgacaggaggtcc

SEQ ID NO: 769519 - DNA, 25 bp, Mus musculus
tcatgatctcaaggacaggaggtcc

SEQ ID NO: 769520 - DNA, 25 bp, Mus musculus
tcatgatctcccagagccccatggt

SEQ ID NO: 769521 - DNA, 25 bp, Mus musculus
tcatgatctccctgagccccatggt

SEQ ID NO: 769522 - DNA, 25 bp, Mus musculus
tcatgatgaatgagactgcacaaca

SEQ ID NO: 769523 - DNA, 25 bp, Mus musculus
tcatgatgaatgatgaggaggcttc

SEQ ID NO: 769524 - DNA, 25 bp, Mus musculus
tcatgatgaatgtgactgcacaaca

SEQ ID NO: 769525 - DNA, 25 bp, Mus musculus
tcatgatgaatgttgaggaggcttc

SEQ ID NO: 769526 - DNA, 25 bp, Mus musculus
tcatgatgacgcatggactaaggca

SEQ ID NO: 769527 - DNA, 25 bp, Mus musculus
tcatgatgacgcttggactaaggca

SEQ ID NO: 769528 - DNA, 25 bp, Mus musculus
tcatgatgccttactacaagcttca

SEQ ID NO: 769529 - DNA, 25 bp, Mus musculus
tcatgatgcctttctacaagcttca

SEQ ID NO: 769530 - DNA, 25 bp, Mus musculus
tcatgatggacaaccattatgccaa

SEQ ID NO: 769531 - DNA, 25 bp, Mus musculus
tcatgatggacatccattatgccaa

SEQ ID NO: 769532 - DNA, 25 bp, Mus musculus
tcatgatggaggaccagaaacgcca

SEQ ID NO: 769533 - DNA, 25 bp, Mus musculus
tcatgatggaggtccagaaacgcca

SEQ ID NO: 769534 - DNA, 25 bp, Mus musculus
tcatgatggatccatatgtagctca

SEQ ID NO: 769535 - DNA, 25 bp, Mus musculus
tcatgatggatcgatatgtagctca

SEQ ID NO: 769536 - DNA, 25 bp, Mus musculus
tcatgatggcatacagcgggtgctg

SEQ ID NO: 769537 - DNA, 25 bp, Mus musculus
tcatgatggcattcagcgggtgctg

SEQ ID NO: 769538 - DNA, 25 bp, Mus musculus
tcatgattgagcaggacgggaccga

SEQ ID NO: 769539 - DNA, 25 bp, Mus musculus
tcatgattgagctggacgggaccga

SEQ ID NO: 769540 - DNA, 25 bp, Mus musculus
tcatgattgatacctcccgcagcgt

SEQ ID NO: 769541 - DNA, 25 bp, Mus musculus
tcatgattgatagctcccgcagcgt

SEQ ID NO: 769542 - DNA, 25 bp, Mus musculus
tcatgattgcttatggcacccagcg

SEQ ID NO: 769543 - DNA, 25 bp, Mus musculus
tcatgattgcttttggcacccagcg

SEQ ID NO: 769544 - DNA, 25 bp, Mus musculus
tcatgattgtgacgagggccatcaa

SEQ ID NO: 769545 - DNA, 25 bp, Mus musculus
tcatgattgtgaggagggccatcaa

SEQ ID NO: 769546 - DNA, 25 bp, Mus musculus
tcatgcaactgaaggctgaagttca

SEQ ID NO: 769547 - DNA, 25 bp, Mus musculus
tcatgcaactgatggctgaagttca

SEQ ID NO: 769548 - DNA, 25 bp, Mus musculus
tcatgcaagattcaggcccttaggg

SEQ ID NO: 769549 - DNA, 25 bp, Mus musculus
tcatgcaagattgaggcccttaggg

SEQ ID NO: 769550 - DNA, 25 bp, Mus musculus
tcatgcacaacccaaacttcacagt

SEQ ID NO: 769551 - DNA, 25 bp, Mus musculus
tcatgcacaaccgaaacttcacagt

SEQ ID NO: 769552 - DNA, 25 bp, Mus musculus
tcatgcacttccagcggcagaagct

SEQ ID NO: 769553 - DNA, 25 bp, Mus musculus
tcatgcacttcctgcggcagaagct

SEQ ID NO: 769554 - DNA, 25 bp, Mus musculus
tcatgcacttctcaagcagagagag

SEQ ID NO: 769555 - DNA, 25 bp, Mus musculus
tcatgcacttctgaagcagagagag

SEQ ID NO: 769556 - DNA, 25 bp, Mus musculus
tcatgcagaagacacggagtgtgcc

SEQ ID NO: 769557 - DNA, 25 bp, Mus musculus
tcatgcagaagagacggagtgtgcc

SEQ ID NO: 769558 - DNA, 25 bp, Mus musculus
tcatgcagacggcttacaacaagct

SEQ ID NO: 769559 - DNA, 25 bp, Mus musculus
tcatgcagacgggttacaacaagct

SEQ ID NO: 769560 - DNA, 25 bp, Mus musculus
tcatgcagcccaaggatagccatcc

SEQ ID NO: 769561 - DNA, 25 bp, Mus musculus
tcatgcagcccatggatagccatcc

SEQ ID NO: 769562 - DNA, 25 bp, Mus musculus
tcatgcagctctaccaggaccatgg

SEQ ID NO: 769563 - DNA, 25 bp, Mus musculus
tcatgcagctcttccaggaccatgg

SEQ ID NO: 769564 - DNA, 25 bp, Mus musculus
tcatgcagctggagtaggcctgctt

SEQ ID NO: 769565 - DNA, 25 bp, Mus musculus
tcatgcagctggtgtaggcctgctt

SEQ ID NO: 769566 - DNA, 25 bp, Mus musculus
tcatgcaggataaactggagaagga

SEQ ID NO: 769567 - DNA, 25 bp, Mus musculus
tcatgcaggatatactggagaagga

SEQ ID NO: 769568 - DNA, 25 bp, Mus musculus
tcatgcagtccaaggcactgactgc

SEQ ID NO: 769569 - DNA, 25 bp, Mus musculus
tcatgcagtccatggcactgactgc

SEQ ID NO: 769570 - DNA, 25 bp, Mus musculus
tcatgcagttgccagactcaggact

SEQ ID NO: 769571 - DNA, 25 bp, Mus musculus
tcatgcagttgcgagactcaggact

SEQ ID NO: 769572 - DNA, 25 bp, Mus musculus
tcatgcatgatgagcgactgagcag

SEQ ID NO: 769573 - DNA, 25 bp, Mus musculus
tcatgcatgatgtgcgactgagcag

SEQ ID NO: 769574 - DNA, 25 bp, Mus musculus
tcatgcatgctgacaaggaagtgtt

SEQ ID NO: 769575 - DNA, 25 bp, Mus musculus
tcatgcatgctgtcaaggaagtgtt

SEQ ID NO: 769576 - DNA, 25 bp, Mus musculus
tcatgcattataatgaggagacgct

SEQ ID NO: 769577 - DNA, 25 bp, Mus musculus
tcatgcattatattgaggagacgct

SEQ ID NO: 769578 - DNA, 25 bp, Mus musculus
tcatgccacagacaccgatgagtgc

SEQ ID NO: 769579 - DNA, 25 bp, Mus musculus
tcatgccacagagaccgatgagtgc

SEQ ID NO: 769580 - DNA, 25 bp, Mus musculus
tcatgccacggtatttctggacagc

SEQ ID NO: 769581 - DNA, 25 bp, Mus musculus
tcatgccacggtttttctggacagc

SEQ ID NO: 769582 - DNA, 25 bp, Mus musculus
tcatgccactcaaatcacgaggacc

SEQ ID NO: 769583 - DNA, 25 bp, Mus musculus
tcatgccactcatatcacgaggacc

SEQ ID NO: 769584 - DNA, 25 bp, Mus musculus
tcatgccagctgctaagctcaagga

SEQ ID NO: 769585 - DNA, 25 bp, Mus musculus
tcatgccagctggtaagctcaagga

SEQ ID NO: 769586 - DNA, 25 bp, Mus musculus
tcatgccagtgtagaagccttggtc

SEQ ID NO: 769587 - DNA, 25 bp, Mus musculus
tcatgccagtgttgaagccttggtc

SEQ ID NO: 769588 - DNA, 25 bp, Mus musculus
tcatgccattcacggacagtatgtg

SEQ ID NO: 769589 - DNA, 25 bp, Mus musculus
tcatgccattcagggacagtatgtg

SEQ ID NO: 769590 - DNA, 25 bp, Mus musculus
tcatgccccgacagagtgaggaggc

SEQ ID NO: 769591 - DNA, 25 bp, Mus musculus
tcatgccccgactgagtgaggaggc

SEQ ID NO: 769592 - DNA, 25 bp, Mus musculus
tcatgcccgggcactgatgcaagca

SEQ ID NO: 769593 - DNA, 25 bp, Mus musculus
tcatgcccgggctctgatgcaagca

SEQ ID NO: 769594 - DNA, 25 bp, Mus musculus
tcatgccctttgacacagaggagct

SEQ ID NO: 769595 - DNA, 25 bp, Mus musculus
tcatgccctttgtcacagaggagct

SEQ ID NO: 769596 - DNA, 25 bp, Mus musculus
tcatgccgctgcagttaatggagat

SEQ ID NO: 769597 - DNA, 25 bp, Mus musculus
tcatgccgctgctgttaatggagat

SEQ ID NO: 769598 - DNA, 25 bp, Mus musculus
tcatgccgggagaatgctacgggcc

SEQ ID NO: 769599 - DNA, 25 bp, Mus musculus
tcatgccgggagtatgctacgggcc

SEQ ID NO: 769600 - DNA, 25 bp, Mus musculus
tcatgccgtggaatgagtccagcat

SEQ ID NO: 769601 - DNA, 25 bp, Mus musculus
tcatgccgtggattgagtccagcat

SEQ ID NO: 769602 - DNA, 25 bp, Mus musculus
tcatgcctatgcctcaggctgcaca

SEQ ID NO: 769603 - DNA, 25 bp, Mus musculus
tcatgcctatgcgtcaggctgcaca

SEQ ID NO: 769604 - DNA, 25 bp, Mus musculus
tcatgcctccatcctacattgaaca

SEQ ID NO: 769605 - DNA, 25 bp, Mus musculus
tcatgcctccatgctacattgaaca

SEQ ID NO: 769606 - DNA, 25 bp, Mus musculus
tcatgcctctgaacatgtgccccag

SEQ ID NO: 769607 - DNA, 25 bp, Mus musculus
tcatgcctctgatcatgtgccccag

SEQ ID NO: 769608 - DNA, 25 bp, Mus musculus
tcatgcctgacaagtgcaagtgtgt

SEQ ID NO: 769609 - DNA, 25 bp, Mus musculus
tcatgcctgacatgtgcaagtgtgt

SEQ ID NO: 769610 - DNA, 25 bp, Mus musculus
tcatgcctgctgatgagaactgtcc

SEQ ID NO: 769611 - DNA, 25 bp, Mus musculus
tcatgcctgctgttgagaactgtcc

SEQ ID NO: 769612 - DNA, 25 bp, Mus musculus
tcatgcctggacaatttcacgaccc

SEQ ID NO: 769613 - DNA, 25 bp, Mus musculus
tcatgcctggactatttcacgaccc

SEQ ID NO: 769614 - DNA, 25 bp, Mus musculus
tcatgcctgtcactcctcaagcaag

SEQ ID NO: 769615 - DNA, 25 bp, Mus musculus
tcatgcctgtcagtcctcaagcaag

SEQ ID NO: 769616 - DNA, 25 bp, Mus musculus
tcatgcctgtccctgattaatggaa

SEQ ID NO: 769617 - DNA, 25 bp, Mus musculus
tcatgcctgtccgtgattaatggaa

SEQ ID NO: 769618 - DNA, 25 bp, Mus musculus
tcatgcctttttcgtcgacctggaa

SEQ ID NO: 769619 - DNA, 25 bp, Mus musculus
tcatgcctttttggtcgacctggaa

SEQ ID NO: 769620 - DNA, 25 bp, Mus musculus
tcatgcgaaagcaccaaggccttgg

SEQ ID NO: 769621 - DNA, 25 bp, Mus musculus
tcatgcgaaagctccaaggccttgg

SEQ ID NO: 769622 - DNA, 25 bp, Mus musculus
tcatgcgagggtcccaacccggagc

SEQ ID NO: 769623 - DNA, 25 bp, Mus musculus
tcatgcgagggtgccaacccggagc

SEQ ID NO: 769624 - DNA, 25 bp, Mus musculus
tcatgcgcactcatccgctcatgta

SEQ ID NO: 769625 - DNA, 25 bp, Mus musculus
tcatgcgcactcttccgctcatgta

SEQ ID NO: 769626 - DNA, 25 bp, Mus musculus
tcatgcgccattactgcctgtgctg

SEQ ID NO: 769627 - DNA, 25 bp, Mus musculus
tcatgcgccatttctgcctgtgctg

SEQ ID NO: 769628 - DNA, 25 bp, Mus musculus
tcatgcggaaccacaatgacctgaa

SEQ ID NO: 769629 - DNA, 25 bp, Mus musculus
tcatgcggaacctcaatgacctgaa

SEQ ID NO: 769630 - DNA, 25 bp, Mus musculus
tcatgcggattaatcttccacaagc

SEQ ID NO: 769631 - DNA, 25 bp, Mus musculus
tcatgcggattattcttccacaagc

SEQ ID NO: 769632 - DNA, 25 bp, Mus musculus
tcatgcggcaggcaaagggccaact

SEQ ID NO: 769633 - DNA, 25 bp, Mus musculus
tcatgcggcagggaaagggccaact

SEQ ID NO: 769634 - DNA, 25 bp, Mus musculus
tcatgcgggcacctatgaggtcaga

SEQ ID NO: 769635 - DNA, 25 bp, Mus musculus
tcatgcgggcacgtatgaggtcaga

SEQ ID NO: 769636 - DNA, 25 bp, Mus musculus
tcatgcgtgagcagatgcaggagca

SEQ ID NO: 769637 - DNA, 25 bp, Mus musculus
tcatgcgtgagctgatgcaggagca

SEQ ID NO: 769638 - DNA, 25 bp, Mus musculus
tcatgctaaagaatgactgctttcc

SEQ ID NO: 769639 - DNA, 25 bp, Mus musculus
tcatgctaaagattgactgctttcc

SEQ ID NO: 769640 - DNA, 25 bp, Mus musculus
tcatgctaacctatgggaagtttga

SEQ ID NO: 769641 - DNA, 25 bp, Mus musculus
tcatgctaacctttgggaagtttga

SEQ ID NO: 769642 - DNA, 25 bp, Mus musculus
tcatgctagaccctcaggatgaggc

SEQ ID NO: 769643 - DNA, 25 bp, Mus musculus
tcatgctagaccgtcaggatgaggc

SEQ ID NO: 769644 - DNA, 25 bp, Mus musculus
tcatgctattgtcggacttatggcc

SEQ ID NO: 769645 - DNA, 25 bp, Mus musculus
tcatgctattgtgggacttatggcc

SEQ ID NO: 769646 - DNA, 25 bp, Mus musculus
tcatgctcagccagtggcagggtca

SEQ ID NO: 769647 - DNA, 25 bp, Mus musculus
tcatgctcagcctgtggcagggtca

SEQ ID NO: 769648 - DNA, 25 bp, Mus musculus
tcatgctgaagacttggcctccaag

SEQ ID NO: 769649 - DNA, 25 bp, Mus musculus
tcatgctgaagagttggcctccaag

SEQ ID NO: 769650 - DNA, 25 bp, Mus musculus
tcatgctgccctcggacccaagtgg

SEQ ID NO: 769651 - DNA, 25 bp, Mus musculus
tcatgctgccctgggacccaagtgg

SEQ ID NO: 769652 - DNA, 25 bp, Mus musculus
tcatgctggccaataatgagaccgg

SEQ ID NO: 769653 - DNA, 25 bp, Mus musculus
tcatgctggccattaatgagaccgg

SEQ ID NO: 769654 - DNA, 25 bp, Mus musculus
tcatgctggcctacggcagccttgc

SEQ ID NO: 769655 - DNA, 25 bp, Mus musculus
tcatgctggccttcggcagccttgc

SEQ ID NO: 769656 - DNA, 25 bp, Mus musculus
tcatgctgggagctatctgtgccat

SEQ ID NO: 769657 - DNA, 25 bp, Mus musculus
tcatgctgggaggtatctgtgccat

SEQ ID NO: 769658 - DNA, 25 bp, Mus musculus
tcatgctggtggctctacgcagaat

SEQ ID NO: 769659 - DNA, 25 bp, Mus musculus
tcatgctggtgggtctacgcagaat

SEQ ID NO: 769660 - DNA, 25 bp, Mus musculus
tcatgcttcctcaaacagcagcgtt

SEQ ID NO: 769661 - DNA, 25 bp, Mus musculus
tcatgcttcctctaacagcagcgtt

SEQ ID NO: 769662 - DNA, 25 bp, Mus musculus
tcatgcttgagtaggacagagaagc

SEQ ID NO: 769663 - DNA, 25 bp, Mus musculus
tcatgcttgagttggacagagaagc

SEQ ID NO: 769664 - DNA, 25 bp, Mus musculus
tcatgcttgcttctggcttcccagt

SEQ ID NO: 769665 - DNA, 25 bp, Mus musculus
tcatgcttgcttgtggcttcccagt

SEQ ID NO: 769666 - DNA, 25 bp, Mus musculus
tcatgcttggacaactggctgcagc

SEQ ID NO: 769667 - DNA, 25 bp, Mus musculus
tcatgcttggactactggctgcagc

SEQ ID NO: 769668 - DNA, 25 bp, Mus musculus
tcatgcttgtggctggcctctttgc

SEQ ID NO: 769669 - DNA, 25 bp, Mus musculus
tcatgcttgtgggtggcctctttgc

SEQ ID NO: 769670 - DNA, 25 bp, Mus musculus
tcatggaaaatacagttttgatacc

SEQ ID NO: 769671 - DNA, 25 bp, Mus musculus
tcatggaaaatagagttttgatacc

SEQ ID NO: 769672 - DNA, 25 bp, Mus musculus
tcatggaaaatcaattgactaaatc

SEQ ID NO: 769673 - DNA, 25 bp, Mus musculus
tcatggaaaatcaggcaccctccca

SEQ ID NO: 769674 - DNA, 25 bp, Mus musculus
tcatggaaaatctattgactaaatc

SEQ ID NO: 769675 - DNA, 25 bp, Mus musculus
tcatggaaaatctggcaccctccca

SEQ ID NO: 769676 - DNA, 25 bp, Mus musculus
tcatggaaacagagaagtaaatgca

SEQ ID NO: 769677 - DNA, 25 bp, Mus musculus
tcatggaaacagtgaagtaaatgca

SEQ ID NO: 769678 - DNA, 25 bp, Mus musculus
tcatggaaacctccgccaagctgaa

SEQ ID NO: 769679 - DNA, 25 bp, Mus musculus
tcatggaaacctgcgccaagctgaa

SEQ ID NO: 769680 - DNA, 25 bp, Mus musculus
tcatggaacttgctcccctggacag

SEQ ID NO: 769681 - DNA, 25 bp, Mus musculus
tcatggaacttggtcccctggacag

SEQ ID NO: 769682 - DNA, 25 bp, Mus musculus
tcatggaaggagcacaagatttgat

SEQ ID NO: 769683 - DNA, 25 bp, Mus musculus
tcatggaaggaggacaagatttgat

SEQ ID NO: 769684 - DNA, 25 bp, Mus musculus
tcatggaaggtgaaaaggccaccac

SEQ ID NO: 769685 - DNA, 25 bp, Mus musculus
tcatggaaggtgtaaaggccaccac

SEQ ID NO: 769686 - DNA, 25 bp, Mus musculus
tcatggaattgccaatgaagacatt

SEQ ID NO: 769687 - DNA, 25 bp, Mus musculus
tcatggaattgcgaatgaagacatt

SEQ ID NO: 769688 - DNA, 25 bp, Mus musculus
tcatggacaactccgggaagcaggc

SEQ ID NO: 769689 - DNA, 25 bp, Mus musculus
tcatggacaactgcgggaagcaggc

SEQ ID NO: 769690 - DNA, 25 bp, Mus musculus
tcatggacaaggctctactgtgcag

SEQ ID NO: 769691 - DNA, 25 bp, Mus musculus
tcatggacaagggtctactgtgcag

SEQ ID NO: 769692 - DNA, 25 bp, Mus musculus
tcatggacatacatctcaagcccgt

SEQ ID NO: 769693 - DNA, 25 bp, Mus musculus
tcatggacatacttctcaagcccgt

SEQ ID NO: 769694 - DNA, 25 bp, Mus musculus
tcatggacccacctatagggcttgg

SEQ ID NO: 769695 - DNA, 25 bp, Mus musculus
tcatggacccacgtatagggcttgg

SEQ ID NO: 769696 - DNA, 25 bp, Mus musculus
tcatggacctaacaggacaaggccc

SEQ ID NO: 769697 - DNA, 25 bp, Mus musculus
tcatggacctaagaggacaaggccc

SEQ ID NO: 769698 - DNA, 25 bp, Mus musculus
tcatggacctggcaccaatgcgcaa

SEQ ID NO: 769699 - DNA, 25 bp, Mus musculus
tcatggacctggctcagtggccttg

SEQ ID NO: 769700 - DNA, 25 bp, Mus musculus
tcatggacctgggaccaatgcgcaa

SEQ ID NO: 769701 - DNA, 25 bp, Mus musculus
tcatggacctgggtcagtggccttg

SEQ ID NO: 769702 - DNA, 25 bp, Mus musculus
tcatggacgatgacaaagtggccac

SEQ ID NO: 769703 - DNA, 25 bp, Mus musculus
tcatggacgatgtcaaagtggccac

SEQ ID NO: 769704 - DNA, 25 bp, Mus musculus
tcatggactcccagggacctgagtg

SEQ ID NO: 769705 - DNA, 25 bp, Mus musculus
tcatggactccctgggacctgagtg

SEQ ID NO: 769706 - DNA, 25 bp, Mus musculus
tcatggactgcaagtacacggtgcc

SEQ ID NO: 769707 - DNA, 25 bp, Mus musculus
tcatggactgcatgtacacggtgcc

SEQ ID NO: 769708 - DNA, 25 bp, Mus musculus
tcatggacttccacgaggagccctt

SEQ ID NO: 769709 - DNA, 25 bp, Mus musculus
tcatggacttcctcgaggagccctt

SEQ ID NO: 769710 - DNA, 25 bp, Mus musculus
tcatggagaaaaatggaccccggaa

SEQ ID NO: 769711 - DNA, 25 bp, Mus musculus
tcatggagaaaattggaccccggaa

SEQ ID NO: 769712 - DNA, 25 bp, Mus musculus
tcatggagaagaatgaacctgagcc

SEQ ID NO: 769713 - DNA, 25 bp, Mus musculus
tcatggagaagattgaacctgagcc

SEQ ID NO: 769714 - DNA, 25 bp, Mus musculus
tcatggagactgagatgatgacaaa

SEQ ID NO: 769715 - DNA, 25 bp, Mus musculus
tcatggagactgtgatgatgacaaa

SEQ ID NO: 769716 - DNA, 25 bp, Mus musculus
tcatggagacttccggaggcacttc

SEQ ID NO: 769717 - DNA, 25 bp, Mus musculus
tcatggagacttgcggaggcacttc

SEQ ID NO: 769718 - DNA, 25 bp, Mus musculus
tcatggagaggaaccagtccatcaa

SEQ ID NO: 769719 - DNA, 25 bp, Mus musculus
tcatggagaggatccagtccatcaa

SEQ ID NO: 769720 - DNA, 25 bp, Mus musculus
tcatggagatttataagaccaatgg

SEQ ID NO: 769721 - DNA, 25 bp, Mus musculus
tcatggagatttttaagaccaatgg

SEQ ID NO: 769722 - DNA, 25 bp, Mus musculus
tcatggagctcgaccttgctgccag

SEQ ID NO: 769723 - DNA, 25 bp, Mus musculus
tcatggagctcgtccttgctgccag

SEQ ID NO: 769724 - DNA, 25 bp, Mus musculus
tcatggagctgaccctactcatcga

SEQ ID NO: 769725 - DNA, 25 bp, Mus musculus
tcatggagctgagcctactcatcga

SEQ ID NO: 769726 - DNA, 25 bp, Mus musculus
tcatggagctttctggtgcaacaag

SEQ ID NO: 769727 - DNA, 25 bp, Mus musculus
tcatggagctttgtggtgcaacaag

SEQ ID NO: 769728 - DNA, 25 bp, Mus musculus
tcatggagtaccaccaggccactgg

SEQ ID NO: 769729 - DNA, 25 bp, Mus musculus
tcatggagtacctccaggccactgg

SEQ ID NO: 769730 - DNA, 25 bp, Mus musculus
tcatggagtattacgtcagcgcatc

SEQ ID NO: 769731 - DNA, 25 bp, Mus musculus
tcatggagtatttcgtcagcgcatc

SEQ ID NO: 769732 - DNA, 25 bp, Mus musculus
tcatggagtgataccctgctttgct

SEQ ID NO: 769733 - DNA, 25 bp, Mus musculus
tcatggagtgattccctgctttgct

SEQ ID NO: 769734 - DNA, 25 bp, Mus musculus
tcatggagttgcataagacatacag

SEQ ID NO: 769735 - DNA, 25 bp, Mus musculus
tcatggagttgcttaagacatacag

SEQ ID NO: 769736 - DNA, 25 bp, Mus musculus
tcatggataaccacaatgtggactc

SEQ ID NO: 769737 - DNA, 25 bp, Mus musculus
tcatggataacctcaatgtggactc

SEQ ID NO: 769738 - DNA, 25 bp, Mus musculus
tcatggatagcccagagaaggctgc

SEQ ID NO: 769739 - DNA, 25 bp, Mus musculus
tcatggatagccgagagaaggctgc

SEQ ID NO: 769740 - DNA, 25 bp, Mus musculus
tcatggatatgcaggtcaacaccca

SEQ ID NO: 769741 - DNA, 25 bp, Mus musculus
tcatggatatgctggtcaacaccca

SEQ ID NO: 769742 - DNA, 25 bp, Mus musculus
tcatggatcaaacatgctgtcctca

SEQ ID NO: 769743 - DNA, 25 bp, Mus musculus
tcatggatcaaagatgctgtcctca

SEQ ID NO: 769744 - DNA, 25 bp, Mus musculus
tcatggatgaacatcaggatgttca

SEQ ID NO: 769745 - DNA, 25 bp, Mus musculus
tcatggatgaacttcaggatgttca

SEQ ID NO: 769746 - DNA, 25 bp, Mus musculus
tcatggatgctcacagaccaaggtt

SEQ ID NO: 769747 - DNA, 25 bp, Mus musculus
tcatggatgctctcagaccaaggtt

SEQ ID NO: 769748 - DNA, 25 bp, Mus musculus
tcatggatgcttcttctgatcccta

SEQ ID NO: 769749 - DNA, 25 bp, Mus musculus
tcatggatgcttgttctgatcccta

SEQ ID NO: 769750 - DNA, 25 bp, Mus musculus
tcatggattggtcgctctatcctag

SEQ ID NO: 769751 - DNA, 25 bp, Mus musculus
tcatggattggtggctctatcctag

SEQ ID NO: 769752 - DNA, 25 bp, Mus musculus
tcatggattgtacaagcctcacacc

SEQ ID NO: 769753 - DNA, 25 bp, Mus musculus
tcatggattgtagaagcctcacacc

SEQ ID NO: 769754 - DNA, 25 bp, Mus musculus
tcatggattgttcccgccctgcatc

SEQ ID NO: 769755 - DNA, 25 bp, Mus musculus
tcatggattgttgccgccctgcatc

SEQ ID NO: 769756 - DNA, 25 bp, Mus musculus
tcatggattttgagaagcagtgtct

SEQ ID NO: 769757 - DNA, 25 bp, Mus musculus
tcatggattttgtgaagcagtgtct

SEQ ID NO: 769758 - DNA, 25 bp, Mus musculus
tcatggcagagtatgacaaccccaa

SEQ ID NO: 769759 - DNA, 25 bp, Mus musculus
tcatggcagagtttgacaaccccaa

SEQ ID NO: 769760 - DNA, 25 bp, Mus musculus
tcatggcagcagacttccttgggct

SEQ ID NO: 769761 - DNA, 25 bp, Mus musculus
tcatggcagcagtcttccttgggct

SEQ ID NO: 769762 - DNA, 25 bp, Mus musculus
tcatggcatcgacctggcgaactct

SEQ ID NO: 769763 - DNA, 25 bp, Mus musculus
tcatggcatcgagctggcgaactct

SEQ ID NO: 769764 - DNA, 25 bp, Mus musculus
tcatggcatgaaagatttggaccgc

SEQ ID NO: 769765 - DNA, 25 bp, Mus musculus
tcatggcatgaatgatttggaccgc

SEQ ID NO: 769766 - DNA, 25 bp, Mus musculus
tcatggcatggaaggagacagtcgc

SEQ ID NO: 769767 - DNA, 25 bp, Mus musculus
tcatggcatggatggagacagtcgc

SEQ ID NO: 769768 - DNA, 25 bp, Mus musculus
tcatggccatctacaaaggaaagct

SEQ ID NO: 769769 - DNA, 25 bp, Mus musculus
tcatggccatcttcaaaggaaagct

SEQ ID NO: 769770 - DNA, 25 bp, Mus musculus
tcatggccgagccttgtggacacca

SEQ ID NO: 769771 - DNA, 25 bp, Mus musculus
tcatggccgagcgttgtggacacca

SEQ ID NO: 769772 - DNA, 25 bp, Mus musculus
tcatggccgatacccagtgatccgg

SEQ ID NO: 769773 - DNA, 25 bp, Mus musculus
tcatggccgatagccagtgatccgg

SEQ ID NO: 769774 - DNA, 25 bp, Mus musculus
tcatggcctctcaatctctttgtgg

SEQ ID NO: 769775 - DNA, 25 bp, Mus musculus
tcatggcctctctatctctttgtgg

SEQ ID NO: 769776 - DNA, 25 bp, Mus musculus
tcatggcggagaagattactgggaa

SEQ ID NO: 769777 - DNA, 25 bp, Mus musculus
tcatggcggagatgattactgggaa

SEQ ID NO: 769778 - DNA, 25 bp, Mus musculus
tcatggcgtcctctccaagcctaag

SEQ ID NO: 769779 - DNA, 25 bp, Mus musculus
tcatggcgtcctgtccaagcctaag

SEQ ID NO: 769780 - DNA, 25 bp, Mus musculus
tcatggctaacccaggaatcttggg

SEQ ID NO: 769781 - DNA, 25 bp, Mus musculus
tcatggctaaccgaggaatcttggg

SEQ ID NO: 769782 - DNA, 25 bp, Mus musculus
tcatggctcgctccaggactagcat

SEQ ID NO: 769783 - DNA, 25 bp, Mus musculus
tcatggctcgctgcaggactagcat

SEQ ID NO: 769784 - DNA, 25 bp, Mus musculus
tcatggctgagcagttgaccggaag

SEQ ID NO: 769785 - DNA, 25 bp, Mus musculus
tcatggctgagctgttgaccggaag

SEQ ID NO: 769786 - DNA, 25 bp, Mus musculus
tcatggctgccaattacctacagtc

SEQ ID NO: 769787 - DNA, 25 bp, Mus musculus
tcatggctgccatttacctacagtc

SEQ ID NO: 769788 - DNA, 25 bp, Mus musculus
tcatggctgcttaggctgcgcctgc

SEQ ID NO: 769789 - DNA, 25 bp, Mus musculus
tcatggctgctttggctgcgcctgc

SEQ ID NO: 769790 - DNA, 25 bp, Mus musculus
tcatggctggacatcttgttggagc

SEQ ID NO: 769791 - DNA, 25 bp, Mus musculus
tcatggctggacttcttgttggagc

SEQ ID NO: 769792 - DNA, 25 bp, Mus musculus
tcatggctgtgtctaaagggcatgt

SEQ ID NO: 769793 - DNA, 25 bp, Mus musculus
tcatggctgtgtgtaaagggcatgt

SEQ ID NO: 769794 - DNA, 25 bp, Mus musculus
tcatggcttcaaattccgggtgcag

SEQ ID NO: 769795 - DNA, 25 bp, Mus musculus
tcatggcttcaatttccgggtgcag

SEQ ID NO: 769796 - DNA, 25 bp, Mus musculus
tcatggcttcttactgccgaggata

SEQ ID NO: 769797 - DNA, 25 bp, Mus musculus
tcatggcttctttctgccgaggata

SEQ ID NO: 769798 - DNA, 25 bp, Mus musculus
tcatgggaatgactatctgtctagc

SEQ ID NO: 769799 - DNA, 25 bp, Mus musculus
tcatgggaatgagtatctgtctagc

SEQ ID NO: 769800 - DNA, 25 bp, Mus musculus
tcatgggacggccacccgagtacac

SEQ ID NO: 769801 - DNA, 25 bp, Mus musculus
tcatgggacggcgacccgagtacac

SEQ ID NO: 769802 - DNA, 25 bp, Mus musculus
tcatgggactcaaggtcgacacccc

SEQ ID NO: 769803 - DNA, 25 bp, Mus musculus
tcatgggactcatggtcgacacccc

SEQ ID NO: 769804 - DNA, 25 bp, Mus musculus
tcatgggactctcaaccagggttcc

SEQ ID NO: 769805 - DNA, 25 bp, Mus musculus
tcatgggactctgaaccagggttcc

SEQ ID NO: 769806 - DNA, 25 bp, Mus musculus
tcatgggactttccaagtgccccaa

SEQ ID NO: 769807 - DNA, 25 bp, Mus musculus
tcatgggactttgcaagtgccccaa

SEQ ID NO: 769808 - DNA, 25 bp, Mus musculus
tcatgggagccaaggagggtgagac

SEQ ID NO: 769809 - DNA, 25 bp, Mus musculus
tcatgggagccatggagggtgagac

SEQ ID NO: 769810 - DNA, 25 bp, Mus musculus
tcatgggagcctagaagaccccaag

SEQ ID NO: 769811 - DNA, 25 bp, Mus musculus
tcatgggagccttgaagaccccaag

SEQ ID NO: 769812 - DNA, 25 bp, Mus musculus
tcatgggagtgaacgagaaggacta

SEQ ID NO: 769813 - DNA, 25 bp, Mus musculus
tcatgggagtgatcgagaaggacta

SEQ ID NO: 769814 - DNA, 25 bp, Mus musculus
tcatgggcaaagagtggaaacaaca

SEQ ID NO: 769815 - DNA, 25 bp, Mus musculus
tcatgggcaaagtgtggaaacaaca

SEQ ID NO: 769816 - DNA, 25 bp, Mus musculus
tcatgggcaataactttgggaacct

SEQ ID NO: 769817 - DNA, 25 bp, Mus musculus
tcatgggcaatatctttgggaacct

SEQ ID NO: 769818 - DNA, 25 bp, Mus musculus
tcatgggcacatacatcttcggcac

SEQ ID NO: 769819 - DNA, 25 bp, Mus musculus
tcatgggcacattcatcttcggcac

SEQ ID NO: 769820 - DNA, 25 bp, Mus musculus
tcatgggcatacagcggagcctagg

SEQ ID NO: 769821 - DNA, 25 bp, Mus musculus
tcatgggcatactgcggagcctagg

SEQ ID NO: 769822 - DNA, 25 bp, Mus musculus
tcatgggcatgtaggccttcccacc

SEQ ID NO: 769823 - DNA, 25 bp, Mus musculus
tcatgggcatgttggccttcccacc

SEQ ID NO: 769824 - DNA, 25 bp, Mus musculus
tcatgggcctcaacaaaggtcacta

SEQ ID NO: 769825 - DNA, 25 bp, Mus musculus
tcatgggcctcatcaaaggtcacta

SEQ ID NO: 769826 - DNA, 25 bp, Mus musculus
tcatgggcgagcacatacactacgg

SEQ ID NO: 769827 - DNA, 25 bp, Mus musculus
tcatgggcgagctcatacactacgg

SEQ ID NO: 769828 - DNA, 25 bp, Mus musculus
tcatggggagcaccattttcttggg

SEQ ID NO: 769829 - DNA, 25 bp, Mus musculus
tcatggggagcagcattttcttggg

SEQ ID NO: 769830 - DNA, 25 bp, Mus musculus
tcatgggtacccaagactctgtggg

SEQ ID NO: 769831 - DNA, 25 bp, Mus musculus
tcatgggtaccctagactctgtggg

SEQ ID NO: 769832 - DNA, 25 bp, Mus musculus
tcatgggtgccacgacttcaagctt

SEQ ID NO: 769833 - DNA, 25 bp, Mus musculus
tcatgggtgccaggacttcaagctt

SEQ ID NO: 769834 - DNA, 25 bp, Mus musculus
tcatgggttccaagccacaggcgat

SEQ ID NO: 769835 - DNA, 25 bp, Mus musculus
tcatgggttccatgccacaggcgat

SEQ ID NO: 769836 - DNA, 25 bp, Mus musculus
tcatggtaatggaactcagcacata

SEQ ID NO: 769837 - DNA, 25 bp, Mus musculus
tcatggtaatggcagccatgctgct

SEQ ID NO: 769838 - DNA, 25 bp, Mus musculus
tcatggtaatgggagccatgctgct

SEQ ID NO: 769839 - DNA, 25 bp, Mus musculus
tcatggtaatggtactcagcacata

SEQ ID NO: 769840 - DNA, 25 bp, Mus musculus
tcatggtaccaactcacagatcggc

SEQ ID NO: 769841 - DNA, 25 bp, Mus musculus
tcatggtaccaagtcacagatcggc

SEQ ID NO: 769842 - DNA, 25 bp, Mus musculus
tcatggtactggagagcagctctgt

SEQ ID NO: 769843 - DNA, 25 bp, Mus musculus
tcatggtactggtgagcagctctgt

SEQ ID NO: 769844 - DNA, 25 bp, Mus musculus
tcatggtagcgcctatgaagggcca

SEQ ID NO: 769845 - DNA, 25 bp, Mus musculus
tcatggtagcgcgtatgaagggcca

SEQ ID NO: 769846 - DNA, 25 bp, Mus musculus
tcatggtatgctcctgaggccctgc

SEQ ID NO: 769847 - DNA, 25 bp, Mus musculus
tcatggtatgctgctgaggccctgc

SEQ ID NO: 769848 - DNA, 25 bp, Mus musculus
tcatggtcacaaagtctacagtggg

SEQ ID NO: 769849 - DNA, 25 bp, Mus musculus
tcatggtcacaatgtctacagtggg

SEQ ID NO: 769850 - DNA, 25 bp, Mus musculus
tcatggtcagtgagaacgcgcccct

SEQ ID NO: 769851 - DNA, 25 bp, Mus musculus
tcatggtcagtgtgaacgcgcccct

SEQ ID NO: 769852 - DNA, 25 bp, Mus musculus
tcatggtcttcgcaaaaccaagaaa

SEQ ID NO: 769853 - DNA, 25 bp, Mus musculus
tcatggtcttcggaaaaccaagaaa

SEQ ID NO: 769854 - DNA, 25 bp, Mus musculus
tcatggtgaaataaaatgggtcgac

SEQ ID NO: 769855 - DNA, 25 bp, Mus musculus
tcatggtgaaattaaatgggtcgac

SEQ ID NO: 769856 - DNA, 25 bp, Mus musculus
tcatggtgaacaatgcacattatgt

SEQ ID NO: 769857 - DNA, 25 bp, Mus musculus
tcatggtgaacattgcacattatgt

SEQ ID NO: 769858 - DNA, 25 bp, Mus musculus
tcatggtgacagattcagggaagcc

SEQ ID NO: 769859 - DNA, 25 bp, Mus musculus
tcatggtgacagtttcagggaagcc

SEQ ID NO: 769860 - DNA, 25 bp, Mus musculus
tcatggtgagcaatgacagccacac

SEQ ID NO: 769861 - DNA, 25 bp, Mus musculus
tcatggtgagcattgacagccacac

SEQ ID NO: 769862 - DNA, 25 bp, Mus musculus
tcatggtgagtcacgccctcctatg

SEQ ID NO: 769863 - DNA, 25 bp, Mus musculus
tcatggtgagtctcgccctcctatg

SEQ ID NO: 769864 - DNA, 25 bp, Mus musculus
tcatggtgctggctcgagctaagcc

SEQ ID NO: 769865 - DNA, 25 bp, Mus musculus
tcatggtgctgggtcgagctaagcc

SEQ ID NO: 769866 - DNA, 25 bp, Mus musculus
tcatggtggcaaactacgtcaaccg

SEQ ID NO: 769867 - DNA, 25 bp, Mus musculus
tcatggtggcaatctacgtcaaccg

SEQ ID NO: 769868 - DNA, 25 bp, Mus musculus
tcatggttacagagagcttgcagct

SEQ ID NO: 769869 - DNA, 25 bp, Mus musculus
tcatggttacagtgagcttgcagct

SEQ ID NO: 769870 - DNA, 25 bp, Mus musculus
tcatggttacgtcggacaggctgcc

SEQ ID NO: 769871 - DNA, 25 bp, Mus musculus
tcatggttacgtgggacaggctgcc

SEQ ID NO: 769872 - DNA, 25 bp, Mus musculus
tcatggttggctatccagacttcct

SEQ ID NO: 769873 - DNA, 25 bp, Mus musculus
tcatggttggctttccagacttcct

SEQ ID NO: 769874 - DNA, 25 bp, Mus musculus
tcatggtttcctattgtgcctctct

SEQ ID NO: 769875 - DNA, 25 bp, Mus musculus
tcatggtttccttttgtgcctctct

SEQ ID NO: 769876 - DNA, 25 bp, Mus musculus
tcatgtaacctcaaaaggaaaccca

SEQ ID NO: 769877 - DNA, 25 bp, Mus musculus
tcatgtaacctctaaaggaaaccca

SEQ ID NO: 769878 - DNA, 25 bp, Mus musculus
tcatgtaatgaacaactccttgaag

SEQ ID NO: 769879 - DNA, 25 bp, Mus musculus
tcatgtaatgaagaactccttgaag

SEQ ID NO: 769880 - DNA, 25 bp, Mus musculus
tcatgtacaaccatttccagcgcta

SEQ ID NO: 769881 - DNA, 25 bp, Mus musculus
tcatgtacaaccttttccagcgcta

SEQ ID NO: 769882 - DNA, 25 bp, Mus musculus
tcatgtacattgcaggcaaatatca

SEQ ID NO: 769883 - DNA, 25 bp, Mus musculus
tcatgtacattggaggcaaatatca

SEQ ID NO: 769884 - DNA, 25 bp, Mus musculus
tcatgtaccagcctaaagattaaag

SEQ ID NO: 769885 - DNA, 25 bp, Mus musculus
tcatgtaccagcgtaaagattaaag

SEQ ID NO: 769886 - DNA, 25 bp, Mus musculus
tcatgtaccatgatgccagccgatg

SEQ ID NO: 769887 - DNA, 25 bp, Mus musculus
tcatgtaccatgttgccagccgatg

SEQ ID NO: 769888 - DNA, 25 bp, Mus musculus
tcatgtacgtgcagagctggctgtc

SEQ ID NO: 769889 - DNA, 25 bp, Mus musculus
tcatgtacgtgctgagctggctgtc

SEQ ID NO: 769890 - DNA, 25 bp, Mus musculus
tcatgtagcaggaaccggagatggt

SEQ ID NO: 769891 - DNA, 25 bp, Mus musculus
tcatgtagcaggtaccggagatggt

SEQ ID NO: 769892 - DNA, 25 bp, Mus musculus
tcatgtagccgaagaggaccttgag

SEQ ID NO: 769893 - DNA, 25 bp, Mus musculus
tcatgtagccgatgaggaccttgag

SEQ ID NO: 769894 - DNA, 25 bp, Mus musculus
tcatgtagccttccttagctccagg

SEQ ID NO: 769895 - DNA, 25 bp, Mus musculus
tcatgtagccttgcttagctccagg

SEQ ID NO: 769896 - DNA, 25 bp, Mus musculus
tcatgtataaaactggatcaattcc

SEQ ID NO: 769897 - DNA, 25 bp, Mus musculus
tcatgtataaaagtggatcaattcc

SEQ ID NO: 769898 - DNA, 25 bp, Mus musculus
tcatgtatagagagctgacctggca

SEQ ID NO: 769899 - DNA, 25 bp, Mus musculus
tcatgtatagagtgctgacctggca

SEQ ID NO: 769900 - DNA, 25 bp, Mus musculus
tcatgtatgggactcactactcttc

SEQ ID NO: 769901 - DNA, 25 bp, Mus musculus
tcatgtatgggagtcactactcttc

SEQ ID NO: 769902 - DNA, 25 bp, Mus musculus
tcatgtcaagggagaccacagacac

SEQ ID NO: 769903 - DNA, 25 bp, Mus musculus
tcatgtcaagggtgaccacagacac

SEQ ID NO: 769904 - DNA, 25 bp, Mus musculus
tcatgtcagaagagcagaaccaccc

SEQ ID NO: 769905 - DNA, 25 bp, Mus musculus
tcatgtcagaagtgcagaaccaccc

SEQ ID NO: 769906 - DNA, 25 bp, Mus musculus
tcatgtcatagtccattgtgctgca

SEQ ID NO: 769907 - DNA, 25 bp, Mus musculus
tcatgtcatagtgcattgtgctgca

SEQ ID NO: 769908 - DNA, 25 bp, Mus musculus
tcatgtcatcttaaactacaagggc

SEQ ID NO: 769909 - DNA, 25 bp, Mus musculus
tcatgtcatctttaactacaagggc

SEQ ID NO: 769910 - DNA, 25 bp, Mus musculus
tcatgtcattagcaagtcaaagaac

SEQ ID NO: 769911 - DNA, 25 bp, Mus musculus
tcatgtcattaggaagtcaaagaac

SEQ ID NO: 769912 - DNA, 25 bp, Mus musculus
tcatgtccactgaagccactggcag

SEQ ID NO: 769913 - DNA, 25 bp, Mus musculus
tcatgtccactgtagccactggcag

SEQ ID NO: 769914 - DNA, 25 bp, Mus musculus
tcatgtccattcacaccatagccag

SEQ ID NO: 769915 - DNA, 25 bp, Mus musculus
tcatgtccattctcaccatagccag

SEQ ID NO: 769916 - DNA, 25 bp, Mus musculus
tcatgtcccgtgatgtacaagctca

SEQ ID NO: 769917 - DNA, 25 bp, Mus musculus
tcatgtcccgtgttgtacaagctca

SEQ ID NO: 769918 - DNA, 25 bp, Mus musculus
tcatgtccctgcacgaggcctacat

SEQ ID NO: 769919 - DNA, 25 bp, Mus musculus
tcatgtccctgctcgaggcctacat

SEQ ID NO: 769920 - DNA, 25 bp, Mus musculus
tcatgtccctgtctcttcagaactg

SEQ ID NO: 769921 - DNA, 25 bp, Mus musculus
tcatgtccctgtgtcttcagaactg

SEQ ID NO: 769922 - DNA, 25 bp, Mus musculus
tcatgtccgaggaggctcagacctt

SEQ ID NO: 769923 - DNA, 25 bp, Mus musculus
tcatgtccgaggtggctcagacctt

SEQ ID NO: 769924 - DNA, 25 bp, Mus musculus
tcatgtcctatgacgctgccgtgtg

SEQ ID NO: 769925 - DNA, 25 bp, Mus musculus
tcatgtcctatgtcgctgccgtgtg

SEQ ID NO: 769926 - DNA, 25 bp, Mus musculus
tcatgtcctcctatcaagacttcta

SEQ ID NO: 769927 - DNA, 25 bp, Mus musculus
tcatgtcctcctttcaagacttcta

SEQ ID NO: 769928 - DNA, 25 bp, Mus musculus
tcatgtcctctacacttaactctgt

SEQ ID NO: 769929 - DNA, 25 bp, Mus musculus
tcatgtcctctagacttaactctgt

SEQ ID NO: 769930 - DNA, 25 bp, Mus musculus
tcatgtcctggaccttctacaaaat

SEQ ID NO: 769931 - DNA, 25 bp, Mus musculus
tcatgtcctggagcttctacaaaat

SEQ ID NO: 769932 - DNA, 25 bp, Mus musculus
tcatgtccttccaggtggcttccca

SEQ ID NO: 769933 - DNA, 25 bp, Mus musculus
tcatgtccttcctggtggcttccca

SEQ ID NO: 769934 - DNA, 25 bp, Mus musculus
tcatgtctaggcagagagttccaaa

SEQ ID NO: 769935 - DNA, 25 bp, Mus musculus
tcatgtctaggctgagagttccaaa

SEQ ID NO: 769936 - DNA, 25 bp, Mus musculus
tcatgtctatcaccacgcgtccatg

SEQ ID NO: 769937 - DNA, 25 bp, Mus musculus
tcatgtctatcagcacgcgtccatg

SEQ ID NO: 769938 - DNA, 25 bp, Mus musculus
tcatgtctattgagtggacaacata

SEQ ID NO: 769939 - DNA, 25 bp, Mus musculus
tcatgtctattgtgtggacaacata

SEQ ID NO: 769940 - DNA, 25 bp, Mus musculus
tcatgtctcatgctatccaggaggg

SEQ ID NO: 769941 - DNA, 25 bp, Mus musculus
tcatgtctcatggtatccaggaggg

SEQ ID NO: 769942 - DNA, 25 bp, Mus musculus
tcatgtgaagatcggactcttggta

SEQ ID NO: 769943 - DNA, 25 bp, Mus musculus
tcatgtgaagatgggactcttggta

SEQ ID NO: 769944 - DNA, 25 bp, Mus musculus
tcatgtgacaatcaggtgtctgaca

SEQ ID NO: 769945 - DNA, 25 bp, Mus musculus
tcatgtgacaatgaggtgtctgaca

SEQ ID NO: 769946 - DNA, 25 bp, Mus musculus
tcatgtgagcagagtctgtcctaca

SEQ ID NO: 769947 - DNA, 25 bp, Mus musculus
tcatgtgagcagtgtctgtcctaca

SEQ ID NO: 769948 - DNA, 25 bp, Mus musculus
tcatgtgaggaactactcacttcat

SEQ ID NO: 769949 - DNA, 25 bp, Mus musculus
tcatgtgaggaagtactcacttcat

SEQ ID NO: 769950 - DNA, 25 bp, Mus musculus
tcatgtgatcaccaaacgaaacact

SEQ ID NO: 769951 - DNA, 25 bp, Mus musculus
tcatgtgatcacgaaacgaaacact

SEQ ID NO: 769952 - DNA, 25 bp, Mus musculus
tcatgtgcaagaaccgtgaagggcg

SEQ ID NO: 769953 - DNA, 25 bp, Mus musculus
tcatgtgcaagatccgtgaagggcg

SEQ ID NO: 769954 - DNA, 25 bp, Mus musculus
tcatgtgcaggaagaaagtgggact

SEQ ID NO: 769955 - DNA, 25 bp, Mus musculus
tcatgtgcaggatgaaagtgggact

SEQ ID NO: 769956 - DNA, 25 bp, Mus musculus
tcatgtgcctgaagagaaatcccag

SEQ ID NO: 769957 - DNA, 25 bp, Mus musculus
tcatgtgcctgatgagaaatcccag

SEQ ID NO: 769958 - DNA, 25 bp, Mus musculus
tcatgtgcgacaagatgacctcacg

SEQ ID NO: 769959 - DNA, 25 bp, Mus musculus
tcatgtgcgacatgatgacctcacg

SEQ ID NO: 769960 - DNA, 25 bp, Mus musculus
tcatgtgctcccagcaggactgcat

SEQ ID NO: 769961 - DNA, 25 bp, Mus musculus
tcatgtgctccctgcaggactgcat

SEQ ID NO: 769962 - DNA, 25 bp, Mus musculus
tcatgtggaccactatgaaaccaaa

SEQ ID NO: 769963 - DNA, 25 bp, Mus musculus
tcatgtggaccagtatgaaaccaaa

SEQ ID NO: 769964 - DNA, 25 bp, Mus musculus
tcatgtggcactctagcatccccgt

SEQ ID NO: 769965 - DNA, 25 bp, Mus musculus
tcatgtggcactgtagcatccccgt

SEQ ID NO: 769966 - DNA, 25 bp, Mus musculus
tcatgtggcattcagagtaaagtct

SEQ ID NO: 769967 - DNA, 25 bp, Mus musculus
tcatgtggcattgagagtaaagtct

SEQ ID NO: 769968 - DNA, 25 bp, Mus musculus
tcatgtggctcaagactctccagga

SEQ ID NO: 769969 - DNA, 25 bp, Mus musculus
tcatgtggctcatgactctccagga

SEQ ID NO: 769970 - DNA, 25 bp, Mus musculus
tcatgtggctgaagacctatgttgg

SEQ ID NO: 769971 - DNA, 25 bp, Mus musculus
tcatgtggctgatgacctatgttgg

SEQ ID NO: 769972 - DNA, 25 bp, Mus musculus
tcatgtgtaataacaaactgctgaa

SEQ ID NO: 769973 - DNA, 25 bp, Mus musculus
tcatgtgtaatatcaaactgctgaa

SEQ ID NO: 769974 - DNA, 25 bp, Mus musculus
tcatgtgtccctagctggttttggg

SEQ ID NO: 769975 - DNA, 25 bp, Mus musculus
tcatgtgtcccttgctggttttggg

SEQ ID NO: 769976 - DNA, 25 bp, Mus musculus
tcatgtgtgatgaaatggagcgctc

SEQ ID NO: 769977 - DNA, 25 bp, Mus musculus
tcatgtgtgatgtaatggagcgctc

SEQ ID NO: 769978 - DNA, 25 bp, Mus musculus
tcatgtgtgccgaggaatcctaccc

SEQ ID NO: 769979 - DNA, 25 bp, Mus musculus
tcatgtgtgccgtggaatcctaccc

SEQ ID NO: 769980 - DNA, 25 bp, Mus musculus
tcatgtgttcaacgccgggctaggc

SEQ ID NO: 769981 - DNA, 25 bp, Mus musculus
tcatgtgttcaaggccgggctaggc

SEQ ID NO: 769982 - DNA, 25 bp, Mus musculus
tcatgttaaaacacctccctccaga

SEQ ID NO: 769983 - DNA, 25 bp, Mus musculus
tcatgttaaaactcctccctccaga

SEQ ID NO: 769984 - DNA, 25 bp, Mus musculus
tcatgttatcaaacagacgggaggc

SEQ ID NO: 769985 - DNA, 25 bp, Mus musculus
tcatgttatcaatcagacgggaggc

SEQ ID NO: 769986 - DNA, 25 bp, Mus musculus
tcatgttcaatgcaacctccttggg

SEQ ID NO: 769987 - DNA, 25 bp, Mus musculus
tcatgttcaatggaacctccttggg

SEQ ID NO: 769988 - DNA, 25 bp, Mus musculus
tcatgttccagccagtactggtgtc

SEQ ID NO: 769989 - DNA, 25 bp, Mus musculus
tcatgttccagcgagtactggtgtc

SEQ ID NO: 769990 - DNA, 25 bp, Mus musculus
tcatgttcccaacgactacggatga

SEQ ID NO: 769991 - DNA, 25 bp, Mus musculus
tcatgttcccaaggactacggatga

SEQ ID NO: 769992 - DNA, 25 bp, Mus musculus
tcatgttcgcccctcaagaatggca

SEQ ID NO: 769993 - DNA, 25 bp, Mus musculus
tcatgttcgcccgtcaagaatggca

SEQ ID NO: 769994 - DNA, 25 bp, Mus musculus
tcatgttctgggaagggcacgtgtt

SEQ ID NO: 769995 - DNA, 25 bp, Mus musculus
tcatgttctgggtagggcacgtgtt

SEQ ID NO: 769996 - DNA, 25 bp, Mus musculus
tcatgttctgtccagccccgggaaa

SEQ ID NO: 769997 - DNA, 25 bp, Mus musculus
tcatgttctgtcgagccccgggaaa

SEQ ID NO: 769998 - DNA, 25 bp, Mus musculus
tcatgttgctaacactgggtatggg

SEQ ID NO: 769999 - DNA, 25 bp, Mus musculus
tcatgttgctaagactgggtatggg

SEQ ID NO: 770000 - DNA, 25 bp, Mus musculus
tcatgttggcggagcacagacacgg

SEQ ID NO: 770001 - DNA, 25 bp, Mus musculus
tcatgttggcggtgcacagacacgg

SEQ ID NO: 770002 - DNA, 25 bp, Mus musculus
tcatgtttgtacaggaagaggccct

SEQ ID NO: 770003 - DNA, 25 bp, Mus musculus
tcatgtttgtactggaagaggccct

SEQ ID NO: 770004 - DNA, 25 bp, Mus musculus
tcatgtttttctctcaacaggaagg

SEQ ID NO: 770005 - DNA, 25 bp, Mus musculus
tcatgtttttctgtcaacaggaagg

SEQ ID NO: 770006 - DNA, 25 bp, Mus musculus
tcattaaaatgtatgcctgggtcaa

SEQ ID NO: 770007 - DNA, 25 bp, Mus musculus
tcattaaaatgtttgcctgggtcaa

SEQ ID NO: 770008 - DNA, 25 bp, Mus musculus
tcattaacaatgagtggcacgacgc

SEQ ID NO: 770009 - DNA, 25 bp, Mus musculus
tcattaacaatgtgtggcacgacgc

SEQ ID NO: 770010 - DNA, 25 bp, Mus musculus
tcattaacaattagcagggccccgg

SEQ ID NO: 770011 - DNA, 25 bp, Mus musculus
tcattaacaatttgcagggccccgg

SEQ ID NO: 770012 - DNA, 25 bp, Mus musculus
tcattaacaggaagccaagccatga

SEQ ID NO: 770013 - DNA, 25 bp, Mus musculus
tcattaacaggatgccaagccatga

SEQ ID NO: 770014 - DNA, 25 bp, Mus musculus
tcattaacagtgaggctagcagcct

SEQ ID NO: 770015 - DNA, 25 bp, Mus musculus
tcattaacagtgtggctagcagcct

SEQ ID NO: 770016 - DNA, 25 bp, Mus musculus
tcattaacattgacccgtgtgctaa

SEQ ID NO: 770017 - DNA, 25 bp, Mus musculus
tcattaacattgtcccgtgtgctaa

SEQ ID NO: 770018 - DNA, 25 bp, Mus musculus
tcattaactttcaacaacagcaagg

SEQ ID NO: 770019 - DNA, 25 bp, Mus musculus
tcattaactttctacaacagcaagg

SEQ ID NO: 770020 - DNA, 25 bp, Mus musculus
tcattaagaatgaggagaagtacaa

SEQ ID NO: 770021 - DNA, 25 bp, Mus musculus
tcattaagaatgtggagaagtacaa

SEQ ID NO: 770022 - DNA, 25 bp, Mus musculus
tcattaagacggcttacctagggag

SEQ ID NO: 770023 - DNA, 25 bp, Mus musculus
tcattaagacgggttacctagggag

SEQ ID NO: 770024 - DNA, 25 bp, Mus musculus
tcattaagcccaacgacaagaaggc

SEQ ID NO: 770025 - DNA, 25 bp, Mus musculus
tcattaagcccatcgacaagaaggc

SEQ ID NO: 770026 - DNA, 25 bp, Mus musculus
tcattaaggatgattggacaatcta

SEQ ID NO: 770027 - DNA, 25 bp, Mus musculus
tcattaaggatgtttggacaatcta

SEQ ID NO: 770028 - DNA, 25 bp, Mus musculus
tcattaagtagcagcggaggatcgt

SEQ ID NO: 770029 - DNA, 25 bp, Mus musculus
tcattaagtagctgcggaggatcgt

SEQ ID NO: 770030 - DNA, 25 bp, Mus musculus
tcattaatggagctgaaaagcccac

SEQ ID NO: 770031 - DNA, 25 bp, Mus musculus
tcattaatggaggtgaaaagcccac

SEQ ID NO: 770032 - DNA, 25 bp, Mus musculus
tcattaatgtggacttaactgaaga

SEQ ID NO: 770033 - DNA, 25 bp, Mus musculus
tcattaatgtggtcttaactgaaga

SEQ ID NO: 770034 - DNA, 25 bp, Mus musculus
tcattacaagatatggcaagccgtg

SEQ ID NO: 770035 - DNA, 25 bp, Mus musculus
tcattacaagatttggcaagccgtg

SEQ ID NO: 770036 - DNA, 25 bp, Mus musculus
tcattacaccacaattggacatggg

SEQ ID NO: 770037 - DNA, 25 bp, Mus musculus
tcattacaccactattggacatggg

SEQ ID NO: 770038 - DNA, 25 bp, Mus musculus
tcattacactcaagcctggcccgag

SEQ ID NO: 770039 - DNA, 25 bp, Mus musculus
tcattacactcatgcctggcccgag

SEQ ID NO: 770040 - DNA, 25 bp, Mus musculus
tcattacagatcagaaagacacagt

SEQ ID NO: 770041 - DNA, 25 bp, Mus musculus
tcattacagatctgaaagacacagt

SEQ ID NO: 770042 - DNA, 25 bp, Mus musculus
tcattacagtgccacacaagatcat

SEQ ID NO: 770043 - DNA, 25 bp, Mus musculus
tcattacagtgcgacacaagatcat

SEQ ID NO: 770044 - DNA, 25 bp, Mus musculus
tcattaccaagtagcctgtcagaag

SEQ ID NO: 770045 - DNA, 25 bp, Mus musculus
tcattaccaagttgcctgtcagaag

SEQ ID NO: 770046 - DNA, 25 bp, Mus musculus
tcattaccagtcaggctttgccacc

SEQ ID NO: 770047 - DNA, 25 bp, Mus musculus
tcattaccagtctggctttgccacc

SEQ ID NO: 770048 - DNA, 25 bp, Mus musculus
tcattaccctggatgtagctcacaa

SEQ ID NO: 770049 - DNA, 25 bp, Mus musculus
tcattaccctggttgtagctcacaa

SEQ ID NO: 770050 - DNA, 25 bp, Mus musculus
tcattaccggtcaggagactcagct

SEQ ID NO: 770051 - DNA, 25 bp, Mus musculus
tcattaccggtctggagactcagct

SEQ ID NO: 770052 - DNA, 25 bp, Mus musculus
tcattactctccagttctctgtgct

SEQ ID NO: 770053 - DNA, 25 bp, Mus musculus
tcattactctcctgttctctgtgct

SEQ ID NO: 770054 - DNA, 25 bp, Mus musculus
tcattactgtctatagttgagcact

SEQ ID NO: 770055 - DNA, 25 bp, Mus musculus
tcattactgtctttagttgagcact

SEQ ID NO: 770056 - DNA, 25 bp, Mus musculus
tcattagaaaaacatgcaacaccat

SEQ ID NO: 770057 - DNA, 25 bp, Mus musculus
tcattagaaaaagatgcaacaccat

SEQ ID NO: 770058 - DNA, 25 bp, Mus musculus
tcattagaacagaaaaaatgtcact

SEQ ID NO: 770059 - DNA, 25 bp, Mus musculus
tcattagaacagtaaaaatgtcact

SEQ ID NO: 770060 - DNA, 25 bp, Mus musculus
tcattagcaaaaagcagtgcacttg

SEQ ID NO: 770061 - DNA, 25 bp, Mus musculus
tcattagcaaaatgcagtgcacttg

SEQ ID NO: 770062 - DNA, 25 bp, Mus musculus
tcattagcaagaagctggagcgata

SEQ ID NO: 770063 - DNA, 25 bp, Mus musculus
tcattagcaagatgctggagcgata

SEQ ID NO: 770064 - DNA, 25 bp, Mus musculus
tcattaggattgcacgagccatgaa

SEQ ID NO: 770065 - DNA, 25 bp, Mus musculus
tcattaggattggacgagccatgaa

SEQ ID NO: 770066 - DNA, 25 bp, Mus musculus
tcattagggtggacgagaagctttt

SEQ ID NO: 770067 - DNA, 25 bp, Mus musculus
tcattagggtggtcgagaagctttt

SEQ ID NO: 770068 - DNA, 25 bp, Mus musculus
tcattagtagacagttgccttgtgg

SEQ ID NO: 770069 - DNA, 25 bp, Mus musculus
tcattagtagactgttgccttgtgg

SEQ ID NO: 770070 - DNA, 25 bp, Mus musculus
tcattagttactcgttcttcagaag

SEQ ID NO: 770071 - DNA, 25 bp, Mus musculus
tcattagttactggttcttcagaag

SEQ ID NO: 770072 - DNA, 25 bp, Mus musculus
tcattataattactccgaagcttta

SEQ ID NO: 770073 - DNA, 25 bp, Mus musculus
tcattataattagtccgaagcttta

SEQ ID NO: 770074 - DNA, 25 bp, Mus musculus
tcattatcaagaaaactcagcaagt

SEQ ID NO: 770075 - DNA, 25 bp, Mus musculus
tcattatcaagataactcagcaagt

SEQ ID NO: 770076 - DNA, 25 bp, Mus musculus
tcattatctaggacttgcaaacaag

SEQ ID NO: 770077 - DNA, 25 bp, Mus musculus
tcattatctaggtcttgcaaacaag

SEQ ID NO: 770078 - DNA, 25 bp, Mus musculus
tcattatctggaagtgacacaagga

SEQ ID NO: 770079 - DNA, 25 bp, Mus musculus
tcattatctggatgtgacacaagga

SEQ ID NO: 770080 - DNA, 25 bp, Mus musculus
tcattatgatgacgctgtgtgacca

SEQ ID NO: 770081 - DNA, 25 bp, Mus musculus
tcattatgatgaggctgtgtgacca

SEQ ID NO: 770082 - DNA, 25 bp, Mus musculus
tcattattggtgagcaagagcggaa

SEQ ID NO: 770083 - DNA, 25 bp, Mus musculus
tcattattggtgtgcaagagcggaa

SEQ ID NO: 770084 - DNA, 25 bp, Mus musculus
tcattcaaacctacagactgcacat

SEQ ID NO: 770085 - DNA, 25 bp, Mus musculus
tcattcaaaccttcagactgcacat

SEQ ID NO: 770086 - DNA, 25 bp, Mus musculus
tcattcaagaggaaaatctccgttg

SEQ ID NO: 770087 - DNA, 25 bp, Mus musculus
tcattcaagaggtaaatctccgttg

SEQ ID NO: 770088 - DNA, 25 bp, Mus musculus
tcattcaagctgagcagaagtcaga

SEQ ID NO: 770089 - DNA, 25 bp, Mus musculus
tcattcaagctgtgcagaagtcaga

SEQ ID NO: 770090 - DNA, 25 bp, Mus musculus
tcattcacaaggagagagggtagct

SEQ ID NO: 770091 - DNA, 25 bp, Mus musculus
tcattcacaaggtgagagggtagct

SEQ ID NO: 770092 - DNA, 25 bp, Mus musculus
tcattcacatgcatactcacttggc

SEQ ID NO: 770093 - DNA, 25 bp, Mus musculus
tcattcacatgcttactcacttggc

SEQ ID NO: 770094 - DNA, 25 bp, Mus musculus
tcattcacatttatgggatgaaacg

SEQ ID NO: 770095 - DNA, 25 bp, Mus musculus
tcattcacatttttgggatgaaacg

SEQ ID NO: 770096 - DNA, 25 bp, Mus musculus
tcattcacgcatagaacattatgct

SEQ ID NO: 770097 - DNA, 25 bp, Mus musculus
tcattcacgcattgaacattatgct

SEQ ID NO: 770098 - DNA, 25 bp, Mus musculus
tcattcacgccaaaaggacctaccg

SEQ ID NO: 770099 - DNA, 25 bp, Mus musculus
tcattcacgccataaggacctaccg

SEQ ID NO: 770100 - DNA, 25 bp, Mus musculus
tcattcagaaacacccttcgggaaa

SEQ ID NO: 770101 - DNA, 25 bp, Mus musculus
tcattcagaaactcccttcgggaaa

SEQ ID NO: 770102 - DNA, 25 bp, Mus musculus
tcattcagaaggatggaagtctctg

SEQ ID NO: 770103 - DNA, 25 bp, Mus musculus
tcattcagaaggttggaagtctctg

SEQ ID NO: 770104 - DNA, 25 bp, Mus musculus
tcattcagctggacaaatttcacaa

SEQ ID NO: 770105 - DNA, 25 bp, Mus musculus
tcattcagctggcaaccttagtgga

SEQ ID NO: 770106 - DNA, 25 bp, Mus musculus
tcattcagctgggaaccttagtgga

SEQ ID NO: 770107 - DNA, 25 bp, Mus musculus
tcattcagctggtcaaatttcacaa

SEQ ID NO: 770108 - DNA, 25 bp, Mus musculus
tcattcaggaagactaccgggacgg

SEQ ID NO: 770109 - DNA, 25 bp, Mus musculus
tcattcaggaagtctaccgggacgg

SEQ ID NO: 770110 - DNA, 25 bp, Mus musculus
tcattcaggcgccacagacagtagt

SEQ ID NO: 770111 - DNA, 25 bp, Mus musculus
tcattcaggcgcgacagacagtagt

SEQ ID NO: 770112 - DNA, 25 bp, Mus musculus
tcattcagtagccaaactgcttggg

SEQ ID NO: 770113 - DNA, 25 bp, Mus musculus
tcattcagtagcgaaactgcttggg

SEQ ID NO: 770114 - DNA, 25 bp, Mus musculus
tcattcagtctgatatcagcatgtg

SEQ ID NO: 770115 - DNA, 25 bp, Mus musculus
tcattcagtctgttatcagcatgtg

SEQ ID NO: 770116 - DNA, 25 bp, Mus musculus
tcattcagtgggataagcttctccg

SEQ ID NO: 770117 - DNA, 25 bp, Mus musculus
tcattcagtgggttaagcttctccg

SEQ ID NO: 770118 - DNA, 25 bp, Mus musculus
tcattcagttaaagtgtgagaacct

SEQ ID NO: 770119 - DNA, 25 bp, Mus musculus
tcattcagttaatgtgtgagaacct

SEQ ID NO: 770120 - DNA, 25 bp, Mus musculus
tcattcataaccatgctcagctacg

SEQ ID NO: 770121 - DNA, 25 bp, Mus musculus
tcattcataaccttgctcagctacg

SEQ ID NO: 770122 - DNA, 25 bp, Mus musculus
tcattccacggcaggtctggcacag

SEQ ID NO: 770123 - DNA, 25 bp, Mus musculus
tcattccacggctggtctggcacag

SEQ ID NO: 770124 - DNA, 25 bp, Mus musculus
tcattccagccgagagcatctccta

SEQ ID NO: 770125 - DNA, 25 bp, Mus musculus
tcattccagccgtgagcatctccta

SEQ ID NO: 770126 - DNA, 25 bp, Mus musculus
tcattccagctaacctgcaaagcgc

SEQ ID NO: 770127 - DNA, 25 bp, Mus musculus
tcattccagctatcctgcaaagcgc

SEQ ID NO: 770128 - DNA, 25 bp, Mus musculus
tcattccagtggattgcagatttac

SEQ ID NO: 770129 - DNA, 25 bp, Mus musculus
tcattccagtggtttgcagatttac

SEQ ID NO: 770130 - DNA, 25 bp, Mus musculus
tcattcccaatgatcctcgtggcca

SEQ ID NO: 770131 - DNA, 25 bp, Mus musculus
tcattcccaatgttcctcgtggcca

SEQ ID NO: 770132 - DNA, 25 bp, Mus musculus
tcattcccacggacatgttcacagt

SEQ ID NO: 770133 - DNA, 25 bp, Mus musculus
tcattcccacggtcatgttcacagt

SEQ ID NO: 770134 - DNA, 25 bp, Mus musculus
tcattcccgtctagtgataaagtgg

SEQ ID NO: 770135 - DNA, 25 bp, Mus musculus
tcattcccgtcttgtgataaagtgg

SEQ ID NO: 770136 - DNA, 25 bp, Mus musculus
tcattcctactgacaaagccgttgc

SEQ ID NO: 770137 - DNA, 25 bp, Mus musculus
tcattcctactgtcaaagccgttgc

SEQ ID NO: 770138 - DNA, 25 bp, Mus musculus
tcattcctacttcatactgttacga

SEQ ID NO: 770139 - DNA, 25 bp, Mus musculus
tcattcctacttgatactgttacga

SEQ ID NO: 770140 - DNA, 25 bp, Mus musculus
tcattcctcttacccagctgtgctt

SEQ ID NO: 770141 - DNA, 25 bp, Mus musculus
tcattcctcttagccagctgtgctt

SEQ ID NO: 770142 - DNA, 25 bp, Mus musculus
tcattcctggaaagtttaccaaaga

SEQ ID NO: 770143 - DNA, 25 bp, Mus musculus
tcattcctggaatgtttaccaaaga

SEQ ID NO: 770144 - DNA, 25 bp, Mus musculus
tcattcgaaagtaagtacctgccag

SEQ ID NO: 770145 - DNA, 25 bp, Mus musculus
tcattcgaaagttagtacctgccag

SEQ ID NO: 770146 - DNA, 25 bp, Mus musculus
tcattcgagtcgatgcgtcggccct

SEQ ID NO: 770147 - DNA, 25 bp, Mus musculus
tcattcgagtcgttgcgtcggccct

SEQ ID NO: 770148 - DNA, 25 bp, Mus musculus
tcattcgcaatgatcgttttataag

SEQ ID NO: 770149 - DNA, 25 bp, Mus musculus
tcattcgcaatgttcgttttataag

SEQ ID NO: 770150 - DNA, 25 bp, Mus musculus
tcattcgccaagaggaaggcctcca

SEQ ID NO: 770151 - DNA, 25 bp, Mus musculus
tcattcgccaagtggaaggcctcca

SEQ ID NO: 770152 - DNA, 25 bp, Mus musculus
tcattcgcccttaagaaagtcaggg

SEQ ID NO: 770153 - DNA, 25 bp, Mus musculus
tcattcgccctttagaaagtcaggg

SEQ ID NO: 770154 - DNA, 25 bp, Mus musculus
tcattcggatttcgtgtcacccaga

SEQ ID NO: 770155 - DNA, 25 bp, Mus musculus
tcattcggatttggtgtcacccaga

SEQ ID NO: 770156 - DNA, 25 bp, Mus musculus
tcattcgttctcaaccagcttcagt

SEQ ID NO: 770157 - DNA, 25 bp, Mus musculus
tcattcgttctctaccagcttcagt

SEQ ID NO: 770158 - DNA, 25 bp, Mus musculus
tcattctagtgtctgcttggcactg

SEQ ID NO: 770159 - DNA, 25 bp, Mus musculus
tcattctagtgtgtgcttggcactg

SEQ ID NO: 770160 - DNA, 25 bp, Mus musculus
tcattctatgagaactgctcccgcc

SEQ ID NO: 770161 - DNA, 25 bp, Mus musculus
tcattctatgagtactgctcccgcc

SEQ ID NO: 770162 - DNA, 25 bp, Mus musculus
tcattctcctaacgtgggccagcct

SEQ ID NO: 770163 - DNA, 25 bp, Mus musculus
tcattctcctaaggtgggccagcct

SEQ ID NO: 770164 - DNA, 25 bp, Mus musculus
tcattctcggagagactgccgggcg

SEQ ID NO: 770165 - DNA, 25 bp, Mus musculus
tcattctcggagtgactgccgggcg

SEQ ID NO: 770166 - DNA, 25 bp, Mus musculus
tcattctgattgcacggcggttgac

SEQ ID NO: 770167 - DNA, 25 bp, Mus musculus
tcattctgattggacggcggttgac

SEQ ID NO: 770168 - DNA, 25 bp, Mus musculus
tcattctgcagaagggtgctggcac

SEQ ID NO: 770169 - DNA, 25 bp, Mus musculus
tcattctgcagatgggtgctggcac

SEQ ID NO: 770170 - DNA, 25 bp, Mus musculus
tcattctgtacaactaccgccacgg

SEQ ID NO: 770171 - DNA, 25 bp, Mus musculus
tcattctgtacatctaccgccacgg

SEQ ID NO: 770172 - DNA, 25 bp, Mus musculus
tcattctgtacgaagggctcctggg

SEQ ID NO: 770173 - DNA, 25 bp, Mus musculus
tcattctgtacgtagggctcctggg

SEQ ID NO: 770174 - DNA, 25 bp, Mus musculus
tcattctgtctccagatctgggagc

SEQ ID NO: 770175 - DNA, 25 bp, Mus musculus
tcattctgtctcgagatctgggagc

SEQ ID NO: 770176 - DNA, 25 bp, Mus musculus
tcattctgtggactcttcgcttacg

SEQ ID NO: 770177 - DNA, 25 bp, Mus musculus
tcattctgtggagtcttcgcttacg

SEQ ID NO: 770178 - DNA, 25 bp, Mus musculus
tcattcttatgtacctatgctgaga

SEQ ID NO: 770179 - DNA, 25 bp, Mus musculus
tcattcttatgttcctatgctgaga

SEQ ID NO: 770180 - DNA, 25 bp, Mus musculus
tcattctttcctacagtgagaggcc

SEQ ID NO: 770181 - DNA, 25 bp, Mus musculus
tcattctttcctccttggcgacttt

SEQ ID NO: 770182 - DNA, 25 bp, Mus musculus
tcattctttcctgcttggcgacttt

SEQ ID NO: 770183 - DNA, 25 bp, Mus musculus
tcattctttccttcagtgagaggcc

SEQ ID NO: 770184 - DNA, 25 bp, Mus musculus
tcattctttgcaacttgatcctggg

SEQ ID NO: 770185 - DNA, 25 bp, Mus musculus
tcattctttgcatcttgatcctggg

SEQ ID NO: 770186 - DNA, 25 bp, Mus musculus
tcattcttttaactggagtgtgaag

SEQ ID NO: 770187 - DNA, 25 bp, Mus musculus
tcattcttttaagtggagtgtgaag

SEQ ID NO: 770188 - DNA, 25 bp, Mus musculus
tcattgaaacggaaaaaactctcta

SEQ ID NO: 770189 - DNA, 25 bp, Mus musculus
tcattgaaacggtaaaaactctcta

SEQ ID NO: 770190 - DNA, 25 bp, Mus musculus
tcattgaaagcccagcccaaaaaga

SEQ ID NO: 770191 - DNA, 25 bp, Mus musculus
tcattgaaagccgagcccaaaaaga

SEQ ID NO: 770192 - DNA, 25 bp, Mus musculus
tcattgaacgggaccggacctacct

SEQ ID NO: 770193 - DNA, 25 bp, Mus musculus
tcattgaacgggtccggacctacct

SEQ ID NO: 770194 - DNA, 25 bp, Mus musculus
tcattgaacttgaccggcagaacaa

SEQ ID NO: 770195 - DNA, 25 bp, Mus musculus
tcattgaacttgtccggcagaacaa

SEQ ID NO: 770196 - DNA, 25 bp, Mus musculus
tcattgaataggaagaacattgatc

SEQ ID NO: 770197 - DNA, 25 bp, Mus musculus
tcattgaataggtagaacattgatc

SEQ ID NO: 770198 - DNA, 25 bp, Mus musculus
tcattgaatatgacggcgagttttc

SEQ ID NO: 770199 - DNA, 25 bp, Mus musculus
tcattgaatatgtcggcgagttttc

SEQ ID NO: 770200 - DNA, 25 bp, Mus musculus
tcattgacaactctaagcttgttac

SEQ ID NO: 770201 - DNA, 25 bp, Mus musculus
tcattgacaactgtaagcttgttac

SEQ ID NO: 770202 - DNA, 25 bp, Mus musculus
tcattgacacgaagtatggacacct

SEQ ID NO: 770203 - DNA, 25 bp, Mus musculus
tcattgacacgatgtatggacacct

SEQ ID NO: 770204 - DNA, 25 bp, Mus musculus
tcattgacagccagcatgtcatcca

SEQ ID NO: 770205 - DNA, 25 bp, Mus musculus
tcattgacagcctgcatgtcatcca

SEQ ID NO: 770206 - DNA, 25 bp, Mus musculus
tcattgacatgaccaaggagtctac

SEQ ID NO: 770207 - DNA, 25 bp, Mus musculus
tcattgacatgagcaaggagtctac

SEQ ID NO: 770208 - DNA, 25 bp, Mus musculus
tcattgaccacactggcgtccggct

SEQ ID NO: 770209 - DNA, 25 bp, Mus musculus
tcattgaccacagtggcgtccggct

SEQ ID NO: 770210 - DNA, 25 bp, Mus musculus
tcattgacccgtcagaccgagcgta

SEQ ID NO: 770211 - DNA, 25 bp, Mus musculus
tcattgacccgtgagaccgagcgta

SEQ ID NO: 770212 - DNA, 25 bp, Mus musculus
tcattgaccctaaaaaggctatggc

SEQ ID NO: 770213 - DNA, 25 bp, Mus musculus
tcattgaccctataaaggctatggc

SEQ ID NO: 770214 - DNA, 25 bp, Mus musculus
tcattgacgagaacgggaagatgga

SEQ ID NO: 770215 - DNA, 25 bp, Mus musculus
tcattgacgagatcgggaagatgga

SEQ ID NO: 770216 - DNA, 25 bp, Mus musculus
tcattgacggagcatgaggccacgc

SEQ ID NO: 770217 - DNA, 25 bp, Mus musculus
tcattgacggaggatgaggccacgc

SEQ ID NO: 770218 - DNA, 25 bp, Mus musculus
tcattgactcccctgtgcaggagag

SEQ ID NO: 770219 - DNA, 25 bp, Mus musculus
tcattgactcccgtgtgcaggagag

SEQ ID NO: 770220 - DNA, 25 bp, Mus musculus
tcattgagaaaaatgggaagttgcg

SEQ ID NO: 770221 - DNA, 25 bp, Mus musculus
tcattgagaaaattgggaagttgcg

SEQ ID NO: 770222 - DNA, 25 bp, Mus musculus
tcattgagacttacgacatcgcccg

SEQ ID NO: 770223 - DNA, 25 bp, Mus musculus
tcattgagactttcgacatcgcccg

SEQ ID NO: 770224 - DNA, 25 bp, Mus musculus
tcattgagattgaggcctgtgttcc

SEQ ID NO: 770225 - DNA, 25 bp, Mus musculus
tcattgagattgtggcctgtgttcc

SEQ ID NO: 770226 - DNA, 25 bp, Mus musculus
tcattgagcatgatcgagacggcag

SEQ ID NO: 770227 - DNA, 25 bp, Mus musculus
tcattgagcatgttcgagacggcag

SEQ ID NO: 770228 - DNA, 25 bp, Mus musculus
tcattgagccctatgacgacaggac

SEQ ID NO: 770229 - DNA, 25 bp, Mus musculus
tcattgagccctttgacgacaggac

SEQ ID NO: 770230 - DNA, 25 bp, Mus musculus
tcattgagctcacccgacaaggcaa

SEQ ID NO: 770231 - DNA, 25 bp, Mus musculus
tcattgagctcagccgacaaggcaa

SEQ ID NO: 770232 - DNA, 25 bp, Mus musculus
tcattgaggagtatgtgcagcactt

SEQ ID NO: 770233 - DNA, 25 bp, Mus musculus
tcattgaggagtttgtgcagcactt

SEQ ID NO: 770234 - DNA, 25 bp, Mus musculus
tcattgaggatgacatgaggcccga

SEQ ID NO: 770235 - DNA, 25 bp, Mus musculus
tcattgaggatgtcatgaggcccga

SEQ ID NO: 770236 - DNA, 25 bp, Mus musculus
tcattgaggcaaagggcaaggccga

SEQ ID NO: 770237 - DNA, 25 bp, Mus musculus
tcattgaggcaatgggcaaggccga

SEQ ID NO: 770238 - DNA, 25 bp, Mus musculus
tcattgaggtggcacagaagctgtt

SEQ ID NO: 770239 - DNA, 25 bp, Mus musculus
tcattgaggtgggacagaagctgtt

SEQ ID NO: 770240 - DNA, 25 bp, Mus musculus
tcattgagtgcactgactttgaagg

SEQ ID NO: 770241 - DNA, 25 bp, Mus musculus
tcattgagtgcagtgactttgaagg

SEQ ID NO: 770242 - DNA, 25 bp, Mus musculus
tcattgatgaagactgtgggcccac

SEQ ID NO: 770243 - DNA, 25 bp, Mus musculus
tcattgatgaagtctgtgggcccac

SEQ ID NO: 770244 - DNA, 25 bp, Mus musculus
tcattgcaagtcagaaaggccaagg

SEQ ID NO: 770245 - DNA, 25 bp, Mus musculus
tcattgcaagtctgaaaggccaagg

SEQ ID NO: 770246 - DNA, 25 bp, Mus musculus
tcattgcagagaaacacaggaacaa

SEQ ID NO: 770247 - DNA, 25 bp, Mus musculus
tcattgcagagatacacaggaacaa

SEQ ID NO: 770248 - DNA, 25 bp, Mus musculus
tcattgcagcctcttgggccgcctt

SEQ ID NO: 770249 - DNA, 25 bp, Mus musculus
tcattgcagcctgttgggccgcctt

SEQ ID NO: 770250 - DNA, 25 bp, Mus musculus
tcattgcagcttactagaggtcccc

SEQ ID NO: 770251 - DNA, 25 bp, Mus musculus
tcattgcagctttctagaggtcccc

SEQ ID NO: 770252 - DNA, 25 bp, Mus musculus
tcattgcaggccctgtgtcaccctg

SEQ ID NO: 770253 - DNA, 25 bp, Mus musculus
tcattgcaggccgtgtgtcaccctg

SEQ ID NO: 770254 - DNA, 25 bp, Mus musculus
tcattgccaatgagcgtgcggtctt

SEQ ID NO: 770255 - DNA, 25 bp, Mus musculus
tcattgccaatgtgcgtgcggtctt

SEQ ID NO: 770256 - DNA, 25 bp, Mus musculus
tcattgccatgtcccagggtgtgga

SEQ ID NO: 770257 - DNA, 25 bp, Mus musculus
tcattgccatgtgccagggtgtgga

SEQ ID NO: 770258 - DNA, 25 bp, Mus musculus
tcattgccattaaccccagtgtgcc

SEQ ID NO: 770259 - DNA, 25 bp, Mus musculus
tcattgccattatccccagtgtgcc

SEQ ID NO: 770260 - DNA, 25 bp, Mus musculus
tcattgccccgacaggacattcgct

SEQ ID NO: 770261 - DNA, 25 bp, Mus musculus
tcattgccccgagaggacattcgct

SEQ ID NO: 770262 - DNA, 25 bp, Mus musculus
tcattgcctacccaaaagctgtaac

SEQ ID NO: 770263 - DNA, 25 bp, Mus musculus
tcattgcctaccgaaaagctgtaac

SEQ ID NO: 770264 - DNA, 25 bp, Mus musculus
tcattgcctgccagctcttcgggtt

SEQ ID NO: 770265 - DNA, 25 bp, Mus musculus
tcattgcctgcctgctcttcgggtt

SEQ ID NO: 770266 - DNA, 25 bp, Mus musculus
tcattgcgcgcacagacctgaagaa

SEQ ID NO: 770267 - DNA, 25 bp, Mus musculus
tcattgcgcgcagagacctgaagaa

SEQ ID NO: 770268 - DNA, 25 bp, Mus musculus
tcattgcggactcctccaaagccgt

SEQ ID NO: 770269 - DNA, 25 bp, Mus musculus
tcattgcggactgctccaaagccgt

SEQ ID NO: 770270 - DNA, 25 bp, Mus musculus
tcattgcgtgctcccatgatcagag

SEQ ID NO: 770271 - DNA, 25 bp, Mus musculus
tcattgcgtgctgccatgatcagag

SEQ ID NO: 770272 - DNA, 25 bp, Mus musculus
tcattgctcaagcaaacaggaactc

SEQ ID NO: 770273 - DNA, 25 bp, Mus musculus
tcattgctcaaggaaacaggaactc

SEQ ID NO: 770274 - DNA, 25 bp, Mus musculus
tcattgctcagtccccggaccttaa

SEQ ID NO: 770275 - DNA, 25 bp, Mus musculus
tcattgctcagtgcccggaccttaa

SEQ ID NO: 770276 - DNA, 25 bp, Mus musculus
tcattgctgagaagtacctgtgagc

SEQ ID NO: 770277 - DNA, 25 bp, Mus musculus
tcattgctgagatgtacctgtgagc

SEQ ID NO: 770278 - DNA, 25 bp, Mus musculus
tcattgctgcagaatactagatctc

SEQ ID NO: 770279 - DNA, 25 bp, Mus musculus
tcattgctgcagtatactagatctc

SEQ ID NO: 770280 - DNA, 25 bp, Mus musculus
tcattgctgcatcagtggccgccat

SEQ ID NO: 770281 - DNA, 25 bp, Mus musculus
tcattgctgcatgagtggccgccat

SEQ ID NO: 770282 - DNA, 25 bp, Mus musculus
tcattgctggagaggcatttggaat

SEQ ID NO: 770283 - DNA, 25 bp, Mus musculus
tcattgctggagtggcatttggaat

SEQ ID NO: 770284 - DNA, 25 bp, Mus musculus
tcattgctggcaacctggcctatgt

SEQ ID NO: 770285 - DNA, 25 bp, Mus musculus
tcattgctggcatcctggcctatgt

SEQ ID NO: 770286 - DNA, 25 bp, Mus musculus
tcattgcttacgatgtgcttgagag

SEQ ID NO: 770287 - DNA, 25 bp, Mus musculus
tcattgcttacgttgtgcttgagag

SEQ ID NO: 770288 - DNA, 25 bp, Mus musculus
tcattgcttcttacccttgactccg

SEQ ID NO: 770289 - DNA, 25 bp, Mus musculus
tcattgcttctttcccttgactccg

SEQ ID NO: 770290 - DNA, 25 bp, Mus musculus
tcattgcttgttcacaggatgggaa

SEQ ID NO: 770291 - DNA, 25 bp, Mus musculus
tcattgcttgttgacaggatgggaa

SEQ ID NO: 770292 - DNA, 25 bp, Mus musculus
tcattggaaccaaggtcgaccgggc

SEQ ID NO: 770293 - DNA, 25 bp, Mus musculus
tcattggaaccatggtcgaccgggc

SEQ ID NO: 770294 - DNA, 25 bp, Mus musculus
tcattggacctcctgagatgcagat

SEQ ID NO: 770295 - DNA, 25 bp, Mus musculus
tcattggacctcgtgagatgcagat

SEQ ID NO: 770296 - DNA, 25 bp, Mus musculus
tcattggactgcacagaggactctg

SEQ ID NO: 770297 - DNA, 25 bp, Mus musculus
tcattggactgctcagaggactctg

SEQ ID NO: 770298 - DNA, 25 bp, Mus musculus
tcattggagcagatctccgagacct

SEQ ID NO: 770299 - DNA, 25 bp, Mus musculus
tcattggagcagttctccgagacct

SEQ ID NO: 770300 - DNA, 25 bp, Mus musculus
tcattggaggaacgaaccatcaagt

SEQ ID NO: 770301 - DNA, 25 bp, Mus musculus
tcattggaggaaggaaccatcaagt

SEQ ID NO: 770302 - DNA, 25 bp, Mus musculus
tcattggcctcacaatttggtatcc

SEQ ID NO: 770303 - DNA, 25 bp, Mus musculus
tcattggcctcagaatttggtatcc

SEQ ID NO: 770304 - DNA, 25 bp, Mus musculus
tcattggcctgaccgtagttgtgac

SEQ ID NO: 770305 - DNA, 25 bp, Mus musculus
tcattggcctgagcgtagttgtgac

SEQ ID NO: 770306 - DNA, 25 bp, Mus musculus
tcattggcggccacgccgggaagac

SEQ ID NO: 770307 - DNA, 25 bp, Mus musculus
tcattggcggcctcgccgggaagac

SEQ ID NO: 770308 - DNA, 25 bp, Mus musculus
tcattggctaaacagaagacttgga

SEQ ID NO: 770309 - DNA, 25 bp, Mus musculus
tcattggctaaagagaagacttgga

SEQ ID NO: 770310 - DNA, 25 bp, Mus musculus
tcattggctagtcctgggcactcat

SEQ ID NO: 770311 - DNA, 25 bp, Mus musculus
tcattggctagtgctgggcactcat

SEQ ID NO: 770312 - DNA, 25 bp, Mus musculus
tcattggctggaagtacctgccacc

SEQ ID NO: 770313 - DNA, 25 bp, Mus musculus
tcattggctggatgtacctgccacc

SEQ ID NO: 770314 - DNA, 25 bp, Mus musculus
tcattggctggcagcacatggatgg

SEQ ID NO: 770315 - DNA, 25 bp, Mus musculus
tcattggctggctgcacatggatgg

SEQ ID NO: 770316 - DNA, 25 bp, Mus musculus
tcattgggaagaagcacgtgggtcc

SEQ ID NO: 770317 - DNA, 25 bp, Mus musculus
tcattgggaagatgcacgtgggtcc

SEQ ID NO: 770318 - DNA, 25 bp, Mus musculus
tcattgggacgcagtcgtggaaacc

SEQ ID NO: 770319 - DNA, 25 bp, Mus musculus
tcattgggacgctgtcgtggaaacc

SEQ ID NO: 770320 - DNA, 25 bp, Mus musculus
tcattgggacttagcagaactctgc

SEQ ID NO: 770321 - DNA, 25 bp, Mus musculus
tcattgggactttgcagaactctgc

SEQ ID NO: 770322 - DNA, 25 bp, Mus musculus
tcattgggcaggaatatgcggatcc

SEQ ID NO: 770323 - DNA, 25 bp, Mus musculus
tcattgggcaggtatatgcggatcc

SEQ ID NO: 770324 - DNA, 25 bp, Mus musculus
tcattgggtgaaagaaagtagaagc

SEQ ID NO: 770325 - DNA, 25 bp, Mus musculus
tcattgggtgaatgaaagtagaagc

SEQ ID NO: 770326 - DNA, 25 bp, Mus musculus
tcattgggttccaactgtgtgttct

SEQ ID NO: 770327 - DNA, 25 bp, Mus musculus
tcattgggttcctactgtgtgttct

SEQ ID NO: 770328 - DNA, 25 bp, Mus musculus
tcattggtacagcagtcatgtggca

SEQ ID NO: 770329 - DNA, 25 bp, Mus musculus
tcattggtacaggagtcatgtggca

SEQ ID NO: 770330 - DNA, 25 bp, Mus musculus
tcattggtatggagagaaaatcttg

SEQ ID NO: 770331 - DNA, 25 bp, Mus musculus
tcattggtatggtgagaaaatcttg

SEQ ID NO: 770332 - DNA, 25 bp, Mus musculus
tcattggtcggacctgggctatgct

SEQ ID NO: 770333 - DNA, 25 bp, Mus musculus
tcattggtcggagctgggctatgct

SEQ ID NO: 770334 - DNA, 25 bp, Mus musculus
tcattggtcgggatgtgtctgctca

SEQ ID NO: 770335 - DNA, 25 bp, Mus musculus
tcattggtcgggttgtgtctgctca

SEQ ID NO: 770336 - DNA, 25 bp, Mus musculus
tcattggtgaaaacagcatgcacca

SEQ ID NO: 770337 - DNA, 25 bp, Mus musculus
tcattggtgaaatcagcatgcacca

SEQ ID NO: 770338 - DNA, 25 bp, Mus musculus
tcattggtgcggctgtcctaaaccc

SEQ ID NO: 770339 - DNA, 25 bp, Mus musculus
tcattggtgcgggtgtcctaaaccc

SEQ ID NO: 770340 - DNA, 25 bp, Mus musculus
tcattggtgtggagagtcaggaacc

SEQ ID NO: 770341 - DNA, 25 bp, Mus musculus
tcattggtgtggtgagtcaggaacc

SEQ ID NO: 770342 - DNA, 25 bp, Mus musculus
tcattggtgtttagccagcctgctc

SEQ ID NO: 770343 - DNA, 25 bp, Mus musculus
tcattggtgttttgccagcctgctc

SEQ ID NO: 770344 - DNA, 25 bp, Mus musculus
tcattggttatgagatgatctccac

SEQ ID NO: 770345 - DNA, 25 bp, Mus musculus
tcattggttatgtgatgatctccac

SEQ ID NO: 770346 - DNA, 25 bp, Mus musculus
tcattgtacgaacgagggaactgca

SEQ ID NO: 770347 - DNA, 25 bp, Mus musculus
tcattgtacgaaggagggaactgca

SEQ ID NO: 770348 - DNA, 25 bp, Mus musculus
tcattgtactaccaaagtgaggagc

SEQ ID NO: 770349 - DNA, 25 bp, Mus musculus
tcattgtactacgaaagtgaggagc

SEQ ID NO: 770350 - DNA, 25 bp, Mus musculus
tcattgtactgtcacagcacctggg

SEQ ID NO: 770351 - DNA, 25 bp, Mus musculus
tcattgtactgtgacagcacctggg

SEQ ID NO: 770352 - DNA, 25 bp, Mus musculus
tcattgtcacaaaggcgatccactc

SEQ ID NO: 770353 - DNA, 25 bp, Mus musculus
tcattgtcacaatggcgatccactc

SEQ ID NO: 770354 - DNA, 25 bp, Mus musculus
tcattgtcacggaggagaactacgt

SEQ ID NO: 770355 - DNA, 25 bp, Mus musculus
tcattgtcacggtggagaactacgt

SEQ ID NO: 770356 - DNA, 25 bp, Mus musculus
tcattgtcagcaaggtctcctccgg

SEQ ID NO: 770357 - DNA, 25 bp, Mus musculus
tcattgtcagcatggtctcctccgg

SEQ ID NO: 770358 - DNA, 25 bp, Mus musculus
tcattgtcgacaccctcgagcttcg

SEQ ID NO: 770359 - DNA, 25 bp, Mus musculus
tcattgtcgacagcctcgagcttcg

SEQ ID NO: 770360 - DNA, 25 bp, Mus musculus
tcattgtcggcaagggtttccagta

SEQ ID NO: 770361 - DNA, 25 bp, Mus musculus
tcattgtcggcatgggtttccagta

SEQ ID NO: 770362 - DNA, 25 bp, Mus musculus
tcattgtctactccgtcaccgacaa

SEQ ID NO: 770363 - DNA, 25 bp, Mus musculus
tcattgtctactgcgtcaccgacaa

SEQ ID NO: 770364 - DNA, 25 bp, Mus musculus
tcattgtctgttcgagcaggaggcc

SEQ ID NO: 770365 - DNA, 25 bp, Mus musculus
tcattgtctgttggagcaggaggcc

SEQ ID NO: 770366 - DNA, 25 bp, Mus musculus
tcattgtgatgccaagcatatccga

SEQ ID NO: 770367 - DNA, 25 bp, Mus musculus
tcattgtgatgcgaagcatatccga

SEQ ID NO: 770368 - DNA, 25 bp, Mus musculus
tcattgtgctggaagagaccatagc

SEQ ID NO: 770369 - DNA, 25 bp, Mus musculus
tcattgtgctggtagagaccatagc

SEQ ID NO: 770370 - DNA, 25 bp, Mus musculus
tcattgtggccgatctctctgctgt

SEQ ID NO: 770371 - DNA, 25 bp, Mus musculus
tcattgtggccgttctctctgctgt

SEQ ID NO: 770372 - DNA, 25 bp, Mus musculus
tcattgtgttggaaacaggcccaca

SEQ ID NO: 770373 - DNA, 25 bp, Mus musculus
tcattgtgttggtaacaggcccaca

SEQ ID NO: 770374 - DNA, 25 bp, Mus musculus
tcattgttcactccatgcgccagaa

SEQ ID NO: 770375 - DNA, 25 bp, Mus musculus
tcattgttcactgcatgcgccagaa

SEQ ID NO: 770376 - DNA, 25 bp, Mus musculus
tcattgttcattccttccaaacttg

SEQ ID NO: 770377 - DNA, 25 bp, Mus musculus
tcattgttcattgcttccaaacttg

SEQ ID NO: 770378 - DNA, 25 bp, Mus musculus
tcattgttgctaacacgatgccctc

SEQ ID NO: 770379 - DNA, 25 bp, Mus musculus
tcattgttgctatcacgatgccctc

SEQ ID NO: 770380 - DNA, 25 bp, Mus musculus
tcattgttttctacacccttgggag

SEQ ID NO: 770381 - DNA, 25 bp, Mus musculus
tcattgttttcttcacccttgggag

SEQ ID NO: 770382 - DNA, 25 bp, Mus musculus
tcatttaacccaatcacttgaggaa

SEQ ID NO: 770383 - DNA, 25 bp, Mus musculus
tcatttaacccattcacttgaggaa

SEQ ID NO: 770384 - DNA, 25 bp, Mus musculus
tcatttaacctaaaccccgagtgtg

SEQ ID NO: 770385 - DNA, 25 bp, Mus musculus
tcatttaacctataccccgagtgtg

SEQ ID NO: 770386 - DNA, 25 bp, Mus musculus
tcatttaagcaccactgacctgcgg

SEQ ID NO: 770387 - DNA, 25 bp, Mus musculus
tcatttaagcacgactgacctgcgg

SEQ ID NO: 770388 - DNA, 25 bp, Mus musculus
tcatttacaccgagtttggcaagat

SEQ ID NO: 770389 - DNA, 25 bp, Mus musculus
tcatttacaccgtgtttggcaagat

SEQ ID NO: 770390 - DNA, 25 bp, Mus musculus
tcatttactcgtatggcttctccac

SEQ ID NO: 770391 - DNA, 25 bp, Mus musculus
tcatttactcgtttggcttctccac

SEQ ID NO: 770392 - DNA, 25 bp, Mus musculus
tcatttcaaaccattgtgggccagg

SEQ ID NO: 770393 - DNA, 25 bp, Mus musculus
tcatttcaaacctttgtgggccagg

SEQ ID NO: 770394 - DNA, 25 bp, Mus musculus
tcatttcagggacggagattaaaaa

SEQ ID NO: 770395 - DNA, 25 bp, Mus musculus
tcatttcagggagggagattaaaaa

SEQ ID NO: 770396 - DNA, 25 bp, Mus musculus
tcatttcattaaaacagcccaaccc

SEQ ID NO: 770397 - DNA, 25 bp, Mus musculus
tcatttcattaatacagcccaaccc

SEQ ID NO: 770398 - DNA, 25 bp, Mus musculus
tcatttccactgcatctctcgatgg

SEQ ID NO: 770399 - DNA, 25 bp, Mus musculus
tcatttccactggatctctcgatgg

SEQ ID NO: 770400 - DNA, 25 bp, Mus musculus
tcatttccaggacggtgtgcacaac

SEQ ID NO: 770401 - DNA, 25 bp, Mus musculus
tcatttccaggagggtgtgcacaac

SEQ ID NO: 770402 - DNA, 25 bp, Mus musculus
tcatttcccaagagcaggtctccag

SEQ ID NO: 770403 - DNA, 25 bp, Mus musculus
tcatttcccaagtgcaggtctccag

SEQ ID NO: 770404 - DNA, 25 bp, Mus musculus
tcatttcccagaaggatgagcactg

SEQ ID NO: 770405 - DNA, 25 bp, Mus musculus
tcatttcccagatggatgagcactg

SEQ ID NO: 770406 - DNA, 25 bp, Mus musculus
tcatttccctcaaggatggctacgt

SEQ ID NO: 770407 - DNA, 25 bp, Mus musculus
tcatttccctcatggatggctacgt

SEQ ID NO: 770408 - DNA, 25 bp, Mus musculus
tcatttcctcttcgcttctattctg

SEQ ID NO: 770409 - DNA, 25 bp, Mus musculus
tcatttcctcttggcttctattctg

SEQ ID NO: 770410 - DNA, 25 bp, Mus musculus
tcatttcgaagtctttgacctcaac

SEQ ID NO: 770411 - DNA, 25 bp, Mus musculus
tcatttcgaagtgtttgacctcaac

SEQ ID NO: 770412 - DNA, 25 bp, Mus musculus
tcatttcgcttgaaattggctttgc

SEQ ID NO: 770413 - DNA, 25 bp, Mus musculus
tcatttcgcttgtaattggctttgc

SEQ ID NO: 770414 - DNA, 25 bp, Mus musculus
tcatttctagtcatcctcagctgct

SEQ ID NO: 770415 - DNA, 25 bp, Mus musculus
tcatttctagtcttcctcagctgct

SEQ ID NO: 770416 - DNA, 25 bp, Mus musculus
tcatttctggttcccgctggtccca

SEQ ID NO: 770417 - DNA, 25 bp, Mus musculus
tcatttctggttgccgctggtccca

SEQ ID NO: 770418 - DNA, 25 bp, Mus musculus
tcatttgaagataccagaaatctca

SEQ ID NO: 770419 - DNA, 25 bp, Mus musculus
tcatttgaagattccagaaatctca

SEQ ID NO: 770420 - DNA, 25 bp, Mus musculus
tcatttgaagctcatcaatgccgtt

SEQ ID NO: 770421 - DNA, 25 bp, Mus musculus
tcatttgaagctgatcaatgccgtt

SEQ ID NO: 770422 - DNA, 25 bp, Mus musculus
tcatttgacagcactgttggagtag

SEQ ID NO: 770423 - DNA, 25 bp, Mus musculus
tcatttgacagctctgttggagtag

SEQ ID NO: 770424 - DNA, 25 bp, Mus musculus
tcatttgagtgtcaggccaggaaac

SEQ ID NO: 770425 - DNA, 25 bp, Mus musculus
tcatttgagtgtgaggccaggaaac

SEQ ID NO: 770426 - DNA, 25 bp, Mus musculus
tcatttgctcaccagactatcagtg

SEQ ID NO: 770427 - DNA, 25 bp, Mus musculus
tcatttgctcacgagactatcagtg

SEQ ID NO: 770428 - DNA, 25 bp, Mus musculus
tcatttgctcggctgctggtagtca

SEQ ID NO: 770429 - DNA, 25 bp, Mus musculus
tcatttgctcgggtgctggtagtca

SEQ ID NO: 770430 - DNA, 25 bp, Mus musculus
tcatttgctgttcgaaagtcggaca

SEQ ID NO: 770431 - DNA, 25 bp, Mus musculus
tcatttgctgttggaaagtcggaca

SEQ ID NO: 770432 - DNA, 25 bp, Mus musculus
tcatttggcagaagcatgtgaaatc

SEQ ID NO: 770433 - DNA, 25 bp, Mus musculus
tcatttggcagatgcatgtgaaatc

SEQ ID NO: 770434 - DNA, 25 bp, Mus musculus
tcatttgggaacaagtaacagaaac

SEQ ID NO: 770435 - DNA, 25 bp, Mus musculus
tcatttgggaactagtaacagaaac

SEQ ID NO: 770436 - DNA, 25 bp, Mus musculus
tcatttggtgtcaatgctatgtcag

SEQ ID NO: 770437 - DNA, 25 bp, Mus musculus
tcatttggtgtctatgctatgtcag

SEQ ID NO: 770438 - DNA, 25 bp, Mus musculus
tcatttgtcaatcagcagctcccag

SEQ ID NO: 770439 - DNA, 25 bp, Mus musculus
tcatttgtcaatgagcagctcccag

SEQ ID NO: 770440 - DNA, 25 bp, Mus musculus
tcatttgtctcacagaacagcgtgg

SEQ ID NO: 770441 - DNA, 25 bp, Mus musculus
tcatttgtctcagagaacagcgtgg

SEQ ID NO: 770442 - DNA, 25 bp, Mus musculus
tcattttactgtagatgaaggcaaa

SEQ ID NO: 770443 - DNA, 25 bp, Mus musculus
tcattttactgttgatgaaggcaaa

SEQ ID NO: 770444 - DNA, 25 bp, Mus musculus
tcattttcaaccctctcagcacagt

SEQ ID NO: 770445 - DNA, 25 bp, Mus musculus
tcattttcaaccgtctcagcacagt

SEQ ID NO: 770446 - DNA, 25 bp, Mus musculus
tcattttccacaaggctgctgctgg

SEQ ID NO: 770447 - DNA, 25 bp, Mus musculus
tcattttccacatggctgctgctgg

SEQ ID NO: 770448 - DNA, 25 bp, Mus musculus
tcattttccatgctgtaatgggcaa

SEQ ID NO: 770449 - DNA, 25 bp, Mus musculus
tcattttccatggtgtaatgggcaa

SEQ ID NO: 770450 - DNA, 25 bp, Mus musculus
tcattttcgtgcatgtagctagccc

SEQ ID NO: 770451 - DNA, 25 bp, Mus musculus
tcattttcgtgcttgtagctagccc

SEQ ID NO: 770452 - DNA, 25 bp, Mus musculus
tcattttctatgaattactcacacg

SEQ ID NO: 770453 - DNA, 25 bp, Mus musculus
tcattttctatgtattactcacacg

SEQ ID NO: 770454 - DNA, 25 bp, Mus musculus
tcattttctccaacggtgacctaga

SEQ ID NO: 770455 - DNA, 25 bp, Mus musculus
tcattttctccatcggtgacctaga

SEQ ID NO: 770456 - DNA, 25 bp, Mus musculus
tcattttgaccaacgtgaatctcag

SEQ ID NO: 770457 - DNA, 25 bp, Mus musculus
tcattttgaccatcgtgaatctcag

SEQ ID NO: 770458 - DNA, 25 bp, Mus musculus
tcattttgccataattagtcacagc

SEQ ID NO: 770459 - DNA, 25 bp, Mus musculus
tcattttgccattattagtcacagc

SEQ ID NO: 770460 - DNA, 25 bp, Mus musculus
tcattttggagaagcttaaccatgg

SEQ ID NO: 770461 - DNA, 25 bp, Mus musculus
tcattttggagatgcttaaccatgg

SEQ ID NO: 770462 - DNA, 25 bp, Mus musculus
tcatttttaatacggtggtcctgga

SEQ ID NO: 770463 - DNA, 25 bp, Mus musculus
tcatttttaatagggtggtcctgga

SEQ ID NO: 770464 - DNA, 25 bp, Mus musculus
tcatttttagataacctccctagtg

SEQ ID NO: 770465 - DNA, 25 bp, Mus musculus
tcatttttagattacctccctagtg

SEQ ID NO: 770466 - DNA, 25 bp, Mus musculus
tcatttttcactcggaacaaaagca

SEQ ID NO: 770467 - DNA, 25 bp, Mus musculus
tcatttttcactgggaacaaaagca

SEQ ID NO: 770468 - DNA, 25 bp, Mus musculus
tcatttttcggtagataaaccaagt

SEQ ID NO: 770469 - DNA, 25 bp, Mus musculus
tcatttttcggttgataaaccaagt

SEQ ID NO: 770470 - DNA, 25 bp, Mus musculus
tcatttttgaatcaacatcttttcc

SEQ ID NO: 770471 - DNA, 25 bp, Mus musculus
tcatttttgaatgaacatcttttcc

SEQ ID NO: 770472 - DNA, 25 bp, Mus musculus
tcatttttgagactgtattccccag

SEQ ID NO: 770473 - DNA, 25 bp, Mus musculus
tcatttttgagagtgtattccccag

SEQ ID NO: 770474 - DNA, 25 bp, Mus musculus
tcattttttcagaggcaggtagagc

SEQ ID NO: 770475 - DNA, 25 bp, Mus musculus
tcattttttcagtggcaggtagagc

SEQ ID NO: 770476 - DNA, 25 bp, Mus musculus
tccaaaaaaccaccatcaaagctga

SEQ ID NO: 770477 - DNA, 25 bp, Mus musculus
tccaaaaaaccagcatcaaagctga

SEQ ID NO: 770478 - DNA, 25 bp, Mus musculus
tccaaaaaccggcttcattatatga

SEQ ID NO: 770479 - DNA, 25 bp, Mus musculus
tccaaaaaccgggttcattatatga

SEQ ID NO: 770480 - DNA, 25 bp, Mus musculus
tccaaaaagaagcagtcactgaaga

SEQ ID NO: 770481 - DNA, 25 bp, Mus musculus
tccaaaaagaaggagtcactgaaga

SEQ ID NO: 770482 - DNA, 25 bp, Mus musculus
tccaaaaagatcaatcagagatgca

SEQ ID NO: 770483 - DNA, 25 bp, Mus musculus
tccaaaaagatctatcagagatgca

SEQ ID NO: 770484 - DNA, 25 bp, Mus musculus
tccaaaaaggaaagacgcttcacct

SEQ ID NO: 770485 - DNA, 25 bp, Mus musculus
tccaaaaaggaatgacgcttcacct

SEQ ID NO: 770486 - DNA, 25 bp, Mus musculus
tccaaaaagtacatggcaaaggcag

SEQ ID NO: 770487 - DNA, 25 bp, Mus musculus
tccaaaaagtacttggcaaaggcag

SEQ ID NO: 770488 - DNA, 25 bp, Mus musculus
tccaaaaatttgctcgccatgaaag

SEQ ID NO: 770489 - DNA, 25 bp, Mus musculus
tccaaaaatttggtcgccatgaaag

SEQ ID NO: 770490 - DNA, 25 bp, Mus musculus
tccaaaactgctccagaaggccagg

SEQ ID NO: 770491 - DNA, 25 bp, Mus musculus
tccaaaactgctgcagaaggccagg

SEQ ID NO: 770492 - DNA, 25 bp, Mus musculus
tccaaaagatatccaaagactcgga

SEQ ID NO: 770493 - DNA, 25 bp, Mus musculus
tccaaaagatatgcaaagactcgga

SEQ ID NO: 770494 - DNA, 25 bp, Mus musculus
tccaaaagatgaacacacattacgg

SEQ ID NO: 770495 - DNA, 25 bp, Mus musculus
tccaaaagatgactacaaacatagg

SEQ ID NO: 770496 - DNA, 25 bp, Mus musculus
tccaaaagatgagtacaaacatagg

SEQ ID NO: 770497 - DNA, 25 bp, Mus musculus
tccaaaagatgatcacacattacgg

SEQ ID NO: 770498 - DNA, 25 bp, Mus musculus
tccaaaagcggtagggagattacca

SEQ ID NO: 770499 - DNA, 25 bp, Mus musculus
tccaaaagcggttgggagattacca

SEQ ID NO: 770500 - DNA, 25 bp, Mus musculus
tccaaaagcgtcagagaagaaagtg

SEQ ID NO: 770501 - DNA, 25 bp, Mus musculus
tccaaaagcgtctgagaagaaagtg

SEQ ID NO: 770502 - DNA, 25 bp, Mus musculus
tccaaaagctaacaatgcagacatt

SEQ ID NO: 770503 - DNA, 25 bp, Mus musculus
tccaaaagctaagaatgcagacatt

SEQ ID NO: 770504 - DNA, 25 bp, Mus musculus
tccaaaagctcaacaccaatgtagc

SEQ ID NO: 770505 - DNA, 25 bp, Mus musculus
tccaaaagctcatcaccaatgtagc

SEQ ID NO: 770506 - DNA, 25 bp, Mus musculus
tccaaaagctcgaccagaattggct

SEQ ID NO: 770507 - DNA, 25 bp, Mus musculus
tccaaaagctcgtccagaattggct

SEQ ID NO: 770508 - DNA, 25 bp, Mus musculus
tccaaaaggaaacaggcggagcttc

SEQ ID NO: 770509 - DNA, 25 bp, Mus musculus
tccaaaaggaaagaggcggagcttc

SEQ ID NO: 770510 - DNA, 25 bp, Mus musculus
tccaaaaggatcaccgtagatgaag

SEQ ID NO: 770511 - DNA, 25 bp, Mus musculus
tccaaaaggatctccgtagatgaag

SEQ ID NO: 770512 - DNA, 25 bp, Mus musculus
tccaaaagtcaaccctgagccaagt

SEQ ID NO: 770513 - DNA, 25 bp, Mus musculus
tccaaaagtcaagcctgagccaagt

SEQ ID NO: 770514 - DNA, 25 bp, Mus musculus
tccaaaagtcatcagggtgagtgtc

SEQ ID NO: 770515 - DNA, 25 bp, Mus musculus
tccaaaagtcatgagggtgagtgtc

SEQ ID NO: 770516 - DNA, 25 bp, Mus musculus
tccaaaagtgagctacaggcaacca

SEQ ID NO: 770517 - DNA, 25 bp, Mus musculus
tccaaaagtgaggtacaggcaacca

SEQ ID NO: 770518 - DNA, 25 bp, Mus musculus
tccaaaatacagaggccctcagctg

SEQ ID NO: 770519 - DNA, 25 bp, Mus musculus
tccaaaatacagtggccctcagctg

SEQ ID NO: 770520 - DNA, 25 bp, Mus musculus
tccaaaatccagcaccgatagagga

SEQ ID NO: 770521 - DNA, 25 bp, Mus musculus
tccaaaatccaggaccgatagagga

SEQ ID NO: 770522 - DNA, 25 bp, Mus musculus
tccaaaatcgcccttggtggcctgt

SEQ ID NO: 770523 - DNA, 25 bp, Mus musculus
tccaaaatcgccgttggtggcctgt

SEQ ID NO: 770524 - DNA, 25 bp, Mus musculus
tccaaaatcttaactgactaaccct

SEQ ID NO: 770525 - DNA, 25 bp, Mus musculus
tccaaaatcttatctgactaaccct

SEQ ID NO: 770526 - DNA, 25 bp, Mus musculus
tccaaaatgattatgaaagcctcag

SEQ ID NO: 770527 - DNA, 25 bp, Mus musculus
tccaaaatgattttgaaagcctcag

SEQ ID NO: 770528 - DNA, 25 bp, Mus musculus
tccaaaatgctacaaagaagtatat

SEQ ID NO: 770529 - DNA, 25 bp, Mus musculus
tccaaaatgctagaaagaagtatat

SEQ ID NO: 770530 - DNA, 25 bp, Mus musculus
tccaaaatggctacggattttgcag

SEQ ID NO: 770531 - DNA, 25 bp, Mus musculus
tccaaaatggcttcggattttgcag

SEQ ID NO: 770532 - DNA, 25 bp, Mus musculus
tccaaaatgggactgatcaacaagg

SEQ ID NO: 770533 - DNA, 25 bp, Mus musculus
tccaaaatgggagtgatcaacaagg

SEQ ID NO: 770534 - DNA, 25 bp, Mus musculus
tccaaaattaagaacgattgtacag

SEQ ID NO: 770535 - DNA, 25 bp, Mus musculus
tccaaaattaagtacgattgtacag

SEQ ID NO: 770536 - DNA, 25 bp, Mus musculus
tccaaacaagccattaccatcggcg

SEQ ID NO: 770537 - DNA, 25 bp, Mus musculus
tccaaacaagcctttaccatcggcg

SEQ ID NO: 770538 - DNA, 25 bp, Mus musculus
tccaaacagcaacacagaccgaact

SEQ ID NO: 770539 - DNA, 25 bp, Mus musculus
tccaaacagcaagacagaccgaact

SEQ ID NO: 770540 - DNA, 25 bp, Mus musculus
tccaaacaggaaaacgaggagggag

SEQ ID NO: 770541 - DNA, 25 bp, Mus musculus
tccaaacaggaatacgaggagggag

SEQ ID NO: 770542 - DNA, 25 bp, Mus musculus
tccaaaccaagcagggtatggaatg

SEQ ID NO: 770543 - DNA, 25 bp, Mus musculus
tccaaaccaagctgggtatggaatg

SEQ ID NO: 770544 - DNA, 25 bp, Mus musculus
tccaaacccacacaggcggaactga

SEQ ID NO: 770545 - DNA, 25 bp, Mus musculus
tccaaacccacagaggcggaactga

SEQ ID NO: 770546 - DNA, 25 bp, Mus musculus
tccaaacccactcggatgtgaagag

SEQ ID NO: 770547 - DNA, 25 bp, Mus musculus
tccaaacccactgggatgtgaagag

SEQ ID NO: 770548 - DNA, 25 bp, Mus musculus
tccaaacctctgatacctcttcaaa

SEQ ID NO: 770549 - DNA, 25 bp, Mus musculus
tccaaacctctgttacctcttcaaa

SEQ ID NO: 770550 - DNA, 25 bp, Mus musculus
tccaaacgcagaaaggacatttccg

SEQ ID NO: 770551 - DNA, 25 bp, Mus musculus
tccaaacgcagataggacatttccg

SEQ ID NO: 770552 - DNA, 25 bp, Mus musculus
tccaaacggaaccttccaaaatgag

SEQ ID NO: 770553 - DNA, 25 bp, Mus musculus
tccaaacggaacgttccaaaatgag

SEQ ID NO: 770554 - DNA, 25 bp, Mus musculus
tccaaactaccacgcggagctgagg

SEQ ID NO: 770555 - DNA, 25 bp, Mus musculus
tccaaactaccaggcggagctgagg

SEQ ID NO: 770556 - DNA, 25 bp, Mus musculus
tccaaactcctcctcaagatgggct

SEQ ID NO: 770557 - DNA, 25 bp, Mus musculus
tccaaactcctcgtcaagatgggct

SEQ ID NO: 770558 - DNA, 25 bp, Mus musculus
tccaaactgtgaccgcaacggcaac

SEQ ID NO: 770559 - DNA, 25 bp, Mus musculus
tccaaactgtgagcgcaacggcaac

SEQ ID NO: 770560 - DNA, 25 bp, Mus musculus
tccaaacttcctactcactgataac

SEQ ID NO: 770561 - DNA, 25 bp, Mus musculus
tccaaacttccttctcactgataac

SEQ ID NO: 770562 - DNA, 25 bp, Mus musculus
tccaaagaaaccaatgagttcatac

SEQ ID NO: 770563 - DNA, 25 bp, Mus musculus
tccaaagaaacctatgagttcatac

SEQ ID NO: 770564 - DNA, 25 bp, Mus musculus
tccaaagaaatgcaagggacgctgc

SEQ ID NO: 770565 - DNA, 25 bp, Mus musculus
tccaaagaaatggaagggacgctgc

SEQ ID NO: 770566 - DNA, 25 bp, Mus musculus
tccaaagaatggctgattgtggaca

SEQ ID NO: 770567 - DNA, 25 bp, Mus musculus
tccaaagaatgggtgattgtggaca

SEQ ID NO: 770568 - DNA, 25 bp, Mus musculus
tccaaagacatcctggtaacttctg

SEQ ID NO: 770569 - DNA, 25 bp, Mus musculus
tccaaagacatcgtggtaacttctg

SEQ ID NO: 770570 - DNA, 25 bp, Mus musculus
tccaaagacatgcagatgaaattct

SEQ ID NO: 770571 - DNA, 25 bp, Mus musculus
tccaaagacatggagatgaaattct

SEQ ID NO: 770572 - DNA, 25 bp, Mus musculus
tccaaagacccaatgcacttgctgt

SEQ ID NO: 770573 - DNA, 25 bp, Mus musculus
tccaaagacccattgcacttgctgt

SEQ ID NO: 770574 - DNA, 25 bp, Mus musculus
tccaaagagacgcaatgcacttact

SEQ ID NO: 770575 - DNA, 25 bp, Mus musculus
tccaaagagacggaatgcacttact

SEQ ID NO: 770576 - DNA, 25 bp, Mus musculus
tccaaagaggaaaagctcagccttc

SEQ ID NO: 770577 - DNA, 25 bp, Mus musculus
tccaaagaggaatagctcagccttc

SEQ ID NO: 770578 - DNA, 25 bp, Mus musculus
tccaaagagtatccgggtcaaggtg

SEQ ID NO: 770579 - DNA, 25 bp, Mus musculus
tccaaagagtatgcgggtcaaggtg

SEQ ID NO: 770580 - DNA, 25 bp, Mus musculus
tccaaagataatcggcccaacaaag

SEQ ID NO: 770581 - DNA, 25 bp, Mus musculus
tccaaagataatgggcccaacaaag

SEQ ID NO: 770582 - DNA, 25 bp, Mus musculus
tccaaagatactaccatgcatctag

SEQ ID NO: 770583 - DNA, 25 bp, Mus musculus
tccaaagatacttccatgcatctag

SEQ ID NO: 770584 - DNA, 25 bp, Mus musculus
tccaaagcaaacagctgacttcctg

SEQ ID NO: 770585 - DNA, 25 bp, Mus musculus
tccaaagcaaactgctgacttcctg

SEQ ID NO: 770586 - DNA, 25 bp, Mus musculus
tccaaagcaaggcagtttccgttct

SEQ ID NO: 770587 - DNA, 25 bp, Mus musculus
tccaaagcaagggagtttccgttct

SEQ ID NO: 770588 - DNA, 25 bp, Mus musculus
tccaaagcagcccatgtctatgcat

SEQ ID NO: 770589 - DNA, 25 bp, Mus musculus
tccaaagcagccgatgtctatgcat

SEQ ID NO: 770590 - DNA, 25 bp, Mus musculus
tccaaagcattgaggcatggcgaac

SEQ ID NO: 770591 - DNA, 25 bp, Mus musculus
tccaaagcattgtggcatggcgaac

SEQ ID NO: 770592 - DNA, 25 bp, Mus musculus
tccaaagccaatagattataatcgc

SEQ ID NO: 770593 - DNA, 25 bp, Mus musculus
tccaaagccaattgattataatcgc

SEQ ID NO: 770594 - DNA, 25 bp, Mus musculus
tccaaagccgggatctaactgctcc

SEQ ID NO: 770595 - DNA, 25 bp, Mus musculus
tccaaagccgggttctaactgctcc

SEQ ID NO: 770596 - DNA, 25 bp, Mus musculus
tccaaagctgccctcagtgaagagc

SEQ ID NO: 770597 - DNA, 25 bp, Mus musculus
tccaaagctgccgtcagtgaagagc

SEQ ID NO: 770598 - DNA, 25 bp, Mus musculus
tccaaagcttcgagatgcagcccaa

SEQ ID NO: 770599 - DNA, 25 bp, Mus musculus
tccaaagcttcgtgatgcagcccaa

SEQ ID NO: 770600 - DNA, 25 bp, Mus musculus
tccaaaggaaacaggccttgctgag

SEQ ID NO: 770601 - DNA, 25 bp, Mus musculus
tccaaaggaaactggccttgctgag

SEQ ID NO: 770602 - DNA, 25 bp, Mus musculus
tccaaaggaactaaatagtgatccc

SEQ ID NO: 770603 - DNA, 25 bp, Mus musculus
tccaaaggaacttaatagtgatccc

SEQ ID NO: 770604 - DNA, 25 bp, Mus musculus
tccaaaggatctaagaatcaaaact

SEQ ID NO: 770605 - DNA, 25 bp, Mus musculus
tccaaaggatcttagaatcaaaact

SEQ ID NO: 770606 - DNA, 25 bp, Mus musculus
tccaaaggctgtcgtcaaactcgag

SEQ ID NO: 770607 - DNA, 25 bp, Mus musculus
tccaaaggctgtggtcaaactcgag

SEQ ID NO: 770608 - DNA, 25 bp, Mus musculus
tccaaaggtgaactcgaagaggcag

SEQ ID NO: 770609 - DNA, 25 bp, Mus musculus
tccaaaggtgaagtcgaagaggcag

SEQ ID NO: 770610 - DNA, 25 bp, Mus musculus
tccaaaggtgtcaacagcaggcgca

SEQ ID NO: 770611 - DNA, 25 bp, Mus musculus
tccaaaggtgtctacagcaggcgca

SEQ ID NO: 770612 - DNA, 25 bp, Mus musculus
tccaaagtacttctcaagactgcag

SEQ ID NO: 770613 - DNA, 25 bp, Mus musculus
tccaaagtacttgtcaagactgcag

SEQ ID NO: 770614 - DNA, 25 bp, Mus musculus
tccaaagtaggacatgaaccaccaa

SEQ ID NO: 770615 - DNA, 25 bp, Mus musculus
tccaaagtaggagatgaaccaccaa

SEQ ID NO: 770616 - DNA, 25 bp, Mus musculus
tccaaagtcggtactcggatcttca

SEQ ID NO: 770617 - DNA, 25 bp, Mus musculus
tccaaagtcggttctcggatcttca

SEQ ID NO: 770618 - DNA, 25 bp, Mus musculus
tccaaagtgcttagctcctagggtg

SEQ ID NO: 770619 - DNA, 25 bp, Mus musculus
tccaaagtgctttgctcctagggtg

SEQ ID NO: 770620 - DNA, 25 bp, Mus musculus
tccaaagtggatctgcggtgaagcc

SEQ ID NO: 770621 - DNA, 25 bp, Mus musculus
tccaaagtggatgtgcggtgaagcc

SEQ ID NO: 770622 - DNA, 25 bp, Mus musculus
tccaaagtgtctcggttcctgcggc

SEQ ID NO: 770623 - DNA, 25 bp, Mus musculus
tccaaagtgtctgggttcctgcggc

SEQ ID NO: 770624 - DNA, 25 bp, Mus musculus
tccaaagtgttaagtcaagtgtgct

SEQ ID NO: 770625 - DNA, 25 bp, Mus musculus
tccaaagtgttatgtcaagtgtgct

SEQ ID NO: 770626 - DNA, 25 bp, Mus musculus
tccaaagttctcagaggcacgttcc

SEQ ID NO: 770627 - DNA, 25 bp, Mus musculus
tccaaagttctctgaggcacgttcc

SEQ ID NO: 770628 - DNA, 25 bp, Mus musculus
tccaaagttggaacgtgggactttg

SEQ ID NO: 770629 - DNA, 25 bp, Mus musculus
tccaaagttggatcgtgggactttg

SEQ ID NO: 770630 - DNA, 25 bp, Mus musculus
tccaaagtttgcaggaaagaatatg

SEQ ID NO: 770631 - DNA, 25 bp, Mus musculus
tccaaagtttgctggaaagaatatg

SEQ ID NO: 770632 - DNA, 25 bp, Mus musculus
tccaaataccagaattacatcatgg

SEQ ID NO: 770633 - DNA, 25 bp, Mus musculus
tccaaataccagtattacatcatgg

SEQ ID NO: 770634 - DNA, 25 bp, Mus musculus
tccaaatacggacgcggtggcttcc

SEQ ID NO: 770635 - DNA, 25 bp, Mus musculus
tccaaatacggaggcggtggcttcc

SEQ ID NO: 770636 - DNA, 25 bp, Mus musculus
tccaaatatggaaaaccgggtcaag

SEQ ID NO: 770637 - DNA, 25 bp, Mus musculus
tccaaatatggataaccgggtcaag

SEQ ID NO: 770638 - DNA, 25 bp, Mus musculus
tccaaatcatctcgctggaagattc

SEQ ID NO: 770639 - DNA, 25 bp, Mus musculus
tccaaatcatctggctggaagattc

SEQ ID NO: 770640 - DNA, 25 bp, Mus musculus
tccaaatcatttcaagggaaaactg

SEQ ID NO: 770641 - DNA, 25 bp, Mus musculus
tccaaatcatttgaagggaaaactg

SEQ ID NO: 770642 - DNA, 25 bp, Mus musculus
tccaaatccaggatcgacgtgctgg

SEQ ID NO: 770643 - DNA, 25 bp, Mus musculus
tccaaatccaggttcgacgtgctgg

SEQ ID NO: 770644 - DNA, 25 bp, Mus musculus
tccaaatctcggactcggacccgat

SEQ ID NO: 770645 - DNA, 25 bp, Mus musculus
tccaaatctcggtctcggacccgat

SEQ ID NO: 770646 - DNA, 25 bp, Mus musculus
tccaaatgaaatcttcaggtccacc

SEQ ID NO: 770647 - DNA, 25 bp, Mus musculus
tccaaatgaaatgttcaggtccacc

SEQ ID NO: 770648 - DNA, 25 bp, Mus musculus
tccaaatggagtcgaattcctcagt

SEQ ID NO: 770649 - DNA, 25 bp, Mus musculus
tccaaatggagtggaattcctcagt

SEQ ID NO: 770650 - DNA, 25 bp, Mus musculus
tccaaatggcttaccatgaacgtct

SEQ ID NO: 770651 - DNA, 25 bp, Mus musculus
tccaaatggctttccatgaacgtct

SEQ ID NO: 770652 - DNA, 25 bp, Mus musculus
tccaaatgggcaatcattttgttct

SEQ ID NO: 770653 - DNA, 25 bp, Mus musculus
tccaaatgggcattcattttgttct

SEQ ID NO: 770654 - DNA, 25 bp, Mus musculus
tccaaatgggctatacccgtccaag

SEQ ID NO: 770655 - DNA, 25 bp, Mus musculus
tccaaatgggctttacccgtccaag

SEQ ID NO: 770656 - DNA, 25 bp, Mus musculus
tccaaatgtctaccaaggagtagcc

SEQ ID NO: 770657 - DNA, 25 bp, Mus musculus
tccaaatgtctagcaaggagtagcc

SEQ ID NO: 770658 - DNA, 25 bp, Mus musculus
tccaaattacgactctaagaccaag

SEQ ID NO: 770659 - DNA, 25 bp, Mus musculus
tccaaattacgagtctaagaccaag

SEQ ID NO: 770660 - DNA, 25 bp, Mus musculus
tccaaattccacaaaagtaatgcag

SEQ ID NO: 770661 - DNA, 25 bp, Mus musculus
tccaaattccactaaagtaatgcag

SEQ ID NO: 770662 - DNA, 25 bp, Mus musculus
tccaaattctggacgaggagcattc

SEQ ID NO: 770663 - DNA, 25 bp, Mus musculus
tccaaattctggtcgaggagcattc

SEQ ID NO: 770664 - DNA, 25 bp, Mus musculus
tccaaattgaagatgggaaaggcac

SEQ ID NO: 770665 - DNA, 25 bp, Mus musculus
tccaaattgaagttgggaaaggcac

SEQ ID NO: 770666 - DNA, 25 bp, Mus musculus
tccaacaaatctacagagaccaaga

SEQ ID NO: 770667 - DNA, 25 bp, Mus musculus
tccaacaaatcttcagagaccaaga

SEQ ID NO: 770668 - DNA, 25 bp, Mus musculus
tccaacaaccatatggcagatcaca

SEQ ID NO: 770669 - DNA, 25 bp, Mus musculus
tccaacaaccatttggcagatcaca

SEQ ID NO: 770670 - DNA, 25 bp, Mus musculus
tccaacaagcatagtccgcccagtg

SEQ ID NO: 770671 - DNA, 25 bp, Mus musculus
tccaacaagcattgtccgcccagtg

SEQ ID NO: 770672 - DNA, 25 bp, Mus musculus
tccaacaagcttcgtacaaagaccc

SEQ ID NO: 770673 - DNA, 25 bp, Mus musculus
tccaacaagcttggtacaaagaccc

SEQ ID NO: 770674 - DNA, 25 bp, Mus musculus
tccaacaagggaattggcaaatcaa

SEQ ID NO: 770675 - DNA, 25 bp, Mus musculus
tccaacaagggatttggcaaatcaa

SEQ ID NO: 770676 - DNA, 25 bp, Mus musculus
tccaacaagtacctggtgaaacgcc

SEQ ID NO: 770677 - DNA, 25 bp, Mus musculus
tccaacaagtacgtggtgaaacgcc

SEQ ID NO: 770678 - DNA, 25 bp, Mus musculus
tccaacacaccccttgtccggattg

SEQ ID NO: 770679 - DNA, 25 bp, Mus musculus
tccaacacacccgttgtccggattg

SEQ ID NO: 770680 - DNA, 25 bp, Mus musculus
tccaacacctcccactatgacacat

SEQ ID NO: 770681 - DNA, 25 bp, Mus musculus
tccaacacctccgactatgacacat

SEQ ID NO: 770682 - DNA, 25 bp, Mus musculus
tccaacacctgccagctggtctttg

SEQ ID NO: 770683 - DNA, 25 bp, Mus musculus
tccaacacctgcgagctggtctttg

SEQ ID NO: 770684 - DNA, 25 bp, Mus musculus
tccaacagacataaacagaactgtc

SEQ ID NO: 770685 - DNA, 25 bp, Mus musculus
tccaacagacattaacagaactgtc

SEQ ID NO: 770686 - DNA, 25 bp, Mus musculus
tccaacagactcaggaggccagggc

SEQ ID NO: 770687 - DNA, 25 bp, Mus musculus
tccaacagactctggaggccagggc

SEQ ID NO: 770688 - DNA, 25 bp, Mus musculus
tccaacagcagacatcaaaagtcag

SEQ ID NO: 770689 - DNA, 25 bp, Mus musculus
tccaacagcagagatcaaaagtcag

SEQ ID NO: 770690 - DNA, 25 bp, Mus musculus
tccaacaggaatcggctcttctggg

SEQ ID NO: 770691 - DNA, 25 bp, Mus musculus
tccaacaggaatgggctcttctggg

SEQ ID NO: 770692 - DNA, 25 bp, Mus musculus
tccaacaggatgagggcacaaaaac

SEQ ID NO: 770693 - DNA, 25 bp, Mus musculus
tccaacaggatgtgggcacaaaaac

SEQ ID NO: 770694 - DNA, 25 bp, Mus musculus
tccaacaggctgaagtttgccctag

SEQ ID NO: 770695 - DNA, 25 bp, Mus musculus
tccaacaggctgtagtttgccctag

SEQ ID NO: 770696 - DNA, 25 bp, Mus musculus
tccaacatcctgctagatgagcggg

SEQ ID NO: 770697 - DNA, 25 bp, Mus musculus
tccaacatcctggtagatgagcggg

SEQ ID NO: 770698 - DNA, 25 bp, Mus musculus
tccaacatggagacccagagtgtcc

SEQ ID NO: 770699 - DNA, 25 bp, Mus musculus
tccaacatggagtcccagagtgtcc

SEQ ID NO: 770700 - DNA, 25 bp, Mus musculus
tccaacatggctccgcggttgtgca

SEQ ID NO: 770701 - DNA, 25 bp, Mus musculus
tccaacatggctgcgcggttgtgca

SEQ ID NO: 770702 - DNA, 25 bp, Mus musculus
tccaacattggcactaccactacag

SEQ ID NO: 770703 - DNA, 25 bp, Mus musculus
tccaacattggctctaccactacag

SEQ ID NO: 770704 - DNA, 25 bp, Mus musculus
tccaaccacatcaacagaaggaggt

SEQ ID NO: 770705 - DNA, 25 bp, Mus musculus
tccaaccacatctacagaaggaggt

SEQ ID NO: 770706 - DNA, 25 bp, Mus musculus
tccaaccagaacaatctctgcagga

SEQ ID NO: 770707 - DNA, 25 bp, Mus musculus
tccaaccagaactatctctgcagga

SEQ ID NO: 770708 - DNA, 25 bp, Mus musculus
tccaaccaggatctacagccattca

SEQ ID NO: 770709 - DNA, 25 bp, Mus musculus
tccaaccaggatgtacagccattca

SEQ ID NO: 770710 - DNA, 25 bp, Mus musculus
tccaaccatgaaactgaatctcact

SEQ ID NO: 770711 - DNA, 25 bp, Mus musculus
tccaaccatgaatctgaatctcact

SEQ ID NO: 770712 - DNA, 25 bp, Mus musculus
tccaacccacaacatcgtggtgaat

SEQ ID NO: 770713 - DNA, 25 bp, Mus musculus
tccaacccacaagatcgtggtgaat

SEQ ID NO: 770714 - DNA, 25 bp, Mus musculus
tccaaccccaagactcaggagcagt

SEQ ID NO: 770715 - DNA, 25 bp, Mus musculus
tccaaccccaagtctcaggagcagt

SEQ ID NO: 770716 - DNA, 25 bp, Mus musculus
tccaacccggtgacagagatgatcc

SEQ ID NO: 770717 - DNA, 25 bp, Mus musculus
tccaacccggtgtcagagatgatcc

SEQ ID NO: 770718 - DNA, 25 bp, Mus musculus
tccaacccgtagaaaagtctgtcac

SEQ ID NO: 770719 - DNA, 25 bp, Mus musculus
tccaacccgtagtaaagtctgtcac

SEQ ID NO: 770720 - DNA, 25 bp, Mus musculus
tccaaccgcacccttgtgaattatg

SEQ ID NO: 770721 - DNA, 25 bp, Mus musculus
tccaaccgcaccgttgtgaattatg

SEQ ID NO: 770722 - DNA, 25 bp, Mus musculus
tccaaccgttgcagctacattgact

SEQ ID NO: 770723 - DNA, 25 bp, Mus musculus
tccaaccgttgctgctacattgact

SEQ ID NO: 770724 - DNA, 25 bp, Mus musculus
tccaaccgttggaaactacagcatt

SEQ ID NO: 770725 - DNA, 25 bp, Mus musculus
tccaaccgttggtaactacagcatt

SEQ ID NO: 770726 - DNA, 25 bp, Mus musculus
tccaacctacgtagcagaaagtggc

SEQ ID NO: 770727 - DNA, 25 bp, Mus musculus
tccaacctacgttgcagaaagtggc

SEQ ID NO: 770728 - DNA, 25 bp, Mus musculus
tccaacctggaacggctgcttcaag

SEQ ID NO: 770729 - DNA, 25 bp, Mus musculus
tccaacctggaagggctgcttcaag

SEQ ID NO: 770730 - DNA, 25 bp, Mus musculus
tccaacctggccaaggagcttgaga

SEQ ID NO: 770731 - DNA, 25 bp, Mus musculus
tccaacctggcctaggagcttgaga

SEQ ID NO: 770732 - DNA, 25 bp, Mus musculus
tccaacctggtaatgcaggctcttc

SEQ ID NO: 770733 - DNA, 25 bp, Mus musculus
tccaacctggtattgcaggctcttc

SEQ ID NO: 770734 - DNA, 25 bp, Mus musculus
tccaaccttgatcccagcaacgtgg

SEQ ID NO: 770735 - DNA, 25 bp, Mus musculus
tccaaccttgatgccagcaacgtgg

SEQ ID NO: 770736 - DNA, 25 bp, Mus musculus
tccaaccttgtaaactctgcagcag

SEQ ID NO: 770737 - DNA, 25 bp, Mus musculus
tccaaccttgtatactctgcagcag

SEQ ID NO: 770738 - DNA, 25 bp, Mus musculus
tccaacgaaaccattggaatcatct

SEQ ID NO: 770739 - DNA, 25 bp, Mus musculus
tccaacgaaacctttggaatcatct

SEQ ID NO: 770740 - DNA, 25 bp, Mus musculus
tccaacgagggtatcaggtccgtgg

SEQ ID NO: 770741 - DNA, 25 bp, Mus musculus
tccaacgagggtttcaggtccgtgg

SEQ ID NO: 770742 - DNA, 25 bp, Mus musculus
tccaacgatgagaccatcgctgcca

SEQ ID NO: 770743 - DNA, 25 bp, Mus musculus
tccaacgatgagtccatcgctgcca

SEQ ID NO: 770744 - DNA, 25 bp, Mus musculus
tccaacgccacacttcctgatggtg

SEQ ID NO: 770745 - DNA, 25 bp, Mus musculus
tccaacgccacagttcctgatggtg

SEQ ID NO: 770746 - DNA, 25 bp, Mus musculus
tccaacgcgctgattggctgtggaa

SEQ ID NO: 770747 - DNA, 25 bp, Mus musculus
tccaacgcgctgtttggctgtggaa

SEQ ID NO: 770748 - DNA, 25 bp, Mus musculus
tccaacgctaccagagtgagacaca

SEQ ID NO: 770749 - DNA, 25 bp, Mus musculus
tccaacgctacctgagtgagacaca

SEQ ID NO: 770750 - DNA, 25 bp, Mus musculus
tccaacggaacacggttatagcagc

SEQ ID NO: 770751 - DNA, 25 bp, Mus musculus
tccaacggaacagggttatagcagc

SEQ ID NO: 770752 - DNA, 25 bp, Mus musculus
tccaacgggcatcttcattatcaac

SEQ ID NO: 770753 - DNA, 25 bp, Mus musculus
tccaacgggcatgttcattatcaac

SEQ ID NO: 770754 - DNA, 25 bp, Mus musculus
tccaacggtgacctagacccctggg

SEQ ID NO: 770755 - DNA, 25 bp, Mus musculus
tccaacggtgacgtagacccctggg

SEQ ID NO: 770756 - DNA, 25 bp, Mus musculus
tccaacggttgtctgagtaaaattc

SEQ ID NO: 770757 - DNA, 25 bp, Mus musculus
tccaacggttgtgtgagtaaaattc

SEQ ID NO: 770758 - DNA, 25 bp, Mus musculus
tccaacgtcgtgcacttgacagaga

SEQ ID NO: 770759 - DNA, 25 bp, Mus musculus
tccaacgtcgtggacttgacagaga

SEQ ID NO: 770760 - DNA, 25 bp, Mus musculus
tccaacgtttatactcgagagaaga

SEQ ID NO: 770761 - DNA, 25 bp, Mus musculus
tccaacgtttattctcgagagaaga

SEQ ID NO: 770762 - DNA, 25 bp, Mus musculus
tccaactacgttatggaggaagcgg

SEQ ID NO: 770763 - DNA, 25 bp, Mus musculus
tccaactacgttttggaggaagcgg

SEQ ID NO: 770764 - DNA, 25 bp, Mus musculus
tccaactactagaggagttgctttg

SEQ ID NO: 770765 - DNA, 25 bp, Mus musculus
tccaactactagtggagttgctttg

SEQ ID NO: 770766 - DNA, 25 bp, Mus musculus
tccaactactccatccatctgaatg

SEQ ID NO: 770767 - DNA, 25 bp, Mus musculus
tccaactactccttccatctgaatg

SEQ ID NO: 770768 - DNA, 25 bp, Mus musculus
tccaactccgtgatcagtgagtgtt

SEQ ID NO: 770769 - DNA, 25 bp, Mus musculus
tccaactccgtgttcagtgagtgtt

SEQ ID NO: 770770 - DNA, 25 bp, Mus musculus
tccaactcctatcgaagccagtggt

SEQ ID NO: 770771 - DNA, 25 bp, Mus musculus
tccaactcctatggaagccagtggt

SEQ ID NO: 770772 - DNA, 25 bp, Mus musculus
tccaactctcagattaaggagtcgg

SEQ ID NO: 770773 - DNA, 25 bp, Mus musculus
tccaactctcagtttaaggagtcgg

SEQ ID NO: 770774 - DNA, 25 bp, Mus musculus
tccaactcttctcatgaactcagct

SEQ ID NO: 770775 - DNA, 25 bp, Mus musculus
tccaactcttctgatgaactcagct

SEQ ID NO: 770776 - DNA, 25 bp, Mus musculus
tccaactgaataagagaggaacggg

SEQ ID NO: 770777 - DNA, 25 bp, Mus musculus
tccaactgaatatgagaggaacggg

SEQ ID NO: 770778 - DNA, 25 bp, Mus musculus
tccaactgcccaagcgccaatgatg

SEQ ID NO: 770779 - DNA, 25 bp, Mus musculus
tccaactgcccatgcgccaatgatg

SEQ ID NO: 770780 - DNA, 25 bp, Mus musculus
tccaactgccccagaagtccaggaa

SEQ ID NO: 770781 - DNA, 25 bp, Mus musculus
tccaactgcccctgaagtccaggaa

SEQ ID NO: 770782 - DNA, 25 bp, Mus musculus
tccaactgctataagtacaatcctc

SEQ ID NO: 770783 - DNA, 25 bp, Mus musculus
tccaactgctattagtacaatcctc

SEQ ID NO: 770784 - DNA, 25 bp, Mus musculus
tccaactgggggactacggagaccg

SEQ ID NO: 770785 - DNA, 25 bp, Mus musculus
tccaactgggggtctacggagaccg

SEQ ID NO: 770786 - DNA, 25 bp, Mus musculus
tccaactgtaggagcaggttcagag

SEQ ID NO: 770787 - DNA, 25 bp, Mus musculus
tccaactgtaggtgcaggttcagag

SEQ ID NO: 770788 - DNA, 25 bp, Mus musculus
tccaactgtctaagtgagttctccc

SEQ ID NO: 770789 - DNA, 25 bp, Mus musculus
tccaactgtctatgtgagttctccc

SEQ ID NO: 770790 - DNA, 25 bp, Mus musculus
tccaacttcaacagtcggcagattg

SEQ ID NO: 770791 - DNA, 25 bp, Mus musculus
tccaacttcaactgtcggcagattg

SEQ ID NO: 770792 - DNA, 25 bp, Mus musculus
tccaacttccaacgttttatctgtg

SEQ ID NO: 770793 - DNA, 25 bp, Mus musculus
tccaacttccaaggttttatctgtg

SEQ ID NO: 770794 - DNA, 25 bp, Mus musculus
tccaacttcgttagaggctctcagc

SEQ ID NO: 770795 - DNA, 25 bp, Mus musculus
tccaacttcgtttgaggctctcagc

SEQ ID NO: 770796 - DNA, 25 bp, Mus musculus
tccaacttctcacggagcagtcgga

SEQ ID NO: 770797 - DNA, 25 bp, Mus musculus
tccaacttctcagggagcagtcgga

SEQ ID NO: 770798 - DNA, 25 bp, Mus musculus
tccaacttcttcctggcctcatatg

SEQ ID NO: 770799 - DNA, 25 bp, Mus musculus
tccaacttcttcgtggcctcatatg

SEQ ID NO: 770800 - DNA, 25 bp, Mus musculus
tccaacttgatgaatcaagcaaggc

SEQ ID NO: 770801 - DNA, 25 bp, Mus musculus
tccaacttgatgtatcaagcaaggc

SEQ ID NO: 770802 - DNA, 25 bp, Mus musculus
tccaacttgcaaataaactgttgct

SEQ ID NO: 770803 - DNA, 25 bp, Mus musculus
tccaacttgcaattaaactgttgct

SEQ ID NO: 770804 - DNA, 25 bp, Mus musculus
tccaacttgcatcgtggcagtcatt

SEQ ID NO: 770805 - DNA, 25 bp, Mus musculus
tccaacttgcatggtggcagtcatt

SEQ ID NO: 770806 - DNA, 25 bp, Mus musculus
tccaacttgtctctcctgatgctgg

SEQ ID NO: 770807 - DNA, 25 bp, Mus musculus
tccaacttgtctgtcctgatgctgg

SEQ ID NO: 770808 - DNA, 25 bp, Mus musculus
tccaactttggaaatagaggtcgat

SEQ ID NO: 770809 - DNA, 25 bp, Mus musculus
tccaactttggatatagaggtcgat

SEQ ID NO: 770810 - DNA, 25 bp, Mus musculus
tccaacttttcgaggttattctcag

SEQ ID NO: 770811 - DNA, 25 bp, Mus musculus
tccaacttttcgtggttattctcag

SEQ ID NO: 770812 - DNA, 25 bp, Mus musculus
tccaagaaatttaaggacgcacctg

SEQ ID NO: 770813 - DNA, 25 bp, Mus musculus
tccaagaaattttaggacgcacctg

SEQ ID NO: 770814 - DNA, 25 bp, Mus musculus
tccaagaaccagcatgccagggcac

SEQ ID NO: 770815 - DNA, 25 bp, Mus musculus
tccaagaaccaggatgccagggcac

SEQ ID NO: 770816 - DNA, 25 bp, Mus musculus
tccaagaactgcctgtgcgcgctca

SEQ ID NO: 770817 - DNA, 25 bp, Mus musculus
tccaagaactgcgtgtgcgcgctca

SEQ ID NO: 770818 - DNA, 25 bp, Mus musculus
tccaagaagattataacaatgctac

SEQ ID NO: 770819 - DNA, 25 bp, Mus musculus
tccaagaagattttaacaatgctac

SEQ ID NO: 770820 - DNA, 25 bp, Mus musculus
tccaagaagcttcacaagctgggta

SEQ ID NO: 770821 - DNA, 25 bp, Mus musculus
tccaagaagcttgacaagctgggta

SEQ ID NO: 770822 - DNA, 25 bp, Mus musculus
tccaagaaggccaggctcggtgtct

SEQ ID NO: 770823 - DNA, 25 bp, Mus musculus
tccaagaaggcctggctcggtgtct

SEQ ID NO: 770824 - DNA, 25 bp, Mus musculus
tccaagaaggttcgcccttggaaat

SEQ ID NO: 770825 - DNA, 25 bp, Mus musculus
tccaagaaggttggcccttggaaat

SEQ ID NO: 770826 - DNA, 25 bp, Mus musculus
tccaagaatgcacagaagtcaactg

SEQ ID NO: 770827 - DNA, 25 bp, Mus musculus
tccaagaatgcactcgagcctaatc

SEQ ID NO: 770828 - DNA, 25 bp, Mus musculus
tccaagaatgcagagaagtcaactg

SEQ ID NO: 770829 - DNA, 25 bp, Mus musculus
tccaagaatgcagtcgagcctaatc

SEQ ID NO: 770830 - DNA, 25 bp, Mus musculus
tccaagacaccaatgaccagctaag

SEQ ID NO: 770831 - DNA, 25 bp, Mus musculus
tccaagacaccattgaccagctaag

SEQ ID NO: 770832 - DNA, 25 bp, Mus musculus
tccaagacactgagggtaacactcc

SEQ ID NO: 770833 - DNA, 25 bp, Mus musculus
tccaagacactgtgggtaacactcc

SEQ ID NO: 770834 - DNA, 25 bp, Mus musculus
tccaagacagctatggactccatgc

SEQ ID NO: 770835 - DNA, 25 bp, Mus musculus
tccaagacagctttggactccatgc

SEQ ID NO: 770836 - DNA, 25 bp, Mus musculus
tccaagaccgagagctcacatgctg

SEQ ID NO: 770837 - DNA, 25 bp, Mus musculus
tccaagaccgagtgctcacatgctg

SEQ ID NO: 770838 - DNA, 25 bp, Mus musculus
tccaagaccgtgagtatacacctgt

SEQ ID NO: 770839 - DNA, 25 bp, Mus musculus
tccaagaccgtgtgtatacacctgt

SEQ ID NO: 770840 - DNA, 25 bp, Mus musculus
tccaagacctacaccatggaggagg

SEQ ID NO: 770841 - DNA, 25 bp, Mus musculus
tccaagacctactccatggaggagg

SEQ ID NO: 770842 - DNA, 25 bp, Mus musculus
tccaagacctgcacgtacgagggct

SEQ ID NO: 770843 - DNA, 25 bp, Mus musculus
tccaagacctgctcgtacgagggct

SEQ ID NO: 770844 - DNA, 25 bp, Mus musculus
tccaagacggtccaggatgcgctaa

SEQ ID NO: 770845 - DNA, 25 bp, Mus musculus
tccaagacggtcgaggatgcgctaa

SEQ ID NO: 770846 - DNA, 25 bp, Mus musculus
tccaagactgagaccatgttcatgg

SEQ ID NO: 770847 - DNA, 25 bp, Mus musculus
tccaagactgagtccatgttcatgg

SEQ ID NO: 770848 - DNA, 25 bp, Mus musculus
tccaagactgcacttcatcttgagc

SEQ ID NO: 770849 - DNA, 25 bp, Mus musculus
tccaagactgcagttcatcttgagc

SEQ ID NO: 770850 - DNA, 25 bp, Mus musculus
tccaagagcactcggctcacatgtg

SEQ ID NO: 770851 - DNA, 25 bp, Mus musculus
tccaagagcactgggctcacatgtg

SEQ ID NO: 770852 - DNA, 25 bp, Mus musculus
tccaagagcattacaaaagggaaga

SEQ ID NO: 770853 - DNA, 25 bp, Mus musculus
tccaagagcatttcaaaagggaaga

SEQ ID NO: 770854 - DNA, 25 bp, Mus musculus
tccaagagcccaacatgctggattg

SEQ ID NO: 770855 - DNA, 25 bp, Mus musculus
tccaagagcccatcatgctggattg

SEQ ID NO: 770856 - DNA, 25 bp, Mus musculus
tccaagaggtatcagtgcgccaact

SEQ ID NO: 770857 - DNA, 25 bp, Mus musculus
tccaagaggtatgagtgcgccaact

SEQ ID NO: 770858 - DNA, 25 bp, Mus musculus
tccaagagttccatctgagccgcgt

SEQ ID NO: 770859 - DNA, 25 bp, Mus musculus
tccaagagttccttctgagccgcgt

SEQ ID NO: 770860 - DNA, 25 bp, Mus musculus
tccaagatacacagaagctttgtcc

SEQ ID NO: 770861 - DNA, 25 bp, Mus musculus
tccaagatacactgaagctttgtcc

SEQ ID NO: 770862 - DNA, 25 bp, Mus musculus
tccaagataccacgcagacgtgaag

SEQ ID NO: 770863 - DNA, 25 bp, Mus musculus
tccaagataccaggcagacgtgaag

SEQ ID NO: 770864 - DNA, 25 bp, Mus musculus
tccaagataggcatgtgagacacta

SEQ ID NO: 770865 - DNA, 25 bp, Mus musculus
tccaagataggcttgtgagacacta

SEQ ID NO: 770866 - DNA, 25 bp, Mus musculus
tccaagatcaagctcaacaatcact

SEQ ID NO: 770867 - DNA, 25 bp, Mus musculus
tccaagatcaaggtcaacaatcact

SEQ ID NO: 770868 - DNA, 25 bp, Mus musculus
tccaagatcacacggaattctggga

SEQ ID NO: 770869 - DNA, 25 bp, Mus musculus
tccaagatcacagggaattctggga

SEQ ID NO: 770870 - DNA, 25 bp, Mus musculus
tccaagatcggcactcggaggtcct

SEQ ID NO: 770871 - DNA, 25 bp, Mus musculus
tccaagatcggctctcggaggtcct

SEQ ID NO: 770872 - DNA, 25 bp, Mus musculus
tccaagatctggctcagggtgacct

SEQ ID NO: 770873 - DNA, 25 bp, Mus musculus
tccaagatctgggtcagggtgacct

SEQ ID NO: 770874 - DNA, 25 bp, Mus musculus
tccaagatgaaccatgccttcttac

SEQ ID NO: 770875 - DNA, 25 bp, Mus musculus
tccaagatgaacctggctgggtgcc

SEQ ID NO: 770876 - DNA, 25 bp, Mus musculus
tccaagatgaacgatgccttcttac

SEQ ID NO: 770877 - DNA, 25 bp, Mus musculus
tccaagatgaacgtggctgggtgcc

SEQ ID NO: 770878 - DNA, 25 bp, Mus musculus
tccaagatgagacaggcaagaaccg

SEQ ID NO: 770879 - DNA, 25 bp, Mus musculus
tccaagatgagagaggcaagaaccg

SEQ ID NO: 770880 - DNA, 25 bp, Mus musculus
tccaagatgatgaactaaacatccg

SEQ ID NO: 770881 - DNA, 25 bp, Mus musculus
tccaagatgatgtactaaacatccg

SEQ ID NO: 770882 - DNA, 25 bp, Mus musculus
tccaagatgcagaaccccaggcaga

SEQ ID NO: 770883 - DNA, 25 bp, Mus musculus
tccaagatgcagtaccccaggcaga

SEQ ID NO: 770884 - DNA, 25 bp, Mus musculus
tccaagatggagcaacagacccagc

SEQ ID NO: 770885 - DNA, 25 bp, Mus musculus
tccaagatggaggaacagacccagc

SEQ ID NO: 770886 - DNA, 25 bp, Mus musculus
tccaagatggcacattcaatctttt

SEQ ID NO: 770887 - DNA, 25 bp, Mus musculus
tccaagatggcagattcaatctttt

SEQ ID NO: 770888 - DNA, 25 bp, Mus musculus
tccaagatgtgaagaacgctgccca

SEQ ID NO: 770889 - DNA, 25 bp, Mus musculus
tccaagatgtgatgaacgctgccca

SEQ ID NO: 770890 - DNA, 25 bp, Mus musculus
tccaagcaaaatccacatgcaggaa

SEQ ID NO: 770891 - DNA, 25 bp, Mus musculus
tccaagcaaaatgcacatgcaggaa

SEQ ID NO: 770892 - DNA, 25 bp, Mus musculus
tccaagcaaccgcagagaaaactac

SEQ ID NO: 770893 - DNA, 25 bp, Mus musculus
tccaagcaaccggagagaaaactac

SEQ ID NO: 770894 - DNA, 25 bp, Mus musculus
tccaagcaagtcaccgtcgatgccg

SEQ ID NO: 770895 - DNA, 25 bp, Mus musculus
tccaagcaagtctccgtcgatgccg

SEQ ID NO: 770896 - DNA, 25 bp, Mus musculus
tccaagcacacaaagatgcccactg

SEQ ID NO: 770897 - DNA, 25 bp, Mus musculus
tccaagcacacatagatgcccactg

SEQ ID NO: 770898 - DNA, 25 bp, Mus musculus
tccaagcactagcattaagtagaca

SEQ ID NO: 770899 - DNA, 25 bp, Mus musculus
tccaagcactaggattaagtagaca

SEQ ID NO: 770900 - DNA, 25 bp, Mus musculus
tccaagcagaaacagaaggcagcct

SEQ ID NO: 770901 - DNA, 25 bp, Mus musculus
tccaagcagaaagagaaggcagcct

SEQ ID NO: 770902 - DNA, 25 bp, Mus musculus
tccaagcagggcaaagaaggatcga

SEQ ID NO: 770903 - DNA, 25 bp, Mus musculus
tccaagcagggctaagaaggatcga

SEQ ID NO: 770904 - DNA, 25 bp, Mus musculus
tccaagcagttgagtttagtctgca

SEQ ID NO: 770905 - DNA, 25 bp, Mus musculus
tccaagcagttgtgtttagtctgca

SEQ ID NO: 770906 - DNA, 25 bp, Mus musculus
tccaagcatgcactgatggtggtcc

SEQ ID NO: 770907 - DNA, 25 bp, Mus musculus
tccaagcatgcagtgatggtggtcc

SEQ ID NO: 770908 - DNA, 25 bp, Mus musculus
tccaagcccactatagccacaatga

SEQ ID NO: 770909 - DNA, 25 bp, Mus musculus
tccaagcccactttagccacaatga

SEQ ID NO: 770910 - DNA, 25 bp, Mus musculus
tccaagccccagcagattaaaatgc

SEQ ID NO: 770911 - DNA, 25 bp, Mus musculus
tccaagccccaggagattaaaatgc

SEQ ID NO: 770912 - DNA, 25 bp, Mus musculus
tccaagccggcacaaggtacctggt

SEQ ID NO: 770913 - DNA, 25 bp, Mus musculus
tccaagccggcagaaggtacctggt

SEQ ID NO: 770914 - DNA, 25 bp, Mus musculus
tccaagcgcaagacagatgtgtgct

SEQ ID NO: 770915 - DNA, 25 bp, Mus musculus
tccaagcgcaagtcagatgtgtgct

SEQ ID NO: 770916 - DNA, 25 bp, Mus musculus
tccaagctatccagaaatcagatga

SEQ ID NO: 770917 - DNA, 25 bp, Mus musculus
tccaagctatcctgaaatcagatga

SEQ ID NO: 770918 - DNA, 25 bp, Mus musculus
tccaagctattgaccgtgccattga

SEQ ID NO: 770919 - DNA, 25 bp, Mus musculus
tccaagctattgtccgtgccattga

SEQ ID NO: 770920 - DNA, 25 bp, Mus musculus
tccaagctctgaatgtcttccggac

SEQ ID NO: 770921 - DNA, 25 bp, Mus musculus
tccaagctctgattgtcttccggac

SEQ ID NO: 770922 - DNA, 25 bp, Mus musculus
tccaagctgaagagatatgagttcc

SEQ ID NO: 770923 - DNA, 25 bp, Mus musculus
tccaagctgaagtgatatgagttcc

SEQ ID NO: 770924 - DNA, 25 bp, Mus musculus
tccaagctgagacgcatgcccggga

SEQ ID NO: 770925 - DNA, 25 bp, Mus musculus
tccaagctgagaggcatgcccggga

SEQ ID NO: 770926 - DNA, 25 bp, Mus musculus
tccaagctgtgaccgacactggcaa

SEQ ID NO: 770927 - DNA, 25 bp, Mus musculus
tccaagctgtgagcgacactggcaa

SEQ ID NO: 770928 - DNA, 25 bp, Mus musculus
tccaagctgtggaaactgctacagg

SEQ ID NO: 770929 - DNA, 25 bp, Mus musculus
tccaagctgtggaggagtttcaggc

SEQ ID NO: 770930 - DNA, 25 bp, Mus musculus
tccaagctgtggtaactgctacagg

SEQ ID NO: 770931 - DNA, 25 bp, Mus musculus
tccaagctgtggtggagtttcaggc

SEQ ID NO: 770932 - DNA, 25 bp, Mus musculus
tccaagcttctgaagaggcttgaca

SEQ ID NO: 770933 - DNA, 25 bp, Mus musculus
tccaagcttctgtagaggcttgaca

SEQ ID NO: 770934 - DNA, 25 bp, Mus musculus
tccaagctttgtaaatatccctcaa

SEQ ID NO: 770935 - DNA, 25 bp, Mus musculus
tccaagctttgttaatatccctcaa

SEQ ID NO: 770936 - DNA, 25 bp, Mus musculus
tccaaggaaaatcaacctcccagct

SEQ ID NO: 770937 - DNA, 25 bp, Mus musculus
tccaaggaaaatgaacctcccagct

SEQ ID NO: 770938 - DNA, 25 bp, Mus musculus
tccaaggaagagcttcctctaaaga

SEQ ID NO: 770939 - DNA, 25 bp, Mus musculus
tccaaggaagaggttcctctaaaga

SEQ ID NO: 770940 - DNA, 25 bp, Mus musculus
tccaaggacaagactgcagaatcca

SEQ ID NO: 770941 - DNA, 25 bp, Mus musculus
tccaaggacaagtctgcagaatcca

SEQ ID NO: 770942 - DNA, 25 bp, Mus musculus
tccaaggactgcagagggaatttcc

SEQ ID NO: 770943 - DNA, 25 bp, Mus musculus
tccaaggactgctgagggaatttcc

SEQ ID NO: 770944 - DNA, 25 bp, Mus musculus
tccaaggagagaaacggctcaagag

SEQ ID NO: 770945 - DNA, 25 bp, Mus musculus
tccaaggagagatacggctcaagag

SEQ ID NO: 770946 - DNA, 25 bp, Mus musculus
tccaaggagataacaggctgcttat

SEQ ID NO: 770947 - DNA, 25 bp, Mus musculus
tccaaggagatatcaggctgcttat

SEQ ID NO: 770948 - DNA, 25 bp, Mus musculus
tccaaggaggacaagaacggacacg

SEQ ID NO: 770949 - DNA, 25 bp, Mus musculus
tccaaggaggactagaacggacacg

SEQ ID NO: 770950 - DNA, 25 bp, Mus musculus
tccaaggaggagaaaccaggatcta

SEQ ID NO: 770951 - DNA, 25 bp, Mus musculus
tccaaggaggagtaaccaggatcta

SEQ ID NO: 770952 - DNA, 25 bp, Mus musculus
tccaaggagggcaccctcatcgtcc

SEQ ID NO: 770953 - DNA, 25 bp, Mus musculus
tccaaggagggctccctcatcgtcc

SEQ ID NO: 770954 - DNA, 25 bp, Mus musculus
tccaaggagtctacgccatgggctt

SEQ ID NO: 770955 - DNA, 25 bp, Mus musculus
tccaaggagtcttcgccatgggctt

SEQ ID NO: 770956 - DNA, 25 bp, Mus musculus
tccaaggagtgtatctggcccagag

SEQ ID NO: 770957 - DNA, 25 bp, Mus musculus
tccaaggagtgtttctggcccagag

SEQ ID NO: 770958 - DNA, 25 bp, Mus musculus
tccaaggcaaagctgtttgagcata

SEQ ID NO: 770959 - DNA, 25 bp, Mus musculus
tccaaggcaaaggtgtttgagcata

SEQ ID NO: 770960 - DNA, 25 bp, Mus musculus
tccaaggcacagaaacttccacagt

SEQ ID NO: 770961 - DNA, 25 bp, Mus musculus
tccaaggcacagtaacttccacagt

SEQ ID NO: 770962 - DNA, 25 bp, Mus musculus
tccaaggcacggagtggacgcatct

SEQ ID NO: 770963 - DNA, 25 bp, Mus musculus
tccaaggcacggtgtggacgcatct

SEQ ID NO: 770964 - DNA, 25 bp, Mus musculus
tccaaggcactgagggaacgctggc

SEQ ID NO: 770965 - DNA, 25 bp, Mus musculus
tccaaggcactgtgggaacgctggc

SEQ ID NO: 770966 - DNA, 25 bp, Mus musculus
tccaaggcaggaaattctattacag

SEQ ID NO: 770967 - DNA, 25 bp, Mus musculus
tccaaggcaggatattctattacag

SEQ ID NO: 770968 - DNA, 25 bp, Mus musculus
tccaaggcaggtacaccgaggtgct

SEQ ID NO: 770969 - DNA, 25 bp, Mus musculus
tccaaggcaggttcaccgaggtgct

SEQ ID NO: 770970 - DNA, 25 bp, Mus musculus
tccaaggcgatcagctgaaaaacag

SEQ ID NO: 770971 - DNA, 25 bp, Mus musculus
tccaaggcgatctgctgaaaaacag

SEQ ID NO: 770972 - DNA, 25 bp, Mus musculus
tccaaggcgtccacgtctgcggagg

SEQ ID NO: 770973 - DNA, 25 bp, Mus musculus
tccaaggcgtcctcgtctgcggagg

SEQ ID NO: 770974 - DNA, 25 bp, Mus musculus
tccaaggctctcctgtaattactgc

SEQ ID NO: 770975 - DNA, 25 bp, Mus musculus
tccaaggctctcgtgtaattactgc

SEQ ID NO: 770976 - DNA, 25 bp, Mus musculus
tccaagggaaggaagactgtaccca

SEQ ID NO: 770977 - DNA, 25 bp, Mus musculus
tccaagggaaggtagactgtaccca

SEQ ID NO: 770978 - DNA, 25 bp, Mus musculus
tccaagggcagtccctatttgaaca

SEQ ID NO: 770979 - DNA, 25 bp, Mus musculus
tccaagggcagtgcctatttgaaca

SEQ ID NO: 770980 - DNA, 25 bp, Mus musculus
tccaagggctatcgatttgtacact

SEQ ID NO: 770981 - DNA, 25 bp, Mus musculus
tccaagggctatggatttgtacact

SEQ ID NO: 770982 - DNA, 25 bp, Mus musculus
tccaagggctctccaacatcgcttt

SEQ ID NO: 770983 - DNA, 25 bp, Mus musculus
tccaagggctctgcaacatcgcttt

SEQ ID NO: 770984 - DNA, 25 bp, Mus musculus
tccaaggtcattcagctgatggaca

SEQ ID NO: 770985 - DNA, 25 bp, Mus musculus
tccaaggtcattgagctgatggaca

SEQ ID NO: 770986 - DNA, 25 bp, Mus musculus
tccaaggtcctgactcgggtcagtg

SEQ ID NO: 770987 - DNA, 25 bp, Mus musculus
tccaaggtcctgtctcgggtcagtg

SEQ ID NO: 770988 - DNA, 25 bp, Mus musculus
tccaaggtcttgcacctcaggaaga

SEQ ID NO: 770989 - DNA, 25 bp, Mus musculus
tccaaggtcttggacctcaggaaga

SEQ ID NO: 770990 - DNA, 25 bp, Mus musculus
tccaaggtgaaaattgtcatggtcg

SEQ ID NO: 770991 - DNA, 25 bp, Mus musculus
tccaaggtgaaatttgtcatggtcg

SEQ ID NO: 770992 - DNA, 25 bp, Mus musculus
tccaaggtggaccagtttgtcacac

SEQ ID NO: 770993 - DNA, 25 bp, Mus musculus
tccaaggtggacgagtttgtcacac

SEQ ID NO: 770994 - DNA, 25 bp, Mus musculus
tccaaggtgtccaggtcgggactct

SEQ ID NO: 770995 - DNA, 25 bp, Mus musculus
tccaaggtgtcctggtcgggactct

SEQ ID NO: 770996 - DNA, 25 bp, Mus musculus
tccaaggttggcagaggtcgctgct

SEQ ID NO: 770997 - DNA, 25 bp, Mus musculus
tccaaggttggctgaggtcgctgct

SEQ ID NO: 770998 - DNA, 25 bp, Mus musculus
tccaagtaccagctggcagaccact

SEQ ID NO: 770999 - DNA, 25 bp, Mus musculus
tccaagtaccaggtggcagaccact

SEQ ID NO: 771000 - DNA, 25 bp, Mus musculus
tccaagtactttaatgaccaatgtc

SEQ ID NO: 771001 - DNA, 25 bp, Mus musculus
tccaagtacttttatgaccaatgtc

SEQ ID NO: 771002 - DNA, 25 bp, Mus musculus
tccaagtatttgagggcagcagcac

SEQ ID NO: 771003 - DNA, 25 bp, Mus musculus
tccaagtatttgtgggcagcagcac

SEQ ID NO: 771004 - DNA, 25 bp, Mus musculus
tccaagtcaaagaataacaacacag

SEQ ID NO: 771005 - DNA, 25 bp, Mus musculus
tccaagtcaaagtataacaacacag

SEQ ID NO: 771006 - DNA, 25 bp, Mus musculus
tccaagtcaactacctagaaaatgg

SEQ ID NO: 771007 - DNA, 25 bp, Mus musculus
tccaagtcaacttcctagaaaatgg

SEQ ID NO: 771008 - DNA, 25 bp, Mus musculus
tccaagtcagaaacaagtcttccat

SEQ ID NO: 771009 - DNA, 25 bp, Mus musculus
tccaagtcagaatcaagtcttccat

SEQ ID NO: 771010 - DNA, 25 bp, Mus musculus
tccaagtccagacgccggctctgtg

SEQ ID NO: 771011 - DNA, 25 bp, Mus musculus
tccaagtccagaggccggctctgtg

SEQ ID NO: 771012 - DNA, 25 bp, Mus musculus
tccaagtccatcatgatatcaggca

SEQ ID NO: 771013 - DNA, 25 bp, Mus musculus
tccaagtccatcttgatatcaggca

SEQ ID NO: 771014 - DNA, 25 bp, Mus musculus
tccaagtcccaaagaaattggcaca

SEQ ID NO: 771015 - DNA, 25 bp, Mus musculus
tccaagtcccaatgaaattggcaca

SEQ ID NO: 771016 - DNA, 25 bp, Mus musculus
tccaagtcctggcataactacatgt

SEQ ID NO: 771017 - DNA, 25 bp, Mus musculus
tccaagtcctgggataactacatgt

SEQ ID NO: 771018 - DNA, 25 bp, Mus musculus
tccaagtcggtcaggtactgggctc

SEQ ID NO: 771019 - DNA, 25 bp, Mus musculus
tccaagtcggtctggtactgggctc

SEQ ID NO: 771020 - DNA, 25 bp, Mus musculus
tccaagtcttagaagatggttctgt

SEQ ID NO: 771021 - DNA, 25 bp, Mus musculus
tccaagtcttagtagatggttctgt

SEQ ID NO: 771022 - DNA, 25 bp, Mus musculus
tccaagtgacagaggaagtgccgtc

SEQ ID NO: 771023 - DNA, 25 bp, Mus musculus
tccaagtgacagtggaagtgccgtc

SEQ ID NO: 771024 - DNA, 25 bp, Mus musculus
tccaagtgaccaaagcagtggtacc

SEQ ID NO: 771025 - DNA, 25 bp, Mus musculus
tccaagtgaccatagcagtggtacc

SEQ ID NO: 771026 - DNA, 25 bp, Mus musculus
tccaagtgacccaggctatccaggg

SEQ ID NO: 771027 - DNA, 25 bp, Mus musculus
tccaagtgaccctggctatccaggg

SEQ ID NO: 771028 - DNA, 25 bp, Mus musculus
tccaagtgcaggaggcttcagagcc

SEQ ID NO: 771029 - DNA, 25 bp, Mus musculus
tccaagtgcaggtggcttcagagcc

SEQ ID NO: 771030 - DNA, 25 bp, Mus musculus
tccaagtgccggacagcctggcggc

SEQ ID NO: 771031 - DNA, 25 bp, Mus musculus
tccaagtgccggtcagcctggcggc

SEQ ID NO: 771032 - DNA, 25 bp, Mus musculus
tccaagtgctatcagcccaagcata

SEQ ID NO: 771033 - DNA, 25 bp, Mus musculus
tccaagtgctatgagcccaagcata

SEQ ID NO: 771034 - DNA, 25 bp, Mus musculus
tccaagtggaacacgtcaagacaag

SEQ ID NO: 771035 - DNA, 25 bp, Mus musculus
tccaagtggaactcgtcaagacaag

SEQ ID NO: 771036 - DNA, 25 bp, Mus musculus
tccaagtggaatatggtgtaacagg

SEQ ID NO: 771037 - DNA, 25 bp, Mus musculus
tccaagtggaatttggtgtaacagg

SEQ ID NO: 771038 - DNA, 25 bp, Mus musculus
tccaagtggacacagcacctcatct

SEQ ID NO: 771039 - DNA, 25 bp, Mus musculus
tccaagtggacagagcacctcatct

SEQ ID NO: 771040 - DNA, 25 bp, Mus musculus
tccaagtggagaatgtaatcctgat

SEQ ID NO: 771041 - DNA, 25 bp, Mus musculus
tccaagtggagattgtaatcctgat

SEQ ID NO: 771042 - DNA, 25 bp, Mus musculus
tccaagtggcgacctactctaagtt

SEQ ID NO: 771043 - DNA, 25 bp, Mus musculus
tccaagtggcgagctactctaagtt

SEQ ID NO: 771044 - DNA, 25 bp, Mus musculus
tccaagtgtaagagccctctaggtg

SEQ ID NO: 771045 - DNA, 25 bp, Mus musculus
tccaagtgtaagtgccctctaggtg

SEQ ID NO: 771046 - DNA, 25 bp, Mus musculus
tccaagtgtggcacgttagggaaca

SEQ ID NO: 771047 - DNA, 25 bp, Mus musculus
tccaagtgtggctcgttagggaaca

SEQ ID NO: 771048 - DNA, 25 bp, Mus musculus
tccaagttagccaaagactctgcgg

SEQ ID NO: 771049 - DNA, 25 bp, Mus musculus
tccaagttagcctaagactctgcgg

SEQ ID NO: 771050 - DNA, 25 bp, Mus musculus
tccaagttcaaaaactccctagtgg

SEQ ID NO: 771051 - DNA, 25 bp, Mus musculus
tccaagttcaaatactccctagtgg

SEQ ID NO: 771052 - DNA, 25 bp, Mus musculus
tccaagttcaatcacatcgtattac

SEQ ID NO: 771053 - DNA, 25 bp, Mus musculus
tccaagttcaatgacatcgtattac

SEQ ID NO: 771054 - DNA, 25 bp, Mus musculus
tccaagttcaccatggataccagta

SEQ ID NO: 771055 - DNA, 25 bp, Mus musculus
tccaagttcaccttggataccagta

SEQ ID NO: 771056 - DNA, 25 bp, Mus musculus
tccaagttcatcctcctggacaaca

SEQ ID NO: 771057 - DNA, 25 bp, Mus musculus
tccaagttcatcgtcctggacaaca

SEQ ID NO: 771058 - DNA, 25 bp, Mus musculus
tccaagttccggaacagtgggagga

SEQ ID NO: 771059 - DNA, 25 bp, Mus musculus
tccaagttccggctcaccgggaagg

SEQ ID NO: 771060 - DNA, 25 bp, Mus musculus
tccaagttccgggtcaccgggaagg

SEQ ID NO: 771061 - DNA, 25 bp, Mus musculus
tccaagttccggtacagtgggagga

SEQ ID NO: 771062 - DNA, 25 bp, Mus musculus
tccaagttctgccttctaactacaa

SEQ ID NO: 771063 - DNA, 25 bp, Mus musculus
tccaagttctgcgttctaactacaa

SEQ ID NO: 771064 - DNA, 25 bp, Mus musculus
tccaagttctggcaacagagtgttc

SEQ ID NO: 771065 - DNA, 25 bp, Mus musculus
tccaagttctgggaacagagtgttc

SEQ ID NO: 771066 - DNA, 25 bp, Mus musculus
tccaagttcttcctaatggctttgg

SEQ ID NO: 771067 - DNA, 25 bp, Mus musculus
tccaagttcttcgtaatggctttgg

SEQ ID NO: 771068 - DNA, 25 bp, Mus musculus
tccaagttgccacgaagcttctggg

SEQ ID NO: 771069 - DNA, 25 bp, Mus musculus
tccaagttgccaggaagcttctggg

SEQ ID NO: 771070 - DNA, 25 bp, Mus musculus
tccaagttgggacgaaatgaaatag

SEQ ID NO: 771071 - DNA, 25 bp, Mus musculus
tccaagttgggaggaaatgaaatag

SEQ ID NO: 771072 - DNA, 25 bp, Mus musculus
tccaagttgttccaagaaagggtgc

SEQ ID NO: 771073 - DNA, 25 bp, Mus musculus
tccaagttgttcgaagaaagggtgc

SEQ ID NO: 771074 - DNA, 25 bp, Mus musculus
tccaataatgaaaacaaccactcgt

SEQ ID NO: 771075 - DNA, 25 bp, Mus musculus
tccaataatgaatacaaccactcgt

SEQ ID NO: 771076 - DNA, 25 bp, Mus musculus
tccaatacagcccttcgggacaacg

SEQ ID NO: 771077 - DNA, 25 bp, Mus musculus
tccaatacagccgttcgggacaacg

SEQ ID NO: 771078 - DNA, 25 bp, Mus musculus
tccaatcactgcagtctgaactgca

SEQ ID NO: 771079 - DNA, 25 bp, Mus musculus
tccaatcactgctgtctgaactgca

SEQ ID NO: 771080 - DNA, 25 bp, Mus musculus
tccaatcagattagacaagtcatga

SEQ ID NO: 771081 - DNA, 25 bp, Mus musculus
tccaatcagatttgacaagtcatga

SEQ ID NO: 771082 - DNA, 25 bp, Mus musculus
tccaatcaggatccactttcaggct

SEQ ID NO: 771083 - DNA, 25 bp, Mus musculus
tccaatcaggatgcactttcaggct

SEQ ID NO: 771084 - DNA, 25 bp, Mus musculus
tccaatcccgaaaactgagtcaagc

SEQ ID NO: 771085 - DNA, 25 bp, Mus musculus
tccaatcccgaatactgagtcaagc

SEQ ID NO: 771086 - DNA, 25 bp, Mus musculus
tccaatcctgctagggaacccagga

SEQ ID NO: 771087 - DNA, 25 bp, Mus musculus
tccaatcctgcttgggaacccagga

SEQ ID NO: 771088 - DNA, 25 bp, Mus musculus
tccaatctccatcacatcatgttgc

SEQ ID NO: 771089 - DNA, 25 bp, Mus musculus
tccaatctccatgacatcatgttgc

SEQ ID NO: 771090 - DNA, 25 bp, Mus musculus
tccaatctgcagattgtggacatga

SEQ ID NO: 771091 - DNA, 25 bp, Mus musculus
tccaatctgcagtttgtggacatga

SEQ ID NO: 771092 - DNA, 25 bp, Mus musculus
tccaatctgggtaacctcagcctgt

SEQ ID NO: 771093 - DNA, 25 bp, Mus musculus
tccaatctgggttacctcagcctgt

SEQ ID NO: 771094 - DNA, 25 bp, Mus musculus
tccaatgaagacaggcctcagctgg

SEQ ID NO: 771095 - DNA, 25 bp, Mus musculus
tccaatgaagactggcctcagctgg

SEQ ID NO: 771096 - DNA, 25 bp, Mus musculus
tccaatgaagccctcggtgccctta

SEQ ID NO: 771097 - DNA, 25 bp, Mus musculus
tccaatgaagccgtcggtgccctta

SEQ ID NO: 771098 - DNA, 25 bp, Mus musculus
tccaatgagatgagagccagccaag

SEQ ID NO: 771099 - DNA, 25 bp, Mus musculus
tccaatgagatgtgagccagccaag

SEQ ID NO: 771100 - DNA, 25 bp, Mus musculus
tccaatgaggtgaccaactggcctg

SEQ ID NO: 771101 - DNA, 25 bp, Mus musculus
tccaatgaggtgtccaactggcctg

SEQ ID NO: 771102 - DNA, 25 bp, Mus musculus
tccaatgatagtcacaagaaagctg

SEQ ID NO: 771103 - DNA, 25 bp, Mus musculus
tccaatgatagtgacaagaaagctg

SEQ ID NO: 771104 - DNA, 25 bp, Mus musculus
tccaatgcaggaagtgtaccacgcc

SEQ ID NO: 771105 - DNA, 25 bp, Mus musculus
tccaatgcaggatgtgtaccacgcc

SEQ ID NO: 771106 - DNA, 25 bp, Mus musculus
tccaatgctacaaggcgctcacctg

SEQ ID NO: 771107 - DNA, 25 bp, Mus musculus
tccaatgctacatggcgctcacctg

SEQ ID NO: 771108 - DNA, 25 bp, Mus musculus
tccaatggacagaacgagaatgtga

SEQ ID NO: 771109 - DNA, 25 bp, Mus musculus
tccaatggacagtacgagaatgtga

SEQ ID NO: 771110 - DNA, 25 bp, Mus musculus
tccaatggcacaaggctttctgcca

SEQ ID NO: 771111 - DNA, 25 bp, Mus musculus
tccaatggcacatggctttctgcca

SEQ ID NO: 771112 - DNA, 25 bp, Mus musculus
tccaatggcttcctgatcgacggct

SEQ ID NO: 771113 - DNA, 25 bp, Mus musculus
tccaatggcttcgtgatcgacggct

SEQ ID NO: 771114 - DNA, 25 bp, Mus musculus
tccaatgggagtaacactccatctt

SEQ ID NO: 771115 - DNA, 25 bp, Mus musculus
tccaatgggagttacactccatctt

SEQ ID NO: 771116 - DNA, 25 bp, Mus musculus
tccaatgggtctcagtacagcggct

SEQ ID NO: 771117 - DNA, 25 bp, Mus musculus
tccaatgggtctgagtacagcggct

SEQ ID NO: 771118 - DNA, 25 bp, Mus musculus
tccaatggtgaaagacttcatgaca

SEQ ID NO: 771119 - DNA, 25 bp, Mus musculus
tccaatggtgaatgacttcatgaca

SEQ ID NO: 771120 - DNA, 25 bp, Mus musculus
tccaatggtgtgacggaccaggctg

SEQ ID NO: 771121 - DNA, 25 bp, Mus musculus
tccaatggtgtgtcggaccaggctg

SEQ ID NO: 771122 - DNA, 25 bp, Mus musculus
tccaatgtcacacgtgagaaccttg

SEQ ID NO: 771123 - DNA, 25 bp, Mus musculus
tccaatgtcacaggtgagaaccttg

SEQ ID NO: 771124 - DNA, 25 bp, Mus musculus
tccaatgtccgaagtctgtatccat

SEQ ID NO: 771125 - DNA, 25 bp, Mus musculus
tccaatgtccgatgtctgtatccat

SEQ ID NO: 771126 - DNA, 25 bp, Mus musculus
tccaatgtccgccattccctgggct

SEQ ID NO: 771127 - DNA, 25 bp, Mus musculus
tccaatgtccgcgattccctgggct

SEQ ID NO: 771128 - DNA, 25 bp, Mus musculus
tccaatgtcctcataattaataagg

SEQ ID NO: 771129 - DNA, 25 bp, Mus musculus
tccaatgtcctcttaattaataagg

SEQ ID NO: 771130 - DNA, 25 bp, Mus musculus
tccaatgtgaaaaagtacgactcca

SEQ ID NO: 771131 - DNA, 25 bp, Mus musculus
tccaatgtgaaatagtacgactcca

SEQ ID NO: 771132 - DNA, 25 bp, Mus musculus
tccaatgtgccaaagatgcaggtgt

SEQ ID NO: 771133 - DNA, 25 bp, Mus musculus
tccaatgtgccatagatgcaggtgt

SEQ ID NO: 771134 - DNA, 25 bp, Mus musculus
tccaatgtgcctcttgccaaactcg

SEQ ID NO: 771135 - DNA, 25 bp, Mus musculus
tccaatgtgcctgttgccaaactcg

SEQ ID NO: 771136 - DNA, 25 bp, Mus musculus
tccaatgttctaagacctctgcctg

SEQ ID NO: 771137 - DNA, 25 bp, Mus musculus
tccaatgttctatgacctctgcctg

SEQ ID NO: 771138 - DNA, 25 bp, Mus musculus
tccaatgttgcccaatacggttcac

SEQ ID NO: 771139 - DNA, 25 bp, Mus musculus
tccaatgttgccgaatacggttcac

SEQ ID NO: 771140 - DNA, 25 bp, Mus musculus
tccaatgttgttccatctcattcgg

SEQ ID NO: 771141 - DNA, 25 bp, Mus musculus
tccaatgttgttgcatctcattcgg

SEQ ID NO: 771142 - DNA, 25 bp, Mus musculus
tccaattatatacggcaggccaacc

SEQ ID NO: 771143 - DNA, 25 bp, Mus musculus
tccaattatatagggcaggccaacc

SEQ ID NO: 771144 - DNA, 25 bp, Mus musculus
tccaattatattcgtgaagctaacc

SEQ ID NO: 771145 - DNA, 25 bp, Mus musculus
tccaattatattggtgaagctaacc

SEQ ID NO: 771146 - DNA, 25 bp, Mus musculus
tccaattatccaaaaaagacccaat

SEQ ID NO: 771147 - DNA, 25 bp, Mus musculus
tccaattatccataaaagacccaat

SEQ ID NO: 771148 - DNA, 25 bp, Mus musculus
tccaattatgtaaagctgaccacag

SEQ ID NO: 771149 - DNA, 25 bp, Mus musculus
tccaattatgtatagctgaccacag

SEQ ID NO: 771150 - DNA, 25 bp, Mus musculus
tccaattcaaagacggggccttcct

SEQ ID NO: 771151 - DNA, 25 bp, Mus musculus
tccaattcaaagtcggggccttcct

SEQ ID NO: 771152 - DNA, 25 bp, Mus musculus
tccaattcccagatggaggctgaca

SEQ ID NO: 771153 - DNA, 25 bp, Mus musculus
tccaattcccagttggaggctgaca

SEQ ID NO: 771154 - DNA, 25 bp, Mus musculus
tccaattccgggatgtgggaaagct

SEQ ID NO: 771155 - DNA, 25 bp, Mus musculus
tccaattccgggttgtgggaaagct

SEQ ID NO: 771156 - DNA, 25 bp, Mus musculus
tccaattcctatcccatcaagaaga

SEQ ID NO: 771157 - DNA, 25 bp, Mus musculus
tccaattcctatgccatcaagaaga

SEQ ID NO: 771158 - DNA, 25 bp, Mus musculus
tccaattggagaagtgggcgacata

SEQ ID NO: 771159 - DNA, 25 bp, Mus musculus
tccaattggagatgtgggcgacata

SEQ ID NO: 771160 - DNA, 25 bp, Mus musculus
tccaattggcttagccactgggaga

SEQ ID NO: 771161 - DNA, 25 bp, Mus musculus
tccaattggctttgccactgggaga

SEQ ID NO: 771162 - DNA, 25 bp, Mus musculus
tccaatttgcacagatgcagggctt

SEQ ID NO: 771163 - DNA, 25 bp, Mus musculus
tccaatttgcactgatgcagggctt

SEQ ID NO: 771164 - DNA, 25 bp, Mus musculus
tccacaaacaccagtgacaacatag

SEQ ID NO: 771165 - DNA, 25 bp, Mus musculus
tccacaaacacctgtgacaacatag

SEQ ID NO: 771166 - DNA, 25 bp, Mus musculus
tccacaaacagacagaggaaggagg

SEQ ID NO: 771167 - DNA, 25 bp, Mus musculus
tccacaaacagagagaggaaggagg

SEQ ID NO: 771168 - DNA, 25 bp, Mus musculus
tccacaaacatccaagacactgagg

SEQ ID NO: 771169 - DNA, 25 bp, Mus musculus
tccacaaacatcgaagacactgagg

SEQ ID NO: 771170 - DNA, 25 bp, Mus musculus
tccacaaagtgactgaacgtctctc

SEQ ID NO: 771171 - DNA, 25 bp, Mus musculus
tccacaaagtgagtgaacgtctctc

SEQ ID NO: 771172 - DNA, 25 bp, Mus musculus
tccacaaagtgcaaaagagggcatc

SEQ ID NO: 771173 - DNA, 25 bp, Mus musculus
tccacaaagtgctaaagagggcatc

SEQ ID NO: 771174 - DNA, 25 bp, Mus musculus
tccacaaatacgcaaattacttctt

SEQ ID NO: 771175 - DNA, 25 bp, Mus musculus
tccacaaatacggaaattacttctt

SEQ ID NO: 771176 - DNA, 25 bp, Mus musculus
tccacaacagtgagtacacggccct

SEQ ID NO: 771177 - DNA, 25 bp, Mus musculus
tccacaacagtgtgtacacggccct

SEQ ID NO: 771178 - DNA, 25 bp, Mus musculus
tccacaaccagaacgagtcgaagct

SEQ ID NO: 771179 - DNA, 25 bp, Mus musculus
tccacaaccagatcgagtcgaagct

SEQ ID NO: 771180 - DNA, 25 bp, Mus musculus
tccacaacccagaacctgaggacga

SEQ ID NO: 771181 - DNA, 25 bp, Mus musculus
tccacaacccagtacctgaggacga

SEQ ID NO: 771182 - DNA, 25 bp, Mus musculus
tccacaactggacttccatccggag

SEQ ID NO: 771183 - DNA, 25 bp, Mus musculus
tccacaactggagttccatccggag

SEQ ID NO: 771184 - DNA, 25 bp, Mus musculus
tccacaactgtgagacacgcagagg

SEQ ID NO: 771185 - DNA, 25 bp, Mus musculus
tccacaactgtgtgacacgcagagg

SEQ ID NO: 771186 - DNA, 25 bp, Mus musculus
tccacaagaaatccattgacaagat

SEQ ID NO: 771187 - DNA, 25 bp, Mus musculus
tccacaagaaatgcattgacaagat

SEQ ID NO: 771188 - DNA, 25 bp, Mus musculus
tccacaagaatgaagtgataccgct

SEQ ID NO: 771189 - DNA, 25 bp, Mus musculus
tccacaagaatgtagtgataccgct

SEQ ID NO: 771190 - DNA, 25 bp, Mus musculus
tccacaagagaccaaaagctagagg

SEQ ID NO: 771191 - DNA, 25 bp, Mus musculus
tccacaagagacgaaaagctagagg

SEQ ID NO: 771192 - DNA, 25 bp, Mus musculus
tccacaagatagacacgtacctcaa

SEQ ID NO: 771193 - DNA, 25 bp, Mus musculus
tccacaagatagtcacgtacctcaa

SEQ ID NO: 771194 - DNA, 25 bp, Mus musculus
tccacaagcacgaggagatatctct

SEQ ID NO: 771195 - DNA, 25 bp, Mus musculus
tccacaagcacgtggagatatctct

SEQ ID NO: 771196 - DNA, 25 bp, Mus musculus
tccacaagcatcataggcgttgcct

SEQ ID NO: 771197 - DNA, 25 bp, Mus musculus
tccacaagcatcttaggcgttgcct

SEQ ID NO: 771198 - DNA, 25 bp, Mus musculus
tccacaagctctaggtctggagagc

SEQ ID NO: 771199 - DNA, 25 bp, Mus musculus
tccacaagctcttggtctggagagc

SEQ ID NO: 771200 - DNA, 25 bp, Mus musculus
tccacaagctttacatatgccagaa

SEQ ID NO: 771201 - DNA, 25 bp, Mus musculus
tccacaagcttttcatatgccagaa

SEQ ID NO: 771202 - DNA, 25 bp, Mus musculus
tccacaaggagaagggtatagttcc

SEQ ID NO: 771203 - DNA, 25 bp, Mus musculus
tccacaaggagatgggtatagttcc

SEQ ID NO: 771204 - DNA, 25 bp, Mus musculus
tccacaagggacacggtgacatgag

SEQ ID NO: 771205 - DNA, 25 bp, Mus musculus
tccacaagggactcggtgacatgag

SEQ ID NO: 771206 - DNA, 25 bp, Mus musculus
tccacaaggtggatcctcggaagga

SEQ ID NO: 771207 - DNA, 25 bp, Mus musculus
tccacaaggtggttcctcggaagga

SEQ ID NO: 771208 - DNA, 25 bp, Mus musculus
tccacaagtcgcattaccttgccag

SEQ ID NO: 771209 - DNA, 25 bp, Mus musculus
tccacaagtcgctttaccttgccag

SEQ ID NO: 771210 - DNA, 25 bp, Mus musculus
tccacaagttggagatgcctacatc

SEQ ID NO: 771211 - DNA, 25 bp, Mus musculus
tccacaagttggtgatgcctacatc

SEQ ID NO: 771212 - DNA, 25 bp, Mus musculus
tccacaatggtgcaagtgtctctag

SEQ ID NO: 771213 - DNA, 25 bp, Mus musculus
tccacaatggtggaagtgtctctag

SEQ ID NO: 771214 - DNA, 25 bp, Mus musculus
tccacacaaatgacccacatgtgga

SEQ ID NO: 771215 - DNA, 25 bp, Mus musculus
tccacacaaatgtcccacatgtgga

SEQ ID NO: 771216 - DNA, 25 bp, Mus musculus
tccacacaagatcaaagagtccagc

SEQ ID NO: 771217 - DNA, 25 bp, Mus musculus
tccacacaagatgaaagagtccagc

SEQ ID NO: 771218 - DNA, 25 bp, Mus musculus
tccacacactggatgacaggaccca

SEQ ID NO: 771219 - DNA, 25 bp, Mus musculus
tccacacactggttgacaggaccca

SEQ ID NO: 771220 - DNA, 25 bp, Mus musculus
tccacacagaaaaggcagcccttgg

SEQ ID NO: 771221 - DNA, 25 bp, Mus musculus
tccacacagaaatggcagcccttgg

SEQ ID NO: 771222 - DNA, 25 bp, Mus musculus
tccacacaggcacttgagcaagcag

SEQ ID NO: 771223 - DNA, 25 bp, Mus musculus
tccacacaggcagttgagcaagcag

SEQ ID NO: 771224 - DNA, 25 bp, Mus musculus
tccacacatggccattctgggcagt

SEQ ID NO: 771225 - DNA, 25 bp, Mus musculus
tccacacatggcgattctgggcagt

SEQ ID NO: 771226 - DNA, 25 bp, Mus musculus
tccacaccagagacaaaggcaacga

SEQ ID NO: 771227 - DNA, 25 bp, Mus musculus
tccacaccagagtcaaaggcaacga

SEQ ID NO: 771228 - DNA, 25 bp, Mus musculus
tccacacccataacgctgagtttta

SEQ ID NO: 771229 - DNA, 25 bp, Mus musculus
tccacacccatatcgctgagtttta

SEQ ID NO: 771230 - DNA, 25 bp, Mus musculus
tccacaccggagctagaccgtttgt

SEQ ID NO: 771231 - DNA, 25 bp, Mus musculus
tccacaccggaggtagaccgtttgt

SEQ ID NO: 771232 - DNA, 25 bp, Mus musculus
tccacacctgtgagaggaagcaaag

SEQ ID NO: 771233 - DNA, 25 bp, Mus musculus
tccacacctgtgtgaggaagcaaag

SEQ ID NO: 771234 - DNA, 25 bp, Mus musculus
tccacacggaaaaacttcacacagt

SEQ ID NO: 771235 - DNA, 25 bp, Mus musculus
tccacacggaaatacttcacacagt

SEQ ID NO: 771236 - DNA, 25 bp, Mus musculus
tccacacgtcggattctggacggcg

SEQ ID NO: 771237 - DNA, 25 bp, Mus musculus
tccacacgtcggtttctggacggcg

SEQ ID NO: 771238 - DNA, 25 bp, Mus musculus
tccacacgtggacccggatttctct

SEQ ID NO: 771239 - DNA, 25 bp, Mus musculus
tccacacgtggagccggatttctct

SEQ ID NO: 771240 - DNA, 25 bp, Mus musculus
tccacactgaccagtaaaaaccctt

SEQ ID NO: 771241 - DNA, 25 bp, Mus musculus
tccacactgacctgtaaaaaccctt

SEQ ID NO: 771242 - DNA, 25 bp, Mus musculus
tccacactggacacactgcttttta

SEQ ID NO: 771243 - DNA, 25 bp, Mus musculus
tccacactggactcactgcttttta

SEQ ID NO: 771244 - DNA, 25 bp, Mus musculus
tccacactgtggcttctgctatagg

SEQ ID NO: 771245 - DNA, 25 bp, Mus musculus
tccacactgtgggttctgctatagg

SEQ ID NO: 771246 - DNA, 25 bp, Mus musculus
tccacacttagacagcttgagcgat

SEQ ID NO: 771247 - DNA, 25 bp, Mus musculus
tccacacttagagagcttgagcgat

SEQ ID NO: 771248 - DNA, 25 bp, Mus musculus
tccacacttctgcaactgtaacgag

SEQ ID NO: 771249 - DNA, 25 bp, Mus musculus
tccacacttctggaactgtaacgag

SEQ ID NO: 771250 - DNA, 25 bp, Mus musculus
tccacacttgttactcgatgccttc

SEQ ID NO: 771251 - DNA, 25 bp, Mus musculus
tccacacttgtttctcgatgccttc

SEQ ID NO: 771252 - DNA, 25 bp, Mus musculus
tccacagaagaaaaagcctatgaaa

SEQ ID NO: 771253 - DNA, 25 bp, Mus musculus
tccacagaagaataagcctatgaaa

SEQ ID NO: 771254 - DNA, 25 bp, Mus musculus
tccacagacacacaggatcttaagt

SEQ ID NO: 771255 - DNA, 25 bp, Mus musculus
tccacagacacagaggatcttaagt

SEQ ID NO: 771256 - DNA, 25 bp, Mus musculus
tccacagaccagcaacataggctac

SEQ ID NO: 771257 - DNA, 25 bp, Mus musculus
tccacagaccagcagatcagagaaa

SEQ ID NO: 771258 - DNA, 25 bp, Mus musculus
tccacagaccaggaacataggctac

SEQ ID NO: 771259 - DNA, 25 bp, Mus musculus
tccacagaccaggagatcagagaaa

SEQ ID NO: 771260 - DNA, 25 bp, Mus musculus
tccacagacccgacagatttgtctc

SEQ ID NO: 771261 - DNA, 25 bp, Mus musculus
tccacagacccgtcagatttgtctc

SEQ ID NO: 771262 - DNA, 25 bp, Mus musculus
tccacagagatcagcgatcagcaaa

SEQ ID NO: 771263 - DNA, 25 bp, Mus musculus
tccacagagatctgcgatcagcaaa

SEQ ID NO: 771264 - DNA, 25 bp, Mus musculus
tccacagaggagaacgaggacaggt

SEQ ID NO: 771265 - DNA, 25 bp, Mus musculus
tccacagaggagtacgaggacaggt

SEQ ID NO: 771266 - DNA, 25 bp, Mus musculus
tccacagcacctatgtgaactcagg

SEQ ID NO: 771267 - DNA, 25 bp, Mus musculus
tccacagcacctttgtgaactcagg

SEQ ID NO: 771268 - DNA, 25 bp, Mus musculus
tccacagcccatccctataaagaag

SEQ ID NO: 771269 - DNA, 25 bp, Mus musculus
tccacagcccatgcctataaagaag

SEQ ID NO: 771270 - DNA, 25 bp, Mus musculus
tccacagcgataaccagacattcag

SEQ ID NO: 771271 - DNA, 25 bp, Mus musculus
tccacagcgatatccagacattcag

SEQ ID NO: 771272 - DNA, 25 bp, Mus musculus
tccacagcgttgaggtgcacaagtg

SEQ ID NO: 771273 - DNA, 25 bp, Mus musculus
tccacagcgttgtggtgcacaagtg

SEQ ID NO: 771274 - DNA, 25 bp, Mus musculus
tccacagctagtccgcatgtttctc

SEQ ID NO: 771275 - DNA, 25 bp, Mus musculus
tccacagctagtgcgcatgtttctc

SEQ ID NO: 771276 - DNA, 25 bp, Mus musculus
tccacaggagaacattaaggccacc

SEQ ID NO: 771277 - DNA, 25 bp, Mus musculus
tccacaggagaagattaaggccacc

SEQ ID NO: 771278 - DNA, 25 bp, Mus musculus
tccacagggaacactgcacctacag

SEQ ID NO: 771279 - DNA, 25 bp, Mus musculus
tccacagggaactctgcacctacag

SEQ ID NO: 771280 - DNA, 25 bp, Mus musculus
tccacagggtgcagtacagacccaa

SEQ ID NO: 771281 - DNA, 25 bp, Mus musculus
tccacagggtgctgtacagacccaa

SEQ ID NO: 771282 - DNA, 25 bp, Mus musculus
tccacaggtcaaagtcatcaagttg

SEQ ID NO: 771283 - DNA, 25 bp, Mus musculus
tccacaggtcaatgtcatcaagttg

SEQ ID NO: 771284 - DNA, 25 bp, Mus musculus
tccacaggtgtgaaggtgagtctgc

SEQ ID NO: 771285 - DNA, 25 bp, Mus musculus
tccacaggtgtgtaggtgagtctgc

SEQ ID NO: 771286 - DNA, 25 bp, Mus musculus
tccacagtaactacacgcatcgtgt

SEQ ID NO: 771287 - DNA, 25 bp, Mus musculus
tccacagtaacttcacgcatcgtgt

SEQ ID NO: 771288 - DNA, 25 bp, Mus musculus
tccacagtacatcagaagtgaggtc

SEQ ID NO: 771289 - DNA, 25 bp, Mus musculus
tccacagtacatgagaagtgaggtc

SEQ ID NO: 771290 - DNA, 25 bp, Mus musculus
tccacagtcacccatttcattgctg

SEQ ID NO: 771291 - DNA, 25 bp, Mus musculus
tccacagtcaccgatttcattgctg

SEQ ID NO: 771292 - DNA, 25 bp, Mus musculus
tccacagtcttcacattcgctggtc

SEQ ID NO: 771293 - DNA, 25 bp, Mus musculus
tccacagtcttctcattcgctggtc

SEQ ID NO: 771294 - DNA, 25 bp, Mus musculus
tccacagtgaacctagggtatccct

SEQ ID NO: 771295 - DNA, 25 bp, Mus musculus
tccacagtgaacgtagggtatccct

SEQ ID NO: 771296 - DNA, 25 bp, Mus musculus
tccacagtggagcacaacttcaaag

SEQ ID NO: 771297 - DNA, 25 bp, Mus musculus
tccacagtggaggacaacttcaaag

SEQ ID NO: 771298 - DNA, 25 bp, Mus musculus
tccacagtggccctaagtatgctgc

SEQ ID NO: 771299 - DNA, 25 bp, Mus musculus
tccacagtggccgtaagtatgctgc

SEQ ID NO: 771300 - DNA, 25 bp, Mus musculus
tccacagtgggccttaaaggcacgc

SEQ ID NO: 771301 - DNA, 25 bp, Mus musculus
tccacagtgggcgttaaaggcacgc

SEQ ID NO: 771302 - DNA, 25 bp, Mus musculus
tccacagtgtatagccatggcggag

SEQ ID NO: 771303 - DNA, 25 bp, Mus musculus
tccacagtgtattgccatggcggag

SEQ ID NO: 771304 - DNA, 25 bp, Mus musculus
tccacagttctgagccactgaggct

SEQ ID NO: 771305 - DNA, 25 bp, Mus musculus
tccacagttctgtgccactgaggct

SEQ ID NO: 771306 - DNA, 25 bp, Mus musculus
tccacatagcaacctgcacaaggga

SEQ ID NO: 771307 - DNA, 25 bp, Mus musculus
tccacatagcaagctgcacaaggga

SEQ ID NO: 771308 - DNA, 25 bp, Mus musculus
tccacatagccccagaatctgtact

SEQ ID NO: 771309 - DNA, 25 bp, Mus musculus
tccacatagcccgagaatctgtact

SEQ ID NO: 771310 - DNA, 25 bp, Mus musculus
tccacatcaaacacaaggaccaggt

SEQ ID NO: 771311 - DNA, 25 bp, Mus musculus
tccacatcaaactcaaggaccaggt

SEQ ID NO: 771312 - DNA, 25 bp, Mus musculus
tccacatcatagccagcttccagag

SEQ ID NO: 771313 - DNA, 25 bp, Mus musculus
tccacatcataggcagcttccagag

SEQ ID NO: 771314 - DNA, 25 bp, Mus musculus
tccacatccttgctcgggacgttca

SEQ ID NO: 771315 - DNA, 25 bp, Mus musculus
tccacatccttggtcgggacgttca

SEQ ID NO: 771316 - DNA, 25 bp, Mus musculus
tccacatctctcagccaagatcaag

SEQ ID NO: 771317 - DNA, 25 bp, Mus musculus
tccacatctctctgccaagatcaag

SEQ ID NO: 771318 - DNA, 25 bp, Mus musculus
tccacatctgcacagaacaagatgt

SEQ ID NO: 771319 - DNA, 25 bp, Mus musculus
tccacatctgcagagaacaagatgt

SEQ ID NO: 771320 - DNA, 25 bp, Mus musculus
tccacatctgccatatgggagaccc

SEQ ID NO: 771321 - DNA, 25 bp, Mus musculus
tccacatctgccttatgggagaccc

SEQ ID NO: 771322 - DNA, 25 bp, Mus musculus
tccacatgagaaatgcaaccgacag

SEQ ID NO: 771323 - DNA, 25 bp, Mus musculus
tccacatgagaattgcaaccgacag

SEQ ID NO: 771324 - DNA, 25 bp, Mus musculus
tccacatgatctagccagagtcaag

SEQ ID NO: 771325 - DNA, 25 bp, Mus musculus
tccacatgatcttgccagagtcaag

SEQ ID NO: 771326 - DNA, 25 bp, Mus musculus
tccacatggcggcagaaactctttc

SEQ ID NO: 771327 - DNA, 25 bp, Mus musculus
tccacatggcgggagaaactctttc

SEQ ID NO: 771328 - DNA, 25 bp, Mus musculus
tccacatgggacaggcaggaatgaa

SEQ ID NO: 771329 - DNA, 25 bp, Mus musculus
tccacatgggactggcaggaatgaa

SEQ ID NO: 771330 - DNA, 25 bp, Mus musculus
tccacatgtgcgcatggtcacactc

SEQ ID NO: 771331 - DNA, 25 bp, Mus musculus
tccacatgtgcggatggtcacactc

SEQ ID NO: 771332 - DNA, 25 bp, Mus musculus
tccacatgtgggacattgtgtgtgt

SEQ ID NO: 771333 - DNA, 25 bp, Mus musculus
tccacatgtgggtcattgtgtgtgt

SEQ ID NO: 771334 - DNA, 25 bp, Mus musculus
tccacattcaggcaagaggatgttg

SEQ ID NO: 771335 - DNA, 25 bp, Mus musculus
tccacattcagggaagaggatgttg

SEQ ID NO: 771336 - DNA, 25 bp, Mus musculus
tccaccaaaaagagagggtgccatc

SEQ ID NO: 771337 - DNA, 25 bp, Mus musculus
tccaccaaaaagtgagggtgccatc

SEQ ID NO: 771338 - DNA, 25 bp, Mus musculus
tccaccaaacggcaagagcgagtcc

SEQ ID NO: 771339 - DNA, 25 bp, Mus musculus
tccaccaaacgggaagagcgagtcc

SEQ ID NO: 771340 - DNA, 25 bp, Mus musculus
tccaccaaatggctgtggctcgcca

SEQ ID NO: 771341 - DNA, 25 bp, Mus musculus
tccaccaaatgggtgtggctcgcca

SEQ ID NO: 771342 - DNA, 25 bp, Mus musculus
tccaccaactccagcgagaatatgt

SEQ ID NO: 771343 - DNA, 25 bp, Mus musculus
tccaccaactcctgcgagaatatgt

SEQ ID NO: 771344 - DNA, 25 bp, Mus musculus
tccaccaagcctcggaagctgtcag

SEQ ID NO: 771345 - DNA, 25 bp, Mus musculus
tccaccaagcctgggaagctgtcag

SEQ ID NO: 771346 - DNA, 25 bp, Mus musculus
tccaccaagtgtaaccagacagatc

SEQ ID NO: 771347 - DNA, 25 bp, Mus musculus
tccaccaagtgttaccagacagatc

SEQ ID NO: 771348 - DNA, 25 bp, Mus musculus
tccaccaatcaaatctcagcgacag

SEQ ID NO: 771349 - DNA, 25 bp, Mus musculus
tccaccaatcaattctcagcgacag

SEQ ID NO: 771350 - DNA, 25 bp, Mus musculus
tccaccacaagcaggagagcatcgt

SEQ ID NO: 771351 - DNA, 25 bp, Mus musculus
tccaccacaagctggagagcatcgt

SEQ ID NO: 771352 - DNA, 25 bp, Mus musculus
tccaccacagaaagcaccttggtat

SEQ ID NO: 771353 - DNA, 25 bp, Mus musculus
tccaccacagaatgcaccttggtat

SEQ ID NO: 771354 - DNA, 25 bp, Mus musculus
tccaccacagttccagagtgtttgg

SEQ ID NO: 771355 - DNA, 25 bp, Mus musculus
tccaccacagttgcagagtgtttgg

SEQ ID NO: 771356 - DNA, 25 bp, Mus musculus
tccaccacattgactactataagaa

SEQ ID NO: 771357 - DNA, 25 bp, Mus musculus
tccaccacattgtctactataagaa

SEQ ID NO: 771358 - DNA, 25 bp, Mus musculus
tccaccactctcaaggctgcttttg

SEQ ID NO: 771359 - DNA, 25 bp, Mus musculus
tccaccactctctaggctgcttttg

SEQ ID NO: 771360 - DNA, 25 bp, Mus musculus
tccaccagagaactattgccacaag

SEQ ID NO: 771361 - DNA, 25 bp, Mus musculus
tccaccagagaagtattgccacaag

SEQ ID NO: 771362 - DNA, 25 bp, Mus musculus
tccaccagcaatatcttgaacaggc

SEQ ID NO: 771363 - DNA, 25 bp, Mus musculus
tccaccagcaatttcttgaacaggc

SEQ ID NO: 771364 - DNA, 25 bp, Mus musculus
tccaccagcacaaaccgaagcagga

SEQ ID NO: 771365 - DNA, 25 bp, Mus musculus
tccaccagcacataccgaagcagga

SEQ ID NO: 771366 - DNA, 25 bp, Mus musculus
tccaccaggaaacaaccggattccg

SEQ ID NO: 771367 - DNA, 25 bp, Mus musculus
tccaccaggaaagaaccggattccg

SEQ ID NO: 771368 - DNA, 25 bp, Mus musculus
tccaccaggatactgggaggcattt

SEQ ID NO: 771369 - DNA, 25 bp, Mus musculus
tccaccaggatagtgggaggcattt

SEQ ID NO: 771370 - DNA, 25 bp, Mus musculus
tccaccaggcagaggacgggctgca

SEQ ID NO: 771371 - DNA, 25 bp, Mus musculus
tccaccaggcagtggacgggctgca

SEQ ID NO: 771372 - DNA, 25 bp, Mus musculus
tccaccagtgagctcttgggttttg

SEQ ID NO: 771373 - DNA, 25 bp, Mus musculus
tccaccagtgaggtcttgggttttg

SEQ ID NO: 771374 - DNA, 25 bp, Mus musculus
tccaccagttgaaccctgaggtgac

SEQ ID NO: 771375 - DNA, 25 bp, Mus musculus
tccaccagttgatccctgaggtgac

SEQ ID NO: 771376 - DNA, 25 bp, Mus musculus
tccaccatcgagagaggaagagagc

SEQ ID NO: 771377 - DNA, 25 bp, Mus musculus
tccaccatcgagtgaggaagagagc

SEQ ID NO: 771378 - DNA, 25 bp, Mus musculus
tccaccatcggtcctaggagtgctt

SEQ ID NO: 771379 - DNA, 25 bp, Mus musculus
tccaccatcggtgctaggagtgctt

SEQ ID NO: 771380 - DNA, 25 bp, Mus musculus
tccaccatctgcaaatactaccaga

SEQ ID NO: 771381 - DNA, 25 bp, Mus musculus
tccaccatctgctaatactaccaga

SEQ ID NO: 771382 - DNA, 25 bp, Mus musculus
tccaccatgacactatcacgcttat

SEQ ID NO: 771383 - DNA, 25 bp, Mus musculus
tccaccatgacagtatcacgcttat

SEQ ID NO: 771384 - DNA, 25 bp, Mus musculus
tccaccatgattcacgggagtggtg

SEQ ID NO: 771385 - DNA, 25 bp, Mus musculus
tccaccatgattgacgggagtggtg

SEQ ID NO: 771386 - DNA, 25 bp, Mus musculus
tccaccatggacataacagactgtt

SEQ ID NO: 771387 - DNA, 25 bp, Mus musculus
tccaccatggacttaacagactgtt

SEQ ID NO: 771388 - DNA, 25 bp, Mus musculus
tccaccatggcgatgctgggcaact

SEQ ID NO: 771389 - DNA, 25 bp, Mus musculus
tccaccatggcgttgctgggcaact

SEQ ID NO: 771390 - DNA, 25 bp, Mus musculus
tccaccatggtgacggggttcagga

SEQ ID NO: 771391 - DNA, 25 bp, Mus musculus
tccaccatggtgtcggggttcagga

SEQ ID NO: 771392 - DNA, 25 bp, Mus musculus
tccaccatgtctcctggcccgtcaa

SEQ ID NO: 771393 - DNA, 25 bp, Mus musculus
tccaccatgtctgctggcccgtcaa

SEQ ID NO: 771394 - DNA, 25 bp, Mus musculus
tccaccatgttcacgcgggcgagcg

SEQ ID NO: 771395 - DNA, 25 bp, Mus musculus
tccaccatgttctcgcgggcgagcg

SEQ ID NO: 771396 - DNA, 25 bp, Mus musculus
tccacccaaggtagaggatccacca

SEQ ID NO: 771397 - DNA, 25 bp, Mus musculus
tccacccaaggttgaggatccacca

SEQ ID NO: 771398 - DNA, 25 bp, Mus musculus
tccacccagatgctgacactattat

SEQ ID NO: 771399 - DNA, 25 bp, Mus musculus
tccacccagatggtgacactattat

SEQ ID NO: 771400 - DNA, 25 bp, Mus musculus
tccacccagggaaaacagttgttga

SEQ ID NO: 771401 - DNA, 25 bp, Mus musculus
tccacccagggataacagttgttga

SEQ ID NO: 771402 - DNA, 25 bp, Mus musculus
tccaccccagacaactgttgtgaga

SEQ ID NO: 771403 - DNA, 25 bp, Mus musculus
tccaccccagactactgttgtgaga

SEQ ID NO: 771404 - DNA, 25 bp, Mus musculus
tccaccccagatagagccagacaag

SEQ ID NO: 771405 - DNA, 25 bp, Mus musculus
tccaccccagattgagccagacaag

SEQ ID NO: 771406 - DNA, 25 bp, Mus musculus
tccaccccaggaaagagggcacttt

SEQ ID NO: 771407 - DNA, 25 bp, Mus musculus
tccaccccaggatagagggcacttt

SEQ ID NO: 771408 - DNA, 25 bp, Mus musculus
tccaccccgcagaaacaaatgtgca

SEQ ID NO: 771409 - DNA, 25 bp, Mus musculus
tccaccccgcagtaacaaatgtgca

SEQ ID NO: 771410 - DNA, 25 bp, Mus musculus
tccacccctgttcacagtcagtgtg

SEQ ID NO: 771411 - DNA, 25 bp, Mus musculus
tccacccctgttgacagtcagtgtg

SEQ ID NO: 771412 - DNA, 25 bp, Mus musculus
tccaccccttgacttgctgaagaaa

SEQ ID NO: 771413 - DNA, 25 bp, Mus musculus
tccaccccttgagttgctgaagaaa

SEQ ID NO: 771414 - DNA, 25 bp, Mus musculus
tccacccgagatacgtgctgacagc

SEQ ID NO: 771415 - DNA, 25 bp, Mus musculus
tccacccgagattcgtgctgacagc

SEQ ID NO: 771416 - DNA, 25 bp, Mus musculus
tccacccggacacaagacttcattg

SEQ ID NO: 771417 - DNA, 25 bp, Mus musculus
tccacccggacagaagacttcattg

SEQ ID NO: 771418 - DNA, 25 bp, Mus musculus
tccacccggattccgccatgttgag

SEQ ID NO: 771419 - DNA, 25 bp, Mus musculus
tccacccggattcgaattactgaca

SEQ ID NO: 771420 - DNA, 25 bp, Mus musculus
tccacccggattgcgccatgttgag

SEQ ID NO: 771421 - DNA, 25 bp, Mus musculus
tccacccggattggaattactgaca

SEQ ID NO: 771422 - DNA, 25 bp, Mus musculus
tccacccggcagaagatcgtagagc

SEQ ID NO: 771423 - DNA, 25 bp, Mus musculus
tccacccggcagtagatcgtagagc

SEQ ID NO: 771424 - DNA, 25 bp, Mus musculus
tccaccctggcacgaatttcttgct

SEQ ID NO: 771425 - DNA, 25 bp, Mus musculus
tccaccctggcaggaatttcttgct

SEQ ID NO: 771426 - DNA, 25 bp, Mus musculus
tccaccctgttgagccgattgacac

SEQ ID NO: 771427 - DNA, 25 bp, Mus musculus
tccaccctgttgtgccgattgacac

SEQ ID NO: 771428 - DNA, 25 bp, Mus musculus
tccaccgaaggcaggctctagactg

SEQ ID NO: 771429 - DNA, 25 bp, Mus musculus
tccaccgaaggctggctctagactg

SEQ ID NO: 771430 - DNA, 25 bp, Mus musculus
tccaccgaccctatgatgaccgaga

SEQ ID NO: 771431 - DNA, 25 bp, Mus musculus
tccaccgaccctttgatgaccgaga

SEQ ID NO: 771432 - DNA, 25 bp, Mus musculus
tccaccgagcatctgccatggagct

SEQ ID NO: 771433 - DNA, 25 bp, Mus musculus
tccaccgagcatgtgccatggagct

SEQ ID NO: 771434 - DNA, 25 bp, Mus musculus
tccaccgaggttcgccccagatttg

SEQ ID NO: 771435 - DNA, 25 bp, Mus musculus
tccaccgaggttggccccagatttg

SEQ ID NO: 771436 - DNA, 25 bp, Mus musculus
tccaccgagtggagcctggcgtata

SEQ ID NO: 771437 - DNA, 25 bp, Mus musculus
tccaccgagtggtgcctggcgtata

SEQ ID NO: 771438 - DNA, 25 bp, Mus musculus
tccaccggatacagctggtgtgtgc

SEQ ID NO: 771439 - DNA, 25 bp, Mus musculus
tccaccggatactgctggtgtgtgc

SEQ ID NO: 771440 - DNA, 25 bp, Mus musculus
tccaccggtgctctcttttcagaca

SEQ ID NO: 771441 - DNA, 25 bp, Mus musculus
tccaccggtgctgtcttttcagaca

SEQ ID NO: 771442 - DNA, 25 bp, Mus musculus
tccaccgtctgacaatagactaagg

SEQ ID NO: 771443 - DNA, 25 bp, Mus musculus
tccaccgtctgagaatagactaagg

SEQ ID NO: 771444 - DNA, 25 bp, Mus musculus
tccaccgtggttatggctgacgtgt

SEQ ID NO: 771445 - DNA, 25 bp, Mus musculus
tccaccgtggttttggctgacgtgt

SEQ ID NO: 771446 - DNA, 25 bp, Mus musculus
tccaccgttcggatacactggtgtc

SEQ ID NO: 771447 - DNA, 25 bp, Mus musculus
tccaccgttcggttacactggtgtc

SEQ ID NO: 771448 - DNA, 25 bp, Mus musculus
tccacctattgacaatggagacatc

SEQ ID NO: 771449 - DNA, 25 bp, Mus musculus
tccacctattgagaatggagacatc

SEQ ID NO: 771450 - DNA, 25 bp, Mus musculus
tccacctcatggacattgccatcat

SEQ ID NO: 771451 - DNA, 25 bp, Mus musculus
tccacctcatggtcattgccatcat

SEQ ID NO: 771452 - DNA, 25 bp, Mus musculus
tccacctccagccatgataacagta

SEQ ID NO: 771453 - DNA, 25 bp, Mus musculus
tccacctccagcgatgataacagta

SEQ ID NO: 771454 - DNA, 25 bp, Mus musculus
tccacctccggcagaaatgtcgagt

SEQ ID NO: 771455 - DNA, 25 bp, Mus musculus
tccacctccggctgaaatgtcgagt

SEQ ID NO: 771456 - DNA, 25 bp, Mus musculus
tccacctgaaaactctaaaacatga

SEQ ID NO: 771457 - DNA, 25 bp, Mus musculus
tccacctgaaaagtctaaaacatga

SEQ ID NO: 771458 - DNA, 25 bp, Mus musculus
tccacctgagaacacattgctaagc

SEQ ID NO: 771459 - DNA, 25 bp, Mus musculus
tccacctgagaagacattgctaagc

SEQ ID NO: 771460 - DNA, 25 bp, Mus musculus
tccacctgagcaccgtttgagacct

SEQ ID NO: 771461 - DNA, 25 bp, Mus musculus
tccacctgagcagcgtttgagacct

SEQ ID NO: 771462 - DNA, 25 bp, Mus musculus
tccacctgccatattaatgctagag

SEQ ID NO: 771463 - DNA, 25 bp, Mus musculus
tccacctgccattttaatgctagag

SEQ ID NO: 771464 - DNA, 25 bp, Mus musculus
tccacctggactacatcggaccatg

SEQ ID NO: 771465 - DNA, 25 bp, Mus musculus
tccacctggacttcatcggaccatg

SEQ ID NO: 771466 - DNA, 25 bp, Mus musculus
tccacctggcagagattcacgaagc

SEQ ID NO: 771467 - DNA, 25 bp, Mus musculus
tccacctggcagtgattcacgaagc

SEQ ID NO: 771468 - DNA, 25 bp, Mus musculus
tccacctgggtgaccattctttgca

SEQ ID NO: 771469 - DNA, 25 bp, Mus musculus
tccacctgggtgtccattctttgca

SEQ ID NO: 771470 - DNA, 25 bp, Mus musculus
tccacctggtcgcacttttgcacga

SEQ ID NO: 771471 - DNA, 25 bp, Mus musculus
tccacctggtcggacttttgcacga

SEQ ID NO: 771472 - DNA, 25 bp, Mus musculus
tccacctggtgtctgaggaaacggc

SEQ ID NO: 771473 - DNA, 25 bp, Mus musculus
tccacctggtgtgtgaggaaacggc

SEQ ID NO: 771474 - DNA, 25 bp, Mus musculus
tccacctgtctccagagcgtgtgtt

SEQ ID NO: 771475 - DNA, 25 bp, Mus musculus
tccacctgtctcgagagcgtgtgtt

SEQ ID NO: 771476 - DNA, 25 bp, Mus musculus
tccaccttctcacgatttggctata

SEQ ID NO: 771477 - DNA, 25 bp, Mus musculus
tccaccttctcaggatttggctata

SEQ ID NO: 771478 - DNA, 25 bp, Mus musculus
tccaccttcttactttattaagagg

SEQ ID NO: 771479 - DNA, 25 bp, Mus musculus
tccaccttcttagtttattaagagg

SEQ ID NO: 771480 - DNA, 25 bp, Mus musculus
tccaccttgaggcaaaggtccgagg

SEQ ID NO: 771481 - DNA, 25 bp, Mus musculus
tccaccttgagggaaaggtccgagg

SEQ ID NO: 771482 - DNA, 25 bp, Mus musculus
tccaccttggatcgcctgctgagcg

SEQ ID NO: 771483 - DNA, 25 bp, Mus musculus
tccaccttggatggcctgctgagcg

SEQ ID NO: 771484 - DNA, 25 bp, Mus musculus
tccacgaagactccctcacagttgt

SEQ ID NO: 771485 - DNA, 25 bp, Mus musculus
tccacgaagactgcctcacagttgt

SEQ ID NO: 771486 - DNA, 25 bp, Mus musculus
tccacgaaggacatgaggtatccct

SEQ ID NO: 771487 - DNA, 25 bp, Mus musculus
tccacgaaggacttgaggtatccct

SEQ ID NO: 771488 - DNA, 25 bp, Mus musculus
tccacgactttgatgctagttcaag

SEQ ID NO: 771489 - DNA, 25 bp, Mus musculus
tccacgactttgttgctagttcaag

SEQ ID NO: 771490 - DNA, 25 bp, Mus musculus
tccacgagaatgagctatggtttag

SEQ ID NO: 771491 - DNA, 25 bp, Mus musculus
tccacgagaatgtgctatggtttag

SEQ ID NO: 771492 - DNA, 25 bp, Mus musculus
tccacgagagctaggcctaggcctt

SEQ ID NO: 771493 - DNA, 25 bp, Mus musculus
tccacgagagcttggcctaggcctt

SEQ ID NO: 771494 - DNA, 25 bp, Mus musculus
tccacgagcacaagcaggagctgat

SEQ ID NO: 771495 - DNA, 25 bp, Mus musculus
tccacgagcacatgcaggagctgat

SEQ ID NO: 771496 - DNA, 25 bp, Mus musculus
tccacgagcccaagatggatgcgct

SEQ ID NO: 771497 - DNA, 25 bp, Mus musculus
tccacgagcccatgatggatgcgct

SEQ ID NO: 771498 - DNA, 25 bp, Mus musculus
tccacgagctgcaccgcatgaacat

SEQ ID NO: 771499 - DNA, 25 bp, Mus musculus
tccacgagctgctccgcatgaacat

SEQ ID NO: 771500 - DNA, 25 bp, Mus musculus
tccacgagggaaaggcatatcacac

SEQ ID NO: 771501 - DNA, 25 bp, Mus musculus
tccacgagggaatggcatatcacac

SEQ ID NO: 771502 - DNA, 25 bp, Mus musculus
tccacgagtccgacgctgtcgtgag

SEQ ID NO: 771503 - DNA, 25 bp, Mus musculus
tccacgagtccgtcgctgtcgtgag

SEQ ID NO: 771504 - DNA, 25 bp, Mus musculus
tccacgagtggaagtaaagcgccct

SEQ ID NO: 771505 - DNA, 25 bp, Mus musculus
tccacgagtggatgtaaagcgccct

SEQ ID NO: 771506 - DNA, 25 bp, Mus musculus
tccacgagtggcacaagcgtgtagc

SEQ ID NO: 771507 - DNA, 25 bp, Mus musculus
tccacgagtggctcaagcgtgtagc

SEQ ID NO: 771508 - DNA, 25 bp, Mus musculus
tccacgagtgtcagagaggcagctg

SEQ ID NO: 771509 - DNA, 25 bp, Mus musculus
tccacgagtgtctgagaggcagctg

SEQ ID NO: 771510 - DNA, 25 bp, Mus musculus
tccacgatatttctaactctttgtc

SEQ ID NO: 771511 - DNA, 25 bp, Mus musculus
tccacgatatttgtaactctttgtc

SEQ ID NO: 771512 - DNA, 25 bp, Mus musculus
tccacgatgcagaaatgaatccagc

SEQ ID NO: 771513 - DNA, 25 bp, Mus musculus
tccacgatgcagtaatgaatccagc

SEQ ID NO: 771514 - DNA, 25 bp, Mus musculus
tccacgcactgtacctgggaagtag

SEQ ID NO: 771515 - DNA, 25 bp, Mus musculus
tccacgcactgttcctgggaagtag

SEQ ID NO: 771516 - DNA, 25 bp, Mus musculus
tccacgcagctacagaagcctaggt

SEQ ID NO: 771517 - DNA, 25 bp, Mus musculus
tccacgcagctagagaagcctaggt

SEQ ID NO: 771518 - DNA, 25 bp, Mus musculus
tccacgcaggacctattacaaagca

SEQ ID NO: 771519 - DNA, 25 bp, Mus musculus
tccacgcaggacgtattacaaagca

SEQ ID NO: 771520 - DNA, 25 bp, Mus musculus
tccacgccagagacttgaacaagtt

SEQ ID NO: 771521 - DNA, 25 bp, Mus musculus
tccacgccagagtcttgaacaagtt

SEQ ID NO: 771522 - DNA, 25 bp, Mus musculus
tccacgcctttgctggagtgaagga

SEQ ID NO: 771523 - DNA, 25 bp, Mus musculus
tccacgcctttggtggagtgaagga

SEQ ID NO: 771524 - DNA, 25 bp, Mus musculus
tccacgctatggatataaaccatct

SEQ ID NO: 771525 - DNA, 25 bp, Mus musculus
tccacgctatggttataaaccatct

SEQ ID NO: 771526 - DNA, 25 bp, Mus musculus
tccacgctgcctcccaattgttggt

SEQ ID NO: 771527 - DNA, 25 bp, Mus musculus
tccacgctgcctgccaattgttggt

SEQ ID NO: 771528 - DNA, 25 bp, Mus musculus
tccacgcttaatccggaagagtttt

SEQ ID NO: 771529 - DNA, 25 bp, Mus musculus
tccacgcttaatgcggaagagtttt

SEQ ID NO: 771530 - DNA, 25 bp, Mus musculus
tccacggaaaaacaaggacatccgc

SEQ ID NO: 771531 - DNA, 25 bp, Mus musculus
tccacggaaaaagaaggacatccgc

SEQ ID NO: 771532 - DNA, 25 bp, Mus musculus
tccacggaacaccagtgcatgcagg

SEQ ID NO: 771533 - DNA, 25 bp, Mus musculus
tccacggaacacgagtgcatgcagg

SEQ ID NO: 771534 - DNA, 25 bp, Mus musculus
tccacggagctgaagattaggtgct

SEQ ID NO: 771535 - DNA, 25 bp, Mus musculus
tccacggagctgtagattaggtgct

SEQ ID NO: 771536 - DNA, 25 bp, Mus musculus
tccacggagcttcccgggatggcct

SEQ ID NO: 771537 - DNA, 25 bp, Mus musculus
tccacggagcttgccgggatggcct

SEQ ID NO: 771538 - DNA, 25 bp, Mus musculus
tccacggatgccagagttgaagaca

SEQ ID NO: 771539 - DNA, 25 bp, Mus musculus
tccacggatgcctgagttgaagaca

SEQ ID NO: 771540 - DNA, 25 bp, Mus musculus
tccacggcaaagaagacatcaaagt

SEQ ID NO: 771541 - DNA, 25 bp, Mus musculus
tccacggcaaagtagacatcaaagt

SEQ ID NO: 771542 - DNA, 25 bp, Mus musculus
tccacggcaagaacacacgggagca

SEQ ID NO: 771543 - DNA, 25 bp, Mus musculus
tccacggcaagatcacacgggagca

SEQ ID NO: 771544 - DNA, 25 bp, Mus musculus
tccacggccgacaggccaagcagaa

SEQ ID NO: 771545 - DNA, 25 bp, Mus musculus
tccacggccgactggccaagcagaa

SEQ ID NO: 771546 - DNA, 25 bp, Mus musculus
tccacggcgtccagagcagattcag

SEQ ID NO: 771547 - DNA, 25 bp, Mus musculus
tccacggcgtcctgagcagattcag

SEQ ID NO: 771548 - DNA, 25 bp, Mus musculus
tccacggctcggctgttctctgcgg

SEQ ID NO: 771549 - DNA, 25 bp, Mus musculus
tccacggctcgggtgttctctgcgg

SEQ ID NO: 771550 - DNA, 25 bp, Mus musculus
tccacgggtttcagcccgcacagaa

SEQ ID NO: 771551 - DNA, 25 bp, Mus musculus
tccacgggtttctgcccgcacagaa

SEQ ID NO: 771552 - DNA, 25 bp, Mus musculus
tccacggtcattagtgttcccagag

SEQ ID NO: 771553 - DNA, 25 bp, Mus musculus
tccacggtcatttgtgttcccagag

SEQ ID NO: 771554 - DNA, 25 bp, Mus musculus
tccacggtgaacatacaatgaaggg

SEQ ID NO: 771555 - DNA, 25 bp, Mus musculus
tccacggtgaacttacaatgaaggg

SEQ ID NO: 771556 - DNA, 25 bp, Mus musculus
tccacggtggctactgtcccaagga

SEQ ID NO: 771557 - DNA, 25 bp, Mus musculus
tccacggtggcttctgtcccaagga

SEQ ID NO: 771558 - DNA, 25 bp, Mus musculus
tccacggtgtgcctcgaggcctgta

SEQ ID NO: 771559 - DNA, 25 bp, Mus musculus
tccacggtgtgcgtcgaggcctgta

SEQ ID NO: 771560 - DNA, 25 bp, Mus musculus
tccacgtacgtccagaagatgtcta

SEQ ID NO: 771561 - DNA, 25 bp, Mus musculus
tccacgtacgtcgagaagatgtcta

SEQ ID NO: 771562 - DNA, 25 bp, Mus musculus
tccacgtcagttcttgagagccccg

SEQ ID NO: 771563 - DNA, 25 bp, Mus musculus
tccacgtcagttgttgagagccccg

SEQ ID NO: 771564 - DNA, 25 bp, Mus musculus
tccacgtcgtgactgtcctctggga

SEQ ID NO: 771565 - DNA, 25 bp, Mus musculus
tccacgtcgtgagtgtcctctggga

SEQ ID NO: 771566 - DNA, 25 bp, Mus musculus
tccacgtgaaacctgggaaagcgcg

SEQ ID NO: 771567 - DNA, 25 bp, Mus musculus
tccacgtgaaacgtgggaaagcgcg

SEQ ID NO: 771568 - DNA, 25 bp, Mus musculus
tccacgtggactccgtggcatgatg

SEQ ID NO: 771569 - DNA, 25 bp, Mus musculus
tccacgtggactgcgtggcatgatg

SEQ ID NO: 771570 - DNA, 25 bp, Mus musculus
tccacgtggaggatgagatcatcgc

SEQ ID NO: 771571 - DNA, 25 bp, Mus musculus
tccacgtggaggttgagatcatcgc

SEQ ID NO: 771572 - DNA, 25 bp, Mus musculus
tccacgtggccaagatctggttctg

SEQ ID NO: 771573 - DNA, 25 bp, Mus musculus
tccacgtggccatgatctggttctg

SEQ ID NO: 771574 - DNA, 25 bp, Mus musculus
tccacgtgtacgagcagcacgagaa

SEQ ID NO: 771575 - DNA, 25 bp, Mus musculus
tccacgtgtacgtgcagcacgagaa

SEQ ID NO: 771576 - DNA, 25 bp, Mus musculus
tccacgtgtcggaagatgtgattct

SEQ ID NO: 771577 - DNA, 25 bp, Mus musculus
tccacgtgtcggtagatgtgattct

SEQ ID NO: 771578 - DNA, 25 bp, Mus musculus
tccactaaggaaagggctaagtcaa

SEQ ID NO: 771579 - DNA, 25 bp, Mus musculus
tccactaaggaatgggctaagtcaa

SEQ ID NO: 771580 - DNA, 25 bp, Mus musculus
tccactaccaacacagttatagcaa

SEQ ID NO: 771581 - DNA, 25 bp, Mus musculus
tccactaccaactcagttatagcaa

SEQ ID NO: 771582 - DNA, 25 bp, Mus musculus
tccactacgcgcacatgggtgcctt

SEQ ID NO: 771583 - DNA, 25 bp, Mus musculus
tccactacgcgctcatgggtgcctt

SEQ ID NO: 771584 - DNA, 25 bp, Mus musculus
tccactaggtccagggaacgtggga

SEQ ID NO: 771585 - DNA, 25 bp, Mus musculus
tccactaggtcctgggaacgtggga

SEQ ID NO: 771586 - DNA, 25 bp, Mus musculus
tccactagttctagtgaggtccgag

SEQ ID NO: 771587 - DNA, 25 bp, Mus musculus
tccactagttcttgtgaggtccgag

SEQ ID NO: 771588 - DNA, 25 bp, Mus musculus
tccactatgaaactggatactaaag

SEQ ID NO: 771589 - DNA, 25 bp, Mus musculus
tccactatgaaagtggatactaaag

SEQ ID NO: 771590 - DNA, 25 bp, Mus musculus
tccactatggagctccagtctgtgt

SEQ ID NO: 771591 - DNA, 25 bp, Mus musculus
tccactatggaggtccagtctgtgt

SEQ ID NO: 771592 - DNA, 25 bp, Mus musculus
tccactcaaagtaccaaggaaggct

SEQ ID NO: 771593 - DNA, 25 bp, Mus musculus
tccactcaaagttccaaggaaggct

SEQ ID NO: 771594 - DNA, 25 bp, Mus musculus
tccactcaagtgacaagactaaagc

SEQ ID NO: 771595 - DNA, 25 bp, Mus musculus
tccactcaagtgtcaagactaaagc

SEQ ID NO: 771596 - DNA, 25 bp, Mus musculus
tccactcacggaagatgaatgtcag

SEQ ID NO: 771597 - DNA, 25 bp, Mus musculus
tccactcacggatgatgaatgtcag

SEQ ID NO: 771598 - DNA, 25 bp, Mus musculus
tccactcactggagaccgaaaacat

SEQ ID NO: 771599 - DNA, 25 bp, Mus musculus
tccactcactggtgaccgaaaacat

SEQ ID NO: 771600 - DNA, 25 bp, Mus musculus
tccactcaggaaccatgggtcggga

SEQ ID NO: 771601 - DNA, 25 bp, Mus musculus
tccactcaggaagcatgggtcggga

SEQ ID NO: 771602 - DNA, 25 bp, Mus musculus
tccactcagtgcacagtgggatata

SEQ ID NO: 771603 - DNA, 25 bp, Mus musculus
tccactcagtgctcagtgggatata

SEQ ID NO: 771604 - DNA, 25 bp, Mus musculus
tccactcagtgtctaagatacccgc

SEQ ID NO: 771605 - DNA, 25 bp, Mus musculus
tccactcagtgtgtaagatacccgc

SEQ ID NO: 771606 - DNA, 25 bp, Mus musculus
tccactccagtgagtagccaaaagg

SEQ ID NO: 771607 - DNA, 25 bp, Mus musculus
tccactccagtgtgtagccaaaagg

SEQ ID NO: 771608 - DNA, 25 bp, Mus musculus
tccactcccagacgacaactatgag

SEQ ID NO: 771609 - DNA, 25 bp, Mus musculus
tccactcccagaggacaactatgag

SEQ ID NO: 771610 - DNA, 25 bp, Mus musculus
tccactcccgaaatctggacatcag

SEQ ID NO: 771611 - DNA, 25 bp, Mus musculus
tccactcccgaattctggacatcag

SEQ ID NO: 771612 - DNA, 25 bp, Mus musculus
tccactccctagctctagtttagca

SEQ ID NO: 771613 - DNA, 25 bp, Mus musculus
tccactccctaggtctagtttagca

SEQ ID NO: 771614 - DNA, 25 bp, Mus musculus
tccactcctggaacaataacgaccg

SEQ ID NO: 771615 - DNA, 25 bp, Mus musculus
tccactcctggatcaataacgaccg

SEQ ID NO: 771616 - DNA, 25 bp, Mus musculus
tccactcgcagcactatgaggcctg

SEQ ID NO: 771617 - DNA, 25 bp, Mus musculus
tccactcgcagctctatgaggcctg

SEQ ID NO: 771618 - DNA, 25 bp, Mus musculus
tccactctacgaacatttcagcagt

SEQ ID NO: 771619 - DNA, 25 bp, Mus musculus
tccactctacgatcatttcagcagt

SEQ ID NO: 771620 - DNA, 25 bp, Mus musculus
tccactctatggaaagatgcttcca

SEQ ID NO: 771621 - DNA, 25 bp, Mus musculus
tccactctatggtaagatgcttcca

SEQ ID NO: 771622 - DNA, 25 bp, Mus musculus
tccactctcaggagatctgtgctga

SEQ ID NO: 771623 - DNA, 25 bp, Mus musculus
tccactctcaggtgatctgtgctga

SEQ ID NO: 771624 - DNA, 25 bp, Mus musculus
tccactctccgaagcatgaatatgc

SEQ ID NO: 771625 - DNA, 25 bp, Mus musculus
tccactctccgatgcatgaatatgc

SEQ ID NO: 771626 - DNA, 25 bp, Mus musculus
tccactctctccaggcttgtcatct

SEQ ID NO: 771627 - DNA, 25 bp, Mus musculus
tccactctctcctggcttgtcatct

SEQ ID NO: 771628 - DNA, 25 bp, Mus musculus
tccactctgcaaccaccataggaaa

SEQ ID NO: 771629 - DNA, 25 bp, Mus musculus
tccactctgcaagcaccataggaaa

SEQ ID NO: 771630 - DNA, 25 bp, Mus musculus
tccactgaacacagggcatggcatt

SEQ ID NO: 771631 - DNA, 25 bp, Mus musculus
tccactgaacactgggcatggcatt

SEQ ID NO: 771632 - DNA, 25 bp, Mus musculus
tccactgaagttaaattgtcctatc

SEQ ID NO: 771633 - DNA, 25 bp, Mus musculus
tccactgaagttcgcatcacaaatg

SEQ ID NO: 771634 - DNA, 25 bp, Mus musculus
tccactgaagttggcatcacaaatg

SEQ ID NO: 771635 - DNA, 25 bp, Mus musculus
tccactgaagtttaattgtcctatc

SEQ ID NO: 771636 - DNA, 25 bp, Mus musculus
tccactgcagtgatcctggtcccga

SEQ ID NO: 771637 - DNA, 25 bp, Mus musculus
tccactgcagtgttcctggtcccga

SEQ ID NO: 771638 - DNA, 25 bp, Mus musculus
tccactgcatctctcgatggctcaa

SEQ ID NO: 771639 - DNA, 25 bp, Mus musculus
tccactgcatctgtcgatggctcaa

SEQ ID NO: 771640 - DNA, 25 bp, Mus musculus
tccactgctacacctgagcggtttt

SEQ ID NO: 771641 - DNA, 25 bp, Mus musculus
tccactgctacagctgagcggtttt

SEQ ID NO: 771642 - DNA, 25 bp, Mus musculus
tccactggaagaatgacagatgaca

SEQ ID NO: 771643 - DNA, 25 bp, Mus musculus
tccactggaagattgacagatgaca

SEQ ID NO: 771644 - DNA, 25 bp, Mus musculus
tccactggactacgacggaaggctg

SEQ ID NO: 771645 - DNA, 25 bp, Mus musculus
tccactggactaggacggaaggctg

SEQ ID NO: 771646 - DNA, 25 bp, Mus musculus
tccactggctcaaggatggacaggc

SEQ ID NO: 771647 - DNA, 25 bp, Mus musculus
tccactggctcatggatggacaggc

SEQ ID NO: 771648 - DNA, 25 bp, Mus musculus
tccactggctcgagtgtacgaagct

SEQ ID NO: 771649 - DNA, 25 bp, Mus musculus
tccactggctcgtgtgtacgaagct

SEQ ID NO: 771650 - DNA, 25 bp, Mus musculus
tccactgggagcagtaacatgatct

SEQ ID NO: 771651 - DNA, 25 bp, Mus musculus
tccactgggagctgtaacatgatct

SEQ ID NO: 771652 - DNA, 25 bp, Mus musculus
tccactgggtggctattctgtcacc

SEQ ID NO: 771653 - DNA, 25 bp, Mus musculus
tccactgggtgggtattctgtcacc

SEQ ID NO: 771654 - DNA, 25 bp, Mus musculus
tccactgtactgagcagtgagcttg

SEQ ID NO: 771655 - DNA, 25 bp, Mus musculus
tccactgtactgtgcagtgagcttg

SEQ ID NO: 771656 - DNA, 25 bp, Mus musculus
tccactgtcaagagcacagccagtt

SEQ ID NO: 771657 - DNA, 25 bp, Mus musculus
tccactgtcaagtgcacagccagtt

SEQ ID NO: 771658 - DNA, 25 bp, Mus musculus
tccactgtgcctcagactttcacta

SEQ ID NO: 771659 - DNA, 25 bp, Mus musculus
tccactgtgcctgagactttcacta

SEQ ID NO: 771660 - DNA, 25 bp, Mus musculus
tccactgtggataaggatcagagca

SEQ ID NO: 771661 - DNA, 25 bp, Mus musculus
tccactgtggattaggatcagagca

SEQ ID NO: 771662 - DNA, 25 bp, Mus musculus
tccactgttgttatgcctggtaaag

SEQ ID NO: 771663 - DNA, 25 bp, Mus musculus
tccactgttgttttgcctggtaaag

SEQ ID NO: 771664 - DNA, 25 bp, Mus musculus
tccacttaggagaatggagagcaca

SEQ ID NO: 771665 - DNA, 25 bp, Mus musculus
tccacttaggagtatggagagcaca

SEQ ID NO: 771666 - DNA, 25 bp, Mus musculus
tccacttcatgaagccaccacaggg

SEQ ID NO: 771667 - DNA, 25 bp, Mus musculus
tccacttcatgatgccaccacaggg

SEQ ID NO: 771668 - DNA, 25 bp, Mus musculus
tccacttcgaagctctgcagcacgt

SEQ ID NO: 771669 - DNA, 25 bp, Mus musculus
tccacttcgaaggtctgcagcacgt

SEQ ID NO: 771670 - DNA, 25 bp, Mus musculus
tccacttcggctcggtggcaggccg

SEQ ID NO: 771671 - DNA, 25 bp, Mus musculus
tccacttcggctgggtggcaggccg

SEQ ID NO: 771672 - DNA, 25 bp, Mus musculus
tccacttcgggcatcgttttcacag

SEQ ID NO: 771673 - DNA, 25 bp, Mus musculus
tccacttcgggcttcgttttcacag

SEQ ID NO: 771674 - DNA, 25 bp, Mus musculus
tccacttcgttcaggagacccagtg

SEQ ID NO: 771675 - DNA, 25 bp, Mus musculus
tccacttcgttctggagacccagtg

SEQ ID NO: 771676 - DNA, 25 bp, Mus musculus
tccacttctcccagtagatggctat

SEQ ID NO: 771677 - DNA, 25 bp, Mus musculus
tccacttctccctgtagatggctat

SEQ ID NO: 771678 - DNA, 25 bp, Mus musculus
tccacttgactcaggctggcagctc

SEQ ID NO: 771679 - DNA, 25 bp, Mus musculus
tccacttgactctggctggcagctc

SEQ ID NO: 771680 - DNA, 25 bp, Mus musculus
tccacttgagtgaagttcggtgctc

SEQ ID NO: 771681 - DNA, 25 bp, Mus musculus
tccacttgagtgtagttcggtgctc

SEQ ID NO: 771682 - DNA, 25 bp, Mus musculus
tccacttgctgtatatgaaagaaag

SEQ ID NO: 771683 - DNA, 25 bp, Mus musculus
tccacttgctgtttatgaaagaaag

SEQ ID NO: 771684 - DNA, 25 bp, Mus musculus
tccacttggaagcacgtgtggctgt

SEQ ID NO: 771685 - DNA, 25 bp, Mus musculus
tccacttggaaggacgtgtggctgt

SEQ ID NO: 771686 - DNA, 25 bp, Mus musculus
tccacttggagaagagcagcagcta

SEQ ID NO: 771687 - DNA, 25 bp, Mus musculus
tccacttggagatgagcagcagcta

SEQ ID NO: 771688 - DNA, 25 bp, Mus musculus
tccacttgtattcatcactcctagc

SEQ ID NO: 771689 - DNA, 25 bp, Mus musculus
tccacttgtattgatcactcctagc

SEQ ID NO: 771690 - DNA, 25 bp, Mus musculus
tccacttgtgtgctggatcagacca

SEQ ID NO: 771691 - DNA, 25 bp, Mus musculus
tccacttgtgtggtggatcagacca

SEQ ID NO: 771692 - DNA, 25 bp, Mus musculus
tccactttaaagaagtaggagactg

SEQ ID NO: 771693 - DNA, 25 bp, Mus musculus
tccactttaaagtagtaggagactg

SEQ ID NO: 771694 - DNA, 25 bp, Mus musculus
tccactttattgagcagatgggcgg

SEQ ID NO: 771695 - DNA, 25 bp, Mus musculus
tccactttattgtgcagatgggcgg

SEQ ID NO: 771696 - DNA, 25 bp, Mus musculus
tccactttgagtaacctgacctggg

SEQ ID NO: 771697 - DNA, 25 bp, Mus musculus
tccactttgagttacctgacctggg

SEQ ID NO: 771698 - DNA, 25 bp, Mus musculus
tccactttgataacctgaagcccta

SEQ ID NO: 771699 - DNA, 25 bp, Mus musculus
tccactttgatatcctgaagcccta

SEQ ID NO: 771700 - DNA, 25 bp, Mus musculus
tccactttgcagacatgaagtaccc

SEQ ID NO: 771701 - DNA, 25 bp, Mus musculus
tccactttgcagtcatgaagtaccc

SEQ ID NO: 771702 - DNA, 25 bp, Mus musculus
tccactttgcccctgggaagagctt

SEQ ID NO: 771703 - DNA, 25 bp, Mus musculus
tccactttgcccgtgggaagagctt

SEQ ID NO: 771704 - DNA, 25 bp, Mus musculus
tccacttttgatctgaaccagtcag

SEQ ID NO: 771705 - DNA, 25 bp, Mus musculus
tccacttttgatgtgaaccagtcag

SEQ ID NO: 771706 - DNA, 25 bp, Mus musculus
tccacttttggaacgggaaggactc

SEQ ID NO: 771707 - DNA, 25 bp, Mus musculus
tccacttttggatcgggaaggactc

SEQ ID NO: 771708 - DNA, 25 bp, Mus musculus
tccacttttgttacaccttatgctg

SEQ ID NO: 771709 - DNA, 25 bp, Mus musculus
tccacttttgtttcaccttatgctg

SEQ ID NO: 771710 - DNA, 25 bp, Mus musculus
tccagaaaagccagttcaagcgttg

SEQ ID NO: 771711 - DNA, 25 bp, Mus musculus
tccagaaaagcctgttcaagcgttg

SEQ ID NO: 771712 - DNA, 25 bp, Mus musculus
tccagaaaaggaccttctacactgt

SEQ ID NO: 771713 - DNA, 25 bp, Mus musculus
tccagaaaaggagcttctacactgt

SEQ ID NO: 771714 - DNA, 25 bp, Mus musculus
tccagaaaccaaagggagtgttcct

SEQ ID NO: 771715 - DNA, 25 bp, Mus musculus
tccagaaaccaatgggagtgttcct

SEQ ID NO: 771716 - DNA, 25 bp, Mus musculus
tccagaaacggccattcagcaagac

SEQ ID NO: 771717 - DNA, 25 bp, Mus musculus
tccagaaacggcgattcagcaagac

SEQ ID NO: 771718 - DNA, 25 bp, Mus musculus
tccagaaacttcatccagtgggagc

SEQ ID NO: 771719 - DNA, 25 bp, Mus musculus
tccagaaacttcttccagtgggagc

SEQ ID NO: 771720 - DNA, 25 bp, Mus musculus
tccagaaagacacggcagttgaagg

SEQ ID NO: 771721 - DNA, 25 bp, Mus musculus
tccagaaagacagggcagttgaagg

SEQ ID NO: 771722 - DNA, 25 bp, Mus musculus
tccagaaagatgacagtattatgcg

SEQ ID NO: 771723 - DNA, 25 bp, Mus musculus
tccagaaagatgtcagtattatgcg

SEQ ID NO: 771724 - DNA, 25 bp, Mus musculus
tccagaaagcctatgatgcctacgg

SEQ ID NO: 771725 - DNA, 25 bp, Mus musculus
tccagaaagcctttgatgcctacgg

SEQ ID NO: 771726 - DNA, 25 bp, Mus musculus
tccagaaagggaagttccaggtcat

SEQ ID NO: 771727 - DNA, 25 bp, Mus musculus
tccagaaagggatgttccaggtcat

SEQ ID NO: 771728 - DNA, 25 bp, Mus musculus
tccagaaagtacagaagaacgaatg

SEQ ID NO: 771729 - DNA, 25 bp, Mus musculus
tccagaaagtactgaagaacgaatg

SEQ ID NO: 771730 - DNA, 25 bp, Mus musculus
tccagaaatcacaaccgaagacatc

SEQ ID NO: 771731 - DNA, 25 bp, Mus musculus
tccagaaatcactaccgaagacatc

SEQ ID NO: 771732 - DNA, 25 bp, Mus musculus
tccagaaatcttagatttggctcct

SEQ ID NO: 771733 - DNA, 25 bp, Mus musculus
tccagaaatctttgatttggctcct

SEQ ID NO: 771734 - DNA, 25 bp, Mus musculus
tccagaaatgagaggcaagtgtgtg

SEQ ID NO: 771735 - DNA, 25 bp, Mus musculus
tccagaaatgagtggcaagtgtgtg

SEQ ID NO: 771736 - DNA, 25 bp, Mus musculus
tccagaaatgcccaggctattgctg

SEQ ID NO: 771737 - DNA, 25 bp, Mus musculus
tccagaaatgccgaggctattgctg

SEQ ID NO: 771738 - DNA, 25 bp, Mus musculus
tccagaaatggcaaccgcgatgaca

SEQ ID NO: 771739 - DNA, 25 bp, Mus musculus
tccagaaatggctaccgcgatgaca

SEQ ID NO: 771740 - DNA, 25 bp, Mus musculus
tccagaaatggtcggtgaaggacca

SEQ ID NO: 771741 - DNA, 25 bp, Mus musculus
tccagaaatggtgggtgaaggacca

SEQ ID NO: 771742 - DNA, 25 bp, Mus musculus
tccagaaattacaacagaagatatc

SEQ ID NO: 771743 - DNA, 25 bp, Mus musculus
tccagaaattactacagaagatatc

SEQ ID NO: 771744 - DNA, 25 bp, Mus musculus
tccagaacactgaaggcatcccatt

SEQ ID NO: 771745 - DNA, 25 bp, Mus musculus
tccagaacactgtaggcatcccatt

SEQ ID NO: 771746 - DNA, 25 bp, Mus musculus
tccagaacagaactaggatctcatt

SEQ ID NO: 771747 - DNA, 25 bp, Mus musculus
tccagaacagaagtaggatctcatt

SEQ ID NO: 771748 - DNA, 25 bp, Mus musculus
tccagaacatcaagggaagcccgat

SEQ ID NO: 771749 - DNA, 25 bp, Mus musculus
tccagaacatcatgggaagcccgat

SEQ ID NO: 771750 - DNA, 25 bp, Mus musculus
tccagaacgacaagtaagtagcacc

SEQ ID NO: 771751 - DNA, 25 bp, Mus musculus
tccagaacgacatgtaagtagcacc

SEQ ID NO: 771752 - DNA, 25 bp, Mus musculus
tccagaacgcggacttgatcgtggt

SEQ ID NO: 771753 - DNA, 25 bp, Mus musculus
tccagaacgcggtcttgatcgtggt

SEQ ID NO: 771754 - DNA, 25 bp, Mus musculus
tccagaactcatctgaaaaactgcc

SEQ ID NO: 771755 - DNA, 25 bp, Mus musculus
tccagaactcatgtgaaaaactgcc

SEQ ID NO: 771756 - DNA, 25 bp, Mus musculus
tccagaactcgtacgggtctgcttg

SEQ ID NO: 771757 - DNA, 25 bp, Mus musculus
tccagaactcgttcgggtctgcttg

SEQ ID NO: 771758 - DNA, 25 bp, Mus musculus
tccagaactggtaaggtcaggtctc

SEQ ID NO: 771759 - DNA, 25 bp, Mus musculus
tccagaactggttaggtcaggtctc

SEQ ID NO: 771760 - DNA, 25 bp, Mus musculus
tccagaacttacaggtagccgccag

SEQ ID NO: 771761 - DNA, 25 bp, Mus musculus
tccagaacttactggtagccgccag

SEQ ID NO: 771762 - DNA, 25 bp, Mus musculus
tccagaagacagcaggcctggacaa

SEQ ID NO: 771763 - DNA, 25 bp, Mus musculus
tccagaagacaggaggcctggacaa

SEQ ID NO: 771764 - DNA, 25 bp, Mus musculus
tccagaagatgtagccagactgata

SEQ ID NO: 771765 - DNA, 25 bp, Mus musculus
tccagaagatgttgccagactgata

SEQ ID NO: 771766 - DNA, 25 bp, Mus musculus
tccagaagcagcatgtaggcaccat

SEQ ID NO: 771767 - DNA, 25 bp, Mus musculus
tccagaagcagcttgtaggcaccat

SEQ ID NO: 771768 - DNA, 25 bp, Mus musculus
tccagaagcagtcgaggcagaggcc

SEQ ID NO: 771769 - DNA, 25 bp, Mus musculus
tccagaagcagtggaggcagaggcc

SEQ ID NO: 771770 - DNA, 25 bp, Mus musculus
tccagaagccctcttcatgtgtggg

SEQ ID NO: 771771 - DNA, 25 bp, Mus musculus
tccagaagccctgttcatgtgtggg

SEQ ID NO: 771772 - DNA, 25 bp, Mus musculus
tccagaagctagacgccgacaggag

SEQ ID NO: 771773 - DNA, 25 bp, Mus musculus
tccagaagctagtcgccgacaggag

SEQ ID NO: 771774 - DNA, 25 bp, Mus musculus
tccagaagcttgctagccgactgag

SEQ ID NO: 771775 - DNA, 25 bp, Mus musculus
tccagaagcttggtagccgactgag

SEQ ID NO: 771776 - DNA, 25 bp, Mus musculus
tccagaaggagtacccattgagggt

SEQ ID NO: 771777 - DNA, 25 bp, Mus musculus
tccagaaggagttcccattgagggt

SEQ ID NO: 771778 - DNA, 25 bp, Mus musculus
tccagaaggatgcttctcctgccag

SEQ ID NO: 771779 - DNA, 25 bp, Mus musculus
tccagaaggatggttctcctgccag

SEQ ID NO: 771780 - DNA, 25 bp, Mus musculus
tccagaaggcggctataaagagcct

SEQ ID NO: 771781 - DNA, 25 bp, Mus musculus
tccagaaggcgggtataaagagcct

SEQ ID NO: 771782 - DNA, 25 bp, Mus musculus
tccagaagggtcaaaggactaacga

SEQ ID NO: 771783 - DNA, 25 bp, Mus musculus
tccagaagggtctaaggactaacga

SEQ ID NO: 771784 - DNA, 25 bp, Mus musculus
tccagaagtacgcaacggaagaggc

SEQ ID NO: 771785 - DNA, 25 bp, Mus musculus
tccagaagtacggaacggaagaggc

SEQ ID NO: 771786 - DNA, 25 bp, Mus musculus
tccagaagtataatggtttcgcccc

SEQ ID NO: 771787 - DNA, 25 bp, Mus musculus
tccagaagtatattggtttcgcccc

SEQ ID NO: 771788 - DNA, 25 bp, Mus musculus
tccagaagtcaccatgagatcacca

SEQ ID NO: 771789 - DNA, 25 bp, Mus musculus
tccagaagtcacgatgagatcacca

SEQ ID NO: 771790 - DNA, 25 bp, Mus musculus
tccagaagtcgaatctaaagcagct

SEQ ID NO: 771791 - DNA, 25 bp, Mus musculus
tccagaagtcgattctaaagcagct

SEQ ID NO: 771792 - DNA, 25 bp, Mus musculus
tccagaagtgctacgtaaagagcct

SEQ ID NO: 771793 - DNA, 25 bp, Mus musculus
tccagaagtgcttcgtaaagagcct

SEQ ID NO: 771794 - DNA, 25 bp, Mus musculus
tccagaagtggcagcgaatggtagc

SEQ ID NO: 771795 - DNA, 25 bp, Mus musculus
tccagaagtggctgcgaatggtagc

SEQ ID NO: 771796 - DNA, 25 bp, Mus musculus
tccagaagtttgacagccctccctt

SEQ ID NO: 771797 - DNA, 25 bp, Mus musculus
tccagaagtttgtcagccctccctt

SEQ ID NO: 771798 - DNA, 25 bp, Mus musculus
tccagaatacaacgagaccaccgag

SEQ ID NO: 771799 - DNA, 25 bp, Mus musculus
tccagaatacaaggagaccaccgag

SEQ ID NO: 771800 - DNA, 25 bp, Mus musculus
tccagaatcccaaagctgcagcagc

SEQ ID NO: 771801 - DNA, 25 bp, Mus musculus
tccagaatcccatagctgcagcagc

SEQ ID NO: 771802 - DNA, 25 bp, Mus musculus
tccagaatccgaccttgcagggacc

SEQ ID NO: 771803 - DNA, 25 bp, Mus musculus
tccagaatccgagcttgcagggacc

SEQ ID NO: 771804 - DNA, 25 bp, Mus musculus
tccagaatctgcaccgtgacttcaa

SEQ ID NO: 771805 - DNA, 25 bp, Mus musculus
tccagaatctgctccgtgacttcaa

SEQ ID NO: 771806 - DNA, 25 bp, Mus musculus
tccagaatggagcttctgcactctg

SEQ ID NO: 771807 - DNA, 25 bp, Mus musculus
tccagaatggaggttctgcactctg

SEQ ID NO: 771808 - DNA, 25 bp, Mus musculus
tccagacaaagaagctattcttcga

SEQ ID NO: 771809 - DNA, 25 bp, Mus musculus
tccagacaaagatgctattcttcga

SEQ ID NO: 771810 - DNA, 25 bp, Mus musculus
tccagacaaccgaggctgtgctgag

SEQ ID NO: 771811 - DNA, 25 bp, Mus musculus
tccagacaaccgtggctgtgctgag

SEQ ID NO: 771812 - DNA, 25 bp, Mus musculus
tccagacaagaaaccccagaacatc

SEQ ID NO: 771813 - DNA, 25 bp, Mus musculus
tccagacaagaaccatgcgcctggg

SEQ ID NO: 771814 - DNA, 25 bp, Mus musculus
tccagacaagaagcatgcgcctggg

SEQ ID NO: 771815 - DNA, 25 bp, Mus musculus
tccagacaagaatccccagaacatc

SEQ ID NO: 771816 - DNA, 25 bp, Mus musculus
tccagacatgtccagagctgctgcg

SEQ ID NO: 771817 - DNA, 25 bp, Mus musculus
tccagacatgtcgagagctgctgcg

SEQ ID NO: 771818 - DNA, 25 bp, Mus musculus
tccagaccagtgagaatgctctggt

SEQ ID NO: 771819 - DNA, 25 bp, Mus musculus
tccagaccagtgtgaatgctctggt

SEQ ID NO: 771820 - DNA, 25 bp, Mus musculus
tccagacccagaagggtgagtgagc

SEQ ID NO: 771821 - DNA, 25 bp, Mus musculus
tccagacccagacccatcgtagtgg

SEQ ID NO: 771822 - DNA, 25 bp, Mus musculus
tccagacccagagccatcgtagtgg

SEQ ID NO: 771823 - DNA, 25 bp, Mus musculus
tccagacccagatgggtgagtgagc

SEQ ID NO: 771824 - DNA, 25 bp, Mus musculus
tccagaccccagagaaactctactt

SEQ ID NO: 771825 - DNA, 25 bp, Mus musculus
tccagaccccagtgaaactctactt

SEQ ID NO: 771826 - DNA, 25 bp, Mus musculus
tccagaccgaagcttgtttgatcaa

SEQ ID NO: 771827 - DNA, 25 bp, Mus musculus
tccagaccgaaggttgtttgatcaa

SEQ ID NO: 771828 - DNA, 25 bp, Mus musculus
tccagaccgtggatggtacaatcat

SEQ ID NO: 771829 - DNA, 25 bp, Mus musculus
tccagaccgtggttggtacaatcat

SEQ ID NO: 771830 - DNA, 25 bp, Mus musculus
tccagacctagtaaagtaaacctct

SEQ ID NO: 771831 - DNA, 25 bp, Mus musculus
tccagacctagttaagtaaacctct

SEQ ID NO: 771832 - DNA, 25 bp, Mus musculus
tccagacctctacaagcctgtggct

SEQ ID NO: 771833 - DNA, 25 bp, Mus musculus
tccagacctctagaagcctgtggct

SEQ ID NO: 771834 - DNA, 25 bp, Mus musculus
tccagacctctgaggataagaccat

SEQ ID NO: 771835 - DNA, 25 bp, Mus musculus
tccagacctctgtggataagaccat

SEQ ID NO: 771836 - DNA, 25 bp, Mus musculus
tccagacctgcccacagggcatgag

SEQ ID NO: 771837 - DNA, 25 bp, Mus musculus
tccagacctgccgacagggcatgag

SEQ ID NO: 771838 - DNA, 25 bp, Mus musculus
tccagacctggaaggtacctgcagt

SEQ ID NO: 771839 - DNA, 25 bp, Mus musculus
tccagacctggatggtacctgcagt

SEQ ID NO: 771840 - DNA, 25 bp, Mus musculus
tccagacctggtagagggagtatag

SEQ ID NO: 771841 - DNA, 25 bp, Mus musculus
tccagacctggttgagggagtatag

SEQ ID NO: 771842 - DNA, 25 bp, Mus musculus
tccagactacagagtacatatcatc

SEQ ID NO: 771843 - DNA, 25 bp, Mus musculus
tccagactacagtgtacatatcatc

SEQ ID NO: 771844 - DNA, 25 bp, Mus musculus
tccagactactgcagcctccaaaag

SEQ ID NO: 771845 - DNA, 25 bp, Mus musculus
tccagactactggagcctccaaaag

SEQ ID NO: 771846 - DNA, 25 bp, Mus musculus
tccagactcagtacagcctttgacc

SEQ ID NO: 771847 - DNA, 25 bp, Mus musculus
tccagactcagttcagcctttgacc

SEQ ID NO: 771848 - DNA, 25 bp, Mus musculus
tccagactcatccagtgctggagga

SEQ ID NO: 771849 - DNA, 25 bp, Mus musculus
tccagactcatcgagtgctggagga

SEQ ID NO: 771850 - DNA, 25 bp, Mus musculus
tccagactcctgacgttcaagttcg

SEQ ID NO: 771851 - DNA, 25 bp, Mus musculus
tccagactcctgtcgttcaagttcg

SEQ ID NO: 771852 - DNA, 25 bp, Mus musculus
tccagactcgagctgggagaattgc

SEQ ID NO: 771853 - DNA, 25 bp, Mus musculus
tccagactcgaggtgggagaattgc

SEQ ID NO: 771854 - DNA, 25 bp, Mus musculus
tccagactggcacgtgtgttccata

SEQ ID NO: 771855 - DNA, 25 bp, Mus musculus
tccagactggcaggtgtgttccata

SEQ ID NO: 771856 - DNA, 25 bp, Mus musculus
tccagactgtatcactgtaataaag

SEQ ID NO: 771857 - DNA, 25 bp, Mus musculus
tccagactgtatgactgtaataaag

SEQ ID NO: 771858 - DNA, 25 bp, Mus musculus
tccagactgttgatgggcagcagct

SEQ ID NO: 771859 - DNA, 25 bp, Mus musculus
tccagactgttgttgggcagcagct

SEQ ID NO: 771860 - DNA, 25 bp, Mus musculus
tccagactgtttaatggcggttact

SEQ ID NO: 771861 - DNA, 25 bp, Mus musculus
tccagactgttttatggcggttact

SEQ ID NO: 771862 - DNA, 25 bp, Mus musculus
tccagacttcaacgagttcgtcaaa

SEQ ID NO: 771863 - DNA, 25 bp, Mus musculus
tccagacttcaaggagttcgtcaaa

SEQ ID NO: 771864 - DNA, 25 bp, Mus musculus
tccagacttcttacgactcctcaga

SEQ ID NO: 771865 - DNA, 25 bp, Mus musculus
tccagacttctttcgactcctcaga

SEQ ID NO: 771866 - DNA, 25 bp, Mus musculus
tccagagaatgcaaccaggcctgag

SEQ ID NO: 771867 - DNA, 25 bp, Mus musculus
tccagagaatgctaccaggcctgag

SEQ ID NO: 771868 - DNA, 25 bp, Mus musculus
tccagagaatgtccttgaagcggcc

SEQ ID NO: 771869 - DNA, 25 bp, Mus musculus
tccagagaatgtgcttgaagcggcc

SEQ ID NO: 771870 - DNA, 25 bp, Mus musculus
tccagagacacacagtgggaccatg

SEQ ID NO: 771871 - DNA, 25 bp, Mus musculus
tccagagacacagagtgggaccatg

SEQ ID NO: 771872 - DNA, 25 bp, Mus musculus
tccagagacagtccagaactggatt

SEQ ID NO: 771873 - DNA, 25 bp, Mus musculus
tccagagacagtgcagaactggatt

SEQ ID NO: 771874 - DNA, 25 bp, Mus musculus
tccagagaccaacatcggcactgtg

SEQ ID NO: 771875 - DNA, 25 bp, Mus musculus
tccagagaccaagatcggcactgtg

SEQ ID NO: 771876 - DNA, 25 bp, Mus musculus
tccagagacggaaaactgtgacact

SEQ ID NO: 771877 - DNA, 25 bp, Mus musculus
tccagagacggataactgtgacact

SEQ ID NO: 771878 - DNA, 25 bp, Mus musculus
tccagagagaacagaagctcggctt

SEQ ID NO: 771879 - DNA, 25 bp, Mus musculus
tccagagagaactgaagctcggctt

SEQ ID NO: 771880 - DNA, 25 bp, Mus musculus
tccagagagtgacccggaagcagaa

SEQ ID NO: 771881 - DNA, 25 bp, Mus musculus
tccagagagtgagccggaagcagaa

SEQ ID NO: 771882 - DNA, 25 bp, Mus musculus
tccagagattcaattcagtggcccc

SEQ ID NO: 771883 - DNA, 25 bp, Mus musculus
tccagagattcatttcagtggcccc

SEQ ID NO: 771884 - DNA, 25 bp, Mus musculus
tccagagcaactacaggccttcagg

SEQ ID NO: 771885 - DNA, 25 bp, Mus musculus
tccagagcaacttcaggccttcagg

SEQ ID NO: 771886 - DNA, 25 bp, Mus musculus
tccagagcacgcaatccgaaaggtg

SEQ ID NO: 771887 - DNA, 25 bp, Mus musculus
tccagagcacgctatccgaaaggtg

SEQ ID NO: 771888 - DNA, 25 bp, Mus musculus
tccagagcagaacttcctttccttc

SEQ ID NO: 771889 - DNA, 25 bp, Mus musculus
tccagagcagaagttcctttccttc

SEQ ID NO: 771890 - DNA, 25 bp, Mus musculus
tccagagcaggaacctagatacgcc

SEQ ID NO: 771891 - DNA, 25 bp, Mus musculus
tccagagcaggatcctagatacgcc

SEQ ID NO: 771892 - DNA, 25 bp, Mus musculus
tccagagcatctacctgggccgctg

SEQ ID NO: 771893 - DNA, 25 bp, Mus musculus
tccagagcatcttcctgggccgctg

SEQ ID NO: 771894 - DNA, 25 bp, Mus musculus
tccagagccaaaagcagcggcaact

SEQ ID NO: 771895 - DNA, 25 bp, Mus musculus
tccagagccaaatgcagcggcaact

SEQ ID NO: 771896 - DNA, 25 bp, Mus musculus
tccagagccgcaagggttaattttc

SEQ ID NO: 771897 - DNA, 25 bp, Mus musculus
tccagagccgcatgggttaattttc

SEQ ID NO: 771898 - DNA, 25 bp, Mus musculus
tccagagcctgaaggatttggtgga

SEQ ID NO: 771899 - DNA, 25 bp, Mus musculus
tccagagcctgatggatttggtgga

SEQ ID NO: 771900 - DNA, 25 bp, Mus musculus
tccagagcgaatacgtgagaagagc

SEQ ID NO: 771901 - DNA, 25 bp, Mus musculus
tccagagcgaattcgtgagaagagc

SEQ ID NO: 771902 - DNA, 25 bp, Mus musculus
tccagagctcacaggccagtggtga

SEQ ID NO: 771903 - DNA, 25 bp, Mus musculus
tccagagctcactggccagtggtga

SEQ ID NO: 771904 - DNA, 25 bp, Mus musculus
tccagagctcagaagtccaagatac

SEQ ID NO: 771905 - DNA, 25 bp, Mus musculus
tccagagctcagaggaaggactcct

SEQ ID NO: 771906 - DNA, 25 bp, Mus musculus
tccagagctcagtagtccaagatac

SEQ ID NO: 771907 - DNA, 25 bp, Mus musculus
tccagagctcagtggaaggactcct

SEQ ID NO: 771908 - DNA, 25 bp, Mus musculus
tccagagctctacttgtaggcagcg

SEQ ID NO: 771909 - DNA, 25 bp, Mus musculus
tccagagctctagttgtaggcagcg

SEQ ID NO: 771910 - DNA, 25 bp, Mus musculus
tccagagctctcacaatacatggga

SEQ ID NO: 771911 - DNA, 25 bp, Mus musculus
tccagagctctcatgagtgctgagg

SEQ ID NO: 771912 - DNA, 25 bp, Mus musculus
tccagagctctccaaccatggtgca

SEQ ID NO: 771913 - DNA, 25 bp, Mus musculus
tccagagctctcgaaccatggtgca

SEQ ID NO: 771914 - DNA, 25 bp, Mus musculus
tccagagctctctcaatacatggga

SEQ ID NO: 771915 - DNA, 25 bp, Mus musculus
tccagagctctcttgagtgctgagg

SEQ ID NO: 771916 - DNA, 25 bp, Mus musculus
tccagagctcttagccgagcgtaag

SEQ ID NO: 771917 - DNA, 25 bp, Mus musculus
tccagagctctttgccgagcgtaag

SEQ ID NO: 771918 - DNA, 25 bp, Mus musculus
tccagagctgatccccgttgataaa

SEQ ID NO: 771919 - DNA, 25 bp, Mus musculus
tccagagctgatgcccgttgataaa

SEQ ID NO: 771920 - DNA, 25 bp, Mus musculus
tccagagcttgaataaaatgtgctc

SEQ ID NO: 771921 - DNA, 25 bp, Mus musculus
tccagagcttgattaaaatgtgctc

SEQ ID NO: 771922 - DNA, 25 bp, Mus musculus
tccagagctttacctgagaaacaag

SEQ ID NO: 771923 - DNA, 25 bp, Mus musculus
tccagagctttagctgagaaacaag

SEQ ID NO: 771924 - DNA, 25 bp, Mus musculus
tccagaggaaaacatgtcagatgtg

SEQ ID NO: 771925 - DNA, 25 bp, Mus musculus
tccagaggaaaagatgtcagatgtg

SEQ ID NO: 771926 - DNA, 25 bp, Mus musculus
tccagaggaaatcggtgatatgcaa

SEQ ID NO: 771927 - DNA, 25 bp, Mus musculus
tccagaggaaatgggtgatatgcaa

SEQ ID NO: 771928 - DNA, 25 bp, Mus musculus
tccagaggaaggccatcaagattgt

SEQ ID NO: 771929 - DNA, 25 bp, Mus musculus
tccagaggaagggcatcaagattgt

SEQ ID NO: 771930 - DNA, 25 bp, Mus musculus
tccagaggaagtaggtgagtacaga

SEQ ID NO: 771931 - DNA, 25 bp, Mus musculus
tccagaggaagttggtgagtacaga

SEQ ID NO: 771932 - DNA, 25 bp, Mus musculus
tccagaggacccattcctcaagagc

SEQ ID NO: 771933 - DNA, 25 bp, Mus musculus
tccagaggaccctttcctcaagagc

SEQ ID NO: 771934 - DNA, 25 bp, Mus musculus
tccagaggagcaacatcctttggcc

SEQ ID NO: 771935 - DNA, 25 bp, Mus musculus
tccagaggagcatcatcctttggcc

SEQ ID NO: 771936 - DNA, 25 bp, Mus musculus
tccagaggatgaacagagcaaaagc

SEQ ID NO: 771937 - DNA, 25 bp, Mus musculus
tccagaggatgatcagagcaaaagc

SEQ ID NO: 771938 - DNA, 25 bp, Mus musculus
tccagaggcattcttcgaccgcgtg

SEQ ID NO: 771939 - DNA, 25 bp, Mus musculus
tccagaggcattgttcgaccgcgtg

SEQ ID NO: 771940 - DNA, 25 bp, Mus musculus
tccagaggcgataactgggcaggct

SEQ ID NO: 771941 - DNA, 25 bp, Mus musculus
tccagaggcgattactgggcaggct

SEQ ID NO: 771942 - DNA, 25 bp, Mus musculus
tccagaggctctcatcgggacactg

SEQ ID NO: 771943 - DNA, 25 bp, Mus musculus
tccagaggctctgatcgggacactg

SEQ ID NO: 771944 - DNA, 25 bp, Mus musculus
tccagaggcttcattaactaccaag

SEQ ID NO: 771945 - DNA, 25 bp, Mus musculus
tccagaggcttctttaactaccaag

SEQ ID NO: 771946 - DNA, 25 bp, Mus musculus
tccagagggatacatgttacctaag

SEQ ID NO: 771947 - DNA, 25 bp, Mus musculus
tccagagggatagatgttacctaag

SEQ ID NO: 771948 - DNA, 25 bp, Mus musculus
tccagagggtgcagacttgcactgg

SEQ ID NO: 771949 - DNA, 25 bp, Mus musculus
tccagagggtgctgacttgcactgg

SEQ ID NO: 771950 - DNA, 25 bp, Mus musculus
tccagaggttcgagaggatacagaa

SEQ ID NO: 771951 - DNA, 25 bp, Mus musculus
tccagaggttcgtgaggatacagaa

SEQ ID NO: 771952 - DNA, 25 bp, Mus musculus
tccagaggtttcaacagcaaaagcc

SEQ ID NO: 771953 - DNA, 25 bp, Mus musculus
tccagaggtttctacagcaaaagcc

SEQ ID NO: 771954 - DNA, 25 bp, Mus musculus
tccagagtatgaagacctctactgc

SEQ ID NO: 771955 - DNA, 25 bp, Mus musculus
tccagagtatgatgacctctactgc

SEQ ID NO: 771956 - DNA, 25 bp, Mus musculus
tccagagtcacaatctccactgttc

SEQ ID NO: 771957 - DNA, 25 bp, Mus musculus
tccagagtcacattctccactgttc

SEQ ID NO: 771958 - DNA, 25 bp, Mus musculus
tccagagtcactaccagcccgtggg

SEQ ID NO: 771959 - DNA, 25 bp, Mus musculus
tccagagtcacttccagcccgtggg

SEQ ID NO: 771960 - DNA, 25 bp, Mus musculus
tccagagtctgaaattcttaagccc

SEQ ID NO: 771961 - DNA, 25 bp, Mus musculus
tccagagtctgatattcttaagccc

SEQ ID NO: 771962 - DNA, 25 bp, Mus musculus
tccagagtctggcttcaaaatgagc

SEQ ID NO: 771963 - DNA, 25 bp, Mus musculus
tccagagtctgggttcaaaatgagc

SEQ ID NO: 771964 - DNA, 25 bp, Mus musculus
tccagagtgacgaggagaacctgct

SEQ ID NO: 771965 - DNA, 25 bp, Mus musculus
tccagagtgacgtggagaacctgct

SEQ ID NO: 771966 - DNA, 25 bp, Mus musculus
tccagagtgccacgaatcagcaaag

SEQ ID NO: 771967 - DNA, 25 bp, Mus musculus
tccagagtgccaggaatcagcaaag

SEQ ID NO: 771968 - DNA, 25 bp, Mus musculus
tccagagtgcttccttaccctaagg

SEQ ID NO: 771969 - DNA, 25 bp, Mus musculus
tccagagtgcttgcttaccctaagg

SEQ ID NO: 771970 - DNA, 25 bp, Mus musculus
tccagagtggccaataagcacagca

SEQ ID NO: 771971 - DNA, 25 bp, Mus musculus
tccagagtggcctataagcacagca

SEQ ID NO: 771972 - DNA, 25 bp, Mus musculus
tccagagttaaaagcgaagttcggg

SEQ ID NO: 771973 - DNA, 25 bp, Mus musculus
tccagagttaaatgcgaagttcggg

SEQ ID NO: 771974 - DNA, 25 bp, Mus musculus
tccagagttggactctagcatgttc

SEQ ID NO: 771975 - DNA, 25 bp, Mus musculus
tccagagttggagtctagcatgttc

SEQ ID NO: 771976 - DNA, 25 bp, Mus musculus
tccagataatatcgccgctgccagg

SEQ ID NO: 771977 - DNA, 25 bp, Mus musculus
tccagataatatggccgctgccagg

SEQ ID NO: 771978 - DNA, 25 bp, Mus musculus
tccagataccaaagcaagacacgtg

SEQ ID NO: 771979 - DNA, 25 bp, Mus musculus
tccagataccaatgcaagacacgtg

SEQ ID NO: 771980 - DNA, 25 bp, Mus musculus
tccagatacgaaacagattgaagca

SEQ ID NO: 771981 - DNA, 25 bp, Mus musculus
tccagatacgaacaggttgaccttg

SEQ ID NO: 771982 - DNA, 25 bp, Mus musculus
tccagatacgaagaggttgaccttg

SEQ ID NO: 771983 - DNA, 25 bp, Mus musculus
tccagatacgaatcagattgaagca

SEQ ID NO: 771984 - DNA, 25 bp, Mus musculus
tccagatagcacacagtttgtattg

SEQ ID NO: 771985 - DNA, 25 bp, Mus musculus
tccagatagcactcagtttgtattg

SEQ ID NO: 771986 - DNA, 25 bp, Mus musculus
tccagatcagacaacagctgaggtg

SEQ ID NO: 771987 - DNA, 25 bp, Mus musculus
tccagatcagactacagctgaggtg

SEQ ID NO: 771988 - DNA, 25 bp, Mus musculus
tccagatcatccaggccgaagccag

SEQ ID NO: 771989 - DNA, 25 bp, Mus musculus
tccagatcatcctggccgaagccag

SEQ ID NO: 771990 - DNA, 25 bp, Mus musculus
tccagatcatggaaaatccctttgt

SEQ ID NO: 771991 - DNA, 25 bp, Mus musculus
tccagatcatggtaaatccctttgt

SEQ ID NO: 771992 - DNA, 25 bp, Mus musculus
tccagatccagtcaggccaggcact

SEQ ID NO: 771993 - DNA, 25 bp, Mus musculus
tccagatccagtgaggccaggcact

SEQ ID NO: 771994 - DNA, 25 bp, Mus musculus
tccagatcccaccaagcgggtgatg

SEQ ID NO: 771995 - DNA, 25 bp, Mus musculus
tccagatcccacgaagcgggtgatg

SEQ ID NO: 771996 - DNA, 25 bp, Mus musculus
tccagatccgagagaacgacttcct

SEQ ID NO: 771997 - DNA, 25 bp, Mus musculus
tccagatccgagtgaacgacttcct

SEQ ID NO: 771998 - DNA, 25 bp, Mus musculus
tccagatcgacaccggaaggaacgc

SEQ ID NO: 771999 - DNA, 25 bp, Mus musculus
tccagatcgacagcggaaggaacgc

SEQ ID NO: 772000 - DNA, 25 bp, Mus musculus
tccagatcgcccagtacaagtgcct

SEQ ID NO: 772001 - DNA, 25 bp, Mus musculus
tccagatcgccctgtacaagtgcct

SEQ ID NO: 772002 - DNA, 25 bp, Mus musculus
tccagatcgggactacagccattac

SEQ ID NO: 772003 - DNA, 25 bp, Mus musculus
tccagatcgggagtacagccattac

SEQ ID NO: 772004 - DNA, 25 bp, Mus musculus
tccagatctggaaacagaatagcca

SEQ ID NO: 772005 - DNA, 25 bp, Mus musculus
tccagatctggatacagaatagcca

SEQ ID NO: 772006 - DNA, 25 bp, Mus musculus
tccagatctggcacctgtacaggcc

SEQ ID NO: 772007 - DNA, 25 bp, Mus musculus
tccagatctggctcctgtacaggcc

SEQ ID NO: 772008 - DNA, 25 bp, Mus musculus
tccagatctgggagcaggagaatac

SEQ ID NO: 772009 - DNA, 25 bp, Mus musculus
tccagatctgggtgcaggagaatac

SEQ ID NO: 772010 - DNA, 25 bp, Mus musculus
tccagatcttcacgttcatcaaggt

SEQ ID NO: 772011 - DNA, 25 bp, Mus musculus
tccagatcttcaggttcatcaaggt

SEQ ID NO: 772012 - DNA, 25 bp, Mus musculus
tccagatgacttaccctctgcaagg

SEQ ID NO: 772013 - DNA, 25 bp, Mus musculus
tccagatgactttccctctgcaagg

SEQ ID NO: 772014 - DNA, 25 bp, Mus musculus
tccagatgagctcctccttgggatc

SEQ ID NO: 772015 - DNA, 25 bp, Mus musculus
tccagatgagctgctccttgggatc

SEQ ID NO: 772016 - DNA, 25 bp, Mus musculus
tccagatgctccagccgatggcctg

SEQ ID NO: 772017 - DNA, 25 bp, Mus musculus
tccagatgctcctgccgatggcctg

SEQ ID NO: 772018 - DNA, 25 bp, Mus musculus
tccagatggactccccaatgctgct

SEQ ID NO: 772019 - DNA, 25 bp, Mus musculus
tccagatggactgcccaatgctgct

SEQ ID NO: 772020 - DNA, 25 bp, Mus musculus
tccagatgggcaaagaccagacggt

SEQ ID NO: 772021 - DNA, 25 bp, Mus musculus
tccagatgggcatagaccagacggt

SEQ ID NO: 772022 - DNA, 25 bp, Mus musculus
tccagatggtgcaccggaagtagta

SEQ ID NO: 772023 - DNA, 25 bp, Mus musculus
tccagatggtgctccggaagtagta

SEQ ID NO: 772024 - DNA, 25 bp, Mus musculus
tccagatgtacactcggagaccaca

SEQ ID NO: 772025 - DNA, 25 bp, Mus musculus
tccagatgtacagtcggagaccaca

SEQ ID NO: 772026 - DNA, 25 bp, Mus musculus
tccagatgtgaaagttttccagagg

SEQ ID NO: 772027 - DNA, 25 bp, Mus musculus
tccagatgtgaatgttttccagagg

SEQ ID NO: 772028 - DNA, 25 bp, Mus musculus
tccagatgtgggaaaaatagtcccc

SEQ ID NO: 772029 - DNA, 25 bp, Mus musculus
tccagatgtgggtaaaatagtcccc

SEQ ID NO: 772030 - DNA, 25 bp, Mus musculus
tccagatgttgaatgagcctcccgg

SEQ ID NO: 772031 - DNA, 25 bp, Mus musculus
tccagatgttgattgagcctcccgg

SEQ ID NO: 772032 - DNA, 25 bp, Mus musculus
tccagattaaagaatcgcgagagct

SEQ ID NO: 772033 - DNA, 25 bp, Mus musculus
tccagattaaagtatcgcgagagct

SEQ ID NO: 772034 - DNA, 25 bp, Mus musculus
tccagattccatcgaagcacgctgc

SEQ ID NO: 772035 - DNA, 25 bp, Mus musculus
tccagattccatggaagcacgctgc

SEQ ID NO: 772036 - DNA, 25 bp, Mus musculus
tccagattctaaattgaggacttca

SEQ ID NO: 772037 - DNA, 25 bp, Mus musculus
tccagattctaatttgaggacttca

SEQ ID NO: 772038 - DNA, 25 bp, Mus musculus
tccagattgagtctggcatgccacc

SEQ ID NO: 772039 - DNA, 25 bp, Mus musculus
tccagattgagtgtggcatgccacc

SEQ ID NO: 772040 - DNA, 25 bp, Mus musculus
tccagattggtcacgggaatgtcat

SEQ ID NO: 772041 - DNA, 25 bp, Mus musculus
tccagattggtctcgggaatgtcat

SEQ ID NO: 772042 - DNA, 25 bp, Mus musculus
tccagatttcagcaggatggtcccc

SEQ ID NO: 772043 - DNA, 25 bp, Mus musculus
tccagatttcaggaggatggtcccc

SEQ ID NO: 772044 - DNA, 25 bp, Mus musculus
tccagatttcctatcagatcatcca

SEQ ID NO: 772045 - DNA, 25 bp, Mus musculus
tccagatttcctttcagatcatcca

SEQ ID NO: 772046 - DNA, 25 bp, Mus musculus
tccagattttaactcggcaggtgtc

SEQ ID NO: 772047 - DNA, 25 bp, Mus musculus
tccagattttaagtcggcaggtgtc

SEQ ID NO: 772048 - DNA, 25 bp, Mus musculus
tccagcaaaccaccacttacgtagt

SEQ ID NO: 772049 - DNA, 25 bp, Mus musculus
tccagcaaaccagcacttacgtagt

SEQ ID NO: 772050 - DNA, 25 bp, Mus musculus
tccagcaaagatccaggctgcagct

SEQ ID NO: 772051 - DNA, 25 bp, Mus musculus
tccagcaaagatgcaggctgcagct

SEQ ID NO: 772052 - DNA, 25 bp, Mus musculus
tccagcaaatcaaagccatgaagac

SEQ ID NO: 772053 - DNA, 25 bp, Mus musculus
tccagcaaatcatagccatgaagac

SEQ ID NO: 772054 - DNA, 25 bp, Mus musculus
tccagcaagttgagactgggtccca

SEQ ID NO: 772055 - DNA, 25 bp, Mus musculus
tccagcaagttgtgactgggtccca

SEQ ID NO: 772056 - DNA, 25 bp, Mus musculus
tccagcacacccaggtgagcttcga

SEQ ID NO: 772057 - DNA, 25 bp, Mus musculus
tccagcacaccctggtgagcttcga

SEQ ID NO: 772058 - DNA, 25 bp, Mus musculus
tccagcacagctctatcaatgacta

SEQ ID NO: 772059 - DNA, 25 bp, Mus musculus
tccagcacagctgtatcaatgacta

SEQ ID NO: 772060 - DNA, 25 bp, Mus musculus
tccagcacaggcaggcataaaccag

SEQ ID NO: 772061 - DNA, 25 bp, Mus musculus
tccagcacaggctggcataaaccag

SEQ ID NO: 772062 - DNA, 25 bp, Mus musculus
tccagcaccgatagaggaagtcacg

SEQ ID NO: 772063 - DNA, 25 bp, Mus musculus
tccagcaccgattgaggaagtcacg

SEQ ID NO: 772064 - DNA, 25 bp, Mus musculus
tccagcaccgtacggatcatggtct

SEQ ID NO: 772065 - DNA, 25 bp, Mus musculus
tccagcaccgtagggatcatggtct

SEQ ID NO: 772066 - DNA, 25 bp, Mus musculus
tccagcacgagcacattgtcaagtt

SEQ ID NO: 772067 - DNA, 25 bp, Mus musculus
tccagcacgagctcattgtcaagtt

SEQ ID NO: 772068 - DNA, 25 bp, Mus musculus
tccagcactcacagaacagcttgtg

SEQ ID NO: 772069 - DNA, 25 bp, Mus musculus
tccagcactcactgaacagcttgtg

SEQ ID NO: 772070 - DNA, 25 bp, Mus musculus
tccagcacttttccaaacttttctg

SEQ ID NO: 772071 - DNA, 25 bp, Mus musculus
tccagcacttttgcaaacttttctg

SEQ ID NO: 772072 - DNA, 25 bp, Mus musculus
tccagcagagccaagtcctttccag

SEQ ID NO: 772073 - DNA, 25 bp, Mus musculus
tccagcagagcctagtcctttccag

SEQ ID NO: 772074 - DNA, 25 bp, Mus musculus
tccagcagcctgatgttaacggtct

SEQ ID NO: 772075 - DNA, 25 bp, Mus musculus
tccagcagcctgttgttaacggtct

SEQ ID NO: 772076 - DNA, 25 bp, Mus musculus
tccagcaggaacatggccgctgcct

SEQ ID NO: 772077 - DNA, 25 bp, Mus musculus
tccagcaggaacttggccgctgcct

SEQ ID NO: 772078 - DNA, 25 bp, Mus musculus
tccagcagggaaactccagaagctt

SEQ ID NO: 772079 - DNA, 25 bp, Mus musculus
tccagcagggaaagctgcctgctat

SEQ ID NO: 772080 - DNA, 25 bp, Mus musculus
tccagcagggaatctccagaagctt

SEQ ID NO: 772081 - DNA, 25 bp, Mus musculus
tccagcagggaatgctgcctgctat

SEQ ID NO: 772082 - DNA, 25 bp, Mus musculus
tccagcagggatacccgagtgtggc

SEQ ID NO: 772083 - DNA, 25 bp, Mus musculus
tccagcagggattcccgagtgtggc

SEQ ID NO: 772084 - DNA, 25 bp, Mus musculus
tccagcagggcaagtttgacaccaa

SEQ ID NO: 772085 - DNA, 25 bp, Mus musculus
tccagcagggcatgtttgacaccaa

SEQ ID NO: 772086 - DNA, 25 bp, Mus musculus
tccagcagtcccaactaagcagtac

SEQ ID NO: 772087 - DNA, 25 bp, Mus musculus
tccagcagtccctactaagcagtac

SEQ ID NO: 772088 - DNA, 25 bp, Mus musculus
tccagcagtggaccggttaaccgag

SEQ ID NO: 772089 - DNA, 25 bp, Mus musculus
tccagcagtggagcggttaaccgag

SEQ ID NO: 772090 - DNA, 25 bp, Mus musculus
tccagcagtttcatatacctacaag

SEQ ID NO: 772091 - DNA, 25 bp, Mus musculus
tccagcagtttcttatacctacaag

SEQ ID NO: 772092 - DNA, 25 bp, Mus musculus
tccagcatatgtacaccaaagcaga

SEQ ID NO: 772093 - DNA, 25 bp, Mus musculus
tccagcatatgttcaccaaagcaga

SEQ ID NO: 772094 - DNA, 25 bp, Mus musculus
tccagcatccggaactttgagatca

SEQ ID NO: 772095 - DNA, 25 bp, Mus musculus
tccagcatccggtactttgagatca

SEQ ID NO: 772096 - DNA, 25 bp, Mus musculus
tccagcatgtaaatccctgccaggc

SEQ ID NO: 772097 - DNA, 25 bp, Mus musculus
tccagcatgtaattccctgccaggc

SEQ ID NO: 772098 - DNA, 25 bp, Mus musculus
tccagcattccacgtgccctctcag

SEQ ID NO: 772099 - DNA, 25 bp, Mus musculus
tccagcattccaggtgccctctcag

SEQ ID NO: 772100 - DNA, 25 bp, Mus musculus
tccagcattcggatgatgtcctgcc

SEQ ID NO: 772101 - DNA, 25 bp, Mus musculus
tccagcattcggttgatgtcctgcc

SEQ ID NO: 772102 - DNA, 25 bp, Mus musculus
tccagccaaaccagtgaccgatctg

SEQ ID NO: 772103 - DNA, 25 bp, Mus musculus
tccagccaaacctgtgaccgatctg

SEQ ID NO: 772104 - DNA, 25 bp, Mus musculus
tccagccaagcaatgtctgcgcctt

SEQ ID NO: 772105 - DNA, 25 bp, Mus musculus
tccagccaagcattgtctgcgcctt

SEQ ID NO: 772106 - DNA, 25 bp, Mus musculus
tccagccaagttagtggaggtcctg

SEQ ID NO: 772107 - DNA, 25 bp, Mus musculus
tccagccaagtttgtggaggtcctg

SEQ ID NO: 772108 - DNA, 25 bp, Mus musculus
tccagccacctgaagggctgggtcc

SEQ ID NO: 772109 - DNA, 25 bp, Mus musculus
tccagccacctgtagggctgggtcc

SEQ ID NO: 772110 - DNA, 25 bp, Mus musculus
tccagccacgatccacgatatttct

SEQ ID NO: 772111 - DNA, 25 bp, Mus musculus
tccagccacgatgcacgatatttct

SEQ ID NO: 772112 - DNA, 25 bp, Mus musculus
tccagccacgggagatattttggca

SEQ ID NO: 772113 - DNA, 25 bp, Mus musculus
tccagccacgggtgatattttggca

SEQ ID NO: 772114 - DNA, 25 bp, Mus musculus
tccagccaggatagcgacactccag

SEQ ID NO: 772115 - DNA, 25 bp, Mus musculus
tccagccaggattgcgacactccag

SEQ ID NO: 772116 - DNA, 25 bp, Mus musculus
tccagccaggcacatggtactctca

SEQ ID NO: 772117 - DNA, 25 bp, Mus musculus
tccagccaggcagatggtactctca

SEQ ID NO: 772118 - DNA, 25 bp, Mus musculus
tccagccaggcccaggttttgttct

SEQ ID NO: 772119 - DNA, 25 bp, Mus musculus
tccagccaggccgaggttttgttct

SEQ ID NO: 772120 - DNA, 25 bp, Mus musculus
tccagccaggtcagtgtgactccaa

SEQ ID NO: 772121 - DNA, 25 bp, Mus musculus
tccagccaggtctgtgtgactccaa

SEQ ID NO: 772122 - DNA, 25 bp, Mus musculus
tccagccatacgaataagagaatca

SEQ ID NO: 772123 - DNA, 25 bp, Mus musculus
tccagccatacgtataagagaatca

SEQ ID NO: 772124 - DNA, 25 bp, Mus musculus
tccagccccagcctgtgagagttgc

SEQ ID NO: 772125 - DNA, 25 bp, Mus musculus
tccagccccagcgtgtgagagttgc

SEQ ID NO: 772126 - DNA, 25 bp, Mus musculus
tccagcccctctaggaggtgtgttc

SEQ ID NO: 772127 - DNA, 25 bp, Mus musculus
tccagcccctcttggaggtgtgttc

SEQ ID NO: 772128 - DNA, 25 bp, Mus musculus
tccagccccttacggagccggaaga

SEQ ID NO: 772129 - DNA, 25 bp, Mus musculus
tccagccccttagggagccggaaga

SEQ ID NO: 772130 - DNA, 25 bp, Mus musculus
tccagcccggagaacctccggagag

SEQ ID NO: 772131 - DNA, 25 bp, Mus musculus
tccagcccggagtacctccggagag

SEQ ID NO: 772132 - DNA, 25 bp, Mus musculus
tccagccctagcactgttaatagga

SEQ ID NO: 772133 - DNA, 25 bp, Mus musculus
tccagccctagctctgttaatagga

SEQ ID NO: 772134 - DNA, 25 bp, Mus musculus
tccagccctgtacggaggccattgc

SEQ ID NO: 772135 - DNA, 25 bp, Mus musculus
tccagccctgtagggaggccattgc

SEQ ID NO: 772136 - DNA, 25 bp, Mus musculus
tccagccgagacactaagagcaaaa

SEQ ID NO: 772137 - DNA, 25 bp, Mus musculus
tccagccgagactctaagagcaaaa

SEQ ID NO: 772138 - DNA, 25 bp, Mus musculus
tccagccgagcacgaccctatgaag

SEQ ID NO: 772139 - DNA, 25 bp, Mus musculus
tccagccgagcaggaccctatgaag

SEQ ID NO: 772140 - DNA, 25 bp, Mus musculus
tccagccgggagagtgaccattgag

SEQ ID NO: 772141 - DNA, 25 bp, Mus musculus
tccagccgggagtgtgaccattgag

SEQ ID NO: 772142 - DNA, 25 bp, Mus musculus
tccagccgtgaacccttctcaggag

SEQ ID NO: 772143 - DNA, 25 bp, Mus musculus
tccagccgtgaagccttctcaggag

SEQ ID NO: 772144 - DNA, 25 bp, Mus musculus
tccagcctacttagcccctgaggtt

SEQ ID NO: 772145 - DNA, 25 bp, Mus musculus
tccagcctactttgcccctgaggtt

SEQ ID NO: 772146 - DNA, 25 bp, Mus musculus
tccagcctcataaagaagagcgctt

SEQ ID NO: 772147 - DNA, 25 bp, Mus musculus
tccagcctcatatagaagagcgctt

SEQ ID NO: 772148 - DNA, 25 bp, Mus musculus
tccagcctctggagttgtgcctagt

SEQ ID NO: 772149 - DNA, 25 bp, Mus musculus
tccagcctctggtgttgtgcctagt

SEQ ID NO: 772150 - DNA, 25 bp, Mus musculus
tccagcctgaacaagggatggctgg

SEQ ID NO: 772151 - DNA, 25 bp, Mus musculus
tccagcctgaactagggatggctgg

SEQ ID NO: 772152 - DNA, 25 bp, Mus musculus
tccagcctgaagaggtggaacccct

SEQ ID NO: 772153 - DNA, 25 bp, Mus musculus
tccagcctgaagtggtggaacccct

SEQ ID NO: 772154 - DNA, 25 bp, Mus musculus
tccagcctgagcaatggacaggtgc

SEQ ID NO: 772155 - DNA, 25 bp, Mus musculus
tccagcctgagctatggacaggtgc

SEQ ID NO: 772156 - DNA, 25 bp, Mus musculus
tccagcctgataagctggtaatgag

SEQ ID NO: 772157 - DNA, 25 bp, Mus musculus
tccagcctgatatgctggtaatgag

SEQ ID NO: 772158 - DNA, 25 bp, Mus musculus
tccagcctggctcagggttcacagt

SEQ ID NO: 772159 - DNA, 25 bp, Mus musculus
tccagcctggctgagggttcacagt

SEQ ID NO: 772160 - DNA, 25 bp, Mus musculus
tccagccttcctccatggaatggaa

SEQ ID NO: 772161 - DNA, 25 bp, Mus musculus
tccagccttcctgcatggaatggaa

SEQ ID NO: 772162 - DNA, 25 bp, Mus musculus
tccagccttgcgacaaatctcagca

SEQ ID NO: 772163 - DNA, 25 bp, Mus musculus
tccagccttgcgtcaaatctcagca

SEQ ID NO: 772164 - DNA, 25 bp, Mus musculus
tccagccttggtcaggaagtcgaaa

SEQ ID NO: 772165 - DNA, 25 bp, Mus musculus
tccagccttggtgaggaagtcgaaa

SEQ ID NO: 772166 - DNA, 25 bp, Mus musculus
tccagcgagaatatgtacaccatca

SEQ ID NO: 772167 - DNA, 25 bp, Mus musculus
tccagcgagaatttgtacaccatca

SEQ ID NO: 772168 - DNA, 25 bp, Mus musculus
tccagcgagcacaaaaccagcgctt

SEQ ID NO: 772169 - DNA, 25 bp, Mus musculus
tccagcgagcactaaaccagcgctt

SEQ ID NO: 772170 - DNA, 25 bp, Mus musculus
tccagcgaggagagtctagattccg

SEQ ID NO: 772171 - DNA, 25 bp, Mus musculus
tccagcgaggagtgtctagattccg

SEQ ID NO: 772172 - DNA, 25 bp, Mus musculus
tccagcgagtacaggtgtccctgtc

SEQ ID NO: 772173 - DNA, 25 bp, Mus musculus
tccagcgagtactggtgtccctgtc

SEQ ID NO: 772174 - DNA, 25 bp, Mus musculus
tccagcgagtctaacaggctgtgga

SEQ ID NO: 772175 - DNA, 25 bp, Mus musculus
tccagcgagtcttacaggctgtgga

SEQ ID NO: 772176 - DNA, 25 bp, Mus musculus
tccagcgataccatcccagtgatag

SEQ ID NO: 772177 - DNA, 25 bp, Mus musculus
tccagcgataccttcccagtgatag

SEQ ID NO: 772178 - DNA, 25 bp, Mus musculus
tccagcgatgagacattcgccatga

SEQ ID NO: 772179 - DNA, 25 bp, Mus musculus
tccagcgatgagtcattcgccatga

SEQ ID NO: 772180 - DNA, 25 bp, Mus musculus
tccagcgcatctcattagcatctca

SEQ ID NO: 772181 - DNA, 25 bp, Mus musculus
tccagcgcatctgattagcatctca

SEQ ID NO: 772182 - DNA, 25 bp, Mus musculus
tccagcgccatccagaatgtgactg

SEQ ID NO: 772183 - DNA, 25 bp, Mus musculus
tccagcgccatcgagaatgtgactg

SEQ ID NO: 772184 - DNA, 25 bp, Mus musculus
tccagcgcgaacacgtgcgctctgg

SEQ ID NO: 772185 - DNA, 25 bp, Mus musculus
tccagcgcgaactcgtgcgctctgg

SEQ ID NO: 772186 - DNA, 25 bp, Mus musculus
tccagcgctgtgaagacatcctaca

SEQ ID NO: 772187 - DNA, 25 bp, Mus musculus
tccagcgctgtgtagacatcctaca

SEQ ID NO: 772188 - DNA, 25 bp, Mus musculus
tccagcggagaaaaacatatctcca

SEQ ID NO: 772189 - DNA, 25 bp, Mus musculus
tccagcggagaataacatatctcca

SEQ ID NO: 772190 - DNA, 25 bp, Mus musculus
tccagcggcagcacatgctgtggtc

SEQ ID NO: 772191 - DNA, 25 bp, Mus musculus
tccagcggcagctcatgctgtggtc

SEQ ID NO: 772192 - DNA, 25 bp, Mus musculus
tccagcgggcctcgccaacaagatt

SEQ ID NO: 772193 - DNA, 25 bp, Mus musculus
tccagcgggcctggccaacaagatt

SEQ ID NO: 772194 - DNA, 25 bp, Mus musculus
tccagcgggcgacgctttatacttg

SEQ ID NO: 772195 - DNA, 25 bp, Mus musculus
tccagcgggcgaggctttatacttg

SEQ ID NO: 772196 - DNA, 25 bp, Mus musculus
tccagcggttctattacactaagtc

SEQ ID NO: 772197 - DNA, 25 bp, Mus musculus
tccagcggttcttttacactaagtc

SEQ ID NO: 772198 - DNA, 25 bp, Mus musculus
tccagcgtgggaagccagagactga

SEQ ID NO: 772199 - DNA, 25 bp, Mus musculus
tccagcgtgggatgccagagactga

SEQ ID NO: 772200 - DNA, 25 bp, Mus musculus
tccagcgtgtagcaataatacctcc

SEQ ID NO: 772201 - DNA, 25 bp, Mus musculus
tccagcgtgtaggaataatacctcc

SEQ ID NO: 772202 - DNA, 25 bp, Mus musculus
tccagcgtgtggatgttatgaacag

SEQ ID NO: 772203 - DNA, 25 bp, Mus musculus
tccagcgtgtggttgttatgaacag

SEQ ID NO: 772204 - DNA, 25 bp, Mus musculus
tccagctaccgacgtgggaacaact

SEQ ID NO: 772205 - DNA, 25 bp, Mus musculus
tccagctaccgaggtgggaacaact

SEQ ID NO: 772206 - DNA, 25 bp, Mus musculus
tccagctactgtagcagttacgtag

SEQ ID NO: 772207 - DNA, 25 bp, Mus musculus
tccagctactgttgcagttacgtag

SEQ ID NO: 772208 - DNA, 25 bp, Mus musculus
tccagctcaatcagctgcagcttga

SEQ ID NO: 772209 - DNA, 25 bp, Mus musculus
tccagctcaatctgctgcagcttga

SEQ ID NO: 772210 - DNA, 25 bp, Mus musculus
tccagctcaatgactcggcatctta

SEQ ID NO: 772211 - DNA, 25 bp, Mus musculus
tccagctcaatgtctcggcatctta

SEQ ID NO: 772212 - DNA, 25 bp, Mus musculus
tccagctcagcaagcgctggcggca

SEQ ID NO: 772213 - DNA, 25 bp, Mus musculus
tccagctcagcatgcgctggcggca

SEQ ID NO: 772214 - DNA, 25 bp, Mus musculus
tccagctcctccctttttataagga

SEQ ID NO: 772215 - DNA, 25 bp, Mus musculus
tccagctcctccgtttttataagga

SEQ ID NO: 772216 - DNA, 25 bp, Mus musculus
tccagctcgaaccagtagtacatag

SEQ ID NO: 772217 - DNA, 25 bp, Mus musculus
tccagctcgaacgagtagtacatag

SEQ ID NO: 772218 - DNA, 25 bp, Mus musculus
tccagctcgggtaaggagtctcaag

SEQ ID NO: 772219 - DNA, 25 bp, Mus musculus
tccagctcgggttaggagtctcaag

SEQ ID NO: 772220 - DNA, 25 bp, Mus musculus
tccagctctgacacagactttgagc

SEQ ID NO: 772221 - DNA, 25 bp, Mus musculus
tccagctctgactcagactttgagc

SEQ ID NO: 772222 - DNA, 25 bp, Mus musculus
tccagctgaaggaaacgctcccact

SEQ ID NO: 772223 - DNA, 25 bp, Mus musculus
tccagctgaaggtaacgctcccact

SEQ ID NO: 772224 - DNA, 25 bp, Mus musculus
tccagctgactcaggtaacgaccaa

SEQ ID NO: 772225 - DNA, 25 bp, Mus musculus
tccagctgactctggtaacgaccaa

SEQ ID NO: 772226 - DNA, 25 bp, Mus musculus
tccagctgactgacaacgtggtggc

SEQ ID NO: 772227 - DNA, 25 bp, Mus musculus
tccagctgactgtcaacgtggtggc

SEQ ID NO: 772228 - DNA, 25 bp, Mus musculus
tccagctgagataaaactttttgac

SEQ ID NO: 772229 - DNA, 25 bp, Mus musculus
tccagctgagattaaactttttgac

SEQ ID NO: 772230 - DNA, 25 bp, Mus musculus
tccagctgattgacgcgggtccttc

SEQ ID NO: 772231 - DNA, 25 bp, Mus musculus
tccagctgattgtcgcgggtccttc

SEQ ID NO: 772232 - DNA, 25 bp, Mus musculus
tccagctgcccacatggttttaaaa

SEQ ID NO: 772233 - DNA, 25 bp, Mus musculus
tccagctgcccagatggttttaaaa

SEQ ID NO: 772234 - DNA, 25 bp, Mus musculus
tccagctgccccaaagaagcgtaag

SEQ ID NO: 772235 - DNA, 25 bp, Mus musculus
tccagctgcccctaagaagcgtaag

SEQ ID NO: 772236 - DNA, 25 bp, Mus musculus
tccagctgctcaagacccacggtgt

SEQ ID NO: 772237 - DNA, 25 bp, Mus musculus
tccagctgctcatgacccacggtgt

SEQ ID NO: 772238 - DNA, 25 bp, Mus musculus
tccagctggaagacttgctgacgcc

SEQ ID NO: 772239 - DNA, 25 bp, Mus musculus
tccagctggaagtcttgctgacgcc

SEQ ID NO: 772240 - DNA, 25 bp, Mus musculus
tccagctggccgcagtaaggcagaa

SEQ ID NO: 772241 - DNA, 25 bp, Mus musculus
tccagctggccggagtaaggcagaa

SEQ ID NO: 772242 - DNA, 25 bp, Mus musculus
tccagctggtcaacaaggaactgaa

SEQ ID NO: 772243 - DNA, 25 bp, Mus musculus
tccagctggtcaatggcaccatgtg

SEQ ID NO: 772244 - DNA, 25 bp, Mus musculus
tccagctggtcatcaaggaactgaa

SEQ ID NO: 772245 - DNA, 25 bp, Mus musculus
tccagctggtcattggcaccatgtg

SEQ ID NO: 772246 - DNA, 25 bp, Mus musculus
tccagctggtgtcaggcagtctcct

SEQ ID NO: 772247 - DNA, 25 bp, Mus musculus
tccagctggtgtgaggcagtctcct

SEQ ID NO: 772248 - DNA, 25 bp, Mus musculus
tccagctgtcttcccctctatgaga

SEQ ID NO: 772249 - DNA, 25 bp, Mus musculus
tccagctgtcttgccctctatgaga

SEQ ID NO: 772250 - DNA, 25 bp, Mus musculus
tccagctgtgagagtcacttgtgct

SEQ ID NO: 772251 - DNA, 25 bp, Mus musculus
tccagctgtgagtgtcacttgtgct

SEQ ID NO: 772252 - DNA, 25 bp, Mus musculus
tccagctgtggcaacgaaagcattg

SEQ ID NO: 772253 - DNA, 25 bp, Mus musculus
tccagctgtggctacgaaagcattg

SEQ ID NO: 772254 - DNA, 25 bp, Mus musculus
tccagctgtgggaagaaatgctcag

SEQ ID NO: 772255 - DNA, 25 bp, Mus musculus
tccagctgtgggtagaaatgctcag

SEQ ID NO: 772256 - DNA, 25 bp, Mus musculus
tccagctgttggatcaagatctgga

SEQ ID NO: 772257 - DNA, 25 bp, Mus musculus
tccagctgttggttcaagatctgga

SEQ ID NO: 772258 - DNA, 25 bp, Mus musculus
tccagctgtttgagatctgctaatt

SEQ ID NO: 772259 - DNA, 25 bp, Mus musculus
tccagctgtttgtgatctgctaatt

SEQ ID NO: 772260 - DNA, 25 bp, Mus musculus
tccagcttagcaaccagctgccatt

SEQ ID NO: 772261 - DNA, 25 bp, Mus musculus
tccagcttagcatccagctgccatt

SEQ ID NO: 772262 - DNA, 25 bp, Mus musculus
tccagcttcaacattgatggacact

SEQ ID NO: 772263 - DNA, 25 bp, Mus musculus
tccagcttcaactttgatggacact

SEQ ID NO: 772264 - DNA, 25 bp, Mus musculus
tccagcttcctgaaaagagagacat

SEQ ID NO: 772265 - DNA, 25 bp, Mus musculus
tccagcttcctgtaaagagagacat

SEQ ID NO: 772266 - DNA, 25 bp, Mus musculus
tccagcttcgaacgcagagatcctg

SEQ ID NO: 772267 - DNA, 25 bp, Mus musculus
tccagcttcgaaggcagagatcctg

SEQ ID NO: 772268 - DNA, 25 bp, Mus musculus
tccagcttctggaaatggcccgcaa

SEQ ID NO: 772269 - DNA, 25 bp, Mus musculus
tccagcttctggtaatggcccgcaa

SEQ ID NO: 772270 - DNA, 25 bp, Mus musculus
tccagcttgaccatgccaataccaa

SEQ ID NO: 772271 - DNA, 25 bp, Mus musculus
tccagcttgaccttgccaataccaa

SEQ ID NO: 772272 - DNA, 25 bp, Mus musculus
tccagcttgggccagagactctact

SEQ ID NO: 772273 - DNA, 25 bp, Mus musculus
tccagcttgggcgagagactctact

SEQ ID NO: 772274 - DNA, 25 bp, Mus musculus
tccagcttgggtcccacctgtgatg

SEQ ID NO: 772275 - DNA, 25 bp, Mus musculus
tccagcttgggtgccacctgtgatg

SEQ ID NO: 772276 - DNA, 25 bp, Mus musculus
tccagcttttggaagccccggtggc

SEQ ID NO: 772277 - DNA, 25 bp, Mus musculus
tccagcttttggtagccccggtggc

SEQ ID NO: 772278 - DNA, 25 bp, Mus musculus
tccaggaaagacaggattctcagcc

SEQ ID NO: 772279 - DNA, 25 bp, Mus musculus
tccaggaaagactggattctcagcc

SEQ ID NO: 772280 - DNA, 25 bp, Mus musculus
tccaggaaatgaacatagaactcat

SEQ ID NO: 772281 - DNA, 25 bp, Mus musculus
tccaggaaatgatcatagaactcat

SEQ ID NO: 772282 - DNA, 25 bp, Mus musculus
tccaggaaatggctattgatatcat

SEQ ID NO: 772283 - DNA, 25 bp, Mus musculus
tccaggaaatgggtattgatatcat

SEQ ID NO: 772284 - DNA, 25 bp, Mus musculus
tccaggaaatttatcgcatgacccc

SEQ ID NO: 772285 - DNA, 25 bp, Mus musculus
tccaggaaatttttcgcatgacccc

SEQ ID NO: 772286 - DNA, 25 bp, Mus musculus
tccaggaaccataccttggaagagg

SEQ ID NO: 772287 - DNA, 25 bp, Mus musculus
tccaggaaccattccttggaagagg

SEQ ID NO: 772288 - DNA, 25 bp, Mus musculus
tccaggaagaacagaccgctcggaa

SEQ ID NO: 772289 - DNA, 25 bp, Mus musculus
tccaggaagaactgaccgctcggaa

SEQ ID NO: 772290 - DNA, 25 bp, Mus musculus
tccaggaagcgcatgaagtctgttc

SEQ ID NO: 772291 - DNA, 25 bp, Mus musculus
tccaggaagcgcttgaagtctgttc

SEQ ID NO: 772292 - DNA, 25 bp, Mus musculus
tccaggaagcggatcccagagtcga

SEQ ID NO: 772293 - DNA, 25 bp, Mus musculus
tccaggaagcggttcccagagtcga

SEQ ID NO: 772294 - DNA, 25 bp, Mus musculus
tccaggaagtcacgcacagaagagc

SEQ ID NO: 772295 - DNA, 25 bp, Mus musculus
tccaggaagtcaggcacagaagagc

SEQ ID NO: 772296 - DNA, 25 bp, Mus musculus
tccaggaatgcaactccacagctaa

SEQ ID NO: 772297 - DNA, 25 bp, Mus musculus
tccaggaatgcaagacatcctctgc

SEQ ID NO: 772298 - DNA, 25 bp, Mus musculus
tccaggaatgcatctccacagctaa

SEQ ID NO: 772299 - DNA, 25 bp, Mus musculus
tccaggaatgcatgacatcctctgc

SEQ ID NO: 772300 - DNA, 25 bp, Mus musculus
tccaggacaatcctgacctccagga

SEQ ID NO: 772301 - DNA, 25 bp, Mus musculus
tccaggacaatcgtgacctccagga

SEQ ID NO: 772302 - DNA, 25 bp, Mus musculus
tccaggacaccacgcggagccaaat

SEQ ID NO: 772303 - DNA, 25 bp, Mus musculus
tccaggacaccaggcggagccaaat

SEQ ID NO: 772304 - DNA, 25 bp, Mus musculus
tccaggacagtgatgcaggctccta

SEQ ID NO: 772305 - DNA, 25 bp, Mus musculus
tccaggacagtgttgcaggctccta

SEQ ID NO: 772306 - DNA, 25 bp, Mus musculus
tccaggacatcgagaatgcgtacaa

SEQ ID NO: 772307 - DNA, 25 bp, Mus musculus
tccaggacatcgtgaatgcgtacaa

SEQ ID NO: 772308 - DNA, 25 bp, Mus musculus
tccaggacatgaagaccaactctgg

SEQ ID NO: 772309 - DNA, 25 bp, Mus musculus
tccaggacatgatgaccaactctgg

SEQ ID NO: 772310 - DNA, 25 bp, Mus musculus
tccaggacatgccagagagccagga

SEQ ID NO: 772311 - DNA, 25 bp, Mus musculus
tccaggacatgcgagagagccagga

SEQ ID NO: 772312 - DNA, 25 bp, Mus musculus
tccaggacattgcaaagaatcccag

SEQ ID NO: 772313 - DNA, 25 bp, Mus musculus
tccaggacattggaaagaatcccag

SEQ ID NO: 772314 - DNA, 25 bp, Mus musculus
tccaggacccctccgtgtagtagag

SEQ ID NO: 772315 - DNA, 25 bp, Mus musculus
tccaggacccctgcgtgtagtagag

SEQ ID NO: 772316 - DNA, 25 bp, Mus musculus
tccaggacctgcagcacgaggcgct

SEQ ID NO: 772317 - DNA, 25 bp, Mus musculus
tccaggacctgctgcacgaggcgct

SEQ ID NO: 772318 - DNA, 25 bp, Mus musculus
tccaggacggagaatcaccaagtca

SEQ ID NO: 772319 - DNA, 25 bp, Mus musculus
tccaggacggagtatcaccaagtca

SEQ ID NO: 772320 - DNA, 25 bp, Mus musculus
tccaggactagcatgctgcctgcct

SEQ ID NO: 772321 - DNA, 25 bp, Mus musculus
tccaggactagcttgctgcctgcct

SEQ ID NO: 772322 - DNA, 25 bp, Mus musculus
tccaggactcgcaggtaggccagag

SEQ ID NO: 772323 - DNA, 25 bp, Mus musculus
tccaggactcgctggtaggccagag

SEQ ID NO: 772324 - DNA, 25 bp, Mus musculus
tccaggactgggatttccctccacg

SEQ ID NO: 772325 - DNA, 25 bp, Mus musculus
tccaggactgggttttccctccacg

SEQ ID NO: 772326 - DNA, 25 bp, Mus musculus
tccaggactttcacttatcaagtaa

SEQ ID NO: 772327 - DNA, 25 bp, Mus musculus
tccaggactttctcttatcaagtaa

SEQ ID NO: 772328 - DNA, 25 bp, Mus musculus
tccaggagaaaacagcagaattgaa

SEQ ID NO: 772329 - DNA, 25 bp, Mus musculus
tccaggagaaaagagcagaattgaa

SEQ ID NO: 772330 - DNA, 25 bp, Mus musculus
tccaggagaagaatgcgcatgccat

SEQ ID NO: 772331 - DNA, 25 bp, Mus musculus
tccaggagaagattgcgcatgccat

SEQ ID NO: 772332 - DNA, 25 bp, Mus musculus
tccaggagacacaagcagctgggcc

SEQ ID NO: 772333 - DNA, 25 bp, Mus musculus
tccaggagacactagcagctgggcc

SEQ ID NO: 772334 - DNA, 25 bp, Mus musculus
tccaggagaccaaccgggaagcatt

SEQ ID NO: 772335 - DNA, 25 bp, Mus musculus
tccaggagaccatccgggaagcatt

SEQ ID NO: 772336 - DNA, 25 bp, Mus musculus
tccaggagagtaactcgctacgccc

SEQ ID NO: 772337 - DNA, 25 bp, Mus musculus
tccaggagagtatctcgctacgccc

SEQ ID NO: 772338 - DNA, 25 bp, Mus musculus
tccaggagatttctagttgccccag

SEQ ID NO: 772339 - DNA, 25 bp, Mus musculus
tccaggagatttgtagttgccccag

SEQ ID NO: 772340 - DNA, 25 bp, Mus musculus
tccaggagccgcatctacacagtca

SEQ ID NO: 772341 - DNA, 25 bp, Mus musculus
tccaggagccgcttctacacagtca

SEQ ID NO: 772342 - DNA, 25 bp, Mus musculus
tccaggagctaaacacagggagcct

SEQ ID NO: 772343 - DNA, 25 bp, Mus musculus
tccaggagctaatcacagggagcct

SEQ ID NO: 772344 - DNA, 25 bp, Mus musculus
tccaggagctagctcacgagctggc

SEQ ID NO: 772345 - DNA, 25 bp, Mus musculus
tccaggagctaggtcacgagctggc

SEQ ID NO: 772346 - DNA, 25 bp, Mus musculus
tccaggagctcaaagaccagcttga

SEQ ID NO: 772347 - DNA, 25 bp, Mus musculus
tccaggagctcatagaccagcttga

SEQ ID NO: 772348 - DNA, 25 bp, Mus musculus
tccaggaggccgctgtgcgaggtgt

SEQ ID NO: 772349 - DNA, 25 bp, Mus musculus
tccaggaggccggtgtgcgaggtgt

SEQ ID NO: 772350 - DNA, 25 bp, Mus musculus
tccaggagggcaagtatgagttccc

SEQ ID NO: 772351 - DNA, 25 bp, Mus musculus
tccaggagggcatgtatgagttccc

SEQ ID NO: 772352 - DNA, 25 bp, Mus musculus
tccaggaggtggacacccgcatcca

SEQ ID NO: 772353 - DNA, 25 bp, Mus musculus
tccaggaggtggtcacccgcatcca

SEQ ID NO: 772354 - DNA, 25 bp, Mus musculus
tccaggagtgataccagctttagtc

SEQ ID NO: 772355 - DNA, 25 bp, Mus musculus
tccaggagtgatcctgaagcgaagc

SEQ ID NO: 772356 - DNA, 25 bp, Mus musculus
tccaggagtgatgctgaagcgaagc

SEQ ID NO: 772357 - DNA, 25 bp, Mus musculus
tccaggagtgattccagctttagtc

SEQ ID NO: 772358 - DNA, 25 bp, Mus musculus
tccaggagttcccaagttcatttct

SEQ ID NO: 772359 - DNA, 25 bp, Mus musculus
tccaggagttccgaagttcatttct

SEQ ID NO: 772360 - DNA, 25 bp, Mus musculus
tccaggagttctaccgctgtctggt

SEQ ID NO: 772361 - DNA, 25 bp, Mus musculus
tccaggagttcttccgctgtctggt

SEQ ID NO: 772362 - DNA, 25 bp, Mus musculus
tccaggagttgaagccaggactgtc

SEQ ID NO: 772363 - DNA, 25 bp, Mus musculus
tccaggagttgatgccaggactgtc

SEQ ID NO: 772364 - DNA, 25 bp, Mus musculus
tccaggatcactatgaccacaacat

SEQ ID NO: 772365 - DNA, 25 bp, Mus musculus
tccaggatcactttgaccacaacat

SEQ ID NO: 772366 - DNA, 25 bp, Mus musculus
tccaggatccacacagttactactg

SEQ ID NO: 772367 - DNA, 25 bp, Mus musculus
tccaggatccactcagttactactg

SEQ ID NO: 772368 - DNA, 25 bp, Mus musculus
tccaggatcccgatgtagttgttgc

SEQ ID NO: 772369 - DNA, 25 bp, Mus musculus
tccaggatcccgttgtagttgttgc

SEQ ID NO: 772370 - DNA, 25 bp, Mus musculus
tccaggatcttgaactttggcctct

SEQ ID NO: 772371 - DNA, 25 bp, Mus musculus
tccaggatcttgtactttggcctct

SEQ ID NO: 772372 - DNA, 25 bp, Mus musculus
tccaggatgactatgacccgtacgc

SEQ ID NO: 772373 - DNA, 25 bp, Mus musculus
tccaggatgactttgacccgtacgc

SEQ ID NO: 772374 - DNA, 25 bp, Mus musculus
tccaggatgcctcgtccatgggcac

SEQ ID NO: 772375 - DNA, 25 bp, Mus musculus
tccaggatgcctggtccatgggcac

SEQ ID NO: 772376 - DNA, 25 bp, Mus musculus
tccaggatggcccacagtttctgaa

SEQ ID NO: 772377 - DNA, 25 bp, Mus musculus
tccaggatggccgacagtttctgaa

SEQ ID NO: 772378 - DNA, 25 bp, Mus musculus
tccaggatgtcacatttgtcagcaa

SEQ ID NO: 772379 - DNA, 25 bp, Mus musculus
tccaggatgtcagatttgtcagcaa

SEQ ID NO: 772380 - DNA, 25 bp, Mus musculus
tccaggattacccaaagctgagcag

SEQ ID NO: 772381 - DNA, 25 bp, Mus musculus
tccaggattaccgaaagctgagcag

SEQ ID NO: 772382 - DNA, 25 bp, Mus musculus
tccaggattatcagagcactcagct

SEQ ID NO: 772383 - DNA, 25 bp, Mus musculus
tccaggattatctgagcactcagct

SEQ ID NO: 772384 - DNA, 25 bp, Mus musculus
tccaggcacgcgagggctgcttttt

SEQ ID NO: 772385 - DNA, 25 bp, Mus musculus
tccaggcacgcgtgggctgcttttt

SEQ ID NO: 772386 - DNA, 25 bp, Mus musculus
tccaggcactacagctcacaggttg

SEQ ID NO: 772387 - DNA, 25 bp, Mus musculus
tccaggcactactgctcacaggttg

SEQ ID NO: 772388 - DNA, 25 bp, Mus musculus
tccaggcagaccaccgtggatcaaa

SEQ ID NO: 772389 - DNA, 25 bp, Mus musculus
tccaggcagacctccgtggatcaaa

SEQ ID NO: 772390 - DNA, 25 bp, Mus musculus
tccaggcagagcagtgcaccattga

SEQ ID NO: 772391 - DNA, 25 bp, Mus musculus
tccaggcagagctgtgcaccattga

SEQ ID NO: 772392 - DNA, 25 bp, Mus musculus
tccaggcagaggaaatcatgaagct

SEQ ID NO: 772393 - DNA, 25 bp, Mus musculus
tccaggcagaggtaatcatgaagct

SEQ ID NO: 772394 - DNA, 25 bp, Mus musculus
tccaggcagctcaggatgaatatga

SEQ ID NO: 772395 - DNA, 25 bp, Mus musculus
tccaggcagctctggatgaatatga

SEQ ID NO: 772396 - DNA, 25 bp, Mus musculus
tccaggcaggacagcttctttaaat

SEQ ID NO: 772397 - DNA, 25 bp, Mus musculus
tccaggcaggactgcttctttaaat

SEQ ID NO: 772398 - DNA, 25 bp, Mus musculus
tccaggcatacaatgaagctggtct

SEQ ID NO: 772399 - DNA, 25 bp, Mus musculus
tccaggcatacattgaagctggtct

SEQ ID NO: 772400 - DNA, 25 bp, Mus musculus
tccaggcatgcccttagagcatggt

SEQ ID NO: 772401 - DNA, 25 bp, Mus musculus
tccaggcatgccgttagagcatggt

SEQ ID NO: 772402 - DNA, 25 bp, Mus musculus
tccaggcatggaccagatagttctg

SEQ ID NO: 772403 - DNA, 25 bp, Mus musculus
tccaggcatggagcagatagttctg

SEQ ID NO: 772404 - DNA, 25 bp, Mus musculus
tccaggcattgcagggagggacatg

SEQ ID NO: 772405 - DNA, 25 bp, Mus musculus
tccaggcattgctgggagggacatg

SEQ ID NO: 772406 - DNA, 25 bp, Mus musculus
tccaggccaacaataccgagatgct

SEQ ID NO: 772407 - DNA, 25 bp, Mus musculus
tccaggccaacattaccgagatgct

SEQ ID NO: 772408 - DNA, 25 bp, Mus musculus
tccaggccaaccaatccacattgtg

SEQ ID NO: 772409 - DNA, 25 bp, Mus musculus
tccaggccaacctatccacattgtg

SEQ ID NO: 772410 - DNA, 25 bp, Mus musculus
tccaggccactgactatgtggagat

SEQ ID NO: 772411 - DNA, 25 bp, Mus musculus
tccaggccactgtctatgtggagat

SEQ ID NO: 772412 - DNA, 25 bp, Mus musculus
tccaggccaggtcgacggaagacac

SEQ ID NO: 772413 - DNA, 25 bp, Mus musculus
tccaggccaggtggacggaagacac

SEQ ID NO: 772414 - DNA, 25 bp, Mus musculus
tccaggcccactatttacagatggt

SEQ ID NO: 772415 - DNA, 25 bp, Mus musculus
tccaggcccactttttacagatggt

SEQ ID NO: 772416 - DNA, 25 bp, Mus musculus
tccaggccctgtagtttaacttcag

SEQ ID NO: 772417 - DNA, 25 bp, Mus musculus
tccaggccctgttgtttaacttcag

SEQ ID NO: 772418 - DNA, 25 bp, Mus musculus
tccaggccgccaataaccgggcgga

SEQ ID NO: 772419 - DNA, 25 bp, Mus musculus
tccaggccgccattaaccgggcgga

SEQ ID NO: 772420 - DNA, 25 bp, Mus musculus
tccaggccgtgtacttcggcatctg

SEQ ID NO: 772421 - DNA, 25 bp, Mus musculus
tccaggccgtgttcttcggcatctg

SEQ ID NO: 772422 - DNA, 25 bp, Mus musculus
tccaggcctacaacgagcagtgcca

SEQ ID NO: 772423 - DNA, 25 bp, Mus musculus
tccaggcctacatcgagcagtgcca

SEQ ID NO: 772424 - DNA, 25 bp, Mus musculus
tccaggcctcacacggcggatgtct

SEQ ID NO: 772425 - DNA, 25 bp, Mus musculus
tccaggcctcactcggcggatgtct

SEQ ID NO: 772426 - DNA, 25 bp, Mus musculus
tccaggcctgtgatagtcctcagcg

SEQ ID NO: 772427 - DNA, 25 bp, Mus musculus
tccaggcctgtgttagtcctcagcg

SEQ ID NO: 772428 - DNA, 25 bp, Mus musculus
tccaggccttcgaggagaacatggc

SEQ ID NO: 772429 - DNA, 25 bp, Mus musculus
tccaggccttcgtggagaacatggc

SEQ ID NO: 772430 - DNA, 25 bp, Mus musculus
tccaggcgaacgagacttctataaa

SEQ ID NO: 772431 - DNA, 25 bp, Mus musculus
tccaggcgaacgtgacttctataaa

SEQ ID NO: 772432 - DNA, 25 bp, Mus musculus
tccaggcgagccaggacaaagtgtg

SEQ ID NO: 772433 - DNA, 25 bp, Mus musculus
tccaggcgagcctggacaaagtgtg

SEQ ID NO: 772434 - DNA, 25 bp, Mus musculus
tccaggcgtgcaccatgcagcagct

SEQ ID NO: 772435 - DNA, 25 bp, Mus musculus
tccaggcgtgcagcatgcagcagct

SEQ ID NO: 772436 - DNA, 25 bp, Mus musculus
tccaggctaagcagagtgtgcatga

SEQ ID NO: 772437 - DNA, 25 bp, Mus musculus
tccaggctaagctgagtgtgcatga

SEQ ID NO: 772438 - DNA, 25 bp, Mus musculus
tccaggctactaagaactacaataa

SEQ ID NO: 772439 - DNA, 25 bp, Mus musculus
tccaggctactatgaactacaataa

SEQ ID NO: 772440 - DNA, 25 bp, Mus musculus
tccaggctacttctcagcggatggg

SEQ ID NO: 772441 - DNA, 25 bp, Mus musculus
tccaggctacttgtcagcggatggg

SEQ ID NO: 772442 - DNA, 25 bp, Mus musculus
tccaggctcaatacccaggaatctg

SEQ ID NO: 772443 - DNA, 25 bp, Mus musculus
tccaggctcaattcccaggaatctg

SEQ ID NO: 772444 - DNA, 25 bp, Mus musculus
tccaggctgcgtaccaacttatggt

SEQ ID NO: 772445 - DNA, 25 bp, Mus musculus
tccaggctgcgttccaacttatggt

SEQ ID NO: 772446 - DNA, 25 bp, Mus musculus
tccaggctggacactctgtgcccag

SEQ ID NO: 772447 - DNA, 25 bp, Mus musculus
tccaggctggactctctgtgcccag

SEQ ID NO: 772448 - DNA, 25 bp, Mus musculus
tccaggctgtgacgtcatggctcca

SEQ ID NO: 772449 - DNA, 25 bp, Mus musculus
tccaggctgtgaggtcatggctcca

SEQ ID NO: 772450 - DNA, 25 bp, Mus musculus
tccaggctgtgcagattggctgata

SEQ ID NO: 772451 - DNA, 25 bp, Mus musculus
tccaggctgtgctgattggctgata

SEQ ID NO: 772452 - DNA, 25 bp, Mus musculus
tccaggcttcgtcggactgcgctgt

SEQ ID NO: 772453 - DNA, 25 bp, Mus musculus
tccaggcttcgtgggactgcgctgt

SEQ ID NO: 772454 - DNA, 25 bp, Mus musculus
tccaggcttctgataaccggtcgtc

SEQ ID NO: 772455 - DNA, 25 bp, Mus musculus
tccaggcttctgttaaccggtcgtc

SEQ ID NO: 772456 - DNA, 25 bp, Mus musculus
tccaggcttgggacatattctcaga

SEQ ID NO: 772457 - DNA, 25 bp, Mus musculus
tccaggcttgggtcatattctcaga

SEQ ID NO: 772458 - DNA, 25 bp, Mus musculus
tccagggaagctcacaatggaaccc

SEQ ID NO: 772459 - DNA, 25 bp, Mus musculus
tccagggaagctgacaatggaaccc

SEQ ID NO: 772460 - DNA, 25 bp, Mus musculus
tccagggaaggaaacgtgcgttatc

SEQ ID NO: 772461 - DNA, 25 bp, Mus musculus
tccagggaaggatacgtgcgttatc

SEQ ID NO: 772462 - DNA, 25 bp, Mus musculus
tccagggaaggcaaagatttgggcc

SEQ ID NO: 772463 - DNA, 25 bp, Mus musculus
tccagggaaggctaagatttgggcc

SEQ ID NO: 772464 - DNA, 25 bp, Mus musculus
tccagggaaggtcctccttaggtct

SEQ ID NO: 772465 - DNA, 25 bp, Mus musculus
tccagggaaggtgctccttaggtct

SEQ ID NO: 772466 - DNA, 25 bp, Mus musculus
tccagggacacgcacctgagctgct

SEQ ID NO: 772467 - DNA, 25 bp, Mus musculus
tccagggacacggacctgagctgct

SEQ ID NO: 772468 - DNA, 25 bp, Mus musculus
tccagggacctacgcaaggactgca

SEQ ID NO: 772469 - DNA, 25 bp, Mus musculus
tccagggacctaggcaaggactgca

SEQ ID NO: 772470 - DNA, 25 bp, Mus musculus
tccagggactccaaaggctaatggc

SEQ ID NO: 772471 - DNA, 25 bp, Mus musculus
tccagggactccagtgaagtgcacc

SEQ ID NO: 772472 - DNA, 25 bp, Mus musculus
tccagggactcctaaggctaatggc

SEQ ID NO: 772473 - DNA, 25 bp, Mus musculus
tccagggactcctgtgaagtgcacc

SEQ ID NO: 772474 - DNA, 25 bp, Mus musculus
tccagggactgacccgtatactgca

SEQ ID NO: 772475 - DNA, 25 bp, Mus musculus
tccagggactgagccgtatactgca

SEQ ID NO: 772476 - DNA, 25 bp, Mus musculus
tccagggactgcaagcctgtctact

SEQ ID NO: 772477 - DNA, 25 bp, Mus musculus
tccagggactgctagcctgtctact

SEQ ID NO: 772478 - DNA, 25 bp, Mus musculus
tccagggagattctccatcagcacc

SEQ ID NO: 772479 - DNA, 25 bp, Mus musculus
tccagggagattgtccatcagcacc

SEQ ID NO: 772480 - DNA, 25 bp, Mus musculus
tccagggagcacagatgatatattt

SEQ ID NO: 772481 - DNA, 25 bp, Mus musculus
tccagggagcactgatgatatattt

SEQ ID NO: 772482 - DNA, 25 bp, Mus musculus
tccagggagcagaagacggaataaa

SEQ ID NO: 772483 - DNA, 25 bp, Mus musculus
tccagggagcagtagacggaataaa

SEQ ID NO: 772484 - DNA, 25 bp, Mus musculus
tccagggagcttacaccagtgacga

SEQ ID NO: 772485 - DNA, 25 bp, Mus musculus
tccagggagctttcaccagtgacga

SEQ ID NO: 772486 - DNA, 25 bp, Mus musculus
tccagggaggaaattacgacgcagc

SEQ ID NO: 772487 - DNA, 25 bp, Mus musculus
tccagggaggaatttacgacgcagc

SEQ ID NO: 772488 - DNA, 25 bp, Mus musculus
tccagggaggacaatgttggctcac

SEQ ID NO: 772489 - DNA, 25 bp, Mus musculus
tccagggaggactatgttggctcac

SEQ ID NO: 772490 - DNA, 25 bp, Mus musculus
tccagggaggagatctactgcctca

SEQ ID NO: 772491 - DNA, 25 bp, Mus musculus
tccagggaggagttctactgcctca

SEQ ID NO: 772492 - DNA, 25 bp, Mus musculus
tccagggaggttctgacggtaccca

SEQ ID NO: 772493 - DNA, 25 bp, Mus musculus
tccagggaggttgtgacggtaccca

SEQ ID NO: 772494 - DNA, 25 bp, Mus musculus
tccagggatctcctgagggcctgtg

SEQ ID NO: 772495 - DNA, 25 bp, Mus musculus
tccagggatctcgtgagggcctgtg

SEQ ID NO: 772496 - DNA, 25 bp, Mus musculus
tccagggatcttctaaataaactaa

SEQ ID NO: 772497 - DNA, 25 bp, Mus musculus
tccagggatcttgtaaataaactaa

SEQ ID NO: 772498 - DNA, 25 bp, Mus musculus
tccagggatgagaacccatctgtcc

SEQ ID NO: 772499 - DNA, 25 bp, Mus musculus
tccagggatgagtacccatctgtcc

SEQ ID NO: 772500 - DNA, 25 bp, Mus musculus
tccagggatgggaggaacgctacta

SEQ ID NO: 772501 - DNA, 25 bp, Mus musculus
tccagggatgggtggaacgctacta

SEQ ID NO: 772502 - DNA, 25 bp, Mus musculus
tccagggcaaggagggaccacccgc

SEQ ID NO: 772503 - DNA, 25 bp, Mus musculus
tccagggcaaggtgggaccacccgc

SEQ ID NO: 772504 - DNA, 25 bp, Mus musculus
tccagggcacaaccttgagggacag

SEQ ID NO: 772505 - DNA, 25 bp, Mus musculus
tccagggcacaagcttgagggacag

SEQ ID NO: 772506 - DNA, 25 bp, Mus musculus
tccagggcacagacatccttctggg

SEQ ID NO: 772507 - DNA, 25 bp, Mus musculus
tccagggcacagtcatccttctggg

SEQ ID NO: 772508 - DNA, 25 bp, Mus musculus
tccagggccagaacaaggagatgct

SEQ ID NO: 772509 - DNA, 25 bp, Mus musculus
tccagggccagatcaaggagatgct

SEQ ID NO: 772510 - DNA, 25 bp, Mus musculus
tccagggcctggcaaaacagtctca

SEQ ID NO: 772511 - DNA, 25 bp, Mus musculus
tccagggcctgggaaaacagtctca

SEQ ID NO: 772512 - DNA, 25 bp, Mus musculus
tccagggcgctgacgcatgcttgcg

SEQ ID NO: 772513 - DNA, 25 bp, Mus musculus
tccagggcgctgtcgcatgcttgcg

SEQ ID NO: 772514 - DNA, 25 bp, Mus musculus
tccagggctaccatgtagtagtagc

SEQ ID NO: 772515 - DNA, 25 bp, Mus musculus
tccagggctaccttgtagtagtagc

SEQ ID NO: 772516 - DNA, 25 bp, Mus musculus
tccagggctatgatcgaatctcagg

SEQ ID NO: 772517 - DNA, 25 bp, Mus musculus
tccagggctatgttcgaatctcagg

SEQ ID NO: 772518 - DNA, 25 bp, Mus musculus
tccagggctctgcaaacatgtgcca

SEQ ID NO: 772519 - DNA, 25 bp, Mus musculus
tccagggctctggaaacatgtgcca

SEQ ID NO: 772520 - DNA, 25 bp, Mus musculus
tccaggggtctgacgactcttgcca

SEQ ID NO: 772521 - DNA, 25 bp, Mus musculus
tccaggggtctgtcgactcttgcca

SEQ ID NO: 772522 - DNA, 25 bp, Mus musculus
tccagggtacgtagctgaaccggcc

SEQ ID NO: 772523 - DNA, 25 bp, Mus musculus
tccagggtacgttgctgaaccggcc

SEQ ID NO: 772524 - DNA, 25 bp, Mus musculus
tccagggtcacaattaaacactaag

SEQ ID NO: 772525 - DNA, 25 bp, Mus musculus
tccagggtcacatttaaacactaag

SEQ ID NO: 772526 - DNA, 25 bp, Mus musculus
tccagggtcagacaactacaaggtt

SEQ ID NO: 772527 - DNA, 25 bp, Mus musculus
tccagggtcagagaactacaaggtt

SEQ ID NO: 772528 - DNA, 25 bp, Mus musculus
tccagggtcagtatggagcagtgac

SEQ ID NO: 772529 - DNA, 25 bp, Mus musculus
tccagggtcagtttggagcagtgac

SEQ ID NO: 772530 - DNA, 25 bp, Mus musculus
tccagggtgcaacgctgccctgcag

SEQ ID NO: 772531 - DNA, 25 bp, Mus musculus
tccagggtgcaaggctgccctgcag

SEQ ID NO: 772532 - DNA, 25 bp, Mus musculus
tccagggtggctacgaaaacgtgcc

SEQ ID NO: 772533 - DNA, 25 bp, Mus musculus
tccagggtggcttcgaaaacgtgcc

SEQ ID NO: 772534 - DNA, 25 bp, Mus musculus
tccagggtgtcaccaggatcctagc

SEQ ID NO: 772535 - DNA, 25 bp, Mus musculus
tccagggtgtcagcaggatcctagc

SEQ ID NO: 772536 - DNA, 25 bp, Mus musculus
tccagggtgtccctctccaaacgtg

SEQ ID NO: 772537 - DNA, 25 bp, Mus musculus
tccagggtgtccgtctccaaacgtg

SEQ ID NO: 772538 - DNA, 25 bp, Mus musculus
tccagggtgtgcagcctatggcttt

SEQ ID NO: 772539 - DNA, 25 bp, Mus musculus
tccagggtgtgctgcctatggcttt

SEQ ID NO: 772540 - DNA, 25 bp, Mus musculus
tccagggttggacaaagctccacag

SEQ ID NO: 772541 - DNA, 25 bp, Mus musculus
tccagggttggagaaagctccacag

SEQ ID NO: 772542 - DNA, 25 bp, Mus musculus
tccagggttgttcagtatcaggcac

SEQ ID NO: 772543 - DNA, 25 bp, Mus musculus
tccagggttgttgagtatcaggcac

SEQ ID NO: 772544 - DNA, 25 bp, Mus musculus
tccaggtaccggcaagactgtcaca

SEQ ID NO: 772545 - DNA, 25 bp, Mus musculus
tccaggtaccgggaagactgtcaca

SEQ ID NO: 772546 - DNA, 25 bp, Mus musculus
tccaggtatgatcacgagatgaacc

SEQ ID NO: 772547 - DNA, 25 bp, Mus musculus
tccaggtatgatgacgagatgaacc

SEQ ID NO: 772548 - DNA, 25 bp, Mus musculus
tccaggtcacccagggatacatagc

SEQ ID NO: 772549 - DNA, 25 bp, Mus musculus
tccaggtcaccctgggatacatagc

SEQ ID NO: 772550 - DNA, 25 bp, Mus musculus
tccaggtcagcgcactagctgtgcc

SEQ ID NO: 772551 - DNA, 25 bp, Mus musculus
tccaggtcagcggactagctgtgcc

SEQ ID NO: 772552 - DNA, 25 bp, Mus musculus
tccaggtccccaaggtggcaggttc

SEQ ID NO: 772553 - DNA, 25 bp, Mus musculus
tccaggtccccatggtggcaggttc

SEQ ID NO: 772554 - DNA, 25 bp, Mus musculus
tccaggtccctacatgagaaggtcc

SEQ ID NO: 772555 - DNA, 25 bp, Mus musculus
tccaggtccctagatgagaaggtcc

SEQ ID NO: 772556 - DNA, 25 bp, Mus musculus
tccaggtcctctaactttagccatg

SEQ ID NO: 772557 - DNA, 25 bp, Mus musculus
tccaggtcctcttactttagccatg

SEQ ID NO: 772558 - DNA, 25 bp, Mus musculus
tccaggtcctggattatgaccgttt

SEQ ID NO: 772559 - DNA, 25 bp, Mus musculus
tccaggtcctggtttatgaccgttt

SEQ ID NO: 772560 - DNA, 25 bp, Mus musculus
tccaggtcgccgatggctgcactgc

SEQ ID NO: 772561 - DNA, 25 bp, Mus musculus
tccaggtcgccgttggctgcactgc

SEQ ID NO: 772562 - DNA, 25 bp, Mus musculus
tccaggtgagaaaagtgcaaggcac

SEQ ID NO: 772563 - DNA, 25 bp, Mus musculus
tccaggtgagaatagtgcaaggcac

SEQ ID NO: 772564 - DNA, 25 bp, Mus musculus
tccaggtgattgacaaaggagatct

SEQ ID NO: 772565 - DNA, 25 bp, Mus musculus
tccaggtgattgtcaaaggagatct

SEQ ID NO: 772566 - DNA, 25 bp, Mus musculus
tccaggtgcaagagctccgggtctg

SEQ ID NO: 772567 - DNA, 25 bp, Mus musculus
tccaggtgcaagtgctccgggtctg

SEQ ID NO: 772568 - DNA, 25 bp, Mus musculus
tccaggtgccagctttggccgctca

SEQ ID NO: 772569 - DNA, 25 bp, Mus musculus
tccaggtgccaggtttggccgctca

SEQ ID NO: 772570 - DNA, 25 bp, Mus musculus
tccaggtgcctcacacagcagaggt

SEQ ID NO: 772571 - DNA, 25 bp, Mus musculus
tccaggtgcctctcacagcagaggt

SEQ ID NO: 772572 - DNA, 25 bp, Mus musculus
tccaggtgcggactcgcatcgatgt

SEQ ID NO: 772573 - DNA, 25 bp, Mus musculus
tccaggtgcggagtcgcatcgatgt

SEQ ID NO: 772574 - DNA, 25 bp, Mus musculus
tccaggtggaccagctgcgtatgca

SEQ ID NO: 772575 - DNA, 25 bp, Mus musculus
tccaggtggaccatcaagacctggg

SEQ ID NO: 772576 - DNA, 25 bp, Mus musculus
tccaggtggacctgctgcgtatgca

SEQ ID NO: 772577 - DNA, 25 bp, Mus musculus
tccaggtggaccttcaagacctggg

SEQ ID NO: 772578 - DNA, 25 bp, Mus musculus
tccaggtgtcagagaaggagtttaa

SEQ ID NO: 772579 - DNA, 25 bp, Mus musculus
tccaggtgtcagtgaaggagtttaa

SEQ ID NO: 772580 - DNA, 25 bp, Mus musculus
tccaggtgttccagaaacagatcaa

SEQ ID NO: 772581 - DNA, 25 bp, Mus musculus
tccaggtgttcctgaaacagatcaa

SEQ ID NO: 772582 - DNA, 25 bp, Mus musculus
tccaggttagtaacagaattctcat

SEQ ID NO: 772583 - DNA, 25 bp, Mus musculus
tccaggttagtatcagaattctcat

SEQ ID NO: 772584 - DNA, 25 bp, Mus musculus
tccaggttggttccaggtggccaga

SEQ ID NO: 772585 - DNA, 25 bp, Mus musculus
tccaggttggttgcaggtggccaga

SEQ ID NO: 772586 - DNA, 25 bp, Mus musculus
tccagtaactatcacgacgatgaga

SEQ ID NO: 772587 - DNA, 25 bp, Mus musculus
tccagtaactatgacgacgatgaga

SEQ ID NO: 772588 - DNA, 25 bp, Mus musculus
tccagtaactgaaaagagaatacaa

SEQ ID NO: 772589 - DNA, 25 bp, Mus musculus
tccagtaactgataagagaatacaa

SEQ ID NO: 772590 - DNA, 25 bp, Mus musculus
tccagtaaggctcttccagatccac

SEQ ID NO: 772591 - DNA, 25 bp, Mus musculus
tccagtaaggctgttccagatccac

SEQ ID NO: 772592 - DNA, 25 bp, Mus musculus
tccagtaagtgcaacatgtgccagt

SEQ ID NO: 772593 - DNA, 25 bp, Mus musculus
tccagtaagtgctacatgtgccagt

SEQ ID NO: 772594 - DNA, 25 bp, Mus musculus
tccagtacaacgactggctggagga

SEQ ID NO: 772595 - DNA, 25 bp, Mus musculus
tccagtacaacgtctggctggagga

SEQ ID NO: 772596 - DNA, 25 bp, Mus musculus
tccagtaccagaacatcatgacaat

SEQ ID NO: 772597 - DNA, 25 bp, Mus musculus
tccagtaccagatcatcatgacaat

SEQ ID NO: 772598 - DNA, 25 bp, Mus musculus
tccagtacctgcatgtgaccttgct

SEQ ID NO: 772599 - DNA, 25 bp, Mus musculus
tccagtacctgcttgtgaccttgct

SEQ ID NO: 772600 - DNA, 25 bp, Mus musculus
tccagtacctggagatgagacccac

SEQ ID NO: 772601 - DNA, 25 bp, Mus musculus
tccagtacctggtgatgagacccac

SEQ ID NO: 772602 - DNA, 25 bp, Mus musculus
tccagtacgggacccgctggcagat

SEQ ID NO: 772603 - DNA, 25 bp, Mus musculus
tccagtacgggagccgctggcagat

SEQ ID NO: 772604 - DNA, 25 bp, Mus musculus
tccagtactatgacagggactacag

SEQ ID NO: 772605 - DNA, 25 bp, Mus musculus
tccagtactatgtcagggactacag

SEQ ID NO: 772606 - DNA, 25 bp, Mus musculus
tccagtactggtctgctgtgaaacg

SEQ ID NO: 772607 - DNA, 25 bp, Mus musculus
tccagtactggtgtgctgtgaaacg

SEQ ID NO: 772608 - DNA, 25 bp, Mus musculus
tccagtagaatcatcaggccttccc

SEQ ID NO: 772609 - DNA, 25 bp, Mus musculus
tccagtagaatcttcaggccttccc

SEQ ID NO: 772610 - DNA, 25 bp, Mus musculus
tccagtagataacaggcagagccca

SEQ ID NO: 772611 - DNA, 25 bp, Mus musculus
tccagtagataagaggcagagccca

SEQ ID NO: 772612 - DNA, 25 bp, Mus musculus
tccagtagatgtcgagacgtacaag

SEQ ID NO: 772613 - DNA, 25 bp, Mus musculus
tccagtagatgtggagacgtacaag

SEQ ID NO: 772614 - DNA, 25 bp, Mus musculus
tccagtagcggtagcattctcttgc

SEQ ID NO: 772615 - DNA, 25 bp, Mus musculus
tccagtagcggttgcattctcttgc

SEQ ID NO: 772616 - DNA, 25 bp, Mus musculus
tccagtatacagaactcgcccaagc

SEQ ID NO: 772617 - DNA, 25 bp, Mus musculus
tccagtatacagtactcgcccaagc

SEQ ID NO: 772618 - DNA, 25 bp, Mus musculus
tccagtatctcccaacagttaccat

SEQ ID NO: 772619 - DNA, 25 bp, Mus musculus
tccagtatctccgaacagttaccat

SEQ ID NO: 772620 - DNA, 25 bp, Mus musculus
tccagtatgcagattctaaagagac

SEQ ID NO: 772621 - DNA, 25 bp, Mus musculus
tccagtatgcagctcagggtcgcta

SEQ ID NO: 772622 - DNA, 25 bp, Mus musculus
tccagtatgcaggtcagggtcgcta

SEQ ID NO: 772623 - DNA, 25 bp, Mus musculus
tccagtatgcagtttctaaagagac

SEQ ID NO: 772624 - DNA, 25 bp, Mus musculus
tccagtattacacgagtgacccaga

SEQ ID NO: 772625 - DNA, 25 bp, Mus musculus
tccagtattacaggagtgacccaga

SEQ ID NO: 772626 - DNA, 25 bp, Mus musculus
tccagtcaaaagaagctctacagag

SEQ ID NO: 772627 - DNA, 25 bp, Mus musculus
tccagtcaaaagtagctctacagag

SEQ ID NO: 772628 - DNA, 25 bp, Mus musculus
tccagtcaaggtcggacctgctttt

SEQ ID NO: 772629 - DNA, 25 bp, Mus musculus
tccagtcaaggtgggacctgctttt

SEQ ID NO: 772630 - DNA, 25 bp, Mus musculus
tccagtcaagttctcggcaaagcag

SEQ ID NO: 772631 - DNA, 25 bp, Mus musculus
tccagtcaagttgtcggcaaagcag

SEQ ID NO: 772632 - DNA, 25 bp, Mus musculus
tccagtcacagaaggctgaaaggca

SEQ ID NO: 772633 - DNA, 25 bp, Mus musculus
tccagtcacagatggctgaaaggca

SEQ ID NO: 772634 - DNA, 25 bp, Mus musculus
tccagtcacccaactatagtcaaag

SEQ ID NO: 772635 - DNA, 25 bp, Mus musculus
tccagtcacccatctatagtcaaag

SEQ ID NO: 772636 - DNA, 25 bp, Mus musculus
tccagtcagaaccgccagctgaggg

SEQ ID NO: 772637 - DNA, 25 bp, Mus musculus
tccagtcagaacggccagctgaggg

SEQ ID NO: 772638 - DNA, 25 bp, Mus musculus
tccagtcagtctattccggactccg

SEQ ID NO: 772639 - DNA, 25 bp, Mus musculus
tccagtcagtcttttccggactccg

SEQ ID NO: 772640 - DNA, 25 bp, Mus musculus
tccagtcatccgcacattggtcgtg

SEQ ID NO: 772641 - DNA, 25 bp, Mus musculus
tccagtcatccggacattggtcgtg

SEQ ID NO: 772642 - DNA, 25 bp, Mus musculus
tccagtccaagtctgctttcaactg

SEQ ID NO: 772643 - DNA, 25 bp, Mus musculus
tccagtccaagtgtgctttcaactg

SEQ ID NO: 772644 - DNA, 25 bp, Mus musculus
tccagtccaggcaggaagaagtttc

SEQ ID NO: 772645 - DNA, 25 bp, Mus musculus
tccagtccaggctggaagaagtttc

SEQ ID NO: 772646 - DNA, 25 bp, Mus musculus
tccagtccctgtatagtttgtgtcc

SEQ ID NO: 772647 - DNA, 25 bp, Mus musculus
tccagtccctgtttagtttgtgtcc

SEQ ID NO: 772648 - DNA, 25 bp, Mus musculus
tccagtccgcacacaatgtcattgt

SEQ ID NO: 772649 - DNA, 25 bp, Mus musculus
tccagtccgcactcaatgtcattgt

SEQ ID NO: 772650 - DNA, 25 bp, Mus musculus
tccagtccggcactcagtaagatca

SEQ ID NO: 772651 - DNA, 25 bp, Mus musculus
tccagtccggcagtcagtaagatca

SEQ ID NO: 772652 - DNA, 25 bp, Mus musculus
tccagtccgtggcagacacatggtg

SEQ ID NO: 772653 - DNA, 25 bp, Mus musculus
tccagtccgtgggagacacatggtg

SEQ ID NO: 772654 - DNA, 25 bp, Mus musculus
tccagtcctaggaagagaatcgctg

SEQ ID NO: 772655 - DNA, 25 bp, Mus musculus
tccagtcctaggtagagaatcgctg

SEQ ID NO: 772656 - DNA, 25 bp, Mus musculus
tccagtcctggtaataaatctgtgg

SEQ ID NO: 772657 - DNA, 25 bp, Mus musculus
tccagtcctggttataaatctgtgg

SEQ ID NO: 772658 - DNA, 25 bp, Mus musculus
tccagtctccgtcgcggaggttcct

SEQ ID NO: 772659 - DNA, 25 bp, Mus musculus
tccagtctccgtggcggaggttcct

SEQ ID NO: 772660 - DNA, 25 bp, Mus musculus
tccagtctcgacaacagcgcatttc

SEQ ID NO: 772661 - DNA, 25 bp, Mus musculus
tccagtctcgactacagcgcatttc

SEQ ID NO: 772662 - DNA, 25 bp, Mus musculus
tccagtctcgagcagctgaggagca

SEQ ID NO: 772663 - DNA, 25 bp, Mus musculus
tccagtctcgaggagctgaggagca

SEQ ID NO: 772664 - DNA, 25 bp, Mus musculus
tccagtctgacacagctcaaaacta

SEQ ID NO: 772665 - DNA, 25 bp, Mus musculus
tccagtctgacagagctcaaaacta

SEQ ID NO: 772666 - DNA, 25 bp, Mus musculus
tccagtcttcagagccatgtttgaa

SEQ ID NO: 772667 - DNA, 25 bp, Mus musculus
tccagtcttcagtgccatgtttgaa

SEQ ID NO: 772668 - DNA, 25 bp, Mus musculus
tccagtgaagagacgggagattcgc

SEQ ID NO: 772669 - DNA, 25 bp, Mus musculus
tccagtgaagagtcgggagattcgc

SEQ ID NO: 772670 - DNA, 25 bp, Mus musculus
tccagtgaatggctctcagatgaca

SEQ ID NO: 772671 - DNA, 25 bp, Mus musculus
tccagtgaatgggtctcagatgaca

SEQ ID NO: 772672 - DNA, 25 bp, Mus musculus
tccagtgacacaccattgctcaagg

SEQ ID NO: 772673 - DNA, 25 bp, Mus musculus
tccagtgacacagcattgctcaagg

SEQ ID NO: 772674 - DNA, 25 bp, Mus musculus
tccagtgacagtccaaagaaacatg

SEQ ID NO: 772675 - DNA, 25 bp, Mus musculus
tccagtgacagtgcaaagaaacatg

SEQ ID NO: 772676 - DNA, 25 bp, Mus musculus
tccagtgaccagagcacttccggtt

SEQ ID NO: 772677 - DNA, 25 bp, Mus musculus
tccagtgaccagtgcacttccggtt

SEQ ID NO: 772678 - DNA, 25 bp, Mus musculus
tccagtgaccgcactaagtcaccaa

SEQ ID NO: 772679 - DNA, 25 bp, Mus musculus
tccagtgaccgctctaagtcaccaa

SEQ ID NO: 772680 - DNA, 25 bp, Mus musculus
tccagtgagcagagtagcacttgcc

SEQ ID NO: 772681 - DNA, 25 bp, Mus musculus
tccagtgagcagtgtagcacttgcc

SEQ ID NO: 772682 - DNA, 25 bp, Mus musculus
tccagtgagggcatcctggatgacc

SEQ ID NO: 772683 - DNA, 25 bp, Mus musculus
tccagtgagggcttcctggatgacc

SEQ ID NO: 772684 - DNA, 25 bp, Mus musculus
tccagtgagtgcagaaggagctcag

SEQ ID NO: 772685 - DNA, 25 bp, Mus musculus
tccagtgagtgctgaaggagctcag

SEQ ID NO: 772686 - DNA, 25 bp, Mus musculus
tccagtgatcatcaggcgaaccttc

SEQ ID NO: 772687 - DNA, 25 bp, Mus musculus
tccagtgatcatgaggcgaaccttc

SEQ ID NO: 772688 - DNA, 25 bp, Mus musculus
tccagtgcagccaagcatagtgtcg

SEQ ID NO: 772689 - DNA, 25 bp, Mus musculus
tccagtgcagcctagcatagtgtcg

SEQ ID NO: 772690 - DNA, 25 bp, Mus musculus
tccagtgcctgacatccgcagagat

SEQ ID NO: 772691 - DNA, 25 bp, Mus musculus
tccagtgcctgagatccgcagagat

SEQ ID NO: 772692 - DNA, 25 bp, Mus musculus
tccagtgcctggctccggagagttc

SEQ ID NO: 772693 - DNA, 25 bp, Mus musculus
tccagtgcctgggtccggagagttc

SEQ ID NO: 772694 - DNA, 25 bp, Mus musculus
tccagtgcctgtatgggccacttca

SEQ ID NO: 772695 - DNA, 25 bp, Mus musculus
tccagtgcctgtttgggccacttca

SEQ ID NO: 772696 - DNA, 25 bp, Mus musculus
tccagtgcgctgaagatgtgaaacg

SEQ ID NO: 772697 - DNA, 25 bp, Mus musculus
tccagtgcgctgtagatgtgaaacg

SEQ ID NO: 772698 - DNA, 25 bp, Mus musculus
tccagtgctaaacgtattggcaaga

SEQ ID NO: 772699 - DNA, 25 bp, Mus musculus
tccagtgctaaaggtattggcaaga

SEQ ID NO: 772700 - DNA, 25 bp, Mus musculus
tccagtgcttcacccgctgtcatag

SEQ ID NO: 772701 - DNA, 25 bp, Mus musculus
tccagtgcttcagccgctgtcatag

SEQ ID NO: 772702 - DNA, 25 bp, Mus musculus
tccagtggaaagcacgacttcatcg

SEQ ID NO: 772703 - DNA, 25 bp, Mus musculus
tccagtggaaaggacgacttcatcg

SEQ ID NO: 772704 - DNA, 25 bp, Mus musculus
tccagtggacagaaagtgtgggact

SEQ ID NO: 772705 - DNA, 25 bp, Mus musculus
tccagtggacagtaagtgtgggact

SEQ ID NO: 772706 - DNA, 25 bp, Mus musculus
tccagtggagccacagatcaggaca

SEQ ID NO: 772707 - DNA, 25 bp, Mus musculus
tccagtggagcctcagatcaggaca

SEQ ID NO: 772708 - DNA, 25 bp, Mus musculus
tccagtggccagattgtgcgccctg

SEQ ID NO: 772709 - DNA, 25 bp, Mus musculus
tccagtggccagctgacttgagacg

SEQ ID NO: 772710 - DNA, 25 bp, Mus musculus
tccagtggccaggtgacttgagacg

SEQ ID NO: 772711 - DNA, 25 bp, Mus musculus
tccagtggccagtttgtgcgccctg

SEQ ID NO: 772712 - DNA, 25 bp, Mus musculus
tccagtggcgatatttgaagccaag

SEQ ID NO: 772713 - DNA, 25 bp, Mus musculus
tccagtggcgatttttgaagccaag

SEQ ID NO: 772714 - DNA, 25 bp, Mus musculus
tccagtggctgaaccctgacagtgc

SEQ ID NO: 772715 - DNA, 25 bp, Mus musculus
tccagtggctgacacatgataggcc

SEQ ID NO: 772716 - DNA, 25 bp, Mus musculus
tccagtggctgagacatgataggcc

SEQ ID NO: 772717 - DNA, 25 bp, Mus musculus
tccagtggctgatccctgacagtgc

SEQ ID NO: 772718 - DNA, 25 bp, Mus musculus
tccagtggcttccagcaaacagcag

SEQ ID NO: 772719 - DNA, 25 bp, Mus musculus
tccagtggcttcgagcaaacagcag

SEQ ID NO: 772720 - DNA, 25 bp, Mus musculus
tccagtgggactatcaacattgacc

SEQ ID NO: 772721 - DNA, 25 bp, Mus musculus
tccagtgggactttcaacattgacc

SEQ ID NO: 772722 - DNA, 25 bp, Mus musculus
tccagtggtgtgatgaagctacagt

SEQ ID NO: 772723 - DNA, 25 bp, Mus musculus
tccagtggtgtgttgaagctacagt

SEQ ID NO: 772724 - DNA, 25 bp, Mus musculus
tccagtggtttgagcttagagacaa

SEQ ID NO: 772725 - DNA, 25 bp, Mus musculus
tccagtggtttgtgcttagagacaa

SEQ ID NO: 772726 - DNA, 25 bp, Mus musculus
tccagtgtaaatagttgagcccaga

SEQ ID NO: 772727 - DNA, 25 bp, Mus musculus
tccagtgtaaattgttgagcccaga

SEQ ID NO: 772728 - DNA, 25 bp, Mus musculus
tccagtgtcacacctacacaggata

SEQ ID NO: 772729 - DNA, 25 bp, Mus musculus
tccagtgtcacactcactcgaagct

SEQ ID NO: 772730 - DNA, 25 bp, Mus musculus
tccagtgtcacagctacacaggata

SEQ ID NO: 772731 - DNA, 25 bp, Mus musculus
tccagtgtcacagtcactcgaagct

SEQ ID NO: 772732 - DNA, 25 bp, Mus musculus
tccagtgtcgaaaggcagatcaggc

SEQ ID NO: 772733 - DNA, 25 bp, Mus musculus
tccagtgtcgaatggcagatcaggc

SEQ ID NO: 772734 - DNA, 25 bp, Mus musculus
tccagtgtgagcatgcctatttctg

SEQ ID NO: 772735 - DNA, 25 bp, Mus musculus
tccagtgtgagcttgcctatttctg

SEQ ID NO: 772736 - DNA, 25 bp, Mus musculus
tccagtgtgcaaacagcagtgctac

SEQ ID NO: 772737 - DNA, 25 bp, Mus musculus
tccagtgtgcaatcagcagtgctac

SEQ ID NO: 772738 - DNA, 25 bp, Mus musculus
tccagtgtgcccagcagtttcagac

SEQ ID NO: 772739 - DNA, 25 bp, Mus musculus
tccagtgtgccctgcagtttcagac

SEQ ID NO: 772740 - DNA, 25 bp, Mus musculus
tccagtgtgccgagcagtgtgcaca

SEQ ID NO: 772741 - DNA, 25 bp, Mus musculus
tccagtgtgccgtgcagtgtgcaca

SEQ ID NO: 772742 - DNA, 25 bp, Mus musculus
tccagtgtggagctcatcaatctgc

SEQ ID NO: 772743 - DNA, 25 bp, Mus musculus
tccagtgtggaggtcatcaatctgc

SEQ ID NO: 772744 - DNA, 25 bp, Mus musculus
tccagtgttccccaaagaacaggct

SEQ ID NO: 772745 - DNA, 25 bp, Mus musculus
tccagtgttcccgaaagaacaggct

SEQ ID NO: 772746 - DNA, 25 bp, Mus musculus
tccagtgttctcaatttcatgaagg

SEQ ID NO: 772747 - DNA, 25 bp, Mus musculus
tccagtgttctctatttcatgaagg

SEQ ID NO: 772748 - DNA, 25 bp, Mus musculus
tccagttaaaacattggacctcaaa

SEQ ID NO: 772749 - DNA, 25 bp, Mus musculus
tccagttaaaactttggacctcaaa

SEQ ID NO: 772750 - DNA, 25 bp, Mus musculus
tccagttacgatctcttccagttgg

SEQ ID NO: 772751 - DNA, 25 bp, Mus musculus
tccagttacgatgtcttccagttgg

SEQ ID NO: 772752 - DNA, 25 bp, Mus musculus
tccagttatatcatgtcctggcggc

SEQ ID NO: 772753 - DNA, 25 bp, Mus musculus
tccagttatatcttgtcctggcggc

SEQ ID NO: 772754 - DNA, 25 bp, Mus musculus
tccagttatggtcagagtcctcccc

SEQ ID NO: 772755 - DNA, 25 bp, Mus musculus
tccagttatggtgagagtcctcccc

SEQ ID NO: 772756 - DNA, 25 bp, Mus musculus
tccagttcactgactatgccgcaca

SEQ ID NO: 772757 - DNA, 25 bp, Mus musculus
tccagttcactgtctatgccgcaca

SEQ ID NO: 772758 - DNA, 25 bp, Mus musculus
tccagttccaaaaccaaagtggtgg

SEQ ID NO: 772759 - DNA, 25 bp, Mus musculus
tccagttccaaatccaaagtggtgg

SEQ ID NO: 772760 - DNA, 25 bp, Mus musculus
tccagttccactcccgaattctgga

SEQ ID NO: 772761 - DNA, 25 bp, Mus musculus
tccagttccactgccgaattctgga

SEQ ID NO: 772762 - DNA, 25 bp, Mus musculus
tccagttcctaaaggatatccggga

SEQ ID NO: 772763 - DNA, 25 bp, Mus musculus
tccagttcctaatggatatccggga

SEQ ID NO: 772764 - DNA, 25 bp, Mus musculus
tccagttcctgactctgcagttgct

SEQ ID NO: 772765 - DNA, 25 bp, Mus musculus
tccagttcctgagtctgcagttgct

SEQ ID NO: 772766 - DNA, 25 bp, Mus musculus
tccagttctagacattttccccttg

SEQ ID NO: 772767 - DNA, 25 bp, Mus musculus
tccagttctagagattttccccttg

SEQ ID NO: 772768 - DNA, 25 bp, Mus musculus
tccagttctctcaacagctgcacag

SEQ ID NO: 772769 - DNA, 25 bp, Mus musculus
tccagttctctctacagctgcacag

SEQ ID NO: 772770 - DNA, 25 bp, Mus musculus
tccagttcttggctcaatggcaaaa

SEQ ID NO: 772771 - DNA, 25 bp, Mus musculus
tccagttcttgggtcaatggcaaaa

SEQ ID NO: 772772 - DNA, 25 bp, Mus musculus
tccagttgactccatccaggcagaa

SEQ ID NO: 772773 - DNA, 25 bp, Mus musculus
tccagttgactcgatccaggcagaa

SEQ ID NO: 772774 - DNA, 25 bp, Mus musculus
tccagttgcactaccgcgcgatgga

SEQ ID NO: 772775 - DNA, 25 bp, Mus musculus
tccagttgcacttccgcgcgatgga

SEQ ID NO: 772776 - DNA, 25 bp, Mus musculus
tccagttgcgacactccttgtctag

SEQ ID NO: 772777 - DNA, 25 bp, Mus musculus
tccagttgcgactctccttgtctag

SEQ ID NO: 772778 - DNA, 25 bp, Mus musculus
tccagttggccgcacctaaagagca

SEQ ID NO: 772779 - DNA, 25 bp, Mus musculus
tccagttggccggacctaaagagca

SEQ ID NO: 772780 - DNA, 25 bp, Mus musculus
tccagttggtgtaatgccccagggc

SEQ ID NO: 772781 - DNA, 25 bp, Mus musculus
tccagttggtgttatgccccagggc

SEQ ID NO: 772782 - DNA, 25 bp, Mus musculus
tccagttgtagaaggcctgacagag

SEQ ID NO: 772783 - DNA, 25 bp, Mus musculus
tccagttgtagatggcctgacagag

SEQ ID NO: 772784 - DNA, 25 bp, Mus musculus
tccagttgtcacacattctggagca

SEQ ID NO: 772785 - DNA, 25 bp, Mus musculus
tccagttgtcactcattctggagca

SEQ ID NO: 772786 - DNA, 25 bp, Mus musculus
tccagttgtccgacaaaaagattcg

SEQ ID NO: 772787 - DNA, 25 bp, Mus musculus
tccagttgtccgtcaaaaagattcg

SEQ ID NO: 772788 - DNA, 25 bp, Mus musculus
tccagttgttgtctgtgaagggaca

SEQ ID NO: 772789 - DNA, 25 bp, Mus musculus
tccagttgttgtgtgtgaagggaca

SEQ ID NO: 772790 - DNA, 25 bp, Mus musculus
tccagtttccctagtgggaatcctt

SEQ ID NO: 772791 - DNA, 25 bp, Mus musculus
tccagtttcccttgtgggaatcctt

SEQ ID NO: 772792 - DNA, 25 bp, Mus musculus
tccagtttcgatcggaaactggcgt

SEQ ID NO: 772793 - DNA, 25 bp, Mus musculus
tccagtttcgatgggaaactggcgt

SEQ ID NO: 772794 - DNA, 25 bp, Mus musculus
tccagtttgactatcagatcctcag

SEQ ID NO: 772795 - DNA, 25 bp, Mus musculus
tccagtttgactttcagatcctcag

SEQ ID NO: 772796 - DNA, 25 bp, Mus musculus
tccagtttgagaccacacatgtggc

SEQ ID NO: 772797 - DNA, 25 bp, Mus musculus
tccagtttgagagcacacatgtggc

SEQ ID NO: 772798 - DNA, 25 bp, Mus musculus
tccagtttgaggacgattcccagtt

SEQ ID NO: 772799 - DNA, 25 bp, Mus musculus
tccagtttgaggtcgattcccagtt

SEQ ID NO: 772800 - DNA, 25 bp, Mus musculus
tccagtttgccgcagaaagacggtg

SEQ ID NO: 772801 - DNA, 25 bp, Mus musculus
tccagtttgccggagaaagacggtg

SEQ ID NO: 772802 - DNA, 25 bp, Mus musculus
tccagtttggaaactcttgctcatg

SEQ ID NO: 772803 - DNA, 25 bp, Mus musculus
tccagtttggaatctcttgctcatg

SEQ ID NO: 772804 - DNA, 25 bp, Mus musculus
tccagtttggccctgtggccccaaa

SEQ ID NO: 772805 - DNA, 25 bp, Mus musculus
tccagtttggccgtgtggccccaaa

SEQ ID NO: 772806 - DNA, 25 bp, Mus musculus
tccagttttaccctcaaaacgtgag

SEQ ID NO: 772807 - DNA, 25 bp, Mus musculus
tccagttttaccgtcaaaacgtgag

SEQ ID NO: 772808 - DNA, 25 bp, Mus musculus
tccagttttatgacagcaccgcctc

SEQ ID NO: 772809 - DNA, 25 bp, Mus musculus
tccagttttatgtcagcaccgcctc

SEQ ID NO: 772810 - DNA, 25 bp, Mus musculus
tccagttttcgaacgtggtcttgcg

SEQ ID NO: 772811 - DNA, 25 bp, Mus musculus
tccagttttcgatcgtggtcttgcg

SEQ ID NO: 772812 - DNA, 25 bp, Mus musculus
tccagttttgctagcagaggatcct

SEQ ID NO: 772813 - DNA, 25 bp, Mus musculus
tccagttttgcttgcagaggatcct

SEQ ID NO: 772814 - DNA, 25 bp, Mus musculus
tccagtttttacacaaggagaagaa

SEQ ID NO: 772815 - DNA, 25 bp, Mus musculus
tccagtttttactcaaggagaagaa

SEQ ID NO: 772816 - DNA, 25 bp, Mus musculus
tccataaagaacaaagaggtgtccg

SEQ ID NO: 772817 - DNA, 25 bp, Mus musculus
tccataaagaactaagaggtgtccg

SEQ ID NO: 772818 - DNA, 25 bp, Mus musculus
tccataaatactctgtggcgggtaa

SEQ ID NO: 772819 - DNA, 25 bp, Mus musculus
tccataaatactgtgtggcgggtaa

SEQ ID NO: 772820 - DNA, 25 bp, Mus musculus
tccataacgagtatagtgaatacat

SEQ ID NO: 772821 - DNA, 25 bp, Mus musculus
tccataacgagtttagtgaatacat

SEQ ID NO: 772822 - DNA, 25 bp, Mus musculus
tccataagaaagcacaccaagcaag

SEQ ID NO: 772823 - DNA, 25 bp, Mus musculus
tccataagaaaggacaccaagcaag

SEQ ID NO: 772824 - DNA, 25 bp, Mus musculus
tccataagacagcatctggcatcta

SEQ ID NO: 772825 - DNA, 25 bp, Mus musculus
tccataagacaggatctggcatcta

SEQ ID NO: 772826 - DNA, 25 bp, Mus musculus
tccataagagtaccatagggcctcc

SEQ ID NO: 772827 - DNA, 25 bp, Mus musculus
tccataagagtagcatagggcctcc

SEQ ID NO: 772828 - DNA, 25 bp, Mus musculus
tccataaggtggaaatagcagaagc

SEQ ID NO: 772829 - DNA, 25 bp, Mus musculus
tccataaggtggtaatagcagaagc

SEQ ID NO: 772830 - DNA, 25 bp, Mus musculus
tccataatgtgcaaaaggaagatgc

SEQ ID NO: 772831 - DNA, 25 bp, Mus musculus
tccataatgtgctaaaggaagatgc

SEQ ID NO: 772832 - DNA, 25 bp, Mus musculus
tccataattcttatcgccaaggatg

SEQ ID NO: 772833 - DNA, 25 bp, Mus musculus
tccataattcttttcgccaaggatg

SEQ ID NO: 772834 - DNA, 25 bp, Mus musculus
tccatacacgaaagagcaaccggcg

SEQ ID NO: 772835 - DNA, 25 bp, Mus musculus
tccatacacgaatgagcaaccggcg

SEQ ID NO: 772836 - DNA, 25 bp, Mus musculus
tccatacagacgatggtcggcggcg

SEQ ID NO: 772837 - DNA, 25 bp, Mus musculus
tccatacagacgttggtcggcggcg

SEQ ID NO: 772838 - DNA, 25 bp, Mus musculus
tccatacagcttacttgataataca

SEQ ID NO: 772839 - DNA, 25 bp, Mus musculus
tccatacagctttcttgataataca

SEQ ID NO: 772840 - DNA, 25 bp, Mus musculus
tccatacataccaacagctgggaag

SEQ ID NO: 772841 - DNA, 25 bp, Mus musculus
tccatacatacctacagctgggaag

SEQ ID NO: 772842 - DNA, 25 bp, Mus musculus
tccatacctgctcggtagtgtctgc

SEQ ID NO: 772843 - DNA, 25 bp, Mus musculus
tccatacctgctgggtagtgtctgc

SEQ ID NO: 772844 - DNA, 25 bp, Mus musculus
tccatacctgggactgaagaggccc

SEQ ID NO: 772845 - DNA, 25 bp, Mus musculus
tccatacctgggtctgaagaggccc

SEQ ID NO: 772846 - DNA, 25 bp, Mus musculus
tccatactacacagcttgggaaggg

SEQ ID NO: 772847 - DNA, 25 bp, Mus musculus
tccatactacactgcttgggaaggg

SEQ ID NO: 772848 - DNA, 25 bp, Mus musculus
tccatactattgactgggtgcgaga

SEQ ID NO: 772849 - DNA, 25 bp, Mus musculus
tccatactattgtctgggtgcgaga

SEQ ID NO: 772850 - DNA, 25 bp, Mus musculus
tccatacttagaacacatagcagtt

SEQ ID NO: 772851 - DNA, 25 bp, Mus musculus
tccatacttagatcacatagcagtt

SEQ ID NO: 772852 - DNA, 25 bp, Mus musculus
tccatactttggactcggagctcca

SEQ ID NO: 772853 - DNA, 25 bp, Mus musculus
tccatactttggtctcggagctcca

SEQ ID NO: 772854 - DNA, 25 bp, Mus musculus
tccatagaagaaaagagtgtaacac

SEQ ID NO: 772855 - DNA, 25 bp, Mus musculus
tccatagaagaatagagtgtaacac

SEQ ID NO: 772856 - DNA, 25 bp, Mus musculus
tccatagacaacaaggcactgtatg

SEQ ID NO: 772857 - DNA, 25 bp, Mus musculus
tccatagacaactaggcactgtatg

SEQ ID NO: 772858 - DNA, 25 bp, Mus musculus
tccatagaccttcagggaacggcct

SEQ ID NO: 772859 - DNA, 25 bp, Mus musculus
tccatagaccttgagggaacggcct

SEQ ID NO: 772860 - DNA, 25 bp, Mus musculus
tccatagataccaacggctgggaaa

SEQ ID NO: 772861 - DNA, 25 bp, Mus musculus
tccatagatacctacggctgggaaa

SEQ ID NO: 772862 - DNA, 25 bp, Mus musculus
tccataggagttccaggccgttccc

SEQ ID NO: 772863 - DNA, 25 bp, Mus musculus
tccataggagttgcaggccgttccc

SEQ ID NO: 772864 - DNA, 25 bp, Mus musculus
tccatagggaggacgctccatgtcc

SEQ ID NO: 772865 - DNA, 25 bp, Mus musculus
tccatagggaggtcgctccatgtcc

SEQ ID NO: 772866 - DNA, 25 bp, Mus musculus
tccataggtgagctccagttggtgt

SEQ ID NO: 772867 - DNA, 25 bp, Mus musculus
tccataggtgaggtccagttggtgt

SEQ ID NO: 772868 - DNA, 25 bp, Mus musculus
tccatagtacctatgaggatgaatg

SEQ ID NO: 772869 - DNA, 25 bp, Mus musculus
tccatagtacctttgaggatgaatg

SEQ ID NO: 772870 - DNA, 25 bp, Mus musculus
tccatagtgcccagcaaatttgagg

SEQ ID NO: 772871 - DNA, 25 bp, Mus musculus
tccatagtgccctgcaaatttgagg

SEQ ID NO: 772872 - DNA, 25 bp, Mus musculus
tccatagttggccatcggtgagacg

SEQ ID NO: 772873 - DNA, 25 bp, Mus musculus
tccatagttggcgatcggtgagacg

SEQ ID NO: 772874 - DNA, 25 bp, Mus musculus
tccatatagataagactggaccgtt

SEQ ID NO: 772875 - DNA, 25 bp, Mus musculus
tccatatagatatgactggaccgtt

SEQ ID NO: 772876 - DNA, 25 bp, Mus musculus
tccatataggacagaggacatccag

SEQ ID NO: 772877 - DNA, 25 bp, Mus musculus
tccatataggactgaggacatccag

SEQ ID NO: 772878 - DNA, 25 bp, Mus musculus
tccatatcaaccatcgctgtggagg

SEQ ID NO: 772879 - DNA, 25 bp, Mus musculus
tccatatcaaccttcgctgtggagg

SEQ ID NO: 772880 - DNA, 25 bp, Mus musculus
tccatatcaagccagagctcaggtt

SEQ ID NO: 772881 - DNA, 25 bp, Mus musculus
tccatatcaagcgagagctcaggtt

SEQ ID NO: 772882 - DNA, 25 bp, Mus musculus
tccatatcagtgaggaggaatcagt

SEQ ID NO: 772883 - DNA, 25 bp, Mus musculus
tccatatcagtgtggaggaatcagt

SEQ ID NO: 772884 - DNA, 25 bp, Mus musculus
tccatatcctgtatctgctgctctg

SEQ ID NO: 772885 - DNA, 25 bp, Mus musculus
tccatatcctgtttctgctgctctg

SEQ ID NO: 772886 - DNA, 25 bp, Mus musculus
tccatatcttggacgggccagacca

SEQ ID NO: 772887 - DNA, 25 bp, Mus musculus
tccatatcttggtcgggccagacca

SEQ ID NO: 772888 - DNA, 25 bp, Mus musculus
tccatatgcctcacaatgggacgga

SEQ ID NO: 772889 - DNA, 25 bp, Mus musculus
tccatatgcctctcaatgggacgga

SEQ ID NO: 772890 - DNA, 25 bp, Mus musculus
tccatatggaagaagaagtgcctgg

SEQ ID NO: 772891 - DNA, 25 bp, Mus musculus
tccatatggaagtagaagtgcctgg

SEQ ID NO: 772892 - DNA, 25 bp, Mus musculus
tccatatggttcacagcacccctgg

SEQ ID NO: 772893 - DNA, 25 bp, Mus musculus
tccatatggttctcagcacccctgg

SEQ ID NO: 772894 - DNA, 25 bp, Mus musculus
tccatcaaaggcattggcttccaaa

SEQ ID NO: 772895 - DNA, 25 bp, Mus musculus
tccatcaaaggctttggcttccaaa

SEQ ID NO: 772896 - DNA, 25 bp, Mus musculus
tccatcaacaggcatggcagcaata

SEQ ID NO: 772897 - DNA, 25 bp, Mus musculus
tccatcaacagggatggcagcaata

SEQ ID NO: 772898 - DNA, 25 bp, Mus musculus
tccatcaaccccaatggcaacagag

SEQ ID NO: 772899 - DNA, 25 bp, Mus musculus
tccatcaacccctatggcaacagag

SEQ ID NO: 772900 - DNA, 25 bp, Mus musculus
tccatcaagaaacggagatccccag

SEQ ID NO: 772901 - DNA, 25 bp, Mus musculus
tccatcaagaaagggagatccccag

SEQ ID NO: 772902 - DNA, 25 bp, Mus musculus
tccatcaaggaaatcaggaatagat

SEQ ID NO: 772903 - DNA, 25 bp, Mus musculus
tccatcaaggaattcaggaatagat

SEQ ID NO: 772904 - DNA, 25 bp, Mus musculus
tccatcaaggccatgcggatcctgg

SEQ ID NO: 772905 - DNA, 25 bp, Mus musculus
tccatcaaggccttgcggatcctgg

SEQ ID NO: 772906 - DNA, 25 bp, Mus musculus
tccatcaagtctacaactctaagag

SEQ ID NO: 772907 - DNA, 25 bp, Mus musculus
tccatcaagtcttcaactctaagag

SEQ ID NO: 772908 - DNA, 25 bp, Mus musculus
tccatcaccaccctgtgagtggcag

SEQ ID NO: 772909 - DNA, 25 bp, Mus musculus
tccatcaccaccgtgtgagtggcag

SEQ ID NO: 772910 - DNA, 25 bp, Mus musculus
tccatcaccgccagaaggaacagca

SEQ ID NO: 772911 - DNA, 25 bp, Mus musculus
tccatcaccgcctgaaggaacagca

SEQ ID NO: 772912 - DNA, 25 bp, Mus musculus
tccatcacctaccagcacgacttgg

SEQ ID NO: 772913 - DNA, 25 bp, Mus musculus
tccatcacctacgagcacgacttgg

SEQ ID NO: 772914 - DNA, 25 bp, Mus musculus
tccatcacctatcaattggctatca

SEQ ID NO: 772915 - DNA, 25 bp, Mus musculus
tccatcacctatgaattggctatca

SEQ ID NO: 772916 - DNA, 25 bp, Mus musculus
tccatcacggatcgtcgaagtttcc

SEQ ID NO: 772917 - DNA, 25 bp, Mus musculus
tccatcacggatggtcgaagtttcc

SEQ ID NO: 772918 - DNA, 25 bp, Mus musculus
tccatcagacccagggcaatcggag

SEQ ID NO: 772919 - DNA, 25 bp, Mus musculus
tccatcagaccctgggcaatcggag

SEQ ID NO: 772920 - DNA, 25 bp, Mus musculus
tccatcagacggaggaagcaggctt

SEQ ID NO: 772921 - DNA, 25 bp, Mus musculus
tccatcagacggtggaagcaggctt

SEQ ID NO: 772922 - DNA, 25 bp, Mus musculus
tccatcagcaacaagagaatagtgg

SEQ ID NO: 772923 - DNA, 25 bp, Mus musculus
tccatcagcaactagagaatagtgg

SEQ ID NO: 772924 - DNA, 25 bp, Mus musculus
tccatcagccaacagaagtctggag

SEQ ID NO: 772925 - DNA, 25 bp, Mus musculus
tccatcagccaagagaagtctggag

SEQ ID NO: 772926 - DNA, 25 bp, Mus musculus
tccatcagctgaaacatttgttgct

SEQ ID NO: 772927 - DNA, 25 bp, Mus musculus
tccatcagctgatacatttgttgct

SEQ ID NO: 772928 - DNA, 25 bp, Mus musculus
tccatcaggaagcagctaaaatggc

SEQ ID NO: 772929 - DNA, 25 bp, Mus musculus
tccatcaggaaggagctaaaatggc

SEQ ID NO: 772930 - DNA, 25 bp, Mus musculus
tccatcaggtgcaaaggataactcg

SEQ ID NO: 772931 - DNA, 25 bp, Mus musculus
tccatcaggtgctaaggataactcg

SEQ ID NO: 772932 - DNA, 25 bp, Mus musculus
tccatcagtgagctccaaagaatga

SEQ ID NO: 772933 - DNA, 25 bp, Mus musculus
tccatcagtgaggtccaaagaatga

SEQ ID NO: 772934 - DNA, 25 bp, Mus musculus
tccatcatcaatctcctagagacag

SEQ ID NO: 772935 - DNA, 25 bp, Mus musculus
tccatcatcaatgtcctagagacag

SEQ ID NO: 772936 - DNA, 25 bp, Mus musculus
tccatcatcgcacatgattttgcag

SEQ ID NO: 772937 - DNA, 25 bp, Mus musculus
tccatcatcgcagatgattttgcag

SEQ ID NO: 772938 - DNA, 25 bp, Mus musculus
tccatcatgagacacacctcctggg

SEQ ID NO: 772939 - DNA, 25 bp, Mus musculus
tccatcatgagacataagatgccca

SEQ ID NO: 772940 - DNA, 25 bp, Mus musculus
tccatcatgagagacacctcctggg

SEQ ID NO: 772941 - DNA, 25 bp, Mus musculus
tccatcatgagagataagatgccca

SEQ ID NO: 772942 - DNA, 25 bp, Mus musculus
tccatcatgataacaggcaatgtct

SEQ ID NO: 772943 - DNA, 25 bp, Mus musculus
tccatcatgatatcaggcaatgtct

SEQ ID NO: 772944 - DNA, 25 bp, Mus musculus
tccatcatgattcgtgtcaagccat

SEQ ID NO: 772945 - DNA, 25 bp, Mus musculus
tccatcatgattggtgtcaagccat

SEQ ID NO: 772946 - DNA, 25 bp, Mus musculus
tccatcatgtctcctgagattcagt

SEQ ID NO: 772947 - DNA, 25 bp, Mus musculus
tccatcatgtctgctgagattcagt

SEQ ID NO: 772948 - DNA, 25 bp, Mus musculus
tccatcatgtggctcaggatggcca

SEQ ID NO: 772949 - DNA, 25 bp, Mus musculus
tccatcatgtgggtcaggatggcca

SEQ ID NO: 772950 - DNA, 25 bp, Mus musculus
tccatcatgtttcacttgcgccgac

SEQ ID NO: 772951 - DNA, 25 bp, Mus musculus
tccatcatgtttgacttgcgccgac

SEQ ID NO: 772952 - DNA, 25 bp, Mus musculus
tccatccactcccagagtcatgagt

SEQ ID NO: 772953 - DNA, 25 bp, Mus musculus
tccatccactccgagagtcatgagt

SEQ ID NO: 772954 - DNA, 25 bp, Mus musculus
tccatccagaaaacctatgacctca

SEQ ID NO: 772955 - DNA, 25 bp, Mus musculus
tccatccagaaatcctatgacctca

SEQ ID NO: 772956 - DNA, 25 bp, Mus musculus
tccatccagatacagggtagcatag

SEQ ID NO: 772957 - DNA, 25 bp, Mus musculus
tccatccagatagagggtagcatag

SEQ ID NO: 772958 - DNA, 25 bp, Mus musculus
tccatccagccaagagagcaaatcg

SEQ ID NO: 772959 - DNA, 25 bp, Mus musculus
tccatccagccatgagagcaaatcg

SEQ ID NO: 772960 - DNA, 25 bp, Mus musculus
tccatccagggtctccggataatgt

SEQ ID NO: 772961 - DNA, 25 bp, Mus musculus
tccatccagggtgtccggataatgt

SEQ ID NO: 772962 - DNA, 25 bp, Mus musculus
tccatccagttgaaggaagtgacct

SEQ ID NO: 772963 - DNA, 25 bp, Mus musculus
tccatccagttgtaggaagtgacct

SEQ ID NO: 772964 - DNA, 25 bp, Mus musculus
tccatccctgggaccacatgtagaa

SEQ ID NO: 772965 - DNA, 25 bp, Mus musculus
tccatccctgggtccacatgtagaa

SEQ ID NO: 772966 - DNA, 25 bp, Mus musculus
tccatcctacaactttgacattggg

SEQ ID NO: 772967 - DNA, 25 bp, Mus musculus
tccatcctacaagtttgacattggg

SEQ ID NO: 772968 - DNA, 25 bp, Mus musculus
tccatcctaggacgatccgattctg

SEQ ID NO: 772969 - DNA, 25 bp, Mus musculus
tccatcctaggaggatccgattctg

SEQ ID NO: 772970 - DNA, 25 bp, Mus musculus
tccatcctcagcctgatggacaggg

SEQ ID NO: 772971 - DNA, 25 bp, Mus musculus
tccatcctcagcgtgatggacaggg

SEQ ID NO: 772972 - DNA, 25 bp, Mus musculus
tccatcctccttacctggaacttgg

SEQ ID NO: 772973 - DNA, 25 bp, Mus musculus
tccatcctcctttcctggaacttgg

SEQ ID NO: 772974 - DNA, 25 bp, Mus musculus
tccatcctggagcacagaccgacag

SEQ ID NO: 772975 - DNA, 25 bp, Mus musculus
tccatcctggaggacagaccgacag

SEQ ID NO: 772976 - DNA, 25 bp, Mus musculus
tccatcctggccatcgttcgggcta

SEQ ID NO: 772977 - DNA, 25 bp, Mus musculus
tccatcctggccttcgttcgggcta

SEQ ID NO: 772978 - DNA, 25 bp, Mus musculus
tccatcctgggccatgatgtacaaa

SEQ ID NO: 772979 - DNA, 25 bp, Mus musculus
tccatcctgggcgatgatgtacaaa

SEQ ID NO: 772980 - DNA, 25 bp, Mus musculus
tccatcctggtgcttacatggactg

SEQ ID NO: 772981 - DNA, 25 bp, Mus musculus
tccatcctggtggttacatggactg

SEQ ID NO: 772982 - DNA, 25 bp, Mus musculus
tccatccttgttaccctgtggacca

SEQ ID NO: 772983 - DNA, 25 bp, Mus musculus
tccatccttgtttccctgtggacca

SEQ ID NO: 772984 - DNA, 25 bp, Mus musculus
tccatcctttatccatagccagaag

SEQ ID NO: 772985 - DNA, 25 bp, Mus musculus
tccatcctttatgcatagccagaag

SEQ ID NO: 772986 - DNA, 25 bp, Mus musculus
tccatcctttggctaacagccttgt

SEQ ID NO: 772987 - DNA, 25 bp, Mus musculus
tccatcctttgggtaacagccttgt

SEQ ID NO: 772988 - DNA, 25 bp, Mus musculus
tccatcgaaggcctctcagagctca

SEQ ID NO: 772989 - DNA, 25 bp, Mus musculus
tccatcgaaggcgtctcagagctca

SEQ ID NO: 772990 - DNA, 25 bp, Mus musculus
tccatcgacaataaagcactatatg

SEQ ID NO: 772991 - DNA, 25 bp, Mus musculus
tccatcgacaattaagcactatatg

SEQ ID NO: 772992 - DNA, 25 bp, Mus musculus
tccatcgacgacatcctctgcgaaa

SEQ ID NO: 772993 - DNA, 25 bp, Mus musculus
tccatcgacgacttcctctgcgaaa

SEQ ID NO: 772994 - DNA, 25 bp, Mus musculus
tccatcgactggatgcaagcaagac

SEQ ID NO: 772995 - DNA, 25 bp, Mus musculus
tccatcgactggttgcaagcaagac

SEQ ID NO: 772996 - DNA, 25 bp, Mus musculus
tccatcgattgaacgtagaactcag

SEQ ID NO: 772997 - DNA, 25 bp, Mus musculus
tccatcgattgatcgtagaactcag

SEQ ID NO: 772998 - DNA, 25 bp, Mus musculus
tccatcgccgtgctctcggcagttg

SEQ ID NO: 772999 - DNA, 25 bp, Mus musculus
tccatcgccgtggtctcggcagttg

SEQ ID NO: 773000 - DNA, 25 bp, Mus musculus
tccatcgccttgaagacattagagc

SEQ ID NO: 773001 - DNA, 25 bp, Mus musculus
tccatcgccttgtagacattagagc

SEQ ID NO: 773002 - DNA, 25 bp, Mus musculus
tccatcggaacactgctgtgtggcc

SEQ ID NO: 773003 - DNA, 25 bp, Mus musculus
tccatcggaacagtgctgtgtggcc

SEQ ID NO: 773004 - DNA, 25 bp, Mus musculus
tccatcggatagaaaagtgtgtttc

SEQ ID NO: 773005 - DNA, 25 bp, Mus musculus
tccatcggatagtaaagtgtgtttc

SEQ ID NO: 773006 - DNA, 25 bp, Mus musculus
tccatcggcatcatgttgcacgagc

SEQ ID NO: 773007 - DNA, 25 bp, Mus musculus
tccatcggcatcttgttgcacgagc

SEQ ID NO: 773008 - DNA, 25 bp, Mus musculus
tccatcggtgagcagagctctggaa

SEQ ID NO: 773009 - DNA, 25 bp, Mus musculus
tccatcggtgaggagagctctggaa

SEQ ID NO: 773010 - DNA, 25 bp, Mus musculus
tccatcgtggaacggccgctgagca

SEQ ID NO: 773011 - DNA, 25 bp, Mus musculus
tccatcgtggaagggccgctgagca

SEQ ID NO: 773012 - DNA, 25 bp, Mus musculus
tccatcgtggtcatcggctctatcg

SEQ ID NO: 773013 - DNA, 25 bp, Mus musculus
tccatcgtggtcttcggctctatcg

SEQ ID NO: 773014 - DNA, 25 bp, Mus musculus
tccatcgtgtccagctttgccctgt

SEQ ID NO: 773015 - DNA, 25 bp, Mus musculus
tccatcgtgtcctgctttgccctgt

SEQ ID NO: 773016 - DNA, 25 bp, Mus musculus
tccatcgttggtaccggcaatggcc

SEQ ID NO: 773017 - DNA, 25 bp, Mus musculus
tccatcgttggttccggcaatggcc

SEQ ID NO: 773018 - DNA, 25 bp, Mus musculus
tccatctacctgcaggtgctgacag

SEQ ID NO: 773019 - DNA, 25 bp, Mus musculus
tccatctacctggaggtgctgacag

SEQ ID NO: 773020 - DNA, 25 bp, Mus musculus
tccatctactatcagctgggagaag

SEQ ID NO: 773021 - DNA, 25 bp, Mus musculus
tccatctactatgagctgggagaag

SEQ ID NO: 773022 - DNA, 25 bp, Mus musculus
tccatctactgaaaaggcggctcag

SEQ ID NO: 773023 - DNA, 25 bp, Mus musculus
tccatctactgataaggcggctcag

SEQ ID NO: 773024 - DNA, 25 bp, Mus musculus
tccatctcaccaagctgtctctaga

SEQ ID NO: 773025 - DNA, 25 bp, Mus musculus
tccatctcaccatgctgtctctaga

SEQ ID NO: 773026 - DNA, 25 bp, Mus musculus
tccatctgagaacgcatacttcagt

SEQ ID NO: 773027 - DNA, 25 bp, Mus musculus
tccatctgagaaggcatacttcagt

SEQ ID NO: 773028 - DNA, 25 bp, Mus musculus
tccatctgcgccagctttctatagc

SEQ ID NO: 773029 - DNA, 25 bp, Mus musculus
tccatctgcgcctgctttctatagc

SEQ ID NO: 773030 - DNA, 25 bp, Mus musculus
tccatctggaaccaagtaacagttt

SEQ ID NO: 773031 - DNA, 25 bp, Mus musculus
tccatctggaacgaagtaacagttt

SEQ ID NO: 773032 - DNA, 25 bp, Mus musculus
tccatctggactcgagccaacaagc

SEQ ID NO: 773033 - DNA, 25 bp, Mus musculus
tccatctggactggagccaacaagc

SEQ ID NO: 773034 - DNA, 25 bp, Mus musculus
tccatctggaggagggagaccaagt

SEQ ID NO: 773035 - DNA, 25 bp, Mus musculus
tccatctggaggtgggagaccaagt

SEQ ID NO: 773036 - DNA, 25 bp, Mus musculus
tccatctggcccatagacatttttt

SEQ ID NO: 773037 - DNA, 25 bp, Mus musculus
tccatctggcccttagacatttttt

SEQ ID NO: 773038 - DNA, 25 bp, Mus musculus
tccatctgtacacaagggctgccac

SEQ ID NO: 773039 - DNA, 25 bp, Mus musculus
tccatctgtacagaagggctgccac

SEQ ID NO: 773040 - DNA, 25 bp, Mus musculus
tccatcttaaggcaactggctctgt

SEQ ID NO: 773041 - DNA, 25 bp, Mus musculus
tccatcttaagggaactggctctgt

SEQ ID NO: 773042 - DNA, 25 bp, Mus musculus
tccatcttggccagagcgtaggaag

SEQ ID NO: 773043 - DNA, 25 bp, Mus musculus
tccatcttggcctgagcgtaggaag

SEQ ID NO: 773044 - DNA, 25 bp, Mus musculus
tccatcttggctcaggccaaggaca

SEQ ID NO: 773045 - DNA, 25 bp, Mus musculus
tccatcttggctgaggccaaggaca

SEQ ID NO: 773046 - DNA, 25 bp, Mus musculus
tccatcttgggaaatgcccgtctcc

SEQ ID NO: 773047 - DNA, 25 bp, Mus musculus
tccatcttgggatatgcccgtctcc

SEQ ID NO: 773048 - DNA, 25 bp, Mus musculus
tccatctttggcatgggagcacccc

SEQ ID NO: 773049 - DNA, 25 bp, Mus musculus
tccatctttggcttgggagcacccc

SEQ ID NO: 773050 - DNA, 25 bp, Mus musculus
tccatgaaagaaatgcagggattaa

SEQ ID NO: 773051 - DNA, 25 bp, Mus musculus
tccatgaaagaattgcagggattaa

SEQ ID NO: 773052 - DNA, 25 bp, Mus musculus
tccatgaaggccacacggtgaaaat

SEQ ID NO: 773053 - DNA, 25 bp, Mus musculus
tccatgaaggcctcacggtgaaaat

SEQ ID NO: 773054 - DNA, 25 bp, Mus musculus
tccatgaagtccacgtccagatgca

SEQ ID NO: 773055 - DNA, 25 bp, Mus musculus
tccatgaagtcctcgtccagatgca

SEQ ID NO: 773056 - DNA, 25 bp, Mus musculus
tccatgaatatcaaggcccatatcc

SEQ ID NO: 773057 - DNA, 25 bp, Mus musculus
tccatgaatatctaggcccatatcc

SEQ ID NO: 773058 - DNA, 25 bp, Mus musculus
tccatgaattcacggtcagagtccc

SEQ ID NO: 773059 - DNA, 25 bp, Mus musculus
tccatgaattcagggtcagagtccc

SEQ ID NO: 773060 - DNA, 25 bp, Mus musculus
tccatgaattgacatgatttacaca

SEQ ID NO: 773061 - DNA, 25 bp, Mus musculus
tccatgaattgagatgatttacaca

SEQ ID NO: 773062 - DNA, 25 bp, Mus musculus
tccatgacaaagaactgaaagtgct

SEQ ID NO: 773063 - DNA, 25 bp, Mus musculus
tccatgacaaagtactgaaagtgct

SEQ ID NO: 773064 - DNA, 25 bp, Mus musculus
tccatgacacagctccaagggaagg

SEQ ID NO: 773065 - DNA, 25 bp, Mus musculus
tccatgacacaggtccaagggaagg

SEQ ID NO: 773066 - DNA, 25 bp, Mus musculus
tccatgacagcgaggtgggcaagct

SEQ ID NO: 773067 - DNA, 25 bp, Mus musculus
tccatgacagcgtggtgggcaagct

SEQ ID NO: 773068 - DNA, 25 bp, Mus musculus
tccatgacaggcagttccctgtatg

SEQ ID NO: 773069 - DNA, 25 bp, Mus musculus
tccatgacaggctgttccctgtatg

SEQ ID NO: 773070 - DNA, 25 bp, Mus musculus
tccatgacagtgcaggattatcagg

SEQ ID NO: 773071 - DNA, 25 bp, Mus musculus
tccatgacagtggaggattatcagg

SEQ ID NO: 773072 - DNA, 25 bp, Mus musculus
tccatgacctacagcttagtggctc

SEQ ID NO: 773073 - DNA, 25 bp, Mus musculus
tccatgacctacctctacgaggaca

SEQ ID NO: 773074 - DNA, 25 bp, Mus musculus
tccatgacctacgtctacgaggaca

SEQ ID NO: 773075 - DNA, 25 bp, Mus musculus
tccatgacctactgcttagtggctc

SEQ ID NO: 773076 - DNA, 25 bp, Mus musculus
tccatgacctagatagagtaattag

SEQ ID NO: 773077 - DNA, 25 bp, Mus musculus
tccatgacctagttagagtaattag

SEQ ID NO: 773078 - DNA, 25 bp, Mus musculus
tccatgacgacgagctcggcgtata

SEQ ID NO: 773079 - DNA, 25 bp, Mus musculus
tccatgacgacgtgctcggcgtata

SEQ ID NO: 773080 - DNA, 25 bp, Mus musculus
tccatgacgagcacctattcatcat

SEQ ID NO: 773081 - DNA, 25 bp, Mus musculus
tccatgacgagctcctattcatcat

SEQ ID NO: 773082 - DNA, 25 bp, Mus musculus
tccatgagaagacgcagggaaaact

SEQ ID NO: 773083 - DNA, 25 bp, Mus musculus
tccatgagaagaggcagggaaaact

SEQ ID NO: 773084 - DNA, 25 bp, Mus musculus
tccatgagaattacaccaaggccct

SEQ ID NO: 773085 - DNA, 25 bp, Mus musculus
tccatgagaatttcaccaaggccct

SEQ ID NO: 773086 - DNA, 25 bp, Mus musculus
tccatgagagctaccgacaggatgg

SEQ ID NO: 773087 - DNA, 25 bp, Mus musculus
tccatgagagcttccgacaggatgg

SEQ ID NO: 773088 - DNA, 25 bp, Mus musculus
tccatgagaggaagggcaaaaagtt

SEQ ID NO: 773089 - DNA, 25 bp, Mus musculus
tccatgagaggatgggcaaaaagtt

SEQ ID NO: 773090 - DNA, 25 bp, Mus musculus
tccatgagctttcccgagacaagga

SEQ ID NO: 773091 - DNA, 25 bp, Mus musculus
tccatgagctttgccgagacaagga

SEQ ID NO: 773092 - DNA, 25 bp, Mus musculus
tccatgaggaacagttccacacagc

SEQ ID NO: 773093 - DNA, 25 bp, Mus musculus
tccatgaggaactgttccacacagc

SEQ ID NO: 773094 - DNA, 25 bp, Mus musculus
tccatgaggagtataagagcaaggg

SEQ ID NO: 773095 - DNA, 25 bp, Mus musculus
tccatgaggagtttaagagcaaggg

SEQ ID NO: 773096 - DNA, 25 bp, Mus musculus
tccatgaggatgcaagctgagctcc

SEQ ID NO: 773097 - DNA, 25 bp, Mus musculus
tccatgaggatggaagctgagctcc

SEQ ID NO: 773098 - DNA, 25 bp, Mus musculus
tccatgaggtcaaggtgggcgcctt

SEQ ID NO: 773099 - DNA, 25 bp, Mus musculus
tccatgaggtcatggtgggcgcctt

SEQ ID NO: 773100 - DNA, 25 bp, Mus musculus
tccatgagttcccagaacgatggtt

SEQ ID NO: 773101 - DNA, 25 bp, Mus musculus
tccatgagttccgagaacgatggtt

SEQ ID NO: 773102 - DNA, 25 bp, Mus musculus
tccatgatccagaacacttgacact

SEQ ID NO: 773103 - DNA, 25 bp, Mus musculus
tccatgatccagtacacttgacact

SEQ ID NO: 773104 - DNA, 25 bp, Mus musculus
tccatgatgaagaggccaacaaaca

SEQ ID NO: 773105 - DNA, 25 bp, Mus musculus
tccatgatgaagtggccaacaaaca

SEQ ID NO: 773106 - DNA, 25 bp, Mus musculus
tccatgatgaggaggtcttgcggct

SEQ ID NO: 773107 - DNA, 25 bp, Mus musculus
tccatgatgaggtggtcttgcggct

SEQ ID NO: 773108 - DNA, 25 bp, Mus musculus
tccatgatgatccaggtgtgctgag

SEQ ID NO: 773109 - DNA, 25 bp, Mus musculus
tccatgatgatcgaggtgtgctgag

SEQ ID NO: 773110 - DNA, 25 bp, Mus musculus
tccatgatggctatgtcctacagca

SEQ ID NO: 773111 - DNA, 25 bp, Mus musculus
tccatgatggctttgtcctacagca

SEQ ID NO: 773112 - DNA, 25 bp, Mus musculus
tccatgatgtgcagggccggaactg

SEQ ID NO: 773113 - DNA, 25 bp, Mus musculus
tccatgatgtgctgggccggaactg

SEQ ID NO: 773114 - DNA, 25 bp, Mus musculus
tccatgcaatcgagcgtgatgctca

SEQ ID NO: 773115 - DNA, 25 bp, Mus musculus
tccatgcaatcgtgcgtgatgctca

SEQ ID NO: 773116 - DNA, 25 bp, Mus musculus
tccatgcactttcgaggctcagaaa

SEQ ID NO: 773117 - DNA, 25 bp, Mus musculus
tccatgcactttggaggctcagaaa

SEQ ID NO: 773118 - DNA, 25 bp, Mus musculus
tccatgcaggagaagtgtcaaacgt

SEQ ID NO: 773119 - DNA, 25 bp, Mus musculus
tccatgcaggagtagtgtcaaacgt

SEQ ID NO: 773120 - DNA, 25 bp, Mus musculus
tccatgcatcccatgtataaataaa

SEQ ID NO: 773121 - DNA, 25 bp, Mus musculus
tccatgcatcccttgtataaataaa

SEQ ID NO: 773122 - DNA, 25 bp, Mus musculus
tccatgccagaaacaagcctgtgaa

SEQ ID NO: 773123 - DNA, 25 bp, Mus musculus
tccatgccagaatcaagcctgtgaa

SEQ ID NO: 773124 - DNA, 25 bp, Mus musculus
tccatgccatcacagagcaactgat

SEQ ID NO: 773125 - DNA, 25 bp, Mus musculus
tccatgccatcagagagcaactgat

SEQ ID NO: 773126 - DNA, 25 bp, Mus musculus
tccatgccatgaaaaactcctctgt

SEQ ID NO: 773127 - DNA, 25 bp, Mus musculus
tccatgccatgataaactcctctgt

SEQ ID NO: 773128 - DNA, 25 bp, Mus musculus
tccatgcccaaaatctgggtgaggg

SEQ ID NO: 773129 - DNA, 25 bp, Mus musculus
tccatgcccaaattctgggtgaggg

SEQ ID NO: 773130 - DNA, 25 bp, Mus musculus
tccatgccgtcaagagctgcttctc

SEQ ID NO: 773131 - DNA, 25 bp, Mus musculus
tccatgccgtcatgagctgcttctc

SEQ ID NO: 773132 - DNA, 25 bp, Mus musculus
tccatgcctgtcacattaaacccag

SEQ ID NO: 773133 - DNA, 25 bp, Mus musculus
tccatgcctgtctcattaaacccag

SEQ ID NO: 773134 - DNA, 25 bp, Mus musculus
tccatgccttacacagatgcagtga

SEQ ID NO: 773135 - DNA, 25 bp, Mus musculus
tccatgccttactcagatgcagtga

SEQ ID NO: 773136 - DNA, 25 bp, Mus musculus
tccatgcgatcgagcctggagcact

SEQ ID NO: 773137 - DNA, 25 bp, Mus musculus
tccatgcgatcgtgcctggagcact

SEQ ID NO: 773138 - DNA, 25 bp, Mus musculus
tccatgcggtctaacctctatcggg

SEQ ID NO: 773139 - DNA, 25 bp, Mus musculus
tccatgcggtcttacctctatcggg

SEQ ID NO: 773140 - DNA, 25 bp, Mus musculus
tccatgctgaagagggaaaccaggc

SEQ ID NO: 773141 - DNA, 25 bp, Mus musculus
tccatgctgaagtgggaaaccaggc

SEQ ID NO: 773142 - DNA, 25 bp, Mus musculus
tccatgctgcccatcaaacgaggcg

SEQ ID NO: 773143 - DNA, 25 bp, Mus musculus
tccatgctgcccttcaaacgaggcg

SEQ ID NO: 773144 - DNA, 25 bp, Mus musculus
tccatgctgccgacactgagagagg

SEQ ID NO: 773145 - DNA, 25 bp, Mus musculus
tccatgctgccgtcactgagagagg

SEQ ID NO: 773146 - DNA, 25 bp, Mus musculus
tccatggacaacacgatatggctcc

SEQ ID NO: 773147 - DNA, 25 bp, Mus musculus
tccatggacaactcgatatggctcc

SEQ ID NO: 773148 - DNA, 25 bp, Mus musculus
tccatggacaatactatgacctcaa

SEQ ID NO: 773149 - DNA, 25 bp, Mus musculus
tccatggacaattctatgacctcaa

SEQ ID NO: 773150 - DNA, 25 bp, Mus musculus
tccatggacgaactgcagagtcaca

SEQ ID NO: 773151 - DNA, 25 bp, Mus musculus
tccatggacgaagtgcagagtcaca

SEQ ID NO: 773152 - DNA, 25 bp, Mus musculus
tccatggagaggaacgtgctggaaa

SEQ ID NO: 773153 - DNA, 25 bp, Mus musculus
tccatggagaggtacgtgctggaaa

SEQ ID NO: 773154 - DNA, 25 bp, Mus musculus
tccatggagatgagagggtacttac

SEQ ID NO: 773155 - DNA, 25 bp, Mus musculus
tccatggagatgtgagggtacttac

SEQ ID NO: 773156 - DNA, 25 bp, Mus musculus
tccatggagcttaagtggtaaaagc

SEQ ID NO: 773157 - DNA, 25 bp, Mus musculus
tccatggagctttagtggtaaaagc

SEQ ID NO: 773158 - DNA, 25 bp, Mus musculus
tccatggaggtgaaaagttctgttg

SEQ ID NO: 773159 - DNA, 25 bp, Mus musculus
tccatggaggtgtaaagttctgttg

SEQ ID NO: 773160 - DNA, 25 bp, Mus musculus
tccatggatgacattctgtttgagg

SEQ ID NO: 773161 - DNA, 25 bp, Mus musculus
tccatggatgactttctgtttgagg

SEQ ID NO: 773162 - DNA, 25 bp, Mus musculus
tccatggatgttaagagaacctctt

SEQ ID NO: 773163 - DNA, 25 bp, Mus musculus
tccatggatgtttagagaacctctt

SEQ ID NO: 773164 - DNA, 25 bp, Mus musculus
tccatggccaagaccctatacagtg

SEQ ID NO: 773165 - DNA, 25 bp, Mus musculus
tccatggccaagtccctatacagtg

SEQ ID NO: 773166 - DNA, 25 bp, Mus musculus
tccatggccacaaccagaactgtga

SEQ ID NO: 773167 - DNA, 25 bp, Mus musculus
tccatggccacatccagaactgtga

SEQ ID NO: 773168 - DNA, 25 bp, Mus musculus
tccatggcctcacagactcacaagg

SEQ ID NO: 773169 - DNA, 25 bp, Mus musculus
tccatggcctcacaggagccgcaga

SEQ ID NO: 773170 - DNA, 25 bp, Mus musculus
tccatggcctcagagactcacaagg

SEQ ID NO: 773171 - DNA, 25 bp, Mus musculus
tccatggcctcagaggagccgcaga

SEQ ID NO: 773172 - DNA, 25 bp, Mus musculus
tccatggcctgccagacctttcaat

SEQ ID NO: 773173 - DNA, 25 bp, Mus musculus
tccatggcctgcgagacctttcaat

SEQ ID NO: 773174 - DNA, 25 bp, Mus musculus
tccatggcggctacgattctgactg

SEQ ID NO: 773175 - DNA, 25 bp, Mus musculus
tccatggcggcttcgattctgactg

SEQ ID NO: 773176 - DNA, 25 bp, Mus musculus
tccatggctgatatccgcatggtct

SEQ ID NO: 773177 - DNA, 25 bp, Mus musculus
tccatggctgatttccgcatggtct

SEQ ID NO: 773178 - DNA, 25 bp, Mus musculus
tccatggcttatcctggagcccgct

SEQ ID NO: 773179 - DNA, 25 bp, Mus musculus
tccatggcttatgctggagcccgct

SEQ ID NO: 773180 - DNA, 25 bp, Mus musculus
tccatgggaactagcacaggagcga

SEQ ID NO: 773181 - DNA, 25 bp, Mus musculus
tccatgggaacttgcacaggagcga

SEQ ID NO: 773182 - DNA, 25 bp, Mus musculus
tccatgggaggcagtcgtccttctt

SEQ ID NO: 773183 - DNA, 25 bp, Mus musculus
tccatgggaggctgtcgtccttctt

SEQ ID NO: 773184 - DNA, 25 bp, Mus musculus
tccatgggcagtccccactggtgac

SEQ ID NO: 773185 - DNA, 25 bp, Mus musculus
tccatgggcagtgcccactggtgac

SEQ ID NO: 773186 - DNA, 25 bp, Mus musculus
tccatgggcttgagcagaaaatcat

SEQ ID NO: 773187 - DNA, 25 bp, Mus musculus
tccatgggcttgtgcagaaaatcat

SEQ ID NO: 773188 - DNA, 25 bp, Mus musculus
tccatgggggcgcacctttccttca

SEQ ID NO: 773189 - DNA, 25 bp, Mus musculus
tccatgggggcggacctttccttca

SEQ ID NO: 773190 - DNA, 25 bp, Mus musculus
tccatggtaaaaagctgaaactggg

SEQ ID NO: 773191 - DNA, 25 bp, Mus musculus
tccatggtaaaatgctgaaactggg

SEQ ID NO: 773192 - DNA, 25 bp, Mus musculus
tccatggtagcgcaactggccctgt

SEQ ID NO: 773193 - DNA, 25 bp, Mus musculus
tccatggtagcggaactggccctgt

SEQ ID NO: 773194 - DNA, 25 bp, Mus musculus
tccatggtatgtcgcaaaaagcaca

SEQ ID NO: 773195 - DNA, 25 bp, Mus musculus
tccatggtatgtggcaaaaagcaca

SEQ ID NO: 773196 - DNA, 25 bp, Mus musculus
tccatggtcactagtctggaaaaga

SEQ ID NO: 773197 - DNA, 25 bp, Mus musculus
tccatggtcacttgtctggaaaaga

SEQ ID NO: 773198 - DNA, 25 bp, Mus musculus
tccatggtctctaagctgccagtgc

SEQ ID NO: 773199 - DNA, 25 bp, Mus musculus
tccatggtctcttagctgccagtgc

SEQ ID NO: 773200 - DNA, 25 bp, Mus musculus
tccatggtgagactgagtacggcaa

SEQ ID NO: 773201 - DNA, 25 bp, Mus musculus
tccatggtgagagtgagtacggcaa

SEQ ID NO: 773202 - DNA, 25 bp, Mus musculus
tccatggtgcatctcaacagcaatg

SEQ ID NO: 773203 - DNA, 25 bp, Mus musculus
tccatggtgcatgtcaacagcaatg

SEQ ID NO: 773204 - DNA, 25 bp, Mus musculus
tccatggtgggtctacttcgacaca

SEQ ID NO: 773205 - DNA, 25 bp, Mus musculus
tccatggtgggtgtacttcgacaca

SEQ ID NO: 773206 - DNA, 25 bp, Mus musculus
tccatggtgtaaagggcaaagatga

SEQ ID NO: 773207 - DNA, 25 bp, Mus musculus
tccatggtgtaatgggcaaagatga

SEQ ID NO: 773208 - DNA, 25 bp, Mus musculus
tccatggtgtttaaggacgtgctgc

SEQ ID NO: 773209 - DNA, 25 bp, Mus musculus
tccatggtgttttaggacgtgctgc

SEQ ID NO: 773210 - DNA, 25 bp, Mus musculus
tccatggtttctcagtgtctgttct

SEQ ID NO: 773211 - DNA, 25 bp, Mus musculus
tccatggtttctgagtgtctgttct

SEQ ID NO: 773212 - DNA, 25 bp, Mus musculus
tccatgtaaaagcaggcgaatgggc

SEQ ID NO: 773213 - DNA, 25 bp, Mus musculus
tccatgtaaaaggaggcgaatgggc

SEQ ID NO: 773214 - DNA, 25 bp, Mus musculus
tccatgtaagtcagaccagtcaaag

SEQ ID NO: 773215 - DNA, 25 bp, Mus musculus
tccatgtaagtctgaccagtcaaag

SEQ ID NO: 773216 - DNA, 25 bp, Mus musculus
tccatgtaccttcaaacctctgacg

SEQ ID NO: 773217 - DNA, 25 bp, Mus musculus
tccatgtaccttgaaacctctgacg

SEQ ID NO: 773218 - DNA, 25 bp, Mus musculus
tccatgtatggacgcaccattatac

SEQ ID NO: 773219 - DNA, 25 bp, Mus musculus
tccatgtatggaggcaccattatac

SEQ ID NO: 773220 - DNA, 25 bp, Mus musculus
tccatgtcaacaagatctccatgtc

SEQ ID NO: 773221 - DNA, 25 bp, Mus musculus
tccatgtcaacatgatctccatgtc

SEQ ID NO: 773222 - DNA, 25 bp, Mus musculus
tccatgtcaactcgttccggaagga

SEQ ID NO: 773223 - DNA, 25 bp, Mus musculus
tccatgtcaactggttccggaagga

SEQ ID NO: 773224 - DNA, 25 bp, Mus musculus
tccatgtcaatgagtctcctagatc

SEQ ID NO: 773225 - DNA, 25 bp, Mus musculus
tccatgtcaatgtgtctcctagatc

SEQ ID NO: 773226 - DNA, 25 bp, Mus musculus
tccatgtcatccctggaagatttga

SEQ ID NO: 773227 - DNA, 25 bp, Mus musculus
tccatgtcatccgtggaagatttga

SEQ ID NO: 773228 - DNA, 25 bp, Mus musculus
tccatgtcgcacatccgtttgttct

SEQ ID NO: 773229 - DNA, 25 bp, Mus musculus
tccatgtcgcacttccgtttgttct

SEQ ID NO: 773230 - DNA, 25 bp, Mus musculus
tccatgtcggaaagcaagggaaatg

SEQ ID NO: 773231 - DNA, 25 bp, Mus musculus
tccatgtcggaatgcaagggaaatg

SEQ ID NO: 773232 - DNA, 25 bp, Mus musculus
tccatgtctcaactgaagaatgtgg

SEQ ID NO: 773233 - DNA, 25 bp, Mus musculus
tccatgtctcaagtgaagaatgtgg

SEQ ID NO: 773234 - DNA, 25 bp, Mus musculus
tccatgtctcctctaggtcagcgag

SEQ ID NO: 773235 - DNA, 25 bp, Mus musculus
tccatgtctcctgtaggtcagcgag

SEQ ID NO: 773236 - DNA, 25 bp, Mus musculus
tccatgtctgccaaccaggccttgt

SEQ ID NO: 773237 - DNA, 25 bp, Mus musculus
tccatgtctgcctaccaggccttgt

SEQ ID NO: 773238 - DNA, 25 bp, Mus musculus
tccatgtgaaagatgataggctaaa

SEQ ID NO: 773239 - DNA, 25 bp, Mus musculus
tccatgtgaaagttgataggctaaa

SEQ ID NO: 773240 - DNA, 25 bp, Mus musculus
tccatgtgacggaaccccgcggagc

SEQ ID NO: 773241 - DNA, 25 bp, Mus musculus
tccatgtgacggtaccccgcggagc

SEQ ID NO: 773242 - DNA, 25 bp, Mus musculus
tccatgtggacacgcaagagctcag

SEQ ID NO: 773243 - DNA, 25 bp, Mus musculus
tccatgtggacaggcaagagctcag

SEQ ID NO: 773244 - DNA, 25 bp, Mus musculus
tccatgtggaggaagagtgcttgct

SEQ ID NO: 773245 - DNA, 25 bp, Mus musculus
tccatgtggaggtagagtgcttgct

SEQ ID NO: 773246 - DNA, 25 bp, Mus musculus
tccatgtggtgtacgatattaaccg

SEQ ID NO: 773247 - DNA, 25 bp, Mus musculus
tccatgtggtgttcgatattaaccg

SEQ ID NO: 773248 - DNA, 25 bp, Mus musculus
tccatgtggttcaccttcccactgg

SEQ ID NO: 773249 - DNA, 25 bp, Mus musculus
tccatgtggttctccttcccactgg

SEQ ID NO: 773250 - DNA, 25 bp, Mus musculus
tccatgtgtcctaccaaaagtactt

SEQ ID NO: 773251 - DNA, 25 bp, Mus musculus
tccatgtgtccttccaaaagtactt

SEQ ID NO: 773252 - DNA, 25 bp, Mus musculus
tccatgtgtgcacgaggacctctaa

SEQ ID NO: 773253 - DNA, 25 bp, Mus musculus
tccatgtgtgcaggaggacctctaa

SEQ ID NO: 773254 - DNA, 25 bp, Mus musculus
tccatgttaaaacgattggtctgcc

SEQ ID NO: 773255 - DNA, 25 bp, Mus musculus
tccatgttaaaaggattggtctgcc

SEQ ID NO: 773256 - DNA, 25 bp, Mus musculus
tccatgttcactatgctgtatctgg

SEQ ID NO: 773257 - DNA, 25 bp, Mus musculus
tccatgttcactttgctgtatctgg

SEQ ID NO: 773258 - DNA, 25 bp, Mus musculus
tccatgttcagtaccaaggagtctc

SEQ ID NO: 773259 - DNA, 25 bp, Mus musculus
tccatgttcagttccaaggagtctc

SEQ ID NO: 773260 - DNA, 25 bp, Mus musculus
tccatgttccccaccctggaaatag

SEQ ID NO: 773261 - DNA, 25 bp, Mus musculus
tccatgttcccctccctggaaatag

SEQ ID NO: 773262 - DNA, 25 bp, Mus musculus
tccatgttgcacagcgagggtcgtc

SEQ ID NO: 773263 - DNA, 25 bp, Mus musculus
tccatgttgcactgcgagggtcgtc

SEQ ID NO: 773264 - DNA, 25 bp, Mus musculus
tccatgtttcacaatcggcatctct

SEQ ID NO: 773265 - DNA, 25 bp, Mus musculus
tccatgtttcactatcggcatctct

SEQ ID NO: 773266 - DNA, 25 bp, Mus musculus
tccatgtttggcagttggttttagt

SEQ ID NO: 773267 - DNA, 25 bp, Mus musculus
tccatgtttggctgttggttttagt

SEQ ID NO: 773268 - DNA, 25 bp, Mus musculus
tccattaaagccattgccctggcca

SEQ ID NO: 773269 - DNA, 25 bp, Mus musculus
tccattaaagcctttgccctggcca

SEQ ID NO: 773270 - DNA, 25 bp, Mus musculus
tccattaattgacgaaagctcccag

SEQ ID NO: 773271 - DNA, 25 bp, Mus musculus
tccattaattgaggaaagctcccag

SEQ ID NO: 773272 - DNA, 25 bp, Mus musculus
tccattacaacccagcccagtatga

SEQ ID NO: 773273 - DNA, 25 bp, Mus musculus
tccattacaaccgagcccagtatga

SEQ ID NO: 773274 - DNA, 25 bp, Mus musculus
tccattacctgtcgcgcggagagtt

SEQ ID NO: 773275 - DNA, 25 bp, Mus musculus
tccattacctgtggcgcggagagtt

SEQ ID NO: 773276 - DNA, 25 bp, Mus musculus
tccattacgggcagactgtcaagct

SEQ ID NO: 773277 - DNA, 25 bp, Mus musculus
tccattacgggctgactgtcaagct

SEQ ID NO: 773278 - DNA, 25 bp, Mus musculus
tccattagagcgctaatcaagagat

SEQ ID NO: 773279 - DNA, 25 bp, Mus musculus
tccattagagcggtaatcaagagat

SEQ ID NO: 773280 - DNA, 25 bp, Mus musculus
tccattagctttccgggcctttcca

SEQ ID NO: 773281 - DNA, 25 bp, Mus musculus
tccattagctttgcgggcctttcca

SEQ ID NO: 773282 - DNA, 25 bp, Mus musculus
tccattatcaccaaaacaaaaaact

SEQ ID NO: 773283 - DNA, 25 bp, Mus musculus
tccattatcacctaaacaaaaaact

SEQ ID NO: 773284 - DNA, 25 bp, Mus musculus
tccattatgatgagctgaagcccta

SEQ ID NO: 773285 - DNA, 25 bp, Mus musculus
tccattatgatgtgctgaagcccta

SEQ ID NO: 773286 - DNA, 25 bp, Mus musculus
tccattatgggacagtggagccaca

SEQ ID NO: 773287 - DNA, 25 bp, Mus musculus
tccattatgggagagtggagccaca

SEQ ID NO: 773288 - DNA, 25 bp, Mus musculus
tccattatttgacacccaccgacgt

SEQ ID NO: 773289 - DNA, 25 bp, Mus musculus
tccattatttgagacccaccgacgt

SEQ ID NO: 773290 - DNA, 25 bp, Mus musculus
tccattcagaggctacagtgacccc

SEQ ID NO: 773291 - DNA, 25 bp, Mus musculus
tccattcagagggtacagtgacccc

SEQ ID NO: 773292 - DNA, 25 bp, Mus musculus
tccattcaggaaaacatacgacagc

SEQ ID NO: 773293 - DNA, 25 bp, Mus musculus
tccattcaggaatacatacgacagc

SEQ ID NO: 773294 - DNA, 25 bp, Mus musculus
tccattccaaagaaaagcccttcaa

SEQ ID NO: 773295 - DNA, 25 bp, Mus musculus
tccattccaaagtaaagcccttcaa

SEQ ID NO: 773296 - DNA, 25 bp, Mus musculus
tccattccaggcatggaagagggag

SEQ ID NO: 773297 - DNA, 25 bp, Mus musculus
tccattccaggcttggaagagggag

SEQ ID NO: 773298 - DNA, 25 bp, Mus musculus
tccattccagggactgaaccccaaa

SEQ ID NO: 773299 - DNA, 25 bp, Mus musculus
tccattccagggtctgaaccccaaa

SEQ ID NO: 773300 - DNA, 25 bp, Mus musculus
tccattcccagtagaaagaacagag

SEQ ID NO: 773301 - DNA, 25 bp, Mus musculus
tccattcccagttgaaagaacagag

SEQ ID NO: 773302 - DNA, 25 bp, Mus musculus
tccattccgtggaagacagacacaa

SEQ ID NO: 773303 - DNA, 25 bp, Mus musculus
tccattccgtggtagacagacacaa

SEQ ID NO: 773304 - DNA, 25 bp, Mus musculus
tccattcctatgacctcaggaactc

SEQ ID NO: 773305 - DNA, 25 bp, Mus musculus
tccattcctatgtcctcaggaactc

SEQ ID NO: 773306 - DNA, 25 bp, Mus musculus
tccattctacagatctgcgacctga

SEQ ID NO: 773307 - DNA, 25 bp, Mus musculus
tccattctacagttctgcgacctga

SEQ ID NO: 773308 - DNA, 25 bp, Mus musculus
tccattcttcggcatcatcctgaaa

SEQ ID NO: 773309 - DNA, 25 bp, Mus musculus
tccattcttcgggatcatcctgaaa

SEQ ID NO: 773310 - DNA, 25 bp, Mus musculus
tccattgaactcagtagagcagact

SEQ ID NO: 773311 - DNA, 25 bp, Mus musculus
tccattgaactctgtagagcagact

SEQ ID NO: 773312 - DNA, 25 bp, Mus musculus
tccattgaccgcatcgacagggaga

SEQ ID NO: 773313 - DNA, 25 bp, Mus musculus
tccattgaccgcttcgacagggaga

SEQ ID NO: 773314 - DNA, 25 bp, Mus musculus
tccattgacggtcgcccagaaaaaa

SEQ ID NO: 773315 - DNA, 25 bp, Mus musculus
tccattgacggtggcccagaaaaaa

SEQ ID NO: 773316 - DNA, 25 bp, Mus musculus
tccattgagggtcgcccgcaggtct

SEQ ID NO: 773317 - DNA, 25 bp, Mus musculus
tccattgagggtggcccgcaggtct

SEQ ID NO: 773318 - DNA, 25 bp, Mus musculus
tccattgagtcgcaatgaagttgtc

SEQ ID NO: 773319 - DNA, 25 bp, Mus musculus
tccattgagtcggaatgaagttgtc

SEQ ID NO: 773320 - DNA, 25 bp, Mus musculus
tccattgatataaactgcgaagtct

SEQ ID NO: 773321 - DNA, 25 bp, Mus musculus
tccattgatatatactgcgaagtct

SEQ ID NO: 773322 - DNA, 25 bp, Mus musculus
tccattgcacaactgaattctaaat

SEQ ID NO: 773323 - DNA, 25 bp, Mus musculus
tccattgcacaagtgaattctaaat

SEQ ID NO: 773324 - DNA, 25 bp, Mus musculus
tccattgcagtgacgaagagcgata

SEQ ID NO: 773325 - DNA, 25 bp, Mus musculus
tccattgcagtgtcgaagagcgata

SEQ ID NO: 773326 - DNA, 25 bp, Mus musculus
tccattggcactctcctggcttact

SEQ ID NO: 773327 - DNA, 25 bp, Mus musculus
tccattggcactgtcctggcttact

SEQ ID NO: 773328 - DNA, 25 bp, Mus musculus
tccattggccctcacttccagaagg

SEQ ID NO: 773329 - DNA, 25 bp, Mus musculus
tccattggccctgacttccagaagg

SEQ ID NO: 773330 - DNA, 25 bp, Mus musculus
tccattggcgtcctggacatctttg

SEQ ID NO: 773331 - DNA, 25 bp, Mus musculus
tccattggcgtcgtggacatctttg

SEQ ID NO: 773332 - DNA, 25 bp, Mus musculus
tccattgggatgctcatgctgtccg

SEQ ID NO: 773333 - DNA, 25 bp, Mus musculus
tccattgggatggtcatgctgtccg

SEQ ID NO: 773334 - DNA, 25 bp, Mus musculus
tccattgggcagctacaccaaggct

SEQ ID NO: 773335 - DNA, 25 bp, Mus musculus
tccattgggcaggtacaccaaggct

SEQ ID NO: 773336 - DNA, 25 bp, Mus musculus
tccattggtcaaaaaggttgaagag

SEQ ID NO: 773337 - DNA, 25 bp, Mus musculus
tccattggtcaataaggttgaagag

SEQ ID NO: 773338 - DNA, 25 bp, Mus musculus
tccattgtgcataaggtgtgagccc

SEQ ID NO: 773339 - DNA, 25 bp, Mus musculus
tccattgtgcattaggtgtgagccc

SEQ ID NO: 773340 - DNA, 25 bp, Mus musculus
tccatttaacccagtgactgtgagg

SEQ ID NO: 773341 - DNA, 25 bp, Mus musculus
tccatttaaccctgtgactgtgagg

SEQ ID NO: 773342 - DNA, 25 bp, Mus musculus
tccatttcaagacatactttccggg

SEQ ID NO: 773343 - DNA, 25 bp, Mus musculus
tccatttcaagagatactttccggg

SEQ ID NO: 773344 - DNA, 25 bp, Mus musculus
tccatttcccagagaatcaacctct

SEQ ID NO: 773345 - DNA, 25 bp, Mus musculus
tccatttcccagtgaatcaacctct

SEQ ID NO: 773346 - DNA, 25 bp, Mus musculus
tccatttgaacacccggtttccagg

SEQ ID NO: 773347 - DNA, 25 bp, Mus musculus
tccatttgaacagccggtttccagg

SEQ ID NO: 773348 - DNA, 25 bp, Mus musculus
tccatttgacctcttataaaaaagt

SEQ ID NO: 773349 - DNA, 25 bp, Mus musculus
tccatttgacctgttataaaaaagt

SEQ ID NO: 773350 - DNA, 25 bp, Mus musculus
tccatttgagcccaccaagaagcca

SEQ ID NO: 773351 - DNA, 25 bp, Mus musculus
tccatttgagccgaccaagaagcca

SEQ ID NO: 773352 - DNA, 25 bp, Mus musculus
tccatttgcactacagggattgcaa

SEQ ID NO: 773353 - DNA, 25 bp, Mus musculus
tccatttgcacttcagggattgcaa

SEQ ID NO: 773354 - DNA, 25 bp, Mus musculus
tccatttgggatcacataaacaatg

SEQ ID NO: 773355 - DNA, 25 bp, Mus musculus
tccatttgggatgacataaacaatg

SEQ ID NO: 773356 - DNA, 25 bp, Mus musculus
tccattttcttgcagaacagtacct

SEQ ID NO: 773357 - DNA, 25 bp, Mus musculus
tccattttcttggagaacagtacct

SEQ ID NO: 773358 - DNA, 25 bp, Mus musculus
tccattttgacactgccagcagaag

SEQ ID NO: 773359 - DNA, 25 bp, Mus musculus
tccattttgacagtgccagcagaag

SEQ ID NO: 773360 - DNA, 25 bp, Mus musculus
tcccaaaacaggactctcagctcgg

SEQ ID NO: 773361 - DNA, 25 bp, Mus musculus
tcccaaaacaggtctctcagctcgg

SEQ ID NO: 773362 - DNA, 25 bp, Mus musculus
tcccaaaccaacagcctggaatgga

SEQ ID NO: 773363 - DNA, 25 bp, Mus musculus
tcccaaaccaactgcctggaatgga

SEQ ID NO: 773364 - DNA, 25 bp, Mus musculus
tcccaaacgggcaggaagagcagcg

SEQ ID NO: 773365 - DNA, 25 bp, Mus musculus
tcccaaacgggctggaagagcagcg

SEQ ID NO: 773366 - DNA, 25 bp, Mus musculus
tcccaaagagatattcacctttgaa

SEQ ID NO: 773367 - DNA, 25 bp, Mus musculus
tcccaaagagattttcacctttgaa

SEQ ID NO: 773368 - DNA, 25 bp, Mus musculus
tcccaaagagctcatcttagccggc

SEQ ID NO: 773369 - DNA, 25 bp, Mus musculus
tcccaaagagctgatcttagccggc

SEQ ID NO: 773370 - DNA, 25 bp, Mus musculus
tcccaaagaggtcggagacgtgatc

SEQ ID NO: 773371 - DNA, 25 bp, Mus musculus
tcccaaagaggtgggagacgtgatc

SEQ ID NO: 773372 - DNA, 25 bp, Mus musculus
tcccaaagatagagtacctggacct

SEQ ID NO: 773373 - DNA, 25 bp, Mus musculus
tcccaaagatagtgtacctggacct

SEQ ID NO: 773374 - DNA, 25 bp, Mus musculus
tcccaaagatcaactgaagaaggct

SEQ ID NO: 773375 - DNA, 25 bp, Mus musculus
tcccaaagatcatctgaagaaggct

SEQ ID NO: 773376 - DNA, 25 bp, Mus musculus
tcccaaaggaggaagctcagcccac

SEQ ID NO: 773377 - DNA, 25 bp, Mus musculus
tcccaaaggaggtagctcagcccac

SEQ ID NO: 773378 - DNA, 25 bp, Mus musculus
tcccaaagggacaggactgatcctc

SEQ ID NO: 773379 - DNA, 25 bp, Mus musculus
tcccaaagggactggactgatcctc

SEQ ID NO: 773380 - DNA, 25 bp, Mus musculus
tcccaaagtccaactcagtaagcag

SEQ ID NO: 773381 - DNA, 25 bp, Mus musculus
tcccaaagtccatctcagtaagcag

SEQ ID NO: 773382 - DNA, 25 bp, Mus musculus
tcccaaagtgacagaagtagccgag

SEQ ID NO: 773383 - DNA, 25 bp, Mus musculus
tcccaaagtgactgaagtagccgag

SEQ ID NO: 773384 - DNA, 25 bp, Mus musculus
tcccaaagtttcctttacaggcgag

SEQ ID NO: 773385 - DNA, 25 bp, Mus musculus
tcccaaagtttcgtttacaggcgag

SEQ ID NO: 773386 - DNA, 25 bp, Mus musculus
tcccaaatgaccagtgtgtaaaagt

SEQ ID NO: 773387 - DNA, 25 bp, Mus musculus
tcccaaatgacctgtgtgtaaaagt

SEQ ID NO: 773388 - DNA, 25 bp, Mus musculus
tcccaaatgtgacattgcaaccaga

SEQ ID NO: 773389 - DNA, 25 bp, Mus musculus
tcccaaatgtgagattgcaaccaga

SEQ ID NO: 773390 - DNA, 25 bp, Mus musculus
tcccaaatgtgtactgtctggacca

SEQ ID NO: 773391 - DNA, 25 bp, Mus musculus
tcccaaatgtgttctgtctggacca

SEQ ID NO: 773392 - DNA, 25 bp, Mus musculus
tcccaaattccacagagcgtgctgt

SEQ ID NO: 773393 - DNA, 25 bp, Mus musculus
tcccaaattccagagagcgtgctgt

SEQ ID NO: 773394 - DNA, 25 bp, Mus musculus
tcccaaattccccaggaggcgtggc

SEQ ID NO: 773395 - DNA, 25 bp, Mus musculus
tcccaaattcccgaggaggcgtggc

SEQ ID NO: 773396 - DNA, 25 bp, Mus musculus
tcccaacacgcaatttgtgtcacag

SEQ ID NO: 773397 - DNA, 25 bp, Mus musculus
tcccaacacgcattttgtgtcacag

SEQ ID NO: 773398 - DNA, 25 bp, Mus musculus
tcccaacatgaccagtaacaggcgg

SEQ ID NO: 773399 - DNA, 25 bp, Mus musculus
tcccaacatgacgagtaacaggcgg

SEQ ID NO: 773400 - DNA, 25 bp, Mus musculus
tcccaaccaacaagagctcaaggag

SEQ ID NO: 773401 - DNA, 25 bp, Mus musculus
tcccaaccaacatgagctcaaggag

SEQ ID NO: 773402 - DNA, 25 bp, Mus musculus
tcccaaccagaacaaaaacatggct

SEQ ID NO: 773403 - DNA, 25 bp, Mus musculus
tcccaaccagaagaaaaacatggct

SEQ ID NO: 773404 - DNA, 25 bp, Mus musculus
tcccaacccggaccggttccttgtg

SEQ ID NO: 773405 - DNA, 25 bp, Mus musculus
tcccaacccggagcggttccttgtg

SEQ ID NO: 773406 - DNA, 25 bp, Mus musculus
tcccaacgatatccccgagggagat

SEQ ID NO: 773407 - DNA, 25 bp, Mus musculus
tcccaacgatatgcccgagggagat

SEQ ID NO: 773408 - DNA, 25 bp, Mus musculus
tcccaacggaatcaggatctttttc

SEQ ID NO: 773409 - DNA, 25 bp, Mus musculus
tcccaacggaatgaggatctttttc

SEQ ID NO: 773410 - DNA, 25 bp, Mus musculus
tcccaacgttgcagtggtagcaggc

SEQ ID NO: 773411 - DNA, 25 bp, Mus musculus
tcccaacgttgctgtggtagcaggc

SEQ ID NO: 773412 - DNA, 25 bp, Mus musculus
tcccaactactacaaaggaaagtgt

SEQ ID NO: 773413 - DNA, 25 bp, Mus musculus
tcccaactactagaaaggaaagtgt

SEQ ID NO: 773414 - DNA, 25 bp, Mus musculus
tcccaactcggcagttccttttgat

SEQ ID NO: 773415 - DNA, 25 bp, Mus musculus
tcccaactcggctgttccttttgat

SEQ ID NO: 773416 - DNA, 25 bp, Mus musculus
tcccaactgggtcgtgctcaatcag

SEQ ID NO: 773417 - DNA, 25 bp, Mus musculus
tcccaactgggtggtgctcaatcag

SEQ ID NO: 773418 - DNA, 25 bp, Mus musculus
tcccaactggtacgcgcggccagat

SEQ ID NO: 773419 - DNA, 25 bp, Mus musculus
tcccaactggtaggcgcggccagat

SEQ ID NO: 773420 - DNA, 25 bp, Mus musculus
tcccaacttcctactaggagtggaa

SEQ ID NO: 773421 - DNA, 25 bp, Mus musculus
tcccaacttccttctaggagtggaa

SEQ ID NO: 773422 - DNA, 25 bp, Mus musculus
tcccaagaaatgatttgaaggtgaa

SEQ ID NO: 773423 - DNA, 25 bp, Mus musculus
tcccaagaaatgttttgaaggtgaa

SEQ ID NO: 773424 - DNA, 25 bp, Mus musculus
tcccaagaatctagcagaacagttg

SEQ ID NO: 773425 - DNA, 25 bp, Mus musculus
tcccaagaatcttgcagaacagttg

SEQ ID NO: 773426 - DNA, 25 bp, Mus musculus
tcccaagacaaacctgtgggctctt

SEQ ID NO: 773427 - DNA, 25 bp, Mus musculus
tcccaagacaaagctgtgggctctt

SEQ ID NO: 773428 - DNA, 25 bp, Mus musculus
tcccaagacaagagctgaaccctat

SEQ ID NO: 773429 - DNA, 25 bp, Mus musculus
tcccaagacaagtgctgaaccctat

SEQ ID NO: 773430 - DNA, 25 bp, Mus musculus
tcccaagaccacattccgctggctg

SEQ ID NO: 773431 - DNA, 25 bp, Mus musculus
tcccaagaccactttccgctggctg

SEQ ID NO: 773432 - DNA, 25 bp, Mus musculus
tcccaagagaagctaccagacagat

SEQ ID NO: 773433 - DNA, 25 bp, Mus musculus
tcccaagagaaggtaccagacagat

SEQ ID NO: 773434 - DNA, 25 bp, Mus musculus
tcccaagagcaacgatggcaacagc

SEQ ID NO: 773435 - DNA, 25 bp, Mus musculus
tcccaagagcaaggatggcaacagc

SEQ ID NO: 773436 - DNA, 25 bp, Mus musculus
tcccaagaggagctgcgcattgtag

SEQ ID NO: 773437 - DNA, 25 bp, Mus musculus
tcccaagaggaggtgcgcattgtag

SEQ ID NO: 773438 - DNA, 25 bp, Mus musculus
tcccaagagggacaagttagttgca

SEQ ID NO: 773439 - DNA, 25 bp, Mus musculus
tcccaagagggagaagttagttgca

SEQ ID NO: 773440 - DNA, 25 bp, Mus musculus
tcccaagagtctctcatcctgggag

SEQ ID NO: 773441 - DNA, 25 bp, Mus musculus
tcccaagagtctgtcatcctgggag

SEQ ID NO: 773442 - DNA, 25 bp, Mus musculus
tcccaagatgcacctagaggacagg

SEQ ID NO: 773443 - DNA, 25 bp, Mus musculus
tcccaagatgcagctagaggacagg

SEQ ID NO: 773444 - DNA, 25 bp, Mus musculus
tcccaagatttactggacacagctg

SEQ ID NO: 773445 - DNA, 25 bp, Mus musculus
tcccaagatttagtggacacagctg

SEQ ID NO: 773446 - DNA, 25 bp, Mus musculus
tcccaagcaaagataggcccttcct

SEQ ID NO: 773447 - DNA, 25 bp, Mus musculus
tcccaagcaaagttaggcccttcct

SEQ ID NO: 773448 - DNA, 25 bp, Mus musculus
tcccaagcacgcaaggccatgattg

SEQ ID NO: 773449 - DNA, 25 bp, Mus musculus
tcccaagcacgctaggccatgattg

SEQ ID NO: 773450 - DNA, 25 bp, Mus musculus
tcccaagcgtgacgtgatggatttg

SEQ ID NO: 773451 - DNA, 25 bp, Mus musculus
tcccaagcgtgaggtgatggatttg

SEQ ID NO: 773452 - DNA, 25 bp, Mus musculus
tcccaagctaccagtgaaactcacg

SEQ ID NO: 773453 - DNA, 25 bp, Mus musculus
tcccaagctacctgtgaaactcacg

SEQ ID NO: 773454 - DNA, 25 bp, Mus musculus
tcccaagctatcaggccaacggtgg

SEQ ID NO: 773455 - DNA, 25 bp, Mus musculus
tcccaagctatctggccaacggtgg

SEQ ID NO: 773456 - DNA, 25 bp, Mus musculus
tcccaagctatgctgatgttatcca

SEQ ID NO: 773457 - DNA, 25 bp, Mus musculus
tcccaagctatggtgatgttatcca

SEQ ID NO: 773458 - DNA, 25 bp, Mus musculus
tcccaagctgagaaagtatacatca

SEQ ID NO: 773459 - DNA, 25 bp, Mus musculus
tcccaagctgagtaagtatacatca

SEQ ID NO: 773460 - DNA, 25 bp, Mus musculus
tcccaaggacctcccgatgttcagt

SEQ ID NO: 773461 - DNA, 25 bp, Mus musculus
tcccaaggacctgccgatgttcagt

SEQ ID NO: 773462 - DNA, 25 bp, Mus musculus
tcccaaggctggcagatcctggacc

SEQ ID NO: 773463 - DNA, 25 bp, Mus musculus
tcccaaggctgggagatcctggacc

SEQ ID NO: 773464 - DNA, 25 bp, Mus musculus
tcccaaggctttcacgcaggtgcta

SEQ ID NO: 773465 - DNA, 25 bp, Mus musculus
tcccaaggctttgacgcaggtgcta

SEQ ID NO: 773466 - DNA, 25 bp, Mus musculus
tcccaaggtgctaggctgaggccag

SEQ ID NO: 773467 - DNA, 25 bp, Mus musculus
tcccaaggtgcttggctgaggccag

SEQ ID NO: 773468 - DNA, 25 bp, Mus musculus
tcccaagtacttaaagggaccatct

SEQ ID NO: 773469 - DNA, 25 bp, Mus musculus
tcccaagtactttaagggaccatct

SEQ ID NO: 773470 - DNA, 25 bp, Mus musculus
tcccaagtcggacccaatgtgcagt

SEQ ID NO: 773471 - DNA, 25 bp, Mus musculus
tcccaagtcggagccaatgtgcagt

SEQ ID NO: 773472 - DNA, 25 bp, Mus musculus
tcccaatacttcacaaccaagggtg

SEQ ID NO: 773473 - DNA, 25 bp, Mus musculus
tcccaatacttctcaaccaagggtg

SEQ ID NO: 773474 - DNA, 25 bp, Mus musculus
tcccaatccagtcccgtctgtgcct

SEQ ID NO: 773475 - DNA, 25 bp, Mus musculus
tcccaatccagtgccgtctgtgcct

SEQ ID NO: 773476 - DNA, 25 bp, Mus musculus
tcccaatgaagaaccgaaatgtcag

SEQ ID NO: 773477 - DNA, 25 bp, Mus musculus
tcccaatgaagatccgaaatgtcag

SEQ ID NO: 773478 - DNA, 25 bp, Mus musculus
tcccaatgccaacggctggatggac

SEQ ID NO: 773479 - DNA, 25 bp, Mus musculus
tcccaatgccaagggctggatggac

SEQ ID NO: 773480 - DNA, 25 bp, Mus musculus
tcccaatgggctactggtctaccag

SEQ ID NO: 773481 - DNA, 25 bp, Mus musculus
tcccaatgggcttctggtctaccag

SEQ ID NO: 773482 - DNA, 25 bp, Mus musculus
tcccaattatggacaccggtgaaaa

SEQ ID NO: 773483 - DNA, 25 bp, Mus musculus
tcccaattatggtcaccggtgaaaa

SEQ ID NO: 773484 - DNA, 25 bp, Mus musculus
tcccaattggttaccgcgcgcgcga

SEQ ID NO: 773485 - DNA, 25 bp, Mus musculus
tcccaattggtttccgcgcgcgcga

SEQ ID NO: 773486 - DNA, 25 bp, Mus musculus
tcccaattgttgctgcagcctccat

SEQ ID NO: 773487 - DNA, 25 bp, Mus musculus
tcccaattgttggtgcagcctccat

SEQ ID NO: 773488 - DNA, 25 bp, Mus musculus
tcccaattttggctatactcctgtt

SEQ ID NO: 773489 - DNA, 25 bp, Mus musculus
tcccaattttgggtatactcctgtt

SEQ ID NO: 773490 - DNA, 25 bp, Mus musculus
tcccacaaagagagtgaagaggctc

SEQ ID NO: 773491 - DNA, 25 bp, Mus musculus
tcccacaaagagtgtgaagaggctc

SEQ ID NO: 773492 - DNA, 25 bp, Mus musculus
tcccacaaatctaccagtatgatgc

SEQ ID NO: 773493 - DNA, 25 bp, Mus musculus
tcccacaaatcttccagtatgatgc

SEQ ID NO: 773494 - DNA, 25 bp, Mus musculus
tcccacacgatgaacaagaactcat

SEQ ID NO: 773495 - DNA, 25 bp, Mus musculus
tcccacacgatgtacaagaactcat

SEQ ID NO: 773496 - DNA, 25 bp, Mus musculus
tcccacacggtgcaattattgccac

SEQ ID NO: 773497 - DNA, 25 bp, Mus musculus
tcccacacggtggaattattgccac

SEQ ID NO: 773498 - DNA, 25 bp, Mus musculus
tcccacagacctaccagctagggaa

SEQ ID NO: 773499 - DNA, 25 bp, Mus musculus
tcccacagaccttccagctagggaa

SEQ ID NO: 773500 - DNA, 25 bp, Mus musculus
tcccacagaggcagattgaagagat

SEQ ID NO: 773501 - DNA, 25 bp, Mus musculus
tcccacagaggctgattgaagagat

SEQ ID NO: 773502 - DNA, 25 bp, Mus musculus
tcccacagatatcgtagaggcctag

SEQ ID NO: 773503 - DNA, 25 bp, Mus musculus
tcccacagatatggtagaggcctag

SEQ ID NO: 773504 - DNA, 25 bp, Mus musculus
tcccacagcggcaacgtttgaaacg

SEQ ID NO: 773505 - DNA, 25 bp, Mus musculus
tcccacagcggctacgtttgaaacg

SEQ ID NO: 773506 - DNA, 25 bp, Mus musculus
tcccacagctggcaaagctttggag

SEQ ID NO: 773507 - DNA, 25 bp, Mus musculus
tcccacagctgggaaagctttggag

SEQ ID NO: 773508 - DNA, 25 bp, Mus musculus
tcccacagtgtgctttcaccggctg

SEQ ID NO: 773509 - DNA, 25 bp, Mus musculus
tcccacagtgtggtttcaccggctg

SEQ ID NO: 773510 - DNA, 25 bp, Mus musculus
tcccacatcacgactagcattcagg

SEQ ID NO: 773511 - DNA, 25 bp, Mus musculus
tcccacatcacgtctagcattcagg

SEQ ID NO: 773512 - DNA, 25 bp, Mus musculus
tcccacatccgtcgccagagggaag

SEQ ID NO: 773513 - DNA, 25 bp, Mus musculus
tcccacatccgtggccagagggaag

SEQ ID NO: 773514 - DNA, 25 bp, Mus musculus
tcccacatggagctgtcccgtctgg

SEQ ID NO: 773515 - DNA, 25 bp, Mus musculus
tcccacatggaggtgtcccgtctgg

SEQ ID NO: 773516 - DNA, 25 bp, Mus musculus
tcccacattaggagatgcacgtgtt

SEQ ID NO: 773517 - DNA, 25 bp, Mus musculus
tcccacattaggtgatgcacgtgtt

SEQ ID NO: 773518 - DNA, 25 bp, Mus musculus
tcccaccacgggatggcttctctgg

SEQ ID NO: 773519 - DNA, 25 bp, Mus musculus
tcccaccacgggttggcttctctgg

SEQ ID NO: 773520 - DNA, 25 bp, Mus musculus
tcccaccagaatcgatgaccagatt

SEQ ID NO: 773521 - DNA, 25 bp, Mus musculus
tcccaccagaatggatgaccagatt

SEQ ID NO: 773522 - DNA, 25 bp, Mus musculus
tcccaccatcagaatcccagcagga

SEQ ID NO: 773523 - DNA, 25 bp, Mus musculus
tcccaccatcagtatcccagcagga

SEQ ID NO: 773524 - DNA, 25 bp, Mus musculus
tcccacccttttatggctggagcag

SEQ ID NO: 773525 - DNA, 25 bp, Mus musculus
tcccacccttttttggctggagcag

SEQ ID NO: 773526 - DNA, 25 bp, Mus musculus
tcccaccgaagtagcgtctcttcag

SEQ ID NO: 773527 - DNA, 25 bp, Mus musculus
tcccaccgaagttgcgtctcttcag

SEQ ID NO: 773528 - DNA, 25 bp, Mus musculus
tcccaccgctccatagctgtgaaag

SEQ ID NO: 773529 - DNA, 25 bp, Mus musculus
tcccaccgctccttagctgtgaaag

SEQ ID NO: 773530 - DNA, 25 bp, Mus musculus
tcccaccgtgaacctggaaaatggc

SEQ ID NO: 773531 - DNA, 25 bp, Mus musculus
tcccaccgtgaagctggaaaatggc

SEQ ID NO: 773532 - DNA, 25 bp, Mus musculus
tcccaccgtggacgtcctcagattg

SEQ ID NO: 773533 - DNA, 25 bp, Mus musculus
tcccaccgtggaggtcctcagattg

SEQ ID NO: 773534 - DNA, 25 bp, Mus musculus
tcccacctcggtcccaataaagaaa

SEQ ID NO: 773535 - DNA, 25 bp, Mus musculus
tcccacctcggtgccaataaagaaa

SEQ ID NO: 773536 - DNA, 25 bp, Mus musculus
tcccaccttgacaacctggaggacg

SEQ ID NO: 773537 - DNA, 25 bp, Mus musculus
tcccaccttgactacctggaggacg

SEQ ID NO: 773538 - DNA, 25 bp, Mus musculus
tcccacgacgttaccatagagaccg

SEQ ID NO: 773539 - DNA, 25 bp, Mus musculus
tcccacgacgtttccatagagaccg

SEQ ID NO: 773540 - DNA, 25 bp, Mus musculus
tcccacgaggtacgtgcggaccaga

SEQ ID NO: 773541 - DNA, 25 bp, Mus musculus
tcccacgaggtaggtgcggaccaga

SEQ ID NO: 773542 - DNA, 25 bp, Mus musculus
tcccacgatttgatgcttcaaagaa

SEQ ID NO: 773543 - DNA, 25 bp, Mus musculus
tcccacgatttgttgcttcaaagaa

SEQ ID NO: 773544 - DNA, 25 bp, Mus musculus
tcccacgcagccctacgtggttgtg

SEQ ID NO: 773545 - DNA, 25 bp, Mus musculus
tcccacgcagccgtacgtggttgtg

SEQ ID NO: 773546 - DNA, 25 bp, Mus musculus
tcccacggaagaactcaatgaggtt

SEQ ID NO: 773547 - DNA, 25 bp, Mus musculus
tcccacggaagatctcaatgaggtt

SEQ ID NO: 773548 - DNA, 25 bp, Mus musculus
tcccacgggcgaagtgaataccatg

SEQ ID NO: 773549 - DNA, 25 bp, Mus musculus
tcccacgggcgatgtgaataccatg

SEQ ID NO: 773550 - DNA, 25 bp, Mus musculus
tcccacgggttcctctcctatagtg

SEQ ID NO: 773551 - DNA, 25 bp, Mus musculus
tcccacgggttcgtctcctatagtg

SEQ ID NO: 773552 - DNA, 25 bp, Mus musculus
tcccacggtgatcggcgtttcggaa

SEQ ID NO: 773553 - DNA, 25 bp, Mus musculus
tcccacggtgatgggcgtttcggaa

SEQ ID NO: 773554 - DNA, 25 bp, Mus musculus
tcccacggtgctcggcacggtcgta

SEQ ID NO: 773555 - DNA, 25 bp, Mus musculus
tcccacggtgctgggcacggtcgta

SEQ ID NO: 773556 - DNA, 25 bp, Mus musculus
tcccacgttcagacaagatgtacca

SEQ ID NO: 773557 - DNA, 25 bp, Mus musculus
tcccacgttcagtcaagatgtacca

SEQ ID NO: 773558 - DNA, 25 bp, Mus musculus
tcccactactgcaccggaaattgca

SEQ ID NO: 773559 - DNA, 25 bp, Mus musculus
tcccactactgctccggaaattgca

SEQ ID NO: 773560 - DNA, 25 bp, Mus musculus
tcccactatgtcaggaaccgcactg

SEQ ID NO: 773561 - DNA, 25 bp, Mus musculus
tcccactatgtctggaaccgcactg

SEQ ID NO: 773562 - DNA, 25 bp, Mus musculus
tcccactcaggactcggctttgaca

SEQ ID NO: 773563 - DNA, 25 bp, Mus musculus
tcccactcaggagtcggctttgaca

SEQ ID NO: 773564 - DNA, 25 bp, Mus musculus
tcccactgctaaattggaccaaaag

SEQ ID NO: 773565 - DNA, 25 bp, Mus musculus
tcccactgctaatttggaccaaaag

SEQ ID NO: 773566 - DNA, 25 bp, Mus musculus
tcccactgctggctttacatgagga

SEQ ID NO: 773567 - DNA, 25 bp, Mus musculus
tcccactgctgggtttacatgagga

SEQ ID NO: 773568 - DNA, 25 bp, Mus musculus
tcccactggaggaggtacgtggcct

SEQ ID NO: 773569 - DNA, 25 bp, Mus musculus
tcccactggaggtggtacgtggcct

SEQ ID NO: 773570 - DNA, 25 bp, Mus musculus
tcccactggcccctgaaaacaataa

SEQ ID NO: 773571 - DNA, 25 bp, Mus musculus
tcccactggcccgtgaaaacaataa

SEQ ID NO: 773572 - DNA, 25 bp, Mus musculus
tcccactggctcaaaagcagatcgg

SEQ ID NO: 773573 - DNA, 25 bp, Mus musculus
tcccactggctctaaagcagatcgg

SEQ ID NO: 773574 - DNA, 25 bp, Mus musculus
tcccactgtaggagaacgatttcga

SEQ ID NO: 773575 - DNA, 25 bp, Mus musculus
tcccactgtaggtgaacgatttcga

SEQ ID NO: 773576 - DNA, 25 bp, Mus musculus
tcccacttcaatcaggtgatcatga

SEQ ID NO: 773577 - DNA, 25 bp, Mus musculus
tcccacttcaatgaggtgatcatga

SEQ ID NO: 773578 - DNA, 25 bp, Mus musculus
tcccacttcatccaggagcagcagg

SEQ ID NO: 773579 - DNA, 25 bp, Mus musculus
tcccacttcatcgaggagcagcagg

SEQ ID NO: 773580 - DNA, 25 bp, Mus musculus
tcccacttggatcagagtcctgcct

SEQ ID NO: 773581 - DNA, 25 bp, Mus musculus
tcccacttggatgagagtcctgcct

SEQ ID NO: 773582 - DNA, 25 bp, Mus musculus
tcccagaaatccaggatagagagca

SEQ ID NO: 773583 - DNA, 25 bp, Mus musculus
tcccagaaatcctggatagagagca

SEQ ID NO: 773584 - DNA, 25 bp, Mus musculus
tcccagaaccgcagtgaagagtttc

SEQ ID NO: 773585 - DNA, 25 bp, Mus musculus
tcccagaaccgctgtgaagagtttc

SEQ ID NO: 773586 - DNA, 25 bp, Mus musculus
tcccagaagaatcaatcgacagaaa

SEQ ID NO: 773587 - DNA, 25 bp, Mus musculus
tcccagaagaatgaatcgacagaaa

SEQ ID NO: 773588 - DNA, 25 bp, Mus musculus
tcccagaagaccaggttgaagtgaa

SEQ ID NO: 773589 - DNA, 25 bp, Mus musculus
tcccagaagacctggttgaagtgaa

SEQ ID NO: 773590 - DNA, 25 bp, Mus musculus
tcccagaagatcacatatagctcag

SEQ ID NO: 773591 - DNA, 25 bp, Mus musculus
tcccagaagatcatccagtttgctt

SEQ ID NO: 773592 - DNA, 25 bp, Mus musculus
tcccagaagatctcatatagctcag

SEQ ID NO: 773593 - DNA, 25 bp, Mus musculus
tcccagaagatcttccagtttgctt

SEQ ID NO: 773594 - DNA, 25 bp, Mus musculus
tcccagaagatgctatccacggatt

SEQ ID NO: 773595 - DNA, 25 bp, Mus musculus
tcccagaagatggtatccacggatt

SEQ ID NO: 773596 - DNA, 25 bp, Mus musculus
tcccagaaggagagatagctcgaag

SEQ ID NO: 773597 - DNA, 25 bp, Mus musculus
tcccagaaggagtgatagctcgaag

SEQ ID NO: 773598 - DNA, 25 bp, Mus musculus
tcccagaaggatcagcactgctggg

SEQ ID NO: 773599 - DNA, 25 bp, Mus musculus
tcccagaaggatgagcactgctggg

SEQ ID NO: 773600 - DNA, 25 bp, Mus musculus
tcccagaaggtaccagccgaaggtt

SEQ ID NO: 773601 - DNA, 25 bp, Mus musculus
tcccagaaggtagcagccgaaggtt

SEQ ID NO: 773602 - DNA, 25 bp, Mus musculus
tcccagaagtttctaaacaagttgg

SEQ ID NO: 773603 - DNA, 25 bp, Mus musculus
tcccagaagtttgtaaacaagttgg

SEQ ID NO: 773604 - DNA, 25 bp, Mus musculus
tcccagaatccaacccatttcaaag

SEQ ID NO: 773605 - DNA, 25 bp, Mus musculus
tcccagaatccatcccatttcaaag

SEQ ID NO: 773606 - DNA, 25 bp, Mus musculus
tcccagaatcccagagactctaagc

SEQ ID NO: 773607 - DNA, 25 bp, Mus musculus
tcccagaatccctgagactctaagc

SEQ ID NO: 773608 - DNA, 25 bp, Mus musculus
tcccagaatccgcacaaggtacagt

SEQ ID NO: 773609 - DNA, 25 bp, Mus musculus
tcccagaatccggacaaggtacagt

SEQ ID NO: 773610 - DNA, 25 bp, Mus musculus
tcccagaatctgagtcttcagccac

SEQ ID NO: 773611 - DNA, 25 bp, Mus musculus
tcccagaatctgtgtcttcagccac

SEQ ID NO: 773612 - DNA, 25 bp, Mus musculus
tcccagaattacctcaggcagtgtc

SEQ ID NO: 773613 - DNA, 25 bp, Mus musculus
tcccagaattacgtcaggcagtgtc

SEQ ID NO: 773614 - DNA, 25 bp, Mus musculus
tcccagacaaacagtatgtgctgac

SEQ ID NO: 773615 - DNA, 25 bp, Mus musculus
tcccagacaaactgtatgtgctgac

SEQ ID NO: 773616 - DNA, 25 bp, Mus musculus
tcccagacaacgaccaggtggaagt

SEQ ID NO: 773617 - DNA, 25 bp, Mus musculus
tcccagacaacgtccaggtggaagt

SEQ ID NO: 773618 - DNA, 25 bp, Mus musculus
tcccagacagttagtaccaggtacc

SEQ ID NO: 773619 - DNA, 25 bp, Mus musculus
tcccagacagtttgtaccaggtacc

SEQ ID NO: 773620 - DNA, 25 bp, Mus musculus
tcccagacatggagcgggagctgca

SEQ ID NO: 773621 - DNA, 25 bp, Mus musculus
tcccagacatggtgcgggagctgca

SEQ ID NO: 773622 - DNA, 25 bp, Mus musculus
tcccagaccgaaacatggctctctt

SEQ ID NO: 773623 - DNA, 25 bp, Mus musculus
tcccagaccgaatcatggctctctt

SEQ ID NO: 773624 - DNA, 25 bp, Mus musculus
tcccagactacaccaaataaagatg

SEQ ID NO: 773625 - DNA, 25 bp, Mus musculus
tcccagactacagcaaataaagatg

SEQ ID NO: 773626 - DNA, 25 bp, Mus musculus
tcccagactcttccaggaataagcg

SEQ ID NO: 773627 - DNA, 25 bp, Mus musculus
tcccagactcttgcaggaataagcg

SEQ ID NO: 773628 - DNA, 25 bp, Mus musculus
tcccagactggaagaactttataac

SEQ ID NO: 773629 - DNA, 25 bp, Mus musculus
tcccagactggatgaactttataac

SEQ ID NO: 773630 - DNA, 25 bp, Mus musculus
tcccagagagatcaagtaattcaat

SEQ ID NO: 773631 - DNA, 25 bp, Mus musculus
tcccagagagatgaagtaattcaat

SEQ ID NO: 773632 - DNA, 25 bp, Mus musculus
tcccagagatcaatgaacgagcaag

SEQ ID NO: 773633 - DNA, 25 bp, Mus musculus
tcccagagatcattgaacgagcaag

SEQ ID NO: 773634 - DNA, 25 bp, Mus musculus
tcccagagcttgatgccagatcaca

SEQ ID NO: 773635 - DNA, 25 bp, Mus musculus
tcccagagcttgttgccagatcaca

SEQ ID NO: 773636 - DNA, 25 bp, Mus musculus
tcccagaggcctctctttttctgaa

SEQ ID NO: 773637 - DNA, 25 bp, Mus musculus
tcccagaggcctgtctttttctgaa

SEQ ID NO: 773638 - DNA, 25 bp, Mus musculus
tcccagaggtacaaggagtgatcct

SEQ ID NO: 773639 - DNA, 25 bp, Mus musculus
tcccagaggtactaggagtgatcct

SEQ ID NO: 773640 - DNA, 25 bp, Mus musculus
tcccagagtctgatccgctgtagag

SEQ ID NO: 773641 - DNA, 25 bp, Mus musculus
tcccagagtctgttccgctgtagag

SEQ ID NO: 773642 - DNA, 25 bp, Mus musculus
tcccagatcagcagaaactctactc

SEQ ID NO: 773643 - DNA, 25 bp, Mus musculus
tcccagatcagctgaaactctactc

SEQ ID NO: 773644 - DNA, 25 bp, Mus musculus
tcccagatcatcagggacaccattc

SEQ ID NO: 773645 - DNA, 25 bp, Mus musculus
tcccagatcatctgggacaccattc

SEQ ID NO: 773646 - DNA, 25 bp, Mus musculus
tcccagatgaccaggcactaggctt

SEQ ID NO: 773647 - DNA, 25 bp, Mus musculus
tcccagatgacctggcactaggctt

SEQ ID NO: 773648 - DNA, 25 bp, Mus musculus
tcccagatgacgatatccagtttgc

SEQ ID NO: 773649 - DNA, 25 bp, Mus musculus
tcccagatgacgttatccagtttgc

SEQ ID NO: 773650 - DNA, 25 bp, Mus musculus
tcccagatgccaagaagagaggccg

SEQ ID NO: 773651 - DNA, 25 bp, Mus musculus
tcccagatgccatgaagagaggccg

SEQ ID NO: 773652 - DNA, 25 bp, Mus musculus
tcccagatgctaagattagagctac

SEQ ID NO: 773653 - DNA, 25 bp, Mus musculus
tcccagatgctatgattagagctac

SEQ ID NO: 773654 - DNA, 25 bp, Mus musculus
tcccagatgtccagggtcctcaggg

SEQ ID NO: 773655 - DNA, 25 bp, Mus musculus
tcccagatgtcctgggtcctcaggg

SEQ ID NO: 773656 - DNA, 25 bp, Mus musculus
tcccagattggcagttggaatgctt

SEQ ID NO: 773657 - DNA, 25 bp, Mus musculus
tcccagattggctgttggaatgctt

SEQ ID NO: 773658 - DNA, 25 bp, Mus musculus
tcccagcaacccaacatggaatggc

SEQ ID NO: 773659 - DNA, 25 bp, Mus musculus
tcccagcaaccctacatggaatggc

SEQ ID NO: 773660 - DNA, 25 bp, Mus musculus
tcccagcaaggtagcggaccctgca

SEQ ID NO: 773661 - DNA, 25 bp, Mus musculus
tcccagcaaggttgcggaccctgca

SEQ ID NO: 773662 - DNA, 25 bp, Mus musculus
tcccagcaatgaccaagtgttgcaa

SEQ ID NO: 773663 - DNA, 25 bp, Mus musculus
tcccagcaatgagcaagtgttgcaa

SEQ ID NO: 773664 - DNA, 25 bp, Mus musculus
tcccagcacgctacgtaggtgaagc

SEQ ID NO: 773665 - DNA, 25 bp, Mus musculus
tcccagcacgcttcgtaggtgaagc

SEQ ID NO: 773666 - DNA, 25 bp, Mus musculus
tcccagcactatcaacatccttaga

SEQ ID NO: 773667 - DNA, 25 bp, Mus musculus
tcccagcactatgaacatccttaga

SEQ ID NO: 773668 - DNA, 25 bp, Mus musculus
tcccagcactggagtgatcactacc

SEQ ID NO: 773669 - DNA, 25 bp, Mus musculus
tcccagcactggtgtgatcactacc

SEQ ID NO: 773670 - DNA, 25 bp, Mus musculus
tcccagcagcaaagcattactacaa

SEQ ID NO: 773671 - DNA, 25 bp, Mus musculus
tcccagcagcaatgcattactacaa

SEQ ID NO: 773672 - DNA, 25 bp, Mus musculus
tcccagcagcggacaaatggaactt

SEQ ID NO: 773673 - DNA, 25 bp, Mus musculus
tcccagcagcggtcaaatggaactt

SEQ ID NO: 773674 - DNA, 25 bp, Mus musculus
tcccagcagtgtaagagaagttgtt

SEQ ID NO: 773675 - DNA, 25 bp, Mus musculus
tcccagcagtgttagagaagttgtt

SEQ ID NO: 773676 - DNA, 25 bp, Mus musculus
tcccagcatcatcagggcctggatc

SEQ ID NO: 773677 - DNA, 25 bp, Mus musculus
tcccagcatcatgagggcctggatc

SEQ ID NO: 773678 - DNA, 25 bp, Mus musculus
tcccagcatgctccgtgatgttcag

SEQ ID NO: 773679 - DNA, 25 bp, Mus musculus
tcccagcatgctgcgtgatgttcag

SEQ ID NO: 773680 - DNA, 25 bp, Mus musculus
tcccagcatttaagaacatgaagat

SEQ ID NO: 773681 - DNA, 25 bp, Mus musculus
tcccagcatttatgaacatgaagat

SEQ ID NO: 773682 - DNA, 25 bp, Mus musculus
tcccagccaagtagcaaaagtcact

SEQ ID NO: 773683 - DNA, 25 bp, Mus musculus
tcccagccaagttgcaaaagtcact

SEQ ID NO: 773684 - DNA, 25 bp, Mus musculus
tcccagccctgtcatgggtgccatg

SEQ ID NO: 773685 - DNA, 25 bp, Mus musculus
tcccagccctgtgatgggtgccatg

SEQ ID NO: 773686 - DNA, 25 bp, Mus musculus
tcccagccgagtcttgaaggtgtgc

SEQ ID NO: 773687 - DNA, 25 bp, Mus musculus
tcccagccgagtgttgaaggtgtgc

SEQ ID NO: 773688 - DNA, 25 bp, Mus musculus
tcccagcctctaagctagcacaggg

SEQ ID NO: 773689 - DNA, 25 bp, Mus musculus
tcccagcctctatgctagcacaggg

SEQ ID NO: 773690 - DNA, 25 bp, Mus musculus
tcccagcctgcacttgattgaggga

SEQ ID NO: 773691 - DNA, 25 bp, Mus musculus
tcccagcctgcagttgattgaggga

SEQ ID NO: 773692 - DNA, 25 bp, Mus musculus
tcccagcgacaacgaggtggaaatc

SEQ ID NO: 773693 - DNA, 25 bp, Mus musculus
tcccagcgacaaggaggtggaaatc

SEQ ID NO: 773694 - DNA, 25 bp, Mus musculus
tcccagcgagcgaggtccggagctc

SEQ ID NO: 773695 - DNA, 25 bp, Mus musculus
tcccagcgagcgtggtccggagctc

SEQ ID NO: 773696 - DNA, 25 bp, Mus musculus
tcccagcgagctatgagaaaggaaa

SEQ ID NO: 773697 - DNA, 25 bp, Mus musculus
tcccagcgagctttgagaaaggaaa

SEQ ID NO: 773698 - DNA, 25 bp, Mus musculus
tcccagcgccaaagatcgggactgt

SEQ ID NO: 773699 - DNA, 25 bp, Mus musculus
tcccagcgccaatgatcgggactgt

SEQ ID NO: 773700 - DNA, 25 bp, Mus musculus
tcccagcgctggagaaaatgcttgg

SEQ ID NO: 773701 - DNA, 25 bp, Mus musculus
tcccagcgctggtgaaaatgcttgg

SEQ ID NO: 773702 - DNA, 25 bp, Mus musculus
tcccagcgggcgaccggtattggaa

SEQ ID NO: 773703 - DNA, 25 bp, Mus musculus
tcccagcgggcgtccggtattggaa

SEQ ID NO: 773704 - DNA, 25 bp, Mus musculus
tcccagcgtctactaaagaggaagc

SEQ ID NO: 773705 - DNA, 25 bp, Mus musculus
tcccagcgtctagtaaagaggaagc

SEQ ID NO: 773706 - DNA, 25 bp, Mus musculus
tcccagctattgctcaggagattgg

SEQ ID NO: 773707 - DNA, 25 bp, Mus musculus
tcccagctattggtcaggagattgg

SEQ ID NO: 773708 - DNA, 25 bp, Mus musculus
tcccagctcgcgagtggaaggaacc

SEQ ID NO: 773709 - DNA, 25 bp, Mus musculus
tcccagctcgcgtgtggaaggaacc

SEQ ID NO: 773710 - DNA, 25 bp, Mus musculus
tcccagctcgtactatcttggaaga

SEQ ID NO: 773711 - DNA, 25 bp, Mus musculus
tcccagctcgtagtatcttggaaga

SEQ ID NO: 773712 - DNA, 25 bp, Mus musculus
tcccagctgctacagtatgtgtaca

SEQ ID NO: 773713 - DNA, 25 bp, Mus musculus
tcccagctgctagagtatgtgtaca

SEQ ID NO: 773714 - DNA, 25 bp, Mus musculus
tcccagctgcttagaaaacatgccg

SEQ ID NO: 773715 - DNA, 25 bp, Mus musculus
tcccagctgctttgaaaacatgccg

SEQ ID NO: 773716 - DNA, 25 bp, Mus musculus
tcccagctgtgcatggtgcaaacaa

SEQ ID NO: 773717 - DNA, 25 bp, Mus musculus
tcccagctgtgcttggtgcaaacaa

SEQ ID NO: 773718 - DNA, 25 bp, Mus musculus
tcccagctgtttaaaggcgccgtct

SEQ ID NO: 773719 - DNA, 25 bp, Mus musculus
tcccagctgttttaaggcgccgtct

SEQ ID NO: 773720 - DNA, 25 bp, Mus musculus
tcccagcttcgcaggtacttttagc

SEQ ID NO: 773721 - DNA, 25 bp, Mus musculus
tcccagcttcgctggtacttttagc

SEQ ID NO: 773722 - DNA, 25 bp, Mus musculus
tcccagcttctcagtcgcggaggaa

SEQ ID NO: 773723 - DNA, 25 bp, Mus musculus
tcccagcttctctgtcgcggaggaa

SEQ ID NO: 773724 - DNA, 25 bp, Mus musculus
tcccagcttgaaaaaactccggaag

SEQ ID NO: 773725 - DNA, 25 bp, Mus musculus
tcccagcttgaataaactccggaag

SEQ ID NO: 773726 - DNA, 25 bp, Mus musculus
tcccaggaaaccctgatcacaggga

SEQ ID NO: 773727 - DNA, 25 bp, Mus musculus
tcccaggaaaccgtgatcacaggga

SEQ ID NO: 773728 - DNA, 25 bp, Mus musculus
tcccaggaactgcattcacatagtg

SEQ ID NO: 773729 - DNA, 25 bp, Mus musculus
tcccaggaactggattcacatagtg

SEQ ID NO: 773730 - DNA, 25 bp, Mus musculus
tcccaggaagatcaatctggaatta

SEQ ID NO: 773731 - DNA, 25 bp, Mus musculus
tcccaggaagatgaatctggaatta

SEQ ID NO: 773732 - DNA, 25 bp, Mus musculus
tcccaggaaggtcgcgtcagcatct

SEQ ID NO: 773733 - DNA, 25 bp, Mus musculus
tcccaggaaggtggcgtcagcatct

SEQ ID NO: 773734 - DNA, 25 bp, Mus musculus
tcccaggacacaagattgaacccgt

SEQ ID NO: 773735 - DNA, 25 bp, Mus musculus
tcccaggacacatgattgaacccgt

SEQ ID NO: 773736 - DNA, 25 bp, Mus musculus
tcccaggaccctctgacaatggtgc

SEQ ID NO: 773737 - DNA, 25 bp, Mus musculus
tcccaggaccctgtgacaatggtgc

SEQ ID NO: 773738 - DNA, 25 bp, Mus musculus
tcccaggactcacaatgacttcagc

SEQ ID NO: 773739 - DNA, 25 bp, Mus musculus
tcccaggactcagaatgacttcagc

SEQ ID NO: 773740 - DNA, 25 bp, Mus musculus
tcccaggacttgctttatgaaacag

SEQ ID NO: 773741 - DNA, 25 bp, Mus musculus
tcccaggacttggtttatgaaacag

SEQ ID NO: 773742 - DNA, 25 bp, Mus musculus
tcccaggagctcaagtcctaagtgt

SEQ ID NO: 773743 - DNA, 25 bp, Mus musculus
tcccaggagctctagtcctaagtgt

SEQ ID NO: 773744 - DNA, 25 bp, Mus musculus
tcccaggaggagattcagatcatcc

SEQ ID NO: 773745 - DNA, 25 bp, Mus musculus
tcccaggaggagctcaagttccaca

SEQ ID NO: 773746 - DNA, 25 bp, Mus musculus
tcccaggaggaggtcaagttccaca

SEQ ID NO: 773747 - DNA, 25 bp, Mus musculus
tcccaggaggagtttcagatcatcc

SEQ ID NO: 773748 - DNA, 25 bp, Mus musculus
tcccaggattcaaagacttcatagc

SEQ ID NO: 773749 - DNA, 25 bp, Mus musculus
tcccaggattcatagacttcatagc

SEQ ID NO: 773750 - DNA, 25 bp, Mus musculus
tcccaggcccacatgagtagcaaag

SEQ ID NO: 773751 - DNA, 25 bp, Mus musculus
tcccaggcccacttgagtagcaaag

SEQ ID NO: 773752 - DNA, 25 bp, Mus musculus
tcccaggcctcacggtcaagtatgt

SEQ ID NO: 773753 - DNA, 25 bp, Mus musculus
tcccaggcctcagggtcaagtatgt

SEQ ID NO: 773754 - DNA, 25 bp, Mus musculus
tcccaggcctctagcaatgcggaag

SEQ ID NO: 773755 - DNA, 25 bp, Mus musculus
tcccaggcctcttgcaatgcggaag

SEQ ID NO: 773756 - DNA, 25 bp, Mus musculus
tcccaggctcttctgaaccctgtgg

SEQ ID NO: 773757 - DNA, 25 bp, Mus musculus
tcccaggctcttgtgaaccctgtgg

SEQ ID NO: 773758 - DNA, 25 bp, Mus musculus
tcccaggctgggaaatggtgagccc

SEQ ID NO: 773759 - DNA, 25 bp, Mus musculus
tcccaggctgggtaatggtgagccc

SEQ ID NO: 773760 - DNA, 25 bp, Mus musculus
tcccagggaaatatgaggtaggtga

SEQ ID NO: 773761 - DNA, 25 bp, Mus musculus
tcccagggaaatttgaggtaggtga

SEQ ID NO: 773762 - DNA, 25 bp, Mus musculus
tcccagggaacaccaccgtagtgat

SEQ ID NO: 773763 - DNA, 25 bp, Mus musculus
tcccagggaacagcaccgtagtgat

SEQ ID NO: 773764 - DNA, 25 bp, Mus musculus
tcccagggaatgagaagcagggcct

SEQ ID NO: 773765 - DNA, 25 bp, Mus musculus
tcccagggaatgtgaagcagggcct

SEQ ID NO: 773766 - DNA, 25 bp, Mus musculus
tcccagggacctcgcaaagctttgt

SEQ ID NO: 773767 - DNA, 25 bp, Mus musculus
tcccagggacctggcaaagctttgt

SEQ ID NO: 773768 - DNA, 25 bp, Mus musculus
tcccagggcatgagtggagacaaga

SEQ ID NO: 773769 - DNA, 25 bp, Mus musculus
tcccagggcatgtgtggagacaaga

SEQ ID NO: 773770 - DNA, 25 bp, Mus musculus
tcccagggccacattacttcctatg

SEQ ID NO: 773771 - DNA, 25 bp, Mus musculus
tcccagggccactttacttcctatg

SEQ ID NO: 773772 - DNA, 25 bp, Mus musculus
tcccagggtggcagaaccatggaat

SEQ ID NO: 773773 - DNA, 25 bp, Mus musculus
tcccagggtggctgaaccatggaat

SEQ ID NO: 773774 - DNA, 25 bp, Mus musculus
tcccagggtttcctctcaggtttgc

SEQ ID NO: 773775 - DNA, 25 bp, Mus musculus
tcccagggtttcgtctcaggtttgc

SEQ ID NO: 773776 - DNA, 25 bp, Mus musculus
tcccaggtcactcgcaggagggacc

SEQ ID NO: 773777 - DNA, 25 bp, Mus musculus
tcccaggtcactggcaggagggacc

SEQ ID NO: 773778 - DNA, 25 bp, Mus musculus
tcccaggtcgctcaggtactcgcgt

SEQ ID NO: 773779 - DNA, 25 bp, Mus musculus
tcccaggtcgctgaggtactcgcgt

SEQ ID NO: 773780 - DNA, 25 bp, Mus musculus
tcccaggtgaccagatggtggcctc

SEQ ID NO: 773781 - DNA, 25 bp, Mus musculus
tcccaggtgacctgatggtggcctc

SEQ ID NO: 773782 - DNA, 25 bp, Mus musculus
tcccaggtgcccaggcaagaagcgg

SEQ ID NO: 773783 - DNA, 25 bp, Mus musculus
tcccaggtgccctggcaagaagcgg

SEQ ID NO: 773784 - DNA, 25 bp, Mus musculus
tcccaggtgggcatccgtggcttct

SEQ ID NO: 773785 - DNA, 25 bp, Mus musculus
tcccaggtgggcttccgtggcttct

SEQ ID NO: 773786 - DNA, 25 bp, Mus musculus
tcccaggtgtcgctacctacgatga

SEQ ID NO: 773787 - DNA, 25 bp, Mus musculus
tcccaggtgtcggtacctacgatga

SEQ ID NO: 773788 - DNA, 25 bp, Mus musculus
tcccagtacctgaagctgctcagtt

SEQ ID NO: 773789 - DNA, 25 bp, Mus musculus
tcccagtacctgtagctgctcagtt

SEQ ID NO: 773790 - DNA, 25 bp, Mus musculus
tcccagtactccaaggcagcctgtg

SEQ ID NO: 773791 - DNA, 25 bp, Mus musculus
tcccagtactcctaggcagcctgtg

SEQ ID NO: 773792 - DNA, 25 bp, Mus musculus
tcccagtccacgatgatgagtcagg

SEQ ID NO: 773793 - DNA, 25 bp, Mus musculus
tcccagtccacgttgatgagtcagg

SEQ ID NO: 773794 - DNA, 25 bp, Mus musculus
tcccagtcccaactgtcaagaaagg

SEQ ID NO: 773795 - DNA, 25 bp, Mus musculus
tcccagtcccaagtgtcaagaaagg

SEQ ID NO: 773796 - DNA, 25 bp, Mus musculus
tcccagtcgtatcagctgtttgcaa

SEQ ID NO: 773797 - DNA, 25 bp, Mus musculus
tcccagtcgtatgagctgtttgcaa

SEQ ID NO: 773798 - DNA, 25 bp, Mus musculus
tcccagtctagcatggagcttcttt

SEQ ID NO: 773799 - DNA, 25 bp, Mus musculus
tcccagtctagcttggagcttcttt

SEQ ID NO: 773800 - DNA, 25 bp, Mus musculus
tcccagtctccaatcactttaaggg

SEQ ID NO: 773801 - DNA, 25 bp, Mus musculus
tcccagtctccattcactttaaggg

SEQ ID NO: 773802 - DNA, 25 bp, Mus musculus
tcccagtgaggtcgagaaagccaaa

SEQ ID NO: 773803 - DNA, 25 bp, Mus musculus
tcccagtgaggtggagaaagccaaa

SEQ ID NO: 773804 - DNA, 25 bp, Mus musculus
tcccagtgagtacggctgatgcaag

SEQ ID NO: 773805 - DNA, 25 bp, Mus musculus
tcccagtgagtagggctgatgcaag

SEQ ID NO: 773806 - DNA, 25 bp, Mus musculus
tcccagtgcttgaagctgaaggtga

SEQ ID NO: 773807 - DNA, 25 bp, Mus musculus
tcccagtgcttgtagctgaaggtga

SEQ ID NO: 773808 - DNA, 25 bp, Mus musculus
tcccagtggaagagcttttcaagct

SEQ ID NO: 773809 - DNA, 25 bp, Mus musculus
tcccagtggaagtgcttttcaagct

SEQ ID NO: 773810 - DNA, 25 bp, Mus musculus
tcccagtggccaacagggtcctgga

SEQ ID NO: 773811 - DNA, 25 bp, Mus musculus
tcccagtggccatcagggtcctgga

SEQ ID NO: 773812 - DNA, 25 bp, Mus musculus
tcccagtgggacagcgcgttgttgc

SEQ ID NO: 773813 - DNA, 25 bp, Mus musculus
tcccagtgggactgcgcgttgttgc

SEQ ID NO: 773814 - DNA, 25 bp, Mus musculus
tcccagtgtacgaggaggagcgctc

SEQ ID NO: 773815 - DNA, 25 bp, Mus musculus
tcccagtgtacgtggaggagcgctc

SEQ ID NO: 773816 - DNA, 25 bp, Mus musculus
tcccagtgttgaaggagccttgcat

SEQ ID NO: 773817 - DNA, 25 bp, Mus musculus
tcccagtgttgatggagccttgcat

SEQ ID NO: 773818 - DNA, 25 bp, Mus musculus
tcccagttcatccacaaacggagct

SEQ ID NO: 773819 - DNA, 25 bp, Mus musculus
tcccagttcatcgacaaacggagct

SEQ ID NO: 773820 - DNA, 25 bp, Mus musculus
tcccagttggccacactgtggataa

SEQ ID NO: 773821 - DNA, 25 bp, Mus musculus
tcccagttggcctcactgtggataa

SEQ ID NO: 773822 - DNA, 25 bp, Mus musculus
tcccagtttggcacttggtgggctg

SEQ ID NO: 773823 - DNA, 25 bp, Mus musculus
tcccagtttggctcttggtgggctg

SEQ ID NO: 773824 - DNA, 25 bp, Mus musculus
tcccatagctggctagtcttatgtc

SEQ ID NO: 773825 - DNA, 25 bp, Mus musculus
tcccatagctgggtagtcttatgtc

SEQ ID NO: 773826 - DNA, 25 bp, Mus musculus
tcccatagtatcaatgcccttctga

SEQ ID NO: 773827 - DNA, 25 bp, Mus musculus
tcccatagtatctatgcccttctga

SEQ ID NO: 773828 - DNA, 25 bp, Mus musculus
tcccatcaagagaagccgaattttg

SEQ ID NO: 773829 - DNA, 25 bp, Mus musculus
tcccatcaagagtagccgaattttg

SEQ ID NO: 773830 - DNA, 25 bp, Mus musculus
tcccatcaaggcacaaacagcttgt

SEQ ID NO: 773831 - DNA, 25 bp, Mus musculus
tcccatcaaggctcaaacagcttgt

SEQ ID NO: 773832 - DNA, 25 bp, Mus musculus
tcccatcactctccgtggctggtgg

SEQ ID NO: 773833 - DNA, 25 bp, Mus musculus
tcccatcactctgcgtggctggtgg

SEQ ID NO: 773834 - DNA, 25 bp, Mus musculus
tcccatcagaagaggaaggttggcg

SEQ ID NO: 773835 - DNA, 25 bp, Mus musculus
tcccatcagaagtggaaggttggcg

SEQ ID NO: 773836 - DNA, 25 bp, Mus musculus
tcccatcagccacgagtacctgaaa

SEQ ID NO: 773837 - DNA, 25 bp, Mus musculus
tcccatcagccaggagtacctgaaa

SEQ ID NO: 773838 - DNA, 25 bp, Mus musculus
tcccatcccggcaggatatccgtgt

SEQ ID NO: 773839 - DNA, 25 bp, Mus musculus
tcccatcccggctggatatccgtgt

SEQ ID NO: 773840 - DNA, 25 bp, Mus musculus
tcccatccctcaagataaagtggtg

SEQ ID NO: 773841 - DNA, 25 bp, Mus musculus
tcccatccctcatgataaagtggtg

SEQ ID NO: 773842 - DNA, 25 bp, Mus musculus
tcccatccgcagatcaacaagatag

SEQ ID NO: 773843 - DNA, 25 bp, Mus musculus
tcccatccgcagttcaacaagatag

SEQ ID NO: 773844 - DNA, 25 bp, Mus musculus
tcccatccgtgcagtggaggagcct

SEQ ID NO: 773845 - DNA, 25 bp, Mus musculus
tcccatccgtgctgtggaggagcct

SEQ ID NO: 773846 - DNA, 25 bp, Mus musculus
tcccatcctcccagaagaggattgc

SEQ ID NO: 773847 - DNA, 25 bp, Mus musculus
tcccatcctccctgaagaggattgc

SEQ ID NO: 773848 - DNA, 25 bp, Mus musculus
tcccatcgccaaagtgaccttcgtg

SEQ ID NO: 773849 - DNA, 25 bp, Mus musculus
tcccatcgccaatgtgaccttcgtg

SEQ ID NO: 773850 - DNA, 25 bp, Mus musculus
tcccatctctagagtcctttgtatc

SEQ ID NO: 773851 - DNA, 25 bp, Mus musculus
tcccatctctagtgtcctttgtatc

SEQ ID NO: 773852 - DNA, 25 bp, Mus musculus
tcccatctgcaaaggtggtcacaga

SEQ ID NO: 773853 - DNA, 25 bp, Mus musculus
tcccatctgcaatggtggtcacaga

SEQ ID NO: 773854 - DNA, 25 bp, Mus musculus
tcccatctgtgtagcctggaaacca

SEQ ID NO: 773855 - DNA, 25 bp, Mus musculus
tcccatctgtgttgcctggaaacca

SEQ ID NO: 773856 - DNA, 25 bp, Mus musculus
tcccatgaaatcagaacagacattc

SEQ ID NO: 773857 - DNA, 25 bp, Mus musculus
tcccatgaaatctgaacagacattc

SEQ ID NO: 773858 - DNA, 25 bp, Mus musculus
tcccatgaccctagaattgctacag

SEQ ID NO: 773859 - DNA, 25 bp, Mus musculus
tcccatgacccttgaattgctacag

SEQ ID NO: 773860 - DNA, 25 bp, Mus musculus
tcccatgactgaccatagaacttct

SEQ ID NO: 773861 - DNA, 25 bp, Mus musculus
tcccatgactgagcatagaacttct

SEQ ID NO: 773862 - DNA, 25 bp, Mus musculus
tcccatgactttcctatcaactttg

SEQ ID NO: 773863 - DNA, 25 bp, Mus musculus
tcccatgactttgctatcaactttg

SEQ ID NO: 773864 - DNA, 25 bp, Mus musculus
tcccatgaggtacagctgtccttgg

SEQ ID NO: 773865 - DNA, 25 bp, Mus musculus
tcccatgaggtagagctgtccttgg

SEQ ID NO: 773866 - DNA, 25 bp, Mus musculus
tcccatgagttcaggatgtcctatg

SEQ ID NO: 773867 - DNA, 25 bp, Mus musculus
tcccatgagttctggatgtcctatg

SEQ ID NO: 773868 - DNA, 25 bp, Mus musculus
tcccatgatcgcaaagctcgttgtg

SEQ ID NO: 773869 - DNA, 25 bp, Mus musculus
tcccatgatcgctaagctcgttgtg

SEQ ID NO: 773870 - DNA, 25 bp, Mus musculus
tcccatgccattccagaggctctgg

SEQ ID NO: 773871 - DNA, 25 bp, Mus musculus
tcccatgccattgcagaggctctgg

SEQ ID NO: 773872 - DNA, 25 bp, Mus musculus
tcccatggaagcatgaacagatcac

SEQ ID NO: 773873 - DNA, 25 bp, Mus musculus
tcccatggaagcttgaacagatcac

SEQ ID NO: 773874 - DNA, 25 bp, Mus musculus
tcccatggatacaaaaacaaatgaa

SEQ ID NO: 773875 - DNA, 25 bp, Mus musculus
tcccatggatacagtgacagaggct

SEQ ID NO: 773876 - DNA, 25 bp, Mus musculus
tcccatggatactaaaacaaatgaa

SEQ ID NO: 773877 - DNA, 25 bp, Mus musculus
tcccatggatactgtgacagaggct

SEQ ID NO: 773878 - DNA, 25 bp, Mus musculus
tcccatgtagaaccctttccatagg

SEQ ID NO: 773879 - DNA, 25 bp, Mus musculus
tcccatgtagaagcctttccatagg

SEQ ID NO: 773880 - DNA, 25 bp, Mus musculus
tcccatgtgagacgagactcccaag

SEQ ID NO: 773881 - DNA, 25 bp, Mus musculus
tcccatgtgagaggagactcccaag

SEQ ID NO: 773882 - DNA, 25 bp, Mus musculus
tcccattactcaattctgtggcagt

SEQ ID NO: 773883 - DNA, 25 bp, Mus musculus
tcccattactcatttctgtggcagt

SEQ ID NO: 773884 - DNA, 25 bp, Mus musculus
tcccattcagagcagatactctcct

SEQ ID NO: 773885 - DNA, 25 bp, Mus musculus
tcccattcagaggagatactctcct

SEQ ID NO: 773886 - DNA, 25 bp, Mus musculus
tcccattccgtaaccggcaggagca

SEQ ID NO: 773887 - DNA, 25 bp, Mus musculus
tcccattccgtatccggcaggagca

SEQ ID NO: 773888 - DNA, 25 bp, Mus musculus
tcccattcctgtcagcggtgactca

SEQ ID NO: 773889 - DNA, 25 bp, Mus musculus
tcccattcctgtgagcggtgactca

SEQ ID NO: 773890 - DNA, 25 bp, Mus musculus
tcccattgattgaaggctgaagctg

SEQ ID NO: 773891 - DNA, 25 bp, Mus musculus
tcccattgattgtaggctgaagctg

SEQ ID NO: 773892 - DNA, 25 bp, Mus musculus
tcccatttaacaagcagagaagctg

SEQ ID NO: 773893 - DNA, 25 bp, Mus musculus
tcccatttaacatgcagagaagctg

SEQ ID NO: 773894 - DNA, 25 bp, Mus musculus
tcccatttactgagggtgttaaggt

SEQ ID NO: 773895 - DNA, 25 bp, Mus musculus
tcccatttactgtgggtgttaaggt

SEQ ID NO: 773896 - DNA, 25 bp, Mus musculus
tcccatttcttcagcttgggcaaat

SEQ ID NO: 773897 - DNA, 25 bp, Mus musculus
tcccatttcttctgcttgggcaaat

SEQ ID NO: 773898 - DNA, 25 bp, Mus musculus
tcccatttggaaccaagttctgacc

SEQ ID NO: 773899 - DNA, 25 bp, Mus musculus
tcccatttggaagcaagttctgacc

SEQ ID NO: 773900 - DNA, 25 bp, Mus musculus
tccccaaaaacaaggccgagcagat

SEQ ID NO: 773901 - DNA, 25 bp, Mus musculus
tccccaaaaacatggccgagcagat

SEQ ID NO: 773902 - DNA, 25 bp, Mus musculus
tccccaaagcccaagaggtggagag

SEQ ID NO: 773903 - DNA, 25 bp, Mus musculus
tccccaaagccctagaggtggagag

SEQ ID NO: 773904 - DNA, 25 bp, Mus musculus
tccccaaataatccagcgagactgt

SEQ ID NO: 773905 - DNA, 25 bp, Mus musculus
tccccaaataatgcagcgagactgt

SEQ ID NO: 773906 - DNA, 25 bp, Mus musculus
tccccaaatactctgaacctgtagt

SEQ ID NO: 773907 - DNA, 25 bp, Mus musculus
tccccaaatactgtgaacctgtagt

SEQ ID NO: 773908 - DNA, 25 bp, Mus musculus
tccccaaattggagctatttacaaa

SEQ ID NO: 773909 - DNA, 25 bp, Mus musculus
tccccaaattggtgctatttacaaa

SEQ ID NO: 773910 - DNA, 25 bp, Mus musculus
tccccaactcaaaaggatggtgaag

SEQ ID NO: 773911 - DNA, 25 bp, Mus musculus
tccccaactcaataggatggtgaag

SEQ ID NO: 773912 - DNA, 25 bp, Mus musculus
tccccaactgggactggagtgctgg

SEQ ID NO: 773913 - DNA, 25 bp, Mus musculus
tccccaactgggtctggagtgctgg

SEQ ID NO: 773914 - DNA, 25 bp, Mus musculus
tccccaactgttagattatcgttca

SEQ ID NO: 773915 - DNA, 25 bp, Mus musculus
tccccaactgtttgattatcgttca

SEQ ID NO: 773916 - DNA, 25 bp, Mus musculus
tccccaagaagtagctaaagccaaa

SEQ ID NO: 773917 - DNA, 25 bp, Mus musculus
tccccaagaagttgctaaagccaaa

SEQ ID NO: 773918 - DNA, 25 bp, Mus musculus
tccccaagcgcgatggtcttgctca

SEQ ID NO: 773919 - DNA, 25 bp, Mus musculus
tccccaagcgcgttggtcttgctca

SEQ ID NO: 773920 - DNA, 25 bp, Mus musculus
tccccaaggagaagaccaagtggaa

SEQ ID NO: 773921 - DNA, 25 bp, Mus musculus
tccccaaggagatgaccaagtggaa

SEQ ID NO: 773922 - DNA, 25 bp, Mus musculus
tccccaaggcaacgacggaacagtg

SEQ ID NO: 773923 - DNA, 25 bp, Mus musculus
tccccaaggcaaggacggaacagtg

SEQ ID NO: 773924 - DNA, 25 bp, Mus musculus
tccccaaggcggacagcgtcttttt

SEQ ID NO: 773925 - DNA, 25 bp, Mus musculus
tccccaaggcggtcagcgtcttttt

SEQ ID NO: 773926 - DNA, 25 bp, Mus musculus
tccccaagtcttacgtgaaactcat

SEQ ID NO: 773927 - DNA, 25 bp, Mus musculus
tccccaagtctttcgtgaaactcat

SEQ ID NO: 773928 - DNA, 25 bp, Mus musculus
tccccaagtggcacaccagaagttg

SEQ ID NO: 773929 - DNA, 25 bp, Mus musculus
tccccaagtggctcaccagaagttg

SEQ ID NO: 773930 - DNA, 25 bp, Mus musculus
tccccacacctacgaagttcgtgat

SEQ ID NO: 773931 - DNA, 25 bp, Mus musculus
tccccacacctaggaagttcgtgat

SEQ ID NO: 773932 - DNA, 25 bp, Mus musculus
tccccacagacaaatggatattcca

SEQ ID NO: 773933 - DNA, 25 bp, Mus musculus
tccccacagacatatggatattcca

SEQ ID NO: 773934 - DNA, 25 bp, Mus musculus
tccccacagagaatgttagaccagt

SEQ ID NO: 773935 - DNA, 25 bp, Mus musculus
tccccacagagattgttagaccagt

SEQ ID NO: 773936 - DNA, 25 bp, Mus musculus
tccccacattctcttgttcgtcatg

SEQ ID NO: 773937 - DNA, 25 bp, Mus musculus
tccccacattctgttgttcgtcatg

SEQ ID NO: 773938 - DNA, 25 bp, Mus musculus
tccccaccagtaagggggtgacgag

SEQ ID NO: 773939 - DNA, 25 bp, Mus musculus
tccccaccagtatgggggtgacgag

SEQ ID NO: 773940 - DNA, 25 bp, Mus musculus
tccccacccagcatatgatgataag

SEQ ID NO: 773941 - DNA, 25 bp, Mus musculus
tccccacccagcttatgatgataag

SEQ ID NO: 773942 - DNA, 25 bp, Mus musculus
tccccacgcgagcatgctgcggtga

SEQ ID NO: 773943 - DNA, 25 bp, Mus musculus
tccccacgcgaggatgctgcggtga

SEQ ID NO: 773944 - DNA, 25 bp, Mus musculus
tccccacgggatagatggatctgaa

SEQ ID NO: 773945 - DNA, 25 bp, Mus musculus
tccccacgggattgatggatctgaa

SEQ ID NO: 773946 - DNA, 25 bp, Mus musculus
tccccactagccctagtgactggag

SEQ ID NO: 773947 - DNA, 25 bp, Mus musculus
tccccactagccgtagtgactggag

SEQ ID NO: 773948 - DNA, 25 bp, Mus musculus
tccccactatccagtggtgtgctgc

SEQ ID NO: 773949 - DNA, 25 bp, Mus musculus
tccccactatcctgtggtgtgctgc

SEQ ID NO: 773950 - DNA, 25 bp, Mus musculus
tccccactgagtaagagatgcctaa

SEQ ID NO: 773951 - DNA, 25 bp, Mus musculus
tccccactgagttagagatgcctaa

SEQ ID NO: 773952 - DNA, 25 bp, Mus musculus
tccccactgattctagagatagttc

SEQ ID NO: 773953 - DNA, 25 bp, Mus musculus
tccccactgattgtagagatagttc

SEQ ID NO: 773954 - DNA, 25 bp, Mus musculus
tccccactggtcaggttgctgggca

SEQ ID NO: 773955 - DNA, 25 bp, Mus musculus
tccccactggtctggttgctgggca

SEQ ID NO: 773956 - DNA, 25 bp, Mus musculus
tccccagaaaggcaaacttctcatt

SEQ ID NO: 773957 - DNA, 25 bp, Mus musculus
tccccagaaagggaaacttctcatt

SEQ ID NO: 773958 - DNA, 25 bp, Mus musculus
tccccagaagatagactgagtatgc

SEQ ID NO: 773959 - DNA, 25 bp, Mus musculus
tccccagaagatcagaatgcagacg

SEQ ID NO: 773960 - DNA, 25 bp, Mus musculus
tccccagaagatgagaatgcagacg

SEQ ID NO: 773961 - DNA, 25 bp, Mus musculus
tccccagaagattgactgagtatgc

SEQ ID NO: 773962 - DNA, 25 bp, Mus musculus
tccccagaagcaaccgtcaaagagg

SEQ ID NO: 773963 - DNA, 25 bp, Mus musculus
tccccagaagcatccgtcaaagagg

SEQ ID NO: 773964 - DNA, 25 bp, Mus musculus
tccccagagaaaagtagtgcagaga

SEQ ID NO: 773965 - DNA, 25 bp, Mus musculus
tccccagagaaatgtagtgcagaga

SEQ ID NO: 773966 - DNA, 25 bp, Mus musculus
tccccagaggacatgattgaggcag

SEQ ID NO: 773967 - DNA, 25 bp, Mus musculus
tccccagaggacttgattgaggcag

SEQ ID NO: 773968 - DNA, 25 bp, Mus musculus
tccccagagggcacagggctaggct

SEQ ID NO: 773969 - DNA, 25 bp, Mus musculus
tccccagagggctcagggctaggct

SEQ ID NO: 773970 - DNA, 25 bp, Mus musculus
tccccagaggttacagacagtaaag

SEQ ID NO: 773971 - DNA, 25 bp, Mus musculus
tccccagaggtttcagacagtaaag

SEQ ID NO: 773972 - DNA, 25 bp, Mus musculus
tccccagagttcctggcttgaatcg

SEQ ID NO: 773973 - DNA, 25 bp, Mus musculus
tccccagagttcgtggcttgaatcg

SEQ ID NO: 773974 - DNA, 25 bp, Mus musculus
tccccagattgccactgaggtgggc

SEQ ID NO: 773975 - DNA, 25 bp, Mus musculus
tccccagattgcgactgaggtgggc

SEQ ID NO: 773976 - DNA, 25 bp, Mus musculus
tccccagcacctcgtggttgtggag

SEQ ID NO: 773977 - DNA, 25 bp, Mus musculus
tccccagcacctggtggttgtggag

SEQ ID NO: 773978 - DNA, 25 bp, Mus musculus
tccccagccacgctgaaagttcagt

SEQ ID NO: 773979 - DNA, 25 bp, Mus musculus
tccccagccacggtgaaagttcagt

SEQ ID NO: 773980 - DNA, 25 bp, Mus musculus
tccccagcctgtagcgacagggttt

SEQ ID NO: 773981 - DNA, 25 bp, Mus musculus
tccccagcctgttgcgacagggttt

SEQ ID NO: 773982 - DNA, 25 bp, Mus musculus
tccccagcggatccaacagacaaat

SEQ ID NO: 773983 - DNA, 25 bp, Mus musculus
tccccagcggatgcaacagacaaat

SEQ ID NO: 773984 - DNA, 25 bp, Mus musculus
tccccagctaagctaagcgtgttat

SEQ ID NO: 773985 - DNA, 25 bp, Mus musculus
tccccagctaaggtaagcgtgttat

SEQ ID NO: 773986 - DNA, 25 bp, Mus musculus
tccccaggaaggcagctgaaggaat

SEQ ID NO: 773987 - DNA, 25 bp, Mus musculus
tccccaggaagggagctgaaggaat

SEQ ID NO: 773988 - DNA, 25 bp, Mus musculus
tccccaggaatcatggaggcggccc

SEQ ID NO: 773989 - DNA, 25 bp, Mus musculus
tccccaggaatcttggaggcggccc

SEQ ID NO: 773990 - DNA, 25 bp, Mus musculus
tccccaggacacaagcacagggtta

SEQ ID NO: 773991 - DNA, 25 bp, Mus musculus
tccccaggacactagcacagggtta

SEQ ID NO: 773992 - DNA, 25 bp, Mus musculus
tccccaggacatctatgatgtgccc

SEQ ID NO: 773993 - DNA, 25 bp, Mus musculus
tccccaggacatgtatgatgtgccc

SEQ ID NO: 773994 - DNA, 25 bp, Mus musculus
tccccaggaccaatgtggcagtgga

SEQ ID NO: 773995 - DNA, 25 bp, Mus musculus
tccccaggaccattgtggcagtgga

SEQ ID NO: 773996 - DNA, 25 bp, Mus musculus
tccccaggcaagaactattctcatg

SEQ ID NO: 773997 - DNA, 25 bp, Mus musculus
tccccaggcaagtactattctcatg

SEQ ID NO: 773998 - DNA, 25 bp, Mus musculus
tccccaggcgggagtctaggaaact

SEQ ID NO: 773999 - DNA, 25 bp, Mus musculus
tccccaggcgggtgtctaggaaact

SEQ ID NO: 774000 - DNA, 25 bp, Mus musculus
tccccaggctcacacaggaagactg

SEQ ID NO: 774001 - DNA, 25 bp, Mus musculus
tccccaggctcagacaggaagactg

SEQ ID NO: 774002 - DNA, 25 bp, Mus musculus
tccccagggtaacgacaatggcacc

SEQ ID NO: 774003 - DNA, 25 bp, Mus musculus
tccccagggtaaggacaatggcacc

SEQ ID NO: 774004 - DNA, 25 bp, Mus musculus
tccccagggtcaagccgttatccaa

SEQ ID NO: 774005 - DNA, 25 bp, Mus musculus
tccccagggtcatgccgttatccaa

SEQ ID NO: 774006 - DNA, 25 bp, Mus musculus
tccccagggtgcccaggaagtcaag

SEQ ID NO: 774007 - DNA, 25 bp, Mus musculus
tccccagggtgcgcaggaagtcaag

SEQ ID NO: 774008 - DNA, 25 bp, Mus musculus
tccccaggtgctcaatgggcgcttc

SEQ ID NO: 774009 - DNA, 25 bp, Mus musculus
tccccaggtgctgaatgggcgcttc

SEQ ID NO: 774010 - DNA, 25 bp, Mus musculus
tccccagtccagagccgcttggagg

SEQ ID NO: 774011 - DNA, 25 bp, Mus musculus
tccccagtccagtgccgcttggagg

SEQ ID NO: 774012 - DNA, 25 bp, Mus musculus
tccccagtgagactcctgaaggaga

SEQ ID NO: 774013 - DNA, 25 bp, Mus musculus
tccccagtgagagtcctgaaggaga

SEQ ID NO: 774014 - DNA, 25 bp, Mus musculus
tccccagtgcggcaagcgttacaaa

SEQ ID NO: 774015 - DNA, 25 bp, Mus musculus
tccccagtgcgggaagcgttacaaa

SEQ ID NO: 774016 - DNA, 25 bp, Mus musculus
tccccagtggaacgcttgcagctgt

SEQ ID NO: 774017 - DNA, 25 bp, Mus musculus
tccccagtggaaggcttgcagctgt

SEQ ID NO: 774018 - DNA, 25 bp, Mus musculus
tccccagtgggaacccagtatagtg

SEQ ID NO: 774019 - DNA, 25 bp, Mus musculus
tccccagtgggatcccagtatagtg

SEQ ID NO: 774020 - DNA, 25 bp, Mus musculus
tccccagtgtcaccaaaataattgc

SEQ ID NO: 774021 - DNA, 25 bp, Mus musculus
tccccagtgtcagcaaaataattgc

SEQ ID NO: 774022 - DNA, 25 bp, Mus musculus
tccccagtgtgacaggaaccagcaa

SEQ ID NO: 774023 - DNA, 25 bp, Mus musculus
tccccagtgtgagaggaaccagcaa

SEQ ID NO: 774024 - DNA, 25 bp, Mus musculus
tccccatatggaagagcttgatgaa

SEQ ID NO: 774025 - DNA, 25 bp, Mus musculus
tccccatatggatgagcttgatgaa

SEQ ID NO: 774026 - DNA, 25 bp, Mus musculus
tccccatccagactataatcctgat

SEQ ID NO: 774027 - DNA, 25 bp, Mus musculus
tccccatccagagtataatcctgat

SEQ ID NO: 774028 - DNA, 25 bp, Mus musculus
tccccatcgatgagacctttaaaag

SEQ ID NO: 774029 - DNA, 25 bp, Mus musculus
tccccatcgatgtgacctttaaaag

SEQ ID NO: 774030 - DNA, 25 bp, Mus musculus
tccccatcgggaacgcgctgatgtt

SEQ ID NO: 774031 - DNA, 25 bp, Mus musculus
tccccatcgggatcgcgctgatgtt

SEQ ID NO: 774032 - DNA, 25 bp, Mus musculus
tccccatctcggaagaggacagtgt

SEQ ID NO: 774033 - DNA, 25 bp, Mus musculus
tccccatctcggtagaggacagtgt

SEQ ID NO: 774034 - DNA, 25 bp, Mus musculus
tccccatgaaggaaagaccaactct

SEQ ID NO: 774035 - DNA, 25 bp, Mus musculus
tccccatgaaggtaagaccaactct

SEQ ID NO: 774036 - DNA, 25 bp, Mus musculus
tccccatgatgaccgaatgttcctg

SEQ ID NO: 774037 - DNA, 25 bp, Mus musculus
tccccatgatgagcgaatgttcctg

SEQ ID NO: 774038 - DNA, 25 bp, Mus musculus
tccccatgcagtatggaatcatcca

SEQ ID NO: 774039 - DNA, 25 bp, Mus musculus
tccccatgcagtttggaatcatcca

SEQ ID NO: 774040 - DNA, 25 bp, Mus musculus
tccccatgcctgcaggagcatcaat

SEQ ID NO: 774041 - DNA, 25 bp, Mus musculus
tccccatgcctggaggagcatcaat

SEQ ID NO: 774042 - DNA, 25 bp, Mus musculus
tccccatggactactcggagggctt

SEQ ID NO: 774043 - DNA, 25 bp, Mus musculus
tccccatggacttctcggagggctt

SEQ ID NO: 774044 - DNA, 25 bp, Mus musculus
tccccatgggcgctgattacatcat

SEQ ID NO: 774045 - DNA, 25 bp, Mus musculus
tccccatgggcggtgattacatcat

SEQ ID NO: 774046 - DNA, 25 bp, Mus musculus
tccccatgggtaatgtgatctcgat

SEQ ID NO: 774047 - DNA, 25 bp, Mus musculus
tccccatgggtattgtgatctcgat

SEQ ID NO: 774048 - DNA, 25 bp, Mus musculus
tccccattacagcacagcagagagg

SEQ ID NO: 774049 - DNA, 25 bp, Mus musculus
tccccattacaggacagcagagagg

SEQ ID NO: 774050 - DNA, 25 bp, Mus musculus
tccccattacctcttagatgagcag

SEQ ID NO: 774051 - DNA, 25 bp, Mus musculus
tccccattacctgttagatgagcag

SEQ ID NO: 774052 - DNA, 25 bp, Mus musculus
tccccattcgccacataggcgagtt

SEQ ID NO: 774053 - DNA, 25 bp, Mus musculus
tccccattcgcctcataggcgagtt

SEQ ID NO: 774054 - DNA, 25 bp, Mus musculus
tccccattctgacacgaggaggcag

SEQ ID NO: 774055 - DNA, 25 bp, Mus musculus
tccccattctgagacgaggaggcag

SEQ ID NO: 774056 - DNA, 25 bp, Mus musculus
tccccattggagcaggcctactgtg

SEQ ID NO: 774057 - DNA, 25 bp, Mus musculus
tccccattggaggaggcctactgtg

SEQ ID NO: 774058 - DNA, 25 bp, Mus musculus
tccccatttggcagtgcctggtgtg

SEQ ID NO: 774059 - DNA, 25 bp, Mus musculus
tccccatttggctgtgcctggtgtg

SEQ ID NO: 774060 - DNA, 25 bp, Mus musculus
tcccccaatgagagaggagccaggt

SEQ ID NO: 774061 - DNA, 25 bp, Mus musculus
tcccccaatgagtgaggagccaggt

SEQ ID NO: 774062 - DNA, 25 bp, Mus musculus
tcccccagagctagggaactgtgtg

SEQ ID NO: 774063 - DNA, 25 bp, Mus musculus
tcccccagagcttgggaactgtgtg

SEQ ID NO: 774064 - DNA, 25 bp, Mus musculus
tcccccaggactcgtgagtaaacaa

SEQ ID NO: 774065 - DNA, 25 bp, Mus musculus
tcccccaggactggtgagtaaacaa

SEQ ID NO: 774066 - DNA, 25 bp, Mus musculus
tccccccggagaacgtggaacagat

SEQ ID NO: 774067 - DNA, 25 bp, Mus musculus
tccccccggagatcgtggaacagat

SEQ ID NO: 774068 - DNA, 25 bp, Mus musculus
tccccgaagaagaactccaccaaga

SEQ ID NO: 774069 - DNA, 25 bp, Mus musculus
tccccgaagaagtactccaccaaga

SEQ ID NO: 774070 - DNA, 25 bp, Mus musculus
tccccgaagatgatgggaatgacct

SEQ ID NO: 774071 - DNA, 25 bp, Mus musculus
tccccgaagatgttgggaatgacct

SEQ ID NO: 774072 - DNA, 25 bp, Mus musculus
tccccgaagctgacaacacagcagg

SEQ ID NO: 774073 - DNA, 25 bp, Mus musculus
tccccgaagctgtcaacacagcagg

SEQ ID NO: 774074 - DNA, 25 bp, Mus musculus
tccccgaatcttagaggctcagatt

SEQ ID NO: 774075 - DNA, 25 bp, Mus musculus
tccccgaatctttgaggctcagatt

SEQ ID NO: 774076 - DNA, 25 bp, Mus musculus
tccccgacagcaagtggagacgttc

SEQ ID NO: 774077 - DNA, 25 bp, Mus musculus
tccccgacagcatgtggagacgttc

SEQ ID NO: 774078 - DNA, 25 bp, Mus musculus
tccccgagaagaatgacatgaccac

SEQ ID NO: 774079 - DNA, 25 bp, Mus musculus
tccccgagaagacagttagggcctt

SEQ ID NO: 774080 - DNA, 25 bp, Mus musculus
tccccgagaagagagttagggcctt

SEQ ID NO: 774081 - DNA, 25 bp, Mus musculus
tccccgagaagattgacatgaccac

SEQ ID NO: 774082 - DNA, 25 bp, Mus musculus
tccccgagagctatagagttcccta

SEQ ID NO: 774083 - DNA, 25 bp, Mus musculus
tccccgagagctttagagttcccta

SEQ ID NO: 774084 - DNA, 25 bp, Mus musculus
tccccgaggagccttacatgcctgt

SEQ ID NO: 774085 - DNA, 25 bp, Mus musculus
tccccgaggagcgttacatgcctgt

SEQ ID NO: 774086 - DNA, 25 bp, Mus musculus
tccccgaggcctcccagagtgtaaa

SEQ ID NO: 774087 - DNA, 25 bp, Mus musculus
tccccgaggcctgccagagtgtaaa

SEQ ID NO: 774088 - DNA, 25 bp, Mus musculus
tccccgagggagacaacggtataga

SEQ ID NO: 774089 - DNA, 25 bp, Mus musculus
tccccgagggagatatcaaggccct

SEQ ID NO: 774090 - DNA, 25 bp, Mus musculus
tccccgagggagtcaacggtataga

SEQ ID NO: 774091 - DNA, 25 bp, Mus musculus
tccccgagggagttatcaaggccct

SEQ ID NO: 774092 - DNA, 25 bp, Mus musculus
tccccgagtcggagaacatctgtgg

SEQ ID NO: 774093 - DNA, 25 bp, Mus musculus
tccccgagtcggtgaacatctgtgg

SEQ ID NO: 774094 - DNA, 25 bp, Mus musculus
tccccgagtgatcgtagtaggtcct

SEQ ID NO: 774095 - DNA, 25 bp, Mus musculus
tccccgagtgatggtagtaggtcct

SEQ ID NO: 774096 - DNA, 25 bp, Mus musculus
tccccgagtgtgattccgcggccgt

SEQ ID NO: 774097 - DNA, 25 bp, Mus musculus
tccccgagtgtgtttccgcggccgt

SEQ ID NO: 774098 - DNA, 25 bp, Mus musculus
tccccgagttgcagttatagagtac

SEQ ID NO: 774099 - DNA, 25 bp, Mus musculus
tccccgagttgctgttatagagtac

SEQ ID NO: 774100 - DNA, 25 bp, Mus musculus
tccccgatggcccagtgggagaaca

SEQ ID NO: 774101 - DNA, 25 bp, Mus musculus
tccccgatggccgagtgggagaaca

SEQ ID NO: 774102 - DNA, 25 bp, Mus musculus
tccccgatggctacagcactgtggt

SEQ ID NO: 774103 - DNA, 25 bp, Mus musculus
tccccgatggcttcagcactgtggt

SEQ ID NO: 774104 - DNA, 25 bp, Mus musculus
tccccgcacgcaccaggttgggaag

SEQ ID NO: 774105 - DNA, 25 bp, Mus musculus
tccccgcacgcagcaggttgggaag

SEQ ID NO: 774106 - DNA, 25 bp, Mus musculus
tccccgcagcgcattgaggagtgca

SEQ ID NO: 774107 - DNA, 25 bp, Mus musculus
tccccgcagcgctttgaggagtgca

SEQ ID NO: 774108 - DNA, 25 bp, Mus musculus
tccccggaggagaacactgagtgaa

SEQ ID NO: 774109 - DNA, 25 bp, Mus musculus
tccccggaggagtacactgagtgaa

SEQ ID NO: 774110 - DNA, 25 bp, Mus musculus
tccccggagtgaaactacgctcaaa

SEQ ID NO: 774111 - DNA, 25 bp, Mus musculus
tccccggagtgatactacgctcaaa

SEQ ID NO: 774112 - DNA, 25 bp, Mus musculus
tccccggatggcacatactcagagt

SEQ ID NO: 774113 - DNA, 25 bp, Mus musculus
tccccggatggctcatactcagagt

SEQ ID NO: 774114 - DNA, 25 bp, Mus musculus
tccccggattagcaaggagctctcc

SEQ ID NO: 774115 - DNA, 25 bp, Mus musculus
tccccggattaggaaggagctctcc

SEQ ID NO: 774116 - DNA, 25 bp, Mus musculus
tccccggcagcaactgtggcacaag

SEQ ID NO: 774117 - DNA, 25 bp, Mus musculus
tccccggcagcatctgtggcacaag

SEQ ID NO: 774118 - DNA, 25 bp, Mus musculus
tccccggcgtttagtggtgtcaact

SEQ ID NO: 774119 - DNA, 25 bp, Mus musculus
tccccggcgttttgtggtgtcaact

SEQ ID NO: 774120 - DNA, 25 bp, Mus musculus
tccccgggaaggctctacagaaagt

SEQ ID NO: 774121 - DNA, 25 bp, Mus musculus
tccccgggaagggtctacagaaagt

SEQ ID NO: 774122 - DNA, 25 bp, Mus musculus
tccccgggagttatggatcctatga

SEQ ID NO: 774123 - DNA, 25 bp, Mus musculus
tccccgggagttttggatcctatga

SEQ ID NO: 774124 - DNA, 25 bp, Mus musculus
tccccggtctgtctcgatccattga

SEQ ID NO: 774125 - DNA, 25 bp, Mus musculus
tccccggtctgtgtcgatccattga

SEQ ID NO: 774126 - DNA, 25 bp, Mus musculus
tccccggtgggaagtgtgcttaaca

SEQ ID NO: 774127 - DNA, 25 bp, Mus musculus
tccccggtgggatgtgtgcttaaca

SEQ ID NO: 774128 - DNA, 25 bp, Mus musculus
tccccggttcagagcccgacggagg

SEQ ID NO: 774129 - DNA, 25 bp, Mus musculus
tccccggttcagtgcccgacggagg

SEQ ID NO: 774130 - DNA, 25 bp, Mus musculus
tccccggttctccaacctggtattg

SEQ ID NO: 774131 - DNA, 25 bp, Mus musculus
tccccggttctcgaacctggtattg

SEQ ID NO: 774132 - DNA, 25 bp, Mus musculus
tccccggttgtcatggtaactactg

SEQ ID NO: 774133 - DNA, 25 bp, Mus musculus
tccccggttgtcttggtaactactg

SEQ ID NO: 774134 - DNA, 25 bp, Mus musculus
tccccgtccgtgagctggagctgag

SEQ ID NO: 774135 - DNA, 25 bp, Mus musculus
tccccgtccgtgtgctggagctgag

SEQ ID NO: 774136 - DNA, 25 bp, Mus musculus
tccccgtcggctcgctcagaggaga

SEQ ID NO: 774137 - DNA, 25 bp, Mus musculus
tccccgtcggctggctcagaggaga

SEQ ID NO: 774138 - DNA, 25 bp, Mus musculus
tccccgtggagcaccaggtgctggt

SEQ ID NO: 774139 - DNA, 25 bp, Mus musculus
tccccgtggagctccaggtgctggt

SEQ ID NO: 774140 - DNA, 25 bp, Mus musculus
tccccgtggcgtcgagaaacttctt

SEQ ID NO: 774141 - DNA, 25 bp, Mus musculus
tccccgtggcgtggagaaacttctt

SEQ ID NO: 774142 - DNA, 25 bp, Mus musculus
tccccgtggctcagggagatgccgt

SEQ ID NO: 774143 - DNA, 25 bp, Mus musculus
tccccgtggctctgggagatgccgt

SEQ ID NO: 774144 - DNA, 25 bp, Mus musculus
tccccgtggctgagacttggtgacc

SEQ ID NO: 774145 - DNA, 25 bp, Mus musculus
tccccgtggctgcacagaaactcat

SEQ ID NO: 774146 - DNA, 25 bp, Mus musculus
tccccgtggctggacagaaactcat

SEQ ID NO: 774147 - DNA, 25 bp, Mus musculus
tccccgtggctgtgacttggtgacc

SEQ ID NO: 774148 - DNA, 25 bp, Mus musculus
tccccgtgggtgatcgttattggct

SEQ ID NO: 774149 - DNA, 25 bp, Mus musculus
tccccgtgggtgttcgttattggct

SEQ ID NO: 774150 - DNA, 25 bp, Mus musculus
tccccgtgttctatcagctgggttg

SEQ ID NO: 774151 - DNA, 25 bp, Mus musculus
tccccgtgttctttcagctgggttg

SEQ ID NO: 774152 - DNA, 25 bp, Mus musculus
tcccctaaatccaggaggctcttgg

SEQ ID NO: 774153 - DNA, 25 bp, Mus musculus
tcccctaaatcctggaggctcttgg

SEQ ID NO: 774154 - DNA, 25 bp, Mus musculus
tcccctaatgttaggttctcttact

SEQ ID NO: 774155 - DNA, 25 bp, Mus musculus
tcccctaatgtttggttctcttact

SEQ ID NO: 774156 - DNA, 25 bp, Mus musculus
tcccctacagtacatgggctgtgtg

SEQ ID NO: 774157 - DNA, 25 bp, Mus musculus
tcccctacagtagatgggctgtgtg

SEQ ID NO: 774158 - DNA, 25 bp, Mus musculus
tcccctacggccaatgctgggtctt

SEQ ID NO: 774159 - DNA, 25 bp, Mus musculus
tcccctacggcctatgctgggtctt

SEQ ID NO: 774160 - DNA, 25 bp, Mus musculus
tcccctagaagtccccgatggtaaa

SEQ ID NO: 774161 - DNA, 25 bp, Mus musculus
tcccctagaagtgcccgatggtaaa

SEQ ID NO: 774162 - DNA, 25 bp, Mus musculus
tcccctagattaaagagcaagtgta

SEQ ID NO: 774163 - DNA, 25 bp, Mus musculus
tcccctagattatagagcaagtgta

SEQ ID NO: 774164 - DNA, 25 bp, Mus musculus
tcccctagcagacataagaacacag

SEQ ID NO: 774165 - DNA, 25 bp, Mus musculus
tcccctagcagagataagaacacag

SEQ ID NO: 774166 - DNA, 25 bp, Mus musculus
tcccctaggagacggctcgtccttg

SEQ ID NO: 774167 - DNA, 25 bp, Mus musculus
tcccctaggagagggctcgtccttg

SEQ ID NO: 774168 - DNA, 25 bp, Mus musculus
tcccctatgtagctgaatatgacca

SEQ ID NO: 774169 - DNA, 25 bp, Mus musculus
tcccctatgtaggtgaatatgacca

SEQ ID NO: 774170 - DNA, 25 bp, Mus musculus
tcccctatttgcaggaaatcctcag

SEQ ID NO: 774171 - DNA, 25 bp, Mus musculus
tcccctatttgctggaaatcctcag

SEQ ID NO: 774172 - DNA, 25 bp, Mus musculus
tcccctcaactgcagagacctgaag

SEQ ID NO: 774173 - DNA, 25 bp, Mus musculus
tcccctcaactggagagacctgaag

SEQ ID NO: 774174 - DNA, 25 bp, Mus musculus
tcccctcagctaccaggtgtgagag

SEQ ID NO: 774175 - DNA, 25 bp, Mus musculus
tcccctcagctagcaggtgtgagag

SEQ ID NO: 774176 - DNA, 25 bp, Mus musculus
tcccctccaggtagagagtacagcc

SEQ ID NO: 774177 - DNA, 25 bp, Mus musculus
tcccctccaggttgagagtacagcc

SEQ ID NO: 774178 - DNA, 25 bp, Mus musculus
tcccctccggcgactagggctttgg

SEQ ID NO: 774179 - DNA, 25 bp, Mus musculus
tcccctccggcgtctagggctttgg

SEQ ID NO: 774180 - DNA, 25 bp, Mus musculus
tcccctcggctaaccaaggaagtgg

SEQ ID NO: 774181 - DNA, 25 bp, Mus musculus
tcccctcggctatccaaggaagtgg

SEQ ID NO: 774182 - DNA, 25 bp, Mus musculus
tcccctcggtacacgggaggacaga

SEQ ID NO: 774183 - DNA, 25 bp, Mus musculus
tcccctcggtactcgggaggacaga

SEQ ID NO: 774184 - DNA, 25 bp, Mus musculus
tcccctcgtgtcagagttaagaatc

SEQ ID NO: 774185 - DNA, 25 bp, Mus musculus
tcccctcgtgtctgagttaagaatc

SEQ ID NO: 774186 - DNA, 25 bp, Mus musculus
tcccctctcctgaattgaaagcgtt

SEQ ID NO: 774187 - DNA, 25 bp, Mus musculus
tcccctctcctgtattgaaagcgtt

SEQ ID NO: 774188 - DNA, 25 bp, Mus musculus
tcccctctgcttacacaatggagtc

SEQ ID NO: 774189 - DNA, 25 bp, Mus musculus
tcccctctgctttcacaatggagtc

SEQ ID NO: 774190 - DNA, 25 bp, Mus musculus
tcccctctggtcactgtgggtacat

SEQ ID NO: 774191 - DNA, 25 bp, Mus musculus
tcccctctggtctctgtgggtacat

SEQ ID NO: 774192 - DNA, 25 bp, Mus musculus
tcccctgaaagtcagtgagactata

SEQ ID NO: 774193 - DNA, 25 bp, Mus musculus
tcccctgaaagtgagtgagactata

SEQ ID NO: 774194 - DNA, 25 bp, Mus musculus
tcccctgacctaagaaggtggtgta

SEQ ID NO: 774195 - DNA, 25 bp, Mus musculus
tcccctgacctatgaaggtggtgta

SEQ ID NO: 774196 - DNA, 25 bp, Mus musculus
tcccctgactgtagcatgctgtgct

SEQ ID NO: 774197 - DNA, 25 bp, Mus musculus
tcccctgactgttgcatgctgtgct

SEQ ID NO: 774198 - DNA, 25 bp, Mus musculus
tcccctgacttcaccggaggtgtga

SEQ ID NO: 774199 - DNA, 25 bp, Mus musculus
tcccctgacttctccggaggtgtga

SEQ ID NO: 774200 - DNA, 25 bp, Mus musculus
tcccctgagcaaacgagaggaagga

SEQ ID NO: 774201 - DNA, 25 bp, Mus musculus
tcccctgagcaatcgagaggaagga

SEQ ID NO: 774202 - DNA, 25 bp, Mus musculus
tcccctgaggaaatggaccagggca

SEQ ID NO: 774203 - DNA, 25 bp, Mus musculus
tcccctgaggaattggaccagggca

SEQ ID NO: 774204 - DNA, 25 bp, Mus musculus
tcccctgagggtatcggaggctaca

SEQ ID NO: 774205 - DNA, 25 bp, Mus musculus
tcccctgagggtttcggaggctaca

SEQ ID NO: 774206 - DNA, 25 bp, Mus musculus
tcccctgcaggacactagggtccgg

SEQ ID NO: 774207 - DNA, 25 bp, Mus musculus
tcccctgcaggagactagggtccgg

SEQ ID NO: 774208 - DNA, 25 bp, Mus musculus
tcccctgcccatcgagagaaatgca

SEQ ID NO: 774209 - DNA, 25 bp, Mus musculus
tcccctgcccatggagagaaatgca

SEQ ID NO: 774210 - DNA, 25 bp, Mus musculus
tcccctgcggagatgcttgtatgcc

SEQ ID NO: 774211 - DNA, 25 bp, Mus musculus
tcccctgcggagttgcttgtatgcc

SEQ ID NO: 774212 - DNA, 25 bp, Mus musculus
tcccctgcggtcatggccttgaggg

SEQ ID NO: 774213 - DNA, 25 bp, Mus musculus
tcccctgcggtcttggccttgaggg

SEQ ID NO: 774214 - DNA, 25 bp, Mus musculus
tcccctgcgtataagcatgcatggg

SEQ ID NO: 774215 - DNA, 25 bp, Mus musculus
tcccctgcgtattagcatgcatggg

SEQ ID NO: 774216 - DNA, 25 bp, Mus musculus
tcccctgcttcgagaatggctgcca

SEQ ID NO: 774217 - DNA, 25 bp, Mus musculus
tcccctgcttcgtgaatggctgcca

SEQ ID NO: 774218 - DNA, 25 bp, Mus musculus
tcccctggaaatatgtcctcaacac

SEQ ID NO: 774219 - DNA, 25 bp, Mus musculus
tcccctggaaatttgtcctcaacac

SEQ ID NO: 774220 - DNA, 25 bp, Mus musculus
tcccctggcaacagaaggtcaggtt

SEQ ID NO: 774221 - DNA, 25 bp, Mus musculus
tcccctggcaactgaaggtcaggtt

SEQ ID NO: 774222 - DNA, 25 bp, Mus musculus
tcccctggccctaagaggaacagtt

SEQ ID NO: 774223 - DNA, 25 bp, Mus musculus
tcccctggcccttagaggaacagtt

SEQ ID NO: 774224 - DNA, 25 bp, Mus musculus
tcccctggcgacaatggttggctaa

SEQ ID NO: 774225 - DNA, 25 bp, Mus musculus
tcccctggcgactatggttggctaa

SEQ ID NO: 774226 - DNA, 25 bp, Mus musculus
tcccctggctctacattattctatg

SEQ ID NO: 774227 - DNA, 25 bp, Mus musculus
tcccctggctcttcattattctatg

SEQ ID NO: 774228 - DNA, 25 bp, Mus musculus
tcccctggtacaagttgcctgctgc

SEQ ID NO: 774229 - DNA, 25 bp, Mus musculus
tcccctggtacatgttgcctgctgc

SEQ ID NO: 774230 - DNA, 25 bp, Mus musculus
tcccctggttcccactggtgggcag

SEQ ID NO: 774231 - DNA, 25 bp, Mus musculus
tcccctggttccgactggtgggcag

SEQ ID NO: 774232 - DNA, 25 bp, Mus musculus
tcccctgtcagcaacgagtctacgt

SEQ ID NO: 774233 - DNA, 25 bp, Mus musculus
tcccctgtcagctacgagtctacgt

SEQ ID NO: 774234 - DNA, 25 bp, Mus musculus
tcccctgtgctgacttgaaaagtgc

SEQ ID NO: 774235 - DNA, 25 bp, Mus musculus
tcccctgtgctgtcttgaaaagtgc

SEQ ID NO: 774236 - DNA, 25 bp, Mus musculus
tcccctgtgcttatctactaaaggc

SEQ ID NO: 774237 - DNA, 25 bp, Mus musculus
tcccctgtgcttttctactaaaggc

SEQ ID NO: 774238 - DNA, 25 bp, Mus musculus
tcccctgtgggcaggtgctaactaa

SEQ ID NO: 774239 - DNA, 25 bp, Mus musculus
tcccctgtgggctggtgctaactaa

SEQ ID NO: 774240 - DNA, 25 bp, Mus musculus
tcccctgtttctcaccaaaggaatt

SEQ ID NO: 774241 - DNA, 25 bp, Mus musculus
tcccctgtttctgaccaaaggaatt

SEQ ID NO: 774242 - DNA, 25 bp, Mus musculus
tccccttagaccaggagatttgcct

SEQ ID NO: 774243 - DNA, 25 bp, Mus musculus
tccccttagacctggagatttgcct

SEQ ID NO: 774244 - DNA, 25 bp, Mus musculus
tccccttggaaacagatacacgatt

SEQ ID NO: 774245 - DNA, 25 bp, Mus musculus
tccccttggaaagagatacacgatt

SEQ ID NO: 774246 - DNA, 25 bp, Mus musculus
tccccttggactagcgaacagtttg

SEQ ID NO: 774247 - DNA, 25 bp, Mus musculus
tccccttggacttgcgaacagtttg

SEQ ID NO: 774248 - DNA, 25 bp, Mus musculus
tccccttggcgaattaagggctgct

SEQ ID NO: 774249 - DNA, 25 bp, Mus musculus
tccccttggcgatttaagggctgct

SEQ ID NO: 774250 - DNA, 25 bp, Mus musculus
tccccttgtgtgacacatgtgcgac

SEQ ID NO: 774251 - DNA, 25 bp, Mus musculus
tccccttgtgtgtcacatgtgcgac

SEQ ID NO: 774252 - DNA, 25 bp, Mus musculus
tcccctttggagactggttcgagta

SEQ ID NO: 774253 - DNA, 25 bp, Mus musculus
tcccctttggagtctggttcgagta

SEQ ID NO: 774254 - DNA, 25 bp, Mus musculus
tcccctttgggaagggcatggtaaa

SEQ ID NO: 774255 - DNA, 25 bp, Mus musculus
tcccctttgggatgggcatggtaaa

SEQ ID NO: 774256 - DNA, 25 bp, Mus musculus
tcccctttgggcatactttccacag

SEQ ID NO: 774257 - DNA, 25 bp, Mus musculus
tcccctttgggcttactttccacag

SEQ ID NO: 774258 - DNA, 25 bp, Mus musculus
tcccctttttgaataagagtgacag

SEQ ID NO: 774259 - DNA, 25 bp, Mus musculus
tcccctttttgattaagagtgacag

SEQ ID NO: 774260 - DNA, 25 bp, Mus musculus
tcccgaaaatcaagcagcagtgctg

SEQ ID NO: 774261 - DNA, 25 bp, Mus musculus
tcccgaaaatcatgcagcagtgctg

SEQ ID NO: 774262 - DNA, 25 bp, Mus musculus
tcccgaaaccagctgtaaacacaga

SEQ ID NO: 774263 - DNA, 25 bp, Mus musculus
tcccgaaaccaggtgtaaacacaga

SEQ ID NO: 774264 - DNA, 25 bp, Mus musculus
tcccgaaagactcttattgcattgg

SEQ ID NO: 774265 - DNA, 25 bp, Mus musculus
tcccgaaagactgttattgcattgg

SEQ ID NO: 774266 - DNA, 25 bp, Mus musculus
tcccgaaatcatccgaagcaaggct

SEQ ID NO: 774267 - DNA, 25 bp, Mus musculus
tcccgaaatcatgcgaagcaaggct

SEQ ID NO: 774268 - DNA, 25 bp, Mus musculus
tcccgaacagagagtgtgcacggcc

SEQ ID NO: 774269 - DNA, 25 bp, Mus musculus
tcccgaacagagtgtgtgcacggcc

SEQ ID NO: 774270 - DNA, 25 bp, Mus musculus
tcccgaagaagacctgcctatgaag

SEQ ID NO: 774271 - DNA, 25 bp, Mus musculus
tcccgaagaagagctgcctatgaag

SEQ ID NO: 774272 - DNA, 25 bp, Mus musculus
tcccgaagtgcactggagatcgccc

SEQ ID NO: 774273 - DNA, 25 bp, Mus musculus
tcccgaagtgcagtggagatcgccc

SEQ ID NO: 774274 - DNA, 25 bp, Mus musculus
tcccgaattctgcacatcagcaatg

SEQ ID NO: 774275 - DNA, 25 bp, Mus musculus
tcccgaattctggacatcagcaatg

SEQ ID NO: 774276 - DNA, 25 bp, Mus musculus
tcccgacatctgcactagtgagagt

SEQ ID NO: 774277 - DNA, 25 bp, Mus musculus
tcccgacatctggactagtgagagt

SEQ ID NO: 774278 - DNA, 25 bp, Mus musculus
tcccgaccagtacctgaagatgaac

SEQ ID NO: 774279 - DNA, 25 bp, Mus musculus
tcccgaccagtagctgaagatgaac

SEQ ID NO: 774280 - DNA, 25 bp, Mus musculus
tcccgaccttgtaaagggaccatgg

SEQ ID NO: 774281 - DNA, 25 bp, Mus musculus
tcccgaccttgttaagggaccatgg

SEQ ID NO: 774282 - DNA, 25 bp, Mus musculus
tcccgacgcggtatctgggcgccag

SEQ ID NO: 774283 - DNA, 25 bp, Mus musculus
tcccgacgcggtttctgggcgccag

SEQ ID NO: 774284 - DNA, 25 bp, Mus musculus
tcccgacttgaaatacaactgctag

SEQ ID NO: 774285 - DNA, 25 bp, Mus musculus
tcccgacttgaattacaactgctag

SEQ ID NO: 774286 - DNA, 25 bp, Mus musculus
tcccgagaagggagtgtatgtcaag

SEQ ID NO: 774287 - DNA, 25 bp, Mus musculus
tcccgagaagggtgtgtatgtcaag

SEQ ID NO: 774288 - DNA, 25 bp, Mus musculus
tcccgagacaagcaaaagaacacag

SEQ ID NO: 774289 - DNA, 25 bp, Mus musculus
tcccgagacaaggaaaagaacacag

SEQ ID NO: 774290 - DNA, 25 bp, Mus musculus
tcccgagagccacacaaattgctac

SEQ ID NO: 774291 - DNA, 25 bp, Mus musculus
tcccgagagccagacaaattgctac

SEQ ID NO: 774292 - DNA, 25 bp, Mus musculus
tcccgagatgaaatggtttcctgga

SEQ ID NO: 774293 - DNA, 25 bp, Mus musculus
tcccgagatgaattggtttcctgga

SEQ ID NO: 774294 - DNA, 25 bp, Mus musculus
tcccgagatgctcttagatgatcca

SEQ ID NO: 774295 - DNA, 25 bp, Mus musculus
tcccgagatgctgttagatgatcca

SEQ ID NO: 774296 - DNA, 25 bp, Mus musculus
tcccgagcccttcgagaagtatact

SEQ ID NO: 774297 - DNA, 25 bp, Mus musculus
tcccgagcccttggagaagtatact

SEQ ID NO: 774298 - DNA, 25 bp, Mus musculus
tcccgagcgaaaccgtaagcgcctg

SEQ ID NO: 774299 - DNA, 25 bp, Mus musculus
tcccgagcgaaagcgtaagcgcctg

SEQ ID NO: 774300 - DNA, 25 bp, Mus musculus
tcccgaggaattcctggatccccag

SEQ ID NO: 774301 - DNA, 25 bp, Mus musculus
tcccgaggaattgctggatccccag

SEQ ID NO: 774302 - DNA, 25 bp, Mus musculus
tcccgaggatctacaacagctccaa

SEQ ID NO: 774303 - DNA, 25 bp, Mus musculus
tcccgaggatcttcaacagctccaa

SEQ ID NO: 774304 - DNA, 25 bp, Mus musculus
tcccgaggatggcagcaatcagcat

SEQ ID NO: 774305 - DNA, 25 bp, Mus musculus
tcccgaggatgggagcaatcagcat

SEQ ID NO: 774306 - DNA, 25 bp, Mus musculus
tcccgaggcacacaagctgtggtct

SEQ ID NO: 774307 - DNA, 25 bp, Mus musculus
tcccgaggcacagaagctgtggtct

SEQ ID NO: 774308 - DNA, 25 bp, Mus musculus
tcccgaggcctcacattcaaaattg

SEQ ID NO: 774309 - DNA, 25 bp, Mus musculus
tcccgaggcctctcattcaaaattg

SEQ ID NO: 774310 - DNA, 25 bp, Mus musculus
tcccgaggctacctgcggcttctct

SEQ ID NO: 774311 - DNA, 25 bp, Mus musculus
tcccgaggctacgtgcggcttctct

SEQ ID NO: 774312 - DNA, 25 bp, Mus musculus
tcccgaggcttgctgtgaactgact

SEQ ID NO: 774313 - DNA, 25 bp, Mus musculus
tcccgaggcttggtgtgaactgact

SEQ ID NO: 774314 - DNA, 25 bp, Mus musculus
tcccgagggagcaaaagagcagctt

SEQ ID NO: 774315 - DNA, 25 bp, Mus musculus
tcccgagggagctaaagagcagctt

SEQ ID NO: 774316 - DNA, 25 bp, Mus musculus
tcccgagggtcccatgggcacagaa

SEQ ID NO: 774317 - DNA, 25 bp, Mus musculus
tcccgagggtccgatgggcacagaa

SEQ ID NO: 774318 - DNA, 25 bp, Mus musculus
tcccgagggttcctgtccagactcg

SEQ ID NO: 774319 - DNA, 25 bp, Mus musculus
tcccgagggttcgtgtccagactcg

SEQ ID NO: 774320 - DNA, 25 bp, Mus musculus
tcccgaggtcatcatggtatgagcc

SEQ ID NO: 774321 - DNA, 25 bp, Mus musculus
tcccgaggtcatgatggtatgagcc

SEQ ID NO: 774322 - DNA, 25 bp, Mus musculus
tcccgagtacgacaggttatcaaca

SEQ ID NO: 774323 - DNA, 25 bp, Mus musculus
tcccgagtacgagaggttatcaaca

SEQ ID NO: 774324 - DNA, 25 bp, Mus musculus
tcccgagtgagccatacatagtcca

SEQ ID NO: 774325 - DNA, 25 bp, Mus musculus
tcccgagtgagcgatacatagtcca

SEQ ID NO: 774326 - DNA, 25 bp, Mus musculus
tcccgagttaccagggacagcacct

SEQ ID NO: 774327 - DNA, 25 bp, Mus musculus
tcccgagttacctgggacagcacct

SEQ ID NO: 774328 - DNA, 25 bp, Mus musculus
tcccgataagccatggccaactttt

SEQ ID NO: 774329 - DNA, 25 bp, Mus musculus
tcccgataagccttggccaactttt

SEQ ID NO: 774330 - DNA, 25 bp, Mus musculus
tcccgatgatctccagtgtaagcgg

SEQ ID NO: 774331 - DNA, 25 bp, Mus musculus
tcccgatgatctgcagtgtaagcgg

SEQ ID NO: 774332 - DNA, 25 bp, Mus musculus
tcccgatggcgacattatggtgcct

SEQ ID NO: 774333 - DNA, 25 bp, Mus musculus
tcccgatggcgagattatggtgcct

SEQ ID NO: 774334 - DNA, 25 bp, Mus musculus
tcccgatgggcaaggttcagcgtcc

SEQ ID NO: 774335 - DNA, 25 bp, Mus musculus
tcccgatgggcatggttcagcgtcc

SEQ ID NO: 774336 - DNA, 25 bp, Mus musculus
tcccgcaaacaaaaactgagactcg

SEQ ID NO: 774337 - DNA, 25 bp, Mus musculus
tcccgcaaacaataactgagactcg

SEQ ID NO: 774338 - DNA, 25 bp, Mus musculus
tcccgcacgattactggagcaaccg

SEQ ID NO: 774339 - DNA, 25 bp, Mus musculus
tcccgcacgatttctggagcaaccg

SEQ ID NO: 774340 - DNA, 25 bp, Mus musculus
tcccgcactgtgactcatggatccg

SEQ ID NO: 774341 - DNA, 25 bp, Mus musculus
tcccgcactgtgtctcatggatccg

SEQ ID NO: 774342 - DNA, 25 bp, Mus musculus
tcccgcagccatattgtattttgtg

SEQ ID NO: 774343 - DNA, 25 bp, Mus musculus
tcccgcagccattttgtattttgtg

SEQ ID NO: 774344 - DNA, 25 bp, Mus musculus
tcccgcagctggaagatgtttctca

SEQ ID NO: 774345 - DNA, 25 bp, Mus musculus
tcccgcagctggtagatgtttctca

SEQ ID NO: 774346 - DNA, 25 bp, Mus musculus
tcccgcaggcctactgtgcgctgtg

SEQ ID NO: 774347 - DNA, 25 bp, Mus musculus
tcccgcaggccttctgtgcgctgtg

SEQ ID NO: 774348 - DNA, 25 bp, Mus musculus
tcccgcagggaaagctcatggaccc

SEQ ID NO: 774349 - DNA, 25 bp, Mus musculus
tcccgcagggaatgctcatggaccc

SEQ ID NO: 774350 - DNA, 25 bp, Mus musculus
tcccgcatggtgctttctttgcgct

SEQ ID NO: 774351 - DNA, 25 bp, Mus musculus
tcccgcatggtggtttctttgcgct

SEQ ID NO: 774352 - DNA, 25 bp, Mus musculus
tcccgcatggttcgaaatgagaccc

SEQ ID NO: 774353 - DNA, 25 bp, Mus musculus
tcccgcatggttggaaatgagaccc

SEQ ID NO: 774354 - DNA, 25 bp, Mus musculus
tcccgccatcaaaaggtacttaatt

SEQ ID NO: 774355 - DNA, 25 bp, Mus musculus
tcccgccatcaataggtacttaatt

SEQ ID NO: 774356 - DNA, 25 bp, Mus musculus
tcccgccatcctatgaacaagtgat

SEQ ID NO: 774357 - DNA, 25 bp, Mus musculus
tcccgccatcctttgaacaagtgat

SEQ ID NO: 774358 - DNA, 25 bp, Mus musculus
tcccgccccagaacataggcgatgt

SEQ ID NO: 774359 - DNA, 25 bp, Mus musculus
tcccgccccagatcataggcgatgt

SEQ ID NO: 774360 - DNA, 25 bp, Mus musculus
tcccgccctgtgacgaattcgtggg

SEQ ID NO: 774361 - DNA, 25 bp, Mus musculus
tcccgccctgtgtcgaattcgtggg

SEQ ID NO: 774362 - DNA, 25 bp, Mus musculus
tcccgcccttacatggcacgtgtga

SEQ ID NO: 774363 - DNA, 25 bp, Mus musculus
tcccgcccttacttggcacgtgtga

SEQ ID NO: 774364 - DNA, 25 bp, Mus musculus
tcccgccgtggcatttgggaattgc

SEQ ID NO: 774365 - DNA, 25 bp, Mus musculus
tcccgccgtggcttttgggaattgc

SEQ ID NO: 774366 - DNA, 25 bp, Mus musculus
tcccgcctgaaacgcagatggctgt

SEQ ID NO: 774367 - DNA, 25 bp, Mus musculus
tcccgcctgaaaggcagatggctgt

SEQ ID NO: 774368 - DNA, 25 bp, Mus musculus
tcccgcctggtgctctgtaagacat

SEQ ID NO: 774369 - DNA, 25 bp, Mus musculus
tcccgcctggtggtctgtaagacat

SEQ ID NO: 774370 - DNA, 25 bp, Mus musculus
tcccgcgatggaagacgatcaggag

SEQ ID NO: 774371 - DNA, 25 bp, Mus musculus
tcccgcgatggatgacgatcaggag

SEQ ID NO: 774372 - DNA, 25 bp, Mus musculus
tcccgcggcagcatctgcggcgtaa

SEQ ID NO: 774373 - DNA, 25 bp, Mus musculus
tcccgcggcagcttctgcggcgtaa

SEQ ID NO: 774374 - DNA, 25 bp, Mus musculus
tcccgcggcccgagattaatatcac

SEQ ID NO: 774375 - DNA, 25 bp, Mus musculus
tcccgcggcccgtgattaatatcac

SEQ ID NO: 774376 - DNA, 25 bp, Mus musculus
tcccgcggctcacgctggattatgt

SEQ ID NO: 774377 - DNA, 25 bp, Mus musculus
tcccgcggctcaggctggattatgt

SEQ ID NO: 774378 - DNA, 25 bp, Mus musculus
tcccgcgtcgtcacgggaaggctct

SEQ ID NO: 774379 - DNA, 25 bp, Mus musculus
tcccgcgtcgtctcgggaaggctct

SEQ ID NO: 774380 - DNA, 25 bp, Mus musculus
tcccgcgtgggcaaagagaaggcac

SEQ ID NO: 774381 - DNA, 25 bp, Mus musculus
tcccgcgtgggctaagagaaggcac

SEQ ID NO: 774382 - DNA, 25 bp, Mus musculus
tcccgcgtgtttctgggagacacct

SEQ ID NO: 774383 - DNA, 25 bp, Mus musculus
tcccgcgtgtttgtgggagacacct

SEQ ID NO: 774384 - DNA, 25 bp, Mus musculus
tcccgctcagaacggaagagcatgt

SEQ ID NO: 774385 - DNA, 25 bp, Mus musculus
tcccgctcagaagggaagagcatgt

SEQ ID NO: 774386 - DNA, 25 bp, Mus musculus
tcccgctccctgaacgtgaacatga

SEQ ID NO: 774387 - DNA, 25 bp, Mus musculus
tcccgctccctgtacgtgaacatga

SEQ ID NO: 774388 - DNA, 25 bp, Mus musculus
tcccgctggagcatcgggcccgtgt

SEQ ID NO: 774389 - DNA, 25 bp, Mus musculus
tcccgctggagcttcgggcccgtgt

SEQ ID NO: 774390 - DNA, 25 bp, Mus musculus
tcccgctgtggtcgtagatcccggc

SEQ ID NO: 774391 - DNA, 25 bp, Mus musculus
tcccgctgtggtggtagatcccggc

SEQ ID NO: 774392 - DNA, 25 bp, Mus musculus
tcccgcttggaaactgtgcacatca

SEQ ID NO: 774393 - DNA, 25 bp, Mus musculus
tcccgcttggaatctgtgcacatca

SEQ ID NO: 774394 - DNA, 25 bp, Mus musculus
tcccggaaggaacgtgagccttcct

SEQ ID NO: 774395 - DNA, 25 bp, Mus musculus
tcccggaaggaaggtgagccttcct

SEQ ID NO: 774396 - DNA, 25 bp, Mus musculus
tcccggaaggacaactccaattctc

SEQ ID NO: 774397 - DNA, 25 bp, Mus musculus
tcccggaaggactactccaattctc

SEQ ID NO: 774398 - DNA, 25 bp, Mus musculus
tcccggaatggcacagaaagtgccc

SEQ ID NO: 774399 - DNA, 25 bp, Mus musculus
tcccggaatggctcagaaagtgccc

SEQ ID NO: 774400 - DNA, 25 bp, Mus musculus
tcccggacaagcagttagatgagag

SEQ ID NO: 774401 - DNA, 25 bp, Mus musculus
tcccggacaagctgttagatgagag

SEQ ID NO: 774402 - DNA, 25 bp, Mus musculus
tcccggacagtcaagagacccagac

SEQ ID NO: 774403 - DNA, 25 bp, Mus musculus
tcccggacagtctagagacccagac

SEQ ID NO: 774404 - DNA, 25 bp, Mus musculus
tcccggaccttcctgcaggagaatg

SEQ ID NO: 774405 - DNA, 25 bp, Mus musculus
tcccggaccttcgtgcaggagaatg

SEQ ID NO: 774406 - DNA, 25 bp, Mus musculus
tcccggacggtgacaacatctccaa

SEQ ID NO: 774407 - DNA, 25 bp, Mus musculus
tcccggacggtgtcaacatctccaa

SEQ ID NO: 774408 - DNA, 25 bp, Mus musculus
tcccggactggtcgcttgtgtagac

SEQ ID NO: 774409 - DNA, 25 bp, Mus musculus
tcccggactggtggcttgtgtagac

SEQ ID NO: 774410 - DNA, 25 bp, Mus musculus
tcccggagacagacaactggtacct

SEQ ID NO: 774411 - DNA, 25 bp, Mus musculus
tcccggagacagtcaactggtacct

SEQ ID NO: 774412 - DNA, 25 bp, Mus musculus
tcccggagaccaaaggcaggacttt

SEQ ID NO: 774413 - DNA, 25 bp, Mus musculus
tcccggagaccataggcaggacttt

SEQ ID NO: 774414 - DNA, 25 bp, Mus musculus
tcccggagacctcggttttgcacaa

SEQ ID NO: 774415 - DNA, 25 bp, Mus musculus
tcccggagacctgggttttgcacaa

SEQ ID NO: 774416 - DNA, 25 bp, Mus musculus
tcccggagaggacagtatgtactca

SEQ ID NO: 774417 - DNA, 25 bp, Mus musculus
tcccggagaggagagtatgtactca

SEQ ID NO: 774418 - DNA, 25 bp, Mus musculus
tcccggagcacaacgtggtccgcag

SEQ ID NO: 774419 - DNA, 25 bp, Mus musculus
tcccggagcacatcgtggtccgcag

SEQ ID NO: 774420 - DNA, 25 bp, Mus musculus
tcccggagcgggacaactgagagcc

SEQ ID NO: 774421 - DNA, 25 bp, Mus musculus
tcccggagcgggtcaactgagagcc

SEQ ID NO: 774422 - DNA, 25 bp, Mus musculus
tcccggagctctaccaagagaaccg

SEQ ID NO: 774423 - DNA, 25 bp, Mus musculus
tcccggagctcttccaagagaaccg

SEQ ID NO: 774424 - DNA, 25 bp, Mus musculus
tcccggagctgaagaatgacacgtt

SEQ ID NO: 774425 - DNA, 25 bp, Mus musculus
tcccggagctgatgaatgacacgtt

SEQ ID NO: 774426 - DNA, 25 bp, Mus musculus
tcccggagcttacagaaggaactgc

SEQ ID NO: 774427 - DNA, 25 bp, Mus musculus
tcccggagcttacggcctgagttcg

SEQ ID NO: 774428 - DNA, 25 bp, Mus musculus
tcccggagcttagagaaggaactgc

SEQ ID NO: 774429 - DNA, 25 bp, Mus musculus
tcccggagcttagggcctgagttcg

SEQ ID NO: 774430 - DNA, 25 bp, Mus musculus
tcccggcaaaggcttactgggcatt

SEQ ID NO: 774431 - DNA, 25 bp, Mus musculus
tcccggcaaagggttactgggcatt

SEQ ID NO: 774432 - DNA, 25 bp, Mus musculus
tcccggcagaccacctgacgtatga

SEQ ID NO: 774433 - DNA, 25 bp, Mus musculus
tcccggcagacctcctgacgtatga

SEQ ID NO: 774434 - DNA, 25 bp, Mus musculus
tcccggcagctgattttggagcgct

SEQ ID NO: 774435 - DNA, 25 bp, Mus musculus
tcccggcagctgtttttggagcgct

SEQ ID NO: 774436 - DNA, 25 bp, Mus musculus
tcccggcaggagcagcaacaacgga

SEQ ID NO: 774437 - DNA, 25 bp, Mus musculus
tcccggcaggaggagcaacaacgga

SEQ ID NO: 774438 - DNA, 25 bp, Mus musculus
tcccggccaatgagaccacactgag

SEQ ID NO: 774439 - DNA, 25 bp, Mus musculus
tcccggccaatgtgaccacactgag

SEQ ID NO: 774440 - DNA, 25 bp, Mus musculus
tcccggccaggccattggcatggct

SEQ ID NO: 774441 - DNA, 25 bp, Mus musculus
tcccggccaggcgattggcatggct

SEQ ID NO: 774442 - DNA, 25 bp, Mus musculus
tcccggcccatcagtgcaatggctg

SEQ ID NO: 774443 - DNA, 25 bp, Mus musculus
tcccggcccatctgtgcaatggctg

SEQ ID NO: 774444 - DNA, 25 bp, Mus musculus
tcccggcgctatcttgcagatcgaa

SEQ ID NO: 774445 - DNA, 25 bp, Mus musculus
tcccggcgctatgttgcagatcgaa

SEQ ID NO: 774446 - DNA, 25 bp, Mus musculus
tcccggcgtccgagtacatggagaa

SEQ ID NO: 774447 - DNA, 25 bp, Mus musculus
tcccggcgtccgtgtacatggagaa

SEQ ID NO: 774448 - DNA, 25 bp, Mus musculus
tcccggctactgagtgaaggtgctg

SEQ ID NO: 774449 - DNA, 25 bp, Mus musculus
tcccggctactgtgtgaaggtgctg

SEQ ID NO: 774450 - DNA, 25 bp, Mus musculus
tcccggctctgcaaacacgtgtttt

SEQ ID NO: 774451 - DNA, 25 bp, Mus musculus
tcccggctctgctaacacgtgtttt

SEQ ID NO: 774452 - DNA, 25 bp, Mus musculus
tcccggctgccgatctcggcagagt

SEQ ID NO: 774453 - DNA, 25 bp, Mus musculus
tcccggctgccgttctcggcagagt

SEQ ID NO: 774454 - DNA, 25 bp, Mus musculus
tcccggctggatatccgtgtgggca

SEQ ID NO: 774455 - DNA, 25 bp, Mus musculus
tcccggctggatttccgtgtgggca

SEQ ID NO: 774456 - DNA, 25 bp, Mus musculus
tcccggcttggcaagtccatactct

SEQ ID NO: 774457 - DNA, 25 bp, Mus musculus
tcccggcttggctagtccatactct

SEQ ID NO: 774458 - DNA, 25 bp, Mus musculus
tcccgggaaatgagccgagactcca

SEQ ID NO: 774459 - DNA, 25 bp, Mus musculus
tcccgggaaatgtgccgagactcca

SEQ ID NO: 774460 - DNA, 25 bp, Mus musculus
tcccgggaagccagcgataaggaaa

SEQ ID NO: 774461 - DNA, 25 bp, Mus musculus
tcccgggaagcctgcgataaggaaa

SEQ ID NO: 774462 - DNA, 25 bp, Mus musculus
tcccgggaagtcaatggacatgaga

SEQ ID NO: 774463 - DNA, 25 bp, Mus musculus
tcccgggaagtctatggacatgaga

SEQ ID NO: 774464 - DNA, 25 bp, Mus musculus
tcccgggaatacaaactagtgatgc

SEQ ID NO: 774465 - DNA, 25 bp, Mus musculus
tcccgggaatactaactagtgatgc

SEQ ID NO: 774466 - DNA, 25 bp, Mus musculus
tcccgggagcccatggccgactgaa

SEQ ID NO: 774467 - DNA, 25 bp, Mus musculus
tcccgggagcccttggccgactgaa

SEQ ID NO: 774468 - DNA, 25 bp, Mus musculus
tcccgggagtgaacctgacatgtct

SEQ ID NO: 774469 - DNA, 25 bp, Mus musculus
tcccgggagtgatcctgacatgtct

SEQ ID NO: 774470 - DNA, 25 bp, Mus musculus
tcccgggatatgagcaagaccttgc

SEQ ID NO: 774471 - DNA, 25 bp, Mus musculus
tcccgggatatgtgcaagaccttgc

SEQ ID NO: 774472 - DNA, 25 bp, Mus musculus
tcccgggcaagaaagatacagcgct

SEQ ID NO: 774473 - DNA, 25 bp, Mus musculus
tcccgggcaagatagatacagcgct

SEQ ID NO: 774474 - DNA, 25 bp, Mus musculus
tcccgggcaccacgaaggtgcatgc

SEQ ID NO: 774475 - DNA, 25 bp, Mus musculus
tcccgggcaccaggaaggtgcatgc

SEQ ID NO: 774476 - DNA, 25 bp, Mus musculus
tcccgggcaggaagcgtctctgcca

SEQ ID NO: 774477 - DNA, 25 bp, Mus musculus
tcccgggcaggatgcgtctctgcca

SEQ ID NO: 774478 - DNA, 25 bp, Mus musculus
tcccgggccagcctgttctttaagc

SEQ ID NO: 774479 - DNA, 25 bp, Mus musculus
tcccgggccagcgtgttctttaagc

SEQ ID NO: 774480 - DNA, 25 bp, Mus musculus
tcccgggcggaactgcctgtccagt

SEQ ID NO: 774481 - DNA, 25 bp, Mus musculus
tcccgggcggaagtgcctgtccagt

SEQ ID NO: 774482 - DNA, 25 bp, Mus musculus
tcccgggctacaagggccttcaggc

SEQ ID NO: 774483 - DNA, 25 bp, Mus musculus
tcccgggctacatgggccttcaggc

SEQ ID NO: 774484 - DNA, 25 bp, Mus musculus
tcccgggtgggtctgcagaacctta

SEQ ID NO: 774485 - DNA, 25 bp, Mus musculus
tcccgggtgggtgtgcagaacctta

SEQ ID NO: 774486 - DNA, 25 bp, Mus musculus
tcccgggtgttactgagaacgttct

SEQ ID NO: 774487 - DNA, 25 bp, Mus musculus
tcccgggtgttagtgagaacgttct

SEQ ID NO: 774488 - DNA, 25 bp, Mus musculus
tcccggtccagtaaagagaagatcc

SEQ ID NO: 774489 - DNA, 25 bp, Mus musculus
tcccggtccagttaagagaagatcc

SEQ ID NO: 774490 - DNA, 25 bp, Mus musculus
tcccggtctccgctcattgggcagg

SEQ ID NO: 774491 - DNA, 25 bp, Mus musculus
tcccggtctccggtcattgggcagg

SEQ ID NO: 774492 - DNA, 25 bp, Mus musculus
tcccggtgatctcccaggtggagca

SEQ ID NO: 774493 - DNA, 25 bp, Mus musculus
tcccggtgatctgccaggtggagca

SEQ ID NO: 774494 - DNA, 25 bp, Mus musculus
tcccggtgctgtatacctatgacaa

SEQ ID NO: 774495 - DNA, 25 bp, Mus musculus
tcccggtgctgtttacctatgacaa

SEQ ID NO: 774496 - DNA, 25 bp, Mus musculus
tcccggtggaacaaaggagtgagat

SEQ ID NO: 774497 - DNA, 25 bp, Mus musculus
tcccggtggaactaaggagtgagat

SEQ ID NO: 774498 - DNA, 25 bp, Mus musculus
tcccggtggcccctttgctgctgtg

SEQ ID NO: 774499 - DNA, 25 bp, Mus musculus
tcccggtggcccgtttgctgctgtg

SEQ ID NO: 774500 - DNA, 25 bp, Mus musculus
tcccggttcccaactgcaatggtgg

SEQ ID NO: 774501 - DNA, 25 bp, Mus musculus
tcccggttcccatctgcaatggtgg

SEQ ID NO: 774502 - DNA, 25 bp, Mus musculus
tcccggtttcccacctgcagagaaa

SEQ ID NO: 774503 - DNA, 25 bp, Mus musculus
tcccggtttccctcctgcagagaaa

SEQ ID NO: 774504 - DNA, 25 bp, Mus musculus
tcccgtaattttccaaatgatgcta

SEQ ID NO: 774505 - DNA, 25 bp, Mus musculus
tcccgtaattttgcaaatgatgcta

SEQ ID NO: 774506 - DNA, 25 bp, Mus musculus
tcccgtacctctcctacaaaaatgg

SEQ ID NO: 774507 - DNA, 25 bp, Mus musculus
tcccgtacctctgctacaaaaatgg

SEQ ID NO: 774508 - DNA, 25 bp, Mus musculus
tcccgtactgggagaagacctttga

SEQ ID NO: 774509 - DNA, 25 bp, Mus musculus
tcccgtactgggtgaagacctttga

SEQ ID NO: 774510 - DNA, 25 bp, Mus musculus
tcccgtattctgctgcaatcctcta

SEQ ID NO: 774511 - DNA, 25 bp, Mus musculus
tcccgtattctggtgcaatcctcta

SEQ ID NO: 774512 - DNA, 25 bp, Mus musculus
tcccgtcagcaccttgacgaatatc

SEQ ID NO: 774513 - DNA, 25 bp, Mus musculus
tcccgtcagcacgttgacgaatatc

SEQ ID NO: 774514 - DNA, 25 bp, Mus musculus
tcccgtcattttaccgagtctcgga

SEQ ID NO: 774515 - DNA, 25 bp, Mus musculus
tcccgtcatttttccgagtctcgga

SEQ ID NO: 774516 - DNA, 25 bp, Mus musculus
tcccgtcggactaccatttcagtgc

SEQ ID NO: 774517 - DNA, 25 bp, Mus musculus
tcccgtcggacttccatttcagtgc

SEQ ID NO: 774518 - DNA, 25 bp, Mus musculus
tcccgtctagggaggacatgtcaca

SEQ ID NO: 774519 - DNA, 25 bp, Mus musculus
tcccgtctagggtggacatgtcaca

SEQ ID NO: 774520 - DNA, 25 bp, Mus musculus
tcccgtgaagcgaatgcgcagcgag

SEQ ID NO: 774521 - DNA, 25 bp, Mus musculus
tcccgtgaagcgtatgcgcagcgag

SEQ ID NO: 774522 - DNA, 25 bp, Mus musculus
tcccgtgaagctcccatggagcaca

SEQ ID NO: 774523 - DNA, 25 bp, Mus musculus
tcccgtgaagctgccatggagcaca

SEQ ID NO: 774524 - DNA, 25 bp, Mus musculus
tcccgtgactgcagatccttggttg

SEQ ID NO: 774525 - DNA, 25 bp, Mus musculus
tcccgtgactgctgatccttggttg

SEQ ID NO: 774526 - DNA, 25 bp, Mus musculus
tcccgtgagttaccatcagatgaag

SEQ ID NO: 774527 - DNA, 25 bp, Mus musculus
tcccgtgagttagcatcagatgaag

SEQ ID NO: 774528 - DNA, 25 bp, Mus musculus
tcccgtgctagcaaagatggttcct

SEQ ID NO: 774529 - DNA, 25 bp, Mus musculus
tcccgtgctagctaagatggttcct

SEQ ID NO: 774530 - DNA, 25 bp, Mus musculus
tcccgtggacagagagcagttgcgc

SEQ ID NO: 774531 - DNA, 25 bp, Mus musculus
tcccgtggacagtgagcagttgcgc

SEQ ID NO: 774532 - DNA, 25 bp, Mus musculus
tcccgtggaggaactttttaagctg

SEQ ID NO: 774533 - DNA, 25 bp, Mus musculus
tcccgtggaggaatacctggtgcat

SEQ ID NO: 774534 - DNA, 25 bp, Mus musculus
tcccgtggaggatctttttaagctg

SEQ ID NO: 774535 - DNA, 25 bp, Mus musculus
tcccgtggaggattacctggtgcat

SEQ ID NO: 774536 - DNA, 25 bp, Mus musculus
tcccgtggccttatggagcaaggac

SEQ ID NO: 774537 - DNA, 25 bp, Mus musculus
tcccgtggccttttggagcaaggac

SEQ ID NO: 774538 - DNA, 25 bp, Mus musculus
tcccgtgtgccacgatgattggagt

SEQ ID NO: 774539 - DNA, 25 bp, Mus musculus
tcccgtgtgccaggatgattggagt

SEQ ID NO: 774540 - DNA, 25 bp, Mus musculus
tcccgtgtgcctcgaagtattcgag

SEQ ID NO: 774541 - DNA, 25 bp, Mus musculus
tcccgtgtgcctggaagtattcgag

SEQ ID NO: 774542 - DNA, 25 bp, Mus musculus
tcccgtgtgcgaaacaagccctatg

SEQ ID NO: 774543 - DNA, 25 bp, Mus musculus
tcccgtgtgcgatacaagccctatg

SEQ ID NO: 774544 - DNA, 25 bp, Mus musculus
tcccgtgttgtcactcaattttgct

SEQ ID NO: 774545 - DNA, 25 bp, Mus musculus
tcccgtgttgtctctcaattttgct

SEQ ID NO: 774546 - DNA, 25 bp, Mus musculus
tcccgttactctcatcaacttctgg

SEQ ID NO: 774547 - DNA, 25 bp, Mus musculus
tcccgttactctgatcaacttctgg

SEQ ID NO: 774548 - DNA, 25 bp, Mus musculus
tcccgttgccgacagctggtgctat

SEQ ID NO: 774549 - DNA, 25 bp, Mus musculus
tcccgttgccgagagctggtgctat

SEQ ID NO: 774550 - DNA, 25 bp, Mus musculus
tcccgttgcctgctatgaagatcgt

SEQ ID NO: 774551 - DNA, 25 bp, Mus musculus
tcccgttgcctggtatgaagatcgt

SEQ ID NO: 774552 - DNA, 25 bp, Mus musculus
tcccgttggaaaacgcacctattgg

SEQ ID NO: 774553 - DNA, 25 bp, Mus musculus
tcccgttggaaatcgcacctattgg

SEQ ID NO: 774554 - DNA, 25 bp, Mus musculus
tcccgtttaaacaaagatgagtatg

SEQ ID NO: 774555 - DNA, 25 bp, Mus musculus
tcccgtttaaactaagatgagtatg

SEQ ID NO: 774556 - DNA, 25 bp, Mus musculus
tcccgtttggtgcatgagacaggca

SEQ ID NO: 774557 - DNA, 25 bp, Mus musculus
tcccgtttggtggatgagacaggca

SEQ ID NO: 774558 - DNA, 25 bp, Mus musculus
tccctaaaaacacccataagaaggg

SEQ ID NO: 774559 - DNA, 25 bp, Mus musculus
tccctaaaaacagccataagaaggg

SEQ ID NO: 774560 - DNA, 25 bp, Mus musculus
tccctaaaagaactagtcctgctcg

SEQ ID NO: 774561 - DNA, 25 bp, Mus musculus
tccctaaaagaagtagtcctgctcg

SEQ ID NO: 774562 - DNA, 25 bp, Mus musculus
tccctaaaatcaaccgctctatgca

SEQ ID NO: 774563 - DNA, 25 bp, Mus musculus
tccctaaaatcatccgctctatgca

SEQ ID NO: 774564 - DNA, 25 bp, Mus musculus
tccctaaagataccagatcgaaggc

SEQ ID NO: 774565 - DNA, 25 bp, Mus musculus
tccctaaagatagcagatcgaaggc

SEQ ID NO: 774566 - DNA, 25 bp, Mus musculus
tccctaaaggacctgcgtgcgtgcg

SEQ ID NO: 774567 - DNA, 25 bp, Mus musculus
tccctaaaggacgtgcgtgcgtgcg

SEQ ID NO: 774568 - DNA, 25 bp, Mus musculus
tccctaaaggtgaggctgattgatg

SEQ ID NO: 774569 - DNA, 25 bp, Mus musculus
tccctaaaggtgtggctgattgatg

SEQ ID NO: 774570 - DNA, 25 bp, Mus musculus
tccctaacacagacaactgtaatgg

SEQ ID NO: 774571 - DNA, 25 bp, Mus musculus
tccctaacacagtcaactgtaatgg

SEQ ID NO: 774572 - DNA, 25 bp, Mus musculus
tccctaacaggaatttgctttgtat

SEQ ID NO: 774573 - DNA, 25 bp, Mus musculus
tccctaacaggattttgctttgtat

SEQ ID NO: 774574 - DNA, 25 bp, Mus musculus
tccctaacgagcaggacgtgcttcg

SEQ ID NO: 774575 - DNA, 25 bp, Mus musculus
tccctaacgagctggacgtgcttcg

SEQ ID NO: 774576 - DNA, 25 bp, Mus musculus
tccctaagaaagagaacgagctatg

SEQ ID NO: 774577 - DNA, 25 bp, Mus musculus
tccctaagaaagtgaacgagctatg

SEQ ID NO: 774578 - DNA, 25 bp, Mus musculus
tccctaaggaagcacctccctgagt

SEQ ID NO: 774579 - DNA, 25 bp, Mus musculus
tccctaaggaaggacctccctgagt

SEQ ID NO: 774580 - DNA, 25 bp, Mus musculus
tccctaataggaactgctcgcgtta

SEQ ID NO: 774581 - DNA, 25 bp, Mus musculus
tccctaataggatctgctcgcgtta

SEQ ID NO: 774582 - DNA, 25 bp, Mus musculus
tccctaatgagaccccgggagttgg

SEQ ID NO: 774583 - DNA, 25 bp, Mus musculus
tccctaatgagagcccgggagttgg

SEQ ID NO: 774584 - DNA, 25 bp, Mus musculus
tccctaattgccagatcagattggc

SEQ ID NO: 774585 - DNA, 25 bp, Mus musculus
tccctaattgcctgatcagattggc

SEQ ID NO: 774586 - DNA, 25 bp, Mus musculus
tccctacagagaagatataatgtcc

SEQ ID NO: 774587 - DNA, 25 bp, Mus musculus
tccctacagagatgatataatgtcc

SEQ ID NO: 774588 - DNA, 25 bp, Mus musculus
tccctacagattcacgtcttaacag

SEQ ID NO: 774589 - DNA, 25 bp, Mus musculus
tccctacagattgacgtcttaacag

SEQ ID NO: 774590 - DNA, 25 bp, Mus musculus
tccctacctgctctatggagcaggc

SEQ ID NO: 774591 - DNA, 25 bp, Mus musculus
tccctacctgctgtatggagcaggc

SEQ ID NO: 774592 - DNA, 25 bp, Mus musculus
tccctacgggtcagtggaaactgtc

SEQ ID NO: 774593 - DNA, 25 bp, Mus musculus
tccctacgggtctgtggaaactgtc

SEQ ID NO: 774594 - DNA, 25 bp, Mus musculus
tccctacgtggtcgagtgtacaggc

SEQ ID NO: 774595 - DNA, 25 bp, Mus musculus
tccctacgtggtggagtgtacaggc

SEQ ID NO: 774596 - DNA, 25 bp, Mus musculus
tccctactcaacatgttctggagag

SEQ ID NO: 774597 - DNA, 25 bp, Mus musculus
tccctactcaacttgttctggagag

SEQ ID NO: 774598 - DNA, 25 bp, Mus musculus
tccctactggtgcacctggcttaga

SEQ ID NO: 774599 - DNA, 25 bp, Mus musculus
tccctactggtggacctggcttaga

SEQ ID NO: 774600 - DNA, 25 bp, Mus musculus
tccctacttgcaagtgagggaggcc

SEQ ID NO: 774601 - DNA, 25 bp, Mus musculus
tccctacttgcatgtgagggaggcc

SEQ ID NO: 774602 - DNA, 25 bp, Mus musculus
tccctagagagcccttgggttttgc

SEQ ID NO: 774603 - DNA, 25 bp, Mus musculus
tccctagagagcgcttgggttttgc

SEQ ID NO: 774604 - DNA, 25 bp, Mus musculus
tccctagcagagagaatgaatgcag

SEQ ID NO: 774605 - DNA, 25 bp, Mus musculus
tccctagcagagtgaatgaatgcag

SEQ ID NO: 774606 - DNA, 25 bp, Mus musculus
tccctagcaggacaacaagaagatt

SEQ ID NO: 774607 - DNA, 25 bp, Mus musculus
tccctagcaggagaacaagaagatt

SEQ ID NO: 774608 - DNA, 25 bp, Mus musculus
tccctagctgggaagacatcgcgct

SEQ ID NO: 774609 - DNA, 25 bp, Mus musculus
tccctagctgggtagacatcgcgct

SEQ ID NO: 774610 - DNA, 25 bp, Mus musculus
tccctaggacggattttcattgttt

SEQ ID NO: 774611 - DNA, 25 bp, Mus musculus
tccctaggacggtttttcattgttt

SEQ ID NO: 774612 - DNA, 25 bp, Mus musculus
tccctaggcctgagtgaactttacc

SEQ ID NO: 774613 - DNA, 25 bp, Mus musculus
tccctaggcctgtgtgaactttacc

SEQ ID NO: 774614 - DNA, 25 bp, Mus musculus
tccctagggtccaagagaacactct

SEQ ID NO: 774615 - DNA, 25 bp, Mus musculus
tccctagggtcctagagaacactct

SEQ ID NO: 774616 - DNA, 25 bp, Mus musculus
tccctaggtcctacgcgttgcagtt

SEQ ID NO: 774617 - DNA, 25 bp, Mus musculus
tccctaggtccttcgcgttgcagtt

SEQ ID NO: 774618 - DNA, 25 bp, Mus musculus
tccctaggtcttactctgccttaaa

SEQ ID NO: 774619 - DNA, 25 bp, Mus musculus
tccctaggtctttctctgccttaaa

SEQ ID NO: 774620 - DNA, 25 bp, Mus musculus
tccctagtgaagcagcagtgggtac

SEQ ID NO: 774621 - DNA, 25 bp, Mus musculus
tccctagtgaaggagcagtgggtac

SEQ ID NO: 774622 - DNA, 25 bp, Mus musculus
tccctagtgcagacaaaggaaatgt

SEQ ID NO: 774623 - DNA, 25 bp, Mus musculus
tccctagtgcagtcaaaggaaatgt

SEQ ID NO: 774624 - DNA, 25 bp, Mus musculus
tccctagtggctcatgagaacccct

SEQ ID NO: 774625 - DNA, 25 bp, Mus musculus
tccctagtggctgatgagaacccct

SEQ ID NO: 774626 - DNA, 25 bp, Mus musculus
tccctatagtggaaagatccacttc

SEQ ID NO: 774627 - DNA, 25 bp, Mus musculus
tccctatagtggtaagatccacttc

SEQ ID NO: 774628 - DNA, 25 bp, Mus musculus
tccctatcgggtcagttagcacacc

SEQ ID NO: 774629 - DNA, 25 bp, Mus musculus
tccctatcgggtgagttagcacacc

SEQ ID NO: 774630 - DNA, 25 bp, Mus musculus
tccctatctctaagattggagcttc

SEQ ID NO: 774631 - DNA, 25 bp, Mus musculus
tccctatctctatgattggagcttc

SEQ ID NO: 774632 - DNA, 25 bp, Mus musculus
tccctatctgtgacctgtcttcaag

SEQ ID NO: 774633 - DNA, 25 bp, Mus musculus
tccctatctgtgtcctgtcttcaag

SEQ ID NO: 774634 - DNA, 25 bp, Mus musculus
tccctatgagtgctataatccacac

SEQ ID NO: 774635 - DNA, 25 bp, Mus musculus
tccctatgagtggtataatccacac

SEQ ID NO: 774636 - DNA, 25 bp, Mus musculus
tccctatgtaaacattcacctgatg

SEQ ID NO: 774637 - DNA, 25 bp, Mus musculus
tccctatgtaaagattcacctgatg

SEQ ID NO: 774638 - DNA, 25 bp, Mus musculus
tccctattcaagagcagagccgcat

SEQ ID NO: 774639 - DNA, 25 bp, Mus musculus
tccctattcaagtgcagagccgcat

SEQ ID NO: 774640 - DNA, 25 bp, Mus musculus
tccctattggccctgattgtggcct

SEQ ID NO: 774641 - DNA, 25 bp, Mus musculus
tccctattggccgtgattgtggcct

SEQ ID NO: 774642 - DNA, 25 bp, Mus musculus
tccctcaacagcatccgttcggaga

SEQ ID NO: 774643 - DNA, 25 bp, Mus musculus
tccctcaacagcttccgttcggaga

SEQ ID NO: 774644 - DNA, 25 bp, Mus musculus
tccctcaaggttcacgtccgggtgg

SEQ ID NO: 774645 - DNA, 25 bp, Mus musculus
tccctcaaggttgacgtccgggtgg

SEQ ID NO: 774646 - DNA, 25 bp, Mus musculus
tccctcaatggaacataccatgtca

SEQ ID NO: 774647 - DNA, 25 bp, Mus musculus
tccctcaatggatcataccatgtca

SEQ ID NO: 774648 - DNA, 25 bp, Mus musculus
tccctcacaggccaagaactacatg

SEQ ID NO: 774649 - DNA, 25 bp, Mus musculus
tccctcacaggcgaagaactacatg

SEQ ID NO: 774650 - DNA, 25 bp, Mus musculus
tccctcacaggtatggatgtattgt

SEQ ID NO: 774651 - DNA, 25 bp, Mus musculus
tccctcacaggtttggatgtattgt

SEQ ID NO: 774652 - DNA, 25 bp, Mus musculus
tccctcactctcactgtgtgaaagt

SEQ ID NO: 774653 - DNA, 25 bp, Mus musculus
tccctcactctctctgtgtgaaagt

SEQ ID NO: 774654 - DNA, 25 bp, Mus musculus
tccctcagaacaagacccaagagga

SEQ ID NO: 774655 - DNA, 25 bp, Mus musculus
tccctcagaacatgacccaagagga

SEQ ID NO: 774656 - DNA, 25 bp, Mus musculus
tccctcagcacacgatcgaaacgta

SEQ ID NO: 774657 - DNA, 25 bp, Mus musculus
tccctcagcacaggatcgaaacgta

SEQ ID NO: 774658 - DNA, 25 bp, Mus musculus
tccctcagcagccacggactgaaga

SEQ ID NO: 774659 - DNA, 25 bp, Mus musculus
tccctcagcagcgacggactgaaga

SEQ ID NO: 774660 - DNA, 25 bp, Mus musculus
tccctcaggactctagagaagatgg

SEQ ID NO: 774661 - DNA, 25 bp, Mus musculus
tccctcaggactgtagagaagatgg

SEQ ID NO: 774662 - DNA, 25 bp, Mus musculus
tccctcagggcgagaaagtctacga

SEQ ID NO: 774663 - DNA, 25 bp, Mus musculus
tccctcagggcgtgaaagtctacga

SEQ ID NO: 774664 - DNA, 25 bp, Mus musculus
tccctcagggtgatcgtgaatgccg

SEQ ID NO: 774665 - DNA, 25 bp, Mus musculus
tccctcagggtgttcgtgaatgccg

SEQ ID NO: 774666 - DNA, 25 bp, Mus musculus
tccctcagtcagaggcgccgaaggc

SEQ ID NO: 774667 - DNA, 25 bp, Mus musculus
tccctcagtcagtggcgccgaaggc

SEQ ID NO: 774668 - DNA, 25 bp, Mus musculus
tccctcagtggacgtatttgaaggg

SEQ ID NO: 774669 - DNA, 25 bp, Mus musculus
tccctcagtggaggtatttgaaggg

SEQ ID NO: 774670 - DNA, 25 bp, Mus musculus
tccctcagtgtgattggagaataaa

SEQ ID NO: 774671 - DNA, 25 bp, Mus musculus
tccctcagtgtgtttggagaataaa

SEQ ID NO: 774672 - DNA, 25 bp, Mus musculus
tccctcatctgacaaggcagagttc

SEQ ID NO: 774673 - DNA, 25 bp, Mus musculus
tccctcatctgagaaggcagagttc

SEQ ID NO: 774674 - DNA, 25 bp, Mus musculus
tccctcatggtgagatgcccaggca

SEQ ID NO: 774675 - DNA, 25 bp, Mus musculus
tccctcatggtgtgatgcccaggca

SEQ ID NO: 774676 - DNA, 25 bp, Mus musculus
tccctccaaaggatctaagaatcaa

SEQ ID NO: 774677 - DNA, 25 bp, Mus musculus
tccctccaaaggttctaagaatcaa

SEQ ID NO: 774678 - DNA, 25 bp, Mus musculus
tccctccagctgattgacgcgggtc

SEQ ID NO: 774679 - DNA, 25 bp, Mus musculus
tccctccagctgtttgacgcgggtc

SEQ ID NO: 774680 - DNA, 25 bp, Mus musculus
tccctccagtaactgctacatgtgc

SEQ ID NO: 774681 - DNA, 25 bp, Mus musculus
tccctccagtaagtgctacatgtgc

SEQ ID NO: 774682 - DNA, 25 bp, Mus musculus
tccctcccatagagtcatgcaaggg

SEQ ID NO: 774683 - DNA, 25 bp, Mus musculus
tccctcccatagtgtcatgcaaggg

SEQ ID NO: 774684 - DNA, 25 bp, Mus musculus
tccctccctggtaagaggacccagt

SEQ ID NO: 774685 - DNA, 25 bp, Mus musculus
tccctccctggttagaggacccagt

SEQ ID NO: 774686 - DNA, 25 bp, Mus musculus
tccctccggagcaggcagtttcttc

SEQ ID NO: 774687 - DNA, 25 bp, Mus musculus
tccctccggagctggcagtttcttc

SEQ ID NO: 774688 - DNA, 25 bp, Mus musculus
tccctccgggacaggaggctgtcag

SEQ ID NO: 774689 - DNA, 25 bp, Mus musculus
tccctccgggactggaggctgtcag

SEQ ID NO: 774690 - DNA, 25 bp, Mus musculus
tccctcctcaccctgcgatcgtggg

SEQ ID NO: 774691 - DNA, 25 bp, Mus musculus
tccctcctcaccgtgcgatcgtggg

SEQ ID NO: 774692 - DNA, 25 bp, Mus musculus
tccctcctgaaaagttgtcagactc

SEQ ID NO: 774693 - DNA, 25 bp, Mus musculus
tccctcctgaaatgttgtcagactc

SEQ ID NO: 774694 - DNA, 25 bp, Mus musculus
tccctcctgatgcaggtgcttctgt

SEQ ID NO: 774695 - DNA, 25 bp, Mus musculus
tccctcctgatggaggtgcttctgt

SEQ ID NO: 774696 - DNA, 25 bp, Mus musculus
tccctcgagtatctgcagttcatgg

SEQ ID NO: 774697 - DNA, 25 bp, Mus musculus
tccctcgagtatgtgcagttcatgg

SEQ ID NO: 774698 - DNA, 25 bp, Mus musculus
tccctcggtacgactccgctatgag

SEQ ID NO: 774699 - DNA, 25 bp, Mus musculus
tccctcggtacgtctccgctatgag

SEQ ID NO: 774700 - DNA, 25 bp, Mus musculus
tccctcggtggcagaaacttagact

SEQ ID NO: 774701 - DNA, 25 bp, Mus musculus
tccctcggtggctgaaacttagact

SEQ ID NO: 774702 - DNA, 25 bp, Mus musculus
tccctcgtttaaacgggcattctgc

SEQ ID NO: 774703 - DNA, 25 bp, Mus musculus
tccctcgtttaatcgggcattctgc

SEQ ID NO: 774704 - DNA, 25 bp, Mus musculus
tccctctaacctagagatatgccct

SEQ ID NO: 774705 - DNA, 25 bp, Mus musculus
tccctctaaccttgagatatgccct

SEQ ID NO: 774706 - DNA, 25 bp, Mus musculus
tccctctataacagccagcgagata

SEQ ID NO: 774707 - DNA, 25 bp, Mus musculus
tccctctataactgccagcgagata

SEQ ID NO: 774708 - DNA, 25 bp, Mus musculus
tccctctctgaaccatcagtggctg

SEQ ID NO: 774709 - DNA, 25 bp, Mus musculus
tccctctctgaagcatcagtggctg

SEQ ID NO: 774710 - DNA, 25 bp, Mus musculus
tccctctctgctccggtaaggcctg

SEQ ID NO: 774711 - DNA, 25 bp, Mus musculus
tccctctctgctgcggtaaggcctg

SEQ ID NO: 774712 - DNA, 25 bp, Mus musculus
tccctctgagcaagtacaggatgtc

SEQ ID NO: 774713 - DNA, 25 bp, Mus musculus
tccctctgagcatgtacaggatgtc

SEQ ID NO: 774714 - DNA, 25 bp, Mus musculus
tccctctgccaaaagattgagcagt

SEQ ID NO: 774715 - DNA, 25 bp, Mus musculus
tccctctgccaatagattgagcagt

SEQ ID NO: 774716 - DNA, 25 bp, Mus musculus
tccctctggagactttgcatatctc

SEQ ID NO: 774717 - DNA, 25 bp, Mus musculus
tccctctggagagtttgcatatctc

SEQ ID NO: 774718 - DNA, 25 bp, Mus musculus
tccctctgtgggacacggaatgaaa

SEQ ID NO: 774719 - DNA, 25 bp, Mus musculus
tccctctgtgggtcacggaatgaaa

SEQ ID NO: 774720 - DNA, 25 bp, Mus musculus
tccctcttaaataaggatttgtcct

SEQ ID NO: 774721 - DNA, 25 bp, Mus musculus
tccctcttaaattaggatttgtcct

SEQ ID NO: 774722 - DNA, 25 bp, Mus musculus
tccctctttggcacacttggaaact

SEQ ID NO: 774723 - DNA, 25 bp, Mus musculus
tccctctttggctcacttggaaact

SEQ ID NO: 774724 - DNA, 25 bp, Mus musculus
tccctgaaaaaactcaatcacgcca

SEQ ID NO: 774725 - DNA, 25 bp, Mus musculus
tccctgaaaaaagtcaatcacgcca

SEQ ID NO: 774726 - DNA, 25 bp, Mus musculus
tccctgaaacgaatcaagaggtctg

SEQ ID NO: 774727 - DNA, 25 bp, Mus musculus
tccctgaaacgattcaagaggtctg

SEQ ID NO: 774728 - DNA, 25 bp, Mus musculus
tccctgaaactgaagaaacggtggt

SEQ ID NO: 774729 - DNA, 25 bp, Mus musculus
tccctgaaactgtagaaacggtggt

SEQ ID NO: 774730 - DNA, 25 bp, Mus musculus
tccctgaaccaaactcttccggagt

SEQ ID NO: 774731 - DNA, 25 bp, Mus musculus
tccctgaaccaatctcttccggagt

SEQ ID NO: 774732 - DNA, 25 bp, Mus musculus
tccctgaactatctgtgaattgagc

SEQ ID NO: 774733 - DNA, 25 bp, Mus musculus
tccctgaactatgtgtgaattgagc

SEQ ID NO: 774734 - DNA, 25 bp, Mus musculus
tccctgaagaaactcgacagatact

SEQ ID NO: 774735 - DNA, 25 bp, Mus musculus
tccctgaagaaagtcgacagatact

SEQ ID NO: 774736 - DNA, 25 bp, Mus musculus
tccctgaagtgacggatgagtataa

SEQ ID NO: 774737 - DNA, 25 bp, Mus musculus
tccctgaagtgagggatgagtataa

SEQ ID NO: 774738 - DNA, 25 bp, Mus musculus
tccctgaatttaaggaaagtgatgc

SEQ ID NO: 774739 - DNA, 25 bp, Mus musculus
tccctgaatttatggaaagtgatgc

SEQ ID NO: 774740 - DNA, 25 bp, Mus musculus
tccctgacaataaagaccaggtgat

SEQ ID NO: 774741 - DNA, 25 bp, Mus musculus
tccctgacaatatagaccaggtgat

SEQ ID NO: 774742 - DNA, 25 bp, Mus musculus
tccctgacatccaagagatccgagt

SEQ ID NO: 774743 - DNA, 25 bp, Mus musculus
tccctgacatcctagagatccgagt

SEQ ID NO: 774744 - DNA, 25 bp, Mus musculus
tccctgaccatcagtttccctgagt

SEQ ID NO: 774745 - DNA, 25 bp, Mus musculus
tccctgaccatctgtttccctgagt

SEQ ID NO: 774746 - DNA, 25 bp, Mus musculus
tccctgaccatgacatccacatgga

SEQ ID NO: 774747 - DNA, 25 bp, Mus musculus
tccctgaccatgtcatccacatgga

SEQ ID NO: 774748 - DNA, 25 bp, Mus musculus
tccctgaccctgagagaggacaact

SEQ ID NO: 774749 - DNA, 25 bp, Mus musculus
tccctgaccctgtgagaggacaact

SEQ ID NO: 774750 - DNA, 25 bp, Mus musculus
tccctgactctgagggtcggtctct

SEQ ID NO: 774751 - DNA, 25 bp, Mus musculus
tccctgactctgtgggtcggtctct

SEQ ID NO: 774752 - DNA, 25 bp, Mus musculus
tccctgagaacacggtggacgtcat

SEQ ID NO: 774753 - DNA, 25 bp, Mus musculus
tccctgagaacagggtggacgtcat

SEQ ID NO: 774754 - DNA, 25 bp, Mus musculus
tccctgagagtcataaggcatggac

SEQ ID NO: 774755 - DNA, 25 bp, Mus musculus
tccctgagagtcttaaggcatggac

SEQ ID NO: 774756 - DNA, 25 bp, Mus musculus
tccctgagcggacgataagcagcat

SEQ ID NO: 774757 - DNA, 25 bp, Mus musculus
tccctgagcggaggataagcagcat

SEQ ID NO: 774758 - DNA, 25 bp, Mus musculus
tccctgagctccatgcctggcaaga

SEQ ID NO: 774759 - DNA, 25 bp, Mus musculus
tccctgagctccttgcctggcaaga

SEQ ID NO: 774760 - DNA, 25 bp, Mus musculus
tccctgagctgcagagagtctcggg

SEQ ID NO: 774761 - DNA, 25 bp, Mus musculus
tccctgagctgctgagagtctcggg

SEQ ID NO: 774762 - DNA, 25 bp, Mus musculus
tccctgagctggacgggaagacagc

SEQ ID NO: 774763 - DNA, 25 bp, Mus musculus
tccctgagctggtcgggaagacagc

SEQ ID NO: 774764 - DNA, 25 bp, Mus musculus
tccctgaggaagagcggcttttctc

SEQ ID NO: 774765 - DNA, 25 bp, Mus musculus
tccctgaggaagtgcggcttttctc

SEQ ID NO: 774766 - DNA, 25 bp, Mus musculus
tccctgagggacaggaatgtgccag

SEQ ID NO: 774767 - DNA, 25 bp, Mus musculus
tccctgagggactggaatgtgccag

SEQ ID NO: 774768 - DNA, 25 bp, Mus musculus
tccctgagggatcgtactgaatttc

SEQ ID NO: 774769 - DNA, 25 bp, Mus musculus
tccctgagggatggtactgaatttc

SEQ ID NO: 774770 - DNA, 25 bp, Mus musculus
tccctgagggcgctgagacagactt

SEQ ID NO: 774771 - DNA, 25 bp, Mus musculus
tccctgagggcggtgagacagactt

SEQ ID NO: 774772 - DNA, 25 bp, Mus musculus
tccctgaggtgacacttcgaggttc

SEQ ID NO: 774773 - DNA, 25 bp, Mus musculus
tccctgaggtgagacttcgaggttc

SEQ ID NO: 774774 - DNA, 25 bp, Mus musculus
tccctgagtcagacatcagaaatat

SEQ ID NO: 774775 - DNA, 25 bp, Mus musculus
tccctgagtcagtcatcagaaatat

SEQ ID NO: 774776 - DNA, 25 bp, Mus musculus
tccctgataactacatagctgcctg

SEQ ID NO: 774777 - DNA, 25 bp, Mus musculus
tccctgataacttcatagctgcctg

SEQ ID NO: 774778 - DNA, 25 bp, Mus musculus
tccctgatagtcctgctggtcgtct

SEQ ID NO: 774779 - DNA, 25 bp, Mus musculus
tccctgatagtcgtgctggtcgtct

SEQ ID NO: 774780 - DNA, 25 bp, Mus musculus
tccctgatccttccggaaattacag

SEQ ID NO: 774781 - DNA, 25 bp, Mus musculus
tccctgatccttgcggaaattacag

SEQ ID NO: 774782 - DNA, 25 bp, Mus musculus
tccctgatgtataggctggatccca

SEQ ID NO: 774783 - DNA, 25 bp, Mus musculus
tccctgatgtattggctggatccca

SEQ ID NO: 774784 - DNA, 25 bp, Mus musculus
tccctgatgtggagctgctgaacaa

SEQ ID NO: 774785 - DNA, 25 bp, Mus musculus
tccctgatgtggtgctgctgaacaa

SEQ ID NO: 774786 - DNA, 25 bp, Mus musculus
tccctgatttgtctccagggtacct

SEQ ID NO: 774787 - DNA, 25 bp, Mus musculus
tccctgatttgtgtccagggtacct

SEQ ID NO: 774788 - DNA, 25 bp, Mus musculus
tccctgcaagagaggtgaaggctca

SEQ ID NO: 774789 - DNA, 25 bp, Mus musculus
tccctgcaagagtggtgaaggctca

SEQ ID NO: 774790 - DNA, 25 bp, Mus musculus
tccctgcaagttcaggacgaagcaa

SEQ ID NO: 774791 - DNA, 25 bp, Mus musculus
tccctgcaagttgaggacgaagcaa

SEQ ID NO: 774792 - DNA, 25 bp, Mus musculus
tccctgcacaggagggtaaatgtct

SEQ ID NO: 774793 - DNA, 25 bp, Mus musculus
tccctgcacaggtgggtaaatgtct

SEQ ID NO: 774794 - DNA, 25 bp, Mus musculus
tccctgcactgcaactttgtccggg

SEQ ID NO: 774795 - DNA, 25 bp, Mus musculus
tccctgcactgctactttgtccggg

SEQ ID NO: 774796 - DNA, 25 bp, Mus musculus
tccctgcagaagatatcagtgcaaa

SEQ ID NO: 774797 - DNA, 25 bp, Mus musculus
tccctgcagaagttatcagtgcaaa

SEQ ID NO: 774798 - DNA, 25 bp, Mus musculus
tccctgcagacgaaagttcatgctg

SEQ ID NO: 774799 - DNA, 25 bp, Mus musculus
tccctgcagacgtaagttcatgctg

SEQ ID NO: 774800 - DNA, 25 bp, Mus musculus
tccctgcagatcaagccgtgccata

SEQ ID NO: 774801 - DNA, 25 bp, Mus musculus
tccctgcagatctagccgtgccata

SEQ ID NO: 774802 - DNA, 25 bp, Mus musculus
tccctgcagcccaatgaaatctgcg

SEQ ID NO: 774803 - DNA, 25 bp, Mus musculus
tccctgcagccctatgaaatctgcg

SEQ ID NO: 774804 - DNA, 25 bp, Mus musculus
tccctgcagtttaatgtgcacccgc

SEQ ID NO: 774805 - DNA, 25 bp, Mus musculus
tccctgcagttttatgtgcacccgc

SEQ ID NO: 774806 - DNA, 25 bp, Mus musculus
tccctgcatccgcagaggctgggaa

SEQ ID NO: 774807 - DNA, 25 bp, Mus musculus
tccctgcatccggagaggctgggaa

SEQ ID NO: 774808 - DNA, 25 bp, Mus musculus
tccctgcatcgcaacgacaacggga

SEQ ID NO: 774809 - DNA, 25 bp, Mus musculus
tccctgcatcgctacgacaacggga

SEQ ID NO: 774810 - DNA, 25 bp, Mus musculus
tccctgcatggaaagttctgggcca

SEQ ID NO: 774811 - DNA, 25 bp, Mus musculus
tccctgcatggatagttctgggcca

SEQ ID NO: 774812 - DNA, 25 bp, Mus musculus
tccctgccattgcaagtatgacctg

SEQ ID NO: 774813 - DNA, 25 bp, Mus musculus
tccctgccattggaagtatgacctg

SEQ ID NO: 774814 - DNA, 25 bp, Mus musculus
tccctgccgccaacactgtgaagtt

SEQ ID NO: 774815 - DNA, 25 bp, Mus musculus
tccctgccgccatcactgtgaagtt

SEQ ID NO: 774816 - DNA, 25 bp, Mus musculus
tccctgccgtatagttgcccagtct

SEQ ID NO: 774817 - DNA, 25 bp, Mus musculus
tccctgccgtattgttgcccagtct

SEQ ID NO: 774818 - DNA, 25 bp, Mus musculus
tccctgccgttcagagcgtctggca

SEQ ID NO: 774819 - DNA, 25 bp, Mus musculus
tccctgccgttctgagcgtctggca

SEQ ID NO: 774820 - DNA, 25 bp, Mus musculus
tccctgccttgaaatatactttttc

SEQ ID NO: 774821 - DNA, 25 bp, Mus musculus
tccctgccttgatatatactttttc

SEQ ID NO: 774822 - DNA, 25 bp, Mus musculus
tccctgcgcttcacctggagcatga

SEQ ID NO: 774823 - DNA, 25 bp, Mus musculus
tccctgcgcttctcctggagcatga

SEQ ID NO: 774824 - DNA, 25 bp, Mus musculus
tccctgcggaggctctggaggtcaa

SEQ ID NO: 774825 - DNA, 25 bp, Mus musculus
tccctgcggagggtctggaggtcaa

SEQ ID NO: 774826 - DNA, 25 bp, Mus musculus
tccctgcgggaccagcttctagtta

SEQ ID NO: 774827 - DNA, 25 bp, Mus musculus
tccctgcgggacgagcttctagtta

SEQ ID NO: 774828 - DNA, 25 bp, Mus musculus
tccctgcgggcaactacaacctgga

SEQ ID NO: 774829 - DNA, 25 bp, Mus musculus
tccctgcgggcatctacaacctgga

SEQ ID NO: 774830 - DNA, 25 bp, Mus musculus
tccctgctagtcagagatactccgt

SEQ ID NO: 774831 - DNA, 25 bp, Mus musculus
tccctgctagtctgagatactccgt

SEQ ID NO: 774832 - DNA, 25 bp, Mus musculus
tccctgctatgtcgatatttgttag

SEQ ID NO: 774833 - DNA, 25 bp, Mus musculus
tccctgctatgtggatatttgttag

SEQ ID NO: 774834 - DNA, 25 bp, Mus musculus
tccctgctcccgacagtctaagagg

SEQ ID NO: 774835 - DNA, 25 bp, Mus musculus
tccctgctcccgtcagtctaagagg

SEQ ID NO: 774836 - DNA, 25 bp, Mus musculus
tccctgctccttaggctatgggcac

SEQ ID NO: 774837 - DNA, 25 bp, Mus musculus
tccctgctcctttggctatgggcac

SEQ ID NO: 774838 - DNA, 25 bp, Mus musculus
tccctgctctggctactttctcagt

SEQ ID NO: 774839 - DNA, 25 bp, Mus musculus
tccctgctctgggtactttctcagt

SEQ ID NO: 774840 - DNA, 25 bp, Mus musculus
tccctgctgaagaaagcgatgccca

SEQ ID NO: 774841 - DNA, 25 bp, Mus musculus
tccctgctgaagtaagcgatgccca

SEQ ID NO: 774842 - DNA, 25 bp, Mus musculus
tccctgctgaggagaatgaataaca

SEQ ID NO: 774843 - DNA, 25 bp, Mus musculus
tccctgctgaggtgaatgaataaca

SEQ ID NO: 774844 - DNA, 25 bp, Mus musculus
tccctgctgcccatgagttggagtc

SEQ ID NO: 774845 - DNA, 25 bp, Mus musculus
tccctgctgcccttgagttggagtc

SEQ ID NO: 774846 - DNA, 25 bp, Mus musculus
tccctgctgctgactcgacatctga

SEQ ID NO: 774847 - DNA, 25 bp, Mus musculus
tccctgctgctgtctcgacatctga

SEQ ID NO: 774848 - DNA, 25 bp, Mus musculus
tccctgctggcaatgagccccagag

SEQ ID NO: 774849 - DNA, 25 bp, Mus musculus
tccctgctggcattgagccccagag

SEQ ID NO: 774850 - DNA, 25 bp, Mus musculus
tccctgctggccagctatggctggt

SEQ ID NO: 774851 - DNA, 25 bp, Mus musculus
tccctgctggcctgctatggctggt

SEQ ID NO: 774852 - DNA, 25 bp, Mus musculus
tccctgcttaatcgcgtgtgtctca

SEQ ID NO: 774853 - DNA, 25 bp, Mus musculus
tccctgcttaatggcgtgtgtctca

SEQ ID NO: 774854 - DNA, 25 bp, Mus musculus
tccctgctttcaccctgatggatat

SEQ ID NO: 774855 - DNA, 25 bp, Mus musculus
tccctgctttcagcctgatggatat

SEQ ID NO: 774856 - DNA, 25 bp, Mus musculus
tccctggaaaagagtgtagtcttgc

SEQ ID NO: 774857 - DNA, 25 bp, Mus musculus
tccctggaaaagtgtgtagtcttgc

SEQ ID NO: 774858 - DNA, 25 bp, Mus musculus
tccctggaacataccaaaccctaga

SEQ ID NO: 774859 - DNA, 25 bp, Mus musculus
tccctggaacattccaaaccctaga

SEQ ID NO: 774860 - DNA, 25 bp, Mus musculus
tccctggaacctagggacttcctct

SEQ ID NO: 774861 - DNA, 25 bp, Mus musculus
tccctggaaccttgggacttcctct

SEQ ID NO: 774862 - DNA, 25 bp, Mus musculus
tccctggaaggcctgcacactaaac

SEQ ID NO: 774863 - DNA, 25 bp, Mus musculus
tccctggaaggcgtgcacactaaac

SEQ ID NO: 774864 - DNA, 25 bp, Mus musculus
tccctggaagtaccagccactactt

SEQ ID NO: 774865 - DNA, 25 bp, Mus musculus
tccctggaagtagcagccactactt

SEQ ID NO: 774866 - DNA, 25 bp, Mus musculus
tccctggaagtgagctcctgtggcg

SEQ ID NO: 774867 - DNA, 25 bp, Mus musculus
tccctggaagtgctaagaatcttcc

SEQ ID NO: 774868 - DNA, 25 bp, Mus musculus
tccctggaagtggtaagaatcttcc

SEQ ID NO: 774869 - DNA, 25 bp, Mus musculus
tccctggaagtgtgctcctgtggcg

SEQ ID NO: 774870 - DNA, 25 bp, Mus musculus
tccctggaatgaagaggctttactc

SEQ ID NO: 774871 - DNA, 25 bp, Mus musculus
tccctggaatgatgaggctttactc

SEQ ID NO: 774872 - DNA, 25 bp, Mus musculus
tccctggacccaccgaagaaagcag

SEQ ID NO: 774873 - DNA, 25 bp, Mus musculus
tccctggacccagcgaagaaagcag

SEQ ID NO: 774874 - DNA, 25 bp, Mus musculus
tccctggacgtcctcacctttgctg

SEQ ID NO: 774875 - DNA, 25 bp, Mus musculus
tccctggacgtcgtcacctttgctg

SEQ ID NO: 774876 - DNA, 25 bp, Mus musculus
tccctggactctcatatccaggagc

SEQ ID NO: 774877 - DNA, 25 bp, Mus musculus
tccctggactctgatatccaggagc

SEQ ID NO: 774878 - DNA, 25 bp, Mus musculus
tccctggacttgacctcaatcacaa

SEQ ID NO: 774879 - DNA, 25 bp, Mus musculus
tccctggacttgtcctcaatcacaa

SEQ ID NO: 774880 - DNA, 25 bp, Mus musculus
tccctggagacgagttctcgctgcg

SEQ ID NO: 774881 - DNA, 25 bp, Mus musculus
tccctggagacgtgttctcgctgcg

SEQ ID NO: 774882 - DNA, 25 bp, Mus musculus
tccctggagcagaggcattgaatca

SEQ ID NO: 774883 - DNA, 25 bp, Mus musculus
tccctggagcagtggcattgaatca

SEQ ID NO: 774884 - DNA, 25 bp, Mus musculus
tccctggaggcaccgcgactgaagc

SEQ ID NO: 774885 - DNA, 25 bp, Mus musculus
tccctggaggcagcgcgactgaagc

SEQ ID NO: 774886 - DNA, 25 bp, Mus musculus
tccctggagtgtctgacagacagca

SEQ ID NO: 774887 - DNA, 25 bp, Mus musculus
tccctggagtgtgtgacagacagca

SEQ ID NO: 774888 - DNA, 25 bp, Mus musculus
tccctggatcctaccgctgtgactg

SEQ ID NO: 774889 - DNA, 25 bp, Mus musculus
tccctggatccttccgctgtgactg

SEQ ID NO: 774890 - DNA, 25 bp, Mus musculus
tccctggatgtgctcagctccgcct

SEQ ID NO: 774891 - DNA, 25 bp, Mus musculus
tccctggatgtggtcagctccgcct

SEQ ID NO: 774892 - DNA, 25 bp, Mus musculus
tccctggcagatcagtttaaagaac

SEQ ID NO: 774893 - DNA, 25 bp, Mus musculus
tccctggcagatgagtttaaagaac

SEQ ID NO: 774894 - DNA, 25 bp, Mus musculus
tccctggcagctctgtagtcgcgtg

SEQ ID NO: 774895 - DNA, 25 bp, Mus musculus
tccctggcagctgtgtagtcgcgtg

SEQ ID NO: 774896 - DNA, 25 bp, Mus musculus
tccctggcaggcagtacgaggtgaa

SEQ ID NO: 774897 - DNA, 25 bp, Mus musculus
tccctggcaggctgtacgaggtgaa

SEQ ID NO: 774898 - DNA, 25 bp, Mus musculus
tccctggcagtactaagcatcatgg

SEQ ID NO: 774899 - DNA, 25 bp, Mus musculus
tccctggcagtagtaagcatcatgg

SEQ ID NO: 774900 - DNA, 25 bp, Mus musculus
tccctggcagttctaatggtttcct

SEQ ID NO: 774901 - DNA, 25 bp, Mus musculus
tccctggcagttgtaatggtttcct

SEQ ID NO: 774902 - DNA, 25 bp, Mus musculus
tccctggccgtgatctctgactcag

SEQ ID NO: 774903 - DNA, 25 bp, Mus musculus
tccctggccgtgttctctgactcag

SEQ ID NO: 774904 - DNA, 25 bp, Mus musculus
tccctggcctttcgagggcatattg

SEQ ID NO: 774905 - DNA, 25 bp, Mus musculus
tccctggcctttggagggcatattg

SEQ ID NO: 774906 - DNA, 25 bp, Mus musculus
tccctggcgagtaagaagctgcccc

SEQ ID NO: 774907 - DNA, 25 bp, Mus musculus
tccctggcgagttagaagctgcccc

SEQ ID NO: 774908 - DNA, 25 bp, Mus musculus
tccctggcggccaaagagaaggtct

SEQ ID NO: 774909 - DNA, 25 bp, Mus musculus
tccctggcggcctaagagaaggtct

SEQ ID NO: 774910 - DNA, 25 bp, Mus musculus
tccctggcgttgatcctagtaataa

SEQ ID NO: 774911 - DNA, 25 bp, Mus musculus
tccctggcgttgttcctagtaataa

SEQ ID NO: 774912 - DNA, 25 bp, Mus musculus
tccctggctcctatgtactaccgag

SEQ ID NO: 774913 - DNA, 25 bp, Mus musculus
tccctggctcctttgtactaccgag

SEQ ID NO: 774914 - DNA, 25 bp, Mus musculus
tccctggctgaaagggcaagaacgc

SEQ ID NO: 774915 - DNA, 25 bp, Mus musculus
tccctggctgaatgggcaagaacgc

SEQ ID NO: 774916 - DNA, 25 bp, Mus musculus
tccctggctgataactgacatgcgg

SEQ ID NO: 774917 - DNA, 25 bp, Mus musculus
tccctggctgattactgacatgcgg

SEQ ID NO: 774918 - DNA, 25 bp, Mus musculus
tccctggctgcccagacggagtcag

SEQ ID NO: 774919 - DNA, 25 bp, Mus musculus
tccctggctgccgagacggagtcag

SEQ ID NO: 774920 - DNA, 25 bp, Mus musculus
tccctggctgctaaggtcagtggac

SEQ ID NO: 774921 - DNA, 25 bp, Mus musculus
tccctggctgcttaggtcagtggac

SEQ ID NO: 774922 - DNA, 25 bp, Mus musculus
tccctggctgtacgattcggaacac

SEQ ID NO: 774923 - DNA, 25 bp, Mus musculus
tccctggctgtaggattcggaacac

SEQ ID NO: 774924 - DNA, 25 bp, Mus musculus
tccctgggaaaacgcagttgcaacc

SEQ ID NO: 774925 - DNA, 25 bp, Mus musculus
tccctgggaaaaggcagttgcaacc

SEQ ID NO: 774926 - DNA, 25 bp, Mus musculus
tccctgggaaagatatagcaatcat

SEQ ID NO: 774927 - DNA, 25 bp, Mus musculus
tccctgggaaagttatagcaatcat

SEQ ID NO: 774928 - DNA, 25 bp, Mus musculus
tccctgggaatacagtcccttgttc

SEQ ID NO: 774929 - DNA, 25 bp, Mus musculus
tccctgggaatagagtcccttgttc

SEQ ID NO: 774930 - DNA, 25 bp, Mus musculus
tccctgggactaagtctccgaagta

SEQ ID NO: 774931 - DNA, 25 bp, Mus musculus
tccctgggactatgtctccgaagta

SEQ ID NO: 774932 - DNA, 25 bp, Mus musculus
tccctgggagagagccatctcacca

SEQ ID NO: 774933 - DNA, 25 bp, Mus musculus
tccctgggagagtgccatctcacca

SEQ ID NO: 774934 - DNA, 25 bp, Mus musculus
tccctgggaggacgcttccactgct

SEQ ID NO: 774935 - DNA, 25 bp, Mus musculus
tccctgggaggaggcttccactgct

SEQ ID NO: 774936 - DNA, 25 bp, Mus musculus
tccctgggcaagcaggtggcggtgg

SEQ ID NO: 774937 - DNA, 25 bp, Mus musculus
tccctgggcaaggaggtggcggtgg

SEQ ID NO: 774938 - DNA, 25 bp, Mus musculus
tccctgggcagacaagaaactccac

SEQ ID NO: 774939 - DNA, 25 bp, Mus musculus
tccctgggcagagaagaaactccac

SEQ ID NO: 774940 - DNA, 25 bp, Mus musculus
tccctgggccagaggagttttccaa

SEQ ID NO: 774941 - DNA, 25 bp, Mus musculus
tccctgggccagtggagttttccaa

SEQ ID NO: 774942 - DNA, 25 bp, Mus musculus
tccctgggctccctgtatgattaca

SEQ ID NO: 774943 - DNA, 25 bp, Mus musculus
tccctgggctccgtgtatgattaca

SEQ ID NO: 774944 - DNA, 25 bp, Mus musculus
tccctgggctgtcatcgattaggct

SEQ ID NO: 774945 - DNA, 25 bp, Mus musculus
tccctgggctgtgatcgattaggct

SEQ ID NO: 774946 - DNA, 25 bp, Mus musculus
tccctgggtagacgactagcctgca

SEQ ID NO: 774947 - DNA, 25 bp, Mus musculus
tccctgggtagaggactagcctgca

SEQ ID NO: 774948 - DNA, 25 bp, Mus musculus
tccctgggtaggacagggacccaca

SEQ ID NO: 774949 - DNA, 25 bp, Mus musculus
tccctgggtaggtcagggacccaca

SEQ ID NO: 774950 - DNA, 25 bp, Mus musculus
tccctgggtatcaggagactgacac

SEQ ID NO: 774951 - DNA, 25 bp, Mus musculus
tccctgggtatctggagactgacac

SEQ ID NO: 774952 - DNA, 25 bp, Mus musculus
tccctgggttaactgggagcaaaat

SEQ ID NO: 774953 - DNA, 25 bp, Mus musculus
tccctgggttaagtgggagcaaaat

SEQ ID NO: 774954 - DNA, 25 bp, Mus musculus
tccctggtaaagcataaaggctctc

SEQ ID NO: 774955 - DNA, 25 bp, Mus musculus
tccctggtaaaggataaaggctctc

SEQ ID NO: 774956 - DNA, 25 bp, Mus musculus
tccctggtacagctgagtttttctt

SEQ ID NO: 774957 - DNA, 25 bp, Mus musculus
tccctggtacaggtgagtttttctt

SEQ ID NO: 774958 - DNA, 25 bp, Mus musculus
tccctggtacttcacaaggtcatca

SEQ ID NO: 774959 - DNA, 25 bp, Mus musculus
tccctggtacttgacaaggtcatca

SEQ ID NO: 774960 - DNA, 25 bp, Mus musculus
tccctggtagaactacgaatccatg

SEQ ID NO: 774961 - DNA, 25 bp, Mus musculus
tccctggtagaagtacgaatccatg

SEQ ID NO: 774962 - DNA, 25 bp, Mus musculus
tccctggtcagaagggaatccgtgg

SEQ ID NO: 774963 - DNA, 25 bp, Mus musculus
tccctggtcagacaggacctcgagg

SEQ ID NO: 774964 - DNA, 25 bp, Mus musculus
tccctggtcagagaggacctcgagg

SEQ ID NO: 774965 - DNA, 25 bp, Mus musculus
tccctggtcagatgggaatccgtgg

SEQ ID NO: 774966 - DNA, 25 bp, Mus musculus
tccctggtctgcagttacaatcact

SEQ ID NO: 774967 - DNA, 25 bp, Mus musculus
tccctggtctgctgttacaatcact

SEQ ID NO: 774968 - DNA, 25 bp, Mus musculus
tccctggtcttgatccagtgtctca

SEQ ID NO: 774969 - DNA, 25 bp, Mus musculus
tccctggtcttgttccagtgtctca

SEQ ID NO: 774970 - DNA, 25 bp, Mus musculus
tccctggtgaaacagaacagtgtct

SEQ ID NO: 774971 - DNA, 25 bp, Mus musculus
tccctggtgaaagagaacagtgtct

SEQ ID NO: 774972 - DNA, 25 bp, Mus musculus
tccctggtgaagaggtgaataaaaa

SEQ ID NO: 774973 - DNA, 25 bp, Mus musculus
tccctggtgaagattccaacaactg

SEQ ID NO: 774974 - DNA, 25 bp, Mus musculus
tccctggtgaagtggtgaataaaaa

SEQ ID NO: 774975 - DNA, 25 bp, Mus musculus
tccctggtgaagtttccaacaactg

SEQ ID NO: 774976 - DNA, 25 bp, Mus musculus
tccctggtgggaaaggctgccaatc

SEQ ID NO: 774977 - DNA, 25 bp, Mus musculus
tccctggtgggataggctgccaatc

SEQ ID NO: 774978 - DNA, 25 bp, Mus musculus
tccctggtgggtcaggaacgacctt

SEQ ID NO: 774979 - DNA, 25 bp, Mus musculus
tccctggtgggtgaggaacgacctt

SEQ ID NO: 774980 - DNA, 25 bp, Mus musculus
tccctggtggtgacatggcagccgc

SEQ ID NO: 774981 - DNA, 25 bp, Mus musculus
tccctggtggtgtcatggcagccgc

SEQ ID NO: 774982 - DNA, 25 bp, Mus musculus
tccctggtgtccatttgtgttctca

SEQ ID NO: 774983 - DNA, 25 bp, Mus musculus
tccctggtgtccttttgtgttctca

SEQ ID NO: 774984 - DNA, 25 bp, Mus musculus
tccctggtgttcctccatgagttca

SEQ ID NO: 774985 - DNA, 25 bp, Mus musculus
tccctggtgttcctggctgagcttg

SEQ ID NO: 774986 - DNA, 25 bp, Mus musculus
tccctggtgttcgtccatgagttca

SEQ ID NO: 774987 - DNA, 25 bp, Mus musculus
tccctggtgttcgtggctgagcttg

SEQ ID NO: 774988 - DNA, 25 bp, Mus musculus
tccctggtgttgatccagactacgc

SEQ ID NO: 774989 - DNA, 25 bp, Mus musculus
tccctggtgttgttccagactacgc

SEQ ID NO: 774990 - DNA, 25 bp, Mus musculus
tccctggttccgagctcgggttccg

SEQ ID NO: 774991 - DNA, 25 bp, Mus musculus
tccctggttccgtgctcgggttccg

SEQ ID NO: 774992 - DNA, 25 bp, Mus musculus
tccctggtttcccaggagacaaagg

SEQ ID NO: 774993 - DNA, 25 bp, Mus musculus
tccctggtttccgaggagacaaagg

SEQ ID NO: 774994 - DNA, 25 bp, Mus musculus
tccctgtaataaagtgtgctcccca

SEQ ID NO: 774995 - DNA, 25 bp, Mus musculus
tccctgtaataatgtgtgctcccca

SEQ ID NO: 774996 - DNA, 25 bp, Mus musculus
tccctgtaattgatgcgaccatcag

SEQ ID NO: 774997 - DNA, 25 bp, Mus musculus
tccctgtaattgttgcgaccatcag

SEQ ID NO: 774998 - DNA, 25 bp, Mus musculus
tccctgtatcgacacacacactggg

SEQ ID NO: 774999 - DNA, 25 bp, Mus musculus
tccctgtatcgagacacacactggg

SEQ ID NO: 775000 - DNA, 25 bp, Mus musculus
tccctgtccagtaggctgtgcctga

SEQ ID NO: 775001 - DNA, 25 bp, Mus musculus
tccctgtccagttggctgtgcctga

SEQ ID NO: 775002 - DNA, 25 bp, Mus musculus
tccctgtcgagcaacaggactctgc

SEQ ID NO: 775003 - DNA, 25 bp, Mus musculus
tccctgtcgagctacaggactctgc

SEQ ID NO: 775004 - DNA, 25 bp, Mus musculus
tccctgtctgccagagtgggacaac

SEQ ID NO: 775005 - DNA, 25 bp, Mus musculus
tccctgtctgcctgagtgggacaac

SEQ ID NO: 775006 - DNA, 25 bp, Mus musculus
tccctgtgagtcagtgagtttgctc

SEQ ID NO: 775007 - DNA, 25 bp, Mus musculus
tccctgtgagtctgtgagtttgctc

SEQ ID NO: 775008 - DNA, 25 bp, Mus musculus
tccctgtgctgcagctagagaggct

SEQ ID NO: 775009 - DNA, 25 bp, Mus musculus
tccctgtgctgcaggtcgtagagaa

SEQ ID NO: 775010 - DNA, 25 bp, Mus musculus
tccctgtgctgctgctagagaggct

SEQ ID NO: 775011 - DNA, 25 bp, Mus musculus
tccctgtgctgctggtcgtagagaa

SEQ ID NO: 775012 - DNA, 25 bp, Mus musculus
tccctgtgcttgagcggctccgggc

SEQ ID NO: 775013 - DNA, 25 bp, Mus musculus
tccctgtgcttgtgcggctccgggc

SEQ ID NO: 775014 - DNA, 25 bp, Mus musculus
tccctgtggaagacccaggagcaca

SEQ ID NO: 775015 - DNA, 25 bp, Mus musculus
tccctgtggaagtcccaggagcaca

SEQ ID NO: 775016 - DNA, 25 bp, Mus musculus
tccctgtggaatataaggagcatca

SEQ ID NO: 775017 - DNA, 25 bp, Mus musculus
tccctgtggaatttaaggagcatca

SEQ ID NO: 775018 - DNA, 25 bp, Mus musculus
tccctgtggactaggaagacacgat

SEQ ID NO: 775019 - DNA, 25 bp, Mus musculus
tccctgtggacttggaagacacgat

SEQ ID NO: 775020 - DNA, 25 bp, Mus musculus
tccctgtggctacacatttcaggtg

SEQ ID NO: 775021 - DNA, 25 bp, Mus musculus
tccctgtggctagacatttcaggtg

SEQ ID NO: 775022 - DNA, 25 bp, Mus musculus
tccctgtggctcatgaggatgtcag

SEQ ID NO: 775023 - DNA, 25 bp, Mus musculus
tccctgtggctcttgaggatgtcag

SEQ ID NO: 775024 - DNA, 25 bp, Mus musculus
tccctgtggtcgaagtgtggtcaga

SEQ ID NO: 775025 - DNA, 25 bp, Mus musculus
tccctgtggtcgtagtgtggtcaga

SEQ ID NO: 775026 - DNA, 25 bp, Mus musculus
tccctgtggtttcctttccgaattg

SEQ ID NO: 775027 - DNA, 25 bp, Mus musculus
tccctgtggtttgctttccgaattg

SEQ ID NO: 775028 - DNA, 25 bp, Mus musculus
tccctgtgtggaccttgtcgctact

SEQ ID NO: 775029 - DNA, 25 bp, Mus musculus
tccctgtgtggagcttgtcgctact

SEQ ID NO: 775030 - DNA, 25 bp, Mus musculus
tccctgtgtgtcatagccgtgcacc

SEQ ID NO: 775031 - DNA, 25 bp, Mus musculus
tccctgtgtgtcttagccgtgcacc

SEQ ID NO: 775032 - DNA, 25 bp, Mus musculus
tccctgtgttggagctgtgtcctca

SEQ ID NO: 775033 - DNA, 25 bp, Mus musculus
tccctgtgttggtgctgtgtcctca

SEQ ID NO: 775034 - DNA, 25 bp, Mus musculus
tccctgttcagactgcatgagaaga

SEQ ID NO: 775035 - DNA, 25 bp, Mus musculus
tccctgttcagagtgcatgagaaga

SEQ ID NO: 775036 - DNA, 25 bp, Mus musculus
tccctgttgaaacgactaaagcacg

SEQ ID NO: 775037 - DNA, 25 bp, Mus musculus
tccctgttgaaaggactaaagcacg

SEQ ID NO: 775038 - DNA, 25 bp, Mus musculus
tccctgttgagaaatatgaagtaca

SEQ ID NO: 775039 - DNA, 25 bp, Mus musculus
tccctgttgagatatatgaagtaca

SEQ ID NO: 775040 - DNA, 25 bp, Mus musculus
tccctgttgggaccaatctgtacgt

SEQ ID NO: 775041 - DNA, 25 bp, Mus musculus
tccctgttgggagcaatctgtacgt

SEQ ID NO: 775042 - DNA, 25 bp, Mus musculus
tccctgtttatcaatcccttgcaaa

SEQ ID NO: 775043 - DNA, 25 bp, Mus musculus
tccctgtttatctatcccttgcaaa

SEQ ID NO: 775044 - DNA, 25 bp, Mus musculus
tcccttaagctaccatgtctgacct

SEQ ID NO: 775045 - DNA, 25 bp, Mus musculus
tcccttaagctagcatgtctgacct

SEQ ID NO: 775046 - DNA, 25 bp, Mus musculus
tcccttacggctagtgaagattcag

SEQ ID NO: 775047 - DNA, 25 bp, Mus musculus
tcccttacggcttgtgaagattcag

SEQ ID NO: 775048 - DNA, 25 bp, Mus musculus
tcccttagaagaattgcggagtttt

SEQ ID NO: 775049 - DNA, 25 bp, Mus musculus
tcccttagaagatttgcggagtttt

SEQ ID NO: 775050 - DNA, 25 bp, Mus musculus
tcccttagttctcgaagtcaaggag

SEQ ID NO: 775051 - DNA, 25 bp, Mus musculus
tcccttagttctggaagtcaaggag

SEQ ID NO: 775052 - DNA, 25 bp, Mus musculus
tcccttatggacaatgcgccggcaa

SEQ ID NO: 775053 - DNA, 25 bp, Mus musculus
tcccttatggactatgcgccggcaa

SEQ ID NO: 775054 - DNA, 25 bp, Mus musculus
tcccttcccagactgattacagcaa

SEQ ID NO: 775055 - DNA, 25 bp, Mus musculus
tcccttcccagagtgattacagcaa

SEQ ID NO: 775056 - DNA, 25 bp, Mus musculus
tcccttcctcctcgccggagtcagt

SEQ ID NO: 775057 - DNA, 25 bp, Mus musculus
tcccttcctcctggccggagtcagt

SEQ ID NO: 775058 - DNA, 25 bp, Mus musculus
tcccttcctgctaatgaaaatattg

SEQ ID NO: 775059 - DNA, 25 bp, Mus musculus
tcccttcctgcttatgaaaatattg

SEQ ID NO: 775060 - DNA, 25 bp, Mus musculus
tcccttcgaccaatcccagatgatg

SEQ ID NO: 775061 - DNA, 25 bp, Mus musculus
tcccttcgaccattcccagatgatg

SEQ ID NO: 775062 - DNA, 25 bp, Mus musculus
tcccttcgtgggatcggcttagcca

SEQ ID NO: 775063 - DNA, 25 bp, Mus musculus
tcccttcgtgggttcggcttagcca

SEQ ID NO: 775064 - DNA, 25 bp, Mus musculus
tcccttctcaggaggacaatgccaa

SEQ ID NO: 775065 - DNA, 25 bp, Mus musculus
tcccttctcaggtggacaatgccaa

SEQ ID NO: 775066 - DNA, 25 bp, Mus musculus
tcccttctgaggcaagaactagtcc

SEQ ID NO: 775067 - DNA, 25 bp, Mus musculus
tcccttctgagggaagaactagtcc

SEQ ID NO: 775068 - DNA, 25 bp, Mus musculus
tcccttctgcagaccctgtgatgca

SEQ ID NO: 775069 - DNA, 25 bp, Mus musculus
tcccttctgcagtccctgtgatgca

SEQ ID NO: 775070 - DNA, 25 bp, Mus musculus
tcccttcttgatagccaagatgcct

SEQ ID NO: 775071 - DNA, 25 bp, Mus musculus
tcccttcttgattgccaagatgcct

SEQ ID NO: 775072 - DNA, 25 bp, Mus musculus
tcccttgaaaaccttgtggaggtca

SEQ ID NO: 775073 - DNA, 25 bp, Mus musculus
tcccttgaaaacgttgtggaggtca

SEQ ID NO: 775074 - DNA, 25 bp, Mus musculus
tcccttgacaggagttgctcgacac

SEQ ID NO: 775075 - DNA, 25 bp, Mus musculus
tcccttgacaggtgttgctcgacac

SEQ ID NO: 775076 - DNA, 25 bp, Mus musculus
tcccttgacccacgtacagtcatgt

SEQ ID NO: 775077 - DNA, 25 bp, Mus musculus
tcccttgacccaggtacagtcatgt

SEQ ID NO: 775078 - DNA, 25 bp, Mus musculus
tcccttgcagatcatgattctggaa

SEQ ID NO: 775079 - DNA, 25 bp, Mus musculus
tcccttgcagatgatgattctggaa

SEQ ID NO: 775080 - DNA, 25 bp, Mus musculus
tcccttgccataaagctacagcctt

SEQ ID NO: 775081 - DNA, 25 bp, Mus musculus
tcccttgccatatagctacagcctt

SEQ ID NO: 775082 - DNA, 25 bp, Mus musculus
tcccttgctgcactgttaagcgggt

SEQ ID NO: 775083 - DNA, 25 bp, Mus musculus
tcccttgctgcagtgttaagcgggt

SEQ ID NO: 775084 - DNA, 25 bp, Mus musculus
tcccttgctggcaaaggcacaagtg

SEQ ID NO: 775085 - DNA, 25 bp, Mus musculus
tcccttgctggctaaggcacaagtg

SEQ ID NO: 775086 - DNA, 25 bp, Mus musculus
tcccttggaaccagtgatcagcaca

SEQ ID NO: 775087 - DNA, 25 bp, Mus musculus
tcccttggaacctgtgatcagcaca

SEQ ID NO: 775088 - DNA, 25 bp, Mus musculus
tcccttggacaacctgccagaagtc

SEQ ID NO: 775089 - DNA, 25 bp, Mus musculus
tcccttggacaagctgccagaagtc

SEQ ID NO: 775090 - DNA, 25 bp, Mus musculus
tcccttgggacactttggaacttgc

SEQ ID NO: 775091 - DNA, 25 bp, Mus musculus
tcccttgggacagtttggaacttgc

SEQ ID NO: 775092 - DNA, 25 bp, Mus musculus
tcccttgggatacaaagaaccagaa

SEQ ID NO: 775093 - DNA, 25 bp, Mus musculus
tcccttgggatagaaagaaccagaa

SEQ ID NO: 775094 - DNA, 25 bp, Mus musculus
tcccttgtagatccttccatcatga

SEQ ID NO: 775095 - DNA, 25 bp, Mus musculus
tcccttgtagatgcttccatcatga

SEQ ID NO: 775096 - DNA, 25 bp, Mus musculus
tcccttgtgaatcgctgggaagtgt

SEQ ID NO: 775097 - DNA, 25 bp, Mus musculus
tcccttgtgaatggctgggaagtgt

SEQ ID NO: 775098 - DNA, 25 bp, Mus musculus
tcccttgtgagtcaggattatgtca

SEQ ID NO: 775099 - DNA, 25 bp, Mus musculus
tcccttgtgagtgaggattatgtca

SEQ ID NO: 775100 - DNA, 25 bp, Mus musculus
tcccttgtgggcaacaaatgttacc

SEQ ID NO: 775101 - DNA, 25 bp, Mus musculus
tcccttgtgggctacaaatgttacc

SEQ ID NO: 775102 - DNA, 25 bp, Mus musculus
tcccttgttccaagctagagaattc

SEQ ID NO: 775103 - DNA, 25 bp, Mus musculus
tcccttgttccatgctagagaattc

SEQ ID NO: 775104 - DNA, 25 bp, Mus musculus
tccctttcccaacaatgccgatgga

SEQ ID NO: 775105 - DNA, 25 bp, Mus musculus
tccctttcccaagaatgccgatgga

SEQ ID NO: 775106 - DNA, 25 bp, Mus musculus
tccctttccggtatgcctctggcgg

SEQ ID NO: 775107 - DNA, 25 bp, Mus musculus
tccctttccggtttgcctctggcgg

SEQ ID NO: 775108 - DNA, 25 bp, Mus musculus
tccctttcctgtacggcgcgtgcgg

SEQ ID NO: 775109 - DNA, 25 bp, Mus musculus
tccctttcctgttcggcgcgtgcgg

SEQ ID NO: 775110 - DNA, 25 bp, Mus musculus
tccctttctcggagtgtgagtcctg

SEQ ID NO: 775111 - DNA, 25 bp, Mus musculus
tccctttctcggtgtgtgagtcctg

SEQ ID NO: 775112 - DNA, 25 bp, Mus musculus
tccctttgcatcacccagtgtggtg

SEQ ID NO: 775113 - DNA, 25 bp, Mus musculus
tccctttgcatctcccagtgtggtg

SEQ ID NO: 775114 - DNA, 25 bp, Mus musculus
tccctttgccccagcagaattgaag

SEQ ID NO: 775115 - DNA, 25 bp, Mus musculus
tccctttgcccctgcagaattgaag

SEQ ID NO: 775116 - DNA, 25 bp, Mus musculus
tccctttgctgtaaacaatgtcaag

SEQ ID NO: 775117 - DNA, 25 bp, Mus musculus
tccctttgctgttaacaatgtcaag

SEQ ID NO: 775118 - DNA, 25 bp, Mus musculus
tccgaaacaccccagaaactgacga

SEQ ID NO: 775119 - DNA, 25 bp, Mus musculus
tccgaaacacccgagaaactgacga

SEQ ID NO: 775120 - DNA, 25 bp, Mus musculus
tccgaaacactcagatcaacaactc

SEQ ID NO: 775121 - DNA, 25 bp, Mus musculus
tccgaaacactctgatcaacaactc

SEQ ID NO: 775122 - DNA, 25 bp, Mus musculus
tccgaaaccactatgcagtctacgt

SEQ ID NO: 775123 - DNA, 25 bp, Mus musculus
tccgaaaccactttgcagtctacgt

SEQ ID NO: 775124 - DNA, 25 bp, Mus musculus
tccgaaacgcacagtggcacacggg

SEQ ID NO: 775125 - DNA, 25 bp, Mus musculus
tccgaaacgcactgtggcacacggg

SEQ ID NO: 775126 - DNA, 25 bp, Mus musculus
tccgaaagacagaatgccattgcca

SEQ ID NO: 775127 - DNA, 25 bp, Mus musculus
tccgaaagacagtatgccattgcca

SEQ ID NO: 775128 - DNA, 25 bp, Mus musculus
tccgaaagccagacaccatcacggt

SEQ ID NO: 775129 - DNA, 25 bp, Mus musculus
tccgaaagccagtcaccatcacggt

SEQ ID NO: 775130 - DNA, 25 bp, Mus musculus
tccgaaagggcaacctagagcgtga

SEQ ID NO: 775131 - DNA, 25 bp, Mus musculus
tccgaaagggcatcctagagcgtga

SEQ ID NO: 775132 - DNA, 25 bp, Mus musculus
tccgaaatgcctccagccgagagcg

SEQ ID NO: 775133 - DNA, 25 bp, Mus musculus
tccgaaatgcctgcagccgagagcg

SEQ ID NO: 775134 - DNA, 25 bp, Mus musculus
tccgaaatggcccataccgtcagct

SEQ ID NO: 775135 - DNA, 25 bp, Mus musculus
tccgaaatggccgataccgtcagct

SEQ ID NO: 775136 - DNA, 25 bp, Mus musculus
tccgaacacggaaaagaagctcatc

SEQ ID NO: 775137 - DNA, 25 bp, Mus musculus
tccgaacacggataagaagctcatc

SEQ ID NO: 775138 - DNA, 25 bp, Mus musculus
tccgaacaggcgacgccgggaactt

SEQ ID NO: 775139 - DNA, 25 bp, Mus musculus
tccgaacaggcgtcgccgggaactt

SEQ ID NO: 775140 - DNA, 25 bp, Mus musculus
tccgaacagttaccatctactaatt

SEQ ID NO: 775141 - DNA, 25 bp, Mus musculus
tccgaacagttagcatctactaatt

SEQ ID NO: 775142 - DNA, 25 bp, Mus musculus
tccgaaccagagacaaaacaactgg

SEQ ID NO: 775143 - DNA, 25 bp, Mus musculus
tccgaaccagagtcaaaacaactgg

SEQ ID NO: 775144 - DNA, 25 bp, Mus musculus
tccgaacctgagcaacggtgaaaca

SEQ ID NO: 775145 - DNA, 25 bp, Mus musculus
tccgaacctgaggaacggtgaaaca

SEQ ID NO: 775146 - DNA, 25 bp, Mus musculus
tccgaactaactccgatctcaggtg

SEQ ID NO: 775147 - DNA, 25 bp, Mus musculus
tccgaactaactgcgatctcaggtg

SEQ ID NO: 775148 - DNA, 25 bp, Mus musculus
tccgaactagtgaagcagcgccctg

SEQ ID NO: 775149 - DNA, 25 bp, Mus musculus
tccgaactagtgtagcagcgccctg

SEQ ID NO: 775150 - DNA, 25 bp, Mus musculus
tccgaactgcggatccaggtgctgg

SEQ ID NO: 775151 - DNA, 25 bp, Mus musculus
tccgaactgcggttccaggtgctgg

SEQ ID NO: 775152 - DNA, 25 bp, Mus musculus
tccgaagaatccacctcctaagagg

SEQ ID NO: 775153 - DNA, 25 bp, Mus musculus
tccgaagaatcctcctcctaagagg

SEQ ID NO: 775154 - DNA, 25 bp, Mus musculus
tccgaagacccaagtacagcatata

SEQ ID NO: 775155 - DNA, 25 bp, Mus musculus
tccgaagacccatgtacagcatata

SEQ ID NO: 775156 - DNA, 25 bp, Mus musculus
tccgaagaccccaaaataactgtag

SEQ ID NO: 775157 - DNA, 25 bp, Mus musculus
tccgaagacccctaaataactgtag

SEQ ID NO: 775158 - DNA, 25 bp, Mus musculus
tccgaagagaacatctggccctggt

SEQ ID NO: 775159 - DNA, 25 bp, Mus musculus
tccgaagagaacttctggccctggt

SEQ ID NO: 775160 - DNA, 25 bp, Mus musculus
tccgaagagcgtagcgacccctgaa

SEQ ID NO: 775161 - DNA, 25 bp, Mus musculus
tccgaagagcgttgcgacccctgaa

SEQ ID NO: 775162 - DNA, 25 bp, Mus musculus
tccgaagaggccagaaactagatcc

SEQ ID NO: 775163 - DNA, 25 bp, Mus musculus
tccgaagaggcctgaaactagatcc

SEQ ID NO: 775164 - DNA, 25 bp, Mus musculus
tccgaagatgatcggctcagcaaag

SEQ ID NO: 775165 - DNA, 25 bp, Mus musculus
tccgaagatgatgggctcagcaaag

SEQ ID NO: 775166 - DNA, 25 bp, Mus musculus
tccgaagcaaacaggccatcattcc

SEQ ID NO: 775167 - DNA, 25 bp, Mus musculus
tccgaagcaaactggccatcattcc

SEQ ID NO: 775168 - DNA, 25 bp, Mus musculus
tccgaagcaagaaagcagatggcac

SEQ ID NO: 775169 - DNA, 25 bp, Mus musculus
tccgaagcaagatagcagatggcac

SEQ ID NO: 775170 - DNA, 25 bp, Mus musculus
tccgaagcacgcagaatgagatcta

SEQ ID NO: 775171 - DNA, 25 bp, Mus musculus
tccgaagcacgctgaatgagatcta

SEQ ID NO: 775172 - DNA, 25 bp, Mus musculus
tccgaagcggagaaggctttctgct

SEQ ID NO: 775173 - DNA, 25 bp, Mus musculus
tccgaagcggagtaggctttctgct

SEQ ID NO: 775174 - DNA, 25 bp, Mus musculus
tccgaaggcgaaagatgaaccacca

SEQ ID NO: 775175 - DNA, 25 bp, Mus musculus
tccgaaggcgaatgatgaaccacca

SEQ ID NO: 775176 - DNA, 25 bp, Mus musculus
tccgaaggctgaaacaagaacgtga

SEQ ID NO: 775177 - DNA, 25 bp, Mus musculus
tccgaaggctgatacaagaacgtga

SEQ ID NO: 775178 - DNA, 25 bp, Mus musculus
tccgaaggcttcagtggcataccag

SEQ ID NO: 775179 - DNA, 25 bp, Mus musculus
tccgaaggcttctgtggcataccag

SEQ ID NO: 775180 - DNA, 25 bp, Mus musculus
tccgaagggattatacagacttaag

SEQ ID NO: 775181 - DNA, 25 bp, Mus musculus
tccgaagggattttacagacttaag

SEQ ID NO: 775182 - DNA, 25 bp, Mus musculus
tccgaagggcacaagtgtgaccgcc

SEQ ID NO: 775183 - DNA, 25 bp, Mus musculus
tccgaagggcactagtgtgaccgcc

SEQ ID NO: 775184 - DNA, 25 bp, Mus musculus
tccgaagggccactcagaaactagg

SEQ ID NO: 775185 - DNA, 25 bp, Mus musculus
tccgaagggccagtcagaaactagg

SEQ ID NO: 775186 - DNA, 25 bp, Mus musculus
tccgaagtagctcggatcaccgtct

SEQ ID NO: 775187 - DNA, 25 bp, Mus musculus
tccgaagtagctgggatcaccgtct

SEQ ID NO: 775188 - DNA, 25 bp, Mus musculus
tccgaagtaggaattggacggctga

SEQ ID NO: 775189 - DNA, 25 bp, Mus musculus
tccgaagtaggatttggacggctga

SEQ ID NO: 775190 - DNA, 25 bp, Mus musculus
tccgaagtcatcaaaaccaaagcag

SEQ ID NO: 775191 - DNA, 25 bp, Mus musculus
tccgaagtcatctaaaccaaagcag

SEQ ID NO: 775192 - DNA, 25 bp, Mus musculus
tccgaatcagcacaactggagatct

SEQ ID NO: 775193 - DNA, 25 bp, Mus musculus
tccgaatcagcagaactggagatct

SEQ ID NO: 775194 - DNA, 25 bp, Mus musculus
tccgaatgggcaacctcaaaaggct

SEQ ID NO: 775195 - DNA, 25 bp, Mus musculus
tccgaatgggcatcctcaaaaggct

SEQ ID NO: 775196 - DNA, 25 bp, Mus musculus
tccgaatggtgcctgaggacattaa

SEQ ID NO: 775197 - DNA, 25 bp, Mus musculus
tccgaatggtgcgtgaggacattaa

SEQ ID NO: 775198 - DNA, 25 bp, Mus musculus
tccgaatgtctgaggacaagccaca

SEQ ID NO: 775199 - DNA, 25 bp, Mus musculus
tccgaatgtctgtggacaagccaca

SEQ ID NO: 775200 - DNA, 25 bp, Mus musculus
tccgaattgttcaagcaggctcctg

SEQ ID NO: 775201 - DNA, 25 bp, Mus musculus
tccgaattgttctagcaggctcctg

SEQ ID NO: 775202 - DNA, 25 bp, Mus musculus
tccgacacataccagcagataaaag

SEQ ID NO: 775203 - DNA, 25 bp, Mus musculus
tccgacacatacgagcagataaaag

SEQ ID NO: 775204 - DNA, 25 bp, Mus musculus
tccgacagcctgagggacctgccat

SEQ ID NO: 775205 - DNA, 25 bp, Mus musculus
tccgacagcctgagtcgccaaggtg

SEQ ID NO: 775206 - DNA, 25 bp, Mus musculus
tccgacagcctgtgggacctgccat

SEQ ID NO: 775207 - DNA, 25 bp, Mus musculus
tccgacagcctgtgtcgccaaggtg

SEQ ID NO: 775208 - DNA, 25 bp, Mus musculus
tccgacagggtaccgtaagctggtc

SEQ ID NO: 775209 - DNA, 25 bp, Mus musculus
tccgacagggtagcgtaagctggtc

SEQ ID NO: 775210 - DNA, 25 bp, Mus musculus
tccgacatgttgcacatcagcacca

SEQ ID NO: 775211 - DNA, 25 bp, Mus musculus
tccgacatgttggacatcagcacca

SEQ ID NO: 775212 - DNA, 25 bp, Mus musculus
tccgacattgaaaaggacagcttca

SEQ ID NO: 775213 - DNA, 25 bp, Mus musculus
tccgacattgaataggacagcttca

SEQ ID NO: 775214 - DNA, 25 bp, Mus musculus
tccgaccacgatcaggatgcagagg

SEQ ID NO: 775215 - DNA, 25 bp, Mus musculus
tccgaccacgatgaggatgcagagg

SEQ ID NO: 775216 - DNA, 25 bp, Mus musculus
tccgaccagcaaagcggagtgctct

SEQ ID NO: 775217 - DNA, 25 bp, Mus musculus
tccgaccagcaatgcggagtgctct

SEQ ID NO: 775218 - DNA, 25 bp, Mus musculus
tccgacccaagtcggaagggcctag

SEQ ID NO: 775219 - DNA, 25 bp, Mus musculus
tccgacccaagtgggaagggcctag

SEQ ID NO: 775220 - DNA, 25 bp, Mus musculus
tccgacccagagagtggcgctcatc

SEQ ID NO: 775221 - DNA, 25 bp, Mus musculus
tccgacccagagtgtggcgctcatc

SEQ ID NO: 775222 - DNA, 25 bp, Mus musculus
tccgaccgctggattcgaagacatg

SEQ ID NO: 775223 - DNA, 25 bp, Mus musculus
tccgaccgctggtttcgaagacatg

SEQ ID NO: 775224 - DNA, 25 bp, Mus musculus
tccgaccgtcaaaggatccaagtca

SEQ ID NO: 775225 - DNA, 25 bp, Mus musculus
tccgaccgtcaatggatccaagtca

SEQ ID NO: 775226 - DNA, 25 bp, Mus musculus
tccgacctagcaacctaattgtttg

SEQ ID NO: 775227 - DNA, 25 bp, Mus musculus
tccgacctagcatcctaattgtttg

SEQ ID NO: 775228 - DNA, 25 bp, Mus musculus
tccgacctggaaatagaactattaa

SEQ ID NO: 775229 - DNA, 25 bp, Mus musculus
tccgacctggaattagaactattaa

SEQ ID NO: 775230 - DNA, 25 bp, Mus musculus
tccgacctgggacatactgtcagcc

SEQ ID NO: 775231 - DNA, 25 bp, Mus musculus
tccgacctgggagatactgtcagcc

SEQ ID NO: 775232 - DNA, 25 bp, Mus musculus
tccgacctggtcaacatgggtatca

SEQ ID NO: 775233 - DNA, 25 bp, Mus musculus
tccgacctggtctacatgggtatca

SEQ ID NO: 775234 - DNA, 25 bp, Mus musculus
tccgacgagataacaccaagtgtct

SEQ ID NO: 775235 - DNA, 25 bp, Mus musculus
tccgacgagatatcaccaagtgtct

SEQ ID NO: 775236 - DNA, 25 bp, Mus musculus
tccgacgcaccgatgatacaccggt

SEQ ID NO: 775237 - DNA, 25 bp, Mus musculus
tccgacgcaccgttgatacaccggt

SEQ ID NO: 775238 - DNA, 25 bp, Mus musculus
tccgacgcccagaatggacctggaa

SEQ ID NO: 775239 - DNA, 25 bp, Mus musculus
tccgacgcccagtatggacctggaa

SEQ ID NO: 775240 - DNA, 25 bp, Mus musculus
tccgacgctgccagccgtgctattg

SEQ ID NO: 775241 - DNA, 25 bp, Mus musculus
tccgacgctgcctgccgtgctattg

SEQ ID NO: 775242 - DNA, 25 bp, Mus musculus
tccgacgtgtacctccgcagcagaa

SEQ ID NO: 775243 - DNA, 25 bp, Mus musculus
tccgacgtgtacgtccgcagcagaa

SEQ ID NO: 775244 - DNA, 25 bp, Mus musculus
tccgactactccaatgagaagccgt

SEQ ID NO: 775245 - DNA, 25 bp, Mus musculus
tccgactactcctatgagaagccgt

SEQ ID NO: 775246 - DNA, 25 bp, Mus musculus
tccgactcgctcagttctggaggca

SEQ ID NO: 775247 - DNA, 25 bp, Mus musculus
tccgactcgctctgttctggaggca

SEQ ID NO: 775248 - DNA, 25 bp, Mus musculus
tccgactctggcatcgttgctgaga

SEQ ID NO: 775249 - DNA, 25 bp, Mus musculus
tccgactctggcttcgttgctgaga

SEQ ID NO: 775250 - DNA, 25 bp, Mus musculus
tccgactgaagcagagacgaaggtg

SEQ ID NO: 775251 - DNA, 25 bp, Mus musculus
tccgactgaagctgagacgaaggtg

SEQ ID NO: 775252 - DNA, 25 bp, Mus musculus
tccgactggagtccaacaaggaagg

SEQ ID NO: 775253 - DNA, 25 bp, Mus musculus
tccgactggagtgcaacaaggaagg

SEQ ID NO: 775254 - DNA, 25 bp, Mus musculus
tccgactgtcttagatggcctgatc

SEQ ID NO: 775255 - DNA, 25 bp, Mus musculus
tccgactgtctttgatggcctgatc

SEQ ID NO: 775256 - DNA, 25 bp, Mus musculus
tccgacttcgaacggtacgagcagg

SEQ ID NO: 775257 - DNA, 25 bp, Mus musculus
tccgacttcgaagggtacgagcagg

SEQ ID NO: 775258 - DNA, 25 bp, Mus musculus
tccgacttgcccagaaagaaaaagc

SEQ ID NO: 775259 - DNA, 25 bp, Mus musculus
tccgacttgccctgaaagaaaaagc

SEQ ID NO: 775260 - DNA, 25 bp, Mus musculus
tccgagaaaaagaggacaaagatga

SEQ ID NO: 775261 - DNA, 25 bp, Mus musculus
tccgagaaaaagtggacaaagatga

SEQ ID NO: 775262 - DNA, 25 bp, Mus musculus
tccgagaaagccaagggcctgattc

SEQ ID NO: 775263 - DNA, 25 bp, Mus musculus
tccgagaaagcctagggcctgattc

SEQ ID NO: 775264 - DNA, 25 bp, Mus musculus
tccgagaagtacacatgcgcctggt

SEQ ID NO: 775265 - DNA, 25 bp, Mus musculus
tccgagaagtactcatgcgcctggt

SEQ ID NO: 775266 - DNA, 25 bp, Mus musculus
tccgagacacggatggccatgggtc

SEQ ID NO: 775267 - DNA, 25 bp, Mus musculus
tccgagacacggttggccatgggtc

SEQ ID NO: 775268 - DNA, 25 bp, Mus musculus
tccgagacagataattatccgaggg

SEQ ID NO: 775269 - DNA, 25 bp, Mus musculus
tccgagacagattattatccgaggg

SEQ ID NO: 775270 - DNA, 25 bp, Mus musculus
tccgagacagctacgggcgcgcgct

SEQ ID NO: 775271 - DNA, 25 bp, Mus musculus
tccgagacagcttcgggcgcgcgct

SEQ ID NO: 775272 - DNA, 25 bp, Mus musculus
tccgagacgaatcagggatgtcatc

SEQ ID NO: 775273 - DNA, 25 bp, Mus musculus
tccgagacgaatgagggatgtcatc

SEQ ID NO: 775274 - DNA, 25 bp, Mus musculus
tccgagacgtggacctcaatggaga

SEQ ID NO: 775275 - DNA, 25 bp, Mus musculus
tccgagacgtggtcctcaatggaga

SEQ ID NO: 775276 - DNA, 25 bp, Mus musculus
tccgagactatacgcgtgtgcacaa

SEQ ID NO: 775277 - DNA, 25 bp, Mus musculus
tccgagactataggcgtgtgcacaa

SEQ ID NO: 775278 - DNA, 25 bp, Mus musculus
tccgagactatgaggagtcccagaa

SEQ ID NO: 775279 - DNA, 25 bp, Mus musculus
tccgagactatgtggagtcccagaa

SEQ ID NO: 775280 - DNA, 25 bp, Mus musculus
tccgagactgcgcagccaggaagcc

SEQ ID NO: 775281 - DNA, 25 bp, Mus musculus
tccgagactgcggagccaggaagcc

SEQ ID NO: 775282 - DNA, 25 bp, Mus musculus
tccgagagaacaaaatcaagcagct

SEQ ID NO: 775283 - DNA, 25 bp, Mus musculus
tccgagagaacataatcaagcagct

SEQ ID NO: 775284 - DNA, 25 bp, Mus musculus
tccgagagaggaataagcgacatag

SEQ ID NO: 775285 - DNA, 25 bp, Mus musculus
tccgagagaggattaagcgacatag

SEQ ID NO: 775286 - DNA, 25 bp, Mus musculus
tccgagagccgcactggccaagagt

SEQ ID NO: 775287 - DNA, 25 bp, Mus musculus
tccgagagccgctctggccaagagt

SEQ ID NO: 775288 - DNA, 25 bp, Mus musculus
tccgagaggcaacaaagtttgcggc

SEQ ID NO: 775289 - DNA, 25 bp, Mus musculus
tccgagaggcaagaaagtttgcggc

SEQ ID NO: 775290 - DNA, 25 bp, Mus musculus
tccgagaggcctatgaagcaggtct

SEQ ID NO: 775291 - DNA, 25 bp, Mus musculus
tccgagaggcctttgaagcaggtct

SEQ ID NO: 775292 - DNA, 25 bp, Mus musculus
tccgagatacctagttaaagagtgc

SEQ ID NO: 775293 - DNA, 25 bp, Mus musculus
tccgagataccttgttaaagagtgc

SEQ ID NO: 775294 - DNA, 25 bp, Mus musculus
tccgagatattcctaagtatgagtt

SEQ ID NO: 775295 - DNA, 25 bp, Mus musculus
tccgagatattcgtaagtatgagtt

SEQ ID NO: 775296 - DNA, 25 bp, Mus musculus
tccgagatcagtcttctcacaccag

SEQ ID NO: 775297 - DNA, 25 bp, Mus musculus
tccgagatcagtgttctcacaccag

SEQ ID NO: 775298 - DNA, 25 bp, Mus musculus
tccgagatgctaagttagccaaagt

SEQ ID NO: 775299 - DNA, 25 bp, Mus musculus
tccgagatgctatgttagccaaagt

SEQ ID NO: 775300 - DNA, 25 bp, Mus musculus
tccgagatgggaagtgtagacagtc

SEQ ID NO: 775301 - DNA, 25 bp, Mus musculus
tccgagatgggatgtgtagacagtc

SEQ ID NO: 775302 - DNA, 25 bp, Mus musculus
tccgagattaccaggaggagaggct

SEQ ID NO: 775303 - DNA, 25 bp, Mus musculus
tccgagattacctggaggagaggct

SEQ ID NO: 775304 - DNA, 25 bp, Mus musculus
tccgagcacagcactcaagggctgg

SEQ ID NO: 775305 - DNA, 25 bp, Mus musculus
tccgagcacagctctcaagggctgg

SEQ ID NO: 775306 - DNA, 25 bp, Mus musculus
tccgagcactagatccacaagtcgc

SEQ ID NO: 775307 - DNA, 25 bp, Mus musculus
tccgagcactagttccacaagtcgc

SEQ ID NO: 775308 - DNA, 25 bp, Mus musculus
tccgagcagagaccataaatgagag

SEQ ID NO: 775309 - DNA, 25 bp, Mus musculus
tccgagcagagagcataaatgagag

SEQ ID NO: 775310 - DNA, 25 bp, Mus musculus
tccgagcagtctctggtgcggtctc

SEQ ID NO: 775311 - DNA, 25 bp, Mus musculus
tccgagcagtctgtggtgcggtctc

SEQ ID NO: 775312 - DNA, 25 bp, Mus musculus
tccgagcagttcatcggcctcttct

SEQ ID NO: 775313 - DNA, 25 bp, Mus musculus
tccgagcagttcttcggcctcttct

SEQ ID NO: 775314 - DNA, 25 bp, Mus musculus
tccgagccaattcgctgcgccgtgg

SEQ ID NO: 775315 - DNA, 25 bp, Mus musculus
tccgagccaattggctgcgccgtgg

SEQ ID NO: 775316 - DNA, 25 bp, Mus musculus
tccgagccaggcagtctagagttgg

SEQ ID NO: 775317 - DNA, 25 bp, Mus musculus
tccgagccaggctgtctagagttgg

SEQ ID NO: 775318 - DNA, 25 bp, Mus musculus
tccgagcccgcaacactgatgaaac

SEQ ID NO: 775319 - DNA, 25 bp, Mus musculus
tccgagcccgcatcactgatgaaac

SEQ ID NO: 775320 - DNA, 25 bp, Mus musculus
tccgagccgggcaatccgtttgtaa

SEQ ID NO: 775321 - DNA, 25 bp, Mus musculus
tccgagccgggctatccgtttgtaa

SEQ ID NO: 775322 - DNA, 25 bp, Mus musculus
tccgagccggtgaaagtagagatgc

SEQ ID NO: 775323 - DNA, 25 bp, Mus musculus
tccgagccggtgtaagtagagatgc

SEQ ID NO: 775324 - DNA, 25 bp, Mus musculus
tccgagcgatcgatcgggcacgatt

SEQ ID NO: 775325 - DNA, 25 bp, Mus musculus
tccgagcgatcgttcgggcacgatt

SEQ ID NO: 775326 - DNA, 25 bp, Mus musculus
tccgagcgcgcgactagccagaaag

SEQ ID NO: 775327 - DNA, 25 bp, Mus musculus
tccgagcgcgcgtctagccagaaag

SEQ ID NO: 775328 - DNA, 25 bp, Mus musculus
tccgagcgctctcctcttggaggag

SEQ ID NO: 775329 - DNA, 25 bp, Mus musculus
tccgagcgctctgctcttggaggag

SEQ ID NO: 775330 - DNA, 25 bp, Mus musculus
tccgagcggagtctcagttacagag

SEQ ID NO: 775331 - DNA, 25 bp, Mus musculus
tccgagcggagtgtcagttacagag

SEQ ID NO: 775332 - DNA, 25 bp, Mus musculus
tccgagcgtaccagtgccactgtca

SEQ ID NO: 775333 - DNA, 25 bp, Mus musculus
tccgagcgtacctgtgccactgtca

SEQ ID NO: 775334 - DNA, 25 bp, Mus musculus
tccgagcgtcgcctgatcatcgtgc

SEQ ID NO: 775335 - DNA, 25 bp, Mus musculus
tccgagcgtcgcgtgatcatcgtgc

SEQ ID NO: 775336 - DNA, 25 bp, Mus musculus
tccgagcgtggactttgaccacagc

SEQ ID NO: 775337 - DNA, 25 bp, Mus musculus
tccgagcgtggagtttgaccacagc

SEQ ID NO: 775338 - DNA, 25 bp, Mus musculus
tccgagctccagcacaccagtttga

SEQ ID NO: 775339 - DNA, 25 bp, Mus musculus
tccgagctccaggacaccagtttga

SEQ ID NO: 775340 - DNA, 25 bp, Mus musculus
tccgagctgggaataagataccttc

SEQ ID NO: 775341 - DNA, 25 bp, Mus musculus
tccgagctgggattaagataccttc

SEQ ID NO: 775342 - DNA, 25 bp, Mus musculus
tccgagctttgcagcggaggccccg

SEQ ID NO: 775343 - DNA, 25 bp, Mus musculus
tccgagctttgctgcggaggccccg

SEQ ID NO: 775344 - DNA, 25 bp, Mus musculus
tccgaggaaagaaaacaggccatct

SEQ ID NO: 775345 - DNA, 25 bp, Mus musculus
tccgaggaaagataacaggccatct

SEQ ID NO: 775346 - DNA, 25 bp, Mus musculus
tccgaggaaagtctgaccaggtcga

SEQ ID NO: 775347 - DNA, 25 bp, Mus musculus
tccgaggaaagtgtgaccaggtcga

SEQ ID NO: 775348 - DNA, 25 bp, Mus musculus
tccgaggaagaaatctttgatgccc

SEQ ID NO: 775349 - DNA, 25 bp, Mus musculus
tccgaggaagaattctttgatgccc

SEQ ID NO: 775350 - DNA, 25 bp, Mus musculus
tccgaggaagctagctgaagctgct

SEQ ID NO: 775351 - DNA, 25 bp, Mus musculus
tccgaggaagcttgctgaagctgct

SEQ ID NO: 775352 - DNA, 25 bp, Mus musculus
tccgaggacaagaccttggcaaggg

SEQ ID NO: 775353 - DNA, 25 bp, Mus musculus
tccgaggacaagtccttggcaaggg

SEQ ID NO: 775354 - DNA, 25 bp, Mus musculus
tccgaggagacaaatctgcgagtcc

SEQ ID NO: 775355 - DNA, 25 bp, Mus musculus
tccgaggagacatatctgcgagtcc

SEQ ID NO: 775356 - DNA, 25 bp, Mus musculus
tccgaggagatcaacgagtgcctgt

SEQ ID NO: 775357 - DNA, 25 bp, Mus musculus
tccgaggagatctacgagtgcctgt

SEQ ID NO: 775358 - DNA, 25 bp, Mus musculus
tccgaggaggagaacgggcagttgc

SEQ ID NO: 775359 - DNA, 25 bp, Mus musculus
tccgaggaggagtacgggcagttgc

SEQ ID NO: 775360 - DNA, 25 bp, Mus musculus
tccgaggattggatttggaccatgg

SEQ ID NO: 775361 - DNA, 25 bp, Mus musculus
tccgaggattggttttggaccatgg

SEQ ID NO: 775362 - DNA, 25 bp, Mus musculus
tccgaggcagacaggccgctcagca

SEQ ID NO: 775363 - DNA, 25 bp, Mus musculus
tccgaggcagactggccgctcagca

SEQ ID NO: 775364 - DNA, 25 bp, Mus musculus
tccgaggcatgcagcaagcagaggc

SEQ ID NO: 775365 - DNA, 25 bp, Mus musculus
tccgaggcatgctgcaagcagaggc

SEQ ID NO: 775366 - DNA, 25 bp, Mus musculus
tccgaggcttttacggctttcctgg

SEQ ID NO: 775367 - DNA, 25 bp, Mus musculus
tccgaggctttttcggctttcctgg

SEQ ID NO: 775368 - DNA, 25 bp, Mus musculus
tccgagggacaccagaggatctcgt

SEQ ID NO: 775369 - DNA, 25 bp, Mus musculus
tccgagggacacgagaggatctcgt

SEQ ID NO: 775370 - DNA, 25 bp, Mus musculus
tccgagggaccaagaagcagcggct

SEQ ID NO: 775371 - DNA, 25 bp, Mus musculus
tccgagggaccacctcctatgcaga

SEQ ID NO: 775372 - DNA, 25 bp, Mus musculus
tccgagggaccagctcctatgcaga

SEQ ID NO: 775373 - DNA, 25 bp, Mus musculus
tccgagggaccatgaagcagcggct

SEQ ID NO: 775374 - DNA, 25 bp, Mus musculus
tccgagggacctacttattgcttaa

SEQ ID NO: 775375 - DNA, 25 bp, Mus musculus
tccgagggaccttcttattgcttaa

SEQ ID NO: 775376 - DNA, 25 bp, Mus musculus
tccgagggctacattcagaactaca

SEQ ID NO: 775377 - DNA, 25 bp, Mus musculus
tccgagggctactttcagaactaca

SEQ ID NO: 775378 - DNA, 25 bp, Mus musculus
tccgaggggaaaacactttatgagg

SEQ ID NO: 775379 - DNA, 25 bp, Mus musculus
tccgaggggaaatcactttatgagg

SEQ ID NO: 775380 - DNA, 25 bp, Mus musculus
tccgaggtaggcacctctcggctct

SEQ ID NO: 775381 - DNA, 25 bp, Mus musculus
tccgaggtaggctcctctcggctct

SEQ ID NO: 775382 - DNA, 25 bp, Mus musculus
tccgaggtcaaccagtgcaacagta

SEQ ID NO: 775383 - DNA, 25 bp, Mus musculus
tccgaggtcaacgagtgcaacagta

SEQ ID NO: 775384 - DNA, 25 bp, Mus musculus
tccgaggtcggacagcagactttgt

SEQ ID NO: 775385 - DNA, 25 bp, Mus musculus
tccgaggtcggagagcagactttgt

SEQ ID NO: 775386 - DNA, 25 bp, Mus musculus
tccgaggtgacacggtgttgctaaa

SEQ ID NO: 775387 - DNA, 25 bp, Mus musculus
tccgaggtgacagggtgttgctaaa

SEQ ID NO: 775388 - DNA, 25 bp, Mus musculus
tccgaggtgccgaccagatttaaag

SEQ ID NO: 775389 - DNA, 25 bp, Mus musculus
tccgaggtgccgtccagatttaaag

SEQ ID NO: 775390 - DNA, 25 bp, Mus musculus
tccgaggttaccctctatttctggg

SEQ ID NO: 775391 - DNA, 25 bp, Mus musculus
tccgaggttaccgtctatttctggg

SEQ ID NO: 775392 - DNA, 25 bp, Mus musculus
tccgaggttgacctgggtagaatct

SEQ ID NO: 775393 - DNA, 25 bp, Mus musculus
tccgaggttgacgtgggtagaatct

SEQ ID NO: 775394 - DNA, 25 bp, Mus musculus
tccgagtagccaccacgatgagcgg

SEQ ID NO: 775395 - DNA, 25 bp, Mus musculus
tccgagtagccagcacgatgagcgg

SEQ ID NO: 775396 - DNA, 25 bp, Mus musculus
tccgagtatacacggagagtgtgct

SEQ ID NO: 775397 - DNA, 25 bp, Mus musculus
tccgagtatacagggagagtgtgct

SEQ ID NO: 775398 - DNA, 25 bp, Mus musculus
tccgagtccccaacaagtggctgat

SEQ ID NO: 775399 - DNA, 25 bp, Mus musculus
tccgagtccccatcaagtggctgat

SEQ ID NO: 775400 - DNA, 25 bp, Mus musculus
tccgagtcgataacacttcaaaagg

SEQ ID NO: 775401 - DNA, 25 bp, Mus musculus
tccgagtcgatatcacttcaaaagg

SEQ ID NO: 775402 - DNA, 25 bp, Mus musculus
tccgagtcggcaagaagataggctg

SEQ ID NO: 775403 - DNA, 25 bp, Mus musculus
tccgagtcggcatgaagataggctg

SEQ ID NO: 775404 - DNA, 25 bp, Mus musculus
tccgagtctcggaacagcagccaca

SEQ ID NO: 775405 - DNA, 25 bp, Mus musculus
tccgagtctcggtacagcagccaca

SEQ ID NO: 775406 - DNA, 25 bp, Mus musculus
tccgagtctctgctcgataagtgcc

SEQ ID NO: 775407 - DNA, 25 bp, Mus musculus
tccgagtctctggtcgataagtgcc

SEQ ID NO: 775408 - DNA, 25 bp, Mus musculus
tccgagtcttagcaggacgaacatt

SEQ ID NO: 775409 - DNA, 25 bp, Mus musculus
tccgagtcttaggaggacgaacatt

SEQ ID NO: 775410 - DNA, 25 bp, Mus musculus
tccgagtgccggacagggtccagaa

SEQ ID NO: 775411 - DNA, 25 bp, Mus musculus
tccgagtgccggtcagggtccagaa

SEQ ID NO: 775412 - DNA, 25 bp, Mus musculus
tccgagtgcggcattacggagtaag

SEQ ID NO: 775413 - DNA, 25 bp, Mus musculus
tccgagtgcggctttacggagtaag

SEQ ID NO: 775414 - DNA, 25 bp, Mus musculus
tccgagtgggctacgtgatgtctgt

SEQ ID NO: 775415 - DNA, 25 bp, Mus musculus
tccgagtgggcttcgtgatgtctgt

SEQ ID NO: 775416 - DNA, 25 bp, Mus musculus
tccgagttccccagaaggttgtgag

SEQ ID NO: 775417 - DNA, 25 bp, Mus musculus
tccgagttcccctgaaggttgtgag

SEQ ID NO: 775418 - DNA, 25 bp, Mus musculus
tccgagttcctaattgggaccaaga

SEQ ID NO: 775419 - DNA, 25 bp, Mus musculus
tccgagttcctatttgggaccaaga

SEQ ID NO: 775420 - DNA, 25 bp, Mus musculus
tccgagttcttacaggagttgtggc

SEQ ID NO: 775421 - DNA, 25 bp, Mus musculus
tccgagttcttagaggagttgtggc

SEQ ID NO: 775422 - DNA, 25 bp, Mus musculus
tccgagttgaagctgacagccgtta

SEQ ID NO: 775423 - DNA, 25 bp, Mus musculus
tccgagttgaaggtgacagccgtta

SEQ ID NO: 775424 - DNA, 25 bp, Mus musculus
tccgagttgcacagaaaaagaacat

SEQ ID NO: 775425 - DNA, 25 bp, Mus musculus
tccgagttgcactgaaaaagaacat

SEQ ID NO: 775426 - DNA, 25 bp, Mus musculus
tccgatacatggatttcaaatccat

SEQ ID NO: 775427 - DNA, 25 bp, Mus musculus
tccgatacatggttttcaaatccat

SEQ ID NO: 775428 - DNA, 25 bp, Mus musculus
tccgatacgctcacatggtcaatgg

SEQ ID NO: 775429 - DNA, 25 bp, Mus musculus
tccgatacgctctcatggtcaatgg

SEQ ID NO: 775430 - DNA, 25 bp, Mus musculus
tccgatagcacacggcaatctagag

SEQ ID NO: 775431 - DNA, 25 bp, Mus musculus
tccgatagcacagggcaatctagag

SEQ ID NO: 775432 - DNA, 25 bp, Mus musculus
tccgatagcacccatcggctagatg

SEQ ID NO: 775433 - DNA, 25 bp, Mus musculus
tccgatagcaccgatcggctagatg

SEQ ID NO: 775434 - DNA, 25 bp, Mus musculus
tccgataggaggagtgctcttcagt

SEQ ID NO: 775435 - DNA, 25 bp, Mus musculus
tccgataggaggtgtgctcttcagt

SEQ ID NO: 775436 - DNA, 25 bp, Mus musculus
tccgatatggctaccggcgtgatct

SEQ ID NO: 775437 - DNA, 25 bp, Mus musculus
tccgatatggcttccggcgtgatct

SEQ ID NO: 775438 - DNA, 25 bp, Mus musculus
tccgatccatttctggaagcagaaa

SEQ ID NO: 775439 - DNA, 25 bp, Mus musculus
tccgatccatttgtggaagcagaaa

SEQ ID NO: 775440 - DNA, 25 bp, Mus musculus
tccgatctaggacttcctcgtggta

SEQ ID NO: 775441 - DNA, 25 bp, Mus musculus
tccgatctaggagttcctcgtggta

SEQ ID NO: 775442 - DNA, 25 bp, Mus musculus
tccgatgagttgaggagccacgtcc

SEQ ID NO: 775443 - DNA, 25 bp, Mus musculus
tccgatgagttgtggagccacgtcc

SEQ ID NO: 775444 - DNA, 25 bp, Mus musculus
tccgatgctaagagcactccaactg

SEQ ID NO: 775445 - DNA, 25 bp, Mus musculus
tccgatgctaagtgcactccaactg

SEQ ID NO: 775446 - DNA, 25 bp, Mus musculus
tccgatgctgtgcagtttccaatta

SEQ ID NO: 775447 - DNA, 25 bp, Mus musculus
tccgatgctgtggagtttccaatta

SEQ ID NO: 775448 - DNA, 25 bp, Mus musculus
tccgatggaagcatcctgcaaacca

SEQ ID NO: 775449 - DNA, 25 bp, Mus musculus
tccgatggaagcttcctgcaaacca

SEQ ID NO: 775450 - DNA, 25 bp, Mus musculus
tccgatggatgcctccagagagcat

SEQ ID NO: 775451 - DNA, 25 bp, Mus musculus
tccgatggatgcgtccagagagcat

SEQ ID NO: 775452 - DNA, 25 bp, Mus musculus
tccgatggctgcagaggacaacccg

SEQ ID NO: 775453 - DNA, 25 bp, Mus musculus
tccgatggctgctgaggacaacccg

SEQ ID NO: 775454 - DNA, 25 bp, Mus musculus
tccgatgtccaaatcccaggagacg

SEQ ID NO: 775455 - DNA, 25 bp, Mus musculus
tccgatgtccaattcccaggagacg

SEQ ID NO: 775456 - DNA, 25 bp, Mus musculus
tccgattaaatacgaaagccaacaa

SEQ ID NO: 775457 - DNA, 25 bp, Mus musculus
tccgattaaataggaaagccaacaa

SEQ ID NO: 775458 - DNA, 25 bp, Mus musculus
tccgattcccgactgcgactggctg

SEQ ID NO: 775459 - DNA, 25 bp, Mus musculus
tccgattcccgagtgcgactggctg

SEQ ID NO: 775460 - DNA, 25 bp, Mus musculus
tccgattggaaaatccctcaggatg

SEQ ID NO: 775461 - DNA, 25 bp, Mus musculus
tccgattggaaattccctcaggatg

SEQ ID NO: 775462 - DNA, 25 bp, Mus musculus
tccgattgggatcgacaaagccctg

SEQ ID NO: 775463 - DNA, 25 bp, Mus musculus
tccgattgggatggacaaagccctg

SEQ ID NO: 775464 - DNA, 25 bp, Mus musculus
tccgcaaatccacccaggatagcga

SEQ ID NO: 775465 - DNA, 25 bp, Mus musculus
tccgcaaatccagccaggatagcga

SEQ ID NO: 775466 - DNA, 25 bp, Mus musculus
tccgcaaatgtactgcaaatcattt

SEQ ID NO: 775467 - DNA, 25 bp, Mus musculus
tccgcaaatgtagtgcaaatcattt

SEQ ID NO: 775468 - DNA, 25 bp, Mus musculus
tccgcaacctggaggccctagcttt

SEQ ID NO: 775469 - DNA, 25 bp, Mus musculus
tccgcaacctggtggccctagcttt

SEQ ID NO: 775470 - DNA, 25 bp, Mus musculus
tccgcaacggcaaccacaagataga

SEQ ID NO: 775471 - DNA, 25 bp, Mus musculus
tccgcaacggcatccacaagataga

SEQ ID NO: 775472 - DNA, 25 bp, Mus musculus
tccgcaactcttaagcgtcgtgcaa

SEQ ID NO: 775473 - DNA, 25 bp, Mus musculus
tccgcaactctttagcgtcgtgcaa

SEQ ID NO: 775474 - DNA, 25 bp, Mus musculus
tccgcaactttgacgatagccccat

SEQ ID NO: 775475 - DNA, 25 bp, Mus musculus
tccgcaactttgtcgatagccccat

SEQ ID NO: 775476 - DNA, 25 bp, Mus musculus
tccgcaaggaagaacccaacgtgct

SEQ ID NO: 775477 - DNA, 25 bp, Mus musculus
tccgcaaggaagtacccaacgtgct

SEQ ID NO: 775478 - DNA, 25 bp, Mus musculus
tccgcaatagacctgttcccgtcta

SEQ ID NO: 775479 - DNA, 25 bp, Mus musculus
tccgcaatagacgtgttcccgtcta

SEQ ID NO: 775480 - DNA, 25 bp, Mus musculus
tccgcacgccggatgtgctggagtc

SEQ ID NO: 775481 - DNA, 25 bp, Mus musculus
tccgcacgccggttgtgctggagtc

SEQ ID NO: 775482 - DNA, 25 bp, Mus musculus
tccgcactgtgaaagactcacaact

SEQ ID NO: 775483 - DNA, 25 bp, Mus musculus
tccgcactgtgatagactcacaact

SEQ ID NO: 775484 - DNA, 25 bp, Mus musculus
tccgcagagacaaagatcggaggaa

SEQ ID NO: 775485 - DNA, 25 bp, Mus musculus
tccgcagagacatagatcggaggaa

SEQ ID NO: 775486 - DNA, 25 bp, Mus musculus
tccgcagccatacagtaagtcacct

SEQ ID NO: 775487 - DNA, 25 bp, Mus musculus
tccgcagccatagagtaagtcacct

SEQ ID NO: 775488 - DNA, 25 bp, Mus musculus
tccgcagccctgctttggattgtcc

SEQ ID NO: 775489 - DNA, 25 bp, Mus musculus
tccgcagccctggtttggattgtcc

SEQ ID NO: 775490 - DNA, 25 bp, Mus musculus
tccgcagctcctcatcgtgttggtg

SEQ ID NO: 775491 - DNA, 25 bp, Mus musculus
tccgcagctcctgatcgtgttggtg

SEQ ID NO: 775492 - DNA, 25 bp, Mus musculus
tccgcaggaatgagcgagccatgct

SEQ ID NO: 775493 - DNA, 25 bp, Mus musculus
tccgcaggaatgtgcgagccatgct

SEQ ID NO: 775494 - DNA, 25 bp, Mus musculus
tccgcaggctctccctgttgaggca

SEQ ID NO: 775495 - DNA, 25 bp, Mus musculus
tccgcaggctctgcctgttgaggca

SEQ ID NO: 775496 - DNA, 25 bp, Mus musculus
tccgcagggattccaaaatccccgg

SEQ ID NO: 775497 - DNA, 25 bp, Mus musculus
tccgcagggattgcaaaatccccgg

SEQ ID NO: 775498 - DNA, 25 bp, Mus musculus
tccgcaggtcgtcacggtcactgca

SEQ ID NO: 775499 - DNA, 25 bp, Mus musculus
tccgcaggtcgtgacggtcactgca

SEQ ID NO: 775500 - DNA, 25 bp, Mus musculus
tccgcagtggcaagtggctatcctg

SEQ ID NO: 775501 - DNA, 25 bp, Mus musculus
tccgcagtggcatgtggctatcctg

SEQ ID NO: 775502 - DNA, 25 bp, Mus musculus
tccgcagtgtctaggatgggcctgt

SEQ ID NO: 775503 - DNA, 25 bp, Mus musculus
tccgcagtgtcttggatgggcctgt

SEQ ID NO: 775504 - DNA, 25 bp, Mus musculus
tccgcagtgtgacccatgcttatta

SEQ ID NO: 775505 - DNA, 25 bp, Mus musculus
tccgcagtgtgagccatgcttatta

SEQ ID NO: 775506 - DNA, 25 bp, Mus musculus
tccgcataacttcctgtaagtgttt

SEQ ID NO: 775507 - DNA, 25 bp, Mus musculus
tccgcataacttgctgtaagtgttt

SEQ ID NO: 775508 - DNA, 25 bp, Mus musculus
tccgcatcaggacccagctaagctg

SEQ ID NO: 775509 - DNA, 25 bp, Mus musculus
tccgcatcaggagccagctaagctg

SEQ ID NO: 775510 - DNA, 25 bp, Mus musculus
tccgcatccagacgtaggaactaga

SEQ ID NO: 775511 - DNA, 25 bp, Mus musculus
tccgcatccagaggtaggaactaga

SEQ ID NO: 775512 - DNA, 25 bp, Mus musculus
tccgcatccggtatggctctgcaag

SEQ ID NO: 775513 - DNA, 25 bp, Mus musculus
tccgcatccggtttggctctgcaag

SEQ ID NO: 775514 - DNA, 25 bp, Mus musculus
tccgcatgactccaagcaaaatcca

SEQ ID NO: 775515 - DNA, 25 bp, Mus musculus
tccgcatgactcgaagcaaaatcca

SEQ ID NO: 775516 - DNA, 25 bp, Mus musculus
tccgcatgatcgagaggcactactt

SEQ ID NO: 775517 - DNA, 25 bp, Mus musculus
tccgcatgatcgtgaggcactactt

SEQ ID NO: 775518 - DNA, 25 bp, Mus musculus
tccgcatggcatcgaggaaccgctc

SEQ ID NO: 775519 - DNA, 25 bp, Mus musculus
tccgcatggcatggaggaaccgctc

SEQ ID NO: 775520 - DNA, 25 bp, Mus musculus
tccgccaacccaaatgcgtcaagtt

SEQ ID NO: 775521 - DNA, 25 bp, Mus musculus
tccgccaacccatatgcgtcaagtt

SEQ ID NO: 775522 - DNA, 25 bp, Mus musculus
tccgccactcgaaaagtatgcctgt

SEQ ID NO: 775523 - DNA, 25 bp, Mus musculus
tccgccactcgataagtatgcctgt

SEQ ID NO: 775524 - DNA, 25 bp, Mus musculus
tccgccagcagtcacgtcactggaa

SEQ ID NO: 775525 - DNA, 25 bp, Mus musculus
tccgccagcagtgacgtcactggaa

SEQ ID NO: 775526 - DNA, 25 bp, Mus musculus
tccgccagccggagccgtctggatg

SEQ ID NO: 775527 - DNA, 25 bp, Mus musculus
tccgccagccggtgccgtctggatg

SEQ ID NO: 775528 - DNA, 25 bp, Mus musculus
tccgccagcgcaaagggtttgttaa

SEQ ID NO: 775529 - DNA, 25 bp, Mus musculus
tccgccagcgcatagggtttgttaa

SEQ ID NO: 775530 - DNA, 25 bp, Mus musculus
tccgccagggcgagagcatcaccat

SEQ ID NO: 775531 - DNA, 25 bp, Mus musculus
tccgccagggcgtgagcatcaccat

SEQ ID NO: 775532 - DNA, 25 bp, Mus musculus
tccgccaggtcaagggcatgttggc

SEQ ID NO: 775533 - DNA, 25 bp, Mus musculus
tccgccaggtcatgggcatgttggc

SEQ ID NO: 775534 - DNA, 25 bp, Mus musculus
tccgccatattgattctgcttctat

SEQ ID NO: 775535 - DNA, 25 bp, Mus musculus
tccgccatattgtttctgcttctat

SEQ ID NO: 775536 - DNA, 25 bp, Mus musculus
tccgccatcttgcattccgcggtag

SEQ ID NO: 775537 - DNA, 25 bp, Mus musculus
tccgccatcttggattccgcggtag

SEQ ID NO: 775538 - DNA, 25 bp, Mus musculus
tccgccattccaaaagtatgcctgc

SEQ ID NO: 775539 - DNA, 25 bp, Mus musculus
tccgccattccataagtatgcctgc

SEQ ID NO: 775540 - DNA, 25 bp, Mus musculus
tccgcccagtggaagaaggtgacca

SEQ ID NO: 775541 - DNA, 25 bp, Mus musculus
tccgcccagtggtagaaggtgacca

SEQ ID NO: 775542 - DNA, 25 bp, Mus musculus
tccgccctgacaatgaggaagccat

SEQ ID NO: 775543 - DNA, 25 bp, Mus musculus
tccgccctgacattgaggaagccat

SEQ ID NO: 775544 - DNA, 25 bp, Mus musculus
tccgcccttgtgatggccgtcacta

SEQ ID NO: 775545 - DNA, 25 bp, Mus musculus
tccgcccttgtgttggccgtcacta

SEQ ID NO: 775546 - DNA, 25 bp, Mus musculus
tccgccgagtatagctgcctcaagg

SEQ ID NO: 775547 - DNA, 25 bp, Mus musculus
tccgccgagtattgctgcctcaagg

SEQ ID NO: 775548 - DNA, 25 bp, Mus musculus
tccgccgagtgccagctcaggagat

SEQ ID NO: 775549 - DNA, 25 bp, Mus musculus
tccgccgagtgcgagctcaggagat

SEQ ID NO: 775550 - DNA, 25 bp, Mus musculus
tccgccgattagatgggttaccaaa

SEQ ID NO: 775551 - DNA, 25 bp, Mus musculus
tccgccgattagttgggttaccaaa

SEQ ID NO: 775552 - DNA, 25 bp, Mus musculus
tccgccgccttaaggcggcgatcgg

SEQ ID NO: 775553 - DNA, 25 bp, Mus musculus
tccgccgccttatggcggcgatcgg

SEQ ID NO: 775554 - DNA, 25 bp, Mus musculus
tccgccggctagagagtacacatgt

SEQ ID NO: 775555 - DNA, 25 bp, Mus musculus
tccgccggctagtgagtacacatgt

SEQ ID NO: 775556 - DNA, 25 bp, Mus musculus
tccgcctaaggcaggtgggagccac

SEQ ID NO: 775557 - DNA, 25 bp, Mus musculus
tccgcctaaggctggtgggagccac

SEQ ID NO: 775558 - DNA, 25 bp, Mus musculus
tccgcctacagtatccagcaggagc

SEQ ID NO: 775559 - DNA, 25 bp, Mus musculus
tccgcctacagtttccagcaggagc

SEQ ID NO: 775560 - DNA, 25 bp, Mus musculus
tccgcctcaacgactgcggtgattg

SEQ ID NO: 775561 - DNA, 25 bp, Mus musculus
tccgcctcaacgtctgcggtgattg

SEQ ID NO: 775562 - DNA, 25 bp, Mus musculus
tccgcctcagtaacggctctgattg

SEQ ID NO: 775563 - DNA, 25 bp, Mus musculus
tccgcctcagtatcggctctgattg

SEQ ID NO: 775564 - DNA, 25 bp, Mus musculus
tccgcctccatgagccggatagcgg

SEQ ID NO: 775565 - DNA, 25 bp, Mus musculus
tccgcctccatgtgccggatagcgg

SEQ ID NO: 775566 - DNA, 25 bp, Mus musculus
tccgcctggatgcattctcagtgct

SEQ ID NO: 775567 - DNA, 25 bp, Mus musculus
tccgcctggatggattctcagtgct

SEQ ID NO: 775568 - DNA, 25 bp, Mus musculus
tccgcctgtcctagcattctttgtg

SEQ ID NO: 775569 - DNA, 25 bp, Mus musculus
tccgcctgtccttgcattctttgtg

SEQ ID NO: 775570 - DNA, 25 bp, Mus musculus
tccgccttcttcactagaaatggcc

SEQ ID NO: 775571 - DNA, 25 bp, Mus musculus
tccgccttcttctctagaaatggcc

SEQ ID NO: 775572 - DNA, 25 bp, Mus musculus
tccgccttttcgatcagggtgggag

SEQ ID NO: 775573 - DNA, 25 bp, Mus musculus
tccgccttttcgttcagggtgggag

SEQ ID NO: 775574 - DNA, 25 bp, Mus musculus
tccgcgaacaccaggattccctgga

SEQ ID NO: 775575 - DNA, 25 bp, Mus musculus
tccgcgaacacctggattccctgga

SEQ ID NO: 775576 - DNA, 25 bp, Mus musculus
tccgcgacaattcagtgagcagctt

SEQ ID NO: 775577 - DNA, 25 bp, Mus musculus
tccgcgacaattgagtgagcagctt

SEQ ID NO: 775578 - DNA, 25 bp, Mus musculus
tccgcgagccgcatatttgggcgcc

SEQ ID NO: 775579 - DNA, 25 bp, Mus musculus
tccgcgagccgcttatttgggcgcc

SEQ ID NO: 775580 - DNA, 25 bp, Mus musculus
tccgcgatgtgacccaggagtcctt

SEQ ID NO: 775581 - DNA, 25 bp, Mus musculus
tccgcgatgtgagccaggagtcctt

SEQ ID NO: 775582 - DNA, 25 bp, Mus musculus
tccgcgcagttcaagtgctgcccgg

SEQ ID NO: 775583 - DNA, 25 bp, Mus musculus
tccgcgcagttctagtgctgcccgg

SEQ ID NO: 775584 - DNA, 25 bp, Mus musculus
tccgcgcccctgactaaagtcgatg

SEQ ID NO: 775585 - DNA, 25 bp, Mus musculus
tccgcgcccctgtctaaagtcgatg

SEQ ID NO: 775586 - DNA, 25 bp, Mus musculus
tccgcgccgccacagctttaggaaa

SEQ ID NO: 775587 - DNA, 25 bp, Mus musculus
tccgcgccgccagagctttaggaaa

SEQ ID NO: 775588 - DNA, 25 bp, Mus musculus
tccgcgccgggcatagagaaattgc

SEQ ID NO: 775589 - DNA, 25 bp, Mus musculus
tccgcgccgggcttagagaaattgc

SEQ ID NO: 775590 - DNA, 25 bp, Mus musculus
tccgcgccgtgacgtgccaagctgt

SEQ ID NO: 775591 - DNA, 25 bp, Mus musculus
tccgcgccgtgaggtgccaagctgt

SEQ ID NO: 775592 - DNA, 25 bp, Mus musculus
tccgcgcttttcattaccgtacgca

SEQ ID NO: 775593 - DNA, 25 bp, Mus musculus
tccgcgcttttctttaccgtacgca

SEQ ID NO: 775594 - DNA, 25 bp, Mus musculus
tccgcggaggcccacaggattcgtt

SEQ ID NO: 775595 - DNA, 25 bp, Mus musculus
tccgcggaggccgacaggattcgtt

SEQ ID NO: 775596 - DNA, 25 bp, Mus musculus
tccgcggagggaaggagtacaacat

SEQ ID NO: 775597 - DNA, 25 bp, Mus musculus
tccgcggagggatggagtacaacat

SEQ ID NO: 775598 - DNA, 25 bp, Mus musculus
tccgcggcgcccagagggcttcgat

SEQ ID NO: 775599 - DNA, 25 bp, Mus musculus
tccgcggcgccctgagggcttcgat

SEQ ID NO: 775600 - DNA, 25 bp, Mus musculus
tccgcggctgcaccatcaaggttgt

SEQ ID NO: 775601 - DNA, 25 bp, Mus musculus
tccgcggctgcagcatcaaggttgt

SEQ ID NO: 775602 - DNA, 25 bp, Mus musculus
tccgcgggtattctcaggaggccta

SEQ ID NO: 775603 - DNA, 25 bp, Mus musculus
tccgcgggtattgtcaggaggccta

SEQ ID NO: 775604 - DNA, 25 bp, Mus musculus
tccgcgggtctcctcgcgggtatct

SEQ ID NO: 775605 - DNA, 25 bp, Mus musculus
tccgcgggtctcgtcgcgggtatct

SEQ ID NO: 775606 - DNA, 25 bp, Mus musculus
tccgcggtagcgctggcggcggtaa

SEQ ID NO: 775607 - DNA, 25 bp, Mus musculus
tccgcggtagcggtggcggcggtaa

SEQ ID NO: 775608 - DNA, 25 bp, Mus musculus
tccgcggtcgttactgaccgcctgg

SEQ ID NO: 775609 - DNA, 25 bp, Mus musculus
tccgcggtcgtttctgaccgcctgg

SEQ ID NO: 775610 - DNA, 25 bp, Mus musculus
tccgcggtgttgaggagaaccacgc

SEQ ID NO: 775611 - DNA, 25 bp, Mus musculus
tccgcggtgttgtggagaaccacgc

SEQ ID NO: 775612 - DNA, 25 bp, Mus musculus
tccgcgtaccctcgaagcatttcgg

SEQ ID NO: 775613 - DNA, 25 bp, Mus musculus
tccgcgtaccctggaagcatttcgg

SEQ ID NO: 775614 - DNA, 25 bp, Mus musculus
tccgcgtccgggagagactaaggtc

SEQ ID NO: 775615 - DNA, 25 bp, Mus musculus
tccgcgtccgggtgagactaaggtc

SEQ ID NO: 775616 - DNA, 25 bp, Mus musculus
tccgcgtgatttccccgccgccttt

SEQ ID NO: 775617 - DNA, 25 bp, Mus musculus
tccgcgtgatttgcccgccgccttt

SEQ ID NO: 775618 - DNA, 25 bp, Mus musculus
tccgctacatcgagttcaaacaggg

SEQ ID NO: 775619 - DNA, 25 bp, Mus musculus
tccgctacatcgtgttcaaacaggg

SEQ ID NO: 775620 - DNA, 25 bp, Mus musculus
tccgctacatgtatagccgagagaa

SEQ ID NO: 775621 - DNA, 25 bp, Mus musculus
tccgctacatgtttagccgagagaa

SEQ ID NO: 775622 - DNA, 25 bp, Mus musculus
tccgctaccgaaagcaaccgtggag

SEQ ID NO: 775623 - DNA, 25 bp, Mus musculus
tccgctaccgaatgcaaccgtggag

SEQ ID NO: 775624 - DNA, 25 bp, Mus musculus
tccgctactcacaagggccaaagat

SEQ ID NO: 775625 - DNA, 25 bp, Mus musculus
tccgctactcactagggccaaagat

SEQ ID NO: 775626 - DNA, 25 bp, Mus musculus
tccgctatcccaatgggctcctggg

SEQ ID NO: 775627 - DNA, 25 bp, Mus musculus
tccgctatcccattgggctcctggg

SEQ ID NO: 775628 - DNA, 25 bp, Mus musculus
tccgctatgctcaagatgatttctc

SEQ ID NO: 775629 - DNA, 25 bp, Mus musculus
tccgctatgctctagatgatttctc

SEQ ID NO: 775630 - DNA, 25 bp, Mus musculus
tccgctcatatgcttacctgctgct

SEQ ID NO: 775631 - DNA, 25 bp, Mus musculus
tccgctcatatggttacctgctgct

SEQ ID NO: 775632 - DNA, 25 bp, Mus musculus
tccgctcatttcactaagccttgaa

SEQ ID NO: 775633 - DNA, 25 bp, Mus musculus
tccgctcatttctctaagccttgaa

SEQ ID NO: 775634 - DNA, 25 bp, Mus musculus
tccgctcctcgtcattctgcatttt

SEQ ID NO: 775635 - DNA, 25 bp, Mus musculus
tccgctcctcgtgattctgcatttt

SEQ ID NO: 775636 - DNA, 25 bp, Mus musculus
tccgctcgctgtccatggtttctga

SEQ ID NO: 775637 - DNA, 25 bp, Mus musculus
tccgctcgctgtgcatggtttctga

SEQ ID NO: 775638 - DNA, 25 bp, Mus musculus
tccgctctgctcatcgtcaggagaa

SEQ ID NO: 775639 - DNA, 25 bp, Mus musculus
tccgctctgctcttcgtcaggagaa

SEQ ID NO: 775640 - DNA, 25 bp, Mus musculus
tccgctcttgccagagaggactcaa

SEQ ID NO: 775641 - DNA, 25 bp, Mus musculus
tccgctcttgcctgagaggactcaa

SEQ ID NO: 775642 - DNA, 25 bp, Mus musculus
tccgctgccccacagaggatgcagt

SEQ ID NO: 775643 - DNA, 25 bp, Mus musculus
tccgctgccccacattctacaagca

SEQ ID NO: 775644 - DNA, 25 bp, Mus musculus
tccgctgccccagagaggatgcagt

SEQ ID NO: 775645 - DNA, 25 bp, Mus musculus
tccgctgccccagattctacaagca

SEQ ID NO: 775646 - DNA, 25 bp, Mus musculus
tccgctgctagcagaataacaagac

SEQ ID NO: 775647 - DNA, 25 bp, Mus musculus
tccgctgctagctgaataacaagac

SEQ ID NO: 775648 - DNA, 25 bp, Mus musculus
tccgctggcatacggcatgacatct

SEQ ID NO: 775649 - DNA, 25 bp, Mus musculus
tccgctggcatagggcatgacatct

SEQ ID NO: 775650 - DNA, 25 bp, Mus musculus
tccgctgggaggagtgataagtaac

SEQ ID NO: 775651 - DNA, 25 bp, Mus musculus
tccgctgggaggtgtgataagtaac

SEQ ID NO: 775652 - DNA, 25 bp, Mus musculus
tccgctggtcctcatgcaggcctgt

SEQ ID NO: 775653 - DNA, 25 bp, Mus musculus
tccgctggtcctgatgcaggcctgt

SEQ ID NO: 775654 - DNA, 25 bp, Mus musculus
tccgctggtctgagggctaaagttg

SEQ ID NO: 775655 - DNA, 25 bp, Mus musculus
tccgctggtctgtgggctaaagttg

SEQ ID NO: 775656 - DNA, 25 bp, Mus musculus
tccgctgtagagctgacctgactgc

SEQ ID NO: 775657 - DNA, 25 bp, Mus musculus
tccgctgtagaggtgacctgactgc

SEQ ID NO: 775658 - DNA, 25 bp, Mus musculus
tccgctgtctggcaagctctcagca

SEQ ID NO: 775659 - DNA, 25 bp, Mus musculus
tccgctgtctgggaagctctcagca

SEQ ID NO: 775660 - DNA, 25 bp, Mus musculus
tccgctgtgtcaacgtgcctgggag

SEQ ID NO: 775661 - DNA, 25 bp, Mus musculus
tccgctgtgtcatcgtgcctgggag

SEQ ID NO: 775662 - DNA, 25 bp, Mus musculus
tccgcttagagaaggtgtagccggt

SEQ ID NO: 775663 - DNA, 25 bp, Mus musculus
tccgcttagagatggtgtagccggt

SEQ ID NO: 775664 - DNA, 25 bp, Mus musculus
tccgcttcagatcggaagagtcata

SEQ ID NO: 775665 - DNA, 25 bp, Mus musculus
tccgcttcagatgggaagagtcata

SEQ ID NO: 775666 - DNA, 25 bp, Mus musculus
tccgcttctggtagaccttcccggg

SEQ ID NO: 775667 - DNA, 25 bp, Mus musculus
tccgcttctggttgaccttcccggg

SEQ ID NO: 775668 - DNA, 25 bp, Mus musculus
tccgcttggccaccagtaccaaagg

SEQ ID NO: 775669 - DNA, 25 bp, Mus musculus
tccgcttggccagcagtaccaaagg

SEQ ID NO: 775670 - DNA, 25 bp, Mus musculus
tccgcttggtggaggagactcgaat

SEQ ID NO: 775671 - DNA, 25 bp, Mus musculus
tccgcttggtggtggagactcgaat

SEQ ID NO: 775672 - DNA, 25 bp, Mus musculus
tccgctttggctagtcgattgctca

SEQ ID NO: 775673 - DNA, 25 bp, Mus musculus
tccgctttggcttgtcgattgctca

SEQ ID NO: 775674 - DNA, 25 bp, Mus musculus
tccggaaacgatcccttacttagac

SEQ ID NO: 775675 - DNA, 25 bp, Mus musculus
tccggaaacgatgccttacttagac

SEQ ID NO: 775676 - DNA, 25 bp, Mus musculus
tccggaaatagcataaaacgcccag

SEQ ID NO: 775677 - DNA, 25 bp, Mus musculus
tccggaaatagcttaaaacgcccag

SEQ ID NO: 775678 - DNA, 25 bp, Mus musculus
tccggaaccagaacggcccgcggtg

SEQ ID NO: 775679 - DNA, 25 bp, Mus musculus
tccggaaccagatcggcccgcggtg

SEQ ID NO: 775680 - DNA, 25 bp, Mus musculus
tccggaacctgtcctcagatgacac

SEQ ID NO: 775681 - DNA, 25 bp, Mus musculus
tccggaacctgtgctcagatgacac

SEQ ID NO: 775682 - DNA, 25 bp, Mus musculus
tccggaacgcgaagcgcacgtattt

SEQ ID NO: 775683 - DNA, 25 bp, Mus musculus
tccggaacgcgatgcgcacgtattt

SEQ ID NO: 775684 - DNA, 25 bp, Mus musculus
tccggaactcaaagcagatgtacag

SEQ ID NO: 775685 - DNA, 25 bp, Mus musculus
tccggaactcaatgcagatgtacag

SEQ ID NO: 775686 - DNA, 25 bp, Mus musculus
tccggaactcctcagggcgcaaggc

SEQ ID NO: 775687 - DNA, 25 bp, Mus musculus
tccggaactcctgagggcgcaaggc

SEQ ID NO: 775688 - DNA, 25 bp, Mus musculus
tccggaagaattatactgcgaagtt

SEQ ID NO: 775689 - DNA, 25 bp, Mus musculus
tccggaagaattttactgcgaagtt

SEQ ID NO: 775690 - DNA, 25 bp, Mus musculus
tccggaagcctccaagtgattttct

SEQ ID NO: 775691 - DNA, 25 bp, Mus musculus
tccggaagcctcgaagtgattttct

SEQ ID NO: 775692 - DNA, 25 bp, Mus musculus
tccggaagctccaacatttatggtt

SEQ ID NO: 775693 - DNA, 25 bp, Mus musculus
tccggaagctcctacatttatggtt

SEQ ID NO: 775694 - DNA, 25 bp, Mus musculus
tccggaagctgcataactcttacac

SEQ ID NO: 775695 - DNA, 25 bp, Mus musculus
tccggaagctgcttaactcttacac

SEQ ID NO: 775696 - DNA, 25 bp, Mus musculus
tccggaaggacaaagatggcaagtt

SEQ ID NO: 775697 - DNA, 25 bp, Mus musculus
tccggaaggacatagatggcaagtt

SEQ ID NO: 775698 - DNA, 25 bp, Mus musculus
tccggaagggaaacccgctggagca

SEQ ID NO: 775699 - DNA, 25 bp, Mus musculus
tccggaagggaatcccgctggagca

SEQ ID NO: 775700 - DNA, 25 bp, Mus musculus
tccggaagtcacaagacacaccctt

SEQ ID NO: 775701 - DNA, 25 bp, Mus musculus
tccggaagtcactagacacaccctt

SEQ ID NO: 775702 - DNA, 25 bp, Mus musculus
tccggaagtcatcgtaagcctgttt

SEQ ID NO: 775703 - DNA, 25 bp, Mus musculus
tccggaagtcatggtaagcctgttt

SEQ ID NO: 775704 - DNA, 25 bp, Mus musculus
tccggaagtctactgtccctacagc

SEQ ID NO: 775705 - DNA, 25 bp, Mus musculus
tccggaagtctagtgtccctacagc

SEQ ID NO: 775706 - DNA, 25 bp, Mus musculus
tccggaagtggaagtggtaccagtt

SEQ ID NO: 775707 - DNA, 25 bp, Mus musculus
tccggaagtggatgtggtaccagtt

SEQ ID NO: 775708 - DNA, 25 bp, Mus musculus
tccggaagttgcaacgggaacagca

SEQ ID NO: 775709 - DNA, 25 bp, Mus musculus
tccggaagttgctacgggaacagca

SEQ ID NO: 775710 - DNA, 25 bp, Mus musculus
tccggaatacaacgacaacaaactt

SEQ ID NO: 775711 - DNA, 25 bp, Mus musculus
tccggaatacaaggacaacaaactt

SEQ ID NO: 775712 - DNA, 25 bp, Mus musculus
tccggaatcattatcgctggttccc

SEQ ID NO: 775713 - DNA, 25 bp, Mus musculus
tccggaatcattttcgctggttccc

SEQ ID NO: 775714 - DNA, 25 bp, Mus musculus
tccggaatcgttcggctcagtgctg

SEQ ID NO: 775715 - DNA, 25 bp, Mus musculus
tccggaatcgttgggctcagtgctg

SEQ ID NO: 775716 - DNA, 25 bp, Mus musculus
tccggaatgggaaaaagtcaattgc

SEQ ID NO: 775717 - DNA, 25 bp, Mus musculus
tccggaatgggataaagtcaattgc

SEQ ID NO: 775718 - DNA, 25 bp, Mus musculus
tccggaattcgtcccgtggccctag

SEQ ID NO: 775719 - DNA, 25 bp, Mus musculus
tccggaattcgtgccgtggccctag

SEQ ID NO: 775720 - DNA, 25 bp, Mus musculus
tccggaattgtgattacacttacag

SEQ ID NO: 775721 - DNA, 25 bp, Mus musculus
tccggaattgtgtttacacttacag

SEQ ID NO: 775722 - DNA, 25 bp, Mus musculus
tccggacacttgcttgagacgctcc

SEQ ID NO: 775723 - DNA, 25 bp, Mus musculus
tccggacacttggttgagacgctcc

SEQ ID NO: 775724 - DNA, 25 bp, Mus musculus
tccggacatgatacttggacatctt

SEQ ID NO: 775725 - DNA, 25 bp, Mus musculus
tccggacatgattcttggacatctt

SEQ ID NO: 775726 - DNA, 25 bp, Mus musculus
tccggacatttgatgaatttcagga

SEQ ID NO: 775727 - DNA, 25 bp, Mus musculus
tccggacatttgttgaatttcagga

SEQ ID NO: 775728 - DNA, 25 bp, Mus musculus
tccggaccgaagcatgattgctgct

SEQ ID NO: 775729 - DNA, 25 bp, Mus musculus
tccggaccgaaggatgattgctgct

SEQ ID NO: 775730 - DNA, 25 bp, Mus musculus
tccggacctgacagagacatgcagc

SEQ ID NO: 775731 - DNA, 25 bp, Mus musculus
tccggacctgactgagacatgcagc

SEQ ID NO: 775732 - DNA, 25 bp, Mus musculus
tccggacgacataactatgaggcct

SEQ ID NO: 775733 - DNA, 25 bp, Mus musculus
tccggacgacattactatgaggcct

SEQ ID NO: 775734 - DNA, 25 bp, Mus musculus
tccggacggaagaagtccacaccgg

SEQ ID NO: 775735 - DNA, 25 bp, Mus musculus
tccggacggaagtagtccacaccgg

SEQ ID NO: 775736 - DNA, 25 bp, Mus musculus
tccggactccgccatcagcaggagg

SEQ ID NO: 775737 - DNA, 25 bp, Mus musculus
tccggactccgcgatcagcaggagg

SEQ ID NO: 775738 - DNA, 25 bp, Mus musculus
tccggactgtcgaaagaggtcagac

SEQ ID NO: 775739 - DNA, 25 bp, Mus musculus
tccggactgtcgtaagaggtcagac

SEQ ID NO: 775740 - DNA, 25 bp, Mus musculus
tccggagaaagtccacgccgtccaa

SEQ ID NO: 775741 - DNA, 25 bp, Mus musculus
tccggagaaagtgcacgccgtccaa

SEQ ID NO: 775742 - DNA, 25 bp, Mus musculus
tccggagaacgaagcggctacagca

SEQ ID NO: 775743 - DNA, 25 bp, Mus musculus
tccggagaacgatgcggctacagca

SEQ ID NO: 775744 - DNA, 25 bp, Mus musculus
tccggagactacaggaaggttctgc

SEQ ID NO: 775745 - DNA, 25 bp, Mus musculus
tccggagactactggaaggttctgc

SEQ ID NO: 775746 - DNA, 25 bp, Mus musculus
tccggagactgaaaggagtgactga

SEQ ID NO: 775747 - DNA, 25 bp, Mus musculus
tccggagactgataggagtgactga

SEQ ID NO: 775748 - DNA, 25 bp, Mus musculus
tccggagagacaagatggtggttta

SEQ ID NO: 775749 - DNA, 25 bp, Mus musculus
tccggagagacatgatggtggttta

SEQ ID NO: 775750 - DNA, 25 bp, Mus musculus
tccggagagcttagggcaggccttt

SEQ ID NO: 775751 - DNA, 25 bp, Mus musculus
tccggagagctttgggcaggccttt

SEQ ID NO: 775752 - DNA, 25 bp, Mus musculus
tccggagagttcagctgatcctaat

SEQ ID NO: 775753 - DNA, 25 bp, Mus musculus
tccggagagttctgctgatcctaat

SEQ ID NO: 775754 - DNA, 25 bp, Mus musculus
tccggagcgtctaggagcctgcctg

SEQ ID NO: 775755 - DNA, 25 bp, Mus musculus
tccggagcgtcttggagcctgcctg

SEQ ID NO: 775756 - DNA, 25 bp, Mus musculus
tccggaggagatctacattcaacag

SEQ ID NO: 775757 - DNA, 25 bp, Mus musculus
tccggaggagatgtacattcaacag

SEQ ID NO: 775758 - DNA, 25 bp, Mus musculus
tccggaggcaagacataaggaatgg

SEQ ID NO: 775759 - DNA, 25 bp, Mus musculus
tccggaggcaagtcataaggaatgg

SEQ ID NO: 775760 - DNA, 25 bp, Mus musculus
tccggaggtagtccccagtgactct

SEQ ID NO: 775761 - DNA, 25 bp, Mus musculus
tccggaggtagtgcccagtgactct

SEQ ID NO: 775762 - DNA, 25 bp, Mus musculus
tccggaggtccaagccagcatgcag

SEQ ID NO: 775763 - DNA, 25 bp, Mus musculus
tccggaggtccatgccagcatgcag

SEQ ID NO: 775764 - DNA, 25 bp, Mus musculus
tccggagtcaataccaggatcgacg

SEQ ID NO: 775765 - DNA, 25 bp, Mus musculus
tccggagtcaattccaggatcgacg

SEQ ID NO: 775766 - DNA, 25 bp, Mus musculus
tccggatcagacatgtgcctacctc

SEQ ID NO: 775767 - DNA, 25 bp, Mus musculus
tccggatcagacttgtgcctacctc

SEQ ID NO: 775768 - DNA, 25 bp, Mus musculus
tccggatcccacacatgtggaagga

SEQ ID NO: 775769 - DNA, 25 bp, Mus musculus
tccggatcccactcatgtggaagga

SEQ ID NO: 775770 - DNA, 25 bp, Mus musculus
tccggatccgcaatgatgatgaacc

SEQ ID NO: 775771 - DNA, 25 bp, Mus musculus
tccggatccgcattgatgatgaacc

SEQ ID NO: 775772 - DNA, 25 bp, Mus musculus
tccggatcgagaatctggagctgat

SEQ ID NO: 775773 - DNA, 25 bp, Mus musculus
tccggatcgagattctggagctgat

SEQ ID NO: 775774 - DNA, 25 bp, Mus musculus
tccggatgcagaaccaagagaactt

SEQ ID NO: 775775 - DNA, 25 bp, Mus musculus
tccggatgcagatccaagagaactt

SEQ ID NO: 775776 - DNA, 25 bp, Mus musculus
tccggatgtacaccagcagtattta

SEQ ID NO: 775777 - DNA, 25 bp, Mus musculus
tccggatgtacagcagcagtattta

SEQ ID NO: 775778 - DNA, 25 bp, Mus musculus
tccggattctagaaaggactccagg

SEQ ID NO: 775779 - DNA, 25 bp, Mus musculus
tccggattctagtaaggactccagg

SEQ ID NO: 775780 - DNA, 25 bp, Mus musculus
tccggatttggactggcatgcagca

SEQ ID NO: 775781 - DNA, 25 bp, Mus musculus
tccggatttggagtggcatgcagca

SEQ ID NO: 775782 - DNA, 25 bp, Mus musculus
tccggcaaaccactgctatgtactg

SEQ ID NO: 775783 - DNA, 25 bp, Mus musculus
tccggcaaaccagtgctatgtactg

SEQ ID NO: 775784 - DNA, 25 bp, Mus musculus
tccggcaacgaaaagagaagaagca

SEQ ID NO: 775785 - DNA, 25 bp, Mus musculus
tccggcaacgaatagagaagaagca

SEQ ID NO: 775786 - DNA, 25 bp, Mus musculus
tccggcaacgacagtgagtttgcct

SEQ ID NO: 775787 - DNA, 25 bp, Mus musculus
tccggcaacgactgtgagtttgcct

SEQ ID NO: 775788 - DNA, 25 bp, Mus musculus
tccggcaagctcacccagtttggag

SEQ ID NO: 775789 - DNA, 25 bp, Mus musculus
tccggcaagctctcccagtttggag

SEQ ID NO: 775790 - DNA, 25 bp, Mus musculus
tccggcacatcaattgggatgatct

SEQ ID NO: 775791 - DNA, 25 bp, Mus musculus
tccggcacatcatttgggatgatct

SEQ ID NO: 775792 - DNA, 25 bp, Mus musculus
tccggcacgctgattggctactcgg

SEQ ID NO: 775793 - DNA, 25 bp, Mus musculus
tccggcacgctgtttggctactcgg

SEQ ID NO: 775794 - DNA, 25 bp, Mus musculus
tccggcactatgacctggactcggt

SEQ ID NO: 775795 - DNA, 25 bp, Mus musculus
tccggcactatgtcctggactcggt

SEQ ID NO: 775796 - DNA, 25 bp, Mus musculus
tccggcagaggcaagagccggcttt

SEQ ID NO: 775797 - DNA, 25 bp, Mus musculus
tccggcagaggctagagccggcttt

SEQ ID NO: 775798 - DNA, 25 bp, Mus musculus
tccggcagcccaatggcagtctgca

SEQ ID NO: 775799 - DNA, 25 bp, Mus musculus
tccggcagcccattggcagtctgca

SEQ ID NO: 775800 - DNA, 25 bp, Mus musculus
tccggcatccggatgaacaccaagg

SEQ ID NO: 775801 - DNA, 25 bp, Mus musculus
tccggcatccggttgaacaccaagg

SEQ ID NO: 775802 - DNA, 25 bp, Mus musculus
tccggcattataataccctgagcta

SEQ ID NO: 775803 - DNA, 25 bp, Mus musculus
tccggcattatattaccctgagcta

SEQ ID NO: 775804 - DNA, 25 bp, Mus musculus
tccggccaagtccacatagcaagct

SEQ ID NO: 775805 - DNA, 25 bp, Mus musculus
tccggccaagtcgacatagcaagct

SEQ ID NO: 775806 - DNA, 25 bp, Mus musculus
tccggccacattagtgactccacta

SEQ ID NO: 775807 - DNA, 25 bp, Mus musculus
tccggccacatttgtgactccacta

SEQ ID NO: 775808 - DNA, 25 bp, Mus musculus
tccggccactaacggactaccaagt

SEQ ID NO: 775809 - DNA, 25 bp, Mus musculus
tccggccactaagggactaccaagt

SEQ ID NO: 775810 - DNA, 25 bp, Mus musculus
tccggccaggaaaggtgcctatcag

SEQ ID NO: 775811 - DNA, 25 bp, Mus musculus
tccggccaggaatggtgcctatcag

SEQ ID NO: 775812 - DNA, 25 bp, Mus musculus
tccggccagttcaacactaccaaag

SEQ ID NO: 775813 - DNA, 25 bp, Mus musculus
tccggccagttctacactaccaaag

SEQ ID NO: 775814 - DNA, 25 bp, Mus musculus
tccggccctatgagggcattcatct

SEQ ID NO: 775815 - DNA, 25 bp, Mus musculus
tccggccctatgtgggcattcatct

SEQ ID NO: 775816 - DNA, 25 bp, Mus musculus
tccggccggaccacgttgtactgga

SEQ ID NO: 775817 - DNA, 25 bp, Mus musculus
tccggccggacctcgttgtactgga

SEQ ID NO: 775818 - DNA, 25 bp, Mus musculus
tccggcctgcttcttagccgcaggg

SEQ ID NO: 775819 - DNA, 25 bp, Mus musculus
tccggcctgcttgttagccgcaggg

SEQ ID NO: 775820 - DNA, 25 bp, Mus musculus
tccggcctggaaagtgaagtgactc

SEQ ID NO: 775821 - DNA, 25 bp, Mus musculus
tccggcctggaatgtgaagtgactc

SEQ ID NO: 775822 - DNA, 25 bp, Mus musculus
tccggccttaggagagtcgcagaga

SEQ ID NO: 775823 - DNA, 25 bp, Mus musculus
tccggccttaggtgagtcgcagaga

SEQ ID NO: 775824 - DNA, 25 bp, Mus musculus
tccggcgagcctctcgcggtttctg

SEQ ID NO: 775825 - DNA, 25 bp, Mus musculus
tccggcgagcctgtcgcggtttctg

SEQ ID NO: 775826 - DNA, 25 bp, Mus musculus
tccggcgcttcaactccagctggaa

SEQ ID NO: 775827 - DNA, 25 bp, Mus musculus
tccggcgcttcatctccagctggaa

SEQ ID NO: 775828 - DNA, 25 bp, Mus musculus
tccggcggatggacacaagtttctt

SEQ ID NO: 775829 - DNA, 25 bp, Mus musculus
tccggcggatggtcacaagtttctt

SEQ ID NO: 775830 - DNA, 25 bp, Mus musculus
tccggcggcgtgactacgatgcctt

SEQ ID NO: 775831 - DNA, 25 bp, Mus musculus
tccggcggcgtgtctacgatgcctt

SEQ ID NO: 775832 - DNA, 25 bp, Mus musculus
tccggcgggcacagttcctgacttc

SEQ ID NO: 775833 - DNA, 25 bp, Mus musculus
tccggcgggcactgttcctgacttc

SEQ ID NO: 775834 - DNA, 25 bp, Mus musculus
tccggcgtgatcacgctggtttgcg

SEQ ID NO: 775835 - DNA, 25 bp, Mus musculus
tccggcgtgatctcgctggtttgcg

SEQ ID NO: 775836 - DNA, 25 bp, Mus musculus
tccggcgttgcaaccgccgtcggaa

SEQ ID NO: 775837 - DNA, 25 bp, Mus musculus
tccggcgttgcatccgccgtcggaa

SEQ ID NO: 775838 - DNA, 25 bp, Mus musculus
tccggctcaagcattgccctactgt

SEQ ID NO: 775839 - DNA, 25 bp, Mus musculus
tccggctcaagctttgccctactgt

SEQ ID NO: 775840 - DNA, 25 bp, Mus musculus
tccggctcgaagcttctggattaca

SEQ ID NO: 775841 - DNA, 25 bp, Mus musculus
tccggctcgaaggttctggattaca

SEQ ID NO: 775842 - DNA, 25 bp, Mus musculus
tccggctcgacaagtctgagttcca

SEQ ID NO: 775843 - DNA, 25 bp, Mus musculus
tccggctcgacatgtctgagttcca

SEQ ID NO: 775844 - DNA, 25 bp, Mus musculus
tccggctcggagacggagacatact

SEQ ID NO: 775845 - DNA, 25 bp, Mus musculus
tccggctcggagtcggagacatact

SEQ ID NO: 775846 - DNA, 25 bp, Mus musculus
tccggctctgtcagccaggacctgt

SEQ ID NO: 775847 - DNA, 25 bp, Mus musculus
tccggctctgtctgccaggacctgt

SEQ ID NO: 775848 - DNA, 25 bp, Mus musculus
tccggctgattcctcgagtgaggcc

SEQ ID NO: 775849 - DNA, 25 bp, Mus musculus
tccggctgattcgtcgagtgaggcc

SEQ ID NO: 775850 - DNA, 25 bp, Mus musculus
tccggctgcaggctatgatcgcatt

SEQ ID NO: 775851 - DNA, 25 bp, Mus musculus
tccggctgcagggtatgatcgcatt

SEQ ID NO: 775852 - DNA, 25 bp, Mus musculus
tccggctgccgacgaaatttcagga

SEQ ID NO: 775853 - DNA, 25 bp, Mus musculus
tccggctgccgaggaaatttcagga

SEQ ID NO: 775854 - DNA, 25 bp, Mus musculus
tccggctggtagatgcactcatggg

SEQ ID NO: 775855 - DNA, 25 bp, Mus musculus
tccggctggtagttgcactcatggg

SEQ ID NO: 775856 - DNA, 25 bp, Mus musculus
tccggctgtattactatgagcgcag

SEQ ID NO: 775857 - DNA, 25 bp, Mus musculus
tccggctgtatttctatgagcgcag

SEQ ID NO: 775858 - DNA, 25 bp, Mus musculus
tccggctgttggaaggacaattaat

SEQ ID NO: 775859 - DNA, 25 bp, Mus musculus
tccggctgttggtaggacaattaat

SEQ ID NO: 775860 - DNA, 25 bp, Mus musculus
tccggcttaaagattgtggcttaca

SEQ ID NO: 775861 - DNA, 25 bp, Mus musculus
tccggcttaaagtttgtggcttaca

SEQ ID NO: 775862 - DNA, 25 bp, Mus musculus
tccggcttgagactttgatagaaaa

SEQ ID NO: 775863 - DNA, 25 bp, Mus musculus
tccggcttgagagtttgatagaaaa

SEQ ID NO: 775864 - DNA, 25 bp, Mus musculus
tccgggaaaagaactggaaggccat

SEQ ID NO: 775865 - DNA, 25 bp, Mus musculus
tccgggaaaagatctggaaggccat

SEQ ID NO: 775866 - DNA, 25 bp, Mus musculus
tccgggaaatggactgtcagcaaac

SEQ ID NO: 775867 - DNA, 25 bp, Mus musculus
tccgggaaatggtctgtcagcaaac

SEQ ID NO: 775868 - DNA, 25 bp, Mus musculus
tccgggaacaaaatgacaacctagc

SEQ ID NO: 775869 - DNA, 25 bp, Mus musculus
tccgggaacaaattgacaacctagc

SEQ ID NO: 775870 - DNA, 25 bp, Mus musculus
tccgggaaccagactgtgaggctac

SEQ ID NO: 775871 - DNA, 25 bp, Mus musculus
tccgggaaccagctagcactttgca

SEQ ID NO: 775872 - DNA, 25 bp, Mus musculus
tccgggaaccaggtagcactttgca

SEQ ID NO: 775873 - DNA, 25 bp, Mus musculus
tccgggaaccagtctgtgaggctac

SEQ ID NO: 775874 - DNA, 25 bp, Mus musculus
tccgggaacccgctcgtgtacttgg

SEQ ID NO: 775875 - DNA, 25 bp, Mus musculus
tccgggaacccggtcgtgtacttgg

SEQ ID NO: 775876 - DNA, 25 bp, Mus musculus
tccgggaactaccttgcctgtggag

SEQ ID NO: 775877 - DNA, 25 bp, Mus musculus
tccgggaactacgttgcctgtggag

SEQ ID NO: 775878 - DNA, 25 bp, Mus musculus
tccgggaagatcaagcccagcgcat

SEQ ID NO: 775879 - DNA, 25 bp, Mus musculus
tccgggaagatctagcccagcgcat

SEQ ID NO: 775880 - DNA, 25 bp, Mus musculus
tccgggaagattataacccagagtg

SEQ ID NO: 775881 - DNA, 25 bp, Mus musculus
tccgggaagattttaacccagagtg

SEQ ID NO: 775882 - DNA, 25 bp, Mus musculus
tccgggaagcccatgaagtcatcct

SEQ ID NO: 775883 - DNA, 25 bp, Mus musculus
tccgggaagcccttgaagtcatcct

SEQ ID NO: 775884 - DNA, 25 bp, Mus musculus
tccgggaaggtccaaccaaggctgt

SEQ ID NO: 775885 - DNA, 25 bp, Mus musculus
tccgggaaggtcgaaccaaggctgt

SEQ ID NO: 775886 - DNA, 25 bp, Mus musculus
tccgggaagtgtcgtacttcggcct

SEQ ID NO: 775887 - DNA, 25 bp, Mus musculus
tccgggaagtgtggtacttcggcct

SEQ ID NO: 775888 - DNA, 25 bp, Mus musculus
tccgggaataccatgctaggagtgg

SEQ ID NO: 775889 - DNA, 25 bp, Mus musculus
tccgggaataccttgctaggagtgg

SEQ ID NO: 775890 - DNA, 25 bp, Mus musculus
tccgggaattccaccgcgtcaaggt

SEQ ID NO: 775891 - DNA, 25 bp, Mus musculus
tccgggaattcctccgcgtcaaggt

SEQ ID NO: 775892 - DNA, 25 bp, Mus musculus
tccgggacacaacagtggcatgttt

SEQ ID NO: 775893 - DNA, 25 bp, Mus musculus
tccgggacacaagagtggcatgttt

SEQ ID NO: 775894 - DNA, 25 bp, Mus musculus
tccgggacgcaactgctacttcgca

SEQ ID NO: 775895 - DNA, 25 bp, Mus musculus
tccgggacgcaagtgctacttcgca

SEQ ID NO: 775896 - DNA, 25 bp, Mus musculus
tccgggacgcagatgcaaacctggg

SEQ ID NO: 775897 - DNA, 25 bp, Mus musculus
tccgggacgcagttgcaaacctggg

SEQ ID NO: 775898 - DNA, 25 bp, Mus musculus
tccgggactggacgctgtcagccac

SEQ ID NO: 775899 - DNA, 25 bp, Mus musculus
tccgggactggaggctgtcagccac

SEQ ID NO: 775900 - DNA, 25 bp, Mus musculus
tccgggagaagcaacacttgagtcg

SEQ ID NO: 775901 - DNA, 25 bp, Mus musculus
tccgggagaagcacctggatcccat

SEQ ID NO: 775902 - DNA, 25 bp, Mus musculus
tccgggagaagctacacttgagtcg

SEQ ID NO: 775903 - DNA, 25 bp, Mus musculus
tccgggagaagctcctggatcccat

SEQ ID NO: 775904 - DNA, 25 bp, Mus musculus
tccgggagaatgactggacctacta

SEQ ID NO: 775905 - DNA, 25 bp, Mus musculus
tccgggagaatgtctggacctacta

SEQ ID NO: 775906 - DNA, 25 bp, Mus musculus
tccgggagatcaccagtctgtgaca

SEQ ID NO: 775907 - DNA, 25 bp, Mus musculus
tccgggagatcagcagtctgtgaca

SEQ ID NO: 775908 - DNA, 25 bp, Mus musculus
tccgggagctctagctatcatcttt

SEQ ID NO: 775909 - DNA, 25 bp, Mus musculus
tccgggagctcttgctatcatcttt

SEQ ID NO: 775910 - DNA, 25 bp, Mus musculus
tccgggaggaaacatcaatcgtccc

SEQ ID NO: 775911 - DNA, 25 bp, Mus musculus
tccgggaggaaagatcaatcgtccc

SEQ ID NO: 775912 - DNA, 25 bp, Mus musculus
tccgggaggcttatgctgccattga

SEQ ID NO: 775913 - DNA, 25 bp, Mus musculus
tccgggaggcttttgctgccattga

SEQ ID NO: 775914 - DNA, 25 bp, Mus musculus
tccgggagtccgaggagatcatcaa

SEQ ID NO: 775915 - DNA, 25 bp, Mus musculus
tccgggagtccgtggagatcatcaa

SEQ ID NO: 775916 - DNA, 25 bp, Mus musculus
tccgggagtggtatggcccagaaaa

SEQ ID NO: 775917 - DNA, 25 bp, Mus musculus
tccgggagtggtttggcccagaaaa

SEQ ID NO: 775918 - DNA, 25 bp, Mus musculus
tccgggatggcgacagttccacggc

SEQ ID NO: 775919 - DNA, 25 bp, Mus musculus
tccgggatggcgtcagttccacggc

SEQ ID NO: 775920 - DNA, 25 bp, Mus musculus
tccgggatgttcaactggcccagtt

SEQ ID NO: 775921 - DNA, 25 bp, Mus musculus
tccgggatgttctactggcccagtt

SEQ ID NO: 775922 - DNA, 25 bp, Mus musculus
tccgggcagctgcttgtcttaaaaa

SEQ ID NO: 775923 - DNA, 25 bp, Mus musculus
tccgggcagctggttgtcttaaaaa

SEQ ID NO: 775924 - DNA, 25 bp, Mus musculus
tccgggccatgcagaaacagcagcc

SEQ ID NO: 775925 - DNA, 25 bp, Mus musculus
tccgggccatgctgaaacagcagcc

SEQ ID NO: 775926 - DNA, 25 bp, Mus musculus
tccgggccatggacactttgggcgt

SEQ ID NO: 775927 - DNA, 25 bp, Mus musculus
tccgggccatggtcactttgggcgt

SEQ ID NO: 775928 - DNA, 25 bp, Mus musculus
tccgggcccagcaggcctgcattga

SEQ ID NO: 775929 - DNA, 25 bp, Mus musculus
tccgggcccagctggcctgcattga

SEQ ID NO: 775930 - DNA, 25 bp, Mus musculus
tccgggcccgtgaaggcttttgcag

SEQ ID NO: 775931 - DNA, 25 bp, Mus musculus
tccgggcccgtgtaggcttttgcag

SEQ ID NO: 775932 - DNA, 25 bp, Mus musculus
tccgggcctggacaactgcttggct

SEQ ID NO: 775933 - DNA, 25 bp, Mus musculus
tccgggcctggagaactgcttggct

SEQ ID NO: 775934 - DNA, 25 bp, Mus musculus
tccgggcgattaaggacccggcaga

SEQ ID NO: 775935 - DNA, 25 bp, Mus musculus
tccgggcgattatggacccggcaga

SEQ ID NO: 775936 - DNA, 25 bp, Mus musculus
tccgggctagctccagttctctttg

SEQ ID NO: 775937 - DNA, 25 bp, Mus musculus
tccgggctagctgcagttctctttg

SEQ ID NO: 775938 - DNA, 25 bp, Mus musculus
tccgggctcagtatgaccacagtat

SEQ ID NO: 775939 - DNA, 25 bp, Mus musculus
tccgggctcagtttgaccacagtat

SEQ ID NO: 775940 - DNA, 25 bp, Mus musculus
tccgggctctgcaccacaagcgttt

SEQ ID NO: 775941 - DNA, 25 bp, Mus musculus
tccgggctctgctccacaagcgttt

SEQ ID NO: 775942 - DNA, 25 bp, Mus musculus
tccgggctgcctcaagtgcccagtg

SEQ ID NO: 775943 - DNA, 25 bp, Mus musculus
tccgggctgcctgaagtgcccagtg

SEQ ID NO: 775944 - DNA, 25 bp, Mus musculus
tccgggctgctgaagaggcgttttc

SEQ ID NO: 775945 - DNA, 25 bp, Mus musculus
tccgggctgctgtagaggcgttttc

SEQ ID NO: 775946 - DNA, 25 bp, Mus musculus
tccgggctggaaatcctatttcttc

SEQ ID NO: 775947 - DNA, 25 bp, Mus musculus
tccgggctggaattcctatttcttc

SEQ ID NO: 775948 - DNA, 25 bp, Mus musculus
tccgggcttgcaatctggagatggt

SEQ ID NO: 775949 - DNA, 25 bp, Mus musculus
tccgggcttgcattctggagatggt

SEQ ID NO: 775950 - DNA, 25 bp, Mus musculus
tccggggcctgaatcggatccagac

SEQ ID NO: 775951 - DNA, 25 bp, Mus musculus
tccggggcctgattcggatccagac

SEQ ID NO: 775952 - DNA, 25 bp, Mus musculus
tccgggtaaaatagcagtcgaaggc

SEQ ID NO: 775953 - DNA, 25 bp, Mus musculus
tccgggtaaaattgcagtcgaaggc

SEQ ID NO: 775954 - DNA, 25 bp, Mus musculus
tccgggtaaggcatgccgctccctg

SEQ ID NO: 775955 - DNA, 25 bp, Mus musculus
tccgggtaaggcttgccgctccctg

SEQ ID NO: 775956 - DNA, 25 bp, Mus musculus
tccgggtaccaacgctattaaagct

SEQ ID NO: 775957 - DNA, 25 bp, Mus musculus
tccgggtaccaaggctattaaagct

SEQ ID NO: 775958 - DNA, 25 bp, Mus musculus
tccgggtacccaaggccagttgtga

SEQ ID NO: 775959 - DNA, 25 bp, Mus musculus
tccgggtacccatggccagttgtga

SEQ ID NO: 775960 - DNA, 25 bp, Mus musculus
tccgggtatgacagccgttctgcac

SEQ ID NO: 775961 - DNA, 25 bp, Mus musculus
tccgggtatgactgccgttctgcac

SEQ ID NO: 775962 - DNA, 25 bp, Mus musculus
tccgggtcagagagcgtacaagatg

SEQ ID NO: 775963 - DNA, 25 bp, Mus musculus
tccgggtcagagtgcgtacaagatg

SEQ ID NO: 775964 - DNA, 25 bp, Mus musculus
tccgggtccgagagccccagcgatt

SEQ ID NO: 775965 - DNA, 25 bp, Mus musculus
tccgggtccgagtgccccagcgatt

SEQ ID NO: 775966 - DNA, 25 bp, Mus musculus
tccgggtcgggcatcggagtcgcgg

SEQ ID NO: 775967 - DNA, 25 bp, Mus musculus
tccgggtcgggcttcggagtcgcgg

SEQ ID NO: 775968 - DNA, 25 bp, Mus musculus
tccgggtctacaccctgcctgatgg

SEQ ID NO: 775969 - DNA, 25 bp, Mus musculus
tccgggtctacagcctgcctgatgg

SEQ ID NO: 775970 - DNA, 25 bp, Mus musculus
tccgggtgaacgagcacggcatctt

SEQ ID NO: 775971 - DNA, 25 bp, Mus musculus
tccgggtgaacgtgcacggcatctt

SEQ ID NO: 775972 - DNA, 25 bp, Mus musculus
tccgggtgccatatgagaaaatcag

SEQ ID NO: 775973 - DNA, 25 bp, Mus musculus
tccgggtgccatttgagaaaatcag

SEQ ID NO: 775974 - DNA, 25 bp, Mus musculus
tccgggtgctggatcccttcactat

SEQ ID NO: 775975 - DNA, 25 bp, Mus musculus
tccgggtgctggttcccttcactat

SEQ ID NO: 775976 - DNA, 25 bp, Mus musculus
tccgggtggataacagagacctcct

SEQ ID NO: 775977 - DNA, 25 bp, Mus musculus
tccgggtggatatcagagacctcct

SEQ ID NO: 775978 - DNA, 25 bp, Mus musculus
tccgggtgtcccatggcagccaaga

SEQ ID NO: 775979 - DNA, 25 bp, Mus musculus
tccgggtgtcccttggcagccaaga

SEQ ID NO: 775980 - DNA, 25 bp, Mus musculus
tccggtaaaagcacagattccctgt

SEQ ID NO: 775981 - DNA, 25 bp, Mus musculus
tccggtaaaagctcagattccctgt

SEQ ID NO: 775982 - DNA, 25 bp, Mus musculus
tccggtaaccaccacggctgtagag

SEQ ID NO: 775983 - DNA, 25 bp, Mus musculus
tccggtaaccacgacggctgtagag

SEQ ID NO: 775984 - DNA, 25 bp, Mus musculus
tccggtaacctgaaggactcctcgt

SEQ ID NO: 775985 - DNA, 25 bp, Mus musculus
tccggtaacctgtaggactcctcgt

SEQ ID NO: 775986 - DNA, 25 bp, Mus musculus
tccggtacagaaagtattgccaagt

SEQ ID NO: 775987 - DNA, 25 bp, Mus musculus
tccggtacagaatgtattgccaagt

SEQ ID NO: 775988 - DNA, 25 bp, Mus musculus
tccggtacgatgctgtgacaattaa

SEQ ID NO: 775989 - DNA, 25 bp, Mus musculus
tccggtacgatggtgtgacaattaa

SEQ ID NO: 775990 - DNA, 25 bp, Mus musculus
tccggtactgggacctcctgctgct

SEQ ID NO: 775991 - DNA, 25 bp, Mus musculus
tccggtactgggtcctcctgctgct

SEQ ID NO: 775992 - DNA, 25 bp, Mus musculus
tccggtatggctctgcaagatctgc

SEQ ID NO: 775993 - DNA, 25 bp, Mus musculus
tccggtatggctgtgcaagatctgc

SEQ ID NO: 775994 - DNA, 25 bp, Mus musculus
tccggtcaaggaaactgcttttctg

SEQ ID NO: 775995 - DNA, 25 bp, Mus musculus
tccggtcaaggatactgcttttctg

SEQ ID NO: 775996 - DNA, 25 bp, Mus musculus
tccggtcacttaaggcgtttaggct

SEQ ID NO: 775997 - DNA, 25 bp, Mus musculus
tccggtcacttatggcgtttaggct

SEQ ID NO: 775998 - DNA, 25 bp, Mus musculus
tccggtccaacaaggctccgcggtt

SEQ ID NO: 775999 - DNA, 25 bp, Mus musculus
tccggtccaacatggctccgcggtt

SEQ ID NO: 776000 - DNA, 25 bp, Mus musculus
tccggtcggtctccagtatggcggc

SEQ ID NO: 776001 - DNA, 25 bp, Mus musculus
tccggtcggtctgcagtatggcggc

SEQ ID NO: 776002 - DNA, 25 bp, Mus musculus
tccggtctgtgcacctacgtgaaac

SEQ ID NO: 776003 - DNA, 25 bp, Mus musculus
tccggtctgtgctcctacgtgaaac

SEQ ID NO: 776004 - DNA, 25 bp, Mus musculus
tccggtcttagacgcccgagcctgt

SEQ ID NO: 776005 - DNA, 25 bp, Mus musculus
tccggtcttagaggcccgagcctgt

SEQ ID NO: 776006 - DNA, 25 bp, Mus musculus
tccggtgaagaaagaatacccctct

SEQ ID NO: 776007 - DNA, 25 bp, Mus musculus
tccggtgaagaatgaatacccctct

SEQ ID NO: 776008 - DNA, 25 bp, Mus musculus
tccggtgagggaacacatagtactg

SEQ ID NO: 776009 - DNA, 25 bp, Mus musculus
tccggtgagggatcacatagtactg

SEQ ID NO: 776010 - DNA, 25 bp, Mus musculus
tccggtgcaagcctgggtcgagtct

SEQ ID NO: 776011 - DNA, 25 bp, Mus musculus
tccggtgcaagcgtgggtcgagtct

SEQ ID NO: 776012 - DNA, 25 bp, Mus musculus
tccggtgctgctcaactgccttatg

SEQ ID NO: 776013 - DNA, 25 bp, Mus musculus
tccggtgctgctgaactgccttatg

SEQ ID NO: 776014 - DNA, 25 bp, Mus musculus
tccggtggattacagactaggtaca

SEQ ID NO: 776015 - DNA, 25 bp, Mus musculus
tccggtggattagagactaggtaca

SEQ ID NO: 776016 - DNA, 25 bp, Mus musculus
tccggtggcgggagggttgccggct

SEQ ID NO: 776017 - DNA, 25 bp, Mus musculus
tccggtggcgggtgggttgccggct

SEQ ID NO: 776018 - DNA, 25 bp, Mus musculus
tccggtgggtgtcagggttggcata

SEQ ID NO: 776019 - DNA, 25 bp, Mus musculus
tccggtgggtgtgagggttggcata

SEQ ID NO: 776020 - DNA, 25 bp, Mus musculus
tccggtggtgcaatcaatggaggcc

SEQ ID NO: 776021 - DNA, 25 bp, Mus musculus
tccggtggtgcattcaatggaggcc

SEQ ID NO: 776022 - DNA, 25 bp, Mus musculus
tccggtgtcaagagttctgggtcag

SEQ ID NO: 776023 - DNA, 25 bp, Mus musculus
tccggtgtcaagtgttctgggtcag

SEQ ID NO: 776024 - DNA, 25 bp, Mus musculus
tccggtgtccggatcgtgctaatcc

SEQ ID NO: 776025 - DNA, 25 bp, Mus musculus
tccggtgtccggttcgtgctaatcc

SEQ ID NO: 776026 - DNA, 25 bp, Mus musculus
tccggttaactcactgcttttgttc

SEQ ID NO: 776027 - DNA, 25 bp, Mus musculus
tccggttaactctctgcttttgttc

SEQ ID NO: 776028 - DNA, 25 bp, Mus musculus
tccggttccattccaggcttggaag

SEQ ID NO: 776029 - DNA, 25 bp, Mus musculus
tccggttccattgcaggcttggaag

SEQ ID NO: 776030 - DNA, 25 bp, Mus musculus
tccggttgaacaccaaggccttccg

SEQ ID NO: 776031 - DNA, 25 bp, Mus musculus
tccggttgaacagcaaggccttccg

SEQ ID NO: 776032 - DNA, 25 bp, Mus musculus
tccggttggaatatggtgtccatgt

SEQ ID NO: 776033 - DNA, 25 bp, Mus musculus
tccggttggaatttggtgtccatgt

SEQ ID NO: 776034 - DNA, 25 bp, Mus musculus
tccggttggtggacctccacaggtg

SEQ ID NO: 776035 - DNA, 25 bp, Mus musculus
tccggttggtggtcctccacaggtg

SEQ ID NO: 776036 - DNA, 25 bp, Mus musculus
tccggttgtatgatccgggtcatca

SEQ ID NO: 776037 - DNA, 25 bp, Mus musculus
tccggttgtatgttccgggtcatca

SEQ ID NO: 776038 - DNA, 25 bp, Mus musculus
tccggtttgccacagtgcagtacag

SEQ ID NO: 776039 - DNA, 25 bp, Mus musculus
tccggtttgccagagtgcagtacag

SEQ ID NO: 776040 - DNA, 25 bp, Mus musculus
tccggttttcctcagtctccacgta

SEQ ID NO: 776041 - DNA, 25 bp, Mus musculus
tccggttttcctgagtctccacgta

SEQ ID NO: 776042 - DNA, 25 bp, Mus musculus
tccgtaaacagaagttgcctccgcc

SEQ ID NO: 776043 - DNA, 25 bp, Mus musculus
tccgtaaacagacccgaacctcggt

SEQ ID NO: 776044 - DNA, 25 bp, Mus musculus
tccgtaaacagagccgaacctcggt

SEQ ID NO: 776045 - DNA, 25 bp, Mus musculus
tccgtaaacagatgttgcctccgcc

SEQ ID NO: 776046 - DNA, 25 bp, Mus musculus
tccgtaaagcgcaggatgtttgcag

SEQ ID NO: 776047 - DNA, 25 bp, Mus musculus
tccgtaaagcgctggatgtttgcag

SEQ ID NO: 776048 - DNA, 25 bp, Mus musculus
tccgtaaagggtctggcaagcaaac

SEQ ID NO: 776049 - DNA, 25 bp, Mus musculus
tccgtaaagggtgtggcaagcaaac

SEQ ID NO: 776050 - DNA, 25 bp, Mus musculus
tccgtaaagtggatggattggatca

SEQ ID NO: 776051 - DNA, 25 bp, Mus musculus
tccgtaaagtggttggattggatca

SEQ ID NO: 776052 - DNA, 25 bp, Mus musculus
tccgtaagactaaggcagctccctg

SEQ ID NO: 776053 - DNA, 25 bp, Mus musculus
tccgtaagactatggcagctccctg

SEQ ID NO: 776054 - DNA, 25 bp, Mus musculus
tccgtaaggtgaagcacatttgttc

SEQ ID NO: 776055 - DNA, 25 bp, Mus musculus
tccgtaaggtgatgcacatttgttc

SEQ ID NO: 776056 - DNA, 25 bp, Mus musculus
tccgtaatccaaaggccaaatgagg

SEQ ID NO: 776057 - DNA, 25 bp, Mus musculus
tccgtaatccaatggccaaatgagg

SEQ ID NO: 776058 - DNA, 25 bp, Mus musculus
tccgtacaagctcagcaaattctga

SEQ ID NO: 776059 - DNA, 25 bp, Mus musculus
tccgtacaagctgagcaaattctga

SEQ ID NO: 776060 - DNA, 25 bp, Mus musculus
tccgtaccccatcccctgcggtgtt

SEQ ID NO: 776061 - DNA, 25 bp, Mus musculus
tccgtaccccatgccctgcggtgtt

SEQ ID NO: 776062 - DNA, 25 bp, Mus musculus
tccgtacgctgcatgctgcagaact

SEQ ID NO: 776063 - DNA, 25 bp, Mus musculus
tccgtacgctgcttgctgcagaact

SEQ ID NO: 776064 - DNA, 25 bp, Mus musculus
tccgtactgcagctgtctgattccc

SEQ ID NO: 776065 - DNA, 25 bp, Mus musculus
tccgtactgcaggtgtctgattccc

SEQ ID NO: 776066 - DNA, 25 bp, Mus musculus
tccgtagaggaccatcaagcccctt

SEQ ID NO: 776067 - DNA, 25 bp, Mus musculus
tccgtagaggacgatcaagcccctt

SEQ ID NO: 776068 - DNA, 25 bp, Mus musculus
tccgtagctcgacccgaaagaagtc

SEQ ID NO: 776069 - DNA, 25 bp, Mus musculus
tccgtagctcgagccgaaagaagtc

SEQ ID NO: 776070 - DNA, 25 bp, Mus musculus
tccgtaggccctccctggaagcgga

SEQ ID NO: 776071 - DNA, 25 bp, Mus musculus
tccgtaggccctgcctggaagcgga

SEQ ID NO: 776072 - DNA, 25 bp, Mus musculus
tccgtaggctggaacggcttgacca

SEQ ID NO: 776073 - DNA, 25 bp, Mus musculus
tccgtaggctggtacggcttgacca

SEQ ID NO: 776074 - DNA, 25 bp, Mus musculus
tccgtagtgccaatcggagcgacgc

SEQ ID NO: 776075 - DNA, 25 bp, Mus musculus
tccgtagtgccattcggagcgacgc

SEQ ID NO: 776076 - DNA, 25 bp, Mus musculus
tccgtagtgtgcaggtcacgagcgt

SEQ ID NO: 776077 - DNA, 25 bp, Mus musculus
tccgtagtgtgctggtcacgagcgt

SEQ ID NO: 776078 - DNA, 25 bp, Mus musculus
tccgtatattccaccctgctttcat

SEQ ID NO: 776079 - DNA, 25 bp, Mus musculus
tccgtatattcctccctgctttcat

SEQ ID NO: 776080 - DNA, 25 bp, Mus musculus
tccgtatcctccaaacctgtttact

SEQ ID NO: 776081 - DNA, 25 bp, Mus musculus
tccgtatcctcctaacctgtttact

SEQ ID NO: 776082 - DNA, 25 bp, Mus musculus
tccgtatgaaggacgaggtgtttcg

SEQ ID NO: 776083 - DNA, 25 bp, Mus musculus
tccgtatgaaggtcgaggtgtttcg

SEQ ID NO: 776084 - DNA, 25 bp, Mus musculus
tccgtatggtgcaggaacgcaagca

SEQ ID NO: 776085 - DNA, 25 bp, Mus musculus
tccgtatggtgctggaacgcaagca

SEQ ID NO: 776086 - DNA, 25 bp, Mus musculus
tccgtattagtacccgcaaaagccg

SEQ ID NO: 776087 - DNA, 25 bp, Mus musculus
tccgtattagtagccgcaaaagccg

SEQ ID NO: 776088 - DNA, 25 bp, Mus musculus
tccgtcaacggcagataagtgtaga

SEQ ID NO: 776089 - DNA, 25 bp, Mus musculus
tccgtcaacggctgataagtgtaga

SEQ ID NO: 776090 - DNA, 25 bp, Mus musculus
tccgtcaagaatcgcttagtctaca

SEQ ID NO: 776091 - DNA, 25 bp, Mus musculus
tccgtcaagaatggcttagtctaca

SEQ ID NO: 776092 - DNA, 25 bp, Mus musculus
tccgtcaggtcacaggtttcaggcc

SEQ ID NO: 776093 - DNA, 25 bp, Mus musculus
tccgtcaggtcagaggtttcaggcc

SEQ ID NO: 776094 - DNA, 25 bp, Mus musculus
tccgtcatcaagcatactgaccctg

SEQ ID NO: 776095 - DNA, 25 bp, Mus musculus
tccgtcatcaaggatactgaccctg

SEQ ID NO: 776096 - DNA, 25 bp, Mus musculus
tccgtcatcgtacggaacactcatg

SEQ ID NO: 776097 - DNA, 25 bp, Mus musculus
tccgtcatcgtagggaacactcatg

SEQ ID NO: 776098 - DNA, 25 bp, Mus musculus
tccgtccacccaagcagagagggtg

SEQ ID NO: 776099 - DNA, 25 bp, Mus musculus
tccgtccacccatgcagagagggtg

SEQ ID NO: 776100 - DNA, 25 bp, Mus musculus
tccgtccacgccaaatgggttgtgg

SEQ ID NO: 776101 - DNA, 25 bp, Mus musculus
tccgtccacgcctaatgggttgtgg

SEQ ID NO: 776102 - DNA, 25 bp, Mus musculus
tccgtccattggctcccaggtggtg

SEQ ID NO: 776103 - DNA, 25 bp, Mus musculus
tccgtccattgggtcccaggtggtg

SEQ ID NO: 776104 - DNA, 25 bp, Mus musculus
tccgtcccgaatctctgattcagtg

SEQ ID NO: 776105 - DNA, 25 bp, Mus musculus
tccgtcccgaatgtctgattcagtg

SEQ ID NO: 776106 - DNA, 25 bp, Mus musculus
tccgtccctggactctgatatccag

SEQ ID NO: 776107 - DNA, 25 bp, Mus musculus
tccgtccctggagtctgatatccag

SEQ ID NO: 776108 - DNA, 25 bp, Mus musculus
tccgtcctgaaaagaaagaagatat

SEQ ID NO: 776109 - DNA, 25 bp, Mus musculus
tccgtcctgaaatgaaagaagatat

SEQ ID NO: 776110 - DNA, 25 bp, Mus musculus
tccgtcctgcgcctagttctgggag

SEQ ID NO: 776111 - DNA, 25 bp, Mus musculus
tccgtcctgcgcgtagttctgggag

SEQ ID NO: 776112 - DNA, 25 bp, Mus musculus
tccgtcgcagccagaaggagttttc

SEQ ID NO: 776113 - DNA, 25 bp, Mus musculus
tccgtcgcagcctgaaggagttttc

SEQ ID NO: 776114 - DNA, 25 bp, Mus musculus
tccgtcgctgtcctgaggtagttgt

SEQ ID NO: 776115 - DNA, 25 bp, Mus musculus
tccgtcgctgtcgtgaggtagttgt

SEQ ID NO: 776116 - DNA, 25 bp, Mus musculus
tccgtcgtcagcaatgctgtctggg

SEQ ID NO: 776117 - DNA, 25 bp, Mus musculus
tccgtcgtcagctatgctgtctggg

SEQ ID NO: 776118 - DNA, 25 bp, Mus musculus
tccgtcgtgcaaaaccatctatggg

SEQ ID NO: 776119 - DNA, 25 bp, Mus musculus
tccgtcgtgcaataccatctatggg

SEQ ID NO: 776120 - DNA, 25 bp, Mus musculus
tccgtctacacccaaatttgcatat

SEQ ID NO: 776121 - DNA, 25 bp, Mus musculus
tccgtctacaccgaaatttgcatat

SEQ ID NO: 776122 - DNA, 25 bp, Mus musculus
tccgtctagaggaaggacctcctca

SEQ ID NO: 776123 - DNA, 25 bp, Mus musculus
tccgtctagaggtaggacctcctca

SEQ ID NO: 776124 - DNA, 25 bp, Mus musculus
tccgtctatgttagcccctatgaac

SEQ ID NO: 776125 - DNA, 25 bp, Mus musculus
tccgtctatgtttgcccctatgaac

SEQ ID NO: 776126 - DNA, 25 bp, Mus musculus
tccgtctcccgtattctctaacttg

SEQ ID NO: 776127 - DNA, 25 bp, Mus musculus
tccgtctcccgttttctctaacttg

SEQ ID NO: 776128 - DNA, 25 bp, Mus musculus
tccgtctccggcatgaccatgtgct

SEQ ID NO: 776129 - DNA, 25 bp, Mus musculus
tccgtctccggcttgaccatgtgct

SEQ ID NO: 776130 - DNA, 25 bp, Mus musculus
tccgtctctggcagaacgcgctgct

SEQ ID NO: 776131 - DNA, 25 bp, Mus musculus
tccgtctctggctgaacgcgctgct

SEQ ID NO: 776132 - DNA, 25 bp, Mus musculus
tccgtctgcttcagccgcagtgtct

SEQ ID NO: 776133 - DNA, 25 bp, Mus musculus
tccgtctgcttctgccgcagtgtct

SEQ ID NO: 776134 - DNA, 25 bp, Mus musculus
tccgtcttggtcatccggttgcggg

SEQ ID NO: 776135 - DNA, 25 bp, Mus musculus
tccgtcttggtcttccggttgcggg

SEQ ID NO: 776136 - DNA, 25 bp, Mus musculus
tccgtctttattatgggcgccagcg

SEQ ID NO: 776137 - DNA, 25 bp, Mus musculus
tccgtctttattttgggcgccagcg

SEQ ID NO: 776138 - DNA, 25 bp, Mus musculus
tccgtgaactctcgtgtctgtttca

SEQ ID NO: 776139 - DNA, 25 bp, Mus musculus
tccgtgaactctggtgtctgtttca

SEQ ID NO: 776140 - DNA, 25 bp, Mus musculus
tccgtgaagtaacgccagtagaact

SEQ ID NO: 776141 - DNA, 25 bp, Mus musculus
tccgtgaagtaaggccagtagaact

SEQ ID NO: 776142 - DNA, 25 bp, Mus musculus
tccgtgacaaacaggacatccttgg

SEQ ID NO: 776143 - DNA, 25 bp, Mus musculus
tccgtgacaaactggacatccttgg

SEQ ID NO: 776144 - DNA, 25 bp, Mus musculus
tccgtgacagcgcagctcctgaatc

SEQ ID NO: 776145 - DNA, 25 bp, Mus musculus
tccgtgacagcggagctcctgaatc

SEQ ID NO: 776146 - DNA, 25 bp, Mus musculus
tccgtgacaggcacctcagaggagc

SEQ ID NO: 776147 - DNA, 25 bp, Mus musculus
tccgtgacaggctcctcagaggagc

SEQ ID NO: 776148 - DNA, 25 bp, Mus musculus
tccgtgacatggactcagggactgt

SEQ ID NO: 776149 - DNA, 25 bp, Mus musculus
tccgtgacatggtctcagggactgt

SEQ ID NO: 776150 - DNA, 25 bp, Mus musculus
tccgtgacctcgagaggctggcatg

SEQ ID NO: 776151 - DNA, 25 bp, Mus musculus
tccgtgacctcgtgaggctggcatg

SEQ ID NO: 776152 - DNA, 25 bp, Mus musculus
tccgtgagcgctatgtgtgcgactc

SEQ ID NO: 776153 - DNA, 25 bp, Mus musculus
tccgtgagcgctttgtgtgcgactc

SEQ ID NO: 776154 - DNA, 25 bp, Mus musculus
tccgtgaggcttctcgccaaagatg

SEQ ID NO: 776155 - DNA, 25 bp, Mus musculus
tccgtgaggcttgtcgccaaagatg

SEQ ID NO: 776156 - DNA, 25 bp, Mus musculus
tccgtgaggtatcatcactacaaaa

SEQ ID NO: 776157 - DNA, 25 bp, Mus musculus
tccgtgaggtatgatcactacaaaa

SEQ ID NO: 776158 - DNA, 25 bp, Mus musculus
tccgtgagtatgagcttatgagctt

SEQ ID NO: 776159 - DNA, 25 bp, Mus musculus
tccgtgagtatgtgcttatgagctt

SEQ ID NO: 776160 - DNA, 25 bp, Mus musculus
tccgtgatccttccgcttcagatgg

SEQ ID NO: 776161 - DNA, 25 bp, Mus musculus
tccgtgatccttgcgcttcagatgg

SEQ ID NO: 776162 - DNA, 25 bp, Mus musculus
tccgtgatctaacaaagcctggttc

SEQ ID NO: 776163 - DNA, 25 bp, Mus musculus
tccgtgatctaagaaagcctggttc

SEQ ID NO: 776164 - DNA, 25 bp, Mus musculus
tccgtgattactacacctctgcgtg

SEQ ID NO: 776165 - DNA, 25 bp, Mus musculus
tccgtgattacttcacctctgcgtg

SEQ ID NO: 776166 - DNA, 25 bp, Mus musculus
tccgtgcaacgcatctgtgagttcc

SEQ ID NO: 776167 - DNA, 25 bp, Mus musculus
tccgtgcaacgcttctgtgagttcc

SEQ ID NO: 776168 - DNA, 25 bp, Mus musculus
tccgtgcaagtgaacggcacacacg

SEQ ID NO: 776169 - DNA, 25 bp, Mus musculus
tccgtgcaagtgtacggcacacacg

SEQ ID NO: 776170 - DNA, 25 bp, Mus musculus
tccgtgcacaccaaggtcaaaggca

SEQ ID NO: 776171 - DNA, 25 bp, Mus musculus
tccgtgcacacctaggtcaaaggca

SEQ ID NO: 776172 - DNA, 25 bp, Mus musculus
tccgtgcagacaagaagtccaaccc

SEQ ID NO: 776173 - DNA, 25 bp, Mus musculus
tccgtgcagacatgaagtccaaccc

SEQ ID NO: 776174 - DNA, 25 bp, Mus musculus
tccgtgcagtcaatggaggcatgct

SEQ ID NO: 776175 - DNA, 25 bp, Mus musculus
tccgtgcagtcattggaggcatgct

SEQ ID NO: 776176 - DNA, 25 bp, Mus musculus
tccgtgccaaagctaactaatttgc

SEQ ID NO: 776177 - DNA, 25 bp, Mus musculus
tccgtgccaaaggtaactaatttgc

SEQ ID NO: 776178 - DNA, 25 bp, Mus musculus
tccgtgccacagcttgacgagaaga

SEQ ID NO: 776179 - DNA, 25 bp, Mus musculus
tccgtgccacaggttgacgagaaga

SEQ ID NO: 776180 - DNA, 25 bp, Mus musculus
tccgtgccagaaccagggtgtctgt

SEQ ID NO: 776181 - DNA, 25 bp, Mus musculus
tccgtgccagaagcagggtgtctgt

SEQ ID NO: 776182 - DNA, 25 bp, Mus musculus
tccgtgcccaggatcggctcattga

SEQ ID NO: 776183 - DNA, 25 bp, Mus musculus
tccgtgcccaggttcggctcattga

SEQ ID NO: 776184 - DNA, 25 bp, Mus musculus
tccgtgccgttgctttaatctagaa

SEQ ID NO: 776185 - DNA, 25 bp, Mus musculus
tccgtgccgttggtttaatctagaa

SEQ ID NO: 776186 - DNA, 25 bp, Mus musculus
tccgtgcctgccaagggaggcagca

SEQ ID NO: 776187 - DNA, 25 bp, Mus musculus
tccgtgcctgcctagggaggcagca

SEQ ID NO: 776188 - DNA, 25 bp, Mus musculus
tccgtgcggcctattgttccgcgtc

SEQ ID NO: 776189 - DNA, 25 bp, Mus musculus
tccgtgcggccttttgttccgcgtc

SEQ ID NO: 776190 - DNA, 25 bp, Mus musculus
tccgtgctccgaaggtggtccagca

SEQ ID NO: 776191 - DNA, 25 bp, Mus musculus
tccgtgctccgatggtggtccagca

SEQ ID NO: 776192 - DNA, 25 bp, Mus musculus
tccgtgctgcctctggaattggcac

SEQ ID NO: 776193 - DNA, 25 bp, Mus musculus
tccgtgctgcctgtggaattggcac

SEQ ID NO: 776194 - DNA, 25 bp, Mus musculus
tccgtgctgctgatgaattgatgtg

SEQ ID NO: 776195 - DNA, 25 bp, Mus musculus
tccgtgctgctgttgaattgatgtg

SEQ ID NO: 776196 - DNA, 25 bp, Mus musculus
tccgtgctgtgtctgaagcccgacg

SEQ ID NO: 776197 - DNA, 25 bp, Mus musculus
tccgtgctgtgtgtgaagcccgacg

SEQ ID NO: 776198 - DNA, 25 bp, Mus musculus
tccgtggaaagtccaggttctgaca

SEQ ID NO: 776199 - DNA, 25 bp, Mus musculus
tccgtggaaagtgcaggttctgaca

SEQ ID NO: 776200 - DNA, 25 bp, Mus musculus
tccgtggaagagatttttaatgatc

SEQ ID NO: 776201 - DNA, 25 bp, Mus musculus
tccgtggaagagttttttaatgatc

SEQ ID NO: 776202 - DNA, 25 bp, Mus musculus
tccgtggaatcccttattgatgaag

SEQ ID NO: 776203 - DNA, 25 bp, Mus musculus
tccgtggaatccgttattgatgaag

SEQ ID NO: 776204 - DNA, 25 bp, Mus musculus
tccgtggacattcctaacatccgaa

SEQ ID NO: 776205 - DNA, 25 bp, Mus musculus
tccgtggacattgctaacatccgaa

SEQ ID NO: 776206 - DNA, 25 bp, Mus musculus
tccgtggagaagctcgtgctgctca

SEQ ID NO: 776207 - DNA, 25 bp, Mus musculus
tccgtggagaaggtcgtgctgctca

SEQ ID NO: 776208 - DNA, 25 bp, Mus musculus
tccgtggagactccgagttccgtct

SEQ ID NO: 776209 - DNA, 25 bp, Mus musculus
tccgtggagactgcgagttccgtct

SEQ ID NO: 776210 - DNA, 25 bp, Mus musculus
tccgtggaggatcgtttccagaccg

SEQ ID NO: 776211 - DNA, 25 bp, Mus musculus
tccgtggaggatggtttccagaccg

SEQ ID NO: 776212 - DNA, 25 bp, Mus musculus
tccgtggatttgcacatgaagttgg

SEQ ID NO: 776213 - DNA, 25 bp, Mus musculus
tccgtggatttggacatgaagttgg

SEQ ID NO: 776214 - DNA, 25 bp, Mus musculus
tccgtggctactacaagcagggcat

SEQ ID NO: 776215 - DNA, 25 bp, Mus musculus
tccgtggctacttcaagcagggcat

SEQ ID NO: 776216 - DNA, 25 bp, Mus musculus
tccgtgggccgaatacaaatgcgaa

SEQ ID NO: 776217 - DNA, 25 bp, Mus musculus
tccgtgggccgacatctacctgtgt

SEQ ID NO: 776218 - DNA, 25 bp, Mus musculus
tccgtgggccgagatctacctgtgt

SEQ ID NO: 776219 - DNA, 25 bp, Mus musculus
tccgtgggccgattacaaatgcgaa

SEQ ID NO: 776220 - DNA, 25 bp, Mus musculus
tccgtggggcctaccagttccttgt

SEQ ID NO: 776221 - DNA, 25 bp, Mus musculus
tccgtggggccttccagttccttgt

SEQ ID NO: 776222 - DNA, 25 bp, Mus musculus
tccgtgggtataactagacagtcat

SEQ ID NO: 776223 - DNA, 25 bp, Mus musculus
tccgtgggtatatctagacagtcat

SEQ ID NO: 776224 - DNA, 25 bp, Mus musculus
tccgtgggtcaaagtaagggatact

SEQ ID NO: 776225 - DNA, 25 bp, Mus musculus
tccgtgggtcaatgtaagggatact

SEQ ID NO: 776226 - DNA, 25 bp, Mus musculus
tccgtggtatcactgggaccactca

SEQ ID NO: 776227 - DNA, 25 bp, Mus musculus
tccgtggtatcagtgggaccactca

SEQ ID NO: 776228 - DNA, 25 bp, Mus musculus
tccgtggtctcccaggcattaaggg

SEQ ID NO: 776229 - DNA, 25 bp, Mus musculus
tccgtggtctccgaggcattaaggg

SEQ ID NO: 776230 - DNA, 25 bp, Mus musculus
tccgtggtgccgatactcgaagtcg

SEQ ID NO: 776231 - DNA, 25 bp, Mus musculus
tccgtggtgccgttactcgaagtcg

SEQ ID NO: 776232 - DNA, 25 bp, Mus musculus
tccgtggttatgagctggcacacca

SEQ ID NO: 776233 - DNA, 25 bp, Mus musculus
tccgtggttatgtgctggcacacca

SEQ ID NO: 776234 - DNA, 25 bp, Mus musculus
tccgtgtacaagatttgcagagaaa

SEQ ID NO: 776235 - DNA, 25 bp, Mus musculus
tccgtgtacaagttttgcagagaaa

SEQ ID NO: 776236 - DNA, 25 bp, Mus musculus
tccgtgtactccagggacatcgttg

SEQ ID NO: 776237 - DNA, 25 bp, Mus musculus
tccgtgtactcctgggacatcgttg

SEQ ID NO: 776238 - DNA, 25 bp, Mus musculus
tccgtgtcctgtcggtccctcgtaa

SEQ ID NO: 776239 - DNA, 25 bp, Mus musculus
tccgtgtcctgtgggtccctcgtaa

SEQ ID NO: 776240 - DNA, 25 bp, Mus musculus
tccgtgtcgccaaggatgtcagttc

SEQ ID NO: 776241 - DNA, 25 bp, Mus musculus
tccgtgtcgccatggatgtcagttc

SEQ ID NO: 776242 - DNA, 25 bp, Mus musculus
tccgtgtctaacagtcaggttcagg

SEQ ID NO: 776243 - DNA, 25 bp, Mus musculus
tccgtgtctaactgtcaggttcagg

SEQ ID NO: 776244 - DNA, 25 bp, Mus musculus
tccgtgtggccaccataaacagcaa

SEQ ID NO: 776245 - DNA, 25 bp, Mus musculus
tccgtgtggccagcataaacagcaa

SEQ ID NO: 776246 - DNA, 25 bp, Mus musculus
tccgtgtgtgaccaggacaagtttg

SEQ ID NO: 776247 - DNA, 25 bp, Mus musculus
tccgtgtgtgacgaggacaagtttg

SEQ ID NO: 776248 - DNA, 25 bp, Mus musculus
tccgtgtgtggaccagccagctgaa

SEQ ID NO: 776249 - DNA, 25 bp, Mus musculus
tccgtgtgtggagcagccagctgaa

SEQ ID NO: 776250 - DNA, 25 bp, Mus musculus
tccgtgttcagcacaaaggccttgg

SEQ ID NO: 776251 - DNA, 25 bp, Mus musculus
tccgtgttcagctcaaaggccttgg

SEQ ID NO: 776252 - DNA, 25 bp, Mus musculus
tccgtgttcagtcagtgtttgtcca

SEQ ID NO: 776253 - DNA, 25 bp, Mus musculus
tccgtgttcagtgagtgtttgtcca

SEQ ID NO: 776254 - DNA, 25 bp, Mus musculus
tccgtgttcctcaatggaggaacgt

SEQ ID NO: 776255 - DNA, 25 bp, Mus musculus
tccgtgttcctctatggaggaacgt

SEQ ID NO: 776256 - DNA, 25 bp, Mus musculus
tccgtgttcgggcaccgcagcactg

SEQ ID NO: 776257 - DNA, 25 bp, Mus musculus
tccgtgttcggggaccgcagcactg

SEQ ID NO: 776258 - DNA, 25 bp, Mus musculus
tccgtgttgatcctgagggttctcc

SEQ ID NO: 776259 - DNA, 25 bp, Mus musculus
tccgtgttgatcgtgagggttctcc

SEQ ID NO: 776260 - DNA, 25 bp, Mus musculus
tccgtgttggcactgacagggccca

SEQ ID NO: 776261 - DNA, 25 bp, Mus musculus
tccgtgttggcagtgacagggccca

SEQ ID NO: 776262 - DNA, 25 bp, Mus musculus
tccgtgttgggcacaaaggctccac

SEQ ID NO: 776263 - DNA, 25 bp, Mus musculus
tccgtgttgggctcaaaggctccac

SEQ ID NO: 776264 - DNA, 25 bp, Mus musculus
tccgttaggcagagactgtgtcact

SEQ ID NO: 776265 - DNA, 25 bp, Mus musculus
tccgttaggcagtgactgtgtcact

SEQ ID NO: 776266 - DNA, 25 bp, Mus musculus
tccgttagtaagcaagctacgttct

SEQ ID NO: 776267 - DNA, 25 bp, Mus musculus
tccgttagtaaggaagctacgttct

SEQ ID NO: 776268 - DNA, 25 bp, Mus musculus
tccgttcagacacaggccagttcag

SEQ ID NO: 776269 - DNA, 25 bp, Mus musculus
tccgttcagacagaggccagttcag

SEQ ID NO: 776270 - DNA, 25 bp, Mus musculus
tccgttcagctcaccggtgggacaa

SEQ ID NO: 776271 - DNA, 25 bp, Mus musculus
tccgttcagctctccggtgggacaa

SEQ ID NO: 776272 - DNA, 25 bp, Mus musculus
tccgttcgatgcatcagatcgccct

SEQ ID NO: 776273 - DNA, 25 bp, Mus musculus
tccgttcgatgcttcagatcgccct

SEQ ID NO: 776274 - DNA, 25 bp, Mus musculus
tccgttctacatctccacggactgt

SEQ ID NO: 776275 - DNA, 25 bp, Mus musculus
tccgttctacatgtccacggactgt

SEQ ID NO: 776276 - DNA, 25 bp, Mus musculus
tccgttctcagactactaatgagcc

SEQ ID NO: 776277 - DNA, 25 bp, Mus musculus
tccgttctcagagtactaatgagcc

SEQ ID NO: 776278 - DNA, 25 bp, Mus musculus
tccgttctgtccctgtgggcactgt

SEQ ID NO: 776279 - DNA, 25 bp, Mus musculus
tccgttctgtccgtgtgggcactgt

SEQ ID NO: 776280 - DNA, 25 bp, Mus musculus
tccgttcttcagctgtcagactcca

SEQ ID NO: 776281 - DNA, 25 bp, Mus musculus
tccgttcttcaggtgtcagactcca

SEQ ID NO: 776282 - DNA, 25 bp, Mus musculus
tccgttggcccacaaccttcagttg

SEQ ID NO: 776283 - DNA, 25 bp, Mus musculus
tccgttggcccagaaccttcagttg

SEQ ID NO: 776284 - DNA, 25 bp, Mus musculus
tccgttgggaaaagaacatcacatt

SEQ ID NO: 776285 - DNA, 25 bp, Mus musculus
tccgttgggaaatgaacatcacatt

SEQ ID NO: 776286 - DNA, 25 bp, Mus musculus
tccgtttaatgaagtgcgattacca

SEQ ID NO: 776287 - DNA, 25 bp, Mus musculus
tccgtttaatgatgtgcgattacca

SEQ ID NO: 776288 - DNA, 25 bp, Mus musculus
tccgtttcatccagcacgccatgga

SEQ ID NO: 776289 - DNA, 25 bp, Mus musculus
tccgtttcatcctgcacgccatgga

SEQ ID NO: 776290 - DNA, 25 bp, Mus musculus
tccgttttcaagatgaagttttcgt

SEQ ID NO: 776291 - DNA, 25 bp, Mus musculus
tccgttttcaagttgaagttttcgt

SEQ ID NO: 776292 - DNA, 25 bp, Mus musculus
tccgttttcatgacgatttcgctgt

SEQ ID NO: 776293 - DNA, 25 bp, Mus musculus
tccgttttcatgtcgatttcgctgt

SEQ ID NO: 776294 - DNA, 25 bp, Mus musculus
tcctaaaaggaaccaagtagacatc

SEQ ID NO: 776295 - DNA, 25 bp, Mus musculus
tcctaaaaggaagcaagtagacatc

SEQ ID NO: 776296 - DNA, 25 bp, Mus musculus
tcctaaaatcatacaagacattgag

SEQ ID NO: 776297 - DNA, 25 bp, Mus musculus
tcctaaaatcattcaagacattgag

SEQ ID NO: 776298 - DNA, 25 bp, Mus musculus
tcctaaacatccctggcaaaaacat

SEQ ID NO: 776299 - DNA, 25 bp, Mus musculus
tcctaaacatccgtggcaaaaacat

SEQ ID NO: 776300 - DNA, 25 bp, Mus musculus
tcctaaaccagccttgagatatgca

SEQ ID NO: 776301 - DNA, 25 bp, Mus musculus
tcctaaaccagcgttgagatatgca

SEQ ID NO: 776302 - DNA, 25 bp, Mus musculus
tcctaaacgacgagatcaccaaagg

SEQ ID NO: 776303 - DNA, 25 bp, Mus musculus
tcctaaacgacgtgatcaccaaagg

SEQ ID NO: 776304 - DNA, 25 bp, Mus musculus
tcctaaactcataaataacaggtgg

SEQ ID NO: 776305 - DNA, 25 bp, Mus musculus
tcctaaactcattaataacaggtgg

SEQ ID NO: 776306 - DNA, 25 bp, Mus musculus
tcctaaagctaacaccacaggaatg

SEQ ID NO: 776307 - DNA, 25 bp, Mus musculus
tcctaaagctaagaccacaggaatg

SEQ ID NO: 776308 - DNA, 25 bp, Mus musculus
tcctaaagttcaacatgtcatccat

SEQ ID NO: 776309 - DNA, 25 bp, Mus musculus
tcctaaagttcatcatgtcatccat

SEQ ID NO: 776310 - DNA, 25 bp, Mus musculus
tcctaaatgttgatgctgggattgt

SEQ ID NO: 776311 - DNA, 25 bp, Mus musculus
tcctaaatgttgttgctgggattgt

SEQ ID NO: 776312 - DNA, 25 bp, Mus musculus
tcctaaattgacaaagggccagcca

SEQ ID NO: 776313 - DNA, 25 bp, Mus musculus
tcctaaattgactaagggccagcca

SEQ ID NO: 776314 - DNA, 25 bp, Mus musculus
tcctaacaatggagatgcagacacc

SEQ ID NO: 776315 - DNA, 25 bp, Mus musculus
tcctaacaatggtgatgcagacacc

SEQ ID NO: 776316 - DNA, 25 bp, Mus musculus
tcctaacatagtcgaggatcaccaa

SEQ ID NO: 776317 - DNA, 25 bp, Mus musculus
tcctaacatagtggaggatcaccaa

SEQ ID NO: 776318 - DNA, 25 bp, Mus musculus
tcctaaccaaggaagtcactggcat

SEQ ID NO: 776319 - DNA, 25 bp, Mus musculus
tcctaaccaaggtagtcactggcat

SEQ ID NO: 776320 - DNA, 25 bp, Mus musculus
tcctaacctttgatgactctgtact

SEQ ID NO: 776321 - DNA, 25 bp, Mus musculus
tcctaacctttgttgactctgtact

SEQ ID NO: 776322 - DNA, 25 bp, Mus musculus
tcctaacgtgttcagtgaaagcaag

SEQ ID NO: 776323 - DNA, 25 bp, Mus musculus
tcctaacgtgttgagtgaaagcaag

SEQ ID NO: 776324 - DNA, 25 bp, Mus musculus
tcctaactccaacgtgatgcaagaa

SEQ ID NO: 776325 - DNA, 25 bp, Mus musculus
tcctaactccaaggtgatgcaagaa

SEQ ID NO: 776326 - DNA, 25 bp, Mus musculus
tcctaagaagagatgtgggacttcc

SEQ ID NO: 776327 - DNA, 25 bp, Mus musculus
tcctaagaagagttgtgggacttcc

SEQ ID NO: 776328 - DNA, 25 bp, Mus musculus
tcctaagaccaccagagaaaaagct

SEQ ID NO: 776329 - DNA, 25 bp, Mus musculus
tcctaagaccacgagagaaaaagct

SEQ ID NO: 776330 - DNA, 25 bp, Mus musculus
tcctaagactccagcctgactgctg

SEQ ID NO: 776331 - DNA, 25 bp, Mus musculus
tcctaagactcctgcctgactgctg

SEQ ID NO: 776332 - DNA, 25 bp, Mus musculus
tcctaagagcgaccgtattgtcact

SEQ ID NO: 776333 - DNA, 25 bp, Mus musculus
tcctaagagcgagcgtattgtcact

SEQ ID NO: 776334 - DNA, 25 bp, Mus musculus
tcctaagaggagagtaccaagccgt

SEQ ID NO: 776335 - DNA, 25 bp, Mus musculus
tcctaagaggagtgtaccaagccgt

SEQ ID NO: 776336 - DNA, 25 bp, Mus musculus
tcctaagcatggcagatggtatgtg

SEQ ID NO: 776337 - DNA, 25 bp, Mus musculus
tcctaagcatgggagatggtatgtg

SEQ ID NO: 776338 - DNA, 25 bp, Mus musculus
tcctaagccacaaccatagaaggcg

SEQ ID NO: 776339 - DNA, 25 bp, Mus musculus
tcctaagccacatccatagaaggcg

SEQ ID NO: 776340 - DNA, 25 bp, Mus musculus
tcctaagccagacaagttggctcct

SEQ ID NO: 776341 - DNA, 25 bp, Mus musculus
tcctaagccagagaagttggctcct

SEQ ID NO: 776342 - DNA, 25 bp, Mus musculus
tcctaagcccttcctgtgtgttgag

SEQ ID NO: 776343 - DNA, 25 bp, Mus musculus
tcctaagcccttgctgtgtgttgag

SEQ ID NO: 776344 - DNA, 25 bp, Mus musculus
tcctaaggcttacaggaccaacttc

SEQ ID NO: 776345 - DNA, 25 bp, Mus musculus
tcctaaggcttagaggaccaacttc

SEQ ID NO: 776346 - DNA, 25 bp, Mus musculus
tcctaagggaagacctcaattacca

SEQ ID NO: 776347 - DNA, 25 bp, Mus musculus
tcctaagggaagtcctcaattacca

SEQ ID NO: 776348 - DNA, 25 bp, Mus musculus
tcctaagggcatctccaaaggatgc

SEQ ID NO: 776349 - DNA, 25 bp, Mus musculus
tcctaagggcatgtccaaaggatgc

SEQ ID NO: 776350 - DNA, 25 bp, Mus musculus
tcctaagggtttccctggagcgata

SEQ ID NO: 776351 - DNA, 25 bp, Mus musculus
tcctaagggtttgcctggagcgata

SEQ ID NO: 776352 - DNA, 25 bp, Mus musculus
tcctaaggttttctgcccagcatac

SEQ ID NO: 776353 - DNA, 25 bp, Mus musculus
tcctaaggttttgtgcccagcatac

SEQ ID NO: 776354 - DNA, 25 bp, Mus musculus
tcctaagtgcgactaggtttgaaac

SEQ ID NO: 776355 - DNA, 25 bp, Mus musculus
tcctaagtgcgagtaggtttgaaac

SEQ ID NO: 776356 - DNA, 25 bp, Mus musculus
tcctaagtggtgagcttacaggtgt

SEQ ID NO: 776357 - DNA, 25 bp, Mus musculus
tcctaagtggtgtgcttacaggtgt

SEQ ID NO: 776358 - DNA, 25 bp, Mus musculus
tcctaagttcctctcccttgttgct

SEQ ID NO: 776359 - DNA, 25 bp, Mus musculus
tcctaagttcctgtcccttgttgct

SEQ ID NO: 776360 - DNA, 25 bp, Mus musculus
tcctaagttgcaccagggatacaat

SEQ ID NO: 776361 - DNA, 25 bp, Mus musculus
tcctaagttgcagcagggatacaat

SEQ ID NO: 776362 - DNA, 25 bp, Mus musculus
tcctaataactaatatcaccgacgt

SEQ ID NO: 776363 - DNA, 25 bp, Mus musculus
tcctaataactattatcaccgacgt

SEQ ID NO: 776364 - DNA, 25 bp, Mus musculus
tcctaatagaccaaaggacccttgt

SEQ ID NO: 776365 - DNA, 25 bp, Mus musculus
tcctaatagacctaaggacccttgt

SEQ ID NO: 776366 - DNA, 25 bp, Mus musculus
tcctaatccagcaggctcgagagat

SEQ ID NO: 776367 - DNA, 25 bp, Mus musculus
tcctaatccagctggctcgagagat

SEQ ID NO: 776368 - DNA, 25 bp, Mus musculus
tcctaatcgtagacccggagatctt

SEQ ID NO: 776369 - DNA, 25 bp, Mus musculus
tcctaatcgtagtcccggagatctt

SEQ ID NO: 776370 - DNA, 25 bp, Mus musculus
tcctaatcgtggattgggatgttca

SEQ ID NO: 776371 - DNA, 25 bp, Mus musculus
tcctaatcgtggtttgggatgttca

SEQ ID NO: 776372 - DNA, 25 bp, Mus musculus
tcctaatggcccatgcgctgaagcg

SEQ ID NO: 776373 - DNA, 25 bp, Mus musculus
tcctaatggcccttgcgctgaagcg

SEQ ID NO: 776374 - DNA, 25 bp, Mus musculus
tcctaatggcttaggccacgttttt

SEQ ID NO: 776375 - DNA, 25 bp, Mus musculus
tcctaatggctttggccacgttttt

SEQ ID NO: 776376 - DNA, 25 bp, Mus musculus
tcctaattaagaatggagaaattaa

SEQ ID NO: 776377 - DNA, 25 bp, Mus musculus
tcctaattaagacagagtgtggaat

SEQ ID NO: 776378 - DNA, 25 bp, Mus musculus
tcctaattaagagagagtgtggaat

SEQ ID NO: 776379 - DNA, 25 bp, Mus musculus
tcctaattaagattggagaaattaa

SEQ ID NO: 776380 - DNA, 25 bp, Mus musculus
tcctaattacgaatttaagcttggt

SEQ ID NO: 776381 - DNA, 25 bp, Mus musculus
tcctaattacgattttaagcttggt

SEQ ID NO: 776382 - DNA, 25 bp, Mus musculus
tcctaattgtgaagacctgtctctg

SEQ ID NO: 776383 - DNA, 25 bp, Mus musculus
tcctaattgtgatgacctgtctctg

SEQ ID NO: 776384 - DNA, 25 bp, Mus musculus
tcctaatttcttccgcaagggccag

SEQ ID NO: 776385 - DNA, 25 bp, Mus musculus
tcctaatttcttgcgcaagggccag

SEQ ID NO: 776386 - DNA, 25 bp, Mus musculus
tcctacaacctgacactgtgcagtt

SEQ ID NO: 776387 - DNA, 25 bp, Mus musculus
tcctacaacctgcacccggagaatg

SEQ ID NO: 776388 - DNA, 25 bp, Mus musculus
tcctacaacctggacccggagaatg

SEQ ID NO: 776389 - DNA, 25 bp, Mus musculus
tcctacaacctgtcactgtgcagtt

SEQ ID NO: 776390 - DNA, 25 bp, Mus musculus
tcctacaagacgatcttaatttggg

SEQ ID NO: 776391 - DNA, 25 bp, Mus musculus
tcctacaagacgttcttaatttggg

SEQ ID NO: 776392 - DNA, 25 bp, Mus musculus
tcctacaagaggagtaacttctaca

SEQ ID NO: 776393 - DNA, 25 bp, Mus musculus
tcctacaagaggtgtaacttctaca

SEQ ID NO: 776394 - DNA, 25 bp, Mus musculus
tcctacaagcccctgatcgtggtgc

SEQ ID NO: 776395 - DNA, 25 bp, Mus musculus
tcctacaagcccgtgatcgtggtgc

SEQ ID NO: 776396 - DNA, 25 bp, Mus musculus
tcctacaaggttacgccgagggctg

SEQ ID NO: 776397 - DNA, 25 bp, Mus musculus
tcctacaaggtttcgccgagggctg

SEQ ID NO: 776398 - DNA, 25 bp, Mus musculus
tcctacaagtgactcagaaagatta

SEQ ID NO: 776399 - DNA, 25 bp, Mus musculus
tcctacaagtgagtcagaaagatta

SEQ ID NO: 776400 - DNA, 25 bp, Mus musculus
tcctacaagtggcagctgggtacac

SEQ ID NO: 776401 - DNA, 25 bp, Mus musculus
tcctacaagtgggagctgggtacac

SEQ ID NO: 776402 - DNA, 25 bp, Mus musculus
tcctacaatacaactctgccaactg

SEQ ID NO: 776403 - DNA, 25 bp, Mus musculus
tcctacaatacatctctgccaactg

SEQ ID NO: 776404 - DNA, 25 bp, Mus musculus
tcctacaatgggaaaagatgcccaa

SEQ ID NO: 776405 - DNA, 25 bp, Mus musculus
tcctacaatgggtaaagatgcccaa

SEQ ID NO: 776406 - DNA, 25 bp, Mus musculus
tcctacaatttgaggcaggagccaa

SEQ ID NO: 776407 - DNA, 25 bp, Mus musculus
tcctacaatttgtggcaggagccaa

SEQ ID NO: 776408 - DNA, 25 bp, Mus musculus
tcctacacacatatcctggaaatgt

SEQ ID NO: 776409 - DNA, 25 bp, Mus musculus
tcctacacacatttcctggaaatgt

SEQ ID NO: 776410 - DNA, 25 bp, Mus musculus
tcctacacagctacatacaacattt

SEQ ID NO: 776411 - DNA, 25 bp, Mus musculus
tcctacacagcttcatacaacattt

SEQ ID NO: 776412 - DNA, 25 bp, Mus musculus
tcctacacagttattcattagtcca

SEQ ID NO: 776413 - DNA, 25 bp, Mus musculus
tcctacacagtttttcattagtcca

SEQ ID NO: 776414 - DNA, 25 bp, Mus musculus
tcctacacatcaagatgaaagtggt

SEQ ID NO: 776415 - DNA, 25 bp, Mus musculus
tcctacacatcatgatgaaagtggt

SEQ ID NO: 776416 - DNA, 25 bp, Mus musculus
tcctacacgatcagactgtcattcg

SEQ ID NO: 776417 - DNA, 25 bp, Mus musculus
tcctacacgatctgactgtcattcg

SEQ ID NO: 776418 - DNA, 25 bp, Mus musculus
tcctacagaaccattactgtgcaag

SEQ ID NO: 776419 - DNA, 25 bp, Mus musculus
tcctacagaacctttactgtgcaag

SEQ ID NO: 776420 - DNA, 25 bp, Mus musculus
tcctacagacgcaccatggtgctga

SEQ ID NO: 776421 - DNA, 25 bp, Mus musculus
tcctacagacgctccatggtgctga

SEQ ID NO: 776422 - DNA, 25 bp, Mus musculus
tcctacagatgtctctgtccccagg

SEQ ID NO: 776423 - DNA, 25 bp, Mus musculus
tcctacagatgtgtctgtccccagg

SEQ ID NO: 776424 - DNA, 25 bp, Mus musculus
tcctacagattgatccagtttcact

SEQ ID NO: 776425 - DNA, 25 bp, Mus musculus
tcctacagattgttccagtttcact

SEQ ID NO: 776426 - DNA, 25 bp, Mus musculus
tcctacagcaggcacctccagaatg

SEQ ID NO: 776427 - DNA, 25 bp, Mus musculus
tcctacagcagggacctccagaatg

SEQ ID NO: 776428 - DNA, 25 bp, Mus musculus
tcctacagccacattctgcgcaagg

SEQ ID NO: 776429 - DNA, 25 bp, Mus musculus
tcctacagccactttctgcgcaagg

SEQ ID NO: 776430 - DNA, 25 bp, Mus musculus
tcctacaggaagctggttccgtggt

SEQ ID NO: 776431 - DNA, 25 bp, Mus musculus
tcctacaggaaggtggttccgtggt

SEQ ID NO: 776432 - DNA, 25 bp, Mus musculus
tcctacaggaggagcacaagctagc

SEQ ID NO: 776433 - DNA, 25 bp, Mus musculus
tcctacaggaggtgcacaagctagc

SEQ ID NO: 776434 - DNA, 25 bp, Mus musculus
tcctacagttgaccatggactccct

SEQ ID NO: 776435 - DNA, 25 bp, Mus musculus
tcctacagttgagcatggactccct

SEQ ID NO: 776436 - DNA, 25 bp, Mus musculus
tcctacatagtcaggaaagagctgg

SEQ ID NO: 776437 - DNA, 25 bp, Mus musculus
tcctacatagtctggaaagagctgg

SEQ ID NO: 776438 - DNA, 25 bp, Mus musculus
tcctacatctgcaaatggcctacag

SEQ ID NO: 776439 - DNA, 25 bp, Mus musculus
tcctacatctgctaatggcctacag

SEQ ID NO: 776440 - DNA, 25 bp, Mus musculus
tcctacatgaccatttcatggctct

SEQ ID NO: 776441 - DNA, 25 bp, Mus musculus
tcctacatgaccttttcatggctct

SEQ ID NO: 776442 - DNA, 25 bp, Mus musculus
tcctacatgcagcattatgggagca

SEQ ID NO: 776443 - DNA, 25 bp, Mus musculus
tcctacatgcaggattatgggagca

SEQ ID NO: 776444 - DNA, 25 bp, Mus musculus
tcctacattaggctgctggctagcc

SEQ ID NO: 776445 - DNA, 25 bp, Mus musculus
tcctacattagggtgctggctagcc

SEQ ID NO: 776446 - DNA, 25 bp, Mus musculus
tcctaccaggttagaacttcagcaa

SEQ ID NO: 776447 - DNA, 25 bp, Mus musculus
tcctaccaggtttgaacttcagcaa

SEQ ID NO: 776448 - DNA, 25 bp, Mus musculus
tcctacccaggaccagagggaagtg

SEQ ID NO: 776449 - DNA, 25 bp, Mus musculus
tcctacccaggagcagagggaagtg

SEQ ID NO: 776450 - DNA, 25 bp, Mus musculus
tcctacccaggtacaagcagtccga

SEQ ID NO: 776451 - DNA, 25 bp, Mus musculus
tcctacccaggttcaagcagtccga

SEQ ID NO: 776452 - DNA, 25 bp, Mus musculus
tcctacccctgtagttgtggaaaag

SEQ ID NO: 776453 - DNA, 25 bp, Mus musculus
tcctacccctgttgttgtggaaaag

SEQ ID NO: 776454 - DNA, 25 bp, Mus musculus
tcctaccgcccacgcccgggtggtg

SEQ ID NO: 776455 - DNA, 25 bp, Mus musculus
tcctaccgcccaggcccgggtggtg

SEQ ID NO: 776456 - DNA, 25 bp, Mus musculus
tcctaccgccttcacgagggcttct

SEQ ID NO: 776457 - DNA, 25 bp, Mus musculus
tcctaccgccttgacgagggcttct

SEQ ID NO: 776458 - DNA, 25 bp, Mus musculus
tcctaccggatgaggatcgaaaaca

SEQ ID NO: 776459 - DNA, 25 bp, Mus musculus
tcctaccggatgtggatcgaaaaca

SEQ ID NO: 776460 - DNA, 25 bp, Mus musculus
tcctaccgtggcaatgtgacatggt

SEQ ID NO: 776461 - DNA, 25 bp, Mus musculus
tcctaccgtggctatgtgacatggt

SEQ ID NO: 776462 - DNA, 25 bp, Mus musculus
tcctacctagatcccatcaggactg

SEQ ID NO: 776463 - DNA, 25 bp, Mus musculus
tcctacctagatgccatcaggactg

SEQ ID NO: 776464 - DNA, 25 bp, Mus musculus
tcctacctgcatctggatctgagcc

SEQ ID NO: 776465 - DNA, 25 bp, Mus musculus
tcctacctgcatgtggatctgagcc

SEQ ID NO: 776466 - DNA, 25 bp, Mus musculus
tcctacctggctctgtgaagtgtgg

SEQ ID NO: 776467 - DNA, 25 bp, Mus musculus
tcctacctggctgtgtgaagtgtgg

SEQ ID NO: 776468 - DNA, 25 bp, Mus musculus
tcctacctgtgaaagtaagtcacac

SEQ ID NO: 776469 - DNA, 25 bp, Mus musculus
tcctacctgtgatagtaagtcacac

SEQ ID NO: 776470 - DNA, 25 bp, Mus musculus
tcctacgcgagtcggacagggctat

SEQ ID NO: 776471 - DNA, 25 bp, Mus musculus
tcctacgcgagtgggacagggctat

SEQ ID NO: 776472 - DNA, 25 bp, Mus musculus
tcctacgctgtcataagagtgttgt

SEQ ID NO: 776473 - DNA, 25 bp, Mus musculus
tcctacgctgtcttaagagtgttgt

SEQ ID NO: 776474 - DNA, 25 bp, Mus musculus
tcctacgctgtgcaggctgaactgg

SEQ ID NO: 776475 - DNA, 25 bp, Mus musculus
tcctacgctgtggaggctgaactgg

SEQ ID NO: 776476 - DNA, 25 bp, Mus musculus
tcctacggattgaacatcgagatgc

SEQ ID NO: 776477 - DNA, 25 bp, Mus musculus
tcctacggattgtacatcgagatgc

SEQ ID NO: 776478 - DNA, 25 bp, Mus musculus
tcctacggcttcagggtgccttcac

SEQ ID NO: 776479 - DNA, 25 bp, Mus musculus
tcctacggcttctgggtgccttcac

SEQ ID NO: 776480 - DNA, 25 bp, Mus musculus
tcctacgggcaaactgatggatcag

SEQ ID NO: 776481 - DNA, 25 bp, Mus musculus
tcctacgggcaatctgatggatcag

SEQ ID NO: 776482 - DNA, 25 bp, Mus musculus
tcctacgggctcacggccgaggtca

SEQ ID NO: 776483 - DNA, 25 bp, Mus musculus
tcctacgggctctcggccgaggtca

SEQ ID NO: 776484 - DNA, 25 bp, Mus musculus
tcctacgtgaaacctgagcaacatt

SEQ ID NO: 776485 - DNA, 25 bp, Mus musculus
tcctacgtgaaagctgagcaacatt

SEQ ID NO: 776486 - DNA, 25 bp, Mus musculus
tcctactacaaaactgagggcgagg

SEQ ID NO: 776487 - DNA, 25 bp, Mus musculus
tcctactacaaatctgagggcgagg

SEQ ID NO: 776488 - DNA, 25 bp, Mus musculus
tcctactacggtctcgtgcggctgt

SEQ ID NO: 776489 - DNA, 25 bp, Mus musculus
tcctactacggtgtcgtgcggctgt

SEQ ID NO: 776490 - DNA, 25 bp, Mus musculus
tcctactattgcacataaggccatg

SEQ ID NO: 776491 - DNA, 25 bp, Mus musculus
tcctactattgctcataaggccatg

SEQ ID NO: 776492 - DNA, 25 bp, Mus musculus
tcctactcaggacacgtgactgctg

SEQ ID NO: 776493 - DNA, 25 bp, Mus musculus
tcctactcaggagacgtgactgctg

SEQ ID NO: 776494 - DNA, 25 bp, Mus musculus
tcctactctgatactgggctgctgg

SEQ ID NO: 776495 - DNA, 25 bp, Mus musculus
tcctactctgattctgggctgctgg

SEQ ID NO: 776496 - DNA, 25 bp, Mus musculus
tcctactctggcacatcaagtttct

SEQ ID NO: 776497 - DNA, 25 bp, Mus musculus
tcctactctggctcatcaagtttct

SEQ ID NO: 776498 - DNA, 25 bp, Mus musculus
tcctactctgtccaggctgaaaggt

SEQ ID NO: 776499 - DNA, 25 bp, Mus musculus
tcctactctgtcgaggctgaaaggt

SEQ ID NO: 776500 - DNA, 25 bp, Mus musculus
tcctactctttgaggtgggtttcag

SEQ ID NO: 776501 - DNA, 25 bp, Mus musculus
tcctactctttgtggtgggtttcag

SEQ ID NO: 776502 - DNA, 25 bp, Mus musculus
tcctactgataacttggagacctcc

SEQ ID NO: 776503 - DNA, 25 bp, Mus musculus
tcctactgataagttggagacctcc

SEQ ID NO: 776504 - DNA, 25 bp, Mus musculus
tcctactgatgcaaattgtcttctg

SEQ ID NO: 776505 - DNA, 25 bp, Mus musculus
tcctactgatgctaattgtcttctg

SEQ ID NO: 776506 - DNA, 25 bp, Mus musculus
tcctactttgacagagcaggcgtgg

SEQ ID NO: 776507 - DNA, 25 bp, Mus musculus
tcctactttgactgagcaggcgtgg

SEQ ID NO: 776508 - DNA, 25 bp, Mus musculus
tcctactttgttaaaggaggcaaag

SEQ ID NO: 776509 - DNA, 25 bp, Mus musculus
tcctactttgtttaaggaggcaaag

SEQ ID NO: 776510 - DNA, 25 bp, Mus musculus
tcctagaaaattcaacttggatgca

SEQ ID NO: 776511 - DNA, 25 bp, Mus musculus
tcctagaaaattgaacttggatgca

SEQ ID NO: 776512 - DNA, 25 bp, Mus musculus
tcctagaaagccctatgaaggtcga

SEQ ID NO: 776513 - DNA, 25 bp, Mus musculus
tcctagaaagccgtatgaaggtcga

SEQ ID NO: 776514 - DNA, 25 bp, Mus musculus
tcctagaaccaacatgaagggtgcc

SEQ ID NO: 776515 - DNA, 25 bp, Mus musculus
tcctagaaccaagatgaagggtgcc

SEQ ID NO: 776516 - DNA, 25 bp, Mus musculus
tcctagaagaccctgtagagttgat

SEQ ID NO: 776517 - DNA, 25 bp, Mus musculus
tcctagaagaccgtgtagagttgat

SEQ ID NO: 776518 - DNA, 25 bp, Mus musculus
tcctagacacctcttctacagcgga

SEQ ID NO: 776519 - DNA, 25 bp, Mus musculus
tcctagacacctgttctacagcgga

SEQ ID NO: 776520 - DNA, 25 bp, Mus musculus
tcctagagacagaaggaagatggaa

SEQ ID NO: 776521 - DNA, 25 bp, Mus musculus
tcctagagacagtaggaagatggaa

SEQ ID NO: 776522 - DNA, 25 bp, Mus musculus
tcctagaggagcagcgggcactctt

SEQ ID NO: 776523 - DNA, 25 bp, Mus musculus
tcctagaggagctgcgggcactctt

SEQ ID NO: 776524 - DNA, 25 bp, Mus musculus
tcctagaggaggcagtaagcatgca

SEQ ID NO: 776525 - DNA, 25 bp, Mus musculus
tcctagaggagggagtaagcatgca

SEQ ID NO: 776526 - DNA, 25 bp, Mus musculus
tcctagaggagtatataatgtgaca

SEQ ID NO: 776527 - DNA, 25 bp, Mus musculus
tcctagaggagtttataatgtgaca

SEQ ID NO: 776528 - DNA, 25 bp, Mus musculus
tcctagaggcacagagacagagacc

SEQ ID NO: 776529 - DNA, 25 bp, Mus musculus
tcctagaggcactgagacagagacc

SEQ ID NO: 776530 - DNA, 25 bp, Mus musculus
tcctagaggcttaaccataataaaa

SEQ ID NO: 776531 - DNA, 25 bp, Mus musculus
tcctagaggctttaccataataaaa

SEQ ID NO: 776532 - DNA, 25 bp, Mus musculus
tcctagaggtgaagccctccgagct

SEQ ID NO: 776533 - DNA, 25 bp, Mus musculus
tcctagaggtgatgccctccgagct

SEQ ID NO: 776534 - DNA, 25 bp, Mus musculus
tcctagaggtgccagccgcgccata

SEQ ID NO: 776535 - DNA, 25 bp, Mus musculus
tcctagaggtgcgagccgcgccata

SEQ ID NO: 776536 - DNA, 25 bp, Mus musculus
tcctagatagagcagaagaactggc

SEQ ID NO: 776537 - DNA, 25 bp, Mus musculus
tcctagatagaggagaagaactggc

SEQ ID NO: 776538 - DNA, 25 bp, Mus musculus
tcctagatgatgagtgggcgcgcac

SEQ ID NO: 776539 - DNA, 25 bp, Mus musculus
tcctagatgatgtgtgggcgcgcac

SEQ ID NO: 776540 - DNA, 25 bp, Mus musculus
tcctagcacgttctcacagtattgt

SEQ ID NO: 776541 - DNA, 25 bp, Mus musculus
tcctagcacgttgtcacagtattgt

SEQ ID NO: 776542 - DNA, 25 bp, Mus musculus
tcctagcagcacctacatggagcac

SEQ ID NO: 776543 - DNA, 25 bp, Mus musculus
tcctagcagcacgtacatggagcac

SEQ ID NO: 776544 - DNA, 25 bp, Mus musculus
tcctagcagctaccgatgggagtct

SEQ ID NO: 776545 - DNA, 25 bp, Mus musculus
tcctagcagctagcgatgggagtct

SEQ ID NO: 776546 - DNA, 25 bp, Mus musculus
tcctagcagggcacctgtgagtatt

SEQ ID NO: 776547 - DNA, 25 bp, Mus musculus
tcctagcagggctcctgtgagtatt

SEQ ID NO: 776548 - DNA, 25 bp, Mus musculus
tcctagcctttcagcagagagccta

SEQ ID NO: 776549 - DNA, 25 bp, Mus musculus
tcctagcctttctgcagagagccta

SEQ ID NO: 776550 - DNA, 25 bp, Mus musculus
tcctagcgacaactcttgaggtgaa

SEQ ID NO: 776551 - DNA, 25 bp, Mus musculus
tcctagcgacaagtcttgaggtgaa

SEQ ID NO: 776552 - DNA, 25 bp, Mus musculus
tcctagcgacctagacctggtcatg

SEQ ID NO: 776553 - DNA, 25 bp, Mus musculus
tcctagcgaccttgacctggtcatg

SEQ ID NO: 776554 - DNA, 25 bp, Mus musculus
tcctagcgggctcgcttttatctcc

SEQ ID NO: 776555 - DNA, 25 bp, Mus musculus
tcctagcgggctggcttttatctcc

SEQ ID NO: 776556 - DNA, 25 bp, Mus musculus
tcctagctacatacgagactccact

SEQ ID NO: 776557 - DNA, 25 bp, Mus musculus
tcctagctacattcgagactccact

SEQ ID NO: 776558 - DNA, 25 bp, Mus musculus
tcctagctatgcacctaattgatgt

SEQ ID NO: 776559 - DNA, 25 bp, Mus musculus
tcctagctatgctcctaattgatgt

SEQ ID NO: 776560 - DNA, 25 bp, Mus musculus
tcctagctgcctccctgatgaatcg

SEQ ID NO: 776561 - DNA, 25 bp, Mus musculus
tcctagctgcctgcctgatgaatcg

SEQ ID NO: 776562 - DNA, 25 bp, Mus musculus
tcctagctgtttcttctgtgctgct

SEQ ID NO: 776563 - DNA, 25 bp, Mus musculus
tcctagctgtttgttctgtgctgct

SEQ ID NO: 776564 - DNA, 25 bp, Mus musculus
tcctaggacaaacggaagagccctt

SEQ ID NO: 776565 - DNA, 25 bp, Mus musculus
tcctaggacaaagggaagagccctt

SEQ ID NO: 776566 - DNA, 25 bp, Mus musculus
tcctaggagactcagaagagccctc

SEQ ID NO: 776567 - DNA, 25 bp, Mus musculus
tcctaggagactgagaagagccctc

SEQ ID NO: 776568 - DNA, 25 bp, Mus musculus
tcctaggaggcaaccggtctacatg

SEQ ID NO: 776569 - DNA, 25 bp, Mus musculus
tcctaggaggcatccggtctacatg

SEQ ID NO: 776570 - DNA, 25 bp, Mus musculus
tcctaggatgatatcagagacctca

SEQ ID NO: 776571 - DNA, 25 bp, Mus musculus
tcctaggatgatttcagagacctca

SEQ ID NO: 776572 - DNA, 25 bp, Mus musculus
tcctagggaagaacgcctcagccgg

SEQ ID NO: 776573 - DNA, 25 bp, Mus musculus
tcctagggaagatcgcctcagccgg

SEQ ID NO: 776574 - DNA, 25 bp, Mus musculus
tcctagggtgcaacaggtccctgca

SEQ ID NO: 776575 - DNA, 25 bp, Mus musculus
tcctagggtgcacagctggacattt

SEQ ID NO: 776576 - DNA, 25 bp, Mus musculus
tcctagggtgcagagctggacattt

SEQ ID NO: 776577 - DNA, 25 bp, Mus musculus
tcctagggtgcatcaggtccctgca

SEQ ID NO: 776578 - DNA, 25 bp, Mus musculus
tcctaggtctgcacatctacgtcct

SEQ ID NO: 776579 - DNA, 25 bp, Mus musculus
tcctaggtctgctcatctacgtcct

SEQ ID NO: 776580 - DNA, 25 bp, Mus musculus
tcctagtaagagaggcactttagag

SEQ ID NO: 776581 - DNA, 25 bp, Mus musculus
tcctagtaagagtggcactttagag

SEQ ID NO: 776582 - DNA, 25 bp, Mus musculus
tcctagtaaggaagcagccgagcac

SEQ ID NO: 776583 - DNA, 25 bp, Mus musculus
tcctagtaaggaccgagtctgaact

SEQ ID NO: 776584 - DNA, 25 bp, Mus musculus
tcctagtaaggagcgagtctgaact

SEQ ID NO: 776585 - DNA, 25 bp, Mus musculus
tcctagtaaggatgcagccgagcac

SEQ ID NO: 776586 - DNA, 25 bp, Mus musculus
tcctagtaccgcaagaagctgctgg

SEQ ID NO: 776587 - DNA, 25 bp, Mus musculus
tcctagtaccgctagaagctgctgg

SEQ ID NO: 776588 - DNA, 25 bp, Mus musculus
tcctagtcaaatataaccggctggg

SEQ ID NO: 776589 - DNA, 25 bp, Mus musculus
tcctagtcaaatttaaccggctggg

SEQ ID NO: 776590 - DNA, 25 bp, Mus musculus
tcctagtcactccagaggatgactt

SEQ ID NO: 776591 - DNA, 25 bp, Mus musculus
tcctagtcactcgagaggatgactt

SEQ ID NO: 776592 - DNA, 25 bp, Mus musculus
tcctagtctgagctgccgttacatt

SEQ ID NO: 776593 - DNA, 25 bp, Mus musculus
tcctagtctgaggtgccgttacatt

SEQ ID NO: 776594 - DNA, 25 bp, Mus musculus
tcctagtgacggagagccaaagtac

SEQ ID NO: 776595 - DNA, 25 bp, Mus musculus
tcctagtgacggtgagccaaagtac

SEQ ID NO: 776596 - DNA, 25 bp, Mus musculus
tcctagtgatgacaagacgacattg

SEQ ID NO: 776597 - DNA, 25 bp, Mus musculus
tcctagtgatgagaagacgacattg

SEQ ID NO: 776598 - DNA, 25 bp, Mus musculus
tcctagtgccttagagatgacctta

SEQ ID NO: 776599 - DNA, 25 bp, Mus musculus
tcctagtgcctttgagatgacctta

SEQ ID NO: 776600 - DNA, 25 bp, Mus musculus
tcctagtggagcaggtgcctcagta

SEQ ID NO: 776601 - DNA, 25 bp, Mus musculus
tcctagtggagctggtgcctcagta

SEQ ID NO: 776602 - DNA, 25 bp, Mus musculus
tcctagtggcatagggaatgaatct

SEQ ID NO: 776603 - DNA, 25 bp, Mus musculus
tcctagtggcattgggaatgaatct

SEQ ID NO: 776604 - DNA, 25 bp, Mus musculus
tcctagtggcctctgacgtctgctt

SEQ ID NO: 776605 - DNA, 25 bp, Mus musculus
tcctagtggcctgtgacgtctgctt

SEQ ID NO: 776606 - DNA, 25 bp, Mus musculus
tcctagtgtgtcagcaccaaatccc

SEQ ID NO: 776607 - DNA, 25 bp, Mus musculus
tcctagtgtgtctgcaccaaatccc

SEQ ID NO: 776608 - DNA, 25 bp, Mus musculus
tcctagttcaatacagcacagaagc

SEQ ID NO: 776609 - DNA, 25 bp, Mus musculus
tcctagttcaattcagcacagaagc

SEQ ID NO: 776610 - DNA, 25 bp, Mus musculus
tcctataaaactcagtgcccaactt

SEQ ID NO: 776611 - DNA, 25 bp, Mus musculus
tcctataaaactgagtgcccaactt

SEQ ID NO: 776612 - DNA, 25 bp, Mus musculus
tcctataaggaaaagcagagaagat

SEQ ID NO: 776613 - DNA, 25 bp, Mus musculus
tcctataaggaatagcagagaagat

SEQ ID NO: 776614 - DNA, 25 bp, Mus musculus
tcctataatgaacactggaaccatc

SEQ ID NO: 776615 - DNA, 25 bp, Mus musculus
tcctataatgaagactggaaccatc

SEQ ID NO: 776616 - DNA, 25 bp, Mus musculus
tcctatacaaccagtactcctcaga

SEQ ID NO: 776617 - DNA, 25 bp, Mus musculus
tcctatacaacctgtactcctcaga

SEQ ID NO: 776618 - DNA, 25 bp, Mus musculus
tcctatactagacgagggcagtcct

SEQ ID NO: 776619 - DNA, 25 bp, Mus musculus
tcctatactagaggagggcagtcct

SEQ ID NO: 776620 - DNA, 25 bp, Mus musculus
tcctatactctacggtttgcaagcc

SEQ ID NO: 776621 - DNA, 25 bp, Mus musculus
tcctatactctagggtttgcaagcc

SEQ ID NO: 776622 - DNA, 25 bp, Mus musculus
tcctataggatgaggacagaccctc

SEQ ID NO: 776623 - DNA, 25 bp, Mus musculus
tcctataggatgtggacagaccctc

SEQ ID NO: 776624 - DNA, 25 bp, Mus musculus
tcctatatggtaacgggcctggcta

SEQ ID NO: 776625 - DNA, 25 bp, Mus musculus
tcctatatggtatcgggcctggcta

SEQ ID NO: 776626 - DNA, 25 bp, Mus musculus
tcctatccgtggctcttcagagaga

SEQ ID NO: 776627 - DNA, 25 bp, Mus musculus
tcctatccgtgggtcttcagagaga

SEQ ID NO: 776628 - DNA, 25 bp, Mus musculus
tcctatcctggtcccgagatttggg

SEQ ID NO: 776629 - DNA, 25 bp, Mus musculus
tcctatcctggtgccgagatttggg

SEQ ID NO: 776630 - DNA, 25 bp, Mus musculus
tcctatcggagtagcagtattatct

SEQ ID NO: 776631 - DNA, 25 bp, Mus musculus
tcctatcggagttgcagtattatct

SEQ ID NO: 776632 - DNA, 25 bp, Mus musculus
tcctatctcagtagaagcaccccaa

SEQ ID NO: 776633 - DNA, 25 bp, Mus musculus
tcctatctcagttgaagcaccccaa

SEQ ID NO: 776634 - DNA, 25 bp, Mus musculus
tcctatctgctgattcctgcagcct

SEQ ID NO: 776635 - DNA, 25 bp, Mus musculus
tcctatctgctgtttcctgcagcct

SEQ ID NO: 776636 - DNA, 25 bp, Mus musculus
tcctatgaacagcacagagatcagc

SEQ ID NO: 776637 - DNA, 25 bp, Mus musculus
tcctatgaacaggacagagatcagc

SEQ ID NO: 776638 - DNA, 25 bp, Mus musculus
tcctatgacattcatgcgcagacat

SEQ ID NO: 776639 - DNA, 25 bp, Mus musculus
tcctatgacattgatgcgcagacat

SEQ ID NO: 776640 - DNA, 25 bp, Mus musculus
tcctatgagaggctaaactaaggtg

SEQ ID NO: 776641 - DNA, 25 bp, Mus musculus
tcctatgagagggtaaactaaggtg

SEQ ID NO: 776642 - DNA, 25 bp, Mus musculus
tcctatgcacagaagggcattctat

SEQ ID NO: 776643 - DNA, 25 bp, Mus musculus
tcctatgcacagtagggcattctat

SEQ ID NO: 776644 - DNA, 25 bp, Mus musculus
tcctatgccgggaacacaacgtgtg

SEQ ID NO: 776645 - DNA, 25 bp, Mus musculus
tcctatgccgggtacacaacgtgtg

SEQ ID NO: 776646 - DNA, 25 bp, Mus musculus
tcctatgcgcagagagagtggccgc

SEQ ID NO: 776647 - DNA, 25 bp, Mus musculus
tcctatgcgcagtgagagtggccgc

SEQ ID NO: 776648 - DNA, 25 bp, Mus musculus
tcctatggatatatggctgctgctg

SEQ ID NO: 776649 - DNA, 25 bp, Mus musculus
tcctatggatatttggctgctgctg

SEQ ID NO: 776650 - DNA, 25 bp, Mus musculus
tcctatgggaacagtcgaagtacgc

SEQ ID NO: 776651 - DNA, 25 bp, Mus musculus
tcctatgggaactgtcgaagtacgc

SEQ ID NO: 776652 - DNA, 25 bp, Mus musculus
tcctatgggcaaagtgcaatgctca

SEQ ID NO: 776653 - DNA, 25 bp, Mus musculus
tcctatgggcaatgtgcaatgctca

SEQ ID NO: 776654 - DNA, 25 bp, Mus musculus
tcctatggtacaagaacagtctgcc

SEQ ID NO: 776655 - DNA, 25 bp, Mus musculus
tcctatggtacatgaacagtctgcc

SEQ ID NO: 776656 - DNA, 25 bp, Mus musculus
tcctatggtgacaggctgacgtcca

SEQ ID NO: 776657 - DNA, 25 bp, Mus musculus
tcctatggtgactggctgacgtcca

SEQ ID NO: 776658 - DNA, 25 bp, Mus musculus
tcctatggtgtgagcttctctgctg

SEQ ID NO: 776659 - DNA, 25 bp, Mus musculus
tcctatggtgtgtgcttctctgctg

SEQ ID NO: 776660 - DNA, 25 bp, Mus musculus
tcctatgtacagaacggcacaggga

SEQ ID NO: 776661 - DNA, 25 bp, Mus musculus
tcctatgtacagtacggcacaggga

SEQ ID NO: 776662 - DNA, 25 bp, Mus musculus
tcctatgtactaccgaggatctgct

SEQ ID NO: 776663 - DNA, 25 bp, Mus musculus
tcctatgtactagcgaggatctgct

SEQ ID NO: 776664 - DNA, 25 bp, Mus musculus
tcctatgtcgctcccgtgtgcggaa

SEQ ID NO: 776665 - DNA, 25 bp, Mus musculus
tcctatgtcgctgccgtgtgcggaa

SEQ ID NO: 776666 - DNA, 25 bp, Mus musculus
tcctatgtggcccagcggcaacctt

SEQ ID NO: 776667 - DNA, 25 bp, Mus musculus
tcctatgtggccgagcggcaacctt

SEQ ID NO: 776668 - DNA, 25 bp, Mus musculus
tcctatgtgggtcccatggtctcca

SEQ ID NO: 776669 - DNA, 25 bp, Mus musculus
tcctatgtgggtgccatggtctcca

SEQ ID NO: 776670 - DNA, 25 bp, Mus musculus
tcctatgttgaacaagaggctggtg

SEQ ID NO: 776671 - DNA, 25 bp, Mus musculus
tcctatgttgaagaagaggctggtg

SEQ ID NO: 776672 - DNA, 25 bp, Mus musculus
tcctattggaaaagtgcatccatgc

SEQ ID NO: 776673 - DNA, 25 bp, Mus musculus
tcctattggaaatgtgcatccatgc

SEQ ID NO: 776674 - DNA, 25 bp, Mus musculus
tcctattgtcacctccggtcttatc

SEQ ID NO: 776675 - DNA, 25 bp, Mus musculus
tcctattgtcacgtccggtcttatc

SEQ ID NO: 776676 - DNA, 25 bp, Mus musculus
tcctcaaaaagtcaatcccgactga

SEQ ID NO: 776677 - DNA, 25 bp, Mus musculus
tcctcaaaaagtgaatcccgactga

SEQ ID NO: 776678 - DNA, 25 bp, Mus musculus
tcctcaaaaggcactcacctcatta

SEQ ID NO: 776679 - DNA, 25 bp, Mus musculus
tcctcaaaaggctctcacctcatta

SEQ ID NO: 776680 - DNA, 25 bp, Mus musculus
tcctcaaagctgagggatatccgag

SEQ ID NO: 776681 - DNA, 25 bp, Mus musculus
tcctcaaagctgtgggatatccgag

SEQ ID NO: 776682 - DNA, 25 bp, Mus musculus
tcctcaaagtcaatcaagctgtact

SEQ ID NO: 776683 - DNA, 25 bp, Mus musculus
tcctcaaagtcattcaagctgtact

SEQ ID NO: 776684 - DNA, 25 bp, Mus musculus
tcctcaaccttgaataaatgagagg

SEQ ID NO: 776685 - DNA, 25 bp, Mus musculus
tcctcaaccttgtataaatgagagg

SEQ ID NO: 776686 - DNA, 25 bp, Mus musculus
tcctcaacgcacataggaagtgtgt

SEQ ID NO: 776687 - DNA, 25 bp, Mus musculus
tcctcaacgcacttaggaagtgtgt

SEQ ID NO: 776688 - DNA, 25 bp, Mus musculus
tcctcaagagaacagctgcaagcag

SEQ ID NO: 776689 - DNA, 25 bp, Mus musculus
tcctcaagagaagagctgcaagcag

SEQ ID NO: 776690 - DNA, 25 bp, Mus musculus
tcctcaagcagcagaaatttgcaga

SEQ ID NO: 776691 - DNA, 25 bp, Mus musculus
tcctcaagcagctgaaatttgcaga

SEQ ID NO: 776692 - DNA, 25 bp, Mus musculus
tcctcaaggcccacatggtaacgca

SEQ ID NO: 776693 - DNA, 25 bp, Mus musculus
tcctcaaggcccagcagaatgccgt

SEQ ID NO: 776694 - DNA, 25 bp, Mus musculus
tcctcaaggccctcatggtaacgca

SEQ ID NO: 776695 - DNA, 25 bp, Mus musculus
tcctcaaggccctgcagaatgccgt

SEQ ID NO: 776696 - DNA, 25 bp, Mus musculus
tcctcaaggtgaacgggaaagtaat

SEQ ID NO: 776697 - DNA, 25 bp, Mus musculus
tcctcaaggtgatcgggaaagtaat

SEQ ID NO: 776698 - DNA, 25 bp, Mus musculus
tcctcaagtacaccgccaaagacta

SEQ ID NO: 776699 - DNA, 25 bp, Mus musculus
tcctcaagtacagcgccaaagacta

SEQ ID NO: 776700 - DNA, 25 bp, Mus musculus
tcctcaagtcctactcaggagacgt

SEQ ID NO: 776701 - DNA, 25 bp, Mus musculus
tcctcaagtccttctcaggagacgt

SEQ ID NO: 776702 - DNA, 25 bp, Mus musculus
tcctcaagtgcaaggcagtgtctcg

SEQ ID NO: 776703 - DNA, 25 bp, Mus musculus
tcctcaagtgcatggcagtgtctcg

SEQ ID NO: 776704 - DNA, 25 bp, Mus musculus
tcctcaagtgccctgcgaatggcag

SEQ ID NO: 776705 - DNA, 25 bp, Mus musculus
tcctcaagtgccgtgcgaatggcag

SEQ ID NO: 776706 - DNA, 25 bp, Mus musculus
tcctcaatacggagcggaagaacgc

SEQ ID NO: 776707 - DNA, 25 bp, Mus musculus
tcctcaatacggtgcggaagaacgc

SEQ ID NO: 776708 - DNA, 25 bp, Mus musculus
tcctcaatccagcaaagatattttg

SEQ ID NO: 776709 - DNA, 25 bp, Mus musculus
tcctcaatccaggaaagatattttg

SEQ ID NO: 776710 - DNA, 25 bp, Mus musculus
tcctcaatgaaccagacaactgcca

SEQ ID NO: 776711 - DNA, 25 bp, Mus musculus
tcctcaatgaacgagacaactgcca

SEQ ID NO: 776712 - DNA, 25 bp, Mus musculus
tcctcacagcataggcccagggtgt

SEQ ID NO: 776713 - DNA, 25 bp, Mus musculus
tcctcacagcattggcccagggtgt

SEQ ID NO: 776714 - DNA, 25 bp, Mus musculus
tcctcacagcgaattgaaagagctt

SEQ ID NO: 776715 - DNA, 25 bp, Mus musculus
tcctcacagcgatttgaaagagctt

SEQ ID NO: 776716 - DNA, 25 bp, Mus musculus
tcctcacaggtaacaggagctcctg

SEQ ID NO: 776717 - DNA, 25 bp, Mus musculus
tcctcacaggtatcaggagctcctg

SEQ ID NO: 776718 - DNA, 25 bp, Mus musculus
tcctcacaggttccacgagtcatgt

SEQ ID NO: 776719 - DNA, 25 bp, Mus musculus
tcctcacaggttgcacgagtcatgt

SEQ ID NO: 776720 - DNA, 25 bp, Mus musculus
tcctcaccctgacgccgggaaagtt

SEQ ID NO: 776721 - DNA, 25 bp, Mus musculus
tcctcaccctgaggccgggaaagtt

SEQ ID NO: 776722 - DNA, 25 bp, Mus musculus
tcctcacctacgaccgcgtggagag

SEQ ID NO: 776723 - DNA, 25 bp, Mus musculus
tcctcacctacgtccgcgtggagag

SEQ ID NO: 776724 - DNA, 25 bp, Mus musculus
tcctcacctgtgacgtcttcctggt

SEQ ID NO: 776725 - DNA, 25 bp, Mus musculus
tcctcacctgtgtcgtcttcctggt

SEQ ID NO: 776726 - DNA, 25 bp, Mus musculus
tcctcaccttgtataacctcgcaat

SEQ ID NO: 776727 - DNA, 25 bp, Mus musculus
tcctcaccttgtttaacctcgcaat

SEQ ID NO: 776728 - DNA, 25 bp, Mus musculus
tcctcactacttcatgagccagtgc

SEQ ID NO: 776729 - DNA, 25 bp, Mus musculus
tcctcactacttgatgagccagtgc

SEQ ID NO: 776730 - DNA, 25 bp, Mus musculus
tcctcactagggactgcacaggctg

SEQ ID NO: 776731 - DNA, 25 bp, Mus musculus
tcctcactagggtctgcacaggctg

SEQ ID NO: 776732 - DNA, 25 bp, Mus musculus
tcctcactcagcagaagatcctcag

SEQ ID NO: 776733 - DNA, 25 bp, Mus musculus
tcctcactcagctgaagatcctcag

SEQ ID NO: 776734 - DNA, 25 bp, Mus musculus
tcctcactgcgcattggaaccgttg

SEQ ID NO: 776735 - DNA, 25 bp, Mus musculus
tcctcactgcgctttggaaccgttg

SEQ ID NO: 776736 - DNA, 25 bp, Mus musculus
tcctcactggagaatgcagtcagcg

SEQ ID NO: 776737 - DNA, 25 bp, Mus musculus
tcctcactggagtatgcagtcagcg

SEQ ID NO: 776738 - DNA, 25 bp, Mus musculus
tcctcactttccatgcagggaatgt

SEQ ID NO: 776739 - DNA, 25 bp, Mus musculus
tcctcactttccttgcagggaatgt

SEQ ID NO: 776740 - DNA, 25 bp, Mus musculus
tcctcacttttacggttgggccagc

SEQ ID NO: 776741 - DNA, 25 bp, Mus musculus
tcctcacttttagggttgggccagc

SEQ ID NO: 776742 - DNA, 25 bp, Mus musculus
tcctcagaccgcattttgccgcgag

SEQ ID NO: 776743 - DNA, 25 bp, Mus musculus
tcctcagaccgctttttgccgcgag

SEQ ID NO: 776744 - DNA, 25 bp, Mus musculus
tcctcagacgacacctatgtgtccg

SEQ ID NO: 776745 - DNA, 25 bp, Mus musculus
tcctcagacgactcctatgtgtccg

SEQ ID NO: 776746 - DNA, 25 bp, Mus musculus
tcctcagagaccaccgactgggtgc

SEQ ID NO: 776747 - DNA, 25 bp, Mus musculus
tcctcagagacctccgactgggtgc

SEQ ID NO: 776748 - DNA, 25 bp, Mus musculus
tcctcagagactcgagaattttaca

SEQ ID NO: 776749 - DNA, 25 bp, Mus musculus
tcctcagagactggagaattttaca

SEQ ID NO: 776750 - DNA, 25 bp, Mus musculus
tcctcagagcgtacatagggaatga

SEQ ID NO: 776751 - DNA, 25 bp, Mus musculus
tcctcagagcgttcatagggaatga

SEQ ID NO: 776752 - DNA, 25 bp, Mus musculus
tcctcagagctcaccagtgctgtcg

SEQ ID NO: 776753 - DNA, 25 bp, Mus musculus
tcctcagagctctccagtgctgtcg

SEQ ID NO: 776754 - DNA, 25 bp, Mus musculus
tcctcagcatctccctgtctggata

SEQ ID NO: 776755 - DNA, 25 bp, Mus musculus
tcctcagcatctgcctgtctggata

SEQ ID NO: 776756 - DNA, 25 bp, Mus musculus
tcctcagccataaagtttcactgtt

SEQ ID NO: 776757 - DNA, 25 bp, Mus musculus
tcctcagccatatagtttcactgtt

SEQ ID NO: 776758 - DNA, 25 bp, Mus musculus
tcctcagcctcacagggcgacgagg

SEQ ID NO: 776759 - DNA, 25 bp, Mus musculus
tcctcagcctcagagggcgacgagg

SEQ ID NO: 776760 - DNA, 25 bp, Mus musculus
tcctcagcctccagttgttattggt

SEQ ID NO: 776761 - DNA, 25 bp, Mus musculus
tcctcagcctcctgttgttattggt

SEQ ID NO: 776762 - DNA, 25 bp, Mus musculus
tcctcagcggctaccggacggctgg

SEQ ID NO: 776763 - DNA, 25 bp, Mus musculus
tcctcagcggcttccggacggctgg

SEQ ID NO: 776764 - DNA, 25 bp, Mus musculus
tcctcagctgcaaaacggtctggac

SEQ ID NO: 776765 - DNA, 25 bp, Mus musculus
tcctcagctgcataacggtctggac

SEQ ID NO: 776766 - DNA, 25 bp, Mus musculus
tcctcagctgggaacgcctctgtat

SEQ ID NO: 776767 - DNA, 25 bp, Mus musculus
tcctcagctgggtacgcctctgtat

SEQ ID NO: 776768 - DNA, 25 bp, Mus musculus
tcctcaggaggcatgaatgctgcca

SEQ ID NO: 776769 - DNA, 25 bp, Mus musculus
tcctcaggaggcttgaatgctgcca

SEQ ID NO: 776770 - DNA, 25 bp, Mus musculus
tcctcaggcgagatagctgtcatca

SEQ ID NO: 776771 - DNA, 25 bp, Mus musculus
tcctcaggcgagttagctgtcatca

SEQ ID NO: 776772 - DNA, 25 bp, Mus musculus
tcctcaggctatcattacctgcgtt

SEQ ID NO: 776773 - DNA, 25 bp, Mus musculus
tcctcaggctatgattacctgcgtt

SEQ ID NO: 776774 - DNA, 25 bp, Mus musculus
tcctcagggtgacaggccggcttcc

SEQ ID NO: 776775 - DNA, 25 bp, Mus musculus
tcctcagggtgagaggccggcttcc

SEQ ID NO: 776776 - DNA, 25 bp, Mus musculus
tcctcagtcgagaaaaggctggtgg

SEQ ID NO: 776777 - DNA, 25 bp, Mus musculus
tcctcagtcgagtaaaggctggtgg

SEQ ID NO: 776778 - DNA, 25 bp, Mus musculus
tcctcagtgaacagaaagtattaga

SEQ ID NO: 776779 - DNA, 25 bp, Mus musculus
tcctcagtgaactgaaagtattaga

SEQ ID NO: 776780 - DNA, 25 bp, Mus musculus
tcctcagtggacacagccttttcct

SEQ ID NO: 776781 - DNA, 25 bp, Mus musculus
tcctcagtggactcagccttttcct

SEQ ID NO: 776782 - DNA, 25 bp, Mus musculus
tcctcagtgttccacaagcttcagg

SEQ ID NO: 776783 - DNA, 25 bp, Mus musculus
tcctcagtgttcgacaagcttcagg

SEQ ID NO: 776784 - DNA, 25 bp, Mus musculus
tcctcagttcagagccacatttcag

SEQ ID NO: 776785 - DNA, 25 bp, Mus musculus
tcctcagttcagtgccacatttcag

SEQ ID NO: 776786 - DNA, 25 bp, Mus musculus
tcctcagttctcataaatcacagcc

SEQ ID NO: 776787 - DNA, 25 bp, Mus musculus
tcctcagttctcttaaatcacagcc

SEQ ID NO: 776788 - DNA, 25 bp, Mus musculus
tcctcagtttaccaacagattgcag

SEQ ID NO: 776789 - DNA, 25 bp, Mus musculus
tcctcagtttacgaacagattgcag

SEQ ID NO: 776790 - DNA, 25 bp, Mus musculus
tcctcataaaataggccgggtcata

SEQ ID NO: 776791 - DNA, 25 bp, Mus musculus
tcctcataaaattggccgggtcata

SEQ ID NO: 776792 - DNA, 25 bp, Mus musculus
tcctcataaccgctgggcgtcaggc

SEQ ID NO: 776793 - DNA, 25 bp, Mus musculus
tcctcataaccggtgggcgtcaggc

SEQ ID NO: 776794 - DNA, 25 bp, Mus musculus
tcctcatagacaccatgctatgctt

SEQ ID NO: 776795 - DNA, 25 bp, Mus musculus
tcctcatagacagcatgctatgctt

SEQ ID NO: 776796 - DNA, 25 bp, Mus musculus
tcctcatagaggaacgcatcaccag

SEQ ID NO: 776797 - DNA, 25 bp, Mus musculus
tcctcatagaggtacgcatcaccag

SEQ ID NO: 776798 - DNA, 25 bp, Mus musculus
tcctcatagtctccgtcctggtggt

SEQ ID NO: 776799 - DNA, 25 bp, Mus musculus
tcctcatagtctgcgtcctggtggt

SEQ ID NO: 776800 - DNA, 25 bp, Mus musculus
tcctcatcacaaagggcagagaagt

SEQ ID NO: 776801 - DNA, 25 bp, Mus musculus
tcctcatcacaatgggcagagaagt

SEQ ID NO: 776802 - DNA, 25 bp, Mus musculus
tcctcatcagagatcctgagataca

SEQ ID NO: 776803 - DNA, 25 bp, Mus musculus
tcctcatcagagttcctgagataca

SEQ ID NO: 776804 - DNA, 25 bp, Mus musculus
tcctcatcatagagggcatctgcct

SEQ ID NO: 776805 - DNA, 25 bp, Mus musculus
tcctcatcatagtgggcatctgcct

SEQ ID NO: 776806 - DNA, 25 bp, Mus musculus
tcctcatccggaccgcggcgatgga

SEQ ID NO: 776807 - DNA, 25 bp, Mus musculus
tcctcatccggagcgcggcgatgga

SEQ ID NO: 776808 - DNA, 25 bp, Mus musculus
tcctcatcgcacaggtgaccgtagg

SEQ ID NO: 776809 - DNA, 25 bp, Mus musculus
tcctcatcgcactggtgaccgtagg

SEQ ID NO: 776810 - DNA, 25 bp, Mus musculus
tcctcatcgcggaggcaggactggt

SEQ ID NO: 776811 - DNA, 25 bp, Mus musculus
tcctcatcgcggtggcaggactggt

SEQ ID NO: 776812 - DNA, 25 bp, Mus musculus
tcctcatcgtggaggcgatgctctg

SEQ ID NO: 776813 - DNA, 25 bp, Mus musculus
tcctcatcgtggtggcgatgctctg

SEQ ID NO: 776814 - DNA, 25 bp, Mus musculus
tcctcatctacgagatggctgctgg

SEQ ID NO: 776815 - DNA, 25 bp, Mus musculus
tcctcatctacgtgatggctgctgg

SEQ ID NO: 776816 - DNA, 25 bp, Mus musculus
tcctcatcttttacagctctaggaa

SEQ ID NO: 776817 - DNA, 25 bp, Mus musculus
tcctcatctttttcagctctaggaa

SEQ ID NO: 776818 - DNA, 25 bp, Mus musculus
tcctcatgatccagatatgtgccat

SEQ ID NO: 776819 - DNA, 25 bp, Mus musculus
tcctcatgatcctgatatgtgccat

SEQ ID NO: 776820 - DNA, 25 bp, Mus musculus
tcctcatgcacacattcaacaggga

SEQ ID NO: 776821 - DNA, 25 bp, Mus musculus
tcctcatgcacagattcaacaggga

SEQ ID NO: 776822 - DNA, 25 bp, Mus musculus
tcctcatgctgcagacacaggcagg

SEQ ID NO: 776823 - DNA, 25 bp, Mus musculus
tcctcatgctgctgacacaggcagg

SEQ ID NO: 776824 - DNA, 25 bp, Mus musculus
tcctcatgggcgatccaccttttac

SEQ ID NO: 776825 - DNA, 25 bp, Mus musculus
tcctcatgggcgttccaccttttac

SEQ ID NO: 776826 - DNA, 25 bp, Mus musculus
tcctcatgggttatagtgacagtgg

SEQ ID NO: 776827 - DNA, 25 bp, Mus musculus
tcctcatgggttttagtgacagtgg

SEQ ID NO: 776828 - DNA, 25 bp, Mus musculus
tcctcatgtgctacatgttcgtcaa

SEQ ID NO: 776829 - DNA, 25 bp, Mus musculus
tcctcatgtgcttcatgttcgtcaa

SEQ ID NO: 776830 - DNA, 25 bp, Mus musculus
tcctcatgtgttactccattgacag

SEQ ID NO: 776831 - DNA, 25 bp, Mus musculus
tcctcatgtgtttctccattgacag

SEQ ID NO: 776832 - DNA, 25 bp, Mus musculus
tcctcattagggacagcgagtcctc

SEQ ID NO: 776833 - DNA, 25 bp, Mus musculus
tcctcattagggtcagcgagtcctc

SEQ ID NO: 776834 - DNA, 25 bp, Mus musculus
tcctcattaggtacactgcttcaga

SEQ ID NO: 776835 - DNA, 25 bp, Mus musculus
tcctcattaggttcactgcttcaga

SEQ ID NO: 776836 - DNA, 25 bp, Mus musculus
tcctcattctagagtgtgcttggca

SEQ ID NO: 776837 - DNA, 25 bp, Mus musculus
tcctcattctagtgtgtgcttggca

SEQ ID NO: 776838 - DNA, 25 bp, Mus musculus
tcctcattcttgcacatgagatgta

SEQ ID NO: 776839 - DNA, 25 bp, Mus musculus
tcctcattcttggacatgagatgta

SEQ ID NO: 776840 - DNA, 25 bp, Mus musculus
tcctcattgtctacatggagaaagc

SEQ ID NO: 776841 - DNA, 25 bp, Mus musculus
tcctcattgtcttcatggagaaagc

SEQ ID NO: 776842 - DNA, 25 bp, Mus musculus
tcctcattgtggcaccacagaagac

SEQ ID NO: 776843 - DNA, 25 bp, Mus musculus
tcctcattgtgggaccacagaagac

SEQ ID NO: 776844 - DNA, 25 bp, Mus musculus
tcctcatttcccacaaggatggcta

SEQ ID NO: 776845 - DNA, 25 bp, Mus musculus
tcctcatttccctcaaggatggcta

SEQ ID NO: 776846 - DNA, 25 bp, Mus musculus
tcctccaaaagactatggaacgggt

SEQ ID NO: 776847 - DNA, 25 bp, Mus musculus
tcctccaaaagagtatggaacgggt

SEQ ID NO: 776848 - DNA, 25 bp, Mus musculus
tcctccaaaccaagctgggtatgga

SEQ ID NO: 776849 - DNA, 25 bp, Mus musculus
tcctccaaaccatgctgggtatgga

SEQ ID NO: 776850 - DNA, 25 bp, Mus musculus
tcctccaactggcaatgctaaaacg

SEQ ID NO: 776851 - DNA, 25 bp, Mus musculus
tcctccaactgggaatgctaaaacg

SEQ ID NO: 776852 - DNA, 25 bp, Mus musculus
tcctccaagaccaggttgaccatgt

SEQ ID NO: 776853 - DNA, 25 bp, Mus musculus
tcctccaagacctggttgaccatgt

SEQ ID NO: 776854 - DNA, 25 bp, Mus musculus
tcctccaattccaatgccatcaaga

SEQ ID NO: 776855 - DNA, 25 bp, Mus musculus
tcctccaattcctatgccatcaaga

SEQ ID NO: 776856 - DNA, 25 bp, Mus musculus
tcctccacagggaccaagcttctga

SEQ ID NO: 776857 - DNA, 25 bp, Mus musculus
tcctccacagggtccaagcttctga

SEQ ID NO: 776858 - DNA, 25 bp, Mus musculus
tcctccaccaggaaacaaccggatt

SEQ ID NO: 776859 - DNA, 25 bp, Mus musculus
tcctccaccaggtaacaaccggatt

SEQ ID NO: 776860 - DNA, 25 bp, Mus musculus
tcctccacgaaaagcgagttatatt

SEQ ID NO: 776861 - DNA, 25 bp, Mus musculus
tcctccacgaaatgcgagttatatt

SEQ ID NO: 776862 - DNA, 25 bp, Mus musculus
tcctccacggcaaagaagacatcaa

SEQ ID NO: 776863 - DNA, 25 bp, Mus musculus
tcctccacggcatagaagacatcaa

SEQ ID NO: 776864 - DNA, 25 bp, Mus musculus
tcctccacgtcactcttgagatgtc

SEQ ID NO: 776865 - DNA, 25 bp, Mus musculus
tcctccacgtcagtcttgagatgtc

SEQ ID NO: 776866 - DNA, 25 bp, Mus musculus
tcctccagaggaacgctgtcactgt

SEQ ID NO: 776867 - DNA, 25 bp, Mus musculus
tcctccagaggatcgctgtcactgt

SEQ ID NO: 776868 - DNA, 25 bp, Mus musculus
tcctccagagttaactgccatgact

SEQ ID NO: 776869 - DNA, 25 bp, Mus musculus
tcctccagagtttactgccatgact

SEQ ID NO: 776870 - DNA, 25 bp, Mus musculus
tcctccagcagtcctggtcctgtgg

SEQ ID NO: 776871 - DNA, 25 bp, Mus musculus
tcctccagcagtgctggtcctgtgg

SEQ ID NO: 776872 - DNA, 25 bp, Mus musculus
tcctccagcatcagatgcttgtgct

SEQ ID NO: 776873 - DNA, 25 bp, Mus musculus
tcctccagcatctgatgcttgtgct

SEQ ID NO: 776874 - DNA, 25 bp, Mus musculus
tcctccagctggacattgtgtggtg

SEQ ID NO: 776875 - DNA, 25 bp, Mus musculus
tcctccagctggacttcctagagat

SEQ ID NO: 776876 - DNA, 25 bp, Mus musculus
tcctccagctggtcattgtgtggtg

SEQ ID NO: 776877 - DNA, 25 bp, Mus musculus
tcctccagctggtcttcctagagat

SEQ ID NO: 776878 - DNA, 25 bp, Mus musculus
tcctccaggaagaggtcctaagggt

SEQ ID NO: 776879 - DNA, 25 bp, Mus musculus
tcctccaggaagtggtcctaagggt

SEQ ID NO: 776880 - DNA, 25 bp, Mus musculus
tcctccaggctgcagcggataaaga

SEQ ID NO: 776881 - DNA, 25 bp, Mus musculus
tcctccaggctggagcggataaaga

SEQ ID NO: 776882 - DNA, 25 bp, Mus musculus
tcctccaggttaaaatcccgaggga

SEQ ID NO: 776883 - DNA, 25 bp, Mus musculus
tcctccaggttataatcccgaggga

SEQ ID NO: 776884 - DNA, 25 bp, Mus musculus
tcctccagtgcacaaagtacagata

SEQ ID NO: 776885 - DNA, 25 bp, Mus musculus
tcctccagtgcagaaagtacagata

SEQ ID NO: 776886 - DNA, 25 bp, Mus musculus
tcctccagtgtccaagaggacttgg

SEQ ID NO: 776887 - DNA, 25 bp, Mus musculus
tcctccagtgtcgaagaggacttgg

SEQ ID NO: 776888 - DNA, 25 bp, Mus musculus
tcctccataggaacctcatccttgg

SEQ ID NO: 776889 - DNA, 25 bp, Mus musculus
tcctccataggatcctcatccttgg

SEQ ID NO: 776890 - DNA, 25 bp, Mus musculus
tcctccatgataacaagttgacaca

SEQ ID NO: 776891 - DNA, 25 bp, Mus musculus
tcctccatgatatcaagttgacaca

SEQ ID NO: 776892 - DNA, 25 bp, Mus musculus
tcctccatgctgagtatccccttgg

SEQ ID NO: 776893 - DNA, 25 bp, Mus musculus
tcctccatgctgtgtatccccttgg

SEQ ID NO: 776894 - DNA, 25 bp, Mus musculus
tcctccatggtgcaactgtgcagag

SEQ ID NO: 776895 - DNA, 25 bp, Mus musculus
tcctccatggtggaactgtgcagag

SEQ ID NO: 776896 - DNA, 25 bp, Mus musculus
tcctccatgtccacggcttggacat

SEQ ID NO: 776897 - DNA, 25 bp, Mus musculus
tcctccatgtcctcggcttggacat

SEQ ID NO: 776898 - DNA, 25 bp, Mus musculus
tcctccattgtgctatctggaaccc

SEQ ID NO: 776899 - DNA, 25 bp, Mus musculus
tcctccattgtggtatctggaaccc

SEQ ID NO: 776900 - DNA, 25 bp, Mus musculus
tcctccatttccaggtagatgtatg

SEQ ID NO: 776901 - DNA, 25 bp, Mus musculus
tcctccatttcctggtagatgtatg

SEQ ID NO: 776902 - DNA, 25 bp, Mus musculus
tcctcccaactccttttatagagcg

SEQ ID NO: 776903 - DNA, 25 bp, Mus musculus
tcctcccaactcgttttatagagcg

SEQ ID NO: 776904 - DNA, 25 bp, Mus musculus
tcctcccacgagatggacgatagca

SEQ ID NO: 776905 - DNA, 25 bp, Mus musculus
tcctcccacgagttggacgatagca

SEQ ID NO: 776906 - DNA, 25 bp, Mus musculus
tcctcccacttgcaaggtgcgatcg

SEQ ID NO: 776907 - DNA, 25 bp, Mus musculus
tcctcccacttggaaggtgcgatcg

SEQ ID NO: 776908 - DNA, 25 bp, Mus musculus
tcctcccaggatacatagacttcat

SEQ ID NO: 776909 - DNA, 25 bp, Mus musculus
tcctcccaggatagaagtagcctct

SEQ ID NO: 776910 - DNA, 25 bp, Mus musculus
tcctcccaggatctcacgaaggatg

SEQ ID NO: 776911 - DNA, 25 bp, Mus musculus
tcctcccaggatgtcacgaaggatg

SEQ ID NO: 776912 - DNA, 25 bp, Mus musculus
tcctcccaggattcatagacttcat

SEQ ID NO: 776913 - DNA, 25 bp, Mus musculus
tcctcccaggattgaagtagcctct

SEQ ID NO: 776914 - DNA, 25 bp, Mus musculus
tcctcccaggtgaccagatggtggc

SEQ ID NO: 776915 - DNA, 25 bp, Mus musculus
tcctcccaggtgtccagatggtggc

SEQ ID NO: 776916 - DNA, 25 bp, Mus musculus
tcctcccattcacaggagatactct

SEQ ID NO: 776917 - DNA, 25 bp, Mus musculus
tcctcccattcagaggagatactct

SEQ ID NO: 776918 - DNA, 25 bp, Mus musculus
tcctccccacagatgggccagtatg

SEQ ID NO: 776919 - DNA, 25 bp, Mus musculus
tcctccccacagttgggccagtatg

SEQ ID NO: 776920 - DNA, 25 bp, Mus musculus
tcctccccgtggagaagcacttgca

SEQ ID NO: 776921 - DNA, 25 bp, Mus musculus
tcctccccgtggtgaagcacttgca

SEQ ID NO: 776922 - DNA, 25 bp, Mus musculus
tcctcccggcagaggccaagtcaag

SEQ ID NO: 776923 - DNA, 25 bp, Mus musculus
tcctcccggcagtggccaagtcaag

SEQ ID NO: 776924 - DNA, 25 bp, Mus musculus
tcctcccggctccatgatgagctat

SEQ ID NO: 776925 - DNA, 25 bp, Mus musculus
tcctcccggctcgatgatgagctat

SEQ ID NO: 776926 - DNA, 25 bp, Mus musculus
tcctccctagggacctagagaacac

SEQ ID NO: 776927 - DNA, 25 bp, Mus musculus
tcctccctagggtcctagagaacac

SEQ ID NO: 776928 - DNA, 25 bp, Mus musculus
tcctccctcatcagagaaggcagag

SEQ ID NO: 776929 - DNA, 25 bp, Mus musculus
tcctccctcatctgagaaggcagag

SEQ ID NO: 776930 - DNA, 25 bp, Mus musculus
tcctccctgagactcttaaggcatg

SEQ ID NO: 776931 - DNA, 25 bp, Mus musculus
tcctccctgagagtcttaaggcatg

SEQ ID NO: 776932 - DNA, 25 bp, Mus musculus
tcctccctgcagacggttctatgac

SEQ ID NO: 776933 - DNA, 25 bp, Mus musculus
tcctccctgcagtcggttctatgac

SEQ ID NO: 776934 - DNA, 25 bp, Mus musculus
tcctccctgctcctgagaggcagtg

SEQ ID NO: 776935 - DNA, 25 bp, Mus musculus
tcctccctgctcgtgagaggcagtg

SEQ ID NO: 776936 - DNA, 25 bp, Mus musculus
tcctccctgttaaggttgctgggcg

SEQ ID NO: 776937 - DNA, 25 bp, Mus musculus
tcctccctgttatggttgctgggcg

SEQ ID NO: 776938 - DNA, 25 bp, Mus musculus
tcctcccttaagctagcatgtctga

SEQ ID NO: 776939 - DNA, 25 bp, Mus musculus
tcctcccttaaggtagcatgtctga

SEQ ID NO: 776940 - DNA, 25 bp, Mus musculus
tcctccctttgaagtgcgtggtgcc

SEQ ID NO: 776941 - DNA, 25 bp, Mus musculus
tcctccctttgatgtgcgtggtgcc

SEQ ID NO: 776942 - DNA, 25 bp, Mus musculus
tcctccgagaaccaggtagaatgct

SEQ ID NO: 776943 - DNA, 25 bp, Mus musculus
tcctccgagaacgaggtagaatgct

SEQ ID NO: 776944 - DNA, 25 bp, Mus musculus
tcctccgagtacatttttgaacggg

SEQ ID NO: 776945 - DNA, 25 bp, Mus musculus
tcctccgagtacttttttgaacggg

SEQ ID NO: 776946 - DNA, 25 bp, Mus musculus
tcctccgcagtgctttcggctgcga

SEQ ID NO: 776947 - DNA, 25 bp, Mus musculus
tcctccgcagtggtttcggctgcga

SEQ ID NO: 776948 - DNA, 25 bp, Mus musculus
tcctccgcctctatgcagatggaaa

SEQ ID NO: 776949 - DNA, 25 bp, Mus musculus
tcctccgcctctttgcagatggaaa

SEQ ID NO: 776950 - DNA, 25 bp, Mus musculus
tcctccgcctgcatcatagtgacta

SEQ ID NO: 776951 - DNA, 25 bp, Mus musculus
tcctccgcctgcttcatagtgacta

SEQ ID NO: 776952 - DNA, 25 bp, Mus musculus
tcctccgctcgtcagggaggctcga

SEQ ID NO: 776953 - DNA, 25 bp, Mus musculus
tcctccgctcgtgagggaggctcga

SEQ ID NO: 776954 - DNA, 25 bp, Mus musculus
tcctccgcttgcaaatgtcacaaac

SEQ ID NO: 776955 - DNA, 25 bp, Mus musculus
tcctccgcttgctaatgtcacaaac

SEQ ID NO: 776956 - DNA, 25 bp, Mus musculus
tcctccggaactaatcataccaagt

SEQ ID NO: 776957 - DNA, 25 bp, Mus musculus
tcctccggaacttatcataccaagt

SEQ ID NO: 776958 - DNA, 25 bp, Mus musculus
tcctccggctggaagatgcactcat

SEQ ID NO: 776959 - DNA, 25 bp, Mus musculus
tcctccggctggtagatgcactcat

SEQ ID NO: 776960 - DNA, 25 bp, Mus musculus
tcctccgggaagatctagcccagcg

SEQ ID NO: 776961 - DNA, 25 bp, Mus musculus
tcctccgggaagttctagcccagcg

SEQ ID NO: 776962 - DNA, 25 bp, Mus musculus
tcctccgggaggagtctgctgtcta

SEQ ID NO: 776963 - DNA, 25 bp, Mus musculus
tcctccgggaggtgtctgctgtcta

SEQ ID NO: 776964 - DNA, 25 bp, Mus musculus
tcctccgggtatcacagccgttctg

SEQ ID NO: 776965 - DNA, 25 bp, Mus musculus
tcctccgggtatgacagccgttctg

SEQ ID NO: 776966 - DNA, 25 bp, Mus musculus
tcctccgggtgcacattggaaccat

SEQ ID NO: 776967 - DNA, 25 bp, Mus musculus
tcctccgggtgctcattggaaccat

SEQ ID NO: 776968 - DNA, 25 bp, Mus musculus
tcctccgtgctcaggccaggaaggg

SEQ ID NO: 776969 - DNA, 25 bp, Mus musculus
tcctccgtgctctggccaggaaggg

SEQ ID NO: 776970 - DNA, 25 bp, Mus musculus
tcctcctaagaacagagcacggtgt

SEQ ID NO: 776971 - DNA, 25 bp, Mus musculus
tcctcctaagaagagagcacggtgt

SEQ ID NO: 776972 - DNA, 25 bp, Mus musculus
tcctcctagagcagtcgctttttcc

SEQ ID NO: 776973 - DNA, 25 bp, Mus musculus
tcctcctagagctgtcgctttttcc

SEQ ID NO: 776974 - DNA, 25 bp, Mus musculus
tcctcctaggctacgtggcctttcg

SEQ ID NO: 776975 - DNA, 25 bp, Mus musculus
tcctcctaggcttcgtggcctttcg

SEQ ID NO: 776976 - DNA, 25 bp, Mus musculus
tcctcctagttccacctatgaggag

SEQ ID NO: 776977 - DNA, 25 bp, Mus musculus
tcctcctagttcgacctatgaggag

SEQ ID NO: 776978 - DNA, 25 bp, Mus musculus
tcctcctattgacagagcacagggt

SEQ ID NO: 776979 - DNA, 25 bp, Mus musculus
tcctcctattgagagagcacagggt

SEQ ID NO: 776980 - DNA, 25 bp, Mus musculus
tcctcctattgtctcttgggccaag

SEQ ID NO: 776981 - DNA, 25 bp, Mus musculus
tcctcctattgtgtcttgggccaag

SEQ ID NO: 776982 - DNA, 25 bp, Mus musculus
tcctcctcaagaacgatggcacctt

SEQ ID NO: 776983 - DNA, 25 bp, Mus musculus
tcctcctcaagatcgatggcacctt

SEQ ID NO: 776984 - DNA, 25 bp, Mus musculus
tcctcctcagcaacgtatacttcta

SEQ ID NO: 776985 - DNA, 25 bp, Mus musculus
tcctcctcagcatcgtatacttcta

SEQ ID NO: 776986 - DNA, 25 bp, Mus musculus
tcctcctcggagcagaaagagacgg

SEQ ID NO: 776987 - DNA, 25 bp, Mus musculus
tcctcctcggaggagaaagagacgg

SEQ ID NO: 776988 - DNA, 25 bp, Mus musculus
tcctcctctacgatctggctttaca

SEQ ID NO: 776989 - DNA, 25 bp, Mus musculus
tcctcctctacgttctggctttaca

SEQ ID NO: 776990 - DNA, 25 bp, Mus musculus
tcctcctctcggaaggaaacctttg

SEQ ID NO: 776991 - DNA, 25 bp, Mus musculus
tcctcctctcggtaggaaacctttg

SEQ ID NO: 776992 - DNA, 25 bp, Mus musculus
tcctcctgaacaacgagcttctaga

SEQ ID NO: 776993 - DNA, 25 bp, Mus musculus
tcctcctgaacatcgagcttctaga

SEQ ID NO: 776994 - DNA, 25 bp, Mus musculus
tcctcctgaactcagaattacctga

SEQ ID NO: 776995 - DNA, 25 bp, Mus musculus
tcctcctgaactgagaattacctga

SEQ ID NO: 776996 - DNA, 25 bp, Mus musculus
tcctcctgaagaacaggatggctct

SEQ ID NO: 776997 - DNA, 25 bp, Mus musculus
tcctcctgaagatcaggatggctct

SEQ ID NO: 776998 - DNA, 25 bp, Mus musculus
tcctcctgaaggaaggttttgcccg

SEQ ID NO: 776999 - DNA, 25 bp, Mus musculus
tcctcctgaaggaagtcgagccgtg

SEQ ID NO: 777000 - DNA, 25 bp, Mus musculus
tcctcctgaaggtaggttttgcccg

SEQ ID NO: 777001 - DNA, 25 bp, Mus musculus
tcctcctgaaggtagtcgagccgtg

SEQ ID NO: 777002 - DNA, 25 bp, Mus musculus
tcctcctgcgaaagaaagctctagg

SEQ ID NO: 777003 - DNA, 25 bp, Mus musculus
tcctcctgcgaatgaaagctctagg

SEQ ID NO: 777004 - DNA, 25 bp, Mus musculus
tcctcctgggagacttgagccaaag

SEQ ID NO: 777005 - DNA, 25 bp, Mus musculus
tcctcctgggagtcttgagccaaag

SEQ ID NO: 777006 - DNA, 25 bp, Mus musculus
tcctcctgggcaaggatccctcagg

SEQ ID NO: 777007 - DNA, 25 bp, Mus musculus
tcctcctgggcatggatccctcagg

SEQ ID NO: 777008 - DNA, 25 bp, Mus musculus
tcctcctgggctagaacttctatgg

SEQ ID NO: 777009 - DNA, 25 bp, Mus musculus
tcctcctgggcttgaacttctatgg

SEQ ID NO: 777010 - DNA, 25 bp, Mus musculus
tcctcctgggtgacatcgcagtctg

SEQ ID NO: 777011 - DNA, 25 bp, Mus musculus
tcctcctgggtgtcatcgcagtctg

SEQ ID NO: 777012 - DNA, 25 bp, Mus musculus
tcctcctgttaaaattgtcagcagc

SEQ ID NO: 777013 - DNA, 25 bp, Mus musculus
tcctcctgttaatattgtcagcagc

SEQ ID NO: 777014 - DNA, 25 bp, Mus musculus
tcctcctgttttccgcccggagtgg

SEQ ID NO: 777015 - DNA, 25 bp, Mus musculus
tcctcctgttttgcgcccggagtgg

SEQ ID NO: 777016 - DNA, 25 bp, Mus musculus
tcctccttcacaacaggttccatgt

SEQ ID NO: 777017 - DNA, 25 bp, Mus musculus
tcctccttcacatcaggttccatgt

SEQ ID NO: 777018 - DNA, 25 bp, Mus musculus
tcctccttctgaatgtctttgccat

SEQ ID NO: 777019 - DNA, 25 bp, Mus musculus
tcctccttctgacgccaggaactgg

SEQ ID NO: 777020 - DNA, 25 bp, Mus musculus
tcctccttctgaggccaggaactgg

SEQ ID NO: 777021 - DNA, 25 bp, Mus musculus
tcctccttctgattgtctttgccat

SEQ ID NO: 777022 - DNA, 25 bp, Mus musculus
tcctccttgagcagcatactatact

SEQ ID NO: 777023 - DNA, 25 bp, Mus musculus
tcctccttgagctgcatactatact

SEQ ID NO: 777024 - DNA, 25 bp, Mus musculus
tcctccttgcagctgggaatcctag

SEQ ID NO: 777025 - DNA, 25 bp, Mus musculus
tcctccttgcaggtgggaatcctag

SEQ ID NO: 777026 - DNA, 25 bp, Mus musculus
tcctccttgtcgagaccctgattgg

SEQ ID NO: 777027 - DNA, 25 bp, Mus musculus
tcctccttgtcgtgaccctgattgg

SEQ ID NO: 777028 - DNA, 25 bp, Mus musculus
tcctcctttggcagcatcccttgtg

SEQ ID NO: 777029 - DNA, 25 bp, Mus musculus
tcctcctttggcatgtattgcatgt

SEQ ID NO: 777030 - DNA, 25 bp, Mus musculus
tcctcctttggctgcatcccttgtg

SEQ ID NO: 777031 - DNA, 25 bp, Mus musculus
tcctcctttggcttgtattgcatgt

SEQ ID NO: 777032 - DNA, 25 bp, Mus musculus
tcctcctttgtgattctggacagga

SEQ ID NO: 777033 - DNA, 25 bp, Mus musculus
tcctcctttgtgtttctggacagga

SEQ ID NO: 777034 - DNA, 25 bp, Mus musculus
tcctccttttccagaacttcgagca

SEQ ID NO: 777035 - DNA, 25 bp, Mus musculus
tcctccttttcctgaacttcgagca

SEQ ID NO: 777036 - DNA, 25 bp, Mus musculus
tcctccttttgtatggcagctcttt

SEQ ID NO: 777037 - DNA, 25 bp, Mus musculus
tcctccttttgtttggcagctcttt

SEQ ID NO: 777038 - DNA, 25 bp, Mus musculus
tcctcgaagagcagggcctataaag

SEQ ID NO: 777039 - DNA, 25 bp, Mus musculus
tcctcgaagagctgggcctataaag

SEQ ID NO: 777040 - DNA, 25 bp, Mus musculus
tcctcgaagcccaaaggactaggag

SEQ ID NO: 777041 - DNA, 25 bp, Mus musculus
tcctcgaagccctaaggactaggag

SEQ ID NO: 777042 - DNA, 25 bp, Mus musculus
tcctcgaaggatcacccccaagttt

SEQ ID NO: 777043 - DNA, 25 bp, Mus musculus
tcctcgaaggatgacccccaagttt

SEQ ID NO: 777044 - DNA, 25 bp, Mus musculus
tcctcgaatttcataaactgtttct

SEQ ID NO: 777045 - DNA, 25 bp, Mus musculus
tcctcgaatttcttaaactgtttct

SEQ ID NO: 777046 - DNA, 25 bp, Mus musculus
tcctcgacaaaaagagcaaagaagt

SEQ ID NO: 777047 - DNA, 25 bp, Mus musculus
tcctcgacaaaatgagcaaagaagt

SEQ ID NO: 777048 - DNA, 25 bp, Mus musculus
tcctcgacctgcagtatcctataag

SEQ ID NO: 777049 - DNA, 25 bp, Mus musculus
tcctcgacctgctgtatcctataag

SEQ ID NO: 777050 - DNA, 25 bp, Mus musculus
tcctcgagagctatggcacctggtc

SEQ ID NO: 777051 - DNA, 25 bp, Mus musculus
tcctcgagagctttggcacctggtc

SEQ ID NO: 777052 - DNA, 25 bp, Mus musculus
tcctcgagccaaatctgaccgggcg

SEQ ID NO: 777053 - DNA, 25 bp, Mus musculus
tcctcgagccaattctgaccgggcg

SEQ ID NO: 777054 - DNA, 25 bp, Mus musculus
tcctcgagctgaatgagagtgggaa

SEQ ID NO: 777055 - DNA, 25 bp, Mus musculus
tcctcgagctgattgagagtgggaa

SEQ ID NO: 777056 - DNA, 25 bp, Mus musculus
tcctcgaggtcacttgtgtcccagg

SEQ ID NO: 777057 - DNA, 25 bp, Mus musculus
tcctcgaggtcagttgtgtcccagg

SEQ ID NO: 777058 - DNA, 25 bp, Mus musculus
tcctcgagtgaactcaggacgcttc

SEQ ID NO: 777059 - DNA, 25 bp, Mus musculus
tcctcgagtgaagtcaggacgcttc

SEQ ID NO: 777060 - DNA, 25 bp, Mus musculus
tcctcgagtggtcatgtctacccac

SEQ ID NO: 777061 - DNA, 25 bp, Mus musculus
tcctcgagtggtgatgtctacccac

SEQ ID NO: 777062 - DNA, 25 bp, Mus musculus
tcctcgatctacagactacacttgg

SEQ ID NO: 777063 - DNA, 25 bp, Mus musculus
tcctcgatctactgactacacttgg

SEQ ID NO: 777064 - DNA, 25 bp, Mus musculus
tcctcgatgaccagaataaaaatat

SEQ ID NO: 777065 - DNA, 25 bp, Mus musculus
tcctcgatgacctgaataaaaatat

SEQ ID NO: 777066 - DNA, 25 bp, Mus musculus
tcctcgatgggaaggtggctgttct

SEQ ID NO: 777067 - DNA, 25 bp, Mus musculus
tcctcgatgggatggtggctgttct

SEQ ID NO: 777068 - DNA, 25 bp, Mus musculus
tcctcgcaggacaatggagacgagg

SEQ ID NO: 777069 - DNA, 25 bp, Mus musculus
tcctcgcaggactatggagacgagg

SEQ ID NO: 777070 - DNA, 25 bp, Mus musculus
tcctcgcatggcagggccagccagt

SEQ ID NO: 777071 - DNA, 25 bp, Mus musculus
tcctcgcatggctgggccagccagt

SEQ ID NO: 777072 - DNA, 25 bp, Mus musculus
tcctcgccttcgcaggcaacaagga

SEQ ID NO: 777073 - DNA, 25 bp, Mus musculus
tcctcgccttcggaggcaacaagga

SEQ ID NO: 777074 - DNA, 25 bp, Mus musculus
tcctcgcgacagcacaagtactcgg

SEQ ID NO: 777075 - DNA, 25 bp, Mus musculus
tcctcgcgacaggacaagtactcgg

SEQ ID NO: 777076 - DNA, 25 bp, Mus musculus
tcctcgctggaaaaagaagtgggca

SEQ ID NO: 777077 - DNA, 25 bp, Mus musculus
tcctcgctggaataagaagtgggca

SEQ ID NO: 777078 - DNA, 25 bp, Mus musculus
tcctcgctggacagctcagggtgcc

SEQ ID NO: 777079 - DNA, 25 bp, Mus musculus
tcctcgctggactgctcagggtgcc

SEQ ID NO: 777080 - DNA, 25 bp, Mus musculus
tcctcgctggctacaagtggcagga

SEQ ID NO: 777081 - DNA, 25 bp, Mus musculus
tcctcgctggcttcaagtggcagga

SEQ ID NO: 777082 - DNA, 25 bp, Mus musculus
tcctcgcttgcgacagtctcgggca

SEQ ID NO: 777083 - DNA, 25 bp, Mus musculus
tcctcgcttgcgtcagtctcgggca

SEQ ID NO: 777084 - DNA, 25 bp, Mus musculus
tcctcggaacctcactttagaagtg

SEQ ID NO: 777085 - DNA, 25 bp, Mus musculus
tcctcggaacctgactttagaagtg

SEQ ID NO: 777086 - DNA, 25 bp, Mus musculus
tcctcggaacggcaataacctcaga

SEQ ID NO: 777087 - DNA, 25 bp, Mus musculus
tcctcggaacgggaataacctcaga

SEQ ID NO: 777088 - DNA, 25 bp, Mus musculus
tcctcggaagcacaggttgagcctt

SEQ ID NO: 777089 - DNA, 25 bp, Mus musculus
tcctcggaagcagaggttgagcctt

SEQ ID NO: 777090 - DNA, 25 bp, Mus musculus
tcctcggactccacaaggtgctagg

SEQ ID NO: 777091 - DNA, 25 bp, Mus musculus
tcctcggactcctcaaggtgctagg

SEQ ID NO: 777092 - DNA, 25 bp, Mus musculus
tcctcggagatgagtgagtgaacca

SEQ ID NO: 777093 - DNA, 25 bp, Mus musculus
tcctcggagatgtgtgagtgaacca

SEQ ID NO: 777094 - DNA, 25 bp, Mus musculus
tcctcggagcaacgaaagggctgtt

SEQ ID NO: 777095 - DNA, 25 bp, Mus musculus
tcctcggagcaaggaaagggctgtt

SEQ ID NO: 777096 - DNA, 25 bp, Mus musculus
tcctcggaggagaaagagacggaca

SEQ ID NO: 777097 - DNA, 25 bp, Mus musculus
tcctcggaggagtaagagacggaca

SEQ ID NO: 777098 - DNA, 25 bp, Mus musculus
tcctcggagtatcccggcaatcgca

SEQ ID NO: 777099 - DNA, 25 bp, Mus musculus
tcctcggagtatgccggcaatcgca

SEQ ID NO: 777100 - DNA, 25 bp, Mus musculus
tcctcggagtttagagaattcgtct

SEQ ID NO: 777101 - DNA, 25 bp, Mus musculus
tcctcggagttttgagaattcgtct

SEQ ID NO: 777102 - DNA, 25 bp, Mus musculus
tcctcggatcttagcacctctgtat

SEQ ID NO: 777103 - DNA, 25 bp, Mus musculus
tcctcggatctttgcacctctgtat

SEQ ID NO: 777104 - DNA, 25 bp, Mus musculus
tcctcggatggcattttgtgccagt

SEQ ID NO: 777105 - DNA, 25 bp, Mus musculus
tcctcggatggctttttgtgccagt

SEQ ID NO: 777106 - DNA, 25 bp, Mus musculus
tcctcggcggcactgtcagcactat

SEQ ID NO: 777107 - DNA, 25 bp, Mus musculus
tcctcggcggcagtgtcagcactat

SEQ ID NO: 777108 - DNA, 25 bp, Mus musculus
tcctcggcgtgaccgacagcggcaa

SEQ ID NO: 777109 - DNA, 25 bp, Mus musculus
tcctcggcgtgagcgacagcggcaa

SEQ ID NO: 777110 - DNA, 25 bp, Mus musculus
tcctcggctcctaccgaaagaagag

SEQ ID NO: 777111 - DNA, 25 bp, Mus musculus
tcctcggctccttccgaaagaagag

SEQ ID NO: 777112 - DNA, 25 bp, Mus musculus
tcctcggctgggatgacaactactg

SEQ ID NO: 777113 - DNA, 25 bp, Mus musculus
tcctcggctgggttgacaactactg

SEQ ID NO: 777114 - DNA, 25 bp, Mus musculus
tcctcggcttgtatcccaaaagaca

SEQ ID NO: 777115 - DNA, 25 bp, Mus musculus
tcctcggcttgtttcccaaaagaca

SEQ ID NO: 777116 - DNA, 25 bp, Mus musculus
tcctcgggattacttggaaaaatat

SEQ ID NO: 777117 - DNA, 25 bp, Mus musculus
tcctcgggattagttggaaaaatat

SEQ ID NO: 777118 - DNA, 25 bp, Mus musculus
tcctcgggctttctcatcgcatgca

SEQ ID NO: 777119 - DNA, 25 bp, Mus musculus
tcctcgggctttgtcatcgcatgca

SEQ ID NO: 777120 - DNA, 25 bp, Mus musculus
tcctcgggtggaatacacagaggag

SEQ ID NO: 777121 - DNA, 25 bp, Mus musculus
tcctcgggtggattacacagaggag

SEQ ID NO: 777122 - DNA, 25 bp, Mus musculus
tcctcggtctgcacacggagctcta

SEQ ID NO: 777123 - DNA, 25 bp, Mus musculus
tcctcggtctgctcacggagctcta

SEQ ID NO: 777124 - DNA, 25 bp, Mus musculus
tcctcgtcaagaagggctatgagtt

SEQ ID NO: 777125 - DNA, 25 bp, Mus musculus
tcctcgtcaagatgggctatgagtt

SEQ ID NO: 777126 - DNA, 25 bp, Mus musculus
tcctcgtcctccaaaataatcagat

SEQ ID NO: 777127 - DNA, 25 bp, Mus musculus
tcctcgtcctcctaaataatcagat

SEQ ID NO: 777128 - DNA, 25 bp, Mus musculus
tcctcgtcctcgaccaaaaagatgg

SEQ ID NO: 777129 - DNA, 25 bp, Mus musculus
tcctcgtcctcgtccaaaaagatgg

SEQ ID NO: 777130 - DNA, 25 bp, Mus musculus
tcctcgtctgcaacgggctgggcat

SEQ ID NO: 777131 - DNA, 25 bp, Mus musculus
tcctcgtctgcatcgggctgggcat

SEQ ID NO: 777132 - DNA, 25 bp, Mus musculus
tcctcgtcttctctagaacgctggt

SEQ ID NO: 777133 - DNA, 25 bp, Mus musculus
tcctcgtcttctgtagaacgctggt

SEQ ID NO: 777134 - DNA, 25 bp, Mus musculus
tcctcgtgacaaacatctatggaga

SEQ ID NO: 777135 - DNA, 25 bp, Mus musculus
tcctcgtgacaatcatctatggaga

SEQ ID NO: 777136 - DNA, 25 bp, Mus musculus
tcctcgtgctctcgatgatgtcaga

SEQ ID NO: 777137 - DNA, 25 bp, Mus musculus
tcctcgtgctctggatgatgtcaga

SEQ ID NO: 777138 - DNA, 25 bp, Mus musculus
tcctcgtggaggaccacccactgtg

SEQ ID NO: 777139 - DNA, 25 bp, Mus musculus
tcctcgtggaggtccacccactgtg

SEQ ID NO: 777140 - DNA, 25 bp, Mus musculus
tcctcgtggcagagcaaaagctgct

SEQ ID NO: 777141 - DNA, 25 bp, Mus musculus
tcctcgtggcagtgcaaaagctgct

SEQ ID NO: 777142 - DNA, 25 bp, Mus musculus
tcctcgttgatactggtggaaccca

SEQ ID NO: 777143 - DNA, 25 bp, Mus musculus
tcctcgttgatagtggtggaaccca

SEQ ID NO: 777144 - DNA, 25 bp, Mus musculus
tcctcgtttgaacatgtagatgcgt

SEQ ID NO: 777145 - DNA, 25 bp, Mus musculus
tcctcgtttgaagatgtagatgcgt

SEQ ID NO: 777146 - DNA, 25 bp, Mus musculus
tcctctaaacagctgtgagtcctgc

SEQ ID NO: 777147 - DNA, 25 bp, Mus musculus
tcctctaaacaggtgtgagtcctgc

SEQ ID NO: 777148 - DNA, 25 bp, Mus musculus
tcctctaacagtcaaattgtgaaag

SEQ ID NO: 777149 - DNA, 25 bp, Mus musculus
tcctctaacagtgaaattgtgaaag

SEQ ID NO: 777150 - DNA, 25 bp, Mus musculus
tcctctaagaaccattcgaagagaa

SEQ ID NO: 777151 - DNA, 25 bp, Mus musculus
tcctctaagaacgattcgaagagaa

SEQ ID NO: 777152 - DNA, 25 bp, Mus musculus
tcctctaatgtcaccccggatggca

SEQ ID NO: 777153 - DNA, 25 bp, Mus musculus
tcctctaatgtctccccggatggca

SEQ ID NO: 777154 - DNA, 25 bp, Mus musculus
tcctctacccacaacgcggagtgtg

SEQ ID NO: 777155 - DNA, 25 bp, Mus musculus
tcctctacccactacgcggagtgtg

SEQ ID NO: 777156 - DNA, 25 bp, Mus musculus
tcctctacccagaaactgtctgctg

SEQ ID NO: 777157 - DNA, 25 bp, Mus musculus
tcctctacccagtaactgtctgctg

SEQ ID NO: 777158 - DNA, 25 bp, Mus musculus
tcctctacgtcactattagctacgt

SEQ ID NO: 777159 - DNA, 25 bp, Mus musculus
tcctctacgtcagtattagctacgt

SEQ ID NO: 777160 - DNA, 25 bp, Mus musculus
tcctctacttctcgcgatgcaggct

SEQ ID NO: 777161 - DNA, 25 bp, Mus musculus
tcctctacttctggcgatgcaggct

SEQ ID NO: 777162 - DNA, 25 bp, Mus musculus
tcctctactttgatgtcccaggaaa

SEQ ID NO: 777163 - DNA, 25 bp, Mus musculus
tcctctactttgttgtcccaggaaa

SEQ ID NO: 777164 - DNA, 25 bp, Mus musculus
tcctctaggccactagattaatgct

SEQ ID NO: 777165 - DNA, 25 bp, Mus musculus
tcctctaggccagtagattaatgct

SEQ ID NO: 777166 - DNA, 25 bp, Mus musculus
tcctctagggatcggctccttccag

SEQ ID NO: 777167 - DNA, 25 bp, Mus musculus
tcctctagggatgggctccttccag

SEQ ID NO: 777168 - DNA, 25 bp, Mus musculus
tcctctataattagcgtttcaccca

SEQ ID NO: 777169 - DNA, 25 bp, Mus musculus
tcctctataatttgcgtttcaccca

SEQ ID NO: 777170 - DNA, 25 bp, Mus musculus
tcctctatacacatctgccctgatg

SEQ ID NO: 777171 - DNA, 25 bp, Mus musculus
tcctctatacacttctgccctgatg

SEQ ID NO: 777172 - DNA, 25 bp, Mus musculus
tcctctatatgaaatggctgaacag

SEQ ID NO: 777173 - DNA, 25 bp, Mus musculus
tcctctatatgatatggctgaacag

SEQ ID NO: 777174 - DNA, 25 bp, Mus musculus
tcctctatgacgcatacactggctc

SEQ ID NO: 777175 - DNA, 25 bp, Mus musculus
tcctctatgacggatacactggctc

SEQ ID NO: 777176 - DNA, 25 bp, Mus musculus
tcctctatggagcaacgtctagctc

SEQ ID NO: 777177 - DNA, 25 bp, Mus musculus
tcctctatggaggaacgtctagctc

SEQ ID NO: 777178 - DNA, 25 bp, Mus musculus
tcctctattcttagcagactcagca

SEQ ID NO: 777179 - DNA, 25 bp, Mus musculus
tcctctattctttgcagactcagca

SEQ ID NO: 777180 - DNA, 25 bp, Mus musculus
tcctctcaatgtctgcagtcctagt

SEQ ID NO: 777181 - DNA, 25 bp, Mus musculus
tcctctcaatgtgtgcagtcctagt

SEQ ID NO: 777182 - DNA, 25 bp, Mus musculus
tcctctcacatgctgtggaaggtgg

SEQ ID NO: 777183 - DNA, 25 bp, Mus musculus
tcctctcacatggtgtggaaggtgg

SEQ ID NO: 777184 - DNA, 25 bp, Mus musculus
tcctctcagagcaaaatagacatgc

SEQ ID NO: 777185 - DNA, 25 bp, Mus musculus
tcctctcagagctaaatagacatgc

SEQ ID NO: 777186 - DNA, 25 bp, Mus musculus
tcctctcagattatgtgggctccgg

SEQ ID NO: 777187 - DNA, 25 bp, Mus musculus
tcctctcagattttgtgggctccgg

SEQ ID NO: 777188 - DNA, 25 bp, Mus musculus
tcctctcagtggcaagaaattcaag

SEQ ID NO: 777189 - DNA, 25 bp, Mus musculus
tcctctcagtgggaagaaattcaag

SEQ ID NO: 777190 - DNA, 25 bp, Mus musculus
tcctctccaagcctaagtgggatca

SEQ ID NO: 777191 - DNA, 25 bp, Mus musculus
tcctctccaagcgtaagtgggatca

SEQ ID NO: 777192 - DNA, 25 bp, Mus musculus
tcctctccagagctgttgcactttc

SEQ ID NO: 777193 - DNA, 25 bp, Mus musculus
tcctctccagaggtgttgcactttc

SEQ ID NO: 777194 - DNA, 25 bp, Mus musculus
tcctctccaggacttccggcttgat

SEQ ID NO: 777195 - DNA, 25 bp, Mus musculus
tcctctccaggagttccggcttgat

SEQ ID NO: 777196 - DNA, 25 bp, Mus musculus
tcctctcccttcagtcgggagtagc

SEQ ID NO: 777197 - DNA, 25 bp, Mus musculus
tcctctcccttctgtcgggagtagc

SEQ ID NO: 777198 - DNA, 25 bp, Mus musculus
tcctctccggctcaggccgggattt

SEQ ID NO: 777199 - DNA, 25 bp, Mus musculus
tcctctccggctgaggccgggattt

SEQ ID NO: 777200 - DNA, 25 bp, Mus musculus
tcctctcgctctccggagactggag

SEQ ID NO: 777201 - DNA, 25 bp, Mus musculus
tcctctcgctctgcggagactggag

SEQ ID NO: 777202 - DNA, 25 bp, Mus musculus
tcctctcggaagcaaacctttgata

SEQ ID NO: 777203 - DNA, 25 bp, Mus musculus
tcctctcggaaggaaacctttgata

SEQ ID NO: 777204 - DNA, 25 bp, Mus musculus
tcctctcggaatacagtgctgtggc

SEQ ID NO: 777205 - DNA, 25 bp, Mus musculus
tcctctcggaattcagtgctgtggc

SEQ ID NO: 777206 - DNA, 25 bp, Mus musculus
tcctctcggagtcaaaccgacctgg

SEQ ID NO: 777207 - DNA, 25 bp, Mus musculus
tcctctcggagtgaaaccgacctgg

SEQ ID NO: 777208 - DNA, 25 bp, Mus musculus
tcctctcggctacttcggaagcaca

SEQ ID NO: 777209 - DNA, 25 bp, Mus musculus
tcctctcggctagttcggaagcaca

SEQ ID NO: 777210 - DNA, 25 bp, Mus musculus
tcctctctacaaaagtgcgatcaca

SEQ ID NO: 777211 - DNA, 25 bp, Mus musculus
tcctctctacaatagtgcgatcaca

SEQ ID NO: 777212 - DNA, 25 bp, Mus musculus
tcctctctaggtccctgtataccag

SEQ ID NO: 777213 - DNA, 25 bp, Mus musculus
tcctctctaggtgcctgtataccag

SEQ ID NO: 777214 - DNA, 25 bp, Mus musculus
tcctctctccagctggagctgatca

SEQ ID NO: 777215 - DNA, 25 bp, Mus musculus
tcctctctccaggtggagctgatca

SEQ ID NO: 777216 - DNA, 25 bp, Mus musculus
tcctctctccccagatatctggatg

SEQ ID NO: 777217 - DNA, 25 bp, Mus musculus
tcctctctcccctgatatctggatg

SEQ ID NO: 777218 - DNA, 25 bp, Mus musculus
tcctctctttgacagaggacaaagg

SEQ ID NO: 777219 - DNA, 25 bp, Mus musculus
tcctctctttgagagaggacaaagg

SEQ ID NO: 777220 - DNA, 25 bp, Mus musculus
tcctctgaacaaactacaagaacaa

SEQ ID NO: 777221 - DNA, 25 bp, Mus musculus
tcctctgaacaatctacaagaacaa

SEQ ID NO: 777222 - DNA, 25 bp, Mus musculus
tcctctgacaagattctctggcata

SEQ ID NO: 777223 - DNA, 25 bp, Mus musculus
tcctctgacaagtttctctggcata

SEQ ID NO: 777224 - DNA, 25 bp, Mus musculus
tcctctgacagcaccatgggtgaca

SEQ ID NO: 777225 - DNA, 25 bp, Mus musculus
tcctctgacagctccatgggtgaca

SEQ ID NO: 777226 - DNA, 25 bp, Mus musculus
tcctctgacagtcacgagtcctatg

SEQ ID NO: 777227 - DNA, 25 bp, Mus musculus
tcctctgacagtgacgagtcctatg

SEQ ID NO: 777228 - DNA, 25 bp, Mus musculus
tcctctgaggtaataggctcctggc

SEQ ID NO: 777229 - DNA, 25 bp, Mus musculus
tcctctgaggtattaggctcctggc

SEQ ID NO: 777230 - DNA, 25 bp, Mus musculus
tcctctgagtggacagcctccagtg

SEQ ID NO: 777231 - DNA, 25 bp, Mus musculus
tcctctgagtggtcagcctccagtg

SEQ ID NO: 777232 - DNA, 25 bp, Mus musculus
tcctctgatctccactgggtgccgt

SEQ ID NO: 777233 - DNA, 25 bp, Mus musculus
tcctctgatctcgactgggtgccgt

SEQ ID NO: 777234 - DNA, 25 bp, Mus musculus
tcctctgatgaacgcagaagttagc

SEQ ID NO: 777235 - DNA, 25 bp, Mus musculus
tcctctgatgaaggcagaagttagc

SEQ ID NO: 777236 - DNA, 25 bp, Mus musculus
tcctctgcaagtcgcaacagcaatg

SEQ ID NO: 777237 - DNA, 25 bp, Mus musculus
tcctctgcaagtggcaacagcaatg

SEQ ID NO: 777238 - DNA, 25 bp, Mus musculus
tcctctgcagccaggtggccagagt

SEQ ID NO: 777239 - DNA, 25 bp, Mus musculus
tcctctgcagcctggtggccagagt

SEQ ID NO: 777240 - DNA, 25 bp, Mus musculus
tcctctgccaggaatactcggcgca

SEQ ID NO: 777241 - DNA, 25 bp, Mus musculus
tcctctgccaggtatactcggcgca

SEQ ID NO: 777242 - DNA, 25 bp, Mus musculus
tcctctgcggatcaggtgaacacct

SEQ ID NO: 777243 - DNA, 25 bp, Mus musculus
tcctctgcggatgaggtgaacacct

SEQ ID NO: 777244 - DNA, 25 bp, Mus musculus
tcctctgctaggcaagacaacccaa

SEQ ID NO: 777245 - DNA, 25 bp, Mus musculus
tcctctgctagggaagacaacccaa

SEQ ID NO: 777246 - DNA, 25 bp, Mus musculus
tcctctgctcggcatctcatgaagg

SEQ ID NO: 777247 - DNA, 25 bp, Mus musculus
tcctctgctcgggatctcatgaagg

SEQ ID NO: 777248 - DNA, 25 bp, Mus musculus
tcctctgctctactgggaagtggtg

SEQ ID NO: 777249 - DNA, 25 bp, Mus musculus
tcctctgctctagtgggaagtggtg

SEQ ID NO: 777250 - DNA, 25 bp, Mus musculus
tcctctgctgtgacaggtgccggca

SEQ ID NO: 777251 - DNA, 25 bp, Mus musculus
tcctctgctgtgtcaggtgccggca

SEQ ID NO: 777252 - DNA, 25 bp, Mus musculus
tcctctggaccgactcaaggtattc

SEQ ID NO: 777253 - DNA, 25 bp, Mus musculus
tcctctggaccgtctcaaggtattc

SEQ ID NO: 777254 - DNA, 25 bp, Mus musculus
tcctctggacttcacgcaagaagct

SEQ ID NO: 777255 - DNA, 25 bp, Mus musculus
tcctctggacttgacgcaagaagct

SEQ ID NO: 777256 - DNA, 25 bp, Mus musculus
tcctctggaggaaaagtagttagta

SEQ ID NO: 777257 - DNA, 25 bp, Mus musculus
tcctctggaggataagtagttagta

SEQ ID NO: 777258 - DNA, 25 bp, Mus musculus
tcctctggcaccaaccgatgtgtgg

SEQ ID NO: 777259 - DNA, 25 bp, Mus musculus
tcctctggcacctaccgatgtgtgg

SEQ ID NO: 777260 - DNA, 25 bp, Mus musculus
tcctctggcccgagtggttcacaag

SEQ ID NO: 777261 - DNA, 25 bp, Mus musculus
tcctctggcccgtgtggttcacaag

SEQ ID NO: 777262 - DNA, 25 bp, Mus musculus
tcctctgggaagcaggaaccctgag

SEQ ID NO: 777263 - DNA, 25 bp, Mus musculus
tcctctgggaaggaggaaccctgag

SEQ ID NO: 777264 - DNA, 25 bp, Mus musculus
tcctctgggatgagaagtacggcca

SEQ ID NO: 777265 - DNA, 25 bp, Mus musculus
tcctctgggatgtgaagtacggcca

SEQ ID NO: 777266 - DNA, 25 bp, Mus musculus
tcctctggtcctagttcatcatcac

SEQ ID NO: 777267 - DNA, 25 bp, Mus musculus
tcctctggtccttgttcatcatcac

SEQ ID NO: 777268 - DNA, 25 bp, Mus musculus
tcctctggtgtacggctcacagcag

SEQ ID NO: 777269 - DNA, 25 bp, Mus musculus
tcctctggtgtagggctcacagcag

SEQ ID NO: 777270 - DNA, 25 bp, Mus musculus
tcctctgtcaagagtctcatggttc

SEQ ID NO: 777271 - DNA, 25 bp, Mus musculus
tcctctgtcaagtgtctcatggttc

SEQ ID NO: 777272 - DNA, 25 bp, Mus musculus
tcctctgtcagtcaaggaattctgg

SEQ ID NO: 777273 - DNA, 25 bp, Mus musculus
tcctctgtcagtgaaggaattctgg

SEQ ID NO: 777274 - DNA, 25 bp, Mus musculus
tcctctgtcattaaacaaaagagaa

SEQ ID NO: 777275 - DNA, 25 bp, Mus musculus
tcctctgtcatttaacaaaagagaa

SEQ ID NO: 777276 - DNA, 25 bp, Mus musculus
tcctctgtgattctggcataccctg

SEQ ID NO: 777277 - DNA, 25 bp, Mus musculus
tcctctgtgattgtggcataccctg

SEQ ID NO: 777278 - DNA, 25 bp, Mus musculus
tcctctgtggatctccttgtctcca

SEQ ID NO: 777279 - DNA, 25 bp, Mus musculus
tcctctgtggatgtccttgtctcca

SEQ ID NO: 777280 - DNA, 25 bp, Mus musculus
tcctctgtggtcacacaacacgacg

SEQ ID NO: 777281 - DNA, 25 bp, Mus musculus
tcctctgtggtctcacaacacgacg

SEQ ID NO: 777282 - DNA, 25 bp, Mus musculus
tcctctgtggtgaggtgaccataca

SEQ ID NO: 777283 - DNA, 25 bp, Mus musculus
tcctctgtggtgtggtgaccataca

SEQ ID NO: 777284 - DNA, 25 bp, Mus musculus
tcctctgtgtggagaagatgaaaga

SEQ ID NO: 777285 - DNA, 25 bp, Mus musculus
tcctctgtgtggtgaagatgaaaga

SEQ ID NO: 777286 - DNA, 25 bp, Mus musculus
tcctctgttatgacctattccaaag

SEQ ID NO: 777287 - DNA, 25 bp, Mus musculus
tcctctgttatgtcctattccaaag

SEQ ID NO: 777288 - DNA, 25 bp, Mus musculus
tcctctgttgtgcatccgttgctgc

SEQ ID NO: 777289 - DNA, 25 bp, Mus musculus
tcctctgttgtggatccgttgctgc

SEQ ID NO: 777290 - DNA, 25 bp, Mus musculus
tcctcttaagcactcatccttctat

SEQ ID NO: 777291 - DNA, 25 bp, Mus musculus
tcctcttaagcagtcatccttctat

SEQ ID NO: 777292 - DNA, 25 bp, Mus musculus
tcctcttacacgattccgaagatga

SEQ ID NO: 777293 - DNA, 25 bp, Mus musculus
tcctcttacacgtttccgaagatga

SEQ ID NO: 777294 - DNA, 25 bp, Mus musculus
tcctcttacggtagtgcatgcggtt

SEQ ID NO: 777295 - DNA, 25 bp, Mus musculus
tcctcttacggttgtgcatgcggtt

SEQ ID NO: 777296 - DNA, 25 bp, Mus musculus
tcctcttagagcaagggaaggctaa

SEQ ID NO: 777297 - DNA, 25 bp, Mus musculus
tcctcttagagctagggaaggctaa

SEQ ID NO: 777298 - DNA, 25 bp, Mus musculus
tcctcttagctcacgcagggacgct

SEQ ID NO: 777299 - DNA, 25 bp, Mus musculus
tcctcttagctctcgcagggacgct

SEQ ID NO: 777300 - DNA, 25 bp, Mus musculus
tcctcttagtctcctgtttgctctg

SEQ ID NO: 777301 - DNA, 25 bp, Mus musculus
tcctcttagtctgctgtttgctctg

SEQ ID NO: 777302 - DNA, 25 bp, Mus musculus
tcctcttatggcagcagtaatgacc

SEQ ID NO: 777303 - DNA, 25 bp, Mus musculus
tcctcttatggctgcagtaatgacc

SEQ ID NO: 777304 - DNA, 25 bp, Mus musculus
tcctcttccaagagaaggcaaaggg

SEQ ID NO: 777305 - DNA, 25 bp, Mus musculus
tcctcttccaagtgaaggcaaaggg

SEQ ID NO: 777306 - DNA, 25 bp, Mus musculus
tcctcttcttctcggtggcccggat

SEQ ID NO: 777307 - DNA, 25 bp, Mus musculus
tcctcttcttctgggtggcccggat

SEQ ID NO: 777308 - DNA, 25 bp, Mus musculus
tcctcttgaccaaggcagtgaacag

SEQ ID NO: 777309 - DNA, 25 bp, Mus musculus
tcctcttgaccatggcagtgaacag

SEQ ID NO: 777310 - DNA, 25 bp, Mus musculus
tcctcttgcactcaccatatttgag

SEQ ID NO: 777311 - DNA, 25 bp, Mus musculus
tcctcttgcactgaccatatttgag

SEQ ID NO: 777312 - DNA, 25 bp, Mus musculus
tcctcttgccttcgttccaaattgc

SEQ ID NO: 777313 - DNA, 25 bp, Mus musculus
tcctcttgccttggttccaaattgc

SEQ ID NO: 777314 - DNA, 25 bp, Mus musculus
tcctcttggaaaatagggccgtgcg

SEQ ID NO: 777315 - DNA, 25 bp, Mus musculus
tcctcttggaaattagggccgtgcg

SEQ ID NO: 777316 - DNA, 25 bp, Mus musculus
tcctcttggaatatgtagcctcaca

SEQ ID NO: 777317 - DNA, 25 bp, Mus musculus
tcctcttggaatttgtagcctcaca

SEQ ID NO: 777318 - DNA, 25 bp, Mus musculus
tcctcttggagcaagagaaacaccg

SEQ ID NO: 777319 - DNA, 25 bp, Mus musculus
tcctcttggagctagagaaacaccg

SEQ ID NO: 777320 - DNA, 25 bp, Mus musculus
tcctcttggctacaaaacgggagca

SEQ ID NO: 777321 - DNA, 25 bp, Mus musculus
tcctcttggctagaaaacgggagca

SEQ ID NO: 777322 - DNA, 25 bp, Mus musculus
tcctcttgggtcaattaaatcatca

SEQ ID NO: 777323 - DNA, 25 bp, Mus musculus
tcctcttgggtctattaaatcatca

SEQ ID NO: 777324 - DNA, 25 bp, Mus musculus
tcctcttgtgctaaagctgagccgc

SEQ ID NO: 777325 - DNA, 25 bp, Mus musculus
tcctcttgtgcttaagctgagccgc

SEQ ID NO: 777326 - DNA, 25 bp, Mus musculus
tcctcttgttgcaatcactgatagc

SEQ ID NO: 777327 - DNA, 25 bp, Mus musculus
tcctcttgttgctatcactgatagc

SEQ ID NO: 777328 - DNA, 25 bp, Mus musculus
tcctctttaggcagctgaaaacaga

SEQ ID NO: 777329 - DNA, 25 bp, Mus musculus
tcctctttaggctgctgaaaacaga

SEQ ID NO: 777330 - DNA, 25 bp, Mus musculus
tcctctttagtgatggcgaggctga

SEQ ID NO: 777331 - DNA, 25 bp, Mus musculus
tcctctttagtgttggcgaggctga

SEQ ID NO: 777332 - DNA, 25 bp, Mus musculus
tcctctttccatagtcagggctggg

SEQ ID NO: 777333 - DNA, 25 bp, Mus musculus
tcctctttccattgtcagggctggg

SEQ ID NO: 777334 - DNA, 25 bp, Mus musculus
tcctctttcctgacgtttcatgttg

SEQ ID NO: 777335 - DNA, 25 bp, Mus musculus
tcctctttcctgtcgtttcatgttg

SEQ ID NO: 777336 - DNA, 25 bp, Mus musculus
tcctctttgaatatagtacttgcag

SEQ ID NO: 777337 - DNA, 25 bp, Mus musculus
tcctctttgaatttagtacttgcag

SEQ ID NO: 777338 - DNA, 25 bp, Mus musculus
tcctctttgaccacaacaatgcagt

SEQ ID NO: 777339 - DNA, 25 bp, Mus musculus
tcctctttgacctcaacaatgcagt

SEQ ID NO: 777340 - DNA, 25 bp, Mus musculus
tcctctttgatacacaaggccgtgg

SEQ ID NO: 777341 - DNA, 25 bp, Mus musculus
tcctctttgatagacaaggccgtgg

SEQ ID NO: 777342 - DNA, 25 bp, Mus musculus
tcctctttgcctccactattgtgga

SEQ ID NO: 777343 - DNA, 25 bp, Mus musculus
tcctctttgcctgcactattgtgga

SEQ ID NO: 777344 - DNA, 25 bp, Mus musculus
tcctctttgtccctaggactcagac

SEQ ID NO: 777345 - DNA, 25 bp, Mus musculus
tcctctttgtccgtaggactcagac

SEQ ID NO: 777346 - DNA, 25 bp, Mus musculus
tcctctttgtctaatgttctgaaag

SEQ ID NO: 777347 - DNA, 25 bp, Mus musculus
tcctctttgtcttatgttctgaaag

SEQ ID NO: 777348 - DNA, 25 bp, Mus musculus
tcctctttgtgacagaaagtcaacc

SEQ ID NO: 777349 - DNA, 25 bp, Mus musculus
tcctctttgtgagagaaagtcaacc

SEQ ID NO: 777350 - DNA, 25 bp, Mus musculus
tcctgaaaaaacagctcaaacaatg

SEQ ID NO: 777351 - DNA, 25 bp, Mus musculus
tcctgaaaaaactgctcaaacaatg

SEQ ID NO: 777352 - DNA, 25 bp, Mus musculus
tcctgaaaacacactgaaacatgtg

SEQ ID NO: 777353 - DNA, 25 bp, Mus musculus
tcctgaaaacactctgaaacatgtg

SEQ ID NO: 777354 - DNA, 25 bp, Mus musculus
tcctgaaaagggagtctgagaacct

SEQ ID NO: 777355 - DNA, 25 bp, Mus musculus
tcctgaaaagggtgtctgagaacct

SEQ ID NO: 777356 - DNA, 25 bp, Mus musculus
tcctgaaaagttctcagactcctgt

SEQ ID NO: 777357 - DNA, 25 bp, Mus musculus
tcctgaaaagttgtcagactcctgt

SEQ ID NO: 777358 - DNA, 25 bp, Mus musculus
tcctgaaagccgagagagatctgct

SEQ ID NO: 777359 - DNA, 25 bp, Mus musculus
tcctgaaagccgtgagagatctgct

SEQ ID NO: 777360 - DNA, 25 bp, Mus musculus
tcctgaaaggcaacattcgcctggg

SEQ ID NO: 777361 - DNA, 25 bp, Mus musculus
tcctgaaaggcacaaacctcttttg

SEQ ID NO: 777362 - DNA, 25 bp, Mus musculus
tcctgaaaggcagaaacctcttttg

SEQ ID NO: 777363 - DNA, 25 bp, Mus musculus
tcctgaaaggcatcattcgcctggg

SEQ ID NO: 777364 - DNA, 25 bp, Mus musculus
tcctgaacaaggctgagaatctggt

SEQ ID NO: 777365 - DNA, 25 bp, Mus musculus
tcctgaacaagggtgagaatctggt

SEQ ID NO: 777366 - DNA, 25 bp, Mus musculus
tcctgaacaccaccaacaagtcttt

SEQ ID NO: 777367 - DNA, 25 bp, Mus musculus
tcctgaacaccagcaacaagtcttt

SEQ ID NO: 777368 - DNA, 25 bp, Mus musculus
tcctgaacatctatgagcctgacta

SEQ ID NO: 777369 - DNA, 25 bp, Mus musculus
tcctgaacatctttgagcctgacta

SEQ ID NO: 777370 - DNA, 25 bp, Mus musculus
tcctgaaccacaagacctacttgga

SEQ ID NO: 777371 - DNA, 25 bp, Mus musculus
tcctgaaccacatgacctacttgga

SEQ ID NO: 777372 - DNA, 25 bp, Mus musculus
tcctgaaccccaactgcacgtggtg

SEQ ID NO: 777373 - DNA, 25 bp, Mus musculus
tcctgaaccccaagaacaaaggcaa

SEQ ID NO: 777374 - DNA, 25 bp, Mus musculus
tcctgaaccccatctgcacgtggtg

SEQ ID NO: 777375 - DNA, 25 bp, Mus musculus
tcctgaaccccatgaacaaaggcaa

SEQ ID NO: 777376 - DNA, 25 bp, Mus musculus
tcctgaacctcaacagactctgatc

SEQ ID NO: 777377 - DNA, 25 bp, Mus musculus
tcctgaacctcatcagactctgatc

SEQ ID NO: 777378 - DNA, 25 bp, Mus musculus
tcctgaactatccagtcctgaggga

SEQ ID NO: 777379 - DNA, 25 bp, Mus musculus
tcctgaactatcgagtcctgaggga

SEQ ID NO: 777380 - DNA, 25 bp, Mus musculus
tcctgaacttcgagcaggttaaatc

SEQ ID NO: 777381 - DNA, 25 bp, Mus musculus
tcctgaacttcgtgcaggttaaatc

SEQ ID NO: 777382 - DNA, 25 bp, Mus musculus
tcctgaacttgaccgggaaggtgct

SEQ ID NO: 777383 - DNA, 25 bp, Mus musculus
tcctgaacttgagcgggaaggtgct

SEQ ID NO: 777384 - DNA, 25 bp, Mus musculus
tcctgaagaaagcataaagttcaag

SEQ ID NO: 777385 - DNA, 25 bp, Mus musculus
tcctgaagaaaggataaagttcaag

SEQ ID NO: 777386 - DNA, 25 bp, Mus musculus
tcctgaagaatacggtgatggaatg

SEQ ID NO: 777387 - DNA, 25 bp, Mus musculus
tcctgaagaatagggtgatggaatg

SEQ ID NO: 777388 - DNA, 25 bp, Mus musculus
tcctgaagaccaacaacttctaaga

SEQ ID NO: 777389 - DNA, 25 bp, Mus musculus
tcctgaagaccatcaacttctaaga

SEQ ID NO: 777390 - DNA, 25 bp, Mus musculus
tcctgaagacctctccggtgtcatc

SEQ ID NO: 777391 - DNA, 25 bp, Mus musculus
tcctgaagacctgtccggtgtcatc

SEQ ID NO: 777392 - DNA, 25 bp, Mus musculus
tcctgaagagcaaggatgaccaagt

SEQ ID NO: 777393 - DNA, 25 bp, Mus musculus
tcctgaagagcatggatgaccaagt

SEQ ID NO: 777394 - DNA, 25 bp, Mus musculus
tcctgaagagtgctctgggtgctcc

SEQ ID NO: 777395 - DNA, 25 bp, Mus musculus
tcctgaagagtggtctgggtgctcc

SEQ ID NO: 777396 - DNA, 25 bp, Mus musculus
tcctgaagatccagcacaggtatga

SEQ ID NO: 777397 - DNA, 25 bp, Mus musculus
tcctgaagatcctgcacaggtatga

SEQ ID NO: 777398 - DNA, 25 bp, Mus musculus
tcctgaagatggagggtcctttgtc

SEQ ID NO: 777399 - DNA, 25 bp, Mus musculus
tcctgaagatggtgggtcctttgtc

SEQ ID NO: 777400 - DNA, 25 bp, Mus musculus
tcctgaagcaacaggataccctgtg

SEQ ID NO: 777401 - DNA, 25 bp, Mus musculus
tcctgaagcaactggataccctgtg

SEQ ID NO: 777402 - DNA, 25 bp, Mus musculus
tcctgaagcagaccgcctcatcgtg

SEQ ID NO: 777403 - DNA, 25 bp, Mus musculus
tcctgaagcagagcgcctcatcgtg

SEQ ID NO: 777404 - DNA, 25 bp, Mus musculus
tcctgaagcgcaccctgtccatgtg

SEQ ID NO: 777405 - DNA, 25 bp, Mus musculus
tcctgaagcgcagcctgtccatgtg

SEQ ID NO: 777406 - DNA, 25 bp, Mus musculus
tcctgaaggaagcttttgcccgctg

SEQ ID NO: 777407 - DNA, 25 bp, Mus musculus
tcctgaaggaaggttttgcccgctg

SEQ ID NO: 777408 - DNA, 25 bp, Mus musculus
tcctgaaggacccacacgatgcttt

SEQ ID NO: 777409 - DNA, 25 bp, Mus musculus
tcctgaaggaccgacacgatgcttt

SEQ ID NO: 777410 - DNA, 25 bp, Mus musculus
tcctgaaggatcatgacaaacacca

SEQ ID NO: 777411 - DNA, 25 bp, Mus musculus
tcctgaaggatcttgacaaacacca

SEQ ID NO: 777412 - DNA, 25 bp, Mus musculus
tcctgaaggcacaggtagtagggac

SEQ ID NO: 777413 - DNA, 25 bp, Mus musculus
tcctgaaggcactggtagtagggac

SEQ ID NO: 777414 - DNA, 25 bp, Mus musculus
tcctgaaggcctcatggatagccca

SEQ ID NO: 777415 - DNA, 25 bp, Mus musculus
tcctgaaggcctgatggatagccca

SEQ ID NO: 777416 - DNA, 25 bp, Mus musculus
tcctgaagggacaaaaggacggcat

SEQ ID NO: 777417 - DNA, 25 bp, Mus musculus
tcctgaagggactaaaggacggcat

SEQ ID NO: 777418 - DNA, 25 bp, Mus musculus
tcctgaaggtcaaccagatcggctc

SEQ ID NO: 777419 - DNA, 25 bp, Mus musculus
tcctgaaggtcatccagatcggctc

SEQ ID NO: 777420 - DNA, 25 bp, Mus musculus
tcctgaaggtgcctctgatgctggc

SEQ ID NO: 777421 - DNA, 25 bp, Mus musculus
tcctgaaggtgcgtctgatgctggc

SEQ ID NO: 777422 - DNA, 25 bp, Mus musculus
tcctgaagtctcaaaggagaaggcc

SEQ ID NO: 777423 - DNA, 25 bp, Mus musculus
tcctgaagtctctaaggagaaggcc

SEQ ID NO: 777424 - DNA, 25 bp, Mus musculus
tcctgaagttcgagaaccggagtcc

SEQ ID NO: 777425 - DNA, 25 bp, Mus musculus
tcctgaagttcgtgaaccggagtcc

SEQ ID NO: 777426 - DNA, 25 bp, Mus musculus
tcctgaagttgccagatttggatat

SEQ ID NO: 777427 - DNA, 25 bp, Mus musculus
tcctgaagttgcgagatttggatat

SEQ ID NO: 777428 - DNA, 25 bp, Mus musculus
tcctgaatcatacaggaagcccatt

SEQ ID NO: 777429 - DNA, 25 bp, Mus musculus
tcctgaatcatagaggaagcccatt

SEQ ID NO: 777430 - DNA, 25 bp, Mus musculus
tcctgaatgacgaaagggccattgc

SEQ ID NO: 777431 - DNA, 25 bp, Mus musculus
tcctgaatgacgtaagggccattgc

SEQ ID NO: 777432 - DNA, 25 bp, Mus musculus
tcctgaatgccgctctgagcactgg

SEQ ID NO: 777433 - DNA, 25 bp, Mus musculus
tcctgaatgccggtctgagcactgg

SEQ ID NO: 777434 - DNA, 25 bp, Mus musculus
tcctgaattggcatctgcgagaccg

SEQ ID NO: 777435 - DNA, 25 bp, Mus musculus
tcctgaattggcttctgcgagaccg

SEQ ID NO: 777436 - DNA, 25 bp, Mus musculus
tcctgacacagtactttggccgcca

SEQ ID NO: 777437 - DNA, 25 bp, Mus musculus
tcctgacacagttctttggccgcca

SEQ ID NO: 777438 - DNA, 25 bp, Mus musculus
tcctgacactgcatttggaaacgtg

SEQ ID NO: 777439 - DNA, 25 bp, Mus musculus
tcctgacactgcttttggaaacgtg

SEQ ID NO: 777440 - DNA, 25 bp, Mus musculus
tcctgacactttattccggaatggg

SEQ ID NO: 777441 - DNA, 25 bp, Mus musculus
tcctgacacttttttccggaatggg

SEQ ID NO: 777442 - DNA, 25 bp, Mus musculus
tcctgacaggagagagctatgctgg

SEQ ID NO: 777443 - DNA, 25 bp, Mus musculus
tcctgacaggagtgagctatgctgg

SEQ ID NO: 777444 - DNA, 25 bp, Mus musculus
tcctgacattgtcgatttctgtgaa

SEQ ID NO: 777445 - DNA, 25 bp, Mus musculus
tcctgacattgtggatttctgtgaa

SEQ ID NO: 777446 - DNA, 25 bp, Mus musculus
tcctgaccaagcaggagatcctcct

SEQ ID NO: 777447 - DNA, 25 bp, Mus musculus
tcctgaccaagctggagatcctcct

SEQ ID NO: 777448 - DNA, 25 bp, Mus musculus
tcctgaccagtgaaactcattttta

SEQ ID NO: 777449 - DNA, 25 bp, Mus musculus
tcctgaccagtgtaactcattttta

SEQ ID NO: 777450 - DNA, 25 bp, Mus musculus
tcctgaccatgtaccatggatgggt

SEQ ID NO: 777451 - DNA, 25 bp, Mus musculus
tcctgaccatgttccatggatgggt

SEQ ID NO: 777452 - DNA, 25 bp, Mus musculus
tcctgacccaagctgaaataaaacg

SEQ ID NO: 777453 - DNA, 25 bp, Mus musculus
tcctgacccaaggtgaaataaaacg

SEQ ID NO: 777454 - DNA, 25 bp, Mus musculus
tcctgaccctggagaatgcaccata

SEQ ID NO: 777455 - DNA, 25 bp, Mus musculus
tcctgaccctggtgaatgcaccata

SEQ ID NO: 777456 - DNA, 25 bp, Mus musculus
tcctgaccggtgagaccagtagtgc

SEQ ID NO: 777457 - DNA, 25 bp, Mus musculus
tcctgaccggtgtgaccagtagtgc

SEQ ID NO: 777458 - DNA, 25 bp, Mus musculus
tcctgaccgtccagagcctggattg

SEQ ID NO: 777459 - DNA, 25 bp, Mus musculus
tcctgaccgtcctgagcctggattg

SEQ ID NO: 777460 - DNA, 25 bp, Mus musculus
tcctgacctcacaagttcttctctg

SEQ ID NO: 777461 - DNA, 25 bp, Mus musculus
tcctgacctcactagttcttctctg

SEQ ID NO: 777462 - DNA, 25 bp, Mus musculus
tcctgacctcatccgagaacttggc

SEQ ID NO: 777463 - DNA, 25 bp, Mus musculus
tcctgacctcatgcgagaacttggc

SEQ ID NO: 777464 - DNA, 25 bp, Mus musculus
tcctgacctggactgacaaacctga

SEQ ID NO: 777465 - DNA, 25 bp, Mus musculus
tcctgacctggagtgacaaacctga

SEQ ID NO: 777466 - DNA, 25 bp, Mus musculus
tcctgacgatttctctagggctctg

SEQ ID NO: 777467 - DNA, 25 bp, Mus musculus
tcctgacgatttgtctagggctctg

SEQ ID NO: 777468 - DNA, 25 bp, Mus musculus
tcctgacgctggagtgagcctgctg

SEQ ID NO: 777469 - DNA, 25 bp, Mus musculus
tcctgacgctggtgtgagcctgctg

SEQ ID NO: 777470 - DNA, 25 bp, Mus musculus
tcctgacgtcatcggcatcggacct

SEQ ID NO: 777471 - DNA, 25 bp, Mus musculus
tcctgacgtcatgggcatcggacct

SEQ ID NO: 777472 - DNA, 25 bp, Mus musculus
tcctgactatatcctgtgcgaagcc

SEQ ID NO: 777473 - DNA, 25 bp, Mus musculus
tcctgactatatgctgtgcgaagcc

SEQ ID NO: 777474 - DNA, 25 bp, Mus musculus
tcctgactatcgagggcagaactgc

SEQ ID NO: 777475 - DNA, 25 bp, Mus musculus
tcctgactatcgtgggcagaactgc

SEQ ID NO: 777476 - DNA, 25 bp, Mus musculus
tcctgactatgcagagaagattcct

SEQ ID NO: 777477 - DNA, 25 bp, Mus musculus
tcctgactatgctgagaagattcct

SEQ ID NO: 777478 - DNA, 25 bp, Mus musculus
tcctgactgaagatgccagcggcct

SEQ ID NO: 777479 - DNA, 25 bp, Mus musculus
tcctgactgaagttgccagcggcct

SEQ ID NO: 777480 - DNA, 25 bp, Mus musculus
tcctgactgataagactgagagtga

SEQ ID NO: 777481 - DNA, 25 bp, Mus musculus
tcctgactgatatgactgagagtga

SEQ ID NO: 777482 - DNA, 25 bp, Mus musculus
tcctgactggaaactgctgtgtggg

SEQ ID NO: 777483 - DNA, 25 bp, Mus musculus
tcctgactggaatctgctgtgtggg

SEQ ID NO: 777484 - DNA, 25 bp, Mus musculus
tcctgactgtgactgagacagccaa

SEQ ID NO: 777485 - DNA, 25 bp, Mus musculus
tcctgactgtgagtgagacagccaa

SEQ ID NO: 777486 - DNA, 25 bp, Mus musculus
tcctgacttgggagtacagaagcaa

SEQ ID NO: 777487 - DNA, 25 bp, Mus musculus
tcctgacttgggtgtacagaagcaa

SEQ ID NO: 777488 - DNA, 25 bp, Mus musculus
tcctgagaaagaaaacagagaccag

SEQ ID NO: 777489 - DNA, 25 bp, Mus musculus
tcctgagaaagataacagagaccag

SEQ ID NO: 777490 - DNA, 25 bp, Mus musculus
tcctgagaaggacttggtgacattt

SEQ ID NO: 777491 - DNA, 25 bp, Mus musculus
tcctgagaaggagttggtgacattt

SEQ ID NO: 777492 - DNA, 25 bp, Mus musculus
tcctgagacaccagctgcggaaaca

SEQ ID NO: 777493 - DNA, 25 bp, Mus musculus
tcctgagacacctgctgcggaaaca

SEQ ID NO: 777494 - DNA, 25 bp, Mus musculus
tcctgagacactaagatcccctggg

SEQ ID NO: 777495 - DNA, 25 bp, Mus musculus
tcctgagacacttagatcccctggg

SEQ ID NO: 777496 - DNA, 25 bp, Mus musculus
tcctgagacagtaccgagtgggcac

SEQ ID NO: 777497 - DNA, 25 bp, Mus musculus
tcctgagacagttccgagtgggcac

SEQ ID NO: 777498 - DNA, 25 bp, Mus musculus
tcctgagaccttcggcagaatcatg

SEQ ID NO: 777499 - DNA, 25 bp, Mus musculus
tcctgagaccttgggcagaatcatg

SEQ ID NO: 777500 - DNA, 25 bp, Mus musculus
tcctgagacgtaagtctgggtgccc

SEQ ID NO: 777501 - DNA, 25 bp, Mus musculus
tcctgagacgtatgtctgggtgccc

SEQ ID NO: 777502 - DNA, 25 bp, Mus musculus
tcctgagactaccagaactgaatag

SEQ ID NO: 777503 - DNA, 25 bp, Mus musculus
tcctgagactacgagaactgaatag

SEQ ID NO: 777504 - DNA, 25 bp, Mus musculus
tcctgagagattaaacagtagactt

SEQ ID NO: 777505 - DNA, 25 bp, Mus musculus
tcctgagagatttaacagtagactt

SEQ ID NO: 777506 - DNA, 25 bp, Mus musculus
tcctgagagccaagagaaagaaagg

SEQ ID NO: 777507 - DNA, 25 bp, Mus musculus
tcctgagagccatgagaaagaaagg

SEQ ID NO: 777508 - DNA, 25 bp, Mus musculus
tcctgagaggcaccgaatctactgg

SEQ ID NO: 777509 - DNA, 25 bp, Mus musculus
tcctgagaggcagcgaatctactgg

SEQ ID NO: 777510 - DNA, 25 bp, Mus musculus
tcctgagaggtgacggatgctcttg

SEQ ID NO: 777511 - DNA, 25 bp, Mus musculus
tcctgagaggtgtcggatgctcttg

SEQ ID NO: 777512 - DNA, 25 bp, Mus musculus
tcctgagatagtaaacttgcattca

SEQ ID NO: 777513 - DNA, 25 bp, Mus musculus
tcctgagatagttaacttgcattca

SEQ ID NO: 777514 - DNA, 25 bp, Mus musculus
tcctgagcaaaccagagcctagagg

SEQ ID NO: 777515 - DNA, 25 bp, Mus musculus
tcctgagcaaacgagagcctagagg

SEQ ID NO: 777516 - DNA, 25 bp, Mus musculus
tcctgagcaccgagcagggcgcagc

SEQ ID NO: 777517 - DNA, 25 bp, Mus musculus
tcctgagcaccgtgcagggcgcagc

SEQ ID NO: 777518 - DNA, 25 bp, Mus musculus
tcctgagcagaaatgtccgccggag

SEQ ID NO: 777519 - DNA, 25 bp, Mus musculus
tcctgagcagaattgtccgccggag

SEQ ID NO: 777520 - DNA, 25 bp, Mus musculus
tcctgagccaagaagtgaccaagag

SEQ ID NO: 777521 - DNA, 25 bp, Mus musculus
tcctgagccaagtagtgaccaagag

SEQ ID NO: 777522 - DNA, 25 bp, Mus musculus
tcctgagcccttcggaaactcaaca

SEQ ID NO: 777523 - DNA, 25 bp, Mus musculus
tcctgagcccttgggaaactcaaca

SEQ ID NO: 777524 - DNA, 25 bp, Mus musculus
tcctgagccgtgatacaagcttgag

SEQ ID NO: 777525 - DNA, 25 bp, Mus musculus
tcctgagccgtgttacaagcttgag

SEQ ID NO: 777526 - DNA, 25 bp, Mus musculus
tcctgagcctgacggttgtaagagt

SEQ ID NO: 777527 - DNA, 25 bp, Mus musculus
tcctgagcctgagggttgtaagagt

SEQ ID NO: 777528 - DNA, 25 bp, Mus musculus
tcctgagcggccaagagctggtgca

SEQ ID NO: 777529 - DNA, 25 bp, Mus musculus
tcctgagcggcctagagctggtgca

SEQ ID NO: 777530 - DNA, 25 bp, Mus musculus
tcctgagcgggcacacctggcaaca

SEQ ID NO: 777531 - DNA, 25 bp, Mus musculus
tcctgagcgggctcacctggcaaca

SEQ ID NO: 777532 - DNA, 25 bp, Mus musculus
tcctgagcgtatcgcttgtggccta

SEQ ID NO: 777533 - DNA, 25 bp, Mus musculus
tcctgagcgtatggcttgtggccta

SEQ ID NO: 777534 - DNA, 25 bp, Mus musculus
tcctgagcgttcctccataagaaag

SEQ ID NO: 777535 - DNA, 25 bp, Mus musculus
tcctgagcgttcgtccataagaaag

SEQ ID NO: 777536 - DNA, 25 bp, Mus musculus
tcctgagctaataaggccccagaag

SEQ ID NO: 777537 - DNA, 25 bp, Mus musculus
tcctgagctaattaggccccagaag

SEQ ID NO: 777538 - DNA, 25 bp, Mus musculus
tcctgagctcagacgatttggaagg

SEQ ID NO: 777539 - DNA, 25 bp, Mus musculus
tcctgagctcagtcgatttggaagg

SEQ ID NO: 777540 - DNA, 25 bp, Mus musculus
tcctgagctccaaagaaatgtgacc

SEQ ID NO: 777541 - DNA, 25 bp, Mus musculus
tcctgagctccatagaaatgtgacc

SEQ ID NO: 777542 - DNA, 25 bp, Mus musculus
tcctgagctgaactccatcatccga

SEQ ID NO: 777543 - DNA, 25 bp, Mus musculus
tcctgagctgaagtccatcatccga

SEQ ID NO: 777544 - DNA, 25 bp, Mus musculus
tcctgagctgctaaccatgtggttt

SEQ ID NO: 777545 - DNA, 25 bp, Mus musculus
tcctgagctgcttaccatgtggttt

SEQ ID NO: 777546 - DNA, 25 bp, Mus musculus
tcctgagctggacacagttgtccct

SEQ ID NO: 777547 - DNA, 25 bp, Mus musculus
tcctgagctggagacagttgtccct

SEQ ID NO: 777548 - DNA, 25 bp, Mus musculus
tcctgagctggtactgcagtgccca

SEQ ID NO: 777549 - DNA, 25 bp, Mus musculus
tcctgagctggttctgcagtgccca

SEQ ID NO: 777550 - DNA, 25 bp, Mus musculus
tcctgagctgtgacggtgagagccc

SEQ ID NO: 777551 - DNA, 25 bp, Mus musculus
tcctgagctgtgtcggtgagagccc

SEQ ID NO: 777552 - DNA, 25 bp, Mus musculus
tcctgaggaaggaatatgtttttgc

SEQ ID NO: 777553 - DNA, 25 bp, Mus musculus
tcctgaggaaggacatccgagacct

SEQ ID NO: 777554 - DNA, 25 bp, Mus musculus
tcctgaggaaggtatatgtttttgc

SEQ ID NO: 777555 - DNA, 25 bp, Mus musculus
tcctgaggaaggtcatccgagacct

SEQ ID NO: 777556 - DNA, 25 bp, Mus musculus
tcctgaggacagcaatgagaccacc

SEQ ID NO: 777557 - DNA, 25 bp, Mus musculus
tcctgaggacaggaatgagaccacc

SEQ ID NO: 777558 - DNA, 25 bp, Mus musculus
tcctgaggacccactatttaagaag

SEQ ID NO: 777559 - DNA, 25 bp, Mus musculus
tcctgaggaccctctatttaagaag

SEQ ID NO: 777560 - DNA, 25 bp, Mus musculus
tcctgaggactcctggactagcact

SEQ ID NO: 777561 - DNA, 25 bp, Mus musculus
tcctgaggactcgtggactagcact

SEQ ID NO: 777562 - DNA, 25 bp, Mus musculus
tcctgaggagcaacgtcaggtctgc

SEQ ID NO: 777563 - DNA, 25 bp, Mus musculus
tcctgaggagcatcgtcaggtctgc

SEQ ID NO: 777564 - DNA, 25 bp, Mus musculus
tcctgaggagcgacctccgggactt

SEQ ID NO: 777565 - DNA, 25 bp, Mus musculus
tcctgaggagcgtcctccgggactt

SEQ ID NO: 777566 - DNA, 25 bp, Mus musculus
tcctgaggcccaagctgaacttcgc

SEQ ID NO: 777567 - DNA, 25 bp, Mus musculus
tcctgaggcccatgctgaacttcgc

SEQ ID NO: 777568 - DNA, 25 bp, Mus musculus
tcctgaggctcgagaggccatgttc

SEQ ID NO: 777569 - DNA, 25 bp, Mus musculus
tcctgaggctcgtgaggccatgttc

SEQ ID NO: 777570 - DNA, 25 bp, Mus musculus
tcctgagggagacttcggctttgaa

SEQ ID NO: 777571 - DNA, 25 bp, Mus musculus
tcctgagggagagttcggctttgaa

SEQ ID NO: 777572 - DNA, 25 bp, Mus musculus
tcctgagggccaactggaaggccat

SEQ ID NO: 777573 - DNA, 25 bp, Mus musculus
tcctgagggccatctggaaggccat

SEQ ID NO: 777574 - DNA, 25 bp, Mus musculus
tcctgagggcgcaaggccttgctct

SEQ ID NO: 777575 - DNA, 25 bp, Mus musculus
tcctgagggcgctaggccttgctct

SEQ ID NO: 777576 - DNA, 25 bp, Mus musculus
tcctgagggcttcaggctcactcat

SEQ ID NO: 777577 - DNA, 25 bp, Mus musculus
tcctgagggcttgaggctcactcat

SEQ ID NO: 777578 - DNA, 25 bp, Mus musculus
tcctgaggtccaacatgaagttcca

SEQ ID NO: 777579 - DNA, 25 bp, Mus musculus
tcctgaggtccatcatgaagttcca

SEQ ID NO: 777580 - DNA, 25 bp, Mus musculus
tcctgaggtcctatgcagtggtcgg

SEQ ID NO: 777581 - DNA, 25 bp, Mus musculus
tcctgaggtcctttgcagtggtcgg

SEQ ID NO: 777582 - DNA, 25 bp, Mus musculus
tcctgaggtgtgctactgagacaac

SEQ ID NO: 777583 - DNA, 25 bp, Mus musculus
tcctgaggtgtggtactgagacaac

SEQ ID NO: 777584 - DNA, 25 bp, Mus musculus
tcctgaggtttaatggggcacctac

SEQ ID NO: 777585 - DNA, 25 bp, Mus musculus
tcctgaggtttattggggcacctac

SEQ ID NO: 777586 - DNA, 25 bp, Mus musculus
tcctgagtaactataaggattcctt

SEQ ID NO: 777587 - DNA, 25 bp, Mus musculus
tcctgagtaactttaaggattcctt

SEQ ID NO: 777588 - DNA, 25 bp, Mus musculus
tcctgagtacatagatcgcattgcc

SEQ ID NO: 777589 - DNA, 25 bp, Mus musculus
tcctgagtacattgatcgcattgcc

SEQ ID NO: 777590 - DNA, 25 bp, Mus musculus
tcctgagtctttcctgtgccaaagc

SEQ ID NO: 777591 - DNA, 25 bp, Mus musculus
tcctgagtctttgctgtgccaaagc

SEQ ID NO: 777592 - DNA, 25 bp, Mus musculus
tcctgagtgcgtaggcagtactggc

SEQ ID NO: 777593 - DNA, 25 bp, Mus musculus
tcctgagtgcgttggcagtactggc

SEQ ID NO: 777594 - DNA, 25 bp, Mus musculus
tcctgagtggccatgtcgtagtctg

SEQ ID NO: 777595 - DNA, 25 bp, Mus musculus
tcctgagtggccttgtcgtagtctg

SEQ ID NO: 777596 - DNA, 25 bp, Mus musculus
tcctgagtggcgactggttttaact

SEQ ID NO: 777597 - DNA, 25 bp, Mus musculus
tcctgagtggcgtctggttttaact

SEQ ID NO: 777598 - DNA, 25 bp, Mus musculus
tcctgagttcagctgacaagtggag

SEQ ID NO: 777599 - DNA, 25 bp, Mus musculus
tcctgagttcaggtgacaagtggag

SEQ ID NO: 777600 - DNA, 25 bp, Mus musculus
tcctgagttcctcgctcactggtgt

SEQ ID NO: 777601 - DNA, 25 bp, Mus musculus
tcctgagttcctggctcactggtgt

SEQ ID NO: 777602 - DNA, 25 bp, Mus musculus
tcctgagttggtatgttgttctgcc

SEQ ID NO: 777603 - DNA, 25 bp, Mus musculus
tcctgagttggtttgttgttctgcc

SEQ ID NO: 777604 - DNA, 25 bp, Mus musculus
tcctgagtttgtacagaagctacag

SEQ ID NO: 777605 - DNA, 25 bp, Mus musculus
tcctgagtttgttcagaagctacag

SEQ ID NO: 777606 - DNA, 25 bp, Mus musculus
tcctgagttttgcaagaccaaggct

SEQ ID NO: 777607 - DNA, 25 bp, Mus musculus
tcctgagttttggaagaccaaggct

SEQ ID NO: 777608 - DNA, 25 bp, Mus musculus
tcctgataagaacacatgtcccatg

SEQ ID NO: 777609 - DNA, 25 bp, Mus musculus
tcctgataagaagacatgtcccatg

SEQ ID NO: 777610 - DNA, 25 bp, Mus musculus
tcctgatagatgaacgtgctggcct

SEQ ID NO: 777611 - DNA, 25 bp, Mus musculus
tcctgatagatgtacgtgctggcct

SEQ ID NO: 777612 - DNA, 25 bp, Mus musculus
tcctgatcctcacttctttctgaag

SEQ ID NO: 777613 - DNA, 25 bp, Mus musculus
tcctgatcctcagttctttctgaag

SEQ ID NO: 777614 - DNA, 25 bp, Mus musculus
tcctgatccttaaatgtgtcctgtc

SEQ ID NO: 777615 - DNA, 25 bp, Mus musculus
tcctgatccttatatgtgtcctgtc

SEQ ID NO: 777616 - DNA, 25 bp, Mus musculus
tcctgatccttcagggccatggcca

SEQ ID NO: 777617 - DNA, 25 bp, Mus musculus
tcctgatccttctgggccatggcca

SEQ ID NO: 777618 - DNA, 25 bp, Mus musculus
tcctgatccttgagaagctgtggcc

SEQ ID NO: 777619 - DNA, 25 bp, Mus musculus
tcctgatccttgtgaagctgtggcc

SEQ ID NO: 777620 - DNA, 25 bp, Mus musculus
tcctgatgaaggaccttctgagtac

SEQ ID NO: 777621 - DNA, 25 bp, Mus musculus
tcctgatgaaggattcatcctgccc

SEQ ID NO: 777622 - DNA, 25 bp, Mus musculus
tcctgatgaaggtccttctgagtac

SEQ ID NO: 777623 - DNA, 25 bp, Mus musculus
tcctgatgaaggtttcatcctgccc

SEQ ID NO: 777624 - DNA, 25 bp, Mus musculus
tcctgatgacatcatttccaatgag

SEQ ID NO: 777625 - DNA, 25 bp, Mus musculus
tcctgatgacatgatttccaatgag

SEQ ID NO: 777626 - DNA, 25 bp, Mus musculus
tcctgatgacccacaagggacttcc

SEQ ID NO: 777627 - DNA, 25 bp, Mus musculus
tcctgatgaccctcaagggacttcc

SEQ ID NO: 777628 - DNA, 25 bp, Mus musculus
tcctgatgactaagcacagcttggg

SEQ ID NO: 777629 - DNA, 25 bp, Mus musculus
tcctgatgactatgcacagcttggg

SEQ ID NO: 777630 - DNA, 25 bp, Mus musculus
tcctgatgatgtccagcctatcgcc

SEQ ID NO: 777631 - DNA, 25 bp, Mus musculus
tcctgatgatgtgcagcctatcgcc

SEQ ID NO: 777632 - DNA, 25 bp, Mus musculus
tcctgatgcaccaagaaaattggtc

SEQ ID NO: 777633 - DNA, 25 bp, Mus musculus
tcctgatgcacctagaaaattggtc

SEQ ID NO: 777634 - DNA, 25 bp, Mus musculus
tcctgatgcaggatgaacgacatgt

SEQ ID NO: 777635 - DNA, 25 bp, Mus musculus
tcctgatgcaggttgaacgacatgt

SEQ ID NO: 777636 - DNA, 25 bp, Mus musculus
tcctgatgccagctgttctgctcct

SEQ ID NO: 777637 - DNA, 25 bp, Mus musculus
tcctgatgccaggtgttctgctcct

SEQ ID NO: 777638 - DNA, 25 bp, Mus musculus
tcctgatggaacagcaagactgtgc

SEQ ID NO: 777639 - DNA, 25 bp, Mus musculus
tcctgatggaaccatgaaccaagta

SEQ ID NO: 777640 - DNA, 25 bp, Mus musculus
tcctgatggaacgatgaaccaagta

SEQ ID NO: 777641 - DNA, 25 bp, Mus musculus
tcctgatggaactgcaagactgtgc

SEQ ID NO: 777642 - DNA, 25 bp, Mus musculus
tcctgatggagcagtaaaaccaccc

SEQ ID NO: 777643 - DNA, 25 bp, Mus musculus
tcctgatggagctgtaaaaccaccc

SEQ ID NO: 777644 - DNA, 25 bp, Mus musculus
tcctgatggcctccaaagcttaccg

SEQ ID NO: 777645 - DNA, 25 bp, Mus musculus
tcctgatggcctgcaaagcttaccg

SEQ ID NO: 777646 - DNA, 25 bp, Mus musculus
tcctgatggggaaagccatgggccc

SEQ ID NO: 777647 - DNA, 25 bp, Mus musculus
tcctgatggggatagccatgggccc

SEQ ID NO: 777648 - DNA, 25 bp, Mus musculus
tcctgatggtgaatgctgcccacgg

SEQ ID NO: 777649 - DNA, 25 bp, Mus musculus
tcctgatggtgattgctgcccacgg

SEQ ID NO: 777650 - DNA, 25 bp, Mus musculus
tcctgatgtgaactatgaagagctg

SEQ ID NO: 777651 - DNA, 25 bp, Mus musculus
tcctgatgtgaagtatgaagagctg

SEQ ID NO: 777652 - DNA, 25 bp, Mus musculus
tcctgattagagaaactggtgactg

SEQ ID NO: 777653 - DNA, 25 bp, Mus musculus
tcctgattagagtaactggtgactg

SEQ ID NO: 777654 - DNA, 25 bp, Mus musculus
tcctgattcctaatggaaaagccaa

SEQ ID NO: 777655 - DNA, 25 bp, Mus musculus
tcctgattcctattggaaaagccaa

SEQ ID NO: 777656 - DNA, 25 bp, Mus musculus
tcctgattgcctaggtggggctaat

SEQ ID NO: 777657 - DNA, 25 bp, Mus musculus
tcctgattgccttggtggggctaat

SEQ ID NO: 777658 - DNA, 25 bp, Mus musculus
tcctgatttcataccgtcgcagcca

SEQ ID NO: 777659 - DNA, 25 bp, Mus musculus
tcctgatttcattccgtcgcagcca

SEQ ID NO: 777660 - DNA, 25 bp, Mus musculus
tcctgcaaaagtagttcctatgaaa

SEQ ID NO: 777661 - DNA, 25 bp, Mus musculus
tcctgcaaaagttgttcctatgaaa

SEQ ID NO: 777662 - DNA, 25 bp, Mus musculus
tcctgcaaaggaactagaagacttg

SEQ ID NO: 777663 - DNA, 25 bp, Mus musculus
tcctgcaaaggatctagaagacttg

SEQ ID NO: 777664 - DNA, 25 bp, Mus musculus
tcctgcaaccttccgagatcttagt

SEQ ID NO: 777665 - DNA, 25 bp, Mus musculus
tcctgcaaccttgcgagatcttagt

SEQ ID NO: 777666 - DNA, 25 bp, Mus musculus
tcctgcaagactcggtcattgatga

SEQ ID NO: 777667 - DNA, 25 bp, Mus musculus
tcctgcaagactgggtcattgatga

SEQ ID NO: 777668 - DNA, 25 bp, Mus musculus
tcctgcaagccgagcaggtgtccca

SEQ ID NO: 777669 - DNA, 25 bp, Mus musculus
tcctgcaagccgtgcaggtgtccca

SEQ ID NO: 777670 - DNA, 25 bp, Mus musculus
tcctgcaagcgcaaaatcttttaac

SEQ ID NO: 777671 - DNA, 25 bp, Mus musculus
tcctgcaagcgctaaatcttttaac

SEQ ID NO: 777672 - DNA, 25 bp, Mus musculus
tcctgcacactgcacagaagatgcc

SEQ ID NO: 777673 - DNA, 25 bp, Mus musculus
tcctgcacactggacagaagatgcc

SEQ ID NO: 777674 - DNA, 25 bp, Mus musculus
tcctgcacacttacactgatgcggt

SEQ ID NO: 777675 - DNA, 25 bp, Mus musculus
tcctgcacactttcactgatgcggt

SEQ ID NO: 777676 - DNA, 25 bp, Mus musculus
tcctgcaccacgaggacctcattgg

SEQ ID NO: 777677 - DNA, 25 bp, Mus musculus
tcctgcaccacgtggacctcattgg

SEQ ID NO: 777678 - DNA, 25 bp, Mus musculus
tcctgcacggcgagtttggttccta

SEQ ID NO: 777679 - DNA, 25 bp, Mus musculus
tcctgcacggcgtgtttggttccta

SEQ ID NO: 777680 - DNA, 25 bp, Mus musculus
tcctgcactacgagtttgagccttc

SEQ ID NO: 777681 - DNA, 25 bp, Mus musculus
tcctgcactacgtgtttgagccttc

SEQ ID NO: 777682 - DNA, 25 bp, Mus musculus
tcctgcacttgaagaatcattaaaa

SEQ ID NO: 777683 - DNA, 25 bp, Mus musculus
tcctgcacttgatgaatcattaaaa

SEQ ID NO: 777684 - DNA, 25 bp, Mus musculus
tcctgcagaactctaggcatccctt

SEQ ID NO: 777685 - DNA, 25 bp, Mus musculus
tcctgcagaactgtaggcatccctt

SEQ ID NO: 777686 - DNA, 25 bp, Mus musculus
tcctgcagaagaactcggatgctaa

SEQ ID NO: 777687 - DNA, 25 bp, Mus musculus
tcctgcagaagacgcccttttcgct

SEQ ID NO: 777688 - DNA, 25 bp, Mus musculus
tcctgcagaagaggcccttttcgct

SEQ ID NO: 777689 - DNA, 25 bp, Mus musculus
tcctgcagaagatctcggatgctaa

SEQ ID NO: 777690 - DNA, 25 bp, Mus musculus
tcctgcagaagcaacaactggagct

SEQ ID NO: 777691 - DNA, 25 bp, Mus musculus
tcctgcagaagctacaactggagct

SEQ ID NO: 777692 - DNA, 25 bp, Mus musculus
tcctgcagataaataactgtttgac

SEQ ID NO: 777693 - DNA, 25 bp, Mus musculus
tcctgcagataattaactgtttgac

SEQ ID NO: 777694 - DNA, 25 bp, Mus musculus
tcctgcagcgctagtggggcacctc

SEQ ID NO: 777695 - DNA, 25 bp, Mus musculus
tcctgcagcgcttgtggggcacctc

SEQ ID NO: 777696 - DNA, 25 bp, Mus musculus
tcctgcagctgaatctgctgccctt

SEQ ID NO: 777697 - DNA, 25 bp, Mus musculus
tcctgcagctgattctgctgccctt

SEQ ID NO: 777698 - DNA, 25 bp, Mus musculus
tcctgcagctgtaccctgagaactc

SEQ ID NO: 777699 - DNA, 25 bp, Mus musculus
tcctgcagctgttccctgagaactc

SEQ ID NO: 777700 - DNA, 25 bp, Mus musculus
tcctgcagctttacaaagtggaaag

SEQ ID NO: 777701 - DNA, 25 bp, Mus musculus
tcctgcagcttttcaaagtggaaag

SEQ ID NO: 777702 - DNA, 25 bp, Mus musculus
tcctgcagtcctcggaaactcagct

SEQ ID NO: 777703 - DNA, 25 bp, Mus musculus
tcctgcagtcctgggaaactcagct

SEQ ID NO: 777704 - DNA, 25 bp, Mus musculus
tcctgcatcgttctgggctgaccct

SEQ ID NO: 777705 - DNA, 25 bp, Mus musculus
tcctgcatcgttgtgggctgaccct

SEQ ID NO: 777706 - DNA, 25 bp, Mus musculus
tcctgcatgccaacgtggtggttta

SEQ ID NO: 777707 - DNA, 25 bp, Mus musculus
tcctgcatgccatcgtggtggttta

SEQ ID NO: 777708 - DNA, 25 bp, Mus musculus
tcctgcatgcgtatgtggaactgca

SEQ ID NO: 777709 - DNA, 25 bp, Mus musculus
tcctgcatgcgtttgtggaactgca

SEQ ID NO: 777710 - DNA, 25 bp, Mus musculus
tcctgcattaaacacgtggccatca

SEQ ID NO: 777711 - DNA, 25 bp, Mus musculus
tcctgcattaaagacgtggccatca

SEQ ID NO: 777712 - DNA, 25 bp, Mus musculus
tcctgcattctgagtacccatctac

SEQ ID NO: 777713 - DNA, 25 bp, Mus musculus
tcctgcattctgtgtacccatctac

SEQ ID NO: 777714 - DNA, 25 bp, Mus musculus
tcctgcattgctacatcagtacccg

SEQ ID NO: 777715 - DNA, 25 bp, Mus musculus
tcctgcattgcttcatcagtacccg

SEQ ID NO: 777716 - DNA, 25 bp, Mus musculus
tcctgccaacatcgagtctataaat

SEQ ID NO: 777717 - DNA, 25 bp, Mus musculus
tcctgccaacatggagtctataaat

SEQ ID NO: 777718 - DNA, 25 bp, Mus musculus
tcctgccaacgtacactatctgtgc

SEQ ID NO: 777719 - DNA, 25 bp, Mus musculus
tcctgccaacgttcactatctgtgc

SEQ ID NO: 777720 - DNA, 25 bp, Mus musculus
tcctgccaattacgtcaaagtcatt

SEQ ID NO: 777721 - DNA, 25 bp, Mus musculus
tcctgccaattaggtcaaagtcatt

SEQ ID NO: 777722 - DNA, 25 bp, Mus musculus
tcctgccactggagtactgccatgt

SEQ ID NO: 777723 - DNA, 25 bp, Mus musculus
tcctgccactggtgtactgccatgt

SEQ ID NO: 777724 - DNA, 25 bp, Mus musculus
tcctgccacttcattgccaccaagt

SEQ ID NO: 777725 - DNA, 25 bp, Mus musculus
tcctgccacttctttgccaccaagt

SEQ ID NO: 777726 - DNA, 25 bp, Mus musculus
tcctgccagaatatctacaaagatt

SEQ ID NO: 777727 - DNA, 25 bp, Mus musculus
tcctgccagaatttctacaaagatt

SEQ ID NO: 777728 - DNA, 25 bp, Mus musculus
tcctgccagagccactgactaactg

SEQ ID NO: 777729 - DNA, 25 bp, Mus musculus
tcctgccagagcgactgactaactg

SEQ ID NO: 777730 - DNA, 25 bp, Mus musculus
tcctgccataacaccttgggttcct

SEQ ID NO: 777731 - DNA, 25 bp, Mus musculus
tcctgccataactccttgggttcct

SEQ ID NO: 777732 - DNA, 25 bp, Mus musculus
tcctgccatagaatatacaagacac

SEQ ID NO: 777733 - DNA, 25 bp, Mus musculus
tcctgccatagattatacaagacac

SEQ ID NO: 777734 - DNA, 25 bp, Mus musculus
tcctgcccaaatcggaagtttatct

SEQ ID NO: 777735 - DNA, 25 bp, Mus musculus
tcctgcccaaatgggaagtttatct

SEQ ID NO: 777736 - DNA, 25 bp, Mus musculus
tcctgcccaattatgctgagtgctg

SEQ ID NO: 777737 - DNA, 25 bp, Mus musculus
tcctgcccaattttgctgagtgctg

SEQ ID NO: 777738 - DNA, 25 bp, Mus musculus
tcctgcccagggactagatacattt

SEQ ID NO: 777739 - DNA, 25 bp, Mus musculus
tcctgcccagggtctagatacattt

SEQ ID NO: 777740 - DNA, 25 bp, Mus musculus
tcctgcccatggatgtatagtagct

SEQ ID NO: 777741 - DNA, 25 bp, Mus musculus
tcctgcccatggttgtatagtagct

SEQ ID NO: 777742 - DNA, 25 bp, Mus musculus
tcctgccccacaacagaagactgtg

SEQ ID NO: 777743 - DNA, 25 bp, Mus musculus
tcctgccccacatcagaagactgtg

SEQ ID NO: 777744 - DNA, 25 bp, Mus musculus
tcctgcccgcggagggccgcgttta

SEQ ID NO: 777745 - DNA, 25 bp, Mus musculus
tcctgcccgcggtgggccgcgttta

SEQ ID NO: 777746 - DNA, 25 bp, Mus musculus
tcctgccctacaacaggctgtaagg

SEQ ID NO: 777747 - DNA, 25 bp, Mus musculus
tcctgccctacatcaggctgtaagg

SEQ ID NO: 777748 - DNA, 25 bp, Mus musculus
tcctgccctcttaataatctgccag

SEQ ID NO: 777749 - DNA, 25 bp, Mus musculus
tcctgccctctttataatctgccag

SEQ ID NO: 777750 - DNA, 25 bp, Mus musculus
tcctgccctggaaatggaagctgtc

SEQ ID NO: 777751 - DNA, 25 bp, Mus musculus
tcctgccctggatatggaagctgtc

SEQ ID NO: 777752 - DNA, 25 bp, Mus musculus
tcctgccgaaaacccagttgggaat

SEQ ID NO: 777753 - DNA, 25 bp, Mus musculus
tcctgccgaaaagccagttgggaat

SEQ ID NO: 777754 - DNA, 25 bp, Mus musculus
tcctgccgcagcactgagaggacta

SEQ ID NO: 777755 - DNA, 25 bp, Mus musculus
tcctgccgcagctctgagaggacta

SEQ ID NO: 777756 - DNA, 25 bp, Mus musculus
tcctgccggtcaagcagacctgttg

SEQ ID NO: 777757 - DNA, 25 bp, Mus musculus
tcctgccggtcatgcagacctgttg

SEQ ID NO: 777758 - DNA, 25 bp, Mus musculus
tcctgccggtgcacgtgtcagtgag

SEQ ID NO: 777759 - DNA, 25 bp, Mus musculus
tcctgccggtgctcgtgtcagtgag

SEQ ID NO: 777760 - DNA, 25 bp, Mus musculus
tcctgccgtgtgctatcggataaag

SEQ ID NO: 777761 - DNA, 25 bp, Mus musculus
tcctgccgtgtggtatcggataaag

SEQ ID NO: 777762 - DNA, 25 bp, Mus musculus
tcctgcctgactcctgagcgactgg

SEQ ID NO: 777763 - DNA, 25 bp, Mus musculus
tcctgcctgactgctgagcgactgg

SEQ ID NO: 777764 - DNA, 25 bp, Mus musculus
tcctgcctgtccatcggaatcagca

SEQ ID NO: 777765 - DNA, 25 bp, Mus musculus
tcctgcctgtccttcggaatcagca

SEQ ID NO: 777766 - DNA, 25 bp, Mus musculus
tcctgccttgataaacttggtgacc

SEQ ID NO: 777767 - DNA, 25 bp, Mus musculus
tcctgccttgattaacttggtgacc

SEQ ID NO: 777768 - DNA, 25 bp, Mus musculus
tcctgcgaaagcatgggacctgcac

SEQ ID NO: 777769 - DNA, 25 bp, Mus musculus
tcctgcgaaagcttgggacctgcac

SEQ ID NO: 777770 - DNA, 25 bp, Mus musculus
tcctgcgacagacgcttcacaagga

SEQ ID NO: 777771 - DNA, 25 bp, Mus musculus
tcctgcgacagaggcttcacaagga

SEQ ID NO: 777772 - DNA, 25 bp, Mus musculus
tcctgcgagtgcaggaatggctgct

SEQ ID NO: 777773 - DNA, 25 bp, Mus musculus
tcctgcgagtgctggaatggctgct

SEQ ID NO: 777774 - DNA, 25 bp, Mus musculus
tcctgcgagtttagccatggcgctc

SEQ ID NO: 777775 - DNA, 25 bp, Mus musculus
tcctgcgagttttgccatggcgctc

SEQ ID NO: 777776 - DNA, 25 bp, Mus musculus
tcctgcgcaaagcagacatgctcga

SEQ ID NO: 777777 - DNA, 25 bp, Mus musculus
tcctgcgcaaaggagacatgctcga

SEQ ID NO: 777778 - DNA, 25 bp, Mus musculus
tcctgcgcattgcattttactccag

SEQ ID NO: 777779 - DNA, 25 bp, Mus musculus
tcctgcgcattggattttactccag

SEQ ID NO: 777780 - DNA, 25 bp, Mus musculus
tcctgcgcgccacaatgagctccag

SEQ ID NO: 777781 - DNA, 25 bp, Mus musculus
tcctgcgcgccagaatgagctccag

SEQ ID NO: 777782 - DNA, 25 bp, Mus musculus
tcctgcggaactatagggcccggct

SEQ ID NO: 777783 - DNA, 25 bp, Mus musculus
tcctgcggaactttagggcccggct

SEQ ID NO: 777784 - DNA, 25 bp, Mus musculus
tcctgcggagaaaggtcacctacag

SEQ ID NO: 777785 - DNA, 25 bp, Mus musculus
tcctgcggagaatggtcacctacag

SEQ ID NO: 777786 - DNA, 25 bp, Mus musculus
tcctgcggatatagacagcacttcc

SEQ ID NO: 777787 - DNA, 25 bp, Mus musculus
tcctgcggatattgacagcacttcc

SEQ ID NO: 777788 - DNA, 25 bp, Mus musculus
tcctgcggatgaatcgcgctgcctc

SEQ ID NO: 777789 - DNA, 25 bp, Mus musculus
tcctgcggatgattcgcgctgcctc

SEQ ID NO: 777790 - DNA, 25 bp, Mus musculus
tcctgcggcttgagttctgttgtca

SEQ ID NO: 777791 - DNA, 25 bp, Mus musculus
tcctgcggcttgtgttctgttgtca

SEQ ID NO: 777792 - DNA, 25 bp, Mus musculus
tcctgcgggtgcagagccggtctct

SEQ ID NO: 777793 - DNA, 25 bp, Mus musculus
tcctgcgggtgctgagccggtctct

SEQ ID NO: 777794 - DNA, 25 bp, Mus musculus
tcctgcgtcgaaaggatggcactgt

SEQ ID NO: 777795 - DNA, 25 bp, Mus musculus
tcctgcgtcgaatggatggcactgt

SEQ ID NO: 777796 - DNA, 25 bp, Mus musculus
tcctgcgtcttcagccccaggtgga

SEQ ID NO: 777797 - DNA, 25 bp, Mus musculus
tcctgcgtcttctgccccaggtgga

SEQ ID NO: 777798 - DNA, 25 bp, Mus musculus
tcctgcgtgtctagcagtggtgccc

SEQ ID NO: 777799 - DNA, 25 bp, Mus musculus
tcctgcgtgtcttgcagtggtgccc

SEQ ID NO: 777800 - DNA, 25 bp, Mus musculus
tcctgcgttaccaggtgtgggttct

SEQ ID NO: 777801 - DNA, 25 bp, Mus musculus
tcctgcgttacctggtgtgggttct

SEQ ID NO: 777802 - DNA, 25 bp, Mus musculus
tcctgcgttgtaagactgtcttcca

SEQ ID NO: 777803 - DNA, 25 bp, Mus musculus
tcctgcgttgtatgactgtcttcca

SEQ ID NO: 777804 - DNA, 25 bp, Mus musculus
tcctgcgtttgtacgtgcaccgggt

SEQ ID NO: 777805 - DNA, 25 bp, Mus musculus
tcctgcgtttgttcgtgcaccgggt

SEQ ID NO: 777806 - DNA, 25 bp, Mus musculus
tcctgctaagaaccacctgcagcaa

SEQ ID NO: 777807 - DNA, 25 bp, Mus musculus
tcctgctaagaagcacctgcagcaa

SEQ ID NO: 777808 - DNA, 25 bp, Mus musculus
tcctgctaatggagcgtgacggccg

SEQ ID NO: 777809 - DNA, 25 bp, Mus musculus
tcctgctaatggtgcgtgacggccg

SEQ ID NO: 777810 - DNA, 25 bp, Mus musculus
tcctgctactttcgaaggtcagccc

SEQ ID NO: 777811 - DNA, 25 bp, Mus musculus
tcctgctactttggaaggtcagccc

SEQ ID NO: 777812 - DNA, 25 bp, Mus musculus
tcctgctagccaagggtgagctgcc

SEQ ID NO: 777813 - DNA, 25 bp, Mus musculus
tcctgctagccatgggtgagctgcc

SEQ ID NO: 777814 - DNA, 25 bp, Mus musculus
tcctgctaggcaatatattcattac

SEQ ID NO: 777815 - DNA, 25 bp, Mus musculus
tcctgctaggcattatattcattac

SEQ ID NO: 777816 - DNA, 25 bp, Mus musculus
tcctgctagggcaggtgacaatgtc

SEQ ID NO: 777817 - DNA, 25 bp, Mus musculus
tcctgctagggctggtgacaatgtc

SEQ ID NO: 777818 - DNA, 25 bp, Mus musculus
tcctgctagtctaaagagagtggct

SEQ ID NO: 777819 - DNA, 25 bp, Mus musculus
tcctgctagtcttaagagagtggct

SEQ ID NO: 777820 - DNA, 25 bp, Mus musculus
tcctgctcatcaagaccactcaaaa

SEQ ID NO: 777821 - DNA, 25 bp, Mus musculus
tcctgctcatcatgaccactcaaaa

SEQ ID NO: 777822 - DNA, 25 bp, Mus musculus
tcctgctcatcccactgaaggacaa

SEQ ID NO: 777823 - DNA, 25 bp, Mus musculus
tcctgctcatccgactgaaggacaa

SEQ ID NO: 777824 - DNA, 25 bp, Mus musculus
tcctgctcatttaccacaaggctgc

SEQ ID NO: 777825 - DNA, 25 bp, Mus musculus
tcctgctcattttccacaaggctgc

SEQ ID NO: 777826 - DNA, 25 bp, Mus musculus
tcctgctcccagcagttcatgcaga

SEQ ID NO: 777827 - DNA, 25 bp, Mus musculus
tcctgctcccaggagttcatgcaga

SEQ ID NO: 777828 - DNA, 25 bp, Mus musculus
tcctgctcccttccaactgagtgga

SEQ ID NO: 777829 - DNA, 25 bp, Mus musculus
tcctgctcccttgcaactgagtgga

SEQ ID NO: 777830 - DNA, 25 bp, Mus musculus
tcctgctccgttatcttagcgcgaa

SEQ ID NO: 777831 - DNA, 25 bp, Mus musculus
tcctgctccgttttcttagcgcgaa

SEQ ID NO: 777832 - DNA, 25 bp, Mus musculus
tcctgctcctacctgggatgggtac

SEQ ID NO: 777833 - DNA, 25 bp, Mus musculus
tcctgctcctacgtgggatgggtac

SEQ ID NO: 777834 - DNA, 25 bp, Mus musculus
tcctgctcctgcagattggacaact

SEQ ID NO: 777835 - DNA, 25 bp, Mus musculus
tcctgctcctgctgattggacaact

SEQ ID NO: 777836 - DNA, 25 bp, Mus musculus
tcctgctcgaggatctaagcgggaa

SEQ ID NO: 777837 - DNA, 25 bp, Mus musculus
tcctgctcgaggttctaagcgggaa

SEQ ID NO: 777838 - DNA, 25 bp, Mus musculus
tcctgctctagtagtcttagacccc

SEQ ID NO: 777839 - DNA, 25 bp, Mus musculus
tcctgctctagttgtcttagacccc

SEQ ID NO: 777840 - DNA, 25 bp, Mus musculus
tcctgctctcggcacaggattgatg

SEQ ID NO: 777841 - DNA, 25 bp, Mus musculus
tcctgctctcgggacaggattgatg

SEQ ID NO: 777842 - DNA, 25 bp, Mus musculus
tcctgctcttcgagctgctgacagg

SEQ ID NO: 777843 - DNA, 25 bp, Mus musculus
tcctgctcttcgtgctgctgacagg

SEQ ID NO: 777844 - DNA, 25 bp, Mus musculus
tcctgctcttgcctgtgaacaatgg

SEQ ID NO: 777845 - DNA, 25 bp, Mus musculus
tcctgctcttgcgtgtgaacaatgg

SEQ ID NO: 777846 - DNA, 25 bp, Mus musculus
tcctgctgactaactttcagggcaa

SEQ ID NO: 777847 - DNA, 25 bp, Mus musculus
tcctgctgactatctttcagggcaa

SEQ ID NO: 777848 - DNA, 25 bp, Mus musculus
tcctgctgatataagattgacatcc

SEQ ID NO: 777849 - DNA, 25 bp, Mus musculus
tcctgctgatattagattgacatcc

SEQ ID NO: 777850 - DNA, 25 bp, Mus musculus
tcctgctgatccagctgagtgccct

SEQ ID NO: 777851 - DNA, 25 bp, Mus musculus
tcctgctgatcctgctgagtgccct

SEQ ID NO: 777852 - DNA, 25 bp, Mus musculus
tcctgctgcaaaagctcgctcggct

SEQ ID NO: 777853 - DNA, 25 bp, Mus musculus
tcctgctgcaaatgctcgctcggct

SEQ ID NO: 777854 - DNA, 25 bp, Mus musculus
tcctgctgcaggactttctgtggag

SEQ ID NO: 777855 - DNA, 25 bp, Mus musculus
tcctgctgcaggagcacatacggga

SEQ ID NO: 777856 - DNA, 25 bp, Mus musculus
tcctgctgcaggtctttctgtggag

SEQ ID NO: 777857 - DNA, 25 bp, Mus musculus
tcctgctgcaggtgcacatacggga

SEQ ID NO: 777858 - DNA, 25 bp, Mus musculus
tcctgctgcatcagagcctgtgata

SEQ ID NO: 777859 - DNA, 25 bp, Mus musculus
tcctgctgcatctgagcctgtgata

SEQ ID NO: 777860 - DNA, 25 bp, Mus musculus
tcctgctgccatcgcgctgggtagc

SEQ ID NO: 777861 - DNA, 25 bp, Mus musculus
tcctgctgccatggcgctgggtagc

SEQ ID NO: 777862 - DNA, 25 bp, Mus musculus
tcctgctgcccgacaaaaagaagaa

SEQ ID NO: 777863 - DNA, 25 bp, Mus musculus
tcctgctgcccgtcaaaaagaagaa

SEQ ID NO: 777864 - DNA, 25 bp, Mus musculus
tcctgctgccgaatcttagatgatg

SEQ ID NO: 777865 - DNA, 25 bp, Mus musculus
tcctgctgccgattcttagatgatg

SEQ ID NO: 777866 - DNA, 25 bp, Mus musculus
tcctgctgctctaagggaccggcct

SEQ ID NO: 777867 - DNA, 25 bp, Mus musculus
tcctgctgctcttagggaccggcct

SEQ ID NO: 777868 - DNA, 25 bp, Mus musculus
tcctgctgctggactataagcagag

SEQ ID NO: 777869 - DNA, 25 bp, Mus musculus
tcctgctgctggtctataagcagag

SEQ ID NO: 777870 - DNA, 25 bp, Mus musculus
tcctgctgcttacctggtgaatgaa

SEQ ID NO: 777871 - DNA, 25 bp, Mus musculus
tcctgctgcttagctggtgaatgaa

SEQ ID NO: 777872 - DNA, 25 bp, Mus musculus
tcctgctggaaaaccctgatgaggc

SEQ ID NO: 777873 - DNA, 25 bp, Mus musculus
tcctgctggaaatccctgatgaggc

SEQ ID NO: 777874 - DNA, 25 bp, Mus musculus
tcctgctggaatacaaaatcctttg

SEQ ID NO: 777875 - DNA, 25 bp, Mus musculus
tcctgctggaattcaaaatcctttg

SEQ ID NO: 777876 - DNA, 25 bp, Mus musculus
tcctgctggagaagtccgccgtggt

SEQ ID NO: 777877 - DNA, 25 bp, Mus musculus
tcctgctggagatgtccgccgtggt

SEQ ID NO: 777878 - DNA, 25 bp, Mus musculus
tcctgctgggtgaaggtctaggtct

SEQ ID NO: 777879 - DNA, 25 bp, Mus musculus
tcctgctgggtgtaggtctaggtct

SEQ ID NO: 777880 - DNA, 25 bp, Mus musculus
tcctgctggtgacgtctcggtcgcg

SEQ ID NO: 777881 - DNA, 25 bp, Mus musculus
tcctgctggtgaggtctcggtcgcg

SEQ ID NO: 777882 - DNA, 25 bp, Mus musculus
tcctgctggtgcatgtatgcacacg

SEQ ID NO: 777883 - DNA, 25 bp, Mus musculus
tcctgctggtgcttgtatgcacacg

SEQ ID NO: 777884 - DNA, 25 bp, Mus musculus
tcctgctgtcgcaggtcctctttct

SEQ ID NO: 777885 - DNA, 25 bp, Mus musculus
tcctgctgtcgctggtcctctttct

SEQ ID NO: 777886 - DNA, 25 bp, Mus musculus
tcctgctgtgaacgtgaagagcccc

SEQ ID NO: 777887 - DNA, 25 bp, Mus musculus
tcctgctgtgaaggtgaagagcccc

SEQ ID NO: 777888 - DNA, 25 bp, Mus musculus
tcctgctgtgttagagtaggtgccc

SEQ ID NO: 777889 - DNA, 25 bp, Mus musculus
tcctgctgtgtttgagtaggtgccc

SEQ ID NO: 777890 - DNA, 25 bp, Mus musculus
tcctgcttagtacagattgcctcag

SEQ ID NO: 777891 - DNA, 25 bp, Mus musculus
tcctgcttagtactgtcctggagct

SEQ ID NO: 777892 - DNA, 25 bp, Mus musculus
tcctgcttagtagagattgcctcag

SEQ ID NO: 777893 - DNA, 25 bp, Mus musculus
tcctgcttagtagtgtcctggagct

SEQ ID NO: 777894 - DNA, 25 bp, Mus musculus
tcctgcttatacaactgaaatcaag

SEQ ID NO: 777895 - DNA, 25 bp, Mus musculus
tcctgcttatactactgaaatcaag

SEQ ID NO: 777896 - DNA, 25 bp, Mus musculus
tcctgcttcaaacagagcaagaaca

SEQ ID NO: 777897 - DNA, 25 bp, Mus musculus
tcctgcttcaaagagagcaagaaca

SEQ ID NO: 777898 - DNA, 25 bp, Mus musculus
tcctgcttctgcatttcgtggcagc

SEQ ID NO: 777899 - DNA, 25 bp, Mus musculus
tcctgcttctgcttttcgtggcagc

SEQ ID NO: 777900 - DNA, 25 bp, Mus musculus
tcctgcttgattagtgtggcacgaa

SEQ ID NO: 777901 - DNA, 25 bp, Mus musculus
tcctgcttgattccttcagcgtgcc

SEQ ID NO: 777902 - DNA, 25 bp, Mus musculus
tcctgcttgattgcttcagcgtgcc

SEQ ID NO: 777903 - DNA, 25 bp, Mus musculus
tcctgcttgatttgtgtggcacgaa

SEQ ID NO: 777904 - DNA, 25 bp, Mus musculus
tcctgcttggtcacaggtggccccg

SEQ ID NO: 777905 - DNA, 25 bp, Mus musculus
tcctgcttggtctcaggtggccccg

SEQ ID NO: 777906 - DNA, 25 bp, Mus musculus
tcctgctttctcacttctgcatgaa

SEQ ID NO: 777907 - DNA, 25 bp, Mus musculus
tcctgctttctctcttctgcatgaa

SEQ ID NO: 777908 - DNA, 25 bp, Mus musculus
tcctgctttggacaatcgagcagag

SEQ ID NO: 777909 - DNA, 25 bp, Mus musculus
tcctgctttggagaatcgagcagag

SEQ ID NO: 777910 - DNA, 25 bp, Mus musculus
tcctgcttttccaatcggagttgca

SEQ ID NO: 777911 - DNA, 25 bp, Mus musculus
tcctgcttttcctatcggagttgca

SEQ ID NO: 777912 - DNA, 25 bp, Mus musculus
tcctggaaaacactcccgagaacca

SEQ ID NO: 777913 - DNA, 25 bp, Mus musculus
tcctggaaaacagtcccgagaacca

SEQ ID NO: 777914 - DNA, 25 bp, Mus musculus
tcctggaaaactacaggtcttacct

SEQ ID NO: 777915 - DNA, 25 bp, Mus musculus
tcctggaaaacttcaggtcttacct

SEQ ID NO: 777916 - DNA, 25 bp, Mus musculus
tcctggaaacatcctgagaacaccc

SEQ ID NO: 777917 - DNA, 25 bp, Mus musculus
tcctggaaacatgctgagaacaccc

SEQ ID NO: 777918 - DNA, 25 bp, Mus musculus
tcctggaaaggcatcagagcaaagc

SEQ ID NO: 777919 - DNA, 25 bp, Mus musculus
tcctggaaaggcttcagagcaaagc

SEQ ID NO: 777920 - DNA, 25 bp, Mus musculus
tcctggaaatgtctctacgatacag

SEQ ID NO: 777921 - DNA, 25 bp, Mus musculus
tcctggaaatgtgtctacgatacag

SEQ ID NO: 777922 - DNA, 25 bp, Mus musculus
tcctggaactgaagggcctgcgcac

SEQ ID NO: 777923 - DNA, 25 bp, Mus musculus
tcctggaactgacactggctgaagc

SEQ ID NO: 777924 - DNA, 25 bp, Mus musculus
tcctggaactgactgaattaaaatt

SEQ ID NO: 777925 - DNA, 25 bp, Mus musculus
tcctggaactgagactggctgaagc

SEQ ID NO: 777926 - DNA, 25 bp, Mus musculus
tcctggaactgagtgaattaaaatt

SEQ ID NO: 777927 - DNA, 25 bp, Mus musculus
tcctggaactgatgggcctgcgcac

SEQ ID NO: 777928 - DNA, 25 bp, Mus musculus
tcctggaacttgctgcctgaggccc

SEQ ID NO: 777929 - DNA, 25 bp, Mus musculus
tcctggaacttgcttgactccattt

SEQ ID NO: 777930 - DNA, 25 bp, Mus musculus
tcctggaacttggtgcctgaggccc

SEQ ID NO: 777931 - DNA, 25 bp, Mus musculus
tcctggaacttggttgactccattt

SEQ ID NO: 777932 - DNA, 25 bp, Mus musculus
tcctggaagacaattctgctttgga

SEQ ID NO: 777933 - DNA, 25 bp, Mus musculus
tcctggaagacatttctgctttgga

SEQ ID NO: 777934 - DNA, 25 bp, Mus musculus
tcctggaagaccacaataaacagct

SEQ ID NO: 777935 - DNA, 25 bp, Mus musculus
tcctggaagacctcaataaacagct

SEQ ID NO: 777936 - DNA, 25 bp, Mus musculus
tcctggaagactagagggctgatcc

SEQ ID NO: 777937 - DNA, 25 bp, Mus musculus
tcctggaagacttgagggctgatcc

SEQ ID NO: 777938 - DNA, 25 bp, Mus musculus
tcctggaagagtcagacattgacag

SEQ ID NO: 777939 - DNA, 25 bp, Mus musculus
tcctggaagagtgagacattgacag

SEQ ID NO: 777940 - DNA, 25 bp, Mus musculus
tcctggaagatgataggcatgcact

SEQ ID NO: 777941 - DNA, 25 bp, Mus musculus
tcctggaagatgttaggcatgcact

SEQ ID NO: 777942 - DNA, 25 bp, Mus musculus
tcctggaagccaacgggacacagtt

SEQ ID NO: 777943 - DNA, 25 bp, Mus musculus
tcctggaagccatcgggacacagtt

SEQ ID NO: 777944 - DNA, 25 bp, Mus musculus
tcctggaagcctcttgtcagaactc

SEQ ID NO: 777945 - DNA, 25 bp, Mus musculus
tcctggaagcctgttgtcagaactc

SEQ ID NO: 777946 - DNA, 25 bp, Mus musculus
tcctggaaggaaagggcagctgcct

SEQ ID NO: 777947 - DNA, 25 bp, Mus musculus
tcctggaaggaaatctcaagtttca

SEQ ID NO: 777948 - DNA, 25 bp, Mus musculus
tcctggaaggaatgggcagctgcct

SEQ ID NO: 777949 - DNA, 25 bp, Mus musculus
tcctggaaggaattctcaagtttca

SEQ ID NO: 777950 - DNA, 25 bp, Mus musculus
tcctggaaggcaaatgaatgcatac

SEQ ID NO: 777951 - DNA, 25 bp, Mus musculus
tcctggaaggcatatgaatgcatac

SEQ ID NO: 777952 - DNA, 25 bp, Mus musculus
tcctggaagggtaagggccaagcaa

SEQ ID NO: 777953 - DNA, 25 bp, Mus musculus
tcctggaagggttagggccaagcaa

SEQ ID NO: 777954 - DNA, 25 bp, Mus musculus
tcctggaagtaaaacttactggctc

SEQ ID NO: 777955 - DNA, 25 bp, Mus musculus
tcctggaagtaatacttactggctc

SEQ ID NO: 777956 - DNA, 25 bp, Mus musculus
tcctggaatcccacctgtggtgtac

SEQ ID NO: 777957 - DNA, 25 bp, Mus musculus
tcctggaatccctcctgtggtgtac

SEQ ID NO: 777958 - DNA, 25 bp, Mus musculus
tcctggaatgtcatgacccactacc

SEQ ID NO: 777959 - DNA, 25 bp, Mus musculus
tcctggaatgtcttgacccactacc

SEQ ID NO: 777960 - DNA, 25 bp, Mus musculus
tcctggaattctaatctgagtgggc

SEQ ID NO: 777961 - DNA, 25 bp, Mus musculus
tcctggaattcttatctgagtgggc

SEQ ID NO: 777962 - DNA, 25 bp, Mus musculus
tcctggacaacactgtccacctgtt

SEQ ID NO: 777963 - DNA, 25 bp, Mus musculus
tcctggacaacagtgtccacctgtt

SEQ ID NO: 777964 - DNA, 25 bp, Mus musculus
tcctggacaagtcgcccagtatcac

SEQ ID NO: 777965 - DNA, 25 bp, Mus musculus
tcctggacaagtggcccagtatcac

SEQ ID NO: 777966 - DNA, 25 bp, Mus musculus
tcctggacaatactcagcagttgaa

SEQ ID NO: 777967 - DNA, 25 bp, Mus musculus
tcctggacaatagtcagcagttgaa

SEQ ID NO: 777968 - DNA, 25 bp, Mus musculus
tcctggacaccgagaagaacttctg

SEQ ID NO: 777969 - DNA, 25 bp, Mus musculus
tcctggacaccgtgaagaacttctg

SEQ ID NO: 777970 - DNA, 25 bp, Mus musculus
tcctggacaggtaccacttgtcttc

SEQ ID NO: 777971 - DNA, 25 bp, Mus musculus
tcctggacaggttccacttgtcttc

SEQ ID NO: 777972 - DNA, 25 bp, Mus musculus
tcctggacagtgacgagcggcccag

SEQ ID NO: 777973 - DNA, 25 bp, Mus musculus
tcctggacagtgtcgagcggcccag

SEQ ID NO: 777974 - DNA, 25 bp, Mus musculus
tcctggacatcgctgaatgcctgac

SEQ ID NO: 777975 - DNA, 25 bp, Mus musculus
tcctggacatcggtgaatgcctgac

SEQ ID NO: 777976 - DNA, 25 bp, Mus musculus
tcctggaccaaactggcaccaagat

SEQ ID NO: 777977 - DNA, 25 bp, Mus musculus
tcctggaccaaagtggcaccaagat

SEQ ID NO: 777978 - DNA, 25 bp, Mus musculus
tcctggaccacaacagaaaatattc

SEQ ID NO: 777979 - DNA, 25 bp, Mus musculus
tcctggaccacatcagaaaatattc

SEQ ID NO: 777980 - DNA, 25 bp, Mus musculus
tcctggaccagtacacgaagcatca

SEQ ID NO: 777981 - DNA, 25 bp, Mus musculus
tcctggaccagttcacgaagcatca

SEQ ID NO: 777982 - DNA, 25 bp, Mus musculus
tcctggacccctcaggactggaagg

SEQ ID NO: 777983 - DNA, 25 bp, Mus musculus
tcctggacccctgaggactggaagg

SEQ ID NO: 777984 - DNA, 25 bp, Mus musculus
tcctggaccgcgaatgacatagcct

SEQ ID NO: 777985 - DNA, 25 bp, Mus musculus
tcctggaccgcgtatgacatagcct

SEQ ID NO: 777986 - DNA, 25 bp, Mus musculus
tcctggaccggaagcgctcctttgg

SEQ ID NO: 777987 - DNA, 25 bp, Mus musculus
tcctggaccggatgcgctcctttgg

SEQ ID NO: 777988 - DNA, 25 bp, Mus musculus
tcctggacctggacgggaaggactc

SEQ ID NO: 777989 - DNA, 25 bp, Mus musculus
tcctggacctggtcgggaaggactc

SEQ ID NO: 777990 - DNA, 25 bp, Mus musculus
tcctggaccttcaacttcatctgtc

SEQ ID NO: 777991 - DNA, 25 bp, Mus musculus
tcctggaccttctacttcatctgtc

SEQ ID NO: 777992 - DNA, 25 bp, Mus musculus
tcctggacgactagttgaaacttgg

SEQ ID NO: 777993 - DNA, 25 bp, Mus musculus
tcctggacgacttgttgaaacttgg

SEQ ID NO: 777994 - DNA, 25 bp, Mus musculus
tcctggacgagcagaacacaactgg

SEQ ID NO: 777995 - DNA, 25 bp, Mus musculus
tcctggacgagctgaacacaactgg

SEQ ID NO: 777996 - DNA, 25 bp, Mus musculus
tcctggacgccaaagtagacacttt

SEQ ID NO: 777997 - DNA, 25 bp, Mus musculus
tcctggacgccatagtagacacttt

SEQ ID NO: 777998 - DNA, 25 bp, Mus musculus
tcctggacgctgacagatacttctg

SEQ ID NO: 777999 - DNA, 25 bp, Mus musculus
tcctggacgctgtcagatacttctg

SEQ ID NO: 778000 - DNA, 25 bp, Mus musculus
tcctggacgggtaacctcagagctg

SEQ ID NO: 778001 - DNA, 25 bp, Mus musculus
tcctggacgggttacctcagagctg

SEQ ID NO: 778002 - DNA, 25 bp, Mus musculus
tcctggacgtcaaagggtacctgtc

SEQ ID NO: 778003 - DNA, 25 bp, Mus musculus
tcctggacgtcatagggtacctgtc

SEQ ID NO: 778004 - DNA, 25 bp, Mus musculus
tcctggactaaaagccggtaccctg

SEQ ID NO: 778005 - DNA, 25 bp, Mus musculus
tcctggactaaatgccggtaccctg

SEQ ID NO: 778006 - DNA, 25 bp, Mus musculus
tcctggactccacaatgaacggaca

SEQ ID NO: 778007 - DNA, 25 bp, Mus musculus
tcctggactccagaatgaacggaca

SEQ ID NO: 778008 - DNA, 25 bp, Mus musculus
tcctggactcgaattgggtcttggt

SEQ ID NO: 778009 - DNA, 25 bp, Mus musculus
tcctggactcgatttgggtcttggt

SEQ ID NO: 778010 - DNA, 25 bp, Mus musculus
tcctggactctgaagtaagcaaaag

SEQ ID NO: 778011 - DNA, 25 bp, Mus musculus
tcctggactctgtagtaagcaaaag

SEQ ID NO: 778012 - DNA, 25 bp, Mus musculus
tcctggagaacaaagcagggatctc

SEQ ID NO: 778013 - DNA, 25 bp, Mus musculus
tcctggagaacatagcagggatctc

SEQ ID NO: 778014 - DNA, 25 bp, Mus musculus
tcctggagaacgcagtcctgagcag

SEQ ID NO: 778015 - DNA, 25 bp, Mus musculus
tcctggagaacggagtcctgagcag

SEQ ID NO: 778016 - DNA, 25 bp, Mus musculus
tcctggagaactaggccgagtaggc

SEQ ID NO: 778017 - DNA, 25 bp, Mus musculus
tcctggagaacttggccgagtaggc

SEQ ID NO: 778018 - DNA, 25 bp, Mus musculus
tcctggagaatgaggctgtcagagc

SEQ ID NO: 778019 - DNA, 25 bp, Mus musculus
tcctggagaatgctgcaaagctctt

SEQ ID NO: 778020 - DNA, 25 bp, Mus musculus
tcctggagaatggtgcaaagctctt

SEQ ID NO: 778021 - DNA, 25 bp, Mus musculus
tcctggagaatgtggctgtcagagc

SEQ ID NO: 778022 - DNA, 25 bp, Mus musculus
tcctggagacccaggcaagccagga

SEQ ID NO: 778023 - DNA, 25 bp, Mus musculus
tcctggagaccctggcaagccagga

SEQ ID NO: 778024 - DNA, 25 bp, Mus musculus
tcctggagacggacaagcagaaact

SEQ ID NO: 778025 - DNA, 25 bp, Mus musculus
tcctggagacggtcaagcagaaact

SEQ ID NO: 778026 - DNA, 25 bp, Mus musculus
tcctggagagtaagatcttgctggg

SEQ ID NO: 778027 - DNA, 25 bp, Mus musculus
tcctggagagtatgatcttgctggg

SEQ ID NO: 778028 - DNA, 25 bp, Mus musculus
tcctggagatcaatgctggcatcct

SEQ ID NO: 778029 - DNA, 25 bp, Mus musculus
tcctggagatcattgctggcatcct

SEQ ID NO: 778030 - DNA, 25 bp, Mus musculus
tcctggagcacacaccgacaggcag

SEQ ID NO: 778031 - DNA, 25 bp, Mus musculus
tcctggagcacagaccgacaggcag

SEQ ID NO: 778032 - DNA, 25 bp, Mus musculus
tcctggagcaggacagcgtcctatt

SEQ ID NO: 778033 - DNA, 25 bp, Mus musculus
tcctggagcaggatagtgcccgaaa

SEQ ID NO: 778034 - DNA, 25 bp, Mus musculus
tcctggagcaggtcagcgtcctatt

SEQ ID NO: 778035 - DNA, 25 bp, Mus musculus
tcctggagcaggttagtgcccgaaa

SEQ ID NO: 778036 - DNA, 25 bp, Mus musculus
tcctggagccacacacggctggctg

SEQ ID NO: 778037 - DNA, 25 bp, Mus musculus
tcctggagccactcacggctggctg

SEQ ID NO: 778038 - DNA, 25 bp, Mus musculus
tcctggagcccaagcttcctgtgtg

SEQ ID NO: 778039 - DNA, 25 bp, Mus musculus
tcctggagcccatgcttcctgtgtg

SEQ ID NO: 778040 - DNA, 25 bp, Mus musculus
tcctggaggaccagggcccctcagg

SEQ ID NO: 778041 - DNA, 25 bp, Mus musculus
tcctggaggacctgggcccctcagg

SEQ ID NO: 778042 - DNA, 25 bp, Mus musculus
tcctggaggagaagtgtattgtaca

SEQ ID NO: 778043 - DNA, 25 bp, Mus musculus
tcctggaggagatgtgtattgtaca

SEQ ID NO: 778044 - DNA, 25 bp, Mus musculus
tcctggaggagtacttgagctccac

SEQ ID NO: 778045 - DNA, 25 bp, Mus musculus
tcctggaggagtcagcaacattcat

SEQ ID NO: 778046 - DNA, 25 bp, Mus musculus
tcctggaggagtgagcaacattcat

SEQ ID NO: 778047 - DNA, 25 bp, Mus musculus
tcctggaggagttcttgagctccac

SEQ ID NO: 778048 - DNA, 25 bp, Mus musculus
tcctggaggcagcatgactgtactt

SEQ ID NO: 778049 - DNA, 25 bp, Mus musculus
tcctggaggcaggatgactgtactt

SEQ ID NO: 778050 - DNA, 25 bp, Mus musculus
tcctggaggccgacaaccagaacct

SEQ ID NO: 778051 - DNA, 25 bp, Mus musculus
tcctggaggccgtcaaccagaacct

SEQ ID NO: 778052 - DNA, 25 bp, Mus musculus
tcctggaggcgaacacagtcgaaga

SEQ ID NO: 778053 - DNA, 25 bp, Mus musculus
tcctggaggcgatcacagtcgaaga

SEQ ID NO: 778054 - DNA, 25 bp, Mus musculus
tcctggaggcgcacagtcagaaacg

SEQ ID NO: 778055 - DNA, 25 bp, Mus musculus
tcctggaggcgctcagtcagaaacg

SEQ ID NO: 778056 - DNA, 25 bp, Mus musculus
tcctggaggcggcaaagcacaactt

SEQ ID NO: 778057 - DNA, 25 bp, Mus musculus
tcctggaggcgggaaagcacaactt

SEQ ID NO: 778058 - DNA, 25 bp, Mus musculus
tcctggagggccaagtagttcctgt

SEQ ID NO: 778059 - DNA, 25 bp, Mus musculus
tcctggagggcctagtagttcctgt

SEQ ID NO: 778060 - DNA, 25 bp, Mus musculus
tcctggagggtcatcagcagcatcg

SEQ ID NO: 778061 - DNA, 25 bp, Mus musculus
tcctggagggtcttcagcagcatcg

SEQ ID NO: 778062 - DNA, 25 bp, Mus musculus
tcctggaggtagaggcagccgtttt

SEQ ID NO: 778063 - DNA, 25 bp, Mus musculus
tcctggaggtagtggcagccgtttt

SEQ ID NO: 778064 - DNA, 25 bp, Mus musculus
tcctggaggttcataatggatcttg

SEQ ID NO: 778065 - DNA, 25 bp, Mus musculus
tcctggaggttcttaatggatcttg

SEQ ID NO: 778066 - DNA, 25 bp, Mus musculus
tcctggagtataaagacacctgcac

SEQ ID NO: 778067 - DNA, 25 bp, Mus musculus
tcctggagtatatagacacctgcac

SEQ ID NO: 778068 - DNA, 25 bp, Mus musculus
tcctggagtcggcttaaggcagacc

SEQ ID NO: 778069 - DNA, 25 bp, Mus musculus
tcctggagtcgggttaaggcagacc

SEQ ID NO: 778070 - DNA, 25 bp, Mus musculus
tcctggagttgtagaccgcctgaca

SEQ ID NO: 778071 - DNA, 25 bp, Mus musculus
tcctggagttgttgaccgcctgaca

SEQ ID NO: 778072 - DNA, 25 bp, Mus musculus
tcctggataaggacggccaggttcg

SEQ ID NO: 778073 - DNA, 25 bp, Mus musculus
tcctggataaggtcggccaggttcg

SEQ ID NO: 778074 - DNA, 25 bp, Mus musculus
tcctggatacaacactcggcacaac

SEQ ID NO: 778075 - DNA, 25 bp, Mus musculus
tcctggatacaagactcggcacaac

SEQ ID NO: 778076 - DNA, 25 bp, Mus musculus
tcctggataccacagaagacagctt

SEQ ID NO: 778077 - DNA, 25 bp, Mus musculus
tcctggataccagagaagacagctt

SEQ ID NO: 778078 - DNA, 25 bp, Mus musculus
tcctggatgacacgcgcaaatggtg

SEQ ID NO: 778079 - DNA, 25 bp, Mus musculus
tcctggatgacaggcgcaaatggtg

SEQ ID NO: 778080 - DNA, 25 bp, Mus musculus
tcctggatgacgaatggaaaagcag

SEQ ID NO: 778081 - DNA, 25 bp, Mus musculus
tcctggatgacgtatggaaaagcag

SEQ ID NO: 778082 - DNA, 25 bp, Mus musculus
tcctggatgaggaatgcggcagcca

SEQ ID NO: 778083 - DNA, 25 bp, Mus musculus
tcctggatgaggtatgcggcagcca

SEQ ID NO: 778084 - DNA, 25 bp, Mus musculus
tcctggatgccaagatttgagaccc

SEQ ID NO: 778085 - DNA, 25 bp, Mus musculus
tcctggatgccatgatttgagaccc

SEQ ID NO: 778086 - DNA, 25 bp, Mus musculus
tcctggatgcccaattttttactgc

SEQ ID NO: 778087 - DNA, 25 bp, Mus musculus
tcctggatgccctattttttactgc

SEQ ID NO: 778088 - DNA, 25 bp, Mus musculus
tcctggatggaacgactcgggcact

SEQ ID NO: 778089 - DNA, 25 bp, Mus musculus
tcctggatggaaggactcgggcact

SEQ ID NO: 778090 - DNA, 25 bp, Mus musculus
tcctggatggagatgctaagactgg

SEQ ID NO: 778091 - DNA, 25 bp, Mus musculus
tcctggatggagttgctaagactgg

SEQ ID NO: 778092 - DNA, 25 bp, Mus musculus
tcctggatgggaaccccacgtttgc

SEQ ID NO: 778093 - DNA, 25 bp, Mus musculus
tcctggatgggatccccacgtttgc

SEQ ID NO: 778094 - DNA, 25 bp, Mus musculus
tcctggatggtgagagaaccttccg

SEQ ID NO: 778095 - DNA, 25 bp, Mus musculus
tcctggatggtgtgagaaccttccg

SEQ ID NO: 778096 - DNA, 25 bp, Mus musculus
tcctggatgtaaccacaggattgag

SEQ ID NO: 778097 - DNA, 25 bp, Mus musculus
tcctggatgtaagcacaggattgag

SEQ ID NO: 778098 - DNA, 25 bp, Mus musculus
tcctggatgttaagacacctatgcg

SEQ ID NO: 778099 - DNA, 25 bp, Mus musculus
tcctggatgttatgacacctatgcg

SEQ ID NO: 778100 - DNA, 25 bp, Mus musculus
tcctggattaatctacagaatgatc

SEQ ID NO: 778101 - DNA, 25 bp, Mus musculus
tcctggattaatgtacagaatgatc

SEQ ID NO: 778102 - DNA, 25 bp, Mus musculus
tcctggattataacatgggtggctg

SEQ ID NO: 778103 - DNA, 25 bp, Mus musculus
tcctggattatatcatgggtggctg

SEQ ID NO: 778104 - DNA, 25 bp, Mus musculus
tcctggattgtgcagaaggcacttt

SEQ ID NO: 778105 - DNA, 25 bp, Mus musculus
tcctggattgtggagaaggcacttt

SEQ ID NO: 778106 - DNA, 25 bp, Mus musculus
tcctggatttgcagcttcctcaacg

SEQ ID NO: 778107 - DNA, 25 bp, Mus musculus
tcctggatttgctgcttcctcaacg

SEQ ID NO: 778108 - DNA, 25 bp, Mus musculus
tcctggcaaaagcttaaaatgcaac

SEQ ID NO: 778109 - DNA, 25 bp, Mus musculus
tcctggcaaaaggttaaaatgcaac

SEQ ID NO: 778110 - DNA, 25 bp, Mus musculus
tcctggcaattcagctcaaagtcct

SEQ ID NO: 778111 - DNA, 25 bp, Mus musculus
tcctggcaattctgctcaaagtcct

SEQ ID NO: 778112 - DNA, 25 bp, Mus musculus
tcctggcacatcagcgcttccagtt

SEQ ID NO: 778113 - DNA, 25 bp, Mus musculus
tcctggcacatctgcgcttccagtt

SEQ ID NO: 778114 - DNA, 25 bp, Mus musculus
tcctggcacccaaggcaatatgtac

SEQ ID NO: 778115 - DNA, 25 bp, Mus musculus
tcctggcacccatggcaatatgtac

SEQ ID NO: 778116 - DNA, 25 bp, Mus musculus
tcctggcactcaaactcaagactgg

SEQ ID NO: 778117 - DNA, 25 bp, Mus musculus
tcctggcactcatactcaagactgg

SEQ ID NO: 778118 - DNA, 25 bp, Mus musculus
tcctggcactggctctgattcttgc

SEQ ID NO: 778119 - DNA, 25 bp, Mus musculus
tcctggcactgggtctgattcttgc

SEQ ID NO: 778120 - DNA, 25 bp, Mus musculus
tcctggcactgtagatagccaaggg

SEQ ID NO: 778121 - DNA, 25 bp, Mus musculus
tcctggcactgttgatagccaaggg

SEQ ID NO: 778122 - DNA, 25 bp, Mus musculus
tcctggcagagaacagcacactggc

SEQ ID NO: 778123 - DNA, 25 bp, Mus musculus
tcctggcagagatcagcacactggc

SEQ ID NO: 778124 - DNA, 25 bp, Mus musculus
tcctggcagaggactggaataagct

SEQ ID NO: 778125 - DNA, 25 bp, Mus musculus
tcctggcagaggtctggaataagct

SEQ ID NO: 778126 - DNA, 25 bp, Mus musculus
tcctggcagatgactcactgttggg

SEQ ID NO: 778127 - DNA, 25 bp, Mus musculus
tcctggcagatgtctcactgttggg

SEQ ID NO: 778128 - DNA, 25 bp, Mus musculus
tcctggcagcttctgacagtggtgc

SEQ ID NO: 778129 - DNA, 25 bp, Mus musculus
tcctggcagcttgtgacagtggtgc

SEQ ID NO: 778130 - DNA, 25 bp, Mus musculus
tcctggcaggtaaggttggacctgc

SEQ ID NO: 778131 - DNA, 25 bp, Mus musculus
tcctggcaggtatggttggacctgc

SEQ ID NO: 778132 - DNA, 25 bp, Mus musculus
tcctggcagttcctgagatctcaag

SEQ ID NO: 778133 - DNA, 25 bp, Mus musculus
tcctggcagttcgtgagatctcaag

SEQ ID NO: 778134 - DNA, 25 bp, Mus musculus
tcctggcatccgacagcctggggaa

SEQ ID NO: 778135 - DNA, 25 bp, Mus musculus
tcctggcatccgtcagcctggggaa

SEQ ID NO: 778136 - DNA, 25 bp, Mus musculus
tcctggcatgtaagcagtaacagct

SEQ ID NO: 778137 - DNA, 25 bp, Mus musculus
tcctggcatgtatgcagtaacagct

SEQ ID NO: 778138 - DNA, 25 bp, Mus musculus
tcctggccacagacatctacaagag

SEQ ID NO: 778139 - DNA, 25 bp, Mus musculus
tcctggccacagtcatctacaagag

SEQ ID NO: 778140 - DNA, 25 bp, Mus musculus
tcctggccacgcaggcgggtctctt

SEQ ID NO: 778141 - DNA, 25 bp, Mus musculus
tcctggccacgctggcgggtctctt

SEQ ID NO: 778142 - DNA, 25 bp, Mus musculus
tcctggccagacaagcatctgggaa

SEQ ID NO: 778143 - DNA, 25 bp, Mus musculus
tcctggccagacacatgcatgggca

SEQ ID NO: 778144 - DNA, 25 bp, Mus musculus
tcctggccagactagcatctgggaa

SEQ ID NO: 778145 - DNA, 25 bp, Mus musculus
tcctggccagactcatgcatgggca

SEQ ID NO: 778146 - DNA, 25 bp, Mus musculus
tcctggccagagaaaaggacttgac

SEQ ID NO: 778147 - DNA, 25 bp, Mus musculus
tcctggccagagtaaaggacttgac

SEQ ID NO: 778148 - DNA, 25 bp, Mus musculus
tcctggccagtgacgctgttgccgt

SEQ ID NO: 778149 - DNA, 25 bp, Mus musculus
tcctggccagtgagatatgcttccc

SEQ ID NO: 778150 - DNA, 25 bp, Mus musculus
tcctggccagtgtcgctgttgccgt

SEQ ID NO: 778151 - DNA, 25 bp, Mus musculus
tcctggccagtgtgatatgcttccc

SEQ ID NO: 778152 - DNA, 25 bp, Mus musculus
tcctggccatgacgttggatgcctc

SEQ ID NO: 778153 - DNA, 25 bp, Mus musculus
tcctggccatgaggttggatgcctc

SEQ ID NO: 778154 - DNA, 25 bp, Mus musculus
tcctggccgcctactgctggatggc

SEQ ID NO: 778155 - DNA, 25 bp, Mus musculus
tcctggccgccttctgctggatggc

SEQ ID NO: 778156 - DNA, 25 bp, Mus musculus
tcctggccggctatgatatcgccct

SEQ ID NO: 778157 - DNA, 25 bp, Mus musculus
tcctggccggctttgatatcgccct

SEQ ID NO: 778158 - DNA, 25 bp, Mus musculus
tcctggcctccacactaaaggatga

SEQ ID NO: 778159 - DNA, 25 bp, Mus musculus
tcctggcctccagactaaaggatga

SEQ ID NO: 778160 - DNA, 25 bp, Mus musculus
tcctggcctgatacaggtgccaaca

SEQ ID NO: 778161 - DNA, 25 bp, Mus musculus
tcctggcctgattcaggtgccaaca

SEQ ID NO: 778162 - DNA, 25 bp, Mus musculus
tcctggcctgcaagtgtgctggcct

SEQ ID NO: 778163 - DNA, 25 bp, Mus musculus
tcctggcctgcatgtgtgctggcct

SEQ ID NO: 778164 - DNA, 25 bp, Mus musculus
tcctggcctggcatgtcgatagtca

SEQ ID NO: 778165 - DNA, 25 bp, Mus musculus
tcctggcctggcttgtcgatagtca

SEQ ID NO: 778166 - DNA, 25 bp, Mus musculus
tcctggccttagaggtccttaccgt

SEQ ID NO: 778167 - DNA, 25 bp, Mus musculus
tcctggccttagtggtccttaccgt

SEQ ID NO: 778168 - DNA, 25 bp, Mus musculus
tcctggccttgtcgaggttttcatg

SEQ ID NO: 778169 - DNA, 25 bp, Mus musculus
tcctggccttgtggaggttttcatg

SEQ ID NO: 778170 - DNA, 25 bp, Mus musculus
tcctggcgagttacattagtcctgc

SEQ ID NO: 778171 - DNA, 25 bp, Mus musculus
tcctggcgagtttcattagtcctgc

SEQ ID NO: 778172 - DNA, 25 bp, Mus musculus
tcctggcgctcaaccttctggtgca

SEQ ID NO: 778173 - DNA, 25 bp, Mus musculus
tcctggcgctcatccttctggtgca

SEQ ID NO: 778174 - DNA, 25 bp, Mus musculus
tcctggcgctctatcgaaagtttga

SEQ ID NO: 778175 - DNA, 25 bp, Mus musculus
tcctggcgctctttcgaaagtttga

SEQ ID NO: 778176 - DNA, 25 bp, Mus musculus
tcctggcgctgacatcggctttgct

SEQ ID NO: 778177 - DNA, 25 bp, Mus musculus
tcctggcgctgagatcggctttgct

SEQ ID NO: 778178 - DNA, 25 bp, Mus musculus
tcctggcgggcaataatggcctaga

SEQ ID NO: 778179 - DNA, 25 bp, Mus musculus
tcctggcgggcattaatggcctaga

SEQ ID NO: 778180 - DNA, 25 bp, Mus musculus
tcctggcgtctgaatgagcgtcact

SEQ ID NO: 778181 - DNA, 25 bp, Mus musculus
tcctggcgtctgtatgagcgtcact

SEQ ID NO: 778182 - DNA, 25 bp, Mus musculus
tcctggcgtgcacccctttggagta

SEQ ID NO: 778183 - DNA, 25 bp, Mus musculus
tcctggcgtgcagccctttggagta

SEQ ID NO: 778184 - DNA, 25 bp, Mus musculus
tcctggcgtttaccaccttcactgt

SEQ ID NO: 778185 - DNA, 25 bp, Mus musculus
tcctggcgtttagcaccttcactgt

SEQ ID NO: 778186 - DNA, 25 bp, Mus musculus
tcctggctaaagcatgggaagctcg

SEQ ID NO: 778187 - DNA, 25 bp, Mus musculus
tcctggctaaaggatgggaagctcg

SEQ ID NO: 778188 - DNA, 25 bp, Mus musculus
tcctggctaccaactactactggat

SEQ ID NO: 778189 - DNA, 25 bp, Mus musculus
tcctggctaccatctactactggat

SEQ ID NO: 778190 - DNA, 25 bp, Mus musculus
tcctggctagagagggcaacaatca

SEQ ID NO: 778191 - DNA, 25 bp, Mus musculus
tcctggctagagtgggcaacaatca

SEQ ID NO: 778192 - DNA, 25 bp, Mus musculus
tcctggctatcaaaggaatcgacta

SEQ ID NO: 778193 - DNA, 25 bp, Mus musculus
tcctggctatcataggaatcgacta

SEQ ID NO: 778194 - DNA, 25 bp, Mus musculus
tcctggctcacaaagacgaggagtg

SEQ ID NO: 778195 - DNA, 25 bp, Mus musculus
tcctggctcacatagacgaggagtg

SEQ ID NO: 778196 - DNA, 25 bp, Mus musculus
tcctggctctcacagattgcttctc

SEQ ID NO: 778197 - DNA, 25 bp, Mus musculus
tcctggctctcagagattgcttctc

SEQ ID NO: 778198 - DNA, 25 bp, Mus musculus
tcctggctgagccttagagctccaa

SEQ ID NO: 778199 - DNA, 25 bp, Mus musculus
tcctggctgagcgttagagctccaa

SEQ ID NO: 778200 - DNA, 25 bp, Mus musculus
tcctggctgaggacgggaccatagt

SEQ ID NO: 778201 - DNA, 25 bp, Mus musculus
tcctggctgaggtcgggaccatagt

SEQ ID NO: 778202 - DNA, 25 bp, Mus musculus
tcctggctgtctccaaggaaggaag

SEQ ID NO: 778203 - DNA, 25 bp, Mus musculus
tcctggctgtctgcaaggaaggaag

SEQ ID NO: 778204 - DNA, 25 bp, Mus musculus
tcctggctgtgtctgatgccagcaa

SEQ ID NO: 778205 - DNA, 25 bp, Mus musculus
tcctggctgtgtgtgatgccagcaa

SEQ ID NO: 778206 - DNA, 25 bp, Mus musculus
tcctggctgttcctccctgggtgga

SEQ ID NO: 778207 - DNA, 25 bp, Mus musculus
tcctggctgttcgtccctgggtgga

SEQ ID NO: 778208 - DNA, 25 bp, Mus musculus
tcctggctgttgagctgctctctgt

SEQ ID NO: 778209 - DNA, 25 bp, Mus musculus
tcctggctgttgtgctgctctctgt

SEQ ID NO: 778210 - DNA, 25 bp, Mus musculus
tcctggcttactctttggtggctgc

SEQ ID NO: 778211 - DNA, 25 bp, Mus musculus
tcctggcttactgtttggtggctgc

SEQ ID NO: 778212 - DNA, 25 bp, Mus musculus
tcctggcttatcatcgaggatcaca

SEQ ID NO: 778213 - DNA, 25 bp, Mus musculus
tcctggcttatcttcgaggatcaca

SEQ ID NO: 778214 - DNA, 25 bp, Mus musculus
tcctggcttcatctacgagagaagt

SEQ ID NO: 778215 - DNA, 25 bp, Mus musculus
tcctggcttcatgtacgagagaagt

SEQ ID NO: 778216 - DNA, 25 bp, Mus musculus
tcctggcttgcaatgccacagctgc

SEQ ID NO: 778217 - DNA, 25 bp, Mus musculus
tcctggcttgcactgagtactggct

SEQ ID NO: 778218 - DNA, 25 bp, Mus musculus
tcctggcttgcagtgagtactggct

SEQ ID NO: 778219 - DNA, 25 bp, Mus musculus
tcctggcttgcattgccacagctgc

SEQ ID NO: 778220 - DNA, 25 bp, Mus musculus
tcctggctttacaggggctacaact

SEQ ID NO: 778221 - DNA, 25 bp, Mus musculus
tcctggctttactggggctacaact

SEQ ID NO: 778222 - DNA, 25 bp, Mus musculus
tcctggcttttaatgctcggctcaa

SEQ ID NO: 778223 - DNA, 25 bp, Mus musculus
tcctggcttttattgctcggctcaa

SEQ ID NO: 778224 - DNA, 25 bp, Mus musculus
tcctgggaacccagaagtgggagct

SEQ ID NO: 778225 - DNA, 25 bp, Mus musculus
tcctgggaaccctgaagtgggagct

SEQ ID NO: 778226 - DNA, 25 bp, Mus musculus
tcctgggaagccactactttttcat

SEQ ID NO: 778227 - DNA, 25 bp, Mus musculus
tcctgggaagcctctactttttcat

SEQ ID NO: 778228 - DNA, 25 bp, Mus musculus
tcctgggaagctcaagacccaacca

SEQ ID NO: 778229 - DNA, 25 bp, Mus musculus
tcctgggaagctgaagacccaacca

SEQ ID NO: 778230 - DNA, 25 bp, Mus musculus
tcctgggaagtactgggagccattt

SEQ ID NO: 778231 - DNA, 25 bp, Mus musculus
tcctgggaagtagtgggagccattt

SEQ ID NO: 778232 - DNA, 25 bp, Mus musculus
tcctgggaatttccaagagagatct

SEQ ID NO: 778233 - DNA, 25 bp, Mus musculus
tcctgggaatttgcaagagagatct

SEQ ID NO: 778234 - DNA, 25 bp, Mus musculus
tcctgggacagaacctgttttccaa

SEQ ID NO: 778235 - DNA, 25 bp, Mus musculus
tcctgggacagatcctgttttccaa

SEQ ID NO: 778236 - DNA, 25 bp, Mus musculus
tcctgggacagtatcaacaatggcg

SEQ ID NO: 778237 - DNA, 25 bp, Mus musculus
tcctgggacagtttcaacaatggcg

SEQ ID NO: 778238 - DNA, 25 bp, Mus musculus
tcctgggacctgagaagctgagcac

SEQ ID NO: 778239 - DNA, 25 bp, Mus musculus
tcctgggacctgtgaagctgagcac

SEQ ID NO: 778240 - DNA, 25 bp, Mus musculus
tcctgggacgagctcccagctttgg

SEQ ID NO: 778241 - DNA, 25 bp, Mus musculus
tcctgggacgaggtcccagctttgg

SEQ ID NO: 778242 - DNA, 25 bp, Mus musculus
tcctgggacgttccaatccactggc

SEQ ID NO: 778243 - DNA, 25 bp, Mus musculus
tcctgggacgttgcaatccactggc

SEQ ID NO: 778244 - DNA, 25 bp, Mus musculus
tcctgggactcccttccagatgagc

SEQ ID NO: 778245 - DNA, 25 bp, Mus musculus
tcctgggactccgttccagatgagc

SEQ ID NO: 778246 - DNA, 25 bp, Mus musculus
tcctgggactcgaagttgaccgcct

SEQ ID NO: 778247 - DNA, 25 bp, Mus musculus
tcctgggactcgtagttgaccgcct

SEQ ID NO: 778248 - DNA, 25 bp, Mus musculus
tcctgggacttgaattaaggttgat

SEQ ID NO: 778249 - DNA, 25 bp, Mus musculus
tcctgggacttgtattaaggttgat

SEQ ID NO: 778250 - DNA, 25 bp, Mus musculus
tcctgggagatgacgcctactatga

SEQ ID NO: 778251 - DNA, 25 bp, Mus musculus
tcctgggagatgtcgcctactatga

SEQ ID NO: 778252 - DNA, 25 bp, Mus musculus
tcctgggagcatcaagagccccaca

SEQ ID NO: 778253 - DNA, 25 bp, Mus musculus
tcctgggagcatgaagagccccaca

SEQ ID NO: 778254 - DNA, 25 bp, Mus musculus
tcctgggagccaacattggtgactg

SEQ ID NO: 778255 - DNA, 25 bp, Mus musculus
tcctgggagccacacaacctttgac

SEQ ID NO: 778256 - DNA, 25 bp, Mus musculus
tcctgggagccagacaacctttgac

SEQ ID NO: 778257 - DNA, 25 bp, Mus musculus
tcctgggagccatcattggtgactg

SEQ ID NO: 778258 - DNA, 25 bp, Mus musculus
tcctgggaggcaagaagtctggaga

SEQ ID NO: 778259 - DNA, 25 bp, Mus musculus
tcctgggaggcatgaagtctggaga

SEQ ID NO: 778260 - DNA, 25 bp, Mus musculus
tcctgggatcgacggatgcagtaca

SEQ ID NO: 778261 - DNA, 25 bp, Mus musculus
tcctgggatcgagggatgcagtaca

SEQ ID NO: 778262 - DNA, 25 bp, Mus musculus
tcctgggattgtaggcctgcattca

SEQ ID NO: 778263 - DNA, 25 bp, Mus musculus
tcctgggattgttggcctgcattca

SEQ ID NO: 778264 - DNA, 25 bp, Mus musculus
tcctgggcaataagatcgtgattgt

SEQ ID NO: 778265 - DNA, 25 bp, Mus musculus
tcctgggcaatatgatcgtgattgt

SEQ ID NO: 778266 - DNA, 25 bp, Mus musculus
tcctgggcaggcagtgagctgcccc

SEQ ID NO: 778267 - DNA, 25 bp, Mus musculus
tcctgggcaggctgtgagctgcccc

SEQ ID NO: 778268 - DNA, 25 bp, Mus musculus
tcctgggcagggaaggtcatttaca

SEQ ID NO: 778269 - DNA, 25 bp, Mus musculus
tcctgggcagggtaggtcatttaca

SEQ ID NO: 778270 - DNA, 25 bp, Mus musculus
tcctgggcataactaaccccgaagg

SEQ ID NO: 778271 - DNA, 25 bp, Mus musculus
tcctgggcataagtaaccccgaagg

SEQ ID NO: 778272 - DNA, 25 bp, Mus musculus
tcctgggcatcccttcgggttttct

SEQ ID NO: 778273 - DNA, 25 bp, Mus musculus
tcctgggcatccgttcgggttttct

SEQ ID NO: 778274 - DNA, 25 bp, Mus musculus
tcctgggcatctacaagcagggcct

SEQ ID NO: 778275 - DNA, 25 bp, Mus musculus
tcctgggcatcttcaagcagggcct

SEQ ID NO: 778276 - DNA, 25 bp, Mus musculus
tcctgggcatggaaggaacgctcat

SEQ ID NO: 778277 - DNA, 25 bp, Mus musculus
tcctgggcatggtaggaacgctcat

SEQ ID NO: 778278 - DNA, 25 bp, Mus musculus
tcctgggccagacgcactcagtcat

SEQ ID NO: 778279 - DNA, 25 bp, Mus musculus
tcctgggccagaggcactcagtcat

SEQ ID NO: 778280 - DNA, 25 bp, Mus musculus
tcctgggccagcctctgagtagcac

SEQ ID NO: 778281 - DNA, 25 bp, Mus musculus
tcctgggccagcgtctgagtagcac

SEQ ID NO: 778282 - DNA, 25 bp, Mus musculus
tcctgggccaggacgctttccggag

SEQ ID NO: 778283 - DNA, 25 bp, Mus musculus
tcctgggccaggtcgctttccggag

SEQ ID NO: 778284 - DNA, 25 bp, Mus musculus
tcctgggcccaactctacggtatca

SEQ ID NO: 778285 - DNA, 25 bp, Mus musculus
tcctgggcccaactgaagaaatgca

SEQ ID NO: 778286 - DNA, 25 bp, Mus musculus
tcctgggcccaagtctacggtatca

SEQ ID NO: 778287 - DNA, 25 bp, Mus musculus
tcctgggcccaagtgaagaaatgca

SEQ ID NO: 778288 - DNA, 25 bp, Mus musculus
tcctgggcccgtatttcttgatctg

SEQ ID NO: 778289 - DNA, 25 bp, Mus musculus
tcctgggcccgtttttcttgatctg

SEQ ID NO: 778290 - DNA, 25 bp, Mus musculus
tcctgggccctcaggcgtaaggcct

SEQ ID NO: 778291 - DNA, 25 bp, Mus musculus
tcctgggccctctggcgtaaggcct

SEQ ID NO: 778292 - DNA, 25 bp, Mus musculus
tcctgggcgccgacatggctgctta

SEQ ID NO: 778293 - DNA, 25 bp, Mus musculus
tcctgggcgccgtcatggctgctta

SEQ ID NO: 778294 - DNA, 25 bp, Mus musculus
tcctgggctccacgaagagactcaa

SEQ ID NO: 778295 - DNA, 25 bp, Mus musculus
tcctgggctccaggaagagactcaa

SEQ ID NO: 778296 - DNA, 25 bp, Mus musculus
tcctgggctgaactgcagagactca

SEQ ID NO: 778297 - DNA, 25 bp, Mus musculus
tcctgggctgaagtgcagagactca

SEQ ID NO: 778298 - DNA, 25 bp, Mus musculus
tcctgggctggactactgctataac

SEQ ID NO: 778299 - DNA, 25 bp, Mus musculus
tcctgggctggagtactgctataac

SEQ ID NO: 778300 - DNA, 25 bp, Mus musculus
tcctgggctgtcaggagtttgccgt

SEQ ID NO: 778301 - DNA, 25 bp, Mus musculus
tcctgggctgtctggagtttgccgt

SEQ ID NO: 778302 - DNA, 25 bp, Mus musculus
tcctgggcttgaacagtatgctatt

SEQ ID NO: 778303 - DNA, 25 bp, Mus musculus
tcctgggcttgatcagtatgctatt

SEQ ID NO: 778304 - DNA, 25 bp, Mus musculus
tcctgggctttcagcggcggctgct

SEQ ID NO: 778305 - DNA, 25 bp, Mus musculus
tcctgggctttctgcggcggctgct

SEQ ID NO: 778306 - DNA, 25 bp, Mus musculus
tcctgggctttgatgcgctctgcca

SEQ ID NO: 778307 - DNA, 25 bp, Mus musculus
tcctgggctttgttgcgctctgcca

SEQ ID NO: 778308 - DNA, 25 bp, Mus musculus
tcctggggggcaacaagctgccctt

SEQ ID NO: 778309 - DNA, 25 bp, Mus musculus
tcctggggggcatcaagctgccctt

SEQ ID NO: 778310 - DNA, 25 bp, Mus musculus
tcctgggtacctaaagaggaagcct

SEQ ID NO: 778311 - DNA, 25 bp, Mus musculus
tcctgggtaccttaagaggaagcct

SEQ ID NO: 778312 - DNA, 25 bp, Mus musculus
tcctgggtctggaaacctgtggttg

SEQ ID NO: 778313 - DNA, 25 bp, Mus musculus
tcctgggtctggtaacctgtggttg

SEQ ID NO: 778314 - DNA, 25 bp, Mus musculus
tcctgggtgacaaacagaaatctac

SEQ ID NO: 778315 - DNA, 25 bp, Mus musculus
tcctgggtgacatacagaaatctac

SEQ ID NO: 778316 - DNA, 25 bp, Mus musculus
tcctgggtgcacctgacagtcaatt

SEQ ID NO: 778317 - DNA, 25 bp, Mus musculus
tcctgggtgcacgtgacagtcaatt

SEQ ID NO: 778318 - DNA, 25 bp, Mus musculus
tcctgggtgccaacctgctgttctg

SEQ ID NO: 778319 - DNA, 25 bp, Mus musculus
tcctgggtgccatcctgctgttctg

SEQ ID NO: 778320 - DNA, 25 bp, Mus musculus
tcctgggtgctgagatcctgggctt

SEQ ID NO: 778321 - DNA, 25 bp, Mus musculus
tcctgggtgctgtgatcctgggctt

SEQ ID NO: 778322 - DNA, 25 bp, Mus musculus
tcctgggtgggcaaagctctattcc

SEQ ID NO: 778323 - DNA, 25 bp, Mus musculus
tcctgggtgggctaagctctattcc

SEQ ID NO: 778324 - DNA, 25 bp, Mus musculus
tcctgggtgtctatgccagtggatc

SEQ ID NO: 778325 - DNA, 25 bp, Mus musculus
tcctgggtgtctttgccagtggatc

SEQ ID NO: 778326 - DNA, 25 bp, Mus musculus
tcctgggtgtttcgctgacctacag

SEQ ID NO: 778327 - DNA, 25 bp, Mus musculus
tcctgggtgtttggctgacctacag

SEQ ID NO: 778328 - DNA, 25 bp, Mus musculus
tcctgggttaccagtgggcacccat

SEQ ID NO: 778329 - DNA, 25 bp, Mus musculus
tcctgggttacctgtgggcacccat

SEQ ID NO: 778330 - DNA, 25 bp, Mus musculus
tcctgggtttcgagaacaagcaaca

SEQ ID NO: 778331 - DNA, 25 bp, Mus musculus
tcctgggtttcgtgaacaagcaaca

SEQ ID NO: 778332 - DNA, 25 bp, Mus musculus
tcctggtaaaaacggagctgccact

SEQ ID NO: 778333 - DNA, 25 bp, Mus musculus
tcctggtaaaaagggagctgccact

SEQ ID NO: 778334 - DNA, 25 bp, Mus musculus
tcctggtaaatgatcccagtgtcct

SEQ ID NO: 778335 - DNA, 25 bp, Mus musculus
tcctggtaaatgttcccagtgtcct

SEQ ID NO: 778336 - DNA, 25 bp, Mus musculus
tcctggtaaccgaatgctgatggtc

SEQ ID NO: 778337 - DNA, 25 bp, Mus musculus
tcctggtaaccgtatgctgatggtc

SEQ ID NO: 778338 - DNA, 25 bp, Mus musculus
tcctggtacctccttctgtgttaga

SEQ ID NO: 778339 - DNA, 25 bp, Mus musculus
tcctggtacctcgttctgtgttaga

SEQ ID NO: 778340 - DNA, 25 bp, Mus musculus
tcctggtactcgcatggctctttgt

SEQ ID NO: 778341 - DNA, 25 bp, Mus musculus
tcctggtactcggatggctctttgt

SEQ ID NO: 778342 - DNA, 25 bp, Mus musculus
tcctggtagacacgaccctcacaga

SEQ ID NO: 778343 - DNA, 25 bp, Mus musculus
tcctggtagacaggaccctcacaga

SEQ ID NO: 778344 - DNA, 25 bp, Mus musculus
tcctggtaggtacaagctagacatg

SEQ ID NO: 778345 - DNA, 25 bp, Mus musculus
tcctggtaggtagaagctagacatg

SEQ ID NO: 778346 - DNA, 25 bp, Mus musculus
tcctggtcaaacatgaattctcctt

SEQ ID NO: 778347 - DNA, 25 bp, Mus musculus
tcctggtcaaacttgaattctcctt

SEQ ID NO: 778348 - DNA, 25 bp, Mus musculus
tcctggtcaggaatccggcaaatcc

SEQ ID NO: 778349 - DNA, 25 bp, Mus musculus
tcctggtcaggattccggcaaatcc

SEQ ID NO: 778350 - DNA, 25 bp, Mus musculus
tcctggtccagaccagcgagttgtg

SEQ ID NO: 778351 - DNA, 25 bp, Mus musculus
tcctggtccagagcagcgagttgtg

SEQ ID NO: 778352 - DNA, 25 bp, Mus musculus
tcctggtcccgtcgtccctgaattt

SEQ ID NO: 778353 - DNA, 25 bp, Mus musculus
tcctggtcccgtggtccctgaattt

SEQ ID NO: 778354 - DNA, 25 bp, Mus musculus
tcctggtcctggcatttttgtatta

SEQ ID NO: 778355 - DNA, 25 bp, Mus musculus
tcctggtcctgggatttttgtatta

SEQ ID NO: 778356 - DNA, 25 bp, Mus musculus
tcctggtcgagtcggccaagtacat

SEQ ID NO: 778357 - DNA, 25 bp, Mus musculus
tcctggtcgagtgggccaagtacat

SEQ ID NO: 778358 - DNA, 25 bp, Mus musculus
tcctggtcggtgagttcattgagca

SEQ ID NO: 778359 - DNA, 25 bp, Mus musculus
tcctggtcggtgtgttcattgagca

SEQ ID NO: 778360 - DNA, 25 bp, Mus musculus
tcctggtctccaatgctgctgtcaa

SEQ ID NO: 778361 - DNA, 25 bp, Mus musculus
tcctggtctccattgctgctgtcaa

SEQ ID NO: 778362 - DNA, 25 bp, Mus musculus
tcctggtctgacctccaaagagtcg

SEQ ID NO: 778363 - DNA, 25 bp, Mus musculus
tcctggtctgacgtccaaagagtcg

SEQ ID NO: 778364 - DNA, 25 bp, Mus musculus
tcctggtgaacaatgccgctgtggt

SEQ ID NO: 778365 - DNA, 25 bp, Mus musculus
tcctggtgaacattgccgctgtggt

SEQ ID NO: 778366 - DNA, 25 bp, Mus musculus
tcctggtgaaggaggtaccttggcc

SEQ ID NO: 778367 - DNA, 25 bp, Mus musculus
tcctggtgaaggtggtaccttggcc

SEQ ID NO: 778368 - DNA, 25 bp, Mus musculus
tcctggtgaatgctatcatcaacag

SEQ ID NO: 778369 - DNA, 25 bp, Mus musculus
tcctggtgaatggtatcatcaacag

SEQ ID NO: 778370 - DNA, 25 bp, Mus musculus
tcctggtgacagacaggtcgcgagc

SEQ ID NO: 778371 - DNA, 25 bp, Mus musculus
tcctggtgacagtcaggtcgcgagc

SEQ ID NO: 778372 - DNA, 25 bp, Mus musculus
tcctggtgactgactggaacccact

SEQ ID NO: 778373 - DNA, 25 bp, Mus musculus
tcctggtgactgtctggaacccact

SEQ ID NO: 778374 - DNA, 25 bp, Mus musculus
tcctggtgagataacatcgtgagca

SEQ ID NO: 778375 - DNA, 25 bp, Mus musculus
tcctggtgagattacatcgtgagca

SEQ ID NO: 778376 - DNA, 25 bp, Mus musculus
tcctggtgagtgatgtggtgctctt

SEQ ID NO: 778377 - DNA, 25 bp, Mus musculus
tcctggtgagtgttgtggtgctctt

SEQ ID NO: 778378 - DNA, 25 bp, Mus musculus
tcctggtgcactatggtcacagctg

SEQ ID NO: 778379 - DNA, 25 bp, Mus musculus
tcctggtgcactttggtcacagctg

SEQ ID NO: 778380 - DNA, 25 bp, Mus musculus
tcctggtgccccagtcttgaatgtc

SEQ ID NO: 778381 - DNA, 25 bp, Mus musculus
tcctggtgcccctgtcttgaatgtc

SEQ ID NO: 778382 - DNA, 25 bp, Mus musculus
tcctggtgcgcaagctaagtgaact

SEQ ID NO: 778383 - DNA, 25 bp, Mus musculus
tcctggtgcgcatgctaagtgaact

SEQ ID NO: 778384 - DNA, 25 bp, Mus musculus
tcctggtgcggaagacgggtgggca

SEQ ID NO: 778385 - DNA, 25 bp, Mus musculus
tcctggtgcggatgacgggtgggca

SEQ ID NO: 778386 - DNA, 25 bp, Mus musculus
tcctggtgctaaaagaacaaggtcc

SEQ ID NO: 778387 - DNA, 25 bp, Mus musculus
tcctggtgctaatagaacaaggtcc

SEQ ID NO: 778388 - DNA, 25 bp, Mus musculus
tcctggtgcttacatggactgtctg

SEQ ID NO: 778389 - DNA, 25 bp, Mus musculus
tcctggtgcttagatggactgtctg

SEQ ID NO: 778390 - DNA, 25 bp, Mus musculus
tcctggtgctttagggcttgtgcaa

SEQ ID NO: 778391 - DNA, 25 bp, Mus musculus
tcctggtgctttcacttcactgaaa

SEQ ID NO: 778392 - DNA, 25 bp, Mus musculus
tcctggtgctttgacttcactgaaa

SEQ ID NO: 778393 - DNA, 25 bp, Mus musculus
tcctggtgcttttgggcttgtgcaa

SEQ ID NO: 778394 - DNA, 25 bp, Mus musculus
tcctggtggctaacttcctgcttgt

SEQ ID NO: 778395 - DNA, 25 bp, Mus musculus
tcctggtggctatcttcctgcttgt

SEQ ID NO: 778396 - DNA, 25 bp, Mus musculus
tcctggtgggcgagtgcgaaaacat

SEQ ID NO: 778397 - DNA, 25 bp, Mus musculus
tcctggtgggcgtgtgcgaaaacat

SEQ ID NO: 778398 - DNA, 25 bp, Mus musculus
tcctggtggtcaacatgaagggtaa

SEQ ID NO: 778399 - DNA, 25 bp, Mus musculus
tcctggtggtcatcatgaagggtaa

SEQ ID NO: 778400 - DNA, 25 bp, Mus musculus
tcctggttaggaactgcgctcaagt

SEQ ID NO: 778401 - DNA, 25 bp, Mus musculus
tcctggttaggatctgcgctcaagt

SEQ ID NO: 778402 - DNA, 25 bp, Mus musculus
tcctggttcaagactactttgtgct

SEQ ID NO: 778403 - DNA, 25 bp, Mus musculus
tcctggttcaagtctactttgtgct

SEQ ID NO: 778404 - DNA, 25 bp, Mus musculus
tcctggttcaggacatgcctagccc

SEQ ID NO: 778405 - DNA, 25 bp, Mus musculus
tcctggttcaggtcatgcctagccc

SEQ ID NO: 778406 - DNA, 25 bp, Mus musculus
tcctggttccggaccaaggtcaaag

SEQ ID NO: 778407 - DNA, 25 bp, Mus musculus
tcctggttccggtccaaggtcaaag

SEQ ID NO: 778408 - DNA, 25 bp, Mus musculus
tcctggttcgagacaaattcgtgct

SEQ ID NO: 778409 - DNA, 25 bp, Mus musculus
tcctggttcgagtcaaattcgtgct

SEQ ID NO: 778410 - DNA, 25 bp, Mus musculus
tcctggttgagcacgggctggttta

SEQ ID NO: 778411 - DNA, 25 bp, Mus musculus
tcctggttgagctcgggctggttta

SEQ ID NO: 778412 - DNA, 25 bp, Mus musculus
tcctggttgatgaaattatgcgagc

SEQ ID NO: 778413 - DNA, 25 bp, Mus musculus
tcctggttgatgtaattatgcgagc

SEQ ID NO: 778414 - DNA, 25 bp, Mus musculus
tcctggtttatgagggccagcagtt

SEQ ID NO: 778415 - DNA, 25 bp, Mus musculus
tcctggtttatgtgggccagcagtt

SEQ ID NO: 778416 - DNA, 25 bp, Mus musculus
tcctggtttgaccacatcaagggct

SEQ ID NO: 778417 - DNA, 25 bp, Mus musculus
tcctggtttgacgacatcaagggct

SEQ ID NO: 778418 - DNA, 25 bp, Mus musculus
tcctgtaaccatagtccagccatca

SEQ ID NO: 778419 - DNA, 25 bp, Mus musculus
tcctgtaaccattgtccagccatca

SEQ ID NO: 778420 - DNA, 25 bp, Mus musculus
tcctgtaataaacagggatccgaac

SEQ ID NO: 778421 - DNA, 25 bp, Mus musculus
tcctgtaataaagagggatccgaac

SEQ ID NO: 778422 - DNA, 25 bp, Mus musculus
tcctgtacagtgacgatgggcagag

SEQ ID NO: 778423 - DNA, 25 bp, Mus musculus
tcctgtacagtgtcgatgggcagag

SEQ ID NO: 778424 - DNA, 25 bp, Mus musculus
tcctgtacatgcaaccctggtttca

SEQ ID NO: 778425 - DNA, 25 bp, Mus musculus
tcctgtacatgctaccctggtttca

SEQ ID NO: 778426 - DNA, 25 bp, Mus musculus
tcctgtacccaaaaataaaattgtc

SEQ ID NO: 778427 - DNA, 25 bp, Mus musculus
tcctgtacccaataataaaattgtc

SEQ ID NO: 778428 - DNA, 25 bp, Mus musculus
tcctgtacctgaacattggactaca

SEQ ID NO: 778429 - DNA, 25 bp, Mus musculus
tcctgtacctgatcattggactaca

SEQ ID NO: 778430 - DNA, 25 bp, Mus musculus
tcctgtacggaaagagagcctgagc

SEQ ID NO: 778431 - DNA, 25 bp, Mus musculus
tcctgtacggaatgagagcctgagc

SEQ ID NO: 778432 - DNA, 25 bp, Mus musculus
tcctgtagagccaccagattgtgtt

SEQ ID NO: 778433 - DNA, 25 bp, Mus musculus
tcctgtagagcctccagattgtgtt

SEQ ID NO: 778434 - DNA, 25 bp, Mus musculus
tcctgtagagtgagaggccagtaag

SEQ ID NO: 778435 - DNA, 25 bp, Mus musculus
tcctgtagagtgcaaaacttgtgcc

SEQ ID NO: 778436 - DNA, 25 bp, Mus musculus
tcctgtagagtggaaaacttgtgcc

SEQ ID NO: 778437 - DNA, 25 bp, Mus musculus
tcctgtagagtgtgaggccagtaag

SEQ ID NO: 778438 - DNA, 25 bp, Mus musculus
tcctgtagatgcaatataccagcct

SEQ ID NO: 778439 - DNA, 25 bp, Mus musculus
tcctgtagatgctatataccagcct

SEQ ID NO: 778440 - DNA, 25 bp, Mus musculus
tcctgtagcaaaccagaggtccttt

SEQ ID NO: 778441 - DNA, 25 bp, Mus musculus
tcctgtagcaaagcagaggtccttt

SEQ ID NO: 778442 - DNA, 25 bp, Mus musculus
tcctgtagctgccaggagcaaggct

SEQ ID NO: 778443 - DNA, 25 bp, Mus musculus
tcctgtagctgcgaggagcaaggct

SEQ ID NO: 778444 - DNA, 25 bp, Mus musculus
tcctgtaggctgatccgggacagaa

SEQ ID NO: 778445 - DNA, 25 bp, Mus musculus
tcctgtaggctgttccgggacagaa

SEQ ID NO: 778446 - DNA, 25 bp, Mus musculus
tcctgtaggtggcaacagtgacacc

SEQ ID NO: 778447 - DNA, 25 bp, Mus musculus
tcctgtaggtgggaacagtgacacc

SEQ ID NO: 778448 - DNA, 25 bp, Mus musculus
tcctgtagtcctaggagagcgcagt

SEQ ID NO: 778449 - DNA, 25 bp, Mus musculus
tcctgtagtccttggagagcgcagt

SEQ ID NO: 778450 - DNA, 25 bp, Mus musculus
tcctgtagtcgtcggtggtcttatg

SEQ ID NO: 778451 - DNA, 25 bp, Mus musculus
tcctgtagtcgtgggtggtcttatg

SEQ ID NO: 778452 - DNA, 25 bp, Mus musculus
tcctgtatagctacgggcagttcat

SEQ ID NO: 778453 - DNA, 25 bp, Mus musculus
tcctgtatagcttcgggcagttcat

SEQ ID NO: 778454 - DNA, 25 bp, Mus musculus
tcctgtatcccaaggattcttccag

SEQ ID NO: 778455 - DNA, 25 bp, Mus musculus
tcctgtatcccatggattcttccag

SEQ ID NO: 778456 - DNA, 25 bp, Mus musculus
tcctgtatcggacagactggagata

SEQ ID NO: 778457 - DNA, 25 bp, Mus musculus
tcctgtatcggagagactggagata

SEQ ID NO: 778458 - DNA, 25 bp, Mus musculus
tcctgtatctaaagaatctcaagcc

SEQ ID NO: 778459 - DNA, 25 bp, Mus musculus
tcctgtatctaatgaatctcaagcc

SEQ ID NO: 778460 - DNA, 25 bp, Mus musculus
tcctgtatgtatcaggctcactggt

SEQ ID NO: 778461 - DNA, 25 bp, Mus musculus
tcctgtatgtatgaggctcactggt

SEQ ID NO: 778462 - DNA, 25 bp, Mus musculus
tcctgtcaaaaaaccccaactggga

SEQ ID NO: 778463 - DNA, 25 bp, Mus musculus
tcctgtcaaaaatccccaactggga

SEQ ID NO: 778464 - DNA, 25 bp, Mus musculus
tcctgtcaaccacctgcgctgtgag

SEQ ID NO: 778465 - DNA, 25 bp, Mus musculus
tcctgtcaaccagctgcgctgtgag

SEQ ID NO: 778466 - DNA, 25 bp, Mus musculus
tcctgtcaacgccagcggcgtgctt

SEQ ID NO: 778467 - DNA, 25 bp, Mus musculus
tcctgtcaacgcgagcggcgtgctt

SEQ ID NO: 778468 - DNA, 25 bp, Mus musculus
tcctgtcaagatcgcggataatctc

SEQ ID NO: 778469 - DNA, 25 bp, Mus musculus
tcctgtcaagatggcggataatctc

SEQ ID NO: 778470 - DNA, 25 bp, Mus musculus
tcctgtcagacgcaccgttgtgagg

SEQ ID NO: 778471 - DNA, 25 bp, Mus musculus
tcctgtcagacggaccgttgtgagg

SEQ ID NO: 778472 - DNA, 25 bp, Mus musculus
tcctgtcagatcagtacacggtgta

SEQ ID NO: 778473 - DNA, 25 bp, Mus musculus
tcctgtcagatctgtacacggtgta

SEQ ID NO: 778474 - DNA, 25 bp, Mus musculus
tcctgtcagcctcgagcaggtcaag

SEQ ID NO: 778475 - DNA, 25 bp, Mus musculus
tcctgtcagcctggagcaggtcaag

SEQ ID NO: 778476 - DNA, 25 bp, Mus musculus
tcctgtcagcggagactcagtggcc

SEQ ID NO: 778477 - DNA, 25 bp, Mus musculus
tcctgtcagcggagcagtgagcagc

SEQ ID NO: 778478 - DNA, 25 bp, Mus musculus
tcctgtcagcggtgactcagtggcc

SEQ ID NO: 778479 - DNA, 25 bp, Mus musculus
tcctgtcagcggtgcagtgagcagc

SEQ ID NO: 778480 - DNA, 25 bp, Mus musculus
tcctgtcaggctcctgtcctaaact

SEQ ID NO: 778481 - DNA, 25 bp, Mus musculus
tcctgtcaggctgctgtcctaaact

SEQ ID NO: 778482 - DNA, 25 bp, Mus musculus
tcctgtcagtatctcttccatgtgg

SEQ ID NO: 778483 - DNA, 25 bp, Mus musculus
tcctgtcagtatgtcttccatgtgg

SEQ ID NO: 778484 - DNA, 25 bp, Mus musculus
tcctgtccaataaccccagcaaggg

SEQ ID NO: 778485 - DNA, 25 bp, Mus musculus
tcctgtccaatatccccagcaaggg

SEQ ID NO: 778486 - DNA, 25 bp, Mus musculus
tcctgtccagcccaaacatggaaaa

SEQ ID NO: 778487 - DNA, 25 bp, Mus musculus
tcctgtccagccgaaacatggaaaa

SEQ ID NO: 778488 - DNA, 25 bp, Mus musculus
tcctgtcccctgcagaactgaagca

SEQ ID NO: 778489 - DNA, 25 bp, Mus musculus
tcctgtcccctggagaactgaagca

SEQ ID NO: 778490 - DNA, 25 bp, Mus musculus
tcctgtcccgggaggtcaattccca

SEQ ID NO: 778491 - DNA, 25 bp, Mus musculus
tcctgtcccgggtggtcaattccca

SEQ ID NO: 778492 - DNA, 25 bp, Mus musculus
tcctgtcccggtaaagcttctggat

SEQ ID NO: 778493 - DNA, 25 bp, Mus musculus
tcctgtcccggttaagcttctggat

SEQ ID NO: 778494 - DNA, 25 bp, Mus musculus
tcctgtccctggcatggctgtacat

SEQ ID NO: 778495 - DNA, 25 bp, Mus musculus
tcctgtccctgggatggctgtacat

SEQ ID NO: 778496 - DNA, 25 bp, Mus musculus
tcctgtccgccactcaagagcagat

SEQ ID NO: 778497 - DNA, 25 bp, Mus musculus
tcctgtccgccagtcaagagcagat

SEQ ID NO: 778498 - DNA, 25 bp, Mus musculus
tcctgtccgtagaaagggtagaaca

SEQ ID NO: 778499 - DNA, 25 bp, Mus musculus
tcctgtccgtagtaagggtagaaca

SEQ ID NO: 778500 - DNA, 25 bp, Mus musculus
tcctgtcctttgcaaacccaagagg

SEQ ID NO: 778501 - DNA, 25 bp, Mus musculus
tcctgtcctttggaaacccaagagg

SEQ ID NO: 778502 - DNA, 25 bp, Mus musculus
tcctgtcgcggcatctctgggcaga

SEQ ID NO: 778503 - DNA, 25 bp, Mus musculus
tcctgtcgcggcttctctgggcaga

SEQ ID NO: 778504 - DNA, 25 bp, Mus musculus
tcctgtcggatgacatagaagcctg

SEQ ID NO: 778505 - DNA, 25 bp, Mus musculus
tcctgtcggatgtcatagaagcctg

SEQ ID NO: 778506 - DNA, 25 bp, Mus musculus
tcctgtcggcatctactcaccggag

SEQ ID NO: 778507 - DNA, 25 bp, Mus musculus
tcctgtcggcatgtactcaccggag

SEQ ID NO: 778508 - DNA, 25 bp, Mus musculus
tcctgtcggcctcgaggaccgaagt

SEQ ID NO: 778509 - DNA, 25 bp, Mus musculus
tcctgtcggcctggaggaccgaagt

SEQ ID NO: 778510 - DNA, 25 bp, Mus musculus
tcctgtcgtgaaatgatgggtagcg

SEQ ID NO: 778511 - DNA, 25 bp, Mus musculus
tcctgtcgtgaattgatgggtagcg

SEQ ID NO: 778512 - DNA, 25 bp, Mus musculus
tcctgtctcattagggaattgaatg

SEQ ID NO: 778513 - DNA, 25 bp, Mus musculus
tcctgtctcatttgggaattgaatg

SEQ ID NO: 778514 - DNA, 25 bp, Mus musculus
tcctgtctctgtcccatgtgttgga

SEQ ID NO: 778515 - DNA, 25 bp, Mus musculus
tcctgtctctgtgccatgtgttgga

SEQ ID NO: 778516 - DNA, 25 bp, Mus musculus
tcctgtctgccgacagtagaaacca

SEQ ID NO: 778517 - DNA, 25 bp, Mus musculus
tcctgtctgccgtcagtagaaacca

SEQ ID NO: 778518 - DNA, 25 bp, Mus musculus
tcctgtctgtcaaggacctcaatgt

SEQ ID NO: 778519 - DNA, 25 bp, Mus musculus
tcctgtctgtcatggacctcaatgt

SEQ ID NO: 778520 - DNA, 25 bp, Mus musculus
tcctgtctgtgaagaacagtgaaag

SEQ ID NO: 778521 - DNA, 25 bp, Mus musculus
tcctgtctgtgatgaacagtgaaag

SEQ ID NO: 778522 - DNA, 25 bp, Mus musculus
tcctgtctgtggaaatggtgccctg

SEQ ID NO: 778523 - DNA, 25 bp, Mus musculus
tcctgtctgtggtaatggtgccctg

SEQ ID NO: 778524 - DNA, 25 bp, Mus musculus
tcctgtctgttgctgcccagacact

SEQ ID NO: 778525 - DNA, 25 bp, Mus musculus
tcctgtctgttggtgcccagacact

SEQ ID NO: 778526 - DNA, 25 bp, Mus musculus
tcctgtgaaactcttccgggtccgg

SEQ ID NO: 778527 - DNA, 25 bp, Mus musculus
tcctgtgaaactgttccgggtccgg

SEQ ID NO: 778528 - DNA, 25 bp, Mus musculus
tcctgtgaagatatccagtgtggcg

SEQ ID NO: 778529 - DNA, 25 bp, Mus musculus
tcctgtgaagatttccagtgtggcg

SEQ ID NO: 778530 - DNA, 25 bp, Mus musculus
tcctgtgacatgctttttggccctg

SEQ ID NO: 778531 - DNA, 25 bp, Mus musculus
tcctgtgacatggtttttggccctg

SEQ ID NO: 778532 - DNA, 25 bp, Mus musculus
tcctgtgacattagtcagagagcaa

SEQ ID NO: 778533 - DNA, 25 bp, Mus musculus
tcctgtgacatttgtcagagagcaa

SEQ ID NO: 778534 - DNA, 25 bp, Mus musculus
tcctgtgaccgcatcaaagatgagt

SEQ ID NO: 778535 - DNA, 25 bp, Mus musculus
tcctgtgaccgcttcaaagatgagt

SEQ ID NO: 778536 - DNA, 25 bp, Mus musculus
tcctgtgagatcacaacagggccac

SEQ ID NO: 778537 - DNA, 25 bp, Mus musculus
tcctgtgagatctcaacagggccac

SEQ ID NO: 778538 - DNA, 25 bp, Mus musculus
tcctgtgagattcgctgacccgagc

SEQ ID NO: 778539 - DNA, 25 bp, Mus musculus
tcctgtgagattggctgacccgagc

SEQ ID NO: 778540 - DNA, 25 bp, Mus musculus
tcctgtgagcgcaaccgtgcagatg

SEQ ID NO: 778541 - DNA, 25 bp, Mus musculus
tcctgtgagcgctaccgtgcagatg

SEQ ID NO: 778542 - DNA, 25 bp, Mus musculus
tcctgtgagctgaaccgattgtcca

SEQ ID NO: 778543 - DNA, 25 bp, Mus musculus
tcctgtgagctgtaccgattgtcca

SEQ ID NO: 778544 - DNA, 25 bp, Mus musculus
tcctgtgagggcatcagtgccccac

SEQ ID NO: 778545 - DNA, 25 bp, Mus musculus
tcctgtgagggcttcagtgccccac

SEQ ID NO: 778546 - DNA, 25 bp, Mus musculus
tcctgtgcaggtcttcttccaggag

SEQ ID NO: 778547 - DNA, 25 bp, Mus musculus
tcctgtgcaggtgttcttccaggag

SEQ ID NO: 778548 - DNA, 25 bp, Mus musculus
tcctgtgccaggatggaggtctgct

SEQ ID NO: 778549 - DNA, 25 bp, Mus musculus
tcctgtgccaggttggaggtctgct

SEQ ID NO: 778550 - DNA, 25 bp, Mus musculus
tcctgtgcccctagtttgatgcaag

SEQ ID NO: 778551 - DNA, 25 bp, Mus musculus
tcctgtgccccttgtttgatgcaag

SEQ ID NO: 778552 - DNA, 25 bp, Mus musculus
tcctgtgccggcctgactacctgag

SEQ ID NO: 778553 - DNA, 25 bp, Mus musculus
tcctgtgccggcgtgactacctgag

SEQ ID NO: 778554 - DNA, 25 bp, Mus musculus
tcctgtgcgagcctaggaaccctaa

SEQ ID NO: 778555 - DNA, 25 bp, Mus musculus
tcctgtgcgagcgtaggaaccctaa

SEQ ID NO: 778556 - DNA, 25 bp, Mus musculus
tcctgtgcgtccagcttcaatgacc

SEQ ID NO: 778557 - DNA, 25 bp, Mus musculus
tcctgtgcgtcctgcttcaatgacc

SEQ ID NO: 778558 - DNA, 25 bp, Mus musculus
tcctgtgctcaaagagctgccagtc

SEQ ID NO: 778559 - DNA, 25 bp, Mus musculus
tcctgtgctcaacctgatggctgaa

SEQ ID NO: 778560 - DNA, 25 bp, Mus musculus
tcctgtgctcaagctgatggctgaa

SEQ ID NO: 778561 - DNA, 25 bp, Mus musculus
tcctgtgctcaatgagctgccagtc

SEQ ID NO: 778562 - DNA, 25 bp, Mus musculus
tcctgtgctctactgtgggaccgca

SEQ ID NO: 778563 - DNA, 25 bp, Mus musculus
tcctgtgctctagtgtgggaccgca

SEQ ID NO: 778564 - DNA, 25 bp, Mus musculus
tcctgtgctgaacgcagcccaaagt

SEQ ID NO: 778565 - DNA, 25 bp, Mus musculus
tcctgtgctgaaggcagcccaaagt

SEQ ID NO: 778566 - DNA, 25 bp, Mus musculus
tcctgtgctgggacaagcccaggat

SEQ ID NO: 778567 - DNA, 25 bp, Mus musculus
tcctgtgctgggtcaagcccaggat

SEQ ID NO: 778568 - DNA, 25 bp, Mus musculus
tcctgtggaccaatacccaaaagct

SEQ ID NO: 778569 - DNA, 25 bp, Mus musculus
tcctgtggaccattacccaaaagct

SEQ ID NO: 778570 - DNA, 25 bp, Mus musculus
tcctgtggagccacatggtgagatg

SEQ ID NO: 778571 - DNA, 25 bp, Mus musculus
tcctgtggagcctcatggtgagatg

SEQ ID NO: 778572 - DNA, 25 bp, Mus musculus
tcctgtggaggtacctgcagaggca

SEQ ID NO: 778573 - DNA, 25 bp, Mus musculus
tcctgtggaggttcctgcagaggca

SEQ ID NO: 778574 - DNA, 25 bp, Mus musculus
tcctgtggatgcatctggaatgtcc

SEQ ID NO: 778575 - DNA, 25 bp, Mus musculus
tcctgtggatgcttctggaatgtcc

SEQ ID NO: 778576 - DNA, 25 bp, Mus musculus
tcctgtggcacacaaggctttcgca

SEQ ID NO: 778577 - DNA, 25 bp, Mus musculus
tcctgtggcacagaaggctttcgca

SEQ ID NO: 778578 - DNA, 25 bp, Mus musculus
tcctgtggccaaccagaaagtagtg

SEQ ID NO: 778579 - DNA, 25 bp, Mus musculus
tcctgtggccaagcagaaagtagtg

SEQ ID NO: 778580 - DNA, 25 bp, Mus musculus
tcctgtggccatctgcctagtaaag

SEQ ID NO: 778581 - DNA, 25 bp, Mus musculus
tcctgtggccatgtgcctagtaaag

SEQ ID NO: 778582 - DNA, 25 bp, Mus musculus
tcctgtggcccacactggtacactg

SEQ ID NO: 778583 - DNA, 25 bp, Mus musculus
tcctgtggcccagactggtacactg

SEQ ID NO: 778584 - DNA, 25 bp, Mus musculus
tcctgtggcgaacgcagtgtgaaaa

SEQ ID NO: 778585 - DNA, 25 bp, Mus musculus
tcctgtggcgaaggcagtgtgaaaa

SEQ ID NO: 778586 - DNA, 25 bp, Mus musculus
tcctgtgggaaaacacccgcttctt

SEQ ID NO: 778587 - DNA, 25 bp, Mus musculus
tcctgtgggaaatcacccgcttctt

SEQ ID NO: 778588 - DNA, 25 bp, Mus musculus
tcctgtggtaacataggaccagtgg

SEQ ID NO: 778589 - DNA, 25 bp, Mus musculus
tcctgtggtaacttaggaccagtgg

SEQ ID NO: 778590 - DNA, 25 bp, Mus musculus
tcctgtggtcatcagtggtgttcta

SEQ ID NO: 778591 - DNA, 25 bp, Mus musculus
tcctgtggtcatgagtggtgttcta

SEQ ID NO: 778592 - DNA, 25 bp, Mus musculus
tcctgtgtaagacggaggtcatgtc

SEQ ID NO: 778593 - DNA, 25 bp, Mus musculus
tcctgtgtaagagggaggtcatgtc

SEQ ID NO: 778594 - DNA, 25 bp, Mus musculus
tcctgtgtccaacgtcaggtgccca

SEQ ID NO: 778595 - DNA, 25 bp, Mus musculus
tcctgtgtccaaggtcaggtgccca

SEQ ID NO: 778596 - DNA, 25 bp, Mus musculus
tcctgtgtcccaatgggccagtgaa

SEQ ID NO: 778597 - DNA, 25 bp, Mus musculus
tcctgtgtcccattgggccagtgaa

SEQ ID NO: 778598 - DNA, 25 bp, Mus musculus
tcctgtgtcgcaaggcctgatggga

SEQ ID NO: 778599 - DNA, 25 bp, Mus musculus
tcctgtgtcgcatggcctgatggga

SEQ ID NO: 778600 - DNA, 25 bp, Mus musculus
tcctgtgtctgcagtacgatgagag

SEQ ID NO: 778601 - DNA, 25 bp, Mus musculus
tcctgtgtctgctgtacgatgagag

SEQ ID NO: 778602 - DNA, 25 bp, Mus musculus
tcctgtgtctgtacggcatggtttg

SEQ ID NO: 778603 - DNA, 25 bp, Mus musculus
tcctgtgtctgttcggcatggtttg

SEQ ID NO: 778604 - DNA, 25 bp, Mus musculus
tcctgtgtgcggacgctgtgccctc

SEQ ID NO: 778605 - DNA, 25 bp, Mus musculus
tcctgtgtgcggtcgctgtgccctc

SEQ ID NO: 778606 - DNA, 25 bp, Mus musculus
tcctgtgtggttccacaatgcctaa

SEQ ID NO: 778607 - DNA, 25 bp, Mus musculus
tcctgtgtggttgcacaatgcctaa

SEQ ID NO: 778608 - DNA, 25 bp, Mus musculus
tcctgtgtgtatctggacaatgagt

SEQ ID NO: 778609 - DNA, 25 bp, Mus musculus
tcctgtgtgtatgtggacaatgagt

SEQ ID NO: 778610 - DNA, 25 bp, Mus musculus
tcctgtgttctcaggcactccaaag

SEQ ID NO: 778611 - DNA, 25 bp, Mus musculus
tcctgtgttctcagtagagctggtg

SEQ ID NO: 778612 - DNA, 25 bp, Mus musculus
tcctgtgttctctggcactccaaag

SEQ ID NO: 778613 - DNA, 25 bp, Mus musculus
tcctgtgttctctgtagagctggtg

SEQ ID NO: 778614 - DNA, 25 bp, Mus musculus
tcctgttaaaggaaaatcacacaag

SEQ ID NO: 778615 - DNA, 25 bp, Mus musculus
tcctgttaaaggtaaatcacacaag

SEQ ID NO: 778616 - DNA, 25 bp, Mus musculus
tcctgttaagtgagatctcactgct

SEQ ID NO: 778617 - DNA, 25 bp, Mus musculus
tcctgttaagtgtgatctcactgct

SEQ ID NO: 778618 - DNA, 25 bp, Mus musculus
tcctgttacaccaagagcggcatga

SEQ ID NO: 778619 - DNA, 25 bp, Mus musculus
tcctgttacacctagagcggcatga

SEQ ID NO: 778620 - DNA, 25 bp, Mus musculus
tcctgttacaggaatggttatgaat

SEQ ID NO: 778621 - DNA, 25 bp, Mus musculus
tcctgttacaggtatggttatgaat

SEQ ID NO: 778622 - DNA, 25 bp, Mus musculus
tcctgttacctaccccagctgtggg

SEQ ID NO: 778623 - DNA, 25 bp, Mus musculus
tcctgttacctagcccagctgtggg

SEQ ID NO: 778624 - DNA, 25 bp, Mus musculus
tcctgttactgcagcaaacacacca

SEQ ID NO: 778625 - DNA, 25 bp, Mus musculus
tcctgttactgctgcaaacacacca

SEQ ID NO: 778626 - DNA, 25 bp, Mus musculus
tcctgttagattaggattctccggc

SEQ ID NO: 778627 - DNA, 25 bp, Mus musculus
tcctgttagatttggattctccggc

SEQ ID NO: 778628 - DNA, 25 bp, Mus musculus
tcctgttatataagaacggcatcag

SEQ ID NO: 778629 - DNA, 25 bp, Mus musculus
tcctgttatatatgaacggcatcag

SEQ ID NO: 778630 - DNA, 25 bp, Mus musculus
tcctgttattctattaggaccaagg

SEQ ID NO: 778631 - DNA, 25 bp, Mus musculus
tcctgttattcttttaggaccaagg

SEQ ID NO: 778632 - DNA, 25 bp, Mus musculus
tcctgttcagtgaaatggacacaga

SEQ ID NO: 778633 - DNA, 25 bp, Mus musculus
tcctgttcagtgtaatggacacaga

SEQ ID NO: 778634 - DNA, 25 bp, Mus musculus
tcctgttcagttcgaaaaaattgct

SEQ ID NO: 778635 - DNA, 25 bp, Mus musculus
tcctgttcagttggaaaaaattgct

SEQ ID NO: 778636 - DNA, 25 bp, Mus musculus
tcctgttcattgagggagtcacctg

SEQ ID NO: 778637 - DNA, 25 bp, Mus musculus
tcctgttcattgtgggagtcacctg

SEQ ID NO: 778638 - DNA, 25 bp, Mus musculus
tcctgttccacactcagaagaacaa

SEQ ID NO: 778639 - DNA, 25 bp, Mus musculus
tcctgttccacagtcagaagaacaa

SEQ ID NO: 778640 - DNA, 25 bp, Mus musculus
tcctgttccgctatgccgatgactc

SEQ ID NO: 778641 - DNA, 25 bp, Mus musculus
tcctgttccgctttgccgatgactc

SEQ ID NO: 778642 - DNA, 25 bp, Mus musculus
tcctgttcctctacatcctctggag

SEQ ID NO: 778643 - DNA, 25 bp, Mus musculus
tcctgttcctcttcatcctctggag

SEQ ID NO: 778644 - DNA, 25 bp, Mus musculus
tcctgttcgaagctgttcttcatat

SEQ ID NO: 778645 - DNA, 25 bp, Mus musculus
tcctgttcgaaggtgttcttcatat

SEQ ID NO: 778646 - DNA, 25 bp, Mus musculus
tcctgttctggccaatgtttctgaa

SEQ ID NO: 778647 - DNA, 25 bp, Mus musculus
tcctgttctggcgaatgtttctgaa

SEQ ID NO: 778648 - DNA, 25 bp, Mus musculus
tcctgttctgtgacctgtggtgacg

SEQ ID NO: 778649 - DNA, 25 bp, Mus musculus
tcctgttctgtgtcctgtggtgacg

SEQ ID NO: 778650 - DNA, 25 bp, Mus musculus
tcctgttgagcaacagatctgtcct

SEQ ID NO: 778651 - DNA, 25 bp, Mus musculus
tcctgttgagcatcagatctgtcct

SEQ ID NO: 778652 - DNA, 25 bp, Mus musculus
tcctgttgcataagtgtggaagaca

SEQ ID NO: 778653 - DNA, 25 bp, Mus musculus
tcctgttgcatatgtgtggaagaca

SEQ ID NO: 778654 - DNA, 25 bp, Mus musculus
tcctgttgcggcaccatcaagacag

SEQ ID NO: 778655 - DNA, 25 bp, Mus musculus
tcctgttgcggctccatcaagacag

SEQ ID NO: 778656 - DNA, 25 bp, Mus musculus
tcctgttgcttgatgccgtcatcta

SEQ ID NO: 778657 - DNA, 25 bp, Mus musculus
tcctgttgcttgttgccgtcatcta

SEQ ID NO: 778658 - DNA, 25 bp, Mus musculus
tcctgttgggcaaccacgacatcat

SEQ ID NO: 778659 - DNA, 25 bp, Mus musculus
tcctgttgggcatccacgacatcat

SEQ ID NO: 778660 - DNA, 25 bp, Mus musculus
tcctgttgtagcagttgcaggcctt

SEQ ID NO: 778661 - DNA, 25 bp, Mus musculus
tcctgttgtagctgttgcaggcctt

SEQ ID NO: 778662 - DNA, 25 bp, Mus musculus
tcctgttgttccactagaatgctat

SEQ ID NO: 778663 - DNA, 25 bp, Mus musculus
tcctgttgttcccagtcatgctgcc

SEQ ID NO: 778664 - DNA, 25 bp, Mus musculus
tcctgttgttccgagtcatgctgcc

SEQ ID NO: 778665 - DNA, 25 bp, Mus musculus
tcctgttgttcctctagaatgctat

SEQ ID NO: 778666 - DNA, 25 bp, Mus musculus
tcctgtttaggccatgatttccggg

SEQ ID NO: 778667 - DNA, 25 bp, Mus musculus
tcctgtttaggcgatgatttccggg

SEQ ID NO: 778668 - DNA, 25 bp, Mus musculus
tcctgtttcaaccagtggcagagct

SEQ ID NO: 778669 - DNA, 25 bp, Mus musculus
tcctgtttcaacgagtggcagagct

SEQ ID NO: 778670 - DNA, 25 bp, Mus musculus
tcctgtttcaggatgacatgacaac

SEQ ID NO: 778671 - DNA, 25 bp, Mus musculus
tcctgtttcaggttgacatgacaac

SEQ ID NO: 778672 - DNA, 25 bp, Mus musculus
tcctgtttcagtcccttccagcaag

SEQ ID NO: 778673 - DNA, 25 bp, Mus musculus
tcctgtttcagtgccttccagcaag

SEQ ID NO: 778674 - DNA, 25 bp, Mus musculus
tcctgtttgaaaaaagtgccaccta

SEQ ID NO: 778675 - DNA, 25 bp, Mus musculus
tcctgtttgaaataagtgccaccta

SEQ ID NO: 778676 - DNA, 25 bp, Mus musculus
tcctgtttgggaccggcctgcctgt

SEQ ID NO: 778677 - DNA, 25 bp, Mus musculus
tcctgtttgggagcggcctgcctgt

SEQ ID NO: 778678 - DNA, 25 bp, Mus musculus
tcctgtttgggcacttgtcgttctc

SEQ ID NO: 778679 - DNA, 25 bp, Mus musculus
tcctgtttgggctcttgtcgttctc

SEQ ID NO: 778680 - DNA, 25 bp, Mus musculus
tcctgtttgggtccctgagctgtga

SEQ ID NO: 778681 - DNA, 25 bp, Mus musculus
tcctgtttgggtgcctgagctgtga

SEQ ID NO: 778682 - DNA, 25 bp, Mus musculus
tcctgttttattcgaaatgttcttc

SEQ ID NO: 778683 - DNA, 25 bp, Mus musculus
tcctgttttattggaaatgttcttc

SEQ ID NO: 778684 - DNA, 25 bp, Mus musculus
tcctgttttctacgtggaaggaatc

SEQ ID NO: 778685 - DNA, 25 bp, Mus musculus
tcctgttttctaggtggaaggaatc

SEQ ID NO: 778686 - DNA, 25 bp, Mus musculus
tccttaaactggaggcctcggaaca

SEQ ID NO: 778687 - DNA, 25 bp, Mus musculus
tccttaaactggtggcctcggaaca

SEQ ID NO: 778688 - DNA, 25 bp, Mus musculus
tccttaaactttagcctgatgatta

SEQ ID NO: 778689 - DNA, 25 bp, Mus musculus
tccttaaacttttgcctgatgatta

SEQ ID NO: 778690 - DNA, 25 bp, Mus musculus
tccttaaaggtgaaattagtacatt

SEQ ID NO: 778691 - DNA, 25 bp, Mus musculus
tccttaaaggtgtaattagtacatt

SEQ ID NO: 778692 - DNA, 25 bp, Mus musculus
tccttaacaggaagggtgcagcgaa

SEQ ID NO: 778693 - DNA, 25 bp, Mus musculus
tccttaacaggatgggtgcagcgaa

SEQ ID NO: 778694 - DNA, 25 bp, Mus musculus
tccttaacaggtccattcacacagc

SEQ ID NO: 778695 - DNA, 25 bp, Mus musculus
tccttaacaggtgcattcacacagc

SEQ ID NO: 778696 - DNA, 25 bp, Mus musculus
tccttaacctccatcagtaatgatg

SEQ ID NO: 778697 - DNA, 25 bp, Mus musculus
tccttaacctccttcagtaatgatg

SEQ ID NO: 778698 - DNA, 25 bp, Mus musculus
tccttaagaaccagaggaagccgtt

SEQ ID NO: 778699 - DNA, 25 bp, Mus musculus
tccttaagaacctgaggaagccgtt

SEQ ID NO: 778700 - DNA, 25 bp, Mus musculus
tccttaaggagaccaagacgcctgc

SEQ ID NO: 778701 - DNA, 25 bp, Mus musculus
tccttaaggagagcaagacgcctgc

SEQ ID NO: 778702 - DNA, 25 bp, Mus musculus
tccttaatggctcagacatccactc

SEQ ID NO: 778703 - DNA, 25 bp, Mus musculus
tccttaatggctgagacatccactc

SEQ ID NO: 778704 - DNA, 25 bp, Mus musculus
tccttacaagatagaggccgtgaag

SEQ ID NO: 778705 - DNA, 25 bp, Mus musculus
tccttacaagattgaggccgtgaag

SEQ ID NO: 778706 - DNA, 25 bp, Mus musculus
tccttaccactaacagagagtagag

SEQ ID NO: 778707 - DNA, 25 bp, Mus musculus
tccttaccactatcagagagtagag

SEQ ID NO: 778708 - DNA, 25 bp, Mus musculus
tccttaccagtacagtgcgcagatg

SEQ ID NO: 778709 - DNA, 25 bp, Mus musculus
tccttaccagtagagtgcgcagatg

SEQ ID NO: 778710 - DNA, 25 bp, Mus musculus
tccttacctgtccttccttgtgtct

SEQ ID NO: 778711 - DNA, 25 bp, Mus musculus
tccttacctgtcgttccttgtgtct

SEQ ID NO: 778712 - DNA, 25 bp, Mus musculus
tccttacgcaagaccagctgtgagc

SEQ ID NO: 778713 - DNA, 25 bp, Mus musculus
tccttacgcaagtccagctgtgagc

SEQ ID NO: 778714 - DNA, 25 bp, Mus musculus
tccttacggcccactctgagcagaa

SEQ ID NO: 778715 - DNA, 25 bp, Mus musculus
tccttacggccctctctgagcagaa

SEQ ID NO: 778716 - DNA, 25 bp, Mus musculus
tccttactgagactgtaaatagtgt

SEQ ID NO: 778717 - DNA, 25 bp, Mus musculus
tccttactgagagtgtaaatagtgt

SEQ ID NO: 778718 - DNA, 25 bp, Mus musculus
tccttactgcttctcaacttggagg

SEQ ID NO: 778719 - DNA, 25 bp, Mus musculus
tccttactgcttgtcaacttggagg

SEQ ID NO: 778720 - DNA, 25 bp, Mus musculus
tccttactggaaatttgcaactggg

SEQ ID NO: 778721 - DNA, 25 bp, Mus musculus
tccttactggaattttgcaactggg

SEQ ID NO: 778722 - DNA, 25 bp, Mus musculus
tccttactggtactgtgctccctca

SEQ ID NO: 778723 - DNA, 25 bp, Mus musculus
tccttactggtagtgtgctccctca

SEQ ID NO: 778724 - DNA, 25 bp, Mus musculus
tccttagagatccagaaacccgctg

SEQ ID NO: 778725 - DNA, 25 bp, Mus musculus
tccttagagatcgagaaacccgctg

SEQ ID NO: 778726 - DNA, 25 bp, Mus musculus
tccttagaggcaccaagagtcttgg

SEQ ID NO: 778727 - DNA, 25 bp, Mus musculus
tccttagaggcagcaagagtcttgg

SEQ ID NO: 778728 - DNA, 25 bp, Mus musculus
tccttagcctgaagccgatagcggg

SEQ ID NO: 778729 - DNA, 25 bp, Mus musculus
tccttagcctgatgccgatagcggg

SEQ ID NO: 778730 - DNA, 25 bp, Mus musculus
tccttagcgccgattccacgggaag

SEQ ID NO: 778731 - DNA, 25 bp, Mus musculus
tccttagcgccgtttccacgggaag

SEQ ID NO: 778732 - DNA, 25 bp, Mus musculus
tccttaggagagcaggcctgaagcc

SEQ ID NO: 778733 - DNA, 25 bp, Mus musculus
tccttaggagaggaggcctgaagcc

SEQ ID NO: 778734 - DNA, 25 bp, Mus musculus
tccttaggcattcctttccagcggg

SEQ ID NO: 778735 - DNA, 25 bp, Mus musculus
tccttaggcattgctttccagcggg

SEQ ID NO: 778736 - DNA, 25 bp, Mus musculus
tccttaggcctactagagaggcggt

SEQ ID NO: 778737 - DNA, 25 bp, Mus musculus
tccttaggcctagtagagaggcggt

SEQ ID NO: 778738 - DNA, 25 bp, Mus musculus
tccttaggttgtccccagcgagatg

SEQ ID NO: 778739 - DNA, 25 bp, Mus musculus
tccttaggttgtgcccagcgagatg

SEQ ID NO: 778740 - DNA, 25 bp, Mus musculus
tccttagtgctgctctgggtgatca

SEQ ID NO: 778741 - DNA, 25 bp, Mus musculus
tccttagtgctggtctgggtgatca

SEQ ID NO: 778742 - DNA, 25 bp, Mus musculus
tccttagtgggtcatgcagcttcgg

SEQ ID NO: 778743 - DNA, 25 bp, Mus musculus
tccttagtgggtgatgcagcttcgg

SEQ ID NO: 778744 - DNA, 25 bp, Mus musculus
tccttagtggtaccttttgtctgca

SEQ ID NO: 778745 - DNA, 25 bp, Mus musculus
tccttagtggtagcttttgtctgca

SEQ ID NO: 778746 - DNA, 25 bp, Mus musculus
tccttatcatctattgagcctctgt

SEQ ID NO: 778747 - DNA, 25 bp, Mus musculus
tccttatcatcttttgagcctctgt

SEQ ID NO: 778748 - DNA, 25 bp, Mus musculus
tccttatccaagatcaccagttcag

SEQ ID NO: 778749 - DNA, 25 bp, Mus musculus
tccttatccaagttcaccagttcag

SEQ ID NO: 778750 - DNA, 25 bp, Mus musculus
tccttatccaggagcgagggcagtc

SEQ ID NO: 778751 - DNA, 25 bp, Mus musculus
tccttatccaggtgcgagggcagtc

SEQ ID NO: 778752 - DNA, 25 bp, Mus musculus
tccttatcccaaactcattctgcag

SEQ ID NO: 778753 - DNA, 25 bp, Mus musculus
tccttatcccaatctcattctgcag

SEQ ID NO: 778754 - DNA, 25 bp, Mus musculus
tccttatcctctccgggaacaagaa

SEQ ID NO: 778755 - DNA, 25 bp, Mus musculus
tccttatcctctgcgggaacaagaa

SEQ ID NO: 778756 - DNA, 25 bp, Mus musculus
tccttatgacccaaggcatcgggct

SEQ ID NO: 778757 - DNA, 25 bp, Mus musculus
tccttatgaccctaggcatcgggct

SEQ ID NO: 778758 - DNA, 25 bp, Mus musculus
tccttatgatatcggaagtaagtgg

SEQ ID NO: 778759 - DNA, 25 bp, Mus musculus
tccttatgatatgggaagtaagtgg

SEQ ID NO: 778760 - DNA, 25 bp, Mus musculus
tccttatgctacacttttagaacac

SEQ ID NO: 778761 - DNA, 25 bp, Mus musculus
tccttatgctactcttttagaacac

SEQ ID NO: 778762 - DNA, 25 bp, Mus musculus
tccttattcgagatgagctgcacac

SEQ ID NO: 778763 - DNA, 25 bp, Mus musculus
tccttattcgagttgagctgcacac

SEQ ID NO: 778764 - DNA, 25 bp, Mus musculus
tccttcaagctgcatggagtgcttc

SEQ ID NO: 778765 - DNA, 25 bp, Mus musculus
tccttcaagctggatggagtgcttc

SEQ ID NO: 778766 - DNA, 25 bp, Mus musculus
tccttcacagaaagtccatggcaga

SEQ ID NO: 778767 - DNA, 25 bp, Mus musculus
tccttcacagaatgtccatggcaga

SEQ ID NO: 778768 - DNA, 25 bp, Mus musculus
tccttcacattgcagcagttgctgg

SEQ ID NO: 778769 - DNA, 25 bp, Mus musculus
tccttcacattggagcagttgctgg

SEQ ID NO: 778770 - DNA, 25 bp, Mus musculus
tccttcaccgtcaacttctagatgg

SEQ ID NO: 778771 - DNA, 25 bp, Mus musculus
tccttcaccgtctacttctagatgg

SEQ ID NO: 778772 - DNA, 25 bp, Mus musculus
tccttcacgcaacagcaagtagctg

SEQ ID NO: 778773 - DNA, 25 bp, Mus musculus
tccttcacgcaagagcaagtagctg

SEQ ID NO: 778774 - DNA, 25 bp, Mus musculus
tccttcacggagatcattgtctctg

SEQ ID NO: 778775 - DNA, 25 bp, Mus musculus
tccttcacggagttcattgtctctg

SEQ ID NO: 778776 - DNA, 25 bp, Mus musculus
tccttcacggatagggagatacagg

SEQ ID NO: 778777 - DNA, 25 bp, Mus musculus
tccttcacggattgggagatacagg

SEQ ID NO: 778778 - DNA, 25 bp, Mus musculus
tccttcactcccagatgcaaacagt

SEQ ID NO: 778779 - DNA, 25 bp, Mus musculus
tccttcactccctgatgcaaacagt

SEQ ID NO: 778780 - DNA, 25 bp, Mus musculus
tccttcagacccagagagagctgat

SEQ ID NO: 778781 - DNA, 25 bp, Mus musculus
tccttcagaccctgagagagctgat

SEQ ID NO: 778782 - DNA, 25 bp, Mus musculus
tccttcagagtaccgcttagtgtaa

SEQ ID NO: 778783 - DNA, 25 bp, Mus musculus
tccttcagagtagcgcttagtgtaa

SEQ ID NO: 778784 - DNA, 25 bp, Mus musculus
tccttcagcaccagcggcgggtaga

SEQ ID NO: 778785 - DNA, 25 bp, Mus musculus
tccttcagcacctgcggcgggtaga

SEQ ID NO: 778786 - DNA, 25 bp, Mus musculus
tccttcagcagaactggtccagggt

SEQ ID NO: 778787 - DNA, 25 bp, Mus musculus
tccttcagcagatctggtccagggt

SEQ ID NO: 778788 - DNA, 25 bp, Mus musculus
tccttcagctttcaagttccgttcg

SEQ ID NO: 778789 - DNA, 25 bp, Mus musculus
tccttcagctttgaagttccgttcg

SEQ ID NO: 778790 - DNA, 25 bp, Mus musculus
tccttcagggtgaaatgaatgttct

SEQ ID NO: 778791 - DNA, 25 bp, Mus musculus
tccttcagggtgtaatgaatgttct

SEQ ID NO: 778792 - DNA, 25 bp, Mus musculus
tccttcaggtctacagtgggtctga

SEQ ID NO: 778793 - DNA, 25 bp, Mus musculus
tccttcaggtcttcagtgggtctga

SEQ ID NO: 778794 - DNA, 25 bp, Mus musculus
tccttcaggttaaatgtcagctgac

SEQ ID NO: 778795 - DNA, 25 bp, Mus musculus
tccttcaggttatatgtcagctgac

SEQ ID NO: 778796 - DNA, 25 bp, Mus musculus
tccttcagtaaactctgtacgagct

SEQ ID NO: 778797 - DNA, 25 bp, Mus musculus
tccttcagtaaagtctgtacgagct

SEQ ID NO: 778798 - DNA, 25 bp, Mus musculus
tccttcagtgctagaacagaacagc

SEQ ID NO: 778799 - DNA, 25 bp, Mus musculus
tccttcagtgctatgtctcttccgg

SEQ ID NO: 778800 - DNA, 25 bp, Mus musculus
tccttcagtgcttgaacagaacagc

SEQ ID NO: 778801 - DNA, 25 bp, Mus musculus
tccttcagtgctttgtctcttccgg

SEQ ID NO: 778802 - DNA, 25 bp, Mus musculus
tccttcagtggaaccaggagaccag

SEQ ID NO: 778803 - DNA, 25 bp, Mus musculus
tccttcagtggatccaggagaccag

SEQ ID NO: 778804 - DNA, 25 bp, Mus musculus
tccttcatcaatagaggacatatca

SEQ ID NO: 778805 - DNA, 25 bp, Mus musculus
tccttcatcaattgaggacatatca

SEQ ID NO: 778806 - DNA, 25 bp, Mus musculus
tccttcatcgaaaacatcaagagcc

SEQ ID NO: 778807 - DNA, 25 bp, Mus musculus
tccttcatcgaatacatcaagagcc

SEQ ID NO: 778808 - DNA, 25 bp, Mus musculus
tccttcatcgatcaggaaacagagg

SEQ ID NO: 778809 - DNA, 25 bp, Mus musculus
tccttcatcgatgaggaaacagagg

SEQ ID NO: 778810 - DNA, 25 bp, Mus musculus
tccttccacgttaccgagctgaagg

SEQ ID NO: 778811 - DNA, 25 bp, Mus musculus
tccttccacgtttccgagctgaagg

SEQ ID NO: 778812 - DNA, 25 bp, Mus musculus
tccttccaggaaaggacagccggaa

SEQ ID NO: 778813 - DNA, 25 bp, Mus musculus
tccttccaggaatggacagccggaa

SEQ ID NO: 778814 - DNA, 25 bp, Mus musculus
tccttccatgaacacaagcaggtga

SEQ ID NO: 778815 - DNA, 25 bp, Mus musculus
tccttccatgaagacaagcaggtga

SEQ ID NO: 778816 - DNA, 25 bp, Mus musculus
tccttccatgatcccctaaagggat

SEQ ID NO: 778817 - DNA, 25 bp, Mus musculus
tccttccatgatgccctaaagggat

SEQ ID NO: 778818 - DNA, 25 bp, Mus musculus
tccttcccactcaactttgcagagg

SEQ ID NO: 778819 - DNA, 25 bp, Mus musculus
tccttcccactctactttgcagagg

SEQ ID NO: 778820 - DNA, 25 bp, Mus musculus
tccttcccactgcacacagttgagg

SEQ ID NO: 778821 - DNA, 25 bp, Mus musculus
tccttcccactggacacagttgagg

SEQ ID NO: 778822 - DNA, 25 bp, Mus musculus
tccttcccaggcagtgtctcgtgtc

SEQ ID NO: 778823 - DNA, 25 bp, Mus musculus
tccttcccaggctgtgtctcgtgtc

SEQ ID NO: 778824 - DNA, 25 bp, Mus musculus
tccttcccgagaagttgtgatcgga

SEQ ID NO: 778825 - DNA, 25 bp, Mus musculus
tccttcccgagatgttgtgatcgga

SEQ ID NO: 778826 - DNA, 25 bp, Mus musculus
tccttcccgggtctggcatctgatg

SEQ ID NO: 778827 - DNA, 25 bp, Mus musculus
tccttcccgggtgtggcatctgatg

SEQ ID NO: 778828 - DNA, 25 bp, Mus musculus
tccttcccggtgcagattttgccct

SEQ ID NO: 778829 - DNA, 25 bp, Mus musculus
tccttcccggtggagattttgccct

SEQ ID NO: 778830 - DNA, 25 bp, Mus musculus
tccttccgctgcctgtgtgaccagg

SEQ ID NO: 778831 - DNA, 25 bp, Mus musculus
tccttccgctgcgtgtgtgaccagg

SEQ ID NO: 778832 - DNA, 25 bp, Mus musculus
tccttccggaagagacccacgtgct

SEQ ID NO: 778833 - DNA, 25 bp, Mus musculus
tccttccggaagtgacccacgtgct

SEQ ID NO: 778834 - DNA, 25 bp, Mus musculus
tccttcctcctgagctcagtcgatt

SEQ ID NO: 778835 - DNA, 25 bp, Mus musculus
tccttcctcctgtgctcagtcgatt

SEQ ID NO: 778836 - DNA, 25 bp, Mus musculus
tccttcctgaaaatcaaatgcctgg

SEQ ID NO: 778837 - DNA, 25 bp, Mus musculus
tccttcctgaaattcaaatgcctgg

SEQ ID NO: 778838 - DNA, 25 bp, Mus musculus
tccttcctgaggagctgatgatcct

SEQ ID NO: 778839 - DNA, 25 bp, Mus musculus
tccttcctgaggatgctggccgata

SEQ ID NO: 778840 - DNA, 25 bp, Mus musculus
tccttcctgaggtgctgatgatcct

SEQ ID NO: 778841 - DNA, 25 bp, Mus musculus
tccttcctgaggttgctggccgata

SEQ ID NO: 778842 - DNA, 25 bp, Mus musculus
tccttcctgcagagtgtggaaaatg

SEQ ID NO: 778843 - DNA, 25 bp, Mus musculus
tccttcctgcagtgtgtggaaaatg

SEQ ID NO: 778844 - DNA, 25 bp, Mus musculus
tccttcctggtcagtttgtactaca

SEQ ID NO: 778845 - DNA, 25 bp, Mus musculus
tccttcctggtctgtttgtactaca

SEQ ID NO: 778846 - DNA, 25 bp, Mus musculus
tccttcctgtgtctatccgtaggct

SEQ ID NO: 778847 - DNA, 25 bp, Mus musculus
tccttcctgtgtgtatccgtaggct

SEQ ID NO: 778848 - DNA, 25 bp, Mus musculus
tccttccttaggatgtttatgacaa

SEQ ID NO: 778849 - DNA, 25 bp, Mus musculus
tccttccttaggttgtttatgacaa

SEQ ID NO: 778850 - DNA, 25 bp, Mus musculus
tccttccttcatacatgctgagctc

SEQ ID NO: 778851 - DNA, 25 bp, Mus musculus
tccttccttcattcatgctgagctc

SEQ ID NO: 778852 - DNA, 25 bp, Mus musculus
tccttccttgggatgagtctctgcc

SEQ ID NO: 778853 - DNA, 25 bp, Mus musculus
tccttccttgggttgagtctctgcc

SEQ ID NO: 778854 - DNA, 25 bp, Mus musculus
tccttcgaaggccttcaggctgagg

SEQ ID NO: 778855 - DNA, 25 bp, Mus musculus
tccttcgaaggcgttcaggctgagg

SEQ ID NO: 778856 - DNA, 25 bp, Mus musculus
tccttcgacaggacaagaaaactgt

SEQ ID NO: 778857 - DNA, 25 bp, Mus musculus
tccttcgacaggtcaagaaaactgt

SEQ ID NO: 778858 - DNA, 25 bp, Mus musculus
tccttcgacccgcaagactggaagt

SEQ ID NO: 778859 - DNA, 25 bp, Mus musculus
tccttcgacccggaagactggaagt

SEQ ID NO: 778860 - DNA, 25 bp, Mus musculus
tccttcgagcatccgtggagctcct

SEQ ID NO: 778861 - DNA, 25 bp, Mus musculus
tccttcgagcatgcgtggagctcct

SEQ ID NO: 778862 - DNA, 25 bp, Mus musculus
tccttcgagtgaccacgatctctgg

SEQ ID NO: 778863 - DNA, 25 bp, Mus musculus
tccttcgagtgagcacgatctctgg

SEQ ID NO: 778864 - DNA, 25 bp, Mus musculus
tccttcgcagtgaggctgtcttcgc

SEQ ID NO: 778865 - DNA, 25 bp, Mus musculus
tccttcgcagtgtggctgtcttcgc

SEQ ID NO: 778866 - DNA, 25 bp, Mus musculus
tccttcgccaggagacagggttttt

SEQ ID NO: 778867 - DNA, 25 bp, Mus musculus
tccttcgccaggtgacagggttttt

SEQ ID NO: 778868 - DNA, 25 bp, Mus musculus
tccttcgcgctcagctgtgctgaat

SEQ ID NO: 778869 - DNA, 25 bp, Mus musculus
tccttcgcgctctgctgtgctgaat

SEQ ID NO: 778870 - DNA, 25 bp, Mus musculus
tccttcgctattcgaccagagggag

SEQ ID NO: 778871 - DNA, 25 bp, Mus musculus
tccttcgctattggaccagagggag

SEQ ID NO: 778872 - DNA, 25 bp, Mus musculus
tccttcgctggactgctggcacaga

SEQ ID NO: 778873 - DNA, 25 bp, Mus musculus
tccttcgctggagtgctggcacaga

SEQ ID NO: 778874 - DNA, 25 bp, Mus musculus
tccttcggaatactgcagatggcgc

SEQ ID NO: 778875 - DNA, 25 bp, Mus musculus
tccttcggaatagtgcagatggcgc

SEQ ID NO: 778876 - DNA, 25 bp, Mus musculus
tccttcggagttacctggtggacaa

SEQ ID NO: 778877 - DNA, 25 bp, Mus musculus
tccttcggagtttcctggtggacaa

SEQ ID NO: 778878 - DNA, 25 bp, Mus musculus
tccttcggcgagctccacagaatga

SEQ ID NO: 778879 - DNA, 25 bp, Mus musculus
tccttcggcgaggtccacagaatga

SEQ ID NO: 778880 - DNA, 25 bp, Mus musculus
tccttcgggagaaggccgcatctca

SEQ ID NO: 778881 - DNA, 25 bp, Mus musculus
tccttcgggagatggccgcatctca

SEQ ID NO: 778882 - DNA, 25 bp, Mus musculus
tccttcgggttcaagagaggcaagg

SEQ ID NO: 778883 - DNA, 25 bp, Mus musculus
tccttcgggttctagagaggcaagg

SEQ ID NO: 778884 - DNA, 25 bp, Mus musculus
tccttcggttcacggacggaactgg

SEQ ID NO: 778885 - DNA, 25 bp, Mus musculus
tccttcggttcagggacggaactgg

SEQ ID NO: 778886 - DNA, 25 bp, Mus musculus
tccttcgtcgagctaggacgtgctt

SEQ ID NO: 778887 - DNA, 25 bp, Mus musculus
tccttcgtcgaggtaggacgtgctt

SEQ ID NO: 778888 - DNA, 25 bp, Mus musculus
tccttcgtggctctctggaccagcg

SEQ ID NO: 778889 - DNA, 25 bp, Mus musculus
tccttcgtggctgtctggaccagcg

SEQ ID NO: 778890 - DNA, 25 bp, Mus musculus
tccttcgtggtacgcattgtcccca

SEQ ID NO: 778891 - DNA, 25 bp, Mus musculus
tccttcgtggtaggcattgtcccca

SEQ ID NO: 778892 - DNA, 25 bp, Mus musculus
tccttctaccataaatgtgaaccgg

SEQ ID NO: 778893 - DNA, 25 bp, Mus musculus
tccttctaccattaatgtgaaccgg

SEQ ID NO: 778894 - DNA, 25 bp, Mus musculus
tccttctccatgatcactatgctgt

SEQ ID NO: 778895 - DNA, 25 bp, Mus musculus
tccttctccatgttcactatgctgt

SEQ ID NO: 778896 - DNA, 25 bp, Mus musculus
tccttctctgtcattaggaacacaa

SEQ ID NO: 778897 - DNA, 25 bp, Mus musculus
tccttctctgtctttaggaacacaa

SEQ ID NO: 778898 - DNA, 25 bp, Mus musculus
tccttctcttaaaggcagtgcaccc

SEQ ID NO: 778899 - DNA, 25 bp, Mus musculus
tccttctcttaatggcagtgcaccc

SEQ ID NO: 778900 - DNA, 25 bp, Mus musculus
tccttctgaggccatacacacttga

SEQ ID NO: 778901 - DNA, 25 bp, Mus musculus
tccttctgaggcgatacacacttga

SEQ ID NO: 778902 - DNA, 25 bp, Mus musculus
tccttctgcagaagcattatccaga

SEQ ID NO: 778903 - DNA, 25 bp, Mus musculus
tccttctgcagatgcattatccaga

SEQ ID NO: 778904 - DNA, 25 bp, Mus musculus
tccttctggaacagcatcacgctca

SEQ ID NO: 778905 - DNA, 25 bp, Mus musculus
tccttctggaactgcatcacgctca

SEQ ID NO: 778906 - DNA, 25 bp, Mus musculus
tccttctggacactgtggttcctct

SEQ ID NO: 778907 - DNA, 25 bp, Mus musculus
tccttctggacagtgtggttcctct

SEQ ID NO: 778908 - DNA, 25 bp, Mus musculus
tccttctggaggaatgagtttgact

SEQ ID NO: 778909 - DNA, 25 bp, Mus musculus
tccttctggaggtatgagtttgact

SEQ ID NO: 778910 - DNA, 25 bp, Mus musculus
tccttctggcgtagagcagctctcg

SEQ ID NO: 778911 - DNA, 25 bp, Mus musculus
tccttctggcgttgagcagctctcg

SEQ ID NO: 778912 - DNA, 25 bp, Mus musculus
tccttctgggcactagcaactttgg

SEQ ID NO: 778913 - DNA, 25 bp, Mus musculus
tccttctgggcagtagcaactttgg

SEQ ID NO: 778914 - DNA, 25 bp, Mus musculus
tccttctggttgcttagatgggcct

SEQ ID NO: 778915 - DNA, 25 bp, Mus musculus
tccttctggttggttagatgggcct

SEQ ID NO: 778916 - DNA, 25 bp, Mus musculus
tccttctgtgacagcgagggccaga

SEQ ID NO: 778917 - DNA, 25 bp, Mus musculus
tccttctgtgactgcgagggccaga

SEQ ID NO: 778918 - DNA, 25 bp, Mus musculus
tccttctgtgagaacgctagcccca

SEQ ID NO: 778919 - DNA, 25 bp, Mus musculus
tccttctgtgagtacgctagcccca

SEQ ID NO: 778920 - DNA, 25 bp, Mus musculus
tccttcttcctcaccgaagggctgg

SEQ ID NO: 778921 - DNA, 25 bp, Mus musculus
tccttcttcctctccgaagggctgg

SEQ ID NO: 778922 - DNA, 25 bp, Mus musculus
tccttcttcgggacgaacatcggct

SEQ ID NO: 778923 - DNA, 25 bp, Mus musculus
tccttcttcgggtcgaacatcggct

SEQ ID NO: 778924 - DNA, 25 bp, Mus musculus
tccttcttggcacgtgaggtgcagt

SEQ ID NO: 778925 - DNA, 25 bp, Mus musculus
tccttcttggcaggtgaggtgcagt

SEQ ID NO: 778926 - DNA, 25 bp, Mus musculus
tccttgaaaagaaggctggaatgca

SEQ ID NO: 778927 - DNA, 25 bp, Mus musculus
tccttgaaaagatggctggaatgca

SEQ ID NO: 778928 - DNA, 25 bp, Mus musculus
tccttgaaagagatggaagagtcca

SEQ ID NO: 778929 - DNA, 25 bp, Mus musculus
tccttgaaagagttggaagagtcca

SEQ ID NO: 778930 - DNA, 25 bp, Mus musculus
tccttgaacaggattatccccttat

SEQ ID NO: 778931 - DNA, 25 bp, Mus musculus
tccttgaacaggtttatccccttat

SEQ ID NO: 778932 - DNA, 25 bp, Mus musculus
tccttgaacgtcagcaaaagatgct

SEQ ID NO: 778933 - DNA, 25 bp, Mus musculus
tccttgaacgtctgcaaaagatgct

SEQ ID NO: 778934 - DNA, 25 bp, Mus musculus
tccttgaagagaatgtcaagacgca

SEQ ID NO: 778935 - DNA, 25 bp, Mus musculus
tccttgaagagattgtcaagacgca

SEQ ID NO: 778936 - DNA, 25 bp, Mus musculus
tccttgaagatgacgacaggctgga

SEQ ID NO: 778937 - DNA, 25 bp, Mus musculus
tccttgaagatgtcgacaggctgga

SEQ ID NO: 778938 - DNA, 25 bp, Mus musculus
tccttgaagcacagcattccattaa

SEQ ID NO: 778939 - DNA, 25 bp, Mus musculus
tccttgaagcactgcattccattaa

SEQ ID NO: 778940 - DNA, 25 bp, Mus musculus
tccttgaagccccttgctcatgttg

SEQ ID NO: 778941 - DNA, 25 bp, Mus musculus
tccttgaagcccgttgctcatgttg

SEQ ID NO: 778942 - DNA, 25 bp, Mus musculus
tccttgaatactatgaacaaaaaga

SEQ ID NO: 778943 - DNA, 25 bp, Mus musculus
tccttgaatactttgaacaaaaaga

SEQ ID NO: 778944 - DNA, 25 bp, Mus musculus
tccttgaatgaactaggctatgatg

SEQ ID NO: 778945 - DNA, 25 bp, Mus musculus
tccttgaatgaagtaggctatgatg

SEQ ID NO: 778946 - DNA, 25 bp, Mus musculus
tccttgacagatatccacctgacag

SEQ ID NO: 778947 - DNA, 25 bp, Mus musculus
tccttgacagatttccacctgacag

SEQ ID NO: 778948 - DNA, 25 bp, Mus musculus
tccttgactactattcctgtgggaa

SEQ ID NO: 778949 - DNA, 25 bp, Mus musculus
tccttgactacttttcctgtgggaa

SEQ ID NO: 778950 - DNA, 25 bp, Mus musculus
tccttgagagagaaatgtactagtg

SEQ ID NO: 778951 - DNA, 25 bp, Mus musculus
tccttgagagagtaatgtactagtg

SEQ ID NO: 778952 - DNA, 25 bp, Mus musculus
tccttgagatctactccaggatgcc

SEQ ID NO: 778953 - DNA, 25 bp, Mus musculus
tccttgagatcttctccaggatgcc

SEQ ID NO: 778954 - DNA, 25 bp, Mus musculus
tccttgagcagaagagtacgcggtg

SEQ ID NO: 778955 - DNA, 25 bp, Mus musculus
tccttgagcagatgagtacgcggtg

SEQ ID NO: 778956 - DNA, 25 bp, Mus musculus
tccttgagtccaataagagatatca

SEQ ID NO: 778957 - DNA, 25 bp, Mus musculus
tccttgagtccattaagagatatca

SEQ ID NO: 778958 - DNA, 25 bp, Mus musculus
tccttgatatccacctgagttgtaa

SEQ ID NO: 778959 - DNA, 25 bp, Mus musculus
tccttgatatcctcctgagttgtaa

SEQ ID NO: 778960 - DNA, 25 bp, Mus musculus
tccttgatcggaaggaggacgtgaa

SEQ ID NO: 778961 - DNA, 25 bp, Mus musculus
tccttgatcggatggaggacgtgaa

SEQ ID NO: 778962 - DNA, 25 bp, Mus musculus
tccttgatgcaactatcagccaggc

SEQ ID NO: 778963 - DNA, 25 bp, Mus musculus
tccttgatgcaagtatcagccaggc

SEQ ID NO: 778964 - DNA, 25 bp, Mus musculus
tccttgatgcctaacgtggaagccg

SEQ ID NO: 778965 - DNA, 25 bp, Mus musculus
tccttgatgccttacgtggaagccg

SEQ ID NO: 778966 - DNA, 25 bp, Mus musculus
tccttgatggaccaaaaccagccct

SEQ ID NO: 778967 - DNA, 25 bp, Mus musculus
tccttgatggacgaaaaccagccct

SEQ ID NO: 778968 - DNA, 25 bp, Mus musculus
tccttgatggatccaaagaacttag

SEQ ID NO: 778969 - DNA, 25 bp, Mus musculus
tccttgatggatgcaaagaacttag

SEQ ID NO: 778970 - DNA, 25 bp, Mus musculus
tccttgcaagacaggtgcagggaaa

SEQ ID NO: 778971 - DNA, 25 bp, Mus musculus
tccttgcaagactggtgcagggaaa

SEQ ID NO: 778972 - DNA, 25 bp, Mus musculus
tccttgcagtggatcggagcaacag

SEQ ID NO: 778973 - DNA, 25 bp, Mus musculus
tccttgcagtggttcggagcaacag

SEQ ID NO: 778974 - DNA, 25 bp, Mus musculus
tccttgcattgtattacgccgccag

SEQ ID NO: 778975 - DNA, 25 bp, Mus musculus
tccttgcattgttttacgccgccag

SEQ ID NO: 778976 - DNA, 25 bp, Mus musculus
tccttgccaagaagatagcatcttc

SEQ ID NO: 778977 - DNA, 25 bp, Mus musculus
tccttgccaagatgatagcatcttc

SEQ ID NO: 778978 - DNA, 25 bp, Mus musculus
tccttgccaggtcgaagtctgcagc

SEQ ID NO: 778979 - DNA, 25 bp, Mus musculus
tccttgccaggtggaagtctgcagc

SEQ ID NO: 778980 - DNA, 25 bp, Mus musculus
tccttgccagttacagatcacgctg

SEQ ID NO: 778981 - DNA, 25 bp, Mus musculus
tccttgccagtttcagatcacgctg

SEQ ID NO: 778982 - DNA, 25 bp, Mus musculus
tccttgcccaccagaaggtgtctaa

SEQ ID NO: 778983 - DNA, 25 bp, Mus musculus
tccttgcccacctgaaggtgtctaa

SEQ ID NO: 778984 - DNA, 25 bp, Mus musculus
tccttgcctgacagcttacaggttg

SEQ ID NO: 778985 - DNA, 25 bp, Mus musculus
tccttgcctgactgcttacaggttg

SEQ ID NO: 778986 - DNA, 25 bp, Mus musculus
tccttgcctgtgatcctcatggatg

SEQ ID NO: 778987 - DNA, 25 bp, Mus musculus
tccttgcctgtgttcctcatggatg

SEQ ID NO: 778988 - DNA, 25 bp, Mus musculus
tccttgcgttctctctgtaagtggg

SEQ ID NO: 778989 - DNA, 25 bp, Mus musculus
tccttgcgttctgtctgtaagtggg

SEQ ID NO: 778990 - DNA, 25 bp, Mus musculus
tccttgctatcaccactgggcactg

SEQ ID NO: 778991 - DNA, 25 bp, Mus musculus
tccttgctatcagcactgggcactg

SEQ ID NO: 778992 - DNA, 25 bp, Mus musculus
tccttgctcagaaaggcacgcgcct

SEQ ID NO: 778993 - DNA, 25 bp, Mus musculus
tccttgctcagataggcacgcgcct

SEQ ID NO: 778994 - DNA, 25 bp, Mus musculus
tccttgctcagcagcgagtggtttg

SEQ ID NO: 778995 - DNA, 25 bp, Mus musculus
tccttgctcagctgcgagtggtttg

SEQ ID NO: 778996 - DNA, 25 bp, Mus musculus
tccttgctcgaacagtgcggcctga

SEQ ID NO: 778997 - DNA, 25 bp, Mus musculus
tccttgctcgaagagtgcggcctga

SEQ ID NO: 778998 - DNA, 25 bp, Mus musculus
tccttgctctatcccattagcctaa

SEQ ID NO: 778999 - DNA, 25 bp, Mus musculus
tccttgctctatgccattagcctaa

SEQ ID NO: 779000 - DNA, 25 bp, Mus musculus
tccttgctctgtagcagcccctggg

SEQ ID NO: 779001 - DNA, 25 bp, Mus musculus
tccttgctctgttgcagcccctggg

SEQ ID NO: 779002 - DNA, 25 bp, Mus musculus
tccttgctggcacgatggtctctgt

SEQ ID NO: 779003 - DNA, 25 bp, Mus musculus
tccttgctggcaggatggtctctgt

SEQ ID NO: 779004 - DNA, 25 bp, Mus musculus
tccttggaaatcctgccacggactc

SEQ ID NO: 779005 - DNA, 25 bp, Mus musculus
tccttggaaatcgtgccacggactc

SEQ ID NO: 779006 - DNA, 25 bp, Mus musculus
tccttggaatacaagcggcccaggt

SEQ ID NO: 779007 - DNA, 25 bp, Mus musculus
tccttggaatactagcggcccaggt

SEQ ID NO: 779008 - DNA, 25 bp, Mus musculus
tccttggacactatttgatccggca

SEQ ID NO: 779009 - DNA, 25 bp, Mus musculus
tccttggacactctgggtccggtac

SEQ ID NO: 779010 - DNA, 25 bp, Mus musculus
tccttggacactgtgggtccggtac

SEQ ID NO: 779011 - DNA, 25 bp, Mus musculus
tccttggacactttttgatccggca

SEQ ID NO: 779012 - DNA, 25 bp, Mus musculus
tccttggaccccaatcgctgtgaga

SEQ ID NO: 779013 - DNA, 25 bp, Mus musculus
tccttggacccctatcgctgtgaga

SEQ ID NO: 779014 - DNA, 25 bp, Mus musculus
tccttggaccgcacggatttggcgc

SEQ ID NO: 779015 - DNA, 25 bp, Mus musculus
tccttggaccgctcggatttggcgc

SEQ ID NO: 779016 - DNA, 25 bp, Mus musculus
tccttggagcttcaggccttcagaa

SEQ ID NO: 779017 - DNA, 25 bp, Mus musculus
tccttggagcttgaggccttcagaa

SEQ ID NO: 779018 - DNA, 25 bp, Mus musculus
tccttggaggacatctatggaagcc

SEQ ID NO: 779019 - DNA, 25 bp, Mus musculus
tccttggaggacttctatggaagcc

SEQ ID NO: 779020 - DNA, 25 bp, Mus musculus
tccttggaggatcattgggactttc

SEQ ID NO: 779021 - DNA, 25 bp, Mus musculus
tccttggaggatgattgggactttc

SEQ ID NO: 779022 - DNA, 25 bp, Mus musculus
tccttggatgtcacgggttgggttc

SEQ ID NO: 779023 - DNA, 25 bp, Mus musculus
tccttggatgtctcgggttgggttc

SEQ ID NO: 779024 - DNA, 25 bp, Mus musculus
tccttggcacagcaggatactccca

SEQ ID NO: 779025 - DNA, 25 bp, Mus musculus
tccttggcacaggaggatactccca

SEQ ID NO: 779026 - DNA, 25 bp, Mus musculus
tccttggcaggacgtagttctcaca

SEQ ID NO: 779027 - DNA, 25 bp, Mus musculus
tccttggcaggaggtagttctcaca

SEQ ID NO: 779028 - DNA, 25 bp, Mus musculus
tccttggccccacagatggagatcg

SEQ ID NO: 779029 - DNA, 25 bp, Mus musculus
tccttggccccagagatggagatcg

SEQ ID NO: 779030 - DNA, 25 bp, Mus musculus
tccttggcctggctgatccgggcct

SEQ ID NO: 779031 - DNA, 25 bp, Mus musculus
tccttggcctgggtgatccgggcct

SEQ ID NO: 779032 - DNA, 25 bp, Mus musculus
tccttggcctttactctgggtccca

SEQ ID NO: 779033 - DNA, 25 bp, Mus musculus
tccttggccttttctctgggtccca

SEQ ID NO: 779034 - DNA, 25 bp, Mus musculus
tccttggcgaggcatactcctcttt

SEQ ID NO: 779035 - DNA, 25 bp, Mus musculus
tccttggcgagggatactcctcttt

SEQ ID NO: 779036 - DNA, 25 bp, Mus musculus
tccttggcgagtcgcagccccttga

SEQ ID NO: 779037 - DNA, 25 bp, Mus musculus
tccttggcgagtggcagccccttga

SEQ ID NO: 779038 - DNA, 25 bp, Mus musculus
tccttggcgcttacaccctcgggat

SEQ ID NO: 779039 - DNA, 25 bp, Mus musculus
tccttggcgcttcgtgcttcaaccg

SEQ ID NO: 779040 - DNA, 25 bp, Mus musculus
tccttggcgcttggtgcttcaaccg

SEQ ID NO: 779041 - DNA, 25 bp, Mus musculus
tccttggcgctttcaccctcgggat

SEQ ID NO: 779042 - DNA, 25 bp, Mus musculus
tccttggctctaaggctctacgggc

SEQ ID NO: 779043 - DNA, 25 bp, Mus musculus
tccttggctctatggctctacgggc

SEQ ID NO: 779044 - DNA, 25 bp, Mus musculus
tccttggctggactgagtacccgcg

SEQ ID NO: 779045 - DNA, 25 bp, Mus musculus
tccttggctggagtgagtacccgcg

SEQ ID NO: 779046 - DNA, 25 bp, Mus musculus
tccttggctggcaacgcggacatct

SEQ ID NO: 779047 - DNA, 25 bp, Mus musculus
tccttggctggcagtggaagtcccc

SEQ ID NO: 779048 - DNA, 25 bp, Mus musculus
tccttggctggctacgcggacatct

SEQ ID NO: 779049 - DNA, 25 bp, Mus musculus
tccttggctggctgtggaagtcccc

SEQ ID NO: 779050 - DNA, 25 bp, Mus musculus
tccttggcttaaccatcattccagc

SEQ ID NO: 779051 - DNA, 25 bp, Mus musculus
tccttggcttaagcatcattccagc

SEQ ID NO: 779052 - DNA, 25 bp, Mus musculus
tccttggcttggcagaccttggctg

SEQ ID NO: 779053 - DNA, 25 bp, Mus musculus
tccttggcttgggagaccttggctg

SEQ ID NO: 779054 - DNA, 25 bp, Mus musculus
tccttgggaattcatggttgaccgt

SEQ ID NO: 779055 - DNA, 25 bp, Mus musculus
tccttgggaattgatggttgaccgt

SEQ ID NO: 779056 - DNA, 25 bp, Mus musculus
tccttgggactcaagtgcagcttct

SEQ ID NO: 779057 - DNA, 25 bp, Mus musculus
tccttgggactctagtgcagcttct

SEQ ID NO: 779058 - DNA, 25 bp, Mus musculus
tccttgggatgactctctgcctcgc

SEQ ID NO: 779059 - DNA, 25 bp, Mus musculus
tccttgggatgagtctctgcctcgc

SEQ ID NO: 779060 - DNA, 25 bp, Mus musculus
tccttgggcatgaccaacgaggagg

SEQ ID NO: 779061 - DNA, 25 bp, Mus musculus
tccttgggcatgtccaacgaggagg

SEQ ID NO: 779062 - DNA, 25 bp, Mus musculus
tccttggggcccattgaaactgaga

SEQ ID NO: 779063 - DNA, 25 bp, Mus musculus
tccttggggccctttgaaactgaga

SEQ ID NO: 779064 - DNA, 25 bp, Mus musculus
tccttgggtcccatggatctgctgt

SEQ ID NO: 779065 - DNA, 25 bp, Mus musculus
tccttgggtcccttggatctgctgt

SEQ ID NO: 779066 - DNA, 25 bp, Mus musculus
tccttggtccagattcccttgtggg

SEQ ID NO: 779067 - DNA, 25 bp, Mus musculus
tccttggtccagtttcccttgtggg

SEQ ID NO: 779068 - DNA, 25 bp, Mus musculus
tccttggtgagcaaatacctcctga

SEQ ID NO: 779069 - DNA, 25 bp, Mus musculus
tccttggtgagctaatacctcctga

SEQ ID NO: 779070 - DNA, 25 bp, Mus musculus
tccttggtgaggagcagcaagatgc

SEQ ID NO: 779071 - DNA, 25 bp, Mus musculus
tccttggtgaggtgcagcaagatgc

SEQ ID NO: 779072 - DNA, 25 bp, Mus musculus
tccttggtgcaacgccacatgggac

SEQ ID NO: 779073 - DNA, 25 bp, Mus musculus
tccttggtgcaaggccacatgggac

SEQ ID NO: 779074 - DNA, 25 bp, Mus musculus
tccttggtgtctacaaaaccggagg

SEQ ID NO: 779075 - DNA, 25 bp, Mus musculus
tccttggtgtcttcaaaaccggagg

SEQ ID NO: 779076 - DNA, 25 bp, Mus musculus
tccttgtacagaatcagcagacgcc

SEQ ID NO: 779077 - DNA, 25 bp, Mus musculus
tccttgtacagattcagcagacgcc

SEQ ID NO: 779078 - DNA, 25 bp, Mus musculus
tccttgtacatccagagtggccaga

SEQ ID NO: 779079 - DNA, 25 bp, Mus musculus
tccttgtacatcgagagtggccaga

SEQ ID NO: 779080 - DNA, 25 bp, Mus musculus
tccttgtagacacaaggacctctgt

SEQ ID NO: 779081 - DNA, 25 bp, Mus musculus
tccttgtagacagaaggacctctgt

SEQ ID NO: 779082 - DNA, 25 bp, Mus musculus
tccttgtagactagtgagggcacag

SEQ ID NO: 779083 - DNA, 25 bp, Mus musculus
tccttgtagacttgtgagggcacag

SEQ ID NO: 779084 - DNA, 25 bp, Mus musculus
tccttgtaggacaccatgctgccag

SEQ ID NO: 779085 - DNA, 25 bp, Mus musculus
tccttgtaggactccatgctgccag

SEQ ID NO: 779086 - DNA, 25 bp, Mus musculus
tccttgtagttgcaaccagtctata

SEQ ID NO: 779087 - DNA, 25 bp, Mus musculus
tccttgtagttggaaccagtctata

SEQ ID NO: 779088 - DNA, 25 bp, Mus musculus
tccttgtatgccatgcaggtaactc

SEQ ID NO: 779089 - DNA, 25 bp, Mus musculus
tccttgtatgccttgcaggtaactc

SEQ ID NO: 779090 - DNA, 25 bp, Mus musculus
tccttgtcacgacggcaccgtgtct

SEQ ID NO: 779091 - DNA, 25 bp, Mus musculus
tccttgtcacgagggcaccgtgtct

SEQ ID NO: 779092 - DNA, 25 bp, Mus musculus
tccttgtcacggcttcagatgatgg

SEQ ID NO: 779093 - DNA, 25 bp, Mus musculus
tccttgtcacgggttcagatgatgg

SEQ ID NO: 779094 - DNA, 25 bp, Mus musculus
tccttgtccgcccttgtgatggccg

SEQ ID NO: 779095 - DNA, 25 bp, Mus musculus
tccttgtccgccgttgtgatggccg

SEQ ID NO: 779096 - DNA, 25 bp, Mus musculus
tccttgtcctcgaagtctggccctt

SEQ ID NO: 779097 - DNA, 25 bp, Mus musculus
tccttgtcctcgtagtctggccctt

SEQ ID NO: 779098 - DNA, 25 bp, Mus musculus
tccttgtgcaagaactctgagcccc

SEQ ID NO: 779099 - DNA, 25 bp, Mus musculus
tccttgtgcaagtactctgagcccc

SEQ ID NO: 779100 - DNA, 25 bp, Mus musculus
tccttgtggcgcagaggcaagtgca

SEQ ID NO: 779101 - DNA, 25 bp, Mus musculus
tccttgtggcgctgaggcaagtgca

SEQ ID NO: 779102 - DNA, 25 bp, Mus musculus
tccttgtgttgacctggaggcagcc

SEQ ID NO: 779103 - DNA, 25 bp, Mus musculus
tccttgtgttgagctggaggcagcc

SEQ ID NO: 779104 - DNA, 25 bp, Mus musculus
tccttgtgtttgcaaagcttctctc

SEQ ID NO: 779105 - DNA, 25 bp, Mus musculus
tccttgtgtttggaaagcttctctc

SEQ ID NO: 779106 - DNA, 25 bp, Mus musculus
tccttgttcaccaactaaaactgcc

SEQ ID NO: 779107 - DNA, 25 bp, Mus musculus
tccttgttcacctactaaaactgcc

SEQ ID NO: 779108 - DNA, 25 bp, Mus musculus
tccttgttggagctcccatgcagag

SEQ ID NO: 779109 - DNA, 25 bp, Mus musculus
tccttgttggaggtcccatgcagag

SEQ ID NO: 779110 - DNA, 25 bp, Mus musculus
tccttgtttaggatctcggaagcca

SEQ ID NO: 779111 - DNA, 25 bp, Mus musculus
tccttgtttaggttctcggaagcca

SEQ ID NO: 779112 - DNA, 25 bp, Mus musculus
tcctttaagattctcctgtgatgtc

SEQ ID NO: 779113 - DNA, 25 bp, Mus musculus
tcctttaagattgtcctgtgatgtc

SEQ ID NO: 779114 - DNA, 25 bp, Mus musculus
tcctttaagtaaaacaaccctgcag

SEQ ID NO: 779115 - DNA, 25 bp, Mus musculus
tcctttaagtaatacaaccctgcag

SEQ ID NO: 779116 - DNA, 25 bp, Mus musculus
tcctttacatcgaaatgcctgtgaa

SEQ ID NO: 779117 - DNA, 25 bp, Mus musculus
tcctttacatcgtaatgcctgtgaa

SEQ ID NO: 779118 - DNA, 25 bp, Mus musculus
tcctttaccctgacgtgtacccgtg

SEQ ID NO: 779119 - DNA, 25 bp, Mus musculus
tcctttaccctgtcgtgtacccgtg

SEQ ID NO: 779120 - DNA, 25 bp, Mus musculus
tcctttagcaggaaagacctcccgc

SEQ ID NO: 779121 - DNA, 25 bp, Mus musculus
tcctttagcaggtaagacctcccgc

SEQ ID NO: 779122 - DNA, 25 bp, Mus musculus
tcctttaggcacaaggtgactgggc

SEQ ID NO: 779123 - DNA, 25 bp, Mus musculus
tcctttaggcactaggtgactgggc

SEQ ID NO: 779124 - DNA, 25 bp, Mus musculus
tcctttagttgacgcagctagacca

SEQ ID NO: 779125 - DNA, 25 bp, Mus musculus
tcctttagttgaggcagctagacca

SEQ ID NO: 779126 - DNA, 25 bp, Mus musculus
tcctttcaataaccatgagtatcag

SEQ ID NO: 779127 - DNA, 25 bp, Mus musculus
tcctttcaataagcatgagtatcag

SEQ ID NO: 779128 - DNA, 25 bp, Mus musculus
tcctttcacgctctcggtggccgta

SEQ ID NO: 779129 - DNA, 25 bp, Mus musculus
tcctttcacgctgtcggtggccgta

SEQ ID NO: 779130 - DNA, 25 bp, Mus musculus
tcctttccagttactaagctgacta

SEQ ID NO: 779131 - DNA, 25 bp, Mus musculus
tcctttccagttccgagctgcttct

SEQ ID NO: 779132 - DNA, 25 bp, Mus musculus
tcctttccagttgcgagctgcttct

SEQ ID NO: 779133 - DNA, 25 bp, Mus musculus
tcctttccagtttctaagctgacta

SEQ ID NO: 779134 - DNA, 25 bp, Mus musculus
tcctttccatgaccatgtgcttgga

SEQ ID NO: 779135 - DNA, 25 bp, Mus musculus
tcctttccatgagcatgtgcttgga

SEQ ID NO: 779136 - DNA, 25 bp, Mus musculus
tcctttcccaagctatgagaatgag

SEQ ID NO: 779137 - DNA, 25 bp, Mus musculus
tcctttcccaaggtatgagaatgag

SEQ ID NO: 779138 - DNA, 25 bp, Mus musculus
tcctttcccacacaggcgaatgaga

SEQ ID NO: 779139 - DNA, 25 bp, Mus musculus
tcctttcccacagaggcgaatgaga

SEQ ID NO: 779140 - DNA, 25 bp, Mus musculus
tcctttcccgcacaatggcacagag

SEQ ID NO: 779141 - DNA, 25 bp, Mus musculus
tcctttcccgcagaatggcacagag

SEQ ID NO: 779142 - DNA, 25 bp, Mus musculus
tcctttccgaatagttcaagcaggc

SEQ ID NO: 779143 - DNA, 25 bp, Mus musculus
tcctttccgaattgttcaagcaggc

SEQ ID NO: 779144 - DNA, 25 bp, Mus musculus
tcctttccttgcatggagcccgctg

SEQ ID NO: 779145 - DNA, 25 bp, Mus musculus
tcctttccttgcttggagcccgctg

SEQ ID NO: 779146 - DNA, 25 bp, Mus musculus
tcctttcgagaaaggataactcaca

SEQ ID NO: 779147 - DNA, 25 bp, Mus musculus
tcctttcgagaatggataactcaca

SEQ ID NO: 779148 - DNA, 25 bp, Mus musculus
tcctttcgagttcgccttctcctta

SEQ ID NO: 779149 - DNA, 25 bp, Mus musculus
tcctttcgagttggccttctcctta

SEQ ID NO: 779150 - DNA, 25 bp, Mus musculus
tcctttcgattcaagccactgaggc

SEQ ID NO: 779151 - DNA, 25 bp, Mus musculus
tcctttcgattctagccactgaggc

SEQ ID NO: 779152 - DNA, 25 bp, Mus musculus
tcctttcggtccagagcaccgagca

SEQ ID NO: 779153 - DNA, 25 bp, Mus musculus
tcctttcggtcctgagcaccgagca

SEQ ID NO: 779154 - DNA, 25 bp, Mus musculus
tcctttcgttgaaaagcctcaagca

SEQ ID NO: 779155 - DNA, 25 bp, Mus musculus
tcctttcgttgataagcctcaagca

SEQ ID NO: 779156 - DNA, 25 bp, Mus musculus
tcctttctcaggacttgttgcagca

SEQ ID NO: 779157 - DNA, 25 bp, Mus musculus
tcctttctcaggtcttgttgcagca

SEQ ID NO: 779158 - DNA, 25 bp, Mus musculus
tcctttctcattcgcatcatttctc

SEQ ID NO: 779159 - DNA, 25 bp, Mus musculus
tcctttctcattggcatcatttctc

SEQ ID NO: 779160 - DNA, 25 bp, Mus musculus
tcctttctccccagaaggcggaaca

SEQ ID NO: 779161 - DNA, 25 bp, Mus musculus
tcctttctcccctgaaggcggaaca

SEQ ID NO: 779162 - DNA, 25 bp, Mus musculus
tcctttctgctcataacagccacaa

SEQ ID NO: 779163 - DNA, 25 bp, Mus musculus
tcctttctgctcttaacagccacaa

SEQ ID NO: 779164 - DNA, 25 bp, Mus musculus
tcctttctgtagaacctctaaaacg

SEQ ID NO: 779165 - DNA, 25 bp, Mus musculus
tcctttctgtagtacctctaaaacg

SEQ ID NO: 779166 - DNA, 25 bp, Mus musculus
tcctttctgtatattctgacggaca

SEQ ID NO: 779167 - DNA, 25 bp, Mus musculus
tcctttctgtattttctgacggaca

SEQ ID NO: 779168 - DNA, 25 bp, Mus musculus
tcctttctgtccattgattccaggc

SEQ ID NO: 779169 - DNA, 25 bp, Mus musculus
tcctttctgtcctttgattccaggc

SEQ ID NO: 779170 - DNA, 25 bp, Mus musculus
tcctttcttcagagcgaacattcag

SEQ ID NO: 779171 - DNA, 25 bp, Mus musculus
tcctttcttcagtgcgaacattcag

SEQ ID NO: 779172 - DNA, 25 bp, Mus musculus
tcctttcttgctagttgggacccaa

SEQ ID NO: 779173 - DNA, 25 bp, Mus musculus
tcctttcttgcttgttgggacccaa

SEQ ID NO: 779174 - DNA, 25 bp, Mus musculus
tcctttgagattcgtgcgtggactg

SEQ ID NO: 779175 - DNA, 25 bp, Mus musculus
tcctttgagattggtgcgtggactg

SEQ ID NO: 779176 - DNA, 25 bp, Mus musculus
tcctttgagcggacctgtgaccaca

SEQ ID NO: 779177 - DNA, 25 bp, Mus musculus
tcctttgagcggtcctgtgaccaca

SEQ ID NO: 779178 - DNA, 25 bp, Mus musculus
tcctttgaggacaggagaaaaatac

SEQ ID NO: 779179 - DNA, 25 bp, Mus musculus
tcctttgaggactggagaaaaatac

SEQ ID NO: 779180 - DNA, 25 bp, Mus musculus
tcctttgaggcacatgagccggaca

SEQ ID NO: 779181 - DNA, 25 bp, Mus musculus
tcctttgaggcagatgagccggaca

SEQ ID NO: 779182 - DNA, 25 bp, Mus musculus
tcctttgatcctccagttttgaaac

SEQ ID NO: 779183 - DNA, 25 bp, Mus musculus
tcctttgatcctgcagttttgaaac

SEQ ID NO: 779184 - DNA, 25 bp, Mus musculus
tcctttgatgaccagcattttgaaa

SEQ ID NO: 779185 - DNA, 25 bp, Mus musculus
tcctttgatgacgagcattttgaaa

SEQ ID NO: 779186 - DNA, 25 bp, Mus musculus
tcctttgatggaagcagctgcctct

SEQ ID NO: 779187 - DNA, 25 bp, Mus musculus
tcctttgatggatgcagctgcctct

SEQ ID NO: 779188 - DNA, 25 bp, Mus musculus
tcctttgcaattcagtgtagtagaa

SEQ ID NO: 779189 - DNA, 25 bp, Mus musculus
tcctttgcaattgagtgtagtagaa

SEQ ID NO: 779190 - DNA, 25 bp, Mus musculus
tcctttgcaggaacagtagcctgga

SEQ ID NO: 779191 - DNA, 25 bp, Mus musculus
tcctttgcaggatcagtagcctgga

SEQ ID NO: 779192 - DNA, 25 bp, Mus musculus
tcctttgcgggcacttgctgggctt

SEQ ID NO: 779193 - DNA, 25 bp, Mus musculus
tcctttgcgggctcttgctgggctt

SEQ ID NO: 779194 - DNA, 25 bp, Mus musculus
tcctttgcgtttcggctaacagtgg

SEQ ID NO: 779195 - DNA, 25 bp, Mus musculus
tcctttgcgtttgggctaacagtgg

SEQ ID NO: 779196 - DNA, 25 bp, Mus musculus
tcctttgctaccatctatgatgtcc

SEQ ID NO: 779197 - DNA, 25 bp, Mus musculus
tcctttgctaccttctatgatgtcc

SEQ ID NO: 779198 - DNA, 25 bp, Mus musculus
tcctttgcttctacgttctgtccat

SEQ ID NO: 779199 - DNA, 25 bp, Mus musculus
tcctttgcttcttcgttctgtccat

SEQ ID NO: 779200 - DNA, 25 bp, Mus musculus
tcctttggagagaatgaggtataca

SEQ ID NO: 779201 - DNA, 25 bp, Mus musculus
tcctttggagagtatgaggtataca

SEQ ID NO: 779202 - DNA, 25 bp, Mus musculus
tcctttggaggaacggaacaccatt

SEQ ID NO: 779203 - DNA, 25 bp, Mus musculus
tcctttggaggatcggaacaccatt

SEQ ID NO: 779204 - DNA, 25 bp, Mus musculus
tcctttggatcaaggactactgatt

SEQ ID NO: 779205 - DNA, 25 bp, Mus musculus
tcctttggatcatggactactgatt

SEQ ID NO: 779206 - DNA, 25 bp, Mus musculus
tcctttggctgcagccagctagaag

SEQ ID NO: 779207 - DNA, 25 bp, Mus musculus
tcctttggctgcatcccttgtggtc

SEQ ID NO: 779208 - DNA, 25 bp, Mus musculus
tcctttggctgctgccagctagaag

SEQ ID NO: 779209 - DNA, 25 bp, Mus musculus
tcctttggctgcttcccttgtggtc

SEQ ID NO: 779210 - DNA, 25 bp, Mus musculus
tcctttgggcaaatcacctcagtgg

SEQ ID NO: 779211 - DNA, 25 bp, Mus musculus
tcctttgggcaattcacctcagtgg

SEQ ID NO: 779212 - DNA, 25 bp, Mus musculus
tcctttggtgtgactaagaagaacc

SEQ ID NO: 779213 - DNA, 25 bp, Mus musculus
tcctttggtgtgtctaagaagaacc

SEQ ID NO: 779214 - DNA, 25 bp, Mus musculus
tcctttgtaagaacatttccatgtg

SEQ ID NO: 779215 - DNA, 25 bp, Mus musculus
tcctttgtaagatcatttccatgtg

SEQ ID NO: 779216 - DNA, 25 bp, Mus musculus
tcctttgtgcccacctgggatttgt

SEQ ID NO: 779217 - DNA, 25 bp, Mus musculus
tcctttgtgccctcctgggatttgt

SEQ ID NO: 779218 - DNA, 25 bp, Mus musculus
tcctttgtgctgactatgctgagca

SEQ ID NO: 779219 - DNA, 25 bp, Mus musculus
tcctttgtgctgtctatgctgagca

SEQ ID NO: 779220 - DNA, 25 bp, Mus musculus
tcctttgtggcaccaatcattgacg

SEQ ID NO: 779221 - DNA, 25 bp, Mus musculus
tcctttgtggcagcaatcattgacg

SEQ ID NO: 779222 - DNA, 25 bp, Mus musculus
tccttttagcggagaagttcaagag

SEQ ID NO: 779223 - DNA, 25 bp, Mus musculus
tccttttagcggtgaagttcaagag

SEQ ID NO: 779224 - DNA, 25 bp, Mus musculus
tccttttaggatccggccttggcag

SEQ ID NO: 779225 - DNA, 25 bp, Mus musculus
tccttttaggatgcggccttggcag

SEQ ID NO: 779226 - DNA, 25 bp, Mus musculus
tccttttatagaccgctttatccta

SEQ ID NO: 779227 - DNA, 25 bp, Mus musculus
tccttttatagagcgctttatccta

SEQ ID NO: 779228 - DNA, 25 bp, Mus musculus
tccttttcatgcaggtgtgtgggca

SEQ ID NO: 779229 - DNA, 25 bp, Mus musculus
tccttttcatgctggtgtgtgggca

SEQ ID NO: 779230 - DNA, 25 bp, Mus musculus
tccttttccattccagtgccccaag

SEQ ID NO: 779231 - DNA, 25 bp, Mus musculus
tccttttccattgcagtgccccaag

SEQ ID NO: 779232 - DNA, 25 bp, Mus musculus
tccttttcctgaacttcgagcaggt

SEQ ID NO: 779233 - DNA, 25 bp, Mus musculus
tccttttcctgatcttcgagcaggt

SEQ ID NO: 779234 - DNA, 25 bp, Mus musculus
tccttttctgtgagcgtgtcacctc

SEQ ID NO: 779235 - DNA, 25 bp, Mus musculus
tccttttctgtgatacagtgccctg

SEQ ID NO: 779236 - DNA, 25 bp, Mus musculus
tccttttctgtgtgcgtgtcacctc

SEQ ID NO: 779237 - DNA, 25 bp, Mus musculus
tccttttctgtgttacagtgccctg

SEQ ID NO: 779238 - DNA, 25 bp, Mus musculus
tccttttgggctactggtgagcact

SEQ ID NO: 779239 - DNA, 25 bp, Mus musculus
tccttttgggcttctggtgagcact

SEQ ID NO: 779240 - DNA, 25 bp, Mus musculus
tccttttgtggcatgagagaatcaa

SEQ ID NO: 779241 - DNA, 25 bp, Mus musculus
tccttttgtggcttgagagaatcaa

SEQ ID NO: 779242 - DNA, 25 bp, Mus musculus
tcctttttgcccacaatgaccttgt

SEQ ID NO: 779243 - DNA, 25 bp, Mus musculus
tcctttttgccctcaatgaccttgt

SEQ ID NO: 779244 - DNA, 25 bp, Mus musculus
tcgaaaaaagctcattgggaagaag

SEQ ID NO: 779245 - DNA, 25 bp, Mus musculus
tcgaaaaaagctgattgggaagaag

SEQ ID NO: 779246 - DNA, 25 bp, Mus musculus
tcgaaaaaatagatgcagagtggta

SEQ ID NO: 779247 - DNA, 25 bp, Mus musculus
tcgaaaaaatagttgcagagtggta

SEQ ID NO: 779248 - DNA, 25 bp, Mus musculus
tcgaaaaacctcagcagtagacagt

SEQ ID NO: 779249 - DNA, 25 bp, Mus musculus
tcgaaaaacctctgcagtagacagt

SEQ ID NO: 779250 - DNA, 25 bp, Mus musculus
tcgaaaaagcgaacaggaatgtccc

SEQ ID NO: 779251 - DNA, 25 bp, Mus musculus
tcgaaaaagcgatcaggaatgtccc

SEQ ID NO: 779252 - DNA, 25 bp, Mus musculus
tcgaaaaatcctccgggagctgaag

SEQ ID NO: 779253 - DNA, 25 bp, Mus musculus
tcgaaaaatcctgcgggagctgaag

SEQ ID NO: 779254 - DNA, 25 bp, Mus musculus
tcgaaaacccgcaggaggatcctgt

SEQ ID NO: 779255 - DNA, 25 bp, Mus musculus
tcgaaaacccgctggaggatcctgt

SEQ ID NO: 779256 - DNA, 25 bp, Mus musculus
tcgaaacctcatcacagctctgaac

SEQ ID NO: 779257 - DNA, 25 bp, Mus musculus
tcgaaacctcatgacagctctgaac

SEQ ID NO: 779258 - DNA, 25 bp, Mus musculus
tcgaaacggagaaatccacagcacc

SEQ ID NO: 779259 - DNA, 25 bp, Mus musculus
tcgaaacggagatatccacagcacc

SEQ ID NO: 779260 - DNA, 25 bp, Mus musculus
tcgaaagaggtaaggtctcctctgc

SEQ ID NO: 779261 - DNA, 25 bp, Mus musculus
tcgaaagaggtatggtctcctctgc

SEQ ID NO: 779262 - DNA, 25 bp, Mus musculus
tcgaaagcccgtcacagctcaggaa

SEQ ID NO: 779263 - DNA, 25 bp, Mus musculus
tcgaaagcccgtgacagctcaggaa

SEQ ID NO: 779264 - DNA, 25 bp, Mus musculus
tcgaaagcgagcagttcgtctcggc

SEQ ID NO: 779265 - DNA, 25 bp, Mus musculus
tcgaaagcgagctgttcgtctcggc

SEQ ID NO: 779266 - DNA, 25 bp, Mus musculus
tcgaaagctcaacttttcctacaga

SEQ ID NO: 779267 - DNA, 25 bp, Mus musculus
tcgaaagctcaagttttcctacaga

SEQ ID NO: 779268 - DNA, 25 bp, Mus musculus
tcgaaagcttggactgaggcagtgc

SEQ ID NO: 779269 - DNA, 25 bp, Mus musculus
tcgaaagcttggtctgaggcagtgc

SEQ ID NO: 779270 - DNA, 25 bp, Mus musculus
tcgaaaggcctaaactgggccaaaa

SEQ ID NO: 779271 - DNA, 25 bp, Mus musculus
tcgaaaggcctatactgggccaaaa

SEQ ID NO: 779272 - DNA, 25 bp, Mus musculus
tcgaaagtaagtacctgccagacct

SEQ ID NO: 779273 - DNA, 25 bp, Mus musculus
tcgaaagtaagttcctgccagacct

SEQ ID NO: 779274 - DNA, 25 bp, Mus musculus
tcgaaagtcactagtagagatcttg

SEQ ID NO: 779275 - DNA, 25 bp, Mus musculus
tcgaaagtcacttgtagagatcttg

SEQ ID NO: 779276 - DNA, 25 bp, Mus musculus
tcgaaatatccgcaccaagatgggc

SEQ ID NO: 779277 - DNA, 25 bp, Mus musculus
tcgaaatatccggaccaagatgggc

SEQ ID NO: 779278 - DNA, 25 bp, Mus musculus
tcgaaatcattgaccacatttggat

SEQ ID NO: 779279 - DNA, 25 bp, Mus musculus
tcgaaatcattgtccacatttggat

SEQ ID NO: 779280 - DNA, 25 bp, Mus musculus
tcgaaatgcctgagaaggagattca

SEQ ID NO: 779281 - DNA, 25 bp, Mus musculus
tcgaaatgcctgtgaaggagattca

SEQ ID NO: 779282 - DNA, 25 bp, Mus musculus
tcgaacaacaggagagcaaagccaa

SEQ ID NO: 779283 - DNA, 25 bp, Mus musculus
tcgaacaacaggtgagcaaagccaa

SEQ ID NO: 779284 - DNA, 25 bp, Mus musculus
tcgaacacttccacatggacctggg

SEQ ID NO: 779285 - DNA, 25 bp, Mus musculus
tcgaacacttcctcatggacctggg

SEQ ID NO: 779286 - DNA, 25 bp, Mus musculus
tcgaacagtgcaccatcaggactct

SEQ ID NO: 779287 - DNA, 25 bp, Mus musculus
tcgaacagtgcagcatcaggactct

SEQ ID NO: 779288 - DNA, 25 bp, Mus musculus
tcgaacagtggcatcttgggaaaat

SEQ ID NO: 779289 - DNA, 25 bp, Mus musculus
tcgaacagtggcttcttgggaaaat

SEQ ID NO: 779290 - DNA, 25 bp, Mus musculus
tcgaaccaaaagctattttgcgaag

SEQ ID NO: 779291 - DNA, 25 bp, Mus musculus
tcgaaccaaaaggtattttgcgaag

SEQ ID NO: 779292 - DNA, 25 bp, Mus musculus
tcgaaccaacccaagcgttatgatt

SEQ ID NO: 779293 - DNA, 25 bp, Mus musculus
tcgaaccaaccctagcgttatgatt

SEQ ID NO: 779294 - DNA, 25 bp, Mus musculus
tcgaaccctgcacaggctcagcagt

SEQ ID NO: 779295 - DNA, 25 bp, Mus musculus
tcgaaccctgcagaggctcagcagt

SEQ ID NO: 779296 - DNA, 25 bp, Mus musculus
tcgaacctgaagataaaggctgagg

SEQ ID NO: 779297 - DNA, 25 bp, Mus musculus
tcgaacctgaagttaaaggctgagg

SEQ ID NO: 779298 - DNA, 25 bp, Mus musculus
tcgaacgaacctcttggacccagta

SEQ ID NO: 779299 - DNA, 25 bp, Mus musculus
tcgaacgaacctgttggacccagta

SEQ ID NO: 779300 - DNA, 25 bp, Mus musculus
tcgaacgactgaagccgcggcccat

SEQ ID NO: 779301 - DNA, 25 bp, Mus musculus
tcgaacgactgatgccgcggcccat

SEQ ID NO: 779302 - DNA, 25 bp, Mus musculus
tcgaacggaccacatgtgaagacca

SEQ ID NO: 779303 - DNA, 25 bp, Mus musculus
tcgaacggaccagatgtgaagacca

SEQ ID NO: 779304 - DNA, 25 bp, Mus musculus
tcgaactacggccaggctctggagt

SEQ ID NO: 779305 - DNA, 25 bp, Mus musculus
tcgaactacggcgaggctctggagt

SEQ ID NO: 779306 - DNA, 25 bp, Mus musculus
tcgaacttacccacaaagaagagca

SEQ ID NO: 779307 - DNA, 25 bp, Mus musculus
tcgaacttaccctcaaagaagagca

SEQ ID NO: 779308 - DNA, 25 bp, Mus musculus
tcgaacttcgaacacagtcagatgg

SEQ ID NO: 779309 - DNA, 25 bp, Mus musculus
tcgaacttcgaagacagtcagatgg

SEQ ID NO: 779310 - DNA, 25 bp, Mus musculus
tcgaacttgcaaagattatcctgct

SEQ ID NO: 779311 - DNA, 25 bp, Mus musculus
tcgaacttgcaatgattatcctgct

SEQ ID NO: 779312 - DNA, 25 bp, Mus musculus
tcgaagaaagccagaggtggtctct

SEQ ID NO: 779313 - DNA, 25 bp, Mus musculus
tcgaagaaagcctgaggtggtctct

SEQ ID NO: 779314 - DNA, 25 bp, Mus musculus
tcgaagaagagactgataaactgtg

SEQ ID NO: 779315 - DNA, 25 bp, Mus musculus
tcgaagaagagagtgataaactgtg

SEQ ID NO: 779316 - DNA, 25 bp, Mus musculus
tcgaagacaactccaatcaaaatgg

SEQ ID NO: 779317 - DNA, 25 bp, Mus musculus
tcgaagacaactgcaatcaaaatgg

SEQ ID NO: 779318 - DNA, 25 bp, Mus musculus
tcgaagacagctcgaaaaacacatc

SEQ ID NO: 779319 - DNA, 25 bp, Mus musculus
tcgaagacagctggaaaaacacatc

SEQ ID NO: 779320 - DNA, 25 bp, Mus musculus
tcgaagactcaactttgcacaaatt

SEQ ID NO: 779321 - DNA, 25 bp, Mus musculus
tcgaagactcaagtttgcacaaatt

SEQ ID NO: 779322 - DNA, 25 bp, Mus musculus
tcgaagagactcagccggagtctcc

SEQ ID NO: 779323 - DNA, 25 bp, Mus musculus
tcgaagagactctgccggagtctcc

SEQ ID NO: 779324 - DNA, 25 bp, Mus musculus
tcgaagaggcagaggaccgtgatct

SEQ ID NO: 779325 - DNA, 25 bp, Mus musculus
tcgaagaggcagtggaccgtgatct

SEQ ID NO: 779326 - DNA, 25 bp, Mus musculus
tcgaagaggcttacatgcagtgtgc

SEQ ID NO: 779327 - DNA, 25 bp, Mus musculus
tcgaagaggctttcatgcagtgtgc

SEQ ID NO: 779328 - DNA, 25 bp, Mus musculus
tcgaagatgacgactgccagctggt

SEQ ID NO: 779329 - DNA, 25 bp, Mus musculus
tcgaagatgacgtctgccagctggt

SEQ ID NO: 779330 - DNA, 25 bp, Mus musculus
tcgaagcagacaatcccggaagagc

SEQ ID NO: 779331 - DNA, 25 bp, Mus musculus
tcgaagcagacattcccggaagagc

SEQ ID NO: 779332 - DNA, 25 bp, Mus musculus
tcgaagcatccgaggtggagagctc

SEQ ID NO: 779333 - DNA, 25 bp, Mus musculus
tcgaagcatccgtggtggagagctc

SEQ ID NO: 779334 - DNA, 25 bp, Mus musculus
tcgaagccagcaacgtctagagatc

SEQ ID NO: 779335 - DNA, 25 bp, Mus musculus
tcgaagccagcatcgtctagagatc

SEQ ID NO: 779336 - DNA, 25 bp, Mus musculus
tcgaagcccttcaggaagcaggcca

SEQ ID NO: 779337 - DNA, 25 bp, Mus musculus
tcgaagcccttctggaagcaggcca

SEQ ID NO: 779338 - DNA, 25 bp, Mus musculus
tcgaagccgagaaggctcggagtac

SEQ ID NO: 779339 - DNA, 25 bp, Mus musculus
tcgaagccgagatggctcggagtac

SEQ ID NO: 779340 - DNA, 25 bp, Mus musculus
tcgaagcctaccatgacattaatgt

SEQ ID NO: 779341 - DNA, 25 bp, Mus musculus
tcgaagcctaccttgacattaatgt

SEQ ID NO: 779342 - DNA, 25 bp, Mus musculus
tcgaagccttggacagaatccgagt

SEQ ID NO: 779343 - DNA, 25 bp, Mus musculus
tcgaagccttggtcagaatccgagt

SEQ ID NO: 779344 - DNA, 25 bp, Mus musculus
tcgaagcgttatcgcctgggagccc

SEQ ID NO: 779345 - DNA, 25 bp, Mus musculus
tcgaagcgttatggcctgggagccc

SEQ ID NO: 779346 - DNA, 25 bp, Mus musculus
tcgaagcgttgcaagaagtcctgaa

SEQ ID NO: 779347 - DNA, 25 bp, Mus musculus
tcgaagcgttgctagaagtcctgaa

SEQ ID NO: 779348 - DNA, 25 bp, Mus musculus
tcgaagctccagaaagtactggaga

SEQ ID NO: 779349 - DNA, 25 bp, Mus musculus
tcgaagctccagtaagtactggaga

SEQ ID NO: 779350 - DNA, 25 bp, Mus musculus
tcgaagctctgaccagcgattatct

SEQ ID NO: 779351 - DNA, 25 bp, Mus musculus
tcgaagctctgagcagcgattatct

SEQ ID NO: 779352 - DNA, 25 bp, Mus musculus
tcgaagctgcagaagattgtgtaca

SEQ ID NO: 779353 - DNA, 25 bp, Mus musculus
tcgaagctgcagtagattgtgtaca

SEQ ID NO: 779354 - DNA, 25 bp, Mus musculus
tcgaaggacagcctcactgagcaac

SEQ ID NO: 779355 - DNA, 25 bp, Mus musculus
tcgaaggacagcgtcactgagcaac

SEQ ID NO: 779356 - DNA, 25 bp, Mus musculus
tcgaaggacatgaggtgaaatgcta

SEQ ID NO: 779357 - DNA, 25 bp, Mus musculus
tcgaaggacatgtggtgaaatgcta

SEQ ID NO: 779358 - DNA, 25 bp, Mus musculus
tcgaaggacgatacggtgccactga

SEQ ID NO: 779359 - DNA, 25 bp, Mus musculus
tcgaaggacgattcggtgccactga

SEQ ID NO: 779360 - DNA, 25 bp, Mus musculus
tcgaaggacggacagctgcttacat

SEQ ID NO: 779361 - DNA, 25 bp, Mus musculus
tcgaaggacggagagctgcttacat

SEQ ID NO: 779362 - DNA, 25 bp, Mus musculus
tcgaaggactccacgaagcgagggc

SEQ ID NO: 779363 - DNA, 25 bp, Mus musculus
tcgaaggactcctcgaagcgagggc

SEQ ID NO: 779364 - DNA, 25 bp, Mus musculus
tcgaaggactgcatgagcatcctgt

SEQ ID NO: 779365 - DNA, 25 bp, Mus musculus
tcgaaggactgcttgagcatcctgt

SEQ ID NO: 779366 - DNA, 25 bp, Mus musculus
tcgaaggccatgattccaacggtgc

SEQ ID NO: 779367 - DNA, 25 bp, Mus musculus
tcgaaggccatgtttccaacggtgc

SEQ ID NO: 779368 - DNA, 25 bp, Mus musculus
tcgaaggcccatcgccagactttat

SEQ ID NO: 779369 - DNA, 25 bp, Mus musculus
tcgaaggcccatggccagactttat

SEQ ID NO: 779370 - DNA, 25 bp, Mus musculus
tcgaaggctccaaggaagaccctgt

SEQ ID NO: 779371 - DNA, 25 bp, Mus musculus
tcgaaggctccatggaagaccctgt

SEQ ID NO: 779372 - DNA, 25 bp, Mus musculus
tcgaagggccaaatggagaagagaa

SEQ ID NO: 779373 - DNA, 25 bp, Mus musculus
tcgaagggccaattggagaagagaa

SEQ ID NO: 779374 - DNA, 25 bp, Mus musculus
tcgaaggtgttcatcatatgaagac

SEQ ID NO: 779375 - DNA, 25 bp, Mus musculus
tcgaaggtgttcttcatatgaagac

SEQ ID NO: 779376 - DNA, 25 bp, Mus musculus
tcgaaggttcaaaagactgagtggc

SEQ ID NO: 779377 - DNA, 25 bp, Mus musculus
tcgaaggttcaatagactgagtggc

SEQ ID NO: 779378 - DNA, 25 bp, Mus musculus
tcgaagtataccacccgtgtttctt

SEQ ID NO: 779379 - DNA, 25 bp, Mus musculus
tcgaagtatacctcccgtgtttctt

SEQ ID NO: 779380 - DNA, 25 bp, Mus musculus
tcgaagtatgctcgccaccagttcc

SEQ ID NO: 779381 - DNA, 25 bp, Mus musculus
tcgaagtatgctggccaccagttcc

SEQ ID NO: 779382 - DNA, 25 bp, Mus musculus
tcgaagtcacatcgaagagctacca

SEQ ID NO: 779383 - DNA, 25 bp, Mus musculus
tcgaagtcacatggaagagctacca

SEQ ID NO: 779384 - DNA, 25 bp, Mus musculus
tcgaagtgctaaacaaggagctgag

SEQ ID NO: 779385 - DNA, 25 bp, Mus musculus
tcgaagtgctaatcaaggagctgag

SEQ ID NO: 779386 - DNA, 25 bp, Mus musculus
tcgaagtgttggatacaggccagac

SEQ ID NO: 779387 - DNA, 25 bp, Mus musculus
tcgaagtgttggttacaggccagac

SEQ ID NO: 779388 - DNA, 25 bp, Mus musculus
tcgaagttgcagatcatcttagcag

SEQ ID NO: 779389 - DNA, 25 bp, Mus musculus
tcgaagttgcagttcatcttagcag

SEQ ID NO: 779390 - DNA, 25 bp, Mus musculus
tcgaagttgtggctcaaccgactga

SEQ ID NO: 779391 - DNA, 25 bp, Mus musculus
tcgaagttgtgggtcaaccgactga

SEQ ID NO: 779392 - DNA, 25 bp, Mus musculus
tcgaagtttccacgaagttcgggag

SEQ ID NO: 779393 - DNA, 25 bp, Mus musculus
tcgaagtttccaggaagttcgggag

SEQ ID NO: 779394 - DNA, 25 bp, Mus musculus
tcgaataccggtaagtgccggcgcg

SEQ ID NO: 779395 - DNA, 25 bp, Mus musculus
tcgaataccggttagtgccggcgcg

SEQ ID NO: 779396 - DNA, 25 bp, Mus musculus
tcgaatcaacaaaatcccatttgga

SEQ ID NO: 779397 - DNA, 25 bp, Mus musculus
tcgaatcaacaatatcccatttgga

SEQ ID NO: 779398 - DNA, 25 bp, Mus musculus
tcgaatcaaccacacataccagcag

SEQ ID NO: 779399 - DNA, 25 bp, Mus musculus
tcgaatcaaccagacataccagcag

SEQ ID NO: 779400 - DNA, 25 bp, Mus musculus
tcgaatcacacacacatcatatctt

SEQ ID NO: 779401 - DNA, 25 bp, Mus musculus
tcgaatcacacagacatcatatctt

SEQ ID NO: 779402 - DNA, 25 bp, Mus musculus
tcgaatccaaagacggcatgttcaa

SEQ ID NO: 779403 - DNA, 25 bp, Mus musculus
tcgaatccaaagtcggcatgttcaa

SEQ ID NO: 779404 - DNA, 25 bp, Mus musculus
tcgaatccagtgacagatccagggc

SEQ ID NO: 779405 - DNA, 25 bp, Mus musculus
tcgaatccagtgtcagatccagggc

SEQ ID NO: 779406 - DNA, 25 bp, Mus musculus
tcgaatccgatgctcagtaggctgg

SEQ ID NO: 779407 - DNA, 25 bp, Mus musculus
tcgaatccgatggtcagtaggctgg

SEQ ID NO: 779408 - DNA, 25 bp, Mus musculus
tcgaatcctagacccatgcaggcgc

SEQ ID NO: 779409 - DNA, 25 bp, Mus musculus
tcgaatcctagagccatgcaggcgc

SEQ ID NO: 779410 - DNA, 25 bp, Mus musculus
tcgaatcctgagcaaacagcagagg

SEQ ID NO: 779411 - DNA, 25 bp, Mus musculus
tcgaatcctgaggaaacagcagagg

SEQ ID NO: 779412 - DNA, 25 bp, Mus musculus
tcgaatcctggaccggatgcgctcc

SEQ ID NO: 779413 - DNA, 25 bp, Mus musculus
tcgaatcctggagcggatgcgctcc

SEQ ID NO: 779414 - DNA, 25 bp, Mus musculus
tcgaatctgggcattggcctagcaa

SEQ ID NO: 779415 - DNA, 25 bp, Mus musculus
tcgaatctgggctttggcctagcaa

SEQ ID NO: 779416 - DNA, 25 bp, Mus musculus
tcgaatgaacctcgaaaacgggaga

SEQ ID NO: 779417 - DNA, 25 bp, Mus musculus
tcgaatgaacctggaaaacgggaga

SEQ ID NO: 779418 - DNA, 25 bp, Mus musculus
tcgaatgaatcaagcagcagaactg

SEQ ID NO: 779419 - DNA, 25 bp, Mus musculus
tcgaatgaatcatgcagcagaactg

SEQ ID NO: 779420 - DNA, 25 bp, Mus musculus
tcgaatgatgctcgccttcctggtg

SEQ ID NO: 779421 - DNA, 25 bp, Mus musculus
tcgaatgatgctggccttcctggtg

SEQ ID NO: 779422 - DNA, 25 bp, Mus musculus
tcgaatgcggatcagaccctggcta

SEQ ID NO: 779423 - DNA, 25 bp, Mus musculus
tcgaatgcggatgagaccctggcta

SEQ ID NO: 779424 - DNA, 25 bp, Mus musculus
tcgaatggacaaccccagtaactgt

SEQ ID NO: 779425 - DNA, 25 bp, Mus musculus
tcgaatggacaagcccagtaactgt

SEQ ID NO: 779426 - DNA, 25 bp, Mus musculus
tcgaatggcactaccttagggacat

SEQ ID NO: 779427 - DNA, 25 bp, Mus musculus
tcgaatggcacttccttagggacat

SEQ ID NO: 779428 - DNA, 25 bp, Mus musculus
tcgaatgtttgaacccacgtgcctg

SEQ ID NO: 779429 - DNA, 25 bp, Mus musculus
tcgaatgtttgatcccacgtgcctg

SEQ ID NO: 779430 - DNA, 25 bp, Mus musculus
tcgaattgggtcatggtgctctcca

SEQ ID NO: 779431 - DNA, 25 bp, Mus musculus
tcgaattgggtcttggtgctctcca

SEQ ID NO: 779432 - DNA, 25 bp, Mus musculus
tcgaattttttcactgggcgcagat

SEQ ID NO: 779433 - DNA, 25 bp, Mus musculus
tcgaattttttctctgggcgcagat

SEQ ID NO: 779434 - DNA, 25 bp, Mus musculus
tcgacaaccaagaagtgagcaccaa

SEQ ID NO: 779435 - DNA, 25 bp, Mus musculus
tcgacaaccaagtagtgagcaccaa

SEQ ID NO: 779436 - DNA, 25 bp, Mus musculus
tcgacaaccggcaatgtgtgcagtc

SEQ ID NO: 779437 - DNA, 25 bp, Mus musculus
tcgacaaccggctatgtgtgcagtc

SEQ ID NO: 779438 - DNA, 25 bp, Mus musculus
tcgacaatgatgatgatgctctgtg

SEQ ID NO: 779439 - DNA, 25 bp, Mus musculus
tcgacaatgatgttgatgctctgtg

SEQ ID NO: 779440 - DNA, 25 bp, Mus musculus
tcgacaccattcctttgatgacgcc

SEQ ID NO: 779441 - DNA, 25 bp, Mus musculus
tcgacaccattcgtttgatgacgcc

SEQ ID NO: 779442 - DNA, 25 bp, Mus musculus
tcgacacggaccacagcaaagtctc

SEQ ID NO: 779443 - DNA, 25 bp, Mus musculus
tcgacacggacctcagcaaagtctc

SEQ ID NO: 779444 - DNA, 25 bp, Mus musculus
tcgacactcgtccagcaaaatgctg

SEQ ID NO: 779445 - DNA, 25 bp, Mus musculus
tcgacactcgtcgagcaaaatgctg

SEQ ID NO: 779446 - DNA, 25 bp, Mus musculus
tcgacactgcgacaagacaggagta

SEQ ID NO: 779447 - DNA, 25 bp, Mus musculus
tcgacactgcgagaagacaggagta

SEQ ID NO: 779448 - DNA, 25 bp, Mus musculus
tcgacagagtcacgagggctctagc

SEQ ID NO: 779449 - DNA, 25 bp, Mus musculus
tcgacagagtcaggagggctctagc

SEQ ID NO: 779450 - DNA, 25 bp, Mus musculus
tcgacagcagataccagcagtggat

SEQ ID NO: 779451 - DNA, 25 bp, Mus musculus
tcgacagcagattccagcagtggat

SEQ ID NO: 779452 - DNA, 25 bp, Mus musculus
tcgacagcatcaacaaagaaagaac

SEQ ID NO: 779453 - DNA, 25 bp, Mus musculus
tcgacagcatcatcaaagaaagaac

SEQ ID NO: 779454 - DNA, 25 bp, Mus musculus
tcgacagcccttaaccatcggcggt

SEQ ID NO: 779455 - DNA, 25 bp, Mus musculus
tcgacagccctttaccatcggcggt

SEQ ID NO: 779456 - DNA, 25 bp, Mus musculus
tcgacagcctctcgctgtcagatga

SEQ ID NO: 779457 - DNA, 25 bp, Mus musculus
tcgacagcctctggctgtcagatga

SEQ ID NO: 779458 - DNA, 25 bp, Mus musculus
tcgacagctccacagggaaccctgt

SEQ ID NO: 779459 - DNA, 25 bp, Mus musculus
tcgacagctccagagggaaccctgt

SEQ ID NO: 779460 - DNA, 25 bp, Mus musculus
tcgacagctcgaaccactggcaaac

SEQ ID NO: 779461 - DNA, 25 bp, Mus musculus
tcgacagctcgatccactggcaaac

SEQ ID NO: 779462 - DNA, 25 bp, Mus musculus
tcgacagtaatgatgccttcttcag

SEQ ID NO: 779463 - DNA, 25 bp, Mus musculus
tcgacagtaatgttgccttcttcag

SEQ ID NO: 779464 - DNA, 25 bp, Mus musculus
tcgacagtacacacactgagcagcg

SEQ ID NO: 779465 - DNA, 25 bp, Mus musculus
tcgacagtacactcactgagcagcg

SEQ ID NO: 779466 - DNA, 25 bp, Mus musculus
tcgacagtgcatcaggctgagcaag

SEQ ID NO: 779467 - DNA, 25 bp, Mus musculus
tcgacagtgcatgaggctgagcaag

SEQ ID NO: 779468 - DNA, 25 bp, Mus musculus
tcgacagtggaacagagatagcagc

SEQ ID NO: 779469 - DNA, 25 bp, Mus musculus
tcgacagtggaagagagatagcagc

SEQ ID NO: 779470 - DNA, 25 bp, Mus musculus
tcgacagtgtcaatatagcataatt

SEQ ID NO: 779471 - DNA, 25 bp, Mus musculus
tcgacagtgtcattatagcataatt

SEQ ID NO: 779472 - DNA, 25 bp, Mus musculus
tcgacagttccgactgcttcagccg

SEQ ID NO: 779473 - DNA, 25 bp, Mus musculus
tcgacagttccgtctgcttcagccg

SEQ ID NO: 779474 - DNA, 25 bp, Mus musculus
tcgacatacccacggagaagctgag

SEQ ID NO: 779475 - DNA, 25 bp, Mus musculus
tcgacatacccagggagaagctgag

SEQ ID NO: 779476 - DNA, 25 bp, Mus musculus
tcgacatagcgccaagccagatctt

SEQ ID NO: 779477 - DNA, 25 bp, Mus musculus
tcgacatagcgcgaagccagatctt

SEQ ID NO: 779478 - DNA, 25 bp, Mus musculus
tcgacatcagcgagacagcaggaga

SEQ ID NO: 779479 - DNA, 25 bp, Mus musculus
tcgacatcagcgtgacagcaggaga

SEQ ID NO: 779480 - DNA, 25 bp, Mus musculus
tcgacatcatccaggccgacaggac

SEQ ID NO: 779481 - DNA, 25 bp, Mus musculus
tcgacatcatcctggccgacaggac

SEQ ID NO: 779482 - DNA, 25 bp, Mus musculus
tcgacatcgcagctttcaacaagat

SEQ ID NO: 779483 - DNA, 25 bp, Mus musculus
tcgacatcgcaggtttcaacaagat

SEQ ID NO: 779484 - DNA, 25 bp, Mus musculus
tcgacatgcctcaccgattcaaggt

SEQ ID NO: 779485 - DNA, 25 bp, Mus musculus
tcgacatgcctctccgattcaaggt

SEQ ID NO: 779486 - DNA, 25 bp, Mus musculus
tcgacatgcgcgagatcgagaggct

SEQ ID NO: 779487 - DNA, 25 bp, Mus musculus
tcgacatgcgcgtgatcgagaggct

SEQ ID NO: 779488 - DNA, 25 bp, Mus musculus
tcgacatgttaaaacgggtcagctg

SEQ ID NO: 779489 - DNA, 25 bp, Mus musculus
tcgacatgttaatacgggtcagctg

SEQ ID NO: 779490 - DNA, 25 bp, Mus musculus
tcgaccaactctatgacaccagctg

SEQ ID NO: 779491 - DNA, 25 bp, Mus musculus
tcgaccaactctttgacaccagctg

SEQ ID NO: 779492 - DNA, 25 bp, Mus musculus
tcgaccaaggccatgtcactcacaa

SEQ ID NO: 779493 - DNA, 25 bp, Mus musculus
tcgaccaaggccttgtcactcacaa

SEQ ID NO: 779494 - DNA, 25 bp, Mus musculus
tcgaccacgccgagagcacgtacgg

SEQ ID NO: 779495 - DNA, 25 bp, Mus musculus
tcgaccacgccgtgagcacgtacgg

SEQ ID NO: 779496 - DNA, 25 bp, Mus musculus
tcgaccagaactccacaaactgatc

SEQ ID NO: 779497 - DNA, 25 bp, Mus musculus
tcgaccagaactgcacaaactgatc

SEQ ID NO: 779498 - DNA, 25 bp, Mus musculus
tcgaccaggaggacaacgaagctcc

SEQ ID NO: 779499 - DNA, 25 bp, Mus musculus
tcgaccaggaggtcaacgaagctcc

SEQ ID NO: 779500 - DNA, 25 bp, Mus musculus
tcgaccagtttaagggacaacaggg

SEQ ID NO: 779501 - DNA, 25 bp, Mus musculus
tcgaccagtttatgggacaacaggg

SEQ ID NO: 779502 - DNA, 25 bp, Mus musculus
tcgaccatgggcatgtccgacgtgt

SEQ ID NO: 779503 - DNA, 25 bp, Mus musculus
tcgaccatgggcttgtccgacgtgt

SEQ ID NO: 779504 - DNA, 25 bp, Mus musculus
tcgaccattatcagccagagagagg

SEQ ID NO: 779505 - DNA, 25 bp, Mus musculus
tcgaccattatctgccagagagagg

SEQ ID NO: 779506 - DNA, 25 bp, Mus musculus
tcgacccaaactctgatgtggtagc

SEQ ID NO: 779507 - DNA, 25 bp, Mus musculus
tcgacccaaactgtgatgtggtagc

SEQ ID NO: 779508 - DNA, 25 bp, Mus musculus
tcgacccagtgcaggaccggatccg

SEQ ID NO: 779509 - DNA, 25 bp, Mus musculus
tcgacccagtgctggaccggatccg

SEQ ID NO: 779510 - DNA, 25 bp, Mus musculus
tcgaccccgactaggcagttttcct

SEQ ID NO: 779511 - DNA, 25 bp, Mus musculus
tcgaccccgacttggcagttttcct

SEQ ID NO: 779512 - DNA, 25 bp, Mus musculus
tcgacccctgctaggcttaatactg

SEQ ID NO: 779513 - DNA, 25 bp, Mus musculus
tcgacccctgcttggcttaatactg

SEQ ID NO: 779514 - DNA, 25 bp, Mus musculus
tcgacccctttacagtttgcagcct

SEQ ID NO: 779515 - DNA, 25 bp, Mus musculus
tcgacccctttagagtttgcagcct

SEQ ID NO: 779516 - DNA, 25 bp, Mus musculus
tcgacccgactgatctcgacgtgga

SEQ ID NO: 779517 - DNA, 25 bp, Mus musculus
tcgacccgactgttctcgacgtgga

SEQ ID NO: 779518 - DNA, 25 bp, Mus musculus
tcgacccgatgtcgacccagagatg

SEQ ID NO: 779519 - DNA, 25 bp, Mus musculus
tcgacccgatgtggacccagagatg

SEQ ID NO: 779520 - DNA, 25 bp, Mus musculus
tcgaccctataaatacaactttgct

SEQ ID NO: 779521 - DNA, 25 bp, Mus musculus
tcgaccctataattacaactttgct

SEQ ID NO: 779522 - DNA, 25 bp, Mus musculus
tcgaccctgagactaagaagcacat

SEQ ID NO: 779523 - DNA, 25 bp, Mus musculus
tcgaccctgagagtaagaagcacat

SEQ ID NO: 779524 - DNA, 25 bp, Mus musculus
tcgaccctgggcaggaccggagacc

SEQ ID NO: 779525 - DNA, 25 bp, Mus musculus
tcgaccctgggctggaccggagacc

SEQ ID NO: 779526 - DNA, 25 bp, Mus musculus
tcgaccgcgacacaagaaagtgtgc

SEQ ID NO: 779527 - DNA, 25 bp, Mus musculus
tcgaccgcgacagaagaaagtgtgc

SEQ ID NO: 779528 - DNA, 25 bp, Mus musculus
tcgaccgcgaggaagtgaaccagtt

SEQ ID NO: 779529 - DNA, 25 bp, Mus musculus
tcgaccgcgaggtagtgaaccagtt

SEQ ID NO: 779530 - DNA, 25 bp, Mus musculus
tcgaccggaactatgggaccaaact

SEQ ID NO: 779531 - DNA, 25 bp, Mus musculus
tcgaccggaactttgggaccaaact

SEQ ID NO: 779532 - DNA, 25 bp, Mus musculus
tcgaccggtacgagcaagagaagat

SEQ ID NO: 779533 - DNA, 25 bp, Mus musculus
tcgaccggtacgtgcaagagaagat

SEQ ID NO: 779534 - DNA, 25 bp, Mus musculus
tcgaccgtattgcagcagaccatgt

SEQ ID NO: 779535 - DNA, 25 bp, Mus musculus
tcgaccgtattggagcagaccatgt

SEQ ID NO: 779536 - DNA, 25 bp, Mus musculus
tcgaccgtccaacatccaggagaat

SEQ ID NO: 779537 - DNA, 25 bp, Mus musculus
tcgaccgtccaagatccaggagaat

SEQ ID NO: 779538 - DNA, 25 bp, Mus musculus
tcgacctcatccagccttatggcga

SEQ ID NO: 779539 - DNA, 25 bp, Mus musculus
tcgacctcatcctgccttatggcga

SEQ ID NO: 779540 - DNA, 25 bp, Mus musculus
tcgacctccttgatcggaaggagga

SEQ ID NO: 779541 - DNA, 25 bp, Mus musculus
tcgacctccttgttcggaaggagga

SEQ ID NO: 779542 - DNA, 25 bp, Mus musculus
tcgacctgttcaagttgtatgtgct

SEQ ID NO: 779543 - DNA, 25 bp, Mus musculus
tcgacctgttcatgttgtatgtgct

SEQ ID NO: 779544 - DNA, 25 bp, Mus musculus
tcgaccttctctctgatggcaatgc

SEQ ID NO: 779545 - DNA, 25 bp, Mus musculus
tcgaccttctctgtgatggcaatgc

SEQ ID NO: 779546 - DNA, 25 bp, Mus musculus
tcgaccttgactaggaacccgtgag

SEQ ID NO: 779547 - DNA, 25 bp, Mus musculus
tcgaccttgacttggaacccgtgag

SEQ ID NO: 779548 - DNA, 25 bp, Mus musculus
tcgaccttggcactggtatcaaact

SEQ ID NO: 779549 - DNA, 25 bp, Mus musculus
tcgaccttggcagtggtatcaaact

SEQ ID NO: 779550 - DNA, 25 bp, Mus musculus
tcgaccttggtgatcacttttgaag

SEQ ID NO: 779551 - DNA, 25 bp, Mus musculus
tcgaccttggtgttcacttttgaag

SEQ ID NO: 779552 - DNA, 25 bp, Mus musculus
tcgacgacgacgagttgtggtcgct

SEQ ID NO: 779553 - DNA, 25 bp, Mus musculus
tcgacgacgacgtgttgtggtcgct

SEQ ID NO: 779554 - DNA, 25 bp, Mus musculus
tcgacgacttgcagttttttgaaaa

SEQ ID NO: 779555 - DNA, 25 bp, Mus musculus
tcgacgacttgctgttttttgaaaa

SEQ ID NO: 779556 - DNA, 25 bp, Mus musculus
tcgacgagccgcacattcgcatggt

SEQ ID NO: 779557 - DNA, 25 bp, Mus musculus
tcgacgagccgctcattcgcatggt

SEQ ID NO: 779558 - DNA, 25 bp, Mus musculus
tcgacgagcgcgagaagcacaagtt

SEQ ID NO: 779559 - DNA, 25 bp, Mus musculus
tcgacgagcgcgtgaagcacaagtt

SEQ ID NO: 779560 - DNA, 25 bp, Mus musculus
tcgacgagtgcgaccgcaacatcga

SEQ ID NO: 779561 - DNA, 25 bp, Mus musculus
tcgacgagtgcgtccgcaacatcga

SEQ ID NO: 779562 - DNA, 25 bp, Mus musculus
tcgacgcaccgacgagacataaagt

SEQ ID NO: 779563 - DNA, 25 bp, Mus musculus
tcgacgcaccgaggagacataaagt

SEQ ID NO: 779564 - DNA, 25 bp, Mus musculus
tcgacggacgtgcaaagaaatcaag

SEQ ID NO: 779565 - DNA, 25 bp, Mus musculus
tcgacggacgtggaaagaaatcaag

SEQ ID NO: 779566 - DNA, 25 bp, Mus musculus
tcgacggagccgctttacctgaagt

SEQ ID NO: 779567 - DNA, 25 bp, Mus musculus
tcgacggagccggtttacctgaagt

SEQ ID NO: 779568 - DNA, 25 bp, Mus musculus
tcgacggcgacaagggtgtccccgc

SEQ ID NO: 779569 - DNA, 25 bp, Mus musculus
tcgacggcgacatgggtgtccccgc

SEQ ID NO: 779570 - DNA, 25 bp, Mus musculus
tcgacggcgactacttcagctatac

SEQ ID NO: 779571 - DNA, 25 bp, Mus musculus
tcgacggcgacttcttcagctatac

SEQ ID NO: 779572 - DNA, 25 bp, Mus musculus
tcgacggcgagaccatgatcatcat

SEQ ID NO: 779573 - DNA, 25 bp, Mus musculus
tcgacggcgagagcatgatcatcat

SEQ ID NO: 779574 - DNA, 25 bp, Mus musculus
tcgacgggatgaaactggtgcagac

SEQ ID NO: 779575 - DNA, 25 bp, Mus musculus
tcgacgggatgatactggtgcagac

SEQ ID NO: 779576 - DNA, 25 bp, Mus musculus
tcgacgtagacaaatgggattattt

SEQ ID NO: 779577 - DNA, 25 bp, Mus musculus
tcgacgtagacatatgggattattt

SEQ ID NO: 779578 - DNA, 25 bp, Mus musculus
tcgacgtgtctcagaatgatcttcc

SEQ ID NO: 779579 - DNA, 25 bp, Mus musculus
tcgacgtgtctctgaatgatcttcc

SEQ ID NO: 779580 - DNA, 25 bp, Mus musculus
tcgactagaccacagcttgctgtgg

SEQ ID NO: 779581 - DNA, 25 bp, Mus musculus
tcgactagaccagagcttgctgtgg

SEQ ID NO: 779582 - DNA, 25 bp, Mus musculus
tcgactatggcaactacgtcatcaa

SEQ ID NO: 779583 - DNA, 25 bp, Mus musculus
tcgactatggcatctacgtcatcaa

SEQ ID NO: 779584 - DNA, 25 bp, Mus musculus
tcgactattctcatccccacgatgt

SEQ ID NO: 779585 - DNA, 25 bp, Mus musculus
tcgactattctcttccccacgatgt

SEQ ID NO: 779586 - DNA, 25 bp, Mus musculus
tcgactccaccaatgttgagctagc

SEQ ID NO: 779587 - DNA, 25 bp, Mus musculus
tcgactccaccattgttgagctagc

SEQ ID NO: 779588 - DNA, 25 bp, Mus musculus
tcgactccaggtatgatacagatga

SEQ ID NO: 779589 - DNA, 25 bp, Mus musculus
tcgactccaggtttgatacagatga

SEQ ID NO: 779590 - DNA, 25 bp, Mus musculus
tcgactcgccggagccggcctcgat

SEQ ID NO: 779591 - DNA, 25 bp, Mus musculus
tcgactcgccggtgccggcctcgat

SEQ ID NO: 779592 - DNA, 25 bp, Mus musculus
tcgactctccctccggcagacaggc

SEQ ID NO: 779593 - DNA, 25 bp, Mus musculus
tcgactctccctgcggcagacaggc

SEQ ID NO: 779594 - DNA, 25 bp, Mus musculus
tcgactgaccagagtccgcgaatcg

SEQ ID NO: 779595 - DNA, 25 bp, Mus musculus
tcgactgaccagtgtccgcgaatcg

SEQ ID NO: 779596 - DNA, 25 bp, Mus musculus
tcgactgcaagtccgatgcctgcca

SEQ ID NO: 779597 - DNA, 25 bp, Mus musculus
tcgactgcaagtgcgatgcctgcca

SEQ ID NO: 779598 - DNA, 25 bp, Mus musculus
tcgactggtccaccaacgagctgag

SEQ ID NO: 779599 - DNA, 25 bp, Mus musculus
tcgactggtccagcaacgagctgag

SEQ ID NO: 779600 - DNA, 25 bp, Mus musculus
tcgactggttgcaagcaagacggat

SEQ ID NO: 779601 - DNA, 25 bp, Mus musculus
tcgactggttgctagcaagacggat

SEQ ID NO: 779602 - DNA, 25 bp, Mus musculus
tcgactgtccctcaagtgagtgact

SEQ ID NO: 779603 - DNA, 25 bp, Mus musculus
tcgactgtccctgaagtgagtgact

SEQ ID NO: 779604 - DNA, 25 bp, Mus musculus
tcgactgtgctgacccagagcctgt

SEQ ID NO: 779605 - DNA, 25 bp, Mus musculus
tcgactgtgctgtcccagagcctgt

SEQ ID NO: 779606 - DNA, 25 bp, Mus musculus
tcgactgtgtacacaagctggtgca

SEQ ID NO: 779607 - DNA, 25 bp, Mus musculus
tcgactgtgtactcaagctggtgca

SEQ ID NO: 779608 - DNA, 25 bp, Mus musculus
tcgacttcataaccagaagactggc

SEQ ID NO: 779609 - DNA, 25 bp, Mus musculus
tcgacttcataagcagaagactggc

SEQ ID NO: 779610 - DNA, 25 bp, Mus musculus
tcgacttccaccaggcagtggacgg

SEQ ID NO: 779611 - DNA, 25 bp, Mus musculus
tcgacttccacctggcagtggacgg

SEQ ID NO: 779612 - DNA, 25 bp, Mus musculus
tcgacttctgcacgcaatcgcgaag

SEQ ID NO: 779613 - DNA, 25 bp, Mus musculus
tcgacttctgcaggcaatcgcgaag

SEQ ID NO: 779614 - DNA, 25 bp, Mus musculus
tcgacttggggaccacctattcctg

SEQ ID NO: 779615 - DNA, 25 bp, Mus musculus
tcgacttggggagcacctattcctg

SEQ ID NO: 779616 - DNA, 25 bp, Mus musculus
tcgactttaatgattccctgcaaga

SEQ ID NO: 779617 - DNA, 25 bp, Mus musculus
tcgactttaatgtttccctgcaaga

SEQ ID NO: 779618 - DNA, 25 bp, Mus musculus
tcgactttccaaagatagtcacaag

SEQ ID NO: 779619 - DNA, 25 bp, Mus musculus
tcgactttccaatgatagtcacaag

SEQ ID NO: 779620 - DNA, 25 bp, Mus musculus
tcgactttctcgcagtctggaatgc

SEQ ID NO: 779621 - DNA, 25 bp, Mus musculus
tcgactttctcggagtctggaatgc

SEQ ID NO: 779622 - DNA, 25 bp, Mus musculus
tcgactttgagacgaggcaggcttt

SEQ ID NO: 779623 - DNA, 25 bp, Mus musculus
tcgactttgagaggaggcaggcttt

SEQ ID NO: 779624 - DNA, 25 bp, Mus musculus
tcgactttggcaacgcgcacaggat

SEQ ID NO: 779625 - DNA, 25 bp, Mus musculus
tcgactttggcatcgcgcacaggat

SEQ ID NO: 779626 - DNA, 25 bp, Mus musculus
tcgacttttcaaagccgtttatgac

SEQ ID NO: 779627 - DNA, 25 bp, Mus musculus
tcgacttttcaatgccgtttatgac

SEQ ID NO: 779628 - DNA, 25 bp, Mus musculus
tcgactttttgacaatgctaactgt

SEQ ID NO: 779629 - DNA, 25 bp, Mus musculus
tcgactttttgagaatgctaactgt

SEQ ID NO: 779630 - DNA, 25 bp, Mus musculus
tcgagaaagagaacgatgttctgga

SEQ ID NO: 779631 - DNA, 25 bp, Mus musculus
tcgagaaagagatcgatgttctgga

SEQ ID NO: 779632 - DNA, 25 bp, Mus musculus
tcgagaaagcaacttacagctcaac

SEQ ID NO: 779633 - DNA, 25 bp, Mus musculus
tcgagaaagcaagttacagctcaac

SEQ ID NO: 779634 - DNA, 25 bp, Mus musculus
tcgagaaataaacgccacagaacca

SEQ ID NO: 779635 - DNA, 25 bp, Mus musculus
tcgagaaataaaggccacagaacca

SEQ ID NO: 779636 - DNA, 25 bp, Mus musculus
tcgagaaatgcaaagtgatggcctc

SEQ ID NO: 779637 - DNA, 25 bp, Mus musculus
tcgagaaatgcatagtgatggcctc

SEQ ID NO: 779638 - DNA, 25 bp, Mus musculus
tcgagaacatgacactggtagatgc

SEQ ID NO: 779639 - DNA, 25 bp, Mus musculus
tcgagaacatgagactggtagatgc

SEQ ID NO: 779640 - DNA, 25 bp, Mus musculus
tcgagaactcgccaaggcagaaaag

SEQ ID NO: 779641 - DNA, 25 bp, Mus musculus
tcgagaactcgcgaaggcagaaaag

SEQ ID NO: 779642 - DNA, 25 bp, Mus musculus
tcgagaagaaatccaggaagtaaga

SEQ ID NO: 779643 - DNA, 25 bp, Mus musculus
tcgagaagaaatgcaggaagtaaga

SEQ ID NO: 779644 - DNA, 25 bp, Mus musculus
tcgagaagaagtcgttgaaagacac

SEQ ID NO: 779645 - DNA, 25 bp, Mus musculus
tcgagaagaagtggttgaaagacac

SEQ ID NO: 779646 - DNA, 25 bp, Mus musculus
tcgagaagagcacgccaagtactat

SEQ ID NO: 779647 - DNA, 25 bp, Mus musculus
tcgagaagagcaggccaagtactat

SEQ ID NO: 779648 - DNA, 25 bp, Mus musculus
tcgagaagaggtccactggatgaca

SEQ ID NO: 779649 - DNA, 25 bp, Mus musculus
tcgagaagaggtgcactggatgaca

SEQ ID NO: 779650 - DNA, 25 bp, Mus musculus
tcgagaagcattccacattgtaggg

SEQ ID NO: 779651 - DNA, 25 bp, Mus musculus
tcgagaagcattgcacattgtaggg

SEQ ID NO: 779652 - DNA, 25 bp, Mus musculus
tcgagaagggccaccccgaagagca

SEQ ID NO: 779653 - DNA, 25 bp, Mus musculus
tcgagaagggcctccccgaagagca

SEQ ID NO: 779654 - DNA, 25 bp, Mus musculus
tcgagaaggttcaccagccaactgg

SEQ ID NO: 779655 - DNA, 25 bp, Mus musculus
tcgagaaggttctccagccaactgg

SEQ ID NO: 779656 - DNA, 25 bp, Mus musculus
tcgagaagttcgaggacactccaag

SEQ ID NO: 779657 - DNA, 25 bp, Mus musculus
tcgagaagttcgtggacactccaag

SEQ ID NO: 779658 - DNA, 25 bp, Mus musculus
tcgagaatatcgatgaggacttcag

SEQ ID NO: 779659 - DNA, 25 bp, Mus musculus
tcgagaatatcgttgaggacttcag

SEQ ID NO: 779660 - DNA, 25 bp, Mus musculus
tcgagaatatgtatgggcaccaggc

SEQ ID NO: 779661 - DNA, 25 bp, Mus musculus
tcgagaatatgtttgggcaccaggc

SEQ ID NO: 779662 - DNA, 25 bp, Mus musculus
tcgagaatctgtaccgacgtcaggc

SEQ ID NO: 779663 - DNA, 25 bp, Mus musculus
tcgagaatctgttccgacgtcaggc

SEQ ID NO: 779664 - DNA, 25 bp, Mus musculus
tcgagaatgcgtacaagaaaacctt

SEQ ID NO: 779665 - DNA, 25 bp, Mus musculus
tcgagaatgcgttcaagaaaacctt

SEQ ID NO: 779666 - DNA, 25 bp, Mus musculus
tcgagaattgttacggaggcaggtt

SEQ ID NO: 779667 - DNA, 25 bp, Mus musculus
tcgagaattgtttcggaggcaggtt

SEQ ID NO: 779668 - DNA, 25 bp, Mus musculus
tcgagacaacaacatgggcctggtg

SEQ ID NO: 779669 - DNA, 25 bp, Mus musculus
tcgagacaacaagatgggcctggtg

SEQ ID NO: 779670 - DNA, 25 bp, Mus musculus
tcgagacacactaggttcagcggct

SEQ ID NO: 779671 - DNA, 25 bp, Mus musculus
tcgagacacacttggttcagcggct

SEQ ID NO: 779672 - DNA, 25 bp, Mus musculus
tcgagacagaggataaggcgtatct

SEQ ID NO: 779673 - DNA, 25 bp, Mus musculus
tcgagacagaggttaaggcgtatct

SEQ ID NO: 779674 - DNA, 25 bp, Mus musculus
tcgagacatcaacctggatgtgaac

SEQ ID NO: 779675 - DNA, 25 bp, Mus musculus
tcgagacatcaagctggatgtgaac

SEQ ID NO: 779676 - DNA, 25 bp, Mus musculus
tcgagacatcgtcgatgacgacgat

SEQ ID NO: 779677 - DNA, 25 bp, Mus musculus
tcgagacatcgtggatgacgacgat

SEQ ID NO: 779678 - DNA, 25 bp, Mus musculus
tcgagacatgatagccgaggccagc

SEQ ID NO: 779679 - DNA, 25 bp, Mus musculus
tcgagacatgattgccgaggccagc

SEQ ID NO: 779680 - DNA, 25 bp, Mus musculus
tcgagaccagtaccctgactgagga

SEQ ID NO: 779681 - DNA, 25 bp, Mus musculus
tcgagaccagtagcctgactgagga

SEQ ID NO: 779682 - DNA, 25 bp, Mus musculus
tcgagacccctgagtcctacgttgg

SEQ ID NO: 779683 - DNA, 25 bp, Mus musculus
tcgagacccctgtgtcctacgttgg

SEQ ID NO: 779684 - DNA, 25 bp, Mus musculus
tcgagacgatcgctaacgagtatag

SEQ ID NO: 779685 - DNA, 25 bp, Mus musculus
tcgagacgatcggtaacgagtatag

SEQ ID NO: 779686 - DNA, 25 bp, Mus musculus
tcgagactacgacaggaaccgaagg

SEQ ID NO: 779687 - DNA, 25 bp, Mus musculus
tcgagactacgagaggaaccgaagg

SEQ ID NO: 779688 - DNA, 25 bp, Mus musculus
tcgagactgtaaacatgaactaggc

SEQ ID NO: 779689 - DNA, 25 bp, Mus musculus
tcgagactgtaatcatgaactaggc

SEQ ID NO: 779690 - DNA, 25 bp, Mus musculus
tcgagagcaagaactgcattcacag

SEQ ID NO: 779691 - DNA, 25 bp, Mus musculus
tcgagagcaagatctgcattcacag

SEQ ID NO: 779692 - DNA, 25 bp, Mus musculus
tcgagagcactgatgaagccaagct

SEQ ID NO: 779693 - DNA, 25 bp, Mus musculus
tcgagagcactgttgaagccaagct

SEQ ID NO: 779694 - DNA, 25 bp, Mus musculus
tcgagagcagcgcaccaaaggtcct

SEQ ID NO: 779695 - DNA, 25 bp, Mus musculus
tcgagagcagcggaccaaaggtcct

SEQ ID NO: 779696 - DNA, 25 bp, Mus musculus
tcgagagcgaccaggaacgtgcaga

SEQ ID NO: 779697 - DNA, 25 bp, Mus musculus
tcgagagcgacctggaacgtgcaga

SEQ ID NO: 779698 - DNA, 25 bp, Mus musculus
tcgagagctgatagcccggtttcac

SEQ ID NO: 779699 - DNA, 25 bp, Mus musculus
tcgagagctgattgcccggtttcac

SEQ ID NO: 779700 - DNA, 25 bp, Mus musculus
tcgagaggcagccaggaactttccc

SEQ ID NO: 779701 - DNA, 25 bp, Mus musculus
tcgagaggcagcgaggaactttccc

SEQ ID NO: 779702 - DNA, 25 bp, Mus musculus
tcgagaggccgtcagtatctgtcag

SEQ ID NO: 779703 - DNA, 25 bp, Mus musculus
tcgagaggccgtgagtatctgtcag

SEQ ID NO: 779704 - DNA, 25 bp, Mus musculus
tcgagagggcaaagtgtcagaagcc

SEQ ID NO: 779705 - DNA, 25 bp, Mus musculus
tcgagagggcaatgtgtcagaagcc

SEQ ID NO: 779706 - DNA, 25 bp, Mus musculus
tcgagagtggccagattatgtgcat

SEQ ID NO: 779707 - DNA, 25 bp, Mus musculus
tcgagagtggcctgattatgtgcat

SEQ ID NO: 779708 - DNA, 25 bp, Mus musculus
tcgagatctgcgagctggaagccaa

SEQ ID NO: 779709 - DNA, 25 bp, Mus musculus
tcgagatctgcgtgctggaagccaa

SEQ ID NO: 779710 - DNA, 25 bp, Mus musculus
tcgagatggaatcttcggtgtttgc

SEQ ID NO: 779711 - DNA, 25 bp, Mus musculus
tcgagatggaatgttcggtgtttgc

SEQ ID NO: 779712 - DNA, 25 bp, Mus musculus
tcgagatgggcgcaaaaacgtggtt

SEQ ID NO: 779713 - DNA, 25 bp, Mus musculus
tcgagatgggcggaaaaacgtggtt

SEQ ID NO: 779714 - DNA, 25 bp, Mus musculus
tcgagatgtgcacaacctggactac

SEQ ID NO: 779715 - DNA, 25 bp, Mus musculus
tcgagatgtgcagaacctggactac

SEQ ID NO: 779716 - DNA, 25 bp, Mus musculus
tcgagattcaggaataagtcgggct

SEQ ID NO: 779717 - DNA, 25 bp, Mus musculus
tcgagattcaggtataagtcgggct

SEQ ID NO: 779718 - DNA, 25 bp, Mus musculus
tcgagcaaaagacgtgataatacca

SEQ ID NO: 779719 - DNA, 25 bp, Mus musculus
tcgagcaaaagaggtgataatacca

SEQ ID NO: 779720 - DNA, 25 bp, Mus musculus
tcgagcaactaaagcagcacgtgga

SEQ ID NO: 779721 - DNA, 25 bp, Mus musculus
tcgagcaactaaatggactgagggt

SEQ ID NO: 779722 - DNA, 25 bp, Mus musculus
tcgagcaactaatgcagcacgtgga

SEQ ID NO: 779723 - DNA, 25 bp, Mus musculus
tcgagcaactaattggactgagggt

SEQ ID NO: 779724 - DNA, 25 bp, Mus musculus
tcgagcaagagcatacccagggctt

SEQ ID NO: 779725 - DNA, 25 bp, Mus musculus
tcgagcaagagcttacccagggctt

SEQ ID NO: 779726 - DNA, 25 bp, Mus musculus
tcgagcaagccaaccttcaaagcag

SEQ ID NO: 779727 - DNA, 25 bp, Mus musculus
tcgagcaagccatccttcaaagcag

SEQ ID NO: 779728 - DNA, 25 bp, Mus musculus
tcgagcagttcgatgagtctcaccc

SEQ ID NO: 779729 - DNA, 25 bp, Mus musculus
tcgagcagttcgttgagtctcaccc

SEQ ID NO: 779730 - DNA, 25 bp, Mus musculus
tcgagcatcttgaaaggcagtctaa

SEQ ID NO: 779731 - DNA, 25 bp, Mus musculus
tcgagcatcttgtaaggcagtctaa

SEQ ID NO: 779732 - DNA, 25 bp, Mus musculus
tcgagcatggcgagcagaaccgtat

SEQ ID NO: 779733 - DNA, 25 bp, Mus musculus
tcgagcatggcgtgcagaaccgtat

SEQ ID NO: 779734 - DNA, 25 bp, Mus musculus
tcgagccaccaaattcataggcgtg

SEQ ID NO: 779735 - DNA, 25 bp, Mus musculus
tcgagccaccaatttcataggcgtg

SEQ ID NO: 779736 - DNA, 25 bp, Mus musculus
tcgagccagtggcttgatttctggt

SEQ ID NO: 779737 - DNA, 25 bp, Mus musculus
tcgagccagtgggttgatttctggt

SEQ ID NO: 779738 - DNA, 25 bp, Mus musculus
tcgagcccagccctgacaaaatgct

SEQ ID NO: 779739 - DNA, 25 bp, Mus musculus
tcgagcccagccgtgacaaaatgct

SEQ ID NO: 779740 - DNA, 25 bp, Mus musculus
tcgagccccgtacctggaggcttgc

SEQ ID NO: 779741 - DNA, 25 bp, Mus musculus
tcgagccccgtagctggaggcttgc

SEQ ID NO: 779742 - DNA, 25 bp, Mus musculus
tcgagcccgctgatgtgagaaggtc

SEQ ID NO: 779743 - DNA, 25 bp, Mus musculus
tcgagcccgctgttgtgagaaggtc

SEQ ID NO: 779744 - DNA, 25 bp, Mus musculus
tcgagccggcggacatggtacttct

SEQ ID NO: 779745 - DNA, 25 bp, Mus musculus
tcgagccggcggtcatggtacttct

SEQ ID NO: 779746 - DNA, 25 bp, Mus musculus
tcgagcctgcttcaccatggatcct

SEQ ID NO: 779747 - DNA, 25 bp, Mus musculus
tcgagcctgcttgaccatggatcct

SEQ ID NO: 779748 - DNA, 25 bp, Mus musculus
tcgagcctggcactgaggcgacatc

SEQ ID NO: 779749 - DNA, 25 bp, Mus musculus
tcgagcctggcagtgaggcgacatc

SEQ ID NO: 779750 - DNA, 25 bp, Mus musculus
tcgagcctgttgcaccctaatacag

SEQ ID NO: 779751 - DNA, 25 bp, Mus musculus
tcgagcctgttggaccctaatacag

SEQ ID NO: 779752 - DNA, 25 bp, Mus musculus
tcgagcgaagatattgcggatatgc

SEQ ID NO: 779753 - DNA, 25 bp, Mus musculus
tcgagcgaagattttgcggatatgc

SEQ ID NO: 779754 - DNA, 25 bp, Mus musculus
tcgagcggcagaacgagagcataga

SEQ ID NO: 779755 - DNA, 25 bp, Mus musculus
tcgagcggcagatcgagagcataga

SEQ ID NO: 779756 - DNA, 25 bp, Mus musculus
tcgagcggcctccacgtcgatacgg

SEQ ID NO: 779757 - DNA, 25 bp, Mus musculus
tcgagcggcctcgacgtcgatacgg

SEQ ID NO: 779758 - DNA, 25 bp, Mus musculus
tcgagcggtccacggaccaggtcat

SEQ ID NO: 779759 - DNA, 25 bp, Mus musculus
tcgagcggtccagggaccaggtcat

SEQ ID NO: 779760 - DNA, 25 bp, Mus musculus
tcgagcgtcggacttaaccacgtct

SEQ ID NO: 779761 - DNA, 25 bp, Mus musculus
tcgagcgtcggagttaaccacgtct

SEQ ID NO: 779762 - DNA, 25 bp, Mus musculus
tcgagctaagccaagcgccgcggag

SEQ ID NO: 779763 - DNA, 25 bp, Mus musculus
tcgagctaagcctagcgccgcggag

SEQ ID NO: 779764 - DNA, 25 bp, Mus musculus
tcgagctaagctcctcaatattggc

SEQ ID NO: 779765 - DNA, 25 bp, Mus musculus
tcgagctaagctgctcaatattggc

SEQ ID NO: 779766 - DNA, 25 bp, Mus musculus
tcgagctagaggagccccttccaag

SEQ ID NO: 779767 - DNA, 25 bp, Mus musculus
tcgagctagaggtgccccttccaag

SEQ ID NO: 779768 - DNA, 25 bp, Mus musculus
tcgagctcatgtcttccagattgac

SEQ ID NO: 779769 - DNA, 25 bp, Mus musculus
tcgagctcatgtgttccagattgac

SEQ ID NO: 779770 - DNA, 25 bp, Mus musculus
tcgagctggaaaacttgcccgtcgg

SEQ ID NO: 779771 - DNA, 25 bp, Mus musculus
tcgagctggaaatcttgcccgtcgg

SEQ ID NO: 779772 - DNA, 25 bp, Mus musculus
tcgaggaagggcactctgaggtctg

SEQ ID NO: 779773 - DNA, 25 bp, Mus musculus
tcgaggaagggctctctgaggtctg

SEQ ID NO: 779774 - DNA, 25 bp, Mus musculus
tcgaggaatacaccacaggcatggc

SEQ ID NO: 779775 - DNA, 25 bp, Mus musculus
tcgaggaatacagcacaggcatggc

SEQ ID NO: 779776 - DNA, 25 bp, Mus musculus
tcgaggaatgtaaagcaacaggatg

SEQ ID NO: 779777 - DNA, 25 bp, Mus musculus
tcgaggaatgtatagcaacaggatg

SEQ ID NO: 779778 - DNA, 25 bp, Mus musculus
tcgaggacaggcacatcagatgggc

SEQ ID NO: 779779 - DNA, 25 bp, Mus musculus
tcgaggacaggctcatcagatgggc

SEQ ID NO: 779780 - DNA, 25 bp, Mus musculus
tcgaggacatttctaaggcccacgg

SEQ ID NO: 779781 - DNA, 25 bp, Mus musculus
tcgaggacatttgtaaggcccacgg

SEQ ID NO: 779782 - DNA, 25 bp, Mus musculus
tcgaggacggcaacggcctgttcct

SEQ ID NO: 779783 - DNA, 25 bp, Mus musculus
tcgaggacggcatcggcctgttcct

SEQ ID NO: 779784 - DNA, 25 bp, Mus musculus
tcgaggactggtccttgaaaatgag

SEQ ID NO: 779785 - DNA, 25 bp, Mus musculus
tcgaggactggtgcttgaaaatgag

SEQ ID NO: 779786 - DNA, 25 bp, Mus musculus
tcgaggagacccaagggccatagtg

SEQ ID NO: 779787 - DNA, 25 bp, Mus musculus
tcgaggagaccctagggccatagtg

SEQ ID NO: 779788 - DNA, 25 bp, Mus musculus
tcgaggagcaggacgagaatcaaga

SEQ ID NO: 779789 - DNA, 25 bp, Mus musculus
tcgaggagcaggacgtggaagagcc

SEQ ID NO: 779790 - DNA, 25 bp, Mus musculus
tcgaggagcaggtcgagaatcaaga

SEQ ID NO: 779791 - DNA, 25 bp, Mus musculus
tcgaggagcaggtcgtggaagagcc

SEQ ID NO: 779792 - DNA, 25 bp, Mus musculus
tcgaggagcctgactattacagcca

SEQ ID NO: 779793 - DNA, 25 bp, Mus musculus
tcgaggagcctgtctattacagcca

SEQ ID NO: 779794 - DNA, 25 bp, Mus musculus
tcgaggagccttagcccccagaggg

SEQ ID NO: 779795 - DNA, 25 bp, Mus musculus
tcgaggagcctttgcccccagaggg

SEQ ID NO: 779796 - DNA, 25 bp, Mus musculus
tcgaggaggacaacgcagcgaaaga

SEQ ID NO: 779797 - DNA, 25 bp, Mus musculus
tcgaggaggacatcgcagcgaaaga

SEQ ID NO: 779798 - DNA, 25 bp, Mus musculus
tcgaggaggcttaccattacatctt

SEQ ID NO: 779799 - DNA, 25 bp, Mus musculus
tcgaggaggctttccattacatctt

SEQ ID NO: 779800 - DNA, 25 bp, Mus musculus
tcgaggatatccaggcggctgtccg

SEQ ID NO: 779801 - DNA, 25 bp, Mus musculus
tcgaggatatcctggcggctgtccg

SEQ ID NO: 779802 - DNA, 25 bp, Mus musculus
tcgaggatggaactgccaatcagct

SEQ ID NO: 779803 - DNA, 25 bp, Mus musculus
tcgaggatggaagtgccaatcagct

SEQ ID NO: 779804 - DNA, 25 bp, Mus musculus
tcgaggcagaatagctgagccctgc

SEQ ID NO: 779805 - DNA, 25 bp, Mus musculus
tcgaggcagaattgctgagccctgc

SEQ ID NO: 779806 - DNA, 25 bp, Mus musculus
tcgaggcatcaaaggcatagtgaga

SEQ ID NO: 779807 - DNA, 25 bp, Mus musculus
tcgaggcatcaatggcatagtgaga

SEQ ID NO: 779808 - DNA, 25 bp, Mus musculus
tcgaggccaactcagaaaacggtgt

SEQ ID NO: 779809 - DNA, 25 bp, Mus musculus
tcgaggccaactgagaaaacggtgt

SEQ ID NO: 779810 - DNA, 25 bp, Mus musculus
tcgaggccaagtcatcgcaaggact

SEQ ID NO: 779811 - DNA, 25 bp, Mus musculus
tcgaggccaagtgatcgcaaggact

SEQ ID NO: 779812 - DNA, 25 bp, Mus musculus
tcgaggcctactatgaccagaagag

SEQ ID NO: 779813 - DNA, 25 bp, Mus musculus
tcgaggcctactttgaccagaagag

SEQ ID NO: 779814 - DNA, 25 bp, Mus musculus
tcgaggcgctcaagaagcttaacaa

SEQ ID NO: 779815 - DNA, 25 bp, Mus musculus
tcgaggcgctcatgaagcttaacaa

SEQ ID NO: 779816 - DNA, 25 bp, Mus musculus
tcgaggctaatgagtaggtcccaga

SEQ ID NO: 779817 - DNA, 25 bp, Mus musculus
tcgaggctaatgtgtaggtcccaga

SEQ ID NO: 779818 - DNA, 25 bp, Mus musculus
tcgaggctggaaaggctgacatgta

SEQ ID NO: 779819 - DNA, 25 bp, Mus musculus
tcgaggctggaatggctgacatgta

SEQ ID NO: 779820 - DNA, 25 bp, Mus musculus
tcgaggctgggccttcaagaacccg

SEQ ID NO: 779821 - DNA, 25 bp, Mus musculus
tcgaggctgggcgttcaagaacccg

SEQ ID NO: 779822 - DNA, 25 bp, Mus musculus
tcgaggctgtgtatgagctcaccaa

SEQ ID NO: 779823 - DNA, 25 bp, Mus musculus
tcgaggctgtgtttgagctcaccaa

SEQ ID NO: 779824 - DNA, 25 bp, Mus musculus
tcgagggacagtacgttatgcatca

SEQ ID NO: 779825 - DNA, 25 bp, Mus musculus
tcgagggacagttcgttatgcatca

SEQ ID NO: 779826 - DNA, 25 bp, Mus musculus
tcgagggcaccgcgttttcaaacat

SEQ ID NO: 779827 - DNA, 25 bp, Mus musculus
tcgagggcaccgggttttcaaacat

SEQ ID NO: 779828 - DNA, 25 bp, Mus musculus
tcgagggccgccagacagtcagcca

SEQ ID NO: 779829 - DNA, 25 bp, Mus musculus
tcgagggccgcctgacagtcagcca

SEQ ID NO: 779830 - DNA, 25 bp, Mus musculus
tcgagggcgcacaggacactgtgac

SEQ ID NO: 779831 - DNA, 25 bp, Mus musculus
tcgagggcgcactggacactgtgac

SEQ ID NO: 779832 - DNA, 25 bp, Mus musculus
tcgagggctctgagcgctggcaacc

SEQ ID NO: 779833 - DNA, 25 bp, Mus musculus
tcgagggctctgtgcgctggcaacc

SEQ ID NO: 779834 - DNA, 25 bp, Mus musculus
tcgaggggcacacacagctgctgct

SEQ ID NO: 779835 - DNA, 25 bp, Mus musculus
tcgaggggcacagacagctgctgct

SEQ ID NO: 779836 - DNA, 25 bp, Mus musculus
tcgagggtggcaagcattgagaaga

SEQ ID NO: 779837 - DNA, 25 bp, Mus musculus
tcgagggtggcatgcattgagaaga

SEQ ID NO: 779838 - DNA, 25 bp, Mus musculus
tcgagggttcttcccaggccgagcc

SEQ ID NO: 779839 - DNA, 25 bp, Mus musculus
tcgagggttcttgccaggccgagcc

SEQ ID NO: 779840 - DNA, 25 bp, Mus musculus
tcgaggtcaacaacagcgagctgcc

SEQ ID NO: 779841 - DNA, 25 bp, Mus musculus
tcgaggtcaacacccggcgagcaca

SEQ ID NO: 779842 - DNA, 25 bp, Mus musculus
tcgaggtcaacagccggcgagcaca

SEQ ID NO: 779843 - DNA, 25 bp, Mus musculus
tcgaggtcaacatcagcgagctgcc

SEQ ID NO: 779844 - DNA, 25 bp, Mus musculus
tcgaggtcagttctgtcccagggaa

SEQ ID NO: 779845 - DNA, 25 bp, Mus musculus
tcgaggtcagttgtgtcccagggaa

SEQ ID NO: 779846 - DNA, 25 bp, Mus musculus
tcgaggtcctctcgcaagtcaagtt

SEQ ID NO: 779847 - DNA, 25 bp, Mus musculus
tcgaggtcctctggcaagtcaagtt

SEQ ID NO: 779848 - DNA, 25 bp, Mus musculus
tcgaggtgcgacattatttatcaca

SEQ ID NO: 779849 - DNA, 25 bp, Mus musculus
tcgaggtgcgactttatttatcaca

SEQ ID NO: 779850 - DNA, 25 bp, Mus musculus
tcgaggtgcggcaactgctccgagt

SEQ ID NO: 779851 - DNA, 25 bp, Mus musculus
tcgaggtgcggctactgctccgagt

SEQ ID NO: 779852 - DNA, 25 bp, Mus musculus
tcgaggtggaacaccaactggactg

SEQ ID NO: 779853 - DNA, 25 bp, Mus musculus
tcgaggtggaactccaactggactg

SEQ ID NO: 779854 - DNA, 25 bp, Mus musculus
tcgaggtggagcataaccctgggcc

SEQ ID NO: 779855 - DNA, 25 bp, Mus musculus
tcgaggtggagcttaaccctgggcc

SEQ ID NO: 779856 - DNA, 25 bp, Mus musculus
tcgaggtggtcaacgatccagatgc

SEQ ID NO: 779857 - DNA, 25 bp, Mus musculus
tcgaggtggtcatcgatccagatgc

SEQ ID NO: 779858 - DNA, 25 bp, Mus musculus
tcgaggttgaagctagcaaaagttg

SEQ ID NO: 779859 - DNA, 25 bp, Mus musculus
tcgaggttgaaggtagcaaaagttg

SEQ ID NO: 779860 - DNA, 25 bp, Mus musculus
tcgaggttttaccacccgaactctg

SEQ ID NO: 779861 - DNA, 25 bp, Mus musculus
tcgaggttttacgacccgaactctg

SEQ ID NO: 779862 - DNA, 25 bp, Mus musculus
tcgagtacaggcaggcaattcaaac

SEQ ID NO: 779863 - DNA, 25 bp, Mus musculus
tcgagtacaggctggcaattcaaac

SEQ ID NO: 779864 - DNA, 25 bp, Mus musculus
tcgagtagaagaactcattgaaatc

SEQ ID NO: 779865 - DNA, 25 bp, Mus musculus
tcgagtagaagatctcattgaaatc

SEQ ID NO: 779866 - DNA, 25 bp, Mus musculus
tcgagtataatgacggaaggcccac

SEQ ID NO: 779867 - DNA, 25 bp, Mus musculus
tcgagtataatgtcggaaggcccac

SEQ ID NO: 779868 - DNA, 25 bp, Mus musculus
tcgagtatgaaacactgcctggatg

SEQ ID NO: 779869 - DNA, 25 bp, Mus musculus
tcgagtatgaaagactgcctggatg

SEQ ID NO: 779870 - DNA, 25 bp, Mus musculus
tcgagtatgcctacagtgacaacag

SEQ ID NO: 779871 - DNA, 25 bp, Mus musculus
tcgagtatgccttcagtgacaacag

SEQ ID NO: 779872 - DNA, 25 bp, Mus musculus
tcgagtatggtgatatgcttgcagc

SEQ ID NO: 779873 - DNA, 25 bp, Mus musculus
tcgagtatggtgttatgcttgcagc

SEQ ID NO: 779874 - DNA, 25 bp, Mus musculus
tcgagtcaacgtccctgtcattggc

SEQ ID NO: 779875 - DNA, 25 bp, Mus musculus
tcgagtcaacgtgcctgtcattggc

SEQ ID NO: 779876 - DNA, 25 bp, Mus musculus
tcgagtcagttcattaatgccacct

SEQ ID NO: 779877 - DNA, 25 bp, Mus musculus
tcgagtcagttctttaatgccacct

SEQ ID NO: 779878 - DNA, 25 bp, Mus musculus
tcgagtccagctcggaaaggatgca

SEQ ID NO: 779879 - DNA, 25 bp, Mus musculus
tcgagtccagctgggaaaggatgca

SEQ ID NO: 779880 - DNA, 25 bp, Mus musculus
tcgagtcgaagcaccagaaagtact

SEQ ID NO: 779881 - DNA, 25 bp, Mus musculus
tcgagtcgaagctccagaaagtact

SEQ ID NO: 779882 - DNA, 25 bp, Mus musculus
tcgagtcggtctctgacgaccctac

SEQ ID NO: 779883 - DNA, 25 bp, Mus musculus
tcgagtcggtctgtgacgaccctac

SEQ ID NO: 779884 - DNA, 25 bp, Mus musculus
tcgagtcttcggagcgggcgctgtc

SEQ ID NO: 779885 - DNA, 25 bp, Mus musculus
tcgagtcttcggtgcgggcgctgtc

SEQ ID NO: 779886 - DNA, 25 bp, Mus musculus
tcgagtgaatgcagagcctgcggct

SEQ ID NO: 779887 - DNA, 25 bp, Mus musculus
tcgagtgaatgctgagcctgcggct

SEQ ID NO: 779888 - DNA, 25 bp, Mus musculus
tcgagtgagagtatctaacgatgct

SEQ ID NO: 779889 - DNA, 25 bp, Mus musculus
tcgagtgagagtttctaacgatgct

SEQ ID NO: 779890 - DNA, 25 bp, Mus musculus
tcgagtgagcaccatctctggaacc

SEQ ID NO: 779891 - DNA, 25 bp, Mus musculus
tcgagtgagcacgatctctggaacc

SEQ ID NO: 779892 - DNA, 25 bp, Mus musculus
tcgagtgcccatcctgagtagcagc

SEQ ID NO: 779893 - DNA, 25 bp, Mus musculus
tcgagtgcccatgctgagtagcagc

SEQ ID NO: 779894 - DNA, 25 bp, Mus musculus
tcgagtgctactcccctggagagga

SEQ ID NO: 779895 - DNA, 25 bp, Mus musculus
tcgagtgctactgccctggagagga

SEQ ID NO: 779896 - DNA, 25 bp, Mus musculus
tcgagtgctcaaagctattagagac

SEQ ID NO: 779897 - DNA, 25 bp, Mus musculus
tcgagtgctcaatgctattagagac

SEQ ID NO: 779898 - DNA, 25 bp, Mus musculus
tcgagtggagatacagcgagctggt

SEQ ID NO: 779899 - DNA, 25 bp, Mus musculus
tcgagtggagattcagcgagctggt

SEQ ID NO: 779900 - DNA, 25 bp, Mus musculus
tcgagtggagtgagtggtaacttcc

SEQ ID NO: 779901 - DNA, 25 bp, Mus musculus
tcgagtggagtgtgtggtaacttcc

SEQ ID NO: 779902 - DNA, 25 bp, Mus musculus
tcgagtggccaactaccagcgtgat

SEQ ID NO: 779903 - DNA, 25 bp, Mus musculus
tcgagtggccaagtaccagcgtgat

SEQ ID NO: 779904 - DNA, 25 bp, Mus musculus
tcgagtggccggctatgaaacccag

SEQ ID NO: 779905 - DNA, 25 bp, Mus musculus
tcgagtggccgggtatgaaacccag

SEQ ID NO: 779906 - DNA, 25 bp, Mus musculus
tcgagtggtcatctctacccacagc

SEQ ID NO: 779907 - DNA, 25 bp, Mus musculus
tcgagtggtcatgtctacccacagc

SEQ ID NO: 779908 - DNA, 25 bp, Mus musculus
tcgagtggtgtgaccgccggatcac

SEQ ID NO: 779909 - DNA, 25 bp, Mus musculus
tcgagtggtgtgtccgccggatcac

SEQ ID NO: 779910 - DNA, 25 bp, Mus musculus
tcgagtgtgctcaccagggagtgtt

SEQ ID NO: 779911 - DNA, 25 bp, Mus musculus
tcgagtgtgctctccagggagtgtt

SEQ ID NO: 779912 - DNA, 25 bp, Mus musculus
tcgagtgtttatacctgtacttcag

SEQ ID NO: 779913 - DNA, 25 bp, Mus musculus
tcgagtgtttattcctgtacttcag

SEQ ID NO: 779914 - DNA, 25 bp, Mus musculus
tcgagttataaaatcacagagagtg

SEQ ID NO: 779915 - DNA, 25 bp, Mus musculus
tcgagttataaattcacagagagtg

SEQ ID NO: 779916 - DNA, 25 bp, Mus musculus
tcgagttcaccccatgccacaagag

SEQ ID NO: 779917 - DNA, 25 bp, Mus musculus
tcgagttcacccgatgccacaagag

SEQ ID NO: 779918 - DNA, 25 bp, Mus musculus
tcgagttcaggaagtcgtgaaggaa

SEQ ID NO: 779919 - DNA, 25 bp, Mus musculus
tcgagttcaggatgtcgtgaaggaa

SEQ ID NO: 779920 - DNA, 25 bp, Mus musculus
tcgagttctgctcccgttacacagg

SEQ ID NO: 779921 - DNA, 25 bp, Mus musculus
tcgagttctgctgccgttacacagg

SEQ ID NO: 779922 - DNA, 25 bp, Mus musculus
tcgagttctggtcaatgatgcccag

SEQ ID NO: 779923 - DNA, 25 bp, Mus musculus
tcgagttctggtgaatgatgcccag

SEQ ID NO: 779924 - DNA, 25 bp, Mus musculus
tcgagttgctttccggctgattcgt

SEQ ID NO: 779925 - DNA, 25 bp, Mus musculus
tcgagttgctttgcggctgattcgt

SEQ ID NO: 779926 - DNA, 25 bp, Mus musculus
tcgataacgggaagcagcgagagtt

SEQ ID NO: 779927 - DNA, 25 bp, Mus musculus
tcgataacgggatgcagcgagagtt

SEQ ID NO: 779928 - DNA, 25 bp, Mus musculus
tcgataagctctcgcgccagaagct

SEQ ID NO: 779929 - DNA, 25 bp, Mus musculus
tcgataagctctggcgccagaagct

SEQ ID NO: 779930 - DNA, 25 bp, Mus musculus
tcgataagggaacaggtgagtctaa

SEQ ID NO: 779931 - DNA, 25 bp, Mus musculus
tcgataagggaagaggtgagtctaa

SEQ ID NO: 779932 - DNA, 25 bp, Mus musculus
tcgataaggtgcacagagaaggcgc

SEQ ID NO: 779933 - DNA, 25 bp, Mus musculus
tcgataaggtgctcagagaaggcgc

SEQ ID NO: 779934 - DNA, 25 bp, Mus musculus
tcgataagtcctacatgaacccggg

SEQ ID NO: 779935 - DNA, 25 bp, Mus musculus
tcgataagtccttcatgaacccggg

SEQ ID NO: 779936 - DNA, 25 bp, Mus musculus
tcgataagtgccactatagcaacca

SEQ ID NO: 779937 - DNA, 25 bp, Mus musculus
tcgataagtgcctctatagcaacca

SEQ ID NO: 779938 - DNA, 25 bp, Mus musculus
tcgataatgccacagaactccaaga

SEQ ID NO: 779939 - DNA, 25 bp, Mus musculus
tcgataatgccagagaactccaaga

SEQ ID NO: 779940 - DNA, 25 bp, Mus musculus
tcgatacaaagacaattcccaaatg

SEQ ID NO: 779941 - DNA, 25 bp, Mus musculus
tcgatacaaagagaattcccaaatg

SEQ ID NO: 779942 - DNA, 25 bp, Mus musculus
tcgatacacgagagactgtgctggg

SEQ ID NO: 779943 - DNA, 25 bp, Mus musculus
tcgatacacgagtgactgtgctggg

SEQ ID NO: 779944 - DNA, 25 bp, Mus musculus
tcgataccgagtcggagagaagatc

SEQ ID NO: 779945 - DNA, 25 bp, Mus musculus
tcgataccgagtgggagagaagatc

SEQ ID NO: 779946 - DNA, 25 bp, Mus musculus
tcgataccgcccattaaaaccagat

SEQ ID NO: 779947 - DNA, 25 bp, Mus musculus
tcgataccgccctttaaaaccagat

SEQ ID NO: 779948 - DNA, 25 bp, Mus musculus
tcgatactggcccagacaacactga

SEQ ID NO: 779949 - DNA, 25 bp, Mus musculus
tcgatactggccctactgaaagtcc

SEQ ID NO: 779950 - DNA, 25 bp, Mus musculus
tcgatactggccgagacaacactga

SEQ ID NO: 779951 - DNA, 25 bp, Mus musculus
tcgatactggccgtactgaaagtcc

SEQ ID NO: 779952 - DNA, 25 bp, Mus musculus
tcgatagacattcgtagacacagcg

SEQ ID NO: 779953 - DNA, 25 bp, Mus musculus
tcgatagacattggtagacacagcg

SEQ ID NO: 779954 - DNA, 25 bp, Mus musculus
tcgataggaactatggaaccaagat

SEQ ID NO: 779955 - DNA, 25 bp, Mus musculus
tcgataggaactttggaaccaagat

SEQ ID NO: 779956 - DNA, 25 bp, Mus musculus
tcgataggcattccctacctgttgg

SEQ ID NO: 779957 - DNA, 25 bp, Mus musculus
tcgataggcattgcctacctgttgg

SEQ ID NO: 779958 - DNA, 25 bp, Mus musculus
tcgatatcaacaacaactttccgga

SEQ ID NO: 779959 - DNA, 25 bp, Mus musculus
tcgatatcaacatcaactttccgga

SEQ ID NO: 779960 - DNA, 25 bp, Mus musculus
tcgatatgctacacgagaagcggac

SEQ ID NO: 779961 - DNA, 25 bp, Mus musculus
tcgatatgctactcgagaagcggac

SEQ ID NO: 779962 - DNA, 25 bp, Mus musculus
tcgatatggctccattgcaggccta

SEQ ID NO: 779963 - DNA, 25 bp, Mus musculus
tcgatatggctcgattgcaggccta

SEQ ID NO: 779964 - DNA, 25 bp, Mus musculus
tcgatcacgtggacgttcggtgcta

SEQ ID NO: 779965 - DNA, 25 bp, Mus musculus
tcgatcacgtggtcgttcggtgcta

SEQ ID NO: 779966 - DNA, 25 bp, Mus musculus
tcgatcagaatgctctagtcaagcg

SEQ ID NO: 779967 - DNA, 25 bp, Mus musculus
tcgatcagaatggtctagtcaagcg

SEQ ID NO: 779968 - DNA, 25 bp, Mus musculus
tcgatcagcaagctgaacgtaatag

SEQ ID NO: 779969 - DNA, 25 bp, Mus musculus
tcgatcagcaaggtgaacgtaatag

SEQ ID NO: 779970 - DNA, 25 bp, Mus musculus
tcgatcagcagcagcttgctaactt

SEQ ID NO: 779971 - DNA, 25 bp, Mus musculus
tcgatcagcagctgcttgctaactt

SEQ ID NO: 779972 - DNA, 25 bp, Mus musculus
tcgatccagagtcaagacaacaggc

SEQ ID NO: 779973 - DNA, 25 bp, Mus musculus
tcgatccagagtgaagacaacaggc

SEQ ID NO: 779974 - DNA, 25 bp, Mus musculus
tcgatcccagtaagcctggaaaaat

SEQ ID NO: 779975 - DNA, 25 bp, Mus musculus
tcgatcccagtatgcctggaaaaat

SEQ ID NO: 779976 - DNA, 25 bp, Mus musculus
tcgatccttcatcaaacgcagcaag

SEQ ID NO: 779977 - DNA, 25 bp, Mus musculus
tcgatccttcatgaaacgcagcaag

SEQ ID NO: 779978 - DNA, 25 bp, Mus musculus
tcgatcgagaggcagccaggaactt

SEQ ID NO: 779979 - DNA, 25 bp, Mus musculus
tcgatcgagagggagccaggaactt

SEQ ID NO: 779980 - DNA, 25 bp, Mus musculus
tcgatcgcctggcaatgcagtatgc

SEQ ID NO: 779981 - DNA, 25 bp, Mus musculus
tcgatcgcctgggaatgcagtatgc

SEQ ID NO: 779982 - DNA, 25 bp, Mus musculus
tcgatcgcgtgccttccctggagac

SEQ ID NO: 779983 - DNA, 25 bp, Mus musculus
tcgatcgcgtgcgttccctggagac

SEQ ID NO: 779984 - DNA, 25 bp, Mus musculus
tcgatcgggtttccatattggcccc

SEQ ID NO: 779985 - DNA, 25 bp, Mus musculus
tcgatcgggtttgcatattggcccc

SEQ ID NO: 779986 - DNA, 25 bp, Mus musculus
tcgatctcatccaggagtttggcct

SEQ ID NO: 779987 - DNA, 25 bp, Mus musculus
tcgatctcatcctggagtttggcct

SEQ ID NO: 779988 - DNA, 25 bp, Mus musculus
tcgatgaagatgacaaccctgagga

SEQ ID NO: 779989 - DNA, 25 bp, Mus musculus
tcgatgaagatgtcaaccctgagga

SEQ ID NO: 779990 - DNA, 25 bp, Mus musculus
tcgatgaagccaatgctgaacttga

SEQ ID NO: 779991 - DNA, 25 bp, Mus musculus
tcgatgaagccattgctgaacttga

SEQ ID NO: 779992 - DNA, 25 bp, Mus musculus
tcgatgacaaaaatgatcactcacc

SEQ ID NO: 779993 - DNA, 25 bp, Mus musculus
tcgatgacaaaattgatcactcacc

SEQ ID NO: 779994 - DNA, 25 bp, Mus musculus
tcgatgacacagagttctgtgacag

SEQ ID NO: 779995 - DNA, 25 bp, Mus musculus
tcgatgacacagtgttctgtgacag

SEQ ID NO: 779996 - DNA, 25 bp, Mus musculus
tcgatgagagccaggctgtgcgcct

SEQ ID NO: 779997 - DNA, 25 bp, Mus musculus
tcgatgagagcctggctgtgcgcct

SEQ ID NO: 779998 - DNA, 25 bp, Mus musculus
tcgatgagcttgatgccattgcacc

SEQ ID NO: 779999 - DNA, 25 bp, Mus musculus
tcgatgagcttgttgccattgcacc

SEQ ID NO: 780000 - DNA, 25 bp, Mus musculus
tcgatgaggtgaaaagcccagagcc

SEQ ID NO: 780001 - DNA, 25 bp, Mus musculus
tcgatgaggtgataagcccagagcc

SEQ ID NO: 780002 - DNA, 25 bp, Mus musculus
tcgatgatcccaaatacagcaatga

SEQ ID NO: 780003 - DNA, 25 bp, Mus musculus
tcgatgatcccatatacagcaatga

SEQ ID NO: 780004 - DNA, 25 bp, Mus musculus
tcgatgatgcccagcaggaggacag

SEQ ID NO: 780005 - DNA, 25 bp, Mus musculus
tcgatgatgccctgcaggaggacag

SEQ ID NO: 780006 - DNA, 25 bp, Mus musculus
tcgatgatgtcacaaggaccaataa

SEQ ID NO: 780007 - DNA, 25 bp, Mus musculus
tcgatgatgtcagaaggaccaataa

SEQ ID NO: 780008 - DNA, 25 bp, Mus musculus
tcgatgcaaattcaaccaacagcag

SEQ ID NO: 780009 - DNA, 25 bp, Mus musculus
tcgatgcaaattgaaccaacagcag

SEQ ID NO: 780010 - DNA, 25 bp, Mus musculus
tcgatgcaatgacacaggcttctgc

SEQ ID NO: 780011 - DNA, 25 bp, Mus musculus
tcgatgcaatgagacaggcttctgc

SEQ ID NO: 780012 - DNA, 25 bp, Mus musculus
tcgatgcaatttagccccgacagag

SEQ ID NO: 780013 - DNA, 25 bp, Mus musculus
tcgatgcaattttgccccgacagag

SEQ ID NO: 780014 - DNA, 25 bp, Mus musculus
tcgatgcacgggaatggagtattaa

SEQ ID NO: 780015 - DNA, 25 bp, Mus musculus
tcgatgcacgggtatggagtattaa

SEQ ID NO: 780016 - DNA, 25 bp, Mus musculus
tcgatgcccaagacattcaagagga

SEQ ID NO: 780017 - DNA, 25 bp, Mus musculus
tcgatgcccaagtcattcaagagga

SEQ ID NO: 780018 - DNA, 25 bp, Mus musculus
tcgatgcccctgaacgggctgaagg

SEQ ID NO: 780019 - DNA, 25 bp, Mus musculus
tcgatgcccctgtacgggctgaagg

SEQ ID NO: 780020 - DNA, 25 bp, Mus musculus
tcgatgcgcagaaagggttcaacca

SEQ ID NO: 780021 - DNA, 25 bp, Mus musculus
tcgatgcgcagatagggttcaacca

SEQ ID NO: 780022 - DNA, 25 bp, Mus musculus
tcgatgctgcctacactcgcatcaa

SEQ ID NO: 780023 - DNA, 25 bp, Mus musculus
tcgatgctgccttcactcgcatcaa

SEQ ID NO: 780024 - DNA, 25 bp, Mus musculus
tcgatgcttcagatcgcccttcaag

SEQ ID NO: 780025 - DNA, 25 bp, Mus musculus
tcgatgcttcagttcgcccttcaag

SEQ ID NO: 780026 - DNA, 25 bp, Mus musculus
tcgatgctttagagttctacccggg

SEQ ID NO: 780027 - DNA, 25 bp, Mus musculus
tcgatgctttagtgttctacccggg

SEQ ID NO: 780028 - DNA, 25 bp, Mus musculus
tcgatggaaccaaggatgacagcac

SEQ ID NO: 780029 - DNA, 25 bp, Mus musculus
tcgatggaaccatggatgacagcac

SEQ ID NO: 780030 - DNA, 25 bp, Mus musculus
tcgatggaacggatacaggcacctc

SEQ ID NO: 780031 - DNA, 25 bp, Mus musculus
tcgatggaacggttacaggcacctc

SEQ ID NO: 780032 - DNA, 25 bp, Mus musculus
tcgatggcaaccaacacgggtggct

SEQ ID NO: 780033 - DNA, 25 bp, Mus musculus
tcgatggcaacctacacgggtggct

SEQ ID NO: 780034 - DNA, 25 bp, Mus musculus
tcgatggcggagaaggtcctgacac

SEQ ID NO: 780035 - DNA, 25 bp, Mus musculus
tcgatggcggagtaggtcctgacac

SEQ ID NO: 780036 - DNA, 25 bp, Mus musculus
tcgatggctgcccaccaaaatatgc

SEQ ID NO: 780037 - DNA, 25 bp, Mus musculus
tcgatggctgccgaccaaaatatgc

SEQ ID NO: 780038 - DNA, 25 bp, Mus musculus
tcgatggcttcaagttggctcatga

SEQ ID NO: 780039 - DNA, 25 bp, Mus musculus
tcgatggcttcatgttggctcatga

SEQ ID NO: 780040 - DNA, 25 bp, Mus musculus
tcgatgtcagcaacctcaacaggca

SEQ ID NO: 780041 - DNA, 25 bp, Mus musculus
tcgatgtcagcatcctcaacaggca

SEQ ID NO: 780042 - DNA, 25 bp, Mus musculus
tcgatgtccaccagtataaaaggaa

SEQ ID NO: 780043 - DNA, 25 bp, Mus musculus
tcgatgtccacctgtataaaaggaa

SEQ ID NO: 780044 - DNA, 25 bp, Mus musculus
tcgatgtcttttccctcaatgaggc

SEQ ID NO: 780045 - DNA, 25 bp, Mus musculus
tcgatgtcttttgcctcaatgaggc

SEQ ID NO: 780046 - DNA, 25 bp, Mus musculus
tcgatgtgacctataaaagtaccaa

SEQ ID NO: 780047 - DNA, 25 bp, Mus musculus
tcgatgtgacctttaaaagtaccaa

SEQ ID NO: 780048 - DNA, 25 bp, Mus musculus
tcgatgtgtactaggctaaaagtct

SEQ ID NO: 780049 - DNA, 25 bp, Mus musculus
tcgatgtgtacttggctaaaagtct

SEQ ID NO: 780050 - DNA, 25 bp, Mus musculus
tcgatgttctttacccgcacatgcc

SEQ ID NO: 780051 - DNA, 25 bp, Mus musculus
tcgatgttcttttcccgcacatgcc

SEQ ID NO: 780052 - DNA, 25 bp, Mus musculus
tcgattatcggcagcagagtgccgc

SEQ ID NO: 780053 - DNA, 25 bp, Mus musculus
tcgattatcggctgcagagtgccgc

SEQ ID NO: 780054 - DNA, 25 bp, Mus musculus
tcgattccacgaagagaagaagatc

SEQ ID NO: 780055 - DNA, 25 bp, Mus musculus
tcgattccacgatgagaagaagatc

SEQ ID NO: 780056 - DNA, 25 bp, Mus musculus
tcgattccaggtccctttccagctg

SEQ ID NO: 780057 - DNA, 25 bp, Mus musculus
tcgattccaggtgcctttccagctg

SEQ ID NO: 780058 - DNA, 25 bp, Mus musculus
tcgattccatcactggatgccaaca

SEQ ID NO: 780059 - DNA, 25 bp, Mus musculus
tcgattccatcagtggatgccaaca

SEQ ID NO: 780060 - DNA, 25 bp, Mus musculus
tcgattctactcatataagccccaa

SEQ ID NO: 780061 - DNA, 25 bp, Mus musculus
tcgattctactcttataagccccaa

SEQ ID NO: 780062 - DNA, 25 bp, Mus musculus
tcgattctagccactgaggcttggc

SEQ ID NO: 780063 - DNA, 25 bp, Mus musculus
tcgattctagcctctgaggcttggc

SEQ ID NO: 780064 - DNA, 25 bp, Mus musculus
tcgattctggaccttcgagacgggc

SEQ ID NO: 780065 - DNA, 25 bp, Mus musculus
tcgattctggacgttcgagacgggc

SEQ ID NO: 780066 - DNA, 25 bp, Mus musculus
tcgattgaacgtagaactcagtcgc

SEQ ID NO: 780067 - DNA, 25 bp, Mus musculus
tcgattgaacgttgaactcagtcgc

SEQ ID NO: 780068 - DNA, 25 bp, Mus musculus
tcgattggagttcgaggactcacag

SEQ ID NO: 780069 - DNA, 25 bp, Mus musculus
tcgattggagttggaggactcacag

SEQ ID NO: 780070 - DNA, 25 bp, Mus musculus
tcgattgtgatgaggtgatcttcat

SEQ ID NO: 780071 - DNA, 25 bp, Mus musculus
tcgattgtgatgtggtgatcttcat

SEQ ID NO: 780072 - DNA, 25 bp, Mus musculus
tcgatttaccaaatgaacaagcaag

SEQ ID NO: 780073 - DNA, 25 bp, Mus musculus
tcgatttaccaattgaacaagcaag

SEQ ID NO: 780074 - DNA, 25 bp, Mus musculus
tcgatttcaacgaacccccagtcag

SEQ ID NO: 780075 - DNA, 25 bp, Mus musculus
tcgatttcaacgtacccccagtcag

SEQ ID NO: 780076 - DNA, 25 bp, Mus musculus
tcgatttcctgactgcttatggtgc

SEQ ID NO: 780077 - DNA, 25 bp, Mus musculus
tcgatttcctgagtgcttatggtgc

SEQ ID NO: 780078 - DNA, 25 bp, Mus musculus
tcgcaaaaccccatcctgaagaaca

SEQ ID NO: 780079 - DNA, 25 bp, Mus musculus
tcgcaaaaccccttcctgaagaaca

SEQ ID NO: 780080 - DNA, 25 bp, Mus musculus
tcgcaaacggctcgaacatgtgtgg

SEQ ID NO: 780081 - DNA, 25 bp, Mus musculus
tcgcaaacggctggaacatgtgtgg

SEQ ID NO: 780082 - DNA, 25 bp, Mus musculus
tcgcaaagggctatgggaaaaacaa

SEQ ID NO: 780083 - DNA, 25 bp, Mus musculus
tcgcaaagggctttgggaaaaacaa

SEQ ID NO: 780084 - DNA, 25 bp, Mus musculus
tcgcaaataaccctgagtttatcac

SEQ ID NO: 780085 - DNA, 25 bp, Mus musculus
tcgcaaataaccgtgagtttatcac

SEQ ID NO: 780086 - DNA, 25 bp, Mus musculus
tcgcaacgagcgacataagccagag

SEQ ID NO: 780087 - DNA, 25 bp, Mus musculus
tcgcaacgagcgtcataagccagag

SEQ ID NO: 780088 - DNA, 25 bp, Mus musculus
tcgcaactaggacttgacaggtgtc

SEQ ID NO: 780089 - DNA, 25 bp, Mus musculus
tcgcaactaggagttgacaggtgtc

SEQ ID NO: 780090 - DNA, 25 bp, Mus musculus
tcgcaactgcagaggcgattcaagg

SEQ ID NO: 780091 - DNA, 25 bp, Mus musculus
tcgcaactgcagtggcgattcaagg

SEQ ID NO: 780092 - DNA, 25 bp, Mus musculus
tcgcaactgcttacaccgaagagct

SEQ ID NO: 780093 - DNA, 25 bp, Mus musculus
tcgcaactgctttcaccgaagagct

SEQ ID NO: 780094 - DNA, 25 bp, Mus musculus
tcgcaactttgaaacctgtgccaag

SEQ ID NO: 780095 - DNA, 25 bp, Mus musculus
tcgcaactttgatacctgtgccaag

SEQ ID NO: 780096 - DNA, 25 bp, Mus musculus
tcgcaagtggaccacagcaccatac

SEQ ID NO: 780097 - DNA, 25 bp, Mus musculus
tcgcaagtggacgacagcaccatac

SEQ ID NO: 780098 - DNA, 25 bp, Mus musculus
tcgcaatcataaagctgaacaccag

SEQ ID NO: 780099 - DNA, 25 bp, Mus musculus
tcgcaatcataatgctgaacaccag

SEQ ID NO: 780100 - DNA, 25 bp, Mus musculus
tcgcaatcatggagggtgatgcttt

SEQ ID NO: 780101 - DNA, 25 bp, Mus musculus
tcgcaatcatggtgggtgatgcttt

SEQ ID NO: 780102 - DNA, 25 bp, Mus musculus
tcgcaatcgaggcaaccgaggcagt

SEQ ID NO: 780103 - DNA, 25 bp, Mus musculus
tcgcaatcgagggaaccgaggcagt

SEQ ID NO: 780104 - DNA, 25 bp, Mus musculus
tcgcaatggcaacgtcatacccagt

SEQ ID NO: 780105 - DNA, 25 bp, Mus musculus
tcgcaatggcaaggtcatacccagt

SEQ ID NO: 780106 - DNA, 25 bp, Mus musculus
tcgcaatgggagcaactttgtaggc

SEQ ID NO: 780107 - DNA, 25 bp, Mus musculus
tcgcaatgggaggaactttgtaggc

SEQ ID NO: 780108 - DNA, 25 bp, Mus musculus
tcgcaatgtgtgacccactgcagct

SEQ ID NO: 780109 - DNA, 25 bp, Mus musculus
tcgcaatgtgtgtcccactgcagct

SEQ ID NO: 780110 - DNA, 25 bp, Mus musculus
tcgcaattaagaaccgggtggaaac

SEQ ID NO: 780111 - DNA, 25 bp, Mus musculus
tcgcaattaagatccgggtggaaac

SEQ ID NO: 780112 - DNA, 25 bp, Mus musculus
tcgcacaggctgatactcaggccca

SEQ ID NO: 780113 - DNA, 25 bp, Mus musculus
tcgcacaggctgttactcaggccca

SEQ ID NO: 780114 - DNA, 25 bp, Mus musculus
tcgcacatccagacctgttcgtgag

SEQ ID NO: 780115 - DNA, 25 bp, Mus musculus
tcgcacatccagtcctgttcgtgag

SEQ ID NO: 780116 - DNA, 25 bp, Mus musculus
tcgcacatcccaacagccaggagta

SEQ ID NO: 780117 - DNA, 25 bp, Mus musculus
tcgcacatcccatcagccaggagta

SEQ ID NO: 780118 - DNA, 25 bp, Mus musculus
tcgcacccaataagatgtatcccgt

SEQ ID NO: 780119 - DNA, 25 bp, Mus musculus
tcgcacccaatatgatgtatcccgt

SEQ ID NO: 780120 - DNA, 25 bp, Mus musculus
tcgcaccctaggcagcagctgtctg

SEQ ID NO: 780121 - DNA, 25 bp, Mus musculus
tcgcaccctagggagcagctgtctg

SEQ ID NO: 780122 - DNA, 25 bp, Mus musculus
tcgcacgacagtcggaagctctttg

SEQ ID NO: 780123 - DNA, 25 bp, Mus musculus
tcgcacgacagtgggaagctctttg

SEQ ID NO: 780124 - DNA, 25 bp, Mus musculus
tcgcacggaggacaattcgcctagg

SEQ ID NO: 780125 - DNA, 25 bp, Mus musculus
tcgcacggaggagaattcgcctagg

SEQ ID NO: 780126 - DNA, 25 bp, Mus musculus
tcgcacggcacaagtccaaaaagat

SEQ ID NO: 780127 - DNA, 25 bp, Mus musculus
tcgcacggcacatgtccaaaaagat

SEQ ID NO: 780128 - DNA, 25 bp, Mus musculus
tcgcacgtccacaccggtgcggagt

SEQ ID NO: 780129 - DNA, 25 bp, Mus musculus
tcgcacgtccactccggtgcggagt

SEQ ID NO: 780130 - DNA, 25 bp, Mus musculus
tcgcactgttgactctcggcaggcc

SEQ ID NO: 780131 - DNA, 25 bp, Mus musculus
tcgcactgttgagtctcggcaggcc

SEQ ID NO: 780132 - DNA, 25 bp, Mus musculus
tcgcacttccaccagttcatagcag

SEQ ID NO: 780133 - DNA, 25 bp, Mus musculus
tcgcacttccacgagttcatagcag

SEQ ID NO: 780134 - DNA, 25 bp, Mus musculus
tcgcagaagctaagaatggcacagt

SEQ ID NO: 780135 - DNA, 25 bp, Mus musculus
tcgcagaagctatgaatggcacagt

SEQ ID NO: 780136 - DNA, 25 bp, Mus musculus
tcgcagaaggttatcaagtgaggat

SEQ ID NO: 780137 - DNA, 25 bp, Mus musculus
tcgcagaaggttttcaagtgaggat

SEQ ID NO: 780138 - DNA, 25 bp, Mus musculus
tcgcagaatcctctagccaagttac

SEQ ID NO: 780139 - DNA, 25 bp, Mus musculus
tcgcagaatcctgtagccaagttac

SEQ ID NO: 780140 - DNA, 25 bp, Mus musculus
tcgcagacatggagcaaggctacgg

SEQ ID NO: 780141 - DNA, 25 bp, Mus musculus
tcgcagacatggtgcaaggctacgg

SEQ ID NO: 780142 - DNA, 25 bp, Mus musculus
tcgcagacctggaatccaaagagct

SEQ ID NO: 780143 - DNA, 25 bp, Mus musculus
tcgcagacctggtatccaaagagct

SEQ ID NO: 780144 - DNA, 25 bp, Mus musculus
tcgcagactttaaaccggaccatct

SEQ ID NO: 780145 - DNA, 25 bp, Mus musculus
tcgcagactttataccggaccatct

SEQ ID NO: 780146 - DNA, 25 bp, Mus musculus
tcgcagagacttatcccggacaaac

SEQ ID NO: 780147 - DNA, 25 bp, Mus musculus
tcgcagagacttttcccggacaaac

SEQ ID NO: 780148 - DNA, 25 bp, Mus musculus
tcgcagagcagaagcattcccatag

SEQ ID NO: 780149 - DNA, 25 bp, Mus musculus
tcgcagagcagatgcattcccatag

SEQ ID NO: 780150 - DNA, 25 bp, Mus musculus
tcgcagatgtttagcacatgaaccc

SEQ ID NO: 780151 - DNA, 25 bp, Mus musculus
tcgcagatgttttgcacatgaaccc

SEQ ID NO: 780152 - DNA, 25 bp, Mus musculus
tcgcagattccgagcaaagcgtgca

SEQ ID NO: 780153 - DNA, 25 bp, Mus musculus
tcgcagattccgtgcaaagcgtgca

SEQ ID NO: 780154 - DNA, 25 bp, Mus musculus
tcgcagatttccagctgcacaggct

SEQ ID NO: 780155 - DNA, 25 bp, Mus musculus
tcgcagatttcctgctgcacaggct

SEQ ID NO: 780156 - DNA, 25 bp, Mus musculus
tcgcagcagtcgagccagccttctt

SEQ ID NO: 780157 - DNA, 25 bp, Mus musculus
tcgcagcagtcgtgccagccttctt

SEQ ID NO: 780158 - DNA, 25 bp, Mus musculus
tcgcagcccaagaaggtacggcaga

SEQ ID NO: 780159 - DNA, 25 bp, Mus musculus
tcgcagcccaagtaggtacggcaga

SEQ ID NO: 780160 - DNA, 25 bp, Mus musculus
tcgcagcccttgcacctagtggaga

SEQ ID NO: 780161 - DNA, 25 bp, Mus musculus
tcgcagcccttggacctagtggaga

SEQ ID NO: 780162 - DNA, 25 bp, Mus musculus
tcgcagccgacaagtctctggtggc

SEQ ID NO: 780163 - DNA, 25 bp, Mus musculus
tcgcagccgacatgtctctggtggc

SEQ ID NO: 780164 - DNA, 25 bp, Mus musculus
tcgcagccgtagagaggtcagcatg

SEQ ID NO: 780165 - DNA, 25 bp, Mus musculus
tcgcagccgtagtgaggtcagcatg

SEQ ID NO: 780166 - DNA, 25 bp, Mus musculus
tcgcagctgcacctcatgtacgtgg

SEQ ID NO: 780167 - DNA, 25 bp, Mus musculus
tcgcagctgcacgtcatgtacgtgg

SEQ ID NO: 780168 - DNA, 25 bp, Mus musculus
tcgcagctgtgacagacatcctggc

SEQ ID NO: 780169 - DNA, 25 bp, Mus musculus
tcgcagctgtgagagacatcctggc

SEQ ID NO: 780170 - DNA, 25 bp, Mus musculus
tcgcagctgttgcacttggatggtt

SEQ ID NO: 780171 - DNA, 25 bp, Mus musculus
tcgcagctgttggacttggatggtt

SEQ ID NO: 780172 - DNA, 25 bp, Mus musculus
tcgcaggacaagcatgagtattaca

SEQ ID NO: 780173 - DNA, 25 bp, Mus musculus
tcgcaggacaaggatgagtattaca

SEQ ID NO: 780174 - DNA, 25 bp, Mus musculus
tcgcagggcatgaccccaaggccat

SEQ ID NO: 780175 - DNA, 25 bp, Mus musculus
tcgcagggcatgtccccaaggccat

SEQ ID NO: 780176 - DNA, 25 bp, Mus musculus
tcgcagggctcgctggacctaagca

SEQ ID NO: 780177 - DNA, 25 bp, Mus musculus
tcgcagggctcggtggacctaagca

SEQ ID NO: 780178 - DNA, 25 bp, Mus musculus
tcgcagggtaccaaggtattggttt

SEQ ID NO: 780179 - DNA, 25 bp, Mus musculus
tcgcagggtacctaggtattggttt

SEQ ID NO: 780180 - DNA, 25 bp, Mus musculus
tcgcagggtggaaagacaatctgcc

SEQ ID NO: 780181 - DNA, 25 bp, Mus musculus
tcgcagggtggatagacaatctgcc

SEQ ID NO: 780182 - DNA, 25 bp, Mus musculus
tcgcaggtaattctcatatcttgat

SEQ ID NO: 780183 - DNA, 25 bp, Mus musculus
tcgcaggtaattgtcatatcttgat

SEQ ID NO: 780184 - DNA, 25 bp, Mus musculus
tcgcaggtatcgaggcgtcgcccgc

SEQ ID NO: 780185 - DNA, 25 bp, Mus musculus
tcgcaggtatcgtggcgtcgcccgc

SEQ ID NO: 780186 - DNA, 25 bp, Mus musculus
tcgcaggtggcgacacgggtcctct

SEQ ID NO: 780187 - DNA, 25 bp, Mus musculus
tcgcaggtggcgtcacgggtcctct

SEQ ID NO: 780188 - DNA, 25 bp, Mus musculus
tcgcagtcagggagaggcttaaaat

SEQ ID NO: 780189 - DNA, 25 bp, Mus musculus
tcgcagtcagggtgaggcttaaaat

SEQ ID NO: 780190 - DNA, 25 bp, Mus musculus
tcgcagtcttgcagcgtctccgcgg

SEQ ID NO: 780191 - DNA, 25 bp, Mus musculus
tcgcagtcttgctgcgtctccgcgg

SEQ ID NO: 780192 - DNA, 25 bp, Mus musculus
tcgcagtgtggcagtcttcgccgtg

SEQ ID NO: 780193 - DNA, 25 bp, Mus musculus
tcgcagtgtggctgtcttcgccgtg

SEQ ID NO: 780194 - DNA, 25 bp, Mus musculus
tcgcagttccagcttttggttgctg

SEQ ID NO: 780195 - DNA, 25 bp, Mus musculus
tcgcagttccaggttttggttgctg

SEQ ID NO: 780196 - DNA, 25 bp, Mus musculus
tcgcagttgccaatagaatcagttc

SEQ ID NO: 780197 - DNA, 25 bp, Mus musculus
tcgcagttgccattagaatcagttc

SEQ ID NO: 780198 - DNA, 25 bp, Mus musculus
tcgcagttttttccccgggccatct

SEQ ID NO: 780199 - DNA, 25 bp, Mus musculus
tcgcagttttttgcccgggccatct

SEQ ID NO: 780200 - DNA, 25 bp, Mus musculus
tcgcatagtggtccttgccaagcca

SEQ ID NO: 780201 - DNA, 25 bp, Mus musculus
tcgcatagtggtgcttgccaagcca

SEQ ID NO: 780202 - DNA, 25 bp, Mus musculus
tcgcatcaacagctttgaggagcgt

SEQ ID NO: 780203 - DNA, 25 bp, Mus musculus
tcgcatcaacaggtttgaggagcgt

SEQ ID NO: 780204 - DNA, 25 bp, Mus musculus
tcgcatcagaccaacggaggcagct

SEQ ID NO: 780205 - DNA, 25 bp, Mus musculus
tcgcatcagacctacggaggcagct

SEQ ID NO: 780206 - DNA, 25 bp, Mus musculus
tcgcatccctgaacctcaacagtgg

SEQ ID NO: 780207 - DNA, 25 bp, Mus musculus
tcgcatccctgatcctcaacagtgg

SEQ ID NO: 780208 - DNA, 25 bp, Mus musculus
tcgcatcctgtgcaactctggtcag

SEQ ID NO: 780209 - DNA, 25 bp, Mus musculus
tcgcatcctgtggaactctggtcag

SEQ ID NO: 780210 - DNA, 25 bp, Mus musculus
tcgcatcgatgtcgccggcatgaag

SEQ ID NO: 780211 - DNA, 25 bp, Mus musculus
tcgcatcgatgtggccggcatgaag

SEQ ID NO: 780212 - DNA, 25 bp, Mus musculus
tcgcatcgcggacatacacgaaagc

SEQ ID NO: 780213 - DNA, 25 bp, Mus musculus
tcgcatcgcggagatacacgaaagc

SEQ ID NO: 780214 - DNA, 25 bp, Mus musculus
tcgcatctggagaccgtggtacagc

SEQ ID NO: 780215 - DNA, 25 bp, Mus musculus
tcgcatctggagtccgtggtacagc

SEQ ID NO: 780216 - DNA, 25 bp, Mus musculus
tcgcatgcacctctgtcggacatgg

SEQ ID NO: 780217 - DNA, 25 bp, Mus musculus
tcgcatgcacctgtgtcggacatgg

SEQ ID NO: 780218 - DNA, 25 bp, Mus musculus
tcgcatgctggtcaagcctttgcca

SEQ ID NO: 780219 - DNA, 25 bp, Mus musculus
tcgcatgctggtgaagcctttgcca

SEQ ID NO: 780220 - DNA, 25 bp, Mus musculus
tcgcattaatgtagggaggctgctg

SEQ ID NO: 780221 - DNA, 25 bp, Mus musculus
tcgcattaatgttgggaggctgctg

SEQ ID NO: 780222 - DNA, 25 bp, Mus musculus
tcgcattgaagaccctcagctatgg

SEQ ID NO: 780223 - DNA, 25 bp, Mus musculus
tcgcattgaagagcctcagctatgg

SEQ ID NO: 780224 - DNA, 25 bp, Mus musculus
tcgccaaagcctctgacgagggcca

SEQ ID NO: 780225 - DNA, 25 bp, Mus musculus
tcgccaaagcctgtgacgagggcca

SEQ ID NO: 780226 - DNA, 25 bp, Mus musculus
tcgccaaatggtactggaggcccct

SEQ ID NO: 780227 - DNA, 25 bp, Mus musculus
tcgccaaatggttctggaggcccct

SEQ ID NO: 780228 - DNA, 25 bp, Mus musculus
tcgccaagaagaacaatatcccgtt

SEQ ID NO: 780229 - DNA, 25 bp, Mus musculus
tcgccaagaagatcaatatcccgtt

SEQ ID NO: 780230 - DNA, 25 bp, Mus musculus
tcgccaagcgatcagggcgctcttc

SEQ ID NO: 780231 - DNA, 25 bp, Mus musculus
tcgccaagcgatgagggcgctcttc

SEQ ID NO: 780232 - DNA, 25 bp, Mus musculus
tcgccaagcttgcatatgacccata

SEQ ID NO: 780233 - DNA, 25 bp, Mus musculus
tcgccaagcttggatatgacccata

SEQ ID NO: 780234 - DNA, 25 bp, Mus musculus
tcgccaaggaagagctgccccagta

SEQ ID NO: 780235 - DNA, 25 bp, Mus musculus
tcgccaaggaagtgctgccccagta

SEQ ID NO: 780236 - DNA, 25 bp, Mus musculus
tcgccaaggatgagaagcagttcta

SEQ ID NO: 780237 - DNA, 25 bp, Mus musculus
tcgccaaggatgcaaacacctgact

SEQ ID NO: 780238 - DNA, 25 bp, Mus musculus
tcgccaaggatggaaacacctgact

SEQ ID NO: 780239 - DNA, 25 bp, Mus musculus
tcgccaaggatgtgaagcagttcta

SEQ ID NO: 780240 - DNA, 25 bp, Mus musculus
tcgccaaggcagaaaagctgtccct

SEQ ID NO: 780241 - DNA, 25 bp, Mus musculus
tcgccaaggcagtaaagctgtccct

SEQ ID NO: 780242 - DNA, 25 bp, Mus musculus
tcgccaagggctagcagaacacctt

SEQ ID NO: 780243 - DNA, 25 bp, Mus musculus
tcgccaagggcttgcagaacacctt

SEQ ID NO: 780244 - DNA, 25 bp, Mus musculus
tcgccaagttttacgaagacaatgg

SEQ ID NO: 780245 - DNA, 25 bp, Mus musculus
tcgccaagtttttcgaagacaatgg

SEQ ID NO: 780246 - DNA, 25 bp, Mus musculus
tcgccacaaacgcatatgtcagagg

SEQ ID NO: 780247 - DNA, 25 bp, Mus musculus
tcgccacaaacggatatgtcagagg

SEQ ID NO: 780248 - DNA, 25 bp, Mus musculus
tcgccacctcggaggctaaggtgcc

SEQ ID NO: 780249 - DNA, 25 bp, Mus musculus
tcgccacctcggtggctaaggtgcc

SEQ ID NO: 780250 - DNA, 25 bp, Mus musculus
tcgccacggcttccctgtgggcaag

SEQ ID NO: 780251 - DNA, 25 bp, Mus musculus
tcgccacggcttgcctgtgggcaag

SEQ ID NO: 780252 - DNA, 25 bp, Mus musculus
tcgccactagccctgaagcatggac

SEQ ID NO: 780253 - DNA, 25 bp, Mus musculus
tcgccactagccgtgaagcatggac

SEQ ID NO: 780254 - DNA, 25 bp, Mus musculus
tcgccactgaatagaagaacaacag

SEQ ID NO: 780255 - DNA, 25 bp, Mus musculus
tcgccactgaattgaagaacaacag

SEQ ID NO: 780256 - DNA, 25 bp, Mus musculus
tcgccagaaccgagcagacgatggg

SEQ ID NO: 780257 - DNA, 25 bp, Mus musculus
tcgccagaaccgtgcagacgatggg

SEQ ID NO: 780258 - DNA, 25 bp, Mus musculus
tcgccagaagataggaagagaattc

SEQ ID NO: 780259 - DNA, 25 bp, Mus musculus
tcgccagaagattggaagagaattc

SEQ ID NO: 780260 - DNA, 25 bp, Mus musculus
tcgccagaattaaacctcacacaag

SEQ ID NO: 780261 - DNA, 25 bp, Mus musculus
tcgccagaattatacctcacacaag

SEQ ID NO: 780262 - DNA, 25 bp, Mus musculus
tcgccagagggcacgaaggattcgt

SEQ ID NO: 780263 - DNA, 25 bp, Mus musculus
tcgccagagggctcgaaggattcgt

SEQ ID NO: 780264 - DNA, 25 bp, Mus musculus
tcgccagcacgaagagttcatcagg

SEQ ID NO: 780265 - DNA, 25 bp, Mus musculus
tcgccagcacgatgagttcatcagg

SEQ ID NO: 780266 - DNA, 25 bp, Mus musculus
tcgccagcggctagatccgtcagaa

SEQ ID NO: 780267 - DNA, 25 bp, Mus musculus
tcgccagcggcttgatccgtcagaa

SEQ ID NO: 780268 - DNA, 25 bp, Mus musculus
tcgccagctccgaggcagaaagtgc

SEQ ID NO: 780269 - DNA, 25 bp, Mus musculus
tcgccagctccgtggcagaaagtgc

SEQ ID NO: 780270 - DNA, 25 bp, Mus musculus
tcgccaggactacatatcacttttt

SEQ ID NO: 780271 - DNA, 25 bp, Mus musculus
tcgccaggactagatatcacttttt

SEQ ID NO: 780272 - DNA, 25 bp, Mus musculus
tcgccaggcccgacggagcctgaga

SEQ ID NO: 780273 - DNA, 25 bp, Mus musculus
tcgccaggcccgtcggagcctgaga

SEQ ID NO: 780274 - DNA, 25 bp, Mus musculus
tcgccagggctgacaggaagtccag

SEQ ID NO: 780275 - DNA, 25 bp, Mus musculus
tcgccagggctgtcaggaagtccag

SEQ ID NO: 780276 - DNA, 25 bp, Mus musculus
tcgccaggtagcaaagagggtaaca

SEQ ID NO: 780277 - DNA, 25 bp, Mus musculus
tcgccaggtagctaagagggtaaca

SEQ ID NO: 780278 - DNA, 25 bp, Mus musculus
tcgccaggttacctggcagagccag

SEQ ID NO: 780279 - DNA, 25 bp, Mus musculus
tcgccaggttacgtggcagagccag

SEQ ID NO: 780280 - DNA, 25 bp, Mus musculus
tcgccaggttagcacgaaggactgt

SEQ ID NO: 780281 - DNA, 25 bp, Mus musculus
tcgccaggttaggacgaaggactgt

SEQ ID NO: 780282 - DNA, 25 bp, Mus musculus
tcgccagtgatgcttctagtgttaa

SEQ ID NO: 780283 - DNA, 25 bp, Mus musculus
tcgccagtgatggttctagtgttaa

SEQ ID NO: 780284 - DNA, 25 bp, Mus musculus
tcgccagtgggcaaacctgatggag

SEQ ID NO: 780285 - DNA, 25 bp, Mus musculus
tcgccagtgggctaacctgatggag

SEQ ID NO: 780286 - DNA, 25 bp, Mus musculus
tcgccagtggtgagttcccggaagc

SEQ ID NO: 780287 - DNA, 25 bp, Mus musculus
tcgccagtggtgtgttcccggaagc

SEQ ID NO: 780288 - DNA, 25 bp, Mus musculus
tcgccatagacccagagttgcgtgg

SEQ ID NO: 780289 - DNA, 25 bp, Mus musculus
tcgccatagaccgagagttgcgtgg

SEQ ID NO: 780290 - DNA, 25 bp, Mus musculus
tcgccatcaaggacatcctgaagcc

SEQ ID NO: 780291 - DNA, 25 bp, Mus musculus
tcgccatcaaggtcatcctgaagcc

SEQ ID NO: 780292 - DNA, 25 bp, Mus musculus
tcgccatccaggcagaggaaatcat

SEQ ID NO: 780293 - DNA, 25 bp, Mus musculus
tcgccatccagggagaggaaatcat

SEQ ID NO: 780294 - DNA, 25 bp, Mus musculus
tcgccatccttgctgctggagtcct

SEQ ID NO: 780295 - DNA, 25 bp, Mus musculus
tcgccatccttggtgctggagtcct

SEQ ID NO: 780296 - DNA, 25 bp, Mus musculus
tcgccatcgagaaggcctcgggagt

SEQ ID NO: 780297 - DNA, 25 bp, Mus musculus
tcgccatcgagatggcctcgggagt

SEQ ID NO: 780298 - DNA, 25 bp, Mus musculus
tcgccatgatggactacccgtatcc

SEQ ID NO: 780299 - DNA, 25 bp, Mus musculus
tcgccatgatggtctacccgtatcc

SEQ ID NO: 780300 - DNA, 25 bp, Mus musculus
tcgccatggcggctagcagctcgct

SEQ ID NO: 780301 - DNA, 25 bp, Mus musculus
tcgccatggcgggtagcagctcgct

SEQ ID NO: 780302 - DNA, 25 bp, Mus musculus
tcgccatgtcatatgtcccagccag

SEQ ID NO: 780303 - DNA, 25 bp, Mus musculus
tcgccatgtcatttgtcccagccag

SEQ ID NO: 780304 - DNA, 25 bp, Mus musculus
tcgccatgtttgagctctggaggcc

SEQ ID NO: 780305 - DNA, 25 bp, Mus musculus
tcgccatgtttgtgctctggaggcc

SEQ ID NO: 780306 - DNA, 25 bp, Mus musculus
tcgccattgccaacgaatgctatcg

SEQ ID NO: 780307 - DNA, 25 bp, Mus musculus
tcgccattgccatcgaatgctatcg

SEQ ID NO: 780308 - DNA, 25 bp, Mus musculus
tcgcccaagctcagaggtcatcaaa

SEQ ID NO: 780309 - DNA, 25 bp, Mus musculus
tcgcccaagctctgaggtcatcaaa

SEQ ID NO: 780310 - DNA, 25 bp, Mus musculus
tcgcccacagcaagggcaacgtgta

SEQ ID NO: 780311 - DNA, 25 bp, Mus musculus
tcgcccacagcatgggcaacgtgta

SEQ ID NO: 780312 - DNA, 25 bp, Mus musculus
tcgcccacggataagcacacgctgg

SEQ ID NO: 780313 - DNA, 25 bp, Mus musculus
tcgcccacggattagcacacgctgg

SEQ ID NO: 780314 - DNA, 25 bp, Mus musculus
tcgcccaggacaaggttctgtacca

SEQ ID NO: 780315 - DNA, 25 bp, Mus musculus
tcgcccaggacatggttctgtacca

SEQ ID NO: 780316 - DNA, 25 bp, Mus musculus
tcgcccaggtccattgcctgattcg

SEQ ID NO: 780317 - DNA, 25 bp, Mus musculus
tcgcccaggtcctttgcctgattcg

SEQ ID NO: 780318 - DNA, 25 bp, Mus musculus
tcgcccgaggagagcagaaaatcct

SEQ ID NO: 780319 - DNA, 25 bp, Mus musculus
tcgcccgaggagtgcagaaaatcct

SEQ ID NO: 780320 - DNA, 25 bp, Mus musculus
tcgcccgcggcgcttagttaggact

SEQ ID NO: 780321 - DNA, 25 bp, Mus musculus
tcgcccgcggcggttagttaggact

SEQ ID NO: 780322 - DNA, 25 bp, Mus musculus
tcgcccgctgcaccattgtgaacat

SEQ ID NO: 780323 - DNA, 25 bp, Mus musculus
tcgcccgctgcagcattgtgaacat

SEQ ID NO: 780324 - DNA, 25 bp, Mus musculus
tcgcccgggaaaacctggactccag

SEQ ID NO: 780325 - DNA, 25 bp, Mus musculus
tcgcccgggaaatcctggactccag

SEQ ID NO: 780326 - DNA, 25 bp, Mus musculus
tcgcccgggagcatgttacattgac

SEQ ID NO: 780327 - DNA, 25 bp, Mus musculus
tcgcccgggagcttgttacattgac

SEQ ID NO: 780328 - DNA, 25 bp, Mus musculus
tcgcccgggcatatgcagagggaat

SEQ ID NO: 780329 - DNA, 25 bp, Mus musculus
tcgcccgggcatttgcagagggaat

SEQ ID NO: 780330 - DNA, 25 bp, Mus musculus
tcgcccgtctggatcatctacagtc

SEQ ID NO: 780331 - DNA, 25 bp, Mus musculus
tcgcccgtctggttcatctacagtc

SEQ ID NO: 780332 - DNA, 25 bp, Mus musculus
tcgccctcatcgagagcgggatgaa

SEQ ID NO: 780333 - DNA, 25 bp, Mus musculus
tcgccctcatcgtgagcgggatgaa

SEQ ID NO: 780334 - DNA, 25 bp, Mus musculus
tcgccctccgggaagcggtgatgct

SEQ ID NO: 780335 - DNA, 25 bp, Mus musculus
tcgccctccgggtagcggtgatgct

SEQ ID NO: 780336 - DNA, 25 bp, Mus musculus
tcgccctcctatcgtgtgagcttct

SEQ ID NO: 780337 - DNA, 25 bp, Mus musculus
tcgccctcctatggtgtgagcttct

SEQ ID NO: 780338 - DNA, 25 bp, Mus musculus
tcgccctctcggctgcgaaggtaca

SEQ ID NO: 780339 - DNA, 25 bp, Mus musculus
tcgccctctcgggtgcgaaggtaca

SEQ ID NO: 780340 - DNA, 25 bp, Mus musculus
tcgccctctctgaatcccagggttt

SEQ ID NO: 780341 - DNA, 25 bp, Mus musculus
tcgccctctctgtatcccagggttt

SEQ ID NO: 780342 - DNA, 25 bp, Mus musculus
tcgccctgctgtcccgtgtgcgaaa

SEQ ID NO: 780343 - DNA, 25 bp, Mus musculus
tcgccctgctgtgccgtgtgcgaaa

SEQ ID NO: 780344 - DNA, 25 bp, Mus musculus
tcgccgaagaagaaatggattcaaa

SEQ ID NO: 780345 - DNA, 25 bp, Mus musculus
tcgccgaagaagtaatggattcaaa

SEQ ID NO: 780346 - DNA, 25 bp, Mus musculus
tcgccgatgagcacaccgactatgt

SEQ ID NO: 780347 - DNA, 25 bp, Mus musculus
tcgccgatgagctcaccgactatgt

SEQ ID NO: 780348 - DNA, 25 bp, Mus musculus
tcgccgcactagagccagtgaatgt

SEQ ID NO: 780349 - DNA, 25 bp, Mus musculus
tcgccgcactagtgccagtgaatgt

SEQ ID NO: 780350 - DNA, 25 bp, Mus musculus
tcgccgcccagtacagcagagctgg

SEQ ID NO: 780351 - DNA, 25 bp, Mus musculus
tcgccgcccagttcagcagagctgg

SEQ ID NO: 780352 - DNA, 25 bp, Mus musculus
tcgccgccgggcaatcactgacgtg

SEQ ID NO: 780353 - DNA, 25 bp, Mus musculus
tcgccgccgggctatcactgacgtg

SEQ ID NO: 780354 - DNA, 25 bp, Mus musculus
tcgccgccttagaaggaaggaagat

SEQ ID NO: 780355 - DNA, 25 bp, Mus musculus
tcgccgccttagtaggaaggaagat

SEQ ID NO: 780356 - DNA, 25 bp, Mus musculus
tcgccgcggagcaggtttccgctga

SEQ ID NO: 780357 - DNA, 25 bp, Mus musculus
tcgccgcggagctggtttccgctga

SEQ ID NO: 780358 - DNA, 25 bp, Mus musculus
tcgccgcgtctcaggtcccgggaaa

SEQ ID NO: 780359 - DNA, 25 bp, Mus musculus
tcgccgcgtctctggtcccgggaaa

SEQ ID NO: 780360 - DNA, 25 bp, Mus musculus
tcgccgctggccaagattggtattg

SEQ ID NO: 780361 - DNA, 25 bp, Mus musculus
tcgccgctggcctagattggtattg

SEQ ID NO: 780362 - DNA, 25 bp, Mus musculus
tcgccggagaaactggaagattaca

SEQ ID NO: 780363 - DNA, 25 bp, Mus musculus
tcgccggagaaagtggaagattaca

SEQ ID NO: 780364 - DNA, 25 bp, Mus musculus
tcgccgggaactcagcattgctgtc

SEQ ID NO: 780365 - DNA, 25 bp, Mus musculus
tcgccgggaactgagcattgctgtc

SEQ ID NO: 780366 - DNA, 25 bp, Mus musculus
tcgccgtcctggactaaggcagagt

SEQ ID NO: 780367 - DNA, 25 bp, Mus musculus
tcgccgtcctggtctaaggcagagt

SEQ ID NO: 780368 - DNA, 25 bp, Mus musculus
tcgcctacagtgacgaagtacggaa

SEQ ID NO: 780369 - DNA, 25 bp, Mus musculus
tcgcctacagtgtcgaagtacggaa

SEQ ID NO: 780370 - DNA, 25 bp, Mus musculus
tcgcctactaccaggtccgcaaagg

SEQ ID NO: 780371 - DNA, 25 bp, Mus musculus
tcgcctactacctggtccgcaaagg

SEQ ID NO: 780372 - DNA, 25 bp, Mus musculus
tcgcctcaagctctatttacctaag

SEQ ID NO: 780373 - DNA, 25 bp, Mus musculus
tcgcctcaagctgtatttacctaag

SEQ ID NO: 780374 - DNA, 25 bp, Mus musculus
tcgcctcatcaaaccaaaggtcatg

SEQ ID NO: 780375 - DNA, 25 bp, Mus musculus
tcgcctcatcaatccaaaggtcatg

SEQ ID NO: 780376 - DNA, 25 bp, Mus musculus
tcgcctcccaccagaagtaaatcgg

SEQ ID NO: 780377 - DNA, 25 bp, Mus musculus
tcgcctcccacctgaagtaaatcgg

SEQ ID NO: 780378 - DNA, 25 bp, Mus musculus
tcgcctcctgaacaacatgagctgc

SEQ ID NO: 780379 - DNA, 25 bp, Mus musculus
tcgcctcctgaagaacatgagctgc

SEQ ID NO: 780380 - DNA, 25 bp, Mus musculus
tcgcctcctttcctgagggagtgaa

SEQ ID NO: 780381 - DNA, 25 bp, Mus musculus
tcgcctcctttcgtgagggagtgaa

SEQ ID NO: 780382 - DNA, 25 bp, Mus musculus
tcgcctcgacccaataaatacaact

SEQ ID NO: 780383 - DNA, 25 bp, Mus musculus
tcgcctcgaccctataaatacaact

SEQ ID NO: 780384 - DNA, 25 bp, Mus musculus
tcgcctctaatcaacataggatggg

SEQ ID NO: 780385 - DNA, 25 bp, Mus musculus
tcgcctctaatctacataggatggg

SEQ ID NO: 780386 - DNA, 25 bp, Mus musculus
tcgcctgcaaatcaggacgctcagc

SEQ ID NO: 780387 - DNA, 25 bp, Mus musculus
tcgcctgcaaatgaggacgctcagc

SEQ ID NO: 780388 - DNA, 25 bp, Mus musculus
tcgcctgccactaaagcggagattt

SEQ ID NO: 780389 - DNA, 25 bp, Mus musculus
tcgcctgccacttaagcggagattt

SEQ ID NO: 780390 - DNA, 25 bp, Mus musculus
tcgcctgccccaagggctgtgtgtt

SEQ ID NO: 780391 - DNA, 25 bp, Mus musculus
tcgcctgccccatgggctgtgtgtt

SEQ ID NO: 780392 - DNA, 25 bp, Mus musculus
tcgcctgcctggctggaaattgctc

SEQ ID NO: 780393 - DNA, 25 bp, Mus musculus
tcgcctgcctgggtggaaattgctc

SEQ ID NO: 780394 - DNA, 25 bp, Mus musculus
tcgcctgcttgtagtgggcactgct

SEQ ID NO: 780395 - DNA, 25 bp, Mus musculus
tcgcctgcttgttgtgggcactgct

SEQ ID NO: 780396 - DNA, 25 bp, Mus musculus
tcgcctggagtgacacagtcctgca

SEQ ID NO: 780397 - DNA, 25 bp, Mus musculus
tcgcctggagtgtcacagtcctgca

SEQ ID NO: 780398 - DNA, 25 bp, Mus musculus
tcgcctgtctgcctctgtgacaaat

SEQ ID NO: 780399 - DNA, 25 bp, Mus musculus
tcgcctgtctgcgtctgtgacaaat

SEQ ID NO: 780400 - DNA, 25 bp, Mus musculus
tcgcctgtttgcagtacagagacag

SEQ ID NO: 780401 - DNA, 25 bp, Mus musculus
tcgcctgtttgctgtacagagacag

SEQ ID NO: 780402 - DNA, 25 bp, Mus musculus
tcgccttcacctccaggtcaaagaa

SEQ ID NO: 780403 - DNA, 25 bp, Mus musculus
tcgccttcacctgcaggtcaaagaa

SEQ ID NO: 780404 - DNA, 25 bp, Mus musculus
tcgccttcgcctactaacgtttgtg

SEQ ID NO: 780405 - DNA, 25 bp, Mus musculus
tcgccttcgccttctaacgtttgtg

SEQ ID NO: 780406 - DNA, 25 bp, Mus musculus
tcgccttcggcaactgagagagaaa

SEQ ID NO: 780407 - DNA, 25 bp, Mus musculus
tcgccttcggcatctgagagagaaa

SEQ ID NO: 780408 - DNA, 25 bp, Mus musculus
tcgccttgaagtctgctgacatttg

SEQ ID NO: 780409 - DNA, 25 bp, Mus musculus
tcgccttgaagtgtgctgacatttg

SEQ ID NO: 780410 - DNA, 25 bp, Mus musculus
tcgccttgagcgcttatgacttggt

SEQ ID NO: 780411 - DNA, 25 bp, Mus musculus
tcgccttgagcggttatgacttggt

SEQ ID NO: 780412 - DNA, 25 bp, Mus musculus
tcgccttgcctgctgcttataaact

SEQ ID NO: 780413 - DNA, 25 bp, Mus musculus
tcgccttgcctggtgcttataaact

SEQ ID NO: 780414 - DNA, 25 bp, Mus musculus
tcgccttggcctcagatacaataga

SEQ ID NO: 780415 - DNA, 25 bp, Mus musculus
tcgccttggcctgagatacaataga

SEQ ID NO: 780416 - DNA, 25 bp, Mus musculus
tcgccttggcgtagtgcggaatcaa

SEQ ID NO: 780417 - DNA, 25 bp, Mus musculus
tcgccttggcgttgtgcggaatcaa

SEQ ID NO: 780418 - DNA, 25 bp, Mus musculus
tcgccttgtgcaaacgcaaagactg

SEQ ID NO: 780419 - DNA, 25 bp, Mus musculus
tcgccttgtgcatacgcaaagactg

SEQ ID NO: 780420 - DNA, 25 bp, Mus musculus
tcgccttgttccaagggctctccaa

SEQ ID NO: 780421 - DNA, 25 bp, Mus musculus
tcgccttgttcctagggctctccaa

SEQ ID NO: 780422 - DNA, 25 bp, Mus musculus
tcgccttttgatcttggctcgatgc

SEQ ID NO: 780423 - DNA, 25 bp, Mus musculus
tcgccttttgatgttggctcgatgc

SEQ ID NO: 780424 - DNA, 25 bp, Mus musculus
tcgcgaacaaagcagcccgcgtgtg

SEQ ID NO: 780425 - DNA, 25 bp, Mus musculus
tcgcgaacaaaggagcccgcgtgtg

SEQ ID NO: 780426 - DNA, 25 bp, Mus musculus
tcgcgaaccgagaagcgtttagtac

SEQ ID NO: 780427 - DNA, 25 bp, Mus musculus
tcgcgaaccgagtagcgtttagtac

SEQ ID NO: 780428 - DNA, 25 bp, Mus musculus
tcgcgacatacccaaaaccatttgt

SEQ ID NO: 780429 - DNA, 25 bp, Mus musculus
tcgcgacataccgaaaaccatttgt

SEQ ID NO: 780430 - DNA, 25 bp, Mus musculus
tcgcgacttcgccaaggtactaaaa

SEQ ID NO: 780431 - DNA, 25 bp, Mus musculus
tcgcgacttcgcgaaggtactaaaa

SEQ ID NO: 780432 - DNA, 25 bp, Mus musculus
tcgcgagcggagatgactaccgacc

SEQ ID NO: 780433 - DNA, 25 bp, Mus musculus
tcgcgagcggagttgactaccgacc

SEQ ID NO: 780434 - DNA, 25 bp, Mus musculus
tcgcgaggacggacgccattatcgc

SEQ ID NO: 780435 - DNA, 25 bp, Mus musculus
tcgcgaggacggtcgccattatcgc

SEQ ID NO: 780436 - DNA, 25 bp, Mus musculus
tcgcgcaacgtgctactgatagttg

SEQ ID NO: 780437 - DNA, 25 bp, Mus musculus
tcgcgcaacgtggtactgatagttg

SEQ ID NO: 780438 - DNA, 25 bp, Mus musculus
tcgcgccaatttcggttggccggct

SEQ ID NO: 780439 - DNA, 25 bp, Mus musculus
tcgcgccaatttgggttggccggct

SEQ ID NO: 780440 - DNA, 25 bp, Mus musculus
tcgcgccgaaagcagagccaagcag

SEQ ID NO: 780441 - DNA, 25 bp, Mus musculus
tcgcgccgaaaggagagccaagcag

SEQ ID NO: 780442 - DNA, 25 bp, Mus musculus
tcgcgccgaggcacgtggaacctgc

SEQ ID NO: 780443 - DNA, 25 bp, Mus musculus
tcgcgccgaggctcgtggaacctgc

SEQ ID NO: 780444 - DNA, 25 bp, Mus musculus
tcgcgcgttgtcctggagattgaca

SEQ ID NO: 780445 - DNA, 25 bp, Mus musculus
tcgcgcgttgtcgtggagattgaca

SEQ ID NO: 780446 - DNA, 25 bp, Mus musculus
tcgcgctcctgaagcagagctgcag

SEQ ID NO: 780447 - DNA, 25 bp, Mus musculus
tcgcgctcctgatgcagagctgcag

SEQ ID NO: 780448 - DNA, 25 bp, Mus musculus
tcgcgctgctcaaggtgctgggcac

SEQ ID NO: 780449 - DNA, 25 bp, Mus musculus
tcgcgctgctcatggtgctgggcac

SEQ ID NO: 780450 - DNA, 25 bp, Mus musculus
tcgcggagagaaaaatgcctctttc

SEQ ID NO: 780451 - DNA, 25 bp, Mus musculus
tcgcggagagaataatgcctctttc

SEQ ID NO: 780452 - DNA, 25 bp, Mus musculus
tcgcggagcttgcacaaatctatgc

SEQ ID NO: 780453 - DNA, 25 bp, Mus musculus
tcgcggagcttggacaaatctatgc

SEQ ID NO: 780454 - DNA, 25 bp, Mus musculus
tcgcggatcggcagctgcgctcatt

SEQ ID NO: 780455 - DNA, 25 bp, Mus musculus
tcgcggatcggctgctgcgctcatt

SEQ ID NO: 780456 - DNA, 25 bp, Mus musculus
tcgcggattccgaagccccggaggc

SEQ ID NO: 780457 - DNA, 25 bp, Mus musculus
tcgcggattccgtagccccggaggc

SEQ ID NO: 780458 - DNA, 25 bp, Mus musculus
tcgcggctcactctgattctgatgc

SEQ ID NO: 780459 - DNA, 25 bp, Mus musculus
tcgcggctcactgtgattctgatgc

SEQ ID NO: 780460 - DNA, 25 bp, Mus musculus
tcgcggcttctcagggcagacagag

SEQ ID NO: 780461 - DNA, 25 bp, Mus musculus
tcgcggcttctctgggcagacagag

SEQ ID NO: 780462 - DNA, 25 bp, Mus musculus
tcgcggcttggaattcaaactggag

SEQ ID NO: 780463 - DNA, 25 bp, Mus musculus
tcgcggcttggatttcaaactggag

SEQ ID NO: 780464 - DNA, 25 bp, Mus musculus
tcgcgggacacccaaggatggcact

SEQ ID NO: 780465 - DNA, 25 bp, Mus musculus
tcgcgggacaccgaaggatggcact

SEQ ID NO: 780466 - DNA, 25 bp, Mus musculus
tcgcgggccttaaccgacaaggtca

SEQ ID NO: 780467 - DNA, 25 bp, Mus musculus
tcgcgggccttatccgacaaggtca

SEQ ID NO: 780468 - DNA, 25 bp, Mus musculus
tcgcgggtgctgctgccgccatctt

SEQ ID NO: 780469 - DNA, 25 bp, Mus musculus
tcgcgggtgctggtgccgccatctt

SEQ ID NO: 780470 - DNA, 25 bp, Mus musculus
tcgcggtccttgctcagaaaggcac

SEQ ID NO: 780471 - DNA, 25 bp, Mus musculus
tcgcggtccttggtcagaaaggcac

SEQ ID NO: 780472 - DNA, 25 bp, Mus musculus
tcgcggtctcagcaaagcatggact

SEQ ID NO: 780473 - DNA, 25 bp, Mus musculus
tcgcggtctcaggaaagcatggact

SEQ ID NO: 780474 - DNA, 25 bp, Mus musculus
tcgcggtgagctactttgtagcgtg

SEQ ID NO: 780475 - DNA, 25 bp, Mus musculus
tcgcggtgagcttctttgtagcgtg

SEQ ID NO: 780476 - DNA, 25 bp, Mus musculus
tcgcgtacagaacggcgctggacac

SEQ ID NO: 780477 - DNA, 25 bp, Mus musculus
tcgcgtacagaagggcgctggacac

SEQ ID NO: 780478 - DNA, 25 bp, Mus musculus
tcgcgtatcttcctgccgcataaca

SEQ ID NO: 780479 - DNA, 25 bp, Mus musculus
tcgcgtatcttcgtgccgcataaca

SEQ ID NO: 780480 - DNA, 25 bp, Mus musculus
tcgcgtcggcacagaggcttccaat

SEQ ID NO: 780481 - DNA, 25 bp, Mus musculus
tcgcgtcggcactgaggcttccaat

SEQ ID NO: 780482 - DNA, 25 bp, Mus musculus
tcgcgtgcaaggctctgaccgacca

SEQ ID NO: 780483 - DNA, 25 bp, Mus musculus
tcgcgtgcaagggtctgaccgacca

SEQ ID NO: 780484 - DNA, 25 bp, Mus musculus
tcgcgtgtcgggagtccgacttttc

SEQ ID NO: 780485 - DNA, 25 bp, Mus musculus
tcgcgtgtcgggtgtccgacttttc

SEQ ID NO: 780486 - DNA, 25 bp, Mus musculus
tcgcgttcataaaggacggcaaccg

SEQ ID NO: 780487 - DNA, 25 bp, Mus musculus
tcgcgttcataatggacggcaaccg

SEQ ID NO: 780488 - DNA, 25 bp, Mus musculus
tcgctaaaggagcagcatctctggg

SEQ ID NO: 780489 - DNA, 25 bp, Mus musculus
tcgctaaaggaggagcatctctggg

SEQ ID NO: 780490 - DNA, 25 bp, Mus musculus
tcgctaagatctacgccatgcactg

SEQ ID NO: 780491 - DNA, 25 bp, Mus musculus
tcgctaagatcttcgccatgcactg

SEQ ID NO: 780492 - DNA, 25 bp, Mus musculus
tcgctaaggagaacttgcctggccc

SEQ ID NO: 780493 - DNA, 25 bp, Mus musculus
tcgctaaggagatcttgcctggccc

SEQ ID NO: 780494 - DNA, 25 bp, Mus musculus
tcgctacagaagcaggaacttcgga

SEQ ID NO: 780495 - DNA, 25 bp, Mus musculus
tcgctacagaaggaggaacttcgga

SEQ ID NO: 780496 - DNA, 25 bp, Mus musculus
tcgctaccgaaaagtgagggaaatc

SEQ ID NO: 780497 - DNA, 25 bp, Mus musculus
tcgctaccgaaatgtgagggaaatc

SEQ ID NO: 780498 - DNA, 25 bp, Mus musculus
tcgctacctactcgatgggatgaga

SEQ ID NO: 780499 - DNA, 25 bp, Mus musculus
tcgctacctactggatgggatgaga

SEQ ID NO: 780500 - DNA, 25 bp, Mus musculus
tcgctacctgcacgaacgggagcag

SEQ ID NO: 780501 - DNA, 25 bp, Mus musculus
tcgctacctgcaggaacgggagcag

SEQ ID NO: 780502 - DNA, 25 bp, Mus musculus
tcgctactcttgagctgagaccagc

SEQ ID NO: 780503 - DNA, 25 bp, Mus musculus
tcgctactcttgtgctgagaccagc

SEQ ID NO: 780504 - DNA, 25 bp, Mus musculus
tcgctataccataaagaggaggccc

SEQ ID NO: 780505 - DNA, 25 bp, Mus musculus
tcgctataccattaagaggaggccc

SEQ ID NO: 780506 - DNA, 25 bp, Mus musculus
tcgctatgacccctacactcaaagg

SEQ ID NO: 780507 - DNA, 25 bp, Mus musculus
tcgctatgacccgtacactcaaagg

SEQ ID NO: 780508 - DNA, 25 bp, Mus musculus
tcgctatgaggaaattccccagaag

SEQ ID NO: 780509 - DNA, 25 bp, Mus musculus
tcgctatgaggatattccccagaag

SEQ ID NO: 780510 - DNA, 25 bp, Mus musculus
tcgctatgccaacatgccagatgag

SEQ ID NO: 780511 - DNA, 25 bp, Mus musculus
tcgctatgccaagatgccagatgag

SEQ ID NO: 780512 - DNA, 25 bp, Mus musculus
tcgctatggttactgccagcagctc

SEQ ID NO: 780513 - DNA, 25 bp, Mus musculus
tcgctatggttagtgccagcagctc

SEQ ID NO: 780514 - DNA, 25 bp, Mus musculus
tcgctcaaagtgcactacagcccat

SEQ ID NO: 780515 - DNA, 25 bp, Mus musculus
tcgctcaaagtggactacagcccat

SEQ ID NO: 780516 - DNA, 25 bp, Mus musculus
tcgctcaaggctaagcagttgcaag

SEQ ID NO: 780517 - DNA, 25 bp, Mus musculus
tcgctcaaggcttagcagttgcaag

SEQ ID NO: 780518 - DNA, 25 bp, Mus musculus
tcgctcagaaagaataccattttgc

SEQ ID NO: 780519 - DNA, 25 bp, Mus musculus
tcgctcagaaagtataccattttgc

SEQ ID NO: 780520 - DNA, 25 bp, Mus musculus
tcgctcaggctgagagtaactaact

SEQ ID NO: 780521 - DNA, 25 bp, Mus musculus
tcgctcaggctgtgagtaactaact

SEQ ID NO: 780522 - DNA, 25 bp, Mus musculus
tcgctcaggtacacgcgtcggcaca

SEQ ID NO: 780523 - DNA, 25 bp, Mus musculus
tcgctcaggtactcgcgtcggcaca

SEQ ID NO: 780524 - DNA, 25 bp, Mus musculus
tcgctcatatctctggacttgattg

SEQ ID NO: 780525 - DNA, 25 bp, Mus musculus
tcgctcatatctgtggacttgattg

SEQ ID NO: 780526 - DNA, 25 bp, Mus musculus
tcgctcatgcgtacaacagggtatg

SEQ ID NO: 780527 - DNA, 25 bp, Mus musculus
tcgctcatgcgttcaacagggtatg

SEQ ID NO: 780528 - DNA, 25 bp, Mus musculus
tcgctcatggctcagctactcttac

SEQ ID NO: 780529 - DNA, 25 bp, Mus musculus
tcgctcatggctgagctactcttac

SEQ ID NO: 780530 - DNA, 25 bp, Mus musculus
tcgctccagctcagacatcttgtgt

SEQ ID NO: 780531 - DNA, 25 bp, Mus musculus
tcgctccagctctgacatcttgtgt

SEQ ID NO: 780532 - DNA, 25 bp, Mus musculus
tcgctccatctcagaaagtgccttc

SEQ ID NO: 780533 - DNA, 25 bp, Mus musculus
tcgctccatctctgaaagtgccttc

SEQ ID NO: 780534 - DNA, 25 bp, Mus musculus
tcgctcccgaacagccataattgtg

SEQ ID NO: 780535 - DNA, 25 bp, Mus musculus
tcgctcccgaactgccataattgtg

SEQ ID NO: 780536 - DNA, 25 bp, Mus musculus
tcgctcctagatcgcacctgtgacg

SEQ ID NO: 780537 - DNA, 25 bp, Mus musculus
tcgctcctagatggcacctgtgacg

SEQ ID NO: 780538 - DNA, 25 bp, Mus musculus
tcgctcctcgacaggacaatctgca

SEQ ID NO: 780539 - DNA, 25 bp, Mus musculus
tcgctcctcgactggacaatctgca

SEQ ID NO: 780540 - DNA, 25 bp, Mus musculus
tcgctcggcagacagcatctgtggc

SEQ ID NO: 780541 - DNA, 25 bp, Mus musculus
tcgctcggcagagagcatctgtggc

SEQ ID NO: 780542 - DNA, 25 bp, Mus musculus
tcgctcgggctgagccgcgttgtca

SEQ ID NO: 780543 - DNA, 25 bp, Mus musculus
tcgctcgggctgtgccgcgttgtca

SEQ ID NO: 780544 - DNA, 25 bp, Mus musculus
tcgctcggtctacaaggcggctcag

SEQ ID NO: 780545 - DNA, 25 bp, Mus musculus
tcgctcggtctagaaggcggctcag

SEQ ID NO: 780546 - DNA, 25 bp, Mus musculus
tcgctctaggccctaatgcatgtgc

SEQ ID NO: 780547 - DNA, 25 bp, Mus musculus
tcgctctaggccgtaatgcatgtgc

SEQ ID NO: 780548 - DNA, 25 bp, Mus musculus
tcgctctagggaaccggcaccatgg

SEQ ID NO: 780549 - DNA, 25 bp, Mus musculus
tcgctctagggatccggcaccatgg

SEQ ID NO: 780550 - DNA, 25 bp, Mus musculus
tcgctctcgtgaacgcaaggtgcct

SEQ ID NO: 780551 - DNA, 25 bp, Mus musculus
tcgctctcgtgatcgcaaggtgcct

SEQ ID NO: 780552 - DNA, 25 bp, Mus musculus
tcgctcttcagcatgcctactacag

SEQ ID NO: 780553 - DNA, 25 bp, Mus musculus
tcgctcttcagcttgcctactacag

SEQ ID NO: 780554 - DNA, 25 bp, Mus musculus
tcgctcttgatgaggagccctacag

SEQ ID NO: 780555 - DNA, 25 bp, Mus musculus
tcgctcttgatgtggagccctacag

SEQ ID NO: 780556 - DNA, 25 bp, Mus musculus
tcgctgaaaaaaagcaccatgggct

SEQ ID NO: 780557 - DNA, 25 bp, Mus musculus
tcgctgaaaaaatgcaccatgggct

SEQ ID NO: 780558 - DNA, 25 bp, Mus musculus
tcgctgaactacataaaccaaccca

SEQ ID NO: 780559 - DNA, 25 bp, Mus musculus
tcgctgaactacttaaaccaaccca

SEQ ID NO: 780560 - DNA, 25 bp, Mus musculus
tcgctgaagagcacggcaagaagct

SEQ ID NO: 780561 - DNA, 25 bp, Mus musculus
tcgctgaagagctcggcaagaagct

SEQ ID NO: 780562 - DNA, 25 bp, Mus musculus
tcgctgaaggcgaacagactgactc

SEQ ID NO: 780563 - DNA, 25 bp, Mus musculus
tcgctgaaggcgtacagactgactc

SEQ ID NO: 780564 - DNA, 25 bp, Mus musculus
tcgctgagatatattcgtctagctg

SEQ ID NO: 780565 - DNA, 25 bp, Mus musculus
tcgctgagatattttcgtctagctg

SEQ ID NO: 780566 - DNA, 25 bp, Mus musculus
tcgctgatgttgcttattaaagtag

SEQ ID NO: 780567 - DNA, 25 bp, Mus musculus
tcgctgatgttggttattaaagtag

SEQ ID NO: 780568 - DNA, 25 bp, Mus musculus
tcgctgcagctcatgtgagaaacat

SEQ ID NO: 780569 - DNA, 25 bp, Mus musculus
tcgctgcagctcttgtgagaaacat

SEQ ID NO: 780570 - DNA, 25 bp, Mus musculus
tcgctgccagctagccctgaggagt

SEQ ID NO: 780571 - DNA, 25 bp, Mus musculus
tcgctgccagcttgccctgaggagt

SEQ ID NO: 780572 - DNA, 25 bp, Mus musculus
tcgctgccccgcagggacatgtgca

SEQ ID NO: 780573 - DNA, 25 bp, Mus musculus
tcgctgccccgctgggacatgtgca

SEQ ID NO: 780574 - DNA, 25 bp, Mus musculus
tcgctgccgaatcttccagaacctg

SEQ ID NO: 780575 - DNA, 25 bp, Mus musculus
tcgctgccgaatgttccagaacctg

SEQ ID NO: 780576 - DNA, 25 bp, Mus musculus
tcgctgccggtcaggagcactcgaa

SEQ ID NO: 780577 - DNA, 25 bp, Mus musculus
tcgctgccggtctggagcactcgaa

SEQ ID NO: 780578 - DNA, 25 bp, Mus musculus
tcgctgcgatacaattatgagaaag

SEQ ID NO: 780579 - DNA, 25 bp, Mus musculus
tcgctgcgatactattatgagaaag

SEQ ID NO: 780580 - DNA, 25 bp, Mus musculus
tcgctgctgaaacagtgagtcctgg

SEQ ID NO: 780581 - DNA, 25 bp, Mus musculus
tcgctgctgaaagagtgagtcctgg

SEQ ID NO: 780582 - DNA, 25 bp, Mus musculus
tcgctgctggacaaccgattgaatt

SEQ ID NO: 780583 - DNA, 25 bp, Mus musculus
tcgctgctggactaccgattgaatt

SEQ ID NO: 780584 - DNA, 25 bp, Mus musculus
tcgctggaaattcaacgttcaagag

SEQ ID NO: 780585 - DNA, 25 bp, Mus musculus
tcgctggaaattgaacgttcaagag

SEQ ID NO: 780586 - DNA, 25 bp, Mus musculus
tcgctggactgcacagggtgccaga

SEQ ID NO: 780587 - DNA, 25 bp, Mus musculus
tcgctggactgctcagggtgccaga

SEQ ID NO: 780588 - DNA, 25 bp, Mus musculus
tcgctggattcacgcttgactctcg

SEQ ID NO: 780589 - DNA, 25 bp, Mus musculus
tcgctggattcaggcttgactctcg

SEQ ID NO: 780590 - DNA, 25 bp, Mus musculus
tcgctggccgctagcttcatgtcgg

SEQ ID NO: 780591 - DNA, 25 bp, Mus musculus
tcgctggccgcttgcttcatgtcgg

SEQ ID NO: 780592 - DNA, 25 bp, Mus musculus
tcgctggctgagatacagactcacc

SEQ ID NO: 780593 - DNA, 25 bp, Mus musculus
tcgctggctgagttacagactcacc

SEQ ID NO: 780594 - DNA, 25 bp, Mus musculus
tcgctggctttcagctcatctaggg

SEQ ID NO: 780595 - DNA, 25 bp, Mus musculus
tcgctggctttctgctcatctaggg

SEQ ID NO: 780596 - DNA, 25 bp, Mus musculus
tcgctgggaagaacaaggacattgc

SEQ ID NO: 780597 - DNA, 25 bp, Mus musculus
tcgctgggaagatcaaggacattgc

SEQ ID NO: 780598 - DNA, 25 bp, Mus musculus
tcgctgggagacacctggacctgcc

SEQ ID NO: 780599 - DNA, 25 bp, Mus musculus
tcgctgggagactcctggacctgcc

SEQ ID NO: 780600 - DNA, 25 bp, Mus musculus
tcgctgggcagaccgggtgccagca

SEQ ID NO: 780601 - DNA, 25 bp, Mus musculus
tcgctgggcagagcgggtgccagca

SEQ ID NO: 780602 - DNA, 25 bp, Mus musculus
tcgctgggcatcagaaccagagcat

SEQ ID NO: 780603 - DNA, 25 bp, Mus musculus
tcgctgggcatctgaaccagagcat

SEQ ID NO: 780604 - DNA, 25 bp, Mus musculus
tcgctgggctacagggcacaggcaa

SEQ ID NO: 780605 - DNA, 25 bp, Mus musculus
tcgctgggctactgggcacaggcaa

SEQ ID NO: 780606 - DNA, 25 bp, Mus musculus
tcgctggtacttatagcttctgcag

SEQ ID NO: 780607 - DNA, 25 bp, Mus musculus
tcgctggtacttttagcttctgcag

SEQ ID NO: 780608 - DNA, 25 bp, Mus musculus
tcgctggtcctcattctgctcttca

SEQ ID NO: 780609 - DNA, 25 bp, Mus musculus
tcgctggtcctctttctgctcttca

SEQ ID NO: 780610 - DNA, 25 bp, Mus musculus
tcgctgtaaaacagctttatcccag

SEQ ID NO: 780611 - DNA, 25 bp, Mus musculus
tcgctgtaaaactgctttatcccag

SEQ ID NO: 780612 - DNA, 25 bp, Mus musculus
tcgctgtacagccaacaatttgttg

SEQ ID NO: 780613 - DNA, 25 bp, Mus musculus
tcgctgtacagcgaacaatttgttg

SEQ ID NO: 780614 - DNA, 25 bp, Mus musculus
tcgctgtatttgatagtctgggcag

SEQ ID NO: 780615 - DNA, 25 bp, Mus musculus
tcgctgtatttgttagtctgggcag

SEQ ID NO: 780616 - DNA, 25 bp, Mus musculus
tcgctgtcccttaagtgaggcttcc

SEQ ID NO: 780617 - DNA, 25 bp, Mus musculus
tcgctgtccctttagtgaggcttcc

SEQ ID NO: 780618 - DNA, 25 bp, Mus musculus
tcgctgtctcagcacttagagggag

SEQ ID NO: 780619 - DNA, 25 bp, Mus musculus
tcgctgtctcaggacttagagggag

SEQ ID NO: 780620 - DNA, 25 bp, Mus musculus
tcgctgtctctcatccatgacgaca

SEQ ID NO: 780621 - DNA, 25 bp, Mus musculus
tcgctgtctctcttccatgacgaca

SEQ ID NO: 780622 - DNA, 25 bp, Mus musculus
tcgctgtgagaaaattgagacgtcg

SEQ ID NO: 780623 - DNA, 25 bp, Mus musculus
tcgctgtgagaatattgagacgtcg

SEQ ID NO: 780624 - DNA, 25 bp, Mus musculus
tcgctgtgcatgcagcacttcctct

SEQ ID NO: 780625 - DNA, 25 bp, Mus musculus
tcgctgtgcatggagcacttcctct

SEQ ID NO: 780626 - DNA, 25 bp, Mus musculus
tcgctgtggagcagttagaccagtc

SEQ ID NO: 780627 - DNA, 25 bp, Mus musculus
tcgctgtggagctgttagaccagtc

SEQ ID NO: 780628 - DNA, 25 bp, Mus musculus
tcgctgttattgatacagctcagct

SEQ ID NO: 780629 - DNA, 25 bp, Mus musculus
tcgctgttattgttacagctcagct

SEQ ID NO: 780630 - DNA, 25 bp, Mus musculus
tcgcttaagtctctggacctagtga

SEQ ID NO: 780631 - DNA, 25 bp, Mus musculus
tcgcttaagtctgtggacctagtga

SEQ ID NO: 780632 - DNA, 25 bp, Mus musculus
tcgcttacacttcagaagaactact

SEQ ID NO: 780633 - DNA, 25 bp, Mus musculus
tcgcttacacttgagaagaactact

SEQ ID NO: 780634 - DNA, 25 bp, Mus musculus
tcgcttactctgaggaaccctttca

SEQ ID NO: 780635 - DNA, 25 bp, Mus musculus
tcgcttactctgtggaaccctttca

SEQ ID NO: 780636 - DNA, 25 bp, Mus musculus
tcgcttaggtatatctacaccgctg

SEQ ID NO: 780637 - DNA, 25 bp, Mus musculus
tcgcttaggtatttctacaccgctg

SEQ ID NO: 780638 - DNA, 25 bp, Mus musculus
tcgcttcacacacccaataggattt

SEQ ID NO: 780639 - DNA, 25 bp, Mus musculus
tcgcttcacacagccaataggattt

SEQ ID NO: 780640 - DNA, 25 bp, Mus musculus
tcgcttcattgaccagcgtcagcag

SEQ ID NO: 780641 - DNA, 25 bp, Mus musculus
tcgcttcattgagcagcgtcagcag

SEQ ID NO: 780642 - DNA, 25 bp, Mus musculus
tcgcttcgccggacggtactgggcc

SEQ ID NO: 780643 - DNA, 25 bp, Mus musculus
tcgcttcgccggtcggtactgggcc

SEQ ID NO: 780644 - DNA, 25 bp, Mus musculus
tcgcttctcggaaccatctgtggat

SEQ ID NO: 780645 - DNA, 25 bp, Mus musculus
tcgcttctcggatccatctgtggat

SEQ ID NO: 780646 - DNA, 25 bp, Mus musculus
tcgcttgactacagatgtgcaagaa

SEQ ID NO: 780647 - DNA, 25 bp, Mus musculus
tcgcttgactactgatgtgcaagaa

SEQ ID NO: 780648 - DNA, 25 bp, Mus musculus
tcgcttgcgtcactctcgggcacgg

SEQ ID NO: 780649 - DNA, 25 bp, Mus musculus
tcgcttgcgtcagtctcgggcacgg

SEQ ID NO: 780650 - DNA, 25 bp, Mus musculus
tcgcttggaccacaaccgagcaaaa

SEQ ID NO: 780651 - DNA, 25 bp, Mus musculus
tcgcttggaccagaaccgagcaaaa

SEQ ID NO: 780652 - DNA, 25 bp, Mus musculus
tcgcttggtgttacgtctcggccac

SEQ ID NO: 780653 - DNA, 25 bp, Mus musculus
tcgcttggtgtttcgtctcggccac

SEQ ID NO: 780654 - DNA, 25 bp, Mus musculus
tcgcttgtggcacattcagcatcat

SEQ ID NO: 780655 - DNA, 25 bp, Mus musculus
tcgcttgtggcagattcagcatcat

SEQ ID NO: 780656 - DNA, 25 bp, Mus musculus
tcgcttgttcatcgtgcatgagatc

SEQ ID NO: 780657 - DNA, 25 bp, Mus musculus
tcgcttgttcatggtgcatgagatc

SEQ ID NO: 780658 - DNA, 25 bp, Mus musculus
tcgctttcaggtccggttgaccatc

SEQ ID NO: 780659 - DNA, 25 bp, Mus musculus
tcgctttcaggtgcggttgaccatc

SEQ ID NO: 780660 - DNA, 25 bp, Mus musculus
tcgctttcctccagggcatgtgtgg

SEQ ID NO: 780661 - DNA, 25 bp, Mus musculus
tcgctttcctcctgggcatgtgtgg

SEQ ID NO: 780662 - DNA, 25 bp, Mus musculus
tcgctttctggaaggagcattccca

SEQ ID NO: 780663 - DNA, 25 bp, Mus musculus
tcgctttctggatggagcattccca

SEQ ID NO: 780664 - DNA, 25 bp, Mus musculus
tcgctttgaagccttgaacctcagc

SEQ ID NO: 780665 - DNA, 25 bp, Mus musculus
tcgctttgaagcgttgaacctcagc

SEQ ID NO: 780666 - DNA, 25 bp, Mus musculus
tcgctttgacagagaggtagatatt

SEQ ID NO: 780667 - DNA, 25 bp, Mus musculus
tcgctttgacagtgaggtagatatt

SEQ ID NO: 780668 - DNA, 25 bp, Mus musculus
tcgctttgcggcagtcactcacagt

SEQ ID NO: 780669 - DNA, 25 bp, Mus musculus
tcgctttgcggctgtcactcacagt

SEQ ID NO: 780670 - DNA, 25 bp, Mus musculus
tcgctttggagaccgaataactgag

SEQ ID NO: 780671 - DNA, 25 bp, Mus musculus
tcgctttggagagcgaataactgag

SEQ ID NO: 780672 - DNA, 25 bp, Mus musculus
tcggaaaaacctcctcctgccaaag

SEQ ID NO: 780673 - DNA, 25 bp, Mus musculus
tcggaaaaacctgctcctgccaaag

SEQ ID NO: 780674 - DNA, 25 bp, Mus musculus
tcggaaaaccatattggaggatgag

SEQ ID NO: 780675 - DNA, 25 bp, Mus musculus
tcggaaaaccattttggaggatgag

SEQ ID NO: 780676 - DNA, 25 bp, Mus musculus
tcggaaaacgttcctgaagcttgca

SEQ ID NO: 780677 - DNA, 25 bp, Mus musculus
tcggaaaacgttgctgaagcttgca

SEQ ID NO: 780678 - DNA, 25 bp, Mus musculus
tcggaaaccgccacgggcaggtgca

SEQ ID NO: 780679 - DNA, 25 bp, Mus musculus
tcggaaaccgcctcgggcaggtgca

SEQ ID NO: 780680 - DNA, 25 bp, Mus musculus
tcggaaacgcaaccaggaggaacaa

SEQ ID NO: 780681 - DNA, 25 bp, Mus musculus
tcggaaacgcaagcaggaggaacaa

SEQ ID NO: 780682 - DNA, 25 bp, Mus musculus
tcggaaacttgcacaaacaggaagg

SEQ ID NO: 780683 - DNA, 25 bp, Mus musculus
tcggaaacttgctcaaacaggaagg

SEQ ID NO: 780684 - DNA, 25 bp, Mus musculus
tcggaaagtgtgatccttctcagct

SEQ ID NO: 780685 - DNA, 25 bp, Mus musculus
tcggaaagtgtgttccttctcagct

SEQ ID NO: 780686 - DNA, 25 bp, Mus musculus
tcggaaatcctcacttggctgggag

SEQ ID NO: 780687 - DNA, 25 bp, Mus musculus
tcggaaatcctctcttggctgggag

SEQ ID NO: 780688 - DNA, 25 bp, Mus musculus
tcggaaatgactaactgaaacgtgg

SEQ ID NO: 780689 - DNA, 25 bp, Mus musculus
tcggaaatgacttactgaaacgtgg

SEQ ID NO: 780690 - DNA, 25 bp, Mus musculus
tcggaaatgcggcaactggcaaatc

SEQ ID NO: 780691 - DNA, 25 bp, Mus musculus
tcggaaatgcgggaactggcaaatc

SEQ ID NO: 780692 - DNA, 25 bp, Mus musculus
tcggaaatggctctttctgagctcc

SEQ ID NO: 780693 - DNA, 25 bp, Mus musculus
tcggaaatggctgtttctgagctcc

SEQ ID NO: 780694 - DNA, 25 bp, Mus musculus
tcggaacaaaacacaaggcttccgg

SEQ ID NO: 780695 - DNA, 25 bp, Mus musculus
tcggaacaaaactcaaggcttccgg

SEQ ID NO: 780696 - DNA, 25 bp, Mus musculus
tcggaacaggtgaagatgctgcagc

SEQ ID NO: 780697 - DNA, 25 bp, Mus musculus
tcggaacaggtgtagatgctgcagc

SEQ ID NO: 780698 - DNA, 25 bp, Mus musculus
tcggaaccagttctatgtccaggtc

SEQ ID NO: 780699 - DNA, 25 bp, Mus musculus
tcggaaccagttgtatgtccaggtc

SEQ ID NO: 780700 - DNA, 25 bp, Mus musculus
tcggaaccatctctggatcagggcc

SEQ ID NO: 780701 - DNA, 25 bp, Mus musculus
tcggaaccatctgtggatcagggcc

SEQ ID NO: 780702 - DNA, 25 bp, Mus musculus
tcggaaccctccctggtacaggcag

SEQ ID NO: 780703 - DNA, 25 bp, Mus musculus
tcggaaccctccgtggtacaggcag

SEQ ID NO: 780704 - DNA, 25 bp, Mus musculus
tcggaacgcatcaccttggcggtgg

SEQ ID NO: 780705 - DNA, 25 bp, Mus musculus
tcggaacgcatctccttggcggtgg

SEQ ID NO: 780706 - DNA, 25 bp, Mus musculus
tcggaactaaggagtgaactgcagc

SEQ ID NO: 780707 - DNA, 25 bp, Mus musculus
tcggaactaaggtgtgaactgcagc

SEQ ID NO: 780708 - DNA, 25 bp, Mus musculus
tcggaactatggaagctacagaagc

SEQ ID NO: 780709 - DNA, 25 bp, Mus musculus
tcggaactatggtagctacagaagc

SEQ ID NO: 780710 - DNA, 25 bp, Mus musculus
tcggaactgaggctcaagcacagcc

SEQ ID NO: 780711 - DNA, 25 bp, Mus musculus
tcggaactgagggtcaagcacagcc

SEQ ID NO: 780712 - DNA, 25 bp, Mus musculus
tcggaactgcggacctgagagcttc

SEQ ID NO: 780713 - DNA, 25 bp, Mus musculus
tcggaactgcggtcctgagagcttc

SEQ ID NO: 780714 - DNA, 25 bp, Mus musculus
tcggaagacacaagaacatcatcaa

SEQ ID NO: 780715 - DNA, 25 bp, Mus musculus
tcggaagacacatgaacatcatcaa

SEQ ID NO: 780716 - DNA, 25 bp, Mus musculus
tcggaagattcacaggttgtgctgc

SEQ ID NO: 780717 - DNA, 25 bp, Mus musculus
tcggaagattcagaggttgtgctgc

SEQ ID NO: 780718 - DNA, 25 bp, Mus musculus
tcggaagcccttccaacttcgaggc

SEQ ID NO: 780719 - DNA, 25 bp, Mus musculus
tcggaagcccttgcaacttcgaggc

SEQ ID NO: 780720 - DNA, 25 bp, Mus musculus
tcggaagctggacttcaacaaggcg

SEQ ID NO: 780721 - DNA, 25 bp, Mus musculus
tcggaagctggagttcaacaaggcg

SEQ ID NO: 780722 - DNA, 25 bp, Mus musculus
tcggaagctgtccagtgcaatgtct

SEQ ID NO: 780723 - DNA, 25 bp, Mus musculus
tcggaagctgtcgagtgcaatgtct

SEQ ID NO: 780724 - DNA, 25 bp, Mus musculus
tcggaaggaaacctttgatactggc

SEQ ID NO: 780725 - DNA, 25 bp, Mus musculus
tcggaaggaaacgtttgatactggc

SEQ ID NO: 780726 - DNA, 25 bp, Mus musculus
tcggaaggaccacatggctgacact

SEQ ID NO: 780727 - DNA, 25 bp, Mus musculus
tcggaaggaccagatggctgacact

SEQ ID NO: 780728 - DNA, 25 bp, Mus musculus
tcggaaggactccagagaaagctat

SEQ ID NO: 780729 - DNA, 25 bp, Mus musculus
tcggaaggactcgagagaaagctat

SEQ ID NO: 780730 - DNA, 25 bp, Mus musculus
tcggaaggcagcctgtgagcaacct

SEQ ID NO: 780731 - DNA, 25 bp, Mus musculus
tcggaaggcagcgtgtgagcaacct

SEQ ID NO: 780732 - DNA, 25 bp, Mus musculus
tcggaaggcctgcaatgatgccacg

SEQ ID NO: 780733 - DNA, 25 bp, Mus musculus
tcggaaggcctggaatgatgccacg

SEQ ID NO: 780734 - DNA, 25 bp, Mus musculus
tcggaagggcccacaggataacatg

SEQ ID NO: 780735 - DNA, 25 bp, Mus musculus
tcggaagggccctcaggataacatg

SEQ ID NO: 780736 - DNA, 25 bp, Mus musculus
tcggaagtgacaaatatgctgcaag

SEQ ID NO: 780737 - DNA, 25 bp, Mus musculus
tcggaagtgacatatatgctgcaag

SEQ ID NO: 780738 - DNA, 25 bp, Mus musculus
tcggaagtgggtattgacagctgcc

SEQ ID NO: 780739 - DNA, 25 bp, Mus musculus
tcggaagtgggttttgacagctgcc

SEQ ID NO: 780740 - DNA, 25 bp, Mus musculus
tcggaatacatcaaccactgcaatg

SEQ ID NO: 780741 - DNA, 25 bp, Mus musculus
tcggaatacatctaccactgcaatg

SEQ ID NO: 780742 - DNA, 25 bp, Mus musculus
tcggaatagccaaccacaacttgct

SEQ ID NO: 780743 - DNA, 25 bp, Mus musculus
tcggaatagccatccacaacttgct

SEQ ID NO: 780744 - DNA, 25 bp, Mus musculus
tcggaatccttcactgggaaatcta

SEQ ID NO: 780745 - DNA, 25 bp, Mus musculus
tcggaatccttctctgggaaatcta

SEQ ID NO: 780746 - DNA, 25 bp, Mus musculus
tcggaatgcagtccctgacatccag

SEQ ID NO: 780747 - DNA, 25 bp, Mus musculus
tcggaatgcagtgcctgacatccag

SEQ ID NO: 780748 - DNA, 25 bp, Mus musculus
tcggaatggaaaacagttgagatca

SEQ ID NO: 780749 - DNA, 25 bp, Mus musculus
tcggaatggaaatcagttgagatca

SEQ ID NO: 780750 - DNA, 25 bp, Mus musculus
tcggaatgtaacatttgaggatgct

SEQ ID NO: 780751 - DNA, 25 bp, Mus musculus
tcggaatgtaacttttgaggatgct

SEQ ID NO: 780752 - DNA, 25 bp, Mus musculus
tcggaatgtgtgacatcgacatcag

SEQ ID NO: 780753 - DNA, 25 bp, Mus musculus
tcggaatgtgtgtcatcgacatcag

SEQ ID NO: 780754 - DNA, 25 bp, Mus musculus
tcggaatttcgtcatgcccctgaga

SEQ ID NO: 780755 - DNA, 25 bp, Mus musculus
tcggaatttcgtgatgcccctgaga

SEQ ID NO: 780756 - DNA, 25 bp, Mus musculus
tcggacaagccccatcttccagtgg

SEQ ID NO: 780757 - DNA, 25 bp, Mus musculus
tcggacaagcccgatcttccagtgg

SEQ ID NO: 780758 - DNA, 25 bp, Mus musculus
tcggacacaaccagctgctggtcag

SEQ ID NO: 780759 - DNA, 25 bp, Mus musculus
tcggacacaacctgctgctggtcag

SEQ ID NO: 780760 - DNA, 25 bp, Mus musculus
tcggacagacttcgaaagtcacacc

SEQ ID NO: 780761 - DNA, 25 bp, Mus musculus
tcggacagacttggaaagtcacacc

SEQ ID NO: 780762 - DNA, 25 bp, Mus musculus
tcggacagcgcaaagaacggcgatg

SEQ ID NO: 780763 - DNA, 25 bp, Mus musculus
tcggacagcgcatagaacggcgatg

SEQ ID NO: 780764 - DNA, 25 bp, Mus musculus
tcggacaggtacagagcacactcaa

SEQ ID NO: 780765 - DNA, 25 bp, Mus musculus
tcggacaggtactgagcacactcaa

SEQ ID NO: 780766 - DNA, 25 bp, Mus musculus
tcggacagtgtgcagcctgctcagc

SEQ ID NO: 780767 - DNA, 25 bp, Mus musculus
tcggacagtgtggagcctgctcagc

SEQ ID NO: 780768 - DNA, 25 bp, Mus musculus
tcggacatcaaaaaagaatccaatt

SEQ ID NO: 780769 - DNA, 25 bp, Mus musculus
tcggacatcaaataagaatccaatt

SEQ ID NO: 780770 - DNA, 25 bp, Mus musculus
tcggaccaaattacgggctccagaa

SEQ ID NO: 780771 - DNA, 25 bp, Mus musculus
tcggaccaaatttcgggctccagaa

SEQ ID NO: 780772 - DNA, 25 bp, Mus musculus
tcggaccagtggacggcactggtca

SEQ ID NO: 780773 - DNA, 25 bp, Mus musculus
tcggaccagtggtcggcactggtca

SEQ ID NO: 780774 - DNA, 25 bp, Mus musculus
tcggacccggctcaatggagccaag

SEQ ID NO: 780775 - DNA, 25 bp, Mus musculus
tcggacccggctgaatggagccaag

SEQ ID NO: 780776 - DNA, 25 bp, Mus musculus
tcggaccctttcaaccacaggtgct

SEQ ID NO: 780777 - DNA, 25 bp, Mus musculus
tcggaccctttctaccacaggtgct

SEQ ID NO: 780778 - DNA, 25 bp, Mus musculus
tcggacctagagaacgttgccacaa

SEQ ID NO: 780779 - DNA, 25 bp, Mus musculus
tcggacctagagtacgttgccacaa

SEQ ID NO: 780780 - DNA, 25 bp, Mus musculus
tcggacctatatccgtcaagtgcta

SEQ ID NO: 780781 - DNA, 25 bp, Mus musculus
tcggacctatatgcgtcaagtgcta

SEQ ID NO: 780782 - DNA, 25 bp, Mus musculus
tcggacctcagcaaaacgcttggct

SEQ ID NO: 780783 - DNA, 25 bp, Mus musculus
tcggacctcagctaaacgcttggct

SEQ ID NO: 780784 - DNA, 25 bp, Mus musculus
tcggacctggctctatgctgcctgt

SEQ ID NO: 780785 - DNA, 25 bp, Mus musculus
tcggacctggctgtatgctgcctgt

SEQ ID NO: 780786 - DNA, 25 bp, Mus musculus
tcggacctgtatacagagtgaactt

SEQ ID NO: 780787 - DNA, 25 bp, Mus musculus
tcggacctgtattcagagtgaactt

SEQ ID NO: 780788 - DNA, 25 bp, Mus musculus
tcggacgatgagcacgagacgcacc

SEQ ID NO: 780789 - DNA, 25 bp, Mus musculus
tcggacgatgaggacgagacgcacc

SEQ ID NO: 780790 - DNA, 25 bp, Mus musculus
tcggacgccaccacgctcgggagtt

SEQ ID NO: 780791 - DNA, 25 bp, Mus musculus
tcggacgccacctcgctcgggagtt

SEQ ID NO: 780792 - DNA, 25 bp, Mus musculus
tcggacggactaagcttcagaactg

SEQ ID NO: 780793 - DNA, 25 bp, Mus musculus
tcggacggactatgcttcagaactg

SEQ ID NO: 780794 - DNA, 25 bp, Mus musculus
tcggacggagccatctacgccgtga

SEQ ID NO: 780795 - DNA, 25 bp, Mus musculus
tcggacggagccttctacgccgtga

SEQ ID NO: 780796 - DNA, 25 bp, Mus musculus
tcggacgtgaccagtacaaggaaat

SEQ ID NO: 780797 - DNA, 25 bp, Mus musculus
tcggacgtgacctgtacaaggaaat

SEQ ID NO: 780798 - DNA, 25 bp, Mus musculus
tcggactatatgctgtatgtatacg

SEQ ID NO: 780799 - DNA, 25 bp, Mus musculus
tcggactatatggtgtatgtatacg

SEQ ID NO: 780800 - DNA, 25 bp, Mus musculus
tcggactcactaaggccagaaagcc

SEQ ID NO: 780801 - DNA, 25 bp, Mus musculus
tcggactcactatggccagaaagcc

SEQ ID NO: 780802 - DNA, 25 bp, Mus musculus
tcggactcctcaaggtgctaggctg

SEQ ID NO: 780803 - DNA, 25 bp, Mus musculus
tcggactcctcatggtgctaggctg

SEQ ID NO: 780804 - DNA, 25 bp, Mus musculus
tcggactctccgatcctgcaaggct

SEQ ID NO: 780805 - DNA, 25 bp, Mus musculus
tcggactctccgttcctgcaaggct

SEQ ID NO: 780806 - DNA, 25 bp, Mus musculus
tcggactgtagcatcagcgctagcg

SEQ ID NO: 780807 - DNA, 25 bp, Mus musculus
tcggactgtagcttcagcgctagcg

SEQ ID NO: 780808 - DNA, 25 bp, Mus musculus
tcggacttccatatcagtgcccgcg

SEQ ID NO: 780809 - DNA, 25 bp, Mus musculus
tcggacttccatttcagtgcccgcg

SEQ ID NO: 780810 - DNA, 25 bp, Mus musculus
tcggacttgaaaaggcacatgcgtg

SEQ ID NO: 780811 - DNA, 25 bp, Mus musculus
tcggacttgaaatggcacatgcgtg

SEQ ID NO: 780812 - DNA, 25 bp, Mus musculus
tcggagaagcgaaacagtcgtagcc

SEQ ID NO: 780813 - DNA, 25 bp, Mus musculus
tcggagaagcgatacagtcgtagcc

SEQ ID NO: 780814 - DNA, 25 bp, Mus musculus
tcggagaatcatcttggcggtgcac

SEQ ID NO: 780815 - DNA, 25 bp, Mus musculus
tcggagaatcatgttggcggtgcac

SEQ ID NO: 780816 - DNA, 25 bp, Mus musculus
tcggagacacttcagtttctcgcag

SEQ ID NO: 780817 - DNA, 25 bp, Mus musculus
tcggagacacttgagtttctcgcag

SEQ ID NO: 780818 - DNA, 25 bp, Mus musculus
tcggagacagaaccacggttcactt

SEQ ID NO: 780819 - DNA, 25 bp, Mus musculus
tcggagacagaagcacggttcactt

SEQ ID NO: 780820 - DNA, 25 bp, Mus musculus
tcggagacatacacgagggttcttc

SEQ ID NO: 780821 - DNA, 25 bp, Mus musculus
tcggagacatactcgagggttcttc

SEQ ID NO: 780822 - DNA, 25 bp, Mus musculus
tcggagaccctcaaatacaaggata

SEQ ID NO: 780823 - DNA, 25 bp, Mus musculus
tcggagaccctctaatacaaggata

SEQ ID NO: 780824 - DNA, 25 bp, Mus musculus
tcggagacctatcacgaggacgaac

SEQ ID NO: 780825 - DNA, 25 bp, Mus musculus
tcggagacctatgacgaggacgaac

SEQ ID NO: 780826 - DNA, 25 bp, Mus musculus
tcggagacctcccatgctaagagca

SEQ ID NO: 780827 - DNA, 25 bp, Mus musculus
tcggagacctccgatgctaagagca

SEQ ID NO: 780828 - DNA, 25 bp, Mus musculus
tcggagacgggaactgctgctgccc

SEQ ID NO: 780829 - DNA, 25 bp, Mus musculus
tcggagacgggatctgctgctgccc

SEQ ID NO: 780830 - DNA, 25 bp, Mus musculus
tcggagacgtagaggcgaagattct

SEQ ID NO: 780831 - DNA, 25 bp, Mus musculus
tcggagacgtagtggcgaagattct

SEQ ID NO: 780832 - DNA, 25 bp, Mus musculus
tcggagactcggaatgagagcatta

SEQ ID NO: 780833 - DNA, 25 bp, Mus musculus
tcggagactcggtatgagagcatta

SEQ ID NO: 780834 - DNA, 25 bp, Mus musculus
tcggagactgcccaggatgacatca

SEQ ID NO: 780835 - DNA, 25 bp, Mus musculus
tcggagactgccgaggatgacatca

SEQ ID NO: 780836 - DNA, 25 bp, Mus musculus
tcggagagaaaacccgctcaaagca

SEQ ID NO: 780837 - DNA, 25 bp, Mus musculus
tcggagagaaaagccgctcaaagca

SEQ ID NO: 780838 - DNA, 25 bp, Mus musculus
tcggagagaggacctttattaaatc

SEQ ID NO: 780839 - DNA, 25 bp, Mus musculus
tcggagagaggagctttattaaatc

SEQ ID NO: 780840 - DNA, 25 bp, Mus musculus
tcggagagcagaaattaagcaaggg

SEQ ID NO: 780841 - DNA, 25 bp, Mus musculus
tcggagagcagatattaagcaaggg

SEQ ID NO: 780842 - DNA, 25 bp, Mus musculus
tcggagatggtactactggcctcat

SEQ ID NO: 780843 - DNA, 25 bp, Mus musculus
tcggagatggtagtactggcctcat

SEQ ID NO: 780844 - DNA, 25 bp, Mus musculus
tcggagcaagtgctagatctgacac

SEQ ID NO: 780845 - DNA, 25 bp, Mus musculus
tcggagcaagtggtagatctgacac

SEQ ID NO: 780846 - DNA, 25 bp, Mus musculus
tcggagcagcgaaggaccactctcc

SEQ ID NO: 780847 - DNA, 25 bp, Mus musculus
tcggagcagcgatggaccactctcc

SEQ ID NO: 780848 - DNA, 25 bp, Mus musculus
tcggagcagtccacgcatgctacct

SEQ ID NO: 780849 - DNA, 25 bp, Mus musculus
tcggagcagtcctcgcatgctacct

SEQ ID NO: 780850 - DNA, 25 bp, Mus musculus
tcggagccaaaacgagcctatccca

SEQ ID NO: 780851 - DNA, 25 bp, Mus musculus
tcggagccaaaaggagcctatccca

SEQ ID NO: 780852 - DNA, 25 bp, Mus musculus
tcggagccagaacccttaaggagga

SEQ ID NO: 780853 - DNA, 25 bp, Mus musculus
tcggagccagaagccttaaggagga

SEQ ID NO: 780854 - DNA, 25 bp, Mus musculus
tcggagcccctgcagttgaagaaat

SEQ ID NO: 780855 - DNA, 25 bp, Mus musculus
tcggagcccctggagttgaagaaat

SEQ ID NO: 780856 - DNA, 25 bp, Mus musculus
tcggagcccttaaccactacgtgga

SEQ ID NO: 780857 - DNA, 25 bp, Mus musculus
tcggagcccttatccactacgtgga

SEQ ID NO: 780858 - DNA, 25 bp, Mus musculus
tcggagctaagcataaggcggcgct

SEQ ID NO: 780859 - DNA, 25 bp, Mus musculus
tcggagctaagcttaaggcggcgct

SEQ ID NO: 780860 - DNA, 25 bp, Mus musculus
tcggagctccagactactcaaaaat

SEQ ID NO: 780861 - DNA, 25 bp, Mus musculus
tcggagctccagtctactcaaaaat

SEQ ID NO: 780862 - DNA, 25 bp, Mus musculus
tcggagctctcacgaacaactggac

SEQ ID NO: 780863 - DNA, 25 bp, Mus musculus
tcggagctctcaggaacaactggac

SEQ ID NO: 780864 - DNA, 25 bp, Mus musculus
tcggagctgcgccaacatggccgaa

SEQ ID NO: 780865 - DNA, 25 bp, Mus musculus
tcggagctgcgcgaacatggccgaa

SEQ ID NO: 780866 - DNA, 25 bp, Mus musculus
tcggagctgttcagcatgtctgtgg

SEQ ID NO: 780867 - DNA, 25 bp, Mus musculus
tcggagctgttctgcatgtctgtgg

SEQ ID NO: 780868 - DNA, 25 bp, Mus musculus
tcggagcttcagaaccagggtcccc

SEQ ID NO: 780869 - DNA, 25 bp, Mus musculus
tcggagcttcagtaccagggtcccc

SEQ ID NO: 780870 - DNA, 25 bp, Mus musculus
tcggagctttaacgccttcttggcc

SEQ ID NO: 780871 - DNA, 25 bp, Mus musculus
tcggagctttaaggccttcttggcc

SEQ ID NO: 780872 - DNA, 25 bp, Mus musculus
tcggaggaatgaacagacgtccaat

SEQ ID NO: 780873 - DNA, 25 bp, Mus musculus
tcggaggaatgatcagacgtccaat

SEQ ID NO: 780874 - DNA, 25 bp, Mus musculus
tcggaggacctacaggacctaaaag

SEQ ID NO: 780875 - DNA, 25 bp, Mus musculus
tcggaggacctagaggacctaaaag

SEQ ID NO: 780876 - DNA, 25 bp, Mus musculus
tcggaggagctcatctgtttcctgt

SEQ ID NO: 780877 - DNA, 25 bp, Mus musculus
tcggaggagctcttctgtttcctgt

SEQ ID NO: 780878 - DNA, 25 bp, Mus musculus
tcggaggcagtgacatcaatgaggt

SEQ ID NO: 780879 - DNA, 25 bp, Mus musculus
tcggaggcagtgtcatcaatgaggt

SEQ ID NO: 780880 - DNA, 25 bp, Mus musculus
tcggaggcatgacaaagcaagactg

SEQ ID NO: 780881 - DNA, 25 bp, Mus musculus
tcggaggcatgagaaagcaagactg

SEQ ID NO: 780882 - DNA, 25 bp, Mus musculus
tcggaggccagccagatccttcgga

SEQ ID NO: 780883 - DNA, 25 bp, Mus musculus
tcggaggccagcgagatccttcgga

SEQ ID NO: 780884 - DNA, 25 bp, Mus musculus
tcggaggccattccaaagccagtga

SEQ ID NO: 780885 - DNA, 25 bp, Mus musculus
tcggaggccattgcaaagccagtga

SEQ ID NO: 780886 - DNA, 25 bp, Mus musculus
tcggaggccctccagaatacctggg

SEQ ID NO: 780887 - DNA, 25 bp, Mus musculus
tcggaggccctcgagaatacctggg

SEQ ID NO: 780888 - DNA, 25 bp, Mus musculus
tcggaggccttgaaggaagcattgc

SEQ ID NO: 780889 - DNA, 25 bp, Mus musculus
tcggaggccttgtaggaagcattgc

SEQ ID NO: 780890 - DNA, 25 bp, Mus musculus
tcggaggctcagagtgcaagtccca

SEQ ID NO: 780891 - DNA, 25 bp, Mus musculus
tcggaggctcagtgtgcaagtccca

SEQ ID NO: 780892 - DNA, 25 bp, Mus musculus
tcggaggctttactctgtggccagc

SEQ ID NO: 780893 - DNA, 25 bp, Mus musculus
tcggaggctttagtctgtggccagc

SEQ ID NO: 780894 - DNA, 25 bp, Mus musculus
tcggagggctccagccccgagcgaa

SEQ ID NO: 780895 - DNA, 25 bp, Mus musculus
tcggagggctcctgccccgagcgaa

SEQ ID NO: 780896 - DNA, 25 bp, Mus musculus
tcggaggtagccatgcagagcgcac

SEQ ID NO: 780897 - DNA, 25 bp, Mus musculus
tcggaggtagccttgcagagcgcac

SEQ ID NO: 780898 - DNA, 25 bp, Mus musculus
tcggaggtccaacgctgaagaactg

SEQ ID NO: 780899 - DNA, 25 bp, Mus musculus
tcggaggtccaaggctgaagaactg

SEQ ID NO: 780900 - DNA, 25 bp, Mus musculus
tcggaggtggagataacgagaaaca

SEQ ID NO: 780901 - DNA, 25 bp, Mus musculus
tcggaggtggagttaacgagaaaca

SEQ ID NO: 780902 - DNA, 25 bp, Mus musculus
tcggagtacctgatccagcacgact

SEQ ID NO: 780903 - DNA, 25 bp, Mus musculus
tcggagtacctgttccagcacgact

SEQ ID NO: 780904 - DNA, 25 bp, Mus musculus
tcggagtcagcgacccgatccttgg

SEQ ID NO: 780905 - DNA, 25 bp, Mus musculus
tcggagtcagcgtcccgatccttgg

SEQ ID NO: 780906 - DNA, 25 bp, Mus musculus
tcggagtcctataacccagagtatc

SEQ ID NO: 780907 - DNA, 25 bp, Mus musculus
tcggagtcctattacccagagtatc

SEQ ID NO: 780908 - DNA, 25 bp, Mus musculus
tcggagtcctcaactacgagatggc

SEQ ID NO: 780909 - DNA, 25 bp, Mus musculus
tcggagtcctcatctacgagatggc

SEQ ID NO: 780910 - DNA, 25 bp, Mus musculus
tcggagtcgcggctagctcccgctt

SEQ ID NO: 780911 - DNA, 25 bp, Mus musculus
tcggagtcgcgggtagctcccgctt

SEQ ID NO: 780912 - DNA, 25 bp, Mus musculus
tcggagtgccgcagcctgatccagc

SEQ ID NO: 780913 - DNA, 25 bp, Mus musculus
tcggagtgccgctgcctgatccagc

SEQ ID NO: 780914 - DNA, 25 bp, Mus musculus
tcggagtggactaccccgtgaaggt

SEQ ID NO: 780915 - DNA, 25 bp, Mus musculus
tcggagtggacttccccgtgaaggt

SEQ ID NO: 780916 - DNA, 25 bp, Mus musculus
tcggagtggctcactccttgtgcag

SEQ ID NO: 780917 - DNA, 25 bp, Mus musculus
tcggagtggctctctccttgtgcag

SEQ ID NO: 780918 - DNA, 25 bp, Mus musculus
tcggagtggctgagagacatgcaac

SEQ ID NO: 780919 - DNA, 25 bp, Mus musculus
tcggagtggctgtgagacatgcaac

SEQ ID NO: 780920 - DNA, 25 bp, Mus musculus
tcggagtgtcaccaggaaaagaaaa

SEQ ID NO: 780921 - DNA, 25 bp, Mus musculus
tcggagtgtcacgaggaaaagaaaa

SEQ ID NO: 780922 - DNA, 25 bp, Mus musculus
tcggagtgtcctatggaagaatgca

SEQ ID NO: 780923 - DNA, 25 bp, Mus musculus
tcggagtgtcctttggaagaatgca

SEQ ID NO: 780924 - DNA, 25 bp, Mus musculus
tcggagttctgtacaaggacaagaa

SEQ ID NO: 780925 - DNA, 25 bp, Mus musculus
tcggagttctgtcacatcacactac

SEQ ID NO: 780926 - DNA, 25 bp, Mus musculus
tcggagttctgtgacatcacactac

SEQ ID NO: 780927 - DNA, 25 bp, Mus musculus
tcggagttctgttcaaggacaagaa

SEQ ID NO: 780928 - DNA, 25 bp, Mus musculus
tcggagtttgtacacatcgtggcaa

SEQ ID NO: 780929 - DNA, 25 bp, Mus musculus
tcggagtttgtagacatcgtggcaa

SEQ ID NO: 780930 - DNA, 25 bp, Mus musculus
tcggataaacctcgatccacctcag

SEQ ID NO: 780931 - DNA, 25 bp, Mus musculus
tcggataaacctggatccacctcag

SEQ ID NO: 780932 - DNA, 25 bp, Mus musculus
tcggataacgagatgccaccagagg

SEQ ID NO: 780933 - DNA, 25 bp, Mus musculus
tcggataacgagttgccaccagagg

SEQ ID NO: 780934 - DNA, 25 bp, Mus musculus
tcggataccatcagtaaaaatcccc

SEQ ID NO: 780935 - DNA, 25 bp, Mus musculus
tcggataccatctgtaaaaatcccc

SEQ ID NO: 780936 - DNA, 25 bp, Mus musculus
tcggatacgatgagaagagagctgt

SEQ ID NO: 780937 - DNA, 25 bp, Mus musculus
tcggatacgatgtgaagagagctgt

SEQ ID NO: 780938 - DNA, 25 bp, Mus musculus
tcggatagagacacaactgaggagg

SEQ ID NO: 780939 - DNA, 25 bp, Mus musculus
tcggatagagactcaactgaggagg

SEQ ID NO: 780940 - DNA, 25 bp, Mus musculus
tcggatcaagcacagcattgactcc

SEQ ID NO: 780941 - DNA, 25 bp, Mus musculus
tcggatcaagcagagcattgactcc

SEQ ID NO: 780942 - DNA, 25 bp, Mus musculus
tcggatcaccaaccagatatgctgc

SEQ ID NO: 780943 - DNA, 25 bp, Mus musculus
tcggatcaccaagcagatatgctgc

SEQ ID NO: 780944 - DNA, 25 bp, Mus musculus
tcggatccatttctaggatgatcac

SEQ ID NO: 780945 - DNA, 25 bp, Mus musculus
tcggatccatttgtaggatgatcac

SEQ ID NO: 780946 - DNA, 25 bp, Mus musculus
tcggatctgatcacggagatggaga

SEQ ID NO: 780947 - DNA, 25 bp, Mus musculus
tcggatctgatctcggagatggaga

SEQ ID NO: 780948 - DNA, 25 bp, Mus musculus
tcggatctgatgactaagtggttgg

SEQ ID NO: 780949 - DNA, 25 bp, Mus musculus
tcggatctgatgtctaagtggttgg

SEQ ID NO: 780950 - DNA, 25 bp, Mus musculus
tcggatgacagtatatattccaggc

SEQ ID NO: 780951 - DNA, 25 bp, Mus musculus
tcggatgacagtttatattccaggc

SEQ ID NO: 780952 - DNA, 25 bp, Mus musculus
tcggatgagcccatcaaggagtgca

SEQ ID NO: 780953 - DNA, 25 bp, Mus musculus
tcggatgagcccttcaaggagtgca

SEQ ID NO: 780954 - DNA, 25 bp, Mus musculus
tcggatgatggcaaatatgcgaagt

SEQ ID NO: 780955 - DNA, 25 bp, Mus musculus
tcggatgatggctaatatgcgaagt

SEQ ID NO: 780956 - DNA, 25 bp, Mus musculus
tcggatgcagaacgctctgaaccgc

SEQ ID NO: 780957 - DNA, 25 bp, Mus musculus
tcggatgcagaaggctctgaaccgc

SEQ ID NO: 780958 - DNA, 25 bp, Mus musculus
tcggatgccttactcatcttccagc

SEQ ID NO: 780959 - DNA, 25 bp, Mus musculus
tcggatgccttagtcatcttccagc

SEQ ID NO: 780960 - DNA, 25 bp, Mus musculus
tcggatggaacaatactgcaagtgc

SEQ ID NO: 780961 - DNA, 25 bp, Mus musculus
tcggatggaacattactgcaagtgc

SEQ ID NO: 780962 - DNA, 25 bp, Mus musculus
tcggatggtcgcattagagaccaat

SEQ ID NO: 780963 - DNA, 25 bp, Mus musculus
tcggatggtcgctttagagaccaat

SEQ ID NO: 780964 - DNA, 25 bp, Mus musculus
tcggatgtagacctggacaagtacc

SEQ ID NO: 780965 - DNA, 25 bp, Mus musculus
tcggatgtagacgtggacaagtacc

SEQ ID NO: 780966 - DNA, 25 bp, Mus musculus
tcggatgtccgcctgcgcgcacttt

SEQ ID NO: 780967 - DNA, 25 bp, Mus musculus
tcggatgtccgcgtgcgcgcacttt

SEQ ID NO: 780968 - DNA, 25 bp, Mus musculus
tcggatgtctgtccatcttccctga

SEQ ID NO: 780969 - DNA, 25 bp, Mus musculus
tcggatgtctgtgcatcttccctga

SEQ ID NO: 780970 - DNA, 25 bp, Mus musculus
tcggatgtggcactttgcagtgtct

SEQ ID NO: 780971 - DNA, 25 bp, Mus musculus
tcggatgtggcagtttgcagtgtct

SEQ ID NO: 780972 - DNA, 25 bp, Mus musculus
tcggattatcccacatggcacgcca

SEQ ID NO: 780973 - DNA, 25 bp, Mus musculus
tcggattatccctcatggcacgcca

SEQ ID NO: 780974 - DNA, 25 bp, Mus musculus
tcggattcccggcaatgcaagctga

SEQ ID NO: 780975 - DNA, 25 bp, Mus musculus
tcggattcccgggaatgcaagctga

SEQ ID NO: 780976 - DNA, 25 bp, Mus musculus
tcggattgccaaaaacctggagtta

SEQ ID NO: 780977 - DNA, 25 bp, Mus musculus
tcggattgccaataacctggagtta

SEQ ID NO: 780978 - DNA, 25 bp, Mus musculus
tcggatttggtgacacccagacaca

SEQ ID NO: 780979 - DNA, 25 bp, Mus musculus
tcggatttggtgtcacccagacaca

SEQ ID NO: 780980 - DNA, 25 bp, Mus musculus
tcggattttcctcttaacaaacaat

SEQ ID NO: 780981 - DNA, 25 bp, Mus musculus
tcggattttcctgttaacaaacaat

SEQ ID NO: 780982 - DNA, 25 bp, Mus musculus
tcggcaaccagcctgacaacagatg

SEQ ID NO: 780983 - DNA, 25 bp, Mus musculus
tcggcaaccagcgtgacaacagatg

SEQ ID NO: 780984 - DNA, 25 bp, Mus musculus
tcggcaacctcaatgagttctctgg

SEQ ID NO: 780985 - DNA, 25 bp, Mus musculus
tcggcaacctcattgagttctctgg

SEQ ID NO: 780986 - DNA, 25 bp, Mus musculus
tcggcaagaaggagatgcgcatcct

SEQ ID NO: 780987 - DNA, 25 bp, Mus musculus
tcggcaagaaggtgatgcgcatcct

SEQ ID NO: 780988 - DNA, 25 bp, Mus musculus
tcggcaagcattactaccaatcagt

SEQ ID NO: 780989 - DNA, 25 bp, Mus musculus
tcggcaagcatttctaccaatcagt

SEQ ID NO: 780990 - DNA, 25 bp, Mus musculus
tcggcaagcttgctgtcctgctgag

SEQ ID NO: 780991 - DNA, 25 bp, Mus musculus
tcggcaagcttggtgtcctgctgag

SEQ ID NO: 780992 - DNA, 25 bp, Mus musculus
tcggcaaggaagagactgtgctagc

SEQ ID NO: 780993 - DNA, 25 bp, Mus musculus
tcggcaaggaagtgactgtgctagc

SEQ ID NO: 780994 - DNA, 25 bp, Mus musculus
tcggcaaggataacttctgggccaa

SEQ ID NO: 780995 - DNA, 25 bp, Mus musculus
tcggcaaggatatcttctgggccaa

SEQ ID NO: 780996 - DNA, 25 bp, Mus musculus
tcggcaaggtaacttggacaaggac

SEQ ID NO: 780997 - DNA, 25 bp, Mus musculus
tcggcaaggtaagttggacaaggac

SEQ ID NO: 780998 - DNA, 25 bp, Mus musculus
tcggcaatctgcatatgtacgtgaa

SEQ ID NO: 780999 - DNA, 25 bp, Mus musculus
tcggcaatctgcttatgtacgtgaa

SEQ ID NO: 781000 - DNA, 25 bp, Mus musculus
tcggcacactgaagatgagatgaca

SEQ ID NO: 781001 - DNA, 25 bp, Mus musculus
tcggcacactgatgatgagatgaca

SEQ ID NO: 781002 - DNA, 25 bp, Mus musculus
tcggcacccattagcccaggcagtg

SEQ ID NO: 781003 - DNA, 25 bp, Mus musculus
tcggcacccatttgcccaggcagtg

SEQ ID NO: 781004 - DNA, 25 bp, Mus musculus
tcggcaccctggaagctgacttaca

SEQ ID NO: 781005 - DNA, 25 bp, Mus musculus
tcggcaccctggtagctgacttaca

SEQ ID NO: 781006 - DNA, 25 bp, Mus musculus
tcggcactcggcacagcatcgcggg

SEQ ID NO: 781007 - DNA, 25 bp, Mus musculus
tcggcactcggctcagcatcgcggg

SEQ ID NO: 781008 - DNA, 25 bp, Mus musculus
tcggcactgagaccggcatcctgaa

SEQ ID NO: 781009 - DNA, 25 bp, Mus musculus
tcggcactgagagcggcatcctgaa

SEQ ID NO: 781010 - DNA, 25 bp, Mus musculus
tcggcactggtacaggaaactgctt

SEQ ID NO: 781011 - DNA, 25 bp, Mus musculus
tcggcactggtagaggaaactgctt

SEQ ID NO: 781012 - DNA, 25 bp, Mus musculus
tcggcactgtccagagctagcggag

SEQ ID NO: 781013 - DNA, 25 bp, Mus musculus
tcggcactgtcctgagctagcggag

SEQ ID NO: 781014 - DNA, 25 bp, Mus musculus
tcggcagaacaacaccaataaaaat

SEQ ID NO: 781015 - DNA, 25 bp, Mus musculus
tcggcagaacaagaccaataaaaat

SEQ ID NO: 781016 - DNA, 25 bp, Mus musculus
tcggcagaagatccgcgagtgccat

SEQ ID NO: 781017 - DNA, 25 bp, Mus musculus
tcggcagaagatgcgcgagtgccat

SEQ ID NO: 781018 - DNA, 25 bp, Mus musculus
tcggcagatcaaagacatccagttg

SEQ ID NO: 781019 - DNA, 25 bp, Mus musculus
tcggcagatcaatgacatccagttg

SEQ ID NO: 781020 - DNA, 25 bp, Mus musculus
tcggcagccactcaagcgtggtgct

SEQ ID NO: 781021 - DNA, 25 bp, Mus musculus
tcggcagccactgaagcgtggtgct

SEQ ID NO: 781022 - DNA, 25 bp, Mus musculus
tcggcagcggtcattttgtgggcct

SEQ ID NO: 781023 - DNA, 25 bp, Mus musculus
tcggcagcggtctttttgtgggcct

SEQ ID NO: 781024 - DNA, 25 bp, Mus musculus
tcggcagctcctagacacccttggg

SEQ ID NO: 781025 - DNA, 25 bp, Mus musculus
tcggcagctccttgacacccttggg

SEQ ID NO: 781026 - DNA, 25 bp, Mus musculus
tcggcagctgaacctggacaatcag

SEQ ID NO: 781027 - DNA, 25 bp, Mus musculus
tcggcagctgaagctggacaatcag

SEQ ID NO: 781028 - DNA, 25 bp, Mus musculus
tcggcagctgcgctcattcggagtc

SEQ ID NO: 781029 - DNA, 25 bp, Mus musculus
tcggcagctgcggtcattcggagtc

SEQ ID NO: 781030 - DNA, 25 bp, Mus musculus
tcggcagctggaaaacgaacttgac

SEQ ID NO: 781031 - DNA, 25 bp, Mus musculus
tcggcagctggataacgaacttgac

SEQ ID NO: 781032 - DNA, 25 bp, Mus musculus
tcggcagcttgcactcatcggagat

SEQ ID NO: 781033 - DNA, 25 bp, Mus musculus
tcggcagcttgctctcatcggagat

SEQ ID NO: 781034 - DNA, 25 bp, Mus musculus
tcggcaggaggcatatctaggcact

SEQ ID NO: 781035 - DNA, 25 bp, Mus musculus
tcggcaggaggcttatctaggcact

SEQ ID NO: 781036 - DNA, 25 bp, Mus musculus
tcggcagtcagtccatgcagcctaa

SEQ ID NO: 781037 - DNA, 25 bp, Mus musculus
tcggcagtcagtgcatgcagcctaa

SEQ ID NO: 781038 - DNA, 25 bp, Mus musculus
tcggcagtgcgacgcccgcctggag

SEQ ID NO: 781039 - DNA, 25 bp, Mus musculus
tcggcagtgcgaggcccgcctggag

SEQ ID NO: 781040 - DNA, 25 bp, Mus musculus
tcggcatagaacaagaacattgagt

SEQ ID NO: 781041 - DNA, 25 bp, Mus musculus
tcggcatagaactagaacattgagt

SEQ ID NO: 781042 - DNA, 25 bp, Mus musculus
tcggcatctgtgagctgactgacct

SEQ ID NO: 781043 - DNA, 25 bp, Mus musculus
tcggcatctgtgtgctgactgacct

SEQ ID NO: 781044 - DNA, 25 bp, Mus musculus
tcggcatgaattattcaaaagaagg

SEQ ID NO: 781045 - DNA, 25 bp, Mus musculus
tcggcatgaatttttcaaaagaagg

SEQ ID NO: 781046 - DNA, 25 bp, Mus musculus
tcggcatggcgacaatgagtacaac

SEQ ID NO: 781047 - DNA, 25 bp, Mus musculus
tcggcatggcgagaatgagtacaac

SEQ ID NO: 781048 - DNA, 25 bp, Mus musculus
tcggcatgggttaccagtatgttgc

SEQ ID NO: 781049 - DNA, 25 bp, Mus musculus
tcggcatgggtttccagtatgttgc

SEQ ID NO: 781050 - DNA, 25 bp, Mus musculus
tcggcatgtgtgacattgacattcg

SEQ ID NO: 781051 - DNA, 25 bp, Mus musculus
tcggcatgtgtgtcattgacattcg

SEQ ID NO: 781052 - DNA, 25 bp, Mus musculus
tcggcattggcaatgcactctcagg

SEQ ID NO: 781053 - DNA, 25 bp, Mus musculus
tcggcattggcattgcactctcagg

SEQ ID NO: 781054 - DNA, 25 bp, Mus musculus
tcggccaaaggaagaagtatattct

SEQ ID NO: 781055 - DNA, 25 bp, Mus musculus
tcggccaaaggatgaagtatattct

SEQ ID NO: 781056 - DNA, 25 bp, Mus musculus
tcggccaacgatcccatttttcttc

SEQ ID NO: 781057 - DNA, 25 bp, Mus musculus
tcggccaacgatgccatttttcttc

SEQ ID NO: 781058 - DNA, 25 bp, Mus musculus
tcggccactgcgaggttccactcga

SEQ ID NO: 781059 - DNA, 25 bp, Mus musculus
tcggccactgcgtggttccactcga

SEQ ID NO: 781060 - DNA, 25 bp, Mus musculus
tcggccagcacgcttttattaatac

SEQ ID NO: 781061 - DNA, 25 bp, Mus musculus
tcggccagcacggttttattaatac

SEQ ID NO: 781062 - DNA, 25 bp, Mus musculus
tcggccaggcaacatgagaaagagt

SEQ ID NO: 781063 - DNA, 25 bp, Mus musculus
tcggccaggcaagatgagaaagagt

SEQ ID NO: 781064 - DNA, 25 bp, Mus musculus
tcggccagtgcactcagtggtgcca

SEQ ID NO: 781065 - DNA, 25 bp, Mus musculus
tcggccagtgcagtcagtggtgcca

SEQ ID NO: 781066 - DNA, 25 bp, Mus musculus
tcggccatacgaaaaagtccctgtc

SEQ ID NO: 781067 - DNA, 25 bp, Mus musculus
tcggccatacgataaagtccctgtc

SEQ ID NO: 781068 - DNA, 25 bp, Mus musculus
tcggccatggacatgaaggagtcgt

SEQ ID NO: 781069 - DNA, 25 bp, Mus musculus
tcggccatggacttgaaggagtcgt

SEQ ID NO: 781070 - DNA, 25 bp, Mus musculus
tcggcccagtcaagcccagctaatg

SEQ ID NO: 781071 - DNA, 25 bp, Mus musculus
tcggcccagtcatgcccagctaatg

SEQ ID NO: 781072 - DNA, 25 bp, Mus musculus
tcggccccgaaactgaggacaacga

SEQ ID NO: 781073 - DNA, 25 bp, Mus musculus
tcggccccgaaagtgaggacaacga

SEQ ID NO: 781074 - DNA, 25 bp, Mus musculus
tcggccccgcacagaagaggctgcg

SEQ ID NO: 781075 - DNA, 25 bp, Mus musculus
tcggccccgcactgaagaggctgcg

SEQ ID NO: 781076 - DNA, 25 bp, Mus musculus
tcggcccgagcgatggcgctgttcc

SEQ ID NO: 781077 - DNA, 25 bp, Mus musculus
tcggcccgagcgttggcgctgttcc

SEQ ID NO: 781078 - DNA, 25 bp, Mus musculus
tcggcccgtggcatggctctctatg

SEQ ID NO: 781079 - DNA, 25 bp, Mus musculus
tcggcccgtggcttggctctctatg

SEQ ID NO: 781080 - DNA, 25 bp, Mus musculus
tcggccctgtcccagaactttttag

SEQ ID NO: 781081 - DNA, 25 bp, Mus musculus
tcggccctgtccgagaactttttag

SEQ ID NO: 781082 - DNA, 25 bp, Mus musculus
tcggccgcagagaccaataggaagt

SEQ ID NO: 781083 - DNA, 25 bp, Mus musculus
tcggccgcagagtccaataggaagt

SEQ ID NO: 781084 - DNA, 25 bp, Mus musculus
tcggccgctatgcagacgtggttct

SEQ ID NO: 781085 - DNA, 25 bp, Mus musculus
tcggccgctatggagacgtggttct

SEQ ID NO: 781086 - DNA, 25 bp, Mus musculus
tcggccggagaacgctacggtcctt

SEQ ID NO: 781087 - DNA, 25 bp, Mus musculus
tcggccggagaaggctacggtcctt

SEQ ID NO: 781088 - DNA, 25 bp, Mus musculus
tcggccggagctatccagaacttgt

SEQ ID NO: 781089 - DNA, 25 bp, Mus musculus
tcggccggagctttccagaacttgt

SEQ ID NO: 781090 - DNA, 25 bp, Mus musculus
tcggccggtcctctctagctgggct

SEQ ID NO: 781091 - DNA, 25 bp, Mus musculus
tcggccggtcctgtctagctgggct

SEQ ID NO: 781092 - DNA, 25 bp, Mus musculus
tcggccggtgcgcatgtcgtcgggc

SEQ ID NO: 781093 - DNA, 25 bp, Mus musculus
tcggccggtgcggatgtcgtcgggc

SEQ ID NO: 781094 - DNA, 25 bp, Mus musculus
tcggccgtttccacggttagctcgc

SEQ ID NO: 781095 - DNA, 25 bp, Mus musculus
tcggccgtttcctcggttagctcgc

SEQ ID NO: 781096 - DNA, 25 bp, Mus musculus
tcggcctatgcactctgcacattcg

SEQ ID NO: 781097 - DNA, 25 bp, Mus musculus
tcggcctatgcagtctgcacattcg

SEQ ID NO: 781098 - DNA, 25 bp, Mus musculus
tcggcctcgtgtacctccagtcatt

SEQ ID NO: 781099 - DNA, 25 bp, Mus musculus
tcggcctcgtgttcctccagtcatt

SEQ ID NO: 781100 - DNA, 25 bp, Mus musculus
tcggcctgagaaatgagaattctct

SEQ ID NO: 781101 - DNA, 25 bp, Mus musculus
tcggcctgagaattgagaattctct

SEQ ID NO: 781102 - DNA, 25 bp, Mus musculus
tcggcctgccccagaaactctggag

SEQ ID NO: 781103 - DNA, 25 bp, Mus musculus
tcggcctgcccctgaaactctggag

SEQ ID NO: 781104 - DNA, 25 bp, Mus musculus
tcggcctggcgcagaatttctcagt

SEQ ID NO: 781105 - DNA, 25 bp, Mus musculus
tcggcctggcgctgaatttctcagt

SEQ ID NO: 781106 - DNA, 25 bp, Mus musculus
tcggcctgtggaagacattccggac

SEQ ID NO: 781107 - DNA, 25 bp, Mus musculus
tcggcctgtggatgacattccggac

SEQ ID NO: 781108 - DNA, 25 bp, Mus musculus
tcggcctgtgtaaacacagccctgc

SEQ ID NO: 781109 - DNA, 25 bp, Mus musculus
tcggcctgtgtatacacagccctgc

SEQ ID NO: 781110 - DNA, 25 bp, Mus musculus
tcggcctttctgcttctggccatgg

SEQ ID NO: 781111 - DNA, 25 bp, Mus musculus
tcggcctttctggttctggccatgg

SEQ ID NO: 781112 - DNA, 25 bp, Mus musculus
tcggccttttcgaccagtacttccg

SEQ ID NO: 781113 - DNA, 25 bp, Mus musculus
tcggccttttcgtccagtacttccg

SEQ ID NO: 781114 - DNA, 25 bp, Mus musculus
tcggcgaattaaagccctgaaccag

SEQ ID NO: 781115 - DNA, 25 bp, Mus musculus
tcggcgaattaatgccctgaaccag

SEQ ID NO: 781116 - DNA, 25 bp, Mus musculus
tcggcgaggactcagtcggcctcaa

SEQ ID NO: 781117 - DNA, 25 bp, Mus musculus
tcggcgaggactgagtcggcctcaa

SEQ ID NO: 781118 - DNA, 25 bp, Mus musculus
tcggcgatgcctactgtgcggagct

SEQ ID NO: 781119 - DNA, 25 bp, Mus musculus
tcggcgatgccttctgtgcggagct

SEQ ID NO: 781120 - DNA, 25 bp, Mus musculus
tcggcgcctcgaagcctggagcctg

SEQ ID NO: 781121 - DNA, 25 bp, Mus musculus
tcggcgcctcgatgcctggagcctg

SEQ ID NO: 781122 - DNA, 25 bp, Mus musculus
tcggcggaaccgaaggatctgctcc

SEQ ID NO: 781123 - DNA, 25 bp, Mus musculus
tcggcggaaccgtaggatctgctcc

SEQ ID NO: 781124 - DNA, 25 bp, Mus musculus
tcggcggagccacaactcattgaac

SEQ ID NO: 781125 - DNA, 25 bp, Mus musculus
tcggcggagccagaactcattgaac

SEQ ID NO: 781126 - DNA, 25 bp, Mus musculus
tcggcggcagagcaaaccctttcag

SEQ ID NO: 781127 - DNA, 25 bp, Mus musculus
tcggcggcagaggaaaccctttcag

SEQ ID NO: 781128 - DNA, 25 bp, Mus musculus
tcggcggctcccaatctcagaggga

SEQ ID NO: 781129 - DNA, 25 bp, Mus musculus
tcggcggctccctatctcagaggga

SEQ ID NO: 781130 - DNA, 25 bp, Mus musculus
tcggcgggaaaaccccttgttacat

SEQ ID NO: 781131 - DNA, 25 bp, Mus musculus
tcggcgggaaaagcccttgttacat

SEQ ID NO: 781132 - DNA, 25 bp, Mus musculus
tcggcgggcgctcatcctggtctca

SEQ ID NO: 781133 - DNA, 25 bp, Mus musculus
tcggcgggcgctgatcctggtctca

SEQ ID NO: 781134 - DNA, 25 bp, Mus musculus
tcggctacaaaacaggtcggctgcg

SEQ ID NO: 781135 - DNA, 25 bp, Mus musculus
tcggctacaaaagaggtcggctgcg

SEQ ID NO: 781136 - DNA, 25 bp, Mus musculus
tcggctacgacgacaccgatgagtc

SEQ ID NO: 781137 - DNA, 25 bp, Mus musculus
tcggctacgacgtcaccgatgagtc

SEQ ID NO: 781138 - DNA, 25 bp, Mus musculus
tcggctagcaacacagctgactgaa

SEQ ID NO: 781139 - DNA, 25 bp, Mus musculus
tcggctagcaactcagctgactgaa

SEQ ID NO: 781140 - DNA, 25 bp, Mus musculus
tcggctagttcgcaagcacaaatgc

SEQ ID NO: 781141 - DNA, 25 bp, Mus musculus
tcggctagttcggaagcacaaatgc

SEQ ID NO: 781142 - DNA, 25 bp, Mus musculus
tcggctatccaacgaagtggaagct

SEQ ID NO: 781143 - DNA, 25 bp, Mus musculus
tcggctatccaaggaagtggaagct

SEQ ID NO: 781144 - DNA, 25 bp, Mus musculus
tcggctatgtggacgacatgcaggt

SEQ ID NO: 781145 - DNA, 25 bp, Mus musculus
tcggctatgtggtcgacatgcaggt

SEQ ID NO: 781146 - DNA, 25 bp, Mus musculus
tcggctatttgcacaaacggagtgg

SEQ ID NO: 781147 - DNA, 25 bp, Mus musculus
tcggctatttgctcaaacggagtgg

SEQ ID NO: 781148 - DNA, 25 bp, Mus musculus
tcggctcagcagaggtgatgctcat

SEQ ID NO: 781149 - DNA, 25 bp, Mus musculus
tcggctcagcagtggtgatgctcat

SEQ ID NO: 781150 - DNA, 25 bp, Mus musculus
tcggctcagtgtcaacagcagggcc

SEQ ID NO: 781151 - DNA, 25 bp, Mus musculus
tcggctcagtgtgaacagcagggcc

SEQ ID NO: 781152 - DNA, 25 bp, Mus musculus
tcggctccatcaacgcgtcagtgaa

SEQ ID NO: 781153 - DNA, 25 bp, Mus musculus
tcggctccatcatcgcgtcagtgaa

SEQ ID NO: 781154 - DNA, 25 bp, Mus musculus
tcggctcctcctcgcatgtggtgat

SEQ ID NO: 781155 - DNA, 25 bp, Mus musculus
tcggctcctcctggcatgtggtgat

SEQ ID NO: 781156 - DNA, 25 bp, Mus musculus
tcggctcgtccacagtaatttgatg

SEQ ID NO: 781157 - DNA, 25 bp, Mus musculus
tcggctcgtccagagtaatttgatg

SEQ ID NO: 781158 - DNA, 25 bp, Mus musculus
tcggctctgggacttagttaaagaa

SEQ ID NO: 781159 - DNA, 25 bp, Mus musculus
tcggctctgggagttagttaaagaa

SEQ ID NO: 781160 - DNA, 25 bp, Mus musculus
tcggctctgtgcacgatcgatgcaa

SEQ ID NO: 781161 - DNA, 25 bp, Mus musculus
tcggctctgtgctcgatcgatgcaa

SEQ ID NO: 781162 - DNA, 25 bp, Mus musculus
tcggctgagcttcaggagcctcatc

SEQ ID NO: 781163 - DNA, 25 bp, Mus musculus
tcggctgagcttgaggagcctcatc

SEQ ID NO: 781164 - DNA, 25 bp, Mus musculus
tcggctgcaggtctcccatcggaag

SEQ ID NO: 781165 - DNA, 25 bp, Mus musculus
tcggctgcaggtgtcccatcggaag

SEQ ID NO: 781166 - DNA, 25 bp, Mus musculus
tcggctgcagttacgcccggaacgg

SEQ ID NO: 781167 - DNA, 25 bp, Mus musculus
tcggctgcagtttcgcccggaacgg

SEQ ID NO: 781168 - DNA, 25 bp, Mus musculus
tcggctgccacccaggacaaggcag

SEQ ID NO: 781169 - DNA, 25 bp, Mus musculus
tcggctgccaccgaggacaaggcag

SEQ ID NO: 781170 - DNA, 25 bp, Mus musculus
tcggctgctggtacgctaccgtggc

SEQ ID NO: 781171 - DNA, 25 bp, Mus musculus
tcggctgctggttcgctaccgtggc

SEQ ID NO: 781172 - DNA, 25 bp, Mus musculus
tcggctggagatccagccctttgcg

SEQ ID NO: 781173 - DNA, 25 bp, Mus musculus
tcggctggagatgcagccctttgcg

SEQ ID NO: 781174 - DNA, 25 bp, Mus musculus
tcggctgtcagacgtgcaggcctcc

SEQ ID NO: 781175 - DNA, 25 bp, Mus musculus
tcggctgtcagaggtgcaggcctcc

SEQ ID NO: 781176 - DNA, 25 bp, Mus musculus
tcggctgtgagtctttacggcaacc

SEQ ID NO: 781177 - DNA, 25 bp, Mus musculus
tcggctgtgagtgtttacggcaacc

SEQ ID NO: 781178 - DNA, 25 bp, Mus musculus
tcggcttagccgagacagtgacagc

SEQ ID NO: 781179 - DNA, 25 bp, Mus musculus
tcggcttagccgtgacagtgacagc

SEQ ID NO: 781180 - DNA, 25 bp, Mus musculus
tcggcttccacacaatgtattcgac

SEQ ID NO: 781181 - DNA, 25 bp, Mus musculus
tcggcttccacagaatgtattcgac

SEQ ID NO: 781182 - DNA, 25 bp, Mus musculus
tcggcttcggcgactctgcggttga

SEQ ID NO: 781183 - DNA, 25 bp, Mus musculus
tcggcttcggcgtctctgcggttga

SEQ ID NO: 781184 - DNA, 25 bp, Mus musculus
tcggcttctgcgacgagcgcctcgt

SEQ ID NO: 781185 - DNA, 25 bp, Mus musculus
tcggcttctgcgtcgagcgcctcgt

SEQ ID NO: 781186 - DNA, 25 bp, Mus musculus
tcggcttgcgcaccaacgtggactt

SEQ ID NO: 781187 - DNA, 25 bp, Mus musculus
tcggcttgcgcagcaacgtggactt

SEQ ID NO: 781188 - DNA, 25 bp, Mus musculus
tcgggaaaataaaactgcggatact

SEQ ID NO: 781189 - DNA, 25 bp, Mus musculus
tcgggaaaataatactgcggatact

SEQ ID NO: 781190 - DNA, 25 bp, Mus musculus
tcgggaaacaaaagaaccagtgaaa

SEQ ID NO: 781191 - DNA, 25 bp, Mus musculus
tcgggaaacaaatgaaccagtgaaa

SEQ ID NO: 781192 - DNA, 25 bp, Mus musculus
tcgggaaaccgaagactgcagtaat

SEQ ID NO: 781193 - DNA, 25 bp, Mus musculus
tcgggaaaccgatgactgcagtaat

SEQ ID NO: 781194 - DNA, 25 bp, Mus musculus
tcgggaaattgaccctgcgttatac

SEQ ID NO: 781195 - DNA, 25 bp, Mus musculus
tcgggaaattgagcctgcgttatac

SEQ ID NO: 781196 - DNA, 25 bp, Mus musculus
tcgggaacaagtcgcactgtatgtg

SEQ ID NO: 781197 - DNA, 25 bp, Mus musculus
tcgggaacaagtggcactgtatgtg

SEQ ID NO: 781198 - DNA, 25 bp, Mus musculus
tcgggaacagctcgagcacatcaag

SEQ ID NO: 781199 - DNA, 25 bp, Mus musculus
tcgggaacagctggagcacatcaag

SEQ ID NO: 781200 - DNA, 25 bp, Mus musculus
tcgggaacaggaaatcatggcgtcc

SEQ ID NO: 781201 - DNA, 25 bp, Mus musculus
tcgggaacaggatatcatggcgtcc

SEQ ID NO: 781202 - DNA, 25 bp, Mus musculus
tcgggaacctaccaggacatggaag

SEQ ID NO: 781203 - DNA, 25 bp, Mus musculus
tcgggaacctacgaggacatggaag

SEQ ID NO: 781204 - DNA, 25 bp, Mus musculus
tcgggaactctgcaccaggcaccag

SEQ ID NO: 781205 - DNA, 25 bp, Mus musculus
tcgggaactctggaccaggcaccag

SEQ ID NO: 781206 - DNA, 25 bp, Mus musculus
tcgggaagaagaacgtgtttgtgac

SEQ ID NO: 781207 - DNA, 25 bp, Mus musculus
tcgggaagaagatcgtgtttgtgac

SEQ ID NO: 781208 - DNA, 25 bp, Mus musculus
tcgggaagcattaacagtgagacac

SEQ ID NO: 781209 - DNA, 25 bp, Mus musculus
tcgggaagcatttacagtgagacac

SEQ ID NO: 781210 - DNA, 25 bp, Mus musculus
tcgggaagctccagcaggctcatga

SEQ ID NO: 781211 - DNA, 25 bp, Mus musculus
tcgggaagctcctgcaggctcatga

SEQ ID NO: 781212 - DNA, 25 bp, Mus musculus
tcgggaagctgacctgctgaccaac

SEQ ID NO: 781213 - DNA, 25 bp, Mus musculus
tcgggaagctgagctgctgaccaac

SEQ ID NO: 781214 - DNA, 25 bp, Mus musculus
tcgggaaggatcagtatccagccgt

SEQ ID NO: 781215 - DNA, 25 bp, Mus musculus
tcgggaaggatctgtatccagccgt

SEQ ID NO: 781216 - DNA, 25 bp, Mus musculus
tcgggaagttcaaccaagtcaacta

SEQ ID NO: 781217 - DNA, 25 bp, Mus musculus
tcgggaagttcatccaagtcaacta

SEQ ID NO: 781218 - DNA, 25 bp, Mus musculus
tcgggaatccgcagaggaaattcaa

SEQ ID NO: 781219 - DNA, 25 bp, Mus musculus
tcgggaatccgctgaggaaattcaa

SEQ ID NO: 781220 - DNA, 25 bp, Mus musculus
tcgggaatcgctaccatctgctgct

SEQ ID NO: 781221 - DNA, 25 bp, Mus musculus
tcgggaatcgcttccatctgctgct

SEQ ID NO: 781222 - DNA, 25 bp, Mus musculus
tcgggacacatcacaatccagctgt

SEQ ID NO: 781223 - DNA, 25 bp, Mus musculus
tcgggacacatctcaatccagctgt

SEQ ID NO: 781224 - DNA, 25 bp, Mus musculus
tcgggacactctacattctctatgt

SEQ ID NO: 781225 - DNA, 25 bp, Mus musculus
tcgggacactcttcattctctatgt

SEQ ID NO: 781226 - DNA, 25 bp, Mus musculus
tcgggacagcccatgatgacctcca

SEQ ID NO: 781227 - DNA, 25 bp, Mus musculus
tcgggacagcccttgatgacctcca

SEQ ID NO: 781228 - DNA, 25 bp, Mus musculus
tcgggaccgcgacggtcaatttctt

SEQ ID NO: 781229 - DNA, 25 bp, Mus musculus
tcgggaccgcgagggtcaatttctt

SEQ ID NO: 781230 - DNA, 25 bp, Mus musculus
tcgggacctcccacagggacgtgtc

SEQ ID NO: 781231 - DNA, 25 bp, Mus musculus
tcgggacctccctcagggacgtgtc

SEQ ID NO: 781232 - DNA, 25 bp, Mus musculus
tcgggacgctggacttttacatggc

SEQ ID NO: 781233 - DNA, 25 bp, Mus musculus
tcgggacgctggtcttttacatggc

SEQ ID NO: 781234 - DNA, 25 bp, Mus musculus
tcgggacgttcacaaccggattgta

SEQ ID NO: 781235 - DNA, 25 bp, Mus musculus
tcgggacgttcagaaccggattgta

SEQ ID NO: 781236 - DNA, 25 bp, Mus musculus
tcgggactcttgagctgaggccttg

SEQ ID NO: 781237 - DNA, 25 bp, Mus musculus
tcgggactcttgtgctgaggccttg

SEQ ID NO: 781238 - DNA, 25 bp, Mus musculus
tcgggactgtccagagaacgctgtg

SEQ ID NO: 781239 - DNA, 25 bp, Mus musculus
tcgggactgtcctgagaacgctgtg

SEQ ID NO: 781240 - DNA, 25 bp, Mus musculus
tcgggagaagtgctaagtcatactg

SEQ ID NO: 781241 - DNA, 25 bp, Mus musculus
tcgggagaagtggtaagtcatactg

SEQ ID NO: 781242 - DNA, 25 bp, Mus musculus
tcgggagacatgcacaaccaacatc

SEQ ID NO: 781243 - DNA, 25 bp, Mus musculus
tcgggagacatggacaaccaacatc

SEQ ID NO: 781244 - DNA, 25 bp, Mus musculus
tcgggagcctaaacagagcctgggt

SEQ ID NO: 781245 - DNA, 25 bp, Mus musculus
tcgggagcctaaaggaagactgact

SEQ ID NO: 781246 - DNA, 25 bp, Mus musculus
tcgggagcctaatcagagcctgggt

SEQ ID NO: 781247 - DNA, 25 bp, Mus musculus
tcgggagcctaatggaagactgact

SEQ ID NO: 781248 - DNA, 25 bp, Mus musculus
tcgggagcggcgaaccgcaacatat

SEQ ID NO: 781249 - DNA, 25 bp, Mus musculus
tcgggagcggcgtaccgcaacatat

SEQ ID NO: 781250 - DNA, 25 bp, Mus musculus
tcgggagctgagcacaaagcagcct

SEQ ID NO: 781251 - DNA, 25 bp, Mus musculus
tcgggagctgaggacaaagcagcct

SEQ ID NO: 781252 - DNA, 25 bp, Mus musculus
tcgggaggagttaaagccccgcctg

SEQ ID NO: 781253 - DNA, 25 bp, Mus musculus
tcgggaggagtttaagccccgcctg

SEQ ID NO: 781254 - DNA, 25 bp, Mus musculus
tcgggaggctgaccctccaacagcg

SEQ ID NO: 781255 - DNA, 25 bp, Mus musculus
tcgggaggctgagcctccaacagcg

SEQ ID NO: 781256 - DNA, 25 bp, Mus musculus
tcgggaggtctaagctttgctttac

SEQ ID NO: 781257 - DNA, 25 bp, Mus musculus
tcgggaggtctatgctttgctttac

SEQ ID NO: 781258 - DNA, 25 bp, Mus musculus
tcgggagtatcacctcaatgactct

SEQ ID NO: 781259 - DNA, 25 bp, Mus musculus
tcgggagtatcagctcaatgactct

SEQ ID NO: 781260 - DNA, 25 bp, Mus musculus
tcgggagtgccgaggtgaggcctgt

SEQ ID NO: 781261 - DNA, 25 bp, Mus musculus
tcgggagtgccgtggtgaggcctgt

SEQ ID NO: 781262 - DNA, 25 bp, Mus musculus
tcgggatactcaatggaatgtcagc

SEQ ID NO: 781263 - DNA, 25 bp, Mus musculus
tcgggatactcattggaatgtcagc

SEQ ID NO: 781264 - DNA, 25 bp, Mus musculus
tcgggatatcctatcactctgcatg

SEQ ID NO: 781265 - DNA, 25 bp, Mus musculus
tcgggatatcctttcactctgcatg

SEQ ID NO: 781266 - DNA, 25 bp, Mus musculus
tcgggatcatccagaaaacaggatt

SEQ ID NO: 781267 - DNA, 25 bp, Mus musculus
tcgggatcatcctgaaaacaggatt

SEQ ID NO: 781268 - DNA, 25 bp, Mus musculus
tcgggatctttgaggccttctgggc

SEQ ID NO: 781269 - DNA, 25 bp, Mus musculus
tcgggatctttgtggccttctgggc

SEQ ID NO: 781270 - DNA, 25 bp, Mus musculus
tcgggatgacaaagcctcgtatgtg

SEQ ID NO: 781271 - DNA, 25 bp, Mus musculus
tcgggatgacaatgcctcgtatgtg

SEQ ID NO: 781272 - DNA, 25 bp, Mus musculus
tcgggatgacctcgcaaggttacga

SEQ ID NO: 781273 - DNA, 25 bp, Mus musculus
tcgggatgacctggcaaggttacga

SEQ ID NO: 781274 - DNA, 25 bp, Mus musculus
tcgggatgcaccatcaagcagctac

SEQ ID NO: 781275 - DNA, 25 bp, Mus musculus
tcgggatgcaccttcaagcagctac

SEQ ID NO: 781276 - DNA, 25 bp, Mus musculus
tcgggatgccccatggttcgtccta

SEQ ID NO: 781277 - DNA, 25 bp, Mus musculus
tcgggatgccccttggttcgtccta

SEQ ID NO: 781278 - DNA, 25 bp, Mus musculus
tcgggatgccgaaacagggaagata

SEQ ID NO: 781279 - DNA, 25 bp, Mus musculus
tcgggatgccgatacagggaagata

SEQ ID NO: 781280 - DNA, 25 bp, Mus musculus
tcgggatggtccacatgaacgactg

SEQ ID NO: 781281 - DNA, 25 bp, Mus musculus
tcgggatggtcctcatgaacgactg

SEQ ID NO: 781282 - DNA, 25 bp, Mus musculus
tcgggatgtagacgcctggttcttc

SEQ ID NO: 781283 - DNA, 25 bp, Mus musculus
tcgggatgtagaggcctggttcttc

SEQ ID NO: 781284 - DNA, 25 bp, Mus musculus
tcgggatgtgtcagctcagtcgcct

SEQ ID NO: 781285 - DNA, 25 bp, Mus musculus
tcgggatgtgtctgctcagtcgcct

SEQ ID NO: 781286 - DNA, 25 bp, Mus musculus
tcgggattcccgacgtggaaggcaa

SEQ ID NO: 781287 - DNA, 25 bp, Mus musculus
tcgggattcccgtcgtggaaggcaa

SEQ ID NO: 781288 - DNA, 25 bp, Mus musculus
tcgggcaaacggagtaaacaataca

SEQ ID NO: 781289 - DNA, 25 bp, Mus musculus
tcgggcaaacggtgtaaacaataca

SEQ ID NO: 781290 - DNA, 25 bp, Mus musculus
tcgggcaagggcaaccacggcatgc

SEQ ID NO: 781291 - DNA, 25 bp, Mus musculus
tcgggcaagggctaccacggcatgc

SEQ ID NO: 781292 - DNA, 25 bp, Mus musculus
tcgggcaccaagcacttctgattct

SEQ ID NO: 781293 - DNA, 25 bp, Mus musculus
tcgggcaccaaggacttctgattct

SEQ ID NO: 781294 - DNA, 25 bp, Mus musculus
tcgggcaccaggcaagcaattgatt

SEQ ID NO: 781295 - DNA, 25 bp, Mus musculus
tcgggcaccagggaagcaattgatt

SEQ ID NO: 781296 - DNA, 25 bp, Mus musculus
tcgggcaccgtcaggttggcaccgc

SEQ ID NO: 781297 - DNA, 25 bp, Mus musculus
tcgggcaccgtctggttggcaccgc

SEQ ID NO: 781298 - DNA, 25 bp, Mus musculus
tcgggcacgtggacttcctacagga

SEQ ID NO: 781299 - DNA, 25 bp, Mus musculus
tcgggcacgtggtcttcctacagga

SEQ ID NO: 781300 - DNA, 25 bp, Mus musculus
tcgggcacttccaacagaatcaggt

SEQ ID NO: 781301 - DNA, 25 bp, Mus musculus
tcgggcacttcctacagaatcaggt

SEQ ID NO: 781302 - DNA, 25 bp, Mus musculus
tcgggcagagctagtgtgcctcagc

SEQ ID NO: 781303 - DNA, 25 bp, Mus musculus
tcgggcagagcttgtgtgcctcagc

SEQ ID NO: 781304 - DNA, 25 bp, Mus musculus
tcgggcatcgaacagcaggtcagcc

SEQ ID NO: 781305 - DNA, 25 bp, Mus musculus
tcgggcatcgaagagcaggtcagcc

SEQ ID NO: 781306 - DNA, 25 bp, Mus musculus
tcgggccaaacaagtgcaaatgtca

SEQ ID NO: 781307 - DNA, 25 bp, Mus musculus
tcgggccaaacatgtgcaaatgtca

SEQ ID NO: 781308 - DNA, 25 bp, Mus musculus
tcgggccaacggaatccaaggcttg

SEQ ID NO: 781309 - DNA, 25 bp, Mus musculus
tcgggccaacggtatccaaggcttg

SEQ ID NO: 781310 - DNA, 25 bp, Mus musculus
tcgggccaagatcgacgatatcgtg

SEQ ID NO: 781311 - DNA, 25 bp, Mus musculus
tcgggccaagatggacgatatcgtg

SEQ ID NO: 781312 - DNA, 25 bp, Mus musculus
tcgggccagacaacttgccgtatgt

SEQ ID NO: 781313 - DNA, 25 bp, Mus musculus
tcgggccagacatcttgccgtatgt

SEQ ID NO: 781314 - DNA, 25 bp, Mus musculus
tcgggccaggacagaacttctcaat

SEQ ID NO: 781315 - DNA, 25 bp, Mus musculus
tcgggccaggactgaacttctcaat

SEQ ID NO: 781316 - DNA, 25 bp, Mus musculus
tcgggccatggcagtcagcagctgc

SEQ ID NO: 781317 - DNA, 25 bp, Mus musculus
tcgggccatggctgtcagcagctgc

SEQ ID NO: 781318 - DNA, 25 bp, Mus musculus
tcgggcccatgtactcagggaaaag

SEQ ID NO: 781319 - DNA, 25 bp, Mus musculus
tcgggcccatgttctcagggaaaag

SEQ ID NO: 781320 - DNA, 25 bp, Mus musculus
tcgggcccctcaacactgcagggat

SEQ ID NO: 781321 - DNA, 25 bp, Mus musculus
tcgggcccctcatcactgcagggat

SEQ ID NO: 781322 - DNA, 25 bp, Mus musculus
tcgggccctaggagggtaactgcac

SEQ ID NO: 781323 - DNA, 25 bp, Mus musculus
tcgggccctaggtgggtaactgcac

SEQ ID NO: 781324 - DNA, 25 bp, Mus musculus
tcgggccgaaaactatgatatttcc

SEQ ID NO: 781325 - DNA, 25 bp, Mus musculus
tcgggccgaaaagtatgatatttcc

SEQ ID NO: 781326 - DNA, 25 bp, Mus musculus
tcgggcctacaaaggacagccatgg

SEQ ID NO: 781327 - DNA, 25 bp, Mus musculus
tcgggcctacaatggacagccatgg

SEQ ID NO: 781328 - DNA, 25 bp, Mus musculus
tcgggcctatagagatcacatatcg

SEQ ID NO: 781329 - DNA, 25 bp, Mus musculus
tcgggcctatagtgatcacatatcg

SEQ ID NO: 781330 - DNA, 25 bp, Mus musculus
tcgggcctcagccatctgattgctt

SEQ ID NO: 781331 - DNA, 25 bp, Mus musculus
tcgggcctcagcgatctgattgctt

SEQ ID NO: 781332 - DNA, 25 bp, Mus musculus
tcgggcctgtctacagtgggagcac

SEQ ID NO: 781333 - DNA, 25 bp, Mus musculus
tcgggcctgtcttcagtgggagcac

SEQ ID NO: 781334 - DNA, 25 bp, Mus musculus
tcgggcctgtgaccatctttggata

SEQ ID NO: 781335 - DNA, 25 bp, Mus musculus
tcgggcctgtgagcatctttggata

SEQ ID NO: 781336 - DNA, 25 bp, Mus musculus
tcgggccttggtcgaacatcaaatc

SEQ ID NO: 781337 - DNA, 25 bp, Mus musculus
tcgggccttggtggaacatcaaatc

SEQ ID NO: 781338 - DNA, 25 bp, Mus musculus
tcgggctactttctcagcatcgacg

SEQ ID NO: 781339 - DNA, 25 bp, Mus musculus
tcgggctactttgtcagcatcgacg

SEQ ID NO: 781340 - DNA, 25 bp, Mus musculus
tcgggctatctgagatacagctgtg

SEQ ID NO: 781341 - DNA, 25 bp, Mus musculus
tcgggctatctgtgatacagctgtg

SEQ ID NO: 781342 - DNA, 25 bp, Mus musculus
tcgggctatgcacgcttcatcatgc

SEQ ID NO: 781343 - DNA, 25 bp, Mus musculus
tcgggctatgcaggcttcatcatgc

SEQ ID NO: 781344 - DNA, 25 bp, Mus musculus
tcgggctccatcaggaaaccgaggc

SEQ ID NO: 781345 - DNA, 25 bp, Mus musculus
tcgggctccatctggaaaccgaggc

SEQ ID NO: 781346 - DNA, 25 bp, Mus musculus
tcgggctcctgtcccgtccgtctgt

SEQ ID NO: 781347 - DNA, 25 bp, Mus musculus
tcgggctcctgtgccgtccgtctgt

SEQ ID NO: 781348 - DNA, 25 bp, Mus musculus
tcgggctcctttattgcccgagaca

SEQ ID NO: 781349 - DNA, 25 bp, Mus musculus
tcgggctccttttttgcccgagaca

SEQ ID NO: 781350 - DNA, 25 bp, Mus musculus
tcgggctgagttagcagagagatca

SEQ ID NO: 781351 - DNA, 25 bp, Mus musculus
tcgggctgagtttgcagagagatca

SEQ ID NO: 781352 - DNA, 25 bp, Mus musculus
tcgggctgattgattctgtatgcgc

SEQ ID NO: 781353 - DNA, 25 bp, Mus musculus
tcgggctgattgtttctgtatgcgc

SEQ ID NO: 781354 - DNA, 25 bp, Mus musculus
tcgggctgatttaagggctgtcaac

SEQ ID NO: 781355 - DNA, 25 bp, Mus musculus
tcgggctgattttagggctgtcaac

SEQ ID NO: 781356 - DNA, 25 bp, Mus musculus
tcgggctgcaagatcggcccgtcca

SEQ ID NO: 781357 - DNA, 25 bp, Mus musculus
tcgggctgcaagttcggcccgtcca

SEQ ID NO: 781358 - DNA, 25 bp, Mus musculus
tcgggctgggacacccttaactatg

SEQ ID NO: 781359 - DNA, 25 bp, Mus musculus
tcgggctgggactcccttaactatg

SEQ ID NO: 781360 - DNA, 25 bp, Mus musculus
tcgggctgtgggacttacgccatct

SEQ ID NO: 781361 - DNA, 25 bp, Mus musculus
tcgggctgtgggtcttacgccatct

SEQ ID NO: 781362 - DNA, 25 bp, Mus musculus
tcgggcttccgcatccggtcggtct

SEQ ID NO: 781363 - DNA, 25 bp, Mus musculus
tcgggcttccgcttccggtcggtct

SEQ ID NO: 781364 - DNA, 25 bp, Mus musculus
tcgggcttcgggactttatctggag

SEQ ID NO: 781365 - DNA, 25 bp, Mus musculus
tcgggcttcgggtctttatctggag

SEQ ID NO: 781366 - DNA, 25 bp, Mus musculus
tcgggtaccgaacccatccttcttg

SEQ ID NO: 781367 - DNA, 25 bp, Mus musculus
tcgggtaccgaagccatccttcttg

SEQ ID NO: 781368 - DNA, 25 bp, Mus musculus
tcgggtacgtgacgcatgttgacaa

SEQ ID NO: 781369 - DNA, 25 bp, Mus musculus
tcgggtacgtgaggcatgttgacaa

SEQ ID NO: 781370 - DNA, 25 bp, Mus musculus
tcgggtatcctgatatgatcaaagc

SEQ ID NO: 781371 - DNA, 25 bp, Mus musculus
tcgggtatcctgttatgatcaaagc

SEQ ID NO: 781372 - DNA, 25 bp, Mus musculus
tcgggtcaagtcctactctttgtgg

SEQ ID NO: 781373 - DNA, 25 bp, Mus musculus
tcgggtcaagtcgtactctttgtgg

SEQ ID NO: 781374 - DNA, 25 bp, Mus musculus
tcgggtcatttcctttgaagagcag

SEQ ID NO: 781375 - DNA, 25 bp, Mus musculus
tcgggtcatttcgtttgaagagcag

SEQ ID NO: 781376 - DNA, 25 bp, Mus musculus
tcgggtcccaaccagtggatgaaaa

SEQ ID NO: 781377 - DNA, 25 bp, Mus musculus
tcgggtcccaacgagtggatgaaaa

SEQ ID NO: 781378 - DNA, 25 bp, Mus musculus
tcgggtctcttccacaaatacctgg

SEQ ID NO: 781379 - DNA, 25 bp, Mus musculus
tcgggtctcttcgacaaatacctgg

SEQ ID NO: 781380 - DNA, 25 bp, Mus musculus
tcgggtcttaccatcacccgctaga

SEQ ID NO: 781381 - DNA, 25 bp, Mus musculus
tcgggtcttaccttcacccgctaga

SEQ ID NO: 781382 - DNA, 25 bp, Mus musculus
tcgggtcttctcagaagtggaactg

SEQ ID NO: 781383 - DNA, 25 bp, Mus musculus
tcgggtcttctctgaagtggaactg

SEQ ID NO: 781384 - DNA, 25 bp, Mus musculus
tcgggtgactgcaccctcaggatga

SEQ ID NO: 781385 - DNA, 25 bp, Mus musculus
tcgggtgactgctccctcaggatga

SEQ ID NO: 781386 - DNA, 25 bp, Mus musculus
tcgggtgattcaccgccccggtcag

SEQ ID NO: 781387 - DNA, 25 bp, Mus musculus
tcgggtgattcagcgccccggtcag

SEQ ID NO: 781388 - DNA, 25 bp, Mus musculus
tcgggtggattaccagttggcttca

SEQ ID NO: 781389 - DNA, 25 bp, Mus musculus
tcgggtggattagcagttggcttca

SEQ ID NO: 781390 - DNA, 25 bp, Mus musculus
tcgggtggcctacgccaaggtcacc

SEQ ID NO: 781391 - DNA, 25 bp, Mus musculus
tcgggtggcctaggccaaggtcacc

SEQ ID NO: 781392 - DNA, 25 bp, Mus musculus
tcgggtggcgacatcctctccgtgc

SEQ ID NO: 781393 - DNA, 25 bp, Mus musculus
tcgggtggcgacttcctctccgtgc

SEQ ID NO: 781394 - DNA, 25 bp, Mus musculus
tcgggtggcgagctcttcctcttct

SEQ ID NO: 781395 - DNA, 25 bp, Mus musculus
tcgggtggcgaggtcttcctcttct

SEQ ID NO: 781396 - DNA, 25 bp, Mus musculus
tcgggtggcttacaagacagtgaca

SEQ ID NO: 781397 - DNA, 25 bp, Mus musculus
tcgggtggcttagaagacagtgaca

SEQ ID NO: 781398 - DNA, 25 bp, Mus musculus
tcgggtgtattcagcgctcacccac

SEQ ID NO: 781399 - DNA, 25 bp, Mus musculus
tcgggtgtattctgcgctcacccac

SEQ ID NO: 781400 - DNA, 25 bp, Mus musculus
tcgggttcaagcctcaagcattcgg

SEQ ID NO: 781401 - DNA, 25 bp, Mus musculus
tcgggttcaagcgtcaagcattcgg

SEQ ID NO: 781402 - DNA, 25 bp, Mus musculus
tcgggttgtagaagggatatttgct

SEQ ID NO: 781403 - DNA, 25 bp, Mus musculus
tcgggttgtagatgggatatttgct

SEQ ID NO: 781404 - DNA, 25 bp, Mus musculus
tcgggtttgcctccctcgtggagta

SEQ ID NO: 781405 - DNA, 25 bp, Mus musculus
tcgggtttgcctgcctcgtggagta

SEQ ID NO: 781406 - DNA, 25 bp, Mus musculus
tcggtaatggacctcatgccccata

SEQ ID NO: 781407 - DNA, 25 bp, Mus musculus
tcggtaatggacgtcatgccccata

SEQ ID NO: 781408 - DNA, 25 bp, Mus musculus
tcggtacaattacatagggcgtggt

SEQ ID NO: 781409 - DNA, 25 bp, Mus musculus
tcggtacaattagatagggcgtggt

SEQ ID NO: 781410 - DNA, 25 bp, Mus musculus
tcggtaccacggctctgctggcatt

SEQ ID NO: 781411 - DNA, 25 bp, Mus musculus
tcggtaccacgggtctgctggcatt

SEQ ID NO: 781412 - DNA, 25 bp, Mus musculus
tcggtacctctccaaggtcttggac

SEQ ID NO: 781413 - DNA, 25 bp, Mus musculus
tcggtacctctcgaaggtcttggac

SEQ ID NO: 781414 - DNA, 25 bp, Mus musculus
tcggtactaacccaggacagcatga

SEQ ID NO: 781415 - DNA, 25 bp, Mus musculus
tcggtactaaccgaggacagcatga

SEQ ID NO: 781416 - DNA, 25 bp, Mus musculus
tcggtatcaccacatggctccagtt

SEQ ID NO: 781417 - DNA, 25 bp, Mus musculus
tcggtatcaccagatggctccagtt

SEQ ID NO: 781418 - DNA, 25 bp, Mus musculus
tcggtatcgcccaagcttcgtgtct

SEQ ID NO: 781419 - DNA, 25 bp, Mus musculus
tcggtatcgccctagcttcgtgtct

SEQ ID NO: 781420 - DNA, 25 bp, Mus musculus
tcggtatgaccaccagcagttcaag

SEQ ID NO: 781421 - DNA, 25 bp, Mus musculus
tcggtatgaccagcagcagttcaag

SEQ ID NO: 781422 - DNA, 25 bp, Mus musculus
tcggtattctaacagtgctttcctt

SEQ ID NO: 781423 - DNA, 25 bp, Mus musculus
tcggtattctaagagtgctttcctt

SEQ ID NO: 781424 - DNA, 25 bp, Mus musculus
tcggtattgatcagctgcccatggt

SEQ ID NO: 781425 - DNA, 25 bp, Mus musculus
tcggtattgatctgctgcccatggt

SEQ ID NO: 781426 - DNA, 25 bp, Mus musculus
tcggtcaagacgcagggcatgtcct

SEQ ID NO: 781427 - DNA, 25 bp, Mus musculus
tcggtcaagacggagggcatgtcct

SEQ ID NO: 781428 - DNA, 25 bp, Mus musculus
tcggtcacgcggaggccaactttca

SEQ ID NO: 781429 - DNA, 25 bp, Mus musculus
tcggtcacgcggtggccaactttca

SEQ ID NO: 781430 - DNA, 25 bp, Mus musculus
tcggtcacgtgacagaaggttctgc

SEQ ID NO: 781431 - DNA, 25 bp, Mus musculus
tcggtcacgtgagagaaggttctgc

SEQ ID NO: 781432 - DNA, 25 bp, Mus musculus
tcggtcagatctaacaagagccacc

SEQ ID NO: 781433 - DNA, 25 bp, Mus musculus
tcggtcagatcttacaagagccacc

SEQ ID NO: 781434 - DNA, 25 bp, Mus musculus
tcggtcatacttccgccggaggatg

SEQ ID NO: 781435 - DNA, 25 bp, Mus musculus
tcggtcatacttgcgccggaggatg

SEQ ID NO: 781436 - DNA, 25 bp, Mus musculus
tcggtcatatagaactggttagttc

SEQ ID NO: 781437 - DNA, 25 bp, Mus musculus
tcggtcatatagtactggttagttc

SEQ ID NO: 781438 - DNA, 25 bp, Mus musculus
tcggtcatcgctctcttgggcatca

SEQ ID NO: 781439 - DNA, 25 bp, Mus musculus
tcggtcatcgctgtcttgggcatca

SEQ ID NO: 781440 - DNA, 25 bp, Mus musculus
tcggtccaggacatgagctgcatag

SEQ ID NO: 781441 - DNA, 25 bp, Mus musculus
tcggtccaggacttgagctgcatag

SEQ ID NO: 781442 - DNA, 25 bp, Mus musculus
tcggtcccgataccgttcttaaaca

SEQ ID NO: 781443 - DNA, 25 bp, Mus musculus
tcggtcccgatagcgttcttaaaca

SEQ ID NO: 781444 - DNA, 25 bp, Mus musculus
tcggtccctctgcagagtttgcata

SEQ ID NO: 781445 - DNA, 25 bp, Mus musculus
tcggtccctctggagagtttgcata

SEQ ID NO: 781446 - DNA, 25 bp, Mus musculus
tcggtcctatgtctacgctgaagag

SEQ ID NO: 781447 - DNA, 25 bp, Mus musculus
tcggtcctatgtgtacgctgaagag

SEQ ID NO: 781448 - DNA, 25 bp, Mus musculus
tcggtcctccttccgtggagacgcg

SEQ ID NO: 781449 - DNA, 25 bp, Mus musculus
tcggtcctccttgcgtggagacgcg

SEQ ID NO: 781450 - DNA, 25 bp, Mus musculus
tcggtcctttatcgagcagccgctg

SEQ ID NO: 781451 - DNA, 25 bp, Mus musculus
tcggtcctttatggagcagccgctg

SEQ ID NO: 781452 - DNA, 25 bp, Mus musculus
tcggtcggctggagcagcaaatgct

SEQ ID NO: 781453 - DNA, 25 bp, Mus musculus
tcggtcggctggtgcagcaaatgct

SEQ ID NO: 781454 - DNA, 25 bp, Mus musculus
tcggtcgtttcccttgaaggcagca

SEQ ID NO: 781455 - DNA, 25 bp, Mus musculus
tcggtcgtttccgttgaaggcagca

SEQ ID NO: 781456 - DNA, 25 bp, Mus musculus
tcggtctccagtcttcagtgccatg

SEQ ID NO: 781457 - DNA, 25 bp, Mus musculus
tcggtctccagtgttcagtgccatg

SEQ ID NO: 781458 - DNA, 25 bp, Mus musculus
tcggtctgacctactgtgatgctga

SEQ ID NO: 781459 - DNA, 25 bp, Mus musculus
tcggtctgaccttctgtgatgctga

SEQ ID NO: 781460 - DNA, 25 bp, Mus musculus
tcggtctgcacacggagctctaatc

SEQ ID NO: 781461 - DNA, 25 bp, Mus musculus
tcggtctgcacagggagctctaatc

SEQ ID NO: 781462 - DNA, 25 bp, Mus musculus
tcggtctgtaaacattacctgtgaa

SEQ ID NO: 781463 - DNA, 25 bp, Mus musculus
tcggtctgtaaagattacctgtgaa

SEQ ID NO: 781464 - DNA, 25 bp, Mus musculus
tcggtctgtgaccaccctactgttg

SEQ ID NO: 781465 - DNA, 25 bp, Mus musculus
tcggtctgtgacgaccctactgttg

SEQ ID NO: 781466 - DNA, 25 bp, Mus musculus
tcggtctttgccatctttttcccag

SEQ ID NO: 781467 - DNA, 25 bp, Mus musculus
tcggtctttgccttctttttcccag

SEQ ID NO: 781468 - DNA, 25 bp, Mus musculus
tcggtgaaggccctctacacagtcg

SEQ ID NO: 781469 - DNA, 25 bp, Mus musculus
tcggtgaaggccgtctacacagtcg

SEQ ID NO: 781470 - DNA, 25 bp, Mus musculus
tcggtgacaattaggctttgggccc

SEQ ID NO: 781471 - DNA, 25 bp, Mus musculus
tcggtgacaatttggctttgggccc

SEQ ID NO: 781472 - DNA, 25 bp, Mus musculus
tcggtgactctgaagcttcttcaga

SEQ ID NO: 781473 - DNA, 25 bp, Mus musculus
tcggtgactctgtagcttcttcaga

SEQ ID NO: 781474 - DNA, 25 bp, Mus musculus
tcggtgatcccgagtgtgccctatc

SEQ ID NO: 781475 - DNA, 25 bp, Mus musculus
tcggtgatcccgtgtgtgccctatc

SEQ ID NO: 781476 - DNA, 25 bp, Mus musculus
tcggtgatgagcagagccacacgtg

SEQ ID NO: 781477 - DNA, 25 bp, Mus musculus
tcggtgatgagctgagccacacgtg

SEQ ID NO: 781478 - DNA, 25 bp, Mus musculus
tcggtgatgcgaccctgtacgtgcc

SEQ ID NO: 781479 - DNA, 25 bp, Mus musculus
tcggtgatgcgagcctgtacgtgcc

SEQ ID NO: 781480 - DNA, 25 bp, Mus musculus
tcggtgcacctgagacggccacctt

SEQ ID NO: 781481 - DNA, 25 bp, Mus musculus
tcggtgcacctgtgacggccacctt

SEQ ID NO: 781482 - DNA, 25 bp, Mus musculus
tcggtgcagcagcacatcaagttct

SEQ ID NO: 781483 - DNA, 25 bp, Mus musculus
tcggtgcagcaggacatcaagttct

SEQ ID NO: 781484 - DNA, 25 bp, Mus musculus
tcggtgcattaccatcccatgatcg

SEQ ID NO: 781485 - DNA, 25 bp, Mus musculus
tcggtgcattacgatcccatgatcg

SEQ ID NO: 781486 - DNA, 25 bp, Mus musculus
tcggtgcccacactctggaagaagc

SEQ ID NO: 781487 - DNA, 25 bp, Mus musculus
tcggtgcccacagtctggaagaagc

SEQ ID NO: 781488 - DNA, 25 bp, Mus musculus
tcggtgccctcccattcgccgtggg

SEQ ID NO: 781489 - DNA, 25 bp, Mus musculus
tcggtgccctccgattcgccgtggg

SEQ ID NO: 781490 - DNA, 25 bp, Mus musculus
tcggtgcctccccttgcagttggac

SEQ ID NO: 781491 - DNA, 25 bp, Mus musculus
tcggtgcctcccgttgcagttggac

SEQ ID NO: 781492 - DNA, 25 bp, Mus musculus
tcggtgcgcgcgaaccgatacgagc

SEQ ID NO: 781493 - DNA, 25 bp, Mus musculus
tcggtgcgcgcgtaccgatacgagc

SEQ ID NO: 781494 - DNA, 25 bp, Mus musculus
tcggtgcggccccttgttatgacga

SEQ ID NO: 781495 - DNA, 25 bp, Mus musculus
tcggtgcggcccgttgttatgacga

SEQ ID NO: 781496 - DNA, 25 bp, Mus musculus
tcggtgctaccgatgctgtgacccc

SEQ ID NO: 781497 - DNA, 25 bp, Mus musculus
tcggtgctaccgttgctgtgacccc

SEQ ID NO: 781498 - DNA, 25 bp, Mus musculus
tcggtgctgcagaggccgaagcccc

SEQ ID NO: 781499 - DNA, 25 bp, Mus musculus
tcggtgctgcagtggccgaagcccc

SEQ ID NO: 781500 - DNA, 25 bp, Mus musculus
tcggtgcttcgcaacatcacagact

SEQ ID NO: 781501 - DNA, 25 bp, Mus musculus
tcggtgcttcgctacatcacagact

SEQ ID NO: 781502 - DNA, 25 bp, Mus musculus
tcggtggccgatcgctgatgtcttc

SEQ ID NO: 781503 - DNA, 25 bp, Mus musculus
tcggtggccgatggctgatgtcttc

SEQ ID NO: 781504 - DNA, 25 bp, Mus musculus
tcggtggcctggcaacatcggtttc

SEQ ID NO: 781505 - DNA, 25 bp, Mus musculus
tcggtggcctgggaacatcggtttc

SEQ ID NO: 781506 - DNA, 25 bp, Mus musculus
tcggtggcgtccacagcggcttccg

SEQ ID NO: 781507 - DNA, 25 bp, Mus musculus
tcggtggcgtcctcagcggcttccg

SEQ ID NO: 781508 - DNA, 25 bp, Mus musculus
tcggtggctactctggccctgagtc

SEQ ID NO: 781509 - DNA, 25 bp, Mus musculus
tcggtggctactgtggccctgagtc

SEQ ID NO: 781510 - DNA, 25 bp, Mus musculus
tcggtgggcaccaccggcaagctct

SEQ ID NO: 781511 - DNA, 25 bp, Mus musculus
tcggtgggcacctccggcaagctct

SEQ ID NO: 781512 - DNA, 25 bp, Mus musculus
tcggtggtaaatcgagacaaaccca

SEQ ID NO: 781513 - DNA, 25 bp, Mus musculus
tcggtggtaaatggagacaaaccca

SEQ ID NO: 781514 - DNA, 25 bp, Mus musculus
tcggtggtcctgcaccctgcagact

SEQ ID NO: 781515 - DNA, 25 bp, Mus musculus
tcggtggtcctggaccctgcagact

SEQ ID NO: 781516 - DNA, 25 bp, Mus musculus
tcggtggtgtccacaaaagtcaact

SEQ ID NO: 781517 - DNA, 25 bp, Mus musculus
tcggtggtgtcctcaaaagtcaact

SEQ ID NO: 781518 - DNA, 25 bp, Mus musculus
tcggtgtcacctcacagcaacttct

SEQ ID NO: 781519 - DNA, 25 bp, Mus musculus
tcggtgtcacctgacagcaacttct

SEQ ID NO: 781520 - DNA, 25 bp, Mus musculus
tcggtgtcctctagctgtccagctc

SEQ ID NO: 781521 - DNA, 25 bp, Mus musculus
tcggtgtcctcttgctgtccagctc

SEQ ID NO: 781522 - DNA, 25 bp, Mus musculus
tcggtgtgccacagatcggcgagtt

SEQ ID NO: 781523 - DNA, 25 bp, Mus musculus
tcggtgtgccactgatcggcgagtt

SEQ ID NO: 781524 - DNA, 25 bp, Mus musculus
tcggtgtgctgcagttacgcaggcc

SEQ ID NO: 781525 - DNA, 25 bp, Mus musculus
tcggtgtgctgctgttacgcaggcc

SEQ ID NO: 781526 - DNA, 25 bp, Mus musculus
tcggtgtggagccaaagtacgctac

SEQ ID NO: 781527 - DNA, 25 bp, Mus musculus
tcggtgtggagcgaaagtacgctac

SEQ ID NO: 781528 - DNA, 25 bp, Mus musculus
tcggtgtgttcaagaacggccgcgt

SEQ ID NO: 781529 - DNA, 25 bp, Mus musculus
tcggtgtgttcatgaacggccgcgt

SEQ ID NO: 781530 - DNA, 25 bp, Mus musculus
tcggtgttccgaccagaaatcgcaa

SEQ ID NO: 781531 - DNA, 25 bp, Mus musculus
tcggtgttccgagcagaaatcgcaa

SEQ ID NO: 781532 - DNA, 25 bp, Mus musculus
tcggtgttccgcacaatcagctggg

SEQ ID NO: 781533 - DNA, 25 bp, Mus musculus
tcggtgttccgctcaatcagctggg

SEQ ID NO: 781534 - DNA, 25 bp, Mus musculus
tcggtgttggtaagcactgtgccaa

SEQ ID NO: 781535 - DNA, 25 bp, Mus musculus
tcggtgttggtatgcactgtgccaa

SEQ ID NO: 781536 - DNA, 25 bp, Mus musculus
tcggttaagcatatcttactgtcgg

SEQ ID NO: 781537 - DNA, 25 bp, Mus musculus
tcggttaagcatttcttactgtcgg

SEQ ID NO: 781538 - DNA, 25 bp, Mus musculus
tcggttaaggttcctgacaagctgc

SEQ ID NO: 781539 - DNA, 25 bp, Mus musculus
tcggttaaggttgctgacaagctgc

SEQ ID NO: 781540 - DNA, 25 bp, Mus musculus
tcggttacaccaatgggaactggag

SEQ ID NO: 781541 - DNA, 25 bp, Mus musculus
tcggttacaccattgggaactggag

SEQ ID NO: 781542 - DNA, 25 bp, Mus musculus
tcggttacatctcggaagcacacct

SEQ ID NO: 781543 - DNA, 25 bp, Mus musculus
tcggttacatctgggaagcacacct

SEQ ID NO: 781544 - DNA, 25 bp, Mus musculus
tcggttcacagacaaagatccacag

SEQ ID NO: 781545 - DNA, 25 bp, Mus musculus
tcggttcacagagaaagatccacag

SEQ ID NO: 781546 - DNA, 25 bp, Mus musculus
tcggttcactgtacctcatcttcaa

SEQ ID NO: 781547 - DNA, 25 bp, Mus musculus
tcggttcactgttcctcatcttcaa

SEQ ID NO: 781548 - DNA, 25 bp, Mus musculus
tcggttcagcaacaaacagaagaaa

SEQ ID NO: 781549 - DNA, 25 bp, Mus musculus
tcggttcagcaagaaacagaagaaa

SEQ ID NO: 781550 - DNA, 25 bp, Mus musculus
tcggttcagtctccgtgaagcgttt

SEQ ID NO: 781551 - DNA, 25 bp, Mus musculus
tcggttcagtctgcgtgaagcgttt

SEQ ID NO: 781552 - DNA, 25 bp, Mus musculus
tcggttccatttatgcactctttgg

SEQ ID NO: 781553 - DNA, 25 bp, Mus musculus
tcggttccatttttgcactctttgg

SEQ ID NO: 781554 - DNA, 25 bp, Mus musculus
tcggttccccaaaatcttgaaagaa

SEQ ID NO: 781555 - DNA, 25 bp, Mus musculus
tcggttccccaatatcttgaaagaa

SEQ ID NO: 781556 - DNA, 25 bp, Mus musculus
tcggttctccaccaggctacatcgg

SEQ ID NO: 781557 - DNA, 25 bp, Mus musculus
tcggttctccacgaggctacatcgg

SEQ ID NO: 781558 - DNA, 25 bp, Mus musculus
tcggttgagaaaattgagaaaatct

SEQ ID NO: 781559 - DNA, 25 bp, Mus musculus
tcggttgagaaatttgagaaaatct

SEQ ID NO: 781560 - DNA, 25 bp, Mus musculus
tcggttggatagacggagtgtcctt

SEQ ID NO: 781561 - DNA, 25 bp, Mus musculus
tcggttggatagtcggagtgtcctt

SEQ ID NO: 781562 - DNA, 25 bp, Mus musculus
tcggttgtgatactgccctgaatgt

SEQ ID NO: 781563 - DNA, 25 bp, Mus musculus
tcggttgtgatagtgccctgaatgt

SEQ ID NO: 781564 - DNA, 25 bp, Mus musculus
tcggttgttctgacgtgtgctgcta

SEQ ID NO: 781565 - DNA, 25 bp, Mus musculus
tcggttgttctgtcgtgtgctgcta

SEQ ID NO: 781566 - DNA, 25 bp, Mus musculus
tcggtttatcatcgtaatgggagcc

SEQ ID NO: 781567 - DNA, 25 bp, Mus musculus
tcggtttatcatggtaatgggagcc

SEQ ID NO: 781568 - DNA, 25 bp, Mus musculus
tcggtttccccaatttgaccaggtg

SEQ ID NO: 781569 - DNA, 25 bp, Mus musculus
tcggtttccccattttgaccaggtg

SEQ ID NO: 781570 - DNA, 25 bp, Mus musculus
tcggtttgggcgaatcatcaactcc

SEQ ID NO: 781571 - DNA, 25 bp, Mus musculus
tcggtttgggcgtatcatcaactcc

SEQ ID NO: 781572 - DNA, 25 bp, Mus musculus
tcggtttgtacaccccggcctctgg

SEQ ID NO: 781573 - DNA, 25 bp, Mus musculus
tcggtttgtacagcccggcctctgg

SEQ ID NO: 781574 - DNA, 25 bp, Mus musculus
tcggttttccccatcagagaaaggg

SEQ ID NO: 781575 - DNA, 25 bp, Mus musculus
tcggttttccccttcagagaaaggg

SEQ ID NO: 781576 - DNA, 25 bp, Mus musculus
tcggttttctgacggaacatcagct

SEQ ID NO: 781577 - DNA, 25 bp, Mus musculus
tcggttttctgagggaacatcagct

SEQ ID NO: 781578 - DNA, 25 bp, Mus musculus
tcggttttgcacaagccggcctcga

SEQ ID NO: 781579 - DNA, 25 bp, Mus musculus
tcggttttgcactagccggcctcga

SEQ ID NO: 781580 - DNA, 25 bp, Mus musculus
tcgtaaaaaagaacggctcagcagc

SEQ ID NO: 781581 - DNA, 25 bp, Mus musculus
tcgtaaaaaagatcggctcagcagc

SEQ ID NO: 781582 - DNA, 25 bp, Mus musculus
tcgtaaagccacactggatgaaatc

SEQ ID NO: 781583 - DNA, 25 bp, Mus musculus
tcgtaaagccactctggatgaaatc

SEQ ID NO: 781584 - DNA, 25 bp, Mus musculus
tcgtaaagcgtgagccgatgcgact

SEQ ID NO: 781585 - DNA, 25 bp, Mus musculus
tcgtaaagcgtgtgccgatgcgact

SEQ ID NO: 781586 - DNA, 25 bp, Mus musculus
tcgtaaagtcgcacattgagaagaa

SEQ ID NO: 781587 - DNA, 25 bp, Mus musculus
tcgtaaagtcgctcattgagaagaa

SEQ ID NO: 781588 - DNA, 25 bp, Mus musculus
tcgtaacaagaacggaaatacacca

SEQ ID NO: 781589 - DNA, 25 bp, Mus musculus
tcgtaacaagaagggaaatacacca

SEQ ID NO: 781590 - DNA, 25 bp, Mus musculus
tcgtaaccctgtcacctgtaatgcg

SEQ ID NO: 781591 - DNA, 25 bp, Mus musculus
tcgtaaccctgtgacctgtaatgcg

SEQ ID NO: 781592 - DNA, 25 bp, Mus musculus
tcgtaaccttgcagaactgtctctg

SEQ ID NO: 781593 - DNA, 25 bp, Mus musculus
tcgtaaccttgctgaactgtctctg

SEQ ID NO: 781594 - DNA, 25 bp, Mus musculus
tcgtaagagacaaagccaaccaggc

SEQ ID NO: 781595 - DNA, 25 bp, Mus musculus
tcgtaagagacatagccaaccaggc

SEQ ID NO: 781596 - DNA, 25 bp, Mus musculus
tcgtaagcggctacagctcttgccc

SEQ ID NO: 781597 - DNA, 25 bp, Mus musculus
tcgtaagcggcttcagctcttgccc

SEQ ID NO: 781598 - DNA, 25 bp, Mus musculus
tcgtaaggacccaaaatgggcacaa

SEQ ID NO: 781599 - DNA, 25 bp, Mus musculus
tcgtaaggaccctaaatgggcacaa

SEQ ID NO: 781600 - DNA, 25 bp, Mus musculus
tcgtaagtgagtccctcgcggccag

SEQ ID NO: 781601 - DNA, 25 bp, Mus musculus
tcgtaagtgagtgcctcgcggccag

SEQ ID NO: 781602 - DNA, 25 bp, Mus musculus
tcgtaagtgatcagagccgcttcgc

SEQ ID NO: 781603 - DNA, 25 bp, Mus musculus
tcgtaagtgatctgagccgcttcgc

SEQ ID NO: 781604 - DNA, 25 bp, Mus musculus
tcgtaataaagtcctcagcgtcagt

SEQ ID NO: 781605 - DNA, 25 bp, Mus musculus
tcgtaataaagtgctcagcgtcagt

SEQ ID NO: 781606 - DNA, 25 bp, Mus musculus
tcgtaataaataagaaacagcttca

SEQ ID NO: 781607 - DNA, 25 bp, Mus musculus
tcgtaataaatatgaaacagcttca

SEQ ID NO: 781608 - DNA, 25 bp, Mus musculus
tcgtaatatactacatagactcgtc

SEQ ID NO: 781609 - DNA, 25 bp, Mus musculus
tcgtaatatacttcatagactcgtc

SEQ ID NO: 781610 - DNA, 25 bp, Mus musculus
tcgtaatgccgacggtgagcctgta

SEQ ID NO: 781611 - DNA, 25 bp, Mus musculus
tcgtaatgccgagggtgagcctgta

SEQ ID NO: 781612 - DNA, 25 bp, Mus musculus
tcgtacacgtctagccctcattatc

SEQ ID NO: 781613 - DNA, 25 bp, Mus musculus
tcgtacacgtcttgccctcattatc

SEQ ID NO: 781614 - DNA, 25 bp, Mus musculus
tcgtacagaagaataaggaaacggt

SEQ ID NO: 781615 - DNA, 25 bp, Mus musculus
tcgtacagaagattaaggaaacggt

SEQ ID NO: 781616 - DNA, 25 bp, Mus musculus
tcgtacatccgactgctgggcatcc

SEQ ID NO: 781617 - DNA, 25 bp, Mus musculus
tcgtacatccgagtgctgggcatcc

SEQ ID NO: 781618 - DNA, 25 bp, Mus musculus
tcgtacatgtttcagctgcagttct

SEQ ID NO: 781619 - DNA, 25 bp, Mus musculus
tcgtacatgtttgagctgcagttct

SEQ ID NO: 781620 - DNA, 25 bp, Mus musculus
tcgtaccactgccagtgtgatcggg

SEQ ID NO: 781621 - DNA, 25 bp, Mus musculus
tcgtaccactgcgagtgtgatcggg

SEQ ID NO: 781622 - DNA, 25 bp, Mus musculus
tcgtacctgctgaggatggccggag

SEQ ID NO: 781623 - DNA, 25 bp, Mus musculus
tcgtacctgctgtggatggccggag

SEQ ID NO: 781624 - DNA, 25 bp, Mus musculus
tcgtacctggtgcatttggacatgg

SEQ ID NO: 781625 - DNA, 25 bp, Mus musculus
tcgtacctggtggatttggacatgg

SEQ ID NO: 781626 - DNA, 25 bp, Mus musculus
tcgtacgctgcgacgcggtgatgcc

SEQ ID NO: 781627 - DNA, 25 bp, Mus musculus
tcgtacgctgcgtcgcggtgatgcc

SEQ ID NO: 781628 - DNA, 25 bp, Mus musculus
tcgtactacatgatctcccgttcgc

SEQ ID NO: 781629 - DNA, 25 bp, Mus musculus
tcgtactacatgttctcccgttcgc

SEQ ID NO: 781630 - DNA, 25 bp, Mus musculus
tcgtactggactcgcaccgtctttg

SEQ ID NO: 781631 - DNA, 25 bp, Mus musculus
tcgtactggactggcaccgtctttg

SEQ ID NO: 781632 - DNA, 25 bp, Mus musculus
tcgtacttcggcactggctggattc

SEQ ID NO: 781633 - DNA, 25 bp, Mus musculus
tcgtacttcggctctggctggattc

SEQ ID NO: 781634 - DNA, 25 bp, Mus musculus
tcgtagcaggagcaaacacgctaat

SEQ ID NO: 781635 - DNA, 25 bp, Mus musculus
tcgtagcaggaggaaacacgctaat

SEQ ID NO: 781636 - DNA, 25 bp, Mus musculus
tcgtagccgcaaccaacagctgtac

SEQ ID NO: 781637 - DNA, 25 bp, Mus musculus
tcgtagccgcaagcaacagctgtac

SEQ ID NO: 781638 - DNA, 25 bp, Mus musculus
tcgtagccgcccctgtgcgttgcta

SEQ ID NO: 781639 - DNA, 25 bp, Mus musculus
tcgtagccgcccgtgtgcgttgcta

SEQ ID NO: 781640 - DNA, 25 bp, Mus musculus
tcgtagccgcgcaggtggcttcaat

SEQ ID NO: 781641 - DNA, 25 bp, Mus musculus
tcgtagccgcgctggtggcttcaat

SEQ ID NO: 781642 - DNA, 25 bp, Mus musculus
tcgtagctgacgacctggcaaagtt

SEQ ID NO: 781643 - DNA, 25 bp, Mus musculus
tcgtagctgacgtcctggcaaagtt

SEQ ID NO: 781644 - DNA, 25 bp, Mus musculus
tcgtaggaggaaaaaacgcaccagc

SEQ ID NO: 781645 - DNA, 25 bp, Mus musculus
tcgtaggaggaataaacgcaccagc

SEQ ID NO: 781646 - DNA, 25 bp, Mus musculus
tcgtaggcagaacgcattgggactc

SEQ ID NO: 781647 - DNA, 25 bp, Mus musculus
tcgtaggcagaaggcattgggactc

SEQ ID NO: 781648 - DNA, 25 bp, Mus musculus
tcgtagggaacactcatgggcagct

SEQ ID NO: 781649 - DNA, 25 bp, Mus musculus
tcgtagggaacagtcatgggcagct

SEQ ID NO: 781650 - DNA, 25 bp, Mus musculus
tcgtagtagtgaacaaagttgttgg

SEQ ID NO: 781651 - DNA, 25 bp, Mus musculus
tcgtagtagtgatcaaagttgttgg

SEQ ID NO: 781652 - DNA, 25 bp, Mus musculus
tcgtagtctccaactcgggctgggt

SEQ ID NO: 781653 - DNA, 25 bp, Mus musculus
tcgtagtctccatctcgggctgggt

SEQ ID NO: 781654 - DNA, 25 bp, Mus musculus
tcgtatagactacaagacttatctt

SEQ ID NO: 781655 - DNA, 25 bp, Mus musculus
tcgtatagactagaagacttatctt

SEQ ID NO: 781656 - DNA, 25 bp, Mus musculus
tcgtatcaagaaccctacaagagta

SEQ ID NO: 781657 - DNA, 25 bp, Mus musculus
tcgtatcaagaagcctacaagagta

SEQ ID NO: 781658 - DNA, 25 bp, Mus musculus
tcgtatcagctgattgcaattatca

SEQ ID NO: 781659 - DNA, 25 bp, Mus musculus
tcgtatcagctgtttgcaattatca

SEQ ID NO: 781660 - DNA, 25 bp, Mus musculus
tcgtatccgcggaaccgggaccaga

SEQ ID NO: 781661 - DNA, 25 bp, Mus musculus
tcgtatccgcggtaccgggaccaga

SEQ ID NO: 781662 - DNA, 25 bp, Mus musculus
tcgtatctccatacagtgccgcagc

SEQ ID NO: 781663 - DNA, 25 bp, Mus musculus
tcgtatctccattcagtgccgcagc

SEQ ID NO: 781664 - DNA, 25 bp, Mus musculus
tcgtatggaagacactgaaccgttc

SEQ ID NO: 781665 - DNA, 25 bp, Mus musculus
tcgtatggaagagactgaaccgttc

SEQ ID NO: 781666 - DNA, 25 bp, Mus musculus
tcgtatggcaaaacatcggtggcag

SEQ ID NO: 781667 - DNA, 25 bp, Mus musculus
tcgtatggcaaatcatcggtggcag

SEQ ID NO: 781668 - DNA, 25 bp, Mus musculus
tcgtatgggccaagtatttgttcaa

SEQ ID NO: 781669 - DNA, 25 bp, Mus musculus
tcgtatgggccatgtatttgttcaa

SEQ ID NO: 781670 - DNA, 25 bp, Mus musculus
tcgtcaacacaaacgatgccgtcgt

SEQ ID NO: 781671 - DNA, 25 bp, Mus musculus
tcgtcaacacaatcgatgccgtcgt

SEQ ID NO: 781672 - DNA, 25 bp, Mus musculus
tcgtcaacagccacttgacttctgg

SEQ ID NO: 781673 - DNA, 25 bp, Mus musculus
tcgtcaacagcctcttgacttctgg

SEQ ID NO: 781674 - DNA, 25 bp, Mus musculus
tcgtcaacgtgtcgtactctgtcaa

SEQ ID NO: 781675 - DNA, 25 bp, Mus musculus
tcgtcaacgtgtggtactctgtcaa

SEQ ID NO: 781676 - DNA, 25 bp, Mus musculus
tcgtcaactcccataccagcgagat

SEQ ID NO: 781677 - DNA, 25 bp, Mus musculus
tcgtcaactcccttaccagcgagat

SEQ ID NO: 781678 - DNA, 25 bp, Mus musculus
tcgtcaagacaactgtggcagcaga

SEQ ID NO: 781679 - DNA, 25 bp, Mus musculus
tcgtcaagacaagtgtggcagcaga

SEQ ID NO: 781680 - DNA, 25 bp, Mus musculus
tcgtcaagctggactccactgctac

SEQ ID NO: 781681 - DNA, 25 bp, Mus musculus
tcgtcaagctggtctccactgctac

SEQ ID NO: 781682 - DNA, 25 bp, Mus musculus
tcgtcaaggctgcaaacctgttcct

SEQ ID NO: 781683 - DNA, 25 bp, Mus musculus
tcgtcaaggctggaaacctgttcct

SEQ ID NO: 781684 - DNA, 25 bp, Mus musculus
tcgtcacagaagaggttgttgtggt

SEQ ID NO: 781685 - DNA, 25 bp, Mus musculus
tcgtcacagaagtggttgttgtggt

SEQ ID NO: 781686 - DNA, 25 bp, Mus musculus
tcgtcaccaagaatgggcagaagcg

SEQ ID NO: 781687 - DNA, 25 bp, Mus musculus
tcgtcaccaagattgggcagaagcg

SEQ ID NO: 781688 - DNA, 25 bp, Mus musculus
tcgtcaccacacaggtaaccatgtg

SEQ ID NO: 781689 - DNA, 25 bp, Mus musculus
tcgtcaccacactggtaaccatgtg

SEQ ID NO: 781690 - DNA, 25 bp, Mus musculus
tcgtcaccctgtctggtgcccaggg

SEQ ID NO: 781691 - DNA, 25 bp, Mus musculus
tcgtcaccctgtgtggtgcccaggg

SEQ ID NO: 781692 - DNA, 25 bp, Mus musculus
tcgtcaccgatgaagacagttggta

SEQ ID NO: 781693 - DNA, 25 bp, Mus musculus
tcgtcaccgatgtagacagttggta

SEQ ID NO: 781694 - DNA, 25 bp, Mus musculus
tcgtcacggcctattgctactcatg

SEQ ID NO: 781695 - DNA, 25 bp, Mus musculus
tcgtcacggccttttgctactcatg

SEQ ID NO: 781696 - DNA, 25 bp, Mus musculus
tcgtcacgggttcgagccattaaac

SEQ ID NO: 781697 - DNA, 25 bp, Mus musculus
tcgtcacgggttggagccattaaac

SEQ ID NO: 781698 - DNA, 25 bp, Mus musculus
tcgtcactggtacaaagagggcagc

SEQ ID NO: 781699 - DNA, 25 bp, Mus musculus
tcgtcactggtagaaagagggcagc

SEQ ID NO: 781700 - DNA, 25 bp, Mus musculus
tcgtcagacagcctcacattttact

SEQ ID NO: 781701 - DNA, 25 bp, Mus musculus
tcgtcagacagcgtcacattttact

SEQ ID NO: 781702 - DNA, 25 bp, Mus musculus
tcgtcagacattcatcatccaggag

SEQ ID NO: 781703 - DNA, 25 bp, Mus musculus
tcgtcagacattgatcatccaggag

SEQ ID NO: 781704 - DNA, 25 bp, Mus musculus
tcgtcagcctcaatgagaatatctt

SEQ ID NO: 781705 - DNA, 25 bp, Mus musculus
tcgtcagcctcattgagaatatctt

SEQ ID NO: 781706 - DNA, 25 bp, Mus musculus
tcgtcagcgcatcgaaatgctgctt

SEQ ID NO: 781707 - DNA, 25 bp, Mus musculus
tcgtcagcgcatggaaatgctgctt

SEQ ID NO: 781708 - DNA, 25 bp, Mus musculus
tcgtcaggaaaacaagagattacac

SEQ ID NO: 781709 - DNA, 25 bp, Mus musculus
tcgtcaggaaaagaagagattacac

SEQ ID NO: 781710 - DNA, 25 bp, Mus musculus
tcgtcaggaacaatgatgtctctgt

SEQ ID NO: 781711 - DNA, 25 bp, Mus musculus
tcgtcaggaacattgatgtctctgt

SEQ ID NO: 781712 - DNA, 25 bp, Mus musculus
tcgtcaggcagcagaggcacatcct

SEQ ID NO: 781713 - DNA, 25 bp, Mus musculus
tcgtcaggcagctgaggcacatcct

SEQ ID NO: 781714 - DNA, 25 bp, Mus musculus
tcgtcagggatgcttaatcagctca

SEQ ID NO: 781715 - DNA, 25 bp, Mus musculus
tcgtcagggatggttaatcagctca

SEQ ID NO: 781716 - DNA, 25 bp, Mus musculus
tcgtcagtggagattgttctgctgg

SEQ ID NO: 781717 - DNA, 25 bp, Mus musculus
tcgtcagtggagtttgttctgctgg

SEQ ID NO: 781718 - DNA, 25 bp, Mus musculus
tcgtcagtggccatctcatgctcct

SEQ ID NO: 781719 - DNA, 25 bp, Mus musculus
tcgtcagtggccttctcatgctcct

SEQ ID NO: 781720 - DNA, 25 bp, Mus musculus
tcgtcagtgttgcaccacgggatcc

SEQ ID NO: 781721 - DNA, 25 bp, Mus musculus
tcgtcagtgttggaccacgggatcc

SEQ ID NO: 781722 - DNA, 25 bp, Mus musculus
tcgtcatcatcaaatcacagcaagc

SEQ ID NO: 781723 - DNA, 25 bp, Mus musculus
tcgtcatcatcatatcacagcaagc

SEQ ID NO: 781724 - DNA, 25 bp, Mus musculus
tcgtcatcgccaagtccttgcagat

SEQ ID NO: 781725 - DNA, 25 bp, Mus musculus
tcgtcatcgccatgtccttgcagat

SEQ ID NO: 781726 - DNA, 25 bp, Mus musculus
tcgtcatcgctaaccccattttcag

SEQ ID NO: 781727 - DNA, 25 bp, Mus musculus
tcgtcatcgctatccccattttcag

SEQ ID NO: 781728 - DNA, 25 bp, Mus musculus
tcgtcatgacgtacctgtgccagat

SEQ ID NO: 781729 - DNA, 25 bp, Mus musculus
tcgtcatgacgttcctgtgccagat

SEQ ID NO: 781730 - DNA, 25 bp, Mus musculus
tcgtcatgatgaccacgcctgtggt

SEQ ID NO: 781731 - DNA, 25 bp, Mus musculus
tcgtcatgatgagcacgcctgtggt

SEQ ID NO: 781732 - DNA, 25 bp, Mus musculus
tcgtcatggccaacggcttcgtggg

SEQ ID NO: 781733 - DNA, 25 bp, Mus musculus
tcgtcatggccatcggcttcgtggg

SEQ ID NO: 781734 - DNA, 25 bp, Mus musculus
tcgtcatggcgactaaagggtaccc

SEQ ID NO: 781735 - DNA, 25 bp, Mus musculus
tcgtcatggcgagtaaagggtaccc

SEQ ID NO: 781736 - DNA, 25 bp, Mus musculus
tcgtcatgtcctcctatcaagactt

SEQ ID NO: 781737 - DNA, 25 bp, Mus musculus
tcgtcatgtcctgctatcaagactt

SEQ ID NO: 781738 - DNA, 25 bp, Mus musculus
tcgtcattctgcattttatccagct

SEQ ID NO: 781739 - DNA, 25 bp, Mus musculus
tcgtcattctgctttttatccagct

SEQ ID NO: 781740 - DNA, 25 bp, Mus musculus
tcgtccaaatacaggatgctttgag

SEQ ID NO: 781741 - DNA, 25 bp, Mus musculus
tcgtccaaatactggatgctttgag

SEQ ID NO: 781742 - DNA, 25 bp, Mus musculus
tcgtccaagcttagttcatccaggg

SEQ ID NO: 781743 - DNA, 25 bp, Mus musculus
tcgtccaagctttgttcatccaggg

SEQ ID NO: 781744 - DNA, 25 bp, Mus musculus
tcgtccacaccaacgaggagatcga

SEQ ID NO: 781745 - DNA, 25 bp, Mus musculus
tcgtccacaccatcgaggagatcga

SEQ ID NO: 781746 - DNA, 25 bp, Mus musculus
tcgtccacagcgaagaacctgagga

SEQ ID NO: 781747 - DNA, 25 bp, Mus musculus
tcgtccacagcgtagaacctgagga

SEQ ID NO: 781748 - DNA, 25 bp, Mus musculus
tcgtccaccatccagtgaggaagag

SEQ ID NO: 781749 - DNA, 25 bp, Mus musculus
tcgtccaccatcgagtgaggaagag

SEQ ID NO: 781750 - DNA, 25 bp, Mus musculus
tcgtccacgagtagcccaattccag

SEQ ID NO: 781751 - DNA, 25 bp, Mus musculus
tcgtccacgagttgcccaattccag

SEQ ID NO: 781752 - DNA, 25 bp, Mus musculus
tcgtccagagtaatttgatgagaaa

SEQ ID NO: 781753 - DNA, 25 bp, Mus musculus
tcgtccagagtattttgatgagaaa

SEQ ID NO: 781754 - DNA, 25 bp, Mus musculus
tcgtccagcagtcgcaagaggctct

SEQ ID NO: 781755 - DNA, 25 bp, Mus musculus
tcgtccagcagtggcaagaggctct

SEQ ID NO: 781756 - DNA, 25 bp, Mus musculus
tcgtccagggtgcaacgctgccctg

SEQ ID NO: 781757 - DNA, 25 bp, Mus musculus
tcgtccagggtggaacgctgccctg

SEQ ID NO: 781758 - DNA, 25 bp, Mus musculus
tcgtccatgtttatgagggcagtgc

SEQ ID NO: 781759 - DNA, 25 bp, Mus musculus
tcgtccatgtttttgagggcagtgc

SEQ ID NO: 781760 - DNA, 25 bp, Mus musculus
tcgtcccagagaagaggcttggcgc

SEQ ID NO: 781761 - DNA, 25 bp, Mus musculus
tcgtcccagagatgaggcttggcgc

SEQ ID NO: 781762 - DNA, 25 bp, Mus musculus
tcgtcccatgtcctgctgggcagtg

SEQ ID NO: 781763 - DNA, 25 bp, Mus musculus
tcgtcccatgtcgtgctgggcagtg

SEQ ID NO: 781764 - DNA, 25 bp, Mus musculus
tcgtcccggaccagaggagcaagtt

SEQ ID NO: 781765 - DNA, 25 bp, Mus musculus
tcgtcccggacctgaggagcaagtt

SEQ ID NO: 781766 - DNA, 25 bp, Mus musculus
tcgtccctcaacagcatgagagaag

SEQ ID NO: 781767 - DNA, 25 bp, Mus musculus
tcgtccctcaactgcatgagagaag

SEQ ID NO: 781768 - DNA, 25 bp, Mus musculus
tcgtccctgaagaagacattacctt

SEQ ID NO: 781769 - DNA, 25 bp, Mus musculus
tcgtccctgaagtagacattacctt

SEQ ID NO: 781770 - DNA, 25 bp, Mus musculus
tcgtccgaagacaggcacctgggct

SEQ ID NO: 781771 - DNA, 25 bp, Mus musculus
tcgtccgaagactggcacctgggct

SEQ ID NO: 781772 - DNA, 25 bp, Mus musculus
tcgtccgaagttccggagcagccac

SEQ ID NO: 781773 - DNA, 25 bp, Mus musculus
tcgtccgaagttgcggagcagccac

SEQ ID NO: 781774 - DNA, 25 bp, Mus musculus
tcgtccgagtgtctggccaagtaca

SEQ ID NO: 781775 - DNA, 25 bp, Mus musculus
tcgtccgagtgtgtggccaagtaca

SEQ ID NO: 781776 - DNA, 25 bp, Mus musculus
tcgtccgctataagcccgatgagca

SEQ ID NO: 781777 - DNA, 25 bp, Mus musculus
tcgtccgctatatgcccgatgagca

SEQ ID NO: 781778 - DNA, 25 bp, Mus musculus
tcgtccggtagtcttcggccagtcc

SEQ ID NO: 781779 - DNA, 25 bp, Mus musculus
tcgtccggtagtgttcggccagtcc

SEQ ID NO: 781780 - DNA, 25 bp, Mus musculus
tcgtccgtgagtacaagtccatggt

SEQ ID NO: 781781 - DNA, 25 bp, Mus musculus
tcgtccgtgagttcaagtccatggt

SEQ ID NO: 781782 - DNA, 25 bp, Mus musculus
tcgtccgtggccacaccacattggt

SEQ ID NO: 781783 - DNA, 25 bp, Mus musculus
tcgtccgtggcctcaccacattggt

SEQ ID NO: 781784 - DNA, 25 bp, Mus musculus
tcgtcctaaccccagacttcttgtt

SEQ ID NO: 781785 - DNA, 25 bp, Mus musculus
tcgtcctaacccgagacttcttgtt

SEQ ID NO: 781786 - DNA, 25 bp, Mus musculus
tcgtcctcaggaaccatggcatggt

SEQ ID NO: 781787 - DNA, 25 bp, Mus musculus
tcgtcctcaggatccatggcatggt

SEQ ID NO: 781788 - DNA, 25 bp, Mus musculus
tcgtcctcgtccaaaaagatgggca

SEQ ID NO: 781789 - DNA, 25 bp, Mus musculus
tcgtcctcgtcctaaaagatgggca

SEQ ID NO: 781790 - DNA, 25 bp, Mus musculus
tcgtcctgaggaaaaaagcaaaatt

SEQ ID NO: 781791 - DNA, 25 bp, Mus musculus
tcgtcctgaggataaaagcaaaatt

SEQ ID NO: 781792 - DNA, 25 bp, Mus musculus
tcgtcctgcggacaaaggtcaccta

SEQ ID NO: 781793 - DNA, 25 bp, Mus musculus
tcgtcctgcggagaaaggtcaccta

SEQ ID NO: 781794 - DNA, 25 bp, Mus musculus
tcgtcgaaggatacaggactcaggt

SEQ ID NO: 781795 - DNA, 25 bp, Mus musculus
tcgtcgaaggattcaggactcaggt

SEQ ID NO: 781796 - DNA, 25 bp, Mus musculus
tcgtcgagaacgagatgatggcgaa

SEQ ID NO: 781797 - DNA, 25 bp, Mus musculus
tcgtcgagaacgtgatgatggcgaa

SEQ ID NO: 781798 - DNA, 25 bp, Mus musculus
tcgtcgagcaagcatgcttctctta

SEQ ID NO: 781799 - DNA, 25 bp, Mus musculus
tcgtcgagcaaggatgcttctctta

SEQ ID NO: 781800 - DNA, 25 bp, Mus musculus
tcgtcgagcagtacgttgagtctca

SEQ ID NO: 781801 - DNA, 25 bp, Mus musculus
tcgtcgagcagttcgttgagtctca

SEQ ID NO: 781802 - DNA, 25 bp, Mus musculus
tcgtcgccgtgcaggccctggtgct

SEQ ID NO: 781803 - DNA, 25 bp, Mus musculus
tcgtcgccgtgctggccctggtgct

SEQ ID NO: 781804 - DNA, 25 bp, Mus musculus
tcgtcgccgtgtcccaaaatatggg

SEQ ID NO: 781805 - DNA, 25 bp, Mus musculus
tcgtcgccgtgtgccaaaatatggg

SEQ ID NO: 781806 - DNA, 25 bp, Mus musculus
tcgtcgcgcctgacctcttaaaaaa

SEQ ID NO: 781807 - DNA, 25 bp, Mus musculus
tcgtcgcgcctgtcctcttaaaaaa

SEQ ID NO: 781808 - DNA, 25 bp, Mus musculus
tcgtcgcgctctcacgatggctctg

SEQ ID NO: 781809 - DNA, 25 bp, Mus musculus
tcgtcgcgctctgacgatggctctg

SEQ ID NO: 781810 - DNA, 25 bp, Mus musculus
tcgtcgcggcttcgatttcaaactg

SEQ ID NO: 781811 - DNA, 25 bp, Mus musculus
tcgtcgcggcttggatttcaaactg

SEQ ID NO: 781812 - DNA, 25 bp, Mus musculus
tcgtcgcttgcaacccgggtcatgg

SEQ ID NO: 781813 - DNA, 25 bp, Mus musculus
tcgtcgcttgcatcccgggtcatgg

SEQ ID NO: 781814 - DNA, 25 bp, Mus musculus
tcgtcggactccatttgctattctt

SEQ ID NO: 781815 - DNA, 25 bp, Mus musculus
tcgtcggactccttttgctattctt

SEQ ID NO: 781816 - DNA, 25 bp, Mus musculus
tcgtcggagggaacttcattgttgt

SEQ ID NO: 781817 - DNA, 25 bp, Mus musculus
tcgtcggagggatcttcattgttgt

SEQ ID NO: 781818 - DNA, 25 bp, Mus musculus
tcgtcggccacaaagtatgccaggc

SEQ ID NO: 781819 - DNA, 25 bp, Mus musculus
tcgtcggccacatagtatgccaggc

SEQ ID NO: 781820 - DNA, 25 bp, Mus musculus
tcgtcggcgccacatatttctgtcc

SEQ ID NO: 781821 - DNA, 25 bp, Mus musculus
tcgtcggcgccagatatttctgtcc

SEQ ID NO: 781822 - DNA, 25 bp, Mus musculus
tcgtcggctgaaaaggtaaagtaga

SEQ ID NO: 781823 - DNA, 25 bp, Mus musculus
tcgtcggctgaataggtaaagtaga

SEQ ID NO: 781824 - DNA, 25 bp, Mus musculus
tcgtcgtgggacagtagccgtctgt

SEQ ID NO: 781825 - DNA, 25 bp, Mus musculus
tcgtcgtgggactgtagccgtctgt

SEQ ID NO: 781826 - DNA, 25 bp, Mus musculus
tcgtcgttcttgattttcaggtctc

SEQ ID NO: 781827 - DNA, 25 bp, Mus musculus
tcgtcgttcttgtttttcaggtctc

SEQ ID NO: 781828 - DNA, 25 bp, Mus musculus
tcgtctacaccacggacattgtctt

SEQ ID NO: 781829 - DNA, 25 bp, Mus musculus
tcgtctacaccagggacattgtctt

SEQ ID NO: 781830 - DNA, 25 bp, Mus musculus
tcgtctattaccactctggccgcga

SEQ ID NO: 781831 - DNA, 25 bp, Mus musculus
tcgtctattacctctctggccgcga

SEQ ID NO: 781832 - DNA, 25 bp, Mus musculus
tcgtctcaatagaatcaagaagctc

SEQ ID NO: 781833 - DNA, 25 bp, Mus musculus
tcgtctcaatagtatcaagaagctc

SEQ ID NO: 781834 - DNA, 25 bp, Mus musculus
tcgtctcagggaagtatgacagcgg

SEQ ID NO: 781835 - DNA, 25 bp, Mus musculus
tcgtctcagggatgtatgacagcgg

SEQ ID NO: 781836 - DNA, 25 bp, Mus musculus
tcgtctccaaggcacacatcattca

SEQ ID NO: 781837 - DNA, 25 bp, Mus musculus
tcgtctccaagggacacatcattca

SEQ ID NO: 781838 - DNA, 25 bp, Mus musculus
tcgtctccagaaaaccaaagctgtg

SEQ ID NO: 781839 - DNA, 25 bp, Mus musculus
tcgtctccagaataccaaagctgtg

SEQ ID NO: 781840 - DNA, 25 bp, Mus musculus
tcgtctcccatgcatacagtgacag

SEQ ID NO: 781841 - DNA, 25 bp, Mus musculus
tcgtctcccatggatacagtgacag

SEQ ID NO: 781842 - DNA, 25 bp, Mus musculus
tcgtctccgggcagagaatcccagc

SEQ ID NO: 781843 - DNA, 25 bp, Mus musculus
tcgtctccgggctgagaatcccagc

SEQ ID NO: 781844 - DNA, 25 bp, Mus musculus
tcgtctcgagatatcttgggtggcc

SEQ ID NO: 781845 - DNA, 25 bp, Mus musculus
tcgtctcgagatttcttgggtggcc

SEQ ID NO: 781846 - DNA, 25 bp, Mus musculus
tcgtctgagcatattaaagtttctc

SEQ ID NO: 781847 - DNA, 25 bp, Mus musculus
tcgtctgagcattttaaagtttctc

SEQ ID NO: 781848 - DNA, 25 bp, Mus musculus
tcgtctgcactgcagtggactgacc

SEQ ID NO: 781849 - DNA, 25 bp, Mus musculus
tcgtctgcactggagtggactgacc

SEQ ID NO: 781850 - DNA, 25 bp, Mus musculus
tcgtctgcgcacactcaggtactga

SEQ ID NO: 781851 - DNA, 25 bp, Mus musculus
tcgtctgcgcactctcaggtactga

SEQ ID NO: 781852 - DNA, 25 bp, Mus musculus
tcgtctgctccgcatgtccagggtg

SEQ ID NO: 781853 - DNA, 25 bp, Mus musculus
tcgtctgctccggatgtccagggtg

SEQ ID NO: 781854 - DNA, 25 bp, Mus musculus
tcgtctggaccccagacctgctggt

SEQ ID NO: 781855 - DNA, 25 bp, Mus musculus
tcgtctggacccgagacctgctggt

SEQ ID NO: 781856 - DNA, 25 bp, Mus musculus
tcgtctggtgctccgagtctgcatg

SEQ ID NO: 781857 - DNA, 25 bp, Mus musculus
tcgtctggtgctgcgagtctgcatg

SEQ ID NO: 781858 - DNA, 25 bp, Mus musculus
tcgtctgtatccatacacagctgac

SEQ ID NO: 781859 - DNA, 25 bp, Mus musculus
tcgtctgtatccttacacagctgac

SEQ ID NO: 781860 - DNA, 25 bp, Mus musculus
tcgtctgtcttgcaaggttcagttc

SEQ ID NO: 781861 - DNA, 25 bp, Mus musculus
tcgtctgtcttggaaggttcagttc

SEQ ID NO: 781862 - DNA, 25 bp, Mus musculus
tcgtctgtgaaacccattcatggaa

SEQ ID NO: 781863 - DNA, 25 bp, Mus musculus
tcgtctgtgaaagccattcatggaa

SEQ ID NO: 781864 - DNA, 25 bp, Mus musculus
tcgtctgtgccgcatacaatgccag

SEQ ID NO: 781865 - DNA, 25 bp, Mus musculus
tcgtctgtgccggatacaatgccag

SEQ ID NO: 781866 - DNA, 25 bp, Mus musculus
tcgtcttactataccaacctgggct

SEQ ID NO: 781867 - DNA, 25 bp, Mus musculus
tcgtcttactattccaacctgggct

SEQ ID NO: 781868 - DNA, 25 bp, Mus musculus
tcgtcttagcgtaggcccagcgaag

SEQ ID NO: 781869 - DNA, 25 bp, Mus musculus
tcgtcttagcgttggcccagcgaag

SEQ ID NO: 781870 - DNA, 25 bp, Mus musculus
tcgtcttcggaactcgcttcgacta

SEQ ID NO: 781871 - DNA, 25 bp, Mus musculus
tcgtcttcggaagtcgcttcgacta

SEQ ID NO: 781872 - DNA, 25 bp, Mus musculus
tcgtcttgcaacagtgcctgctgat

SEQ ID NO: 781873 - DNA, 25 bp, Mus musculus
tcgtcttgcaactgtgcctgctgat

SEQ ID NO: 781874 - DNA, 25 bp, Mus musculus
tcgtctttaagaaccagagcccctg

SEQ ID NO: 781875 - DNA, 25 bp, Mus musculus
tcgtctttaagatccagagcccctg

SEQ ID NO: 781876 - DNA, 25 bp, Mus musculus
tcgtgaaatcccacaggcagagcgt

SEQ ID NO: 781877 - DNA, 25 bp, Mus musculus
tcgtgaaatccctcaggcagagcgt

SEQ ID NO: 781878 - DNA, 25 bp, Mus musculus
tcgtgaaatcttccaaaatggccat

SEQ ID NO: 781879 - DNA, 25 bp, Mus musculus
tcgtgaaatcttgcaaaatggccat

SEQ ID NO: 781880 - DNA, 25 bp, Mus musculus
tcgtgaacataaccgcgtgtgcgac

SEQ ID NO: 781881 - DNA, 25 bp, Mus musculus
tcgtgaacataagcgcgtgtgcgac

SEQ ID NO: 781882 - DNA, 25 bp, Mus musculus
tcgtgaactactcggctttcgggag

SEQ ID NO: 781883 - DNA, 25 bp, Mus musculus
tcgtgaactactgggctttcgggag

SEQ ID NO: 781884 - DNA, 25 bp, Mus musculus
tcgtgaaggcacatcaggacaaccc

SEQ ID NO: 781885 - DNA, 25 bp, Mus musculus
tcgtgaaggcacttcaggacaaccc

SEQ ID NO: 781886 - DNA, 25 bp, Mus musculus
tcgtgaaggcgtaccgtagctctct

SEQ ID NO: 781887 - DNA, 25 bp, Mus musculus
tcgtgaaggcgttccgtagctctct

SEQ ID NO: 781888 - DNA, 25 bp, Mus musculus
tcgtgaagtgccagaagctgaccga

SEQ ID NO: 781889 - DNA, 25 bp, Mus musculus
tcgtgaagtgcctgaagctgaccga

SEQ ID NO: 781890 - DNA, 25 bp, Mus musculus
tcgtgacaaacaactatggagaagc

SEQ ID NO: 781891 - DNA, 25 bp, Mus musculus
tcgtgacaaacatctatggagaagc

SEQ ID NO: 781892 - DNA, 25 bp, Mus musculus
tcgtgacaggatcctgaaagagctg

SEQ ID NO: 781893 - DNA, 25 bp, Mus musculus
tcgtgacaggatgctgaaagagctg

SEQ ID NO: 781894 - DNA, 25 bp, Mus musculus
tcgtgaccagatccagcttgcagct

SEQ ID NO: 781895 - DNA, 25 bp, Mus musculus
tcgtgaccagatgcagcttgcagct

SEQ ID NO: 781896 - DNA, 25 bp, Mus musculus
tcgtgaccgtgaaggttggcagccc

SEQ ID NO: 781897 - DNA, 25 bp, Mus musculus
tcgtgaccgtgatggttggcagccc

SEQ ID NO: 781898 - DNA, 25 bp, Mus musculus
tcgtgacctctgcacctgcaaacgt

SEQ ID NO: 781899 - DNA, 25 bp, Mus musculus
tcgtgacctctggacctgcaaacgt

SEQ ID NO: 781900 - DNA, 25 bp, Mus musculus
tcgtgacgacatctcggactttcta

SEQ ID NO: 781901 - DNA, 25 bp, Mus musculus
tcgtgacgacatgtcggactttcta

SEQ ID NO: 781902 - DNA, 25 bp, Mus musculus
tcgtgactgtgtatttcataactta

SEQ ID NO: 781903 - DNA, 25 bp, Mus musculus
tcgtgactgtgtttttcataactta

SEQ ID NO: 781904 - DNA, 25 bp, Mus musculus
tcgtgagaacatcaaacaggcgctc

SEQ ID NO: 781905 - DNA, 25 bp, Mus musculus
tcgtgagaacatgaaacaggcgctc

SEQ ID NO: 781906 - DNA, 25 bp, Mus musculus
tcgtgagcagcaaccttcagttgcc

SEQ ID NO: 781907 - DNA, 25 bp, Mus musculus
tcgtgagcagcatccttcagttgcc

SEQ ID NO: 781908 - DNA, 25 bp, Mus musculus
tcgtgagcagtaagagtcctttgag

SEQ ID NO: 781909 - DNA, 25 bp, Mus musculus
tcgtgagcagtatgagtcctttgag

SEQ ID NO: 781910 - DNA, 25 bp, Mus musculus
tcgtgagccttcatcagaatctgaa

SEQ ID NO: 781911 - DNA, 25 bp, Mus musculus
tcgtgagccttcttcagaatctgaa

SEQ ID NO: 781912 - DNA, 25 bp, Mus musculus
tcgtgagggttcaccggtgctgctc

SEQ ID NO: 781913 - DNA, 25 bp, Mus musculus
tcgtgagggttctccggtgctgctc

SEQ ID NO: 781914 - DNA, 25 bp, Mus musculus
tcgtgatctacgcacctgcgctcat

SEQ ID NO: 781915 - DNA, 25 bp, Mus musculus
tcgtgatctacggacctgcgctcat

SEQ ID NO: 781916 - DNA, 25 bp, Mus musculus
tcgtgatgacccagtgagaaagctg

SEQ ID NO: 781917 - DNA, 25 bp, Mus musculus
tcgtgatgaccctgtgagaaagctg

SEQ ID NO: 781918 - DNA, 25 bp, Mus musculus
tcgtgatgggcaactagtgagccag

SEQ ID NO: 781919 - DNA, 25 bp, Mus musculus
tcgtgatgggcatctagtgagccag

SEQ ID NO: 781920 - DNA, 25 bp, Mus musculus
tcgtgatttctgaaagtcaacggca

SEQ ID NO: 781921 - DNA, 25 bp, Mus musculus
tcgtgatttctgtaagtcaacggca

SEQ ID NO: 781922 - DNA, 25 bp, Mus musculus
tcgtgcaaccgtcacaaggcctttc

SEQ ID NO: 781923 - DNA, 25 bp, Mus musculus
tcgtgcaaccgtgacaaggcctttc

SEQ ID NO: 781924 - DNA, 25 bp, Mus musculus
tcgtgcaagaatagtcactgatcgg

SEQ ID NO: 781925 - DNA, 25 bp, Mus musculus
tcgtgcaagaattgtcactgatcgg

SEQ ID NO: 781926 - DNA, 25 bp, Mus musculus
tcgtgcaccttgacctgtcctacaa

SEQ ID NO: 781927 - DNA, 25 bp, Mus musculus
tcgtgcaccttgtcctgtcctacaa

SEQ ID NO: 781928 - DNA, 25 bp, Mus musculus
tcgtgcagaagtacattgagcggcc

SEQ ID NO: 781929 - DNA, 25 bp, Mus musculus
tcgtgcagaagttcattgagcggcc

SEQ ID NO: 781930 - DNA, 25 bp, Mus musculus
tcgtgcagcataaccagtggcccat

SEQ ID NO: 781931 - DNA, 25 bp, Mus musculus
tcgtgcagcatatccagtggcccat

SEQ ID NO: 781932 - DNA, 25 bp, Mus musculus
tcgtgcagccttccagctgggctcg

SEQ ID NO: 781933 - DNA, 25 bp, Mus musculus
tcgtgcagccttgcagctgggctcg

SEQ ID NO: 781934 - DNA, 25 bp, Mus musculus
tcgtgcaggcgcattaccaggccgt

SEQ ID NO: 781935 - DNA, 25 bp, Mus musculus
tcgtgcaggcgctttaccaggccgt

SEQ ID NO: 781936 - DNA, 25 bp, Mus musculus
tcgtgcagtacgctgcaggtatcat

SEQ ID NO: 781937 - DNA, 25 bp, Mus musculus
tcgtgcagtacggtgcaggtatcat

SEQ ID NO: 781938 - DNA, 25 bp, Mus musculus
tcgtgcatctgccaaacgccagtct

SEQ ID NO: 781939 - DNA, 25 bp, Mus musculus
tcgtgcatctgcgaaacgccagtct

SEQ ID NO: 781940 - DNA, 25 bp, Mus musculus
tcgtgccaataacaagccaatactt

SEQ ID NO: 781941 - DNA, 25 bp, Mus musculus
tcgtgccaataagaagccaatactt

SEQ ID NO: 781942 - DNA, 25 bp, Mus musculus
tcgtgccagaaaaagcccacactta

SEQ ID NO: 781943 - DNA, 25 bp, Mus musculus
tcgtgccagaaatagcccacactta

SEQ ID NO: 781944 - DNA, 25 bp, Mus musculus
tcgtgccaggctatgactgggctct

SEQ ID NO: 781945 - DNA, 25 bp, Mus musculus
tcgtgccaggctttgactgggctct

SEQ ID NO: 781946 - DNA, 25 bp, Mus musculus
tcgtgcccctaaatttactcaagtg

SEQ ID NO: 781947 - DNA, 25 bp, Mus musculus
tcgtgcccctaattttactcaagtg

SEQ ID NO: 781948 - DNA, 25 bp, Mus musculus
tcgtgcctgaggaaccagtctgctt

SEQ ID NO: 781949 - DNA, 25 bp, Mus musculus
tcgtgcctgaggtaccagtctgctt

SEQ ID NO: 781950 - DNA, 25 bp, Mus musculus
tcgtgcggcggcatcggcagccttc

SEQ ID NO: 781951 - DNA, 25 bp, Mus musculus
tcgtgcggcggcttcggcagccttc

SEQ ID NO: 781952 - DNA, 25 bp, Mus musculus
tcgtgcgggttcatgtggatgcccc

SEQ ID NO: 781953 - DNA, 25 bp, Mus musculus
tcgtgcgggttcttgtggatgcccc

SEQ ID NO: 781954 - DNA, 25 bp, Mus musculus
tcgtgcggtgttagaacctgaagag

SEQ ID NO: 781955 - DNA, 25 bp, Mus musculus
tcgtgcggtgtttgaacctgaagag

SEQ ID NO: 781956 - DNA, 25 bp, Mus musculus
tcgtgctcaggaccgtctggccaca

SEQ ID NO: 781957 - DNA, 25 bp, Mus musculus
tcgtgctcaggagcgtctggccaca

SEQ ID NO: 781958 - DNA, 25 bp, Mus musculus
tcgtgctccccacagtgctgaggga

SEQ ID NO: 781959 - DNA, 25 bp, Mus musculus
tcgtgctccccagagtgctgaggga

SEQ ID NO: 781960 - DNA, 25 bp, Mus musculus
tcgtgctgctgacataagtttgaag

SEQ ID NO: 781961 - DNA, 25 bp, Mus musculus
tcgtgctgctgagataagtttgaag

SEQ ID NO: 781962 - DNA, 25 bp, Mus musculus
tcgtgctggagcagagggtaggaac

SEQ ID NO: 781963 - DNA, 25 bp, Mus musculus
tcgtgctggagctgagggtaggaac

SEQ ID NO: 781964 - DNA, 25 bp, Mus musculus
tcgtgcttgctacaatgtgggacca

SEQ ID NO: 781965 - DNA, 25 bp, Mus musculus
tcgtgcttgctagaatgtgggacca

SEQ ID NO: 781966 - DNA, 25 bp, Mus musculus
tcgtgctttcgcatccgcagggctg

SEQ ID NO: 781967 - DNA, 25 bp, Mus musculus
tcgtgctttcgcttccgcagggctg

SEQ ID NO: 781968 - DNA, 25 bp, Mus musculus
tcgtggaaacggaactgacaaggga

SEQ ID NO: 781969 - DNA, 25 bp, Mus musculus
tcgtggaaacggtactgacaaggga

SEQ ID NO: 781970 - DNA, 25 bp, Mus musculus
tcgtggaagagccaatgggcacccc

SEQ ID NO: 781971 - DNA, 25 bp, Mus musculus
tcgtggaagagcgaatgggcacccc

SEQ ID NO: 781972 - DNA, 25 bp, Mus musculus
tcgtggacaaaacggtgctgccctt

SEQ ID NO: 781973 - DNA, 25 bp, Mus musculus
tcgtggacaaaagggtgctgccctt

SEQ ID NO: 781974 - DNA, 25 bp, Mus musculus
tcgtggacaccaacgctgtctccgg

SEQ ID NO: 781975 - DNA, 25 bp, Mus musculus
tcgtggacaccatcgctgtctccgg

SEQ ID NO: 781976 - DNA, 25 bp, Mus musculus
tcgtggacacctcggatgagagttc

SEQ ID NO: 781977 - DNA, 25 bp, Mus musculus
tcgtggacacctgggatgagagttc

SEQ ID NO: 781978 - DNA, 25 bp, Mus musculus
tcgtggaccgcaagtacagcatctg

SEQ ID NO: 781979 - DNA, 25 bp, Mus musculus
tcgtggaccgcatgtacagcatctg

SEQ ID NO: 781980 - DNA, 25 bp, Mus musculus
tcgtggacctcaagtcaatcgggac

SEQ ID NO: 781981 - DNA, 25 bp, Mus musculus
tcgtggacctcatgtcaatcgggac

SEQ ID NO: 781982 - DNA, 25 bp, Mus musculus
tcgtggagaatcacatgggtgttgc

SEQ ID NO: 781983 - DNA, 25 bp, Mus musculus
tcgtggagaatctcatgggtgttgc

SEQ ID NO: 781984 - DNA, 25 bp, Mus musculus
tcgtggagatcaagcttgggacgtc

SEQ ID NO: 781985 - DNA, 25 bp, Mus musculus
tcgtggagatcatgcttgggacgtc

SEQ ID NO: 781986 - DNA, 25 bp, Mus musculus
tcgtggagatctacgcgtcgctgcc

SEQ ID NO: 781987 - DNA, 25 bp, Mus musculus
tcgtggagatcttcgcgtcgctgcc

SEQ ID NO: 781988 - DNA, 25 bp, Mus musculus
tcgtggagcaagaactcctttccag

SEQ ID NO: 781989 - DNA, 25 bp, Mus musculus
tcgtggagcaagtactcctttccag

SEQ ID NO: 781990 - DNA, 25 bp, Mus musculus
tcgtggagccgcacaggcccgcttt

SEQ ID NO: 781991 - DNA, 25 bp, Mus musculus
tcgtggagccgctcaggcccgcttt

SEQ ID NO: 781992 - DNA, 25 bp, Mus musculus
tcgtggagtcctacgatgtggagac

SEQ ID NO: 781993 - DNA, 25 bp, Mus musculus
tcgtggagtccttcgatgtggagac

SEQ ID NO: 781994 - DNA, 25 bp, Mus musculus
tcgtggagtgtacggccaatgttca

SEQ ID NO: 781995 - DNA, 25 bp, Mus musculus
tcgtggagtgtagggccaatgttca

SEQ ID NO: 781996 - DNA, 25 bp, Mus musculus
tcgtggagttccagggccgcacgct

SEQ ID NO: 781997 - DNA, 25 bp, Mus musculus
tcgtggagttcctgggccgcacgct

SEQ ID NO: 781998 - DNA, 25 bp, Mus musculus
tcgtggatatccctcagcaagagaa

SEQ ID NO: 781999 - DNA, 25 bp, Mus musculus
tcgtggatatccgtcagcaagagaa

SEQ ID NO: 782000 - DNA, 25 bp, Mus musculus
tcgtggattccgcaaggagcatcct

SEQ ID NO: 782001 - DNA, 25 bp, Mus musculus
tcgtggattccggaaggagcatcct

SEQ ID NO: 782002 - DNA, 25 bp, Mus musculus
tcgtggatttccctaaacagagccg

SEQ ID NO: 782003 - DNA, 25 bp, Mus musculus
tcgtggatttccgtaaacagagccg

SEQ ID NO: 782004 - DNA, 25 bp, Mus musculus
tcgtggcagcagagccactgaggcc

SEQ ID NO: 782005 - DNA, 25 bp, Mus musculus
tcgtggcagcagtgccactgaggcc

SEQ ID NO: 782006 - DNA, 25 bp, Mus musculus
tcgtggcagccacttcagggctcaa

SEQ ID NO: 782007 - DNA, 25 bp, Mus musculus
tcgtggcagccagttcagggctcaa

SEQ ID NO: 782008 - DNA, 25 bp, Mus musculus
tcgtggccaacgctgctcaggacgt

SEQ ID NO: 782009 - DNA, 25 bp, Mus musculus
tcgtggccaacggtgctcaggacgt

SEQ ID NO: 782010 - DNA, 25 bp, Mus musculus
tcgtggccccagaacaaagcttgag

SEQ ID NO: 782011 - DNA, 25 bp, Mus musculus
tcgtggccccagtacaaagcttgag

SEQ ID NO: 782012 - DNA, 25 bp, Mus musculus
tcgtggccctgtccgacgtgctgta

SEQ ID NO: 782013 - DNA, 25 bp, Mus musculus
tcgtggccctgtgcgacgtgctgta

SEQ ID NO: 782014 - DNA, 25 bp, Mus musculus
tcgtggctatcaaatggatcttgcc

SEQ ID NO: 782015 - DNA, 25 bp, Mus musculus
tcgtggctatcatatggatcttgcc

SEQ ID NO: 782016 - DNA, 25 bp, Mus musculus
tcgtggctccgtccatcctctttga

SEQ ID NO: 782017 - DNA, 25 bp, Mus musculus
tcgtggctccgtgcatcctctttga

SEQ ID NO: 782018 - DNA, 25 bp, Mus musculus
tcgtggctcgccatcgtcgcctttg

SEQ ID NO: 782019 - DNA, 25 bp, Mus musculus
tcgtggctcgccttcgtcgcctttg

SEQ ID NO: 782020 - DNA, 25 bp, Mus musculus
tcgtggctctcacagatgaccaagg

SEQ ID NO: 782021 - DNA, 25 bp, Mus musculus
tcgtggctctcagagatgaccaagg

SEQ ID NO: 782022 - DNA, 25 bp, Mus musculus
tcgtggctggacacagcagagaaat

SEQ ID NO: 782023 - DNA, 25 bp, Mus musculus
tcgtggctggactcagcagagaaat

SEQ ID NO: 782024 - DNA, 25 bp, Mus musculus
tcgtggctgtctccctggtgttgct

SEQ ID NO: 782025 - DNA, 25 bp, Mus musculus
tcgtggctgtctgcctggtgttgct

SEQ ID NO: 782026 - DNA, 25 bp, Mus musculus
tcgtggctgtgaaagtgtgtacctt

SEQ ID NO: 782027 - DNA, 25 bp, Mus musculus
tcgtggctgtgaacatggcagtgaa

SEQ ID NO: 782028 - DNA, 25 bp, Mus musculus
tcgtggctgtgatagtgtgtacctt

SEQ ID NO: 782029 - DNA, 25 bp, Mus musculus
tcgtggctgtgatcatggcagtgaa

SEQ ID NO: 782030 - DNA, 25 bp, Mus musculus
tcgtggcttctgaaatagctaaaga

SEQ ID NO: 782031 - DNA, 25 bp, Mus musculus
tcgtggcttctgtaatagctaaaga

SEQ ID NO: 782032 - DNA, 25 bp, Mus musculus
tcgtgggactgacaagctattagaa

SEQ ID NO: 782033 - DNA, 25 bp, Mus musculus
tcgtgggactgagaagctattagaa

SEQ ID NO: 782034 - DNA, 25 bp, Mus musculus
tcgtgggagtatagccgcctgacag

SEQ ID NO: 782035 - DNA, 25 bp, Mus musculus
tcgtgggagtattgccgcctgacag

SEQ ID NO: 782036 - DNA, 25 bp, Mus musculus
tcgtgggatctgagtcccggtcttc

SEQ ID NO: 782037 - DNA, 25 bp, Mus musculus
tcgtgggatctgtgtcccggtcttc

SEQ ID NO: 782038 - DNA, 25 bp, Mus musculus
tcgtgggcctccaaggatgaaaact

SEQ ID NO: 782039 - DNA, 25 bp, Mus musculus
tcgtgggcctcctaggatgaaaact

SEQ ID NO: 782040 - DNA, 25 bp, Mus musculus
tcgtgggctcacacgctctagggaa

SEQ ID NO: 782041 - DNA, 25 bp, Mus musculus
tcgtgggctcactcgctctagggaa

SEQ ID NO: 782042 - DNA, 25 bp, Mus musculus
tcgtgggtgaccaagcgcagtcctg

SEQ ID NO: 782043 - DNA, 25 bp, Mus musculus
tcgtgggtgacctagcgcagtcctg

SEQ ID NO: 782044 - DNA, 25 bp, Mus musculus
tcgtgggttctgagctcgtggacac

SEQ ID NO: 782045 - DNA, 25 bp, Mus musculus
tcgtgggttctgtgctcgtggacac

SEQ ID NO: 782046 - DNA, 25 bp, Mus musculus
tcgtggtataacaacagagagacag

SEQ ID NO: 782047 - DNA, 25 bp, Mus musculus
tcgtggtataactacagagagacag

SEQ ID NO: 782048 - DNA, 25 bp, Mus musculus
tcgtggtcaacaagaagccatggct

SEQ ID NO: 782049 - DNA, 25 bp, Mus musculus
tcgtggtcaacatgaagccatggct

SEQ ID NO: 782050 - DNA, 25 bp, Mus musculus
tcgtggtcacaaaacctcgtccgtc

SEQ ID NO: 782051 - DNA, 25 bp, Mus musculus
tcgtggtcacaatacctcgtccgtc

SEQ ID NO: 782052 - DNA, 25 bp, Mus musculus
tcgtggtcacctcgacagtcctgag

SEQ ID NO: 782053 - DNA, 25 bp, Mus musculus
tcgtggtcacctggacagtcctgag

SEQ ID NO: 782054 - DNA, 25 bp, Mus musculus
tcgtggtcatatcaattgccgtagc

SEQ ID NO: 782055 - DNA, 25 bp, Mus musculus
tcgtggtcatatgaattgccgtagc

SEQ ID NO: 782056 - DNA, 25 bp, Mus musculus
tcgtggtcatgtactaccattagcc

SEQ ID NO: 782057 - DNA, 25 bp, Mus musculus
tcgtggtcatgttctaccattagcc

SEQ ID NO: 782058 - DNA, 25 bp, Mus musculus
tcgtggtccatgactggctgtacag

SEQ ID NO: 782059 - DNA, 25 bp, Mus musculus
tcgtggtccatgtctggctgtacag

SEQ ID NO: 782060 - DNA, 25 bp, Mus musculus
tcgtggtgcaaacacaacagctatg

SEQ ID NO: 782061 - DNA, 25 bp, Mus musculus
tcgtggtgcaaagacaacagctatg

SEQ ID NO: 782062 - DNA, 25 bp, Mus musculus
tcgtggtgctgcacctcggatggct

SEQ ID NO: 782063 - DNA, 25 bp, Mus musculus
tcgtggtgctgctcctcggatggct

SEQ ID NO: 782064 - DNA, 25 bp, Mus musculus
tcgtggttgacactaatgaccgaga

SEQ ID NO: 782065 - DNA, 25 bp, Mus musculus
tcgtggttgacagtaatgaccgaga

SEQ ID NO: 782066 - DNA, 25 bp, Mus musculus
tcgtggtttagcacctcggtggtga

SEQ ID NO: 782067 - DNA, 25 bp, Mus musculus
tcgtggtttagctcctcggtggtga

SEQ ID NO: 782068 - DNA, 25 bp, Mus musculus
tcgtgtacccggaggagtccctggt

SEQ ID NO: 782069 - DNA, 25 bp, Mus musculus
tcgtgtacccggtggagtccctggt

SEQ ID NO: 782070 - DNA, 25 bp, Mus musculus
tcgtgtacctccagtcattgtcctg

SEQ ID NO: 782071 - DNA, 25 bp, Mus musculus
tcgtgtacctcctgtcattgtcctg

SEQ ID NO: 782072 - DNA, 25 bp, Mus musculus
tcgtgtactccaacacggacaaggg

SEQ ID NO: 782073 - DNA, 25 bp, Mus musculus
tcgtgtactccatcacggacaaggg

SEQ ID NO: 782074 - DNA, 25 bp, Mus musculus
tcgtgtatagcacacagcggaacct

SEQ ID NO: 782075 - DNA, 25 bp, Mus musculus
tcgtgtatagcagacagcggaacct

SEQ ID NO: 782076 - DNA, 25 bp, Mus musculus
tcgtgtcacggcaaactgcatattt

SEQ ID NO: 782077 - DNA, 25 bp, Mus musculus
tcgtgtcacggctaactgcatattt

SEQ ID NO: 782078 - DNA, 25 bp, Mus musculus
tcgtgtcatcctagagaaggccacc

SEQ ID NO: 782079 - DNA, 25 bp, Mus musculus
tcgtgtcatccttgagaaggccacc

SEQ ID NO: 782080 - DNA, 25 bp, Mus musculus
tcgtgtcattgaccctaaaaaggct

SEQ ID NO: 782081 - DNA, 25 bp, Mus musculus
tcgtgtcattgagcctaaaaaggct

SEQ ID NO: 782082 - DNA, 25 bp, Mus musculus
tcgtgtccacaaaggcgattttgga

SEQ ID NO: 782083 - DNA, 25 bp, Mus musculus
tcgtgtccacaatggcgattttgga

SEQ ID NO: 782084 - DNA, 25 bp, Mus musculus
tcgtgtccagccctcagctattaga

SEQ ID NO: 782085 - DNA, 25 bp, Mus musculus
tcgtgtccagccgtcagctattaga

SEQ ID NO: 782086 - DNA, 25 bp, Mus musculus
tcgtgtcgccctagagaatgatgac

SEQ ID NO: 782087 - DNA, 25 bp, Mus musculus
tcgtgtcgcccttgagaatgatgac

SEQ ID NO: 782088 - DNA, 25 bp, Mus musculus
tcgtgtctcagaacaagaccaaggg

SEQ ID NO: 782089 - DNA, 25 bp, Mus musculus
tcgtgtctcagatcaagaccaaggg

SEQ ID NO: 782090 - DNA, 25 bp, Mus musculus
tcgtgtctgcaccaacatcaggctg

SEQ ID NO: 782091 - DNA, 25 bp, Mus musculus
tcgtgtctgcacgaacatcaggctg

SEQ ID NO: 782092 - DNA, 25 bp, Mus musculus
tcgtgtctggagaacgatgagcact

SEQ ID NO: 782093 - DNA, 25 bp, Mus musculus
tcgtgtctggagtacgatgagcact

SEQ ID NO: 782094 - DNA, 25 bp, Mus musculus
tcgtgtgcaaaaacggccagtgtgt

SEQ ID NO: 782095 - DNA, 25 bp, Mus musculus
tcgtgtgcaaaatcggccagtgtgt

SEQ ID NO: 782096 - DNA, 25 bp, Mus musculus
tcgtgtggccgtccgctccgcttat

SEQ ID NO: 782097 - DNA, 25 bp, Mus musculus
tcgtgtggccgtgcgctccgcttat

SEQ ID NO: 782098 - DNA, 25 bp, Mus musculus
tcgtgtgttccacgcggaaattgtg

SEQ ID NO: 782099 - DNA, 25 bp, Mus musculus
tcgtgtgttccaggcggaaattgtg

SEQ ID NO: 782100 - DNA, 25 bp, Mus musculus
tcgtgttcaagaaccccctgcctgt

SEQ ID NO: 782101 - DNA, 25 bp, Mus musculus
tcgtgttcaagatccccctgcctgt

SEQ ID NO: 782102 - DNA, 25 bp, Mus musculus
tcgtgttcagtgacacaaccgttga

SEQ ID NO: 782103 - DNA, 25 bp, Mus musculus
tcgtgttcagtgtcacaaccgttga

SEQ ID NO: 782104 - DNA, 25 bp, Mus musculus
tcgtgttccagaagcaactgcgagg

SEQ ID NO: 782105 - DNA, 25 bp, Mus musculus
tcgtgttccagatgcaactgcgagg

SEQ ID NO: 782106 - DNA, 25 bp, Mus musculus
tcgtgttgaccgagattatgtgctc

SEQ ID NO: 782107 - DNA, 25 bp, Mus musculus
tcgtgttgaccgtgattatgtgctc

SEQ ID NO: 782108 - DNA, 25 bp, Mus musculus
tcgtgttgccttcactgacagctgc

SEQ ID NO: 782109 - DNA, 25 bp, Mus musculus
tcgtgttgccttgactgacagctgc

SEQ ID NO: 782110 - DNA, 25 bp, Mus musculus
tcgtgttgttaaccagccaagaggt

SEQ ID NO: 782111 - DNA, 25 bp, Mus musculus
tcgtgttgttaagcagccaagaggt

SEQ ID NO: 782112 - DNA, 25 bp, Mus musculus
tcgtgttttgggaatatgtcaacag

SEQ ID NO: 782113 - DNA, 25 bp, Mus musculus
tcgtgttttgggtatatgtcaacag

SEQ ID NO: 782114 - DNA, 25 bp, Mus musculus
tcgttaaagcaacaaatggaccaag

SEQ ID NO: 782115 - DNA, 25 bp, Mus musculus
tcgttaaagcaagaaatggaccaag

SEQ ID NO: 782116 - DNA, 25 bp, Mus musculus
tcgttacagcgaaagcatatcctat

SEQ ID NO: 782117 - DNA, 25 bp, Mus musculus
tcgttacagcgatagcatatcctat

SEQ ID NO: 782118 - DNA, 25 bp, Mus musculus
tcgttaccgccacaaaaagtgccgg

SEQ ID NO: 782119 - DNA, 25 bp, Mus musculus
tcgttaccgccagaaaaagtgccgg

SEQ ID NO: 782120 - DNA, 25 bp, Mus musculus
tcgttacgaccacaggagattgaag

SEQ ID NO: 782121 - DNA, 25 bp, Mus musculus
tcgttacgaccagaggagattgaag

SEQ ID NO: 782122 - DNA, 25 bp, Mus musculus
tcgttacgaggacaagtactgactc

SEQ ID NO: 782123 - DNA, 25 bp, Mus musculus
tcgttacgaggagaagtactgactc

SEQ ID NO: 782124 - DNA, 25 bp, Mus musculus
tcgttactagagatttacccatggg

SEQ ID NO: 782125 - DNA, 25 bp, Mus musculus
tcgttactagagttttacccatggg

SEQ ID NO: 782126 - DNA, 25 bp, Mus musculus
tcgttagacccgaggcggaagctgc

SEQ ID NO: 782127 - DNA, 25 bp, Mus musculus
tcgttagacccgtggcggaagctgc

SEQ ID NO: 782128 - DNA, 25 bp, Mus musculus
tcgttagatcagagagagaattcca

SEQ ID NO: 782129 - DNA, 25 bp, Mus musculus
tcgttagatcagtgagagaattcca

SEQ ID NO: 782130 - DNA, 25 bp, Mus musculus
tcgttaggagagcaggctagcaccc

SEQ ID NO: 782131 - DNA, 25 bp, Mus musculus
tcgttaggagaggaggctagcaccc

SEQ ID NO: 782132 - DNA, 25 bp, Mus musculus
tcgttagggaacatccatcacaagc

SEQ ID NO: 782133 - DNA, 25 bp, Mus musculus
tcgttagggaacttccatcacaagc

SEQ ID NO: 782134 - DNA, 25 bp, Mus musculus
tcgttataatgacagatgtggccct

SEQ ID NO: 782135 - DNA, 25 bp, Mus musculus
tcgttataatgagagatgtggccct

SEQ ID NO: 782136 - DNA, 25 bp, Mus musculus
tcgttatgacgtagtgaagcacgtt

SEQ ID NO: 782137 - DNA, 25 bp, Mus musculus
tcgttatgacgttgtgaagcacgtt

SEQ ID NO: 782138 - DNA, 25 bp, Mus musculus
tcgttatgggaacatcatgattatg

SEQ ID NO: 782139 - DNA, 25 bp, Mus musculus
tcgttatgggaagatcatgattatg

SEQ ID NO: 782140 - DNA, 25 bp, Mus musculus
tcgttattgaagacagttacctttc

SEQ ID NO: 782141 - DNA, 25 bp, Mus musculus
tcgttattgaagtcagttacctttc

SEQ ID NO: 782142 - DNA, 25 bp, Mus musculus
tcgttcaattggagcagcagctaag

SEQ ID NO: 782143 - DNA, 25 bp, Mus musculus
tcgttcaattggtgcagcagctaag

SEQ ID NO: 782144 - DNA, 25 bp, Mus musculus
tcgttcagatgcagcaaagcgcttg

SEQ ID NO: 782145 - DNA, 25 bp, Mus musculus
tcgttcagatgctgcaaagcgcttg

SEQ ID NO: 782146 - DNA, 25 bp, Mus musculus
tcgttcaggcagaaattgggcagaa

SEQ ID NO: 782147 - DNA, 25 bp, Mus musculus
tcgttcaggcagtaattgggcagaa

SEQ ID NO: 782148 - DNA, 25 bp, Mus musculus
tcgttcatggcaatgggcccaccaa

SEQ ID NO: 782149 - DNA, 25 bp, Mus musculus
tcgttcatggcattgggcccaccaa

SEQ ID NO: 782150 - DNA, 25 bp, Mus musculus
tcgttccaccttagaagtcctgagc

SEQ ID NO: 782151 - DNA, 25 bp, Mus musculus
tcgttccacctttgaagtcctgagc

SEQ ID NO: 782152 - DNA, 25 bp, Mus musculus
tcgttccagcacaattcctgagcag

SEQ ID NO: 782153 - DNA, 25 bp, Mus musculus
tcgttccagcactattcctgagcag

SEQ ID NO: 782154 - DNA, 25 bp, Mus musculus
tcgttcccaaagctgagttcccagg

SEQ ID NO: 782155 - DNA, 25 bp, Mus musculus
tcgttcccaaaggtgagttcccagg

SEQ ID NO: 782156 - DNA, 25 bp, Mus musculus
tcgttccctttgatgcggcctcaga

SEQ ID NO: 782157 - DNA, 25 bp, Mus musculus
tcgttccctttgttgcggcctcaga

SEQ ID NO: 782158 - DNA, 25 bp, Mus musculus
tcgttccggaacacaaagcagatgt

SEQ ID NO: 782159 - DNA, 25 bp, Mus musculus
tcgttccggaactcaaagcagatgt

SEQ ID NO: 782160 - DNA, 25 bp, Mus musculus
tcgttccggacgcaagaagtccaca

SEQ ID NO: 782161 - DNA, 25 bp, Mus musculus
tcgttccggacggaagaagtccaca

SEQ ID NO: 782162 - DNA, 25 bp, Mus musculus
tcgttcgggctaagaccacgctcaa

SEQ ID NO: 782163 - DNA, 25 bp, Mus musculus
tcgttcgggctatgaccacgctcaa

SEQ ID NO: 782164 - DNA, 25 bp, Mus musculus
tcgttctagaggaaggagcaggtct

SEQ ID NO: 782165 - DNA, 25 bp, Mus musculus
tcgttctagaggtaggagcaggtct

SEQ ID NO: 782166 - DNA, 25 bp, Mus musculus
tcgttctctccgagcgcactggtga

SEQ ID NO: 782167 - DNA, 25 bp, Mus musculus
tcgttctctccgtgcgcactggtga

SEQ ID NO: 782168 - DNA, 25 bp, Mus musculus
tcgttctgaagtccgagtgccggtc

SEQ ID NO: 782169 - DNA, 25 bp, Mus musculus
tcgttctgaagtgcgagtgccggtc

SEQ ID NO: 782170 - DNA, 25 bp, Mus musculus
tcgttctgcctcagattatgacggg

SEQ ID NO: 782171 - DNA, 25 bp, Mus musculus
tcgttctgcctctgattatgacggg

SEQ ID NO: 782172 - DNA, 25 bp, Mus musculus
tcgttctggagacttgtttctgccc

SEQ ID NO: 782173 - DNA, 25 bp, Mus musculus
tcgttctggagagttgtttctgccc

SEQ ID NO: 782174 - DNA, 25 bp, Mus musculus
tcgttgaaacatccagcaagacagg

SEQ ID NO: 782175 - DNA, 25 bp, Mus musculus
tcgttgaaacatgcagcaagacagg

SEQ ID NO: 782176 - DNA, 25 bp, Mus musculus
tcgttgaaatccattgatcctgcag

SEQ ID NO: 782177 - DNA, 25 bp, Mus musculus
tcgttgaaatcctttgatcctgcag

SEQ ID NO: 782178 - DNA, 25 bp, Mus musculus
tcgttgaataccatggaagaccagc

SEQ ID NO: 782179 - DNA, 25 bp, Mus musculus
tcgttgaataccttggaagaccagc

SEQ ID NO: 782180 - DNA, 25 bp, Mus musculus
tcgttgccgtgaccagcacaaatgc

SEQ ID NO: 782181 - DNA, 25 bp, Mus musculus
tcgttgccgtgagcagcacaaatgc

SEQ ID NO: 782182 - DNA, 25 bp, Mus musculus
tcgttgctaaccatgctgccgccaa

SEQ ID NO: 782183 - DNA, 25 bp, Mus musculus
tcgttgctaaccttgctgccgccaa

SEQ ID NO: 782184 - DNA, 25 bp, Mus musculus
tcgttgctcaggcattcctcatctg

SEQ ID NO: 782185 - DNA, 25 bp, Mus musculus
tcgttgctcagggattcctcatctg

SEQ ID NO: 782186 - DNA, 25 bp, Mus musculus
tcgttggatcctatggtgtggacaa

SEQ ID NO: 782187 - DNA, 25 bp, Mus musculus
tcgttggatcctttggtgtggacaa

SEQ ID NO: 782188 - DNA, 25 bp, Mus musculus
tcgttggcaatcaccttttttattt

SEQ ID NO: 782189 - DNA, 25 bp, Mus musculus
tcgttggcaatctccttttttattt

SEQ ID NO: 782190 - DNA, 25 bp, Mus musculus
tcgttggcctcaatcgagtcgttgc

SEQ ID NO: 782191 - DNA, 25 bp, Mus musculus
tcgttggcctcattcgagtcgttgc

SEQ ID NO: 782192 - DNA, 25 bp, Mus musculus
tcgttggcttcgcaagaatgaatgg

SEQ ID NO: 782193 - DNA, 25 bp, Mus musculus
tcgttggcttcggaagaatgaatgg

SEQ ID NO: 782194 - DNA, 25 bp, Mus musculus
tcgttgtgagccaatcacctccaag

SEQ ID NO: 782195 - DNA, 25 bp, Mus musculus
tcgttgtgagcctatcacctccaag

SEQ ID NO: 782196 - DNA, 25 bp, Mus musculus
tcgttgtggcacaagctaagcaggg

SEQ ID NO: 782197 - DNA, 25 bp, Mus musculus
tcgttgtggcactagctaagcaggg

SEQ ID NO: 782198 - DNA, 25 bp, Mus musculus
tcgttgtgtggacctgcagtcgtcc

SEQ ID NO: 782199 - DNA, 25 bp, Mus musculus
tcgttgtgtggagctgcagtcgtcc

SEQ ID NO: 782200 - DNA, 25 bp, Mus musculus
tcgttgttgaagctggacgtccaag

SEQ ID NO: 782201 - DNA, 25 bp, Mus musculus
tcgttgttgaaggtggacgtccaag

SEQ ID NO: 782202 - DNA, 25 bp, Mus musculus
tcgttgtttggcaacctggtcatcc

SEQ ID NO: 782203 - DNA, 25 bp, Mus musculus
tcgttgtttggctacctggtcatcc

SEQ ID NO: 782204 - DNA, 25 bp, Mus musculus
tcgtttatgagcacagcatggctag

SEQ ID NO: 782205 - DNA, 25 bp, Mus musculus
tcgtttatgagctcagcatggctag

SEQ ID NO: 782206 - DNA, 25 bp, Mus musculus
tcgtttcaactacgtggtcatgcaa

SEQ ID NO: 782207 - DNA, 25 bp, Mus musculus
tcgtttcaactaggtggtcatgcaa

SEQ ID NO: 782208 - DNA, 25 bp, Mus musculus
tcgtttcccttgaaggcagcagcgg

SEQ ID NO: 782209 - DNA, 25 bp, Mus musculus
tcgtttcccttgtaggcagcagcgg

SEQ ID NO: 782210 - DNA, 25 bp, Mus musculus
tcgtttccgcccaagagaggtgttt

SEQ ID NO: 782211 - DNA, 25 bp, Mus musculus
tcgtttccgccctagagaggtgttt

SEQ ID NO: 782212 - DNA, 25 bp, Mus musculus
tcgtttctgcctctgacattcgcta

SEQ ID NO: 782213 - DNA, 25 bp, Mus musculus
tcgtttctgcctgtgacattcgcta

SEQ ID NO: 782214 - DNA, 25 bp, Mus musculus
tcgtttcttttcattcggttgaatt

SEQ ID NO: 782215 - DNA, 25 bp, Mus musculus
tcgtttcttttctttcggttgaatt

SEQ ID NO: 782216 - DNA, 25 bp, Mus musculus
tcgtttggtcacattaaagccgcat

SEQ ID NO: 782217 - DNA, 25 bp, Mus musculus
tcgtttggtcactttaaagccgcat

SEQ ID NO: 782218 - DNA, 25 bp, Mus musculus
tctaaaacaattcgaaaagaagtgg

SEQ ID NO: 782219 - DNA, 25 bp, Mus musculus
tctaaaacaattggaaaagaagtgg

SEQ ID NO: 782220 - DNA, 25 bp, Mus musculus
tctaaaacattgagccctggtgata

SEQ ID NO: 782221 - DNA, 25 bp, Mus musculus
tctaaaacattgtgccctggtgata

SEQ ID NO: 782222 - DNA, 25 bp, Mus musculus
tctaaaacccgccttggtggactca

SEQ ID NO: 782223 - DNA, 25 bp, Mus musculus
tctaaaacccgcgttggtggactca

SEQ ID NO: 782224 - DNA, 25 bp, Mus musculus
tctaaaacgttcaagaggtcttgcc

SEQ ID NO: 782225 - DNA, 25 bp, Mus musculus
tctaaaacgttctagaggtcttgcc

SEQ ID NO: 782226 - DNA, 25 bp, Mus musculus
tctaaaatacctccgcagcaagatc

SEQ ID NO: 782227 - DNA, 25 bp, Mus musculus
tctaaaatacctgcgcagcaagatc

SEQ ID NO: 782228 - DNA, 25 bp, Mus musculus
tctaaaatctggatccctaaacatc

SEQ ID NO: 782229 - DNA, 25 bp, Mus musculus
tctaaaatctggttccctaaacatc

SEQ ID NO: 782230 - DNA, 25 bp, Mus musculus
tctaaaatgatccacaagaacctgc

SEQ ID NO: 782231 - DNA, 25 bp, Mus musculus
tctaaaatgatcgacaagaacctgc

SEQ ID NO: 782232 - DNA, 25 bp, Mus musculus
tctaaacagagcctcatgtcaggtt

SEQ ID NO: 782233 - DNA, 25 bp, Mus musculus
tctaaacagagcgtcatgtcaggtt

SEQ ID NO: 782234 - DNA, 25 bp, Mus musculus
tctaaacagtttatatgttgccact

SEQ ID NO: 782235 - DNA, 25 bp, Mus musculus
tctaaacagtttcgatcccagcgag

SEQ ID NO: 782236 - DNA, 25 bp, Mus musculus
tctaaacagtttggatcccagcgag

SEQ ID NO: 782237 - DNA, 25 bp, Mus musculus
tctaaacagtttttatgttgccact

SEQ ID NO: 782238 - DNA, 25 bp, Mus musculus
tctaaacatggcagaggagggagct

SEQ ID NO: 782239 - DNA, 25 bp, Mus musculus
tctaaacatggctgaggagggagct

SEQ ID NO: 782240 - DNA, 25 bp, Mus musculus
tctaaaccgaaacccagtgagtggc

SEQ ID NO: 782241 - DNA, 25 bp, Mus musculus
tctaaaccgaaagccagtgagtggc

SEQ ID NO: 782242 - DNA, 25 bp, Mus musculus
tctaaaccgtctaggagcctgcagc

SEQ ID NO: 782243 - DNA, 25 bp, Mus musculus
tctaaaccgtcttggagcctgcagc

SEQ ID NO: 782244 - DNA, 25 bp, Mus musculus
tctaaactaaacagagagaagaagc

SEQ ID NO: 782245 - DNA, 25 bp, Mus musculus
tctaaactaaactgagagaagaagc

SEQ ID NO: 782246 - DNA, 25 bp, Mus musculus
tctaaactaccccaatggatgcaga

SEQ ID NO: 782247 - DNA, 25 bp, Mus musculus
tctaaactacccgaatggatgcaga

SEQ ID NO: 782248 - DNA, 25 bp, Mus musculus
tctaaactagcaagtctgcagacca

SEQ ID NO: 782249 - DNA, 25 bp, Mus musculus
tctaaactagcatgtctgcagacca

SEQ ID NO: 782250 - DNA, 25 bp, Mus musculus
tctaaactcatcagcgaggccacga

SEQ ID NO: 782251 - DNA, 25 bp, Mus musculus
tctaaactcatctgcgaggccacga

SEQ ID NO: 782252 - DNA, 25 bp, Mus musculus
tctaaactgaataatcaagctcgct

SEQ ID NO: 782253 - DNA, 25 bp, Mus musculus
tctaaactgaattatcaagctcgct

SEQ ID NO: 782254 - DNA, 25 bp, Mus musculus
tctaaacttgaacatcgcagaagct

SEQ ID NO: 782255 - DNA, 25 bp, Mus musculus
tctaaacttgaagatcgcagaagct

SEQ ID NO: 782256 - DNA, 25 bp, Mus musculus
tctaaactttataccgtacaccaag

SEQ ID NO: 782257 - DNA, 25 bp, Mus musculus
tctaaactttattccgtacaccaag

SEQ ID NO: 782258 - DNA, 25 bp, Mus musculus
tctaaagaagtacaacttctgcagc

SEQ ID NO: 782259 - DNA, 25 bp, Mus musculus
tctaaagaagtagaacttctgcagc

SEQ ID NO: 782260 - DNA, 25 bp, Mus musculus
tctaaagactctaccacaagccttc

SEQ ID NO: 782261 - DNA, 25 bp, Mus musculus
tctaaagactcttccacaagccttc

SEQ ID NO: 782262 - DNA, 25 bp, Mus musculus
tctaaagagaaaacctgcgatcgtt

SEQ ID NO: 782263 - DNA, 25 bp, Mus musculus
tctaaagagaaatcctgcgatcgtt

SEQ ID NO: 782264 - DNA, 25 bp, Mus musculus
tctaaagagcttcaggcctcgcaag

SEQ ID NO: 782265 - DNA, 25 bp, Mus musculus
tctaaagagcttgaggcctcgcaag

SEQ ID NO: 782266 - DNA, 25 bp, Mus musculus
tctaaagcatgtattccaaaaacac

SEQ ID NO: 782267 - DNA, 25 bp, Mus musculus
tctaaagcatgttttccaaaaacac

SEQ ID NO: 782268 - DNA, 25 bp, Mus musculus
tctaaagccactacattggctaagg

SEQ ID NO: 782269 - DNA, 25 bp, Mus musculus
tctaaagccacttcattggctaagg

SEQ ID NO: 782270 - DNA, 25 bp, Mus musculus
tctaaagctgacaaagaggccgtgg

SEQ ID NO: 782271 - DNA, 25 bp, Mus musculus
tctaaagctgactaagaggccgtgg

SEQ ID NO: 782272 - DNA, 25 bp, Mus musculus
tctaaagcttctcatcctgtcgatg

SEQ ID NO: 782273 - DNA, 25 bp, Mus musculus
tctaaagcttctgatcctgtcgatg

SEQ ID NO: 782274 - DNA, 25 bp, Mus musculus
tctaaaggaattccaaatagtgcta

SEQ ID NO: 782275 - DNA, 25 bp, Mus musculus
tctaaaggaattgcaaatagtgcta

SEQ ID NO: 782276 - DNA, 25 bp, Mus musculus
tctaaaggaggacatccttcatcct

SEQ ID NO: 782277 - DNA, 25 bp, Mus musculus
tctaaaggaggagatccttcatcct

SEQ ID NO: 782278 - DNA, 25 bp, Mus musculus
tctaaaggatatcaagagtgtccag

SEQ ID NO: 782279 - DNA, 25 bp, Mus musculus
tctaaaggatatgaagagtgtccag

SEQ ID NO: 782280 - DNA, 25 bp, Mus musculus
tctaaaggcagtagccgaagttcgc

SEQ ID NO: 782281 - DNA, 25 bp, Mus musculus
tctaaaggcagttgccgaagttcgc

SEQ ID NO: 782282 - DNA, 25 bp, Mus musculus
tctaaagggtggagcccaccaggga

SEQ ID NO: 782283 - DNA, 25 bp, Mus musculus
tctaaagggtggtgcccaccaggga

SEQ ID NO: 782284 - DNA, 25 bp, Mus musculus
tctaaaggtgatccggctgcaggaa

SEQ ID NO: 782285 - DNA, 25 bp, Mus musculus
tctaaaggtgatgcggctgcaggaa

SEQ ID NO: 782286 - DNA, 25 bp, Mus musculus
tctaaataaagcaatgaccagtttc

SEQ ID NO: 782287 - DNA, 25 bp, Mus musculus
tctaaataaagctatgaccagtttc

SEQ ID NO: 782288 - DNA, 25 bp, Mus musculus
tctaaatatggtccacacaattacc

SEQ ID NO: 782289 - DNA, 25 bp, Mus musculus
tctaaatatggtgcacacaattacc

SEQ ID NO: 782290 - DNA, 25 bp, Mus musculus
tctaaatccagcaggcatctctcca

SEQ ID NO: 782291 - DNA, 25 bp, Mus musculus
tctaaatccagctggcatctctcca

SEQ ID NO: 782292 - DNA, 25 bp, Mus musculus
tctaaatccagtcaagagtcgggag

SEQ ID NO: 782293 - DNA, 25 bp, Mus musculus
tctaaatccagtgaagagtcgggag

SEQ ID NO: 782294 - DNA, 25 bp, Mus musculus
tctaaatccattcgaaggaaaactt

SEQ ID NO: 782295 - DNA, 25 bp, Mus musculus
tctaaatccattggaaggaaaactt

SEQ ID NO: 782296 - DNA, 25 bp, Mus musculus
tctaaatccttactttcaggtcaga

SEQ ID NO: 782297 - DNA, 25 bp, Mus musculus
tctaaatccttagtttcaggtcaga

SEQ ID NO: 782298 - DNA, 25 bp, Mus musculus
tctaaatctctgacgcatggcaagt

SEQ ID NO: 782299 - DNA, 25 bp, Mus musculus
tctaaatctctgtcgcatggcaagt

SEQ ID NO: 782300 - DNA, 25 bp, Mus musculus
tctaaatgaaacagtggccactggc

SEQ ID NO: 782301 - DNA, 25 bp, Mus musculus
tctaaatgaaactgtggccactggc

SEQ ID NO: 782302 - DNA, 25 bp, Mus musculus
tctaaatgccagcaggtagagcggc

SEQ ID NO: 782303 - DNA, 25 bp, Mus musculus
tctaaatgccaggaggtagagcggc

SEQ ID NO: 782304 - DNA, 25 bp, Mus musculus
tctaaatgcccaagttgaaaaacat

SEQ ID NO: 782305 - DNA, 25 bp, Mus musculus
tctaaatgcccatgttgaaaaacat

SEQ ID NO: 782306 - DNA, 25 bp, Mus musculus
tctaaatgggtacgaccggaagatc

SEQ ID NO: 782307 - DNA, 25 bp, Mus musculus
tctaaatgggtaggaccggaagatc

SEQ ID NO: 782308 - DNA, 25 bp, Mus musculus
tctaaatggttacagcacaaataat

SEQ ID NO: 782309 - DNA, 25 bp, Mus musculus
tctaaatggttagagcacaaataat

SEQ ID NO: 782310 - DNA, 25 bp, Mus musculus
tctaaatgtgaaaacccagccgcct

SEQ ID NO: 782311 - DNA, 25 bp, Mus musculus
tctaaatgtgaatacccagccgcct

SEQ ID NO: 782312 - DNA, 25 bp, Mus musculus
tctaaattcagacatgcgctgctct

SEQ ID NO: 782313 - DNA, 25 bp, Mus musculus
tctaaattcagagatgcgctgctct

SEQ ID NO: 782314 - DNA, 25 bp, Mus musculus
tctaaattgagaaggaattcctagc

SEQ ID NO: 782315 - DNA, 25 bp, Mus musculus
tctaaattgagatggaattcctagc

SEQ ID NO: 782316 - DNA, 25 bp, Mus musculus
tctaaattgtcactcttctgggagc

SEQ ID NO: 782317 - DNA, 25 bp, Mus musculus
tctaaattgtcagtcttctgggagc

SEQ ID NO: 782318 - DNA, 25 bp, Mus musculus
tctaaattgtgtctctggcaaggca

SEQ ID NO: 782319 - DNA, 25 bp, Mus musculus
tctaaattgtgtgtctggcaaggca

SEQ ID NO: 782320 - DNA, 25 bp, Mus musculus
tctaacaaaaggactcccagagacg

SEQ ID NO: 782321 - DNA, 25 bp, Mus musculus
tctaacaaaaggtctcccagagacg

SEQ ID NO: 782322 - DNA, 25 bp, Mus musculus
tctaacacaggcaactggatgcata

SEQ ID NO: 782323 - DNA, 25 bp, Mus musculus
tctaacacaggctactggatgcata

SEQ ID NO: 782324 - DNA, 25 bp, Mus musculus
tctaacaggactccagagggacagg

SEQ ID NO: 782325 - DNA, 25 bp, Mus musculus
tctaacaggactgcagagggacagg

SEQ ID NO: 782326 - DNA, 25 bp, Mus musculus
tctaacaggcatactggagcaggtt

SEQ ID NO: 782327 - DNA, 25 bp, Mus musculus
tctaacaggcattctggagcaggtt

SEQ ID NO: 782328 - DNA, 25 bp, Mus musculus
tctaacaggtataatggcatcttcg

SEQ ID NO: 782329 - DNA, 25 bp, Mus musculus
tctaacaggtattatggcatcttcg

SEQ ID NO: 782330 - DNA, 25 bp, Mus musculus
tctaacaggtgacacctgtgttttc

SEQ ID NO: 782331 - DNA, 25 bp, Mus musculus
tctaacaggtgagacctgtgttttc

SEQ ID NO: 782332 - DNA, 25 bp, Mus musculus
tctaacatcacaccagaagatcagg

SEQ ID NO: 782333 - DNA, 25 bp, Mus musculus
tctaacatcacagcagaagatcagg

SEQ ID NO: 782334 - DNA, 25 bp, Mus musculus
tctaacatcatgatcccaaggacta

SEQ ID NO: 782335 - DNA, 25 bp, Mus musculus
tctaacatcatgttcccaaggacta

SEQ ID NO: 782336 - DNA, 25 bp, Mus musculus
tctaacatccgtctttgacaatagc

SEQ ID NO: 782337 - DNA, 25 bp, Mus musculus
tctaacatccgtgtttgacaatagc

SEQ ID NO: 782338 - DNA, 25 bp, Mus musculus
tctaacatgggacgcgtcccacgtg

SEQ ID NO: 782339 - DNA, 25 bp, Mus musculus
tctaacatgggaggcgtcccacgtg

SEQ ID NO: 782340 - DNA, 25 bp, Mus musculus
tctaaccatggacgtaatgattcag

SEQ ID NO: 782341 - DNA, 25 bp, Mus musculus
tctaaccatggaggtaatgattcag

SEQ ID NO: 782342 - DNA, 25 bp, Mus musculus
tctaacccatgcctagtcaacaagt

SEQ ID NO: 782343 - DNA, 25 bp, Mus musculus
tctaacccatgcgtagtcaacaagt

SEQ ID NO: 782344 - DNA, 25 bp, Mus musculus
tctaacccggctctcccgatgtgaa

SEQ ID NO: 782345 - DNA, 25 bp, Mus musculus
tctaacccggctgtcccgatgtgaa

SEQ ID NO: 782346 - DNA, 25 bp, Mus musculus
tctaaccgcagaactgggatgtggg

SEQ ID NO: 782347 - DNA, 25 bp, Mus musculus
tctaaccgcagatctgggatgtggg

SEQ ID NO: 782348 - DNA, 25 bp, Mus musculus
tctaacctcaaaccaatggacctca

SEQ ID NO: 782349 - DNA, 25 bp, Mus musculus
tctaacctcaaagcaatggacctca

SEQ ID NO: 782350 - DNA, 25 bp, Mus musculus
tctaacgagaagaacaggacgtacc

SEQ ID NO: 782351 - DNA, 25 bp, Mus musculus
tctaacgagaagtacaggacgtacc

SEQ ID NO: 782352 - DNA, 25 bp, Mus musculus
tctaacggaacacaaagcgagcgag

SEQ ID NO: 782353 - DNA, 25 bp, Mus musculus
tctaacggaacagaaagcgagcgag

SEQ ID NO: 782354 - DNA, 25 bp, Mus musculus
tctaacgtatgaagccactggcttc

SEQ ID NO: 782355 - DNA, 25 bp, Mus musculus
tctaacgtatgatgccactggcttc

SEQ ID NO: 782356 - DNA, 25 bp, Mus musculus
tctaacgtttgtcccagaaccggaa

SEQ ID NO: 782357 - DNA, 25 bp, Mus musculus
tctaacgtttgtgccagaaccggaa

SEQ ID NO: 782358 - DNA, 25 bp, Mus musculus
tctaactcagtcacagcagagatcg

SEQ ID NO: 782359 - DNA, 25 bp, Mus musculus
tctaactcagtctcagcagagatcg

SEQ ID NO: 782360 - DNA, 25 bp, Mus musculus
tctaactcctctatgaactccaaca

SEQ ID NO: 782361 - DNA, 25 bp, Mus musculus
tctaactcctctttgaactccaaca

SEQ ID NO: 782362 - DNA, 25 bp, Mus musculus
tctaactgaccacagtgtattccct

SEQ ID NO: 782363 - DNA, 25 bp, Mus musculus
tctaactgaccagagtgtattccct

SEQ ID NO: 782364 - DNA, 25 bp, Mus musculus
tctaactgagcgagctctgcaaggc

SEQ ID NO: 782365 - DNA, 25 bp, Mus musculus
tctaactgagcgtgctctgcaaggc

SEQ ID NO: 782366 - DNA, 25 bp, Mus musculus
tctaactgcaggaacggagtgtgtg

SEQ ID NO: 782367 - DNA, 25 bp, Mus musculus
tctaactgcaggtacggagtgtgtg

SEQ ID NO: 782368 - DNA, 25 bp, Mus musculus
tctaactgctgccatagcagagctg

SEQ ID NO: 782369 - DNA, 25 bp, Mus musculus
tctaactgctgcgatagcagagctg

SEQ ID NO: 782370 - DNA, 25 bp, Mus musculus
tctaactgtcagcttcaggagaatg

SEQ ID NO: 782371 - DNA, 25 bp, Mus musculus
tctaactgtcaggttcaggagaatg

SEQ ID NO: 782372 - DNA, 25 bp, Mus musculus
tctaacttaggtcgcggtgatgatc

SEQ ID NO: 782373 - DNA, 25 bp, Mus musculus
tctaacttaggtggcggtgatgatc

SEQ ID NO: 782374 - DNA, 25 bp, Mus musculus
tctaacttggcccacaagtaatgtg

SEQ ID NO: 782375 - DNA, 25 bp, Mus musculus
tctaacttggccgacaagtaatgtg

SEQ ID NO: 782376 - DNA, 25 bp, Mus musculus
tctaagaaatgtccgctcaagggac

SEQ ID NO: 782377 - DNA, 25 bp, Mus musculus
tctaagaaatgtgcgctcaagggac

SEQ ID NO: 782378 - DNA, 25 bp, Mus musculus
tctaagaacagtctaacatttgtgg

SEQ ID NO: 782379 - DNA, 25 bp, Mus musculus
tctaagaacagtgtaacatttgtgg

SEQ ID NO: 782380 - DNA, 25 bp, Mus musculus
tctaagaaccatacgaagagaaatt

SEQ ID NO: 782381 - DNA, 25 bp, Mus musculus
tctaagaaccattcgaagagaaatt

SEQ ID NO: 782382 - DNA, 25 bp, Mus musculus
tctaagaagtaaatataacgtagtc

SEQ ID NO: 782383 - DNA, 25 bp, Mus musculus
tctaagaagtaattataacgtagtc

SEQ ID NO: 782384 - DNA, 25 bp, Mus musculus
tctaagacaagcaatactatccggg

SEQ ID NO: 782385 - DNA, 25 bp, Mus musculus
tctaagacaagctatactatccggg

SEQ ID NO: 782386 - DNA, 25 bp, Mus musculus
tctaagacccgacaatggctgtgga

SEQ ID NO: 782387 - DNA, 25 bp, Mus musculus
tctaagacccgagaatggctgtgga

SEQ ID NO: 782388 - DNA, 25 bp, Mus musculus
tctaagactcaaagaaatggaacct

SEQ ID NO: 782389 - DNA, 25 bp, Mus musculus
tctaagactcaatgaaatggaacct

SEQ ID NO: 782390 - DNA, 25 bp, Mus musculus
tctaagacttgcagagttgtggtct

SEQ ID NO: 782391 - DNA, 25 bp, Mus musculus
tctaagacttgccattttaaggcgt

SEQ ID NO: 782392 - DNA, 25 bp, Mus musculus
tctaagacttgcgattttaaggcgt

SEQ ID NO: 782393 - DNA, 25 bp, Mus musculus
tctaagacttgctgagttgtggtct

SEQ ID NO: 782394 - DNA, 25 bp, Mus musculus
tctaagactttaaatgaagataaac

SEQ ID NO: 782395 - DNA, 25 bp, Mus musculus
tctaagactttatatgaagataaac

SEQ ID NO: 782396 - DNA, 25 bp, Mus musculus
tctaagagaaggacaccttgaacca

SEQ ID NO: 782397 - DNA, 25 bp, Mus musculus
tctaagagaaggtcaccttgaacca

SEQ ID NO: 782398 - DNA, 25 bp, Mus musculus
tctaagagccaacagatagagggca

SEQ ID NO: 782399 - DNA, 25 bp, Mus musculus
tctaagagccaagagatagagggca

SEQ ID NO: 782400 - DNA, 25 bp, Mus musculus
tctaagagctctccggttgctcgaa

SEQ ID NO: 782401 - DNA, 25 bp, Mus musculus
tctaagagctctgcggttgctcgaa

SEQ ID NO: 782402 - DNA, 25 bp, Mus musculus
tctaagagtgagatcgtgagttcca

SEQ ID NO: 782403 - DNA, 25 bp, Mus musculus
tctaagagtgagttcgtgagttcca

SEQ ID NO: 782404 - DNA, 25 bp, Mus musculus
tctaagatacctcttcatgggtgcc

SEQ ID NO: 782405 - DNA, 25 bp, Mus musculus
tctaagatacctgttcatgggtgcc

SEQ ID NO: 782406 - DNA, 25 bp, Mus musculus
tctaagcaagcaaggttctggcagt

SEQ ID NO: 782407 - DNA, 25 bp, Mus musculus
tctaagcaagcatggttctggcagt

SEQ ID NO: 782408 - DNA, 25 bp, Mus musculus
tctaagcacaagacagaggcagtcg

SEQ ID NO: 782409 - DNA, 25 bp, Mus musculus
tctaagcacaagtcagaggcagtcg

SEQ ID NO: 782410 - DNA, 25 bp, Mus musculus
tctaagcagttacagccaaagagct

SEQ ID NO: 782411 - DNA, 25 bp, Mus musculus
tctaagcagttagagccaaagagct

SEQ ID NO: 782412 - DNA, 25 bp, Mus musculus
tctaagcatagaactttatcgtttg

SEQ ID NO: 782413 - DNA, 25 bp, Mus musculus
tctaagcatagatctttatcgtttg

SEQ ID NO: 782414 - DNA, 25 bp, Mus musculus
tctaagcccatgaacacacctgaac

SEQ ID NO: 782415 - DNA, 25 bp, Mus musculus
tctaagcccatgtacacacctgaac

SEQ ID NO: 782416 - DNA, 25 bp, Mus musculus
tctaagccccggaacaagcaaaatc

SEQ ID NO: 782417 - DNA, 25 bp, Mus musculus
tctaagccccggtacaagcaaaatc

SEQ ID NO: 782418 - DNA, 25 bp, Mus musculus
tctaagcgtagaagccgaaagcgct

SEQ ID NO: 782419 - DNA, 25 bp, Mus musculus
tctaagcgtagatgccgaaagcgct

SEQ ID NO: 782420 - DNA, 25 bp, Mus musculus
tctaagctgactaaacaacttgtgc

SEQ ID NO: 782421 - DNA, 25 bp, Mus musculus
tctaagctgacttaacaacttgtgc

SEQ ID NO: 782422 - DNA, 25 bp, Mus musculus
tctaagctgagtctggtacgtgcgc

SEQ ID NO: 782423 - DNA, 25 bp, Mus musculus
tctaagctgagtgtggtacgtgcgc

SEQ ID NO: 782424 - DNA, 25 bp, Mus musculus
tctaagctgtcacactccaagggcc

SEQ ID NO: 782425 - DNA, 25 bp, Mus musculus
tctaagctgtcagactccaagggcc

SEQ ID NO: 782426 - DNA, 25 bp, Mus musculus
tctaaggaacgacacaagaaacggg

SEQ ID NO: 782427 - DNA, 25 bp, Mus musculus
tctaaggaacgagacaagaaacggg

SEQ ID NO: 782428 - DNA, 25 bp, Mus musculus
tctaaggaatccaaaatgctacaaa

SEQ ID NO: 782429 - DNA, 25 bp, Mus musculus
tctaaggaatcctaaatgctacaaa

SEQ ID NO: 782430 - DNA, 25 bp, Mus musculus
tctaaggaatctcaaatttgagaga

SEQ ID NO: 782431 - DNA, 25 bp, Mus musculus
tctaaggaatctgaaatttgagaga

SEQ ID NO: 782432 - DNA, 25 bp, Mus musculus
tctaaggagcacatgaagaaaatga

SEQ ID NO: 782433 - DNA, 25 bp, Mus musculus
tctaaggagcacttgaagaaaatga

SEQ ID NO: 782434 - DNA, 25 bp, Mus musculus
tctaaggagtccaacggctatgtgc

SEQ ID NO: 782435 - DNA, 25 bp, Mus musculus
tctaaggagtcctacggctatgtgc

SEQ ID NO: 782436 - DNA, 25 bp, Mus musculus
tctaaggccatgctgaagatgtagc

SEQ ID NO: 782437 - DNA, 25 bp, Mus musculus
tctaaggccatggtgaagatgtagc

SEQ ID NO: 782438 - DNA, 25 bp, Mus musculus
tctaaggccccaaatatgcgtgtgc

SEQ ID NO: 782439 - DNA, 25 bp, Mus musculus
tctaaggccccatatatgcgtgtgc

SEQ ID NO: 782440 - DNA, 25 bp, Mus musculus
tctaaggcgtctctgtcaattcagg

SEQ ID NO: 782441 - DNA, 25 bp, Mus musculus
tctaaggcgtctgtgtcaattcagg

SEQ ID NO: 782442 - DNA, 25 bp, Mus musculus
tctaagggaacgctttgcttatcca

SEQ ID NO: 782443 - DNA, 25 bp, Mus musculus
tctaagggaacggtttgcttatcca

SEQ ID NO: 782444 - DNA, 25 bp, Mus musculus
tctaagggttgtccccaagactgtg

SEQ ID NO: 782445 - DNA, 25 bp, Mus musculus
tctaagggttgtgcccaagactgtg

SEQ ID NO: 782446 - DNA, 25 bp, Mus musculus
tctaaggtggaaaaacagctgcagg

SEQ ID NO: 782447 - DNA, 25 bp, Mus musculus
tctaaggtggaataacagctgcagg

SEQ ID NO: 782448 - DNA, 25 bp, Mus musculus
tctaagtactaccagcatgtggaca

SEQ ID NO: 782449 - DNA, 25 bp, Mus musculus
tctaagtactacgagcatgtggaca

SEQ ID NO: 782450 - DNA, 25 bp, Mus musculus
tctaagtaggttatcctacaatggg

SEQ ID NO: 782451 - DNA, 25 bp, Mus musculus
tctaagtaggttttcctacaatggg

SEQ ID NO: 782452 - DNA, 25 bp, Mus musculus
tctaagtatggtcacctggccaact

SEQ ID NO: 782453 - DNA, 25 bp, Mus musculus
tctaagtatggtgacctggccaact

SEQ ID NO: 782454 - DNA, 25 bp, Mus musculus
tctaagtgaaggcaacatgggcctc

SEQ ID NO: 782455 - DNA, 25 bp, Mus musculus
tctaagtgaagggaacatgggcctc

SEQ ID NO: 782456 - DNA, 25 bp, Mus musculus
tctaagtgacaaacagcacacttgc

SEQ ID NO: 782457 - DNA, 25 bp, Mus musculus
tctaagtgacaatcagcacacttgc

SEQ ID NO: 782458 - DNA, 25 bp, Mus musculus
tctaagtggtcaccagagcacagcc

SEQ ID NO: 782459 - DNA, 25 bp, Mus musculus
tctaagtggtcagcagagcacagcc

SEQ ID NO: 782460 - DNA, 25 bp, Mus musculus
tctaagtgtgtcagtgcctattcag

SEQ ID NO: 782461 - DNA, 25 bp, Mus musculus
tctaagtgtgtctgtgcctattcag

SEQ ID NO: 782462 - DNA, 25 bp, Mus musculus
tctaagtttaaaatgcaaagcctgg

SEQ ID NO: 782463 - DNA, 25 bp, Mus musculus
tctaagtttaaattgcaaagcctgg

SEQ ID NO: 782464 - DNA, 25 bp, Mus musculus
tctaagtttccactgattgtgggac

SEQ ID NO: 782465 - DNA, 25 bp, Mus musculus
tctaagtttccagtgattgtgggac

SEQ ID NO: 782466 - DNA, 25 bp, Mus musculus
tctaagtttctgcaacgagtattcc

SEQ ID NO: 782467 - DNA, 25 bp, Mus musculus
tctaagtttctggaacgagtattcc

SEQ ID NO: 782468 - DNA, 25 bp, Mus musculus
tctaataaacggagcggtgagccaa

SEQ ID NO: 782469 - DNA, 25 bp, Mus musculus
tctaataaacggtgcggtgagccaa

SEQ ID NO: 782470 - DNA, 25 bp, Mus musculus
tctaataaagaactttatgtggtcc

SEQ ID NO: 782471 - DNA, 25 bp, Mus musculus
tctaataaagaagtttatgtggtcc

SEQ ID NO: 782472 - DNA, 25 bp, Mus musculus
tctaataaagtgactggatgtctct

SEQ ID NO: 782473 - DNA, 25 bp, Mus musculus
tctaataaagtgtctggatgtctct

SEQ ID NO: 782474 - DNA, 25 bp, Mus musculus
tctaataactgcctgggccctgctt

SEQ ID NO: 782475 - DNA, 25 bp, Mus musculus
tctaataactgcgtgggccctgctt

SEQ ID NO: 782476 - DNA, 25 bp, Mus musculus
tctaataccctgaagaaacccaatt

SEQ ID NO: 782477 - DNA, 25 bp, Mus musculus
tctaataccctgtagaaacccaatt

SEQ ID NO: 782478 - DNA, 25 bp, Mus musculus
tctaatatgaagctatcaagactgc

SEQ ID NO: 782479 - DNA, 25 bp, Mus musculus
tctaatatgaaggtatcaagactgc

SEQ ID NO: 782480 - DNA, 25 bp, Mus musculus
tctaatatggacaccgtgggccgaa

SEQ ID NO: 782481 - DNA, 25 bp, Mus musculus
tctaatatggactccgtgggccgaa

SEQ ID NO: 782482 - DNA, 25 bp, Mus musculus
tctaatcactacagcctccagcggt

SEQ ID NO: 782483 - DNA, 25 bp, Mus musculus
tctaatcactactgcctccagcggt

SEQ ID NO: 782484 - DNA, 25 bp, Mus musculus
tctaatcccagacagaggagcggct

SEQ ID NO: 782485 - DNA, 25 bp, Mus musculus
tctaatcccagagagaggagcggct

SEQ ID NO: 782486 - DNA, 25 bp, Mus musculus
tctaatccctgcctgaaccaagctg

SEQ ID NO: 782487 - DNA, 25 bp, Mus musculus
tctaatccctgcgtgaaccaagctg

SEQ ID NO: 782488 - DNA, 25 bp, Mus musculus
tctaatcgccgaagagtgtttttgg

SEQ ID NO: 782489 - DNA, 25 bp, Mus musculus
tctaatcgccgatgagtgtttttgg

SEQ ID NO: 782490 - DNA, 25 bp, Mus musculus
tctaatcgttggatcctttggtgtg

SEQ ID NO: 782491 - DNA, 25 bp, Mus musculus
tctaatcgttggttcctttggtgtg

SEQ ID NO: 782492 - DNA, 25 bp, Mus musculus
tctaatcttaagagatgaccttggg

SEQ ID NO: 782493 - DNA, 25 bp, Mus musculus
tctaatcttaagtgatgaccttggg

SEQ ID NO: 782494 - DNA, 25 bp, Mus musculus
tctaatgaatctcaagccttctaag

SEQ ID NO: 782495 - DNA, 25 bp, Mus musculus
tctaatgaatctgaagccttctaag

SEQ ID NO: 782496 - DNA, 25 bp, Mus musculus
tctaatgactcacgcgacgtgggct

SEQ ID NO: 782497 - DNA, 25 bp, Mus musculus
tctaatgactcaggcgacgtgggct

SEQ ID NO: 782498 - DNA, 25 bp, Mus musculus
tctaatgagagacctcttggtgtgc

SEQ ID NO: 782499 - DNA, 25 bp, Mus musculus
tctaatgagagagctcttggtgtgc

SEQ ID NO: 782500 - DNA, 25 bp, Mus musculus
tctaatgatgagcatgatggacctc

SEQ ID NO: 782501 - DNA, 25 bp, Mus musculus
tctaatgatgaggatgatggacctc

SEQ ID NO: 782502 - DNA, 25 bp, Mus musculus
tctaatgcagtgactgagtccatga

SEQ ID NO: 782503 - DNA, 25 bp, Mus musculus
tctaatgcagtgtctgagtccatga

SEQ ID NO: 782504 - DNA, 25 bp, Mus musculus
tctaatgcgtcactttctaagcggc

SEQ ID NO: 782505 - DNA, 25 bp, Mus musculus
tctaatgcgtcagtttctaagcggc

SEQ ID NO: 782506 - DNA, 25 bp, Mus musculus
tctaatgtagatccatgtccacgca

SEQ ID NO: 782507 - DNA, 25 bp, Mus musculus
tctaatgtagatgcatgtccacgca

SEQ ID NO: 782508 - DNA, 25 bp, Mus musculus
tctaatgtatgaaagcccgggttca

SEQ ID NO: 782509 - DNA, 25 bp, Mus musculus
tctaatgtatgatagcccgggttca

SEQ ID NO: 782510 - DNA, 25 bp, Mus musculus
tctaatgtcctcagtttaccaacag

SEQ ID NO: 782511 - DNA, 25 bp, Mus musculus
tctaatgtcctctgtttaccaacag

SEQ ID NO: 782512 - DNA, 25 bp, Mus musculus
tctaatgtgggtctcagctggatgc

SEQ ID NO: 782513 - DNA, 25 bp, Mus musculus
tctaatgtgggtgtcagctggatgc

SEQ ID NO: 782514 - DNA, 25 bp, Mus musculus
tctaatgttaatactccagttaagg

SEQ ID NO: 782515 - DNA, 25 bp, Mus musculus
tctaatgttaattctccagttaagg

SEQ ID NO: 782516 - DNA, 25 bp, Mus musculus
tctaattctctacagcaacaaccac

SEQ ID NO: 782517 - DNA, 25 bp, Mus musculus
tctaattctctagagcaacaaccac

SEQ ID NO: 782518 - DNA, 25 bp, Mus musculus
tctaattggcatccataggctgcta

SEQ ID NO: 782519 - DNA, 25 bp, Mus musculus
tctaattggcatgcataggctgcta

SEQ ID NO: 782520 - DNA, 25 bp, Mus musculus
tctaattttttgcaaccagagttca

SEQ ID NO: 782521 - DNA, 25 bp, Mus musculus
tctaattttttggaaccagagttca

SEQ ID NO: 782522 - DNA, 25 bp, Mus musculus
tctacaaaacacagggagggagcga

SEQ ID NO: 782523 - DNA, 25 bp, Mus musculus
tctacaaaacactgggagggagcga

SEQ ID NO: 782524 - DNA, 25 bp, Mus musculus
tctacaaaaccgcaggactggacct

SEQ ID NO: 782525 - DNA, 25 bp, Mus musculus
tctacaaaaccggaggactggacct

SEQ ID NO: 782526 - DNA, 25 bp, Mus musculus
tctacaaacgcgacgacgccattgg

SEQ ID NO: 782527 - DNA, 25 bp, Mus musculus
tctacaaacgcgtcgacgccattgg

SEQ ID NO: 782528 - DNA, 25 bp, Mus musculus
tctacaaagcagaggcacggatgag

SEQ ID NO: 782529 - DNA, 25 bp, Mus musculus
tctacaaagcagtggcacggatgag

SEQ ID NO: 782530 - DNA, 25 bp, Mus musculus
tctacaaagccaagaatgaatttgc

SEQ ID NO: 782531 - DNA, 25 bp, Mus musculus
tctacaaagccatgaatgaatttgc

SEQ ID NO: 782532 - DNA, 25 bp, Mus musculus
tctacaaagcgcctcaagtctgtgg

SEQ ID NO: 782533 - DNA, 25 bp, Mus musculus
tctacaaagcgcgtcaagtctgtgg

SEQ ID NO: 782534 - DNA, 25 bp, Mus musculus
tctacaaaggagactgtaaatgctt

SEQ ID NO: 782535 - DNA, 25 bp, Mus musculus
tctacaaaggagtctgtaaatgctt

SEQ ID NO: 782536 - DNA, 25 bp, Mus musculus
tctacaaataaacagctcgtgggta

SEQ ID NO: 782537 - DNA, 25 bp, Mus musculus
tctacaaataaagagctcgtgggta

SEQ ID NO: 782538 - DNA, 25 bp, Mus musculus
tctacaaatgtcactgacaaggatg

SEQ ID NO: 782539 - DNA, 25 bp, Mus musculus
tctacaaatgtctctgacaaggatg

SEQ ID NO: 782540 - DNA, 25 bp, Mus musculus
tctacaaatgttcaagctgcttttc

SEQ ID NO: 782541 - DNA, 25 bp, Mus musculus
tctacaaatgttgaagctgcttttc

SEQ ID NO: 782542 - DNA, 25 bp, Mus musculus
tctacaacaacaagaagcagttcat

SEQ ID NO: 782543 - DNA, 25 bp, Mus musculus
tctacaacaacatgaagcagttcat

SEQ ID NO: 782544 - DNA, 25 bp, Mus musculus
tctacaacaggaaagatggaaagcc

SEQ ID NO: 782545 - DNA, 25 bp, Mus musculus
tctacaacaggatagatggaaagcc

SEQ ID NO: 782546 - DNA, 25 bp, Mus musculus
tctacaacgtacaggacccagaaac

SEQ ID NO: 782547 - DNA, 25 bp, Mus musculus
tctacaacgtactggacccagaaac

SEQ ID NO: 782548 - DNA, 25 bp, Mus musculus
tctacaagaacaactacagcgacac

SEQ ID NO: 782549 - DNA, 25 bp, Mus musculus
tctacaagaacatctacagcgacac

SEQ ID NO: 782550 - DNA, 25 bp, Mus musculus
tctacaagagagcattagccttaca

SEQ ID NO: 782551 - DNA, 25 bp, Mus musculus
tctacaagagaggattagccttaca

SEQ ID NO: 782552 - DNA, 25 bp, Mus musculus
tctacaagccagagcaatgccatcc

SEQ ID NO: 782553 - DNA, 25 bp, Mus musculus
tctacaagccagtgcaatgccatcc

SEQ ID NO: 782554 - DNA, 25 bp, Mus musculus
tctacaagcgtgcagagggcaaacc

SEQ ID NO: 782555 - DNA, 25 bp, Mus musculus
tctacaagcgtggagagggcaaacc

SEQ ID NO: 782556 - DNA, 25 bp, Mus musculus
tctacaagctcaactgataagtcag

SEQ ID NO: 782557 - DNA, 25 bp, Mus musculus
tctacaagctcaccaggtcaacagg

SEQ ID NO: 782558 - DNA, 25 bp, Mus musculus
tctacaagctcagcaggtcaacagg

SEQ ID NO: 782559 - DNA, 25 bp, Mus musculus
tctacaagctcatctgataagtcag

SEQ ID NO: 782560 - DNA, 25 bp, Mus musculus
tctacaaggaggaaatgaactcaga

SEQ ID NO: 782561 - DNA, 25 bp, Mus musculus
tctacaaggaggtaatgaactcaga

SEQ ID NO: 782562 - DNA, 25 bp, Mus musculus
tctacaaggccaaggcccacgagtc

SEQ ID NO: 782563 - DNA, 25 bp, Mus musculus
tctacaaggccatggcccacgagtc

SEQ ID NO: 782564 - DNA, 25 bp, Mus musculus
tctacaagtacaatgaatatcaagg

SEQ ID NO: 782565 - DNA, 25 bp, Mus musculus
tctacaagtacattgaatatcaagg

SEQ ID NO: 782566 - DNA, 25 bp, Mus musculus
tctacaagtcagctgaaggtgacgc

SEQ ID NO: 782567 - DNA, 25 bp, Mus musculus
tctacaagtcaggtgaaggtgacgc

SEQ ID NO: 782568 - DNA, 25 bp, Mus musculus
tctacaatcctacactctccagagg

SEQ ID NO: 782569 - DNA, 25 bp, Mus musculus
tctacaatcctagactctccagagg

SEQ ID NO: 782570 - DNA, 25 bp, Mus musculus
tctacaatcctcagagcaagacata

SEQ ID NO: 782571 - DNA, 25 bp, Mus musculus
tctacaatcctctgagcaagacata

SEQ ID NO: 782572 - DNA, 25 bp, Mus musculus
tctacaatgagcagatgagcgactt

SEQ ID NO: 782573 - DNA, 25 bp, Mus musculus
tctacaatgagctgatgagcgactt

SEQ ID NO: 782574 - DNA, 25 bp, Mus musculus
tctacaatgccacaaagcttcttct

SEQ ID NO: 782575 - DNA, 25 bp, Mus musculus
tctacaatgccagaaagcttcttct

SEQ ID NO: 782576 - DNA, 25 bp, Mus musculus
tctacaatggtgcagtaaatagcaa

SEQ ID NO: 782577 - DNA, 25 bp, Mus musculus
tctacaatggtggagtaaatagcaa

SEQ ID NO: 782578 - DNA, 25 bp, Mus musculus
tctacaattcctatggaggcagtga

SEQ ID NO: 782579 - DNA, 25 bp, Mus musculus
tctacaattcctttggaggcagtga

SEQ ID NO: 782580 - DNA, 25 bp, Mus musculus
tctacaattgttcagggagagcaca

SEQ ID NO: 782581 - DNA, 25 bp, Mus musculus
tctacaattgttgagggagagcaca

SEQ ID NO: 782582 - DNA, 25 bp, Mus musculus
tctacaatttctcactggtgatact

SEQ ID NO: 782583 - DNA, 25 bp, Mus musculus
tctacaatttctgactggtgatact

SEQ ID NO: 782584 - DNA, 25 bp, Mus musculus
tctacacaagctcacaagagaggga

SEQ ID NO: 782585 - DNA, 25 bp, Mus musculus
tctacacaagctgacaagagaggga

SEQ ID NO: 782586 - DNA, 25 bp, Mus musculus
tctacacagcaaaggcattatttac

SEQ ID NO: 782587 - DNA, 25 bp, Mus musculus
tctacacagcaatggcattatttac

SEQ ID NO: 782588 - DNA, 25 bp, Mus musculus
tctacacatgcaaggcggtcaacga

SEQ ID NO: 782589 - DNA, 25 bp, Mus musculus
tctacacatgcatggcggtcaacga

SEQ ID NO: 782590 - DNA, 25 bp, Mus musculus
tctacaccacttagagtgatgtctg

SEQ ID NO: 782591 - DNA, 25 bp, Mus musculus
tctacaccactttgagtgatgtctg

SEQ ID NO: 782592 - DNA, 25 bp, Mus musculus
tctacacccaaaattgcatatggaa

SEQ ID NO: 782593 - DNA, 25 bp, Mus musculus
tctacacccaaatttgcatatggaa

SEQ ID NO: 782594 - DNA, 25 bp, Mus musculus
tctacacccgtgaggccaattatgt

SEQ ID NO: 782595 - DNA, 25 bp, Mus musculus
tctacacccgtgtggccaattatgt

SEQ ID NO: 782596 - DNA, 25 bp, Mus musculus
tctacaccggttccccttgctaggg

SEQ ID NO: 782597 - DNA, 25 bp, Mus musculus
tctacaccggttgcccttgctaggg

SEQ ID NO: 782598 - DNA, 25 bp, Mus musculus
tctacacctcggaagtctggaagtc

SEQ ID NO: 782599 - DNA, 25 bp, Mus musculus
tctacacctcggtagtctggaagtc

SEQ ID NO: 782600 - DNA, 25 bp, Mus musculus
tctacacggatcacatgaaaggcgt

SEQ ID NO: 782601 - DNA, 25 bp, Mus musculus
tctacacggatctcatgaaaggcgt

SEQ ID NO: 782602 - DNA, 25 bp, Mus musculus
tctacactctacatcgtagcacgga

SEQ ID NO: 782603 - DNA, 25 bp, Mus musculus
tctacactctacttcgtagcacgga

SEQ ID NO: 782604 - DNA, 25 bp, Mus musculus
tctacactgcccaccgatactgtat

SEQ ID NO: 782605 - DNA, 25 bp, Mus musculus
tctacactgccctccgatactgtat

SEQ ID NO: 782606 - DNA, 25 bp, Mus musculus
tctacacttagcactcagagaggcc

SEQ ID NO: 782607 - DNA, 25 bp, Mus musculus
tctacacttagctctcagagaggcc

SEQ ID NO: 782608 - DNA, 25 bp, Mus musculus
tctacagaaccacaaccttgcaggc

SEQ ID NO: 782609 - DNA, 25 bp, Mus musculus
tctacagaaccagaaccttgcaggc

SEQ ID NO: 782610 - DNA, 25 bp, Mus musculus
tctacagaactccataatatctgcc

SEQ ID NO: 782611 - DNA, 25 bp, Mus musculus
tctacagaactcgataatatctgcc

SEQ ID NO: 782612 - DNA, 25 bp, Mus musculus
tctacagaatgaacaaacccagaat

SEQ ID NO: 782613 - DNA, 25 bp, Mus musculus
tctacagaatgatcaaacccagaat

SEQ ID NO: 782614 - DNA, 25 bp, Mus musculus
tctacagactgtatggcaagccctg

SEQ ID NO: 782615 - DNA, 25 bp, Mus musculus
tctacagactgtttggcaagccctg

SEQ ID NO: 782616 - DNA, 25 bp, Mus musculus
tctacagagcctatctggcggccta

SEQ ID NO: 782617 - DNA, 25 bp, Mus musculus
tctacagagcctttctggcggccta

SEQ ID NO: 782618 - DNA, 25 bp, Mus musculus
tctacagagggtaaagtgcagccca

SEQ ID NO: 782619 - DNA, 25 bp, Mus musculus
tctacagagggttaagtgcagccca

SEQ ID NO: 782620 - DNA, 25 bp, Mus musculus
tctacagagtctatgagtccggcag

SEQ ID NO: 782621 - DNA, 25 bp, Mus musculus
tctacagagtctttgagtccggcag

SEQ ID NO: 782622 - DNA, 25 bp, Mus musculus
tctacagatgaaaacgtgtcacttg

SEQ ID NO: 782623 - DNA, 25 bp, Mus musculus
tctacagatgaatacgtgtcacttg

SEQ ID NO: 782624 - DNA, 25 bp, Mus musculus
tctacagatggactgcgccaagtcc

SEQ ID NO: 782625 - DNA, 25 bp, Mus musculus
tctacagatggagtgcgccaagtcc

SEQ ID NO: 782626 - DNA, 25 bp, Mus musculus
tctacagatgttagggctgcgccgc

SEQ ID NO: 782627 - DNA, 25 bp, Mus musculus
tctacagatgtttgggctgcgccgc

SEQ ID NO: 782628 - DNA, 25 bp, Mus musculus
tctacagcaacaacttccgctggga

SEQ ID NO: 782629 - DNA, 25 bp, Mus musculus
tctacagcaacatcttccgctggga

SEQ ID NO: 782630 - DNA, 25 bp, Mus musculus
tctacagcagtgatcctccctttga

SEQ ID NO: 782631 - DNA, 25 bp, Mus musculus
tctacagcagtgttcctccctttga

SEQ ID NO: 782632 - DNA, 25 bp, Mus musculus
tctacagccaccattgacaaacacg

SEQ ID NO: 782633 - DNA, 25 bp, Mus musculus
tctacagccacctttgacaaacacg

SEQ ID NO: 782634 - DNA, 25 bp, Mus musculus
tctacagcgccaaattcagaagagg

SEQ ID NO: 782635 - DNA, 25 bp, Mus musculus
tctacagcgccatattcagaagagg

SEQ ID NO: 782636 - DNA, 25 bp, Mus musculus
tctacagcgggaacgcaggttcctg

SEQ ID NO: 782637 - DNA, 25 bp, Mus musculus
tctacagcgggatcgcaggttcctg

SEQ ID NO: 782638 - DNA, 25 bp, Mus musculus
tctacagctactagcccagaggctt

SEQ ID NO: 782639 - DNA, 25 bp, Mus musculus
tctacagctacttgcccagaggctt

SEQ ID NO: 782640 - DNA, 25 bp, Mus musculus
tctacagctgctcgtagcctgggct

SEQ ID NO: 782641 - DNA, 25 bp, Mus musculus
tctacagctgctggtagcctgggct

SEQ ID NO: 782642 - DNA, 25 bp, Mus musculus
tctacagctgttaaccatagttggt

SEQ ID NO: 782643 - DNA, 25 bp, Mus musculus
tctacagctgtttaccatagttggt

SEQ ID NO: 782644 - DNA, 25 bp, Mus musculus
tctacagcttcacacttatcactaa

SEQ ID NO: 782645 - DNA, 25 bp, Mus musculus
tctacagcttcagacttatcactaa

SEQ ID NO: 782646 - DNA, 25 bp, Mus musculus
tctacagcttgcacttgccggtcac

SEQ ID NO: 782647 - DNA, 25 bp, Mus musculus
tctacagcttgctcttgccggtcac

SEQ ID NO: 782648 - DNA, 25 bp, Mus musculus
tctacaggaacgaggtgaagattca

SEQ ID NO: 782649 - DNA, 25 bp, Mus musculus
tctacaggaacgtggtgaagattca

SEQ ID NO: 782650 - DNA, 25 bp, Mus musculus
tctacaggaagtacaagaagatcat

SEQ ID NO: 782651 - DNA, 25 bp, Mus musculus
tctacaggaagttcaagaagatcat

SEQ ID NO: 782652 - DNA, 25 bp, Mus musculus
tctacaggctgtcccaaggtacgtt

SEQ ID NO: 782653 - DNA, 25 bp, Mus musculus
tctacaggctgtgccaaggtacgtt

SEQ ID NO: 782654 - DNA, 25 bp, Mus musculus
tctacaggcttgcagacttgtttgg

SEQ ID NO: 782655 - DNA, 25 bp, Mus musculus
tctacaggcttggagacttgtttgg

SEQ ID NO: 782656 - DNA, 25 bp, Mus musculus
tctacagggaggatcaaggcagttg

SEQ ID NO: 782657 - DNA, 25 bp, Mus musculus
tctacagggaggttcaaggcagttg

SEQ ID NO: 782658 - DNA, 25 bp, Mus musculus
tctacaggtacaacgcgggcaaaag

SEQ ID NO: 782659 - DNA, 25 bp, Mus musculus
tctacaggtacatcgcgggcaaaag

SEQ ID NO: 782660 - DNA, 25 bp, Mus musculus
tctacagtctgaagctgcttattgc

SEQ ID NO: 782661 - DNA, 25 bp, Mus musculus
tctacagtctgaccagggtgtctac

SEQ ID NO: 782662 - DNA, 25 bp, Mus musculus
tctacagtctgagcagggtgtctac

SEQ ID NO: 782663 - DNA, 25 bp, Mus musculus
tctacagtctgatgctgcttattgc

SEQ ID NO: 782664 - DNA, 25 bp, Mus musculus
tctacagtgacaagcgcatggtcca

SEQ ID NO: 782665 - DNA, 25 bp, Mus musculus
tctacagtgacatgcgcatggtcca

SEQ ID NO: 782666 - DNA, 25 bp, Mus musculus
tctacagtgactatgtcttcctgga

SEQ ID NO: 782667 - DNA, 25 bp, Mus musculus
tctacagtgactttgtcttcctgga

SEQ ID NO: 782668 - DNA, 25 bp, Mus musculus
tctacagtgattagcgaaaaggtct

SEQ ID NO: 782669 - DNA, 25 bp, Mus musculus
tctacagtgatttgcgaaaaggtct

SEQ ID NO: 782670 - DNA, 25 bp, Mus musculus
tctacagtgggacgtacctgctttc

SEQ ID NO: 782671 - DNA, 25 bp, Mus musculus
tctacagtgggaggtacctgctttc

SEQ ID NO: 782672 - DNA, 25 bp, Mus musculus
tctacagtgtgtacggagttcttca

SEQ ID NO: 782673 - DNA, 25 bp, Mus musculus
tctacagtgtgttcggagttcttca

SEQ ID NO: 782674 - DNA, 25 bp, Mus musculus
tctacagttgttccaacgttaccag

SEQ ID NO: 782675 - DNA, 25 bp, Mus musculus
tctacagttgttgcaacgttaccag

SEQ ID NO: 782676 - DNA, 25 bp, Mus musculus
tctacatacgcaacacccgtggaca

SEQ ID NO: 782677 - DNA, 25 bp, Mus musculus
tctacatacgcatcacccgtggaca

SEQ ID NO: 782678 - DNA, 25 bp, Mus musculus
tctacatagagacggagaaaaagaa

SEQ ID NO: 782679 - DNA, 25 bp, Mus musculus
tctacatagagagggagaaaaagaa

SEQ ID NO: 782680 - DNA, 25 bp, Mus musculus
tctacatagcatcgcgcagcgcagt

SEQ ID NO: 782681 - DNA, 25 bp, Mus musculus
tctacatagcatggcgcagcgcagt

SEQ ID NO: 782682 - DNA, 25 bp, Mus musculus
tctacataggatcggtgcacaactg

SEQ ID NO: 782683 - DNA, 25 bp, Mus musculus
tctacataggatgggtgcacaactg

SEQ ID NO: 782684 - DNA, 25 bp, Mus musculus
tctacatcaatacgatgaaggacaa

SEQ ID NO: 782685 - DNA, 25 bp, Mus musculus
tctacatcaataggatgaaggacaa

SEQ ID NO: 782686 - DNA, 25 bp, Mus musculus
tctacatccaatcgcacaaggcttt

SEQ ID NO: 782687 - DNA, 25 bp, Mus musculus
tctacatccaatggcacaaggcttt

SEQ ID NO: 782688 - DNA, 25 bp, Mus musculus
tctacatcccacagtgtggagaatg

SEQ ID NO: 782689 - DNA, 25 bp, Mus musculus
tctacatcccactgtgtggagaatg

SEQ ID NO: 782690 - DNA, 25 bp, Mus musculus
tctacatcgccacagactctgagag

SEQ ID NO: 782691 - DNA, 25 bp, Mus musculus
tctacatcgccagagactctgagag

SEQ ID NO: 782692 - DNA, 25 bp, Mus musculus
tctacatcgtagcacggatcataaa

SEQ ID NO: 782693 - DNA, 25 bp, Mus musculus
tctacatcgtaggacggatcataaa

SEQ ID NO: 782694 - DNA, 25 bp, Mus musculus
tctacatctatgaccgaatgaggct

SEQ ID NO: 782695 - DNA, 25 bp, Mus musculus
tctacatctatgtccgaatgaggct

SEQ ID NO: 782696 - DNA, 25 bp, Mus musculus
tctacatctgcaaagaggaaaaagc

SEQ ID NO: 782697 - DNA, 25 bp, Mus musculus
tctacatctgcatagaggaaaaagc

SEQ ID NO: 782698 - DNA, 25 bp, Mus musculus
tctacatcttttcaggaactggaag

SEQ ID NO: 782699 - DNA, 25 bp, Mus musculus
tctacatcttttgaggaactggaag

SEQ ID NO: 782700 - DNA, 25 bp, Mus musculus
tctacatgaaggcagcagacgtcgt

SEQ ID NO: 782701 - DNA, 25 bp, Mus musculus
tctacatgaagggagcagacgtcgt

SEQ ID NO: 782702 - DNA, 25 bp, Mus musculus
tctacatgaagtatgacacaccttt

SEQ ID NO: 782703 - DNA, 25 bp, Mus musculus
tctacatgaagtttgacacaccttt

SEQ ID NO: 782704 - DNA, 25 bp, Mus musculus
tctacatggacgaacaggccaccac

SEQ ID NO: 782705 - DNA, 25 bp, Mus musculus
tctacatggacgtacaggccaccac

SEQ ID NO: 782706 - DNA, 25 bp, Mus musculus
tctacatgggagatctgattgcagt

SEQ ID NO: 782707 - DNA, 25 bp, Mus musculus
tctacatgggagttctgattgcagt

SEQ ID NO: 782708 - DNA, 25 bp, Mus musculus
tctacatggtgcagagcctcttcat

SEQ ID NO: 782709 - DNA, 25 bp, Mus musculus
tctacatggtgctgagcctcttcat

SEQ ID NO: 782710 - DNA, 25 bp, Mus musculus
tctacatgttggaggagtttgtggt

SEQ ID NO: 782711 - DNA, 25 bp, Mus musculus
tctacatgttggtggagtttgtggt

SEQ ID NO: 782712 - DNA, 25 bp, Mus musculus
tctacattaagaacttggatgacac

SEQ ID NO: 782713 - DNA, 25 bp, Mus musculus
tctacattaagatcttggatgacac

SEQ ID NO: 782714 - DNA, 25 bp, Mus musculus
tctacattacatcgagagccggaag

SEQ ID NO: 782715 - DNA, 25 bp, Mus musculus
tctacattacatggagagccggaag

SEQ ID NO: 782716 - DNA, 25 bp, Mus musculus
tctacattcatgaagggaccttcat

SEQ ID NO: 782717 - DNA, 25 bp, Mus musculus
tctacattcatgtagggaccttcat

SEQ ID NO: 782718 - DNA, 25 bp, Mus musculus
tctacattcggcctgcagtgcctgc

SEQ ID NO: 782719 - DNA, 25 bp, Mus musculus
tctacattcggcgtgcagtgcctgc

SEQ ID NO: 782720 - DNA, 25 bp, Mus musculus
tctacattctcaatgctgtgggagc

SEQ ID NO: 782721 - DNA, 25 bp, Mus musculus
tctacattctcattgctgtgggagc

SEQ ID NO: 782722 - DNA, 25 bp, Mus musculus
tctacattgtagagataatggctct

SEQ ID NO: 782723 - DNA, 25 bp, Mus musculus
tctacattgtagtgataatggctct

SEQ ID NO: 782724 - DNA, 25 bp, Mus musculus
tctacatttctgaaggaactcactc

SEQ ID NO: 782725 - DNA, 25 bp, Mus musculus
tctacatttctgtaggaactcactc

SEQ ID NO: 782726 - DNA, 25 bp, Mus musculus
tctaccaaaagaccatatgcaaaag

SEQ ID NO: 782727 - DNA, 25 bp, Mus musculus
tctaccaaaagagcatatgcaaaag

SEQ ID NO: 782728 - DNA, 25 bp, Mus musculus
tctaccaaagcaagaactcccagta

SEQ ID NO: 782729 - DNA, 25 bp, Mus musculus
tctaccaaagcatgaactcccagta

SEQ ID NO: 782730 - DNA, 25 bp, Mus musculus
tctaccaaatcacatgatgctaaag

SEQ ID NO: 782731 - DNA, 25 bp, Mus musculus
tctaccaaatcagatgatgctaaag

SEQ ID NO: 782732 - DNA, 25 bp, Mus musculus
tctaccaagcccatcagtgaggtgc

SEQ ID NO: 782733 - DNA, 25 bp, Mus musculus
tctaccaagcccttcagtgaggtgc

SEQ ID NO: 782734 - DNA, 25 bp, Mus musculus
tctaccaatcctatcctggaagatg

SEQ ID NO: 782735 - DNA, 25 bp, Mus musculus
tctaccaatcctttcctggaagatg

SEQ ID NO: 782736 - DNA, 25 bp, Mus musculus
tctaccacagctatggccgcgtgct

SEQ ID NO: 782737 - DNA, 25 bp, Mus musculus
tctaccacagctttggccgcgtgct

SEQ ID NO: 782738 - DNA, 25 bp, Mus musculus
tctaccactctgcaggtatgtgggc

SEQ ID NO: 782739 - DNA, 25 bp, Mus musculus
tctaccactctggaggtatgtgggc

SEQ ID NO: 782740 - DNA, 25 bp, Mus musculus
tctaccagaacgcaggaccgatcat

SEQ ID NO: 782741 - DNA, 25 bp, Mus musculus
tctaccagaacggaggaccgatcat

SEQ ID NO: 782742 - DNA, 25 bp, Mus musculus
tctaccagacttcagagaaatgctc

SEQ ID NO: 782743 - DNA, 25 bp, Mus musculus
tctaccagacttgagagaaatgctc

SEQ ID NO: 782744 - DNA, 25 bp, Mus musculus
tctaccagagggatagagaagaaga

SEQ ID NO: 782745 - DNA, 25 bp, Mus musculus
tctaccagagggttagagaagaaga

SEQ ID NO: 782746 - DNA, 25 bp, Mus musculus
tctaccagatgtaccacaccagtgt

SEQ ID NO: 782747 - DNA, 25 bp, Mus musculus
tctaccagatgttccacaccagtgt

SEQ ID NO: 782748 - DNA, 25 bp, Mus musculus
tctaccagcagaagcgtaggaaggg

SEQ ID NO: 782749 - DNA, 25 bp, Mus musculus
tctaccagcagatgcgtaggaaggg

SEQ ID NO: 782750 - DNA, 25 bp, Mus musculus
tctaccagccgacgtgcatcgtgct

SEQ ID NO: 782751 - DNA, 25 bp, Mus musculus
tctaccagccgaggtgcatcgtgct

SEQ ID NO: 782752 - DNA, 25 bp, Mus musculus
tctaccagcgaacgtgtgatgacgg

SEQ ID NO: 782753 - DNA, 25 bp, Mus musculus
tctaccagcgaaggtgtgatgacgg

SEQ ID NO: 782754 - DNA, 25 bp, Mus musculus
tctaccagcgccagtacttcaagga

SEQ ID NO: 782755 - DNA, 25 bp, Mus musculus
tctaccagcgcctgtacttcaagga

SEQ ID NO: 782756 - DNA, 25 bp, Mus musculus
tctaccagctgaagtaaaattggac

SEQ ID NO: 782757 - DNA, 25 bp, Mus musculus
tctaccagctgatgtaaaattggac

SEQ ID NO: 782758 - DNA, 25 bp, Mus musculus
tctaccaggagcagcacgtggactc

SEQ ID NO: 782759 - DNA, 25 bp, Mus musculus
tctaccaggagctgcacgtggactc

SEQ ID NO: 782760 - DNA, 25 bp, Mus musculus
tctaccagggtccatacaaggttgg

SEQ ID NO: 782761 - DNA, 25 bp, Mus musculus
tctaccagggtcgatacaaggttgg

SEQ ID NO: 782762 - DNA, 25 bp, Mus musculus
tctaccagtcttaaggtaaggacat

SEQ ID NO: 782763 - DNA, 25 bp, Mus musculus
tctaccagtctttaggtaaggacat

SEQ ID NO: 782764 - DNA, 25 bp, Mus musculus
tctaccagtgggagcgggatgaact

SEQ ID NO: 782765 - DNA, 25 bp, Mus musculus
tctaccagtgggtgcgggatgaact

SEQ ID NO: 782766 - DNA, 25 bp, Mus musculus
tctaccagtttgaagcagcctggga

SEQ ID NO: 782767 - DNA, 25 bp, Mus musculus
tctaccagtttgtagcagcctggga

SEQ ID NO: 782768 - DNA, 25 bp, Mus musculus
tctaccatggagaacaggacctgcc

SEQ ID NO: 782769 - DNA, 25 bp, Mus musculus
tctaccatggagtacaggacctgcc

SEQ ID NO: 782770 - DNA, 25 bp, Mus musculus
tctaccatgggtccagtccatagct

SEQ ID NO: 782771 - DNA, 25 bp, Mus musculus
tctaccatgggtgcagtccatagct

SEQ ID NO: 782772 - DNA, 25 bp, Mus musculus
tctaccatggtacatgtgagagtga

SEQ ID NO: 782773 - DNA, 25 bp, Mus musculus
tctaccatggtagatgtgagagtga

SEQ ID NO: 782774 - DNA, 25 bp, Mus musculus
tctaccatgtggaagagctggaccc

SEQ ID NO: 782775 - DNA, 25 bp, Mus musculus
tctaccatgtggtagagctggaccc

SEQ ID NO: 782776 - DNA, 25 bp, Mus musculus
tctaccattgacaatgtggaagacg

SEQ ID NO: 782777 - DNA, 25 bp, Mus musculus
tctaccattgactatgtggaagacg

SEQ ID NO: 782778 - DNA, 25 bp, Mus musculus
tctacccacattcctgacgacaggt

SEQ ID NO: 782779 - DNA, 25 bp, Mus musculus
tctacccacattgctgacgacaggt

SEQ ID NO: 782780 - DNA, 25 bp, Mus musculus
tctacccagaagcatgccatcttgg

SEQ ID NO: 782781 - DNA, 25 bp, Mus musculus
tctacccagaaggatgccatcttgg

SEQ ID NO: 782782 - DNA, 25 bp, Mus musculus
tctacccagaggagcgctacatgga

SEQ ID NO: 782783 - DNA, 25 bp, Mus musculus
tctacccagaggtgcgctacatgga

SEQ ID NO: 782784 - DNA, 25 bp, Mus musculus
tctacccatcgaagacacagtggaa

SEQ ID NO: 782785 - DNA, 25 bp, Mus musculus
tctacccatcgatgacacagtggaa

SEQ ID NO: 782786 - DNA, 25 bp, Mus musculus
tctaccccactgaggcggcgagatg

SEQ ID NO: 782787 - DNA, 25 bp, Mus musculus
tctaccccactgtggcggcgagatg

SEQ ID NO: 782788 - DNA, 25 bp, Mus musculus
tctaccccgagtctaaagagaacaa

SEQ ID NO: 782789 - DNA, 25 bp, Mus musculus
tctaccccgagtgtaaagagaacaa

SEQ ID NO: 782790 - DNA, 25 bp, Mus musculus
tctaccccggacagacgggtggcct

SEQ ID NO: 782791 - DNA, 25 bp, Mus musculus
tctaccccggactgacgggtggcct

SEQ ID NO: 782792 - DNA, 25 bp, Mus musculus
tctacccctattcgaagccagtagg

SEQ ID NO: 782793 - DNA, 25 bp, Mus musculus
tctacccctattggaagccagtagg

SEQ ID NO: 782794 - DNA, 25 bp, Mus musculus
tctacccggtcaagctgatgctatt

SEQ ID NO: 782795 - DNA, 25 bp, Mus musculus
tctacccggtcatgctgatgctatt

SEQ ID NO: 782796 - DNA, 25 bp, Mus musculus
tctacccgttcgagtttgaaagcag

SEQ ID NO: 782797 - DNA, 25 bp, Mus musculus
tctacccgttcgtgtttgaaagcag

SEQ ID NO: 782798 - DNA, 25 bp, Mus musculus
tctaccctggtcacatctggctaca

SEQ ID NO: 782799 - DNA, 25 bp, Mus musculus
tctaccctggtctcatctggctaca

SEQ ID NO: 782800 - DNA, 25 bp, Mus musculus
tctaccctgtgtccaagtaccaaca

SEQ ID NO: 782801 - DNA, 25 bp, Mus musculus
tctaccctgtgtcttttcaagaggc

SEQ ID NO: 782802 - DNA, 25 bp, Mus musculus
tctaccctgtgtgcaagtaccaaca

SEQ ID NO: 782803 - DNA, 25 bp, Mus musculus
tctaccctgtgtgttttcaagaggc

SEQ ID NO: 782804 - DNA, 25 bp, Mus musculus
tctacccttcagatcacatttgaca

SEQ ID NO: 782805 - DNA, 25 bp, Mus musculus
tctacccttcagcagacgccggaga

SEQ ID NO: 782806 - DNA, 25 bp, Mus musculus
tctacccttcaggagacgccggaga

SEQ ID NO: 782807 - DNA, 25 bp, Mus musculus
tctacccttcagttcacatttgaca

SEQ ID NO: 782808 - DNA, 25 bp, Mus musculus
tctacccttggcatgggacgcctct

SEQ ID NO: 782809 - DNA, 25 bp, Mus musculus
tctacccttggcttgggacgcctct

SEQ ID NO: 782810 - DNA, 25 bp, Mus musculus
tctaccgaattgctcagcaactggg

SEQ ID NO: 782811 - DNA, 25 bp, Mus musculus
tctaccgaattggtcagcaactggg

SEQ ID NO: 782812 - DNA, 25 bp, Mus musculus
tctaccgacacaacgcagatcttgc

SEQ ID NO: 782813 - DNA, 25 bp, Mus musculus
tctaccgacacatcgcagatcttgc

SEQ ID NO: 782814 - DNA, 25 bp, Mus musculus
tctaccgacagaagtcatcatgagc

SEQ ID NO: 782815 - DNA, 25 bp, Mus musculus
tctaccgacagatgtcatcatgagc

SEQ ID NO: 782816 - DNA, 25 bp, Mus musculus
tctaccgatgtaagtgggccctggc

SEQ ID NO: 782817 - DNA, 25 bp, Mus musculus
tctaccgatgtatgtgggccctggc

SEQ ID NO: 782818 - DNA, 25 bp, Mus musculus
tctaccgcgctacaatgaatgcctt

SEQ ID NO: 782819 - DNA, 25 bp, Mus musculus
tctaccgcgctagaatgaatgcctt

SEQ ID NO: 782820 - DNA, 25 bp, Mus musculus
tctaccgctgtcaggtccagaaggg

SEQ ID NO: 782821 - DNA, 25 bp, Mus musculus
tctaccgctgtctggtccagaaggg

SEQ ID NO: 782822 - DNA, 25 bp, Mus musculus
tctaccggatctattacctcaagga

SEQ ID NO: 782823 - DNA, 25 bp, Mus musculus
tctaccggatcttttacctcaagga

SEQ ID NO: 782824 - DNA, 25 bp, Mus musculus
tctaccgggcagcacctttctgggc

SEQ ID NO: 782825 - DNA, 25 bp, Mus musculus
tctaccgggcaggacctttctgggc

SEQ ID NO: 782826 - DNA, 25 bp, Mus musculus
tctaccgtcagtctgggctccagtg

SEQ ID NO: 782827 - DNA, 25 bp, Mus musculus
tctaccgtcagtgtgggctccagtg

SEQ ID NO: 782828 - DNA, 25 bp, Mus musculus
tctaccgtgaatcttggctgtaaac

SEQ ID NO: 782829 - DNA, 25 bp, Mus musculus
tctaccgtgaatgttggctgtaaac

SEQ ID NO: 782830 - DNA, 25 bp, Mus musculus
tctaccgtttccagaagccgtggct

SEQ ID NO: 782831 - DNA, 25 bp, Mus musculus
tctaccgtttcctgaagccgtggct

SEQ ID NO: 782832 - DNA, 25 bp, Mus musculus
tctacctagaggagttggaatctgg

SEQ ID NO: 782833 - DNA, 25 bp, Mus musculus
tctacctagaggtgttggaatctgg

SEQ ID NO: 782834 - DNA, 25 bp, Mus musculus
tctacctcacctcagtggtcagggc

SEQ ID NO: 782835 - DNA, 25 bp, Mus musculus
tctacctcacctgagtggtcagggc

SEQ ID NO: 782836 - DNA, 25 bp, Mus musculus
tctacctcagggagactcgggcggc

SEQ ID NO: 782837 - DNA, 25 bp, Mus musculus
tctacctcagggtgactcgggcggc

SEQ ID NO: 782838 - DNA, 25 bp, Mus musculus
tctacctcatacactggcccatggg

SEQ ID NO: 782839 - DNA, 25 bp, Mus musculus
tctacctcatactctggcccatggg

SEQ ID NO: 782840 - DNA, 25 bp, Mus musculus
tctacctccatccaattgctggagt

SEQ ID NO: 782841 - DNA, 25 bp, Mus musculus
tctacctccatcgaattgctggagt

SEQ ID NO: 782842 - DNA, 25 bp, Mus musculus
tctacctcggcaagaacgagaaggg

SEQ ID NO: 782843 - DNA, 25 bp, Mus musculus
tctacctcggcatgaacgagaaggg

SEQ ID NO: 782844 - DNA, 25 bp, Mus musculus
tctacctcgggaactttgtggcctt

SEQ ID NO: 782845 - DNA, 25 bp, Mus musculus
tctacctcgggatctttgtggcctt

SEQ ID NO: 782846 - DNA, 25 bp, Mus musculus
tctacctctgtcagttttctgggcc

SEQ ID NO: 782847 - DNA, 25 bp, Mus musculus
tctacctctgtctgttttctgggcc

SEQ ID NO: 782848 - DNA, 25 bp, Mus musculus
tctacctgaagcaaggaggcaaaaa

SEQ ID NO: 782849 - DNA, 25 bp, Mus musculus
tctacctgaagccactgggccctgg

SEQ ID NO: 782850 - DNA, 25 bp, Mus musculus
tctacctgaagcgactgggccctgg

SEQ ID NO: 782851 - DNA, 25 bp, Mus musculus
tctacctgaagctaggaggcaaaaa

SEQ ID NO: 782852 - DNA, 25 bp, Mus musculus
tctacctgaatgagctacagcagag

SEQ ID NO: 782853 - DNA, 25 bp, Mus musculus
tctacctgaatgtgctacagcagag

SEQ ID NO: 782854 - DNA, 25 bp, Mus musculus
tctacctgatcaagggcagtgccct

SEQ ID NO: 782855 - DNA, 25 bp, Mus musculus
tctacctgatcatgggcagtgccct

SEQ ID NO: 782856 - DNA, 25 bp, Mus musculus
tctacctgcctaagcaaaacggtct

SEQ ID NO: 782857 - DNA, 25 bp, Mus musculus
tctacctgcctatgcaaaacggtct

SEQ ID NO: 782858 - DNA, 25 bp, Mus musculus
tctacctgctgaatgttctgttcat

SEQ ID NO: 782859 - DNA, 25 bp, Mus musculus
tctacctgctgattgttctgttcat

SEQ ID NO: 782860 - DNA, 25 bp, Mus musculus
tctacctgctggacgaggagagcaa

SEQ ID NO: 782861 - DNA, 25 bp, Mus musculus
tctacctgctggtcgaggagagcaa

SEQ ID NO: 782862 - DNA, 25 bp, Mus musculus
tctacctggaaaccccgagtgtcga

SEQ ID NO: 782863 - DNA, 25 bp, Mus musculus
tctacctggaaagcccgagtgtcga

SEQ ID NO: 782864 - DNA, 25 bp, Mus musculus
tctacctggaatagaggtgctttgg

SEQ ID NO: 782865 - DNA, 25 bp, Mus musculus
tctacctggaattgaggtgctttgg

SEQ ID NO: 782866 - DNA, 25 bp, Mus musculus
tctacctggactaaccggcagggct

SEQ ID NO: 782867 - DNA, 25 bp, Mus musculus
tctacctggacttaccggcagggct

SEQ ID NO: 782868 - DNA, 25 bp, Mus musculus
tctacctggcagagatcacactagc

SEQ ID NO: 782869 - DNA, 25 bp, Mus musculus
tctacctggcagtgatcacactagc

SEQ ID NO: 782870 - DNA, 25 bp, Mus musculus
tctacctggcgtcggccttgaactc

SEQ ID NO: 782871 - DNA, 25 bp, Mus musculus
tctacctggcgtgggccttgaactc

SEQ ID NO: 782872 - DNA, 25 bp, Mus musculus
tctacctgggagattgtgtgcgaca

SEQ ID NO: 782873 - DNA, 25 bp, Mus musculus
tctacctgggagtttgtgtgcgaca

SEQ ID NO: 782874 - DNA, 25 bp, Mus musculus
tctacctgggctattgcttctgtgg

SEQ ID NO: 782875 - DNA, 25 bp, Mus musculus
tctacctgggcttttgcttctgtgg

SEQ ID NO: 782876 - DNA, 25 bp, Mus musculus
tctacctggtcaacaaaggccctgg

SEQ ID NO: 782877 - DNA, 25 bp, Mus musculus
tctacctggtcatcaaaggccctgg

SEQ ID NO: 782878 - DNA, 25 bp, Mus musculus
tctacctgtgtacggcatatgccag

SEQ ID NO: 782879 - DNA, 25 bp, Mus musculus
tctacctgtgtagggcatatgccag

SEQ ID NO: 782880 - DNA, 25 bp, Mus musculus
tctaccttcccaactgacctaggat

SEQ ID NO: 782881 - DNA, 25 bp, Mus musculus
tctaccttcccatctgacctaggat

SEQ ID NO: 782882 - DNA, 25 bp, Mus musculus
tctaccttctgtcactggtggaaaa

SEQ ID NO: 782883 - DNA, 25 bp, Mus musculus
tctaccttctgtgactggtggaaaa

SEQ ID NO: 782884 - DNA, 25 bp, Mus musculus
tctaccttgctacggacgggctgca

SEQ ID NO: 782885 - DNA, 25 bp, Mus musculus
tctaccttgctagggacgggctgca

SEQ ID NO: 782886 - DNA, 25 bp, Mus musculus
tctacgaacattacagcagtccaca

SEQ ID NO: 782887 - DNA, 25 bp, Mus musculus
tctacgaacatttcagcagtccaca

SEQ ID NO: 782888 - DNA, 25 bp, Mus musculus
tctacgaactagaggactggttcct

SEQ ID NO: 782889 - DNA, 25 bp, Mus musculus
tctacgaactagtggactggttcct

SEQ ID NO: 782890 - DNA, 25 bp, Mus musculus
tctacgaagacaacgaacacttcct

SEQ ID NO: 782891 - DNA, 25 bp, Mus musculus
tctacgaagacatcgaacacttcct

SEQ ID NO: 782892 - DNA, 25 bp, Mus musculus
tctacgaagcgcagaaagagaatga

SEQ ID NO: 782893 - DNA, 25 bp, Mus musculus
tctacgaagcgctgaaagagaatga

SEQ ID NO: 782894 - DNA, 25 bp, Mus musculus
tctacgaatgcaactcaaggtgtcg

SEQ ID NO: 782895 - DNA, 25 bp, Mus musculus
tctacgaatgcatctcaaggtgtcg

SEQ ID NO: 782896 - DNA, 25 bp, Mus musculus
tctacgaatgtccacctaggcaggg

SEQ ID NO: 782897 - DNA, 25 bp, Mus musculus
tctacgaatgtcgacctaggcaggg

SEQ ID NO: 782898 - DNA, 25 bp, Mus musculus
tctacgaccccgatgtgggcaactt

SEQ ID NO: 782899 - DNA, 25 bp, Mus musculus
tctacgaccccgttgtgggcaactt

SEQ ID NO: 782900 - DNA, 25 bp, Mus musculus
tctacgacgcacagccggaagttcc

SEQ ID NO: 782901 - DNA, 25 bp, Mus musculus
tctacgacgcactgccggaagttcc

SEQ ID NO: 782902 - DNA, 25 bp, Mus musculus
tctacgagctcaagcaggcctgtgc

SEQ ID NO: 782903 - DNA, 25 bp, Mus musculus
tctacgagctcatgcaggcctgtgc

SEQ ID NO: 782904 - DNA, 25 bp, Mus musculus
tctacgaggcatagatttaaggact

SEQ ID NO: 782905 - DNA, 25 bp, Mus musculus
tctacgaggcattgatttaaggact

SEQ ID NO: 782906 - DNA, 25 bp, Mus musculus
tctacgcaaccgactcgggcagtac

SEQ ID NO: 782907 - DNA, 25 bp, Mus musculus
tctacgcaaccgtctcgggcagtac

SEQ ID NO: 782908 - DNA, 25 bp, Mus musculus
tctacgcacccgaacggctgtaggg

SEQ ID NO: 782909 - DNA, 25 bp, Mus musculus
tctacgcacccgtacggctgtaggg

SEQ ID NO: 782910 - DNA, 25 bp, Mus musculus
tctacgccctgaagcggatcctgtg

SEQ ID NO: 782911 - DNA, 25 bp, Mus musculus
tctacgccctgatgcggatcctgtg

SEQ ID NO: 782912 - DNA, 25 bp, Mus musculus
tctacgcggtcgagtctgaggagcc

SEQ ID NO: 782913 - DNA, 25 bp, Mus musculus
tctacgcggtcgtgtctgaggagcc

SEQ ID NO: 782914 - DNA, 25 bp, Mus musculus
tctacgctcctaaactccaagagtt

SEQ ID NO: 782915 - DNA, 25 bp, Mus musculus
tctacgctcctatactccaagagtt

SEQ ID NO: 782916 - DNA, 25 bp, Mus musculus
tctacgctctgcagagtctctggcc

SEQ ID NO: 782917 - DNA, 25 bp, Mus musculus
tctacgctctgctgagtctctggcc

SEQ ID NO: 782918 - DNA, 25 bp, Mus musculus
tctacgctgagcagctctcgggatc

SEQ ID NO: 782919 - DNA, 25 bp, Mus musculus
tctacgctgagctgctctcgggatc

SEQ ID NO: 782920 - DNA, 25 bp, Mus musculus
tctacggagggcagtgtcgtcagca

SEQ ID NO: 782921 - DNA, 25 bp, Mus musculus
tctacggagggctgtgtcgtcagca

SEQ ID NO: 782922 - DNA, 25 bp, Mus musculus
tctacggcaacactctgcagtccat

SEQ ID NO: 782923 - DNA, 25 bp, Mus musculus
tctacggcaacagtctgcagtccat

SEQ ID NO: 782924 - DNA, 25 bp, Mus musculus
tctacgggtcacatgggtaggagtc

SEQ ID NO: 782925 - DNA, 25 bp, Mus musculus
tctacgggtcacttgggtaggagtc

SEQ ID NO: 782926 - DNA, 25 bp, Mus musculus
tctacggtcaacagacagtgttcat

SEQ ID NO: 782927 - DNA, 25 bp, Mus musculus
tctacggtcaactgacagtgttcat

SEQ ID NO: 782928 - DNA, 25 bp, Mus musculus
tctacggtctcaacgtggccctaat

SEQ ID NO: 782929 - DNA, 25 bp, Mus musculus
tctacggtctcatcgtggccctaat

SEQ ID NO: 782930 - DNA, 25 bp, Mus musculus
tctacgtattgaagagcgggctgga

SEQ ID NO: 782931 - DNA, 25 bp, Mus musculus
tctacgtattgatgagcgggctgga

SEQ ID NO: 782932 - DNA, 25 bp, Mus musculus
tctacgtcatctcagttgtgtggaa

SEQ ID NO: 782933 - DNA, 25 bp, Mus musculus
tctacgtcatctgagttgtgtggaa

SEQ ID NO: 782934 - DNA, 25 bp, Mus musculus
tctacgtctgggaatttggggtcca

SEQ ID NO: 782935 - DNA, 25 bp, Mus musculus
tctacgtctgggtatttggggtcca

SEQ ID NO: 782936 - DNA, 25 bp, Mus musculus
tctacgtcttaacgcagagactagc

SEQ ID NO: 782937 - DNA, 25 bp, Mus musculus
tctacgtcttaaggcagagactagc

SEQ ID NO: 782938 - DNA, 25 bp, Mus musculus
tctacgtctttgagcgtttccccac

SEQ ID NO: 782939 - DNA, 25 bp, Mus musculus
tctacgtctttgtgcgtttccccac

SEQ ID NO: 782940 - DNA, 25 bp, Mus musculus
tctacgtgaactcgctcaacatggt

SEQ ID NO: 782941 - DNA, 25 bp, Mus musculus
tctacgtgaactggctcaacatggt

SEQ ID NO: 782942 - DNA, 25 bp, Mus musculus
tctacgtgggctctgataaataccc

SEQ ID NO: 782943 - DNA, 25 bp, Mus musculus
tctacgtgggctgtgataaataccc

SEQ ID NO: 782944 - DNA, 25 bp, Mus musculus
tctacgtgtacaatgagtcccagga

SEQ ID NO: 782945 - DNA, 25 bp, Mus musculus
tctacgtgtacattgagtcccagga

SEQ ID NO: 782946 - DNA, 25 bp, Mus musculus
tctacgtgtatgcaggcatcctggc

SEQ ID NO: 782947 - DNA, 25 bp, Mus musculus
tctacgtgtatggaggcatcctggc

SEQ ID NO: 782948 - DNA, 25 bp, Mus musculus
tctacgttctgtccattgagacttc

SEQ ID NO: 782949 - DNA, 25 bp, Mus musculus
tctacgttctgtgcattgagacttc

SEQ ID NO: 782950 - DNA, 25 bp, Mus musculus
tctactaattttcccatgaaaaggg

SEQ ID NO: 782951 - DNA, 25 bp, Mus musculus
tctactaattttgccatgaaaaggg

SEQ ID NO: 782952 - DNA, 25 bp, Mus musculus
tctactacaactaccatccaggagg

SEQ ID NO: 782953 - DNA, 25 bp, Mus musculus
tctactacaacttccatccaggagg

SEQ ID NO: 782954 - DNA, 25 bp, Mus musculus
tctactaccaacaataaaactgtct

SEQ ID NO: 782955 - DNA, 25 bp, Mus musculus
tctactaccaactataaaactgtct

SEQ ID NO: 782956 - DNA, 25 bp, Mus musculus
tctactactcccagaaggagtccac

SEQ ID NO: 782957 - DNA, 25 bp, Mus musculus
tctactactccctgaaggagtccac

SEQ ID NO: 782958 - DNA, 25 bp, Mus musculus
tctactagctctccctaaggctgta

SEQ ID NO: 782959 - DNA, 25 bp, Mus musculus
tctactagctctgcctaaggctgta

SEQ ID NO: 782960 - DNA, 25 bp, Mus musculus
tctactatgtgaacagtattgaggg

SEQ ID NO: 782961 - DNA, 25 bp, Mus musculus
tctactatgtgatcagtattgaggg

SEQ ID NO: 782962 - DNA, 25 bp, Mus musculus
tctactcagaatatggggacaagaa

SEQ ID NO: 782963 - DNA, 25 bp, Mus musculus
tctactcagaatttggggacaagaa

SEQ ID NO: 782964 - DNA, 25 bp, Mus musculus
tctactcagaggagggcaaaggagt

SEQ ID NO: 782965 - DNA, 25 bp, Mus musculus
tctactcagaggtgggcaaaggagt

SEQ ID NO: 782966 - DNA, 25 bp, Mus musculus
tctactccaacgagggctacagaag

SEQ ID NO: 782967 - DNA, 25 bp, Mus musculus
tctactccaacgtgggctacagaag

SEQ ID NO: 782968 - DNA, 25 bp, Mus musculus
tctactccatcgagggactcagcag

SEQ ID NO: 782969 - DNA, 25 bp, Mus musculus
tctactccatcgtgggactcagcag

SEQ ID NO: 782970 - DNA, 25 bp, Mus musculus
tctactccgaagctttgcttttgga

SEQ ID NO: 782971 - DNA, 25 bp, Mus musculus
tctactccgaaggtttgcttttgga

SEQ ID NO: 782972 - DNA, 25 bp, Mus musculus
tctactccggtgacagttccgggcg

SEQ ID NO: 782973 - DNA, 25 bp, Mus musculus
tctactccggtgtcagttccgggcg

SEQ ID NO: 782974 - DNA, 25 bp, Mus musculus
tctactccgtataccgcaatgctgc

SEQ ID NO: 782975 - DNA, 25 bp, Mus musculus
tctactccgtattccgcaatgctgc

SEQ ID NO: 782976 - DNA, 25 bp, Mus musculus
tctactcctttgctgagtgggctct

SEQ ID NO: 782977 - DNA, 25 bp, Mus musculus
tctactcctttggtgagtgggctct

SEQ ID NO: 782978 - DNA, 25 bp, Mus musculus
tctactcgcaacatgtctgagaccc

SEQ ID NO: 782979 - DNA, 25 bp, Mus musculus
tctactcgcaacttgtctgagaccc

SEQ ID NO: 782980 - DNA, 25 bp, Mus musculus
tctactcgggacactcttcattctc

SEQ ID NO: 782981 - DNA, 25 bp, Mus musculus
tctactcgggactctcttcattctc

SEQ ID NO: 782982 - DNA, 25 bp, Mus musculus
tctactcgtcttattgctgtgctga

SEQ ID NO: 782983 - DNA, 25 bp, Mus musculus
tctactcgtctttttgctgtgctga

SEQ ID NO: 782984 - DNA, 25 bp, Mus musculus
tctactctgagaaggaatgcaaaga

SEQ ID NO: 782985 - DNA, 25 bp, Mus musculus
tctactctgagatggaatgcaaaga

SEQ ID NO: 782986 - DNA, 25 bp, Mus musculus
tctactctgccgaggatgatgcgtc

SEQ ID NO: 782987 - DNA, 25 bp, Mus musculus
tctactctgccgtggatgatgcgtc

SEQ ID NO: 782988 - DNA, 25 bp, Mus musculus
tctactctgcttcttgggacataag

SEQ ID NO: 782989 - DNA, 25 bp, Mus musculus
tctactctgcttgttgggacataag

SEQ ID NO: 782990 - DNA, 25 bp, Mus musculus
tctactctgggaaggtatcaagggc

SEQ ID NO: 782991 - DNA, 25 bp, Mus musculus
tctactctgggatggtatcaagggc

SEQ ID NO: 782992 - DNA, 25 bp, Mus musculus
tctactctgggtctgtggcctttgc

SEQ ID NO: 782993 - DNA, 25 bp, Mus musculus
tctactctgggtgtgtggcctttgc

SEQ ID NO: 782994 - DNA, 25 bp, Mus musculus
tctactgaaaaaatggatgaagaag

SEQ ID NO: 782995 - DNA, 25 bp, Mus musculus
tctactgaaaaattggatgaagaag

SEQ ID NO: 782996 - DNA, 25 bp, Mus musculus
tctactgaaaatcgtgatgcatgcc

SEQ ID NO: 782997 - DNA, 25 bp, Mus musculus
tctactgaaaatggtgatgcatgcc

SEQ ID NO: 782998 - DNA, 25 bp, Mus musculus
tctactgaactgaaagcccacaaag

SEQ ID NO: 782999 - DNA, 25 bp, Mus musculus
tctactgaactgtaagcccacaaag

SEQ ID NO: 783000 - DNA, 25 bp, Mus musculus
tctactgaagacacccatgatgaaa

SEQ ID NO: 783001 - DNA, 25 bp, Mus musculus
tctactgaagactcccatgatgaaa

SEQ ID NO: 783002 - DNA, 25 bp, Mus musculus
tctactgagtgaaggtgataaggtc

SEQ ID NO: 783003 - DNA, 25 bp, Mus musculus
tctactgagtgatggtgataaggtc

SEQ ID NO: 783004 - DNA, 25 bp, Mus musculus
tctactgatacaagcccggtggttc

SEQ ID NO: 783005 - DNA, 25 bp, Mus musculus
tctactgatacatgcccggtggttc

SEQ ID NO: 783006 - DNA, 25 bp, Mus musculus
tctactgcaacaatccgggactcta

SEQ ID NO: 783007 - DNA, 25 bp, Mus musculus
tctactgcaacattccgggactcta

SEQ ID NO: 783008 - DNA, 25 bp, Mus musculus
tctactgcaagacgcagttcatgga

SEQ ID NO: 783009 - DNA, 25 bp, Mus musculus
tctactgcaagaggcagttcatgga

SEQ ID NO: 783010 - DNA, 25 bp, Mus musculus
tctactgcactcaagaagcccttga

SEQ ID NO: 783011 - DNA, 25 bp, Mus musculus
tctactgcactctagaagcccttga

SEQ ID NO: 783012 - DNA, 25 bp, Mus musculus
tctactgcatctctcgcaaaccgga

SEQ ID NO: 783013 - DNA, 25 bp, Mus musculus
tctactgcatctgtcgcaaaccgga

SEQ ID NO: 783014 - DNA, 25 bp, Mus musculus
tctactgccaacacccaggagaggc

SEQ ID NO: 783015 - DNA, 25 bp, Mus musculus
tctactgccaactcccaggagaggc

SEQ ID NO: 783016 - DNA, 25 bp, Mus musculus
tctactgcctcacgaacacaagttc

SEQ ID NO: 783017 - DNA, 25 bp, Mus musculus
tctactgcctcaggaacacaagttc

SEQ ID NO: 783018 - DNA, 25 bp, Mus musculus
tctactgccttgactccacatctgg

SEQ ID NO: 783019 - DNA, 25 bp, Mus musculus
tctactgccttgtctccacatctgg

SEQ ID NO: 783020 - DNA, 25 bp, Mus musculus
tctactgcggctatatttgggacgg

SEQ ID NO: 783021 - DNA, 25 bp, Mus musculus
tctactgcggctttatttgggacgg

SEQ ID NO: 783022 - DNA, 25 bp, Mus musculus
tctactgcggtgaggaatcaaacaa

SEQ ID NO: 783023 - DNA, 25 bp, Mus musculus
tctactgcggtgtggaatcaaacaa

SEQ ID NO: 783024 - DNA, 25 bp, Mus musculus
tctactgctgcaaagccaacaatgg

SEQ ID NO: 783025 - DNA, 25 bp, Mus musculus
tctactgctgcatagccaacaatgg

SEQ ID NO: 783026 - DNA, 25 bp, Mus musculus
tctactgctgttctcacatatggcc

SEQ ID NO: 783027 - DNA, 25 bp, Mus musculus
tctactgctgttgtcacatatggcc

SEQ ID NO: 783028 - DNA, 25 bp, Mus musculus
tctactggaattcctcgaactccaa

SEQ ID NO: 783029 - DNA, 25 bp, Mus musculus
tctactggaattgctcgaactccaa

SEQ ID NO: 783030 - DNA, 25 bp, Mus musculus
tctactggacagcatcggcagccac

SEQ ID NO: 783031 - DNA, 25 bp, Mus musculus
tctactggacaggatcggcagccac

SEQ ID NO: 783032 - DNA, 25 bp, Mus musculus
tctactggacgacaggaaccattgt

SEQ ID NO: 783033 - DNA, 25 bp, Mus musculus
tctactggacgagaggaaccattgt

SEQ ID NO: 783034 - DNA, 25 bp, Mus musculus
tctactggactgatgcggcttctaa

SEQ ID NO: 783035 - DNA, 25 bp, Mus musculus
tctactggactgttgcggcttctaa

SEQ ID NO: 783036 - DNA, 25 bp, Mus musculus
tctactggatttaggtgcaagccgg

SEQ ID NO: 783037 - DNA, 25 bp, Mus musculus
tctactggattttggtgcaagccgg

SEQ ID NO: 783038 - DNA, 25 bp, Mus musculus
tctactggcaaaactgggaggtggt

SEQ ID NO: 783039 - DNA, 25 bp, Mus musculus
tctactggcaaatctgggaggtggt

SEQ ID NO: 783040 - DNA, 25 bp, Mus musculus
tctactggctcacaccctggattga

SEQ ID NO: 783041 - DNA, 25 bp, Mus musculus
tctactggctcagaccctggattga

SEQ ID NO: 783042 - DNA, 25 bp, Mus musculus
tctactgggactaaaggcagaagcg

SEQ ID NO: 783043 - DNA, 25 bp, Mus musculus
tctactgggacttaaggcagaagcg

SEQ ID NO: 783044 - DNA, 25 bp, Mus musculus
tctactgggaggaccggctgctgaa

SEQ ID NO: 783045 - DNA, 25 bp, Mus musculus
tctactgggaggtccggctgctgaa

SEQ ID NO: 783046 - DNA, 25 bp, Mus musculus
tctactgggctgactgaaggggctt

SEQ ID NO: 783047 - DNA, 25 bp, Mus musculus
tctactgggctgtctgaaggggctt

SEQ ID NO: 783048 - DNA, 25 bp, Mus musculus
tctactggtccgacctgtcccaaaa

SEQ ID NO: 783049 - DNA, 25 bp, Mus musculus
tctactggtccgtcctgtcccaaaa

SEQ ID NO: 783050 - DNA, 25 bp, Mus musculus
tctactgtggcaagaagaccctcga

SEQ ID NO: 783051 - DNA, 25 bp, Mus musculus
tctactgtggcatgaagaccctcga

SEQ ID NO: 783052 - DNA, 25 bp, Mus musculus
tctactgtgtgcagtgagtggtctc

SEQ ID NO: 783053 - DNA, 25 bp, Mus musculus
tctactgtgtgctgtgagtggtctc

SEQ ID NO: 783054 - DNA, 25 bp, Mus musculus
tctacttaatcaaggaatatgcaag

SEQ ID NO: 783055 - DNA, 25 bp, Mus musculus
tctacttaatcatggaatatgcaag

SEQ ID NO: 783056 - DNA, 25 bp, Mus musculus
tctacttacctgacggaaaatcggg

SEQ ID NO: 783057 - DNA, 25 bp, Mus musculus
tctacttacctgcttataactgtac

SEQ ID NO: 783058 - DNA, 25 bp, Mus musculus
tctacttacctggttataactgtac

SEQ ID NO: 783059 - DNA, 25 bp, Mus musculus
tctacttacctgtcggaaaatcggg

SEQ ID NO: 783060 - DNA, 25 bp, Mus musculus
tctacttactccctcagcagcttct

SEQ ID NO: 783061 - DNA, 25 bp, Mus musculus
tctacttactccgtcagcagcttct

SEQ ID NO: 783062 - DNA, 25 bp, Mus musculus
tctacttcaaccctcagaggagcag

SEQ ID NO: 783063 - DNA, 25 bp, Mus musculus
tctacttcaaccgtcagaggagcag

SEQ ID NO: 783064 - DNA, 25 bp, Mus musculus
tctacttcaagcaggggcccattta

SEQ ID NO: 783065 - DNA, 25 bp, Mus musculus
tctacttcaagctggggcccattta

SEQ ID NO: 783066 - DNA, 25 bp, Mus musculus
tctacttcatataacgggcgggatc

SEQ ID NO: 783067 - DNA, 25 bp, Mus musculus
tctacttcatattacgggcgggatc

SEQ ID NO: 783068 - DNA, 25 bp, Mus musculus
tctacttcctggctaccaactacta

SEQ ID NO: 783069 - DNA, 25 bp, Mus musculus
tctacttcctgggtaccaactacta

SEQ ID NO: 783070 - DNA, 25 bp, Mus musculus
tctacttcgagaactgcgagctgga

SEQ ID NO: 783071 - DNA, 25 bp, Mus musculus
tctacttcgagatctgcgagctgga

SEQ ID NO: 783072 - DNA, 25 bp, Mus musculus
tctacttcgggccttggactgagct

SEQ ID NO: 783073 - DNA, 25 bp, Mus musculus
tctacttcgggcgttggactgagct

SEQ ID NO: 783074 - DNA, 25 bp, Mus musculus
tctacttctcttcactcggtgcaag

SEQ ID NO: 783075 - DNA, 25 bp, Mus musculus
tctacttctcttgactcggtgcaag

SEQ ID NO: 783076 - DNA, 25 bp, Mus musculus
tctacttctggccatgcaggctttc

SEQ ID NO: 783077 - DNA, 25 bp, Mus musculus
tctacttctggcgatgcaggctttc

SEQ ID NO: 783078 - DNA, 25 bp, Mus musculus
tctacttctttaacctggctgtgct

SEQ ID NO: 783079 - DNA, 25 bp, Mus musculus
tctacttctttatcctggctgtgct

SEQ ID NO: 783080 - DNA, 25 bp, Mus musculus
tctacttgtgcgagcaaaatgaagc

SEQ ID NO: 783081 - DNA, 25 bp, Mus musculus
tctacttgtgcgtgcaaaatgaagc

SEQ ID NO: 783082 - DNA, 25 bp, Mus musculus
tctactttctgtaggtgcgacttga

SEQ ID NO: 783083 - DNA, 25 bp, Mus musculus
tctactttctgttggtgcgacttga

SEQ ID NO: 783084 - DNA, 25 bp, Mus musculus
tctactttgatgagaacatgaagcc

SEQ ID NO: 783085 - DNA, 25 bp, Mus musculus
tctactttgatgtgaacatgaagcc

SEQ ID NO: 783086 - DNA, 25 bp, Mus musculus
tctactttgcatccgttcctctcta

SEQ ID NO: 783087 - DNA, 25 bp, Mus musculus
tctactttgcatgcgttcctctcta

SEQ ID NO: 783088 - DNA, 25 bp, Mus musculus
tctactttgttgacccaggaaagat

SEQ ID NO: 783089 - DNA, 25 bp, Mus musculus
tctactttgttgtcccaggaaagat

SEQ ID NO: 783090 - DNA, 25 bp, Mus musculus
tctactttttgacatgtctcctggc

SEQ ID NO: 783091 - DNA, 25 bp, Mus musculus
tctactttttgagatgtctcctggc

SEQ ID NO: 783092 - DNA, 25 bp, Mus musculus
tctagaaaggacaccagggagggaa

SEQ ID NO: 783093 - DNA, 25 bp, Mus musculus
tctagaaaggactccagggagggaa

SEQ ID NO: 783094 - DNA, 25 bp, Mus musculus
tctagaaagggacaccgtgcagact

SEQ ID NO: 783095 - DNA, 25 bp, Mus musculus
tctagaaagggagaccgtgcagact

SEQ ID NO: 783096 - DNA, 25 bp, Mus musculus
tctagaaagtgaactgaaactattt

SEQ ID NO: 783097 - DNA, 25 bp, Mus musculus
tctagaaagtgatctgaaactattt

SEQ ID NO: 783098 - DNA, 25 bp, Mus musculus
tctagaaatctacagcacaggtcgg

SEQ ID NO: 783099 - DNA, 25 bp, Mus musculus
tctagaaatctagagcacaggtcgg

SEQ ID NO: 783100 - DNA, 25 bp, Mus musculus
tctagaagaacacaaaagatcacat

SEQ ID NO: 783101 - DNA, 25 bp, Mus musculus
tctagaagaacagaaaagatcacat

SEQ ID NO: 783102 - DNA, 25 bp, Mus musculus
tctagaagacttaccaaaataaatg

SEQ ID NO: 783103 - DNA, 25 bp, Mus musculus
tctagaagactttccaaaataaatg

SEQ ID NO: 783104 - DNA, 25 bp, Mus musculus
tctagaagagacacaggtagtagct

SEQ ID NO: 783105 - DNA, 25 bp, Mus musculus
tctagaagagactcaggtagtagct

SEQ ID NO: 783106 - DNA, 25 bp, Mus musculus
tctagaagccctagaacccttctgg

SEQ ID NO: 783107 - DNA, 25 bp, Mus musculus
tctagaagcccttgaacccttctgg

SEQ ID NO: 783108 - DNA, 25 bp, Mus musculus
tctagaaggaagaacattcaggatg

SEQ ID NO: 783109 - DNA, 25 bp, Mus musculus
tctagaaggaagtacattcaggatg

SEQ ID NO: 783110 - DNA, 25 bp, Mus musculus
tctagaagtgctcaggactgtgccc

SEQ ID NO: 783111 - DNA, 25 bp, Mus musculus
tctagaagtgctgaggactgtgccc

SEQ ID NO: 783112 - DNA, 25 bp, Mus musculus
tctagaagtggacgtatatcccagt

SEQ ID NO: 783113 - DNA, 25 bp, Mus musculus
tctagaagtggaggtatatcccagt

SEQ ID NO: 783114 - DNA, 25 bp, Mus musculus
tctagaatcgctcagtgtgcccgga

SEQ ID NO: 783115 - DNA, 25 bp, Mus musculus
tctagaatcgctgagtgtgcccgga

SEQ ID NO: 783116 - DNA, 25 bp, Mus musculus
tctagaatctgtccagaggctgaag

SEQ ID NO: 783117 - DNA, 25 bp, Mus musculus
tctagaatctgtgcagaggctgaag

SEQ ID NO: 783118 - DNA, 25 bp, Mus musculus
tctagaatgaaaagctcccaaaggg

SEQ ID NO: 783119 - DNA, 25 bp, Mus musculus
tctagaatgaaatgctcccaaaggg

SEQ ID NO: 783120 - DNA, 25 bp, Mus musculus
tctagacagaacaggagagcatgta

SEQ ID NO: 783121 - DNA, 25 bp, Mus musculus
tctagacagaactggagagcatgta

SEQ ID NO: 783122 - DNA, 25 bp, Mus musculus
tctagacagtagactataatagctt

SEQ ID NO: 783123 - DNA, 25 bp, Mus musculus
tctagacagtagtctataatagctt

SEQ ID NO: 783124 - DNA, 25 bp, Mus musculus
tctagacatgaaccaattccgaatg

SEQ ID NO: 783125 - DNA, 25 bp, Mus musculus
tctagacatgaagcaattccgaatg

SEQ ID NO: 783126 - DNA, 25 bp, Mus musculus
tctagaccactgcaagatcacttgt

SEQ ID NO: 783127 - DNA, 25 bp, Mus musculus
tctagaccactggaagatcacttgt

SEQ ID NO: 783128 - DNA, 25 bp, Mus musculus
tctagacgatgtccggcggatgaac

SEQ ID NO: 783129 - DNA, 25 bp, Mus musculus
tctagacgatgtgcggcggatgaac

SEQ ID NO: 783130 - DNA, 25 bp, Mus musculus
tctagactcagtagagttgacaacc

SEQ ID NO: 783131 - DNA, 25 bp, Mus musculus
tctagactcagttgagttgacaacc

SEQ ID NO: 783132 - DNA, 25 bp, Mus musculus
tctagactcttgcatctgagagata

SEQ ID NO: 783133 - DNA, 25 bp, Mus musculus
tctagactcttggatctgagagata

SEQ ID NO: 783134 - DNA, 25 bp, Mus musculus
tctagactgaatctggtcacagcct

SEQ ID NO: 783135 - DNA, 25 bp, Mus musculus
tctagactgaatgtggtcacagcct

SEQ ID NO: 783136 - DNA, 25 bp, Mus musculus
tctagactgaccattaacttgtggg

SEQ ID NO: 783137 - DNA, 25 bp, Mus musculus
tctagactgacctttaacttgtggg

SEQ ID NO: 783138 - DNA, 25 bp, Mus musculus
tctagactgccacgaagtcccggga

SEQ ID NO: 783139 - DNA, 25 bp, Mus musculus
tctagactgccaggaagtcccggga

SEQ ID NO: 783140 - DNA, 25 bp, Mus musculus
tctagacttttaaagcctagactgc

SEQ ID NO: 783141 - DNA, 25 bp, Mus musculus
tctagacttttatagcctagactgc

SEQ ID NO: 783142 - DNA, 25 bp, Mus musculus
tctagagaatcaagcaggaggatca

SEQ ID NO: 783143 - DNA, 25 bp, Mus musculus
tctagagaatcatgcaggaggatca

SEQ ID NO: 783144 - DNA, 25 bp, Mus musculus
tctagagactgtaaaacttgtcaga

SEQ ID NO: 783145 - DNA, 25 bp, Mus musculus
tctagagactgttaaacttgtcaga

SEQ ID NO: 783146 - DNA, 25 bp, Mus musculus
tctagagagaagagaaattacctgg

SEQ ID NO: 783147 - DNA, 25 bp, Mus musculus
tctagagagaagtgaaattacctgg

SEQ ID NO: 783148 - DNA, 25 bp, Mus musculus
tctagagatcaactcccaggacagg

SEQ ID NO: 783149 - DNA, 25 bp, Mus musculus
tctagagatcaagtcccaggacagg

SEQ ID NO: 783150 - DNA, 25 bp, Mus musculus
tctagagcacatctgtaagacagga

SEQ ID NO: 783151 - DNA, 25 bp, Mus musculus
tctagagcacatgtgtaagacagga

SEQ ID NO: 783152 - DNA, 25 bp, Mus musculus
tctagagcgcatcgccaggaagccc

SEQ ID NO: 783153 - DNA, 25 bp, Mus musculus
tctagagcgcatggccaggaagccc

SEQ ID NO: 783154 - DNA, 25 bp, Mus musculus
tctagagcgcctctggaggcagttt

SEQ ID NO: 783155 - DNA, 25 bp, Mus musculus
tctagagcgcctgtggaggcagttt

SEQ ID NO: 783156 - DNA, 25 bp, Mus musculus
tctagagctttgactcagctggcag

SEQ ID NO: 783157 - DNA, 25 bp, Mus musculus
tctagagctttgtctcagctggcag

SEQ ID NO: 783158 - DNA, 25 bp, Mus musculus
tctagaggaaggacctcctcacact

SEQ ID NO: 783159 - DNA, 25 bp, Mus musculus
tctagaggaaggtcctcctcacact

SEQ ID NO: 783160 - DNA, 25 bp, Mus musculus
tctagaggaggtcagatcagacccc

SEQ ID NO: 783161 - DNA, 25 bp, Mus musculus
tctagaggaggtgagatcagacccc

SEQ ID NO: 783162 - DNA, 25 bp, Mus musculus
tctagaggccgactactcaggactt

SEQ ID NO: 783163 - DNA, 25 bp, Mus musculus
tctagaggccgagtactcaggactt

SEQ ID NO: 783164 - DNA, 25 bp, Mus musculus
tctagagggagaccaagacagacac

SEQ ID NO: 783165 - DNA, 25 bp, Mus musculus
tctagagggagagcaagacagacac

SEQ ID NO: 783166 - DNA, 25 bp, Mus musculus
tctagagtagctcactgaggctccc

SEQ ID NO: 783167 - DNA, 25 bp, Mus musculus
tctagagtagctgactgaggctccc

SEQ ID NO: 783168 - DNA, 25 bp, Mus musculus
tctagagtgcctcaggaaccagtgc

SEQ ID NO: 783169 - DNA, 25 bp, Mus musculus
tctagagtgcctgaggaaccagtgc

SEQ ID NO: 783170 - DNA, 25 bp, Mus musculus
tctagagtggatctgtatacaacac

SEQ ID NO: 783171 - DNA, 25 bp, Mus musculus
tctagagtggatgtgtatacaacac

SEQ ID NO: 783172 - DNA, 25 bp, Mus musculus
tctagagttcacaggcagaaactgc

SEQ ID NO: 783173 - DNA, 25 bp, Mus musculus
tctagagttcactggcagaaactgc

SEQ ID NO: 783174 - DNA, 25 bp, Mus musculus
tctagagttctaacgtgccaatgac

SEQ ID NO: 783175 - DNA, 25 bp, Mus musculus
tctagagttctatcgtgccaatgac

SEQ ID NO: 783176 - DNA, 25 bp, Mus musculus
tctagataagttcctggctggacca

SEQ ID NO: 783177 - DNA, 25 bp, Mus musculus
tctagataagttgctggctggacca

SEQ ID NO: 783178 - DNA, 25 bp, Mus musculus
tctagatacactacttgtggatgtt

SEQ ID NO: 783179 - DNA, 25 bp, Mus musculus
tctagatacacttcttgtggatgtt

SEQ ID NO: 783180 - DNA, 25 bp, Mus musculus
tctagatagggaagaaactgcctgg

SEQ ID NO: 783181 - DNA, 25 bp, Mus musculus
tctagatagggatgaaactgcctgg

SEQ ID NO: 783182 - DNA, 25 bp, Mus musculus
tctagatatacactatgaatgcttt

SEQ ID NO: 783183 - DNA, 25 bp, Mus musculus
tctagatatacagtatgaatgcttt

SEQ ID NO: 783184 - DNA, 25 bp, Mus musculus
tctagatatatgctggacatggccc

SEQ ID NO: 783185 - DNA, 25 bp, Mus musculus
tctagatatatggtggacatggccc

SEQ ID NO: 783186 - DNA, 25 bp, Mus musculus
tctagatcctaaaattgctcagaac

SEQ ID NO: 783187 - DNA, 25 bp, Mus musculus
tctagatcctaatattgctcagaac

SEQ ID NO: 783188 - DNA, 25 bp, Mus musculus
tctagatctcaaagattcggttggc

SEQ ID NO: 783189 - DNA, 25 bp, Mus musculus
tctagatctcaatgattcggttggc

SEQ ID NO: 783190 - DNA, 25 bp, Mus musculus
tctagatctctgatgcaagaaaccc

SEQ ID NO: 783191 - DNA, 25 bp, Mus musculus
tctagatctctgttgcaagaaaccc

SEQ ID NO: 783192 - DNA, 25 bp, Mus musculus
tctagatgagtaagctcgcacgccc

SEQ ID NO: 783193 - DNA, 25 bp, Mus musculus
tctagatgagtatgctcgcacgccc

SEQ ID NO: 783194 - DNA, 25 bp, Mus musculus
tctagatgatgtcgcaaccacagag

SEQ ID NO: 783195 - DNA, 25 bp, Mus musculus
tctagatgatgtggcaaccacagag

SEQ ID NO: 783196 - DNA, 25 bp, Mus musculus
tctagatgcaagagaaatcagagtg

SEQ ID NO: 783197 - DNA, 25 bp, Mus musculus
tctagatgcaagtgaaatcagagtg

SEQ ID NO: 783198 - DNA, 25 bp, Mus musculus
tctagcaaagttcgccctcactgag

SEQ ID NO: 783199 - DNA, 25 bp, Mus musculus
tctagcaaagttggccctcactgag

SEQ ID NO: 783200 - DNA, 25 bp, Mus musculus
tctagcaagactcttgtggatgatg

SEQ ID NO: 783201 - DNA, 25 bp, Mus musculus
tctagcaagactgttgtggatgatg

SEQ ID NO: 783202 - DNA, 25 bp, Mus musculus
tctagcaagcgactgacagaggcat

SEQ ID NO: 783203 - DNA, 25 bp, Mus musculus
tctagcaagcgagtgacagaggcat

SEQ ID NO: 783204 - DNA, 25 bp, Mus musculus
tctagcaagcttctcgatcttataa

SEQ ID NO: 783205 - DNA, 25 bp, Mus musculus
tctagcaagcttgtcgatcttataa

SEQ ID NO: 783206 - DNA, 25 bp, Mus musculus
tctagcacgttaacaacgcgcggtc

SEQ ID NO: 783207 - DNA, 25 bp, Mus musculus
tctagcacgttatcaacgcgcggtc

SEQ ID NO: 783208 - DNA, 25 bp, Mus musculus
tctagcagaactacttggattagtt

SEQ ID NO: 783209 - DNA, 25 bp, Mus musculus
tctagcagaacttcttggattagtt

SEQ ID NO: 783210 - DNA, 25 bp, Mus musculus
tctagcagagccctcatggacgcta

SEQ ID NO: 783211 - DNA, 25 bp, Mus musculus
tctagcagagccgtcatggacgcta

SEQ ID NO: 783212 - DNA, 25 bp, Mus musculus
tctagcagctacacccagcagatct

SEQ ID NO: 783213 - DNA, 25 bp, Mus musculus
tctagcagctactcccagcagatct

SEQ ID NO: 783214 - DNA, 25 bp, Mus musculus
tctagcagttcacggaagatcggtc

SEQ ID NO: 783215 - DNA, 25 bp, Mus musculus
tctagcagttcagggaagatcggtc

SEQ ID NO: 783216 - DNA, 25 bp, Mus musculus
tctagccaagtcactcatcaaatcc

SEQ ID NO: 783217 - DNA, 25 bp, Mus musculus
tctagccaagtctctcatcaaatcc

SEQ ID NO: 783218 - DNA, 25 bp, Mus musculus
tctagccaagttacatggctcctca

SEQ ID NO: 783219 - DNA, 25 bp, Mus musculus
tctagccaagtttcatggctcctca

SEQ ID NO: 783220 - DNA, 25 bp, Mus musculus
tctagccacagaatggaacacagtg

SEQ ID NO: 783221 - DNA, 25 bp, Mus musculus
tctagccacagattggaacacagtg

SEQ ID NO: 783222 - DNA, 25 bp, Mus musculus
tctagccaggaaagcaatggaatcc

SEQ ID NO: 783223 - DNA, 25 bp, Mus musculus
tctagccaggaatgcaatggaatcc

SEQ ID NO: 783224 - DNA, 25 bp, Mus musculus
tctagccagttgctgagcgctgtaa

SEQ ID NO: 783225 - DNA, 25 bp, Mus musculus
tctagccagttggtgagcgctgtaa

SEQ ID NO: 783226 - DNA, 25 bp, Mus musculus
tctagcccgacacattgaaaaagct

SEQ ID NO: 783227 - DNA, 25 bp, Mus musculus
tctagcccgacagattgaaaaagct

SEQ ID NO: 783228 - DNA, 25 bp, Mus musculus
tctagccctggacaagctgagtccg

SEQ ID NO: 783229 - DNA, 25 bp, Mus musculus
tctagccctggagaagctgagtccg

SEQ ID NO: 783230 - DNA, 25 bp, Mus musculus
tctagccctggcacgaaataagagc

SEQ ID NO: 783231 - DNA, 25 bp, Mus musculus
tctagccctggctcgaaataagagc

SEQ ID NO: 783232 - DNA, 25 bp, Mus musculus
tctagccggagcctttcgaggactc

SEQ ID NO: 783233 - DNA, 25 bp, Mus musculus
tctagccggagcgtttcgaggactc

SEQ ID NO: 783234 - DNA, 25 bp, Mus musculus
tctagccgggagcatgaaaggcctc

SEQ ID NO: 783235 - DNA, 25 bp, Mus musculus
tctagccgggaggatgaaaggcctc

SEQ ID NO: 783236 - DNA, 25 bp, Mus musculus
tctagccgtttcaggccttggagtg

SEQ ID NO: 783237 - DNA, 25 bp, Mus musculus
tctagccgtttctggccttggagtg

SEQ ID NO: 783238 - DNA, 25 bp, Mus musculus
tctagcctcctccagtatgatttga

SEQ ID NO: 783239 - DNA, 25 bp, Mus musculus
tctagcctcctcgagtatgatttga

SEQ ID NO: 783240 - DNA, 25 bp, Mus musculus
tctagcctctctactaggtgtgaac

SEQ ID NO: 783241 - DNA, 25 bp, Mus musculus
tctagcctctcttctaggtgtgaac

SEQ ID NO: 783242 - DNA, 25 bp, Mus musculus
tctagcctctgaagagaggtactcc

SEQ ID NO: 783243 - DNA, 25 bp, Mus musculus
tctagcctctgatgagaggtactcc

SEQ ID NO: 783244 - DNA, 25 bp, Mus musculus
tctagcctgatcagaccatgctttg

SEQ ID NO: 783245 - DNA, 25 bp, Mus musculus
tctagcctgatctgaccatgctttg

SEQ ID NO: 783246 - DNA, 25 bp, Mus musculus
tctagcctggacagcagggaggcat

SEQ ID NO: 783247 - DNA, 25 bp, Mus musculus
tctagcctggactgcagggaggcat

SEQ ID NO: 783248 - DNA, 25 bp, Mus musculus
tctagccttggcatctgggatgtct

SEQ ID NO: 783249 - DNA, 25 bp, Mus musculus
tctagccttggcttctgggatgtct

SEQ ID NO: 783250 - DNA, 25 bp, Mus musculus
tctagcctttacaacacccatcagg

SEQ ID NO: 783251 - DNA, 25 bp, Mus musculus
tctagcctttactacacccatcagg

SEQ ID NO: 783252 - DNA, 25 bp, Mus musculus
tctagcgcatgacaagatctggttt

SEQ ID NO: 783253 - DNA, 25 bp, Mus musculus
tctagcgcatgagaagatctggttt

SEQ ID NO: 783254 - DNA, 25 bp, Mus musculus
tctagctagctcagtatccaaggaa

SEQ ID NO: 783255 - DNA, 25 bp, Mus musculus
tctagctagctctgtatccaaggaa

SEQ ID NO: 783256 - DNA, 25 bp, Mus musculus
tctagctagcttccctcaacatgtt

SEQ ID NO: 783257 - DNA, 25 bp, Mus musculus
tctagctagcttgcctcaacatgtt

SEQ ID NO: 783258 - DNA, 25 bp, Mus musculus
tctagctcctagagccttagagatg

SEQ ID NO: 783259 - DNA, 25 bp, Mus musculus
tctagctcctagtgccttagagatg

SEQ ID NO: 783260 - DNA, 25 bp, Mus musculus
tctagctctagacatattaaacacg

SEQ ID NO: 783261 - DNA, 25 bp, Mus musculus
tctagctctagagatattaaacacg

SEQ ID NO: 783262 - DNA, 25 bp, Mus musculus
tctagctgaaggcactaactgactg

SEQ ID NO: 783263 - DNA, 25 bp, Mus musculus
tctagctgaagggactaactgactg

SEQ ID NO: 783264 - DNA, 25 bp, Mus musculus
tctagctgacggcaaggtgttcacc

SEQ ID NO: 783265 - DNA, 25 bp, Mus musculus
tctagctgacgggaaggtgttcacc

SEQ ID NO: 783266 - DNA, 25 bp, Mus musculus
tctagctggagtaggtactattgtc

SEQ ID NO: 783267 - DNA, 25 bp, Mus musculus
tctagctggagttggtactattgtc

SEQ ID NO: 783268 - DNA, 25 bp, Mus musculus
tctagctgtctgacctaccgggaaa

SEQ ID NO: 783269 - DNA, 25 bp, Mus musculus
tctagctgtctgtcctaccgggaaa

SEQ ID NO: 783270 - DNA, 25 bp, Mus musculus
tctagcttcgccatgtacatggccc

SEQ ID NO: 783271 - DNA, 25 bp, Mus musculus
tctagcttcgccttgtacatggccc

SEQ ID NO: 783272 - DNA, 25 bp, Mus musculus
tctagctttgtgatcctgctctgca

SEQ ID NO: 783273 - DNA, 25 bp, Mus musculus
tctagctttgtgttcctgctctgca

SEQ ID NO: 783274 - DNA, 25 bp, Mus musculus
tctaggaaaaatcctagggccgaga

SEQ ID NO: 783275 - DNA, 25 bp, Mus musculus
tctaggaaaaatgctagggccgaga

SEQ ID NO: 783276 - DNA, 25 bp, Mus musculus
tctaggaagattccctgacacaggg

SEQ ID NO: 783277 - DNA, 25 bp, Mus musculus
tctaggaagattgcctgacacaggg

SEQ ID NO: 783278 - DNA, 25 bp, Mus musculus
tctaggaagccacagggaggtactt

SEQ ID NO: 783279 - DNA, 25 bp, Mus musculus
tctaggaagccagagggaggtactt

SEQ ID NO: 783280 - DNA, 25 bp, Mus musculus
tctaggaatctcagtagctgggatg

SEQ ID NO: 783281 - DNA, 25 bp, Mus musculus
tctaggaatctctgtagctgggatg

SEQ ID NO: 783282 - DNA, 25 bp, Mus musculus
tctaggaccctaccagttcacaaaa

SEQ ID NO: 783283 - DNA, 25 bp, Mus musculus
tctaggaccctagcagttcacaaaa

SEQ ID NO: 783284 - DNA, 25 bp, Mus musculus
tctaggacctaaacctttcgttgaa

SEQ ID NO: 783285 - DNA, 25 bp, Mus musculus
tctaggacctaatcctttcgttgaa

SEQ ID NO: 783286 - DNA, 25 bp, Mus musculus
tctaggacctgcactggaacccggg

SEQ ID NO: 783287 - DNA, 25 bp, Mus musculus
tctaggacctgctctggaacccggg

SEQ ID NO: 783288 - DNA, 25 bp, Mus musculus
tctaggactccaactgttacagaca

SEQ ID NO: 783289 - DNA, 25 bp, Mus musculus
tctaggactccatctgttacagaca

SEQ ID NO: 783290 - DNA, 25 bp, Mus musculus
tctaggacttgcaaacaagagcgtt

SEQ ID NO: 783291 - DNA, 25 bp, Mus musculus
tctaggacttgctaacaagagcgtt

SEQ ID NO: 783292 - DNA, 25 bp, Mus musculus
tctaggagaaatagccaaggtagcc

SEQ ID NO: 783293 - DNA, 25 bp, Mus musculus
tctaggagaaattgccaaggtagcc

SEQ ID NO: 783294 - DNA, 25 bp, Mus musculus
tctaggagcccacggaaaggactgc

SEQ ID NO: 783295 - DNA, 25 bp, Mus musculus
tctaggagcccagggaaaggactgc

SEQ ID NO: 783296 - DNA, 25 bp, Mus musculus
tctaggagccggagaggtctttgcc

SEQ ID NO: 783297 - DNA, 25 bp, Mus musculus
tctaggagccggtgaggtctttgcc

SEQ ID NO: 783298 - DNA, 25 bp, Mus musculus
tctaggagtttaccaactgagacat

SEQ ID NO: 783299 - DNA, 25 bp, Mus musculus
tctaggagtttagcaactgagacat

SEQ ID NO: 783300 - DNA, 25 bp, Mus musculus
tctaggatggctctcttgtcgcttc

SEQ ID NO: 783301 - DNA, 25 bp, Mus musculus
tctaggatggctgtcttgtcgcttc

SEQ ID NO: 783302 - DNA, 25 bp, Mus musculus
tctaggcagtgacgtggagttccac

SEQ ID NO: 783303 - DNA, 25 bp, Mus musculus
tctaggcagtgaggtggagttccac

SEQ ID NO: 783304 - DNA, 25 bp, Mus musculus
tctaggcatgaacttcagtggccca

SEQ ID NO: 783305 - DNA, 25 bp, Mus musculus
tctaggcatgaagttcagtggccca

SEQ ID NO: 783306 - DNA, 25 bp, Mus musculus
tctaggccaaaaccttgtgatttgg

SEQ ID NO: 783307 - DNA, 25 bp, Mus musculus
tctaggccaaaacgctcggtacctc

SEQ ID NO: 783308 - DNA, 25 bp, Mus musculus
tctaggccaaaagcttgtgatttgg

SEQ ID NO: 783309 - DNA, 25 bp, Mus musculus
tctaggccaaaaggctcggtacctc

SEQ ID NO: 783310 - DNA, 25 bp, Mus musculus
tctaggccagccatggatgcatagt

SEQ ID NO: 783311 - DNA, 25 bp, Mus musculus
tctaggccagccttggatgcatagt

SEQ ID NO: 783312 - DNA, 25 bp, Mus musculus
tctaggccaggcaaaatcaaagatg

SEQ ID NO: 783313 - DNA, 25 bp, Mus musculus
tctaggccaggctaaatcaaagatg

SEQ ID NO: 783314 - DNA, 25 bp, Mus musculus
tctaggccagtacattaatgcttag

SEQ ID NO: 783315 - DNA, 25 bp, Mus musculus
tctaggccagtacgcggataggacc

SEQ ID NO: 783316 - DNA, 25 bp, Mus musculus
tctaggccagtagattaatgcttag

SEQ ID NO: 783317 - DNA, 25 bp, Mus musculus
tctaggccagtaggcggataggacc

SEQ ID NO: 783318 - DNA, 25 bp, Mus musculus
tctaggccggtgagagatatctgtc

SEQ ID NO: 783319 - DNA, 25 bp, Mus musculus
tctaggccggtgtgagatatctgtc

SEQ ID NO: 783320 - DNA, 25 bp, Mus musculus
tctaggcgagcgacctttgttggtg

SEQ ID NO: 783321 - DNA, 25 bp, Mus musculus
tctaggcgagcgtcctttgttggtg

SEQ ID NO: 783322 - DNA, 25 bp, Mus musculus
tctaggctacgacgtgccgtccaag

SEQ ID NO: 783323 - DNA, 25 bp, Mus musculus
tctaggctacgaggtgccgtccaag

SEQ ID NO: 783324 - DNA, 25 bp, Mus musculus
tctaggctagacaggtcacacaatt

SEQ ID NO: 783325 - DNA, 25 bp, Mus musculus
tctaggctagactggtcacacaatt

SEQ ID NO: 783326 - DNA, 25 bp, Mus musculus
tctaggctctgcattgccgacccag

SEQ ID NO: 783327 - DNA, 25 bp, Mus musculus
tctaggctctgctttgccgacccag

SEQ ID NO: 783328 - DNA, 25 bp, Mus musculus
tctaggctgtggctcaaaaacgcac

SEQ ID NO: 783329 - DNA, 25 bp, Mus musculus
tctaggctgtgggtcaaaaacgcac

SEQ ID NO: 783330 - DNA, 25 bp, Mus musculus
tctagggatatgatagccacagttt

SEQ ID NO: 783331 - DNA, 25 bp, Mus musculus
tctagggatatgttagccacagttt

SEQ ID NO: 783332 - DNA, 25 bp, Mus musculus
tctagggatgtactccagagctact

SEQ ID NO: 783333 - DNA, 25 bp, Mus musculus
tctagggatgtagtccagagctact

SEQ ID NO: 783334 - DNA, 25 bp, Mus musculus
tctagggcattcacccaggtgggtg

SEQ ID NO: 783335 - DNA, 25 bp, Mus musculus
tctagggcattctcccaggtgggtg

SEQ ID NO: 783336 - DNA, 25 bp, Mus musculus
tctagggccaataggaggaccacca

SEQ ID NO: 783337 - DNA, 25 bp, Mus musculus
tctagggccaattggaggaccacca

SEQ ID NO: 783338 - DNA, 25 bp, Mus musculus
tctagggcctttctcccgagctgtg

SEQ ID NO: 783339 - DNA, 25 bp, Mus musculus
tctagggcctttgtcccgagctgtg

SEQ ID NO: 783340 - DNA, 25 bp, Mus musculus
tctagggctttgcttccgagtccgc

SEQ ID NO: 783341 - DNA, 25 bp, Mus musculus
tctagggctttggttccgagtccgc

SEQ ID NO: 783342 - DNA, 25 bp, Mus musculus
tctagggtcatcagttctagctctg

SEQ ID NO: 783343 - DNA, 25 bp, Mus musculus
tctagggtcatctgttctagctctg

SEQ ID NO: 783344 - DNA, 25 bp, Mus musculus
tctagggtggcaccggctacctacc

SEQ ID NO: 783345 - DNA, 25 bp, Mus musculus
tctagggtggcagcggctacctacc

SEQ ID NO: 783346 - DNA, 25 bp, Mus musculus
tctaggtactgtcggtggtttgccc

SEQ ID NO: 783347 - DNA, 25 bp, Mus musculus
tctaggtactgtgggtggtttgccc

SEQ ID NO: 783348 - DNA, 25 bp, Mus musculus
tctaggtccctgagcccatgatgag

SEQ ID NO: 783349 - DNA, 25 bp, Mus musculus
tctaggtccctgtgcccatgatgag

SEQ ID NO: 783350 - DNA, 25 bp, Mus musculus
tctaggtcggccattctgcttctgg

SEQ ID NO: 783351 - DNA, 25 bp, Mus musculus
tctaggtcggcctttctgcttctgg

SEQ ID NO: 783352 - DNA, 25 bp, Mus musculus
tctaggtcttatagtggaagaggca

SEQ ID NO: 783353 - DNA, 25 bp, Mus musculus
tctaggtcttattgtggaagaggca

SEQ ID NO: 783354 - DNA, 25 bp, Mus musculus
tctaggtgattgctcccatgtgcgt

SEQ ID NO: 783355 - DNA, 25 bp, Mus musculus
tctaggtgattggtcccatgtgcgt

SEQ ID NO: 783356 - DNA, 25 bp, Mus musculus
tctaggtggctgagctgtagactct

SEQ ID NO: 783357 - DNA, 25 bp, Mus musculus
tctaggtggctgtgctgtagactct

SEQ ID NO: 783358 - DNA, 25 bp, Mus musculus
tctaggtgtcgcctcgtttcgaggt

SEQ ID NO: 783359 - DNA, 25 bp, Mus musculus
tctaggtgtcgcgtcgtttcgaggt

SEQ ID NO: 783360 - DNA, 25 bp, Mus musculus
tctaggttaagacccggacaagcgg

SEQ ID NO: 783361 - DNA, 25 bp, Mus musculus
tctaggttaagagccggacaagcgg

SEQ ID NO: 783362 - DNA, 25 bp, Mus musculus
tctaggttacatagctggctccaaa

SEQ ID NO: 783363 - DNA, 25 bp, Mus musculus
tctaggttacattgctggctccaaa

SEQ ID NO: 783364 - DNA, 25 bp, Mus musculus
tctaggttctcacgcgggaactgct

SEQ ID NO: 783365 - DNA, 25 bp, Mus musculus
tctaggttctcaggcgggaactgct

SEQ ID NO: 783366 - DNA, 25 bp, Mus musculus
tctagtaaaaggaactagggccagc

SEQ ID NO: 783367 - DNA, 25 bp, Mus musculus
tctagtaaaaggtactagggccagc

SEQ ID NO: 783368 - DNA, 25 bp, Mus musculus
tctagtaaaattccccacggaccct

SEQ ID NO: 783369 - DNA, 25 bp, Mus musculus
tctagtaaaattgcccacggaccct

SEQ ID NO: 783370 - DNA, 25 bp, Mus musculus
tctagtaactggctcacaaacattg

SEQ ID NO: 783371 - DNA, 25 bp, Mus musculus
tctagtaactgggtcacaaacattg

SEQ ID NO: 783372 - DNA, 25 bp, Mus musculus
tctagtactagaccagctggcacac

SEQ ID NO: 783373 - DNA, 25 bp, Mus musculus
tctagtactagagcagctggcacac

SEQ ID NO: 783374 - DNA, 25 bp, Mus musculus
tctagtagacccacttaatatgcat

SEQ ID NO: 783375 - DNA, 25 bp, Mus musculus
tctagtagaccctcttaatatgcat

SEQ ID NO: 783376 - DNA, 25 bp, Mus musculus
tctagtatgtttctcagtggtctct

SEQ ID NO: 783377 - DNA, 25 bp, Mus musculus
tctagtatgtttgtcagtggtctct

SEQ ID NO: 783378 - DNA, 25 bp, Mus musculus
tctagtatttctactgggaaaagga

SEQ ID NO: 783379 - DNA, 25 bp, Mus musculus
tctagtatttcttctgggaaaagga

SEQ ID NO: 783380 - DNA, 25 bp, Mus musculus
tctagtatttgtacagggcatcggt

SEQ ID NO: 783381 - DNA, 25 bp, Mus musculus
tctagtatttgttcagggcatcggt

SEQ ID NO: 783382 - DNA, 25 bp, Mus musculus
tctagtcccgaaagccaaaatcatc

SEQ ID NO: 783383 - DNA, 25 bp, Mus musculus
tctagtcccgaatgccaaaatcatc

SEQ ID NO: 783384 - DNA, 25 bp, Mus musculus
tctagtcctaacaggaggctgcagg

SEQ ID NO: 783385 - DNA, 25 bp, Mus musculus
tctagtcctaactggaggctgcagg

SEQ ID NO: 783386 - DNA, 25 bp, Mus musculus
tctagtcgatcgctggtggtgcaca

SEQ ID NO: 783387 - DNA, 25 bp, Mus musculus
tctagtcgatcggtggtggtgcaca

SEQ ID NO: 783388 - DNA, 25 bp, Mus musculus
tctagtcggaccaaatttcgggctc

SEQ ID NO: 783389 - DNA, 25 bp, Mus musculus
tctagtcggacctaatttcgggctc

SEQ ID NO: 783390 - DNA, 25 bp, Mus musculus
tctagtctcaagcatgcctgcctgg

SEQ ID NO: 783391 - DNA, 25 bp, Mus musculus
tctagtctcaaggatgcctgcctgg

SEQ ID NO: 783392 - DNA, 25 bp, Mus musculus
tctagtctcgggatcctctggcctc

SEQ ID NO: 783393 - DNA, 25 bp, Mus musculus
tctagtctcgggttcctctggcctc

SEQ ID NO: 783394 - DNA, 25 bp, Mus musculus
tctagtctgtgcactgtaggtccca

SEQ ID NO: 783395 - DNA, 25 bp, Mus musculus
tctagtctgtgctctgtaggtccca

SEQ ID NO: 783396 - DNA, 25 bp, Mus musculus
tctagtcttctgaccagaggcagcg

SEQ ID NO: 783397 - DNA, 25 bp, Mus musculus
tctagtcttctgtccagaggcagcg

SEQ ID NO: 783398 - DNA, 25 bp, Mus musculus
tctagtgaaggtccatagttttgaa

SEQ ID NO: 783399 - DNA, 25 bp, Mus musculus
tctagtgaaggtgcatagttttgaa

SEQ ID NO: 783400 - DNA, 25 bp, Mus musculus
tctagtgaagtgcacacaaagtgtc

SEQ ID NO: 783401 - DNA, 25 bp, Mus musculus
tctagtgaagtggacacaaagtgtc

SEQ ID NO: 783402 - DNA, 25 bp, Mus musculus
tctagtgaatccacaccagcatcaa

SEQ ID NO: 783403 - DNA, 25 bp, Mus musculus
tctagtgaatcctcaccagcatcaa

SEQ ID NO: 783404 - DNA, 25 bp, Mus musculus
tctagtgacaagaaatgggaccgtc

SEQ ID NO: 783405 - DNA, 25 bp, Mus musculus
tctagtgacaagtaatgggaccgtc

SEQ ID NO: 783406 - DNA, 25 bp, Mus musculus
tctagtgacaggatggtcattggct

SEQ ID NO: 783407 - DNA, 25 bp, Mus musculus
tctagtgacaggttggtcattggct

SEQ ID NO: 783408 - DNA, 25 bp, Mus musculus
tctagtgacgaaccctgggcatgtg

SEQ ID NO: 783409 - DNA, 25 bp, Mus musculus
tctagtgacgaagcctgggcatgtg

SEQ ID NO: 783410 - DNA, 25 bp, Mus musculus
tctagtgcactacttcattcccagg

SEQ ID NO: 783411 - DNA, 25 bp, Mus musculus
tctagtgcactagttcattcccagg

SEQ ID NO: 783412 - DNA, 25 bp, Mus musculus
tctagtgcccctactggaatgagcg

SEQ ID NO: 783413 - DNA, 25 bp, Mus musculus
tctagtgccccttctggaatgagcg

SEQ ID NO: 783414 - DNA, 25 bp, Mus musculus
tctagtgcctcaaataaaccgttca

SEQ ID NO: 783415 - DNA, 25 bp, Mus musculus
tctagtgcctcatataaaccgttca

SEQ ID NO: 783416 - DNA, 25 bp, Mus musculus
tctagtgctgaacacaccagccctg

SEQ ID NO: 783417 - DNA, 25 bp, Mus musculus
tctagtgctgaagacaccagccctg

SEQ ID NO: 783418 - DNA, 25 bp, Mus musculus
tctagtggcccaaatctgtaagcat

SEQ ID NO: 783419 - DNA, 25 bp, Mus musculus
tctagtggcccatatctgtaagcat

SEQ ID NO: 783420 - DNA, 25 bp, Mus musculus
tctagtggctctcttccaataacgt

SEQ ID NO: 783421 - DNA, 25 bp, Mus musculus
tctagtggctctgttccaataacgt

SEQ ID NO: 783422 - DNA, 25 bp, Mus musculus
tctagtgggactacagaatgctgtt

SEQ ID NO: 783423 - DNA, 25 bp, Mus musculus
tctagtgggacttcagaatgctgtt

SEQ ID NO: 783424 - DNA, 25 bp, Mus musculus
tctagtgggttactgatgaataaca

SEQ ID NO: 783425 - DNA, 25 bp, Mus musculus
tctagtgggttagtgatgaataaca

SEQ ID NO: 783426 - DNA, 25 bp, Mus musculus
tctagtgtattcaaaggatcccaag

SEQ ID NO: 783427 - DNA, 25 bp, Mus musculus
tctagtgtattctaaggatcccaag

SEQ ID NO: 783428 - DNA, 25 bp, Mus musculus
tctagttcaaagcaggcacaggttg

SEQ ID NO: 783429 - DNA, 25 bp, Mus musculus
tctagttcaaaggaggcacaggttg

SEQ ID NO: 783430 - DNA, 25 bp, Mus musculus
tctagttgattgagatggaaaagga

SEQ ID NO: 783431 - DNA, 25 bp, Mus musculus
tctagttgattgtgatggaaaagga

SEQ ID NO: 783432 - DNA, 25 bp, Mus musculus
tctagttgcaagctcaaaggcagct

SEQ ID NO: 783433 - DNA, 25 bp, Mus musculus
tctagttgcaaggtcaaaggcagct

SEQ ID NO: 783434 - DNA, 25 bp, Mus musculus
tctagtttcgtcaatcctgacacac

SEQ ID NO: 783435 - DNA, 25 bp, Mus musculus
tctagtttcgtctatcctgacacac

SEQ ID NO: 783436 - DNA, 25 bp, Mus musculus
tctagtttggagatgagaacactct

SEQ ID NO: 783437 - DNA, 25 bp, Mus musculus
tctagtttggagttgagaacactct

SEQ ID NO: 783438 - DNA, 25 bp, Mus musculus
tctagtttgtctaagcttgcttggt

SEQ ID NO: 783439 - DNA, 25 bp, Mus musculus
tctagtttgtcttagcttgcttggt

SEQ ID NO: 783440 - DNA, 25 bp, Mus musculus
tctataaacaagcacaacactggct

SEQ ID NO: 783441 - DNA, 25 bp, Mus musculus
tctataaacaaggacaacactggct

SEQ ID NO: 783442 - DNA, 25 bp, Mus musculus
tctataaagcaccattcattgcaga

SEQ ID NO: 783443 - DNA, 25 bp, Mus musculus
tctataaagcacgattcattgcaga

SEQ ID NO: 783444 - DNA, 25 bp, Mus musculus
tctataaaggcaaatggtgctgggc

SEQ ID NO: 783445 - DNA, 25 bp, Mus musculus
tctataaaggcatatggtgctgggc

SEQ ID NO: 783446 - DNA, 25 bp, Mus musculus
tctataaatttgcaatcacggaatc

SEQ ID NO: 783447 - DNA, 25 bp, Mus musculus
tctataaatttggaatcacggaatc

SEQ ID NO: 783448 - DNA, 25 bp, Mus musculus
tctataacatccagctctttggcct

SEQ ID NO: 783449 - DNA, 25 bp, Mus musculus
tctataacatcctgctctttggcct

SEQ ID NO: 783450 - DNA, 25 bp, Mus musculus
tctataaccctgaggatcctccagg

SEQ ID NO: 783451 - DNA, 25 bp, Mus musculus
tctataaccctgtggatcctccagg

SEQ ID NO: 783452 - DNA, 25 bp, Mus musculus
tctataactaccaaggccccgagga

SEQ ID NO: 783453 - DNA, 25 bp, Mus musculus
tctataactacctaggccccgagga

SEQ ID NO: 783454 - DNA, 25 bp, Mus musculus
tctataactgccagcgagatatctc

SEQ ID NO: 783455 - DNA, 25 bp, Mus musculus
tctataactgcctgcgagatatctc

SEQ ID NO: 783456 - DNA, 25 bp, Mus musculus
tctataagaactaggtgcctaagcc

SEQ ID NO: 783457 - DNA, 25 bp, Mus musculus
tctataagaacttggtgcctaagcc

SEQ ID NO: 783458 - DNA, 25 bp, Mus musculus
tctataagcggacctacgccagtgg

SEQ ID NO: 783459 - DNA, 25 bp, Mus musculus
tctataagcggagctacgccagtgg

SEQ ID NO: 783460 - DNA, 25 bp, Mus musculus
tctataagcttcatgagcggaagtg

SEQ ID NO: 783461 - DNA, 25 bp, Mus musculus
tctataagcttcttgagcggaagtg

SEQ ID NO: 783462 - DNA, 25 bp, Mus musculus
tctataaggatacacagaaattctc

SEQ ID NO: 783463 - DNA, 25 bp, Mus musculus
tctataaggatagacagaaattctc

SEQ ID NO: 783464 - DNA, 25 bp, Mus musculus
tctataaggttcatagatgggcgtg

SEQ ID NO: 783465 - DNA, 25 bp, Mus musculus
tctataaggttcttagatgggcgtg

SEQ ID NO: 783466 - DNA, 25 bp, Mus musculus
tctataatcacaaaggctatgggca

SEQ ID NO: 783467 - DNA, 25 bp, Mus musculus
tctataatcacataggctatgggca

SEQ ID NO: 783468 - DNA, 25 bp, Mus musculus
tctataattggcctgatgaatcatt

SEQ ID NO: 783469 - DNA, 25 bp, Mus musculus
tctataattggcgtgatgaatcatt

SEQ ID NO: 783470 - DNA, 25 bp, Mus musculus
tctatacacagaaaacatcagccta

SEQ ID NO: 783471 - DNA, 25 bp, Mus musculus
tctatacacagaccgcagccttggg

SEQ ID NO: 783472 - DNA, 25 bp, Mus musculus
tctatacacagagcgcagccttggg

SEQ ID NO: 783473 - DNA, 25 bp, Mus musculus
tctatacacagataacatcagccta

SEQ ID NO: 783474 - DNA, 25 bp, Mus musculus
tctatacaccttcctcagtggcgtg

SEQ ID NO: 783475 - DNA, 25 bp, Mus musculus
tctatacaccttgctcagtggcgtg

SEQ ID NO: 783476 - DNA, 25 bp, Mus musculus
tctatacactacaaatcagcatcat

SEQ ID NO: 783477 - DNA, 25 bp, Mus musculus
tctatacactactaatcagcatcat

SEQ ID NO: 783478 - DNA, 25 bp, Mus musculus
tctatacagggaacactgcagttgg

SEQ ID NO: 783479 - DNA, 25 bp, Mus musculus
tctatacagggatcactgcagttgg

SEQ ID NO: 783480 - DNA, 25 bp, Mus musculus
tctataccaggtctgaaaaagggca

SEQ ID NO: 783481 - DNA, 25 bp, Mus musculus
tctataccaggtgtgaaaaagggca

SEQ ID NO: 783482 - DNA, 25 bp, Mus musculus
tctataccattgagccctggacctt

SEQ ID NO: 783483 - DNA, 25 bp, Mus musculus
tctataccattgtgccctggacctt

SEQ ID NO: 783484 - DNA, 25 bp, Mus musculus
tctatacccagacccgaattctcaa

SEQ ID NO: 783485 - DNA, 25 bp, Mus musculus
tctatacccagagccgaattctcaa

SEQ ID NO: 783486 - DNA, 25 bp, Mus musculus
tctatacctatgctgacacccctaa

SEQ ID NO: 783487 - DNA, 25 bp, Mus musculus
tctatacctatggtgacacccctaa

SEQ ID NO: 783488 - DNA, 25 bp, Mus musculus
tctatactctaacgccatgagacgg

SEQ ID NO: 783489 - DNA, 25 bp, Mus musculus
tctatactctaaggccatgagacgg

SEQ ID NO: 783490 - DNA, 25 bp, Mus musculus
tctatactggatctgcctgaaacca

SEQ ID NO: 783491 - DNA, 25 bp, Mus musculus
tctatactggatgtgcctgaaacca

SEQ ID NO: 783492 - DNA, 25 bp, Mus musculus
tctatagaccagatgaggcaactca

SEQ ID NO: 783493 - DNA, 25 bp, Mus musculus
tctatagaccagttgaggcaactca

SEQ ID NO: 783494 - DNA, 25 bp, Mus musculus
tctataggacatcaagcgtgcagct

SEQ ID NO: 783495 - DNA, 25 bp, Mus musculus
tctataggacatgaagcgtgcagct

SEQ ID NO: 783496 - DNA, 25 bp, Mus musculus
tctatagggaatccctacgtggtgg

SEQ ID NO: 783497 - DNA, 25 bp, Mus musculus
tctatagggaatgcctacgtggtgg

SEQ ID NO: 783498 - DNA, 25 bp, Mus musculus
tctatagtgactccaatgggagcgg

SEQ ID NO: 783499 - DNA, 25 bp, Mus musculus
tctatagtgactgcaatgggagcgg

SEQ ID NO: 783500 - DNA, 25 bp, Mus musculus
tctatatagtttagtgacactcagt

SEQ ID NO: 783501 - DNA, 25 bp, Mus musculus
tctatatagttttgtgacactcagt

SEQ ID NO: 783502 - DNA, 25 bp, Mus musculus
tctatatcaagacggaacgagactc

SEQ ID NO: 783503 - DNA, 25 bp, Mus musculus
tctatatcaagagggaacgagactc

SEQ ID NO: 783504 - DNA, 25 bp, Mus musculus
tctatatcagttataaggcacttct

SEQ ID NO: 783505 - DNA, 25 bp, Mus musculus
tctatatcagttttaaggcacttct

SEQ ID NO: 783506 - DNA, 25 bp, Mus musculus
tctatatctgacctaaagtttctcc

SEQ ID NO: 783507 - DNA, 25 bp, Mus musculus
tctatatctgacgtaaagtttctcc

SEQ ID NO: 783508 - DNA, 25 bp, Mus musculus
tctatatgctgaacacacactgggc

SEQ ID NO: 783509 - DNA, 25 bp, Mus musculus
tctatatgctgatcacacactgggc

SEQ ID NO: 783510 - DNA, 25 bp, Mus musculus
tctatatggaataagactgccagcg

SEQ ID NO: 783511 - DNA, 25 bp, Mus musculus
tctatatggaattagactgccagcg

SEQ ID NO: 783512 - DNA, 25 bp, Mus musculus
tctatatggactataatgccaccac

SEQ ID NO: 783513 - DNA, 25 bp, Mus musculus
tctatatggactttaatgccaccac

SEQ ID NO: 783514 - DNA, 25 bp, Mus musculus
tctatattcaacaaaagttgcgtcc

SEQ ID NO: 783515 - DNA, 25 bp, Mus musculus
tctatattcaactaaagttgcgtcc

SEQ ID NO: 783516 - DNA, 25 bp, Mus musculus
tctatatttgcgcaaaactttgggc

SEQ ID NO: 783517 - DNA, 25 bp, Mus musculus
tctatatttgcggaaaactttgggc

SEQ ID NO: 783518 - DNA, 25 bp, Mus musculus
tctatcaacatcacgcacgccatgg

SEQ ID NO: 783519 - DNA, 25 bp, Mus musculus
tctatcaacatctcgcacgccatgg

SEQ ID NO: 783520 - DNA, 25 bp, Mus musculus
tctatcaactcaaggtggacagcag

SEQ ID NO: 783521 - DNA, 25 bp, Mus musculus
tctatcaactcatggtggacagcag

SEQ ID NO: 783522 - DNA, 25 bp, Mus musculus
tctatcaagggactgtgtgccaacc

SEQ ID NO: 783523 - DNA, 25 bp, Mus musculus
tctatcaagggagtgtgtgccaacc

SEQ ID NO: 783524 - DNA, 25 bp, Mus musculus
tctatcacaagtaaccaccagagag

SEQ ID NO: 783525 - DNA, 25 bp, Mus musculus
tctatcacaagttaccaccagagag

SEQ ID NO: 783526 - DNA, 25 bp, Mus musculus
tctatcagaaccagaaccggcggca

SEQ ID NO: 783527 - DNA, 25 bp, Mus musculus
tctatcagaacctgaaccggcggca

SEQ ID NO: 783528 - DNA, 25 bp, Mus musculus
tctatcagacttcgactcagcgtga

SEQ ID NO: 783529 - DNA, 25 bp, Mus musculus
tctatcagacttggactcagcgtga

SEQ ID NO: 783530 - DNA, 25 bp, Mus musculus
tctatcagatctcccactgtgcagg

SEQ ID NO: 783531 - DNA, 25 bp, Mus musculus
tctatcagatctgccactgtgcagg

SEQ ID NO: 783532 - DNA, 25 bp, Mus musculus
tctatcagatgcaaccacggttcag

SEQ ID NO: 783533 - DNA, 25 bp, Mus musculus
tctatcagatgctaccacggttcag

SEQ ID NO: 783534 - DNA, 25 bp, Mus musculus
tctatcagattgacagtggcagtga

SEQ ID NO: 783535 - DNA, 25 bp, Mus musculus
tctatcagattgtcagtggcagtga

SEQ ID NO: 783536 - DNA, 25 bp, Mus musculus
tctatcagcggcaggtggagttcat

SEQ ID NO: 783537 - DNA, 25 bp, Mus musculus
tctatcagcggctggtggagttcat

SEQ ID NO: 783538 - DNA, 25 bp, Mus musculus
tctatcaggcctctgatccggcaca

SEQ ID NO: 783539 - DNA, 25 bp, Mus musculus
tctatcaggcctgtgatccggcaca

SEQ ID NO: 783540 - DNA, 25 bp, Mus musculus
tctatcatctataaaactacagtga

SEQ ID NO: 783541 - DNA, 25 bp, Mus musculus
tctatcatctattaaactacagtga

SEQ ID NO: 783542 - DNA, 25 bp, Mus musculus
tctatcatctgacgaatgagaaaac

SEQ ID NO: 783543 - DNA, 25 bp, Mus musculus
tctatcatctgaggaatgagaaaac

SEQ ID NO: 783544 - DNA, 25 bp, Mus musculus
tctatcatggccatcgtgaaggcca

SEQ ID NO: 783545 - DNA, 25 bp, Mus musculus
tctatcatggccttcgtgaaggcca

SEQ ID NO: 783546 - DNA, 25 bp, Mus musculus
tctatcattagacggcccacagtgc

SEQ ID NO: 783547 - DNA, 25 bp, Mus musculus
tctatcattagagggcccacagtgc

SEQ ID NO: 783548 - DNA, 25 bp, Mus musculus
tctatccagcggatgtgaccatcac

SEQ ID NO: 783549 - DNA, 25 bp, Mus musculus
tctatccagcggttgtgaccatcac

SEQ ID NO: 783550 - DNA, 25 bp, Mus musculus
tctatccaggctcacctaatggaca

SEQ ID NO: 783551 - DNA, 25 bp, Mus musculus
tctatccaggctgacctaatggaca

SEQ ID NO: 783552 - DNA, 25 bp, Mus musculus
tctatccattctacgggatcatcct

SEQ ID NO: 783553 - DNA, 25 bp, Mus musculus
tctatccattcttcgggatcatcct

SEQ ID NO: 783554 - DNA, 25 bp, Mus musculus
tctatcccctgacattcactcaggt

SEQ ID NO: 783555 - DNA, 25 bp, Mus musculus
tctatcccctgagattcactcaggt

SEQ ID NO: 783556 - DNA, 25 bp, Mus musculus
tctatccctccaaggcacagaaact

SEQ ID NO: 783557 - DNA, 25 bp, Mus musculus
tctatccctccatggcacagaaact

SEQ ID NO: 783558 - DNA, 25 bp, Mus musculus
tctatccggacacataaccgaggct

SEQ ID NO: 783559 - DNA, 25 bp, Mus musculus
tctatccggacagataaccgaggct

SEQ ID NO: 783560 - DNA, 25 bp, Mus musculus
tctatccgggagatcagcagtctgt

SEQ ID NO: 783561 - DNA, 25 bp, Mus musculus
tctatccgggagttcagcagtctgt

SEQ ID NO: 783562 - DNA, 25 bp, Mus musculus
tctatccttgttattcctgcggctg

SEQ ID NO: 783563 - DNA, 25 bp, Mus musculus
tctatccttgtttttcctgcggctg

SEQ ID NO: 783564 - DNA, 25 bp, Mus musculus
tctatcgacccgatgtggacccaga

SEQ ID NO: 783565 - DNA, 25 bp, Mus musculus
tctatcgacccgttgtggacccaga

SEQ ID NO: 783566 - DNA, 25 bp, Mus musculus
tctatcgagacaagcctcatagcag

SEQ ID NO: 783567 - DNA, 25 bp, Mus musculus
tctatcgagacatgcctcatagcag

SEQ ID NO: 783568 - DNA, 25 bp, Mus musculus
tctatcgccattacctgcagctcaa

SEQ ID NO: 783569 - DNA, 25 bp, Mus musculus
tctatcgccatttcctgcagctcaa

SEQ ID NO: 783570 - DNA, 25 bp, Mus musculus
tctatcgggataacctttcactctg

SEQ ID NO: 783571 - DNA, 25 bp, Mus musculus
tctatcgggatatcctttcactctg

SEQ ID NO: 783572 - DNA, 25 bp, Mus musculus
tctatcgtccaacctttgttcatcc

SEQ ID NO: 783573 - DNA, 25 bp, Mus musculus
tctatcgtccaagctttgttcatcc

SEQ ID NO: 783574 - DNA, 25 bp, Mus musculus
tctatcgtggtcagcatggtggcct

SEQ ID NO: 783575 - DNA, 25 bp, Mus musculus
tctatcgtggtctgcatggtggcct

SEQ ID NO: 783576 - DNA, 25 bp, Mus musculus
tctatcgttattcgtgtgggtggct

SEQ ID NO: 783577 - DNA, 25 bp, Mus musculus
tctatcgttattggtgtgggtggct

SEQ ID NO: 783578 - DNA, 25 bp, Mus musculus
tctatcgtttccacgcccagttctt

SEQ ID NO: 783579 - DNA, 25 bp, Mus musculus
tctatcgtttcctcgcccagttctt

SEQ ID NO: 783580 - DNA, 25 bp, Mus musculus
tctatctaggctctgctttgccgac

SEQ ID NO: 783581 - DNA, 25 bp, Mus musculus
tctatctaggctgtgctttgccgac

SEQ ID NO: 783582 - DNA, 25 bp, Mus musculus
tctatctcaggacaaattgatgcag

SEQ ID NO: 783583 - DNA, 25 bp, Mus musculus
tctatctcaggagaaattgatgcag

SEQ ID NO: 783584 - DNA, 25 bp, Mus musculus
tctatctcattaatcggcggaagcc

SEQ ID NO: 783585 - DNA, 25 bp, Mus musculus
tctatctcattattcggcggaagcc

SEQ ID NO: 783586 - DNA, 25 bp, Mus musculus
tctatctccatgcaatcgtgcgtga

SEQ ID NO: 783587 - DNA, 25 bp, Mus musculus
tctatctccatggaatcgtgcgtga

SEQ ID NO: 783588 - DNA, 25 bp, Mus musculus
tctatctcgtccaaggagaaaagaa

SEQ ID NO: 783589 - DNA, 25 bp, Mus musculus
tctatctcgtcctaggagaaaagaa

SEQ ID NO: 783590 - DNA, 25 bp, Mus musculus
tctatcttattaaatgggatgaact

SEQ ID NO: 783591 - DNA, 25 bp, Mus musculus
tctatcttattatatgggatgaact

SEQ ID NO: 783592 - DNA, 25 bp, Mus musculus
tctatgaacaagaggcactcaccca

SEQ ID NO: 783593 - DNA, 25 bp, Mus musculus
tctatgaacaagtggcactcaccca

SEQ ID NO: 783594 - DNA, 25 bp, Mus musculus
tctatgaacgagaggtggaaatgcc

SEQ ID NO: 783595 - DNA, 25 bp, Mus musculus
tctatgaacgagtggtggaaatgcc

SEQ ID NO: 783596 - DNA, 25 bp, Mus musculus
tctatgaactggatgcggaccccaa

SEQ ID NO: 783597 - DNA, 25 bp, Mus musculus
tctatgaactggttgcggaccccaa

SEQ ID NO: 783598 - DNA, 25 bp, Mus musculus
tctatgaagcacaggaactccgaga

SEQ ID NO: 783599 - DNA, 25 bp, Mus musculus
tctatgaagcactggaactccgaga

SEQ ID NO: 783600 - DNA, 25 bp, Mus musculus
tctatgaaggacaagattggctgtc

SEQ ID NO: 783601 - DNA, 25 bp, Mus musculus
tctatgaaggactagattggctgtc

SEQ ID NO: 783602 - DNA, 25 bp, Mus musculus
tctatgaagtaactagctctctagg

SEQ ID NO: 783603 - DNA, 25 bp, Mus musculus
tctatgaagtaagtagctctctagg

SEQ ID NO: 783604 - DNA, 25 bp, Mus musculus
tctatgacaaggatcactacaagtt

SEQ ID NO: 783605 - DNA, 25 bp, Mus musculus
tctatgacaaggttcactacaagtt

SEQ ID NO: 783606 - DNA, 25 bp, Mus musculus
tctatgacaatgactagcactctgc

SEQ ID NO: 783607 - DNA, 25 bp, Mus musculus
tctatgacaatgtctagcactctgc

SEQ ID NO: 783608 - DNA, 25 bp, Mus musculus
tctatgacacccatggagctgacgc

SEQ ID NO: 783609 - DNA, 25 bp, Mus musculus
tctatgacacccttggagctgacgc

SEQ ID NO: 783610 - DNA, 25 bp, Mus musculus
tctatgacacgtccacagacaggct

SEQ ID NO: 783611 - DNA, 25 bp, Mus musculus
tctatgacacgtgcacagacaggct

SEQ ID NO: 783612 - DNA, 25 bp, Mus musculus
tctatgacagcacggagtagccttg

SEQ ID NO: 783613 - DNA, 25 bp, Mus musculus
tctatgacagcagggagtagccttg

SEQ ID NO: 783614 - DNA, 25 bp, Mus musculus
tctatgacagtcagcgcctctgatg

SEQ ID NO: 783615 - DNA, 25 bp, Mus musculus
tctatgacagtctgcgcctctgatg

SEQ ID NO: 783616 - DNA, 25 bp, Mus musculus
tctatgacattgagcaacagcagat

SEQ ID NO: 783617 - DNA, 25 bp, Mus musculus
tctatgacattgtgcaacagcagat

SEQ ID NO: 783618 - DNA, 25 bp, Mus musculus
tctatgacatttatctaccaacaca

SEQ ID NO: 783619 - DNA, 25 bp, Mus musculus
tctatgacatttttctaccaacaca

SEQ ID NO: 783620 - DNA, 25 bp, Mus musculus
tctatgaccaagacaacagcaacct

SEQ ID NO: 783621 - DNA, 25 bp, Mus musculus
tctatgaccaagtcaacagcaacct

SEQ ID NO: 783622 - DNA, 25 bp, Mus musculus
tctatgaccgctatggccgggaagg

SEQ ID NO: 783623 - DNA, 25 bp, Mus musculus
tctatgaccgctttggccgggaagg

SEQ ID NO: 783624 - DNA, 25 bp, Mus musculus
tctatgacctctaaataggaccctc

SEQ ID NO: 783625 - DNA, 25 bp, Mus musculus
tctatgacctcttaataggaccctc

SEQ ID NO: 783626 - DNA, 25 bp, Mus musculus
tctatgacggatacactggctccag

SEQ ID NO: 783627 - DNA, 25 bp, Mus musculus
tctatgacggattcactggctccag

SEQ ID NO: 783628 - DNA, 25 bp, Mus musculus
tctatgacttcgaccgcttctcgcg

SEQ ID NO: 783629 - DNA, 25 bp, Mus musculus
tctatgacttcgtccgcttctcgcg

SEQ ID NO: 783630 - DNA, 25 bp, Mus musculus
tctatgagaaaaacgtctctgggaa

SEQ ID NO: 783631 - DNA, 25 bp, Mus musculus
tctatgagaaaatcgtctctgggaa

SEQ ID NO: 783632 - DNA, 25 bp, Mus musculus
tctatgagaagaccggtgccaagtg

SEQ ID NO: 783633 - DNA, 25 bp, Mus musculus
tctatgagaagagcggtgccaagtg

SEQ ID NO: 783634 - DNA, 25 bp, Mus musculus
tctatgagaaggaaaacgctgtgcc

SEQ ID NO: 783635 - DNA, 25 bp, Mus musculus
tctatgagaaggacagctctgttgc

SEQ ID NO: 783636 - DNA, 25 bp, Mus musculus
tctatgagaaggtaaacgctgtgcc

SEQ ID NO: 783637 - DNA, 25 bp, Mus musculus
tctatgagaaggtcagctctgttgc

SEQ ID NO: 783638 - DNA, 25 bp, Mus musculus
tctatgagcgcacccggcagctgcg

SEQ ID NO: 783639 - DNA, 25 bp, Mus musculus
tctatgagcgcagccggcagctgcg

SEQ ID NO: 783640 - DNA, 25 bp, Mus musculus
tctatgaggagacaatcgtcaccaa

SEQ ID NO: 783641 - DNA, 25 bp, Mus musculus
tctatgaggagagaatcgtcaccaa

SEQ ID NO: 783642 - DNA, 25 bp, Mus musculus
tctatgaggcatcgcagacactgaa

SEQ ID NO: 783643 - DNA, 25 bp, Mus musculus
tctatgaggcatggcagacactgaa

SEQ ID NO: 783644 - DNA, 25 bp, Mus musculus
tctatgaggccaaagcccctggtca

SEQ ID NO: 783645 - DNA, 25 bp, Mus musculus
tctatgaggccatagcccctggtca

SEQ ID NO: 783646 - DNA, 25 bp, Mus musculus
tctatgagtgttccccgaacttggg

SEQ ID NO: 783647 - DNA, 25 bp, Mus musculus
tctatgagtgttgcccgaacttggg

SEQ ID NO: 783648 - DNA, 25 bp, Mus musculus
tctatgatcccacctatggtagcac

SEQ ID NO: 783649 - DNA, 25 bp, Mus musculus
tctatgatcccagctatggtagcac

SEQ ID NO: 783650 - DNA, 25 bp, Mus musculus
tctatgcaaacgagaggatggttca

SEQ ID NO: 783651 - DNA, 25 bp, Mus musculus
tctatgcaaacgtgaggatggttca

SEQ ID NO: 783652 - DNA, 25 bp, Mus musculus
tctatgcacaaacgttatatgtccc

SEQ ID NO: 783653 - DNA, 25 bp, Mus musculus
tctatgcacaaaggttatatgtccc

SEQ ID NO: 783654 - DNA, 25 bp, Mus musculus
tctatgcaccaacagaaccttacag

SEQ ID NO: 783655 - DNA, 25 bp, Mus musculus
tctatgcaccaagagaaccttacag

SEQ ID NO: 783656 - DNA, 25 bp, Mus musculus
tctatgcaggagagtacatcgattt

SEQ ID NO: 783657 - DNA, 25 bp, Mus musculus
tctatgcaggagtgtacatcgattt

SEQ ID NO: 783658 - DNA, 25 bp, Mus musculus
tctatgcagtatacaaggagcaccc

SEQ ID NO: 783659 - DNA, 25 bp, Mus musculus
tctatgcagtattcaaggagcaccc

SEQ ID NO: 783660 - DNA, 25 bp, Mus musculus
tctatgccacaaaccagaacgcagg

SEQ ID NO: 783661 - DNA, 25 bp, Mus musculus
tctatgccacaatccagaacgcagg

SEQ ID NO: 783662 - DNA, 25 bp, Mus musculus
tctatgccacgaatggagcaggcgt

SEQ ID NO: 783663 - DNA, 25 bp, Mus musculus
tctatgccacgattggagcaggcgt

SEQ ID NO: 783664 - DNA, 25 bp, Mus musculus
tctatgccctccatcggaacagtgc

SEQ ID NO: 783665 - DNA, 25 bp, Mus musculus
tctatgccctccttcggaacagtgc

SEQ ID NO: 783666 - DNA, 25 bp, Mus musculus
tctatgccgtggaggtgattgcatc

SEQ ID NO: 783667 - DNA, 25 bp, Mus musculus
tctatgccgtggtggtgattgcatc

SEQ ID NO: 783668 - DNA, 25 bp, Mus musculus
tctatgcgaaagctggatccagaca

SEQ ID NO: 783669 - DNA, 25 bp, Mus musculus
tctatgcgaaaggtggatccagaca

SEQ ID NO: 783670 - DNA, 25 bp, Mus musculus
tctatgcgggtgactgtgccctgga

SEQ ID NO: 783671 - DNA, 25 bp, Mus musculus
tctatgcgggtgtctgtgccctgga

SEQ ID NO: 783672 - DNA, 25 bp, Mus musculus
tctatgctatccctgaggctgccac

SEQ ID NO: 783673 - DNA, 25 bp, Mus musculus
tctatgctatccgtgaggctgccac

SEQ ID NO: 783674 - DNA, 25 bp, Mus musculus
tctatgctgaagatccatgtaaact

SEQ ID NO: 783675 - DNA, 25 bp, Mus musculus
tctatgctgaagttccatgtaaact

SEQ ID NO: 783676 - DNA, 25 bp, Mus musculus
tctatggaaaatcgtacaacctggc

SEQ ID NO: 783677 - DNA, 25 bp, Mus musculus
tctatggaaaatggtacaacctggc

SEQ ID NO: 783678 - DNA, 25 bp, Mus musculus
tctatggacatgaagatgtgaagaa

SEQ ID NO: 783679 - DNA, 25 bp, Mus musculus
tctatggacatgtagatgtgaagaa

SEQ ID NO: 783680 - DNA, 25 bp, Mus musculus
tctatggacctacctgtagctttgg

SEQ ID NO: 783681 - DNA, 25 bp, Mus musculus
tctatggacctagctgtagctttgg

SEQ ID NO: 783682 - DNA, 25 bp, Mus musculus
tctatggactccaagggactctgcc

SEQ ID NO: 783683 - DNA, 25 bp, Mus musculus
tctatggactcctagggactctgcc

SEQ ID NO: 783684 - DNA, 25 bp, Mus musculus
tctatggagaagacgtggcacaatc

SEQ ID NO: 783685 - DNA, 25 bp, Mus musculus
tctatggagaagtcgtggcacaatc

SEQ ID NO: 783686 - DNA, 25 bp, Mus musculus
tctatggagagacctagatccaaag

SEQ ID NO: 783687 - DNA, 25 bp, Mus musculus
tctatggagagagctagatccaaag

SEQ ID NO: 783688 - DNA, 25 bp, Mus musculus
tctatggaggcaacggcatcgttgg

SEQ ID NO: 783689 - DNA, 25 bp, Mus musculus
tctatggaggcatcggcatcgttgg

SEQ ID NO: 783690 - DNA, 25 bp, Mus musculus
tctatggatggtcctatgggaaatg

SEQ ID NO: 783691 - DNA, 25 bp, Mus musculus
tctatggatggtgctatgggaaatg

SEQ ID NO: 783692 - DNA, 25 bp, Mus musculus
tctatggcaacaactctctgagcag

SEQ ID NO: 783693 - DNA, 25 bp, Mus musculus
tctatggcaacatctctctgagcag

SEQ ID NO: 783694 - DNA, 25 bp, Mus musculus
tctatggcaatcagagggacttctg

SEQ ID NO: 783695 - DNA, 25 bp, Mus musculus
tctatggcaatctgagggacttctg

SEQ ID NO: 783696 - DNA, 25 bp, Mus musculus
tctatggccatgaagcttttgagca

SEQ ID NO: 783697 - DNA, 25 bp, Mus musculus
tctatggccatgtagcttttgagca

SEQ ID NO: 783698 - DNA, 25 bp, Mus musculus
tctatggcgttaagcaaagcctaca

SEQ ID NO: 783699 - DNA, 25 bp, Mus musculus
tctatggcgttatgcaaagcctaca

SEQ ID NO: 783700 - DNA, 25 bp, Mus musculus
tctatggctcaacctgcctcactgt

SEQ ID NO: 783701 - DNA, 25 bp, Mus musculus
tctatggctcaagctgcctcactgt

SEQ ID NO: 783702 - DNA, 25 bp, Mus musculus
tctatggctttgcagcccttgtggg

SEQ ID NO: 783703 - DNA, 25 bp, Mus musculus
tctatggctttggagcccttgtggg

SEQ ID NO: 783704 - DNA, 25 bp, Mus musculus
tctatgggagcaccatgttcgtctt

SEQ ID NO: 783705 - DNA, 25 bp, Mus musculus
tctatgggagcagcatgttcgtctt

SEQ ID NO: 783706 - DNA, 25 bp, Mus musculus
tctatggtgacaacagagtccatga

SEQ ID NO: 783707 - DNA, 25 bp, Mus musculus
tctatggtgacatcagagtccatga

SEQ ID NO: 783708 - DNA, 25 bp, Mus musculus
tctatggtgcggagattgtgtctgc

SEQ ID NO: 783709 - DNA, 25 bp, Mus musculus
tctatggtgcggtgattgtgtctgc

SEQ ID NO: 783710 - DNA, 25 bp, Mus musculus
tctatggtgtccactttgagttacc

SEQ ID NO: 783711 - DNA, 25 bp, Mus musculus
tctatggtgtcctctttgagttacc

SEQ ID NO: 783712 - DNA, 25 bp, Mus musculus
tctatggttgctacgtggtcagcgt

SEQ ID NO: 783713 - DNA, 25 bp, Mus musculus
tctatggttgcttcgtggtcagcgt

SEQ ID NO: 783714 - DNA, 25 bp, Mus musculus
tctatgtacattcttacaaagcacc

SEQ ID NO: 783715 - DNA, 25 bp, Mus musculus
tctatgtacattgttacaaagcacc

SEQ ID NO: 783716 - DNA, 25 bp, Mus musculus
tctatgtactgcatgctgtttgtcg

SEQ ID NO: 783717 - DNA, 25 bp, Mus musculus
tctatgtactgcttgctgtttgtcg

SEQ ID NO: 783718 - DNA, 25 bp, Mus musculus
tctatgtcagaaaccagaggtagga

SEQ ID NO: 783719 - DNA, 25 bp, Mus musculus
tctatgtcagaatccagaggtagga

SEQ ID NO: 783720 - DNA, 25 bp, Mus musculus
tctatgtccaggctagaggccatcg

SEQ ID NO: 783721 - DNA, 25 bp, Mus musculus
tctatgtccagggtagaggccatcg

SEQ ID NO: 783722 - DNA, 25 bp, Mus musculus
tctatgtcgagaccatctgccgagt

SEQ ID NO: 783723 - DNA, 25 bp, Mus musculus
tctatgtcgagagcatctgccgagt

SEQ ID NO: 783724 - DNA, 25 bp, Mus musculus
tctatgtcggaaaggtcaggattgc

SEQ ID NO: 783725 - DNA, 25 bp, Mus musculus
tctatgtcggaatggtcaggattgc

SEQ ID NO: 783726 - DNA, 25 bp, Mus musculus
tctatgtcgtgaacggtgacttggg

SEQ ID NO: 783727 - DNA, 25 bp, Mus musculus
tctatgtcgtgatcggtgacttggg

SEQ ID NO: 783728 - DNA, 25 bp, Mus musculus
tctatgtctccgacgcattccacaa

SEQ ID NO: 783729 - DNA, 25 bp, Mus musculus
tctatgtctccgtcgcattccacaa

SEQ ID NO: 783730 - DNA, 25 bp, Mus musculus
tctatgtgacctacctgggatacag

SEQ ID NO: 783731 - DNA, 25 bp, Mus musculus
tctatgtgaccttcctgggatacag

SEQ ID NO: 783732 - DNA, 25 bp, Mus musculus
tctatgtggcctaccaggacacagg

SEQ ID NO: 783733 - DNA, 25 bp, Mus musculus
tctatgtggcctacctccgtggctt

SEQ ID NO: 783734 - DNA, 25 bp, Mus musculus
tctatgtggccttccaggacacagg

SEQ ID NO: 783735 - DNA, 25 bp, Mus musculus
tctatgtggccttcctccgtggctt

SEQ ID NO: 783736 - DNA, 25 bp, Mus musculus
tctatgtggcgccaaatggagactg

SEQ ID NO: 783737 - DNA, 25 bp, Mus musculus
tctatgtggcgcgaaatggagactg

SEQ ID NO: 783738 - DNA, 25 bp, Mus musculus
tctatgtggctgctgcctttgacct

SEQ ID NO: 783739 - DNA, 25 bp, Mus musculus
tctatgtggctggtgcctttgacct

SEQ ID NO: 783740 - DNA, 25 bp, Mus musculus
tctatgtgggctacatgctgtgggc

SEQ ID NO: 783741 - DNA, 25 bp, Mus musculus
tctatgtgggctccatctactatga

SEQ ID NO: 783742 - DNA, 25 bp, Mus musculus
tctatgtgggctgcatctactatga

SEQ ID NO: 783743 - DNA, 25 bp, Mus musculus
tctatgtgggcttcatgctgtgggc

SEQ ID NO: 783744 - DNA, 25 bp, Mus musculus
tctatgtgtttgctggagacaacgg

SEQ ID NO: 783745 - DNA, 25 bp, Mus musculus
tctatgtgtttggtggagacaacgg

SEQ ID NO: 783746 - DNA, 25 bp, Mus musculus
tctatgttactacttggctatggct

SEQ ID NO: 783747 - DNA, 25 bp, Mus musculus
tctatgttactagttggctatggct

SEQ ID NO: 783748 - DNA, 25 bp, Mus musculus
tctatgttgtctctccctacaggag

SEQ ID NO: 783749 - DNA, 25 bp, Mus musculus
tctatgttgtctgtccctacaggag

SEQ ID NO: 783750 - DNA, 25 bp, Mus musculus
tctattacagggagtgtccccagga

SEQ ID NO: 783751 - DNA, 25 bp, Mus musculus
tctattacagggtgtgtccccagga

SEQ ID NO: 783752 - DNA, 25 bp, Mus musculus
tctattattaaaagaactcgtttgg

SEQ ID NO: 783753 - DNA, 25 bp, Mus musculus
tctattattaaatgaactcgtttgg

SEQ ID NO: 783754 - DNA, 25 bp, Mus musculus
tctattcagtttcccttcccaatgt

SEQ ID NO: 783755 - DNA, 25 bp, Mus musculus
tctattcagtttgccttcccaatgt

SEQ ID NO: 783756 - DNA, 25 bp, Mus musculus
tctattccaacacggaccattctgg

SEQ ID NO: 783757 - DNA, 25 bp, Mus musculus
tctattccaacagggaccattctgg

SEQ ID NO: 783758 - DNA, 25 bp, Mus musculus
tctattcccattatgttcctgacac

SEQ ID NO: 783759 - DNA, 25 bp, Mus musculus
tctattcccattttgttcctgacac

SEQ ID NO: 783760 - DNA, 25 bp, Mus musculus
tctattcgtcatacaattgctggga

SEQ ID NO: 783761 - DNA, 25 bp, Mus musculus
tctattcgtcattcaattgctggga

SEQ ID NO: 783762 - DNA, 25 bp, Mus musculus
tctattctacatcttactgtcatga

SEQ ID NO: 783763 - DNA, 25 bp, Mus musculus
tctattctacatgttactgtcatga

SEQ ID NO: 783764 - DNA, 25 bp, Mus musculus
tctattctgggaagacacatcctgg

SEQ ID NO: 783765 - DNA, 25 bp, Mus musculus
tctattctgggacccatgatggaca

SEQ ID NO: 783766 - DNA, 25 bp, Mus musculus
tctattctgggagccatgatggaca

SEQ ID NO: 783767 - DNA, 25 bp, Mus musculus
tctattctgggatgacacatcctgg

SEQ ID NO: 783768 - DNA, 25 bp, Mus musculus
tctattctttctacatgccagctgc

SEQ ID NO: 783769 - DNA, 25 bp, Mus musculus
tctattctttcttcatgccagctgc

SEQ ID NO: 783770 - DNA, 25 bp, Mus musculus
tctattgaaatcaagagcatcgatg

SEQ ID NO: 783771 - DNA, 25 bp, Mus musculus
tctattgaaatctagagcatcgatg

SEQ ID NO: 783772 - DNA, 25 bp, Mus musculus
tctattgggttgattccaaactcca

SEQ ID NO: 783773 - DNA, 25 bp, Mus musculus
tctattgggttgtttccaaactcca

SEQ ID NO: 783774 - DNA, 25 bp, Mus musculus
tctattgtagacaagtacattggtg

SEQ ID NO: 783775 - DNA, 25 bp, Mus musculus
tctattgtagactagtacattggtg

SEQ ID NO: 783776 - DNA, 25 bp, Mus musculus
tctattgtggtacaggcctcagagg

SEQ ID NO: 783777 - DNA, 25 bp, Mus musculus
tctattgtggtagaggcctcagagg

SEQ ID NO: 783778 - DNA, 25 bp, Mus musculus
tctatttagatcagcctatgagcag

SEQ ID NO: 783779 - DNA, 25 bp, Mus musculus
tctatttagatctgcctatgagcag

SEQ ID NO: 783780 - DNA, 25 bp, Mus musculus
tctatttatgaactggacaagcaag

SEQ ID NO: 783781 - DNA, 25 bp, Mus musculus
tctatttatgaagtggacaagcaag

SEQ ID NO: 783782 - DNA, 25 bp, Mus musculus
tctatttccactaacaaaggaagat

SEQ ID NO: 783783 - DNA, 25 bp, Mus musculus
tctatttccacttacaaaggaagat

SEQ ID NO: 783784 - DNA, 25 bp, Mus musculus
tctatttccagtctgaaggacatga

SEQ ID NO: 783785 - DNA, 25 bp, Mus musculus
tctatttccagtgtgaaggacatga

SEQ ID NO: 783786 - DNA, 25 bp, Mus musculus
tctatttcggcgaatcttgaacgtg

SEQ ID NO: 783787 - DNA, 25 bp, Mus musculus
tctatttcggcgtatcttgaacgtg

SEQ ID NO: 783788 - DNA, 25 bp, Mus musculus
tctatttggctacaacacgggcctc

SEQ ID NO: 783789 - DNA, 25 bp, Mus musculus
tctatttggctagaacacgggcctc

SEQ ID NO: 783790 - DNA, 25 bp, Mus musculus
tctatttggtaaatgctacagacta

SEQ ID NO: 783791 - DNA, 25 bp, Mus musculus
tctatttggtaattgctacagacta

SEQ ID NO: 783792 - DNA, 25 bp, Mus musculus
tctatttggttactgccaccatacc

SEQ ID NO: 783793 - DNA, 25 bp, Mus musculus
tctatttggttagtgccaccatacc

SEQ ID NO: 783794 - DNA, 25 bp, Mus musculus
tctatttttataacgccacgtacct

SEQ ID NO: 783795 - DNA, 25 bp, Mus musculus
tctatttttatatcgccacgtacct

SEQ ID NO: 783796 - DNA, 25 bp, Mus musculus
tctcaaaagagaagacaatgtcaac

SEQ ID NO: 783797 - DNA, 25 bp, Mus musculus
tctcaaaagagatgacaatgtcaac

SEQ ID NO: 783798 - DNA, 25 bp, Mus musculus
tctcaaaagtggatggccccatgcg

SEQ ID NO: 783799 - DNA, 25 bp, Mus musculus
tctcaaaagtggttggccccatgcg

SEQ ID NO: 783800 - DNA, 25 bp, Mus musculus
tctcaaaagtttcgccaatgggctg

SEQ ID NO: 783801 - DNA, 25 bp, Mus musculus
tctcaaaagtttggccaatgggctg

SEQ ID NO: 783802 - DNA, 25 bp, Mus musculus
tctcaaaatttcagggccttcattt

SEQ ID NO: 783803 - DNA, 25 bp, Mus musculus
tctcaaaatttctgggccttcattt

SEQ ID NO: 783804 - DNA, 25 bp, Mus musculus
tctcaaacacatcgccaaagctagg

SEQ ID NO: 783805 - DNA, 25 bp, Mus musculus
tctcaaacacatggccaaagctagg

SEQ ID NO: 783806 - DNA, 25 bp, Mus musculus
tctcaaacagaacaaccgacccaat

SEQ ID NO: 783807 - DNA, 25 bp, Mus musculus
tctcaaacagaagaaccgacccaat

SEQ ID NO: 783808 - DNA, 25 bp, Mus musculus
tctcaaacatctacctgatcaaggg

SEQ ID NO: 783809 - DNA, 25 bp, Mus musculus
tctcaaacatcttcctgatcaaggg

SEQ ID NO: 783810 - DNA, 25 bp, Mus musculus
tctcaaaccaagactagtggcaaaa

SEQ ID NO: 783811 - DNA, 25 bp, Mus musculus
tctcaaaccaagtctagtggcaaaa

SEQ ID NO: 783812 - DNA, 25 bp, Mus musculus
tctcaaactaatcaccgagttgtgg

SEQ ID NO: 783813 - DNA, 25 bp, Mus musculus
tctcaaactaatgaccgagttgtgg

SEQ ID NO: 783814 - DNA, 25 bp, Mus musculus
tctcaaactccacgtgctgtgatca

SEQ ID NO: 783815 - DNA, 25 bp, Mus musculus
tctcaaactccaggtgctgtgatca

SEQ ID NO: 783816 - DNA, 25 bp, Mus musculus
tctcaaactgatctgctcccgggtg

SEQ ID NO: 783817 - DNA, 25 bp, Mus musculus
tctcaaactgatgtgctcccgggtg

SEQ ID NO: 783818 - DNA, 25 bp, Mus musculus
tctcaaagaagcacgctgcctacgc

SEQ ID NO: 783819 - DNA, 25 bp, Mus musculus
tctcaaagaagctcgctgcctacgc

SEQ ID NO: 783820 - DNA, 25 bp, Mus musculus
tctcaaagaccaactggagggagtc

SEQ ID NO: 783821 - DNA, 25 bp, Mus musculus
tctcaaagaccatctggagggagtc

SEQ ID NO: 783822 - DNA, 25 bp, Mus musculus
tctcaaagacctatagtgctggctg

SEQ ID NO: 783823 - DNA, 25 bp, Mus musculus
tctcaaagacctttagtgctggctg

SEQ ID NO: 783824 - DNA, 25 bp, Mus musculus
tctcaaagacggaattagactggtt

SEQ ID NO: 783825 - DNA, 25 bp, Mus musculus
tctcaaagacggtattagactggtt

SEQ ID NO: 783826 - DNA, 25 bp, Mus musculus
tctcaaagagaacagaacaatgacc

SEQ ID NO: 783827 - DNA, 25 bp, Mus musculus
tctcaaagagaagagaacaatgacc

SEQ ID NO: 783828 - DNA, 25 bp, Mus musculus
tctcaaagaggacatgctcctggcc

SEQ ID NO: 783829 - DNA, 25 bp, Mus musculus
tctcaaagaggagatgctcctggcc

SEQ ID NO: 783830 - DNA, 25 bp, Mus musculus
tctcaaagcacgagacagtggtcgg

SEQ ID NO: 783831 - DNA, 25 bp, Mus musculus
tctcaaagcacgtgacagtggtcgg

SEQ ID NO: 783832 - DNA, 25 bp, Mus musculus
tctcaaagctgtccatcagaaggag

SEQ ID NO: 783833 - DNA, 25 bp, Mus musculus
tctcaaagctgtgcatcagaaggag

SEQ ID NO: 783834 - DNA, 25 bp, Mus musculus
tctcaaaggctcagaagacactcca

SEQ ID NO: 783835 - DNA, 25 bp, Mus musculus
tctcaaaggctctgaagacactcca

SEQ ID NO: 783836 - DNA, 25 bp, Mus musculus
tctcaaagtagaacacgagtgggtc

SEQ ID NO: 783837 - DNA, 25 bp, Mus musculus
tctcaaagtagatcacgagtgggtc

SEQ ID NO: 783838 - DNA, 25 bp, Mus musculus
tctcaaagtcacagctagtaaatgg

SEQ ID NO: 783839 - DNA, 25 bp, Mus musculus
tctcaaagtcactgctagtaaatgg

SEQ ID NO: 783840 - DNA, 25 bp, Mus musculus
tctcaaatcatgctgaaataaaatg

SEQ ID NO: 783841 - DNA, 25 bp, Mus musculus
tctcaaatcatggtgaaataaaatg

SEQ ID NO: 783842 - DNA, 25 bp, Mus musculus
tctcaaatttatcctgatggactgc

SEQ ID NO: 783843 - DNA, 25 bp, Mus musculus
tctcaaatttatgctgatggactgc

SEQ ID NO: 783844 - DNA, 25 bp, Mus musculus
tctcaacaaaccactgctgcaggtg

SEQ ID NO: 783845 - DNA, 25 bp, Mus musculus
tctcaacaaacctctgctgcaggtg

SEQ ID NO: 783846 - DNA, 25 bp, Mus musculus
tctcaacacctaagtcaaagcagtc

SEQ ID NO: 783847 - DNA, 25 bp, Mus musculus
tctcaacacctatgtcaaagcagtc

SEQ ID NO: 783848 - DNA, 25 bp, Mus musculus
tctcaacagcgacaagctgaacagc

SEQ ID NO: 783849 - DNA, 25 bp, Mus musculus
tctcaacagcgagaagctgaacagc

SEQ ID NO: 783850 - DNA, 25 bp, Mus musculus
tctcaacatcgaccccagctggatg

SEQ ID NO: 783851 - DNA, 25 bp, Mus musculus
tctcaacatcgagcccagctggatg

SEQ ID NO: 783852 - DNA, 25 bp, Mus musculus
tctcaacatgggagaggccttgtgg

SEQ ID NO: 783853 - DNA, 25 bp, Mus musculus
tctcaacatgggtgaggccttgtgg

SEQ ID NO: 783854 - DNA, 25 bp, Mus musculus
tctcaaccaaggctggactggcctc

SEQ ID NO: 783855 - DNA, 25 bp, Mus musculus
tctcaaccaagggtggactggcctc

SEQ ID NO: 783856 - DNA, 25 bp, Mus musculus
tctcaaccactccagttatactcag

SEQ ID NO: 783857 - DNA, 25 bp, Mus musculus
tctcaaccactcgagttatactcag

SEQ ID NO: 783858 - DNA, 25 bp, Mus musculus
tctcaacccaagcaaatgattataa

SEQ ID NO: 783859 - DNA, 25 bp, Mus musculus
tctcaacccaaggaaatgattataa

SEQ ID NO: 783860 - DNA, 25 bp, Mus musculus
tctcaacctgctctcgctacaggag

SEQ ID NO: 783861 - DNA, 25 bp, Mus musculus
tctcaacctgctgtcgctacaggag

SEQ ID NO: 783862 - DNA, 25 bp, Mus musculus
tctcaacggatacatgctgctgcca

SEQ ID NO: 783863 - DNA, 25 bp, Mus musculus
tctcaacggatagatgctgctgcca

SEQ ID NO: 783864 - DNA, 25 bp, Mus musculus
tctcaacggtgtacggtttaagcgg

SEQ ID NO: 783865 - DNA, 25 bp, Mus musculus
tctcaacggtgttcggtttaagcgg

SEQ ID NO: 783866 - DNA, 25 bp, Mus musculus
tctcaactggctcgtaggtcccttt

SEQ ID NO: 783867 - DNA, 25 bp, Mus musculus
tctcaactggctggtaggtcccttt

SEQ ID NO: 783868 - DNA, 25 bp, Mus musculus
tctcaactggtcactgacaagcctc

SEQ ID NO: 783869 - DNA, 25 bp, Mus musculus
tctcaactggtctctgacaagcctc

SEQ ID NO: 783870 - DNA, 25 bp, Mus musculus
tctcaacttggacgagtactacttt

SEQ ID NO: 783871 - DNA, 25 bp, Mus musculus
tctcaacttggaggagtactacttt

SEQ ID NO: 783872 - DNA, 25 bp, Mus musculus
tctcaactttggagggatcagggtg

SEQ ID NO: 783873 - DNA, 25 bp, Mus musculus
tctcaactttggtgggatcagggtg

SEQ ID NO: 783874 - DNA, 25 bp, Mus musculus
tctcaagaaagaagtgggatcagct

SEQ ID NO: 783875 - DNA, 25 bp, Mus musculus
tctcaagaaagatgtgggatcagct

SEQ ID NO: 783876 - DNA, 25 bp, Mus musculus
tctcaagaagatcctcagggattac

SEQ ID NO: 783877 - DNA, 25 bp, Mus musculus
tctcaagaagatgctcagggattac

SEQ ID NO: 783878 - DNA, 25 bp, Mus musculus
tctcaagaagggaaaggacatcatc

SEQ ID NO: 783879 - DNA, 25 bp, Mus musculus
tctcaagaagggtaaggacatcatc

SEQ ID NO: 783880 - DNA, 25 bp, Mus musculus
tctcaagaccagagaatggcaggtg

SEQ ID NO: 783881 - DNA, 25 bp, Mus musculus
tctcaagaccagtgaatggcaggtg

SEQ ID NO: 783882 - DNA, 25 bp, Mus musculus
tctcaagacgatcgatcacaaccga

SEQ ID NO: 783883 - DNA, 25 bp, Mus musculus
tctcaagacgatggatcacaaccga

SEQ ID NO: 783884 - DNA, 25 bp, Mus musculus
tctcaagagacgagaaagtctgtct

SEQ ID NO: 783885 - DNA, 25 bp, Mus musculus
tctcaagagacgtgaaagtctgtct

SEQ ID NO: 783886 - DNA, 25 bp, Mus musculus
tctcaagagatcctctgaagtttct

SEQ ID NO: 783887 - DNA, 25 bp, Mus musculus
tctcaagagatcgtctgaagtttct

SEQ ID NO: 783888 - DNA, 25 bp, Mus musculus
tctcaagagtgtagagaatgcgcct

SEQ ID NO: 783889 - DNA, 25 bp, Mus musculus
tctcaagagtgttgagaatgcgcct

SEQ ID NO: 783890 - DNA, 25 bp, Mus musculus
tctcaagataccagtgtttgatgct

SEQ ID NO: 783891 - DNA, 25 bp, Mus musculus
tctcaagatacctgtgtttgatgct

SEQ ID NO: 783892 - DNA, 25 bp, Mus musculus
tctcaagatcttagcgtgaatggct

SEQ ID NO: 783893 - DNA, 25 bp, Mus musculus
tctcaagatctttgcgtgaatggct

SEQ ID NO: 783894 - DNA, 25 bp, Mus musculus
tctcaagcacctagaaataaagctg

SEQ ID NO: 783895 - DNA, 25 bp, Mus musculus
tctcaagcaccttgaaataaagctg

SEQ ID NO: 783896 - DNA, 25 bp, Mus musculus
tctcaagcagcaaagtttgatcctt

SEQ ID NO: 783897 - DNA, 25 bp, Mus musculus
tctcaagcagcatagtttgatcctt

SEQ ID NO: 783898 - DNA, 25 bp, Mus musculus
tctcaagccatgaggaaggccggcc

SEQ ID NO: 783899 - DNA, 25 bp, Mus musculus
tctcaagccatgtggaaggccggcc

SEQ ID NO: 783900 - DNA, 25 bp, Mus musculus
tctcaagccattccagatgcctggc

SEQ ID NO: 783901 - DNA, 25 bp, Mus musculus
tctcaagccattgcagatgcctggc

SEQ ID NO: 783902 - DNA, 25 bp, Mus musculus
tctcaagcgaaacgaggaattctcc

SEQ ID NO: 783903 - DNA, 25 bp, Mus musculus
tctcaagcgaaaggaggaattctcc

SEQ ID NO: 783904 - DNA, 25 bp, Mus musculus
tctcaagcttatacctccatcatcg

SEQ ID NO: 783905 - DNA, 25 bp, Mus musculus
tctcaagcttattcctccatcatcg

SEQ ID NO: 783906 - DNA, 25 bp, Mus musculus
tctcaaggacacagcgtggtcaagc

SEQ ID NO: 783907 - DNA, 25 bp, Mus musculus
tctcaaggacactgcgtggtcaagc

SEQ ID NO: 783908 - DNA, 25 bp, Mus musculus
tctcaaggacctaagtgctggctgt

SEQ ID NO: 783909 - DNA, 25 bp, Mus musculus
tctcaaggaccttagtgctggctgt

SEQ ID NO: 783910 - DNA, 25 bp, Mus musculus
tctcaaggagagacaagtcttttct

SEQ ID NO: 783911 - DNA, 25 bp, Mus musculus
tctcaaggagagtcaagtcttttct

SEQ ID NO: 783912 - DNA, 25 bp, Mus musculus
tctcaaggagttcggcttttgtgtc

SEQ ID NO: 783913 - DNA, 25 bp, Mus musculus
tctcaaggagttgggcttttgtgtc

SEQ ID NO: 783914 - DNA, 25 bp, Mus musculus
tctcaaggatagaatggtgaacagc

SEQ ID NO: 783915 - DNA, 25 bp, Mus musculus
tctcaaggatagtatggtgaacagc

SEQ ID NO: 783916 - DNA, 25 bp, Mus musculus
tctcaaggcaaacaacatcaagcaa

SEQ ID NO: 783917 - DNA, 25 bp, Mus musculus
tctcaaggcaaagaacatcaagcaa

SEQ ID NO: 783918 - DNA, 25 bp, Mus musculus
tctcaaggcatgaggactcctggga

SEQ ID NO: 783919 - DNA, 25 bp, Mus musculus
tctcaaggcatgtggactcctggga

SEQ ID NO: 783920 - DNA, 25 bp, Mus musculus
tctcaaggcgtgagcttgggcagct

SEQ ID NO: 783921 - DNA, 25 bp, Mus musculus
tctcaaggcgtgtgcttgggcagct

SEQ ID NO: 783922 - DNA, 25 bp, Mus musculus
tctcaaggctgtccagatgctctgg

SEQ ID NO: 783923 - DNA, 25 bp, Mus musculus
tctcaaggctgtgcagatgctctgg

SEQ ID NO: 783924 - DNA, 25 bp, Mus musculus
tctcaagggccaagataggacacac

SEQ ID NO: 783925 - DNA, 25 bp, Mus musculus
tctcaagggccatgataggacacac

SEQ ID NO: 783926 - DNA, 25 bp, Mus musculus
tctcaaggtcgaaaccgagtgggag

SEQ ID NO: 783927 - DNA, 25 bp, Mus musculus
tctcaaggtcgataccgagtgggag

SEQ ID NO: 783928 - DNA, 25 bp, Mus musculus
tctcaagtacggaggtacctggagg

SEQ ID NO: 783929 - DNA, 25 bp, Mus musculus
tctcaagtacggtggtacctggagg

SEQ ID NO: 783930 - DNA, 25 bp, Mus musculus
tctcaagtattgagcagaagacgga

SEQ ID NO: 783931 - DNA, 25 bp, Mus musculus
tctcaagtattgtgcagaagacgga

SEQ ID NO: 783932 - DNA, 25 bp, Mus musculus
tctcaagtcacaacaagtgtatcat

SEQ ID NO: 783933 - DNA, 25 bp, Mus musculus
tctcaagtcacatcaagtgtatcat

SEQ ID NO: 783934 - DNA, 25 bp, Mus musculus
tctcaagtgactaggcagagccagg

SEQ ID NO: 783935 - DNA, 25 bp, Mus musculus
tctcaagtgacttggcagagccagg

SEQ ID NO: 783936 - DNA, 25 bp, Mus musculus
tctcaagtggctcatccgatacaag

SEQ ID NO: 783937 - DNA, 25 bp, Mus musculus
tctcaagtggctgatccgatacaag

SEQ ID NO: 783938 - DNA, 25 bp, Mus musculus
tctcaagtgtcaagtaaaagaccat

SEQ ID NO: 783939 - DNA, 25 bp, Mus musculus
tctcaagtgtcatgtaaaagaccat

SEQ ID NO: 783940 - DNA, 25 bp, Mus musculus
tctcaagttcgccagatgctcttcg

SEQ ID NO: 783941 - DNA, 25 bp, Mus musculus
tctcaagttcgcgagatgctcttcg

SEQ ID NO: 783942 - DNA, 25 bp, Mus musculus
tctcaagttgagattggcactacca

SEQ ID NO: 783943 - DNA, 25 bp, Mus musculus
tctcaagttgagtttggcactacca

SEQ ID NO: 783944 - DNA, 25 bp, Mus musculus
tctcaagtttctctggatgtgcgtg

SEQ ID NO: 783945 - DNA, 25 bp, Mus musculus
tctcaagtttctgtggatgtgcgtg

SEQ ID NO: 783946 - DNA, 25 bp, Mus musculus
tctcaataatgcagagctgttgaaa

SEQ ID NO: 783947 - DNA, 25 bp, Mus musculus
tctcaataatgctgagctgttgaaa

SEQ ID NO: 783948 - DNA, 25 bp, Mus musculus
tctcaatagtatcaagaagctctcc

SEQ ID NO: 783949 - DNA, 25 bp, Mus musculus
tctcaatagtatgaagaagctctcc

SEQ ID NO: 783950 - DNA, 25 bp, Mus musculus
tctcaatatgagactgtgccacagc

SEQ ID NO: 783951 - DNA, 25 bp, Mus musculus
tctcaatatgagtctgtgccacagc

SEQ ID NO: 783952 - DNA, 25 bp, Mus musculus
tctcaatcagtcaaagtagtgcacg

SEQ ID NO: 783953 - DNA, 25 bp, Mus musculus
tctcaatcagtctaagtagtgcacg

SEQ ID NO: 783954 - DNA, 25 bp, Mus musculus
tctcaatcattgacctcggaggtgc

SEQ ID NO: 783955 - DNA, 25 bp, Mus musculus
tctcaatcattgtcctcggaggtgc

SEQ ID NO: 783956 - DNA, 25 bp, Mus musculus
tctcaatccatacaagtcttggaca

SEQ ID NO: 783957 - DNA, 25 bp, Mus musculus
tctcaatccatagaagtcttggaca

SEQ ID NO: 783958 - DNA, 25 bp, Mus musculus
tctcaatcgattctgacctgctctg

SEQ ID NO: 783959 - DNA, 25 bp, Mus musculus
tctcaatcgattgtgacctgctctg

SEQ ID NO: 783960 - DNA, 25 bp, Mus musculus
tctcaatgatggagggcaatgtcaa

SEQ ID NO: 783961 - DNA, 25 bp, Mus musculus
tctcaatgatggtgggcaatgtcaa

SEQ ID NO: 783962 - DNA, 25 bp, Mus musculus
tctcaatgcaaaagaggaaaattcc

SEQ ID NO: 783963 - DNA, 25 bp, Mus musculus
tctcaatgcaaatgaggaaaattcc

SEQ ID NO: 783964 - DNA, 25 bp, Mus musculus
tctcaatgcagcaggtacgggcgtc

SEQ ID NO: 783965 - DNA, 25 bp, Mus musculus
tctcaatgcagctggtacgggcgtc

SEQ ID NO: 783966 - DNA, 25 bp, Mus musculus
tctcaatgcctgcaccaagagtgct

SEQ ID NO: 783967 - DNA, 25 bp, Mus musculus
tctcaatgcctggaccaagagtgct

SEQ ID NO: 783968 - DNA, 25 bp, Mus musculus
tctcaatggcacctttgaatcccag

SEQ ID NO: 783969 - DNA, 25 bp, Mus musculus
tctcaatggcacgtttgaatcccag

SEQ ID NO: 783970 - DNA, 25 bp, Mus musculus
tctcaatggcagatgtcaaaatgga

SEQ ID NO: 783971 - DNA, 25 bp, Mus musculus
tctcaatggcagttgtcaaaatgga

SEQ ID NO: 783972 - DNA, 25 bp, Mus musculus
tctcaatgtctgcatggatgccaaa

SEQ ID NO: 783973 - DNA, 25 bp, Mus musculus
tctcaatgtctggatggatgccaaa

SEQ ID NO: 783974 - DNA, 25 bp, Mus musculus
tctcaatgtgcccttacgagatggc

SEQ ID NO: 783975 - DNA, 25 bp, Mus musculus
tctcaatgtgccgttacgagatggc

SEQ ID NO: 783976 - DNA, 25 bp, Mus musculus
tctcaattttgcatcaggcccgcta

SEQ ID NO: 783977 - DNA, 25 bp, Mus musculus
tctcaattttgcctgaatcgccaca

SEQ ID NO: 783978 - DNA, 25 bp, Mus musculus
tctcaattttgcgtgaatcgccaca

SEQ ID NO: 783979 - DNA, 25 bp, Mus musculus
tctcaattttgcttcaggcccgcta

SEQ ID NO: 783980 - DNA, 25 bp, Mus musculus
tctcacaaaattcaagtcggccttt

SEQ ID NO: 783981 - DNA, 25 bp, Mus musculus
tctcacaaaattgaagtcggccttt

SEQ ID NO: 783982 - DNA, 25 bp, Mus musculus
tctcacaaggagaaactatacctga

SEQ ID NO: 783983 - DNA, 25 bp, Mus musculus
tctcacaaggagtaactatacctga

SEQ ID NO: 783984 - DNA, 25 bp, Mus musculus
tctcacaagtcaagcgataaagcag

SEQ ID NO: 783985 - DNA, 25 bp, Mus musculus
tctcacaagtcatgcgataaagcag

SEQ ID NO: 783986 - DNA, 25 bp, Mus musculus
tctcacactaccaaaaaataggcag

SEQ ID NO: 783987 - DNA, 25 bp, Mus musculus
tctcacactacctaaaaataggcag

SEQ ID NO: 783988 - DNA, 25 bp, Mus musculus
tctcacagagatatcaccactatta

SEQ ID NO: 783989 - DNA, 25 bp, Mus musculus
tctcacagagatttcaccactatta

SEQ ID NO: 783990 - DNA, 25 bp, Mus musculus
tctcacagagtacaagtgccgctgc

SEQ ID NO: 783991 - DNA, 25 bp, Mus musculus
tctcacagagtagaagtgccgctgc

SEQ ID NO: 783992 - DNA, 25 bp, Mus musculus
tctcacagctgaagcactcaccttt

SEQ ID NO: 783993 - DNA, 25 bp, Mus musculus
tctcacagctgatgcactcaccttt

SEQ ID NO: 783994 - DNA, 25 bp, Mus musculus
tctcacaggactacagggaaaatgc

SEQ ID NO: 783995 - DNA, 25 bp, Mus musculus
tctcacaggacttcagggaaaatgc

SEQ ID NO: 783996 - DNA, 25 bp, Mus musculus
tctcacagtggcatgtaacaacttc

SEQ ID NO: 783997 - DNA, 25 bp, Mus musculus
tctcacagtggccaagtgctgggac

SEQ ID NO: 783998 - DNA, 25 bp, Mus musculus
tctcacagtggcgaagtgctgggac

SEQ ID NO: 783999 - DNA, 25 bp, Mus musculus
tctcacagtggcttgtaacaacttc

SEQ ID NO: 784000 - DNA, 25 bp, Mus musculus
tctcacatggagcttcgtccagggt

SEQ ID NO: 784001 - DNA, 25 bp, Mus musculus
tctcacatggaggttcgtccagggt

SEQ ID NO: 784002 - DNA, 25 bp, Mus musculus
tctcacattaaactacagcaagctg

SEQ ID NO: 784003 - DNA, 25 bp, Mus musculus
tctcacattaaagtacagcaagctg

SEQ ID NO: 784004 - DNA, 25 bp, Mus musculus
tctcacattgtcaacaaaagaaagg

SEQ ID NO: 784005 - DNA, 25 bp, Mus musculus
tctcacattgtctacaaaagaaagg

SEQ ID NO: 784006 - DNA, 25 bp, Mus musculus
tctcacatttgcaggctcagcagct

SEQ ID NO: 784007 - DNA, 25 bp, Mus musculus
tctcacatttgctggctcagcagct

SEQ ID NO: 784008 - DNA, 25 bp, Mus musculus
tctcaccaaacaaagtgccctacta

SEQ ID NO: 784009 - DNA, 25 bp, Mus musculus
tctcaccaaacatagtgccctacta

SEQ ID NO: 784010 - DNA, 25 bp, Mus musculus
tctcaccaatgaaggtgaagctgac

SEQ ID NO: 784011 - DNA, 25 bp, Mus musculus
tctcaccaatgatggtgaagctgac

SEQ ID NO: 784012 - DNA, 25 bp, Mus musculus
tctcaccagaagcttacgaacggag

SEQ ID NO: 784013 - DNA, 25 bp, Mus musculus
tctcaccagaaggttacgaacggag

SEQ ID NO: 784014 - DNA, 25 bp, Mus musculus
tctcaccagcatctcttccagtaaa

SEQ ID NO: 784015 - DNA, 25 bp, Mus musculus
tctcaccagcatgtcttccagtaaa

SEQ ID NO: 784016 - DNA, 25 bp, Mus musculus
tctcaccagtggaatcagtacaaga

SEQ ID NO: 784017 - DNA, 25 bp, Mus musculus
tctcaccagtggtatcagtacaaga

SEQ ID NO: 784018 - DNA, 25 bp, Mus musculus
tctcacccagctactagagcagtgc

SEQ ID NO: 784019 - DNA, 25 bp, Mus musculus
tctcacccagcttctagagcagtgc

SEQ ID NO: 784020 - DNA, 25 bp, Mus musculus
tctcaccgacatcttgctacagtgg

SEQ ID NO: 784021 - DNA, 25 bp, Mus musculus
tctcaccgacatgttgctacagtgg

SEQ ID NO: 784022 - DNA, 25 bp, Mus musculus
tctcaccggtgacgatctagagcgg

SEQ ID NO: 784023 - DNA, 25 bp, Mus musculus
tctcaccggtgaggatctagagcgg

SEQ ID NO: 784024 - DNA, 25 bp, Mus musculus
tctcaccgtttcactgcgaaaaagg

SEQ ID NO: 784025 - DNA, 25 bp, Mus musculus
tctcaccgtttctctgcgaaaaagg

SEQ ID NO: 784026 - DNA, 25 bp, Mus musculus
tctcacctattgctctgttcctctg

SEQ ID NO: 784027 - DNA, 25 bp, Mus musculus
tctcacctattggtctgttcctctg

SEQ ID NO: 784028 - DNA, 25 bp, Mus musculus
tctcacctcggcagcgtgagaggct

SEQ ID NO: 784029 - DNA, 25 bp, Mus musculus
tctcacctcggctgcgtgagaggct

SEQ ID NO: 784030 - DNA, 25 bp, Mus musculus
tctcacctgcctctaaattggtaca

SEQ ID NO: 784031 - DNA, 25 bp, Mus musculus
tctcacctgcctgtaaattggtaca

SEQ ID NO: 784032 - DNA, 25 bp, Mus musculus
tctcaccttaggagtgcagcacaga

SEQ ID NO: 784033 - DNA, 25 bp, Mus musculus
tctcaccttaggtgtgcagcacaga

SEQ ID NO: 784034 - DNA, 25 bp, Mus musculus
tctcacgagggtagcgcttgtgtct

SEQ ID NO: 784035 - DNA, 25 bp, Mus musculus
tctcacgagggttgcgcttgtgtct

SEQ ID NO: 784036 - DNA, 25 bp, Mus musculus
tctcacgcccggatgtccggattgg

SEQ ID NO: 784037 - DNA, 25 bp, Mus musculus
tctcacgcccggttgtccggattgg

SEQ ID NO: 784038 - DNA, 25 bp, Mus musculus
tctcacgcgagtccttcatcaagac

SEQ ID NO: 784039 - DNA, 25 bp, Mus musculus
tctcacgcgagtgcttcatcaagac

SEQ ID NO: 784040 - DNA, 25 bp, Mus musculus
tctcacggagcactcggagagcaag

SEQ ID NO: 784041 - DNA, 25 bp, Mus musculus
tctcacggagcagtcggagagcaag

SEQ ID NO: 784042 - DNA, 25 bp, Mus musculus
tctcacgggattcctaggcctctgg

SEQ ID NO: 784043 - DNA, 25 bp, Mus musculus
tctcacgggattgctaggcctctgg

SEQ ID NO: 784044 - DNA, 25 bp, Mus musculus
tctcacgtgtgaaaggacagcgagg

SEQ ID NO: 784045 - DNA, 25 bp, Mus musculus
tctcacgtgtgataggacagcgagg

SEQ ID NO: 784046 - DNA, 25 bp, Mus musculus
tctcactaatgaaaggcctgtccct

SEQ ID NO: 784047 - DNA, 25 bp, Mus musculus
tctcactaatgataggcctgtccct

SEQ ID NO: 784048 - DNA, 25 bp, Mus musculus
tctcactagtgacagtcgggcatgg

SEQ ID NO: 784049 - DNA, 25 bp, Mus musculus
tctcactagtgagagtcgggcatgg

SEQ ID NO: 784050 - DNA, 25 bp, Mus musculus
tctcactatggcagctctagggatc

SEQ ID NO: 784051 - DNA, 25 bp, Mus musculus
tctcactatggctgctctagggatc

SEQ ID NO: 784052 - DNA, 25 bp, Mus musculus
tctcactcaaaaagccaacggttgt

SEQ ID NO: 784053 - DNA, 25 bp, Mus musculus
tctcactcaaaatgccaacggttgt

SEQ ID NO: 784054 - DNA, 25 bp, Mus musculus
tctcactctcaacaaattcagaggg

SEQ ID NO: 784055 - DNA, 25 bp, Mus musculus
tctcactctcaagaaattcagaggg

SEQ ID NO: 784056 - DNA, 25 bp, Mus musculus
tctcactgaagtccatctagatggc

SEQ ID NO: 784057 - DNA, 25 bp, Mus musculus
tctcactgaagtgcatctagatggc

SEQ ID NO: 784058 - DNA, 25 bp, Mus musculus
tctcactgcatgcagccagaggtgg

SEQ ID NO: 784059 - DNA, 25 bp, Mus musculus
tctcactgcatggagccagaggtgg

SEQ ID NO: 784060 - DNA, 25 bp, Mus musculus
tctcactgcctgagaggcctctctt

SEQ ID NO: 784061 - DNA, 25 bp, Mus musculus
tctcactgcctgtgaggcctctctt

SEQ ID NO: 784062 - DNA, 25 bp, Mus musculus
tctcactgcgcaacatggatttgag

SEQ ID NO: 784063 - DNA, 25 bp, Mus musculus
tctcactgcgcatcatggatttgag

SEQ ID NO: 784064 - DNA, 25 bp, Mus musculus
tctcactggatcctatgctcagaag

SEQ ID NO: 784065 - DNA, 25 bp, Mus musculus
tctcactggatcgtatgctcagaag

SEQ ID NO: 784066 - DNA, 25 bp, Mus musculus
tctcactggcacagtttactgccat

SEQ ID NO: 784067 - DNA, 25 bp, Mus musculus
tctcactggcactgtttactgccat

SEQ ID NO: 784068 - DNA, 25 bp, Mus musculus
tctcactggctgagttggaaacgga

SEQ ID NO: 784069 - DNA, 25 bp, Mus musculus
tctcactggctgtgttggaaacgga

SEQ ID NO: 784070 - DNA, 25 bp, Mus musculus
tctcacttctacagtcagggcctgg

SEQ ID NO: 784071 - DNA, 25 bp, Mus musculus
tctcacttctactgtcagggcctgg

SEQ ID NO: 784072 - DNA, 25 bp, Mus musculus
tctcacttctccacattgtctccag

SEQ ID NO: 784073 - DNA, 25 bp, Mus musculus
tctcacttctcctcattgtctccag

SEQ ID NO: 784074 - DNA, 25 bp, Mus musculus
tctcacttctgcatgaaaagaaacc

SEQ ID NO: 784075 - DNA, 25 bp, Mus musculus
tctcacttctgcttgaaaagaaacc

SEQ ID NO: 784076 - DNA, 25 bp, Mus musculus
tctcacttgatgcttctggctcagg

SEQ ID NO: 784077 - DNA, 25 bp, Mus musculus
tctcacttgatggttctggctcagg

SEQ ID NO: 784078 - DNA, 25 bp, Mus musculus
tctcacttgtcacttcttgcatgtc

SEQ ID NO: 784079 - DNA, 25 bp, Mus musculus
tctcacttgtcagttcttgcatgtc

SEQ ID NO: 784080 - DNA, 25 bp, Mus musculus
tctcagaaacttacctggaagccca

SEQ ID NO: 784081 - DNA, 25 bp, Mus musculus
tctcagaaacttcaaagtgccaggg

SEQ ID NO: 784082 - DNA, 25 bp, Mus musculus
tctcagaaacttgaaagtgccaggg

SEQ ID NO: 784083 - DNA, 25 bp, Mus musculus
tctcagaaactttcctggaagccca

SEQ ID NO: 784084 - DNA, 25 bp, Mus musculus
tctcagaaatccagggttgagcccc

SEQ ID NO: 784085 - DNA, 25 bp, Mus musculus
tctcagaaatcctgggttgagcccc

SEQ ID NO: 784086 - DNA, 25 bp, Mus musculus
tctcagaacaggacagccatcatcc

SEQ ID NO: 784087 - DNA, 25 bp, Mus musculus
tctcagaacaggtcagccatcatcc

SEQ ID NO: 784088 - DNA, 25 bp, Mus musculus
tctcagaagaggcacactactgggt

SEQ ID NO: 784089 - DNA, 25 bp, Mus musculus
tctcagaagagggacactactgggt

SEQ ID NO: 784090 - DNA, 25 bp, Mus musculus
tctcagaaggtaatgtgagacctca

SEQ ID NO: 784091 - DNA, 25 bp, Mus musculus
tctcagaaggtattgtgagacctca

SEQ ID NO: 784092 - DNA, 25 bp, Mus musculus
tctcagaaggtgaagtagaccactc

SEQ ID NO: 784093 - DNA, 25 bp, Mus musculus
tctcagaaggtgtagtagaccactc

SEQ ID NO: 784094 - DNA, 25 bp, Mus musculus
tctcagaatgatataaacttgtccg

SEQ ID NO: 784095 - DNA, 25 bp, Mus musculus
tctcagaatgatttaaacttgtccg

SEQ ID NO: 784096 - DNA, 25 bp, Mus musculus
tctcagaattgcacatcccaggtgg

SEQ ID NO: 784097 - DNA, 25 bp, Mus musculus
tctcagaattgctcatcccaggtgg

SEQ ID NO: 784098 - DNA, 25 bp, Mus musculus
tctcagacaagaagcccattcccta

SEQ ID NO: 784099 - DNA, 25 bp, Mus musculus
tctcagacaagatgcccattcccta

SEQ ID NO: 784100 - DNA, 25 bp, Mus musculus
tctcagacaagcagatggtgcacct

SEQ ID NO: 784101 - DNA, 25 bp, Mus musculus
tctcagacaagctgatggtgcacct

SEQ ID NO: 784102 - DNA, 25 bp, Mus musculus
tctcagacagtgaatgcagaaagct

SEQ ID NO: 784103 - DNA, 25 bp, Mus musculus
tctcagacagtgtatgcagaaagct

SEQ ID NO: 784104 - DNA, 25 bp, Mus musculus
tctcagacatgaaatacgagtgtcg

SEQ ID NO: 784105 - DNA, 25 bp, Mus musculus
tctcagacatgatatacgagtgtcg

SEQ ID NO: 784106 - DNA, 25 bp, Mus musculus
tctcagaccatcaacagacgcgtgg

SEQ ID NO: 784107 - DNA, 25 bp, Mus musculus
tctcagaccatctacagacgcgtgg

SEQ ID NO: 784108 - DNA, 25 bp, Mus musculus
tctcagacgactctgtaaaacagtt

SEQ ID NO: 784109 - DNA, 25 bp, Mus musculus
tctcagacgactgtgtaaaacagtt

SEQ ID NO: 784110 - DNA, 25 bp, Mus musculus
tctcagactggactcagggtgtctc

SEQ ID NO: 784111 - DNA, 25 bp, Mus musculus
tctcagactggagtcagggtgtctc

SEQ ID NO: 784112 - DNA, 25 bp, Mus musculus
tctcagactggcatcatatttaccc

SEQ ID NO: 784113 - DNA, 25 bp, Mus musculus
tctcagactggcttcatatttaccc

SEQ ID NO: 784114 - DNA, 25 bp, Mus musculus
tctcagagaacaccgtggtggctgc

SEQ ID NO: 784115 - DNA, 25 bp, Mus musculus
tctcagagaacagcgtggtggctgc

SEQ ID NO: 784116 - DNA, 25 bp, Mus musculus
tctcagagaccactgaagaatttca

SEQ ID NO: 784117 - DNA, 25 bp, Mus musculus
tctcagagaccagtgaagaatttca

SEQ ID NO: 784118 - DNA, 25 bp, Mus musculus
tctcagagacctacgttcaagcagt

SEQ ID NO: 784119 - DNA, 25 bp, Mus musculus
tctcagagaccttcgttcaagcagt

SEQ ID NO: 784120 - DNA, 25 bp, Mus musculus
tctcagagagaaccttcaggccatt

SEQ ID NO: 784121 - DNA, 25 bp, Mus musculus
tctcagagagaagcttcaggccatt

SEQ ID NO: 784122 - DNA, 25 bp, Mus musculus
tctcagagattgatggaaacagaaa

SEQ ID NO: 784123 - DNA, 25 bp, Mus musculus
tctcagagattgttggaaacagaaa

SEQ ID NO: 784124 - DNA, 25 bp, Mus musculus
tctcagagcagaaccatcgattgct

SEQ ID NO: 784125 - DNA, 25 bp, Mus musculus
tctcagagcagatccatcgattgct

SEQ ID NO: 784126 - DNA, 25 bp, Mus musculus
tctcagagcaggatttcaaagtggc

SEQ ID NO: 784127 - DNA, 25 bp, Mus musculus
tctcagagcaggttttcaaagtggc

SEQ ID NO: 784128 - DNA, 25 bp, Mus musculus
tctcagagccggatcggcgcgtcga

SEQ ID NO: 784129 - DNA, 25 bp, Mus musculus
tctcagagccggttcggcgcgtcga

SEQ ID NO: 784130 - DNA, 25 bp, Mus musculus
tctcagagcgcaatttcatcgcggg

SEQ ID NO: 784131 - DNA, 25 bp, Mus musculus
tctcagagcgcattttcatcgcggg

SEQ ID NO: 784132 - DNA, 25 bp, Mus musculus
tctcagagcggacctatcggttgtc

SEQ ID NO: 784133 - DNA, 25 bp, Mus musculus
tctcagagcggagctatcggttgtc

SEQ ID NO: 784134 - DNA, 25 bp, Mus musculus
tctcagagcggcaccggtgaacgct

SEQ ID NO: 784135 - DNA, 25 bp, Mus musculus
tctcagagcggctccggtgaacgct

SEQ ID NO: 784136 - DNA, 25 bp, Mus musculus
tctcagaggaccagaggcgggaact

SEQ ID NO: 784137 - DNA, 25 bp, Mus musculus
tctcagaggacctgaggcgggaact

SEQ ID NO: 784138 - DNA, 25 bp, Mus musculus
tctcagaggagcagttgtgcagcca

SEQ ID NO: 784139 - DNA, 25 bp, Mus musculus
tctcagaggagctgttgtgcagcca

SEQ ID NO: 784140 - DNA, 25 bp, Mus musculus
tctcagaggcagaaggcacaagagc

SEQ ID NO: 784141 - DNA, 25 bp, Mus musculus
tctcagaggcagtaggcacaagagc

SEQ ID NO: 784142 - DNA, 25 bp, Mus musculus
tctcagaggctaaggagatgccagg

SEQ ID NO: 784143 - DNA, 25 bp, Mus musculus
tctcagaggctatggagatgccagg

SEQ ID NO: 784144 - DNA, 25 bp, Mus musculus
tctcagagtaacaaaggactgcacc

SEQ ID NO: 784145 - DNA, 25 bp, Mus musculus
tctcagagtaactaaggactgcacc

SEQ ID NO: 784146 - DNA, 25 bp, Mus musculus
tctcagagtgttcacaggaagcagc

SEQ ID NO: 784147 - DNA, 25 bp, Mus musculus
tctcagagtgttgacaggaagcagc

SEQ ID NO: 784148 - DNA, 25 bp, Mus musculus
tctcagatatcgatgggaccatcac

SEQ ID NO: 784149 - DNA, 25 bp, Mus musculus
tctcagatatcgttgggaccatcac

SEQ ID NO: 784150 - DNA, 25 bp, Mus musculus
tctcagatattcagcacgtactccc

SEQ ID NO: 784151 - DNA, 25 bp, Mus musculus
tctcagatattctgcacgtactccc

SEQ ID NO: 784152 - DNA, 25 bp, Mus musculus
tctcagatcaagaggctcctcagtg

SEQ ID NO: 784153 - DNA, 25 bp, Mus musculus
tctcagatcaagtggctcctcagtg

SEQ ID NO: 784154 - DNA, 25 bp, Mus musculus
tctcagatcacccaggacttcaggg

SEQ ID NO: 784155 - DNA, 25 bp, Mus musculus
tctcagatcaccgaggacttcaggg

SEQ ID NO: 784156 - DNA, 25 bp, Mus musculus
tctcagatgaatcgcttggactgtg

SEQ ID NO: 784157 - DNA, 25 bp, Mus musculus
tctcagatgaatggcttggactgtg

SEQ ID NO: 784158 - DNA, 25 bp, Mus musculus
tctcagatgataacggaaggacgca

SEQ ID NO: 784159 - DNA, 25 bp, Mus musculus
tctcagatgatatcggaaggacgca

SEQ ID NO: 784160 - DNA, 25 bp, Mus musculus
tctcagatgctaacagggatcttgc

SEQ ID NO: 784161 - DNA, 25 bp, Mus musculus
tctcagatgctatcagggatcttgc

SEQ ID NO: 784162 - DNA, 25 bp, Mus musculus
tctcagatgctgactgctctccatc

SEQ ID NO: 784163 - DNA, 25 bp, Mus musculus
tctcagatgctgtctgctctccatc

SEQ ID NO: 784164 - DNA, 25 bp, Mus musculus
tctcagatggccctcgaagacctgg

SEQ ID NO: 784165 - DNA, 25 bp, Mus musculus
tctcagatggccgtcgaagacctgg

SEQ ID NO: 784166 - DNA, 25 bp, Mus musculus
tctcagattatgagggctccgggcc

SEQ ID NO: 784167 - DNA, 25 bp, Mus musculus
tctcagattatgtgggctccgggcc

SEQ ID NO: 784168 - DNA, 25 bp, Mus musculus
tctcagcacaccaggtaggaaggag

SEQ ID NO: 784169 - DNA, 25 bp, Mus musculus
tctcagcacacctggtaggaaggag

SEQ ID NO: 784170 - DNA, 25 bp, Mus musculus
tctcagcaccggatggttcaccatg

SEQ ID NO: 784171 - DNA, 25 bp, Mus musculus
tctcagcaccggttggttcaccatg

SEQ ID NO: 784172 - DNA, 25 bp, Mus musculus
tctcagcagagcaacctcgcaatgg

SEQ ID NO: 784173 - DNA, 25 bp, Mus musculus
tctcagcagagctacctcgcaatgg

SEQ ID NO: 784174 - DNA, 25 bp, Mus musculus
tctcagcagagtcccctgggaggaa

SEQ ID NO: 784175 - DNA, 25 bp, Mus musculus
tctcagcagagtgccctgggaggaa

SEQ ID NO: 784176 - DNA, 25 bp, Mus musculus
tctcagcagcaaaatgtcaagaatt

SEQ ID NO: 784177 - DNA, 25 bp, Mus musculus
tctcagcagcaatatgtcaagaatt

SEQ ID NO: 784178 - DNA, 25 bp, Mus musculus
tctcagcaggatccacataccctaa

SEQ ID NO: 784179 - DNA, 25 bp, Mus musculus
tctcagcaggatgcacataccctaa

SEQ ID NO: 784180 - DNA, 25 bp, Mus musculus
tctcagcagggcagccccaacaatg

SEQ ID NO: 784181 - DNA, 25 bp, Mus musculus
tctcagcagggctgccccaacaatg

SEQ ID NO: 784182 - DNA, 25 bp, Mus musculus
tctcagcaggttagaggcaggatta

SEQ ID NO: 784183 - DNA, 25 bp, Mus musculus
tctcagcaggttcaacagcccactg

SEQ ID NO: 784184 - DNA, 25 bp, Mus musculus
tctcagcaggttctgtggcgctgcc

SEQ ID NO: 784185 - DNA, 25 bp, Mus musculus
tctcagcaggttgaacagcccactg

SEQ ID NO: 784186 - DNA, 25 bp, Mus musculus
tctcagcaggttgtgtggcgctgcc

SEQ ID NO: 784187 - DNA, 25 bp, Mus musculus
tctcagcaggtttgaggcaggatta

SEQ ID NO: 784188 - DNA, 25 bp, Mus musculus
tctcagcataaacgaagcagtttgt

SEQ ID NO: 784189 - DNA, 25 bp, Mus musculus
tctcagcataaaggaagcagtttgt

SEQ ID NO: 784190 - DNA, 25 bp, Mus musculus
tctcagcatcgcagtggtagactat

SEQ ID NO: 784191 - DNA, 25 bp, Mus musculus
tctcagcatcgctgtggtagactat

SEQ ID NO: 784192 - DNA, 25 bp, Mus musculus
tctcagcattggagccctcgtaata

SEQ ID NO: 784193 - DNA, 25 bp, Mus musculus
tctcagcattggtgccctcgtaata

SEQ ID NO: 784194 - DNA, 25 bp, Mus musculus
tctcagccatccagtaccttggcaa

SEQ ID NO: 784195 - DNA, 25 bp, Mus musculus
tctcagccatcctgtaccttggcaa

SEQ ID NO: 784196 - DNA, 25 bp, Mus musculus
tctcagcccaccacgggtagtctgt

SEQ ID NO: 784197 - DNA, 25 bp, Mus musculus
tctcagcccacctcgggtagtctgt

SEQ ID NO: 784198 - DNA, 25 bp, Mus musculus
tctcagccccaactccggaagagaa

SEQ ID NO: 784199 - DNA, 25 bp, Mus musculus
tctcagccccaagtccggaagagaa

SEQ ID NO: 784200 - DNA, 25 bp, Mus musculus
tctcagcccttcactcggtcattgt

SEQ ID NO: 784201 - DNA, 25 bp, Mus musculus
tctcagcccttctctcggtcattgt

SEQ ID NO: 784202 - DNA, 25 bp, Mus musculus
tctcagccgggtagtaatgcccacg

SEQ ID NO: 784203 - DNA, 25 bp, Mus musculus
tctcagccgggttgtaatgcccacg

SEQ ID NO: 784204 - DNA, 25 bp, Mus musculus
tctcagcctggccaaaaatagagtg

SEQ ID NO: 784205 - DNA, 25 bp, Mus musculus
tctcagcctggcgaaaaatagagtg

SEQ ID NO: 784206 - DNA, 25 bp, Mus musculus
tctcagcctgtaactatattttcga

SEQ ID NO: 784207 - DNA, 25 bp, Mus musculus
tctcagcctgtatctatattttcga

SEQ ID NO: 784208 - DNA, 25 bp, Mus musculus
tctcagcctgtgcttcagagggtcc

SEQ ID NO: 784209 - DNA, 25 bp, Mus musculus
tctcagcctgtggttcagagggtcc

SEQ ID NO: 784210 - DNA, 25 bp, Mus musculus
tctcagccttggaggatgacctggc

SEQ ID NO: 784211 - DNA, 25 bp, Mus musculus
tctcagccttggtggatgacctggc

SEQ ID NO: 784212 - DNA, 25 bp, Mus musculus
tctcagcgactcagcaacaattggc

SEQ ID NO: 784213 - DNA, 25 bp, Mus musculus
tctcagcgactccaatttgatgttt

SEQ ID NO: 784214 - DNA, 25 bp, Mus musculus
tctcagcgactcgaatttgatgttt

SEQ ID NO: 784215 - DNA, 25 bp, Mus musculus
tctcagcgactctgcaacaattggc

SEQ ID NO: 784216 - DNA, 25 bp, Mus musculus
tctcagcgatgtcgaatcctagagc

SEQ ID NO: 784217 - DNA, 25 bp, Mus musculus
tctcagcgatgtggaatcctagagc

SEQ ID NO: 784218 - DNA, 25 bp, Mus musculus
tctcagcgcaggagtcgcgctcgag

SEQ ID NO: 784219 - DNA, 25 bp, Mus musculus
tctcagcgcaggcacatttgaaact

SEQ ID NO: 784220 - DNA, 25 bp, Mus musculus
tctcagcgcagggacatttgaaact

SEQ ID NO: 784221 - DNA, 25 bp, Mus musculus
tctcagcgcaggtgtcgcgctcgag

SEQ ID NO: 784222 - DNA, 25 bp, Mus musculus
tctcagcggagtactcatagttcct

SEQ ID NO: 784223 - DNA, 25 bp, Mus musculus
tctcagcggagttctcatagttcct

SEQ ID NO: 784224 - DNA, 25 bp, Mus musculus
tctcagcgtaccctggagatgagtc

SEQ ID NO: 784225 - DNA, 25 bp, Mus musculus
tctcagcgtaccgtggagatgagtc

SEQ ID NO: 784226 - DNA, 25 bp, Mus musculus
tctcagcgtgacagtggaagaattc

SEQ ID NO: 784227 - DNA, 25 bp, Mus musculus
tctcagcgtgactgtggaagaattc

SEQ ID NO: 784228 - DNA, 25 bp, Mus musculus
tctcagcgtggtatgggctacatgc

SEQ ID NO: 784229 - DNA, 25 bp, Mus musculus
tctcagcgtggtttgggctacatgc

SEQ ID NO: 784230 - DNA, 25 bp, Mus musculus
tctcagctctgtcactacatcaacg

SEQ ID NO: 784231 - DNA, 25 bp, Mus musculus
tctcagctctgtgactacatcaacg

SEQ ID NO: 784232 - DNA, 25 bp, Mus musculus
tctcagctgactcccgggagaatgt

SEQ ID NO: 784233 - DNA, 25 bp, Mus musculus
tctcagctgactgccgggagaatgt

SEQ ID NO: 784234 - DNA, 25 bp, Mus musculus
tctcagctgcggatcttgcgcgacg

SEQ ID NO: 784235 - DNA, 25 bp, Mus musculus
tctcagctgcggttcttgcgcgacg

SEQ ID NO: 784236 - DNA, 25 bp, Mus musculus
tctcagctgctaaacctaacccagt

SEQ ID NO: 784237 - DNA, 25 bp, Mus musculus
tctcagctgctatacctaacccagt

SEQ ID NO: 784238 - DNA, 25 bp, Mus musculus
tctcagctggctatgatgctgcaca

SEQ ID NO: 784239 - DNA, 25 bp, Mus musculus
tctcagctggctttgatgctgcaca

SEQ ID NO: 784240 - DNA, 25 bp, Mus musculus
tctcagctgtgtcctccgcaggatg

SEQ ID NO: 784241 - DNA, 25 bp, Mus musculus
tctcagctgtgtgctccgcaggatg

SEQ ID NO: 784242 - DNA, 25 bp, Mus musculus
tctcaggaactccacagttataaca

SEQ ID NO: 784243 - DNA, 25 bp, Mus musculus
tctcaggaactcgacagttataaca

SEQ ID NO: 784244 - DNA, 25 bp, Mus musculus
tctcaggaaggaaccggaagaagct

SEQ ID NO: 784245 - DNA, 25 bp, Mus musculus
tctcaggaaggatccggaagaagct

SEQ ID NO: 784246 - DNA, 25 bp, Mus musculus
tctcaggacacgcaagcgcaagtca

SEQ ID NO: 784247 - DNA, 25 bp, Mus musculus
tctcaggacacggaagcgcaagtca

SEQ ID NO: 784248 - DNA, 25 bp, Mus musculus
tctcaggacagacagggaaagcaaa

SEQ ID NO: 784249 - DNA, 25 bp, Mus musculus
tctcaggacagactggagccaagat

SEQ ID NO: 784250 - DNA, 25 bp, Mus musculus
tctcaggacagagagggaaagcaaa

SEQ ID NO: 784251 - DNA, 25 bp, Mus musculus
tctcaggacagagtggagccaagat

SEQ ID NO: 784252 - DNA, 25 bp, Mus musculus
tctcaggactccatccggaaccagg

SEQ ID NO: 784253 - DNA, 25 bp, Mus musculus
tctcaggactccttccggaaccagg

SEQ ID NO: 784254 - DNA, 25 bp, Mus musculus
tctcaggagcatccctggatctgca

SEQ ID NO: 784255 - DNA, 25 bp, Mus musculus
tctcaggagcatgcctggatctgca

SEQ ID NO: 784256 - DNA, 25 bp, Mus musculus
tctcaggagccactcgagtccttga

SEQ ID NO: 784257 - DNA, 25 bp, Mus musculus
tctcaggagccagtcgagtccttga

SEQ ID NO: 784258 - DNA, 25 bp, Mus musculus
tctcaggaggacaaagctatgtctt

SEQ ID NO: 784259 - DNA, 25 bp, Mus musculus
tctcaggaggactaagctatgtctt

SEQ ID NO: 784260 - DNA, 25 bp, Mus musculus
tctcaggaggcccttgggcttaaga

SEQ ID NO: 784261 - DNA, 25 bp, Mus musculus
tctcaggaggccgttgggcttaaga

SEQ ID NO: 784262 - DNA, 25 bp, Mus musculus
tctcaggatgaaaataacggtgccc

SEQ ID NO: 784263 - DNA, 25 bp, Mus musculus
tctcaggatgaatataacggtgccc

SEQ ID NO: 784264 - DNA, 25 bp, Mus musculus
tctcaggatgagatctgggccttca

SEQ ID NO: 784265 - DNA, 25 bp, Mus musculus
tctcaggatgagttctgggccttca

SEQ ID NO: 784266 - DNA, 25 bp, Mus musculus
tctcaggcacaaatggcccagggtg

SEQ ID NO: 784267 - DNA, 25 bp, Mus musculus
tctcaggcacaattggcccagggtg

SEQ ID NO: 784268 - DNA, 25 bp, Mus musculus
tctcaggcaggcactatcagcagct

SEQ ID NO: 784269 - DNA, 25 bp, Mus musculus
tctcaggcaggctctatcagcagct

SEQ ID NO: 784270 - DNA, 25 bp, Mus musculus
tctcaggccagcaatgtccatgtgg

SEQ ID NO: 784271 - DNA, 25 bp, Mus musculus
tctcaggccagctatgtccatgtgg

SEQ ID NO: 784272 - DNA, 25 bp, Mus musculus
tctcaggccatgacaaggagagtgg

SEQ ID NO: 784273 - DNA, 25 bp, Mus musculus
tctcaggccatgattatcggaatca

SEQ ID NO: 784274 - DNA, 25 bp, Mus musculus
tctcaggccatgtcaaggagagtgg

SEQ ID NO: 784275 - DNA, 25 bp, Mus musculus
tctcaggccatgtttatcggaatca

SEQ ID NO: 784276 - DNA, 25 bp, Mus musculus
tctcaggccgtactcctgcagggct

SEQ ID NO: 784277 - DNA, 25 bp, Mus musculus
tctcaggccgtagtcctgcagggct

SEQ ID NO: 784278 - DNA, 25 bp, Mus musculus
tctcaggcctcacgcacattatagt

SEQ ID NO: 784279 - DNA, 25 bp, Mus musculus
tctcaggcctcaggcacattatagt

SEQ ID NO: 784280 - DNA, 25 bp, Mus musculus
tctcaggcctcgaaaaaattaagca

SEQ ID NO: 784281 - DNA, 25 bp, Mus musculus
tctcaggcctcgtaaaaattaagca

SEQ ID NO: 784282 - DNA, 25 bp, Mus musculus
tctcaggcgtgactagaaaatcccc

SEQ ID NO: 784283 - DNA, 25 bp, Mus musculus
tctcaggcgtgagtagaaaatcccc

SEQ ID NO: 784284 - DNA, 25 bp, Mus musculus
tctcaggctaaacagtacttgcatt

SEQ ID NO: 784285 - DNA, 25 bp, Mus musculus
tctcaggctaaagagtacttgcatt

SEQ ID NO: 784286 - DNA, 25 bp, Mus musculus
tctcaggctagcagaaaagagggcc

SEQ ID NO: 784287 - DNA, 25 bp, Mus musculus
tctcaggctagctgaaaagagggcc

SEQ ID NO: 784288 - DNA, 25 bp, Mus musculus
tctcaggctctcagtacaggaaaac

SEQ ID NO: 784289 - DNA, 25 bp, Mus musculus
tctcaggctctccttatcggctggg

SEQ ID NO: 784290 - DNA, 25 bp, Mus musculus
tctcaggctctcgttatcggctggg

SEQ ID NO: 784291 - DNA, 25 bp, Mus musculus
tctcaggctctctgtacaggaaaac

SEQ ID NO: 784292 - DNA, 25 bp, Mus musculus
tctcagggaaccagtacgggacaag

SEQ ID NO: 784293 - DNA, 25 bp, Mus musculus
tctcagggaacctgtacgggacaag

SEQ ID NO: 784294 - DNA, 25 bp, Mus musculus
tctcagggaactagaagaccttatc

SEQ ID NO: 784295 - DNA, 25 bp, Mus musculus
tctcagggaacttgaagaccttatc

SEQ ID NO: 784296 - DNA, 25 bp, Mus musculus
tctcagggacgactttgcattccgg

SEQ ID NO: 784297 - DNA, 25 bp, Mus musculus
tctcagggacgagtttgcattccgg

SEQ ID NO: 784298 - DNA, 25 bp, Mus musculus
tctcagggagagcagtcacgccgct

SEQ ID NO: 784299 - DNA, 25 bp, Mus musculus
tctcagggagaggagtcacgccgct

SEQ ID NO: 784300 - DNA, 25 bp, Mus musculus
tctcagggcctccattggaataacc

SEQ ID NO: 784301 - DNA, 25 bp, Mus musculus
tctcagggcctcgattggaataacc

SEQ ID NO: 784302 - DNA, 25 bp, Mus musculus
tctcaggggtcaaagcctcctaccg

SEQ ID NO: 784303 - DNA, 25 bp, Mus musculus
tctcaggggtcatagcctcctaccg

SEQ ID NO: 784304 - DNA, 25 bp, Mus musculus
tctcagggtgaacatgaactcacac

SEQ ID NO: 784305 - DNA, 25 bp, Mus musculus
tctcagggtgaagatgaactcacac

SEQ ID NO: 784306 - DNA, 25 bp, Mus musculus
tctcagggtgacagggcggtttaaa

SEQ ID NO: 784307 - DNA, 25 bp, Mus musculus
tctcagggtgactgggcggtttaaa

SEQ ID NO: 784308 - DNA, 25 bp, Mus musculus
tctcagggtgtcaaagctgctgggt

SEQ ID NO: 784309 - DNA, 25 bp, Mus musculus
tctcagggtgtctaagctgctgggt

SEQ ID NO: 784310 - DNA, 25 bp, Mus musculus
tctcagggttttccgcaatcaggcc

SEQ ID NO: 784311 - DNA, 25 bp, Mus musculus
tctcagggttttgcgcaatcaggcc

SEQ ID NO: 784312 - DNA, 25 bp, Mus musculus
tctcaggtaactagaagtagtcaac

SEQ ID NO: 784313 - DNA, 25 bp, Mus musculus
tctcaggtaacttgaagtagtcaac

SEQ ID NO: 784314 - DNA, 25 bp, Mus musculus
tctcaggtcggaatgatattattca

SEQ ID NO: 784315 - DNA, 25 bp, Mus musculus
tctcaggtcggattgatattattca

SEQ ID NO: 784316 - DNA, 25 bp, Mus musculus
tctcaggttagcatgtcaggccagt

SEQ ID NO: 784317 - DNA, 25 bp, Mus musculus
tctcaggttagcttgtcaggccagt

SEQ ID NO: 784318 - DNA, 25 bp, Mus musculus
tctcaggttccacccattaccagaa

SEQ ID NO: 784319 - DNA, 25 bp, Mus musculus
tctcaggttccagccattaccagaa

SEQ ID NO: 784320 - DNA, 25 bp, Mus musculus
tctcaggttttaccaccaacattgt

SEQ ID NO: 784321 - DNA, 25 bp, Mus musculus
tctcaggttttagcaccaacattgt

SEQ ID NO: 784322 - DNA, 25 bp, Mus musculus
tctcagtaaaacagcctctgggctc

SEQ ID NO: 784323 - DNA, 25 bp, Mus musculus
tctcagtaaaactgcctctgggctc

SEQ ID NO: 784324 - DNA, 25 bp, Mus musculus
tctcagtacagtaggccaggaacct

SEQ ID NO: 784325 - DNA, 25 bp, Mus musculus
tctcagtacagttggccaggaacct

SEQ ID NO: 784326 - DNA, 25 bp, Mus musculus
tctcagtacctgcaaaacatgaaga

SEQ ID NO: 784327 - DNA, 25 bp, Mus musculus
tctcagtacctggaaaacatgaaga

SEQ ID NO: 784328 - DNA, 25 bp, Mus musculus
tctcagtaggagctgaatgggtcct

SEQ ID NO: 784329 - DNA, 25 bp, Mus musculus
tctcagtaggaggtgaatgggtcct

SEQ ID NO: 784330 - DNA, 25 bp, Mus musculus
tctcagtagtacaccagagcctgct

SEQ ID NO: 784331 - DNA, 25 bp, Mus musculus
tctcagtagtactccagagcctgct

SEQ ID NO: 784332 - DNA, 25 bp, Mus musculus
tctcagtatggtatgagcatgtagc

SEQ ID NO: 784333 - DNA, 25 bp, Mus musculus
tctcagtatggtttgagcatgtagc

SEQ ID NO: 784334 - DNA, 25 bp, Mus musculus
tctcagtcatctagccgagaaagat

SEQ ID NO: 784335 - DNA, 25 bp, Mus musculus
tctcagtcatcttgccgagaaagat

SEQ ID NO: 784336 - DNA, 25 bp, Mus musculus
tctcagtcgttgatcctgggagcac

SEQ ID NO: 784337 - DNA, 25 bp, Mus musculus
tctcagtcgttgttcctgggagcac

SEQ ID NO: 784338 - DNA, 25 bp, Mus musculus
tctcagtctggcatcgataaagctt

SEQ ID NO: 784339 - DNA, 25 bp, Mus musculus
tctcagtctggcttcgataaagctt

SEQ ID NO: 784340 - DNA, 25 bp, Mus musculus
tctcagtctggtacgggtaaaacag

SEQ ID NO: 784341 - DNA, 25 bp, Mus musculus
tctcagtctggttcgggtaaaacag

SEQ ID NO: 784342 - DNA, 25 bp, Mus musculus
tctcagtgaattccgcgatgaagcc

SEQ ID NO: 784343 - DNA, 25 bp, Mus musculus
tctcagtgaattgcgcgatgaagcc

SEQ ID NO: 784344 - DNA, 25 bp, Mus musculus
tctcagtgagaaccgcacattggag

SEQ ID NO: 784345 - DNA, 25 bp, Mus musculus
tctcagtgagaagcgcacattggag

SEQ ID NO: 784346 - DNA, 25 bp, Mus musculus
tctcagtgagggagtacgcttgccc

SEQ ID NO: 784347 - DNA, 25 bp, Mus musculus
tctcagtgagggtgtacgcttgccc

SEQ ID NO: 784348 - DNA, 25 bp, Mus musculus
tctcagtgcaggattgcaccatccc

SEQ ID NO: 784349 - DNA, 25 bp, Mus musculus
tctcagtgcaggtttgcaccatccc

SEQ ID NO: 784350 - DNA, 25 bp, Mus musculus
tctcagtgccatatcagaggggaca

SEQ ID NO: 784351 - DNA, 25 bp, Mus musculus
tctcagtgccatttcagaggggaca

SEQ ID NO: 784352 - DNA, 25 bp, Mus musculus
tctcagtgcctccatgaggagtata

SEQ ID NO: 784353 - DNA, 25 bp, Mus musculus
tctcagtgcctcgatgaggagtata

SEQ ID NO: 784354 - DNA, 25 bp, Mus musculus
tctcagtggagacacacagactgac

SEQ ID NO: 784355 - DNA, 25 bp, Mus musculus
tctcagtggagagacacagactgac

SEQ ID NO: 784356 - DNA, 25 bp, Mus musculus
tctcagtggatgcagcacaggacac

SEQ ID NO: 784357 - DNA, 25 bp, Mus musculus
tctcagtggatggagcacaggacac

SEQ ID NO: 784358 - DNA, 25 bp, Mus musculus
tctcagtggcgacgtttggaacatt

SEQ ID NO: 784359 - DNA, 25 bp, Mus musculus
tctcagtggcgaggtttggaacatt

SEQ ID NO: 784360 - DNA, 25 bp, Mus musculus
tctcagttactgaggcagggctctc

SEQ ID NO: 784361 - DNA, 25 bp, Mus musculus
tctcagttactgtggcagggctctc

SEQ ID NO: 784362 - DNA, 25 bp, Mus musculus
tctcagttcctgatcggaaaccact

SEQ ID NO: 784363 - DNA, 25 bp, Mus musculus
tctcagttcctgttcggaaaccact

SEQ ID NO: 784364 - DNA, 25 bp, Mus musculus
tctcagttctttaatgtgtgaccat

SEQ ID NO: 784365 - DNA, 25 bp, Mus musculus
tctcagttcttttatgtgtgaccat

SEQ ID NO: 784366 - DNA, 25 bp, Mus musculus
tctcagttgcaacacatgtcggaaa

SEQ ID NO: 784367 - DNA, 25 bp, Mus musculus
tctcagttgcaagacatgtcggaaa

SEQ ID NO: 784368 - DNA, 25 bp, Mus musculus
tctcagttgggtatggaagcaggca

SEQ ID NO: 784369 - DNA, 25 bp, Mus musculus
tctcagttgggtttggaagcaggca

SEQ ID NO: 784370 - DNA, 25 bp, Mus musculus
tctcagttgttgcaagagcacggcc

SEQ ID NO: 784371 - DNA, 25 bp, Mus musculus
tctcagttgttggaagagcacggcc

SEQ ID NO: 784372 - DNA, 25 bp, Mus musculus
tctcataaaggcatctggtgtcagc

SEQ ID NO: 784373 - DNA, 25 bp, Mus musculus
tctcataaaggcttctggtgtcagc

SEQ ID NO: 784374 - DNA, 25 bp, Mus musculus
tctcatacacagctgcaattttgac

SEQ ID NO: 784375 - DNA, 25 bp, Mus musculus
tctcatacacaggtgcaattttgac

SEQ ID NO: 784376 - DNA, 25 bp, Mus musculus
tctcatacgatacggtggtgcacac

SEQ ID NO: 784377 - DNA, 25 bp, Mus musculus
tctcatacgatagggtggtgcacac

SEQ ID NO: 784378 - DNA, 25 bp, Mus musculus
tctcatagcagtagtggtacccgac

SEQ ID NO: 784379 - DNA, 25 bp, Mus musculus
tctcatagcagttgtggtacccgac

SEQ ID NO: 784380 - DNA, 25 bp, Mus musculus
tctcataggatgcttggaatgtaaa

SEQ ID NO: 784381 - DNA, 25 bp, Mus musculus
tctcataggatggttggaatgtaaa

SEQ ID NO: 784382 - DNA, 25 bp, Mus musculus
tctcatatctcactcctagctggtg

SEQ ID NO: 784383 - DNA, 25 bp, Mus musculus
tctcatatctcagtcctagctggtg

SEQ ID NO: 784384 - DNA, 25 bp, Mus musculus
tctcatattaacagaaatggcaacc

SEQ ID NO: 784385 - DNA, 25 bp, Mus musculus
tctcatattaactgaaatggcaacc

SEQ ID NO: 784386 - DNA, 25 bp, Mus musculus
tctcatcaatagcttgaagaccagc

SEQ ID NO: 784387 - DNA, 25 bp, Mus musculus
tctcatcaataggttgaagaccagc

SEQ ID NO: 784388 - DNA, 25 bp, Mus musculus
tctcatcagcagctcacaagtctag

SEQ ID NO: 784389 - DNA, 25 bp, Mus musculus
tctcatcagcaggtcacaagtctag

SEQ ID NO: 784390 - DNA, 25 bp, Mus musculus
tctcatcagccgaaagtccagaaat

SEQ ID NO: 784391 - DNA, 25 bp, Mus musculus
tctcatcagccgtaagtccagaaat

SEQ ID NO: 784392 - DNA, 25 bp, Mus musculus
tctcatcagcgaaacgggggagttg

SEQ ID NO: 784393 - DNA, 25 bp, Mus musculus
tctcatcagcgatacgggggagttg

SEQ ID NO: 784394 - DNA, 25 bp, Mus musculus
tctcatcaggatacgtccatccagc

SEQ ID NO: 784395 - DNA, 25 bp, Mus musculus
tctcatcaggattcgtccatccagc

SEQ ID NO: 784396 - DNA, 25 bp, Mus musculus
tctcatcatcgaaatattgccacgt

SEQ ID NO: 784397 - DNA, 25 bp, Mus musculus
tctcatcatcgatatattgccacgt

SEQ ID NO: 784398 - DNA, 25 bp, Mus musculus
tctcatcatctcagtagacatctct

SEQ ID NO: 784399 - DNA, 25 bp, Mus musculus
tctcatcatctctgtagacatctct

SEQ ID NO: 784400 - DNA, 25 bp, Mus musculus
tctcatccacagagggtccgctggc

SEQ ID NO: 784401 - DNA, 25 bp, Mus musculus
tctcatccacagtgggtccgctggc

SEQ ID NO: 784402 - DNA, 25 bp, Mus musculus
tctcatccacgccttgggcggcatg

SEQ ID NO: 784403 - DNA, 25 bp, Mus musculus
tctcatccacgcgttgggcggcatg

SEQ ID NO: 784404 - DNA, 25 bp, Mus musculus
tctcatccagatcaaagcgctctca

SEQ ID NO: 784405 - DNA, 25 bp, Mus musculus
tctcatccagatgaaagcgctctca

SEQ ID NO: 784406 - DNA, 25 bp, Mus musculus
tctcatccgccaaggagctggcccg

SEQ ID NO: 784407 - DNA, 25 bp, Mus musculus
tctcatccgccatggagctggcccg

SEQ ID NO: 784408 - DNA, 25 bp, Mus musculus
tctcatccgggacagaggatctgct

SEQ ID NO: 784409 - DNA, 25 bp, Mus musculus
tctcatccgggagagaggatctgct

SEQ ID NO: 784410 - DNA, 25 bp, Mus musculus
tctcatcctgggagatgtcgcctac

SEQ ID NO: 784411 - DNA, 25 bp, Mus musculus
tctcatcctgggtgatgtcgcctac

SEQ ID NO: 784412 - DNA, 25 bp, Mus musculus
tctcatcgtggactgggatgtgcac

SEQ ID NO: 784413 - DNA, 25 bp, Mus musculus
tctcatcgtggagtgggatgtgcac

SEQ ID NO: 784414 - DNA, 25 bp, Mus musculus
tctcatctacctcgagggtggagtc

SEQ ID NO: 784415 - DNA, 25 bp, Mus musculus
tctcatctacctggagggtggagtc

SEQ ID NO: 784416 - DNA, 25 bp, Mus musculus
tctcatctgctacaatcagaaagga

SEQ ID NO: 784417 - DNA, 25 bp, Mus musculus
tctcatctgctagaatcagaaagga

SEQ ID NO: 784418 - DNA, 25 bp, Mus musculus
tctcatctgcttctctgtcgtaaac

SEQ ID NO: 784419 - DNA, 25 bp, Mus musculus
tctcatctgcttgtctgtcgtaaac

SEQ ID NO: 784420 - DNA, 25 bp, Mus musculus
tctcatctgtgacaccggtatcctc

SEQ ID NO: 784421 - DNA, 25 bp, Mus musculus
tctcatctgtgagaccggtatcctc

SEQ ID NO: 784422 - DNA, 25 bp, Mus musculus
tctcatcttccactcttcctatatg

SEQ ID NO: 784423 - DNA, 25 bp, Mus musculus
tctcatcttccagtcttcctatatg

SEQ ID NO: 784424 - DNA, 25 bp, Mus musculus
tctcatctttggactcatcacttgc

SEQ ID NO: 784425 - DNA, 25 bp, Mus musculus
tctcatctttggtctcatcacttgc

SEQ ID NO: 784426 - DNA, 25 bp, Mus musculus
tctcatgaagtaaggcaggccttaa

SEQ ID NO: 784427 - DNA, 25 bp, Mus musculus
tctcatgaagtatggcaggccttaa

SEQ ID NO: 784428 - DNA, 25 bp, Mus musculus
tctcatgacctcactgacagtccat

SEQ ID NO: 784429 - DNA, 25 bp, Mus musculus
tctcatgacctctctgacagtccat

SEQ ID NO: 784430 - DNA, 25 bp, Mus musculus
tctcatgcacctagggaagaaaacg

SEQ ID NO: 784431 - DNA, 25 bp, Mus musculus
tctcatgcaccttgggaagaaaacg

SEQ ID NO: 784432 - DNA, 25 bp, Mus musculus
tctcatgccagcactggactcctgg

SEQ ID NO: 784433 - DNA, 25 bp, Mus musculus
tctcatgccagctctggactcctgg

SEQ ID NO: 784434 - DNA, 25 bp, Mus musculus
tctcatgccccaccttagagtgctt

SEQ ID NO: 784435 - DNA, 25 bp, Mus musculus
tctcatgccccagcttagagtgctt

SEQ ID NO: 784436 - DNA, 25 bp, Mus musculus
tctcatgcctttaggagcgggcgtc

SEQ ID NO: 784437 - DNA, 25 bp, Mus musculus
tctcatgccttttggagcgggcgtc

SEQ ID NO: 784438 - DNA, 25 bp, Mus musculus
tctcatgcggagcaggtcttcccac

SEQ ID NO: 784439 - DNA, 25 bp, Mus musculus
tctcatgcggaggaggtcttcccac

SEQ ID NO: 784440 - DNA, 25 bp, Mus musculus
tctcatggacacaatcactggacca

SEQ ID NO: 784441 - DNA, 25 bp, Mus musculus
tctcatggacactatcactggacca

SEQ ID NO: 784442 - DNA, 25 bp, Mus musculus
tctcatggaccacggaagggtaaca

SEQ ID NO: 784443 - DNA, 25 bp, Mus musculus
tctcatggaccagggaagggtaaca

SEQ ID NO: 784444 - DNA, 25 bp, Mus musculus
tctcatggccccagggttaaaggtg

SEQ ID NO: 784445 - DNA, 25 bp, Mus musculus
tctcatggcccctgggttaaaggtg

SEQ ID NO: 784446 - DNA, 25 bp, Mus musculus
tctcatggctgtagagcgtggcagt

SEQ ID NO: 784447 - DNA, 25 bp, Mus musculus
tctcatggctgttgagcgtggcagt

SEQ ID NO: 784448 - DNA, 25 bp, Mus musculus
tctcatgggatcagtacggaaagat

SEQ ID NO: 784449 - DNA, 25 bp, Mus musculus
tctcatgggatctgtacggaaagat

SEQ ID NO: 784450 - DNA, 25 bp, Mus musculus
tctcatgggctgaaagacaagaagg

SEQ ID NO: 784451 - DNA, 25 bp, Mus musculus
tctcatgggctgtaagacaagaagg

SEQ ID NO: 784452 - DNA, 25 bp, Mus musculus
tctcatggtaccaagtcacagatcg

SEQ ID NO: 784453 - DNA, 25 bp, Mus musculus
tctcatggtacctagtcacagatcg

SEQ ID NO: 784454 - DNA, 25 bp, Mus musculus
tctcatggtccaacaaagagactgc

SEQ ID NO: 784455 - DNA, 25 bp, Mus musculus
tctcatggtccatcaaagagactgc

SEQ ID NO: 784456 - DNA, 25 bp, Mus musculus
tctcatggttctcaggtgtttgaca

SEQ ID NO: 784457 - DNA, 25 bp, Mus musculus
tctcatggttctgaggtgtttgaca

SEQ ID NO: 784458 - DNA, 25 bp, Mus musculus
tctcatggtttaagatccatctctg

SEQ ID NO: 784459 - DNA, 25 bp, Mus musculus
tctcatggtttatgatccatctctg

SEQ ID NO: 784460 - DNA, 25 bp, Mus musculus
tctcatgtaccgatcagaagaacaa

SEQ ID NO: 784461 - DNA, 25 bp, Mus musculus
tctcatgtaccgttcagaagaacaa

SEQ ID NO: 784462 - DNA, 25 bp, Mus musculus
tctcatgtggcaactctacccagag

SEQ ID NO: 784463 - DNA, 25 bp, Mus musculus
tctcatgtggcatctctacccagag

SEQ ID NO: 784464 - DNA, 25 bp, Mus musculus
tctcatgtgtccctagctggttttg

SEQ ID NO: 784465 - DNA, 25 bp, Mus musculus
tctcatgtgtccgtagctggttttg

SEQ ID NO: 784466 - DNA, 25 bp, Mus musculus
tctcattaaaggaggcgctgccaaa

SEQ ID NO: 784467 - DNA, 25 bp, Mus musculus
tctcattaaaggtggcgctgccaaa

SEQ ID NO: 784468 - DNA, 25 bp, Mus musculus
tctcattaacagcatgccaagccat

SEQ ID NO: 784469 - DNA, 25 bp, Mus musculus
tctcattaacaggatgccaagccat

SEQ ID NO: 784470 - DNA, 25 bp, Mus musculus
tctcattcagaacatttatcgagga

SEQ ID NO: 784471 - DNA, 25 bp, Mus musculus
tctcattcagaagatttatcgagga

SEQ ID NO: 784472 - DNA, 25 bp, Mus musculus
tctcattcagtgaaccgcatccagt

SEQ ID NO: 784473 - DNA, 25 bp, Mus musculus
tctcattcagtgtaccgcatccagt

SEQ ID NO: 784474 - DNA, 25 bp, Mus musculus
tctcattccaggactgttctcctgg

SEQ ID NO: 784475 - DNA, 25 bp, Mus musculus
tctcattccaggtctgttctcctgg

SEQ ID NO: 784476 - DNA, 25 bp, Mus musculus
tctcattcggatatggtgtcaccca

SEQ ID NO: 784477 - DNA, 25 bp, Mus musculus
tctcattcggatttggtgtcaccca

SEQ ID NO: 784478 - DNA, 25 bp, Mus musculus
tctcattgaaaaacgcctggaggct

SEQ ID NO: 784479 - DNA, 25 bp, Mus musculus
tctcattgaaaatcgcctggaggct

SEQ ID NO: 784480 - DNA, 25 bp, Mus musculus
tctcattgaattcgcagctgtcaac

SEQ ID NO: 784481 - DNA, 25 bp, Mus musculus
tctcattgaattggcagctgtcaac

SEQ ID NO: 784482 - DNA, 25 bp, Mus musculus
tctcattgaggtcgcacagaagctg

SEQ ID NO: 784483 - DNA, 25 bp, Mus musculus
tctcattgaggtggcacagaagctg

SEQ ID NO: 784484 - DNA, 25 bp, Mus musculus
tctcattgcactccagaggcgccga

SEQ ID NO: 784485 - DNA, 25 bp, Mus musculus
tctcattgcactgcagaggcgccga

SEQ ID NO: 784486 - DNA, 25 bp, Mus musculus
tctcattggagtctctgtggccttc

SEQ ID NO: 784487 - DNA, 25 bp, Mus musculus
tctcattggagtgtctgtggccttc

SEQ ID NO: 784488 - DNA, 25 bp, Mus musculus
tctcattggattccctccagaagac

SEQ ID NO: 784489 - DNA, 25 bp, Mus musculus
tctcattggattgcctccagaagac

SEQ ID NO: 784490 - DNA, 25 bp, Mus musculus
tctcattgggagatcttagctgtgc

SEQ ID NO: 784491 - DNA, 25 bp, Mus musculus
tctcattgggagttcttagctgtgc

SEQ ID NO: 784492 - DNA, 25 bp, Mus musculus
tctcattgtactctcacagcacctg

SEQ ID NO: 784493 - DNA, 25 bp, Mus musculus
tctcattgtactgtcacagcacctg

SEQ ID NO: 784494 - DNA, 25 bp, Mus musculus
tctcatttacaaagctgttgatgac

SEQ ID NO: 784495 - DNA, 25 bp, Mus musculus
tctcatttacaatgctgttgatgac

SEQ ID NO: 784496 - DNA, 25 bp, Mus musculus
tctcattttcaacggaaaggcacac

SEQ ID NO: 784497 - DNA, 25 bp, Mus musculus
tctcattttcaagggaaaggcacac

SEQ ID NO: 784498 - DNA, 25 bp, Mus musculus
tctccaaaaaaccaccatcaaagct

SEQ ID NO: 784499 - DNA, 25 bp, Mus musculus
tctccaaaaaacgaccatcaaagct

SEQ ID NO: 784500 - DNA, 25 bp, Mus musculus
tctccaaaagatatacagcttacag

SEQ ID NO: 784501 - DNA, 25 bp, Mus musculus
tctccaaaagatttacagcttacag

SEQ ID NO: 784502 - DNA, 25 bp, Mus musculus
tctccaaagttgcaacgtgggactt

SEQ ID NO: 784503 - DNA, 25 bp, Mus musculus
tctccaaagttggaacgtgggactt

SEQ ID NO: 784504 - DNA, 25 bp, Mus musculus
tctccaacaatgagccgggttccga

SEQ ID NO: 784505 - DNA, 25 bp, Mus musculus
tctccaacaatgtgccgggttccga

SEQ ID NO: 784506 - DNA, 25 bp, Mus musculus
tctccaacgacactggcatctacgt

SEQ ID NO: 784507 - DNA, 25 bp, Mus musculus
tctccaacgacagtggcatctacgt

SEQ ID NO: 784508 - DNA, 25 bp, Mus musculus
tctccaacggtgcaggtagcatgtc

SEQ ID NO: 784509 - DNA, 25 bp, Mus musculus
tctccaacggtggaggtagcatgtc

SEQ ID NO: 784510 - DNA, 25 bp, Mus musculus
tctccaactctcagtttaaggagtc

SEQ ID NO: 784511 - DNA, 25 bp, Mus musculus
tctccaactctctgtttaaggagtc

SEQ ID NO: 784512 - DNA, 25 bp, Mus musculus
tctccaagaagcagactcgctacct

SEQ ID NO: 784513 - DNA, 25 bp, Mus musculus
tctccaagaagctgactcgctacct

SEQ ID NO: 784514 - DNA, 25 bp, Mus musculus
tctccaagagatacagtggccgtcc

SEQ ID NO: 784515 - DNA, 25 bp, Mus musculus
tctccaagagattcagtggccgtcc

SEQ ID NO: 784516 - DNA, 25 bp, Mus musculus
tctccaagatccatgagaaggcctt

SEQ ID NO: 784517 - DNA, 25 bp, Mus musculus
tctccaagatccttgagaaggcctt

SEQ ID NO: 784518 - DNA, 25 bp, Mus musculus
tctccaagatctccagagacgtgca

SEQ ID NO: 784519 - DNA, 25 bp, Mus musculus
tctccaagatctgcagagacgtgca

SEQ ID NO: 784520 - DNA, 25 bp, Mus musculus
tctccaagatgcagtaccccaggca

SEQ ID NO: 784521 - DNA, 25 bp, Mus musculus
tctccaagatgctgtaccccaggca

SEQ ID NO: 784522 - DNA, 25 bp, Mus musculus
tctccaagatggaccttattgaaca

SEQ ID NO: 784523 - DNA, 25 bp, Mus musculus
tctccaagatggtccttattgaaca

SEQ ID NO: 784524 - DNA, 25 bp, Mus musculus
tctccaagcaggactgggtacagct

SEQ ID NO: 784525 - DNA, 25 bp, Mus musculus
tctccaagcaggtctgggtacagct

SEQ ID NO: 784526 - DNA, 25 bp, Mus musculus
tctccaagcctaccatcgggttgtc

SEQ ID NO: 784527 - DNA, 25 bp, Mus musculus
tctccaagcctagcatcgggttgtc

SEQ ID NO: 784528 - DNA, 25 bp, Mus musculus
tctccaagctgaatatccgggctgc

SEQ ID NO: 784529 - DNA, 25 bp, Mus musculus
tctccaagctgattatccgggctgc

SEQ ID NO: 784530 - DNA, 25 bp, Mus musculus
tctccaagctgcaggtccgagatgc

SEQ ID NO: 784531 - DNA, 25 bp, Mus musculus
tctccaagctgctggtccgagatgc

SEQ ID NO: 784532 - DNA, 25 bp, Mus musculus
tctccaagctgtccagattggctga

SEQ ID NO: 784533 - DNA, 25 bp, Mus musculus
tctccaagctgtgcagattggctga

SEQ ID NO: 784534 - DNA, 25 bp, Mus musculus
tctccaaggagaaattgaaactcac

SEQ ID NO: 784535 - DNA, 25 bp, Mus musculus
tctccaaggagatattgaaactcac

SEQ ID NO: 784536 - DNA, 25 bp, Mus musculus
tctccaaggctaaccagaaggccag

SEQ ID NO: 784537 - DNA, 25 bp, Mus musculus
tctccaaggctatccagaaggccag

SEQ ID NO: 784538 - DNA, 25 bp, Mus musculus
tctccaagggtgacatgaaaatcag

SEQ ID NO: 784539 - DNA, 25 bp, Mus musculus
tctccaagggtgtcatgaaaatcag

SEQ ID NO: 784540 - DNA, 25 bp, Mus musculus
tctccaagtccaataggcatgcctc

SEQ ID NO: 784541 - DNA, 25 bp, Mus musculus
tctccaagtccattaggcatgcctc

SEQ ID NO: 784542 - DNA, 25 bp, Mus musculus
tctccaagtcctcgcataactacat

SEQ ID NO: 784543 - DNA, 25 bp, Mus musculus
tctccaagtcctggcataactacat

SEQ ID NO: 784544 - DNA, 25 bp, Mus musculus
tctccaagtcgaccagaaagtcctt

SEQ ID NO: 784545 - DNA, 25 bp, Mus musculus
tctccaagtcgagcagaaagtcctt

SEQ ID NO: 784546 - DNA, 25 bp, Mus musculus
tctccaatcttgatcttcacggtga

SEQ ID NO: 784547 - DNA, 25 bp, Mus musculus
tctccaatcttgttcttcacggtga

SEQ ID NO: 784548 - DNA, 25 bp, Mus musculus
tctccaatgctgctgtcaacccttt

SEQ ID NO: 784549 - DNA, 25 bp, Mus musculus
tctccaatgctggtgtcaacccttt

SEQ ID NO: 784550 - DNA, 25 bp, Mus musculus
tctccaatggcaacaaaaagcacag

SEQ ID NO: 784551 - DNA, 25 bp, Mus musculus
tctccaatggcatcaaaaagcacag

SEQ ID NO: 784552 - DNA, 25 bp, Mus musculus
tctccaatgtgacctactatactcg

SEQ ID NO: 784553 - DNA, 25 bp, Mus musculus
tctccaatgtgagctactatactcg

SEQ ID NO: 784554 - DNA, 25 bp, Mus musculus
tctccaatttttcagaacttcagtg

SEQ ID NO: 784555 - DNA, 25 bp, Mus musculus
tctccaatttttgagaacttcagtg

SEQ ID NO: 784556 - DNA, 25 bp, Mus musculus
tctccacaaagtcatggttgtcaca

SEQ ID NO: 784557 - DNA, 25 bp, Mus musculus
tctccacaaagtgatggttgtcaca

SEQ ID NO: 784558 - DNA, 25 bp, Mus musculus
tctccacactacagggcagcatgac

SEQ ID NO: 784559 - DNA, 25 bp, Mus musculus
tctccacactactgggcagcatgac

SEQ ID NO: 784560 - DNA, 25 bp, Mus musculus
tctccacactggaagcggttctgat

SEQ ID NO: 784561 - DNA, 25 bp, Mus musculus
tctccacactggtagcggttctgat

SEQ ID NO: 784562 - DNA, 25 bp, Mus musculus
tctccacacttgattctcgatgcct

SEQ ID NO: 784563 - DNA, 25 bp, Mus musculus
tctccacacttgtttctcgatgcct

SEQ ID NO: 784564 - DNA, 25 bp, Mus musculus
tctccacagaaaacttcacccggat

SEQ ID NO: 784565 - DNA, 25 bp, Mus musculus
tctccacagaaatcttcacccggat

SEQ ID NO: 784566 - DNA, 25 bp, Mus musculus
tctccacagaacctgaagctctttg

SEQ ID NO: 784567 - DNA, 25 bp, Mus musculus
tctccacagaacgtgaagctctttg

SEQ ID NO: 784568 - DNA, 25 bp, Mus musculus
tctccacaggcaccgtgataaaggt

SEQ ID NO: 784569 - DNA, 25 bp, Mus musculus
tctccacaggcagcgtgataaaggt

SEQ ID NO: 784570 - DNA, 25 bp, Mus musculus
tctccacaggttacataagcgttcg

SEQ ID NO: 784571 - DNA, 25 bp, Mus musculus
tctccacaggtttcataagcgttcg

SEQ ID NO: 784572 - DNA, 25 bp, Mus musculus
tctccaccaagacctgaaaaatggc

SEQ ID NO: 784573 - DNA, 25 bp, Mus musculus
tctccaccaagagctgaaaaatggc

SEQ ID NO: 784574 - DNA, 25 bp, Mus musculus
tctccaccaatgatcagtgttgaca

SEQ ID NO: 784575 - DNA, 25 bp, Mus musculus
tctccaccaatgttcagtgttgaca

SEQ ID NO: 784576 - DNA, 25 bp, Mus musculus
tctccaccaggtatttgatttcacc

SEQ ID NO: 784577 - DNA, 25 bp, Mus musculus
tctccaccaggtttttgatttcacc

SEQ ID NO: 784578 - DNA, 25 bp, Mus musculus
tctccacctcctcactgttgatgga

SEQ ID NO: 784579 - DNA, 25 bp, Mus musculus
tctccacctcctgactgttgatgga

SEQ ID NO: 784580 - DNA, 25 bp, Mus musculus
tctccacggactataacggcaatcc

SEQ ID NO: 784581 - DNA, 25 bp, Mus musculus
tctccacggactttaacggcaatcc

SEQ ID NO: 784582 - DNA, 25 bp, Mus musculus
tctccacggcaacggaagaagatga

SEQ ID NO: 784583 - DNA, 25 bp, Mus musculus
tctccacggcaagggaagaagatga

SEQ ID NO: 784584 - DNA, 25 bp, Mus musculus
tctccacgtgggaagtcaggctcac

SEQ ID NO: 784585 - DNA, 25 bp, Mus musculus
tctccacgtgggtagtcaggctcac

SEQ ID NO: 784586 - DNA, 25 bp, Mus musculus
tctccactcaccacctggatgaggc

SEQ ID NO: 784587 - DNA, 25 bp, Mus musculus
tctccactcacctcctggatgaggc

SEQ ID NO: 784588 - DNA, 25 bp, Mus musculus
tctccactcggaatatcccacatgg

SEQ ID NO: 784589 - DNA, 25 bp, Mus musculus
tctccactcggattatcccacatgg

SEQ ID NO: 784590 - DNA, 25 bp, Mus musculus
tctccactggagctgttcaacagca

SEQ ID NO: 784591 - DNA, 25 bp, Mus musculus
tctccactggaggtgttcaacagca

SEQ ID NO: 784592 - DNA, 25 bp, Mus musculus
tctccactgggtcgctattctgtca

SEQ ID NO: 784593 - DNA, 25 bp, Mus musculus
tctccactgggtggctattctgtca

SEQ ID NO: 784594 - DNA, 25 bp, Mus musculus
tctccactgtcacggaactggatca

SEQ ID NO: 784595 - DNA, 25 bp, Mus musculus
tctccactgtcagggaactggatca

SEQ ID NO: 784596 - DNA, 25 bp, Mus musculus
tctccacttattcggcaaagagggc

SEQ ID NO: 784597 - DNA, 25 bp, Mus musculus
tctccacttattgggcaaagagggc

SEQ ID NO: 784598 - DNA, 25 bp, Mus musculus
tctccacttttgatctgaaccagtc

SEQ ID NO: 784599 - DNA, 25 bp, Mus musculus
tctccacttttgttctgaaccagtc

SEQ ID NO: 784600 - DNA, 25 bp, Mus musculus
tctccagaaacgatttcagcatctg

SEQ ID NO: 784601 - DNA, 25 bp, Mus musculus
tctccagaaacgttttcagcatctg

SEQ ID NO: 784602 - DNA, 25 bp, Mus musculus
tctccagaaagactttgcacagcac

SEQ ID NO: 784603 - DNA, 25 bp, Mus musculus
tctccagaaagagtttgcacagcac

SEQ ID NO: 784604 - DNA, 25 bp, Mus musculus
tctccagaaataaagcaggtgacag

SEQ ID NO: 784605 - DNA, 25 bp, Mus musculus
tctccagaaatatagcaggtgacag

SEQ ID NO: 784606 - DNA, 25 bp, Mus musculus
tctccagaacctcgaaatacaggaa

SEQ ID NO: 784607 - DNA, 25 bp, Mus musculus
tctccagaacctggaaatacaggaa

SEQ ID NO: 784608 - DNA, 25 bp, Mus musculus
tctccagaagaaatcatctccactg

SEQ ID NO: 784609 - DNA, 25 bp, Mus musculus
tctccagaagaattcatctccactg

SEQ ID NO: 784610 - DNA, 25 bp, Mus musculus
tctccagacaccatgctttttgact

SEQ ID NO: 784611 - DNA, 25 bp, Mus musculus
tctccagacaccttgctttttgact

SEQ ID NO: 784612 - DNA, 25 bp, Mus musculus
tctccagacagcagctgattcgaga

SEQ ID NO: 784613 - DNA, 25 bp, Mus musculus
tctccagacagctgctgattcgaga

SEQ ID NO: 784614 - DNA, 25 bp, Mus musculus
tctccagagaacctcagcaagaggg

SEQ ID NO: 784615 - DNA, 25 bp, Mus musculus
tctccagagaacgtcagcaagaggg

SEQ ID NO: 784616 - DNA, 25 bp, Mus musculus
tctccagagaggctgcaagcccgga

SEQ ID NO: 784617 - DNA, 25 bp, Mus musculus
tctccagagagggtgcaagcccgga

SEQ ID NO: 784618 - DNA, 25 bp, Mus musculus
tctccagagctgatgcactttctgt

SEQ ID NO: 784619 - DNA, 25 bp, Mus musculus
tctccagagctgttgcactttctgt

SEQ ID NO: 784620 - DNA, 25 bp, Mus musculus
tctccagagtgaaggagtattcaca

SEQ ID NO: 784621 - DNA, 25 bp, Mus musculus
tctccagagtgatggagtattcaca

SEQ ID NO: 784622 - DNA, 25 bp, Mus musculus
tctccagagtttcagtgaccaccat

SEQ ID NO: 784623 - DNA, 25 bp, Mus musculus
tctccagagtttgagtgaccaccat

SEQ ID NO: 784624 - DNA, 25 bp, Mus musculus
tctccagattttctctatgtccgtt

SEQ ID NO: 784625 - DNA, 25 bp, Mus musculus
tctccagattttgtctatgtccgtt

SEQ ID NO: 784626 - DNA, 25 bp, Mus musculus
tctccagcagcacataacaaatgtt

SEQ ID NO: 784627 - DNA, 25 bp, Mus musculus
tctccagcagcagataacaaatgtt

SEQ ID NO: 784628 - DNA, 25 bp, Mus musculus
tctccagcaggaacatggccgctgc

SEQ ID NO: 784629 - DNA, 25 bp, Mus musculus
tctccagcaggatcatggccgctgc

SEQ ID NO: 784630 - DNA, 25 bp, Mus musculus
tctccagccacaatgccaacgtgga

SEQ ID NO: 784631 - DNA, 25 bp, Mus musculus
tctccagccacattgccaacgtgga

SEQ ID NO: 784632 - DNA, 25 bp, Mus musculus
tctccagccagcaaccgaatttgtg

SEQ ID NO: 784633 - DNA, 25 bp, Mus musculus
tctccagccagctaccgaatttgtg

SEQ ID NO: 784634 - DNA, 25 bp, Mus musculus
tctccagccatgctgagcagtctga

SEQ ID NO: 784635 - DNA, 25 bp, Mus musculus
tctccagccatggtgagcagtctga

SEQ ID NO: 784636 - DNA, 25 bp, Mus musculus
tctccagcccggattacaaagactg

SEQ ID NO: 784637 - DNA, 25 bp, Mus musculus
tctccagcccggtttacaaagactg

SEQ ID NO: 784638 - DNA, 25 bp, Mus musculus
tctccagcctgacctgtgactactt

SEQ ID NO: 784639 - DNA, 25 bp, Mus musculus
tctccagcctgagctgtgactactt

SEQ ID NO: 784640 - DNA, 25 bp, Mus musculus
tctccagcgatgagtcattcgccat

SEQ ID NO: 784641 - DNA, 25 bp, Mus musculus
tctccagcgatgtgtcattcgccat

SEQ ID NO: 784642 - DNA, 25 bp, Mus musculus
tctccagcgggcaattgagctctgg

SEQ ID NO: 784643 - DNA, 25 bp, Mus musculus
tctccagcgggctattgagctctgg

SEQ ID NO: 784644 - DNA, 25 bp, Mus musculus
tctccagcgtttccaaaacgggctt

SEQ ID NO: 784645 - DNA, 25 bp, Mus musculus
tctccagcgtttgcaaaacgggctt

SEQ ID NO: 784646 - DNA, 25 bp, Mus musculus
tctccagctggaagtcttgctgacg

SEQ ID NO: 784647 - DNA, 25 bp, Mus musculus
tctccagctggatgtcttgctgacg

SEQ ID NO: 784648 - DNA, 25 bp, Mus musculus
tctccagctgggaaggaggttacaa

SEQ ID NO: 784649 - DNA, 25 bp, Mus musculus
tctccagctgggtaggaggttacaa

SEQ ID NO: 784650 - DNA, 25 bp, Mus musculus
tctccagctggtagtatacattgcg

SEQ ID NO: 784651 - DNA, 25 bp, Mus musculus
tctccagctggttgtatacattgcg

SEQ ID NO: 784652 - DNA, 25 bp, Mus musculus
tctccaggaagaacctccggtaaag

SEQ ID NO: 784653 - DNA, 25 bp, Mus musculus
tctccaggaagatcctccggtaaag

SEQ ID NO: 784654 - DNA, 25 bp, Mus musculus
tctccaggacatcgagaatgcgtac

SEQ ID NO: 784655 - DNA, 25 bp, Mus musculus
tctccaggacatggagaatgcgtac

SEQ ID NO: 784656 - DNA, 25 bp, Mus musculus
tctccaggactcacaatgtctgtga

SEQ ID NO: 784657 - DNA, 25 bp, Mus musculus
tctccaggactctcaatgtctgtga

SEQ ID NO: 784658 - DNA, 25 bp, Mus musculus
tctccaggagccagagtatgtgctc

SEQ ID NO: 784659 - DNA, 25 bp, Mus musculus
tctccaggagcctgagtatgtgctc

SEQ ID NO: 784660 - DNA, 25 bp, Mus musculus
tctccaggaggaatgggacagacct

SEQ ID NO: 784661 - DNA, 25 bp, Mus musculus
tctccaggaggattgggacagacct

SEQ ID NO: 784662 - DNA, 25 bp, Mus musculus
tctccaggagttccggcttgatagt

SEQ ID NO: 784663 - DNA, 25 bp, Mus musculus
tctccaggagttgcggcttgatagt

SEQ ID NO: 784664 - DNA, 25 bp, Mus musculus
tctccaggatcacagacccagaatt

SEQ ID NO: 784665 - DNA, 25 bp, Mus musculus
tctccaggatcagagacccagaatt

SEQ ID NO: 784666 - DNA, 25 bp, Mus musculus
tctccaggatgcctggtccatgggc

SEQ ID NO: 784667 - DNA, 25 bp, Mus musculus
tctccaggatgcgtggtccatgggc

SEQ ID NO: 784668 - DNA, 25 bp, Mus musculus
tctccaggcaagctgaagggtaccc

SEQ ID NO: 784669 - DNA, 25 bp, Mus musculus
tctccaggcaaggtgaagggtaccc

SEQ ID NO: 784670 - DNA, 25 bp, Mus musculus
tctccaggcctgaatggcttcccag

SEQ ID NO: 784671 - DNA, 25 bp, Mus musculus
tctccaggcctgtatggcttcccag

SEQ ID NO: 784672 - DNA, 25 bp, Mus musculus
tctccaggctgtcctgattggctga

SEQ ID NO: 784673 - DNA, 25 bp, Mus musculus
tctccaggctgtgctgattggctga

SEQ ID NO: 784674 - DNA, 25 bp, Mus musculus
tctccagggatcatgtaaataaact

SEQ ID NO: 784675 - DNA, 25 bp, Mus musculus
tctccagggatcttgtaaataaact

SEQ ID NO: 784676 - DNA, 25 bp, Mus musculus
tctccagtagaactgcagaaatgcc

SEQ ID NO: 784677 - DNA, 25 bp, Mus musculus
tctccagtagaagtgcagaaatgcc

SEQ ID NO: 784678 - DNA, 25 bp, Mus musculus
tctccagtagccactaaagcccagg

SEQ ID NO: 784679 - DNA, 25 bp, Mus musculus
tctccagtagcctctaaagcccagg

SEQ ID NO: 784680 - DNA, 25 bp, Mus musculus
tctccagtagttacaccccagcagt

SEQ ID NO: 784681 - DNA, 25 bp, Mus musculus
tctccagtagtttcaccccagcagt

SEQ ID NO: 784682 - DNA, 25 bp, Mus musculus
tctccagtcaccctcctgttgaggg

SEQ ID NO: 784683 - DNA, 25 bp, Mus musculus
tctccagtcaccgtcctgttgaggg

SEQ ID NO: 784684 - DNA, 25 bp, Mus musculus
tctccagtctaacgctgaatagaag

SEQ ID NO: 784685 - DNA, 25 bp, Mus musculus
tctccagtctaaggctgaatagaag

SEQ ID NO: 784686 - DNA, 25 bp, Mus musculus
tctccagtctcccagtggtgggtgt

SEQ ID NO: 784687 - DNA, 25 bp, Mus musculus
tctccagtctccgagtggtgggtgt

SEQ ID NO: 784688 - DNA, 25 bp, Mus musculus
tctccagtcttcagtgccatgtttg

SEQ ID NO: 784689 - DNA, 25 bp, Mus musculus
tctccagtcttctgtgccatgtttg

SEQ ID NO: 784690 - DNA, 25 bp, Mus musculus
tctccagtgcctacgtgggtctgtc

SEQ ID NO: 784691 - DNA, 25 bp, Mus musculus
tctccagtgcctcagtatgctccga

SEQ ID NO: 784692 - DNA, 25 bp, Mus musculus
tctccagtgcctgagtatgctccga

SEQ ID NO: 784693 - DNA, 25 bp, Mus musculus
tctccagtgccttcgtgggtctgtc

SEQ ID NO: 784694 - DNA, 25 bp, Mus musculus
tctccagtggccaaaagaatcaaga

SEQ ID NO: 784695 - DNA, 25 bp, Mus musculus
tctccagtggcctaaagaatcaaga

SEQ ID NO: 784696 - DNA, 25 bp, Mus musculus
tctccagtggtgagatgaagctaca

SEQ ID NO: 784697 - DNA, 25 bp, Mus musculus
tctccagtggtgtgatgaagctaca

SEQ ID NO: 784698 - DNA, 25 bp, Mus musculus
tctccagtgtgcagacactgaccaa

SEQ ID NO: 784699 - DNA, 25 bp, Mus musculus
tctccagtgtgctgacactgaccaa

SEQ ID NO: 784700 - DNA, 25 bp, Mus musculus
tctccagttacaaggtgttggcacc

SEQ ID NO: 784701 - DNA, 25 bp, Mus musculus
tctccagttacatggtgttggcacc

SEQ ID NO: 784702 - DNA, 25 bp, Mus musculus
tctccagttgacatccctggtgaag

SEQ ID NO: 784703 - DNA, 25 bp, Mus musculus
tctccagttgacttccctggtgaag

SEQ ID NO: 784704 - DNA, 25 bp, Mus musculus
tctccagttttaccgtcaaaacgtg

SEQ ID NO: 784705 - DNA, 25 bp, Mus musculus
tctccagttttagcgtcaaaacgtg

SEQ ID NO: 784706 - DNA, 25 bp, Mus musculus
tctccagtttttaccggccagctgg

SEQ ID NO: 784707 - DNA, 25 bp, Mus musculus
tctccagttttttccggccagctgg

SEQ ID NO: 784708 - DNA, 25 bp, Mus musculus
tctccataagttatctgggccggcg

SEQ ID NO: 784709 - DNA, 25 bp, Mus musculus
tctccataagttttctgggccggcg

SEQ ID NO: 784710 - DNA, 25 bp, Mus musculus
tctccataatcgcatggcggtggct

SEQ ID NO: 784711 - DNA, 25 bp, Mus musculus
tctccataatcggatggcggtggct

SEQ ID NO: 784712 - DNA, 25 bp, Mus musculus
tctccatagttgattctgggtgaaa

SEQ ID NO: 784713 - DNA, 25 bp, Mus musculus
tctccatagttgtttctgggtgaaa

SEQ ID NO: 784714 - DNA, 25 bp, Mus musculus
tctccatatcaaccgagagctcagg

SEQ ID NO: 784715 - DNA, 25 bp, Mus musculus
tctccatatcaagcgagagctcagg

SEQ ID NO: 784716 - DNA, 25 bp, Mus musculus
tctccatatggaacaacctactttc

SEQ ID NO: 784717 - DNA, 25 bp, Mus musculus
tctccatatggatcaacctactttc

SEQ ID NO: 784718 - DNA, 25 bp, Mus musculus
tctccatatttaacagcacgtggct

SEQ ID NO: 784719 - DNA, 25 bp, Mus musculus
tctccatatttatcagcacgtggct

SEQ ID NO: 784720 - DNA, 25 bp, Mus musculus
tctccatcactgctgtcgccaaata

SEQ ID NO: 784721 - DNA, 25 bp, Mus musculus
tctccatcactggtgtcgccaaata

SEQ ID NO: 784722 - DNA, 25 bp, Mus musculus
tctccatcagaacagagccctgagg

SEQ ID NO: 784723 - DNA, 25 bp, Mus musculus
tctccatcagaagagagccctgagg

SEQ ID NO: 784724 - DNA, 25 bp, Mus musculus
tctccatcatgcagcagtgtgacag

SEQ ID NO: 784725 - DNA, 25 bp, Mus musculus
tctccatcatgctgcagtgtgacag

SEQ ID NO: 784726 - DNA, 25 bp, Mus musculus
tctccatccacaacagagaagctgc

SEQ ID NO: 784727 - DNA, 25 bp, Mus musculus
tctccatccacatcagagaagctgc

SEQ ID NO: 784728 - DNA, 25 bp, Mus musculus
tctccatccacccatatgaacatgg

SEQ ID NO: 784729 - DNA, 25 bp, Mus musculus
tctccatccaccgatatgaacatgg

SEQ ID NO: 784730 - DNA, 25 bp, Mus musculus
tctccatccacgatttccagtcgga

SEQ ID NO: 784731 - DNA, 25 bp, Mus musculus
tctccatccacgttttccagtcgga

SEQ ID NO: 784732 - DNA, 25 bp, Mus musculus
tctccatccccacagggctagtggt

SEQ ID NO: 784733 - DNA, 25 bp, Mus musculus
tctccatccccagagggctagtggt

SEQ ID NO: 784734 - DNA, 25 bp, Mus musculus
tctccatcctgcatgctccaggtga

SEQ ID NO: 784735 - DNA, 25 bp, Mus musculus
tctccatcctgcttgctccaggtga

SEQ ID NO: 784736 - DNA, 25 bp, Mus musculus
tctccatcgggcaggtgtccttcgg

SEQ ID NO: 784737 - DNA, 25 bp, Mus musculus
tctccatcgggctggtgtccttcgg

SEQ ID NO: 784738 - DNA, 25 bp, Mus musculus
tctccatcgtgaaatatcagttccg

SEQ ID NO: 784739 - DNA, 25 bp, Mus musculus
tctccatcgtgatatatcagttccg

SEQ ID NO: 784740 - DNA, 25 bp, Mus musculus
tctccatctagtcggacgacagtga

SEQ ID NO: 784741 - DNA, 25 bp, Mus musculus
tctccatctagtgggacgacagtga

SEQ ID NO: 784742 - DNA, 25 bp, Mus musculus
tctccatgagcgcatcttgtttgct

SEQ ID NO: 784743 - DNA, 25 bp, Mus musculus
tctccatgagcggatcttgtttgct

SEQ ID NO: 784744 - DNA, 25 bp, Mus musculus
tctccatgcaatcgtgcgtgatgct

SEQ ID NO: 784745 - DNA, 25 bp, Mus musculus
tctccatgcaatggtgcgtgatgct

SEQ ID NO: 784746 - DNA, 25 bp, Mus musculus
tctccatgcaggcatcaagcagatc

SEQ ID NO: 784747 - DNA, 25 bp, Mus musculus
tctccatgcagggatcaagcagatc

SEQ ID NO: 784748 - DNA, 25 bp, Mus musculus
tctccatgcagtcccgggagctctt

SEQ ID NO: 784749 - DNA, 25 bp, Mus musculus
tctccatgcagtgccgggagctctt

SEQ ID NO: 784750 - DNA, 25 bp, Mus musculus
tctccatggcagacatgctgatctt

SEQ ID NO: 784751 - DNA, 25 bp, Mus musculus
tctccatggcagtcatgctgatctt

SEQ ID NO: 784752 - DNA, 25 bp, Mus musculus
tctccatggcatccagaaagtcctc

SEQ ID NO: 784753 - DNA, 25 bp, Mus musculus
tctccatggcatgcagaaagtcctc

SEQ ID NO: 784754 - DNA, 25 bp, Mus musculus
tctccatgggagaggcggtacccta

SEQ ID NO: 784755 - DNA, 25 bp, Mus musculus
tctccatgggagtggcggtacccta

SEQ ID NO: 784756 - DNA, 25 bp, Mus musculus
tctccatggtggctctacttcgaca

SEQ ID NO: 784757 - DNA, 25 bp, Mus musculus
tctccatggtgggtctacttcgaca

SEQ ID NO: 784758 - DNA, 25 bp, Mus musculus
tctccatggttactggcctggcctc

SEQ ID NO: 784759 - DNA, 25 bp, Mus musculus
tctccatggttagtggcctggcctc

SEQ ID NO: 784760 - DNA, 25 bp, Mus musculus
tctccatgtatgctgtgaaccaagc

SEQ ID NO: 784761 - DNA, 25 bp, Mus musculus
tctccatgtatggtgtgaaccaagc

SEQ ID NO: 784762 - DNA, 25 bp, Mus musculus
tctccatgtcagctgagggtcagga

SEQ ID NO: 784763 - DNA, 25 bp, Mus musculus
tctccatgtcaggtgagggtcagga

SEQ ID NO: 784764 - DNA, 25 bp, Mus musculus
tctccatgtccaacctaagggttca

SEQ ID NO: 784765 - DNA, 25 bp, Mus musculus
tctccatgtccatcctaagggttca

SEQ ID NO: 784766 - DNA, 25 bp, Mus musculus
tctccatgttcactatgctgtatct

SEQ ID NO: 784767 - DNA, 25 bp, Mus musculus
tctccatgttcagtatgctgtatct

SEQ ID NO: 784768 - DNA, 25 bp, Mus musculus
tctccattcaatctcgtggcctggc

SEQ ID NO: 784769 - DNA, 25 bp, Mus musculus
tctccattcaatgtcgtggcctggc

SEQ ID NO: 784770 - DNA, 25 bp, Mus musculus
tctccattcctgagaagaatcgacc

SEQ ID NO: 784771 - DNA, 25 bp, Mus musculus
tctccattcctgtgaagaatcgacc

SEQ ID NO: 784772 - DNA, 25 bp, Mus musculus
tctccattcgatcctttgatgacac

SEQ ID NO: 784773 - DNA, 25 bp, Mus musculus
tctccattcgatgctttgatgacac

SEQ ID NO: 784774 - DNA, 25 bp, Mus musculus
tctccattgagaagaacgggactct

SEQ ID NO: 784775 - DNA, 25 bp, Mus musculus
tctccattgagatgaacgggactct

SEQ ID NO: 784776 - DNA, 25 bp, Mus musculus
tctccattgatgatggctgcaatga

SEQ ID NO: 784777 - DNA, 25 bp, Mus musculus
tctccattgatgttggctgcaatga

SEQ ID NO: 784778 - DNA, 25 bp, Mus musculus
tctccattgccccagtgtatcagca

SEQ ID NO: 784779 - DNA, 25 bp, Mus musculus
tctccattgcccgagtgtatcagca

SEQ ID NO: 784780 - DNA, 25 bp, Mus musculus
tctccattgctgactatcctctcta

SEQ ID NO: 784781 - DNA, 25 bp, Mus musculus
tctccattgctgtctatcctctcta

SEQ ID NO: 784782 - DNA, 25 bp, Mus musculus
tctccattggccctgacttccagaa

SEQ ID NO: 784783 - DNA, 25 bp, Mus musculus
tctccattggccgtgacttccagaa

SEQ ID NO: 784784 - DNA, 25 bp, Mus musculus
tctcccaagaaaacctccgcagatg

SEQ ID NO: 784785 - DNA, 25 bp, Mus musculus
tctcccaagaaatcctccgcagatg

SEQ ID NO: 784786 - DNA, 25 bp, Mus musculus
tctcccaagacaaacctgtgggctc

SEQ ID NO: 784787 - DNA, 25 bp, Mus musculus
tctcccaagacatacctgtgggctc

SEQ ID NO: 784788 - DNA, 25 bp, Mus musculus
tctcccaatgataagatgcttcttc

SEQ ID NO: 784789 - DNA, 25 bp, Mus musculus
tctcccaatgattagatgcttcttc

SEQ ID NO: 784790 - DNA, 25 bp, Mus musculus
tctcccaatttcagagaccgaagcc

SEQ ID NO: 784791 - DNA, 25 bp, Mus musculus
tctcccaatttctgagaccgaagcc

SEQ ID NO: 784792 - DNA, 25 bp, Mus musculus
tctcccactctcctggtaaatgatc

SEQ ID NO: 784793 - DNA, 25 bp, Mus musculus
tctcccactctcgtggtaaatgatc

SEQ ID NO: 784794 - DNA, 25 bp, Mus musculus
tctcccactcttacttcaaatacgg

SEQ ID NO: 784795 - DNA, 25 bp, Mus musculus
tctcccactctttcttcaaatacgg

SEQ ID NO: 784796 - DNA, 25 bp, Mus musculus
tctcccagatggacatcagcttcta

SEQ ID NO: 784797 - DNA, 25 bp, Mus musculus
tctcccagatggacggactctgttt

SEQ ID NO: 784798 - DNA, 25 bp, Mus musculus
tctcccagatggtcatcagcttcta

SEQ ID NO: 784799 - DNA, 25 bp, Mus musculus
tctcccagatggtcggactctgttt

SEQ ID NO: 784800 - DNA, 25 bp, Mus musculus
tctcccagctggacgaatttctcgc

SEQ ID NO: 784801 - DNA, 25 bp, Mus musculus
tctcccagctggtcgaatttctcgc

SEQ ID NO: 784802 - DNA, 25 bp, Mus musculus
tctcccaggaagagaaacttacagg

SEQ ID NO: 784803 - DNA, 25 bp, Mus musculus
tctcccaggaagtgaaacttacagg

SEQ ID NO: 784804 - DNA, 25 bp, Mus musculus
tctcccagtttgcagaggcccgggc

SEQ ID NO: 784805 - DNA, 25 bp, Mus musculus
tctcccagtttggagaggcccgggc

SEQ ID NO: 784806 - DNA, 25 bp, Mus musculus
tctcccatgcataggttcacttcct

SEQ ID NO: 784807 - DNA, 25 bp, Mus musculus
tctcccatgcattggttcacttcct

SEQ ID NO: 784808 - DNA, 25 bp, Mus musculus
tctcccatggatacagtgacagagg

SEQ ID NO: 784809 - DNA, 25 bp, Mus musculus
tctcccatggattcagtgacagagg

SEQ ID NO: 784810 - DNA, 25 bp, Mus musculus
tctcccattgacctgtgggccgtgg

SEQ ID NO: 784811 - DNA, 25 bp, Mus musculus
tctcccattgacgtgtgggccgtgg

SEQ ID NO: 784812 - DNA, 25 bp, Mus musculus
tctccccaaataatctcagacgtag

SEQ ID NO: 784813 - DNA, 25 bp, Mus musculus
tctccccaaatattctcagacgtag

SEQ ID NO: 784814 - DNA, 25 bp, Mus musculus
tctccccaaccgaggctccaacttt

SEQ ID NO: 784815 - DNA, 25 bp, Mus musculus
tctccccaaccgtggctccaacttt

SEQ ID NO: 784816 - DNA, 25 bp, Mus musculus
tctccccaactgattgattatcgtt

SEQ ID NO: 784817 - DNA, 25 bp, Mus musculus
tctccccaactgtttgattatcgtt

SEQ ID NO: 784818 - DNA, 25 bp, Mus musculus
tctccccaagacacagtgagtcctg

SEQ ID NO: 784819 - DNA, 25 bp, Mus musculus
tctccccaagactcagtgagtcctg

SEQ ID NO: 784820 - DNA, 25 bp, Mus musculus
tctccccactggaggcagatgacct

SEQ ID NO: 784821 - DNA, 25 bp, Mus musculus
tctccccactggtggcagatgacct

SEQ ID NO: 784822 - DNA, 25 bp, Mus musculus
tctccccactgtcctggtcggtgtg

SEQ ID NO: 784823 - DNA, 25 bp, Mus musculus
tctccccactgtgctggtcggtgtg

SEQ ID NO: 784824 - DNA, 25 bp, Mus musculus
tctccccagagtcggtattgaaagt

SEQ ID NO: 784825 - DNA, 25 bp, Mus musculus
tctccccagagtgggtattgaaagt

SEQ ID NO: 784826 - DNA, 25 bp, Mus musculus
tctccccaggctaggctcactgtga

SEQ ID NO: 784827 - DNA, 25 bp, Mus musculus
tctccccaggcttggctcactgtga

SEQ ID NO: 784828 - DNA, 25 bp, Mus musculus
tctccccatggtaggagcagccaaa

SEQ ID NO: 784829 - DNA, 25 bp, Mus musculus
tctccccatggttggagcagccaaa

SEQ ID NO: 784830 - DNA, 25 bp, Mus musculus
tctcccctgactctagcatgctgtg

SEQ ID NO: 784831 - DNA, 25 bp, Mus musculus
tctcccctgactgtagcatgctgtg

SEQ ID NO: 784832 - DNA, 25 bp, Mus musculus
tctcccctgggaacgcagatacctt

SEQ ID NO: 784833 - DNA, 25 bp, Mus musculus
tctcccctgggatcgcagatacctt

SEQ ID NO: 784834 - DNA, 25 bp, Mus musculus
tctccccttgaacggataaagacaa

SEQ ID NO: 784835 - DNA, 25 bp, Mus musculus
tctccccttgaagggataaagacaa

SEQ ID NO: 784836 - DNA, 25 bp, Mus musculus
tctcccgaggctagctgtgaactga

SEQ ID NO: 784837 - DNA, 25 bp, Mus musculus
tctcccgaggcttgctgtgaactga

SEQ ID NO: 784838 - DNA, 25 bp, Mus musculus
tctcccgagggcacacgtgttgggc

SEQ ID NO: 784839 - DNA, 25 bp, Mus musculus
tctcccgagggctcacgtgttgggc

SEQ ID NO: 784840 - DNA, 25 bp, Mus musculus
tctcccgcagacaacaattacgatg

SEQ ID NO: 784841 - DNA, 25 bp, Mus musculus
tctcccgcagactacaattacgatg

SEQ ID NO: 784842 - DNA, 25 bp, Mus musculus
tctcccggacggctggcaagagtca

SEQ ID NO: 784843 - DNA, 25 bp, Mus musculus
tctcccggacgggtggcaagagtca

SEQ ID NO: 784844 - DNA, 25 bp, Mus musculus
tctcccggcgggactctgtgcagtt

SEQ ID NO: 784845 - DNA, 25 bp, Mus musculus
tctcccggcgggtctctgtgcagtt

SEQ ID NO: 784846 - DNA, 25 bp, Mus musculus
tctcccgggagaccactactctgag

SEQ ID NO: 784847 - DNA, 25 bp, Mus musculus
tctcccgggagagcactactctgag

SEQ ID NO: 784848 - DNA, 25 bp, Mus musculus
tctcccgggagtacaatgaactgct

SEQ ID NO: 784849 - DNA, 25 bp, Mus musculus
tctcccgggagttcaatgaactgct

SEQ ID NO: 784850 - DNA, 25 bp, Mus musculus
tctcccggtgcgagctccgagttgg

SEQ ID NO: 784851 - DNA, 25 bp, Mus musculus
tctcccggtgcgtgctccgagttgg

SEQ ID NO: 784852 - DNA, 25 bp, Mus musculus
tctcccgtcctgaggagggtgacgc

SEQ ID NO: 784853 - DNA, 25 bp, Mus musculus
tctcccgtcctgtggagggtgacgc

SEQ ID NO: 784854 - DNA, 25 bp, Mus musculus
tctcccgtgtgccaagatgtgatgc

SEQ ID NO: 784855 - DNA, 25 bp, Mus musculus
tctcccgtgtgcgaagatgtgatgc

SEQ ID NO: 784856 - DNA, 25 bp, Mus musculus
tctccctaccacagtgaacgtgtgc

SEQ ID NO: 784857 - DNA, 25 bp, Mus musculus
tctccctaccactgtgaacgtgtgc

SEQ ID NO: 784858 - DNA, 25 bp, Mus musculus
tctccctcagagagcgatgctgaag

SEQ ID NO: 784859 - DNA, 25 bp, Mus musculus
tctccctcagagtgcgatgctgaag

SEQ ID NO: 784860 - DNA, 25 bp, Mus musculus
tctccctccagcagattgacgcggg

SEQ ID NO: 784861 - DNA, 25 bp, Mus musculus
tctccctccagctgattgacgcggg

SEQ ID NO: 784862 - DNA, 25 bp, Mus musculus
tctccctctcagattggtacagcct

SEQ ID NO: 784863 - DNA, 25 bp, Mus musculus
tctccctctcagtttggtacagcct

SEQ ID NO: 784864 - DNA, 25 bp, Mus musculus
tctccctctggaaagtcactggcat

SEQ ID NO: 784865 - DNA, 25 bp, Mus musculus
tctccctctggatagtcactggcat

SEQ ID NO: 784866 - DNA, 25 bp, Mus musculus
tctccctgcaggagaaccagaacag

SEQ ID NO: 784867 - DNA, 25 bp, Mus musculus
tctccctgcaggtgaaccagaacag

SEQ ID NO: 784868 - DNA, 25 bp, Mus musculus
tctccctgccatacggattaaaagg

SEQ ID NO: 784869 - DNA, 25 bp, Mus musculus
tctccctgccattcggattaaaagg

SEQ ID NO: 784870 - DNA, 25 bp, Mus musculus
tctccctgctccattggctatgggc

SEQ ID NO: 784871 - DNA, 25 bp, Mus musculus
tctccctgctcctttggctatgggc

SEQ ID NO: 784872 - DNA, 25 bp, Mus musculus
tctccctgggatcctttgcgctggc

SEQ ID NO: 784873 - DNA, 25 bp, Mus musculus
tctccctgggatgctttgcgctggc

SEQ ID NO: 784874 - DNA, 25 bp, Mus musculus
tctccctggtttaggacaaagacgt

SEQ ID NO: 784875 - DNA, 25 bp, Mus musculus
tctccctggtttcaacagagttcag

SEQ ID NO: 784876 - DNA, 25 bp, Mus musculus
tctccctggtttgaacagagttcag

SEQ ID NO: 784877 - DNA, 25 bp, Mus musculus
tctccctggttttggacaaagacgt

SEQ ID NO: 784878 - DNA, 25 bp, Mus musculus
tctccctgttggatcccgaggtgcc

SEQ ID NO: 784879 - DNA, 25 bp, Mus musculus
tctccctgttggttcccgaggtgcc

SEQ ID NO: 784880 - DNA, 25 bp, Mus musculus
tctcccttaataattatcaagtgcc

SEQ ID NO: 784881 - DNA, 25 bp, Mus musculus
tctcccttaatatttatcaagtgcc

SEQ ID NO: 784882 - DNA, 25 bp, Mus musculus
tctcccttatccaagtagacaacac

SEQ ID NO: 784883 - DNA, 25 bp, Mus musculus
tctcccttatcctagtagacaacac

SEQ ID NO: 784884 - DNA, 25 bp, Mus musculus
tctcccttcggactttgatgtgatc

SEQ ID NO: 784885 - DNA, 25 bp, Mus musculus
tctcccttcggagtttgatgtgatc

SEQ ID NO: 784886 - DNA, 25 bp, Mus musculus
tctcccttgacccaggtacagtcat

SEQ ID NO: 784887 - DNA, 25 bp, Mus musculus
tctcccttgaccgaggtacagtcat

SEQ ID NO: 784888 - DNA, 25 bp, Mus musculus
tctcccttgagaacactaatagtag

SEQ ID NO: 784889 - DNA, 25 bp, Mus musculus
tctcccttgagatcactaatagtag

SEQ ID NO: 784890 - DNA, 25 bp, Mus musculus
tctcccttggagctggaacagtttc

SEQ ID NO: 784891 - DNA, 25 bp, Mus musculus
tctcccttggaggtggaacagtttc

SEQ ID NO: 784892 - DNA, 25 bp, Mus musculus
tctccgaagagtacacgggctccag

SEQ ID NO: 784893 - DNA, 25 bp, Mus musculus
tctccgaagagttcacgggctccag

SEQ ID NO: 784894 - DNA, 25 bp, Mus musculus
tctccgaaggacatcgcaaaggcct

SEQ ID NO: 784895 - DNA, 25 bp, Mus musculus
tctccgaaggacttcgcaaaggcct

SEQ ID NO: 784896 - DNA, 25 bp, Mus musculus
tctccgaatatgagctccctgagga

SEQ ID NO: 784897 - DNA, 25 bp, Mus musculus
tctccgaatatgtgctccctgagga

SEQ ID NO: 784898 - DNA, 25 bp, Mus musculus
tctccgacatatacgatggaacagt

SEQ ID NO: 784899 - DNA, 25 bp, Mus musculus
tctccgacatattcgatggaacagt

SEQ ID NO: 784900 - DNA, 25 bp, Mus musculus
tctccgacgcataccacaaagcatt

SEQ ID NO: 784901 - DNA, 25 bp, Mus musculus
tctccgacgcattccacaaagcatt

SEQ ID NO: 784902 - DNA, 25 bp, Mus musculus
tctccgagaacacagtagaacgcgt

SEQ ID NO: 784903 - DNA, 25 bp, Mus musculus
tctccgagaacagagtagaacgcgt

SEQ ID NO: 784904 - DNA, 25 bp, Mus musculus
tctccgagagaacagttcaagatca

SEQ ID NO: 784905 - DNA, 25 bp, Mus musculus
tctccgagagaagagttcaagatca

SEQ ID NO: 784906 - DNA, 25 bp, Mus musculus
tctccgagaggacaacgcctactgt

SEQ ID NO: 784907 - DNA, 25 bp, Mus musculus
tctccgagaggagaacgcctactgt

SEQ ID NO: 784908 - DNA, 25 bp, Mus musculus
tctccgagattcaggaccgtgttgg

SEQ ID NO: 784909 - DNA, 25 bp, Mus musculus
tctccgagattctggaccgtgttgg

SEQ ID NO: 784910 - DNA, 25 bp, Mus musculus
tctccgagcagaatgagaaggccct

SEQ ID NO: 784911 - DNA, 25 bp, Mus musculus
tctccgagcagattgagaaggccct

SEQ ID NO: 784912 - DNA, 25 bp, Mus musculus
tctccgagcccacaatacagctgga

SEQ ID NO: 784913 - DNA, 25 bp, Mus musculus
tctccgagcccagaatacagctgga

SEQ ID NO: 784914 - DNA, 25 bp, Mus musculus
tctccgagcgccacagtgggtccgg

SEQ ID NO: 784915 - DNA, 25 bp, Mus musculus
tctccgagcgcctcagtgggtccgg

SEQ ID NO: 784916 - DNA, 25 bp, Mus musculus
tctccgaggccaatgctgagaggat

SEQ ID NO: 784917 - DNA, 25 bp, Mus musculus
tctccgaggccattgctgagaggat

SEQ ID NO: 784918 - DNA, 25 bp, Mus musculus
tctccgaggccgaggccattgggcc

SEQ ID NO: 784919 - DNA, 25 bp, Mus musculus
tctccgaggccgtggccattgggcc

SEQ ID NO: 784920 - DNA, 25 bp, Mus musculus
tctccgagggacacacggtatacct

SEQ ID NO: 784921 - DNA, 25 bp, Mus musculus
tctccgagggactcacggtatacct

SEQ ID NO: 784922 - DNA, 25 bp, Mus musculus
tctccgattaaaaacgaaagccaac

SEQ ID NO: 784923 - DNA, 25 bp, Mus musculus
tctccgattaaatacgaaagccaac

SEQ ID NO: 784924 - DNA, 25 bp, Mus musculus
tctccgcaagaaacccagataattc

SEQ ID NO: 784925 - DNA, 25 bp, Mus musculus
tctccgcaagaatcccagataattc

SEQ ID NO: 784926 - DNA, 25 bp, Mus musculus
tctccgcaccacagaaaagatgaaa

SEQ ID NO: 784927 - DNA, 25 bp, Mus musculus
tctccgcaccactgaaaagatgaaa

SEQ ID NO: 784928 - DNA, 25 bp, Mus musculus
tctccgcagggaagtctatatccgg

SEQ ID NO: 784929 - DNA, 25 bp, Mus musculus
tctccgcagggatgtctatatccgg

SEQ ID NO: 784930 - DNA, 25 bp, Mus musculus
tctccgccagagcagagtttatctt

SEQ ID NO: 784931 - DNA, 25 bp, Mus musculus
tctccgccagaggagagtttatctt

SEQ ID NO: 784932 - DNA, 25 bp, Mus musculus
tctccgccatcaatgttcaagactg

SEQ ID NO: 784933 - DNA, 25 bp, Mus musculus
tctccgccatcattgttcaagactg

SEQ ID NO: 784934 - DNA, 25 bp, Mus musculus
tctccgcgccgccttctgagggaag

SEQ ID NO: 784935 - DNA, 25 bp, Mus musculus
tctccgcgccgcgttctgagggaag

SEQ ID NO: 784936 - DNA, 25 bp, Mus musculus
tctccgcggagactctctctgaggc

SEQ ID NO: 784937 - DNA, 25 bp, Mus musculus
tctccgcggagagtctctctgaggc

SEQ ID NO: 784938 - DNA, 25 bp, Mus musculus
tctccgcggccccagtgctggtaga

SEQ ID NO: 784939 - DNA, 25 bp, Mus musculus
tctccgcggcccgagtgctggtaga

SEQ ID NO: 784940 - DNA, 25 bp, Mus musculus
tctccgcgtgcaccgctgtaaagga

SEQ ID NO: 784941 - DNA, 25 bp, Mus musculus
tctccgcgtgcagcgctgtaaagga

SEQ ID NO: 784942 - DNA, 25 bp, Mus musculus
tctccgctggcaaaaacgggtggaa

SEQ ID NO: 784943 - DNA, 25 bp, Mus musculus
tctccgctggcataaacgggtggaa

SEQ ID NO: 784944 - DNA, 25 bp, Mus musculus
tctccgctgtctaacggactcgatg

SEQ ID NO: 784945 - DNA, 25 bp, Mus musculus
tctccgctgtcttacggactcgatg

SEQ ID NO: 784946 - DNA, 25 bp, Mus musculus
tctccgcttagacaaggtgtagccg

SEQ ID NO: 784947 - DNA, 25 bp, Mus musculus
tctccgcttagagaaggtgtagccg

SEQ ID NO: 784948 - DNA, 25 bp, Mus musculus
tctccgctttttaacaaatgtacag

SEQ ID NO: 784949 - DNA, 25 bp, Mus musculus
tctccgcttttttacaaatgtacag

SEQ ID NO: 784950 - DNA, 25 bp, Mus musculus
tctccggaagcacatagagctcagg

SEQ ID NO: 784951 - DNA, 25 bp, Mus musculus
tctccggaagcagatagagctcagg

SEQ ID NO: 784952 - DNA, 25 bp, Mus musculus
tctccggacactattttcctgaggg

SEQ ID NO: 784953 - DNA, 25 bp, Mus musculus
tctccggacacttttttcctgaggg

SEQ ID NO: 784954 - DNA, 25 bp, Mus musculus
tctccggagggaccgagtggtcagt

SEQ ID NO: 784955 - DNA, 25 bp, Mus musculus
tctccggagggagcgagtggtcagt

SEQ ID NO: 784956 - DNA, 25 bp, Mus musculus
tctccggcatgaccatgtgctatgc

SEQ ID NO: 784957 - DNA, 25 bp, Mus musculus
tctccggcatgagcatgtgctatgc

SEQ ID NO: 784958 - DNA, 25 bp, Mus musculus
tctccggcatggatcagtgcgtgac

SEQ ID NO: 784959 - DNA, 25 bp, Mus musculus
tctccggcatggttcagtgcgtgac

SEQ ID NO: 784960 - DNA, 25 bp, Mus musculus
tctccggccaaacaagcagactttc

SEQ ID NO: 784961 - DNA, 25 bp, Mus musculus
tctccggccaaagaagcagactttc

SEQ ID NO: 784962 - DNA, 25 bp, Mus musculus
tctccggctgctagaagctgtcctt

SEQ ID NO: 784963 - DNA, 25 bp, Mus musculus
tctccggctgcttgaagctgtcctt

SEQ ID NO: 784964 - DNA, 25 bp, Mus musculus
tctccgggactacctgcaaaactta

SEQ ID NO: 784965 - DNA, 25 bp, Mus musculus
tctccgggactagctgcaaaactta

SEQ ID NO: 784966 - DNA, 25 bp, Mus musculus
tctccgggattgatgttagtacaca

SEQ ID NO: 784967 - DNA, 25 bp, Mus musculus
tctccgggattgttgttagtacaca

SEQ ID NO: 784968 - DNA, 25 bp, Mus musculus
tctccgggcatgagtgatccgatct

SEQ ID NO: 784969 - DNA, 25 bp, Mus musculus
tctccgggcatgtgtgatccgatct

SEQ ID NO: 784970 - DNA, 25 bp, Mus musculus
tctccggtaaaaccacagattccct

SEQ ID NO: 784971 - DNA, 25 bp, Mus musculus
tctccggtaaaagcacagattccct

SEQ ID NO: 784972 - DNA, 25 bp, Mus musculus
tctccggtcaagcatactgcttttc

SEQ ID NO: 784973 - DNA, 25 bp, Mus musculus
tctccggtcaaggatactgcttttc

SEQ ID NO: 784974 - DNA, 25 bp, Mus musculus
tctccggtgcagcaaagatgttcac

SEQ ID NO: 784975 - DNA, 25 bp, Mus musculus
tctccggtgcaggaaagatgttcac

SEQ ID NO: 784976 - DNA, 25 bp, Mus musculus
tctccggttaaacgcgcaaagctca

SEQ ID NO: 784977 - DNA, 25 bp, Mus musculus
tctccggttaaaggcgcaaagctca

SEQ ID NO: 784978 - DNA, 25 bp, Mus musculus
tctccggttccgacagatttgataa

SEQ ID NO: 784979 - DNA, 25 bp, Mus musculus
tctccggttccgtcagatttgataa

SEQ ID NO: 784980 - DNA, 25 bp, Mus musculus
tctccggttgcaccctgacagatgg

SEQ ID NO: 784981 - DNA, 25 bp, Mus musculus
tctccggttgcagcctgacagatgg

SEQ ID NO: 784982 - DNA, 25 bp, Mus musculus
tctccgtagatgaagctctccagca

SEQ ID NO: 784983 - DNA, 25 bp, Mus musculus
tctccgtagatgtagctctccagca

SEQ ID NO: 784984 - DNA, 25 bp, Mus musculus
tctccgtcacggaggccggatgcag

SEQ ID NO: 784985 - DNA, 25 bp, Mus musculus
tctccgtcacggtggccggatgcag

SEQ ID NO: 784986 - DNA, 25 bp, Mus musculus
tctccgtcctggaggtcttcctctt

SEQ ID NO: 784987 - DNA, 25 bp, Mus musculus
tctccgtcctggtggtcttcctctt

SEQ ID NO: 784988 - DNA, 25 bp, Mus musculus
tctccgtgcatgaccagggtcaaga

SEQ ID NO: 784989 - DNA, 25 bp, Mus musculus
tctccgtgcatgtccagggtcaaga

SEQ ID NO: 784990 - DNA, 25 bp, Mus musculus
tctccgtgcccacaagacatgtcag

SEQ ID NO: 784991 - DNA, 25 bp, Mus musculus
tctccgtgcccagaagacatgtcag

SEQ ID NO: 784992 - DNA, 25 bp, Mus musculus
tctccgtggactctgtgaaaatgcc

SEQ ID NO: 784993 - DNA, 25 bp, Mus musculus
tctccgtggactgtgtgaaaatgcc

SEQ ID NO: 784994 - DNA, 25 bp, Mus musculus
tctccgtgggcgagaagtgtgtcct

SEQ ID NO: 784995 - DNA, 25 bp, Mus musculus
tctccgtgggcgtgaagtgtgtcct

SEQ ID NO: 784996 - DNA, 25 bp, Mus musculus
tctccgttatgactgtgaacaatga

SEQ ID NO: 784997 - DNA, 25 bp, Mus musculus
tctccgttatgagtgtgaacaatga

SEQ ID NO: 784998 - DNA, 25 bp, Mus musculus
tctccgttcacaagaccctgggctt

SEQ ID NO: 784999 - DNA, 25 bp, Mus musculus
tctccgttcacatgaccctgggctt

SEQ ID NO: 785000 - DNA, 25 bp, Mus musculus
tctcctaaggagaacactgacctag

SEQ ID NO: 785001 - DNA, 25 bp, Mus musculus
tctcctaaggagtacactgacctag

SEQ ID NO: 785002 - DNA, 25 bp, Mus musculus
tctcctacaagcacaacggaaagag

SEQ ID NO: 785003 - DNA, 25 bp, Mus musculus
tctcctacaagctcaacggaaagag

SEQ ID NO: 785004 - DNA, 25 bp, Mus musculus
tctcctaccttgataaggcagatgc

SEQ ID NO: 785005 - DNA, 25 bp, Mus musculus
tctcctaccttgttaaggcagatgc

SEQ ID NO: 785006 - DNA, 25 bp, Mus musculus
tctcctacgccgagggtttgggcaa

SEQ ID NO: 785007 - DNA, 25 bp, Mus musculus
tctcctacgccgtgggtttgggcaa

SEQ ID NO: 785008 - DNA, 25 bp, Mus musculus
tctcctactcccagttgctgaggac

SEQ ID NO: 785009 - DNA, 25 bp, Mus musculus
tctcctactccctgttgctgaggac

SEQ ID NO: 785010 - DNA, 25 bp, Mus musculus
tctcctagacaacgccatgaactgg

SEQ ID NO: 785011 - DNA, 25 bp, Mus musculus
tctcctagacaaggccatgaactgg

SEQ ID NO: 785012 - DNA, 25 bp, Mus musculus
tctcctagagacagtgttcttccac

SEQ ID NO: 785013 - DNA, 25 bp, Mus musculus
tctcctagagactgtgttcttccac

SEQ ID NO: 785014 - DNA, 25 bp, Mus musculus
tctcctagatcaaccctgaggaaac

SEQ ID NO: 785015 - DNA, 25 bp, Mus musculus
tctcctagatcatccctgaggaaac

SEQ ID NO: 785016 - DNA, 25 bp, Mus musculus
tctcctaggagaaggaagctttgca

SEQ ID NO: 785017 - DNA, 25 bp, Mus musculus
tctcctaggagatggaagctttgca

SEQ ID NO: 785018 - DNA, 25 bp, Mus musculus
tctcctaggctccatgtttcccatg

SEQ ID NO: 785019 - DNA, 25 bp, Mus musculus
tctcctaggctcgatgtttcccatg

SEQ ID NO: 785020 - DNA, 25 bp, Mus musculus
tctcctagggaaacattttactccg

SEQ ID NO: 785021 - DNA, 25 bp, Mus musculus
tctcctagggaatcattttactccg

SEQ ID NO: 785022 - DNA, 25 bp, Mus musculus
tctcctagtgaaaagaggcagcttg

SEQ ID NO: 785023 - DNA, 25 bp, Mus musculus
tctcctagtgaatagaggcagcttg

SEQ ID NO: 785024 - DNA, 25 bp, Mus musculus
tctcctagtggtaagtgtgtcctct

SEQ ID NO: 785025 - DNA, 25 bp, Mus musculus
tctcctagtggttagtgtgtcctct

SEQ ID NO: 785026 - DNA, 25 bp, Mus musculus
tctcctagttttagagacagattct

SEQ ID NO: 785027 - DNA, 25 bp, Mus musculus
tctcctagtttttgagacagattct

SEQ ID NO: 785028 - DNA, 25 bp, Mus musculus
tctcctataaagaacatctgcctgt

SEQ ID NO: 785029 - DNA, 25 bp, Mus musculus
tctcctataaagtacatctgcctgt

SEQ ID NO: 785030 - DNA, 25 bp, Mus musculus
tctcctataggtcgcaaatgcaaat

SEQ ID NO: 785031 - DNA, 25 bp, Mus musculus
tctcctataggtggcaaatgcaaat

SEQ ID NO: 785032 - DNA, 25 bp, Mus musculus
tctcctatagtgacatcccagctgg

SEQ ID NO: 785033 - DNA, 25 bp, Mus musculus
tctcctatagtgtcatcccagctgg

SEQ ID NO: 785034 - DNA, 25 bp, Mus musculus
tctcctatgccgctgagcaggcttc

SEQ ID NO: 785035 - DNA, 25 bp, Mus musculus
tctcctatgccggtgagcaggcttc

SEQ ID NO: 785036 - DNA, 25 bp, Mus musculus
tctcctatgcgtcaagtggagcccc

SEQ ID NO: 785037 - DNA, 25 bp, Mus musculus
tctcctatgcgtgaagtggagcccc

SEQ ID NO: 785038 - DNA, 25 bp, Mus musculus
tctcctatgctaccgactgtgctgg

SEQ ID NO: 785039 - DNA, 25 bp, Mus musculus
tctcctatgctagcgactgtgctgg

SEQ ID NO: 785040 - DNA, 25 bp, Mus musculus
tctcctattagaaaccagttggaaa

SEQ ID NO: 785041 - DNA, 25 bp, Mus musculus
tctcctattagataccagttggaaa

SEQ ID NO: 785042 - DNA, 25 bp, Mus musculus
tctcctattccaactgtttcttcgg

SEQ ID NO: 785043 - DNA, 25 bp, Mus musculus
tctcctattccatctgtttcttcgg

SEQ ID NO: 785044 - DNA, 25 bp, Mus musculus
tctcctcagaggctttatagaaact

SEQ ID NO: 785045 - DNA, 25 bp, Mus musculus
tctcctcagagggtttatagaaact

SEQ ID NO: 785046 - DNA, 25 bp, Mus musculus
tctcctcaggtgatacccattgaag

SEQ ID NO: 785047 - DNA, 25 bp, Mus musculus
tctcctcaggtgttacccattgaag

SEQ ID NO: 785048 - DNA, 25 bp, Mus musculus
tctcctcatctaaacagtgtcactg

SEQ ID NO: 785049 - DNA, 25 bp, Mus musculus
tctcctcatctatacagtgtcactg

SEQ ID NO: 785050 - DNA, 25 bp, Mus musculus
tctcctcatgatcctgatatgtgcc

SEQ ID NO: 785051 - DNA, 25 bp, Mus musculus
tctcctcatgatgctgatatgtgcc

SEQ ID NO: 785052 - DNA, 25 bp, Mus musculus
tctcctcatggtctacttcacaaac

SEQ ID NO: 785053 - DNA, 25 bp, Mus musculus
tctcctcatggtgtacttcacaaac

SEQ ID NO: 785054 - DNA, 25 bp, Mus musculus
tctcctccagaaaagggaccaaggg

SEQ ID NO: 785055 - DNA, 25 bp, Mus musculus
tctcctccagaatagggaccaaggg

SEQ ID NO: 785056 - DNA, 25 bp, Mus musculus
tctcctccagagaaactcattgctg

SEQ ID NO: 785057 - DNA, 25 bp, Mus musculus
tctcctccagagtaactcattgctg

SEQ ID NO: 785058 - DNA, 25 bp, Mus musculus
tctcctcccaggagaccagatggtg

SEQ ID NO: 785059 - DNA, 25 bp, Mus musculus
tctcctcccaggtgaccagatggtg

SEQ ID NO: 785060 - DNA, 25 bp, Mus musculus
tctcctccctcaactgagaaggcag

SEQ ID NO: 785061 - DNA, 25 bp, Mus musculus
tctcctccctcatctgagaaggcag

SEQ ID NO: 785062 - DNA, 25 bp, Mus musculus
tctcctccctggacaaggctcagtg

SEQ ID NO: 785063 - DNA, 25 bp, Mus musculus
tctcctccctggtcaaggctcagtg

SEQ ID NO: 785064 - DNA, 25 bp, Mus musculus
tctcctccgaggagtgcctctgtca

SEQ ID NO: 785065 - DNA, 25 bp, Mus musculus
tctcctccgaggtgtgcctctgtca

SEQ ID NO: 785066 - DNA, 25 bp, Mus musculus
tctcctccgtgaaaaactgtgtccg

SEQ ID NO: 785067 - DNA, 25 bp, Mus musculus
tctcctccgtgataaactgtgtccg

SEQ ID NO: 785068 - DNA, 25 bp, Mus musculus
tctcctcctaggactgaagagccat

SEQ ID NO: 785069 - DNA, 25 bp, Mus musculus
tctcctcctaggtctgaagagccat

SEQ ID NO: 785070 - DNA, 25 bp, Mus musculus
tctcctcctccaaccaagtttattg

SEQ ID NO: 785071 - DNA, 25 bp, Mus musculus
tctcctcctccatccaagtttattg

SEQ ID NO: 785072 - DNA, 25 bp, Mus musculus
tctcctcctgtgctagaacgtgtca

SEQ ID NO: 785073 - DNA, 25 bp, Mus musculus
tctcctcctgtggtagaacgtgtca

SEQ ID NO: 785074 - DNA, 25 bp, Mus musculus
tctcctccttatctttggccaaaag

SEQ ID NO: 785075 - DNA, 25 bp, Mus musculus
tctcctccttatgtttggccaaaag

SEQ ID NO: 785076 - DNA, 25 bp, Mus musculus
tctcctcgagatctccggtccttga

SEQ ID NO: 785077 - DNA, 25 bp, Mus musculus
tctcctcgagatgtccggtccttga

SEQ ID NO: 785078 - DNA, 25 bp, Mus musculus
tctcctcgaggacacagctgctgtc

SEQ ID NO: 785079 - DNA, 25 bp, Mus musculus
tctcctcgaggagacagctgctgtc

SEQ ID NO: 785080 - DNA, 25 bp, Mus musculus
tctcctcgcgggaatctgggccggc

SEQ ID NO: 785081 - DNA, 25 bp, Mus musculus
tctcctcgcgggtatctgggccggc

SEQ ID NO: 785082 - DNA, 25 bp, Mus musculus
tctcctcgggaaccgagcgagcgac

SEQ ID NO: 785083 - DNA, 25 bp, Mus musculus
tctcctcgggaagcgagcgagcgac

SEQ ID NO: 785084 - DNA, 25 bp, Mus musculus
tctcctcggtatccagactggctga

SEQ ID NO: 785085 - DNA, 25 bp, Mus musculus
tctcctcggtatgcagactggctga

SEQ ID NO: 785086 - DNA, 25 bp, Mus musculus
tctcctcgtggtctggtctcgtacc

SEQ ID NO: 785087 - DNA, 25 bp, Mus musculus
tctcctcgtggtgtggtctcgtacc

SEQ ID NO: 785088 - DNA, 25 bp, Mus musculus
tctcctctacttagttgtcccagga

SEQ ID NO: 785089 - DNA, 25 bp, Mus musculus
tctcctctactttgttgtcccagga

SEQ ID NO: 785090 - DNA, 25 bp, Mus musculus
tctcctctctttcacagaggacaaa

SEQ ID NO: 785091 - DNA, 25 bp, Mus musculus
tctcctctctttgacagaggacaaa

SEQ ID NO: 785092 - DNA, 25 bp, Mus musculus
tctcctctggcgactgtgtggtgaa

SEQ ID NO: 785093 - DNA, 25 bp, Mus musculus
tctcctctggcgtctgtgtggtgaa

SEQ ID NO: 785094 - DNA, 25 bp, Mus musculus
tctcctctttatcaactctgccaaa

SEQ ID NO: 785095 - DNA, 25 bp, Mus musculus
tctcctctttatgaactctgccaaa

SEQ ID NO: 785096 - DNA, 25 bp, Mus musculus
tctcctgaaaagccctgcagcctgg

SEQ ID NO: 785097 - DNA, 25 bp, Mus musculus
tctcctgaaaaggcctgcagcctgg

SEQ ID NO: 785098 - DNA, 25 bp, Mus musculus
tctcctgacattcccacatctgtta

SEQ ID NO: 785099 - DNA, 25 bp, Mus musculus
tctcctgacattgccacatctgtta

SEQ ID NO: 785100 - DNA, 25 bp, Mus musculus
tctcctgaccgtcctgagcctggat

SEQ ID NO: 785101 - DNA, 25 bp, Mus musculus
tctcctgaccgtgctgagcctggat

SEQ ID NO: 785102 - DNA, 25 bp, Mus musculus
tctcctgacgcacagtggacgaacg

SEQ ID NO: 785103 - DNA, 25 bp, Mus musculus
tctcctgacgcagagtggacgaacg

SEQ ID NO: 785104 - DNA, 25 bp, Mus musculus
tctcctgacttgaggcaccagggct

SEQ ID NO: 785105 - DNA, 25 bp, Mus musculus
tctcctgacttgtggcaccagggct

SEQ ID NO: 785106 - DNA, 25 bp, Mus musculus
tctcctgagaatatgacaggacggc

SEQ ID NO: 785107 - DNA, 25 bp, Mus musculus
tctcctgagaatttgacaggacggc

SEQ ID NO: 785108 - DNA, 25 bp, Mus musculus
tctcctgagacacactggaaaccag

SEQ ID NO: 785109 - DNA, 25 bp, Mus musculus
tctcctgagacagactggaaaccag

SEQ ID NO: 785110 - DNA, 25 bp, Mus musculus
tctcctgagagtaccctgctgcggt

SEQ ID NO: 785111 - DNA, 25 bp, Mus musculus
tctcctgagagttccctgctgcggt

SEQ ID NO: 785112 - DNA, 25 bp, Mus musculus
tctcctgagcagatagcctgaggtt

SEQ ID NO: 785113 - DNA, 25 bp, Mus musculus
tctcctgagcagttagcctgaggtt

SEQ ID NO: 785114 - DNA, 25 bp, Mus musculus
tctcctgaggctctacatgtacatc

SEQ ID NO: 785115 - DNA, 25 bp, Mus musculus
tctcctgaggctgtacatgtacatc

SEQ ID NO: 785116 - DNA, 25 bp, Mus musculus
tctcctgcagacacagttatacctg

SEQ ID NO: 785117 - DNA, 25 bp, Mus musculus
tctcctgcagactcagttatacctg

SEQ ID NO: 785118 - DNA, 25 bp, Mus musculus
tctcctgcatggatgagggacttca

SEQ ID NO: 785119 - DNA, 25 bp, Mus musculus
tctcctgcatggttgagggacttca

SEQ ID NO: 785120 - DNA, 25 bp, Mus musculus
tctcctgccccgagaggaaggtcct

SEQ ID NO: 785121 - DNA, 25 bp, Mus musculus
tctcctgccccgtgaggaaggtcct

SEQ ID NO: 785122 - DNA, 25 bp, Mus musculus
tctcctgcggagctacaggcagaac

SEQ ID NO: 785123 - DNA, 25 bp, Mus musculus
tctcctgcggaggtacaggcagaac

SEQ ID NO: 785124 - DNA, 25 bp, Mus musculus
tctcctgctcatacgcaatgatcgt

SEQ ID NO: 785125 - DNA, 25 bp, Mus musculus
tctcctgctcattcgcaatgatcgt

SEQ ID NO: 785126 - DNA, 25 bp, Mus musculus
tctcctgctcggcatgacaaagcct

SEQ ID NO: 785127 - DNA, 25 bp, Mus musculus
tctcctgctcgggatgacaaagcct

SEQ ID NO: 785128 - DNA, 25 bp, Mus musculus
tctcctgctgctacggaggcagagg

SEQ ID NO: 785129 - DNA, 25 bp, Mus musculus
tctcctgctgcttcggaggcagagg

SEQ ID NO: 785130 - DNA, 25 bp, Mus musculus
tctcctgcttacaagtttgaccctg

SEQ ID NO: 785131 - DNA, 25 bp, Mus musculus
tctcctgcttactagtttgaccctg

SEQ ID NO: 785132 - DNA, 25 bp, Mus musculus
tctcctggaagaagcatagccagcg

SEQ ID NO: 785133 - DNA, 25 bp, Mus musculus
tctcctggaagatgcatagccagcg

SEQ ID NO: 785134 - DNA, 25 bp, Mus musculus
tctcctggaaggctataacaagact

SEQ ID NO: 785135 - DNA, 25 bp, Mus musculus
tctcctggaagggtataacaagact

SEQ ID NO: 785136 - DNA, 25 bp, Mus musculus
tctcctggaggacttctttagacag

SEQ ID NO: 785137 - DNA, 25 bp, Mus musculus
tctcctggaggagttctttagacag

SEQ ID NO: 785138 - DNA, 25 bp, Mus musculus
tctcctggatggcattcgggccact

SEQ ID NO: 785139 - DNA, 25 bp, Mus musculus
tctcctggatgggattcgggccact

SEQ ID NO: 785140 - DNA, 25 bp, Mus musculus
tctcctggcaatcggtctggtcaca

SEQ ID NO: 785141 - DNA, 25 bp, Mus musculus
tctcctggcaatgggtctggtcaca

SEQ ID NO: 785142 - DNA, 25 bp, Mus musculus
tctcctggcatcatgggaaaggctc

SEQ ID NO: 785143 - DNA, 25 bp, Mus musculus
tctcctggcatcttgggaaaggctc

SEQ ID NO: 785144 - DNA, 25 bp, Mus musculus
tctcctggcttactctttggtggct

SEQ ID NO: 785145 - DNA, 25 bp, Mus musculus
tctcctggcttagtctttggtggct

SEQ ID NO: 785146 - DNA, 25 bp, Mus musculus
tctcctgggaaaaccgttcagctct

SEQ ID NO: 785147 - DNA, 25 bp, Mus musculus
tctcctgggaaatccgttcagctct

SEQ ID NO: 785148 - DNA, 25 bp, Mus musculus
tctcctgggagcacaggaatgtcga

SEQ ID NO: 785149 - DNA, 25 bp, Mus musculus
tctcctgggagctcaggaatgtcga

SEQ ID NO: 785150 - DNA, 25 bp, Mus musculus
tctcctgggcacagctacttaacca

SEQ ID NO: 785151 - DNA, 25 bp, Mus musculus
tctcctgggcactgctacttaacca

SEQ ID NO: 785152 - DNA, 25 bp, Mus musculus
tctcctgggccaacgttttgggaga

SEQ ID NO: 785153 - DNA, 25 bp, Mus musculus
tctcctgggccatcgttttgggaga

SEQ ID NO: 785154 - DNA, 25 bp, Mus musculus
tctcctggtcacatatgcatccttg

SEQ ID NO: 785155 - DNA, 25 bp, Mus musculus
tctcctggtcacttatgcatccttg

SEQ ID NO: 785156 - DNA, 25 bp, Mus musculus
tctcctggtgtcagagcctctctag

SEQ ID NO: 785157 - DNA, 25 bp, Mus musculus
tctcctggtgtctgagcctctctag

SEQ ID NO: 785158 - DNA, 25 bp, Mus musculus
tctcctggtgtgcaaaacttggttc

SEQ ID NO: 785159 - DNA, 25 bp, Mus musculus
tctcctggtgtggaaaacttggttc

SEQ ID NO: 785160 - DNA, 25 bp, Mus musculus
tctcctggttccaggtcgttttacg

SEQ ID NO: 785161 - DNA, 25 bp, Mus musculus
tctcctggttcctggtcgttttacg

SEQ ID NO: 785162 - DNA, 25 bp, Mus musculus
tctcctgtcagtcatctgtcaccat

SEQ ID NO: 785163 - DNA, 25 bp, Mus musculus
tctcctgtcagtgatctgtcaccat

SEQ ID NO: 785164 - DNA, 25 bp, Mus musculus
tctcctgtgaagcttaagttaacac

SEQ ID NO: 785165 - DNA, 25 bp, Mus musculus
tctcctgtgaaggttaagttaacac

SEQ ID NO: 785166 - DNA, 25 bp, Mus musculus
tctcctgtggacaagcctggaaagg

SEQ ID NO: 785167 - DNA, 25 bp, Mus musculus
tctcctgtggactagcctggaaagg

SEQ ID NO: 785168 - DNA, 25 bp, Mus musculus
tctcctgtggagacttacacaaggg

SEQ ID NO: 785169 - DNA, 25 bp, Mus musculus
tctcctgtggagtcttacacaaggg

SEQ ID NO: 785170 - DNA, 25 bp, Mus musculus
tctcctgtgggaccttccatgagtc

SEQ ID NO: 785171 - DNA, 25 bp, Mus musculus
tctcctgtgggagcttccatgagtc

SEQ ID NO: 785172 - DNA, 25 bp, Mus musculus
tctcctgtgggtcttatggttcttc

SEQ ID NO: 785173 - DNA, 25 bp, Mus musculus
tctcctgtgggtgttatggttcttc

SEQ ID NO: 785174 - DNA, 25 bp, Mus musculus
tctcctgtggtaaaggaaaggctat

SEQ ID NO: 785175 - DNA, 25 bp, Mus musculus
tctcctgtggtataggaaaggctat

SEQ ID NO: 785176 - DNA, 25 bp, Mus musculus
tctcctgtgtgtacccggtgttgcc

SEQ ID NO: 785177 - DNA, 25 bp, Mus musculus
tctcctgtgtgttcccggtgttgcc

SEQ ID NO: 785178 - DNA, 25 bp, Mus musculus
tctcctgtttccatgcctcgtatgc

SEQ ID NO: 785179 - DNA, 25 bp, Mus musculus
tctcctgtttccttgcctcgtatgc

SEQ ID NO: 785180 - DNA, 25 bp, Mus musculus
tctccttaccgtcgagttggaggtt

SEQ ID NO: 785181 - DNA, 25 bp, Mus musculus
tctccttaccgtggagttggaggtt

SEQ ID NO: 785182 - DNA, 25 bp, Mus musculus
tctccttacctcaggtcccttatag

SEQ ID NO: 785183 - DNA, 25 bp, Mus musculus
tctccttacctctggtcccttatag

SEQ ID NO: 785184 - DNA, 25 bp, Mus musculus
tctccttagtgcatgaatcgttcct

SEQ ID NO: 785185 - DNA, 25 bp, Mus musculus
tctccttagtgcttgaatcgttcct

SEQ ID NO: 785186 - DNA, 25 bp, Mus musculus
tctccttcaaggacctcaacttcag

SEQ ID NO: 785187 - DNA, 25 bp, Mus musculus
tctccttcaaggtcctcaacttcag

SEQ ID NO: 785188 - DNA, 25 bp, Mus musculus
tctccttcaattcctatgagctggg

SEQ ID NO: 785189 - DNA, 25 bp, Mus musculus
tctccttcaattgctatgagctggg

SEQ ID NO: 785190 - DNA, 25 bp, Mus musculus
tctccttcagtccaggagccctgag

SEQ ID NO: 785191 - DNA, 25 bp, Mus musculus
tctccttcagtcgaggagccctgag

SEQ ID NO: 785192 - DNA, 25 bp, Mus musculus
tctccttcatcaaagtcttcaggaa

SEQ ID NO: 785193 - DNA, 25 bp, Mus musculus
tctccttcatcatagtcttcaggaa

SEQ ID NO: 785194 - DNA, 25 bp, Mus musculus
tctccttcatgtcgaaatgcccagg

SEQ ID NO: 785195 - DNA, 25 bp, Mus musculus
tctccttcatgtggaaatgcccagg

SEQ ID NO: 785196 - DNA, 25 bp, Mus musculus
tctccttcgcccaggttgttataga

SEQ ID NO: 785197 - DNA, 25 bp, Mus musculus
tctccttcgccctggttgttataga

SEQ ID NO: 785198 - DNA, 25 bp, Mus musculus
tctccttctatcagcccagagaaga

SEQ ID NO: 785199 - DNA, 25 bp, Mus musculus
tctccttctatctgcccagagaaga

SEQ ID NO: 785200 - DNA, 25 bp, Mus musculus
tctccttctccgaatcaccttggaa

SEQ ID NO: 785201 - DNA, 25 bp, Mus musculus
tctccttctccgtatcaccttggaa

SEQ ID NO: 785202 - DNA, 25 bp, Mus musculus
tctccttgaaatcgactggtcccac

SEQ ID NO: 785203 - DNA, 25 bp, Mus musculus
tctccttgaaatggactggtcccac

SEQ ID NO: 785204 - DNA, 25 bp, Mus musculus
tctccttgactgcacgttgaactca

SEQ ID NO: 785205 - DNA, 25 bp, Mus musculus
tctccttgactggacgttgaactca

SEQ ID NO: 785206 - DNA, 25 bp, Mus musculus
tctccttgagatcttctccaggatg

SEQ ID NO: 785207 - DNA, 25 bp, Mus musculus
tctccttgagatgttctccaggatg

SEQ ID NO: 785208 - DNA, 25 bp, Mus musculus
tctccttgatgcctctgaacctggg

SEQ ID NO: 785209 - DNA, 25 bp, Mus musculus
tctccttgatgcgtctgaacctggg

SEQ ID NO: 785210 - DNA, 25 bp, Mus musculus
tctccttgctgaccaaaagtctggg

SEQ ID NO: 785211 - DNA, 25 bp, Mus musculus
tctccttgctgagcaaaagtctggg

SEQ ID NO: 785212 - DNA, 25 bp, Mus musculus
tctccttgcttaaccagaacaatcg

SEQ ID NO: 785213 - DNA, 25 bp, Mus musculus
tctccttgcttaagggattggacaa

SEQ ID NO: 785214 - DNA, 25 bp, Mus musculus
tctccttgcttatccagaacaatcg

SEQ ID NO: 785215 - DNA, 25 bp, Mus musculus
tctccttgcttatgggattggacaa

SEQ ID NO: 785216 - DNA, 25 bp, Mus musculus
tctccttggaataggacgaccagag

SEQ ID NO: 785217 - DNA, 25 bp, Mus musculus
tctccttggaattggacgaccagag

SEQ ID NO: 785218 - DNA, 25 bp, Mus musculus
tctccttggcacaggaggatactcc

SEQ ID NO: 785219 - DNA, 25 bp, Mus musculus
tctccttggcactggaggatactcc

SEQ ID NO: 785220 - DNA, 25 bp, Mus musculus
tctcctttatatactgctgaccggg

SEQ ID NO: 785221 - DNA, 25 bp, Mus musculus
tctcctttatattctgctgaccggg

SEQ ID NO: 785222 - DNA, 25 bp, Mus musculus
tctcctttgaagatgacagtgctcc

SEQ ID NO: 785223 - DNA, 25 bp, Mus musculus
tctcctttgaagttgacagtgctcc

SEQ ID NO: 785224 - DNA, 25 bp, Mus musculus
tctcctttgagcacattcgggaagg

SEQ ID NO: 785225 - DNA, 25 bp, Mus musculus
tctcctttgagctcattcgggaagg

SEQ ID NO: 785226 - DNA, 25 bp, Mus musculus
tctcctttgctaccatctatgatgt

SEQ ID NO: 785227 - DNA, 25 bp, Mus musculus
tctcctttgctagcatctatgatgt

SEQ ID NO: 785228 - DNA, 25 bp, Mus musculus
tctcctttggacagtatggcctcct

SEQ ID NO: 785229 - DNA, 25 bp, Mus musculus
tctcctttggactgtatggcctcct

SEQ ID NO: 785230 - DNA, 25 bp, Mus musculus
tctcgaaacccgagaagacttactt

SEQ ID NO: 785231 - DNA, 25 bp, Mus musculus
tctcgaaacccgtgaagacttactt

SEQ ID NO: 785232 - DNA, 25 bp, Mus musculus
tctcgaacagaaaatagggatccgc

SEQ ID NO: 785233 - DNA, 25 bp, Mus musculus
tctcgaacagaatatagggatccgc

SEQ ID NO: 785234 - DNA, 25 bp, Mus musculus
tctcgaacgtgccagtgagtaagat

SEQ ID NO: 785235 - DNA, 25 bp, Mus musculus
tctcgaacgtgcgagtgagtaagat

SEQ ID NO: 785236 - DNA, 25 bp, Mus musculus
tctcgaagaggaagcgttagactca

SEQ ID NO: 785237 - DNA, 25 bp, Mus musculus
tctcgaagaggatgcgttagactca

SEQ ID NO: 785238 - DNA, 25 bp, Mus musculus
tctcgaagctctaaatcactttgaa

SEQ ID NO: 785239 - DNA, 25 bp, Mus musculus
tctcgaagctcttaatcactttgaa

SEQ ID NO: 785240 - DNA, 25 bp, Mus musculus
tctcgaagtgttcgatacaggccag

SEQ ID NO: 785241 - DNA, 25 bp, Mus musculus
tctcgaagtgttggatacaggccag

SEQ ID NO: 785242 - DNA, 25 bp, Mus musculus
tctcgaatccgcattgacagcctct

SEQ ID NO: 785243 - DNA, 25 bp, Mus musculus
tctcgaatccgctttgacagcctct

SEQ ID NO: 785244 - DNA, 25 bp, Mus musculus
tctcgacacaatacagaagatttta

SEQ ID NO: 785245 - DNA, 25 bp, Mus musculus
tctcgacacaattcagaagatttta

SEQ ID NO: 785246 - DNA, 25 bp, Mus musculus
tctcgacagtggatgaataaattta

SEQ ID NO: 785247 - DNA, 25 bp, Mus musculus
tctcgacagtggttgaataaattta

SEQ ID NO: 785248 - DNA, 25 bp, Mus musculus
tctcgacattatcgatgaagatggg

SEQ ID NO: 785249 - DNA, 25 bp, Mus musculus
tctcgacattatggatgaagatggg

SEQ ID NO: 785250 - DNA, 25 bp, Mus musculus
tctcgaccagaacagaacaggagag

SEQ ID NO: 785251 - DNA, 25 bp, Mus musculus
tctcgaccagaagagaacaggagag

SEQ ID NO: 785252 - DNA, 25 bp, Mus musculus
tctcgacctggtatgcgcatggcct

SEQ ID NO: 785253 - DNA, 25 bp, Mus musculus
tctcgacctggtttgcgcatggcct

SEQ ID NO: 785254 - DNA, 25 bp, Mus musculus
tctcgacggagaagaggtccagata

SEQ ID NO: 785255 - DNA, 25 bp, Mus musculus
tctcgacggagatgaggtccagata

SEQ ID NO: 785256 - DNA, 25 bp, Mus musculus
tctcgactatctctttgcacacgga

SEQ ID NO: 785257 - DNA, 25 bp, Mus musculus
tctcgactatctgtttgcacacgga

SEQ ID NO: 785258 - DNA, 25 bp, Mus musculus
tctcgactatgacactgtggctggg

SEQ ID NO: 785259 - DNA, 25 bp, Mus musculus
tctcgactatgagactgtggctggg

SEQ ID NO: 785260 - DNA, 25 bp, Mus musculus
tctcgactctgaattgacctccaag

SEQ ID NO: 785261 - DNA, 25 bp, Mus musculus
tctcgactctgatttgacctccaag

SEQ ID NO: 785262 - DNA, 25 bp, Mus musculus
tctcgactgcagacattgccatgcc

SEQ ID NO: 785263 - DNA, 25 bp, Mus musculus
tctcgactgcagtcattgccatgcc

SEQ ID NO: 785264 - DNA, 25 bp, Mus musculus
tctcgactggacaacgtgatgaaga

SEQ ID NO: 785265 - DNA, 25 bp, Mus musculus
tctcgactggactacgtgatgaaga

SEQ ID NO: 785266 - DNA, 25 bp, Mus musculus
tctcgagaagagcaggccaagtact

SEQ ID NO: 785267 - DNA, 25 bp, Mus musculus
tctcgagaagaggaggccaagtact

SEQ ID NO: 785268 - DNA, 25 bp, Mus musculus
tctcgagagagtacctgcagactag

SEQ ID NO: 785269 - DNA, 25 bp, Mus musculus
tctcgagagagttcctgcagactag

SEQ ID NO: 785270 - DNA, 25 bp, Mus musculus
tctcgagcaactaaagcagcacgtg

SEQ ID NO: 785271 - DNA, 25 bp, Mus musculus
tctcgagcaacttaagcagcacgtg

SEQ ID NO: 785272 - DNA, 25 bp, Mus musculus
tctcgagcccggaagccagcgttca

SEQ ID NO: 785273 - DNA, 25 bp, Mus musculus
tctcgagcccggtagccagcgttca

SEQ ID NO: 785274 - DNA, 25 bp, Mus musculus
tctcgagcgcgtagagctccgtgct

SEQ ID NO: 785275 - DNA, 25 bp, Mus musculus
tctcgagcgcgttgagctccgtgct

SEQ ID NO: 785276 - DNA, 25 bp, Mus musculus
tctcgagctggcaacatgggtgtag

SEQ ID NO: 785277 - DNA, 25 bp, Mus musculus
tctcgagctggctacatgggtgtag

SEQ ID NO: 785278 - DNA, 25 bp, Mus musculus
tctcgaggccgaaaggtgatgctgt

SEQ ID NO: 785279 - DNA, 25 bp, Mus musculus
tctcgaggccgataggtgatgctgt

SEQ ID NO: 785280 - DNA, 25 bp, Mus musculus
tctcgagttcgccggtggttcctgc

SEQ ID NO: 785281 - DNA, 25 bp, Mus musculus
tctcgagttcgcgggtggttcctgc

SEQ ID NO: 785282 - DNA, 25 bp, Mus musculus
tctcgagttggaaaagccattgata

SEQ ID NO: 785283 - DNA, 25 bp, Mus musculus
tctcgagttggataagccattgata

SEQ ID NO: 785284 - DNA, 25 bp, Mus musculus
tctcgatagctccatgctgggtgat

SEQ ID NO: 785285 - DNA, 25 bp, Mus musculus
tctcgatagctcgatgctgggtgat

SEQ ID NO: 785286 - DNA, 25 bp, Mus musculus
tctcgatccgctatgggaattcccc

SEQ ID NO: 785287 - DNA, 25 bp, Mus musculus
tctcgatccgctttgggaattcccc

SEQ ID NO: 785288 - DNA, 25 bp, Mus musculus
tctcgatgccatcgtacgctgcgac

SEQ ID NO: 785289 - DNA, 25 bp, Mus musculus
tctcgatgccatggtacgctgcgac

SEQ ID NO: 785290 - DNA, 25 bp, Mus musculus
tctcgatttgacagcaactccatct

SEQ ID NO: 785291 - DNA, 25 bp, Mus musculus
tctcgatttgactgcaactccatct

SEQ ID NO: 785292 - DNA, 25 bp, Mus musculus
tctcgcaaggataagaaatagcggt

SEQ ID NO: 785293 - DNA, 25 bp, Mus musculus
tctcgcaaggattagaaatagcggt

SEQ ID NO: 785294 - DNA, 25 bp, Mus musculus
tctcgcaccttcatcacgttcagtg

SEQ ID NO: 785295 - DNA, 25 bp, Mus musculus
tctcgcaccttcttcacgttcagtg

SEQ ID NO: 785296 - DNA, 25 bp, Mus musculus
tctcgcagaaggatttcaagtgagg

SEQ ID NO: 785297 - DNA, 25 bp, Mus musculus
tctcgcagaaggttttcaagtgagg

SEQ ID NO: 785298 - DNA, 25 bp, Mus musculus
tctcgccctcatcgagagcgggatg

SEQ ID NO: 785299 - DNA, 25 bp, Mus musculus
tctcgccctcatggagagcgggatg

SEQ ID NO: 785300 - DNA, 25 bp, Mus musculus
tctcgccctggtcattctatgctgt

SEQ ID NO: 785301 - DNA, 25 bp, Mus musculus
tctcgccctggtgattctatgctgt

SEQ ID NO: 785302 - DNA, 25 bp, Mus musculus
tctcgcctgatgagcttgtgactga

SEQ ID NO: 785303 - DNA, 25 bp, Mus musculus
tctcgcctgatgtgcttgtgactga

SEQ ID NO: 785304 - DNA, 25 bp, Mus musculus
tctcgccttcgccttctaacgtttg

SEQ ID NO: 785305 - DNA, 25 bp, Mus musculus
tctcgccttcgcgttctaacgtttg

SEQ ID NO: 785306 - DNA, 25 bp, Mus musculus
tctcgccttgctcgagaagctttca

SEQ ID NO: 785307 - DNA, 25 bp, Mus musculus
tctcgccttgctggagaagctttca

SEQ ID NO: 785308 - DNA, 25 bp, Mus musculus
tctcgcggaagcctctctgaaagcg

SEQ ID NO: 785309 - DNA, 25 bp, Mus musculus
tctcgcggaagcgtctctgaaagcg

SEQ ID NO: 785310 - DNA, 25 bp, Mus musculus
tctcgctcctagatggcacctgtga

SEQ ID NO: 785311 - DNA, 25 bp, Mus musculus
tctcgctcctagttggcacctgtga

SEQ ID NO: 785312 - DNA, 25 bp, Mus musculus
tctcgctctgcgcagactggaggac

SEQ ID NO: 785313 - DNA, 25 bp, Mus musculus
tctcgctctgcggagactggaggac

SEQ ID NO: 785314 - DNA, 25 bp, Mus musculus
tctcgctgagggacttgtggaaact

SEQ ID NO: 785315 - DNA, 25 bp, Mus musculus
tctcgctgagggtcttgtggaaact

SEQ ID NO: 785316 - DNA, 25 bp, Mus musculus
tctcgctgccacaggagtgggacta

SEQ ID NO: 785317 - DNA, 25 bp, Mus musculus
tctcgctgccactggagtgggacta

SEQ ID NO: 785318 - DNA, 25 bp, Mus musculus
tctcgctgcgggagcatgagctgct

SEQ ID NO: 785319 - DNA, 25 bp, Mus musculus
tctcgctgcgggtgcatgagctgct

SEQ ID NO: 785320 - DNA, 25 bp, Mus musculus
tctcgctgcgttaccccaaaatagt

SEQ ID NO: 785321 - DNA, 25 bp, Mus musculus
tctcgctgcgtttccccaaaatagt

SEQ ID NO: 785322 - DNA, 25 bp, Mus musculus
tctcgctggctgagttacagactca

SEQ ID NO: 785323 - DNA, 25 bp, Mus musculus
tctcgctggctgtgttacagactca

SEQ ID NO: 785324 - DNA, 25 bp, Mus musculus
tctcgctgtattagatagtctgggc

SEQ ID NO: 785325 - DNA, 25 bp, Mus musculus
tctcgctgtatttgatagtctgggc

SEQ ID NO: 785326 - DNA, 25 bp, Mus musculus
tctcgcttctcgcaaccatctgtgg

SEQ ID NO: 785327 - DNA, 25 bp, Mus musculus
tctcgcttctcggaaccatctgtgg

SEQ ID NO: 785328 - DNA, 25 bp, Mus musculus
tctcgcttggcccagagcagcagag

SEQ ID NO: 785329 - DNA, 25 bp, Mus musculus
tctcgcttggccgagagcagcagag

SEQ ID NO: 785330 - DNA, 25 bp, Mus musculus
tctcggaaccatctgtggatcaggg

SEQ ID NO: 785331 - DNA, 25 bp, Mus musculus
tctcggaaccatgtgtggatcaggg

SEQ ID NO: 785332 - DNA, 25 bp, Mus musculus
tctcggaacccacgaagtcaaccaa

SEQ ID NO: 785333 - DNA, 25 bp, Mus musculus
tctcggaacccaggaagtcaaccaa

SEQ ID NO: 785334 - DNA, 25 bp, Mus musculus
tctcggaactgactggcaccgtggc

SEQ ID NO: 785335 - DNA, 25 bp, Mus musculus
tctcggaactgagtggcaccgtggc

SEQ ID NO: 785336 - DNA, 25 bp, Mus musculus
tctcggaatgccaggaacaaggacg

SEQ ID NO: 785337 - DNA, 25 bp, Mus musculus
tctcggaatgcctggaacaaggacg

SEQ ID NO: 785338 - DNA, 25 bp, Mus musculus
tctcggacagacagaagatctcact

SEQ ID NO: 785339 - DNA, 25 bp, Mus musculus
tctcggacagactgaagatctcact

SEQ ID NO: 785340 - DNA, 25 bp, Mus musculus
tctcggacccttactaccacaggtg

SEQ ID NO: 785341 - DNA, 25 bp, Mus musculus
tctcggaccctttctaccacaggtg

SEQ ID NO: 785342 - DNA, 25 bp, Mus musculus
tctcggacctgtattcagagtgaac

SEQ ID NO: 785343 - DNA, 25 bp, Mus musculus
tctcggacctgttttcagagtgaac

SEQ ID NO: 785344 - DNA, 25 bp, Mus musculus
tctcggaccttaacagatgaaaagt

SEQ ID NO: 785345 - DNA, 25 bp, Mus musculus
tctcggaccttatcagatgaaaagt

SEQ ID NO: 785346 - DNA, 25 bp, Mus musculus
tctcggactcatccatatggctggg

SEQ ID NO: 785347 - DNA, 25 bp, Mus musculus
tctcggactcatgcatatggctggg

SEQ ID NO: 785348 - DNA, 25 bp, Mus musculus
tctcggagagctctagcaaggcctt

SEQ ID NO: 785349 - DNA, 25 bp, Mus musculus
tctcggagagctgtagcaaggcctt

SEQ ID NO: 785350 - DNA, 25 bp, Mus musculus
tctcggagataaatttccatgcact

SEQ ID NO: 785351 - DNA, 25 bp, Mus musculus
tctcggagataattttccatgcact

SEQ ID NO: 785352 - DNA, 25 bp, Mus musculus
tctcggagatctatcatttaaccct

SEQ ID NO: 785353 - DNA, 25 bp, Mus musculus
tctcggagatctttcatttaaccct

SEQ ID NO: 785354 - DNA, 25 bp, Mus musculus
tctcggagcttcagaaccagggtcc

SEQ ID NO: 785355 - DNA, 25 bp, Mus musculus
tctcggagcttctgaaccagggtcc

SEQ ID NO: 785356 - DNA, 25 bp, Mus musculus
tctcggagtgaaaccgacctggact

SEQ ID NO: 785357 - DNA, 25 bp, Mus musculus
tctcggagtgaatccgacctggact

SEQ ID NO: 785358 - DNA, 25 bp, Mus musculus
tctcggagtgtcacgaggaaaagaa

SEQ ID NO: 785359 - DNA, 25 bp, Mus musculus
tctcggagtgtctcgaggaaaagaa

SEQ ID NO: 785360 - DNA, 25 bp, Mus musculus
tctcggatgactccgtccccattgg

SEQ ID NO: 785361 - DNA, 25 bp, Mus musculus
tctcggatgactgcgtccccattgg

SEQ ID NO: 785362 - DNA, 25 bp, Mus musculus
tctcggatgctaatctgcgtgtctg

SEQ ID NO: 785363 - DNA, 25 bp, Mus musculus
tctcggatgctattctgcgtgtctg

SEQ ID NO: 785364 - DNA, 25 bp, Mus musculus
tctcggattatgaactacttgtcac

SEQ ID NO: 785365 - DNA, 25 bp, Mus musculus
tctcggattatgtactacttgtcac

SEQ ID NO: 785366 - DNA, 25 bp, Mus musculus
tctcggcaagcacacacctatctgt

SEQ ID NO: 785367 - DNA, 25 bp, Mus musculus
tctcggcaagcagacacctatctgt

SEQ ID NO: 785368 - DNA, 25 bp, Mus musculus
tctcggcactgaaggcagacagtac

SEQ ID NO: 785369 - DNA, 25 bp, Mus musculus
tctcggcactgatggcagacagtac

SEQ ID NO: 785370 - DNA, 25 bp, Mus musculus
tctcggcagatcaatgacatccagt

SEQ ID NO: 785371 - DNA, 25 bp, Mus musculus
tctcggcagatctatgacatccagt

SEQ ID NO: 785372 - DNA, 25 bp, Mus musculus
tctcggcagcatcccaccaatgttg

SEQ ID NO: 785373 - DNA, 25 bp, Mus musculus
tctcggcagcatgccaccaatgttg

SEQ ID NO: 785374 - DNA, 25 bp, Mus musculus
tctcggcatagtactggacccagga

SEQ ID NO: 785375 - DNA, 25 bp, Mus musculus
tctcggcatagttctggacccagga

SEQ ID NO: 785376 - DNA, 25 bp, Mus musculus
tctcggcattagagaagagaacccc

SEQ ID NO: 785377 - DNA, 25 bp, Mus musculus
tctcggcattagtgaagagaacccc

SEQ ID NO: 785378 - DNA, 25 bp, Mus musculus
tctcggccacctcatgcattcaggg

SEQ ID NO: 785379 - DNA, 25 bp, Mus musculus
tctcggccacctgatgcattcaggg

SEQ ID NO: 785380 - DNA, 25 bp, Mus musculus
tctcggcccattcctatttgctgtt

SEQ ID NO: 785381 - DNA, 25 bp, Mus musculus
tctcggcccattgctatttgctgtt

SEQ ID NO: 785382 - DNA, 25 bp, Mus musculus
tctcggcccgaactgtgctagtgaa

SEQ ID NO: 785383 - DNA, 25 bp, Mus musculus
tctcggcccgaagtgtgctagtgaa

SEQ ID NO: 785384 - DNA, 25 bp, Mus musculus
tctcggccgcttctccagcatgaaa

SEQ ID NO: 785385 - DNA, 25 bp, Mus musculus
tctcggccgcttgtccagcatgaaa

SEQ ID NO: 785386 - DNA, 25 bp, Mus musculus
tctcggcgcgctaagactgtgtaca

SEQ ID NO: 785387 - DNA, 25 bp, Mus musculus
tctcggcgcgcttagactgtgtaca

SEQ ID NO: 785388 - DNA, 25 bp, Mus musculus
tctcggcgcttcagccgggctgcag

SEQ ID NO: 785389 - DNA, 25 bp, Mus musculus
tctcggcgcttctgccgggctgcag

SEQ ID NO: 785390 - DNA, 25 bp, Mus musculus
tctcggctagcaaagcattgggacg

SEQ ID NO: 785391 - DNA, 25 bp, Mus musculus
tctcggctagcatagcattgggacg

SEQ ID NO: 785392 - DNA, 25 bp, Mus musculus
tctcggctgaacatcatcatcatcg

SEQ ID NO: 785393 - DNA, 25 bp, Mus musculus
tctcggctgaacttcatcatcatcg

SEQ ID NO: 785394 - DNA, 25 bp, Mus musculus
tctcggctgcgaaggtacagagaga

SEQ ID NO: 785395 - DNA, 25 bp, Mus musculus
tctcggctgcgatggtacagagaga

SEQ ID NO: 785396 - DNA, 25 bp, Mus musculus
tctcggctggctcggtatgaatgca

SEQ ID NO: 785397 - DNA, 25 bp, Mus musculus
tctcggctggctgggtatgaatgca

SEQ ID NO: 785398 - DNA, 25 bp, Mus musculus
tctcggctgtggaatttcaactggc

SEQ ID NO: 785399 - DNA, 25 bp, Mus musculus
tctcggctgtggtatttcaactggc

SEQ ID NO: 785400 - DNA, 25 bp, Mus musculus
tctcggctgttaaggaagcaatgcc

SEQ ID NO: 785401 - DNA, 25 bp, Mus musculus
tctcggctgttatggaagcaatgcc

SEQ ID NO: 785402 - DNA, 25 bp, Mus musculus
tctcgggaaaagctggtgaagctct

SEQ ID NO: 785403 - DNA, 25 bp, Mus musculus
tctcgggaaaaggtggtgaagctct

SEQ ID NO: 785404 - DNA, 25 bp, Mus musculus
tctcgggaagaacacccgactctta

SEQ ID NO: 785405 - DNA, 25 bp, Mus musculus
tctcgggaagaagacccgactctta

SEQ ID NO: 785406 - DNA, 25 bp, Mus musculus
tctcgggacaatagcctgcttctgt

SEQ ID NO: 785407 - DNA, 25 bp, Mus musculus
tctcgggacaattgcctgcttctgt

SEQ ID NO: 785408 - DNA, 25 bp, Mus musculus
tctcgggacgggatggtttgcaact

SEQ ID NO: 785409 - DNA, 25 bp, Mus musculus
tctcgggacgggttggtttgcaact

SEQ ID NO: 785410 - DNA, 25 bp, Mus musculus
tctcgggagcacagaattttggagc

SEQ ID NO: 785411 - DNA, 25 bp, Mus musculus
tctcgggagcactgaattttggagc

SEQ ID NO: 785412 - DNA, 25 bp, Mus musculus
tctcgggaggctatgcaaggtttct

SEQ ID NO: 785413 - DNA, 25 bp, Mus musculus
tctcgggaggctttgcaaggtttct

SEQ ID NO: 785414 - DNA, 25 bp, Mus musculus
tctcgggctcctcggacggaacgct

SEQ ID NO: 785415 - DNA, 25 bp, Mus musculus
tctcgggctcctgggacggaacgct

SEQ ID NO: 785416 - DNA, 25 bp, Mus musculus
tctcgggtccggcagagcccacttg

SEQ ID NO: 785417 - DNA, 25 bp, Mus musculus
tctcgggtccgggagagcccacttg

SEQ ID NO: 785418 - DNA, 25 bp, Mus musculus
tctcgggtcgccaggcgtgcccaga

SEQ ID NO: 785419 - DNA, 25 bp, Mus musculus
tctcgggtcgcctggcgtgcccaga

SEQ ID NO: 785420 - DNA, 25 bp, Mus musculus
tctcggtaaatcctgcaagccaatc

SEQ ID NO: 785421 - DNA, 25 bp, Mus musculus
tctcggtaaatcgtgcaagccaatc

SEQ ID NO: 785422 - DNA, 25 bp, Mus musculus
tctcggtagaggacagtgtcttcgt

SEQ ID NO: 785423 - DNA, 25 bp, Mus musculus
tctcggtagaggtcagtgtcttcgt

SEQ ID NO: 785424 - DNA, 25 bp, Mus musculus
tctcggtcacgaaccaaatctcggt

SEQ ID NO: 785425 - DNA, 25 bp, Mus musculus
tctcggtcacgatccaaatctcggt

SEQ ID NO: 785426 - DNA, 25 bp, Mus musculus
tctcggtcattgatattgggaataa

SEQ ID NO: 785427 - DNA, 25 bp, Mus musculus
tctcggtcattgttattgggaataa

SEQ ID NO: 785428 - DNA, 25 bp, Mus musculus
tctcggtcgaaccaaagacagtgca

SEQ ID NO: 785429 - DNA, 25 bp, Mus musculus
tctcggtcgaacgaaagacagtgca

SEQ ID NO: 785430 - DNA, 25 bp, Mus musculus
tctcggtctcggacccgatctcgat

SEQ ID NO: 785431 - DNA, 25 bp, Mus musculus
tctcggtctcggtcccgatctcgat

SEQ ID NO: 785432 - DNA, 25 bp, Mus musculus
tctcggtcttgaagccaagtttggg

SEQ ID NO: 785433 - DNA, 25 bp, Mus musculus
tctcggtcttgatgccaagtttggg

SEQ ID NO: 785434 - DNA, 25 bp, Mus musculus
tctcggtgactgacccatggagcca

SEQ ID NO: 785435 - DNA, 25 bp, Mus musculus
tctcggtgactgaggaaagtgcctc

SEQ ID NO: 785436 - DNA, 25 bp, Mus musculus
tctcggtgactgtcccatggagcca

SEQ ID NO: 785437 - DNA, 25 bp, Mus musculus
tctcggtgactgtggaaagtgcctc

SEQ ID NO: 785438 - DNA, 25 bp, Mus musculus
tctcggtgcagcagagcgatgctag

SEQ ID NO: 785439 - DNA, 25 bp, Mus musculus
tctcggtgcagctgagcgatgctag

SEQ ID NO: 785440 - DNA, 25 bp, Mus musculus
tctcggtgctatccgtggtcctcct

SEQ ID NO: 785441 - DNA, 25 bp, Mus musculus
tctcggtgctatgcgtggtcctcct

SEQ ID NO: 785442 - DNA, 25 bp, Mus musculus
tctcggtggtgtatggaaccatggt

SEQ ID NO: 785443 - DNA, 25 bp, Mus musculus
tctcggtggtgtttggaaccatggt

SEQ ID NO: 785444 - DNA, 25 bp, Mus musculus
tctcggtgtgataatcatcggctta

SEQ ID NO: 785445 - DNA, 25 bp, Mus musculus
tctcggtgtgattatcatcggctta

SEQ ID NO: 785446 - DNA, 25 bp, Mus musculus
tctcggttcagtctccgtgaagcgt

SEQ ID NO: 785447 - DNA, 25 bp, Mus musculus
tctcggttcagtgtccgtgaagcgt

SEQ ID NO: 785448 - DNA, 25 bp, Mus musculus
tctcgtaaaagaaaccatgccaaag

SEQ ID NO: 785449 - DNA, 25 bp, Mus musculus
tctcgtaaaagataccatgccaaag

SEQ ID NO: 785450 - DNA, 25 bp, Mus musculus
tctcgtaccaggcagcctttcctga

SEQ ID NO: 785451 - DNA, 25 bp, Mus musculus
tctcgtaccagggagcctttcctga

SEQ ID NO: 785452 - DNA, 25 bp, Mus musculus
tctcgtactgcacgcttcgagtacc

SEQ ID NO: 785453 - DNA, 25 bp, Mus musculus
tctcgtactgcaggcttcgagtacc

SEQ ID NO: 785454 - DNA, 25 bp, Mus musculus
tctcgtagaattcacaaaaaagctt

SEQ ID NO: 785455 - DNA, 25 bp, Mus musculus
tctcgtagaattgacaaaaaagctt

SEQ ID NO: 785456 - DNA, 25 bp, Mus musculus
tctcgtagacggaggactgatgaag

SEQ ID NO: 785457 - DNA, 25 bp, Mus musculus
tctcgtagacggtggactgatgaag

SEQ ID NO: 785458 - DNA, 25 bp, Mus musculus
tctcgtagccggagacccgaacaca

SEQ ID NO: 785459 - DNA, 25 bp, Mus musculus
tctcgtagccggtgacccgaacaca

SEQ ID NO: 785460 - DNA, 25 bp, Mus musculus
tctcgtcaccgaaatgctcagtggg

SEQ ID NO: 785461 - DNA, 25 bp, Mus musculus
tctcgtcaccgatatgctcagtggg

SEQ ID NO: 785462 - DNA, 25 bp, Mus musculus
tctcgtcactcccaaggttttcgga

SEQ ID NO: 785463 - DNA, 25 bp, Mus musculus
tctcgtcactccgaaggttttcgga

SEQ ID NO: 785464 - DNA, 25 bp, Mus musculus
tctcgtcagcctcattgagaatatc

SEQ ID NO: 785465 - DNA, 25 bp, Mus musculus
tctcgtcagcctgattgagaatatc

SEQ ID NO: 785466 - DNA, 25 bp, Mus musculus
tctcgtcattaacaatctggtatct

SEQ ID NO: 785467 - DNA, 25 bp, Mus musculus
tctcgtcattaagaatctggtatct

SEQ ID NO: 785468 - DNA, 25 bp, Mus musculus
tctcgtccagtgaagtacatggagt

SEQ ID NO: 785469 - DNA, 25 bp, Mus musculus
tctcgtccagtgtagtacatggagt

SEQ ID NO: 785470 - DNA, 25 bp, Mus musculus
tctcgtctgtggaagctgataccca

SEQ ID NO: 785471 - DNA, 25 bp, Mus musculus
tctcgtctgtggtagctgataccca

SEQ ID NO: 785472 - DNA, 25 bp, Mus musculus
tctcgtgaacgcaaggtgcctgcct

SEQ ID NO: 785473 - DNA, 25 bp, Mus musculus
tctcgtgaacgctaggtgcctgcct

SEQ ID NO: 785474 - DNA, 25 bp, Mus musculus
tctcgtgaagttcgaaaggctttac

SEQ ID NO: 785475 - DNA, 25 bp, Mus musculus
tctcgtgaagttggaaaggctttac

SEQ ID NO: 785476 - DNA, 25 bp, Mus musculus
tctcgtgctccaagaactgcctgtg

SEQ ID NO: 785477 - DNA, 25 bp, Mus musculus
tctcgtgctccatgaactgcctgtg

SEQ ID NO: 785478 - DNA, 25 bp, Mus musculus
tctcgtggaggcagctaaggactac

SEQ ID NO: 785479 - DNA, 25 bp, Mus musculus
tctcgtggaggctgctaaggactac

SEQ ID NO: 785480 - DNA, 25 bp, Mus musculus
tctcgtggcacaacattgactacac

SEQ ID NO: 785481 - DNA, 25 bp, Mus musculus
tctcgtggcacatcattgactacac

SEQ ID NO: 785482 - DNA, 25 bp, Mus musculus
tctcgtggcttgcagatacattcca

SEQ ID NO: 785483 - DNA, 25 bp, Mus musculus
tctcgtggcttggagatacattcca

SEQ ID NO: 785484 - DNA, 25 bp, Mus musculus
tctcgtggtcaaagagttttacggc

SEQ ID NO: 785485 - DNA, 25 bp, Mus musculus
tctcgtggtcaatgagttttacggc

SEQ ID NO: 785486 - DNA, 25 bp, Mus musculus
tctcgtggtccccagctaacctggg

SEQ ID NO: 785487 - DNA, 25 bp, Mus musculus
tctcgtggtcccgagctaacctggg

SEQ ID NO: 785488 - DNA, 25 bp, Mus musculus
tctcgtgtctggagtacgatgagca

SEQ ID NO: 785489 - DNA, 25 bp, Mus musculus
tctcgtgtctggtgtacgatgagca

SEQ ID NO: 785490 - DNA, 25 bp, Mus musculus
tctcgtgtgactccggaggctgtcc

SEQ ID NO: 785491 - DNA, 25 bp, Mus musculus
tctcgtgtgactgcggaggctgtcc

SEQ ID NO: 785492 - DNA, 25 bp, Mus musculus
tctcgtgtggtacggatggctcatc

SEQ ID NO: 785493 - DNA, 25 bp, Mus musculus
tctcgtgtggtagggatggctcatc

SEQ ID NO: 785494 - DNA, 25 bp, Mus musculus
tctcgttggaatatattgggacact

SEQ ID NO: 785495 - DNA, 25 bp, Mus musculus
tctcgttggaatttattgggacact

SEQ ID NO: 785496 - DNA, 25 bp, Mus musculus
tctcgttggaggcaactacatgaag

SEQ ID NO: 785497 - DNA, 25 bp, Mus musculus
tctcgttggagggaactacatgaag

SEQ ID NO: 785498 - DNA, 25 bp, Mus musculus
tctcgttgtgttaagagcctgctgg

SEQ ID NO: 785499 - DNA, 25 bp, Mus musculus
tctcgttgtgtttagagcctgctgg

SEQ ID NO: 785500 - DNA, 25 bp, Mus musculus
tctcgtttccttcagagtcagtcac

SEQ ID NO: 785501 - DNA, 25 bp, Mus musculus
tctcgtttccttgagagtcagtcac

SEQ ID NO: 785502 - DNA, 25 bp, Mus musculus
tctcgtttgcgaaatggaatgtctg

SEQ ID NO: 785503 - DNA, 25 bp, Mus musculus
tctcgtttgcgatatggaatgtctg

SEQ ID NO: 785504 - DNA, 25 bp, Mus musculus
tctctaaaacccatgccggcatgga

SEQ ID NO: 785505 - DNA, 25 bp, Mus musculus
tctctaaaacccttgccggcatgga

SEQ ID NO: 785506 - DNA, 25 bp, Mus musculus
tctctaaacgttacaaatctcatat

SEQ ID NO: 785507 - DNA, 25 bp, Mus musculus
tctctaaacgtttcaaatctcatat

SEQ ID NO: 785508 - DNA, 25 bp, Mus musculus
tctctaaagcatctattccaaaaac

SEQ ID NO: 785509 - DNA, 25 bp, Mus musculus
tctctaaagcatgtattccaaaaac

SEQ ID NO: 785510 - DNA, 25 bp, Mus musculus
tctctaaataaaaactagcgcattg

SEQ ID NO: 785511 - DNA, 25 bp, Mus musculus
tctctaaataaatactagcgcattg

SEQ ID NO: 785512 - DNA, 25 bp, Mus musculus
tctctaacaccgaggtgaccatcgg

SEQ ID NO: 785513 - DNA, 25 bp, Mus musculus
tctctaacaccgtggtgaccatcgg

SEQ ID NO: 785514 - DNA, 25 bp, Mus musculus
tctctaaccacaaagccattatggg

SEQ ID NO: 785515 - DNA, 25 bp, Mus musculus
tctctaaccacatagccattatggg

SEQ ID NO: 785516 - DNA, 25 bp, Mus musculus
tctctaagatccacggtggagaccc

SEQ ID NO: 785517 - DNA, 25 bp, Mus musculus
tctctaagatcctcggtggagaccc

SEQ ID NO: 785518 - DNA, 25 bp, Mus musculus
tctctaagatggagaagatctgagc

SEQ ID NO: 785519 - DNA, 25 bp, Mus musculus
tctctaagatggtgaagatctgagc

SEQ ID NO: 785520 - DNA, 25 bp, Mus musculus
tctctaaggctacaggctgctcagc

SEQ ID NO: 785521 - DNA, 25 bp, Mus musculus
tctctaaggctagaggctgctcagc

SEQ ID NO: 785522 - DNA, 25 bp, Mus musculus
tctctaagtcacaaggctccttcgc

SEQ ID NO: 785523 - DNA, 25 bp, Mus musculus
tctctaagtcactaggctccttcgc

SEQ ID NO: 785524 - DNA, 25 bp, Mus musculus
tctctaagtgtgacagtgcctattc

SEQ ID NO: 785525 - DNA, 25 bp, Mus musculus
tctctaagtgtgtcagtgcctattc

SEQ ID NO: 785526 - DNA, 25 bp, Mus musculus
tctctaatgcctcagtggtcaatcc

SEQ ID NO: 785527 - DNA, 25 bp, Mus musculus
tctctaatgcctgagtggtcaatcc

SEQ ID NO: 785528 - DNA, 25 bp, Mus musculus
tctctacaaactcccactgagattt

SEQ ID NO: 785529 - DNA, 25 bp, Mus musculus
tctctacaaactgccactgagattt

SEQ ID NO: 785530 - DNA, 25 bp, Mus musculus
tctctacaagaaccataaacgctgg

SEQ ID NO: 785531 - DNA, 25 bp, Mus musculus
tctctacaagaagcataaacgctgg

SEQ ID NO: 785532 - DNA, 25 bp, Mus musculus
tctctacacagacgtccagggttgc

SEQ ID NO: 785533 - DNA, 25 bp, Mus musculus
tctctacacagaggtccagggttgc

SEQ ID NO: 785534 - DNA, 25 bp, Mus musculus
tctctacacgtacgatgtgaacggg

SEQ ID NO: 785535 - DNA, 25 bp, Mus musculus
tctctacacgtaggatgtgaacggg

SEQ ID NO: 785536 - DNA, 25 bp, Mus musculus
tctctacactgtacccatccgggaa

SEQ ID NO: 785537 - DNA, 25 bp, Mus musculus
tctctacactgttcccatccgggaa

SEQ ID NO: 785538 - DNA, 25 bp, Mus musculus
tctctacatggacgtacaggccacc

SEQ ID NO: 785539 - DNA, 25 bp, Mus musculus
tctctacatggaggtacaggccacc

SEQ ID NO: 785540 - DNA, 25 bp, Mus musculus
tctctacattaacaacttggatgac

SEQ ID NO: 785541 - DNA, 25 bp, Mus musculus
tctctacattaagaacttggatgac

SEQ ID NO: 785542 - DNA, 25 bp, Mus musculus
tctctaccaaggctggctagccttt

SEQ ID NO: 785543 - DNA, 25 bp, Mus musculus
tctctaccaaggcttcctgatcatt

SEQ ID NO: 785544 - DNA, 25 bp, Mus musculus
tctctaccaagggtggctagccttt

SEQ ID NO: 785545 - DNA, 25 bp, Mus musculus
tctctaccaagggttcctgatcatt

SEQ ID NO: 785546 - DNA, 25 bp, Mus musculus
tctctacccaggagaactcttcgtc

SEQ ID NO: 785547 - DNA, 25 bp, Mus musculus
tctctacccaggtgaactcttcgtc

SEQ ID NO: 785548 - DNA, 25 bp, Mus musculus
tctctaccgacacatcgcagatctt

SEQ ID NO: 785549 - DNA, 25 bp, Mus musculus
tctctaccgacacatgtcatcatga

SEQ ID NO: 785550 - DNA, 25 bp, Mus musculus
tctctaccgacagatcgcagatctt

SEQ ID NO: 785551 - DNA, 25 bp, Mus musculus
tctctaccgacagatgtcatcatga

SEQ ID NO: 785552 - DNA, 25 bp, Mus musculus
tctctaccttcgactgctcgctggg

SEQ ID NO: 785553 - DNA, 25 bp, Mus musculus
tctctaccttcgtctgctcgctggg

SEQ ID NO: 785554 - DNA, 25 bp, Mus musculus
tctctacgagctagctcgggagagc

SEQ ID NO: 785555 - DNA, 25 bp, Mus musculus
tctctacgagcttgctcgggagagc

SEQ ID NO: 785556 - DNA, 25 bp, Mus musculus
tctctactaaggacttacgagttta

SEQ ID NO: 785557 - DNA, 25 bp, Mus musculus
tctctactaaggtcttacgagttta

SEQ ID NO: 785558 - DNA, 25 bp, Mus musculus
tctctactagcaaatctggttcttg

SEQ ID NO: 785559 - DNA, 25 bp, Mus musculus
tctctactagcatatctggttcttg

SEQ ID NO: 785560 - DNA, 25 bp, Mus musculus
tctctactttctcttggtgcgactt

SEQ ID NO: 785561 - DNA, 25 bp, Mus musculus
tctctactttctgttggtgcgactt

SEQ ID NO: 785562 - DNA, 25 bp, Mus musculus
tctctagaaaggcagaccgtgcaga

SEQ ID NO: 785563 - DNA, 25 bp, Mus musculus
tctctagaaagggagaccgtgcaga

SEQ ID NO: 785564 - DNA, 25 bp, Mus musculus
tctctagacggaaggtctgtgctta

SEQ ID NO: 785565 - DNA, 25 bp, Mus musculus
tctctagacggatggtctgtgctta

SEQ ID NO: 785566 - DNA, 25 bp, Mus musculus
tctctagagattcggaagaacatga

SEQ ID NO: 785567 - DNA, 25 bp, Mus musculus
tctctagagattgggaagaacatga

SEQ ID NO: 785568 - DNA, 25 bp, Mus musculus
tctctagatatacactatgaatgct

SEQ ID NO: 785569 - DNA, 25 bp, Mus musculus
tctctagatatagactatgaatgct

SEQ ID NO: 785570 - DNA, 25 bp, Mus musculus
tctctagatttcatcagagctattg

SEQ ID NO: 785571 - DNA, 25 bp, Mus musculus
tctctagatttcttcagagctattg

SEQ ID NO: 785572 - DNA, 25 bp, Mus musculus
tctctagcaaccagtgtgatttgcg

SEQ ID NO: 785573 - DNA, 25 bp, Mus musculus
tctctagcaacctgtgtgatttgcg

SEQ ID NO: 785574 - DNA, 25 bp, Mus musculus
tctctagcagaacacatcagccacg

SEQ ID NO: 785575 - DNA, 25 bp, Mus musculus
tctctagcagaagacatcagccacg

SEQ ID NO: 785576 - DNA, 25 bp, Mus musculus
tctctagcatgcactctgaggagga

SEQ ID NO: 785577 - DNA, 25 bp, Mus musculus
tctctagcatgctctctgaggagga

SEQ ID NO: 785578 - DNA, 25 bp, Mus musculus
tctctagccaagactctcatcaaat

SEQ ID NO: 785579 - DNA, 25 bp, Mus musculus
tctctagccaagtctctcatcaaat

SEQ ID NO: 785580 - DNA, 25 bp, Mus musculus
tctctagctagtcttgcttatcaaa

SEQ ID NO: 785581 - DNA, 25 bp, Mus musculus
tctctagctagtgttgcttatcaaa

SEQ ID NO: 785582 - DNA, 25 bp, Mus musculus
tctctaggataaagagagcctgctg

SEQ ID NO: 785583 - DNA, 25 bp, Mus musculus
tctctaggataatgagagcctgctg

SEQ ID NO: 785584 - DNA, 25 bp, Mus musculus
tctctagggacacggccttctgaag

SEQ ID NO: 785585 - DNA, 25 bp, Mus musculus
tctctagggacagggccttctgaag

SEQ ID NO: 785586 - DNA, 25 bp, Mus musculus
tctctagggtgacggaatgtggtca

SEQ ID NO: 785587 - DNA, 25 bp, Mus musculus
tctctagggtgagggaatgtggtca

SEQ ID NO: 785588 - DNA, 25 bp, Mus musculus
tctctaggttcgcatgcaggatcgt

SEQ ID NO: 785589 - DNA, 25 bp, Mus musculus
tctctaggttcggatgcaggatcgt

SEQ ID NO: 785590 - DNA, 25 bp, Mus musculus
tctctagtgcctcgaccggcttcgg

SEQ ID NO: 785591 - DNA, 25 bp, Mus musculus
tctctagtgcctggaccggcttcgg

SEQ ID NO: 785592 - DNA, 25 bp, Mus musculus
tctctataaacaaggacaacactgg

SEQ ID NO: 785593 - DNA, 25 bp, Mus musculus
tctctataaacatggacaacactgg

SEQ ID NO: 785594 - DNA, 25 bp, Mus musculus
tctctatagccgaaaagaaggacag

SEQ ID NO: 785595 - DNA, 25 bp, Mus musculus
tctctatagccgtaaagaaggacag

SEQ ID NO: 785596 - DNA, 25 bp, Mus musculus
tctctatagcctcgaaaaaatgacg

SEQ ID NO: 785597 - DNA, 25 bp, Mus musculus
tctctatagcctggaaaaaatgacg

SEQ ID NO: 785598 - DNA, 25 bp, Mus musculus
tctctatatttgagaggcaggcggt

SEQ ID NO: 785599 - DNA, 25 bp, Mus musculus
tctctatatttgtgaggcaggcggt

SEQ ID NO: 785600 - DNA, 25 bp, Mus musculus
tctctatctattagacacactgtag

SEQ ID NO: 785601 - DNA, 25 bp, Mus musculus
tctctatctatttgacacactgtag

SEQ ID NO: 785602 - DNA, 25 bp, Mus musculus
tctctatctgggaagttaaactgcc

SEQ ID NO: 785603 - DNA, 25 bp, Mus musculus
tctctatctgggtagttaaactgcc

SEQ ID NO: 785604 - DNA, 25 bp, Mus musculus
tctctatgacaacgatcactacaag

SEQ ID NO: 785605 - DNA, 25 bp, Mus musculus
tctctatgacaaggatcactacaag

SEQ ID NO: 785606 - DNA, 25 bp, Mus musculus
tctctatgagttacgcctcgtggcc

SEQ ID NO: 785607 - DNA, 25 bp, Mus musculus
tctctatgagtttcgcctcgtggcc

SEQ ID NO: 785608 - DNA, 25 bp, Mus musculus
tctctatgatcccagctatggtagc

SEQ ID NO: 785609 - DNA, 25 bp, Mus musculus
tctctatgatccgagctatggtagc

SEQ ID NO: 785610 - DNA, 25 bp, Mus musculus
tctctatgcaagctattgaccaggt

SEQ ID NO: 785611 - DNA, 25 bp, Mus musculus
tctctatgcaaggtattgaccaggt

SEQ ID NO: 785612 - DNA, 25 bp, Mus musculus
tctctatgcctcacagcctgtttag

SEQ ID NO: 785613 - DNA, 25 bp, Mus musculus
tctctatgcctctcagcctgtttag

SEQ ID NO: 785614 - DNA, 25 bp, Mus musculus
tctctatgctccctgtgctggtggg

SEQ ID NO: 785615 - DNA, 25 bp, Mus musculus
tctctatgctccgtgtgctggtggg

SEQ ID NO: 785616 - DNA, 25 bp, Mus musculus
tctctatgggaactggactgagtgc

SEQ ID NO: 785617 - DNA, 25 bp, Mus musculus
tctctatgggaagtggactgagtgc

SEQ ID NO: 785618 - DNA, 25 bp, Mus musculus
tctctatggtaccaaggaattcagc

SEQ ID NO: 785619 - DNA, 25 bp, Mus musculus
tctctatggtacgaaggaattcagc

SEQ ID NO: 785620 - DNA, 25 bp, Mus musculus
tctctatgtattctggaaatgggtg

SEQ ID NO: 785621 - DNA, 25 bp, Mus musculus
tctctatgtattgtggaaatgggtg

SEQ ID NO: 785622 - DNA, 25 bp, Mus musculus
tctctatgtcagaagtggaccttcc

SEQ ID NO: 785623 - DNA, 25 bp, Mus musculus
tctctatgtcagtagtggaccttcc

SEQ ID NO: 785624 - DNA, 25 bp, Mus musculus
tctctatgtccgatcttggttgcca

SEQ ID NO: 785625 - DNA, 25 bp, Mus musculus
tctctatgtccgttcttggttgcca

SEQ ID NO: 785626 - DNA, 25 bp, Mus musculus
tctctcaagcagcaaagtttgatcc

SEQ ID NO: 785627 - DNA, 25 bp, Mus musculus
tctctcaagcaggaaagtttgatcc

SEQ ID NO: 785628 - DNA, 25 bp, Mus musculus
tctctcaatacaagggactgtcttt

SEQ ID NO: 785629 - DNA, 25 bp, Mus musculus
tctctcaatacatgggactgtcttt

SEQ ID NO: 785630 - DNA, 25 bp, Mus musculus
tctctcaatggccaacacctgcata

SEQ ID NO: 785631 - DNA, 25 bp, Mus musculus
tctctcaatggcgaacacctgcata

SEQ ID NO: 785632 - DNA, 25 bp, Mus musculus
tctctcacaggcagactttctagtg

SEQ ID NO: 785633 - DNA, 25 bp, Mus musculus
tctctcacaggctgactttctagtg

SEQ ID NO: 785634 - DNA, 25 bp, Mus musculus
tctctcaccagcctgaataccaagg

SEQ ID NO: 785635 - DNA, 25 bp, Mus musculus
tctctcaccagcgtgaataccaagg

SEQ ID NO: 785636 - DNA, 25 bp, Mus musculus
tctctcacgtggcttggctgcttgt

SEQ ID NO: 785637 - DNA, 25 bp, Mus musculus
tctctcacgtgggttggctgcttgt

SEQ ID NO: 785638 - DNA, 25 bp, Mus musculus
tctctcagacatccataatgaagcc

SEQ ID NO: 785639 - DNA, 25 bp, Mus musculus
tctctcagacatgcataatgaagcc

SEQ ID NO: 785640 - DNA, 25 bp, Mus musculus
tctctcagcactcgccgggaaagtt

SEQ ID NO: 785641 - DNA, 25 bp, Mus musculus
tctctcagcactggccgggaaagtt

SEQ ID NO: 785642 - DNA, 25 bp, Mus musculus
tctctcagcagacaggagtcctccg

SEQ ID NO: 785643 - DNA, 25 bp, Mus musculus
tctctcagcagagaggagtcctccg

SEQ ID NO: 785644 - DNA, 25 bp, Mus musculus
tctctcagccaaatcaccaacatgt

SEQ ID NO: 785645 - DNA, 25 bp, Mus musculus
tctctcagccaattcaccaacatgt

SEQ ID NO: 785646 - DNA, 25 bp, Mus musculus
tctctcagcgagaataaaattcttc

SEQ ID NO: 785647 - DNA, 25 bp, Mus musculus
tctctcagcgagtataaaattcttc

SEQ ID NO: 785648 - DNA, 25 bp, Mus musculus
tctctcagcgtcagggctctcagaa

SEQ ID NO: 785649 - DNA, 25 bp, Mus musculus
tctctcagcgtctgggctctcagaa

SEQ ID NO: 785650 - DNA, 25 bp, Mus musculus
tctctcaggtacctagcagcaagct

SEQ ID NO: 785651 - DNA, 25 bp, Mus musculus
tctctcaggtacgtagcagcaagct

SEQ ID NO: 785652 - DNA, 25 bp, Mus musculus
tctctcatatccagggaccagcttc

SEQ ID NO: 785653 - DNA, 25 bp, Mus musculus
tctctcatatcctgggaccagcttc

SEQ ID NO: 785654 - DNA, 25 bp, Mus musculus
tctctcatgcatagtggagctcact

SEQ ID NO: 785655 - DNA, 25 bp, Mus musculus
tctctcatgcattgtggagctcact

SEQ ID NO: 785656 - DNA, 25 bp, Mus musculus
tctctcattgagctggcacagaagc

SEQ ID NO: 785657 - DNA, 25 bp, Mus musculus
tctctcattgaggtggcacagaagc

SEQ ID NO: 785658 - DNA, 25 bp, Mus musculus
tctctccaacctatgagcttgctct

SEQ ID NO: 785659 - DNA, 25 bp, Mus musculus
tctctccaacctttgagcttgctct

SEQ ID NO: 785660 - DNA, 25 bp, Mus musculus
tctctccaactcacagtttaaggag

SEQ ID NO: 785661 - DNA, 25 bp, Mus musculus
tctctccaactctcagtttaaggag

SEQ ID NO: 785662 - DNA, 25 bp, Mus musculus
tctctccaataacgtggccctggtc

SEQ ID NO: 785663 - DNA, 25 bp, Mus musculus
tctctccaataaggtggccctggtc

SEQ ID NO: 785664 - DNA, 25 bp, Mus musculus
tctctccaatgtagccgaatacggt

SEQ ID NO: 785665 - DNA, 25 bp, Mus musculus
tctctccaatgttgccgaatacggt

SEQ ID NO: 785666 - DNA, 25 bp, Mus musculus
tctctccacaccattgcaattatgc

SEQ ID NO: 785667 - DNA, 25 bp, Mus musculus
tctctccacacctttgcaattatgc

SEQ ID NO: 785668 - DNA, 25 bp, Mus musculus
tctctccacggtcctaagttgacat

SEQ ID NO: 785669 - DNA, 25 bp, Mus musculus
tctctccacggtgctaagttgacat

SEQ ID NO: 785670 - DNA, 25 bp, Mus musculus
tctctccagatcagattcagccgaa

SEQ ID NO: 785671 - DNA, 25 bp, Mus musculus
tctctccagatctgattcagccgaa

SEQ ID NO: 785672 - DNA, 25 bp, Mus musculus
tctctccagattcaggggctccggg

SEQ ID NO: 785673 - DNA, 25 bp, Mus musculus
tctctccagattgaggggctccggg

SEQ ID NO: 785674 - DNA, 25 bp, Mus musculus
tctctccatagacgagatagaagtg

SEQ ID NO: 785675 - DNA, 25 bp, Mus musculus
tctctccatagaggagatagaagtg

SEQ ID NO: 785676 - DNA, 25 bp, Mus musculus
tctctcccaagcaccgtttgcaatg

SEQ ID NO: 785677 - DNA, 25 bp, Mus musculus
tctctcccaagctccgtttgcaatg

SEQ ID NO: 785678 - DNA, 25 bp, Mus musculus
tctctcccaggaatacaacgatctc

SEQ ID NO: 785679 - DNA, 25 bp, Mus musculus
tctctcccaggattacaacgatctc

SEQ ID NO: 785680 - DNA, 25 bp, Mus musculus
tctctcccagggatactttgcagtg

SEQ ID NO: 785681 - DNA, 25 bp, Mus musculus
tctctcccagggttactttgcagtg

SEQ ID NO: 785682 - DNA, 25 bp, Mus musculus
tctctccccaacagtttgattatcg

SEQ ID NO: 785683 - DNA, 25 bp, Mus musculus
tctctccccaactgtttgattatcg

SEQ ID NO: 785684 - DNA, 25 bp, Mus musculus
tctctcccggcgaggagcgccgaag

SEQ ID NO: 785685 - DNA, 25 bp, Mus musculus
tctctcccggcgtggagcgccgaag

SEQ ID NO: 785686 - DNA, 25 bp, Mus musculus
tctctccctcagaaagaccttcttg

SEQ ID NO: 785687 - DNA, 25 bp, Mus musculus
tctctccctcagtaagaccttcttg

SEQ ID NO: 785688 - DNA, 25 bp, Mus musculus
tctctccctcggcagtggttggctg

SEQ ID NO: 785689 - DNA, 25 bp, Mus musculus
tctctccctcgggagtggttggctg

SEQ ID NO: 785690 - DNA, 25 bp, Mus musculus
tctctccctctcatttaagaaagcc

SEQ ID NO: 785691 - DNA, 25 bp, Mus musculus
tctctccctctcttttaagaaagcc

SEQ ID NO: 785692 - DNA, 25 bp, Mus musculus
tctctccggagccagcctttgctga

SEQ ID NO: 785693 - DNA, 25 bp, Mus musculus
tctctccggagcgagcctttgctga

SEQ ID NO: 785694 - DNA, 25 bp, Mus musculus
tctctccgggaacattataacccag

SEQ ID NO: 785695 - DNA, 25 bp, Mus musculus
tctctccgggaagattataacccag

SEQ ID NO: 785696 - DNA, 25 bp, Mus musculus
tctctccgggacaggacgctggccg

SEQ ID NO: 785697 - DNA, 25 bp, Mus musculus
tctctccgggactggacgctggccg

SEQ ID NO: 785698 - DNA, 25 bp, Mus musculus
tctctcctatgcctcaagtggagcc

SEQ ID NO: 785699 - DNA, 25 bp, Mus musculus
tctctcctatgcgtcaagtggagcc

SEQ ID NO: 785700 - DNA, 25 bp, Mus musculus
tctctcctcatgatcctgatatgtg

SEQ ID NO: 785701 - DNA, 25 bp, Mus musculus
tctctcctcatgttcctgatatgtg

SEQ ID NO: 785702 - DNA, 25 bp, Mus musculus
tctctcctgtacaagcgaacacgga

SEQ ID NO: 785703 - DNA, 25 bp, Mus musculus
tctctcctgtactagcgaacacgga

SEQ ID NO: 785704 - DNA, 25 bp, Mus musculus
tctctcctgtagcatgagccagaca

SEQ ID NO: 785705 - DNA, 25 bp, Mus musculus
tctctcctgtaggatgagccagaca

SEQ ID NO: 785706 - DNA, 25 bp, Mus musculus
tctctccttggaataggacgaccag

SEQ ID NO: 785707 - DNA, 25 bp, Mus musculus
tctctccttggattaggacgaccag

SEQ ID NO: 785708 - DNA, 25 bp, Mus musculus
tctctccttggcacaggaggatact

SEQ ID NO: 785709 - DNA, 25 bp, Mus musculus
tctctccttggctcaggaggatact

SEQ ID NO: 785710 - DNA, 25 bp, Mus musculus
tctctcgcgagaacaggtggctctg

SEQ ID NO: 785711 - DNA, 25 bp, Mus musculus
tctctcgcgagatcaggtggctctg

SEQ ID NO: 785712 - DNA, 25 bp, Mus musculus
tctctcgctgaacgcgtacagactg

SEQ ID NO: 785713 - DNA, 25 bp, Mus musculus
tctctcgctgaaggcgtacagactg

SEQ ID NO: 785714 - DNA, 25 bp, Mus musculus
tctctcggaactcagtggcaccgtg

SEQ ID NO: 785715 - DNA, 25 bp, Mus musculus
tctctcggaactgagtggcaccgtg

SEQ ID NO: 785716 - DNA, 25 bp, Mus musculus
tctctcggaatcagcggtttgttct

SEQ ID NO: 785717 - DNA, 25 bp, Mus musculus
tctctcggaatctgcggtttgttct

SEQ ID NO: 785718 - DNA, 25 bp, Mus musculus
tctctcggattaagaacagccctga

SEQ ID NO: 785719 - DNA, 25 bp, Mus musculus
tctctcggattatgaacagccctga

SEQ ID NO: 785720 - DNA, 25 bp, Mus musculus
tctctcgggaaacgactcactcgtc

SEQ ID NO: 785721 - DNA, 25 bp, Mus musculus
tctctcgggaaaggactcactcgtc

SEQ ID NO: 785722 - DNA, 25 bp, Mus musculus
tctctcggtatcagcagttcaagga

SEQ ID NO: 785723 - DNA, 25 bp, Mus musculus
tctctcggtatctgcagttcaagga

SEQ ID NO: 785724 - DNA, 25 bp, Mus musculus
tctctcgtactgcaggcttcgagta

SEQ ID NO: 785725 - DNA, 25 bp, Mus musculus
tctctcgtactggaggcttcgagta

SEQ ID NO: 785726 - DNA, 25 bp, Mus musculus
tctctctaaatgagatccggcagct

SEQ ID NO: 785727 - DNA, 25 bp, Mus musculus
tctctctaaatgtgatccggcagct

SEQ ID NO: 785728 - DNA, 25 bp, Mus musculus
tctctctcagcgactgggctctcag

SEQ ID NO: 785729 - DNA, 25 bp, Mus musculus
tctctctcagcgtctgggctctcag

SEQ ID NO: 785730 - DNA, 25 bp, Mus musculus
tctctctcaggacactgggttccct

SEQ ID NO: 785731 - DNA, 25 bp, Mus musculus
tctctctcaggagactgggttccct

SEQ ID NO: 785732 - DNA, 25 bp, Mus musculus
tctctctcctcaagatcctgatatg

SEQ ID NO: 785733 - DNA, 25 bp, Mus musculus
tctctctcctcatgatcctgatatg

SEQ ID NO: 785734 - DNA, 25 bp, Mus musculus
tctctctcgaggacggctgcggaaa

SEQ ID NO: 785735 - DNA, 25 bp, Mus musculus
tctctctcgaggtcggctgcggaaa

SEQ ID NO: 785736 - DNA, 25 bp, Mus musculus
tctctctcgctactttgcaccaaag

SEQ ID NO: 785737 - DNA, 25 bp, Mus musculus
tctctctcgctagtttgcaccaaag

SEQ ID NO: 785738 - DNA, 25 bp, Mus musculus
tctctctctgatatggaaagttctt

SEQ ID NO: 785739 - DNA, 25 bp, Mus musculus
tctctctctgatttggaaagttctt

SEQ ID NO: 785740 - DNA, 25 bp, Mus musculus
tctctctctgctcaaaacctcggtg

SEQ ID NO: 785741 - DNA, 25 bp, Mus musculus
tctctctctgctgaaaacctcggtg

SEQ ID NO: 785742 - DNA, 25 bp, Mus musculus
tctctctcttgtccaacgtcagcta

SEQ ID NO: 785743 - DNA, 25 bp, Mus musculus
tctctctcttgtgcaacgtcagcta

SEQ ID NO: 785744 - DNA, 25 bp, Mus musculus
tctctctgatttcgaaagttcttca

SEQ ID NO: 785745 - DNA, 25 bp, Mus musculus
tctctctgatttggaaagttcttca

SEQ ID NO: 785746 - DNA, 25 bp, Mus musculus
tctctctgcaggagattatagagcg

SEQ ID NO: 785747 - DNA, 25 bp, Mus musculus
tctctctgcaggtgattatagagcg

SEQ ID NO: 785748 - DNA, 25 bp, Mus musculus
tctctctgcccaagagaacgtggtg

SEQ ID NO: 785749 - DNA, 25 bp, Mus musculus
tctctctgcccatgagaacgtggtg

SEQ ID NO: 785750 - DNA, 25 bp, Mus musculus
tctctctgcgatcagctgtgtcctg

SEQ ID NO: 785751 - DNA, 25 bp, Mus musculus
tctctctgcgatgagctgtgtcctg

SEQ ID NO: 785752 - DNA, 25 bp, Mus musculus
tctctctgctgtcgagcttcggctc

SEQ ID NO: 785753 - DNA, 25 bp, Mus musculus
tctctctgctgtggagcttcggctc

SEQ ID NO: 785754 - DNA, 25 bp, Mus musculus
tctctctggatgccaacccagcagg

SEQ ID NO: 785755 - DNA, 25 bp, Mus musculus
tctctctggatggcaacccagcagg

SEQ ID NO: 785756 - DNA, 25 bp, Mus musculus
tctctctgggctagccagggctctc

SEQ ID NO: 785757 - DNA, 25 bp, Mus musculus
tctctctgggcttgccagggctctc

SEQ ID NO: 785758 - DNA, 25 bp, Mus musculus
tctctctgtgttagtccccacaggc

SEQ ID NO: 785759 - DNA, 25 bp, Mus musculus
tctctctgtgtttgtccccacaggc

SEQ ID NO: 785760 - DNA, 25 bp, Mus musculus
tctctcttaacaacaggttctgccg

SEQ ID NO: 785761 - DNA, 25 bp, Mus musculus
tctctcttaacatcaggttctgccg

SEQ ID NO: 785762 - DNA, 25 bp, Mus musculus
tctctcttccagcgccaggtatcat

SEQ ID NO: 785763 - DNA, 25 bp, Mus musculus
tctctcttccagggccaggtatcat

SEQ ID NO: 785764 - DNA, 25 bp, Mus musculus
tctctcttctgaccactgcaggctt

SEQ ID NO: 785765 - DNA, 25 bp, Mus musculus
tctctcttctgagcactgcaggctt

SEQ ID NO: 785766 - DNA, 25 bp, Mus musculus
tctctcttggccaggagatacattg

SEQ ID NO: 785767 - DNA, 25 bp, Mus musculus
tctctcttggcctggagatacattg

SEQ ID NO: 785768 - DNA, 25 bp, Mus musculus
tctctctttgggaatcgtcggctga

SEQ ID NO: 785769 - DNA, 25 bp, Mus musculus
tctctctttgggtatcgtcggctga

SEQ ID NO: 785770 - DNA, 25 bp, Mus musculus
tctctgaaaccaaatgaccagatct

SEQ ID NO: 785771 - DNA, 25 bp, Mus musculus
tctctgaaaccatatgaccagatct

SEQ ID NO: 785772 - DNA, 25 bp, Mus musculus
tctctgaaacttcgaggcccgtgtc

SEQ ID NO: 785773 - DNA, 25 bp, Mus musculus
tctctgaaacttggaggcccgtgtc

SEQ ID NO: 785774 - DNA, 25 bp, Mus musculus
tctctgaaagaacgaggtgctaagc

SEQ ID NO: 785775 - DNA, 25 bp, Mus musculus
tctctgaaagaaggaggtgctaagc

SEQ ID NO: 785776 - DNA, 25 bp, Mus musculus
tctctgaaaggtcaaatacatggcc

SEQ ID NO: 785777 - DNA, 25 bp, Mus musculus
tctctgaaaggtgaaatacatggcc

SEQ ID NO: 785778 - DNA, 25 bp, Mus musculus
tctctgaaatcgactggctgaacct

SEQ ID NO: 785779 - DNA, 25 bp, Mus musculus
tctctgaaatcgtctggctgaacct

SEQ ID NO: 785780 - DNA, 25 bp, Mus musculus
tctctgaacagacgcatccagctgg

SEQ ID NO: 785781 - DNA, 25 bp, Mus musculus
tctctgaacagaggcatccagctgg

SEQ ID NO: 785782 - DNA, 25 bp, Mus musculus
tctctgaaccgtccggtgctcactg

SEQ ID NO: 785783 - DNA, 25 bp, Mus musculus
tctctgaaccgtgcggtgctcactg

SEQ ID NO: 785784 - DNA, 25 bp, Mus musculus
tctctgaagaagacaccgctgcttt

SEQ ID NO: 785785 - DNA, 25 bp, Mus musculus
tctctgaagaagtcaccgctgcttt

SEQ ID NO: 785786 - DNA, 25 bp, Mus musculus
tctctgaagcgactgcacgttcctg

SEQ ID NO: 785787 - DNA, 25 bp, Mus musculus
tctctgaagcgagtgcacgttcctg

SEQ ID NO: 785788 - DNA, 25 bp, Mus musculus
tctctgaagcttcagatctgggaca

SEQ ID NO: 785789 - DNA, 25 bp, Mus musculus
tctctgaagcttgagatctgggaca

SEQ ID NO: 785790 - DNA, 25 bp, Mus musculus
tctctgaaggacaactgagagcctt

SEQ ID NO: 785791 - DNA, 25 bp, Mus musculus
tctctgaaggactactgagagcctt

SEQ ID NO: 785792 - DNA, 25 bp, Mus musculus
tctctgaaggcacaagggccactct

SEQ ID NO: 785793 - DNA, 25 bp, Mus musculus
tctctgaaggcagaagggccactct

SEQ ID NO: 785794 - DNA, 25 bp, Mus musculus
tctctgaagggacccgacagatcca

SEQ ID NO: 785795 - DNA, 25 bp, Mus musculus
tctctgaagggagccgacagatcca

SEQ ID NO: 785796 - DNA, 25 bp, Mus musculus
tctctgaatagacgaagtggacact

SEQ ID NO: 785797 - DNA, 25 bp, Mus musculus
tctctgaatagaggaagtggacact

SEQ ID NO: 785798 - DNA, 25 bp, Mus musculus
tctctgaattacagtgaatgggccc

SEQ ID NO: 785799 - DNA, 25 bp, Mus musculus
tctctgaattactgtgaatgggccc

SEQ ID NO: 785800 - DNA, 25 bp, Mus musculus
tctctgaattcacatactacctgtc

SEQ ID NO: 785801 - DNA, 25 bp, Mus musculus
tctctgaattcagatactacctgtc

SEQ ID NO: 785802 - DNA, 25 bp, Mus musculus
tctctgacacacagtcgcagggaag

SEQ ID NO: 785803 - DNA, 25 bp, Mus musculus
tctctgacacactgtcgcagggaag

SEQ ID NO: 785804 - DNA, 25 bp, Mus musculus
tctctgacacagatcctggggtggt

SEQ ID NO: 785805 - DNA, 25 bp, Mus musculus
tctctgacacagttcctggggtggt

SEQ ID NO: 785806 - DNA, 25 bp, Mus musculus
tctctgacacctagggaatctccct

SEQ ID NO: 785807 - DNA, 25 bp, Mus musculus
tctctgacacctatccagagcggtg

SEQ ID NO: 785808 - DNA, 25 bp, Mus musculus
tctctgacaccttgggaatctccct

SEQ ID NO: 785809 - DNA, 25 bp, Mus musculus
tctctgacacctttccagagcggtg

SEQ ID NO: 785810 - DNA, 25 bp, Mus musculus
tctctgacaggtaaaaattcacgca

SEQ ID NO: 785811 - DNA, 25 bp, Mus musculus
tctctgacaggttaaaattcacgca

SEQ ID NO: 785812 - DNA, 25 bp, Mus musculus
tctctgacatcccagaagattctcc

SEQ ID NO: 785813 - DNA, 25 bp, Mus musculus
tctctgacatccgagaagattctcc

SEQ ID NO: 785814 - DNA, 25 bp, Mus musculus
tctctgacctaaactggtatttggg

SEQ ID NO: 785815 - DNA, 25 bp, Mus musculus
tctctgacctaatctggtatttggg

SEQ ID NO: 785816 - DNA, 25 bp, Mus musculus
tctctgacctcacgcagcatgggac

SEQ ID NO: 785817 - DNA, 25 bp, Mus musculus
tctctgacctcaggcagcatgggac

SEQ ID NO: 785818 - DNA, 25 bp, Mus musculus
tctctgacgatgaccaaggtctctt

SEQ ID NO: 785819 - DNA, 25 bp, Mus musculus
tctctgacgatgtccaaggtctctt

SEQ ID NO: 785820 - DNA, 25 bp, Mus musculus
tctctgactcagcaagaaacgcgct

SEQ ID NO: 785821 - DNA, 25 bp, Mus musculus
tctctgactcaggaagaaacgcgct

SEQ ID NO: 785822 - DNA, 25 bp, Mus musculus
tctctgactgaacatactgggatgg

SEQ ID NO: 785823 - DNA, 25 bp, Mus musculus
tctctgactgaagatactgggatgg

SEQ ID NO: 785824 - DNA, 25 bp, Mus musculus
tctctgagaactcgatctgtttcta

SEQ ID NO: 785825 - DNA, 25 bp, Mus musculus
tctctgagaactggatctgtttcta

SEQ ID NO: 785826 - DNA, 25 bp, Mus musculus
tctctgagagcaacatcaacctctg

SEQ ID NO: 785827 - DNA, 25 bp, Mus musculus
tctctgagagcatcatcaacctctg

SEQ ID NO: 785828 - DNA, 25 bp, Mus musculus
tctctgagcagactcttgaggcata

SEQ ID NO: 785829 - DNA, 25 bp, Mus musculus
tctctgagcagagtcttgaggcata

SEQ ID NO: 785830 - DNA, 25 bp, Mus musculus
tctctgagcagtcccttcagggctg

SEQ ID NO: 785831 - DNA, 25 bp, Mus musculus
tctctgagcagtgccttcagggctg

SEQ ID NO: 785832 - DNA, 25 bp, Mus musculus
tctctgagctcacggaagactggac

SEQ ID NO: 785833 - DNA, 25 bp, Mus musculus
tctctgagctcagggaagactggac

SEQ ID NO: 785834 - DNA, 25 bp, Mus musculus
tctctgagctctccatctgtctgct

SEQ ID NO: 785835 - DNA, 25 bp, Mus musculus
tctctgagctctgcatctgtctgct

SEQ ID NO: 785836 - DNA, 25 bp, Mus musculus
tctctgaggatgagatcattgtcac

SEQ ID NO: 785837 - DNA, 25 bp, Mus musculus
tctctgaggatgtgatcattgtcac

SEQ ID NO: 785838 - DNA, 25 bp, Mus musculus
tctctgaggccactattcacgggac

SEQ ID NO: 785839 - DNA, 25 bp, Mus musculus
tctctgaggccagtattcacgggac

SEQ ID NO: 785840 - DNA, 25 bp, Mus musculus
tctctgaggcccctgagcggcgagg

SEQ ID NO: 785841 - DNA, 25 bp, Mus musculus
tctctgaggcccgtgagcggcgagg

SEQ ID NO: 785842 - DNA, 25 bp, Mus musculus
tctctgagttgcatccattggccca

SEQ ID NO: 785843 - DNA, 25 bp, Mus musculus
tctctgagttgcttccattggccca

SEQ ID NO: 785844 - DNA, 25 bp, Mus musculus
tctctgataaaaatggatattcata

SEQ ID NO: 785845 - DNA, 25 bp, Mus musculus
tctctgataaaattggatattcata

SEQ ID NO: 785846 - DNA, 25 bp, Mus musculus
tctctgatcagtaccatgacatcct

SEQ ID NO: 785847 - DNA, 25 bp, Mus musculus
tctctgatcagttccatgacatcct

SEQ ID NO: 785848 - DNA, 25 bp, Mus musculus
tctctgatccaacacatgaaggctt

SEQ ID NO: 785849 - DNA, 25 bp, Mus musculus
tctctgatccaagacatgaaggctt

SEQ ID NO: 785850 - DNA, 25 bp, Mus musculus
tctctgatccagaccttccaaaagg

SEQ ID NO: 785851 - DNA, 25 bp, Mus musculus
tctctgatccagtccttccaaaagg

SEQ ID NO: 785852 - DNA, 25 bp, Mus musculus
tctctgatggtacaggaagaaccca

SEQ ID NO: 785853 - DNA, 25 bp, Mus musculus
tctctgatggtagaggaagaaccca

SEQ ID NO: 785854 - DNA, 25 bp, Mus musculus
tctctgatggttatgattgccatga

SEQ ID NO: 785855 - DNA, 25 bp, Mus musculus
tctctgatggttttgattgccatga

SEQ ID NO: 785856 - DNA, 25 bp, Mus musculus
tctctgcaaactagataggaaagta

SEQ ID NO: 785857 - DNA, 25 bp, Mus musculus
tctctgcaaacttgataggaaagta

SEQ ID NO: 785858 - DNA, 25 bp, Mus musculus
tctctgcaacaaacacacgtagcca

SEQ ID NO: 785859 - DNA, 25 bp, Mus musculus
tctctgcaacaatcacacgtagcca

SEQ ID NO: 785860 - DNA, 25 bp, Mus musculus
tctctgcaactgaaagcattcttag

SEQ ID NO: 785861 - DNA, 25 bp, Mus musculus
tctctgcaactgtaagcattcttag

SEQ ID NO: 785862 - DNA, 25 bp, Mus musculus
tctctgcacgaacggctttccacgt

SEQ ID NO: 785863 - DNA, 25 bp, Mus musculus
tctctgcacgaagggctttccacgt

SEQ ID NO: 785864 - DNA, 25 bp, Mus musculus
tctctgcagatacctggagcaaata

SEQ ID NO: 785865 - DNA, 25 bp, Mus musculus
tctctgcagatagctggagcaaata

SEQ ID NO: 785866 - DNA, 25 bp, Mus musculus
tctctgcagctaagaggccgggcaa

SEQ ID NO: 785867 - DNA, 25 bp, Mus musculus
tctctgcagctatgaggccgggcaa

SEQ ID NO: 785868 - DNA, 25 bp, Mus musculus
tctctgcaggaaaagtgaatcttgg

SEQ ID NO: 785869 - DNA, 25 bp, Mus musculus
tctctgcaggaatagtgaatcttgg

SEQ ID NO: 785870 - DNA, 25 bp, Mus musculus
tctctgcaggtacgtgctaaggcct

SEQ ID NO: 785871 - DNA, 25 bp, Mus musculus
tctctgcaggtaggtgctaaggcct

SEQ ID NO: 785872 - DNA, 25 bp, Mus musculus
tctctgcagtaacaataaaagcgcc

SEQ ID NO: 785873 - DNA, 25 bp, Mus musculus
tctctgcagtaagaataaaagcgcc

SEQ ID NO: 785874 - DNA, 25 bp, Mus musculus
tctctgcatggcatctgtccccaga

SEQ ID NO: 785875 - DNA, 25 bp, Mus musculus
tctctgcatggcttctgtccccaga

SEQ ID NO: 785876 - DNA, 25 bp, Mus musculus
tctctgccagaaaggccgatgcctc

SEQ ID NO: 785877 - DNA, 25 bp, Mus musculus
tctctgccagaatggccgatgcctc

SEQ ID NO: 785878 - DNA, 25 bp, Mus musculus
tctctgccagccagcatctgacaag

SEQ ID NO: 785879 - DNA, 25 bp, Mus musculus
tctctgccagcctgcatctgacaag

SEQ ID NO: 785880 - DNA, 25 bp, Mus musculus
tctctgcccgcaagatgatggctga

SEQ ID NO: 785881 - DNA, 25 bp, Mus musculus
tctctgcccgcatgatgatggctga

SEQ ID NO: 785882 - DNA, 25 bp, Mus musculus
tctctgcctgtcactggtgtctaac

SEQ ID NO: 785883 - DNA, 25 bp, Mus musculus
tctctgcctgtctctggtgtctaac

SEQ ID NO: 785884 - DNA, 25 bp, Mus musculus
tctctgcctttgcaaacatcttgtc

SEQ ID NO: 785885 - DNA, 25 bp, Mus musculus
tctctgcctttggaaacatcttgtc

SEQ ID NO: 785886 - DNA, 25 bp, Mus musculus
tctctgcgaaagcacatgaaagttc

SEQ ID NO: 785887 - DNA, 25 bp, Mus musculus
tctctgcgaaaggacatgaaagttc

SEQ ID NO: 785888 - DNA, 25 bp, Mus musculus
tctctgcgcatacatcttgtttgtc

SEQ ID NO: 785889 - DNA, 25 bp, Mus musculus
tctctgcgcatagatcttgtttgtc

SEQ ID NO: 785890 - DNA, 25 bp, Mus musculus
tctctgcgctcccagttggccaaga

SEQ ID NO: 785891 - DNA, 25 bp, Mus musculus
tctctgcgctccgagttggccaaga

SEQ ID NO: 785892 - DNA, 25 bp, Mus musculus
tctctgcggttgagttgggctgtca

SEQ ID NO: 785893 - DNA, 25 bp, Mus musculus
tctctgcggttgtgttgggctgtca

SEQ ID NO: 785894 - DNA, 25 bp, Mus musculus
tctctgcgtggcaggccgctgtctg

SEQ ID NO: 785895 - DNA, 25 bp, Mus musculus
tctctgcgtggctggccgctgtctg

SEQ ID NO: 785896 - DNA, 25 bp, Mus musculus
tctctgctccctacccttggatgag

SEQ ID NO: 785897 - DNA, 25 bp, Mus musculus
tctctgctcccttcccttggatgag

SEQ ID NO: 785898 - DNA, 25 bp, Mus musculus
tctctgctcgataagtgcctctata

SEQ ID NO: 785899 - DNA, 25 bp, Mus musculus
tctctgctcgattagtgcctctata

SEQ ID NO: 785900 - DNA, 25 bp, Mus musculus
tctctgctgatgagtctggatctga

SEQ ID NO: 785901 - DNA, 25 bp, Mus musculus
tctctgctgatgtgtctggatctga

SEQ ID NO: 785902 - DNA, 25 bp, Mus musculus
tctctgctgctacgtggccaagaag

SEQ ID NO: 785903 - DNA, 25 bp, Mus musculus
tctctgctgctaggtggccaagaag

SEQ ID NO: 785904 - DNA, 25 bp, Mus musculus
tctctgctgctcaagatagttctgg

SEQ ID NO: 785905 - DNA, 25 bp, Mus musculus
tctctgctgctctagatagttctgg

SEQ ID NO: 785906 - DNA, 25 bp, Mus musculus
tctctgctggatccctcttatgcta

SEQ ID NO: 785907 - DNA, 25 bp, Mus musculus
tctctgctggatgcctcttatgcta

SEQ ID NO: 785908 - DNA, 25 bp, Mus musculus
tctctgctggtacaagaggccatta

SEQ ID NO: 785909 - DNA, 25 bp, Mus musculus
tctctgctggtagaagaggccatta

SEQ ID NO: 785910 - DNA, 25 bp, Mus musculus
tctctgctgtagaagacaaagattt

SEQ ID NO: 785911 - DNA, 25 bp, Mus musculus
tctctgctgtagactgcggtaagtg

SEQ ID NO: 785912 - DNA, 25 bp, Mus musculus
tctctgctgtagtagacaaagattt

SEQ ID NO: 785913 - DNA, 25 bp, Mus musculus
tctctgctgtagtctgcggtaagtg

SEQ ID NO: 785914 - DNA, 25 bp, Mus musculus
tctctgcttcccagaagatccgttc

SEQ ID NO: 785915 - DNA, 25 bp, Mus musculus
tctctgcttccctgaagatccgttc

SEQ ID NO: 785916 - DNA, 25 bp, Mus musculus
tctctgctttccagtaggactctgg

SEQ ID NO: 785917 - DNA, 25 bp, Mus musculus
tctctgctttcctgtaggactctgg

SEQ ID NO: 785918 - DNA, 25 bp, Mus musculus
tctctgcttttgatccagggaggcg

SEQ ID NO: 785919 - DNA, 25 bp, Mus musculus
tctctgcttttgttccagggaggcg

SEQ ID NO: 785920 - DNA, 25 bp, Mus musculus
tctctggaaaaaccaccgtccatgg

SEQ ID NO: 785921 - DNA, 25 bp, Mus musculus
tctctggaaaaagcaccgtccatgg

SEQ ID NO: 785922 - DNA, 25 bp, Mus musculus
tctctggaaaggactgccagcacaa

SEQ ID NO: 785923 - DNA, 25 bp, Mus musculus
tctctggaaaggtctgccagcacaa

SEQ ID NO: 785924 - DNA, 25 bp, Mus musculus
tctctggaagagattgaaagccacc

SEQ ID NO: 785925 - DNA, 25 bp, Mus musculus
tctctggaagagtttgaaagccacc

SEQ ID NO: 785926 - DNA, 25 bp, Mus musculus
tctctggacaagaacggtgtggacc

SEQ ID NO: 785927 - DNA, 25 bp, Mus musculus
tctctggacaagtacggtgtggacc

SEQ ID NO: 785928 - DNA, 25 bp, Mus musculus
tctctggacatcaataagactaggc

SEQ ID NO: 785929 - DNA, 25 bp, Mus musculus
tctctggacatctataagactaggc

SEQ ID NO: 785930 - DNA, 25 bp, Mus musculus
tctctggacatgaaactgcctgggc

SEQ ID NO: 785931 - DNA, 25 bp, Mus musculus
tctctggacatgtaactgcctgggc

SEQ ID NO: 785932 - DNA, 25 bp, Mus musculus
tctctggacccgatttgttttctct

SEQ ID NO: 785933 - DNA, 25 bp, Mus musculus
tctctggacccgttttgttttctct

SEQ ID NO: 785934 - DNA, 25 bp, Mus musculus
tctctggaccctctccaggtgatgg

SEQ ID NO: 785935 - DNA, 25 bp, Mus musculus
tctctggaccctgtccaggtgatgg

SEQ ID NO: 785936 - DNA, 25 bp, Mus musculus
tctctggagaacctggaggatgtcc

SEQ ID NO: 785937 - DNA, 25 bp, Mus musculus
tctctggagaacgtggaggatgtcc

SEQ ID NO: 785938 - DNA, 25 bp, Mus musculus
tctctggagactacaccctgctgta

SEQ ID NO: 785939 - DNA, 25 bp, Mus musculus
tctctggagacttcaccctgctgta

SEQ ID NO: 785940 - DNA, 25 bp, Mus musculus
tctctggagagactacaaagttctg

SEQ ID NO: 785941 - DNA, 25 bp, Mus musculus
tctctggagagagtacaaagttctg

SEQ ID NO: 785942 - DNA, 25 bp, Mus musculus
tctctggagctgctttcggaggccc

SEQ ID NO: 785943 - DNA, 25 bp, Mus musculus
tctctggagctggtttcggaggccc

SEQ ID NO: 785944 - DNA, 25 bp, Mus musculus
tctctggagtaaaggatgagccaca

SEQ ID NO: 785945 - DNA, 25 bp, Mus musculus
tctctggagtaatggatgagccaca

SEQ ID NO: 785946 - DNA, 25 bp, Mus musculus
tctctggatacaaactctactggag

SEQ ID NO: 785947 - DNA, 25 bp, Mus musculus
tctctggatacatactctactggag

SEQ ID NO: 785948 - DNA, 25 bp, Mus musculus
tctctggcaaacattgacgatgttg

SEQ ID NO: 785949 - DNA, 25 bp, Mus musculus
tctctggcaaactttgacgatgttg

SEQ ID NO: 785950 - DNA, 25 bp, Mus musculus
tctctggcagaacgcgctgcttgaa

SEQ ID NO: 785951 - DNA, 25 bp, Mus musculus
tctctggcagaaggcgctgcttgaa

SEQ ID NO: 785952 - DNA, 25 bp, Mus musculus
tctctggccaacatggcatcaacca

SEQ ID NO: 785953 - DNA, 25 bp, Mus musculus
tctctggccaacttggcatcaacca

SEQ ID NO: 785954 - DNA, 25 bp, Mus musculus
tctctggccagccacttggcactta

SEQ ID NO: 785955 - DNA, 25 bp, Mus musculus
tctctggccagcgacttggcactta

SEQ ID NO: 785956 - DNA, 25 bp, Mus musculus
tctctggcctgcattgcaattggag

SEQ ID NO: 785957 - DNA, 25 bp, Mus musculus
tctctggcctgctttgcaattggag

SEQ ID NO: 785958 - DNA, 25 bp, Mus musculus
tctctggcggccattgtccgggcca

SEQ ID NO: 785959 - DNA, 25 bp, Mus musculus
tctctggcggcctttgtccgggcca

SEQ ID NO: 785960 - DNA, 25 bp, Mus musculus
tctctggctacacaacgtatgggtg

SEQ ID NO: 785961 - DNA, 25 bp, Mus musculus
tctctggctacagaacgtatgggtg

SEQ ID NO: 785962 - DNA, 25 bp, Mus musculus
tctctggctagcacatccaccaaga

SEQ ID NO: 785963 - DNA, 25 bp, Mus musculus
tctctggctagctcatccaccaaga

SEQ ID NO: 785964 - DNA, 25 bp, Mus musculus
tctctggcttcaactcttgtgtggg

SEQ ID NO: 785965 - DNA, 25 bp, Mus musculus
tctctggcttcatctcttgtgtggg

SEQ ID NO: 785966 - DNA, 25 bp, Mus musculus
tctctgggaaatcctgaggcgttgc

SEQ ID NO: 785967 - DNA, 25 bp, Mus musculus
tctctgggaaatgctgaggcgttgc

SEQ ID NO: 785968 - DNA, 25 bp, Mus musculus
tctctgggacctcatgacttcctgc

SEQ ID NO: 785969 - DNA, 25 bp, Mus musculus
tctctgggacctgatgacttcctgc

SEQ ID NO: 785970 - DNA, 25 bp, Mus musculus
tctctgggagatcctaacaagggag

SEQ ID NO: 785971 - DNA, 25 bp, Mus musculus
tctctgggagatgctaacaagggag

SEQ ID NO: 785972 - DNA, 25 bp, Mus musculus
tctctgggagctccatatagggccc

SEQ ID NO: 785973 - DNA, 25 bp, Mus musculus
tctctgggagctgcatatagggccc

SEQ ID NO: 785974 - DNA, 25 bp, Mus musculus
tctctgggatggactggacactgat

SEQ ID NO: 785975 - DNA, 25 bp, Mus musculus
tctctgggatggtctggacactgat

SEQ ID NO: 785976 - DNA, 25 bp, Mus musculus
tctctgggccccagcgttcctgctg

SEQ ID NO: 785977 - DNA, 25 bp, Mus musculus
tctctgggcccctgcgttcctgctg

SEQ ID NO: 785978 - DNA, 25 bp, Mus musculus
tctctgggccctacgtcagaaaatg

SEQ ID NO: 785979 - DNA, 25 bp, Mus musculus
tctctgggcccttcgtcagaaaatg

SEQ ID NO: 785980 - DNA, 25 bp, Mus musculus
tctctgggccgtagtctttccccaa

SEQ ID NO: 785981 - DNA, 25 bp, Mus musculus
tctctgggccgttgtctttccccaa

SEQ ID NO: 785982 - DNA, 25 bp, Mus musculus
tctctgggctccacaaggtcctgga

SEQ ID NO: 785983 - DNA, 25 bp, Mus musculus
tctctgggctcctcaaggtcctgga

SEQ ID NO: 785984 - DNA, 25 bp, Mus musculus
tctctgggtactatctgccaagccg

SEQ ID NO: 785985 - DNA, 25 bp, Mus musculus
tctctgggtactttctgccaagccg

SEQ ID NO: 785986 - DNA, 25 bp, Mus musculus
tctctgggtccccagacaagaccat

SEQ ID NO: 785987 - DNA, 25 bp, Mus musculus
tctctgggtcccgagacaagaccat

SEQ ID NO: 785988 - DNA, 25 bp, Mus musculus
tctctggtatatccccttttcctgc

SEQ ID NO: 785989 - DNA, 25 bp, Mus musculus
tctctggtatatgcccttttcctgc

SEQ ID NO: 785990 - DNA, 25 bp, Mus musculus
tctctggtcccgcaaaacttgaatg

SEQ ID NO: 785991 - DNA, 25 bp, Mus musculus
tctctggtcccggaaaacttgaatg

SEQ ID NO: 785992 - DNA, 25 bp, Mus musculus
tctctggtgactcgtgactgtcctg

SEQ ID NO: 785993 - DNA, 25 bp, Mus musculus
tctctggtgactggtgactgtcctg

SEQ ID NO: 785994 - DNA, 25 bp, Mus musculus
tctctggtggcgcaagcgttcgtct

SEQ ID NO: 785995 - DNA, 25 bp, Mus musculus
tctctggtggcggaagcgttcgtct

SEQ ID NO: 785996 - DNA, 25 bp, Mus musculus
tctctggttttcatcgcaggcagtg

SEQ ID NO: 785997 - DNA, 25 bp, Mus musculus
tctctggttttcttcgcaggcagtg

SEQ ID NO: 785998 - DNA, 25 bp, Mus musculus
tctctgtaattgcaaacacaatcag

SEQ ID NO: 785999 - DNA, 25 bp, Mus musculus
tctctgtaattggaaacacaatcag

SEQ ID NO: 786000 - DNA, 25 bp, Mus musculus
tctctgtaccagacgtccaggtcag

SEQ ID NO: 786001 - DNA, 25 bp, Mus musculus
tctctgtaccagtcgtccaggtcag

SEQ ID NO: 786002 - DNA, 25 bp, Mus musculus
tctctgtagaaaagctggaaaagaa

SEQ ID NO: 786003 - DNA, 25 bp, Mus musculus
tctctgtagaaatgctggaaaagaa

SEQ ID NO: 786004 - DNA, 25 bp, Mus musculus
tctctgtagaggagcaccgagcctc

SEQ ID NO: 786005 - DNA, 25 bp, Mus musculus
tctctgtagaggtgcaccgagcctc

SEQ ID NO: 786006 - DNA, 25 bp, Mus musculus
tctctgtaggagcatcggccatgta

SEQ ID NO: 786007 - DNA, 25 bp, Mus musculus
tctctgtaggaggatcggccatgta

SEQ ID NO: 786008 - DNA, 25 bp, Mus musculus
tctctgtcaaccatgggaagtgcca

SEQ ID NO: 786009 - DNA, 25 bp, Mus musculus
tctctgtcaaccttgggaagtgcca

SEQ ID NO: 786010 - DNA, 25 bp, Mus musculus
tctctgtcaagtactgcagtcatag

SEQ ID NO: 786011 - DNA, 25 bp, Mus musculus
tctctgtcaagttctgcagtcatag

SEQ ID NO: 786012 - DNA, 25 bp, Mus musculus
tctctgtcacaactaccctcggaag

SEQ ID NO: 786013 - DNA, 25 bp, Mus musculus
tctctgtcacaagtaccctcggaag

SEQ ID NO: 786014 - DNA, 25 bp, Mus musculus
tctctgtcacccatctgggactatt

SEQ ID NO: 786015 - DNA, 25 bp, Mus musculus
tctctgtcacccttctgggactatt

SEQ ID NO: 786016 - DNA, 25 bp, Mus musculus
tctctgtccaggctcagtatggagc

SEQ ID NO: 786017 - DNA, 25 bp, Mus musculus
tctctgtccagggtcagtatggagc

SEQ ID NO: 786018 - DNA, 25 bp, Mus musculus
tctctgtcgtaaacccagcctctta

SEQ ID NO: 786019 - DNA, 25 bp, Mus musculus
tctctgtcgtaatcccagcctctta

SEQ ID NO: 786020 - DNA, 25 bp, Mus musculus
tctctgtgaacacgtggaggtcctt

SEQ ID NO: 786021 - DNA, 25 bp, Mus musculus
tctctgtgaacaggtggaggtcctt

SEQ ID NO: 786022 - DNA, 25 bp, Mus musculus
tctctgtgaaggacaacggcgtctc

SEQ ID NO: 786023 - DNA, 25 bp, Mus musculus
tctctgtgaaggtcaacggcgtctc

SEQ ID NO: 786024 - DNA, 25 bp, Mus musculus
tctctgtgacggcatgcgttgaatg

SEQ ID NO: 786025 - DNA, 25 bp, Mus musculus
tctctgtgacgggatgcgttgaatg

SEQ ID NO: 786026 - DNA, 25 bp, Mus musculus
tctctgtgctagatgacgagtacca

SEQ ID NO: 786027 - DNA, 25 bp, Mus musculus
tctctgtgctagttgacgagtacca

SEQ ID NO: 786028 - DNA, 25 bp, Mus musculus
tctctgtgctcaaatggatcaggaa

SEQ ID NO: 786029 - DNA, 25 bp, Mus musculus
tctctgtgctcatatggatcaggaa

SEQ ID NO: 786030 - DNA, 25 bp, Mus musculus
tctctgtggcaaacagggatcctgg

SEQ ID NO: 786031 - DNA, 25 bp, Mus musculus
tctctgtggcaatcagggatcctgg

SEQ ID NO: 786032 - DNA, 25 bp, Mus musculus
tctctgtggcatacaaagacgagtg

SEQ ID NO: 786033 - DNA, 25 bp, Mus musculus
tctctgtggcattcaaagacgagtg

SEQ ID NO: 786034 - DNA, 25 bp, Mus musculus
tctctgtgggtgaggacagcatccc

SEQ ID NO: 786035 - DNA, 25 bp, Mus musculus
tctctgtgggtgtggacagcatccc

SEQ ID NO: 786036 - DNA, 25 bp, Mus musculus
tctctgtggtgcagaccaatcgtgg

SEQ ID NO: 786037 - DNA, 25 bp, Mus musculus
tctctgtggtgctgaccaatcgtgg

SEQ ID NO: 786038 - DNA, 25 bp, Mus musculus
tctctgtggtggatgaaaatctcag

SEQ ID NO: 786039 - DNA, 25 bp, Mus musculus
tctctgtggtggttgaaaatctcag

SEQ ID NO: 786040 - DNA, 25 bp, Mus musculus
tctctgtgtatgacccacctcagca

SEQ ID NO: 786041 - DNA, 25 bp, Mus musculus
tctctgtgtatgtcccacctcagca

SEQ ID NO: 786042 - DNA, 25 bp, Mus musculus
tctctgtgtcataagtagcaaatca

SEQ ID NO: 786043 - DNA, 25 bp, Mus musculus
tctctgtgtcattagtagcaaatca

SEQ ID NO: 786044 - DNA, 25 bp, Mus musculus
tctctgtgtggaaacggagttatag

SEQ ID NO: 786045 - DNA, 25 bp, Mus musculus
tctctgtgtggatacggagttatag

SEQ ID NO: 786046 - DNA, 25 bp, Mus musculus
tctctgtgtgttcgcctctttcttc

SEQ ID NO: 786047 - DNA, 25 bp, Mus musculus
tctctgtgtgttggcctctttcttc

SEQ ID NO: 786048 - DNA, 25 bp, Mus musculus
tctctgtgtttacaagagctcgaag

SEQ ID NO: 786049 - DNA, 25 bp, Mus musculus
tctctgtgtttagaagagctcgaag

SEQ ID NO: 786050 - DNA, 25 bp, Mus musculus
tctctgtgtttgaccccacaggcca

SEQ ID NO: 786051 - DNA, 25 bp, Mus musculus
tctctgtgtttgtccccacaggcca

SEQ ID NO: 786052 - DNA, 25 bp, Mus musculus
tctctgttagaaatgtatgcagact

SEQ ID NO: 786053 - DNA, 25 bp, Mus musculus
tctctgttagaattgtatgcagact

SEQ ID NO: 786054 - DNA, 25 bp, Mus musculus
tctctgttaggtactgagctcatgc

SEQ ID NO: 786055 - DNA, 25 bp, Mus musculus
tctctgttaggttctgagctcatgc

SEQ ID NO: 786056 - DNA, 25 bp, Mus musculus
tctctgttatgacagtggtggtccc

SEQ ID NO: 786057 - DNA, 25 bp, Mus musculus
tctctgttatgagagtggtggtccc

SEQ ID NO: 786058 - DNA, 25 bp, Mus musculus
tctctgttctctaaggcccaatggc

SEQ ID NO: 786059 - DNA, 25 bp, Mus musculus
tctctgttctcttaggcccaatggc

SEQ ID NO: 786060 - DNA, 25 bp, Mus musculus
tctctgtttctcacaaggcgtgtgc

SEQ ID NO: 786061 - DNA, 25 bp, Mus musculus
tctctgtttctctcaaggcgtgtgc

SEQ ID NO: 786062 - DNA, 25 bp, Mus musculus
tctctgtttgctagagcttggtcgg

SEQ ID NO: 786063 - DNA, 25 bp, Mus musculus
tctctgtttgcttgagcttggtcgg

SEQ ID NO: 786064 - DNA, 25 bp, Mus musculus
tctctgtttgttagcctgcgaaggc

SEQ ID NO: 786065 - DNA, 25 bp, Mus musculus
tctctgtttgtttgcctgcgaaggc

SEQ ID NO: 786066 - DNA, 25 bp, Mus musculus
tctcttaaagagcagacaacgctct

SEQ ID NO: 786067 - DNA, 25 bp, Mus musculus
tctcttaaagaggagacaacgctct

SEQ ID NO: 786068 - DNA, 25 bp, Mus musculus
tctcttaagaacatagtacagattt

SEQ ID NO: 786069 - DNA, 25 bp, Mus musculus
tctcttaagaacttagtacagattt

SEQ ID NO: 786070 - DNA, 25 bp, Mus musculus
tctcttaaggagcaagtagcgtctc

SEQ ID NO: 786071 - DNA, 25 bp, Mus musculus
tctcttaaggaggaagtagcgtctc

SEQ ID NO: 786072 - DNA, 25 bp, Mus musculus
tctcttacagaaagctgatgtttgc

SEQ ID NO: 786073 - DNA, 25 bp, Mus musculus
tctcttacagaatgctgatgtttgc

SEQ ID NO: 786074 - DNA, 25 bp, Mus musculus
tctcttaccccaacacagatgtgtt

SEQ ID NO: 786075 - DNA, 25 bp, Mus musculus
tctcttaccccatcacagatgtgtt

SEQ ID NO: 786076 - DNA, 25 bp, Mus musculus
tctcttagagacagattgaattcca

SEQ ID NO: 786077 - DNA, 25 bp, Mus musculus
tctcttagagactgattgaattcca

SEQ ID NO: 786078 - DNA, 25 bp, Mus musculus
tctcttagatggagaaataaagaac

SEQ ID NO: 786079 - DNA, 25 bp, Mus musculus
tctcttagatggtgaaataaagaac

SEQ ID NO: 786080 - DNA, 25 bp, Mus musculus
tctcttagggatctctgggtacttg

SEQ ID NO: 786081 - DNA, 25 bp, Mus musculus
tctcttagggatgtctgggtacttg

SEQ ID NO: 786082 - DNA, 25 bp, Mus musculus
tctcttatctcacactgcagagcag

SEQ ID NO: 786083 - DNA, 25 bp, Mus musculus
tctcttatctcagactgcagagcag

SEQ ID NO: 786084 - DNA, 25 bp, Mus musculus
tctcttatgggcataagaataccca

SEQ ID NO: 786085 - DNA, 25 bp, Mus musculus
tctcttatgggcttaagaataccca

SEQ ID NO: 786086 - DNA, 25 bp, Mus musculus
tctcttcaaagaagggattaaacct

SEQ ID NO: 786087 - DNA, 25 bp, Mus musculus
tctcttcaaagatgggattaaacct

SEQ ID NO: 786088 - DNA, 25 bp, Mus musculus
tctcttcaatgaaagtcactggatt

SEQ ID NO: 786089 - DNA, 25 bp, Mus musculus
tctcttcaatgatagtcactggatt

SEQ ID NO: 786090 - DNA, 25 bp, Mus musculus
tctcttcaatgcagtaggcgatggc

SEQ ID NO: 786091 - DNA, 25 bp, Mus musculus
tctcttcaatgctgtaggcgatggc

SEQ ID NO: 786092 - DNA, 25 bp, Mus musculus
tctcttcacatgcatcctcttcaag

SEQ ID NO: 786093 - DNA, 25 bp, Mus musculus
tctcttcacatggatcctcttcaag

SEQ ID NO: 786094 - DNA, 25 bp, Mus musculus
tctcttcacgctatggccagggctc

SEQ ID NO: 786095 - DNA, 25 bp, Mus musculus
tctcttcacgctttggccagggctc

SEQ ID NO: 786096 - DNA, 25 bp, Mus musculus
tctcttcactaccaaaaggcaaggg

SEQ ID NO: 786097 - DNA, 25 bp, Mus musculus
tctcttcactacgaaaaggcaaggg

SEQ ID NO: 786098 - DNA, 25 bp, Mus musculus
tctcttcactatacctaggaggaaa

SEQ ID NO: 786099 - DNA, 25 bp, Mus musculus
tctcttcactattcctaggaggaaa

SEQ ID NO: 786100 - DNA, 25 bp, Mus musculus
tctcttcagcacatcgcaataccaa

SEQ ID NO: 786101 - DNA, 25 bp, Mus musculus
tctcttcagcacttcgcaataccaa

SEQ ID NO: 786102 - DNA, 25 bp, Mus musculus
tctcttcagggtcagcttcctcctt

SEQ ID NO: 786103 - DNA, 25 bp, Mus musculus
tctcttcagggtgagcttcctcctt

SEQ ID NO: 786104 - DNA, 25 bp, Mus musculus
tctcttcatcggatgggcaggagct

SEQ ID NO: 786105 - DNA, 25 bp, Mus musculus
tctcttcatcggttgggcaggagct

SEQ ID NO: 786106 - DNA, 25 bp, Mus musculus
tctcttcattttctacaggcttggt

SEQ ID NO: 786107 - DNA, 25 bp, Mus musculus
tctcttcattttgtacaggcttggt

SEQ ID NO: 786108 - DNA, 25 bp, Mus musculus
tctcttccatatccctctcaatggg

SEQ ID NO: 786109 - DNA, 25 bp, Mus musculus
tctcttccatatgcctctcaatggg

SEQ ID NO: 786110 - DNA, 25 bp, Mus musculus
tctcttcccggaagcgcggcgcgtg

SEQ ID NO: 786111 - DNA, 25 bp, Mus musculus
tctcttcccggatgcgcggcgcgtg

SEQ ID NO: 786112 - DNA, 25 bp, Mus musculus
tctcttccctgaattgtctccaggg

SEQ ID NO: 786113 - DNA, 25 bp, Mus musculus
tctcttccctgatttgtctccaggg

SEQ ID NO: 786114 - DNA, 25 bp, Mus musculus
tctcttccggccctgggatgtcacg

SEQ ID NO: 786115 - DNA, 25 bp, Mus musculus
tctcttccggccgtgggatgtcacg

SEQ ID NO: 786116 - DNA, 25 bp, Mus musculus
tctcttccggcgacagctggcgatc

SEQ ID NO: 786117 - DNA, 25 bp, Mus musculus
tctcttccggcgtcagctggcgatc

SEQ ID NO: 786118 - DNA, 25 bp, Mus musculus
tctcttccgtcaatgcctgttcctg

SEQ ID NO: 786119 - DNA, 25 bp, Mus musculus
tctcttccgtcattgcctgttcctg

SEQ ID NO: 786120 - DNA, 25 bp, Mus musculus
tctcttcgggcaattaacagctggc

SEQ ID NO: 786121 - DNA, 25 bp, Mus musculus
tctcttcgggcatttaacagctggc

SEQ ID NO: 786122 - DNA, 25 bp, Mus musculus
tctcttctaggtctgaactccttcc

SEQ ID NO: 786123 - DNA, 25 bp, Mus musculus
tctcttctaggtgtgaactccttcc

SEQ ID NO: 786124 - DNA, 25 bp, Mus musculus
tctcttctccaacgctttccaagag

SEQ ID NO: 786125 - DNA, 25 bp, Mus musculus
tctcttctccaaggctttccaagag

SEQ ID NO: 786126 - DNA, 25 bp, Mus musculus
tctcttctccgaaaaatttatgaaa

SEQ ID NO: 786127 - DNA, 25 bp, Mus musculus
tctcttctccgataaatttatgaaa

SEQ ID NO: 786128 - DNA, 25 bp, Mus musculus
tctcttctgagcactgcaggcttgc

SEQ ID NO: 786129 - DNA, 25 bp, Mus musculus
tctcttctgagctctgcaggcttgc

SEQ ID NO: 786130 - DNA, 25 bp, Mus musculus
tctcttctgcgacatcgttttctag

SEQ ID NO: 786131 - DNA, 25 bp, Mus musculus
tctcttctgcgagatcgttttctag

SEQ ID NO: 786132 - DNA, 25 bp, Mus musculus
tctcttctgggaaaacatagatcaa

SEQ ID NO: 786133 - DNA, 25 bp, Mus musculus
tctcttctgggataacatagatcaa

SEQ ID NO: 786134 - DNA, 25 bp, Mus musculus
tctcttctgtacaaggttctaggtc

SEQ ID NO: 786135 - DNA, 25 bp, Mus musculus
tctcttctgtactaggttctaggtc

SEQ ID NO: 786136 - DNA, 25 bp, Mus musculus
tctcttctttagaagaggaaggcaa

SEQ ID NO: 786137 - DNA, 25 bp, Mus musculus
tctcttctttagtagaggaaggcaa

SEQ ID NO: 786138 - DNA, 25 bp, Mus musculus
tctcttgaaaatctgatgcatcatt

SEQ ID NO: 786139 - DNA, 25 bp, Mus musculus
tctcttgaaaatgtgatgcatcatt

SEQ ID NO: 786140 - DNA, 25 bp, Mus musculus
tctcttgaagatatgaaggtagaca

SEQ ID NO: 786141 - DNA, 25 bp, Mus musculus
tctcttgaagatttgaaggtagaca

SEQ ID NO: 786142 - DNA, 25 bp, Mus musculus
tctcttgacagcagtctatggactg

SEQ ID NO: 786143 - DNA, 25 bp, Mus musculus
tctcttgacagctgtctatggactg

SEQ ID NO: 786144 - DNA, 25 bp, Mus musculus
tctcttgagcagagtggccgtcagc

SEQ ID NO: 786145 - DNA, 25 bp, Mus musculus
tctcttgagcagcacccaaatcact

SEQ ID NO: 786146 - DNA, 25 bp, Mus musculus
tctcttgagcaggacccaaatcact

SEQ ID NO: 786147 - DNA, 25 bp, Mus musculus
tctcttgagcagtgtggccgtcagc

SEQ ID NO: 786148 - DNA, 25 bp, Mus musculus
tctcttgatagtacttcggaaaaaa

SEQ ID NO: 786149 - DNA, 25 bp, Mus musculus
tctcttgatagttcttcggaaaaaa

SEQ ID NO: 786150 - DNA, 25 bp, Mus musculus
tctcttgcaggccaagaaatatgca

SEQ ID NO: 786151 - DNA, 25 bp, Mus musculus
tctcttgcaggcgaagaaatatgca

SEQ ID NO: 786152 - DNA, 25 bp, Mus musculus
tctcttgccacactgccatggagaa

SEQ ID NO: 786153 - DNA, 25 bp, Mus musculus
tctcttgccacagtgccatggagaa

SEQ ID NO: 786154 - DNA, 25 bp, Mus musculus
tctcttgcctgtagcaagggctaca

SEQ ID NO: 786155 - DNA, 25 bp, Mus musculus
tctcttgcctgttgcaagggctaca

SEQ ID NO: 786156 - DNA, 25 bp, Mus musculus
tctcttgctaccctaagtgcacact

SEQ ID NO: 786157 - DNA, 25 bp, Mus musculus
tctcttgctaccgtaagtgcacact

SEQ ID NO: 786158 - DNA, 25 bp, Mus musculus
tctcttgctcccctggaccatgaat

SEQ ID NO: 786159 - DNA, 25 bp, Mus musculus
tctcttgctcccgtggaccatgaat

SEQ ID NO: 786160 - DNA, 25 bp, Mus musculus
tctcttgctgaacagagacagcatg

SEQ ID NO: 786161 - DNA, 25 bp, Mus musculus
tctcttgctgaacagggagcctgct

SEQ ID NO: 786162 - DNA, 25 bp, Mus musculus
tctcttgctgaagagagacagcatg

SEQ ID NO: 786163 - DNA, 25 bp, Mus musculus
tctcttgctgaagagggagcctgct

SEQ ID NO: 786164 - DNA, 25 bp, Mus musculus
tctcttgctgccctggatgcgctca

SEQ ID NO: 786165 - DNA, 25 bp, Mus musculus
tctcttgctgccgtggatgcgctca

SEQ ID NO: 786166 - DNA, 25 bp, Mus musculus
tctcttgcttgtatgaaactgtctt

SEQ ID NO: 786167 - DNA, 25 bp, Mus musculus
tctcttgcttgtttgaaactgtctt

SEQ ID NO: 786168 - DNA, 25 bp, Mus musculus
tctcttggaatacaactacgtgaag

SEQ ID NO: 786169 - DNA, 25 bp, Mus musculus
tctcttggaatagaactacgtgaag

SEQ ID NO: 786170 - DNA, 25 bp, Mus musculus
tctcttggacgacgccaatgggctt

SEQ ID NO: 786171 - DNA, 25 bp, Mus musculus
tctcttggacgaggccaatgggctt

SEQ ID NO: 786172 - DNA, 25 bp, Mus musculus
tctcttggagccctgccctagcttc

SEQ ID NO: 786173 - DNA, 25 bp, Mus musculus
tctcttggagccgtgccctagcttc

SEQ ID NO: 786174 - DNA, 25 bp, Mus musculus
tctcttgggcaaaaggagttgggac

SEQ ID NO: 786175 - DNA, 25 bp, Mus musculus
tctcttgggcaataggagttgggac

SEQ ID NO: 786176 - DNA, 25 bp, Mus musculus
tctcttgggctgcaccatttgaaca

SEQ ID NO: 786177 - DNA, 25 bp, Mus musculus
tctcttgggctggaccatttgaaca

SEQ ID NO: 786178 - DNA, 25 bp, Mus musculus
tctcttgggtgactactgtggctca

SEQ ID NO: 786179 - DNA, 25 bp, Mus musculus
tctcttgggtgagtactgtggctca

SEQ ID NO: 786180 - DNA, 25 bp, Mus musculus
tctcttgtccaacgtcagctacaaa

SEQ ID NO: 786181 - DNA, 25 bp, Mus musculus
tctcttgtccaaggtcagctacaaa

SEQ ID NO: 786182 - DNA, 25 bp, Mus musculus
tctcttgtgctgaatagctgcctgg

SEQ ID NO: 786183 - DNA, 25 bp, Mus musculus
tctcttgtgctgtatagctgcctgg

SEQ ID NO: 786184 - DNA, 25 bp, Mus musculus
tctcttgttcccaaaattgccacca

SEQ ID NO: 786185 - DNA, 25 bp, Mus musculus
tctcttgttccctaaattgccacca

SEQ ID NO: 786186 - DNA, 25 bp, Mus musculus
tctcttgttttgaagccatgacaat

SEQ ID NO: 786187 - DNA, 25 bp, Mus musculus
tctcttgttttgtagccatgacaat

SEQ ID NO: 786188 - DNA, 25 bp, Mus musculus
tctctttaggaaacccagttgagtc

SEQ ID NO: 786189 - DNA, 25 bp, Mus musculus
tctctttaggaatcccagttgagtc

SEQ ID NO: 786190 - DNA, 25 bp, Mus musculus
tctctttattctagcctttggaagg

SEQ ID NO: 786191 - DNA, 25 bp, Mus musculus
tctctttattcttgcctttggaagg

SEQ ID NO: 786192 - DNA, 25 bp, Mus musculus
tctctttcagcgaggcaaccctggc

SEQ ID NO: 786193 - DNA, 25 bp, Mus musculus
tctctttcagcgtggcaaccctggc

SEQ ID NO: 786194 - DNA, 25 bp, Mus musculus
tctctttccagacttcagtcaacag

SEQ ID NO: 786195 - DNA, 25 bp, Mus musculus
tctctttccagagttcagtcaacag

SEQ ID NO: 786196 - DNA, 25 bp, Mus musculus
tctctttcgccacgacatgaactca

SEQ ID NO: 786197 - DNA, 25 bp, Mus musculus
tctctttcgccaggacatgaactca

SEQ ID NO: 786198 - DNA, 25 bp, Mus musculus
tctctttctacaacctgaggaccga

SEQ ID NO: 786199 - DNA, 25 bp, Mus musculus
tctctttctacatcctgaggaccga

SEQ ID NO: 786200 - DNA, 25 bp, Mus musculus
tctctttctccaagaagtggctggg

SEQ ID NO: 786201 - DNA, 25 bp, Mus musculus
tctctttctccatgaagtggctggg

SEQ ID NO: 786202 - DNA, 25 bp, Mus musculus
tctctttctcccagcccaataaaaa

SEQ ID NO: 786203 - DNA, 25 bp, Mus musculus
tctctttctccctgcccaataaaaa

SEQ ID NO: 786204 - DNA, 25 bp, Mus musculus
tctctttctctacgcgagcgtcctt

SEQ ID NO: 786205 - DNA, 25 bp, Mus musculus
tctctttctctaggcgagcgtcctt

SEQ ID NO: 786206 - DNA, 25 bp, Mus musculus
tctctttctgctcttgcccggctcg

SEQ ID NO: 786207 - DNA, 25 bp, Mus musculus
tctctttctgctgttgcccggctcg

SEQ ID NO: 786208 - DNA, 25 bp, Mus musculus
tctctttgaacgcacacgctctggc

SEQ ID NO: 786209 - DNA, 25 bp, Mus musculus
tctctttgaacggacacgctctggc

SEQ ID NO: 786210 - DNA, 25 bp, Mus musculus
tctctttgaaggatactttggaaca

SEQ ID NO: 786211 - DNA, 25 bp, Mus musculus
tctctttgaaggttactttggaaca

SEQ ID NO: 786212 - DNA, 25 bp, Mus musculus
tctctttgacagaggacaaaggtgt

SEQ ID NO: 786213 - DNA, 25 bp, Mus musculus
tctctttgacagtggacaaaggtgt

SEQ ID NO: 786214 - DNA, 25 bp, Mus musculus
tctctttgcacacggacagctttgt

SEQ ID NO: 786215 - DNA, 25 bp, Mus musculus
tctctttgcacagggacagctttgt

SEQ ID NO: 786216 - DNA, 25 bp, Mus musculus
tctctttgggaaacgtcggctgaaa

SEQ ID NO: 786217 - DNA, 25 bp, Mus musculus
tctctttgggaatcgtcggctgaaa

SEQ ID NO: 786218 - DNA, 25 bp, Mus musculus
tctctttgtcggaggagctcttctg

SEQ ID NO: 786219 - DNA, 25 bp, Mus musculus
tctctttgtcggtggagctcttctg

SEQ ID NO: 786220 - DNA, 25 bp, Mus musculus
tctcttttccccacggaagagaaga

SEQ ID NO: 786221 - DNA, 25 bp, Mus musculus
tctcttttcccctcggaagagaaga

SEQ ID NO: 786222 - DNA, 25 bp, Mus musculus
tctcttttcctgaagcccttcaagg

SEQ ID NO: 786223 - DNA, 25 bp, Mus musculus
tctcttttcctgtagcccttcaagg

SEQ ID NO: 786224 - DNA, 25 bp, Mus musculus
tctcttttggaaaagttcttgatcc

SEQ ID NO: 786225 - DNA, 25 bp, Mus musculus
tctcttttggaatagttcttgatcc

SEQ ID NO: 786226 - DNA, 25 bp, Mus musculus
tctgaaaaaagcatcgaaagtgtac

SEQ ID NO: 786227 - DNA, 25 bp, Mus musculus
tctgaaaaaagcttcgaaagtgtac

SEQ ID NO: 786228 - DNA, 25 bp, Mus musculus
tctgaaaaacagacgtcctgcggag

SEQ ID NO: 786229 - DNA, 25 bp, Mus musculus
tctgaaaaacagtcgtcctgcggag

SEQ ID NO: 786230 - DNA, 25 bp, Mus musculus
tctgaaaagggcagtacaggcagca

SEQ ID NO: 786231 - DNA, 25 bp, Mus musculus
tctgaaaagggctgtacaggcagca

SEQ ID NO: 786232 - DNA, 25 bp, Mus musculus
tctgaaaaggtgcatacagaaagtc

SEQ ID NO: 786233 - DNA, 25 bp, Mus musculus
tctgaaaaggtggatacagaaagtc

SEQ ID NO: 786234 - DNA, 25 bp, Mus musculus
tctgaaaatgtacagcgagtacgtg

SEQ ID NO: 786235 - DNA, 25 bp, Mus musculus
tctgaaaatgtagagcgagtacgtg

SEQ ID NO: 786236 - DNA, 25 bp, Mus musculus
tctgaaacagctaataattgagctc

SEQ ID NO: 786237 - DNA, 25 bp, Mus musculus
tctgaaacagcttataattgagctc

SEQ ID NO: 786238 - DNA, 25 bp, Mus musculus
tctgaaacaggcagtgagactcatg

SEQ ID NO: 786239 - DNA, 25 bp, Mus musculus
tctgaaacaggctgtgagactcatg

SEQ ID NO: 786240 - DNA, 25 bp, Mus musculus
tctgaaaccaaaagaccagatcttg

SEQ ID NO: 786241 - DNA, 25 bp, Mus musculus
tctgaaaccaaatgaccagatcttg

SEQ ID NO: 786242 - DNA, 25 bp, Mus musculus
tctgaaacctgtcacacgtattcct

SEQ ID NO: 786243 - DNA, 25 bp, Mus musculus
tctgaaacctgtgacacgtattcct

SEQ ID NO: 786244 - DNA, 25 bp, Mus musculus
tctgaaacgaaaacctgccaacgtt

SEQ ID NO: 786245 - DNA, 25 bp, Mus musculus
tctgaaacgaaatcctgccaacgtt

SEQ ID NO: 786246 - DNA, 25 bp, Mus musculus
tctgaaacgtcacaaaaagaaatgc

SEQ ID NO: 786247 - DNA, 25 bp, Mus musculus
tctgaaacgtcagaaaaagaaatgc

SEQ ID NO: 786248 - DNA, 25 bp, Mus musculus
tctgaaactcaccaaagtagatgac

SEQ ID NO: 786249 - DNA, 25 bp, Mus musculus
tctgaaactcacgaaagtagatgac

SEQ ID NO: 786250 - DNA, 25 bp, Mus musculus
tctgaaactctgatagaagacgtgc

SEQ ID NO: 786251 - DNA, 25 bp, Mus musculus
tctgaaactctgttagaagacgtgc

SEQ ID NO: 786252 - DNA, 25 bp, Mus musculus
tctgaaagaactcgtggttgaacta

SEQ ID NO: 786253 - DNA, 25 bp, Mus musculus
tctgaaagaactggtggttgaacta

SEQ ID NO: 786254 - DNA, 25 bp, Mus musculus
tctgaaagacacagtcatcttacct

SEQ ID NO: 786255 - DNA, 25 bp, Mus musculus
tctgaaagacactgtcatcttacct

SEQ ID NO: 786256 - DNA, 25 bp, Mus musculus
tctgaaagacatactgcgccgcagc

SEQ ID NO: 786257 - DNA, 25 bp, Mus musculus
tctgaaagacattctgcgccgcagc

SEQ ID NO: 786258 - DNA, 25 bp, Mus musculus
tctgaaagagaacaccatggtgggc

SEQ ID NO: 786259 - DNA, 25 bp, Mus musculus
tctgaaagagaagaccatggtgggc

SEQ ID NO: 786260 - DNA, 25 bp, Mus musculus
tctgaaagagatctcatttctgaca

SEQ ID NO: 786261 - DNA, 25 bp, Mus musculus
tctgaaagagatgtcatttctgaca

SEQ ID NO: 786262 - DNA, 25 bp, Mus musculus
tctgaaagagcaagaccaccttcga

SEQ ID NO: 786263 - DNA, 25 bp, Mus musculus
tctgaaagagcatgaccaccttcga

SEQ ID NO: 786264 - DNA, 25 bp, Mus musculus
tctgaaagagctagtgacatgcacg

SEQ ID NO: 786265 - DNA, 25 bp, Mus musculus
tctgaaagagcttgtgacatgcacg

SEQ ID NO: 786266 - DNA, 25 bp, Mus musculus
tctgaaagatgtctatccccatgcc

SEQ ID NO: 786267 - DNA, 25 bp, Mus musculus
tctgaaagatgtgtatccccatgcc

SEQ ID NO: 786268 - DNA, 25 bp, Mus musculus
tctgaaagccatcattagtttctgg

SEQ ID NO: 786269 - DNA, 25 bp, Mus musculus
tctgaaagccatgattagtttctgg

SEQ ID NO: 786270 - DNA, 25 bp, Mus musculus
tctgaaagcctcagtgatctctcag

SEQ ID NO: 786271 - DNA, 25 bp, Mus musculus
tctgaaagcctctgtgatctctcag

SEQ ID NO: 786272 - DNA, 25 bp, Mus musculus
tctgaaaggcggaagctgatgctta

SEQ ID NO: 786273 - DNA, 25 bp, Mus musculus
tctgaaaggcggtagctgatgctta

SEQ ID NO: 786274 - DNA, 25 bp, Mus musculus
tctgaaaggtgtccgagattccagc

SEQ ID NO: 786275 - DNA, 25 bp, Mus musculus
tctgaaaggtgtgcgagattccagc

SEQ ID NO: 786276 - DNA, 25 bp, Mus musculus
tctgaaagtcttagtggcctcaagc

SEQ ID NO: 786277 - DNA, 25 bp, Mus musculus
tctgaaagtctttgtggcctcaagc

SEQ ID NO: 786278 - DNA, 25 bp, Mus musculus
tctgaaagtgcgacatgatgaggat

SEQ ID NO: 786279 - DNA, 25 bp, Mus musculus
tctgaaagtgcgtcatgatgaggat

SEQ ID NO: 786280 - DNA, 25 bp, Mus musculus
tctgaaatccatcgtacctattact

SEQ ID NO: 786281 - DNA, 25 bp, Mus musculus
tctgaaatccatggtacctattact

SEQ ID NO: 786282 - DNA, 25 bp, Mus musculus
tctgaaatcgggattgccatgggct

SEQ ID NO: 786283 - DNA, 25 bp, Mus musculus
tctgaaatcgggtttgccatgggct

SEQ ID NO: 786284 - DNA, 25 bp, Mus musculus
tctgaaatcgtgataccaggtaact

SEQ ID NO: 786285 - DNA, 25 bp, Mus musculus
tctgaaatcgtgttaccaggtaact

SEQ ID NO: 786286 - DNA, 25 bp, Mus musculus
tctgaaatcttgctgcctgctggaa

SEQ ID NO: 786287 - DNA, 25 bp, Mus musculus
tctgaaatcttggtgcctgctggaa

SEQ ID NO: 786288 - DNA, 25 bp, Mus musculus
tctgaaatgcctaaacaaaatgaac

SEQ ID NO: 786289 - DNA, 25 bp, Mus musculus
tctgaaatgccttaacaaaatgaac

SEQ ID NO: 786290 - DNA, 25 bp, Mus musculus
tctgaaatggagcacacaacagctg

SEQ ID NO: 786291 - DNA, 25 bp, Mus musculus
tctgaaatggaggacacaacagctg

SEQ ID NO: 786292 - DNA, 25 bp, Mus musculus
tctgaaattgtgagcaagagagaga

SEQ ID NO: 786293 - DNA, 25 bp, Mus musculus
tctgaaattgtgtgcaagagagaga

SEQ ID NO: 786294 - DNA, 25 bp, Mus musculus
tctgaacaaccacattatggaacaa

SEQ ID NO: 786295 - DNA, 25 bp, Mus musculus
tctgaacaaccagattatggaacaa

SEQ ID NO: 786296 - DNA, 25 bp, Mus musculus
tctgaacaactgaaatcccatcaag

SEQ ID NO: 786297 - DNA, 25 bp, Mus musculus
tctgaacaactgtaatcccatcaag

SEQ ID NO: 786298 - DNA, 25 bp, Mus musculus
tctgaacaagagactcaaccctgtg

SEQ ID NO: 786299 - DNA, 25 bp, Mus musculus
tctgaacaagagtctcaaccctgtg

SEQ ID NO: 786300 - DNA, 25 bp, Mus musculus
tctgaacaaggtcttaaagcatgag

SEQ ID NO: 786301 - DNA, 25 bp, Mus musculus
tctgaacaaggtgttaaagcatgag

SEQ ID NO: 786302 - DNA, 25 bp, Mus musculus
tctgaacaatgtcgaagtctgcagt

SEQ ID NO: 786303 - DNA, 25 bp, Mus musculus
tctgaacaatgtggaagtctgcagt

SEQ ID NO: 786304 - DNA, 25 bp, Mus musculus
tctgaacacacaatgcgactcccat

SEQ ID NO: 786305 - DNA, 25 bp, Mus musculus
tctgaacacacattgcgactcccat

SEQ ID NO: 786306 - DNA, 25 bp, Mus musculus
tctgaacactggcaggagggatatc

SEQ ID NO: 786307 - DNA, 25 bp, Mus musculus
tctgaacactgggaggagggatatc

SEQ ID NO: 786308 - DNA, 25 bp, Mus musculus
tctgaacagacgcatccagctggtt

SEQ ID NO: 786309 - DNA, 25 bp, Mus musculus
tctgaacagacggatccagctggtt

SEQ ID NO: 786310 - DNA, 25 bp, Mus musculus
tctgaaccaaagagatggctgcctt

SEQ ID NO: 786311 - DNA, 25 bp, Mus musculus
tctgaaccaaagtgatggctgcctt

SEQ ID NO: 786312 - DNA, 25 bp, Mus musculus
tctgaaccacgtctttgacgacgtg

SEQ ID NO: 786313 - DNA, 25 bp, Mus musculus
tctgaaccacgtgtttgacgacgtg

SEQ ID NO: 786314 - DNA, 25 bp, Mus musculus
tctgaaccacttagtgagacctgtg

SEQ ID NO: 786315 - DNA, 25 bp, Mus musculus
tctgaaccactttgtgagacctgtg

SEQ ID NO: 786316 - DNA, 25 bp, Mus musculus
tctgaaccagctccgagagaggctt

SEQ ID NO: 786317 - DNA, 25 bp, Mus musculus
tctgaaccagctgcgagagaggctt

SEQ ID NO: 786318 - DNA, 25 bp, Mus musculus
tctgaaccgacactttctcttccgg

SEQ ID NO: 786319 - DNA, 25 bp, Mus musculus
tctgaaccgacagtttctcttccgg

SEQ ID NO: 786320 - DNA, 25 bp, Mus musculus
tctgaacctcctaggagacggccac

SEQ ID NO: 786321 - DNA, 25 bp, Mus musculus
tctgaacctccttggagacggccac

SEQ ID NO: 786322 - DNA, 25 bp, Mus musculus
tctgaacctcttcgaagagacttgc

SEQ ID NO: 786323 - DNA, 25 bp, Mus musculus
tctgaacctcttggaagagacttgc

SEQ ID NO: 786324 - DNA, 25 bp, Mus musculus
tctgaacctgggagatgcagaaact

SEQ ID NO: 786325 - DNA, 25 bp, Mus musculus
tctgaacctgggatctgaaccaaag

SEQ ID NO: 786326 - DNA, 25 bp, Mus musculus
tctgaacctgggtgatgcagaaact

SEQ ID NO: 786327 - DNA, 25 bp, Mus musculus
tctgaacctgggttctgaaccaaag

SEQ ID NO: 786328 - DNA, 25 bp, Mus musculus
tctgaacctgtcaacgtgaagaagt

SEQ ID NO: 786329 - DNA, 25 bp, Mus musculus
tctgaacctgtctacgtgaagaagt

SEQ ID NO: 786330 - DNA, 25 bp, Mus musculus
tctgaacgaactaaagatactccac

SEQ ID NO: 786331 - DNA, 25 bp, Mus musculus
tctgaacgaacttaagatactccac

SEQ ID NO: 786332 - DNA, 25 bp, Mus musculus
tctgaacgccatagtgcaaaagcta

SEQ ID NO: 786333 - DNA, 25 bp, Mus musculus
tctgaacgccattgtgcaaaagcta

SEQ ID NO: 786334 - DNA, 25 bp, Mus musculus
tctgaacggatcatcggccgactcg

SEQ ID NO: 786335 - DNA, 25 bp, Mus musculus
tctgaacggatcttcggccgactcg

SEQ ID NO: 786336 - DNA, 25 bp, Mus musculus
tctgaacgggatcctaagcctttgc

SEQ ID NO: 786337 - DNA, 25 bp, Mus musculus
tctgaacgggatgctaagcctttgc

SEQ ID NO: 786338 - DNA, 25 bp, Mus musculus
tctgaacgtctgaccttgaaggact

SEQ ID NO: 786339 - DNA, 25 bp, Mus musculus
tctgaacgtctgtccttgaaggact

SEQ ID NO: 786340 - DNA, 25 bp, Mus musculus
tctgaactacctcccgagaaatttg

SEQ ID NO: 786341 - DNA, 25 bp, Mus musculus
tctgaactacctgccgagaaatttg

SEQ ID NO: 786342 - DNA, 25 bp, Mus musculus
tctgaactccgacggctgtccacag

SEQ ID NO: 786343 - DNA, 25 bp, Mus musculus
tctgaactccgagggctgtccacag

SEQ ID NO: 786344 - DNA, 25 bp, Mus musculus
tctgaactcttgcttcgagaagaat

SEQ ID NO: 786345 - DNA, 25 bp, Mus musculus
tctgaactcttggttcgagaagaat

SEQ ID NO: 786346 - DNA, 25 bp, Mus musculus
tctgaactgtgtactcctctctcgg

SEQ ID NO: 786347 - DNA, 25 bp, Mus musculus
tctgaactgtgttctcctctctcgg

SEQ ID NO: 786348 - DNA, 25 bp, Mus musculus
tctgaacttgctattgagggatgaa

SEQ ID NO: 786349 - DNA, 25 bp, Mus musculus
tctgaacttgcttttgagggatgaa

SEQ ID NO: 786350 - DNA, 25 bp, Mus musculus
tctgaagaaacgcaagacctccatt

SEQ ID NO: 786351 - DNA, 25 bp, Mus musculus
tctgaagaaacggaagacctccatt

SEQ ID NO: 786352 - DNA, 25 bp, Mus musculus
tctgaagaaagacgacaccaccttt

SEQ ID NO: 786353 - DNA, 25 bp, Mus musculus
tctgaagaaagaggacaccaccttt

SEQ ID NO: 786354 - DNA, 25 bp, Mus musculus
tctgaagaaccaattggaaaagata

SEQ ID NO: 786355 - DNA, 25 bp, Mus musculus
tctgaagaaccatttggaaaagata

SEQ ID NO: 786356 - DNA, 25 bp, Mus musculus
tctgaagacagcagggccgcagtct

SEQ ID NO: 786357 - DNA, 25 bp, Mus musculus
tctgaagacagctgggccgcagtct

SEQ ID NO: 786358 - DNA, 25 bp, Mus musculus
tctgaagacccacgtgggacctgaa

SEQ ID NO: 786359 - DNA, 25 bp, Mus musculus
tctgaagacccaggtgggacctgaa

SEQ ID NO: 786360 - DNA, 25 bp, Mus musculus
tctgaagacgaaatctgaaccggac

SEQ ID NO: 786361 - DNA, 25 bp, Mus musculus
tctgaagacgaattctgaaccggac

SEQ ID NO: 786362 - DNA, 25 bp, Mus musculus
tctgaagactatcagagtttttcct

SEQ ID NO: 786363 - DNA, 25 bp, Mus musculus
tctgaagactatgagagtttttcct

SEQ ID NO: 786364 - DNA, 25 bp, Mus musculus
tctgaagagccccagctgcgcagac

SEQ ID NO: 786365 - DNA, 25 bp, Mus musculus
tctgaagagcccgagctgcgcagac

SEQ ID NO: 786366 - DNA, 25 bp, Mus musculus
tctgaagaggcaaaagaagcagcaa

SEQ ID NO: 786367 - DNA, 25 bp, Mus musculus
tctgaagaggcataagaagcagcaa

SEQ ID NO: 786368 - DNA, 25 bp, Mus musculus
tctgaagataggaactgccccaagg

SEQ ID NO: 786369 - DNA, 25 bp, Mus musculus
tctgaagataggtactgccccaagg

SEQ ID NO: 786370 - DNA, 25 bp, Mus musculus
tctgaagatgatccatggctacccc

SEQ ID NO: 786371 - DNA, 25 bp, Mus musculus
tctgaagatgatgcatggctacccc

SEQ ID NO: 786372 - DNA, 25 bp, Mus musculus
tctgaagatgcaaagggaaatgtct

SEQ ID NO: 786373 - DNA, 25 bp, Mus musculus
tctgaagatgcatagggaaatgtct

SEQ ID NO: 786374 - DNA, 25 bp, Mus musculus
tctgaagatgccctaccagatcctg

SEQ ID NO: 786375 - DNA, 25 bp, Mus musculus
tctgaagatgccgtaccagatcctg

SEQ ID NO: 786376 - DNA, 25 bp, Mus musculus
tctgaagattgcctgtacctaaata

SEQ ID NO: 786377 - DNA, 25 bp, Mus musculus
tctgaagattgcgtgtacctaaata

SEQ ID NO: 786378 - DNA, 25 bp, Mus musculus
tctgaagcaactacgcctgctgtgg

SEQ ID NO: 786379 - DNA, 25 bp, Mus musculus
tctgaagcaacttcgcctgctgtgg

SEQ ID NO: 786380 - DNA, 25 bp, Mus musculus
tctgaagcaagaccattggctaaag

SEQ ID NO: 786381 - DNA, 25 bp, Mus musculus
tctgaagcaagagcattggctaaag

SEQ ID NO: 786382 - DNA, 25 bp, Mus musculus
tctgaagcagacctaagcactcctg

SEQ ID NO: 786383 - DNA, 25 bp, Mus musculus
tctgaagcagacgtaagcactcctg

SEQ ID NO: 786384 - DNA, 25 bp, Mus musculus
tctgaagcagcgctttgaccacatt

SEQ ID NO: 786385 - DNA, 25 bp, Mus musculus
tctgaagcagcggtttgaccacatt

SEQ ID NO: 786386 - DNA, 25 bp, Mus musculus
tctgaagcatcactggctgttgaca

SEQ ID NO: 786387 - DNA, 25 bp, Mus musculus
tctgaagcatcagtggctgttgaca

SEQ ID NO: 786388 - DNA, 25 bp, Mus musculus
tctgaagcctacactagagggagga

SEQ ID NO: 786389 - DNA, 25 bp, Mus musculus
tctgaagcctactctagagggagga

SEQ ID NO: 786390 - DNA, 25 bp, Mus musculus
tctgaagcggaaccccactcagcga

SEQ ID NO: 786391 - DNA, 25 bp, Mus musculus
tctgaagcggaagcccactcagcga

SEQ ID NO: 786392 - DNA, 25 bp, Mus musculus
tctgaagcgtgcaaagatgcacatc

SEQ ID NO: 786393 - DNA, 25 bp, Mus musculus
tctgaagcgtgctaagatgcacatc

SEQ ID NO: 786394 - DNA, 25 bp, Mus musculus
tctgaagctatgctaggcacctggg

SEQ ID NO: 786395 - DNA, 25 bp, Mus musculus
tctgaagctatggtaggcacctggg

SEQ ID NO: 786396 - DNA, 25 bp, Mus musculus
tctgaaggaactcactcgacagaag

SEQ ID NO: 786397 - DNA, 25 bp, Mus musculus
tctgaaggaactgactcgacagaag

SEQ ID NO: 786398 - DNA, 25 bp, Mus musculus
tctgaaggaagtcaatgtctacatg

SEQ ID NO: 786399 - DNA, 25 bp, Mus musculus
tctgaaggaagtgaatgtctacatg

SEQ ID NO: 786400 - DNA, 25 bp, Mus musculus
tctgaaggaattctatctcactccc

SEQ ID NO: 786401 - DNA, 25 bp, Mus musculus
tctgaaggaattgtatctcactccc

SEQ ID NO: 786402 - DNA, 25 bp, Mus musculus
tctgaaggacctccgtgtgtggacc

SEQ ID NO: 786403 - DNA, 25 bp, Mus musculus
tctgaaggacctgcgtgtgtggacc

SEQ ID NO: 786404 - DNA, 25 bp, Mus musculus
tctgaaggacttctcctggaagagc

SEQ ID NO: 786405 - DNA, 25 bp, Mus musculus
tctgaaggacttgtcctggaagagc

SEQ ID NO: 786406 - DNA, 25 bp, Mus musculus
tctgaaggagatcagcagagaaacc

SEQ ID NO: 786407 - DNA, 25 bp, Mus musculus
tctgaaggagatgagcagagaaacc

SEQ ID NO: 786408 - DNA, 25 bp, Mus musculus
tctgaaggcatgacggtttgagctc

SEQ ID NO: 786409 - DNA, 25 bp, Mus musculus
tctgaaggcatgagaagctggaaca

SEQ ID NO: 786410 - DNA, 25 bp, Mus musculus
tctgaaggcatgtcggtttgagctc

SEQ ID NO: 786411 - DNA, 25 bp, Mus musculus
tctgaaggcatgtgaagctggaaca

SEQ ID NO: 786412 - DNA, 25 bp, Mus musculus
tctgaaggctcacctcacagttgag

SEQ ID NO: 786413 - DNA, 25 bp, Mus musculus
tctgaaggctcagctcacagttgag

SEQ ID NO: 786414 - DNA, 25 bp, Mus musculus
tctgaaggctgactttgaccggcca

SEQ ID NO: 786415 - DNA, 25 bp, Mus musculus
tctgaaggctgagtttgaccggcca

SEQ ID NO: 786416 - DNA, 25 bp, Mus musculus
tctgaagtacaactctattggacgg

SEQ ID NO: 786417 - DNA, 25 bp, Mus musculus
tctgaagtacaagtctattggacgg

SEQ ID NO: 786418 - DNA, 25 bp, Mus musculus
tctgaagtacctccaagtgttcgag

SEQ ID NO: 786419 - DNA, 25 bp, Mus musculus
tctgaagtacctgcaagtgttcgag

SEQ ID NO: 786420 - DNA, 25 bp, Mus musculus
tctgaagtatgtcgagtgtttcact

SEQ ID NO: 786421 - DNA, 25 bp, Mus musculus
tctgaagtatgtggagtgtttcact

SEQ ID NO: 786422 - DNA, 25 bp, Mus musculus
tctgaagtcatgactacaggaccta

SEQ ID NO: 786423 - DNA, 25 bp, Mus musculus
tctgaagtcatgtctacaggaccta

SEQ ID NO: 786424 - DNA, 25 bp, Mus musculus
tctgaagtccctacagggtctggct

SEQ ID NO: 786425 - DNA, 25 bp, Mus musculus
tctgaagtcccttcagggtctggct

SEQ ID NO: 786426 - DNA, 25 bp, Mus musculus
tctgaagtctgtagagggtcgctcc

SEQ ID NO: 786427 - DNA, 25 bp, Mus musculus
tctgaagtctgttgagggtcgctcc

SEQ ID NO: 786428 - DNA, 25 bp, Mus musculus
tctgaagtgaaacgaggagtctgca

SEQ ID NO: 786429 - DNA, 25 bp, Mus musculus
tctgaagtgaaaggaggagtctgca

SEQ ID NO: 786430 - DNA, 25 bp, Mus musculus
tctgaagtggttaagcagagggcac

SEQ ID NO: 786431 - DNA, 25 bp, Mus musculus
tctgaagtggtttagcagagggcac

SEQ ID NO: 786432 - DNA, 25 bp, Mus musculus
tctgaagtgtccaggattcccaaca

SEQ ID NO: 786433 - DNA, 25 bp, Mus musculus
tctgaagtgtcctggattcccaaca

SEQ ID NO: 786434 - DNA, 25 bp, Mus musculus
tctgaagttccaaggcctccccatg

SEQ ID NO: 786435 - DNA, 25 bp, Mus musculus
tctgaagttccatggcctccccatg

SEQ ID NO: 786436 - DNA, 25 bp, Mus musculus
tctgaagttgcacatgaacctccca

SEQ ID NO: 786437 - DNA, 25 bp, Mus musculus
tctgaagttgcagatgaacctccca

SEQ ID NO: 786438 - DNA, 25 bp, Mus musculus
tctgaagttgccaaaccttgtggac

SEQ ID NO: 786439 - DNA, 25 bp, Mus musculus
tctgaagttgccatatcagaggaat

SEQ ID NO: 786440 - DNA, 25 bp, Mus musculus
tctgaagttgcctaaccttgtggac

SEQ ID NO: 786441 - DNA, 25 bp, Mus musculus
tctgaagttgccttatcagaggaat

SEQ ID NO: 786442 - DNA, 25 bp, Mus musculus
tctgaatatcaaaaacgtatgctgg

SEQ ID NO: 786443 - DNA, 25 bp, Mus musculus
tctgaatatcaataacgtatgctgg

SEQ ID NO: 786444 - DNA, 25 bp, Mus musculus
tctgaatatgcgagccctggaatta

SEQ ID NO: 786445 - DNA, 25 bp, Mus musculus
tctgaatatgcgtgccctggaatta

SEQ ID NO: 786446 - DNA, 25 bp, Mus musculus
tctgaatattttaatgaagctccct

SEQ ID NO: 786447 - DNA, 25 bp, Mus musculus
tctgaatatttttatgaagctccct

SEQ ID NO: 786448 - DNA, 25 bp, Mus musculus
tctgaatcagacaataatgaaggtt

SEQ ID NO: 786449 - DNA, 25 bp, Mus musculus
tctgaatcagactataatgaaggtt

SEQ ID NO: 786450 - DNA, 25 bp, Mus musculus
tctgaatccgacactgattctgaag

SEQ ID NO: 786451 - DNA, 25 bp, Mus musculus
tctgaatccgactctgattctgaag

SEQ ID NO: 786452 - DNA, 25 bp, Mus musculus
tctgaatcctaaaacaaacctttgc

SEQ ID NO: 786453 - DNA, 25 bp, Mus musculus
tctgaatcctaatacaaacctttgc

SEQ ID NO: 786454 - DNA, 25 bp, Mus musculus
tctgaatctttcaggccaccaagac

SEQ ID NO: 786455 - DNA, 25 bp, Mus musculus
tctgaatctttctggccaccaagac

SEQ ID NO: 786456 - DNA, 25 bp, Mus musculus
tctgaatgacatcctgtgatcccta

SEQ ID NO: 786457 - DNA, 25 bp, Mus musculus
tctgaatgacatgctgtgatcccta

SEQ ID NO: 786458 - DNA, 25 bp, Mus musculus
tctgaatgactcacctgtgggcctg

SEQ ID NO: 786459 - DNA, 25 bp, Mus musculus
tctgaatgactctcctgtgggcctg

SEQ ID NO: 786460 - DNA, 25 bp, Mus musculus
tctgaatgagaaatgcccctcggtc

SEQ ID NO: 786461 - DNA, 25 bp, Mus musculus
tctgaatgagaattgcccctcggtc

SEQ ID NO: 786462 - DNA, 25 bp, Mus musculus
tctgaatgagcgacactatggagcc

SEQ ID NO: 786463 - DNA, 25 bp, Mus musculus
tctgaatgagcgtcactatggagcc

SEQ ID NO: 786464 - DNA, 25 bp, Mus musculus
tctgaatgcaagctcccatcgtcca

SEQ ID NO: 786465 - DNA, 25 bp, Mus musculus
tctgaatgcaaggtcccatcgtcca

SEQ ID NO: 786466 - DNA, 25 bp, Mus musculus
tctgaatgctagaggcccaacgaag

SEQ ID NO: 786467 - DNA, 25 bp, Mus musculus
tctgaatgctagtggcccaacgaag

SEQ ID NO: 786468 - DNA, 25 bp, Mus musculus
tctgaatggaccaatgaggtgtcca

SEQ ID NO: 786469 - DNA, 25 bp, Mus musculus
tctgaatggacctatgaggtgtcca

SEQ ID NO: 786470 - DNA, 25 bp, Mus musculus
tctgaatggcttctatatccccaag

SEQ ID NO: 786471 - DNA, 25 bp, Mus musculus
tctgaatggcttgtatatccccaag

SEQ ID NO: 786472 - DNA, 25 bp, Mus musculus
tctgaatgtctcctgcctgtccgtc

SEQ ID NO: 786473 - DNA, 25 bp, Mus musculus
tctgaatgtctcgtgcctgtccgtc

SEQ ID NO: 786474 - DNA, 25 bp, Mus musculus
tctgaatgtgatcacctgaccctcc

SEQ ID NO: 786475 - DNA, 25 bp, Mus musculus
tctgaatgtgatgacctgaccctcc

SEQ ID NO: 786476 - DNA, 25 bp, Mus musculus
tctgaattagggagcacctgaggcc

SEQ ID NO: 786477 - DNA, 25 bp, Mus musculus
tctgaattagggtgcacctgaggcc

SEQ ID NO: 786478 - DNA, 25 bp, Mus musculus
tctgaattcctcaatgtggtccaag

SEQ ID NO: 786479 - DNA, 25 bp, Mus musculus
tctgaattcctctatgtggtccaag

SEQ ID NO: 786480 - DNA, 25 bp, Mus musculus
tctgaattcttgcaggtcagtgttt

SEQ ID NO: 786481 - DNA, 25 bp, Mus musculus
tctgaattcttggaggtcagtgttt

SEQ ID NO: 786482 - DNA, 25 bp, Mus musculus
tctgaattggatccgaggctcaggc

SEQ ID NO: 786483 - DNA, 25 bp, Mus musculus
tctgaattggatgcgaggctcaggc

SEQ ID NO: 786484 - DNA, 25 bp, Mus musculus
tctgaattgttgagtaggttccggc

SEQ ID NO: 786485 - DNA, 25 bp, Mus musculus
tctgaattgttgtgtaggttccggc

SEQ ID NO: 786486 - DNA, 25 bp, Mus musculus
tctgaatttaatcatcttcgccttc

SEQ ID NO: 786487 - DNA, 25 bp, Mus musculus
tctgaatttaatgatcttcgccttc

SEQ ID NO: 786488 - DNA, 25 bp, Mus musculus
tctgaatttgggaataaaggcctct

SEQ ID NO: 786489 - DNA, 25 bp, Mus musculus
tctgaatttgggtataaaggcctct

SEQ ID NO: 786490 - DNA, 25 bp, Mus musculus
tctgacaatgcaccatctcttgctg

SEQ ID NO: 786491 - DNA, 25 bp, Mus musculus
tctgacaatgcagcatctcttgctg

SEQ ID NO: 786492 - DNA, 25 bp, Mus musculus
tctgacacaacaccgctattaaatg

SEQ ID NO: 786493 - DNA, 25 bp, Mus musculus
tctgacacaacagcgctattaaatg

SEQ ID NO: 786494 - DNA, 25 bp, Mus musculus
tctgacacattgaggctaactgggc

SEQ ID NO: 786495 - DNA, 25 bp, Mus musculus
tctgacacattgtggctaactgggc

SEQ ID NO: 786496 - DNA, 25 bp, Mus musculus
tctgacaccacaacatccactgatg

SEQ ID NO: 786497 - DNA, 25 bp, Mus musculus
tctgacaccacatcatccactgatg

SEQ ID NO: 786498 - DNA, 25 bp, Mus musculus
tctgacaccaccattcccatggatg

SEQ ID NO: 786499 - DNA, 25 bp, Mus musculus
tctgacaccacctttcccatggatg

SEQ ID NO: 786500 - DNA, 25 bp, Mus musculus
tctgacaccagactgcatgagctgc

SEQ ID NO: 786501 - DNA, 25 bp, Mus musculus
tctgacaccagagtgcatgagctgc

SEQ ID NO: 786502 - DNA, 25 bp, Mus musculus
tctgacacccgcactaggtatctgg

SEQ ID NO: 786503 - DNA, 25 bp, Mus musculus
tctgacacccgctctaggtatctgg

SEQ ID NO: 786504 - DNA, 25 bp, Mus musculus
tctgacactagtcactgtgtgctct

SEQ ID NO: 786505 - DNA, 25 bp, Mus musculus
tctgacactagtgactgtgtgctct

SEQ ID NO: 786506 - DNA, 25 bp, Mus musculus
tctgacagaacacaacgatgaaatc

SEQ ID NO: 786507 - DNA, 25 bp, Mus musculus
tctgacagaacagaacgatgaaatc

SEQ ID NO: 786508 - DNA, 25 bp, Mus musculus
tctgacagaggaaaatgaggaagca

SEQ ID NO: 786509 - DNA, 25 bp, Mus musculus
tctgacagaggataatgaggaagca

SEQ ID NO: 786510 - DNA, 25 bp, Mus musculus
tctgacagatctcccactgaagtag

SEQ ID NO: 786511 - DNA, 25 bp, Mus musculus
tctgacagatctgccactgaagtag

SEQ ID NO: 786512 - DNA, 25 bp, Mus musculus
tctgacaggataaacactgctcacg

SEQ ID NO: 786513 - DNA, 25 bp, Mus musculus
tctgacaggatatacactgctcacg

SEQ ID NO: 786514 - DNA, 25 bp, Mus musculus
tctgacaggttcacaccagttatgt

SEQ ID NO: 786515 - DNA, 25 bp, Mus musculus
tctgacaggttctcaccagttatgt

SEQ ID NO: 786516 - DNA, 25 bp, Mus musculus
tctgacagtcagcaacctggaggag

SEQ ID NO: 786517 - DNA, 25 bp, Mus musculus
tctgacagtcaggaacctggaggag

SEQ ID NO: 786518 - DNA, 25 bp, Mus musculus
tctgacagtgagatgcctccaaggg

SEQ ID NO: 786519 - DNA, 25 bp, Mus musculus
tctgacagtgagttgcctccaaggg

SEQ ID NO: 786520 - DNA, 25 bp, Mus musculus
tctgacatagttctgttgactcaca

SEQ ID NO: 786521 - DNA, 25 bp, Mus musculus
tctgacatagttgtgttgactcaca

SEQ ID NO: 786522 - DNA, 25 bp, Mus musculus
tctgacatgagactaaccctgaagg

SEQ ID NO: 786523 - DNA, 25 bp, Mus musculus
tctgacatgagagtaaccctgaagg

SEQ ID NO: 786524 - DNA, 25 bp, Mus musculus
tctgacatggatcttcagaagaagc

SEQ ID NO: 786525 - DNA, 25 bp, Mus musculus
tctgacatggatgttcagaagaagc

SEQ ID NO: 786526 - DNA, 25 bp, Mus musculus
tctgacatggcccactgaagggaag

SEQ ID NO: 786527 - DNA, 25 bp, Mus musculus
tctgacatggccgactgaagggaag

SEQ ID NO: 786528 - DNA, 25 bp, Mus musculus
tctgacatggtacaaaacacctagc

SEQ ID NO: 786529 - DNA, 25 bp, Mus musculus
tctgacatggtagaaaacacctagc

SEQ ID NO: 786530 - DNA, 25 bp, Mus musculus
tctgaccaaacccaagtttcattaa

SEQ ID NO: 786531 - DNA, 25 bp, Mus musculus
tctgaccaaaccgaagtttcattaa

SEQ ID NO: 786532 - DNA, 25 bp, Mus musculus
tctgaccaaagacctgcaaggcctt

SEQ ID NO: 786533 - DNA, 25 bp, Mus musculus
tctgaccaaagagctgcaaggcctt

SEQ ID NO: 786534 - DNA, 25 bp, Mus musculus
tctgaccaaggacatgactggaaag

SEQ ID NO: 786535 - DNA, 25 bp, Mus musculus
tctgaccaaggagatgactggaaag

SEQ ID NO: 786536 - DNA, 25 bp, Mus musculus
tctgaccaccaactaccaatggctg

SEQ ID NO: 786537 - DNA, 25 bp, Mus musculus
tctgaccaccaagtaccaatggctg

SEQ ID NO: 786538 - DNA, 25 bp, Mus musculus
tctgaccacgtcaagaaaggtttac

SEQ ID NO: 786539 - DNA, 25 bp, Mus musculus
tctgaccacgtctagaaaggtttac

SEQ ID NO: 786540 - DNA, 25 bp, Mus musculus
tctgaccagatccatgaaaaactcc

SEQ ID NO: 786541 - DNA, 25 bp, Mus musculus
tctgaccagatcgatgaaaaactcc

SEQ ID NO: 786542 - DNA, 25 bp, Mus musculus
tctgaccaggagatgcagagtgcca

SEQ ID NO: 786543 - DNA, 25 bp, Mus musculus
tctgaccaggagttgcagagtgcca

SEQ ID NO: 786544 - DNA, 25 bp, Mus musculus
tctgaccagggaagcagactgactt

SEQ ID NO: 786545 - DNA, 25 bp, Mus musculus
tctgaccagggatgcagactgactt

SEQ ID NO: 786546 - DNA, 25 bp, Mus musculus
tctgaccagtggaagcgtttgcatc

SEQ ID NO: 786547 - DNA, 25 bp, Mus musculus
tctgaccagtggtagcgtttgcatc

SEQ ID NO: 786548 - DNA, 25 bp, Mus musculus
tctgaccatcctcgggaacatgaag

SEQ ID NO: 786549 - DNA, 25 bp, Mus musculus
tctgaccatcctggggaacatgaag

SEQ ID NO: 786550 - DNA, 25 bp, Mus musculus
tctgaccatctgagaatagaaagct

SEQ ID NO: 786551 - DNA, 25 bp, Mus musculus
tctgaccatctgtgaatagaaagct

SEQ ID NO: 786552 - DNA, 25 bp, Mus musculus
tctgaccatcttatgtaccttataa

SEQ ID NO: 786553 - DNA, 25 bp, Mus musculus
tctgaccatcttttgtaccttataa

SEQ ID NO: 786554 - DNA, 25 bp, Mus musculus
tctgaccatgaacaaagacgagctt

SEQ ID NO: 786555 - DNA, 25 bp, Mus musculus
tctgaccatgaagaaagacgagctt

SEQ ID NO: 786556 - DNA, 25 bp, Mus musculus
tctgaccatgctctgaaaatctggg

SEQ ID NO: 786557 - DNA, 25 bp, Mus musculus
tctgaccatgctgtgaaaatctggg

SEQ ID NO: 786558 - DNA, 25 bp, Mus musculus
tctgacccagctcatcacatgatca

SEQ ID NO: 786559 - DNA, 25 bp, Mus musculus
tctgacccagctgatcacatgatca

SEQ ID NO: 786560 - DNA, 25 bp, Mus musculus
tctgacccataccacagtggctatg

SEQ ID NO: 786561 - DNA, 25 bp, Mus musculus
tctgacccatacgacagtggctatg

SEQ ID NO: 786562 - DNA, 25 bp, Mus musculus
tctgacccggttcaagtggatccac

SEQ ID NO: 786563 - DNA, 25 bp, Mus musculus
tctgacccggttgaagtggatccac

SEQ ID NO: 786564 - DNA, 25 bp, Mus musculus
tctgacccgtccagggcagagacca

SEQ ID NO: 786565 - DNA, 25 bp, Mus musculus
tctgacccgtcctgggcagagacca

SEQ ID NO: 786566 - DNA, 25 bp, Mus musculus
tctgaccctggcatttcagctttta

SEQ ID NO: 786567 - DNA, 25 bp, Mus musculus
tctgaccctggcttttcagctttta

SEQ ID NO: 786568 - DNA, 25 bp, Mus musculus
tctgacccttctcgagcaaaggaca

SEQ ID NO: 786569 - DNA, 25 bp, Mus musculus
tctgacccttctggagcaaaggaca

SEQ ID NO: 786570 - DNA, 25 bp, Mus musculus
tctgaccgaggacgcggtgttcctc

SEQ ID NO: 786571 - DNA, 25 bp, Mus musculus
tctgaccgaggaggcggtgttcctc

SEQ ID NO: 786572 - DNA, 25 bp, Mus musculus
tctgaccgatccacgtagcatctca

SEQ ID NO: 786573 - DNA, 25 bp, Mus musculus
tctgaccgatcctcgtagcatctca

SEQ ID NO: 786574 - DNA, 25 bp, Mus musculus
tctgaccgcagaacggagacccgtt

SEQ ID NO: 786575 - DNA, 25 bp, Mus musculus
tctgaccgcagatcggagacccgtt

SEQ ID NO: 786576 - DNA, 25 bp, Mus musculus
tctgaccgctggagtgatcacaatg

SEQ ID NO: 786577 - DNA, 25 bp, Mus musculus
tctgaccgctggtgtgatcacaatg

SEQ ID NO: 786578 - DNA, 25 bp, Mus musculus
tctgaccgggcgaggaagccaatta

SEQ ID NO: 786579 - DNA, 25 bp, Mus musculus
tctgaccgggcgtggaagccaatta

SEQ ID NO: 786580 - DNA, 25 bp, Mus musculus
tctgacctacgacctcaagaactgg

SEQ ID NO: 786581 - DNA, 25 bp, Mus musculus
tctgacctacgagctcaagaactgg

SEQ ID NO: 786582 - DNA, 25 bp, Mus musculus
tctgacctaggaaccctggccttgg

SEQ ID NO: 786583 - DNA, 25 bp, Mus musculus
tctgacctaggatccctggccttgg

SEQ ID NO: 786584 - DNA, 25 bp, Mus musculus
tctgacctagtgaaaggcatctccg

SEQ ID NO: 786585 - DNA, 25 bp, Mus musculus
tctgacctagtgtaaggcatctccg

SEQ ID NO: 786586 - DNA, 25 bp, Mus musculus
tctgacctatacacacattgccatg

SEQ ID NO: 786587 - DNA, 25 bp, Mus musculus
tctgacctatactcacattgccatg

SEQ ID NO: 786588 - DNA, 25 bp, Mus musculus
tctgacctcaggcagcatgggacag

SEQ ID NO: 786589 - DNA, 25 bp, Mus musculus
tctgacctcagggagcatgggacag

SEQ ID NO: 786590 - DNA, 25 bp, Mus musculus
tctgacctctggagatttggctgcc

SEQ ID NO: 786591 - DNA, 25 bp, Mus musculus
tctgacctctggtgatttggctgcc

SEQ ID NO: 786592 - DNA, 25 bp, Mus musculus
tctgacctgaaacccgagaagctgg

SEQ ID NO: 786593 - DNA, 25 bp, Mus musculus
tctgacctgaaagccgagaagctgg

SEQ ID NO: 786594 - DNA, 25 bp, Mus musculus
tctgacctgcatcataacaaacttc

SEQ ID NO: 786595 - DNA, 25 bp, Mus musculus
tctgacctgcatgataacaaacttc

SEQ ID NO: 786596 - DNA, 25 bp, Mus musculus
tctgacctgctcaaccaggagctgc

SEQ ID NO: 786597 - DNA, 25 bp, Mus musculus
tctgacctgctctaccaggagctgc

SEQ ID NO: 786598 - DNA, 25 bp, Mus musculus
tctgacctttgacagcaacaatgtg

SEQ ID NO: 786599 - DNA, 25 bp, Mus musculus
tctgacctttgagagcaacaatgtg

SEQ ID NO: 786600 - DNA, 25 bp, Mus musculus
tctgacgaagacatatgatgctgca

SEQ ID NO: 786601 - DNA, 25 bp, Mus musculus
tctgacgaagacttatgatgctgca

SEQ ID NO: 786602 - DNA, 25 bp, Mus musculus
tctgacgactggagatgtgattgct

SEQ ID NO: 786603 - DNA, 25 bp, Mus musculus
tctgacgactggtgatgtgattgct

SEQ ID NO: 786604 - DNA, 25 bp, Mus musculus
tctgacgatgatcacgtgtgttgag

SEQ ID NO: 786605 - DNA, 25 bp, Mus musculus
tctgacgatgatgacgtgtgttgag

SEQ ID NO: 786606 - DNA, 25 bp, Mus musculus
tctgacgcaagaactcttcaagggc

SEQ ID NO: 786607 - DNA, 25 bp, Mus musculus
tctgacgcaagatctcttcaagggc

SEQ ID NO: 786608 - DNA, 25 bp, Mus musculus
tctgacgctgagatgccatggcatc

SEQ ID NO: 786609 - DNA, 25 bp, Mus musculus
tctgacgctgagttgccatggcatc

SEQ ID NO: 786610 - DNA, 25 bp, Mus musculus
tctgacggccgtcaagcagaggttc

SEQ ID NO: 786611 - DNA, 25 bp, Mus musculus
tctgacggccgtgaagcagaggttc

SEQ ID NO: 786612 - DNA, 25 bp, Mus musculus
tctgacgtaggtcttggagccagct

SEQ ID NO: 786613 - DNA, 25 bp, Mus musculus
tctgacgtaggtgttggagccagct

SEQ ID NO: 786614 - DNA, 25 bp, Mus musculus
tctgacgtgattacaggaagcatac

SEQ ID NO: 786615 - DNA, 25 bp, Mus musculus
tctgacgtgatttcaggaagcatac

SEQ ID NO: 786616 - DNA, 25 bp, Mus musculus
tctgacgtggcactgaaacagctgc

SEQ ID NO: 786617 - DNA, 25 bp, Mus musculus
tctgacgtggcagtgaaacagctgc

SEQ ID NO: 786618 - DNA, 25 bp, Mus musculus
tctgacgttgggagataaatccacc

SEQ ID NO: 786619 - DNA, 25 bp, Mus musculus
tctgacgttgggtgataaatccacc

SEQ ID NO: 786620 - DNA, 25 bp, Mus musculus
tctgacgttgtcaccatgaagctaa

SEQ ID NO: 786621 - DNA, 25 bp, Mus musculus
tctgacgttgtctccatgaagctaa

SEQ ID NO: 786622 - DNA, 25 bp, Mus musculus
tctgacgttgtgacctcagtgagag

SEQ ID NO: 786623 - DNA, 25 bp, Mus musculus
tctgacgttgtgtcctcagtgagag

SEQ ID NO: 786624 - DNA, 25 bp, Mus musculus
tctgactacgccatcctgggtacag

SEQ ID NO: 786625 - DNA, 25 bp, Mus musculus
tctgactacgccttcctgggtacag

SEQ ID NO: 786626 - DNA, 25 bp, Mus musculus
tctgactactgaacaaactgtctgt

SEQ ID NO: 786627 - DNA, 25 bp, Mus musculus
tctgactactgatcaaactgtctgt

SEQ ID NO: 786628 - DNA, 25 bp, Mus musculus
tctgactcacatcaaagctgggtgc

SEQ ID NO: 786629 - DNA, 25 bp, Mus musculus
tctgactcacatgaaagctgggtgc

SEQ ID NO: 786630 - DNA, 25 bp, Mus musculus
tctgactcatctaggtgaactatgc

SEQ ID NO: 786631 - DNA, 25 bp, Mus musculus
tctgactcatcttggtgaactatgc

SEQ ID NO: 786632 - DNA, 25 bp, Mus musculus
tctgactcgcagacgacatgagccg

SEQ ID NO: 786633 - DNA, 25 bp, Mus musculus
tctgactcgcagtcgacatgagccg

SEQ ID NO: 786634 - DNA, 25 bp, Mus musculus
tctgactcgctcaggtggcattgct

SEQ ID NO: 786635 - DNA, 25 bp, Mus musculus
tctgactcgctctggtggcattgct

SEQ ID NO: 786636 - DNA, 25 bp, Mus musculus
tctgactcggatccattggtcaaat

SEQ ID NO: 786637 - DNA, 25 bp, Mus musculus
tctgactcggatgcattggtcaaat

SEQ ID NO: 786638 - DNA, 25 bp, Mus musculus
tctgactctagcctctgggacacgt

SEQ ID NO: 786639 - DNA, 25 bp, Mus musculus
tctgactctagcgtctgggacacgt

SEQ ID NO: 786640 - DNA, 25 bp, Mus musculus
tctgactctcatcactctggttctt

SEQ ID NO: 786641 - DNA, 25 bp, Mus musculus
tctgactctcatgactctggttctt

SEQ ID NO: 786642 - DNA, 25 bp, Mus musculus
tctgactctccacttttgatctgaa

SEQ ID NO: 786643 - DNA, 25 bp, Mus musculus
tctgactctccagttttgatctgaa

SEQ ID NO: 786644 - DNA, 25 bp, Mus musculus
tctgactctgagacagacgtgagca

SEQ ID NO: 786645 - DNA, 25 bp, Mus musculus
tctgactctgagtcagacgtgagca

SEQ ID NO: 786646 - DNA, 25 bp, Mus musculus
tctgactcttccatcggtgtccgag

SEQ ID NO: 786647 - DNA, 25 bp, Mus musculus
tctgactcttccttcggtgtccgag

SEQ ID NO: 786648 - DNA, 25 bp, Mus musculus
tctgactgaactcgaggcggccatt

SEQ ID NO: 786649 - DNA, 25 bp, Mus musculus
tctgactgaactggaggcggccatt

SEQ ID NO: 786650 - DNA, 25 bp, Mus musculus
tctgactgaagaaactgggatggca

SEQ ID NO: 786651 - DNA, 25 bp, Mus musculus
tctgactgaagatactgggatggca

SEQ ID NO: 786652 - DNA, 25 bp, Mus musculus
tctgactgaaggacctggtgccgag

SEQ ID NO: 786653 - DNA, 25 bp, Mus musculus
tctgactgaaggtcctggtgccgag

SEQ ID NO: 786654 - DNA, 25 bp, Mus musculus
tctgactgatgtccaaggtcttgca

SEQ ID NO: 786655 - DNA, 25 bp, Mus musculus
tctgactgatgtgcaaggtcttgca

SEQ ID NO: 786656 - DNA, 25 bp, Mus musculus
tctgactgcattagcctgccgccaa

SEQ ID NO: 786657 - DNA, 25 bp, Mus musculus
tctgactgcatttgcctgccgccaa

SEQ ID NO: 786658 - DNA, 25 bp, Mus musculus
tctgactgctgcagccgtctcagat

SEQ ID NO: 786659 - DNA, 25 bp, Mus musculus
tctgactgctgctgccgtctcagat

SEQ ID NO: 786660 - DNA, 25 bp, Mus musculus
tctgactggcctcagaaggcatgac

SEQ ID NO: 786661 - DNA, 25 bp, Mus musculus
tctgactggcctgagaaggcatgac

SEQ ID NO: 786662 - DNA, 25 bp, Mus musculus
tctgactgtagtaattactgcaagg

SEQ ID NO: 786663 - DNA, 25 bp, Mus musculus
tctgactgtagttattactgcaagg

SEQ ID NO: 786664 - DNA, 25 bp, Mus musculus
tctgactgtcacagaaatattggaa

SEQ ID NO: 786665 - DNA, 25 bp, Mus musculus
tctgactgtcactgaaatattggaa

SEQ ID NO: 786666 - DNA, 25 bp, Mus musculus
tctgacttaaagacgccaggaccga

SEQ ID NO: 786667 - DNA, 25 bp, Mus musculus
tctgacttaaagtcgccaggaccga

SEQ ID NO: 786668 - DNA, 25 bp, Mus musculus
tctgacttccccagcaggtctaatt

SEQ ID NO: 786669 - DNA, 25 bp, Mus musculus
tctgacttcccctgcaggtctaatt

SEQ ID NO: 786670 - DNA, 25 bp, Mus musculus
tctgacttcctgaactctcaccgga

SEQ ID NO: 786671 - DNA, 25 bp, Mus musculus
tctgacttcctgtactctcaccgga

SEQ ID NO: 786672 - DNA, 25 bp, Mus musculus
tctgacttcgtgagcaaaaacggcc

SEQ ID NO: 786673 - DNA, 25 bp, Mus musculus
tctgacttcgtgtgcaaaaacggcc

SEQ ID NO: 786674 - DNA, 25 bp, Mus musculus
tctgacttctccactgtgtgagctg

SEQ ID NO: 786675 - DNA, 25 bp, Mus musculus
tctgacttctcctctgtgtgagctg

SEQ ID NO: 786676 - DNA, 25 bp, Mus musculus
tctgacttctgaacgctgagggtgg

SEQ ID NO: 786677 - DNA, 25 bp, Mus musculus
tctgacttctgatcgctgagggtgg

SEQ ID NO: 786678 - DNA, 25 bp, Mus musculus
tctgacttggaaaccccagattcca

SEQ ID NO: 786679 - DNA, 25 bp, Mus musculus
tctgacttggaatccccagattcca

SEQ ID NO: 786680 - DNA, 25 bp, Mus musculus
tctgacttggttactccaaatggga

SEQ ID NO: 786681 - DNA, 25 bp, Mus musculus
tctgacttggtttctccaaatggga

SEQ ID NO: 786682 - DNA, 25 bp, Mus musculus
tctgactttatgactgacgtccctg

SEQ ID NO: 786683 - DNA, 25 bp, Mus musculus
tctgactttatgtctgacgtccctg

SEQ ID NO: 786684 - DNA, 25 bp, Mus musculus
tctgactttgccaagcctgggacga

SEQ ID NO: 786685 - DNA, 25 bp, Mus musculus
tctgactttgcctagcctgggacga

SEQ ID NO: 786686 - DNA, 25 bp, Mus musculus
tctgagaaagtcatgctgcacctgc

SEQ ID NO: 786687 - DNA, 25 bp, Mus musculus
tctgagaaagtcttgctgcacctgc

SEQ ID NO: 786688 - DNA, 25 bp, Mus musculus
tctgagaaatagagccctaagggac

SEQ ID NO: 786689 - DNA, 25 bp, Mus musculus
tctgagaaatagtgccctaagggac

SEQ ID NO: 786690 - DNA, 25 bp, Mus musculus
tctgagaacagcaccgaggaagaat

SEQ ID NO: 786691 - DNA, 25 bp, Mus musculus
tctgagaacagctccgaggaagaat

SEQ ID NO: 786692 - DNA, 25 bp, Mus musculus
tctgagaacgtgaactcgcagtggc

SEQ ID NO: 786693 - DNA, 25 bp, Mus musculus
tctgagaacgtgtactcgcagtggc

SEQ ID NO: 786694 - DNA, 25 bp, Mus musculus
tctgagaactacattgttagcctgc

SEQ ID NO: 786695 - DNA, 25 bp, Mus musculus
tctgagaactactttgttagcctgc

SEQ ID NO: 786696 - DNA, 25 bp, Mus musculus
tctgagaactccatcatttttatgc

SEQ ID NO: 786697 - DNA, 25 bp, Mus musculus
tctgagaactccttcatttttatgc

SEQ ID NO: 786698 - DNA, 25 bp, Mus musculus
tctgagaactggatctgtttctaca

SEQ ID NO: 786699 - DNA, 25 bp, Mus musculus
tctgagaactggttctgtttctaca

SEQ ID NO: 786700 - DNA, 25 bp, Mus musculus
tctgagaagacaaacatccgggctt

SEQ ID NO: 786701 - DNA, 25 bp, Mus musculus
tctgagaagacatacatccgggctt

SEQ ID NO: 786702 - DNA, 25 bp, Mus musculus
tctgagaagcagcatcaatctgcag

SEQ ID NO: 786703 - DNA, 25 bp, Mus musculus
tctgagaagcaggatcaatctgcag

SEQ ID NO: 786704 - DNA, 25 bp, Mus musculus
tctgagaagctacgtgatgtctacc

SEQ ID NO: 786705 - DNA, 25 bp, Mus musculus
tctgagaagctaggtgatgtctacc

SEQ ID NO: 786706 - DNA, 25 bp, Mus musculus
tctgagaaggctatgggaacacacc

SEQ ID NO: 786707 - DNA, 25 bp, Mus musculus
tctgagaaggctttgggaacacacc

SEQ ID NO: 786708 - DNA, 25 bp, Mus musculus
tctgagaaggttacccggggctgtc

SEQ ID NO: 786709 - DNA, 25 bp, Mus musculus
tctgagaaggtttcccggggctgtc

SEQ ID NO: 786710 - DNA, 25 bp, Mus musculus
tctgagaagtagcaatcagagccca

SEQ ID NO: 786711 - DNA, 25 bp, Mus musculus
tctgagaagtaggaatcagagccca

SEQ ID NO: 786712 - DNA, 25 bp, Mus musculus
tctgagaagtccagaaagtaatctc

SEQ ID NO: 786713 - DNA, 25 bp, Mus musculus
tctgagaagtcctgaaagtaatctc

SEQ ID NO: 786714 - DNA, 25 bp, Mus musculus
tctgagaagtgactatcggtcagca

SEQ ID NO: 786715 - DNA, 25 bp, Mus musculus
tctgagaagtgagtatcggtcagca

SEQ ID NO: 786716 - DNA, 25 bp, Mus musculus
tctgagacaaggatcgaaaagcgaa

SEQ ID NO: 786717 - DNA, 25 bp, Mus musculus
tctgagacaaggcttggcgttcagt

SEQ ID NO: 786718 - DNA, 25 bp, Mus musculus
tctgagacaagggttggcgttcagt

SEQ ID NO: 786719 - DNA, 25 bp, Mus musculus
tctgagacaaggttcgaaaagcgaa

SEQ ID NO: 786720 - DNA, 25 bp, Mus musculus
tctgagacacagcaagcaaccagcc

SEQ ID NO: 786721 - DNA, 25 bp, Mus musculus
tctgagacacaggaagcaaccagcc

SEQ ID NO: 786722 - DNA, 25 bp, Mus musculus
tctgagacacatcgcccagatggca

SEQ ID NO: 786723 - DNA, 25 bp, Mus musculus
tctgagacacatggcccagatggca

SEQ ID NO: 786724 - DNA, 25 bp, Mus musculus
tctgagacaggcaatgaaggactta

SEQ ID NO: 786725 - DNA, 25 bp, Mus musculus
tctgagacaggctatgaaggactta

SEQ ID NO: 786726 - DNA, 25 bp, Mus musculus
tctgagacagtcattacatctgtag

SEQ ID NO: 786727 - DNA, 25 bp, Mus musculus
tctgagacagtctttacatctgtag

SEQ ID NO: 786728 - DNA, 25 bp, Mus musculus
tctgagacagtgatactttgctatt

SEQ ID NO: 786729 - DNA, 25 bp, Mus musculus
tctgagacagtgttactttgctatt

SEQ ID NO: 786730 - DNA, 25 bp, Mus musculus
tctgagaccatgaggaaagcatcca

SEQ ID NO: 786731 - DNA, 25 bp, Mus musculus
tctgagaccatgtggaaagcatcca

SEQ ID NO: 786732 - DNA, 25 bp, Mus musculus
tctgagaccgtgctacctgggaacc

SEQ ID NO: 786733 - DNA, 25 bp, Mus musculus
tctgagaccgtggtacctgggaacc

SEQ ID NO: 786734 - DNA, 25 bp, Mus musculus
tctgagactgacaccaggtatttcg

SEQ ID NO: 786735 - DNA, 25 bp, Mus musculus
tctgagactgactccaggtatttcg

SEQ ID NO: 786736 - DNA, 25 bp, Mus musculus
tctgagagatatatgagtaaaggat

SEQ ID NO: 786737 - DNA, 25 bp, Mus musculus
tctgagagatatttgagtaaaggat

SEQ ID NO: 786738 - DNA, 25 bp, Mus musculus
tctgagagcagacaggtgatctgaa

SEQ ID NO: 786739 - DNA, 25 bp, Mus musculus
tctgagagcagagaggtgatctgaa

SEQ ID NO: 786740 - DNA, 25 bp, Mus musculus
tctgagagccctcatgaacacacag

SEQ ID NO: 786741 - DNA, 25 bp, Mus musculus
tctgagagccctgatgaacacacag

SEQ ID NO: 786742 - DNA, 25 bp, Mus musculus
tctgagagcctccaacggcaagttt

SEQ ID NO: 786743 - DNA, 25 bp, Mus musculus
tctgagagcctcgaacggcaagttt

SEQ ID NO: 786744 - DNA, 25 bp, Mus musculus
tctgagagcggcatctgtaggaccc

SEQ ID NO: 786745 - DNA, 25 bp, Mus musculus
tctgagagcggcttctgtaggaccc

SEQ ID NO: 786746 - DNA, 25 bp, Mus musculus
tctgagagctagatggtttgtggcc

SEQ ID NO: 786747 - DNA, 25 bp, Mus musculus
tctgagagctagttggtttgtggcc

SEQ ID NO: 786748 - DNA, 25 bp, Mus musculus
tctgagagctctcgaattgtaccgc

SEQ ID NO: 786749 - DNA, 25 bp, Mus musculus
tctgagagctctggaattgtaccgc

SEQ ID NO: 786750 - DNA, 25 bp, Mus musculus
tctgagaggaaaatactgaagcagt

SEQ ID NO: 786751 - DNA, 25 bp, Mus musculus
tctgagaggaaattactgaagcagt

SEQ ID NO: 786752 - DNA, 25 bp, Mus musculus
tctgagaggactaccccagtcccta

SEQ ID NO: 786753 - DNA, 25 bp, Mus musculus
tctgagaggacttccccagtcccta

SEQ ID NO: 786754 - DNA, 25 bp, Mus musculus
tctgagaggagtcttaagagagact

SEQ ID NO: 786755 - DNA, 25 bp, Mus musculus
tctgagaggagtgttaagagagact

SEQ ID NO: 786756 - DNA, 25 bp, Mus musculus
tctgagagtctccatcaaatcccca

SEQ ID NO: 786757 - DNA, 25 bp, Mus musculus
tctgagagtctcgatcaaatcccca

SEQ ID NO: 786758 - DNA, 25 bp, Mus musculus
tctgagataatacaatcgctgtcgc

SEQ ID NO: 786759 - DNA, 25 bp, Mus musculus
tctgagataatagaatcgctgtcgc

SEQ ID NO: 786760 - DNA, 25 bp, Mus musculus
tctgagatagcaccaggcaggaatg

SEQ ID NO: 786761 - DNA, 25 bp, Mus musculus
tctgagatagcagcaggcaggaatg

SEQ ID NO: 786762 - DNA, 25 bp, Mus musculus
tctgagatgagcagcctacgccgta

SEQ ID NO: 786763 - DNA, 25 bp, Mus musculus
tctgagatgagctgcctacgccgta

SEQ ID NO: 786764 - DNA, 25 bp, Mus musculus
tctgagatggccacaacagtgaagg

SEQ ID NO: 786765 - DNA, 25 bp, Mus musculus
tctgagatggcctcaacagtgaagg

SEQ ID NO: 786766 - DNA, 25 bp, Mus musculus
tctgagatgtgacacaagtacatgt

SEQ ID NO: 786767 - DNA, 25 bp, Mus musculus
tctgagatgtgagacaagtacatgt

SEQ ID NO: 786768 - DNA, 25 bp, Mus musculus
tctgagattcaacagagcttccgag

SEQ ID NO: 786769 - DNA, 25 bp, Mus musculus
tctgagattcaagagagcttccgag

SEQ ID NO: 786770 - DNA, 25 bp, Mus musculus
tctgagattggcaggctcacctacc

SEQ ID NO: 786771 - DNA, 25 bp, Mus musculus
tctgagattggctggctcacctacc

SEQ ID NO: 786772 - DNA, 25 bp, Mus musculus
tctgagcaaaatcggctccttcctc

SEQ ID NO: 786773 - DNA, 25 bp, Mus musculus
tctgagcaaaatgggctccttcctc

SEQ ID NO: 786774 - DNA, 25 bp, Mus musculus
tctgagcaacaactctgccttgccg

SEQ ID NO: 786775 - DNA, 25 bp, Mus musculus
tctgagcaacaagtctgccttgccg

SEQ ID NO: 786776 - DNA, 25 bp, Mus musculus
tctgagcaagctctcgtctggaccc

SEQ ID NO: 786777 - DNA, 25 bp, Mus musculus
tctgagcaagctgtcgtctggaccc

SEQ ID NO: 786778 - DNA, 25 bp, Mus musculus
tctgagcacagacgatctggtcaac

SEQ ID NO: 786779 - DNA, 25 bp, Mus musculus
tctgagcacagaggatctggtcaac

SEQ ID NO: 786780 - DNA, 25 bp, Mus musculus
tctgagcaccatagccactgtgagg

SEQ ID NO: 786781 - DNA, 25 bp, Mus musculus
tctgagcaccattgccactgtgagg

SEQ ID NO: 786782 - DNA, 25 bp, Mus musculus
tctgagcaccttcatgagtggattg

SEQ ID NO: 786783 - DNA, 25 bp, Mus musculus
tctgagcaccttgatgagtggattg

SEQ ID NO: 786784 - DNA, 25 bp, Mus musculus
tctgagcactatcaccagctctgtg

SEQ ID NO: 786785 - DNA, 25 bp, Mus musculus
tctgagcactatgaccagctctgtg

SEQ ID NO: 786786 - DNA, 25 bp, Mus musculus
tctgagcactgactgggctcaccca

SEQ ID NO: 786787 - DNA, 25 bp, Mus musculus
tctgagcactgagtgggctcaccca

SEQ ID NO: 786788 - DNA, 25 bp, Mus musculus
tctgagcagcccatgtctgaacgga

SEQ ID NO: 786789 - DNA, 25 bp, Mus musculus
tctgagcagcccttgtctgaacgga

SEQ ID NO: 786790 - DNA, 25 bp, Mus musculus
tctgagcagcttcacaaagggtggc

SEQ ID NO: 786791 - DNA, 25 bp, Mus musculus
tctgagcagcttgacaaagggtggc

SEQ ID NO: 786792 - DNA, 25 bp, Mus musculus
tctgagcagtccagcgttggtaccc

SEQ ID NO: 786793 - DNA, 25 bp, Mus musculus
tctgagcagtcctgcgttggtaccc

SEQ ID NO: 786794 - DNA, 25 bp, Mus musculus
tctgagcagttgctcagctgcagca

SEQ ID NO: 786795 - DNA, 25 bp, Mus musculus
tctgagcagttggtcagctgcagca

SEQ ID NO: 786796 - DNA, 25 bp, Mus musculus
tctgagcatcacacgagctgtgcgc

SEQ ID NO: 786797 - DNA, 25 bp, Mus musculus
tctgagcatcactcgagctgtgcgc

SEQ ID NO: 786798 - DNA, 25 bp, Mus musculus
tctgagcatctcagccatgcggctc

SEQ ID NO: 786799 - DNA, 25 bp, Mus musculus
tctgagcatctctgccatgcggctc

SEQ ID NO: 786800 - DNA, 25 bp, Mus musculus
tctgagcatgccagccttgggactg

SEQ ID NO: 786801 - DNA, 25 bp, Mus musculus
tctgagcatgcctgccttgggactg

SEQ ID NO: 786802 - DNA, 25 bp, Mus musculus
tctgagccacatattacaatttaga

SEQ ID NO: 786803 - DNA, 25 bp, Mus musculus
tctgagccacattttacaatttaga

SEQ ID NO: 786804 - DNA, 25 bp, Mus musculus
tctgagccacctcggatgatgggta

SEQ ID NO: 786805 - DNA, 25 bp, Mus musculus
tctgagccacctgggatgatgggta

SEQ ID NO: 786806 - DNA, 25 bp, Mus musculus
tctgagccagtgcagatcgggatcc

SEQ ID NO: 786807 - DNA, 25 bp, Mus musculus
tctgagccagtggagatcgggatcc

SEQ ID NO: 786808 - DNA, 25 bp, Mus musculus
tctgagccatccacatggatgaact

SEQ ID NO: 786809 - DNA, 25 bp, Mus musculus
tctgagccatccagagccagagcaa

SEQ ID NO: 786810 - DNA, 25 bp, Mus musculus
tctgagccatcctcatggatgaact

SEQ ID NO: 786811 - DNA, 25 bp, Mus musculus
tctgagccatcctgagccagagcaa

SEQ ID NO: 786812 - DNA, 25 bp, Mus musculus
tctgagcctgggacgcctcctgtgc

SEQ ID NO: 786813 - DNA, 25 bp, Mus musculus
tctgagcctgggtcgcctcctgtgc

SEQ ID NO: 786814 - DNA, 25 bp, Mus musculus
tctgagcctgtgataccctcctctg

SEQ ID NO: 786815 - DNA, 25 bp, Mus musculus
tctgagcctgtgttaccctcctctg

SEQ ID NO: 786816 - DNA, 25 bp, Mus musculus
tctgagccttctcaagcgtgctaag

SEQ ID NO: 786817 - DNA, 25 bp, Mus musculus
tctgagccttctgaagcgtgctaag

SEQ ID NO: 786818 - DNA, 25 bp, Mus musculus
tctgagccttgtaccctgtagtgac

SEQ ID NO: 786819 - DNA, 25 bp, Mus musculus
tctgagccttgttccctgtagtgac

SEQ ID NO: 786820 - DNA, 25 bp, Mus musculus
tctgagcctttaagcaaagcacgga

SEQ ID NO: 786821 - DNA, 25 bp, Mus musculus
tctgagcctttatgcaaagcacgga

SEQ ID NO: 786822 - DNA, 25 bp, Mus musculus
tctgagcgaggtccagaatatggct

SEQ ID NO: 786823 - DNA, 25 bp, Mus musculus
tctgagcgaggtgcagaatatggct

SEQ ID NO: 786824 - DNA, 25 bp, Mus musculus
tctgagcgatcacgccagctgttgg

SEQ ID NO: 786825 - DNA, 25 bp, Mus musculus
tctgagcgatcaggccagctgttgg

SEQ ID NO: 786826 - DNA, 25 bp, Mus musculus
tctgagcgatgaagagaacttaaga

SEQ ID NO: 786827 - DNA, 25 bp, Mus musculus
tctgagcgatgatgagaacttaaga

SEQ ID NO: 786828 - DNA, 25 bp, Mus musculus
tctgagcgcaaacattaaggcacgg

SEQ ID NO: 786829 - DNA, 25 bp, Mus musculus
tctgagcgcaaagattaaggcacgg

SEQ ID NO: 786830 - DNA, 25 bp, Mus musculus
tctgagcgccacagtagcacaaggc

SEQ ID NO: 786831 - DNA, 25 bp, Mus musculus
tctgagcgccactgtagcacaaggc

SEQ ID NO: 786832 - DNA, 25 bp, Mus musculus
tctgagcgctagaacccggctccgg

SEQ ID NO: 786833 - DNA, 25 bp, Mus musculus
tctgagcgctagtacccggctccgg

SEQ ID NO: 786834 - DNA, 25 bp, Mus musculus
tctgagcggagacaatcaaggcctt

SEQ ID NO: 786835 - DNA, 25 bp, Mus musculus
tctgagcggagagaatcaaggcctt

SEQ ID NO: 786836 - DNA, 25 bp, Mus musculus
tctgagcgttaaagacgtctttgtg

SEQ ID NO: 786837 - DNA, 25 bp, Mus musculus
tctgagcgttaatgacgtctttgtg

SEQ ID NO: 786838 - DNA, 25 bp, Mus musculus
tctgagctgactcagccatcaatat

SEQ ID NO: 786839 - DNA, 25 bp, Mus musculus
tctgagctgactgagccatcaatat

SEQ ID NO: 786840 - DNA, 25 bp, Mus musculus
tctgagctgagacctatggctctgg

SEQ ID NO: 786841 - DNA, 25 bp, Mus musculus
tctgagctgagagctatggctctgg

SEQ ID NO: 786842 - DNA, 25 bp, Mus musculus
tctgagctgcggaacctggtgagca

SEQ ID NO: 786843 - DNA, 25 bp, Mus musculus
tctgagctgcggtacctggtgagca

SEQ ID NO: 786844 - DNA, 25 bp, Mus musculus
tctgagctgcgtcgtaaagcggaca

SEQ ID NO: 786845 - DNA, 25 bp, Mus musculus
tctgagctgcgtggtaaagcggaca

SEQ ID NO: 786846 - DNA, 25 bp, Mus musculus
tctgagctggatcctgtagagaacc

SEQ ID NO: 786847 - DNA, 25 bp, Mus musculus
tctgagctggatgctgtagagaacc

SEQ ID NO: 786848 - DNA, 25 bp, Mus musculus
tctgagctgggcaacacccagcaac

SEQ ID NO: 786849 - DNA, 25 bp, Mus musculus
tctgagctgggctacacccagcaac

SEQ ID NO: 786850 - DNA, 25 bp, Mus musculus
tctgagctggtcagtaagtctgcag

SEQ ID NO: 786851 - DNA, 25 bp, Mus musculus
tctgagctggtctgtaagtctgcag

SEQ ID NO: 786852 - DNA, 25 bp, Mus musculus
tctgagctgtcaagctttgaccagc

SEQ ID NO: 786853 - DNA, 25 bp, Mus musculus
tctgagctgtcatgctttgaccagc

SEQ ID NO: 786854 - DNA, 25 bp, Mus musculus
tctgagctgtggacaggcatctctg

SEQ ID NO: 786855 - DNA, 25 bp, Mus musculus
tctgagctgtggtcaggcatctctg

SEQ ID NO: 786856 - DNA, 25 bp, Mus musculus
tctgagcttaaaaaacttgatggtc

SEQ ID NO: 786857 - DNA, 25 bp, Mus musculus
tctgagcttaaataacttgatggtc

SEQ ID NO: 786858 - DNA, 25 bp, Mus musculus
tctgagcttactctcactactgttc

SEQ ID NO: 786859 - DNA, 25 bp, Mus musculus
tctgagcttactgtcactactgttc

SEQ ID NO: 786860 - DNA, 25 bp, Mus musculus
tctgagcttcctatgatcccttgca

SEQ ID NO: 786861 - DNA, 25 bp, Mus musculus
tctgagcttcctttgatcccttgca

SEQ ID NO: 786862 - DNA, 25 bp, Mus musculus
tctgaggaaaccctacggtcgcaac

SEQ ID NO: 786863 - DNA, 25 bp, Mus musculus
tctgaggaaaccgtacggtcgcaac

SEQ ID NO: 786864 - DNA, 25 bp, Mus musculus
tctgaggaaagtcgaagccgccaag

SEQ ID NO: 786865 - DNA, 25 bp, Mus musculus
tctgaggaaagtggaagccgccaag

SEQ ID NO: 786866 - DNA, 25 bp, Mus musculus
tctgaggaacgtctccgctgaggat

SEQ ID NO: 786867 - DNA, 25 bp, Mus musculus
tctgaggaacgtgtccgctgaggat

SEQ ID NO: 786868 - DNA, 25 bp, Mus musculus
tctgaggaagagatacagttgattc

SEQ ID NO: 786869 - DNA, 25 bp, Mus musculus
tctgaggaagagttacagttgattc

SEQ ID NO: 786870 - DNA, 25 bp, Mus musculus
tctgaggaagctattcccaatatca

SEQ ID NO: 786871 - DNA, 25 bp, Mus musculus
tctgaggaagcttttcccaatatca

SEQ ID NO: 786872 - DNA, 25 bp, Mus musculus
tctgaggaatgaaggaattgccatt

SEQ ID NO: 786873 - DNA, 25 bp, Mus musculus
tctgaggaatgacaaaacagttacc

SEQ ID NO: 786874 - DNA, 25 bp, Mus musculus
tctgaggaatgagaaaacagttacc

SEQ ID NO: 786875 - DNA, 25 bp, Mus musculus
tctgaggaatgatggaattgccatt

SEQ ID NO: 786876 - DNA, 25 bp, Mus musculus
tctgaggacatgcaacaggatgccg

SEQ ID NO: 786877 - DNA, 25 bp, Mus musculus
tctgaggacatggaacaggatgccg

SEQ ID NO: 786878 - DNA, 25 bp, Mus musculus
tctgaggactttcgtactagcatct

SEQ ID NO: 786879 - DNA, 25 bp, Mus musculus
tctgaggactttggtactagcatct

SEQ ID NO: 786880 - DNA, 25 bp, Mus musculus
tctgaggagaagacaaataggaccc

SEQ ID NO: 786881 - DNA, 25 bp, Mus musculus
tctgaggagaagtcaaataggaccc

SEQ ID NO: 786882 - DNA, 25 bp, Mus musculus
tctgaggagaccataaagcttctga

SEQ ID NO: 786883 - DNA, 25 bp, Mus musculus
tctgaggagaccttaaagcttctga

SEQ ID NO: 786884 - DNA, 25 bp, Mus musculus
tctgaggagagactgcggagactgc

SEQ ID NO: 786885 - DNA, 25 bp, Mus musculus
tctgaggagagagtgcggagactgc

SEQ ID NO: 786886 - DNA, 25 bp, Mus musculus
tctgaggagatgagtacctcacctc

SEQ ID NO: 786887 - DNA, 25 bp, Mus musculus
tctgaggagatgtgtacctcacctc

SEQ ID NO: 786888 - DNA, 25 bp, Mus musculus
tctgaggagcctctattcagggcca

SEQ ID NO: 786889 - DNA, 25 bp, Mus musculus
tctgaggagcctgtattcagggcca

SEQ ID NO: 786890 - DNA, 25 bp, Mus musculus
tctgaggaggctccttagaaagcca

SEQ ID NO: 786891 - DNA, 25 bp, Mus musculus
tctgaggaggctgcttagaaagcca

SEQ ID NO: 786892 - DNA, 25 bp, Mus musculus
tctgaggagtgaattgcaacgcaat

SEQ ID NO: 786893 - DNA, 25 bp, Mus musculus
tctgaggagtgatttgcaacgcaat

SEQ ID NO: 786894 - DNA, 25 bp, Mus musculus
tctgaggataccaagtagatagcct

SEQ ID NO: 786895 - DNA, 25 bp, Mus musculus
tctgaggatacctagtagatagcct

SEQ ID NO: 786896 - DNA, 25 bp, Mus musculus
tctgaggatcctctttgggtccctg

SEQ ID NO: 786897 - DNA, 25 bp, Mus musculus
tctgaggatcctgtttgggtccctg

SEQ ID NO: 786898 - DNA, 25 bp, Mus musculus
tctgaggatgaacacagcatggaca

SEQ ID NO: 786899 - DNA, 25 bp, Mus musculus
tctgaggatgaagacagcatggaca

SEQ ID NO: 786900 - DNA, 25 bp, Mus musculus
tctgaggatgtgatcattgtcacaa

SEQ ID NO: 786901 - DNA, 25 bp, Mus musculus
tctgaggatgtgttcattgtcacaa

SEQ ID NO: 786902 - DNA, 25 bp, Mus musculus
tctgaggcacggatgagtacagccg

SEQ ID NO: 786903 - DNA, 25 bp, Mus musculus
tctgaggcacggttgagtacagccg

SEQ ID NO: 786904 - DNA, 25 bp, Mus musculus
tctgaggcacgtacctctgatccaa

SEQ ID NO: 786905 - DNA, 25 bp, Mus musculus
tctgaggcacgttcctctgatccaa

SEQ ID NO: 786906 - DNA, 25 bp, Mus musculus
tctgaggccaatctccgggaaattt

SEQ ID NO: 786907 - DNA, 25 bp, Mus musculus
tctgaggccaatgtccgggaaattt

SEQ ID NO: 786908 - DNA, 25 bp, Mus musculus
tctgaggccagaagagaaggccatc

SEQ ID NO: 786909 - DNA, 25 bp, Mus musculus
tctgaggccagatgagaaggccatc

SEQ ID NO: 786910 - DNA, 25 bp, Mus musculus
tctgaggcccaaagtattttaagga

SEQ ID NO: 786911 - DNA, 25 bp, Mus musculus
tctgaggcccaatgtattttaagga

SEQ ID NO: 786912 - DNA, 25 bp, Mus musculus
tctgaggccgcactatgacatgttg

SEQ ID NO: 786913 - DNA, 25 bp, Mus musculus
tctgaggccgcagtatgacatgttg

SEQ ID NO: 786914 - DNA, 25 bp, Mus musculus
tctgaggcctcgctggtccgtgcct

SEQ ID NO: 786915 - DNA, 25 bp, Mus musculus
tctgaggcctcggtggtccgtgcct

SEQ ID NO: 786916 - DNA, 25 bp, Mus musculus
tctgaggcctgtacttgtgtgtttc

SEQ ID NO: 786917 - DNA, 25 bp, Mus musculus
tctgaggcctgtctctcggctctgc

SEQ ID NO: 786918 - DNA, 25 bp, Mus musculus
tctgaggcctgtgtctcggctctgc

SEQ ID NO: 786919 - DNA, 25 bp, Mus musculus
tctgaggcctgttcttgtgtgtttc

SEQ ID NO: 786920 - DNA, 25 bp, Mus musculus
tctgaggctcatacggctgcctctg

SEQ ID NO: 786921 - DNA, 25 bp, Mus musculus
tctgaggctcattcggctgcctctg

SEQ ID NO: 786922 - DNA, 25 bp, Mus musculus
tctgaggctggtcttcttcgtgaac

SEQ ID NO: 786923 - DNA, 25 bp, Mus musculus
tctgaggctggtgttcttcgtgaac

SEQ ID NO: 786924 - DNA, 25 bp, Mus musculus
tctgagggaaatcttcatctgctgg

SEQ ID NO: 786925 - DNA, 25 bp, Mus musculus
tctgagggaaatgttcatctgctgg

SEQ ID NO: 786926 - DNA, 25 bp, Mus musculus
tctgagggaacaacagctgacagag

SEQ ID NO: 786927 - DNA, 25 bp, Mus musculus
tctgagggaacatcagctgacagag

SEQ ID NO: 786928 - DNA, 25 bp, Mus musculus
tctgagggagctcgaaagcagcctc

SEQ ID NO: 786929 - DNA, 25 bp, Mus musculus
tctgagggagctggaaagcagcctc

SEQ ID NO: 786930 - DNA, 25 bp, Mus musculus
tctgagggaggaccaccggccatct

SEQ ID NO: 786931 - DNA, 25 bp, Mus musculus
tctgagggaggagcaccggccatct

SEQ ID NO: 786932 - DNA, 25 bp, Mus musculus
tctgagggccacacactcgtgatca

SEQ ID NO: 786933 - DNA, 25 bp, Mus musculus
tctgagggccactcactcgtgatca

SEQ ID NO: 786934 - DNA, 25 bp, Mus musculus
tctgagggctctcctttgcatgtca

SEQ ID NO: 786935 - DNA, 25 bp, Mus musculus
tctgagggctctgctttgcatgtca

SEQ ID NO: 786936 - DNA, 25 bp, Mus musculus
tctgagggctggcaccatgcccatg

SEQ ID NO: 786937 - DNA, 25 bp, Mus musculus
tctgagggctgggaccatgcccatg

SEQ ID NO: 786938 - DNA, 25 bp, Mus musculus
tctgagggcttgcacgtcgagaccc

SEQ ID NO: 786939 - DNA, 25 bp, Mus musculus
tctgagggcttggacgtcgagaccc

SEQ ID NO: 786940 - DNA, 25 bp, Mus musculus
tctgaggggaagaactctgctaaag

SEQ ID NO: 786941 - DNA, 25 bp, Mus musculus
tctgaggggaagtactctgctaaag

SEQ ID NO: 786942 - DNA, 25 bp, Mus musculus
tctgagggtcagcatccaggcatgc

SEQ ID NO: 786943 - DNA, 25 bp, Mus musculus
tctgagggtcagcatggccaagcat

SEQ ID NO: 786944 - DNA, 25 bp, Mus musculus
tctgagggtcaggatccaggcatgc

SEQ ID NO: 786945 - DNA, 25 bp, Mus musculus
tctgagggtcaggatggccaagcat

SEQ ID NO: 786946 - DNA, 25 bp, Mus musculus
tctgaggtcctcctgggtgatgacc

SEQ ID NO: 786947 - DNA, 25 bp, Mus musculus
tctgaggtcctcgtgggtgatgacc

SEQ ID NO: 786948 - DNA, 25 bp, Mus musculus
tctgaggtctctagaggaaatttta

SEQ ID NO: 786949 - DNA, 25 bp, Mus musculus
tctgaggtctcttgaggaaatttta

SEQ ID NO: 786950 - DNA, 25 bp, Mus musculus
tctgaggtgccaacggaagcagcat

SEQ ID NO: 786951 - DNA, 25 bp, Mus musculus
tctgaggtgccatcggaagcagcat

SEQ ID NO: 786952 - DNA, 25 bp, Mus musculus
tctgaggtggagacctagctagcca

SEQ ID NO: 786953 - DNA, 25 bp, Mus musculus
tctgaggtggagtcctagctagcca

SEQ ID NO: 786954 - DNA, 25 bp, Mus musculus
tctgaggtgggtacctcactaggta

SEQ ID NO: 786955 - DNA, 25 bp, Mus musculus
tctgaggtgggttcctcactaggta

SEQ ID NO: 786956 - DNA, 25 bp, Mus musculus
tctgaggtgtttcacatagagtgta

SEQ ID NO: 786957 - DNA, 25 bp, Mus musculus
tctgaggtgtttgacatagagtgta

SEQ ID NO: 786958 - DNA, 25 bp, Mus musculus
tctgaggttctcacacgtggcttgc

SEQ ID NO: 786959 - DNA, 25 bp, Mus musculus
tctgaggttctctcacgtggcttgc

SEQ ID NO: 786960 - DNA, 25 bp, Mus musculus
tctgagtaagagctgtaacccagcc

SEQ ID NO: 786961 - DNA, 25 bp, Mus musculus
tctgagtaagaggtgtaacccagcc

SEQ ID NO: 786962 - DNA, 25 bp, Mus musculus
tctgagtaccacaccctgctctatg

SEQ ID NO: 786963 - DNA, 25 bp, Mus musculus
tctgagtaccactccctgctctatg

SEQ ID NO: 786964 - DNA, 25 bp, Mus musculus
tctgagtaccagactatcccactta

SEQ ID NO: 786965 - DNA, 25 bp, Mus musculus
tctgagtaccagtctatcccactta

SEQ ID NO: 786966 - DNA, 25 bp, Mus musculus
tctgagtaccggcaatatgctgaca

SEQ ID NO: 786967 - DNA, 25 bp, Mus musculus
tctgagtaccgggaatatgctgaca

SEQ ID NO: 786968 - DNA, 25 bp, Mus musculus
tctgagtcactgcttcctcttgctg

SEQ ID NO: 786969 - DNA, 25 bp, Mus musculus
tctgagtcactggttcctcttgctg

SEQ ID NO: 786970 - DNA, 25 bp, Mus musculus
tctgagtcagcaagggattcatgat

SEQ ID NO: 786971 - DNA, 25 bp, Mus musculus
tctgagtcagcatgggattcatgat

SEQ ID NO: 786972 - DNA, 25 bp, Mus musculus
tctgagtccaaaagaagggtttgcc

SEQ ID NO: 786973 - DNA, 25 bp, Mus musculus
tctgagtccaaatgaagggtttgcc

SEQ ID NO: 786974 - DNA, 25 bp, Mus musculus
tctgagtccacacaggcaccaggtg

SEQ ID NO: 786975 - DNA, 25 bp, Mus musculus
tctgagtccacagaggcaccaggtg

SEQ ID NO: 786976 - DNA, 25 bp, Mus musculus
tctgagtccatgattcgagaggtgg

SEQ ID NO: 786977 - DNA, 25 bp, Mus musculus
tctgagtccatgtttcgagaggtgg

SEQ ID NO: 786978 - DNA, 25 bp, Mus musculus
tctgagtccccacggaaaatgcagg

SEQ ID NO: 786979 - DNA, 25 bp, Mus musculus
tctgagtccccagggaaaatgcagg

SEQ ID NO: 786980 - DNA, 25 bp, Mus musculus
tctgagtcctggacagacggctgta

SEQ ID NO: 786981 - DNA, 25 bp, Mus musculus
tctgagtcctggtcagacggctgta

SEQ ID NO: 786982 - DNA, 25 bp, Mus musculus
tctgagtcgctgcttcctttggcgg

SEQ ID NO: 786983 - DNA, 25 bp, Mus musculus
tctgagtcgctggttcctttggcgg

SEQ ID NO: 786984 - DNA, 25 bp, Mus musculus
tctgagtcggctaccgagttggaac

SEQ ID NO: 786985 - DNA, 25 bp, Mus musculus
tctgagtcggcttccgagttggaac

SEQ ID NO: 786986 - DNA, 25 bp, Mus musculus
tctgagtctagaacctgtcccaggc

SEQ ID NO: 786987 - DNA, 25 bp, Mus musculus
tctgagtctagatcctgtcccaggc

SEQ ID NO: 786988 - DNA, 25 bp, Mus musculus
tctgagtctcccaaagtccccttta

SEQ ID NO: 786989 - DNA, 25 bp, Mus musculus
tctgagtctccctaagtccccttta

SEQ ID NO: 786990 - DNA, 25 bp, Mus musculus
tctgagtctccgctgctcaagggcc

SEQ ID NO: 786991 - DNA, 25 bp, Mus musculus
tctgagtctccggtgctcaagggcc

SEQ ID NO: 786992 - DNA, 25 bp, Mus musculus
tctgagtgccaaagtgggtgacctc

SEQ ID NO: 786993 - DNA, 25 bp, Mus musculus
tctgagtgccaatgtgggtgacctc

SEQ ID NO: 786994 - DNA, 25 bp, Mus musculus
tctgagtgccttccccaaggaacga

SEQ ID NO: 786995 - DNA, 25 bp, Mus musculus
tctgagtgccttgcccaaggaacga

SEQ ID NO: 786996 - DNA, 25 bp, Mus musculus
tctgagtgctgactaacaccaaact

SEQ ID NO: 786997 - DNA, 25 bp, Mus musculus
tctgagtgctgagtaacaccaaact

SEQ ID NO: 786998 - DNA, 25 bp, Mus musculus
tctgagtgggacacaagctctgtag

SEQ ID NO: 786999 - DNA, 25 bp, Mus musculus
tctgagtgggactcaagctctgtag

SEQ ID NO: 787000 - DNA, 25 bp, Mus musculus
tctgagtgtcatatctacaacggga

SEQ ID NO: 787001 - DNA, 25 bp, Mus musculus
tctgagtgtcatttctacaacggga

SEQ ID NO: 787002 - DNA, 25 bp, Mus musculus
tctgagtgtcttacccatggctggg

SEQ ID NO: 787003 - DNA, 25 bp, Mus musculus
tctgagtgtctttcccatggctggg

SEQ ID NO: 787004 - DNA, 25 bp, Mus musculus
tctgagtgtttgaccctttcaggac

SEQ ID NO: 787005 - DNA, 25 bp, Mus musculus
tctgagtgtttgtccctttcaggac

SEQ ID NO: 787006 - DNA, 25 bp, Mus musculus
tctgagtgttttcctgcttttgccc

SEQ ID NO: 787007 - DNA, 25 bp, Mus musculus
tctgagtgttttgctgcttttgccc

SEQ ID NO: 787008 - DNA, 25 bp, Mus musculus
tctgagttcactagcacatggattc

SEQ ID NO: 787009 - DNA, 25 bp, Mus musculus
tctgagttcacttgcacatggattc

SEQ ID NO: 787010 - DNA, 25 bp, Mus musculus
tctgagttccctctttgtcctttat

SEQ ID NO: 787011 - DNA, 25 bp, Mus musculus
tctgagttccctgtttgtcctttat

SEQ ID NO: 787012 - DNA, 25 bp, Mus musculus
tctgagttctatactggctggctag

SEQ ID NO: 787013 - DNA, 25 bp, Mus musculus
tctgagttctattctggctggctag

SEQ ID NO: 787014 - DNA, 25 bp, Mus musculus
tctgagttctcactggttcgccagc

SEQ ID NO: 787015 - DNA, 25 bp, Mus musculus
tctgagttctcagtggttcgccagc

SEQ ID NO: 787016 - DNA, 25 bp, Mus musculus
tctgagttcttgcttgcaggacggt

SEQ ID NO: 787017 - DNA, 25 bp, Mus musculus
tctgagttcttggttgcaggacggt

SEQ ID NO: 787018 - DNA, 25 bp, Mus musculus
tctgagttgatgatttaggttccac

SEQ ID NO: 787019 - DNA, 25 bp, Mus musculus
tctgagttgatgttttaggttccac

SEQ ID NO: 787020 - DNA, 25 bp, Mus musculus
tctgagttggaaaatgctatttgct

SEQ ID NO: 787021 - DNA, 25 bp, Mus musculus
tctgagttggaatatgctatttgct

SEQ ID NO: 787022 - DNA, 25 bp, Mus musculus
tctgagttgtccaaccgtgagatta

SEQ ID NO: 787023 - DNA, 25 bp, Mus musculus
tctgagttgtcctaccgtgagatta

SEQ ID NO: 787024 - DNA, 25 bp, Mus musculus
tctgagtttcctagtctcggcgcgc

SEQ ID NO: 787025 - DNA, 25 bp, Mus musculus
tctgagtttcctcttgctactgggc

SEQ ID NO: 787026 - DNA, 25 bp, Mus musculus
tctgagtttcctgttgctactgggc

SEQ ID NO: 787027 - DNA, 25 bp, Mus musculus
tctgagtttccttgtctcggcgcgc

SEQ ID NO: 787028 - DNA, 25 bp, Mus musculus
tctgataaggccaccctgctggcct

SEQ ID NO: 787029 - DNA, 25 bp, Mus musculus
tctgataaggcctccctgctggcct

SEQ ID NO: 787030 - DNA, 25 bp, Mus musculus
tctgataagtgacctgcaacctggg

SEQ ID NO: 787031 - DNA, 25 bp, Mus musculus
tctgataagtgagctgcaacctggg

SEQ ID NO: 787032 - DNA, 25 bp, Mus musculus
tctgatacgggaagtggggcttacc

SEQ ID NO: 787033 - DNA, 25 bp, Mus musculus
tctgatacgggatgtggggcttacc

SEQ ID NO: 787034 - DNA, 25 bp, Mus musculus
tctgatagagctccctggccactgt

SEQ ID NO: 787035 - DNA, 25 bp, Mus musculus
tctgatagagctgcctggccactgt

SEQ ID NO: 787036 - DNA, 25 bp, Mus musculus
tctgatagatggacgtgtcgaagga

SEQ ID NO: 787037 - DNA, 25 bp, Mus musculus
tctgatagatggtcgtgtcgaagga

SEQ ID NO: 787038 - DNA, 25 bp, Mus musculus
tctgatagattcaaactgaaaggca

SEQ ID NO: 787039 - DNA, 25 bp, Mus musculus
tctgatagattctaactgaaaggca

SEQ ID NO: 787040 - DNA, 25 bp, Mus musculus
tctgatatagaaagcatgagataca

SEQ ID NO: 787041 - DNA, 25 bp, Mus musculus
tctgatatagaatgcatgagataca

SEQ ID NO: 787042 - DNA, 25 bp, Mus musculus
tctgatatcagcacccgattacaaa

SEQ ID NO: 787043 - DNA, 25 bp, Mus musculus
tctgatatcagctcccgattacaaa

SEQ ID NO: 787044 - DNA, 25 bp, Mus musculus
tctgatatcattcggctacggaaca

SEQ ID NO: 787045 - DNA, 25 bp, Mus musculus
tctgatatcattgggctacggaaca

SEQ ID NO: 787046 - DNA, 25 bp, Mus musculus
tctgatattatcactgtgttcacac

SEQ ID NO: 787047 - DNA, 25 bp, Mus musculus
tctgatattatctctgtgttcacac

SEQ ID NO: 787048 - DNA, 25 bp, Mus musculus
tctgatattctcactcaaagaggaa

SEQ ID NO: 787049 - DNA, 25 bp, Mus musculus
tctgatattctctctcaaagaggaa

SEQ ID NO: 787050 - DNA, 25 bp, Mus musculus
tctgatatttgaattgctggtgaag

SEQ ID NO: 787051 - DNA, 25 bp, Mus musculus
tctgatatttgatttgctggtgaag

SEQ ID NO: 787052 - DNA, 25 bp, Mus musculus
tctgatcaaaagctcggaggagcca

SEQ ID NO: 787053 - DNA, 25 bp, Mus musculus
tctgatcaaaaggtcggaggagcca

SEQ ID NO: 787054 - DNA, 25 bp, Mus musculus
tctgatcagacactgctgttccagg

SEQ ID NO: 787055 - DNA, 25 bp, Mus musculus
tctgatcagacagtgctgttccagg

SEQ ID NO: 787056 - DNA, 25 bp, Mus musculus
tctgatcagtaaccatcaggctgca

SEQ ID NO: 787057 - DNA, 25 bp, Mus musculus
tctgatcagtaagcatcaggctgca

SEQ ID NO: 787058 - DNA, 25 bp, Mus musculus
tctgatcagtttaacctctgggaat

SEQ ID NO: 787059 - DNA, 25 bp, Mus musculus
tctgatcagttttacctctgggaat

SEQ ID NO: 787060 - DNA, 25 bp, Mus musculus
tctgatccagaccttccaaaaggaa

SEQ ID NO: 787061 - DNA, 25 bp, Mus musculus
tctgatccagacgttccaaaaggaa

SEQ ID NO: 787062 - DNA, 25 bp, Mus musculus
tctgatccagtgaaaaggcgggcat

SEQ ID NO: 787063 - DNA, 25 bp, Mus musculus
tctgatccagtgtaaaggcgggcat

SEQ ID NO: 787064 - DNA, 25 bp, Mus musculus
tctgatcccaggctcacagttacca

SEQ ID NO: 787065 - DNA, 25 bp, Mus musculus
tctgatcccagggtcacagttacca

SEQ ID NO: 787066 - DNA, 25 bp, Mus musculus
tctgatccgaaaacatgaggccttt

SEQ ID NO: 787067 - DNA, 25 bp, Mus musculus
tctgatccgaaatcatgaggccttt

SEQ ID NO: 787068 - DNA, 25 bp, Mus musculus
tctgatccgttcaagaagcaccaag

SEQ ID NO: 787069 - DNA, 25 bp, Mus musculus
tctgatccgttctagaagcaccaag

SEQ ID NO: 787070 - DNA, 25 bp, Mus musculus
tctgatcgaaggacgatacggtgcc

SEQ ID NO: 787071 - DNA, 25 bp, Mus musculus
tctgatcgaaggtcgatacggtgcc

SEQ ID NO: 787072 - DNA, 25 bp, Mus musculus
tctgatcgagacagaggataaggcg

SEQ ID NO: 787073 - DNA, 25 bp, Mus musculus
tctgatcgagactgaggataaggcg

SEQ ID NO: 787074 - DNA, 25 bp, Mus musculus
tctgatcgccatcgctgtggttgct

SEQ ID NO: 787075 - DNA, 25 bp, Mus musculus
tctgatcgccatggctgtggttgct

SEQ ID NO: 787076 - DNA, 25 bp, Mus musculus
tctgatcggaagcaggctgagaatc

SEQ ID NO: 787077 - DNA, 25 bp, Mus musculus
tctgatcggaaggaggctgagaatc

SEQ ID NO: 787078 - DNA, 25 bp, Mus musculus
tctgatcggttgacaaagtcaagcc

SEQ ID NO: 787079 - DNA, 25 bp, Mus musculus
tctgatcggttgtcaaagtcaagcc

SEQ ID NO: 787080 - DNA, 25 bp, Mus musculus
tctgatcgtaaactggtgcttttgc

SEQ ID NO: 787081 - DNA, 25 bp, Mus musculus
tctgatcgtaaagtggtgcttttgc

SEQ ID NO: 787082 - DNA, 25 bp, Mus musculus
tctgatctataacaaagcccacaag

SEQ ID NO: 787083 - DNA, 25 bp, Mus musculus
tctgatctataagaaagcccacaag

SEQ ID NO: 787084 - DNA, 25 bp, Mus musculus
tctgatctccagctaaccatcttgg

SEQ ID NO: 787085 - DNA, 25 bp, Mus musculus
tctgatctccaggtaaccatcttgg

SEQ ID NO: 787086 - DNA, 25 bp, Mus musculus
tctgatctgagacgtacgttcatag

SEQ ID NO: 787087 - DNA, 25 bp, Mus musculus
tctgatctgagaggtacgttcatag

SEQ ID NO: 787088 - DNA, 25 bp, Mus musculus
tctgatctggagagtacagagctgg

SEQ ID NO: 787089 - DNA, 25 bp, Mus musculus
tctgatctggagtgtacagagctgg

SEQ ID NO: 787090 - DNA, 25 bp, Mus musculus
tctgatctgggtaagtgtgtctggc

SEQ ID NO: 787091 - DNA, 25 bp, Mus musculus
tctgatctgggttagtgtgtctggc

SEQ ID NO: 787092 - DNA, 25 bp, Mus musculus
tctgatcttcatagaaacatagctg

SEQ ID NO: 787093 - DNA, 25 bp, Mus musculus
tctgatcttcattgaaacatagctg

SEQ ID NO: 787094 - DNA, 25 bp, Mus musculus
tctgatcttctcaccacgtgggaag

SEQ ID NO: 787095 - DNA, 25 bp, Mus musculus
tctgatcttctctccacgtgggaag

SEQ ID NO: 787096 - DNA, 25 bp, Mus musculus
tctgatgaactgcactacttggagg

SEQ ID NO: 787097 - DNA, 25 bp, Mus musculus
tctgatgaactggactacttggagg

SEQ ID NO: 787098 - DNA, 25 bp, Mus musculus
tctgatgacaatcgccaggatttga

SEQ ID NO: 787099 - DNA, 25 bp, Mus musculus
tctgatgacaatggccaggatttga

SEQ ID NO: 787100 - DNA, 25 bp, Mus musculus
tctgatgacacactaatagaggaca

SEQ ID NO: 787101 - DNA, 25 bp, Mus musculus
tctgatgacacagtaatagaggaca

SEQ ID NO: 787102 - DNA, 25 bp, Mus musculus
tctgatgacacgagttctgatgaga

SEQ ID NO: 787103 - DNA, 25 bp, Mus musculus
tctgatgacacgcagaaaaaagatg

SEQ ID NO: 787104 - DNA, 25 bp, Mus musculus
tctgatgacacggagaaaaaagatg

SEQ ID NO: 787105 - DNA, 25 bp, Mus musculus
tctgatgacacgtgttctgatgaga

SEQ ID NO: 787106 - DNA, 25 bp, Mus musculus
tctgatgacttacatgatttgaact

SEQ ID NO: 787107 - DNA, 25 bp, Mus musculus
tctgatgacttagatgatttgaact

SEQ ID NO: 787108 - DNA, 25 bp, Mus musculus
tctgatgagagcaattgagatctat

SEQ ID NO: 787109 - DNA, 25 bp, Mus musculus
tctgatgagagctattgagatctat

SEQ ID NO: 787110 - DNA, 25 bp, Mus musculus
tctgatgagcagaaccatctggtgg

SEQ ID NO: 787111 - DNA, 25 bp, Mus musculus
tctgatgagcagtaccatctggtgg

SEQ ID NO: 787112 - DNA, 25 bp, Mus musculus
tctgatgagcatccccgtgagatgt

SEQ ID NO: 787113 - DNA, 25 bp, Mus musculus
tctgatgagcatgcccgtgagatgt

SEQ ID NO: 787114 - DNA, 25 bp, Mus musculus
tctgatgatgaaaaacccacggatg

SEQ ID NO: 787115 - DNA, 25 bp, Mus musculus
tctgatgatgaataacccacggatg

SEQ ID NO: 787116 - DNA, 25 bp, Mus musculus
tctgatgatgccacatgccgactct

SEQ ID NO: 787117 - DNA, 25 bp, Mus musculus
tctgatgatgcctcatgccgactct

SEQ ID NO: 787118 - DNA, 25 bp, Mus musculus
tctgatgcagaaacgagatccgaga

SEQ ID NO: 787119 - DNA, 25 bp, Mus musculus
tctgatgcagaatcgagatccgaga

SEQ ID NO: 787120 - DNA, 25 bp, Mus musculus
tctgatgcatgcaccaatttggtca

SEQ ID NO: 787121 - DNA, 25 bp, Mus musculus
tctgatgcatgctccaatttggtca

SEQ ID NO: 787122 - DNA, 25 bp, Mus musculus
tctgatgccacaaaagccagcgagg

SEQ ID NO: 787123 - DNA, 25 bp, Mus musculus
tctgatgccacaatgtgtgcggtgg

SEQ ID NO: 787124 - DNA, 25 bp, Mus musculus
tctgatgccacataagccagcgagg

SEQ ID NO: 787125 - DNA, 25 bp, Mus musculus
tctgatgccacattgtgtgcggtgg

SEQ ID NO: 787126 - DNA, 25 bp, Mus musculus
tctgatgccatcatcgacctgctga

SEQ ID NO: 787127 - DNA, 25 bp, Mus musculus
tctgatgccatcttcgacctgctga

SEQ ID NO: 787128 - DNA, 25 bp, Mus musculus
tctgatgcctgtaaagaagtcgtcc

SEQ ID NO: 787129 - DNA, 25 bp, Mus musculus
tctgatgcctgttaagaagtcgtcc

SEQ ID NO: 787130 - DNA, 25 bp, Mus musculus
tctgatgcctttaaccactagagac

SEQ ID NO: 787131 - DNA, 25 bp, Mus musculus
tctgatgccttttaccactagagac

SEQ ID NO: 787132 - DNA, 25 bp, Mus musculus
tctgatgcgcatctacaacgtgcgc

SEQ ID NO: 787133 - DNA, 25 bp, Mus musculus
tctgatgcgcatgtacaacgtgcgc

SEQ ID NO: 787134 - DNA, 25 bp, Mus musculus
tctgatgcgtcgctgggtcatcgcc

SEQ ID NO: 787135 - DNA, 25 bp, Mus musculus
tctgatgcgtcggtgggtcatcgcc

SEQ ID NO: 787136 - DNA, 25 bp, Mus musculus
tctgatgctatcatgaatatgcagg

SEQ ID NO: 787137 - DNA, 25 bp, Mus musculus
tctgatgctatcttgaatatgcagg

SEQ ID NO: 787138 - DNA, 25 bp, Mus musculus
tctgatgctctaagcgtgggctgca

SEQ ID NO: 787139 - DNA, 25 bp, Mus musculus
tctgatgctctatgcgtgggctgca

SEQ ID NO: 787140 - DNA, 25 bp, Mus musculus
tctgatgcttgcaacttacatctag

SEQ ID NO: 787141 - DNA, 25 bp, Mus musculus
tctgatgcttgctacttacatctag

SEQ ID NO: 787142 - DNA, 25 bp, Mus musculus
tctgatggaacacttaagatgctgg

SEQ ID NO: 787143 - DNA, 25 bp, Mus musculus
tctgatggaacagttaagatgctgg

SEQ ID NO: 787144 - DNA, 25 bp, Mus musculus
tctgatggaatcactaagcaaagtg

SEQ ID NO: 787145 - DNA, 25 bp, Mus musculus
tctgatggaatctctaagcaaagtg

SEQ ID NO: 787146 - DNA, 25 bp, Mus musculus
tctgatggacgacaatcagaacgag

SEQ ID NO: 787147 - DNA, 25 bp, Mus musculus
tctgatggacgagaatcagaacgag

SEQ ID NO: 787148 - DNA, 25 bp, Mus musculus
tctgatggagacaacccagtacatg

SEQ ID NO: 787149 - DNA, 25 bp, Mus musculus
tctgatggagaccacgcctgacatt

SEQ ID NO: 787150 - DNA, 25 bp, Mus musculus
tctgatggagacgacgcctgacatt

SEQ ID NO: 787151 - DNA, 25 bp, Mus musculus
tctgatggagactacccagtacatg

SEQ ID NO: 787152 - DNA, 25 bp, Mus musculus
tctgatggaggacgacacataccgg

SEQ ID NO: 787153 - DNA, 25 bp, Mus musculus
tctgatggaggaggacacataccgg

SEQ ID NO: 787154 - DNA, 25 bp, Mus musculus
tctgatggatctaagcccggcttct

SEQ ID NO: 787155 - DNA, 25 bp, Mus musculus
tctgatggatcttagcccggcttct

SEQ ID NO: 787156 - DNA, 25 bp, Mus musculus
tctgatggatgacatagaaagggca

SEQ ID NO: 787157 - DNA, 25 bp, Mus musculus
tctgatggatgagatagaaagggca

SEQ ID NO: 787158 - DNA, 25 bp, Mus musculus
tctgatggatgccagtgtagtgcac

SEQ ID NO: 787159 - DNA, 25 bp, Mus musculus
tctgatggatgcgagtgtagtgcac

SEQ ID NO: 787160 - DNA, 25 bp, Mus musculus
tctgatggattcagcattgctcaaa

SEQ ID NO: 787161 - DNA, 25 bp, Mus musculus
tctgatggattctgcattgctcaaa

SEQ ID NO: 787162 - DNA, 25 bp, Mus musculus
tctgatggcaacacctatggtgtcc

SEQ ID NO: 787163 - DNA, 25 bp, Mus musculus
tctgatggcaactcctatggtgtcc

SEQ ID NO: 787164 - DNA, 25 bp, Mus musculus
tctgatggccacagcttcctaacca

SEQ ID NO: 787165 - DNA, 25 bp, Mus musculus
tctgatggccactgcttcctaacca

SEQ ID NO: 787166 - DNA, 25 bp, Mus musculus
tctgatggcgccacctaccgggacg

SEQ ID NO: 787167 - DNA, 25 bp, Mus musculus
tctgatggcgcctcctaccgggacg

SEQ ID NO: 787168 - DNA, 25 bp, Mus musculus
tctgatggtatgcagaccagagcac

SEQ ID NO: 787169 - DNA, 25 bp, Mus musculus
tctgatggtatggagaccagagcac

SEQ ID NO: 787170 - DNA, 25 bp, Mus musculus
tctgatggtggcatgcctgtctccc

SEQ ID NO: 787171 - DNA, 25 bp, Mus musculus
tctgatggtggcttgcctgtctccc

SEQ ID NO: 787172 - DNA, 25 bp, Mus musculus
tctgatgtaccaacctggactgtgc

SEQ ID NO: 787173 - DNA, 25 bp, Mus musculus
tctgatgtaccatcctggactgtgc

SEQ ID NO: 787174 - DNA, 25 bp, Mus musculus
tctgatgtcatgagttccctctgtc

SEQ ID NO: 787175 - DNA, 25 bp, Mus musculus
tctgatgtcatgtgttccctctgtc

SEQ ID NO: 787176 - DNA, 25 bp, Mus musculus
tctgatgtctctaacaacaggaagc

SEQ ID NO: 787177 - DNA, 25 bp, Mus musculus
tctgatgtctcttacaacaggaagc

SEQ ID NO: 787178 - DNA, 25 bp, Mus musculus
tctgatgtctggatggctgagtacc

SEQ ID NO: 787179 - DNA, 25 bp, Mus musculus
tctgatgtctggttggctgagtacc

SEQ ID NO: 787180 - DNA, 25 bp, Mus musculus
tctgatgtcttacgcaacttaaacc

SEQ ID NO: 787181 - DNA, 25 bp, Mus musculus
tctgatgtcttaggcaacttaaacc

SEQ ID NO: 787182 - DNA, 25 bp, Mus musculus
tctgatgtgcttacgagaagcctcc

SEQ ID NO: 787183 - DNA, 25 bp, Mus musculus
tctgatgtgctttcgagaagcctcc

SEQ ID NO: 787184 - DNA, 25 bp, Mus musculus
tctgatgttcggatatgggaatgag

SEQ ID NO: 787185 - DNA, 25 bp, Mus musculus
tctgatgttcggttatgggaatgag

SEQ ID NO: 787186 - DNA, 25 bp, Mus musculus
tctgatgttgaactggaagaaaaag

SEQ ID NO: 787187 - DNA, 25 bp, Mus musculus
tctgatgttgaagtggaagaaaaag

SEQ ID NO: 787188 - DNA, 25 bp, Mus musculus
tctgatgtttacagcatgttatggg

SEQ ID NO: 787189 - DNA, 25 bp, Mus musculus
tctgatgtttactgcatgttatggg

SEQ ID NO: 787190 - DNA, 25 bp, Mus musculus
tctgattaaagacgaagccagtgca

SEQ ID NO: 787191 - DNA, 25 bp, Mus musculus
tctgattaaagaggaagccagtgca

SEQ ID NO: 787192 - DNA, 25 bp, Mus musculus
tctgattcagaaagggcatgccctg

SEQ ID NO: 787193 - DNA, 25 bp, Mus musculus
tctgattcagaatgggcatgccctg

SEQ ID NO: 787194 - DNA, 25 bp, Mus musculus
tctgattcagacaagagaaaacatt

SEQ ID NO: 787195 - DNA, 25 bp, Mus musculus
tctgattcagactagagaaaacatt

SEQ ID NO: 787196 - DNA, 25 bp, Mus musculus
tctgattcagagaggctacgactct

SEQ ID NO: 787197 - DNA, 25 bp, Mus musculus
tctgattcagagtggctacgactct

SEQ ID NO: 787198 - DNA, 25 bp, Mus musculus
tctgattcagatcggagccgcagtg

SEQ ID NO: 787199 - DNA, 25 bp, Mus musculus
tctgattcagatgggagccgcagtg

SEQ ID NO: 787200 - DNA, 25 bp, Mus musculus
tctgattcaggacggaacgacggaa

SEQ ID NO: 787201 - DNA, 25 bp, Mus musculus
tctgattcaggagggaacgacggaa

SEQ ID NO: 787202 - DNA, 25 bp, Mus musculus
tctgattcaggcaagctggagtcct

SEQ ID NO: 787203 - DNA, 25 bp, Mus musculus
tctgattcaggctagctggagtcct

SEQ ID NO: 787204 - DNA, 25 bp, Mus musculus
tctgattccacacagagcccctatc

SEQ ID NO: 787205 - DNA, 25 bp, Mus musculus
tctgattccacagagagcccctatc

SEQ ID NO: 787206 - DNA, 25 bp, Mus musculus
tctgattccagacggtgctgtgcgc

SEQ ID NO: 787207 - DNA, 25 bp, Mus musculus
tctgattccagagggtgctgtgcgc

SEQ ID NO: 787208 - DNA, 25 bp, Mus musculus
tctgattctcacattgcccattttt

SEQ ID NO: 787209 - DNA, 25 bp, Mus musculus
tctgattctcactttgcccattttt

SEQ ID NO: 787210 - DNA, 25 bp, Mus musculus
tctgattctcagcaggcaaacatct

SEQ ID NO: 787211 - DNA, 25 bp, Mus musculus
tctgattctcaggaggcaaacatct

SEQ ID NO: 787212 - DNA, 25 bp, Mus musculus
tctgattgccagcagccctcatgag

SEQ ID NO: 787213 - DNA, 25 bp, Mus musculus
tctgattgccaggagccctcatgag

SEQ ID NO: 787214 - DNA, 25 bp, Mus musculus
tctgattggagaatgaagacccctg

SEQ ID NO: 787215 - DNA, 25 bp, Mus musculus
tctgattggagattgaagacccctg

SEQ ID NO: 787216 - DNA, 25 bp, Mus musculus
tctgattggagcagatcctcgggag

SEQ ID NO: 787217 - DNA, 25 bp, Mus musculus
tctgattggagctgatcctcgggag

SEQ ID NO: 787218 - DNA, 25 bp, Mus musculus
tctgattggtcccagggcatctcca

SEQ ID NO: 787219 - DNA, 25 bp, Mus musculus
tctgattggtccgagggcatctcca

SEQ ID NO: 787220 - DNA, 25 bp, Mus musculus
tctgattgttatagagcgtggtgct

SEQ ID NO: 787221 - DNA, 25 bp, Mus musculus
tctgattgttattgagcgtggtgct

SEQ ID NO: 787222 - DNA, 25 bp, Mus musculus
tctgatttatctcttacgtgtggtt

SEQ ID NO: 787223 - DNA, 25 bp, Mus musculus
tctgatttatctgttacgtgtggtt

SEQ ID NO: 787224 - DNA, 25 bp, Mus musculus
tctgatttctatacagagatggctt

SEQ ID NO: 787225 - DNA, 25 bp, Mus musculus
tctgatttctattcagagatggctt

SEQ ID NO: 787226 - DNA, 25 bp, Mus musculus
tctgatttgcggacagaactgagta

SEQ ID NO: 787227 - DNA, 25 bp, Mus musculus
tctgatttgcggtcagaactgagta

SEQ ID NO: 787228 - DNA, 25 bp, Mus musculus
tctgattttgagagagcaatttcta

SEQ ID NO: 787229 - DNA, 25 bp, Mus musculus
tctgattttgagtgagcaatttcta

SEQ ID NO: 787230 - DNA, 25 bp, Mus musculus
tctgattttgccagacatgctgaaa

SEQ ID NO: 787231 - DNA, 25 bp, Mus musculus
tctgattttgcctgacatgctgaaa

SEQ ID NO: 787232 - DNA, 25 bp, Mus musculus
tctgcaaaattaccactcaggagcc

SEQ ID NO: 787233 - DNA, 25 bp, Mus musculus
tctgcaaaattagcactcaggagcc

SEQ ID NO: 787234 - DNA, 25 bp, Mus musculus
tctgcaaacacgagttttctgcttg

SEQ ID NO: 787235 - DNA, 25 bp, Mus musculus
tctgcaaacacgtgttttctgcttg

SEQ ID NO: 787236 - DNA, 25 bp, Mus musculus
tctgcaaacctaccacctgagagag

SEQ ID NO: 787237 - DNA, 25 bp, Mus musculus
tctgcaaacctagcacctgagagag

SEQ ID NO: 787238 - DNA, 25 bp, Mus musculus
tctgcaaacgtacgatcgagcacct

SEQ ID NO: 787239 - DNA, 25 bp, Mus musculus
tctgcaaacgtaggatcgagcacct

SEQ ID NO: 787240 - DNA, 25 bp, Mus musculus
tctgcaaagcttattcgggataaag

SEQ ID NO: 787241 - DNA, 25 bp, Mus musculus
tctgcaaagctttttcgggataaag

SEQ ID NO: 787242 - DNA, 25 bp, Mus musculus
tctgcaaagggaagctccacacgtg

SEQ ID NO: 787243 - DNA, 25 bp, Mus musculus
tctgcaaagggatgctccacacgtg

SEQ ID NO: 787244 - DNA, 25 bp, Mus musculus
tctgcaaagggcacatcccctgaag

SEQ ID NO: 787245 - DNA, 25 bp, Mus musculus
tctgcaaagggctcatcccctgaag

SEQ ID NO: 787246 - DNA, 25 bp, Mus musculus
tctgcaaatgatctatttggtaacc

SEQ ID NO: 787247 - DNA, 25 bp, Mus musculus
tctgcaaatgatgtatttggtaacc

SEQ ID NO: 787248 - DNA, 25 bp, Mus musculus
tctgcaacagggaggccatgaggaa

SEQ ID NO: 787249 - DNA, 25 bp, Mus musculus
tctgcaacagggtggccatgaggaa

SEQ ID NO: 787250 - DNA, 25 bp, Mus musculus
tctgcaacatgtaccagtgcgtgat

SEQ ID NO: 787251 - DNA, 25 bp, Mus musculus
tctgcaacatgttccagtgcgtgat

SEQ ID NO: 787252 - DNA, 25 bp, Mus musculus
tctgcaacgccaacaagaagtcgga

SEQ ID NO: 787253 - DNA, 25 bp, Mus musculus
tctgcaacgccatcaagaagtcgga

SEQ ID NO: 787254 - DNA, 25 bp, Mus musculus
tctgcaacgggcagggcatctactg

SEQ ID NO: 787255 - DNA, 25 bp, Mus musculus
tctgcaacgggctgggcatctactg

SEQ ID NO: 787256 - DNA, 25 bp, Mus musculus
tctgcaacgtaaacaactcctgctt

SEQ ID NO: 787257 - DNA, 25 bp, Mus musculus
tctgcaacgtaatcaactcctgctt

SEQ ID NO: 787258 - DNA, 25 bp, Mus musculus
tctgcaacgtatcccgatgtggagt

SEQ ID NO: 787259 - DNA, 25 bp, Mus musculus
tctgcaacgtatgccgatgtggagt

SEQ ID NO: 787260 - DNA, 25 bp, Mus musculus
tctgcaactgcgagcacagtggaaa

SEQ ID NO: 787261 - DNA, 25 bp, Mus musculus
tctgcaactgcgtgcacagtggaaa

SEQ ID NO: 787262 - DNA, 25 bp, Mus musculus
tctgcaagatgaagtgtgggaaaac

SEQ ID NO: 787263 - DNA, 25 bp, Mus musculus
tctgcaagatgatgtgtgggaaaac

SEQ ID NO: 787264 - DNA, 25 bp, Mus musculus
tctgcaagatgccatgtgtgagaca

SEQ ID NO: 787265 - DNA, 25 bp, Mus musculus
tctgcaagatgcgatgtgtgagaca

SEQ ID NO: 787266 - DNA, 25 bp, Mus musculus
tctgcaagatttccacctgctgggc

SEQ ID NO: 787267 - DNA, 25 bp, Mus musculus
tctgcaagatttgcacctgctgggc

SEQ ID NO: 787268 - DNA, 25 bp, Mus musculus
tctgcaagcaataaaaggagactgt

SEQ ID NO: 787269 - DNA, 25 bp, Mus musculus
tctgcaagcaattaaaggagactgt

SEQ ID NO: 787270 - DNA, 25 bp, Mus musculus
tctgcaagcagaatatgatcgcctg

SEQ ID NO: 787271 - DNA, 25 bp, Mus musculus
tctgcaagcagaccgtgtcggtgtc

SEQ ID NO: 787272 - DNA, 25 bp, Mus musculus
tctgcaagcagagcgtgtcggtgtc

SEQ ID NO: 787273 - DNA, 25 bp, Mus musculus
tctgcaagcagattatgatcgcctg

SEQ ID NO: 787274 - DNA, 25 bp, Mus musculus
tctgcaaggaaccatggcagtgcat

SEQ ID NO: 787275 - DNA, 25 bp, Mus musculus
tctgcaaggaacgatggcagtgcat

SEQ ID NO: 787276 - DNA, 25 bp, Mus musculus
tctgcaaggaccaagaccagactgg

SEQ ID NO: 787277 - DNA, 25 bp, Mus musculus
tctgcaaggacctagaccagactgg

SEQ ID NO: 787278 - DNA, 25 bp, Mus musculus
tctgcaaggagcaacacagctaaac

SEQ ID NO: 787279 - DNA, 25 bp, Mus musculus
tctgcaaggagctacacagctaaac

SEQ ID NO: 787280 - DNA, 25 bp, Mus musculus
tctgcaaggcagactcaagtgcaaa

SEQ ID NO: 787281 - DNA, 25 bp, Mus musculus
tctgcaaggcagtctcaagtgcaaa

SEQ ID NO: 787282 - DNA, 25 bp, Mus musculus
tctgcaaggcctaacccgggaaggg

SEQ ID NO: 787283 - DNA, 25 bp, Mus musculus
tctgcaaggccttacccgggaaggg

SEQ ID NO: 787284 - DNA, 25 bp, Mus musculus
tctgcaaggctgcagcagctgagaa

SEQ ID NO: 787285 - DNA, 25 bp, Mus musculus
tctgcaaggctggagcagctgagaa

SEQ ID NO: 787286 - DNA, 25 bp, Mus musculus
tctgcaaggtgcaggctgtgaacca

SEQ ID NO: 787287 - DNA, 25 bp, Mus musculus
tctgcaaggtgctggctgtgaacca

SEQ ID NO: 787288 - DNA, 25 bp, Mus musculus
tctgcaagtctgatcgaaacagtac

SEQ ID NO: 787289 - DNA, 25 bp, Mus musculus
tctgcaagtctgattacatttaaga

SEQ ID NO: 787290 - DNA, 25 bp, Mus musculus
tctgcaagtctgttcgaaacagtac

SEQ ID NO: 787291 - DNA, 25 bp, Mus musculus
tctgcaagtctgtttacatttaaga

SEQ ID NO: 787292 - DNA, 25 bp, Mus musculus
tctgcaagtggacagcttggcaatg

SEQ ID NO: 787293 - DNA, 25 bp, Mus musculus
tctgcaagtggagagcttggcaatg

SEQ ID NO: 787294 - DNA, 25 bp, Mus musculus
tctgcaatagcaacaaacgggtttg

SEQ ID NO: 787295 - DNA, 25 bp, Mus musculus
tctgcaatagcatcaaacgggtttg

SEQ ID NO: 787296 - DNA, 25 bp, Mus musculus
tctgcaatcctgcttcttgtggcca

SEQ ID NO: 787297 - DNA, 25 bp, Mus musculus
tctgcaatcctggttcttgtggcca

SEQ ID NO: 787298 - DNA, 25 bp, Mus musculus
tctgcaatctgacgaggcctccagc

SEQ ID NO: 787299 - DNA, 25 bp, Mus musculus
tctgcaatctgaggaggcctccagc

SEQ ID NO: 787300 - DNA, 25 bp, Mus musculus
tctgcaatgatgaggaccatggctg

SEQ ID NO: 787301 - DNA, 25 bp, Mus musculus
tctgcaatgatgtggaccatggctg

SEQ ID NO: 787302 - DNA, 25 bp, Mus musculus
tctgcaatggtgctcacagatacca

SEQ ID NO: 787303 - DNA, 25 bp, Mus musculus
tctgcaatggtggtcacagatacca

SEQ ID NO: 787304 - DNA, 25 bp, Mus musculus
tctgcaattcctaagcccctgcggg

SEQ ID NO: 787305 - DNA, 25 bp, Mus musculus
tctgcaattccttagcccctgcggg

SEQ ID NO: 787306 - DNA, 25 bp, Mus musculus
tctgcaattgccaaattactgaaat

SEQ ID NO: 787307 - DNA, 25 bp, Mus musculus
tctgcaattgcctaattactgaaat

SEQ ID NO: 787308 - DNA, 25 bp, Mus musculus
tctgcacaaactctactccttggtt

SEQ ID NO: 787309 - DNA, 25 bp, Mus musculus
tctgcacaaactgtactccttggtt

SEQ ID NO: 787310 - DNA, 25 bp, Mus musculus
tctgcacacctgactgggatactcc

SEQ ID NO: 787311 - DNA, 25 bp, Mus musculus
tctgcacacctgtctgggatactcc

SEQ ID NO: 787312 - DNA, 25 bp, Mus musculus
tctgcacagacaatcagagtgccta

SEQ ID NO: 787313 - DNA, 25 bp, Mus musculus
tctgcacagacacgtagacggcacc

SEQ ID NO: 787314 - DNA, 25 bp, Mus musculus
tctgcacagacaggtagacggcacc

SEQ ID NO: 787315 - DNA, 25 bp, Mus musculus
tctgcacagacattcagagtgccta

SEQ ID NO: 787316 - DNA, 25 bp, Mus musculus
tctgcacagcagagagggaaatcca

SEQ ID NO: 787317 - DNA, 25 bp, Mus musculus
tctgcacagcagtgagggaaatcca

SEQ ID NO: 787318 - DNA, 25 bp, Mus musculus
tctgcacaggaaatagacagggctt

SEQ ID NO: 787319 - DNA, 25 bp, Mus musculus
tctgcacaggaattagacagggctt

SEQ ID NO: 787320 - DNA, 25 bp, Mus musculus
tctgcacagtgaaacgtatcgtctt

SEQ ID NO: 787321 - DNA, 25 bp, Mus musculus
tctgcacagtgacttcgttgagtgc

SEQ ID NO: 787322 - DNA, 25 bp, Mus musculus
tctgcacagtgagttcgttgagtgc

SEQ ID NO: 787323 - DNA, 25 bp, Mus musculus
tctgcacagtgatacgtatcgtctt

SEQ ID NO: 787324 - DNA, 25 bp, Mus musculus
tctgcacagtgcctcagtgaaatag

SEQ ID NO: 787325 - DNA, 25 bp, Mus musculus
tctgcacagtgcgtcagtgaaatag

SEQ ID NO: 787326 - DNA, 25 bp, Mus musculus
tctgcacatgatcaaagccaagctt

SEQ ID NO: 787327 - DNA, 25 bp, Mus musculus
tctgcacatgatgaaagccaagctt

SEQ ID NO: 787328 - DNA, 25 bp, Mus musculus
tctgcacattagagacccagtaggg

SEQ ID NO: 787329 - DNA, 25 bp, Mus musculus
tctgcacattagtgacccagtaggg

SEQ ID NO: 787330 - DNA, 25 bp, Mus musculus
tctgcacattcgctctcagcactgg

SEQ ID NO: 787331 - DNA, 25 bp, Mus musculus
tctgcacattcggtctcagcactgg

SEQ ID NO: 787332 - DNA, 25 bp, Mus musculus
tctgcaccaacaaagcccagatggt

SEQ ID NO: 787333 - DNA, 25 bp, Mus musculus
tctgcaccaacatagcccagatggt

SEQ ID NO: 787334 - DNA, 25 bp, Mus musculus
tctgcaccaatactgtaggctcctt

SEQ ID NO: 787335 - DNA, 25 bp, Mus musculus
tctgcaccaatagtgtaggctcctt

SEQ ID NO: 787336 - DNA, 25 bp, Mus musculus
tctgcaccaggtatggaatgggtct

SEQ ID NO: 787337 - DNA, 25 bp, Mus musculus
tctgcaccaggtttggaatgggtct

SEQ ID NO: 787338 - DNA, 25 bp, Mus musculus
tctgcaccgaggactgagtctgccc

SEQ ID NO: 787339 - DNA, 25 bp, Mus musculus
tctgcaccgaggagtactcacgctg

SEQ ID NO: 787340 - DNA, 25 bp, Mus musculus
tctgcaccgaggtctgagtctgccc

SEQ ID NO: 787341 - DNA, 25 bp, Mus musculus
tctgcaccgaggtgtactcacgctg

SEQ ID NO: 787342 - DNA, 25 bp, Mus musculus
tctgcacctgaactgtaagcccttg

SEQ ID NO: 787343 - DNA, 25 bp, Mus musculus
tctgcacctgaagtgtaagcccttg

SEQ ID NO: 787344 - DNA, 25 bp, Mus musculus
tctgcacgagcgattccctatggca

SEQ ID NO: 787345 - DNA, 25 bp, Mus musculus
tctgcacgagcgtttccctatggca

SEQ ID NO: 787346 - DNA, 25 bp, Mus musculus
tctgcacgcgccaggccatcatggt

SEQ ID NO: 787347 - DNA, 25 bp, Mus musculus
tctgcacgcgcctggccatcatggt

SEQ ID NO: 787348 - DNA, 25 bp, Mus musculus
tctgcacgtcaccatgtaaaggcca

SEQ ID NO: 787349 - DNA, 25 bp, Mus musculus
tctgcacgtcacgatgtaaaggcca

SEQ ID NO: 787350 - DNA, 25 bp, Mus musculus
tctgcactctacatgggagatctga

SEQ ID NO: 787351 - DNA, 25 bp, Mus musculus
tctgcactctacttgggagatctga

SEQ ID NO: 787352 - DNA, 25 bp, Mus musculus
tctgcactctgcaacaggaaccagt

SEQ ID NO: 787353 - DNA, 25 bp, Mus musculus
tctgcactctgctacaggaaccagt

SEQ ID NO: 787354 - DNA, 25 bp, Mus musculus
tctgcactgaaacgactctggctct

SEQ ID NO: 787355 - DNA, 25 bp, Mus musculus
tctgcactgaaaggactctggctct

SEQ ID NO: 787356 - DNA, 25 bp, Mus musculus
tctgcactggccaaaacctgtacgt

SEQ ID NO: 787357 - DNA, 25 bp, Mus musculus
tctgcactggcctaaacctgtacgt

SEQ ID NO: 787358 - DNA, 25 bp, Mus musculus
tctgcactggctccacatgctggga

SEQ ID NO: 787359 - DNA, 25 bp, Mus musculus
tctgcactggctgcacatgctggga

SEQ ID NO: 787360 - DNA, 25 bp, Mus musculus
tctgcacttccacctcattgctgat

SEQ ID NO: 787361 - DNA, 25 bp, Mus musculus
tctgcacttccagctcattgctgat

SEQ ID NO: 787362 - DNA, 25 bp, Mus musculus
tctgcagaaatgactctttatccat

SEQ ID NO: 787363 - DNA, 25 bp, Mus musculus
tctgcagaaatgtctctttatccat

SEQ ID NO: 787364 - DNA, 25 bp, Mus musculus
tctgcagaactaccgctccggacgt

SEQ ID NO: 787365 - DNA, 25 bp, Mus musculus
tctgcagaactagcgctccggacgt

SEQ ID NO: 787366 - DNA, 25 bp, Mus musculus
tctgcagaactgctgccttggcata

SEQ ID NO: 787367 - DNA, 25 bp, Mus musculus
tctgcagaactggtgccttggcata

SEQ ID NO: 787368 - DNA, 25 bp, Mus musculus
tctgcagaagacaggcagagaagag

SEQ ID NO: 787369 - DNA, 25 bp, Mus musculus
tctgcagaagactggcagagaagag

SEQ ID NO: 787370 - DNA, 25 bp, Mus musculus
tctgcagaagagaccctcactcagt

SEQ ID NO: 787371 - DNA, 25 bp, Mus musculus
tctgcagaagagtccctcactcagt

SEQ ID NO: 787372 - DNA, 25 bp, Mus musculus
tctgcagaatatcgtggtggcgcca

SEQ ID NO: 787373 - DNA, 25 bp, Mus musculus
tctgcagaatatggtggtggcgcca

SEQ ID NO: 787374 - DNA, 25 bp, Mus musculus
tctgcagacactctggtggagtttc

SEQ ID NO: 787375 - DNA, 25 bp, Mus musculus
tctgcagacactgtggtggagtttc

SEQ ID NO: 787376 - DNA, 25 bp, Mus musculus
tctgcagagaagatagctaaccacc

SEQ ID NO: 787377 - DNA, 25 bp, Mus musculus
tctgcagagaagttagctaaccacc

SEQ ID NO: 787378 - DNA, 25 bp, Mus musculus
tctgcagagcagagctacaaggtga

SEQ ID NO: 787379 - DNA, 25 bp, Mus musculus
tctgcagagcagtgctacaaggtga

SEQ ID NO: 787380 - DNA, 25 bp, Mus musculus
tctgcagaggatcttcaggctctcc

SEQ ID NO: 787381 - DNA, 25 bp, Mus musculus
tctgcagaggatgttcaggctctcc

SEQ ID NO: 787382 - DNA, 25 bp, Mus musculus
tctgcagaggtaagagtgtttacag

SEQ ID NO: 787383 - DNA, 25 bp, Mus musculus
tctgcagaggtatgagtgtttacag

SEQ ID NO: 787384 - DNA, 25 bp, Mus musculus
tctgcagagtgtcgagagagttcct

SEQ ID NO: 787385 - DNA, 25 bp, Mus musculus
tctgcagagtgtggagagagttcct

SEQ ID NO: 787386 - DNA, 25 bp, Mus musculus
tctgcagatccaacatgtgggtcag

SEQ ID NO: 787387 - DNA, 25 bp, Mus musculus
tctgcagatccatcatgtgggtcag

SEQ ID NO: 787388 - DNA, 25 bp, Mus musculus
tctgcagatcccaggcaaacaggcc

SEQ ID NO: 787389 - DNA, 25 bp, Mus musculus
tctgcagatccctggcaaacaggcc

SEQ ID NO: 787390 - DNA, 25 bp, Mus musculus
tctgcagatgaactcctcatcaccg

SEQ ID NO: 787391 - DNA, 25 bp, Mus musculus
tctgcagatgaagtcctcatcaccg

SEQ ID NO: 787392 - DNA, 25 bp, Mus musculus
tctgcagcaatcctgggagatgctg

SEQ ID NO: 787393 - DNA, 25 bp, Mus musculus
tctgcagcaatcgtgggagatgctg

SEQ ID NO: 787394 - DNA, 25 bp, Mus musculus
tctgcagcaccaatgttatgaataa

SEQ ID NO: 787395 - DNA, 25 bp, Mus musculus
tctgcagcaccattgttatgaataa

SEQ ID NO: 787396 - DNA, 25 bp, Mus musculus
tctgcagcacgtcccagtgctggtg

SEQ ID NO: 787397 - DNA, 25 bp, Mus musculus
tctgcagcacgtgccagtgctggtg

SEQ ID NO: 787398 - DNA, 25 bp, Mus musculus
tctgcagcagaaatgacaccgcctg

SEQ ID NO: 787399 - DNA, 25 bp, Mus musculus
tctgcagcagaattgacaccgcctg

SEQ ID NO: 787400 - DNA, 25 bp, Mus musculus
tctgcagcaggtcttgaagacctta

SEQ ID NO: 787401 - DNA, 25 bp, Mus musculus
tctgcagcaggtgttgaagacctta

SEQ ID NO: 787402 - DNA, 25 bp, Mus musculus
tctgcagcatcacgccaaggtgctg

SEQ ID NO: 787403 - DNA, 25 bp, Mus musculus
tctgcagcatcaggccaaggtgctg

SEQ ID NO: 787404 - DNA, 25 bp, Mus musculus
tctgcagccgagactgcggctgcga

SEQ ID NO: 787405 - DNA, 25 bp, Mus musculus
tctgcagccgagtctgcggctgcga

SEQ ID NO: 787406 - DNA, 25 bp, Mus musculus
tctgcagcctgacaactggaggtcc

SEQ ID NO: 787407 - DNA, 25 bp, Mus musculus
tctgcagcctgagaactggaggtcc

SEQ ID NO: 787408 - DNA, 25 bp, Mus musculus
tctgcagcctgcatgataacatggg

SEQ ID NO: 787409 - DNA, 25 bp, Mus musculus
tctgcagcctgcttgataacatggg

SEQ ID NO: 787410 - DNA, 25 bp, Mus musculus
tctgcagcgagaccgcagagaagca

SEQ ID NO: 787411 - DNA, 25 bp, Mus musculus
tctgcagcgagagcgcagagaagca

SEQ ID NO: 787412 - DNA, 25 bp, Mus musculus
tctgcagcgattcctgtgggtccgt

SEQ ID NO: 787413 - DNA, 25 bp, Mus musculus
tctgcagcgattgctgtgggtccgt

SEQ ID NO: 787414 - DNA, 25 bp, Mus musculus
tctgcagcgcccagcgggcatagat

SEQ ID NO: 787415 - DNA, 25 bp, Mus musculus
tctgcagcgccctgcgggcatagat

SEQ ID NO: 787416 - DNA, 25 bp, Mus musculus
tctgcagctccgagcgcgcgactag

SEQ ID NO: 787417 - DNA, 25 bp, Mus musculus
tctgcagctccgcactgagcctgtg

SEQ ID NO: 787418 - DNA, 25 bp, Mus musculus
tctgcagctccggactgagcctgtg

SEQ ID NO: 787419 - DNA, 25 bp, Mus musculus
tctgcagctccgtgcgcgcgactag

SEQ ID NO: 787420 - DNA, 25 bp, Mus musculus
tctgcagctctccttgcttatggga

SEQ ID NO: 787421 - DNA, 25 bp, Mus musculus
tctgcagctctcgttgcttatggga

SEQ ID NO: 787422 - DNA, 25 bp, Mus musculus
tctgcagctgaaagacatcctcaga

SEQ ID NO: 787423 - DNA, 25 bp, Mus musculus
tctgcagctgaatgacatcctcaga

SEQ ID NO: 787424 - DNA, 25 bp, Mus musculus
tctgcagctggacctctttccggca

SEQ ID NO: 787425 - DNA, 25 bp, Mus musculus
tctgcagctggagctctttccggca

SEQ ID NO: 787426 - DNA, 25 bp, Mus musculus
tctgcagctgttatttgacctgtat

SEQ ID NO: 787427 - DNA, 25 bp, Mus musculus
tctgcagctgttttttgacctgtat

SEQ ID NO: 787428 - DNA, 25 bp, Mus musculus
tctgcagctttgaagtctaatagca

SEQ ID NO: 787429 - DNA, 25 bp, Mus musculus
tctgcagctttgtagtctaatagca

SEQ ID NO: 787430 - DNA, 25 bp, Mus musculus
tctgcaggaaaactgaatcttggcg

SEQ ID NO: 787431 - DNA, 25 bp, Mus musculus
tctgcaggaaaagtgaatcttggcg

SEQ ID NO: 787432 - DNA, 25 bp, Mus musculus
tctgcaggaaccacattatggatct

SEQ ID NO: 787433 - DNA, 25 bp, Mus musculus
tctgcaggaaccagaacgacagggc

SEQ ID NO: 787434 - DNA, 25 bp, Mus musculus
tctgcaggaacctcattatggatct

SEQ ID NO: 787435 - DNA, 25 bp, Mus musculus
tctgcaggaacctgaacgacagggc

SEQ ID NO: 787436 - DNA, 25 bp, Mus musculus
tctgcaggaagacgaagagatgaat

SEQ ID NO: 787437 - DNA, 25 bp, Mus musculus
tctgcaggaagaggaagagatgaat

SEQ ID NO: 787438 - DNA, 25 bp, Mus musculus
tctgcaggaagtcgacaccacctac

SEQ ID NO: 787439 - DNA, 25 bp, Mus musculus
tctgcaggaagtggacaccacctac

SEQ ID NO: 787440 - DNA, 25 bp, Mus musculus
tctgcaggacagcatccgaaaagtg

SEQ ID NO: 787441 - DNA, 25 bp, Mus musculus
tctgcaggacaggatccgaaaagtg

SEQ ID NO: 787442 - DNA, 25 bp, Mus musculus
tctgcaggagccagacagcttggat

SEQ ID NO: 787443 - DNA, 25 bp, Mus musculus
tctgcaggagcctgacagcttggat

SEQ ID NO: 787444 - DNA, 25 bp, Mus musculus
tctgcaggagtcaccttacctctgg

SEQ ID NO: 787445 - DNA, 25 bp, Mus musculus
tctgcaggagtctccttacctctgg

SEQ ID NO: 787446 - DNA, 25 bp, Mus musculus
tctgcaggcagacgtgctgtgactt

SEQ ID NO: 787447 - DNA, 25 bp, Mus musculus
tctgcaggcagaggtgctgtgactt

SEQ ID NO: 787448 - DNA, 25 bp, Mus musculus
tctgcaggcatccacaaaggtagct

SEQ ID NO: 787449 - DNA, 25 bp, Mus musculus
tctgcaggcatcgacaaaggtagct

SEQ ID NO: 787450 - DNA, 25 bp, Mus musculus
tctgcagggaagcagctaaagtatt

SEQ ID NO: 787451 - DNA, 25 bp, Mus musculus
tctgcagggaaggagctaaagtatt

SEQ ID NO: 787452 - DNA, 25 bp, Mus musculus
tctgcagggacaagatcacccgccg

SEQ ID NO: 787453 - DNA, 25 bp, Mus musculus
tctgcagggacatgatcacccgccg

SEQ ID NO: 787454 - DNA, 25 bp, Mus musculus
tctgcagggagaaaaaccatattca

SEQ ID NO: 787455 - DNA, 25 bp, Mus musculus
tctgcagggagataaaccatattca

SEQ ID NO: 787456 - DNA, 25 bp, Mus musculus
tctgcagggagccatgatgtgtata

SEQ ID NO: 787457 - DNA, 25 bp, Mus musculus
tctgcagggagcgatgatgtgtata

SEQ ID NO: 787458 - DNA, 25 bp, Mus musculus
tctgcagggcaactagaaccttctc

SEQ ID NO: 787459 - DNA, 25 bp, Mus musculus
tctgcagggcaagtagaaccttctc

SEQ ID NO: 787460 - DNA, 25 bp, Mus musculus
tctgcaggtgtgactgaactctgaa

SEQ ID NO: 787461 - DNA, 25 bp, Mus musculus
tctgcaggtgtgtctgaactctgaa

SEQ ID NO: 787462 - DNA, 25 bp, Mus musculus
tctgcagtaaagaccaaatttgagc

SEQ ID NO: 787463 - DNA, 25 bp, Mus musculus
tctgcagtaaagtccaaatttgagc

SEQ ID NO: 787464 - DNA, 25 bp, Mus musculus
tctgcagtaccaagggacccagcag

SEQ ID NO: 787465 - DNA, 25 bp, Mus musculus
tctgcagtaccatgggacccagcag

SEQ ID NO: 787466 - DNA, 25 bp, Mus musculus
tctgcagtacgaagagagggtgatc

SEQ ID NO: 787467 - DNA, 25 bp, Mus musculus
tctgcagtacgatgagagggtgatc

SEQ ID NO: 787468 - DNA, 25 bp, Mus musculus
tctgcagtccaaccctgtcctggaa

SEQ ID NO: 787469 - DNA, 25 bp, Mus musculus
tctgcagtccaagcctgtcctggaa

SEQ ID NO: 787470 - DNA, 25 bp, Mus musculus
tctgcagtccctctgatgcaccagg

SEQ ID NO: 787471 - DNA, 25 bp, Mus musculus
tctgcagtccctgtgatgcaccagg

SEQ ID NO: 787472 - DNA, 25 bp, Mus musculus
tctgcagtcttcacaccttattagg

SEQ ID NO: 787473 - DNA, 25 bp, Mus musculus
tctgcagtcttctcaccttattagg

SEQ ID NO: 787474 - DNA, 25 bp, Mus musculus
tctgcagtgaacatgatggagctgt

SEQ ID NO: 787475 - DNA, 25 bp, Mus musculus
tctgcagtgaacttgatggagctgt

SEQ ID NO: 787476 - DNA, 25 bp, Mus musculus
tctgcagtgacacgaatcgttgtgg

SEQ ID NO: 787477 - DNA, 25 bp, Mus musculus
tctgcagtgacaggaatcgttgtgg

SEQ ID NO: 787478 - DNA, 25 bp, Mus musculus
tctgcagtgatgagctaacgcacaa

SEQ ID NO: 787479 - DNA, 25 bp, Mus musculus
tctgcagtgatgtgctaacgcacaa

SEQ ID NO: 787480 - DNA, 25 bp, Mus musculus
tctgcagtgcacactcagtgaaaga

SEQ ID NO: 787481 - DNA, 25 bp, Mus musculus
tctgcagtgcactctcagtgaaaga

SEQ ID NO: 787482 - DNA, 25 bp, Mus musculus
tctgcagtgcagatcagccatattg

SEQ ID NO: 787483 - DNA, 25 bp, Mus musculus
tctgcagtgcagttcagccatattg

SEQ ID NO: 787484 - DNA, 25 bp, Mus musculus
tctgcagtggaaacttgtaagccag

SEQ ID NO: 787485 - DNA, 25 bp, Mus musculus
tctgcagtggaatcttgtaagccag

SEQ ID NO: 787486 - DNA, 25 bp, Mus musculus
tctgcagtggcacccagacaagaac

SEQ ID NO: 787487 - DNA, 25 bp, Mus musculus
tctgcagtggcagccagacaagaac

SEQ ID NO: 787488 - DNA, 25 bp, Mus musculus
tctgcagtgggtatactgctgctcc

SEQ ID NO: 787489 - DNA, 25 bp, Mus musculus
tctgcagtgggtttactgctgctcc

SEQ ID NO: 787490 - DNA, 25 bp, Mus musculus
tctgcagtggtcaaaccctgctcag

SEQ ID NO: 787491 - DNA, 25 bp, Mus musculus
tctgcagtggtctaaccctgctcag

SEQ ID NO: 787492 - DNA, 25 bp, Mus musculus
tctgcagtgtctaggagaaaacgca

SEQ ID NO: 787493 - DNA, 25 bp, Mus musculus
tctgcagtgtcttggagaaaacgca

SEQ ID NO: 787494 - DNA, 25 bp, Mus musculus
tctgcagtgtgtctctactccatgg

SEQ ID NO: 787495 - DNA, 25 bp, Mus musculus
tctgcagtgtgtgtctactccatgg

SEQ ID NO: 787496 - DNA, 25 bp, Mus musculus
tctgcataaaaccacagagcccagg

SEQ ID NO: 787497 - DNA, 25 bp, Mus musculus
tctgcataaaacgacagagcccagg

SEQ ID NO: 787498 - DNA, 25 bp, Mus musculus
tctgcataacagacatgaggtacca

SEQ ID NO: 787499 - DNA, 25 bp, Mus musculus
tctgcataacagtcatgaggtacca

SEQ ID NO: 787500 - DNA, 25 bp, Mus musculus
tctgcatacaggctgcttgaggtcc

SEQ ID NO: 787501 - DNA, 25 bp, Mus musculus
tctgcatacagggtgcttgaggtcc

SEQ ID NO: 787502 - DNA, 25 bp, Mus musculus
tctgcatcagaaccaaacgtaagca

SEQ ID NO: 787503 - DNA, 25 bp, Mus musculus
tctgcatcagaagcaaacgtaagca

SEQ ID NO: 787504 - DNA, 25 bp, Mus musculus
tctgcatcaggtatggttggagcct

SEQ ID NO: 787505 - DNA, 25 bp, Mus musculus
tctgcatcaggtttggttggagcct

SEQ ID NO: 787506 - DNA, 25 bp, Mus musculus
tctgcatcccaaactatgccaagtg

SEQ ID NO: 787507 - DNA, 25 bp, Mus musculus
tctgcatcccaatctatgccaagtg

SEQ ID NO: 787508 - DNA, 25 bp, Mus musculus
tctgcatccctcagaaaaagcctgg

SEQ ID NO: 787509 - DNA, 25 bp, Mus musculus
tctgcatccctctgaaaaagcctgg

SEQ ID NO: 787510 - DNA, 25 bp, Mus musculus
tctgcatcctagacaggcgtcttcc

SEQ ID NO: 787511 - DNA, 25 bp, Mus musculus
tctgcatcctagtcaggcgtcttcc

SEQ ID NO: 787512 - DNA, 25 bp, Mus musculus
tctgcatcgagcaccacacgttctt

SEQ ID NO: 787513 - DNA, 25 bp, Mus musculus
tctgcatcgagctccacacgttctt

SEQ ID NO: 787514 - DNA, 25 bp, Mus musculus
tctgcatcgcggacaatagtaggag

SEQ ID NO: 787515 - DNA, 25 bp, Mus musculus
tctgcatcgcggtcaatagtaggag

SEQ ID NO: 787516 - DNA, 25 bp, Mus musculus
tctgcatcgctgaggtagctgtgac

SEQ ID NO: 787517 - DNA, 25 bp, Mus musculus
tctgcatcgctgtggtagctgtgac

SEQ ID NO: 787518 - DNA, 25 bp, Mus musculus
tctgcatctacacggaacgttcctc

SEQ ID NO: 787519 - DNA, 25 bp, Mus musculus
tctgcatctacagggaacgttcctc

SEQ ID NO: 787520 - DNA, 25 bp, Mus musculus
tctgcatctgctccgaagtcttcgt

SEQ ID NO: 787521 - DNA, 25 bp, Mus musculus
tctgcatctgctgcgaagtcttcgt

SEQ ID NO: 787522 - DNA, 25 bp, Mus musculus
tctgcatctggcataccactggcta

SEQ ID NO: 787523 - DNA, 25 bp, Mus musculus
tctgcatctggcttaccactggcta

SEQ ID NO: 787524 - DNA, 25 bp, Mus musculus
tctgcatcttcaaccggaaccgcat

SEQ ID NO: 787525 - DNA, 25 bp, Mus musculus
tctgcatcttcatccggaaccgcat

SEQ ID NO: 787526 - DNA, 25 bp, Mus musculus
tctgcatgactaagagaagaaacca

SEQ ID NO: 787527 - DNA, 25 bp, Mus musculus
tctgcatgactatgagaagaaacca

SEQ ID NO: 787528 - DNA, 25 bp, Mus musculus
tctgcatgaggccttggctgctgca

SEQ ID NO: 787529 - DNA, 25 bp, Mus musculus
tctgcatgaggcgttggctgctgca

SEQ ID NO: 787530 - DNA, 25 bp, Mus musculus
tctgcatgaggtccttcatgaccag

SEQ ID NO: 787531 - DNA, 25 bp, Mus musculus
tctgcatgaggtgcttcatgaccag

SEQ ID NO: 787532 - DNA, 25 bp, Mus musculus
tctgcatgatccagcccactgcaag

SEQ ID NO: 787533 - DNA, 25 bp, Mus musculus
tctgcatgatcctgcccactgcaag

SEQ ID NO: 787534 - DNA, 25 bp, Mus musculus
tctgcatggaaaacattccaaccag

SEQ ID NO: 787535 - DNA, 25 bp, Mus musculus
tctgcatggaaatcattccaaccag

SEQ ID NO: 787536 - DNA, 25 bp, Mus musculus
tctgcatggttgaccgttctggaag

SEQ ID NO: 787537 - DNA, 25 bp, Mus musculus
tctgcatggttgtccgttctggaag

SEQ ID NO: 787538 - DNA, 25 bp, Mus musculus
tctgcatggtttactactctcggga

SEQ ID NO: 787539 - DNA, 25 bp, Mus musculus
tctgcatggttttctactctcggga

SEQ ID NO: 787540 - DNA, 25 bp, Mus musculus
tctgcatgtgagagcactgacacag

SEQ ID NO: 787541 - DNA, 25 bp, Mus musculus
tctgcatgtgagtgcactgacacag

SEQ ID NO: 787542 - DNA, 25 bp, Mus musculus
tctgcatgtgctccacttcttactg

SEQ ID NO: 787543 - DNA, 25 bp, Mus musculus
tctgcatgtgctgcacttcttactg

SEQ ID NO: 787544 - DNA, 25 bp, Mus musculus
tctgcatgtgtgactctcgtactgc

SEQ ID NO: 787545 - DNA, 25 bp, Mus musculus
tctgcatgtgtgtctctcgtactgc

SEQ ID NO: 787546 - DNA, 25 bp, Mus musculus
tctgcatgtgttagcgccccgtgcc

SEQ ID NO: 787547 - DNA, 25 bp, Mus musculus
tctgcatgtgtttgcgccccgtgcc

SEQ ID NO: 787548 - DNA, 25 bp, Mus musculus
tctgcattacatatactgaatttgg

SEQ ID NO: 787549 - DNA, 25 bp, Mus musculus
tctgcattacatttactgaatttgg

SEQ ID NO: 787550 - DNA, 25 bp, Mus musculus
tctgcattagtgatgttggagatta

SEQ ID NO: 787551 - DNA, 25 bp, Mus musculus
tctgcattagtgttgttggagatta

SEQ ID NO: 787552 - DNA, 25 bp, Mus musculus
tctgcattcctcaaggtgaagctac

SEQ ID NO: 787553 - DNA, 25 bp, Mus musculus
tctgcattcctctaggtgaagctac

SEQ ID NO: 787554 - DNA, 25 bp, Mus musculus
tctgcattgccgagtccagaagccc

SEQ ID NO: 787555 - DNA, 25 bp, Mus musculus
tctgcattgccgtgtccagaagccc

SEQ ID NO: 787556 - DNA, 25 bp, Mus musculus
tctgcattggatctgaactgaacgc

SEQ ID NO: 787557 - DNA, 25 bp, Mus musculus
tctgcattggatgtgaactgaacgc

SEQ ID NO: 787558 - DNA, 25 bp, Mus musculus
tctgcattgtctagggagtcttctg

SEQ ID NO: 787559 - DNA, 25 bp, Mus musculus
tctgcattgtcttgggagtcttctg

SEQ ID NO: 787560 - DNA, 25 bp, Mus musculus
tctgcattgttgaagggacccaaag

SEQ ID NO: 787561 - DNA, 25 bp, Mus musculus
tctgcattgttgtagggacccaaag

SEQ ID NO: 787562 - DNA, 25 bp, Mus musculus
tctgcatttaaaccgattccagcag

SEQ ID NO: 787563 - DNA, 25 bp, Mus musculus
tctgcatttaaagcgattccagcag

SEQ ID NO: 787564 - DNA, 25 bp, Mus musculus
tctgcatttggacagattcttcgaa

SEQ ID NO: 787565 - DNA, 25 bp, Mus musculus
tctgcatttggagagattcttcgaa

SEQ ID NO: 787566 - DNA, 25 bp, Mus musculus
tctgcattttccagggtattaaaga

SEQ ID NO: 787567 - DNA, 25 bp, Mus musculus
tctgcattttcctgggtattaaaga

SEQ ID NO: 787568 - DNA, 25 bp, Mus musculus
tctgcattttgaagaaggctggcac

SEQ ID NO: 787569 - DNA, 25 bp, Mus musculus
tctgcattttgatgaaggctggcac

SEQ ID NO: 787570 - DNA, 25 bp, Mus musculus
tctgcattttggaccagtggtgccc

SEQ ID NO: 787571 - DNA, 25 bp, Mus musculus
tctgcattttggtccagtggtgccc

SEQ ID NO: 787572 - DNA, 25 bp, Mus musculus
tctgccaaattcaatgcctgccctg

SEQ ID NO: 787573 - DNA, 25 bp, Mus musculus
tctgccaaattctatgcctgccctg

SEQ ID NO: 787574 - DNA, 25 bp, Mus musculus
tctgccaacctgagcgcctgggtac

SEQ ID NO: 787575 - DNA, 25 bp, Mus musculus
tctgccaacctgtgcgcctgggtac

SEQ ID NO: 787576 - DNA, 25 bp, Mus musculus
tctgccaactccatcatcgtgaaca

SEQ ID NO: 787577 - DNA, 25 bp, Mus musculus
tctgccaactccttcatcgtgaaca

SEQ ID NO: 787578 - DNA, 25 bp, Mus musculus
tctgccaagagtagattagacaatc

SEQ ID NO: 787579 - DNA, 25 bp, Mus musculus
tctgccaagagttgattagacaatc

SEQ ID NO: 787580 - DNA, 25 bp, Mus musculus
tctgccaagatcagtgtgggtaagg

SEQ ID NO: 787581 - DNA, 25 bp, Mus musculus
tctgccaagatctgtgtgggtaagg

SEQ ID NO: 787582 - DNA, 25 bp, Mus musculus
tctgccaaggcaaattcagctccac

SEQ ID NO: 787583 - DNA, 25 bp, Mus musculus
tctgccaaggcatattcagctccac

SEQ ID NO: 787584 - DNA, 25 bp, Mus musculus
tctgccaagtctctgaagccgtcct

SEQ ID NO: 787585 - DNA, 25 bp, Mus musculus
tctgccaagtctgtgaagccgtcct

SEQ ID NO: 787586 - DNA, 25 bp, Mus musculus
tctgccaagtgtaagggactcccaa

SEQ ID NO: 787587 - DNA, 25 bp, Mus musculus
tctgccaagtgttagggactcccaa

SEQ ID NO: 787588 - DNA, 25 bp, Mus musculus
tctgccacaactactgaggctccaa

SEQ ID NO: 787589 - DNA, 25 bp, Mus musculus
tctgccacaacttctgaggctccaa

SEQ ID NO: 787590 - DNA, 25 bp, Mus musculus
tctgccacacctcccaaattgagtt

SEQ ID NO: 787591 - DNA, 25 bp, Mus musculus
tctgccacacctgccaaattgagtt

SEQ ID NO: 787592 - DNA, 25 bp, Mus musculus
tctgccacaggtaccgagtccgagg

SEQ ID NO: 787593 - DNA, 25 bp, Mus musculus
tctgccacaggttccgagtccgagg

SEQ ID NO: 787594 - DNA, 25 bp, Mus musculus
tctgccacccagctgccgatggaag

SEQ ID NO: 787595 - DNA, 25 bp, Mus musculus
tctgccacccaggtgccgatggaag

SEQ ID NO: 787596 - DNA, 25 bp, Mus musculus
tctgccaccggtaaagggaacttga

SEQ ID NO: 787597 - DNA, 25 bp, Mus musculus
tctgccaccggttaagggaacttga

SEQ ID NO: 787598 - DNA, 25 bp, Mus musculus
tctgccacgcaactgctgggttatt

SEQ ID NO: 787599 - DNA, 25 bp, Mus musculus
tctgccacgcaagtgctgggttatt

SEQ ID NO: 787600 - DNA, 25 bp, Mus musculus
tctgccacgtctcttgccacaaaga

SEQ ID NO: 787601 - DNA, 25 bp, Mus musculus
tctgccacgtctgttgccacaaaga

SEQ ID NO: 787602 - DNA, 25 bp, Mus musculus
tctgccactcaaagagacctgatgc

SEQ ID NO: 787603 - DNA, 25 bp, Mus musculus
tctgccactcaatgagacctgatgc

SEQ ID NO: 787604 - DNA, 25 bp, Mus musculus
tctgccacttctccattgacatgct

SEQ ID NO: 787605 - DNA, 25 bp, Mus musculus
tctgccacttctgcattgacatgct

SEQ ID NO: 787606 - DNA, 25 bp, Mus musculus
tctgccagaacacacccaagtctta

SEQ ID NO: 787607 - DNA, 25 bp, Mus musculus
tctgccagaacagacccaagtctta

SEQ ID NO: 787608 - DNA, 25 bp, Mus musculus
tctgccagcaggaggtccgtaaagt

SEQ ID NO: 787609 - DNA, 25 bp, Mus musculus
tctgccagcaggcaaacattcaggg

SEQ ID NO: 787610 - DNA, 25 bp, Mus musculus
tctgccagcagggaaacattcaggg

SEQ ID NO: 787611 - DNA, 25 bp, Mus musculus
tctgccagcaggtggtccgtaaagt

SEQ ID NO: 787612 - DNA, 25 bp, Mus musculus
tctgccagcatgagccacaggtcct

SEQ ID NO: 787613 - DNA, 25 bp, Mus musculus
tctgccagcatgtgccacaggtcct

SEQ ID NO: 787614 - DNA, 25 bp, Mus musculus
tctgccagccaaccccggctcagag

SEQ ID NO: 787615 - DNA, 25 bp, Mus musculus
tctgccagccaagcccggctcagag

SEQ ID NO: 787616 - DNA, 25 bp, Mus musculus
tctgccagctacaagccggtgtttg

SEQ ID NO: 787617 - DNA, 25 bp, Mus musculus
tctgccagctactagccggtgtttg

SEQ ID NO: 787618 - DNA, 25 bp, Mus musculus
tctgccagctgtcaggcatgcatct

SEQ ID NO: 787619 - DNA, 25 bp, Mus musculus
tctgccagctgtgaggcatgcatct

SEQ ID NO: 787620 - DNA, 25 bp, Mus musculus
tctgccaggagaaccaggcagcatc

SEQ ID NO: 787621 - DNA, 25 bp, Mus musculus
tctgccaggagatccaggcagcatc

SEQ ID NO: 787622 - DNA, 25 bp, Mus musculus
tctgccaggcttacaacagtacctt

SEQ ID NO: 787623 - DNA, 25 bp, Mus musculus
tctgccaggctttcaacagtacctt

SEQ ID NO: 787624 - DNA, 25 bp, Mus musculus
tctgccagtgagcaccagggactgc

SEQ ID NO: 787625 - DNA, 25 bp, Mus musculus
tctgccagtgaggaccagggactgc

SEQ ID NO: 787626 - DNA, 25 bp, Mus musculus
tctgccagttcaaggaggaccgcag

SEQ ID NO: 787627 - DNA, 25 bp, Mus musculus
tctgccagttcatggaggaccgcag

SEQ ID NO: 787628 - DNA, 25 bp, Mus musculus
tctgccatcgttcgattaattaaag

SEQ ID NO: 787629 - DNA, 25 bp, Mus musculus
tctgccatcgttggattaattaaag

SEQ ID NO: 787630 - DNA, 25 bp, Mus musculus
tctgccatctgcacgtctggctgct

SEQ ID NO: 787631 - DNA, 25 bp, Mus musculus
tctgccatctgctcgtctggctgct

SEQ ID NO: 787632 - DNA, 25 bp, Mus musculus
tctgccatgattccgcccgctgtgt

SEQ ID NO: 787633 - DNA, 25 bp, Mus musculus
tctgccatgattgcgcccgctgtgt

SEQ ID NO: 787634 - DNA, 25 bp, Mus musculus
tctgccatgcaaaacgagggagcgt

SEQ ID NO: 787635 - DNA, 25 bp, Mus musculus
tctgccatgcaatacgagggagcgt

SEQ ID NO: 787636 - DNA, 25 bp, Mus musculus
tctgccatgcggctccctgtgtgtc

SEQ ID NO: 787637 - DNA, 25 bp, Mus musculus
tctgccatgcgggtccctgtgtgtc

SEQ ID NO: 787638 - DNA, 25 bp, Mus musculus
tctgccatggttctcactaaaatga

SEQ ID NO: 787639 - DNA, 25 bp, Mus musculus
tctgccatggttgtcactaaaatga

SEQ ID NO: 787640 - DNA, 25 bp, Mus musculus
tctgccattgggagccacgtggtta

SEQ ID NO: 787641 - DNA, 25 bp, Mus musculus
tctgccattgggtgccacgtggtta

SEQ ID NO: 787642 - DNA, 25 bp, Mus musculus
tctgccatttaaagttgtgatcttg

SEQ ID NO: 787643 - DNA, 25 bp, Mus musculus
tctgccatttaatgttgtgatcttg

SEQ ID NO: 787644 - DNA, 25 bp, Mus musculus
tctgcccaaaaaagaagacgcctta

SEQ ID NO: 787645 - DNA, 25 bp, Mus musculus
tctgcccaaaaatgaagacgcctta

SEQ ID NO: 787646 - DNA, 25 bp, Mus musculus
tctgcccaatgacgacgataaattc

SEQ ID NO: 787647 - DNA, 25 bp, Mus musculus
tctgcccaatgaggacgataaattc

SEQ ID NO: 787648 - DNA, 25 bp, Mus musculus
tctgcccacagcaatgatggaccac

SEQ ID NO: 787649 - DNA, 25 bp, Mus musculus
tctgcccacagctatgatggaccac

SEQ ID NO: 787650 - DNA, 25 bp, Mus musculus
tctgcccactgaatagtaatcacac

SEQ ID NO: 787651 - DNA, 25 bp, Mus musculus
tctgcccactgattagtaatcacac

SEQ ID NO: 787652 - DNA, 25 bp, Mus musculus
tctgcccagaacattttcaccccag

SEQ ID NO: 787653 - DNA, 25 bp, Mus musculus
tctgcccagaactttttcaccccag

SEQ ID NO: 787654 - DNA, 25 bp, Mus musculus
tctgcccagagcaggataagatcct

SEQ ID NO: 787655 - DNA, 25 bp, Mus musculus
tctgcccagagctggataagatcct

SEQ ID NO: 787656 - DNA, 25 bp, Mus musculus
tctgcccaggaaattgaaaagtcct

SEQ ID NO: 787657 - DNA, 25 bp, Mus musculus
tctgcccaggaatttgaaaagtcct

SEQ ID NO: 787658 - DNA, 25 bp, Mus musculus
tctgcccaggacagcatgagtttcc

SEQ ID NO: 787659 - DNA, 25 bp, Mus musculus
tctgcccaggactgcatgagtttcc

SEQ ID NO: 787660 - DNA, 25 bp, Mus musculus
tctgcccatgagaacgtggtggtag

SEQ ID NO: 787661 - DNA, 25 bp, Mus musculus
tctgcccatgagtacgtggtggtag

SEQ ID NO: 787662 - DNA, 25 bp, Mus musculus
tctgccccacggagcttgtgaaatg

SEQ ID NO: 787663 - DNA, 25 bp, Mus musculus
tctgccccacggtgcttgtgaaatg

SEQ ID NO: 787664 - DNA, 25 bp, Mus musculus
tctgccccgcttctgacctgaatgg

SEQ ID NO: 787665 - DNA, 25 bp, Mus musculus
tctgccccgcttgtgacctgaatgg

SEQ ID NO: 787666 - DNA, 25 bp, Mus musculus
tctgccccgggtacaaggaggctct

SEQ ID NO: 787667 - DNA, 25 bp, Mus musculus
tctgccccgggttcaaggaggctct

SEQ ID NO: 787668 - DNA, 25 bp, Mus musculus
tctgcccgagctctgcttggctgtg

SEQ ID NO: 787669 - DNA, 25 bp, Mus musculus
tctgcccgagctgtgcttggctgtg

SEQ ID NO: 787670 - DNA, 25 bp, Mus musculus
tctgcccgcaagatgatggctgacg

SEQ ID NO: 787671 - DNA, 25 bp, Mus musculus
tctgcccgcaagttgatggctgacg

SEQ ID NO: 787672 - DNA, 25 bp, Mus musculus
tctgcccgcagtacaatgtgctgtt

SEQ ID NO: 787673 - DNA, 25 bp, Mus musculus
tctgcccgcagttcaatgtgctgtt

SEQ ID NO: 787674 - DNA, 25 bp, Mus musculus
tctgcccggacaaaatagaacagct

SEQ ID NO: 787675 - DNA, 25 bp, Mus musculus
tctgcccggacataatagaacagct

SEQ ID NO: 787676 - DNA, 25 bp, Mus musculus
tctgcccggcccagttggacctaaa

SEQ ID NO: 787677 - DNA, 25 bp, Mus musculus
tctgcccggccctgttggacctaaa

SEQ ID NO: 787678 - DNA, 25 bp, Mus musculus
tctgcccgtaccctggaatgacaaa

SEQ ID NO: 787679 - DNA, 25 bp, Mus musculus
tctgcccgtaccgtggaatgacaaa

SEQ ID NO: 787680 - DNA, 25 bp, Mus musculus
tctgccctcacactgagttgctggc

SEQ ID NO: 787681 - DNA, 25 bp, Mus musculus
tctgccctcacagtgagttgctggc

SEQ ID NO: 787682 - DNA, 25 bp, Mus musculus
tctgccctgctcattgggaaatctt

SEQ ID NO: 787683 - DNA, 25 bp, Mus musculus
tctgccctgctctttgggaaatctt

SEQ ID NO: 787684 - DNA, 25 bp, Mus musculus
tctgccctggatactaagctgaagg

SEQ ID NO: 787685 - DNA, 25 bp, Mus musculus
tctgccctggattctaagctgaagg

SEQ ID NO: 787686 - DNA, 25 bp, Mus musculus
tctgccctggctcgatggcggcaaa

SEQ ID NO: 787687 - DNA, 25 bp, Mus musculus
tctgccctggctggatggcggcaaa

SEQ ID NO: 787688 - DNA, 25 bp, Mus musculus
tctgccctgtaactgcgcagatcag

SEQ ID NO: 787689 - DNA, 25 bp, Mus musculus
tctgccctgtaagtgcgcagatcag

SEQ ID NO: 787690 - DNA, 25 bp, Mus musculus
tctgcccttcatacactctagaaat

SEQ ID NO: 787691 - DNA, 25 bp, Mus musculus
tctgcccttcattcactctagaaat

SEQ ID NO: 787692 - DNA, 25 bp, Mus musculus
tctgcccttcggatgtctgtccatc

SEQ ID NO: 787693 - DNA, 25 bp, Mus musculus
tctgcccttcggttgtctgtccatc

SEQ ID NO: 787694 - DNA, 25 bp, Mus musculus
tctgcccttgggagactgtagtagc

SEQ ID NO: 787695 - DNA, 25 bp, Mus musculus
tctgcccttgggtgactgtagtagc

SEQ ID NO: 787696 - DNA, 25 bp, Mus musculus
tctgccgaacccaggcatgatgcta

SEQ ID NO: 787697 - DNA, 25 bp, Mus musculus
tctgccgaaccctggcatgatgcta

SEQ ID NO: 787698 - DNA, 25 bp, Mus musculus
tctgccgaaggaagatggcgcatac

SEQ ID NO: 787699 - DNA, 25 bp, Mus musculus
tctgccgaaggatgatggcgcatac

SEQ ID NO: 787700 - DNA, 25 bp, Mus musculus
tctgccgaccccagctatgatgagg

SEQ ID NO: 787701 - DNA, 25 bp, Mus musculus
tctgccgacccctgctatgatgagg

SEQ ID NO: 787702 - DNA, 25 bp, Mus musculus
tctgccgaggcccagtcaagggcat

SEQ ID NO: 787703 - DNA, 25 bp, Mus musculus
tctgccgaggccgagtcaagggcat

SEQ ID NO: 787704 - DNA, 25 bp, Mus musculus
tctgccgatgaactcaaaagtctgt

SEQ ID NO: 787705 - DNA, 25 bp, Mus musculus
tctgccgatgaagtcaaaagtctgt

SEQ ID NO: 787706 - DNA, 25 bp, Mus musculus
tctgccgccaggctctgccagtttg

SEQ ID NO: 787707 - DNA, 25 bp, Mus musculus
tctgccgccagggtctgccagtttg

SEQ ID NO: 787708 - DNA, 25 bp, Mus musculus
tctgccgccttgacaaaataataga

SEQ ID NO: 787709 - DNA, 25 bp, Mus musculus
tctgccgccttgtcaaaataataga

SEQ ID NO: 787710 - DNA, 25 bp, Mus musculus
tctgccgctatcaccagcatgcaaa

SEQ ID NO: 787711 - DNA, 25 bp, Mus musculus
tctgccgctatctccagcatgcaaa

SEQ ID NO: 787712 - DNA, 25 bp, Mus musculus
tctgccgggcagcaagagtctctgc

SEQ ID NO: 787713 - DNA, 25 bp, Mus musculus
tctgccgggcaggaagagtctctgc

SEQ ID NO: 787714 - DNA, 25 bp, Mus musculus
tctgccgggctcagatctccatgac

SEQ ID NO: 787715 - DNA, 25 bp, Mus musculus
tctgccgggctctgatctccatgac

SEQ ID NO: 787716 - DNA, 25 bp, Mus musculus
tctgccgggtagaaccctaccaacg

SEQ ID NO: 787717 - DNA, 25 bp, Mus musculus
tctgccgggtagtaccctaccaacg

SEQ ID NO: 787718 - DNA, 25 bp, Mus musculus
tctgccgtgcacaacgatgggtaac

SEQ ID NO: 787719 - DNA, 25 bp, Mus musculus
tctgccgtgcactacgatgggtaac

SEQ ID NO: 787720 - DNA, 25 bp, Mus musculus
tctgccgtgcccatttacaaaggct

SEQ ID NO: 787721 - DNA, 25 bp, Mus musculus
tctgccgtgcccttttacaaaggct

SEQ ID NO: 787722 - DNA, 25 bp, Mus musculus
tctgccgtggttagatgaggccgat

SEQ ID NO: 787723 - DNA, 25 bp, Mus musculus
tctgccgtggtttgatgaggccgat

SEQ ID NO: 787724 - DNA, 25 bp, Mus musculus
tctgccgttcctaccagcttgcata

SEQ ID NO: 787725 - DNA, 25 bp, Mus musculus
tctgccgttccttccagcttgcata

SEQ ID NO: 787726 - DNA, 25 bp, Mus musculus
tctgcctaaagtcgtgaacacaagt

SEQ ID NO: 787727 - DNA, 25 bp, Mus musculus
tctgcctaaagtggtgaacacaagt

SEQ ID NO: 787728 - DNA, 25 bp, Mus musculus
tctgcctaatggactaactttcttt

SEQ ID NO: 787729 - DNA, 25 bp, Mus musculus
tctgcctaatggtctaactttcttt

SEQ ID NO: 787730 - DNA, 25 bp, Mus musculus
tctgcctagcatctccaagtcctgt

SEQ ID NO: 787731 - DNA, 25 bp, Mus musculus
tctgcctagcatgtccaagtcctgt

SEQ ID NO: 787732 - DNA, 25 bp, Mus musculus
tctgcctatcaactttctgtatgtg

SEQ ID NO: 787733 - DNA, 25 bp, Mus musculus
tctgcctatcaagtttctgtatgtg

SEQ ID NO: 787734 - DNA, 25 bp, Mus musculus
tctgcctatctccaggacatcgaga

SEQ ID NO: 787735 - DNA, 25 bp, Mus musculus
tctgcctatctcgaggacatcgaga

SEQ ID NO: 787736 - DNA, 25 bp, Mus musculus
tctgcctatcttctatccggctggc

SEQ ID NO: 787737 - DNA, 25 bp, Mus musculus
tctgcctatcttgtatccggctggc

SEQ ID NO: 787738 - DNA, 25 bp, Mus musculus
tctgcctcaacacggagggctcctt

SEQ ID NO: 787739 - DNA, 25 bp, Mus musculus
tctgcctcaacagggagggctcctt

SEQ ID NO: 787740 - DNA, 25 bp, Mus musculus
tctgcctcgcgcagatgttcatctg

SEQ ID NO: 787741 - DNA, 25 bp, Mus musculus
tctgcctcgcgctgatgttcatctg

SEQ ID NO: 787742 - DNA, 25 bp, Mus musculus
tctgcctcgggtccctctggatgtc

SEQ ID NO: 787743 - DNA, 25 bp, Mus musculus
tctgcctcgggtgcctctggatgtc

SEQ ID NO: 787744 - DNA, 25 bp, Mus musculus
tctgcctctaggcaccagttctgca

SEQ ID NO: 787745 - DNA, 25 bp, Mus musculus
tctgcctctagggaccagttctgca

SEQ ID NO: 787746 - DNA, 25 bp, Mus musculus
tctgcctgaagactattacacgcgg

SEQ ID NO: 787747 - DNA, 25 bp, Mus musculus
tctgcctgaagagtattacacgcgg

SEQ ID NO: 787748 - DNA, 25 bp, Mus musculus
tctgcctgaatccatcattgcagct

SEQ ID NO: 787749 - DNA, 25 bp, Mus musculus
tctgcctgaatcgatcattgcagct

SEQ ID NO: 787750 - DNA, 25 bp, Mus musculus
tctgcctgacgacttttgataaatt

SEQ ID NO: 787751 - DNA, 25 bp, Mus musculus
tctgcctgacgagttttgataaatt

SEQ ID NO: 787752 - DNA, 25 bp, Mus musculus
tctgcctgactccttgggacccggt

SEQ ID NO: 787753 - DNA, 25 bp, Mus musculus
tctgcctgactcgttgggacccggt

SEQ ID NO: 787754 - DNA, 25 bp, Mus musculus
tctgcctgactgatctcccgtttca

SEQ ID NO: 787755 - DNA, 25 bp, Mus musculus
tctgcctgactgttctcccgtttca

SEQ ID NO: 787756 - DNA, 25 bp, Mus musculus
tctgcctgaggacgcctgtgtcatg

SEQ ID NO: 787757 - DNA, 25 bp, Mus musculus
tctgcctgaggaggcctgtgtcatg

SEQ ID NO: 787758 - DNA, 25 bp, Mus musculus
tctgcctgcaggattgggactccca

SEQ ID NO: 787759 - DNA, 25 bp, Mus musculus
tctgcctgcaggtttgggactccca

SEQ ID NO: 787760 - DNA, 25 bp, Mus musculus
tctgcctgcagtacaaaaacaccta

SEQ ID NO: 787761 - DNA, 25 bp, Mus musculus
tctgcctgcagttcaaaaacaccta

SEQ ID NO: 787762 - DNA, 25 bp, Mus musculus
tctgcctgccaacctggagagagtc

SEQ ID NO: 787763 - DNA, 25 bp, Mus musculus
tctgcctgccaagctggagagagtc

SEQ ID NO: 787764 - DNA, 25 bp, Mus musculus
tctgcctgccgacaggactagactg

SEQ ID NO: 787765 - DNA, 25 bp, Mus musculus
tctgcctgccgagaggactagactg

SEQ ID NO: 787766 - DNA, 25 bp, Mus musculus
tctgcctgcgtactaaagatctcag

SEQ ID NO: 787767 - DNA, 25 bp, Mus musculus
tctgcctgcgtagtaaagatctcag

SEQ ID NO: 787768 - DNA, 25 bp, Mus musculus
tctgcctgcgtgaatcctgcaggcc

SEQ ID NO: 787769 - DNA, 25 bp, Mus musculus
tctgcctgcgtgtatcctgcaggcc

SEQ ID NO: 787770 - DNA, 25 bp, Mus musculus
tctgcctgctggaaatgaaatgatc

SEQ ID NO: 787771 - DNA, 25 bp, Mus musculus
tctgcctgctggagatgttgctcct

SEQ ID NO: 787772 - DNA, 25 bp, Mus musculus
tctgcctgctggtaatgaaatgatc

SEQ ID NO: 787773 - DNA, 25 bp, Mus musculus
tctgcctgctggtgatgttgctcct

SEQ ID NO: 787774 - DNA, 25 bp, Mus musculus
tctgcctggaagctacacttactcc

SEQ ID NO: 787775 - DNA, 25 bp, Mus musculus
tctgcctggaaggtacacttactcc

SEQ ID NO: 787776 - DNA, 25 bp, Mus musculus
tctgcctggcaaagcttttaattgg

SEQ ID NO: 787777 - DNA, 25 bp, Mus musculus
tctgcctggcaatgcttttaattgg

SEQ ID NO: 787778 - DNA, 25 bp, Mus musculus
tctgcctgggatagttgtcaaatgt

SEQ ID NO: 787779 - DNA, 25 bp, Mus musculus
tctgcctgggattgttgtcaaatgt

SEQ ID NO: 787780 - DNA, 25 bp, Mus musculus
tctgcctggtccattcagatccgtg

SEQ ID NO: 787781 - DNA, 25 bp, Mus musculus
tctgcctggtcctttcagatccgtg

SEQ ID NO: 787782 - DNA, 25 bp, Mus musculus
tctgcctgtaaaacctgagccattg

SEQ ID NO: 787783 - DNA, 25 bp, Mus musculus
tctgcctgtaaatcctgagccattg

SEQ ID NO: 787784 - DNA, 25 bp, Mus musculus
tctgcctgtggaaaatcccgtttgc

SEQ ID NO: 787785 - DNA, 25 bp, Mus musculus
tctgcctgtggataatcccgtttgc

SEQ ID NO: 787786 - DNA, 25 bp, Mus musculus
tctgccttacagatcctggacctga

SEQ ID NO: 787787 - DNA, 25 bp, Mus musculus
tctgccttacagttcctggacctga

SEQ ID NO: 787788 - DNA, 25 bp, Mus musculus
tctgccttatccactttggagagtg

SEQ ID NO: 787789 - DNA, 25 bp, Mus musculus
tctgccttatcctctttggagagtg

SEQ ID NO: 787790 - DNA, 25 bp, Mus musculus
tctgccttatggcagaccctggtgt

SEQ ID NO: 787791 - DNA, 25 bp, Mus musculus
tctgccttatgggagaccctggtgt

SEQ ID NO: 787792 - DNA, 25 bp, Mus musculus
tctgccttccgtcccgttgctttaa

SEQ ID NO: 787793 - DNA, 25 bp, Mus musculus
tctgccttccgtgccgttgctttaa

SEQ ID NO: 787794 - DNA, 25 bp, Mus musculus
tctgccttccttccaatacgaagtt

SEQ ID NO: 787795 - DNA, 25 bp, Mus musculus
tctgccttccttgcaatacgaagtt

SEQ ID NO: 787796 - DNA, 25 bp, Mus musculus
tctgccttcggacctacagctggat

SEQ ID NO: 787797 - DNA, 25 bp, Mus musculus
tctgccttcggagctacagctggat

SEQ ID NO: 787798 - DNA, 25 bp, Mus musculus
tctgccttgaagaacatcgagaagc

SEQ ID NO: 787799 - DNA, 25 bp, Mus musculus
tctgccttgaagtacatcgagaagc

SEQ ID NO: 787800 - DNA, 25 bp, Mus musculus
tctgccttgcgcaggaagtacactc

SEQ ID NO: 787801 - DNA, 25 bp, Mus musculus
tctgccttgcgctggaagtacactc

SEQ ID NO: 787802 - DNA, 25 bp, Mus musculus
tctgccttggtcagatctctcctga

SEQ ID NO: 787803 - DNA, 25 bp, Mus musculus
tctgccttggtctgatctctcctga

SEQ ID NO: 787804 - DNA, 25 bp, Mus musculus
tctgcctttgatagtaaagaaagga

SEQ ID NO: 787805 - DNA, 25 bp, Mus musculus
tctgcctttgattgtaaagaaagga

SEQ ID NO: 787806 - DNA, 25 bp, Mus musculus
tctgccttttggatgacctctgccc

SEQ ID NO: 787807 - DNA, 25 bp, Mus musculus
tctgccttttggttgacctctgccc

SEQ ID NO: 787808 - DNA, 25 bp, Mus musculus
tctgcgaaaccaaatcggaggccat

SEQ ID NO: 787809 - DNA, 25 bp, Mus musculus
tctgcgaaaccatatcggaggccat

SEQ ID NO: 787810 - DNA, 25 bp, Mus musculus
tctgcgaacagaccatcgagacgct

SEQ ID NO: 787811 - DNA, 25 bp, Mus musculus
tctgcgaacagagcatcgagacgct

SEQ ID NO: 787812 - DNA, 25 bp, Mus musculus
tctgcgaagctaatgacctgcctct

SEQ ID NO: 787813 - DNA, 25 bp, Mus musculus
tctgcgaagctattgacctgcctct

SEQ ID NO: 787814 - DNA, 25 bp, Mus musculus
tctgcgaatcgcacctgcagcaaag

SEQ ID NO: 787815 - DNA, 25 bp, Mus musculus
tctgcgaatcgctcctgcagcaaag

SEQ ID NO: 787816 - DNA, 25 bp, Mus musculus
tctgcgacaatgcaccttcctgcta

SEQ ID NO: 787817 - DNA, 25 bp, Mus musculus
tctgcgacaatggaccttcctgcta

SEQ ID NO: 787818 - DNA, 25 bp, Mus musculus
tctgcgaccagtattatctaacatc

SEQ ID NO: 787819 - DNA, 25 bp, Mus musculus
tctgcgaccagttttatctaacatc

SEQ ID NO: 787820 - DNA, 25 bp, Mus musculus
tctgcgacggagcatctgagctgca

SEQ ID NO: 787821 - DNA, 25 bp, Mus musculus
tctgcgacggaggatctgagctgca

SEQ ID NO: 787822 - DNA, 25 bp, Mus musculus
tctgcgactactcgtgacaatgtcc

SEQ ID NO: 787823 - DNA, 25 bp, Mus musculus
tctgcgactactggtgacaatgtcc

SEQ ID NO: 787824 - DNA, 25 bp, Mus musculus
tctgcgactcaaatgcctgggtccc

SEQ ID NO: 787825 - DNA, 25 bp, Mus musculus
tctgcgactcaattgcctgggtccc

SEQ ID NO: 787826 - DNA, 25 bp, Mus musculus
tctgcgacttgccaggaaaggctca

SEQ ID NO: 787827 - DNA, 25 bp, Mus musculus
tctgcgacttgcgaggaaaggctca

SEQ ID NO: 787828 - DNA, 25 bp, Mus musculus
tctgcgagagttagggaatcgatct

SEQ ID NO: 787829 - DNA, 25 bp, Mus musculus
tctgcgagagtttgggaatcgatct

SEQ ID NO: 787830 - DNA, 25 bp, Mus musculus
tctgcgagccaacagaactctataa

SEQ ID NO: 787831 - DNA, 25 bp, Mus musculus
tctgcgagccaagagaactctataa

SEQ ID NO: 787832 - DNA, 25 bp, Mus musculus
tctgcgagctggaagccaatggcga

SEQ ID NO: 787833 - DNA, 25 bp, Mus musculus
tctgcgagctggtagccaatggcga

SEQ ID NO: 787834 - DNA, 25 bp, Mus musculus
tctgcgaggagtccgcgtgttctcc

SEQ ID NO: 787835 - DNA, 25 bp, Mus musculus
tctgcgaggagtgcgcgtgttctcc

SEQ ID NO: 787836 - DNA, 25 bp, Mus musculus
tctgcgaggcccacgaaagggacca

SEQ ID NO: 787837 - DNA, 25 bp, Mus musculus
tctgcgaggccctcgaaagggacca

SEQ ID NO: 787838 - DNA, 25 bp, Mus musculus
tctgcgaggtgcagatccaccgcgg

SEQ ID NO: 787839 - DNA, 25 bp, Mus musculus
tctgcgaggtgctgatccaccgcgg

SEQ ID NO: 787840 - DNA, 25 bp, Mus musculus
tctgcgagtccaattagcggagaag

SEQ ID NO: 787841 - DNA, 25 bp, Mus musculus
tctgcgagtccatttagcggagaag

SEQ ID NO: 787842 - DNA, 25 bp, Mus musculus
tctgcgagttttctggcaaaggctt

SEQ ID NO: 787843 - DNA, 25 bp, Mus musculus
tctgcgagttttgtggcaaaggctt

SEQ ID NO: 787844 - DNA, 25 bp, Mus musculus
tctgcgcacggtattattgtcattg

SEQ ID NO: 787845 - DNA, 25 bp, Mus musculus
tctgcgcacggttttattgtcattg

SEQ ID NO: 787846 - DNA, 25 bp, Mus musculus
tctgcgcaggcgcacttccaacgtt

SEQ ID NO: 787847 - DNA, 25 bp, Mus musculus
tctgcgcaggcggacttccaacgtt

SEQ ID NO: 787848 - DNA, 25 bp, Mus musculus
tctgcgcagggtcatgcttcgcgcc

SEQ ID NO: 787849 - DNA, 25 bp, Mus musculus
tctgcgcagggtgatgcttcgcgcc

SEQ ID NO: 787850 - DNA, 25 bp, Mus musculus
tctgcgcatgcgagactggctcaaa

SEQ ID NO: 787851 - DNA, 25 bp, Mus musculus
tctgcgcatgcgtgactggctcaaa

SEQ ID NO: 787852 - DNA, 25 bp, Mus musculus
tctgcgccaagcatggcattgaata

SEQ ID NO: 787853 - DNA, 25 bp, Mus musculus
tctgcgccaagcttggcattgaata

SEQ ID NO: 787854 - DNA, 25 bp, Mus musculus
tctgcgccactgactacacggaaga

SEQ ID NO: 787855 - DNA, 25 bp, Mus musculus
tctgcgccactgtctacacggaaga

SEQ ID NO: 787856 - DNA, 25 bp, Mus musculus
tctgcgccgtctctgtagccgtcgg

SEQ ID NO: 787857 - DNA, 25 bp, Mus musculus
tctgcgccgtctgtgtagccgtcgg

SEQ ID NO: 787858 - DNA, 25 bp, Mus musculus
tctgcgcctgctatctatagccagg

SEQ ID NO: 787859 - DNA, 25 bp, Mus musculus
tctgcgcctgctttctatagccagg

SEQ ID NO: 787860 - DNA, 25 bp, Mus musculus
tctgcgcgccgaaagagagaagatg

SEQ ID NO: 787861 - DNA, 25 bp, Mus musculus
tctgcgcgccgatagagagaagatg

SEQ ID NO: 787862 - DNA, 25 bp, Mus musculus
tctgcgcggactcatgctggcagtc

SEQ ID NO: 787863 - DNA, 25 bp, Mus musculus
tctgcgcggactgatgctggcagtc

SEQ ID NO: 787864 - DNA, 25 bp, Mus musculus
tctgcgctcaagcacagctatatga

SEQ ID NO: 787865 - DNA, 25 bp, Mus musculus
tctgcgctcaaggacagctatatga

SEQ ID NO: 787866 - DNA, 25 bp, Mus musculus
tctgcgctcagccagctcatggtgt

SEQ ID NO: 787867 - DNA, 25 bp, Mus musculus
tctgcgctcagcgagctcatggtgt

SEQ ID NO: 787868 - DNA, 25 bp, Mus musculus
tctgcgctccccagcgtacaattta

SEQ ID NO: 787869 - DNA, 25 bp, Mus musculus
tctgcgctcccctgcgtacaattta

SEQ ID NO: 787870 - DNA, 25 bp, Mus musculus
tctgcgctgaggatgtgaaggactt

SEQ ID NO: 787871 - DNA, 25 bp, Mus musculus
tctgcgctgaggttgtgaaggactt

SEQ ID NO: 787872 - DNA, 25 bp, Mus musculus
tctgcgctgggacagacacagtcct

SEQ ID NO: 787873 - DNA, 25 bp, Mus musculus
tctgcgctgggagagacacagtcct

SEQ ID NO: 787874 - DNA, 25 bp, Mus musculus
tctgcgctgtcccaagtgtcctcag

SEQ ID NO: 787875 - DNA, 25 bp, Mus musculus
tctgcgctgtccgaagtgtcctcag

SEQ ID NO: 787876 - DNA, 25 bp, Mus musculus
tctgcgcttgcgatgggcgtcagct

SEQ ID NO: 787877 - DNA, 25 bp, Mus musculus
tctgcgcttgcgttgggcgtcagct

SEQ ID NO: 787878 - DNA, 25 bp, Mus musculus
tctgcggacttaaaaggcaccgtct

SEQ ID NO: 787879 - DNA, 25 bp, Mus musculus
tctgcggacttataaggcaccgtct

SEQ ID NO: 787880 - DNA, 25 bp, Mus musculus
tctgcggataaacagagacttgcca

SEQ ID NO: 787881 - DNA, 25 bp, Mus musculus
tctgcggataaagagagacttgcca

SEQ ID NO: 787882 - DNA, 25 bp, Mus musculus
tctgcggcatgcaaagcatcataca

SEQ ID NO: 787883 - DNA, 25 bp, Mus musculus
tctgcggcatgctaagcatcataca

SEQ ID NO: 787884 - DNA, 25 bp, Mus musculus
tctgcggccatgacaagtgccctgc

SEQ ID NO: 787885 - DNA, 25 bp, Mus musculus
tctgcggccatgtcaagtgccctgc

SEQ ID NO: 787886 - DNA, 25 bp, Mus musculus
tctgcggccctcctggtgaatgctg

SEQ ID NO: 787887 - DNA, 25 bp, Mus musculus
tctgcggccctcgtggtgaatgctg

SEQ ID NO: 787888 - DNA, 25 bp, Mus musculus
tctgcggcctgaaagcaaagccttg

SEQ ID NO: 787889 - DNA, 25 bp, Mus musculus
tctgcggcctgatagcaaagccttg

SEQ ID NO: 787890 - DNA, 25 bp, Mus musculus
tctgcggcgtaacgcctgcgaatcg

SEQ ID NO: 787891 - DNA, 25 bp, Mus musculus
tctgcggcgtaaggcctgcgaatcg

SEQ ID NO: 787892 - DNA, 25 bp, Mus musculus
tctgcgggaactctttgagttcaga

SEQ ID NO: 787893 - DNA, 25 bp, Mus musculus
tctgcgggaactgtttgagttcaga

SEQ ID NO: 787894 - DNA, 25 bp, Mus musculus
tctgcgggacgcagcagtacttggt

SEQ ID NO: 787895 - DNA, 25 bp, Mus musculus
tctgcgggacgctgcagtacttggt

SEQ ID NO: 787896 - DNA, 25 bp, Mus musculus
tctgcgggcgcacagtctctgagtc

SEQ ID NO: 787897 - DNA, 25 bp, Mus musculus
tctgcgggcgcagagtctctgagtc

SEQ ID NO: 787898 - DNA, 25 bp, Mus musculus
tctgcgggtgataccacttaaagaa

SEQ ID NO: 787899 - DNA, 25 bp, Mus musculus
tctgcgggtgattccacttaaagaa

SEQ ID NO: 787900 - DNA, 25 bp, Mus musculus
tctgcggtcagaatgagagagtcaa

SEQ ID NO: 787901 - DNA, 25 bp, Mus musculus
tctgcggtcagattgagagagtcaa

SEQ ID NO: 787902 - DNA, 25 bp, Mus musculus
tctgcggtcgcgcttaccatgctaa

SEQ ID NO: 787903 - DNA, 25 bp, Mus musculus
tctgcggtcgcggttaccatgctaa

SEQ ID NO: 787904 - DNA, 25 bp, Mus musculus
tctgcggtctttctgcttgcactct

SEQ ID NO: 787905 - DNA, 25 bp, Mus musculus
tctgcggtctttgtgcttgcactct

SEQ ID NO: 787906 - DNA, 25 bp, Mus musculus
tctgcggtgactactaagatcccag

SEQ ID NO: 787907 - DNA, 25 bp, Mus musculus
tctgcggtgacttctaagatcccag

SEQ ID NO: 787908 - DNA, 25 bp, Mus musculus
tctgcggttgctcgaactccctaaa

SEQ ID NO: 787909 - DNA, 25 bp, Mus musculus
tctgcggttgctggaactccctaaa

SEQ ID NO: 787910 - DNA, 25 bp, Mus musculus
tctgcgtaagaacaagactctacgc

SEQ ID NO: 787911 - DNA, 25 bp, Mus musculus
tctgcgtaagaagaagactctacgc

SEQ ID NO: 787912 - DNA, 25 bp, Mus musculus
tctgcgtcaaaacatacgagaaggg

SEQ ID NO: 787913 - DNA, 25 bp, Mus musculus
tctgcgtcaaaagatacgagaaggg

SEQ ID NO: 787914 - DNA, 25 bp, Mus musculus
tctgcgtcagacagaatccgttcta

SEQ ID NO: 787915 - DNA, 25 bp, Mus musculus
tctgcgtcagactgaatccgttcta

SEQ ID NO: 787916 - DNA, 25 bp, Mus musculus
tctgcgtccctcagatcctcgagtg

SEQ ID NO: 787917 - DNA, 25 bp, Mus musculus
tctgcgtccctctgatcctcgagtg

SEQ ID NO: 787918 - DNA, 25 bp, Mus musculus
tctgcgtcctgcagctaggctgtaa

SEQ ID NO: 787919 - DNA, 25 bp, Mus musculus
tctgcgtcctgctgctaggctgtaa

SEQ ID NO: 787920 - DNA, 25 bp, Mus musculus
tctgcgtctgtgaagaggaaatcac

SEQ ID NO: 787921 - DNA, 25 bp, Mus musculus
tctgcgtctgtgtagaggaaatcac

SEQ ID NO: 787922 - DNA, 25 bp, Mus musculus
tctgcgtgatccacgggcttggagc

SEQ ID NO: 787923 - DNA, 25 bp, Mus musculus
tctgcgtgatcctcgggcttggagc

SEQ ID NO: 787924 - DNA, 25 bp, Mus musculus
tctgcgtgccctagggaagcatgcc

SEQ ID NO: 787925 - DNA, 25 bp, Mus musculus
tctgcgtgccctcctatgagaagca

SEQ ID NO: 787926 - DNA, 25 bp, Mus musculus
tctgcgtgccctgctatgagaagca

SEQ ID NO: 787927 - DNA, 25 bp, Mus musculus
tctgcgtgcccttgggaagcatgcc

SEQ ID NO: 787928 - DNA, 25 bp, Mus musculus
tctgcgtgctagatgtcgacctaca

SEQ ID NO: 787929 - DNA, 25 bp, Mus musculus
tctgcgtgctagttgtcgacctaca

SEQ ID NO: 787930 - DNA, 25 bp, Mus musculus
tctgcgtggtggcttaccttggact

SEQ ID NO: 787931 - DNA, 25 bp, Mus musculus
tctgcgtggtgggttaccttggact

SEQ ID NO: 787932 - DNA, 25 bp, Mus musculus
tctgcgttccaaagccctgtctcta

SEQ ID NO: 787933 - DNA, 25 bp, Mus musculus
tctgcgttccaatgccctgtctcta

SEQ ID NO: 787934 - DNA, 25 bp, Mus musculus
tctgcgtttcgaagtgaaggattgc

SEQ ID NO: 787935 - DNA, 25 bp, Mus musculus
tctgcgtttcgatgtgaaggattgc

SEQ ID NO: 787936 - DNA, 25 bp, Mus musculus
tctgctaaaaggaatcacctgagtg

SEQ ID NO: 787937 - DNA, 25 bp, Mus musculus
tctgctaaaaggtatcacctgagtg

SEQ ID NO: 787938 - DNA, 25 bp, Mus musculus
tctgctaaactaagtcggaaagaca

SEQ ID NO: 787939 - DNA, 25 bp, Mus musculus
tctgctaaactatgtcggaaagaca

SEQ ID NO: 787940 - DNA, 25 bp, Mus musculus
tctgctaaagagcaggccaagtttg

SEQ ID NO: 787941 - DNA, 25 bp, Mus musculus
tctgctaaagaggaggccaagtttg

SEQ ID NO: 787942 - DNA, 25 bp, Mus musculus
tctgctaactaaagaatgctgacct

SEQ ID NO: 787943 - DNA, 25 bp, Mus musculus
tctgctaactaatgaatgctgacct

SEQ ID NO: 787944 - DNA, 25 bp, Mus musculus
tctgctaaggaacgactcctcctct

SEQ ID NO: 787945 - DNA, 25 bp, Mus musculus
tctgctaaggaaggactcctcctct

SEQ ID NO: 787946 - DNA, 25 bp, Mus musculus
tctgctaaggacattgagaaggtcg

SEQ ID NO: 787947 - DNA, 25 bp, Mus musculus
tctgctaaggactttgagaaggtcg

SEQ ID NO: 787948 - DNA, 25 bp, Mus musculus
tctgctaagtgaagttagtgatggg

SEQ ID NO: 787949 - DNA, 25 bp, Mus musculus
tctgctaagtgatgttagtgatggg

SEQ ID NO: 787950 - DNA, 25 bp, Mus musculus
tctgctacacaccaagccagaagtg

SEQ ID NO: 787951 - DNA, 25 bp, Mus musculus
tctgctacacacgaagccagaagtg

SEQ ID NO: 787952 - DNA, 25 bp, Mus musculus
tctgctacacagctaggcagtgtct

SEQ ID NO: 787953 - DNA, 25 bp, Mus musculus
tctgctacacaggtaggcagtgtct

SEQ ID NO: 787954 - DNA, 25 bp, Mus musculus
tctgctacagagatggtcacgtaca

SEQ ID NO: 787955 - DNA, 25 bp, Mus musculus
tctgctacagagttggtcacgtaca

SEQ ID NO: 787956 - DNA, 25 bp, Mus musculus
tctgctacagccacatgattcgacg

SEQ ID NO: 787957 - DNA, 25 bp, Mus musculus
tctgctacagcctcatgattcgacg

SEQ ID NO: 787958 - DNA, 25 bp, Mus musculus
tctgctacaggaaccagtgaaccct

SEQ ID NO: 787959 - DNA, 25 bp, Mus musculus
tctgctacaggatccagtgaaccct

SEQ ID NO: 787960 - DNA, 25 bp, Mus musculus
tctgctacctcaataaataacaggc

SEQ ID NO: 787961 - DNA, 25 bp, Mus musculus
tctgctacctcattaaataacaggc

SEQ ID NO: 787962 - DNA, 25 bp, Mus musculus
tctgctacgcaacctagggatccgg

SEQ ID NO: 787963 - DNA, 25 bp, Mus musculus
tctgctacgcaagctagggatccgg

SEQ ID NO: 787964 - DNA, 25 bp, Mus musculus
tctgctacgggtcatcaagcgatgc

SEQ ID NO: 787965 - DNA, 25 bp, Mus musculus
tctgctacgggtgatcaagcgatgc

SEQ ID NO: 787966 - DNA, 25 bp, Mus musculus
tctgctactctgcattaagaatcgc

SEQ ID NO: 787967 - DNA, 25 bp, Mus musculus
tctgctactctggattaagaatcgc

SEQ ID NO: 787968 - DNA, 25 bp, Mus musculus
tctgctagccccagcaacatcaagg

SEQ ID NO: 787969 - DNA, 25 bp, Mus musculus
tctgctagcccctgcaacatcaagg

SEQ ID NO: 787970 - DNA, 25 bp, Mus musculus
tctgctagggaacacaacccaagct

SEQ ID NO: 787971 - DNA, 25 bp, Mus musculus
tctgctagggaagacaacccaagct

SEQ ID NO: 787972 - DNA, 25 bp, Mus musculus
tctgctataagtaaaggcataacct

SEQ ID NO: 787973 - DNA, 25 bp, Mus musculus
tctgctataagttaaggcataacct

SEQ ID NO: 787974 - DNA, 25 bp, Mus musculus
tctgctatcaagacgaggatcaagg

SEQ ID NO: 787975 - DNA, 25 bp, Mus musculus
tctgctatcaagtcgaggatcaagg

SEQ ID NO: 787976 - DNA, 25 bp, Mus musculus
tctgctatcgccacaaacggatatg

SEQ ID NO: 787977 - DNA, 25 bp, Mus musculus
tctgctatcgcctcaaacggatatg

SEQ ID NO: 787978 - DNA, 25 bp, Mus musculus
tctgctatgaggcttaactgctgtc

SEQ ID NO: 787979 - DNA, 25 bp, Mus musculus
tctgctatgagggttaactgctgtc

SEQ ID NO: 787980 - DNA, 25 bp, Mus musculus
tctgctatgataagcgcttcgcgga

SEQ ID NO: 787981 - DNA, 25 bp, Mus musculus
tctgctatgatatgcgcttcgcgga

SEQ ID NO: 787982 - DNA, 25 bp, Mus musculus
tctgctatgcccatcgggctgaagg

SEQ ID NO: 787983 - DNA, 25 bp, Mus musculus
tctgctatgcccttcgggctgaagg

SEQ ID NO: 787984 - DNA, 25 bp, Mus musculus
tctgctatggtgcaccacagtcaag

SEQ ID NO: 787985 - DNA, 25 bp, Mus musculus
tctgctatggtggaccacagtcaag

SEQ ID NO: 787986 - DNA, 25 bp, Mus musculus
tctgctattctgacactgaccgcca

SEQ ID NO: 787987 - DNA, 25 bp, Mus musculus
tctgctattctgtcactgaccgcca

SEQ ID NO: 787988 - DNA, 25 bp, Mus musculus
tctgctattggcattggcttggcat

SEQ ID NO: 787989 - DNA, 25 bp, Mus musculus
tctgctattggctttggcttggcat

SEQ ID NO: 787990 - DNA, 25 bp, Mus musculus
tctgctattgtcaatgcacaaaggt

SEQ ID NO: 787991 - DNA, 25 bp, Mus musculus
tctgctattgtctatgcacaaaggt

SEQ ID NO: 787992 - DNA, 25 bp, Mus musculus
tctgctcaacgtcgtggacagtgcc

SEQ ID NO: 787993 - DNA, 25 bp, Mus musculus
tctgctcaacgtggtggacagtgcc

SEQ ID NO: 787994 - DNA, 25 bp, Mus musculus
tctgctcaaggaagaaggcctgttc

SEQ ID NO: 787995 - DNA, 25 bp, Mus musculus
tctgctcaaggatgaaggcctgttc

SEQ ID NO: 787996 - DNA, 25 bp, Mus musculus
tctgctcacaaaaggaagccgttgc

SEQ ID NO: 787997 - DNA, 25 bp, Mus musculus
tctgctcacaaatggaagccgttgc

SEQ ID NO: 787998 - DNA, 25 bp, Mus musculus
tctgctcacacacgatagagagggc

SEQ ID NO: 787999 - DNA, 25 bp, Mus musculus
tctgctcacacaggatagagagggc

SEQ ID NO: 788000 - DNA, 25 bp, Mus musculus
tctgctcatctacggtggcagcggc

SEQ ID NO: 788001 - DNA, 25 bp, Mus musculus
tctgctcatctacgtcctctacaag

SEQ ID NO: 788002 - DNA, 25 bp, Mus musculus
tctgctcatctagggtggcagcggc

SEQ ID NO: 788003 - DNA, 25 bp, Mus musculus
tctgctcatctaggtcctctacaag

SEQ ID NO: 788004 - DNA, 25 bp, Mus musculus
tctgctccacctacgaggttttacc

SEQ ID NO: 788005 - DNA, 25 bp, Mus musculus
tctgctccaccttcgaggttttacc

SEQ ID NO: 788006 - DNA, 25 bp, Mus musculus
tctgctccacggagagaccgggctc

SEQ ID NO: 788007 - DNA, 25 bp, Mus musculus
tctgctccacggtgagaccgggctc

SEQ ID NO: 788008 - DNA, 25 bp, Mus musculus
tctgctccagatctgttctatgtcc

SEQ ID NO: 788009 - DNA, 25 bp, Mus musculus
tctgctccagatgtgttctatgtcc

SEQ ID NO: 788010 - DNA, 25 bp, Mus musculus
tctgctccagctccaattttgcctt

SEQ ID NO: 788011 - DNA, 25 bp, Mus musculus
tctgctccagctgcaattttgcctt

SEQ ID NO: 788012 - DNA, 25 bp, Mus musculus
tctgctccaggcaggtcactgaaca

SEQ ID NO: 788013 - DNA, 25 bp, Mus musculus
tctgctccaggctggtcactgaaca

SEQ ID NO: 788014 - DNA, 25 bp, Mus musculus
tctgctccagtaagccctcaggaaa

SEQ ID NO: 788015 - DNA, 25 bp, Mus musculus
tctgctccagtatgccctcaggaaa

SEQ ID NO: 788016 - DNA, 25 bp, Mus musculus
tctgctccatgcagaagaaaaaaca

SEQ ID NO: 788017 - DNA, 25 bp, Mus musculus
tctgctccatgctgaagaaaaaaca

SEQ ID NO: 788018 - DNA, 25 bp, Mus musculus
tctgctccatttacaacctgaaaac

SEQ ID NO: 788019 - DNA, 25 bp, Mus musculus
tctgctccattttcaacctgaaaac

SEQ ID NO: 788020 - DNA, 25 bp, Mus musculus
tctgctcccaggcaagtcatcagga

SEQ ID NO: 788021 - DNA, 25 bp, Mus musculus
tctgctcccagggaagtcatcagga

SEQ ID NO: 788022 - DNA, 25 bp, Mus musculus
tctgctccctgactgtaccctgtgg

SEQ ID NO: 788023 - DNA, 25 bp, Mus musculus
tctgctccctgagtgtaccctgtgg

SEQ ID NO: 788024 - DNA, 25 bp, Mus musculus
tctgctcctcaaaggacaaactaga

SEQ ID NO: 788025 - DNA, 25 bp, Mus musculus
tctgctcctcaatggacaaactaga

SEQ ID NO: 788026 - DNA, 25 bp, Mus musculus
tctgctcctcacactgtgcatcttg

SEQ ID NO: 788027 - DNA, 25 bp, Mus musculus
tctgctcctcactctgtgcatcttg

SEQ ID NO: 788028 - DNA, 25 bp, Mus musculus
tctgctcctcatcggtgccttgggc

SEQ ID NO: 788029 - DNA, 25 bp, Mus musculus
tctgctcctcatgggtgccttgggc

SEQ ID NO: 788030 - DNA, 25 bp, Mus musculus
tctgctcctgataggaacctttgtg

SEQ ID NO: 788031 - DNA, 25 bp, Mus musculus
tctgctcctgattggaacctttgtg

SEQ ID NO: 788032 - DNA, 25 bp, Mus musculus
tctgctcctgcacggccttcgtata

SEQ ID NO: 788033 - DNA, 25 bp, Mus musculus
tctgctcctgcagggccttcgtata

SEQ ID NO: 788034 - DNA, 25 bp, Mus musculus
tctgctcctgccaagttggcaaggc

SEQ ID NO: 788035 - DNA, 25 bp, Mus musculus
tctgctcctgcctagttggcaaggc

SEQ ID NO: 788036 - DNA, 25 bp, Mus musculus
tctgctcctgctcgtcgctgtggca

SEQ ID NO: 788037 - DNA, 25 bp, Mus musculus
tctgctcctgctggtcgctgtggca

SEQ ID NO: 788038 - DNA, 25 bp, Mus musculus
tctgctcctggtcaacgagtgttcg

SEQ ID NO: 788039 - DNA, 25 bp, Mus musculus
tctgctcctggtgaacgagtgttcg

SEQ ID NO: 788040 - DNA, 25 bp, Mus musculus
tctgctccttggctacaagagctct

SEQ ID NO: 788041 - DNA, 25 bp, Mus musculus
tctgctccttgggtacaagagctct

SEQ ID NO: 788042 - DNA, 25 bp, Mus musculus
tctgctcgacttcaaataccgggca

SEQ ID NO: 788043 - DNA, 25 bp, Mus musculus
tctgctcgacttgaaataccgggca

SEQ ID NO: 788044 - DNA, 25 bp, Mus musculus
tctgctcgctctcgacaatgccaag

SEQ ID NO: 788045 - DNA, 25 bp, Mus musculus
tctgctcgctctggacaatgccaag

SEQ ID NO: 788046 - DNA, 25 bp, Mus musculus
tctgctcgcttcaagctctggtaca

SEQ ID NO: 788047 - DNA, 25 bp, Mus musculus
tctgctcgcttctagctctggtaca

SEQ ID NO: 788048 - DNA, 25 bp, Mus musculus
tctgctcgggatctcatgaaggtgc

SEQ ID NO: 788049 - DNA, 25 bp, Mus musculus
tctgctcgggatgtcatgaaggtgc

SEQ ID NO: 788050 - DNA, 25 bp, Mus musculus
tctgctctataaaccacggcgcggt

SEQ ID NO: 788051 - DNA, 25 bp, Mus musculus
tctgctctataatccacggcgcggt

SEQ ID NO: 788052 - DNA, 25 bp, Mus musculus
tctgctctcagccaggttgtgcgca

SEQ ID NO: 788053 - DNA, 25 bp, Mus musculus
tctgctctcagcgaggttgtgcgca

SEQ ID NO: 788054 - DNA, 25 bp, Mus musculus
tctgctctccttcgcactctgtgga

SEQ ID NO: 788055 - DNA, 25 bp, Mus musculus
tctgctctccttggcactctgtgga

SEQ ID NO: 788056 - DNA, 25 bp, Mus musculus
tctgctctctttctcgtccagtgaa

SEQ ID NO: 788057 - DNA, 25 bp, Mus musculus
tctgctctctttgtcgtccagtgaa

SEQ ID NO: 788058 - DNA, 25 bp, Mus musculus
tctgctctgagaaagctgtcccttt

SEQ ID NO: 788059 - DNA, 25 bp, Mus musculus
tctgctctgagaattatatcaccta

SEQ ID NO: 788060 - DNA, 25 bp, Mus musculus
tctgctctgagatagctgtcccttt

SEQ ID NO: 788061 - DNA, 25 bp, Mus musculus
tctgctctgagatttatatcaccta

SEQ ID NO: 788062 - DNA, 25 bp, Mus musculus
tctgctctgcctcatggatttagga

SEQ ID NO: 788063 - DNA, 25 bp, Mus musculus
tctgctctgcctgatggatttagga

SEQ ID NO: 788064 - DNA, 25 bp, Mus musculus
tctgctctgcgcaaacatcattgtg

SEQ ID NO: 788065 - DNA, 25 bp, Mus musculus
tctgctctgcgctaacatcattgtg

SEQ ID NO: 788066 - DNA, 25 bp, Mus musculus
tctgctctgcttagccgatatccat

SEQ ID NO: 788067 - DNA, 25 bp, Mus musculus
tctgctctgcttcacacgagtatca

SEQ ID NO: 788068 - DNA, 25 bp, Mus musculus
tctgctctgcttgacacgagtatca

SEQ ID NO: 788069 - DNA, 25 bp, Mus musculus
tctgctctgctttgccgatatccat

SEQ ID NO: 788070 - DNA, 25 bp, Mus musculus
tctgctctggaacagtccacagtgt

SEQ ID NO: 788071 - DNA, 25 bp, Mus musculus
tctgctctggaagagtccacagtgt

SEQ ID NO: 788072 - DNA, 25 bp, Mus musculus
tctgctctggatcaagagggtcacc

SEQ ID NO: 788073 - DNA, 25 bp, Mus musculus
tctgctctggatgaagagggtcacc

SEQ ID NO: 788074 - DNA, 25 bp, Mus musculus
tctgctctgttcattccactgtgcc

SEQ ID NO: 788075 - DNA, 25 bp, Mus musculus
tctgctctgttctttccactgtgcc

SEQ ID NO: 788076 - DNA, 25 bp, Mus musculus
tctgctcttaacagccacaaggacc

SEQ ID NO: 788077 - DNA, 25 bp, Mus musculus
tctgctcttaactgccacaaggacc

SEQ ID NO: 788078 - DNA, 25 bp, Mus musculus
tctgctcttgggagtttctcttgtt

SEQ ID NO: 788079 - DNA, 25 bp, Mus musculus
tctgctcttgggtgtttctcttgtt

SEQ ID NO: 788080 - DNA, 25 bp, Mus musculus
tctgctcttttcagaagtctggact

SEQ ID NO: 788081 - DNA, 25 bp, Mus musculus
tctgctcttttctgaagtctggact

SEQ ID NO: 788082 - DNA, 25 bp, Mus musculus
tctgctgaacgaagctctcagcatc

SEQ ID NO: 788083 - DNA, 25 bp, Mus musculus
tctgctgaacgatgctctcagcatc

SEQ ID NO: 788084 - DNA, 25 bp, Mus musculus
tctgctgaaggtcgctggctacgcc

SEQ ID NO: 788085 - DNA, 25 bp, Mus musculus
tctgctgaaggtggctggctacgcc

SEQ ID NO: 788086 - DNA, 25 bp, Mus musculus
tctgctgaagtcagggaagaattga

SEQ ID NO: 788087 - DNA, 25 bp, Mus musculus
tctgctgaagtctgggaagaattga

SEQ ID NO: 788088 - DNA, 25 bp, Mus musculus
tctgctgaagttaatggcccctggg

SEQ ID NO: 788089 - DNA, 25 bp, Mus musculus
tctgctgaagtttatggcccctggg

SEQ ID NO: 788090 - DNA, 25 bp, Mus musculus
tctgctgacaaacgatgttaacatt

SEQ ID NO: 788091 - DNA, 25 bp, Mus musculus
tctgctgacaaaggatgttaacatt

SEQ ID NO: 788092 - DNA, 25 bp, Mus musculus
tctgctgacccaccaaggctctggg

SEQ ID NO: 788093 - DNA, 25 bp, Mus musculus
tctgctgacccagcaaggctctggg

SEQ ID NO: 788094 - DNA, 25 bp, Mus musculus
tctgctgaccgactacatcgaggga

SEQ ID NO: 788095 - DNA, 25 bp, Mus musculus
tctgctgaccgagtacatcgaggga

SEQ ID NO: 788096 - DNA, 25 bp, Mus musculus
tctgctgacgagcagccccatattg

SEQ ID NO: 788097 - DNA, 25 bp, Mus musculus
tctgctgacgaggagccccatattg

SEQ ID NO: 788098 - DNA, 25 bp, Mus musculus
tctgctgacgatcgctggtctccct

SEQ ID NO: 788099 - DNA, 25 bp, Mus musculus
tctgctgacgatggctggtctccct

SEQ ID NO: 788100 - DNA, 25 bp, Mus musculus
tctgctgactggaggtctctttagc

SEQ ID NO: 788101 - DNA, 25 bp, Mus musculus
tctgctgactggtggtctctttagc

SEQ ID NO: 788102 - DNA, 25 bp, Mus musculus
tctgctgaggtacgagctttttcgg

SEQ ID NO: 788103 - DNA, 25 bp, Mus musculus
tctgctgaggtaggagctttttcgg

SEQ ID NO: 788104 - DNA, 25 bp, Mus musculus
tctgctgaggtcattgtggagtccc

SEQ ID NO: 788105 - DNA, 25 bp, Mus musculus
tctgctgaggtctttgtggagtccc

SEQ ID NO: 788106 - DNA, 25 bp, Mus musculus
tctgctgaggtgaactttagtacca

SEQ ID NO: 788107 - DNA, 25 bp, Mus musculus
tctgctgaggtgtactttagtacca

SEQ ID NO: 788108 - DNA, 25 bp, Mus musculus
tctgctgatcctcatcgcacaggtg

SEQ ID NO: 788109 - DNA, 25 bp, Mus musculus
tctgctgatcctgatcgcacaggtg

SEQ ID NO: 788110 - DNA, 25 bp, Mus musculus
tctgctgatgagactggatctgaca

SEQ ID NO: 788111 - DNA, 25 bp, Mus musculus
tctgctgatgagtctggatctgaca

SEQ ID NO: 788112 - DNA, 25 bp, Mus musculus
tctgctgcaaggacttgtggtattt

SEQ ID NO: 788113 - DNA, 25 bp, Mus musculus
tctgctgcaaggtcttgtggtattt

SEQ ID NO: 788114 - DNA, 25 bp, Mus musculus
tctgctgcaagtagcctcgccgtcg

SEQ ID NO: 788115 - DNA, 25 bp, Mus musculus
tctgctgcaagttgcctcgccgtcg

SEQ ID NO: 788116 - DNA, 25 bp, Mus musculus
tctgctgcacgacaatatgaaatag

SEQ ID NO: 788117 - DNA, 25 bp, Mus musculus
tctgctgcacgagaatatgaaatag

SEQ ID NO: 788118 - DNA, 25 bp, Mus musculus
tctgctgcacggatctctgccctgg

SEQ ID NO: 788119 - DNA, 25 bp, Mus musculus
tctgctgcacggttctctgccctgg

SEQ ID NO: 788120 - DNA, 25 bp, Mus musculus
tctgctgcactgagcagtctcggaa

SEQ ID NO: 788121 - DNA, 25 bp, Mus musculus
tctgctgcactgtgcagtctcggaa

SEQ ID NO: 788122 - DNA, 25 bp, Mus musculus
tctgctgcagacaagggctgagtga

SEQ ID NO: 788123 - DNA, 25 bp, Mus musculus
tctgctgcagactagggctgagtga

SEQ ID NO: 788124 - DNA, 25 bp, Mus musculus
tctgctgcagccctcatcgtctatg

SEQ ID NO: 788125 - DNA, 25 bp, Mus musculus
tctgctgcagccgtcatcgtctatg

SEQ ID NO: 788126 - DNA, 25 bp, Mus musculus
tctgctgcagtaaaacactgaaggc

SEQ ID NO: 788127 - DNA, 25 bp, Mus musculus
tctgctgcagtataacactgaaggc

SEQ ID NO: 788128 - DNA, 25 bp, Mus musculus
tctgctgcatgactccttgtttgga

SEQ ID NO: 788129 - DNA, 25 bp, Mus musculus
tctgctgcatgagtccttgtttgga

SEQ ID NO: 788130 - DNA, 25 bp, Mus musculus
tctgctgcattaacgctgggctact

SEQ ID NO: 788131 - DNA, 25 bp, Mus musculus
tctgctgcattatcgctgggctact

SEQ ID NO: 788132 - DNA, 25 bp, Mus musculus
tctgctgcccaaactaactccatgg

SEQ ID NO: 788133 - DNA, 25 bp, Mus musculus
tctgctgcccaatctaactccatgg

SEQ ID NO: 788134 - DNA, 25 bp, Mus musculus
tctgctgcccggagctcgtcagcat

SEQ ID NO: 788135 - DNA, 25 bp, Mus musculus
tctgctgcccggtgctcgtcagcat

SEQ ID NO: 788136 - DNA, 25 bp, Mus musculus
tctgctgcccttagtttgatcctca

SEQ ID NO: 788137 - DNA, 25 bp, Mus musculus
tctgctgccctttgtttgatcctca

SEQ ID NO: 788138 - DNA, 25 bp, Mus musculus
tctgctgccgtactgggtgaacctg

SEQ ID NO: 788139 - DNA, 25 bp, Mus musculus
tctgctgccgtagtgggtgaacctg

SEQ ID NO: 788140 - DNA, 25 bp, Mus musculus
tctgctgcctccagcgggaaccggg

SEQ ID NO: 788141 - DNA, 25 bp, Mus musculus
tctgctgcctcctgcgggaaccggg

SEQ ID NO: 788142 - DNA, 25 bp, Mus musculus
tctgctgcgacaaggagtgtctgtg

SEQ ID NO: 788143 - DNA, 25 bp, Mus musculus
tctgctgcgacatggagtgtctgtg

SEQ ID NO: 788144 - DNA, 25 bp, Mus musculus
tctgctgcgcctccaggaaagcaaa

SEQ ID NO: 788145 - DNA, 25 bp, Mus musculus
tctgctgcgcctgcaggaaagcaaa

SEQ ID NO: 788146 - DNA, 25 bp, Mus musculus
tctgctgctctacatagttctgggt

SEQ ID NO: 788147 - DNA, 25 bp, Mus musculus
tctgctgctctagatagttctgggt

SEQ ID NO: 788148 - DNA, 25 bp, Mus musculus
tctgctgctgctccattgtcccaga

SEQ ID NO: 788149 - DNA, 25 bp, Mus musculus
tctgctgctgctgcattgtcccaga

SEQ ID NO: 788150 - DNA, 25 bp, Mus musculus
tctgctgctggaaagctcggcttcc

SEQ ID NO: 788151 - DNA, 25 bp, Mus musculus
tctgctgctggatagctcggcttcc

SEQ ID NO: 788152 - DNA, 25 bp, Mus musculus
tctgctgctgggacctattggagct

SEQ ID NO: 788153 - DNA, 25 bp, Mus musculus
tctgctgctgggtcctattggagct

SEQ ID NO: 788154 - DNA, 25 bp, Mus musculus
tctgctgctgtcaagtatgatgccc

SEQ ID NO: 788155 - DNA, 25 bp, Mus musculus
tctgctgctgtctagtatgatgccc

SEQ ID NO: 788156 - DNA, 25 bp, Mus musculus
tctgctgctgttcctcatgagcagc

SEQ ID NO: 788157 - DNA, 25 bp, Mus musculus
tctgctgctgttgctcatgagcagc

SEQ ID NO: 788158 - DNA, 25 bp, Mus musculus
tctgctgcttccaaggcccttctaa

SEQ ID NO: 788159 - DNA, 25 bp, Mus musculus
tctgctgcttcctaggcccttctaa

SEQ ID NO: 788160 - DNA, 25 bp, Mus musculus
tctgctgcttctcgtacagtgttca

SEQ ID NO: 788161 - DNA, 25 bp, Mus musculus
tctgctgcttctggtacagtgttca

SEQ ID NO: 788162 - DNA, 25 bp, Mus musculus
tctgctgcttgacttgcctgatgct

SEQ ID NO: 788163 - DNA, 25 bp, Mus musculus
tctgctgcttgagttgcctgatgct

SEQ ID NO: 788164 - DNA, 25 bp, Mus musculus
tctgctgcttttcagtatcttcctc

SEQ ID NO: 788165 - DNA, 25 bp, Mus musculus
tctgctgcttttgagtatcttcctc

SEQ ID NO: 788166 - DNA, 25 bp, Mus musculus
tctgctggaaaactactacgccaca

SEQ ID NO: 788167 - DNA, 25 bp, Mus musculus
tctgctggaaaagtactacgccaca

SEQ ID NO: 788168 - DNA, 25 bp, Mus musculus
tctgctggacccaggtcaatctttt

SEQ ID NO: 788169 - DNA, 25 bp, Mus musculus
tctgctggaccctggtcaatctttt

SEQ ID NO: 788170 - DNA, 25 bp, Mus musculus
tctgctggagaccactgagagcagc

SEQ ID NO: 788171 - DNA, 25 bp, Mus musculus
tctgctggagacgactgagagcagc

SEQ ID NO: 788172 - DNA, 25 bp, Mus musculus
tctgctggagccaacttgaggcgtt

SEQ ID NO: 788173 - DNA, 25 bp, Mus musculus
tctgctggagcctacttgaggcgtt

SEQ ID NO: 788174 - DNA, 25 bp, Mus musculus
tctgctggagttactgttggccgtt

SEQ ID NO: 788175 - DNA, 25 bp, Mus musculus
tctgctggagtttctgttggccgtt

SEQ ID NO: 788176 - DNA, 25 bp, Mus musculus
tctgctggatccaggcagcttcatg

SEQ ID NO: 788177 - DNA, 25 bp, Mus musculus
tctgctggatcctggcagcttcatg

SEQ ID NO: 788178 - DNA, 25 bp, Mus musculus
tctgctggccatcttgggcaccact

SEQ ID NO: 788179 - DNA, 25 bp, Mus musculus
tctgctggccatgttgggcaccact

SEQ ID NO: 788180 - DNA, 25 bp, Mus musculus
tctgctgggagacagcgctgtaccc

SEQ ID NO: 788181 - DNA, 25 bp, Mus musculus
tctgctgggagagagcgctgtaccc

SEQ ID NO: 788182 - DNA, 25 bp, Mus musculus
tctgctgggaggacacccttccttt

SEQ ID NO: 788183 - DNA, 25 bp, Mus musculus
tctgctgggaggtcacccttccttt

SEQ ID NO: 788184 - DNA, 25 bp, Mus musculus
tctgctgggcatattaagtggtctc

SEQ ID NO: 788185 - DNA, 25 bp, Mus musculus
tctgctgggcattttaagtggtctc

SEQ ID NO: 788186 - DNA, 25 bp, Mus musculus
tctgctgggctcctgaagtgctact

SEQ ID NO: 788187 - DNA, 25 bp, Mus musculus
tctgctgggctcgtgaagtgctact

SEQ ID NO: 788188 - DNA, 25 bp, Mus musculus
tctgctgggctgcagtcctgtgcct

SEQ ID NO: 788189 - DNA, 25 bp, Mus musculus
tctgctgggctggagtcctgtgcct

SEQ ID NO: 788190 - DNA, 25 bp, Mus musculus
tctgctgggcttacggttgtgtacc

SEQ ID NO: 788191 - DNA, 25 bp, Mus musculus
tctgctgggctttcggttgtgtacc

SEQ ID NO: 788192 - DNA, 25 bp, Mus musculus
tctgctgggttcacactgaggttat

SEQ ID NO: 788193 - DNA, 25 bp, Mus musculus
tctgctgggttcagtggacgagttc

SEQ ID NO: 788194 - DNA, 25 bp, Mus musculus
tctgctgggttctcactgaggttat

SEQ ID NO: 788195 - DNA, 25 bp, Mus musculus
tctgctgggttctgtggacgagttc

SEQ ID NO: 788196 - DNA, 25 bp, Mus musculus
tctgctggtagaagaggccattagt

SEQ ID NO: 788197 - DNA, 25 bp, Mus musculus
tctgctggtagatgaggccattagt

SEQ ID NO: 788198 - DNA, 25 bp, Mus musculus
tctgctggtattcgtgatgtacttg

SEQ ID NO: 788199 - DNA, 25 bp, Mus musculus
tctgctggtattggtgatgtacttg

SEQ ID NO: 788200 - DNA, 25 bp, Mus musculus
tctgctggtcagaaatattctccat

SEQ ID NO: 788201 - DNA, 25 bp, Mus musculus
tctgctggtcagtaatattctccat

SEQ ID NO: 788202 - DNA, 25 bp, Mus musculus
tctgctgtcagaatgatggtcctca

SEQ ID NO: 788203 - DNA, 25 bp, Mus musculus
tctgctgtcagattgatggtcctca

SEQ ID NO: 788204 - DNA, 25 bp, Mus musculus
tctgctgtcagtccttacatgttgc

SEQ ID NO: 788205 - DNA, 25 bp, Mus musculus
tctgctgtcagtgcttacatgttgc

SEQ ID NO: 788206 - DNA, 25 bp, Mus musculus
tctgctgtccggaattctctggttt

SEQ ID NO: 788207 - DNA, 25 bp, Mus musculus
tctgctgtccggtattctctggttt

SEQ ID NO: 788208 - DNA, 25 bp, Mus musculus
tctgctgtgcagaggctctgcaacg

SEQ ID NO: 788209 - DNA, 25 bp, Mus musculus
tctgctgtgcagtggctctgcaacg

SEQ ID NO: 788210 - DNA, 25 bp, Mus musculus
tctgctgtgcttaaacagcagttgg

SEQ ID NO: 788211 - DNA, 25 bp, Mus musculus
tctgctgtgctttaacagcagttgg

SEQ ID NO: 788212 - DNA, 25 bp, Mus musculus
tctgctgtggaaaaattacacctat

SEQ ID NO: 788213 - DNA, 25 bp, Mus musculus
tctgctgtggaacatcgaggaccct

SEQ ID NO: 788214 - DNA, 25 bp, Mus musculus
tctgctgtggaagatcgaggaccct

SEQ ID NO: 788215 - DNA, 25 bp, Mus musculus
tctgctgtggaataattacacctat

SEQ ID NO: 788216 - DNA, 25 bp, Mus musculus
tctgctgtggtcaatgggagcagca

SEQ ID NO: 788217 - DNA, 25 bp, Mus musculus
tctgctgtggtctatgggagcagca

SEQ ID NO: 788218 - DNA, 25 bp, Mus musculus
tctgctgttactccctgcaatctgg

SEQ ID NO: 788219 - DNA, 25 bp, Mus musculus
tctgctgttactgcctgcaatctgg

SEQ ID NO: 788220 - DNA, 25 bp, Mus musculus
tctgcttaaaatatgaagggatcgt

SEQ ID NO: 788221 - DNA, 25 bp, Mus musculus
tctgcttaaaatttgaagggatcgt

SEQ ID NO: 788222 - DNA, 25 bp, Mus musculus
tctgcttaccccagtctcctggaat

SEQ ID NO: 788223 - DNA, 25 bp, Mus musculus
tctgcttacccctgtctcctggaat

SEQ ID NO: 788224 - DNA, 25 bp, Mus musculus
tctgcttaccctcgacagctagagt

SEQ ID NO: 788225 - DNA, 25 bp, Mus musculus
tctgcttaccctggacagctagagt

SEQ ID NO: 788226 - DNA, 25 bp, Mus musculus
tctgcttatccactttcgatgggaa

SEQ ID NO: 788227 - DNA, 25 bp, Mus musculus
tctgcttatccagtttcgatgggaa

SEQ ID NO: 788228 - DNA, 25 bp, Mus musculus
tctgcttatcttcgtagccaatgca

SEQ ID NO: 788229 - DNA, 25 bp, Mus musculus
tctgcttatcttggtagccaatgca

SEQ ID NO: 788230 - DNA, 25 bp, Mus musculus
tctgcttcaagcacattaggaacgg

SEQ ID NO: 788231 - DNA, 25 bp, Mus musculus
tctgcttcaagctcattaggaacgg

SEQ ID NO: 788232 - DNA, 25 bp, Mus musculus
tctgcttcaagtccttgacaacgca

SEQ ID NO: 788233 - DNA, 25 bp, Mus musculus
tctgcttcaagtgcttgacaacgca

SEQ ID NO: 788234 - DNA, 25 bp, Mus musculus
tctgcttcaatcatcttacgaggag

SEQ ID NO: 788235 - DNA, 25 bp, Mus musculus
tctgcttcaatcttcttacgaggag

SEQ ID NO: 788236 - DNA, 25 bp, Mus musculus
tctgcttcaggaaggccctataggg

SEQ ID NO: 788237 - DNA, 25 bp, Mus musculus
tctgcttcaggacaaacggaagcca

SEQ ID NO: 788238 - DNA, 25 bp, Mus musculus
tctgcttcaggagaaacggaagcca

SEQ ID NO: 788239 - DNA, 25 bp, Mus musculus
tctgcttcaggatggccctataggg

SEQ ID NO: 788240 - DNA, 25 bp, Mus musculus
tctgcttcagtgacttcgaggtgcg

SEQ ID NO: 788241 - DNA, 25 bp, Mus musculus
tctgcttcagtgtcttcgaggtgcg

SEQ ID NO: 788242 - DNA, 25 bp, Mus musculus
tctgcttcgaacaccgagttaacgt

SEQ ID NO: 788243 - DNA, 25 bp, Mus musculus
tctgcttcgaacctccatcatgagt

SEQ ID NO: 788244 - DNA, 25 bp, Mus musculus
tctgcttcgaacgtccatcatgagt

SEQ ID NO: 788245 - DNA, 25 bp, Mus musculus
tctgcttcgaactccgagttaacgt

SEQ ID NO: 788246 - DNA, 25 bp, Mus musculus
tctgcttcggcgcacgcgaggcttt

SEQ ID NO: 788247 - DNA, 25 bp, Mus musculus
tctgcttcggcggacgcgaggcttt

SEQ ID NO: 788248 - DNA, 25 bp, Mus musculus
tctgcttctgaacagctcacggaga

SEQ ID NO: 788249 - DNA, 25 bp, Mus musculus
tctgcttctgaagagctcacggaga

SEQ ID NO: 788250 - DNA, 25 bp, Mus musculus
tctgcttgagttaacttggtgaggc

SEQ ID NO: 788251 - DNA, 25 bp, Mus musculus
tctgcttgagtttacttggtgaggc

SEQ ID NO: 788252 - DNA, 25 bp, Mus musculus
tctgcttgatgtcttctgtgtaccg

SEQ ID NO: 788253 - DNA, 25 bp, Mus musculus
tctgcttgatgtgttctgtgtaccg

SEQ ID NO: 788254 - DNA, 25 bp, Mus musculus
tctgcttgattgagggaaccatcga

SEQ ID NO: 788255 - DNA, 25 bp, Mus musculus
tctgcttgattgtgggaaccatcga

SEQ ID NO: 788256 - DNA, 25 bp, Mus musculus
tctgcttgccccaaacaaatggtgt

SEQ ID NO: 788257 - DNA, 25 bp, Mus musculus
tctgcttgcccctaacaaatggtgt

SEQ ID NO: 788258 - DNA, 25 bp, Mus musculus
tctgcttgcttacagatggctccca

SEQ ID NO: 788259 - DNA, 25 bp, Mus musculus
tctgcttgcttagagatggctccca

SEQ ID NO: 788260 - DNA, 25 bp, Mus musculus
tctgcttggaggatggaccaaagag

SEQ ID NO: 788261 - DNA, 25 bp, Mus musculus
tctgcttggaggttggaccaaagag

SEQ ID NO: 788262 - DNA, 25 bp, Mus musculus
tctgcttggctccagccttgctggg

SEQ ID NO: 788263 - DNA, 25 bp, Mus musculus
tctgcttggctcctaccaaggcctt

SEQ ID NO: 788264 - DNA, 25 bp, Mus musculus
tctgcttggctcgagccttgctggg

SEQ ID NO: 788265 - DNA, 25 bp, Mus musculus
tctgcttggctcgtaccaaggcctt

SEQ ID NO: 788266 - DNA, 25 bp, Mus musculus
tctgcttgggaaaggctttaccatc

SEQ ID NO: 788267 - DNA, 25 bp, Mus musculus
tctgcttgggaatggctttaccatc

SEQ ID NO: 788268 - DNA, 25 bp, Mus musculus
tctgcttgggagcatgcccttcagt

SEQ ID NO: 788269 - DNA, 25 bp, Mus musculus
tctgcttgggaggatgcccttcagt

SEQ ID NO: 788270 - DNA, 25 bp, Mus musculus
tctgcttggttgcagctcacaactt

SEQ ID NO: 788271 - DNA, 25 bp, Mus musculus
tctgcttggttggagctcacaactt

SEQ ID NO: 788272 - DNA, 25 bp, Mus musculus
tctgcttgtccaagtcacttcactt

SEQ ID NO: 788273 - DNA, 25 bp, Mus musculus
tctgcttgtccatgtcacttcactt

SEQ ID NO: 788274 - DNA, 25 bp, Mus musculus
tctgcttgtggcacacggagccgaa

SEQ ID NO: 788275 - DNA, 25 bp, Mus musculus
tctgcttgtggctcacggagccgaa

SEQ ID NO: 788276 - DNA, 25 bp, Mus musculus
tctgctttgaaacgtctggtgacat

SEQ ID NO: 788277 - DNA, 25 bp, Mus musculus
tctgctttgaaaggtctggtgacat

SEQ ID NO: 788278 - DNA, 25 bp, Mus musculus
tctgctttgacacttgactgacggg

SEQ ID NO: 788279 - DNA, 25 bp, Mus musculus
tctgctttgacagttgactgacggg

SEQ ID NO: 788280 - DNA, 25 bp, Mus musculus
tctgctttgaggagcatatccgggc

SEQ ID NO: 788281 - DNA, 25 bp, Mus musculus
tctgctttgaggtgcatatccgggc

SEQ ID NO: 788282 - DNA, 25 bp, Mus musculus
tctgctttgcagagctaaagctcgg

SEQ ID NO: 788283 - DNA, 25 bp, Mus musculus
tctgctttgcagtgctaaagctcgg

SEQ ID NO: 788284 - DNA, 25 bp, Mus musculus
tctgctttgcatacacatcacgtca

SEQ ID NO: 788285 - DNA, 25 bp, Mus musculus
tctgctttgcattcacatcacgtca

SEQ ID NO: 788286 - DNA, 25 bp, Mus musculus
tctgctttgccgacccagaggatca

SEQ ID NO: 788287 - DNA, 25 bp, Mus musculus
tctgctttgccgatatccatcggag

SEQ ID NO: 788288 - DNA, 25 bp, Mus musculus
tctgctttgccgtcccagaggatca

SEQ ID NO: 788289 - DNA, 25 bp, Mus musculus
tctgctttgccgttatccatcggag

SEQ ID NO: 788290 - DNA, 25 bp, Mus musculus
tctgctttgcctagaaaccgttgct

SEQ ID NO: 788291 - DNA, 25 bp, Mus musculus
tctgctttgccttgaaaccgttgct

SEQ ID NO: 788292 - DNA, 25 bp, Mus musculus
tctgctttggatagaatgctgcagg

SEQ ID NO: 788293 - DNA, 25 bp, Mus musculus
tctgctttggattgaatgctgcagg

SEQ ID NO: 788294 - DNA, 25 bp, Mus musculus
tctgcttttactattcctgggatca

SEQ ID NO: 788295 - DNA, 25 bp, Mus musculus
tctgcttttacttttcctgggatca

SEQ ID NO: 788296 - DNA, 25 bp, Mus musculus
tctgcttttgctctctcctccaaaa

SEQ ID NO: 788297 - DNA, 25 bp, Mus musculus
tctgcttttgctgtctcctccaaaa

SEQ ID NO: 788298 - DNA, 25 bp, Mus musculus
tctgcttttggacagtgccgaattt

SEQ ID NO: 788299 - DNA, 25 bp, Mus musculus
tctgcttttggagagtgccgaattt

SEQ ID NO: 788300 - DNA, 25 bp, Mus musculus
tctgcttttgttccagggaggcgcc

SEQ ID NO: 788301 - DNA, 25 bp, Mus musculus
tctgcttttgttgcagggaggcgcc

SEQ ID NO: 788302 - DNA, 25 bp, Mus musculus
tctgctttttatactggttccatga

SEQ ID NO: 788303 - DNA, 25 bp, Mus musculus
tctgctttttattctggttccatga

SEQ ID NO: 788304 - DNA, 25 bp, Mus musculus
tctgctttttcaaggtgccccatga

SEQ ID NO: 788305 - DNA, 25 bp, Mus musculus
tctgctttttcatggtgccccatga

SEQ ID NO: 788306 - DNA, 25 bp, Mus musculus
tctggaaaacatctccccaactcta

SEQ ID NO: 788307 - DNA, 25 bp, Mus musculus
tctggaaaacatgtccccaactcta

SEQ ID NO: 788308 - DNA, 25 bp, Mus musculus
tctggaaaaggccacacaaatcagg

SEQ ID NO: 788309 - DNA, 25 bp, Mus musculus
tctggaaaaggcgacacaaatcagg

SEQ ID NO: 788310 - DNA, 25 bp, Mus musculus
tctggaaacctgaggttggagttcc

SEQ ID NO: 788311 - DNA, 25 bp, Mus musculus
tctggaaacctgtggttggagttcc

SEQ ID NO: 788312 - DNA, 25 bp, Mus musculus
tctggaaacttgatcgacctctaca

SEQ ID NO: 788313 - DNA, 25 bp, Mus musculus
tctggaaacttgttcgacctctaca

SEQ ID NO: 788314 - DNA, 25 bp, Mus musculus
tctggaaagcaacagtaccattgga

SEQ ID NO: 788315 - DNA, 25 bp, Mus musculus
tctggaaagcaagagtaccattgga

SEQ ID NO: 788316 - DNA, 25 bp, Mus musculus
tctggaaagccgacagaagctgagc

SEQ ID NO: 788317 - DNA, 25 bp, Mus musculus
tctggaaagccgtcagaagctgagc

SEQ ID NO: 788318 - DNA, 25 bp, Mus musculus
tctggaaaggcaccacctggaattt

SEQ ID NO: 788319 - DNA, 25 bp, Mus musculus
tctggaaaggcagcacctggaattt

SEQ ID NO: 788320 - DNA, 25 bp, Mus musculus
tctggaaaggccactgcagctaggc

SEQ ID NO: 788321 - DNA, 25 bp, Mus musculus
tctggaaaggcctctgcagctaggc

SEQ ID NO: 788322 - DNA, 25 bp, Mus musculus
tctggaaaggctacgagagcccatc

SEQ ID NO: 788323 - DNA, 25 bp, Mus musculus
tctggaaaggcttcgagagcccatc

SEQ ID NO: 788324 - DNA, 25 bp, Mus musculus
tctggaaaggtcatccccactagcc

SEQ ID NO: 788325 - DNA, 25 bp, Mus musculus
tctggaaaggtcttccccactagcc

SEQ ID NO: 788326 - DNA, 25 bp, Mus musculus
tctggaaagtataatcctctgaggg

SEQ ID NO: 788327 - DNA, 25 bp, Mus musculus
tctggaaagtattatcctctgaggg

SEQ ID NO: 788328 - DNA, 25 bp, Mus musculus
tctggaaagtttatgcccatcatgc

SEQ ID NO: 788329 - DNA, 25 bp, Mus musculus
tctggaaagtttttgcccatcatgc

SEQ ID NO: 788330 - DNA, 25 bp, Mus musculus
tctggaaataaaccagggcaagtct

SEQ ID NO: 788331 - DNA, 25 bp, Mus musculus
tctggaaataaagcagggcaagtct

SEQ ID NO: 788332 - DNA, 25 bp, Mus musculus
tctggaaataggatgtctgggcaca

SEQ ID NO: 788333 - DNA, 25 bp, Mus musculus
tctggaaataggttgtctgggcaca

SEQ ID NO: 788334 - DNA, 25 bp, Mus musculus
tctggaaatgcaccgtagagcacca

SEQ ID NO: 788335 - DNA, 25 bp, Mus musculus
tctggaaatgcagcgtagagcacca

SEQ ID NO: 788336 - DNA, 25 bp, Mus musculus
tctggaacaacgacctgaccatctc

SEQ ID NO: 788337 - DNA, 25 bp, Mus musculus
tctggaacaacgtcctgaccatctc

SEQ ID NO: 788338 - DNA, 25 bp, Mus musculus
tctggaacaattcctcatggataca

SEQ ID NO: 788339 - DNA, 25 bp, Mus musculus
tctggaacaattgctcatggataca

SEQ ID NO: 788340 - DNA, 25 bp, Mus musculus
tctggaacacgtagagatgcatggc

SEQ ID NO: 788341 - DNA, 25 bp, Mus musculus
tctggaacacgttgagatgcatggc

SEQ ID NO: 788342 - DNA, 25 bp, Mus musculus
tctggaacagagattgagtacggta

SEQ ID NO: 788343 - DNA, 25 bp, Mus musculus
tctggaacagagtttgagtacggta

SEQ ID NO: 788344 - DNA, 25 bp, Mus musculus
tctggaacagcaacacgctcacagg

SEQ ID NO: 788345 - DNA, 25 bp, Mus musculus
tctggaacagcaagacatgtggtgg

SEQ ID NO: 788346 - DNA, 25 bp, Mus musculus
tctggaacagcatcacgctcacagg

SEQ ID NO: 788347 - DNA, 25 bp, Mus musculus
tctggaacagcatgacatgtggtgg

SEQ ID NO: 788348 - DNA, 25 bp, Mus musculus
tctggaaccccgacttgtaaaggtg

SEQ ID NO: 788349 - DNA, 25 bp, Mus musculus
tctggaaccccgtcttgtaaaggtg

SEQ ID NO: 788350 - DNA, 25 bp, Mus musculus
tctggaaccgcactgaactgctggc

SEQ ID NO: 788351 - DNA, 25 bp, Mus musculus
tctggaaccgcagtgaactgctggc

SEQ ID NO: 788352 - DNA, 25 bp, Mus musculus
tctggaaccgctccagcaagagctt

SEQ ID NO: 788353 - DNA, 25 bp, Mus musculus
tctggaaccgctccccaaaaactgg

SEQ ID NO: 788354 - DNA, 25 bp, Mus musculus
tctggaaccgctgcagcaagagctt

SEQ ID NO: 788355 - DNA, 25 bp, Mus musculus
tctggaaccgctgcccaaaaactgg

SEQ ID NO: 788356 - DNA, 25 bp, Mus musculus
tctggaacctcccaactatggcatc

SEQ ID NO: 788357 - DNA, 25 bp, Mus musculus
tctggaacctccgaactatggcatc

SEQ ID NO: 788358 - DNA, 25 bp, Mus musculus
tctggaacctgaagttgatgcgttg

SEQ ID NO: 788359 - DNA, 25 bp, Mus musculus
tctggaacctgatgttgatgcgttg

SEQ ID NO: 788360 - DNA, 25 bp, Mus musculus
tctggaacgacactatcacctgcgg

SEQ ID NO: 788361 - DNA, 25 bp, Mus musculus
tctggaacgacagtatcacctgcgg

SEQ ID NO: 788362 - DNA, 25 bp, Mus musculus
tctggaacgacgaccagagccttgg

SEQ ID NO: 788363 - DNA, 25 bp, Mus musculus
tctggaacgacgtccagagccttgg

SEQ ID NO: 788364 - DNA, 25 bp, Mus musculus
tctggaacgaggaaagcaggcagca

SEQ ID NO: 788365 - DNA, 25 bp, Mus musculus
tctggaacgaggtaagcaggcagca

SEQ ID NO: 788366 - DNA, 25 bp, Mus musculus
tctggaacggtgacctcatagacag

SEQ ID NO: 788367 - DNA, 25 bp, Mus musculus
tctggaacggtgtcctcatagacag

SEQ ID NO: 788368 - DNA, 25 bp, Mus musculus
tctggaacgttaagggtaatgagcc

SEQ ID NO: 788369 - DNA, 25 bp, Mus musculus
tctggaacgttatgggtaatgagcc

SEQ ID NO: 788370 - DNA, 25 bp, Mus musculus
tctggaactcgactagaccttgaag

SEQ ID NO: 788371 - DNA, 25 bp, Mus musculus
tctggaactcgagtagaccttgaag

SEQ ID NO: 788372 - DNA, 25 bp, Mus musculus
tctggaagaaagacggtatccaggg

SEQ ID NO: 788373 - DNA, 25 bp, Mus musculus
tctggaagaaagtcggtatccaggg

SEQ ID NO: 788374 - DNA, 25 bp, Mus musculus
tctggaagaactcctgcacatcctg

SEQ ID NO: 788375 - DNA, 25 bp, Mus musculus
tctggaagaactgctgcacatcctg

SEQ ID NO: 788376 - DNA, 25 bp, Mus musculus
tctggaagaagcacggtgaatccag

SEQ ID NO: 788377 - DNA, 25 bp, Mus musculus
tctggaagaagcagccaaaactgag

SEQ ID NO: 788378 - DNA, 25 bp, Mus musculus
tctggaagaagcctgtggaacaaga

SEQ ID NO: 788379 - DNA, 25 bp, Mus musculus
tctggaagaagcgtgtggaacaaga

SEQ ID NO: 788380 - DNA, 25 bp, Mus musculus
tctggaagaagctcggtgaatccag

SEQ ID NO: 788381 - DNA, 25 bp, Mus musculus
tctggaagaagctgccaaaactgag

SEQ ID NO: 788382 - DNA, 25 bp, Mus musculus
tctggaagaccacgtagaaacactg

SEQ ID NO: 788383 - DNA, 25 bp, Mus musculus
tctggaagaccaggtagaaacactg

SEQ ID NO: 788384 - DNA, 25 bp, Mus musculus
tctggaagatttacgaaacaaccgg

SEQ ID NO: 788385 - DNA, 25 bp, Mus musculus
tctggaagattttcgaaacaaccgg

SEQ ID NO: 788386 - DNA, 25 bp, Mus musculus
tctggaagccgccattgaatgtgcc

SEQ ID NO: 788387 - DNA, 25 bp, Mus musculus
tctggaagccgcgattgaatgtgcc

SEQ ID NO: 788388 - DNA, 25 bp, Mus musculus
tctggaagccttctcgcgacgtgga

SEQ ID NO: 788389 - DNA, 25 bp, Mus musculus
tctggaagccttgtcgcgacgtgga

SEQ ID NO: 788390 - DNA, 25 bp, Mus musculus
tctggaagctcacaaagaagttttc

SEQ ID NO: 788391 - DNA, 25 bp, Mus musculus
tctggaagctcactccagttttggg

SEQ ID NO: 788392 - DNA, 25 bp, Mus musculus
tctggaagctcagaaagaagttttc

SEQ ID NO: 788393 - DNA, 25 bp, Mus musculus
tctggaagctcagtccagttttggg

SEQ ID NO: 788394 - DNA, 25 bp, Mus musculus
tctggaaggccaacagctcctctat

SEQ ID NO: 788395 - DNA, 25 bp, Mus musculus
tctggaaggccatcagctcctctat

SEQ ID NO: 788396 - DNA, 25 bp, Mus musculus
tctggaaggcccagtcactctgaca

SEQ ID NO: 788397 - DNA, 25 bp, Mus musculus
tctggaaggccctgtcactctgaca

SEQ ID NO: 788398 - DNA, 25 bp, Mus musculus
tctggaagggcactgaactaggcaa

SEQ ID NO: 788399 - DNA, 25 bp, Mus musculus
tctggaagggcagtgaactaggcaa

SEQ ID NO: 788400 - DNA, 25 bp, Mus musculus
tctggaagggccagtgcctctggaa

SEQ ID NO: 788401 - DNA, 25 bp, Mus musculus
tctggaagggcctgtgcctctggaa

SEQ ID NO: 788402 - DNA, 25 bp, Mus musculus
tctggaagggtgatcgatccacagg

SEQ ID NO: 788403 - DNA, 25 bp, Mus musculus
tctggaagggtgttcgatccacagg

SEQ ID NO: 788404 - DNA, 25 bp, Mus musculus
tctggaagtaaaccaagagacttag

SEQ ID NO: 788405 - DNA, 25 bp, Mus musculus
tctggaagtaaagcaagagacttag

SEQ ID NO: 788406 - DNA, 25 bp, Mus musculus
tctggaagtccgaggccacccgagt

SEQ ID NO: 788407 - DNA, 25 bp, Mus musculus
tctggaagtccgtggccacccgagt

SEQ ID NO: 788408 - DNA, 25 bp, Mus musculus
tctggaagtcttacccgctggtgca

SEQ ID NO: 788409 - DNA, 25 bp, Mus musculus
tctggaagtctttcccgctggtgca

SEQ ID NO: 788410 - DNA, 25 bp, Mus musculus
tctggaagtgacacaaggaagaact

SEQ ID NO: 788411 - DNA, 25 bp, Mus musculus
tctggaagtgactcaaggaagaact

SEQ ID NO: 788412 - DNA, 25 bp, Mus musculus
tctggaagtggccacgtacaccttc

SEQ ID NO: 788413 - DNA, 25 bp, Mus musculus
tctggaagtggcgacgtacaccttc

SEQ ID NO: 788414 - DNA, 25 bp, Mus musculus
tctggaataaaaccagaagcatggt

SEQ ID NO: 788415 - DNA, 25 bp, Mus musculus
tctggaataaaagcagaagcatggt

SEQ ID NO: 788416 - DNA, 25 bp, Mus musculus
tctggaatacccagaaactcggaat

SEQ ID NO: 788417 - DNA, 25 bp, Mus musculus
tctggaataccctgaaactcggaat

SEQ ID NO: 788418 - DNA, 25 bp, Mus musculus
tctggaatacttatccttcggtgcc

SEQ ID NO: 788419 - DNA, 25 bp, Mus musculus
tctggaatacttttccttcggtgcc

SEQ ID NO: 788420 - DNA, 25 bp, Mus musculus
tctggaatatgcagccacagtgctt

SEQ ID NO: 788421 - DNA, 25 bp, Mus musculus
tctggaatatgctgccacagtgctt

SEQ ID NO: 788422 - DNA, 25 bp, Mus musculus
tctggaatcccaacttgaagcaaat

SEQ ID NO: 788423 - DNA, 25 bp, Mus musculus
tctggaatcccatcttgaagcaaat

SEQ ID NO: 788424 - DNA, 25 bp, Mus musculus
tctggaatgagcagtccgaagccca

SEQ ID NO: 788425 - DNA, 25 bp, Mus musculus
tctggaatgagctgtccgaagccca

SEQ ID NO: 788426 - DNA, 25 bp, Mus musculus
tctggaatgatcagcacctccttgg

SEQ ID NO: 788427 - DNA, 25 bp, Mus musculus
tctggaatgatctgcacctccttgg

SEQ ID NO: 788428 - DNA, 25 bp, Mus musculus
tctggaatgctaccaagtttgccct

SEQ ID NO: 788429 - DNA, 25 bp, Mus musculus
tctggaatgctagcaagtttgccct

SEQ ID NO: 788430 - DNA, 25 bp, Mus musculus
tctggaatggaaaacaggtggcgat

SEQ ID NO: 788431 - DNA, 25 bp, Mus musculus
tctggaatggaatacaggtggcgat

SEQ ID NO: 788432 - DNA, 25 bp, Mus musculus
tctggaatggttccttccctagacc

SEQ ID NO: 788433 - DNA, 25 bp, Mus musculus
tctggaatggttgcttccctagacc

SEQ ID NO: 788434 - DNA, 25 bp, Mus musculus
tctggaatgtgcagctgtcagacca

SEQ ID NO: 788435 - DNA, 25 bp, Mus musculus
tctggaatgtgctgctgtcagacca

SEQ ID NO: 788436 - DNA, 25 bp, Mus musculus
tctggaatgtgtctaccctgctggt

SEQ ID NO: 788437 - DNA, 25 bp, Mus musculus
tctggaatgtgtgtaccctgctggt

SEQ ID NO: 788438 - DNA, 25 bp, Mus musculus
tctggaattctgactattgtcacag

SEQ ID NO: 788439 - DNA, 25 bp, Mus musculus
tctggaattctgtctattgtcacag

SEQ ID NO: 788440 - DNA, 25 bp, Mus musculus
tctggacaagaacggtgtggacctc

SEQ ID NO: 788441 - DNA, 25 bp, Mus musculus
tctggacaagaagggtgtggacctc

SEQ ID NO: 788442 - DNA, 25 bp, Mus musculus
tctggacaagtacaacgctgagaag

SEQ ID NO: 788443 - DNA, 25 bp, Mus musculus
tctggacaagtagaacgctgagaag

SEQ ID NO: 788444 - DNA, 25 bp, Mus musculus
tctggacaccaccacttcacagaag

SEQ ID NO: 788445 - DNA, 25 bp, Mus musculus
tctggacaccacgacttcacagaag

SEQ ID NO: 788446 - DNA, 25 bp, Mus musculus
tctggacactatcgatgtcagcaac

SEQ ID NO: 788447 - DNA, 25 bp, Mus musculus
tctggacactatggatgtcagcaac

SEQ ID NO: 788448 - DNA, 25 bp, Mus musculus
tctggacaggcaaggcaagaatcct

SEQ ID NO: 788449 - DNA, 25 bp, Mus musculus
tctggacaggcatggcaagaatcct

SEQ ID NO: 788450 - DNA, 25 bp, Mus musculus
tctggacagtgcagcgatccagttc

SEQ ID NO: 788451 - DNA, 25 bp, Mus musculus
tctggacagtgcatgctgacagcgc

SEQ ID NO: 788452 - DNA, 25 bp, Mus musculus
tctggacagtgctgcgatccagttc

SEQ ID NO: 788453 - DNA, 25 bp, Mus musculus
tctggacagtgcttgctgacagcgc

SEQ ID NO: 788454 - DNA, 25 bp, Mus musculus
tctggacatcctcttgtgcaatggt

SEQ ID NO: 788455 - DNA, 25 bp, Mus musculus
tctggacatcctgttgtgcaatggt

SEQ ID NO: 788456 - DNA, 25 bp, Mus musculus
tctggacatttgaagtaggtggctc

SEQ ID NO: 788457 - DNA, 25 bp, Mus musculus
tctggacatttgtagtaggtggctc

SEQ ID NO: 788458 - DNA, 25 bp, Mus musculus
tctggaccagcacgtggattggaac

SEQ ID NO: 788459 - DNA, 25 bp, Mus musculus
tctggaccagcaggtggattggaac

SEQ ID NO: 788460 - DNA, 25 bp, Mus musculus
tctggaccgagcaagttaagagtcg

SEQ ID NO: 788461 - DNA, 25 bp, Mus musculus
tctggaccgagcagagcaagctgaa

SEQ ID NO: 788462 - DNA, 25 bp, Mus musculus
tctggaccgagctagttaagagtcg

SEQ ID NO: 788463 - DNA, 25 bp, Mus musculus
tctggaccgagctgagcaagctgaa

SEQ ID NO: 788464 - DNA, 25 bp, Mus musculus
tctggaccgcgcaggacttggcttt

SEQ ID NO: 788465 - DNA, 25 bp, Mus musculus
tctggaccgcgctggacttggcttt

SEQ ID NO: 788466 - DNA, 25 bp, Mus musculus
tctggacctctgcatagacagttaa

SEQ ID NO: 788467 - DNA, 25 bp, Mus musculus
tctggacctctggatagacagttaa

SEQ ID NO: 788468 - DNA, 25 bp, Mus musculus
tctggacctgggaaggacccgcagt

SEQ ID NO: 788469 - DNA, 25 bp, Mus musculus
tctggacctgggtaggacccgcagt

SEQ ID NO: 788470 - DNA, 25 bp, Mus musculus
tctggacctggtacctgcttggctc

SEQ ID NO: 788471 - DNA, 25 bp, Mus musculus
tctggacctggttcctgcttggctc

SEQ ID NO: 788472 - DNA, 25 bp, Mus musculus
tctggacgaccaacaccatcttcat

SEQ ID NO: 788473 - DNA, 25 bp, Mus musculus
tctggacgaccatcaccatcttcat

SEQ ID NO: 788474 - DNA, 25 bp, Mus musculus
tctggacgagcactatgatctagcc

SEQ ID NO: 788475 - DNA, 25 bp, Mus musculus
tctggacgagcagtatgatctagcc

SEQ ID NO: 788476 - DNA, 25 bp, Mus musculus
tctggacgaggaccattctaaggga

SEQ ID NO: 788477 - DNA, 25 bp, Mus musculus
tctggacgaggagcattctaaggga

SEQ ID NO: 788478 - DNA, 25 bp, Mus musculus
tctggacgagttcctgctcaacaag

SEQ ID NO: 788479 - DNA, 25 bp, Mus musculus
tctggacgagttgctgctcaacaag

SEQ ID NO: 788480 - DNA, 25 bp, Mus musculus
tctggacgcgtcagccgctgtatgg

SEQ ID NO: 788481 - DNA, 25 bp, Mus musculus
tctggacgcgtctgccgctgtatgg

SEQ ID NO: 788482 - DNA, 25 bp, Mus musculus
tctggacgctgaagccaccggtcgg

SEQ ID NO: 788483 - DNA, 25 bp, Mus musculus
tctggacgctgatgccaccggtcgg

SEQ ID NO: 788484 - DNA, 25 bp, Mus musculus
tctggacgctgcactggtcttatca

SEQ ID NO: 788485 - DNA, 25 bp, Mus musculus
tctggacgctgctctggtcttatca

SEQ ID NO: 788486 - DNA, 25 bp, Mus musculus
tctggacgtggcaaagacaaggatc

SEQ ID NO: 788487 - DNA, 25 bp, Mus musculus
tctggacgtggctaagacaaggatc

SEQ ID NO: 788488 - DNA, 25 bp, Mus musculus
tctggacgtttacccacgtagtgcg

SEQ ID NO: 788489 - DNA, 25 bp, Mus musculus
tctggacgtttagccacgtagtgcg

SEQ ID NO: 788490 - DNA, 25 bp, Mus musculus
tctggactaaatcaaaattccttgg

SEQ ID NO: 788491 - DNA, 25 bp, Mus musculus
tctggactaaatgaaaattccttgg

SEQ ID NO: 788492 - DNA, 25 bp, Mus musculus
tctggactatgaattccaggccaac

SEQ ID NO: 788493 - DNA, 25 bp, Mus musculus
tctggactatgatttccaggccaac

SEQ ID NO: 788494 - DNA, 25 bp, Mus musculus
tctggactcagacatacgaagaagc

SEQ ID NO: 788495 - DNA, 25 bp, Mus musculus
tctggactcagagatacgaagaagc

SEQ ID NO: 788496 - DNA, 25 bp, Mus musculus
tctggactcggacgagtcttacccc

SEQ ID NO: 788497 - DNA, 25 bp, Mus musculus
tctggactcggaggagtcttacccc

SEQ ID NO: 788498 - DNA, 25 bp, Mus musculus
tctggactgaatctcactgacttgg

SEQ ID NO: 788499 - DNA, 25 bp, Mus musculus
tctggactgaatgtcactgacttgg

SEQ ID NO: 788500 - DNA, 25 bp, Mus musculus
tctggactgagcatcaggaggagca

SEQ ID NO: 788501 - DNA, 25 bp, Mus musculus
tctggactgagcttcaggaggagca

SEQ ID NO: 788502 - DNA, 25 bp, Mus musculus
tctggacttctaccctcctggtgtg

SEQ ID NO: 788503 - DNA, 25 bp, Mus musculus
tctggacttctagcctcctggtgtg

SEQ ID NO: 788504 - DNA, 25 bp, Mus musculus
tctggacttggcctcattgtaatct

SEQ ID NO: 788505 - DNA, 25 bp, Mus musculus
tctggacttggcgtcattgtaatct

SEQ ID NO: 788506 - DNA, 25 bp, Mus musculus
tctggactttttctgccatctaaag

SEQ ID NO: 788507 - DNA, 25 bp, Mus musculus
tctggactttttgtgccatctaaag

SEQ ID NO: 788508 - DNA, 25 bp, Mus musculus
tctggagaacagatgttgactatca

SEQ ID NO: 788509 - DNA, 25 bp, Mus musculus
tctggagaacagttgttgactatca

SEQ ID NO: 788510 - DNA, 25 bp, Mus musculus
tctggagaacctcccaggcggagca

SEQ ID NO: 788511 - DNA, 25 bp, Mus musculus
tctggagaacctgccaggcggagca

SEQ ID NO: 788512 - DNA, 25 bp, Mus musculus
tctggagaagaaccaacactgtcct

SEQ ID NO: 788513 - DNA, 25 bp, Mus musculus
tctggagaagaagcaacactgtcct

SEQ ID NO: 788514 - DNA, 25 bp, Mus musculus
tctggagacaaactagagatagacc

SEQ ID NO: 788515 - DNA, 25 bp, Mus musculus
tctggagacaaagtagagatagacc

SEQ ID NO: 788516 - DNA, 25 bp, Mus musculus
tctggagaccttccggcattcatcc

SEQ ID NO: 788517 - DNA, 25 bp, Mus musculus
tctggagaccttgcggcattcatcc

SEQ ID NO: 788518 - DNA, 25 bp, Mus musculus
tctggagacgtgaaggccacggtcg

SEQ ID NO: 788519 - DNA, 25 bp, Mus musculus
tctggagacgtgtaggccacggtcg

SEQ ID NO: 788520 - DNA, 25 bp, Mus musculus
tctggagactaacccaccaacagga

SEQ ID NO: 788521 - DNA, 25 bp, Mus musculus
tctggagactaagccaccaacagga

SEQ ID NO: 788522 - DNA, 25 bp, Mus musculus
tctggagactagcttattgagatta

SEQ ID NO: 788523 - DNA, 25 bp, Mus musculus
tctggagactaggttattgagatta

SEQ ID NO: 788524 - DNA, 25 bp, Mus musculus
tctggagagagaactctgtctgtgg

SEQ ID NO: 788525 - DNA, 25 bp, Mus musculus
tctggagagagatctctgtctgtgg

SEQ ID NO: 788526 - DNA, 25 bp, Mus musculus
tctggagagctgagtgcaagtttgc

SEQ ID NO: 788527 - DNA, 25 bp, Mus musculus
tctggagagctgtgtgcaagtttgc

SEQ ID NO: 788528 - DNA, 25 bp, Mus musculus
tctggagagggtagtgtgatcacac

SEQ ID NO: 788529 - DNA, 25 bp, Mus musculus
tctggagagggttgtgtgatcacac

SEQ ID NO: 788530 - DNA, 25 bp, Mus musculus
tctggagatatgcttatgacgggca

SEQ ID NO: 788531 - DNA, 25 bp, Mus musculus
tctggagatatggttatgacgggca

SEQ ID NO: 788532 - DNA, 25 bp, Mus musculus
tctggagatccgagccatggacgag

SEQ ID NO: 788533 - DNA, 25 bp, Mus musculus
tctggagatccgtgccatggacgag

SEQ ID NO: 788534 - DNA, 25 bp, Mus musculus
tctggagatgaaaagggcttaagga

SEQ ID NO: 788535 - DNA, 25 bp, Mus musculus
tctggagatgaatagggcttaagga

SEQ ID NO: 788536 - DNA, 25 bp, Mus musculus
tctggagatgatcagtatcaaggag

SEQ ID NO: 788537 - DNA, 25 bp, Mus musculus
tctggagatgatgagtatcaaggag

SEQ ID NO: 788538 - DNA, 25 bp, Mus musculus
tctggagatgccacggtggctgaaa

SEQ ID NO: 788539 - DNA, 25 bp, Mus musculus
tctggagatgcctcggtggctgaaa

SEQ ID NO: 788540 - DNA, 25 bp, Mus musculus
tctggagatgctcagatcaatgtgg

SEQ ID NO: 788541 - DNA, 25 bp, Mus musculus
tctggagatgctgagatcaatgtgg

SEQ ID NO: 788542 - DNA, 25 bp, Mus musculus
tctggagcaaccatgaagtccctgg

SEQ ID NO: 788543 - DNA, 25 bp, Mus musculus
tctggagcaaccttgaagtccctgg

SEQ ID NO: 788544 - DNA, 25 bp, Mus musculus
tctggagcaagaccacaacaatctg

SEQ ID NO: 788545 - DNA, 25 bp, Mus musculus
tctggagcaagagcacaacaatctg

SEQ ID NO: 788546 - DNA, 25 bp, Mus musculus
tctggagcaagcacagagagagttg

SEQ ID NO: 788547 - DNA, 25 bp, Mus musculus
tctggagcaagctcagagagagttg

SEQ ID NO: 788548 - DNA, 25 bp, Mus musculus
tctggagcactccaacctggacagg

SEQ ID NO: 788549 - DNA, 25 bp, Mus musculus
tctggagcactcgaacctggacagg

SEQ ID NO: 788550 - DNA, 25 bp, Mus musculus
tctggagcagttaggaacttcctcg

SEQ ID NO: 788551 - DNA, 25 bp, Mus musculus
tctggagcagtttggaacttcctcg

SEQ ID NO: 788552 - DNA, 25 bp, Mus musculus
tctggagccaaaaaggacccaaagg

SEQ ID NO: 788553 - DNA, 25 bp, Mus musculus
tctggagccaaataggacccaaagg

SEQ ID NO: 788554 - DNA, 25 bp, Mus musculus
tctggagccctcagcactggttgac

SEQ ID NO: 788555 - DNA, 25 bp, Mus musculus
tctggagccctctgcactggttgac

SEQ ID NO: 788556 - DNA, 25 bp, Mus musculus
tctggagcgcatagcacagagtgac

SEQ ID NO: 788557 - DNA, 25 bp, Mus musculus
tctggagcgcattgcacagagtgac

SEQ ID NO: 788558 - DNA, 25 bp, Mus musculus
tctggagcgcctcgagattttgtca

SEQ ID NO: 788559 - DNA, 25 bp, Mus musculus
tctggagcgcctggagattttgtca

SEQ ID NO: 788560 - DNA, 25 bp, Mus musculus
tctggagcgtttcaccttgctgaac

SEQ ID NO: 788561 - DNA, 25 bp, Mus musculus
tctggagcgtttgaccttgctgaac

SEQ ID NO: 788562 - DNA, 25 bp, Mus musculus
tctggagctgacatactgttctggg

SEQ ID NO: 788563 - DNA, 25 bp, Mus musculus
tctggagctgacttactgttctggg

SEQ ID NO: 788564 - DNA, 25 bp, Mus musculus
tctggagctgctatctctgctgtct

SEQ ID NO: 788565 - DNA, 25 bp, Mus musculus
tctggagctgctttctctgctgtct

SEQ ID NO: 788566 - DNA, 25 bp, Mus musculus
tctggaggaaaacacctgtccacgg

SEQ ID NO: 788567 - DNA, 25 bp, Mus musculus
tctggaggaaaagacctgtccacgg

SEQ ID NO: 788568 - DNA, 25 bp, Mus musculus
tctggaggaaacatcaattcgctat

SEQ ID NO: 788569 - DNA, 25 bp, Mus musculus
tctggaggaaacttcaattcgctat

SEQ ID NO: 788570 - DNA, 25 bp, Mus musculus
tctggaggaagacaacgaccacctg

SEQ ID NO: 788571 - DNA, 25 bp, Mus musculus
tctggaggaagagaacgaccacctg

SEQ ID NO: 788572 - DNA, 25 bp, Mus musculus
tctggaggaattcttaaatcaatct

SEQ ID NO: 788573 - DNA, 25 bp, Mus musculus
tctggaggaattgttaaatcaatct

SEQ ID NO: 788574 - DNA, 25 bp, Mus musculus
tctggaggacatccaacttctccct

SEQ ID NO: 788575 - DNA, 25 bp, Mus musculus
tctggaggacatgcaacttctccct

SEQ ID NO: 788576 - DNA, 25 bp, Mus musculus
tctggaggacctcttgatattggcc

SEQ ID NO: 788577 - DNA, 25 bp, Mus musculus
tctggaggacctgttgatattggcc

SEQ ID NO: 788578 - DNA, 25 bp, Mus musculus
tctggaggcccgcttgtgtgtaaaa

SEQ ID NO: 788579 - DNA, 25 bp, Mus musculus
tctggaggcccggttgtgtgtaaaa

SEQ ID NO: 788580 - DNA, 25 bp, Mus musculus
tctggaggcctgacatcgtcctcta

SEQ ID NO: 788581 - DNA, 25 bp, Mus musculus
tctggaggcctgtcatcgtcctcta

SEQ ID NO: 788582 - DNA, 25 bp, Mus musculus
tctggaggcgagagagcccagctat

SEQ ID NO: 788583 - DNA, 25 bp, Mus musculus
tctggaggcgagtgagcccagctat

SEQ ID NO: 788584 - DNA, 25 bp, Mus musculus
tctggaggcgccagaagccattgat

SEQ ID NO: 788585 - DNA, 25 bp, Mus musculus
tctggaggcgcctgaagccattgat

SEQ ID NO: 788586 - DNA, 25 bp, Mus musculus
tctggaggctaaacaccaatttctt

SEQ ID NO: 788587 - DNA, 25 bp, Mus musculus
tctggaggctaatcaccaatttctt

SEQ ID NO: 788588 - DNA, 25 bp, Mus musculus
tctggaggctacaggttggagatct

SEQ ID NO: 788589 - DNA, 25 bp, Mus musculus
tctggaggctactggttggagatct

SEQ ID NO: 788590 - DNA, 25 bp, Mus musculus
tctggaggctctaccggaaccaatg

SEQ ID NO: 788591 - DNA, 25 bp, Mus musculus
tctggaggctcttccggaaccaatg

SEQ ID NO: 788592 - DNA, 25 bp, Mus musculus
tctggaggcttaagagtgccctgct

SEQ ID NO: 788593 - DNA, 25 bp, Mus musculus
tctggaggcttatgagtgccctgct

SEQ ID NO: 788594 - DNA, 25 bp, Mus musculus
tctggagggaagacttctggccagt

SEQ ID NO: 788595 - DNA, 25 bp, Mus musculus
tctggagggaagtcttctggccagt

SEQ ID NO: 788596 - DNA, 25 bp, Mus musculus
tctggagggagacaatcggctttct

SEQ ID NO: 788597 - DNA, 25 bp, Mus musculus
tctggagggagagaatcggctttct

SEQ ID NO: 788598 - DNA, 25 bp, Mus musculus
tctggagggcagcatggcttcacat

SEQ ID NO: 788599 - DNA, 25 bp, Mus musculus
tctggagggcaggatggcttcacat

SEQ ID NO: 788600 - DNA, 25 bp, Mus musculus
tctggagggcatcttccgcaagctc

SEQ ID NO: 788601 - DNA, 25 bp, Mus musculus
tctggagggcatgttccgcaagctc

SEQ ID NO: 788602 - DNA, 25 bp, Mus musculus
tctggaggtaccagacaaacgccta

SEQ ID NO: 788603 - DNA, 25 bp, Mus musculus
tctggaggtacctgacaaacgccta

SEQ ID NO: 788604 - DNA, 25 bp, Mus musculus
tctggaggtgggagcccctttctac

SEQ ID NO: 788605 - DNA, 25 bp, Mus musculus
tctggaggtgggtgcccctttctac

SEQ ID NO: 788606 - DNA, 25 bp, Mus musculus
tctggaggttccaaggacaatctgt

SEQ ID NO: 788607 - DNA, 25 bp, Mus musculus
tctggaggttcctaggacaatctgt

SEQ ID NO: 788608 - DNA, 25 bp, Mus musculus
tctggagtacgaagagcactacatc

SEQ ID NO: 788609 - DNA, 25 bp, Mus musculus
tctggagtacgatgagcactacatc

SEQ ID NO: 788610 - DNA, 25 bp, Mus musculus
tctggagtagaacactctgacgtgc

SEQ ID NO: 788611 - DNA, 25 bp, Mus musculus
tctggagtagaagactctgacgtgc

SEQ ID NO: 788612 - DNA, 25 bp, Mus musculus
tctggagtccgcagaaatggctgtg

SEQ ID NO: 788613 - DNA, 25 bp, Mus musculus
tctggagtccgctgaaatggctgtg

SEQ ID NO: 788614 - DNA, 25 bp, Mus musculus
tctggagtcctcactgtacagtgcc

SEQ ID NO: 788615 - DNA, 25 bp, Mus musculus
tctggagtcctctctgtacagtgcc

SEQ ID NO: 788616 - DNA, 25 bp, Mus musculus
tctggagtgaggcataacaaaaggt

SEQ ID NO: 788617 - DNA, 25 bp, Mus musculus
tctggagtgagggataacaaaaggt

SEQ ID NO: 788618 - DNA, 25 bp, Mus musculus
tctggagtgcacaaataccgctcct

SEQ ID NO: 788619 - DNA, 25 bp, Mus musculus
tctggagtgcactaataccgctcct

SEQ ID NO: 788620 - DNA, 25 bp, Mus musculus
tctggagtgtctctgcggtacaaag

SEQ ID NO: 788621 - DNA, 25 bp, Mus musculus
tctggagtgtctgtgcggtacaaag

SEQ ID NO: 788622 - DNA, 25 bp, Mus musculus
tctggagttatcagatgcagaggac

SEQ ID NO: 788623 - DNA, 25 bp, Mus musculus
tctggagttatctgatgcagaggac

SEQ ID NO: 788624 - DNA, 25 bp, Mus musculus
tctggagttgaactccgagttacac

SEQ ID NO: 788625 - DNA, 25 bp, Mus musculus
tctggagttgaagtccgagttacac

SEQ ID NO: 788626 - DNA, 25 bp, Mus musculus
tctggagtttgacttagaagctctg

SEQ ID NO: 788627 - DNA, 25 bp, Mus musculus
tctggagtttgagttagaagctctg

SEQ ID NO: 788628 - DNA, 25 bp, Mus musculus
tctggataagtgaggccggccccat

SEQ ID NO: 788629 - DNA, 25 bp, Mus musculus
tctggataagtgtggccggccccat

SEQ ID NO: 788630 - DNA, 25 bp, Mus musculus
tctggatagaaacaatttgaaacgg

SEQ ID NO: 788631 - DNA, 25 bp, Mus musculus
tctggatagaaagaatttgaaacgg

SEQ ID NO: 788632 - DNA, 25 bp, Mus musculus
tctggatagacaagatcaaatctca

SEQ ID NO: 788633 - DNA, 25 bp, Mus musculus
tctggatagacatgatcaaatctca

SEQ ID NO: 788634 - DNA, 25 bp, Mus musculus
tctggatataaacctacctatacac

SEQ ID NO: 788635 - DNA, 25 bp, Mus musculus
tctggatataaagctacctatacac

SEQ ID NO: 788636 - DNA, 25 bp, Mus musculus
tctggatatccacaaaagagtcatc

SEQ ID NO: 788637 - DNA, 25 bp, Mus musculus
tctggatatccagaaaagagtcatc

SEQ ID NO: 788638 - DNA, 25 bp, Mus musculus
tctggatattatccatgcacttaaa

SEQ ID NO: 788639 - DNA, 25 bp, Mus musculus
tctggatattatgcatgcacttaaa

SEQ ID NO: 788640 - DNA, 25 bp, Mus musculus
tctggatattccaaaagttcaacat

SEQ ID NO: 788641 - DNA, 25 bp, Mus musculus
tctggatattcctaaagttcaacat

SEQ ID NO: 788642 - DNA, 25 bp, Mus musculus
tctggatcaagaccgactgtacaac

SEQ ID NO: 788643 - DNA, 25 bp, Mus musculus
tctggatcaagacggtcacctgaat

SEQ ID NO: 788644 - DNA, 25 bp, Mus musculus
tctggatcaagagcgactgtacaac

SEQ ID NO: 788645 - DNA, 25 bp, Mus musculus
tctggatcaagagggtcacctgaat

SEQ ID NO: 788646 - DNA, 25 bp, Mus musculus
tctggatcaatgcatagaactgcca

SEQ ID NO: 788647 - DNA, 25 bp, Mus musculus
tctggatcaatggatagaactgcca

SEQ ID NO: 788648 - DNA, 25 bp, Mus musculus
tctggatcagtcagctctccctgaa

SEQ ID NO: 788649 - DNA, 25 bp, Mus musculus
tctggatcagtctgctctccctgaa

SEQ ID NO: 788650 - DNA, 25 bp, Mus musculus
tctggatccaagaaaagttgtactg

SEQ ID NO: 788651 - DNA, 25 bp, Mus musculus
tctggatccaagtaaagttgtactg

SEQ ID NO: 788652 - DNA, 25 bp, Mus musculus
tctggatccaggaaaagtctgttca

SEQ ID NO: 788653 - DNA, 25 bp, Mus musculus
tctggatccaggtaaagtctgttca

SEQ ID NO: 788654 - DNA, 25 bp, Mus musculus
tctggatcctcacagcaatgatgtt

SEQ ID NO: 788655 - DNA, 25 bp, Mus musculus
tctggatcctcagagcaatgatgtt

SEQ ID NO: 788656 - DNA, 25 bp, Mus musculus
tctggatcctcgatgggctggccta

SEQ ID NO: 788657 - DNA, 25 bp, Mus musculus
tctggatcctcgttgggctggccta

SEQ ID NO: 788658 - DNA, 25 bp, Mus musculus
tctggatcgccacggcttcgtgtcc

SEQ ID NO: 788659 - DNA, 25 bp, Mus musculus
tctggatcgccagggcttcgtgtcc

SEQ ID NO: 788660 - DNA, 25 bp, Mus musculus
tctggatctgtgatgtagaatctgc

SEQ ID NO: 788661 - DNA, 25 bp, Mus musculus
tctggatctgtgttgtagaatctgc

SEQ ID NO: 788662 - DNA, 25 bp, Mus musculus
tctggatgcaacagggaacctggta

SEQ ID NO: 788663 - DNA, 25 bp, Mus musculus
tctggatgcaactgggaacctggta

SEQ ID NO: 788664 - DNA, 25 bp, Mus musculus
tctggatgcagactttgtggccttt

SEQ ID NO: 788665 - DNA, 25 bp, Mus musculus
tctggatgcagagtttgtggccttt

SEQ ID NO: 788666 - DNA, 25 bp, Mus musculus
tctggatgcagcctgtgaccctgcc

SEQ ID NO: 788667 - DNA, 25 bp, Mus musculus
tctggatgcagcgtgtgaccctgcc

SEQ ID NO: 788668 - DNA, 25 bp, Mus musculus
tctggatgcccgaatgcatgatggc

SEQ ID NO: 788669 - DNA, 25 bp, Mus musculus
tctggatgcccgcacaaagataggg

SEQ ID NO: 788670 - DNA, 25 bp, Mus musculus
tctggatgcccggacaaagataggg

SEQ ID NO: 788671 - DNA, 25 bp, Mus musculus
tctggatgcccgtatgcatgatggc

SEQ ID NO: 788672 - DNA, 25 bp, Mus musculus
tctggatgccttagtggcccacaaa

SEQ ID NO: 788673 - DNA, 25 bp, Mus musculus
tctggatgcctttgtggcccacaaa

SEQ ID NO: 788674 - DNA, 25 bp, Mus musculus
tctggatgcttaagctaagtatggc

SEQ ID NO: 788675 - DNA, 25 bp, Mus musculus
tctggatgcttatgctaagtatggc

SEQ ID NO: 788676 - DNA, 25 bp, Mus musculus
tctggatggaaaactttgcacaacg

SEQ ID NO: 788677 - DNA, 25 bp, Mus musculus
tctggatggaaatctttgcacaacg

SEQ ID NO: 788678 - DNA, 25 bp, Mus musculus
tctggatggcatctgtccgctgaca

SEQ ID NO: 788679 - DNA, 25 bp, Mus musculus
tctggatggcatgtgtccgctgaca

SEQ ID NO: 788680 - DNA, 25 bp, Mus musculus
tctggatggcttcttcagagtttgc

SEQ ID NO: 788681 - DNA, 25 bp, Mus musculus
tctggatggcttgttcagagtttgc

SEQ ID NO: 788682 - DNA, 25 bp, Mus musculus
tctggatggtggattaacacgaacc

SEQ ID NO: 788683 - DNA, 25 bp, Mus musculus
tctggatggtggtttaacacgaacc

SEQ ID NO: 788684 - DNA, 25 bp, Mus musculus
tctggatgtcatccaaatggctttc

SEQ ID NO: 788685 - DNA, 25 bp, Mus musculus
tctggatgtcatgcaaatggctttc

SEQ ID NO: 788686 - DNA, 25 bp, Mus musculus
tctggatgtcctacttaccacagca

SEQ ID NO: 788687 - DNA, 25 bp, Mus musculus
tctggatgtccttcttaccacagca

SEQ ID NO: 788688 - DNA, 25 bp, Mus musculus
tctggatgtcttacttcggaaacaa

SEQ ID NO: 788689 - DNA, 25 bp, Mus musculus
tctggatgtctttcttcggaaacaa

SEQ ID NO: 788690 - DNA, 25 bp, Mus musculus
tctggatgtggaaagtgaagctaag

SEQ ID NO: 788691 - DNA, 25 bp, Mus musculus
tctggatgtggactcaccccttcct

SEQ ID NO: 788692 - DNA, 25 bp, Mus musculus
tctggatgtggagtcaccccttcct

SEQ ID NO: 788693 - DNA, 25 bp, Mus musculus
tctggatgtggatagtgaagctaag

SEQ ID NO: 788694 - DNA, 25 bp, Mus musculus
tctggattacagagacccaaggtcc

SEQ ID NO: 788695 - DNA, 25 bp, Mus musculus
tctggattacagtgacccaaggtcc

SEQ ID NO: 788696 - DNA, 25 bp, Mus musculus
tctggattataacacagaaatcgtc

SEQ ID NO: 788697 - DNA, 25 bp, Mus musculus
tctggattataagacagaaatcgtc

SEQ ID NO: 788698 - DNA, 25 bp, Mus musculus
tctggattattaaaacacctgtgag

SEQ ID NO: 788699 - DNA, 25 bp, Mus musculus
tctggattattataacacctgtgag

SEQ ID NO: 788700 - DNA, 25 bp, Mus musculus
tctggattcactacagagcagagcc

SEQ ID NO: 788701 - DNA, 25 bp, Mus musculus
tctggattcacttcagagcagagcc

SEQ ID NO: 788702 - DNA, 25 bp, Mus musculus
tctggattccataatcaaactgaag

SEQ ID NO: 788703 - DNA, 25 bp, Mus musculus
tctggattccatcggcacttgcatc

SEQ ID NO: 788704 - DNA, 25 bp, Mus musculus
tctggattccatgggcacttgcatc

SEQ ID NO: 788705 - DNA, 25 bp, Mus musculus
tctggattccattatcaaactgaag

SEQ ID NO: 788706 - DNA, 25 bp, Mus musculus
tctggattctcaaagtcagaaggga

SEQ ID NO: 788707 - DNA, 25 bp, Mus musculus
tctggattctcatagtcagaaggga

SEQ ID NO: 788708 - DNA, 25 bp, Mus musculus
tctggattgatcctgatgacttccc

SEQ ID NO: 788709 - DNA, 25 bp, Mus musculus
tctggattgatcgtgatgacttccc

SEQ ID NO: 788710 - DNA, 25 bp, Mus musculus
tctggattggctaaagatgcttggg

SEQ ID NO: 788711 - DNA, 25 bp, Mus musculus
tctggattggcttaagatgcttggg

SEQ ID NO: 788712 - DNA, 25 bp, Mus musculus
tctggattgtaacagagacattctg

SEQ ID NO: 788713 - DNA, 25 bp, Mus musculus
tctggattgtaagagagacattctg

SEQ ID NO: 788714 - DNA, 25 bp, Mus musculus
tctggatttctcagcactgcaagcc

SEQ ID NO: 788715 - DNA, 25 bp, Mus musculus
tctggatttctctgcactgcaagcc

SEQ ID NO: 788716 - DNA, 25 bp, Mus musculus
tctggatttgctactaggacgttgg

SEQ ID NO: 788717 - DNA, 25 bp, Mus musculus
tctggatttgcttctaggacgttgg

SEQ ID NO: 788718 - DNA, 25 bp, Mus musculus
tctggatttggaatcgtactcccca

SEQ ID NO: 788719 - DNA, 25 bp, Mus musculus
tctggatttggattcgtactcccca

SEQ ID NO: 788720 - DNA, 25 bp, Mus musculus
tctggatttgggaatgagtgtgctt

SEQ ID NO: 788721 - DNA, 25 bp, Mus musculus
tctggatttgggtatgagtgtgctt

SEQ ID NO: 788722 - DNA, 25 bp, Mus musculus
tctggattttcactcttcgcctttc

SEQ ID NO: 788723 - DNA, 25 bp, Mus musculus
tctggattttcagtcttcgcctttc

SEQ ID NO: 788724 - DNA, 25 bp, Mus musculus
tctggattttggattcccacccttt

SEQ ID NO: 788725 - DNA, 25 bp, Mus musculus
tctggattttggtttcccacccttt

SEQ ID NO: 788726 - DNA, 25 bp, Mus musculus
tctggcaaacatagacgatgttgtg

SEQ ID NO: 788727 - DNA, 25 bp, Mus musculus
tctggcaaacattgacgatgttgtg

SEQ ID NO: 788728 - DNA, 25 bp, Mus musculus
tctggcaaactccacaggcagtaag

SEQ ID NO: 788729 - DNA, 25 bp, Mus musculus
tctggcaaactcgacaggcagtaag

SEQ ID NO: 788730 - DNA, 25 bp, Mus musculus
tctggcaaagagatttccctgggat

SEQ ID NO: 788731 - DNA, 25 bp, Mus musculus
tctggcaaagagttttccctgggat

SEQ ID NO: 788732 - DNA, 25 bp, Mus musculus
tctggcaacagcacaaaggcgaagt

SEQ ID NO: 788733 - DNA, 25 bp, Mus musculus
tctggcaacagctcaaaggcgaagt

SEQ ID NO: 788734 - DNA, 25 bp, Mus musculus
tctggcaagagcaaaatccgtccct

SEQ ID NO: 788735 - DNA, 25 bp, Mus musculus
tctggcaagagctaaatccgtccct

SEQ ID NO: 788736 - DNA, 25 bp, Mus musculus
tctggcaagatgcaaaggtccccgt

SEQ ID NO: 788737 - DNA, 25 bp, Mus musculus
tctggcaagatggaaaggtccccgt

SEQ ID NO: 788738 - DNA, 25 bp, Mus musculus
tctggcaagattctggctcttgtgg

SEQ ID NO: 788739 - DNA, 25 bp, Mus musculus
tctggcaagattgtggctcttgtgg

SEQ ID NO: 788740 - DNA, 25 bp, Mus musculus
tctggcaagtacagaaaatgttctc

SEQ ID NO: 788741 - DNA, 25 bp, Mus musculus
tctggcaagtactgaaaatgttctc

SEQ ID NO: 788742 - DNA, 25 bp, Mus musculus
tctggcaatgagcagatgaccaagt

SEQ ID NO: 788743 - DNA, 25 bp, Mus musculus
tctggcaatgaggagatgaccaagt

SEQ ID NO: 788744 - DNA, 25 bp, Mus musculus
tctggcacaagaccctggatgagag

SEQ ID NO: 788745 - DNA, 25 bp, Mus musculus
tctggcacaagagcctggatgagag

SEQ ID NO: 788746 - DNA, 25 bp, Mus musculus
tctggcacagggagatattactagc

SEQ ID NO: 788747 - DNA, 25 bp, Mus musculus
tctggcacagggtgatattactagc

SEQ ID NO: 788748 - DNA, 25 bp, Mus musculus
tctggcacagtaagaagcctcgggc

SEQ ID NO: 788749 - DNA, 25 bp, Mus musculus
tctggcacagtatgaagcctcgggc

SEQ ID NO: 788750 - DNA, 25 bp, Mus musculus
tctggcacatgaagctcagtaactg

SEQ ID NO: 788751 - DNA, 25 bp, Mus musculus
tctggcacatgatgctcagtaactg

SEQ ID NO: 788752 - DNA, 25 bp, Mus musculus
tctggcaccctgactaataaccttc

SEQ ID NO: 788753 - DNA, 25 bp, Mus musculus
tctggcaccctgagagctcaggcat

SEQ ID NO: 788754 - DNA, 25 bp, Mus musculus
tctggcaccctgtctaataaccttc

SEQ ID NO: 788755 - DNA, 25 bp, Mus musculus
tctggcaccctgtgagctcaggcat

SEQ ID NO: 788756 - DNA, 25 bp, Mus musculus
tctggcacctacacactctacttaa

SEQ ID NO: 788757 - DNA, 25 bp, Mus musculus
tctggcacctactcactctacttaa

SEQ ID NO: 788758 - DNA, 25 bp, Mus musculus
tctggcacctccagtgtctgcggtc

SEQ ID NO: 788759 - DNA, 25 bp, Mus musculus
tctggcacctcctgtgtctgcggtc

SEQ ID NO: 788760 - DNA, 25 bp, Mus musculus
tctggcacggaaccctgttatgaca

SEQ ID NO: 788761 - DNA, 25 bp, Mus musculus
tctggcacggaagcctgttatgaca

SEQ ID NO: 788762 - DNA, 25 bp, Mus musculus
tctggcacggacacccggtctgggt

SEQ ID NO: 788763 - DNA, 25 bp, Mus musculus
tctggcacggactcccggtctgggt

SEQ ID NO: 788764 - DNA, 25 bp, Mus musculus
tctggcactgaacaaaagaaactta

SEQ ID NO: 788765 - DNA, 25 bp, Mus musculus
tctggcactgaagaaaagaaactta

SEQ ID NO: 788766 - DNA, 25 bp, Mus musculus
tctggcacttccaggtactggctct

SEQ ID NO: 788767 - DNA, 25 bp, Mus musculus
tctggcacttcctggtactggctct

SEQ ID NO: 788768 - DNA, 25 bp, Mus musculus
tctggcactttcagggaccaggcac

SEQ ID NO: 788769 - DNA, 25 bp, Mus musculus
tctggcactttctgggaccaggcac

SEQ ID NO: 788770 - DNA, 25 bp, Mus musculus
tctggcagaaggcaatagaggaact

SEQ ID NO: 788771 - DNA, 25 bp, Mus musculus
tctggcagaagggaatagaggaact

SEQ ID NO: 788772 - DNA, 25 bp, Mus musculus
tctggcagaggtcgtggcggcgaga

SEQ ID NO: 788773 - DNA, 25 bp, Mus musculus
tctggcagaggtggtggcggcgaga

SEQ ID NO: 788774 - DNA, 25 bp, Mus musculus
tctggcagagtaagcctacgtgctg

SEQ ID NO: 788775 - DNA, 25 bp, Mus musculus
tctggcagagtatgcctacgtgctg

SEQ ID NO: 788776 - DNA, 25 bp, Mus musculus
tctggcagatctccgccgtagccaa

SEQ ID NO: 788777 - DNA, 25 bp, Mus musculus
tctggcagatctgcgccgtagccaa

SEQ ID NO: 788778 - DNA, 25 bp, Mus musculus
tctggcagcaacaaatttgaaaggc

SEQ ID NO: 788779 - DNA, 25 bp, Mus musculus
tctggcagcaactaatttgaaaggc

SEQ ID NO: 788780 - DNA, 25 bp, Mus musculus
tctggcagccaacaaacaggtcatg

SEQ ID NO: 788781 - DNA, 25 bp, Mus musculus
tctggcagccaagaaacaggtcatg

SEQ ID NO: 788782 - DNA, 25 bp, Mus musculus
tctggcagcgataccacctacttct

SEQ ID NO: 788783 - DNA, 25 bp, Mus musculus
tctggcagcgattccacctacttct

SEQ ID NO: 788784 - DNA, 25 bp, Mus musculus
tctggcagctacagggacagaaact

SEQ ID NO: 788785 - DNA, 25 bp, Mus musculus
tctggcagctactgggacagaaact

SEQ ID NO: 788786 - DNA, 25 bp, Mus musculus
tctggcaggagcagacttctggaag

SEQ ID NO: 788787 - DNA, 25 bp, Mus musculus
tctggcaggagctgacttctggaag

SEQ ID NO: 788788 - DNA, 25 bp, Mus musculus
tctggcaggcccaccagggagagaa

SEQ ID NO: 788789 - DNA, 25 bp, Mus musculus
tctggcaggccctccagggagagaa

SEQ ID NO: 788790 - DNA, 25 bp, Mus musculus
tctggcaggtgtacctcgactacct

SEQ ID NO: 788791 - DNA, 25 bp, Mus musculus
tctggcaggtgttcctcgactacct

SEQ ID NO: 788792 - DNA, 25 bp, Mus musculus
tctggcatagagacgctgcgctctc

SEQ ID NO: 788793 - DNA, 25 bp, Mus musculus
tctggcatagagtcgctgcgctctc

SEQ ID NO: 788794 - DNA, 25 bp, Mus musculus
tctggcatccaaaagcggttgggag

SEQ ID NO: 788795 - DNA, 25 bp, Mus musculus
tctggcatccaatagcggttgggag

SEQ ID NO: 788796 - DNA, 25 bp, Mus musculus
tctggcatccagcatgaggaacagg

SEQ ID NO: 788797 - DNA, 25 bp, Mus musculus
tctggcatccaggatgaggaacagg

SEQ ID NO: 788798 - DNA, 25 bp, Mus musculus
tctggcatcgttcctgagactcctg

SEQ ID NO: 788799 - DNA, 25 bp, Mus musculus
tctggcatcgttgctgagactcctg

SEQ ID NO: 788800 - DNA, 25 bp, Mus musculus
tctggcatctggcatcctcttgttg

SEQ ID NO: 788801 - DNA, 25 bp, Mus musculus
tctggcatctgggatcctcttgttg

SEQ ID NO: 788802 - DNA, 25 bp, Mus musculus
tctggcatgtaccacttcttccgga

SEQ ID NO: 788803 - DNA, 25 bp, Mus musculus
tctggcatgtacgacttcttccgga

SEQ ID NO: 788804 - DNA, 25 bp, Mus musculus
tctggcattaacactgccctttttg

SEQ ID NO: 788805 - DNA, 25 bp, Mus musculus
tctggcattaactctgccctttttg

SEQ ID NO: 788806 - DNA, 25 bp, Mus musculus
tctggcattcctccgggcatcaaca

SEQ ID NO: 788807 - DNA, 25 bp, Mus musculus
tctggcattcctgcgggcatcaaca

SEQ ID NO: 788808 - DNA, 25 bp, Mus musculus
tctggccaagagaagctatgctgtg

SEQ ID NO: 788809 - DNA, 25 bp, Mus musculus
tctggccaagagtagctatgctgtg

SEQ ID NO: 788810 - DNA, 25 bp, Mus musculus
tctggccaagttacggaaagatatc

SEQ ID NO: 788811 - DNA, 25 bp, Mus musculus
tctggccaagtttcggaaagatatc

SEQ ID NO: 788812 - DNA, 25 bp, Mus musculus
tctggccaatgaaagtgaggacccc

SEQ ID NO: 788813 - DNA, 25 bp, Mus musculus
tctggccaatgacgacaatgaagaa

SEQ ID NO: 788814 - DNA, 25 bp, Mus musculus
tctggccaatgaggacaatgaagaa

SEQ ID NO: 788815 - DNA, 25 bp, Mus musculus
tctggccaatgatagtgaggacccc

SEQ ID NO: 788816 - DNA, 25 bp, Mus musculus
tctggccagatacagtcgttgcccc

SEQ ID NO: 788817 - DNA, 25 bp, Mus musculus
tctggccagatagagtcgttgcccc

SEQ ID NO: 788818 - DNA, 25 bp, Mus musculus
tctggccagccacttggcacttaag

SEQ ID NO: 788819 - DNA, 25 bp, Mus musculus
tctggccagccagttggcacttaag

SEQ ID NO: 788820 - DNA, 25 bp, Mus musculus
tctggccagcgaacgatgatgggct

SEQ ID NO: 788821 - DNA, 25 bp, Mus musculus
tctggccagcgatcgatgatgggct

SEQ ID NO: 788822 - DNA, 25 bp, Mus musculus
tctggccagcggaagagggaaggca

SEQ ID NO: 788823 - DNA, 25 bp, Mus musculus
tctggccagcggtagagggaaggca

SEQ ID NO: 788824 - DNA, 25 bp, Mus musculus
tctggccataatagaggctctgaac

SEQ ID NO: 788825 - DNA, 25 bp, Mus musculus
tctggccataattgaggctctgaac

SEQ ID NO: 788826 - DNA, 25 bp, Mus musculus
tctggccatattcctacatatctct

SEQ ID NO: 788827 - DNA, 25 bp, Mus musculus
tctggccatattgctacatatctct

SEQ ID NO: 788828 - DNA, 25 bp, Mus musculus
tctggccatcagcacaagcagaggc

SEQ ID NO: 788829 - DNA, 25 bp, Mus musculus
tctggccatcaggacaagcagaggc

SEQ ID NO: 788830 - DNA, 25 bp, Mus musculus
tctggccatcgtcactacatctttc

SEQ ID NO: 788831 - DNA, 25 bp, Mus musculus
tctggccatcgtgactacatctttc

SEQ ID NO: 788832 - DNA, 25 bp, Mus musculus
tctggccatgagataattgtgcagt

SEQ ID NO: 788833 - DNA, 25 bp, Mus musculus
tctggccatgagttaattgtgcagt

SEQ ID NO: 788834 - DNA, 25 bp, Mus musculus
tctggccatggtaagtctggaaatg

SEQ ID NO: 788835 - DNA, 25 bp, Mus musculus
tctggccatggttagtctggaaatg

SEQ ID NO: 788836 - DNA, 25 bp, Mus musculus
tctggcccacagagacgctgctcta

SEQ ID NO: 788837 - DNA, 25 bp, Mus musculus
tctggcccacagtgacgctgctcta

SEQ ID NO: 788838 - DNA, 25 bp, Mus musculus
tctggcccagatcccgaagatgaac

SEQ ID NO: 788839 - DNA, 25 bp, Mus musculus
tctggcccagatgccgaagatgaac

SEQ ID NO: 788840 - DNA, 25 bp, Mus musculus
tctggcccaggcaagtgatacttgt

SEQ ID NO: 788841 - DNA, 25 bp, Mus musculus
tctggcccaggctagtgatacttgt

SEQ ID NO: 788842 - DNA, 25 bp, Mus musculus
tctggcccatccaggaaaggttgca

SEQ ID NO: 788843 - DNA, 25 bp, Mus musculus
tctggcccatcctggaaaggttgca

SEQ ID NO: 788844 - DNA, 25 bp, Mus musculus
tctggccccagcaccgcgtggtggt

SEQ ID NO: 788845 - DNA, 25 bp, Mus musculus
tctggccccagctccgcgtggtggt

SEQ ID NO: 788846 - DNA, 25 bp, Mus musculus
tctggccgagttccaaagggccata

SEQ ID NO: 788847 - DNA, 25 bp, Mus musculus
tctggccgagttctctatgtttgct

SEQ ID NO: 788848 - DNA, 25 bp, Mus musculus
tctggccgagttgcaaagggccata

SEQ ID NO: 788849 - DNA, 25 bp, Mus musculus
tctggccgagttgtctatgtttgct

SEQ ID NO: 788850 - DNA, 25 bp, Mus musculus
tctggccgctgacgtatgcactgct

SEQ ID NO: 788851 - DNA, 25 bp, Mus musculus
tctggccgctgaggtatgcactgct

SEQ ID NO: 788852 - DNA, 25 bp, Mus musculus
tctggcctaattcgaggaaggatac

SEQ ID NO: 788853 - DNA, 25 bp, Mus musculus
tctggcctaattggaggaaggatac

SEQ ID NO: 788854 - DNA, 25 bp, Mus musculus
tctggcctccagataccaacacaga

SEQ ID NO: 788855 - DNA, 25 bp, Mus musculus
tctggcctccagttaccaacacaga

SEQ ID NO: 788856 - DNA, 25 bp, Mus musculus
tctggcctcctgcaaaatgcctggt

SEQ ID NO: 788857 - DNA, 25 bp, Mus musculus
tctggcctcctggaaaatgcctggt

SEQ ID NO: 788858 - DNA, 25 bp, Mus musculus
tctggcctcgacaggcacatgcaaa

SEQ ID NO: 788859 - DNA, 25 bp, Mus musculus
tctggcctcgactggcacatgcaaa

SEQ ID NO: 788860 - DNA, 25 bp, Mus musculus
tctggcctcgggagtctgtcttctg

SEQ ID NO: 788861 - DNA, 25 bp, Mus musculus
tctggcctcgggtgtctgtcttctg

SEQ ID NO: 788862 - DNA, 25 bp, Mus musculus
tctggcctggagaagtctttcttgc

SEQ ID NO: 788863 - DNA, 25 bp, Mus musculus
tctggcctggagtagtctttcttgc

SEQ ID NO: 788864 - DNA, 25 bp, Mus musculus
tctggcctgtgtcaagcaggttcag

SEQ ID NO: 788865 - DNA, 25 bp, Mus musculus
tctggcctgtgtgaagcaggttcag

SEQ ID NO: 788866 - DNA, 25 bp, Mus musculus
tctggccttcctactaatgatgagc

SEQ ID NO: 788867 - DNA, 25 bp, Mus musculus
tctggccttccttctaatgatgagc

SEQ ID NO: 788868 - DNA, 25 bp, Mus musculus
tctggccttcttcaacctgtgtggt

SEQ ID NO: 788869 - DNA, 25 bp, Mus musculus
tctggccttcttgaacctgtgtggt

SEQ ID NO: 788870 - DNA, 25 bp, Mus musculus
tctggccttgaaaatcgctgggcga

SEQ ID NO: 788871 - DNA, 25 bp, Mus musculus
tctggccttgaatatcgctgggcga

SEQ ID NO: 788872 - DNA, 25 bp, Mus musculus
tctggccttgatactacctgctaag

SEQ ID NO: 788873 - DNA, 25 bp, Mus musculus
tctggccttgattctacctgctaag

SEQ ID NO: 788874 - DNA, 25 bp, Mus musculus
tctggccttgccacagaggtcactg

SEQ ID NO: 788875 - DNA, 25 bp, Mus musculus
tctggccttgcctcagaggtcactg

SEQ ID NO: 788876 - DNA, 25 bp, Mus musculus
tctggcgatgcacgctttccagaaa

SEQ ID NO: 788877 - DNA, 25 bp, Mus musculus
tctggcgatgcaggctttccagaaa

SEQ ID NO: 788878 - DNA, 25 bp, Mus musculus
tctggcgcaagacgaaacctccagt

SEQ ID NO: 788879 - DNA, 25 bp, Mus musculus
tctggcgcaagaggaaacctccagt

SEQ ID NO: 788880 - DNA, 25 bp, Mus musculus
tctggcgcaatgaccgagggaagac

SEQ ID NO: 788881 - DNA, 25 bp, Mus musculus
tctggcgcaatgtccgagggaagac

SEQ ID NO: 788882 - DNA, 25 bp, Mus musculus
tctggcgccatcagtggttaccctg

SEQ ID NO: 788883 - DNA, 25 bp, Mus musculus
tctggcgccatcctagcacagcggg

SEQ ID NO: 788884 - DNA, 25 bp, Mus musculus
tctggcgccatcgtagcacagcggg

SEQ ID NO: 788885 - DNA, 25 bp, Mus musculus
tctggcgccatctgtggttaccctg

SEQ ID NO: 788886 - DNA, 25 bp, Mus musculus
tctggcgcccatatgcaaaggcctt

SEQ ID NO: 788887 - DNA, 25 bp, Mus musculus
tctggcgcccatttgcaaaggcctt

SEQ ID NO: 788888 - DNA, 25 bp, Mus musculus
tctggcgccgctacggaaagttctc

SEQ ID NO: 788889 - DNA, 25 bp, Mus musculus
tctggcgccgcttcggaaagttctc

SEQ ID NO: 788890 - DNA, 25 bp, Mus musculus
tctggcggccatagtccgggccatg

SEQ ID NO: 788891 - DNA, 25 bp, Mus musculus
tctggcggccattgtccgggccatg

SEQ ID NO: 788892 - DNA, 25 bp, Mus musculus
tctggcgggaatatcccgaccgcct

SEQ ID NO: 788893 - DNA, 25 bp, Mus musculus
tctggcgggaatttcccgaccgcct

SEQ ID NO: 788894 - DNA, 25 bp, Mus musculus
tctggcgggcaaaatacaaactctg

SEQ ID NO: 788895 - DNA, 25 bp, Mus musculus
tctggcgggcaatatacaaactctg

SEQ ID NO: 788896 - DNA, 25 bp, Mus musculus
tctggcgtagccagagagcctgctg

SEQ ID NO: 788897 - DNA, 25 bp, Mus musculus
tctggcgtagcctgagagcctgctg

SEQ ID NO: 788898 - DNA, 25 bp, Mus musculus
tctggcgtcccaagactcaggaaaa

SEQ ID NO: 788899 - DNA, 25 bp, Mus musculus
tctggcgtcccatgactcaggaaaa

SEQ ID NO: 788900 - DNA, 25 bp, Mus musculus
tctggcgtgcacacttggaacagcc

SEQ ID NO: 788901 - DNA, 25 bp, Mus musculus
tctggcgtgcactcttggaacagcc

SEQ ID NO: 788902 - DNA, 25 bp, Mus musculus
tctggcgtgtggagaagtttgacct

SEQ ID NO: 788903 - DNA, 25 bp, Mus musculus
tctggcgtgtggtgaagtttgacct

SEQ ID NO: 788904 - DNA, 25 bp, Mus musculus
tctggcgttcggctttccagtgcaa

SEQ ID NO: 788905 - DNA, 25 bp, Mus musculus
tctggcgttcgggtttccagtgcaa

SEQ ID NO: 788906 - DNA, 25 bp, Mus musculus
tctggcgtttccacgcttaatccgg

SEQ ID NO: 788907 - DNA, 25 bp, Mus musculus
tctggcgtttcctcgcttaatccgg

SEQ ID NO: 788908 - DNA, 25 bp, Mus musculus
tctggctaaaggagagatctcgaaa

SEQ ID NO: 788909 - DNA, 25 bp, Mus musculus
tctggctaaaggtgagatctcgaaa

SEQ ID NO: 788910 - DNA, 25 bp, Mus musculus
tctggctaactgcaagctaaagacc

SEQ ID NO: 788911 - DNA, 25 bp, Mus musculus
tctggctaactggaagctaaagacc

SEQ ID NO: 788912 - DNA, 25 bp, Mus musculus
tctggctaagagaaaatggccagca

SEQ ID NO: 788913 - DNA, 25 bp, Mus musculus
tctggctaagagtaaatggccagca

SEQ ID NO: 788914 - DNA, 25 bp, Mus musculus
tctggctaaggaattgcaagcggag

SEQ ID NO: 788915 - DNA, 25 bp, Mus musculus
tctggctaaggatttgcaagcggag

SEQ ID NO: 788916 - DNA, 25 bp, Mus musculus
tctggctacaacaagtggtctcggc

SEQ ID NO: 788917 - DNA, 25 bp, Mus musculus
tctggctacaactagtggtctcggc

SEQ ID NO: 788918 - DNA, 25 bp, Mus musculus
tctggctacacaacgtatgggtggc

SEQ ID NO: 788919 - DNA, 25 bp, Mus musculus
tctggctacacatcgtatgggtggc

SEQ ID NO: 788920 - DNA, 25 bp, Mus musculus
tctggctaccagaatctccgtgtct

SEQ ID NO: 788921 - DNA, 25 bp, Mus musculus
tctggctaccagtatctccgtgtct

SEQ ID NO: 788922 - DNA, 25 bp, Mus musculus
tctggctactgaagatcctactttg

SEQ ID NO: 788923 - DNA, 25 bp, Mus musculus
tctggctactgatgatcctactttg

SEQ ID NO: 788924 - DNA, 25 bp, Mus musculus
tctggctagcaacgaagattcgttc

SEQ ID NO: 788925 - DNA, 25 bp, Mus musculus
tctggctagcaaggaagattcgttc

SEQ ID NO: 788926 - DNA, 25 bp, Mus musculus
tctggctaggccaggccagagccgc

SEQ ID NO: 788927 - DNA, 25 bp, Mus musculus
tctggctaggcctggccagagccgc

SEQ ID NO: 788928 - DNA, 25 bp, Mus musculus
tctggctataatactatggacctag

SEQ ID NO: 788929 - DNA, 25 bp, Mus musculus
tctggctataattctatggacctag

SEQ ID NO: 788930 - DNA, 25 bp, Mus musculus
tctggctcaaggaatctagaaaaag

SEQ ID NO: 788931 - DNA, 25 bp, Mus musculus
tctggctcaaggtatctagaaaaag

SEQ ID NO: 788932 - DNA, 25 bp, Mus musculus
tctggctcacctagggaggcatgag

SEQ ID NO: 788933 - DNA, 25 bp, Mus musculus
tctggctcaccttgggaggcatgag

SEQ ID NO: 788934 - DNA, 25 bp, Mus musculus
tctggctcagaaaagctcactgcct

SEQ ID NO: 788935 - DNA, 25 bp, Mus musculus
tctggctcagaatagctcactgcct

SEQ ID NO: 788936 - DNA, 25 bp, Mus musculus
tctggctcaggactatctcatggag

SEQ ID NO: 788937 - DNA, 25 bp, Mus musculus
tctggctcaggagtatctcatggag

SEQ ID NO: 788938 - DNA, 25 bp, Mus musculus
tctggctcatgaacgggcctactgg

SEQ ID NO: 788939 - DNA, 25 bp, Mus musculus
tctggctcatgatcgggcctactgg

SEQ ID NO: 788940 - DNA, 25 bp, Mus musculus
tctggctccaacaggtaatgctccg

SEQ ID NO: 788941 - DNA, 25 bp, Mus musculus
tctggctccaactggtaatgctccg

SEQ ID NO: 788942 - DNA, 25 bp, Mus musculus
tctggctccagaagcagagggacca

SEQ ID NO: 788943 - DNA, 25 bp, Mus musculus
tctggctccagatgcagagggacca

SEQ ID NO: 788944 - DNA, 25 bp, Mus musculus
tctggctcgagtagaagaactcatt

SEQ ID NO: 788945 - DNA, 25 bp, Mus musculus
tctggctcgagttgaagaactcatt

SEQ ID NO: 788946 - DNA, 25 bp, Mus musculus
tctggctctttgagcaggtgcttcc

SEQ ID NO: 788947 - DNA, 25 bp, Mus musculus
tctggctctttgtgcaggtgcttcc

SEQ ID NO: 788948 - DNA, 25 bp, Mus musculus
tctggctgaacgcattcgaggccat

SEQ ID NO: 788949 - DNA, 25 bp, Mus musculus
tctggctgaacggattcgaggccat

SEQ ID NO: 788950 - DNA, 25 bp, Mus musculus
tctggctgaggacatcgaccctgag

SEQ ID NO: 788951 - DNA, 25 bp, Mus musculus
tctggctgaggagatcgaccctgag

SEQ ID NO: 788952 - DNA, 25 bp, Mus musculus
tctggctgatcacattaaggtcctg

SEQ ID NO: 788953 - DNA, 25 bp, Mus musculus
tctggctgatcagattaaggtcctg

SEQ ID NO: 788954 - DNA, 25 bp, Mus musculus
tctggctgatctccagtctctgcta

SEQ ID NO: 788955 - DNA, 25 bp, Mus musculus
tctggctgatctgcagtctctgcta

SEQ ID NO: 788956 - DNA, 25 bp, Mus musculus
tctggctgattcaagaccggcccga

SEQ ID NO: 788957 - DNA, 25 bp, Mus musculus
tctggctgattctagaccggcccga

SEQ ID NO: 788958 - DNA, 25 bp, Mus musculus
tctggctgcagaccgccgacttgct

SEQ ID NO: 788959 - DNA, 25 bp, Mus musculus
tctggctgcagagcgccgacttgct

SEQ ID NO: 788960 - DNA, 25 bp, Mus musculus
tctggctgccggctttgaggaacac

SEQ ID NO: 788961 - DNA, 25 bp, Mus musculus
tctggctgccgggtttgaggaacac

SEQ ID NO: 788962 - DNA, 25 bp, Mus musculus
tctggctgctaacactgttgaggaa

SEQ ID NO: 788963 - DNA, 25 bp, Mus musculus
tctggctgctaagactgttgaggaa

SEQ ID NO: 788964 - DNA, 25 bp, Mus musculus
tctggctgctcaaggccaatgccga

SEQ ID NO: 788965 - DNA, 25 bp, Mus musculus
tctggctgctcatggccaatgccga

SEQ ID NO: 788966 - DNA, 25 bp, Mus musculus
tctggctgctgcaaacgtggtgaag

SEQ ID NO: 788967 - DNA, 25 bp, Mus musculus
tctggctgctgctaacgtggtgaag

SEQ ID NO: 788968 - DNA, 25 bp, Mus musculus
tctggctggattacaacttgtttct

SEQ ID NO: 788969 - DNA, 25 bp, Mus musculus
tctggctggatttcaacttgtttct

SEQ ID NO: 788970 - DNA, 25 bp, Mus musculus
tctggctgggtaaaatccaactggg

SEQ ID NO: 788971 - DNA, 25 bp, Mus musculus
tctggctgggtataatccaactggg

SEQ ID NO: 788972 - DNA, 25 bp, Mus musculus
tctggctggttcacttcactccctg

SEQ ID NO: 788973 - DNA, 25 bp, Mus musculus
tctggctggttctcttcactccctg

SEQ ID NO: 788974 - DNA, 25 bp, Mus musculus
tctggctgtaccacggcttcccttt

SEQ ID NO: 788975 - DNA, 25 bp, Mus musculus
tctggctgtacctcggcttcccttt

SEQ ID NO: 788976 - DNA, 25 bp, Mus musculus
tctggctgtaggacccgatctttac

SEQ ID NO: 788977 - DNA, 25 bp, Mus musculus
tctggctgtaggtcccgatctttac

SEQ ID NO: 788978 - DNA, 25 bp, Mus musculus
tctggctgtgctctacggcaaacgc

SEQ ID NO: 788979 - DNA, 25 bp, Mus musculus
tctggctgtgctgtacggcaaacgc

SEQ ID NO: 788980 - DNA, 25 bp, Mus musculus
tctggctgtggaagctcggaacaaa

SEQ ID NO: 788981 - DNA, 25 bp, Mus musculus
tctggctgtggatgctcggaacaaa

SEQ ID NO: 788982 - DNA, 25 bp, Mus musculus
tctggctgtggcattaacagcaagc

SEQ ID NO: 788983 - DNA, 25 bp, Mus musculus
tctggctgtggcattgtctactgca

SEQ ID NO: 788984 - DNA, 25 bp, Mus musculus
tctggctgtggctttaacagcaagc

SEQ ID NO: 788985 - DNA, 25 bp, Mus musculus
tctggctgtggctttgtctactgca

SEQ ID NO: 788986 - DNA, 25 bp, Mus musculus
tctggcttaggtcagtagatcagtg

SEQ ID NO: 788987 - DNA, 25 bp, Mus musculus
tctggcttaggtgagtagatcagtg

SEQ ID NO: 788988 - DNA, 25 bp, Mus musculus
tctggcttcactccattggctcttc

SEQ ID NO: 788989 - DNA, 25 bp, Mus musculus
tctggcttcactgcattggctcttc

SEQ ID NO: 788990 - DNA, 25 bp, Mus musculus
tctggcttcaggactcgctacgttt

SEQ ID NO: 788991 - DNA, 25 bp, Mus musculus
tctggcttcaggtctcgctacgttt

SEQ ID NO: 788992 - DNA, 25 bp, Mus musculus
tctggcttcataattggaaaatctc

SEQ ID NO: 788993 - DNA, 25 bp, Mus musculus
tctggcttcatatttggaaaatctc

SEQ ID NO: 788994 - DNA, 25 bp, Mus musculus
tctggcttcctgcatgtaagcacag

SEQ ID NO: 788995 - DNA, 25 bp, Mus musculus
tctggcttcctggatgtaagcacag

SEQ ID NO: 788996 - DNA, 25 bp, Mus musculus
tctggcttgcctctgtactgtgtgg

SEQ ID NO: 788997 - DNA, 25 bp, Mus musculus
tctggcttgcctgtgtactgtgtgg

SEQ ID NO: 788998 - DNA, 25 bp, Mus musculus
tctggcttggctatatcaattcggg

SEQ ID NO: 788999 - DNA, 25 bp, Mus musculus
tctggcttggctttatcaattcggg

SEQ ID NO: 789000 - DNA, 25 bp, Mus musculus
tctggcttgggaattactgtctggc

SEQ ID NO: 789001 - DNA, 25 bp, Mus musculus
tctggcttgggatttactgtctggc

SEQ ID NO: 789002 - DNA, 25 bp, Mus musculus
tctggctttgctcatagtaattcct

SEQ ID NO: 789003 - DNA, 25 bp, Mus musculus
tctggctttgctgatagtaattcct

SEQ ID NO: 789004 - DNA, 25 bp, Mus musculus
tctgggaaaaacaagctcgcaaagg

SEQ ID NO: 789005 - DNA, 25 bp, Mus musculus
tctgggaaaaactagctcgcaaagg

SEQ ID NO: 789006 - DNA, 25 bp, Mus musculus
tctgggaaaacaattcaggattttg

SEQ ID NO: 789007 - DNA, 25 bp, Mus musculus
tctgggaaaacatttcaggattttg

SEQ ID NO: 789008 - DNA, 25 bp, Mus musculus
tctgggaaactcacgaaggacattc

SEQ ID NO: 789009 - DNA, 25 bp, Mus musculus
tctgggaaactctcgaaggacattc

SEQ ID NO: 789010 - DNA, 25 bp, Mus musculus
tctgggaaatggaacgatgacgcct

SEQ ID NO: 789011 - DNA, 25 bp, Mus musculus
tctgggaaatggtacgatgacgcct

SEQ ID NO: 789012 - DNA, 25 bp, Mus musculus
tctgggaacagcctgcctgagtacc

SEQ ID NO: 789013 - DNA, 25 bp, Mus musculus
tctgggaacagcgtgcctgagtacc

SEQ ID NO: 789014 - DNA, 25 bp, Mus musculus
tctgggaacatgaagagatggaatc

SEQ ID NO: 789015 - DNA, 25 bp, Mus musculus
tctgggaacatgtagagatggaatc

SEQ ID NO: 789016 - DNA, 25 bp, Mus musculus
tctgggaaccccagtggattaaagg

SEQ ID NO: 789017 - DNA, 25 bp, Mus musculus
tctgggaacccctgtggattaaagg

SEQ ID NO: 789018 - DNA, 25 bp, Mus musculus
tctgggaacggcaggagtttgtcaa

SEQ ID NO: 789019 - DNA, 25 bp, Mus musculus
tctgggaacggctggagtttgtcaa

SEQ ID NO: 789020 - DNA, 25 bp, Mus musculus
tctgggaactttaggaaacgtgact

SEQ ID NO: 789021 - DNA, 25 bp, Mus musculus
tctgggaacttttggaaacgtgact

SEQ ID NO: 789022 - DNA, 25 bp, Mus musculus
tctgggaagccccaccacgtgtact

SEQ ID NO: 789023 - DNA, 25 bp, Mus musculus
tctgggaagcccgaccacgtgtact

SEQ ID NO: 789024 - DNA, 25 bp, Mus musculus
tctgggaagctaccatctcactctg

SEQ ID NO: 789025 - DNA, 25 bp, Mus musculus
tctgggaagctagcatctcactctg

SEQ ID NO: 789026 - DNA, 25 bp, Mus musculus
tctgggaagctcagggcaaatcatg

SEQ ID NO: 789027 - DNA, 25 bp, Mus musculus
tctgggaagctctgggcaaatcatg

SEQ ID NO: 789028 - DNA, 25 bp, Mus musculus
tctgggaagctgcaacgaagtatcc

SEQ ID NO: 789029 - DNA, 25 bp, Mus musculus
tctgggaagctggaacgaagtatcc

SEQ ID NO: 789030 - DNA, 25 bp, Mus musculus
tctgggaaggccagactgttgatga

SEQ ID NO: 789031 - DNA, 25 bp, Mus musculus
tctgggaaggcctgactgttgatga

SEQ ID NO: 789032 - DNA, 25 bp, Mus musculus
tctgggaaggtcagacagaactagt

SEQ ID NO: 789033 - DNA, 25 bp, Mus musculus
tctgggaaggtctgacagaactagt

SEQ ID NO: 789034 - DNA, 25 bp, Mus musculus
tctgggaatgtcagcacctcaacag

SEQ ID NO: 789035 - DNA, 25 bp, Mus musculus
tctgggaatgtctgcacctcaacag

SEQ ID NO: 789036 - DNA, 25 bp, Mus musculus
tctgggaattcacatcactaaagca

SEQ ID NO: 789037 - DNA, 25 bp, Mus musculus
tctgggaattcagatcactaaagca

SEQ ID NO: 789038 - DNA, 25 bp, Mus musculus
tctgggaattggctatctggaccgc

SEQ ID NO: 789039 - DNA, 25 bp, Mus musculus
tctgggaattgggtatctggaccgc

SEQ ID NO: 789040 - DNA, 25 bp, Mus musculus
tctgggacaacaacacatgctggcg

SEQ ID NO: 789041 - DNA, 25 bp, Mus musculus
tctgggacaacatcacatgctggcg

SEQ ID NO: 789042 - DNA, 25 bp, Mus musculus
tctgggacacctaactcaagagacc

SEQ ID NO: 789043 - DNA, 25 bp, Mus musculus
tctgggacaccttactcaagagacc

SEQ ID NO: 789044 - DNA, 25 bp, Mus musculus
tctgggacagctcaatcctgtcctc

SEQ ID NO: 789045 - DNA, 25 bp, Mus musculus
tctgggacagctgaatcctgtcctc

SEQ ID NO: 789046 - DNA, 25 bp, Mus musculus
tctgggaccaagagtatcagcggtg

SEQ ID NO: 789047 - DNA, 25 bp, Mus musculus
tctgggaccaagtgtatcagcggtg

SEQ ID NO: 789048 - DNA, 25 bp, Mus musculus
tctgggaccacgagatgaacaagtg

SEQ ID NO: 789049 - DNA, 25 bp, Mus musculus
tctgggaccacgtgatgaacaagtg

SEQ ID NO: 789050 - DNA, 25 bp, Mus musculus
tctgggacctgtattgtgcggcacc

SEQ ID NO: 789051 - DNA, 25 bp, Mus musculus
tctgggacctgttttgtgcggcacc

SEQ ID NO: 789052 - DNA, 25 bp, Mus musculus
tctgggacgacaagggttccctaga

SEQ ID NO: 789053 - DNA, 25 bp, Mus musculus
tctgggacgacatgggttccctaga

SEQ ID NO: 789054 - DNA, 25 bp, Mus musculus
tctgggacggacatcttcactggag

SEQ ID NO: 789055 - DNA, 25 bp, Mus musculus
tctgggacggacttcttcactggag

SEQ ID NO: 789056 - DNA, 25 bp, Mus musculus
tctgggacggatcaatgagatcgtc

SEQ ID NO: 789057 - DNA, 25 bp, Mus musculus
tctgggacggatgaatgagatcgtc

SEQ ID NO: 789058 - DNA, 25 bp, Mus musculus
tctgggactgtcacaaagcacgtga

SEQ ID NO: 789059 - DNA, 25 bp, Mus musculus
tctgggactgtctcaaagcacgtga

SEQ ID NO: 789060 - DNA, 25 bp, Mus musculus
tctgggacttccctggacctggagc

SEQ ID NO: 789061 - DNA, 25 bp, Mus musculus
tctgggacttccgtggacctggagc

SEQ ID NO: 789062 - DNA, 25 bp, Mus musculus
tctgggactttaaccaggagcagct

SEQ ID NO: 789063 - DNA, 25 bp, Mus musculus
tctgggactttatccaggagcagct

SEQ ID NO: 789064 - DNA, 25 bp, Mus musculus
tctgggagaaaaccttgaatggaac

SEQ ID NO: 789065 - DNA, 25 bp, Mus musculus
tctgggagaaaagcttgaatggaac

SEQ ID NO: 789066 - DNA, 25 bp, Mus musculus
tctgggagaagtatgtcccaacaga

SEQ ID NO: 789067 - DNA, 25 bp, Mus musculus
tctgggagaagtttgtcccaacaga

SEQ ID NO: 789068 - DNA, 25 bp, Mus musculus
tctgggagaccacttgagcacagtc

SEQ ID NO: 789069 - DNA, 25 bp, Mus musculus
tctgggagaccagttgagcacagtc

SEQ ID NO: 789070 - DNA, 25 bp, Mus musculus
tctgggagactcagtcccttgtgac

SEQ ID NO: 789071 - DNA, 25 bp, Mus musculus
tctgggagactctgtcccttgtgac

SEQ ID NO: 789072 - DNA, 25 bp, Mus musculus
tctgggagagacaccgccctgtctc

SEQ ID NO: 789073 - DNA, 25 bp, Mus musculus
tctgggagagactccgccctgtctc

SEQ ID NO: 789074 - DNA, 25 bp, Mus musculus
tctgggagatgcacatggcgacgcc

SEQ ID NO: 789075 - DNA, 25 bp, Mus musculus
tctgggagatgctcatggcgacgcc

SEQ ID NO: 789076 - DNA, 25 bp, Mus musculus
tctgggagcaggagaatacataaaa

SEQ ID NO: 789077 - DNA, 25 bp, Mus musculus
tctgggagcaggtgaatacataaaa

SEQ ID NO: 789078 - DNA, 25 bp, Mus musculus
tctgggagccatcatggacatatca

SEQ ID NO: 789079 - DNA, 25 bp, Mus musculus
tctgggagccatgatggacatatca

SEQ ID NO: 789080 - DNA, 25 bp, Mus musculus
tctgggaggagtacacgcagcgctt

SEQ ID NO: 789081 - DNA, 25 bp, Mus musculus
tctgggaggagttcacgcagcgctt

SEQ ID NO: 789082 - DNA, 25 bp, Mus musculus
tctgggaggatgaacatcaggagct

SEQ ID NO: 789083 - DNA, 25 bp, Mus musculus
tctgggaggatgtacatcaggagct

SEQ ID NO: 789084 - DNA, 25 bp, Mus musculus
tctgggaggtctagtatggcagcca

SEQ ID NO: 789085 - DNA, 25 bp, Mus musculus
tctgggaggtcttgtatggcagcca

SEQ ID NO: 789086 - DNA, 25 bp, Mus musculus
tctgggagtactacagctgttgtta

SEQ ID NO: 789087 - DNA, 25 bp, Mus musculus
tctgggagtacttcagctgttgtta

SEQ ID NO: 789088 - DNA, 25 bp, Mus musculus
tctgggagtgagagataacagtcct

SEQ ID NO: 789089 - DNA, 25 bp, Mus musculus
tctgggagtgagtgataacagtcct

SEQ ID NO: 789090 - DNA, 25 bp, Mus musculus
tctgggataaaaccacactggaatg

SEQ ID NO: 789091 - DNA, 25 bp, Mus musculus
tctgggataaaagcacactggaatg

SEQ ID NO: 789092 - DNA, 25 bp, Mus musculus
tctgggataagaagcaggcagaatg

SEQ ID NO: 789093 - DNA, 25 bp, Mus musculus
tctgggataagatgcaggcagaatg

SEQ ID NO: 789094 - DNA, 25 bp, Mus musculus
tctgggataattactgtgtgaaaaa

SEQ ID NO: 789095 - DNA, 25 bp, Mus musculus
tctgggataatttctgtgtgaaaaa

SEQ ID NO: 789096 - DNA, 25 bp, Mus musculus
tctgggataccccatcctcataaag

SEQ ID NO: 789097 - DNA, 25 bp, Mus musculus
tctgggatacccgatcctcataaag

SEQ ID NO: 789098 - DNA, 25 bp, Mus musculus
tctgggatataacaatgaacaaatt

SEQ ID NO: 789099 - DNA, 25 bp, Mus musculus
tctgggatataagaatgaacaaatt

SEQ ID NO: 789100 - DNA, 25 bp, Mus musculus
tctgggatatgcatatgaagttcaa

SEQ ID NO: 789101 - DNA, 25 bp, Mus musculus
tctgggatatgcttatgaagttcaa

SEQ ID NO: 789102 - DNA, 25 bp, Mus musculus
tctgggatcaatcgcgacattcggg

SEQ ID NO: 789103 - DNA, 25 bp, Mus musculus
tctgggatcaatggcgacattcggg

SEQ ID NO: 789104 - DNA, 25 bp, Mus musculus
tctgggatccgaacccctgctcaga

SEQ ID NO: 789105 - DNA, 25 bp, Mus musculus
tctgggatccgatcccctgctcaga

SEQ ID NO: 789106 - DNA, 25 bp, Mus musculus
tctgggatcctcagagtctggtgtg

SEQ ID NO: 789107 - DNA, 25 bp, Mus musculus
tctgggatcctctgagtctggtgtg

SEQ ID NO: 789108 - DNA, 25 bp, Mus musculus
tctgggatcgccaggagagagataa

SEQ ID NO: 789109 - DNA, 25 bp, Mus musculus
tctgggatcgcctggagagagataa

SEQ ID NO: 789110 - DNA, 25 bp, Mus musculus
tctgggatgaccagaacaagtcctc

SEQ ID NO: 789111 - DNA, 25 bp, Mus musculus
tctgggatgacctgaacaagtcctc

SEQ ID NO: 789112 - DNA, 25 bp, Mus musculus
tctgggatgcccctctgggaagttc

SEQ ID NO: 789113 - DNA, 25 bp, Mus musculus
tctgggatgcccgtctgggaagttc

SEQ ID NO: 789114 - DNA, 25 bp, Mus musculus
tctgggatgctcaagagagaacgca

SEQ ID NO: 789115 - DNA, 25 bp, Mus musculus
tctgggatgctctagagagaacgca

SEQ ID NO: 789116 - DNA, 25 bp, Mus musculus
tctgggatgtttaggtccctaagct

SEQ ID NO: 789117 - DNA, 25 bp, Mus musculus
tctgggatgttttggtccctaagct

SEQ ID NO: 789118 - DNA, 25 bp, Mus musculus
tctgggattaccagcgctgggtgca

SEQ ID NO: 789119 - DNA, 25 bp, Mus musculus
tctgggattacctgcgctgggtgca

SEQ ID NO: 789120 - DNA, 25 bp, Mus musculus
tctgggattgaaaacggagccttcc

SEQ ID NO: 789121 - DNA, 25 bp, Mus musculus
tctgggattgaaagacgagacgatg

SEQ ID NO: 789122 - DNA, 25 bp, Mus musculus
tctgggattgaatacggagccttcc

SEQ ID NO: 789123 - DNA, 25 bp, Mus musculus
tctgggattgaatgacgagacgatg

SEQ ID NO: 789124 - DNA, 25 bp, Mus musculus
tctgggatttccatctttgcctgtc

SEQ ID NO: 789125 - DNA, 25 bp, Mus musculus
tctgggatttccttctttgcctgtc

SEQ ID NO: 789126 - DNA, 25 bp, Mus musculus
tctgggcaagacagatccgcaacca

SEQ ID NO: 789127 - DNA, 25 bp, Mus musculus
tctgggcaagactgatccgcaacca

SEQ ID NO: 789128 - DNA, 25 bp, Mus musculus
tctgggcaagagaatccacgaagcc

SEQ ID NO: 789129 - DNA, 25 bp, Mus musculus
tctgggcaagagtatccacgaagcc

SEQ ID NO: 789130 - DNA, 25 bp, Mus musculus
tctgggcaaggacctcttccacaga

SEQ ID NO: 789131 - DNA, 25 bp, Mus musculus
tctgggcaaggagctcttccacaga

SEQ ID NO: 789132 - DNA, 25 bp, Mus musculus
tctgggcaatgacgtgaacgatgac

SEQ ID NO: 789133 - DNA, 25 bp, Mus musculus
tctgggcaatgaggtgaacgatgac

SEQ ID NO: 789134 - DNA, 25 bp, Mus musculus
tctgggcacaagaagtggatcatcc

SEQ ID NO: 789135 - DNA, 25 bp, Mus musculus
tctgggcacaagtagtggatcatcc

SEQ ID NO: 789136 - DNA, 25 bp, Mus musculus
tctgggcacacacaacaaaggccgg

SEQ ID NO: 789137 - DNA, 25 bp, Mus musculus
tctgggcacacagaacaaaggccgg

SEQ ID NO: 789138 - DNA, 25 bp, Mus musculus
tctgggcacagtaatagacggtggc

SEQ ID NO: 789139 - DNA, 25 bp, Mus musculus
tctgggcacagttatagacggtggc

SEQ ID NO: 789140 - DNA, 25 bp, Mus musculus
tctgggcacggtaaaggattgtctg

SEQ ID NO: 789141 - DNA, 25 bp, Mus musculus
tctgggcacggttaaggattgtctg

SEQ ID NO: 789142 - DNA, 25 bp, Mus musculus
tctgggcagaatactatgaacatgg

SEQ ID NO: 789143 - DNA, 25 bp, Mus musculus
tctgggcagaatcctaaggaaacga

SEQ ID NO: 789144 - DNA, 25 bp, Mus musculus
tctgggcagaatctcacgatggatg

SEQ ID NO: 789145 - DNA, 25 bp, Mus musculus
tctgggcagaatgctaaggaaacga

SEQ ID NO: 789146 - DNA, 25 bp, Mus musculus
tctgggcagaatgtcacgatggatg

SEQ ID NO: 789147 - DNA, 25 bp, Mus musculus
tctgggcagaattctatgaacatgg

SEQ ID NO: 789148 - DNA, 25 bp, Mus musculus
tctgggcagactcgaccctcacatt

SEQ ID NO: 789149 - DNA, 25 bp, Mus musculus
tctgggcagactggaccctcacatt

SEQ ID NO: 789150 - DNA, 25 bp, Mus musculus
tctgggcagtcccattactacggtt

SEQ ID NO: 789151 - DNA, 25 bp, Mus musculus
tctgggcagtccgattactacggtt

SEQ ID NO: 789152 - DNA, 25 bp, Mus musculus
tctgggcagttcaagtgacaggatg

SEQ ID NO: 789153 - DNA, 25 bp, Mus musculus
tctgggcagttctagtgacaggatg

SEQ ID NO: 789154 - DNA, 25 bp, Mus musculus
tctgggcatccacgagaagtactta

SEQ ID NO: 789155 - DNA, 25 bp, Mus musculus
tctgggcatccaggagaagtactta

SEQ ID NO: 789156 - DNA, 25 bp, Mus musculus
tctgggcatcgccacggacatagtc

SEQ ID NO: 789157 - DNA, 25 bp, Mus musculus
tctgggcatcgcgacggacatagtc

SEQ ID NO: 789158 - DNA, 25 bp, Mus musculus
tctgggcatgtgagaccatgtctcc

SEQ ID NO: 789159 - DNA, 25 bp, Mus musculus
tctgggcatgtgtgaccatgtctcc

SEQ ID NO: 789160 - DNA, 25 bp, Mus musculus
tctgggcatttaaaagaagtgcagc

SEQ ID NO: 789161 - DNA, 25 bp, Mus musculus
tctgggcatttataagaagtgcagc

SEQ ID NO: 789162 - DNA, 25 bp, Mus musculus
tctgggccatttacaacctggtgac

SEQ ID NO: 789163 - DNA, 25 bp, Mus musculus
tctgggccattttcaacctggtgac

SEQ ID NO: 789164 - DNA, 25 bp, Mus musculus
tctgggcccactatgaggagcggcc

SEQ ID NO: 789165 - DNA, 25 bp, Mus musculus
tctgggcccactttgaggagcggcc

SEQ ID NO: 789166 - DNA, 25 bp, Mus musculus
tctgggccctgacaacatcaactgg

SEQ ID NO: 789167 - DNA, 25 bp, Mus musculus
tctgggccctgagaacatcaactgg

SEQ ID NO: 789168 - DNA, 25 bp, Mus musculus
tctgggccctggaatagagtccgcc

SEQ ID NO: 789169 - DNA, 25 bp, Mus musculus
tctgggccctggtatagagtccgcc

SEQ ID NO: 789170 - DNA, 25 bp, Mus musculus
tctgggcccttcctcagaaaatggg

SEQ ID NO: 789171 - DNA, 25 bp, Mus musculus
tctgggcccttcgtcagaaaatggg

SEQ ID NO: 789172 - DNA, 25 bp, Mus musculus
tctgggccggaccaatctactcatc

SEQ ID NO: 789173 - DNA, 25 bp, Mus musculus
tctgggccggacgaatctactcatc

SEQ ID NO: 789174 - DNA, 25 bp, Mus musculus
tctgggcctcaacatggtgtctcct

SEQ ID NO: 789175 - DNA, 25 bp, Mus musculus
tctgggcctcaagatggtgtctcct

SEQ ID NO: 789176 - DNA, 25 bp, Mus musculus
tctgggcctcccattgtgagctatg

SEQ ID NO: 789177 - DNA, 25 bp, Mus musculus
tctgggcctccctttgtgagctatg

SEQ ID NO: 789178 - DNA, 25 bp, Mus musculus
tctgggcgagcaccgcttcggagaa

SEQ ID NO: 789179 - DNA, 25 bp, Mus musculus
tctgggcgagcagcgcttcggagaa

SEQ ID NO: 789180 - DNA, 25 bp, Mus musculus
tctgggcgcgtgaccaatgcccctg

SEQ ID NO: 789181 - DNA, 25 bp, Mus musculus
tctgggcgcgtgtccaatgcccctg

SEQ ID NO: 789182 - DNA, 25 bp, Mus musculus
tctgggctatggacgctttccaaaa

SEQ ID NO: 789183 - DNA, 25 bp, Mus musculus
tctgggctatggtcgctttccaaaa

SEQ ID NO: 789184 - DNA, 25 bp, Mus musculus
tctgggctctaaagcatgaagtctt

SEQ ID NO: 789185 - DNA, 25 bp, Mus musculus
tctgggctctaatgcatgaagtctt

SEQ ID NO: 789186 - DNA, 25 bp, Mus musculus
tctgggctgaccacggtgtgcaagc

SEQ ID NO: 789187 - DNA, 25 bp, Mus musculus
tctgggctgacctcggtgtgcaagc

SEQ ID NO: 789188 - DNA, 25 bp, Mus musculus
tctgggctgagtcgagattatatct

SEQ ID NO: 789189 - DNA, 25 bp, Mus musculus
tctgggctgagtggagattatatct

SEQ ID NO: 789190 - DNA, 25 bp, Mus musculus
tctgggctgccaacagggacaagta

SEQ ID NO: 789191 - DNA, 25 bp, Mus musculus
tctgggctgccatcagggacaagta

SEQ ID NO: 789192 - DNA, 25 bp, Mus musculus
tctgggctgttcaatctatctgtct

SEQ ID NO: 789193 - DNA, 25 bp, Mus musculus
tctgggctgttctatctatctgtct

SEQ ID NO: 789194 - DNA, 25 bp, Mus musculus
tctgggcttacgcagtccctggtgc

SEQ ID NO: 789195 - DNA, 25 bp, Mus musculus
tctgggcttacggagtccctggtgc

SEQ ID NO: 789196 - DNA, 25 bp, Mus musculus
tctgggcttggcattggcactcaat

SEQ ID NO: 789197 - DNA, 25 bp, Mus musculus
tctgggcttggctttggcactcaat

SEQ ID NO: 789198 - DNA, 25 bp, Mus musculus
tctgggcttgtaacctgaagttgcc

SEQ ID NO: 789199 - DNA, 25 bp, Mus musculus
tctgggcttgtatcctgaagttgcc

SEQ ID NO: 789200 - DNA, 25 bp, Mus musculus
tctgggctttttcctgtgctccgag

SEQ ID NO: 789201 - DNA, 25 bp, Mus musculus
tctgggctttttgctgtgctccgag

SEQ ID NO: 789202 - DNA, 25 bp, Mus musculus
tctggggaaggaacagtccctgtgc

SEQ ID NO: 789203 - DNA, 25 bp, Mus musculus
tctggggaaggatcagtccctgtgc

SEQ ID NO: 789204 - DNA, 25 bp, Mus musculus
tctggggagattccctcaaaaagtg

SEQ ID NO: 789205 - DNA, 25 bp, Mus musculus
tctggggagattgcctcaaaaagtg

SEQ ID NO: 789206 - DNA, 25 bp, Mus musculus
tctggggcactgagaaatctggctg

SEQ ID NO: 789207 - DNA, 25 bp, Mus musculus
tctggggcactgtgaaatctggctg

SEQ ID NO: 789208 - DNA, 25 bp, Mus musculus
tctggggttcctactcctggctggg

SEQ ID NO: 789209 - DNA, 25 bp, Mus musculus
tctggggttccttctcctggctggg

SEQ ID NO: 789210 - DNA, 25 bp, Mus musculus
tctgggtaacccagcgaattacccg

SEQ ID NO: 789211 - DNA, 25 bp, Mus musculus
tctgggtaaccctgcgaattacccg

SEQ ID NO: 789212 - DNA, 25 bp, Mus musculus
tctgggtaccccacttttacctcag

SEQ ID NO: 789213 - DNA, 25 bp, Mus musculus
tctgggtacccctcttttacctcag

SEQ ID NO: 789214 - DNA, 25 bp, Mus musculus
tctgggtaccgcaatggcacagacc

SEQ ID NO: 789215 - DNA, 25 bp, Mus musculus
tctgggtaccgctatggcacagacc

SEQ ID NO: 789216 - DNA, 25 bp, Mus musculus
tctgggtacctgagccaggacactg

SEQ ID NO: 789217 - DNA, 25 bp, Mus musculus
tctgggtacctgtgccaggacactg

SEQ ID NO: 789218 - DNA, 25 bp, Mus musculus
tctgggtactatctgccaagccggg

SEQ ID NO: 789219 - DNA, 25 bp, Mus musculus
tctgggtactatgtgccaagccggg

SEQ ID NO: 789220 - DNA, 25 bp, Mus musculus
tctgggtactttcaccactatgctt

SEQ ID NO: 789221 - DNA, 25 bp, Mus musculus
tctgggtactttgaccactatgctt

SEQ ID NO: 789222 - DNA, 25 bp, Mus musculus
tctgggtagggcacgtgttcccttc

SEQ ID NO: 789223 - DNA, 25 bp, Mus musculus
tctgggtagggctcgtgttcccttc

SEQ ID NO: 789224 - DNA, 25 bp, Mus musculus
tctgggtcatacagaacctgtggcc

SEQ ID NO: 789225 - DNA, 25 bp, Mus musculus
tctgggtcatactgaacctgtggcc

SEQ ID NO: 789226 - DNA, 25 bp, Mus musculus
tctgggtccaaaccagaatggttct

SEQ ID NO: 789227 - DNA, 25 bp, Mus musculus
tctgggtccaaagcagaatggttct

SEQ ID NO: 789228 - DNA, 25 bp, Mus musculus
tctgggtccctaaccaatgtgcttt

SEQ ID NO: 789229 - DNA, 25 bp, Mus musculus
tctgggtccctatccaatgtgcttt

SEQ ID NO: 789230 - DNA, 25 bp, Mus musculus
tctgggtccgtcacgtagcaaatga

SEQ ID NO: 789231 - DNA, 25 bp, Mus musculus
tctgggtccgtctcgtagcaaatga

SEQ ID NO: 789232 - DNA, 25 bp, Mus musculus
tctgggtcgctgctgatgctcttac

SEQ ID NO: 789233 - DNA, 25 bp, Mus musculus
tctgggtcgctggtgatgctcttac

SEQ ID NO: 789234 - DNA, 25 bp, Mus musculus
tctgggtctcccaactggcatggca

SEQ ID NO: 789235 - DNA, 25 bp, Mus musculus
tctgggtctccctactggcatggca

SEQ ID NO: 789236 - DNA, 25 bp, Mus musculus
tctgggtcttctctgatttacaatt

SEQ ID NO: 789237 - DNA, 25 bp, Mus musculus
tctgggtcttctctgtccggctgca

SEQ ID NO: 789238 - DNA, 25 bp, Mus musculus
tctgggtcttctgtgatttacaatt

SEQ ID NO: 789239 - DNA, 25 bp, Mus musculus
tctgggtcttctgtgtccggctgca

SEQ ID NO: 789240 - DNA, 25 bp, Mus musculus
tctgggtgatcacctgagctcctgt

SEQ ID NO: 789241 - DNA, 25 bp, Mus musculus
tctgggtgatcagctgagctcctgt

SEQ ID NO: 789242 - DNA, 25 bp, Mus musculus
tctgggtgcccaatgagcagtgcct

SEQ ID NO: 789243 - DNA, 25 bp, Mus musculus
tctgggtgcccattgagcagtgcct

SEQ ID NO: 789244 - DNA, 25 bp, Mus musculus
tctgggtgcgccataattgtccgag

SEQ ID NO: 789245 - DNA, 25 bp, Mus musculus
tctgggtgcgccttaattgtccgag

SEQ ID NO: 789246 - DNA, 25 bp, Mus musculus
tctgggtgcgtcacttcaagggcga

SEQ ID NO: 789247 - DNA, 25 bp, Mus musculus
tctgggtgcgtctcttcaagggcga

SEQ ID NO: 789248 - DNA, 25 bp, Mus musculus
tctgggtgctatcggggatcattcc

SEQ ID NO: 789249 - DNA, 25 bp, Mus musculus
tctgggtgctatgggggatcattcc

SEQ ID NO: 789250 - DNA, 25 bp, Mus musculus
tctgggtgtacgcaagacaagacga

SEQ ID NO: 789251 - DNA, 25 bp, Mus musculus
tctgggtgtacggaagacaagacga

SEQ ID NO: 789252 - DNA, 25 bp, Mus musculus
tctgggtgtgaaactcgatcgcatt

SEQ ID NO: 789253 - DNA, 25 bp, Mus musculus
tctgggtgtgaatctcgatcgcatt

SEQ ID NO: 789254 - DNA, 25 bp, Mus musculus
tctgggtgtgtgcaattctcagctg

SEQ ID NO: 789255 - DNA, 25 bp, Mus musculus
tctgggtgtgtggaattctcagctg

SEQ ID NO: 789256 - DNA, 25 bp, Mus musculus
tctgggttaaggagctgcgcagttt

SEQ ID NO: 789257 - DNA, 25 bp, Mus musculus
tctgggttaaggtgctgcgcagttt

SEQ ID NO: 789258 - DNA, 25 bp, Mus musculus
tctgggttacctcagcctgtcttag

SEQ ID NO: 789259 - DNA, 25 bp, Mus musculus
tctgggttacctgagcctgtcttag

SEQ ID NO: 789260 - DNA, 25 bp, Mus musculus
tctgggttccctcagggctatgaca

SEQ ID NO: 789261 - DNA, 25 bp, Mus musculus
tctgggttccctgagggctatgaca

SEQ ID NO: 789262 - DNA, 25 bp, Mus musculus
tctgggttggaaaagactcccagga

SEQ ID NO: 789263 - DNA, 25 bp, Mus musculus
tctgggttggaatagactcccagga

SEQ ID NO: 789264 - DNA, 25 bp, Mus musculus
tctgggttggctcgaacgccttcat

SEQ ID NO: 789265 - DNA, 25 bp, Mus musculus
tctgggttggctggaacgccttcat

SEQ ID NO: 789266 - DNA, 25 bp, Mus musculus
tctgggtttacaaatgaatcagtca

SEQ ID NO: 789267 - DNA, 25 bp, Mus musculus
tctgggtttacatatgaatcagtca

SEQ ID NO: 789268 - DNA, 25 bp, Mus musculus
tctgggtttcctagggctctgcatc

SEQ ID NO: 789269 - DNA, 25 bp, Mus musculus
tctgggtttccttgggctctgcatc

SEQ ID NO: 789270 - DNA, 25 bp, Mus musculus
tctgggttttctcaatctgccgtgg

SEQ ID NO: 789271 - DNA, 25 bp, Mus musculus
tctgggttttctgaatctgccgtgg

SEQ ID NO: 789272 - DNA, 25 bp, Mus musculus
tctgggtttttccagtggctgacac

SEQ ID NO: 789273 - DNA, 25 bp, Mus musculus
tctgggtttttcctgaaggaacaag

SEQ ID NO: 789274 - DNA, 25 bp, Mus musculus
tctgggtttttcgagtggctgacac

SEQ ID NO: 789275 - DNA, 25 bp, Mus musculus
tctgggtttttcgtgaaggaacaag

SEQ ID NO: 789276 - DNA, 25 bp, Mus musculus
tctggtaaagctaatacactggtgt

SEQ ID NO: 789277 - DNA, 25 bp, Mus musculus
tctggtaaagcttatacactggtgt

SEQ ID NO: 789278 - DNA, 25 bp, Mus musculus
tctggtaattgcattgaagagttct

SEQ ID NO: 789279 - DNA, 25 bp, Mus musculus
tctggtaattgctttgaagagttct

SEQ ID NO: 789280 - DNA, 25 bp, Mus musculus
tctggtaccatgacccagcctgtac

SEQ ID NO: 789281 - DNA, 25 bp, Mus musculus
tctggtaccatgtcccagcctgtac

SEQ ID NO: 789282 - DNA, 25 bp, Mus musculus
tctggtaccgatatctgaaggcacg

SEQ ID NO: 789283 - DNA, 25 bp, Mus musculus
tctggtaccgatttctgaaggcacg

SEQ ID NO: 789284 - DNA, 25 bp, Mus musculus
tctggtacctagaggctgtgtgccc

SEQ ID NO: 789285 - DNA, 25 bp, Mus musculus
tctggtacctagtggctgtgtgccc

SEQ ID NO: 789286 - DNA, 25 bp, Mus musculus
tctggtactgctagatgtttgtccc

SEQ ID NO: 789287 - DNA, 25 bp, Mus musculus
tctggtactgcttgatgtttgtccc

SEQ ID NO: 789288 - DNA, 25 bp, Mus musculus
tctggtacttcccatcgcctatgag

SEQ ID NO: 789289 - DNA, 25 bp, Mus musculus
tctggtacttccgatcgcctatgag

SEQ ID NO: 789290 - DNA, 25 bp, Mus musculus
tctggtagcccacggtcgggcgagg

SEQ ID NO: 789291 - DNA, 25 bp, Mus musculus
tctggtagcccagggtcgggcgagg

SEQ ID NO: 789292 - DNA, 25 bp, Mus musculus
tctggtaggttcattgtgccttttc

SEQ ID NO: 789293 - DNA, 25 bp, Mus musculus
tctggtaggttctttgtgccttttc

SEQ ID NO: 789294 - DNA, 25 bp, Mus musculus
tctggtagtgctccctgggatgaca

SEQ ID NO: 789295 - DNA, 25 bp, Mus musculus
tctggtagtgctgcctgggatgaca

SEQ ID NO: 789296 - DNA, 25 bp, Mus musculus
tctggtagttgcaagaaaaaatggc

SEQ ID NO: 789297 - DNA, 25 bp, Mus musculus
tctggtagttgctagaaaaaatggc

SEQ ID NO: 789298 - DNA, 25 bp, Mus musculus
tctggtatactcacaacctcttctt

SEQ ID NO: 789299 - DNA, 25 bp, Mus musculus
tctggtatactctcaacctcttctt

SEQ ID NO: 789300 - DNA, 25 bp, Mus musculus
tctggtatcactaccctgctttttg

SEQ ID NO: 789301 - DNA, 25 bp, Mus musculus
tctggtatcacttccctgctttttg

SEQ ID NO: 789302 - DNA, 25 bp, Mus musculus
tctggtatccagattaaaaaacacg

SEQ ID NO: 789303 - DNA, 25 bp, Mus musculus
tctggtatccagtttaaaaaacacg

SEQ ID NO: 789304 - DNA, 25 bp, Mus musculus
tctggtatgccaccaggcctaaggc

SEQ ID NO: 789305 - DNA, 25 bp, Mus musculus
tctggtatgccagcaggcctaaggc

SEQ ID NO: 789306 - DNA, 25 bp, Mus musculus
tctggtattagaccgccatgctaac

SEQ ID NO: 789307 - DNA, 25 bp, Mus musculus
tctggtattagagcgccatgctaac

SEQ ID NO: 789308 - DNA, 25 bp, Mus musculus
tctggtattttgatgccaaggaacg

SEQ ID NO: 789309 - DNA, 25 bp, Mus musculus
tctggtattttgttgccaaggaacg

SEQ ID NO: 789310 - DNA, 25 bp, Mus musculus
tctggtcaagacacatggctgaacc

SEQ ID NO: 789311 - DNA, 25 bp, Mus musculus
tctggtcaagactcatggctgaacc

SEQ ID NO: 789312 - DNA, 25 bp, Mus musculus
tctggtcaagagagtgaaactgcgt

SEQ ID NO: 789313 - DNA, 25 bp, Mus musculus
tctggtcaagagtgtgaaactgcgt

SEQ ID NO: 789314 - DNA, 25 bp, Mus musculus
tctggtcaaggtcaatgaggacacg

SEQ ID NO: 789315 - DNA, 25 bp, Mus musculus
tctggtcaaggtccaggtggcttta

SEQ ID NO: 789316 - DNA, 25 bp, Mus musculus
tctggtcaaggtgaatgaggacacg

SEQ ID NO: 789317 - DNA, 25 bp, Mus musculus
tctggtcaaggtgcaggtggcttta

SEQ ID NO: 789318 - DNA, 25 bp, Mus musculus
tctggtcaataaagcctatgctggc

SEQ ID NO: 789319 - DNA, 25 bp, Mus musculus
tctggtcaataatgcctatgctggc

SEQ ID NO: 789320 - DNA, 25 bp, Mus musculus
tctggtcactcacaggaacagcctg

SEQ ID NO: 789321 - DNA, 25 bp, Mus musculus
tctggtcactcagaggaacagcctg

SEQ ID NO: 789322 - DNA, 25 bp, Mus musculus
tctggtcagaaaccttttgatctct

SEQ ID NO: 789323 - DNA, 25 bp, Mus musculus
tctggtcagaaagcttttgatctct

SEQ ID NO: 789324 - DNA, 25 bp, Mus musculus
tctggtcaggctaccaaaagttgcc

SEQ ID NO: 789325 - DNA, 25 bp, Mus musculus
tctggtcaggcttccaaaagttgcc

SEQ ID NO: 789326 - DNA, 25 bp, Mus musculus
tctggtcagtgcactacttcttcat

SEQ ID NO: 789327 - DNA, 25 bp, Mus musculus
tctggtcagtgctctacttcttcat

SEQ ID NO: 789328 - DNA, 25 bp, Mus musculus
tctggtccacaaactggaggaggca

SEQ ID NO: 789329 - DNA, 25 bp, Mus musculus
tctggtccacaatctggaggaggca

SEQ ID NO: 789330 - DNA, 25 bp, Mus musculus
tctggtccaggccaaggatgacgcc

SEQ ID NO: 789331 - DNA, 25 bp, Mus musculus
tctggtccaggcgaaggatgacgcc

SEQ ID NO: 789332 - DNA, 25 bp, Mus musculus
tctggtccagttagaggacgattcc

SEQ ID NO: 789333 - DNA, 25 bp, Mus musculus
tctggtccagtttgaggacgattcc

SEQ ID NO: 789334 - DNA, 25 bp, Mus musculus
tctggtccattgaaaggaatagaac

SEQ ID NO: 789335 - DNA, 25 bp, Mus musculus
tctggtccattgtaaggaatagaac

SEQ ID NO: 789336 - DNA, 25 bp, Mus musculus
tctggtcccccactagcagatgcta

SEQ ID NO: 789337 - DNA, 25 bp, Mus musculus
tctggtcccccagtagcagatgcta

SEQ ID NO: 789338 - DNA, 25 bp, Mus musculus
tctggtcccgcaaaacttgaatgaa

SEQ ID NO: 789339 - DNA, 25 bp, Mus musculus
tctggtcccgcataacttgaatgaa

SEQ ID NO: 789340 - DNA, 25 bp, Mus musculus
tctggtccgattcctccgaaaggct

SEQ ID NO: 789341 - DNA, 25 bp, Mus musculus
tctggtccgattgctccgaaaggct

SEQ ID NO: 789342 - DNA, 25 bp, Mus musculus
tctggtccgcatacatgccttgtga

SEQ ID NO: 789343 - DNA, 25 bp, Mus musculus
tctggtccgcattcatgccttgtga

SEQ ID NO: 789344 - DNA, 25 bp, Mus musculus
tctggtccgttgagtgtagagctga

SEQ ID NO: 789345 - DNA, 25 bp, Mus musculus
tctggtccgttgtgtgtagagctga

SEQ ID NO: 789346 - DNA, 25 bp, Mus musculus
tctggtcctgtacgactgaagcttg

SEQ ID NO: 789347 - DNA, 25 bp, Mus musculus
tctggtcctgtaggactgaagcttg

SEQ ID NO: 789348 - DNA, 25 bp, Mus musculus
tctggtccttaacaaagtgtccttc

SEQ ID NO: 789349 - DNA, 25 bp, Mus musculus
tctggtccttaagaaagtgtccttc

SEQ ID NO: 789350 - DNA, 25 bp, Mus musculus
tctggtccttcgctaacaactctgg

SEQ ID NO: 789351 - DNA, 25 bp, Mus musculus
tctggtccttcggtaacaactctgg

SEQ ID NO: 789352 - DNA, 25 bp, Mus musculus
tctggtccttgacccggcgcagacg

SEQ ID NO: 789353 - DNA, 25 bp, Mus musculus
tctggtccttgagccggcgcagacg

SEQ ID NO: 789354 - DNA, 25 bp, Mus musculus
tctggtcgaaccagcagtgtgggca

SEQ ID NO: 789355 - DNA, 25 bp, Mus musculus
tctggtcgaacctgcagtgtgggca

SEQ ID NO: 789356 - DNA, 25 bp, Mus musculus
tctggtcgaagacccaggttctgga

SEQ ID NO: 789357 - DNA, 25 bp, Mus musculus
tctggtcgaagagccaggttctgga

SEQ ID NO: 789358 - DNA, 25 bp, Mus musculus
tctggtcgattgagatgaggtgatc

SEQ ID NO: 789359 - DNA, 25 bp, Mus musculus
tctggtcgattgtgatgaggtgatc

SEQ ID NO: 789360 - DNA, 25 bp, Mus musculus
tctggtcggaacaaaactcaaggct

SEQ ID NO: 789361 - DNA, 25 bp, Mus musculus
tctggtcggaactaaactcaaggct

SEQ ID NO: 789362 - DNA, 25 bp, Mus musculus
tctggtcggaggagccccgagccct

SEQ ID NO: 789363 - DNA, 25 bp, Mus musculus
tctggtcggaggtgccccgagccct

SEQ ID NO: 789364 - DNA, 25 bp, Mus musculus
tctggtcgtcacagtctggagtccc

SEQ ID NO: 789365 - DNA, 25 bp, Mus musculus
tctggtcgtcactgtctggagtccc

SEQ ID NO: 789366 - DNA, 25 bp, Mus musculus
tctggtcgtgtgcaaagactgcgct

SEQ ID NO: 789367 - DNA, 25 bp, Mus musculus
tctggtcgtgtggaaagactgcgct

SEQ ID NO: 789368 - DNA, 25 bp, Mus musculus
tctggtctcaatacccgtctcaagg

SEQ ID NO: 789369 - DNA, 25 bp, Mus musculus
tctggtctcaattcccgtctcaagg

SEQ ID NO: 789370 - DNA, 25 bp, Mus musculus
tctggtctccttatggtgatgcaca

SEQ ID NO: 789371 - DNA, 25 bp, Mus musculus
tctggtctccttttggtgatgcaca

SEQ ID NO: 789372 - DNA, 25 bp, Mus musculus
tctggtctctccacatgctgctgtg

SEQ ID NO: 789373 - DNA, 25 bp, Mus musculus
tctggtctctcctcatgctgctgtg

SEQ ID NO: 789374 - DNA, 25 bp, Mus musculus
tctggtctgtcaagacatgtttgtg

SEQ ID NO: 789375 - DNA, 25 bp, Mus musculus
tctggtctgtcatgacatgtttgtg

SEQ ID NO: 789376 - DNA, 25 bp, Mus musculus
tctggtcttgagattggcgttttag

SEQ ID NO: 789377 - DNA, 25 bp, Mus musculus
tctggtcttgagtttggcgttttag

SEQ ID NO: 789378 - DNA, 25 bp, Mus musculus
tctggtgaaccacagggatgaactg

SEQ ID NO: 789379 - DNA, 25 bp, Mus musculus
tctggtgaaccagagggatgaactg

SEQ ID NO: 789380 - DNA, 25 bp, Mus musculus
tctggtgaagtgagatcctgaagct

SEQ ID NO: 789381 - DNA, 25 bp, Mus musculus
tctggtgaagtgtgatcctgaagct

SEQ ID NO: 789382 - DNA, 25 bp, Mus musculus
tctggtgacaagatcagtagttcct

SEQ ID NO: 789383 - DNA, 25 bp, Mus musculus
tctggtgacaagttcagtagttcct

SEQ ID NO: 789384 - DNA, 25 bp, Mus musculus
tctggtgacagaaggtctgcctgcc

SEQ ID NO: 789385 - DNA, 25 bp, Mus musculus
tctggtgacagacattaactgggac

SEQ ID NO: 789386 - DNA, 25 bp, Mus musculus
tctggtgacagagattaactgggac

SEQ ID NO: 789387 - DNA, 25 bp, Mus musculus
tctggtgacagatggtctgcctgcc

SEQ ID NO: 789388 - DNA, 25 bp, Mus musculus
tctggtgacagtagctgggactagc

SEQ ID NO: 789389 - DNA, 25 bp, Mus musculus
tctggtgacagttgctgggactagc

SEQ ID NO: 789390 - DNA, 25 bp, Mus musculus
tctggtgacggacgacatccaatgg

SEQ ID NO: 789391 - DNA, 25 bp, Mus musculus
tctggtgacggaggacatccaatgg

SEQ ID NO: 789392 - DNA, 25 bp, Mus musculus
tctggtgactcgacagcttctctcc

SEQ ID NO: 789393 - DNA, 25 bp, Mus musculus
tctggtgactcgtcagcttctctcc

SEQ ID NO: 789394 - DNA, 25 bp, Mus musculus
tctggtgagcgacaactgcgagact

SEQ ID NO: 789395 - DNA, 25 bp, Mus musculus
tctggtgagcgagaactgcgagact

SEQ ID NO: 789396 - DNA, 25 bp, Mus musculus
tctggtgagggacaggtaagtggcc

SEQ ID NO: 789397 - DNA, 25 bp, Mus musculus
tctggtgagggagaggtaagtggcc

SEQ ID NO: 789398 - DNA, 25 bp, Mus musculus
tctggtgattatcggtaggaaaacc

SEQ ID NO: 789399 - DNA, 25 bp, Mus musculus
tctggtgattatgggtaggaaaacc

SEQ ID NO: 789400 - DNA, 25 bp, Mus musculus
tctggtgcaagcaagacaagccttc

SEQ ID NO: 789401 - DNA, 25 bp, Mus musculus
tctggtgcaagctagacaagccttc

SEQ ID NO: 789402 - DNA, 25 bp, Mus musculus
tctggtgcaggacagaacaaccttg

SEQ ID NO: 789403 - DNA, 25 bp, Mus musculus
tctggtgcaggagagaacaaccttg

SEQ ID NO: 789404 - DNA, 25 bp, Mus musculus
tctggtgcagggacatgattagtgc

SEQ ID NO: 789405 - DNA, 25 bp, Mus musculus
tctggtgcagggtcatgattagtgc

SEQ ID NO: 789406 - DNA, 25 bp, Mus musculus
tctggtgccaagatctacatctcca

SEQ ID NO: 789407 - DNA, 25 bp, Mus musculus
tctggtgccaagttctacatctcca

SEQ ID NO: 789408 - DNA, 25 bp, Mus musculus
tctggtgcgagcagcgcagtccaca

SEQ ID NO: 789409 - DNA, 25 bp, Mus musculus
tctggtgcgagctgcgcagtccaca

SEQ ID NO: 789410 - DNA, 25 bp, Mus musculus
tctggtgcggcaagtgaggcaccac

SEQ ID NO: 789411 - DNA, 25 bp, Mus musculus
tctggtgcggcatgtgaggcaccac

SEQ ID NO: 789412 - DNA, 25 bp, Mus musculus
tctggtgcggtcacgagcccgagca

SEQ ID NO: 789413 - DNA, 25 bp, Mus musculus
tctggtgcggtctcgagcccgagca

SEQ ID NO: 789414 - DNA, 25 bp, Mus musculus
tctggtgctgttacaggcctgggca

SEQ ID NO: 789415 - DNA, 25 bp, Mus musculus
tctggtgctgtttcaggcctgggca

SEQ ID NO: 789416 - DNA, 25 bp, Mus musculus
tctggtggaaatcggtaatctccga

SEQ ID NO: 789417 - DNA, 25 bp, Mus musculus
tctggtggaaatgggtaatctccga

SEQ ID NO: 789418 - DNA, 25 bp, Mus musculus
tctggtggaaggagctgtacagccc

SEQ ID NO: 789419 - DNA, 25 bp, Mus musculus
tctggtggaaggtgctgtacagccc

SEQ ID NO: 789420 - DNA, 25 bp, Mus musculus
tctggtggacaacataaaggctccc

SEQ ID NO: 789421 - DNA, 25 bp, Mus musculus
tctggtggacaagataaaggctccc

SEQ ID NO: 789422 - DNA, 25 bp, Mus musculus
tctggtggacccacagatgcctcgc

SEQ ID NO: 789423 - DNA, 25 bp, Mus musculus
tctggtggaccctcagatgcctcgc

SEQ ID NO: 789424 - DNA, 25 bp, Mus musculus
tctggtggagttagtaatagctgcc

SEQ ID NO: 789425 - DNA, 25 bp, Mus musculus
tctggtggagtttgtaatagctgcc

SEQ ID NO: 789426 - DNA, 25 bp, Mus musculus
tctggtggatcacgccaaaaaaggg

SEQ ID NO: 789427 - DNA, 25 bp, Mus musculus
tctggtggatcaggccaaaaaaggg

SEQ ID NO: 789428 - DNA, 25 bp, Mus musculus
tctggtggatgcatctgctgctctc

SEQ ID NO: 789429 - DNA, 25 bp, Mus musculus
tctggtggatgcttctgctgctctc

SEQ ID NO: 789430 - DNA, 25 bp, Mus musculus
tctggtggccaaagtcacagggaaa

SEQ ID NO: 789431 - DNA, 25 bp, Mus musculus
tctggtggccaatgtcacagggaaa

SEQ ID NO: 789432 - DNA, 25 bp, Mus musculus
tctggtggccctagcttaataaaga

SEQ ID NO: 789433 - DNA, 25 bp, Mus musculus
tctggtggcccttgcttaataaaga

SEQ ID NO: 789434 - DNA, 25 bp, Mus musculus
tctggtggcctcatgggatggttct

SEQ ID NO: 789435 - DNA, 25 bp, Mus musculus
tctggtggcctcttgggatggttct

SEQ ID NO: 789436 - DNA, 25 bp, Mus musculus
tctggtggcttacgcttatgcatgc

SEQ ID NO: 789437 - DNA, 25 bp, Mus musculus
tctggtggcttaggcttatgcatgc

SEQ ID NO: 789438 - DNA, 25 bp, Mus musculus
tctggtgggagaatgctggctacct

SEQ ID NO: 789439 - DNA, 25 bp, Mus musculus
tctggtgggagattgctggctacct

SEQ ID NO: 789440 - DNA, 25 bp, Mus musculus
tctggtgggattcgatataacgaac

SEQ ID NO: 789441 - DNA, 25 bp, Mus musculus
tctggtgggattggatataacgaac

SEQ ID NO: 789442 - DNA, 25 bp, Mus musculus
tctggtgggctccatcgataacgac

SEQ ID NO: 789443 - DNA, 25 bp, Mus musculus
tctggtgggctcgatcgataacgac

SEQ ID NO: 789444 - DNA, 25 bp, Mus musculus
tctggtgggtttccctatgaaaaca

SEQ ID NO: 789445 - DNA, 25 bp, Mus musculus
tctggtgggtttgcctatgaaaaca

SEQ ID NO: 789446 - DNA, 25 bp, Mus musculus
tctggtggtagcagggtactaccat

SEQ ID NO: 789447 - DNA, 25 bp, Mus musculus
tctggtggtagctgggtactaccat

SEQ ID NO: 789448 - DNA, 25 bp, Mus musculus
tctggtggtctgagagatctgagct

SEQ ID NO: 789449 - DNA, 25 bp, Mus musculus
tctggtggtctgtgagatctgagct

SEQ ID NO: 789450 - DNA, 25 bp, Mus musculus
tctggtgtatcaccttccctgcttc

SEQ ID NO: 789451 - DNA, 25 bp, Mus musculus
tctggtgtatcagcttccctgcttc

SEQ ID NO: 789452 - DNA, 25 bp, Mus musculus
tctggtgtgcttagctacaaggctc

SEQ ID NO: 789453 - DNA, 25 bp, Mus musculus
tctggtgtgctttgctacaaggctc

SEQ ID NO: 789454 - DNA, 25 bp, Mus musculus
tctggtgttctaatctccagttgac

SEQ ID NO: 789455 - DNA, 25 bp, Mus musculus
tctggtgttctattctccagttgac

SEQ ID NO: 789456 - DNA, 25 bp, Mus musculus
tctggtgttttccaatcactcgcga

SEQ ID NO: 789457 - DNA, 25 bp, Mus musculus
tctggtgttttcgaatcactcgcga

SEQ ID NO: 789458 - DNA, 25 bp, Mus musculus
tctggttaacaacggatatgtgcgg

SEQ ID NO: 789459 - DNA, 25 bp, Mus musculus
tctggttaacaagggatatgtgcgg

SEQ ID NO: 789460 - DNA, 25 bp, Mus musculus
tctggttaactgcatgccctgctca

SEQ ID NO: 789461 - DNA, 25 bp, Mus musculus
tctggttaactggatgccctgctca

SEQ ID NO: 789462 - DNA, 25 bp, Mus musculus
tctggttatgacctgcaggaaacac

SEQ ID NO: 789463 - DNA, 25 bp, Mus musculus
tctggttatgacgtgcaggaaacac

SEQ ID NO: 789464 - DNA, 25 bp, Mus musculus
tctggttcattcattgggttcctac

SEQ ID NO: 789465 - DNA, 25 bp, Mus musculus
tctggttcattctttgggttcctac

SEQ ID NO: 789466 - DNA, 25 bp, Mus musculus
tctggttcctgacctggacacagtt

SEQ ID NO: 789467 - DNA, 25 bp, Mus musculus
tctggttcctgagctggacacagtt

SEQ ID NO: 789468 - DNA, 25 bp, Mus musculus
tctggttctctacacgtacgatgtg

SEQ ID NO: 789469 - DNA, 25 bp, Mus musculus
tctggttctctagacgtacgatgtg

SEQ ID NO: 789470 - DNA, 25 bp, Mus musculus
tctggttctgggaatagactggatg

SEQ ID NO: 789471 - DNA, 25 bp, Mus musculus
tctggttctgggtatagactggatg

SEQ ID NO: 789472 - DNA, 25 bp, Mus musculus
tctggttctgttacccgttgttccg

SEQ ID NO: 789473 - DNA, 25 bp, Mus musculus
tctggttctgtttcccgttgttccg

SEQ ID NO: 789474 - DNA, 25 bp, Mus musculus
tctggttgaaaaactagatagctct

SEQ ID NO: 789475 - DNA, 25 bp, Mus musculus
tctggttgaaaatctagatagctct

SEQ ID NO: 789476 - DNA, 25 bp, Mus musculus
tctggttgatgcctccagggctatg

SEQ ID NO: 789477 - DNA, 25 bp, Mus musculus
tctggttgatgcgtccagggctatg

SEQ ID NO: 789478 - DNA, 25 bp, Mus musculus
tctggttgcccgagccaggcctggt

SEQ ID NO: 789479 - DNA, 25 bp, Mus musculus
tctggttgcccgtgccaggcctggt

SEQ ID NO: 789480 - DNA, 25 bp, Mus musculus
tctggttgcgtcatcggcttctgtg

SEQ ID NO: 789481 - DNA, 25 bp, Mus musculus
tctggttgcgtcttcggcttctgtg

SEQ ID NO: 789482 - DNA, 25 bp, Mus musculus
tctggttggacaatctgagctgcag

SEQ ID NO: 789483 - DNA, 25 bp, Mus musculus
tctggttggacattctgagctgcag

SEQ ID NO: 789484 - DNA, 25 bp, Mus musculus
tctggttgggacaccccgagaagag

SEQ ID NO: 789485 - DNA, 25 bp, Mus musculus
tctggttgggactccccgagaagag

SEQ ID NO: 789486 - DNA, 25 bp, Mus musculus
tctggttgtatcagttctgttcatc

SEQ ID NO: 789487 - DNA, 25 bp, Mus musculus
tctggttgtatctgttctgttcatc

SEQ ID NO: 789488 - DNA, 25 bp, Mus musculus
tctggtttccagctgacagacacga

SEQ ID NO: 789489 - DNA, 25 bp, Mus musculus
tctggtttccaggtgacagacacga

SEQ ID NO: 789490 - DNA, 25 bp, Mus musculus
tctggtttctgtagaaccctggaga

SEQ ID NO: 789491 - DNA, 25 bp, Mus musculus
tctggtttctgttgaaccctggaga

SEQ ID NO: 789492 - DNA, 25 bp, Mus musculus
tctggtttcttgacatgattatgga

SEQ ID NO: 789493 - DNA, 25 bp, Mus musculus
tctggtttcttgtcatgattatgga

SEQ ID NO: 789494 - DNA, 25 bp, Mus musculus
tctggttttcttcgcaggcagtgtt

SEQ ID NO: 789495 - DNA, 25 bp, Mus musculus
tctggttttcttggcaggcagtgtt

SEQ ID NO: 789496 - DNA, 25 bp, Mus musculus
tctggttttttcaacaaagcgaact

SEQ ID NO: 789497 - DNA, 25 bp, Mus musculus
tctggttttttctacaaagcgaact

SEQ ID NO: 789498 - DNA, 25 bp, Mus musculus
tctgtaaaaatgaccctgagggaat

SEQ ID NO: 789499 - DNA, 25 bp, Mus musculus
tctgtaaaaatgtccctgagggaat

SEQ ID NO: 789500 - DNA, 25 bp, Mus musculus
tctgtaaaccctacggcagcatccg

SEQ ID NO: 789501 - DNA, 25 bp, Mus musculus
tctgtaaacccttcggcagcatccg

SEQ ID NO: 789502 - DNA, 25 bp, Mus musculus
tctgtaaagcatatcagatgcaact

SEQ ID NO: 789503 - DNA, 25 bp, Mus musculus
tctgtaaagcatttcagatgcaact

SEQ ID NO: 789504 - DNA, 25 bp, Mus musculus
tctgtaaagcgacttctagaagaag

SEQ ID NO: 789505 - DNA, 25 bp, Mus musculus
tctgtaaagcgagttctagaagaag

SEQ ID NO: 789506 - DNA, 25 bp, Mus musculus
tctgtaaagctaaagatgccgagtt

SEQ ID NO: 789507 - DNA, 25 bp, Mus musculus
tctgtaaagctatagatgccgagtt

SEQ ID NO: 789508 - DNA, 25 bp, Mus musculus
tctgtaaaggctatgtggtccctgt

SEQ ID NO: 789509 - DNA, 25 bp, Mus musculus
tctgtaaaggctttgtggtccctgt

SEQ ID NO: 789510 - DNA, 25 bp, Mus musculus
tctgtaaagtatcaaattcccttgg

SEQ ID NO: 789511 - DNA, 25 bp, Mus musculus
tctgtaaagtatgaaattcccttgg

SEQ ID NO: 789512 - DNA, 25 bp, Mus musculus
tctgtaaatagcatcaataagatgt

SEQ ID NO: 789513 - DNA, 25 bp, Mus musculus
tctgtaaatagcttcaataagatgt

SEQ ID NO: 789514 - DNA, 25 bp, Mus musculus
tctgtaaatgctactgccggtccaa

SEQ ID NO: 789515 - DNA, 25 bp, Mus musculus
tctgtaaatgcttctgccggtccaa

SEQ ID NO: 789516 - DNA, 25 bp, Mus musculus
tctgtaacaacaagtttttcattga

SEQ ID NO: 789517 - DNA, 25 bp, Mus musculus
tctgtaacaacatgtttttcattga

SEQ ID NO: 789518 - DNA, 25 bp, Mus musculus
tctgtaacatcaagaatgcttcagc

SEQ ID NO: 789519 - DNA, 25 bp, Mus musculus
tctgtaacatcatgaatgcttcagc

SEQ ID NO: 789520 - DNA, 25 bp, Mus musculus
tctgtaacctggcatataagctcct

SEQ ID NO: 789521 - DNA, 25 bp, Mus musculus
tctgtaacctgggatataagctcct

SEQ ID NO: 789522 - DNA, 25 bp, Mus musculus
tctgtaactagacgtgcgaccgcat

SEQ ID NO: 789523 - DNA, 25 bp, Mus musculus
tctgtaactagaggtgcgaccgcat

SEQ ID NO: 789524 - DNA, 25 bp, Mus musculus
tctgtaactgacaggactgtggctg

SEQ ID NO: 789525 - DNA, 25 bp, Mus musculus
tctgtaactgactggactgtggctg

SEQ ID NO: 789526 - DNA, 25 bp, Mus musculus
tctgtaagcaaacgaagggcctccg

SEQ ID NO: 789527 - DNA, 25 bp, Mus musculus
tctgtaagcaaaggaagggcctccg

SEQ ID NO: 789528 - DNA, 25 bp, Mus musculus
tctgtaagcatcaggagctagacac

SEQ ID NO: 789529 - DNA, 25 bp, Mus musculus
tctgtaagcatctggagctagacac

SEQ ID NO: 789530 - DNA, 25 bp, Mus musculus
tctgtaagccggaacctcttagtgg

SEQ ID NO: 789531 - DNA, 25 bp, Mus musculus
tctgtaagccggtacctcttagtgg

SEQ ID NO: 789532 - DNA, 25 bp, Mus musculus
tctgtaaggagtctccaatcattgg

SEQ ID NO: 789533 - DNA, 25 bp, Mus musculus
tctgtaaggagtgtccaatcattgg

SEQ ID NO: 789534 - DNA, 25 bp, Mus musculus
tctgtaagtcaacggcaaacaccac

SEQ ID NO: 789535 - DNA, 25 bp, Mus musculus
tctgtaagtcaagggcaaacaccac

SEQ ID NO: 789536 - DNA, 25 bp, Mus musculus
tctgtaagtcctcggaggaaactcc

SEQ ID NO: 789537 - DNA, 25 bp, Mus musculus
tctgtaagtcctgggaggaaactcc

SEQ ID NO: 789538 - DNA, 25 bp, Mus musculus
tctgtaagtgacagcaccacacggg

SEQ ID NO: 789539 - DNA, 25 bp, Mus musculus
tctgtaagtgactgcaccacacggg

SEQ ID NO: 789540 - DNA, 25 bp, Mus musculus
tctgtaagttttcgccctgagcaac

SEQ ID NO: 789541 - DNA, 25 bp, Mus musculus
tctgtaagttttggccctgagcaac

SEQ ID NO: 789542 - DNA, 25 bp, Mus musculus
tctgtaatgcagctccgccttgata

SEQ ID NO: 789543 - DNA, 25 bp, Mus musculus
tctgtaatgcaggtccgccttgata

SEQ ID NO: 789544 - DNA, 25 bp, Mus musculus
tctgtaatgcatcgtactgtgactc

SEQ ID NO: 789545 - DNA, 25 bp, Mus musculus
tctgtaatgcatggtactgtgactc

SEQ ID NO: 789546 - DNA, 25 bp, Mus musculus
tctgtaattgggaaagaacttggac

SEQ ID NO: 789547 - DNA, 25 bp, Mus musculus
tctgtaattgggtaagaacttggac

SEQ ID NO: 789548 - DNA, 25 bp, Mus musculus
tctgtaattgtaaaatcctgagggc

SEQ ID NO: 789549 - DNA, 25 bp, Mus musculus
tctgtaattgtataatcctgagggc

SEQ ID NO: 789550 - DNA, 25 bp, Mus musculus
tctgtacaaaaaactcaaagggctg

SEQ ID NO: 789551 - DNA, 25 bp, Mus musculus
tctgtacaaaaatctcaaagggctg

SEQ ID NO: 789552 - DNA, 25 bp, Mus musculus
tctgtacaacgaacagaggctggtt

SEQ ID NO: 789553 - DNA, 25 bp, Mus musculus
tctgtacaacgatcagaggctggtt

SEQ ID NO: 789554 - DNA, 25 bp, Mus musculus
tctgtacaactaccgccacggtggc

SEQ ID NO: 789555 - DNA, 25 bp, Mus musculus
tctgtacaactagcgccacggtggc

SEQ ID NO: 789556 - DNA, 25 bp, Mus musculus
tctgtacaaggaacaatggctctga

SEQ ID NO: 789557 - DNA, 25 bp, Mus musculus
tctgtacaaggatcaatggctctga

SEQ ID NO: 789558 - DNA, 25 bp, Mus musculus
tctgtacaaggtactaggtcttata

SEQ ID NO: 789559 - DNA, 25 bp, Mus musculus
tctgtacaaggttctaggtcttata

SEQ ID NO: 789560 - DNA, 25 bp, Mus musculus
tctgtacatactagtttataacaac

SEQ ID NO: 789561 - DNA, 25 bp, Mus musculus
tctgtacatacttgtttataacaac

SEQ ID NO: 789562 - DNA, 25 bp, Mus musculus
tctgtacatccgaagcactccgaca

SEQ ID NO: 789563 - DNA, 25 bp, Mus musculus
tctgtacatccgtagcactccgaca

SEQ ID NO: 789564 - DNA, 25 bp, Mus musculus
tctgtaccacaacaggctgactcca

SEQ ID NO: 789565 - DNA, 25 bp, Mus musculus
tctgtaccacaagaggctgactcca

SEQ ID NO: 789566 - DNA, 25 bp, Mus musculus
tctgtaccacctccgcattgaggca

SEQ ID NO: 789567 - DNA, 25 bp, Mus musculus
tctgtaccacctgcgcattgaggca

SEQ ID NO: 789568 - DNA, 25 bp, Mus musculus
tctgtaccaggacttctgtgctggg

SEQ ID NO: 789569 - DNA, 25 bp, Mus musculus
tctgtaccaggagttctgtgctggg

SEQ ID NO: 789570 - DNA, 25 bp, Mus musculus
tctgtacccagacattccaaagaag

SEQ ID NO: 789571 - DNA, 25 bp, Mus musculus
tctgtacccagagattccaaagaag

SEQ ID NO: 789572 - DNA, 25 bp, Mus musculus
tctgtacccatcagggcctgagtcc

SEQ ID NO: 789573 - DNA, 25 bp, Mus musculus
tctgtacccatctgggcctgagtcc

SEQ ID NO: 789574 - DNA, 25 bp, Mus musculus
tctgtaccgaggaggcattgcctgg

SEQ ID NO: 789575 - DNA, 25 bp, Mus musculus
tctgtaccgaggtggcattgcctgg

SEQ ID NO: 789576 - DNA, 25 bp, Mus musculus
tctgtaccgatgcaagcagctgaag

SEQ ID NO: 789577 - DNA, 25 bp, Mus musculus
tctgtaccgatggaagcagctgaag

SEQ ID NO: 789578 - DNA, 25 bp, Mus musculus
tctgtaccgttgaggtgaccagccc

SEQ ID NO: 789579 - DNA, 25 bp, Mus musculus
tctgtaccgttgtggtgaccagccc

SEQ ID NO: 789580 - DNA, 25 bp, Mus musculus
tctgtacctggacagccaggaagat

SEQ ID NO: 789581 - DNA, 25 bp, Mus musculus
tctgtacctggagagccaggaagat

SEQ ID NO: 789582 - DNA, 25 bp, Mus musculus
tctgtacgattgacagtggatctga

SEQ ID NO: 789583 - DNA, 25 bp, Mus musculus
tctgtacgattgtcagtggatctga

SEQ ID NO: 789584 - DNA, 25 bp, Mus musculus
tctgtacggcatcgtttggtatgca

SEQ ID NO: 789585 - DNA, 25 bp, Mus musculus
tctgtacggcatggtttggtatgca

SEQ ID NO: 789586 - DNA, 25 bp, Mus musculus
tctgtactccaaccgtgcagcgtgc

SEQ ID NO: 789587 - DNA, 25 bp, Mus musculus
tctgtactccaagcgtgcagcgtgc

SEQ ID NO: 789588 - DNA, 25 bp, Mus musculus
tctgtactccgactgatcgctccta

SEQ ID NO: 789589 - DNA, 25 bp, Mus musculus
tctgtactccgagtgatcgctccta

SEQ ID NO: 789590 - DNA, 25 bp, Mus musculus
tctgtagagcagactcggattccag

SEQ ID NO: 789591 - DNA, 25 bp, Mus musculus
tctgtagagcagtctcggattccag

SEQ ID NO: 789592 - DNA, 25 bp, Mus musculus
tctgtagaggagcaccgagcctcag

SEQ ID NO: 789593 - DNA, 25 bp, Mus musculus
tctgtagaggaggaccgagcctcag

SEQ ID NO: 789594 - DNA, 25 bp, Mus musculus
tctgtagagggaccatcaagggcac

SEQ ID NO: 789595 - DNA, 25 bp, Mus musculus
tctgtagagggagcatcaagggcac

SEQ ID NO: 789596 - DNA, 25 bp, Mus musculus
tctgtagagttgactgtggcttgaa

SEQ ID NO: 789597 - DNA, 25 bp, Mus musculus
tctgtagagttgtctgtggcttgaa

SEQ ID NO: 789598 - DNA, 25 bp, Mus musculus
tctgtagcactcatctaaagtgaac

SEQ ID NO: 789599 - DNA, 25 bp, Mus musculus
tctgtagcactcttctaaagtgaac

SEQ ID NO: 789600 - DNA, 25 bp, Mus musculus
tctgtagcctgacggaccaatgctg

SEQ ID NO: 789601 - DNA, 25 bp, Mus musculus
tctgtagcctgagggaccaatgctg

SEQ ID NO: 789602 - DNA, 25 bp, Mus musculus
tctgtaggaggaaaaggactcagag

SEQ ID NO: 789603 - DNA, 25 bp, Mus musculus
tctgtaggaggataaggactcagag

SEQ ID NO: 789604 - DNA, 25 bp, Mus musculus
tctgtaggataaccatgggaccacc

SEQ ID NO: 789605 - DNA, 25 bp, Mus musculus
tctgtaggataagcatgggaccacc

SEQ ID NO: 789606 - DNA, 25 bp, Mus musculus
tctgtaggtctacttctatggactc

SEQ ID NO: 789607 - DNA, 25 bp, Mus musculus
tctgtaggtctagttctatggactc

SEQ ID NO: 789608 - DNA, 25 bp, Mus musculus
tctgtaggtgaaagggccttgccca

SEQ ID NO: 789609 - DNA, 25 bp, Mus musculus
tctgtaggtgaatgggccttgccca

SEQ ID NO: 789610 - DNA, 25 bp, Mus musculus
tctgtagtgatcctgatggtaaccg

SEQ ID NO: 789611 - DNA, 25 bp, Mus musculus
tctgtagtgatcgtgatggtaaccg

SEQ ID NO: 789612 - DNA, 25 bp, Mus musculus
tctgtagtgtttcccgggcatcaaa

SEQ ID NO: 789613 - DNA, 25 bp, Mus musculus
tctgtagtgtttgccgggcatcaaa

SEQ ID NO: 789614 - DNA, 25 bp, Mus musculus
tctgtagttgcgcacagcttcagac

SEQ ID NO: 789615 - DNA, 25 bp, Mus musculus
tctgtagttgcggacagcttcagac

SEQ ID NO: 789616 - DNA, 25 bp, Mus musculus
tctgtagttggactggcaagatccc

SEQ ID NO: 789617 - DNA, 25 bp, Mus musculus
tctgtagttggagtggcaagatccc

SEQ ID NO: 789618 - DNA, 25 bp, Mus musculus
tctgtataatccacttcatgagcca

SEQ ID NO: 789619 - DNA, 25 bp, Mus musculus
tctgtataatcctcttcatgagcca

SEQ ID NO: 789620 - DNA, 25 bp, Mus musculus
tctgtatacaaaagagtacgtggct

SEQ ID NO: 789621 - DNA, 25 bp, Mus musculus
tctgtatacaaatgagtacgtggct

SEQ ID NO: 789622 - DNA, 25 bp, Mus musculus
tctgtatacttgagtcactctgtgt

SEQ ID NO: 789623 - DNA, 25 bp, Mus musculus
tctgtatacttgtgtcactctgtgt

SEQ ID NO: 789624 - DNA, 25 bp, Mus musculus
tctgtatcctggagattgttgtgtc

SEQ ID NO: 789625 - DNA, 25 bp, Mus musculus
tctgtatcctggtgattgttgtgtc

SEQ ID NO: 789626 - DNA, 25 bp, Mus musculus
tctgtatccttcaggatgagccggc

SEQ ID NO: 789627 - DNA, 25 bp, Mus musculus
tctgtatccttctggatgagccggc

SEQ ID NO: 789628 - DNA, 25 bp, Mus musculus
tctgtatcgaatctccacactggaa

SEQ ID NO: 789629 - DNA, 25 bp, Mus musculus
tctgtatcgaatgtccacactggaa

SEQ ID NO: 789630 - DNA, 25 bp, Mus musculus
tctgtatctcagaaacttcaaagtg

SEQ ID NO: 789631 - DNA, 25 bp, Mus musculus
tctgtatctcagtaacttcaaagtg

SEQ ID NO: 789632 - DNA, 25 bp, Mus musculus
tctgtatgccaacccagacttccag

SEQ ID NO: 789633 - DNA, 25 bp, Mus musculus
tctgtatgccaagccagacttccag

SEQ ID NO: 789634 - DNA, 25 bp, Mus musculus
tctgtatggcacacagggcaacgtg

SEQ ID NO: 789635 - DNA, 25 bp, Mus musculus
tctgtatggcactcagggcaacgtg

SEQ ID NO: 789636 - DNA, 25 bp, Mus musculus
tctgtatggccacacctcaactctg

SEQ ID NO: 789637 - DNA, 25 bp, Mus musculus
tctgtatggccagacctcaactctg

SEQ ID NO: 789638 - DNA, 25 bp, Mus musculus
tctgtatgggaaccctcgtcacggc

SEQ ID NO: 789639 - DNA, 25 bp, Mus musculus
tctgtatgggaacttaagggcctct

SEQ ID NO: 789640 - DNA, 25 bp, Mus musculus
tctgtatgggaagcctcgtcacggc

SEQ ID NO: 789641 - DNA, 25 bp, Mus musculus
tctgtatgggaagttaagggcctct

SEQ ID NO: 789642 - DNA, 25 bp, Mus musculus
tctgtatgtcccagaatgtccatgt

SEQ ID NO: 789643 - DNA, 25 bp, Mus musculus
tctgtatgtccctgaatgtccatgt

SEQ ID NO: 789644 - DNA, 25 bp, Mus musculus
tctgtattgtggctatcttgatcta

SEQ ID NO: 789645 - DNA, 25 bp, Mus musculus
tctgtattgtgggtatcttgatcta

SEQ ID NO: 789646 - DNA, 25 bp, Mus musculus
tctgtcaaaaggctgtagtcagttc

SEQ ID NO: 789647 - DNA, 25 bp, Mus musculus
tctgtcaaaagggtgtagtcagttc

SEQ ID NO: 789648 - DNA, 25 bp, Mus musculus
tctgtcaaagataggcagaagcggt

SEQ ID NO: 789649 - DNA, 25 bp, Mus musculus
tctgtcaaagatccaaagatagctg

SEQ ID NO: 789650 - DNA, 25 bp, Mus musculus
tctgtcaaagatgcaaagatagctg

SEQ ID NO: 789651 - DNA, 25 bp, Mus musculus
tctgtcaaagattggcagaagcggt

SEQ ID NO: 789652 - DNA, 25 bp, Mus musculus
tctgtcaacaaactatcaagcaagg

SEQ ID NO: 789653 - DNA, 25 bp, Mus musculus
tctgtcaacaaagtatcaagcaagg

SEQ ID NO: 789654 - DNA, 25 bp, Mus musculus
tctgtcaacagcaacgtggattcct

SEQ ID NO: 789655 - DNA, 25 bp, Mus musculus
tctgtcaacagctacgtggattcct

SEQ ID NO: 789656 - DNA, 25 bp, Mus musculus
tctgtcaacaggctaaacgcaccaa

SEQ ID NO: 789657 - DNA, 25 bp, Mus musculus
tctgtcaacagggtaaacgcaccaa

SEQ ID NO: 789658 - DNA, 25 bp, Mus musculus
tctgtcaactgtctcgactctccga

SEQ ID NO: 789659 - DNA, 25 bp, Mus musculus
tctgtcaactgtgtcgactctccga

SEQ ID NO: 789660 - DNA, 25 bp, Mus musculus
tctgtcaaggacaggtgcaactgga

SEQ ID NO: 789661 - DNA, 25 bp, Mus musculus
tctgtcaaggactggtgcaactgga

SEQ ID NO: 789662 - DNA, 25 bp, Mus musculus
tctgtcaagggaacggagccgctgt

SEQ ID NO: 789663 - DNA, 25 bp, Mus musculus
tctgtcaagggatcggagccgctgt

SEQ ID NO: 789664 - DNA, 25 bp, Mus musculus
tctgtcaagtacagcagtcatagta

SEQ ID NO: 789665 - DNA, 25 bp, Mus musculus
tctgtcaagtactgcagtcatagta

SEQ ID NO: 789666 - DNA, 25 bp, Mus musculus
tctgtcaagtgtctcatggttctga

SEQ ID NO: 789667 - DNA, 25 bp, Mus musculus
tctgtcaagtgtgtcatggttctga

SEQ ID NO: 789668 - DNA, 25 bp, Mus musculus
tctgtcacaggacaacagtacggac

SEQ ID NO: 789669 - DNA, 25 bp, Mus musculus
tctgtcacaggagaacagtacggac

SEQ ID NO: 789670 - DNA, 25 bp, Mus musculus
tctgtcacatagagcccagagcgtc

SEQ ID NO: 789671 - DNA, 25 bp, Mus musculus
tctgtcacatagtgcccagagcgtc

SEQ ID NO: 789672 - DNA, 25 bp, Mus musculus
tctgtcaccatcagcttcagagtct

SEQ ID NO: 789673 - DNA, 25 bp, Mus musculus
tctgtcaccatctgcttcagagtct

SEQ ID NO: 789674 - DNA, 25 bp, Mus musculus
tctgtcacccaaatccaagaggaac

SEQ ID NO: 789675 - DNA, 25 bp, Mus musculus
tctgtcacccaattccaagaggaac

SEQ ID NO: 789676 - DNA, 25 bp, Mus musculus
tctgtcaccccaagtcggattagag

SEQ ID NO: 789677 - DNA, 25 bp, Mus musculus
tctgtcaccccatgtcggattagag

SEQ ID NO: 789678 - DNA, 25 bp, Mus musculus
tctgtcaccctgatgcgggacccat

SEQ ID NO: 789679 - DNA, 25 bp, Mus musculus
tctgtcaccctgttgcgggacccat

SEQ ID NO: 789680 - DNA, 25 bp, Mus musculus
tctgtcacccttctgggactatttg

SEQ ID NO: 789681 - DNA, 25 bp, Mus musculus
tctgtcacccttgtgggactatttg

SEQ ID NO: 789682 - DNA, 25 bp, Mus musculus
tctgtcacctaaagcagtgaaaatg

SEQ ID NO: 789683 - DNA, 25 bp, Mus musculus
tctgtcacctaatgcagtgaaaatg

SEQ ID NO: 789684 - DNA, 25 bp, Mus musculus
tctgtcacttcaacgagcctgtgta

SEQ ID NO: 789685 - DNA, 25 bp, Mus musculus
tctgtcacttcatcgagcctgtgta

SEQ ID NO: 789686 - DNA, 25 bp, Mus musculus
tctgtcagaaaccatggcagccctg

SEQ ID NO: 789687 - DNA, 25 bp, Mus musculus
tctgtcagaaacgatggcagccctg

SEQ ID NO: 789688 - DNA, 25 bp, Mus musculus
tctgtcagaagacaagctgtcggaa

SEQ ID NO: 789689 - DNA, 25 bp, Mus musculus
tctgtcagaagagaagctgtcggaa

SEQ ID NO: 789690 - DNA, 25 bp, Mus musculus
tctgtcagactaagtggcaagtact

SEQ ID NO: 789691 - DNA, 25 bp, Mus musculus
tctgtcagactatgtggcaagtact

SEQ ID NO: 789692 - DNA, 25 bp, Mus musculus
tctgtcagattcaggcactgagaag

SEQ ID NO: 789693 - DNA, 25 bp, Mus musculus
tctgtcagattctggcactgagaag

SEQ ID NO: 789694 - DNA, 25 bp, Mus musculus
tctgtcaggaaaacaatttaggttc

SEQ ID NO: 789695 - DNA, 25 bp, Mus musculus
tctgtcaggaaatcaatttaggttc

SEQ ID NO: 789696 - DNA, 25 bp, Mus musculus
tctgtcaggcatcacaagcatggcc

SEQ ID NO: 789697 - DNA, 25 bp, Mus musculus
tctgtcaggcatgacaagcatggcc

SEQ ID NO: 789698 - DNA, 25 bp, Mus musculus
tctgtcaggcccctttctaatgaga

SEQ ID NO: 789699 - DNA, 25 bp, Mus musculus
tctgtcaggcccgtttctaatgaga

SEQ ID NO: 789700 - DNA, 25 bp, Mus musculus
tctgtcagtgagaagacacctcttc

SEQ ID NO: 789701 - DNA, 25 bp, Mus musculus
tctgtcagtgagtagacacctcttc

SEQ ID NO: 789702 - DNA, 25 bp, Mus musculus
tctgtcagtgtaagccccaggagag

SEQ ID NO: 789703 - DNA, 25 bp, Mus musculus
tctgtcagtgtatgccccaggagag

SEQ ID NO: 789704 - DNA, 25 bp, Mus musculus
tctgtcatagccctggtatcaagct

SEQ ID NO: 789705 - DNA, 25 bp, Mus musculus
tctgtcatagccgtggtatcaagct

SEQ ID NO: 789706 - DNA, 25 bp, Mus musculus
tctgtcatcccgcaggcggtagaac

SEQ ID NO: 789707 - DNA, 25 bp, Mus musculus
tctgtcatcccggaggcggtagaac

SEQ ID NO: 789708 - DNA, 25 bp, Mus musculus
tctgtcatctaacatgtctcccaaa

SEQ ID NO: 789709 - DNA, 25 bp, Mus musculus
tctgtcatctaagatgtctcccaaa

SEQ ID NO: 789710 - DNA, 25 bp, Mus musculus
tctgtcatctcacggctcaggaggt

SEQ ID NO: 789711 - DNA, 25 bp, Mus musculus
tctgtcatctcagggctcaggaggt

SEQ ID NO: 789712 - DNA, 25 bp, Mus musculus
tctgtcatgatgaagctagagcacc

SEQ ID NO: 789713 - DNA, 25 bp, Mus musculus
tctgtcatgatgtagctagagcacc

SEQ ID NO: 789714 - DNA, 25 bp, Mus musculus
tctgtcattgggaactgctgcaccc

SEQ ID NO: 789715 - DNA, 25 bp, Mus musculus
tctgtcattgggtactgctgcaccc

SEQ ID NO: 789716 - DNA, 25 bp, Mus musculus
tctgtccaagaccaacacgatgggc

SEQ ID NO: 789717 - DNA, 25 bp, Mus musculus
tctgtccaagacgaacacgatgggc

SEQ ID NO: 789718 - DNA, 25 bp, Mus musculus
tctgtccaaggtactaggtctgagg

SEQ ID NO: 789719 - DNA, 25 bp, Mus musculus
tctgtccaaggttctaggtctgagg

SEQ ID NO: 789720 - DNA, 25 bp, Mus musculus
tctgtccacattatgtgggacatgg

SEQ ID NO: 789721 - DNA, 25 bp, Mus musculus
tctgtccacattttgtgggacatgg

SEQ ID NO: 789722 - DNA, 25 bp, Mus musculus
tctgtccactgaagacatgaagtcc

SEQ ID NO: 789723 - DNA, 25 bp, Mus musculus
tctgtccactgatgacatgaagtcc

SEQ ID NO: 789724 - DNA, 25 bp, Mus musculus
tctgtccactgtctagggcatccta

SEQ ID NO: 789725 - DNA, 25 bp, Mus musculus
tctgtccactgtgtagggcatccta

SEQ ID NO: 789726 - DNA, 25 bp, Mus musculus
tctgtccagaggacaaaggccaagc

SEQ ID NO: 789727 - DNA, 25 bp, Mus musculus
tctgtccagaggtcaaaggccaagc

SEQ ID NO: 789728 - DNA, 25 bp, Mus musculus
tctgtccatccacaaaggagggtgc

SEQ ID NO: 789729 - DNA, 25 bp, Mus musculus
tctgtccatccagaaaggagggtgc

SEQ ID NO: 789730 - DNA, 25 bp, Mus musculus
tctgtccattgaatccaggcctcag

SEQ ID NO: 789731 - DNA, 25 bp, Mus musculus
tctgtccattgacacttccaactga

SEQ ID NO: 789732 - DNA, 25 bp, Mus musculus
tctgtccattgagacttccaactga

SEQ ID NO: 789733 - DNA, 25 bp, Mus musculus
tctgtccattgattccaggcctcag

SEQ ID NO: 789734 - DNA, 25 bp, Mus musculus
tctgtcccaaaaacaagcggaattt

SEQ ID NO: 789735 - DNA, 25 bp, Mus musculus
tctgtcccaaaatcaagcggaattt

SEQ ID NO: 789736 - DNA, 25 bp, Mus musculus
tctgtcccacagcaccaggaggtgc

SEQ ID NO: 789737 - DNA, 25 bp, Mus musculus
tctgtcccacaggaccaggaggtgc

SEQ ID NO: 789738 - DNA, 25 bp, Mus musculus
tctgtcccaggcatttaaatttcct

SEQ ID NO: 789739 - DNA, 25 bp, Mus musculus
tctgtcccaggcttttaaatttcct

SEQ ID NO: 789740 - DNA, 25 bp, Mus musculus
tctgtccccaggattatacatgctg

SEQ ID NO: 789741 - DNA, 25 bp, Mus musculus
tctgtccccaggctcatcggttggt

SEQ ID NO: 789742 - DNA, 25 bp, Mus musculus
tctgtccccagggtcatcggttggt

SEQ ID NO: 789743 - DNA, 25 bp, Mus musculus
tctgtccccaggtttatacatgctg

SEQ ID NO: 789744 - DNA, 25 bp, Mus musculus
tctgtccccttgctctttcagaatg

SEQ ID NO: 789745 - DNA, 25 bp, Mus musculus
tctgtccccttggtctttcagaatg

SEQ ID NO: 789746 - DNA, 25 bp, Mus musculus
tctgtccctgagcaaatggccctgc

SEQ ID NO: 789747 - DNA, 25 bp, Mus musculus
tctgtccctgaggaaatggccctgc

SEQ ID NO: 789748 - DNA, 25 bp, Mus musculus
tctgtccgatggaccggtttgcaag

SEQ ID NO: 789749 - DNA, 25 bp, Mus musculus
tctgtccgatggtccggtttgcaag

SEQ ID NO: 789750 - DNA, 25 bp, Mus musculus
tctgtccggcagcaggatgctcccg

SEQ ID NO: 789751 - DNA, 25 bp, Mus musculus
tctgtccggcaggaggatgctcccg

SEQ ID NO: 789752 - DNA, 25 bp, Mus musculus
tctgtcctcagtcctcttaggtttt

SEQ ID NO: 789753 - DNA, 25 bp, Mus musculus
tctgtcctcagtgctcttaggtttt

SEQ ID NO: 789754 - DNA, 25 bp, Mus musculus
tctgtcctccggctggtagatgcac

SEQ ID NO: 789755 - DNA, 25 bp, Mus musculus
tctgtcctccgggtggtagatgcac

SEQ ID NO: 789756 - DNA, 25 bp, Mus musculus
tctgtcctccttatgtttggcagct

SEQ ID NO: 789757 - DNA, 25 bp, Mus musculus
tctgtcctccttttgtttggcagct

SEQ ID NO: 789758 - DNA, 25 bp, Mus musculus
tctgtcctcgccatctgtcgattat

SEQ ID NO: 789759 - DNA, 25 bp, Mus musculus
tctgtcctcgccttctgtcgattat

SEQ ID NO: 789760 - DNA, 25 bp, Mus musculus
tctgtcctctggcattcctctttgc

SEQ ID NO: 789761 - DNA, 25 bp, Mus musculus
tctgtcctctgggattcctctttgc

SEQ ID NO: 789762 - DNA, 25 bp, Mus musculus
tctgtcctgaaacgtaaggtagaca

SEQ ID NO: 789763 - DNA, 25 bp, Mus musculus
tctgtcctgaaaggtaaggtagaca

SEQ ID NO: 789764 - DNA, 25 bp, Mus musculus
tctgtcctgactcgaatctgctgtg

SEQ ID NO: 789765 - DNA, 25 bp, Mus musculus
tctgtcctgactggaatctgctgtg

SEQ ID NO: 789766 - DNA, 25 bp, Mus musculus
tctgtcctgctgctggagcaagcgc

SEQ ID NO: 789767 - DNA, 25 bp, Mus musculus
tctgtcctgctggtggagcaagcgc

SEQ ID NO: 789768 - DNA, 25 bp, Mus musculus
tctgtcctggaaatgccaaccacag

SEQ ID NO: 789769 - DNA, 25 bp, Mus musculus
tctgtcctggaattgccaaccacag

SEQ ID NO: 789770 - DNA, 25 bp, Mus musculus
tctgtccttgcccattcctggcaag

SEQ ID NO: 789771 - DNA, 25 bp, Mus musculus
tctgtccttgccgattcctggcaag

SEQ ID NO: 789772 - DNA, 25 bp, Mus musculus
tctgtcgaaggcacagccctcgaat

SEQ ID NO: 789773 - DNA, 25 bp, Mus musculus
tctgtcgaaggctcagccctcgaat

SEQ ID NO: 789774 - DNA, 25 bp, Mus musculus
tctgtcgagccaccaatttcatagg

SEQ ID NO: 789775 - DNA, 25 bp, Mus musculus
tctgtcgagccagcaatttcatagg

SEQ ID NO: 789776 - DNA, 25 bp, Mus musculus
tctgtcgcacagatgaccatataat

SEQ ID NO: 789777 - DNA, 25 bp, Mus musculus
tctgtcgcacagttgaccatataat

SEQ ID NO: 789778 - DNA, 25 bp, Mus musculus
tctgtcgccagtcaagtcctcggaa

SEQ ID NO: 789779 - DNA, 25 bp, Mus musculus
tctgtcgccagtgaagtcctcggaa

SEQ ID NO: 789780 - DNA, 25 bp, Mus musculus
tctgtcgctttaaccagcagctcaa

SEQ ID NO: 789781 - DNA, 25 bp, Mus musculus
tctgtcgctttatccagcagctcaa

SEQ ID NO: 789782 - DNA, 25 bp, Mus musculus
tctgtcgctttcaggactgctgcag

SEQ ID NO: 789783 - DNA, 25 bp, Mus musculus
tctgtcgctttctggactgctgcag

SEQ ID NO: 789784 - DNA, 25 bp, Mus musculus
tctgtcggagcgctcggatccctct

SEQ ID NO: 789785 - DNA, 25 bp, Mus musculus
tctgtcggagcggtcggatccctct

SEQ ID NO: 789786 - DNA, 25 bp, Mus musculus
tctgtcggatttccccaaattggat

SEQ ID NO: 789787 - DNA, 25 bp, Mus musculus
tctgtcggatttgcccaaattggat

SEQ ID NO: 789788 - DNA, 25 bp, Mus musculus
tctgtcggccgtcttgaccgcggtt

SEQ ID NO: 789789 - DNA, 25 bp, Mus musculus
tctgtcggccgtgttgaccgcggtt

SEQ ID NO: 789790 - DNA, 25 bp, Mus musculus
tctgtcgggacaccttggcctgtca

SEQ ID NO: 789791 - DNA, 25 bp, Mus musculus
tctgtcgggacagcttggcctgtca

SEQ ID NO: 789792 - DNA, 25 bp, Mus musculus
tctgtcgggatcagaaagaactcag

SEQ ID NO: 789793 - DNA, 25 bp, Mus musculus
tctgtcgggatctgaaagaactcag

SEQ ID NO: 789794 - DNA, 25 bp, Mus musculus
tctgtcgggtacaaagaagagtagc

SEQ ID NO: 789795 - DNA, 25 bp, Mus musculus
tctgtcgggtactaagaagagtagc

SEQ ID NO: 789796 - DNA, 25 bp, Mus musculus
tctgtcgtccaccatcgagtgagga

SEQ ID NO: 789797 - DNA, 25 bp, Mus musculus
tctgtcgtccacgatcgagtgagga

SEQ ID NO: 789798 - DNA, 25 bp, Mus musculus
tctgtcgtgattactggccggtcac

SEQ ID NO: 789799 - DNA, 25 bp, Mus musculus
tctgtcgtgatttctggccggtcac

SEQ ID NO: 789800 - DNA, 25 bp, Mus musculus
tctgtcgttgttcttgaagctgtgg

SEQ ID NO: 789801 - DNA, 25 bp, Mus musculus
tctgtcgttgttgttgaagctgtgg

SEQ ID NO: 789802 - DNA, 25 bp, Mus musculus
tctgtctagataactaatgatgctt

SEQ ID NO: 789803 - DNA, 25 bp, Mus musculus
tctgtctagatatctaatgatgctt

SEQ ID NO: 789804 - DNA, 25 bp, Mus musculus
tctgtctataagaaatccatatgga

SEQ ID NO: 789805 - DNA, 25 bp, Mus musculus
tctgtctataagtaatccatatgga

SEQ ID NO: 789806 - DNA, 25 bp, Mus musculus
tctgtctatcccctgtggctctgta

SEQ ID NO: 789807 - DNA, 25 bp, Mus musculus
tctgtctatcccgtgtggctctgta

SEQ ID NO: 789808 - DNA, 25 bp, Mus musculus
tctgtctcatgtatcgcgtgggcga

SEQ ID NO: 789809 - DNA, 25 bp, Mus musculus
tctgtctcatgtttcgcgtgggcga

SEQ ID NO: 789810 - DNA, 25 bp, Mus musculus
tctgtctccactcggtggctattct

SEQ ID NO: 789811 - DNA, 25 bp, Mus musculus
tctgtctccactgggtggctattct

SEQ ID NO: 789812 - DNA, 25 bp, Mus musculus
tctgtctccgtcatcaagcatactg

SEQ ID NO: 789813 - DNA, 25 bp, Mus musculus
tctgtctccgtcttcaagcatactg

SEQ ID NO: 789814 - DNA, 25 bp, Mus musculus
tctgtctcctatctgggtgccatgg

SEQ ID NO: 789815 - DNA, 25 bp, Mus musculus
tctgtctcctatgtgggtgccatgg

SEQ ID NO: 789816 - DNA, 25 bp, Mus musculus
tctgtctcctgaaacgagaattgga

SEQ ID NO: 789817 - DNA, 25 bp, Mus musculus
tctgtctcctgatacgagaattgga

SEQ ID NO: 789818 - DNA, 25 bp, Mus musculus
tctgtctcctgtccctattttccaa

SEQ ID NO: 789819 - DNA, 25 bp, Mus musculus
tctgtctcctgtgcctattttccaa

SEQ ID NO: 789820 - DNA, 25 bp, Mus musculus
tctgtctcgagacctgaagacactc

SEQ ID NO: 789821 - DNA, 25 bp, Mus musculus
tctgtctcgagagctgaagacactc

SEQ ID NO: 789822 - DNA, 25 bp, Mus musculus
tctgtctgagggcaggtaaaaacag

SEQ ID NO: 789823 - DNA, 25 bp, Mus musculus
tctgtctgaggggaggtaaaaacag

SEQ ID NO: 789824 - DNA, 25 bp, Mus musculus
tctgtctgatgtagcccatgtggaa

SEQ ID NO: 789825 - DNA, 25 bp, Mus musculus
tctgtctgatgttgcccatgtggaa

SEQ ID NO: 789826 - DNA, 25 bp, Mus musculus
tctgtctgcaacagcggcaagggag

SEQ ID NO: 789827 - DNA, 25 bp, Mus musculus
tctgtctgcaactgcggcaagggag

SEQ ID NO: 789828 - DNA, 25 bp, Mus musculus
tctgtctgcatactccggcgtcatt

SEQ ID NO: 789829 - DNA, 25 bp, Mus musculus
tctgtctgcatagtccggcgtcatt

SEQ ID NO: 789830 - DNA, 25 bp, Mus musculus
tctgtctggacccaataaagattca

SEQ ID NO: 789831 - DNA, 25 bp, Mus musculus
tctgtctggaccgaataaagattca

SEQ ID NO: 789832 - DNA, 25 bp, Mus musculus
tctgtctggataagtgtggccggcc

SEQ ID NO: 789833 - DNA, 25 bp, Mus musculus
tctgtctggatatgtgtggccggcc

SEQ ID NO: 789834 - DNA, 25 bp, Mus musculus
tctgtctgtacgattgtcagtggat

SEQ ID NO: 789835 - DNA, 25 bp, Mus musculus
tctgtctgtacgtttgtcagtggat

SEQ ID NO: 789836 - DNA, 25 bp, Mus musculus
tctgtctgtaggaccaggacaggtc

SEQ ID NO: 789837 - DNA, 25 bp, Mus musculus
tctgtctgtaggtccaggacaggtc

SEQ ID NO: 789838 - DNA, 25 bp, Mus musculus
tctgtctgtatgagtgggtatgcct

SEQ ID NO: 789839 - DNA, 25 bp, Mus musculus
tctgtctgtatgtgtgggtatgcct

SEQ ID NO: 789840 - DNA, 25 bp, Mus musculus
tctgtctgtctgcatagtccggcgt

SEQ ID NO: 789841 - DNA, 25 bp, Mus musculus
tctgtctgtctggatagtccggcgt

SEQ ID NO: 789842 - DNA, 25 bp, Mus musculus
tctgtctgtggcagcacgacagtga

SEQ ID NO: 789843 - DNA, 25 bp, Mus musculus
tctgtctgtggctgcacgacagtga

SEQ ID NO: 789844 - DNA, 25 bp, Mus musculus
tctgtcttaagaagctttggccaaa

SEQ ID NO: 789845 - DNA, 25 bp, Mus musculus
tctgtcttaagatgctttggccaaa

SEQ ID NO: 789846 - DNA, 25 bp, Mus musculus
tctgtcttagggagtgagctacttt

SEQ ID NO: 789847 - DNA, 25 bp, Mus musculus
tctgtcttagggtgtgagctacttt

SEQ ID NO: 789848 - DNA, 25 bp, Mus musculus
tctgtcttcagcacgatgtacctga

SEQ ID NO: 789849 - DNA, 25 bp, Mus musculus
tctgtcttcagctcgatgtacctga

SEQ ID NO: 789850 - DNA, 25 bp, Mus musculus
tctgtcttccataggaagccctggg

SEQ ID NO: 789851 - DNA, 25 bp, Mus musculus
tctgtcttccattggaagccctggg

SEQ ID NO: 789852 - DNA, 25 bp, Mus musculus
tctgtcttcggtcctccaattttaa

SEQ ID NO: 789853 - DNA, 25 bp, Mus musculus
tctgtcttcggtgctccaattttaa

SEQ ID NO: 789854 - DNA, 25 bp, Mus musculus
tctgtcttgcaaagccctttgtaga

SEQ ID NO: 789855 - DNA, 25 bp, Mus musculus
tctgtcttgcaatgccctttgtaga

SEQ ID NO: 789856 - DNA, 25 bp, Mus musculus
tctgtcttggctatcagaagaccag

SEQ ID NO: 789857 - DNA, 25 bp, Mus musculus
tctgtcttggctttcagaagaccag

SEQ ID NO: 789858 - DNA, 25 bp, Mus musculus
tctgtctttgctaggaggttctccc

SEQ ID NO: 789859 - DNA, 25 bp, Mus musculus
tctgtctttgcttggaggttctccc

SEQ ID NO: 789860 - DNA, 25 bp, Mus musculus
tctgtctttggcagggtgatgcaaa

SEQ ID NO: 789861 - DNA, 25 bp, Mus musculus
tctgtctttggctgggtgatgcaaa

SEQ ID NO: 789862 - DNA, 25 bp, Mus musculus
tctgtcttttagctgtctgccttat

SEQ ID NO: 789863 - DNA, 25 bp, Mus musculus
tctgtcttttaggtgtctgccttat

SEQ ID NO: 789864 - DNA, 25 bp, Mus musculus
tctgtcttttctcccaactcttttg

SEQ ID NO: 789865 - DNA, 25 bp, Mus musculus
tctgtcttttctgccaactcttttg

SEQ ID NO: 789866 - DNA, 25 bp, Mus musculus
tctgtgaaaaatctagacgaagcca

SEQ ID NO: 789867 - DNA, 25 bp, Mus musculus
tctgtgaaaaatgtagacgaagcca

SEQ ID NO: 789868 - DNA, 25 bp, Mus musculus
tctgtgaaaacgcaaggctggcttc

SEQ ID NO: 789869 - DNA, 25 bp, Mus musculus
tctgtgaaaacggaaggctggcttc

SEQ ID NO: 789870 - DNA, 25 bp, Mus musculus
tctgtgaaaaggcacgctgatctgt

SEQ ID NO: 789871 - DNA, 25 bp, Mus musculus
tctgtgaaaagggacgctgatctgt

SEQ ID NO: 789872 - DNA, 25 bp, Mus musculus
tctgtgaaacaccatgggccatagc

SEQ ID NO: 789873 - DNA, 25 bp, Mus musculus
tctgtgaaacacgatgggccatagc

SEQ ID NO: 789874 - DNA, 25 bp, Mus musculus
tctgtgaaactaagaagaatgttac

SEQ ID NO: 789875 - DNA, 25 bp, Mus musculus
tctgtgaaactatgaagaatgttac

SEQ ID NO: 789876 - DNA, 25 bp, Mus musculus
tctgtgaacagtcgaagtagcagca

SEQ ID NO: 789877 - DNA, 25 bp, Mus musculus
tctgtgaacagtggaagtagcagca

SEQ ID NO: 789878 - DNA, 25 bp, Mus musculus
tctgtgaacttgctcaggacaagga

SEQ ID NO: 789879 - DNA, 25 bp, Mus musculus
tctgtgaacttggtcaggacaagga

SEQ ID NO: 789880 - DNA, 25 bp, Mus musculus
tctgtgaactttcggctaaggtaca

SEQ ID NO: 789881 - DNA, 25 bp, Mus musculus
tctgtgaactttgggctaaggtaca

SEQ ID NO: 789882 - DNA, 25 bp, Mus musculus
tctgtgaagagtatataccagtcat

SEQ ID NO: 789883 - DNA, 25 bp, Mus musculus
tctgtgaagagtttataccagtcat

SEQ ID NO: 789884 - DNA, 25 bp, Mus musculus
tctgtgaaggcgcacttcttcctgg

SEQ ID NO: 789885 - DNA, 25 bp, Mus musculus
tctgtgaaggcggacttcttcctgg

SEQ ID NO: 789886 - DNA, 25 bp, Mus musculus
tctgtgaagtggagtacaaggtcaa

SEQ ID NO: 789887 - DNA, 25 bp, Mus musculus
tctgtgaagtggtgtacaaggtcaa

SEQ ID NO: 789888 - DNA, 25 bp, Mus musculus
tctgtgaatattctgctcgggcctt

SEQ ID NO: 789889 - DNA, 25 bp, Mus musculus
tctgtgaatattgtgctcgggcctt

SEQ ID NO: 789890 - DNA, 25 bp, Mus musculus
tctgtgaattgaagaaacgggtcat

SEQ ID NO: 789891 - DNA, 25 bp, Mus musculus
tctgtgaattgatgaaacgggtcat

SEQ ID NO: 789892 - DNA, 25 bp, Mus musculus
tctgtgacaaatatagtggccatcc

SEQ ID NO: 789893 - DNA, 25 bp, Mus musculus
tctgtgacaaatttagtggccatcc

SEQ ID NO: 789894 - DNA, 25 bp, Mus musculus
tctgtgacaacacggacggctcctt

SEQ ID NO: 789895 - DNA, 25 bp, Mus musculus
tctgtgacaacagggacggctcctt

SEQ ID NO: 789896 - DNA, 25 bp, Mus musculus
tctgtgacaagtctgtaactgcccc

SEQ ID NO: 789897 - DNA, 25 bp, Mus musculus
tctgtgacaagtgtgtaactgcccc

SEQ ID NO: 789898 - DNA, 25 bp, Mus musculus
tctgtgacacccaagaatgcgctgg

SEQ ID NO: 789899 - DNA, 25 bp, Mus musculus
tctgtgacaccctagaatgcgctgg

SEQ ID NO: 789900 - DNA, 25 bp, Mus musculus
tctgtgacagccagtgttagcatct

SEQ ID NO: 789901 - DNA, 25 bp, Mus musculus
tctgtgacagcctgtgttagcatct

SEQ ID NO: 789902 - DNA, 25 bp, Mus musculus
tctgtgacagcgaattggctaccaa

SEQ ID NO: 789903 - DNA, 25 bp, Mus musculus
tctgtgacagcgtattggctaccaa

SEQ ID NO: 789904 - DNA, 25 bp, Mus musculus
tctgtgacagctaaacttgaacaag

SEQ ID NO: 789905 - DNA, 25 bp, Mus musculus
tctgtgacagcttaacttgaacaag

SEQ ID NO: 789906 - DNA, 25 bp, Mus musculus
tctgtgacatgaacgccattcagat

SEQ ID NO: 789907 - DNA, 25 bp, Mus musculus
tctgtgacatgatcgccattcagat

SEQ ID NO: 789908 - DNA, 25 bp, Mus musculus
tctgtgaccagtcagagctactctc

SEQ ID NO: 789909 - DNA, 25 bp, Mus musculus
tctgtgaccagtgagagctactctc

SEQ ID NO: 789910 - DNA, 25 bp, Mus musculus
tctgtgacccttacctgcagtgtgg

SEQ ID NO: 789911 - DNA, 25 bp, Mus musculus
tctgtgaccctttcctgcagtgtgg

SEQ ID NO: 789912 - DNA, 25 bp, Mus musculus
tctgtgacctcgatggccaaactct

SEQ ID NO: 789913 - DNA, 25 bp, Mus musculus
tctgtgacctcgttggccaaactct

SEQ ID NO: 789914 - DNA, 25 bp, Mus musculus
tctgtgacgaccctactgttgtggc

SEQ ID NO: 789915 - DNA, 25 bp, Mus musculus
tctgtgacgaccgtactgttgtggc

SEQ ID NO: 789916 - DNA, 25 bp, Mus musculus
tctgtgacgctgaacactgctggag

SEQ ID NO: 789917 - DNA, 25 bp, Mus musculus
tctgtgacgctgtacactgctggag

SEQ ID NO: 789918 - DNA, 25 bp, Mus musculus
tctgtgacggcgaggcagactgcaa

SEQ ID NO: 789919 - DNA, 25 bp, Mus musculus
tctgtgacggcgtggcagactgcaa

SEQ ID NO: 789920 - DNA, 25 bp, Mus musculus
tctgtgactatgataagatcaacct

SEQ ID NO: 789921 - DNA, 25 bp, Mus musculus
tctgtgactatgttaagatcaacct

SEQ ID NO: 789922 - DNA, 25 bp, Mus musculus
tctgtgactccacagggaggaccag

SEQ ID NO: 789923 - DNA, 25 bp, Mus musculus
tctgtgactccagagggaggaccag

SEQ ID NO: 789924 - DNA, 25 bp, Mus musculus
tctgtgactcccagattacccgtgg

SEQ ID NO: 789925 - DNA, 25 bp, Mus musculus
tctgtgactccctgattacccgtgg

SEQ ID NO: 789926 - DNA, 25 bp, Mus musculus
tctgtgactgcgagggccagaatga

SEQ ID NO: 789927 - DNA, 25 bp, Mus musculus
tctgtgactgcgtgggccagaatga

SEQ ID NO: 789928 - DNA, 25 bp, Mus musculus
tctgtgacttcgctgcctcgcggtt

SEQ ID NO: 789929 - DNA, 25 bp, Mus musculus
tctgtgacttcggtgcctcgcggtt

SEQ ID NO: 789930 - DNA, 25 bp, Mus musculus
tctgtgagacacaaggagacaggtt

SEQ ID NO: 789931 - DNA, 25 bp, Mus musculus
tctgtgagacactaggagacaggtt

SEQ ID NO: 789932 - DNA, 25 bp, Mus musculus
tctgtgagaccgctatcctcatcgc

SEQ ID NO: 789933 - DNA, 25 bp, Mus musculus
tctgtgagaccggtatcctcatcgc

SEQ ID NO: 789934 - DNA, 25 bp, Mus musculus
tctgtgagccagaccactctggagg

SEQ ID NO: 789935 - DNA, 25 bp, Mus musculus
tctgtgagccagtccactctggagg

SEQ ID NO: 789936 - DNA, 25 bp, Mus musculus
tctgtgagccctcgaaaggcgtgcc

SEQ ID NO: 789937 - DNA, 25 bp, Mus musculus
tctgtgagccctggaaaggcgtgcc

SEQ ID NO: 789938 - DNA, 25 bp, Mus musculus
tctgtgaggcccataaagtcctggg

SEQ ID NO: 789939 - DNA, 25 bp, Mus musculus
tctgtgaggcccttaaagtcctggg

SEQ ID NO: 789940 - DNA, 25 bp, Mus musculus
tctgtgaggctacctctcatggagt

SEQ ID NO: 789941 - DNA, 25 bp, Mus musculus
tctgtgaggctagctctcatggagt

SEQ ID NO: 789942 - DNA, 25 bp, Mus musculus
tctgtgagtaccagtgtgcagcctc

SEQ ID NO: 789943 - DNA, 25 bp, Mus musculus
tctgtgagtacctgtgtgcagcctc

SEQ ID NO: 789944 - DNA, 25 bp, Mus musculus
tctgtgagtgaacacgtccatgtcc

SEQ ID NO: 789945 - DNA, 25 bp, Mus musculus
tctgtgagtgaagacgtccatgtcc

SEQ ID NO: 789946 - DNA, 25 bp, Mus musculus
tctgtgatcagacatagcctatacg

SEQ ID NO: 789947 - DNA, 25 bp, Mus musculus
tctgtgatcagagatagcctatacg

SEQ ID NO: 789948 - DNA, 25 bp, Mus musculus
tctgtgatcgcacagaggcccagct

SEQ ID NO: 789949 - DNA, 25 bp, Mus musculus
tctgtgatcgcagagaggcccagct

SEQ ID NO: 789950 - DNA, 25 bp, Mus musculus
tctgtgatcggcatgaactagcaag

SEQ ID NO: 789951 - DNA, 25 bp, Mus musculus
tctgtgatcggcttgaactagcaag

SEQ ID NO: 789952 - DNA, 25 bp, Mus musculus
tctgtgatgacaatgaatggatgac

SEQ ID NO: 789953 - DNA, 25 bp, Mus musculus
tctgtgatgacattgaatggatgac

SEQ ID NO: 789954 - DNA, 25 bp, Mus musculus
tctgtgatgagaacggctctaaggg

SEQ ID NO: 789955 - DNA, 25 bp, Mus musculus
tctgtgatgagatcggctctaaggg

SEQ ID NO: 789956 - DNA, 25 bp, Mus musculus
tctgtgatgaggctttcacactcac

SEQ ID NO: 789957 - DNA, 25 bp, Mus musculus
tctgtgatgagggtttcacactcac

SEQ ID NO: 789958 - DNA, 25 bp, Mus musculus
tctgtgatgatactgctattttggt

SEQ ID NO: 789959 - DNA, 25 bp, Mus musculus
tctgtgatgatagtgctattttggt

SEQ ID NO: 789960 - DNA, 25 bp, Mus musculus
tctgtgatgcacaggcagactcacc

SEQ ID NO: 789961 - DNA, 25 bp, Mus musculus
tctgtgatgcactggcagactcacc

SEQ ID NO: 789962 - DNA, 25 bp, Mus musculus
tctgtgatgccaagagtatcgatga

SEQ ID NO: 789963 - DNA, 25 bp, Mus musculus
tctgtgatgccatgagtatcgatga

SEQ ID NO: 789964 - DNA, 25 bp, Mus musculus
tctgtgatggcaatgcggacactgt

SEQ ID NO: 789965 - DNA, 25 bp, Mus musculus
tctgtgatggcattgcggacactgt

SEQ ID NO: 789966 - DNA, 25 bp, Mus musculus
tctgtgatgtgtcacatgtgctgac

SEQ ID NO: 789967 - DNA, 25 bp, Mus musculus
tctgtgatgtgtgacatgtgctgac

SEQ ID NO: 789968 - DNA, 25 bp, Mus musculus
tctgtgattctgagggcagtgccca

SEQ ID NO: 789969 - DNA, 25 bp, Mus musculus
tctgtgattctgtgggcagtgccca

SEQ ID NO: 789970 - DNA, 25 bp, Mus musculus
tctgtgattttgctaggagatatag

SEQ ID NO: 789971 - DNA, 25 bp, Mus musculus
tctgtgattttggtaggagatatag

SEQ ID NO: 789972 - DNA, 25 bp, Mus musculus
tctgtgatttttcctgacaagccag

SEQ ID NO: 789973 - DNA, 25 bp, Mus musculus
tctgtgatttttgctgacaagccag

SEQ ID NO: 789974 - DNA, 25 bp, Mus musculus
tctgtgcaaaacatgttacactggg

SEQ ID NO: 789975 - DNA, 25 bp, Mus musculus
tctgtgcaaaacttgttacactggg

SEQ ID NO: 789976 - DNA, 25 bp, Mus musculus
tctgtgcaaagccactgtgtcatcg

SEQ ID NO: 789977 - DNA, 25 bp, Mus musculus
tctgtgcaaagcgactgtgtcatcg

SEQ ID NO: 789978 - DNA, 25 bp, Mus musculus
tctgtgcaagtaacaggctgatttc

SEQ ID NO: 789979 - DNA, 25 bp, Mus musculus
tctgtgcaagtatcaggctgatttc

SEQ ID NO: 789980 - DNA, 25 bp, Mus musculus
tctgtgcacgccctcaccggtgtgg

SEQ ID NO: 789981 - DNA, 25 bp, Mus musculus
tctgtgcacgccgtcaccggtgtgg

SEQ ID NO: 789982 - DNA, 25 bp, Mus musculus
tctgtgcacgtaaagagactagctt

SEQ ID NO: 789983 - DNA, 25 bp, Mus musculus
tctgtgcacgtatagagactagctt

SEQ ID NO: 789984 - DNA, 25 bp, Mus musculus
tctgtgcagcagagaagacaatacc

SEQ ID NO: 789985 - DNA, 25 bp, Mus musculus
tctgtgcagcagtgaagacaatacc

SEQ ID NO: 789986 - DNA, 25 bp, Mus musculus
tctgtgcagcctagtgaggcccagc

SEQ ID NO: 789987 - DNA, 25 bp, Mus musculus
tctgtgcagccttgtgaggcccagc

SEQ ID NO: 789988 - DNA, 25 bp, Mus musculus
tctgtgcaggcactgaccgctacgc

SEQ ID NO: 789989 - DNA, 25 bp, Mus musculus
tctgtgcaggcagtgaccgctacgc

SEQ ID NO: 789990 - DNA, 25 bp, Mus musculus
tctgtgcagtggcaccaaggctcag

SEQ ID NO: 789991 - DNA, 25 bp, Mus musculus
tctgtgcagtggcccggcagcacct

SEQ ID NO: 789992 - DNA, 25 bp, Mus musculus
tctgtgcagtgggaccaaggctcag

SEQ ID NO: 789993 - DNA, 25 bp, Mus musculus
tctgtgcagtgggccggcagcacct

SEQ ID NO: 789994 - DNA, 25 bp, Mus musculus
tctgtgccactgaggctctgagaca

SEQ ID NO: 789995 - DNA, 25 bp, Mus musculus
tctgtgccactgtggctctgagaca

SEQ ID NO: 789996 - DNA, 25 bp, Mus musculus
tctgtgccatctcttccagaagaaa

SEQ ID NO: 789997 - DNA, 25 bp, Mus musculus
tctgtgccatctgttccagaagaaa

SEQ ID NO: 789998 - DNA, 25 bp, Mus musculus
tctgtgccggatacaatgccagcag

SEQ ID NO: 789999 - DNA, 25 bp, Mus musculus
tctgtgccggattcaatgccagcag

SEQ ID NO: 790000 - DNA, 25 bp, Mus musculus
tctgtgccggctacttcgactgcaa

SEQ ID NO: 790001 - DNA, 25 bp, Mus musculus
tctgtgccggcttcttcgactgcaa

SEQ ID NO: 790002 - DNA, 25 bp, Mus musculus
tctgtgcctatcatcatgggcgtca

SEQ ID NO: 790003 - DNA, 25 bp, Mus musculus
tctgtgcctatcttcatgggcgtca

SEQ ID NO: 790004 - DNA, 25 bp, Mus musculus
tctgtgcctccaaggactgtctggc

SEQ ID NO: 790005 - DNA, 25 bp, Mus musculus
tctgtgcctccatggactgtctggc

SEQ ID NO: 790006 - DNA, 25 bp, Mus musculus
tctgtgcctcggacgggaggacctt

SEQ ID NO: 790007 - DNA, 25 bp, Mus musculus
tctgtgcctcggtcgggaggacctt

SEQ ID NO: 790008 - DNA, 25 bp, Mus musculus
tctgtgcctctacagcacttctaag

SEQ ID NO: 790009 - DNA, 25 bp, Mus musculus
tctgtgcctctagagcacttctaag

SEQ ID NO: 790010 - DNA, 25 bp, Mus musculus
tctgtgcctgccacagtggttttgg

SEQ ID NO: 790011 - DNA, 25 bp, Mus musculus
tctgtgcctgcctcagtggttttgg

SEQ ID NO: 790012 - DNA, 25 bp, Mus musculus
tctgtgcctgtgaccggaagctggt

SEQ ID NO: 790013 - DNA, 25 bp, Mus musculus
tctgtgcctgtgaccttgccgagga

SEQ ID NO: 790014 - DNA, 25 bp, Mus musculus
tctgtgcctgtgtccggaagctggt

SEQ ID NO: 790015 - DNA, 25 bp, Mus musculus
tctgtgcctgtgtccttgccgagga

SEQ ID NO: 790016 - DNA, 25 bp, Mus musculus
tctgtgccttctaaatcgagcagag

SEQ ID NO: 790017 - DNA, 25 bp, Mus musculus
tctgtgccttcttaatcgagcagag

SEQ ID NO: 790018 - DNA, 25 bp, Mus musculus
tctgtgcctttgacttgtacgagct

SEQ ID NO: 790019 - DNA, 25 bp, Mus musculus
tctgtgcctttgtcttgtacgagct

SEQ ID NO: 790020 - DNA, 25 bp, Mus musculus
tctgtgcgaaaacaccatctccgtg

SEQ ID NO: 790021 - DNA, 25 bp, Mus musculus
tctgtgcgaaaagaccatctccgtg

SEQ ID NO: 790022 - DNA, 25 bp, Mus musculus
tctgtgcgacatcaacgaaaggtcc

SEQ ID NO: 790023 - DNA, 25 bp, Mus musculus
tctgtgcgacatgaacgaaaggtcc

SEQ ID NO: 790024 - DNA, 25 bp, Mus musculus
tctgtgcgacgcagtgtgctaccac

SEQ ID NO: 790025 - DNA, 25 bp, Mus musculus
tctgtgcgacgctgtgtgctaccac

SEQ ID NO: 790026 - DNA, 25 bp, Mus musculus
tctgtgcgagaactatttgcccggc

SEQ ID NO: 790027 - DNA, 25 bp, Mus musculus
tctgtgcgagaagtatttgcccggc

SEQ ID NO: 790028 - DNA, 25 bp, Mus musculus
tctgtgcgagtcaatcaccctaata

SEQ ID NO: 790029 - DNA, 25 bp, Mus musculus
tctgtgcgagtctatcaccctaata

SEQ ID NO: 790030 - DNA, 25 bp, Mus musculus
tctgtgcgcaagaccacacctgtgt

SEQ ID NO: 790031 - DNA, 25 bp, Mus musculus
tctgtgcgcaagtccacacctgtgt

SEQ ID NO: 790032 - DNA, 25 bp, Mus musculus
tctgtgcgcagtctccttcacggaa

SEQ ID NO: 790033 - DNA, 25 bp, Mus musculus
tctgtgcgcagtgtccttcacggaa

SEQ ID NO: 790034 - DNA, 25 bp, Mus musculus
tctgtgcggcccaggagccgtgact

SEQ ID NO: 790035 - DNA, 25 bp, Mus musculus
tctgtgcggccctggagccgtgact

SEQ ID NO: 790036 - DNA, 25 bp, Mus musculus
tctgtgctagccaaggcctggcttg

SEQ ID NO: 790037 - DNA, 25 bp, Mus musculus
tctgtgctagcctaggcctggcttg

SEQ ID NO: 790038 - DNA, 25 bp, Mus musculus
tctgtgctagctcaccagatgaggc

SEQ ID NO: 790039 - DNA, 25 bp, Mus musculus
tctgtgctagctgaccagatgaggc

SEQ ID NO: 790040 - DNA, 25 bp, Mus musculus
tctgtgctctctatgggaagtggac

SEQ ID NO: 790041 - DNA, 25 bp, Mus musculus
tctgtgctctctttgggaagtggac

SEQ ID NO: 790042 - DNA, 25 bp, Mus musculus
tctgtgctctgtctaatgactctgc

SEQ ID NO: 790043 - DNA, 25 bp, Mus musculus
tctgtgctctgtgtaatgactctgc

SEQ ID NO: 790044 - DNA, 25 bp, Mus musculus
tctgtgctgagtagagcaatgacat

SEQ ID NO: 790045 - DNA, 25 bp, Mus musculus
tctgtgctgagttgagcaatgacat

SEQ ID NO: 790046 - DNA, 25 bp, Mus musculus
tctgtgctgcagactggccgctgct

SEQ ID NO: 790047 - DNA, 25 bp, Mus musculus
tctgtgctgcagtctggccgctgct

SEQ ID NO: 790048 - DNA, 25 bp, Mus musculus
tctgtgctgctgcttgtcatccttg

SEQ ID NO: 790049 - DNA, 25 bp, Mus musculus
tctgtgctgctggttgtcatccttg

SEQ ID NO: 790050 - DNA, 25 bp, Mus musculus
tctgtgctggctattagcaattcct

SEQ ID NO: 790051 - DNA, 25 bp, Mus musculus
tctgtgctggcttttagcaattcct

SEQ ID NO: 790052 - DNA, 25 bp, Mus musculus
tctgtgctgggtctttacgtttcta

SEQ ID NO: 790053 - DNA, 25 bp, Mus musculus
tctgtgctgggtgtttacgtttcta

SEQ ID NO: 790054 - DNA, 25 bp, Mus musculus
tctgtgctgtgcaataattctcgac

SEQ ID NO: 790055 - DNA, 25 bp, Mus musculus
tctgtgctgtgctataattctcgac

SEQ ID NO: 790056 - DNA, 25 bp, Mus musculus
tctgtgcttaagaccgggaccacgg

SEQ ID NO: 790057 - DNA, 25 bp, Mus musculus
tctgtgcttaagtccgggaccacgg

SEQ ID NO: 790058 - DNA, 25 bp, Mus musculus
tctgtgcttactctgactgggtggt

SEQ ID NO: 790059 - DNA, 25 bp, Mus musculus
tctgtgcttactgtgactgggtggt

SEQ ID NO: 790060 - DNA, 25 bp, Mus musculus
tctgtgcttcatcgaattgccaatg

SEQ ID NO: 790061 - DNA, 25 bp, Mus musculus
tctgtgcttcatggaattgccaatg

SEQ ID NO: 790062 - DNA, 25 bp, Mus musculus
tctgtgcttgcaatcctgacctcat

SEQ ID NO: 790063 - DNA, 25 bp, Mus musculus
tctgtgcttgcattcctgacctcat

SEQ ID NO: 790064 - DNA, 25 bp, Mus musculus
tctgtgcttggcaccgtcggtcggt

SEQ ID NO: 790065 - DNA, 25 bp, Mus musculus
tctgtgcttggctccgtcggtcggt

SEQ ID NO: 790066 - DNA, 25 bp, Mus musculus
tctgtggaaactcgtcacttggatg

SEQ ID NO: 790067 - DNA, 25 bp, Mus musculus
tctgtggaaactggtcacttggatg

SEQ ID NO: 790068 - DNA, 25 bp, Mus musculus
tctgtggaaatcaacgaccgacggg

SEQ ID NO: 790069 - DNA, 25 bp, Mus musculus
tctgtggaaatctacgaccgacggg

SEQ ID NO: 790070 - DNA, 25 bp, Mus musculus
tctgtggaagagcataccacctgct

SEQ ID NO: 790071 - DNA, 25 bp, Mus musculus
tctgtggaagaggataccacctgct

SEQ ID NO: 790072 - DNA, 25 bp, Mus musculus
tctgtggaagcgacgggtccaacct

SEQ ID NO: 790073 - DNA, 25 bp, Mus musculus
tctgtggaagcgtcgggtccaacct

SEQ ID NO: 790074 - DNA, 25 bp, Mus musculus
tctgtggaaggaagatctggctgtt

SEQ ID NO: 790075 - DNA, 25 bp, Mus musculus
tctgtggaaggatgatctggctgtt

SEQ ID NO: 790076 - DNA, 25 bp, Mus musculus
tctgtggaattgaacaagaggccct

SEQ ID NO: 790077 - DNA, 25 bp, Mus musculus
tctgtggaattgtacaagaggccct

SEQ ID NO: 790078 - DNA, 25 bp, Mus musculus
tctgtggacacactacagtattgct

SEQ ID NO: 790079 - DNA, 25 bp, Mus musculus
tctgtggacacagtacagtattgct

SEQ ID NO: 790080 - DNA, 25 bp, Mus musculus
tctgtggacatcaggccagcggaag

SEQ ID NO: 790081 - DNA, 25 bp, Mus musculus
tctgtggacatctggccagcggaag

SEQ ID NO: 790082 - DNA, 25 bp, Mus musculus
tctgtggaccaaaggatgacgcaac

SEQ ID NO: 790083 - DNA, 25 bp, Mus musculus
tctgtggaccaatggatgacgcaac

SEQ ID NO: 790084 - DNA, 25 bp, Mus musculus
tctgtggaccgaagcatacagacag

SEQ ID NO: 790085 - DNA, 25 bp, Mus musculus
tctgtggaccgatgcatacagacag

SEQ ID NO: 790086 - DNA, 25 bp, Mus musculus
tctgtggacgagagccttgactaca

SEQ ID NO: 790087 - DNA, 25 bp, Mus musculus
tctgtggacgagatctggtggtttc

SEQ ID NO: 790088 - DNA, 25 bp, Mus musculus
tctgtggacgagtgccttgactaca

SEQ ID NO: 790089 - DNA, 25 bp, Mus musculus
tctgtggacgagttctggtggtttc

SEQ ID NO: 790090 - DNA, 25 bp, Mus musculus
tctgtggagacaccttatggctcgg

SEQ ID NO: 790091 - DNA, 25 bp, Mus musculus
tctgtggagacagcttatggctcgg

SEQ ID NO: 790092 - DNA, 25 bp, Mus musculus
tctgtggagacgactaggtctgtgc

SEQ ID NO: 790093 - DNA, 25 bp, Mus musculus
tctgtggagacgtctaggtctgtgc

SEQ ID NO: 790094 - DNA, 25 bp, Mus musculus
tctgtggagcaaaggttgccacttt

SEQ ID NO: 790095 - DNA, 25 bp, Mus musculus
tctgtggagcaatggttgccacttt

SEQ ID NO: 790096 - DNA, 25 bp, Mus musculus
tctgtggagcaccactgcagtgtcc

SEQ ID NO: 790097 - DNA, 25 bp, Mus musculus
tctgtggagcacgactgcagtgtcc

SEQ ID NO: 790098 - DNA, 25 bp, Mus musculus
tctgtggagcatccggtcctacaca

SEQ ID NO: 790099 - DNA, 25 bp, Mus musculus
tctgtggagcatgcggtcctacaca

SEQ ID NO: 790100 - DNA, 25 bp, Mus musculus
tctgtggaggacaaccaggagcctg

SEQ ID NO: 790101 - DNA, 25 bp, Mus musculus
tctgtggaggactaccaggagcctg

SEQ ID NO: 790102 - DNA, 25 bp, Mus musculus
tctgtggagtccctcaagaatggct

SEQ ID NO: 790103 - DNA, 25 bp, Mus musculus
tctgtggagtccgtcaagaatggct

SEQ ID NO: 790104 - DNA, 25 bp, Mus musculus
tctgtggatggaacagagaaaaaga

SEQ ID NO: 790105 - DNA, 25 bp, Mus musculus
tctgtggatggatcagagaaaaaga

SEQ ID NO: 790106 - DNA, 25 bp, Mus musculus
tctgtggcacaaacgagtacatggc

SEQ ID NO: 790107 - DNA, 25 bp, Mus musculus
tctgtggcacaatcgagtacatggc

SEQ ID NO: 790108 - DNA, 25 bp, Mus musculus
tctgtggcacctcaagctcatgtgg

SEQ ID NO: 790109 - DNA, 25 bp, Mus musculus
tctgtggcacctgaagctcatgtgg

SEQ ID NO: 790110 - DNA, 25 bp, Mus musculus
tctgtggcagcacgacagtgacata

SEQ ID NO: 790111 - DNA, 25 bp, Mus musculus
tctgtggcagcaggacagtgacata

SEQ ID NO: 790112 - DNA, 25 bp, Mus musculus
tctgtggcaggaatcaaagtctgaa

SEQ ID NO: 790113 - DNA, 25 bp, Mus musculus
tctgtggcaggacctttccgtaaag

SEQ ID NO: 790114 - DNA, 25 bp, Mus musculus
tctgtggcaggagctttccgtaaag

SEQ ID NO: 790115 - DNA, 25 bp, Mus musculus
tctgtggcaggattcaaagtctgaa

SEQ ID NO: 790116 - DNA, 25 bp, Mus musculus
tctgtggcattcatgaaaaacaagt

SEQ ID NO: 790117 - DNA, 25 bp, Mus musculus
tctgtggcattcttgaaaaacaagt

SEQ ID NO: 790118 - DNA, 25 bp, Mus musculus
tctgtggccagactgattcgtcagg

SEQ ID NO: 790119 - DNA, 25 bp, Mus musculus
tctgtggccagagtgattcgtcagg

SEQ ID NO: 790120 - DNA, 25 bp, Mus musculus
tctgtggccaggacctcaacaagct

SEQ ID NO: 790121 - DNA, 25 bp, Mus musculus
tctgtggccaggtcctcaacaagct

SEQ ID NO: 790122 - DNA, 25 bp, Mus musculus
tctgtggcccaaaatccgagttccc

SEQ ID NO: 790123 - DNA, 25 bp, Mus musculus
tctgtggcccaatatccgagttccc

SEQ ID NO: 790124 - DNA, 25 bp, Mus musculus
tctgtggcctcactggcgctgcttt

SEQ ID NO: 790125 - DNA, 25 bp, Mus musculus
tctgtggcctcagtggcgctgcttt

SEQ ID NO: 790126 - DNA, 25 bp, Mus musculus
tctgtggcctggcaaggaagaaacc

SEQ ID NO: 790127 - DNA, 25 bp, Mus musculus
tctgtggcctgggaaggaagaaacc

SEQ ID NO: 790128 - DNA, 25 bp, Mus musculus
tctgtggctggaattgaagtccttc

SEQ ID NO: 790129 - DNA, 25 bp, Mus musculus
tctgtggctggatttgaagtccttc

SEQ ID NO: 790130 - DNA, 25 bp, Mus musculus
tctgtggctgttctacgtggcatcc

SEQ ID NO: 790131 - DNA, 25 bp, Mus musculus
tctgtggctgttgtacgtggcatcc

SEQ ID NO: 790132 - DNA, 25 bp, Mus musculus
tctgtggcttccctgggactaagtc

SEQ ID NO: 790133 - DNA, 25 bp, Mus musculus
tctgtggcttccgtgggactaagtc

SEQ ID NO: 790134 - DNA, 25 bp, Mus musculus
tctgtggcttgacggaaacaacctg

SEQ ID NO: 790135 - DNA, 25 bp, Mus musculus
tctgtggcttgagggaaacaacctg

SEQ ID NO: 790136 - DNA, 25 bp, Mus musculus
tctgtggcttttcgtgcaccgatcg

SEQ ID NO: 790137 - DNA, 25 bp, Mus musculus
tctgtggcttttggtgcaccgatcg

SEQ ID NO: 790138 - DNA, 25 bp, Mus musculus
tctgtgggaaacacacgcaggcttt

SEQ ID NO: 790139 - DNA, 25 bp, Mus musculus
tctgtgggaaactcacgcaggcttt

SEQ ID NO: 790140 - DNA, 25 bp, Mus musculus
tctgtgggaagtcacctccaggccc

SEQ ID NO: 790141 - DNA, 25 bp, Mus musculus
tctgtgggaagtgacctccaggccc

SEQ ID NO: 790142 - DNA, 25 bp, Mus musculus
tctgtgggacacaataagatggtga

SEQ ID NO: 790143 - DNA, 25 bp, Mus musculus
tctgtgggacactataagatggtga

SEQ ID NO: 790144 - DNA, 25 bp, Mus musculus
tctgtgggacggagccttcatgaat

SEQ ID NO: 790145 - DNA, 25 bp, Mus musculus
tctgtgggacggtgccttcatgaat

SEQ ID NO: 790146 - DNA, 25 bp, Mus musculus
tctgtgggcacaatggtgagacata

SEQ ID NO: 790147 - DNA, 25 bp, Mus musculus
tctgtgggcacattggtgagacata

SEQ ID NO: 790148 - DNA, 25 bp, Mus musculus
tctgtgggcagacgctgacattcag

SEQ ID NO: 790149 - DNA, 25 bp, Mus musculus
tctgtgggcagaggctgacattcag

SEQ ID NO: 790150 - DNA, 25 bp, Mus musculus
tctgtgggccagacctgctgcgctg

SEQ ID NO: 790151 - DNA, 25 bp, Mus musculus
tctgtgggccagtcctgctgcgctg

SEQ ID NO: 790152 - DNA, 25 bp, Mus musculus
tctgtgggccctcacgcttacttac

SEQ ID NO: 790153 - DNA, 25 bp, Mus musculus
tctgtgggccctgacgcttacttac

SEQ ID NO: 790154 - DNA, 25 bp, Mus musculus
tctgtgggccgacaacaagtgaata

SEQ ID NO: 790155 - DNA, 25 bp, Mus musculus
tctgtgggccgagaacaagtgaata

SEQ ID NO: 790156 - DNA, 25 bp, Mus musculus
tctgtgggccgtcctgttggtcaca

SEQ ID NO: 790157 - DNA, 25 bp, Mus musculus
tctgtgggccgtgctgttggtcaca

SEQ ID NO: 790158 - DNA, 25 bp, Mus musculus
tctgtgggcctcattgctacaagat

SEQ ID NO: 790159 - DNA, 25 bp, Mus musculus
tctgtgggcctctttgctacaagat

SEQ ID NO: 790160 - DNA, 25 bp, Mus musculus
tctgtggtctaaatttgcctggagg

SEQ ID NO: 790161 - DNA, 25 bp, Mus musculus
tctgtggtctaattttgcctggagg

SEQ ID NO: 790162 - DNA, 25 bp, Mus musculus
tctgtggtctcaataaaggaggcgc

SEQ ID NO: 790163 - DNA, 25 bp, Mus musculus
tctgtggtctcattaaaggaggcgc

SEQ ID NO: 790164 - DNA, 25 bp, Mus musculus
tctgtggtggcgctaacgactcttg

SEQ ID NO: 790165 - DNA, 25 bp, Mus musculus
tctgtggtggcggtaacgactcttg

SEQ ID NO: 790166 - DNA, 25 bp, Mus musculus
tctgtggtgggtcatcaaaggccct

SEQ ID NO: 790167 - DNA, 25 bp, Mus musculus
tctgtggtgggtgatcaaaggccct

SEQ ID NO: 790168 - DNA, 25 bp, Mus musculus
tctgtggttctcaagtcagaagcat

SEQ ID NO: 790169 - DNA, 25 bp, Mus musculus
tctgtggttctcaggtcagcaagtt

SEQ ID NO: 790170 - DNA, 25 bp, Mus musculus
tctgtggttctctagtcagaagcat

SEQ ID NO: 790171 - DNA, 25 bp, Mus musculus
tctgtggttctctggtcagcaagtt

SEQ ID NO: 790172 - DNA, 25 bp, Mus musculus
tctgtggttgccatgactgacactg

SEQ ID NO: 790173 - DNA, 25 bp, Mus musculus
tctgtggttgccttgactgacactg

SEQ ID NO: 790174 - DNA, 25 bp, Mus musculus
tctgtgtaaagcacacttggaagac

SEQ ID NO: 790175 - DNA, 25 bp, Mus musculus
tctgtgtaaagctcacttggaagac

SEQ ID NO: 790176 - DNA, 25 bp, Mus musculus
tctgtgtaacttcgtacctgaatgg

SEQ ID NO: 790177 - DNA, 25 bp, Mus musculus
tctgtgtaacttggtacctgaatgg

SEQ ID NO: 790178 - DNA, 25 bp, Mus musculus
tctgtgtaagcacttgctcaggtcc

SEQ ID NO: 790179 - DNA, 25 bp, Mus musculus
tctgtgtaagcagttgctcaggtcc

SEQ ID NO: 790180 - DNA, 25 bp, Mus musculus
tctgtgtaattaagacttccaggcc

SEQ ID NO: 790181 - DNA, 25 bp, Mus musculus
tctgtgtaattatgacttccaggcc

SEQ ID NO: 790182 - DNA, 25 bp, Mus musculus
tctgtgtacttaaacagaagttggc

SEQ ID NO: 790183 - DNA, 25 bp, Mus musculus
tctgtgtacttatacagaagttggc

SEQ ID NO: 790184 - DNA, 25 bp, Mus musculus
tctgtgtacttcaatgtcatcaaca

SEQ ID NO: 790185 - DNA, 25 bp, Mus musculus
tctgtgtacttctatgtcatcaaca

SEQ ID NO: 790186 - DNA, 25 bp, Mus musculus
tctgtgtagccacctgcgcaacagg

SEQ ID NO: 790187 - DNA, 25 bp, Mus musculus
tctgtgtagccagctgcgcaacagg

SEQ ID NO: 790188 - DNA, 25 bp, Mus musculus
tctgtgtaggatccaggtccgtgaa

SEQ ID NO: 790189 - DNA, 25 bp, Mus musculus
tctgtgtaggatgcaggtccgtgaa

SEQ ID NO: 790190 - DNA, 25 bp, Mus musculus
tctgtgtatcataagagaatgctca

SEQ ID NO: 790191 - DNA, 25 bp, Mus musculus
tctgtgtatcattagagaatgctca

SEQ ID NO: 790192 - DNA, 25 bp, Mus musculus
tctgtgtcaactccgtggactcgta

SEQ ID NO: 790193 - DNA, 25 bp, Mus musculus
tctgtgtcaactgcgtggactcgta

SEQ ID NO: 790194 - DNA, 25 bp, Mus musculus
tctgtgtcacagagaatgatccagt

SEQ ID NO: 790195 - DNA, 25 bp, Mus musculus
tctgtgtcacagtgaatgatccagt

SEQ ID NO: 790196 - DNA, 25 bp, Mus musculus
tctgtgtcagggaaaagactgcacg

SEQ ID NO: 790197 - DNA, 25 bp, Mus musculus
tctgtgtcagggaatatgtcaattc

SEQ ID NO: 790198 - DNA, 25 bp, Mus musculus
tctgtgtcagggtaaagactgcacg

SEQ ID NO: 790199 - DNA, 25 bp, Mus musculus
tctgtgtcagggtatatgtcaattc

SEQ ID NO: 790200 - DNA, 25 bp, Mus musculus
tctgtgtcatctagccggaaattca

SEQ ID NO: 790201 - DNA, 25 bp, Mus musculus
tctgtgtcatcttgccggaaattca

SEQ ID NO: 790202 - DNA, 25 bp, Mus musculus
tctgtgtccccaagaactgtctctc

SEQ ID NO: 790203 - DNA, 25 bp, Mus musculus
tctgtgtccccatgaactgtctctc

SEQ ID NO: 790204 - DNA, 25 bp, Mus musculus
tctgtgtccgccctccgtgttagtc

SEQ ID NO: 790205 - DNA, 25 bp, Mus musculus
tctgtgtccgccgtccgtgttagtc

SEQ ID NO: 790206 - DNA, 25 bp, Mus musculus
tctgtgtcgcacacagcggctatga

SEQ ID NO: 790207 - DNA, 25 bp, Mus musculus
tctgtgtcgcactcagcggctatga

SEQ ID NO: 790208 - DNA, 25 bp, Mus musculus
tctgtgtcgcatacagccctgtata

SEQ ID NO: 790209 - DNA, 25 bp, Mus musculus
tctgtgtcgcattcagccctgtata

SEQ ID NO: 790210 - DNA, 25 bp, Mus musculus
tctgtgtcggatctctatcaactca

SEQ ID NO: 790211 - DNA, 25 bp, Mus musculus
tctgtgtcggatgtctatcaactca

SEQ ID NO: 790212 - DNA, 25 bp, Mus musculus
tctgtgtctccacgaagaacctccg

SEQ ID NO: 790213 - DNA, 25 bp, Mus musculus
tctgtgtctccaggaagaacctccg

SEQ ID NO: 790214 - DNA, 25 bp, Mus musculus
tctgtgtcttacatgataagcatca

SEQ ID NO: 790215 - DNA, 25 bp, Mus musculus
tctgtgtcttacttgataagcatca

SEQ ID NO: 790216 - DNA, 25 bp, Mus musculus
tctgtgtcttgcagagtgcctgctc

SEQ ID NO: 790217 - DNA, 25 bp, Mus musculus
tctgtgtcttgctgagtgcctgctc

SEQ ID NO: 790218 - DNA, 25 bp, Mus musculus
tctgtgtgaaagagtgtgcgtgccc

SEQ ID NO: 790219 - DNA, 25 bp, Mus musculus
tctgtgtgaaagtgtgtgcgtgccc

SEQ ID NO: 790220 - DNA, 25 bp, Mus musculus
tctgtgtgaacaccctgggatcctt

SEQ ID NO: 790221 - DNA, 25 bp, Mus musculus
tctgtgtgaacagcctgggatcctt

SEQ ID NO: 790222 - DNA, 25 bp, Mus musculus
tctgtgtgaagaactcctgtcatct

SEQ ID NO: 790223 - DNA, 25 bp, Mus musculus
tctgtgtgaagatctcctgtcatct

SEQ ID NO: 790224 - DNA, 25 bp, Mus musculus
tctgtgtgaattcaagccctggaca

SEQ ID NO: 790225 - DNA, 25 bp, Mus musculus
tctgtgtgaattgaagccctggaca

SEQ ID NO: 790226 - DNA, 25 bp, Mus musculus
tctgtgtgacaaattggatttcagt

SEQ ID NO: 790227 - DNA, 25 bp, Mus musculus
tctgtgtgacaatttggatttcagt

SEQ ID NO: 790228 - DNA, 25 bp, Mus musculus
tctgtgtgacagagaacctgggagc

SEQ ID NO: 790229 - DNA, 25 bp, Mus musculus
tctgtgtgacagtgaacctgggagc

SEQ ID NO: 790230 - DNA, 25 bp, Mus musculus
tctgtgtgagggagaccaaccttcg

SEQ ID NO: 790231 - DNA, 25 bp, Mus musculus
tctgtgtgagggtgaccaaccttcg

SEQ ID NO: 790232 - DNA, 25 bp, Mus musculus
tctgtgtgaggtagggcatcctctc

SEQ ID NO: 790233 - DNA, 25 bp, Mus musculus
tctgtgtgaggttgggcatcctctc

SEQ ID NO: 790234 - DNA, 25 bp, Mus musculus
tctgtgtgatacaagagcccatgca

SEQ ID NO: 790235 - DNA, 25 bp, Mus musculus
tctgtgtgatactagagcccatgca

SEQ ID NO: 790236 - DNA, 25 bp, Mus musculus
tctgtgtgcatgcatcttacactgt

SEQ ID NO: 790237 - DNA, 25 bp, Mus musculus
tctgtgtgcatggatcttacactgt

SEQ ID NO: 790238 - DNA, 25 bp, Mus musculus
tctgtgtgcctgagaatcaggacca

SEQ ID NO: 790239 - DNA, 25 bp, Mus musculus
tctgtgtgcctgtgaatcaggacca

SEQ ID NO: 790240 - DNA, 25 bp, Mus musculus
tctgtgtgccttcatgtggcctggc

SEQ ID NO: 790241 - DNA, 25 bp, Mus musculus
tctgtgtgccttgatgtggcctggc

SEQ ID NO: 790242 - DNA, 25 bp, Mus musculus
tctgtgtgctatcagggtcagtgcc

SEQ ID NO: 790243 - DNA, 25 bp, Mus musculus
tctgtgtgctatgagggtcagtgcc

SEQ ID NO: 790244 - DNA, 25 bp, Mus musculus
tctgtgtgctcaacccgaagtgacc

SEQ ID NO: 790245 - DNA, 25 bp, Mus musculus
tctgtgtgctcatcccgaagtgacc

SEQ ID NO: 790246 - DNA, 25 bp, Mus musculus
tctgtgtggcctcgctattcggaaa

SEQ ID NO: 790247 - DNA, 25 bp, Mus musculus
tctgtgtggcctggctattcggaaa

SEQ ID NO: 790248 - DNA, 25 bp, Mus musculus
tctgtgtgtacaatcccgcccaaaa

SEQ ID NO: 790249 - DNA, 25 bp, Mus musculus
tctgtgtgtacattcccgcccaaaa

SEQ ID NO: 790250 - DNA, 25 bp, Mus musculus
tctgtgtgtacgagggtggcggcgg

SEQ ID NO: 790251 - DNA, 25 bp, Mus musculus
tctgtgtgtacgtgggtggcggcgg

SEQ ID NO: 790252 - DNA, 25 bp, Mus musculus
tctgtgtgtataagactgttcaagc

SEQ ID NO: 790253 - DNA, 25 bp, Mus musculus
tctgtgtgtatatgactgttcaagc

SEQ ID NO: 790254 - DNA, 25 bp, Mus musculus
tctgtgtgttaaagttgggaagctc

SEQ ID NO: 790255 - DNA, 25 bp, Mus musculus
tctgtgtgttaatgttgggaagctc

SEQ ID NO: 790256 - DNA, 25 bp, Mus musculus
tctgtgttccgacggtctgcagtgt

SEQ ID NO: 790257 - DNA, 25 bp, Mus musculus
tctgtgttccgagggtctgcagtgt

SEQ ID NO: 790258 - DNA, 25 bp, Mus musculus
tctgtgttccggaactttgacgtgg

SEQ ID NO: 790259 - DNA, 25 bp, Mus musculus
tctgtgttccggtactttgacgtgg

SEQ ID NO: 790260 - DNA, 25 bp, Mus musculus
tctgtgttcctgcaggtgaccatgg

SEQ ID NO: 790261 - DNA, 25 bp, Mus musculus
tctgtgttcctggaggtgaccatgg

SEQ ID NO: 790262 - DNA, 25 bp, Mus musculus
tctgtgttcgacaggcggctctgag

SEQ ID NO: 790263 - DNA, 25 bp, Mus musculus
tctgtgttcgactggcggctctgag

SEQ ID NO: 790264 - DNA, 25 bp, Mus musculus
tctgtgttcttacgagagtgaggct

SEQ ID NO: 790265 - DNA, 25 bp, Mus musculus
tctgtgttcttaggagagtgaggct

SEQ ID NO: 790266 - DNA, 25 bp, Mus musculus
tctgtgttgaggactacaagatgtg

SEQ ID NO: 790267 - DNA, 25 bp, Mus musculus
tctgtgttgaggtctacaagatgtg

SEQ ID NO: 790268 - DNA, 25 bp, Mus musculus
tctgtgttggctacttcagatggcg

SEQ ID NO: 790269 - DNA, 25 bp, Mus musculus
tctgtgttggcttcttcagatggcg

SEQ ID NO: 790270 - DNA, 25 bp, Mus musculus
tctgtgtttcaccttcaagcctgtg

SEQ ID NO: 790271 - DNA, 25 bp, Mus musculus
tctgtgtttcacgttcaagcctgtg

SEQ ID NO: 790272 - DNA, 25 bp, Mus musculus
tctgtgtttttacaacaagatgcca

SEQ ID NO: 790273 - DNA, 25 bp, Mus musculus
tctgtgtttttagaacaagatgcca

SEQ ID NO: 790274 - DNA, 25 bp, Mus musculus
tctgttaaagcaaaatgaggaaaat

SEQ ID NO: 790275 - DNA, 25 bp, Mus musculus
tctgttaaagcataatgaggaaaat

SEQ ID NO: 790276 - DNA, 25 bp, Mus musculus
tctgttaatgccagggattagaccc

SEQ ID NO: 790277 - DNA, 25 bp, Mus musculus
tctgttaatgcctgggattagaccc

SEQ ID NO: 790278 - DNA, 25 bp, Mus musculus
tctgttacagccagcttgagggctt

SEQ ID NO: 790279 - DNA, 25 bp, Mus musculus
tctgttacagcctgcttgagggctt

SEQ ID NO: 790280 - DNA, 25 bp, Mus musculus
tctgttaccaatcaggatgtcactc

SEQ ID NO: 790281 - DNA, 25 bp, Mus musculus
tctgttaccaatgaggatgtcactc

SEQ ID NO: 790282 - DNA, 25 bp, Mus musculus
tctgttacccagaaggccttgcaca

SEQ ID NO: 790283 - DNA, 25 bp, Mus musculus
tctgttacccagtaggccttgcaca

SEQ ID NO: 790284 - DNA, 25 bp, Mus musculus
tctgttacctgtacaatgacagagc

SEQ ID NO: 790285 - DNA, 25 bp, Mus musculus
tctgttacctgttcaatgacagagc

SEQ ID NO: 790286 - DNA, 25 bp, Mus musculus
tctgttacgaatctgttggtgagcc

SEQ ID NO: 790287 - DNA, 25 bp, Mus musculus
tctgttacgaatgtgttggtgagcc

SEQ ID NO: 790288 - DNA, 25 bp, Mus musculus
tctgttactctcagcctggaatccc

SEQ ID NO: 790289 - DNA, 25 bp, Mus musculus
tctgttactctctgcctggaatccc

SEQ ID NO: 790290 - DNA, 25 bp, Mus musculus
tctgttagagacaaagccctgggtc

SEQ ID NO: 790291 - DNA, 25 bp, Mus musculus
tctgttagagactaagccctgggtc

SEQ ID NO: 790292 - DNA, 25 bp, Mus musculus
tctgttaggcctaagtgcagctccc

SEQ ID NO: 790293 - DNA, 25 bp, Mus musculus
tctgttaggccttagtgcagctccc

SEQ ID NO: 790294 - DNA, 25 bp, Mus musculus
tctgttaggcggacacacaaacccg

SEQ ID NO: 790295 - DNA, 25 bp, Mus musculus
tctgttaggcggtcacacaaacccg

SEQ ID NO: 790296 - DNA, 25 bp, Mus musculus
tctgttataggaaaccatccaatgc

SEQ ID NO: 790297 - DNA, 25 bp, Mus musculus
tctgttataggataccatccaatgc

SEQ ID NO: 790298 - DNA, 25 bp, Mus musculus
tctgttattagaagcggatatgaac

SEQ ID NO: 790299 - DNA, 25 bp, Mus musculus
tctgttattagatgcggatatgaac

SEQ ID NO: 790300 - DNA, 25 bp, Mus musculus
tctgttattatcaggagatgcccac

SEQ ID NO: 790301 - DNA, 25 bp, Mus musculus
tctgttattatctggagatgcccac

SEQ ID NO: 790302 - DNA, 25 bp, Mus musculus
tctgttcacactcatgacaagtaag

SEQ ID NO: 790303 - DNA, 25 bp, Mus musculus
tctgttcacactgatgacaagtaag

SEQ ID NO: 790304 - DNA, 25 bp, Mus musculus
tctgttcactagagcgcttccgctc

SEQ ID NO: 790305 - DNA, 25 bp, Mus musculus
tctgttcactagtgcgcttccgctc

SEQ ID NO: 790306 - DNA, 25 bp, Mus musculus
tctgttcagacacggctgcaggcca

SEQ ID NO: 790307 - DNA, 25 bp, Mus musculus
tctgttcagacagggctgcaggcca

SEQ ID NO: 790308 - DNA, 25 bp, Mus musculus
tctgttcatctacaacagctttaag

SEQ ID NO: 790309 - DNA, 25 bp, Mus musculus
tctgttcatctagaacagctttaag

SEQ ID NO: 790310 - DNA, 25 bp, Mus musculus
tctgttccaaggaattaaaactgta

SEQ ID NO: 790311 - DNA, 25 bp, Mus musculus
tctgttccaaggtattaaaactgta

SEQ ID NO: 790312 - DNA, 25 bp, Mus musculus
tctgttccagtgatggccctcacgg

SEQ ID NO: 790313 - DNA, 25 bp, Mus musculus
tctgttccagtgttggccctcacgg

SEQ ID NO: 790314 - DNA, 25 bp, Mus musculus
tctgttcccaaacagatggctagca

SEQ ID NO: 790315 - DNA, 25 bp, Mus musculus
tctgttcccaaagagatggctagca

SEQ ID NO: 790316 - DNA, 25 bp, Mus musculus
tctgttcccatgaggtgaaggccag

SEQ ID NO: 790317 - DNA, 25 bp, Mus musculus
tctgttcccatgtggtgaaggccag

SEQ ID NO: 790318 - DNA, 25 bp, Mus musculus
tctgttcccctgacttctccggagg

SEQ ID NO: 790319 - DNA, 25 bp, Mus musculus
tctgttcccctgtcttctccggagg

SEQ ID NO: 790320 - DNA, 25 bp, Mus musculus
tctgttccctctacaggtagcagcg

SEQ ID NO: 790321 - DNA, 25 bp, Mus musculus
tctgttccctcttcaggtagcagcg

SEQ ID NO: 790322 - DNA, 25 bp, Mus musculus
tctgttccggaacacaacatctgga

SEQ ID NO: 790323 - DNA, 25 bp, Mus musculus
tctgttccggaagacaacatctgga

SEQ ID NO: 790324 - DNA, 25 bp, Mus musculus
tctgttcctaatcttaaggaaaagg

SEQ ID NO: 790325 - DNA, 25 bp, Mus musculus
tctgttcctaatgttaaggaaaagg

SEQ ID NO: 790326 - DNA, 25 bp, Mus musculus
tctgttcctcagcacttggagggca

SEQ ID NO: 790327 - DNA, 25 bp, Mus musculus
tctgttcctcaggacttggagggca

SEQ ID NO: 790328 - DNA, 25 bp, Mus musculus
tctgttcctgttcttctgccagctc

SEQ ID NO: 790329 - DNA, 25 bp, Mus musculus
tctgttcctgttgttctgccagctc

SEQ ID NO: 790330 - DNA, 25 bp, Mus musculus
tctgttcgtgcaagaatagtcactg

SEQ ID NO: 790331 - DNA, 25 bp, Mus musculus
tctgttcgtgcatgaatagtcactg

SEQ ID NO: 790332 - DNA, 25 bp, Mus musculus
tctgttctacccagaaggagggagg

SEQ ID NO: 790333 - DNA, 25 bp, Mus musculus
tctgttctaccctgaaggagggagg

SEQ ID NO: 790334 - DNA, 25 bp, Mus musculus
tctgttctacctcacattggatgtc

SEQ ID NO: 790335 - DNA, 25 bp, Mus musculus
tctgttctacctgacattggatgtc

SEQ ID NO: 790336 - DNA, 25 bp, Mus musculus
tctgttctagagaacccgagcatta

SEQ ID NO: 790337 - DNA, 25 bp, Mus musculus
tctgttctagagtacccgagcatta

SEQ ID NO: 790338 - DNA, 25 bp, Mus musculus
tctgttctccagatgaaccccgcta

SEQ ID NO: 790339 - DNA, 25 bp, Mus musculus
tctgttctccagttgaaccccgcta

SEQ ID NO: 790340 - DNA, 25 bp, Mus musculus
tctgttctccttagctggcagggcc

SEQ ID NO: 790341 - DNA, 25 bp, Mus musculus
tctgttctcctttgctggcagggcc

SEQ ID NO: 790342 - DNA, 25 bp, Mus musculus
tctgttctcggaagtggatgagcca

SEQ ID NO: 790343 - DNA, 25 bp, Mus musculus
tctgttctcggatgtggatgagcca

SEQ ID NO: 790344 - DNA, 25 bp, Mus musculus
tctgttctctggctactatctgcca

SEQ ID NO: 790345 - DNA, 25 bp, Mus musculus
tctgttctctgggtactatctgcca

SEQ ID NO: 790346 - DNA, 25 bp, Mus musculus
tctgttctgagaagcatacctgcat

SEQ ID NO: 790347 - DNA, 25 bp, Mus musculus
tctgttctgagatgcatacctgcat

SEQ ID NO: 790348 - DNA, 25 bp, Mus musculus
tctgttctggacaaggcaaacttga

SEQ ID NO: 790349 - DNA, 25 bp, Mus musculus
tctgttctggacactgctcatttgg

SEQ ID NO: 790350 - DNA, 25 bp, Mus musculus
tctgttctggactaggcaaacttga

SEQ ID NO: 790351 - DNA, 25 bp, Mus musculus
tctgttctggactctgctcatttgg

SEQ ID NO: 790352 - DNA, 25 bp, Mus musculus
tctgttctgtgcataggcacggagg

SEQ ID NO: 790353 - DNA, 25 bp, Mus musculus
tctgttctgtgcttaggcacggagg

SEQ ID NO: 790354 - DNA, 25 bp, Mus musculus
tctgttcttggacccaggtcttcag

SEQ ID NO: 790355 - DNA, 25 bp, Mus musculus
tctgttcttggagccaggtcttcag

SEQ ID NO: 790356 - DNA, 25 bp, Mus musculus
tctgttcttgtcaatcgtggcccta

SEQ ID NO: 790357 - DNA, 25 bp, Mus musculus
tctgttcttgtctatcgtggcccta

SEQ ID NO: 790358 - DNA, 25 bp, Mus musculus
tctgttctttccactaaccatgcct

SEQ ID NO: 790359 - DNA, 25 bp, Mus musculus
tctgttctttcctctaaccatgcct

SEQ ID NO: 790360 - DNA, 25 bp, Mus musculus
tctgttgaaatactccacggcatta

SEQ ID NO: 790361 - DNA, 25 bp, Mus musculus
tctgttgaaatagtccacggcatta

SEQ ID NO: 790362 - DNA, 25 bp, Mus musculus
tctgttgaacaaatcaaggcactgg

SEQ ID NO: 790363 - DNA, 25 bp, Mus musculus
tctgttgaacaattcaaggcactgg

SEQ ID NO: 790364 - DNA, 25 bp, Mus musculus
tctgttgaacccaggagagtatgga

SEQ ID NO: 790365 - DNA, 25 bp, Mus musculus
tctgttgaaccctggagagtatgga

SEQ ID NO: 790366 - DNA, 25 bp, Mus musculus
tctgttgaagtccagaatctgctcc

SEQ ID NO: 790367 - DNA, 25 bp, Mus musculus
tctgttgaagtcgagaatctgctcc

SEQ ID NO: 790368 - DNA, 25 bp, Mus musculus
tctgttgacagaaagaaatcctgag

SEQ ID NO: 790369 - DNA, 25 bp, Mus musculus
tctgttgacagatagaaatcctgag

SEQ ID NO: 790370 - DNA, 25 bp, Mus musculus
tctgttgaccaaaagaaacagtggg

SEQ ID NO: 790371 - DNA, 25 bp, Mus musculus
tctgttgaccaatagaaacagtggg

SEQ ID NO: 790372 - DNA, 25 bp, Mus musculus
tctgttgactatcgcaaaaagtcca

SEQ ID NO: 790373 - DNA, 25 bp, Mus musculus
tctgttgactatggcaaaaagtcca

SEQ ID NO: 790374 - DNA, 25 bp, Mus musculus
tctgttgagaaacaagggctcaatg

SEQ ID NO: 790375 - DNA, 25 bp, Mus musculus
tctgttgagaaagaagggctcaatg

SEQ ID NO: 790376 - DNA, 25 bp, Mus musculus
tctgttgagcaaaccctgcatccca

SEQ ID NO: 790377 - DNA, 25 bp, Mus musculus
tctgttgagcaatccctgcatccca

SEQ ID NO: 790378 - DNA, 25 bp, Mus musculus
tctgttgatgaaccaagacttgcag

SEQ ID NO: 790379 - DNA, 25 bp, Mus musculus
tctgttgatgaagcaagacttgcag

SEQ ID NO: 790380 - DNA, 25 bp, Mus musculus
tctgttgatgccatttagagtggaa

SEQ ID NO: 790381 - DNA, 25 bp, Mus musculus
tctgttgatgccttttagagtggaa

SEQ ID NO: 790382 - DNA, 25 bp, Mus musculus
tctgttgcaatgcacaagttcgggt

SEQ ID NO: 790383 - DNA, 25 bp, Mus musculus
tctgttgcaatggacaagttcgggt

SEQ ID NO: 790384 - DNA, 25 bp, Mus musculus
tctgttgcagccagatttcagcgca

SEQ ID NO: 790385 - DNA, 25 bp, Mus musculus
tctgttgcagcctgatttcagcgca

SEQ ID NO: 790386 - DNA, 25 bp, Mus musculus
tctgttgcatgactctgggccctca

SEQ ID NO: 790387 - DNA, 25 bp, Mus musculus
tctgttgcatgagtctgggccctca

SEQ ID NO: 790388 - DNA, 25 bp, Mus musculus
tctgttgcccctcttgtcatagatc

SEQ ID NO: 790389 - DNA, 25 bp, Mus musculus
tctgttgcccctgttgtcatagatc

SEQ ID NO: 790390 - DNA, 25 bp, Mus musculus
tctgttgcgggaaaggggcacccca

SEQ ID NO: 790391 - DNA, 25 bp, Mus musculus
tctgttgcgggataggggcacccca

SEQ ID NO: 790392 - DNA, 25 bp, Mus musculus
tctgttgctaaaatcgatccttcgg

SEQ ID NO: 790393 - DNA, 25 bp, Mus musculus
tctgttgctaaaccggtgagttcac

SEQ ID NO: 790394 - DNA, 25 bp, Mus musculus
tctgttgctaaagcggtgagttcac

SEQ ID NO: 790395 - DNA, 25 bp, Mus musculus
tctgttgctaaattcgatccttcgg

SEQ ID NO: 790396 - DNA, 25 bp, Mus musculus
tctgttgctagccttttggcacgtg

SEQ ID NO: 790397 - DNA, 25 bp, Mus musculus
tctgttgctagcgttttggcacgtg

SEQ ID NO: 790398 - DNA, 25 bp, Mus musculus
tctgttgctctaacacctcctgtct

SEQ ID NO: 790399 - DNA, 25 bp, Mus musculus
tctgttgctctatcacctcctgtct

SEQ ID NO: 790400 - DNA, 25 bp, Mus musculus
tctgttgctcttctgccccagatag

SEQ ID NO: 790401 - DNA, 25 bp, Mus musculus
tctgttgctcttgtgccccagatag

SEQ ID NO: 790402 - DNA, 25 bp, Mus musculus
tctgttgctttacgtggtagaggac

SEQ ID NO: 790403 - DNA, 25 bp, Mus musculus
tctgttgctttaggtggtagaggac

SEQ ID NO: 790404 - DNA, 25 bp, Mus musculus
tctgttggacagaaagactttctgc

SEQ ID NO: 790405 - DNA, 25 bp, Mus musculus
tctgttggacagtaagactttctgc

SEQ ID NO: 790406 - DNA, 25 bp, Mus musculus
tctgttggcagaaggcatcatttta

SEQ ID NO: 790407 - DNA, 25 bp, Mus musculus
tctgttggcagatggcatcatttta

SEQ ID NO: 790408 - DNA, 25 bp, Mus musculus
tctgttggcataccctcgtggagga

SEQ ID NO: 790409 - DNA, 25 bp, Mus musculus
tctgttggcatagcctcgtggagga

SEQ ID NO: 790410 - DNA, 25 bp, Mus musculus
tctgttggcctgcacatgacgaaag

SEQ ID NO: 790411 - DNA, 25 bp, Mus musculus
tctgttggcctggacatgacgaaag

SEQ ID NO: 790412 - DNA, 25 bp, Mus musculus
tctgttgggaaaactgcaattttgg

SEQ ID NO: 790413 - DNA, 25 bp, Mus musculus
tctgttgggaaatctgcaattttgg

SEQ ID NO: 790414 - DNA, 25 bp, Mus musculus
tctgttgggaccactaacatctaag

SEQ ID NO: 790415 - DNA, 25 bp, Mus musculus
tctgttgggacctctaacatctaag

SEQ ID NO: 790416 - DNA, 25 bp, Mus musculus
tctgttggtgcgacttgactttttc

SEQ ID NO: 790417 - DNA, 25 bp, Mus musculus
tctgttggtgcgtcttgactttttc

SEQ ID NO: 790418 - DNA, 25 bp, Mus musculus
tctgttgtctacacaaaattggaac

SEQ ID NO: 790419 - DNA, 25 bp, Mus musculus
tctgttgtctactcaaaattggaac

SEQ ID NO: 790420 - DNA, 25 bp, Mus musculus
tctgttgtgcatccgttgctgcagc

SEQ ID NO: 790421 - DNA, 25 bp, Mus musculus
tctgttgtgcatgcgttgctgcagc

SEQ ID NO: 790422 - DNA, 25 bp, Mus musculus
tctgttgtgtgtctcgctctgagac

SEQ ID NO: 790423 - DNA, 25 bp, Mus musculus
tctgttgtgtgtgtcgctctgagac

SEQ ID NO: 790424 - DNA, 25 bp, Mus musculus
tctgttgtgttgacttgcaacctca

SEQ ID NO: 790425 - DNA, 25 bp, Mus musculus
tctgttgtgttgtcttgcaacctca

SEQ ID NO: 790426 - DNA, 25 bp, Mus musculus
tctgttgttcgtcatgcgttgtttc

SEQ ID NO: 790427 - DNA, 25 bp, Mus musculus
tctgttgttcgtgatgcgttgtttc

SEQ ID NO: 790428 - DNA, 25 bp, Mus musculus
tctgttgttctacgtgaacggctgt

SEQ ID NO: 790429 - DNA, 25 bp, Mus musculus
tctgttgttctaggtgaacggctgt

SEQ ID NO: 790430 - DNA, 25 bp, Mus musculus
tctgtttaaaagctactgtacctgc

SEQ ID NO: 790431 - DNA, 25 bp, Mus musculus
tctgtttaaaaggtactgtacctgc

SEQ ID NO: 790432 - DNA, 25 bp, Mus musculus
tctgtttaagacacaccctgagacc

SEQ ID NO: 790433 - DNA, 25 bp, Mus musculus
tctgtttaagactcaccctgagacc

SEQ ID NO: 790434 - DNA, 25 bp, Mus musculus
tctgtttaccagagggtcagccttc

SEQ ID NO: 790435 - DNA, 25 bp, Mus musculus
tctgtttaccagtgggtcagccttc

SEQ ID NO: 790436 - DNA, 25 bp, Mus musculus
tctgtttacccgaggtattgatata

SEQ ID NO: 790437 - DNA, 25 bp, Mus musculus
tctgtttacccgtggtattgatata

SEQ ID NO: 790438 - DNA, 25 bp, Mus musculus
tctgtttatcggcattcttttgaca

SEQ ID NO: 790439 - DNA, 25 bp, Mus musculus
tctgtttatcgggattcttttgaca

SEQ ID NO: 790440 - DNA, 25 bp, Mus musculus
tctgtttatgtgagctggactagct

SEQ ID NO: 790441 - DNA, 25 bp, Mus musculus
tctgtttatgtgtgctggactagct

SEQ ID NO: 790442 - DNA, 25 bp, Mus musculus
tctgtttcacaaattcagtctcaaa

SEQ ID NO: 790443 - DNA, 25 bp, Mus musculus
tctgtttcacaatttcagtctcaaa

SEQ ID NO: 790444 - DNA, 25 bp, Mus musculus
tctgtttcagaaaccagatacgaaa

SEQ ID NO: 790445 - DNA, 25 bp, Mus musculus
tctgtttcagaatccagatacgaaa

SEQ ID NO: 790446 - DNA, 25 bp, Mus musculus
tctgtttccttaaaatctgatccaa

SEQ ID NO: 790447 - DNA, 25 bp, Mus musculus
tctgtttccttataatctgatccaa

SEQ ID NO: 790448 - DNA, 25 bp, Mus musculus
tctgtttctactaatgatgctggca

SEQ ID NO: 790449 - DNA, 25 bp, Mus musculus
tctgtttctacttatgatgctggca

SEQ ID NO: 790450 - DNA, 25 bp, Mus musculus
tctgtttctcacacagactgcagct

SEQ ID NO: 790451 - DNA, 25 bp, Mus musculus
tctgtttctcactcagactgcagct

SEQ ID NO: 790452 - DNA, 25 bp, Mus musculus
tctgtttcttataccttaggagtac

SEQ ID NO: 790453 - DNA, 25 bp, Mus musculus
tctgtttcttattccttaggagtac

SEQ ID NO: 790454 - DNA, 25 bp, Mus musculus
tctgtttcttcacctgtcgcctggc

SEQ ID NO: 790455 - DNA, 25 bp, Mus musculus
tctgtttcttcagctgtcgcctggc

SEQ ID NO: 790456 - DNA, 25 bp, Mus musculus
tctgtttgacataatacggcgatgg

SEQ ID NO: 790457 - DNA, 25 bp, Mus musculus
tctgtttgacattatacggcgatgg

SEQ ID NO: 790458 - DNA, 25 bp, Mus musculus
tctgtttgagaacagtgctaattac

SEQ ID NO: 790459 - DNA, 25 bp, Mus musculus
tctgtttgagaagagtgctaattac

SEQ ID NO: 790460 - DNA, 25 bp, Mus musculus
tctgtttgagctaaacctactgtca

SEQ ID NO: 790461 - DNA, 25 bp, Mus musculus
tctgtttgagcttaacctactgtca

SEQ ID NO: 790462 - DNA, 25 bp, Mus musculus
tctgtttgaggaactaactacatgg

SEQ ID NO: 790463 - DNA, 25 bp, Mus musculus
tctgtttgaggatctaactacatgg

SEQ ID NO: 790464 - DNA, 25 bp, Mus musculus
tctgtttgatgtcgtggttatcctc

SEQ ID NO: 790465 - DNA, 25 bp, Mus musculus
tctgtttgatgtggtggttatcctc

SEQ ID NO: 790466 - DNA, 25 bp, Mus musculus
tctgtttgcagacatcgtggctcac

SEQ ID NO: 790467 - DNA, 25 bp, Mus musculus
tctgtttgcagagatcgtggctcac

SEQ ID NO: 790468 - DNA, 25 bp, Mus musculus
tctgtttgccacacaacgtttgaaa

SEQ ID NO: 790469 - DNA, 25 bp, Mus musculus
tctgtttgccactcaacgtttgaaa

SEQ ID NO: 790470 - DNA, 25 bp, Mus musculus
tctgtttgcctcctgagtaacggga

SEQ ID NO: 790471 - DNA, 25 bp, Mus musculus
tctgtttgcctcgtgagtaacggga

SEQ ID NO: 790472 - DNA, 25 bp, Mus musculus
tctgtttgctagagcttggtcggat

SEQ ID NO: 790473 - DNA, 25 bp, Mus musculus
tctgtttgctagtgcttggtcggat

SEQ ID NO: 790474 - DNA, 25 bp, Mus musculus
tctgtttggctaaggaaatgaacag

SEQ ID NO: 790475 - DNA, 25 bp, Mus musculus
tctgtttggctatggaaatgaacag

SEQ ID NO: 790476 - DNA, 25 bp, Mus musculus
tctgtttgttgaaccagcatggcag

SEQ ID NO: 790477 - DNA, 25 bp, Mus musculus
tctgtttgttgatccagcatggcag

SEQ ID NO: 790478 - DNA, 25 bp, Mus musculus
tctgttttccgcatggtcaagcagg

SEQ ID NO: 790479 - DNA, 25 bp, Mus musculus
tctgttttccgcttggtcaagcagg

SEQ ID NO: 790480 - DNA, 25 bp, Mus musculus
tctgttttcttgaagctagctcgga

SEQ ID NO: 790481 - DNA, 25 bp, Mus musculus
tctgttttcttgtagctagctcgga

SEQ ID NO: 790482 - DNA, 25 bp, Mus musculus
tctgttttggcccagcttctgaaga

SEQ ID NO: 790483 - DNA, 25 bp, Mus musculus
tctgttttggccgagcttctgaaga

SEQ ID NO: 790484 - DNA, 25 bp, Mus musculus
tcttaaaaggccagtgtgccgccgc

SEQ ID NO: 790485 - DNA, 25 bp, Mus musculus
tcttaaaaggcctgtgtgccgccgc

SEQ ID NO: 790486 - DNA, 25 bp, Mus musculus
tcttaaaagggcaagggatttctag

SEQ ID NO: 790487 - DNA, 25 bp, Mus musculus
tcttaaaagggctagggatttctag

SEQ ID NO: 790488 - DNA, 25 bp, Mus musculus
tcttaaaagtgacctctatgaggtg

SEQ ID NO: 790489 - DNA, 25 bp, Mus musculus
tcttaaaagtgagctctatgaggtg

SEQ ID NO: 790490 - DNA, 25 bp, Mus musculus
tcttaaacaagaagatgaggactct

SEQ ID NO: 790491 - DNA, 25 bp, Mus musculus
tcttaaacaagatgatgaggactct

SEQ ID NO: 790492 - DNA, 25 bp, Mus musculus
tcttaaacagaactcagtttgtcag

SEQ ID NO: 790493 - DNA, 25 bp, Mus musculus
tcttaaacagaagtcagtttgtcag

SEQ ID NO: 790494 - DNA, 25 bp, Mus musculus
tcttaaacattccttgtcccttttg

SEQ ID NO: 790495 - DNA, 25 bp, Mus musculus
tcttaaacattcgttgtcccttttg

SEQ ID NO: 790496 - DNA, 25 bp, Mus musculus
tcttaaacatttacagctgcccctt

SEQ ID NO: 790497 - DNA, 25 bp, Mus musculus
tcttaaacattttcagctgcccctt

SEQ ID NO: 790498 - DNA, 25 bp, Mus musculus
tcttaaaccttacatagtgtgtgtg

SEQ ID NO: 790499 - DNA, 25 bp, Mus musculus
tcttaaaccttagatagtgtgtgtg

SEQ ID NO: 790500 - DNA, 25 bp, Mus musculus
tcttaaactacgacctcacgcagcg

SEQ ID NO: 790501 - DNA, 25 bp, Mus musculus
tcttaaactacgtcctcacgcagcg

SEQ ID NO: 790502 - DNA, 25 bp, Mus musculus
tcttaaagagaaagtcaatcgtgtc

SEQ ID NO: 790503 - DNA, 25 bp, Mus musculus
tcttaaagagaatgtcaatcgtgtc

SEQ ID NO: 790504 - DNA, 25 bp, Mus musculus
tcttaaagagcgatcctttcctgcc

SEQ ID NO: 790505 - DNA, 25 bp, Mus musculus
tcttaaagagcgttcctttcctgcc

SEQ ID NO: 790506 - DNA, 25 bp, Mus musculus
tcttaaagcatgagaagacgccact

SEQ ID NO: 790507 - DNA, 25 bp, Mus musculus
tcttaaagcatgtgaagacgccact

SEQ ID NO: 790508 - DNA, 25 bp, Mus musculus
tcttaaagggatacaggaagaccac

SEQ ID NO: 790509 - DNA, 25 bp, Mus musculus
tcttaaagggattcaggaagaccac

SEQ ID NO: 790510 - DNA, 25 bp, Mus musculus
tcttaaaggtaacagggctcactcc

SEQ ID NO: 790511 - DNA, 25 bp, Mus musculus
tcttaaaggtaagagggctcactcc

SEQ ID NO: 790512 - DNA, 25 bp, Mus musculus
tcttaaagtcacagcgctctagccc

SEQ ID NO: 790513 - DNA, 25 bp, Mus musculus
tcttaaagtcactgcgctctagccc

SEQ ID NO: 790514 - DNA, 25 bp, Mus musculus
tcttaacaaactaaggacaggtgca

SEQ ID NO: 790515 - DNA, 25 bp, Mus musculus
tcttaacaaacttaggacaggtgca

SEQ ID NO: 790516 - DNA, 25 bp, Mus musculus
tcttaactcaggctggagttcacag

SEQ ID NO: 790517 - DNA, 25 bp, Mus musculus
tcttaactcagggtggagttcacag

SEQ ID NO: 790518 - DNA, 25 bp, Mus musculus
tcttaactgcctctcttggaagcct

SEQ ID NO: 790519 - DNA, 25 bp, Mus musculus
tcttaactgcctgtcttggaagcct

SEQ ID NO: 790520 - DNA, 25 bp, Mus musculus
tcttaactgtgcaatggagtagaag

SEQ ID NO: 790521 - DNA, 25 bp, Mus musculus
tcttaactgtgctatggagtagaag

SEQ ID NO: 790522 - DNA, 25 bp, Mus musculus
tcttaagagctgatgtaatccaggg

SEQ ID NO: 790523 - DNA, 25 bp, Mus musculus
tcttaagagctgttgtaatccaggg

SEQ ID NO: 790524 - DNA, 25 bp, Mus musculus
tcttaagccatacgtcaagggaaac

SEQ ID NO: 790525 - DNA, 25 bp, Mus musculus
tcttaagccataggtcaagggaaac

SEQ ID NO: 790526 - DNA, 25 bp, Mus musculus
tcttaagcgctaccagaacctgaag

SEQ ID NO: 790527 - DNA, 25 bp, Mus musculus
tcttaagcgctagcagaacctgaag

SEQ ID NO: 790528 - DNA, 25 bp, Mus musculus
tcttaagctcatcgccagcaacagc

SEQ ID NO: 790529 - DNA, 25 bp, Mus musculus
tcttaagctcatggccagcaacagc

SEQ ID NO: 790530 - DNA, 25 bp, Mus musculus
tcttaagctggacactttgctggct

SEQ ID NO: 790531 - DNA, 25 bp, Mus musculus
tcttaagctggagactttgctggct

SEQ ID NO: 790532 - DNA, 25 bp, Mus musculus
tcttaagctgtgaatgatcgcgaca

SEQ ID NO: 790533 - DNA, 25 bp, Mus musculus
tcttaagctgtgtatgatcgcgaca

SEQ ID NO: 790534 - DNA, 25 bp, Mus musculus
tcttaaggacctcgccttgaacctg

SEQ ID NO: 790535 - DNA, 25 bp, Mus musculus
tcttaaggacctggccttgaacctg

SEQ ID NO: 790536 - DNA, 25 bp, Mus musculus
tcttaaggcagacgccactgtgccc

SEQ ID NO: 790537 - DNA, 25 bp, Mus musculus
tcttaaggcagaggccactgtgccc

SEQ ID NO: 790538 - DNA, 25 bp, Mus musculus
tcttaaggccaaagtccagctccaa

SEQ ID NO: 790539 - DNA, 25 bp, Mus musculus
tcttaaggccaatgtccagctccaa

SEQ ID NO: 790540 - DNA, 25 bp, Mus musculus
tcttaagggactagaataccttcat

SEQ ID NO: 790541 - DNA, 25 bp, Mus musculus
tcttaagggacttgaataccttcat

SEQ ID NO: 790542 - DNA, 25 bp, Mus musculus
tcttaaggtcgaagtgaaaccagtc

SEQ ID NO: 790543 - DNA, 25 bp, Mus musculus
tcttaaggtcgatgtgaaaccagtc

SEQ ID NO: 790544 - DNA, 25 bp, Mus musculus
tcttaagtatagcatcacgtggcca

SEQ ID NO: 790545 - DNA, 25 bp, Mus musculus
tcttaagtataggatcacgtggcca

SEQ ID NO: 790546 - DNA, 25 bp, Mus musculus
tcttaataacttccgggctgagcag

SEQ ID NO: 790547 - DNA, 25 bp, Mus musculus
tcttaataacttgcgggctgagcag

SEQ ID NO: 790548 - DNA, 25 bp, Mus musculus
tcttaataagttcaacagcagcaca

SEQ ID NO: 790549 - DNA, 25 bp, Mus musculus
tcttaataagttgaacagcagcaca

SEQ ID NO: 790550 - DNA, 25 bp, Mus musculus
tcttaatactagattggcatccact

SEQ ID NO: 790551 - DNA, 25 bp, Mus musculus
tcttaatactagtttggcatccact

SEQ ID NO: 790552 - DNA, 25 bp, Mus musculus
tcttaatccggaagaggatccacct

SEQ ID NO: 790553 - DNA, 25 bp, Mus musculus
tcttaatccggatgaggatccacct

SEQ ID NO: 790554 - DNA, 25 bp, Mus musculus
tcttaatcctacacagtgaagctgt

SEQ ID NO: 790555 - DNA, 25 bp, Mus musculus
tcttaatcctactcagtgaagctgt

SEQ ID NO: 790556 - DNA, 25 bp, Mus musculus
tcttaatcgagaatggcctgctgaa

SEQ ID NO: 790557 - DNA, 25 bp, Mus musculus
tcttaatcgagattggcctgctgaa

SEQ ID NO: 790558 - DNA, 25 bp, Mus musculus
tcttaatcgcacaggagatccaggc

SEQ ID NO: 790559 - DNA, 25 bp, Mus musculus
tcttaatcgcactggagatccaggc

SEQ ID NO: 790560 - DNA, 25 bp, Mus musculus
tcttaatgctagatgagaagcgcgt

SEQ ID NO: 790561 - DNA, 25 bp, Mus musculus
tcttaatgctagttgagaagcgcgt

SEQ ID NO: 790562 - DNA, 25 bp, Mus musculus
tcttaatggaacagcagaatctgtc

SEQ ID NO: 790563 - DNA, 25 bp, Mus musculus
tcttaatggaactgcagaatctgtc

SEQ ID NO: 790564 - DNA, 25 bp, Mus musculus
tcttaatggcagagcaccccgagac

SEQ ID NO: 790565 - DNA, 25 bp, Mus musculus
tcttaatggcagtgcaccccgagac

SEQ ID NO: 790566 - DNA, 25 bp, Mus musculus
tcttaatggcggaagccacctgcct

SEQ ID NO: 790567 - DNA, 25 bp, Mus musculus
tcttaatggcggtagccacctgcct

SEQ ID NO: 790568 - DNA, 25 bp, Mus musculus
tcttaatggctgagctatcgcttca

SEQ ID NO: 790569 - DNA, 25 bp, Mus musculus
tcttaatggctgtgctatcgcttca

SEQ ID NO: 790570 - DNA, 25 bp, Mus musculus
tcttaatgtgtgaggaccacagcac

SEQ ID NO: 790571 - DNA, 25 bp, Mus musculus
tcttaatgtgtgtggaccacagcac

SEQ ID NO: 790572 - DNA, 25 bp, Mus musculus
tcttaattcttcagatgcagggtgt

SEQ ID NO: 790573 - DNA, 25 bp, Mus musculus
tcttaattcttctgatgcagggtgt

SEQ ID NO: 790574 - DNA, 25 bp, Mus musculus
tcttaattggagaccaggagccctg

SEQ ID NO: 790575 - DNA, 25 bp, Mus musculus
tcttaattggagtccaggagccctg

SEQ ID NO: 790576 - DNA, 25 bp, Mus musculus
tcttacaacttgcttttcagtgtcc

SEQ ID NO: 790577 - DNA, 25 bp, Mus musculus
tcttacaacttggttttcagtgtcc

SEQ ID NO: 790578 - DNA, 25 bp, Mus musculus
tcttacaaggaaaatgagtgaatgt

SEQ ID NO: 790579 - DNA, 25 bp, Mus musculus
tcttacaaggaatatgagtgaatgt

SEQ ID NO: 790580 - DNA, 25 bp, Mus musculus
tcttacaattagctggctgacgagc

SEQ ID NO: 790581 - DNA, 25 bp, Mus musculus
tcttacaattaggtggctgacgagc

SEQ ID NO: 790582 - DNA, 25 bp, Mus musculus
tcttacaccaggaacatgactctga

SEQ ID NO: 790583 - DNA, 25 bp, Mus musculus
tcttacaccaggtacatgactctga

SEQ ID NO: 790584 - DNA, 25 bp, Mus musculus
tcttacaccgaacttgactttcagt

SEQ ID NO: 790585 - DNA, 25 bp, Mus musculus
tcttacaccgaagttgactttcagt

SEQ ID NO: 790586 - DNA, 25 bp, Mus musculus
tcttacacgtttccgaagatgatgg

SEQ ID NO: 790587 - DNA, 25 bp, Mus musculus
tcttacacgtttgcgaagatgatgg

SEQ ID NO: 790588 - DNA, 25 bp, Mus musculus
tcttacagacatcgagcagttcttt

SEQ ID NO: 790589 - DNA, 25 bp, Mus musculus
tcttacagacatggagcagttcttt

SEQ ID NO: 790590 - DNA, 25 bp, Mus musculus
tcttacaggcccaggttagcagtac

SEQ ID NO: 790591 - DNA, 25 bp, Mus musculus
tcttacaggccctggttagcagtac

SEQ ID NO: 790592 - DNA, 25 bp, Mus musculus
tcttacagtgcaaatgaggagccat

SEQ ID NO: 790593 - DNA, 25 bp, Mus musculus
tcttacagtgcatatgaggagccat

SEQ ID NO: 790594 - DNA, 25 bp, Mus musculus
tcttacatatggcagggatcgtagg

SEQ ID NO: 790595 - DNA, 25 bp, Mus musculus
tcttacatatgggagggatcgtagg

SEQ ID NO: 790596 - DNA, 25 bp, Mus musculus
tcttacatgctgaatcactggtgga

SEQ ID NO: 790597 - DNA, 25 bp, Mus musculus
tcttacatgctgtatcactggtgga

SEQ ID NO: 790598 - DNA, 25 bp, Mus musculus
tcttacattggacaacaccaccgag

SEQ ID NO: 790599 - DNA, 25 bp, Mus musculus
tcttacattggagaacaccaccgag

SEQ ID NO: 790600 - DNA, 25 bp, Mus musculus
tcttaccaagccacagcatgactta

SEQ ID NO: 790601 - DNA, 25 bp, Mus musculus
tcttaccaagcctcagcatgactta

SEQ ID NO: 790602 - DNA, 25 bp, Mus musculus
tcttaccaagggacccaagtcggag

SEQ ID NO: 790603 - DNA, 25 bp, Mus musculus
tcttaccaagggtcccaagtcggag

SEQ ID NO: 790604 - DNA, 25 bp, Mus musculus
tcttaccaatctctccctgacctcc

SEQ ID NO: 790605 - DNA, 25 bp, Mus musculus
tcttaccaatctgtccctgacctcc

SEQ ID NO: 790606 - DNA, 25 bp, Mus musculus
tcttaccacaaccttcaggaggagt

SEQ ID NO: 790607 - DNA, 25 bp, Mus musculus
tcttaccacaacgttcaggaggagt

SEQ ID NO: 790608 - DNA, 25 bp, Mus musculus
tcttaccatcgtcagcttggcatca

SEQ ID NO: 790609 - DNA, 25 bp, Mus musculus
tcttaccatcgtgagcttggcatca

SEQ ID NO: 790610 - DNA, 25 bp, Mus musculus
tcttacccaggcaggacttcaactc

SEQ ID NO: 790611 - DNA, 25 bp, Mus musculus
tcttacccaggctggacttcaactc

SEQ ID NO: 790612 - DNA, 25 bp, Mus musculus
tcttacccgctgctgcatgtggtct

SEQ ID NO: 790613 - DNA, 25 bp, Mus musculus
tcttacccgctggtgcatgtggtct

SEQ ID NO: 790614 - DNA, 25 bp, Mus musculus
tcttaccctgccaggagcaacagag

SEQ ID NO: 790615 - DNA, 25 bp, Mus musculus
tcttaccctgcctggagcaacagag

SEQ ID NO: 790616 - DNA, 25 bp, Mus musculus
tcttaccgggagatggagcatttga

SEQ ID NO: 790617 - DNA, 25 bp, Mus musculus
tcttaccgggagttggagcatttga

SEQ ID NO: 790618 - DNA, 25 bp, Mus musculus
tcttaccgttcactggcttcctgaa

SEQ ID NO: 790619 - DNA, 25 bp, Mus musculus
tcttaccgttcagtggcttcctgaa

SEQ ID NO: 790620 - DNA, 25 bp, Mus musculus
tcttaccgttgcacgtgtgcccagg

SEQ ID NO: 790621 - DNA, 25 bp, Mus musculus
tcttaccgttgctcgtgtgcccagg

SEQ ID NO: 790622 - DNA, 25 bp, Mus musculus
tcttacctactacacttaccagtgc

SEQ ID NO: 790623 - DNA, 25 bp, Mus musculus
tcttacctactagacttaccagtgc

SEQ ID NO: 790624 - DNA, 25 bp, Mus musculus
tcttacctgggtagtgggaacagct

SEQ ID NO: 790625 - DNA, 25 bp, Mus musculus
tcttacctgggttgtgggaacagct

SEQ ID NO: 790626 - DNA, 25 bp, Mus musculus
tcttaccttaggcagctccagtggc

SEQ ID NO: 790627 - DNA, 25 bp, Mus musculus
tcttaccttagggagctccagtggc

SEQ ID NO: 790628 - DNA, 25 bp, Mus musculus
tcttacgaccgcagtctctccgggc

SEQ ID NO: 790629 - DNA, 25 bp, Mus musculus
tcttacgaccgctgtctctccgggc

SEQ ID NO: 790630 - DNA, 25 bp, Mus musculus
tcttacggtggacccctagtgggtc

SEQ ID NO: 790631 - DNA, 25 bp, Mus musculus
tcttacggtggagccctagtgggtc

SEQ ID NO: 790632 - DNA, 25 bp, Mus musculus
tcttactaagaactttgcagcggag

SEQ ID NO: 790633 - DNA, 25 bp, Mus musculus
tcttactaagaagtttgcagcggag

SEQ ID NO: 790634 - DNA, 25 bp, Mus musculus
tcttactcaatgctggtcgtcccgc

SEQ ID NO: 790635 - DNA, 25 bp, Mus musculus
tcttactcaatggtggtcgtcccgc

SEQ ID NO: 790636 - DNA, 25 bp, Mus musculus
tcttactcacagagctggtcaccaa

SEQ ID NO: 790637 - DNA, 25 bp, Mus musculus
tcttactcacagtgctggtcaccaa

SEQ ID NO: 790638 - DNA, 25 bp, Mus musculus
tcttactcggctatcacggaggctg

SEQ ID NO: 790639 - DNA, 25 bp, Mus musculus
tcttactcggctttcacggaggctg

SEQ ID NO: 790640 - DNA, 25 bp, Mus musculus
tcttactctaagatgccctttgcag

SEQ ID NO: 790641 - DNA, 25 bp, Mus musculus
tcttactctaagttgccctttgcag

SEQ ID NO: 790642 - DNA, 25 bp, Mus musculus
tcttactgcagtccgcccttctaga

SEQ ID NO: 790643 - DNA, 25 bp, Mus musculus
tcttactgcagtgcgcccttctaga

SEQ ID NO: 790644 - DNA, 25 bp, Mus musculus
tcttactggagaaagtgagtcatca

SEQ ID NO: 790645 - DNA, 25 bp, Mus musculus
tcttactggagatagtgagtcatca

SEQ ID NO: 790646 - DNA, 25 bp, Mus musculus
tcttactgtcggagcagcggtcctg

SEQ ID NO: 790647 - DNA, 25 bp, Mus musculus
tcttactgtcggtgcagcggtcctg

SEQ ID NO: 790648 - DNA, 25 bp, Mus musculus
tcttactgtgcccagaagccgcaat

SEQ ID NO: 790649 - DNA, 25 bp, Mus musculus
tcttactgtgccgagaagccgcaat

SEQ ID NO: 790650 - DNA, 25 bp, Mus musculus
tcttagaaagacaagggccacattt

SEQ ID NO: 790651 - DNA, 25 bp, Mus musculus
tcttagaaagactagggccacattt

SEQ ID NO: 790652 - DNA, 25 bp, Mus musculus
tcttagaacatcagattcaagtcag

SEQ ID NO: 790653 - DNA, 25 bp, Mus musculus
tcttagaacatctgattcaagtcag

SEQ ID NO: 790654 - DNA, 25 bp, Mus musculus
tcttagaaccccaacattgtgggtg

SEQ ID NO: 790655 - DNA, 25 bp, Mus musculus
tcttagaacccctacattgtgggtg

SEQ ID NO: 790656 - DNA, 25 bp, Mus musculus
tcttagaacgctctcagttggcgct

SEQ ID NO: 790657 - DNA, 25 bp, Mus musculus
tcttagaacgctgtcagttggcgct

SEQ ID NO: 790658 - DNA, 25 bp, Mus musculus
tcttagaagcctcggccggagctat

SEQ ID NO: 790659 - DNA, 25 bp, Mus musculus
tcttagaagcctgggccggagctat

SEQ ID NO: 790660 - DNA, 25 bp, Mus musculus
tcttagaatctgcaattgagtgcca

SEQ ID NO: 790661 - DNA, 25 bp, Mus musculus
tcttagaatctggaattgagtgcca

SEQ ID NO: 790662 - DNA, 25 bp, Mus musculus
tcttagagaaaacagacatggcagg

SEQ ID NO: 790663 - DNA, 25 bp, Mus musculus
tcttagagaaaagagacatggcagg

SEQ ID NO: 790664 - DNA, 25 bp, Mus musculus
tcttagagactgactgccacgtgct

SEQ ID NO: 790665 - DNA, 25 bp, Mus musculus
tcttagagactgtctgccacgtgct

SEQ ID NO: 790666 - DNA, 25 bp, Mus musculus
tcttagagcctaagggcagatgcca

SEQ ID NO: 790667 - DNA, 25 bp, Mus musculus
tcttagagcctatgggcagatgcca

SEQ ID NO: 790668 - DNA, 25 bp, Mus musculus
tcttagagctcgatcgagaggcagc

SEQ ID NO: 790669 - DNA, 25 bp, Mus musculus
tcttagagctcgttcgagaggcagc

SEQ ID NO: 790670 - DNA, 25 bp, Mus musculus
tcttagagcttgagctgaattacac

SEQ ID NO: 790671 - DNA, 25 bp, Mus musculus
tcttagagcttgtgctgaattacac

SEQ ID NO: 790672 - DNA, 25 bp, Mus musculus
tcttagagggctagacgccaggtcc

SEQ ID NO: 790673 - DNA, 25 bp, Mus musculus
tcttagagggcttgacgccaggtcc

SEQ ID NO: 790674 - DNA, 25 bp, Mus musculus
tcttagatctatctgccagtctaac

SEQ ID NO: 790675 - DNA, 25 bp, Mus musculus
tcttagatctatgtgccagtctaac

SEQ ID NO: 790676 - DNA, 25 bp, Mus musculus
tcttagatgaacaggtaaaaagcat

SEQ ID NO: 790677 - DNA, 25 bp, Mus musculus
tcttagatgaactggtaaaaagcat

SEQ ID NO: 790678 - DNA, 25 bp, Mus musculus
tcttagatggtacaaggcccaggag

SEQ ID NO: 790679 - DNA, 25 bp, Mus musculus
tcttagatggtagaaggcccaggag

SEQ ID NO: 790680 - DNA, 25 bp, Mus musculus
tcttagattaagaggtcaccaaaag

SEQ ID NO: 790681 - DNA, 25 bp, Mus musculus
tcttagattaagtggtcaccaaaag

SEQ ID NO: 790682 - DNA, 25 bp, Mus musculus
tcttagattcctatcactaccaagt

SEQ ID NO: 790683 - DNA, 25 bp, Mus musculus
tcttagattcctttcactaccaagt

SEQ ID NO: 790684 - DNA, 25 bp, Mus musculus
tcttagattcttcgactctgcagct

SEQ ID NO: 790685 - DNA, 25 bp, Mus musculus
tcttagattcttggactctgcagct

SEQ ID NO: 790686 - DNA, 25 bp, Mus musculus
tcttagcagaggagatcacagcagc

SEQ ID NO: 790687 - DNA, 25 bp, Mus musculus
tcttagcagaggtgatcacagcagc

SEQ ID NO: 790688 - DNA, 25 bp, Mus musculus
tcttagcagctaaaaggcggtgcct

SEQ ID NO: 790689 - DNA, 25 bp, Mus musculus
tcttagcagctataaggcggtgcct

SEQ ID NO: 790690 - DNA, 25 bp, Mus musculus
tcttagcagcttcggtttaaacacc

SEQ ID NO: 790691 - DNA, 25 bp, Mus musculus
tcttagcagcttgggtttaaacacc

SEQ ID NO: 790692 - DNA, 25 bp, Mus musculus
tcttagcccctgatatgaggttgcc

SEQ ID NO: 790693 - DNA, 25 bp, Mus musculus
tcttagcccctgttatgaggttgcc

SEQ ID NO: 790694 - DNA, 25 bp, Mus musculus
tcttagcctataactccaaaggagc

SEQ ID NO: 790695 - DNA, 25 bp, Mus musculus
tcttagcctatatctccaaaggagc

SEQ ID NO: 790696 - DNA, 25 bp, Mus musculus
tcttagcctgctctgtgagagagga

SEQ ID NO: 790697 - DNA, 25 bp, Mus musculus
tcttagcctgctgtgtgagagagga

SEQ ID NO: 790698 - DNA, 25 bp, Mus musculus
tcttagcctgtgatgtgctttctat

SEQ ID NO: 790699 - DNA, 25 bp, Mus musculus
tcttagcctgtgttgtgctttctat

SEQ ID NO: 790700 - DNA, 25 bp, Mus musculus
tcttagcgtgaaaggctataactgc

SEQ ID NO: 790701 - DNA, 25 bp, Mus musculus
tcttagcgtgaatggctataactgc

SEQ ID NO: 790702 - DNA, 25 bp, Mus musculus
tcttagctaactaccggcagcatgg

SEQ ID NO: 790703 - DNA, 25 bp, Mus musculus
tcttagctaacttccggcagcatgg

SEQ ID NO: 790704 - DNA, 25 bp, Mus musculus
tcttagctgagacaccaagaggtgg

SEQ ID NO: 790705 - DNA, 25 bp, Mus musculus
tcttagctgagagaccaagaggtgg

SEQ ID NO: 790706 - DNA, 25 bp, Mus musculus
tcttagctgcaaagccatcccgagg

SEQ ID NO: 790707 - DNA, 25 bp, Mus musculus
tcttagctgcaatgccatcccgagg

SEQ ID NO: 790708 - DNA, 25 bp, Mus musculus
tcttagctgcgcagtttccccgaag

SEQ ID NO: 790709 - DNA, 25 bp, Mus musculus
tcttagctgcgctgtttccccgaag

SEQ ID NO: 790710 - DNA, 25 bp, Mus musculus
tcttagctggacacgacaaccgagt

SEQ ID NO: 790711 - DNA, 25 bp, Mus musculus
tcttagctggactcgacaaccgagt

SEQ ID NO: 790712 - DNA, 25 bp, Mus musculus
tcttagctgggaagtgtaactccgc

SEQ ID NO: 790713 - DNA, 25 bp, Mus musculus
tcttagctgggatgtgtaactccgc

SEQ ID NO: 790714 - DNA, 25 bp, Mus musculus
tcttagctgtagcaaaggcagattc

SEQ ID NO: 790715 - DNA, 25 bp, Mus musculus
tcttagctgtaggaaaggcagattc

SEQ ID NO: 790716 - DNA, 25 bp, Mus musculus
tcttagctgttgactactgacaggg

SEQ ID NO: 790717 - DNA, 25 bp, Mus musculus
tcttagctgttgtctactgacaggg

SEQ ID NO: 790718 - DNA, 25 bp, Mus musculus
tcttaggaagtgagaattgaaccac

SEQ ID NO: 790719 - DNA, 25 bp, Mus musculus
tcttaggaagtgtgaattgaaccac

SEQ ID NO: 790720 - DNA, 25 bp, Mus musculus
tcttaggaattgagtgccagccact

SEQ ID NO: 790721 - DNA, 25 bp, Mus musculus
tcttaggaattgtgtgccagccact

SEQ ID NO: 790722 - DNA, 25 bp, Mus musculus
tcttaggagctaaggcctctgcggg

SEQ ID NO: 790723 - DNA, 25 bp, Mus musculus
tcttaggagctatggcctctgcggg

SEQ ID NO: 790724 - DNA, 25 bp, Mus musculus
tcttaggagggcatatggcgttcct

SEQ ID NO: 790725 - DNA, 25 bp, Mus musculus
tcttaggagggcttatggcgttcct

SEQ ID NO: 790726 - DNA, 25 bp, Mus musculus
tcttaggatcccacaaggctgggac

SEQ ID NO: 790727 - DNA, 25 bp, Mus musculus
tcttaggatcccacccagaaacctg

SEQ ID NO: 790728 - DNA, 25 bp, Mus musculus
tcttaggatccctcaaggctgggac

SEQ ID NO: 790729 - DNA, 25 bp, Mus musculus
tcttaggatccctcccagaaacctg

SEQ ID NO: 790730 - DNA, 25 bp, Mus musculus
tcttaggctgctacataatgcttga

SEQ ID NO: 790731 - DNA, 25 bp, Mus musculus
tcttaggctgcttcataatgcttga

SEQ ID NO: 790732 - DNA, 25 bp, Mus musculus
tcttagggatgtctgggtacttgaa

SEQ ID NO: 790733 - DNA, 25 bp, Mus musculus
tcttagggatgtgtgggtacttgaa

SEQ ID NO: 790734 - DNA, 25 bp, Mus musculus
tcttagggtcagagcatgctcagtg

SEQ ID NO: 790735 - DNA, 25 bp, Mus musculus
tcttagggtcagtgcatgctcagtg

SEQ ID NO: 790736 - DNA, 25 bp, Mus musculus
tcttaggtgagcacagccttgaggg

SEQ ID NO: 790737 - DNA, 25 bp, Mus musculus
tcttaggtgagctcagccttgaggg

SEQ ID NO: 790738 - DNA, 25 bp, Mus musculus
tcttagtaataacgcagggagtagc

SEQ ID NO: 790739 - DNA, 25 bp, Mus musculus
tcttagtaataaggcagggagtagc

SEQ ID NO: 790740 - DNA, 25 bp, Mus musculus
tcttagtagcagagacaccaggctc

SEQ ID NO: 790741 - DNA, 25 bp, Mus musculus
tcttagtagcagtgacaccaggctc

SEQ ID NO: 790742 - DNA, 25 bp, Mus musculus
tcttagtagccactgcagcacctct

SEQ ID NO: 790743 - DNA, 25 bp, Mus musculus
tcttagtagccagtgcagcacctct

SEQ ID NO: 790744 - DNA, 25 bp, Mus musculus
tcttagtccgagactcttcccatca

SEQ ID NO: 790745 - DNA, 25 bp, Mus musculus
tcttagtccgagtctcttcccatca

SEQ ID NO: 790746 - DNA, 25 bp, Mus musculus
tcttagtcctggatagggctactgg

SEQ ID NO: 790747 - DNA, 25 bp, Mus musculus
tcttagtcctggttagggctactgg

SEQ ID NO: 790748 - DNA, 25 bp, Mus musculus
tcttagtgagaactgagatgactcg

SEQ ID NO: 790749 - DNA, 25 bp, Mus musculus
tcttagtgagaagtgagatgactcg

SEQ ID NO: 790750 - DNA, 25 bp, Mus musculus
tcttagtgccagaacttcaggctac

SEQ ID NO: 790751 - DNA, 25 bp, Mus musculus
tcttagtgccagtacttcaggctac

SEQ ID NO: 790752 - DNA, 25 bp, Mus musculus
tcttagtgctcgcaatttacgttca

SEQ ID NO: 790753 - DNA, 25 bp, Mus musculus
tcttagtgctcggaatttacgttca

SEQ ID NO: 790754 - DNA, 25 bp, Mus musculus
tcttagtggactcaggcctctcgcc

SEQ ID NO: 790755 - DNA, 25 bp, Mus musculus
tcttagtggactgaggcctctcgcc

SEQ ID NO: 790756 - DNA, 25 bp, Mus musculus
tcttagtggccaacatgaattttaa

SEQ ID NO: 790757 - DNA, 25 bp, Mus musculus
tcttagtggccatcatgaattttaa

SEQ ID NO: 790758 - DNA, 25 bp, Mus musculus
tcttagttccagaactgagtcttcc

SEQ ID NO: 790759 - DNA, 25 bp, Mus musculus
tcttagttccagtactgagtcttcc

SEQ ID NO: 790760 - DNA, 25 bp, Mus musculus
tcttagttcgtcagtgcctgccggg

SEQ ID NO: 790761 - DNA, 25 bp, Mus musculus
tcttagttcgtctgtgcctgccggg

SEQ ID NO: 790762 - DNA, 25 bp, Mus musculus
tcttataaccaacttctcacatagg

SEQ ID NO: 790763 - DNA, 25 bp, Mus musculus
tcttataaccaagttctcacatagg

SEQ ID NO: 790764 - DNA, 25 bp, Mus musculus
tcttatacacagcagacttcagact

SEQ ID NO: 790765 - DNA, 25 bp, Mus musculus
tcttatacacaggagacttcagact

SEQ ID NO: 790766 - DNA, 25 bp, Mus musculus
tcttataccccaagtacccgagagg

SEQ ID NO: 790767 - DNA, 25 bp, Mus musculus
tcttataccccatgtacccgagagg

SEQ ID NO: 790768 - DNA, 25 bp, Mus musculus
tcttatactactccagtgaaccaac

SEQ ID NO: 790769 - DNA, 25 bp, Mus musculus
tcttatactactgcagtgaaccaac

SEQ ID NO: 790770 - DNA, 25 bp, Mus musculus
tcttatactgagcttcgccgggtca

SEQ ID NO: 790771 - DNA, 25 bp, Mus musculus
tcttatactgaggttcgccgggtca

SEQ ID NO: 790772 - DNA, 25 bp, Mus musculus
tcttatagaaaacatgccagagaag

SEQ ID NO: 790773 - DNA, 25 bp, Mus musculus
tcttatagaaaagatgccagagaag

SEQ ID NO: 790774 - DNA, 25 bp, Mus musculus
tcttatagcagcaagggagccctgg

SEQ ID NO: 790775 - DNA, 25 bp, Mus musculus
tcttatagcagctagggagccctgg

SEQ ID NO: 790776 - DNA, 25 bp, Mus musculus
tcttatatagatcatgtgatggagc

SEQ ID NO: 790777 - DNA, 25 bp, Mus musculus
tcttatatagatgatgtgatggagc

SEQ ID NO: 790778 - DNA, 25 bp, Mus musculus
tcttatcactaacaaagctagtggg

SEQ ID NO: 790779 - DNA, 25 bp, Mus musculus
tcttatcactaagaaagctagtggg

SEQ ID NO: 790780 - DNA, 25 bp, Mus musculus
tcttatcatattcagccttctgccg

SEQ ID NO: 790781 - DNA, 25 bp, Mus musculus
tcttatcatattgagccttctgccg

SEQ ID NO: 790782 - DNA, 25 bp, Mus musculus
tcttatccgagaactgtgccacagc

SEQ ID NO: 790783 - DNA, 25 bp, Mus musculus
tcttatccgagatctgtgccacagc

SEQ ID NO: 790784 - DNA, 25 bp, Mus musculus
tcttatcgccaacgatgcaaacacc

SEQ ID NO: 790785 - DNA, 25 bp, Mus musculus
tcttatcgccaaggatgcaaacacc

SEQ ID NO: 790786 - DNA, 25 bp, Mus musculus
tcttatcgggagcacagccagagtg

SEQ ID NO: 790787 - DNA, 25 bp, Mus musculus
tcttatcgggaggacagccagagtg

SEQ ID NO: 790788 - DNA, 25 bp, Mus musculus
tcttatctcccacctacagggtggc

SEQ ID NO: 790789 - DNA, 25 bp, Mus musculus
tcttatctcccagctacagggtggc

SEQ ID NO: 790790 - DNA, 25 bp, Mus musculus
tcttatctcctcagggcaaggacct

SEQ ID NO: 790791 - DNA, 25 bp, Mus musculus
tcttatctcctctgggcaaggacct

SEQ ID NO: 790792 - DNA, 25 bp, Mus musculus
tcttatgaaataccccaaagtgcaa

SEQ ID NO: 790793 - DNA, 25 bp, Mus musculus
tcttatgaaatagcccaaagtgcaa

SEQ ID NO: 790794 - DNA, 25 bp, Mus musculus
tcttatgaggccaaccatctctatc

SEQ ID NO: 790795 - DNA, 25 bp, Mus musculus
tcttatgaggcctaccatctctatc

SEQ ID NO: 790796 - DNA, 25 bp, Mus musculus
tcttatgaggctaccgagccaccgt

SEQ ID NO: 790797 - DNA, 25 bp, Mus musculus
tcttatgaggcttccgagccaccgt

SEQ ID NO: 790798 - DNA, 25 bp, Mus musculus
tcttatgcaagacggccgtgctcac

SEQ ID NO: 790799 - DNA, 25 bp, Mus musculus
tcttatgcaagagggccgtgctcac

SEQ ID NO: 790800 - DNA, 25 bp, Mus musculus
tcttatgctaagaataacattccca

SEQ ID NO: 790801 - DNA, 25 bp, Mus musculus
tcttatgctaagtataacattccca

SEQ ID NO: 790802 - DNA, 25 bp, Mus musculus
tcttatgctgctagtttccggttcg

SEQ ID NO: 790803 - DNA, 25 bp, Mus musculus
tcttatgctgcttgtttccggttcg

SEQ ID NO: 790804 - DNA, 25 bp, Mus musculus
tcttatggcgtgcagggttctagac

SEQ ID NO: 790805 - DNA, 25 bp, Mus musculus
tcttatggcgtggagggttctagac

SEQ ID NO: 790806 - DNA, 25 bp, Mus musculus
tcttatggctgcattggacccgcgt

SEQ ID NO: 790807 - DNA, 25 bp, Mus musculus
tcttatggctgctttggacccgcgt

SEQ ID NO: 790808 - DNA, 25 bp, Mus musculus
tcttatggtcttcccaggaactgca

SEQ ID NO: 790809 - DNA, 25 bp, Mus musculus
tcttatggtcttgccaggaactgca

SEQ ID NO: 790810 - DNA, 25 bp, Mus musculus
tcttatgttttgcagtcacacaagc

SEQ ID NO: 790811 - DNA, 25 bp, Mus musculus
tcttatgttttggagtcacacaagc

SEQ ID NO: 790812 - DNA, 25 bp, Mus musculus
tcttattaaggcagctgacaaggcc

SEQ ID NO: 790813 - DNA, 25 bp, Mus musculus
tcttattaaggctgctgacaaggcc

SEQ ID NO: 790814 - DNA, 25 bp, Mus musculus
tcttattatctacttggtccgtggc

SEQ ID NO: 790815 - DNA, 25 bp, Mus musculus
tcttattatctagttggtccgtggc

SEQ ID NO: 790816 - DNA, 25 bp, Mus musculus
tcttattctcttagatgaagccaga

SEQ ID NO: 790817 - DNA, 25 bp, Mus musculus
tcttattctctttgatgaagccaga

SEQ ID NO: 790818 - DNA, 25 bp, Mus musculus
tcttattgcctacgccggttcggga

SEQ ID NO: 790819 - DNA, 25 bp, Mus musculus
tcttattgcctaggccggttcggga

SEQ ID NO: 790820 - DNA, 25 bp, Mus musculus
tcttattgctgcataccttgcctct

SEQ ID NO: 790821 - DNA, 25 bp, Mus musculus
tcttattgctgcttaccttgcctct

SEQ ID NO: 790822 - DNA, 25 bp, Mus musculus
tcttattgtgacagggtggcgcgct

SEQ ID NO: 790823 - DNA, 25 bp, Mus musculus
tcttattgtgactgggtggcgcgct

SEQ ID NO: 790824 - DNA, 25 bp, Mus musculus
tcttatttcagccagaagtggtgcg

SEQ ID NO: 790825 - DNA, 25 bp, Mus musculus
tcttatttcagcgagaagtggtgcg

SEQ ID NO: 790826 - DNA, 25 bp, Mus musculus
tcttatttcgccagccttggtaccc

SEQ ID NO: 790827 - DNA, 25 bp, Mus musculus
tcttatttcgcctgccttggtaccc

SEQ ID NO: 790828 - DNA, 25 bp, Mus musculus
tcttcaaaaaggagcacccagaccg

SEQ ID NO: 790829 - DNA, 25 bp, Mus musculus
tcttcaaaaaggtgcacccagaccg

SEQ ID NO: 790830 - DNA, 25 bp, Mus musculus
tcttcaaaagttcgaagcaaccctg

SEQ ID NO: 790831 - DNA, 25 bp, Mus musculus
tcttcaaaagttggaagcaaccctg

SEQ ID NO: 790832 - DNA, 25 bp, Mus musculus
tcttcaaaccaccaagtaagctttc

SEQ ID NO: 790833 - DNA, 25 bp, Mus musculus
tcttcaaaccacgaagtaagctttc

SEQ ID NO: 790834 - DNA, 25 bp, Mus musculus
tcttcaaactagaccgctgggctga

SEQ ID NO: 790835 - DNA, 25 bp, Mus musculus
tcttcaaactagtccgctgggctga

SEQ ID NO: 790836 - DNA, 25 bp, Mus musculus
tcttcaaagagacacgacacagagg

SEQ ID NO: 790837 - DNA, 25 bp, Mus musculus
tcttcaaagagagacgacacagagg

SEQ ID NO: 790838 - DNA, 25 bp, Mus musculus
tcttcaaagccacagatgattttac

SEQ ID NO: 790839 - DNA, 25 bp, Mus musculus
tcttcaaagccagagatgattttac

SEQ ID NO: 790840 - DNA, 25 bp, Mus musculus
tcttcaaaggttaccccaagcaggt

SEQ ID NO: 790841 - DNA, 25 bp, Mus musculus
tcttcaaaggtttccccaagcaggt

SEQ ID NO: 790842 - DNA, 25 bp, Mus musculus
tcttcaaagtggacaccagctccct

SEQ ID NO: 790843 - DNA, 25 bp, Mus musculus
tcttcaaagtggtcaccagctccct

SEQ ID NO: 790844 - DNA, 25 bp, Mus musculus
tcttcaacaaggacctgctggccac

SEQ ID NO: 790845 - DNA, 25 bp, Mus musculus
tcttcaacaaggtcctgctggccac

SEQ ID NO: 790846 - DNA, 25 bp, Mus musculus
tcttcaacactgacgtggcccagat

SEQ ID NO: 790847 - DNA, 25 bp, Mus musculus
tcttcaacactgtcgtggcccagat

SEQ ID NO: 790848 - DNA, 25 bp, Mus musculus
tcttcaacaggaagctcaaaacatt

SEQ ID NO: 790849 - DNA, 25 bp, Mus musculus
tcttcaacaggatgctcaaaacatt

SEQ ID NO: 790850 - DNA, 25 bp, Mus musculus
tcttcaacattacgtcccgagaaag

SEQ ID NO: 790851 - DNA, 25 bp, Mus musculus
tcttcaacattaggtcccgagaaag

SEQ ID NO: 790852 - DNA, 25 bp, Mus musculus
tcttcaaccacacagactgatggcc

SEQ ID NO: 790853 - DNA, 25 bp, Mus musculus
tcttcaaccacagagactgatggcc

SEQ ID NO: 790854 - DNA, 25 bp, Mus musculus
tcttcaacccaaacttcaagtctac

SEQ ID NO: 790855 - DNA, 25 bp, Mus musculus
tcttcaacccaatcttcaagtctac

SEQ ID NO: 790856 - DNA, 25 bp, Mus musculus
tcttcaacgataccaaactggacgc

SEQ ID NO: 790857 - DNA, 25 bp, Mus musculus
tcttcaacgatagcaaactggacgc

SEQ ID NO: 790858 - DNA, 25 bp, Mus musculus
tcttcaacgtgacgcctgaggtggt

SEQ ID NO: 790859 - DNA, 25 bp, Mus musculus
tcttcaacgtgaggcctgaggtggt

SEQ ID NO: 790860 - DNA, 25 bp, Mus musculus
tcttcaagaaggagcaagccatgtg

SEQ ID NO: 790861 - DNA, 25 bp, Mus musculus
tcttcaagaaggtgcaagccatgtg

SEQ ID NO: 790862 - DNA, 25 bp, Mus musculus
tcttcaagacttaaggagactgtgt

SEQ ID NO: 790863 - DNA, 25 bp, Mus musculus
tcttcaagactttaggagactgtgt

SEQ ID NO: 790864 - DNA, 25 bp, Mus musculus
tcttcaagctagattcgatcctgtg

SEQ ID NO: 790865 - DNA, 25 bp, Mus musculus
tcttcaagctagtttcgatcctgtg

SEQ ID NO: 790866 - DNA, 25 bp, Mus musculus
tcttcaagctcgctctgcggccgtt

SEQ ID NO: 790867 - DNA, 25 bp, Mus musculus
tcttcaagctcggtctgcggccgtt

SEQ ID NO: 790868 - DNA, 25 bp, Mus musculus
tcttcaaggacaatgccatcctatc

SEQ ID NO: 790869 - DNA, 25 bp, Mus musculus
tcttcaaggacattgccatcctatc

SEQ ID NO: 790870 - DNA, 25 bp, Mus musculus
tcttcaagggcacctatggcagcca

SEQ ID NO: 790871 - DNA, 25 bp, Mus musculus
tcttcaagggcagctatggcagcca

SEQ ID NO: 790872 - DNA, 25 bp, Mus musculus
tcttcaaggtcgatggccaggaagg

SEQ ID NO: 790873 - DNA, 25 bp, Mus musculus
tcttcaaggtcgttggccaggaagg

SEQ ID NO: 790874 - DNA, 25 bp, Mus musculus
tcttcaagtactcggccaaaacagg

SEQ ID NO: 790875 - DNA, 25 bp, Mus musculus
tcttcaagtactgggccaaaacagg

SEQ ID NO: 790876 - DNA, 25 bp, Mus musculus
tcttcaagtagaatgtgacacacag

SEQ ID NO: 790877 - DNA, 25 bp, Mus musculus
tcttcaagtagattgtgacacacag

SEQ ID NO: 790878 - DNA, 25 bp, Mus musculus
tcttcaagtatgcttgtggaggctg

SEQ ID NO: 790879 - DNA, 25 bp, Mus musculus
tcttcaagtatggttgtggaggctg

SEQ ID NO: 790880 - DNA, 25 bp, Mus musculus
tcttcaagtgtaagccgatcagcat

SEQ ID NO: 790881 - DNA, 25 bp, Mus musculus
tcttcaagtgtatgccgatcagcat

SEQ ID NO: 790882 - DNA, 25 bp, Mus musculus
tcttcaataactctggttacccctg

SEQ ID NO: 790883 - DNA, 25 bp, Mus musculus
tcttcaataactgtggttacccctg

SEQ ID NO: 790884 - DNA, 25 bp, Mus musculus
tcttcaatcggcagcttagtgaccc

SEQ ID NO: 790885 - DNA, 25 bp, Mus musculus
tcttcaatcggcctatgtcgctatg

SEQ ID NO: 790886 - DNA, 25 bp, Mus musculus
tcttcaatcggcgtatgtcgctatg

SEQ ID NO: 790887 - DNA, 25 bp, Mus musculus
tcttcaatcggctgcttagtgaccc

SEQ ID NO: 790888 - DNA, 25 bp, Mus musculus
tcttcaatgaaaacctccaggctgc

SEQ ID NO: 790889 - DNA, 25 bp, Mus musculus
tcttcaatgaaatcctccaggctgc

SEQ ID NO: 790890 - DNA, 25 bp, Mus musculus
tcttcaatgcatacgacacggacca

SEQ ID NO: 790891 - DNA, 25 bp, Mus musculus
tcttcaatgcattcgacacggacca

SEQ ID NO: 790892 - DNA, 25 bp, Mus musculus
tcttcaatgctgaaggcgatggcat

SEQ ID NO: 790893 - DNA, 25 bp, Mus musculus
tcttcaatgctgtaggcgatggcat

SEQ ID NO: 790894 - DNA, 25 bp, Mus musculus
tcttcaatggttactccactggaca

SEQ ID NO: 790895 - DNA, 25 bp, Mus musculus
tcttcaatggtttctccactggaca

SEQ ID NO: 790896 - DNA, 25 bp, Mus musculus
tcttcaattggaactggcgctacca

SEQ ID NO: 790897 - DNA, 25 bp, Mus musculus
tcttcaattggatctggcgctacca

SEQ ID NO: 790898 - DNA, 25 bp, Mus musculus
tcttcaatttggagcaaagacttgg

SEQ ID NO: 790899 - DNA, 25 bp, Mus musculus
tcttcaatttggtgcaaagacttgg

SEQ ID NO: 790900 - DNA, 25 bp, Mus musculus
tcttcacaaaagaagccgtggtcct

SEQ ID NO: 790901 - DNA, 25 bp, Mus musculus
tcttcacaaaagtagccgtggtcct

SEQ ID NO: 790902 - DNA, 25 bp, Mus musculus
tcttcacaaaggagctggacttggg

SEQ ID NO: 790903 - DNA, 25 bp, Mus musculus
tcttcacaaaggtgctggacttggg

SEQ ID NO: 790904 - DNA, 25 bp, Mus musculus
tcttcacacaaccaactagaaaagc

SEQ ID NO: 790905 - DNA, 25 bp, Mus musculus
tcttcacacaacgaactagaaaagc

SEQ ID NO: 790906 - DNA, 25 bp, Mus musculus
tcttcacacagcattatgtcagtag

SEQ ID NO: 790907 - DNA, 25 bp, Mus musculus
tcttcacacagctttatgtcagtag

SEQ ID NO: 790908 - DNA, 25 bp, Mus musculus
tcttcacacaggacgccgctgtgag

SEQ ID NO: 790909 - DNA, 25 bp, Mus musculus
tcttcacacaggtcgccgctgtgag

SEQ ID NO: 790910 - DNA, 25 bp, Mus musculus
tcttcacacatcatgagcgagaagg

SEQ ID NO: 790911 - DNA, 25 bp, Mus musculus
tcttcacacatcttgagcgagaagg

SEQ ID NO: 790912 - DNA, 25 bp, Mus musculus
tcttcacacgctccaacattgcttg

SEQ ID NO: 790913 - DNA, 25 bp, Mus musculus
tcttcacacgctgcaacattgcttg

SEQ ID NO: 790914 - DNA, 25 bp, Mus musculus
tcttcacagcagcattcgttctgat

SEQ ID NO: 790915 - DNA, 25 bp, Mus musculus
tcttcacagcaggattcgttctgat

SEQ ID NO: 790916 - DNA, 25 bp, Mus musculus
tcttcacatctaccagagcacggat

SEQ ID NO: 790917 - DNA, 25 bp, Mus musculus
tcttcacatctagcagagcacggat

SEQ ID NO: 790918 - DNA, 25 bp, Mus musculus
tcttcacatgtcacttcaatgaaag

SEQ ID NO: 790919 - DNA, 25 bp, Mus musculus
tcttcacatgtcatggccgtgatgg

SEQ ID NO: 790920 - DNA, 25 bp, Mus musculus
tcttcacatgtctcttcaatgaaag

SEQ ID NO: 790921 - DNA, 25 bp, Mus musculus
tcttcacatgtcttggccgtgatgg

SEQ ID NO: 790922 - DNA, 25 bp, Mus musculus
tcttcacatttgacttgattgaaag

SEQ ID NO: 790923 - DNA, 25 bp, Mus musculus
tcttcacatttgtcttgattgaaag

SEQ ID NO: 790924 - DNA, 25 bp, Mus musculus
tcttcaccaaccaaatgggcatcgg

SEQ ID NO: 790925 - DNA, 25 bp, Mus musculus
tcttcaccaacctaatgggcatcgg

SEQ ID NO: 790926 - DNA, 25 bp, Mus musculus
tcttcaccagggatctggccagcgt

SEQ ID NO: 790927 - DNA, 25 bp, Mus musculus
tcttcaccagggttctggccagcgt

SEQ ID NO: 790928 - DNA, 25 bp, Mus musculus
tcttcaccattgagtatggctggaa

SEQ ID NO: 790929 - DNA, 25 bp, Mus musculus
tcttcaccattgtgtatggctggaa

SEQ ID NO: 790930 - DNA, 25 bp, Mus musculus
tcttcacccttcaatggtgtccgtg

SEQ ID NO: 790931 - DNA, 25 bp, Mus musculus
tcttcacccttctatggtgtccgtg

SEQ ID NO: 790932 - DNA, 25 bp, Mus musculus
tcttcaccgcggacgggtcggcttg

SEQ ID NO: 790933 - DNA, 25 bp, Mus musculus
tcttcaccgcggtcgggtcggcttg

SEQ ID NO: 790934 - DNA, 25 bp, Mus musculus
tcttcaccgtgaattgaaactttcc

SEQ ID NO: 790935 - DNA, 25 bp, Mus musculus
tcttcaccgtgatttgaaactttcc

SEQ ID NO: 790936 - DNA, 25 bp, Mus musculus
tcttcacctctgacgccatgatctg

SEQ ID NO: 790937 - DNA, 25 bp, Mus musculus
tcttcacctctgtcgccatgatctg

SEQ ID NO: 790938 - DNA, 25 bp, Mus musculus
tcttcacctgcgagagtgagggtgt

SEQ ID NO: 790939 - DNA, 25 bp, Mus musculus
tcttcacctgcgtgagtgagggtgt

SEQ ID NO: 790940 - DNA, 25 bp, Mus musculus
tcttcacctttaagcacaaacataa

SEQ ID NO: 790941 - DNA, 25 bp, Mus musculus
tcttcacctttatgcacaaacataa

SEQ ID NO: 790942 - DNA, 25 bp, Mus musculus
tcttcacgggtcacatggggaagct

SEQ ID NO: 790943 - DNA, 25 bp, Mus musculus
tcttcacgggtctcatggggaagct

SEQ ID NO: 790944 - DNA, 25 bp, Mus musculus
tcttcacggttaccattgggttgtt

SEQ ID NO: 790945 - DNA, 25 bp, Mus musculus
tcttcacggttagcattgggttgtt

SEQ ID NO: 790946 - DNA, 25 bp, Mus musculus
tcttcactaactacgagagccggaa

SEQ ID NO: 790947 - DNA, 25 bp, Mus musculus
tcttcactaacttcgagagccggaa

SEQ ID NO: 790948 - DNA, 25 bp, Mus musculus
tcttcactactgaggcagcgacttt

SEQ ID NO: 790949 - DNA, 25 bp, Mus musculus
tcttcactactgtggcagcgacttt

SEQ ID NO: 790950 - DNA, 25 bp, Mus musculus
tcttcactatgcctgtgcgaaccgc

SEQ ID NO: 790951 - DNA, 25 bp, Mus musculus
tcttcactatgcgtgtgcgaaccgc

SEQ ID NO: 790952 - DNA, 25 bp, Mus musculus
tcttcactccctccagttatgtgtg

SEQ ID NO: 790953 - DNA, 25 bp, Mus musculus
tcttcactccctgcagttatgtgtg

SEQ ID NO: 790954 - DNA, 25 bp, Mus musculus
tcttcactgtgaacaataaagtttg

SEQ ID NO: 790955 - DNA, 25 bp, Mus musculus
tcttcactgtgatcaataaagtttg

SEQ ID NO: 790956 - DNA, 25 bp, Mus musculus
tcttcactgtgcactgtgtcgaggt

SEQ ID NO: 790957 - DNA, 25 bp, Mus musculus
tcttcactgtgctctgtgtcgaggt

SEQ ID NO: 790958 - DNA, 25 bp, Mus musculus
tcttcactgtggatgagaaaatact

SEQ ID NO: 790959 - DNA, 25 bp, Mus musculus
tcttcactgtggttgagaaaatact

SEQ ID NO: 790960 - DNA, 25 bp, Mus musculus
tcttcacttgccacaataatgatat

SEQ ID NO: 790961 - DNA, 25 bp, Mus musculus
tcttcacttgcctcaataatgatat

SEQ ID NO: 790962 - DNA, 25 bp, Mus musculus
tcttcagaacggactttctctaccc

SEQ ID NO: 790963 - DNA, 25 bp, Mus musculus
tcttcagaacggtctttctctaccc

SEQ ID NO: 790964 - DNA, 25 bp, Mus musculus
tcttcagaaggtccgcatgcacgtg

SEQ ID NO: 790965 - DNA, 25 bp, Mus musculus
tcttcagaaggtgcgcatgcacgtg

SEQ ID NO: 790966 - DNA, 25 bp, Mus musculus
tcttcagacactactcgcaggctta

SEQ ID NO: 790967 - DNA, 25 bp, Mus musculus
tcttcagacacttctcgcaggctta

SEQ ID NO: 790968 - DNA, 25 bp, Mus musculus
tcttcagactaccaggacgacgaca

SEQ ID NO: 790969 - DNA, 25 bp, Mus musculus
tcttcagactacgaggacgacgaca

SEQ ID NO: 790970 - DNA, 25 bp, Mus musculus
tcttcagagaacagtaaagcatccg

SEQ ID NO: 790971 - DNA, 25 bp, Mus musculus
tcttcagagaactgtaaagcatccg

SEQ ID NO: 790972 - DNA, 25 bp, Mus musculus
tcttcagagacaatcaacttgctgg

SEQ ID NO: 790973 - DNA, 25 bp, Mus musculus
tcttcagagacattcaacttgctgg

SEQ ID NO: 790974 - DNA, 25 bp, Mus musculus
tcttcagagacccatgcctggtgca

SEQ ID NO: 790975 - DNA, 25 bp, Mus musculus
tcttcagagaccgatgcctggtgca

SEQ ID NO: 790976 - DNA, 25 bp, Mus musculus
tcttcagaggtgcagacctcggagg

SEQ ID NO: 790977 - DNA, 25 bp, Mus musculus
tcttcagaggtggagacctcggagg

SEQ ID NO: 790978 - DNA, 25 bp, Mus musculus
tcttcagagtttcctacttctcctg

SEQ ID NO: 790979 - DNA, 25 bp, Mus musculus
tcttcagagtttgctacttctcctg

SEQ ID NO: 790980 - DNA, 25 bp, Mus musculus
tcttcagataaaccaagatggtttt

SEQ ID NO: 790981 - DNA, 25 bp, Mus musculus
tcttcagataaagcaagatggtttt

SEQ ID NO: 790982 - DNA, 25 bp, Mus musculus
tcttcagatccaaaccaagaacatg

SEQ ID NO: 790983 - DNA, 25 bp, Mus musculus
tcttcagatccataccaagaacatg

SEQ ID NO: 790984 - DNA, 25 bp, Mus musculus
tcttcagatgagacctggcctgttc

SEQ ID NO: 790985 - DNA, 25 bp, Mus musculus
tcttcagatgagtcctggcctgttc

SEQ ID NO: 790986 - DNA, 25 bp, Mus musculus
tcttcagatggacctaggatgggct

SEQ ID NO: 790987 - DNA, 25 bp, Mus musculus
tcttcagatggagctaggatgggct

SEQ ID NO: 790988 - DNA, 25 bp, Mus musculus
tcttcagcacagatcttaattggag

SEQ ID NO: 790989 - DNA, 25 bp, Mus musculus
tcttcagcacagttcttaattggag

SEQ ID NO: 790990 - DNA, 25 bp, Mus musculus
tcttcagcagcgatagttctttcgc

SEQ ID NO: 790991 - DNA, 25 bp, Mus musculus
tcttcagcagcgttagttctttcgc

SEQ ID NO: 790992 - DNA, 25 bp, Mus musculus
tcttcagcatcacgtacagagatcc

SEQ ID NO: 790993 - DNA, 25 bp, Mus musculus
tcttcagcatcaggtacagagatcc

SEQ ID NO: 790994 - DNA, 25 bp, Mus musculus
tcttcagcatgacagagacaaggaa

SEQ ID NO: 790995 - DNA, 25 bp, Mus musculus
tcttcagcatgagagagacaaggaa

SEQ ID NO: 790996 - DNA, 25 bp, Mus musculus
tcttcagcgggcaggccgttctgag

SEQ ID NO: 790997 - DNA, 25 bp, Mus musculus
tcttcagcgggctggccgttctgag

SEQ ID NO: 790998 - DNA, 25 bp, Mus musculus
tcttcagcgtccaggctctgttcct

SEQ ID NO: 790999 - DNA, 25 bp, Mus musculus
tcttcagcgtcccaattgtctatga

SEQ ID NO: 791000 - DNA, 25 bp, Mus musculus
tcttcagcgtccgaattgtctatga

SEQ ID NO: 791001 - DNA, 25 bp, Mus musculus
tcttcagcgtcctggctctgttcct

SEQ ID NO: 791002 - DNA, 25 bp, Mus musculus
tcttcagctgccaaccctacaaatg

SEQ ID NO: 791003 - DNA, 25 bp, Mus musculus
tcttcagctgcctaccctacaaatg

SEQ ID NO: 791004 - DNA, 25 bp, Mus musculus
tcttcaggaagcagagccgcgagtg

SEQ ID NO: 791005 - DNA, 25 bp, Mus musculus
tcttcaggaagctgagccgcgagtg

SEQ ID NO: 791006 - DNA, 25 bp, Mus musculus
tcttcaggagatcagagcgaggcct

SEQ ID NO: 791007 - DNA, 25 bp, Mus musculus
tcttcaggagatgagagcgaggcct

SEQ ID NO: 791008 - DNA, 25 bp, Mus musculus
tcttcaggagttcccaaagtgggag

SEQ ID NO: 791009 - DNA, 25 bp, Mus musculus
tcttcaggagttgccaaagtgggag

SEQ ID NO: 791010 - DNA, 25 bp, Mus musculus
tcttcaggataacacagttcctagc

SEQ ID NO: 791011 - DNA, 25 bp, Mus musculus
tcttcaggataagacagttcctagc

SEQ ID NO: 791012 - DNA, 25 bp, Mus musculus
tcttcaggatgaattatagctgctg

SEQ ID NO: 791013 - DNA, 25 bp, Mus musculus
tcttcaggatgatttatagctgctg

SEQ ID NO: 791014 - DNA, 25 bp, Mus musculus
tcttcaggcaaaagagatcatgtgg

SEQ ID NO: 791015 - DNA, 25 bp, Mus musculus
tcttcaggcaaatgagatcatgtgg

SEQ ID NO: 791016 - DNA, 25 bp, Mus musculus
tcttcaggcacaagcatcagctctt

SEQ ID NO: 791017 - DNA, 25 bp, Mus musculus
tcttcaggcacatgcatcagctctt

SEQ ID NO: 791018 - DNA, 25 bp, Mus musculus
tcttcaggcgtaacctaacatggga

SEQ ID NO: 791019 - DNA, 25 bp, Mus musculus
tcttcaggcgtatcctaacatggga

SEQ ID NO: 791020 - DNA, 25 bp, Mus musculus
tcttcagggaccaagtatcttcact

SEQ ID NO: 791021 - DNA, 25 bp, Mus musculus
tcttcagggacctagtatcttcact

SEQ ID NO: 791022 - DNA, 25 bp, Mus musculus
tcttcagggcgaatcataaagagaa

SEQ ID NO: 791023 - DNA, 25 bp, Mus musculus
tcttcagggcgattcataaagagaa

SEQ ID NO: 791024 - DNA, 25 bp, Mus musculus
tcttcaggtgttaagtgttttcatc

SEQ ID NO: 791025 - DNA, 25 bp, Mus musculus
tcttcaggtgtttagtgttttcatc

SEQ ID NO: 791026 - DNA, 25 bp, Mus musculus
tcttcaggttccattcaagagagtg

SEQ ID NO: 791027 - DNA, 25 bp, Mus musculus
tcttcaggttcctttcaagagagtg

SEQ ID NO: 791028 - DNA, 25 bp, Mus musculus
tcttcagtcacaagcacgcggagtt

SEQ ID NO: 791029 - DNA, 25 bp, Mus musculus
tcttcagtcacatgcacgcggagtt

SEQ ID NO: 791030 - DNA, 25 bp, Mus musculus
tcttcagtctcgctccttggaagtc

SEQ ID NO: 791031 - DNA, 25 bp, Mus musculus
tcttcagtctcggtccttggaagtc

SEQ ID NO: 791032 - DNA, 25 bp, Mus musculus
tcttcagtcttgaggaccgcgtggc

SEQ ID NO: 791033 - DNA, 25 bp, Mus musculus
tcttcagtcttgtggaccgcgtggc

SEQ ID NO: 791034 - DNA, 25 bp, Mus musculus
tcttcagtgaaccaggagcatccat

SEQ ID NO: 791035 - DNA, 25 bp, Mus musculus
tcttcagtgaacgaggagcatccat

SEQ ID NO: 791036 - DNA, 25 bp, Mus musculus
tcttcagtgaagcagcccaagccaa

SEQ ID NO: 791037 - DNA, 25 bp, Mus musculus
tcttcagtgaaggagcccaagccaa

SEQ ID NO: 791038 - DNA, 25 bp, Mus musculus
tcttcagtgcagaggtccatggcct

SEQ ID NO: 791039 - DNA, 25 bp, Mus musculus
tcttcagtgcagtggtccatggcct

SEQ ID NO: 791040 - DNA, 25 bp, Mus musculus
tcttcagtgcccagtctccatacat

SEQ ID NO: 791041 - DNA, 25 bp, Mus musculus
tcttcagtgccctgtctccatacat

SEQ ID NO: 791042 - DNA, 25 bp, Mus musculus
tcttcagtggcaacccttctgttga

SEQ ID NO: 791043 - DNA, 25 bp, Mus musculus
tcttcagtggcatcccttctgttga

SEQ ID NO: 791044 - DNA, 25 bp, Mus musculus
tcttcagtggcccagtcttaccgtt

SEQ ID NO: 791045 - DNA, 25 bp, Mus musculus
tcttcagtggccgagtcttaccgtt

SEQ ID NO: 791046 - DNA, 25 bp, Mus musculus
tcttcagtggctctcgcctcaagct

SEQ ID NO: 791047 - DNA, 25 bp, Mus musculus
tcttcagtggctgtcgcctcaagct

SEQ ID NO: 791048 - DNA, 25 bp, Mus musculus
tcttcagtgtgtccagtgcggcctt

SEQ ID NO: 791049 - DNA, 25 bp, Mus musculus
tcttcagtgtgtgcagtgcggcctt

SEQ ID NO: 791050 - DNA, 25 bp, Mus musculus
tcttcagttctaatgctatgcctct

SEQ ID NO: 791051 - DNA, 25 bp, Mus musculus
tcttcagttctattgctatgcctct

SEQ ID NO: 791052 - DNA, 25 bp, Mus musculus
tcttcataacatccaaggatctggg

SEQ ID NO: 791053 - DNA, 25 bp, Mus musculus
tcttcataacatgcaaggatctggg

SEQ ID NO: 791054 - DNA, 25 bp, Mus musculus
tcttcataatgaaccagaggttgag

SEQ ID NO: 791055 - DNA, 25 bp, Mus musculus
tcttcataatgatccagaggttgag

SEQ ID NO: 791056 - DNA, 25 bp, Mus musculus
tcttcatacaaaccacagcatgcca

SEQ ID NO: 791057 - DNA, 25 bp, Mus musculus
tcttcatacaaagcacagcatgcca

SEQ ID NO: 791058 - DNA, 25 bp, Mus musculus
tcttcataggacagcagatcgggag

SEQ ID NO: 791059 - DNA, 25 bp, Mus musculus
tcttcataggactgcagatcgggag

SEQ ID NO: 791060 - DNA, 25 bp, Mus musculus
tcttcataggccagggagagctcgt

SEQ ID NO: 791061 - DNA, 25 bp, Mus musculus
tcttcataggcctgggagagctcgt

SEQ ID NO: 791062 - DNA, 25 bp, Mus musculus
tcttcatagtttatgtgccagatac

SEQ ID NO: 791063 - DNA, 25 bp, Mus musculus
tcttcatagtttttgtgccagatac

SEQ ID NO: 791064 - DNA, 25 bp, Mus musculus
tcttcatatgtacacagtgcactga

SEQ ID NO: 791065 - DNA, 25 bp, Mus musculus
tcttcatatgtagacagtgcactga

SEQ ID NO: 791066 - DNA, 25 bp, Mus musculus
tcttcatcaacacaatgggtcaagg

SEQ ID NO: 791067 - DNA, 25 bp, Mus musculus
tcttcatcaacagaatgggtcaagg

SEQ ID NO: 791068 - DNA, 25 bp, Mus musculus
tcttcatcaaccctaagtgcttgtt

SEQ ID NO: 791069 - DNA, 25 bp, Mus musculus
tcttcatcaaccgtaagtgcttgtt

SEQ ID NO: 791070 - DNA, 25 bp, Mus musculus
tcttcatcaccacagccataggact

SEQ ID NO: 791071 - DNA, 25 bp, Mus musculus
tcttcatcaccagagccataggact

SEQ ID NO: 791072 - DNA, 25 bp, Mus musculus
tcttcatcagcaatgtaaggatctt

SEQ ID NO: 791073 - DNA, 25 bp, Mus musculus
tcttcatcagcattgtaaggatctt

SEQ ID NO: 791074 - DNA, 25 bp, Mus musculus
tcttcatcagtgagagactgacatc

SEQ ID NO: 791075 - DNA, 25 bp, Mus musculus
tcttcatcagtgtgagactgacatc

SEQ ID NO: 791076 - DNA, 25 bp, Mus musculus
tcttcatcatccaccctcttgggag

SEQ ID NO: 791077 - DNA, 25 bp, Mus musculus
tcttcatcatcctccctcttgggag

SEQ ID NO: 791078 - DNA, 25 bp, Mus musculus
tcttcatcctagaggctgtccgtca

SEQ ID NO: 791079 - DNA, 25 bp, Mus musculus
tcttcatcctagtggctgtccgtca

SEQ ID NO: 791080 - DNA, 25 bp, Mus musculus
tcttcatcgatgagcttgatgccat

SEQ ID NO: 791081 - DNA, 25 bp, Mus musculus
tcttcatcgatgaggctggccactg

SEQ ID NO: 791082 - DNA, 25 bp, Mus musculus
tcttcatcgatgtgcttgatgccat

SEQ ID NO: 791083 - DNA, 25 bp, Mus musculus
tcttcatcgatgtggctggccactg

SEQ ID NO: 791084 - DNA, 25 bp, Mus musculus
tcttcatctcccacattgttctcag

SEQ ID NO: 791085 - DNA, 25 bp, Mus musculus
tcttcatctccctcattgttctcag

SEQ ID NO: 791086 - DNA, 25 bp, Mus musculus
tcttcatctctaacctggcggctgg

SEQ ID NO: 791087 - DNA, 25 bp, Mus musculus
tcttcatctctaccaaggctggcta

SEQ ID NO: 791088 - DNA, 25 bp, Mus musculus
tcttcatctctagcaaggctggcta

SEQ ID NO: 791089 - DNA, 25 bp, Mus musculus
tcttcatctctatcctggcggctgg

SEQ ID NO: 791090 - DNA, 25 bp, Mus musculus
tcttcatctggccagtccacagcag

SEQ ID NO: 791091 - DNA, 25 bp, Mus musculus
tcttcatctggcgagtccacagcag

SEQ ID NO: 791092 - DNA, 25 bp, Mus musculus
tcttcatgctcaccagtgtcctggg

SEQ ID NO: 791093 - DNA, 25 bp, Mus musculus
tcttcatgctcagcagtgtcctggg

SEQ ID NO: 791094 - DNA, 25 bp, Mus musculus
tcttcatgctttccaaggtcattga

SEQ ID NO: 791095 - DNA, 25 bp, Mus musculus
tcttcatgctttgcaaggtcattga

SEQ ID NO: 791096 - DNA, 25 bp, Mus musculus
tcttcatggaaacaatgacgtgaca

SEQ ID NO: 791097 - DNA, 25 bp, Mus musculus
tcttcatggaaagaatgacgtgaca

SEQ ID NO: 791098 - DNA, 25 bp, Mus musculus
tcttcatggcatacaaggacaggtg

SEQ ID NO: 791099 - DNA, 25 bp, Mus musculus
tcttcatggcattcaaggacaggtg

SEQ ID NO: 791100 - DNA, 25 bp, Mus musculus
tcttcatggcctacaaccgagctgc

SEQ ID NO: 791101 - DNA, 25 bp, Mus musculus
tcttcatggcctagccgtacaccga

SEQ ID NO: 791102 - DNA, 25 bp, Mus musculus
tcttcatggccttcaaccgagctgc

SEQ ID NO: 791103 - DNA, 25 bp, Mus musculus
tcttcatggccttgccgtacaccga

SEQ ID NO: 791104 - DNA, 25 bp, Mus musculus
tcttcatggcgtcctaagccagtgc

SEQ ID NO: 791105 - DNA, 25 bp, Mus musculus
tcttcatggcgtgctaagccagtgc

SEQ ID NO: 791106 - DNA, 25 bp, Mus musculus
tcttcatgggaaagacaagcccctc

SEQ ID NO: 791107 - DNA, 25 bp, Mus musculus
tcttcatgggaatgacaagcccctc

SEQ ID NO: 791108 - DNA, 25 bp, Mus musculus
tcttcatgggagactttgtggaccg

SEQ ID NO: 791109 - DNA, 25 bp, Mus musculus
tcttcatgggagtctttgtggaccg

SEQ ID NO: 791110 - DNA, 25 bp, Mus musculus
tcttcatgttccagtgatcttcggg

SEQ ID NO: 791111 - DNA, 25 bp, Mus musculus
tcttcatgttcctgtgatcttcggg

SEQ ID NO: 791112 - DNA, 25 bp, Mus musculus
tcttcattacagaagggtattgatg

SEQ ID NO: 791113 - DNA, 25 bp, Mus musculus
tcttcattacagtagggtattgatg

SEQ ID NO: 791114 - DNA, 25 bp, Mus musculus
tcttcattcgaaagtaagtacctgc

SEQ ID NO: 791115 - DNA, 25 bp, Mus musculus
tcttcattcgaatgtaagtacctgc

SEQ ID NO: 791116 - DNA, 25 bp, Mus musculus
tcttcattcttcatcgacgaagaca

SEQ ID NO: 791117 - DNA, 25 bp, Mus musculus
tcttcattcttcttcgacgaagaca

SEQ ID NO: 791118 - DNA, 25 bp, Mus musculus
tcttcattgaagacagagctgaaat

SEQ ID NO: 791119 - DNA, 25 bp, Mus musculus
tcttcattgaagtcagagctgaaat

SEQ ID NO: 791120 - DNA, 25 bp, Mus musculus
tcttcattgagtcagcccgctggta

SEQ ID NO: 791121 - DNA, 25 bp, Mus musculus
tcttcattgagtgagcccgctggta

SEQ ID NO: 791122 - DNA, 25 bp, Mus musculus
tcttcattggaactgtcatcccatc

SEQ ID NO: 791123 - DNA, 25 bp, Mus musculus
tcttcattggaagtgtcatcccatc

SEQ ID NO: 791124 - DNA, 25 bp, Mus musculus
tcttcattggcaacaatagcagcat

SEQ ID NO: 791125 - DNA, 25 bp, Mus musculus
tcttcattggcatcaatagcagcat

SEQ ID NO: 791126 - DNA, 25 bp, Mus musculus
tcttcattggctacactgcgctcgt

SEQ ID NO: 791127 - DNA, 25 bp, Mus musculus
tcttcattggcttcactgcgctcgt

SEQ ID NO: 791128 - DNA, 25 bp, Mus musculus
tcttcattgtggcacacagagccag

SEQ ID NO: 791129 - DNA, 25 bp, Mus musculus
tcttcattgtgggacacagagccag

SEQ ID NO: 791130 - DNA, 25 bp, Mus musculus
tcttcattttctacaggcttggtca

SEQ ID NO: 791131 - DNA, 25 bp, Mus musculus
tcttcattttcttcaggcttggtca

SEQ ID NO: 791132 - DNA, 25 bp, Mus musculus
tcttccaaaggcagtggtcaaactc

SEQ ID NO: 791133 - DNA, 25 bp, Mus musculus
tcttccaaaggctgtggtcaaactc

SEQ ID NO: 791134 - DNA, 25 bp, Mus musculus
tcttccaaatgaactagagccaagg

SEQ ID NO: 791135 - DNA, 25 bp, Mus musculus
tcttccaaatgatctagagccaagg

SEQ ID NO: 791136 - DNA, 25 bp, Mus musculus
tcttccaagactacgacagccacat

SEQ ID NO: 791137 - DNA, 25 bp, Mus musculus
tcttccaagacttcgacagccacat

SEQ ID NO: 791138 - DNA, 25 bp, Mus musculus
tcttccaatcgaactactcccaaaa

SEQ ID NO: 791139 - DNA, 25 bp, Mus musculus
tcttccaatcgatctactcccaaaa

SEQ ID NO: 791140 - DNA, 25 bp, Mus musculus
tcttccacaaccagatcgagtcgaa

SEQ ID NO: 791141 - DNA, 25 bp, Mus musculus
tcttccacaacctgatcgagtcgaa

SEQ ID NO: 791142 - DNA, 25 bp, Mus musculus
tcttccacaaggacccggacataaa

SEQ ID NO: 791143 - DNA, 25 bp, Mus musculus
tcttccacaaggtcccggacataaa

SEQ ID NO: 791144 - DNA, 25 bp, Mus musculus
tcttccacacacagatgtgttcctg

SEQ ID NO: 791145 - DNA, 25 bp, Mus musculus
tcttccacacactgatgtgttcctg

SEQ ID NO: 791146 - DNA, 25 bp, Mus musculus
tcttccacgaacagatattatgtca

SEQ ID NO: 791147 - DNA, 25 bp, Mus musculus
tcttccacgaactgatattatgtca

SEQ ID NO: 791148 - DNA, 25 bp, Mus musculus
tcttccacgagaatgagctatggtt

SEQ ID NO: 791149 - DNA, 25 bp, Mus musculus
tcttccacgagattgagctatggtt

SEQ ID NO: 791150 - DNA, 25 bp, Mus musculus
tcttccacgagcacatgcaggagct

SEQ ID NO: 791151 - DNA, 25 bp, Mus musculus
tcttccacgagctcatgcaggagct

SEQ ID NO: 791152 - DNA, 25 bp, Mus musculus
tcttccactgtaattagaaacctgt

SEQ ID NO: 791153 - DNA, 25 bp, Mus musculus
tcttccactgtatttagaaacctgt

SEQ ID NO: 791154 - DNA, 25 bp, Mus musculus
tcttccactgtgatcttttctctgt

SEQ ID NO: 791155 - DNA, 25 bp, Mus musculus
tcttccactgtgttcttttctctgt

SEQ ID NO: 791156 - DNA, 25 bp, Mus musculus
tcttccagatgtcgtaatgaacggg

SEQ ID NO: 791157 - DNA, 25 bp, Mus musculus
tcttccagatgtggtaatgaacggg

SEQ ID NO: 791158 - DNA, 25 bp, Mus musculus
tcttccagcctgatatgctggtaat

SEQ ID NO: 791159 - DNA, 25 bp, Mus musculus
tcttccagcctgttatgctggtaat

SEQ ID NO: 791160 - DNA, 25 bp, Mus musculus
tcttccagctcaataactactatag

SEQ ID NO: 791161 - DNA, 25 bp, Mus musculus
tcttccagctcattaactactatag

SEQ ID NO: 791162 - DNA, 25 bp, Mus musculus
tcttccagcttaactctgggtgtga

SEQ ID NO: 791163 - DNA, 25 bp, Mus musculus
tcttccagcttatctctgggtgtga

SEQ ID NO: 791164 - DNA, 25 bp, Mus musculus
tcttccaggacaagttcgatgtgtc

SEQ ID NO: 791165 - DNA, 25 bp, Mus musculus
tcttccaggacatgttcgatgtgtc

SEQ ID NO: 791166 - DNA, 25 bp, Mus musculus
tcttccaggaccatctaccagtttg

SEQ ID NO: 791167 - DNA, 25 bp, Mus musculus
tcttccaggaccttctaccagtttg

SEQ ID NO: 791168 - DNA, 25 bp, Mus musculus
tcttccaggatgacagatttgtcag

SEQ ID NO: 791169 - DNA, 25 bp, Mus musculus
tcttccaggatgtcagatttgtcag

SEQ ID NO: 791170 - DNA, 25 bp, Mus musculus
tcttccaggcaactgccaacttagg

SEQ ID NO: 791171 - DNA, 25 bp, Mus musculus
tcttccaggcaagtgccaacttagg

SEQ ID NO: 791172 - DNA, 25 bp, Mus musculus
tcttccaggcttagaggcacgtcgg

SEQ ID NO: 791173 - DNA, 25 bp, Mus musculus
tcttccaggctttgaggcacgtcgg

SEQ ID NO: 791174 - DNA, 25 bp, Mus musculus
tcttccagggaacttacagttgaca

SEQ ID NO: 791175 - DNA, 25 bp, Mus musculus
tcttccagggaagttacagttgaca

SEQ ID NO: 791176 - DNA, 25 bp, Mus musculus
tcttccaggtcaaaggacgccgtgt

SEQ ID NO: 791177 - DNA, 25 bp, Mus musculus
tcttccaggtcataggacgccgtgt

SEQ ID NO: 791178 - DNA, 25 bp, Mus musculus
tcttccaggtgaacgcacccattaa

SEQ ID NO: 791179 - DNA, 25 bp, Mus musculus
tcttccaggtgatcgcacccattaa

SEQ ID NO: 791180 - DNA, 25 bp, Mus musculus
tcttccagtgtgagcttgcctattt

SEQ ID NO: 791181 - DNA, 25 bp, Mus musculus
tcttccagtgtgtgcttgcctattt

SEQ ID NO: 791182 - DNA, 25 bp, Mus musculus
tcttccataagcacgtgctgtcccg

SEQ ID NO: 791183 - DNA, 25 bp, Mus musculus
tcttccataagctcgtgctgtcccg

SEQ ID NO: 791184 - DNA, 25 bp, Mus musculus
tcttccataatgaaaaatccgtgag

SEQ ID NO: 791185 - DNA, 25 bp, Mus musculus
tcttccataatgtaaaatccgtgag

SEQ ID NO: 791186 - DNA, 25 bp, Mus musculus
tcttccatctctacgtgagcacatc

SEQ ID NO: 791187 - DNA, 25 bp, Mus musculus
tcttccatctcttcgtgagcacatc

SEQ ID NO: 791188 - DNA, 25 bp, Mus musculus
tcttccatggcgaggttgacaagcc

SEQ ID NO: 791189 - DNA, 25 bp, Mus musculus
tcttccatggcgtggttgacaagcc

SEQ ID NO: 791190 - DNA, 25 bp, Mus musculus
tcttccatggtaccttccatcttgg

SEQ ID NO: 791191 - DNA, 25 bp, Mus musculus
tcttccatggtagcttccatcttgg

SEQ ID NO: 791192 - DNA, 25 bp, Mus musculus
tcttccatgtcgctaatcccgtgat

SEQ ID NO: 791193 - DNA, 25 bp, Mus musculus
tcttccatgtcggtaatcccgtgat

SEQ ID NO: 791194 - DNA, 25 bp, Mus musculus
tcttccattccgcacatgattcttg

SEQ ID NO: 791195 - DNA, 25 bp, Mus musculus
tcttccattccggacatgattcttg

SEQ ID NO: 791196 - DNA, 25 bp, Mus musculus
tcttcccaactgaactgcaagagag

SEQ ID NO: 791197 - DNA, 25 bp, Mus musculus
tcttcccaactgtactgcaagagag

SEQ ID NO: 791198 - DNA, 25 bp, Mus musculus
tcttcccacacgctggaattattgc

SEQ ID NO: 791199 - DNA, 25 bp, Mus musculus
tcttcccacacggtggaattattgc

SEQ ID NO: 791200 - DNA, 25 bp, Mus musculus
tcttcccaccctagttctcttaaga

SEQ ID NO: 791201 - DNA, 25 bp, Mus musculus
tcttcccacccttgttctcttaaga

SEQ ID NO: 791202 - DNA, 25 bp, Mus musculus
tcttcccacgatcctaccgattggg

SEQ ID NO: 791203 - DNA, 25 bp, Mus musculus
tcttcccacgatgctaccgattggg

SEQ ID NO: 791204 - DNA, 25 bp, Mus musculus
tcttcccagaagcactaaagccgag

SEQ ID NO: 791205 - DNA, 25 bp, Mus musculus
tcttcccagaaggactaaagccgag

SEQ ID NO: 791206 - DNA, 25 bp, Mus musculus
tcttcccagataccctgattctggg

SEQ ID NO: 791207 - DNA, 25 bp, Mus musculus
tcttcccagatagcctgattctggg

SEQ ID NO: 791208 - DNA, 25 bp, Mus musculus
tcttcccagtctatccgctcatatg

SEQ ID NO: 791209 - DNA, 25 bp, Mus musculus
tcttcccagtctttccgctcatatg

SEQ ID NO: 791210 - DNA, 25 bp, Mus musculus
tcttcccatcataataagtcagggc

SEQ ID NO: 791211 - DNA, 25 bp, Mus musculus
tcttcccatcattataagtcagggc

SEQ ID NO: 791212 - DNA, 25 bp, Mus musculus
tcttcccattgtagaccaagtgtgg

SEQ ID NO: 791213 - DNA, 25 bp, Mus musculus
tcttcccattgttgaccaagtgtgg

SEQ ID NO: 791214 - DNA, 25 bp, Mus musculus
tcttccccaaggagatgaccaagtg

SEQ ID NO: 791215 - DNA, 25 bp, Mus musculus
tcttccccaaggtgatgaccaagtg

SEQ ID NO: 791216 - DNA, 25 bp, Mus musculus
tcttccccagggaagtcatgaactt

SEQ ID NO: 791217 - DNA, 25 bp, Mus musculus
tcttccccagggtagtcatgaactt

SEQ ID NO: 791218 - DNA, 25 bp, Mus musculus
tcttccccatagctgagtccaggat

SEQ ID NO: 791219 - DNA, 25 bp, Mus musculus
tcttccccataggtgagtccaggat

SEQ ID NO: 791220 - DNA, 25 bp, Mus musculus
tcttccccattgacagccgagggtc

SEQ ID NO: 791221 - DNA, 25 bp, Mus musculus
tcttccccattgtcagccgagggtc

SEQ ID NO: 791222 - DNA, 25 bp, Mus musculus
tcttcccctacaatgcttcttgtga

SEQ ID NO: 791223 - DNA, 25 bp, Mus musculus
tcttcccctacattgcttcttgtga

SEQ ID NO: 791224 - DNA, 25 bp, Mus musculus
tcttcccctgtcaggagagagagaa

SEQ ID NO: 791225 - DNA, 25 bp, Mus musculus
tcttcccctgtctggagagagagaa

SEQ ID NO: 791226 - DNA, 25 bp, Mus musculus
tcttcccgaggaaatcgacgacgtc

SEQ ID NO: 791227 - DNA, 25 bp, Mus musculus
tcttcccgaggatatcgacgacgtc

SEQ ID NO: 791228 - DNA, 25 bp, Mus musculus
tcttcccgaggtcatgatggtatga

SEQ ID NO: 791229 - DNA, 25 bp, Mus musculus
tcttcccgaggtgatgatggtatga

SEQ ID NO: 791230 - DNA, 25 bp, Mus musculus
tcttcccgcaacctgatcgtggagc

SEQ ID NO: 791231 - DNA, 25 bp, Mus musculus
tcttcccgcaacgtgatcgtggagc

SEQ ID NO: 791232 - DNA, 25 bp, Mus musculus
tcttcccggcataggatgcagggtc

SEQ ID NO: 791233 - DNA, 25 bp, Mus musculus
tcttcccggcattggatgcagggtc

SEQ ID NO: 791234 - DNA, 25 bp, Mus musculus
tcttcccgggaactgtatgaaacag

SEQ ID NO: 791235 - DNA, 25 bp, Mus musculus
tcttcccgggaagtgtatgaaacag

SEQ ID NO: 791236 - DNA, 25 bp, Mus musculus
tcttcccgggttccagcctgtgtat

SEQ ID NO: 791237 - DNA, 25 bp, Mus musculus
tcttcccgggttgcagcctgtgtat

SEQ ID NO: 791238 - DNA, 25 bp, Mus musculus
tcttcccggttgacagcaggtctgg

SEQ ID NO: 791239 - DNA, 25 bp, Mus musculus
tcttcccggttgtcagcaggtctgg

SEQ ID NO: 791240 - DNA, 25 bp, Mus musculus
tcttccctaggcaatgctgctgcta

SEQ ID NO: 791241 - DNA, 25 bp, Mus musculus
tcttccctaggctatgctgctgcta

SEQ ID NO: 791242 - DNA, 25 bp, Mus musculus
tcttccctcatcagaaagctttacc

SEQ ID NO: 791243 - DNA, 25 bp, Mus musculus
tcttccctcatctgaaagctttacc

SEQ ID NO: 791244 - DNA, 25 bp, Mus musculus
tcttccctccctcatttatactggg

SEQ ID NO: 791245 - DNA, 25 bp, Mus musculus
tcttccctccctgatttatactggg

SEQ ID NO: 791246 - DNA, 25 bp, Mus musculus
tcttccctgacaattaaaggcacag

SEQ ID NO: 791247 - DNA, 25 bp, Mus musculus
tcttccctgacatttaaaggcacag

SEQ ID NO: 791248 - DNA, 25 bp, Mus musculus
tcttccctgaggcttttgactatgg

SEQ ID NO: 791249 - DNA, 25 bp, Mus musculus
tcttccctgagggttttgactatgg

SEQ ID NO: 791250 - DNA, 25 bp, Mus musculus
tcttccctgattagtctccagggta

SEQ ID NO: 791251 - DNA, 25 bp, Mus musculus
tcttccctgatttgtctccagggta

SEQ ID NO: 791252 - DNA, 25 bp, Mus musculus
tcttccctgccgaggtgatcatagc

SEQ ID NO: 791253 - DNA, 25 bp, Mus musculus
tcttccctgccgtggtgatcatagc

SEQ ID NO: 791254 - DNA, 25 bp, Mus musculus
tcttccctggcgagttagaagctgc

SEQ ID NO: 791255 - DNA, 25 bp, Mus musculus
tcttccctggcgtgttagaagctgc

SEQ ID NO: 791256 - DNA, 25 bp, Mus musculus
tcttccctgtccacggtggtctggc

SEQ ID NO: 791257 - DNA, 25 bp, Mus musculus
tcttccctgtcctcggtggtctggc

SEQ ID NO: 791258 - DNA, 25 bp, Mus musculus
tcttccctgtggatcccaggctgct

SEQ ID NO: 791259 - DNA, 25 bp, Mus musculus
tcttccctgtggttcccaggctgct

SEQ ID NO: 791260 - DNA, 25 bp, Mus musculus
tcttccctgttccttccaatgccag

SEQ ID NO: 791261 - DNA, 25 bp, Mus musculus
tcttccctgttcgttccaatgccag

SEQ ID NO: 791262 - DNA, 25 bp, Mus musculus
tcttcccttatgagagataagaccg

SEQ ID NO: 791263 - DNA, 25 bp, Mus musculus
tcttcccttatgtgagataagaccg

SEQ ID NO: 791264 - DNA, 25 bp, Mus musculus
tcttcccttggcatcacctctgtgg

SEQ ID NO: 791265 - DNA, 25 bp, Mus musculus
tcttcccttggcttcacctctgtgg

SEQ ID NO: 791266 - DNA, 25 bp, Mus musculus
tcttccgaagaaaacaggatcccct

SEQ ID NO: 791267 - DNA, 25 bp, Mus musculus
tcttccgaagaatacaggatcccct

SEQ ID NO: 791268 - DNA, 25 bp, Mus musculus
tcttccgacaagcaatgctggatgt

SEQ ID NO: 791269 - DNA, 25 bp, Mus musculus
tcttccgacaaggaatgctggatgt

SEQ ID NO: 791270 - DNA, 25 bp, Mus musculus
tcttccgacagaccagttagcttac

SEQ ID NO: 791271 - DNA, 25 bp, Mus musculus
tcttccgacagagcagttagcttac

SEQ ID NO: 791272 - DNA, 25 bp, Mus musculus
tcttccgacattacattgatgagga

SEQ ID NO: 791273 - DNA, 25 bp, Mus musculus
tcttccgacatttcattgatgagga

SEQ ID NO: 791274 - DNA, 25 bp, Mus musculus
tcttccgagagcagccggaacctct

SEQ ID NO: 791275 - DNA, 25 bp, Mus musculus
tcttccgagagctgccggaacctct

SEQ ID NO: 791276 - DNA, 25 bp, Mus musculus
tcttccgcaacgagtggggcagctt

SEQ ID NO: 791277 - DNA, 25 bp, Mus musculus
tcttccgcaacgtgtggggcagctt

SEQ ID NO: 791278 - DNA, 25 bp, Mus musculus
tcttccgcaggaatgcgaagttctc

SEQ ID NO: 791279 - DNA, 25 bp, Mus musculus
tcttccgcaggattgcgaagttctc

SEQ ID NO: 791280 - DNA, 25 bp, Mus musculus
tcttccgccgccattttaaatctag

SEQ ID NO: 791281 - DNA, 25 bp, Mus musculus
tcttccgccgcctttttaaatctag

SEQ ID NO: 791282 - DNA, 25 bp, Mus musculus
tcttccggaaccaatgcacctagca

SEQ ID NO: 791283 - DNA, 25 bp, Mus musculus
tcttccggaacctatgcacctagca

SEQ ID NO: 791284 - DNA, 25 bp, Mus musculus
tcttccggaatcattttcgctggtt

SEQ ID NO: 791285 - DNA, 25 bp, Mus musculus
tcttccggaatctttttcgctggtt

SEQ ID NO: 791286 - DNA, 25 bp, Mus musculus
tcttccggacaaccatcaacagggc

SEQ ID NO: 791287 - DNA, 25 bp, Mus musculus
tcttccggacaagcatcaacagggc

SEQ ID NO: 791288 - DNA, 25 bp, Mus musculus
tcttccggactcagaagatcatctg

SEQ ID NO: 791289 - DNA, 25 bp, Mus musculus
tcttccggactctgaagatcatctg

SEQ ID NO: 791290 - DNA, 25 bp, Mus musculus
tcttccggccgtccttgatgggtct

SEQ ID NO: 791291 - DNA, 25 bp, Mus musculus
tcttccggccgtgcttgatgggtct

SEQ ID NO: 791292 - DNA, 25 bp, Mus musculus
tcttccgggagaacattgtcactga

SEQ ID NO: 791293 - DNA, 25 bp, Mus musculus
tcttccgggagatcattgtcactga

SEQ ID NO: 791294 - DNA, 25 bp, Mus musculus
tcttccgggtcaacaccgaggtgtc

SEQ ID NO: 791295 - DNA, 25 bp, Mus musculus
tcttccgggtcatcaccgaggtgtc

SEQ ID NO: 791296 - DNA, 25 bp, Mus musculus
tcttccggtgggagtcggtcagata

SEQ ID NO: 791297 - DNA, 25 bp, Mus musculus
tcttccggtgggtgtcggtcagata

SEQ ID NO: 791298 - DNA, 25 bp, Mus musculus
tcttccgtaagactaaggcagctcc

SEQ ID NO: 791299 - DNA, 25 bp, Mus musculus
tcttccgtaagagtaaggcagctcc

SEQ ID NO: 791300 - DNA, 25 bp, Mus musculus
tcttccgtctggaggagctatctgg

SEQ ID NO: 791301 - DNA, 25 bp, Mus musculus
tcttccgtctggtggagctatctgg

SEQ ID NO: 791302 - DNA, 25 bp, Mus musculus
tcttccgttgccctgtggcttcggc

SEQ ID NO: 791303 - DNA, 25 bp, Mus musculus
tcttccgttgccgtgtggcttcggc

SEQ ID NO: 791304 - DNA, 25 bp, Mus musculus
tcttcctaacaacagcaaacaattc

SEQ ID NO: 791305 - DNA, 25 bp, Mus musculus
tcttcctaacaagagcaaacaattc

SEQ ID NO: 791306 - DNA, 25 bp, Mus musculus
tcttcctaaccaaaggttcccgtct

SEQ ID NO: 791307 - DNA, 25 bp, Mus musculus
tcttcctaaccataggttcccgtct

SEQ ID NO: 791308 - DNA, 25 bp, Mus musculus
tcttcctaagcaagacaacagttgc

SEQ ID NO: 791309 - DNA, 25 bp, Mus musculus
tcttcctaagcatgacaacagttgc

SEQ ID NO: 791310 - DNA, 25 bp, Mus musculus
tcttcctaatgacgccactgtctgc

SEQ ID NO: 791311 - DNA, 25 bp, Mus musculus
tcttcctaatgaggccactgtctgc

SEQ ID NO: 791312 - DNA, 25 bp, Mus musculus
tcttcctaatggctttggccacgtt

SEQ ID NO: 791313 - DNA, 25 bp, Mus musculus
tcttcctaatgggtttggccacgtt

SEQ ID NO: 791314 - DNA, 25 bp, Mus musculus
tcttcctagcccagagacatacttg

SEQ ID NO: 791315 - DNA, 25 bp, Mus musculus
tcttcctagccctgagacatacttg

SEQ ID NO: 791316 - DNA, 25 bp, Mus musculus
tcttcctagcctatcagcagagagc

SEQ ID NO: 791317 - DNA, 25 bp, Mus musculus
tcttcctagcctttcagcagagagc

SEQ ID NO: 791318 - DNA, 25 bp, Mus musculus
tcttcctaggacagtttgggctccg

SEQ ID NO: 791319 - DNA, 25 bp, Mus musculus
tcttcctaggactgtttgggctccg

SEQ ID NO: 791320 - DNA, 25 bp, Mus musculus
tcttcctaggagatactggcagggt

SEQ ID NO: 791321 - DNA, 25 bp, Mus musculus
tcttcctaggagttactggcagggt

SEQ ID NO: 791322 - DNA, 25 bp, Mus musculus
tcttcctatatgatgacgctggtca

SEQ ID NO: 791323 - DNA, 25 bp, Mus musculus
tcttcctatatgttgacgctggtca

SEQ ID NO: 791324 - DNA, 25 bp, Mus musculus
tcttcctcaaagcaccaaaggtgtg

SEQ ID NO: 791325 - DNA, 25 bp, Mus musculus
tcttcctcaaaggaccaaaggtgtg

SEQ ID NO: 791326 - DNA, 25 bp, Mus musculus
tcttcctccgggaaccaacgctatt

SEQ ID NO: 791327 - DNA, 25 bp, Mus musculus
tcttcctccgggtaccaacgctatt

SEQ ID NO: 791328 - DNA, 25 bp, Mus musculus
tcttcctcggaacggcctacttgga

SEQ ID NO: 791329 - DNA, 25 bp, Mus musculus
tcttcctcggaagggcctacttgga

SEQ ID NO: 791330 - DNA, 25 bp, Mus musculus
tcttcctctacacaagtgagctcta

SEQ ID NO: 791331 - DNA, 25 bp, Mus musculus
tcttcctctacagaagtgagctcta

SEQ ID NO: 791332 - DNA, 25 bp, Mus musculus
tcttcctctatcctggtcagcatgg

SEQ ID NO: 791333 - DNA, 25 bp, Mus musculus
tcttcctctatcgtggtcagcatgg

SEQ ID NO: 791334 - DNA, 25 bp, Mus musculus
tcttcctctcaaaccaagtctagtg

SEQ ID NO: 791335 - DNA, 25 bp, Mus musculus
tcttcctctcaatccaagtctagtg

SEQ ID NO: 791336 - DNA, 25 bp, Mus musculus
tcttcctctccgaagggctggtaac

SEQ ID NO: 791337 - DNA, 25 bp, Mus musculus
tcttcctctccgtagggctggtaac

SEQ ID NO: 791338 - DNA, 25 bp, Mus musculus
tcttcctgaatacatgacactgtgg

SEQ ID NO: 791339 - DNA, 25 bp, Mus musculus
tcttcctgaatagatgacactgtgg

SEQ ID NO: 791340 - DNA, 25 bp, Mus musculus
tcttcctgaatgcaacgggaggaca

SEQ ID NO: 791341 - DNA, 25 bp, Mus musculus
tcttcctgaatggaacgggaggaca

SEQ ID NO: 791342 - DNA, 25 bp, Mus musculus
tcttcctgaccgctgtgaccagtag

SEQ ID NO: 791343 - DNA, 25 bp, Mus musculus
tcttcctgaccggtgtgaccagtag

SEQ ID NO: 791344 - DNA, 25 bp, Mus musculus
tcttcctgacggcagcccttgggtt

SEQ ID NO: 791345 - DNA, 25 bp, Mus musculus
tcttcctgacgggagcccttgggtt

SEQ ID NO: 791346 - DNA, 25 bp, Mus musculus
tcttcctgactgatatgactgagag

SEQ ID NO: 791347 - DNA, 25 bp, Mus musculus
tcttcctgactgttatgactgagag

SEQ ID NO: 791348 - DNA, 25 bp, Mus musculus
tcttcctgagccaggattaatcatg

SEQ ID NO: 791349 - DNA, 25 bp, Mus musculus
tcttcctgagcctggattaatcatg

SEQ ID NO: 791350 - DNA, 25 bp, Mus musculus
tcttcctgaggtcataaacacatgg

SEQ ID NO: 791351 - DNA, 25 bp, Mus musculus
tcttcctgaggtgataaacacatgg

SEQ ID NO: 791352 - DNA, 25 bp, Mus musculus
tcttcctgagtcagcgaggctcctc

SEQ ID NO: 791353 - DNA, 25 bp, Mus musculus
tcttcctgagtctgcgaggctcctc

SEQ ID NO: 791354 - DNA, 25 bp, Mus musculus
tcttcctgattgaggctagtgcagc

SEQ ID NO: 791355 - DNA, 25 bp, Mus musculus
tcttcctgattgtggctagtgcagc

SEQ ID NO: 791356 - DNA, 25 bp, Mus musculus
tcttcctgcaccagtgccctgtggg

SEQ ID NO: 791357 - DNA, 25 bp, Mus musculus
tcttcctgcacctgtgccctgtggg

SEQ ID NO: 791358 - DNA, 25 bp, Mus musculus
tcttcctgccacagcatggattatg

SEQ ID NO: 791359 - DNA, 25 bp, Mus musculus
tcttcctgccactgcatggattatg

SEQ ID NO: 791360 - DNA, 25 bp, Mus musculus
tcttcctgccgaaaagccagttggg

SEQ ID NO: 791361 - DNA, 25 bp, Mus musculus
tcttcctgccgataagccagttggg

SEQ ID NO: 791362 - DNA, 25 bp, Mus musculus
tcttcctgccttagggagtaaaggc

SEQ ID NO: 791363 - DNA, 25 bp, Mus musculus
tcttcctgcctttgggagtaaaggc

SEQ ID NO: 791364 - DNA, 25 bp, Mus musculus
tcttcctgcgccaaggtatggcgag

SEQ ID NO: 791365 - DNA, 25 bp, Mus musculus
tcttcctgcgcctaggtatggcgag

SEQ ID NO: 791366 - DNA, 25 bp, Mus musculus
tcttcctgcgtcatacctgggtagt

SEQ ID NO: 791367 - DNA, 25 bp, Mus musculus
tcttcctgcgtcttacctgggtagt

SEQ ID NO: 791368 - DNA, 25 bp, Mus musculus
tcttcctgctcaagatcaccgggca

SEQ ID NO: 791369 - DNA, 25 bp, Mus musculus
tcttcctgctcatgatcaccgggca

SEQ ID NO: 791370 - DNA, 25 bp, Mus musculus
tcttcctggaggcaatgtacaacca

SEQ ID NO: 791371 - DNA, 25 bp, Mus musculus
tcttcctggagggaatgtacaacca

SEQ ID NO: 791372 - DNA, 25 bp, Mus musculus
tcttcctggcgcaggtttcccggat

SEQ ID NO: 791373 - DNA, 25 bp, Mus musculus
tcttcctggcgctggtttcccggat

SEQ ID NO: 791374 - DNA, 25 bp, Mus musculus
tcttcctgggagaagacgctgcaga

SEQ ID NO: 791375 - DNA, 25 bp, Mus musculus
tcttcctgggagtagacgctgcaga

SEQ ID NO: 791376 - DNA, 25 bp, Mus musculus
tcttcctgggtaaccaagggccagc

SEQ ID NO: 791377 - DNA, 25 bp, Mus musculus
tcttcctgggtatccaagggccagc

SEQ ID NO: 791378 - DNA, 25 bp, Mus musculus
tcttcctgggtcatcagaaagacca

SEQ ID NO: 791379 - DNA, 25 bp, Mus musculus
tcttcctgggtcttcagaaagacca

SEQ ID NO: 791380 - DNA, 25 bp, Mus musculus
tcttcctggtggagcatgcagccag

SEQ ID NO: 791381 - DNA, 25 bp, Mus musculus
tcttcctggtggtgcatgcagccag

SEQ ID NO: 791382 - DNA, 25 bp, Mus musculus
tcttcctgtagaccagcgcctgctg

SEQ ID NO: 791383 - DNA, 25 bp, Mus musculus
tcttcctgtagagcagcgcctgctg

SEQ ID NO: 791384 - DNA, 25 bp, Mus musculus
tcttcctgtaggaggcaacagtgac

SEQ ID NO: 791385 - DNA, 25 bp, Mus musculus
tcttcctgtaggtggcaacagtgac

SEQ ID NO: 791386 - DNA, 25 bp, Mus musculus
tcttcctgtcatctctttttgcaga

SEQ ID NO: 791387 - DNA, 25 bp, Mus musculus
tcttcctgtcatgtctttttgcaga

SEQ ID NO: 791388 - DNA, 25 bp, Mus musculus
tcttccttaagtatggcggtcacca

SEQ ID NO: 791389 - DNA, 25 bp, Mus musculus
tcttccttaagtttggcggtcacca

SEQ ID NO: 791390 - DNA, 25 bp, Mus musculus
tcttccttacttagctcctaagcca

SEQ ID NO: 791391 - DNA, 25 bp, Mus musculus
tcttccttactttgctcctaagcca

SEQ ID NO: 791392 - DNA, 25 bp, Mus musculus
tcttccttcagcagatctggtccag

SEQ ID NO: 791393 - DNA, 25 bp, Mus musculus
tcttccttcagctgatctggtccag

SEQ ID NO: 791394 - DNA, 25 bp, Mus musculus
tcttccttgactcgatgcgcctgga

SEQ ID NO: 791395 - DNA, 25 bp, Mus musculus
tcttccttgactggatgcgcctgga

SEQ ID NO: 791396 - DNA, 25 bp, Mus musculus
tcttccttggaacatcacagtacat

SEQ ID NO: 791397 - DNA, 25 bp, Mus musculus
tcttccttggaagatcacagtacat

SEQ ID NO: 791398 - DNA, 25 bp, Mus musculus
tcttcctttagtagaagagatggag

SEQ ID NO: 791399 - DNA, 25 bp, Mus musculus
tcttcctttagttgaagagatggag

SEQ ID NO: 791400 - DNA, 25 bp, Mus musculus
tcttcctttgatcactccagatttc

SEQ ID NO: 791401 - DNA, 25 bp, Mus musculus
tcttcctttgatgactccagatttc

SEQ ID NO: 791402 - DNA, 25 bp, Mus musculus
tcttccttttgtcctgtcctgtcgc

SEQ ID NO: 791403 - DNA, 25 bp, Mus musculus
tcttccttttgtgctgtcctgtcgc

SEQ ID NO: 791404 - DNA, 25 bp, Mus musculus
tcttcgaaacctataagagttaccg

SEQ ID NO: 791405 - DNA, 25 bp, Mus musculus
tcttcgaaacctttaagagttaccg

SEQ ID NO: 791406 - DNA, 25 bp, Mus musculus
tcttcgaagcatcgtggctcaccgg

SEQ ID NO: 791407 - DNA, 25 bp, Mus musculus
tcttcgaagcatggtggctcaccgg

SEQ ID NO: 791408 - DNA, 25 bp, Mus musculus
tcttcgaaggacacctcgaagcgag

SEQ ID NO: 791409 - DNA, 25 bp, Mus musculus
tcttcgaaggactcctcgaagcgag

SEQ ID NO: 791410 - DNA, 25 bp, Mus musculus
tcttcgaatacaaggccctgagccc

SEQ ID NO: 791411 - DNA, 25 bp, Mus musculus
tcttcgaatacatggccctgagccc

SEQ ID NO: 791412 - DNA, 25 bp, Mus musculus
tcttcgaatggcagaagaaattggg

SEQ ID NO: 791413 - DNA, 25 bp, Mus musculus
tcttcgaatggctgaagaaattggg

SEQ ID NO: 791414 - DNA, 25 bp, Mus musculus
tcttcgacaaatacctgggagcaat

SEQ ID NO: 791415 - DNA, 25 bp, Mus musculus
tcttcgacaaattcctgggagcaat

SEQ ID NO: 791416 - DNA, 25 bp, Mus musculus
tcttcgacggtaattcatcctggat

SEQ ID NO: 791417 - DNA, 25 bp, Mus musculus
tcttcgacggtatttcatcctggat

SEQ ID NO: 791418 - DNA, 25 bp, Mus musculus
tcttcgactccacgactcttgaaca

SEQ ID NO: 791419 - DNA, 25 bp, Mus musculus
tcttcgactccaggactcttgaaca

SEQ ID NO: 791420 - DNA, 25 bp, Mus musculus
tcttcgagactcatggagcggagga

SEQ ID NO: 791421 - DNA, 25 bp, Mus musculus
tcttcgagactcttggagcggagga

SEQ ID NO: 791422 - DNA, 25 bp, Mus musculus
tcttcgagcagtacgggaaggtgct

SEQ ID NO: 791423 - DNA, 25 bp, Mus musculus
tcttcgagcagttcgggaaggtgct

SEQ ID NO: 791424 - DNA, 25 bp, Mus musculus
tcttcgagcatccatctacgggcag

SEQ ID NO: 791425 - DNA, 25 bp, Mus musculus
tcttcgagcatcgatctacgggcag

SEQ ID NO: 791426 - DNA, 25 bp, Mus musculus
tcttcgagccccaggctgagcactg

SEQ ID NO: 791427 - DNA, 25 bp, Mus musculus
tcttcgagcccctggctgagcactg

SEQ ID NO: 791428 - DNA, 25 bp, Mus musculus
tcttcgaggaaaccggaagcccgtg

SEQ ID NO: 791429 - DNA, 25 bp, Mus musculus
tcttcgaggaaagcggaagcccgtg

SEQ ID NO: 791430 - DNA, 25 bp, Mus musculus
tcttcgagggcaaggtttgtcacgg

SEQ ID NO: 791431 - DNA, 25 bp, Mus musculus
tcttcgagggcatggtttgtcacgg

SEQ ID NO: 791432 - DNA, 25 bp, Mus musculus
tcttcgagggtcaacccaacgacag

SEQ ID NO: 791433 - DNA, 25 bp, Mus musculus
tcttcgagggtctacccaacgacag

SEQ ID NO: 791434 - DNA, 25 bp, Mus musculus
tcttcgagtacgagacccagagaag

SEQ ID NO: 791435 - DNA, 25 bp, Mus musculus
tcttcgagtacgtgacccagagaag

SEQ ID NO: 791436 - DNA, 25 bp, Mus musculus
tcttcgatatgcaacacgagaagcg

SEQ ID NO: 791437 - DNA, 25 bp, Mus musculus
tcttcgatatgctacacgagaagcg

SEQ ID NO: 791438 - DNA, 25 bp, Mus musculus
tcttcgatgacaatgccaagttgcc

SEQ ID NO: 791439 - DNA, 25 bp, Mus musculus
tcttcgatgacattgccaagttgcc

SEQ ID NO: 791440 - DNA, 25 bp, Mus musculus
tcttcgatgccaagcgcctcatcgg

SEQ ID NO: 791441 - DNA, 25 bp, Mus musculus
tcttcgatgccatgcgcctcatcgg

SEQ ID NO: 791442 - DNA, 25 bp, Mus musculus
tcttcgatggagacctggtgtgcac

SEQ ID NO: 791443 - DNA, 25 bp, Mus musculus
tcttcgatggagtcctggtgtgcac

SEQ ID NO: 791444 - DNA, 25 bp, Mus musculus
tcttcgcagagcaatcacaggttca

SEQ ID NO: 791445 - DNA, 25 bp, Mus musculus
tcttcgcagagctatcacaggttca

SEQ ID NO: 791446 - DNA, 25 bp, Mus musculus
tcttcgcagccgagggacagtgcct

SEQ ID NO: 791447 - DNA, 25 bp, Mus musculus
tcttcgcagccgtgggacagtgcct

SEQ ID NO: 791448 - DNA, 25 bp, Mus musculus
tcttcgccatacacttcagcttcaa

SEQ ID NO: 791449 - DNA, 25 bp, Mus musculus
tcttcgccatactcttcagcttcaa

SEQ ID NO: 791450 - DNA, 25 bp, Mus musculus
tcttcgccatcacacaaacctgttg

SEQ ID NO: 791451 - DNA, 25 bp, Mus musculus
tcttcgccatcagacaaacctgttg

SEQ ID NO: 791452 - DNA, 25 bp, Mus musculus
tcttcgcccgggaaatcctggactc

SEQ ID NO: 791453 - DNA, 25 bp, Mus musculus
tcttcgcccgggtaatcctggactc

SEQ ID NO: 791454 - DNA, 25 bp, Mus musculus
tcttcgccctcaagttcacttgcag

SEQ ID NO: 791455 - DNA, 25 bp, Mus musculus
tcttcgccctcatgttcacttgcag

SEQ ID NO: 791456 - DNA, 25 bp, Mus musculus
tcttcgccctcgctatcgggtggct

SEQ ID NO: 791457 - DNA, 25 bp, Mus musculus
tcttcgccctcggtatcgggtggct

SEQ ID NO: 791458 - DNA, 25 bp, Mus musculus
tcttcgcgctaaccagcaagctgtg

SEQ ID NO: 791459 - DNA, 25 bp, Mus musculus
tcttcgcgctaagcagcaagctgtg

SEQ ID NO: 791460 - DNA, 25 bp, Mus musculus
tcttcgcggtccaggtggtcgtgct

SEQ ID NO: 791461 - DNA, 25 bp, Mus musculus
tcttcgcggtcctggtggtcgtgct

SEQ ID NO: 791462 - DNA, 25 bp, Mus musculus
tcttcgctctacaggtttcttggaa

SEQ ID NO: 791463 - DNA, 25 bp, Mus musculus
tcttcgctctactggtttcttggaa

SEQ ID NO: 791464 - DNA, 25 bp, Mus musculus
tcttcggaaatgcaagccaggtgac

SEQ ID NO: 791465 - DNA, 25 bp, Mus musculus
tcttcggaaatggaagccaggtgac

SEQ ID NO: 791466 - DNA, 25 bp, Mus musculus
tcttcggagcctcatccagggttcg

SEQ ID NO: 791467 - DNA, 25 bp, Mus musculus
tcttcggagcctgatccagggttcg

SEQ ID NO: 791468 - DNA, 25 bp, Mus musculus
tcttcggaggatctccctcttacca

SEQ ID NO: 791469 - DNA, 25 bp, Mus musculus
tcttcggaggatgtccctcttacca

SEQ ID NO: 791470 - DNA, 25 bp, Mus musculus
tcttcggagtaaagacttgctgtac

SEQ ID NO: 791471 - DNA, 25 bp, Mus musculus
tcttcggagtaatgacttgctgtac

SEQ ID NO: 791472 - DNA, 25 bp, Mus musculus
tcttcggagtcacagggaacaggcc

SEQ ID NO: 791473 - DNA, 25 bp, Mus musculus
tcttcggagtcagagggaacaggcc

SEQ ID NO: 791474 - DNA, 25 bp, Mus musculus
tcttcggcacagacatctgcaaggc

SEQ ID NO: 791475 - DNA, 25 bp, Mus musculus
tcttcggcacagtcatctgcaaggc

SEQ ID NO: 791476 - DNA, 25 bp, Mus musculus
tcttcggcagagacagatgcagcag

SEQ ID NO: 791477 - DNA, 25 bp, Mus musculus
tcttcggcagagtcagatgcagcag

SEQ ID NO: 791478 - DNA, 25 bp, Mus musculus
tcttcggctacacctggaacagcag

SEQ ID NO: 791479 - DNA, 25 bp, Mus musculus
tcttcggctacagctggaacagcag

SEQ ID NO: 791480 - DNA, 25 bp, Mus musculus
tcttcggctctaacgtgaacgaggg

SEQ ID NO: 791481 - DNA, 25 bp, Mus musculus
tcttcggctctatcgtgaacgaggg

SEQ ID NO: 791482 - DNA, 25 bp, Mus musculus
tcttcggctctcagacatgcagggc

SEQ ID NO: 791483 - DNA, 25 bp, Mus musculus
tcttcggctctctgacatgcagggc

SEQ ID NO: 791484 - DNA, 25 bp, Mus musculus
tcttcggcttcaaggcccagttgcg

SEQ ID NO: 791485 - DNA, 25 bp, Mus musculus
tcttcggcttcatggcccagttgcg

SEQ ID NO: 791486 - DNA, 25 bp, Mus musculus
tcttcgggaaccaggagccgtggac

SEQ ID NO: 791487 - DNA, 25 bp, Mus musculus
tcttcgggaacctggagccgtggac

SEQ ID NO: 791488 - DNA, 25 bp, Mus musculus
tcttcgggacccaagtggagcagga

SEQ ID NO: 791489 - DNA, 25 bp, Mus musculus
tcttcgggaccctagtggagcagga

SEQ ID NO: 791490 - DNA, 25 bp, Mus musculus
tcttcgggacctcactgaacagtgg

SEQ ID NO: 791491 - DNA, 25 bp, Mus musculus
tcttcgggacctgactgaacagtgg

SEQ ID NO: 791492 - DNA, 25 bp, Mus musculus
tcttcgggagtaagtcgcacagctc

SEQ ID NO: 791493 - DNA, 25 bp, Mus musculus
tcttcgggagtatgtcgcacagctc

SEQ ID NO: 791494 - DNA, 25 bp, Mus musculus
tcttcgggatcaacctgaaaacagg

SEQ ID NO: 791495 - DNA, 25 bp, Mus musculus
tcttcgggatcatcctgaaaacagg

SEQ ID NO: 791496 - DNA, 25 bp, Mus musculus
tcttcgggccgaaaactatgatatt

SEQ ID NO: 791497 - DNA, 25 bp, Mus musculus
tcttcgggccgataactatgatatt

SEQ ID NO: 791498 - DNA, 25 bp, Mus musculus
tcttcgggtggacaagactcttaaa

SEQ ID NO: 791499 - DNA, 25 bp, Mus musculus
tcttcgggtggagaagactcttaaa

SEQ ID NO: 791500 - DNA, 25 bp, Mus musculus
tcttcggtaaacatcaacagcacgg

SEQ ID NO: 791501 - DNA, 25 bp, Mus musculus
tcttcggtaaacttcaacagcacgg

SEQ ID NO: 791502 - DNA, 25 bp, Mus musculus
tcttcggtacagacaaggacctgcc

SEQ ID NO: 791503 - DNA, 25 bp, Mus musculus
tcttcggtacagtcaaggacctgcc

SEQ ID NO: 791504 - DNA, 25 bp, Mus musculus
tcttcggtccgaagaccatgagcgc

SEQ ID NO: 791505 - DNA, 25 bp, Mus musculus
tcttcggtccgatgaccatgagcgc

SEQ ID NO: 791506 - DNA, 25 bp, Mus musculus
tcttcggtgcttatatagctggcag

SEQ ID NO: 791507 - DNA, 25 bp, Mus musculus
tcttcggtgcttttatagctggcag

SEQ ID NO: 791508 - DNA, 25 bp, Mus musculus
tcttcggtgtacagctctcccattg

SEQ ID NO: 791509 - DNA, 25 bp, Mus musculus
tcttcggtgtactgctctcccattg

SEQ ID NO: 791510 - DNA, 25 bp, Mus musculus
tcttcggtgtccactacaccgtctt

SEQ ID NO: 791511 - DNA, 25 bp, Mus musculus
tcttcggtgtcctctacaccgtctt

SEQ ID NO: 791512 - DNA, 25 bp, Mus musculus
tcttcggttcctctcactcctgtga

SEQ ID NO: 791513 - DNA, 25 bp, Mus musculus
tcttcggttcctgtcactcctgtga

SEQ ID NO: 791514 - DNA, 25 bp, Mus musculus
tcttcggtttccatctttccagccg

SEQ ID NO: 791515 - DNA, 25 bp, Mus musculus
tcttcggtttccttctttccagccg

SEQ ID NO: 791516 - DNA, 25 bp, Mus musculus
tcttcgtaacacaggccagcagtgg

SEQ ID NO: 791517 - DNA, 25 bp, Mus musculus
tcttcgtaacactggccagcagtgg

SEQ ID NO: 791518 - DNA, 25 bp, Mus musculus
tcttcgtatggcaggggacccagtt

SEQ ID NO: 791519 - DNA, 25 bp, Mus musculus
tcttcgtatggctggggacccagtt

SEQ ID NO: 791520 - DNA, 25 bp, Mus musculus
tcttcgtcaaggaacagagcgaggt

SEQ ID NO: 791521 - DNA, 25 bp, Mus musculus
tcttcgtcaaggtacagagcgaggt

SEQ ID NO: 791522 - DNA, 25 bp, Mus musculus
tcttcgtcaggacaaggctctctct

SEQ ID NO: 791523 - DNA, 25 bp, Mus musculus
tcttcgtcaggagaaggctctctct

SEQ ID NO: 791524 - DNA, 25 bp, Mus musculus
tcttcgtcgcggcttggatttcaaa

SEQ ID NO: 791525 - DNA, 25 bp, Mus musculus
tcttcgtcgcgggttggatttcaaa

SEQ ID NO: 791526 - DNA, 25 bp, Mus musculus
tcttcgtctttgcacggctgagcca

SEQ ID NO: 791527 - DNA, 25 bp, Mus musculus
tcttcgtctttggacggctgagcca

SEQ ID NO: 791528 - DNA, 25 bp, Mus musculus
tcttcgtggataaccggatagacac

SEQ ID NO: 791529 - DNA, 25 bp, Mus musculus
tcttcgtggatatccggatagacac

SEQ ID NO: 791530 - DNA, 25 bp, Mus musculus
tcttcgtggcagaccagcggagtcg

SEQ ID NO: 791531 - DNA, 25 bp, Mus musculus
tcttcgtggcagtccagcggagtcg

SEQ ID NO: 791532 - DNA, 25 bp, Mus musculus
tcttcgtggctacctggaacatgca

SEQ ID NO: 791533 - DNA, 25 bp, Mus musculus
tcttcgtggctagctggaacatgca

SEQ ID NO: 791534 - DNA, 25 bp, Mus musculus
tcttcgtgggcacctggatggtcta

SEQ ID NO: 791535 - DNA, 25 bp, Mus musculus
tcttcgtgggcagctggatggtcta

SEQ ID NO: 791536 - DNA, 25 bp, Mus musculus
tcttcgtggtatcgcacacaggaca

SEQ ID NO: 791537 - DNA, 25 bp, Mus musculus
tcttcgtggtatggcacacaggaca

SEQ ID NO: 791538 - DNA, 25 bp, Mus musculus
tcttcgtggtgaaggaaaagctcca

SEQ ID NO: 791539 - DNA, 25 bp, Mus musculus
tcttcgtggtgatggaaaagctcca

SEQ ID NO: 791540 - DNA, 25 bp, Mus musculus
tcttcgttcgctaaccggcggcttc

SEQ ID NO: 791541 - DNA, 25 bp, Mus musculus
tcttcgttcgcttaccggcggcttc

SEQ ID NO: 791542 - DNA, 25 bp, Mus musculus
tcttcgttgagaagatccaaggagt

SEQ ID NO: 791543 - DNA, 25 bp, Mus musculus
tcttcgttgagatgatccaaggagt

SEQ ID NO: 791544 - DNA, 25 bp, Mus musculus
tcttcgttgagtacgcgaacgctgg

SEQ ID NO: 791545 - DNA, 25 bp, Mus musculus
tcttcgttgagttcgcgaacgctgg

SEQ ID NO: 791546 - DNA, 25 bp, Mus musculus
tcttcgttttgtatgccacatcctg

SEQ ID NO: 791547 - DNA, 25 bp, Mus musculus
tcttcgttttgtttgccacatcctg

SEQ ID NO: 791548 - DNA, 25 bp, Mus musculus
tcttctaaactactatctggaccag

SEQ ID NO: 791549 - DNA, 25 bp, Mus musculus
tcttctaaactagtatctggaccag

SEQ ID NO: 791550 - DNA, 25 bp, Mus musculus
tcttctaaactccttcgacaggaca

SEQ ID NO: 791551 - DNA, 25 bp, Mus musculus
tcttctaaactcgttcgacaggaca

SEQ ID NO: 791552 - DNA, 25 bp, Mus musculus
tcttctaaccagagggcatgtgtgc

SEQ ID NO: 791553 - DNA, 25 bp, Mus musculus
tcttctaaccagtgggcatgtgtgc

SEQ ID NO: 791554 - DNA, 25 bp, Mus musculus
tcttctacaaggaggctgagtacac

SEQ ID NO: 791555 - DNA, 25 bp, Mus musculus
tcttctacaaggtggctgagtacac

SEQ ID NO: 791556 - DNA, 25 bp, Mus musculus
tcttctacccggaccccatgatggt

SEQ ID NO: 791557 - DNA, 25 bp, Mus musculus
tcttctacccggtccccatgatggt

SEQ ID NO: 791558 - DNA, 25 bp, Mus musculus
tcttctaccggaagctgacgggact

SEQ ID NO: 791559 - DNA, 25 bp, Mus musculus
tcttctaccggatgctgacgggact

SEQ ID NO: 791560 - DNA, 25 bp, Mus musculus
tcttctaccgtcactggtctctgga

SEQ ID NO: 791561 - DNA, 25 bp, Mus musculus
tcttctaccgtctctggtctctgga

SEQ ID NO: 791562 - DNA, 25 bp, Mus musculus
tcttctaccgttacctgaagccgtg

SEQ ID NO: 791563 - DNA, 25 bp, Mus musculus
tcttctaccgtttcctgaagccgtg

SEQ ID NO: 791564 - DNA, 25 bp, Mus musculus
tcttctacctgaatcggtactgctg

SEQ ID NO: 791565 - DNA, 25 bp, Mus musculus
tcttctacctgattcggtactgctg

SEQ ID NO: 791566 - DNA, 25 bp, Mus musculus
tcttctacctgcagcccaagtatgc

SEQ ID NO: 791567 - DNA, 25 bp, Mus musculus
tcttctacctgcaggacgaggagag

SEQ ID NO: 791568 - DNA, 25 bp, Mus musculus
tcttctacctgctgcccaagtatgc

SEQ ID NO: 791569 - DNA, 25 bp, Mus musculus
tcttctacctgctggacgaggagag

SEQ ID NO: 791570 - DNA, 25 bp, Mus musculus
tcttctactgagaaggtaggcgcag

SEQ ID NO: 791571 - DNA, 25 bp, Mus musculus
tcttctactgagtaggtaggcgcag

SEQ ID NO: 791572 - DNA, 25 bp, Mus musculus
tcttctactgggagcccctgaaccg

SEQ ID NO: 791573 - DNA, 25 bp, Mus musculus
tcttctactgggtgcccctgaaccg

SEQ ID NO: 791574 - DNA, 25 bp, Mus musculus
tcttctacttggagcagtgcgaggc

SEQ ID NO: 791575 - DNA, 25 bp, Mus musculus
tcttctacttggtgcagtgcgaggc

SEQ ID NO: 791576 - DNA, 25 bp, Mus musculus
tcttctagagtaacacatcgcttac

SEQ ID NO: 791577 - DNA, 25 bp, Mus musculus
tcttctagagtatcacatcgcttac

SEQ ID NO: 791578 - DNA, 25 bp, Mus musculus
tcttctagccggaagaaagcggaaa

SEQ ID NO: 791579 - DNA, 25 bp, Mus musculus
tcttctagccggtagaaagcggaaa

SEQ ID NO: 791580 - DNA, 25 bp, Mus musculus
tcttctaggaatctcagtagctggg

SEQ ID NO: 791581 - DNA, 25 bp, Mus musculus
tcttctaggaatgtcagtagctggg

SEQ ID NO: 791582 - DNA, 25 bp, Mus musculus
tcttctagtgagctcgtaggtacct

SEQ ID NO: 791583 - DNA, 25 bp, Mus musculus
tcttctagtgaggtcgtaggtacct

SEQ ID NO: 791584 - DNA, 25 bp, Mus musculus
tcttctataatgagtatcctggagg

SEQ ID NO: 791585 - DNA, 25 bp, Mus musculus
tcttctataatgtgtatcctggagg

SEQ ID NO: 791586 - DNA, 25 bp, Mus musculus
tcttctatgacaacggcaaagtggt

SEQ ID NO: 791587 - DNA, 25 bp, Mus musculus
tcttctatgacatcggcaaagtggt

SEQ ID NO: 791588 - DNA, 25 bp, Mus musculus
tcttctatgattcccagcacagcca

SEQ ID NO: 791589 - DNA, 25 bp, Mus musculus
tcttctatgattgccagcacagcca

SEQ ID NO: 791590 - DNA, 25 bp, Mus musculus
tcttctcaactccaaggaagctgcc

SEQ ID NO: 791591 - DNA, 25 bp, Mus musculus
tcttctcaactcgaaggaagctgcc

SEQ ID NO: 791592 - DNA, 25 bp, Mus musculus
tcttctcaatgaacaaagcaggagc

SEQ ID NO: 791593 - DNA, 25 bp, Mus musculus
tcttctcaatgatcaaagcaggagc

SEQ ID NO: 791594 - DNA, 25 bp, Mus musculus
tcttctcagaacaggatggattggg

SEQ ID NO: 791595 - DNA, 25 bp, Mus musculus
tcttctcagaactggatggattggg

SEQ ID NO: 791596 - DNA, 25 bp, Mus musculus
tcttctcagagccagaaggtaggga

SEQ ID NO: 791597 - DNA, 25 bp, Mus musculus
tcttctcagagcgagaaggtaggga

SEQ ID NO: 791598 - DNA, 25 bp, Mus musculus
tcttctcaggaccaggcagaagaag

SEQ ID NO: 791599 - DNA, 25 bp, Mus musculus
tcttctcaggacgaggcagaagaag

SEQ ID NO: 791600 - DNA, 25 bp, Mus musculus
tcttctcatcgaccagcagggctat

SEQ ID NO: 791601 - DNA, 25 bp, Mus musculus
tcttctcatcgagcagcagggctat

SEQ ID NO: 791602 - DNA, 25 bp, Mus musculus
tcttctccagcgatgagtcattcgc

SEQ ID NO: 791603 - DNA, 25 bp, Mus musculus
tcttctccagcgttgagtcattcgc

SEQ ID NO: 791604 - DNA, 25 bp, Mus musculus
tcttctccaggtagatgagtttagg

SEQ ID NO: 791605 - DNA, 25 bp, Mus musculus
tcttctccaggttgatgagtttagg

SEQ ID NO: 791606 - DNA, 25 bp, Mus musculus
tcttctccatggcagaggcggtacc

SEQ ID NO: 791607 - DNA, 25 bp, Mus musculus
tcttctccatgggagaggcggtacc

SEQ ID NO: 791608 - DNA, 25 bp, Mus musculus
tcttctcccgagagtgagacttcct

SEQ ID NO: 791609 - DNA, 25 bp, Mus musculus
tcttctcccgagtgtgagacttcct

SEQ ID NO: 791610 - DNA, 25 bp, Mus musculus
tcttctccgcagaggagcatatcta

SEQ ID NO: 791611 - DNA, 25 bp, Mus musculus
tcttctccgcagtggagcatatcta

SEQ ID NO: 791612 - DNA, 25 bp, Mus musculus
tcttctcctaaacatgaagaggagc

SEQ ID NO: 791613 - DNA, 25 bp, Mus musculus
tcttctcctaaagatgaagaggagc

SEQ ID NO: 791614 - DNA, 25 bp, Mus musculus
tcttctcctacaaacgacactggga

SEQ ID NO: 791615 - DNA, 25 bp, Mus musculus
tcttctcctacatacgacactggga

SEQ ID NO: 791616 - DNA, 25 bp, Mus musculus
tcttctcctactccgacatcgagag

SEQ ID NO: 791617 - DNA, 25 bp, Mus musculus
tcttctcctactgcgacatcgagag

SEQ ID NO: 791618 - DNA, 25 bp, Mus musculus
tcttctcggaccaagtatcaaggcg

SEQ ID NO: 791619 - DNA, 25 bp, Mus musculus
tcttctcggacctagtatcaaggcg

SEQ ID NO: 791620 - DNA, 25 bp, Mus musculus
tcttctcggagcatcagaaccaggg

SEQ ID NO: 791621 - DNA, 25 bp, Mus musculus
tcttctcggagcttcagaaccaggg

SEQ ID NO: 791622 - DNA, 25 bp, Mus musculus
tcttctcggatgagcaaaacaaggt

SEQ ID NO: 791623 - DNA, 25 bp, Mus musculus
tcttctcggatgtgcaaaacaaggt

SEQ ID NO: 791624 - DNA, 25 bp, Mus musculus
tcttctcgtgaaatgcaatgcagcc

SEQ ID NO: 791625 - DNA, 25 bp, Mus musculus
tcttctcgtgaattgcaatgcagcc

SEQ ID NO: 791626 - DNA, 25 bp, Mus musculus
tcttctctaccgacagatgtcatca

SEQ ID NO: 791627 - DNA, 25 bp, Mus musculus
tcttctctaccgtcagatgtcatca

SEQ ID NO: 791628 - DNA, 25 bp, Mus musculus
tcttctctatttccgtattgtgcat

SEQ ID NO: 791629 - DNA, 25 bp, Mus musculus
tcttctctatttgcgtattgtgcat

SEQ ID NO: 791630 - DNA, 25 bp, Mus musculus
tcttctctccacctgggaagtcagg

SEQ ID NO: 791631 - DNA, 25 bp, Mus musculus
tcttctctccacgtgggaagtcagg

SEQ ID NO: 791632 - DNA, 25 bp, Mus musculus
tcttctctgaacaaaatcatcagag

SEQ ID NO: 791633 - DNA, 25 bp, Mus musculus
tcttctctgaactaaatcatcagag

SEQ ID NO: 791634 - DNA, 25 bp, Mus musculus
tcttctctgcagctaagaggccggg

SEQ ID NO: 791635 - DNA, 25 bp, Mus musculus
tcttctctgcaggtaagaggccggg

SEQ ID NO: 791636 - DNA, 25 bp, Mus musculus
tcttctctgcatctgtgggactggg

SEQ ID NO: 791637 - DNA, 25 bp, Mus musculus
tcttctctgcatgtgtgggactggg

SEQ ID NO: 791638 - DNA, 25 bp, Mus musculus
tcttctctgtgtaaaggcgattccc

SEQ ID NO: 791639 - DNA, 25 bp, Mus musculus
tcttctctgtgttaaggcgattccc

SEQ ID NO: 791640 - DNA, 25 bp, Mus musculus
tcttctcttgagcaggttccactct

SEQ ID NO: 791641 - DNA, 25 bp, Mus musculus
tcttctcttgaggaggttccactct

SEQ ID NO: 791642 - DNA, 25 bp, Mus musculus
tcttctctttctctagctgcgattg

SEQ ID NO: 791643 - DNA, 25 bp, Mus musculus
tcttctctttctgtagctgcgattg

SEQ ID NO: 791644 - DNA, 25 bp, Mus musculus
tcttctgaaagacagccctttgcgg

SEQ ID NO: 791645 - DNA, 25 bp, Mus musculus
tcttctgaaagagagccctttgcgg

SEQ ID NO: 791646 - DNA, 25 bp, Mus musculus
tcttctgaagggaacgagctcctgg

SEQ ID NO: 791647 - DNA, 25 bp, Mus musculus
tcttctgaagggtacgagctcctgg

SEQ ID NO: 791648 - DNA, 25 bp, Mus musculus
tcttctgaccaaagagtgagttcac

SEQ ID NO: 791649 - DNA, 25 bp, Mus musculus
tcttctgaccaatgagtgagttcac

SEQ ID NO: 791650 - DNA, 25 bp, Mus musculus
tcttctgaccagaggcagcgggaac

SEQ ID NO: 791651 - DNA, 25 bp, Mus musculus
tcttctgaccagtggcagcgggaac

SEQ ID NO: 791652 - DNA, 25 bp, Mus musculus
tcttctgacggacgaagattttttc

SEQ ID NO: 791653 - DNA, 25 bp, Mus musculus
tcttctgacggaggaagattttttc

SEQ ID NO: 791654 - DNA, 25 bp, Mus musculus
tcttctgagatgaccctctatttcc

SEQ ID NO: 791655 - DNA, 25 bp, Mus musculus
tcttctgagatgtccctctatttcc

SEQ ID NO: 791656 - DNA, 25 bp, Mus musculus
tcttctgagctaaccagcagtcacg

SEQ ID NO: 791657 - DNA, 25 bp, Mus musculus
tcttctgagctatccagcagtcacg

SEQ ID NO: 791658 - DNA, 25 bp, Mus musculus
tcttctgaggacagagaactctcta

SEQ ID NO: 791659 - DNA, 25 bp, Mus musculus
tcttctgaggactgagaactctcta

SEQ ID NO: 791660 - DNA, 25 bp, Mus musculus
tcttctgaggatccatctactctaa

SEQ ID NO: 791661 - DNA, 25 bp, Mus musculus
tcttctgaggatgcatctactctaa

SEQ ID NO: 791662 - DNA, 25 bp, Mus musculus
tcttctgaggccactacagagtctt

SEQ ID NO: 791663 - DNA, 25 bp, Mus musculus
tcttctgaggcctctacagagtctt

SEQ ID NO: 791664 - DNA, 25 bp, Mus musculus
tcttctgatctccaggtaaccatct

SEQ ID NO: 791665 - DNA, 25 bp, Mus musculus
tcttctgatctcgaggtaaccatct

SEQ ID NO: 791666 - DNA, 25 bp, Mus musculus
tcttctgcaccaacgttcttggcac

SEQ ID NO: 791667 - DNA, 25 bp, Mus musculus
tcttctgcaccatcgttcttggcac

SEQ ID NO: 791668 - DNA, 25 bp, Mus musculus
tcttctgcactgagtacaggcacag

SEQ ID NO: 791669 - DNA, 25 bp, Mus musculus
tcttctgcactgtgtacaggcacag

SEQ ID NO: 791670 - DNA, 25 bp, Mus musculus
tcttctgcagcaatgtaatggcgtt

SEQ ID NO: 791671 - DNA, 25 bp, Mus musculus
tcttctgcagcattgtaatggcgtt

SEQ ID NO: 791672 - DNA, 25 bp, Mus musculus
tcttctgcagggagcgatgatgtgt

SEQ ID NO: 791673 - DNA, 25 bp, Mus musculus
tcttctgcagggtgcgatgatgtgt

SEQ ID NO: 791674 - DNA, 25 bp, Mus musculus
tcttctgcatcaatgtgagcacccc

SEQ ID NO: 791675 - DNA, 25 bp, Mus musculus
tcttctgcatcattgtgagcacccc

SEQ ID NO: 791676 - DNA, 25 bp, Mus musculus
tcttctgcctccagtgtcacagtca

SEQ ID NO: 791677 - DNA, 25 bp, Mus musculus
tcttctgcctcctgtgtcacagtca

SEQ ID NO: 791678 - DNA, 25 bp, Mus musculus
tcttctgcggcactgcgtgatggtt

SEQ ID NO: 791679 - DNA, 25 bp, Mus musculus
tcttctgcggcagtgcgtgatggtt

SEQ ID NO: 791680 - DNA, 25 bp, Mus musculus
tcttctgctaggattgtctcctcgg

SEQ ID NO: 791681 - DNA, 25 bp, Mus musculus
tcttctgctaggtttgtctcctcgg

SEQ ID NO: 791682 - DNA, 25 bp, Mus musculus
tcttctggacaactacaacgctgag

SEQ ID NO: 791683 - DNA, 25 bp, Mus musculus
tcttctggacaagtacaacgctgag

SEQ ID NO: 791684 - DNA, 25 bp, Mus musculus
tcttctggagctaagttcccagtca

SEQ ID NO: 791685 - DNA, 25 bp, Mus musculus
tcttctggagcttagttcccagtca

SEQ ID NO: 791686 - DNA, 25 bp, Mus musculus
tcttctggaggcatatgagtgccct

SEQ ID NO: 791687 - DNA, 25 bp, Mus musculus
tcttctggaggcttatgagtgccct

SEQ ID NO: 791688 - DNA, 25 bp, Mus musculus
tcttctggagtaataggactgggcc

SEQ ID NO: 791689 - DNA, 25 bp, Mus musculus
tcttctggagtattaggactgggcc

SEQ ID NO: 791690 - DNA, 25 bp, Mus musculus
tcttctggcaccatgttactctcct

SEQ ID NO: 791691 - DNA, 25 bp, Mus musculus
tcttctggcaccttgttactctcct

SEQ ID NO: 791692 - DNA, 25 bp, Mus musculus
tcttctggccagcaacttcatcagt

SEQ ID NO: 791693 - DNA, 25 bp, Mus musculus
tcttctggccaggaacttcatcagt

SEQ ID NO: 791694 - DNA, 25 bp, Mus musculus
tcttctggcctcaggaacagatggt

SEQ ID NO: 791695 - DNA, 25 bp, Mus musculus
tcttctggcctctggaacagatggt

SEQ ID NO: 791696 - DNA, 25 bp, Mus musculus
tcttctggctcgcttggctgggcat

SEQ ID NO: 791697 - DNA, 25 bp, Mus musculus
tcttctggctcggttggctgggcat

SEQ ID NO: 791698 - DNA, 25 bp, Mus musculus
tcttctgggaccagtattgtgcggc

SEQ ID NO: 791699 - DNA, 25 bp, Mus musculus
tcttctgggacctgtattgtgcggc

SEQ ID NO: 791700 - DNA, 25 bp, Mus musculus
tcttctgggctcaacagaatattcc

SEQ ID NO: 791701 - DNA, 25 bp, Mus musculus
tcttctgggctctacagaatattcc

SEQ ID NO: 791702 - DNA, 25 bp, Mus musculus
tcttctgggctgatcaatctatctg

SEQ ID NO: 791703 - DNA, 25 bp, Mus musculus
tcttctgggctgttcaatctatctg

SEQ ID NO: 791704 - DNA, 25 bp, Mus musculus
tcttctgggtcaccttcggaggaca

SEQ ID NO: 791705 - DNA, 25 bp, Mus musculus
tcttctgggtcagcttcggaggaca

SEQ ID NO: 791706 - DNA, 25 bp, Mus musculus
tcttctgggttaattgaactgttcc

SEQ ID NO: 791707 - DNA, 25 bp, Mus musculus
tcttctgggttatttgaactgttcc

SEQ ID NO: 791708 - DNA, 25 bp, Mus musculus
tcttctggtgaacccatgcactcct

SEQ ID NO: 791709 - DNA, 25 bp, Mus musculus
tcttctggtgaagccatgcactcct

SEQ ID NO: 791710 - DNA, 25 bp, Mus musculus
tcttctggtgcaaagacaatccttg

SEQ ID NO: 791711 - DNA, 25 bp, Mus musculus
tcttctggtgcatagacaatccttg

SEQ ID NO: 791712 - DNA, 25 bp, Mus musculus
tcttctggttttcccactgactttc

SEQ ID NO: 791713 - DNA, 25 bp, Mus musculus
tcttctggttttgccactgactttc

SEQ ID NO: 791714 - DNA, 25 bp, Mus musculus
tcttctgtccccaaactcgcgggtg

SEQ ID NO: 791715 - DNA, 25 bp, Mus musculus
tcttctgtcccctaactcgcgggtg

SEQ ID NO: 791716 - DNA, 25 bp, Mus musculus
tcttctgtggcaagtgctcctccaa

SEQ ID NO: 791717 - DNA, 25 bp, Mus musculus
tcttctgtggcatgtgctcctccaa

SEQ ID NO: 791718 - DNA, 25 bp, Mus musculus
tcttctgtggccaccgggtggagcc

SEQ ID NO: 791719 - DNA, 25 bp, Mus musculus
tcttctgtggcctccgggtggagcc

SEQ ID NO: 791720 - DNA, 25 bp, Mus musculus
tcttctgtgtatctactagtctgta

SEQ ID NO: 791721 - DNA, 25 bp, Mus musculus
tcttctgtgtatgtactagtctgta

SEQ ID NO: 791722 - DNA, 25 bp, Mus musculus
tcttctgtgtccatggcgacgggca

SEQ ID NO: 791723 - DNA, 25 bp, Mus musculus
tcttctgtgtccttggcgacgggca

SEQ ID NO: 791724 - DNA, 25 bp, Mus musculus
tcttctgtgtcgcactcagcggcta

SEQ ID NO: 791725 - DNA, 25 bp, Mus musculus
tcttctgtgtcggactcagcggcta

SEQ ID NO: 791726 - DNA, 25 bp, Mus musculus
tcttctgtgtgacaaattggatttc

SEQ ID NO: 791727 - DNA, 25 bp, Mus musculus
tcttctgtgtgagaaattggatttc

SEQ ID NO: 791728 - DNA, 25 bp, Mus musculus
tcttctgttatgagggtttgcgccc

SEQ ID NO: 791729 - DNA, 25 bp, Mus musculus
tcttctgttatgtgggtttgcgccc

SEQ ID NO: 791730 - DNA, 25 bp, Mus musculus
tcttctgtttctaataccttaggag

SEQ ID NO: 791731 - DNA, 25 bp, Mus musculus
tcttctgtttcttataccttaggag

SEQ ID NO: 791732 - DNA, 25 bp, Mus musculus
tcttctgttttcctggcacccaagg

SEQ ID NO: 791733 - DNA, 25 bp, Mus musculus
tcttctgttttcgtggcacccaagg

SEQ ID NO: 791734 - DNA, 25 bp, Mus musculus
tcttcttagaagattcgcagcgcaa

SEQ ID NO: 791735 - DNA, 25 bp, Mus musculus
tcttcttagaagtttcgcagcgcaa

SEQ ID NO: 791736 - DNA, 25 bp, Mus musculus
tcttcttagactctgatgttcctga

SEQ ID NO: 791737 - DNA, 25 bp, Mus musculus
tcttcttagactgtgatgttcctga

SEQ ID NO: 791738 - DNA, 25 bp, Mus musculus
tcttcttatgcaagacggccgtgct

SEQ ID NO: 791739 - DNA, 25 bp, Mus musculus
tcttcttatgcatgacggccgtgct

SEQ ID NO: 791740 - DNA, 25 bp, Mus musculus
tcttcttatgggacactggctcttc

SEQ ID NO: 791741 - DNA, 25 bp, Mus musculus
tcttcttatgggtcactggctcttc

SEQ ID NO: 791742 - DNA, 25 bp, Mus musculus
tcttcttcaagtccatggaccagga

SEQ ID NO: 791743 - DNA, 25 bp, Mus musculus
tcttcttcaagtgcatggaccagga

SEQ ID NO: 791744 - DNA, 25 bp, Mus musculus
tcttcttcactacgtacctgtttgc

SEQ ID NO: 791745 - DNA, 25 bp, Mus musculus
tcttcttcactaggtacctgtttgc

SEQ ID NO: 791746 - DNA, 25 bp, Mus musculus
tcttcttcagcgatactatgatgca

SEQ ID NO: 791747 - DNA, 25 bp, Mus musculus
tcttcttcagcgttactatgatgca

SEQ ID NO: 791748 - DNA, 25 bp, Mus musculus
tcttcttcagctatctctcagacct

SEQ ID NO: 791749 - DNA, 25 bp, Mus musculus
tcttcttcagctttctctcagacct

SEQ ID NO: 791750 - DNA, 25 bp, Mus musculus
tcttcttcagggattcaaacaggtc

SEQ ID NO: 791751 - DNA, 25 bp, Mus musculus
tcttcttcagggtttcaaacaggtc

SEQ ID NO: 791752 - DNA, 25 bp, Mus musculus
tcttcttcatcaaccgtaagtgctt

SEQ ID NO: 791753 - DNA, 25 bp, Mus musculus
tcttcttcatcatccgtaagtgctt

SEQ ID NO: 791754 - DNA, 25 bp, Mus musculus
tcttcttcatccaagtggctgtccg

SEQ ID NO: 791755 - DNA, 25 bp, Mus musculus
tcttcttcatcctagtggctgtccg

SEQ ID NO: 791756 - DNA, 25 bp, Mus musculus
tcttcttccaccagtctcgagagcg

SEQ ID NO: 791757 - DNA, 25 bp, Mus musculus
tcttcttccacctgtctcgagagcg

SEQ ID NO: 791758 - DNA, 25 bp, Mus musculus
tcttcttccatcaacagcgggaacg

SEQ ID NO: 791759 - DNA, 25 bp, Mus musculus
tcttcttccatctacagcgggaacg

SEQ ID NO: 791760 - DNA, 25 bp, Mus musculus
tcttcttccgagagcgctcggcaga

SEQ ID NO: 791761 - DNA, 25 bp, Mus musculus
tcttcttccgagtgcgctcggcaga

SEQ ID NO: 791762 - DNA, 25 bp, Mus musculus
tcttcttccgcacagcgggtttccg

SEQ ID NO: 791763 - DNA, 25 bp, Mus musculus
tcttcttccgcagagcgggtttccg

SEQ ID NO: 791764 - DNA, 25 bp, Mus musculus
tcttcttccgcgagtccgctgtgga

SEQ ID NO: 791765 - DNA, 25 bp, Mus musculus
tcttcttccgcgtgtccgctgtgga

SEQ ID NO: 791766 - DNA, 25 bp, Mus musculus
tcttcttcctgaccgtatggcttgt

SEQ ID NO: 791767 - DNA, 25 bp, Mus musculus
tcttcttcctgagcgtatggcttgt

SEQ ID NO: 791768 - DNA, 25 bp, Mus musculus
tcttcttcgcggctgctggtgccgc

SEQ ID NO: 791769 - DNA, 25 bp, Mus musculus
tcttcttcgcgggtgctggtgccgc

SEQ ID NO: 791770 - DNA, 25 bp, Mus musculus
tcttcttcgtgaacgtgggtggtgt

SEQ ID NO: 791771 - DNA, 25 bp, Mus musculus
tcttcttcgtgatcgtgggtggtgt

SEQ ID NO: 791772 - DNA, 25 bp, Mus musculus
tcttcttcgttgagaacctggaagg

SEQ ID NO: 791773 - DNA, 25 bp, Mus musculus
tcttcttcgttgtgaacctggaagg

SEQ ID NO: 791774 - DNA, 25 bp, Mus musculus
tcttcttctcttcacaggtacctga

SEQ ID NO: 791775 - DNA, 25 bp, Mus musculus
tcttcttctcttgacaggtacctga

SEQ ID NO: 791776 - DNA, 25 bp, Mus musculus
tcttcttctgggaggcccggatggt

SEQ ID NO: 791777 - DNA, 25 bp, Mus musculus
tcttcttctgggtggcccggatggt

SEQ ID NO: 791778 - DNA, 25 bp, Mus musculus
tcttcttgaattccaggctttcatg

SEQ ID NO: 791779 - DNA, 25 bp, Mus musculus
tcttcttgaattgcaggctttcatg

SEQ ID NO: 791780 - DNA, 25 bp, Mus musculus
tcttcttggaccaaagccctttcca

SEQ ID NO: 791781 - DNA, 25 bp, Mus musculus
tcttcttggacctaagccctttcca

SEQ ID NO: 791782 - DNA, 25 bp, Mus musculus
tcttcttgggcacagccagcgtggc

SEQ ID NO: 791783 - DNA, 25 bp, Mus musculus
tcttcttgggcagagccagcgtggc

SEQ ID NO: 791784 - DNA, 25 bp, Mus musculus
tcttcttgggtgcaataaccctgcc

SEQ ID NO: 791785 - DNA, 25 bp, Mus musculus
tcttcttgggtggaataaccctgcc

SEQ ID NO: 791786 - DNA, 25 bp, Mus musculus
tcttcttgggttccaacatcggcac

SEQ ID NO: 791787 - DNA, 25 bp, Mus musculus
tcttcttgggttgcaacatcggcac

SEQ ID NO: 791788 - DNA, 25 bp, Mus musculus
tcttcttgtagtcggccatgcagtg

SEQ ID NO: 791789 - DNA, 25 bp, Mus musculus
tcttcttgtagtgggccatgcagtg

SEQ ID NO: 791790 - DNA, 25 bp, Mus musculus
tcttcttgtctcagagagcagtaga

SEQ ID NO: 791791 - DNA, 25 bp, Mus musculus
tcttcttgtctctgagagcagtaga

SEQ ID NO: 791792 - DNA, 25 bp, Mus musculus
tcttctttacaacgcgagtgtgcag

SEQ ID NO: 791793 - DNA, 25 bp, Mus musculus
tcttctttacaaggcgagtgtgcag

SEQ ID NO: 791794 - DNA, 25 bp, Mus musculus
tcttctttccaccatggtaacctct

SEQ ID NO: 791795 - DNA, 25 bp, Mus musculus
tcttctttccacgatggtaacctct

SEQ ID NO: 791796 - DNA, 25 bp, Mus musculus
tcttctttccgacactcatcactgt

SEQ ID NO: 791797 - DNA, 25 bp, Mus musculus
tcttctttccgagactcatcactgt

SEQ ID NO: 791798 - DNA, 25 bp, Mus musculus
tcttctttgaaccactggaatctaa

SEQ ID NO: 791799 - DNA, 25 bp, Mus musculus
tcttctttgaacgactggaatctaa

SEQ ID NO: 791800 - DNA, 25 bp, Mus musculus
tcttctttgggactccaacatatac

SEQ ID NO: 791801 - DNA, 25 bp, Mus musculus
tcttctttgggagtccaacatatac

SEQ ID NO: 791802 - DNA, 25 bp, Mus musculus
tcttctttgggtcaacaaccatcct

SEQ ID NO: 791803 - DNA, 25 bp, Mus musculus
tcttctttgggtgaacaaccatcct

SEQ ID NO: 791804 - DNA, 25 bp, Mus musculus
tcttctttgtatcctggccttagtg

SEQ ID NO: 791805 - DNA, 25 bp, Mus musculus
tcttctttgtatgctggccttagtg

SEQ ID NO: 791806 - DNA, 25 bp, Mus musculus
tcttctttgtctactacatgctgct

SEQ ID NO: 791807 - DNA, 25 bp, Mus musculus
tcttctttgtcttctacatgctgct

SEQ ID NO: 791808 - DNA, 25 bp, Mus musculus
tcttcttttagaagttccggaagct

SEQ ID NO: 791809 - DNA, 25 bp, Mus musculus
tcttcttttagatgttccggaagct

SEQ ID NO: 791810 - DNA, 25 bp, Mus musculus
tcttcttttaggattagcatgagct

SEQ ID NO: 791811 - DNA, 25 bp, Mus musculus
tcttcttttaggtttagcatgagct

SEQ ID NO: 791812 - DNA, 25 bp, Mus musculus
tcttcttttgacatcaggccgtcag

SEQ ID NO: 791813 - DNA, 25 bp, Mus musculus
tcttcttttgacttcaggccgtcag

SEQ ID NO: 791814 - DNA, 25 bp, Mus musculus
tcttcttttgttaagcctcaggaac

SEQ ID NO: 791815 - DNA, 25 bp, Mus musculus
tcttcttttgtttagcctcaggaac

SEQ ID NO: 791816 - DNA, 25 bp, Mus musculus
tcttgaaaagtcacgcctggtttcc

SEQ ID NO: 791817 - DNA, 25 bp, Mus musculus
tcttgaaaagtctcgcctggtttcc

SEQ ID NO: 791818 - DNA, 25 bp, Mus musculus
tcttgaaacacacacagcccagctg

SEQ ID NO: 791819 - DNA, 25 bp, Mus musculus
tcttgaaacacagacagcccagctg

SEQ ID NO: 791820 - DNA, 25 bp, Mus musculus
tcttgaaacgaaactggcgtgactg

SEQ ID NO: 791821 - DNA, 25 bp, Mus musculus
tcttgaaacgaatctggcgtgactg

SEQ ID NO: 791822 - DNA, 25 bp, Mus musculus
tcttgaaagaaaaggtgttatacct

SEQ ID NO: 791823 - DNA, 25 bp, Mus musculus
tcttgaaagaaatggtgttatacct

SEQ ID NO: 791824 - DNA, 25 bp, Mus musculus
tcttgaaagcacctggattggaaga

SEQ ID NO: 791825 - DNA, 25 bp, Mus musculus
tcttgaaagcacgtggattggaaga

SEQ ID NO: 791826 - DNA, 25 bp, Mus musculus
tcttgaaagccaatcgaggagttgt

SEQ ID NO: 791827 - DNA, 25 bp, Mus musculus
tcttgaaagccattcgaggagttgt

SEQ ID NO: 791828 - DNA, 25 bp, Mus musculus
tcttgaaagtttccctcagcagggc

SEQ ID NO: 791829 - DNA, 25 bp, Mus musculus
tcttgaaagtttgcctcagcagggc

SEQ ID NO: 791830 - DNA, 25 bp, Mus musculus
tcttgaaatccaagccgaattccct

SEQ ID NO: 791831 - DNA, 25 bp, Mus musculus
tcttgaaatccatgccgaattccct

SEQ ID NO: 791832 - DNA, 25 bp, Mus musculus
tcttgaacaggcaccatcaggtgca

SEQ ID NO: 791833 - DNA, 25 bp, Mus musculus
tcttgaacaggctccatcaggtgca

SEQ ID NO: 791834 - DNA, 25 bp, Mus musculus
tcttgaacatcaacccattgagaac

SEQ ID NO: 791835 - DNA, 25 bp, Mus musculus
tcttgaacatcatcccattgagaac

SEQ ID NO: 791836 - DNA, 25 bp, Mus musculus
tcttgaacctggagcccctggcgga

SEQ ID NO: 791837 - DNA, 25 bp, Mus musculus
tcttgaacctggtgcccctggcgga

SEQ ID NO: 791838 - DNA, 25 bp, Mus musculus
tcttgaacttgaattgaagaccagg

SEQ ID NO: 791839 - DNA, 25 bp, Mus musculus
tcttgaacttgatttgaagaccagg

SEQ ID NO: 791840 - DNA, 25 bp, Mus musculus
tcttgaagagaaccatcagcgattc

SEQ ID NO: 791841 - DNA, 25 bp, Mus musculus
tcttgaagagaagcatcagcgattc

SEQ ID NO: 791842 - DNA, 25 bp, Mus musculus
tcttgaagagagatcgccaagttgt

SEQ ID NO: 791843 - DNA, 25 bp, Mus musculus
tcttgaagagagttcgccaagttgt

SEQ ID NO: 791844 - DNA, 25 bp, Mus musculus
tcttgaagagccagtaagcctgggc

SEQ ID NO: 791845 - DNA, 25 bp, Mus musculus
tcttgaagagcctgtaagcctgggc

SEQ ID NO: 791846 - DNA, 25 bp, Mus musculus
tcttgaagatttaacagccatgctg

SEQ ID NO: 791847 - DNA, 25 bp, Mus musculus
tcttgaagattttacagccatgctg

SEQ ID NO: 791848 - DNA, 25 bp, Mus musculus
tcttgaagccaactgcaaacatgga

SEQ ID NO: 791849 - DNA, 25 bp, Mus musculus
tcttgaagccaagtgcaaacatgga

SEQ ID NO: 791850 - DNA, 25 bp, Mus musculus
tcttgaagccgtaagaggctgaggc

SEQ ID NO: 791851 - DNA, 25 bp, Mus musculus
tcttgaagccgttagaggctgaggc

SEQ ID NO: 791852 - DNA, 25 bp, Mus musculus
tcttgaagcttactgctgatgccaa

SEQ ID NO: 791853 - DNA, 25 bp, Mus musculus
tcttgaagcttagtgctgatgccaa

SEQ ID NO: 791854 - DNA, 25 bp, Mus musculus
tcttgaaggctaatggcggacgccg

SEQ ID NO: 791855 - DNA, 25 bp, Mus musculus
tcttgaaggctattggcggacgccg

SEQ ID NO: 791856 - DNA, 25 bp, Mus musculus
tcttgaaggttccagcgcttaagga

SEQ ID NO: 791857 - DNA, 25 bp, Mus musculus
tcttgaaggttcgagcgcttaagga

SEQ ID NO: 791858 - DNA, 25 bp, Mus musculus
tcttgaattgcacgctttcatgctg

SEQ ID NO: 791859 - DNA, 25 bp, Mus musculus
tcttgaattgcaggctttcatgctg

SEQ ID NO: 791860 - DNA, 25 bp, Mus musculus
tcttgaattggaagcgctacacgca

SEQ ID NO: 791861 - DNA, 25 bp, Mus musculus
tcttgaattggatgcgctacacgca

SEQ ID NO: 791862 - DNA, 25 bp, Mus musculus
tcttgaattggcaagtagggagaaa

SEQ ID NO: 791863 - DNA, 25 bp, Mus musculus
tcttgaattggctagtagggagaaa

SEQ ID NO: 791864 - DNA, 25 bp, Mus musculus
tcttgacagagcatcctcggtggcc

SEQ ID NO: 791865 - DNA, 25 bp, Mus musculus
tcttgacagagcttcctcggtggcc

SEQ ID NO: 791866 - DNA, 25 bp, Mus musculus
tcttgacatctacccacggtcaccg

SEQ ID NO: 791867 - DNA, 25 bp, Mus musculus
tcttgacatctagccacggtcaccg

SEQ ID NO: 791868 - DNA, 25 bp, Mus musculus
tcttgacatctcagctgtagtagac

SEQ ID NO: 791869 - DNA, 25 bp, Mus musculus
tcttgacatctctgctgtagtagac

SEQ ID NO: 791870 - DNA, 25 bp, Mus musculus
tcttgacatgaacaagcctcgctgt

SEQ ID NO: 791871 - DNA, 25 bp, Mus musculus
tcttgacatgaagaagcctcgctgt

SEQ ID NO: 791872 - DNA, 25 bp, Mus musculus
tcttgacatgctacccttggcatgc

SEQ ID NO: 791873 - DNA, 25 bp, Mus musculus
tcttgacatgcttcccttggcatgc

SEQ ID NO: 791874 - DNA, 25 bp, Mus musculus
tcttgaccaaaaagtggcaccccaa

SEQ ID NO: 791875 - DNA, 25 bp, Mus musculus
tcttgaccaaaatgtggcaccccaa

SEQ ID NO: 791876 - DNA, 25 bp, Mus musculus
tcttgaccaaggcagtgaacagcct

SEQ ID NO: 791877 - DNA, 25 bp, Mus musculus
tcttgaccaagggagtgaacagcct

SEQ ID NO: 791878 - DNA, 25 bp, Mus musculus
tcttgaccatgaaggccagaaagat

SEQ ID NO: 791879 - DNA, 25 bp, Mus musculus
tcttgaccatgatggccagaaagat

SEQ ID NO: 791880 - DNA, 25 bp, Mus musculus
tcttgaccctggctgactccctagg

SEQ ID NO: 791881 - DNA, 25 bp, Mus musculus
tcttgaccctgggtgactccctagg

SEQ ID NO: 791882 - DNA, 25 bp, Mus musculus
tcttgaccggcccagtgaggaagtt

SEQ ID NO: 791883 - DNA, 25 bp, Mus musculus
tcttgaccggccgagtgaggaagtt

SEQ ID NO: 791884 - DNA, 25 bp, Mus musculus
tcttgacctaccaatatggaatccc

SEQ ID NO: 791885 - DNA, 25 bp, Mus musculus
tcttgacctacctatatggaatccc

SEQ ID NO: 791886 - DNA, 25 bp, Mus musculus
tcttgacctccgctgatagggaaac

SEQ ID NO: 791887 - DNA, 25 bp, Mus musculus
tcttgacctccggtgatagggaaac

SEQ ID NO: 791888 - DNA, 25 bp, Mus musculus
tcttgaccttgactgcaatgtgcca

SEQ ID NO: 791889 - DNA, 25 bp, Mus musculus
tcttgaccttgagtgcaatgtgcca

SEQ ID NO: 791890 - DNA, 25 bp, Mus musculus
tcttgacgaagtcattgactggtgg

SEQ ID NO: 791891 - DNA, 25 bp, Mus musculus
tcttgacgaagtgattgactggtgg

SEQ ID NO: 791892 - DNA, 25 bp, Mus musculus
tcttgactactgatagaattcctgg

SEQ ID NO: 791893 - DNA, 25 bp, Mus musculus
tcttgactactgttagaattcctgg

SEQ ID NO: 791894 - DNA, 25 bp, Mus musculus
tcttgactctggatacatgggtgtg

SEQ ID NO: 791895 - DNA, 25 bp, Mus musculus
tcttgactctggttacatgggtgtg

SEQ ID NO: 791896 - DNA, 25 bp, Mus musculus
tcttgactggctaacagggacgtgg

SEQ ID NO: 791897 - DNA, 25 bp, Mus musculus
tcttgactggcttacagggacgtgg

SEQ ID NO: 791898 - DNA, 25 bp, Mus musculus
tcttgactgtagcatgaaaatgcat

SEQ ID NO: 791899 - DNA, 25 bp, Mus musculus
tcttgactgtaggatgaaaatgcat

SEQ ID NO: 791900 - DNA, 25 bp, Mus musculus
tcttgacttcctcaagcctttcagg

SEQ ID NO: 791901 - DNA, 25 bp, Mus musculus
tcttgacttcctgaagcctttcagg

SEQ ID NO: 791902 - DNA, 25 bp, Mus musculus
tcttgagaacatcaagctgagcctt

SEQ ID NO: 791903 - DNA, 25 bp, Mus musculus
tcttgagaacatgaagctgagcctt

SEQ ID NO: 791904 - DNA, 25 bp, Mus musculus
tcttgagaagcgaagtttggaacca

SEQ ID NO: 791905 - DNA, 25 bp, Mus musculus
tcttgagaagcgtagtttggaacca

SEQ ID NO: 791906 - DNA, 25 bp, Mus musculus
tcttgagactatcctgaagcagccc

SEQ ID NO: 791907 - DNA, 25 bp, Mus musculus
tcttgagactatgctgaagcagccc

SEQ ID NO: 791908 - DNA, 25 bp, Mus musculus
tcttgagatgatcagcatgggcaca

SEQ ID NO: 791909 - DNA, 25 bp, Mus musculus
tcttgagatgatgagcatgggcaca

SEQ ID NO: 791910 - DNA, 25 bp, Mus musculus
tcttgagattctctgttgaagtcca

SEQ ID NO: 791911 - DNA, 25 bp, Mus musculus
tcttgagattctgtgttgaagtcca

SEQ ID NO: 791912 - DNA, 25 bp, Mus musculus
tcttgagcaatgagaggcctggacc

SEQ ID NO: 791913 - DNA, 25 bp, Mus musculus
tcttgagcaatgtgaggcctggacc

SEQ ID NO: 791914 - DNA, 25 bp, Mus musculus
tcttgagcaccaacaagtgtgggcg

SEQ ID NO: 791915 - DNA, 25 bp, Mus musculus
tcttgagcaccatcaagtgtgggcg

SEQ ID NO: 791916 - DNA, 25 bp, Mus musculus
tcttgagccgccagccggagagtgt

SEQ ID NO: 791917 - DNA, 25 bp, Mus musculus
tcttgagccgcctgccggagagtgt

SEQ ID NO: 791918 - DNA, 25 bp, Mus musculus
tcttgagctgctctttcggaccctg

SEQ ID NO: 791919 - DNA, 25 bp, Mus musculus
tcttgagctgctgtttcggaccctg

SEQ ID NO: 791920 - DNA, 25 bp, Mus musculus
tcttgagctggaaatgggagatgat

SEQ ID NO: 791921 - DNA, 25 bp, Mus musculus
tcttgagctggatatgggagatgat

SEQ ID NO: 791922 - DNA, 25 bp, Mus musculus
tcttgagcttcacgctggaaagaag

SEQ ID NO: 791923 - DNA, 25 bp, Mus musculus
tcttgagcttcaggctggaaagaag

SEQ ID NO: 791924 - DNA, 25 bp, Mus musculus
tcttgaggacccagttgcctctcat

SEQ ID NO: 791925 - DNA, 25 bp, Mus musculus
tcttgaggaccctgttgcctctcat

SEQ ID NO: 791926 - DNA, 25 bp, Mus musculus
tcttgaggatacacaggatccgcaa

SEQ ID NO: 791927 - DNA, 25 bp, Mus musculus
tcttgaggatactcaggatccgcaa

SEQ ID NO: 791928 - DNA, 25 bp, Mus musculus
tcttgaggcaacagagaacccaggg

SEQ ID NO: 791929 - DNA, 25 bp, Mus musculus
tcttgaggcaactgagaacccaggg

SEQ ID NO: 791930 - DNA, 25 bp, Mus musculus
tcttgaggccaacgaacagaagtct

SEQ ID NO: 791931 - DNA, 25 bp, Mus musculus
tcttgaggccaaggaacagaagtct

SEQ ID NO: 791932 - DNA, 25 bp, Mus musculus
tcttgaggtaacagaaccttggcct

SEQ ID NO: 791933 - DNA, 25 bp, Mus musculus
tcttgaggtaactgaaccttggcct

SEQ ID NO: 791934 - DNA, 25 bp, Mus musculus
tcttgaggtgaaccgcggctctcaa

SEQ ID NO: 791935 - DNA, 25 bp, Mus musculus
tcttgaggtgaagcgcggctctcaa

SEQ ID NO: 791936 - DNA, 25 bp, Mus musculus
tcttgagtagtgagaactatgacga

SEQ ID NO: 791937 - DNA, 25 bp, Mus musculus
tcttgagtagtgtgaactatgacga

SEQ ID NO: 791938 - DNA, 25 bp, Mus musculus
tcttgagtatcactccagcatgatt

SEQ ID NO: 791939 - DNA, 25 bp, Mus musculus
tcttgagtatcagtccagcatgatt

SEQ ID NO: 791940 - DNA, 25 bp, Mus musculus
tcttgataacccatacaataatctg

SEQ ID NO: 791941 - DNA, 25 bp, Mus musculus
tcttgataacccttacaataatctg

SEQ ID NO: 791942 - DNA, 25 bp, Mus musculus
tcttgatacagtcttgtggtgccct

SEQ ID NO: 791943 - DNA, 25 bp, Mus musculus
tcttgatacagtgttgtggtgccct

SEQ ID NO: 791944 - DNA, 25 bp, Mus musculus
tcttgatatgtacgaagaagattcc

SEQ ID NO: 791945 - DNA, 25 bp, Mus musculus
tcttgatatgtaggaagaagattcc

SEQ ID NO: 791946 - DNA, 25 bp, Mus musculus
tcttgatcacaacaacctggacctg

SEQ ID NO: 791947 - DNA, 25 bp, Mus musculus
tcttgatcacaagaacctggacctg

SEQ ID NO: 791948 - DNA, 25 bp, Mus musculus
tcttgatcattgagaagcatttgaa

SEQ ID NO: 791949 - DNA, 25 bp, Mus musculus
tcttgatcattgtgaagcatttgaa

SEQ ID NO: 791950 - DNA, 25 bp, Mus musculus
tcttgatccggcaaaagaagaaggg

SEQ ID NO: 791951 - DNA, 25 bp, Mus musculus
tcttgatccggctaaagaagaaggg

SEQ ID NO: 791952 - DNA, 25 bp, Mus musculus
tcttgatcttctcagtgtacgtgtc

SEQ ID NO: 791953 - DNA, 25 bp, Mus musculus
tcttgatcttctgagtgtacgtgtc

SEQ ID NO: 791954 - DNA, 25 bp, Mus musculus
tcttgatgaagcactaaagcatgtt

SEQ ID NO: 791955 - DNA, 25 bp, Mus musculus
tcttgatgaagctctaaagcatgtt

SEQ ID NO: 791956 - DNA, 25 bp, Mus musculus
tcttgatgacagaatcctgcagtgc

SEQ ID NO: 791957 - DNA, 25 bp, Mus musculus
tcttgatgacagtatcctgcagtgc

SEQ ID NO: 791958 - DNA, 25 bp, Mus musculus
tcttgatgcatgatatctgggcagc

SEQ ID NO: 791959 - DNA, 25 bp, Mus musculus
tcttgatgcatgttatctgggcagc

SEQ ID NO: 791960 - DNA, 25 bp, Mus musculus
tcttgatggataaccttcctttggg

SEQ ID NO: 791961 - DNA, 25 bp, Mus musculus
tcttgatggatatccttcctttggg

SEQ ID NO: 791962 - DNA, 25 bp, Mus musculus
tcttgatggctgaccagggaggcct

SEQ ID NO: 791963 - DNA, 25 bp, Mus musculus
tcttgatggctgtccagggaggcct

SEQ ID NO: 791964 - DNA, 25 bp, Mus musculus
tcttgatgtggaaatgatggatatc

SEQ ID NO: 791965 - DNA, 25 bp, Mus musculus
tcttgatgtggatatgatggatatc

SEQ ID NO: 791966 - DNA, 25 bp, Mus musculus
tcttgattgccacgttgcgagtggc

SEQ ID NO: 791967 - DNA, 25 bp, Mus musculus
tcttgattgccaggttgcgagtggc

SEQ ID NO: 791968 - DNA, 25 bp, Mus musculus
tcttgattgtggagcgacagcttct

SEQ ID NO: 791969 - DNA, 25 bp, Mus musculus
tcttgattgtggtgcgacagcttct

SEQ ID NO: 791970 - DNA, 25 bp, Mus musculus
tcttgcaaacaacaatctccagaca

SEQ ID NO: 791971 - DNA, 25 bp, Mus musculus
tcttgcaaacaagaatctccagaca

SEQ ID NO: 791972 - DNA, 25 bp, Mus musculus
tcttgcaaagccatagactgagctg

SEQ ID NO: 791973 - DNA, 25 bp, Mus musculus
tcttgcaaagccctttgtagagatc

SEQ ID NO: 791974 - DNA, 25 bp, Mus musculus
tcttgcaaagccgtttgtagagatc

SEQ ID NO: 791975 - DNA, 25 bp, Mus musculus
tcttgcaaagccttagactgagctg

SEQ ID NO: 791976 - DNA, 25 bp, Mus musculus
tcttgcaaagtaaagtgacccctgt

SEQ ID NO: 791977 - DNA, 25 bp, Mus musculus
tcttgcaaagtatagtgacccctgt

SEQ ID NO: 791978 - DNA, 25 bp, Mus musculus
tcttgcaactgaatggaccatgtac

SEQ ID NO: 791979 - DNA, 25 bp, Mus musculus
tcttgcaactgattggaccatgtac

SEQ ID NO: 791980 - DNA, 25 bp, Mus musculus
tcttgcaagacacagagccgagtaa

SEQ ID NO: 791981 - DNA, 25 bp, Mus musculus
tcttgcaagacagagagccgagtaa

SEQ ID NO: 791982 - DNA, 25 bp, Mus musculus
tcttgcaagatgacagaactatcca

SEQ ID NO: 791983 - DNA, 25 bp, Mus musculus
tcttgcaagatgtcagaactatcca

SEQ ID NO: 791984 - DNA, 25 bp, Mus musculus
tcttgcacaaaactactttgaactt

SEQ ID NO: 791985 - DNA, 25 bp, Mus musculus
tcttgcacaaaagtactttgaactt

SEQ ID NO: 791986 - DNA, 25 bp, Mus musculus
tcttgcacaccgagaaagtatgcgc

SEQ ID NO: 791987 - DNA, 25 bp, Mus musculus
tcttgcacaccgtgaaagtatgcgc

SEQ ID NO: 791988 - DNA, 25 bp, Mus musculus
tcttgcacagtaaaatggcctaggg

SEQ ID NO: 791989 - DNA, 25 bp, Mus musculus
tcttgcacagtataatggcctaggg

SEQ ID NO: 791990 - DNA, 25 bp, Mus musculus
tcttgcagacaacaacagcttcatt

SEQ ID NO: 791991 - DNA, 25 bp, Mus musculus
tcttgcagacaagaacagcttcatt

SEQ ID NO: 791992 - DNA, 25 bp, Mus musculus
tcttgcagatacagcgctaggaaaa

SEQ ID NO: 791993 - DNA, 25 bp, Mus musculus
tcttgcagatactgcgctaggaaaa

SEQ ID NO: 791994 - DNA, 25 bp, Mus musculus
tcttgcagcagaaccgacttgccca

SEQ ID NO: 791995 - DNA, 25 bp, Mus musculus
tcttgcagcagatccgacttgccca

SEQ ID NO: 791996 - DNA, 25 bp, Mus musculus
tcttgcagcaggctaaagaagtggc

SEQ ID NO: 791997 - DNA, 25 bp, Mus musculus
tcttgcagcagggtaaagaagtggc

SEQ ID NO: 791998 - DNA, 25 bp, Mus musculus
tcttgcagctttatacacggaaaaa

SEQ ID NO: 791999 - DNA, 25 bp, Mus musculus
tcttgcagctttttacacggaaaaa

SEQ ID NO: 792000 - DNA, 25 bp, Mus musculus
tcttgcaggaataagcgttagggat

SEQ ID NO: 792001 - DNA, 25 bp, Mus musculus
tcttgcaggaattagcgttagggat

SEQ ID NO: 792002 - DNA, 25 bp, Mus musculus
tcttgcaggatgagaagcagctcga

SEQ ID NO: 792003 - DNA, 25 bp, Mus musculus
tcttgcaggatgtgaagcagctcga

SEQ ID NO: 792004 - DNA, 25 bp, Mus musculus
tcttgcaggcaaacccgacctcgta

SEQ ID NO: 792005 - DNA, 25 bp, Mus musculus
tcttgcaggcaatcccgacctcgta

SEQ ID NO: 792006 - DNA, 25 bp, Mus musculus
tcttgcagggcccagtgaaaaagcc

SEQ ID NO: 792007 - DNA, 25 bp, Mus musculus
tcttgcagggccgagtgaaaaagcc

SEQ ID NO: 792008 - DNA, 25 bp, Mus musculus
tcttgcagtttcagcaaagaccttc

SEQ ID NO: 792009 - DNA, 25 bp, Mus musculus
tcttgcagtttctgcaaagaccttc

SEQ ID NO: 792010 - DNA, 25 bp, Mus musculus
tcttgcagttttcaggtaagttcca

SEQ ID NO: 792011 - DNA, 25 bp, Mus musculus
tcttgcagttttgaggtaagttcca

SEQ ID NO: 792012 - DNA, 25 bp, Mus musculus
tcttgcatatggaaaaagctagctt

SEQ ID NO: 792013 - DNA, 25 bp, Mus musculus
tcttgcatatggtaaaagctagctt

SEQ ID NO: 792014 - DNA, 25 bp, Mus musculus
tcttgcatcctgctgcaaaagctcg

SEQ ID NO: 792015 - DNA, 25 bp, Mus musculus
tcttgcatcctggtgcaaaagctcg

SEQ ID NO: 792016 - DNA, 25 bp, Mus musculus
tcttgcatgccactcgagacaatgc

SEQ ID NO: 792017 - DNA, 25 bp, Mus musculus
tcttgcatgccagtcgagacaatgc

SEQ ID NO: 792018 - DNA, 25 bp, Mus musculus
tcttgcatgctacgccacactgaag

SEQ ID NO: 792019 - DNA, 25 bp, Mus musculus
tcttgcatgctaggccacactgaag

SEQ ID NO: 792020 - DNA, 25 bp, Mus musculus
tcttgcatgtcaccagggcttgctg

SEQ ID NO: 792021 - DNA, 25 bp, Mus musculus
tcttgcatgtcagcagggcttgctg

SEQ ID NO: 792022 - DNA, 25 bp, Mus musculus
tcttgcatttcgagaaggaactgtg

SEQ ID NO: 792023 - DNA, 25 bp, Mus musculus
tcttgcatttcgtgaaggaactgtg

SEQ ID NO: 792024 - DNA, 25 bp, Mus musculus
tcttgcatttggaagaccttcagaa

SEQ ID NO: 792025 - DNA, 25 bp, Mus musculus
tcttgcatttggtagaccttcagaa

SEQ ID NO: 792026 - DNA, 25 bp, Mus musculus
tcttgccaaaaaagctcagcagaag

SEQ ID NO: 792027 - DNA, 25 bp, Mus musculus
tcttgccaaaaatgctcagcagaag

SEQ ID NO: 792028 - DNA, 25 bp, Mus musculus
tcttgccaactaagaacggctcttg

SEQ ID NO: 792029 - DNA, 25 bp, Mus musculus
tcttgccaactatgaacggctcttg

SEQ ID NO: 792030 - DNA, 25 bp, Mus musculus
tcttgccaagctctacgagaataag

SEQ ID NO: 792031 - DNA, 25 bp, Mus musculus
tcttgccaagctgtacgagaataag

SEQ ID NO: 792032 - DNA, 25 bp, Mus musculus
tcttgccacacacgctctgggtgaa

SEQ ID NO: 792033 - DNA, 25 bp, Mus musculus
tcttgccacacaggctctgggtgaa

SEQ ID NO: 792034 - DNA, 25 bp, Mus musculus
tcttgccacagtcccatggagaagg

SEQ ID NO: 792035 - DNA, 25 bp, Mus musculus
tcttgccacagtgccatggagaagg

SEQ ID NO: 792036 - DNA, 25 bp, Mus musculus
tcttgccagaacactggtagtaagc

SEQ ID NO: 792037 - DNA, 25 bp, Mus musculus
tcttgccagaactctggtagtaagc

SEQ ID NO: 792038 - DNA, 25 bp, Mus musculus
tcttgcccagcaactacctcatctt

SEQ ID NO: 792039 - DNA, 25 bp, Mus musculus
tcttgcccagcatctacctcatctt

SEQ ID NO: 792040 - DNA, 25 bp, Mus musculus
tcttgcccccagcaagagagctcag

SEQ ID NO: 792041 - DNA, 25 bp, Mus musculus
tcttgcccccaggaagagagctcag

SEQ ID NO: 792042 - DNA, 25 bp, Mus musculus
tcttgcccgagaaggagctagggac

SEQ ID NO: 792043 - DNA, 25 bp, Mus musculus
tcttgcccgagatggagctagggac

SEQ ID NO: 792044 - DNA, 25 bp, Mus musculus
tcttgcccggctcgacggcgacatg

SEQ ID NO: 792045 - DNA, 25 bp, Mus musculus
tcttgcccggctggacggcgacatg

SEQ ID NO: 792046 - DNA, 25 bp, Mus musculus
tcttgccctcataatctgcaacaca

SEQ ID NO: 792047 - DNA, 25 bp, Mus musculus
tcttgccctcattatctgcaacaca

SEQ ID NO: 792048 - DNA, 25 bp, Mus musculus
tcttgccctgagattctgtagccct

SEQ ID NO: 792049 - DNA, 25 bp, Mus musculus
tcttgccctgagtttctgtagccct

SEQ ID NO: 792050 - DNA, 25 bp, Mus musculus
tcttgccctgggactgaacctttga

SEQ ID NO: 792051 - DNA, 25 bp, Mus musculus
tcttgccctgggtctgaacctttga

SEQ ID NO: 792052 - DNA, 25 bp, Mus musculus
tcttgcccttggagccagccattca

SEQ ID NO: 792053 - DNA, 25 bp, Mus musculus
tcttgcccttggtgccagccattca

SEQ ID NO: 792054 - DNA, 25 bp, Mus musculus
tcttgccgagaaagatcctacttca

SEQ ID NO: 792055 - DNA, 25 bp, Mus musculus
tcttgccgagaatgatcctacttca

SEQ ID NO: 792056 - DNA, 25 bp, Mus musculus
tcttgccgatctcaagggtttcctg

SEQ ID NO: 792057 - DNA, 25 bp, Mus musculus
tcttgccgatctgaagggtttcctg

SEQ ID NO: 792058 - DNA, 25 bp, Mus musculus
tcttgccgggacctctatgcaaaac

SEQ ID NO: 792059 - DNA, 25 bp, Mus musculus
tcttgccgggacgtctatgcaaaac

SEQ ID NO: 792060 - DNA, 25 bp, Mus musculus
tcttgcctatgccagacacagggct

SEQ ID NO: 792061 - DNA, 25 bp, Mus musculus
tcttgcctatgcgagacacagggct

SEQ ID NO: 792062 - DNA, 25 bp, Mus musculus
tcttgcctccaaattacaatgtgtc

SEQ ID NO: 792063 - DNA, 25 bp, Mus musculus
tcttgcctccaacaagtatccaaag

SEQ ID NO: 792064 - DNA, 25 bp, Mus musculus
tcttgcctccaagaagtatccaaag

SEQ ID NO: 792065 - DNA, 25 bp, Mus musculus
tcttgcctccaatttacaatgtgtc

SEQ ID NO: 792066 - DNA, 25 bp, Mus musculus
tcttgcctgatcctggccacaggtc

SEQ ID NO: 792067 - DNA, 25 bp, Mus musculus
tcttgcctgatcgtggccacaggtc

SEQ ID NO: 792068 - DNA, 25 bp, Mus musculus
tcttgcctgcccatactgttcttga

SEQ ID NO: 792069 - DNA, 25 bp, Mus musculus
tcttgcctgcccttactgttcttga

SEQ ID NO: 792070 - DNA, 25 bp, Mus musculus
tcttgcctgctgcttgtgatccctg

SEQ ID NO: 792071 - DNA, 25 bp, Mus musculus
tcttgcctgctggttgtgatccctg

SEQ ID NO: 792072 - DNA, 25 bp, Mus musculus
tcttgcctgtggattcagagcccca

SEQ ID NO: 792073 - DNA, 25 bp, Mus musculus
tcttgcctgtggtttcagagcccca

SEQ ID NO: 792074 - DNA, 25 bp, Mus musculus
tcttgcctgtttcgtagggatggcc

SEQ ID NO: 792075 - DNA, 25 bp, Mus musculus
tcttgcctgtttggtagggatggcc

SEQ ID NO: 792076 - DNA, 25 bp, Mus musculus
tcttgccttcgtaccaaattgccag

SEQ ID NO: 792077 - DNA, 25 bp, Mus musculus
tcttgccttcgttccaaattgccag

SEQ ID NO: 792078 - DNA, 25 bp, Mus musculus
tcttgccttgtacctggaaccagtg

SEQ ID NO: 792079 - DNA, 25 bp, Mus musculus
tcttgccttgtagctggaaccagtg

SEQ ID NO: 792080 - DNA, 25 bp, Mus musculus
tcttgcctttaacgagcagggcagg

SEQ ID NO: 792081 - DNA, 25 bp, Mus musculus
tcttgcctttaaggagcagggcagg

SEQ ID NO: 792082 - DNA, 25 bp, Mus musculus
tcttgcgaaagaaccgtgacatccc

SEQ ID NO: 792083 - DNA, 25 bp, Mus musculus
tcttgcgaaagatccgtgacatccc

SEQ ID NO: 792084 - DNA, 25 bp, Mus musculus
tcttgcgcagatactggatgacctg

SEQ ID NO: 792085 - DNA, 25 bp, Mus musculus
tcttgcgcagattctggatgacctg

SEQ ID NO: 792086 - DNA, 25 bp, Mus musculus
tcttgcggctccagcagactgacaa

SEQ ID NO: 792087 - DNA, 25 bp, Mus musculus
tcttgcggctcctgcagactgacaa

SEQ ID NO: 792088 - DNA, 25 bp, Mus musculus
tcttgcgggagaacctgaaaggcct

SEQ ID NO: 792089 - DNA, 25 bp, Mus musculus
tcttgcgggagatcctgaaaggcct

SEQ ID NO: 792090 - DNA, 25 bp, Mus musculus
tcttgcgtcactaggcagcctcaat

SEQ ID NO: 792091 - DNA, 25 bp, Mus musculus
tcttgcgtcacttggcagcctcaat

SEQ ID NO: 792092 - DNA, 25 bp, Mus musculus
tcttgcgtgcttaggctgggttcct

SEQ ID NO: 792093 - DNA, 25 bp, Mus musculus
tcttgcgtgctttggctgggttcct

SEQ ID NO: 792094 - DNA, 25 bp, Mus musculus
tcttgctacaatagagagatggaga

SEQ ID NO: 792095 - DNA, 25 bp, Mus musculus
tcttgctacaattgagagatggaga

SEQ ID NO: 792096 - DNA, 25 bp, Mus musculus
tcttgctcaaggcagtgaaaagaag

SEQ ID NO: 792097 - DNA, 25 bp, Mus musculus
tcttgctcaagggagtgaaaagaag

SEQ ID NO: 792098 - DNA, 25 bp, Mus musculus
tcttgctcacagctggacaagtctg

SEQ ID NO: 792099 - DNA, 25 bp, Mus musculus
tcttgctcacaggtggacaagtctg

SEQ ID NO: 792100 - DNA, 25 bp, Mus musculus
tcttgctcacccacgctatttgcag

SEQ ID NO: 792101 - DNA, 25 bp, Mus musculus
tcttgctcaccctcgctatttgcag

SEQ ID NO: 792102 - DNA, 25 bp, Mus musculus
tcttgctcaggtactcgttttggct

SEQ ID NO: 792103 - DNA, 25 bp, Mus musculus
tcttgctcaggttctcgttttggct

SEQ ID NO: 792104 - DNA, 25 bp, Mus musculus
tcttgctcatgtctggctattaaca

SEQ ID NO: 792105 - DNA, 25 bp, Mus musculus
tcttgctcatgtgtggctattaaca

SEQ ID NO: 792106 - DNA, 25 bp, Mus musculus
tcttgctcccgaccttctgggcggg

SEQ ID NO: 792107 - DNA, 25 bp, Mus musculus
tcttgctcccgagcttctgggcggg

SEQ ID NO: 792108 - DNA, 25 bp, Mus musculus
tcttgctcgagactacaactgtgcc

SEQ ID NO: 792109 - DNA, 25 bp, Mus musculus
tcttgctcgagagtacaactgtgcc

SEQ ID NO: 792110 - DNA, 25 bp, Mus musculus
tcttgctctaccaggcacacaagta

SEQ ID NO: 792111 - DNA, 25 bp, Mus musculus
tcttgctctacctggcacacaagta

SEQ ID NO: 792112 - DNA, 25 bp, Mus musculus
tcttgctctcgactgttaatggcgg

SEQ ID NO: 792113 - DNA, 25 bp, Mus musculus
tcttgctctcgagtgttaatggcgg

SEQ ID NO: 792114 - DNA, 25 bp, Mus musculus
tcttgctgaagaagcctcatgttct

SEQ ID NO: 792115 - DNA, 25 bp, Mus musculus
tcttgctgaagatgcctcatgttct

SEQ ID NO: 792116 - DNA, 25 bp, Mus musculus
tcttgctgagaaactaacaggccca

SEQ ID NO: 792117 - DNA, 25 bp, Mus musculus
tcttgctgagaatctaacaggccca

SEQ ID NO: 792118 - DNA, 25 bp, Mus musculus
tcttgctgagataaacaccaggaca

SEQ ID NO: 792119 - DNA, 25 bp, Mus musculus
tcttgctgagattaacaccaggaca

SEQ ID NO: 792120 - DNA, 25 bp, Mus musculus
tcttgctgccctcgatgcgctcaat

SEQ ID NO: 792121 - DNA, 25 bp, Mus musculus
tcttgctgccctggatgcgctcaat

SEQ ID NO: 792122 - DNA, 25 bp, Mus musculus
tcttgctggctcagcaagcccgata

SEQ ID NO: 792123 - DNA, 25 bp, Mus musculus
tcttgctggctctgcaagcccgata

SEQ ID NO: 792124 - DNA, 25 bp, Mus musculus
tcttgctgggttagctgttggtgct

SEQ ID NO: 792125 - DNA, 25 bp, Mus musculus
tcttgctgggtttgctgttggtgct

SEQ ID NO: 792126 - DNA, 25 bp, Mus musculus
tcttgctggtctctggctcgctcct

SEQ ID NO: 792127 - DNA, 25 bp, Mus musculus
tcttgctggtctgtggctcgctcct

SEQ ID NO: 792128 - DNA, 25 bp, Mus musculus
tcttgcttctagaggctctcttcca

SEQ ID NO: 792129 - DNA, 25 bp, Mus musculus
tcttgcttctagtggctctcttcca

SEQ ID NO: 792130 - DNA, 25 bp, Mus musculus
tcttgcttgtgaccaaacagctgac

SEQ ID NO: 792131 - DNA, 25 bp, Mus musculus
tcttgcttgtgagcaaacagctgac

SEQ ID NO: 792132 - DNA, 25 bp, Mus musculus
tcttgctttagacagatggtggcaa

SEQ ID NO: 792133 - DNA, 25 bp, Mus musculus
tcttgctttagagagatggtggcaa

SEQ ID NO: 792134 - DNA, 25 bp, Mus musculus
tcttgctttcggacgcgcagtgttc

SEQ ID NO: 792135 - DNA, 25 bp, Mus musculus
tcttgctttcggtcgcgcagtgttc

SEQ ID NO: 792136 - DNA, 25 bp, Mus musculus
tcttgctttggtcggctcaacgcct

SEQ ID NO: 792137 - DNA, 25 bp, Mus musculus
tcttgctttggtgggctcaacgcct

SEQ ID NO: 792138 - DNA, 25 bp, Mus musculus
tcttgcttttagcaggtccaggcag

SEQ ID NO: 792139 - DNA, 25 bp, Mus musculus
tcttgcttttaggaggtccaggcag

SEQ ID NO: 792140 - DNA, 25 bp, Mus musculus
tcttggaaacatctgttaagaactg

SEQ ID NO: 792141 - DNA, 25 bp, Mus musculus
tcttggaaacatgtgttaagaactg

SEQ ID NO: 792142 - DNA, 25 bp, Mus musculus
tcttggaacaagagtgaggagaact

SEQ ID NO: 792143 - DNA, 25 bp, Mus musculus
tcttggaacaagtgtgaggagaact

SEQ ID NO: 792144 - DNA, 25 bp, Mus musculus
tcttggaacacccaatgaggacacg

SEQ ID NO: 792145 - DNA, 25 bp, Mus musculus
tcttggaacaccgaatgaggacacg

SEQ ID NO: 792146 - DNA, 25 bp, Mus musculus
tcttggaacagacgtatggcaagag

SEQ ID NO: 792147 - DNA, 25 bp, Mus musculus
tcttggaacagaggtatggcaagag

SEQ ID NO: 792148 - DNA, 25 bp, Mus musculus
tcttggaacgaaacagccttgcctc

SEQ ID NO: 792149 - DNA, 25 bp, Mus musculus
tcttggaacgaatcagccttgcctc

SEQ ID NO: 792150 - DNA, 25 bp, Mus musculus
tcttggaagataacccactgcattg

SEQ ID NO: 792151 - DNA, 25 bp, Mus musculus
tcttggaagatatcccactgcattg

SEQ ID NO: 792152 - DNA, 25 bp, Mus musculus
tcttggaagatgctacgaaattgag

SEQ ID NO: 792153 - DNA, 25 bp, Mus musculus
tcttggaagatggtacgaaattgag

SEQ ID NO: 792154 - DNA, 25 bp, Mus musculus
tcttggaaggagactataaaacgcc

SEQ ID NO: 792155 - DNA, 25 bp, Mus musculus
tcttggaaggagtctataaaacgcc

SEQ ID NO: 792156 - DNA, 25 bp, Mus musculus
tcttggaaggcaaggtcatgccatc

SEQ ID NO: 792157 - DNA, 25 bp, Mus musculus
tcttggaaggcatggtcatgccatc

SEQ ID NO: 792158 - DNA, 25 bp, Mus musculus
tcttggaaggccatacagggcaaaa

SEQ ID NO: 792159 - DNA, 25 bp, Mus musculus
tcttggaaggccttacagggcaaaa

SEQ ID NO: 792160 - DNA, 25 bp, Mus musculus
tcttggaagtggagactgaggaact

SEQ ID NO: 792161 - DNA, 25 bp, Mus musculus
tcttggaagtggtgactgaggaact

SEQ ID NO: 792162 - DNA, 25 bp, Mus musculus
tcttggaagtgtctcggcaaccgct

SEQ ID NO: 792163 - DNA, 25 bp, Mus musculus
tcttggaagtgtgtcggcaaccgct

SEQ ID NO: 792164 - DNA, 25 bp, Mus musculus
tcttggaatgagaagtaccgattct

SEQ ID NO: 792165 - DNA, 25 bp, Mus musculus
tcttggaatgagtagtaccgattct

SEQ ID NO: 792166 - DNA, 25 bp, Mus musculus
tcttggacaacaagtttggaccacg

SEQ ID NO: 792167 - DNA, 25 bp, Mus musculus
tcttggacaacatgtttggaccacg

SEQ ID NO: 792168 - DNA, 25 bp, Mus musculus
tcttggacaagcacaagactataga

SEQ ID NO: 792169 - DNA, 25 bp, Mus musculus
tcttggacaagctcaagactataga

SEQ ID NO: 792170 - DNA, 25 bp, Mus musculus
tcttggacagcaccagtgtagcagc

SEQ ID NO: 792171 - DNA, 25 bp, Mus musculus
tcttggacagcagcagtgtagcagc

SEQ ID NO: 792172 - DNA, 25 bp, Mus musculus
tcttggacagctcagaaatccattg

SEQ ID NO: 792173 - DNA, 25 bp, Mus musculus
tcttggacagctgagaaatccattg

SEQ ID NO: 792174 - DNA, 25 bp, Mus musculus
tcttggacagtgctttaccagaagg

SEQ ID NO: 792175 - DNA, 25 bp, Mus musculus
tcttggacagtggtttaccagaagg

SEQ ID NO: 792176 - DNA, 25 bp, Mus musculus
tcttggaccagaaataaaattctca

SEQ ID NO: 792177 - DNA, 25 bp, Mus musculus
tcttggaccagatataaaattctca

SEQ ID NO: 792178 - DNA, 25 bp, Mus musculus
tcttggaccccacctgaacgtggtc

SEQ ID NO: 792179 - DNA, 25 bp, Mus musculus
tcttggaccccagctgaacgtggtc

SEQ ID NO: 792180 - DNA, 25 bp, Mus musculus
tcttggacctagaagactattgcca

SEQ ID NO: 792181 - DNA, 25 bp, Mus musculus
tcttggacctagtagactattgcca

SEQ ID NO: 792182 - DNA, 25 bp, Mus musculus
tcttggacctcacgaagagtgacgt

SEQ ID NO: 792183 - DNA, 25 bp, Mus musculus
tcttggacctcaggaagagtgacgt

SEQ ID NO: 792184 - DNA, 25 bp, Mus musculus
tcttggacggttcctcattggcgcc

SEQ ID NO: 792185 - DNA, 25 bp, Mus musculus
tcttggacggttgctcattggcgcc

SEQ ID NO: 792186 - DNA, 25 bp, Mus musculus
tcttggacgtgcagagcacagcccc

SEQ ID NO: 792187 - DNA, 25 bp, Mus musculus
tcttggacgtgctgagcacagcccc

SEQ ID NO: 792188 - DNA, 25 bp, Mus musculus
tcttggacgtttatcatggtctccg

SEQ ID NO: 792189 - DNA, 25 bp, Mus musculus
tcttggacgtttttcatggtctccg

SEQ ID NO: 792190 - DNA, 25 bp, Mus musculus
tcttggactacgaagacgacgaggt

SEQ ID NO: 792191 - DNA, 25 bp, Mus musculus
tcttggactacgtagacgacgaggt

SEQ ID NO: 792192 - DNA, 25 bp, Mus musculus
tcttggactgacaatgggaccttca

SEQ ID NO: 792193 - DNA, 25 bp, Mus musculus
tcttggactgactatgggaccttca

SEQ ID NO: 792194 - DNA, 25 bp, Mus musculus
tcttggactggacattggtgcccag

SEQ ID NO: 792195 - DNA, 25 bp, Mus musculus
tcttggactggagattggtgcccag

SEQ ID NO: 792196 - DNA, 25 bp, Mus musculus
tcttggagaactaacagaggtctgc

SEQ ID NO: 792197 - DNA, 25 bp, Mus musculus
tcttggagaactatggtgacgcgct

SEQ ID NO: 792198 - DNA, 25 bp, Mus musculus
tcttggagaacttacagaggtctgc

SEQ ID NO: 792199 - DNA, 25 bp, Mus musculus
tcttggagaactttggtgacgcgct

SEQ ID NO: 792200 - DNA, 25 bp, Mus musculus
tcttggagacccatgccccatgctg

SEQ ID NO: 792201 - DNA, 25 bp, Mus musculus
tcttggagacccttgccccatgctg

SEQ ID NO: 792202 - DNA, 25 bp, Mus musculus
tcttggagagtcatgcaaaacctga

SEQ ID NO: 792203 - DNA, 25 bp, Mus musculus
tcttggagagtcttgcaaaacctga

SEQ ID NO: 792204 - DNA, 25 bp, Mus musculus
tcttggagatcaatgggacccctgt

SEQ ID NO: 792205 - DNA, 25 bp, Mus musculus
tcttggagatcattgggacccctgt

SEQ ID NO: 792206 - DNA, 25 bp, Mus musculus
tcttggagatttcagggaaactggt

SEQ ID NO: 792207 - DNA, 25 bp, Mus musculus
tcttggagatttgagggaaactggt

SEQ ID NO: 792208 - DNA, 25 bp, Mus musculus
tcttggagcaacatcccctttatca

SEQ ID NO: 792209 - DNA, 25 bp, Mus musculus
tcttggagcaacttcccctttatca

SEQ ID NO: 792210 - DNA, 25 bp, Mus musculus
tcttggagccatccctaaaccgtag

SEQ ID NO: 792211 - DNA, 25 bp, Mus musculus
tcttggagccatgcctaaaccgtag

SEQ ID NO: 792212 - DNA, 25 bp, Mus musculus
tcttggagccttcccgtggacagca

SEQ ID NO: 792213 - DNA, 25 bp, Mus musculus
tcttggagccttgccgtggacagca

SEQ ID NO: 792214 - DNA, 25 bp, Mus musculus
tcttggagcgtgaactgcagcgacg

SEQ ID NO: 792215 - DNA, 25 bp, Mus musculus
tcttggagcgtgtactgcagcgacg

SEQ ID NO: 792216 - DNA, 25 bp, Mus musculus
tcttggaggcagcagatggctttct

SEQ ID NO: 792217 - DNA, 25 bp, Mus musculus
tcttggaggcaggagatggctttct

SEQ ID NO: 792218 - DNA, 25 bp, Mus musculus
tcttggaggtgcagaagcggatcaa

SEQ ID NO: 792219 - DNA, 25 bp, Mus musculus
tcttggaggtgctgaagcggatcaa

SEQ ID NO: 792220 - DNA, 25 bp, Mus musculus
tcttggagttgacccaagagaaaag

SEQ ID NO: 792221 - DNA, 25 bp, Mus musculus
tcttggagttgagccaagagaaaag

SEQ ID NO: 792222 - DNA, 25 bp, Mus musculus
tcttggatcagccagcaaagtgccc

SEQ ID NO: 792223 - DNA, 25 bp, Mus musculus
tcttggatcagcgagcaaagtgccc

SEQ ID NO: 792224 - DNA, 25 bp, Mus musculus
tcttggatcgctctcttacctggga

SEQ ID NO: 792225 - DNA, 25 bp, Mus musculus
tcttggatcgctgtcttacctggga

SEQ ID NO: 792226 - DNA, 25 bp, Mus musculus
tcttggatgcaaaaccagttgtact

SEQ ID NO: 792227 - DNA, 25 bp, Mus musculus
tcttggatgcaataccagttgtact

SEQ ID NO: 792228 - DNA, 25 bp, Mus musculus
tcttggattcgactcacaaggagct

SEQ ID NO: 792229 - DNA, 25 bp, Mus musculus
tcttggattcgagtcacaaggagct

SEQ ID NO: 792230 - DNA, 25 bp, Mus musculus
tcttggcaatggaagatgctttaaa

SEQ ID NO: 792231 - DNA, 25 bp, Mus musculus
tcttggcaatggtagatgctttaaa

SEQ ID NO: 792232 - DNA, 25 bp, Mus musculus
tcttggcaccgacctcttcagcaag

SEQ ID NO: 792233 - DNA, 25 bp, Mus musculus
tcttggcaccgagctcttcagcaag

SEQ ID NO: 792234 - DNA, 25 bp, Mus musculus
tcttggcacgagctgttgccagcca

SEQ ID NO: 792235 - DNA, 25 bp, Mus musculus
tcttggcacgaggtgttgccagcca

SEQ ID NO: 792236 - DNA, 25 bp, Mus musculus
tcttggcactagctgaaaaacatgg

SEQ ID NO: 792237 - DNA, 25 bp, Mus musculus
tcttggcactaggtgaaaaacatgg

SEQ ID NO: 792238 - DNA, 25 bp, Mus musculus
tcttggcagaatcccgctcagaagg

SEQ ID NO: 792239 - DNA, 25 bp, Mus musculus
tcttggcagaatgccgctcagaagg

SEQ ID NO: 792240 - DNA, 25 bp, Mus musculus
tcttggcagaggaggccaggttttc

SEQ ID NO: 792241 - DNA, 25 bp, Mus musculus
tcttggcagaggtggccaggttttc

SEQ ID NO: 792242 - DNA, 25 bp, Mus musculus
tcttggcaggctacgtggacttgac

SEQ ID NO: 792243 - DNA, 25 bp, Mus musculus
tcttggcaggcttcgtggacttgac

SEQ ID NO: 792244 - DNA, 25 bp, Mus musculus
tcttggcagtcaccagtctgcggag

SEQ ID NO: 792245 - DNA, 25 bp, Mus musculus
tcttggcagtcagcagtctgcggag

SEQ ID NO: 792246 - DNA, 25 bp, Mus musculus
tcttggcagtctatgtagacttcga

SEQ ID NO: 792247 - DNA, 25 bp, Mus musculus
tcttggcagtctttgtagacttcga

SEQ ID NO: 792248 - DNA, 25 bp, Mus musculus
tcttggccagagactcatttggtgc

SEQ ID NO: 792249 - DNA, 25 bp, Mus musculus
tcttggccagagtctcatttggtgc

SEQ ID NO: 792250 - DNA, 25 bp, Mus musculus
tcttggccaggtacgtgctctcgaa

SEQ ID NO: 792251 - DNA, 25 bp, Mus musculus
tcttggccaggttcgtgctctcgaa

SEQ ID NO: 792252 - DNA, 25 bp, Mus musculus
tcttggccctcaagagagaagaagg

SEQ ID NO: 792253 - DNA, 25 bp, Mus musculus
tcttggccctcatgagagaagaagg

SEQ ID NO: 792254 - DNA, 25 bp, Mus musculus
tcttggccctgaacttgacgggctt

SEQ ID NO: 792255 - DNA, 25 bp, Mus musculus
tcttggccctgatcttgacgggctt

SEQ ID NO: 792256 - DNA, 25 bp, Mus musculus
tcttggccctgccagagatgatcga

SEQ ID NO: 792257 - DNA, 25 bp, Mus musculus
tcttggccctgcgagagatgatcga

SEQ ID NO: 792258 - DNA, 25 bp, Mus musculus
tcttggccctgtagagcatctttca

SEQ ID NO: 792259 - DNA, 25 bp, Mus musculus
tcttggccctgttgagcatctttca

SEQ ID NO: 792260 - DNA, 25 bp, Mus musculus
tcttggcctggtagatgaatttggc

SEQ ID NO: 792261 - DNA, 25 bp, Mus musculus
tcttggcctggttgatgaatttggc

SEQ ID NO: 792262 - DNA, 25 bp, Mus musculus
tcttggcgacatagacaatgacggc

SEQ ID NO: 792263 - DNA, 25 bp, Mus musculus
tcttggcgacattgacaatgacggc

SEQ ID NO: 792264 - DNA, 25 bp, Mus musculus
tcttggcgacgaagcaaaggtcaca

SEQ ID NO: 792265 - DNA, 25 bp, Mus musculus
tcttggcgacgatgcaaaggtcaca

SEQ ID NO: 792266 - DNA, 25 bp, Mus musculus
tcttggcgagcacatgtaaatagca

SEQ ID NO: 792267 - DNA, 25 bp, Mus musculus
tcttggcgagcagatgtaaatagca

SEQ ID NO: 792268 - DNA, 25 bp, Mus musculus
tcttggctactgatgattcagcaga

SEQ ID NO: 792269 - DNA, 25 bp, Mus musculus
tcttggctactgttgattcagcaga

SEQ ID NO: 792270 - DNA, 25 bp, Mus musculus
tcttggctattacaacagactgcct

SEQ ID NO: 792271 - DNA, 25 bp, Mus musculus
tcttggctattagaacagactgcct

SEQ ID NO: 792272 - DNA, 25 bp, Mus musculus
tcttggctcacgatcctgtgcagct

SEQ ID NO: 792273 - DNA, 25 bp, Mus musculus
tcttggctcacgttcctgtgcagct

SEQ ID NO: 792274 - DNA, 25 bp, Mus musculus
tcttggctccagcatttgtgcagga

SEQ ID NO: 792275 - DNA, 25 bp, Mus musculus
tcttggctccaggatttgtgcagga

SEQ ID NO: 792276 - DNA, 25 bp, Mus musculus
tcttggctctgcagaagcacttcca

SEQ ID NO: 792277 - DNA, 25 bp, Mus musculus
tcttggctctgctgaagcacttcca

SEQ ID NO: 792278 - DNA, 25 bp, Mus musculus
tcttggctctgtagctaaaagcgaa

SEQ ID NO: 792279 - DNA, 25 bp, Mus musculus
tcttggctctgttgctaaaagcgaa

SEQ ID NO: 792280 - DNA, 25 bp, Mus musculus
tcttggctgctacttgtcgcgctct

SEQ ID NO: 792281 - DNA, 25 bp, Mus musculus
tcttggctgctagttgtcgcgctct

SEQ ID NO: 792282 - DNA, 25 bp, Mus musculus
tcttggctgtaaacttgacctaaag

SEQ ID NO: 792283 - DNA, 25 bp, Mus musculus
tcttggctgtaatcttgacctaaag

SEQ ID NO: 792284 - DNA, 25 bp, Mus musculus
tcttggctgtagatccacagggtgc

SEQ ID NO: 792285 - DNA, 25 bp, Mus musculus
tcttggctgtagttccacagggtgc

SEQ ID NO: 792286 - DNA, 25 bp, Mus musculus
tcttggcttcacaggtgaaacgtct

SEQ ID NO: 792287 - DNA, 25 bp, Mus musculus
tcttggcttcactggtgaaacgtct

SEQ ID NO: 792288 - DNA, 25 bp, Mus musculus
tcttggcttctgagatcctctttgc

SEQ ID NO: 792289 - DNA, 25 bp, Mus musculus
tcttggcttctgcaaccatcagtgg

SEQ ID NO: 792290 - DNA, 25 bp, Mus musculus
tcttggcttctggaaccatcagtgg

SEQ ID NO: 792291 - DNA, 25 bp, Mus musculus
tcttggcttctgtgatcctctttgc

SEQ ID NO: 792292 - DNA, 25 bp, Mus musculus
tcttgggaaacaaagacctggatgg

SEQ ID NO: 792293 - DNA, 25 bp, Mus musculus
tcttgggaaacatagacctggatgg

SEQ ID NO: 792294 - DNA, 25 bp, Mus musculus
tcttgggaagcaaaatcaagcacca

SEQ ID NO: 792295 - DNA, 25 bp, Mus musculus
tcttgggaagcataatcaagcacca

SEQ ID NO: 792296 - DNA, 25 bp, Mus musculus
tcttgggaagccattgtacactgga

SEQ ID NO: 792297 - DNA, 25 bp, Mus musculus
tcttgggaagcctttgtacactgga

SEQ ID NO: 792298 - DNA, 25 bp, Mus musculus
tcttgggacatgaagtctttacagc

SEQ ID NO: 792299 - DNA, 25 bp, Mus musculus
tcttgggacatgtagtctttacagc

SEQ ID NO: 792300 - DNA, 25 bp, Mus musculus
tcttgggacctcaaggaggaacatg

SEQ ID NO: 792301 - DNA, 25 bp, Mus musculus
tcttgggacctctaggaggaacatg

SEQ ID NO: 792302 - DNA, 25 bp, Mus musculus
tcttgggacgtaactgaagtgggcc

SEQ ID NO: 792303 - DNA, 25 bp, Mus musculus
tcttgggacgtatctgaagtgggcc

SEQ ID NO: 792304 - DNA, 25 bp, Mus musculus
tcttgggagaataaatggagcaatg

SEQ ID NO: 792305 - DNA, 25 bp, Mus musculus
tcttgggagaattaatggagcaatg

SEQ ID NO: 792306 - DNA, 25 bp, Mus musculus
tcttgggagcatcttgcatactctg

SEQ ID NO: 792307 - DNA, 25 bp, Mus musculus
tcttgggagcatgttgcatactctg

SEQ ID NO: 792308 - DNA, 25 bp, Mus musculus
tcttgggatcatcacaaaaaaggat

SEQ ID NO: 792309 - DNA, 25 bp, Mus musculus
tcttgggatcatgacaaaaaaggat

SEQ ID NO: 792310 - DNA, 25 bp, Mus musculus
tcttgggatcggagacaggcacaac

SEQ ID NO: 792311 - DNA, 25 bp, Mus musculus
tcttgggatcggtgacaggcacaac

SEQ ID NO: 792312 - DNA, 25 bp, Mus musculus
tcttgggcattgagcagcaggttct

SEQ ID NO: 792313 - DNA, 25 bp, Mus musculus
tcttgggcattgtgcagcaggttct

SEQ ID NO: 792314 - DNA, 25 bp, Mus musculus
tcttgggccagaccagttctatgcc

SEQ ID NO: 792315 - DNA, 25 bp, Mus musculus
tcttgggccagagcagttctatgcc

SEQ ID NO: 792316 - DNA, 25 bp, Mus musculus
tcttgggccgtaactgctgtgtcac

SEQ ID NO: 792317 - DNA, 25 bp, Mus musculus
tcttgggccgtatctgctgtgtcac

SEQ ID NO: 792318 - DNA, 25 bp, Mus musculus
tcttgggcctggagtaaaactatgt

SEQ ID NO: 792319 - DNA, 25 bp, Mus musculus
tcttgggcctggtgtaaaactatgt

SEQ ID NO: 792320 - DNA, 25 bp, Mus musculus
tcttgggcctgtctggaggagcagc

SEQ ID NO: 792321 - DNA, 25 bp, Mus musculus
tcttgggcctgtgtggaggagcagc

SEQ ID NO: 792322 - DNA, 25 bp, Mus musculus
tcttgggctatgcaggtgagtgtgg

SEQ ID NO: 792323 - DNA, 25 bp, Mus musculus
tcttgggctatggaggtgagtgtgg

SEQ ID NO: 792324 - DNA, 25 bp, Mus musculus
tcttgggctcccaggcatttgcgaa

SEQ ID NO: 792325 - DNA, 25 bp, Mus musculus
tcttgggctccctggcatttgcgaa

SEQ ID NO: 792326 - DNA, 25 bp, Mus musculus
tcttgggctctgcagagtgataaca

SEQ ID NO: 792327 - DNA, 25 bp, Mus musculus
tcttgggctctggagagtgataaca

SEQ ID NO: 792328 - DNA, 25 bp, Mus musculus
tcttgggcttccagcggtcccttga

SEQ ID NO: 792329 - DNA, 25 bp, Mus musculus
tcttgggcttcctgcggtcccttga

SEQ ID NO: 792330 - DNA, 25 bp, Mus musculus
tcttgggtgagaagaagacatcagg

SEQ ID NO: 792331 - DNA, 25 bp, Mus musculus
tcttgggtgagatgaagacatcagg

SEQ ID NO: 792332 - DNA, 25 bp, Mus musculus
tcttgggtggaccatccgtcttcat

SEQ ID NO: 792333 - DNA, 25 bp, Mus musculus
tcttgggtggacgatccgtcttcat

SEQ ID NO: 792334 - DNA, 25 bp, Mus musculus
tcttgggttccaacatcggcaccac

SEQ ID NO: 792335 - DNA, 25 bp, Mus musculus
tcttgggttccatcatcggcaccac

SEQ ID NO: 792336 - DNA, 25 bp, Mus musculus
tcttggtaacaacgccctgggtgac

SEQ ID NO: 792337 - DNA, 25 bp, Mus musculus
tcttggtaacaaggccctgggtgac

SEQ ID NO: 792338 - DNA, 25 bp, Mus musculus
tcttggtacttacatgataacatca

SEQ ID NO: 792339 - DNA, 25 bp, Mus musculus
tcttggtacttagatgataacatca

SEQ ID NO: 792340 - DNA, 25 bp, Mus musculus
tcttggtagaagagagcaacgtgca

SEQ ID NO: 792341 - DNA, 25 bp, Mus musculus
tcttggtagaagtgagcaacgtgca

SEQ ID NO: 792342 - DNA, 25 bp, Mus musculus
tcttggtagcagaatggaatgaacc

SEQ ID NO: 792343 - DNA, 25 bp, Mus musculus
tcttggtagcagtatggaatgaacc

SEQ ID NO: 792344 - DNA, 25 bp, Mus musculus
tcttggtagccaatgcaatcgtggg

SEQ ID NO: 792345 - DNA, 25 bp, Mus musculus
tcttggtagccattgcaatcgtggg

SEQ ID NO: 792346 - DNA, 25 bp, Mus musculus
tcttggtagcccaggtttgcattgc

SEQ ID NO: 792347 - DNA, 25 bp, Mus musculus
tcttggtagccctggtttgcattgc

SEQ ID NO: 792348 - DNA, 25 bp, Mus musculus
tcttggtatctccttggacaggata

SEQ ID NO: 792349 - DNA, 25 bp, Mus musculus
tcttggtatctcgttggacaggata

SEQ ID NO: 792350 - DNA, 25 bp, Mus musculus
tcttggtattatcccattgtagcta

SEQ ID NO: 792351 - DNA, 25 bp, Mus musculus
tcttggtattatgccattgtagcta

SEQ ID NO: 792352 - DNA, 25 bp, Mus musculus
tcttggtcacatactcagaatctct

SEQ ID NO: 792353 - DNA, 25 bp, Mus musculus
tcttggtcacattctcagaatctct

SEQ ID NO: 792354 - DNA, 25 bp, Mus musculus
tcttggtcatcacagaatgtcttaa

SEQ ID NO: 792355 - DNA, 25 bp, Mus musculus
tcttggtcatcagagaatgtcttaa

SEQ ID NO: 792356 - DNA, 25 bp, Mus musculus
tcttggtcatcgagacagacgggcg

SEQ ID NO: 792357 - DNA, 25 bp, Mus musculus
tcttggtcatcgcaaatgcgggaac

SEQ ID NO: 792358 - DNA, 25 bp, Mus musculus
tcttggtcatcggaaatgcgggaac

SEQ ID NO: 792359 - DNA, 25 bp, Mus musculus
tcttggtcatcgtgacagacgggcg

SEQ ID NO: 792360 - DNA, 25 bp, Mus musculus
tcttggtctcttcctaaagatatag

SEQ ID NO: 792361 - DNA, 25 bp, Mus musculus
tcttggtctcttgctaaagatatag

SEQ ID NO: 792362 - DNA, 25 bp, Mus musculus
tcttggtctgtcagttagagttgac

SEQ ID NO: 792363 - DNA, 25 bp, Mus musculus
tcttggtctgtctgttagagttgac

SEQ ID NO: 792364 - DNA, 25 bp, Mus musculus
tcttggtgaattaacagtaccgccg

SEQ ID NO: 792365 - DNA, 25 bp, Mus musculus
tcttggtgaatttacagtaccgccg

SEQ ID NO: 792366 - DNA, 25 bp, Mus musculus
tcttggtgacacaagacagagcaac

SEQ ID NO: 792367 - DNA, 25 bp, Mus musculus
tcttggtgacaccaactatgcctgg

SEQ ID NO: 792368 - DNA, 25 bp, Mus musculus
tcttggtgacacgaactatgcctgg

SEQ ID NO: 792369 - DNA, 25 bp, Mus musculus
tcttggtgacactagacagagcaac

SEQ ID NO: 792370 - DNA, 25 bp, Mus musculus
tcttggtgaccaacctggatttcca

SEQ ID NO: 792371 - DNA, 25 bp, Mus musculus
tcttggtgaccatcctggatttcca

SEQ ID NO: 792372 - DNA, 25 bp, Mus musculus
tcttggtgagggacctgacaactta

SEQ ID NO: 792373 - DNA, 25 bp, Mus musculus
tcttggtgagggtcctgacaactta

SEQ ID NO: 792374 - DNA, 25 bp, Mus musculus
tcttggtgccgcctgtattactcta

SEQ ID NO: 792375 - DNA, 25 bp, Mus musculus
tcttggtgccgcgtgtattactcta

SEQ ID NO: 792376 - DNA, 25 bp, Mus musculus
tcttggtgcctacggctttagttcc

SEQ ID NO: 792377 - DNA, 25 bp, Mus musculus
tcttggtgcctagggctttagttcc

SEQ ID NO: 792378 - DNA, 25 bp, Mus musculus
tcttggtgcgagagagcacgaccac

SEQ ID NO: 792379 - DNA, 25 bp, Mus musculus
tcttggtgcgagtgagcacgaccac

SEQ ID NO: 792380 - DNA, 25 bp, Mus musculus
tcttggtgctctccatttcactcct

SEQ ID NO: 792381 - DNA, 25 bp, Mus musculus
tcttggtgctctgcatttcactcct

SEQ ID NO: 792382 - DNA, 25 bp, Mus musculus
tcttggtggagaaaccctcgctgaa

SEQ ID NO: 792383 - DNA, 25 bp, Mus musculus
tcttggtggagaaccatcagtacgc

SEQ ID NO: 792384 - DNA, 25 bp, Mus musculus
tcttggtggagataccctcgctgaa

SEQ ID NO: 792385 - DNA, 25 bp, Mus musculus
tcttggtggagatccatcagtacgc

SEQ ID NO: 792386 - DNA, 25 bp, Mus musculus
tcttggtggcataagagacgctgaa

SEQ ID NO: 792387 - DNA, 25 bp, Mus musculus
tcttggtggcattagagacgctgaa

SEQ ID NO: 792388 - DNA, 25 bp, Mus musculus
tcttggtgggtgcacatgtatgctt

SEQ ID NO: 792389 - DNA, 25 bp, Mus musculus
tcttggtgggtggacatgtatgctt

SEQ ID NO: 792390 - DNA, 25 bp, Mus musculus
tcttggtggttcaatcgcgccctct

SEQ ID NO: 792391 - DNA, 25 bp, Mus musculus
tcttggtggttctatcgcgccctct

SEQ ID NO: 792392 - DNA, 25 bp, Mus musculus
tcttggtgtctcagcaggtgccagc

SEQ ID NO: 792393 - DNA, 25 bp, Mus musculus
tcttggtgtctctgcaggtgccagc

SEQ ID NO: 792394 - DNA, 25 bp, Mus musculus
tcttggtgtggacatggatgataaa

SEQ ID NO: 792395 - DNA, 25 bp, Mus musculus
tcttggtgtggagatggatgataaa

SEQ ID NO: 792396 - DNA, 25 bp, Mus musculus
tcttggttaggccagccgaagttag

SEQ ID NO: 792397 - DNA, 25 bp, Mus musculus
tcttggttaggcgagccgaagttag

SEQ ID NO: 792398 - DNA, 25 bp, Mus musculus
tcttggttccctcgcgtactctgag

SEQ ID NO: 792399 - DNA, 25 bp, Mus musculus
tcttggttccctggcgtactctgag

SEQ ID NO: 792400 - DNA, 25 bp, Mus musculus
tcttggttctagacagaagttggtt

SEQ ID NO: 792401 - DNA, 25 bp, Mus musculus
tcttggttctagtcagaagttggtt

SEQ ID NO: 792402 - DNA, 25 bp, Mus musculus
tcttggttctcgaggagcatctgtc

SEQ ID NO: 792403 - DNA, 25 bp, Mus musculus
tcttggttctcgtggagcatctgtc

SEQ ID NO: 792404 - DNA, 25 bp, Mus musculus
tcttggttgtagaacggccgtacca

SEQ ID NO: 792405 - DNA, 25 bp, Mus musculus
tcttggttgtagtacggccgtacca

SEQ ID NO: 792406 - DNA, 25 bp, Mus musculus
tcttggtttagtcagcaatgttctc

SEQ ID NO: 792407 - DNA, 25 bp, Mus musculus
tcttggtttagtgagcaatgttctc

SEQ ID NO: 792408 - DNA, 25 bp, Mus musculus
tcttggtttctcaactgcatggccc

SEQ ID NO: 792409 - DNA, 25 bp, Mus musculus
tcttggtttctctactgcatggccc

SEQ ID NO: 792410 - DNA, 25 bp, Mus musculus
tcttggttttcgacacagaagtggt

SEQ ID NO: 792411 - DNA, 25 bp, Mus musculus
tcttggttttcgtcacagaagtggt

SEQ ID NO: 792412 - DNA, 25 bp, Mus musculus
tcttgtaaaaatcgaacagttacct

SEQ ID NO: 792413 - DNA, 25 bp, Mus musculus
tcttgtaaaaatggaacagttacct

SEQ ID NO: 792414 - DNA, 25 bp, Mus musculus
tcttgtaaaagcagtaggagcctga

SEQ ID NO: 792415 - DNA, 25 bp, Mus musculus
tcttgtaaaagctgtaggagcctga

SEQ ID NO: 792416 - DNA, 25 bp, Mus musculus
tcttgtacagtgcaggccgtcaggt

SEQ ID NO: 792417 - DNA, 25 bp, Mus musculus
tcttgtacagtggaggccgtcaggt

SEQ ID NO: 792418 - DNA, 25 bp, Mus musculus
tcttgtacgagcaagagttgaatcc

SEQ ID NO: 792419 - DNA, 25 bp, Mus musculus
tcttgtacgagctagagttgaatcc

SEQ ID NO: 792420 - DNA, 25 bp, Mus musculus
tcttgtacgcggacgacactcccgg

SEQ ID NO: 792421 - DNA, 25 bp, Mus musculus
tcttgtacgcggtcgacactcccgg

SEQ ID NO: 792422 - DNA, 25 bp, Mus musculus
tcttgtatccggctggctgagctga

SEQ ID NO: 792423 - DNA, 25 bp, Mus musculus
tcttgtatccgggtggctgagctga

SEQ ID NO: 792424 - DNA, 25 bp, Mus musculus
tcttgtatctgacgaacgtgtccgc

SEQ ID NO: 792425 - DNA, 25 bp, Mus musculus
tcttgtatctgaggaacgtgtccgc

SEQ ID NO: 792426 - DNA, 25 bp, Mus musculus
tcttgtatctggagccctgtttgaa

SEQ ID NO: 792427 - DNA, 25 bp, Mus musculus
tcttgtatctggtgccctgtttgaa

SEQ ID NO: 792428 - DNA, 25 bp, Mus musculus
tcttgtatgccgagcaggacagcag

SEQ ID NO: 792429 - DNA, 25 bp, Mus musculus
tcttgtatgccgtgcaggacagcag

SEQ ID NO: 792430 - DNA, 25 bp, Mus musculus
tcttgtcaaaatcccaacctccagt

SEQ ID NO: 792431 - DNA, 25 bp, Mus musculus
tcttgtcaaaatgccaacctccagt

SEQ ID NO: 792432 - DNA, 25 bp, Mus musculus
tcttgtcagagtcgctaccagcagg

SEQ ID NO: 792433 - DNA, 25 bp, Mus musculus
tcttgtcagagtggctaccagcagg

SEQ ID NO: 792434 - DNA, 25 bp, Mus musculus
tcttgtcagtcaccaaagaataccg

SEQ ID NO: 792435 - DNA, 25 bp, Mus musculus
tcttgtcagtcagcaaagaataccg

SEQ ID NO: 792436 - DNA, 25 bp, Mus musculus
tcttgtcgcttcagttgttgggtgg

SEQ ID NO: 792437 - DNA, 25 bp, Mus musculus
tcttgtcgcttctgttgttgggtgg

SEQ ID NO: 792438 - DNA, 25 bp, Mus musculus
tcttgtcgtcttagctgggaaccga

SEQ ID NO: 792439 - DNA, 25 bp, Mus musculus
tcttgtcgtctttgctgggaaccga

SEQ ID NO: 792440 - DNA, 25 bp, Mus musculus
tcttgtcgttctcccgctctgtggc

SEQ ID NO: 792441 - DNA, 25 bp, Mus musculus
tcttgtcgttctgccgctctgtggc

SEQ ID NO: 792442 - DNA, 25 bp, Mus musculus
tcttgtctacatagtactctactta

SEQ ID NO: 792443 - DNA, 25 bp, Mus musculus
tcttgtctacattgtactctactta

SEQ ID NO: 792444 - DNA, 25 bp, Mus musculus
tcttgtctcagacagcagtagagat

SEQ ID NO: 792445 - DNA, 25 bp, Mus musculus
tcttgtctcagagagcagtagagat

SEQ ID NO: 792446 - DNA, 25 bp, Mus musculus
tcttgtctccctctatgagagccct

SEQ ID NO: 792447 - DNA, 25 bp, Mus musculus
tcttgtctccctgtatgagagccct

SEQ ID NO: 792448 - DNA, 25 bp, Mus musculus
tcttgtctcctgataaccctctttc

SEQ ID NO: 792449 - DNA, 25 bp, Mus musculus
tcttgtctcctgttaaccctctttc

SEQ ID NO: 792450 - DNA, 25 bp, Mus musculus
tcttgtctctctcaggacactgggt

SEQ ID NO: 792451 - DNA, 25 bp, Mus musculus
tcttgtctctctgaggacactgggt

SEQ ID NO: 792452 - DNA, 25 bp, Mus musculus
tcttgtgaagttatagaccaggtga

SEQ ID NO: 792453 - DNA, 25 bp, Mus musculus
tcttgtgaagttttagaccaggtga

SEQ ID NO: 792454 - DNA, 25 bp, Mus musculus
tcttgtgacaatagctgtaaaacaa

SEQ ID NO: 792455 - DNA, 25 bp, Mus musculus
tcttgtgacaattgctgtaaaacaa

SEQ ID NO: 792456 - DNA, 25 bp, Mus musculus
tcttgtgaccttcataagtatctgc

SEQ ID NO: 792457 - DNA, 25 bp, Mus musculus
tcttgtgaccttgataagtatctgc

SEQ ID NO: 792458 - DNA, 25 bp, Mus musculus
tcttgtgagcgcatccaggtgcctg

SEQ ID NO: 792459 - DNA, 25 bp, Mus musculus
tcttgtgagcgcttccaggtgcctg

SEQ ID NO: 792460 - DNA, 25 bp, Mus musculus
tcttgtgccctacacatgctaagtc

SEQ ID NO: 792461 - DNA, 25 bp, Mus musculus
tcttgtgccctagacatgctaagtc

SEQ ID NO: 792462 - DNA, 25 bp, Mus musculus
tcttgtgccggtctggtaatgaacc

SEQ ID NO: 792463 - DNA, 25 bp, Mus musculus
tcttgtgccggtgtggtaatgaacc

SEQ ID NO: 792464 - DNA, 25 bp, Mus musculus
tcttgtgcgcagctagccgcctcag

SEQ ID NO: 792465 - DNA, 25 bp, Mus musculus
tcttgtgcgcaggtagccgcctcag

SEQ ID NO: 792466 - DNA, 25 bp, Mus musculus
tcttgtgcgtcccagaggcaacaaa

SEQ ID NO: 792467 - DNA, 25 bp, Mus musculus
tcttgtgcgtccgagaggcaacaaa

SEQ ID NO: 792468 - DNA, 25 bp, Mus musculus
tcttgtgctaaacctgagccgccta

SEQ ID NO: 792469 - DNA, 25 bp, Mus musculus
tcttgtgctaaagctgagccgccta

SEQ ID NO: 792470 - DNA, 25 bp, Mus musculus
tcttgtgctgtaaagctgcctgggc

SEQ ID NO: 792471 - DNA, 25 bp, Mus musculus
tcttgtgctgtatagctgcctgggc

SEQ ID NO: 792472 - DNA, 25 bp, Mus musculus
tcttgtggaattaaaaagtacagtg

SEQ ID NO: 792473 - DNA, 25 bp, Mus musculus
tcttgtggaatttaaaagtacagtg

SEQ ID NO: 792474 - DNA, 25 bp, Mus musculus
tcttgtggatcaaggaaatgggaag

SEQ ID NO: 792475 - DNA, 25 bp, Mus musculus
tcttgtggatcatggaaatgggaag

SEQ ID NO: 792476 - DNA, 25 bp, Mus musculus
tcttgtggcctcagccgacctcaga

SEQ ID NO: 792477 - DNA, 25 bp, Mus musculus
tcttgtggcctctgccgacctcaga

SEQ ID NO: 792478 - DNA, 25 bp, Mus musculus
tcttgtggccttccaaaataggttg

SEQ ID NO: 792479 - DNA, 25 bp, Mus musculus
tcttgtggccttgcaaaataggttg

SEQ ID NO: 792480 - DNA, 25 bp, Mus musculus
tcttgtggctaccaacctgtttggc

SEQ ID NO: 792481 - DNA, 25 bp, Mus musculus
tcttgtggctacgaacctgtttggc

SEQ ID NO: 792482 - DNA, 25 bp, Mus musculus
tcttgtggtacaacatccctctggt

SEQ ID NO: 792483 - DNA, 25 bp, Mus musculus
tcttgtggtacatcatccctctggt

SEQ ID NO: 792484 - DNA, 25 bp, Mus musculus
tcttgtgtagtaccctggagtctgc

SEQ ID NO: 792485 - DNA, 25 bp, Mus musculus
tcttgtgtagtagcctggagtctgc

SEQ ID NO: 792486 - DNA, 25 bp, Mus musculus
tcttgtgtcatactgcctctattca

SEQ ID NO: 792487 - DNA, 25 bp, Mus musculus
tcttgtgtcatagtgcctctattca

SEQ ID NO: 792488 - DNA, 25 bp, Mus musculus
tcttgtgtcccgagccctggagctg

SEQ ID NO: 792489 - DNA, 25 bp, Mus musculus
tcttgtgtcccgtgccctggagctg

SEQ ID NO: 792490 - DNA, 25 bp, Mus musculus
tcttgtgtcgctaccggcaatgggc

SEQ ID NO: 792491 - DNA, 25 bp, Mus musculus
tcttgtgtcgcttccggcaatgggc

SEQ ID NO: 792492 - DNA, 25 bp, Mus musculus
tcttgtgtgaatagaggacagtaac

SEQ ID NO: 792493 - DNA, 25 bp, Mus musculus
tcttgtgtgaattgaggacagtaac

SEQ ID NO: 792494 - DNA, 25 bp, Mus musculus
tcttgtgtgattactgacatagcaa

SEQ ID NO: 792495 - DNA, 25 bp, Mus musculus
tcttgtgtgatttctgacatagcaa

SEQ ID NO: 792496 - DNA, 25 bp, Mus musculus
tcttgtgtggacatcatggctctag

SEQ ID NO: 792497 - DNA, 25 bp, Mus musculus
tcttgtgtggacttcatggctctag

SEQ ID NO: 792498 - DNA, 25 bp, Mus musculus
tcttgtgtgtttacccatgagcagg

SEQ ID NO: 792499 - DNA, 25 bp, Mus musculus
tcttgtgtgttttcccatgagcagg

SEQ ID NO: 792500 - DNA, 25 bp, Mus musculus
tcttgttagaccctcatcctgaagg

SEQ ID NO: 792501 - DNA, 25 bp, Mus musculus
tcttgttagaccgtcatcctgaagg

SEQ ID NO: 792502 - DNA, 25 bp, Mus musculus
tcttgttattgcaggctggacctcc

SEQ ID NO: 792503 - DNA, 25 bp, Mus musculus
tcttgttattgctggctggacctcc

SEQ ID NO: 792504 - DNA, 25 bp, Mus musculus
tcttgttcacaaccacagtctatgc

SEQ ID NO: 792505 - DNA, 25 bp, Mus musculus
tcttgttcacaagcacagtctatgc

SEQ ID NO: 792506 - DNA, 25 bp, Mus musculus
tcttgttcccagcttacagatgaag

SEQ ID NO: 792507 - DNA, 25 bp, Mus musculus
tcttgttcccaggttacagatgaag

SEQ ID NO: 792508 - DNA, 25 bp, Mus musculus
tcttgttccctaaaacagtcatttg

SEQ ID NO: 792509 - DNA, 25 bp, Mus musculus
tcttgttccctataacagtcatttg

SEQ ID NO: 792510 - DNA, 25 bp, Mus musculus
tcttgttcctggctactattctacc

SEQ ID NO: 792511 - DNA, 25 bp, Mus musculus
tcttgttcctgggtactattctacc

SEQ ID NO: 792512 - DNA, 25 bp, Mus musculus
tcttgttctctacattcagtgtagc

SEQ ID NO: 792513 - DNA, 25 bp, Mus musculus
tcttgttctctagattcagtgtagc

SEQ ID NO: 792514 - DNA, 25 bp, Mus musculus
tcttgttctgccatacagatcctgg

SEQ ID NO: 792515 - DNA, 25 bp, Mus musculus
tcttgttctgccttacagatcctgg

SEQ ID NO: 792516 - DNA, 25 bp, Mus musculus
tcttgttctgtcatgacctcttgta

SEQ ID NO: 792517 - DNA, 25 bp, Mus musculus
tcttgttctgtcttgacctcttgta

SEQ ID NO: 792518 - DNA, 25 bp, Mus musculus
tcttgttcttggagccacaaacatc

SEQ ID NO: 792519 - DNA, 25 bp, Mus musculus
tcttgttcttggtgccacaaacatc

SEQ ID NO: 792520 - DNA, 25 bp, Mus musculus
tcttgttgaagcaccaggccagcat

SEQ ID NO: 792521 - DNA, 25 bp, Mus musculus
tcttgttgaagctccaggccagcat

SEQ ID NO: 792522 - DNA, 25 bp, Mus musculus
tcttgttgaatgcaccccgagtctg

SEQ ID NO: 792523 - DNA, 25 bp, Mus musculus
tcttgttgaatggaccccgagtctg

SEQ ID NO: 792524 - DNA, 25 bp, Mus musculus
tcttgttgcagcatctggcagtgac

SEQ ID NO: 792525 - DNA, 25 bp, Mus musculus
tcttgttgcagcttctggcagtgac

SEQ ID NO: 792526 - DNA, 25 bp, Mus musculus
tcttgttgccagagtacccaggtag

SEQ ID NO: 792527 - DNA, 25 bp, Mus musculus
tcttgttgccagtgtacccaggtag

SEQ ID NO: 792528 - DNA, 25 bp, Mus musculus
tcttgttgctcacgtctcctgaacc

SEQ ID NO: 792529 - DNA, 25 bp, Mus musculus
tcttgttgctcaggtctcctgaacc

SEQ ID NO: 792530 - DNA, 25 bp, Mus musculus
tcttgttgggcgattagcgcatcgg

SEQ ID NO: 792531 - DNA, 25 bp, Mus musculus
tcttgttgggcgtttagcgcatcgg

SEQ ID NO: 792532 - DNA, 25 bp, Mus musculus
tcttgttgtgaacaagctacaagaa

SEQ ID NO: 792533 - DNA, 25 bp, Mus musculus
tcttgttgtgaagaagctacaagaa

SEQ ID NO: 792534 - DNA, 25 bp, Mus musculus
tcttgtttactgatgccgggagaca

SEQ ID NO: 792535 - DNA, 25 bp, Mus musculus
tcttgtttactgttgccgggagaca

SEQ ID NO: 792536 - DNA, 25 bp, Mus musculus
tcttgtttctgcattgtagttgtag

SEQ ID NO: 792537 - DNA, 25 bp, Mus musculus
tcttgtttctgctttgtagttgtag

SEQ ID NO: 792538 - DNA, 25 bp, Mus musculus
tcttgtttgagacccctgaacagag

SEQ ID NO: 792539 - DNA, 25 bp, Mus musculus
tcttgtttgagagccctgaacagag

SEQ ID NO: 792540 - DNA, 25 bp, Mus musculus
tcttgtttgccaacgtaggaggaat

SEQ ID NO: 792541 - DNA, 25 bp, Mus musculus
tcttgtttgccatcgtaggaggaat

SEQ ID NO: 792542 - DNA, 25 bp, Mus musculus
tcttgtttgctccaggcagcgagga

SEQ ID NO: 792543 - DNA, 25 bp, Mus musculus
tcttgtttgctcgaggcagcgagga

SEQ ID NO: 792544 - DNA, 25 bp, Mus musculus
tcttgttttgaacccatgacaatgc

SEQ ID NO: 792545 - DNA, 25 bp, Mus musculus
tcttgttttgaagccatgacaatgc

SEQ ID NO: 792546 - DNA, 25 bp, Mus musculus
tcttgtttttcacgtctcttccact

SEQ ID NO: 792547 - DNA, 25 bp, Mus musculus
tcttgtttttcaggtctcttccact

SEQ ID NO: 792548 - DNA, 25 bp, Mus musculus
tctttaaaaaccaagatccggtgct

SEQ ID NO: 792549 - DNA, 25 bp, Mus musculus
tctttaaaaacctagatccggtgct

SEQ ID NO: 792550 - DNA, 25 bp, Mus musculus
tctttaaaaagtctagatgtgccca

SEQ ID NO: 792551 - DNA, 25 bp, Mus musculus
tctttaaaaagtgtagatgtgccca

SEQ ID NO: 792552 - DNA, 25 bp, Mus musculus
tctttaaaaataaggcaaccaggcc

SEQ ID NO: 792553 - DNA, 25 bp, Mus musculus
tctttaaaaatatggcaaccaggcc

SEQ ID NO: 792554 - DNA, 25 bp, Mus musculus
tctttaaagcgtacgggacagataa

SEQ ID NO: 792555 - DNA, 25 bp, Mus musculus
tctttaaagcgttcgggacagataa

SEQ ID NO: 792556 - DNA, 25 bp, Mus musculus
tctttaaatttgcaaggacatctcc

SEQ ID NO: 792557 - DNA, 25 bp, Mus musculus
tctttaaatttggaaggacatctcc

SEQ ID NO: 792558 - DNA, 25 bp, Mus musculus
tctttaacagtcagaggcagcccaa

SEQ ID NO: 792559 - DNA, 25 bp, Mus musculus
tctttaacagtctgaggcagcccaa

SEQ ID NO: 792560 - DNA, 25 bp, Mus musculus
tctttaaccagaattattcttgcag

SEQ ID NO: 792561 - DNA, 25 bp, Mus musculus
tctttaaccagatttattcttgcag

SEQ ID NO: 792562 - DNA, 25 bp, Mus musculus
tctttaacgggcatcctcgaggaca

SEQ ID NO: 792563 - DNA, 25 bp, Mus musculus
tctttaacgggcttcctcgaggaca

SEQ ID NO: 792564 - DNA, 25 bp, Mus musculus
tctttaagaatcacatgtaccccag

SEQ ID NO: 792565 - DNA, 25 bp, Mus musculus
tctttaagaatctcatgtaccccag

SEQ ID NO: 792566 - DNA, 25 bp, Mus musculus
tctttaagaccaccctcccaaggag

SEQ ID NO: 792567 - DNA, 25 bp, Mus musculus
tctttaagaccagcctcccaaggag

SEQ ID NO: 792568 - DNA, 25 bp, Mus musculus
tctttaagatttccatgtgagggct

SEQ ID NO: 792569 - DNA, 25 bp, Mus musculus
tctttaagatttgcatgtgagggct

SEQ ID NO: 792570 - DNA, 25 bp, Mus musculus
tctttaagcaacagtgcggttgtga

SEQ ID NO: 792571 - DNA, 25 bp, Mus musculus
tctttaagcaactgtgcggttgtga

SEQ ID NO: 792572 - DNA, 25 bp, Mus musculus
tctttaagcgaaaccgcaagcgaga

SEQ ID NO: 792573 - DNA, 25 bp, Mus musculus
tctttaagcgaatccgcaagcgaga

SEQ ID NO: 792574 - DNA, 25 bp, Mus musculus
tctttaagcgcgattggctggcccg

SEQ ID NO: 792575 - DNA, 25 bp, Mus musculus
tctttaagcgcgtttggctggcccg

SEQ ID NO: 792576 - DNA, 25 bp, Mus musculus
tctttaaggcttcaggcagcacaca

SEQ ID NO: 792577 - DNA, 25 bp, Mus musculus
tctttaaggcttgaggcagcacaca

SEQ ID NO: 792578 - DNA, 25 bp, Mus musculus
tctttaagggtaaatttgttcatcg

SEQ ID NO: 792579 - DNA, 25 bp, Mus musculus
tctttaagggtatatttgttcatcg

SEQ ID NO: 792580 - DNA, 25 bp, Mus musculus
tctttaagtgcacagtggatgttcc

SEQ ID NO: 792581 - DNA, 25 bp, Mus musculus
tctttaagtgcagagtggatgttcc

SEQ ID NO: 792582 - DNA, 25 bp, Mus musculus
tctttaataagtaataaggtctatg

SEQ ID NO: 792583 - DNA, 25 bp, Mus musculus
tctttaataagttataaggtctatg

SEQ ID NO: 792584 - DNA, 25 bp, Mus musculus
tctttaatcattcggacagctcaat

SEQ ID NO: 792585 - DNA, 25 bp, Mus musculus
tctttaatcattgggacagctcaat

SEQ ID NO: 792586 - DNA, 25 bp, Mus musculus
tctttaatgattccattgtggaccc

SEQ ID NO: 792587 - DNA, 25 bp, Mus musculus
tctttaatgattgcattgtggaccc

SEQ ID NO: 792588 - DNA, 25 bp, Mus musculus
tctttaatgcgacaggaagcgatgc

SEQ ID NO: 792589 - DNA, 25 bp, Mus musculus
tctttaatgcgagaggaagcgatgc

SEQ ID NO: 792590 - DNA, 25 bp, Mus musculus
tctttaattagtctgggagctgaac

SEQ ID NO: 792591 - DNA, 25 bp, Mus musculus
tctttaattagtgtgggagctgaac

SEQ ID NO: 792592 - DNA, 25 bp, Mus musculus
tctttacacgggatgcttgtgccct

SEQ ID NO: 792593 - DNA, 25 bp, Mus musculus
tctttacacgggttgcttgtgccct

SEQ ID NO: 792594 - DNA, 25 bp, Mus musculus
tctttacagctaatttccctaggtc

SEQ ID NO: 792595 - DNA, 25 bp, Mus musculus
tctttacagctattttccctaggtc

SEQ ID NO: 792596 - DNA, 25 bp, Mus musculus
tctttacaggttcctgtcacctcca

SEQ ID NO: 792597 - DNA, 25 bp, Mus musculus
tctttacaggttgctgtcacctcca

SEQ ID NO: 792598 - DNA, 25 bp, Mus musculus
tctttaccaaccagtatgggcgcca

SEQ ID NO: 792599 - DNA, 25 bp, Mus musculus
tctttaccaacctgtatgggcgcca

SEQ ID NO: 792600 - DNA, 25 bp, Mus musculus
tctttaccacctagggactgcttta

SEQ ID NO: 792601 - DNA, 25 bp, Mus musculus
tctttaccaccttgggactgcttta

SEQ ID NO: 792602 - DNA, 25 bp, Mus musculus
tctttaccagctaccagtacatgga

SEQ ID NO: 792603 - DNA, 25 bp, Mus musculus
tctttaccagcttccagtacatgga

SEQ ID NO: 792604 - DNA, 25 bp, Mus musculus
tctttacccaccagagacaggcctg

SEQ ID NO: 792605 - DNA, 25 bp, Mus musculus
tctttacccacctgagacaggcctg

SEQ ID NO: 792606 - DNA, 25 bp, Mus musculus
tctttacccagaagcgccatgatgc

SEQ ID NO: 792607 - DNA, 25 bp, Mus musculus
tctttacccagatgcgccatgatgc

SEQ ID NO: 792608 - DNA, 25 bp, Mus musculus
tctttacccgggatgagtggaagaa

SEQ ID NO: 792609 - DNA, 25 bp, Mus musculus
tctttacccgggttgagtggaagaa

SEQ ID NO: 792610 - DNA, 25 bp, Mus musculus
tctttacccgttcaagagaagaacg

SEQ ID NO: 792611 - DNA, 25 bp, Mus musculus
tctttacccgttgaagagaagaacg

SEQ ID NO: 792612 - DNA, 25 bp, Mus musculus
tctttaccctggacattctgtattc

SEQ ID NO: 792613 - DNA, 25 bp, Mus musculus
tctttaccctggtcattctgtattc

SEQ ID NO: 792614 - DNA, 25 bp, Mus musculus
tctttacctgagagacagccaatgg

SEQ ID NO: 792615 - DNA, 25 bp, Mus musculus
tctttacctgagtgacagccaatgg

SEQ ID NO: 792616 - DNA, 25 bp, Mus musculus
tctttaccttctcgatcatgctacc

SEQ ID NO: 792617 - DNA, 25 bp, Mus musculus
tctttaccttctggatcatgctacc

SEQ ID NO: 792618 - DNA, 25 bp, Mus musculus
tctttactgtgcaactggatgacta

SEQ ID NO: 792619 - DNA, 25 bp, Mus musculus
tctttactgtgctactggatgacta

SEQ ID NO: 792620 - DNA, 25 bp, Mus musculus
tctttagatcctaagtgcgagtagg

SEQ ID NO: 792621 - DNA, 25 bp, Mus musculus
tctttagatccttagtgcgagtagg

SEQ ID NO: 792622 - DNA, 25 bp, Mus musculus
tctttagccagaatggaccttgtaa

SEQ ID NO: 792623 - DNA, 25 bp, Mus musculus
tctttagccagattggaccttgtaa

SEQ ID NO: 792624 - DNA, 25 bp, Mus musculus
tctttagccctgagccattaaacag

SEQ ID NO: 792625 - DNA, 25 bp, Mus musculus
tctttagccctgtgccattaaacag

SEQ ID NO: 792626 - DNA, 25 bp, Mus musculus
tctttagccggtcggtgatccgaag

SEQ ID NO: 792627 - DNA, 25 bp, Mus musculus
tctttagccggtgggtgatccgaag

SEQ ID NO: 792628 - DNA, 25 bp, Mus musculus
tctttagggtacacctgacgtccgc

SEQ ID NO: 792629 - DNA, 25 bp, Mus musculus
tctttagggtactcctgacgtccgc

SEQ ID NO: 792630 - DNA, 25 bp, Mus musculus
tctttagttaaacaactcctggatt

SEQ ID NO: 792631 - DNA, 25 bp, Mus musculus
tctttagttaaagaactcctggatt

SEQ ID NO: 792632 - DNA, 25 bp, Mus musculus
tctttataagggaccaggttcccag

SEQ ID NO: 792633 - DNA, 25 bp, Mus musculus
tctttataagggtccaggttcccag

SEQ ID NO: 792634 - DNA, 25 bp, Mus musculus
tctttatatggacgagttgattcac

SEQ ID NO: 792635 - DNA, 25 bp, Mus musculus
tctttatatggaggagttgattcac

SEQ ID NO: 792636 - DNA, 25 bp, Mus musculus
tctttatcaacaacatccgggtgct

SEQ ID NO: 792637 - DNA, 25 bp, Mus musculus
tctttatcaacatcatccgggtgct

SEQ ID NO: 792638 - DNA, 25 bp, Mus musculus
tctttatccagtcaaatacaaagct

SEQ ID NO: 792639 - DNA, 25 bp, Mus musculus
tctttatccagtgaaatacaaagct

SEQ ID NO: 792640 - DNA, 25 bp, Mus musculus
tctttatcccttctagatccttcca

SEQ ID NO: 792641 - DNA, 25 bp, Mus musculus
tctttatcccttgtagatccttcca

SEQ ID NO: 792642 - DNA, 25 bp, Mus musculus
tctttatctcttaagcattcggagg

SEQ ID NO: 792643 - DNA, 25 bp, Mus musculus
tctttatctctttagcattcggagg

SEQ ID NO: 792644 - DNA, 25 bp, Mus musculus
tctttatcttgcactgtgaggaagc

SEQ ID NO: 792645 - DNA, 25 bp, Mus musculus
tctttatcttgctctgtgaggaagc

SEQ ID NO: 792646 - DNA, 25 bp, Mus musculus
tctttatgacttcctgcctcgggag

SEQ ID NO: 792647 - DNA, 25 bp, Mus musculus
tctttatgacttgctgcctcgggag

SEQ ID NO: 792648 - DNA, 25 bp, Mus musculus
tctttatgattcatggccgataccc

SEQ ID NO: 792649 - DNA, 25 bp, Mus musculus
tctttatgattcttggccgataccc

SEQ ID NO: 792650 - DNA, 25 bp, Mus musculus
tctttatgccgacgttagtggaaaa

SEQ ID NO: 792651 - DNA, 25 bp, Mus musculus
tctttatgccgaggttagtggaaaa

SEQ ID NO: 792652 - DNA, 25 bp, Mus musculus
tctttatgctggaataatgctgacc

SEQ ID NO: 792653 - DNA, 25 bp, Mus musculus
tctttatgctggagggagtcagctc

SEQ ID NO: 792654 - DNA, 25 bp, Mus musculus
tctttatgctggtataatgctgacc

SEQ ID NO: 792655 - DNA, 25 bp, Mus musculus
tctttatgctggtgggagtcagctc

SEQ ID NO: 792656 - DNA, 25 bp, Mus musculus
tctttatgtctgctagtgggcttca

SEQ ID NO: 792657 - DNA, 25 bp, Mus musculus
tctttatgtctggtagtgggcttca

SEQ ID NO: 792658 - DNA, 25 bp, Mus musculus
tctttattctacatgttggtggagt

SEQ ID NO: 792659 - DNA, 25 bp, Mus musculus
tctttattctacttgttggtggagt

SEQ ID NO: 792660 - DNA, 25 bp, Mus musculus
tctttattgagcagaatcaggcaga

SEQ ID NO: 792661 - DNA, 25 bp, Mus musculus
tctttattgagctgaatcaggcaga

SEQ ID NO: 792662 - DNA, 25 bp, Mus musculus
tctttattggtgaatcatcagctaa

SEQ ID NO: 792663 - DNA, 25 bp, Mus musculus
tctttattggtgtatcatcagctaa

SEQ ID NO: 792664 - DNA, 25 bp, Mus musculus
tctttatttatgcacacactgccag

SEQ ID NO: 792665 - DNA, 25 bp, Mus musculus
tctttatttatggacacactgccag

SEQ ID NO: 792666 - DNA, 25 bp, Mus musculus
tctttatttttaccagggggctgtc

SEQ ID NO: 792667 - DNA, 25 bp, Mus musculus
tctttatttttagcagggggctgtc

SEQ ID NO: 792668 - DNA, 25 bp, Mus musculus
tctttcaaaaagagccccgccttca

SEQ ID NO: 792669 - DNA, 25 bp, Mus musculus
tctttcaaaaagtgccccgccttca

SEQ ID NO: 792670 - DNA, 25 bp, Mus musculus
tctttcaacactaggcctggctctg

SEQ ID NO: 792671 - DNA, 25 bp, Mus musculus
tctttcaacacttggcctggctctg

SEQ ID NO: 792672 - DNA, 25 bp, Mus musculus
tctttcaacgacaagaagtttgtca

SEQ ID NO: 792673 - DNA, 25 bp, Mus musculus
tctttcaacgactagaagtttgtca

SEQ ID NO: 792674 - DNA, 25 bp, Mus musculus
tctttcaacgccactatctctgtgg

SEQ ID NO: 792675 - DNA, 25 bp, Mus musculus
tctttcaacgcctctatctctgtgg

SEQ ID NO: 792676 - DNA, 25 bp, Mus musculus
tctttcaagccaagtcgctgggact

SEQ ID NO: 792677 - DNA, 25 bp, Mus musculus
tctttcaagccatgtcgctgggact

SEQ ID NO: 792678 - DNA, 25 bp, Mus musculus
tctttcaaggcacaacagtctgctg

SEQ ID NO: 792679 - DNA, 25 bp, Mus musculus
tctttcaaggcagaacagtctgctg

SEQ ID NO: 792680 - DNA, 25 bp, Mus musculus
tctttcacaaatagatgttgcacag

SEQ ID NO: 792681 - DNA, 25 bp, Mus musculus
tctttcacaaattgatgttgcacag

SEQ ID NO: 792682 - DNA, 25 bp, Mus musculus
tctttcacaagacaagaggtgagac

SEQ ID NO: 792683 - DNA, 25 bp, Mus musculus
tctttcacaagagaagaggtgagac

SEQ ID NO: 792684 - DNA, 25 bp, Mus musculus
tctttcacgaggatggcgaatgctg

SEQ ID NO: 792685 - DNA, 25 bp, Mus musculus
tctttcacgaggttggcgaatgctg

SEQ ID NO: 792686 - DNA, 25 bp, Mus musculus
tctttcagagtgcaacgggcagaac

SEQ ID NO: 792687 - DNA, 25 bp, Mus musculus
tctttcagagtggaacgggcagaac

SEQ ID NO: 792688 - DNA, 25 bp, Mus musculus
tctttcagatgacggtattaggctc

SEQ ID NO: 792689 - DNA, 25 bp, Mus musculus
tctttcagatgagggtattaggctc

SEQ ID NO: 792690 - DNA, 25 bp, Mus musculus
tctttcagatggaaatgattgttcg

SEQ ID NO: 792691 - DNA, 25 bp, Mus musculus
tctttcagatggtaatgattgttcg

SEQ ID NO: 792692 - DNA, 25 bp, Mus musculus
tctttcaggaacagaattgggaccc

SEQ ID NO: 792693 - DNA, 25 bp, Mus musculus
tctttcaggaactgaattgggaccc

SEQ ID NO: 792694 - DNA, 25 bp, Mus musculus
tctttcataaccaggcaatgctgtg

SEQ ID NO: 792695 - DNA, 25 bp, Mus musculus
tctttcataacctggcaatgctgtg

SEQ ID NO: 792696 - DNA, 25 bp, Mus musculus
tctttcatgaccaaaaccgtgcctt

SEQ ID NO: 792697 - DNA, 25 bp, Mus musculus
tctttcatgacctaaaccgtgcctt

SEQ ID NO: 792698 - DNA, 25 bp, Mus musculus
tctttccaaaagagaccctgcaaac

SEQ ID NO: 792699 - DNA, 25 bp, Mus musculus
tctttccaaaagtgaccctgcaaac

SEQ ID NO: 792700 - DNA, 25 bp, Mus musculus
tctttccaaaccaacaggaattggt

SEQ ID NO: 792701 - DNA, 25 bp, Mus musculus
tctttccaaacctacaggaattggt

SEQ ID NO: 792702 - DNA, 25 bp, Mus musculus
tctttccaacatccttcgagatgat

SEQ ID NO: 792703 - DNA, 25 bp, Mus musculus
tctttccaacatgcttcgagatgat

SEQ ID NO: 792704 - DNA, 25 bp, Mus musculus
tctttccaaccactcttgatggaga

SEQ ID NO: 792705 - DNA, 25 bp, Mus musculus
tctttccaaccagtcttgatggaga

SEQ ID NO: 792706 - DNA, 25 bp, Mus musculus
tctttccaccgcagaagcaaatgaa

SEQ ID NO: 792707 - DNA, 25 bp, Mus musculus
tctttccaccgctgaagcaaatgaa

SEQ ID NO: 792708 - DNA, 25 bp, Mus musculus
tctttccagaacatcagttgcaatc

SEQ ID NO: 792709 - DNA, 25 bp, Mus musculus
tctttccagaacttcagttgcaatc

SEQ ID NO: 792710 - DNA, 25 bp, Mus musculus
tctttcccaaatcaactctatgttc

SEQ ID NO: 792711 - DNA, 25 bp, Mus musculus
tctttcccaaatgaactctatgttc

SEQ ID NO: 792712 - DNA, 25 bp, Mus musculus
tctttcccaatccaaacaagtttga

SEQ ID NO: 792713 - DNA, 25 bp, Mus musculus
tctttcccaatcgaaacaagtttga

SEQ ID NO: 792714 - DNA, 25 bp, Mus musculus
tctttcccaatgatgcacttctgcc

SEQ ID NO: 792715 - DNA, 25 bp, Mus musculus
tctttcccaatgttgcacttctgcc

SEQ ID NO: 792716 - DNA, 25 bp, Mus musculus
tctttcccaggacagtgcatccggc

SEQ ID NO: 792717 - DNA, 25 bp, Mus musculus
tctttcccaggagagtgcatccggc

SEQ ID NO: 792718 - DNA, 25 bp, Mus musculus
tctttcccagtgctgaccaggtact

SEQ ID NO: 792719 - DNA, 25 bp, Mus musculus
tctttcccagtggtgaccaggtact

SEQ ID NO: 792720 - DNA, 25 bp, Mus musculus
tctttccctggcagcagtgtgagaa

SEQ ID NO: 792721 - DNA, 25 bp, Mus musculus
tctttccctggctgcagtgtgagaa

SEQ ID NO: 792722 - DNA, 25 bp, Mus musculus
tctttcccttgactccgctggacaa

SEQ ID NO: 792723 - DNA, 25 bp, Mus musculus
tctttcccttgagtccgctggacaa

SEQ ID NO: 792724 - DNA, 25 bp, Mus musculus
tctttccgcgttctggatcaacagc

SEQ ID NO: 792725 - DNA, 25 bp, Mus musculus
tctttccgcgttgtggatcaacagc

SEQ ID NO: 792726 - DNA, 25 bp, Mus musculus
tctttccggcagcttctccatggtg

SEQ ID NO: 792727 - DNA, 25 bp, Mus musculus
tctttccggcaggttctccatggtg

SEQ ID NO: 792728 - DNA, 25 bp, Mus musculus
tctttcctagaaagctacttcattc

SEQ ID NO: 792729 - DNA, 25 bp, Mus musculus
tctttcctagaatgctacttcattc

SEQ ID NO: 792730 - DNA, 25 bp, Mus musculus
tctttcctgattctggcaatttcaa

SEQ ID NO: 792731 - DNA, 25 bp, Mus musculus
tctttcctgattgtggcaatttcaa

SEQ ID NO: 792732 - DNA, 25 bp, Mus musculus
tctttcctgcatagtgctgtttggg

SEQ ID NO: 792733 - DNA, 25 bp, Mus musculus
tctttcctgcattgtgctgtttggg

SEQ ID NO: 792734 - DNA, 25 bp, Mus musculus
tctttcctgccccattctgggaggt

SEQ ID NO: 792735 - DNA, 25 bp, Mus musculus
tctttcctgcccgattctgggaggt

SEQ ID NO: 792736 - DNA, 25 bp, Mus musculus
tctttcctggataacggaagcagaa

SEQ ID NO: 792737 - DNA, 25 bp, Mus musculus
tctttcctggattacggaagcagaa

SEQ ID NO: 792738 - DNA, 25 bp, Mus musculus
tctttcgaggaacgccaatggcaca

SEQ ID NO: 792739 - DNA, 25 bp, Mus musculus
tctttcgaggaaggccaatggcaca

SEQ ID NO: 792740 - DNA, 25 bp, Mus musculus
tctttcgcaaccatggtgaagttgg

SEQ ID NO: 792741 - DNA, 25 bp, Mus musculus
tctttcgcaaccttggtgaagttgg

SEQ ID NO: 792742 - DNA, 25 bp, Mus musculus
tctttcggagcacctggtgaaacag

SEQ ID NO: 792743 - DNA, 25 bp, Mus musculus
tctttcggagcagctggtgaaacag

SEQ ID NO: 792744 - DNA, 25 bp, Mus musculus
tctttcggcataaggctgttgtgct

SEQ ID NO: 792745 - DNA, 25 bp, Mus musculus
tctttcggcatatggctgttgtgct

SEQ ID NO: 792746 - DNA, 25 bp, Mus musculus
tctttcgtccggaagtcttcggcca

SEQ ID NO: 792747 - DNA, 25 bp, Mus musculus
tctttcgtccggtagtcttcggcca

SEQ ID NO: 792748 - DNA, 25 bp, Mus musculus
tctttctacctcatgtcatctgcca

SEQ ID NO: 792749 - DNA, 25 bp, Mus musculus
tctttctacctcttgtcatctgcca

SEQ ID NO: 792750 - DNA, 25 bp, Mus musculus
tctttctattctacagcatctcctg

SEQ ID NO: 792751 - DNA, 25 bp, Mus musculus
tctttctattcttcagcatctcctg

SEQ ID NO: 792752 - DNA, 25 bp, Mus musculus
tctttctcactgaggaactggagtc

SEQ ID NO: 792753 - DNA, 25 bp, Mus musculus
tctttctcactgtggaactggagtc

SEQ ID NO: 792754 - DNA, 25 bp, Mus musculus
tctttctcatcaacagcgtgttagc

SEQ ID NO: 792755 - DNA, 25 bp, Mus musculus
tctttctcatcatcagcgtgttagc

SEQ ID NO: 792756 - DNA, 25 bp, Mus musculus
tctttctccacgctcagaaagtgga

SEQ ID NO: 792757 - DNA, 25 bp, Mus musculus
tctttctccacggtcagaaagtgga

SEQ ID NO: 792758 - DNA, 25 bp, Mus musculus
tctttctcctccattccacgtgtgg

SEQ ID NO: 792759 - DNA, 25 bp, Mus musculus
tctttctcctcctttccacgtgtgg

SEQ ID NO: 792760 - DNA, 25 bp, Mus musculus
tctttctcctgccagggaggacatg

SEQ ID NO: 792761 - DNA, 25 bp, Mus musculus
tctttctcctgcgagggaggacatg

SEQ ID NO: 792762 - DNA, 25 bp, Mus musculus
tctttctcgtccagtgaagtacatg

SEQ ID NO: 792763 - DNA, 25 bp, Mus musculus
tctttctcgtcctgtgaagtacatg

SEQ ID NO: 792764 - DNA, 25 bp, Mus musculus
tctttctcgtctagtcagggtctga

SEQ ID NO: 792765 - DNA, 25 bp, Mus musculus
tctttctcgtcttgtcagggtctga

SEQ ID NO: 792766 - DNA, 25 bp, Mus musculus
tctttctgaaacccagcactgcctt

SEQ ID NO: 792767 - DNA, 25 bp, Mus musculus
tctttctgaaacgcagcactgcctt

SEQ ID NO: 792768 - DNA, 25 bp, Mus musculus
tctttctgaagtagcatccggagaa

SEQ ID NO: 792769 - DNA, 25 bp, Mus musculus
tctttctgaagttgcatccggagaa

SEQ ID NO: 792770 - DNA, 25 bp, Mus musculus
tctttctgaggaagcctgttgttcc

SEQ ID NO: 792771 - DNA, 25 bp, Mus musculus
tctttctgaggatgcctgttgttcc

SEQ ID NO: 792772 - DNA, 25 bp, Mus musculus
tctttctgcaggaaccgacccttga

SEQ ID NO: 792773 - DNA, 25 bp, Mus musculus
tctttctgcaggtaccgacccttga

SEQ ID NO: 792774 - DNA, 25 bp, Mus musculus
tctttctgcagtccggtggtgctac

SEQ ID NO: 792775 - DNA, 25 bp, Mus musculus
tctttctgcagtgcggtggtgctac

SEQ ID NO: 792776 - DNA, 25 bp, Mus musculus
tctttctgccccacagggactctga

SEQ ID NO: 792777 - DNA, 25 bp, Mus musculus
tctttctgcccctcagggactctga

SEQ ID NO: 792778 - DNA, 25 bp, Mus musculus
tctttctgcgtaaatgctggtggag

SEQ ID NO: 792779 - DNA, 25 bp, Mus musculus
tctttctgcgtatatgctggtggag

SEQ ID NO: 792780 - DNA, 25 bp, Mus musculus
tctttctggaccagggtaggacccg

SEQ ID NO: 792781 - DNA, 25 bp, Mus musculus
tctttctggacctgggtaggacccg

SEQ ID NO: 792782 - DNA, 25 bp, Mus musculus
tctttctggccaccaagacgtcgtg

SEQ ID NO: 792783 - DNA, 25 bp, Mus musculus
tctttctggccagcaagacgtcgtg

SEQ ID NO: 792784 - DNA, 25 bp, Mus musculus
tctttctggcttatggacgctcttg

SEQ ID NO: 792785 - DNA, 25 bp, Mus musculus
tctttctggcttttggacgctcttg

SEQ ID NO: 792786 - DNA, 25 bp, Mus musculus
tctttctgtgaccatgccgtgattg

SEQ ID NO: 792787 - DNA, 25 bp, Mus musculus
tctttctgtgacgatgccgtgattg

SEQ ID NO: 792788 - DNA, 25 bp, Mus musculus
tctttctgtggaacctggagtcatg

SEQ ID NO: 792789 - DNA, 25 bp, Mus musculus
tctttctgtggaccatgcggtccta

SEQ ID NO: 792790 - DNA, 25 bp, Mus musculus
tctttctgtggagcatgcggtccta

SEQ ID NO: 792791 - DNA, 25 bp, Mus musculus
tctttctgtggatcctggagtcatg

SEQ ID NO: 792792 - DNA, 25 bp, Mus musculus
tctttcttagaccagctcacctgcg

SEQ ID NO: 792793 - DNA, 25 bp, Mus musculus
tctttcttagacgagctcacctgcg

SEQ ID NO: 792794 - DNA, 25 bp, Mus musculus
tctttcttcgggaggttggtccctg

SEQ ID NO: 792795 - DNA, 25 bp, Mus musculus
tctttcttcgggtggttggtccctg

SEQ ID NO: 792796 - DNA, 25 bp, Mus musculus
tctttcttctccagcgatgagtcat

SEQ ID NO: 792797 - DNA, 25 bp, Mus musculus
tctttcttctcctgcgatgagtcat

SEQ ID NO: 792798 - DNA, 25 bp, Mus musculus
tctttcttgattctggaggactggc

SEQ ID NO: 792799 - DNA, 25 bp, Mus musculus
tctttcttgattgtggaggactggc

SEQ ID NO: 792800 - DNA, 25 bp, Mus musculus
tctttcttggttcacggagtgaagt

SEQ ID NO: 792801 - DNA, 25 bp, Mus musculus
tctttcttggttgacggagtgaagt

SEQ ID NO: 792802 - DNA, 25 bp, Mus musculus
tctttcttgttcagtgaccgaggga

SEQ ID NO: 792803 - DNA, 25 bp, Mus musculus
tctttcttgttctgtgaccgaggga

SEQ ID NO: 792804 - DNA, 25 bp, Mus musculus
tctttgaaagagcaacaaaatggct

SEQ ID NO: 792805 - DNA, 25 bp, Mus musculus
tctttgaaagaggaacaaaatggct

SEQ ID NO: 792806 - DNA, 25 bp, Mus musculus
tctttgaaatggatagcagtccgag

SEQ ID NO: 792807 - DNA, 25 bp, Mus musculus
tctttgaaatggttagcagtccgag

SEQ ID NO: 792808 - DNA, 25 bp, Mus musculus
tctttgaacagtctgagtggcagcc

SEQ ID NO: 792809 - DNA, 25 bp, Mus musculus
tctttgaacagtgtgagtggcagcc

SEQ ID NO: 792810 - DNA, 25 bp, Mus musculus
tctttgaacgttcttccagcaaacg

SEQ ID NO: 792811 - DNA, 25 bp, Mus musculus
tctttgaacgttgttccagcaaacg

SEQ ID NO: 792812 - DNA, 25 bp, Mus musculus
tctttgaactcactgacctcgtgga

SEQ ID NO: 792813 - DNA, 25 bp, Mus musculus
tctttgaactcagtgacctcgtgga

SEQ ID NO: 792814 - DNA, 25 bp, Mus musculus
tctttgaactccacccagccaaaaa

SEQ ID NO: 792815 - DNA, 25 bp, Mus musculus
tctttgaactcctcccagccaaaaa

SEQ ID NO: 792816 - DNA, 25 bp, Mus musculus
tctttgaactggaagtttctgggaa

SEQ ID NO: 792817 - DNA, 25 bp, Mus musculus
tctttgaactggtagtttctgggaa

SEQ ID NO: 792818 - DNA, 25 bp, Mus musculus
tctttgaagagaagattgaacctta

SEQ ID NO: 792819 - DNA, 25 bp, Mus musculus
tctttgaagagatgattgaacctta

SEQ ID NO: 792820 - DNA, 25 bp, Mus musculus
tctttgaagagcacctaaccccaga

SEQ ID NO: 792821 - DNA, 25 bp, Mus musculus
tctttgaagagctcctaaccccaga

SEQ ID NO: 792822 - DNA, 25 bp, Mus musculus
tctttgaagatgagatgatgtcatc

SEQ ID NO: 792823 - DNA, 25 bp, Mus musculus
tctttgaagatgtgatgatgtcatc

SEQ ID NO: 792824 - DNA, 25 bp, Mus musculus
tctttgaatccacaagctggcaaac

SEQ ID NO: 792825 - DNA, 25 bp, Mus musculus
tctttgaatccagaagctggcaaac

SEQ ID NO: 792826 - DNA, 25 bp, Mus musculus
tctttgaattaactggactgtggca

SEQ ID NO: 792827 - DNA, 25 bp, Mus musculus
tctttgaattaagtggactgtggca

SEQ ID NO: 792828 - DNA, 25 bp, Mus musculus
tctttgacagagcacaaaggtgtgg

SEQ ID NO: 792829 - DNA, 25 bp, Mus musculus
tctttgacagaggacaaaggtgtgg

SEQ ID NO: 792830 - DNA, 25 bp, Mus musculus
tctttgaccaagagtagtgttcgga

SEQ ID NO: 792831 - DNA, 25 bp, Mus musculus
tctttgaccaagtgtagtgttcgga

SEQ ID NO: 792832 - DNA, 25 bp, Mus musculus
tctttgaccaccctgggaaaggtca

SEQ ID NO: 792833 - DNA, 25 bp, Mus musculus
tctttgaccaccgtgggaaaggtca

SEQ ID NO: 792834 - DNA, 25 bp, Mus musculus
tctttgactcggcagcagaagtttg

SEQ ID NO: 792835 - DNA, 25 bp, Mus musculus
tctttgactcgggagcagaagtttg

SEQ ID NO: 792836 - DNA, 25 bp, Mus musculus
tctttgactggcaaggccggagcct

SEQ ID NO: 792837 - DNA, 25 bp, Mus musculus
tctttgactggctaggccggagcct

SEQ ID NO: 792838 - DNA, 25 bp, Mus musculus
tctttgactggtaccatatcatcgt

SEQ ID NO: 792839 - DNA, 25 bp, Mus musculus
tctttgactggttccatatcatcgt

SEQ ID NO: 792840 - DNA, 25 bp, Mus musculus
tctttgagaactcctccccggagga

SEQ ID NO: 792841 - DNA, 25 bp, Mus musculus
tctttgagaactgctccccggagga

SEQ ID NO: 792842 - DNA, 25 bp, Mus musculus
tctttgagagggaccgacagagtgc

SEQ ID NO: 792843 - DNA, 25 bp, Mus musculus
tctttgagagggtccgacagagtgc

SEQ ID NO: 792844 - DNA, 25 bp, Mus musculus
tctttgagatacatttataagctct

SEQ ID NO: 792845 - DNA, 25 bp, Mus musculus
tctttgagatacttttataagctct

SEQ ID NO: 792846 - DNA, 25 bp, Mus musculus
tctttgagatcaatgaggcctttgc

SEQ ID NO: 792847 - DNA, 25 bp, Mus musculus
tctttgagatcattgaggcctttgc

SEQ ID NO: 792848 - DNA, 25 bp, Mus musculus
tctttgagatccatcggttattttt

SEQ ID NO: 792849 - DNA, 25 bp, Mus musculus
tctttgagatccttcggttattttt

SEQ ID NO: 792850 - DNA, 25 bp, Mus musculus
tctttgagatgaaggatgccaaagc

SEQ ID NO: 792851 - DNA, 25 bp, Mus musculus
tctttgagatgatggatgccaaagc

SEQ ID NO: 792852 - DNA, 25 bp, Mus musculus
tctttgagcacgagaggaccttcct

SEQ ID NO: 792853 - DNA, 25 bp, Mus musculus
tctttgagcacgtgaggaccttcct

SEQ ID NO: 792854 - DNA, 25 bp, Mus musculus
tctttgagcaggaacgtaatgtatt

SEQ ID NO: 792855 - DNA, 25 bp, Mus musculus
tctttgagcaggcactcgatggctg

SEQ ID NO: 792856 - DNA, 25 bp, Mus musculus
tctttgagcagggactcgatggctg

SEQ ID NO: 792857 - DNA, 25 bp, Mus musculus
tctttgagcaggtacgtaatgtatt

SEQ ID NO: 792858 - DNA, 25 bp, Mus musculus
tctttgaggatgacaccatctcgga

SEQ ID NO: 792859 - DNA, 25 bp, Mus musculus
tctttgaggatgtcaccatctcgga

SEQ ID NO: 792860 - DNA, 25 bp, Mus musculus
tctttgaggattccgagctctacag

SEQ ID NO: 792861 - DNA, 25 bp, Mus musculus
tctttgaggattgcgagctctacag

SEQ ID NO: 792862 - DNA, 25 bp, Mus musculus
tctttgagggctaagagatgttaaa

SEQ ID NO: 792863 - DNA, 25 bp, Mus musculus
tctttgagggcttagagatgttaaa

SEQ ID NO: 792864 - DNA, 25 bp, Mus musculus
tctttgaggtacaacagactatgca

SEQ ID NO: 792865 - DNA, 25 bp, Mus musculus
tctttgaggtactacagactatgca

SEQ ID NO: 792866 - DNA, 25 bp, Mus musculus
tctttgaggtataccttaagccgta

SEQ ID NO: 792867 - DNA, 25 bp, Mus musculus
tctttgaggtattccttaagccgta

SEQ ID NO: 792868 - DNA, 25 bp, Mus musculus
tctttgaggtgaccttcttggaaac

SEQ ID NO: 792869 - DNA, 25 bp, Mus musculus
tctttgaggtgagcttcttggaaac

SEQ ID NO: 792870 - DNA, 25 bp, Mus musculus
tctttgagtactacgttggcttcac

SEQ ID NO: 792871 - DNA, 25 bp, Mus musculus
tctttgagtacttcgttggcttcac

SEQ ID NO: 792872 - DNA, 25 bp, Mus musculus
tctttgatatgaagccaagctctgc

SEQ ID NO: 792873 - DNA, 25 bp, Mus musculus
tctttgatatgatgccaagctctgc

SEQ ID NO: 792874 - DNA, 25 bp, Mus musculus
tctttgatcctcattatatggagca

SEQ ID NO: 792875 - DNA, 25 bp, Mus musculus
tctttgatcctctttatatggagca

SEQ ID NO: 792876 - DNA, 25 bp, Mus musculus
tctttgatgaacattacaggcagtg

SEQ ID NO: 792877 - DNA, 25 bp, Mus musculus
tctttgatgaactttacaggcagtg

SEQ ID NO: 792878 - DNA, 25 bp, Mus musculus
tctttgatgaagagtcctatagcct

SEQ ID NO: 792879 - DNA, 25 bp, Mus musculus
tctttgatgaagtgtcctatagcct

SEQ ID NO: 792880 - DNA, 25 bp, Mus musculus
tctttgatgaatcggtgttcggcaa

SEQ ID NO: 792881 - DNA, 25 bp, Mus musculus
tctttgatgaatgggtgttcggcaa

SEQ ID NO: 792882 - DNA, 25 bp, Mus musculus
tctttgatgagcacaaagaagaaga

SEQ ID NO: 792883 - DNA, 25 bp, Mus musculus
tctttgatgagctcaaagaagaaga

SEQ ID NO: 792884 - DNA, 25 bp, Mus musculus
tctttgatgatgcttacaaatctca

SEQ ID NO: 792885 - DNA, 25 bp, Mus musculus
tctttgatgatggttacaaatctca

SEQ ID NO: 792886 - DNA, 25 bp, Mus musculus
tctttgatgctaagaatgcctgcga

SEQ ID NO: 792887 - DNA, 25 bp, Mus musculus
tctttgatgctatgaatgcctgcga

SEQ ID NO: 792888 - DNA, 25 bp, Mus musculus
tctttgatggctacgactgccagct

SEQ ID NO: 792889 - DNA, 25 bp, Mus musculus
tctttgatggcttcgactgccagct

SEQ ID NO: 792890 - DNA, 25 bp, Mus musculus
tctttgcaacctatggatctggtca

SEQ ID NO: 792891 - DNA, 25 bp, Mus musculus
tctttgcaacctttggatctggtca

SEQ ID NO: 792892 - DNA, 25 bp, Mus musculus
tctttgcaagagaaggcaatgtgcc

SEQ ID NO: 792893 - DNA, 25 bp, Mus musculus
tctttgcaagagtaggcaatgtgcc

SEQ ID NO: 792894 - DNA, 25 bp, Mus musculus
tctttgcacaggacagagatccaag

SEQ ID NO: 792895 - DNA, 25 bp, Mus musculus
tctttgcacaggtcagagatccaag

SEQ ID NO: 792896 - DNA, 25 bp, Mus musculus
tctttgcaccacacatctatgtggc

SEQ ID NO: 792897 - DNA, 25 bp, Mus musculus
tctttgcaccactcatctatgtggc

SEQ ID NO: 792898 - DNA, 25 bp, Mus musculus
tctttgcagaccagatagtcttgaa

SEQ ID NO: 792899 - DNA, 25 bp, Mus musculus
tctttgcagacctgatagtcttgaa

SEQ ID NO: 792900 - DNA, 25 bp, Mus musculus
tctttgcaggctcgttcaggaagga

SEQ ID NO: 792901 - DNA, 25 bp, Mus musculus
tctttgcaggctggttcaggaagga

SEQ ID NO: 792902 - DNA, 25 bp, Mus musculus
tctttgcataggaaaagggcggctg

SEQ ID NO: 792903 - DNA, 25 bp, Mus musculus
tctttgcataggtaaagggcggctg

SEQ ID NO: 792904 - DNA, 25 bp, Mus musculus
tctttgcatgggaaaataataggcc

SEQ ID NO: 792905 - DNA, 25 bp, Mus musculus
tctttgcatgggtaaataataggcc

SEQ ID NO: 792906 - DNA, 25 bp, Mus musculus
tctttgccaacaagagccgggaacc

SEQ ID NO: 792907 - DNA, 25 bp, Mus musculus
tctttgccaacatgagccgggaacc

SEQ ID NO: 792908 - DNA, 25 bp, Mus musculus
tctttgccagaaaactaccattact

SEQ ID NO: 792909 - DNA, 25 bp, Mus musculus
tctttgccagaatactaccattact

SEQ ID NO: 792910 - DNA, 25 bp, Mus musculus
tctttgcctactcacccagtggagc

SEQ ID NO: 792911 - DNA, 25 bp, Mus musculus
tctttgcctactgacccagtggagc

SEQ ID NO: 792912 - DNA, 25 bp, Mus musculus
tctttgcctcacagccagaccccat

SEQ ID NO: 792913 - DNA, 25 bp, Mus musculus
tctttgcctcactgccagaccccat

SEQ ID NO: 792914 - DNA, 25 bp, Mus musculus
tctttgcctgatcactggagcccta

SEQ ID NO: 792915 - DNA, 25 bp, Mus musculus
tctttgcctgatgactggagcccta

SEQ ID NO: 792916 - DNA, 25 bp, Mus musculus
tctttgcgagaaaggagatccgacc

SEQ ID NO: 792917 - DNA, 25 bp, Mus musculus
tctttgcgagaatggagatccgacc

SEQ ID NO: 792918 - DNA, 25 bp, Mus musculus
tctttgcggacgaggtgcttggttc

SEQ ID NO: 792919 - DNA, 25 bp, Mus musculus
tctttgcggacgtggtgcttggttc

SEQ ID NO: 792920 - DNA, 25 bp, Mus musculus
tctttgcggctacgtccatcgttct

SEQ ID NO: 792921 - DNA, 25 bp, Mus musculus
tctttgcggctaggtccatcgttct

SEQ ID NO: 792922 - DNA, 25 bp, Mus musculus
tctttgcggtgcaagcaatatgcgg

SEQ ID NO: 792923 - DNA, 25 bp, Mus musculus
tctttgcggtgctagcaatatgcgg

SEQ ID NO: 792924 - DNA, 25 bp, Mus musculus
tctttgcggttgcttcaagtttttc

SEQ ID NO: 792925 - DNA, 25 bp, Mus musculus
tctttgcggttggttcaagtttttc

SEQ ID NO: 792926 - DNA, 25 bp, Mus musculus
tctttgcgtcccagggaatggtggc

SEQ ID NO: 792927 - DNA, 25 bp, Mus musculus
tctttgcgtccctgggaatggtggc

SEQ ID NO: 792928 - DNA, 25 bp, Mus musculus
tctttgcgtgcaacgagggctttgc

SEQ ID NO: 792929 - DNA, 25 bp, Mus musculus
tctttgcgtgcatcgagggctttgc

SEQ ID NO: 792930 - DNA, 25 bp, Mus musculus
tctttgctacaacatggaggacgca

SEQ ID NO: 792931 - DNA, 25 bp, Mus musculus
tctttgctacaagatggaggacgca

SEQ ID NO: 792932 - DNA, 25 bp, Mus musculus
tctttgctagggaaaaacattcact

SEQ ID NO: 792933 - DNA, 25 bp, Mus musculus
tctttgctagggtaaaacattcact

SEQ ID NO: 792934 - DNA, 25 bp, Mus musculus
tctttgctattcacaagcagttggg

SEQ ID NO: 792935 - DNA, 25 bp, Mus musculus
tctttgctattctcaagcagttggg

SEQ ID NO: 792936 - DNA, 25 bp, Mus musculus
tctttgctcagacctgaacgagtgc

SEQ ID NO: 792937 - DNA, 25 bp, Mus musculus
tctttgctcagagctgaacgagtgc

SEQ ID NO: 792938 - DNA, 25 bp, Mus musculus
tctttgctcaggagatataaataag

SEQ ID NO: 792939 - DNA, 25 bp, Mus musculus
tctttgctcaggtgatataaataag

SEQ ID NO: 792940 - DNA, 25 bp, Mus musculus
tctttgctgagcacgtgggtacctg

SEQ ID NO: 792941 - DNA, 25 bp, Mus musculus
tctttgctgagctcgtgggtacctg

SEQ ID NO: 792942 - DNA, 25 bp, Mus musculus
tctttgctgcacacggactctactt

SEQ ID NO: 792943 - DNA, 25 bp, Mus musculus
tctttgctgcactcggactctactt

SEQ ID NO: 792944 - DNA, 25 bp, Mus musculus
tctttgctgcgacaaggaggttctg

SEQ ID NO: 792945 - DNA, 25 bp, Mus musculus
tctttgctgcgagaaggaggttctg

SEQ ID NO: 792946 - DNA, 25 bp, Mus musculus
tctttgctgcttatgacccggcggc

SEQ ID NO: 792947 - DNA, 25 bp, Mus musculus
tctttgctgcttcagacggacctgc

SEQ ID NO: 792948 - DNA, 25 bp, Mus musculus
tctttgctgcttgagacggacctgc

SEQ ID NO: 792949 - DNA, 25 bp, Mus musculus
tctttgctgcttttgacccggcggc

SEQ ID NO: 792950 - DNA, 25 bp, Mus musculus
tctttgctggatcttccttggaaga

SEQ ID NO: 792951 - DNA, 25 bp, Mus musculus
tctttgctggatgttccttggaaga

SEQ ID NO: 792952 - DNA, 25 bp, Mus musculus
tctttgctgtgccaaagccctgaaa

SEQ ID NO: 792953 - DNA, 25 bp, Mus musculus
tctttgctgtgcgaaagccctgaaa

SEQ ID NO: 792954 - DNA, 25 bp, Mus musculus
tctttgctgttgaccaagtcttgct

SEQ ID NO: 792955 - DNA, 25 bp, Mus musculus
tctttgctgttgtccaagtcttgct

SEQ ID NO: 792956 - DNA, 25 bp, Mus musculus
tctttggaaatcaaatggatgtcac

SEQ ID NO: 792957 - DNA, 25 bp, Mus musculus
tctttggaaatctaatggatgtcac

SEQ ID NO: 792958 - DNA, 25 bp, Mus musculus
tctttggaccagagatgcaaatcct

SEQ ID NO: 792959 - DNA, 25 bp, Mus musculus
tctttggaccagtgatgcaaatcct

SEQ ID NO: 792960 - DNA, 25 bp, Mus musculus
tctttggacccaccctgaacagctt

SEQ ID NO: 792961 - DNA, 25 bp, Mus musculus
tctttggacccagcctgaacagctt

SEQ ID NO: 792962 - DNA, 25 bp, Mus musculus
tctttggaccccatgactgttccca

SEQ ID NO: 792963 - DNA, 25 bp, Mus musculus
tctttggaccccttgactgttccca

SEQ ID NO: 792964 - DNA, 25 bp, Mus musculus
tctttggacctcagggagaccagct

SEQ ID NO: 792965 - DNA, 25 bp, Mus musculus
tctttggacctctgggagaccagct

SEQ ID NO: 792966 - DNA, 25 bp, Mus musculus
tctttggactgtccacggcactggt

SEQ ID NO: 792967 - DNA, 25 bp, Mus musculus
tctttggactgtgcacggcactggt

SEQ ID NO: 792968 - DNA, 25 bp, Mus musculus
tctttggagaaactgaagtgactct

SEQ ID NO: 792969 - DNA, 25 bp, Mus musculus
tctttggagaaagtgaagtgactct

SEQ ID NO: 792970 - DNA, 25 bp, Mus musculus
tctttggagcccagtttgtgctgac

SEQ ID NO: 792971 - DNA, 25 bp, Mus musculus
tctttggagccctgtttgtgctgac

SEQ ID NO: 792972 - DNA, 25 bp, Mus musculus
tctttggagtcgaggtcctctggca

SEQ ID NO: 792973 - DNA, 25 bp, Mus musculus
tctttggagtcgtggtcctctggca

SEQ ID NO: 792974 - DNA, 25 bp, Mus musculus
tctttggatcgtaaactacttgagc

SEQ ID NO: 792975 - DNA, 25 bp, Mus musculus
tctttggatcgttaactacttgagc

SEQ ID NO: 792976 - DNA, 25 bp, Mus musculus
tctttggatgctatgctacatgccg

SEQ ID NO: 792977 - DNA, 25 bp, Mus musculus
tctttggatgctttgctacatgccg

SEQ ID NO: 792978 - DNA, 25 bp, Mus musculus
tctttggcaccgaaccgcgagttct

SEQ ID NO: 792979 - DNA, 25 bp, Mus musculus
tctttggcaccgtaccgcgagttct

SEQ ID NO: 792980 - DNA, 25 bp, Mus musculus
tctttggcaggccaccctgttgtcg

SEQ ID NO: 792981 - DNA, 25 bp, Mus musculus
tctttggcaggcgaccctgttgtcg

SEQ ID NO: 792982 - DNA, 25 bp, Mus musculus
tctttggcatggacagaccctccca

SEQ ID NO: 792983 - DNA, 25 bp, Mus musculus
tctttggcatggtcagaccctccca

SEQ ID NO: 792984 - DNA, 25 bp, Mus musculus
tctttggcatgtactggtggacggc

SEQ ID NO: 792985 - DNA, 25 bp, Mus musculus
tctttggcatgttctggtggacggc

SEQ ID NO: 792986 - DNA, 25 bp, Mus musculus
tctttggccactcacggtgcaggtg

SEQ ID NO: 792987 - DNA, 25 bp, Mus musculus
tctttggccactgacggtgcaggtg

SEQ ID NO: 792988 - DNA, 25 bp, Mus musculus
tctttggcccagattgctgcccttg

SEQ ID NO: 792989 - DNA, 25 bp, Mus musculus
tctttggcccagtttgctgcccttg

SEQ ID NO: 792990 - DNA, 25 bp, Mus musculus
tctttggcctcgcaatgatattgag

SEQ ID NO: 792991 - DNA, 25 bp, Mus musculus
tctttggcctcggaatgatattgag

SEQ ID NO: 792992 - DNA, 25 bp, Mus musculus
tctttggcctgaccagtgccttggg

SEQ ID NO: 792993 - DNA, 25 bp, Mus musculus
tctttggcctgagcagtgccttggg

SEQ ID NO: 792994 - DNA, 25 bp, Mus musculus
tctttggcctggctatctgggctcc

SEQ ID NO: 792995 - DNA, 25 bp, Mus musculus
tctttggcctgggtatctgggctcc

SEQ ID NO: 792996 - DNA, 25 bp, Mus musculus
tctttggcttgccaaccttcagcag

SEQ ID NO: 792997 - DNA, 25 bp, Mus musculus
tctttggcttgcgaaccttcagcag

SEQ ID NO: 792998 - DNA, 25 bp, Mus musculus
tctttggcttttcccactggtcaac

SEQ ID NO: 792999 - DNA, 25 bp, Mus musculus
tctttggcttttgccactggtcaac

SEQ ID NO: 793000 - DNA, 25 bp, Mus musculus
tctttgggaatcctcggctgaaaag

SEQ ID NO: 793001 - DNA, 25 bp, Mus musculus
tctttgggaatcgtcggctgaaaag

SEQ ID NO: 793002 - DNA, 25 bp, Mus musculus
tctttgggaccaagactctactggg

SEQ ID NO: 793003 - DNA, 25 bp, Mus musculus
tctttgggaccatgactctactggg

SEQ ID NO: 793004 - DNA, 25 bp, Mus musculus
tctttgggacccatcaagcctttga

SEQ ID NO: 793005 - DNA, 25 bp, Mus musculus
tctttgggacccttcaagcctttga

SEQ ID NO: 793006 - DNA, 25 bp, Mus musculus
tctttgggagaaatgacgaaagtac

SEQ ID NO: 793007 - DNA, 25 bp, Mus musculus
tctttgggagaattgacgaaagtac

SEQ ID NO: 793008 - DNA, 25 bp, Mus musculus
tctttgggagccatgggaaagcacc

SEQ ID NO: 793009 - DNA, 25 bp, Mus musculus
tctttgggagccttgggaaagcacc

SEQ ID NO: 793010 - DNA, 25 bp, Mus musculus
tctttgggatcaagtaatcagacct

SEQ ID NO: 793011 - DNA, 25 bp, Mus musculus
tctttgggatcatgtaatcagacct

SEQ ID NO: 793012 - DNA, 25 bp, Mus musculus
tctttgggatgcagtttaccctggg

SEQ ID NO: 793013 - DNA, 25 bp, Mus musculus
tctttgggatgctgtttaccctggg

SEQ ID NO: 793014 - DNA, 25 bp, Mus musculus
tctttgggcagcaggccgtacccca

SEQ ID NO: 793015 - DNA, 25 bp, Mus musculus
tctttgggcagctggccgtacccca

SEQ ID NO: 793016 - DNA, 25 bp, Mus musculus
tctttgggcattagaggacaatccg

SEQ ID NO: 793017 - DNA, 25 bp, Mus musculus
tctttgggcatttgaggacaatccg

SEQ ID NO: 793018 - DNA, 25 bp, Mus musculus
tctttgggccccaggagttagctcc

SEQ ID NO: 793019 - DNA, 25 bp, Mus musculus
tctttgggcccctggagttagctcc

SEQ ID NO: 793020 - DNA, 25 bp, Mus musculus
tctttgggttgaccttggactctgc

SEQ ID NO: 793021 - DNA, 25 bp, Mus musculus
tctttgggttgagcttggactctgc

SEQ ID NO: 793022 - DNA, 25 bp, Mus musculus
tctttggtagctcgaggcaaggata

SEQ ID NO: 793023 - DNA, 25 bp, Mus musculus
tctttggtagctggaggcaaggata

SEQ ID NO: 793024 - DNA, 25 bp, Mus musculus
tctttggtcgggaagaagatcgtgt

SEQ ID NO: 793025 - DNA, 25 bp, Mus musculus
tctttggtcgggtagaagatcgtgt

SEQ ID NO: 793026 - DNA, 25 bp, Mus musculus
tctttggtgaaaactgggaggagca

SEQ ID NO: 793027 - DNA, 25 bp, Mus musculus
tctttggtgaaatctgggaggagca

SEQ ID NO: 793028 - DNA, 25 bp, Mus musculus
tctttggtgactctccctattgtag

SEQ ID NO: 793029 - DNA, 25 bp, Mus musculus
tctttggtgactgtccctattgtag

SEQ ID NO: 793030 - DNA, 25 bp, Mus musculus
tctttggtgcaacagtgacattcaa

SEQ ID NO: 793031 - DNA, 25 bp, Mus musculus
tctttggtgcaagagtgacattcaa

SEQ ID NO: 793032 - DNA, 25 bp, Mus musculus
tctttggtggacaatcaacccctga

SEQ ID NO: 793033 - DNA, 25 bp, Mus musculus
tctttggtggactatcaacccctga

SEQ ID NO: 793034 - DNA, 25 bp, Mus musculus
tctttggtggcgagctgactagtac

SEQ ID NO: 793035 - DNA, 25 bp, Mus musculus
tctttggtggcgtgctgactagtac

SEQ ID NO: 793036 - DNA, 25 bp, Mus musculus
tctttggtggctatgaactgagcag

SEQ ID NO: 793037 - DNA, 25 bp, Mus musculus
tctttggtggctttgaactgagcag

SEQ ID NO: 793038 - DNA, 25 bp, Mus musculus
tctttggtggtaaagaagacggacc

SEQ ID NO: 793039 - DNA, 25 bp, Mus musculus
tctttggtggtatagaagacggacc

SEQ ID NO: 793040 - DNA, 25 bp, Mus musculus
tctttggtgtcgagaattctccagg

SEQ ID NO: 793041 - DNA, 25 bp, Mus musculus
tctttggtgtcgtgaattctccagg

SEQ ID NO: 793042 - DNA, 25 bp, Mus musculus
tctttgtaagttcatgctgcgcacg

SEQ ID NO: 793043 - DNA, 25 bp, Mus musculus
tctttgtaagttgatgctgcgcacg

SEQ ID NO: 793044 - DNA, 25 bp, Mus musculus
tctttgtaccataattaaacgatgc

SEQ ID NO: 793045 - DNA, 25 bp, Mus musculus
tctttgtaccattattaaacgatgc

SEQ ID NO: 793046 - DNA, 25 bp, Mus musculus
tctttgtacgtgaaatttgaccctc

SEQ ID NO: 793047 - DNA, 25 bp, Mus musculus
tctttgtacgtgtaatttgaccctc

SEQ ID NO: 793048 - DNA, 25 bp, Mus musculus
tctttgtactaaccatcgggtctct

SEQ ID NO: 793049 - DNA, 25 bp, Mus musculus
tctttgtactaagcatcgggtctct

SEQ ID NO: 793050 - DNA, 25 bp, Mus musculus
tctttgtagacaccaagaaattgcc

SEQ ID NO: 793051 - DNA, 25 bp, Mus musculus
tctttgtagacagcaagaaattgcc

SEQ ID NO: 793052 - DNA, 25 bp, Mus musculus
tctttgtaggcaccaacgccacagg

SEQ ID NO: 793053 - DNA, 25 bp, Mus musculus
tctttgtaggcagcaacgccacagg

SEQ ID NO: 793054 - DNA, 25 bp, Mus musculus
tctttgtagtacaccgaatgctatg

SEQ ID NO: 793055 - DNA, 25 bp, Mus musculus
tctttgtagtactccgaatgctatg

SEQ ID NO: 793056 - DNA, 25 bp, Mus musculus
tctttgtatcctcgccttagtgatt

SEQ ID NO: 793057 - DNA, 25 bp, Mus musculus
tctttgtatcctggccttagtgatt

SEQ ID NO: 793058 - DNA, 25 bp, Mus musculus
tctttgtcagataagcccagggtga

SEQ ID NO: 793059 - DNA, 25 bp, Mus musculus
tctttgtcagattagcccagggtga

SEQ ID NO: 793060 - DNA, 25 bp, Mus musculus
tctttgtcattcatcgctggagccg

SEQ ID NO: 793061 - DNA, 25 bp, Mus musculus
tctttgtcattcttcgctggagccg

SEQ ID NO: 793062 - DNA, 25 bp, Mus musculus
tctttgtccctacgactcagacagc

SEQ ID NO: 793063 - DNA, 25 bp, Mus musculus
tctttgtccctaggactcagacagc

SEQ ID NO: 793064 - DNA, 25 bp, Mus musculus
tctttgtcgaagctagaggaccggc

SEQ ID NO: 793065 - DNA, 25 bp, Mus musculus
tctttgtcgaaggtagaggaccggc

SEQ ID NO: 793066 - DNA, 25 bp, Mus musculus
tctttgtcggaacactgtcaacggc

SEQ ID NO: 793067 - DNA, 25 bp, Mus musculus
tctttgtcggaagactgtcaacggc

SEQ ID NO: 793068 - DNA, 25 bp, Mus musculus
tctttgtcggagcagctcttctgtt

SEQ ID NO: 793069 - DNA, 25 bp, Mus musculus
tctttgtcggaggagctcttctgtt

SEQ ID NO: 793070 - DNA, 25 bp, Mus musculus
tctttgtgaaccagtggcaggttaa

SEQ ID NO: 793071 - DNA, 25 bp, Mus musculus
tctttgtgaacctgtggcaggttaa

SEQ ID NO: 793072 - DNA, 25 bp, Mus musculus
tctttgtgacaacgatcatgcagga

SEQ ID NO: 793073 - DNA, 25 bp, Mus musculus
tctttgtgacaaggatcatgcagga

SEQ ID NO: 793074 - DNA, 25 bp, Mus musculus
tctttgtgacagaaagtcaaccatg

SEQ ID NO: 793075 - DNA, 25 bp, Mus musculus
tctttgtgacagtaagtcaaccatg

SEQ ID NO: 793076 - DNA, 25 bp, Mus musculus
tctttgtgatgaagtcaccacaaga

SEQ ID NO: 793077 - DNA, 25 bp, Mus musculus
tctttgtgatgatgtcaccacaaga

SEQ ID NO: 793078 - DNA, 25 bp, Mus musculus
tctttgtgcagcacataaaactcca

SEQ ID NO: 793079 - DNA, 25 bp, Mus musculus
tctttgtgcagcagtgacatccaca

SEQ ID NO: 793080 - DNA, 25 bp, Mus musculus
tctttgtgcagcctccctcgctgga

SEQ ID NO: 793081 - DNA, 25 bp, Mus musculus
tctttgtgcagcgtccctcgctgga

SEQ ID NO: 793082 - DNA, 25 bp, Mus musculus
tctttgtgcagctcataaaactcca

SEQ ID NO: 793083 - DNA, 25 bp, Mus musculus
tctttgtgcagctgtgacatccaca

SEQ ID NO: 793084 - DNA, 25 bp, Mus musculus
tctttgtgcagtaccaacaccgcgt

SEQ ID NO: 793085 - DNA, 25 bp, Mus musculus
tctttgtgcagttccaacaccgcgt

SEQ ID NO: 793086 - DNA, 25 bp, Mus musculus
tctttgtgcggcctgcggagtggag

SEQ ID NO: 793087 - DNA, 25 bp, Mus musculus
tctttgtgcggcgtgcggagtggag

SEQ ID NO: 793088 - DNA, 25 bp, Mus musculus
tctttgtggcttaggacctggacag

SEQ ID NO: 793089 - DNA, 25 bp, Mus musculus
tctttgtggctttggacctggacag

SEQ ID NO: 793090 - DNA, 25 bp, Mus musculus
tctttgtgggttcggagcggagcag

SEQ ID NO: 793091 - DNA, 25 bp, Mus musculus
tctttgtgggttgggagcggagcag

SEQ ID NO: 793092 - DNA, 25 bp, Mus musculus
tctttgtggtgtatgtgcatcagac

SEQ ID NO: 793093 - DNA, 25 bp, Mus musculus
tctttgtggtgtttgtgcatcagac

SEQ ID NO: 793094 - DNA, 25 bp, Mus musculus
tctttgtgtgtgaggaatgcgggca

SEQ ID NO: 793095 - DNA, 25 bp, Mus musculus
tctttgtgtgtgtggaatgcgggca

SEQ ID NO: 793096 - DNA, 25 bp, Mus musculus
tctttgttcaataatacaccagggc

SEQ ID NO: 793097 - DNA, 25 bp, Mus musculus
tctttgttcaattatacaccagggc

SEQ ID NO: 793098 - DNA, 25 bp, Mus musculus
tctttgttcagtacctagccacctg

SEQ ID NO: 793099 - DNA, 25 bp, Mus musculus
tctttgttcagttcctagccacctg

SEQ ID NO: 793100 - DNA, 25 bp, Mus musculus
tctttgttctgcctcagtcctagcc

SEQ ID NO: 793101 - DNA, 25 bp, Mus musculus
tctttgttctgcgtcagtcctagcc

SEQ ID NO: 793102 - DNA, 25 bp, Mus musculus
tctttgttggtgacaaatatgtcaa

SEQ ID NO: 793103 - DNA, 25 bp, Mus musculus
tctttgttggtgtcaaatatgtcaa

SEQ ID NO: 793104 - DNA, 25 bp, Mus musculus
tctttgtttaagcactgaggaccca

SEQ ID NO: 793105 - DNA, 25 bp, Mus musculus
tctttgtttaaggactgaggaccca

SEQ ID NO: 793106 - DNA, 25 bp, Mus musculus
tcttttaaaacaagatgccgtcggg

SEQ ID NO: 793107 - DNA, 25 bp, Mus musculus
tcttttaaaacatgatgccgtcggg

SEQ ID NO: 793108 - DNA, 25 bp, Mus musculus
tcttttaaaactcctgtacctgtgc

SEQ ID NO: 793109 - DNA, 25 bp, Mus musculus
tcttttaaaactgctgtacctgtgc

SEQ ID NO: 793110 - DNA, 25 bp, Mus musculus
tcttttaaagctcgcagtcgcgaat

SEQ ID NO: 793111 - DNA, 25 bp, Mus musculus
tcttttaaagctggcagtcgcgaat

SEQ ID NO: 793112 - DNA, 25 bp, Mus musculus
tcttttaaaggtcacaaagctgcca

SEQ ID NO: 793113 - DNA, 25 bp, Mus musculus
tcttttaaaggtgacaaagctgcca

SEQ ID NO: 793114 - DNA, 25 bp, Mus musculus
tcttttaagggaccaggaacaggat

SEQ ID NO: 793115 - DNA, 25 bp, Mus musculus
tcttttaagggagcaggaacaggat

SEQ ID NO: 793116 - DNA, 25 bp, Mus musculus
tcttttacactaagtccttcgtgaa

SEQ ID NO: 793117 - DNA, 25 bp, Mus musculus
tcttttacactatgtccttcgtgaa

SEQ ID NO: 793118 - DNA, 25 bp, Mus musculus
tcttttacagcgctgagtccttgag

SEQ ID NO: 793119 - DNA, 25 bp, Mus musculus
tcttttacagcggtgagtccttgag

SEQ ID NO: 793120 - DNA, 25 bp, Mus musculus
tcttttacatgtacctgagagtaat

SEQ ID NO: 793121 - DNA, 25 bp, Mus musculus
tcttttacatgttcctgagagtaat

SEQ ID NO: 793122 - DNA, 25 bp, Mus musculus
tcttttactcaacaggctagcactg

SEQ ID NO: 793123 - DNA, 25 bp, Mus musculus
tcttttactcaagaggctagcactg

SEQ ID NO: 793124 - DNA, 25 bp, Mus musculus
tcttttactgccctcaagtgagttg

SEQ ID NO: 793125 - DNA, 25 bp, Mus musculus
tcttttactgccgtcaagtgagttg

SEQ ID NO: 793126 - DNA, 25 bp, Mus musculus
tcttttagaaaaatgtatatgcagc

SEQ ID NO: 793127 - DNA, 25 bp, Mus musculus
tcttttagaaaattgtatatgcagc

SEQ ID NO: 793128 - DNA, 25 bp, Mus musculus
tcttttagaccacctggacactcag

SEQ ID NO: 793129 - DNA, 25 bp, Mus musculus
tcttttagaccagctggacactcag

SEQ ID NO: 793130 - DNA, 25 bp, Mus musculus
tcttttagagatccctgcagctaag

SEQ ID NO: 793131 - DNA, 25 bp, Mus musculus
tcttttagagatgcctgcagctaag

SEQ ID NO: 793132 - DNA, 25 bp, Mus musculus
tcttttagagttacacaacaaggag

SEQ ID NO: 793133 - DNA, 25 bp, Mus musculus
tcttttagagtttcacaacaaggag

SEQ ID NO: 793134 - DNA, 25 bp, Mus musculus
tcttttagcgatagggaggcaccat

SEQ ID NO: 793135 - DNA, 25 bp, Mus musculus
tcttttagcgattgggaggcaccat

SEQ ID NO: 793136 - DNA, 25 bp, Mus musculus
tcttttagtctgctgggtccccaca

SEQ ID NO: 793137 - DNA, 25 bp, Mus musculus
tcttttagtctggtgggtccccaca

SEQ ID NO: 793138 - DNA, 25 bp, Mus musculus
tcttttatccgactgtgtgagacct

SEQ ID NO: 793139 - DNA, 25 bp, Mus musculus
tcttttatccgagtgtgtgagacct

SEQ ID NO: 793140 - DNA, 25 bp, Mus musculus
tcttttattcaaaacttcagtgttc

SEQ ID NO: 793141 - DNA, 25 bp, Mus musculus
tcttttattcaatacttcagtgttc

SEQ ID NO: 793142 - DNA, 25 bp, Mus musculus
tcttttcaaggaagatgtcagcact

SEQ ID NO: 793143 - DNA, 25 bp, Mus musculus
tcttttcaaggatgatgtcagcact

SEQ ID NO: 793144 - DNA, 25 bp, Mus musculus
tcttttcagttgcattagcagaaat

SEQ ID NO: 793145 - DNA, 25 bp, Mus musculus
tcttttcagttggattagcagaaat

SEQ ID NO: 793146 - DNA, 25 bp, Mus musculus
tcttttcattccatctctacaccgg

SEQ ID NO: 793147 - DNA, 25 bp, Mus musculus
tcttttcattccttctctacaccgg

SEQ ID NO: 793148 - DNA, 25 bp, Mus musculus
tcttttcatttacgaacatctgtga

SEQ ID NO: 793149 - DNA, 25 bp, Mus musculus
tcttttcatttaggaacatctgtga

SEQ ID NO: 793150 - DNA, 25 bp, Mus musculus
tcttttccagatagtaggtgaagtg

SEQ ID NO: 793151 - DNA, 25 bp, Mus musculus
tcttttccagattgtaggtgaagtg

SEQ ID NO: 793152 - DNA, 25 bp, Mus musculus
tcttttccagcgacgtggcgatcca

SEQ ID NO: 793153 - DNA, 25 bp, Mus musculus
tcttttccagcgtcgtggcgatcca

SEQ ID NO: 793154 - DNA, 25 bp, Mus musculus
tcttttccctgcattagctgctcgt

SEQ ID NO: 793155 - DNA, 25 bp, Mus musculus
tcttttccctgctttagctgctcgt

SEQ ID NO: 793156 - DNA, 25 bp, Mus musculus
tcttttcccttgcacaagctgccag

SEQ ID NO: 793157 - DNA, 25 bp, Mus musculus
tcttttcccttggacaagctgccag

SEQ ID NO: 793158 - DNA, 25 bp, Mus musculus
tcttttcctacgcaatctgcctggg

SEQ ID NO: 793159 - DNA, 25 bp, Mus musculus
tcttttcctacggaatctgcctggg

SEQ ID NO: 793160 - DNA, 25 bp, Mus musculus
tcttttccttggctcagcatctacc

SEQ ID NO: 793161 - DNA, 25 bp, Mus musculus
tcttttccttgggtcagcatctacc

SEQ ID NO: 793162 - DNA, 25 bp, Mus musculus
tcttttcgcaggaaattgtcatatc

SEQ ID NO: 793163 - DNA, 25 bp, Mus musculus
tcttttcgcaggtaattgtcatatc

SEQ ID NO: 793164 - DNA, 25 bp, Mus musculus
tcttttcgcatccatacacctcttt

SEQ ID NO: 793165 - DNA, 25 bp, Mus musculus
tcttttcgcatcgatacacctcttt

SEQ ID NO: 793166 - DNA, 25 bp, Mus musculus
tcttttcgctgcacactggcagact

SEQ ID NO: 793167 - DNA, 25 bp, Mus musculus
tcttttcgctgctcactggcagact

SEQ ID NO: 793168 - DNA, 25 bp, Mus musculus
tcttttcggcaacactgtcttccgc

SEQ ID NO: 793169 - DNA, 25 bp, Mus musculus
tcttttcggcaagactgtcttccgc

SEQ ID NO: 793170 - DNA, 25 bp, Mus musculus
tcttttctaagacccagatactcta

SEQ ID NO: 793171 - DNA, 25 bp, Mus musculus
tcttttctaagagccagatactcta

SEQ ID NO: 793172 - DNA, 25 bp, Mus musculus
tcttttctatcacaaacagatgagc

SEQ ID NO: 793173 - DNA, 25 bp, Mus musculus
tcttttctatcagaaacagatgagc

SEQ ID NO: 793174 - DNA, 25 bp, Mus musculus
tcttttctcagactgctacggcaac

SEQ ID NO: 793175 - DNA, 25 bp, Mus musculus
tcttttctcagagtgctacggcaac

SEQ ID NO: 793176 - DNA, 25 bp, Mus musculus
tcttttctccacacatgaagagctg

SEQ ID NO: 793177 - DNA, 25 bp, Mus musculus
tcttttctccactcatgaagagctg

SEQ ID NO: 793178 - DNA, 25 bp, Mus musculus
tcttttctccagcaggaaaaaatgg

SEQ ID NO: 793179 - DNA, 25 bp, Mus musculus
tcttttctccaggaggaaaaaatgg

SEQ ID NO: 793180 - DNA, 25 bp, Mus musculus
tcttttctggagcatgcccatccca

SEQ ID NO: 793181 - DNA, 25 bp, Mus musculus
tcttttctggaggatgcccatccca

SEQ ID NO: 793182 - DNA, 25 bp, Mus musculus
tcttttgaatgcagatgccatctca

SEQ ID NO: 793183 - DNA, 25 bp, Mus musculus
tcttttgaatgctgatgccatctca

SEQ ID NO: 793184 - DNA, 25 bp, Mus musculus
tcttttgccagcactgatgagcaag

SEQ ID NO: 793185 - DNA, 25 bp, Mus musculus
tcttttgccagctctgatgagcaag

SEQ ID NO: 793186 - DNA, 25 bp, Mus musculus
tcttttgccaggacagaggcagagc

SEQ ID NO: 793187 - DNA, 25 bp, Mus musculus
tcttttgccaggtcagaggcagagc

SEQ ID NO: 793188 - DNA, 25 bp, Mus musculus
tcttttgctcagcttgcaaggacaa

SEQ ID NO: 793189 - DNA, 25 bp, Mus musculus
tcttttgctcaggttgcaaggacaa

SEQ ID NO: 793190 - DNA, 25 bp, Mus musculus
tcttttggaacaccagaacaccatt

SEQ ID NO: 793191 - DNA, 25 bp, Mus musculus
tcttttggaacagcagaacaccatt

SEQ ID NO: 793192 - DNA, 25 bp, Mus musculus
tcttttggaggaccaacagttcttc

SEQ ID NO: 793193 - DNA, 25 bp, Mus musculus
tcttttggaggagcaacagttcttc

SEQ ID NO: 793194 - DNA, 25 bp, Mus musculus
tcttttggagtgctcagtacaaggc

SEQ ID NO: 793195 - DNA, 25 bp, Mus musculus
tcttttggagtggtcagtacaaggc

SEQ ID NO: 793196 - DNA, 25 bp, Mus musculus
tcttttggatttaggacaccatgaa

SEQ ID NO: 793197 - DNA, 25 bp, Mus musculus
tcttttggattttggacaccatgaa

SEQ ID NO: 793198 - DNA, 25 bp, Mus musculus
tcttttggcaaaaagctcaccaagg

SEQ ID NO: 793199 - DNA, 25 bp, Mus musculus
tcttttggcaaatagctcaccaagg

SEQ ID NO: 793200 - DNA, 25 bp, Mus musculus
tcttttggctggcaccagtgatccc

SEQ ID NO: 793201 - DNA, 25 bp, Mus musculus
tcttttggctgggaccagtgatccc

SEQ ID NO: 793202 - DNA, 25 bp, Mus musculus
tcttttggctgtcactgggagccca

SEQ ID NO: 793203 - DNA, 25 bp, Mus musculus
tcttttggctgtgactgggagccca

SEQ ID NO: 793204 - DNA, 25 bp, Mus musculus
tcttttgggatgagatctaaaactc

SEQ ID NO: 793205 - DNA, 25 bp, Mus musculus
tcttttgggatgtgatctaaaactc

SEQ ID NO: 793206 - DNA, 25 bp, Mus musculus
tcttttgggccacttggcttggata

SEQ ID NO: 793207 - DNA, 25 bp, Mus musculus
tcttttgggccagttggcttggata

SEQ ID NO: 793208 - DNA, 25 bp, Mus musculus
tcttttggtcctaagaatcgttcaa

SEQ ID NO: 793209 - DNA, 25 bp, Mus musculus
tcttttggtccttagaatcgttcaa

SEQ ID NO: 793210 - DNA, 25 bp, Mus musculus
tcttttggtcttcgtgaattttcac

SEQ ID NO: 793211 - DNA, 25 bp, Mus musculus
tcttttggtcttggtgaattttcac

SEQ ID NO: 793212 - DNA, 25 bp, Mus musculus
tcttttggtttcatctggagcccct

SEQ ID NO: 793213 - DNA, 25 bp, Mus musculus
tcttttggtttcttctggagcccct

SEQ ID NO: 793214 - DNA, 25 bp, Mus musculus
tcttttgtcttgcagtgtcccactg

SEQ ID NO: 793215 - DNA, 25 bp, Mus musculus
tcttttgtcttggagtgtcccactg

SEQ ID NO: 793216 - DNA, 25 bp, Mus musculus
tcttttgttcatcagctgggacgga

SEQ ID NO: 793217 - DNA, 25 bp, Mus musculus
tcttttgttcatgagctgggacgga

SEQ ID NO: 793218 - DNA, 25 bp, Mus musculus
tctttttaaaatccccgtgaagtca

SEQ ID NO: 793219 - DNA, 25 bp, Mus musculus
tctttttaaaatgcccgtgaagtca

SEQ ID NO: 793220 - DNA, 25 bp, Mus musculus
tctttttacctaagaaggcaacagc

SEQ ID NO: 793221 - DNA, 25 bp, Mus musculus
tctttttacctatgaaggcaacagc

SEQ ID NO: 793222 - DNA, 25 bp, Mus musculus
tctttttaccttaacatatggcgta

SEQ ID NO: 793223 - DNA, 25 bp, Mus musculus
tctttttacctttacatatggcgta

SEQ ID NO: 793224 - DNA, 25 bp, Mus musculus
tctttttcagctctaggaatgattc

SEQ ID NO: 793225 - DNA, 25 bp, Mus musculus
tctttttcagctgtaggaatgattc

SEQ ID NO: 793226 - DNA, 25 bp, Mus musculus
tctttttccgttacctggctattgg

SEQ ID NO: 793227 - DNA, 25 bp, Mus musculus
tctttttccgtttcctggctattgg

SEQ ID NO: 793228 - DNA, 25 bp, Mus musculus
tctttttcggaaagctgggagcaca

SEQ ID NO: 793229 - DNA, 25 bp, Mus musculus
tctttttcggaatgctgggagcaca

SEQ ID NO: 793230 - DNA, 25 bp, Mus musculus
tctttttctacacagggaatgaggg

SEQ ID NO: 793231 - DNA, 25 bp, Mus musculus
tctttttctacagagggaatgaggg

SEQ ID NO: 793232 - DNA, 25 bp, Mus musculus
tctttttctagacactggatgtata

SEQ ID NO: 793233 - DNA, 25 bp, Mus musculus
tctttttctagagactggatgtata

SEQ ID NO: 793234 - DNA, 25 bp, Mus musculus
tctttttctctacagagctgggtcg

SEQ ID NO: 793235 - DNA, 25 bp, Mus musculus
tctttttctctagagagctgggtcg

SEQ ID NO: 793236 - DNA, 25 bp, Mus musculus
tctttttctgaaccgacagcctcca

SEQ ID NO: 793237 - DNA, 25 bp, Mus musculus
tctttttctgaagcgacagcctcca

SEQ ID NO: 793238 - DNA, 25 bp, Mus musculus
tctttttctgttcgactctttgtca

SEQ ID NO: 793239 - DNA, 25 bp, Mus musculus
tctttttctgttggactctttgtca

SEQ ID NO: 793240 - DNA, 25 bp, Mus musculus
tctttttcttgaagctcctaagacc

SEQ ID NO: 793241 - DNA, 25 bp, Mus musculus
tctttttcttgatgctcctaagacc

SEQ ID NO: 793242 - DNA, 25 bp, Mus musculus
tctttttcttggagaacccagacag

SEQ ID NO: 793243 - DNA, 25 bp, Mus musculus
tctttttcttggtgaacccagacag

SEQ ID NO: 793244 - DNA, 25 bp, Mus musculus
tctttttgactcacatgacgacaga

SEQ ID NO: 793245 - DNA, 25 bp, Mus musculus
tctttttgactctcatgacgacaga

SEQ ID NO: 793246 - DNA, 25 bp, Mus musculus
tctttttggagaataagtgtctaaa

SEQ ID NO: 793247 - DNA, 25 bp, Mus musculus
tctttttggagattaagtgtctaaa

SEQ ID NO: 793248 - DNA, 25 bp, Mus musculus
tctttttggagtagcccagttgcct

SEQ ID NO: 793249 - DNA, 25 bp, Mus musculus
tctttttggagttgcccagttgcct

SEQ ID NO: 793250 - DNA, 25 bp, Mus musculus
tctttttggcctcggaatttccagc

SEQ ID NO: 793251 - DNA, 25 bp, Mus musculus
tctttttggcctgggaatttccagc

SEQ ID NO: 793252 - DNA, 25 bp, Mus musculus
tctttttgtagacgtaccaccagac

SEQ ID NO: 793253 - DNA, 25 bp, Mus musculus
tctttttgtagaggtaccaccagac

SEQ ID NO: 793254 - DNA, 25 bp, Mus musculus
tctttttgtctgcatccattgccgg

SEQ ID NO: 793255 - DNA, 25 bp, Mus musculus
tctttttgtctggatccattgccgg

SEQ ID NO: 793256 - DNA, 25 bp, Mus musculus
tgaaaaaacacaaacgcctagaggg

SEQ ID NO: 793257 - DNA, 25 bp, Mus musculus
tgaaaaaacacatacgcctagaggg

SEQ ID NO: 793258 - DNA, 25 bp, Mus musculus
tgaaaaaacaccatcgctaactaaa

SEQ ID NO: 793259 - DNA, 25 bp, Mus musculus
tgaaaaaacaccttcgctaactaaa

SEQ ID NO: 793260 - DNA, 25 bp, Mus musculus
tgaaaaaacagcacaaacaatgcag

SEQ ID NO: 793261 - DNA, 25 bp, Mus musculus
tgaaaaaacagctcaaacaatgcag

SEQ ID NO: 793262 - DNA, 25 bp, Mus musculus
tgaaaaaacttgcactgaaggcaga

SEQ ID NO: 793263 - DNA, 25 bp, Mus musculus
tgaaaaaacttggactgaaggcaga

SEQ ID NO: 793264 - DNA, 25 bp, Mus musculus
tgaaaaaagccaagatgcaggaacc

SEQ ID NO: 793265 - DNA, 25 bp, Mus musculus
tgaaaaaagccatgatgcaggaacc

SEQ ID NO: 793266 - DNA, 25 bp, Mus musculus
tgaaaaaatgacagctttggaggcc

SEQ ID NO: 793267 - DNA, 25 bp, Mus musculus
tgaaaaaatgactgctttggaggcc

SEQ ID NO: 793268 - DNA, 25 bp, Mus musculus
tgaaaaaatttcaattccagatgcc

SEQ ID NO: 793269 - DNA, 25 bp, Mus musculus
tgaaaaaatttctattccagatgcc

SEQ ID NO: 793270 - DNA, 25 bp, Mus musculus
tgaaaaacaaccagaaccccagctg

SEQ ID NO: 793271 - DNA, 25 bp, Mus musculus
tgaaaaacaacctgaaccccagctg

SEQ ID NO: 793272 - DNA, 25 bp, Mus musculus
tgaaaaacaagtagacactgaagag

SEQ ID NO: 793273 - DNA, 25 bp, Mus musculus
tgaaaaacaagttgacactgaagag

SEQ ID NO: 793274 - DNA, 25 bp, Mus musculus
tgaaaaacagcaacctgcggcacat

SEQ ID NO: 793275 - DNA, 25 bp, Mus musculus
tgaaaaacagcatcctgcggcacat

SEQ ID NO: 793276 - DNA, 25 bp, Mus musculus
tgaaaaaccgctacatcatcatgcg

SEQ ID NO: 793277 - DNA, 25 bp, Mus musculus
tgaaaaaccgcttcatcatcatgcg

SEQ ID NO: 793278 - DNA, 25 bp, Mus musculus
tgaaaaacggttctatctgaaggaa

SEQ ID NO: 793279 - DNA, 25 bp, Mus musculus
tgaaaaacggttgtatctgaaggaa

SEQ ID NO: 793280 - DNA, 25 bp, Mus musculus
tgaaaaacgtatctaattacctgcc

SEQ ID NO: 793281 - DNA, 25 bp, Mus musculus
tgaaaaacgtatgtaattacctgcc

SEQ ID NO: 793282 - DNA, 25 bp, Mus musculus
tgaaaaactataccaacctcctggc

SEQ ID NO: 793283 - DNA, 25 bp, Mus musculus
tgaaaaactatagcaacctcctggc

SEQ ID NO: 793284 - DNA, 25 bp, Mus musculus
tgaaaaactcaactaggctgtgggt

SEQ ID NO: 793285 - DNA, 25 bp, Mus musculus
tgaaaaactcaagtaggctgtgggt

SEQ ID NO: 793286 - DNA, 25 bp, Mus musculus
tgaaaaagcaaaactgaaagcagaa

SEQ ID NO: 793287 - DNA, 25 bp, Mus musculus
tgaaaaagcaaatctgaaagcagaa

SEQ ID NO: 793288 - DNA, 25 bp, Mus musculus
tgaaaaagcagaaaattcgtcgctc

SEQ ID NO: 793289 - DNA, 25 bp, Mus musculus
tgaaaaagcagataattcgtcgctc

SEQ ID NO: 793290 - DNA, 25 bp, Mus musculus
tgaaaaagctctctcaacaaactat

SEQ ID NO: 793291 - DNA, 25 bp, Mus musculus
tgaaaaagctctgtcaacaaactat

SEQ ID NO: 793292 - DNA, 25 bp, Mus musculus
tgaaaaaggactccagctgtaccag

SEQ ID NO: 793293 - DNA, 25 bp, Mus musculus
tgaaaaaggactgcagctgtaccag

SEQ ID NO: 793294 - DNA, 25 bp, Mus musculus
tgaaaaagtagccatgctgacccaa

SEQ ID NO: 793295 - DNA, 25 bp, Mus musculus
tgaaaaagtagcgatgctgacccaa

SEQ ID NO: 793296 - DNA, 25 bp, Mus musculus
tgaaaaataaggcacagctgtcggc

SEQ ID NO: 793297 - DNA, 25 bp, Mus musculus
tgaaaaataagggacagctgtcggc

SEQ ID NO: 793298 - DNA, 25 bp, Mus musculus
tgaaaaatacagaccattgaagctc

SEQ ID NO: 793299 - DNA, 25 bp, Mus musculus
tgaaaaatacagtccattgaagctc

SEQ ID NO: 793300 - DNA, 25 bp, Mus musculus
tgaaaaatccgtcaggtatcatcac

SEQ ID NO: 793301 - DNA, 25 bp, Mus musculus
tgaaaaatccgtgaggtatcatcac

SEQ ID NO: 793302 - DNA, 25 bp, Mus musculus
tgaaaaatctgcagttcctgctttg

SEQ ID NO: 793303 - DNA, 25 bp, Mus musculus
tgaaaaatctgctgttcctgctttg

SEQ ID NO: 793304 - DNA, 25 bp, Mus musculus
tgaaaaatctggacataagtcgccc

SEQ ID NO: 793305 - DNA, 25 bp, Mus musculus
tgaaaaatctggtcataagtcgccc

SEQ ID NO: 793306 - DNA, 25 bp, Mus musculus
tgaaaaatgggacctggtagagaaa

SEQ ID NO: 793307 - DNA, 25 bp, Mus musculus
tgaaaaatgggagctggtagagaaa

SEQ ID NO: 793308 - DNA, 25 bp, Mus musculus
tgaaaaattaccacctcccgatcct

SEQ ID NO: 793309 - DNA, 25 bp, Mus musculus
tgaaaaattacctcctcccgatcct

SEQ ID NO: 793310 - DNA, 25 bp, Mus musculus
tgaaaaattgcacgccaaaaccttg

SEQ ID NO: 793311 - DNA, 25 bp, Mus musculus
tgaaaaattgcaggccaaaaccttg

SEQ ID NO: 793312 - DNA, 25 bp, Mus musculus
tgaaaacaaagtcgctcaagaaccc

SEQ ID NO: 793313 - DNA, 25 bp, Mus musculus
tgaaaacaaagtggctcaagaaccc

SEQ ID NO: 793314 - DNA, 25 bp, Mus musculus
tgaaaacacggccaagatcttggct

SEQ ID NO: 793315 - DNA, 25 bp, Mus musculus
tgaaaacacggcgaagatcttggct

SEQ ID NO: 793316 - DNA, 25 bp, Mus musculus
tgaaaacactctcaaacatgtgggt

SEQ ID NO: 793317 - DNA, 25 bp, Mus musculus
tgaaaacactctgaaacatgtgggt

SEQ ID NO: 793318 - DNA, 25 bp, Mus musculus
tgaaaacagaagactaaaatagggc

SEQ ID NO: 793319 - DNA, 25 bp, Mus musculus
tgaaaacagaagtctaaaatagggc

SEQ ID NO: 793320 - DNA, 25 bp, Mus musculus
tgaaaacagcatccaccaataccct

SEQ ID NO: 793321 - DNA, 25 bp, Mus musculus
tgaaaacagcatgcaccaataccct

SEQ ID NO: 793322 - DNA, 25 bp, Mus musculus
tgaaaacaggacatagtgcccagcg

SEQ ID NO: 793323 - DNA, 25 bp, Mus musculus
tgaaaacaggacttagtgcccagcg

SEQ ID NO: 793324 - DNA, 25 bp, Mus musculus
tgaaaacaggttagtggcagttacc

SEQ ID NO: 793325 - DNA, 25 bp, Mus musculus
tgaaaacaggtttgtggcagttacc

SEQ ID NO: 793326 - DNA, 25 bp, Mus musculus
tgaaaacattctagtggccaaagac

SEQ ID NO: 793327 - DNA, 25 bp, Mus musculus
tgaaaacattcttgtggccaaagac

SEQ ID NO: 793328 - DNA, 25 bp, Mus musculus
tgaaaaccagatagagaagttaggg

SEQ ID NO: 793329 - DNA, 25 bp, Mus musculus
tgaaaaccagattgagaagttaggg

SEQ ID NO: 793330 - DNA, 25 bp, Mus musculus
tgaaaaccatggagggcctccaaca

SEQ ID NO: 793331 - DNA, 25 bp, Mus musculus
tgaaaaccatggtgggcctccaaca

SEQ ID NO: 793332 - DNA, 25 bp, Mus musculus
tgaaaaccccagagctacaagatgt

SEQ ID NO: 793333 - DNA, 25 bp, Mus musculus
tgaaaaccccagtgctacaagatgt

SEQ ID NO: 793334 - DNA, 25 bp, Mus musculus
tgaaaacccgggatctgcaccgtga

SEQ ID NO: 793335 - DNA, 25 bp, Mus musculus
tgaaaacccgggttctgcaccgtga

SEQ ID NO: 793336 - DNA, 25 bp, Mus musculus
tgaaaaccgacacaagaagctggag

SEQ ID NO: 793337 - DNA, 25 bp, Mus musculus
tgaaaaccgacagaagaagctggag

SEQ ID NO: 793338 - DNA, 25 bp, Mus musculus
tgaaaaccgaccacttgattgtcct

SEQ ID NO: 793339 - DNA, 25 bp, Mus musculus
tgaaaaccgacctcttgattgtcct

SEQ ID NO: 793340 - DNA, 25 bp, Mus musculus
tgaaaacctacccatgaacctacct

SEQ ID NO: 793341 - DNA, 25 bp, Mus musculus
tgaaaacctaccgatgaacctacct

SEQ ID NO: 793342 - DNA, 25 bp, Mus musculus
tgaaaacctcagctgcagtcaagaa

SEQ ID NO: 793343 - DNA, 25 bp, Mus musculus
tgaaaacctcaggtgcagtcaagaa

SEQ ID NO: 793344 - DNA, 25 bp, Mus musculus
tgaaaaccttaactggtaagaccat

SEQ ID NO: 793345 - DNA, 25 bp, Mus musculus
tgaaaaccttaagtggtaagaccat

SEQ ID NO: 793346 - DNA, 25 bp, Mus musculus
tgaaaacgagtcagggcctcaagat

SEQ ID NO: 793347 - DNA, 25 bp, Mus musculus
tgaaaacgagtctgggcctcaagat

SEQ ID NO: 793348 - DNA, 25 bp, Mus musculus
tgaaaacggagccttccagggactg

SEQ ID NO: 793349 - DNA, 25 bp, Mus musculus
tgaaaacggagcgttccagggactg

SEQ ID NO: 793350 - DNA, 25 bp, Mus musculus
tgaaaacggagtcaacatgcagcat

SEQ ID NO: 793351 - DNA, 25 bp, Mus musculus
tgaaaacggagtgaacatgcagcat

SEQ ID NO: 793352 - DNA, 25 bp, Mus musculus
tgaaaacggtccaggagaaggcagc

SEQ ID NO: 793353 - DNA, 25 bp, Mus musculus
tgaaaacggtcctggagaaggcagc

SEQ ID NO: 793354 - DNA, 25 bp, Mus musculus
tgaaaacgtgtccagcaaagtccgt

SEQ ID NO: 793355 - DNA, 25 bp, Mus musculus
tgaaaacgtgtcgagcaaagtccgt

SEQ ID NO: 793356 - DNA, 25 bp, Mus musculus
tgaaaacgttgacggtacccctgct

SEQ ID NO: 793357 - DNA, 25 bp, Mus musculus
tgaaaacgttgagggtacccctgct

SEQ ID NO: 793358 - DNA, 25 bp, Mus musculus
tgaaaactaaaacactggctacctc

SEQ ID NO: 793359 - DNA, 25 bp, Mus musculus
tgaaaactaaaagactggctacctc

SEQ ID NO: 793360 - DNA, 25 bp, Mus musculus
tgaaaactcagaatgtcttcttaac

SEQ ID NO: 793361 - DNA, 25 bp, Mus musculus
tgaaaactcagattgtcttcttaac

SEQ ID NO: 793362 - DNA, 25 bp, Mus musculus
tgaaaactcagcagcacccaatgct

SEQ ID NO: 793363 - DNA, 25 bp, Mus musculus
tgaaaactcagctgcacccaatgct

SEQ ID NO: 793364 - DNA, 25 bp, Mus musculus
tgaaaactcgggatgacctggcaag

SEQ ID NO: 793365 - DNA, 25 bp, Mus musculus
tgaaaactcgggttgacctggcaag

SEQ ID NO: 793366 - DNA, 25 bp, Mus musculus
tgaaaactctgcctgctcagggtat

SEQ ID NO: 793367 - DNA, 25 bp, Mus musculus
tgaaaactctgcgtgctcagggtat

SEQ ID NO: 793368 - DNA, 25 bp, Mus musculus
tgaaaactgaagacgcccaaagggt

SEQ ID NO: 793369 - DNA, 25 bp, Mus musculus
tgaaaactgaagtcgcccaaagggt

SEQ ID NO: 793370 - DNA, 25 bp, Mus musculus
tgaaaacttgccagcaaagagaacg

SEQ ID NO: 793371 - DNA, 25 bp, Mus musculus
tgaaaacttgcctgcaaagagaacg

SEQ ID NO: 793372 - DNA, 25 bp, Mus musculus
tgaaaacttggtccgactaaacctt

SEQ ID NO: 793373 - DNA, 25 bp, Mus musculus
tgaaaacttggtgcgactaaacctt

SEQ ID NO: 793374 - DNA, 25 bp, Mus musculus
tgaaaagaagccaagttgtgattgc

SEQ ID NO: 793375 - DNA, 25 bp, Mus musculus
tgaaaagaagcctagttgtgattgc

SEQ ID NO: 793376 - DNA, 25 bp, Mus musculus
tgaaaagaatacaggagctagctcc

SEQ ID NO: 793377 - DNA, 25 bp, Mus musculus
tgaaaagaatactggagctagctcc

SEQ ID NO: 793378 - DNA, 25 bp, Mus musculus
tgaaaagacagcacgattggagacg

SEQ ID NO: 793379 - DNA, 25 bp, Mus musculus
tgaaaagacagctcgattggagacg

SEQ ID NO: 793380 - DNA, 25 bp, Mus musculus
tgaaaagacatcatagcgccaggtc

SEQ ID NO: 793381 - DNA, 25 bp, Mus musculus
tgaaaagacatcttagcgccaggtc

SEQ ID NO: 793382 - DNA, 25 bp, Mus musculus
tgaaaagacggaagcttccttggta

SEQ ID NO: 793383 - DNA, 25 bp, Mus musculus
tgaaaagacggatgcttccttggta

SEQ ID NO: 793384 - DNA, 25 bp, Mus musculus
tgaaaagagcgaccgatgctcagcc

SEQ ID NO: 793385 - DNA, 25 bp, Mus musculus
tgaaaagagcgagcgatgctcagcc

SEQ ID NO: 793386 - DNA, 25 bp, Mus musculus
tgaaaagagtcaacaatccaagagc

SEQ ID NO: 793387 - DNA, 25 bp, Mus musculus
tgaaaagagtcatcaatccaagagc

SEQ ID NO: 793388 - DNA, 25 bp, Mus musculus
tgaaaagatagaagacctcgtcccc

SEQ ID NO: 793389 - DNA, 25 bp, Mus musculus
tgaaaagatagatgacctcgtcccc

SEQ ID NO: 793390 - DNA, 25 bp, Mus musculus
tgaaaagatcaaattccagaaggtt

SEQ ID NO: 793391 - DNA, 25 bp, Mus musculus
tgaaaagatcaatttccagaaggtt

SEQ ID NO: 793392 - DNA, 25 bp, Mus musculus
tgaaaagattaactcagaagggacc

SEQ ID NO: 793393 - DNA, 25 bp, Mus musculus
tgaaaagattaagtcagaagggacc

SEQ ID NO: 793394 - DNA, 25 bp, Mus musculus
tgaaaagattagcaagaaatacccg

SEQ ID NO: 793395 - DNA, 25 bp, Mus musculus
tgaaaagattaggaagaaatacccg

SEQ ID NO: 793396 - DNA, 25 bp, Mus musculus
tgaaaagattggatcggaagaatga

SEQ ID NO: 793397 - DNA, 25 bp, Mus musculus
tgaaaagattggttcggaagaatga

SEQ ID NO: 793398 - DNA, 25 bp, Mus musculus
tgaaaagcagaacagagccacgagg

SEQ ID NO: 793399 - DNA, 25 bp, Mus musculus
tgaaaagcagaagagagccacgagg

SEQ ID NO: 793400 - DNA, 25 bp, Mus musculus
tgaaaagccaccagaaggagccgac

SEQ ID NO: 793401 - DNA, 25 bp, Mus musculus
tgaaaagccacctgaaggagccgac

SEQ ID NO: 793402 - DNA, 25 bp, Mus musculus
tgaaaagcctgacctgcgtgcatca

SEQ ID NO: 793403 - DNA, 25 bp, Mus musculus
tgaaaagcctgagctgcgtgcatca

SEQ ID NO: 793404 - DNA, 25 bp, Mus musculus
tgaaaagcgaatatatatcccattg

SEQ ID NO: 793405 - DNA, 25 bp, Mus musculus
tgaaaagcgaatttatatcccattg

SEQ ID NO: 793406 - DNA, 25 bp, Mus musculus
tgaaaagctaagcaccacggtgacc

SEQ ID NO: 793407 - DNA, 25 bp, Mus musculus
tgaaaagctaaggaccacggtgacc

SEQ ID NO: 793408 - DNA, 25 bp, Mus musculus
tgaaaagctagccaaaggggaacct

SEQ ID NO: 793409 - DNA, 25 bp, Mus musculus
tgaaaagctagcgaaaggggaacct

SEQ ID NO: 793410 - DNA, 25 bp, Mus musculus
tgaaaagctgcaagactcggtggtc

SEQ ID NO: 793411 - DNA, 25 bp, Mus musculus
tgaaaagctgcatgactcggtggtc

SEQ ID NO: 793412 - DNA, 25 bp, Mus musculus
tgaaaagcttgtcggcagtccagcc

SEQ ID NO: 793413 - DNA, 25 bp, Mus musculus
tgaaaagcttgtgggcagtccagcc

SEQ ID NO: 793414 - DNA, 25 bp, Mus musculus
tgaaaaggaaggagtcaaagtcgga

SEQ ID NO: 793415 - DNA, 25 bp, Mus musculus
tgaaaaggaaggtgtcaaagtcgga

SEQ ID NO: 793416 - DNA, 25 bp, Mus musculus
tgaaaaggacctctcgaagtgttgg

SEQ ID NO: 793417 - DNA, 25 bp, Mus musculus
tgaaaaggacctgtcgaagtgttgg

SEQ ID NO: 793418 - DNA, 25 bp, Mus musculus
tgaaaaggatggacgaagtcctaac

SEQ ID NO: 793419 - DNA, 25 bp, Mus musculus
tgaaaaggatggtcgaagtcctaac

SEQ ID NO: 793420 - DNA, 25 bp, Mus musculus
tgaaaagggcccagcgtggcgctca

SEQ ID NO: 793421 - DNA, 25 bp, Mus musculus
tgaaaagggccctgcgtggcgctca

SEQ ID NO: 793422 - DNA, 25 bp, Mus musculus
tgaaaaggttgtactccagctcttt

SEQ ID NO: 793423 - DNA, 25 bp, Mus musculus
tgaaaaggttgttctccagctcttt

SEQ ID NO: 793424 - DNA, 25 bp, Mus musculus
tgaaaagtcatacagcagtgccgcc

SEQ ID NO: 793425 - DNA, 25 bp, Mus musculus
tgaaaagtcatagagcagtgccgcc

SEQ ID NO: 793426 - DNA, 25 bp, Mus musculus
tgaaaagtcggaaacttaaagacat

SEQ ID NO: 793427 - DNA, 25 bp, Mus musculus
tgaaaagtcggatacttaaagacat

SEQ ID NO: 793428 - DNA, 25 bp, Mus musculus
tgaaaagtgcacatcactgccctga

SEQ ID NO: 793429 - DNA, 25 bp, Mus musculus
tgaaaagtgcacttcactgccctga

SEQ ID NO: 793430 - DNA, 25 bp, Mus musculus
tgaaaagtgctaacaccgagagtga

SEQ ID NO: 793431 - DNA, 25 bp, Mus musculus
tgaaaagtgctatcaccgagagtga

SEQ ID NO: 793432 - DNA, 25 bp, Mus musculus
tgaaaataaactacctagagaagac

SEQ ID NO: 793433 - DNA, 25 bp, Mus musculus
tgaaaataaacttcctagagaagac

SEQ ID NO: 793434 - DNA, 25 bp, Mus musculus
tgaaaataagagagcttccaacttg

SEQ ID NO: 793435 - DNA, 25 bp, Mus musculus
tgaaaataagagtgcttccaacttg

SEQ ID NO: 793436 - DNA, 25 bp, Mus musculus
tgaaaataaggaagttggagacctc

SEQ ID NO: 793437 - DNA, 25 bp, Mus musculus
tgaaaataaggatgttggagacctc

SEQ ID NO: 793438 - DNA, 25 bp, Mus musculus
tgaaaatatccaactaccgcacaca

SEQ ID NO: 793439 - DNA, 25 bp, Mus musculus
tgaaaatatccatctaccgcacaca

SEQ ID NO: 793440 - DNA, 25 bp, Mus musculus
tgaaaatatgctcaaaccctttgga

SEQ ID NO: 793441 - DNA, 25 bp, Mus musculus
tgaaaatatgctgaaaccctttgga

SEQ ID NO: 793442 - DNA, 25 bp, Mus musculus
tgaaaatcacggcagaactgcagcc

SEQ ID NO: 793443 - DNA, 25 bp, Mus musculus
tgaaaatcacgggagaactgcagcc

SEQ ID NO: 793444 - DNA, 25 bp, Mus musculus
tgaaaatccacaagtagtacctgag

SEQ ID NO: 793445 - DNA, 25 bp, Mus musculus
tgaaaatccacatgtagtacctgag

SEQ ID NO: 793446 - DNA, 25 bp, Mus musculus
tgaaaatcccgacttactaacaaca

SEQ ID NO: 793447 - DNA, 25 bp, Mus musculus
tgaaaatcccgagttactaacaaca

SEQ ID NO: 793448 - DNA, 25 bp, Mus musculus
tgaaaatcgaccacacgggcttcag

SEQ ID NO: 793449 - DNA, 25 bp, Mus musculus
tgaaaatcgacctcacgggcttcag

SEQ ID NO: 793450 - DNA, 25 bp, Mus musculus
tgaaaatcgggcactaaaagatgaa

SEQ ID NO: 793451 - DNA, 25 bp, Mus musculus
tgaaaatcgggctctaaaagatgaa

SEQ ID NO: 793452 - DNA, 25 bp, Mus musculus
tgaaaatctcctagcctgtgatcct

SEQ ID NO: 793453 - DNA, 25 bp, Mus musculus
tgaaaatctccttgcctgtgatcct

SEQ ID NO: 793454 - DNA, 25 bp, Mus musculus
tgaaaatgaactatggacctcgctg

SEQ ID NO: 793455 - DNA, 25 bp, Mus musculus
tgaaaatgaactttggacctcgctg

SEQ ID NO: 793456 - DNA, 25 bp, Mus musculus
tgaaaatgacgacgaagaatacgag

SEQ ID NO: 793457 - DNA, 25 bp, Mus musculus
tgaaaatgacgaggaagaatacgag

SEQ ID NO: 793458 - DNA, 25 bp, Mus musculus
tgaaaatgaggaagactgctggaat

SEQ ID NO: 793459 - DNA, 25 bp, Mus musculus
tgaaaatgaggatgactgctggaat

SEQ ID NO: 793460 - DNA, 25 bp, Mus musculus
tgaaaatgaggtccctgagcctcct

SEQ ID NO: 793461 - DNA, 25 bp, Mus musculus
tgaaaatgaggtgcctgagcctcct

SEQ ID NO: 793462 - DNA, 25 bp, Mus musculus
tgaaaatgatatatccgcattcacc

SEQ ID NO: 793463 - DNA, 25 bp, Mus musculus
tgaaaatgatatttccgcattcacc

SEQ ID NO: 793464 - DNA, 25 bp, Mus musculus
tgaaaatgatttcaaggcactacaa

SEQ ID NO: 793465 - DNA, 25 bp, Mus musculus
tgaaaatgatttgaaggcactacaa

SEQ ID NO: 793466 - DNA, 25 bp, Mus musculus
tgaaaatgccaaaggaaggaagcct

SEQ ID NO: 793467 - DNA, 25 bp, Mus musculus
tgaaaatgccaatggaaggaagcct

SEQ ID NO: 793468 - DNA, 25 bp, Mus musculus
tgaaaatgccaccttggagaaaacc

SEQ ID NO: 793469 - DNA, 25 bp, Mus musculus
tgaaaatgccacgttggagaaaacc

SEQ ID NO: 793470 - DNA, 25 bp, Mus musculus
tgaaaatgctatagcccaagtggct

SEQ ID NO: 793471 - DNA, 25 bp, Mus musculus
tgaaaatgctattgcccaagtggct

SEQ ID NO: 793472 - DNA, 25 bp, Mus musculus
tgaaaatgctccagacatccagcgt

SEQ ID NO: 793473 - DNA, 25 bp, Mus musculus
tgaaaatgctcctgacatccagcgt

SEQ ID NO: 793474 - DNA, 25 bp, Mus musculus
tgaaaatgctgcagtgccggagctg

SEQ ID NO: 793475 - DNA, 25 bp, Mus musculus
tgaaaatgctgctgtgccggagctg

SEQ ID NO: 793476 - DNA, 25 bp, Mus musculus
tgaaaatggagcattcctagcagag

SEQ ID NO: 793477 - DNA, 25 bp, Mus musculus
tgaaaatggagctttcctagcagag

SEQ ID NO: 793478 - DNA, 25 bp, Mus musculus
tgaaaatggaggactacggccgtcc

SEQ ID NO: 793479 - DNA, 25 bp, Mus musculus
tgaaaatggaggtctacggccgtcc

SEQ ID NO: 793480 - DNA, 25 bp, Mus musculus
tgaaaatggccacaggatccgtgtc

SEQ ID NO: 793481 - DNA, 25 bp, Mus musculus
tgaaaatggccagaggatccgtgtc

SEQ ID NO: 793482 - DNA, 25 bp, Mus musculus
tgaaaattcagaagctgttactgag

SEQ ID NO: 793483 - DNA, 25 bp, Mus musculus
tgaaaattcagatgctgttactgag

SEQ ID NO: 793484 - DNA, 25 bp, Mus musculus
tgaaaattgcaacttgctagaagaa

SEQ ID NO: 793485 - DNA, 25 bp, Mus musculus
tgaaaattgcaagttgctagaagaa

SEQ ID NO: 793486 - DNA, 25 bp, Mus musculus
tgaaaattggagattttggtttggc

SEQ ID NO: 793487 - DNA, 25 bp, Mus musculus
tgaaaattggagtttttggtttggc

SEQ ID NO: 793488 - DNA, 25 bp, Mus musculus
tgaaaattgtgccaaagcctacata

SEQ ID NO: 793489 - DNA, 25 bp, Mus musculus
tgaaaattgtgcgaaagcctacata

SEQ ID NO: 793490 - DNA, 25 bp, Mus musculus
tgaaaatttacgaaaaagcctattg

SEQ ID NO: 793491 - DNA, 25 bp, Mus musculus
tgaaaatttacgtaaaagcctattg

SEQ ID NO: 793492 - DNA, 25 bp, Mus musculus
tgaaaatttttccttggctacagca

SEQ ID NO: 793493 - DNA, 25 bp, Mus musculus
tgaaaatttttcgttggctacagca

SEQ ID NO: 793494 - DNA, 25 bp, Mus musculus
tgaaacaacagaaacaaccactcga

SEQ ID NO: 793495 - DNA, 25 bp, Mus musculus
tgaaacaacagatacaaccactcga

SEQ ID NO: 793496 - DNA, 25 bp, Mus musculus
tgaaacaagctaagaagttctggtc

SEQ ID NO: 793497 - DNA, 25 bp, Mus musculus
tgaaacaagctatgaagttctggtc

SEQ ID NO: 793498 - DNA, 25 bp, Mus musculus
tgaaacaatgatctggcagctccag

SEQ ID NO: 793499 - DNA, 25 bp, Mus musculus
tgaaacaatgatgtggcagctccag

SEQ ID NO: 793500 - DNA, 25 bp, Mus musculus
tgaaacacaacactgtcctcatggc

SEQ ID NO: 793501 - DNA, 25 bp, Mus musculus
tgaaacacaacagtgtcctcatggc

SEQ ID NO: 793502 - DNA, 25 bp, Mus musculus
tgaaacacagttctcagagtccatg

SEQ ID NO: 793503 - DNA, 25 bp, Mus musculus
tgaaacacagttgtcagagtccatg

SEQ ID NO: 793504 - DNA, 25 bp, Mus musculus
tgaaacacccatatttccaagtcgg

SEQ ID NO: 793505 - DNA, 25 bp, Mus musculus
tgaaacacccatttttccaagtcgg

SEQ ID NO: 793506 - DNA, 25 bp, Mus musculus
tgaaacaccggaagctccgggaaca

SEQ ID NO: 793507 - DNA, 25 bp, Mus musculus
tgaaacaccggatgctccgggaaca

SEQ ID NO: 793508 - DNA, 25 bp, Mus musculus
tgaaacacctgcaacctgagcagat

SEQ ID NO: 793509 - DNA, 25 bp, Mus musculus
tgaaacacctgctacctgagcagat

SEQ ID NO: 793510 - DNA, 25 bp, Mus musculus
tgaaacactgccaggatggaaagca

SEQ ID NO: 793511 - DNA, 25 bp, Mus musculus
tgaaacactgcctggatggaaagca

SEQ ID NO: 793512 - DNA, 25 bp, Mus musculus
tgaaacagactaccccgaattactg

SEQ ID NO: 793513 - DNA, 25 bp, Mus musculus
tgaaacagactagcccgaattactg

SEQ ID NO: 793514 - DNA, 25 bp, Mus musculus
tgaaacagatccacttaaattcggg

SEQ ID NO: 793515 - DNA, 25 bp, Mus musculus
tgaaacagatcctcttaaattcggg

SEQ ID NO: 793516 - DNA, 25 bp, Mus musculus
tgaaacagattgcaagaaacaaatt

SEQ ID NO: 793517 - DNA, 25 bp, Mus musculus
tgaaacagattggaagaaacaaatt

SEQ ID NO: 793518 - DNA, 25 bp, Mus musculus
tgaaacagcataaccaccattaaaa

SEQ ID NO: 793519 - DNA, 25 bp, Mus musculus
tgaaacagcatatccaccattaaaa

SEQ ID NO: 793520 - DNA, 25 bp, Mus musculus
tgaaacagctggatcactgagacct

SEQ ID NO: 793521 - DNA, 25 bp, Mus musculus
tgaaacagctggttcactgagacct

SEQ ID NO: 793522 - DNA, 25 bp, Mus musculus
tgaaacagcttgacaagaacaaact

SEQ ID NO: 793523 - DNA, 25 bp, Mus musculus
tgaaacagcttgtcaagaacaaact

SEQ ID NO: 793524 - DNA, 25 bp, Mus musculus
tgaaacaggacaccaagcagatcca

SEQ ID NO: 793525 - DNA, 25 bp, Mus musculus
tgaaacaggacagcaagcagatcca

SEQ ID NO: 793526 - DNA, 25 bp, Mus musculus
tgaaacaggagaatactatatgctt

SEQ ID NO: 793527 - DNA, 25 bp, Mus musculus
tgaaacaggagattactatatgctt

SEQ ID NO: 793528 - DNA, 25 bp, Mus musculus
tgaaacaggcgcacagccctgacat

SEQ ID NO: 793529 - DNA, 25 bp, Mus musculus
tgaaacaggcgctcagccctgacat

SEQ ID NO: 793530 - DNA, 25 bp, Mus musculus
tgaaacagtgcccaaatgcagtagt

SEQ ID NO: 793531 - DNA, 25 bp, Mus musculus
tgaaacagtgccgaaatgcagtagt

SEQ ID NO: 793532 - DNA, 25 bp, Mus musculus
tgaaacagttggctcgacaggcact

SEQ ID NO: 793533 - DNA, 25 bp, Mus musculus
tgaaacagttgggtcgacaggcact

SEQ ID NO: 793534 - DNA, 25 bp, Mus musculus
tgaaacataaggatggctcctccgg

SEQ ID NO: 793535 - DNA, 25 bp, Mus musculus
tgaaacataaggttggctcctccgg

SEQ ID NO: 793536 - DNA, 25 bp, Mus musculus
tgaaacatccaaagtgctccgtgga

SEQ ID NO: 793537 - DNA, 25 bp, Mus musculus
tgaaacatccaatgtgctccgtgga

SEQ ID NO: 793538 - DNA, 25 bp, Mus musculus
tgaaacatccagcaagacaggcaaa

SEQ ID NO: 793539 - DNA, 25 bp, Mus musculus
tgaaacatccaggaagacaggcaaa

SEQ ID NO: 793540 - DNA, 25 bp, Mus musculus
tgaaacatctagaagacattgtgga

SEQ ID NO: 793541 - DNA, 25 bp, Mus musculus
tgaaacatctagtagacattgtgga

SEQ ID NO: 793542 - DNA, 25 bp, Mus musculus
tgaaacattcaactactgggaacca

SEQ ID NO: 793543 - DNA, 25 bp, Mus musculus
tgaaacattcaagtactgggaacca

SEQ ID NO: 793544 - DNA, 25 bp, Mus musculus
tgaaaccaaaagagcttatagcttg

SEQ ID NO: 793545 - DNA, 25 bp, Mus musculus
tgaaaccaaaagtgcttatagcttg

SEQ ID NO: 793546 - DNA, 25 bp, Mus musculus
tgaaaccaaagaaacgtaaatgtgg

SEQ ID NO: 793547 - DNA, 25 bp, Mus musculus
tgaaaccaaagatacgtaaatgtgg

SEQ ID NO: 793548 - DNA, 25 bp, Mus musculus
tgaaaccaaatgaccagatcttggc

SEQ ID NO: 793549 - DNA, 25 bp, Mus musculus
tgaaaccaaatgtccagatcttggc

SEQ ID NO: 793550 - DNA, 25 bp, Mus musculus
tgaaaccactggctcctccaagctt

SEQ ID NO: 793551 - DNA, 25 bp, Mus musculus
tgaaaccactgggtcctccaagctt

SEQ ID NO: 793552 - DNA, 25 bp, Mus musculus
tgaaaccagagacgaatatgacccc

SEQ ID NO: 793553 - DNA, 25 bp, Mus musculus
tgaaaccagagaggaatatgacccc

SEQ ID NO: 793554 - DNA, 25 bp, Mus musculus
tgaaaccagattactcatcagccga

SEQ ID NO: 793555 - DNA, 25 bp, Mus musculus
tgaaaccagatttctcatcagccga

SEQ ID NO: 793556 - DNA, 25 bp, Mus musculus
tgaaaccagccaacctaattacccg

SEQ ID NO: 793557 - DNA, 25 bp, Mus musculus
tgaaaccagccatcctaattacccg

SEQ ID NO: 793558 - DNA, 25 bp, Mus musculus
tgaaaccagtttacaaggagaatga

SEQ ID NO: 793559 - DNA, 25 bp, Mus musculus
tgaaaccagttttcaaggagaatga

SEQ ID NO: 793560 - DNA, 25 bp, Mus musculus
tgaaaccatcccatataacgatctg

SEQ ID NO: 793561 - DNA, 25 bp, Mus musculus
tgaaaccatcccttataacgatctg

SEQ ID NO: 793562 - DNA, 25 bp, Mus musculus
tgaaaccatgatcatagacaactgc

SEQ ID NO: 793563 - DNA, 25 bp, Mus musculus
tgaaaccatgatgatagacaactgc

SEQ ID NO: 793564 - DNA, 25 bp, Mus musculus
tgaaacccaacaagtagctgcccag

SEQ ID NO: 793565 - DNA, 25 bp, Mus musculus
tgaaacccaacatgtagctgcccag

SEQ ID NO: 793566 - DNA, 25 bp, Mus musculus
tgaaacccacgcacacagcacttgt

SEQ ID NO: 793567 - DNA, 25 bp, Mus musculus
tgaaacccacgctcacagcacttgt

SEQ ID NO: 793568 - DNA, 25 bp, Mus musculus
tgaaacccatagagaccccacgctt

SEQ ID NO: 793569 - DNA, 25 bp, Mus musculus
tgaaacccatagtgaccccacgctt

SEQ ID NO: 793570 - DNA, 25 bp, Mus musculus
tgaaacccatttacttaggactgtg

SEQ ID NO: 793571 - DNA, 25 bp, Mus musculus
tgaaacccattttcttaggactgtg

SEQ ID NO: 793572 - DNA, 25 bp, Mus musculus
tgaaaccccagaacgagtcttcgtg

SEQ ID NO: 793573 - DNA, 25 bp, Mus musculus
tgaaaccccagatcgagtcttcgtg

SEQ ID NO: 793574 - DNA, 25 bp, Mus musculus
tgaaaccgaagacggaacagtgcag

SEQ ID NO: 793575 - DNA, 25 bp, Mus musculus
tgaaaccgaagagggaacagtgcag

SEQ ID NO: 793576 - DNA, 25 bp, Mus musculus
tgaaaccgacctcaaacagattaat

SEQ ID NO: 793577 - DNA, 25 bp, Mus musculus
tgaaaccgacctgaaacagattaat

SEQ ID NO: 793578 - DNA, 25 bp, Mus musculus
tgaaaccgcagaaccttctcatcag

SEQ ID NO: 793579 - DNA, 25 bp, Mus musculus
tgaaaccgcagatccttctcatcag

SEQ ID NO: 793580 - DNA, 25 bp, Mus musculus
tgaaaccggccacgtacctggtgcc

SEQ ID NO: 793581 - DNA, 25 bp, Mus musculus
tgaaaccggccaggtacctggtgcc

SEQ ID NO: 793582 - DNA, 25 bp, Mus musculus
tgaaacctagatcaagatccacttc

SEQ ID NO: 793583 - DNA, 25 bp, Mus musculus
tgaaacctagatgaagatccacttc

SEQ ID NO: 793584 - DNA, 25 bp, Mus musculus
tgaaacctatttcgcgataccctac

SEQ ID NO: 793585 - DNA, 25 bp, Mus musculus
tgaaacctatttggcgataccctac

SEQ ID NO: 793586 - DNA, 25 bp, Mus musculus
tgaaacctctgacggcactgagttc

SEQ ID NO: 793587 - DNA, 25 bp, Mus musculus
tgaaacctctgagggcactgagttc

SEQ ID NO: 793588 - DNA, 25 bp, Mus musculus
tgaaacctgactcccatctttcttt

SEQ ID NO: 793589 - DNA, 25 bp, Mus musculus
tgaaacctgactgccatctttcttt

SEQ ID NO: 793590 - DNA, 25 bp, Mus musculus
tgaaacctgagtatgagaagttttc

SEQ ID NO: 793591 - DNA, 25 bp, Mus musculus
tgaaacctgagtttgagaagttttc

SEQ ID NO: 793592 - DNA, 25 bp, Mus musculus
tgaaacgactgtaaagtttccaaag

SEQ ID NO: 793593 - DNA, 25 bp, Mus musculus
tgaaacgactgttaagtttccaaag

SEQ ID NO: 793594 - DNA, 25 bp, Mus musculus
tgaaacgagccgcaatctcacaggc

SEQ ID NO: 793595 - DNA, 25 bp, Mus musculus
tgaaacgagccggaatctcacaggc

SEQ ID NO: 793596 - DNA, 25 bp, Mus musculus
tgaaacgctacgaaggccctctctg

SEQ ID NO: 793597 - DNA, 25 bp, Mus musculus
tgaaacgctacgtaggccctctctg

SEQ ID NO: 793598 - DNA, 25 bp, Mus musculus
tgaaacgctctgaacagctgatgga

SEQ ID NO: 793599 - DNA, 25 bp, Mus musculus
tgaaacgctctgtacagctgatgga

SEQ ID NO: 793600 - DNA, 25 bp, Mus musculus
tgaaacgctgcaatcgcacagcagc

SEQ ID NO: 793601 - DNA, 25 bp, Mus musculus
tgaaacgctgcattcgcacagcagc

SEQ ID NO: 793602 - DNA, 25 bp, Mus musculus
tgaaacgctgcgctacagactctct

SEQ ID NO: 793603 - DNA, 25 bp, Mus musculus
tgaaacgctgcggtacagactctct

SEQ ID NO: 793604 - DNA, 25 bp, Mus musculus
tgaaacggaagaagaactccctcaa

SEQ ID NO: 793605 - DNA, 25 bp, Mus musculus
tgaaacggaagatgaactccctcaa

SEQ ID NO: 793606 - DNA, 25 bp, Mus musculus
tgaaactaaaacaggcaggctcccc

SEQ ID NO: 793607 - DNA, 25 bp, Mus musculus
tgaaactaaaactggcaggctcccc

SEQ ID NO: 793608 - DNA, 25 bp, Mus musculus
tgaaactaatttcaaagggtccctg

SEQ ID NO: 793609 - DNA, 25 bp, Mus musculus
tgaaactaatttgaaagggtccctg

SEQ ID NO: 793610 - DNA, 25 bp, Mus musculus
tgaaactacccacctaatgatactg

SEQ ID NO: 793611 - DNA, 25 bp, Mus musculus
tgaaactacccagctaatgatactg

SEQ ID NO: 793612 - DNA, 25 bp, Mus musculus
tgaaactaggtcagagaatgaggac

SEQ ID NO: 793613 - DNA, 25 bp, Mus musculus
tgaaactaggtctgagaatgaggac

SEQ ID NO: 793614 - DNA, 25 bp, Mus musculus
tgaaactatgtaacatggtgtccct

SEQ ID NO: 793615 - DNA, 25 bp, Mus musculus
tgaaactatgtatcatggtgtccct

SEQ ID NO: 793616 - DNA, 25 bp, Mus musculus
tgaaactcccacagcacacaatggg

SEQ ID NO: 793617 - DNA, 25 bp, Mus musculus
tgaaactcccactgcacacaatggg

SEQ ID NO: 793618 - DNA, 25 bp, Mus musculus
tgaaactccgtcatcagatggctgc

SEQ ID NO: 793619 - DNA, 25 bp, Mus musculus
tgaaactccgtcttcagatggctgc

SEQ ID NO: 793620 - DNA, 25 bp, Mus musculus
tgaaactcgggcagagtttgcagag

SEQ ID NO: 793621 - DNA, 25 bp, Mus musculus
tgaaactcgggctgagtttgcagag

SEQ ID NO: 793622 - DNA, 25 bp, Mus musculus
tgaaactcgtggaaaacttctgccg

SEQ ID NO: 793623 - DNA, 25 bp, Mus musculus
tgaaactcgtggtaaacttctgccg

SEQ ID NO: 793624 - DNA, 25 bp, Mus musculus
tgaaactctgctagcagtggccaga

SEQ ID NO: 793625 - DNA, 25 bp, Mus musculus
tgaaactctgcttgcagtggccaga

SEQ ID NO: 793626 - DNA, 25 bp, Mus musculus
tgaaactgaagaccggtgtcaagcc

SEQ ID NO: 793627 - DNA, 25 bp, Mus musculus
tgaaactgaagagcggtgtcaagcc

SEQ ID NO: 793628 - DNA, 25 bp, Mus musculus
tgaaactgcgtgctccggatcaagc

SEQ ID NO: 793629 - DNA, 25 bp, Mus musculus
tgaaactgcgtggtccggatcaagc

SEQ ID NO: 793630 - DNA, 25 bp, Mus musculus
tgaaactggatgatcaaccaaagtg

SEQ ID NO: 793631 - DNA, 25 bp, Mus musculus
tgaaactggatgttcaaccaaagtg

SEQ ID NO: 793632 - DNA, 25 bp, Mus musculus
tgaaactgggaaatcactgaaggtg

SEQ ID NO: 793633 - DNA, 25 bp, Mus musculus
tgaaactgggaattcactgaaggtg

SEQ ID NO: 793634 - DNA, 25 bp, Mus musculus
tgaaactgtaaccattgaattgaag

SEQ ID NO: 793635 - DNA, 25 bp, Mus musculus
tgaaactgtaacgattgaattgaag

SEQ ID NO: 793636 - DNA, 25 bp, Mus musculus
tgaaactgtcaaactgactcaccta

SEQ ID NO: 793637 - DNA, 25 bp, Mus musculus
tgaaactgtcaatctgactcaccta

SEQ ID NO: 793638 - DNA, 25 bp, Mus musculus
tgaaactgttttcccagaatgcttc

SEQ ID NO: 793639 - DNA, 25 bp, Mus musculus
tgaaactgttttgccagaatgcttc

SEQ ID NO: 793640 - DNA, 25 bp, Mus musculus
tgaaacttgactacaaggatgtcct

SEQ ID NO: 793641 - DNA, 25 bp, Mus musculus
tgaaacttgacttcaaggatgtcct

SEQ ID NO: 793642 - DNA, 25 bp, Mus musculus
tgaaactttccgactttggcctttg

SEQ ID NO: 793643 - DNA, 25 bp, Mus musculus
tgaaactttccgtctttggcctttg

SEQ ID NO: 793644 - DNA, 25 bp, Mus musculus
tgaaagaaagccctccatctaaacc

SEQ ID NO: 793645 - DNA, 25 bp, Mus musculus
tgaaagaaagccgtccatctaaacc

SEQ ID NO: 793646 - DNA, 25 bp, Mus musculus
tgaaagaaagtacttgccaaccatt

SEQ ID NO: 793647 - DNA, 25 bp, Mus musculus
tgaaagaaagtagttgccaaccatt

SEQ ID NO: 793648 - DNA, 25 bp, Mus musculus
tgaaagaaatgcagggattaacctt

SEQ ID NO: 793649 - DNA, 25 bp, Mus musculus
tgaaagaaatgctgggattaacctt

SEQ ID NO: 793650 - DNA, 25 bp, Mus musculus
tgaaagaagattaaaggaagccgtg

SEQ ID NO: 793651 - DNA, 25 bp, Mus musculus
tgaaagaagatttaaggaagccgtg

SEQ ID NO: 793652 - DNA, 25 bp, Mus musculus
tgaaagaagcatcccagagtcatgt

SEQ ID NO: 793653 - DNA, 25 bp, Mus musculus
tgaaagaagcatgccagagtcatgt

SEQ ID NO: 793654 - DNA, 25 bp, Mus musculus
tgaaagaatttcctaaaaatagtgg

SEQ ID NO: 793655 - DNA, 25 bp, Mus musculus
tgaaagaatttcgtaaaaatagtgg

SEQ ID NO: 793656 - DNA, 25 bp, Mus musculus
tgaaagacaattcttccggcacgtt

SEQ ID NO: 793657 - DNA, 25 bp, Mus musculus
tgaaagacaattgttccggcacgtt

SEQ ID NO: 793658 - DNA, 25 bp, Mus musculus
tgaaagacacaaccgaaaaggagct

SEQ ID NO: 793659 - DNA, 25 bp, Mus musculus
tgaaagacacaactgtgtggatcat

SEQ ID NO: 793660 - DNA, 25 bp, Mus musculus
tgaaagacacaagcgaaaaggagct

SEQ ID NO: 793661 - DNA, 25 bp, Mus musculus
tgaaagacacaagtgtgtggatcat

SEQ ID NO: 793662 - DNA, 25 bp, Mus musculus
tgaaagacacgcagcagaaatggat

SEQ ID NO: 793663 - DNA, 25 bp, Mus musculus
tgaaagacacgctgcagaaatggat

SEQ ID NO: 793664 - DNA, 25 bp, Mus musculus
tgaaagacctggctcatgagccagg

SEQ ID NO: 793665 - DNA, 25 bp, Mus musculus
tgaaagacctgggtcatgagccagg

SEQ ID NO: 793666 - DNA, 25 bp, Mus musculus
tgaaagacgaagctgatgcggatct

SEQ ID NO: 793667 - DNA, 25 bp, Mus musculus
tgaaagacgaaggtgatgcggatct

SEQ ID NO: 793668 - DNA, 25 bp, Mus musculus
tgaaagacgccacgcagagaagaag

SEQ ID NO: 793669 - DNA, 25 bp, Mus musculus
tgaaagacgccaggcagagaagaag

SEQ ID NO: 793670 - DNA, 25 bp, Mus musculus
tgaaagactcacagggctggaccca

SEQ ID NO: 793671 - DNA, 25 bp, Mus musculus
tgaaagactcactgggctggaccca

SEQ ID NO: 793672 - DNA, 25 bp, Mus musculus
tgaaagacttggaacagctgatgac

SEQ ID NO: 793673 - DNA, 25 bp, Mus musculus
tgaaagacttggtacagctgatgac

SEQ ID NO: 793674 - DNA, 25 bp, Mus musculus
tgaaagagaagaacagcaagttttt

SEQ ID NO: 793675 - DNA, 25 bp, Mus musculus
tgaaagagaagatcagcaagttttt

SEQ ID NO: 793676 - DNA, 25 bp, Mus musculus
tgaaagagaaggacaaactcagcac

SEQ ID NO: 793677 - DNA, 25 bp, Mus musculus
tgaaagagaaggtcaaactcagcac

SEQ ID NO: 793678 - DNA, 25 bp, Mus musculus
tgaaagagatcacccgagatattaa

SEQ ID NO: 793679 - DNA, 25 bp, Mus musculus
tgaaagagatcagccgagatattaa

SEQ ID NO: 793680 - DNA, 25 bp, Mus musculus
tgaaagagatggaagagtccatcag

SEQ ID NO: 793681 - DNA, 25 bp, Mus musculus
tgaaagagatggtagagtccatcag

SEQ ID NO: 793682 - DNA, 25 bp, Mus musculus
tgaaagagcatgaccaccttcgaaa

SEQ ID NO: 793683 - DNA, 25 bp, Mus musculus
tgaaagagcatgtccaccttcgaaa

SEQ ID NO: 793684 - DNA, 25 bp, Mus musculus
tgaaagaggcacaggagcgctatgc

SEQ ID NO: 793685 - DNA, 25 bp, Mus musculus
tgaaagaggcactggagcgctatgc

SEQ ID NO: 793686 - DNA, 25 bp, Mus musculus
tgaaagaggcccacttcaaggccca

SEQ ID NO: 793687 - DNA, 25 bp, Mus musculus
tgaaagaggcccctcccaatacaga

SEQ ID NO: 793688 - DNA, 25 bp, Mus musculus
tgaaagaggcccgtcccaatacaga

SEQ ID NO: 793689 - DNA, 25 bp, Mus musculus
tgaaagaggccctcttcaaggccca

SEQ ID NO: 793690 - DNA, 25 bp, Mus musculus
tgaaagagtgagacctgggtcagcc

SEQ ID NO: 793691 - DNA, 25 bp, Mus musculus
tgaaagagtgagtcctgggtcagcc

SEQ ID NO: 793692 - DNA, 25 bp, Mus musculus
tgaaagataaacctgaggaggaagc

SEQ ID NO: 793693 - DNA, 25 bp, Mus musculus
tgaaagataaacgtgaggaggaagc

SEQ ID NO: 793694 - DNA, 25 bp, Mus musculus
tgaaagatctgacgaggcttgtttt

SEQ ID NO: 793695 - DNA, 25 bp, Mus musculus
tgaaagatctgaggaggcttgtttt

SEQ ID NO: 793696 - DNA, 25 bp, Mus musculus
tgaaagatgtacagagcaatctgat

SEQ ID NO: 793697 - DNA, 25 bp, Mus musculus
tgaaagatgtactgagcaatctgat

SEQ ID NO: 793698 - DNA, 25 bp, Mus musculus
tgaaagattccacagagatccccgg

SEQ ID NO: 793699 - DNA, 25 bp, Mus musculus
tgaaagattccagagagatccccgg

SEQ ID NO: 793700 - DNA, 25 bp, Mus musculus
tgaaagatttggaagaaatgtgccg

SEQ ID NO: 793701 - DNA, 25 bp, Mus musculus
tgaaagatttggtagaaatgtgccg

SEQ ID NO: 793702 - DNA, 25 bp, Mus musculus
tgaaagcaacttacaagcaggccgg

SEQ ID NO: 793703 - DNA, 25 bp, Mus musculus
tgaaagcaactttcaagcaggccgg

SEQ ID NO: 793704 - DNA, 25 bp, Mus musculus
tgaaagcaagtcctaagagaggacg

SEQ ID NO: 793705 - DNA, 25 bp, Mus musculus
tgaaagcaagtcgtaagagaggacg

SEQ ID NO: 793706 - DNA, 25 bp, Mus musculus
tgaaagcaattgcaaggcagcggtt

SEQ ID NO: 793707 - DNA, 25 bp, Mus musculus
tgaaagcaattggaaggcagcggtt

SEQ ID NO: 793708 - DNA, 25 bp, Mus musculus
tgaaagcaccataagcaccacagaa

SEQ ID NO: 793709 - DNA, 25 bp, Mus musculus
tgaaagcaccattagcaccacagaa

SEQ ID NO: 793710 - DNA, 25 bp, Mus musculus
tgaaagcagaaaccatgaccgtcag

SEQ ID NO: 793711 - DNA, 25 bp, Mus musculus
tgaaagcagaaagcatgaccgtcag

SEQ ID NO: 793712 - DNA, 25 bp, Mus musculus
tgaaagcatcctctgccagtgttgg

SEQ ID NO: 793713 - DNA, 25 bp, Mus musculus
tgaaagcatcctgtgccagtgttgg

SEQ ID NO: 793714 - DNA, 25 bp, Mus musculus
tgaaagcatggaaagcagaccgggc

SEQ ID NO: 793715 - DNA, 25 bp, Mus musculus
tgaaagcatggacaagaccaggatg

SEQ ID NO: 793716 - DNA, 25 bp, Mus musculus
tgaaagcatggagaagaccaggatg

SEQ ID NO: 793717 - DNA, 25 bp, Mus musculus
tgaaagcatggatagcagaccgggc

SEQ ID NO: 793718 - DNA, 25 bp, Mus musculus
tgaaagccaagcacagatcgctgaa

SEQ ID NO: 793719 - DNA, 25 bp, Mus musculus
tgaaagccaagctcagatcgctgaa

SEQ ID NO: 793720 - DNA, 25 bp, Mus musculus
tgaaagccacccatggctccaggga

SEQ ID NO: 793721 - DNA, 25 bp, Mus musculus
tgaaagccacccttggctccaggga

SEQ ID NO: 793722 - DNA, 25 bp, Mus musculus
tgaaagccacgtacatccactctcg

SEQ ID NO: 793723 - DNA, 25 bp, Mus musculus
tgaaagccacgttcatccactctcg

SEQ ID NO: 793724 - DNA, 25 bp, Mus musculus
tgaaagccctctcggtgcttcgcta

SEQ ID NO: 793725 - DNA, 25 bp, Mus musculus
tgaaagccctctgggtgcttcgcta

SEQ ID NO: 793726 - DNA, 25 bp, Mus musculus
tgaaagccctggacaagattgtgcc

SEQ ID NO: 793727 - DNA, 25 bp, Mus musculus
tgaaagccctggtcaagattgtgcc

SEQ ID NO: 793728 - DNA, 25 bp, Mus musculus
tgaaagccggacagtggcagtgaaa

SEQ ID NO: 793729 - DNA, 25 bp, Mus musculus
tgaaagccggactgtggcagtgaaa

SEQ ID NO: 793730 - DNA, 25 bp, Mus musculus
tgaaagccgggtacgagagttaagc

SEQ ID NO: 793731 - DNA, 25 bp, Mus musculus
tgaaagccgggttcgagagttaagc

SEQ ID NO: 793732 - DNA, 25 bp, Mus musculus
tgaaagcctagcagtgaagtacgtg

SEQ ID NO: 793733 - DNA, 25 bp, Mus musculus
tgaaagcctagctgtgaagtacgtg

SEQ ID NO: 793734 - DNA, 25 bp, Mus musculus
tgaaagcctaggaaccgactctggc

SEQ ID NO: 793735 - DNA, 25 bp, Mus musculus
tgaaagcctaggtaccgactctggc

SEQ ID NO: 793736 - DNA, 25 bp, Mus musculus
tgaaagcctatcaggccgagtcaag

SEQ ID NO: 793737 - DNA, 25 bp, Mus musculus
tgaaagcctatctggccgagtcaag

SEQ ID NO: 793738 - DNA, 25 bp, Mus musculus
tgaaagcctcagaagtgaagagcag

SEQ ID NO: 793739 - DNA, 25 bp, Mus musculus
tgaaagcctcagtagtgaagagcag

SEQ ID NO: 793740 - DNA, 25 bp, Mus musculus
tgaaagcctggacattccaacccag

SEQ ID NO: 793741 - DNA, 25 bp, Mus musculus
tgaaagcctggagattccaacccag

SEQ ID NO: 793742 - DNA, 25 bp, Mus musculus
tgaaagcgggccacagatgaaggtc

SEQ ID NO: 793743 - DNA, 25 bp, Mus musculus
tgaaagcgggcctcagatgaaggtc

SEQ ID NO: 793744 - DNA, 25 bp, Mus musculus
tgaaagctctttcgccaacaatgtc

SEQ ID NO: 793745 - DNA, 25 bp, Mus musculus
tgaaagctctttggccaacaatgtc

SEQ ID NO: 793746 - DNA, 25 bp, Mus musculus
tgaaagctgacaatctcaaaaaacg

SEQ ID NO: 793747 - DNA, 25 bp, Mus musculus
tgaaagctgacattctcaaaaaacg

SEQ ID NO: 793748 - DNA, 25 bp, Mus musculus
tgaaagctgatcaacactgtttaga

SEQ ID NO: 793749 - DNA, 25 bp, Mus musculus
tgaaagctgatctacactgtttaga

SEQ ID NO: 793750 - DNA, 25 bp, Mus musculus
tgaaagctgcccaagtttaaaaggt

SEQ ID NO: 793751 - DNA, 25 bp, Mus musculus
tgaaagctgccctagtttaaaaggt

SEQ ID NO: 793752 - DNA, 25 bp, Mus musculus
tgaaagctgctaatctgtggcagga

SEQ ID NO: 793753 - DNA, 25 bp, Mus musculus
tgaaagctgctattctgtggcagga

SEQ ID NO: 793754 - DNA, 25 bp, Mus musculus
tgaaagctggagacagagtaaaagc

SEQ ID NO: 793755 - DNA, 25 bp, Mus musculus
tgaaagctggagtcagagtaaaagc

SEQ ID NO: 793756 - DNA, 25 bp, Mus musculus
tgaaagctggtaatgagatcaaccg

SEQ ID NO: 793757 - DNA, 25 bp, Mus musculus
tgaaagctggtattgagatcaaccg

SEQ ID NO: 793758 - DNA, 25 bp, Mus musculus
tgaaaggaaacaataagaaggagct

SEQ ID NO: 793759 - DNA, 25 bp, Mus musculus
tgaaaggaaacattaagaaggagct

SEQ ID NO: 793760 - DNA, 25 bp, Mus musculus
tgaaaggaaataaagtgaatgaggt

SEQ ID NO: 793761 - DNA, 25 bp, Mus musculus
tgaaaggaaatatagtgaatgaggt

SEQ ID NO: 793762 - DNA, 25 bp, Mus musculus
tgaaaggacaaccaaagcagggcct

SEQ ID NO: 793763 - DNA, 25 bp, Mus musculus
tgaaaggacaacgaaagcagggcct

SEQ ID NO: 793764 - DNA, 25 bp, Mus musculus
tgaaaggacacactttacaacagcc

SEQ ID NO: 793765 - DNA, 25 bp, Mus musculus
tgaaaggacacagtttacaacagcc

SEQ ID NO: 793766 - DNA, 25 bp, Mus musculus
tgaaaggacctaacgcgccacctta

SEQ ID NO: 793767 - DNA, 25 bp, Mus musculus
tgaaaggacctatcgcgccacctta

SEQ ID NO: 793768 - DNA, 25 bp, Mus musculus
tgaaaggactaaagcacgccaacat

SEQ ID NO: 793769 - DNA, 25 bp, Mus musculus
tgaaaggactaatgcacgccaacat

SEQ ID NO: 793770 - DNA, 25 bp, Mus musculus
tgaaaggactgcatctccaggagcc

SEQ ID NO: 793771 - DNA, 25 bp, Mus musculus
tgaaaggactgcttctccaggagcc

SEQ ID NO: 793772 - DNA, 25 bp, Mus musculus
tgaaaggagactactttaggtatct

SEQ ID NO: 793773 - DNA, 25 bp, Mus musculus
tgaaaggagacttctttaggtatct

SEQ ID NO: 793774 - DNA, 25 bp, Mus musculus
tgaaaggagctactgtaaacaaaca

SEQ ID NO: 793775 - DNA, 25 bp, Mus musculus
tgaaaggagctagtgtaaacaaaca

SEQ ID NO: 793776 - DNA, 25 bp, Mus musculus
tgaaaggagtctagcagcacagagc

SEQ ID NO: 793777 - DNA, 25 bp, Mus musculus
tgaaaggagtcttgcagcacagagc

SEQ ID NO: 793778 - DNA, 25 bp, Mus musculus
tgaaaggattaacggctccttcctt

SEQ ID NO: 793779 - DNA, 25 bp, Mus musculus
tgaaaggattaagggctccttcctt

SEQ ID NO: 793780 - DNA, 25 bp, Mus musculus
tgaaaggattctaagggaatttctt

SEQ ID NO: 793781 - DNA, 25 bp, Mus musculus
tgaaaggattcttagggaatttctt

SEQ ID NO: 793782 - DNA, 25 bp, Mus musculus
tgaaaggcaacaatcgcctgggcaa

SEQ ID NO: 793783 - DNA, 25 bp, Mus musculus
tgaaaggcaacattcgcctgggcaa

SEQ ID NO: 793784 - DNA, 25 bp, Mus musculus
tgaaaggcacagcaaaatacatgct

SEQ ID NO: 793785 - DNA, 25 bp, Mus musculus
tgaaaggcacaggaaaatacatgct

SEQ ID NO: 793786 - DNA, 25 bp, Mus musculus
tgaaaggcataaagccagcagcaac

SEQ ID NO: 793787 - DNA, 25 bp, Mus musculus
tgaaaggcataatgccagcagcaac

SEQ ID NO: 793788 - DNA, 25 bp, Mus musculus
tgaaaggcatgacccgggctgaaat

SEQ ID NO: 793789 - DNA, 25 bp, Mus musculus
tgaaaggcatgagccgggctgaaat

SEQ ID NO: 793790 - DNA, 25 bp, Mus musculus
tgaaaggcatttacggctttacgga

SEQ ID NO: 793791 - DNA, 25 bp, Mus musculus
tgaaaggcattttcggctttacgga

SEQ ID NO: 793792 - DNA, 25 bp, Mus musculus
tgaaaggccggtagcagtaaagtcc

SEQ ID NO: 793793 - DNA, 25 bp, Mus musculus
tgaaaggccggttgcagtaaagtcc

SEQ ID NO: 793794 - DNA, 25 bp, Mus musculus
tgaaaggcctctaccgccaagggat

SEQ ID NO: 793795 - DNA, 25 bp, Mus musculus
tgaaaggcctcttccgccaagggat

SEQ ID NO: 793796 - DNA, 25 bp, Mus musculus
tgaaaggccttaagtctgtgagttc

SEQ ID NO: 793797 - DNA, 25 bp, Mus musculus
tgaaaggccttatgtctgtgagttc

SEQ ID NO: 793798 - DNA, 25 bp, Mus musculus
tgaaaggcggatacttggaccagcg

SEQ ID NO: 793799 - DNA, 25 bp, Mus musculus
tgaaaggcggattcttggaccagcg

SEQ ID NO: 793800 - DNA, 25 bp, Mus musculus
tgaaaggcgtgactgcagccgccat

SEQ ID NO: 793801 - DNA, 25 bp, Mus musculus
tgaaaggcgtgagtgcagccgccat

SEQ ID NO: 793802 - DNA, 25 bp, Mus musculus
tgaaaggcttcaccaggccatggag

SEQ ID NO: 793803 - DNA, 25 bp, Mus musculus
tgaaaggcttcagcaggccatggag

SEQ ID NO: 793804 - DNA, 25 bp, Mus musculus
tgaaaggcttccaccgtgtggcggt

SEQ ID NO: 793805 - DNA, 25 bp, Mus musculus
tgaaaggcttcctccgtgtggcggt

SEQ ID NO: 793806 - DNA, 25 bp, Mus musculus
tgaaagggaccccagtctcggcccg

SEQ ID NO: 793807 - DNA, 25 bp, Mus musculus
tgaaagggacccgagtctcggcccg

SEQ ID NO: 793808 - DNA, 25 bp, Mus musculus
tgaaagggagcacaccatcgaagaa

SEQ ID NO: 793809 - DNA, 25 bp, Mus musculus
tgaaagggagcagaccatcgaagaa

SEQ ID NO: 793810 - DNA, 25 bp, Mus musculus
tgaaagggtctgagaggaattctac

SEQ ID NO: 793811 - DNA, 25 bp, Mus musculus
tgaaagggtctgtgaggaattctac

SEQ ID NO: 793812 - DNA, 25 bp, Mus musculus
tgaaaggtacatcaagcaggccatt

SEQ ID NO: 793813 - DNA, 25 bp, Mus musculus
tgaaaggtacatgaagcaggccatt

SEQ ID NO: 793814 - DNA, 25 bp, Mus musculus
tgaaaggtgccaagatctgaagagg

SEQ ID NO: 793815 - DNA, 25 bp, Mus musculus
tgaaaggtgccatgatctgaagagg

SEQ ID NO: 793816 - DNA, 25 bp, Mus musculus
tgaaaggttatcctcattggccagc

SEQ ID NO: 793817 - DNA, 25 bp, Mus musculus
tgaaaggttatcgtcattggccagc

SEQ ID NO: 793818 - DNA, 25 bp, Mus musculus
tgaaagtaaattcagcagaatgatg

SEQ ID NO: 793819 - DNA, 25 bp, Mus musculus
tgaaagtaaattgagcagaatgatg

SEQ ID NO: 793820 - DNA, 25 bp, Mus musculus
tgaaagtacaccatgcagagtgcac

SEQ ID NO: 793821 - DNA, 25 bp, Mus musculus
tgaaagtacaccttgcagagtgcac

SEQ ID NO: 793822 - DNA, 25 bp, Mus musculus
tgaaagtagaataggccacgtggct

SEQ ID NO: 793823 - DNA, 25 bp, Mus musculus
tgaaagtagaattggccacgtggct

SEQ ID NO: 793824 - DNA, 25 bp, Mus musculus
tgaaagtagtttacccagccgttga

SEQ ID NO: 793825 - DNA, 25 bp, Mus musculus
tgaaagtagttttcccagccgttga

SEQ ID NO: 793826 - DNA, 25 bp, Mus musculus
tgaaagtatctgagagtttctgtcc

SEQ ID NO: 793827 - DNA, 25 bp, Mus musculus
tgaaagtatctgtgagtttctgtcc

SEQ ID NO: 793828 - DNA, 25 bp, Mus musculus
tgaaagtatggcatctgaagaacac

SEQ ID NO: 793829 - DNA, 25 bp, Mus musculus
tgaaagtatggcttctgaagaacac

SEQ ID NO: 793830 - DNA, 25 bp, Mus musculus
tgaaagtattccaactcaaaaaaga

SEQ ID NO: 793831 - DNA, 25 bp, Mus musculus
tgaaagtattcctactcaaaaaaga

SEQ ID NO: 793832 - DNA, 25 bp, Mus musculus
tgaaagtcattgaaagccgagccca

SEQ ID NO: 793833 - DNA, 25 bp, Mus musculus
tgaaagtcattgtaagccgagccca

SEQ ID NO: 793834 - DNA, 25 bp, Mus musculus
tgaaagtcctcgatgacctgaataa

SEQ ID NO: 793835 - DNA, 25 bp, Mus musculus
tgaaagtcctcgttgacctgaataa

SEQ ID NO: 793836 - DNA, 25 bp, Mus musculus
tgaaagtcgacgagctccggcaaat

SEQ ID NO: 793837 - DNA, 25 bp, Mus musculus
tgaaagtcgacgtgctccggcaaat

SEQ ID NO: 793838 - DNA, 25 bp, Mus musculus
tgaaagtctacgaggacgaaacaaa

SEQ ID NO: 793839 - DNA, 25 bp, Mus musculus
tgaaagtctacgtggacgaaacaaa

SEQ ID NO: 793840 - DNA, 25 bp, Mus musculus
tgaaagtctggaaaacacatggcta

SEQ ID NO: 793841 - DNA, 25 bp, Mus musculus
tgaaagtctggataacacatggcta

SEQ ID NO: 793842 - DNA, 25 bp, Mus musculus
tgaaagtgaaacagatccttggcag

SEQ ID NO: 793843 - DNA, 25 bp, Mus musculus
tgaaagtgaaactgatccttggcag

SEQ ID NO: 793844 - DNA, 25 bp, Mus musculus
tgaaagtgacacctttttcccagaa

SEQ ID NO: 793845 - DNA, 25 bp, Mus musculus
tgaaagtgacacgtttttcccagaa

SEQ ID NO: 793846 - DNA, 25 bp, Mus musculus
tgaaagtgacctacgggccatgact

SEQ ID NO: 793847 - DNA, 25 bp, Mus musculus
tgaaagtgaccttcgggccatgact

SEQ ID NO: 793848 - DNA, 25 bp, Mus musculus
tgaaagtgatctacttaaggcaatt

SEQ ID NO: 793849 - DNA, 25 bp, Mus musculus
tgaaagtgatcttcttaaggcaatt

SEQ ID NO: 793850 - DNA, 25 bp, Mus musculus
tgaaagtgcaatcaaggcccctgac

SEQ ID NO: 793851 - DNA, 25 bp, Mus musculus
tgaaagtgcaatgaaggcccctgac

SEQ ID NO: 793852 - DNA, 25 bp, Mus musculus
tgaaagtgccaaagttgagtgtgcg

SEQ ID NO: 793853 - DNA, 25 bp, Mus musculus
tgaaagtgccaatgttgagtgtgcg

SEQ ID NO: 793854 - DNA, 25 bp, Mus musculus
tgaaagtgcgacatgatgaggatat

SEQ ID NO: 793855 - DNA, 25 bp, Mus musculus
tgaaagtgcgacttgatgaggatat

SEQ ID NO: 793856 - DNA, 25 bp, Mus musculus
tgaaagtggaacagctcggatgtca

SEQ ID NO: 793857 - DNA, 25 bp, Mus musculus
tgaaagtggaactgctcggatgtca

SEQ ID NO: 793858 - DNA, 25 bp, Mus musculus
tgaaagtgtccacgtgcccgatgac

SEQ ID NO: 793859 - DNA, 25 bp, Mus musculus
tgaaagtgtccaggtgcccgatgac

SEQ ID NO: 793860 - DNA, 25 bp, Mus musculus
tgaaagttcagtcttcactgcccct

SEQ ID NO: 793861 - DNA, 25 bp, Mus musculus
tgaaagttcagtgttcactgcccct

SEQ ID NO: 793862 - DNA, 25 bp, Mus musculus
tgaaagttcatgctcgctcaccgcc

SEQ ID NO: 793863 - DNA, 25 bp, Mus musculus
tgaaagttcatggtcgctcaccgcc

SEQ ID NO: 793864 - DNA, 25 bp, Mus musculus
tgaaagttcttcatctaatagacag

SEQ ID NO: 793865 - DNA, 25 bp, Mus musculus
tgaaagttcttcttctaatagacag

SEQ ID NO: 793866 - DNA, 25 bp, Mus musculus
tgaaataaaacgactctcttccctt

SEQ ID NO: 793867 - DNA, 25 bp, Mus musculus
tgaaataaaacgtctctcttccctt

SEQ ID NO: 793868 - DNA, 25 bp, Mus musculus
tgaaataaacaaccaggcagcagtt

SEQ ID NO: 793869 - DNA, 25 bp, Mus musculus
tgaaataaacaagcaggcagcagtt

SEQ ID NO: 793870 - DNA, 25 bp, Mus musculus
tgaaataacaaacattctgagcagc

SEQ ID NO: 793871 - DNA, 25 bp, Mus musculus
tgaaataacaaagattctgagcagc

SEQ ID NO: 793872 - DNA, 25 bp, Mus musculus
tgaaataaccaacataatgagcacc

SEQ ID NO: 793873 - DNA, 25 bp, Mus musculus
tgaaataaccaagataatgagcacc

SEQ ID NO: 793874 - DNA, 25 bp, Mus musculus
tgaaataagttgacagtcatcagcc

SEQ ID NO: 793875 - DNA, 25 bp, Mus musculus
tgaaataagttgtcagtcatcagcc

SEQ ID NO: 793876 - DNA, 25 bp, Mus musculus
tgaaatacaaagacagacctgggca

SEQ ID NO: 793877 - DNA, 25 bp, Mus musculus
tgaaatacaaagtcagacctgggca

SEQ ID NO: 793878 - DNA, 25 bp, Mus musculus
tgaaatacaccaaggaccacactgt

SEQ ID NO: 793879 - DNA, 25 bp, Mus musculus
tgaaatacaccatggaccacactgt

SEQ ID NO: 793880 - DNA, 25 bp, Mus musculus
tgaaatacacgcagatcctgatggg

SEQ ID NO: 793881 - DNA, 25 bp, Mus musculus
tgaaatacacgctgatcctgatggg

SEQ ID NO: 793882 - DNA, 25 bp, Mus musculus
tgaaatacaggacgtagtagccacg

SEQ ID NO: 793883 - DNA, 25 bp, Mus musculus
tgaaatacaggaggtagtagccacg

SEQ ID NO: 793884 - DNA, 25 bp, Mus musculus
tgaaatacatttccaagcagcagca

SEQ ID NO: 793885 - DNA, 25 bp, Mus musculus
tgaaatacatttgcaagcagcagca

SEQ ID NO: 793886 - DNA, 25 bp, Mus musculus
tgaaatacctaccactgtcctcaac

SEQ ID NO: 793887 - DNA, 25 bp, Mus musculus
tgaaatacctacgactgtcctcaac

SEQ ID NO: 793888 - DNA, 25 bp, Mus musculus
tgaaatagagatcgccaaggcacag

SEQ ID NO: 793889 - DNA, 25 bp, Mus musculus
tgaaatagagatggccaaggcacag

SEQ ID NO: 793890 - DNA, 25 bp, Mus musculus
tgaaatagcacaaggcatattggac

SEQ ID NO: 793891 - DNA, 25 bp, Mus musculus
tgaaatagcacatggcatattggac

SEQ ID NO: 793892 - DNA, 25 bp, Mus musculus
tgaaatagccaacgagactggagac

SEQ ID NO: 793893 - DNA, 25 bp, Mus musculus
tgaaatagccaaggagactggagac

SEQ ID NO: 793894 - DNA, 25 bp, Mus musculus
tgaaatagctttcaccagtgtatgg

SEQ ID NO: 793895 - DNA, 25 bp, Mus musculus
tgaaatagctttgaccagtgtatgg

SEQ ID NO: 793896 - DNA, 25 bp, Mus musculus
tgaaatagtctccttcctgaaaggg

SEQ ID NO: 793897 - DNA, 25 bp, Mus musculus
tgaaatagtctcgttcctgaaaggg

SEQ ID NO: 793898 - DNA, 25 bp, Mus musculus
tgaaatagtgcacatcctcctgact

SEQ ID NO: 793899 - DNA, 25 bp, Mus musculus
tgaaatagtgcagatcctcctgact

SEQ ID NO: 793900 - DNA, 25 bp, Mus musculus
tgaaatataaaaagcagtgcactga

SEQ ID NO: 793901 - DNA, 25 bp, Mus musculus
tgaaatataaaatgcagtgcactga

SEQ ID NO: 793902 - DNA, 25 bp, Mus musculus
tgaaatatgacaccaacaggcccaa

SEQ ID NO: 793903 - DNA, 25 bp, Mus musculus
tgaaatatgacagcaacaggcccaa

SEQ ID NO: 793904 - DNA, 25 bp, Mus musculus
tgaaatcaaggaccgatcttccgtc

SEQ ID NO: 793905 - DNA, 25 bp, Mus musculus
tgaaatcaaggagcgatcttccgtc

SEQ ID NO: 793906 - DNA, 25 bp, Mus musculus
tgaaatcatcaaccccaagagccaa

SEQ ID NO: 793907 - DNA, 25 bp, Mus musculus
tgaaatcatcaagcccaagagccaa

SEQ ID NO: 793908 - DNA, 25 bp, Mus musculus
tgaaatccaacgacctcatgcccat

SEQ ID NO: 793909 - DNA, 25 bp, Mus musculus
tgaaatccaacgtcctcatgcccat

SEQ ID NO: 793910 - DNA, 25 bp, Mus musculus
tgaaatccaggaactatgaggtgaa

SEQ ID NO: 793911 - DNA, 25 bp, Mus musculus
tgaaatccaggatctatgaggtgaa

SEQ ID NO: 793912 - DNA, 25 bp, Mus musculus
tgaaatccatgactacaatcaggac

SEQ ID NO: 793913 - DNA, 25 bp, Mus musculus
tgaaatccatgagtacaatcaggac

SEQ ID NO: 793914 - DNA, 25 bp, Mus musculus
tgaaatccatggaacagaatgggcc

SEQ ID NO: 793915 - DNA, 25 bp, Mus musculus
tgaaatccatggtacagaatgggcc

SEQ ID NO: 793916 - DNA, 25 bp, Mus musculus
tgaaatcccagtcccaactgtcaag

SEQ ID NO: 793917 - DNA, 25 bp, Mus musculus
tgaaatcccagtgccaactgtcaag

SEQ ID NO: 793918 - DNA, 25 bp, Mus musculus
tgaaatcccgtacttacaaaaggat

SEQ ID NO: 793919 - DNA, 25 bp, Mus musculus
tgaaatcccgtagttacaaaaggat

SEQ ID NO: 793920 - DNA, 25 bp, Mus musculus
tgaaatccgtggatatgagctggca

SEQ ID NO: 793921 - DNA, 25 bp, Mus musculus
tgaaatccgtggttatgagctggca

SEQ ID NO: 793922 - DNA, 25 bp, Mus musculus
tgaaatcctccacgctgcgtaccaa

SEQ ID NO: 793923 - DNA, 25 bp, Mus musculus
tgaaatcctccaggctgcgtaccaa

SEQ ID NO: 793924 - DNA, 25 bp, Mus musculus
tgaaatcctccgaaaggaagaggac

SEQ ID NO: 793925 - DNA, 25 bp, Mus musculus
tgaaatcctccgtaaggaagaggac

SEQ ID NO: 793926 - DNA, 25 bp, Mus musculus
tgaaatcgaaccagaagttaaaggc

SEQ ID NO: 793927 - DNA, 25 bp, Mus musculus
tgaaatcgaacctgaagttaaaggc

SEQ ID NO: 793928 - DNA, 25 bp, Mus musculus
tgaaatcgggatagccatgggctca

SEQ ID NO: 793929 - DNA, 25 bp, Mus musculus
tgaaatcgggattgccatgggctca

SEQ ID NO: 793930 - DNA, 25 bp, Mus musculus
tgaaatctagatcatggctgttaca

SEQ ID NO: 793931 - DNA, 25 bp, Mus musculus
tgaaatctagatgatggctgttaca

SEQ ID NO: 793932 - DNA, 25 bp, Mus musculus
tgaaatgacaacctcaaccctccag

SEQ ID NO: 793933 - DNA, 25 bp, Mus musculus
tgaaatgacaacgtcaaccctccag

SEQ ID NO: 793934 - DNA, 25 bp, Mus musculus
tgaaatgacctgaagatatttgtgt

SEQ ID NO: 793935 - DNA, 25 bp, Mus musculus
tgaaatgacctgtagatatttgtgt

SEQ ID NO: 793936 - DNA, 25 bp, Mus musculus
tgaaatgagggcactcaccatcccg

SEQ ID NO: 793937 - DNA, 25 bp, Mus musculus
tgaaatgagggctctcaccatcccg

SEQ ID NO: 793938 - DNA, 25 bp, Mus musculus
tgaaatgagtgccaagaaaatccat

SEQ ID NO: 793939 - DNA, 25 bp, Mus musculus
tgaaatgagtgcgaagaaaatccat

SEQ ID NO: 793940 - DNA, 25 bp, Mus musculus
tgaaatgcaccaccgattgtcgaac

SEQ ID NO: 793941 - DNA, 25 bp, Mus musculus
tgaaatgcaccagcgattgtcgaac

SEQ ID NO: 793942 - DNA, 25 bp, Mus musculus
tgaaatgcacctccggtctgagcat

SEQ ID NO: 793943 - DNA, 25 bp, Mus musculus
tgaaatgcacctgcggtctgagcat

SEQ ID NO: 793944 - DNA, 25 bp, Mus musculus
tgaaatgccggacgccatggaacag

SEQ ID NO: 793945 - DNA, 25 bp, Mus musculus
tgaaatgccggaggccatggaacag

SEQ ID NO: 793946 - DNA, 25 bp, Mus musculus
tgaaatgccggcagcagaccatgta

SEQ ID NO: 793947 - DNA, 25 bp, Mus musculus
tgaaatgccggctgcagaccatgta

SEQ ID NO: 793948 - DNA, 25 bp, Mus musculus
tgaaatgcctcaacatgccgtactg

SEQ ID NO: 793949 - DNA, 25 bp, Mus musculus
tgaaatgcctcatcatgccgtactg

SEQ ID NO: 793950 - DNA, 25 bp, Mus musculus
tgaaatgcctgtcaagatggtcgcg

SEQ ID NO: 793951 - DNA, 25 bp, Mus musculus
tgaaatgcctgtgaagatggtcgcg

SEQ ID NO: 793952 - DNA, 25 bp, Mus musculus
tgaaatgcggaaccaaacaccggcg

SEQ ID NO: 793953 - DNA, 25 bp, Mus musculus
tgaaatgcggaagcaaacaccggcg

SEQ ID NO: 793954 - DNA, 25 bp, Mus musculus
tgaaatgcttgaagaacctcaccag

SEQ ID NO: 793955 - DNA, 25 bp, Mus musculus
tgaaatgcttgatgaacctcaccag

SEQ ID NO: 793956 - DNA, 25 bp, Mus musculus
tgaaatggcaaccaagctgtatcgc

SEQ ID NO: 793957 - DNA, 25 bp, Mus musculus
tgaaatggcaacgaagctgtatcgc

SEQ ID NO: 793958 - DNA, 25 bp, Mus musculus
tgaaatggccatcaatccacacata

SEQ ID NO: 793959 - DNA, 25 bp, Mus musculus
tgaaatggccatgaatccacacata

SEQ ID NO: 793960 - DNA, 25 bp, Mus musculus
tgaaatggcggaaagtcaagacccc

SEQ ID NO: 793961 - DNA, 25 bp, Mus musculus
tgaaatggcggatagtcaagacccc

SEQ ID NO: 793962 - DNA, 25 bp, Mus musculus
tgaaatgggaccacgcgctctgcct

SEQ ID NO: 793963 - DNA, 25 bp, Mus musculus
tgaaatgggacctcgcgctctgcct

SEQ ID NO: 793964 - DNA, 25 bp, Mus musculus
tgaaatgggcatcaaaaaccatgag

SEQ ID NO: 793965 - DNA, 25 bp, Mus musculus
tgaaatgggcatgaaaaaccatgag

SEQ ID NO: 793966 - DNA, 25 bp, Mus musculus
tgaaatgtccgcaccacactgtcct

SEQ ID NO: 793967 - DNA, 25 bp, Mus musculus
tgaaatgtccgctccacactgtcct

SEQ ID NO: 793968 - DNA, 25 bp, Mus musculus
tgaaatgttttacgtgcatcaagcc

SEQ ID NO: 793969 - DNA, 25 bp, Mus musculus
tgaaatgttttaggtgcatcaagcc

SEQ ID NO: 793970 - DNA, 25 bp, Mus musculus
tgaaattagggaagatgaggagcct

SEQ ID NO: 793971 - DNA, 25 bp, Mus musculus
tgaaattagggatgatgaggagcct

SEQ ID NO: 793972 - DNA, 25 bp, Mus musculus
tgaaattatggaaactgacgtcaac

SEQ ID NO: 793973 - DNA, 25 bp, Mus musculus
tgaaattatggatactgacgtcaac

SEQ ID NO: 793974 - DNA, 25 bp, Mus musculus
tgaaattattcaccatgaccagctt

SEQ ID NO: 793975 - DNA, 25 bp, Mus musculus
tgaaattattcagcatgaccagctt

SEQ ID NO: 793976 - DNA, 25 bp, Mus musculus
tgaaattcagcgagggctttccctg

SEQ ID NO: 793977 - DNA, 25 bp, Mus musculus
tgaaattcagcgtgggctttccctg

SEQ ID NO: 793978 - DNA, 25 bp, Mus musculus
tgaaattcctaaccattctctgttc

SEQ ID NO: 793979 - DNA, 25 bp, Mus musculus
tgaaattcctaagcattctctgttc

SEQ ID NO: 793980 - DNA, 25 bp, Mus musculus
tgaaattcggcaccaaatccccatt

SEQ ID NO: 793981 - DNA, 25 bp, Mus musculus
tgaaattcggcagcaaatccccatt

SEQ ID NO: 793982 - DNA, 25 bp, Mus musculus
tgaaattgaaacacctacgcagata

SEQ ID NO: 793983 - DNA, 25 bp, Mus musculus
tgaaattgaaactcctacgcagata

SEQ ID NO: 793984 - DNA, 25 bp, Mus musculus
tgaaattgagttaggccatcctgat

SEQ ID NO: 793985 - DNA, 25 bp, Mus musculus
tgaaattgagtttggccatcctgat

SEQ ID NO: 793986 - DNA, 25 bp, Mus musculus
tgaaattgctaaagtccagagcggg

SEQ ID NO: 793987 - DNA, 25 bp, Mus musculus
tgaaattgctaatgtccagagcggg

SEQ ID NO: 793988 - DNA, 25 bp, Mus musculus
tgaaattgctcgcaaccgggaaggc

SEQ ID NO: 793989 - DNA, 25 bp, Mus musculus
tgaaattgctcggaaccgggaaggc

SEQ ID NO: 793990 - DNA, 25 bp, Mus musculus
tgaaattgggagctgcaatcactcc

SEQ ID NO: 793991 - DNA, 25 bp, Mus musculus
tgaaattgggaggtgcaatcactcc

SEQ ID NO: 793992 - DNA, 25 bp, Mus musculus
tgaaatttccgtctgtctgtgcctg

SEQ ID NO: 793993 - DNA, 25 bp, Mus musculus
tgaaatttccgtgtgtctgtgcctg

SEQ ID NO: 793994 - DNA, 25 bp, Mus musculus
tgaaatttgagccatgtgaagttga

SEQ ID NO: 793995 - DNA, 25 bp, Mus musculus
tgaaatttgagcgatgtgaagttga

SEQ ID NO: 793996 - DNA, 25 bp, Mus musculus
tgaaatttgcctccaagatattcag

SEQ ID NO: 793997 - DNA, 25 bp, Mus musculus
tgaaatttgcctgcaagatattcag

SEQ ID NO: 793998 - DNA, 25 bp, Mus musculus
tgaaatttggagatgcatgaattcg

SEQ ID NO: 793999 - DNA, 25 bp, Mus musculus
tgaaatttggagttgcatgaattcg

SEQ ID NO: 794000 - DNA, 25 bp, Mus musculus
tgaaatttttaaacggaatcaccgc

SEQ ID NO: 794001 - DNA, 25 bp, Mus musculus
tgaaatttttaatcggaatcaccgc

SEQ ID NO: 794002 - DNA, 25 bp, Mus musculus
tgaaatttttatcaagaggaataag

SEQ ID NO: 794003 - DNA, 25 bp, Mus musculus
tgaaatttttatgaagaggaataag

SEQ ID NO: 794004 - DNA, 25 bp, Mus musculus
tgaacaaaatgccagtgccttcctt

SEQ ID NO: 794005 - DNA, 25 bp, Mus musculus
tgaacaaaatgcgagtgccttcctt

SEQ ID NO: 794006 - DNA, 25 bp, Mus musculus
tgaacaaacccgacagccatggtgg

SEQ ID NO: 794007 - DNA, 25 bp, Mus musculus
tgaacaaacccgtcagccatggtgg

SEQ ID NO: 794008 - DNA, 25 bp, Mus musculus
tgaacaaagacaaggcctgactgga

SEQ ID NO: 794009 - DNA, 25 bp, Mus musculus
tgaacaaagacatggcctgactgga

SEQ ID NO: 794010 - DNA, 25 bp, Mus musculus
tgaacaaatctcatgctgaacagag

SEQ ID NO: 794011 - DNA, 25 bp, Mus musculus
tgaacaaatctcttgctgaacagag

SEQ ID NO: 794012 - DNA, 25 bp, Mus musculus
tgaacaacatgcctgtcaacaccgg

SEQ ID NO: 794013 - DNA, 25 bp, Mus musculus
tgaacaacatgcgtgtcaacaccgg

SEQ ID NO: 794014 - DNA, 25 bp, Mus musculus
tgaacaacccttagagcatcatccc

SEQ ID NO: 794015 - DNA, 25 bp, Mus musculus
tgaacaaccctttgagcatcatccc

SEQ ID NO: 794016 - DNA, 25 bp, Mus musculus
tgaacaaccggaattggcaagtaaa

SEQ ID NO: 794017 - DNA, 25 bp, Mus musculus
tgaacaaccggatttggcaagtaaa

SEQ ID NO: 794018 - DNA, 25 bp, Mus musculus
tgaacaacctcactcagtgggccct

SEQ ID NO: 794019 - DNA, 25 bp, Mus musculus
tgaacaacctcagtcagtgggccct

SEQ ID NO: 794020 - DNA, 25 bp, Mus musculus
tgaacaacgagcatctagacttatg

SEQ ID NO: 794021 - DNA, 25 bp, Mus musculus
tgaacaacgagcttctagacttatg

SEQ ID NO: 794022 - DNA, 25 bp, Mus musculus
tgaacaacgtggaagtacacacagc

SEQ ID NO: 794023 - DNA, 25 bp, Mus musculus
tgaacaacgtggtagtacacacagc

SEQ ID NO: 794024 - DNA, 25 bp, Mus musculus
tgaacaactaagaggattgagagag

SEQ ID NO: 794025 - DNA, 25 bp, Mus musculus
tgaacaactaagtggattgagagag

SEQ ID NO: 794026 - DNA, 25 bp, Mus musculus
tgaacaagaagaataaaccccgctg

SEQ ID NO: 794027 - DNA, 25 bp, Mus musculus
tgaacaagaagattaaaccccgctg

SEQ ID NO: 794028 - DNA, 25 bp, Mus musculus
tgaacaagaagccaatgagaaagca

SEQ ID NO: 794029 - DNA, 25 bp, Mus musculus
tgaacaagaagcgaatgagaaagca

SEQ ID NO: 794030 - DNA, 25 bp, Mus musculus
tgaacaagactaatggtccatggct

SEQ ID NO: 794031 - DNA, 25 bp, Mus musculus
tgaacaagactattggtccatggct

SEQ ID NO: 794032 - DNA, 25 bp, Mus musculus
tgaacaagcaacaggcccacgacct

SEQ ID NO: 794033 - DNA, 25 bp, Mus musculus
tgaacaagcaactggcccacgacct

SEQ ID NO: 794034 - DNA, 25 bp, Mus musculus
tgaacaagcatcataacaccccaca

SEQ ID NO: 794035 - DNA, 25 bp, Mus musculus
tgaacaagcatcttaacaccccaca

SEQ ID NO: 794036 - DNA, 25 bp, Mus musculus
tgaacaagccttaggagcagcaagt

SEQ ID NO: 794037 - DNA, 25 bp, Mus musculus
tgaacaagcctttggagcagcaagt

SEQ ID NO: 794038 - DNA, 25 bp, Mus musculus
tgaacaagctgccttccgtgagcca

SEQ ID NO: 794039 - DNA, 25 bp, Mus musculus
tgaacaagctgcgttccgtgagcca

SEQ ID NO: 794040 - DNA, 25 bp, Mus musculus
tgaacaaggatcatggctgtggtca

SEQ ID NO: 794041 - DNA, 25 bp, Mus musculus
tgaacaaggatcttggctgtggtca

SEQ ID NO: 794042 - DNA, 25 bp, Mus musculus
tgaacaaggtcaaggcccgggtcat

SEQ ID NO: 794043 - DNA, 25 bp, Mus musculus
tgaacaaggtcatggcccgggtcat

SEQ ID NO: 794044 - DNA, 25 bp, Mus musculus
tgaacaagtgcaccgagttgagctt

SEQ ID NO: 794045 - DNA, 25 bp, Mus musculus
tgaacaagtgcagcgagttgagctt

SEQ ID NO: 794046 - DNA, 25 bp, Mus musculus
tgaacaagttgaccatggccagcct

SEQ ID NO: 794047 - DNA, 25 bp, Mus musculus
tgaacaagttgagcatggccagcct

SEQ ID NO: 794048 - DNA, 25 bp, Mus musculus
tgaacaatgagcaaactgtcacgtg

SEQ ID NO: 794049 - DNA, 25 bp, Mus musculus
tgaacaatgagctaactgtcacgtg

SEQ ID NO: 794050 - DNA, 25 bp, Mus musculus
tgaacaatgccgctgtggtccatgg

SEQ ID NO: 794051 - DNA, 25 bp, Mus musculus
tgaacaatgccggtgtggtccatgg

SEQ ID NO: 794052 - DNA, 25 bp, Mus musculus
tgaacaatgtcaacaaggcactgcg

SEQ ID NO: 794053 - DNA, 25 bp, Mus musculus
tgaacaatgtcatcaaggcactgcg

SEQ ID NO: 794054 - DNA, 25 bp, Mus musculus
tgaacaattcaacgcactggaagaa

SEQ ID NO: 794055 - DNA, 25 bp, Mus musculus
tgaacaattcaaggcactggaagaa

SEQ ID NO: 794056 - DNA, 25 bp, Mus musculus
tgaacacaatgacaatgattatgat

SEQ ID NO: 794057 - DNA, 25 bp, Mus musculus
tgaacacaatgagaatgattatgat

SEQ ID NO: 794058 - DNA, 25 bp, Mus musculus
tgaacacacgatcaaaagctccttg

SEQ ID NO: 794059 - DNA, 25 bp, Mus musculus
tgaacacacgatgaaaagctccttg

SEQ ID NO: 794060 - DNA, 25 bp, Mus musculus
tgaacacagaatatgaacaagcaga

SEQ ID NO: 794061 - DNA, 25 bp, Mus musculus
tgaacacagaatttgaacaagcaga

SEQ ID NO: 794062 - DNA, 25 bp, Mus musculus
tgaacacagacacctatgacaagat

SEQ ID NO: 794063 - DNA, 25 bp, Mus musculus
tgaacacagacagctatgacaagat

SEQ ID NO: 794064 - DNA, 25 bp, Mus musculus
tgaacacagagaaggccagattact

SEQ ID NO: 794065 - DNA, 25 bp, Mus musculus
tgaacacagagatggccagattact

SEQ ID NO: 794066 - DNA, 25 bp, Mus musculus
tgaacacagccaaagccgtgcagag

SEQ ID NO: 794067 - DNA, 25 bp, Mus musculus
tgaacacagccatagccgtgcagag

SEQ ID NO: 794068 - DNA, 25 bp, Mus musculus
tgaacacagcctctagatggtgaca

SEQ ID NO: 794069 - DNA, 25 bp, Mus musculus
tgaacacagcctgtagatggtgaca

SEQ ID NO: 794070 - DNA, 25 bp, Mus musculus
tgaacaccaacgcttttgcacgcgg

SEQ ID NO: 794071 - DNA, 25 bp, Mus musculus
tgaacaccaacggttttgcacgcgg

SEQ ID NO: 794072 - DNA, 25 bp, Mus musculus
tgaacaccagaaagagcaacaaacc

SEQ ID NO: 794073 - DNA, 25 bp, Mus musculus
tgaacaccagaatgagcaacaaacc

SEQ ID NO: 794074 - DNA, 25 bp, Mus musculus
tgaacaccagcaccttcactgagta

SEQ ID NO: 794075 - DNA, 25 bp, Mus musculus
tgaacaccagcagcttcactgagta

SEQ ID NO: 794076 - DNA, 25 bp, Mus musculus
tgaacaccagtgcatccttccgctg

SEQ ID NO: 794077 - DNA, 25 bp, Mus musculus
tgaacaccagtggatccttccgctg

SEQ ID NO: 794078 - DNA, 25 bp, Mus musculus
tgaacaccctccagaatgggcacaa

SEQ ID NO: 794079 - DNA, 25 bp, Mus musculus
tgaacaccctcctgaatgggcacaa

SEQ ID NO: 794080 - DNA, 25 bp, Mus musculus
tgaacaccgccaagtcctaacaatg

SEQ ID NO: 794081 - DNA, 25 bp, Mus musculus
tgaacaccgccatgtcctaacaatg

SEQ ID NO: 794082 - DNA, 25 bp, Mus musculus
tgaacaccggctcatgatggagcag

SEQ ID NO: 794083 - DNA, 25 bp, Mus musculus
tgaacaccggctgatgatggagcag

SEQ ID NO: 794084 - DNA, 25 bp, Mus musculus
tgaacacgatggagtcatgaccggg

SEQ ID NO: 794085 - DNA, 25 bp, Mus musculus
tgaacacgatggtgtcatgaccggg

SEQ ID NO: 794086 - DNA, 25 bp, Mus musculus
tgaacacggctgaactggaccactt

SEQ ID NO: 794087 - DNA, 25 bp, Mus musculus
tgaacacggctgtactggaccactt

SEQ ID NO: 794088 - DNA, 25 bp, Mus musculus
tgaacactacctcgtccttctgagg

SEQ ID NO: 794089 - DNA, 25 bp, Mus musculus
tgaacactacctggtccttctgagg

SEQ ID NO: 794090 - DNA, 25 bp, Mus musculus
tgaacactgaatatgagctgagacc

SEQ ID NO: 794091 - DNA, 25 bp, Mus musculus
tgaacactgaatttgagctgagacc

SEQ ID NO: 794092 - DNA, 25 bp, Mus musculus
tgaacagagaccagacccgtcgtgt

SEQ ID NO: 794093 - DNA, 25 bp, Mus musculus
tgaacagagacctgacccgtcgtgt

SEQ ID NO: 794094 - DNA, 25 bp, Mus musculus
tgaacagagctacaatgcaacgtgg

SEQ ID NO: 794095 - DNA, 25 bp, Mus musculus
tgaacagagctagaatgcaacgtgg

SEQ ID NO: 794096 - DNA, 25 bp, Mus musculus
tgaacagagtatccagtctgcccag

SEQ ID NO: 794097 - DNA, 25 bp, Mus musculus
tgaacagagtatgcagtctgcccag

SEQ ID NO: 794098 - DNA, 25 bp, Mus musculus
tgaacagatggaagacagcgtcctt

SEQ ID NO: 794099 - DNA, 25 bp, Mus musculus
tgaacagatggatgacagcgtcctt

SEQ ID NO: 794100 - DNA, 25 bp, Mus musculus
tgaacagcaaccacacaggctacga

SEQ ID NO: 794101 - DNA, 25 bp, Mus musculus
tgaacagcaacctcacaggctacga

SEQ ID NO: 794102 - DNA, 25 bp, Mus musculus
tgaacagcaatcatgcaagtgttga

SEQ ID NO: 794103 - DNA, 25 bp, Mus musculus
tgaacagcaatcttgcaagtgttga

SEQ ID NO: 794104 - DNA, 25 bp, Mus musculus
tgaacagcatcgagggcgtcagcgt

SEQ ID NO: 794105 - DNA, 25 bp, Mus musculus
tgaacagcatcgtgggcgtcagcgt

SEQ ID NO: 794106 - DNA, 25 bp, Mus musculus
tgaacagccgacatctgcaaaccct

SEQ ID NO: 794107 - DNA, 25 bp, Mus musculus
tgaacagccgacttctgcaaaccct

SEQ ID NO: 794108 - DNA, 25 bp, Mus musculus
tgaacagccggtatccaggagtgga

SEQ ID NO: 794109 - DNA, 25 bp, Mus musculus
tgaacagccggtttccaggagtgga

SEQ ID NO: 794110 - DNA, 25 bp, Mus musculus
tgaacagcgcgtctacgagccgcgc

SEQ ID NO: 794111 - DNA, 25 bp, Mus musculus
tgaacagcgcgtgtacgagccgcgc

SEQ ID NO: 794112 - DNA, 25 bp, Mus musculus
tgaacagctaaacggccgaaacagc

SEQ ID NO: 794113 - DNA, 25 bp, Mus musculus
tgaacagctaaagggccgaaacagc

SEQ ID NO: 794114 - DNA, 25 bp, Mus musculus
tgaacagcttcgcaatcagatccag

SEQ ID NO: 794115 - DNA, 25 bp, Mus musculus
tgaacagcttcggaatcagatccag

SEQ ID NO: 794116 - DNA, 25 bp, Mus musculus
tgaacaggatgcagacaaaccagac

SEQ ID NO: 794117 - DNA, 25 bp, Mus musculus
tgaacaggatgctgacaaaccagac

SEQ ID NO: 794118 - DNA, 25 bp, Mus musculus
tgaacaggatttagccaacggctcc

SEQ ID NO: 794119 - DNA, 25 bp, Mus musculus
tgaacaggattttgccaacggctcc

SEQ ID NO: 794120 - DNA, 25 bp, Mus musculus
tgaacaggcctccaaggtggaccag

SEQ ID NO: 794121 - DNA, 25 bp, Mus musculus
tgaacaggcctcgaaggtggaccag

SEQ ID NO: 794122 - DNA, 25 bp, Mus musculus
tgaacaggtcaaaccccggtgggaa

SEQ ID NO: 794123 - DNA, 25 bp, Mus musculus
tgaacaggtcaatccccggtgggaa

SEQ ID NO: 794124 - DNA, 25 bp, Mus musculus
tgaacaggtcctacacctgtggctg

SEQ ID NO: 794125 - DNA, 25 bp, Mus musculus
tgaacaggtccttcacctgtggctg

SEQ ID NO: 794126 - DNA, 25 bp, Mus musculus
tgaacaggtgtcagtcgtcatcaat

SEQ ID NO: 794127 - DNA, 25 bp, Mus musculus
tgaacaggtgtctgtcgtcatcaat

SEQ ID NO: 794128 - DNA, 25 bp, Mus musculus
tgaacagtaagtaaccagtggccca

SEQ ID NO: 794129 - DNA, 25 bp, Mus musculus
tgaacagtaagttaccagtggccca

SEQ ID NO: 794130 - DNA, 25 bp, Mus musculus
tgaacagtacctatgtggaaatgat

SEQ ID NO: 794131 - DNA, 25 bp, Mus musculus
tgaacagtacctttgtggaaatgat

SEQ ID NO: 794132 - DNA, 25 bp, Mus musculus
tgaacagtatcacctgctcagcagt

SEQ ID NO: 794133 - DNA, 25 bp, Mus musculus
tgaacagtatcagctgctcagcagt

SEQ ID NO: 794134 - DNA, 25 bp, Mus musculus
tgaacagtatggcaacgtggaaatc

SEQ ID NO: 794135 - DNA, 25 bp, Mus musculus
tgaacagtatgggaacgtggaaatc

SEQ ID NO: 794136 - DNA, 25 bp, Mus musculus
tgaacagtcaaacccatccaaaaag

SEQ ID NO: 794137 - DNA, 25 bp, Mus musculus
tgaacagtcaaagccatccaaaaag

SEQ ID NO: 794138 - DNA, 25 bp, Mus musculus
tgaacagtctgacgacaccgcgcag

SEQ ID NO: 794139 - DNA, 25 bp, Mus musculus
tgaacagtctgactggcagccgaca

SEQ ID NO: 794140 - DNA, 25 bp, Mus musculus
tgaacagtctgaggacaccgcgcag

SEQ ID NO: 794141 - DNA, 25 bp, Mus musculus
tgaacagtctgagtggcagccgaca

SEQ ID NO: 794142 - DNA, 25 bp, Mus musculus
tgaacagtgctgatggacctccaac

SEQ ID NO: 794143 - DNA, 25 bp, Mus musculus
tgaacagtgctgttggacctccaac

SEQ ID NO: 794144 - DNA, 25 bp, Mus musculus
tgaacagtgcttccactcactgtgc

SEQ ID NO: 794145 - DNA, 25 bp, Mus musculus
tgaacagtgcttgcactcactgtgc

SEQ ID NO: 794146 - DNA, 25 bp, Mus musculus
tgaacagtggcgatgtgagaagccc

SEQ ID NO: 794147 - DNA, 25 bp, Mus musculus
tgaacagtggcgttgtgagaagccc

SEQ ID NO: 794148 - DNA, 25 bp, Mus musculus
tgaacagtgtcccacagctctcagc

SEQ ID NO: 794149 - DNA, 25 bp, Mus musculus
tgaacagtgtccgacagctctcagc

SEQ ID NO: 794150 - DNA, 25 bp, Mus musculus
tgaacagttccgacatgccatctgg

SEQ ID NO: 794151 - DNA, 25 bp, Mus musculus
tgaacagttccgtcatgccatctgg

SEQ ID NO: 794152 - DNA, 25 bp, Mus musculus
tgaacagttgcaagggagagagcct

SEQ ID NO: 794153 - DNA, 25 bp, Mus musculus
tgaacagttgcatgggagagagcct

SEQ ID NO: 794154 - DNA, 25 bp, Mus musculus
tgaacatatgacagactcattaaag

SEQ ID NO: 794155 - DNA, 25 bp, Mus musculus
tgaacatatgactgactcattaaag

SEQ ID NO: 794156 - DNA, 25 bp, Mus musculus
tgaacatcaaccattggtccacgtt

SEQ ID NO: 794157 - DNA, 25 bp, Mus musculus
tgaacatcaacctttggtccacgtt

SEQ ID NO: 794158 - DNA, 25 bp, Mus musculus
tgaacatcacccaggtgccctacgg

SEQ ID NO: 794159 - DNA, 25 bp, Mus musculus
tgaacatcaccctggtgccctacgg

SEQ ID NO: 794160 - DNA, 25 bp, Mus musculus
tgaacatcacctagggcaacagaag

SEQ ID NO: 794161 - DNA, 25 bp, Mus musculus
tgaacatcaccttgggcaacagaag

SEQ ID NO: 794162 - DNA, 25 bp, Mus musculus
tgaacatcatggaacctagcctcct

SEQ ID NO: 794163 - DNA, 25 bp, Mus musculus
tgaacatcatggtacctagcctcct

SEQ ID NO: 794164 - DNA, 25 bp, Mus musculus
tgaacatcccggctggtgagaccag

SEQ ID NO: 794165 - DNA, 25 bp, Mus musculus
tgaacatcccgggtggtgagaccag

SEQ ID NO: 794166 - DNA, 25 bp, Mus musculus
tgaacatcctagcaaacagagtggg

SEQ ID NO: 794167 - DNA, 25 bp, Mus musculus
tgaacatcctaggaaacagagtggg

SEQ ID NO: 794168 - DNA, 25 bp, Mus musculus
tgaacatctatcagctcactgccct

SEQ ID NO: 794169 - DNA, 25 bp, Mus musculus
tgaacatctatctgctcactgccct

SEQ ID NO: 794170 - DNA, 25 bp, Mus musculus
tgaacatctcgaacatctcccagcg

SEQ ID NO: 794171 - DNA, 25 bp, Mus musculus
tgaacatctcgatcatctcccagcg

SEQ ID NO: 794172 - DNA, 25 bp, Mus musculus
tgaacatgactgcaaggacatgagc

SEQ ID NO: 794173 - DNA, 25 bp, Mus musculus
tgaacatgactggaaggacatgagc

SEQ ID NO: 794174 - DNA, 25 bp, Mus musculus
tgaacatgcacacaaagagcttcag

SEQ ID NO: 794175 - DNA, 25 bp, Mus musculus
tgaacatgcacagaaagagcttcag

SEQ ID NO: 794176 - DNA, 25 bp, Mus musculus
tgaacatggagacccaaaagagaat

SEQ ID NO: 794177 - DNA, 25 bp, Mus musculus
tgaacatggagagccaaaagagaat

SEQ ID NO: 794178 - DNA, 25 bp, Mus musculus
tgaacatggctaccaaacttacctg

SEQ ID NO: 794179 - DNA, 25 bp, Mus musculus
tgaacatggctacgcctcatcgttc

SEQ ID NO: 794180 - DNA, 25 bp, Mus musculus
tgaacatggctagcaaacttacctg

SEQ ID NO: 794181 - DNA, 25 bp, Mus musculus
tgaacatggctaggcctcatcgttc

SEQ ID NO: 794182 - DNA, 25 bp, Mus musculus
tgaacatggtcgcttctggccccac

SEQ ID NO: 794183 - DNA, 25 bp, Mus musculus
tgaacatggtcggttctggccccac

SEQ ID NO: 794184 - DNA, 25 bp, Mus musculus
tgaacatggttcaagacagcgcctt

SEQ ID NO: 794185 - DNA, 25 bp, Mus musculus
tgaacatggttctagacagcgcctt

SEQ ID NO: 794186 - DNA, 25 bp, Mus musculus
tgaacatgtttgacaagctctccag

SEQ ID NO: 794187 - DNA, 25 bp, Mus musculus
tgaacatgtttgatgaagggttcca

SEQ ID NO: 794188 - DNA, 25 bp, Mus musculus
tgaacatgtttgtcaagctctccag

SEQ ID NO: 794189 - DNA, 25 bp, Mus musculus
tgaacatgtttgttgaagggttcca

SEQ ID NO: 794190 - DNA, 25 bp, Mus musculus
tgaacattgcgcagtatgcgggcat

SEQ ID NO: 794191 - DNA, 25 bp, Mus musculus
tgaacattgcgctgtatgcgggcat

SEQ ID NO: 794192 - DNA, 25 bp, Mus musculus
tgaacatttttgctgtggaaagtgg

SEQ ID NO: 794193 - DNA, 25 bp, Mus musculus
tgaacatttttggtgtggaaagtgg

SEQ ID NO: 794194 - DNA, 25 bp, Mus musculus
tgaaccaaaaaacagctgcctgcct

SEQ ID NO: 794195 - DNA, 25 bp, Mus musculus
tgaaccaaaaaagagctgcctgcct

SEQ ID NO: 794196 - DNA, 25 bp, Mus musculus
tgaaccaaaggacaaggctcccacg

SEQ ID NO: 794197 - DNA, 25 bp, Mus musculus
tgaaccaaaggagaaggctcccacg

SEQ ID NO: 794198 - DNA, 25 bp, Mus musculus
tgaaccaagccaagacatatagagc

SEQ ID NO: 794199 - DNA, 25 bp, Mus musculus
tgaaccaagccatgacatatagagc

SEQ ID NO: 794200 - DNA, 25 bp, Mus musculus
tgaaccacaccaagtgccggttagg

SEQ ID NO: 794201 - DNA, 25 bp, Mus musculus
tgaaccacaccatgtgccggttagg

SEQ ID NO: 794202 - DNA, 25 bp, Mus musculus
tgaaccacacccagactatggctct

SEQ ID NO: 794203 - DNA, 25 bp, Mus musculus
tgaaccacaccctgactatggctct

SEQ ID NO: 794204 - DNA, 25 bp, Mus musculus
tgaaccacacttacctagtcatagg

SEQ ID NO: 794205 - DNA, 25 bp, Mus musculus
tgaaccacactttcctagtcatagg

SEQ ID NO: 794206 - DNA, 25 bp, Mus musculus
tgaaccacagagcactgactattac

SEQ ID NO: 794207 - DNA, 25 bp, Mus musculus
tgaaccacagaggactgactattac

SEQ ID NO: 794208 - DNA, 25 bp, Mus musculus
tgaaccacagcaagtgagtgcactt

SEQ ID NO: 794209 - DNA, 25 bp, Mus musculus
tgaaccacagcatgtgagtgcactt

SEQ ID NO: 794210 - DNA, 25 bp, Mus musculus
tgaaccacagccagcccagtgattt

SEQ ID NO: 794211 - DNA, 25 bp, Mus musculus
tgaaccacagcctgcccagtgattt

SEQ ID NO: 794212 - DNA, 25 bp, Mus musculus
tgaaccacatctaaaaactgcaacg

SEQ ID NO: 794213 - DNA, 25 bp, Mus musculus
tgaaccacatcttaaaactgcaacg

SEQ ID NO: 794214 - DNA, 25 bp, Mus musculus
tgaaccaccagaagaggttcctcca

SEQ ID NO: 794215 - DNA, 25 bp, Mus musculus
tgaaccaccagatgaggttcctcca

SEQ ID NO: 794216 - DNA, 25 bp, Mus musculus
tgaaccacccggacacagttgaagg

SEQ ID NO: 794217 - DNA, 25 bp, Mus musculus
tgaaccacccggtcacagttgaagg

SEQ ID NO: 794218 - DNA, 25 bp, Mus musculus
tgaaccacgtatagttagtagaatt

SEQ ID NO: 794219 - DNA, 25 bp, Mus musculus
tgaaccacgtattgttagtagaatt

SEQ ID NO: 794220 - DNA, 25 bp, Mus musculus
tgaaccacttcactcagcggtacgc

SEQ ID NO: 794221 - DNA, 25 bp, Mus musculus
tgaaccacttcagtcagcggtacgc

SEQ ID NO: 794222 - DNA, 25 bp, Mus musculus
tgaaccagacagagcaggaactgga

SEQ ID NO: 794223 - DNA, 25 bp, Mus musculus
tgaaccagacagtgcaggaactgga

SEQ ID NO: 794224 - DNA, 25 bp, Mus musculus
tgaaccagaccaccatgactttgac

SEQ ID NO: 794225 - DNA, 25 bp, Mus musculus
tgaaccagaccagcatgactttgac

SEQ ID NO: 794226 - DNA, 25 bp, Mus musculus
tgaaccagacctacgaggagctggc

SEQ ID NO: 794227 - DNA, 25 bp, Mus musculus
tgaaccagaccttcgaggagctggc

SEQ ID NO: 794228 - DNA, 25 bp, Mus musculus
tgaaccagagggatgaactggtccg

SEQ ID NO: 794229 - DNA, 25 bp, Mus musculus
tgaaccagagggttgaactggtccg

SEQ ID NO: 794230 - DNA, 25 bp, Mus musculus
tgaaccagaggtccaacacaaacct

SEQ ID NO: 794231 - DNA, 25 bp, Mus musculus
tgaaccagaggtgcaacacaaacct

SEQ ID NO: 794232 - DNA, 25 bp, Mus musculus
tgaaccagagttcgttggccaagga

SEQ ID NO: 794233 - DNA, 25 bp, Mus musculus
tgaaccagagttggttggccaagga

SEQ ID NO: 794234 - DNA, 25 bp, Mus musculus
tgaaccagccttacagatcaggtag

SEQ ID NO: 794235 - DNA, 25 bp, Mus musculus
tgaaccagcctttcagatcaggtag

SEQ ID NO: 794236 - DNA, 25 bp, Mus musculus
tgaaccagctggaccggattacaga

SEQ ID NO: 794237 - DNA, 25 bp, Mus musculus
tgaaccagctggtccggattacaga

SEQ ID NO: 794238 - DNA, 25 bp, Mus musculus
tgaaccagctgtctccagaccgagg

SEQ ID NO: 794239 - DNA, 25 bp, Mus musculus
tgaaccagctgtgtccagaccgagg

SEQ ID NO: 794240 - DNA, 25 bp, Mus musculus
tgaaccaggactccttctgagtgct

SEQ ID NO: 794241 - DNA, 25 bp, Mus musculus
tgaaccaggactgcttctgagtgct

SEQ ID NO: 794242 - DNA, 25 bp, Mus musculus
tgaaccagggccactcggtgccact

SEQ ID NO: 794243 - DNA, 25 bp, Mus musculus
tgaaccagggcctctcggtgccact

SEQ ID NO: 794244 - DNA, 25 bp, Mus musculus
tgaaccaggtaaacaaccaagggct

SEQ ID NO: 794245 - DNA, 25 bp, Mus musculus
tgaaccaggtaatcaaccaagggct

SEQ ID NO: 794246 - DNA, 25 bp, Mus musculus
tgaaccagtgtaaaaacgtcctgcc

SEQ ID NO: 794247 - DNA, 25 bp, Mus musculus
tgaaccagtgtataaacgtcctgcc

SEQ ID NO: 794248 - DNA, 25 bp, Mus musculus
tgaaccatcacgaggccctgatttg

SEQ ID NO: 794249 - DNA, 25 bp, Mus musculus
tgaaccatcacgtggccctgatttg

SEQ ID NO: 794250 - DNA, 25 bp, Mus musculus
tgaaccatccaaaaagtcttaaggc

SEQ ID NO: 794251 - DNA, 25 bp, Mus musculus
tgaaccatccaataagtcttaaggc

SEQ ID NO: 794252 - DNA, 25 bp, Mus musculus
tgaaccatgaatcttttactccttt

SEQ ID NO: 794253 - DNA, 25 bp, Mus musculus
tgaaccatgaatgttttactccttt

SEQ ID NO: 794254 - DNA, 25 bp, Mus musculus
tgaaccatgccccaagaacctaagg

SEQ ID NO: 794255 - DNA, 25 bp, Mus musculus
tgaaccatgcccgaagaacctaagg

SEQ ID NO: 794256 - DNA, 25 bp, Mus musculus
tgaaccatgccgacccttgcatcag

SEQ ID NO: 794257 - DNA, 25 bp, Mus musculus
tgaaccatgccgtcccttgcatcag

SEQ ID NO: 794258 - DNA, 25 bp, Mus musculus
tgaaccatggctccgatcaaaatcg

SEQ ID NO: 794259 - DNA, 25 bp, Mus musculus
tgaaccatggctgcgatcaaaatcg

SEQ ID NO: 794260 - DNA, 25 bp, Mus musculus
tgaaccatttggacagcgccaacct

SEQ ID NO: 794261 - DNA, 25 bp, Mus musculus
tgaaccatttggtcagcgccaacct

SEQ ID NO: 794262 - DNA, 25 bp, Mus musculus
tgaacccagaccatcgggaggagga

SEQ ID NO: 794263 - DNA, 25 bp, Mus musculus
tgaacccagaccttcgggaggagga

SEQ ID NO: 794264 - DNA, 25 bp, Mus musculus
tgaacccagattcgaagctgtcccc

SEQ ID NO: 794265 - DNA, 25 bp, Mus musculus
tgaacccagattggaagctgtcccc

SEQ ID NO: 794266 - DNA, 25 bp, Mus musculus
tgaacccatataagggcagaaggag

SEQ ID NO: 794267 - DNA, 25 bp, Mus musculus
tgaacccatatatgggcagaaggag

SEQ ID NO: 794268 - DNA, 25 bp, Mus musculus
tgaacccattgaagtagaagaaggg

SEQ ID NO: 794269 - DNA, 25 bp, Mus musculus
tgaacccattgatgtagaagaaggg

SEQ ID NO: 794270 - DNA, 25 bp, Mus musculus
tgaaccccaaacagagaagtctcct

SEQ ID NO: 794271 - DNA, 25 bp, Mus musculus
tgaaccccaaactgagaagtctcct

SEQ ID NO: 794272 - DNA, 25 bp, Mus musculus
tgaaccccaacacgcagaccattta

SEQ ID NO: 794273 - DNA, 25 bp, Mus musculus
tgaaccccaacaggcagaccattta

SEQ ID NO: 794274 - DNA, 25 bp, Mus musculus
tgaaccccatgaagagggtaccagc

SEQ ID NO: 794275 - DNA, 25 bp, Mus musculus
tgaaccccatgatgagggtaccagc

SEQ ID NO: 794276 - DNA, 25 bp, Mus musculus
tgaaccccgccacgctgtcgggatg

SEQ ID NO: 794277 - DNA, 25 bp, Mus musculus
tgaaccccgccaggctgtcgggatg

SEQ ID NO: 794278 - DNA, 25 bp, Mus musculus
tgaaccccgctaaccctggagtttt

SEQ ID NO: 794279 - DNA, 25 bp, Mus musculus
tgaaccccgctatccctggagtttt

SEQ ID NO: 794280 - DNA, 25 bp, Mus musculus
tgaaccccgtccataagtgctctgt

SEQ ID NO: 794281 - DNA, 25 bp, Mus musculus
tgaaccccgtccttaagtgctctgt

SEQ ID NO: 794282 - DNA, 25 bp, Mus musculus
tgaaccccttgcaggaccgcgttcg

SEQ ID NO: 794283 - DNA, 25 bp, Mus musculus
tgaaccccttgctggaccgcgttcg

SEQ ID NO: 794284 - DNA, 25 bp, Mus musculus
tgaaccccttggaggactggctgcg

SEQ ID NO: 794285 - DNA, 25 bp, Mus musculus
tgaaccccttggtggactggctgcg

SEQ ID NO: 794286 - DNA, 25 bp, Mus musculus
tgaacccgagaaagttgataaagac

SEQ ID NO: 794287 - DNA, 25 bp, Mus musculus
tgaacccgagaatgttgataaagac

SEQ ID NO: 794288 - DNA, 25 bp, Mus musculus
tgaaccctaaacaaataggtgaaca

SEQ ID NO: 794289 - DNA, 25 bp, Mus musculus
tgaaccctaaactaataggtgaaca

SEQ ID NO: 794290 - DNA, 25 bp, Mus musculus
tgaaccctcagcagaagtctgacct

SEQ ID NO: 794291 - DNA, 25 bp, Mus musculus
tgaaccctcagctgaagtctgacct

SEQ ID NO: 794292 - DNA, 25 bp, Mus musculus
tgaaccctgacaagagtcttgccct

SEQ ID NO: 794293 - DNA, 25 bp, Mus musculus
tgaaccctgacatgagtcttgccct

SEQ ID NO: 794294 - DNA, 25 bp, Mus musculus
tgaaccctgaggagacgcagaggat

SEQ ID NO: 794295 - DNA, 25 bp, Mus musculus
tgaaccctgaggtgacgcagaggat

SEQ ID NO: 794296 - DNA, 25 bp, Mus musculus
tgaaccctgctgacattgagtctct

SEQ ID NO: 794297 - DNA, 25 bp, Mus musculus
tgaaccctgctgtcattgagtctct

SEQ ID NO: 794298 - DNA, 25 bp, Mus musculus
tgaaccctttgtaaatgccagaatg

SEQ ID NO: 794299 - DNA, 25 bp, Mus musculus
tgaaccctttgttaatgccagaatg

SEQ ID NO: 794300 - DNA, 25 bp, Mus musculus
tgaaccgaccagaccaaggaggcat

SEQ ID NO: 794301 - DNA, 25 bp, Mus musculus
tgaaccgaccagtccaaggaggcat

SEQ ID NO: 794302 - DNA, 25 bp, Mus musculus
tgaaccgacttccttaactctgctg

SEQ ID NO: 794303 - DNA, 25 bp, Mus musculus
tgaaccgacttcgttaactctgctg

SEQ ID NO: 794304 - DNA, 25 bp, Mus musculus
tgaaccgatggaagtaccctggtga

SEQ ID NO: 794305 - DNA, 25 bp, Mus musculus
tgaaccgatggatgtaccctggtga

SEQ ID NO: 794306 - DNA, 25 bp, Mus musculus
tgaaccgcaaggaggtactaaccct

SEQ ID NO: 794307 - DNA, 25 bp, Mus musculus
tgaaccgcaaggtggtactaaccct

SEQ ID NO: 794308 - DNA, 25 bp, Mus musculus
tgaaccgcaccactcctggagtgag

SEQ ID NO: 794309 - DNA, 25 bp, Mus musculus
tgaaccgcaccagtcctggagtgag

SEQ ID NO: 794310 - DNA, 25 bp, Mus musculus
tgaaccgcagctagcagggaccagg

SEQ ID NO: 794311 - DNA, 25 bp, Mus musculus
tgaaccgcagcttgcagggaccagg

SEQ ID NO: 794312 - DNA, 25 bp, Mus musculus
tgaaccgcatgcacaggactcacaa

SEQ ID NO: 794313 - DNA, 25 bp, Mus musculus
tgaaccgcatgctcaggactcacaa

SEQ ID NO: 794314 - DNA, 25 bp, Mus musculus
tgaaccgcatgtctccgggagctct

SEQ ID NO: 794315 - DNA, 25 bp, Mus musculus
tgaaccgcatgtgtccgggagctct

SEQ ID NO: 794316 - DNA, 25 bp, Mus musculus
tgaaccgccatcctgagattgtgat

SEQ ID NO: 794317 - DNA, 25 bp, Mus musculus
tgaaccgccatcgtgagattgtgat

SEQ ID NO: 794318 - DNA, 25 bp, Mus musculus
tgaaccgcctgcagtacgccgtcat

SEQ ID NO: 794319 - DNA, 25 bp, Mus musculus
tgaaccgcctgctgtacgccgtcat

SEQ ID NO: 794320 - DNA, 25 bp, Mus musculus
tgaaccgcgttacgtctcacagaca

SEQ ID NO: 794321 - DNA, 25 bp, Mus musculus
tgaaccgcgttaggtctcacagaca

SEQ ID NO: 794322 - DNA, 25 bp, Mus musculus
tgaaccgcttctcggattacctgcg

SEQ ID NO: 794323 - DNA, 25 bp, Mus musculus
tgaaccgcttctgggattacctgcg

SEQ ID NO: 794324 - DNA, 25 bp, Mus musculus
tgaaccggacaaaaggtgatgagga

SEQ ID NO: 794325 - DNA, 25 bp, Mus musculus
tgaaccggacaataggtgatgagga

SEQ ID NO: 794326 - DNA, 25 bp, Mus musculus
tgaaccggacataccctgacaacgt

SEQ ID NO: 794327 - DNA, 25 bp, Mus musculus
tgaaccggacattccctgacaacgt

SEQ ID NO: 794328 - DNA, 25 bp, Mus musculus
tgaaccgtgcctcagtcagaagacg

SEQ ID NO: 794329 - DNA, 25 bp, Mus musculus
tgaaccgtgcctgagtcagaagacg

SEQ ID NO: 794330 - DNA, 25 bp, Mus musculus
tgaaccgtgcggagctcactgccat

SEQ ID NO: 794331 - DNA, 25 bp, Mus musculus
tgaaccgtgcggtgctcactgccat

SEQ ID NO: 794332 - DNA, 25 bp, Mus musculus
tgaacctacagaacaacgaggctgg

SEQ ID NO: 794333 - DNA, 25 bp, Mus musculus
tgaacctacagatcaacgaggctgg

SEQ ID NO: 794334 - DNA, 25 bp, Mus musculus
tgaacctacagcagggctcttcacg

SEQ ID NO: 794335 - DNA, 25 bp, Mus musculus
tgaacctacagctgggctcttcacg

SEQ ID NO: 794336 - DNA, 25 bp, Mus musculus
tgaacctcaagcagagccgcaggct

SEQ ID NO: 794337 - DNA, 25 bp, Mus musculus
tgaacctcaagctgagccgcaggct

SEQ ID NO: 794338 - DNA, 25 bp, Mus musculus
tgaacctcaatacctgtgctgcccg

SEQ ID NO: 794339 - DNA, 25 bp, Mus musculus
tgaacctcaatagctgtgctgcccg

SEQ ID NO: 794340 - DNA, 25 bp, Mus musculus
tgaacctcaccgagaaaatcaagaa

SEQ ID NO: 794341 - DNA, 25 bp, Mus musculus
tgaacctcaccgtgaaaatcaagaa

SEQ ID NO: 794342 - DNA, 25 bp, Mus musculus
tgaacctcactgaggccagagtgca

SEQ ID NO: 794343 - DNA, 25 bp, Mus musculus
tgaacctcactgtggccagagtgca

SEQ ID NO: 794344 - DNA, 25 bp, Mus musculus
tgaacctcagaaatgcacagggcaa

SEQ ID NO: 794345 - DNA, 25 bp, Mus musculus
tgaacctcagaattgcacagggcaa

SEQ ID NO: 794346 - DNA, 25 bp, Mus musculus
tgaacctgaaagcaaagaccgagtg

SEQ ID NO: 794347 - DNA, 25 bp, Mus musculus
tgaacctgaaaggaaagaccgagtg

SEQ ID NO: 794348 - DNA, 25 bp, Mus musculus
tgaacctgacagattcccgcttggc

SEQ ID NO: 794349 - DNA, 25 bp, Mus musculus
tgaacctgacagtttcccgcttggc

SEQ ID NO: 794350 - DNA, 25 bp, Mus musculus
tgaacctgacataccatgcccaaaa

SEQ ID NO: 794351 - DNA, 25 bp, Mus musculus
tgaacctgacattccatgcccaaaa

SEQ ID NO: 794352 - DNA, 25 bp, Mus musculus
tgaacctgacccactccaggagagc

SEQ ID NO: 794353 - DNA, 25 bp, Mus musculus
tgaacctgaccctctccaggagagc

SEQ ID NO: 794354 - DNA, 25 bp, Mus musculus
tgaacctgactcagaggcctggagt

SEQ ID NO: 794355 - DNA, 25 bp, Mus musculus
tgaacctgactctgaggcctggagt

SEQ ID NO: 794356 - DNA, 25 bp, Mus musculus
tgaacctgaggaagatcagctctga

SEQ ID NO: 794357 - DNA, 25 bp, Mus musculus
tgaacctgaggatgatcagctctga

SEQ ID NO: 794358 - DNA, 25 bp, Mus musculus
tgaacctgaggccttaccatagctg

SEQ ID NO: 794359 - DNA, 25 bp, Mus musculus
tgaacctgaggccttcatttgtgtt

SEQ ID NO: 794360 - DNA, 25 bp, Mus musculus
tgaacctgaggcgttaccatagctg

SEQ ID NO: 794361 - DNA, 25 bp, Mus musculus
tgaacctgaggcgttcatttgtgtt

SEQ ID NO: 794362 - DNA, 25 bp, Mus musculus
tgaacctgatggactgccttaaatc

SEQ ID NO: 794363 - DNA, 25 bp, Mus musculus
tgaacctgatggaggagggaaaaaa

SEQ ID NO: 794364 - DNA, 25 bp, Mus musculus
tgaacctgatggtctgccttaaatc

SEQ ID NO: 794365 - DNA, 25 bp, Mus musculus
tgaacctgatggtggagggaaaaaa

SEQ ID NO: 794366 - DNA, 25 bp, Mus musculus
tgaacctgcaggatgggagaacaag

SEQ ID NO: 794367 - DNA, 25 bp, Mus musculus
tgaacctgcaggttgggagaacaag

SEQ ID NO: 794368 - DNA, 25 bp, Mus musculus
tgaacctgccctcaaagtttgtgcg

SEQ ID NO: 794369 - DNA, 25 bp, Mus musculus
tgaacctgccctgaaagtttgtgcg

SEQ ID NO: 794370 - DNA, 25 bp, Mus musculus
tgaacctgcctcaccgtgtcactcg

SEQ ID NO: 794371 - DNA, 25 bp, Mus musculus
tgaacctgcctctccgtgtcactcg

SEQ ID NO: 794372 - DNA, 25 bp, Mus musculus
tgaacctgcttaacaccataatggg

SEQ ID NO: 794373 - DNA, 25 bp, Mus musculus
tgaacctgcttatcaccataatggg

SEQ ID NO: 794374 - DNA, 25 bp, Mus musculus
tgaacctggccaagattaattatgt

SEQ ID NO: 794375 - DNA, 25 bp, Mus musculus
tgaacctggccatgattaattatgt

SEQ ID NO: 794376 - DNA, 25 bp, Mus musculus
tgaacctggcctacattgccaacct

SEQ ID NO: 794377 - DNA, 25 bp, Mus musculus
tgaacctggccttcattgccaacct

SEQ ID NO: 794378 - DNA, 25 bp, Mus musculus
tgaacctgggatctgaaccaaagcc

SEQ ID NO: 794379 - DNA, 25 bp, Mus musculus
tgaacctgggatgtgaaccaaagcc

SEQ ID NO: 794380 - DNA, 25 bp, Mus musculus
tgaacctgggcaacctagaagtgac

SEQ ID NO: 794381 - DNA, 25 bp, Mus musculus
tgaacctgggcatcctagaagtgac

SEQ ID NO: 794382 - DNA, 25 bp, Mus musculus
tgaacctggtcgcagttcaatgccc

SEQ ID NO: 794383 - DNA, 25 bp, Mus musculus
tgaacctggtcggagttcaatgccc

SEQ ID NO: 794384 - DNA, 25 bp, Mus musculus
tgaacctgtggaactgggcagttac

SEQ ID NO: 794385 - DNA, 25 bp, Mus musculus
tgaacctgtggatctgggcagttac

SEQ ID NO: 794386 - DNA, 25 bp, Mus musculus
tgaaccttacagatttgctcctatt

SEQ ID NO: 794387 - DNA, 25 bp, Mus musculus
tgaaccttacagttttgctcctatt

SEQ ID NO: 794388 - DNA, 25 bp, Mus musculus
tgaaccttcaggatccaccttaagg

SEQ ID NO: 794389 - DNA, 25 bp, Mus musculus
tgaaccttcaggttccaccttaagg

SEQ ID NO: 794390 - DNA, 25 bp, Mus musculus
tgaaccttcgggatgccgaaacagg

SEQ ID NO: 794391 - DNA, 25 bp, Mus musculus
tgaaccttcgggttgccgaaacagg

SEQ ID NO: 794392 - DNA, 25 bp, Mus musculus
tgaaccttctgaacgccatgttcag

SEQ ID NO: 794393 - DNA, 25 bp, Mus musculus
tgaaccttctgatcgccatgttcag

SEQ ID NO: 794394 - DNA, 25 bp, Mus musculus
tgaaccttctttctcccggcagcga

SEQ ID NO: 794395 - DNA, 25 bp, Mus musculus
tgaaccttctttgtcccggcagcga

SEQ ID NO: 794396 - DNA, 25 bp, Mus musculus
tgaaccttgatcaacttgctaccag

SEQ ID NO: 794397 - DNA, 25 bp, Mus musculus
tgaaccttgatctacttgctaccag

SEQ ID NO: 794398 - DNA, 25 bp, Mus musculus
tgaaccttgcctcgaaagatacaag

SEQ ID NO: 794399 - DNA, 25 bp, Mus musculus
tgaaccttgcctggaaagatacaag

SEQ ID NO: 794400 - DNA, 25 bp, Mus musculus
tgaaccttttataggagagatgagc

SEQ ID NO: 794401 - DNA, 25 bp, Mus musculus
tgaaccttttattggagagatgagc

SEQ ID NO: 794402 - DNA, 25 bp, Mus musculus
tgaacgaaccacagtccaatgagga

SEQ ID NO: 794403 - DNA, 25 bp, Mus musculus
tgaacgaaccactgtccaatgagga

SEQ ID NO: 794404 - DNA, 25 bp, Mus musculus
tgaacgaacttcacctggaccacaa

SEQ ID NO: 794405 - DNA, 25 bp, Mus musculus
tgaacgaacttctcctggaccacaa

SEQ ID NO: 794406 - DNA, 25 bp, Mus musculus
tgaacgaattaaactcacaggagaa

SEQ ID NO: 794407 - DNA, 25 bp, Mus musculus
tgaacgaattaatctcacaggagaa

SEQ ID NO: 794408 - DNA, 25 bp, Mus musculus
tgaacgacatgtcgacaattggcct

SEQ ID NO: 794409 - DNA, 25 bp, Mus musculus
tgaacgacatgtggacaattggcct

SEQ ID NO: 794410 - DNA, 25 bp, Mus musculus
tgaacgaccagtactacaatgccat

SEQ ID NO: 794411 - DNA, 25 bp, Mus musculus
tgaacgaccagttctacaatgccat

SEQ ID NO: 794412 - DNA, 25 bp, Mus musculus
tgaacgagacaactgccagtacgtt

SEQ ID NO: 794413 - DNA, 25 bp, Mus musculus
tgaacgagacaagtgccagtacgtt

SEQ ID NO: 794414 - DNA, 25 bp, Mus musculus
tgaacgagatggacatgtgcccaga

SEQ ID NO: 794415 - DNA, 25 bp, Mus musculus
tgaacgagatggtcatgtgcccaga

SEQ ID NO: 794416 - DNA, 25 bp, Mus musculus
tgaacgagcaagctacgctctggag

SEQ ID NO: 794417 - DNA, 25 bp, Mus musculus
tgaacgagcaaggtacgctctggag

SEQ ID NO: 794418 - DNA, 25 bp, Mus musculus
tgaacgagctctaacaggaacactc

SEQ ID NO: 794419 - DNA, 25 bp, Mus musculus
tgaacgagctcttacaggaacactc

SEQ ID NO: 794420 - DNA, 25 bp, Mus musculus
tgaacgaggagcatccattgcacat

SEQ ID NO: 794421 - DNA, 25 bp, Mus musculus
tgaacgaggagcttccattgcacat

SEQ ID NO: 794422 - DNA, 25 bp, Mus musculus
tgaacgagggctacctcaacaaccc

SEQ ID NO: 794423 - DNA, 25 bp, Mus musculus
tgaacgagggcttcctcaacaaccc

SEQ ID NO: 794424 - DNA, 25 bp, Mus musculus
tgaacgaggtagagagatcaaccgc

SEQ ID NO: 794425 - DNA, 25 bp, Mus musculus
tgaacgaggtagtgagatcaaccgc

SEQ ID NO: 794426 - DNA, 25 bp, Mus musculus
tgaacgagtgcaccaagcctcacct

SEQ ID NO: 794427 - DNA, 25 bp, Mus musculus
tgaacgagtgcagcaagcctcacct

SEQ ID NO: 794428 - DNA, 25 bp, Mus musculus
tgaacgagtgcgaaactgagaatcc

SEQ ID NO: 794429 - DNA, 25 bp, Mus musculus
tgaacgagtgcgtaactgagaatcc

SEQ ID NO: 794430 - DNA, 25 bp, Mus musculus
tgaacgagtgttcgtacagggctat

SEQ ID NO: 794431 - DNA, 25 bp, Mus musculus
tgaacgagtgttggtacagggctat

SEQ ID NO: 794432 - DNA, 25 bp, Mus musculus
tgaacgagtttacagccacgctgtc

SEQ ID NO: 794433 - DNA, 25 bp, Mus musculus
tgaacgagtttagagccacgctgtc

SEQ ID NO: 794434 - DNA, 25 bp, Mus musculus
tgaacgagtttgagtacctgaagct

SEQ ID NO: 794435 - DNA, 25 bp, Mus musculus
tgaacgagtttgtgtacctgaagct

SEQ ID NO: 794436 - DNA, 25 bp, Mus musculus
tgaacgatgagtatagcctgtcccc

SEQ ID NO: 794437 - DNA, 25 bp, Mus musculus
tgaacgatgagtttagcctgtcccc

SEQ ID NO: 794438 - DNA, 25 bp, Mus musculus
tgaacgatgctcacagcatccggga

SEQ ID NO: 794439 - DNA, 25 bp, Mus musculus
tgaacgatgctctcagcatccggga

SEQ ID NO: 794440 - DNA, 25 bp, Mus musculus
tgaacgcaagtgagagcccatagtc

SEQ ID NO: 794441 - DNA, 25 bp, Mus musculus
tgaacgcaagtgtgagcccatagtc

SEQ ID NO: 794442 - DNA, 25 bp, Mus musculus
tgaacgcacccaataattgcgtgtg

SEQ ID NO: 794443 - DNA, 25 bp, Mus musculus
tgaacgcacccattaattgcgtgtg

SEQ ID NO: 794444 - DNA, 25 bp, Mus musculus
tgaacgcagcccaaagtatcatctt

SEQ ID NO: 794445 - DNA, 25 bp, Mus musculus
tgaacgcagccctaagtatcatctt

SEQ ID NO: 794446 - DNA, 25 bp, Mus musculus
tgaacgcatcatacagaacctggat

SEQ ID NO: 794447 - DNA, 25 bp, Mus musculus
tgaacgcatcattcagaacctggat

SEQ ID NO: 794448 - DNA, 25 bp, Mus musculus
tgaacgccctggagcctgtgctgga

SEQ ID NO: 794449 - DNA, 25 bp, Mus musculus
tgaacgccctggtgcctgtgctgga

SEQ ID NO: 794450 - DNA, 25 bp, Mus musculus
tgaacgccttcaagcagagaaaggc

SEQ ID NO: 794451 - DNA, 25 bp, Mus musculus
tgaacgccttcatgcagagaaaggc

SEQ ID NO: 794452 - DNA, 25 bp, Mus musculus
tgaacgcttccgaacaggccagact

SEQ ID NO: 794453 - DNA, 25 bp, Mus musculus
tgaacgcttccgtacaggccagact

SEQ ID NO: 794454 - DNA, 25 bp, Mus musculus
tgaacgctttcaaggtgggctgcat

SEQ ID NO: 794455 - DNA, 25 bp, Mus musculus
tgaacgctttcatggtgggctgcat

SEQ ID NO: 794456 - DNA, 25 bp, Mus musculus
tgaacggacagtaggacctaagtgg

SEQ ID NO: 794457 - DNA, 25 bp, Mus musculus
tgaacggacagttggacctaagtgg

SEQ ID NO: 794458 - DNA, 25 bp, Mus musculus
tgaacggaccagaagtgagctcctg

SEQ ID NO: 794459 - DNA, 25 bp, Mus musculus
tgaacggaccagtagtgagctcctg

SEQ ID NO: 794460 - DNA, 25 bp, Mus musculus
tgaacggcaaagctttcaccgggaa

SEQ ID NO: 794461 - DNA, 25 bp, Mus musculus
tgaacggcaaaggtttcaccgggaa

SEQ ID NO: 794462 - DNA, 25 bp, Mus musculus
tgaacggctgacaactcaagacagt

SEQ ID NO: 794463 - DNA, 25 bp, Mus musculus
tgaacggctgactactcaagacagt

SEQ ID NO: 794464 - DNA, 25 bp, Mus musculus
tgaacggctgttacctcttatccaa

SEQ ID NO: 794465 - DNA, 25 bp, Mus musculus
tgaacggctgtttcctcttatccaa

SEQ ID NO: 794466 - DNA, 25 bp, Mus musculus
tgaacggcttgaaggcctctcgctt

SEQ ID NO: 794467 - DNA, 25 bp, Mus musculus
tgaacggcttgacactccagtccaa

SEQ ID NO: 794468 - DNA, 25 bp, Mus musculus
tgaacggcttgagactccagtccaa

SEQ ID NO: 794469 - DNA, 25 bp, Mus musculus
tgaacggcttgatggcctctcgctt

SEQ ID NO: 794470 - DNA, 25 bp, Mus musculus
tgaacgggtcaaagtggcagaacat

SEQ ID NO: 794471 - DNA, 25 bp, Mus musculus
tgaacgggtcaatgtggcagaacat

SEQ ID NO: 794472 - DNA, 25 bp, Mus musculus
tgaacgtaatagaaccatggctcag

SEQ ID NO: 794473 - DNA, 25 bp, Mus musculus
tgaacgtaatagtaccatggctcag

SEQ ID NO: 794474 - DNA, 25 bp, Mus musculus
tgaacgtagaagcattttcacagcc

SEQ ID NO: 794475 - DNA, 25 bp, Mus musculus
tgaacgtagaaggattttcacagcc

SEQ ID NO: 794476 - DNA, 25 bp, Mus musculus
tgaacgtcactccaaaggcctactg

SEQ ID NO: 794477 - DNA, 25 bp, Mus musculus
tgaacgtcactcgaaaggcctactg

SEQ ID NO: 794478 - DNA, 25 bp, Mus musculus
tgaacgtcgcctactacgtggcaga

SEQ ID NO: 794479 - DNA, 25 bp, Mus musculus
tgaacgtcgccttctacgtggcaga

SEQ ID NO: 794480 - DNA, 25 bp, Mus musculus
tgaacgtctaggagtggagtacaca

SEQ ID NO: 794481 - DNA, 25 bp, Mus musculus
tgaacgtctaggtgtggagtacaca

SEQ ID NO: 794482 - DNA, 25 bp, Mus musculus
tgaacgtgccacactttgcctgggc

SEQ ID NO: 794483 - DNA, 25 bp, Mus musculus
tgaacgtgccactctttgcctgggc

SEQ ID NO: 794484 - DNA, 25 bp, Mus musculus
tgaacgtgcttgaggtcctgaagca

SEQ ID NO: 794485 - DNA, 25 bp, Mus musculus
tgaacgtgcttgtggtcctgaagca

SEQ ID NO: 794486 - DNA, 25 bp, Mus musculus
tgaacgtggagtaggcctttctggc

SEQ ID NO: 794487 - DNA, 25 bp, Mus musculus
tgaacgtggagttggcctttctggc

SEQ ID NO: 794488 - DNA, 25 bp, Mus musculus
tgaacgtggtagaaggcattgagct

SEQ ID NO: 794489 - DNA, 25 bp, Mus musculus
tgaacgtggtagtaggcattgagct

SEQ ID NO: 794490 - DNA, 25 bp, Mus musculus
tgaacgtgtcctcatgagagtagga

SEQ ID NO: 794491 - DNA, 25 bp, Mus musculus
tgaacgtgtcctgatgagagtagga

SEQ ID NO: 794492 - DNA, 25 bp, Mus musculus
tgaacgtgtcttctgaggccggaac

SEQ ID NO: 794493 - DNA, 25 bp, Mus musculus
tgaacgtgtcttgtgaggccggaac

SEQ ID NO: 794494 - DNA, 25 bp, Mus musculus
tgaacgtgttgacagaatgtgcccg

SEQ ID NO: 794495 - DNA, 25 bp, Mus musculus
tgaacgtgttgagagaatgtgcccg

SEQ ID NO: 794496 - DNA, 25 bp, Mus musculus
tgaacgttacctatgtcgccctgaa

SEQ ID NO: 794497 - DNA, 25 bp, Mus musculus
tgaacgttacctttgtcgccctgaa

SEQ ID NO: 794498 - DNA, 25 bp, Mus musculus
tgaactaaacatccggtctgctcga

SEQ ID NO: 794499 - DNA, 25 bp, Mus musculus
tgaactaaacatgcggtctgctcga

SEQ ID NO: 794500 - DNA, 25 bp, Mus musculus
tgaactaaatggacttgctgtcaaa

SEQ ID NO: 794501 - DNA, 25 bp, Mus musculus
tgaactaaatggtcttgctgtcaaa

SEQ ID NO: 794502 - DNA, 25 bp, Mus musculus
tgaactaatgtgaggctgctaactt

SEQ ID NO: 794503 - DNA, 25 bp, Mus musculus
tgaactaatgtgtggctgctaactt

SEQ ID NO: 794504 - DNA, 25 bp, Mus musculus
tgaactacacggaggtgcccaccag

SEQ ID NO: 794505 - DNA, 25 bp, Mus musculus
tgaactacacggtggtgcccaccag

SEQ ID NO: 794506 - DNA, 25 bp, Mus musculus
tgaactacagatcatcaaatacagc

SEQ ID NO: 794507 - DNA, 25 bp, Mus musculus
tgaactacagatgatcaaatacagc

SEQ ID NO: 794508 - DNA, 25 bp, Mus musculus
tgaactacaggcaagagactggccc

SEQ ID NO: 794509 - DNA, 25 bp, Mus musculus
tgaactacaggctagagactggccc

SEQ ID NO: 794510 - DNA, 25 bp, Mus musculus
tgaactacatgaaagtaagagctgg

SEQ ID NO: 794511 - DNA, 25 bp, Mus musculus
tgaactacatgatagtaagagctgg

SEQ ID NO: 794512 - DNA, 25 bp, Mus musculus
tgaactaccacgatggagagaccgt

SEQ ID NO: 794513 - DNA, 25 bp, Mus musculus
tgaactaccacgttggagagaccgt

SEQ ID NO: 794514 - DNA, 25 bp, Mus musculus
tgaactagatcgaagcatccgaggt

SEQ ID NO: 794515 - DNA, 25 bp, Mus musculus
tgaactagatcgtagcatccgaggt

SEQ ID NO: 794516 - DNA, 25 bp, Mus musculus
tgaactagctgaagtagaggataac

SEQ ID NO: 794517 - DNA, 25 bp, Mus musculus
tgaactagctgatgtagaggataac

SEQ ID NO: 794518 - DNA, 25 bp, Mus musculus
tgaactaggagtcgacaaagcagga

SEQ ID NO: 794519 - DNA, 25 bp, Mus musculus
tgaactaggagtggacaaagcagga

SEQ ID NO: 794520 - DNA, 25 bp, Mus musculus
tgaactaggcaaagagccagcatcc

SEQ ID NO: 794521 - DNA, 25 bp, Mus musculus
tgaactaggcaatgagccagcatcc

SEQ ID NO: 794522 - DNA, 25 bp, Mus musculus
tgaactagggcaaagtcccaagctt

SEQ ID NO: 794523 - DNA, 25 bp, Mus musculus
tgaactagggcatagtcccaagctt

SEQ ID NO: 794524 - DNA, 25 bp, Mus musculus
tgaactatgacgaggagcctgacaa

SEQ ID NO: 794525 - DNA, 25 bp, Mus musculus
tgaactatgacgtggagcctgacaa

SEQ ID NO: 794526 - DNA, 25 bp, Mus musculus
tgaactatgtggagagactctgaaa

SEQ ID NO: 794527 - DNA, 25 bp, Mus musculus
tgaactatgtggtgagactctgaaa

SEQ ID NO: 794528 - DNA, 25 bp, Mus musculus
tgaactcaaagcactcggtacagga

SEQ ID NO: 794529 - DNA, 25 bp, Mus musculus
tgaactcaaagctctcggtacagga

SEQ ID NO: 794530 - DNA, 25 bp, Mus musculus
tgaactcaaagtcggatctcagacg

SEQ ID NO: 794531 - DNA, 25 bp, Mus musculus
tgaactcaaagtgggatctcagacg

SEQ ID NO: 794532 - DNA, 25 bp, Mus musculus
tgaactcaaggaaacagagggctgg

SEQ ID NO: 794533 - DNA, 25 bp, Mus musculus
tgaactcaaggatacagagggctgg

SEQ ID NO: 794534 - DNA, 25 bp, Mus musculus
tgaactcaatgacacctgggaggag

SEQ ID NO: 794535 - DNA, 25 bp, Mus musculus
tgaactcaatgagacctgggaggag

SEQ ID NO: 794536 - DNA, 25 bp, Mus musculus
tgaactcacagtaggaacgcggcct

SEQ ID NO: 794537 - DNA, 25 bp, Mus musculus
tgaactcacagttggaacgcggcct

SEQ ID NO: 794538 - DNA, 25 bp, Mus musculus
tgaactcactgtctctttgcagcat

SEQ ID NO: 794539 - DNA, 25 bp, Mus musculus
tgaactcactgtgtctttgcagcat

SEQ ID NO: 794540 - DNA, 25 bp, Mus musculus
tgaactcagaacagtacaccagtag

SEQ ID NO: 794541 - DNA, 25 bp, Mus musculus
tgaactcagaactgtacaccagtag

SEQ ID NO: 794542 - DNA, 25 bp, Mus musculus
tgaactcaggaaagtgcgccagtgg

SEQ ID NO: 794543 - DNA, 25 bp, Mus musculus
tgaactcaggaatgtgcgccagtgg

SEQ ID NO: 794544 - DNA, 25 bp, Mus musculus
tgaactcagtaaccacacacggcct

SEQ ID NO: 794545 - DNA, 25 bp, Mus musculus
tgaactcagtaagcacacacggcct

SEQ ID NO: 794546 - DNA, 25 bp, Mus musculus
tgaactcatctcctcgaagccataa

SEQ ID NO: 794547 - DNA, 25 bp, Mus musculus
tgaactcatctcgtcgaagccataa

SEQ ID NO: 794548 - DNA, 25 bp, Mus musculus
tgaactcattgtcacggaggagaac

SEQ ID NO: 794549 - DNA, 25 bp, Mus musculus
tgaactcattgtgacggaggagaac

SEQ ID NO: 794550 - DNA, 25 bp, Mus musculus
tgaactccaaagcacatataatggc

SEQ ID NO: 794551 - DNA, 25 bp, Mus musculus
tgaactccaaaggacatataatggc

SEQ ID NO: 794552 - DNA, 25 bp, Mus musculus
tgaactccacgaattccagaaagga

SEQ ID NO: 794553 - DNA, 25 bp, Mus musculus
tgaactccacgatttccagaaagga

SEQ ID NO: 794554 - DNA, 25 bp, Mus musculus
tgaactcccagtacctgaagctgct

SEQ ID NO: 794555 - DNA, 25 bp, Mus musculus
tgaactcccagttcctgaagctgct

SEQ ID NO: 794556 - DNA, 25 bp, Mus musculus
tgaactccggatatgcaatcaaccc

SEQ ID NO: 794557 - DNA, 25 bp, Mus musculus
tgaactccggatttgcaatcaaccc

SEQ ID NO: 794558 - DNA, 25 bp, Mus musculus
tgaactcctcccacagtacttagac

SEQ ID NO: 794559 - DNA, 25 bp, Mus musculus
tgaactcctccctcagtacttagac

SEQ ID NO: 794560 - DNA, 25 bp, Mus musculus
tgaactcctgctcaccgagtggcac

SEQ ID NO: 794561 - DNA, 25 bp, Mus musculus
tgaactcctgctgaccgagtggcac

SEQ ID NO: 794562 - DNA, 25 bp, Mus musculus
tgaactccttgaatgaacagcgtgg

SEQ ID NO: 794563 - DNA, 25 bp, Mus musculus
tgaactccttgattgaacagcgtgg

SEQ ID NO: 794564 - DNA, 25 bp, Mus musculus
tgaactccttttaccggaaggccat

SEQ ID NO: 794565 - DNA, 25 bp, Mus musculus
tgaactcctttttccggaaggccat

SEQ ID NO: 794566 - DNA, 25 bp, Mus musculus
tgaactcgaagacgcagaggaccgt

SEQ ID NO: 794567 - DNA, 25 bp, Mus musculus
tgaactcgaagaggcagaggaccgt

SEQ ID NO: 794568 - DNA, 25 bp, Mus musculus
tgaactcgcagcagctgaccgcctt

SEQ ID NO: 794569 - DNA, 25 bp, Mus musculus
tgaactcgcagctgctgaccgcctt

SEQ ID NO: 794570 - DNA, 25 bp, Mus musculus
tgaactcgtagtagtcggaccagag

SEQ ID NO: 794571 - DNA, 25 bp, Mus musculus
tgaactcgtagttgtcggaccagag

SEQ ID NO: 794572 - DNA, 25 bp, Mus musculus
tgaactctaacgctgctgcctttgc

SEQ ID NO: 794573 - DNA, 25 bp, Mus musculus
tgaactctaacggtgctgcctttgc

SEQ ID NO: 794574 - DNA, 25 bp, Mus musculus
tgaactctacccacattgctgacga

SEQ ID NO: 794575 - DNA, 25 bp, Mus musculus
tgaactctaccctcattgctgacga

SEQ ID NO: 794576 - DNA, 25 bp, Mus musculus
tgaactctactgcaatagctacaac

SEQ ID NO: 794577 - DNA, 25 bp, Mus musculus
tgaactctactggaatagctacaac

SEQ ID NO: 794578 - DNA, 25 bp, Mus musculus
tgaactctataaaatcaaggaggag

SEQ ID NO: 794579 - DNA, 25 bp, Mus musculus
tgaactctataatatcaaggaggag

SEQ ID NO: 794580 - DNA, 25 bp, Mus musculus
tgaactctcagacgcagaaggcaca

SEQ ID NO: 794581 - DNA, 25 bp, Mus musculus
tgaactctcagaggcagaaggcaca

SEQ ID NO: 794582 - DNA, 25 bp, Mus musculus
tgaactctcgctcctctgttctggc

SEQ ID NO: 794583 - DNA, 25 bp, Mus musculus
tgaactctcgctgctctgttctggc

SEQ ID NO: 794584 - DNA, 25 bp, Mus musculus
tgaactctctccctctgatgtgtcc

SEQ ID NO: 794585 - DNA, 25 bp, Mus musculus
tgaactctctccgtctgatgtgtcc

SEQ ID NO: 794586 - DNA, 25 bp, Mus musculus
tgaactctgaacctgagctacagca

SEQ ID NO: 794587 - DNA, 25 bp, Mus musculus
tgaactctgaacgtgagctacagca

SEQ ID NO: 794588 - DNA, 25 bp, Mus musculus
tgaactctgaggcacagtcatactg

SEQ ID NO: 794589 - DNA, 25 bp, Mus musculus
tgaactctgagggacagtcatactg

SEQ ID NO: 794590 - DNA, 25 bp, Mus musculus
tgaactctgcttcattgagggaacc

SEQ ID NO: 794591 - DNA, 25 bp, Mus musculus
tgaactctgcttgattgagggaacc

SEQ ID NO: 794592 - DNA, 25 bp, Mus musculus
tgaactgaaaagaagatggcgaggc

SEQ ID NO: 794593 - DNA, 25 bp, Mus musculus
tgaactgaaaagtagatggcgaggc

SEQ ID NO: 794594 - DNA, 25 bp, Mus musculus
tgaactgaaggaaatcaacactaac

SEQ ID NO: 794595 - DNA, 25 bp, Mus musculus
tgaactgaaggatatcaacactaac

SEQ ID NO: 794596 - DNA, 25 bp, Mus musculus
tgaactgaaggcaggagtcacatgg

SEQ ID NO: 794597 - DNA, 25 bp, Mus musculus
tgaactgaaggctggagtcacatgg

SEQ ID NO: 794598 - DNA, 25 bp, Mus musculus
tgaactgaatgcagcaagataccag

SEQ ID NO: 794599 - DNA, 25 bp, Mus musculus
tgaactgaatgctgcaagataccag

SEQ ID NO: 794600 - DNA, 25 bp, Mus musculus
tgaactgagcagctcattcttcgca

SEQ ID NO: 794601 - DNA, 25 bp, Mus musculus
tgaactgagcaggtcattcttcgca

SEQ ID NO: 794602 - DNA, 25 bp, Mus musculus
tgaactgatagaaaggaaaacctgt

SEQ ID NO: 794603 - DNA, 25 bp, Mus musculus
tgaactgatagataggaaaacctgt

SEQ ID NO: 794604 - DNA, 25 bp, Mus musculus
tgaactgcacggagctacaggagct

SEQ ID NO: 794605 - DNA, 25 bp, Mus musculus
tgaactgcacggtgctacaggagct

SEQ ID NO: 794606 - DNA, 25 bp, Mus musculus
tgaactgccaccagattatccatcc

SEQ ID NO: 794607 - DNA, 25 bp, Mus musculus
tgaactgccacctgattatccatcc

SEQ ID NO: 794608 - DNA, 25 bp, Mus musculus
tgaactgccgacactatcgaaaagc

SEQ ID NO: 794609 - DNA, 25 bp, Mus musculus
tgaactgccgactctatcgaaaagc

SEQ ID NO: 794610 - DNA, 25 bp, Mus musculus
tgaactgcgagccatggcccgaaag

SEQ ID NO: 794611 - DNA, 25 bp, Mus musculus
tgaactgcgagcgatggcccgaaag

SEQ ID NO: 794612 - DNA, 25 bp, Mus musculus
tgaactgcgcagctaacgctctggg

SEQ ID NO: 794613 - DNA, 25 bp, Mus musculus
tgaactgcgcaggtaacgctctggg

SEQ ID NO: 794614 - DNA, 25 bp, Mus musculus
tgaactgctacaccagtgttgggag

SEQ ID NO: 794615 - DNA, 25 bp, Mus musculus
tgaactgctacagcagtgttgggag

SEQ ID NO: 794616 - DNA, 25 bp, Mus musculus
tgaactgctgcaccgtaagcatgag

SEQ ID NO: 794617 - DNA, 25 bp, Mus musculus
tgaactgctgcagcgtaagcatgag

SEQ ID NO: 794618 - DNA, 25 bp, Mus musculus
tgaactggacctaggcttaaatcat

SEQ ID NO: 794619 - DNA, 25 bp, Mus musculus
tgaactggaccttggcttaaatcat

SEQ ID NO: 794620 - DNA, 25 bp, Mus musculus
tgaactggacgtaaagtctctacgg

SEQ ID NO: 794621 - DNA, 25 bp, Mus musculus
tgaactggacgttaagtctctacgg

SEQ ID NO: 794622 - DNA, 25 bp, Mus musculus
tgaactggagcgagtggccaagtct

SEQ ID NO: 794623 - DNA, 25 bp, Mus musculus
tgaactggagcgtgtggccaagtct

SEQ ID NO: 794624 - DNA, 25 bp, Mus musculus
tgaactggatcactttactccgcct

SEQ ID NO: 794625 - DNA, 25 bp, Mus musculus
tgaactggatcagtttactccgcct

SEQ ID NO: 794626 - DNA, 25 bp, Mus musculus
tgaactggcagccaaagaacatgca

SEQ ID NO: 794627 - DNA, 25 bp, Mus musculus
tgaactggcagcgaaagaacatgca

SEQ ID NO: 794628 - DNA, 25 bp, Mus musculus
tgaactggccaaaaaccagaaagac

SEQ ID NO: 794629 - DNA, 25 bp, Mus musculus
tgaactggccaataaccagaaagac

SEQ ID NO: 794630 - DNA, 25 bp, Mus musculus
tgaactggccacatctcttagaagt

SEQ ID NO: 794631 - DNA, 25 bp, Mus musculus
tgaactggccacttctcttagaagt

SEQ ID NO: 794632 - DNA, 25 bp, Mus musculus
tgaactggccgacatactaacagag

SEQ ID NO: 794633 - DNA, 25 bp, Mus musculus
tgaactggccgagatactaacagag

SEQ ID NO: 794634 - DNA, 25 bp, Mus musculus
tgaactgggagcaaataaaatgcta

SEQ ID NO: 794635 - DNA, 25 bp, Mus musculus
tgaactgggagctaataaaatgcta

SEQ ID NO: 794636 - DNA, 25 bp, Mus musculus
tgaactgggatccaaagaagcgacc

SEQ ID NO: 794637 - DNA, 25 bp, Mus musculus
tgaactgggatcgaaagaagcgacc

SEQ ID NO: 794638 - DNA, 25 bp, Mus musculus
tgaactggtgaacccattgtatccc

SEQ ID NO: 794639 - DNA, 25 bp, Mus musculus
tgaactggtgaagccattgtatccc

SEQ ID NO: 794640 - DNA, 25 bp, Mus musculus
tgaactggtggaaaatgctcggcaa

SEQ ID NO: 794641 - DNA, 25 bp, Mus musculus
tgaactggtggataatgctcggcaa

SEQ ID NO: 794642 - DNA, 25 bp, Mus musculus
tgaactggttcactattacatggaa

SEQ ID NO: 794643 - DNA, 25 bp, Mus musculus
tgaactggttcagtattacatggaa

SEQ ID NO: 794644 - DNA, 25 bp, Mus musculus
tgaactgtcatgagataacctggga

SEQ ID NO: 794645 - DNA, 25 bp, Mus musculus
tgaactgtcatgtgataacctggga

SEQ ID NO: 794646 - DNA, 25 bp, Mus musculus
tgaactgtccctcttgccactggca

SEQ ID NO: 794647 - DNA, 25 bp, Mus musculus
tgaactgtccctgttgccactggca

SEQ ID NO: 794648 - DNA, 25 bp, Mus musculus
tgaactgtcctgctgacaaactggg

SEQ ID NO: 794649 - DNA, 25 bp, Mus musculus
tgaactgtcctggtgacaaactggg

SEQ ID NO: 794650 - DNA, 25 bp, Mus musculus
tgaactgtcgatcaagcatggcctc

SEQ ID NO: 794651 - DNA, 25 bp, Mus musculus
tgaactgtcgatgaagcatggcctc

SEQ ID NO: 794652 - DNA, 25 bp, Mus musculus
tgaactgtgacaagctgccgaacca

SEQ ID NO: 794653 - DNA, 25 bp, Mus musculus
tgaactgtgacatgctgccgaacca

SEQ ID NO: 794654 - DNA, 25 bp, Mus musculus
tgaactgtgtcccaagatcaggatt

SEQ ID NO: 794655 - DNA, 25 bp, Mus musculus
tgaactgtgtccgaagatcaggatt

SEQ ID NO: 794656 - DNA, 25 bp, Mus musculus
tgaactgttcccactcctagtgtgt

SEQ ID NO: 794657 - DNA, 25 bp, Mus musculus
tgaactgttccctctcctagtgtgt

SEQ ID NO: 794658 - DNA, 25 bp, Mus musculus
tgaactgttctcagttcctgtgaga

SEQ ID NO: 794659 - DNA, 25 bp, Mus musculus
tgaactgttctctgttcctgtgaga

SEQ ID NO: 794660 - DNA, 25 bp, Mus musculus
tgaacttaagagcaatgtgcccaat

SEQ ID NO: 794661 - DNA, 25 bp, Mus musculus
tgaacttaagaggaatgtgcccaat

SEQ ID NO: 794662 - DNA, 25 bp, Mus musculus
tgaacttacaggacaaaactttact

SEQ ID NO: 794663 - DNA, 25 bp, Mus musculus
tgaacttacaggtcaaaactttact

SEQ ID NO: 794664 - DNA, 25 bp, Mus musculus
tgaacttaggccattgattcctgtg

SEQ ID NO: 794665 - DNA, 25 bp, Mus musculus
tgaacttaggcctttgattcctgtg

SEQ ID NO: 794666 - DNA, 25 bp, Mus musculus
tgaacttcaacaaccaagcactgca

SEQ ID NO: 794667 - DNA, 25 bp, Mus musculus
tgaacttcaacatccaagcactgca

SEQ ID NO: 794668 - DNA, 25 bp, Mus musculus
tgaacttcacagatggattactcgt

SEQ ID NO: 794669 - DNA, 25 bp, Mus musculus
tgaacttcacagttggattactcgt

SEQ ID NO: 794670 - DNA, 25 bp, Mus musculus
tgaacttcagaaagtgctgggtcca

SEQ ID NO: 794671 - DNA, 25 bp, Mus musculus
tgaacttcagaatgtgctgggtcca

SEQ ID NO: 794672 - DNA, 25 bp, Mus musculus
tgaacttcatccagccgtgtgctat

SEQ ID NO: 794673 - DNA, 25 bp, Mus musculus
tgaacttcatcctgccgtgtgctat

SEQ ID NO: 794674 - DNA, 25 bp, Mus musculus
tgaacttccgatcctcatcctgcag

SEQ ID NO: 794675 - DNA, 25 bp, Mus musculus
tgaacttccgatgctcatcctgcag

SEQ ID NO: 794676 - DNA, 25 bp, Mus musculus
tgaacttcgagcaggttaaatccct

SEQ ID NO: 794677 - DNA, 25 bp, Mus musculus
tgaacttcgagctggttaaatccct

SEQ ID NO: 794678 - DNA, 25 bp, Mus musculus
tgaacttctagccacgtgtagcgcc

SEQ ID NO: 794679 - DNA, 25 bp, Mus musculus
tgaacttctagcgacgtgtagcgcc

SEQ ID NO: 794680 - DNA, 25 bp, Mus musculus
tgaacttctatccaggctcacctaa

SEQ ID NO: 794681 - DNA, 25 bp, Mus musculus
tgaacttctatcgaggctcacctaa

SEQ ID NO: 794682 - DNA, 25 bp, Mus musculus
tgaacttctgaaatcatgctgcaag

SEQ ID NO: 794683 - DNA, 25 bp, Mus musculus
tgaacttctgaacatcgtagttgtg

SEQ ID NO: 794684 - DNA, 25 bp, Mus musculus
tgaacttctgaagatcgtagttgtg

SEQ ID NO: 794685 - DNA, 25 bp, Mus musculus
tgaacttctgaattcatgctgcaag

SEQ ID NO: 794686 - DNA, 25 bp, Mus musculus
tgaacttctgatcgaaacagctgaa

SEQ ID NO: 794687 - DNA, 25 bp, Mus musculus
tgaacttctgatggaaacagctgaa

SEQ ID NO: 794688 - DNA, 25 bp, Mus musculus
tgaacttcttcaccaactttgtgtc

SEQ ID NO: 794689 - DNA, 25 bp, Mus musculus
tgaacttcttcagcaactttgtgtc

SEQ ID NO: 794690 - DNA, 25 bp, Mus musculus
tgaacttggagcagtttgtacaatc

SEQ ID NO: 794691 - DNA, 25 bp, Mus musculus
tgaacttggagctgtttgtacaatc

SEQ ID NO: 794692 - DNA, 25 bp, Mus musculus
tgaacttggataaccaccctgggtg

SEQ ID NO: 794693 - DNA, 25 bp, Mus musculus
tgaacttggatatccaccctgggtg

SEQ ID NO: 794694 - DNA, 25 bp, Mus musculus
tgaacttgtaccacgagctgatgaa

SEQ ID NO: 794695 - DNA, 25 bp, Mus musculus
tgaacttgtacctcgagctgatgaa

SEQ ID NO: 794696 - DNA, 25 bp, Mus musculus
tgaactttaaggaatagtagctctt

SEQ ID NO: 794697 - DNA, 25 bp, Mus musculus
tgaactttaaggtatagtagctctt

SEQ ID NO: 794698 - DNA, 25 bp, Mus musculus
tgaactttacctagaacctctgctc

SEQ ID NO: 794699 - DNA, 25 bp, Mus musculus
tgaactttaccttgaacctctgctc

SEQ ID NO: 794700 - DNA, 25 bp, Mus musculus
tgaactttcctaccggcgagactct

SEQ ID NO: 794701 - DNA, 25 bp, Mus musculus
tgaactttcctagcggcgagactct

SEQ ID NO: 794702 - DNA, 25 bp, Mus musculus
tgaactttcggcaaaggtacatcta

SEQ ID NO: 794703 - DNA, 25 bp, Mus musculus
tgaactttcggctaaggtacatcta

SEQ ID NO: 794704 - DNA, 25 bp, Mus musculus
tgaacttttcttcccaccgctgttg

SEQ ID NO: 794705 - DNA, 25 bp, Mus musculus
tgaacttttcttgccaccgctgttg

SEQ ID NO: 794706 - DNA, 25 bp, Mus musculus
tgaactttttccacaggaacgaagc

SEQ ID NO: 794707 - DNA, 25 bp, Mus musculus
tgaactttttcctcaggaacgaagc

SEQ ID NO: 794708 - DNA, 25 bp, Mus musculus
tgaagaaaacagcacacagaaagat

SEQ ID NO: 794709 - DNA, 25 bp, Mus musculus
tgaagaaaacaggacacagaaagat

SEQ ID NO: 794710 - DNA, 25 bp, Mus musculus
tgaagaaacagacgtcaaaggaaaa

SEQ ID NO: 794711 - DNA, 25 bp, Mus musculus
tgaagaaacagaggtcaaaggaaaa

SEQ ID NO: 794712 - DNA, 25 bp, Mus musculus
tgaagaaacagcctcagcctccagg

SEQ ID NO: 794713 - DNA, 25 bp, Mus musculus
tgaagaaacagcgtcagcctccagg

SEQ ID NO: 794714 - DNA, 25 bp, Mus musculus
tgaagaaaccacctaccctagagcc

SEQ ID NO: 794715 - DNA, 25 bp, Mus musculus
tgaagaaaccacgtaccctagagcc

SEQ ID NO: 794716 - DNA, 25 bp, Mus musculus
tgaagaaaccatccccagtacagat

SEQ ID NO: 794717 - DNA, 25 bp, Mus musculus
tgaagaaaccatgcccagtacagat

SEQ ID NO: 794718 - DNA, 25 bp, Mus musculus
tgaagaaacgaaagcagggccccat

SEQ ID NO: 794719 - DNA, 25 bp, Mus musculus
tgaagaaacgaatgcagggccccat

SEQ ID NO: 794720 - DNA, 25 bp, Mus musculus
tgaagaaactctcggccatgatggg

SEQ ID NO: 794721 - DNA, 25 bp, Mus musculus
tgaagaaactctgggccatgatggg

SEQ ID NO: 794722 - DNA, 25 bp, Mus musculus
tgaagaaagaggacaccacctttga

SEQ ID NO: 794723 - DNA, 25 bp, Mus musculus
tgaagaaagaggtcaccacctttga

SEQ ID NO: 794724 - DNA, 25 bp, Mus musculus
tgaagaaaggcgagatctgccattt

SEQ ID NO: 794725 - DNA, 25 bp, Mus musculus
tgaagaaaggcgtgatctgccattt

SEQ ID NO: 794726 - DNA, 25 bp, Mus musculus
tgaagaaagtgaacaaagctggcaa

SEQ ID NO: 794727 - DNA, 25 bp, Mus musculus
tgaagaaagtgatcaaagctggcaa

SEQ ID NO: 794728 - DNA, 25 bp, Mus musculus
tgaagaaagtggagtccttctggag

SEQ ID NO: 794729 - DNA, 25 bp, Mus musculus
tgaagaaagtggtgtccttctggag

SEQ ID NO: 794730 - DNA, 25 bp, Mus musculus
tgaagaaatactagcgcaagcagac

SEQ ID NO: 794731 - DNA, 25 bp, Mus musculus
tgaagaaatacttgcgcaagcagac

SEQ ID NO: 794732 - DNA, 25 bp, Mus musculus
tgaagaaatcgaagcaatggcagcc

SEQ ID NO: 794733 - DNA, 25 bp, Mus musculus
tgaagaaatcgatgcaatggcagcc

SEQ ID NO: 794734 - DNA, 25 bp, Mus musculus
tgaagaaattcaaaagcatctgcaa

SEQ ID NO: 794735 - DNA, 25 bp, Mus musculus
tgaagaaattcataagcatctgcaa

SEQ ID NO: 794736 - DNA, 25 bp, Mus musculus
tgaagaaattgaagccgtgaaaagc

SEQ ID NO: 794737 - DNA, 25 bp, Mus musculus
tgaagaaattgatgccgtgaaaagc

SEQ ID NO: 794738 - DNA, 25 bp, Mus musculus
tgaagaaatttgcagtctacgtgcg

SEQ ID NO: 794739 - DNA, 25 bp, Mus musculus
tgaagaaatttggagtctacgtgcg

SEQ ID NO: 794740 - DNA, 25 bp, Mus musculus
tgaagaacaacacctacaagttggc

SEQ ID NO: 794741 - DNA, 25 bp, Mus musculus
tgaagaacaacagctacaagttggc

SEQ ID NO: 794742 - DNA, 25 bp, Mus musculus
tgaagaacaagaatctgacacagcg

SEQ ID NO: 794743 - DNA, 25 bp, Mus musculus
tgaagaacaagattctgacacagcg

SEQ ID NO: 794744 - DNA, 25 bp, Mus musculus
tgaagaacaagcattcggagcagcc

SEQ ID NO: 794745 - DNA, 25 bp, Mus musculus
tgaagaacaagctttcggagcagcc

SEQ ID NO: 794746 - DNA, 25 bp, Mus musculus
tgaagaacaatccagactagcagca

SEQ ID NO: 794747 - DNA, 25 bp, Mus musculus
tgaagaacaatcgagactagcagca

SEQ ID NO: 794748 - DNA, 25 bp, Mus musculus
tgaagaacaccaaagggaacactct

SEQ ID NO: 794749 - DNA, 25 bp, Mus musculus
tgaagaacaccatagggaacactct

SEQ ID NO: 794750 - DNA, 25 bp, Mus musculus
tgaagaacacgtagaaagtcactgg

SEQ ID NO: 794751 - DNA, 25 bp, Mus musculus
tgaagaacacgttgaaagtcactgg

SEQ ID NO: 794752 - DNA, 25 bp, Mus musculus
tgaagaacacttctgaggacatcgc

SEQ ID NO: 794753 - DNA, 25 bp, Mus musculus
tgaagaacacttgtgaggacatcgc

SEQ ID NO: 794754 - DNA, 25 bp, Mus musculus
tgaagaacatgtcgcagcgcatcgg

SEQ ID NO: 794755 - DNA, 25 bp, Mus musculus
tgaagaacatgtggcagcgcatcgg

SEQ ID NO: 794756 - DNA, 25 bp, Mus musculus
tgaagaacctgaagccaaactggcc

SEQ ID NO: 794757 - DNA, 25 bp, Mus musculus
tgaagaacctgatgccaaactggcc

SEQ ID NO: 794758 - DNA, 25 bp, Mus musculus
tgaagaacctggaggaaccgtctcc

SEQ ID NO: 794759 - DNA, 25 bp, Mus musculus
tgaagaacctggtggaaccgtctcc

SEQ ID NO: 794760 - DNA, 25 bp, Mus musculus
tgaagaacggcaccaccacggcttg

SEQ ID NO: 794761 - DNA, 25 bp, Mus musculus
tgaagaacggcagcaccacggcttg

SEQ ID NO: 794762 - DNA, 25 bp, Mus musculus
tgaagaactctcacgagcccagaat

SEQ ID NO: 794763 - DNA, 25 bp, Mus musculus
tgaagaactctctcgagcccagaat

SEQ ID NO: 794764 - DNA, 25 bp, Mus musculus
tgaagaactgccaccgggtcctgtc

SEQ ID NO: 794765 - DNA, 25 bp, Mus musculus
tgaagaactgcctccgggtcctgtc

SEQ ID NO: 794766 - DNA, 25 bp, Mus musculus
tgaagaactgctcgcacctggatgc

SEQ ID NO: 794767 - DNA, 25 bp, Mus musculus
tgaagaactgctggcacctggatgc

SEQ ID NO: 794768 - DNA, 25 bp, Mus musculus
tgaagaacttctcaggattggcctg

SEQ ID NO: 794769 - DNA, 25 bp, Mus musculus
tgaagaacttctgaggattggcctg

SEQ ID NO: 794770 - DNA, 25 bp, Mus musculus
tgaagaagacctatgactctgtgga

SEQ ID NO: 794771 - DNA, 25 bp, Mus musculus
tgaagaagacctttgactctgtgga

SEQ ID NO: 794772 - DNA, 25 bp, Mus musculus
tgaagaagacttcaaccgcgactgg

SEQ ID NO: 794773 - DNA, 25 bp, Mus musculus
tgaagaagacttgaaccgcgactgg

SEQ ID NO: 794774 - DNA, 25 bp, Mus musculus
tgaagaagagtcagagaggaagctt

SEQ ID NO: 794775 - DNA, 25 bp, Mus musculus
tgaagaagagtctgagaggaagctt

SEQ ID NO: 794776 - DNA, 25 bp, Mus musculus
tgaagaagatcaacctgtctcacag

SEQ ID NO: 794777 - DNA, 25 bp, Mus musculus
tgaagaagatcaccgagaaaatggc

SEQ ID NO: 794778 - DNA, 25 bp, Mus musculus
tgaagaagatcagcgagaaaatggc

SEQ ID NO: 794779 - DNA, 25 bp, Mus musculus
tgaagaagatcatcctgtctcacag

SEQ ID NO: 794780 - DNA, 25 bp, Mus musculus
tgaagaagatgaactgttagagacc

SEQ ID NO: 794781 - DNA, 25 bp, Mus musculus
tgaagaagatgatctgttagagacc

SEQ ID NO: 794782 - DNA, 25 bp, Mus musculus
tgaagaagatggcatttctgctgtt

SEQ ID NO: 794783 - DNA, 25 bp, Mus musculus
tgaagaagatgggatttctgctgtt

SEQ ID NO: 794784 - DNA, 25 bp, Mus musculus
tgaagaagattccttgcaaagccag

SEQ ID NO: 794785 - DNA, 25 bp, Mus musculus
tgaagaagattcgttgcaaagccag

SEQ ID NO: 794786 - DNA, 25 bp, Mus musculus
tgaagaagcaaacgcccgagcaaag

SEQ ID NO: 794787 - DNA, 25 bp, Mus musculus
tgaagaagcaaaggcccgagcaaag

SEQ ID NO: 794788 - DNA, 25 bp, Mus musculus
tgaagaagccaacaacacactgacc

SEQ ID NO: 794789 - DNA, 25 bp, Mus musculus
tgaagaagccaagaacacactgacc

SEQ ID NO: 794790 - DNA, 25 bp, Mus musculus
tgaagaagcgttcactgcccaggaa

SEQ ID NO: 794791 - DNA, 25 bp, Mus musculus
tgaagaagcgttgactgcccaggaa

SEQ ID NO: 794792 - DNA, 25 bp, Mus musculus
tgaagaagctctatccaacgaagac

SEQ ID NO: 794793 - DNA, 25 bp, Mus musculus
tgaagaagctctttccaacgaagac

SEQ ID NO: 794794 - DNA, 25 bp, Mus musculus
tgaagaagctgacgatgatgatatc

SEQ ID NO: 794795 - DNA, 25 bp, Mus musculus
tgaagaagctgaggatgatgatatc

SEQ ID NO: 794796 - DNA, 25 bp, Mus musculus
tgaagaaggacccacactctcagac

SEQ ID NO: 794797 - DNA, 25 bp, Mus musculus
tgaagaaggaccgacactctcagac

SEQ ID NO: 794798 - DNA, 25 bp, Mus musculus
tgaagaaggcacctgagttcccaga

SEQ ID NO: 794799 - DNA, 25 bp, Mus musculus
tgaagaaggcacgtgagttcccaga

SEQ ID NO: 794800 - DNA, 25 bp, Mus musculus
tgaagaagggcaacaactcctccaa

SEQ ID NO: 794801 - DNA, 25 bp, Mus musculus
tgaagaagggcatcaactcctccaa

SEQ ID NO: 794802 - DNA, 25 bp, Mus musculus
tgaagaagggccagcatctgtatgg

SEQ ID NO: 794803 - DNA, 25 bp, Mus musculus
tgaagaagggcctgcatctgtatgg

SEQ ID NO: 794804 - DNA, 25 bp, Mus musculus
tgaagaaggtgaagcccagacagaa

SEQ ID NO: 794805 - DNA, 25 bp, Mus musculus
tgaagaaggtgacaaatcaggacac

SEQ ID NO: 794806 - DNA, 25 bp, Mus musculus
tgaagaaggtgagaaatcaggacac

SEQ ID NO: 794807 - DNA, 25 bp, Mus musculus
tgaagaaggtgatgcccagacagaa

SEQ ID NO: 794808 - DNA, 25 bp, Mus musculus
tgaagaagtcatcctggaccgagga

SEQ ID NO: 794809 - DNA, 25 bp, Mus musculus
tgaagaagtcatgctggaccgagga

SEQ ID NO: 794810 - DNA, 25 bp, Mus musculus
tgaagaagttccacgccgacatgct

SEQ ID NO: 794811 - DNA, 25 bp, Mus musculus
tgaagaagttcctcgccgacatgct

SEQ ID NO: 794812 - DNA, 25 bp, Mus musculus
tgaagaagttctcccggaaggacta

SEQ ID NO: 794813 - DNA, 25 bp, Mus musculus
tgaagaagttctgccggaaggacta

SEQ ID NO: 794814 - DNA, 25 bp, Mus musculus
tgaagaatccgtacgccaggcaact

SEQ ID NO: 794815 - DNA, 25 bp, Mus musculus
tgaagaatccgttcgccaggcaact

SEQ ID NO: 794816 - DNA, 25 bp, Mus musculus
tgaagaatgaagaggctgccctcac

SEQ ID NO: 794817 - DNA, 25 bp, Mus musculus
tgaagaatgaagtggctgccctcac

SEQ ID NO: 794818 - DNA, 25 bp, Mus musculus
tgaagaatgactacagtacatcggg

SEQ ID NO: 794819 - DNA, 25 bp, Mus musculus
tgaagaatgacttcagtacatcggg

SEQ ID NO: 794820 - DNA, 25 bp, Mus musculus
tgaagaatgcctcagatggtgctct

SEQ ID NO: 794821 - DNA, 25 bp, Mus musculus
tgaagaatgcctgagatggtgctct

SEQ ID NO: 794822 - DNA, 25 bp, Mus musculus
tgaagaatgggacacaagtccatgg

SEQ ID NO: 794823 - DNA, 25 bp, Mus musculus
tgaagaatgggagacaagtccatgg

SEQ ID NO: 794824 - DNA, 25 bp, Mus musculus
tgaagaatggttaccccaaagccca

SEQ ID NO: 794825 - DNA, 25 bp, Mus musculus
tgaagaatggtttccccaaagccca

SEQ ID NO: 794826 - DNA, 25 bp, Mus musculus
tgaagaattaaactttgatcgactc

SEQ ID NO: 794827 - DNA, 25 bp, Mus musculus
tgaagaattaaagtttgatcgactc

SEQ ID NO: 794828 - DNA, 25 bp, Mus musculus
tgaagaattagaccccatggacccc

SEQ ID NO: 794829 - DNA, 25 bp, Mus musculus
tgaagaattagagcccatggacccc

SEQ ID NO: 794830 - DNA, 25 bp, Mus musculus
tgaagaattcataccagtattgggc

SEQ ID NO: 794831 - DNA, 25 bp, Mus musculus
tgaagaattcatccagacagaggcc

SEQ ID NO: 794832 - DNA, 25 bp, Mus musculus
tgaagaattcatgcagacagaggcc

SEQ ID NO: 794833 - DNA, 25 bp, Mus musculus
tgaagaattcattccagtattgggc

SEQ ID NO: 794834 - DNA, 25 bp, Mus musculus
tgaagaattccacgaagaactgacc

SEQ ID NO: 794835 - DNA, 25 bp, Mus musculus
tgaagaattccaggaagaactgacc

SEQ ID NO: 794836 - DNA, 25 bp, Mus musculus
tgaagaattcttatccacgtacctg

SEQ ID NO: 794837 - DNA, 25 bp, Mus musculus
tgaagaattcttttccacgtacctg

SEQ ID NO: 794838 - DNA, 25 bp, Mus musculus
tgaagaattgatcgcagcccgagca

SEQ ID NO: 794839 - DNA, 25 bp, Mus musculus
tgaagaattgatggcagcccgagca

SEQ ID NO: 794840 - DNA, 25 bp, Mus musculus
tgaagacaaaatagtccatgtggat

SEQ ID NO: 794841 - DNA, 25 bp, Mus musculus
tgaagacaaaattgtccatgtggat

SEQ ID NO: 794842 - DNA, 25 bp, Mus musculus
tgaagacaacccaggagcagctgac

SEQ ID NO: 794843 - DNA, 25 bp, Mus musculus
tgaagacaaccctggagcagctgac

SEQ ID NO: 794844 - DNA, 25 bp, Mus musculus
tgaagacaacttcggcctcatgtat

SEQ ID NO: 794845 - DNA, 25 bp, Mus musculus
tgaagacaacttgggcctcatgtat

SEQ ID NO: 794846 - DNA, 25 bp, Mus musculus
tgaagacaagcaccggctctgaaga

SEQ ID NO: 794847 - DNA, 25 bp, Mus musculus
tgaagacaagcagcggctctgaaga

SEQ ID NO: 794848 - DNA, 25 bp, Mus musculus
tgaagacaaggccacccatcctctg

SEQ ID NO: 794849 - DNA, 25 bp, Mus musculus
tgaagacaaggcgacccatcctctg

SEQ ID NO: 794850 - DNA, 25 bp, Mus musculus
tgaagacaatgacaactcggacagt

SEQ ID NO: 794851 - DNA, 25 bp, Mus musculus
tgaagacaatgagaactcggacagt

SEQ ID NO: 794852 - DNA, 25 bp, Mus musculus
tgaagacaattaacctgcagagcct

SEQ ID NO: 794853 - DNA, 25 bp, Mus musculus
tgaagacaattatcctgcagagcct

SEQ ID NO: 794854 - DNA, 25 bp, Mus musculus
tgaagacaccatagatctcgtctcc

SEQ ID NO: 794855 - DNA, 25 bp, Mus musculus
tgaagacaccatcaagagatacctc

SEQ ID NO: 794856 - DNA, 25 bp, Mus musculus
tgaagacaccatgaagagatacctc

SEQ ID NO: 794857 - DNA, 25 bp, Mus musculus
tgaagacaccattgatctcgtctcc

SEQ ID NO: 794858 - DNA, 25 bp, Mus musculus
tgaagacaccttagaactacgggac

SEQ ID NO: 794859 - DNA, 25 bp, Mus musculus
tgaagacacctttgaactacgggac

SEQ ID NO: 794860 - DNA, 25 bp, Mus musculus
tgaagacactacagaccctggacag

SEQ ID NO: 794861 - DNA, 25 bp, Mus musculus
tgaagacactactgaccctggacag

SEQ ID NO: 794862 - DNA, 25 bp, Mus musculus
tgaagacagaatccagtttcttgtg

SEQ ID NO: 794863 - DNA, 25 bp, Mus musculus
tgaagacagaatgcagtttcttgtg

SEQ ID NO: 794864 - DNA, 25 bp, Mus musculus
tgaagacagaccacaatgagcagct

SEQ ID NO: 794865 - DNA, 25 bp, Mus musculus
tgaagacagacctcaatgagcagct

SEQ ID NO: 794866 - DNA, 25 bp, Mus musculus
tgaagacagagcagaaatgacggtg

SEQ ID NO: 794867 - DNA, 25 bp, Mus musculus
tgaagacagagctgaaatgacggtg

SEQ ID NO: 794868 - DNA, 25 bp, Mus musculus
tgaagacagcatcgacagtcccctg

SEQ ID NO: 794869 - DNA, 25 bp, Mus musculus
tgaagacagcatggacagtcccctg

SEQ ID NO: 794870 - DNA, 25 bp, Mus musculus
tgaagacagggtagtacatagcaat

SEQ ID NO: 794871 - DNA, 25 bp, Mus musculus
tgaagacagggttgtacatagcaat

SEQ ID NO: 794872 - DNA, 25 bp, Mus musculus
tgaagacagttacctttctgagaat

SEQ ID NO: 794873 - DNA, 25 bp, Mus musculus
tgaagacagttagctttctgagaat

SEQ ID NO: 794874 - DNA, 25 bp, Mus musculus
tgaagacatagtacgagatggcagg

SEQ ID NO: 794875 - DNA, 25 bp, Mus musculus
tgaagacatagttcgagatggcagg

SEQ ID NO: 794876 - DNA, 25 bp, Mus musculus
tgaagacattggacgcagtctcctg

SEQ ID NO: 794877 - DNA, 25 bp, Mus musculus
tgaagacattggtcgcagtctcctg

SEQ ID NO: 794878 - DNA, 25 bp, Mus musculus
tgaagacattgtctcccgaaacccc

SEQ ID NO: 794879 - DNA, 25 bp, Mus musculus
tgaagacattgtgtcccgaaacccc

SEQ ID NO: 794880 - DNA, 25 bp, Mus musculus
tgaagacattttcgctcagagaccc

SEQ ID NO: 794881 - DNA, 25 bp, Mus musculus
tgaagacattttggctcagagaccc

SEQ ID NO: 794882 - DNA, 25 bp, Mus musculus
tgaagaccaacaacttctaagagac

SEQ ID NO: 794883 - DNA, 25 bp, Mus musculus
tgaagaccaacatcttctaagagac

SEQ ID NO: 794884 - DNA, 25 bp, Mus musculus
tgaagaccaagaccaacggtgcaga

SEQ ID NO: 794885 - DNA, 25 bp, Mus musculus
tgaagaccaagagcaacggtgcaga

SEQ ID NO: 794886 - DNA, 25 bp, Mus musculus
tgaagaccaagtataaagagaccat

SEQ ID NO: 794887 - DNA, 25 bp, Mus musculus
tgaagaccaagtcccagactaagtt

SEQ ID NO: 794888 - DNA, 25 bp, Mus musculus
tgaagaccaagtgccagactaagtt

SEQ ID NO: 794889 - DNA, 25 bp, Mus musculus
tgaagaccaagtttaaagagaccat

SEQ ID NO: 794890 - DNA, 25 bp, Mus musculus
tgaagaccagatcctgccgctgttg

SEQ ID NO: 794891 - DNA, 25 bp, Mus musculus
tgaagaccagatgctgccgctgttg

SEQ ID NO: 794892 - DNA, 25 bp, Mus musculus
tgaagaccaggtcgctgcaaaagtg

SEQ ID NO: 794893 - DNA, 25 bp, Mus musculus
tgaagaccaggtggctgcaaaagtg

SEQ ID NO: 794894 - DNA, 25 bp, Mus musculus
tgaagacccacgagggacctgaaga

SEQ ID NO: 794895 - DNA, 25 bp, Mus musculus
tgaagacccacgtgggacctgaaga

SEQ ID NO: 794896 - DNA, 25 bp, Mus musculus
tgaagacccagtattccgcctgaca

SEQ ID NO: 794897 - DNA, 25 bp, Mus musculus
tgaagacccagttttccgcctgaca

SEQ ID NO: 794898 - DNA, 25 bp, Mus musculus
tgaagaccccaaacagtttgttcct

SEQ ID NO: 794899 - DNA, 25 bp, Mus musculus
tgaagaccccaatcagtttgttcct

SEQ ID NO: 794900 - DNA, 25 bp, Mus musculus
tgaagaccccgtctctgaggtcacg

SEQ ID NO: 794901 - DNA, 25 bp, Mus musculus
tgaagaccccgtgtctgaggtcacg

SEQ ID NO: 794902 - DNA, 25 bp, Mus musculus
tgaagaccggatctttaccaacctg

SEQ ID NO: 794903 - DNA, 25 bp, Mus musculus
tgaagaccggatgtttaccaacctg

SEQ ID NO: 794904 - DNA, 25 bp, Mus musculus
tgaagaccggcccttgcacatgttg

SEQ ID NO: 794905 - DNA, 25 bp, Mus musculus
tgaagaccggccgttgcacatgttg

SEQ ID NO: 794906 - DNA, 25 bp, Mus musculus
tgaagaccgtgacctctgcggccat

SEQ ID NO: 794907 - DNA, 25 bp, Mus musculus
tgaagaccgtgagctctgcggccat

SEQ ID NO: 794908 - DNA, 25 bp, Mus musculus
tgaagacctgcaaggcccaagtcat

SEQ ID NO: 794909 - DNA, 25 bp, Mus musculus
tgaagacctgcaaggtccgtgggta

SEQ ID NO: 794910 - DNA, 25 bp, Mus musculus
tgaagacctgcatggcccaagtcat

SEQ ID NO: 794911 - DNA, 25 bp, Mus musculus
tgaagacctgcatggtccgtgggta

SEQ ID NO: 794912 - DNA, 25 bp, Mus musculus
tgaagacctggaacctgccgagtgc

SEQ ID NO: 794913 - DNA, 25 bp, Mus musculus
tgaagacctggatcctgccgagtgc

SEQ ID NO: 794914 - DNA, 25 bp, Mus musculus
tgaagaccttatacggaagctagct

SEQ ID NO: 794915 - DNA, 25 bp, Mus musculus
tgaagaccttattcggaagctagct

SEQ ID NO: 794916 - DNA, 25 bp, Mus musculus
tgaagacgaagactatgtctgcccc

SEQ ID NO: 794917 - DNA, 25 bp, Mus musculus
tgaagacgaagagtatgtctgcccc

SEQ ID NO: 794918 - DNA, 25 bp, Mus musculus
tgaagacgatatcgagaatggagga

SEQ ID NO: 794919 - DNA, 25 bp, Mus musculus
tgaagacgatatggagaatggagga

SEQ ID NO: 794920 - DNA, 25 bp, Mus musculus
tgaagacgatcacggtttgagtgct

SEQ ID NO: 794921 - DNA, 25 bp, Mus musculus
tgaagacgatcagggtttgagtgct

SEQ ID NO: 794922 - DNA, 25 bp, Mus musculus
tgaagacgcacaagcacaaggcggg

SEQ ID NO: 794923 - DNA, 25 bp, Mus musculus
tgaagacgcacatgcacaaggcggg

SEQ ID NO: 794924 - DNA, 25 bp, Mus musculus
tgaagacgcccaaagggttttccag

SEQ ID NO: 794925 - DNA, 25 bp, Mus musculus
tgaagacgcccatagggttttccag

SEQ ID NO: 794926 - DNA, 25 bp, Mus musculus
tgaagacgcgggacttaaagcgcgt

SEQ ID NO: 794927 - DNA, 25 bp, Mus musculus
tgaagacgcgggtcttaaagcgcgt

SEQ ID NO: 794928 - DNA, 25 bp, Mus musculus
tgaagacgcttgagctaaagaaaag

SEQ ID NO: 794929 - DNA, 25 bp, Mus musculus
tgaagacgcttgtgctaaagaaaag

SEQ ID NO: 794930 - DNA, 25 bp, Mus musculus
tgaagacggcgactgtacattatct

SEQ ID NO: 794931 - DNA, 25 bp, Mus musculus
tgaagacggcgagtgtacattatct

SEQ ID NO: 794932 - DNA, 25 bp, Mus musculus
tgaagacggtagaaactagttgccc

SEQ ID NO: 794933 - DNA, 25 bp, Mus musculus
tgaagacggtagtaactagttgccc

SEQ ID NO: 794934 - DNA, 25 bp, Mus musculus
tgaagacggtgcagatgatcgccat

SEQ ID NO: 794935 - DNA, 25 bp, Mus musculus
tgaagacggtgctgatgatcgccat

SEQ ID NO: 794936 - DNA, 25 bp, Mus musculus
tgaagacgtttcaaaggagatattc

SEQ ID NO: 794937 - DNA, 25 bp, Mus musculus
tgaagacgtttctaaggagatattc

SEQ ID NO: 794938 - DNA, 25 bp, Mus musculus
tgaagactccgtcctggaccctgag

SEQ ID NO: 794939 - DNA, 25 bp, Mus musculus
tgaagactccgtgctggaccctgag

SEQ ID NO: 794940 - DNA, 25 bp, Mus musculus
tgaagactctaaacaagaaggaggc

SEQ ID NO: 794941 - DNA, 25 bp, Mus musculus
tgaagactctaatcaagaaggaggc

SEQ ID NO: 794942 - DNA, 25 bp, Mus musculus
tgaagactcttgcacagagaccatc

SEQ ID NO: 794943 - DNA, 25 bp, Mus musculus
tgaagactcttggacagagaccatc

SEQ ID NO: 794944 - DNA, 25 bp, Mus musculus
tgaagactgaacattctcctcggcc

SEQ ID NO: 794945 - DNA, 25 bp, Mus musculus
tgaagactgaactttctcctcggcc

SEQ ID NO: 794946 - DNA, 25 bp, Mus musculus
tgaagactggaaatgaacatggagc

SEQ ID NO: 794947 - DNA, 25 bp, Mus musculus
tgaagactggaattgaacatggagc

SEQ ID NO: 794948 - DNA, 25 bp, Mus musculus
tgaagactggagaaaaagatctaac

SEQ ID NO: 794949 - DNA, 25 bp, Mus musculus
tgaagactggagtaaaagatctaac

SEQ ID NO: 794950 - DNA, 25 bp, Mus musculus
tgaagacttgatagcacaaatccgg

SEQ ID NO: 794951 - DNA, 25 bp, Mus musculus
tgaagacttgattgcacaaatccgg

SEQ ID NO: 794952 - DNA, 25 bp, Mus musculus
tgaagagaagaaaccgcacagctgg

SEQ ID NO: 794953 - DNA, 25 bp, Mus musculus
tgaagagaagaatccgcacagctgg

SEQ ID NO: 794954 - DNA, 25 bp, Mus musculus
tgaagagaagcaacagcgattcaat

SEQ ID NO: 794955 - DNA, 25 bp, Mus musculus
tgaagagaagcatcagcgattcaat

SEQ ID NO: 794956 - DNA, 25 bp, Mus musculus
tgaagagaaggcacgcctggctgct

SEQ ID NO: 794957 - DNA, 25 bp, Mus musculus
tgaagagaaggctcgcctggctgct

SEQ ID NO: 794958 - DNA, 25 bp, Mus musculus
tgaagagaaggtcggtcccttcacg

SEQ ID NO: 794959 - DNA, 25 bp, Mus musculus
tgaagagaaggtgggtcccttcacg

SEQ ID NO: 794960 - DNA, 25 bp, Mus musculus
tgaagagactaaagaagagtctggg

SEQ ID NO: 794961 - DNA, 25 bp, Mus musculus
tgaagagactaatgaagagtctggg

SEQ ID NO: 794962 - DNA, 25 bp, Mus musculus
tgaagagactccagcagaatccgaa

SEQ ID NO: 794963 - DNA, 25 bp, Mus musculus
tgaagagactcctgcagaatccgaa

SEQ ID NO: 794964 - DNA, 25 bp, Mus musculus
tgaagagactttctacacaatgagc

SEQ ID NO: 794965 - DNA, 25 bp, Mus musculus
tgaagagactttgtacacaatgagc

SEQ ID NO: 794966 - DNA, 25 bp, Mus musculus
tgaagagagcaaactggaataactc

SEQ ID NO: 794967 - DNA, 25 bp, Mus musculus
tgaagagagcaatctggaataactc

SEQ ID NO: 794968 - DNA, 25 bp, Mus musculus
tgaagagagccacaacaatccatct

SEQ ID NO: 794969 - DNA, 25 bp, Mus musculus
tgaagagagccagaacaatccatct

SEQ ID NO: 794970 - DNA, 25 bp, Mus musculus
tgaagagagtagctgccgagttcct

SEQ ID NO: 794971 - DNA, 25 bp, Mus musculus
tgaagagagtaggtgccgagttcct

SEQ ID NO: 794972 - DNA, 25 bp, Mus musculus
tgaagagatgtcatcactgacaaaa

SEQ ID NO: 794973 - DNA, 25 bp, Mus musculus
tgaagagatgtcttcactgacaaaa

SEQ ID NO: 794974 - DNA, 25 bp, Mus musculus
tgaagagcaaggatgaccaagtgac

SEQ ID NO: 794975 - DNA, 25 bp, Mus musculus
tgaagagcaaggttgaccaagtgac

SEQ ID NO: 794976 - DNA, 25 bp, Mus musculus
tgaagagcaccgaacactggaggaa

SEQ ID NO: 794977 - DNA, 25 bp, Mus musculus
tgaagagcaccgtacactggaggaa

SEQ ID NO: 794978 - DNA, 25 bp, Mus musculus
tgaagagcaggtccgcatctgtgac

SEQ ID NO: 794979 - DNA, 25 bp, Mus musculus
tgaagagcaggtgcgcatctgtgac

SEQ ID NO: 794980 - DNA, 25 bp, Mus musculus
tgaagagcagtgagttgagatgtac

SEQ ID NO: 794981 - DNA, 25 bp, Mus musculus
tgaagagcagtgtgttgagatgtac

SEQ ID NO: 794982 - DNA, 25 bp, Mus musculus
tgaagagcatccctggcgagtacta

SEQ ID NO: 794983 - DNA, 25 bp, Mus musculus
tgaagagcatccgtggcgagtacta

SEQ ID NO: 794984 - DNA, 25 bp, Mus musculus
tgaagagccattagatatcggagat

SEQ ID NO: 794985 - DNA, 25 bp, Mus musculus
tgaagagccatttgatatcggagat

SEQ ID NO: 794986 - DNA, 25 bp, Mus musculus
tgaagagcccataaccaggaaagga

SEQ ID NO: 794987 - DNA, 25 bp, Mus musculus
tgaagagcccattaccaggaaagga

SEQ ID NO: 794988 - DNA, 25 bp, Mus musculus
tgaagagctttgaccagttcacctg

SEQ ID NO: 794989 - DNA, 25 bp, Mus musculus
tgaagagctttgtccagttcacctg

SEQ ID NO: 794990 - DNA, 25 bp, Mus musculus
tgaagaggaacaaattagaatagct

SEQ ID NO: 794991 - DNA, 25 bp, Mus musculus
tgaagaggaacatattagaatagct

SEQ ID NO: 794992 - DNA, 25 bp, Mus musculus
tgaagaggaacgactacgtgcacgc

SEQ ID NO: 794993 - DNA, 25 bp, Mus musculus
tgaagaggaacgtctacgtgcacgc

SEQ ID NO: 794994 - DNA, 25 bp, Mus musculus
tgaagaggagcccaaaaagacagga

SEQ ID NO: 794995 - DNA, 25 bp, Mus musculus
tgaagaggagccgaaaaagacagga

SEQ ID NO: 794996 - DNA, 25 bp, Mus musculus
tgaagaggatctaccggctgtggat

SEQ ID NO: 794997 - DNA, 25 bp, Mus musculus
tgaagaggatcttccggctgtggat

SEQ ID NO: 794998 - DNA, 25 bp, Mus musculus
tgaagaggcacaaaaggagaggcgg

SEQ ID NO: 794999 - DNA, 25 bp, Mus musculus
tgaagaggcacataaggagaggcgg

SEQ ID NO: 795000 - DNA, 25 bp, Mus musculus
tgaagaggcgaccaaagctgtcacc

SEQ ID NO: 795001 - DNA, 25 bp, Mus musculus
tgaagaggcgacgaaagctgtcacc

SEQ ID NO: 795002 - DNA, 25 bp, Mus musculus
tgaagaggctgaagatgatgtgtca

SEQ ID NO: 795003 - DNA, 25 bp, Mus musculus
tgaagaggctgatgatgatgtgtca

SEQ ID NO: 795004 - DNA, 25 bp, Mus musculus
tgaagagggatgaaaacacaggact

SEQ ID NO: 795005 - DNA, 25 bp, Mus musculus
tgaagagggatgtaaacacaggact

SEQ ID NO: 795006 - DNA, 25 bp, Mus musculus
tgaagagggcagacgtcttatctgt

SEQ ID NO: 795007 - DNA, 25 bp, Mus musculus
tgaagagggcagtcgtcttatctgt

SEQ ID NO: 795008 - DNA, 25 bp, Mus musculus
tgaagagggccaaccagaggaagaa

SEQ ID NO: 795009 - DNA, 25 bp, Mus musculus
tgaagagggccatccagaggaagaa

SEQ ID NO: 795010 - DNA, 25 bp, Mus musculus
tgaagaggttcaaccaggcccgaag

SEQ ID NO: 795011 - DNA, 25 bp, Mus musculus
tgaagaggttcatccaggcccgaag

SEQ ID NO: 795012 - DNA, 25 bp, Mus musculus
tgaagaggttgcagcgacaggctcc

SEQ ID NO: 795013 - DNA, 25 bp, Mus musculus
tgaagaggttgctgcgacaggctcc

SEQ ID NO: 795014 - DNA, 25 bp, Mus musculus
tgaagagtacttaaaagtagacgcc

SEQ ID NO: 795015 - DNA, 25 bp, Mus musculus
tgaagagtactttaaagtagacgcc

SEQ ID NO: 795016 - DNA, 25 bp, Mus musculus
tgaagagtcagaagtcacggcatcg

SEQ ID NO: 795017 - DNA, 25 bp, Mus musculus
tgaagagtcagatgtcacggcatcg

SEQ ID NO: 795018 - DNA, 25 bp, Mus musculus
tgaagagtcctaaagcctcctaagg

SEQ ID NO: 795019 - DNA, 25 bp, Mus musculus
tgaagagtcctatagcctcctaagg

SEQ ID NO: 795020 - DNA, 25 bp, Mus musculus
tgaagagtgcagagggcggcgatgc

SEQ ID NO: 795021 - DNA, 25 bp, Mus musculus
tgaagagtgcagtgggcggcgatgc

SEQ ID NO: 795022 - DNA, 25 bp, Mus musculus
tgaagagtgggtcctagtcctgccc

SEQ ID NO: 795023 - DNA, 25 bp, Mus musculus
tgaagagtgggtgctagtcctgccc

SEQ ID NO: 795024 - DNA, 25 bp, Mus musculus
tgaagagtgtttcatgagtggcacc

SEQ ID NO: 795025 - DNA, 25 bp, Mus musculus
tgaagagtgtttgatgagtggcacc

SEQ ID NO: 795026 - DNA, 25 bp, Mus musculus
tgaagagttacgattaccagatatt

SEQ ID NO: 795027 - DNA, 25 bp, Mus musculus
tgaagagttacgtttaccagatatt

SEQ ID NO: 795028 - DNA, 25 bp, Mus musculus
tgaagagttctcaaaggaaaagttt

SEQ ID NO: 795029 - DNA, 25 bp, Mus musculus
tgaagagttctcagtccctcgtcac

SEQ ID NO: 795030 - DNA, 25 bp, Mus musculus
tgaagagttctctaaggaaaagttt

SEQ ID NO: 795031 - DNA, 25 bp, Mus musculus
tgaagagttctctgtccctcgtcac

SEQ ID NO: 795032 - DNA, 25 bp, Mus musculus
tgaagataaaaacgcaccattgcgg

SEQ ID NO: 795033 - DNA, 25 bp, Mus musculus
tgaagataaaaaggcaccattgcgg

SEQ ID NO: 795034 - DNA, 25 bp, Mus musculus
tgaagataactcaaatgatgggacc

SEQ ID NO: 795035 - DNA, 25 bp, Mus musculus
tgaagataactctaatgatgggacc

SEQ ID NO: 795036 - DNA, 25 bp, Mus musculus
tgaagataatcactgatcgaactgg

SEQ ID NO: 795037 - DNA, 25 bp, Mus musculus
tgaagataatcagtgatcgaactgg

SEQ ID NO: 795038 - DNA, 25 bp, Mus musculus
tgaagataccccatatgaggcagtc

SEQ ID NO: 795039 - DNA, 25 bp, Mus musculus
tgaagataccccttatgaggcagtc

SEQ ID NO: 795040 - DNA, 25 bp, Mus musculus
tgaagatactgtccctcgagctgcg

SEQ ID NO: 795041 - DNA, 25 bp, Mus musculus
tgaagatactgtgcctcgagctgcg

SEQ ID NO: 795042 - DNA, 25 bp, Mus musculus
tgaagatatccgctgcaaatgcatc

SEQ ID NO: 795043 - DNA, 25 bp, Mus musculus
tgaagatatccggtgcaaatgcatc

SEQ ID NO: 795044 - DNA, 25 bp, Mus musculus
tgaagatattttctctggagtctcc

SEQ ID NO: 795045 - DNA, 25 bp, Mus musculus
tgaagatattttgtctggagtctcc

SEQ ID NO: 795046 - DNA, 25 bp, Mus musculus
tgaagatcaaagagtcactggagct

SEQ ID NO: 795047 - DNA, 25 bp, Mus musculus
tgaagatcaaagtgtcactggagct

SEQ ID NO: 795048 - DNA, 25 bp, Mus musculus
tgaagatcagttccctcagggaccc

SEQ ID NO: 795049 - DNA, 25 bp, Mus musculus
tgaagatcagttgcctcagggaccc

SEQ ID NO: 795050 - DNA, 25 bp, Mus musculus
tgaagatcctcaagaaagttggaca

SEQ ID NO: 795051 - DNA, 25 bp, Mus musculus
tgaagatcctcatgaaagttggaca

SEQ ID NO: 795052 - DNA, 25 bp, Mus musculus
tgaagatcgtcactcgcaccaagtc

SEQ ID NO: 795053 - DNA, 25 bp, Mus musculus
tgaagatcgtcagtcgcaccaagtc

SEQ ID NO: 795054 - DNA, 25 bp, Mus musculus
tgaagatctatcacctaagctacct

SEQ ID NO: 795055 - DNA, 25 bp, Mus musculus
tgaagatctatctcctaagctacct

SEQ ID NO: 795056 - DNA, 25 bp, Mus musculus
tgaagatctgagctcttcagatgag

SEQ ID NO: 795057 - DNA, 25 bp, Mus musculus
tgaagatctgaggtcttcagatgag

SEQ ID NO: 795058 - DNA, 25 bp, Mus musculus
tgaagatcttctctgagaagctgct

SEQ ID NO: 795059 - DNA, 25 bp, Mus musculus
tgaagatcttctgtgagaagctgct

SEQ ID NO: 795060 - DNA, 25 bp, Mus musculus
tgaagatcttgacgcgaaccttagg

SEQ ID NO: 795061 - DNA, 25 bp, Mus musculus
tgaagatcttgaggcgaaccttagg

SEQ ID NO: 795062 - DNA, 25 bp, Mus musculus
tgaagatgaacacttgtgggcctcg

SEQ ID NO: 795063 - DNA, 25 bp, Mus musculus
tgaagatgaacagttgtgggcctcg

SEQ ID NO: 795064 - DNA, 25 bp, Mus musculus
tgaagatgaactcgacaaatactcc

SEQ ID NO: 795065 - DNA, 25 bp, Mus musculus
tgaagatgaactggacaaatactcc

SEQ ID NO: 795066 - DNA, 25 bp, Mus musculus
tgaagatgacaaagagtgacgatga

SEQ ID NO: 795067 - DNA, 25 bp, Mus musculus
tgaagatgacaaattgttagacggg

SEQ ID NO: 795068 - DNA, 25 bp, Mus musculus
tgaagatgacaatgagtgacgatga

SEQ ID NO: 795069 - DNA, 25 bp, Mus musculus
tgaagatgacaatttgttagacggg

SEQ ID NO: 795070 - DNA, 25 bp, Mus musculus
tgaagatgacatacgcagggcacgg

SEQ ID NO: 795071 - DNA, 25 bp, Mus musculus
tgaagatgacattcgcagggcacgg

SEQ ID NO: 795072 - DNA, 25 bp, Mus musculus
tgaagatgacccagagttggtcgac

SEQ ID NO: 795073 - DNA, 25 bp, Mus musculus
tgaagatgaccctgagttggtcgac

SEQ ID NO: 795074 - DNA, 25 bp, Mus musculus
tgaagatgacgacgacgaacaagag

SEQ ID NO: 795075 - DNA, 25 bp, Mus musculus
tgaagatgacgaggacgaacaagag

SEQ ID NO: 795076 - DNA, 25 bp, Mus musculus
tgaagatgacgtagaagcttacgtg

SEQ ID NO: 795077 - DNA, 25 bp, Mus musculus
tgaagatgacgttgaagcttacgtg

SEQ ID NO: 795078 - DNA, 25 bp, Mus musculus
tgaagatgagcacccgccaaccctg

SEQ ID NO: 795079 - DNA, 25 bp, Mus musculus
tgaagatgagcagccgccaaccctg

SEQ ID NO: 795080 - DNA, 25 bp, Mus musculus
tgaagatgcacaaccgaagccacac

SEQ ID NO: 795081 - DNA, 25 bp, Mus musculus
tgaagatgcacatccgaagccacac

SEQ ID NO: 795082 - DNA, 25 bp, Mus musculus
tgaagatgcagcagcctgaacaggc

SEQ ID NO: 795083 - DNA, 25 bp, Mus musculus
tgaagatgcagctgcctgaacaggc

SEQ ID NO: 795084 - DNA, 25 bp, Mus musculus
tgaagatgcaggcagaacagctcca

SEQ ID NO: 795085 - DNA, 25 bp, Mus musculus
tgaagatgcagggagaacagctcca

SEQ ID NO: 795086 - DNA, 25 bp, Mus musculus
tgaagatgccaaatgtctactcctg

SEQ ID NO: 795087 - DNA, 25 bp, Mus musculus
tgaagatgccaattgtctactcctg

SEQ ID NO: 795088 - DNA, 25 bp, Mus musculus
tgaagatgcccactgcactggttgg

SEQ ID NO: 795089 - DNA, 25 bp, Mus musculus
tgaagatgcccagtgcactggttgg

SEQ ID NO: 795090 - DNA, 25 bp, Mus musculus
tgaagatgcggtaccgatgcgaaga

SEQ ID NO: 795091 - DNA, 25 bp, Mus musculus
tgaagatgcggttccgatgcgaaga

SEQ ID NO: 795092 - DNA, 25 bp, Mus musculus
tgaagatgctcaactccctgctcaa

SEQ ID NO: 795093 - DNA, 25 bp, Mus musculus
tgaagatgctcatctccctgctcaa

SEQ ID NO: 795094 - DNA, 25 bp, Mus musculus
tgaagatgctgaccggaagtatgaa

SEQ ID NO: 795095 - DNA, 25 bp, Mus musculus
tgaagatgctgagcggaagtatgaa

SEQ ID NO: 795096 - DNA, 25 bp, Mus musculus
tgaagatgcttcaccagaacctgga

SEQ ID NO: 795097 - DNA, 25 bp, Mus musculus
tgaagatgcttctccagaacctgga

SEQ ID NO: 795098 - DNA, 25 bp, Mus musculus
tgaagatgcttgaaaaactcaacca

SEQ ID NO: 795099 - DNA, 25 bp, Mus musculus
tgaagatgcttgtaaaactcaacca

SEQ ID NO: 795100 - DNA, 25 bp, Mus musculus
tgaagatggagacgcctgttactcg

SEQ ID NO: 795101 - DNA, 25 bp, Mus musculus
tgaagatggagaggcctgttactcg

SEQ ID NO: 795102 - DNA, 25 bp, Mus musculus
tgaagatggaggaaatcaaccacct

SEQ ID NO: 795103 - DNA, 25 bp, Mus musculus
tgaagatggaggtaatcaaccacct

SEQ ID NO: 795104 - DNA, 25 bp, Mus musculus
tgaagatggcacatacagtccagag

SEQ ID NO: 795105 - DNA, 25 bp, Mus musculus
tgaagatggcacttacagtccagag

SEQ ID NO: 795106 - DNA, 25 bp, Mus musculus
tgaagatggccgagatgtccccatg

SEQ ID NO: 795107 - DNA, 25 bp, Mus musculus
tgaagatggccgtgatgtccccatg

SEQ ID NO: 795108 - DNA, 25 bp, Mus musculus
tgaagatgggaaaggcacaatcctg

SEQ ID NO: 795109 - DNA, 25 bp, Mus musculus
tgaagatgggaatggcacaatcctg

SEQ ID NO: 795110 - DNA, 25 bp, Mus musculus
tgaagatgggtgactagatgacctg

SEQ ID NO: 795111 - DNA, 25 bp, Mus musculus
tgaagatgggtgtctagatgacctg

SEQ ID NO: 795112 - DNA, 25 bp, Mus musculus
tgaagatggtggaccgcgagcaact

SEQ ID NO: 795113 - DNA, 25 bp, Mus musculus
tgaagatggtggtccgcgagcaact

SEQ ID NO: 795114 - DNA, 25 bp, Mus musculus
tgaagatgtagcacgggctattaat

SEQ ID NO: 795115 - DNA, 25 bp, Mus musculus
tgaagatgtagctcgggctattaat

SEQ ID NO: 795116 - DNA, 25 bp, Mus musculus
tgaagatgtagtaaaccagtcaagt

SEQ ID NO: 795117 - DNA, 25 bp, Mus musculus
tgaagatgtagttaaccagtcaagt

SEQ ID NO: 795118 - DNA, 25 bp, Mus musculus
tgaagatgtcccatacaccgcagct

SEQ ID NO: 795119 - DNA, 25 bp, Mus musculus
tgaagatgtcccttacaccgcagct

SEQ ID NO: 795120 - DNA, 25 bp, Mus musculus
tgaagatgtgaaccgcatgtctccg

SEQ ID NO: 795121 - DNA, 25 bp, Mus musculus
tgaagatgtgaagcgcatgtctccg

SEQ ID NO: 795122 - DNA, 25 bp, Mus musculus
tgaagatgttggcattaactacagg

SEQ ID NO: 795123 - DNA, 25 bp, Mus musculus
tgaagatgttgggattaactacagg

SEQ ID NO: 795124 - DNA, 25 bp, Mus musculus
tgaagattactgattgaaacgagag

SEQ ID NO: 795125 - DNA, 25 bp, Mus musculus
tgaagattactgtttgaaacgagag

SEQ ID NO: 795126 - DNA, 25 bp, Mus musculus
tgaagattaggtccttggatgcagt

SEQ ID NO: 795127 - DNA, 25 bp, Mus musculus
tgaagattaggtgcttggatgcagt

SEQ ID NO: 795128 - DNA, 25 bp, Mus musculus
tgaagattcaggatcgatcactatt

SEQ ID NO: 795129 - DNA, 25 bp, Mus musculus
tgaagattcaggttcgatcactatt

SEQ ID NO: 795130 - DNA, 25 bp, Mus musculus
tgaagattgacaacctcaccggcga

SEQ ID NO: 795131 - DNA, 25 bp, Mus musculus
tgaagattgacatcctcaccggcga

SEQ ID NO: 795132 - DNA, 25 bp, Mus musculus
tgaagattgcaacgctatacctgga

SEQ ID NO: 795133 - DNA, 25 bp, Mus musculus
tgaagattgcaaggctatacctgga

SEQ ID NO: 795134 - DNA, 25 bp, Mus musculus
tgaagattgcccagcagcacggtga

SEQ ID NO: 795135 - DNA, 25 bp, Mus musculus
tgaagattgccctgcagcacggtga

SEQ ID NO: 795136 - DNA, 25 bp, Mus musculus
tgaagatttccacacttctatgcct

SEQ ID NO: 795137 - DNA, 25 bp, Mus musculus
tgaagatttccagacttctatgcct

SEQ ID NO: 795138 - DNA, 25 bp, Mus musculus
tgaagatttgaaagaagaggtctgc

SEQ ID NO: 795139 - DNA, 25 bp, Mus musculus
tgaagatttgaatgaagaggtctgc

SEQ ID NO: 795140 - DNA, 25 bp, Mus musculus
tgaagattttgccaatcggaatgca

SEQ ID NO: 795141 - DNA, 25 bp, Mus musculus
tgaagattttgcgaatcggaatgca

SEQ ID NO: 795142 - DNA, 25 bp, Mus musculus
tgaagcaaacctacgagcgcctcgt

SEQ ID NO: 795143 - DNA, 25 bp, Mus musculus
tgaagcaaaccttcgagcgcctcgt

SEQ ID NO: 795144 - DNA, 25 bp, Mus musculus
tgaagcaacgggactacgagacagc

SEQ ID NO: 795145 - DNA, 25 bp, Mus musculus
tgaagcaacgggtctacgagacagc

SEQ ID NO: 795146 - DNA, 25 bp, Mus musculus
tgaagcaactagattctttgtctca

SEQ ID NO: 795147 - DNA, 25 bp, Mus musculus
tgaagcaactagtttctttgtctca

SEQ ID NO: 795148 - DNA, 25 bp, Mus musculus
tgaagcaagaatataaacacatcag

SEQ ID NO: 795149 - DNA, 25 bp, Mus musculus
tgaagcaagaatttaaacacatcag

SEQ ID NO: 795150 - DNA, 25 bp, Mus musculus
tgaagcaagatacgatcaccagata

SEQ ID NO: 795151 - DNA, 25 bp, Mus musculus
tgaagcaagataggatcaccagata

SEQ ID NO: 795152 - DNA, 25 bp, Mus musculus
tgaagcaaggcccttccagcccagt

SEQ ID NO: 795153 - DNA, 25 bp, Mus musculus
tgaagcaaggccgttccagcccagt

SEQ ID NO: 795154 - DNA, 25 bp, Mus musculus
tgaagcaatattcgctgccctggag

SEQ ID NO: 795155 - DNA, 25 bp, Mus musculus
tgaagcaatattggctgccctggag

SEQ ID NO: 795156 - DNA, 25 bp, Mus musculus
tgaagcacacatccgactaaatggg

SEQ ID NO: 795157 - DNA, 25 bp, Mus musculus
tgaagcacacatgcgactaaatggg

SEQ ID NO: 795158 - DNA, 25 bp, Mus musculus
tgaagcaccaggctttctgccttgg

SEQ ID NO: 795159 - DNA, 25 bp, Mus musculus
tgaagcaccagggtttctgccttgg

SEQ ID NO: 795160 - DNA, 25 bp, Mus musculus
tgaagcacccagacctagttaggcc

SEQ ID NO: 795161 - DNA, 25 bp, Mus musculus
tgaagcacccagtcctagttaggcc

SEQ ID NO: 795162 - DNA, 25 bp, Mus musculus
tgaagcacctgtcgatttaaacaaa

SEQ ID NO: 795163 - DNA, 25 bp, Mus musculus
tgaagcacctgtggatttaaacaaa

SEQ ID NO: 795164 - DNA, 25 bp, Mus musculus
tgaagcacggttacctgaggcacac

SEQ ID NO: 795165 - DNA, 25 bp, Mus musculus
tgaagcacggtttcctgaggcacac

SEQ ID NO: 795166 - DNA, 25 bp, Mus musculus
tgaagcacgtggagaccaacaccta

SEQ ID NO: 795167 - DNA, 25 bp, Mus musculus
tgaagcacgtggtgaccaacaccta

SEQ ID NO: 795168 - DNA, 25 bp, Mus musculus
tgaagcactctcctgatctaatgag

SEQ ID NO: 795169 - DNA, 25 bp, Mus musculus
tgaagcactctcgtgatctaatgag

SEQ ID NO: 795170 - DNA, 25 bp, Mus musculus
tgaagcactttcctaaacatgcagc

SEQ ID NO: 795171 - DNA, 25 bp, Mus musculus
tgaagcactttcgtaaacatgcagc

SEQ ID NO: 795172 - DNA, 25 bp, Mus musculus
tgaagcagaaccagcacgaggagct

SEQ ID NO: 795173 - DNA, 25 bp, Mus musculus
tgaagcagaacctgcacgaggagct

SEQ ID NO: 795174 - DNA, 25 bp, Mus musculus
tgaagcagcgagagctagacgcgtc

SEQ ID NO: 795175 - DNA, 25 bp, Mus musculus
tgaagcagcgagtgctagacgcgtc

SEQ ID NO: 795176 - DNA, 25 bp, Mus musculus
tgaagcagggtcagcgctggaccaa

SEQ ID NO: 795177 - DNA, 25 bp, Mus musculus
tgaagcagggtctgcgctggaccaa

SEQ ID NO: 795178 - DNA, 25 bp, Mus musculus
tgaagcagtacacctcttacaactt

SEQ ID NO: 795179 - DNA, 25 bp, Mus musculus
tgaagcagtacagctcttacaactt

SEQ ID NO: 795180 - DNA, 25 bp, Mus musculus
tgaagcagtcgcagctgttggcttt

SEQ ID NO: 795181 - DNA, 25 bp, Mus musculus
tgaagcagtcgctgctgttggcttt

SEQ ID NO: 795182 - DNA, 25 bp, Mus musculus
tgaagcagtgtcaggtaaaaagccc

SEQ ID NO: 795183 - DNA, 25 bp, Mus musculus
tgaagcagtgtctggtaaaaagccc

SEQ ID NO: 795184 - DNA, 25 bp, Mus musculus
tgaagcagttctatgaccaggccct

SEQ ID NO: 795185 - DNA, 25 bp, Mus musculus
tgaagcagttctttgaccaggccct

SEQ ID NO: 795186 - DNA, 25 bp, Mus musculus
tgaagcatcccactgtcaaccagga

SEQ ID NO: 795187 - DNA, 25 bp, Mus musculus
tgaagcatcccagtgtcaaccagga

SEQ ID NO: 795188 - DNA, 25 bp, Mus musculus
tgaagcatgcccaggaaaaggcgga

SEQ ID NO: 795189 - DNA, 25 bp, Mus musculus
tgaagcatgccctggaaaaggcgga

SEQ ID NO: 795190 - DNA, 25 bp, Mus musculus
tgaagcattcagcaaaaggtctctg

SEQ ID NO: 795191 - DNA, 25 bp, Mus musculus
tgaagcattcaggaaaaggtctctg

SEQ ID NO: 795192 - DNA, 25 bp, Mus musculus
tgaagcattgtacccctaacctctg

SEQ ID NO: 795193 - DNA, 25 bp, Mus musculus
tgaagcattgtagccctaacctctg

SEQ ID NO: 795194 - DNA, 25 bp, Mus musculus
tgaagccaaaatcgctctggccatg

SEQ ID NO: 795195 - DNA, 25 bp, Mus musculus
tgaagccaaaatggctctggccatg

SEQ ID NO: 795196 - DNA, 25 bp, Mus musculus
tgaagccaaacactctcgtgattgg

SEQ ID NO: 795197 - DNA, 25 bp, Mus musculus
tgaagccaaacagtctcgtgattgg

SEQ ID NO: 795198 - DNA, 25 bp, Mus musculus
tgaagccaacggagaactaaaggtc

SEQ ID NO: 795199 - DNA, 25 bp, Mus musculus
tgaagccaacggtgaactaaaggtc

SEQ ID NO: 795200 - DNA, 25 bp, Mus musculus
tgaagccaagagcttctgctctgta

SEQ ID NO: 795201 - DNA, 25 bp, Mus musculus
tgaagccaagaggttctgctctgta

SEQ ID NO: 795202 - DNA, 25 bp, Mus musculus
tgaagccacatgattaccccaagtg

SEQ ID NO: 795203 - DNA, 25 bp, Mus musculus
tgaagccacatgtttaccccaagtg

SEQ ID NO: 795204 - DNA, 25 bp, Mus musculus
tgaagccactgcacagctcctaaga

SEQ ID NO: 795205 - DNA, 25 bp, Mus musculus
tgaagccactgctcagctcctaaga

SEQ ID NO: 795206 - DNA, 25 bp, Mus musculus
tgaagccagcctcgtcatgggccta

SEQ ID NO: 795207 - DNA, 25 bp, Mus musculus
tgaagccagcctggtcatgggccta

SEQ ID NO: 795208 - DNA, 25 bp, Mus musculus
tgaagccagcgacccggagctcctg

SEQ ID NO: 795209 - DNA, 25 bp, Mus musculus
tgaagccagcgagccggagctcctg

SEQ ID NO: 795210 - DNA, 25 bp, Mus musculus
tgaagccagcgtcctaatgcagagc

SEQ ID NO: 795211 - DNA, 25 bp, Mus musculus
tgaagccagcgtgctaatgcagagc

SEQ ID NO: 795212 - DNA, 25 bp, Mus musculus
tgaagccaggaaatgcatgaaccgc

SEQ ID NO: 795213 - DNA, 25 bp, Mus musculus
tgaagccaggaattgcatgaaccgc

SEQ ID NO: 795214 - DNA, 25 bp, Mus musculus
tgaagccagtgtctctgccgaaccc

SEQ ID NO: 795215 - DNA, 25 bp, Mus musculus
tgaagccagtgtgtctgccgaaccc

SEQ ID NO: 795216 - DNA, 25 bp, Mus musculus
tgaagccagttacaagcagccagtc

SEQ ID NO: 795217 - DNA, 25 bp, Mus musculus
tgaagccagttagaagcagccagtc

SEQ ID NO: 795218 - DNA, 25 bp, Mus musculus
tgaagccatcatcacccactttaat

SEQ ID NO: 795219 - DNA, 25 bp, Mus musculus
tgaagccatcatgacccactttaat

SEQ ID NO: 795220 - DNA, 25 bp, Mus musculus
tgaagccatcttcacgatgctgtcc

SEQ ID NO: 795221 - DNA, 25 bp, Mus musculus
tgaagccatcttgacgatgctgtcc

SEQ ID NO: 795222 - DNA, 25 bp, Mus musculus
tgaagcccaaacagatgtaccagga

SEQ ID NO: 795223 - DNA, 25 bp, Mus musculus
tgaagcccaaactgatgtaccagga

SEQ ID NO: 795224 - DNA, 25 bp, Mus musculus
tgaagcccagccagaagaaggtgag

SEQ ID NO: 795225 - DNA, 25 bp, Mus musculus
tgaagcccagcctgaagaaggtgag

SEQ ID NO: 795226 - DNA, 25 bp, Mus musculus
tgaagcccataaaatagtcaaagag

SEQ ID NO: 795227 - DNA, 25 bp, Mus musculus
tgaagcccataatatagtcaaagag

SEQ ID NO: 795228 - DNA, 25 bp, Mus musculus
tgaagcccatccagagctctcgaac

SEQ ID NO: 795229 - DNA, 25 bp, Mus musculus
tgaagcccatcctgagctctcgaac

SEQ ID NO: 795230 - DNA, 25 bp, Mus musculus
tgaagccccgtcaaacaagaacatg

SEQ ID NO: 795231 - DNA, 25 bp, Mus musculus
tgaagccccgtctaacaagaacatg

SEQ ID NO: 795232 - DNA, 25 bp, Mus musculus
tgaagcccctggagtttggcaagcc

SEQ ID NO: 795233 - DNA, 25 bp, Mus musculus
tgaagcccctggtgtttggcaagcc

SEQ ID NO: 795234 - DNA, 25 bp, Mus musculus
tgaagccctaagcactcacagacga

SEQ ID NO: 795235 - DNA, 25 bp, Mus musculus
tgaagccctaaggactcacagacga

SEQ ID NO: 795236 - DNA, 25 bp, Mus musculus
tgaagccctacgaggaagaaggttt

SEQ ID NO: 795237 - DNA, 25 bp, Mus musculus
tgaagccctacgtggaagaaggttt

SEQ ID NO: 795238 - DNA, 25 bp, Mus musculus
tgaagccctgaaagtgggaacaacc

SEQ ID NO: 795239 - DNA, 25 bp, Mus musculus
tgaagccctgaacaggtaccggtca

SEQ ID NO: 795240 - DNA, 25 bp, Mus musculus
tgaagccctgaagaggtaccggtca

SEQ ID NO: 795241 - DNA, 25 bp, Mus musculus
tgaagccctgaatgtgggaacaacc

SEQ ID NO: 795242 - DNA, 25 bp, Mus musculus
tgaagccgaaaaccagtttaagagg

SEQ ID NO: 795243 - DNA, 25 bp, Mus musculus
tgaagccgaaaagcagtttaagagg

SEQ ID NO: 795244 - DNA, 25 bp, Mus musculus
tgaagccgaccgctttgacttttca

SEQ ID NO: 795245 - DNA, 25 bp, Mus musculus
tgaagccgaccggtttgacttttca

SEQ ID NO: 795246 - DNA, 25 bp, Mus musculus
tgaagccgagcgctgtatcagcatc

SEQ ID NO: 795247 - DNA, 25 bp, Mus musculus
tgaagccgagcggtgtatcagcatc

SEQ ID NO: 795248 - DNA, 25 bp, Mus musculus
tgaagccgagctacgggtcacagcc

SEQ ID NO: 795249 - DNA, 25 bp, Mus musculus
tgaagccgagcttcgggtcacagcc

SEQ ID NO: 795250 - DNA, 25 bp, Mus musculus
tgaagccgcagtctccactcttcta

SEQ ID NO: 795251 - DNA, 25 bp, Mus musculus
tgaagccgcagtgtccactcttcta

SEQ ID NO: 795252 - DNA, 25 bp, Mus musculus
tgaagccgccatataagacaacgag

SEQ ID NO: 795253 - DNA, 25 bp, Mus musculus
tgaagccgccatttaagacaacgag

SEQ ID NO: 795254 - DNA, 25 bp, Mus musculus
tgaagccgctcgcagagtgactctg

SEQ ID NO: 795255 - DNA, 25 bp, Mus musculus
tgaagccgctcggagagtgactctg

SEQ ID NO: 795256 - DNA, 25 bp, Mus musculus
tgaagccggtgcagccaggagccat

SEQ ID NO: 795257 - DNA, 25 bp, Mus musculus
tgaagccggtgctgccaggagccat

SEQ ID NO: 795258 - DNA, 25 bp, Mus musculus
tgaagcctactgagccctatggaga

SEQ ID NO: 795259 - DNA, 25 bp, Mus musculus
tgaagcctactgtgccctatggaga

SEQ ID NO: 795260 - DNA, 25 bp, Mus musculus
tgaagcctccatagaaagcaatgag

SEQ ID NO: 795261 - DNA, 25 bp, Mus musculus
tgaagcctccattgaaagcaatgag

SEQ ID NO: 795262 - DNA, 25 bp, Mus musculus
tgaagcctccggagtgaacaagcat

SEQ ID NO: 795263 - DNA, 25 bp, Mus musculus
tgaagcctccggtgtgaacaagcat

SEQ ID NO: 795264 - DNA, 25 bp, Mus musculus
tgaagcctgagactatgtacgagac

SEQ ID NO: 795265 - DNA, 25 bp, Mus musculus
tgaagcctgagagtatgtacgagac

SEQ ID NO: 795266 - DNA, 25 bp, Mus musculus
tgaagcctgccccagtgtatgggac

SEQ ID NO: 795267 - DNA, 25 bp, Mus musculus
tgaagcctgcccgagtgtatgggac

SEQ ID NO: 795268 - DNA, 25 bp, Mus musculus
tgaagcctggcaaggctcctgcttc

SEQ ID NO: 795269 - DNA, 25 bp, Mus musculus
tgaagcctggcatggctcctgcttc

SEQ ID NO: 795270 - DNA, 25 bp, Mus musculus
tgaagcctggccacacgttcatcac

SEQ ID NO: 795271 - DNA, 25 bp, Mus musculus
tgaagcctggcctcacgttcatcac

SEQ ID NO: 795272 - DNA, 25 bp, Mus musculus
tgaagcctggtcagcagtaccgaat

SEQ ID NO: 795273 - DNA, 25 bp, Mus musculus
tgaagcctggtctgcagtaccgaat

SEQ ID NO: 795274 - DNA, 25 bp, Mus musculus
tgaagccttatcaaaatcagtgcct

SEQ ID NO: 795275 - DNA, 25 bp, Mus musculus
tgaagccttatctaaatcagtgcct

SEQ ID NO: 795276 - DNA, 25 bp, Mus musculus
tgaagccttgctcctgacagtgttc

SEQ ID NO: 795277 - DNA, 25 bp, Mus musculus
tgaagccttgctgctgacagtgttc

SEQ ID NO: 795278 - DNA, 25 bp, Mus musculus
tgaagcctttctcaagagttacggg

SEQ ID NO: 795279 - DNA, 25 bp, Mus musculus
tgaagcctttctgaagagttacggg

SEQ ID NO: 795280 - DNA, 25 bp, Mus musculus
tgaagcgaaccaaggatattaagga

SEQ ID NO: 795281 - DNA, 25 bp, Mus musculus
tgaagcgaaccatggatattaagga

SEQ ID NO: 795282 - DNA, 25 bp, Mus musculus
tgaagcgattgcagcctgcagagct

SEQ ID NO: 795283 - DNA, 25 bp, Mus musculus
tgaagcgattgctgcctgcagagct

SEQ ID NO: 795284 - DNA, 25 bp, Mus musculus
tgaagcgcagaccaagccatagtga

SEQ ID NO: 795285 - DNA, 25 bp, Mus musculus
tgaagcgcagacgaagccatagtga

SEQ ID NO: 795286 - DNA, 25 bp, Mus musculus
tgaagcgcagctccccttcttgtgg

SEQ ID NO: 795287 - DNA, 25 bp, Mus musculus
tgaagcgcagctgcccttcttgtgg

SEQ ID NO: 795288 - DNA, 25 bp, Mus musculus
tgaagcgccatcagaccaagattga

SEQ ID NO: 795289 - DNA, 25 bp, Mus musculus
tgaagcgccatctgaccaagattga

SEQ ID NO: 795290 - DNA, 25 bp, Mus musculus
tgaagcgccgagaccgtgaggccct

SEQ ID NO: 795291 - DNA, 25 bp, Mus musculus
tgaagcgccgagtccgtgaggccct

SEQ ID NO: 795292 - DNA, 25 bp, Mus musculus
tgaagcgctatgaccggaagggaat

SEQ ID NO: 795293 - DNA, 25 bp, Mus musculus
tgaagcgctatgtccggaagggaat

SEQ ID NO: 795294 - DNA, 25 bp, Mus musculus
tgaagcggagatctaaagaccccag

SEQ ID NO: 795295 - DNA, 25 bp, Mus musculus
tgaagcggagatgtaaagaccccag

SEQ ID NO: 795296 - DNA, 25 bp, Mus musculus
tgaagcggatccagtgccatgagca

SEQ ID NO: 795297 - DNA, 25 bp, Mus musculus
tgaagcggatcctgtgccatgagca

SEQ ID NO: 795298 - DNA, 25 bp, Mus musculus
tgaagcggcactctttgcacatcat

SEQ ID NO: 795299 - DNA, 25 bp, Mus musculus
tgaagcggcactgtttgcacatcat

SEQ ID NO: 795300 - DNA, 25 bp, Mus musculus
tgaagcgtcagcagacaaggcagca

SEQ ID NO: 795301 - DNA, 25 bp, Mus musculus
tgaagcgtcagctgacaaggcagca

SEQ ID NO: 795302 - DNA, 25 bp, Mus musculus
tgaagctaaagcagatcgagcacac

SEQ ID NO: 795303 - DNA, 25 bp, Mus musculus
tgaagctaaagctgatcgagcacac

SEQ ID NO: 795304 - DNA, 25 bp, Mus musculus
tgaagctaactgacagccctgaacc

SEQ ID NO: 795305 - DNA, 25 bp, Mus musculus
tgaagctaactgtcagccctgaacc

SEQ ID NO: 795306 - DNA, 25 bp, Mus musculus
tgaagctacccacctctgtgggtca

SEQ ID NO: 795307 - DNA, 25 bp, Mus musculus
tgaagctacccagctctgtgggtca

SEQ ID NO: 795308 - DNA, 25 bp, Mus musculus
tgaagctagcaaaagttgtagcgcc

SEQ ID NO: 795309 - DNA, 25 bp, Mus musculus
tgaagctagcaatagttgtagcgcc

SEQ ID NO: 795310 - DNA, 25 bp, Mus musculus
tgaagctagcttatgctgttcgagg

SEQ ID NO: 795311 - DNA, 25 bp, Mus musculus
tgaagctagcttttgctgttcgagg

SEQ ID NO: 795312 - DNA, 25 bp, Mus musculus
tgaagctattgcagagaaaaaccgt

SEQ ID NO: 795313 - DNA, 25 bp, Mus musculus
tgaagctattgctgagaaaaaccgt

SEQ ID NO: 795314 - DNA, 25 bp, Mus musculus
tgaagctcaacgaaatagtgggcaa

SEQ ID NO: 795315 - DNA, 25 bp, Mus musculus
tgaagctcaacgtaatagtgggcaa

SEQ ID NO: 795316 - DNA, 25 bp, Mus musculus
tgaagctcagatccgacttcagctg

SEQ ID NO: 795317 - DNA, 25 bp, Mus musculus
tgaagctcagatgcgacttcagctg

SEQ ID NO: 795318 - DNA, 25 bp, Mus musculus
tgaagctcagcgcacagctgctgtg

SEQ ID NO: 795319 - DNA, 25 bp, Mus musculus
tgaagctcagcggacagctgctgtg

SEQ ID NO: 795320 - DNA, 25 bp, Mus musculus
tgaagctcatttaaagactcgttgg

SEQ ID NO: 795321 - DNA, 25 bp, Mus musculus
tgaagctcatttactccaacatctc

SEQ ID NO: 795322 - DNA, 25 bp, Mus musculus
tgaagctcattttaagactcgttgg

SEQ ID NO: 795323 - DNA, 25 bp, Mus musculus
tgaagctcattttctccaacatctc

SEQ ID NO: 795324 - DNA, 25 bp, Mus musculus
tgaagctccacacactcggaagaac

SEQ ID NO: 795325 - DNA, 25 bp, Mus musculus
tgaagctccacagactcggaagaac

SEQ ID NO: 795326 - DNA, 25 bp, Mus musculus
tgaagctctcccagccatacggatt

SEQ ID NO: 795327 - DNA, 25 bp, Mus musculus
tgaagctctccctgccatacggatt

SEQ ID NO: 795328 - DNA, 25 bp, Mus musculus
tgaagctcttccagtcacggaggag

SEQ ID NO: 795329 - DNA, 25 bp, Mus musculus
tgaagctcttcctgtcacggaggag

SEQ ID NO: 795330 - DNA, 25 bp, Mus musculus
tgaagctgactacgcaggcctactg

SEQ ID NO: 795331 - DNA, 25 bp, Mus musculus
tgaagctgactaggcaggcctactg

SEQ ID NO: 795332 - DNA, 25 bp, Mus musculus
tgaagctgagtgctagcattcattt

SEQ ID NO: 795333 - DNA, 25 bp, Mus musculus
tgaagctgagtggtagcattcattt

SEQ ID NO: 795334 - DNA, 25 bp, Mus musculus
tgaagctgatgcacagttggcctac

SEQ ID NO: 795335 - DNA, 25 bp, Mus musculus
tgaagctgatgctcagttggcctac

SEQ ID NO: 795336 - DNA, 25 bp, Mus musculus
tgaagctgcaggcaagctacacaca

SEQ ID NO: 795337 - DNA, 25 bp, Mus musculus
tgaagctgcagggaagctacacaca

SEQ ID NO: 795338 - DNA, 25 bp, Mus musculus
tgaagctgccagactagtgaagggc

SEQ ID NO: 795339 - DNA, 25 bp, Mus musculus
tgaagctgccagtctagtgaagggc

SEQ ID NO: 795340 - DNA, 25 bp, Mus musculus
tgaagctgccctctgacgttgtgac

SEQ ID NO: 795341 - DNA, 25 bp, Mus musculus
tgaagctgccctgtgacgttgtgac

SEQ ID NO: 795342 - DNA, 25 bp, Mus musculus
tgaagctgcggcatcttgcagggcc

SEQ ID NO: 795343 - DNA, 25 bp, Mus musculus
tgaagctgcggcttcttgcagggcc

SEQ ID NO: 795344 - DNA, 25 bp, Mus musculus
tgaagctggagcatgctaagtcggc

SEQ ID NO: 795345 - DNA, 25 bp, Mus musculus
tgaagctggagcttgctaagtcggc

SEQ ID NO: 795346 - DNA, 25 bp, Mus musculus
tgaagctgggtgaggatactatcgc

SEQ ID NO: 795347 - DNA, 25 bp, Mus musculus
tgaagctgggtgtggatactatcgc

SEQ ID NO: 795348 - DNA, 25 bp, Mus musculus
tgaagctggtcaccactgagcctgc

SEQ ID NO: 795349 - DNA, 25 bp, Mus musculus
tgaagctggtcagcactgagcctgc

SEQ ID NO: 795350 - DNA, 25 bp, Mus musculus
tgaagctggtgcatggcctgcacaa

SEQ ID NO: 795351 - DNA, 25 bp, Mus musculus
tgaagctggtgcttggcctgcacaa

SEQ ID NO: 795352 - DNA, 25 bp, Mus musculus
tgaagctgtgaacccaacagttggc

SEQ ID NO: 795353 - DNA, 25 bp, Mus musculus
tgaagctgtgaagccaacagttggc

SEQ ID NO: 795354 - DNA, 25 bp, Mus musculus
tgaagctgtgggactggacactgct

SEQ ID NO: 795355 - DNA, 25 bp, Mus musculus
tgaagctgtgggtctggacactgct

SEQ ID NO: 795356 - DNA, 25 bp, Mus musculus
tgaagctgtttcctggtcctgccca

SEQ ID NO: 795357 - DNA, 25 bp, Mus musculus
tgaagctgtttcgtggtcctgccca

SEQ ID NO: 795358 - DNA, 25 bp, Mus musculus
tgaagctgtttgatgaccctgacct

SEQ ID NO: 795359 - DNA, 25 bp, Mus musculus
tgaagctgtttgttgaccctgacct

SEQ ID NO: 795360 - DNA, 25 bp, Mus musculus
tgaagcttacaaaatggcagcactg

SEQ ID NO: 795361 - DNA, 25 bp, Mus musculus
tgaagcttacaatatggcagcactg

SEQ ID NO: 795362 - DNA, 25 bp, Mus musculus
tgaagcttactgctgatgccaagtt

SEQ ID NO: 795363 - DNA, 25 bp, Mus musculus
tgaagcttactggtgatgccaagtt

SEQ ID NO: 795364 - DNA, 25 bp, Mus musculus
tgaagcttagaaaacctagaattac

SEQ ID NO: 795365 - DNA, 25 bp, Mus musculus
tgaagcttagaatacctagaattac

SEQ ID NO: 795366 - DNA, 25 bp, Mus musculus
tgaagcttcggaagcagaaggctct

SEQ ID NO: 795367 - DNA, 25 bp, Mus musculus
tgaagcttcggatgcagaaggctct

SEQ ID NO: 795368 - DNA, 25 bp, Mus musculus
tgaagcttgcagattgtataccaag

SEQ ID NO: 795369 - DNA, 25 bp, Mus musculus
tgaagcttgcagtttgtataccaag

SEQ ID NO: 795370 - DNA, 25 bp, Mus musculus
tgaagcttgcatactgtgacatctg

SEQ ID NO: 795371 - DNA, 25 bp, Mus musculus
tgaagcttgcattctgtgacatctg

SEQ ID NO: 795372 - DNA, 25 bp, Mus musculus
tgaagcttgtaaatgaggcttggaa

SEQ ID NO: 795373 - DNA, 25 bp, Mus musculus
tgaagcttgtaattgaggcttggaa

SEQ ID NO: 795374 - DNA, 25 bp, Mus musculus
tgaagcttgtgcctcctttctgtcc

SEQ ID NO: 795375 - DNA, 25 bp, Mus musculus
tgaagcttgtgcgtcctttctgtcc

SEQ ID NO: 795376 - DNA, 25 bp, Mus musculus
tgaagctttaaacgaacctacttgt

SEQ ID NO: 795377 - DNA, 25 bp, Mus musculus
tgaagctttaaaggaacctacttgt

SEQ ID NO: 795378 - DNA, 25 bp, Mus musculus
tgaagctttcatatgatgaagagca

SEQ ID NO: 795379 - DNA, 25 bp, Mus musculus
tgaagctttcatttgatgaagagca

SEQ ID NO: 795380 - DNA, 25 bp, Mus musculus
tgaagcttttgtaaagaggagaaac

SEQ ID NO: 795381 - DNA, 25 bp, Mus musculus
tgaagcttttgttaagaggagaaac

SEQ ID NO: 795382 - DNA, 25 bp, Mus musculus
tgaaggaaagtgcatccgaaatatt

SEQ ID NO: 795383 - DNA, 25 bp, Mus musculus
tgaaggaaagtggatccgaaatatt

SEQ ID NO: 795384 - DNA, 25 bp, Mus musculus
tgaaggaaatccagcaaaggtcaac

SEQ ID NO: 795385 - DNA, 25 bp, Mus musculus
tgaaggaaatcctgcaaaggtcaac

SEQ ID NO: 795386 - DNA, 25 bp, Mus musculus
tgaaggaaatgcctttggctctcca

SEQ ID NO: 795387 - DNA, 25 bp, Mus musculus
tgaaggaaatgcgtttggctctcca

SEQ ID NO: 795388 - DNA, 25 bp, Mus musculus
tgaaggaaattaccttgatgatgct

SEQ ID NO: 795389 - DNA, 25 bp, Mus musculus
tgaaggaaattagcttgatgatgct

SEQ ID NO: 795390 - DNA, 25 bp, Mus musculus
tgaaggaaatttcgccacaatggcc

SEQ ID NO: 795391 - DNA, 25 bp, Mus musculus
tgaaggaaatttggccacaatggcc

SEQ ID NO: 795392 - DNA, 25 bp, Mus musculus
tgaaggaacaccatgaccaaccaag

SEQ ID NO: 795393 - DNA, 25 bp, Mus musculus
tgaaggaacaccttgaccaaccaag

SEQ ID NO: 795394 - DNA, 25 bp, Mus musculus
tgaaggaacctgctctgatactggg

SEQ ID NO: 795395 - DNA, 25 bp, Mus musculus
tgaaggaacctggtctgatactggg

SEQ ID NO: 795396 - DNA, 25 bp, Mus musculus
tgaaggaactcactcgacagaagaa

SEQ ID NO: 795397 - DNA, 25 bp, Mus musculus
tgaaggaactcagtcgacagaagaa

SEQ ID NO: 795398 - DNA, 25 bp, Mus musculus
tgaaggaactgaagctgctacagac

SEQ ID NO: 795399 - DNA, 25 bp, Mus musculus
tgaaggaactgatgctgctacagac

SEQ ID NO: 795400 - DNA, 25 bp, Mus musculus
tgaaggaactgcaggccattgccga

SEQ ID NO: 795401 - DNA, 25 bp, Mus musculus
tgaaggaactgctggccattgccga

SEQ ID NO: 795402 - DNA, 25 bp, Mus musculus
tgaaggaactggatgaaaacggaga

SEQ ID NO: 795403 - DNA, 25 bp, Mus musculus
tgaaggaactggttgaaaacggaga

SEQ ID NO: 795404 - DNA, 25 bp, Mus musculus
tgaaggaagagcactgaagttgcca

SEQ ID NO: 795405 - DNA, 25 bp, Mus musculus
tgaaggaagagctctgaagttgcca

SEQ ID NO: 795406 - DNA, 25 bp, Mus musculus
tgaaggaaggctctatcacagagag

SEQ ID NO: 795407 - DNA, 25 bp, Mus musculus
tgaaggaaggctgtatcacagagag

SEQ ID NO: 795408 - DNA, 25 bp, Mus musculus
tgaaggaaggttatgcccgctgtgt

SEQ ID NO: 795409 - DNA, 25 bp, Mus musculus
tgaaggaaggttttgcccgctgtgt

SEQ ID NO: 795410 - DNA, 25 bp, Mus musculus
tgaaggaagtggatgagacccgcaa

SEQ ID NO: 795411 - DNA, 25 bp, Mus musculus
tgaaggaagtggttgagacccgcaa

SEQ ID NO: 795412 - DNA, 25 bp, Mus musculus
tgaaggaagtgtcacagaatgcgcc

SEQ ID NO: 795413 - DNA, 25 bp, Mus musculus
tgaaggaagtgtgacagaatgcgcc

SEQ ID NO: 795414 - DNA, 25 bp, Mus musculus
tgaaggaatccgacttgtaaagcca

SEQ ID NO: 795415 - DNA, 25 bp, Mus musculus
tgaaggaatccgtcttgtaaagcca

SEQ ID NO: 795416 - DNA, 25 bp, Mus musculus
tgaaggaatgctaaatccaaggacc

SEQ ID NO: 795417 - DNA, 25 bp, Mus musculus
tgaaggaatgcttaatccaaggacc

SEQ ID NO: 795418 - DNA, 25 bp, Mus musculus
tgaaggaattcaccagtcaactggc

SEQ ID NO: 795419 - DNA, 25 bp, Mus musculus
tgaaggaattcagcagtcaactggc

SEQ ID NO: 795420 - DNA, 25 bp, Mus musculus
tgaaggacaacgagaagaaccggaa

SEQ ID NO: 795421 - DNA, 25 bp, Mus musculus
tgaaggacaacgtgaagaaccggaa

SEQ ID NO: 795422 - DNA, 25 bp, Mus musculus
tgaaggacagcaccacatactcacg

SEQ ID NO: 795423 - DNA, 25 bp, Mus musculus
tgaaggacagcagcacatactcacg

SEQ ID NO: 795424 - DNA, 25 bp, Mus musculus
tgaaggacatggagcgacacctgaa

SEQ ID NO: 795425 - DNA, 25 bp, Mus musculus
tgaaggacatggtgcgacacctgaa

SEQ ID NO: 795426 - DNA, 25 bp, Mus musculus
tgaaggacatttcttggcagcaacc

SEQ ID NO: 795427 - DNA, 25 bp, Mus musculus
tgaaggacatttgttggcagcaacc

SEQ ID NO: 795428 - DNA, 25 bp, Mus musculus
tgaaggaccacacgccccgagtggt

SEQ ID NO: 795429 - DNA, 25 bp, Mus musculus
tgaaggaccacaggccccgagtggt

SEQ ID NO: 795430 - DNA, 25 bp, Mus musculus
tgaaggacccaaacgaccacaccgt

SEQ ID NO: 795431 - DNA, 25 bp, Mus musculus
tgaaggacccaatcgaccacaccgt

SEQ ID NO: 795432 - DNA, 25 bp, Mus musculus
tgaaggaccccaccgagctcctgag

SEQ ID NO: 795433 - DNA, 25 bp, Mus musculus
tgaaggaccccagcgagctcctgag

SEQ ID NO: 795434 - DNA, 25 bp, Mus musculus
tgaaggacgctcagcttttcattca

SEQ ID NO: 795435 - DNA, 25 bp, Mus musculus
tgaaggacgctctgcttttcattca

SEQ ID NO: 795436 - DNA, 25 bp, Mus musculus
tgaaggactaaaacgcttaatgaca

SEQ ID NO: 795437 - DNA, 25 bp, Mus musculus
tgaaggactaaatcgcttaatgaca

SEQ ID NO: 795438 - DNA, 25 bp, Mus musculus
tgaaggactgagcagaacctgtctc

SEQ ID NO: 795439 - DNA, 25 bp, Mus musculus
tgaaggactgaggagaacctgtctc

SEQ ID NO: 795440 - DNA, 25 bp, Mus musculus
tgaaggactgggagaagcgtctcat

SEQ ID NO: 795441 - DNA, 25 bp, Mus musculus
tgaaggactgggtgaagcgtctcat

SEQ ID NO: 795442 - DNA, 25 bp, Mus musculus
tgaaggactttcagcacaaggaccg

SEQ ID NO: 795443 - DNA, 25 bp, Mus musculus
tgaaggactttctgcacaaggaccg

SEQ ID NO: 795444 - DNA, 25 bp, Mus musculus
tgaaggagaacaaagttgccatcat

SEQ ID NO: 795445 - DNA, 25 bp, Mus musculus
tgaaggagaacatagttgccatcat

SEQ ID NO: 795446 - DNA, 25 bp, Mus musculus
tgaaggagacggaaaaggcttcctg

SEQ ID NO: 795447 - DNA, 25 bp, Mus musculus
tgaaggagacggtaaaggcttcctg

SEQ ID NO: 795448 - DNA, 25 bp, Mus musculus
tgaaggagataacctattgatctgc

SEQ ID NO: 795449 - DNA, 25 bp, Mus musculus
tgaaggagataagctattgatctgc

SEQ ID NO: 795450 - DNA, 25 bp, Mus musculus
tgaaggagatctagctcaaggcagt

SEQ ID NO: 795451 - DNA, 25 bp, Mus musculus
tgaaggagatcttgctcaaggcagt

SEQ ID NO: 795452 - DNA, 25 bp, Mus musculus
tgaaggagatgaaccagcactgcgt

SEQ ID NO: 795453 - DNA, 25 bp, Mus musculus
tgaaggagatgatccagcactgcgt

SEQ ID NO: 795454 - DNA, 25 bp, Mus musculus
tgaaggagatggcacagtcagtctt

SEQ ID NO: 795455 - DNA, 25 bp, Mus musculus
tgaaggagatgggacagtcagtctt

SEQ ID NO: 795456 - DNA, 25 bp, Mus musculus
tgaaggagcaatcgacatgcaaaat

SEQ ID NO: 795457 - DNA, 25 bp, Mus musculus
tgaaggagcaatggacatgcaaaat

SEQ ID NO: 795458 - DNA, 25 bp, Mus musculus
tgaaggagcatcagataatccagtc

SEQ ID NO: 795459 - DNA, 25 bp, Mus musculus
tgaaggagcatctgataatccagtc

SEQ ID NO: 795460 - DNA, 25 bp, Mus musculus
tgaaggagcctgacactggctctag

SEQ ID NO: 795461 - DNA, 25 bp, Mus musculus
tgaaggagcctgtcactggctctag

SEQ ID NO: 795462 - DNA, 25 bp, Mus musculus
tgaaggagctgtcggcataccagca

SEQ ID NO: 795463 - DNA, 25 bp, Mus musculus
tgaaggagctgtgggcataccagca

SEQ ID NO: 795464 - DNA, 25 bp, Mus musculus
tgaaggagcttgatacctttctcgg

SEQ ID NO: 795465 - DNA, 25 bp, Mus musculus
tgaaggagcttgttacctttctcgg

SEQ ID NO: 795466 - DNA, 25 bp, Mus musculus
tgaaggaggacgcacacatggtcac

SEQ ID NO: 795467 - DNA, 25 bp, Mus musculus
tgaaggaggacggacacatggtcac

SEQ ID NO: 795468 - DNA, 25 bp, Mus musculus
tgaaggaggccgaaggatcgtttac

SEQ ID NO: 795469 - DNA, 25 bp, Mus musculus
tgaaggaggccgtaggatcgtttac

SEQ ID NO: 795470 - DNA, 25 bp, Mus musculus
tgaaggaggctacgctgcacccttc

SEQ ID NO: 795471 - DNA, 25 bp, Mus musculus
tgaaggaggctaggctgcacccttc

SEQ ID NO: 795472 - DNA, 25 bp, Mus musculus
tgaaggagggcaagccttacctggt

SEQ ID NO: 795473 - DNA, 25 bp, Mus musculus
tgaaggagggcatgccttacctggt

SEQ ID NO: 795474 - DNA, 25 bp, Mus musculus
tgaaggagggtcatcgaatggacaa

SEQ ID NO: 795475 - DNA, 25 bp, Mus musculus
tgaaggagggtcttcgaatggacaa

SEQ ID NO: 795476 - DNA, 25 bp, Mus musculus
tgaaggagtcagaagccattaaacc

SEQ ID NO: 795477 - DNA, 25 bp, Mus musculus
tgaaggagtcagtagccattaaacc

SEQ ID NO: 795478 - DNA, 25 bp, Mus musculus
tgaaggagttgaaccgctgtgatga

SEQ ID NO: 795479 - DNA, 25 bp, Mus musculus
tgaaggagttgatccgctgtgatga

SEQ ID NO: 795480 - DNA, 25 bp, Mus musculus
tgaaggagtttgcaatcgagtgact

SEQ ID NO: 795481 - DNA, 25 bp, Mus musculus
tgaaggagtttggaatcgagtgact

SEQ ID NO: 795482 - DNA, 25 bp, Mus musculus
tgaaggataaggaagatgaaactgg

SEQ ID NO: 795483 - DNA, 25 bp, Mus musculus
tgaaggataaggtagatgaaactgg

SEQ ID NO: 795484 - DNA, 25 bp, Mus musculus
tgaaggatcagaagtcagcttcatc

SEQ ID NO: 795485 - DNA, 25 bp, Mus musculus
tgaaggatcagatgtcagcttcatc

SEQ ID NO: 795486 - DNA, 25 bp, Mus musculus
tgaaggatcctgacatggtctggga

SEQ ID NO: 795487 - DNA, 25 bp, Mus musculus
tgaaggatcctgtcatggtctggga

SEQ ID NO: 795488 - DNA, 25 bp, Mus musculus
tgaaggatctggaagggttacaccg

SEQ ID NO: 795489 - DNA, 25 bp, Mus musculus
tgaaggatctggtagggttacaccg

SEQ ID NO: 795490 - DNA, 25 bp, Mus musculus
tgaaggatgaagatcagattcaagg

SEQ ID NO: 795491 - DNA, 25 bp, Mus musculus
tgaaggatgaagttcagattcaagg

SEQ ID NO: 795492 - DNA, 25 bp, Mus musculus
tgaaggatgacacctacgcaccaaa

SEQ ID NO: 795493 - DNA, 25 bp, Mus musculus
tgaaggatgacagctacgcaccaaa

SEQ ID NO: 795494 - DNA, 25 bp, Mus musculus
tgaaggatgaggagcgcaccctcac

SEQ ID NO: 795495 - DNA, 25 bp, Mus musculus
tgaaggatgaggtgcgcaccctcac

SEQ ID NO: 795496 - DNA, 25 bp, Mus musculus
tgaaggatgagtacacccaccgtac

SEQ ID NO: 795497 - DNA, 25 bp, Mus musculus
tgaaggatgagttcacccaccgtac

SEQ ID NO: 795498 - DNA, 25 bp, Mus musculus
tgaaggatgggaactgcacagattg

SEQ ID NO: 795499 - DNA, 25 bp, Mus musculus
tgaaggatgggatctgcacagattg

SEQ ID NO: 795500 - DNA, 25 bp, Mus musculus
tgaaggatgtcacttctgtgacctg

SEQ ID NO: 795501 - DNA, 25 bp, Mus musculus
tgaaggatgtcagttctgtgacctg

SEQ ID NO: 795502 - DNA, 25 bp, Mus musculus
tgaaggcaaaatcgcccgtgtgtgc

SEQ ID NO: 795503 - DNA, 25 bp, Mus musculus
tgaaggcaaaatggcccgtgtgtgc

SEQ ID NO: 795504 - DNA, 25 bp, Mus musculus
tgaaggcaaattaccttacccaacg

SEQ ID NO: 795505 - DNA, 25 bp, Mus musculus
tgaaggcaaatttccttacccaacg

SEQ ID NO: 795506 - DNA, 25 bp, Mus musculus
tgaaggcaatagacccaaatgaatg

SEQ ID NO: 795507 - DNA, 25 bp, Mus musculus
tgaaggcaatagtcccaaatgaatg

SEQ ID NO: 795508 - DNA, 25 bp, Mus musculus
tgaaggcaccaacggccatggcact

SEQ ID NO: 795509 - DNA, 25 bp, Mus musculus
tgaaggcaccaagggccatggcact

SEQ ID NO: 795510 - DNA, 25 bp, Mus musculus
tgaaggcactgaacgtggagccaga

SEQ ID NO: 795511 - DNA, 25 bp, Mus musculus
tgaaggcactgatcgtggagccaga

SEQ ID NO: 795512 - DNA, 25 bp, Mus musculus
tgaaggcactgccttggctggacct

SEQ ID NO: 795513 - DNA, 25 bp, Mus musculus
tgaaggcactgcgttggctggacct

SEQ ID NO: 795514 - DNA, 25 bp, Mus musculus
tgaaggcagcagactctacaaacac

SEQ ID NO: 795515 - DNA, 25 bp, Mus musculus
tgaaggcagcagtctctacaaacac

SEQ ID NO: 795516 - DNA, 25 bp, Mus musculus
tgaaggcagtttacctatgggaggc

SEQ ID NO: 795517 - DNA, 25 bp, Mus musculus
tgaaggcagttttcctatgggaggc

SEQ ID NO: 795518 - DNA, 25 bp, Mus musculus
tgaaggcatctgctgcattatcgct

SEQ ID NO: 795519 - DNA, 25 bp, Mus musculus
tgaaggcatctggtgcattatcgct

SEQ ID NO: 795520 - DNA, 25 bp, Mus musculus
tgaaggcattctctgtgtgattaag

SEQ ID NO: 795521 - DNA, 25 bp, Mus musculus
tgaaggcattctgtgtgtgattaag

SEQ ID NO: 795522 - DNA, 25 bp, Mus musculus
tgaaggcatttgaactgagaaactc

SEQ ID NO: 795523 - DNA, 25 bp, Mus musculus
tgaaggcatttgtactgagaaactc

SEQ ID NO: 795524 - DNA, 25 bp, Mus musculus
tgaaggccaagacggtcaggctacc

SEQ ID NO: 795525 - DNA, 25 bp, Mus musculus
tgaaggccaagagggtcaggctacc

SEQ ID NO: 795526 - DNA, 25 bp, Mus musculus
tgaaggccaagtactacaatgaccc

SEQ ID NO: 795527 - DNA, 25 bp, Mus musculus
tgaaggccaagttctacaatgaccc

SEQ ID NO: 795528 - DNA, 25 bp, Mus musculus
tgaaggccacatacggccccagcag

SEQ ID NO: 795529 - DNA, 25 bp, Mus musculus
tgaaggccacattcggccccagcag

SEQ ID NO: 795530 - DNA, 25 bp, Mus musculus
tgaaggcccacccgaatataagaaa

SEQ ID NO: 795531 - DNA, 25 bp, Mus musculus
tgaaggcccaccggaatataagaaa

SEQ ID NO: 795532 - DNA, 25 bp, Mus musculus
tgaaggccccggcactctcaacata

SEQ ID NO: 795533 - DNA, 25 bp, Mus musculus
tgaaggccccgggactctcaacata

SEQ ID NO: 795534 - DNA, 25 bp, Mus musculus
tgaaggccctctacacagtcggcta

SEQ ID NO: 795535 - DNA, 25 bp, Mus musculus
tgaaggccctcttcacagtcggcta

SEQ ID NO: 795536 - DNA, 25 bp, Mus musculus
tgaaggcctggacgtcggtcctcca

SEQ ID NO: 795537 - DNA, 25 bp, Mus musculus
tgaaggcctggaggtcggtcctcca

SEQ ID NO: 795538 - DNA, 25 bp, Mus musculus
tgaaggcgactaactggatgactgg

SEQ ID NO: 795539 - DNA, 25 bp, Mus musculus
tgaaggcgactatctggatgactgg

SEQ ID NO: 795540 - DNA, 25 bp, Mus musculus
tgaaggcgcactagagctgctggca

SEQ ID NO: 795541 - DNA, 25 bp, Mus musculus
tgaaggcgcacttgagctgctggca

SEQ ID NO: 795542 - DNA, 25 bp, Mus musculus
tgaaggcgcatgactggccatcgat

SEQ ID NO: 795543 - DNA, 25 bp, Mus musculus
tgaaggcgcatgtctggccatcgat

SEQ ID NO: 795544 - DNA, 25 bp, Mus musculus
tgaaggcgcctaagatttaccccac

SEQ ID NO: 795545 - DNA, 25 bp, Mus musculus
tgaaggcgcctatgatttaccccac

SEQ ID NO: 795546 - DNA, 25 bp, Mus musculus
tgaaggcgtacacactgactcctaa

SEQ ID NO: 795547 - DNA, 25 bp, Mus musculus
tgaaggcgtacagactgactcctaa

SEQ ID NO: 795548 - DNA, 25 bp, Mus musculus
tgaaggcgtagccatcatgtccgac

SEQ ID NO: 795549 - DNA, 25 bp, Mus musculus
tgaaggcgtagcgatcatgtccgac

SEQ ID NO: 795550 - DNA, 25 bp, Mus musculus
tgaaggctaaagatcagcaggctgc

SEQ ID NO: 795551 - DNA, 25 bp, Mus musculus
tgaaggctaaagttcagcaggctgc

SEQ ID NO: 795552 - DNA, 25 bp, Mus musculus
tgaaggctaaccagaggaaaaactt

SEQ ID NO: 795553 - DNA, 25 bp, Mus musculus
tgaaggctaacctgaggaaaaactt

SEQ ID NO: 795554 - DNA, 25 bp, Mus musculus
tgaaggctacggacagaccgagtgc

SEQ ID NO: 795555 - DNA, 25 bp, Mus musculus
tgaaggctacggtcagaccgagtgc

SEQ ID NO: 795556 - DNA, 25 bp, Mus musculus
tgaaggctatggaccaggagatcac

SEQ ID NO: 795557 - DNA, 25 bp, Mus musculus
tgaaggctatggtccaggagatcac

SEQ ID NO: 795558 - DNA, 25 bp, Mus musculus
tgaaggctcccaagattctgaatgg

SEQ ID NO: 795559 - DNA, 25 bp, Mus musculus
tgaaggctcccatgattctgaatgg

SEQ ID NO: 795560 - DNA, 25 bp, Mus musculus
tgaaggctcggcacgtctgctccgt

SEQ ID NO: 795561 - DNA, 25 bp, Mus musculus
tgaaggctcggctcgtctgctccgt

SEQ ID NO: 795562 - DNA, 25 bp, Mus musculus
tgaaggctctgtaagaccaagaagg

SEQ ID NO: 795563 - DNA, 25 bp, Mus musculus
tgaaggctctgtcgaagcatcagtt

SEQ ID NO: 795564 - DNA, 25 bp, Mus musculus
tgaaggctctgtggaagcatcagtt

SEQ ID NO: 795565 - DNA, 25 bp, Mus musculus
tgaaggctctgttagaccaagaagg

SEQ ID NO: 795566 - DNA, 25 bp, Mus musculus
tgaaggctgactacgaggcagagca

SEQ ID NO: 795567 - DNA, 25 bp, Mus musculus
tgaaggctgacttcgaggcagagca

SEQ ID NO: 795568 - DNA, 25 bp, Mus musculus
tgaaggctgcatagcccttcgcttg

SEQ ID NO: 795569 - DNA, 25 bp, Mus musculus
tgaaggctgcattgcccttcgcttg

SEQ ID NO: 795570 - DNA, 25 bp, Mus musculus
tgaaggctggcaagggcctgaccat

SEQ ID NO: 795571 - DNA, 25 bp, Mus musculus
tgaaggctggcatgggcctgaccat

SEQ ID NO: 795572 - DNA, 25 bp, Mus musculus
tgaaggctggctatgtcggaggcca

SEQ ID NO: 795573 - DNA, 25 bp, Mus musculus
tgaaggctggctttgtcggaggcca

SEQ ID NO: 795574 - DNA, 25 bp, Mus musculus
tgaaggctgggtacctttggaaaca

SEQ ID NO: 795575 - DNA, 25 bp, Mus musculus
tgaaggctgggttcctttggaaaca

SEQ ID NO: 795576 - DNA, 25 bp, Mus musculus
tgaaggctgtacagctcctacacag

SEQ ID NO: 795577 - DNA, 25 bp, Mus musculus
tgaaggctgtactgctcctacacag

SEQ ID NO: 795578 - DNA, 25 bp, Mus musculus
tgaaggcttaatcccaagcaactat

SEQ ID NO: 795579 - DNA, 25 bp, Mus musculus
tgaaggcttaatgccaagcaactat

SEQ ID NO: 795580 - DNA, 25 bp, Mus musculus
tgaaggcttagacaagaagtcatgc

SEQ ID NO: 795581 - DNA, 25 bp, Mus musculus
tgaaggcttagagaagaagtcatgc

SEQ ID NO: 795582 - DNA, 25 bp, Mus musculus
tgaaggcttgtaactcgctacggtg

SEQ ID NO: 795583 - DNA, 25 bp, Mus musculus
tgaaggcttgtatctcgctacggtg

SEQ ID NO: 795584 - DNA, 25 bp, Mus musculus
tgaaggcttttaccaggctccatct

SEQ ID NO: 795585 - DNA, 25 bp, Mus musculus
tgaaggcttttagcaggctccatct

SEQ ID NO: 795586 - DNA, 25 bp, Mus musculus
tgaagggacctgaacagatggaaga

SEQ ID NO: 795587 - DNA, 25 bp, Mus musculus
tgaagggacctgtacagatggaaga

SEQ ID NO: 795588 - DNA, 25 bp, Mus musculus
tgaagggagactcggcaagactctt

SEQ ID NO: 795589 - DNA, 25 bp, Mus musculus
tgaagggagactgggcaagactctt

SEQ ID NO: 795590 - DNA, 25 bp, Mus musculus
tgaagggagatacttctgccagctc

SEQ ID NO: 795591 - DNA, 25 bp, Mus musculus
tgaagggagatagttctgccagctc

SEQ ID NO: 795592 - DNA, 25 bp, Mus musculus
tgaagggatattcacttttgtagac

SEQ ID NO: 795593 - DNA, 25 bp, Mus musculus
tgaagggatattgacttttgtagac

SEQ ID NO: 795594 - DNA, 25 bp, Mus musculus
tgaagggatcgtagaagattataac

SEQ ID NO: 795595 - DNA, 25 bp, Mus musculus
tgaagggatcgttgaagattataac

SEQ ID NO: 795596 - DNA, 25 bp, Mus musculus
tgaagggcacgacagcctggtggac

SEQ ID NO: 795597 - DNA, 25 bp, Mus musculus
tgaagggcacgagagcctggtggac

SEQ ID NO: 795598 - DNA, 25 bp, Mus musculus
tgaagggcagagagtgacttttgac

SEQ ID NO: 795599 - DNA, 25 bp, Mus musculus
tgaagggcagagtgtgacttttgac

SEQ ID NO: 795600 - DNA, 25 bp, Mus musculus
tgaagggccagaagcggaaggtgaa

SEQ ID NO: 795601 - DNA, 25 bp, Mus musculus
tgaagggccagatgcggaaggtgaa

SEQ ID NO: 795602 - DNA, 25 bp, Mus musculus
tgaagggcctccctcagaggtcgtc

SEQ ID NO: 795603 - DNA, 25 bp, Mus musculus
tgaagggcctccgtcagaggtcgtc

SEQ ID NO: 795604 - DNA, 25 bp, Mus musculus
tgaagggcctggagttaggcccaat

SEQ ID NO: 795605 - DNA, 25 bp, Mus musculus
tgaagggcctggtgttaggcccaat

SEQ ID NO: 795606 - DNA, 25 bp, Mus musculus
tgaagggcttcaactaccagttact

SEQ ID NO: 795607 - DNA, 25 bp, Mus musculus
tgaagggcttcatctaccagttact

SEQ ID NO: 795608 - DNA, 25 bp, Mus musculus
tgaaggggcagacctcagatacctg

SEQ ID NO: 795609 - DNA, 25 bp, Mus musculus
tgaaggggcagagctcagatacctg

SEQ ID NO: 795610 - DNA, 25 bp, Mus musculus
tgaagggtaaggagtccaacaagaa

SEQ ID NO: 795611 - DNA, 25 bp, Mus musculus
tgaagggtaaggtgtccaacaagaa

SEQ ID NO: 795612 - DNA, 25 bp, Mus musculus
tgaagggtgcgaccccacaatagtg

SEQ ID NO: 795613 - DNA, 25 bp, Mus musculus
tgaagggtgcgagcccacaatagtg

SEQ ID NO: 795614 - DNA, 25 bp, Mus musculus
tgaagggttccaagacgccatcctc

SEQ ID NO: 795615 - DNA, 25 bp, Mus musculus
tgaagggttccatgacgccatcctc

SEQ ID NO: 795616 - DNA, 25 bp, Mus musculus
tgaagggttgccacatttacctcgg

SEQ ID NO: 795617 - DNA, 25 bp, Mus musculus
tgaagggttgcctcatttacctcgg

SEQ ID NO: 795618 - DNA, 25 bp, Mus musculus
tgaaggtaaacgaggccctgaattc

SEQ ID NO: 795619 - DNA, 25 bp, Mus musculus
tgaaggtaaacgtggccctgaattc

SEQ ID NO: 795620 - DNA, 25 bp, Mus musculus
tgaaggtacccaagaacacagtgga

SEQ ID NO: 795621 - DNA, 25 bp, Mus musculus
tgaaggtacccatgaacacagtgga

SEQ ID NO: 795622 - DNA, 25 bp, Mus musculus
tgaaggtactctctggtatatgccc

SEQ ID NO: 795623 - DNA, 25 bp, Mus musculus
tgaaggtactctgtggtatatgccc

SEQ ID NO: 795624 - DNA, 25 bp, Mus musculus
tgaaggtcttcacggtgcctcccag

SEQ ID NO: 795625 - DNA, 25 bp, Mus musculus
tgaaggtcttcagggtgcctcccag

SEQ ID NO: 795626 - DNA, 25 bp, Mus musculus
tgaaggtcttccagtactgttctcc

SEQ ID NO: 795627 - DNA, 25 bp, Mus musculus
tgaaggtcttcctgtactgttctcc

SEQ ID NO: 795628 - DNA, 25 bp, Mus musculus
tgaaggtcttctcccaaataaatat

SEQ ID NO: 795629 - DNA, 25 bp, Mus musculus
tgaaggtcttctgccaaataaatat

SEQ ID NO: 795630 - DNA, 25 bp, Mus musculus
tgaaggtgaagacttcaaacatcca

SEQ ID NO: 795631 - DNA, 25 bp, Mus musculus
tgaaggtgaagagttcaaacatcca

SEQ ID NO: 795632 - DNA, 25 bp, Mus musculus
tgaaggtgacagcgcagaaccaaga

SEQ ID NO: 795633 - DNA, 25 bp, Mus musculus
tgaaggtgacagggcagaaccaaga

SEQ ID NO: 795634 - DNA, 25 bp, Mus musculus
tgaaggtgccaaccagtgtggcccc

SEQ ID NO: 795635 - DNA, 25 bp, Mus musculus
tgaaggtgccaacctcaattcatcc

SEQ ID NO: 795636 - DNA, 25 bp, Mus musculus
tgaaggtgccaagcagtgtggcccc

SEQ ID NO: 795637 - DNA, 25 bp, Mus musculus
tgaaggtgccaagctcaattcatcc

SEQ ID NO: 795638 - DNA, 25 bp, Mus musculus
tgaaggtgcttaactcttttaaagc

SEQ ID NO: 795639 - DNA, 25 bp, Mus musculus
tgaaggtgcttatctcttttaaagc

SEQ ID NO: 795640 - DNA, 25 bp, Mus musculus
tgaaggtggaggaagaccctttgtc

SEQ ID NO: 795641 - DNA, 25 bp, Mus musculus
tgaaggtggaggtagaccctttgtc

SEQ ID NO: 795642 - DNA, 25 bp, Mus musculus
tgaaggtgtcagaagcgggctacta

SEQ ID NO: 795643 - DNA, 25 bp, Mus musculus
tgaaggtgtcagtagcgggctacta

SEQ ID NO: 795644 - DNA, 25 bp, Mus musculus
tgaaggttcagaaccacagccagtc

SEQ ID NO: 795645 - DNA, 25 bp, Mus musculus
tgaaggttcagatccacagccagtc

SEQ ID NO: 795646 - DNA, 25 bp, Mus musculus
tgaaggttcagtcattccagatgaa

SEQ ID NO: 795647 - DNA, 25 bp, Mus musculus
tgaaggttcagtgattccagatgaa

SEQ ID NO: 795648 - DNA, 25 bp, Mus musculus
tgaagtaaattccatgtcaacaagc

SEQ ID NO: 795649 - DNA, 25 bp, Mus musculus
tgaagtaaattcgatgtcaacaagc

SEQ ID NO: 795650 - DNA, 25 bp, Mus musculus
tgaagtaacgccagtagaacttcct

SEQ ID NO: 795651 - DNA, 25 bp, Mus musculus
tgaagtaacgcctgtagaacttcct

SEQ ID NO: 795652 - DNA, 25 bp, Mus musculus
tgaagtaagtccctgtgtcattggg

SEQ ID NO: 795653 - DNA, 25 bp, Mus musculus
tgaagtaagtccgtgtgtcattggg

SEQ ID NO: 795654 - DNA, 25 bp, Mus musculus
tgaagtaattcaatggttggccaaa

SEQ ID NO: 795655 - DNA, 25 bp, Mus musculus
tgaagtaattcattggttggccaaa

SEQ ID NO: 795656 - DNA, 25 bp, Mus musculus
tgaagtacaactagccgtcctggtg

SEQ ID NO: 795657 - DNA, 25 bp, Mus musculus
tgaagtacaacttgccgtcctggtg

SEQ ID NO: 795658 - DNA, 25 bp, Mus musculus
tgaagtacaagtcaaaaacggaggc

SEQ ID NO: 795659 - DNA, 25 bp, Mus musculus
tgaagtacaagtgaaaaacggaggc

SEQ ID NO: 795660 - DNA, 25 bp, Mus musculus
tgaagtacaattagttcctgaaagt

SEQ ID NO: 795661 - DNA, 25 bp, Mus musculus
tgaagtacaatttgttcctgaaagt

SEQ ID NO: 795662 - DNA, 25 bp, Mus musculus
tgaagtacagctcggctgtcatcac

SEQ ID NO: 795663 - DNA, 25 bp, Mus musculus
tgaagtacagctgggctgtcatcac

SEQ ID NO: 795664 - DNA, 25 bp, Mus musculus
tgaagtacagtcagtgtcgcttagc

SEQ ID NO: 795665 - DNA, 25 bp, Mus musculus
tgaagtacagtctgtgtcgcttagc

SEQ ID NO: 795666 - DNA, 25 bp, Mus musculus
tgaagtacccgtaccatgacagtac

SEQ ID NO: 795667 - DNA, 25 bp, Mus musculus
tgaagtacccgttccatgacagtac

SEQ ID NO: 795668 - DNA, 25 bp, Mus musculus
tgaagtacgaggacgccatccagtt

SEQ ID NO: 795669 - DNA, 25 bp, Mus musculus
tgaagtacgaggtcgccatccagtt

SEQ ID NO: 795670 - DNA, 25 bp, Mus musculus
tgaagtacgtccaccctcggagcca

SEQ ID NO: 795671 - DNA, 25 bp, Mus musculus
tgaagtacgtcctccctcggagcca

SEQ ID NO: 795672 - DNA, 25 bp, Mus musculus
tgaagtagaacacccgtcactgctg

SEQ ID NO: 795673 - DNA, 25 bp, Mus musculus
tgaagtagaacagccgtcactgctg

SEQ ID NO: 795674 - DNA, 25 bp, Mus musculus
tgaagtagacaacaatttcagcaaa

SEQ ID NO: 795675 - DNA, 25 bp, Mus musculus
tgaagtagacaagaatttcagcaaa

SEQ ID NO: 795676 - DNA, 25 bp, Mus musculus
tgaagtagcaggagggtacagtatt

SEQ ID NO: 795677 - DNA, 25 bp, Mus musculus
tgaagtagcaggtgggtacagtatt

SEQ ID NO: 795678 - DNA, 25 bp, Mus musculus
tgaagtaggctaagatgacatcggt

SEQ ID NO: 795679 - DNA, 25 bp, Mus musculus
tgaagtaggctatgatgacatcggt

SEQ ID NO: 795680 - DNA, 25 bp, Mus musculus
tgaagtatcaggcaggaaacctcat

SEQ ID NO: 795681 - DNA, 25 bp, Mus musculus
tgaagtatcagggaggaaacctcat

SEQ ID NO: 795682 - DNA, 25 bp, Mus musculus
tgaagtcaacggacgtgctgagcag

SEQ ID NO: 795683 - DNA, 25 bp, Mus musculus
tgaagtcaacggtcgtgctgagcag

SEQ ID NO: 795684 - DNA, 25 bp, Mus musculus
tgaagtcaatgcagtcaggccaggg

SEQ ID NO: 795685 - DNA, 25 bp, Mus musculus
tgaagtcaatgcattcttggacaac

SEQ ID NO: 795686 - DNA, 25 bp, Mus musculus
tgaagtcaatgctgtcaggccaggg

SEQ ID NO: 795687 - DNA, 25 bp, Mus musculus
tgaagtcaatgctttcttggacaac

SEQ ID NO: 795688 - DNA, 25 bp, Mus musculus
tgaagtcacatcaagcatcctgtct

SEQ ID NO: 795689 - DNA, 25 bp, Mus musculus
tgaagtcacatctagcatcctgtct

SEQ ID NO: 795690 - DNA, 25 bp, Mus musculus
tgaagtcacgctcgagtggttctca

SEQ ID NO: 795691 - DNA, 25 bp, Mus musculus
tgaagtcacgctggagtggttctca

SEQ ID NO: 795692 - DNA, 25 bp, Mus musculus
tgaagtcagagtccctgggcattcc

SEQ ID NO: 795693 - DNA, 25 bp, Mus musculus
tgaagtcagagtgcctgggcattcc

SEQ ID NO: 795694 - DNA, 25 bp, Mus musculus
tgaagtcagcgtcgatggacacacg

SEQ ID NO: 795695 - DNA, 25 bp, Mus musculus
tgaagtcagcgtggatggacacacg

SEQ ID NO: 795696 - DNA, 25 bp, Mus musculus
tgaagtcaggatacataggcttgac

SEQ ID NO: 795697 - DNA, 25 bp, Mus musculus
tgaagtcaggattcataggcttgac

SEQ ID NO: 795698 - DNA, 25 bp, Mus musculus
tgaagtcattaccatccttggagag

SEQ ID NO: 795699 - DNA, 25 bp, Mus musculus
tgaagtcattacgatccttggagag

SEQ ID NO: 795700 - DNA, 25 bp, Mus musculus
tgaagtcattgtcccagtttagaag

SEQ ID NO: 795701 - DNA, 25 bp, Mus musculus
tgaagtcattgtgccagtttagaag

SEQ ID NO: 795702 - DNA, 25 bp, Mus musculus
tgaagtccaagactaagtctaagac

SEQ ID NO: 795703 - DNA, 25 bp, Mus musculus
tgaagtccaagagtaagtctaagac

SEQ ID NO: 795704 - DNA, 25 bp, Mus musculus
tgaagtccataccaggacctgccga

SEQ ID NO: 795705 - DNA, 25 bp, Mus musculus
tgaagtccatacgaggacctgccga

SEQ ID NO: 795706 - DNA, 25 bp, Mus musculus
tgaagtccctacagggtctggctca

SEQ ID NO: 795707 - DNA, 25 bp, Mus musculus
tgaagtccctactgggtctggctca

SEQ ID NO: 795708 - DNA, 25 bp, Mus musculus
tgaagtccgagtaacaccaaccagg

SEQ ID NO: 795709 - DNA, 25 bp, Mus musculus
tgaagtccgagttacaccaaccagg

SEQ ID NO: 795710 - DNA, 25 bp, Mus musculus
tgaagtccgtaaacagatgttgcct

SEQ ID NO: 795711 - DNA, 25 bp, Mus musculus
tgaagtccgtaatcagatgttgcct

SEQ ID NO: 795712 - DNA, 25 bp, Mus musculus
tgaagtccgtgcagcgctgcatcgc

SEQ ID NO: 795713 - DNA, 25 bp, Mus musculus
tgaagtccgtgctgcgctgcatcgc

SEQ ID NO: 795714 - DNA, 25 bp, Mus musculus
tgaagtcctgtcaagaaaaatgcct

SEQ ID NO: 795715 - DNA, 25 bp, Mus musculus
tgaagtcctgtctagaaaaatgcct

SEQ ID NO: 795716 - DNA, 25 bp, Mus musculus
tgaagtcgaaggacagatcacatcc

SEQ ID NO: 795717 - DNA, 25 bp, Mus musculus
tgaagtcgaaggtcagatcacatcc

SEQ ID NO: 795718 - DNA, 25 bp, Mus musculus
tgaagtcgagcaaaatggtggtctt

SEQ ID NO: 795719 - DNA, 25 bp, Mus musculus
tgaagtcgagcataatggtggtctt

SEQ ID NO: 795720 - DNA, 25 bp, Mus musculus
tgaagtcgtggcatcgggatgtcct

SEQ ID NO: 795721 - DNA, 25 bp, Mus musculus
tgaagtcgtggcttcgggatgtcct

SEQ ID NO: 795722 - DNA, 25 bp, Mus musculus
tgaagtctacatctccctgcttcct

SEQ ID NO: 795723 - DNA, 25 bp, Mus musculus
tgaagtctacatgtccctgcttcct

SEQ ID NO: 795724 - DNA, 25 bp, Mus musculus
tgaagtctcagtaagctcggaagga

SEQ ID NO: 795725 - DNA, 25 bp, Mus musculus
tgaagtctcagttagctcggaagga

SEQ ID NO: 795726 - DNA, 25 bp, Mus musculus
tgaagtctcggtccattacgatccc

SEQ ID NO: 795727 - DNA, 25 bp, Mus musculus
tgaagtctcggtgcattacgatccc

SEQ ID NO: 795728 - DNA, 25 bp, Mus musculus
tgaagtctctctccgccaagcatgg

SEQ ID NO: 795729 - DNA, 25 bp, Mus musculus
tgaagtctctctgcgccaagcatgg

SEQ ID NO: 795730 - DNA, 25 bp, Mus musculus
tgaagtctgataaaatacgttaatc

SEQ ID NO: 795731 - DNA, 25 bp, Mus musculus
tgaagtctgatataatacgttaatc

SEQ ID NO: 795732 - DNA, 25 bp, Mus musculus
tgaagtctgcaaataaaacagtagg

SEQ ID NO: 795733 - DNA, 25 bp, Mus musculus
tgaagtctgcaattaaaacagtagg

SEQ ID NO: 795734 - DNA, 25 bp, Mus musculus
tgaagtctgctgcagtaaaacactg

SEQ ID NO: 795735 - DNA, 25 bp, Mus musculus
tgaagtctgctggagtaaaacactg

SEQ ID NO: 795736 - DNA, 25 bp, Mus musculus
tgaagtctggacacaagggccttgc

SEQ ID NO: 795737 - DNA, 25 bp, Mus musculus
tgaagtctggactcaagggccttgc

SEQ ID NO: 795738 - DNA, 25 bp, Mus musculus
tgaagtgaagttctcacctattcac

SEQ ID NO: 795739 - DNA, 25 bp, Mus musculus
tgaagtgaagttgtcacctattcac

SEQ ID NO: 795740 - DNA, 25 bp, Mus musculus
tgaagtgactacctacaaagctgtg

SEQ ID NO: 795741 - DNA, 25 bp, Mus musculus
tgaagtgactacgtacaaagctgtg

SEQ ID NO: 795742 - DNA, 25 bp, Mus musculus
tgaagtgatcaacttcatgcgcact

SEQ ID NO: 795743 - DNA, 25 bp, Mus musculus
tgaagtgatcaagttcatgcgcact

SEQ ID NO: 795744 - DNA, 25 bp, Mus musculus
tgaagtgattcacaacatgactgag

SEQ ID NO: 795745 - DNA, 25 bp, Mus musculus
tgaagtgattcagaacatgactgag

SEQ ID NO: 795746 - DNA, 25 bp, Mus musculus
tgaagtgcattccagtcctctcaag

SEQ ID NO: 795747 - DNA, 25 bp, Mus musculus
tgaagtgcattcgagtcctctcaag

SEQ ID NO: 795748 - DNA, 25 bp, Mus musculus
tgaagtgccagaagctgaccgacga

SEQ ID NO: 795749 - DNA, 25 bp, Mus musculus
tgaagtgccagatgctgaccgacga

SEQ ID NO: 795750 - DNA, 25 bp, Mus musculus
tgaagtgccatcagtatgacgggct

SEQ ID NO: 795751 - DNA, 25 bp, Mus musculus
tgaagtgccatctgtatgacgggct

SEQ ID NO: 795752 - DNA, 25 bp, Mus musculus
tgaagtgcctgtaaaagagtcactg

SEQ ID NO: 795753 - DNA, 25 bp, Mus musculus
tgaagtgcctgttaaagagtcactg

SEQ ID NO: 795754 - DNA, 25 bp, Mus musculus
tgaagtgcggccacctgccggtctc

SEQ ID NO: 795755 - DNA, 25 bp, Mus musculus
tgaagtgcggcctcctgccggtctc

SEQ ID NO: 795756 - DNA, 25 bp, Mus musculus
tgaagtgctaaaacagttaacagaa

SEQ ID NO: 795757 - DNA, 25 bp, Mus musculus
tgaagtgctaaatcagttaacagaa

SEQ ID NO: 795758 - DNA, 25 bp, Mus musculus
tgaagtgctctgaagtctgtagagg

SEQ ID NO: 795759 - DNA, 25 bp, Mus musculus
tgaagtgctctgtagtctgtagagg

SEQ ID NO: 795760 - DNA, 25 bp, Mus musculus
tgaagtggaagaagccgtgctagaa

SEQ ID NO: 795761 - DNA, 25 bp, Mus musculus
tgaagtggaagatgccgtgctagaa

SEQ ID NO: 795762 - DNA, 25 bp, Mus musculus
tgaagtggacctaggtaaaaagtgc

SEQ ID NO: 795763 - DNA, 25 bp, Mus musculus
tgaagtggaccttggtaaaaagtgc

SEQ ID NO: 795764 - DNA, 25 bp, Mus musculus
tgaagtggcagtctatgacaaggat

SEQ ID NO: 795765 - DNA, 25 bp, Mus musculus
tgaagtggcagtgtatgacaaggat

SEQ ID NO: 795766 - DNA, 25 bp, Mus musculus
tgaagtggccaaatttgctgcatat

SEQ ID NO: 795767 - DNA, 25 bp, Mus musculus
tgaagtggccaattttgctgcatat

SEQ ID NO: 795768 - DNA, 25 bp, Mus musculus
tgaagtggtattagggaacatcatt

SEQ ID NO: 795769 - DNA, 25 bp, Mus musculus
tgaagtggtatttgggaacatcatt

SEQ ID NO: 795770 - DNA, 25 bp, Mus musculus
tgaagtgtaactccaaatacgacgg

SEQ ID NO: 795771 - DNA, 25 bp, Mus musculus
tgaagtgtaactgcaaatacgacgg

SEQ ID NO: 795772 - DNA, 25 bp, Mus musculus
tgaagtgtggctctgccagccctcc

SEQ ID NO: 795773 - DNA, 25 bp, Mus musculus
tgaagtgtggctgtgccagccctcc

SEQ ID NO: 795774 - DNA, 25 bp, Mus musculus
tgaagttaaaaccaaaacgaatgat

SEQ ID NO: 795775 - DNA, 25 bp, Mus musculus
tgaagttaaaacgaaaacgaatgat

SEQ ID NO: 795776 - DNA, 25 bp, Mus musculus
tgaagttaaaagagaggggctcccg

SEQ ID NO: 795777 - DNA, 25 bp, Mus musculus
tgaagttaaaagtgaggggctcccg

SEQ ID NO: 795778 - DNA, 25 bp, Mus musculus
tgaagttatggtaatccacctgcct

SEQ ID NO: 795779 - DNA, 25 bp, Mus musculus
tgaagttatggttatccacctgcct

SEQ ID NO: 795780 - DNA, 25 bp, Mus musculus
tgaagttattcacgaaattgggtac

SEQ ID NO: 795781 - DNA, 25 bp, Mus musculus
tgaagttattcaggaaattgggtac

SEQ ID NO: 795782 - DNA, 25 bp, Mus musculus
tgaagttcaaaaacctggaggaggt

SEQ ID NO: 795783 - DNA, 25 bp, Mus musculus
tgaagttcaaaatcctggaggaggt

SEQ ID NO: 795784 - DNA, 25 bp, Mus musculus
tgaagttcccatcattatcacagat

SEQ ID NO: 795785 - DNA, 25 bp, Mus musculus
tgaagttcccatgattatcacagat

SEQ ID NO: 795786 - DNA, 25 bp, Mus musculus
tgaagttccgttcgagcaaatccag

SEQ ID NO: 795787 - DNA, 25 bp, Mus musculus
tgaagttccgttggagcaaatccag

SEQ ID NO: 795788 - DNA, 25 bp, Mus musculus
tgaagttcctaaagcaatgttctct

SEQ ID NO: 795789 - DNA, 25 bp, Mus musculus
tgaagttcctaatgcaatgttctct

SEQ ID NO: 795790 - DNA, 25 bp, Mus musculus
tgaagttcctacagaattctcgggt

SEQ ID NO: 795791 - DNA, 25 bp, Mus musculus
tgaagttcctactgaattctcgggt

SEQ ID NO: 795792 - DNA, 25 bp, Mus musculus
tgaagttcctccagcaactgactgc

SEQ ID NO: 795793 - DNA, 25 bp, Mus musculus
tgaagttcctcctgcaactgactgc

SEQ ID NO: 795794 - DNA, 25 bp, Mus musculus
tgaagttctatcaatattctcagga

SEQ ID NO: 795795 - DNA, 25 bp, Mus musculus
tgaagttctatctatattctcagga

SEQ ID NO: 795796 - DNA, 25 bp, Mus musculus
tgaagttctctcagaaggttcttcc

SEQ ID NO: 795797 - DNA, 25 bp, Mus musculus
tgaagttctctctgaaggttcttcc

SEQ ID NO: 795798 - DNA, 25 bp, Mus musculus
tgaagttgaaggactaaaacgctta

SEQ ID NO: 795799 - DNA, 25 bp, Mus musculus
tgaagttgaaggtctaaaacgctta

SEQ ID NO: 795800 - DNA, 25 bp, Mus musculus
tgaagttgcagaagaacctcccaca

SEQ ID NO: 795801 - DNA, 25 bp, Mus musculus
tgaagttgcagatgaacctcccaca

SEQ ID NO: 795802 - DNA, 25 bp, Mus musculus
tgaagttgctggacgcctatctcct

SEQ ID NO: 795803 - DNA, 25 bp, Mus musculus
tgaagttgctggtcgcctatctcct

SEQ ID NO: 795804 - DNA, 25 bp, Mus musculus
tgaagttggcccagatcctaaccag

SEQ ID NO: 795805 - DNA, 25 bp, Mus musculus
tgaagttggccctgatcctaaccag

SEQ ID NO: 795806 - DNA, 25 bp, Mus musculus
tgaagttggtccagtacgggacccg

SEQ ID NO: 795807 - DNA, 25 bp, Mus musculus
tgaagttggtcctgtacgggacccg

SEQ ID NO: 795808 - DNA, 25 bp, Mus musculus
tgaagttggtgccaggtgcctatct

SEQ ID NO: 795809 - DNA, 25 bp, Mus musculus
tgaagttggtgcgaggtgcctatct

SEQ ID NO: 795810 - DNA, 25 bp, Mus musculus
tgaagttgtatgagccctgcaggca

SEQ ID NO: 795811 - DNA, 25 bp, Mus musculus
tgaagttgtatgtgccctgcaggca

SEQ ID NO: 795812 - DNA, 25 bp, Mus musculus
tgaagttgtgccaacctcctccgct

SEQ ID NO: 795813 - DNA, 25 bp, Mus musculus
tgaagttgtgcctacctcctccgct

SEQ ID NO: 795814 - DNA, 25 bp, Mus musculus
tgaagttgttcgaagtcattgaaac

SEQ ID NO: 795815 - DNA, 25 bp, Mus musculus
tgaagttgttcgtagtcattgaaac

SEQ ID NO: 795816 - DNA, 25 bp, Mus musculus
tgaagttgttttaattcctgggcga

SEQ ID NO: 795817 - DNA, 25 bp, Mus musculus
tgaagttgtttttattcctgggcga

SEQ ID NO: 795818 - DNA, 25 bp, Mus musculus
tgaagtttcagtcggatctcaatgc

SEQ ID NO: 795819 - DNA, 25 bp, Mus musculus
tgaagtttcagtgggatctcaatgc

SEQ ID NO: 795820 - DNA, 25 bp, Mus musculus
tgaagtttctaccagccagagtgga

SEQ ID NO: 795821 - DNA, 25 bp, Mus musculus
tgaagtttctacgagccagagtgga

SEQ ID NO: 795822 - DNA, 25 bp, Mus musculus
tgaagtttctgcccctggctccatt

SEQ ID NO: 795823 - DNA, 25 bp, Mus musculus
tgaagtttctgcgcctggctccatt

SEQ ID NO: 795824 - DNA, 25 bp, Mus musculus
tgaagtttgaaaacggccaggccct

SEQ ID NO: 795825 - DNA, 25 bp, Mus musculus
tgaagtttgaaatcggccaggccct

SEQ ID NO: 795826 - DNA, 25 bp, Mus musculus
tgaagtttgttaatatgctgctgtc

SEQ ID NO: 795827 - DNA, 25 bp, Mus musculus
tgaagtttgttattatgctgctgtc

SEQ ID NO: 795828 - DNA, 25 bp, Mus musculus
tgaagttttcccactctgtaccaga

SEQ ID NO: 795829 - DNA, 25 bp, Mus musculus
tgaagttttccctctctgtaccaga

SEQ ID NO: 795830 - DNA, 25 bp, Mus musculus
tgaataaagttaaggaattggaaaa

SEQ ID NO: 795831 - DNA, 25 bp, Mus musculus
tgaataaagttatggaattggaaaa

SEQ ID NO: 795832 - DNA, 25 bp, Mus musculus
tgaataaccataccctcatggactc

SEQ ID NO: 795833 - DNA, 25 bp, Mus musculus
tgaataaccatagcctcatggactc

SEQ ID NO: 795834 - DNA, 25 bp, Mus musculus
tgaataacggttccaattgcctctg

SEQ ID NO: 795835 - DNA, 25 bp, Mus musculus
tgaataacggttgcaattgcctctg

SEQ ID NO: 795836 - DNA, 25 bp, Mus musculus
tgaataactgagctgggtccatgga

SEQ ID NO: 795837 - DNA, 25 bp, Mus musculus
tgaataactgaggtgggtccatgga

SEQ ID NO: 795838 - DNA, 25 bp, Mus musculus
tgaataagatttccatggaaggctc

SEQ ID NO: 795839 - DNA, 25 bp, Mus musculus
tgaataagatttgcatggaaggctc

SEQ ID NO: 795840 - DNA, 25 bp, Mus musculus
tgaataagtcagacagccagggctt

SEQ ID NO: 795841 - DNA, 25 bp, Mus musculus
tgaataagtcagtcagccagggctt

SEQ ID NO: 795842 - DNA, 25 bp, Mus musculus
tgaataatccatcagaaaccaataa

SEQ ID NO: 795843 - DNA, 25 bp, Mus musculus
tgaataatccatgagaaaccaataa

SEQ ID NO: 795844 - DNA, 25 bp, Mus musculus
tgaatacaaattagcaactggccag

SEQ ID NO: 795845 - DNA, 25 bp, Mus musculus
tgaatacaaatttgcaactggccag

SEQ ID NO: 795846 - DNA, 25 bp, Mus musculus
tgaatacaaccactcgtacacgtct

SEQ ID NO: 795847 - DNA, 25 bp, Mus musculus
tgaatacaaccagtcgtacacgtct

SEQ ID NO: 795848 - DNA, 25 bp, Mus musculus
tgaatacaatcaacaggaacaggac

SEQ ID NO: 795849 - DNA, 25 bp, Mus musculus
tgaatacaatcatcaggaacaggac

SEQ ID NO: 795850 - DNA, 25 bp, Mus musculus
tgaatacacccacgagcttcggttg

SEQ ID NO: 795851 - DNA, 25 bp, Mus musculus
tgaatacacccaggagcttcggttg

SEQ ID NO: 795852 - DNA, 25 bp, Mus musculus
tgaatacatctgcacccaacagaat

SEQ ID NO: 795853 - DNA, 25 bp, Mus musculus
tgaatacatctggacccaacagaat

SEQ ID NO: 795854 - DNA, 25 bp, Mus musculus
tgaatacatggaccacacgtacctc

SEQ ID NO: 795855 - DNA, 25 bp, Mus musculus
tgaatacatggagcacacgtacctc

SEQ ID NO: 795856 - DNA, 25 bp, Mus musculus
tgaataccatcgagagaacagcagt

SEQ ID NO: 795857 - DNA, 25 bp, Mus musculus
tgaataccatcgtgagaacagcagt

SEQ ID NO: 795858 - DNA, 25 bp, Mus musculus
tgaatacccagaagagctccagtgt

SEQ ID NO: 795859 - DNA, 25 bp, Mus musculus
tgaatacccagatgagctccagtgt

SEQ ID NO: 795860 - DNA, 25 bp, Mus musculus
tgaataccgggtctgccagctgccg

SEQ ID NO: 795861 - DNA, 25 bp, Mus musculus
tgaataccgggtgtgccagctgccg

SEQ ID NO: 795862 - DNA, 25 bp, Mus musculus
tgaataccgtggctgtcaaagcact

SEQ ID NO: 795863 - DNA, 25 bp, Mus musculus
tgaataccgtgggtgtcaaagcact

SEQ ID NO: 795864 - DNA, 25 bp, Mus musculus
tgaatacctcatcatgctcatgccg

SEQ ID NO: 795865 - DNA, 25 bp, Mus musculus
tgaatacctcatgatgctcatgccg

SEQ ID NO: 795866 - DNA, 25 bp, Mus musculus
tgaatacctctacaaacaagagaac

SEQ ID NO: 795867 - DNA, 25 bp, Mus musculus
tgaatacctctagaaacaagagaac

SEQ ID NO: 795868 - DNA, 25 bp, Mus musculus
tgaataccttaactacaacaaaggg

SEQ ID NO: 795869 - DNA, 25 bp, Mus musculus
tgaataccttaagtacaacaaaggg

SEQ ID NO: 795870 - DNA, 25 bp, Mus musculus
tgaataccttctacttgaagcacat

SEQ ID NO: 795871 - DNA, 25 bp, Mus musculus
tgaataccttcttcttgaagcacat

SEQ ID NO: 795872 - DNA, 25 bp, Mus musculus
tgaatacggcaccaaaacattttgg

SEQ ID NO: 795873 - DNA, 25 bp, Mus musculus
tgaatacggcacgaaaacattttgg

SEQ ID NO: 795874 - DNA, 25 bp, Mus musculus
tgaatactccttctattctgatgag

SEQ ID NO: 795875 - DNA, 25 bp, Mus musculus
tgaatactccttgtattctgatgag

SEQ ID NO: 795876 - DNA, 25 bp, Mus musculus
tgaatactgagcacgactctggtga

SEQ ID NO: 795877 - DNA, 25 bp, Mus musculus
tgaatactgagctcgactctggtga

SEQ ID NO: 795878 - DNA, 25 bp, Mus musculus
tgaatacttggtaggcctagggaaa

SEQ ID NO: 795879 - DNA, 25 bp, Mus musculus
tgaatacttggttggcctagggaaa

SEQ ID NO: 795880 - DNA, 25 bp, Mus musculus
tgaatagaatgcatagccaggcact

SEQ ID NO: 795881 - DNA, 25 bp, Mus musculus
tgaatagaatgcttagccaggcact

SEQ ID NO: 795882 - DNA, 25 bp, Mus musculus
tgaatagactgacccagctggaaag

SEQ ID NO: 795883 - DNA, 25 bp, Mus musculus
tgaatagactgagccagctggaaag

SEQ ID NO: 795884 - DNA, 25 bp, Mus musculus
tgaatagccttccagacatcgtgga

SEQ ID NO: 795885 - DNA, 25 bp, Mus musculus
tgaatagccttcgagacatcgtgga

SEQ ID NO: 795886 - DNA, 25 bp, Mus musculus
tgaatagctgctccctgcggcctga

SEQ ID NO: 795887 - DNA, 25 bp, Mus musculus
tgaatagctgctcgttgccctgact

SEQ ID NO: 795888 - DNA, 25 bp, Mus musculus
tgaatagctgctgcctgcggcctga

SEQ ID NO: 795889 - DNA, 25 bp, Mus musculus
tgaatagctgctggttgccctgact

SEQ ID NO: 795890 - DNA, 25 bp, Mus musculus
tgaatagggcttaaggagatgtctc

SEQ ID NO: 795891 - DNA, 25 bp, Mus musculus
tgaatagggctttaggagatgtctc

SEQ ID NO: 795892 - DNA, 25 bp, Mus musculus
tgaatagtaatcacacaggctacga

SEQ ID NO: 795893 - DNA, 25 bp, Mus musculus
tgaatagtaatctcacaggctacga

SEQ ID NO: 795894 - DNA, 25 bp, Mus musculus
tgaatagttcacaagtgcgcttcct

SEQ ID NO: 795895 - DNA, 25 bp, Mus musculus
tgaatagttcactagtgcgcttcct

SEQ ID NO: 795896 - DNA, 25 bp, Mus musculus
tgaatataggaaccactgacatagt

SEQ ID NO: 795897 - DNA, 25 bp, Mus musculus
tgaatataggaagcactgacatagt

SEQ ID NO: 795898 - DNA, 25 bp, Mus musculus
tgaatatcatgcaggtggctctacg

SEQ ID NO: 795899 - DNA, 25 bp, Mus musculus
tgaatatcatgctggtggctctacg

SEQ ID NO: 795900 - DNA, 25 bp, Mus musculus
tgaatatcattcctccaggaggagg

SEQ ID NO: 795901 - DNA, 25 bp, Mus musculus
tgaatatcattcgtccaggaggagg

SEQ ID NO: 795902 - DNA, 25 bp, Mus musculus
tgaatatccaggaagtatctctaga

SEQ ID NO: 795903 - DNA, 25 bp, Mus musculus
tgaatatccaggtagtatctctaga

SEQ ID NO: 795904 - DNA, 25 bp, Mus musculus
tgaatatcctcaatatcttgaaaag

SEQ ID NO: 795905 - DNA, 25 bp, Mus musculus
tgaatatcctcattatcttgaaaag

SEQ ID NO: 795906 - DNA, 25 bp, Mus musculus
tgaatatcgatacaagaagtcttaa

SEQ ID NO: 795907 - DNA, 25 bp, Mus musculus
tgaatatcgatagaagaagtcttaa

SEQ ID NO: 795908 - DNA, 25 bp, Mus musculus
tgaatatgactcacgggtgaaggcc

SEQ ID NO: 795909 - DNA, 25 bp, Mus musculus
tgaatatgactctcgggtgaaggcc

SEQ ID NO: 795910 - DNA, 25 bp, Mus musculus
tgaatatgagagcaacgggagatat

SEQ ID NO: 795911 - DNA, 25 bp, Mus musculus
tgaatatgagaggaacgggagatat

SEQ ID NO: 795912 - DNA, 25 bp, Mus musculus
tgaatatgccagcaccaccccggaa

SEQ ID NO: 795913 - DNA, 25 bp, Mus musculus
tgaatatgccaggaccaccccggaa

SEQ ID NO: 795914 - DNA, 25 bp, Mus musculus
tgaatatgtagtcattgctcagcct

SEQ ID NO: 795915 - DNA, 25 bp, Mus musculus
tgaatatgtagtgattgctcagcct

SEQ ID NO: 795916 - DNA, 25 bp, Mus musculus
tgaatattgacaacccacagtcctg

SEQ ID NO: 795917 - DNA, 25 bp, Mus musculus
tgaatattgacatcccacagtcctg

SEQ ID NO: 795918 - DNA, 25 bp, Mus musculus
tgaatatttgatcgcacacctggct

SEQ ID NO: 795919 - DNA, 25 bp, Mus musculus
tgaatatttgatggcacacctggct

SEQ ID NO: 795920 - DNA, 25 bp, Mus musculus
tgaatcaacaaacagggaggccacc

SEQ ID NO: 795921 - DNA, 25 bp, Mus musculus
tgaatcaacaaagagggaggccacc

SEQ ID NO: 795922 - DNA, 25 bp, Mus musculus
tgaatcaagcatccattcaagtgga

SEQ ID NO: 795923 - DNA, 25 bp, Mus musculus
tgaatcaagcatgcattcaagtgga

SEQ ID NO: 795924 - DNA, 25 bp, Mus musculus
tgaatcacttatacactgctcccag

SEQ ID NO: 795925 - DNA, 25 bp, Mus musculus
tgaatcacttattcactgctcccag

SEQ ID NO: 795926 - DNA, 25 bp, Mus musculus
tgaatcagacacaggaggctgtgtt

SEQ ID NO: 795927 - DNA, 25 bp, Mus musculus
tgaatcagacactggaggctgtgtt

SEQ ID NO: 795928 - DNA, 25 bp, Mus musculus
tgaatcagaccacacagtaccaagt

SEQ ID NO: 795929 - DNA, 25 bp, Mus musculus
tgaatcagaccagacagtaccaagt

SEQ ID NO: 795930 - DNA, 25 bp, Mus musculus
tgaatcagcacacaggagacctcga

SEQ ID NO: 795931 - DNA, 25 bp, Mus musculus
tgaatcagcacagaggagacctcga

SEQ ID NO: 795932 - DNA, 25 bp, Mus musculus
tgaatcaggctcaggttcacactga

SEQ ID NO: 795933 - DNA, 25 bp, Mus musculus
tgaatcaggctctggttcacactga

SEQ ID NO: 795934 - DNA, 25 bp, Mus musculus
tgaatcatatttaacacagcggtct

SEQ ID NO: 795935 - DNA, 25 bp, Mus musculus
tgaatcatattttacacagcggtct

SEQ ID NO: 795936 - DNA, 25 bp, Mus musculus
tgaatcattgagcatccaagtcatg

SEQ ID NO: 795937 - DNA, 25 bp, Mus musculus
tgaatcattgaggatccaagtcatg

SEQ ID NO: 795938 - DNA, 25 bp, Mus musculus
tgaatccaataacggaggagtgacc

SEQ ID NO: 795939 - DNA, 25 bp, Mus musculus
tgaatccaataagggaggagtgacc

SEQ ID NO: 795940 - DNA, 25 bp, Mus musculus
tgaatccacagaccagccggacaac

SEQ ID NO: 795941 - DNA, 25 bp, Mus musculus
tgaatccacagagcagccggacaac

SEQ ID NO: 795942 - DNA, 25 bp, Mus musculus
tgaatccagaaaccctatgatgcct

SEQ ID NO: 795943 - DNA, 25 bp, Mus musculus
tgaatccagaaagcctatgatgcct

SEQ ID NO: 795944 - DNA, 25 bp, Mus musculus
tgaatccagtgcacagtacaaagct

SEQ ID NO: 795945 - DNA, 25 bp, Mus musculus
tgaatccagtgctcagtacaaagct

SEQ ID NO: 795946 - DNA, 25 bp, Mus musculus
tgaatccatcatagcagctgcatgt

SEQ ID NO: 795947 - DNA, 25 bp, Mus musculus
tgaatccatcattgcagctgcatgt

SEQ ID NO: 795948 - DNA, 25 bp, Mus musculus
tgaatccatgagagagtcatactct

SEQ ID NO: 795949 - DNA, 25 bp, Mus musculus
tgaatccatgagtgagtcatactct

SEQ ID NO: 795950 - DNA, 25 bp, Mus musculus
tgaatcccagagaaacaaaccgcac

SEQ ID NO: 795951 - DNA, 25 bp, Mus musculus
tgaatcccagagtaacaaaccgcac

SEQ ID NO: 795952 - DNA, 25 bp, Mus musculus
tgaatcccaggtacagtaacgccca

SEQ ID NO: 795953 - DNA, 25 bp, Mus musculus
tgaatcccaggttcagtaacgccca

SEQ ID NO: 795954 - DNA, 25 bp, Mus musculus
tgaatcccagttcatccacaaacgg

SEQ ID NO: 795955 - DNA, 25 bp, Mus musculus
tgaatcccagttgatccacaaacgg

SEQ ID NO: 795956 - DNA, 25 bp, Mus musculus
tgaatcccatcaacctgccactgtg

SEQ ID NO: 795957 - DNA, 25 bp, Mus musculus
tgaatcccatcatcctgccactgtg

SEQ ID NO: 795958 - DNA, 25 bp, Mus musculus
tgaatcccgagaccatccacatgta

SEQ ID NO: 795959 - DNA, 25 bp, Mus musculus
tgaatcccgagagcatccacatgta

SEQ ID NO: 795960 - DNA, 25 bp, Mus musculus
tgaatcccgccactgacaagaggtg

SEQ ID NO: 795961 - DNA, 25 bp, Mus musculus
tgaatcccgccagtgacaagaggtg

SEQ ID NO: 795962 - DNA, 25 bp, Mus musculus
tgaatcccgtgtagcttttgtgagg

SEQ ID NO: 795963 - DNA, 25 bp, Mus musculus
tgaatcccgtgttgcttttgtgagg

SEQ ID NO: 795964 - DNA, 25 bp, Mus musculus
tgaatccctacacgctggctatggc

SEQ ID NO: 795965 - DNA, 25 bp, Mus musculus
tgaatccctacaggctggctatggc

SEQ ID NO: 795966 - DNA, 25 bp, Mus musculus
tgaatccctcggcatgacggttgct

SEQ ID NO: 795967 - DNA, 25 bp, Mus musculus
tgaatccctcgggatgacggttgct

SEQ ID NO: 795968 - DNA, 25 bp, Mus musculus
tgaatccctgcaagtggtggactgc

SEQ ID NO: 795969 - DNA, 25 bp, Mus musculus
tgaatccctgcatgtggtggactgc

SEQ ID NO: 795970 - DNA, 25 bp, Mus musculus
tgaatcccttcaccatgcaggagga

SEQ ID NO: 795971 - DNA, 25 bp, Mus musculus
tgaatcccttcagcatgcaggagga

SEQ ID NO: 795972 - DNA, 25 bp, Mus musculus
tgaatccgggaacagcactattgtc

SEQ ID NO: 795973 - DNA, 25 bp, Mus musculus
tgaatccgggaagagcactattgtc

SEQ ID NO: 795974 - DNA, 25 bp, Mus musculus
tgaatcctaaaacaaacctttgcca

SEQ ID NO: 795975 - DNA, 25 bp, Mus musculus
tgaatcctaaaagaaacctttgcca

SEQ ID NO: 795976 - DNA, 25 bp, Mus musculus
tgaatcctaagtagctcagcctgga

SEQ ID NO: 795977 - DNA, 25 bp, Mus musculus
tgaatcctaagttgctcagcctgga

SEQ ID NO: 795978 - DNA, 25 bp, Mus musculus
tgaatcctccagaaggaatcgtggc

SEQ ID NO: 795979 - DNA, 25 bp, Mus musculus
tgaatcctccagtaggaatcgtggc

SEQ ID NO: 795980 - DNA, 25 bp, Mus musculus
tgaatccttacaaccaggtgacaag

SEQ ID NO: 795981 - DNA, 25 bp, Mus musculus
tgaatccttacatccaggtgacaag

SEQ ID NO: 795982 - DNA, 25 bp, Mus musculus
tgaatccttcaaacgcgctgacatc

SEQ ID NO: 795983 - DNA, 25 bp, Mus musculus
tgaatccttcaatcgcgctgacatc

SEQ ID NO: 795984 - DNA, 25 bp, Mus musculus
tgaatccttccacgacggacagggc

SEQ ID NO: 795985 - DNA, 25 bp, Mus musculus
tgaatccttccaggacggacagggc

SEQ ID NO: 795986 - DNA, 25 bp, Mus musculus
tgaatccttttcatagagcttgtgc

SEQ ID NO: 795987 - DNA, 25 bp, Mus musculus
tgaatccttttcttagagcttgtgc

SEQ ID NO: 795988 - DNA, 25 bp, Mus musculus
tgaatcgcaccgcatacactgtggg

SEQ ID NO: 795989 - DNA, 25 bp, Mus musculus
tgaatcgcaccggatacactgtggg

SEQ ID NO: 795990 - DNA, 25 bp, Mus musculus
tgaatcgcttcaaggcctaagccac

SEQ ID NO: 795991 - DNA, 25 bp, Mus musculus
tgaatcgcttcatggcctaagccac

SEQ ID NO: 795992 - DNA, 25 bp, Mus musculus
tgaatcggcactctacagccattgg

SEQ ID NO: 795993 - DNA, 25 bp, Mus musculus
tgaatcggcactgtacagccattgg

SEQ ID NO: 795994 - DNA, 25 bp, Mus musculus
tgaatcggccgacacaatgtatgac

SEQ ID NO: 795995 - DNA, 25 bp, Mus musculus
tgaatcggccgagacaatgtatgac

SEQ ID NO: 795996 - DNA, 25 bp, Mus musculus
tgaatcgggtacaactgggcggcct

SEQ ID NO: 795997 - DNA, 25 bp, Mus musculus
tgaatcgggtactactgggcggcct

SEQ ID NO: 795998 - DNA, 25 bp, Mus musculus
tgaatcgtgtcaccccttaccggga

SEQ ID NO: 795999 - DNA, 25 bp, Mus musculus
tgaatcgtgtcagcccttaccggga

SEQ ID NO: 796000 - DNA, 25 bp, Mus musculus
tgaatctaccacacctgtcagggag

SEQ ID NO: 796001 - DNA, 25 bp, Mus musculus
tgaatctaccactcctgtcagggag

SEQ ID NO: 796002 - DNA, 25 bp, Mus musculus
tgaatctactggcaaggcacctctg

SEQ ID NO: 796003 - DNA, 25 bp, Mus musculus
tgaatctactgggaaggcacctctg

SEQ ID NO: 796004 - DNA, 25 bp, Mus musculus
tgaatctatgatagccgggcaggcc

SEQ ID NO: 796005 - DNA, 25 bp, Mus musculus
tgaatctatgattgccgggcaggcc

SEQ ID NO: 796006 - DNA, 25 bp, Mus musculus
tgaatctcacggactggagggccag

SEQ ID NO: 796007 - DNA, 25 bp, Mus musculus
tgaatctcacggtctggagggccag

SEQ ID NO: 796008 - DNA, 25 bp, Mus musculus
tgaatctccgagagctgaacgctgt

SEQ ID NO: 796009 - DNA, 25 bp, Mus musculus
tgaatctccgagtgctgaacgctgt

SEQ ID NO: 796010 - DNA, 25 bp, Mus musculus
tgaatctctacaataagaacttgga

SEQ ID NO: 796011 - DNA, 25 bp, Mus musculus
tgaatctctacattaagaacttgga

SEQ ID NO: 796012 - DNA, 25 bp, Mus musculus
tgaatctgaggaagaacagcggcct

SEQ ID NO: 796013 - DNA, 25 bp, Mus musculus
tgaatctgaggatgaacagcggcct

SEQ ID NO: 796014 - DNA, 25 bp, Mus musculus
tgaatctgaggtcgcatgtgcttgc

SEQ ID NO: 796015 - DNA, 25 bp, Mus musculus
tgaatctgaggtggcatgtgcttgc

SEQ ID NO: 796016 - DNA, 25 bp, Mus musculus
tgaatctgcagtatttgatcgggtc

SEQ ID NO: 796017 - DNA, 25 bp, Mus musculus
tgaatctgcagtttttgatcgggtc

SEQ ID NO: 796018 - DNA, 25 bp, Mus musculus
tgaatctgctgaccgagtacatcga

SEQ ID NO: 796019 - DNA, 25 bp, Mus musculus
tgaatctgctgagcgagtacatcga

SEQ ID NO: 796020 - DNA, 25 bp, Mus musculus
tgaatctggaacagcttctgcctgt

SEQ ID NO: 796021 - DNA, 25 bp, Mus musculus
tgaatctggaactgcttctgcctgt

SEQ ID NO: 796022 - DNA, 25 bp, Mus musculus
tgaatctgtgaaatttgtcactcag

SEQ ID NO: 796023 - DNA, 25 bp, Mus musculus
tgaatctgtgaattttgtcactcag

SEQ ID NO: 796024 - DNA, 25 bp, Mus musculus
tgaatctgtggaaactcaggttttc

SEQ ID NO: 796025 - DNA, 25 bp, Mus musculus
tgaatctgtggatactcaggttttc

SEQ ID NO: 796026 - DNA, 25 bp, Mus musculus
tgaatcttccgcaagggtagaaaaa

SEQ ID NO: 796027 - DNA, 25 bp, Mus musculus
tgaatcttccgctagggtagaaaaa

SEQ ID NO: 796028 - DNA, 25 bp, Mus musculus
tgaatctttctaaaggcagcatcct

SEQ ID NO: 796029 - DNA, 25 bp, Mus musculus
tgaatctttctataggcagcatcct

SEQ ID NO: 796030 - DNA, 25 bp, Mus musculus
tgaatgaaagtcacacagacaccgc

SEQ ID NO: 796031 - DNA, 25 bp, Mus musculus
tgaatgaaagtctcacagacaccgc

SEQ ID NO: 796032 - DNA, 25 bp, Mus musculus
tgaatgaacctgaaagcaaagaccg

SEQ ID NO: 796033 - DNA, 25 bp, Mus musculus
tgaatgaacctgtaagcaaagaccg

SEQ ID NO: 796034 - DNA, 25 bp, Mus musculus
tgaatgaactgtcgaaagtaacggg

SEQ ID NO: 796035 - DNA, 25 bp, Mus musculus
tgaatgaactgtggaaagtaacggg

SEQ ID NO: 796036 - DNA, 25 bp, Mus musculus
tgaatgaagaggactgcagactgaa

SEQ ID NO: 796037 - DNA, 25 bp, Mus musculus
tgaatgaagaggtctgcagactgaa

SEQ ID NO: 796038 - DNA, 25 bp, Mus musculus
tgaatgaaggatcacagctacgcac

SEQ ID NO: 796039 - DNA, 25 bp, Mus musculus
tgaatgaaggatgacagctacgcac

SEQ ID NO: 796040 - DNA, 25 bp, Mus musculus
tgaatgaatttgagaagtggcagga

SEQ ID NO: 796041 - DNA, 25 bp, Mus musculus
tgaatgaatttgtgaagtggcagga

SEQ ID NO: 796042 - DNA, 25 bp, Mus musculus
tgaatgacaaatcgcagggtttgtg

SEQ ID NO: 796043 - DNA, 25 bp, Mus musculus
tgaatgacaaatggcagggtttgtg

SEQ ID NO: 796044 - DNA, 25 bp, Mus musculus
tgaatgacaaccagcccacgttcac

SEQ ID NO: 796045 - DNA, 25 bp, Mus musculus
tgaatgacaacctgcccacgttcac

SEQ ID NO: 796046 - DNA, 25 bp, Mus musculus
tgaatgacaccaaaagccctcctca

SEQ ID NO: 796047 - DNA, 25 bp, Mus musculus
tgaatgacaccaagcgaggagatgc

SEQ ID NO: 796048 - DNA, 25 bp, Mus musculus
tgaatgacaccataagccctcctca

SEQ ID NO: 796049 - DNA, 25 bp, Mus musculus
tgaatgacaccatgcgaggagatgc

SEQ ID NO: 796050 - DNA, 25 bp, Mus musculus
tgaatgacagcacagctctgtggtg

SEQ ID NO: 796051 - DNA, 25 bp, Mus musculus
tgaatgacagcagagctctgtggtg

SEQ ID NO: 796052 - DNA, 25 bp, Mus musculus
tgaatgacgagaacgtgcagcaggt

SEQ ID NO: 796053 - DNA, 25 bp, Mus musculus
tgaatgacgagatcgtgcagcaggt

SEQ ID NO: 796054 - DNA, 25 bp, Mus musculus
tgaatgagatgtcggccatcctgcg

SEQ ID NO: 796055 - DNA, 25 bp, Mus musculus
tgaatgagatgtgggccatcctgcg

SEQ ID NO: 796056 - DNA, 25 bp, Mus musculus
tgaatgagcaaaacccagaggcgca

SEQ ID NO: 796057 - DNA, 25 bp, Mus musculus
tgaatgagcaaatcccagaggcgca

SEQ ID NO: 796058 - DNA, 25 bp, Mus musculus
tgaatgagcgagacttgaacaggct

SEQ ID NO: 796059 - DNA, 25 bp, Mus musculus
tgaatgagcgagtcttgaacaggct

SEQ ID NO: 796060 - DNA, 25 bp, Mus musculus
tgaatgagctcaactaacaggaagc

SEQ ID NO: 796061 - DNA, 25 bp, Mus musculus
tgaatgagctcatctaacaggaagc

SEQ ID NO: 796062 - DNA, 25 bp, Mus musculus
tgaatgagctcgagtccctgacatg

SEQ ID NO: 796063 - DNA, 25 bp, Mus musculus
tgaatgagctcgtgtccctgacatg

SEQ ID NO: 796064 - DNA, 25 bp, Mus musculus
tgaatgaggaaacggccagtcttct

SEQ ID NO: 796065 - DNA, 25 bp, Mus musculus
tgaatgaggaaagggccagtcttct

SEQ ID NO: 796066 - DNA, 25 bp, Mus musculus
tgaatgaggattaaaaacttgggcc

SEQ ID NO: 796067 - DNA, 25 bp, Mus musculus
tgaatgaggatttaaaacttgggcc

SEQ ID NO: 796068 - DNA, 25 bp, Mus musculus
tgaatgagggtgacaacttgcggct

SEQ ID NO: 796069 - DNA, 25 bp, Mus musculus
tgaatgagggtgtcaacttgcggct

SEQ ID NO: 796070 - DNA, 25 bp, Mus musculus
tgaatgaggtgaacatagacatagc

SEQ ID NO: 796071 - DNA, 25 bp, Mus musculus
tgaatgaggtgatcatagacatagc

SEQ ID NO: 796072 - DNA, 25 bp, Mus musculus
tgaatgaggttcagaacagattgca

SEQ ID NO: 796073 - DNA, 25 bp, Mus musculus
tgaatgaggttctgaacagattgca

SEQ ID NO: 796074 - DNA, 25 bp, Mus musculus
tgaatgatctggagcgcattgcaca

SEQ ID NO: 796075 - DNA, 25 bp, Mus musculus
tgaatgatctggtgcgcattgcaca

SEQ ID NO: 796076 - DNA, 25 bp, Mus musculus
tgaatgatcttcacaaaggcggtcc

SEQ ID NO: 796077 - DNA, 25 bp, Mus musculus
tgaatgatcttctcaaaggcggtcc

SEQ ID NO: 796078 - DNA, 25 bp, Mus musculus
tgaatgatgtatcccaagccaaagc

SEQ ID NO: 796079 - DNA, 25 bp, Mus musculus
tgaatgatgtatgccaagccaaagc

SEQ ID NO: 796080 - DNA, 25 bp, Mus musculus
tgaatgatgtccaccctaacagccc

SEQ ID NO: 796081 - DNA, 25 bp, Mus musculus
tgaatgatgtcctccctaacagccc

SEQ ID NO: 796082 - DNA, 25 bp, Mus musculus
tgaatgatgtcgaggagttgaccac

SEQ ID NO: 796083 - DNA, 25 bp, Mus musculus
tgaatgatgtcgtggagttgaccac

SEQ ID NO: 796084 - DNA, 25 bp, Mus musculus
tgaatgattgatacagaactgaact

SEQ ID NO: 796085 - DNA, 25 bp, Mus musculus
tgaatgattgattcagaactgaact

SEQ ID NO: 796086 - DNA, 25 bp, Mus musculus
tgaatgcaaagaaatggcgggaacc

SEQ ID NO: 796087 - DNA, 25 bp, Mus musculus
tgaatgcaaagatatggcgggaacc

SEQ ID NO: 796088 - DNA, 25 bp, Mus musculus
tgaatgcagagcctgcggctttcta

SEQ ID NO: 796089 - DNA, 25 bp, Mus musculus
tgaatgcagagcgtgcggctttcta

SEQ ID NO: 796090 - DNA, 25 bp, Mus musculus
tgaatgcagagtctctctgggagac

SEQ ID NO: 796091 - DNA, 25 bp, Mus musculus
tgaatgcagagtgtctctgggagac

SEQ ID NO: 796092 - DNA, 25 bp, Mus musculus
tgaatgcagcacctatgtgggctct

SEQ ID NO: 796093 - DNA, 25 bp, Mus musculus
tgaatgcagcacgtatgtgggctct

SEQ ID NO: 796094 - DNA, 25 bp, Mus musculus
tgaatgcagcccagatgcacacgct

SEQ ID NO: 796095 - DNA, 25 bp, Mus musculus
tgaatgcagccctgatgcacacgct

SEQ ID NO: 796096 - DNA, 25 bp, Mus musculus
tgaatgcaggtcatgccagtgactg

SEQ ID NO: 796097 - DNA, 25 bp, Mus musculus
tgaatgcaggtcttgccagtgactg

SEQ ID NO: 796098 - DNA, 25 bp, Mus musculus
tgaatgcatacacccaagttcaaat

SEQ ID NO: 796099 - DNA, 25 bp, Mus musculus
tgaatgcatacagccaagttcaaat

SEQ ID NO: 796100 - DNA, 25 bp, Mus musculus
tgaatgccacctacatccgagaagt

SEQ ID NO: 796101 - DNA, 25 bp, Mus musculus
tgaatgccaccttcatccgagaagt

SEQ ID NO: 796102 - DNA, 25 bp, Mus musculus
tgaatgccagctcgatcgctgtcca

SEQ ID NO: 796103 - DNA, 25 bp, Mus musculus
tgaatgccagctggatcgctgtcca

SEQ ID NO: 796104 - DNA, 25 bp, Mus musculus
tgaatgccagtgacacacagatttc

SEQ ID NO: 796105 - DNA, 25 bp, Mus musculus
tgaatgccagtgtcacacagatttc

SEQ ID NO: 796106 - DNA, 25 bp, Mus musculus
tgaatgcccagacactagacgggag

SEQ ID NO: 796107 - DNA, 25 bp, Mus musculus
tgaatgcccagagactagacgggag

SEQ ID NO: 796108 - DNA, 25 bp, Mus musculus
tgaatgcccaggaatcagccaagag

SEQ ID NO: 796109 - DNA, 25 bp, Mus musculus
tgaatgcccaggtatcagccaagag

SEQ ID NO: 796110 - DNA, 25 bp, Mus musculus
tgaatgccgcaaactatacaagtat

SEQ ID NO: 796111 - DNA, 25 bp, Mus musculus
tgaatgccgcaatctatacaagtat

SEQ ID NO: 796112 - DNA, 25 bp, Mus musculus
tgaatgccgcagagactttcaccaa

SEQ ID NO: 796113 - DNA, 25 bp, Mus musculus
tgaatgccgcagtgactttcaccaa

SEQ ID NO: 796114 - DNA, 25 bp, Mus musculus
tgaatgccgtgcagactgtggtccg

SEQ ID NO: 796115 - DNA, 25 bp, Mus musculus
tgaatgccgtgctgactgtggtccg

SEQ ID NO: 796116 - DNA, 25 bp, Mus musculus
tgaatgcctcctcaagtatcagctc

SEQ ID NO: 796117 - DNA, 25 bp, Mus musculus
tgaatgcctcctgaagtatcagctc

SEQ ID NO: 796118 - DNA, 25 bp, Mus musculus
tgaatgccttccctaggaagcatga

SEQ ID NO: 796119 - DNA, 25 bp, Mus musculus
tgaatgccttccgtaggaagcatga

SEQ ID NO: 796120 - DNA, 25 bp, Mus musculus
tgaatgccttggaatcacatagtcc

SEQ ID NO: 796121 - DNA, 25 bp, Mus musculus
tgaatgccttggtatcacatagtcc

SEQ ID NO: 796122 - DNA, 25 bp, Mus musculus
tgaatgcgattcaaatggaaaccat

SEQ ID NO: 796123 - DNA, 25 bp, Mus musculus
tgaatgcgattctaatggaaaccat

SEQ ID NO: 796124 - DNA, 25 bp, Mus musculus
tgaatgcgcaagaacttcagagtga

SEQ ID NO: 796125 - DNA, 25 bp, Mus musculus
tgaatgcgcaagtacttcagagtga

SEQ ID NO: 796126 - DNA, 25 bp, Mus musculus
tgaatgcggagtacatcatgctgaa

SEQ ID NO: 796127 - DNA, 25 bp, Mus musculus
tgaatgcggagttcatcatgctgaa

SEQ ID NO: 796128 - DNA, 25 bp, Mus musculus
tgaatgctaatacaagacgccaaga

SEQ ID NO: 796129 - DNA, 25 bp, Mus musculus
tgaatgctaatagaagacgccaaga

SEQ ID NO: 796130 - DNA, 25 bp, Mus musculus
tgaatgctacagaaagccggagctg

SEQ ID NO: 796131 - DNA, 25 bp, Mus musculus
tgaatgctacagtaagccggagctg

SEQ ID NO: 796132 - DNA, 25 bp, Mus musculus
tgaatgctacctaccatttcactag

SEQ ID NO: 796133 - DNA, 25 bp, Mus musculus
tgaatgctaccttccatttcactag

SEQ ID NO: 796134 - DNA, 25 bp, Mus musculus
tgaatgctacttctgtacagaagag

SEQ ID NO: 796135 - DNA, 25 bp, Mus musculus
tgaatgctacttgtgtacagaagag

SEQ ID NO: 796136 - DNA, 25 bp, Mus musculus
tgaatgctatcaacaacagtggccc

SEQ ID NO: 796137 - DNA, 25 bp, Mus musculus
tgaatgctatcatcaacagtggccc

SEQ ID NO: 796138 - DNA, 25 bp, Mus musculus
tgaatgctctgacgctgacctgtcc

SEQ ID NO: 796139 - DNA, 25 bp, Mus musculus
tgaatgctctgaggctgacctgtcc

SEQ ID NO: 796140 - DNA, 25 bp, Mus musculus
tgaatgctcttaaccatagtcacag

SEQ ID NO: 796141 - DNA, 25 bp, Mus musculus
tgaatgctcttatccatagtcacag

SEQ ID NO: 796142 - DNA, 25 bp, Mus musculus
tgaatgctgacgagggagagccagg

SEQ ID NO: 796143 - DNA, 25 bp, Mus musculus
tgaatgctgacgtgggagagccagg

SEQ ID NO: 796144 - DNA, 25 bp, Mus musculus
tgaatgctgcatctctggtccggga

SEQ ID NO: 796145 - DNA, 25 bp, Mus musculus
tgaatgctgcatgtctggtccggga

SEQ ID NO: 796146 - DNA, 25 bp, Mus musculus
tgaatgctgctgaccgcgctgtggt

SEQ ID NO: 796147 - DNA, 25 bp, Mus musculus
tgaatgctgctgtccgcgctgtggt

SEQ ID NO: 796148 - DNA, 25 bp, Mus musculus
tgaatggaacctacctgtgaagaga

SEQ ID NO: 796149 - DNA, 25 bp, Mus musculus
tgaatggaaccttcctgtgaagaga

SEQ ID NO: 796150 - DNA, 25 bp, Mus musculus
tgaatggacgcaatgtgggctccaa

SEQ ID NO: 796151 - DNA, 25 bp, Mus musculus
tgaatggacgcattgtgggctccaa

SEQ ID NO: 796152 - DNA, 25 bp, Mus musculus
tgaatggaggcaaaccagtcaacaa

SEQ ID NO: 796153 - DNA, 25 bp, Mus musculus
tgaatggaggcataccagtcaacaa

SEQ ID NO: 796154 - DNA, 25 bp, Mus musculus
tgaatggattctctaacaactactg

SEQ ID NO: 796155 - DNA, 25 bp, Mus musculus
tgaatggattctgtaacaactactg

SEQ ID NO: 796156 - DNA, 25 bp, Mus musculus
tgaatggcaagtacacggctgacgg

SEQ ID NO: 796157 - DNA, 25 bp, Mus musculus
tgaatggcaagttcacggctgacgg

SEQ ID NO: 796158 - DNA, 25 bp, Mus musculus
tgaatggcaccacggtgtcctctcc

SEQ ID NO: 796159 - DNA, 25 bp, Mus musculus
tgaatggcaccagggtgtcctctcc

SEQ ID NO: 796160 - DNA, 25 bp, Mus musculus
tgaatggcagaaaacagggttccag

SEQ ID NO: 796161 - DNA, 25 bp, Mus musculus
tgaatggcagaatacagggttccag

SEQ ID NO: 796162 - DNA, 25 bp, Mus musculus
tgaatggcttctatatccccaaggg

SEQ ID NO: 796163 - DNA, 25 bp, Mus musculus
tgaatggcttctttatccccaaggg

SEQ ID NO: 796164 - DNA, 25 bp, Mus musculus
tgaatgggaacaaagaatcggagcc

SEQ ID NO: 796165 - DNA, 25 bp, Mus musculus
tgaatgggaacatagaatcggagcc

SEQ ID NO: 796166 - DNA, 25 bp, Mus musculus
tgaatgggaagaatgctagagaatt

SEQ ID NO: 796167 - DNA, 25 bp, Mus musculus
tgaatgggaagattgctagagaatt

SEQ ID NO: 796168 - DNA, 25 bp, Mus musculus
tgaatgggaaggagctcaatggaaa

SEQ ID NO: 796169 - DNA, 25 bp, Mus musculus
tgaatgggaaggtgctcaatggaaa

SEQ ID NO: 796170 - DNA, 25 bp, Mus musculus
tgaatgggatttccgcccaggttct

SEQ ID NO: 796171 - DNA, 25 bp, Mus musculus
tgaatgggatttgcgcccaggttct

SEQ ID NO: 796172 - DNA, 25 bp, Mus musculus
tgaatgggtctcagatgacatctct

SEQ ID NO: 796173 - DNA, 25 bp, Mus musculus
tgaatgggtctctgatgacatctct

SEQ ID NO: 796174 - DNA, 25 bp, Mus musculus
tgaatggtaggtaggtagccgttcc

SEQ ID NO: 796175 - DNA, 25 bp, Mus musculus
tgaatggtaggttggtagccgttcc

SEQ ID NO: 796176 - DNA, 25 bp, Mus musculus
tgaatggtgtcgaggacaggatgtc

SEQ ID NO: 796177 - DNA, 25 bp, Mus musculus
tgaatggtgtcgtggacaggatgtc

SEQ ID NO: 796178 - DNA, 25 bp, Mus musculus
tgaatgtaaaataccaaggctgagt

SEQ ID NO: 796179 - DNA, 25 bp, Mus musculus
tgaatgtaaaattccaaggctgagt

SEQ ID NO: 796180 - DNA, 25 bp, Mus musculus
tgaatgtaactgagccatgatgtca

SEQ ID NO: 796181 - DNA, 25 bp, Mus musculus
tgaatgtaactgtgccatgatgtca

SEQ ID NO: 796182 - DNA, 25 bp, Mus musculus
tgaatgtacccaccctcttgagagg

SEQ ID NO: 796183 - DNA, 25 bp, Mus musculus
tgaatgtacccagcctcttgagagg

SEQ ID NO: 796184 - DNA, 25 bp, Mus musculus
tgaatgtagaatcggtgagcacaca

SEQ ID NO: 796185 - DNA, 25 bp, Mus musculus
tgaatgtagaatgggtgagcacaca

SEQ ID NO: 796186 - DNA, 25 bp, Mus musculus
tgaatgtagcatcaacaacggcagc

SEQ ID NO: 796187 - DNA, 25 bp, Mus musculus
tgaatgtagcatgaacaacggcagc

SEQ ID NO: 796188 - DNA, 25 bp, Mus musculus
tgaatgtccatgaatgggccctggg

SEQ ID NO: 796189 - DNA, 25 bp, Mus musculus
tgaatgtccatgtatgggccctggg

SEQ ID NO: 796190 - DNA, 25 bp, Mus musculus
tgaatgtccttgagacgccagagct

SEQ ID NO: 796191 - DNA, 25 bp, Mus musculus
tgaatgtccttgtgacgccagagct

SEQ ID NO: 796192 - DNA, 25 bp, Mus musculus
tgaatgtcgtcacctggaccctgct

SEQ ID NO: 796193 - DNA, 25 bp, Mus musculus
tgaatgtcgtcagctggaccctgct

SEQ ID NO: 796194 - DNA, 25 bp, Mus musculus
tgaatgtgacccatgatgcagcaca

SEQ ID NO: 796195 - DNA, 25 bp, Mus musculus
tgaatgtgacccttgatgcagcaca

SEQ ID NO: 796196 - DNA, 25 bp, Mus musculus
tgaatgtgactcagtggacagaact

SEQ ID NO: 796197 - DNA, 25 bp, Mus musculus
tgaatgtgactctgtggacagaact

SEQ ID NO: 796198 - DNA, 25 bp, Mus musculus
tgaatgtgacttccctgcggcctgc

SEQ ID NO: 796199 - DNA, 25 bp, Mus musculus
tgaatgtgacttgcctgcggcctgc

SEQ ID NO: 796200 - DNA, 25 bp, Mus musculus
tgaatgtgagatcaccaaacggagg

SEQ ID NO: 796201 - DNA, 25 bp, Mus musculus
tgaatgtgagatgaccaaacggagg

SEQ ID NO: 796202 - DNA, 25 bp, Mus musculus
tgaatgtgcaccacaaatgccggga

SEQ ID NO: 796203 - DNA, 25 bp, Mus musculus
tgaatgtgcacctcaaatgccggga

SEQ ID NO: 796204 - DNA, 25 bp, Mus musculus
tgaatgtgccaaccccggaaggaca

SEQ ID NO: 796205 - DNA, 25 bp, Mus musculus
tgaatgtgccaagcccggaaggaca

SEQ ID NO: 796206 - DNA, 25 bp, Mus musculus
tgaatgtgccagcaatccctgccaa

SEQ ID NO: 796207 - DNA, 25 bp, Mus musculus
tgaatgtgccaggaatccctgccaa

SEQ ID NO: 796208 - DNA, 25 bp, Mus musculus
tgaatgtgccgaaaatacctacaaa

SEQ ID NO: 796209 - DNA, 25 bp, Mus musculus
tgaatgtgccgataatacctacaaa

SEQ ID NO: 796210 - DNA, 25 bp, Mus musculus
tgaatgtgcgagataaaactatggc

SEQ ID NO: 796211 - DNA, 25 bp, Mus musculus
tgaatgtgcgagttaaaactatggc

SEQ ID NO: 796212 - DNA, 25 bp, Mus musculus
tgaatgtgctacagcagagacagat

SEQ ID NO: 796213 - DNA, 25 bp, Mus musculus
tgaatgtgctactgcagagacagat

SEQ ID NO: 796214 - DNA, 25 bp, Mus musculus
tgaatgtggtggactccgccctgga

SEQ ID NO: 796215 - DNA, 25 bp, Mus musculus
tgaatgtggtggtctccgccctgga

SEQ ID NO: 796216 - DNA, 25 bp, Mus musculus
tgaatgttggtgatccggagtcccc

SEQ ID NO: 796217 - DNA, 25 bp, Mus musculus
tgaatgttggtgttccggagtcccc

SEQ ID NO: 796218 - DNA, 25 bp, Mus musculus
tgaatgttgtgaaggtttaagaaat

SEQ ID NO: 796219 - DNA, 25 bp, Mus musculus
tgaatgttgtgatggtttaagaaat

SEQ ID NO: 796220 - DNA, 25 bp, Mus musculus
tgaatgtttgggatggaagagccat

SEQ ID NO: 796221 - DNA, 25 bp, Mus musculus
tgaatgtttgggttggaagagccat

SEQ ID NO: 796222 - DNA, 25 bp, Mus musculus
tgaattaatatgatccaggagctct

SEQ ID NO: 796223 - DNA, 25 bp, Mus musculus
tgaattaatatgttccaggagctct

SEQ ID NO: 796224 - DNA, 25 bp, Mus musculus
tgaattaccagacggaagagcaaca

SEQ ID NO: 796225 - DNA, 25 bp, Mus musculus
tgaattaccagagggaagagcaaca

SEQ ID NO: 796226 - DNA, 25 bp, Mus musculus
tgaattacctggcatccaagggcga

SEQ ID NO: 796227 - DNA, 25 bp, Mus musculus
tgaattacctgggatccaagggcga

SEQ ID NO: 796228 - DNA, 25 bp, Mus musculus
tgaattagaatccagagacccagtg

SEQ ID NO: 796229 - DNA, 25 bp, Mus musculus
tgaattagaatcgagagacccagtg

SEQ ID NO: 796230 - DNA, 25 bp, Mus musculus
tgaattatataaacaagacagggac

SEQ ID NO: 796231 - DNA, 25 bp, Mus musculus
tgaattatataatcaagacagggac

SEQ ID NO: 796232 - DNA, 25 bp, Mus musculus
tgaattcaactcctggagcccacag

SEQ ID NO: 796233 - DNA, 25 bp, Mus musculus
tgaattcaactcgtggagcccacag

SEQ ID NO: 796234 - DNA, 25 bp, Mus musculus
tgaattcagactacgaactcaccta

SEQ ID NO: 796235 - DNA, 25 bp, Mus musculus
tgaattcagacttcgaactcaccta

SEQ ID NO: 796236 - DNA, 25 bp, Mus musculus
tgaattcaggcgaagctgagtcacg

SEQ ID NO: 796237 - DNA, 25 bp, Mus musculus
tgaattcaggcgtagctgagtcacg

SEQ ID NO: 796238 - DNA, 25 bp, Mus musculus
tgaattcagtgacacgaaggaagca

SEQ ID NO: 796239 - DNA, 25 bp, Mus musculus
tgaattcagtgagacgaaggaagca

SEQ ID NO: 796240 - DNA, 25 bp, Mus musculus
tgaattcatagcagaggccttggag

SEQ ID NO: 796241 - DNA, 25 bp, Mus musculus
tgaattcatagctgaggccttggag

SEQ ID NO: 796242 - DNA, 25 bp, Mus musculus
tgaattcatcacagctacagaggat

SEQ ID NO: 796243 - DNA, 25 bp, Mus musculus
tgaattcatcactgctacagaggat

SEQ ID NO: 796244 - DNA, 25 bp, Mus musculus
tgaattccaagacgtccaccagcgg

SEQ ID NO: 796245 - DNA, 25 bp, Mus musculus
tgaattccaagaggtccaccagcgg

SEQ ID NO: 796246 - DNA, 25 bp, Mus musculus
tgaattccaaggctgaagtaaggtt

SEQ ID NO: 796247 - DNA, 25 bp, Mus musculus
tgaattccaagggtgaagtaaggtt

SEQ ID NO: 796248 - DNA, 25 bp, Mus musculus
tgaattccctacattgtctggactg

SEQ ID NO: 796249 - DNA, 25 bp, Mus musculus
tgaattccctactttgtctggactg

SEQ ID NO: 796250 - DNA, 25 bp, Mus musculus
tgaattccgctgactctcacgagcc

SEQ ID NO: 796251 - DNA, 25 bp, Mus musculus
tgaattccgctgtctctcacgagcc

SEQ ID NO: 796252 - DNA, 25 bp, Mus musculus
tgaattcgccagcaagaatatgcac

SEQ ID NO: 796253 - DNA, 25 bp, Mus musculus
tgaattcgccaggaagaatatgcac

SEQ ID NO: 796254 - DNA, 25 bp, Mus musculus
tgaattcgggccactttgtcttttc

SEQ ID NO: 796255 - DNA, 25 bp, Mus musculus
tgaattcgggcctctttgtcttttc

SEQ ID NO: 796256 - DNA, 25 bp, Mus musculus
tgaattcgtaagcaccctaaatggg

SEQ ID NO: 796257 - DNA, 25 bp, Mus musculus
tgaattcgtaaggaccctaaatggg

SEQ ID NO: 796258 - DNA, 25 bp, Mus musculus
tgaattctcatcaagccttttggct

SEQ ID NO: 796259 - DNA, 25 bp, Mus musculus
tgaattctcatctagccttttggct

SEQ ID NO: 796260 - DNA, 25 bp, Mus musculus
tgaattctgctcacttcctaggcct

SEQ ID NO: 796261 - DNA, 25 bp, Mus musculus
tgaattctgctcatgcctttggaca

SEQ ID NO: 796262 - DNA, 25 bp, Mus musculus
tgaattctgctctcttcctaggcct

SEQ ID NO: 796263 - DNA, 25 bp, Mus musculus
tgaattctgctcttgcctttggaca

SEQ ID NO: 796264 - DNA, 25 bp, Mus musculus
tgaattctgtgaacagtcgggccag

SEQ ID NO: 796265 - DNA, 25 bp, Mus musculus
tgaattctgtgatcagtcgggccag

SEQ ID NO: 796266 - DNA, 25 bp, Mus musculus
tgaattgaactgcacaaaaagtgtt

SEQ ID NO: 796267 - DNA, 25 bp, Mus musculus
tgaattgaactggacaaaaagtgtt

SEQ ID NO: 796268 - DNA, 25 bp, Mus musculus
tgaattgacctccaagctgaagaga

SEQ ID NO: 796269 - DNA, 25 bp, Mus musculus
tgaattgacctcgaagctgaagaga

SEQ ID NO: 796270 - DNA, 25 bp, Mus musculus
tgaattgagcatcccagacagtggt

SEQ ID NO: 796271 - DNA, 25 bp, Mus musculus
tgaattgagcatgccagacagtggt

SEQ ID NO: 796272 - DNA, 25 bp, Mus musculus
tgaattgcatcaacagcagatggcg

SEQ ID NO: 796273 - DNA, 25 bp, Mus musculus
tgaattgcatcatcagcagatggcg

SEQ ID NO: 796274 - DNA, 25 bp, Mus musculus
tgaattggaagaacactgggttggc

SEQ ID NO: 796275 - DNA, 25 bp, Mus musculus
tgaattggaagatcactgggttggc

SEQ ID NO: 796276 - DNA, 25 bp, Mus musculus
tgaattggacctcccacgtcaatgg

SEQ ID NO: 796277 - DNA, 25 bp, Mus musculus
tgaattggacctgccacgtcaatgg

SEQ ID NO: 796278 - DNA, 25 bp, Mus musculus
tgaattggctagaagggagaaaaca

SEQ ID NO: 796279 - DNA, 25 bp, Mus musculus
tgaattggctagtagggagaaaaca

SEQ ID NO: 796280 - DNA, 25 bp, Mus musculus
tgaatttaagctaaatcagcctgag

SEQ ID NO: 796281 - DNA, 25 bp, Mus musculus
tgaatttaagcttaatcagcctgag

SEQ ID NO: 796282 - DNA, 25 bp, Mus musculus
tgaatttcacaaccaatccccttgg

SEQ ID NO: 796283 - DNA, 25 bp, Mus musculus
tgaatttcacaagcaatccccttgg

SEQ ID NO: 796284 - DNA, 25 bp, Mus musculus
tgaatttcagaaagggtctcacaaa

SEQ ID NO: 796285 - DNA, 25 bp, Mus musculus
tgaatttcagaatgggtctcacaaa

SEQ ID NO: 796286 - DNA, 25 bp, Mus musculus
tgaatttctcacacgggagctggct

SEQ ID NO: 796287 - DNA, 25 bp, Mus musculus
tgaatttctcactcgggagctggct

SEQ ID NO: 796288 - DNA, 25 bp, Mus musculus
tgaatttgaagcaaactacgttgcc

SEQ ID NO: 796289 - DNA, 25 bp, Mus musculus
tgaatttgaagctaactacgttgcc

SEQ ID NO: 796290 - DNA, 25 bp, Mus musculus
tgaatttgaatacctcccactagat

SEQ ID NO: 796291 - DNA, 25 bp, Mus musculus
tgaatttgaatagctcccactagat

SEQ ID NO: 796292 - DNA, 25 bp, Mus musculus
tgaatttgacttaaaaggcgatccg

SEQ ID NO: 796293 - DNA, 25 bp, Mus musculus
tgaatttgactttaaaggcgatccg

SEQ ID NO: 796294 - DNA, 25 bp, Mus musculus
tgaatttgagtacaaaccaccacat

SEQ ID NO: 796295 - DNA, 25 bp, Mus musculus
tgaatttgagtagaaaccaccacat

SEQ ID NO: 796296 - DNA, 25 bp, Mus musculus
tgaatttgccaaagagccaccgcag

SEQ ID NO: 796297 - DNA, 25 bp, Mus musculus
tgaatttgccaatgagccaccgcag

SEQ ID NO: 796298 - DNA, 25 bp, Mus musculus
tgaatttgtcaacaacctgctgcca

SEQ ID NO: 796299 - DNA, 25 bp, Mus musculus
tgaatttgtcaagaacctgctgcca

SEQ ID NO: 796300 - DNA, 25 bp, Mus musculus
tgaattttctgaagcctggcctctg

SEQ ID NO: 796301 - DNA, 25 bp, Mus musculus
tgaattttctgatgcctggcctctg

SEQ ID NO: 796302 - DNA, 25 bp, Mus musculus
tgaattttttccactcagactcagc

SEQ ID NO: 796303 - DNA, 25 bp, Mus musculus
tgaattttttcctctcagactcagc

SEQ ID NO: 796304 - DNA, 25 bp, Mus musculus
tgacaaaaagcaacagctagaagga

SEQ ID NO: 796305 - DNA, 25 bp, Mus musculus
tgacaaaaagcatcagctagaagga

SEQ ID NO: 796306 - DNA, 25 bp, Mus musculus
tgacaaaactcacttgaatccaaca

SEQ ID NO: 796307 - DNA, 25 bp, Mus musculus
tgacaaaactcagttgaatccaaca

SEQ ID NO: 796308 - DNA, 25 bp, Mus musculus
tgacaaaagtttagggcattaagaa

SEQ ID NO: 796309 - DNA, 25 bp, Mus musculus
tgacaaaagttttgggcattaagaa

SEQ ID NO: 796310 - DNA, 25 bp, Mus musculus
tgacaaacgcctacagcagggacga

SEQ ID NO: 796311 - DNA, 25 bp, Mus musculus
tgacaaacgccttcagcagggacga

SEQ ID NO: 796312 - DNA, 25 bp, Mus musculus
tgacaaacggtcagaagcagaagag

SEQ ID NO: 796313 - DNA, 25 bp, Mus musculus
tgacaaacggtctgaagcagaagag

SEQ ID NO: 796314 - DNA, 25 bp, Mus musculus
tgacaaagaggcctcctctgaccca

SEQ ID NO: 796315 - DNA, 25 bp, Mus musculus
tgacaaagaggcgtcctctgaccca

SEQ ID NO: 796316 - DNA, 25 bp, Mus musculus
tgacaaagagtgacgatgatgtctc

SEQ ID NO: 796317 - DNA, 25 bp, Mus musculus
tgacaaagagtgtcgatgatgtctc

SEQ ID NO: 796318 - DNA, 25 bp, Mus musculus
tgacaaagcctgaatccgccacatt

SEQ ID NO: 796319 - DNA, 25 bp, Mus musculus
tgacaaagcctgtatccgccacatt

SEQ ID NO: 796320 - DNA, 25 bp, Mus musculus
tgacaaaggctgcagtgcccacaac

SEQ ID NO: 796321 - DNA, 25 bp, Mus musculus
tgacaaaggctggagtgcccacaac

SEQ ID NO: 796322 - DNA, 25 bp, Mus musculus
tgacaaaggtagagaaaagcaccaa

SEQ ID NO: 796323 - DNA, 25 bp, Mus musculus
tgacaaaggtagtgaaaagcaccaa

SEQ ID NO: 796324 - DNA, 25 bp, Mus musculus
tgacaaagttccagctgatattaga

SEQ ID NO: 796325 - DNA, 25 bp, Mus musculus
tgacaaagttcctgctgatattaga

SEQ ID NO: 796326 - DNA, 25 bp, Mus musculus
tgacaaataccacagagaagtaact

SEQ ID NO: 796327 - DNA, 25 bp, Mus musculus
tgacaaataccagagagaagtaact

SEQ ID NO: 796328 - DNA, 25 bp, Mus musculus
tgacaaatatgcagcaagatttggg

SEQ ID NO: 796329 - DNA, 25 bp, Mus musculus
tgacaaatatgctgcaagatttggg

SEQ ID NO: 796330 - DNA, 25 bp, Mus musculus
tgacaacaaagacccagagtgtgta

SEQ ID NO: 796331 - DNA, 25 bp, Mus musculus
tgacaacaaagagccagagtgtgta

SEQ ID NO: 796332 - DNA, 25 bp, Mus musculus
tgacaacagactcgatgagccaggc

SEQ ID NO: 796333 - DNA, 25 bp, Mus musculus
tgacaacagactggatgagccaggc

SEQ ID NO: 796334 - DNA, 25 bp, Mus musculus
tgacaacagcgcagactcctgcctg

SEQ ID NO: 796335 - DNA, 25 bp, Mus musculus
tgacaacagcgctgactcctgcctg

SEQ ID NO: 796336 - DNA, 25 bp, Mus musculus
tgacaacagcgtcaagtacccgtac

SEQ ID NO: 796337 - DNA, 25 bp, Mus musculus
tgacaacagcgtgaagtacccgtac

SEQ ID NO: 796338 - DNA, 25 bp, Mus musculus
tgacaacaggagacttcgacgtcac

SEQ ID NO: 796339 - DNA, 25 bp, Mus musculus
tgacaacaggagtcttcgacgtcac

SEQ ID NO: 796340 - DNA, 25 bp, Mus musculus
tgacaacagtgtcggcctcgtcgtc

SEQ ID NO: 796341 - DNA, 25 bp, Mus musculus
tgacaacagtgtgggcctcgtcgtc

SEQ ID NO: 796342 - DNA, 25 bp, Mus musculus
tgacaacatggcagagctctttgcc

SEQ ID NO: 796343 - DNA, 25 bp, Mus musculus
tgacaacatggctgagctctttgcc

SEQ ID NO: 796344 - DNA, 25 bp, Mus musculus
tgacaaccagcacgcctgaggacct

SEQ ID NO: 796345 - DNA, 25 bp, Mus musculus
tgacaaccagcaggcctgaggacct

SEQ ID NO: 796346 - DNA, 25 bp, Mus musculus
tgacaaccatttacagtctcacgcc

SEQ ID NO: 796347 - DNA, 25 bp, Mus musculus
tgacaaccattttcagtctcacgcc

SEQ ID NO: 796348 - DNA, 25 bp, Mus musculus
tgacaacccagcatgtaggaacggc

SEQ ID NO: 796349 - DNA, 25 bp, Mus musculus
tgacaacccagcttgtaggaacggc

SEQ ID NO: 796350 - DNA, 25 bp, Mus musculus
tgacaaccggcacattgtctctggg

SEQ ID NO: 796351 - DNA, 25 bp, Mus musculus
tgacaaccggcagattgtctctggg

SEQ ID NO: 796352 - DNA, 25 bp, Mus musculus
tgacaaccgtgtaagctgcttaggt

SEQ ID NO: 796353 - DNA, 25 bp, Mus musculus
tgacaaccgtgttagctgcttaggt

SEQ ID NO: 796354 - DNA, 25 bp, Mus musculus
tgacaacctgatacgggtcttctct

SEQ ID NO: 796355 - DNA, 25 bp, Mus musculus
tgacaacctgattcgggtcttctct

SEQ ID NO: 796356 - DNA, 25 bp, Mus musculus
tgacaacctggcatccacacggaaa

SEQ ID NO: 796357 - DNA, 25 bp, Mus musculus
tgacaacctggcttccacacggaaa

SEQ ID NO: 796358 - DNA, 25 bp, Mus musculus
tgacaacgagtgaatgaggaacccc

SEQ ID NO: 796359 - DNA, 25 bp, Mus musculus
tgacaacgagtgtatgaggaacccc

SEQ ID NO: 796360 - DNA, 25 bp, Mus musculus
tgacaacgccccacaggtgttacct

SEQ ID NO: 796361 - DNA, 25 bp, Mus musculus
tgacaacgcccctcaggtgttacct

SEQ ID NO: 796362 - DNA, 25 bp, Mus musculus
tgacaacggctaatgtggaacagca

SEQ ID NO: 796363 - DNA, 25 bp, Mus musculus
tgacaacggctattgtggaacagca

SEQ ID NO: 796364 - DNA, 25 bp, Mus musculus
tgacaacgttgtctgcttcaccagg

SEQ ID NO: 796365 - DNA, 25 bp, Mus musculus
tgacaacgttgtgtgcttcaccagg

SEQ ID NO: 796366 - DNA, 25 bp, Mus musculus
tgacaactgaagagatagatgcgct

SEQ ID NO: 796367 - DNA, 25 bp, Mus musculus
tgacaactgaagtgatagatgcgct

SEQ ID NO: 796368 - DNA, 25 bp, Mus musculus
tgacaactgcacatttaacacctgc

SEQ ID NO: 796369 - DNA, 25 bp, Mus musculus
tgacaactgcacttttaacacctgc

SEQ ID NO: 796370 - DNA, 25 bp, Mus musculus
tgacaactttgtcgcctgtatggcc

SEQ ID NO: 796371 - DNA, 25 bp, Mus musculus
tgacaactttgtggcctgtatggcc

SEQ ID NO: 796372 - DNA, 25 bp, Mus musculus
tgacaagaaaaccatcactgtgtct

SEQ ID NO: 796373 - DNA, 25 bp, Mus musculus
tgacaagaaaacgatcactgtgtct

SEQ ID NO: 796374 - DNA, 25 bp, Mus musculus
tgacaagaacaaactacaggcgatt

SEQ ID NO: 796375 - DNA, 25 bp, Mus musculus
tgacaagaacaatctacaggcgatt

SEQ ID NO: 796376 - DNA, 25 bp, Mus musculus
tgacaagacgcacgcactggacatg

SEQ ID NO: 796377 - DNA, 25 bp, Mus musculus
tgacaagacgcaggcactggacatg

SEQ ID NO: 796378 - DNA, 25 bp, Mus musculus
tgacaagaggagactttccttgttg

SEQ ID NO: 796379 - DNA, 25 bp, Mus musculus
tgacaagaggagtctttccttgttg

SEQ ID NO: 796380 - DNA, 25 bp, Mus musculus
tgacaagaggatcttcaccacccga

SEQ ID NO: 796381 - DNA, 25 bp, Mus musculus
tgacaagaggatgttcaccacccga

SEQ ID NO: 796382 - DNA, 25 bp, Mus musculus
tgacaagaggcacaaagatatctgg

SEQ ID NO: 796383 - DNA, 25 bp, Mus musculus
tgacaagaggcagaaagatatctgg

SEQ ID NO: 796384 - DNA, 25 bp, Mus musculus
tgacaagatcacagaaattcccagt

SEQ ID NO: 796385 - DNA, 25 bp, Mus musculus
tgacaagatcaccatctccaagaac

SEQ ID NO: 796386 - DNA, 25 bp, Mus musculus
tgacaagatcacgatctccaagaac

SEQ ID NO: 796387 - DNA, 25 bp, Mus musculus
tgacaagatcactgaaattcccagt

SEQ ID NO: 796388 - DNA, 25 bp, Mus musculus
tgacaagatgtacgtgaccaatgac

SEQ ID NO: 796389 - DNA, 25 bp, Mus musculus
tgacaagatgtaggtgaccaatgac

SEQ ID NO: 796390 - DNA, 25 bp, Mus musculus
tgacaagattatcggccgctgcact

SEQ ID NO: 796391 - DNA, 25 bp, Mus musculus
tgacaagattatgggccgctgcact

SEQ ID NO: 796392 - DNA, 25 bp, Mus musculus
tgacaagattggcaagaacgacgcc

SEQ ID NO: 796393 - DNA, 25 bp, Mus musculus
tgacaagattgggaagaacgacgcc

SEQ ID NO: 796394 - DNA, 25 bp, Mus musculus
tgacaagcaatcataagagggaggc

SEQ ID NO: 796395 - DNA, 25 bp, Mus musculus
tgacaagcaatcttaagagggaggc

SEQ ID NO: 796396 - DNA, 25 bp, Mus musculus
tgacaagcacaacaaaggcgagggc

SEQ ID NO: 796397 - DNA, 25 bp, Mus musculus
tgacaagcacaagaaaggcgagggc

SEQ ID NO: 796398 - DNA, 25 bp, Mus musculus
tgacaagcagtacggcaactaccct

SEQ ID NO: 796399 - DNA, 25 bp, Mus musculus
tgacaagcagtagggcaactaccct

SEQ ID NO: 796400 - DNA, 25 bp, Mus musculus
tgacaagccaccagaaccgtgtagg

SEQ ID NO: 796401 - DNA, 25 bp, Mus musculus
tgacaagccacctgaaccgtgtagg

SEQ ID NO: 796402 - DNA, 25 bp, Mus musculus
tgacaagcccctcatcaaggacttg

SEQ ID NO: 796403 - DNA, 25 bp, Mus musculus
tgacaagcccctgatcaaggacttg

SEQ ID NO: 796404 - DNA, 25 bp, Mus musculus
tgacaagcccggcactctcaggaga

SEQ ID NO: 796405 - DNA, 25 bp, Mus musculus
tgacaagcccgggactctcaggaga

SEQ ID NO: 796406 - DNA, 25 bp, Mus musculus
tgacaagcggctcaaggcagagcct

SEQ ID NO: 796407 - DNA, 25 bp, Mus musculus
tgacaagcggctgaaggcagagcct

SEQ ID NO: 796408 - DNA, 25 bp, Mus musculus
tgacaagctacgaggagcccggctc

SEQ ID NO: 796409 - DNA, 25 bp, Mus musculus
tgacaagctacgtggagcccggctc

SEQ ID NO: 796410 - DNA, 25 bp, Mus musculus
tgacaagctcagcaagatccagacg

SEQ ID NO: 796411 - DNA, 25 bp, Mus musculus
tgacaagctcaggaagatccagacg

SEQ ID NO: 796412 - DNA, 25 bp, Mus musculus
tgacaaggacctctcggacctggta

SEQ ID NO: 796413 - DNA, 25 bp, Mus musculus
tgacaaggacctgtcggacctggta

SEQ ID NO: 796414 - DNA, 25 bp, Mus musculus
tgacaaggagacagtgatcaaccca

SEQ ID NO: 796415 - DNA, 25 bp, Mus musculus
tgacaaggagacatacgaacttcgt

SEQ ID NO: 796416 - DNA, 25 bp, Mus musculus
tgacaaggagactgtgatcaaccca

SEQ ID NO: 796417 - DNA, 25 bp, Mus musculus
tgacaaggagacttacgaacttcgt

SEQ ID NO: 796418 - DNA, 25 bp, Mus musculus
tgacaaggagatcaactcccaggtc

SEQ ID NO: 796419 - DNA, 25 bp, Mus musculus
tgacaaggagatgaactcccaggtc

SEQ ID NO: 796420 - DNA, 25 bp, Mus musculus
tgacaaggcctacccgacagtgtgt

SEQ ID NO: 796421 - DNA, 25 bp, Mus musculus
tgacaaggcctagccgacagtgtgt

SEQ ID NO: 796422 - DNA, 25 bp, Mus musculus
tgacaaggcgacacacgatggaagc

SEQ ID NO: 796423 - DNA, 25 bp, Mus musculus
tgacaaggcgactcacgatggaagc

SEQ ID NO: 796424 - DNA, 25 bp, Mus musculus
tgacaaggctctcaagtacttggag

SEQ ID NO: 796425 - DNA, 25 bp, Mus musculus
tgacaaggctctgaagtacttggag

SEQ ID NO: 796426 - DNA, 25 bp, Mus musculus
tgacaaggctgtatccattattgaa

SEQ ID NO: 796427 - DNA, 25 bp, Mus musculus
tgacaaggctgtttccattattgaa

SEQ ID NO: 796428 - DNA, 25 bp, Mus musculus
tgacaagggtcactacatcaaggcc

SEQ ID NO: 796429 - DNA, 25 bp, Mus musculus
tgacaagggtcagtacatcaaggcc

SEQ ID NO: 796430 - DNA, 25 bp, Mus musculus
tgacaaggttgtacctgggaacagg

SEQ ID NO: 796431 - DNA, 25 bp, Mus musculus
tgacaaggttgttcctgggaacagg

SEQ ID NO: 796432 - DNA, 25 bp, Mus musculus
tgacaagtccccatcgttgaagtga

SEQ ID NO: 796433 - DNA, 25 bp, Mus musculus
tgacaagtccccttcgttgaagtga

SEQ ID NO: 796434 - DNA, 25 bp, Mus musculus
tgacaagtgacgctggtctccacca

SEQ ID NO: 796435 - DNA, 25 bp, Mus musculus
tgacaagtgacggtggtctccacca

SEQ ID NO: 796436 - DNA, 25 bp, Mus musculus
tgacaagtgtgtaactgcccctggc

SEQ ID NO: 796437 - DNA, 25 bp, Mus musculus
tgacaagtgtgttactgcccctggc

SEQ ID NO: 796438 - DNA, 25 bp, Mus musculus
tgacaagtgttgctggtgtacccat

SEQ ID NO: 796439 - DNA, 25 bp, Mus musculus
tgacaagtgttggtggtgtacccat

SEQ ID NO: 796440 - DNA, 25 bp, Mus musculus
tgacaagttcagagcgatgaagtac

SEQ ID NO: 796441 - DNA, 25 bp, Mus musculus
tgacaagttcagtgcgatgaagtac

SEQ ID NO: 796442 - DNA, 25 bp, Mus musculus
tgacaataaccaccattcacagact

SEQ ID NO: 796443 - DNA, 25 bp, Mus musculus
tgacaataaccagcattcacagact

SEQ ID NO: 796444 - DNA, 25 bp, Mus musculus
tgacaatacagacaggagaaaagcg

SEQ ID NO: 796445 - DNA, 25 bp, Mus musculus
tgacaatacagagaggagaaaagcg

SEQ ID NO: 796446 - DNA, 25 bp, Mus musculus
tgacaatatcctcaccctaatacgg

SEQ ID NO: 796447 - DNA, 25 bp, Mus musculus
tgacaatatcctgaccctaatacgg

SEQ ID NO: 796448 - DNA, 25 bp, Mus musculus
tgacaatcatcccaactggtaggcg

SEQ ID NO: 796449 - DNA, 25 bp, Mus musculus
tgacaatcatccgaactggtaggcg

SEQ ID NO: 796450 - DNA, 25 bp, Mus musculus
tgacaatcctccagagtttactgcc

SEQ ID NO: 796451 - DNA, 25 bp, Mus musculus
tgacaatcctcctgagtttactgcc

SEQ ID NO: 796452 - DNA, 25 bp, Mus musculus
tgacaatcgggaatccggaagccca

SEQ ID NO: 796453 - DNA, 25 bp, Mus musculus
tgacaatcgggattccggaagccca

SEQ ID NO: 796454 - DNA, 25 bp, Mus musculus
tgacaatgacagacagccttgtgag

SEQ ID NO: 796455 - DNA, 25 bp, Mus musculus
tgacaatgacagtcagccttgtgag

SEQ ID NO: 796456 - DNA, 25 bp, Mus musculus
tgacaatgacggcatccctgatgac

SEQ ID NO: 796457 - DNA, 25 bp, Mus musculus
tgacaatgacgggatccctgatgac

SEQ ID NO: 796458 - DNA, 25 bp, Mus musculus
tgacaatgactcctcgcaactgatg

SEQ ID NO: 796459 - DNA, 25 bp, Mus musculus
tgacaatgactcgtcgcaactgatg

SEQ ID NO: 796460 - DNA, 25 bp, Mus musculus
tgacaatgatcacccgcagggactg

SEQ ID NO: 796461 - DNA, 25 bp, Mus musculus
tgacaatgatcagccgcagggactg

SEQ ID NO: 796462 - DNA, 25 bp, Mus musculus
tgacaatgatctccccatggaggag

SEQ ID NO: 796463 - DNA, 25 bp, Mus musculus
tgacaatgatctgcccatggaggag

SEQ ID NO: 796464 - DNA, 25 bp, Mus musculus
tgacaatgcagcatctcttgctgtg

SEQ ID NO: 796465 - DNA, 25 bp, Mus musculus
tgacaatgcagcttctcttgctgtg

SEQ ID NO: 796466 - DNA, 25 bp, Mus musculus
tgacaatgcagtacatcagccaccg

SEQ ID NO: 796467 - DNA, 25 bp, Mus musculus
tgacaatgcagttcatcagccaccg

SEQ ID NO: 796468 - DNA, 25 bp, Mus musculus
tgacaatgccttcctgagctaccac

SEQ ID NO: 796469 - DNA, 25 bp, Mus musculus
tgacaatgccttgctgagctaccac

SEQ ID NO: 796470 - DNA, 25 bp, Mus musculus
tgacaatgctccaaagtttgctgcc

SEQ ID NO: 796471 - DNA, 25 bp, Mus musculus
tgacaatgctcctaagtttgctgcc

SEQ ID NO: 796472 - DNA, 25 bp, Mus musculus
tgacaatgctctcctgaggtacaac

SEQ ID NO: 796473 - DNA, 25 bp, Mus musculus
tgacaatgctctgctgaggtacaac

SEQ ID NO: 796474 - DNA, 25 bp, Mus musculus
tgacaatggaaaatggtgtgcagca

SEQ ID NO: 796475 - DNA, 25 bp, Mus musculus
tgacaatggaaattggtgtgcagca

SEQ ID NO: 796476 - DNA, 25 bp, Mus musculus
tgacaatgggatctttgcgccaggc

SEQ ID NO: 796477 - DNA, 25 bp, Mus musculus
tgacaatgggatgtttgcgccaggc

SEQ ID NO: 796478 - DNA, 25 bp, Mus musculus
tgacaatgtagtcatccccgagtgt

SEQ ID NO: 796479 - DNA, 25 bp, Mus musculus
tgacaatgtagtgatccccgagtgt

SEQ ID NO: 796480 - DNA, 25 bp, Mus musculus
tgacaatgttgcagaatccccggat

SEQ ID NO: 796481 - DNA, 25 bp, Mus musculus
tgacaatgttgctgaatccccggat

SEQ ID NO: 796482 - DNA, 25 bp, Mus musculus
tgacaattgggtcctaacagccgct

SEQ ID NO: 796483 - DNA, 25 bp, Mus musculus
tgacaattgggtgctaacagccgct

SEQ ID NO: 796484 - DNA, 25 bp, Mus musculus
tgacaatttctcatccctttgggaa

SEQ ID NO: 796485 - DNA, 25 bp, Mus musculus
tgacaatttctcttccctttgggaa

SEQ ID NO: 796486 - DNA, 25 bp, Mus musculus
tgacaattttaactcgccagaagat

SEQ ID NO: 796487 - DNA, 25 bp, Mus musculus
tgacaattttaagtcgccagaagat

SEQ ID NO: 796488 - DNA, 25 bp, Mus musculus
tgacacaagagcatatggccaccat

SEQ ID NO: 796489 - DNA, 25 bp, Mus musculus
tgacacaagagcttatggccaccat

SEQ ID NO: 796490 - DNA, 25 bp, Mus musculus
tgacacacagatatcctacttacca

SEQ ID NO: 796491 - DNA, 25 bp, Mus musculus
tgacacacagatttcctacttacca

SEQ ID NO: 796492 - DNA, 25 bp, Mus musculus
tgacacacattgaatccagaccttc

SEQ ID NO: 796493 - DNA, 25 bp, Mus musculus
tgacacacattgtatccagaccttc

SEQ ID NO: 796494 - DNA, 25 bp, Mus musculus
tgacacactatgaaaagggttggct

SEQ ID NO: 796495 - DNA, 25 bp, Mus musculus
tgacacactatgacgcacgtccgcg

SEQ ID NO: 796496 - DNA, 25 bp, Mus musculus
tgacacactatgtaaagggttggct

SEQ ID NO: 796497 - DNA, 25 bp, Mus musculus
tgacacactatgtcgcacgtccgcg

SEQ ID NO: 796498 - DNA, 25 bp, Mus musculus
tgacacagagctctacctcacacag

SEQ ID NO: 796499 - DNA, 25 bp, Mus musculus
tgacacagagctgtacctcacacag

SEQ ID NO: 796500 - DNA, 25 bp, Mus musculus
tgacacagaggacagtttctctacc

SEQ ID NO: 796501 - DNA, 25 bp, Mus musculus
tgacacagaggagagtttctctacc

SEQ ID NO: 796502 - DNA, 25 bp, Mus musculus
tgacacagcactagtagtgtggaag

SEQ ID NO: 796503 - DNA, 25 bp, Mus musculus
tgacacagcacttgtagtgtggaag

SEQ ID NO: 796504 - DNA, 25 bp, Mus musculus
tgacacagcccaacgtggtcacaat

SEQ ID NO: 796505 - DNA, 25 bp, Mus musculus
tgacacagcccatcgtggtcacaat

SEQ ID NO: 796506 - DNA, 25 bp, Mus musculus
tgacacagcgggaggctcagacttg

SEQ ID NO: 796507 - DNA, 25 bp, Mus musculus
tgacacagcgggtggctcagacttg

SEQ ID NO: 796508 - DNA, 25 bp, Mus musculus
tgacacaggcagcatggcattgaac

SEQ ID NO: 796509 - DNA, 25 bp, Mus musculus
tgacacaggcaggatggcattgaac

SEQ ID NO: 796510 - DNA, 25 bp, Mus musculus
tgacacagtatgatgccaagaagaa

SEQ ID NO: 796511 - DNA, 25 bp, Mus musculus
tgacacagtatgttgccaagaagaa

SEQ ID NO: 796512 - DNA, 25 bp, Mus musculus
tgacacagtcacaactgctatctcg

SEQ ID NO: 796513 - DNA, 25 bp, Mus musculus
tgacacagtcactactgctatctcg

SEQ ID NO: 796514 - DNA, 25 bp, Mus musculus
tgacacagtcgcaggtgacactcgc

SEQ ID NO: 796515 - DNA, 25 bp, Mus musculus
tgacacagtcgctggtgacactcgc

SEQ ID NO: 796516 - DNA, 25 bp, Mus musculus
tgacacagtgtgatggccccaacaa

SEQ ID NO: 796517 - DNA, 25 bp, Mus musculus
tgacacagtgtgttggccccaacaa

SEQ ID NO: 796518 - DNA, 25 bp, Mus musculus
tgacacatacggacctcaaacctga

SEQ ID NO: 796519 - DNA, 25 bp, Mus musculus
tgacacatacggtcctcaaacctga

SEQ ID NO: 796520 - DNA, 25 bp, Mus musculus
tgacacatgatacgccaggagcaaa

SEQ ID NO: 796521 - DNA, 25 bp, Mus musculus
tgacacatgataggccaggagcaaa

SEQ ID NO: 796522 - DNA, 25 bp, Mus musculus
tgacacatgcatacagtaacctctt

SEQ ID NO: 796523 - DNA, 25 bp, Mus musculus
tgacacatgcattcagtaacctctt

SEQ ID NO: 796524 - DNA, 25 bp, Mus musculus
tgacacatgcttccatccagaactg

SEQ ID NO: 796525 - DNA, 25 bp, Mus musculus
tgacacatgcttgcatccagaactg

SEQ ID NO: 796526 - DNA, 25 bp, Mus musculus
tgacacatggacagctgattttggt

SEQ ID NO: 796527 - DNA, 25 bp, Mus musculus
tgacacatggactgctgattttggt

SEQ ID NO: 796528 - DNA, 25 bp, Mus musculus
tgacaccaaattccgctctcacgag

SEQ ID NO: 796529 - DNA, 25 bp, Mus musculus
tgacaccaaattgcgctctcacgag

SEQ ID NO: 796530 - DNA, 25 bp, Mus musculus
tgacaccaacccagtcaacggcaaa

SEQ ID NO: 796531 - DNA, 25 bp, Mus musculus
tgacaccaaccctgtcaacggcaaa

SEQ ID NO: 796532 - DNA, 25 bp, Mus musculus
tgacaccaagcgaggagatgcttgt

SEQ ID NO: 796533 - DNA, 25 bp, Mus musculus
tgacaccaagcgtggagatgcttgt

SEQ ID NO: 796534 - DNA, 25 bp, Mus musculus
tgacaccaaggcaccaatcgacacg

SEQ ID NO: 796535 - DNA, 25 bp, Mus musculus
tgacaccaaggctccaatcgacacg

SEQ ID NO: 796536 - DNA, 25 bp, Mus musculus
tgacaccaccggactctagaggact

SEQ ID NO: 796537 - DNA, 25 bp, Mus musculus
tgacaccaccggtctctagaggact

SEQ ID NO: 796538 - DNA, 25 bp, Mus musculus
tgacaccacggccagtggactttcc

SEQ ID NO: 796539 - DNA, 25 bp, Mus musculus
tgacaccacggcgagtggactttcc

SEQ ID NO: 796540 - DNA, 25 bp, Mus musculus
tgacaccagactccatgagctgcac

SEQ ID NO: 796541 - DNA, 25 bp, Mus musculus
tgacaccagactctttgtctctggt

SEQ ID NO: 796542 - DNA, 25 bp, Mus musculus
tgacaccagactgcatgagctgcac

SEQ ID NO: 796543 - DNA, 25 bp, Mus musculus
tgacaccagactgtttgtctctggt

SEQ ID NO: 796544 - DNA, 25 bp, Mus musculus
tgacaccagcaacccagacatactg

SEQ ID NO: 796545 - DNA, 25 bp, Mus musculus
tgacaccagcaagccagacatactg

SEQ ID NO: 796546 - DNA, 25 bp, Mus musculus
tgacaccaggtaattcgatgaggag

SEQ ID NO: 796547 - DNA, 25 bp, Mus musculus
tgacaccaggtatttcgatgaggag

SEQ ID NO: 796548 - DNA, 25 bp, Mus musculus
tgacaccaggtcaaggagtgctggc

SEQ ID NO: 796549 - DNA, 25 bp, Mus musculus
tgacaccaggtctaggagtgctggc

SEQ ID NO: 796550 - DNA, 25 bp, Mus musculus
tgacaccatccaccgttcggttaca

SEQ ID NO: 796551 - DNA, 25 bp, Mus musculus
tgacaccatccagcgttcggttaca

SEQ ID NO: 796552 - DNA, 25 bp, Mus musculus
tgacacccagtacaccggccgaaag

SEQ ID NO: 796553 - DNA, 25 bp, Mus musculus
tgacacccagtagaccggccgaaag

SEQ ID NO: 796554 - DNA, 25 bp, Mus musculus
tgacacccctaacgacttccagtta

SEQ ID NO: 796555 - DNA, 25 bp, Mus musculus
tgacacccctaaggacttccagtta

SEQ ID NO: 796556 - DNA, 25 bp, Mus musculus
tgacacccgaaaaactacccatggc

SEQ ID NO: 796557 - DNA, 25 bp, Mus musculus
tgacacccgaaatactacccatggc

SEQ ID NO: 796558 - DNA, 25 bp, Mus musculus
tgacacccgtgtacgagtccaatgg

SEQ ID NO: 796559 - DNA, 25 bp, Mus musculus
tgacacccgtgttcgagtccaatgg

SEQ ID NO: 796560 - DNA, 25 bp, Mus musculus
tgacacccttgtcgataacatctct

SEQ ID NO: 796561 - DNA, 25 bp, Mus musculus
tgacacccttgtggataacatctct

SEQ ID NO: 796562 - DNA, 25 bp, Mus musculus
tgacaccgtggtcaaccagctgctg

SEQ ID NO: 796563 - DNA, 25 bp, Mus musculus
tgacaccgtggtgaaccagctgctg

SEQ ID NO: 796564 - DNA, 25 bp, Mus musculus
tgacacgcaacacaagaaactaaga

SEQ ID NO: 796565 - DNA, 25 bp, Mus musculus
tgacacgcaacagaagaaactaaga

SEQ ID NO: 796566 - DNA, 25 bp, Mus musculus
tgacacgctattactacctttttcc

SEQ ID NO: 796567 - DNA, 25 bp, Mus musculus
tgacacgctatttctacctttttcc

SEQ ID NO: 796568 - DNA, 25 bp, Mus musculus
tgacacgcttggagctgcctggcat

SEQ ID NO: 796569 - DNA, 25 bp, Mus musculus
tgacacgcttggtgctgcctggcat

SEQ ID NO: 796570 - DNA, 25 bp, Mus musculus
tgacacggagaaaaaagatgagccc

SEQ ID NO: 796571 - DNA, 25 bp, Mus musculus
tgacacggagaataaagatgagccc

SEQ ID NO: 796572 - DNA, 25 bp, Mus musculus
tgacacggccaaccagatcaagagc

SEQ ID NO: 796573 - DNA, 25 bp, Mus musculus
tgacacggccaagcagatcaagagc

SEQ ID NO: 796574 - DNA, 25 bp, Mus musculus
tgacacggccgcagcagctgtgcgc

SEQ ID NO: 796575 - DNA, 25 bp, Mus musculus
tgacacggccgctgcagctgtgcgc

SEQ ID NO: 796576 - DNA, 25 bp, Mus musculus
tgacacggcgagcacttggcctgcc

SEQ ID NO: 796577 - DNA, 25 bp, Mus musculus
tgacacggcgaggacttggcctgcc

SEQ ID NO: 796578 - DNA, 25 bp, Mus musculus
tgacacggctgactcagcagtatgg

SEQ ID NO: 796579 - DNA, 25 bp, Mus musculus
tgacacggctgagtcagcagtatgg

SEQ ID NO: 796580 - DNA, 25 bp, Mus musculus
tgacacgggcgtactccggtttcaa

SEQ ID NO: 796581 - DNA, 25 bp, Mus musculus
tgacacgggcgttctccggtttcaa

SEQ ID NO: 796582 - DNA, 25 bp, Mus musculus
tgacacgggctcctcctatttctgc

SEQ ID NO: 796583 - DNA, 25 bp, Mus musculus
tgacacgggctcgtcctatttctgc

SEQ ID NO: 796584 - DNA, 25 bp, Mus musculus
tgacacggtgtgcaatgagatgcac

SEQ ID NO: 796585 - DNA, 25 bp, Mus musculus
tgacacggtgtggaatgagatgcac

SEQ ID NO: 796586 - DNA, 25 bp, Mus musculus
tgacacggttgacccctggccacat

SEQ ID NO: 796587 - DNA, 25 bp, Mus musculus
tgacacggttgagccctggccacat

SEQ ID NO: 796588 - DNA, 25 bp, Mus musculus
tgacacgtgaaccaaaccctcttct

SEQ ID NO: 796589 - DNA, 25 bp, Mus musculus
tgacacgtgaacgaaaccctcttct

SEQ ID NO: 796590 - DNA, 25 bp, Mus musculus
tgacacgttcctcagagcagcctgg

SEQ ID NO: 796591 - DNA, 25 bp, Mus musculus
tgacacgttcctgagagcagcctgg

SEQ ID NO: 796592 - DNA, 25 bp, Mus musculus
tgacactagtcacttgttgcccttg

SEQ ID NO: 796593 - DNA, 25 bp, Mus musculus
tgacactagtcagttgttgcccttg

SEQ ID NO: 796594 - DNA, 25 bp, Mus musculus
tgacactatttcaggcttcttgggt

SEQ ID NO: 796595 - DNA, 25 bp, Mus musculus
tgacactatttctggcttcttgggt

SEQ ID NO: 796596 - DNA, 25 bp, Mus musculus
tgacactcaagaacaggctatcctg

SEQ ID NO: 796597 - DNA, 25 bp, Mus musculus
tgacactcaagatcaggctatcctg

SEQ ID NO: 796598 - DNA, 25 bp, Mus musculus
tgacactcagaaacttttgcgcaca

SEQ ID NO: 796599 - DNA, 25 bp, Mus musculus
tgacactcagaatcttttgcgcaca

SEQ ID NO: 796600 - DNA, 25 bp, Mus musculus
tgacactccgagatctaagagccac

SEQ ID NO: 796601 - DNA, 25 bp, Mus musculus
tgacactccgagttctaagagccac

SEQ ID NO: 796602 - DNA, 25 bp, Mus musculus
tgacactcggcgcttccgatttgcc

SEQ ID NO: 796603 - DNA, 25 bp, Mus musculus
tgacactcggcggttccgatttgcc

SEQ ID NO: 796604 - DNA, 25 bp, Mus musculus
tgacactctggaagccttctcgcga

SEQ ID NO: 796605 - DNA, 25 bp, Mus musculus
tgacactctggatgccttctcgcga

SEQ ID NO: 796606 - DNA, 25 bp, Mus musculus
tgacactgaagcaggcacccaagag

SEQ ID NO: 796607 - DNA, 25 bp, Mus musculus
tgacactgaagctggcacccaagag

SEQ ID NO: 796608 - DNA, 25 bp, Mus musculus
tgacactgagccagtccgttcagac

SEQ ID NO: 796609 - DNA, 25 bp, Mus musculus
tgacactgagcctgtccgttcagac

SEQ ID NO: 796610 - DNA, 25 bp, Mus musculus
tgacactgatgaagggcccaggcat

SEQ ID NO: 796611 - DNA, 25 bp, Mus musculus
tgacactgatgatgggcccaggcat

SEQ ID NO: 796612 - DNA, 25 bp, Mus musculus
tgacactgcatgaccgaactaccaa

SEQ ID NO: 796613 - DNA, 25 bp, Mus musculus
tgacactgcatgctattcttgtgct

SEQ ID NO: 796614 - DNA, 25 bp, Mus musculus
tgacactgcatggtattcttgtgct

SEQ ID NO: 796615 - DNA, 25 bp, Mus musculus
tgacactgcatgtccgaactaccaa

SEQ ID NO: 796616 - DNA, 25 bp, Mus musculus
tgacactggtaaaacaatgcaaact

SEQ ID NO: 796617 - DNA, 25 bp, Mus musculus
tgacactggtaatacaatgcaaact

SEQ ID NO: 796618 - DNA, 25 bp, Mus musculus
tgacactggtgaagaggttcatcca

SEQ ID NO: 796619 - DNA, 25 bp, Mus musculus
tgacactggtgatgaggttcatcca

SEQ ID NO: 796620 - DNA, 25 bp, Mus musculus
tgacactgtcctacttgagatcctg

SEQ ID NO: 796621 - DNA, 25 bp, Mus musculus
tgacactgtccttcttgagatcctg

SEQ ID NO: 796622 - DNA, 25 bp, Mus musculus
tgacactgtggtcaaccgatggatg

SEQ ID NO: 796623 - DNA, 25 bp, Mus musculus
tgacactgtggtgaaccgatggatg

SEQ ID NO: 796624 - DNA, 25 bp, Mus musculus
tgacacttattgacctcaactccac

SEQ ID NO: 796625 - DNA, 25 bp, Mus musculus
tgacacttattgtcctcaactccac

SEQ ID NO: 796626 - DNA, 25 bp, Mus musculus
tgacacttcccaagtatttgacagt

SEQ ID NO: 796627 - DNA, 25 bp, Mus musculus
tgacacttcccatgtatttgacagt

SEQ ID NO: 796628 - DNA, 25 bp, Mus musculus
tgacacttgttcaccctcatttcct

SEQ ID NO: 796629 - DNA, 25 bp, Mus musculus
tgacacttgttctccctcatttcct

SEQ ID NO: 796630 - DNA, 25 bp, Mus musculus
tgacactttgcaaacccattcgagt

SEQ ID NO: 796631 - DNA, 25 bp, Mus musculus
tgacactttgcatacccattcgagt

SEQ ID NO: 796632 - DNA, 25 bp, Mus musculus
tgacagaaaccgcataccctgtgac

SEQ ID NO: 796633 - DNA, 25 bp, Mus musculus
tgacagaaaccggataccctgtgac

SEQ ID NO: 796634 - DNA, 25 bp, Mus musculus
tgacagaaagtcaaccatggttgct

SEQ ID NO: 796635 - DNA, 25 bp, Mus musculus
tgacagaaagtctaccatggttgct

SEQ ID NO: 796636 - DNA, 25 bp, Mus musculus
tgacagaaatttcccaacgggcttg

SEQ ID NO: 796637 - DNA, 25 bp, Mus musculus
tgacagaaatttgccaacgggcttg

SEQ ID NO: 796638 - DNA, 25 bp, Mus musculus
tgacagaaccctccactcagtgagc

SEQ ID NO: 796639 - DNA, 25 bp, Mus musculus
tgacagaaccctgcactcagtgagc

SEQ ID NO: 796640 - DNA, 25 bp, Mus musculus
tgacagacaagcatgcacctgagca

SEQ ID NO: 796641 - DNA, 25 bp, Mus musculus
tgacagacaagcttgcacctgagca

SEQ ID NO: 796642 - DNA, 25 bp, Mus musculus
tgacagacatcaagaacctgttttt

SEQ ID NO: 796643 - DNA, 25 bp, Mus musculus
tgacagacatcatgaacctgttttt

SEQ ID NO: 796644 - DNA, 25 bp, Mus musculus
tgacagaccacaccccaatggagat

SEQ ID NO: 796645 - DNA, 25 bp, Mus musculus
tgacagaccacagcccaatggagat

SEQ ID NO: 796646 - DNA, 25 bp, Mus musculus
tgacagacccaactcagcgacttgt

SEQ ID NO: 796647 - DNA, 25 bp, Mus musculus
tgacagacccaagtcagcgacttgt

SEQ ID NO: 796648 - DNA, 25 bp, Mus musculus
tgacagacccgcaggccccagaagg

SEQ ID NO: 796649 - DNA, 25 bp, Mus musculus
tgacagacccgctggccccagaagg

SEQ ID NO: 796650 - DNA, 25 bp, Mus musculus
tgacagacgccactgcgctcaacat

SEQ ID NO: 796651 - DNA, 25 bp, Mus musculus
tgacagacgccagtgcgctcaacat

SEQ ID NO: 796652 - DNA, 25 bp, Mus musculus
tgacagactacgaccgctaagttat

SEQ ID NO: 796653 - DNA, 25 bp, Mus musculus
tgacagactacgtccgctaagttat

SEQ ID NO: 796654 - DNA, 25 bp, Mus musculus
tgacagactggcagctgactgtgcc

SEQ ID NO: 796655 - DNA, 25 bp, Mus musculus
tgacagactggctgctgactgtgcc

SEQ ID NO: 796656 - DNA, 25 bp, Mus musculus
tgacagactggtaaacagaaaaccc

SEQ ID NO: 796657 - DNA, 25 bp, Mus musculus
tgacagactggttaacagaaaaccc

SEQ ID NO: 796658 - DNA, 25 bp, Mus musculus
tgacagacttcgcttttgccaagcg

SEQ ID NO: 796659 - DNA, 25 bp, Mus musculus
tgacagacttcggttttgccaagcg

SEQ ID NO: 796660 - DNA, 25 bp, Mus musculus
tgacagacttctaaccaggcagggt

SEQ ID NO: 796661 - DNA, 25 bp, Mus musculus
tgacagacttcttaccaggcagggt

SEQ ID NO: 796662 - DNA, 25 bp, Mus musculus
tgacagagacaacaatagggtcggc

SEQ ID NO: 796663 - DNA, 25 bp, Mus musculus
tgacagagacaagaatagggtcggc

SEQ ID NO: 796664 - DNA, 25 bp, Mus musculus
tgacagagagatcatatacccaaga

SEQ ID NO: 796665 - DNA, 25 bp, Mus musculus
tgacagagagatgatatacccaaga

SEQ ID NO: 796666 - DNA, 25 bp, Mus musculus
tgacagagcatcctcggtggccagc

SEQ ID NO: 796667 - DNA, 25 bp, Mus musculus
tgacagagcatcgtcggtggccagc

SEQ ID NO: 796668 - DNA, 25 bp, Mus musculus
tgacagagccagaagtggtgctcga

SEQ ID NO: 796669 - DNA, 25 bp, Mus musculus
tgacagagccagtagtggtgctcga

SEQ ID NO: 796670 - DNA, 25 bp, Mus musculus
tgacagagctggaccagcggagaat

SEQ ID NO: 796671 - DNA, 25 bp, Mus musculus
tgacagagctggtccagcggagaat

SEQ ID NO: 796672 - DNA, 25 bp, Mus musculus
tgacagagctgtatataaggagccg

SEQ ID NO: 796673 - DNA, 25 bp, Mus musculus
tgacagagctgtttataaggagccg

SEQ ID NO: 796674 - DNA, 25 bp, Mus musculus
tgacagaggatcataagggagcacc

SEQ ID NO: 796675 - DNA, 25 bp, Mus musculus
tgacagaggatcttaagggagcacc

SEQ ID NO: 796676 - DNA, 25 bp, Mus musculus
tgacagagtacaagtgtggagatca

SEQ ID NO: 796677 - DNA, 25 bp, Mus musculus
tgacagagtacatgtgtggagatca

SEQ ID NO: 796678 - DNA, 25 bp, Mus musculus
tgacagagttacaattagaagaacc

SEQ ID NO: 796679 - DNA, 25 bp, Mus musculus
tgacagagttacaccactccaggaa

SEQ ID NO: 796680 - DNA, 25 bp, Mus musculus
tgacagagttactattagaagaacc

SEQ ID NO: 796681 - DNA, 25 bp, Mus musculus
tgacagagttactccactccaggaa

SEQ ID NO: 796682 - DNA, 25 bp, Mus musculus
tgacagagttataggccacaagagg

SEQ ID NO: 796683 - DNA, 25 bp, Mus musculus
tgacagagttattggccacaagagg

SEQ ID NO: 796684 - DNA, 25 bp, Mus musculus
tgacagatgaaactggaaaatccaa

SEQ ID NO: 796685 - DNA, 25 bp, Mus musculus
tgacagatgaaagtggaaaatccaa

SEQ ID NO: 796686 - DNA, 25 bp, Mus musculus
tgacagattgtgctatacatacggg

SEQ ID NO: 796687 - DNA, 25 bp, Mus musculus
tgacagattgtggtatacatacggg

SEQ ID NO: 796688 - DNA, 25 bp, Mus musculus
tgacagcaactgaacaatggatttt

SEQ ID NO: 796689 - DNA, 25 bp, Mus musculus
tgacagcaactgtacaatggatttt

SEQ ID NO: 796690 - DNA, 25 bp, Mus musculus
tgacagcaattgagaaggcttggcc

SEQ ID NO: 796691 - DNA, 25 bp, Mus musculus
tgacagcaattgtgaaggcttggcc

SEQ ID NO: 796692 - DNA, 25 bp, Mus musculus
tgacagcacactcctttgaagagaa

SEQ ID NO: 796693 - DNA, 25 bp, Mus musculus
tgacagcacactgctttgaagagaa

SEQ ID NO: 796694 - DNA, 25 bp, Mus musculus
tgacagcactgaattggacaactcc

SEQ ID NO: 796695 - DNA, 25 bp, Mus musculus
tgacagcactgatttggacaactcc

SEQ ID NO: 796696 - DNA, 25 bp, Mus musculus
tgacagcagaccatatgggccggga

SEQ ID NO: 796697 - DNA, 25 bp, Mus musculus
tgacagcagaccctccaaacctaag

SEQ ID NO: 796698 - DNA, 25 bp, Mus musculus
tgacagcagaccgtccaaacctaag

SEQ ID NO: 796699 - DNA, 25 bp, Mus musculus
tgacagcagaccttatgggccggga

SEQ ID NO: 796700 - DNA, 25 bp, Mus musculus
tgacagcagctgaggcgttaaccca

SEQ ID NO: 796701 - DNA, 25 bp, Mus musculus
tgacagcagctgtggcgttaaccca

SEQ ID NO: 796702 - DNA, 25 bp, Mus musculus
tgacagcataatcttgaactggcca

SEQ ID NO: 796703 - DNA, 25 bp, Mus musculus
tgacagcataatgttgaactggcca

SEQ ID NO: 796704 - DNA, 25 bp, Mus musculus
tgacagcatatccaaattcctgcag

SEQ ID NO: 796705 - DNA, 25 bp, Mus musculus
tgacagcatatcgaaattcctgcag

SEQ ID NO: 796706 - DNA, 25 bp, Mus musculus
tgacagcatgaacgacaaccccttc

SEQ ID NO: 796707 - DNA, 25 bp, Mus musculus
tgacagcatgaaggacaaccccttc

SEQ ID NO: 796708 - DNA, 25 bp, Mus musculus
tgacagcatttcagaaggcaccagc

SEQ ID NO: 796709 - DNA, 25 bp, Mus musculus
tgacagcatttctgaaggcaccagc

SEQ ID NO: 796710 - DNA, 25 bp, Mus musculus
tgacagccacgcacaaaatgttttg

SEQ ID NO: 796711 - DNA, 25 bp, Mus musculus
tgacagccacgctcaaaatgttttg

SEQ ID NO: 796712 - DNA, 25 bp, Mus musculus
tgacagccatggagttgtaccagct

SEQ ID NO: 796713 - DNA, 25 bp, Mus musculus
tgacagccatggtgttgtaccagct

SEQ ID NO: 796714 - DNA, 25 bp, Mus musculus
tgacagccatgtacacctgggtgcg

SEQ ID NO: 796715 - DNA, 25 bp, Mus musculus
tgacagccatgttcacctgggtgcg

SEQ ID NO: 796716 - DNA, 25 bp, Mus musculus
tgacagcccagcagggtgacgccca

SEQ ID NO: 796717 - DNA, 25 bp, Mus musculus
tgacagcccagctgggtgacgccca

SEQ ID NO: 796718 - DNA, 25 bp, Mus musculus
tgacagccctctagcttagccaaga

SEQ ID NO: 796719 - DNA, 25 bp, Mus musculus
tgacagccctcttgcttagccaaga

SEQ ID NO: 796720 - DNA, 25 bp, Mus musculus
tgacagccctgacctccaagctgat

SEQ ID NO: 796721 - DNA, 25 bp, Mus musculus
tgacagccctgagctccaagctgat

SEQ ID NO: 796722 - DNA, 25 bp, Mus musculus
tgacagccgtaaagcacgaacagga

SEQ ID NO: 796723 - DNA, 25 bp, Mus musculus
tgacagccgtaatgcacgaacagga

SEQ ID NO: 796724 - DNA, 25 bp, Mus musculus
tgacagccgtctagaggagctcaaa

SEQ ID NO: 796725 - DNA, 25 bp, Mus musculus
tgacagccgtcttgaggagctcaaa

SEQ ID NO: 796726 - DNA, 25 bp, Mus musculus
tgacagccgtgaagactttcccctc

SEQ ID NO: 796727 - DNA, 25 bp, Mus musculus
tgacagccgtgatgactttcccctc

SEQ ID NO: 796728 - DNA, 25 bp, Mus musculus
tgacagccgttcagcacgagcgttt

SEQ ID NO: 796729 - DNA, 25 bp, Mus musculus
tgacagccgttctgcacgagcgttt

SEQ ID NO: 796730 - DNA, 25 bp, Mus musculus
tgacagcctactacggcagatgtgg

SEQ ID NO: 796731 - DNA, 25 bp, Mus musculus
tgacagcctacttcggcagatgtgg

SEQ ID NO: 796732 - DNA, 25 bp, Mus musculus
tgacagcctgatcctagatcaccag

SEQ ID NO: 796733 - DNA, 25 bp, Mus musculus
tgacagcctgatgctagatcaccag

SEQ ID NO: 796734 - DNA, 25 bp, Mus musculus
tgacagccttggctgcgcgtgccaa

SEQ ID NO: 796735 - DNA, 25 bp, Mus musculus
tgacagccttgggtgcgcgtgccaa

SEQ ID NO: 796736 - DNA, 25 bp, Mus musculus
tgacagcgagagagacaacagcgca

SEQ ID NO: 796737 - DNA, 25 bp, Mus musculus
tgacagcgagagtgacaacagcgca

SEQ ID NO: 796738 - DNA, 25 bp, Mus musculus
tgacagcgctggattactgtactgg

SEQ ID NO: 796739 - DNA, 25 bp, Mus musculus
tgacagcgctggtttactgtactgg

SEQ ID NO: 796740 - DNA, 25 bp, Mus musculus
tgacagcggagcacctgaatcactt

SEQ ID NO: 796741 - DNA, 25 bp, Mus musculus
tgacagcggagctcctgaatcactt

SEQ ID NO: 796742 - DNA, 25 bp, Mus musculus
tgacagcggcgtagggaagacatct

SEQ ID NO: 796743 - DNA, 25 bp, Mus musculus
tgacagcggcgttgggaagacatct

SEQ ID NO: 796744 - DNA, 25 bp, Mus musculus
tgacagctacagcacagagggcttg

SEQ ID NO: 796745 - DNA, 25 bp, Mus musculus
tgacagctacaggacagagggcttg

SEQ ID NO: 796746 - DNA, 25 bp, Mus musculus
tgacagctacatcaaatcaaggagc

SEQ ID NO: 796747 - DNA, 25 bp, Mus musculus
tgacagctacatgaaatcaaggagc

SEQ ID NO: 796748 - DNA, 25 bp, Mus musculus
tgacagctataacaacggaggaggc

SEQ ID NO: 796749 - DNA, 25 bp, Mus musculus
tgacagctataagaacggaggaggc

SEQ ID NO: 796750 - DNA, 25 bp, Mus musculus
tgacagctatcaagcgtgcggccag

SEQ ID NO: 796751 - DNA, 25 bp, Mus musculus
tgacagctatcatgcgtgcggccag

SEQ ID NO: 796752 - DNA, 25 bp, Mus musculus
tgacagctatgacccttactcctga

SEQ ID NO: 796753 - DNA, 25 bp, Mus musculus
tgacagctatgagccttactcctga

SEQ ID NO: 796754 - DNA, 25 bp, Mus musculus
tgacagctccagctcagtggatgga

SEQ ID NO: 796755 - DNA, 25 bp, Mus musculus
tgacagctccaggtcagtggatgga

SEQ ID NO: 796756 - DNA, 25 bp, Mus musculus
tgacagctgtctatggactggtggt

SEQ ID NO: 796757 - DNA, 25 bp, Mus musculus
tgacagctgtctttggactggtggt

SEQ ID NO: 796758 - DNA, 25 bp, Mus musculus
tgacagcttccaagagtgagacctg

SEQ ID NO: 796759 - DNA, 25 bp, Mus musculus
tgacagcttccatgagtgagacctg

SEQ ID NO: 796760 - DNA, 25 bp, Mus musculus
tgacagcttgcacccatcagttctg

SEQ ID NO: 796761 - DNA, 25 bp, Mus musculus
tgacagcttgcacttctctccttcg

SEQ ID NO: 796762 - DNA, 25 bp, Mus musculus
tgacagcttgcagccatcagttctg

SEQ ID NO: 796763 - DNA, 25 bp, Mus musculus
tgacagcttgcagttctctccttcg

SEQ ID NO: 796764 - DNA, 25 bp, Mus musculus
tgacaggaacgacccatacacagca

SEQ ID NO: 796765 - DNA, 25 bp, Mus musculus
tgacaggaacgagccatacacagca

SEQ ID NO: 796766 - DNA, 25 bp, Mus musculus
tgacaggaagtccagctcccacgac

SEQ ID NO: 796767 - DNA, 25 bp, Mus musculus
tgacaggaagtcgagctcccacgac

SEQ ID NO: 796768 - DNA, 25 bp, Mus musculus
tgacaggacggcatccctttgcctt

SEQ ID NO: 796769 - DNA, 25 bp, Mus musculus
tgacaggacggcttccctttgcctt

SEQ ID NO: 796770 - DNA, 25 bp, Mus musculus
tgacaggatcatcgtgctggcccag

SEQ ID NO: 796771 - DNA, 25 bp, Mus musculus
tgacaggatcatggtgctggcccag

SEQ ID NO: 796772 - DNA, 25 bp, Mus musculus
tgacaggcacaacgacaacattatg

SEQ ID NO: 796773 - DNA, 25 bp, Mus musculus
tgacaggcacaaggacaacattatg

SEQ ID NO: 796774 - DNA, 25 bp, Mus musculus
tgacaggcataactgacccagtgac

SEQ ID NO: 796775 - DNA, 25 bp, Mus musculus
tgacaggcataagtgacccagtgac

SEQ ID NO: 796776 - DNA, 25 bp, Mus musculus
tgacaggctacgaggctaccaggtg

SEQ ID NO: 796777 - DNA, 25 bp, Mus musculus
tgacaggctacgtggctaccaggtg

SEQ ID NO: 796778 - DNA, 25 bp, Mus musculus
tgacaggctttaattgtaaattccc

SEQ ID NO: 796779 - DNA, 25 bp, Mus musculus
tgacaggctttatttgtaaattccc

SEQ ID NO: 796780 - DNA, 25 bp, Mus musculus
tgacaggcttttcgctcaccgagta

SEQ ID NO: 796781 - DNA, 25 bp, Mus musculus
tgacaggcttttggctcaccgagta

SEQ ID NO: 796782 - DNA, 25 bp, Mus musculus
tgacagggacacagtctgaccggca

SEQ ID NO: 796783 - DNA, 25 bp, Mus musculus
tgacagggacactgtctgaccggca

SEQ ID NO: 796784 - DNA, 25 bp, Mus musculus
tgacagggacagaagcgctgtacca

SEQ ID NO: 796785 - DNA, 25 bp, Mus musculus
tgacagggacagtagcgctgtacca

SEQ ID NO: 796786 - DNA, 25 bp, Mus musculus
tgacagggactgaactgaagatgac

SEQ ID NO: 796787 - DNA, 25 bp, Mus musculus
tgacagggactgtactgaagatgac

SEQ ID NO: 796788 - DNA, 25 bp, Mus musculus
tgacaggtgtctacagaaagtggct

SEQ ID NO: 796789 - DNA, 25 bp, Mus musculus
tgacaggtgtcttcagaaagtggct

SEQ ID NO: 796790 - DNA, 25 bp, Mus musculus
tgacaggtgttgatgctgtctacga

SEQ ID NO: 796791 - DNA, 25 bp, Mus musculus
tgacaggtgttgttgctgtctacga

SEQ ID NO: 796792 - DNA, 25 bp, Mus musculus
tgacaggtttctcgaactatatcct

SEQ ID NO: 796793 - DNA, 25 bp, Mus musculus
tgacaggtttctggaactatatcct

SEQ ID NO: 796794 - DNA, 25 bp, Mus musculus
tgacagtaccttctactgcctacag

SEQ ID NO: 796795 - DNA, 25 bp, Mus musculus
tgacagtaccttgtactgcctacag

SEQ ID NO: 796796 - DNA, 25 bp, Mus musculus
tgacagtagcctccaagaagacaag

SEQ ID NO: 796797 - DNA, 25 bp, Mus musculus
tgacagtagcctgcaagaagacaag

SEQ ID NO: 796798 - DNA, 25 bp, Mus musculus
tgacagtatataatccaggcgggcg

SEQ ID NO: 796799 - DNA, 25 bp, Mus musculus
tgacagtatatattccaggcgggcg

SEQ ID NO: 796800 - DNA, 25 bp, Mus musculus
tgacagtatcatcctaaagaatgac

SEQ ID NO: 796801 - DNA, 25 bp, Mus musculus
tgacagtatcatgctaaagaatgac

SEQ ID NO: 796802 - DNA, 25 bp, Mus musculus
tgacagtccacaacgctctgatgga

SEQ ID NO: 796803 - DNA, 25 bp, Mus musculus
tgacagtccacatcgctctgatgga

SEQ ID NO: 796804 - DNA, 25 bp, Mus musculus
tgacagtccagaactcccaggagac

SEQ ID NO: 796805 - DNA, 25 bp, Mus musculus
tgacagtccagatctcccaggagac

SEQ ID NO: 796806 - DNA, 25 bp, Mus musculus
tgacagtccatgcagaggtacgtgc

SEQ ID NO: 796807 - DNA, 25 bp, Mus musculus
tgacagtccatggagaggtacgtgc

SEQ ID NO: 796808 - DNA, 25 bp, Mus musculus
tgacagtcctatctttgaagatgat

SEQ ID NO: 796809 - DNA, 25 bp, Mus musculus
tgacagtcctatgtttgaagatgat

SEQ ID NO: 796810 - DNA, 25 bp, Mus musculus
tgacagtccttaaatcacccgctac

SEQ ID NO: 796811 - DNA, 25 bp, Mus musculus
tgacagtccttatatcacccgctac

SEQ ID NO: 796812 - DNA, 25 bp, Mus musculus
tgacagtctctaaaccagggatgga

SEQ ID NO: 796813 - DNA, 25 bp, Mus musculus
tgacagtctctataccagggatgga

SEQ ID NO: 796814 - DNA, 25 bp, Mus musculus
tgacagtgaattagacttttcagct

SEQ ID NO: 796815 - DNA, 25 bp, Mus musculus
tgacagtgaatttgacttttcagct

SEQ ID NO: 796816 - DNA, 25 bp, Mus musculus
tgacagtgacagaccggaggacact

SEQ ID NO: 796817 - DNA, 25 bp, Mus musculus
tgacagtgacagtccggaggacact

SEQ ID NO: 796818 - DNA, 25 bp, Mus musculus
tgacagtgaccactcgagcaagaag

SEQ ID NO: 796819 - DNA, 25 bp, Mus musculus
tgacagtgaccagtcgagcaagaag

SEQ ID NO: 796820 - DNA, 25 bp, Mus musculus
tgacagtgagcaccaactgaaggct

SEQ ID NO: 796821 - DNA, 25 bp, Mus musculus
tgacagtgagcagcaactgaaggct

SEQ ID NO: 796822 - DNA, 25 bp, Mus musculus
tgacagtgcaaacaaacatgtgtgg

SEQ ID NO: 796823 - DNA, 25 bp, Mus musculus
tgacagtgcaaagaaacatgtgtgg

SEQ ID NO: 796824 - DNA, 25 bp, Mus musculus
tgacagtggaaactcctgcgtgctg

SEQ ID NO: 796825 - DNA, 25 bp, Mus musculus
tgacagtggaaagtcctgcgtgctg

SEQ ID NO: 796826 - DNA, 25 bp, Mus musculus
tgacagtggcttacacctcaactac

SEQ ID NO: 796827 - DNA, 25 bp, Mus musculus
tgacagtggctttcacctcaactac

SEQ ID NO: 796828 - DNA, 25 bp, Mus musculus
tgacagtgggctatactgctaaagc

SEQ ID NO: 796829 - DNA, 25 bp, Mus musculus
tgacagtgggctttactgctaaagc

SEQ ID NO: 796830 - DNA, 25 bp, Mus musculus
tgacagtgtgtgaagaagacctcca

SEQ ID NO: 796831 - DNA, 25 bp, Mus musculus
tgacagtgtgtgtagaagacctcca

SEQ ID NO: 796832 - DNA, 25 bp, Mus musculus
tgacagttcagacaaggcccctgtg

SEQ ID NO: 796833 - DNA, 25 bp, Mus musculus
tgacagttcagagaaggcccctgtg

SEQ ID NO: 796834 - DNA, 25 bp, Mus musculus
tgacagttcatacagcttccgccac

SEQ ID NO: 796835 - DNA, 25 bp, Mus musculus
tgacagttcatagagcttccgccac

SEQ ID NO: 796836 - DNA, 25 bp, Mus musculus
tgacagttccaacgatgacaaaact

SEQ ID NO: 796837 - DNA, 25 bp, Mus musculus
tgacagttccaaggatgacaaaact

SEQ ID NO: 796838 - DNA, 25 bp, Mus musculus
tgacagttgacccaggctgggcacc

SEQ ID NO: 796839 - DNA, 25 bp, Mus musculus
tgacagttgaccgaggctgggcacc

SEQ ID NO: 796840 - DNA, 25 bp, Mus musculus
tgacataatgatcagggacaacctg

SEQ ID NO: 796841 - DNA, 25 bp, Mus musculus
tgacataatgatgagggacaacctg

SEQ ID NO: 796842 - DNA, 25 bp, Mus musculus
tgacatacaagccacacctacagga

SEQ ID NO: 796843 - DNA, 25 bp, Mus musculus
tgacatacaagcgacacctacagga

SEQ ID NO: 796844 - DNA, 25 bp, Mus musculus
tgacatacatggatgaaggcggcag

SEQ ID NO: 796845 - DNA, 25 bp, Mus musculus
tgacatacatggttgaaggcggcag

SEQ ID NO: 796846 - DNA, 25 bp, Mus musculus
tgacatactgtcacagccgctctga

SEQ ID NO: 796847 - DNA, 25 bp, Mus musculus
tgacatactgtctcagccgctctga

SEQ ID NO: 796848 - DNA, 25 bp, Mus musculus
tgacatagcttcagatgcatttgct

SEQ ID NO: 796849 - DNA, 25 bp, Mus musculus
tgacatagcttctgatgcatttgct

SEQ ID NO: 796850 - DNA, 25 bp, Mus musculus
tgacataggtcaaagcgcaaaccct

SEQ ID NO: 796851 - DNA, 25 bp, Mus musculus
tgacataggtcatagcgcaaaccct

SEQ ID NO: 796852 - DNA, 25 bp, Mus musculus
tgacatagtaataggtatcctggag

SEQ ID NO: 796853 - DNA, 25 bp, Mus musculus
tgacatagtaattggtatcctggag

SEQ ID NO: 796854 - DNA, 25 bp, Mus musculus
tgacatatactccaggctgttgcgg

SEQ ID NO: 796855 - DNA, 25 bp, Mus musculus
tgacatatactcgaggctgttgcgg

SEQ ID NO: 796856 - DNA, 25 bp, Mus musculus
tgacatatgcccacatccatgctgg

SEQ ID NO: 796857 - DNA, 25 bp, Mus musculus
tgacatatgccctcatccatgctgg

SEQ ID NO: 796858 - DNA, 25 bp, Mus musculus
tgacatattcaaagactatgcggcc

SEQ ID NO: 796859 - DNA, 25 bp, Mus musculus
tgacatattcaatgactatgcggcc

SEQ ID NO: 796860 - DNA, 25 bp, Mus musculus
tgacatcaaccgagagccccttatt

SEQ ID NO: 796861 - DNA, 25 bp, Mus musculus
tgacatcaaccgtgagccccttatt

SEQ ID NO: 796862 - DNA, 25 bp, Mus musculus
tgacatcaagagagtatttgaagcc

SEQ ID NO: 796863 - DNA, 25 bp, Mus musculus
tgacatcaagagtgtatttgaagcc

SEQ ID NO: 796864 - DNA, 25 bp, Mus musculus
tgacatcaagatccattgctgtgtg

SEQ ID NO: 796865 - DNA, 25 bp, Mus musculus
tgacatcaagatgcattgctgtgtg

SEQ ID NO: 796866 - DNA, 25 bp, Mus musculus
tgacatcaagttcaactaccaccat

SEQ ID NO: 796867 - DNA, 25 bp, Mus musculus
tgacatcaagttgaactaccaccat

SEQ ID NO: 796868 - DNA, 25 bp, Mus musculus
tgacatcacaaaagaagaatccttc

SEQ ID NO: 796869 - DNA, 25 bp, Mus musculus
tgacatcacaaatgaagaatccttc

SEQ ID NO: 796870 - DNA, 25 bp, Mus musculus
tgacatcaccaaccagtcctctttt

SEQ ID NO: 796871 - DNA, 25 bp, Mus musculus
tgacatcaccaagcagtcctctttt

SEQ ID NO: 796872 - DNA, 25 bp, Mus musculus
tgacatcacccgagataatctggag

SEQ ID NO: 796873 - DNA, 25 bp, Mus musculus
tgacatcacccgtgataatctggag

SEQ ID NO: 796874 - DNA, 25 bp, Mus musculus
tgacatcacgctcacagtagacggc

SEQ ID NO: 796875 - DNA, 25 bp, Mus musculus
tgacatcacgctgacagtagacggc

SEQ ID NO: 796876 - DNA, 25 bp, Mus musculus
tgacatcagaagaaaaccggctgct

SEQ ID NO: 796877 - DNA, 25 bp, Mus musculus
tgacatcagaagtaaaccggctgct

SEQ ID NO: 796878 - DNA, 25 bp, Mus musculus
tgacatcagatgaaccatcgctggg

SEQ ID NO: 796879 - DNA, 25 bp, Mus musculus
tgacatcagatgtaccatcgctggg

SEQ ID NO: 796880 - DNA, 25 bp, Mus musculus
tgacatcagcaacggtggacatcca

SEQ ID NO: 796881 - DNA, 25 bp, Mus musculus
tgacatcagcaacgtgtcccacaac

SEQ ID NO: 796882 - DNA, 25 bp, Mus musculus
tgacatcagcaagggtggacatcca

SEQ ID NO: 796883 - DNA, 25 bp, Mus musculus
tgacatcagcaaggtgtcccacaac

SEQ ID NO: 796884 - DNA, 25 bp, Mus musculus
tgacatcagcccagacccggaagat

SEQ ID NO: 796885 - DNA, 25 bp, Mus musculus
tgacatcagccctgacccggaagat

SEQ ID NO: 796886 - DNA, 25 bp, Mus musculus
tgacatcaggatatctggtctcccc

SEQ ID NO: 796887 - DNA, 25 bp, Mus musculus
tgacatcaggatttctggtctcccc

SEQ ID NO: 796888 - DNA, 25 bp, Mus musculus
tgacatcatgaccagtgaccacagc

SEQ ID NO: 796889 - DNA, 25 bp, Mus musculus
tgacatcatgacgagtgaccacagc

SEQ ID NO: 796890 - DNA, 25 bp, Mus musculus
tgacatccaagcaaaagaagaactg

SEQ ID NO: 796891 - DNA, 25 bp, Mus musculus
tgacatccaagctaaagaagaactg

SEQ ID NO: 796892 - DNA, 25 bp, Mus musculus
tgacatccagaccaagatgactgag

SEQ ID NO: 796893 - DNA, 25 bp, Mus musculus
tgacatccagacgaagatgactgag

SEQ ID NO: 796894 - DNA, 25 bp, Mus musculus
tgacatccgctgaggagaggaaacc

SEQ ID NO: 796895 - DNA, 25 bp, Mus musculus
tgacatccgctgtggagaggaaacc

SEQ ID NO: 796896 - DNA, 25 bp, Mus musculus
tgacatccgtgtcgctggcacagga

SEQ ID NO: 796897 - DNA, 25 bp, Mus musculus
tgacatccgtgtggctggcacagga

SEQ ID NO: 796898 - DNA, 25 bp, Mus musculus
tgacatcctcaaccaggagcaggcg

SEQ ID NO: 796899 - DNA, 25 bp, Mus musculus
tgacatcctcaagcaggagcaggcg

SEQ ID NO: 796900 - DNA, 25 bp, Mus musculus
tgacatcctcagatgacccttggga

SEQ ID NO: 796901 - DNA, 25 bp, Mus musculus
tgacatcctcagttgacccttggga

SEQ ID NO: 796902 - DNA, 25 bp, Mus musculus
tgacatcctcatccgaaaatttgac

SEQ ID NO: 796903 - DNA, 25 bp, Mus musculus
tgacatcctcatgcgaaaatttgac

SEQ ID NO: 796904 - DNA, 25 bp, Mus musculus
tgacatcctgtaacccaaggattct

SEQ ID NO: 796905 - DNA, 25 bp, Mus musculus
tgacatcctgtatcccaaggattct

SEQ ID NO: 796906 - DNA, 25 bp, Mus musculus
tgacatccttgtagggaccccaggg

SEQ ID NO: 796907 - DNA, 25 bp, Mus musculus
tgacatccttgttgggaccccaggg

SEQ ID NO: 796908 - DNA, 25 bp, Mus musculus
tgacatcgctacagtacaggatatg

SEQ ID NO: 796909 - DNA, 25 bp, Mus musculus
tgacatcgctactgtacaggatatg

SEQ ID NO: 796910 - DNA, 25 bp, Mus musculus
tgacatcggcctcgccgacctccga

SEQ ID NO: 796911 - DNA, 25 bp, Mus musculus
tgacatcggcctggccgacctccga

SEQ ID NO: 796912 - DNA, 25 bp, Mus musculus
tgacatcggcttagctgctggccct

SEQ ID NO: 796913 - DNA, 25 bp, Mus musculus
tgacatcggctttgctgctggccct

SEQ ID NO: 796914 - DNA, 25 bp, Mus musculus
tgacatctaccgcttataccaaagc

SEQ ID NO: 796915 - DNA, 25 bp, Mus musculus
tgacatctaccggttataccaaagc

SEQ ID NO: 796916 - DNA, 25 bp, Mus musculus
tgacatctacgaccttccggaaagg

SEQ ID NO: 796917 - DNA, 25 bp, Mus musculus
tgacatctacgagcttccggaaagg

SEQ ID NO: 796918 - DNA, 25 bp, Mus musculus
tgacatctatgacttccacttctct

SEQ ID NO: 796919 - DNA, 25 bp, Mus musculus
tgacatctatgagttccacttctct

SEQ ID NO: 796920 - DNA, 25 bp, Mus musculus
tgacatctccagctggttgtataca

SEQ ID NO: 796921 - DNA, 25 bp, Mus musculus
tgacatctccaggtggttgtataca

SEQ ID NO: 796922 - DNA, 25 bp, Mus musculus
tgacatctctgcagtagtagacaaa

SEQ ID NO: 796923 - DNA, 25 bp, Mus musculus
tgacatctctgctgtagtagacaaa

SEQ ID NO: 796924 - DNA, 25 bp, Mus musculus
tgacatctcttcagactgtcccagg

SEQ ID NO: 796925 - DNA, 25 bp, Mus musculus
tgacatctcttctgactgtcccagg

SEQ ID NO: 796926 - DNA, 25 bp, Mus musculus
tgacatctgtgtatgcccgccacaa

SEQ ID NO: 796927 - DNA, 25 bp, Mus musculus
tgacatctgtgtttgcccgccacaa

SEQ ID NO: 796928 - DNA, 25 bp, Mus musculus
tgacatgaagctcctggaacagaga

SEQ ID NO: 796929 - DNA, 25 bp, Mus musculus
tgacatgaagctgctggaacagaga

SEQ ID NO: 796930 - DNA, 25 bp, Mus musculus
tgacatgaaggaattcgccaactgg

SEQ ID NO: 796931 - DNA, 25 bp, Mus musculus
tgacatgaaggatttcgccaactgg

SEQ ID NO: 796932 - DNA, 25 bp, Mus musculus
tgacatgaccataggcacagactca

SEQ ID NO: 796933 - DNA, 25 bp, Mus musculus
tgacatgaccattggcacagactca

SEQ ID NO: 796934 - DNA, 25 bp, Mus musculus
tgacatgactctaagtaggttttcc

SEQ ID NO: 796935 - DNA, 25 bp, Mus musculus
tgacatgactcttagtaggttttcc

SEQ ID NO: 796936 - DNA, 25 bp, Mus musculus
tgacatgagcaacgagtctacatgg

SEQ ID NO: 796937 - DNA, 25 bp, Mus musculus
tgacatgagcaaggagtctacatgg

SEQ ID NO: 796938 - DNA, 25 bp, Mus musculus
tgacatgaggctactggacggagat

SEQ ID NO: 796939 - DNA, 25 bp, Mus musculus
tgacatgaggcttctggacggagat

SEQ ID NO: 796940 - DNA, 25 bp, Mus musculus
tgacatgatcaaactcagaactcag

SEQ ID NO: 796941 - DNA, 25 bp, Mus musculus
tgacatgatcaatctcagaactcag

SEQ ID NO: 796942 - DNA, 25 bp, Mus musculus
tgacatgatgttaccgcaaagccgg

SEQ ID NO: 796943 - DNA, 25 bp, Mus musculus
tgacatgatgtttccgcaaagccgg

SEQ ID NO: 796944 - DNA, 25 bp, Mus musculus
tgacatgattccatgcatcctgcag

SEQ ID NO: 796945 - DNA, 25 bp, Mus musculus
tgacatgattccttgcatcctgcag

SEQ ID NO: 796946 - DNA, 25 bp, Mus musculus
tgacatgcaaaaccaccgtgtagtg

SEQ ID NO: 796947 - DNA, 25 bp, Mus musculus
tgacatgcaaaagcaccgtgtagtg

SEQ ID NO: 796948 - DNA, 25 bp, Mus musculus
tgacatgcaagacgttgttctgagc

SEQ ID NO: 796949 - DNA, 25 bp, Mus musculus
tgacatgcaagaggttgttctgagc

SEQ ID NO: 796950 - DNA, 25 bp, Mus musculus
tgacatgcaccgattacatccctcg

SEQ ID NO: 796951 - DNA, 25 bp, Mus musculus
tgacatgcaccgtttacatccctcg

SEQ ID NO: 796952 - DNA, 25 bp, Mus musculus
tgacatgcacgcagctgcagacatc

SEQ ID NO: 796953 - DNA, 25 bp, Mus musculus
tgacatgcacgctgctgcagacatc

SEQ ID NO: 796954 - DNA, 25 bp, Mus musculus
tgacatgcacgtcgccgacatgctt

SEQ ID NO: 796955 - DNA, 25 bp, Mus musculus
tgacatgcacgtggccgacatgctt

SEQ ID NO: 796956 - DNA, 25 bp, Mus musculus
tgacatgccgatctccttggatggg

SEQ ID NO: 796957 - DNA, 25 bp, Mus musculus
tgacatgccgatgtccttggatggg

SEQ ID NO: 796958 - DNA, 25 bp, Mus musculus
tgacatgcctcacggatccttggcc

SEQ ID NO: 796959 - DNA, 25 bp, Mus musculus
tgacatgcctcagggatccttggcc

SEQ ID NO: 796960 - DNA, 25 bp, Mus musculus
tgacatgcgggccttggcgaaaaac

SEQ ID NO: 796961 - DNA, 25 bp, Mus musculus
tgacatgcgggcgttggcgaaaaac

SEQ ID NO: 796962 - DNA, 25 bp, Mus musculus
tgacatgctatacccttgcccaggg

SEQ ID NO: 796963 - DNA, 25 bp, Mus musculus
tgacatgctatagccttgcccaggg

SEQ ID NO: 796964 - DNA, 25 bp, Mus musculus
tgacatgctcatcgtgaagccggga

SEQ ID NO: 796965 - DNA, 25 bp, Mus musculus
tgacatgctcatggtgaagccggga

SEQ ID NO: 796966 - DNA, 25 bp, Mus musculus
tgacatgctccgctctttggccact

SEQ ID NO: 796967 - DNA, 25 bp, Mus musculus
tgacatgctccggtctttggccact

SEQ ID NO: 796968 - DNA, 25 bp, Mus musculus
tgacatggaataagcccagccttag

SEQ ID NO: 796969 - DNA, 25 bp, Mus musculus
tgacatggaatatgcccagccttag

SEQ ID NO: 796970 - DNA, 25 bp, Mus musculus
tgacatggactgagtgcacaggagt

SEQ ID NO: 796971 - DNA, 25 bp, Mus musculus
tgacatggactgtgtgcacaggagt

SEQ ID NO: 796972 - DNA, 25 bp, Mus musculus
tgacatggagaccttgtgtatggcc

SEQ ID NO: 796973 - DNA, 25 bp, Mus musculus
tgacatggagacgttgtgtatggcc

SEQ ID NO: 796974 - DNA, 25 bp, Mus musculus
tgacatggagggatgtgagccctat

SEQ ID NO: 796975 - DNA, 25 bp, Mus musculus
tgacatggagggttgtgagccctat

SEQ ID NO: 796976 - DNA, 25 bp, Mus musculus
tgacatgggcgccagcggctccaaa

SEQ ID NO: 796977 - DNA, 25 bp, Mus musculus
tgacatgggcgcgagcggctccaaa

SEQ ID NO: 796978 - DNA, 25 bp, Mus musculus
tgacatggtccactctgttgctcta

SEQ ID NO: 796979 - DNA, 25 bp, Mus musculus
tgacatggtccagtctgttgctcta

SEQ ID NO: 796980 - DNA, 25 bp, Mus musculus
tgacatggtcttcttcctgcaaggc

SEQ ID NO: 796981 - DNA, 25 bp, Mus musculus
tgacatggtcttgttcctgcaaggc

SEQ ID NO: 796982 - DNA, 25 bp, Mus musculus
tgacatggttagctaactgccctgg

SEQ ID NO: 796983 - DNA, 25 bp, Mus musculus
tgacatggttaggtaactgccctgg

SEQ ID NO: 796984 - DNA, 25 bp, Mus musculus
tgacatgtacatactcaacgagagc

SEQ ID NO: 796985 - DNA, 25 bp, Mus musculus
tgacatgtacattctcaacgagagc

SEQ ID NO: 796986 - DNA, 25 bp, Mus musculus
tgacatgtcaggcaatccctccagg

SEQ ID NO: 796987 - DNA, 25 bp, Mus musculus
tgacatgtcagggaatccctccagg

SEQ ID NO: 796988 - DNA, 25 bp, Mus musculus
tgacatgtctaccactcagggctgt

SEQ ID NO: 796989 - DNA, 25 bp, Mus musculus
tgacatgtctacgactcagggctgt

SEQ ID NO: 796990 - DNA, 25 bp, Mus musculus
tgacattaacatctcgggctttcta

SEQ ID NO: 796991 - DNA, 25 bp, Mus musculus
tgacattaacatgtcgggctttcta

SEQ ID NO: 796992 - DNA, 25 bp, Mus musculus
tgacattaaccgagtccccgaggag

SEQ ID NO: 796993 - DNA, 25 bp, Mus musculus
tgacattaaccgtgtccccgaggag

SEQ ID NO: 796994 - DNA, 25 bp, Mus musculus
tgacattaaggaccagccagaaaat

SEQ ID NO: 796995 - DNA, 25 bp, Mus musculus
tgacattaaggagcagccagaaaat

SEQ ID NO: 796996 - DNA, 25 bp, Mus musculus
tgacattatgctaggcaacaaaaaa

SEQ ID NO: 796997 - DNA, 25 bp, Mus musculus
tgacattatgcttggcaacaaaaaa

SEQ ID NO: 796998 - DNA, 25 bp, Mus musculus
tgacattcgctactgcactcaggat

SEQ ID NO: 796999 - DNA, 25 bp, Mus musculus
tgacattcgctagtgcactcaggat

SEQ ID NO: 797000 - DNA, 25 bp, Mus musculus
tgacattctgttagaggacacagcg

SEQ ID NO: 797001 - DNA, 25 bp, Mus musculus
tgacattctgtttgaggacacagcg

SEQ ID NO: 797002 - DNA, 25 bp, Mus musculus
tgacattgagtcactgcagcgtgag

SEQ ID NO: 797003 - DNA, 25 bp, Mus musculus
tgacattgagtctctgcagcgtgag

SEQ ID NO: 797004 - DNA, 25 bp, Mus musculus
tgacattgatcaagatggaaaactc

SEQ ID NO: 797005 - DNA, 25 bp, Mus musculus
tgacattgatcatgatggaaaactc

SEQ ID NO: 797006 - DNA, 25 bp, Mus musculus
tgacattgcaacaggaaagcttttg

SEQ ID NO: 797007 - DNA, 25 bp, Mus musculus
tgacattgcaactggaaagcttttg

SEQ ID NO: 797008 - DNA, 25 bp, Mus musculus
tgacattgcacaccttagtaagact

SEQ ID NO: 797009 - DNA, 25 bp, Mus musculus
tgacattgcacagcttagtaagact

SEQ ID NO: 797010 - DNA, 25 bp, Mus musculus
tgacattgctggagagtttgaccca

SEQ ID NO: 797011 - DNA, 25 bp, Mus musculus
tgacattgctggtgagtttgaccca

SEQ ID NO: 797012 - DNA, 25 bp, Mus musculus
tgacattggccaagctgcagaacaa

SEQ ID NO: 797013 - DNA, 25 bp, Mus musculus
tgacattggccatgctgcagaacaa

SEQ ID NO: 797014 - DNA, 25 bp, Mus musculus
tgacattggtggacaaatgggattg

SEQ ID NO: 797015 - DNA, 25 bp, Mus musculus
tgacattggtggtcaaatgggattg

SEQ ID NO: 797016 - DNA, 25 bp, Mus musculus
tgacattgtgatctgggacccagaa

SEQ ID NO: 797017 - DNA, 25 bp, Mus musculus
tgacattgtgatgtgggacccagaa

SEQ ID NO: 797018 - DNA, 25 bp, Mus musculus
tgacattgtggtaccggcctccgga

SEQ ID NO: 797019 - DNA, 25 bp, Mus musculus
tgacattgtggttccggcctccgga

SEQ ID NO: 797020 - DNA, 25 bp, Mus musculus
tgacatttatcaccgtgggacatcg

SEQ ID NO: 797021 - DNA, 25 bp, Mus musculus
tgacatttatcagcgtgggacatcg

SEQ ID NO: 797022 - DNA, 25 bp, Mus musculus
tgacatttccaccacctcttggcag

SEQ ID NO: 797023 - DNA, 25 bp, Mus musculus
tgacatttccacgacctcttggcag

SEQ ID NO: 797024 - DNA, 25 bp, Mus musculus
tgacatttggtcagttgggtgcatc

SEQ ID NO: 797025 - DNA, 25 bp, Mus musculus
tgacatttggtctgttgggtgcatc

SEQ ID NO: 797026 - DNA, 25 bp, Mus musculus
tgacatttgtcacagagcaagaggt

SEQ ID NO: 797027 - DNA, 25 bp, Mus musculus
tgacatttgtcagagagcaagaggt

SEQ ID NO: 797028 - DNA, 25 bp, Mus musculus
tgacatttgtctacgaggcatagat

SEQ ID NO: 797029 - DNA, 25 bp, Mus musculus
tgacatttgtcttcgaggcatagat

SEQ ID NO: 797030 - DNA, 25 bp, Mus musculus
tgaccaaaaaccacaaaggcttctt

SEQ ID NO: 797031 - DNA, 25 bp, Mus musculus
tgaccaaaaacctcaaaggcttctt

SEQ ID NO: 797032 - DNA, 25 bp, Mus musculus
tgaccaaaaccgagccttgtggaaa

SEQ ID NO: 797033 - DNA, 25 bp, Mus musculus
tgaccaaaaccgtgccttgtggaaa

SEQ ID NO: 797034 - DNA, 25 bp, Mus musculus
tgaccaaaattcagaagcaccagga

SEQ ID NO: 797035 - DNA, 25 bp, Mus musculus
tgaccaaaattctgaagcaccagga

SEQ ID NO: 797036 - DNA, 25 bp, Mus musculus
tgaccaaacgagagcatggacccaa

SEQ ID NO: 797037 - DNA, 25 bp, Mus musculus
tgaccaaacgagtgcatggacccaa

SEQ ID NO: 797038 - DNA, 25 bp, Mus musculus
tgaccaaagcaaacgggagcatctc

SEQ ID NO: 797039 - DNA, 25 bp, Mus musculus
tgaccaaagcaatcgggagcatctc

SEQ ID NO: 797040 - DNA, 25 bp, Mus musculus
tgaccaaatctactctgagttccgt

SEQ ID NO: 797041 - DNA, 25 bp, Mus musculus
tgaccaaatctagtctgagttccgt

SEQ ID NO: 797042 - DNA, 25 bp, Mus musculus
tgaccaacacgaacactgaaaagct

SEQ ID NO: 797043 - DNA, 25 bp, Mus musculus
tgaccaacacgatcactgaaaagct

SEQ ID NO: 797044 - DNA, 25 bp, Mus musculus
tgaccaacccctaagtgggctccgg

SEQ ID NO: 797045 - DNA, 25 bp, Mus musculus
tgaccaaccccttagtgggctccgg

SEQ ID NO: 797046 - DNA, 25 bp, Mus musculus
tgaccaaccggaacgaggaaggaga

SEQ ID NO: 797047 - DNA, 25 bp, Mus musculus
tgaccaaccggatcgaggaaggaga

SEQ ID NO: 797048 - DNA, 25 bp, Mus musculus
tgaccaacctaactcacagcgaggc

SEQ ID NO: 797049 - DNA, 25 bp, Mus musculus
tgaccaacctaagtcacagcgaggc

SEQ ID NO: 797050 - DNA, 25 bp, Mus musculus
tgaccaagaaacagaaacagtgccc

SEQ ID NO: 797051 - DNA, 25 bp, Mus musculus
tgaccaagaaactgaaacagtgccc

SEQ ID NO: 797052 - DNA, 25 bp, Mus musculus
tgaccaagacaacagcgattaacgg

SEQ ID NO: 797053 - DNA, 25 bp, Mus musculus
tgaccaagacaagagcgattaacgg

SEQ ID NO: 797054 - DNA, 25 bp, Mus musculus
tgaccaagaggtcctagcagagctg

SEQ ID NO: 797055 - DNA, 25 bp, Mus musculus
tgaccaagaggtgctagcagagctg

SEQ ID NO: 797056 - DNA, 25 bp, Mus musculus
tgaccaagatgacgaaaaccaaagc

SEQ ID NO: 797057 - DNA, 25 bp, Mus musculus
tgaccaagatgaggaaaaccaaagc

SEQ ID NO: 797058 - DNA, 25 bp, Mus musculus
tgaccaagcaccagacctacgctgt

SEQ ID NO: 797059 - DNA, 25 bp, Mus musculus
tgaccaagcacctgacctacgctgt

SEQ ID NO: 797060 - DNA, 25 bp, Mus musculus
tgaccaagcagcagcttcactgtat

SEQ ID NO: 797061 - DNA, 25 bp, Mus musculus
tgaccaagcagctgcttcactgtat

SEQ ID NO: 797062 - DNA, 25 bp, Mus musculus
tgaccaagcgagagtgtgaagccct

SEQ ID NO: 797063 - DNA, 25 bp, Mus musculus
tgaccaagcgagtgtgtgaagccct

SEQ ID NO: 797064 - DNA, 25 bp, Mus musculus
tgaccaagctggcattcgtctcctg

SEQ ID NO: 797065 - DNA, 25 bp, Mus musculus
tgaccaagctgggattcgtctcctg

SEQ ID NO: 797066 - DNA, 25 bp, Mus musculus
tgaccaaggacaagactggaaagga

SEQ ID NO: 797067 - DNA, 25 bp, Mus musculus
tgaccaaggacatgactggaaagga

SEQ ID NO: 797068 - DNA, 25 bp, Mus musculus
tgaccaaggagtatggcacagatca

SEQ ID NO: 797069 - DNA, 25 bp, Mus musculus
tgaccaaggagtttggcacagatca

SEQ ID NO: 797070 - DNA, 25 bp, Mus musculus
tgaccaaggcagatacgtagaatct

SEQ ID NO: 797071 - DNA, 25 bp, Mus musculus
tgaccaaggcagttacgtagaatct

SEQ ID NO: 797072 - DNA, 25 bp, Mus musculus
tgaccaaggccgagctgtccctgca

SEQ ID NO: 797073 - DNA, 25 bp, Mus musculus
tgaccaaggccgtgctgtccctgca

SEQ ID NO: 797074 - DNA, 25 bp, Mus musculus
tgaccaagtggactaacgagaagcc

SEQ ID NO: 797075 - DNA, 25 bp, Mus musculus
tgaccaagtggagtaacgagaagcc

SEQ ID NO: 797076 - DNA, 25 bp, Mus musculus
tgaccaataagcctgaggctccttt

SEQ ID NO: 797077 - DNA, 25 bp, Mus musculus
tgaccaataagcgtgaggctccttt

SEQ ID NO: 797078 - DNA, 25 bp, Mus musculus
tgaccaataatgaagccatgctgag

SEQ ID NO: 797079 - DNA, 25 bp, Mus musculus
tgaccaataatgtagccatgctgag

SEQ ID NO: 797080 - DNA, 25 bp, Mus musculus
tgaccaatcagtaccccatggttct

SEQ ID NO: 797081 - DNA, 25 bp, Mus musculus
tgaccaatcagttccccatggttct

SEQ ID NO: 797082 - DNA, 25 bp, Mus musculus
tgaccaatgcccaggtgggcatgag

SEQ ID NO: 797083 - DNA, 25 bp, Mus musculus
tgaccaatgccctggtgggcatgag

SEQ ID NO: 797084 - DNA, 25 bp, Mus musculus
tgaccaattctgacctgctcaatgg

SEQ ID NO: 797085 - DNA, 25 bp, Mus musculus
tgaccaattctgtcctgctcaatgg

SEQ ID NO: 797086 - DNA, 25 bp, Mus musculus
tgaccacaaagacatccatagcagt

SEQ ID NO: 797087 - DNA, 25 bp, Mus musculus
tgaccacaaagagatccatagcagt

SEQ ID NO: 797088 - DNA, 25 bp, Mus musculus
tgaccacaacaaagcagtgatggct

SEQ ID NO: 797089 - DNA, 25 bp, Mus musculus
tgaccacaacaatgcagtgatggct

SEQ ID NO: 797090 - DNA, 25 bp, Mus musculus
tgaccacaaccgaactgcaataaag

SEQ ID NO: 797091 - DNA, 25 bp, Mus musculus
tgaccacaaccgtactgcaataaag

SEQ ID NO: 797092 - DNA, 25 bp, Mus musculus
tgaccacaagcccatctggatgcat

SEQ ID NO: 797093 - DNA, 25 bp, Mus musculus
tgaccacaagccgatctggatgcat

SEQ ID NO: 797094 - DNA, 25 bp, Mus musculus
tgaccacacaagctaggcagcgttt

SEQ ID NO: 797095 - DNA, 25 bp, Mus musculus
tgaccacacaaggtaggcagcgttt

SEQ ID NO: 797096 - DNA, 25 bp, Mus musculus
tgaccacactggcactggacgtgtc

SEQ ID NO: 797097 - DNA, 25 bp, Mus musculus
tgaccacactgggactggacgtgtc

SEQ ID NO: 797098 - DNA, 25 bp, Mus musculus
tgaccacaggaccagcccactggga

SEQ ID NO: 797099 - DNA, 25 bp, Mus musculus
tgaccacaggacgagcccactggga

SEQ ID NO: 797100 - DNA, 25 bp, Mus musculus
tgaccacagtgccagaaactgccac

SEQ ID NO: 797101 - DNA, 25 bp, Mus musculus
tgaccacagtgcgagaaactgccac

SEQ ID NO: 797102 - DNA, 25 bp, Mus musculus
tgaccacatcaacggctggatccgg

SEQ ID NO: 797103 - DNA, 25 bp, Mus musculus
tgaccacatcaagggctggatccgg

SEQ ID NO: 797104 - DNA, 25 bp, Mus musculus
tgaccacattctctatacagggaac

SEQ ID NO: 797105 - DNA, 25 bp, Mus musculus
tgaccacattctgtatacagggaac

SEQ ID NO: 797106 - DNA, 25 bp, Mus musculus
tgaccaccaaaaatgtaccgccgtg

SEQ ID NO: 797107 - DNA, 25 bp, Mus musculus
tgaccaccaaaattgtaccgccgtg

SEQ ID NO: 797108 - DNA, 25 bp, Mus musculus
tgaccaccatctatcagattgagca

SEQ ID NO: 797109 - DNA, 25 bp, Mus musculus
tgaccaccatctttcagattgagca

SEQ ID NO: 797110 - DNA, 25 bp, Mus musculus
tgaccaccctggcaaaggtcatctc

SEQ ID NO: 797111 - DNA, 25 bp, Mus musculus
tgaccaccctgggaaaggtcatctc

SEQ ID NO: 797112 - DNA, 25 bp, Mus musculus
tgaccaccgaataggaggctacaag

SEQ ID NO: 797113 - DNA, 25 bp, Mus musculus
tgaccaccgaattggaggctacaag

SEQ ID NO: 797114 - DNA, 25 bp, Mus musculus
tgaccacctaccaacaggagaagct

SEQ ID NO: 797115 - DNA, 25 bp, Mus musculus
tgaccacctacctacaggagaagct

SEQ ID NO: 797116 - DNA, 25 bp, Mus musculus
tgaccacctgccaagttggttttgg

SEQ ID NO: 797117 - DNA, 25 bp, Mus musculus
tgaccacctgcctagttggttttgg

SEQ ID NO: 797118 - DNA, 25 bp, Mus musculus
tgaccacctgggactggactcgagc

SEQ ID NO: 797119 - DNA, 25 bp, Mus musculus
tgaccacctgggtctggactcgagc

SEQ ID NO: 797120 - DNA, 25 bp, Mus musculus
tgaccacgaacaccatagcaccatt

SEQ ID NO: 797121 - DNA, 25 bp, Mus musculus
tgaccacgaacagcatagcaccatt

SEQ ID NO: 797122 - DNA, 25 bp, Mus musculus
tgaccacgaagcaacagcgatgatg

SEQ ID NO: 797123 - DNA, 25 bp, Mus musculus
tgaccacgaagctacagcgatgatg

SEQ ID NO: 797124 - DNA, 25 bp, Mus musculus
tgaccacggcaacatggccttgaac

SEQ ID NO: 797125 - DNA, 25 bp, Mus musculus
tgaccacggcaagatggccttgaac

SEQ ID NO: 797126 - DNA, 25 bp, Mus musculus
tgaccacgttttccgtcacataaac

SEQ ID NO: 797127 - DNA, 25 bp, Mus musculus
tgaccacgttttgcgtcacataaac

SEQ ID NO: 797128 - DNA, 25 bp, Mus musculus
tgaccactagcacggctcttagaac

SEQ ID NO: 797129 - DNA, 25 bp, Mus musculus
tgaccactagcagggctcttagaac

SEQ ID NO: 797130 - DNA, 25 bp, Mus musculus
tgaccactcatgcagtgtgaccagc

SEQ ID NO: 797131 - DNA, 25 bp, Mus musculus
tgaccactcatggagtgtgaccagc

SEQ ID NO: 797132 - DNA, 25 bp, Mus musculus
tgaccactccagaaacacgtcggga

SEQ ID NO: 797133 - DNA, 25 bp, Mus musculus
tgaccactccagtaacacgtcggga

SEQ ID NO: 797134 - DNA, 25 bp, Mus musculus
tgaccactccgcctctgctggaatg

SEQ ID NO: 797135 - DNA, 25 bp, Mus musculus
tgaccactccgcgtctgctggaatg

SEQ ID NO: 797136 - DNA, 25 bp, Mus musculus
tgaccactcgagcaagaagtcccac

SEQ ID NO: 797137 - DNA, 25 bp, Mus musculus
tgaccactcgaggaagaagtcccac

SEQ ID NO: 797138 - DNA, 25 bp, Mus musculus
tgaccactctccaaaatatacctgt

SEQ ID NO: 797139 - DNA, 25 bp, Mus musculus
tgaccactctcctaaatatacctgt

SEQ ID NO: 797140 - DNA, 25 bp, Mus musculus
tgaccactgctgagaaattaaaaag

SEQ ID NO: 797141 - DNA, 25 bp, Mus musculus
tgaccactgctgtgaaattaaaaag

SEQ ID NO: 797142 - DNA, 25 bp, Mus musculus
tgaccactggaaagaccgctacctt

SEQ ID NO: 797143 - DNA, 25 bp, Mus musculus
tgaccactggaatgaccgctacctt

SEQ ID NO: 797144 - DNA, 25 bp, Mus musculus
tgaccactggctaggatctccttga

SEQ ID NO: 797145 - DNA, 25 bp, Mus musculus
tgaccactggcttggatctccttga

SEQ ID NO: 797146 - DNA, 25 bp, Mus musculus
tgaccacttagacggacataggact

SEQ ID NO: 797147 - DNA, 25 bp, Mus musculus
tgaccacttagagggacataggact

SEQ ID NO: 797148 - DNA, 25 bp, Mus musculus
tgaccacttgcaaaaacagccggcc

SEQ ID NO: 797149 - DNA, 25 bp, Mus musculus
tgaccacttgcataaacagccggcc

SEQ ID NO: 797150 - DNA, 25 bp, Mus musculus
tgaccagaatgaagcccggaaatac

SEQ ID NO: 797151 - DNA, 25 bp, Mus musculus
tgaccagaatgatgcccggaaatac

SEQ ID NO: 797152 - DNA, 25 bp, Mus musculus
tgaccagaatggagctgtggcccgg

SEQ ID NO: 797153 - DNA, 25 bp, Mus musculus
tgaccagaatggtgctgtggcccgg

SEQ ID NO: 797154 - DNA, 25 bp, Mus musculus
tgaccagagaaaacctttctgcagg

SEQ ID NO: 797155 - DNA, 25 bp, Mus musculus
tgaccagagaaatcctttctgcagg

SEQ ID NO: 797156 - DNA, 25 bp, Mus musculus
tgaccagagcacatccggttctgag

SEQ ID NO: 797157 - DNA, 25 bp, Mus musculus
tgaccagagcacttccggttctgag

SEQ ID NO: 797158 - DNA, 25 bp, Mus musculus
tgaccagagcgaccaccggctggca

SEQ ID NO: 797159 - DNA, 25 bp, Mus musculus
tgaccagagcgagcaccggctggca

SEQ ID NO: 797160 - DNA, 25 bp, Mus musculus
tgaccagagttcaggtgcccggccc

SEQ ID NO: 797161 - DNA, 25 bp, Mus musculus
tgaccagagttctggtgcccggccc

SEQ ID NO: 797162 - DNA, 25 bp, Mus musculus
tgaccagatcgaaggaatagttcat

SEQ ID NO: 797163 - DNA, 25 bp, Mus musculus
tgaccagatcgatggaatagttcat

SEQ ID NO: 797164 - DNA, 25 bp, Mus musculus
tgaccagatcgtagaaatcaatggg

SEQ ID NO: 797165 - DNA, 25 bp, Mus musculus
tgaccagatcgttgaaatcaatggg

SEQ ID NO: 797166 - DNA, 25 bp, Mus musculus
tgaccagcaagcagatcatttcccc

SEQ ID NO: 797167 - DNA, 25 bp, Mus musculus
tgaccagcaagctgatcatttcccc

SEQ ID NO: 797168 - DNA, 25 bp, Mus musculus
tgaccagcacaaatgctgccaaaat

SEQ ID NO: 797169 - DNA, 25 bp, Mus musculus
tgaccagcacaattgctgccaaaat

SEQ ID NO: 797170 - DNA, 25 bp, Mus musculus
tgaccagcaggaactatcaaaccga

SEQ ID NO: 797171 - DNA, 25 bp, Mus musculus
tgaccagcaggatctatcaaaccga

SEQ ID NO: 797172 - DNA, 25 bp, Mus musculus
tgaccagcccatcgatatcctgcag

SEQ ID NO: 797173 - DNA, 25 bp, Mus musculus
tgaccagcccatggatatcctgcag

SEQ ID NO: 797174 - DNA, 25 bp, Mus musculus
tgaccagcctccctgtggcagaatg

SEQ ID NO: 797175 - DNA, 25 bp, Mus musculus
tgaccagcctccgtgtggcagaatg

SEQ ID NO: 797176 - DNA, 25 bp, Mus musculus
tgaccagcgggaatggaatgagcct

SEQ ID NO: 797177 - DNA, 25 bp, Mus musculus
tgaccagcgggattggaatgagcct

SEQ ID NO: 797178 - DNA, 25 bp, Mus musculus
tgaccagctcccatggaaccagcta

SEQ ID NO: 797179 - DNA, 25 bp, Mus musculus
tgaccagctcccttggaaccagcta

SEQ ID NO: 797180 - DNA, 25 bp, Mus musculus
tgaccagctcgcagaaagccctgat

SEQ ID NO: 797181 - DNA, 25 bp, Mus musculus
tgaccagctcgctgaaagccctgat

SEQ ID NO: 797182 - DNA, 25 bp, Mus musculus
tgaccagctgtaactggccttgcgg

SEQ ID NO: 797183 - DNA, 25 bp, Mus musculus
tgaccagctgtaagaagaatacaca

SEQ ID NO: 797184 - DNA, 25 bp, Mus musculus
tgaccagctgtatctggccttgcgg

SEQ ID NO: 797185 - DNA, 25 bp, Mus musculus
tgaccagctgtatgaagaatacaca

SEQ ID NO: 797186 - DNA, 25 bp, Mus musculus
tgaccaggaagtagctgtggtgtac

SEQ ID NO: 797187 - DNA, 25 bp, Mus musculus
tgaccaggaagttgctgtggtgtac

SEQ ID NO: 797188 - DNA, 25 bp, Mus musculus
tgaccaggacagcttcagccatctg

SEQ ID NO: 797189 - DNA, 25 bp, Mus musculus
tgaccaggacaggttcagccatctg

SEQ ID NO: 797190 - DNA, 25 bp, Mus musculus
tgaccaggacgacacagccaatgga

SEQ ID NO: 797191 - DNA, 25 bp, Mus musculus
tgaccaggacgagacagccaatgga

SEQ ID NO: 797192 - DNA, 25 bp, Mus musculus
tgaccaggacttccgcagtttccgg

SEQ ID NO: 797193 - DNA, 25 bp, Mus musculus
tgaccaggacttgcgcagtttccgg

SEQ ID NO: 797194 - DNA, 25 bp, Mus musculus
tgaccaggagcgatttgataacagc

SEQ ID NO: 797195 - DNA, 25 bp, Mus musculus
tgaccaggagcgttttgataacagc

SEQ ID NO: 797196 - DNA, 25 bp, Mus musculus
tgaccagggcagaaggcgtaattaa

SEQ ID NO: 797197 - DNA, 25 bp, Mus musculus
tgaccagggcagtaggcgtaattaa

SEQ ID NO: 797198 - DNA, 25 bp, Mus musculus
tgaccaggtagcaatcagctccaaa

SEQ ID NO: 797199 - DNA, 25 bp, Mus musculus
tgaccaggtagctatcagctccaaa

SEQ ID NO: 797200 - DNA, 25 bp, Mus musculus
tgaccaggtgtcacatcatgcccga

SEQ ID NO: 797201 - DNA, 25 bp, Mus musculus
tgaccaggtgtctcatcatgcccga

SEQ ID NO: 797202 - DNA, 25 bp, Mus musculus
tgaccaggttataaactcagctgcc

SEQ ID NO: 797203 - DNA, 25 bp, Mus musculus
tgaccaggttattaactcagctgcc

SEQ ID NO: 797204 - DNA, 25 bp, Mus musculus
tgaccagtacttaaggtgaggcctg

SEQ ID NO: 797205 - DNA, 25 bp, Mus musculus
tgaccagtactttaggtgaggcctg

SEQ ID NO: 797206 - DNA, 25 bp, Mus musculus
tgaccagtccttacatgctgatctg

SEQ ID NO: 797207 - DNA, 25 bp, Mus musculus
tgaccagtcctttcatgctgatctg

SEQ ID NO: 797208 - DNA, 25 bp, Mus musculus
tgaccagtgacgaagtcagcctctg

SEQ ID NO: 797209 - DNA, 25 bp, Mus musculus
tgaccagtgacgtagtcagcctctg

SEQ ID NO: 797210 - DNA, 25 bp, Mus musculus
tgaccagtgcagcatccatcgatgg

SEQ ID NO: 797211 - DNA, 25 bp, Mus musculus
tgaccagtgcaggatccatcgatgg

SEQ ID NO: 797212 - DNA, 25 bp, Mus musculus
tgaccagtgctgaacatctcaagga

SEQ ID NO: 797213 - DNA, 25 bp, Mus musculus
tgaccagtgctgtacatctcaagga

SEQ ID NO: 797214 - DNA, 25 bp, Mus musculus
tgaccagtggctacgtatgcacctg

SEQ ID NO: 797215 - DNA, 25 bp, Mus musculus
tgaccagtggcttcgtatgcacctg

SEQ ID NO: 797216 - DNA, 25 bp, Mus musculus
tgaccagtgtgtaaaagtgtcccca

SEQ ID NO: 797217 - DNA, 25 bp, Mus musculus
tgaccagtgtgttaaagtgtcccca

SEQ ID NO: 797218 - DNA, 25 bp, Mus musculus
tgaccagttaaaacaagtccagcag

SEQ ID NO: 797219 - DNA, 25 bp, Mus musculus
tgaccagttaaatcaagtccagcag

SEQ ID NO: 797220 - DNA, 25 bp, Mus musculus
tgaccagttgaactctgaggagaag

SEQ ID NO: 797221 - DNA, 25 bp, Mus musculus
tgaccagttgaagtctgaggagaag

SEQ ID NO: 797222 - DNA, 25 bp, Mus musculus
tgaccataagaacagcactggctca

SEQ ID NO: 797223 - DNA, 25 bp, Mus musculus
tgaccataagaagagcactggctca

SEQ ID NO: 797224 - DNA, 25 bp, Mus musculus
tgaccatacagaagaattacagagc

SEQ ID NO: 797225 - DNA, 25 bp, Mus musculus
tgaccatacagatgaattacagagc

SEQ ID NO: 797226 - DNA, 25 bp, Mus musculus
tgaccatagccaacacagaaacttc

SEQ ID NO: 797227 - DNA, 25 bp, Mus musculus
tgaccatagccatcacagaaacttc

SEQ ID NO: 797228 - DNA, 25 bp, Mus musculus
tgaccatatctaacatcacagcaga

SEQ ID NO: 797229 - DNA, 25 bp, Mus musculus
tgaccatatctatcatcacagcaga

SEQ ID NO: 797230 - DNA, 25 bp, Mus musculus
tgaccatcaaatctggcattgagga

SEQ ID NO: 797231 - DNA, 25 bp, Mus musculus
tgaccatcaaatgtggcattgagga

SEQ ID NO: 797232 - DNA, 25 bp, Mus musculus
tgaccatcaacccaccaggagtgct

SEQ ID NO: 797233 - DNA, 25 bp, Mus musculus
tgaccatcaaccgaccaggagtgct

SEQ ID NO: 797234 - DNA, 25 bp, Mus musculus
tgaccatcacgaagggcaatgagga

SEQ ID NO: 797235 - DNA, 25 bp, Mus musculus
tgaccatcacgatgggcaatgagga

SEQ ID NO: 797236 - DNA, 25 bp, Mus musculus
tgaccatcacttactgcttggagga

SEQ ID NO: 797237 - DNA, 25 bp, Mus musculus
tgaccatcactttctgcttggagga

SEQ ID NO: 797238 - DNA, 25 bp, Mus musculus
tgaccatcatcaaagcctctaacct

SEQ ID NO: 797239 - DNA, 25 bp, Mus musculus
tgaccatcatcatagcctctaacct

SEQ ID NO: 797240 - DNA, 25 bp, Mus musculus
tgaccatccagaagtggcaaaacag

SEQ ID NO: 797241 - DNA, 25 bp, Mus musculus
tgaccatccagatgtggcaaaacag

SEQ ID NO: 797242 - DNA, 25 bp, Mus musculus
tgaccatccccaaggtctgaagaca

SEQ ID NO: 797243 - DNA, 25 bp, Mus musculus
tgaccatccccatggtctgaagaca

SEQ ID NO: 797244 - DNA, 25 bp, Mus musculus
tgaccatcctgtctcgctgtgagaa

SEQ ID NO: 797245 - DNA, 25 bp, Mus musculus
tgaccatcctgtgtcgctgtgagaa

SEQ ID NO: 797246 - DNA, 25 bp, Mus musculus
tgaccatcgccgctctggtgggctc

SEQ ID NO: 797247 - DNA, 25 bp, Mus musculus
tgaccatcgccggtctggtgggctc

SEQ ID NO: 797248 - DNA, 25 bp, Mus musculus
tgaccatcggctatgctgatgtgca

SEQ ID NO: 797249 - DNA, 25 bp, Mus musculus
tgaccatcggctttgctgatgtgca

SEQ ID NO: 797250 - DNA, 25 bp, Mus musculus
tgaccatcgtggcatctgtgctaga

SEQ ID NO: 797251 - DNA, 25 bp, Mus musculus
tgaccatcgtgggatctgtgctaga

SEQ ID NO: 797252 - DNA, 25 bp, Mus musculus
tgaccatctggacccagaatagccc

SEQ ID NO: 797253 - DNA, 25 bp, Mus musculus
tgaccatctggagccagaatagccc

SEQ ID NO: 797254 - DNA, 25 bp, Mus musculus
tgaccatcttagctgcaaagccatc

SEQ ID NO: 797255 - DNA, 25 bp, Mus musculus
tgaccatcttaggtgcaaagccatc

SEQ ID NO: 797256 - DNA, 25 bp, Mus musculus
tgaccatgaaacaaaacgacagaat

SEQ ID NO: 797257 - DNA, 25 bp, Mus musculus
tgaccatgaaactaaacgacagaat

SEQ ID NO: 797258 - DNA, 25 bp, Mus musculus
tgaccatgaagaaagacgagcttac

SEQ ID NO: 797259 - DNA, 25 bp, Mus musculus
tgaccatgaagatagacgagcttac

SEQ ID NO: 797260 - DNA, 25 bp, Mus musculus
tgaccatgatgaccaagagctgctc

SEQ ID NO: 797261 - DNA, 25 bp, Mus musculus
tgaccatgatgagcaagagctgctc

SEQ ID NO: 797262 - DNA, 25 bp, Mus musculus
tgaccatggccaccgccagggtgca

SEQ ID NO: 797263 - DNA, 25 bp, Mus musculus
tgaccatggccagcgccagggtgca

SEQ ID NO: 797264 - DNA, 25 bp, Mus musculus
tgaccatggcctattggacagcagc

SEQ ID NO: 797265 - DNA, 25 bp, Mus musculus
tgaccatggccttttggacagcagc

SEQ ID NO: 797266 - DNA, 25 bp, Mus musculus
tgaccatgggctctcagtgccacat

SEQ ID NO: 797267 - DNA, 25 bp, Mus musculus
tgaccatgggctgtcagtgccacat

SEQ ID NO: 797268 - DNA, 25 bp, Mus musculus
tgaccatggtacctggcaaaggacc

SEQ ID NO: 797269 - DNA, 25 bp, Mus musculus
tgaccatggtacgtggcaaaggacc

SEQ ID NO: 797270 - DNA, 25 bp, Mus musculus
tgaccatggtcaacgggtgcccaca

SEQ ID NO: 797271 - DNA, 25 bp, Mus musculus
tgaccatggtcatcgggtgcccaca

SEQ ID NO: 797272 - DNA, 25 bp, Mus musculus
tgaccatggtggaaccttaggcagg

SEQ ID NO: 797273 - DNA, 25 bp, Mus musculus
tgaccatggtggtaccttaggcagg

SEQ ID NO: 797274 - DNA, 25 bp, Mus musculus
tgaccattaaaccaggcgagcacgg

SEQ ID NO: 797275 - DNA, 25 bp, Mus musculus
tgaccattaaacgaggcgagcacgg

SEQ ID NO: 797276 - DNA, 25 bp, Mus musculus
tgaccattcaatctcacaggatgcg

SEQ ID NO: 797277 - DNA, 25 bp, Mus musculus
tgaccattcaatgtcacaggatgcg

SEQ ID NO: 797278 - DNA, 25 bp, Mus musculus
tgaccatttggacatactgccccgc

SEQ ID NO: 797279 - DNA, 25 bp, Mus musculus
tgaccatttggagatactgccccgc

SEQ ID NO: 797280 - DNA, 25 bp, Mus musculus
tgacccaaatcacaaagcccttagg

SEQ ID NO: 797281 - DNA, 25 bp, Mus musculus
tgacccaaatcagaaagcccttagg

SEQ ID NO: 797282 - DNA, 25 bp, Mus musculus
tgacccaacgacacctgaagcgagg

SEQ ID NO: 797283 - DNA, 25 bp, Mus musculus
tgacccaacgactcctgaagcgagg

SEQ ID NO: 797284 - DNA, 25 bp, Mus musculus
tgacccaactccagagcaacttcag

SEQ ID NO: 797285 - DNA, 25 bp, Mus musculus
tgacccaactcccttgatgacgcag

SEQ ID NO: 797286 - DNA, 25 bp, Mus musculus
tgacccaactccgttgatgacgcag

SEQ ID NO: 797287 - DNA, 25 bp, Mus musculus
tgacccaactcctgagcaacttcag

SEQ ID NO: 797288 - DNA, 25 bp, Mus musculus
tgacccaactcgatggctggaaaaa

SEQ ID NO: 797289 - DNA, 25 bp, Mus musculus
tgacccaactcgttggctggaaaaa

SEQ ID NO: 797290 - DNA, 25 bp, Mus musculus
tgacccaagagactgctctcatctt

SEQ ID NO: 797291 - DNA, 25 bp, Mus musculus
tgacccaagagagtgctctcatctt

SEQ ID NO: 797292 - DNA, 25 bp, Mus musculus
tgacccaagcacaagtgtgggagcc

SEQ ID NO: 797293 - DNA, 25 bp, Mus musculus
tgacccaagcactagtgtgggagcc

SEQ ID NO: 797294 - DNA, 25 bp, Mus musculus
tgacccaaggcaacgggctgcctcg

SEQ ID NO: 797295 - DNA, 25 bp, Mus musculus
tgacccaaggcatcgggctgcctcg

SEQ ID NO: 797296 - DNA, 25 bp, Mus musculus
tgacccaaggtgaaataaaacgtct

SEQ ID NO: 797297 - DNA, 25 bp, Mus musculus
tgacccaaggtgtaataaaacgtct

SEQ ID NO: 797298 - DNA, 25 bp, Mus musculus
tgacccaagtccaaatgtttacagg

SEQ ID NO: 797299 - DNA, 25 bp, Mus musculus
tgacccaagtcctaatgtttacagg

SEQ ID NO: 797300 - DNA, 25 bp, Mus musculus
tgacccaatgatccctgatgcagag

SEQ ID NO: 797301 - DNA, 25 bp, Mus musculus
tgacccaatgatgcctgatgcagag

SEQ ID NO: 797302 - DNA, 25 bp, Mus musculus
tgacccacaagcagaggaagcgtta

SEQ ID NO: 797303 - DNA, 25 bp, Mus musculus
tgacccacaagctgaggaagcgtta

SEQ ID NO: 797304 - DNA, 25 bp, Mus musculus
tgacccaccatgaatgctggctgtg

SEQ ID NO: 797305 - DNA, 25 bp, Mus musculus
tgacccaccatgtatgctggctgtg

SEQ ID NO: 797306 - DNA, 25 bp, Mus musculus
tgacccacctccatacattgatggg

SEQ ID NO: 797307 - DNA, 25 bp, Mus musculus
tgacccacctccttacattgatggg

SEQ ID NO: 797308 - DNA, 25 bp, Mus musculus
tgacccacgtggcacccagaactgt

SEQ ID NO: 797309 - DNA, 25 bp, Mus musculus
tgacccacgtgggacccagaactgt

SEQ ID NO: 797310 - DNA, 25 bp, Mus musculus
tgacccacgtgtaggcaggaggcca

SEQ ID NO: 797311 - DNA, 25 bp, Mus musculus
tgacccacgtgttggcaggaggcca

SEQ ID NO: 797312 - DNA, 25 bp, Mus musculus
tgacccagacgtagatttccccaac

SEQ ID NO: 797313 - DNA, 25 bp, Mus musculus
tgacccagacgttgatttccccaac

SEQ ID NO: 797314 - DNA, 25 bp, Mus musculus
tgacccagcctgacgcgttctcagt

SEQ ID NO: 797315 - DNA, 25 bp, Mus musculus
tgacccagcctgtcgcgttctcagt

SEQ ID NO: 797316 - DNA, 25 bp, Mus musculus
tgacccagcgaacaggatatcggtg

SEQ ID NO: 797317 - DNA, 25 bp, Mus musculus
tgacccagcgaagaggatatcggtg

SEQ ID NO: 797318 - DNA, 25 bp, Mus musculus
tgacccaggacaagcttataggagg

SEQ ID NO: 797319 - DNA, 25 bp, Mus musculus
tgacccaggacatgcttataggagg

SEQ ID NO: 797320 - DNA, 25 bp, Mus musculus
tgacccaggagcatcattcaacatg

SEQ ID NO: 797321 - DNA, 25 bp, Mus musculus
tgacccaggagcttcattcaacatg

SEQ ID NO: 797322 - DNA, 25 bp, Mus musculus
tgacccagtcagagatcgatacgta

SEQ ID NO: 797323 - DNA, 25 bp, Mus musculus
tgacccagtcagtgatcgatacgta

SEQ ID NO: 797324 - DNA, 25 bp, Mus musculus
tgacccatcagacttctcccaggat

SEQ ID NO: 797325 - DNA, 25 bp, Mus musculus
tgacccatcagagttctcccaggat

SEQ ID NO: 797326 - DNA, 25 bp, Mus musculus
tgacccatgcttattaccgagatgc

SEQ ID NO: 797327 - DNA, 25 bp, Mus musculus
tgacccatgctttttaccgagatgc

SEQ ID NO: 797328 - DNA, 25 bp, Mus musculus
tgaccccaaaaccttggcgcgtctg

SEQ ID NO: 797329 - DNA, 25 bp, Mus musculus
tgaccccaaaacgttggcgcgtctg

SEQ ID NO: 797330 - DNA, 25 bp, Mus musculus
tgaccccaaagaacggcttcccttg

SEQ ID NO: 797331 - DNA, 25 bp, Mus musculus
tgaccccaaagatcggcttcccttg

SEQ ID NO: 797332 - DNA, 25 bp, Mus musculus
tgaccccaacctcgtggtcaaggtt

SEQ ID NO: 797333 - DNA, 25 bp, Mus musculus
tgaccccaacctggtggtcaaggtt

SEQ ID NO: 797334 - DNA, 25 bp, Mus musculus
tgaccccaactgagtgccgcgggat

SEQ ID NO: 797335 - DNA, 25 bp, Mus musculus
tgaccccaactgtgtgccgcgggat

SEQ ID NO: 797336 - DNA, 25 bp, Mus musculus
tgaccccaaggacaagtgggttaag

SEQ ID NO: 797337 - DNA, 25 bp, Mus musculus
tgaccccaaggagaagtgggttaag

SEQ ID NO: 797338 - DNA, 25 bp, Mus musculus
tgaccccacactactgaggaggctc

SEQ ID NO: 797339 - DNA, 25 bp, Mus musculus
tgaccccacacttctgaggaggctc

SEQ ID NO: 797340 - DNA, 25 bp, Mus musculus
tgaccccaccatctataagtgcttg

SEQ ID NO: 797341 - DNA, 25 bp, Mus musculus
tgaccccaccatgtataagtgcttg

SEQ ID NO: 797342 - DNA, 25 bp, Mus musculus
tgaccccagggcaaaggcattaagt

SEQ ID NO: 797343 - DNA, 25 bp, Mus musculus
tgaccccagggctaaggcattaagt

SEQ ID NO: 797344 - DNA, 25 bp, Mus musculus
tgaccccagtagaggccactgtcgt

SEQ ID NO: 797345 - DNA, 25 bp, Mus musculus
tgaccccagtagtggccactgtcgt

SEQ ID NO: 797346 - DNA, 25 bp, Mus musculus
tgaccccataacatgctaagcaagc

SEQ ID NO: 797347 - DNA, 25 bp, Mus musculus
tgaccccataacttgctaagcaagc

SEQ ID NO: 797348 - DNA, 25 bp, Mus musculus
tgaccccatcagacagaccaaggtg

SEQ ID NO: 797349 - DNA, 25 bp, Mus musculus
tgaccccatcagtcagaccaaggtg

SEQ ID NO: 797350 - DNA, 25 bp, Mus musculus
tgaccccatggaagaaattcagatt

SEQ ID NO: 797351 - DNA, 25 bp, Mus musculus
tgaccccatggatgaaattcagatt

SEQ ID NO: 797352 - DNA, 25 bp, Mus musculus
tgaccccgactcaacgtgagacgta

SEQ ID NO: 797353 - DNA, 25 bp, Mus musculus
tgaccccgactctacgtgagacgta

SEQ ID NO: 797354 - DNA, 25 bp, Mus musculus
tgaccccgattgaggatttaccgct

SEQ ID NO: 797355 - DNA, 25 bp, Mus musculus
tgaccccgattgtggatttaccgct

SEQ ID NO: 797356 - DNA, 25 bp, Mus musculus
tgaccccgcgttcgtggcctggaac

SEQ ID NO: 797357 - DNA, 25 bp, Mus musculus
tgaccccgcgttggtggcctggaac

SEQ ID NO: 797358 - DNA, 25 bp, Mus musculus
tgaccccgtggaaggcgccgattgt

SEQ ID NO: 797359 - DNA, 25 bp, Mus musculus
tgaccccgtggatggcgccgattgt

SEQ ID NO: 797360 - DNA, 25 bp, Mus musculus
tgacccctactgcaagtgcctctgg

SEQ ID NO: 797361 - DNA, 25 bp, Mus musculus
tgacccctactggaagtgcctctgg

SEQ ID NO: 797362 - DNA, 25 bp, Mus musculus
tgacccctgccactatggttcctgt

SEQ ID NO: 797363 - DNA, 25 bp, Mus musculus
tgacccctgccagtatggttcctgt

SEQ ID NO: 797364 - DNA, 25 bp, Mus musculus
tgacccctgctgagcttcgagacct

SEQ ID NO: 797365 - DNA, 25 bp, Mus musculus
tgacccctgctgtgcttcgagacct

SEQ ID NO: 797366 - DNA, 25 bp, Mus musculus
tgacccctgggtacagcaattcatc

SEQ ID NO: 797367 - DNA, 25 bp, Mus musculus
tgacccctgggttcagcaattcatc

SEQ ID NO: 797368 - DNA, 25 bp, Mus musculus
tgacccctgtgccacttgggcctgt

SEQ ID NO: 797369 - DNA, 25 bp, Mus musculus
tgacccctgtgcgacttgggcctgt

SEQ ID NO: 797370 - DNA, 25 bp, Mus musculus
tgaccccttctaacgagacatgcct

SEQ ID NO: 797371 - DNA, 25 bp, Mus musculus
tgaccccttctatcgagacatgcct

SEQ ID NO: 797372 - DNA, 25 bp, Mus musculus
tgaccccttgttccctgtagctttg

SEQ ID NO: 797373 - DNA, 25 bp, Mus musculus
tgaccccttgttgcctgtagctttg

SEQ ID NO: 797374 - DNA, 25 bp, Mus musculus
tgacccgcagggagactgacgcgcc

SEQ ID NO: 797375 - DNA, 25 bp, Mus musculus
tgacccgcagggtgactgacgcgcc

SEQ ID NO: 797376 - DNA, 25 bp, Mus musculus
tgacccgcatgcaggcagagatgag

SEQ ID NO: 797377 - DNA, 25 bp, Mus musculus
tgacccgcatgctggcagagatgag

SEQ ID NO: 797378 - DNA, 25 bp, Mus musculus
tgacccgctacaacaaagagctctc

SEQ ID NO: 797379 - DNA, 25 bp, Mus musculus
tgacccgctacatcaaagagctctc

SEQ ID NO: 797380 - DNA, 25 bp, Mus musculus
tgacccggaagtctccagaactatt

SEQ ID NO: 797381 - DNA, 25 bp, Mus musculus
tgacccggaagtctctcactggcca

SEQ ID NO: 797382 - DNA, 25 bp, Mus musculus
tgacccggaagtgtccagaactatt

SEQ ID NO: 797383 - DNA, 25 bp, Mus musculus
tgacccggaagtgtctcactggcca

SEQ ID NO: 797384 - DNA, 25 bp, Mus musculus
tgacccgggcagaagaatccctgct

SEQ ID NO: 797385 - DNA, 25 bp, Mus musculus
tgacccgggcagtagaatccctgct

SEQ ID NO: 797386 - DNA, 25 bp, Mus musculus
tgacccggtgtcaagtcgctctgtc

SEQ ID NO: 797387 - DNA, 25 bp, Mus musculus
tgacccggtgtctagtcgctctgtc

SEQ ID NO: 797388 - DNA, 25 bp, Mus musculus
tgacccgtagcaagaacgtgaccgg

SEQ ID NO: 797389 - DNA, 25 bp, Mus musculus
tgacccgtagcatgaacgtgaccgg

SEQ ID NO: 797390 - DNA, 25 bp, Mus musculus
tgacccgtatacagcagcaggattg

SEQ ID NO: 797391 - DNA, 25 bp, Mus musculus
tgacccgtatactgcagcaggattg

SEQ ID NO: 797392 - DNA, 25 bp, Mus musculus
tgaccctaacgcatcctgtgctgaa

SEQ ID NO: 797393 - DNA, 25 bp, Mus musculus
tgaccctaacgcttcctgtgctgaa

SEQ ID NO: 797394 - DNA, 25 bp, Mus musculus
tgaccctaagagaatccttcccctg

SEQ ID NO: 797395 - DNA, 25 bp, Mus musculus
tgaccctaagagtatccttcccctg

SEQ ID NO: 797396 - DNA, 25 bp, Mus musculus
tgaccctaccctcagccttgggaag

SEQ ID NO: 797397 - DNA, 25 bp, Mus musculus
tgaccctaccctgagccttgggaag

SEQ ID NO: 797398 - DNA, 25 bp, Mus musculus
tgaccctcaaggctgataaacagta

SEQ ID NO: 797399 - DNA, 25 bp, Mus musculus
tgaccctcaagggtgataaacagta

SEQ ID NO: 797400 - DNA, 25 bp, Mus musculus
tgaccctccgatcagtgagagtctg

SEQ ID NO: 797401 - DNA, 25 bp, Mus musculus
tgaccctccgatgagtgagagtctg

SEQ ID NO: 797402 - DNA, 25 bp, Mus musculus
tgaccctccttcactttgatgccag

SEQ ID NO: 797403 - DNA, 25 bp, Mus musculus
tgaccctccttctctttgatgccag

SEQ ID NO: 797404 - DNA, 25 bp, Mus musculus
tgaccctgacaaaacgtttctacct

SEQ ID NO: 797405 - DNA, 25 bp, Mus musculus
tgaccctgacaatacgtttctacct

SEQ ID NO: 797406 - DNA, 25 bp, Mus musculus
tgaccctgacacagagctgtacctc

SEQ ID NO: 797407 - DNA, 25 bp, Mus musculus
tgaccctgacactgagctgtacctc

SEQ ID NO: 797408 - DNA, 25 bp, Mus musculus
tgaccctgatctcagttggaggaca

SEQ ID NO: 797409 - DNA, 25 bp, Mus musculus
tgaccctgatctgagttggaggaca

SEQ ID NO: 797410 - DNA, 25 bp, Mus musculus
tgaccctgatgtactccaagcagag

SEQ ID NO: 797411 - DNA, 25 bp, Mus musculus
tgaccctgatgttctccaagcagag

SEQ ID NO: 797412 - DNA, 25 bp, Mus musculus
tgaccctgccaaatccaggatgtcc

SEQ ID NO: 797413 - DNA, 25 bp, Mus musculus
tgaccctgccaattccaggatgtcc

SEQ ID NO: 797414 - DNA, 25 bp, Mus musculus
tgaccctgccataccaaggagcaga

SEQ ID NO: 797415 - DNA, 25 bp, Mus musculus
tgaccctgccattccaaggagcaga

SEQ ID NO: 797416 - DNA, 25 bp, Mus musculus
tgaccctgcgttatacagagatata

SEQ ID NO: 797417 - DNA, 25 bp, Mus musculus
tgaccctgcgttttacagagatata

SEQ ID NO: 797418 - DNA, 25 bp, Mus musculus
tgaccctgctggctgcggagtttct

SEQ ID NO: 797419 - DNA, 25 bp, Mus musculus
tgaccctgctgggtgcggagtttct

SEQ ID NO: 797420 - DNA, 25 bp, Mus musculus
tgaccctggaccaaaaggagacagg

SEQ ID NO: 797421 - DNA, 25 bp, Mus musculus
tgaccctggacctaaaggagacagg

SEQ ID NO: 797422 - DNA, 25 bp, Mus musculus
tgaccctggcacacagcttggaggc

SEQ ID NO: 797423 - DNA, 25 bp, Mus musculus
tgaccctggcactcagcttggaggc

SEQ ID NO: 797424 - DNA, 25 bp, Mus musculus
tgaccctggtgaatgcaccatataa

SEQ ID NO: 797425 - DNA, 25 bp, Mus musculus
tgaccctggtgattgcaccatataa

SEQ ID NO: 797426 - DNA, 25 bp, Mus musculus
tgaccctgtacccattgactctcta

SEQ ID NO: 797427 - DNA, 25 bp, Mus musculus
tgaccctgtaccgattgactctcta

SEQ ID NO: 797428 - DNA, 25 bp, Mus musculus
tgaccctgtggtcaggcgcccaaag

SEQ ID NO: 797429 - DNA, 25 bp, Mus musculus
tgaccctgtggtgaggcgcccaaag

SEQ ID NO: 797430 - DNA, 25 bp, Mus musculus
tgacccttcattcttaagctatggg

SEQ ID NO: 797431 - DNA, 25 bp, Mus musculus
tgacccttcattgttaagctatggg

SEQ ID NO: 797432 - DNA, 25 bp, Mus musculus
tgacccttgctcagtctatgcagcg

SEQ ID NO: 797433 - DNA, 25 bp, Mus musculus
tgacccttgctctgtctatgcagcg

SEQ ID NO: 797434 - DNA, 25 bp, Mus musculus
tgacccttgtgtctatccggagccc

SEQ ID NO: 797435 - DNA, 25 bp, Mus musculus
tgacccttgtgtgtatccggagccc

SEQ ID NO: 797436 - DNA, 25 bp, Mus musculus
tgacccttttgacctggatgtcttc

SEQ ID NO: 797437 - DNA, 25 bp, Mus musculus
tgacccttttgagctggatgtcttc

SEQ ID NO: 797438 - DNA, 25 bp, Mus musculus
tgaccgaactaccaagtcactgctg

SEQ ID NO: 797439 - DNA, 25 bp, Mus musculus
tgaccgaactacgaagtcactgctg

SEQ ID NO: 797440 - DNA, 25 bp, Mus musculus
tgaccgaaggagcacttttcaggct

SEQ ID NO: 797441 - DNA, 25 bp, Mus musculus
tgaccgaaggaggacttttcaggct

SEQ ID NO: 797442 - DNA, 25 bp, Mus musculus
tgaccgaatcaaagaaagtgatccg

SEQ ID NO: 797443 - DNA, 25 bp, Mus musculus
tgaccgaatcaatgaaagtgatccg

SEQ ID NO: 797444 - DNA, 25 bp, Mus musculus
tgaccgaatcctcgacctgcgcata

SEQ ID NO: 797445 - DNA, 25 bp, Mus musculus
tgaccgaatcctggacctgcgcata

SEQ ID NO: 797446 - DNA, 25 bp, Mus musculus
tgaccgaccctgacacggtcgagtg

SEQ ID NO: 797447 - DNA, 25 bp, Mus musculus
tgaccgaccctgtcacggtcgagtg

SEQ ID NO: 797448 - DNA, 25 bp, Mus musculus
tgaccgagaatgctgaggtgaaact

SEQ ID NO: 797449 - DNA, 25 bp, Mus musculus
tgaccgagaatggtgaggtgaaact

SEQ ID NO: 797450 - DNA, 25 bp, Mus musculus
tgaccgagaccccaatagtgcaacg

SEQ ID NO: 797451 - DNA, 25 bp, Mus musculus
tgaccgagacccgaatagtgcaacg

SEQ ID NO: 797452 - DNA, 25 bp, Mus musculus
tgaccgagagcaccgctgccaaatt

SEQ ID NO: 797453 - DNA, 25 bp, Mus musculus
tgaccgagagcagcgctgccaaatt

SEQ ID NO: 797454 - DNA, 25 bp, Mus musculus
tgaccgagctgtcggaagaactttg

SEQ ID NO: 797455 - DNA, 25 bp, Mus musculus
tgaccgagctgtgggaagaactttg

SEQ ID NO: 797456 - DNA, 25 bp, Mus musculus
tgaccgaggactccctggaccacgg

SEQ ID NO: 797457 - DNA, 25 bp, Mus musculus
tgaccgaggactgcctggaccacgg

SEQ ID NO: 797458 - DNA, 25 bp, Mus musculus
tgaccgaggcgaagctctacgagaa

SEQ ID NO: 797459 - DNA, 25 bp, Mus musculus
tgaccgaggcgatgctctacgagaa

SEQ ID NO: 797460 - DNA, 25 bp, Mus musculus
tgaccgagggtcagcaggaacgtct

SEQ ID NO: 797461 - DNA, 25 bp, Mus musculus
tgaccgagggtctgcaggaacgtct

SEQ ID NO: 797462 - DNA, 25 bp, Mus musculus
tgaccgagtacaacgagggaggcac

SEQ ID NO: 797463 - DNA, 25 bp, Mus musculus
tgaccgagtacatcgagggaggcac

SEQ ID NO: 797464 - DNA, 25 bp, Mus musculus
tgaccgatgctgagttcccacactc

SEQ ID NO: 797465 - DNA, 25 bp, Mus musculus
tgaccgatgctgtgttcccacactc

SEQ ID NO: 797466 - DNA, 25 bp, Mus musculus
tgaccgatgggtcctcactgctgcc

SEQ ID NO: 797467 - DNA, 25 bp, Mus musculus
tgaccgatgggtgctcactgctgcc

SEQ ID NO: 797468 - DNA, 25 bp, Mus musculus
tgaccgatttcaccacttcttcaca

SEQ ID NO: 797469 - DNA, 25 bp, Mus musculus
tgaccgatttcagcacttcttcaca

SEQ ID NO: 797470 - DNA, 25 bp, Mus musculus
tgaccgcaaccaatatttatcacct

SEQ ID NO: 797471 - DNA, 25 bp, Mus musculus
tgaccgcaaccattatttatcacct

SEQ ID NO: 797472 - DNA, 25 bp, Mus musculus
tgaccgcacagaccagtggtatgga

SEQ ID NO: 797473 - DNA, 25 bp, Mus musculus
tgaccgcacagagcagtggtatgga

SEQ ID NO: 797474 - DNA, 25 bp, Mus musculus
tgaccgcactaactcaccaaagttt

SEQ ID NO: 797475 - DNA, 25 bp, Mus musculus
tgaccgcactaagtcaccaaagttt

SEQ ID NO: 797476 - DNA, 25 bp, Mus musculus
tgaccgcactagaggtcgcccagtc

SEQ ID NO: 797477 - DNA, 25 bp, Mus musculus
tgaccgcactagtggtcgcccagtc

SEQ ID NO: 797478 - DNA, 25 bp, Mus musculus
tgaccgcactgtagatcaccttgat

SEQ ID NO: 797479 - DNA, 25 bp, Mus musculus
tgaccgcactgttgatcaccttgat

SEQ ID NO: 797480 - DNA, 25 bp, Mus musculus
tgaccgcagttgaccagaagcgctt

SEQ ID NO: 797481 - DNA, 25 bp, Mus musculus
tgaccgcagttgtccagaagcgctt

SEQ ID NO: 797482 - DNA, 25 bp, Mus musculus
tgaccgcatccgagggcggctggag

SEQ ID NO: 797483 - DNA, 25 bp, Mus musculus
tgaccgcatccgtgggcggctggag

SEQ ID NO: 797484 - DNA, 25 bp, Mus musculus
tgaccgcatctgagagtataatccg

SEQ ID NO: 797485 - DNA, 25 bp, Mus musculus
tgaccgcatctgtgagtataatccg

SEQ ID NO: 797486 - DNA, 25 bp, Mus musculus
tgaccgccacatcgtcttctggaac

SEQ ID NO: 797487 - DNA, 25 bp, Mus musculus
tgaccgccacatggtcttctggaac

SEQ ID NO: 797488 - DNA, 25 bp, Mus musculus
tgaccgccagtcattccaggaggct

SEQ ID NO: 797489 - DNA, 25 bp, Mus musculus
tgaccgccagtctttccaggaggct

SEQ ID NO: 797490 - DNA, 25 bp, Mus musculus
tgaccgccagttccctctttaccgg

SEQ ID NO: 797491 - DNA, 25 bp, Mus musculus
tgaccgccagttgcctctttaccgg

SEQ ID NO: 797492 - DNA, 25 bp, Mus musculus
tgaccgccccgtccagatgtgctgt

SEQ ID NO: 797493 - DNA, 25 bp, Mus musculus
tgaccgccccgtgcagatgtgctgt

SEQ ID NO: 797494 - DNA, 25 bp, Mus musculus
tgaccgcctcggaggaaccacaaaa

SEQ ID NO: 797495 - DNA, 25 bp, Mus musculus
tgaccgcctcggtggaaccacaaaa

SEQ ID NO: 797496 - DNA, 25 bp, Mus musculus
tgaccgctgaggaaactgtaaaagc

SEQ ID NO: 797497 - DNA, 25 bp, Mus musculus
tgaccgctgaggtaactgtaaaagc

SEQ ID NO: 797498 - DNA, 25 bp, Mus musculus
tgaccgcttcgacagggagaacctg

SEQ ID NO: 797499 - DNA, 25 bp, Mus musculus
tgaccgcttcgagagggagaacctg

SEQ ID NO: 797500 - DNA, 25 bp, Mus musculus
tgaccgctttgaagttcgtgcacat

SEQ ID NO: 797501 - DNA, 25 bp, Mus musculus
tgaccgctttgatgttcgtgcacat

SEQ ID NO: 797502 - DNA, 25 bp, Mus musculus
tgaccggaagaacgttgtttcctgg

SEQ ID NO: 797503 - DNA, 25 bp, Mus musculus
tgaccggaagaaggttgtttcctgg

SEQ ID NO: 797504 - DNA, 25 bp, Mus musculus
tgaccggacagcaggcattcatgga

SEQ ID NO: 797505 - DNA, 25 bp, Mus musculus
tgaccggacagctggcattcatgga

SEQ ID NO: 797506 - DNA, 25 bp, Mus musculus
tgaccggacaggatttggagagaat

SEQ ID NO: 797507 - DNA, 25 bp, Mus musculus
tgaccggacaggttttggagagaat

SEQ ID NO: 797508 - DNA, 25 bp, Mus musculus
tgaccggacagtccccttctgcagt

SEQ ID NO: 797509 - DNA, 25 bp, Mus musculus
tgaccggacagtgcccttctgcagt

SEQ ID NO: 797510 - DNA, 25 bp, Mus musculus
tgaccggaggccaactgctctgcag

SEQ ID NO: 797511 - DNA, 25 bp, Mus musculus
tgaccggaggcctactgctctgcag

SEQ ID NO: 797512 - DNA, 25 bp, Mus musculus
tgaccggcatctctggaatgtggat

SEQ ID NO: 797513 - DNA, 25 bp, Mus musculus
tgaccggcatctgtggaatgtggat

SEQ ID NO: 797514 - DNA, 25 bp, Mus musculus
tgaccgggaagaaattccaatgagc

SEQ ID NO: 797515 - DNA, 25 bp, Mus musculus
tgaccgggaagatattccaatgagc

SEQ ID NO: 797516 - DNA, 25 bp, Mus musculus
tgaccgggaggtaagtaggacctct

SEQ ID NO: 797517 - DNA, 25 bp, Mus musculus
tgaccgggaggttagtaggacctct

SEQ ID NO: 797518 - DNA, 25 bp, Mus musculus
tgaccgggtactatttaaagcacag

SEQ ID NO: 797519 - DNA, 25 bp, Mus musculus
tgaccgggtactttttaaagcacag

SEQ ID NO: 797520 - DNA, 25 bp, Mus musculus
tgaccgggttgcacctaaagactta

SEQ ID NO: 797521 - DNA, 25 bp, Mus musculus
tgaccgggttgctcctaaagactta

SEQ ID NO: 797522 - DNA, 25 bp, Mus musculus
tgaccggtagagatgtggagaacac

SEQ ID NO: 797523 - DNA, 25 bp, Mus musculus
tgaccggtagagttgtggagaacac

SEQ ID NO: 797524 - DNA, 25 bp, Mus musculus
tgaccggtcccacctggacatttct

SEQ ID NO: 797525 - DNA, 25 bp, Mus musculus
tgaccggtcccagctggacatttct

SEQ ID NO: 797526 - DNA, 25 bp, Mus musculus
tgaccgtaagagatctgggcctccc

SEQ ID NO: 797527 - DNA, 25 bp, Mus musculus
tgaccgtaagagttctgggcctccc

SEQ ID NO: 797528 - DNA, 25 bp, Mus musculus
tgaccgtattgtcttccgccgaggc

SEQ ID NO: 797529 - DNA, 25 bp, Mus musculus
tgaccgtattgtgttccgccgaggc

SEQ ID NO: 797530 - DNA, 25 bp, Mus musculus
tgaccgtcctgaccctggattgcag

SEQ ID NO: 797531 - DNA, 25 bp, Mus musculus
tgaccgtcctgagcctggattgcag

SEQ ID NO: 797532 - DNA, 25 bp, Mus musculus
tgaccgtctggtacctgagctggac

SEQ ID NO: 797533 - DNA, 25 bp, Mus musculus
tgaccgtctggttcctgagctggac

SEQ ID NO: 797534 - DNA, 25 bp, Mus musculus
tgaccgtgagcaatggccgagaaaa

SEQ ID NO: 797535 - DNA, 25 bp, Mus musculus
tgaccgtgagcattggccgagaaaa

SEQ ID NO: 797536 - DNA, 25 bp, Mus musculus
tgaccgtgcacacaaatggtggcaa

SEQ ID NO: 797537 - DNA, 25 bp, Mus musculus
tgaccgtgcacagaaatggtggcaa

SEQ ID NO: 797538 - DNA, 25 bp, Mus musculus
tgaccgtgccccagctggcggtctt

SEQ ID NO: 797539 - DNA, 25 bp, Mus musculus
tgaccgtgccccaggactgagcact

SEQ ID NO: 797540 - DNA, 25 bp, Mus musculus
tgaccgtgcccctgctggcggtctt

SEQ ID NO: 797541 - DNA, 25 bp, Mus musculus
tgaccgtgcccctggactgagcact

SEQ ID NO: 797542 - DNA, 25 bp, Mus musculus
tgaccgtgcgagagagcagcaccaa

SEQ ID NO: 797543 - DNA, 25 bp, Mus musculus
tgaccgtgcgagtgagcagcaccaa

SEQ ID NO: 797544 - DNA, 25 bp, Mus musculus
tgaccgtgctgtccacattacatgc

SEQ ID NO: 797545 - DNA, 25 bp, Mus musculus
tgaccgtgctgtgcacattacatgc

SEQ ID NO: 797546 - DNA, 25 bp, Mus musculus
tgaccgtgggatccgaatctttgag

SEQ ID NO: 797547 - DNA, 25 bp, Mus musculus
tgaccgtgggatgcgaatctttgag

SEQ ID NO: 797548 - DNA, 25 bp, Mus musculus
tgaccgtgttgcaatccatgaggct

SEQ ID NO: 797549 - DNA, 25 bp, Mus musculus
tgaccgtgttgctatccatgaggct

SEQ ID NO: 797550 - DNA, 25 bp, Mus musculus
tgaccgttacatatgggtgtggccc

SEQ ID NO: 797551 - DNA, 25 bp, Mus musculus
tgaccgttacatttgggtgtggccc

SEQ ID NO: 797552 - DNA, 25 bp, Mus musculus
tgaccgttgtagacttttgtaccac

SEQ ID NO: 797553 - DNA, 25 bp, Mus musculus
tgaccgttgtagtcttttgtaccac

SEQ ID NO: 797554 - DNA, 25 bp, Mus musculus
tgaccgtttggacaaaaccctcaga

SEQ ID NO: 797555 - DNA, 25 bp, Mus musculus
tgaccgtttggagaaaaccctcaga

SEQ ID NO: 797556 - DNA, 25 bp, Mus musculus
tgacctaaagcaagtgccagatacc

SEQ ID NO: 797557 - DNA, 25 bp, Mus musculus
tgacctaaagcatgtgccagatacc

SEQ ID NO: 797558 - DNA, 25 bp, Mus musculus
tgacctaaggagctgccactcgccg

SEQ ID NO: 797559 - DNA, 25 bp, Mus musculus
tgacctaaggaggtgccactcgccg

SEQ ID NO: 797560 - DNA, 25 bp, Mus musculus
tgacctacaacaaagtgtaccggta

SEQ ID NO: 797561 - DNA, 25 bp, Mus musculus
tgacctacaacatagtgtaccggta

SEQ ID NO: 797562 - DNA, 25 bp, Mus musculus
tgacctacagagcaaacagcggaag

SEQ ID NO: 797563 - DNA, 25 bp, Mus musculus
tgacctacagaggaaacagcggaag

SEQ ID NO: 797564 - DNA, 25 bp, Mus musculus
tgacctacagataccggaaccagaa

SEQ ID NO: 797565 - DNA, 25 bp, Mus musculus
tgacctacagattccggaaccagaa

SEQ ID NO: 797566 - DNA, 25 bp, Mus musculus
tgacctacaggaagaagacgggctt

SEQ ID NO: 797567 - DNA, 25 bp, Mus musculus
tgacctacaggatgaagacgggctt

SEQ ID NO: 797568 - DNA, 25 bp, Mus musculus
tgacctacagttcctgctcccagag

SEQ ID NO: 797569 - DNA, 25 bp, Mus musculus
tgacctacagttgctgctcccagag

SEQ ID NO: 797570 - DNA, 25 bp, Mus musculus
tgacctacccaaaggccatgtggac

SEQ ID NO: 797571 - DNA, 25 bp, Mus musculus
tgacctacccaatggccatgtggac

SEQ ID NO: 797572 - DNA, 25 bp, Mus musculus
tgacctacctgaccatgtgcatgaa

SEQ ID NO: 797573 - DNA, 25 bp, Mus musculus
tgacctacctgagcatgtgcatgaa

SEQ ID NO: 797574 - DNA, 25 bp, Mus musculus
tgacctactgttctgagccctgaag

SEQ ID NO: 797575 - DNA, 25 bp, Mus musculus
tgacctactgttgtgagccctgaag

SEQ ID NO: 797576 - DNA, 25 bp, Mus musculus
tgacctagagaacccatgttcctgc

SEQ ID NO: 797577 - DNA, 25 bp, Mus musculus
tgacctagagaagccatgttcctgc

SEQ ID NO: 797578 - DNA, 25 bp, Mus musculus
tgacctagatggcatacatgctttg

SEQ ID NO: 797579 - DNA, 25 bp, Mus musculus
tgacctagatgggatacatgctttg

SEQ ID NO: 797580 - DNA, 25 bp, Mus musculus
tgacctagcaaacctgtgtggtcct

SEQ ID NO: 797581 - DNA, 25 bp, Mus musculus
tgacctagcaaagctgtgtggtcct

SEQ ID NO: 797582 - DNA, 25 bp, Mus musculus
tgacctagctcccagatctcagcag

SEQ ID NO: 797583 - DNA, 25 bp, Mus musculus
tgacctagctccgagatctcagcag

SEQ ID NO: 797584 - DNA, 25 bp, Mus musculus
tgacctagttgaccagtgcccaaag

SEQ ID NO: 797585 - DNA, 25 bp, Mus musculus
tgacctagttgagcagtgcccaaag

SEQ ID NO: 797586 - DNA, 25 bp, Mus musculus
tgacctatacacacattgccatggc

SEQ ID NO: 797587 - DNA, 25 bp, Mus musculus
tgacctatacactcattgccatggc

SEQ ID NO: 797588 - DNA, 25 bp, Mus musculus
tgacctatcgctacccaccgaagtt

SEQ ID NO: 797589 - DNA, 25 bp, Mus musculus
tgacctatcgcttcccaccgaagtt

SEQ ID NO: 797590 - DNA, 25 bp, Mus musculus
tgacctattcaaagactatacagcc

SEQ ID NO: 797591 - DNA, 25 bp, Mus musculus
tgacctattcaatgactatacagcc

SEQ ID NO: 797592 - DNA, 25 bp, Mus musculus
tgacctcaaagacagaagcacctta

SEQ ID NO: 797593 - DNA, 25 bp, Mus musculus
tgacctcaaagagagaagcacctta

SEQ ID NO: 797594 - DNA, 25 bp, Mus musculus
tgacctcaagagcatcaagtggacc

SEQ ID NO: 797595 - DNA, 25 bp, Mus musculus
tgacctcaagaggatcaagtggacc

SEQ ID NO: 797596 - DNA, 25 bp, Mus musculus
tgacctcaaggaagcaaagccacaa

SEQ ID NO: 797597 - DNA, 25 bp, Mus musculus
tgacctcaaggatgcaaagccacaa

SEQ ID NO: 797598 - DNA, 25 bp, Mus musculus
tgacctcaatcacaaacaactattt

SEQ ID NO: 797599 - DNA, 25 bp, Mus musculus
tgacctcaatcagaaacaactattt

SEQ ID NO: 797600 - DNA, 25 bp, Mus musculus
tgacctcacaaaccgacctttatgg

SEQ ID NO: 797601 - DNA, 25 bp, Mus musculus
tgacctcacaaagcgacctttatgg

SEQ ID NO: 797602 - DNA, 25 bp, Mus musculus
tgacctcaccgcactacctggagat

SEQ ID NO: 797603 - DNA, 25 bp, Mus musculus
tgacctcaccgctctacctggagat

SEQ ID NO: 797604 - DNA, 25 bp, Mus musculus
tgacctcactacagacctgattgtg

SEQ ID NO: 797605 - DNA, 25 bp, Mus musculus
tgacctcactactgacctgattgtg

SEQ ID NO: 797606 - DNA, 25 bp, Mus musculus
tgacctcagacccaattccggaggt

SEQ ID NO: 797607 - DNA, 25 bp, Mus musculus
tgacctcagaccgaattccggaggt

SEQ ID NO: 797608 - DNA, 25 bp, Mus musculus
tgacctcagcaaaattcctcctcta

SEQ ID NO: 797609 - DNA, 25 bp, Mus musculus
tgacctcagcaatattcctcctcta

SEQ ID NO: 797610 - DNA, 25 bp, Mus musculus
tgacctcagccaataagatcacgct

SEQ ID NO: 797611 - DNA, 25 bp, Mus musculus
tgacctcagccattaagatcacgct

SEQ ID NO: 797612 - DNA, 25 bp, Mus musculus
tgacctcagctacccagatgaactt

SEQ ID NO: 797613 - DNA, 25 bp, Mus musculus
tgacctcagctagccagatgaactt

SEQ ID NO: 797614 - DNA, 25 bp, Mus musculus
tgacctcaggcacaaattctacaat

SEQ ID NO: 797615 - DNA, 25 bp, Mus musculus
tgacctcaggcagaaattctacaat

SEQ ID NO: 797616 - DNA, 25 bp, Mus musculus
tgacctcagtacatggctaatttct

SEQ ID NO: 797617 - DNA, 25 bp, Mus musculus
tgacctcagtacttggctaatttct

SEQ ID NO: 797618 - DNA, 25 bp, Mus musculus
tgacctcataaccaatagaaaggag

SEQ ID NO: 797619 - DNA, 25 bp, Mus musculus
tgacctcataacgaatagaaaggag

SEQ ID NO: 797620 - DNA, 25 bp, Mus musculus
tgacctcatataaaacagttgcaac

SEQ ID NO: 797621 - DNA, 25 bp, Mus musculus
tgacctcatatataacagttgcaac

SEQ ID NO: 797622 - DNA, 25 bp, Mus musculus
tgacctcatgggacaactgagcagc

SEQ ID NO: 797623 - DNA, 25 bp, Mus musculus
tgacctcatgggtcaactgagcagc

SEQ ID NO: 797624 - DNA, 25 bp, Mus musculus
tgacctccaagcagaagagatatga

SEQ ID NO: 797625 - DNA, 25 bp, Mus musculus
tgacctccaagctgaagagatatga

SEQ ID NO: 797626 - DNA, 25 bp, Mus musculus
tgacctccacaaaaggaaatgagtt

SEQ ID NO: 797627 - DNA, 25 bp, Mus musculus
tgacctccacaaccaagttttgcag

SEQ ID NO: 797628 - DNA, 25 bp, Mus musculus
tgacctccacaagcaagttttgcag

SEQ ID NO: 797629 - DNA, 25 bp, Mus musculus
tgacctccacaataggaaatgagtt

SEQ ID NO: 797630 - DNA, 25 bp, Mus musculus
tgacctccagttcgaccctgatcaa

SEQ ID NO: 797631 - DNA, 25 bp, Mus musculus
tgacctccagttggaccctgatcaa

SEQ ID NO: 797632 - DNA, 25 bp, Mus musculus
tgacctccattcatgctgcaacatg

SEQ ID NO: 797633 - DNA, 25 bp, Mus musculus
tgacctccattcttgctgcaacatg

SEQ ID NO: 797634 - DNA, 25 bp, Mus musculus
tgacctccccgacatccagaatgga

SEQ ID NO: 797635 - DNA, 25 bp, Mus musculus
tgacctccccgagatccagaatgga

SEQ ID NO: 797636 - DNA, 25 bp, Mus musculus
tgacctccgtatactgcctgaggcc

SEQ ID NO: 797637 - DNA, 25 bp, Mus musculus
tgacctccgtattctgcctgaggcc

SEQ ID NO: 797638 - DNA, 25 bp, Mus musculus
tgacctccgtgcagaccaggagctc

SEQ ID NO: 797639 - DNA, 25 bp, Mus musculus
tgacctccgtgctgaccaggagctc

SEQ ID NO: 797640 - DNA, 25 bp, Mus musculus
tgacctcctctcatgtgcagattcc

SEQ ID NO: 797641 - DNA, 25 bp, Mus musculus
tgacctcctctcttgtgcagattcc

SEQ ID NO: 797642 - DNA, 25 bp, Mus musculus
tgacctcctgcgaggcattgtggcc

SEQ ID NO: 797643 - DNA, 25 bp, Mus musculus
tgacctcctgcgtggcattgtggcc

SEQ ID NO: 797644 - DNA, 25 bp, Mus musculus
tgacctcctggtccgcattggcaag

SEQ ID NO: 797645 - DNA, 25 bp, Mus musculus
tgacctcctggtgcgcattggcaag

SEQ ID NO: 797646 - DNA, 25 bp, Mus musculus
tgacctcggagaccacgaggcagag

SEQ ID NO: 797647 - DNA, 25 bp, Mus musculus
tgacctcggagagcacgaggcagag

SEQ ID NO: 797648 - DNA, 25 bp, Mus musculus
tgacctcgggacacgccgatggctg

SEQ ID NO: 797649 - DNA, 25 bp, Mus musculus
tgacctcgggactcgccgatggctg

SEQ ID NO: 797650 - DNA, 25 bp, Mus musculus
tgacctcgtaccctgtgtcctgagc

SEQ ID NO: 797651 - DNA, 25 bp, Mus musculus
tgacctcgtaccgtgtgtcctgagc

SEQ ID NO: 797652 - DNA, 25 bp, Mus musculus
tgacctctacatcccagatagtgga

SEQ ID NO: 797653 - DNA, 25 bp, Mus musculus
tgacctctacatgccagatagtgga

SEQ ID NO: 797654 - DNA, 25 bp, Mus musculus
tgacctctatggcagcgcgttcagt

SEQ ID NO: 797655 - DNA, 25 bp, Mus musculus
tgacctctatgggagcgcgttcagt

SEQ ID NO: 797656 - DNA, 25 bp, Mus musculus
tgacctctccatcggatatccttta

SEQ ID NO: 797657 - DNA, 25 bp, Mus musculus
tgacctctccatgggatatccttta

SEQ ID NO: 797658 - DNA, 25 bp, Mus musculus
tgacctctgacgagctgcagtttgg

SEQ ID NO: 797659 - DNA, 25 bp, Mus musculus
tgacctctgacgtgctgcagtttgg

SEQ ID NO: 797660 - DNA, 25 bp, Mus musculus
tgacctctgcagcagtacgatgctt

SEQ ID NO: 797661 - DNA, 25 bp, Mus musculus
tgacctctgcaggagtacgatgctt

SEQ ID NO: 797662 - DNA, 25 bp, Mus musculus
tgacctctgcatccatgaggcatgc

SEQ ID NO: 797663 - DNA, 25 bp, Mus musculus
tgacctctgcatgcatgaggcatgc

SEQ ID NO: 797664 - DNA, 25 bp, Mus musculus
tgacctctggtcctgtggcatcaca

SEQ ID NO: 797665 - DNA, 25 bp, Mus musculus
tgacctctggtcgtgtggcatcaca

SEQ ID NO: 797666 - DNA, 25 bp, Mus musculus
tgacctctgtgcagcggagactgat

SEQ ID NO: 797667 - DNA, 25 bp, Mus musculus
tgacctctgtgctgcggagactgat

SEQ ID NO: 797668 - DNA, 25 bp, Mus musculus
tgacctcttgtcctgtatagcaacc

SEQ ID NO: 797669 - DNA, 25 bp, Mus musculus
tgacctcttgtcgtgtatagcaacc

SEQ ID NO: 797670 - DNA, 25 bp, Mus musculus
tgacctctttgaacacgtctccagc

SEQ ID NO: 797671 - DNA, 25 bp, Mus musculus
tgacctctttgaatacaaatttgca

SEQ ID NO: 797672 - DNA, 25 bp, Mus musculus
tgacctctttgatcacgtctccagc

SEQ ID NO: 797673 - DNA, 25 bp, Mus musculus
tgacctctttgattacaaatttgca

SEQ ID NO: 797674 - DNA, 25 bp, Mus musculus
tgacctgaaggtcgcgcacgtttgt

SEQ ID NO: 797675 - DNA, 25 bp, Mus musculus
tgacctgaaggtggcgcacgtttgt

SEQ ID NO: 797676 - DNA, 25 bp, Mus musculus
tgacctgactgcaggagactgcctt

SEQ ID NO: 797677 - DNA, 25 bp, Mus musculus
tgacctgactgctggagactgcctt

SEQ ID NO: 797678 - DNA, 25 bp, Mus musculus
tgacctgagagactctctcggaagt

SEQ ID NO: 797679 - DNA, 25 bp, Mus musculus
tgacctgagagagtctctcggaagt

SEQ ID NO: 797680 - DNA, 25 bp, Mus musculus
tgacctgatgttactacgcctcagc

SEQ ID NO: 797681 - DNA, 25 bp, Mus musculus
tgacctgatgtttctacgcctcagc

SEQ ID NO: 797682 - DNA, 25 bp, Mus musculus
tgacctgcagccatatctccagact

SEQ ID NO: 797683 - DNA, 25 bp, Mus musculus
tgacctgcagccttatctccagact

SEQ ID NO: 797684 - DNA, 25 bp, Mus musculus
tgacctgcaggcaagctgccaagaa

SEQ ID NO: 797685 - DNA, 25 bp, Mus musculus
tgacctgcaggctagctgccaagaa

SEQ ID NO: 797686 - DNA, 25 bp, Mus musculus
tgacctgcagtcagtcaacgtcggc

SEQ ID NO: 797687 - DNA, 25 bp, Mus musculus
tgacctgcagtctgtcaacgtcggc

SEQ ID NO: 797688 - DNA, 25 bp, Mus musculus
tgacctgccgtgctgaaggcttccc

SEQ ID NO: 797689 - DNA, 25 bp, Mus musculus
tgacctgccgtggtgaaggcttccc

SEQ ID NO: 797690 - DNA, 25 bp, Mus musculus
tgacctgcgcatacgctccttctgg

SEQ ID NO: 797691 - DNA, 25 bp, Mus musculus
tgacctgcgcattcgctccttctgg

SEQ ID NO: 797692 - DNA, 25 bp, Mus musculus
tgacctgcggaacccaagacttaca

SEQ ID NO: 797693 - DNA, 25 bp, Mus musculus
tgacctgcggaagccaagacttaca

SEQ ID NO: 797694 - DNA, 25 bp, Mus musculus
tgacctgcgtaacatggacaacctg

SEQ ID NO: 797695 - DNA, 25 bp, Mus musculus
tgacctgcgtaagatggacaacctg

SEQ ID NO: 797696 - DNA, 25 bp, Mus musculus
tgacctgcgtcacctgtaaacacaa

SEQ ID NO: 797697 - DNA, 25 bp, Mus musculus
tgacctgcgtcagctgtaaacacaa

SEQ ID NO: 797698 - DNA, 25 bp, Mus musculus
tgacctgctactcctggttgctggt

SEQ ID NO: 797699 - DNA, 25 bp, Mus musculus
tgacctgctactgctggttgctggt

SEQ ID NO: 797700 - DNA, 25 bp, Mus musculus
tgacctgctaggcactggaactgca

SEQ ID NO: 797701 - DNA, 25 bp, Mus musculus
tgacctgctagggactggaactgca

SEQ ID NO: 797702 - DNA, 25 bp, Mus musculus
tgacctgctctcactaaggctacag

SEQ ID NO: 797703 - DNA, 25 bp, Mus musculus
tgacctgctctctctaaggctacag

SEQ ID NO: 797704 - DNA, 25 bp, Mus musculus
tgacctggaactcgcgggcatccct

SEQ ID NO: 797705 - DNA, 25 bp, Mus musculus
tgacctggaactggcgggcatccct

SEQ ID NO: 797706 - DNA, 25 bp, Mus musculus
tgacctggactacgagtctgatgag

SEQ ID NO: 797707 - DNA, 25 bp, Mus musculus
tgacctggactaggagtctgatgag

SEQ ID NO: 797708 - DNA, 25 bp, Mus musculus
tgacctggactcaagtagcctgaat

SEQ ID NO: 797709 - DNA, 25 bp, Mus musculus
tgacctggactcacagaggaagggc

SEQ ID NO: 797710 - DNA, 25 bp, Mus musculus
tgacctggactctagtagcctgaat

SEQ ID NO: 797711 - DNA, 25 bp, Mus musculus
tgacctggactctcagaggaagggc

SEQ ID NO: 797712 - DNA, 25 bp, Mus musculus
tgacctggagatcgccaaagactgg

SEQ ID NO: 797713 - DNA, 25 bp, Mus musculus
tgacctggagatggccaaagactgg

SEQ ID NO: 797714 - DNA, 25 bp, Mus musculus
tgacctggagcgagacaaacctcgg

SEQ ID NO: 797715 - DNA, 25 bp, Mus musculus
tgacctggagcgtgacaaacctcgg

SEQ ID NO: 797716 - DNA, 25 bp, Mus musculus
tgacctggagctactgagaaagcat

SEQ ID NO: 797717 - DNA, 25 bp, Mus musculus
tgacctggagcttctgagaaagcat

SEQ ID NO: 797718 - DNA, 25 bp, Mus musculus
tgacctggatgaccctgaacgagga

SEQ ID NO: 797719 - DNA, 25 bp, Mus musculus
tgacctggatgagcctgaacgagga

SEQ ID NO: 797720 - DNA, 25 bp, Mus musculus
tgacctggctgcacggggaacccgt

SEQ ID NO: 797721 - DNA, 25 bp, Mus musculus
tgacctggctgctcggggaacccgt

SEQ ID NO: 797722 - DNA, 25 bp, Mus musculus
tgacctgggcgcagcagtttcgtct

SEQ ID NO: 797723 - DNA, 25 bp, Mus musculus
tgacctgggcgctgcagtttcgtct

SEQ ID NO: 797724 - DNA, 25 bp, Mus musculus
tgacctgggcttacgctttgatgtg

SEQ ID NO: 797725 - DNA, 25 bp, Mus musculus
tgacctgggctttcgctttgatgtg

SEQ ID NO: 797726 - DNA, 25 bp, Mus musculus
tgacctggtcagagtatctagctcc

SEQ ID NO: 797727 - DNA, 25 bp, Mus musculus
tgacctggtcagtgtatctagctcc

SEQ ID NO: 797728 - DNA, 25 bp, Mus musculus
tgacctggtgatccgggcgcgggac

SEQ ID NO: 797729 - DNA, 25 bp, Mus musculus
tgacctggtgatgcgggcgcgggac

SEQ ID NO: 797730 - DNA, 25 bp, Mus musculus
tgacctggtgtgaggtaagtagata

SEQ ID NO: 797731 - DNA, 25 bp, Mus musculus
tgacctggtgtgtggtaagtagata

SEQ ID NO: 797732 - DNA, 25 bp, Mus musculus
tgacctgtatgcatctggcgagcgc

SEQ ID NO: 797733 - DNA, 25 bp, Mus musculus
tgacctgtatgcttctggcgagcgc

SEQ ID NO: 797734 - DNA, 25 bp, Mus musculus
tgacctgtcccacgtgtctgtggcc

SEQ ID NO: 797735 - DNA, 25 bp, Mus musculus
tgacctgtcccaggtgtctgtggcc

SEQ ID NO: 797736 - DNA, 25 bp, Mus musculus
tgacctgtctaacgaagctctgctg

SEQ ID NO: 797737 - DNA, 25 bp, Mus musculus
tgacctgtctaaggaagctctgctg

SEQ ID NO: 797738 - DNA, 25 bp, Mus musculus
tgacctgttccgaatcctctgctgc

SEQ ID NO: 797739 - DNA, 25 bp, Mus musculus
tgacctgttccgtatcctctgctgc

SEQ ID NO: 797740 - DNA, 25 bp, Mus musculus
tgaccttaccggctctgggtacctt

SEQ ID NO: 797741 - DNA, 25 bp, Mus musculus
tgaccttaccgggtctgggtacctt

SEQ ID NO: 797742 - DNA, 25 bp, Mus musculus
tgaccttagccaacctgctggagac

SEQ ID NO: 797743 - DNA, 25 bp, Mus musculus
tgaccttagccatcctgctggagac

SEQ ID NO: 797744 - DNA, 25 bp, Mus musculus
tgaccttagccccagcatgcactgt

SEQ ID NO: 797745 - DNA, 25 bp, Mus musculus
tgaccttagcccgagcatgcactgt

SEQ ID NO: 797746 - DNA, 25 bp, Mus musculus
tgaccttagcctcatgcagcagccg

SEQ ID NO: 797747 - DNA, 25 bp, Mus musculus
tgaccttagcctgatgcagcagccg

SEQ ID NO: 797748 - DNA, 25 bp, Mus musculus
tgaccttatcatctgggagatcgag

SEQ ID NO: 797749 - DNA, 25 bp, Mus musculus
tgaccttatcatgtgggagatcgag

SEQ ID NO: 797750 - DNA, 25 bp, Mus musculus
tgaccttccttcacacggatgggct

SEQ ID NO: 797751 - DNA, 25 bp, Mus musculus
tgaccttccttctcacggatgggct

SEQ ID NO: 797752 - DNA, 25 bp, Mus musculus
tgaccttctgttaaggtgtcttgcc

SEQ ID NO: 797753 - DNA, 25 bp, Mus musculus
tgaccttctgtttaggtgtcttgcc

SEQ ID NO: 797754 - DNA, 25 bp, Mus musculus
tgaccttgaaggacatctacacttg

SEQ ID NO: 797755 - DNA, 25 bp, Mus musculus
tgaccttgaaggtcatctacacttg

SEQ ID NO: 797756 - DNA, 25 bp, Mus musculus
tgaccttgaggactacgacgcagaa

SEQ ID NO: 797757 - DNA, 25 bp, Mus musculus
tgaccttgaggagtacgacgcagaa

SEQ ID NO: 797758 - DNA, 25 bp, Mus musculus
tgaccttgccaaaaccaagaaagca

SEQ ID NO: 797759 - DNA, 25 bp, Mus musculus
tgaccttgccaataccaagaaagca

SEQ ID NO: 797760 - DNA, 25 bp, Mus musculus
tgaccttgccataaaccgcgctctt

SEQ ID NO: 797761 - DNA, 25 bp, Mus musculus
tgaccttgccattaaccgcgctctt

SEQ ID NO: 797762 - DNA, 25 bp, Mus musculus
tgaccttgctggcagcctgtctggc

SEQ ID NO: 797763 - DNA, 25 bp, Mus musculus
tgaccttgctgggagcctgtctggc

SEQ ID NO: 797764 - DNA, 25 bp, Mus musculus
tgaccttggacaagctccctctgtg

SEQ ID NO: 797765 - DNA, 25 bp, Mus musculus
tgaccttggacactgtgagcccaga

SEQ ID NO: 797766 - DNA, 25 bp, Mus musculus
tgaccttggacagtgtgagcccaga

SEQ ID NO: 797767 - DNA, 25 bp, Mus musculus
tgaccttggacatgctccctctgtg

SEQ ID NO: 797768 - DNA, 25 bp, Mus musculus
tgaccttggactcatgacagtgcct

SEQ ID NO: 797769 - DNA, 25 bp, Mus musculus
tgaccttggactgatgacagtgcct

SEQ ID NO: 797770 - DNA, 25 bp, Mus musculus
tgaccttggcccctaacttggatga

SEQ ID NO: 797771 - DNA, 25 bp, Mus musculus
tgaccttggcccgtaacttggatga

SEQ ID NO: 797772 - DNA, 25 bp, Mus musculus
tgaccttgggtacccatacagcgac

SEQ ID NO: 797773 - DNA, 25 bp, Mus musculus
tgaccttgggtagccatacagcgac

SEQ ID NO: 797774 - DNA, 25 bp, Mus musculus
tgaccttggtacagacctggaccag

SEQ ID NO: 797775 - DNA, 25 bp, Mus musculus
tgaccttggtactgacctggaccag

SEQ ID NO: 797776 - DNA, 25 bp, Mus musculus
tgaccttgtagaaagggaccgagcg

SEQ ID NO: 797777 - DNA, 25 bp, Mus musculus
tgaccttgtagatagggaccgagcg

SEQ ID NO: 797778 - DNA, 25 bp, Mus musculus
tgaccttgtggtcggactctgcaca

SEQ ID NO: 797779 - DNA, 25 bp, Mus musculus
tgaccttgtggtgggactctgcaca

SEQ ID NO: 797780 - DNA, 25 bp, Mus musculus
tgacctttaacccacataagcgaat

SEQ ID NO: 797781 - DNA, 25 bp, Mus musculus
tgacctttaaccgacataagcgaat

SEQ ID NO: 797782 - DNA, 25 bp, Mus musculus
tgacctttccaacctgtgcgtcctg

SEQ ID NO: 797783 - DNA, 25 bp, Mus musculus
tgacctttccaagctgtgcgtcctg

SEQ ID NO: 797784 - DNA, 25 bp, Mus musculus
tgacctttcctccagaagttcctgt

SEQ ID NO: 797785 - DNA, 25 bp, Mus musculus
tgacctttcctcgagaagttcctgt

SEQ ID NO: 797786 - DNA, 25 bp, Mus musculus
tgacctttcgaaacttagcagtgga

SEQ ID NO: 797787 - DNA, 25 bp, Mus musculus
tgacctttcgaatcttagcagtgga

SEQ ID NO: 797788 - DNA, 25 bp, Mus musculus
tgacctttctctacaggagcggcag

SEQ ID NO: 797789 - DNA, 25 bp, Mus musculus
tgacctttctcttcaggagcggcag

SEQ ID NO: 797790 - DNA, 25 bp, Mus musculus
tgaccttttcatccccatgcagttt

SEQ ID NO: 797791 - DNA, 25 bp, Mus musculus
tgaccttttcatgcccatgcagttt

SEQ ID NO: 797792 - DNA, 25 bp, Mus musculus
tgacgaaagtaccatgcctacaagg

SEQ ID NO: 797793 - DNA, 25 bp, Mus musculus
tgacgaaagtacgatgcctacaagg

SEQ ID NO: 797794 - DNA, 25 bp, Mus musculus
tgacgaacaattactatgcagcaat

SEQ ID NO: 797795 - DNA, 25 bp, Mus musculus
tgacgaacaatttctatgcagcaat

SEQ ID NO: 797796 - DNA, 25 bp, Mus musculus
tgacgaacctttaaggcctgttcag

SEQ ID NO: 797797 - DNA, 25 bp, Mus musculus
tgacgaaccttttaggcctgttcag

SEQ ID NO: 797798 - DNA, 25 bp, Mus musculus
tgacgaagcggacgaagacagaggc

SEQ ID NO: 797799 - DNA, 25 bp, Mus musculus
tgacgaagcggaggaagacagaggc

SEQ ID NO: 797800 - DNA, 25 bp, Mus musculus
tgacgaaggatacacgcctttgatg

SEQ ID NO: 797801 - DNA, 25 bp, Mus musculus
tgacgaaggatagacgcctttgatg

SEQ ID NO: 797802 - DNA, 25 bp, Mus musculus
tgacgaagttagcacacagcatctt

SEQ ID NO: 797803 - DNA, 25 bp, Mus musculus
tgacgaagttaggacacagcatctt

SEQ ID NO: 797804 - DNA, 25 bp, Mus musculus
tgacgaagttccagatattattccg

SEQ ID NO: 797805 - DNA, 25 bp, Mus musculus
tgacgaagttcctgatattattccg

SEQ ID NO: 797806 - DNA, 25 bp, Mus musculus
tgacgaattcgtcgaacgcagcgtg

SEQ ID NO: 797807 - DNA, 25 bp, Mus musculus
tgacgaattcgtggaacgcagcgtg

SEQ ID NO: 797808 - DNA, 25 bp, Mus musculus
tgacgacaggcaatgtgccggactg

SEQ ID NO: 797809 - DNA, 25 bp, Mus musculus
tgacgacaggcattgtgccggactg

SEQ ID NO: 797810 - DNA, 25 bp, Mus musculus
tgacgacatccactctgtgcgaaga

SEQ ID NO: 797811 - DNA, 25 bp, Mus musculus
tgacgacatccagtctgtgcgaaga

SEQ ID NO: 797812 - DNA, 25 bp, Mus musculus
tgacgaccatcaccaggcttcggaa

SEQ ID NO: 797813 - DNA, 25 bp, Mus musculus
tgacgaccatcagcaggcttcggaa

SEQ ID NO: 797814 - DNA, 25 bp, Mus musculus
tgacgacctcttctgaggcagaaga

SEQ ID NO: 797815 - DNA, 25 bp, Mus musculus
tgacgacctcttgtgaggcagaaga

SEQ ID NO: 797816 - DNA, 25 bp, Mus musculus
tgacgacctgtgatccgacatatac

SEQ ID NO: 797817 - DNA, 25 bp, Mus musculus
tgacgacctgtgttccgacatatac

SEQ ID NO: 797818 - DNA, 25 bp, Mus musculus
tgacgacgacgacaatgatcctgaa

SEQ ID NO: 797819 - DNA, 25 bp, Mus musculus
tgacgacgacgagaatgatcctgaa

SEQ ID NO: 797820 - DNA, 25 bp, Mus musculus
tgacgacgatgacaagaaagtgaca

SEQ ID NO: 797821 - DNA, 25 bp, Mus musculus
tgacgacgatgagaagaaagtgaca

SEQ ID NO: 797822 - DNA, 25 bp, Mus musculus
tgacgacgtgctcggcgtataagta

SEQ ID NO: 797823 - DNA, 25 bp, Mus musculus
tgacgacgtgctgggcgtataagta

SEQ ID NO: 797824 - DNA, 25 bp, Mus musculus
tgacgacgtggacagttttgtatcc

SEQ ID NO: 797825 - DNA, 25 bp, Mus musculus
tgacgacgtggagagttttgtatcc

SEQ ID NO: 797826 - DNA, 25 bp, Mus musculus
tgacgactacacagatggccgagtg

SEQ ID NO: 797827 - DNA, 25 bp, Mus musculus
tgacgactacactgatggccgagtg

SEQ ID NO: 797828 - DNA, 25 bp, Mus musculus
tgacgactctgtccaggtgctcctg

SEQ ID NO: 797829 - DNA, 25 bp, Mus musculus
tgacgactctgtgcaggtgctcctg

SEQ ID NO: 797830 - DNA, 25 bp, Mus musculus
tgacgagaagacaaacgcatggtcc

SEQ ID NO: 797831 - DNA, 25 bp, Mus musculus
tgacgagaagactaacgcatggtcc

SEQ ID NO: 797832 - DNA, 25 bp, Mus musculus
tgacgagaagctacgctgctcagag

SEQ ID NO: 797833 - DNA, 25 bp, Mus musculus
tgacgagaagctactacagaggtgc

SEQ ID NO: 797834 - DNA, 25 bp, Mus musculus
tgacgagaagcttcgctgctcagag

SEQ ID NO: 797835 - DNA, 25 bp, Mus musculus
tgacgagaagcttctacagaggtgc

SEQ ID NO: 797836 - DNA, 25 bp, Mus musculus
tgacgagagccaagtgatcactgcc

SEQ ID NO: 797837 - DNA, 25 bp, Mus musculus
tgacgagagccatgtgatcactgcc

SEQ ID NO: 797838 - DNA, 25 bp, Mus musculus
tgacgagaggcgcagcccacagctc

SEQ ID NO: 797839 - DNA, 25 bp, Mus musculus
tgacgagaggcggagcccacagctc

SEQ ID NO: 797840 - DNA, 25 bp, Mus musculus
tgacgagcacctattcatcataact

SEQ ID NO: 797841 - DNA, 25 bp, Mus musculus
tgacgagcaccttttcatcataact

SEQ ID NO: 797842 - DNA, 25 bp, Mus musculus
tgacgaggagaacacccttcgggaa

SEQ ID NO: 797843 - DNA, 25 bp, Mus musculus
tgacgaggagaagacccttcgggaa

SEQ ID NO: 797844 - DNA, 25 bp, Mus musculus
tgacgagtgttcctttgagcggacc

SEQ ID NO: 797845 - DNA, 25 bp, Mus musculus
tgacgagtgttcgtttgagcggacc

SEQ ID NO: 797846 - DNA, 25 bp, Mus musculus
tgacgatcactcagactgatgtcaa

SEQ ID NO: 797847 - DNA, 25 bp, Mus musculus
tgacgatcactctgactgatgtcaa

SEQ ID NO: 797848 - DNA, 25 bp, Mus musculus
tgacgatgactacttcctctgcctt

SEQ ID NO: 797849 - DNA, 25 bp, Mus musculus
tgacgatgactagttcctctgcctt

SEQ ID NO: 797850 - DNA, 25 bp, Mus musculus
tgacgatgatctacttgtcagcaca

SEQ ID NO: 797851 - DNA, 25 bp, Mus musculus
tgacgatgatcttcttgtcagcaca

SEQ ID NO: 797852 - DNA, 25 bp, Mus musculus
tgacgatgatggagaagctctcgga

SEQ ID NO: 797853 - DNA, 25 bp, Mus musculus
tgacgatgatggtgaagctctcgga

SEQ ID NO: 797854 - DNA, 25 bp, Mus musculus
tgacgatgctcacagtgtagtggcc

SEQ ID NO: 797855 - DNA, 25 bp, Mus musculus
tgacgatgctcagagtgtagtggcc

SEQ ID NO: 797856 - DNA, 25 bp, Mus musculus
tgacgatggcccaggaatctatacc

SEQ ID NO: 797857 - DNA, 25 bp, Mus musculus
tgacgatggccctggaatctatacc

SEQ ID NO: 797858 - DNA, 25 bp, Mus musculus
tgacgatgtgacacagctcatccct

SEQ ID NO: 797859 - DNA, 25 bp, Mus musculus
tgacgatgtgactcagctcatccct

SEQ ID NO: 797860 - DNA, 25 bp, Mus musculus
tgacgatttcctcaagactttcagc

SEQ ID NO: 797861 - DNA, 25 bp, Mus musculus
tgacgatttcctgaagactttcagc

SEQ ID NO: 797862 - DNA, 25 bp, Mus musculus
tgacgatttctcaagggctctgcag

SEQ ID NO: 797863 - DNA, 25 bp, Mus musculus
tgacgatttctctagggctctgcag

SEQ ID NO: 797864 - DNA, 25 bp, Mus musculus
tgacgccagagacctccgtcacgtg

SEQ ID NO: 797865 - DNA, 25 bp, Mus musculus
tgacgccagagagctccgtcacgtg

SEQ ID NO: 797866 - DNA, 25 bp, Mus musculus
tgacgccagcaaccacaatgcctgg

SEQ ID NO: 797867 - DNA, 25 bp, Mus musculus
tgacgccagcaagcacaatgcctgg

SEQ ID NO: 797868 - DNA, 25 bp, Mus musculus
tgacgcccatgcctgtgaaccaagc

SEQ ID NO: 797869 - DNA, 25 bp, Mus musculus
tgacgcccatgcgtgtgaaccaagc

SEQ ID NO: 797870 - DNA, 25 bp, Mus musculus
tgacgcccgagcagcaggaggccct

SEQ ID NO: 797871 - DNA, 25 bp, Mus musculus
tgacgcccgagctgcaggaggccct

SEQ ID NO: 797872 - DNA, 25 bp, Mus musculus
tgacgccggccactatacctgtgtt

SEQ ID NO: 797873 - DNA, 25 bp, Mus musculus
tgacgccggccagtatacctgtgtt

SEQ ID NO: 797874 - DNA, 25 bp, Mus musculus
tgacgccgggaaagtttgccgagat

SEQ ID NO: 797875 - DNA, 25 bp, Mus musculus
tgacgccgggaatgtttgccgagat

SEQ ID NO: 797876 - DNA, 25 bp, Mus musculus
tgacgccttgcacgccggagcatca

SEQ ID NO: 797877 - DNA, 25 bp, Mus musculus
tgacgccttgcaggccggagcatca

SEQ ID NO: 797878 - DNA, 25 bp, Mus musculus
tgacgcgacttcactatgtacaagg

SEQ ID NO: 797879 - DNA, 25 bp, Mus musculus
tgacgcgacttctctatgtacaagg

SEQ ID NO: 797880 - DNA, 25 bp, Mus musculus
tgacgcggcaggaagaccacttact

SEQ ID NO: 797881 - DNA, 25 bp, Mus musculus
tgacgcggcaggtagaccacttact

SEQ ID NO: 797882 - DNA, 25 bp, Mus musculus
tgacgcgggcttcttcaccaacgat

SEQ ID NO: 797883 - DNA, 25 bp, Mus musculus
tgacgcgggcttgttcaccaacgat

SEQ ID NO: 797884 - DNA, 25 bp, Mus musculus
tgacgcgtgtcacggtgacttcgat

SEQ ID NO: 797885 - DNA, 25 bp, Mus musculus
tgacgcgtgtcagggtgacttcgat

SEQ ID NO: 797886 - DNA, 25 bp, Mus musculus
tgacgcgttctcagtcttcccaggc

SEQ ID NO: 797887 - DNA, 25 bp, Mus musculus
tgacgcgttctctgtcttcccaggc

SEQ ID NO: 797888 - DNA, 25 bp, Mus musculus
tgacgctacacaccaaccatggctt

SEQ ID NO: 797889 - DNA, 25 bp, Mus musculus
tgacgctacacagcaaccatggctt

SEQ ID NO: 797890 - DNA, 25 bp, Mus musculus
tgacgctagggcatgggactaccag

SEQ ID NO: 797891 - DNA, 25 bp, Mus musculus
tgacgctagggcttgggactaccag

SEQ ID NO: 797892 - DNA, 25 bp, Mus musculus
tgacgctcagacagtagcgaggctg

SEQ ID NO: 797893 - DNA, 25 bp, Mus musculus
tgacgctcagactgtagcgaggctg

SEQ ID NO: 797894 - DNA, 25 bp, Mus musculus
tgacgctcgtgaagcatcggcgaga

SEQ ID NO: 797895 - DNA, 25 bp, Mus musculus
tgacgctcgtgatgcatcggcgaga

SEQ ID NO: 797896 - DNA, 25 bp, Mus musculus
tgacgctgacacctgggaaaaaatg

SEQ ID NO: 797897 - DNA, 25 bp, Mus musculus
tgacgctgacacgtgggaaaaaatg

SEQ ID NO: 797898 - DNA, 25 bp, Mus musculus
tgacgctggcagacgctatgagact

SEQ ID NO: 797899 - DNA, 25 bp, Mus musculus
tgacgctggcagtcgctatgagact

SEQ ID NO: 797900 - DNA, 25 bp, Mus musculus
tgacgctggcccagctatttctaca

SEQ ID NO: 797901 - DNA, 25 bp, Mus musculus
tgacgctggccctgctatttctaca

SEQ ID NO: 797902 - DNA, 25 bp, Mus musculus
tgacgctggtgaaatacaggacgta

SEQ ID NO: 797903 - DNA, 25 bp, Mus musculus
tgacgctggtgatatacaggacgta

SEQ ID NO: 797904 - DNA, 25 bp, Mus musculus
tgacggaagtacaatgatggagatt

SEQ ID NO: 797905 - DNA, 25 bp, Mus musculus
tgacggaagtactatgatggagatt

SEQ ID NO: 797906 - DNA, 25 bp, Mus musculus
tgacggaatcatccccttcctacag

SEQ ID NO: 797907 - DNA, 25 bp, Mus musculus
tgacggaatcatgcccttcctacag

SEQ ID NO: 797908 - DNA, 25 bp, Mus musculus
tgacggacagacaaaccgacagcct

SEQ ID NO: 797909 - DNA, 25 bp, Mus musculus
tgacggacagactaaccgacagcct

SEQ ID NO: 797910 - DNA, 25 bp, Mus musculus
tgacggaccggaagtgctcccgaaa

SEQ ID NO: 797911 - DNA, 25 bp, Mus musculus
tgacggaccggatgtgctcccgaaa

SEQ ID NO: 797912 - DNA, 25 bp, Mus musculus
tgacggagaatgacacagagggtgg

SEQ ID NO: 797913 - DNA, 25 bp, Mus musculus
tgacggagaatgtcacagagggtgg

SEQ ID NO: 797914 - DNA, 25 bp, Mus musculus
tgacggagcaggagatttcccctcc

SEQ ID NO: 797915 - DNA, 25 bp, Mus musculus
tgacggagcaggtgatttcccctcc

SEQ ID NO: 797916 - DNA, 25 bp, Mus musculus
tgacggagccgaacagcctaaggct

SEQ ID NO: 797917 - DNA, 25 bp, Mus musculus
tgacggagccgatcagcctaaggct

SEQ ID NO: 797918 - DNA, 25 bp, Mus musculus
tgacggagtcccctttctcatgcat

SEQ ID NO: 797919 - DNA, 25 bp, Mus musculus
tgacggagtcccgtttctcatgcat

SEQ ID NO: 797920 - DNA, 25 bp, Mus musculus
tgacggagtgatcaatggtgaatac

SEQ ID NO: 797921 - DNA, 25 bp, Mus musculus
tgacggagtgatgaatggtgaatac

SEQ ID NO: 797922 - DNA, 25 bp, Mus musculus
tgacggatacgtcaagccacagatc

SEQ ID NO: 797923 - DNA, 25 bp, Mus musculus
tgacggatacgtgaagccacagatc

SEQ ID NO: 797924 - DNA, 25 bp, Mus musculus
tgacggatctgtagctcaccacgaa

SEQ ID NO: 797925 - DNA, 25 bp, Mus musculus
tgacggatctgttgctcaccacgaa

SEQ ID NO: 797926 - DNA, 25 bp, Mus musculus
tgacggatgaccacagacggatgac

SEQ ID NO: 797927 - DNA, 25 bp, Mus musculus
tgacggatgacctcagacggatgac

SEQ ID NO: 797928 - DNA, 25 bp, Mus musculus
tgacggattccacctatcgagctgt

SEQ ID NO: 797929 - DNA, 25 bp, Mus musculus
tgacggattccagctatcgagctgt

SEQ ID NO: 797930 - DNA, 25 bp, Mus musculus
tgacggcaacagaagccatagccag

SEQ ID NO: 797931 - DNA, 25 bp, Mus musculus
tgacggcaacagtagccatagccag

SEQ ID NO: 797932 - DNA, 25 bp, Mus musculus
tgacggcaatccaagcgtgaaggct

SEQ ID NO: 797933 - DNA, 25 bp, Mus musculus
tgacggcaatcctagcgtgaaggct

SEQ ID NO: 797934 - DNA, 25 bp, Mus musculus
tgacggcacgccctacgtcactgta

SEQ ID NO: 797935 - DNA, 25 bp, Mus musculus
tgacggcacgccgtacgtcactgta

SEQ ID NO: 797936 - DNA, 25 bp, Mus musculus
tgacggcatcagatgtgcgtcaggc

SEQ ID NO: 797937 - DNA, 25 bp, Mus musculus
tgacggcatcagttgtgcgtcaggc

SEQ ID NO: 797938 - DNA, 25 bp, Mus musculus
tgacggccatacctgttcgctcttc

SEQ ID NO: 797939 - DNA, 25 bp, Mus musculus
tgacggccatacgtgttcgctcttc

SEQ ID NO: 797940 - DNA, 25 bp, Mus musculus
tgacggccccggattattctgcctt

SEQ ID NO: 797941 - DNA, 25 bp, Mus musculus
tgacggccccggtttattctgcctt

SEQ ID NO: 797942 - DNA, 25 bp, Mus musculus
tgacggccgcccactgtgtggaaga

SEQ ID NO: 797943 - DNA, 25 bp, Mus musculus
tgacggccgccctctgtgtggaaga

SEQ ID NO: 797944 - DNA, 25 bp, Mus musculus
tgacggccgtagaccagtctgagtg

SEQ ID NO: 797945 - DNA, 25 bp, Mus musculus
tgacggccgtagtccagtctgagtg

SEQ ID NO: 797946 - DNA, 25 bp, Mus musculus
tgacggccttggagcaaactcactg

SEQ ID NO: 797947 - DNA, 25 bp, Mus musculus
tgacggccttggtgcaaactcactg

SEQ ID NO: 797948 - DNA, 25 bp, Mus musculus
tgacggcgagttatctgcagacact

SEQ ID NO: 797949 - DNA, 25 bp, Mus musculus
tgacggcgagttttctgcagacact

SEQ ID NO: 797950 - DNA, 25 bp, Mus musculus
tgacggcgcttgatggagaccgaga

SEQ ID NO: 797951 - DNA, 25 bp, Mus musculus
tgacggcgcttgttggagaccgaga

SEQ ID NO: 797952 - DNA, 25 bp, Mus musculus
tgacggcggtccaagagtctccttc

SEQ ID NO: 797953 - DNA, 25 bp, Mus musculus
tgacggcggtcctagagtctccttc

SEQ ID NO: 797954 - DNA, 25 bp, Mus musculus
tgacggctctcccacaattcatctt

SEQ ID NO: 797955 - DNA, 25 bp, Mus musculus
tgacggctctccgacaattcatctt

SEQ ID NO: 797956 - DNA, 25 bp, Mus musculus
tgacggctgggaaattgggtatctc

SEQ ID NO: 797957 - DNA, 25 bp, Mus musculus
tgacggctgggatattgggtatctc

SEQ ID NO: 797958 - DNA, 25 bp, Mus musculus
tgacggctgtgacgcagttctcttg

SEQ ID NO: 797959 - DNA, 25 bp, Mus musculus
tgacggctgtgaggcagttctcttg

SEQ ID NO: 797960 - DNA, 25 bp, Mus musculus
tgacgggaactcatccagagggact

SEQ ID NO: 797961 - DNA, 25 bp, Mus musculus
tgacgggaactcttccagagggact

SEQ ID NO: 797962 - DNA, 25 bp, Mus musculus
tgacgggaaggtcttcaccacaggt

SEQ ID NO: 797963 - DNA, 25 bp, Mus musculus
tgacgggaaggtgttcaccacaggt

SEQ ID NO: 797964 - DNA, 25 bp, Mus musculus
tgacgggcaaacagtgtgtcaaccg

SEQ ID NO: 797965 - DNA, 25 bp, Mus musculus
tgacgggcaaactgtgtgtcaaccg

SEQ ID NO: 797966 - DNA, 25 bp, Mus musculus
tgacgggcatcgcagctaaccttgt

SEQ ID NO: 797967 - DNA, 25 bp, Mus musculus
tgacgggcatcggagctaaccttgt

SEQ ID NO: 797968 - DNA, 25 bp, Mus musculus
tgacgggcatctccccatttgttgg

SEQ ID NO: 797969 - DNA, 25 bp, Mus musculus
tgacgggcatctgcccatttgttgg

SEQ ID NO: 797970 - DNA, 25 bp, Mus musculus
tgacgggcttcgaggcctacagtgt

SEQ ID NO: 797971 - DNA, 25 bp, Mus musculus
tgacgggcttcgtggcctacagtgt

SEQ ID NO: 797972 - DNA, 25 bp, Mus musculus
tgacggtacagtagaaccttattct

SEQ ID NO: 797973 - DNA, 25 bp, Mus musculus
tgacggtacagttgaaccttattct

SEQ ID NO: 797974 - DNA, 25 bp, Mus musculus
tgacggtattgacgacatgattggc

SEQ ID NO: 797975 - DNA, 25 bp, Mus musculus
tgacggtattgaggacatgattggc

SEQ ID NO: 797976 - DNA, 25 bp, Mus musculus
tgacggtcaaggagttgaattcttc

SEQ ID NO: 797977 - DNA, 25 bp, Mus musculus
tgacggtcaaggtgttgaattcttc

SEQ ID NO: 797978 - DNA, 25 bp, Mus musculus
tgacggtcagggacacatcactggg

SEQ ID NO: 797979 - DNA, 25 bp, Mus musculus
tgacggtcagggtcacatcactggg

SEQ ID NO: 797980 - DNA, 25 bp, Mus musculus
tgacggtgagccaaagtactacccg

SEQ ID NO: 797981 - DNA, 25 bp, Mus musculus
tgacggtgagcctaagtactacccg

SEQ ID NO: 797982 - DNA, 25 bp, Mus musculus
tgacggtgcctgatgagttctccca

SEQ ID NO: 797983 - DNA, 25 bp, Mus musculus
tgacggtgcctgttgagttctccca

SEQ ID NO: 797984 - DNA, 25 bp, Mus musculus
tgacggtggccaatgctgcctggtc

SEQ ID NO: 797985 - DNA, 25 bp, Mus musculus
tgacggtggccattgctgcctggtc

SEQ ID NO: 797986 - DNA, 25 bp, Mus musculus
tgacggtggtctccaccaagacctg

SEQ ID NO: 797987 - DNA, 25 bp, Mus musculus
tgacggtggtctgcaccaagacctg

SEQ ID NO: 797988 - DNA, 25 bp, Mus musculus
tgacggtttgagctctcgtgcccgc

SEQ ID NO: 797989 - DNA, 25 bp, Mus musculus
tgacggtttgaggtctcgtgcccgc

SEQ ID NO: 797990 - DNA, 25 bp, Mus musculus
tgacgtaagtggcaagtaaatatat

SEQ ID NO: 797991 - DNA, 25 bp, Mus musculus
tgacgtaagtgggaagtaaatatat

SEQ ID NO: 797992 - DNA, 25 bp, Mus musculus
tgacgtagccaaaggtaacgctgct

SEQ ID NO: 797993 - DNA, 25 bp, Mus musculus
tgacgtagccaatggtaacgctgct

SEQ ID NO: 797994 - DNA, 25 bp, Mus musculus
tgacgtatgacacgactgacgaggc

SEQ ID NO: 797995 - DNA, 25 bp, Mus musculus
tgacgtatgacaggactgacgaggc

SEQ ID NO: 797996 - DNA, 25 bp, Mus musculus
tgacgtatgccccattcacgctttt

SEQ ID NO: 797997 - DNA, 25 bp, Mus musculus
tgacgtatgcccgattcacgctttt

SEQ ID NO: 797998 - DNA, 25 bp, Mus musculus
tgacgtcaactgagtcccctgtaag

SEQ ID NO: 797999 - DNA, 25 bp, Mus musculus
tgacgtcaactgtgtcccctgtaag

SEQ ID NO: 798000 - DNA, 25 bp, Mus musculus
tgacgtcacagaacccaaaagaatt

SEQ ID NO: 798001 - DNA, 25 bp, Mus musculus
tgacgtcacagatcccaaaagaatt

SEQ ID NO: 798002 - DNA, 25 bp, Mus musculus
tgacgtcatcatcaagaacaacctg

SEQ ID NO: 798003 - DNA, 25 bp, Mus musculus
tgacgtcatcatgaagaacaacctg

SEQ ID NO: 798004 - DNA, 25 bp, Mus musculus
tgacgtcatcgtccgtgtggtgccc

SEQ ID NO: 798005 - DNA, 25 bp, Mus musculus
tgacgtcatcgtgcgtgtggtgccc

SEQ ID NO: 798006 - DNA, 25 bp, Mus musculus
tgacgtccaggaaatagcaacagag

SEQ ID NO: 798007 - DNA, 25 bp, Mus musculus
tgacgtccaggatatagcaacagag

SEQ ID NO: 798008 - DNA, 25 bp, Mus musculus
tgacgtcccctgcatcagcattctt

SEQ ID NO: 798009 - DNA, 25 bp, Mus musculus
tgacgtcccctggatcagcattctt

SEQ ID NO: 798010 - DNA, 25 bp, Mus musculus
tgacgtccgttgcaccatgaaggcg

SEQ ID NO: 798011 - DNA, 25 bp, Mus musculus
tgacgtccgttggaccatgaaggcg

SEQ ID NO: 798012 - DNA, 25 bp, Mus musculus
tgacgtctgatgacgagagctggaa

SEQ ID NO: 798013 - DNA, 25 bp, Mus musculus
tgacgtctgatgtcgagagctggaa

SEQ ID NO: 798014 - DNA, 25 bp, Mus musculus
tgacgtcttcaccaggctctttcag

SEQ ID NO: 798015 - DNA, 25 bp, Mus musculus
tgacgtcttcacgaggctctttcag

SEQ ID NO: 798016 - DNA, 25 bp, Mus musculus
tgacgtctttgtcattgaagagtgg

SEQ ID NO: 798017 - DNA, 25 bp, Mus musculus
tgacgtctttgtgattgaagagtgg

SEQ ID NO: 798018 - DNA, 25 bp, Mus musculus
tgacgtgaaacgaagagaagcaatc

SEQ ID NO: 798019 - DNA, 25 bp, Mus musculus
tgacgtgaaacgtagagaagcaatc

SEQ ID NO: 798020 - DNA, 25 bp, Mus musculus
tgacgtgacaaacgtgaaatacccg

SEQ ID NO: 798021 - DNA, 25 bp, Mus musculus
tgacgtgacaaaggtgaaatacccg

SEQ ID NO: 798022 - DNA, 25 bp, Mus musculus
tgacgtgactccacctgagctcgtg

SEQ ID NO: 798023 - DNA, 25 bp, Mus musculus
tgacgtgactcctcctgagctcgtg

SEQ ID NO: 798024 - DNA, 25 bp, Mus musculus
tgacgtgcgattagtgattcatgca

SEQ ID NO: 798025 - DNA, 25 bp, Mus musculus
tgacgtgcgatttgtgattcatgca

SEQ ID NO: 798026 - DNA, 25 bp, Mus musculus
tgacgtggatgtccagaagatagta

SEQ ID NO: 798027 - DNA, 25 bp, Mus musculus
tgacgtggatgtgcagaagatagta

SEQ ID NO: 798028 - DNA, 25 bp, Mus musculus
tgacgtggcactcaaacagctgcga

SEQ ID NO: 798029 - DNA, 25 bp, Mus musculus
tgacgtggcactgaaacagctgcga

SEQ ID NO: 798030 - DNA, 25 bp, Mus musculus
tgacgtggctggctctccagctgtc

SEQ ID NO: 798031 - DNA, 25 bp, Mus musculus
tgacgtggctgggtctccagctgtc

SEQ ID NO: 798032 - DNA, 25 bp, Mus musculus
tgacgtggctttctaaacccgagag

SEQ ID NO: 798033 - DNA, 25 bp, Mus musculus
tgacgtggctttgtaaacccgagag

SEQ ID NO: 798034 - DNA, 25 bp, Mus musculus
tgacgtggtggaccagatttacaag

SEQ ID NO: 798035 - DNA, 25 bp, Mus musculus
tgacgtggtggagcagatttacaag

SEQ ID NO: 798036 - DNA, 25 bp, Mus musculus
tgacgtgtcccactatcatgtcaat

SEQ ID NO: 798037 - DNA, 25 bp, Mus musculus
tgacgtgtcccagtatcatgtcaat

SEQ ID NO: 798038 - DNA, 25 bp, Mus musculus
tgacgtgtgacccaaccaagaagaa

SEQ ID NO: 798039 - DNA, 25 bp, Mus musculus
tgacgtgtgaccgaaccaagaagaa

SEQ ID NO: 798040 - DNA, 25 bp, Mus musculus
tgacgtgtggcaattagagacggca

SEQ ID NO: 798041 - DNA, 25 bp, Mus musculus
tgacgtgtggcatttagagacggca

SEQ ID NO: 798042 - DNA, 25 bp, Mus musculus
tgacgttcacccagcatcctggaac

SEQ ID NO: 798043 - DNA, 25 bp, Mus musculus
tgacgttcaccctgcatcctggaac

SEQ ID NO: 798044 - DNA, 25 bp, Mus musculus
tgacgttcgcttagccaacatgctg

SEQ ID NO: 798045 - DNA, 25 bp, Mus musculus
tgacgttcgctttgccaacatgctg

SEQ ID NO: 798046 - DNA, 25 bp, Mus musculus
tgacgttcttccctaacctgatggg

SEQ ID NO: 798047 - DNA, 25 bp, Mus musculus
tgacgttcttccgtaacctgatggg

SEQ ID NO: 798048 - DNA, 25 bp, Mus musculus
tgacgtttcgtcagaagagagaaac

SEQ ID NO: 798049 - DNA, 25 bp, Mus musculus
tgacgtttcgtctgaagagagaaac

SEQ ID NO: 798050 - DNA, 25 bp, Mus musculus
tgacgtttctgacgacagcgctcgg

SEQ ID NO: 798051 - DNA, 25 bp, Mus musculus
tgacgtttctgaggacagcgctcgg

SEQ ID NO: 798052 - DNA, 25 bp, Mus musculus
tgactaaaaaacagaattgtgcctt

SEQ ID NO: 798053 - DNA, 25 bp, Mus musculus
tgactaaaaaactgaattgtgcctt

SEQ ID NO: 798054 - DNA, 25 bp, Mus musculus
tgactaaatcagatgaagaacggac

SEQ ID NO: 798055 - DNA, 25 bp, Mus musculus
tgactaaatcagttgaagaacggac

SEQ ID NO: 798056 - DNA, 25 bp, Mus musculus
tgactaacgatgaataccccatccc

SEQ ID NO: 798057 - DNA, 25 bp, Mus musculus
tgactaacgatgtataccccatccc

SEQ ID NO: 798058 - DNA, 25 bp, Mus musculus
tgactaagaacaacggacacaacct

SEQ ID NO: 798059 - DNA, 25 bp, Mus musculus
tgactaagaacatcggacacaacct

SEQ ID NO: 798060 - DNA, 25 bp, Mus musculus
tgactaagaagtccttgccaggtgg

SEQ ID NO: 798061 - DNA, 25 bp, Mus musculus
tgactaagaagtgcttgccaggtgg

SEQ ID NO: 798062 - DNA, 25 bp, Mus musculus
tgactaagagaacaaaccactggtc

SEQ ID NO: 798063 - DNA, 25 bp, Mus musculus
tgactaagagaagaaaccactggtc

SEQ ID NO: 798064 - DNA, 25 bp, Mus musculus
tgactaaggcagaaccagggaaatc

SEQ ID NO: 798065 - DNA, 25 bp, Mus musculus
tgactaaggcagtaccagggaaatc

SEQ ID NO: 798066 - DNA, 25 bp, Mus musculus
tgactaataaccatcagggccacgc

SEQ ID NO: 798067 - DNA, 25 bp, Mus musculus
tgactaataaccttcagggccacgc

SEQ ID NO: 798068 - DNA, 25 bp, Mus musculus
tgactacaagctcgacttccgaagg

SEQ ID NO: 798069 - DNA, 25 bp, Mus musculus
tgactacaagctggacttccgaagg

SEQ ID NO: 798070 - DNA, 25 bp, Mus musculus
tgactacaccgacaacgtgggctgt

SEQ ID NO: 798071 - DNA, 25 bp, Mus musculus
tgactacaccgagaacgtgggctgt

SEQ ID NO: 798072 - DNA, 25 bp, Mus musculus
tgactacactcacgacctgtatgtc

SEQ ID NO: 798073 - DNA, 25 bp, Mus musculus
tgactacactcaggacctgtatgtc

SEQ ID NO: 798074 - DNA, 25 bp, Mus musculus
tgactacagcatctggcggaagaat

SEQ ID NO: 798075 - DNA, 25 bp, Mus musculus
tgactacagcatgtggcggaagaat

SEQ ID NO: 798076 - DNA, 25 bp, Mus musculus
tgactacatcgtccctcggcactgt

SEQ ID NO: 798077 - DNA, 25 bp, Mus musculus
tgactacatcgtgcctcggcactgt

SEQ ID NO: 798078 - DNA, 25 bp, Mus musculus
tgactaccagggctcgcttgatgag

SEQ ID NO: 798079 - DNA, 25 bp, Mus musculus
tgactaccaggggtcgcttgatgag

SEQ ID NO: 798080 - DNA, 25 bp, Mus musculus
tgactaccagtactagacatctcag

SEQ ID NO: 798081 - DNA, 25 bp, Mus musculus
tgactaccagtagtagacatctcag

SEQ ID NO: 798082 - DNA, 25 bp, Mus musculus
tgactaccatctaccagaagtacct

SEQ ID NO: 798083 - DNA, 25 bp, Mus musculus
tgactaccatcttccagaagtacct

SEQ ID NO: 798084 - DNA, 25 bp, Mus musculus
tgactacccaagctctctcatcgga

SEQ ID NO: 798085 - DNA, 25 bp, Mus musculus
tgactacccaaggtctctcatcgga

SEQ ID NO: 798086 - DNA, 25 bp, Mus musculus
tgactaccgagaaagccagttcacc

SEQ ID NO: 798087 - DNA, 25 bp, Mus musculus
tgactaccgagatagccagttcacc

SEQ ID NO: 798088 - DNA, 25 bp, Mus musculus
tgactaccggaccaaggtgctttcc

SEQ ID NO: 798089 - DNA, 25 bp, Mus musculus
tgactaccggacgaaggtgctttcc

SEQ ID NO: 798090 - DNA, 25 bp, Mus musculus
tgactaccgggaagcacaggagttt

SEQ ID NO: 798091 - DNA, 25 bp, Mus musculus
tgactaccgggatgcacaggagttt

SEQ ID NO: 798092 - DNA, 25 bp, Mus musculus
tgactacgagaaagtcacctccatc

SEQ ID NO: 798093 - DNA, 25 bp, Mus musculus
tgactacgagaatgtcacctccatc

SEQ ID NO: 798094 - DNA, 25 bp, Mus musculus
tgactacgccttcctgggtacagca

SEQ ID NO: 798095 - DNA, 25 bp, Mus musculus
tgactacgccttgctgggtacagca

SEQ ID NO: 798096 - DNA, 25 bp, Mus musculus
tgactacgcgatactgtctgagtgg

SEQ ID NO: 798097 - DNA, 25 bp, Mus musculus
tgactacgcgattctgtctgagtgg

SEQ ID NO: 798098 - DNA, 25 bp, Mus musculus
tgactacggcaacctcaccaaaggc

SEQ ID NO: 798099 - DNA, 25 bp, Mus musculus
tgactacggcaagctcaccaaaggc

SEQ ID NO: 798100 - DNA, 25 bp, Mus musculus
tgactactacatcgagcgtgccctg

SEQ ID NO: 798101 - DNA, 25 bp, Mus musculus
tgactactacatggagcgtgccctg

SEQ ID NO: 798102 - DNA, 25 bp, Mus musculus
tgactactaccgatacttggccgag

SEQ ID NO: 798103 - DNA, 25 bp, Mus musculus
tgactactaccgttacttggccgag

SEQ ID NO: 798104 - DNA, 25 bp, Mus musculus
tgactactatgcagctagtggtgta

SEQ ID NO: 798105 - DNA, 25 bp, Mus musculus
tgactactatgctgctagtggtgta

SEQ ID NO: 798106 - DNA, 25 bp, Mus musculus
tgactactatttcccaggaggccag

SEQ ID NO: 798107 - DNA, 25 bp, Mus musculus
tgactactatttgccaggaggccag

SEQ ID NO: 798108 - DNA, 25 bp, Mus musculus
tgactactcttcaagaggacttggg

SEQ ID NO: 798109 - DNA, 25 bp, Mus musculus
tgactactcttctagaggacttggg

SEQ ID NO: 798110 - DNA, 25 bp, Mus musculus
tgactactgatcaaactgtctgtat

SEQ ID NO: 798111 - DNA, 25 bp, Mus musculus
tgactactgatctaactgtctgtat

SEQ ID NO: 798112 - DNA, 25 bp, Mus musculus
tgactactgtggctcactcaatgag

SEQ ID NO: 798113 - DNA, 25 bp, Mus musculus
tgactactgtgggtcactcaatgag

SEQ ID NO: 798114 - DNA, 25 bp, Mus musculus
tgactacttcacatgcataactaaa

SEQ ID NO: 798115 - DNA, 25 bp, Mus musculus
tgactacttcacttgcataactaaa

SEQ ID NO: 798116 - DNA, 25 bp, Mus musculus
tgactaggacccatgatgtcttgaa

SEQ ID NO: 798117 - DNA, 25 bp, Mus musculus
tgactaggacccttgatgtcttgaa

SEQ ID NO: 798118 - DNA, 25 bp, Mus musculus
tgactagtatctaaccccagacctg

SEQ ID NO: 798119 - DNA, 25 bp, Mus musculus
tgactagtatcttaccccagacctg

SEQ ID NO: 798120 - DNA, 25 bp, Mus musculus
tgactagtgtagaggaagaacacac

SEQ ID NO: 798121 - DNA, 25 bp, Mus musculus
tgactagtgtagtggaagaacacac

SEQ ID NO: 798122 - DNA, 25 bp, Mus musculus
tgactataagtacaagccaaggcct

SEQ ID NO: 798123 - DNA, 25 bp, Mus musculus
tgactataagtagaagccaaggcct

SEQ ID NO: 798124 - DNA, 25 bp, Mus musculus
tgactatacaaaacaccctgcaaaa

SEQ ID NO: 798125 - DNA, 25 bp, Mus musculus
tgactatacaaatcaccctgcaaaa

SEQ ID NO: 798126 - DNA, 25 bp, Mus musculus
tgactatacagccacgctgtctctg

SEQ ID NO: 798127 - DNA, 25 bp, Mus musculus
tgactatacagcgacgctgtctctg

SEQ ID NO: 798128 - DNA, 25 bp, Mus musculus
tgactatacggaaaatgtgctgaca

SEQ ID NO: 798129 - DNA, 25 bp, Mus musculus
tgactatacggataatgtgctgaca

SEQ ID NO: 798130 - DNA, 25 bp, Mus musculus
tgactatagttgctgtaaagctctg

SEQ ID NO: 798131 - DNA, 25 bp, Mus musculus
tgactatagttggtgtaaagctctg

SEQ ID NO: 798132 - DNA, 25 bp, Mus musculus
tgactatataaacagacgccgggcg

SEQ ID NO: 798133 - DNA, 25 bp, Mus musculus
tgactatataaagagacgccgggcg

SEQ ID NO: 798134 - DNA, 25 bp, Mus musculus
tgactatcctggaaatcaggtaccc

SEQ ID NO: 798135 - DNA, 25 bp, Mus musculus
tgactatcctggtaatcaggtaccc

SEQ ID NO: 798136 - DNA, 25 bp, Mus musculus
tgactatctttcagggcaaagagcc

SEQ ID NO: 798137 - DNA, 25 bp, Mus musculus
tgactatctttctgggcaaagagcc

SEQ ID NO: 798138 - DNA, 25 bp, Mus musculus
tgactatgaagccatgagctttgtc

SEQ ID NO: 798139 - DNA, 25 bp, Mus musculus
tgactatgaagcgatgagctttgtc

SEQ ID NO: 798140 - DNA, 25 bp, Mus musculus
tgactatgaaggacaactgactcca

SEQ ID NO: 798141 - DNA, 25 bp, Mus musculus
tgactatgaaggtcaactgactcca

SEQ ID NO: 798142 - DNA, 25 bp, Mus musculus
tgactatgacccctacgcggtggaa

SEQ ID NO: 798143 - DNA, 25 bp, Mus musculus
tgactatgacccgtacgcggtggaa

SEQ ID NO: 798144 - DNA, 25 bp, Mus musculus
tgactatgaggccacccggatagag

SEQ ID NO: 798145 - DNA, 25 bp, Mus musculus
tgactatgaggcgacccggatagag

SEQ ID NO: 798146 - DNA, 25 bp, Mus musculus
tgactatgatagatttccggcttta

SEQ ID NO: 798147 - DNA, 25 bp, Mus musculus
tgactatgatagttttccggcttta

SEQ ID NO: 798148 - DNA, 25 bp, Mus musculus
tgactatgcagacccaagctgtgcg

SEQ ID NO: 798149 - DNA, 25 bp, Mus musculus
tgactatgcagagccaagctgtgcg

SEQ ID NO: 798150 - DNA, 25 bp, Mus musculus
tgactatgcggccaccctgtctctg

SEQ ID NO: 798151 - DNA, 25 bp, Mus musculus
tgactatgcggcgaccctgtctctg

SEQ ID NO: 798152 - DNA, 25 bp, Mus musculus
tgactatgctggattcatcttcggc

SEQ ID NO: 798153 - DNA, 25 bp, Mus musculus
tgactatgctggtttcatcttcggc

SEQ ID NO: 798154 - DNA, 25 bp, Mus musculus
tgactatgggtcaggttcgggctcc

SEQ ID NO: 798155 - DNA, 25 bp, Mus musculus
tgactatgggtctggttcgggctcc

SEQ ID NO: 798156 - DNA, 25 bp, Mus musculus
tgactatttaaacagtacctttcgg

SEQ ID NO: 798157 - DNA, 25 bp, Mus musculus
tgactatttaaagagtacctttcgg

SEQ ID NO: 798158 - DNA, 25 bp, Mus musculus
tgactatttggtagcacatggaaga

SEQ ID NO: 798159 - DNA, 25 bp, Mus musculus
tgactatttggttgcacatggaaga

SEQ ID NO: 798160 - DNA, 25 bp, Mus musculus
tgactattttaaaattgggcaaagt

SEQ ID NO: 798161 - DNA, 25 bp, Mus musculus
tgactattttaatattgggcaaagt

SEQ ID NO: 798162 - DNA, 25 bp, Mus musculus
tgactcaaaaggactaatagttaag

SEQ ID NO: 798163 - DNA, 25 bp, Mus musculus
tgactcaaaaggtctaatagttaag

SEQ ID NO: 798164 - DNA, 25 bp, Mus musculus
tgactcaaatgaatccatctccagc

SEQ ID NO: 798165 - DNA, 25 bp, Mus musculus
tgactcaaatgattccatctccagc

SEQ ID NO: 798166 - DNA, 25 bp, Mus musculus
tgactcaactcactataaagagacc

SEQ ID NO: 798167 - DNA, 25 bp, Mus musculus
tgactcaactcagtataaagagacc

SEQ ID NO: 798168 - DNA, 25 bp, Mus musculus
tgactcacatcaaagctgggtgcat

SEQ ID NO: 798169 - DNA, 25 bp, Mus musculus
tgactcacatcatagctgggtgcat

SEQ ID NO: 798170 - DNA, 25 bp, Mus musculus
tgactcaccaccagcgcttgagaaa

SEQ ID NO: 798171 - DNA, 25 bp, Mus musculus
tgactcaccacctgcgcttgagaaa

SEQ ID NO: 798172 - DNA, 25 bp, Mus musculus
tgactcactcttcctggaactacct

SEQ ID NO: 798173 - DNA, 25 bp, Mus musculus
tgactcactcttgctggaactacct

SEQ ID NO: 798174 - DNA, 25 bp, Mus musculus
tgactcagacgtcgtggaaaacaat

SEQ ID NO: 798175 - DNA, 25 bp, Mus musculus
tgactcagacgtggtggaaaacaat

SEQ ID NO: 798176 - DNA, 25 bp, Mus musculus
tgactcagatctatagtgaccctga

SEQ ID NO: 798177 - DNA, 25 bp, Mus musculus
tgactcagatctttagtgaccctga

SEQ ID NO: 798178 - DNA, 25 bp, Mus musculus
tgactcagcaagaaacgcgcttctg

SEQ ID NO: 798179 - DNA, 25 bp, Mus musculus
tgactcagcaagtaacgcgcttctg

SEQ ID NO: 798180 - DNA, 25 bp, Mus musculus
tgactcagcagcacaaggccttctg

SEQ ID NO: 798181 - DNA, 25 bp, Mus musculus
tgactcagcagcagtccaagtctca

SEQ ID NO: 798182 - DNA, 25 bp, Mus musculus
tgactcagcagctcaaggccttctg

SEQ ID NO: 798183 - DNA, 25 bp, Mus musculus
tgactcagcagctgtccaagtctca

SEQ ID NO: 798184 - DNA, 25 bp, Mus musculus
tgactcagcggaacaccaaataccc

SEQ ID NO: 798185 - DNA, 25 bp, Mus musculus
tgactcagcggatcaccaaataccc

SEQ ID NO: 798186 - DNA, 25 bp, Mus musculus
tgactcagctcaaccctaagaccaa

SEQ ID NO: 798187 - DNA, 25 bp, Mus musculus
tgactcagctcatccctaagaccaa

SEQ ID NO: 798188 - DNA, 25 bp, Mus musculus
tgactcagctgcctgtcggcgtgac

SEQ ID NO: 798189 - DNA, 25 bp, Mus musculus
tgactcagctgcgtgtcggcgtgac

SEQ ID NO: 798190 - DNA, 25 bp, Mus musculus
tgactcagctgtaagaagcacggat

SEQ ID NO: 798191 - DNA, 25 bp, Mus musculus
tgactcagctgtcattgagggacct

SEQ ID NO: 798192 - DNA, 25 bp, Mus musculus
tgactcagctgtgattgagggacct

SEQ ID NO: 798193 - DNA, 25 bp, Mus musculus
tgactcagctgttagaagcacggat

SEQ ID NO: 798194 - DNA, 25 bp, Mus musculus
tgactcagggcaaccagatgaacgg

SEQ ID NO: 798195 - DNA, 25 bp, Mus musculus
tgactcagggcatccagatgaacgg

SEQ ID NO: 798196 - DNA, 25 bp, Mus musculus
tgactcagggccacctggagagaaa

SEQ ID NO: 798197 - DNA, 25 bp, Mus musculus
tgactcagggcctcctggagagaaa

SEQ ID NO: 798198 - DNA, 25 bp, Mus musculus
tgactcatagggatggagaccccat

SEQ ID NO: 798199 - DNA, 25 bp, Mus musculus
tgactcatagggttggagaccccat

SEQ ID NO: 798200 - DNA, 25 bp, Mus musculus
tgactcatcgtcaggagaggagaac

SEQ ID NO: 798201 - DNA, 25 bp, Mus musculus
tgactcatcgtctggagaggagaac

SEQ ID NO: 798202 - DNA, 25 bp, Mus musculus
tgactcatgttcatcccgcatggtg

SEQ ID NO: 798203 - DNA, 25 bp, Mus musculus
tgactcatgttcttcccgcatggtg

SEQ ID NO: 798204 - DNA, 25 bp, Mus musculus
tgactccaagcaaatggccccagga

SEQ ID NO: 798205 - DNA, 25 bp, Mus musculus
tgactccaagcatatggccccagga

SEQ ID NO: 798206 - DNA, 25 bp, Mus musculus
tgactccactagctgcgctcagcgt

SEQ ID NO: 798207 - DNA, 25 bp, Mus musculus
tgactccactaggtgcgctcagcgt

SEQ ID NO: 798208 - DNA, 25 bp, Mus musculus
tgactccatcttatggtccctgcag

SEQ ID NO: 798209 - DNA, 25 bp, Mus musculus
tgactccatcttttggtccctgcag

SEQ ID NO: 798210 - DNA, 25 bp, Mus musculus
tgactccatgagagtcaacctcacc

SEQ ID NO: 798211 - DNA, 25 bp, Mus musculus
tgactccatgagtgtcaacctcacc

SEQ ID NO: 798212 - DNA, 25 bp, Mus musculus
tgactcccaagtagccatagcaaca

SEQ ID NO: 798213 - DNA, 25 bp, Mus musculus
tgactcccaagttgccatagcaaca

SEQ ID NO: 798214 - DNA, 25 bp, Mus musculus
tgactcccgaatccatgtctgcttg

SEQ ID NO: 798215 - DNA, 25 bp, Mus musculus
tgactcccgaatgcatgtctgcttg

SEQ ID NO: 798216 - DNA, 25 bp, Mus musculus
tgactcccgtctctacttcaactgg

SEQ ID NO: 798217 - DNA, 25 bp, Mus musculus
tgactcccgtctgtacttcaactgg

SEQ ID NO: 798218 - DNA, 25 bp, Mus musculus
tgactccctgccaaccagctgtgga

SEQ ID NO: 798219 - DNA, 25 bp, Mus musculus
tgactccctgcctaccagctgtgga

SEQ ID NO: 798220 - DNA, 25 bp, Mus musculus
tgactccgaacacgaagaggacgag

SEQ ID NO: 798221 - DNA, 25 bp, Mus musculus
tgactccgaacaggaagaggacgag

SEQ ID NO: 798222 - DNA, 25 bp, Mus musculus
tgactccgccggctagtgagtacac

SEQ ID NO: 798223 - DNA, 25 bp, Mus musculus
tgactccgccgggtagtgagtacac

SEQ ID NO: 798224 - DNA, 25 bp, Mus musculus
tgactccgcgggactgcggcgtcat

SEQ ID NO: 798225 - DNA, 25 bp, Mus musculus
tgactccgcgggtctgcggcgtcat

SEQ ID NO: 798226 - DNA, 25 bp, Mus musculus
tgactccggcatccggttgaacacc

SEQ ID NO: 798227 - DNA, 25 bp, Mus musculus
tgactccggcatgcggttgaacacc

SEQ ID NO: 798228 - DNA, 25 bp, Mus musculus
tgactcctatccagttgtgaagaag

SEQ ID NO: 798229 - DNA, 25 bp, Mus musculus
tgactcctatcctgttgtgaagaag

SEQ ID NO: 798230 - DNA, 25 bp, Mus musculus
tgactcctatggataccaggcgccg

SEQ ID NO: 798231 - DNA, 25 bp, Mus musculus
tgactcctatggttaccaggcgccg

SEQ ID NO: 798232 - DNA, 25 bp, Mus musculus
tgactcctcggactatcccggcaat

SEQ ID NO: 798233 - DNA, 25 bp, Mus musculus
tgactcctcggagtatcccggcaat

SEQ ID NO: 798234 - DNA, 25 bp, Mus musculus
tgactcctggaacatgcacttgccc

SEQ ID NO: 798235 - DNA, 25 bp, Mus musculus
tgactcctggaagatgcacttgccc

SEQ ID NO: 798236 - DNA, 25 bp, Mus musculus
tgactcctttcgcaagtgggctagg
